United States Patent 11,369,692 (MATERIALS AND METHODS FOR TREATMENT OF DUCHENNE MUSCULAR DYSTROPHY) - sequence listing, part 30

SEQ ID NO: 991070 - DNA, 22 bp, Artificial Sequence
  chemically synthesized
tcttttcccttgattttacaat

SEQ ID NO: 991071 - DNA, 22 bp, Artificial Sequence
  chemically synthesized
ttttcttttcccttgattttac

SEQ ID NO: 991072 - DNA, 22 bp, Artificial Sequence
  chemically synthesized
aaactattttcttttcccttga

SEQ ID NO: 991073 - DNA, 22 bp, Artificial Sequence
  chemically synthesized
aaattgtaaaatcaagggaaaa

SEQ ID NO: 991074 - DNA, 22 bp, Artificial Sequence
  chemically synthesized
aaaactattttcttttcccttg

SEQ ID NO: 991075 - DNA, 22 bp, Artificial Sequence
  chemically synthesized
taaaatcaagggaaaagaaaat

SEQ ID NO: 991076 - DNA, 22 bp, Artificial Sequence
  chemically synthesized
cccaaaatatttaaaactattt

SEQ ID NO: 991077 - DNA, 22 bp, Artificial Sequence
  chemically synthesized
gcccaaaatatttaaaactatt

SEQ ID NO: 991078 - DNA, 22 bp, Artificial Sequence
  chemically synthesized
tgcccaaaatatttaaaactat

SEQ ID NO: 991079 - DNA, 22 bp, Artificial Sequence
  chemically synthesized
agaagattttgcccaaaatatt

SEQ ID NO: 991080 - DNA, 22 bp, Artificial Sequence
  chemically synthesized
aagaagattttgcccaaaatat

SEQ ID NO: 991081 - DNA, 22 bp, Artificial Sequence
  chemically synthesized
ttaagaagattttgcccaaaat

SEQ ID NO: 991082 - DNA, 22 bp, Artificial Sequence
  chemically synthesized
cttaagaagattttgcccaaaa

SEQ ID NO: 991083 - DNA, 22 bp, Artificial Sequence
  chemically synthesized
tcttaagaagattttgcccaaa

SEQ ID NO: 991084 - DNA, 22 bp, Artificial Sequence
  chemically synthesized
ttcttaagaagattttgcccaa

SEQ ID NO: 991085 - DNA, 22 bp, Artificial Sequence
  chemically synthesized
tttcttaagaagattttgccca

SEQ ID NO: 991086 - DNA, 22 bp, Artificial Sequence
  chemically synthesized
tttttcttaagaagattttgcc

SEQ ID NO: 991087 - DNA, 22 bp, Artificial Sequence
  chemically synthesized
taaatattttgggcaaaatctt

SEQ ID NO: 991088 - DNA, 22 bp, Artificial Sequence
  chemically synthesized
aaatattttgggcaaaatcttc

SEQ ID NO: 991089 - DNA, 22 bp, Artificial Sequence
  chemically synthesized
aatattttgggcaaaatcttct

SEQ ID NO: 991090 - DNA, 22 bp, Artificial Sequence
  chemically synthesized
tgggcaaaatcttcttaagaaa

SEQ ID NO: 991091 - DNA, 22 bp, Artificial Sequence
  chemically synthesized
gggcaaaatcttcttaagaaaa

SEQ ID NO: 991092 - DNA, 22 bp, Artificial Sequence
  chemically synthesized
ggcaaaatcttcttaagaaaaa

SEQ ID NO: 991093 - DNA, 22 bp, Artificial Sequence
  chemically synthesized
gaaataggacattctttttctt

SEQ ID NO: 991094 - DNA, 22 bp, Artificial Sequence
  chemically synthesized
cttaagaaaaagaatgtcctat

SEQ ID NO: 991095 - DNA, 22 bp, Artificial Sequence
  chemically synthesized
ttaagaaaaagaatgtcctatt

SEQ ID NO: 991096 - DNA, 22 bp, Artificial Sequence
  chemically synthesized
aagaaaaagaatgtcctatttc

SEQ ID NO: 991097 - DNA, 22 bp, Artificial Sequence
  chemically synthesized
agaaaaagaatgtcctatttcc

SEQ ID NO: 991098 - DNA, 22 bp, Artificial Sequence
  chemically synthesized
aacgtgccagagtcattggaaa

SEQ ID NO: 991099 - DNA, 22 bp, Artificial Sequence
  chemically synthesized
aaacgtgccagagtcattggaa

SEQ ID NO: 991100 - DNA, 22 bp, Artificial Sequence
  chemically synthesized
tgtttaaacgtgccagagtcat

SEQ ID NO: 991101 - DNA, 22 bp, Artificial Sequence
  chemically synthesized
ctatgtttaaacgtgccagagt

SEQ ID NO: 991102 - DNA, 22 bp, Artificial Sequence
  chemically synthesized
cctatgtttaaacgtgccagag

SEQ ID NO: 991103 - DNA, 22 bp, Artificial Sequence
  chemically synthesized
tcctatgtttaaacgtgccaga

SEQ ID NO: 991104 - DNA, 22 bp, Artificial Sequence
  chemically synthesized
tttccaatgactctggcacgtt

SEQ ID NO: 991105 - DNA, 22 bp, Artificial Sequence
  chemically synthesized
tttcctatgtttaaacgtgcca

SEQ ID NO: 991106 - DNA, 22 bp, Artificial Sequence
  chemically synthesized
ccaatgactctggcacgtttaa

SEQ ID NO: 991107 - DNA, 22 bp, Artificial Sequence
  chemically synthesized
caatgactctggcacgtttaaa

SEQ ID NO: 991108 - DNA, 22 bp, Artificial Sequence
  chemically synthesized
attctttcctatgtttaaacgt

SEQ ID NO: 991109 - DNA, 22 bp, Artificial Sequence
  chemically synthesized
taattctttcctatgtttaaac

SEQ ID NO: 991110 - DNA, 22 bp, Artificial Sequence
  chemically synthesized
ctaattctttcctatgtttaaa

SEQ ID NO: 991111 - DNA, 22 bp, Artificial Sequence
  chemically synthesized
tctaattctttcctatgtttaa

SEQ ID NO: 991112 - DNA, 22 bp, Artificial Sequence
  chemically synthesized
ttctaattctttcctatgttta

SEQ ID NO: 991113 - DNA, 22 bp, Artificial Sequence
  chemically synthesized
tggcacgtttaaacataggaaa

SEQ ID NO: 991114 - DNA, 22 bp, Artificial Sequence
  chemically synthesized
tttttctaattctttcctatgt

SEQ ID NO: 991115 - DNA, 22 bp, Artificial Sequence
  chemically synthesized
gcacgtttaaacataggaaaga

SEQ ID NO: 991116 - DNA, 22 bp, Artificial Sequence
  chemically synthesized
aaattgtttttctaattctttc

SEQ ID NO: 991117 - DNA, 22 bp, Artificial Sequence
  chemically synthesized
aaacataggaaagaattagaaa

SEQ ID NO: 991118 - DNA, 22 bp, Artificial Sequence
  chemically synthesized
aacataggaaagaattagaaaa

SEQ ID NO: 991119 - DNA, 22 bp, Artificial Sequence
  chemically synthesized
aagggtccaaaatatactaaaa

SEQ ID NO: 991120 - DNA, 22 bp, Artificial Sequence
  chemically synthesized
aaagggtccaaaatatactaaa

SEQ ID NO: 991121 - DNA, 22 bp, Artificial Sequence
  chemically synthesized
taaagggtccaaaatatactaa

SEQ ID NO: 991122 - DNA, 22 bp, Artificial Sequence
  chemically synthesized
gaaaaacaattttagtatattt

SEQ ID NO: 991123 - DNA, 22 bp, Artificial Sequence
  chemically synthesized
aattttaaagggtccaaaatat

SEQ ID NO: 991124 - DNA, 22 bp, Artificial Sequence
  chemically synthesized
aaattttaaagggtccaaaata

SEQ ID NO: 991125 - DNA, 22 bp, Artificial Sequence
  chemically synthesized
cttaaattttaaagggtccaaa

SEQ ID NO: 991126 - DNA, 22 bp, Artificial Sequence
  chemically synthesized
acttaaattttaaagggtccaa

SEQ ID NO: 991127 - DNA, 22 bp, Artificial Sequence
  chemically synthesized
tacttaaattttaaagggtcca

SEQ ID NO: 991128 - DNA, 22 bp, Artificial Sequence
  chemically synthesized
tagtatattttggaccctttaa

SEQ ID NO: 991129 - DNA, 22 bp, Artificial Sequence
  chemically synthesized
agtatattttggaccctttaaa

SEQ ID NO: 991130 - DNA, 22 bp, Artificial Sequence
  chemically synthesized
gtatattttggaccctttaaaa

SEQ ID NO: 991131 - DNA, 22 bp, Artificial Sequence
  chemically synthesized
atgttttacttaaattttaaag

SEQ ID NO: 991132 - DNA, 22 bp, Artificial Sequence
  chemically synthesized
aatgttttacttaaattttaaa

SEQ ID NO: 991133 - DNA, 22 bp, Artificial Sequence
  chemically synthesized
tggaccctttaaaatttaagta

SEQ ID NO: 991134 - DNA, 22 bp, Artificial Sequence
  chemically synthesized
ggaccctttaaaatttaagtaa

SEQ ID NO: 991135 - DNA, 22 bp, Artificial Sequence
  chemically synthesized
gaccctttaaaatttaagtaaa

SEQ ID NO: 991136 - DNA, 22 bp, Artificial Sequence
  chemically synthesized
taaaatttaagtaaaacattaa

SEQ ID NO: 991137 - DNA, 22 bp, Artificial Sequence
  chemically synthesized
aaaatttaagtaaaacattaag

SEQ ID NO: 991138 - DNA, 22 bp, Artificial Sequence
  chemically synthesized
aaatttaagtaaaacattaaga

SEQ ID NO: 991139 - DNA, 22 bp, Artificial Sequence
  chemically synthesized
aagtaaaacattaagatgtatt

SEQ ID NO: 991140 - DNA, 22 bp, Artificial Sequence
  chemically synthesized
agtaaaacattaagatgtattt

SEQ ID NO: 991141 - DNA, 22 bp, Artificial Sequence
  chemically synthesized
aaagtaaaggtataaaatacat

SEQ ID NO: 991142 - DNA, 22 bp, Artificial Sequence
  chemically synthesized
agatgtattttatacctttact

SEQ ID NO: 991143 - DNA, 22 bp, Artificial Sequence
  chemically synthesized
tcacatattcaaagtaaaggta

SEQ ID NO: 991144 - DNA, 22 bp, Artificial Sequence
  chemically synthesized
tatacctttactttgaatatgt

SEQ ID NO: 991145 - DNA, 22 bp, Artificial Sequence
  chemically synthesized
atacctttactttgaatatgtg

SEQ ID NO: 991146 - DNA, 22 bp, Artificial Sequence
  chemically synthesized
tacctttactttgaatatgtga

SEQ ID NO: 991147 - DNA, 22 bp, Artificial Sequence
  chemically synthesized
tactttgaatatgtgataattc

SEQ ID NO: 991148 - DNA, 22 bp, Artificial Sequence
  chemically synthesized
tggagtaaaggagaattatcac

SEQ ID NO: 991149 - DNA, 22 bp, Artificial Sequence
  chemically synthesized
actttgaatatgtgataattct

SEQ ID NO: 991150 - DNA, 22 bp, Artificial Sequence
  chemically synthesized
ctttgaatatgtgataattctc

SEQ ID NO: 991151 - DNA, 22 bp, Artificial Sequence
  chemically synthesized
tatggagtaaaggagaattatc

SEQ ID NO: 991152 - DNA, 22 bp, Artificial Sequence
  chemically synthesized
tgaatatgtgataattctcctt

SEQ ID NO: 991153 - DNA, 22 bp, Artificial Sequence
  chemically synthesized
gaatatgtgataattctccttt

SEQ ID NO: 991154 - DNA, 22 bp, Artificial Sequence
  chemically synthesized
aatatgtgataattctccttta

SEQ ID NO: 991155 - DNA, 22 bp, Artificial Sequence
  chemically synthesized
tattctatggagtaaaggagaa

SEQ ID NO: 991156 - DNA, 22 bp, Artificial Sequence
  chemically synthesized
gtattctatggagtaaaggaga

SEQ ID NO: 991157 - DNA, 22 bp, Artificial Sequence
  chemically synthesized
tgtattctatggagtaaaggag

SEQ ID NO: 991158 - DNA, 22 bp, Artificial Sequence
  chemically synthesized
ttgtattctatggagtaaagga

SEQ ID NO: 991159 - DNA, 22 bp, Artificial Sequence
  chemically synthesized
cagagtttttgtattctatgga

SEQ ID NO: 991160 - DNA, 22 bp, Artificial Sequence
  chemically synthesized
gcagagtttttgtattctatgg

SEQ ID NO: 991161 - DNA, 22 bp, Artificial Sequence
  chemically synthesized
tcctttactccatagaatacaa

SEQ ID NO: 991162 - DNA, 22 bp, Artificial Sequence
  chemically synthesized
ctttactccatagaatacaaaa

SEQ ID NO: 991163 - DNA, 22 bp, Artificial Sequence
  chemically synthesized
tactccatagaatacaaaaact

SEQ ID NO: 991164 - DNA, 22 bp, Artificial Sequence
  chemically synthesized
actccatagaatacaaaaactc

SEQ ID NO: 991165 - DNA, 22 bp, Artificial Sequence
  chemically synthesized
ctccatagaatacaaaaactct

SEQ ID NO: 991166 - DNA, 22 bp, Artificial Sequence
  chemically synthesized
catagaatacaaaaactctgca

SEQ ID NO: 991167 - DNA, 22 bp, Artificial Sequence
  chemically synthesized
agataatgatatttgcagagtt

SEQ ID NO: 991168 - DNA, 22 bp, Artificial Sequence
  chemically synthesized
aagataatgatatttgcagagt

SEQ ID NO: 991169 - DNA, 22 bp, Artificial Sequence
  chemically synthesized
taagataatgatatttgcagag

SEQ ID NO: 991170 - DNA, 22 bp, Artificial Sequence
  chemically synthesized
ttaagataatgatatttgcaga

SEQ ID NO: 991171 - DNA, 22 bp, Artificial Sequence
  chemically synthesized
tgcaaatatcattatcttaaaa

SEQ ID NO: 991172 - DNA, 22 bp, Artificial Sequence
  chemically synthesized
caaatatcattatcttaaaaat

SEQ ID NO: 991173 - DNA, 22 bp, Artificial Sequence
  chemically synthesized
acacatatatacaaatacattt

SEQ ID NO: 991174 - DNA, 22 bp, Artificial Sequence
  chemically synthesized
aacacatatatacaaatacatt

SEQ ID NO: 991175 - DNA, 22 bp, Artificial Sequence
  chemically synthesized
tcttaaaaatgtatttgtatat

SEQ ID NO: 991176 - DNA, 22 bp, Artificial Sequence
  chemically synthesized
aatttaacacatatatacaaat

SEQ ID NO: 991177 - DNA, 22 bp, Artificial Sequence
  chemically synthesized
aaaaatgtatttgtatatatgt

SEQ ID NO: 991178 - DNA, 22 bp, Artificial Sequence
  chemically synthesized
aaaatgtatttgtatatatgtg

SEQ ID NO: 991179 - DNA, 22 bp, Artificial Sequence
  chemically synthesized
gaaagattcaatttaacacata

SEQ ID NO: 991180 - DNA, 22 bp, Artificial Sequence
  chemically synthesized
attagaaagattcaatttaaca

SEQ ID NO: 991181 - DNA, 22 bp, Artificial Sequence
  chemically synthesized
gtatatatgtgttaaattgaat

SEQ ID NO: 991182 - DNA, 22 bp, Artificial Sequence
  chemically synthesized
ctcattagaaagattcaattta

SEQ ID NO: 991183 - DNA, 22 bp, Artificial Sequence
  chemically synthesized
tatatatgtgttaaattgaatc

SEQ ID NO: 991184 - DNA, 22 bp, Artificial Sequence
  chemically synthesized
cctcattagaaagattcaattt

SEQ ID NO: 991185 - DNA, 22 bp, Artificial Sequence
  chemically synthesized
tcctcattagaaagattcaatt

SEQ ID NO: 991186 - DNA, 22 bp, Artificial Sequence
  chemically synthesized
actttcctcattagaaagattc

SEQ ID NO: 991187 - DNA, 22 bp, Artificial Sequence
  chemically synthesized
aattgaatctttctaatgagga

SEQ ID NO: 991188 - DNA, 22 bp, Artificial Sequence
  chemically synthesized
aatctttctaatgaggaaagtt

SEQ ID NO: 991189 - DNA, 22 bp, Artificial Sequence
  chemically synthesized
agagtgaacgttaactttcctc

SEQ ID NO: 991190 - DNA, 22 bp, Artificial Sequence
  chemically synthesized
tctaatgaggaaagttaacgtt

SEQ ID NO: 991191 - DNA, 22 bp, Artificial Sequence
  chemically synthesized
ctaatgaggaaagttaacgttc

SEQ ID NO: 991192 - DNA, 22 bp, Artificial Sequence
  chemically synthesized
taatgaggaaagttaacgttca

SEQ ID NO: 991193 - DNA, 22 bp, Artificial Sequence
  chemically synthesized
atgaggaaagttaacgttcact

SEQ ID NO: 991194 - DNA, 22 bp, Artificial Sequence
  chemically synthesized
ataagaacaacctgagagtgaa

SEQ ID NO: 991195 - DNA, 22 bp, Artificial Sequence
  chemically synthesized
atctgataagaacaacctgaga

SEQ ID NO: 991196 - DNA, 22 bp, Artificial Sequence
  chemically synthesized
acgttcactctcaggttgttct

SEQ ID NO: 991197 - DNA, 22 bp, Artificial Sequence
  chemically synthesized
caaactcatctgataagaacaa

SEQ ID NO: 991198 - DNA, 22 bp, Artificial Sequence
  chemically synthesized
actctcaggttgttcttatcag

SEQ ID NO: 991199 - DNA, 22 bp, Artificial Sequence
  chemically synthesized
tcaggttgttcttatcagatga

SEQ ID NO: 991200 - DNA, 22 bp, Artificial Sequence
  chemically synthesized
aggttgttcttatcagatgagt

SEQ ID NO: 991201 - DNA, 22 bp, Artificial Sequence
  chemically synthesized
ataatacaactacaaactcatc

SEQ ID NO: 991202 - DNA, 22 bp, Artificial Sequence
  chemically synthesized
cataatacaactacaaactcat

SEQ ID NO: 991203 - DNA, 22 bp, Artificial Sequence
  chemically synthesized
ttcttatcagatgagtttgtag

SEQ ID NO: 991204 - DNA, 22 bp, Artificial Sequence
  chemically synthesized
ttcataatacaactacaaactc

SEQ ID NO: 991205 - DNA, 22 bp, Artificial Sequence
  chemically synthesized
cttcataatacaactacaaact

SEQ ID NO: 991206 - DNA, 22 bp, Artificial Sequence
  chemically synthesized
ttatcagatgagtttgtagttg

SEQ ID NO: 991207 - DNA, 22 bp, Artificial Sequence
  chemically synthesized
tttcttcataatacaactacaa

SEQ ID NO: 991208 - DNA, 22 bp, Artificial Sequence
  chemically synthesized
atcagatgagtttgtagttgta

SEQ ID NO: 991209 - DNA, 22 bp, Artificial Sequence
  chemically synthesized
tcagatgagtttgtagttgtat

SEQ ID NO: 991210 - DNA, 22 bp, Artificial Sequence
  chemically synthesized
gtagttgtattatgaagaaaca

SEQ ID NO: 991211 - DNA, 22 bp, Artificial Sequence
  chemically synthesized
tagttgtattatgaagaaacaa

SEQ ID NO: 991212 - DNA, 22 bp, Artificial Sequence
  chemically synthesized
tattatgaagaaacaacacatt

SEQ ID NO: 991213 - DNA, 22 bp, Artificial Sequence
  chemically synthesized
tgaagaaacaacacattcctta

SEQ ID NO: 991214 - DNA, 22 bp, Artificial Sequence
  chemically synthesized
atagagacgtcagtaaggaatg

SEQ ID NO: 991215 - DNA, 22 bp, Artificial Sequence
  chemically synthesized
agctaatagagacgtcagtaag

SEQ ID NO: 991216 - DNA, 22 bp, Artificial Sequence
  chemically synthesized
aaataactaagctaatagagac

SEQ ID NO: 991217 - DNA, 22 bp, Artificial Sequence
  chemically synthesized
cttactgacgtctctattagct

SEQ ID NO: 991218 - DNA, 22 bp, Artificial Sequence
  chemically synthesized
aactgaaataactaagctaata

SEQ ID NO: 991219 - DNA, 22 bp, Artificial Sequence
  chemically synthesized
actgacgtctctattagcttag

SEQ ID NO: 991220 - DNA, 22 bp, Artificial Sequence
  chemically synthesized
ctgacgtctctattagcttagt

SEQ ID NO: 991221 - DNA, 22 bp, Artificial Sequence
  chemically synthesized
tcaactgaaataactaagctaa

SEQ ID NO: 991222 - DNA, 22 bp, Artificial Sequence
  chemically synthesized
acgtctctattagcttagttat

SEQ ID NO: 991223 - DNA, 22 bp, Artificial Sequence
  chemically synthesized
ttctcaactgaaataactaagc

SEQ ID NO: 991224 - DNA, 22 bp, Artificial Sequence
  chemically synthesized
gttctcaactgaaataactaag

SEQ ID NO: 991225 - DNA, 22 bp, Artificial Sequence
  chemically synthesized
ccttgttctcaactgaaataac

SEQ ID NO: 991226 - DNA, 22 bp, Artificial Sequence
  chemically synthesized
cccttgttctcaactgaaataa

SEQ ID NO: 991227 - DNA, 22 bp, Artificial Sequence
  chemically synthesized
tattagcttagttatttcagtt

SEQ ID NO: 991228 - DNA, 22 bp, Artificial Sequence
  chemically synthesized
tcccttgttctcaactgaaata

SEQ ID NO: 991229 - DNA, 22 bp, Artificial Sequence
  chemically synthesized
ttagcttagttatttcagttga

SEQ ID NO: 991230 - DNA, 22 bp, Artificial Sequence
  chemically synthesized
gcttagttatttcagttgagaa

SEQ ID NO: 991231 - DNA, 22 bp, Artificial Sequence
  chemically synthesized
tgttttcccttgttctcaactg

SEQ ID NO: 991232 - DNA, 22 bp, Artificial Sequence
  chemically synthesized
atgttttcccttgttctcaact

SEQ ID NO: 991233 - DNA, 22 bp, Artificial Sequence
  chemically synthesized
ttatgttttcccttgttctcaa

SEQ ID NO: 991234 - DNA, 22 bp, Artificial Sequence
  chemically synthesized
agttatttcagttgagaacaag

SEQ ID NO: 991235 - DNA, 22 bp, Artificial Sequence
  chemically synthesized
gttatttcagttgagaacaagg

SEQ ID NO: 991236 - DNA, 22 bp, Artificial Sequence
  chemically synthesized
tttcagttgagaacaagggaaa

SEQ ID NO: 991237 - DNA, 22 bp, Artificial Sequence
  chemically synthesized
cagttgagaacaagggaaaaca

SEQ ID NO: 991238 - DNA, 22 bp, Artificial Sequence
  chemically synthesized
agttgagaacaagggaaaacat

SEQ ID NO: 991239 - DNA, 22 bp, Artificial Sequence
  chemically synthesized
caataataccattcttatgttt

SEQ ID NO: 991240 - DNA, 22 bp, Artificial Sequence
  chemically synthesized
agaacaagggaaaacataagaa

SEQ ID NO: 991241 - DNA, 22 bp, Artificial Sequence
  chemically synthesized
ttggagtgtattgctatacatt

SEQ ID NO: 991242 - DNA, 22 bp, Artificial Sequence
  chemically synthesized
tgatgtgaataaaatgtatagc

SEQ ID NO: 991243 - DNA, 22 bp, Artificial Sequence
  chemically synthesized
gagtgtattgctatacatttta

SEQ ID NO: 991244 - DNA, 22 bp, Artificial Sequence
  chemically synthesized
ctatacattttattcacatcac

SEQ ID NO: 991245 - DNA, 22 bp, Artificial Sequence
  chemically synthesized
tacattttattcacatcacagt

SEQ ID NO: 991246 - DNA, 22 bp, Artificial Sequence
  chemically synthesized
tattcacatcacagtattttat

SEQ ID NO: 991247 - DNA, 22 bp, Artificial Sequence
  chemically synthesized
attcacatcacagtattttata

SEQ ID NO: 991248 - DNA, 22 bp, Artificial Sequence
  chemically synthesized
aaaaaagagaaatataaaatac

SEQ ID NO: 991249 - DNA, 22 bp, Artificial Sequence
  chemically synthesized
ttcacatcacagtattttatat

SEQ ID NO: 991250 - DNA, 22 bp, Artificial Sequence
  chemically synthesized
aaaaaaagagaaatataaaata

SEQ ID NO: 991251 - DNA, 22 bp, Artificial Sequence
  chemically synthesized
acatcacagtattttatatttc

SEQ ID NO: 991252 - DNA, 22 bp, Artificial Sequence
  chemically synthesized
tgtacaaacttaaaaaaagaga

SEQ ID NO: 991253 - DNA, 22 bp, Artificial Sequence
  chemically synthesized
tctgtgtacaaacttaaaaaaa

SEQ ID NO: 991254 - DNA, 22 bp, Artificial Sequence
  chemically synthesized
tatatttctctttttttaagtt

SEQ ID NO: 991255 - DNA, 22 bp, Artificial Sequence
  chemically synthesized
atatttctctttttttaagttt

SEQ ID NO: 991256 - DNA, 22 bp, Artificial Sequence
  chemically synthesized
tatttctctttttttaagtttg

SEQ ID NO: 991257 - DNA, 22 bp, Artificial Sequence
  chemically synthesized
ctctttttttaagtttgtacac

SEQ ID NO: 991258 - DNA, 22 bp, Artificial Sequence
  chemically synthesized
tctttttttaagtttgtacaca

SEQ ID NO: 991259 - DNA, 22 bp, Artificial Sequence
  chemically synthesized
cagagatattgtctgtgtacaa

SEQ ID NO: 991260 - DNA, 22 bp, Artificial Sequence
  chemically synthesized
tttttttaagtttgtacacaga

SEQ ID NO: 991261 - DNA, 22 bp, Artificial Sequence
  chemically synthesized
tttttaagtttgtacacagaca

SEQ ID NO: 991262 - DNA, 22 bp, Artificial Sequence
  chemically synthesized
ttttaagtttgtacacagacaa

SEQ ID NO: 991263 - DNA, 22 bp, Artificial Sequence
  chemically synthesized
tttaagtttgtacacagacaat

SEQ ID NO: 991264 - DNA, 22 bp, Artificial Sequence
  chemically synthesized
ttaagtttgtacacagacaata

SEQ ID NO: 991265 - DNA, 22 bp, Artificial Sequence
  chemically synthesized
taagtttgtacacagacaatat

SEQ ID NO: 991266 - DNA, 22 bp, Artificial Sequence
  chemically synthesized
aagtttgtacacagacaatatc

SEQ ID NO: 991267 - DNA, 22 bp, Artificial Sequence
  chemically synthesized
agtttgtacacagacaatatct

SEQ ID NO: 991268 - DNA, 22 bp, Artificial Sequence
  chemically synthesized
ataaaaataattccagagatat

SEQ ID NO: 991269 - DNA, 22 bp, Artificial Sequence
  chemically synthesized
gtacacagacaatatctctgga

SEQ ID NO: 991270 - DNA, 22 bp, Artificial Sequence
  chemically synthesized
aataaaaataattccagagata

SEQ ID NO: 991271 - DNA, 22 bp, Artificial Sequence
  chemically synthesized
tacacagacaatatctctggaa

SEQ ID NO: 991272 - DNA, 22 bp, Artificial Sequence
  chemically synthesized
aatatcccttaataaaaataat

SEQ ID NO: 991273 - DNA, 22 bp, Artificial Sequence
  chemically synthesized
atcattaaatatcccttaataa

SEQ ID NO: 991274 - DNA, 22 bp, Artificial Sequence
  chemically synthesized
tggaattatttttattaaggga

SEQ ID NO: 991275 - DNA, 22 bp, Artificial Sequence
  chemically synthesized
aatcattaaatatcccttaata

SEQ ID NO: 991276 - DNA, 22 bp, Artificial Sequence
  chemically synthesized
gaattatttttattaagggata

SEQ ID NO: 991277 - DNA, 22 bp, Artificial Sequence
  chemically synthesized
tttaatcattaaatatccctta

SEQ ID NO: 991278 - DNA, 22 bp, Artificial Sequence
  chemically synthesized
atttaatcattaaatatccctt

SEQ ID NO: 991279 - DNA, 22 bp, Artificial Sequence
  chemically synthesized
tttttattaagggatatttaat

SEQ ID NO: 991280 - DNA, 22 bp, Artificial Sequence
  chemically synthesized
ttattaagggatatttaatgat

SEQ ID NO: 991281 - DNA, 22 bp, Artificial Sequence
  chemically synthesized
tattaagggatatttaatgatt

SEQ ID NO: 991282 - DNA, 22 bp, Artificial Sequence
  chemically synthesized
attaagggatatttaatgatta

SEQ ID NO: 991283 - DNA, 22 bp, Artificial Sequence
  chemically synthesized
agagtgcttatttaatcattaa

SEQ ID NO: 991284 - DNA, 22 bp, Artificial Sequence
  chemically synthesized
ttaagggatatttaatgattaa

SEQ ID NO: 991285 - DNA, 22 bp, Artificial Sequence
  chemically synthesized
agggatatttaatgattaaata

SEQ ID NO: 991286 - DNA, 22 bp, Artificial Sequence
  chemically synthesized
gctaagagtgcttatttaatca

SEQ ID NO: 991287 - DNA, 22 bp, Artificial Sequence
  chemically synthesized
cgctaagagtgcttatttaatc

SEQ ID NO: 991288 - DNA, 22 bp, Artificial Sequence
  chemically synthesized
aaggtcttcgctaagagtgctt

SEQ ID NO: 991289 - DNA, 22 bp, Artificial Sequence
  chemically synthesized
aatgattaaataagcactctta

SEQ ID NO: 991290 - DNA, 22 bp, Artificial Sequence
  chemically synthesized
aaaggtcttcgctaagagtgct

SEQ ID NO: 991291 - DNA, 22 bp, Artificial Sequence
  chemically synthesized
atgattaaataagcactcttag

SEQ ID NO: 991292 - DNA, 22 bp, Artificial Sequence
  chemically synthesized
aataagcactcttagcgaagac

SEQ ID NO: 991293 - DNA, 22 bp, Artificial Sequence
  chemically synthesized
gtaaaaaataacacttaaaggt

SEQ ID NO: 991294 - DNA, 22 bp, Artificial Sequence
  chemically synthesized
ggtaaaaaataacacttaaagg

SEQ ID NO: 991295 - DNA, 22 bp, Artificial Sequence
  chemically synthesized
ttagcgaagacctttaagtgtt

SEQ ID NO: 991296 - DNA, 22 bp, Artificial Sequence
  chemically synthesized
agcgaagacctttaagtgttat

SEQ ID NO: 991297 - DNA, 22 bp, Artificial Sequence
  chemically synthesized
gcgaagacctttaagtgttatt

SEQ ID NO: 991298 - DNA, 22 bp, Artificial Sequence
  chemically synthesized
tatacgatttggtaaaaaataa

SEQ ID NO: 991299 - DNA, 22 bp, Artificial Sequence
  chemically synthesized
taagtgttattttttaccaaat

SEQ ID NO: 991300 - DNA, 22 bp, Artificial Sequence
  chemically synthesized
aagtgttattttttaccaaatc

SEQ ID NO: 991301 - DNA, 22 bp, Artificial Sequence
  chemically synthesized
agtgttattttttaccaaatcg

SEQ ID NO: 991302 - DNA, 22 bp, Artificial Sequence
  chemically synthesized
tatgtggaagctatatacgatt

SEQ ID NO: 991303 - DNA, 22 bp, Artificial Sequence
  chemically synthesized
ttttttaccaaatcgtatatag

SEQ ID NO: 991304 - DNA, 22 bp, Artificial Sequence
  chemically synthesized
tttaccaaatcgtatatagctt

SEQ ID NO: 991305 - DNA, 22 bp, Artificial Sequence
  chemically synthesized
cattgtatgtggaagctatata

SEQ ID NO: 991306 - DNA, 22 bp, Artificial Sequence
  chemically synthesized
ttaccaaatcgtatatagcttc

SEQ ID NO: 991307 - DNA, 22 bp, Artificial Sequence
  chemically synthesized
gcattgtatgtggaagctatat

SEQ ID NO: 991308 - DNA, 22 bp, Artificial Sequence
  chemically synthesized
taccaaatcgtatatagcttcc

SEQ ID NO: 991309 - DNA, 22 bp, Artificial Sequence
  chemically synthesized
accaaatcgtatatagcttcca

SEQ ID NO: 991310 - DNA, 22 bp, Artificial Sequence
  chemically synthesized
ccaaatcgtatatagcttccac

SEQ ID NO: 991311 - DNA, 22 bp, Artificial Sequence
  chemically synthesized
gaatgtttgcattgtatgtgga

SEQ ID NO: 991312 - DNA, 22 bp, Artificial Sequence
  chemically synthesized
cagtactggaatgtttgcattg

SEQ ID NO: 991313 - DNA, 22 bp, Artificial Sequence
  chemically synthesized
tctgcagtactggaatgtttgc

SEQ ID NO: 991314 - DNA, 22 bp, Artificial Sequence
  chemically synthesized
ccacatacaatgcaaacattcc

SEQ ID NO: 991315 - DNA, 22 bp, Artificial Sequence
  chemically synthesized
cacatacaatgcaaacattcca

SEQ ID NO: 991316 - DNA, 22 bp, Artificial Sequence
  chemically synthesized
tatattatctgcagtactggaa

SEQ ID NO: 991317 - DNA, 22 bp, Artificial Sequence
  chemically synthesized
tgtacccctgtatattatctgc

SEQ ID NO: 991318 - DNA, 22 bp, Artificial Sequence
  chemically synthesized
cagtactgcagataatatacag

SEQ ID NO: 991319 - DNA, 22 bp, Artificial Sequence
  chemically synthesized
aaacctgtgtacccctgtatat

SEQ ID NO: 991320 - DNA, 22 bp, Artificial Sequence
  chemically synthesized
caaacctgtgtacccctgtata

SEQ ID NO: 991321 - DNA, 22 bp, Artificial Sequence
  chemically synthesized
cttcaaacctgtgtacccctgt

SEQ ID NO: 991322 - DNA, 22 bp, Artificial Sequence
  chemically synthesized
cagataatatacaggggtacac

SEQ ID NO: 991323 - DNA, 22 bp, Artificial Sequence
  chemically synthesized
cactacttcaaacctgtgtacc

SEQ ID NO: 991324 - DNA, 22 bp, Artificial Sequence
  chemically synthesized
tccactacttcaaacctgtgta

SEQ ID NO: 991325 - DNA, 22 bp, Artificial Sequence
  chemically synthesized
tggtccatcagtctctccacta

SEQ ID NO: 991326 - DNA, 22 bp, Artificial Sequence
  chemically synthesized
atggtccatcagtctctccact

SEQ ID NO: 991327 - DNA, 22 bp, Artificial Sequence
  chemically synthesized
tggcttatggtccatcagtctc

SEQ ID NO: 991328 - DNA, 22 bp, Artificial Sequence
  chemically synthesized
gaagtagtggagagactgatgg

SEQ ID NO: 991329 - DNA, 22 bp, Artificial Sequence
  chemically synthesized
atggcttatggtccatcagtct

SEQ ID NO: 991330 - DNA, 22 bp, Artificial Sequence
  chemically synthesized
aagtagtggagagactgatgga

SEQ ID NO: 991331 - DNA, 22 bp, Artificial Sequence
  chemically synthesized
aaaagatttatggcttatggtc

SEQ ID NO: 991332 - DNA, 22 bp, Artificial Sequence
  chemically synthesized
aaaaagatttatggcttatggt

SEQ ID NO: 991333 - DNA, 22 bp, Artificial Sequence
  chemically synthesized
taaaaagatttatggcttatgg

SEQ ID NO: 991334 - DNA, 22 bp, Artificial Sequence
  chemically synthesized
ttaaaaagatttatggcttatg

SEQ ID NO: 991335 - DNA, 22 bp, Artificial Sequence
  chemically synthesized
tttaaaaagatttatggcttat

SEQ ID NO: 991336 - DNA, 22 bp, Artificial Sequence
  chemically synthesized
ttttaaaaagatttatggctta

SEQ ID NO: 991337 - DNA, 22 bp, Artificial Sequence
  chemically synthesized
atggaccataagccataaatct

SEQ ID NO: 991338 - DNA, 22 bp, Artificial Sequence
  chemically synthesized
gtgatttttttaaaaagattta

SEQ ID NO: 991339 - DNA, 22 bp, Artificial Sequence
  chemically synthesized
ggtgatttttttaaaaagattt

SEQ ID NO: 991340 - DNA, 22 bp, Artificial Sequence
  chemically synthesized
tggtgatttttttaaaaagatt

SEQ ID NO: 991341 - DNA, 22 bp, Artificial Sequence
  chemically synthesized
agattttggtgatttttttaaa

SEQ ID NO: 991342 - DNA, 22 bp, Artificial Sequence
  chemically synthesized
tagctgagattttggtgatttt

SEQ ID NO: 991343 - DNA, 22 bp, Artificial Sequence
  chemically synthesized
tttaaaaaaatcaccaaaatct

SEQ ID NO: 991344 - DNA, 22 bp, Artificial Sequence
  chemically synthesized
ttaaaaaaatcaccaaaatctc

SEQ ID NO: 991345 - DNA, 22 bp, Artificial Sequence
  chemically synthesized
taaaaaaatcaccaaaatctca

SEQ ID NO: 991346 - DNA, 22 bp, Artificial Sequence
  chemically synthesized
aaaaaaatcaccaaaatctcag

SEQ ID NO: 991347 - DNA, 22 bp, Artificial Sequence
  chemically synthesized
aaaaaatcaccaaaatctcagc

SEQ ID NO: 991348 - DNA, 22 bp, Artificial Sequence
  chemically synthesized
tatgatcaagattatagctgag

SEQ ID NO: 991349 - DNA, 22 bp, Artificial Sequence
  chemically synthesized
gtatgatcaagattatagctga

SEQ ID NO: 991350 - DNA, 22 bp, Artificial Sequence
  chemically synthesized
tgtatgatcaagattatagctg

SEQ ID NO: 991351 - DNA, 22 bp, Artificial Sequence
  chemically synthesized
ttttgtatgatcaagattatag

SEQ ID NO: 991352 - DNA, 22 bp, Artificial Sequence
  chemically synthesized
attttgtatgatcaagattata

SEQ ID NO: 991353 - DNA, 22 bp, Artificial Sequence
  chemically synthesized
tattttgtatgatcaagattat

SEQ ID NO: 991354 - DNA, 22 bp, Artificial Sequence
  chemically synthesized
ttattttgtatgatcaagatta

SEQ ID NO: 991355 - DNA, 22 bp, Artificial Sequence
  chemically synthesized
tttattttgtatgatcaagatt

SEQ ID NO: 991356 - DNA, 22 bp, Artificial Sequence
  chemically synthesized
tttttattttgtatgatcaaga

SEQ ID NO: 991357 - DNA, 22 bp, Artificial Sequence
  chemically synthesized
ctctttttattttgtatgatca

SEQ ID NO: 991358 - DNA, 22 bp, Artificial Sequence
  chemically synthesized
agctataatcttgatcatacaa

SEQ ID NO: 991359 - DNA, 22 bp, Artificial Sequence
  chemically synthesized
taatcttgatcatacaaaataa

SEQ ID NO: 991360 - DNA, 22 bp, Artificial Sequence
  chemically synthesized
gagctcctctttttattttgta

SEQ ID NO: 991361 - DNA, 22 bp, Artificial Sequence
  chemically synthesized
agagctcctctttttattttgt

SEQ ID NO: 991362 - DNA, 22 bp, Artificial Sequence
  chemically synthesized
tagagctcctctttttattttg

SEQ ID NO: 991363 - DNA, 22 bp, Artificial Sequence
  chemically synthesized
tttagagctcctctttttattt

SEQ ID NO: 991364 - DNA, 22 bp, Artificial Sequence
  chemically synthesized
ctttagagctcctctttttatt

SEQ ID NO: 991365 - DNA, 22 bp, Artificial Sequence
  chemically synthesized
gatcatacaaaataaaaagagg

SEQ ID NO: 991366 - DNA, 22 bp, Artificial Sequence
  chemically synthesized
atcatacaaaataaaaagagga

SEQ ID NO: 991367 - DNA, 22 bp, Artificial Sequence
  chemically synthesized
tttctttagagctcctcttttt

SEQ ID NO: 991368 - DNA, 22 bp, Artificial Sequence
  chemically synthesized
atttctttagagctcctctttt

SEQ ID NO: 991369 - DNA, 22 bp, Artificial Sequence
  chemically synthesized
tatttctttagagctcctcttt

SEQ ID NO: 991370 - DNA, 22 bp, Artificial Sequence
  chemically synthesized
ctttatttctttagagctcctc

SEQ ID NO: 991371 - DNA, 22 bp, Artificial Sequence
  chemically synthesized
gctttatttctttagagctcct

SEQ ID NO: 991372 - DNA, 22 bp, Artificial Sequence
  chemically synthesized
tgctttatttctttagagctcc

SEQ ID NO: 991373 - DNA, 22 bp, Artificial Sequence
  chemically synthesized
ttgctttatttctttagagctc

SEQ ID NO: 991374 - DNA, 22 bp, Artificial Sequence
  chemically synthesized
tttgctttatttctttagagct

SEQ ID NO: 991375 - DNA, 22 bp, Artificial Sequence
  chemically synthesized
ttttgctttatttctttagagc

SEQ ID NO: 991376 - DNA, 22 bp, Artificial Sequence
  chemically synthesized
tttttgctttatttctttagag

SEQ ID NO: 991377 - DNA, 22 bp, Artificial Sequence
  chemically synthesized
ttttttgctttatttctttaga

SEQ ID NO: 991378 - DNA, 22 bp, Artificial Sequence
  chemically synthesized
tttttttgctttatttctttag

SEQ ID NO: 991379 - DNA, 22 bp, Artificial Sequence
  chemically synthesized
ttttttttgctttatttcttta

SEQ ID NO: 991380 - DNA, 22 bp, Artificial Sequence
  chemically synthesized
taaatttttttttttgctttat

SEQ ID NO: 991381 - DNA, 22 bp, Artificial Sequence
  chemically synthesized
taaagaaataaagcaaaaaaaa

SEQ ID NO: 991382 - DNA, 22 bp, Artificial Sequence
  chemically synthesized
aagaaataaagcaaaaaaaaaa

SEQ ID NO: 991383 - DNA, 22 bp, Artificial Sequence
  chemically synthesized
cagtaatgtggattataaattt

SEQ ID NO: 991384 - DNA, 22 bp, Artificial Sequence
  chemically synthesized
gatgattgcagtaatgtggatt

SEQ ID NO: 991385 - DNA, 22 bp, Artificial Sequence
  chemically synthesized
acaaactagatgattgcagtaa

SEQ ID NO: 991386 - DNA, 22 bp, Artificial Sequence
  chemically synthesized
cacaaactagatgattgcagta

SEQ ID NO: 991387 - DNA, 22 bp, Artificial Sequence
  chemically synthesized
ataatccacattactgcaatca

SEQ ID NO: 991388 - DNA, 22 bp, Artificial Sequence
  chemically synthesized
tcacaaactagatgattgcagt

SEQ ID NO: 991389 - DNA, 22 bp, Artificial Sequence
  chemically synthesized
taatccacattactgcaatcat

SEQ ID NO: 991390 - DNA, 22 bp, Artificial Sequence
  chemically synthesized
tttcacaaactagatgattgca

SEQ ID NO: 991391 - DNA, 22 bp, Artificial Sequence
  chemically synthesized
ctttcacaaactagatgattgc

SEQ ID NO: 991392 - DNA, 22 bp, Artificial Sequence
  chemically synthesized
ttctttcacaaactagatgatt

SEQ ID NO: 991393 - DNA, 22 bp, Artificial Sequence
  chemically synthesized
ctgcaatcatctagtttgtgaa

SEQ ID NO: 991394 - DNA, 22 bp, Artificial Sequence
  chemically synthesized
caatcatctagtttgtgaaaga

SEQ ID NO: 991395 - DNA, 22 bp, Artificial Sequence
  chemically synthesized
aaatacatactcttctttcaca

SEQ ID NO: 991396 - DNA, 22 bp, Artificial Sequence
  chemically synthesized
aaaatacatactcttctttcac

SEQ ID NO: 991397 - DNA, 22 bp, Artificial Sequence
  chemically synthesized
atttaaaatacatactcttctt

SEQ ID NO: 991398 - DNA, 22 bp, Artificial Sequence
  chemically synthesized
aatttaaaatacatactcttct

SEQ ID NO: 991399 - DNA, 22 bp, Artificial Sequence
  chemically synthesized
gtttgtgaaagaagagtatgta

SEQ ID NO: 991400 - DNA, 22 bp, Artificial Sequence
  chemically synthesized
gtgaaagaagagtatgtatttt

SEQ ID NO: 991401 - DNA, 22 bp, Artificial Sequence
  chemically synthesized
aggatttaatttaaaatacata

SEQ ID NO: 991402 - DNA, 22 bp, Artificial Sequence
  chemically synthesized
tgaaagaagagtatgtatttta

SEQ ID NO: 991403 - DNA, 22 bp, Artificial Sequence
  chemically synthesized
taaattaaatccttaatgattt

SEQ ID NO: 991404 - DNA, 22 bp, Artificial Sequence
  chemically synthesized
aaattaaatccttaatgatttg

SEQ ID NO: 991405 - DNA, 22 bp, Artificial Sequence
  chemically synthesized
aattaaatccttaatgatttga

SEQ ID NO: 991406 - DNA, 22 bp, Artificial Sequence
  chemically synthesized
caaaaacaaaatatcaaatcat

SEQ ID NO: 991407 - DNA, 22 bp, Artificial Sequence
  chemically synthesized
aatccttaatgatttgatattt

SEQ ID NO: 991408 - DNA, 22 bp, Artificial Sequence
  chemically synthesized
tgaagttccaaaaacaaaatat

SEQ ID NO: 991409 - DNA, 22 bp, Artificial Sequence
  chemically synthesized
aatgatttgatattttgttttt

SEQ ID NO: 991410 - DNA, 22 bp, Artificial Sequence
  chemically synthesized
atgatttgatattttgtttttg

SEQ ID NO: 991411 - DNA, 22 bp, Artificial Sequence
  chemically synthesized
gttgtgaagttccaaaaacaaa

SEQ ID NO: 991412 - DNA, 22 bp, Artificial Sequence
  chemically synthesized
ggttgtgaagttccaaaaacaa

SEQ ID NO: 991413 - DNA, 22 bp, Artificial Sequence
  chemically synthesized
gatattttgtttttggaacttc

SEQ ID NO: 991414 - DNA, 22 bp, Artificial Sequence
  chemically synthesized
atattttgtttttggaacttca

SEQ ID NO: 991415 - DNA, 22 bp, Artificial Sequence
  chemically synthesized
ggatagtcttggttgtgaagtt

SEQ ID NO: 991416 - DNA, 22 bp, Artificial Sequence
  chemically synthesized
aggatagtcttggttgtgaagt

SEQ ID NO: 991417 - DNA, 22 bp, Artificial Sequence
  chemically synthesized
tgtttttggaacttcacaacca

SEQ ID NO: 991418 - DNA, 22 bp, Artificial Sequence
  chemically synthesized
gtttttggaacttcacaaccaa

SEQ ID NO: 991419 - DNA, 22 bp, Artificial Sequence
  chemically synthesized
cttaggatagtcttggttgtga

SEQ ID NO: 991420 - DNA, 22 bp, Artificial Sequence
  chemically synthesized
tttttggaacttcacaaccaag

SEQ ID NO: 991421 - DNA, 22 bp, Artificial Sequence
  chemically synthesized
ttggaacttcacaaccaagact

SEQ ID NO: 991422 - DNA, 22 bp, Artificial Sequence
  chemically synthesized
tggaacttcacaaccaagacta

SEQ ID NO: 991423 - DNA, 22 bp, Artificial Sequence
  chemically synthesized
aattccttaggatagtcttggt

SEQ ID NO: 991424 - DNA, 22 bp, Artificial Sequence
  chemically synthesized
ggaacttcacaaccaagactat

SEQ ID NO: 991425 - DNA, 22 bp, Artificial Sequence
  chemically synthesized
gaacttcacaaccaagactatc

SEQ ID NO: 991426 - DNA, 22 bp, Artificial Sequence
  chemically synthesized
tgaattccttaggatagtcttg

SEQ ID NO: 991427 - DNA, 22 bp, Artificial Sequence
  chemically synthesized
cacaaccaagactatcctaagg

SEQ ID NO: 991428 - DNA, 22 bp, Artificial Sequence
  chemically synthesized
acaaccaagactatcctaagga

SEQ ID NO: 991429 - DNA, 22 bp, Artificial Sequence
  chemically synthesized
tgaggaaagctctgaattcctt

SEQ ID NO: 991430 - DNA, 22 bp, Artificial Sequence
  chemically synthesized
gtgaggaaagctctgaattcct

SEQ ID NO: 991431 - DNA, 22 bp, Artificial Sequence
  chemically synthesized
gtcttgtgaggaaagctctgaa

SEQ ID NO: 991432 - DNA, 22 bp, Artificial Sequence
  chemically synthesized
ggtcttgtgaggaaagctctga

SEQ ID NO: 991433 - DNA, 22 bp, Artificial Sequence
  chemically synthesized
tcctaaggaattcagagctttc

SEQ ID NO: 991434 - DNA, 22 bp, Artificial Sequence
  chemically synthesized
tggtcttgtgaggaaagctctg

SEQ ID NO: 991435 - DNA, 22 bp, Artificial Sequence
  chemically synthesized
ctttggtcttgtgaggaaagct

SEQ ID NO: 991436 - DNA, 22 bp, Artificial Sequence
  chemically synthesized
aggaattcagagctttcctcac

SEQ ID NO: 991437 - DNA, 22 bp, Artificial Sequence
  chemically synthesized
ttgctttggtcttgtgaggaaa

SEQ ID NO: 991438 - DNA, 22 bp, Artificial Sequence
  chemically synthesized
agagctttcctcacaagaccaa

SEQ ID NO: 991439 - DNA, 22 bp, Artificial Sequence
  chemically synthesized
atgcactgttgctttggtcttg

SEQ ID NO: 991440 - DNA, 22 bp, Artificial Sequence
  chemically synthesized
catgcactgttgctttggtctt

SEQ ID NO: 991441 - DNA, 22 bp, Artificial Sequence
  chemically synthesized
tcctcacaagaccaaagcaaca

SEQ ID NO: 991442 - DNA, 22 bp, Artificial Sequence
  chemically synthesized
aatttcatgcactgttgctttg

SEQ ID NO: 991443 - DNA, 22 bp, Artificial Sequence
  chemically synthesized
cctcacaagaccaaagcaacag

SEQ ID NO: 991444 - DNA, 22 bp, Artificial Sequence
  chemically synthesized
ctcacaagaccaaagcaacagt

SEQ ID NO: 991445 - DNA, 22 bp, Artificial Sequence
  chemically synthesized
acaagaccaaagcaacagtgca

SEQ ID NO: 991446 - DNA, 22 bp, Artificial Sequence
  chemically synthesized
agttcaatttcatgcactgttg

SEQ ID NO: 991447 - DNA, 22 bp, Artificial Sequence
  chemically synthesized
gagttcaatttcatgcactgtt

SEQ ID NO: 991448 - DNA, 22 bp, Artificial Sequence
  chemically synthesized
tgagttcaatttcatgcactgt

SEQ ID NO: 991449 - DNA, 22 bp, Artificial Sequence
  chemically synthesized
ttgagttcaatttcatgcactg

SEQ ID NO: 991450 - DNA, 22 bp, Artificial Sequence
  chemically synthesized
tttgagttcaatttcatgcact

SEQ ID NO: 991451 - DNA, 22 bp, Artificial Sequence
  chemically synthesized
tttttgagttcaatttcatgca

SEQ ID NO: 991452 - DNA, 22 bp, Artificial Sequence
  chemically synthesized
aactcaaaaagagccaccattc

SEQ ID NO: 991453 - DNA, 22 bp, Artificial Sequence
  chemically synthesized
aaaaagagccaccattctgtgt

SEQ ID NO: 991454 - DNA, 22 bp, Artificial Sequence
  chemically synthesized
tgtcagccaagaagtcacacag

SEQ ID NO: 991455 - DNA, 22 bp, Artificial Sequence
  chemically synthesized
aattgtgtcagccaagaagtca

SEQ ID NO: 991456 - DNA, 22 bp, Artificial Sequence
  chemically synthesized
tgtgtgacttcttggctgacac

SEQ ID NO: 991457 - DNA, 22 bp, Artificial Sequence
  chemically synthesized
tgtgacttcttggctgacacaa

SEQ ID NO: 991458 - DNA, 22 bp, Artificial Sequence
  chemically synthesized
taaatatctaaattgtgtcagc

SEQ ID NO: 991459 - DNA, 22 bp, Artificial Sequence
  chemically synthesized
cttggctgacacaatttagata

SEQ ID NO: 991460 - DNA, 22 bp, Artificial Sequence
  chemically synthesized
ttggctgacacaatttagatat

SEQ ID NO: 991461 - DNA, 22 bp, Artificial Sequence
  chemically synthesized
gtaaagctataaatatctaaat

SEQ ID NO: 991462 - DNA, 22 bp, Artificial Sequence
  chemically synthesized
ggctgacacaatttagatattt

SEQ ID NO: 991463 - DNA, 22 bp, Artificial Sequence
  chemically synthesized
gctgacacaatttagatattta

SEQ ID NO: 991464 - DNA, 22 bp, Artificial Sequence
  chemically synthesized
acacaatttagatatttatagc

SEQ ID NO: 991465 - DNA, 22 bp, Artificial Sequence
  chemically synthesized
cagtggcccattcgtaaagcta

SEQ ID NO: 991466 - DNA, 22 bp, Artificial Sequence
  chemically synthesized
tccagtggcccattcgtaaagc

SEQ ID NO: 991467 - DNA, 22 bp, Artificial Sequence
  chemically synthesized
agatatttatagctttacgaat

SEQ ID NO: 991468 - DNA, 22 bp, Artificial Sequence
  chemically synthesized
ctccagtggcccattcgtaaag

SEQ ID NO: 991469 - DNA, 22 bp, Artificial Sequence
  chemically synthesized
gatatttatagctttacgaatg

SEQ ID NO: 991470 - DNA, 22 bp, Artificial Sequence
  chemically synthesized
ttctccagtggcccattcgtaa

SEQ ID NO: 991471 - DNA, 22 bp, Artificial Sequence
  chemically synthesized
atagctttacgaatgggccact

SEQ ID NO: 991472 - DNA, 22 bp, Artificial Sequence
  chemically synthesized
aagttcttctccagtggcccat

SEQ ID NO: 991473 - DNA, 22 bp, Artificial Sequence
  chemically synthesized
tagctttacgaatgggccactg

SEQ ID NO: 991474 - DNA, 22 bp, Artificial Sequence
  chemically synthesized
caagttcttctccagtggccca

SEQ ID NO: 991475 - DNA, 22 bp, Artificial Sequence
  chemically synthesized
tacgaatgggccactggagaag

SEQ ID NO: 991476 - DNA, 22 bp, Artificial Sequence
  chemically synthesized
acgaatgggccactggagaaga

SEQ ID NO: 991477 - DNA, 22 bp, Artificial Sequence
  chemically synthesized
cgaatgggccactggagaagaa

SEQ ID NO: 991478 - DNA, 22 bp, Artificial Sequence
  chemically synthesized
gagaaagcttcaagttcttctc

SEQ ID NO: 991479 - DNA, 22 bp, Artificial Sequence
  chemically synthesized
gctagagaaagcttcaagttct

SEQ ID NO: 991480 - DNA, 22 bp, Artificial Sequence
  chemically synthesized
ctggctagagaaagcttcaagt

SEQ ID NO: 991481 - DNA, 22 bp, Artificial Sequence
  chemically synthesized
cctggctagagaaagcttcaag

SEQ ID NO: 991482 - DNA, 22 bp, Artificial Sequence
  chemically synthesized
gagaagaacttgaagctttctc

SEQ ID NO: 991483 - DNA, 22 bp, Artificial Sequence
  chemically synthesized
atccttcctggctagagaaagc

SEQ ID NO: 991484 - DNA, 22 bp, Artificial Sequence
  chemically synthesized
attaatccttcctggctagaga

SEQ ID NO: 991485 - DNA, 22 bp, Artificial Sequence
  chemically synthesized
gaagctttctctagccaggaag

SEQ ID NO: 991486 - DNA, 22 bp, Artificial Sequence
  chemically synthesized
aagctttctctagccaggaagg

SEQ ID NO: 991487 - DNA, 22 bp, Artificial Sequence
  chemically synthesized
tctctagccaggaaggattaat

SEQ ID NO: 991488 - DNA, 22 bp, Artificial Sequence
  chemically synthesized
ctctagccaggaaggattaatg

SEQ ID NO: 991489 - DNA, 22 bp, Artificial Sequence
  chemically synthesized
tctagccaggaaggattaatga

SEQ ID NO: 991490 - DNA, 22 bp, Artificial Sequence
  chemically synthesized
tagccaggaaggattaatgaac

SEQ ID NO: 991491 - DNA, 22 bp, Artificial Sequence
  chemically synthesized
ccaggtgcgcacgttcattaat

SEQ ID NO: 991492 - DNA, 22 bp, Artificial Sequence
  chemically synthesized
gccaggaaggattaatgaacgt

SEQ ID NO: 991493 - DNA, 22 bp, Artificial Sequence
  chemically synthesized
atgaacgtgcgcacctggtaat

SEQ ID NO: 991494 - DNA, 22 bp, Artificial Sequence
  chemically synthesized
aggaagatggagtggtgtaatt

SEQ ID NO: 991495 - DNA, 22 bp, Artificial Sequence
  chemically synthesized
caggaagatggagtggtgtaat

SEQ ID NO: 991496 - DNA, 22 bp, Artificial Sequence
  chemically synthesized
tcaggaagatggagtggtgtaa

SEQ ID NO: 991497 - DNA, 22 bp, Artificial Sequence
  chemically synthesized
gtaattacaccactccatcttc

SEQ ID NO: 991498 - DNA, 22 bp, Artificial Sequence
  chemically synthesized
caccactccatcttcctgaaag

SEQ ID NO: 991499 - DNA, 22 bp, Artificial Sequence
  chemically synthesized
catcttcctgaaagccctcacg

SEQ ID NO: 991500 - DNA, 22 bp, Artificial Sequence
  chemically synthesized
ccatggaggcagcgtgagggct

SEQ ID NO: 991501 - DNA, 22 bp, Artificial Sequence
  chemically synthesized
tgccatggaggcagcgtgaggg

SEQ ID NO: 991502 - DNA, 22 bp, Artificial Sequence
  chemically synthesized
ctgccatggaggcagcgtgagg

SEQ ID NO: 991503 - DNA, 22 bp, Artificial Sequence
  chemically synthesized
cctgaaagccctcacgctgcct

SEQ ID NO: 991504 - DNA, 22 bp, Artificial Sequence
  chemically synthesized
ctgaaagccctcacgctgcctc

SEQ ID NO: 991505 - DNA, 22 bp, Artificial Sequence
  chemically synthesized
tagtttctgccatggaggcagc

SEQ ID NO: 991506 - DNA, 22 bp, Artificial Sequence
  chemically synthesized
aaagccctcacgctgcctccat

SEQ ID NO: 991507 - DNA, 22 bp, Artificial Sequence
  chemically synthesized
attatagtttctgccatggagg

SEQ ID NO: 991508 - DNA, 22 bp, Artificial Sequence
  chemically synthesized
cattatagtttctgccatggag

SEQ ID NO: 991509 - DNA, 22 bp, Artificial Sequence
  chemically synthesized
tcattatagtttctgccatgga

SEQ ID NO: 991510 - DNA, 22 bp, Artificial Sequence
  chemically synthesized
acgctgcctccatggcagaaac

SEQ ID NO: 991511 - DNA, 22 bp, Artificial Sequence
  chemically synthesized
aatgcattttcattatagtttc

SEQ ID NO: 991512 - DNA, 22 bp, Artificial Sequence
  chemically synthesized
cctccatggcagaaactataat

SEQ ID NO: 991513 - DNA, 22 bp, Artificial Sequence
  chemically synthesized
caatgcattttcattatagttt

SEQ ID NO: 991514 - DNA, 22 bp, Artificial Sequence
  chemically synthesized
tcaatgcattttcattatagtt

SEQ ID NO: 991515 - DNA, 22 bp, Artificial Sequence
  chemically synthesized
ttcaatgcattttcattatagt

SEQ ID NO: 991516 - DNA, 22 bp, Artificial Sequence
  chemically synthesized
catggcagaaactataatgaaa

SEQ ID NO: 991517 - DNA, 22 bp, Artificial Sequence
  chemically synthesized
atatttttcaatgcattttcat

SEQ ID NO: 991518 - DNA, 22 bp, Artificial Sequence
  chemically synthesized
cagattgatatttttcaatgca

SEQ ID NO: 991519 - DNA, 22 bp, Artificial Sequence
  chemically synthesized
taatgaaaatgcattgaaaaat

SEQ ID NO: 991520 - DNA, 22 bp, Artificial Sequence
  chemically synthesized
tagaattgcagattgatatttt

SEQ ID NO: 991521 - DNA, 22 bp, Artificial Sequence
  chemically synthesized
attgtagaattgcagattgata

SEQ ID NO: 991522 - DNA, 22 bp, Artificial Sequence
  chemically synthesized
aattgtagaattgcagattgat

SEQ ID NO: 991523 - DNA, 22 bp, Artificial Sequence
  chemically synthesized
gatttaattgtagaattgcaga

SEQ ID NO: 991524 - DNA, 22 bp, Artificial Sequence
  chemically synthesized
aaaaatatcaatctgcaattct

SEQ ID NO: 991525 - DNA, 22 bp, Artificial Sequence
  chemically synthesized
agatttaattgtagaattgcag

SEQ ID NO: 991526 - DNA, 22 bp, Artificial Sequence
  chemically synthesized
tttagatttaattgtagaattg

SEQ ID NO: 991527 - DNA, 22 bp, Artificial Sequence
  chemically synthesized
ttatttagatttaattgtagaa

SEQ ID NO: 991528 - DNA, 22 bp, Artificial Sequence
  chemically synthesized
attatttagatttaattgtaga

SEQ ID NO: 991529 - DNA, 22 bp, Artificial Sequence
  chemically synthesized
tattatttagatttaattgtag

SEQ ID NO: 991530 - DNA, 22 bp, Artificial Sequence
  chemically synthesized
caattctacaattaaatctaaa

SEQ ID NO: 991531 - DNA, 22 bp, Artificial Sequence
  chemically synthesized
tacaattaaatctaaataataa

SEQ ID NO: 991532 - DNA, 22 bp, Artificial Sequence
  chemically synthesized
caattaaatctaaataataaaa

SEQ ID NO: 991533 - DNA, 22 bp, Artificial Sequence
  chemically synthesized
aatctaaataataaaacttggt

SEQ ID NO: 991534 - DNA, 22 bp, Artificial Sequence
  chemically synthesized
aataataaaacttggtatcttt

SEQ ID NO: 991535 - DNA, 22 bp, Artificial Sequence
  chemically synthesized
gaatgtgtggggagaaaagata

SEQ ID NO: 991536 - DNA, 22 bp, Artificial Sequence
  chemically synthesized
tcacatctggaatgtgtgggga

SEQ ID NO: 991537 - DNA, 22 bp, Artificial Sequence
  chemically synthesized
ggtatcttttctccccacacat

SEQ ID NO: 991538 - DNA, 22 bp, Artificial Sequence
  chemically synthesized
atcacatctggaatgtgtgggg

SEQ ID NO: 991539 - DNA, 22 bp, Artificial Sequence
  chemically synthesized
gtatcttttctccccacacatt

SEQ ID NO: 991540 - DNA, 22 bp, Artificial Sequence
  chemically synthesized
tatcacatctggaatgtgtggg

SEQ ID NO: 991541 - DNA, 22 bp, Artificial Sequence
  chemically synthesized
tgttttatcacatctggaatgt

SEQ ID NO: 991542 - DNA, 22 bp, Artificial Sequence
  chemically synthesized
ttctccccacacattccagatg

SEQ ID NO: 991543 - DNA, 22 bp, Artificial Sequence
  chemically synthesized
tctccccacacattccagatgt

SEQ ID NO: 991544 - DNA, 22 bp, Artificial Sequence
  chemically synthesized
ctccccacacattccagatgtg

SEQ ID NO: 991545 - DNA, 22 bp, Artificial Sequence
  chemically synthesized
tctgtgttttatcacatctgga

SEQ ID NO: 991546 - DNA, 22 bp, Artificial Sequence
  chemically synthesized
tccccacacattccagatgtga

SEQ ID NO: 991547 - DNA, 22 bp, Artificial Sequence
  chemically synthesized
cccacacattccagatgtgata

SEQ ID NO: 991548 - DNA, 22 bp, Artificial Sequence
  chemically synthesized
aatgctgtctgtgttttatcac

SEQ ID NO: 991549 - DNA, 22 bp, Artificial Sequence
  chemically synthesized
aaatgctgtctgtgttttatca

SEQ ID NO: 991550 - DNA, 22 bp, Artificial Sequence
  chemically synthesized
aatttaaatgctgtctgtgttt

SEQ ID NO: 991551 - DNA, 22 bp, Artificial Sequence
  chemically synthesized
cagatgtgataaaacacagaca

SEQ ID NO: 991552 - DNA, 22 bp, Artificial Sequence
  chemically synthesized
aaatttaaatgctgtctgtgtt

SEQ ID NO: 991553 - DNA, 22 bp, Artificial Sequence
  chemically synthesized
taaatttaaatgctgtctgtgt

SEQ ID NO: 991554 - DNA, 22 bp, Artificial Sequence
  chemically synthesized
tgttttaaatttaaatgctgtc

SEQ ID NO: 991555 - DNA, 22 bp, Artificial Sequence
  chemically synthesized
tatgttttaaatttaaatgctg

SEQ ID NO: 991556 - DNA, 22 bp, Artificial Sequence
  chemically synthesized
ctatgttttaaatttaaatgct

SEQ ID NO: 991557 - DNA, 22 bp, Artificial Sequence
  chemically synthesized
agcttctatgttttaaatttaa

SEQ ID NO: 991558 - DNA, 22 bp, Artificial Sequence
  chemically synthesized
acattcagcttctatgttttaa

SEQ ID NO: 991559 - DNA, 22 bp, Artificial Sequence
  chemically synthesized
aaatttaaaacatagaagctga

SEQ ID NO: 991560 - DNA, 22 bp, Artificial Sequence
  chemically synthesized
aatttaaaacatagaagctgaa

SEQ ID NO: 991561 - DNA, 22 bp, Artificial Sequence
  chemically synthesized
aaaaataggctgacattcagct

SEQ ID NO: 991562 - DNA, 22 bp, Artificial Sequence
  chemically synthesized
aaaacatagaagctgaatgtca

SEQ ID NO: 991563 - DNA, 22 bp, Artificial Sequence
  chemically synthesized
aaacatagaagctgaatgtcag

SEQ ID NO: 991564 - DNA, 22 bp, Artificial Sequence
  chemically synthesized
gaaatgaggcatgttcaaaaat

SEQ ID NO: 991565 - DNA, 22 bp, Artificial Sequence
  chemically synthesized
aatgtcagcctatttttgaaca

SEQ ID NO: 991566 - DNA, 22 bp, Artificial Sequence
  chemically synthesized
ggaaatgaggcatgttcaaaaa

SEQ ID NO: 991567 - DNA, 22 bp, Artificial Sequence
  chemically synthesized
tggaaatgaggcatgttcaaaa

SEQ ID NO: 991568 - DNA, 22 bp, Artificial Sequence
  chemically synthesized
ctttggaaatgaggcatgttca

SEQ ID NO: 991569 - DNA, 22 bp, Artificial Sequence
  chemically synthesized
actttggaaatgaggcatgttc

SEQ ID NO: 991570 - DNA, 22 bp, Artificial Sequence
  chemically synthesized
tttttgaacatgcctcatttcc

SEQ ID NO: 991571 - DNA, 22 bp, Artificial Sequence
  chemically synthesized
tgaggtttactttggaaatgag

SEQ ID NO: 991572 - DNA, 22 bp, Artificial Sequence
  chemically synthesized
gtgaggtttactttggaaatga

SEQ ID NO: 991573 - DNA, 22 bp, Artificial Sequence
  chemically synthesized
ttgaacatgcctcatttccaaa

SEQ ID NO: 991574 - DNA, 22 bp, Artificial Sequence
  chemically synthesized
tgaacatgcctcatttccaaag

SEQ ID NO: 991575 - DNA, 22 bp, Artificial Sequence
  chemically synthesized
ttgtgaggtttactttggaaat

SEQ ID NO: 991576 - DNA, 22 bp, Artificial Sequence
  chemically synthesized
gaacatgcctcatttccaaagt

SEQ ID NO: 991577 - DNA, 22 bp, Artificial Sequence
  chemically synthesized
aacatgcctcatttccaaagta

SEQ ID NO: 991578 - DNA, 22 bp, Artificial Sequence
  chemically synthesized
tcttgtgaggtttactttggaa

SEQ ID NO: 991579 - DNA, 22 bp, Artificial Sequence
  chemically synthesized
ctcttgtgaggtttactttgga

SEQ ID NO: 991580 - DNA, 22 bp, Artificial Sequence
  chemically synthesized
tctcttgtgaggtttactttgg

SEQ ID NO: 991581 - DNA, 22 bp, Artificial Sequence
  chemically synthesized
ttctcttgtgaggtttactttg

SEQ ID NO: 991582 - DNA, 22 bp, Artificial Sequence
  chemically synthesized
tttctcttgtgaggtttacttt

SEQ ID NO: 991583 - DNA, 22 bp, Artificial Sequence
  chemically synthesized
ttttctcttgtgaggtttactt

SEQ ID NO: 991584 - DNA, 22 bp, Artificial Sequence
  chemically synthesized
ttttttctcttgtgaggtttac

SEQ ID NO: 991585 - DNA, 22 bp, Artificial Sequence
  chemically synthesized
atttccaaagtaaacctcacaa

SEQ ID NO: 991586 - DNA, 22 bp, Artificial Sequence
  chemically synthesized
ccaaagtaaacctcacaagaga

SEQ ID NO: 991587 - DNA, 22 bp, Artificial Sequence
  chemically synthesized
caaagtaaacctcacaagagaa

SEQ ID NO: 991588 - DNA, 22 bp, Artificial Sequence
  chemically synthesized
ataacctcttttttctcttgtg

SEQ ID NO: 991589 - DNA, 22 bp, Artificial Sequence
  chemically synthesized
aataacctcttttttctcttgt

SEQ ID NO: 991590 - DNA, 22 bp, Artificial Sequence
  chemically synthesized
tatttaataacctcttttttct

SEQ ID NO: 991591 - DNA, 22 bp, Artificial Sequence
  chemically synthesized
ctgtatttaataacctcttttt

SEQ ID NO: 991592 - DNA, 22 bp, Artificial Sequence
  chemically synthesized
gctgtatttaataacctctttt

SEQ ID NO: 991593 - DNA, 22 bp, Artificial Sequence
  chemically synthesized
tgctgtatttaataacctcttt

SEQ ID NO: 991594 - DNA, 22 bp, Artificial Sequence
  chemically synthesized
ttgctgtatttaataacctctt

SEQ ID NO: 991595 - DNA, 22 bp, Artificial Sequence
  chemically synthesized
acaagagaaaaaagaggttatt

SEQ ID NO: 991596 - DNA, 22 bp, Artificial Sequence
  chemically synthesized
tttgctgtatttaataacctct

SEQ ID NO: 991597 - DNA, 22 bp, Artificial Sequence
  chemically synthesized
ttttttgctgtatttaataacc

SEQ ID NO: 991598 - DNA, 22 bp, Artificial Sequence
  chemically synthesized
ttattttttgctgtatttaata

SEQ ID NO: 991599 - DNA, 22 bp, Artificial Sequence
  chemically synthesized
aatgttgttattttttgctgta

SEQ ID NO: 991600 - DNA, 22 bp, Artificial Sequence
  chemically synthesized
gaatgttgttattttttgctgt

SEQ ID NO: 991601 - DNA, 22 bp, Artificial Sequence
  chemically synthesized
ttaaatacagcaaaaaataaca

SEQ ID NO: 991602 - DNA, 22 bp, Artificial Sequence
  chemically synthesized
cacatttgaatgttgttatttt

SEQ ID NO: 991603 - DNA, 22 bp, Artificial Sequence
  chemically synthesized
aatacagcaaaaaataacaaca

SEQ ID NO: 991604 - DNA, 22 bp, Artificial Sequence
  chemically synthesized
ttgcacatttgaatgttgttat

SEQ ID NO: 991605 - DNA, 22 bp, Artificial Sequence
  chemically synthesized
tgttgcacatttgaatgttgtt

SEQ ID NO: 991606 - DNA, 22 bp, Artificial Sequence
  chemically synthesized
tctgttgcacatttgaatgttg

SEQ ID NO: 991607 - DNA, 22 bp, Artificial Sequence
  chemically synthesized
tgggttctctgttgcacatttg

SEQ ID NO: 991608 - DNA, 22 bp, Artificial Sequence
  chemically synthesized
aaatgtgcaacagagaacccat

SEQ ID NO: 991609 - DNA, 22 bp, Artificial Sequence
  chemically synthesized
ataaagggaaaacagttatggg

SEQ ID NO: 991610 - DNA, 22 bp, Artificial Sequence
  chemically synthesized
aataaagggaaaacagttatgg

SEQ ID NO: 991611 - DNA, 22 bp, Artificial Sequence
  chemically synthesized
taataaagggaaaacagttatg

SEQ ID NO: 991612 - DNA, 22 bp, Artificial Sequence
  chemically synthesized
tgttttaataaagggaaaacag

SEQ ID NO: 991613 - DNA, 22 bp, Artificial Sequence
  chemically synthesized
tggtgtatgctgtgttttaata

SEQ ID NO: 991614 - DNA, 22 bp, Artificial Sequence
  chemically synthesized
atggtgtatgctgtgttttaat

SEQ ID NO: 991615 - DNA, 22 bp, Artificial Sequence
  chemically synthesized
ttttccctttattaaaacacag

SEQ ID NO: 991616 - DNA, 22 bp, Artificial Sequence
  chemically synthesized
tccctttattaaaacacagcat

SEQ ID NO: 991617 - DNA, 22 bp, Artificial Sequence
  chemically synthesized
ccctttattaaaacacagcata

SEQ ID NO: 991618 - DNA, 22 bp, Artificial Sequence
  chemically synthesized
cctttattaaaacacagcatac

SEQ ID NO: 991619 - DNA, 22 bp, Artificial Sequence
  chemically synthesized
tattaaaacacagcatacacca

SEQ ID NO: 991620 - DNA, 22 bp, Artificial Sequence
  chemically synthesized
attaaaacacagcatacaccat

SEQ ID NO: 991621 - DNA, 22 bp, Artificial Sequence
  chemically synthesized
ttaaaacacagcatacaccata

SEQ ID NO: 991622 - DNA, 22 bp, Artificial Sequence
  chemically synthesized
aaacacagcatacaccataagt

SEQ ID NO: 991623 - DNA, 22 bp, Artificial Sequence
  chemically synthesized
aagtaaatgcatcacttatggt

SEQ ID NO: 991624 - DNA, 22 bp, Artificial Sequence
  chemically synthesized
gaagtaaatgcatcacttatgg

SEQ ID NO: 991625 - DNA, 22 bp, Artificial Sequence
  chemically synthesized
tgaagtaaatgcatcacttatg

SEQ ID NO: 991626 - DNA, 22 bp, Artificial Sequence
  chemically synthesized
ctttgaagtaaatgcatcactt

SEQ ID NO: 991627 - DNA, 22 bp, Artificial Sequence
  chemically synthesized
tgctttgaagtaaatgcatcac

SEQ ID NO: 991628 - DNA, 22 bp, Artificial Sequence
  chemically synthesized
aaatgcctctgctttgaagtaa

SEQ ID NO: 991629 - DNA, 22 bp, Artificial Sequence
  chemically synthesized
atcattgaaatgcctctgcttt

SEQ ID NO: 991630 - DNA, 22 bp, Artificial Sequence
  chemically synthesized
aatcattgaaatgcctctgctt

SEQ ID NO: 991631 - DNA, 22 bp, Artificial Sequence
  chemically synthesized
acttcaaagcagaggcatttca

SEQ ID NO: 991632 - DNA, 22 bp, Artificial Sequence
  chemically synthesized
tgatttaatcattgaaatgcct

SEQ ID NO: 991633 - DNA, 22 bp, Artificial Sequence
  chemically synthesized
cttcaaagcagaggcatttcaa

SEQ ID NO: 991634 - DNA, 22 bp, Artificial Sequence
  chemically synthesized
caaagcagaggcatttcaatga

SEQ ID NO: 991635 - DNA, 22 bp, Artificial Sequence
  chemically synthesized
aaagcagaggcatttcaatgat

SEQ ID NO: 991636 - DNA, 22 bp, Artificial Sequence
  chemically synthesized
ggttgtgatttaatcattgaaa

SEQ ID NO: 991637 - DNA, 22 bp, Artificial Sequence
  chemically synthesized
cggttgtgatttaatcattgaa

SEQ ID NO: 991638 - DNA, 22 bp, Artificial Sequence
  chemically synthesized
tacacttcggttgtgatttaat

SEQ ID NO: 991639 - DNA, 22 bp, Artificial Sequence
  chemically synthesized
gtacacttcggttgtgatttaa

SEQ ID NO: 991640 - DNA, 22 bp, Artificial Sequence
  chemically synthesized
tgtacacttcggttgtgattta

SEQ ID NO: 991641 - DNA, 22 bp, Artificial Sequence
  chemically synthesized
cctttgtacacttcggttgtga

SEQ ID NO: 991642 - DNA, 22 bp, Artificial Sequence
  chemically synthesized
caatgattaaatcacaaccgaa

SEQ ID NO: 991643 - DNA, 22 bp, Artificial Sequence
  chemically synthesized
acctttgtacacttcggttgtg

SEQ ID NO: 991644 - DNA, 22 bp, Artificial Sequence
  chemically synthesized
aatgattaaatcacaaccgaag

SEQ ID NO: 991645 - DNA, 22 bp, Artificial Sequence
  chemically synthesized
tacctttgtacacttcggttgt

SEQ ID NO: 991646 - DNA, 22 bp, Artificial Sequence
  chemically synthesized
aattttacctttgtacacttcg

SEQ ID NO: 991647 - DNA, 22 bp, Artificial Sequence
  chemically synthesized
taaattttacctttgtacactt

SEQ ID NO: 991648 - DNA, 22 bp, Artificial Sequence
  chemically synthesized
aatcacaaccgaagtgtacaaa

SEQ ID NO: 991649 - DNA, 22 bp, Artificial Sequence
  chemically synthesized
ctaaattttacctttgtacact

SEQ ID NO: 991650 - DNA, 22 bp, Artificial Sequence
  chemically synthesized
cacttctaaattttacctttgt

SEQ ID NO: 991651 - DNA, 22 bp, Artificial Sequence
  chemically synthesized
gcacttctaaattttacctttg

SEQ ID NO: 991652 - DNA, 22 bp, Artificial Sequence
  chemically synthesized
tgcacttctaaattttaccttt

SEQ ID NO: 991653 - DNA, 22 bp, Artificial Sequence
  chemically synthesized
gaagataaagatacctttgcac

SEQ ID NO: 991654 - DNA, 22 bp, Artificial Sequence
  chemically synthesized
ggaagataaagatacctttgca

SEQ ID NO: 991655 - DNA, 22 bp, Artificial Sequence
  chemically synthesized
gacttggaagataaagatacct

SEQ ID NO: 991656 - DNA, 22 bp, Artificial Sequence
  chemically synthesized
agaagtgcaaaggtatctttat

SEQ ID NO: 991657 - DNA, 22 bp, Artificial Sequence
  chemically synthesized
gaagtgcaaaggtatctttatc

SEQ ID NO: 991658 - DNA, 22 bp, Artificial Sequence
  chemically synthesized
tatcttccaagtccagttactt

SEQ ID NO: 991659 - DNA, 22 bp, Artificial Sequence
  chemically synthesized
atcttccaagtccagttacttg

SEQ ID NO: 991660 - DNA, 22 bp, Artificial Sequence
  chemically synthesized
tcttccaagtccagttacttgt

SEQ ID NO: 991661 - DNA, 22 bp, Artificial Sequence
  chemically synthesized
gaaaaaatagccagaacaagta

SEQ ID NO: 991662 - DNA, 22 bp, Artificial Sequence
  chemically synthesized
ccaagtccagttacttgttctg

SEQ ID NO: 991663 - DNA, 22 bp, Artificial Sequence
  chemically synthesized
agaaaaaatagccagaacaagt

SEQ ID NO: 991664 - DNA, 22 bp, Artificial Sequence
  chemically synthesized
caagtccagttacttgttctgg

SEQ ID NO: 991665 - DNA, 22 bp, Artificial Sequence
  chemically synthesized
agtaagagtttagaaaaaatag

SEQ ID NO: 991666 - DNA, 22 bp, Artificial Sequence
  chemically synthesized
cagtaagagtttagaaaaaata

SEQ ID NO: 991667 - DNA, 22 bp, Artificial Sequence
  chemically synthesized
cttgttctggctattttttcta

SEQ ID NO: 991668 - DNA, 22 bp, Artificial Sequence
  chemically synthesized
tcagtaagagtttagaaaaaat

SEQ ID NO: 991669 - DNA, 22 bp, Artificial Sequence
  chemically synthesized
gttctggctattttttctaaac

SEQ ID NO: 991670 - DNA, 22 bp, Artificial Sequence
  chemically synthesized
ctttcagtaagagtttagaaaa

SEQ ID NO: 991671 - DNA, 22 bp, Artificial Sequence
  chemically synthesized
ttctggctattttttctaaact

SEQ ID NO: 991672 - DNA, 22 bp, Artificial Sequence
  chemically synthesized
cctttcagtaagagtttagaaa

SEQ ID NO: 991673 - DNA, 22 bp, Artificial Sequence
  chemically synthesized
tcctttcagtaagagtttagaa

SEQ ID NO: 991674 - DNA, 22 bp, Artificial Sequence
  chemically synthesized
tggctattttttctaaactctt

SEQ ID NO: 991675 - DNA, 22 bp, Artificial Sequence
  chemically synthesized
gctattttttctaaactcttac

SEQ ID NO: 991676 - DNA, 22 bp, Artificial Sequence
  chemically synthesized
ttttttctaaactcttactgaa

SEQ ID NO: 991677 - DNA, 22 bp, Artificial Sequence
  chemically synthesized
agtgaggttttcctttcagtaa

SEQ ID NO: 991678 - DNA, 22 bp, Artificial Sequence
  chemically synthesized
tttctaaactcttactgaaagg

SEQ ID NO: 991679 - DNA, 22 bp, Artificial Sequence
  chemically synthesized
ttctaaactcttactgaaagga

SEQ ID NO: 991680 - DNA, 22 bp, Artificial Sequence
  chemically synthesized
tctaaactcttactgaaaggaa

SEQ ID NO: 991681 - DNA, 22 bp, Artificial Sequence
  chemically synthesized
ttaagtgaggttttcctttcag

SEQ ID NO: 991682 - DNA, 22 bp, Artificial Sequence
  chemically synthesized
ctaaactcttactgaaaggaaa

SEQ ID NO: 991683 - DNA, 22 bp, Artificial Sequence
  chemically synthesized
taaactcttactgaaaggaaaa

SEQ ID NO: 991684 - DNA, 22 bp, Artificial Sequence
  chemically synthesized
aactcttactgaaaggaaaacc

SEQ ID NO: 991685 - DNA, 22 bp, Artificial Sequence
  chemically synthesized
aaagttattaagtgaggttttc

SEQ ID NO: 991686 - DNA, 22 bp, Artificial Sequence
  chemically synthesized
aaaagttattaagtgaggtttt

SEQ ID NO: 991687 - DNA, 22 bp, Artificial Sequence
  chemically synthesized
ttactgaaaggaaaacctcact

SEQ ID NO: 991688 - DNA, 22 bp, Artificial Sequence
  chemically synthesized
taaaagttattaagtgaggttt

SEQ ID NO: 991689 - DNA, 22 bp, Artificial Sequence
  chemically synthesized
ttaaaagttattaagtgaggtt

SEQ ID NO: 991690 - DNA, 22 bp, Artificial Sequence
  chemically synthesized
actgaaaggaaaacctcactta

SEQ ID NO: 991691 - DNA, 22 bp, Artificial Sequence
  chemically synthesized
ctgaaaggaaaacctcacttaa

SEQ ID NO: 991692 - DNA, 22 bp, Artificial Sequence
  chemically synthesized
aaaggaaaacctcacttaataa

SEQ ID NO: 991693 - DNA, 22 bp, Artificial Sequence
  chemically synthesized
tatttttaaaagttattaagtg

SEQ ID NO: 991694 - DNA, 22 bp, Artificial Sequence
  chemically synthesized
atatttttaaaagttattaagt

SEQ ID NO: 991695 - DNA, 22 bp, Artificial Sequence
  chemically synthesized
tttatatttttaaaagttatta

SEQ ID NO: 991696 - DNA, 22 bp, Artificial Sequence
  chemically synthesized
atttatatttttaaaagttatt

SEQ ID NO: 991697 - DNA, 22 bp, Artificial Sequence
  chemically synthesized
tatttatatttttaaaagttat

SEQ ID NO: 991698 - DNA, 22 bp, Artificial Sequence
  chemically synthesized
ttatttatatttttaaaagtta

SEQ ID NO: 991699 - DNA, 22 bp, Artificial Sequence
  chemically synthesized
tttatttatatttttaaaagtt

SEQ ID NO: 991700 - DNA, 22 bp, Artificial Sequence
  chemically synthesized
ttttttatttatatttttaaaa

SEQ ID NO: 991701 - DNA, 22 bp, Artificial Sequence
  chemically synthesized
attttttatttatatttttaaa

SEQ ID NO: 991702 - DNA, 22 bp, Artificial Sequence
  chemically synthesized
acttaataacttttaaaaatat

SEQ ID NO: 991703 - DNA, 22 bp, Artificial Sequence
  chemically synthesized
aataacttttaaaaatataaat

SEQ ID NO: 991704 - DNA, 22 bp, Artificial Sequence
  chemically synthesized
ataacttttaaaaatataaata

SEQ ID NO: 991705 - DNA, 22 bp, Artificial Sequence
  chemically synthesized
ttaaaaatataaataaaaaata

SEQ ID NO: 991706 - DNA, 22 bp, Artificial Sequence
  chemically synthesized
taaaaatataaataaaaaataa

SEQ ID NO: 991707 - DNA, 22 bp, Artificial Sequence
  chemically synthesized
aaaaatataaataaaaaataaa

SEQ ID NO: 991708 - DNA, 22 bp, Artificial Sequence
  chemically synthesized
aaaatataaataaaaaataaat

SEQ ID NO: 991709 - DNA, 22 bp, Artificial Sequence
  chemically synthesized
tgtaaagaagataatgatttat

SEQ ID NO: 991710 - DNA, 22 bp, Artificial Sequence
  chemically synthesized
acatacggttatgtaaagaaga

SEQ ID NO: 991711 - DNA, 22 bp, Artificial Sequence
  chemically synthesized
caattaacatacggttatgtaa

SEQ ID NO: 991712 - DNA, 22 bp, Artificial Sequence
  chemically synthesized
gcaattaacatacggttatgta

SEQ ID NO: 991713 - DNA, 22 bp, Artificial Sequence
  chemically synthesized
tgcaattaacatacggttatgt

SEQ ID NO: 991714 - DNA, 22 bp, Artificial Sequence
  chemically synthesized
tcttctttacataaccgtatgt

SEQ ID NO: 991715 - DNA, 22 bp, Artificial Sequence
  chemically synthesized
ctttacataaccgtatgttaat

SEQ ID NO: 991716 - DNA, 22 bp, Artificial Sequence
  chemically synthesized
tttacataaccgtatgttaatt

SEQ ID NO: 991717 - DNA, 22 bp, Artificial Sequence
  chemically synthesized
aagtaattttgcaattaacata

SEQ ID NO: 991718 - DNA, 22 bp, Artificial Sequence
  chemically synthesized
tacataaccgtatgttaattgc

SEQ ID NO: 991719 - DNA, 22 bp, Artificial Sequence
  chemically synthesized
acataaccgtatgttaattgca

SEQ ID NO: 991720 - DNA, 22 bp, Artificial Sequence
  chemically synthesized
cataaccgtatgttaattgcaa

SEQ ID NO: 991721 - DNA, 22 bp, Artificial Sequence
  chemically synthesized
gttcaagtaattttgcaattaa

SEQ ID NO: 991722 - DNA, 22 bp, Artificial Sequence
  chemically synthesized
agttcaagtaattttgcaatta

SEQ ID NO: 991723 - DNA, 22 bp, Artificial Sequence
  chemically synthesized
tagttcaagtaattttgcaatt

SEQ ID NO: 991724 - DNA, 22 bp, Artificial Sequence
  chemically synthesized
tttagttcaagtaattttgcaa

SEQ ID NO: 991725 - DNA, 22 bp, Artificial Sequence
  chemically synthesized
attgcaaaattacttgaactaa

SEQ ID NO: 991726 - DNA, 22 bp, Artificial Sequence
  chemically synthesized
caaaattacttgaactaaagag

SEQ ID NO: 991727 - DNA, 22 bp, Artificial Sequence
  chemically synthesized
tgtcatcgtatatctctttagt

SEQ ID NO: 991728 - DNA, 22 bp, Artificial Sequence
  chemically synthesized
cttgaactaaagagatatacga

SEQ ID NO: 991729 - DNA, 22 bp, Artificial Sequence
  chemically synthesized
catactatgtcatcgtatatct

SEQ ID NO: 991730 - DNA, 22 bp, Artificial Sequence
  chemically synthesized
gaactaaagagatatacgatga

SEQ ID NO: 991731 - DNA, 22 bp, Artificial Sequence
  chemically synthesized
aactaaagagatatacgatgac

SEQ ID NO: 991732 - DNA, 22 bp, Artificial Sequence
  chemically synthesized
agttgcatactatgtcatcgta

SEQ ID NO: 991733 - DNA, 22 bp, Artificial Sequence
  chemically synthesized
gagttgcatactatgtcatcgt

SEQ ID NO: 991734 - DNA, 22 bp, Artificial Sequence
  chemically synthesized
aagagatatacgatgacatagt

SEQ ID NO: 991735 - DNA, 22 bp, Artificial Sequence
  chemically synthesized
tttgagttgcatactatgtcat

SEQ ID NO: 991736 - DNA, 22 bp, Artificial Sequence
  chemically synthesized
taacaagttatttgagttgcat

SEQ ID NO: 991737 - DNA, 22 bp, Artificial Sequence
  chemically synthesized
gtaacaagttatttgagttgca

SEQ ID NO: 991738 - DNA, 22 bp, Artificial Sequence
  chemically synthesized
tgtaacaagttatttgagttgc

SEQ ID NO: 991739 - DNA, 22 bp, Artificial Sequence
  chemically synthesized
tttgtaacaagttatttgagtt

SEQ ID NO: 991740 - DNA, 22 bp, Artificial Sequence
  chemically synthesized
ctttgtaacaagttatttgagt

SEQ ID NO: 991741 - DNA, 22 bp, Artificial Sequence
  chemically synthesized
ggatgaaaatttctttgtaaca

SEQ ID NO: 991742 - DNA, 22 bp, Artificial Sequence
  chemically synthesized
aggatgaaaatttctttgtaac

SEQ ID NO: 991743 - DNA, 22 bp, Artificial Sequence
  chemically synthesized
taggatgaaaatttctttgtaa

SEQ ID NO: 991744 - DNA, 22 bp, Artificial Sequence
  chemically synthesized
aaataacttgttacaaagaaat

SEQ ID NO: 991745 - DNA, 22 bp, Artificial Sequence
  chemically synthesized
aagttttaggatgaaaatttct

SEQ ID NO: 991746 - DNA, 22 bp, Artificial Sequence
  chemically synthesized
ttcaagttttaggatgaaaatt

SEQ ID NO: 991747 - DNA, 22 bp, Artificial Sequence
  chemically synthesized
gttcaagttttaggatgaaaat

SEQ ID NO: 991748 - DNA, 22 bp, Artificial Sequence
  chemically synthesized
gttacaaagaaattttcatcct

SEQ ID NO: 991749 - DNA, 22 bp, Artificial Sequence
  chemically synthesized
ttacaaagaaattttcatccta

SEQ ID NO: 991750 - DNA, 22 bp, Artificial Sequence
  chemically synthesized
atttgttcaagttttaggatga

SEQ ID NO: 991751 - DNA, 22 bp, Artificial Sequence
  chemically synthesized
caaagaaattttcatcctaaaa

SEQ ID NO: 991752 - DNA, 22 bp, Artificial Sequence
  chemically synthesized
gatttgttcaagttttaggatg

SEQ ID NO: 991753 - DNA, 22 bp, Artificial Sequence
  chemically synthesized
caaaaagtttgatttgttcaag

SEQ ID NO: 991754 - DNA, 22 bp, Artificial Sequence
  chemically synthesized
tcatcctaaaacttgaacaaat

SEQ ID NO: 991755 - DNA, 22 bp, Artificial Sequence
  chemically synthesized
catcctaaaacttgaacaaatc

SEQ ID NO: 991756 - DNA, 22 bp, Artificial Sequence
  chemically synthesized
atcctaaaacttgaacaaatca

SEQ ID NO: 991757 - DNA, 22 bp, Artificial Sequence
  chemically synthesized
ctgcaaaaagtttgatttgttc

SEQ ID NO: 991758 - DNA, 22 bp, Artificial Sequence
  chemically synthesized
aaacttgaacaaatcaaacttt

SEQ ID NO: 991759 - DNA, 22 bp, Artificial Sequence
  chemically synthesized
gaacaaatcaaactttttgcag

SEQ ID NO: 991760 - DNA, 22 bp, Artificial Sequence
  chemically synthesized
agaaaaatactactgcaaaaag

SEQ ID NO: 991761 - DNA, 22 bp, Artificial Sequence
  chemically synthesized
aacaaatcaaactttttgcagt

SEQ ID NO: 991762 - DNA, 22 bp, Artificial Sequence
  chemically synthesized
tctgagaaaaatactactgcaa

SEQ ID NO: 991763 - DNA, 22 bp, Artificial Sequence
  chemically synthesized
atctgagaaaaatactactgca

SEQ ID NO: 991764 - DNA, 22 bp, Artificial Sequence
  chemically synthesized
tatctgagaaaaatactactgc

SEQ ID NO: 991765 - DNA, 22 bp, Artificial Sequence
  chemically synthesized
tgttttatctgagaaaaatact

SEQ ID NO: 991766 - DNA, 22 bp, Artificial Sequence
  chemically synthesized
tttgcagtagtatttttctcag

SEQ ID NO: 991767 - DNA, 22 bp, Artificial Sequence
  chemically synthesized
ttgcagtagtatttttctcaga

SEQ ID NO: 991768 - DNA, 22 bp, Artificial Sequence
  chemically synthesized
tactgtgttttatctgagaaaa

SEQ ID NO: 991769 - DNA, 22 bp, Artificial Sequence
  chemically synthesized
tgcagtagtatttttctcagat

SEQ ID NO: 991770 - DNA, 22 bp, Artificial Sequence
  chemically synthesized
gcagtagtatttttctcagata

SEQ ID NO: 991771 - DNA, 22 bp, Artificial Sequence
  chemically synthesized
tatactgtgttttatctgagaa

SEQ ID NO: 991772 - DNA, 22 bp, Artificial Sequence
  chemically synthesized
cagtagtatttttctcagataa

SEQ ID NO: 991773 - DNA, 22 bp, Artificial Sequence
  chemically synthesized
aacctctatactgtgttttatc

SEQ ID NO: 991774 - DNA, 22 bp, Artificial Sequence
  chemically synthesized
ggttgaacctctatactgtgtt

SEQ ID NO: 991775 - DNA, 22 bp, Artificial Sequence
  chemically synthesized
ttctcagataaaacacagtata

SEQ ID NO: 991776 - DNA, 22 bp, Artificial Sequence
  chemically synthesized
tctcagataaaacacagtatag

SEQ ID NO: 991777 - DNA, 22 bp, Artificial Sequence
  chemically synthesized
ctcagataaaacacagtataga

SEQ ID NO: 991778 - DNA, 22 bp, Artificial Sequence
  chemically synthesized
tcagataaaacacagtatagag

SEQ ID NO: 991779 - DNA, 22 bp, Artificial Sequence
  chemically synthesized
agataaaacacagtatagaggt

SEQ ID NO: 991780 - DNA, 22 bp, Artificial Sequence
  chemically synthesized
agaaacactaggttgaacctct

SEQ ID NO: 991781 - DNA, 22 bp, Artificial Sequence
  chemically synthesized
tgtcacattaagaaacactagg

SEQ ID NO: 991782 - DNA, 22 bp, Artificial Sequence
  chemically synthesized
gtgtcacattaagaaacactag

SEQ ID NO: 991783 - DNA, 22 bp, Artificial Sequence
  chemically synthesized
tgtgtcacattaagaaacacta

SEQ ID NO: 991784 - DNA, 22 bp, Artificial Sequence
  chemically synthesized
ctttgtgtcacattaagaaaca

SEQ ID NO: 991785 - DNA, 22 bp, Artificial Sequence
  chemically synthesized
aacctagtgtttcttaatgtga

SEQ ID NO: 991786 - DNA, 22 bp, Artificial Sequence
  chemically synthesized
gtgtttcttaatgtgacacaaa

SEQ ID NO: 991787 - DNA, 22 bp, Artificial Sequence
  chemically synthesized
gaatatcaaattgctttgtgtc

SEQ ID NO: 991788 - DNA, 22 bp, Artificial Sequence
  chemically synthesized
ggaatatcaaattgctttgtgt

SEQ ID NO: 991789 - DNA, 22 bp, Artificial Sequence
  chemically synthesized
cttaatgtgacacaaagcaatt

SEQ ID NO: 991790 - DNA, 22 bp, Artificial Sequence
  chemically synthesized
cttggaatatcaaattgctttg

SEQ ID NO: 991791 - DNA, 22 bp, Artificial Sequence
  chemically synthesized
ttaatgtgacacaaagcaattt

SEQ ID NO: 991792 - DNA, 22 bp, Artificial Sequence
  chemically synthesized
ccttggaatatcaaattgcttt

SEQ ID NO: 991793 - DNA, 22 bp, Artificial Sequence
  chemically synthesized
aatgtgacacaaagcaatttga

SEQ ID NO: 991794 - DNA, 22 bp, Artificial Sequence
  chemically synthesized
atgtgacacaaagcaatttgat

SEQ ID NO: 991795 - DNA, 22 bp, Artificial Sequence
  chemically synthesized
ccttccttggaatatcaaattg

SEQ ID NO: 991796 - DNA, 22 bp, Artificial Sequence
  chemically synthesized
tatatacatagctgccttcctt

SEQ ID NO: 991797 - DNA, 22 bp, Artificial Sequence
  chemically synthesized
atatatacatagctgccttcct

SEQ ID NO: 991798 - DNA, 22 bp, Artificial Sequence
  chemically synthesized
gatattccaaggaaggcagcta

SEQ ID NO: 991799 - DNA, 22 bp, Artificial Sequence
  chemically synthesized
atattccaaggaaggcagctat

SEQ ID NO: 991800 - DNA, 22 bp, Artificial Sequence
  chemically synthesized
agtttatatatacatagctgcc

SEQ ID NO: 991801 - DNA, 22 bp, Artificial Sequence
  chemically synthesized
tcagtttatatatacatagctg

SEQ ID NO: 991802 - DNA, 22 bp, Artificial Sequence
  chemically synthesized
ctcagtttatatatacatagct

SEQ ID NO: 991803 - DNA, 22 bp, Artificial Sequence
  chemically synthesized
caaggaaggcagctatgtatat

SEQ ID NO: 991804 - DNA, 22 bp, Artificial Sequence
  chemically synthesized
aaagcagccttctcagtttata

SEQ ID NO: 991805 - DNA, 22 bp, Artificial Sequence
  chemically synthesized
tgaaagcagccttctcagttta

SEQ ID NO: 991806 - DNA, 22 bp, Artificial Sequence
  chemically synthesized
ctgaaagcagccttctcagttt

SEQ ID NO: 991807 - DNA, 22 bp, Artificial Sequence
  chemically synthesized
tctgaaagcagccttctcagtt

SEQ ID NO: 991808 - DNA, 22 bp, Artificial Sequence
  chemically synthesized
tgtatatataaactgagaaggc

SEQ ID NO: 991809 - DNA, 22 bp, Artificial Sequence
  chemically synthesized
ttttctgaaagcagccttctca

SEQ ID NO: 991810 - DNA, 22 bp, Artificial Sequence
  chemically synthesized
attgttttctgaaagcagcctt

SEQ ID NO: 991811 - DNA, 22 bp, Artificial Sequence
  chemically synthesized
gattgttttctgaaagcagcct

SEQ ID NO: 991812 - DNA, 22 bp, Artificial Sequence
  chemically synthesized
agaaggctgctttcagaaaaca

SEQ ID NO: 991813 - DNA, 22 bp, Artificial Sequence
  chemically synthesized
gagaaccttgattgttttctga

SEQ ID NO: 991814 - DNA, 22 bp, Artificial Sequence
  chemically synthesized
agagaaccttgattgttttctg

SEQ ID NO: 991815 - DNA, 22 bp, Artificial Sequence
  chemically synthesized
cttagagaaccttgattgtttt

SEQ ID NO: 991816 - DNA, 22 bp, Artificial Sequence
  chemically synthesized
gcttagagaaccttgattgttt

SEQ ID NO: 991817 - DNA, 22 bp, Artificial Sequence
  chemically synthesized
tgcttagagaaccttgattgtt

SEQ ID NO: 991818 - DNA, 22 bp, Artificial Sequence
  chemically synthesized
ctttcagaaaacaatcaaggtt

SEQ ID NO: 991819 - DNA, 22 bp, Artificial Sequence
  chemically synthesized
ctttgcttagagaaccttgatt

SEQ ID NO: 991820 - DNA, 22 bp, Artificial Sequence
  chemically synthesized
tcagaaaacaatcaaggttctc

SEQ ID NO: 991821 - DNA, 22 bp, Artificial Sequence
  chemically synthesized
cagaaaacaatcaaggttctct

SEQ ID NO: 991822 - DNA, 22 bp, Artificial Sequence
  chemically synthesized
agaaaacaatcaaggttctcta

SEQ ID NO: 991823 - DNA, 22 bp, Artificial Sequence
  chemically synthesized
tcataaaaccctgctttgctta

SEQ ID NO: 991824 - DNA, 22 bp, Artificial Sequence
  chemically synthesized
atcataaaaccctgctttgctt

SEQ ID NO: 991825 - DNA, 22 bp, Artificial Sequence
  chemically synthesized
tatcataaaaccctgctttgct

SEQ ID NO: 991826 - DNA, 22 bp, Artificial Sequence
  chemically synthesized
tctaagcaaagcagggttttat

SEQ ID NO: 991827 - DNA, 22 bp, Artificial Sequence
  chemically synthesized
taagcaaagcagggttttatga

SEQ ID NO: 991828 - DNA, 22 bp, Artificial Sequence
  chemically synthesized
agcaaagcagggttttatgata

SEQ ID NO: 991829 - DNA, 22 bp, Artificial Sequence
  chemically synthesized
agtgtgagtaccatgaaacttt

SEQ ID NO: 991830 - DNA, 22 bp, Artificial Sequence
  chemically synthesized
tatgataaagtttcatggtact

SEQ ID NO: 991831 - DNA, 22 bp, Artificial Sequence
  chemically synthesized
aaattcagtgtgagtaccatga

SEQ ID NO: 991832 - DNA, 22 bp, Artificial Sequence
  chemically synthesized
atgataaagtttcatggtactc

SEQ ID NO: 991833 - DNA, 22 bp, Artificial Sequence
  chemically synthesized
tgataaagtttcatggtactca

SEQ ID NO: 991834 - DNA, 22 bp, Artificial Sequence
  chemically synthesized
aagcagtcattaaaattcagtg

SEQ ID NO: 991835 - DNA, 22 bp, Artificial Sequence
  chemically synthesized
catggtactcacactgaatttt

SEQ ID NO: 991836 - DNA, 22 bp, Artificial Sequence
  chemically synthesized
atggtactcacactgaatttta

SEQ ID NO: 991837 - DNA, 22 bp, Artificial Sequence
  chemically synthesized
ctaaagcagtcattaaaattca

SEQ ID NO: 991838 - DNA, 22 bp, Artificial Sequence
  chemically synthesized
actaaagcagtcattaaaattc

SEQ ID NO: 991839 - DNA, 22 bp, Artificial Sequence
  chemically synthesized
tactaaagcagtcattaaaatt

SEQ ID NO: 991840 - DNA, 22 bp, Artificial Sequence
  chemically synthesized
ctttactaaagcagtcattaaa

SEQ ID NO: 991841 - DNA, 22 bp, Artificial Sequence
  chemically synthesized
tgctttactaaagcagtcatta

SEQ ID NO: 991842 - DNA, 22 bp, Artificial Sequence
  chemically synthesized
acactgaattttaatgactgct

SEQ ID NO: 991843 - DNA, 22 bp, Artificial Sequence
  chemically synthesized
ctgctttactaaagcagtcatt

SEQ ID NO: 991844 - DNA, 22 bp, Artificial Sequence
  chemically synthesized
tctgctttactaaagcagtcat

SEQ ID NO: 991845 - DNA, 22 bp, Artificial Sequence
  chemically synthesized
tttctgctttactaaagcagtc

SEQ ID NO: 991846 - DNA, 22 bp, Artificial Sequence
  chemically synthesized
tctttctgctttactaaagcag

SEQ ID NO: 991847 - DNA, 22 bp, Artificial Sequence
  chemically synthesized
aattttaatgactgctttagta

SEQ ID NO: 991848 - DNA, 22 bp, Artificial Sequence
  chemically synthesized
tctctttctgctttactaaagc

SEQ ID NO: 991849 - DNA, 22 bp, Artificial Sequence
  chemically synthesized
ctctctttctgctttactaaag

SEQ ID NO: 991850 - DNA, 22 bp, Artificial Sequence
  chemically synthesized
tctctctttctgctttactaaa

SEQ ID NO: 991851 - DNA, 22 bp, Artificial Sequence
  chemically synthesized
taatgactgctttagtaaagca

SEQ ID NO: 991852 - DNA, 22 bp, Artificial Sequence
  chemically synthesized
aatgactgctttagtaaagcag

SEQ ID NO: 991853 - DNA, 22 bp, Artificial Sequence
  chemically synthesized
atgactgctttagtaaagcaga

SEQ ID NO: 991854 - DNA, 22 bp, Artificial Sequence
  chemically synthesized
aattttctctctttctgcttta

SEQ ID NO: 991855 - DNA, 22 bp, Artificial Sequence
  chemically synthesized
cattaaattttctctctttctg

SEQ ID NO: 991856 - DNA, 22 bp, Artificial Sequence
  chemically synthesized
ctttagtaaagcagaaagagag

SEQ ID NO: 991857 - DNA, 22 bp, Artificial Sequence
  chemically synthesized
acattaaattttctctctttct

SEQ ID NO: 991858 - DNA, 22 bp, Artificial Sequence
  chemically synthesized
tagtaaagcagaaagagagaaa

SEQ ID NO: 991859 - DNA, 22 bp, Artificial Sequence
  chemically synthesized
agtaaagcagaaagagagaaaa

SEQ ID NO: 991860 - DNA, 22 bp, Artificial Sequence
  chemically synthesized
gtaaagcagaaagagagaaaat

SEQ ID NO: 991861 - DNA, 22 bp, Artificial Sequence
  chemically synthesized
gtatcagtgcttacattaaatt

SEQ ID NO: 991862 - DNA, 22 bp, Artificial Sequence
  chemically synthesized
agtatcagtgcttacattaaat

SEQ ID NO: 991863 - DNA, 22 bp, Artificial Sequence
  chemically synthesized
tagtatcagtgcttacattaaa

SEQ ID NO: 991864 - DNA, 22 bp, Artificial Sequence
  chemically synthesized
ttagtatcagtgcttacattaa

SEQ ID NO: 991865 - DNA, 22 bp, Artificial Sequence
  chemically synthesized
acttttagtatcagtgcttaca

SEQ ID NO: 991866 - DNA, 22 bp, Artificial Sequence
  chemically synthesized
aatgtaagcactgatactaaaa

SEQ ID NO: 991867 - DNA, 22 bp, Artificial Sequence
  chemically synthesized
atgtaagcactgatactaaaag

SEQ ID NO: 991868 - DNA, 22 bp, Artificial Sequence
  chemically synthesized
agacggcaattaacttttagta

SEQ ID NO: 991869 - DNA, 22 bp, Artificial Sequence
  chemically synthesized
tgtgttaagacggcaattaact

SEQ ID NO: 991870 - DNA, 22 bp, Artificial Sequence
  chemically synthesized
atactaaaagttaattgccgtc

SEQ ID NO: 991871 - DNA, 22 bp, Artificial Sequence
  chemically synthesized
gcgcctgtgtgttaagacggca

SEQ ID NO: 991872 - DNA, 22 bp, Artificial Sequence
  chemically synthesized
ggcgcctgtgtgttaagacggc

SEQ ID NO: 991873 - DNA, 22 bp, Artificial Sequence
  chemically synthesized
aaagttaattgccgtcttaaca

SEQ ID NO: 991874 - DNA, 22 bp, Artificial Sequence
  chemically synthesized
attgccgtcttaacacacaggc

SEQ ID NO: 991875 - DNA, 22 bp, Artificial Sequence
  chemically synthesized
ggggaatcttggcgcctgtgtg

SEQ ID NO: 991876 - DNA, 22 bp, Artificial Sequence
  chemically synthesized
ccgtcttaacacacaggcgcca

SEQ ID NO: 991877 - DNA, 22 bp, Artificial Sequence
  chemically synthesized
ctaggggaatcttggcgcctgt

SEQ ID NO: 991878 - DNA, 22 bp, Artificial Sequence
  chemically synthesized
ctgctaggggaatcttggcgcc

SEQ ID NO: 991879 - DNA, 22 bp, Artificial Sequence
  chemically synthesized
aacacacaggcgccaagattcc

SEQ ID NO: 991880 - DNA, 22 bp, Artificial Sequence
  chemically synthesized
acacacaggcgccaagattccc

SEQ ID NO: 991881 - DNA, 22 bp, Artificial Sequence
  chemically synthesized
agagactcctgctaggggaatc

SEQ ID NO: 991882 - DNA, 22 bp, Artificial Sequence
  chemically synthesized
aagagactcctgctaggggaat

SEQ ID NO: 991883 - DNA, 22 bp, Artificial Sequence
  chemically synthesized
taagagactcctgctaggggaa

SEQ ID NO: 991884 - DNA, 22 bp, Artificial Sequence
  chemically synthesized
ttaagagactcctgctagggga

SEQ ID NO: 991885 - DNA, 22 bp, Artificial Sequence
  chemically synthesized
tttaagagactcctgctagggg

SEQ ID NO: 991886 - DNA, 22 bp, Artificial Sequence
  chemically synthesized
aaggtgttttttaagagactcc

SEQ ID NO: 991887 - DNA, 22 bp, Artificial Sequence
  chemically synthesized
aaaggtgttttttaagagactc

SEQ ID NO: 991888 - DNA, 22 bp, Artificial Sequence
  chemically synthesized
ccctagcaggagtctcttaaaa

SEQ ID NO: 991889 - DNA, 22 bp, Artificial Sequence
  chemically synthesized
cgtttaaaggtgttttttaaga

SEQ ID NO: 991890 - DNA, 22 bp, Artificial Sequence
  chemically synthesized
tgcgtttaaaggtgttttttaa

SEQ ID NO: 991891 - DNA, 22 bp, Artificial Sequence
  chemically synthesized
gcaggagtctcttaaaaaacac

SEQ ID NO: 991892 - DNA, 22 bp, Artificial Sequence
  chemically synthesized
ctgcgtttaaaggtgtttttta

SEQ ID NO: 991893 - DNA, 22 bp, Artificial Sequence
  chemically synthesized
ttctgcgtttaaaggtgttttt

SEQ ID NO: 991894 - DNA, 22 bp, Artificial Sequence
  chemically synthesized
tgccctcttctgcgtttaaagg

SEQ ID NO: 991895 - DNA, 22 bp, Artificial Sequence
  chemically synthesized
gtgccctcttctgcgtttaaag

SEQ ID NO: 991896 - DNA, 22 bp, Artificial Sequence
  chemically synthesized
ttaaaaaacacctttaaacgca

SEQ ID NO: 991897 - DNA, 22 bp, Artificial Sequence
  chemically synthesized
aaaaaacacctttaaacgcaga

SEQ ID NO: 991898 - DNA, 22 bp, Artificial Sequence
  chemically synthesized
aaaaacacctttaaacgcagaa

SEQ ID NO: 991899 - DNA, 22 bp, Artificial Sequence
  chemically synthesized
aaagcttgtgccctcttctgcg

SEQ ID NO: 991900 - DNA, 22 bp, Artificial Sequence
  chemically synthesized
caaagcttgtgccctcttctgc

SEQ ID NO: 991901 - DNA, 22 bp, Artificial Sequence
  chemically synthesized
tcaaagcttgtgccctcttctg

SEQ ID NO: 991902 - DNA, 22 bp, Artificial Sequence
  chemically synthesized
ttcaaagcttgtgccctcttct

SEQ ID NO: 991903 - DNA, 22 bp, Artificial Sequence
  chemically synthesized
tttcaaagcttgtgccctcttc

SEQ ID NO: 991904 - DNA, 22 bp, Artificial Sequence
  chemically synthesized
ttttcaaagcttgtgccctctt

SEQ ID NO: 991905 - DNA, 22 bp, Artificial Sequence
  chemically synthesized
tttttcaaagcttgtgccctct

SEQ ID NO: 991906 - DNA, 22 bp, Artificial Sequence
  chemically synthesized
ttttttcaaagcttgtgccctc

SEQ ID NO: 991907 - DNA, 22 bp, Artificial Sequence
  chemically synthesized
taaacgcagaagagggcacaag

SEQ ID NO: 991908 - DNA, 22 bp, Artificial Sequence
  chemically synthesized
tttttttcaaagcttgtgccct

SEQ ID NO: 991909 - DNA, 22 bp, Artificial Sequence
  chemically synthesized
aaacgcagaagagggcacaagc

SEQ ID NO: 991910 - DNA, 22 bp, Artificial Sequence
  chemically synthesized
ttttttttcaaagcttgtgccc

SEQ ID NO: 991911 - DNA, 22 bp, Artificial Sequence
  chemically synthesized
aacgcagaagagggcacaagct

SEQ ID NO: 991912 - DNA, 22 bp, Artificial Sequence
  chemically synthesized
tttttttttcaaagcttgtgcc

SEQ ID NO: 991913 - DNA, 22 bp, Artificial Sequence
  chemically synthesized
ttttttttttcaaagcttgtgc

SEQ ID NO: 991914 - DNA, 22 bp, Artificial Sequence
  chemically synthesized
tttttttttttcaaagcttgtg

SEQ ID NO: 991915 - DNA, 22 bp, Artificial Sequence
  chemically synthesized
acagtaacaggcaatttttttt

SEQ ID NO: 991916 - DNA, 22 bp, Artificial Sequence
  chemically synthesized
aacagtaacaggcaattttttt

SEQ ID NO: 991917 - DNA, 22 bp, Artificial Sequence
  chemically synthesized
tgaaaaaaaaaaaaaattgcct

SEQ ID NO: 991918 - DNA, 22 bp, Artificial Sequence
  chemically synthesized
gaaaaaaaaaaaaaattgcctg

SEQ ID NO: 991919 - DNA, 22 bp, Artificial Sequence
  chemically synthesized
aaaaaaaaaaaaaattgcctgt

SEQ ID NO: 991920 - DNA, 22 bp, Artificial Sequence
  chemically synthesized
catcagggaacaatagagttta

SEQ ID NO: 991921 - DNA, 22 bp, Artificial Sequence
  chemically synthesized
cctgttactgttaaactctatt

SEQ ID NO: 991922 - DNA, 22 bp, Artificial Sequence
  chemically synthesized
ttactgttaaactctattgttc

SEQ ID NO: 991923 - DNA, 22 bp, Artificial Sequence
  chemically synthesized
tactccatcagggaacaataga

SEQ ID NO: 991924 - DNA, 22 bp, Artificial Sequence
  chemically synthesized
tatactccatcagggaacaata

SEQ ID NO: 991925 - DNA, 22 bp, Artificial Sequence
  chemically synthesized
ctgttaaactctattgttccct

SEQ ID NO: 991926 - DNA, 22 bp, Artificial Sequence
  chemically synthesized
ctatactccatcagggaacaat

SEQ ID NO: 991927 - DNA, 22 bp, Artificial Sequence
  chemically synthesized
ttctatactccatcagggaaca

SEQ ID NO: 991928 - DNA, 22 bp, Artificial Sequence
  chemically synthesized
ttaaactctattgttccctgat

SEQ ID NO: 991929 - DNA, 22 bp, Artificial Sequence
  chemically synthesized
cttctatactccatcagggaac

SEQ ID NO: 991930 - DNA, 22 bp, Artificial Sequence
  chemically synthesized
tcttctatactccatcagggaa

SEQ ID NO: 991931 - DNA, 22 bp, Artificial Sequence
  chemically synthesized
aactctattgttccctgatgga

SEQ ID NO: 991932 - DNA, 22 bp, Artificial Sequence
  chemically synthesized
tttcttctatactccatcaggg

SEQ ID NO: 991933 - DNA, 22 bp, Artificial Sequence
  chemically synthesized
ctttcttctatactccatcagg

SEQ ID NO: 991934 - DNA, 22 bp, Artificial Sequence
  chemically synthesized
tattgttccctgatggagtata

SEQ ID NO: 991935 - DNA, 22 bp, Artificial Sequence
  chemically synthesized
ttgttccctgatggagtataga

SEQ ID NO: 991936 - DNA, 22 bp, Artificial Sequence
  chemically synthesized
gagcatttctttcttctatact

SEQ ID NO: 991937 - DNA, 22 bp, Artificial Sequence
  chemically synthesized
ttccctgatggagtatagaaga

SEQ ID NO: 991938 - DNA, 22 bp, Artificial Sequence
  chemically synthesized
ctggagcatttctttcttctat

SEQ ID NO: 991939 - DNA, 22 bp, Artificial Sequence
  chemically synthesized
cctgatggagtatagaagaaag

SEQ ID NO: 991940 - DNA, 22 bp, Artificial Sequence
  chemically synthesized
tcctggagcatttctttcttct

SEQ ID NO: 991941 - DNA, 22 bp, Artificial Sequence
  chemically synthesized
atggagtatagaagaaagaaat

SEQ ID NO: 991942 - DNA, 22 bp, Artificial Sequence
  chemically synthesized
cctctcctggagcatttctttc

SEQ ID NO: 991943 - DNA, 22 bp, Artificial Sequence
  chemically synthesized
ccctctcctggagcatttcttt

SEQ ID NO: 991944 - DNA, 22 bp, Artificial Sequence
  chemically synthesized
atatccacttccctctcctgga

SEQ ID NO: 991945 - DNA, 22 bp, Artificial Sequence
  chemically synthesized
gagggggcaattcatatccact

SEQ ID NO: 991946 - DNA, 22 bp, Artificial Sequence
  chemically synthesized
caggagagggaagtggatatga

SEQ ID NO: 991947 - DNA, 22 bp, Artificial Sequence
  chemically synthesized
tggagggggcaattcatatcca

SEQ ID NO: 991948 - DNA, 22 bp, Artificial Sequence
  chemically synthesized
ctctggagggggcaattcatat

SEQ ID NO: 991949 - DNA, 22 bp, Artificial Sequence
  chemically synthesized
gctcctctggagggggcaattc

SEQ ID NO: 991950 - DNA, 22 bp, Artificial Sequence
  chemically synthesized
ggctcctctggagggggcaatt

SEQ ID NO: 991951 - DNA, 22 bp, Artificial Sequence
  chemically synthesized
tttggctcctctggagggggca

SEQ ID NO: 991952 - DNA, 22 bp, Artificial Sequence
  chemically synthesized
gtttggctcctctggagggggc

SEQ ID NO: 991953 - DNA, 22 bp, Artificial Sequence
  chemically synthesized
cagccaatttgtttggctcctc

SEQ ID NO: 991954 - DNA, 22 bp, Artificial Sequence
  chemically synthesized
ccccctccagaggagccaaaca

SEQ ID NO: 991955 - DNA, 22 bp, Artificial Sequence
  chemically synthesized
ctacagccaatttgtttggctc

SEQ ID NO: 991956 - DNA, 22 bp, Artificial Sequence
  chemically synthesized
cctacagccaatttgtttggct

SEQ ID NO: 991957 - DNA, 22 bp, Artificial Sequence
  chemically synthesized
cagaggagccaaacaaattggc

SEQ ID NO: 991958 - DNA, 22 bp, Artificial Sequence
  chemically synthesized
aagtcttcctacagccaatttg

SEQ ID NO: 991959 - DNA, 22 bp, Artificial Sequence
  chemically synthesized
gaagtcttcctacagccaattt

SEQ ID NO: 991960 - DNA, 22 bp, Artificial Sequence
  chemically synthesized
tgaagtcttcctacagccaatt

SEQ ID NO: 991961 - DNA, 22 bp, Artificial Sequence
  chemically synthesized
ttgaagtcttcctacagccaat

SEQ ID NO: 991962 - DNA, 22 bp, Artificial Sequence
  chemically synthesized
gtccagcttttgaagtcttcct

SEQ ID NO: 991963 - DNA, 22 bp, Artificial Sequence
  chemically synthesized
ttcgtccagcttttgaagtctt

SEQ ID NO: 991964 - DNA, 22 bp, Artificial Sequence
  chemically synthesized
tgttcgtccagcttttgaagtc

SEQ ID NO: 991965 - DNA, 22 bp, Artificial Sequence
  chemically synthesized
gctgtaggaagacttcaaaagc

SEQ ID NO: 991966 - DNA, 22 bp, Artificial Sequence
  chemically synthesized
tctgttcgtccagcttttgaag

SEQ ID NO: 991967 - DNA, 22 bp, Artificial Sequence
  chemically synthesized
ctctgttcgtccagcttttgaa

SEQ ID NO: 991968 - DNA, 22 bp, Artificial Sequence
  chemically synthesized
taggaagacttcaaaagctgga

SEQ ID NO: 991969 - DNA, 22 bp, Artificial Sequence
  chemically synthesized
agcttctctgttcgtccagctt

SEQ ID NO: 991970 - DNA, 22 bp, Artificial Sequence
  chemically synthesized
gagcttctctgttcgtccagct

SEQ ID NO: 991971 - DNA, 22 bp, Artificial Sequence
  chemically synthesized
tgagcttctctgttcgtccagc

SEQ ID NO: 991972 - DNA, 22 bp, Artificial Sequence
  chemically synthesized
caaaagctggacgaacagagaa

SEQ ID NO: 991973 - DNA, 22 bp, Artificial Sequence
  chemically synthesized
aaaagctggacgaacagagaag

SEQ ID NO: 991974 - DNA, 22 bp, Artificial Sequence
  chemically synthesized
taaggtctttgagcttctctgt

SEQ ID NO: 991975 - DNA, 22 bp, Artificial Sequence
  chemically synthesized
gacgaacagagaagctcaaaga

SEQ ID NO: 991976 - DNA, 22 bp, Artificial Sequence
  chemically synthesized
aaagaccttacagatttgggct

SEQ ID NO: 991977 - DNA, 22 bp, Artificial Sequence
  chemically synthesized
acagatttgggctacttgccct

SEQ ID NO: 991978 - DNA, 22 bp, Artificial Sequence
  chemically synthesized
cagatttgggctacttgccctt

SEQ ID NO: 991979 - DNA, 22 bp, Artificial Sequence
  chemically synthesized
gggctacttgcccttgctgtgt

SEQ ID NO: 991980 - DNA, 22 bp, Artificial Sequence
  chemically synthesized
ggctacttgcccttgctgtgtt

SEQ ID NO: 991981 - DNA, 22 bp, Artificial Sequence
  chemically synthesized
aaaaaaaaaaaaaaacacagca

SEQ ID NO: 991982 - DNA, 22 bp, Artificial Sequence
  chemically synthesized
cttgcccttgctgtgttttttt

SEQ ID NO: 991983 - DNA, 22 bp, Artificial Sequence
  chemically synthesized
gcccttgctgtgtttttttttt

SEQ ID NO: 991984 - DNA, 22 bp, Artificial Sequence
  chemically synthesized
cccttgctgtgttttttttttt

SEQ ID NO: 991985 - DNA, 22 bp, Artificial Sequence
  chemically synthesized
ggggaaattaaaaaaaaaaaaa

SEQ ID NO: 991986 - DNA, 22 bp, Artificial Sequence
  chemically synthesized
taggggaaattaaaaaaaaaaa

SEQ ID NO: 991987 - DNA, 22 bp, Artificial Sequence
  chemically synthesized
gctgtgtttttttttttttttt

SEQ ID NO: 991988 - DNA, 22 bp, Artificial Sequence
  chemically synthesized
ctgtgtttttttttttttttta

SEQ ID NO: 991989 - DNA, 22 bp, Artificial Sequence
  chemically synthesized
attctaggggaaattaaaaaaa

SEQ ID NO: 991990 - DNA, 22 bp, Artificial Sequence
  chemically synthesized
tgttttttttttttttttaatt

SEQ ID NO: 991991 - DNA, 22 bp, Artificial Sequence
  chemically synthesized
tttttttttttttaatttcccc

SEQ ID NO: 991992 - DNA, 22 bp, Artificial Sequence
  chemically synthesized
ttttttttttttaatttcccct

SEQ ID NO: 991993 - DNA, 22 bp, Artificial Sequence
  chemically synthesized
tttttttttttaatttccccta

SEQ ID NO: 991994 - DNA, 22 bp, Artificial Sequence
  chemically synthesized
ttttttttttaatttcccctag

SEQ ID NO: 991995 - DNA, 22 bp, Artificial Sequence
  chemically synthesized
tttttttttaatttcccctaga

SEQ ID NO: 991996 - DNA, 22 bp, Artificial Sequence
  chemically synthesized
aaccatattcattctaggggaa

SEQ ID NO: 991997 - DNA, 22 bp, Artificial Sequence
  chemically synthesized
ttttttttaatttcccctagaa

SEQ ID NO: 991998 - DNA, 22 bp, Artificial Sequence
  chemically synthesized
tttttttaatttcccctagaat

SEQ ID NO: 991999 - DNA, 22 bp, Artificial Sequence
  chemically synthesized
ttttttaatttcccctagaatg

SEQ ID NO: 992000 - DNA, 22 bp, Artificial Sequence
  chemically synthesized
tttttaatttcccctagaatga

SEQ ID NO: 992001 - DNA, 22 bp, Artificial Sequence
  chemically synthesized
ttttaatttcccctagaatgaa

SEQ ID NO: 992002 - DNA, 22 bp, Artificial Sequence
  chemically synthesized
tttaatttcccctagaatgaat

SEQ ID NO: 992003 - DNA, 22 bp, Artificial Sequence
  chemically synthesized
aagttaaaccatattcattcta

SEQ ID NO: 992004 - DNA, 22 bp, Artificial Sequence
  chemically synthesized
ttaatttcccctagaatgaata

SEQ ID NO: 992005 - DNA, 22 bp, Artificial Sequence
  chemically synthesized
taatttcccctagaatgaatat

SEQ ID NO: 992006 - DNA, 22 bp, Artificial Sequence
  chemically synthesized
tcaagttaaaccatattcattc

SEQ ID NO: 992007 - DNA, 22 bp, Artificial Sequence
  chemically synthesized
aatttcccctagaatgaatatg

SEQ ID NO: 992008 - DNA, 22 bp, Artificial Sequence
  chemically synthesized
atttcccctagaatgaatatgg

SEQ ID NO: 992009 - DNA, 22 bp, Artificial Sequence
  chemically synthesized
ctctcaagttaaaccatattca

SEQ ID NO: 992010 - DNA, 22 bp, Artificial Sequence
  chemically synthesized
gctctcaagttaaaccatattc

SEQ ID NO: 992011 - DNA, 22 bp, Artificial Sequence
  chemically synthesized
cccctagaatgaatatggttta

SEQ ID NO: 992012 - DNA, 22 bp, Artificial Sequence
  chemically synthesized
ccctagaatgaatatggtttaa

SEQ ID NO: 992013 - DNA, 22 bp, Artificial Sequence
  chemically synthesized
tttgctctcaagttaaaccata

SEQ ID NO: 992014 - DNA, 22 bp, Artificial Sequence
  chemically synthesized
gaatgaatatggtttaacttga

SEQ ID NO: 992015 - DNA, 22 bp, Artificial Sequence
  chemically synthesized
cattatttgctctcaagttaaa

SEQ ID NO: 992016 - DNA, 22 bp, Artificial Sequence
  chemically synthesized
ccattatttgctctcaagttaa

SEQ ID NO: 992017 - DNA, 22 bp, Artificial Sequence
  chemically synthesized
aaaatgcatccttccattattt

SEQ ID NO: 992018 - DNA, 22 bp, Artificial Sequence
  chemically synthesized
aacttgagagcaaataatggaa

SEQ ID NO: 992019 - DNA, 22 bp, Artificial Sequence
  chemically synthesized
aaaaatgcatccttccattatt

SEQ ID NO: 992020 - DNA, 22 bp, Artificial Sequence
  chemically synthesized
acttgagagcaaataatggaag

SEQ ID NO: 992021 - DNA, 22 bp, Artificial Sequence
  chemically synthesized
gagagcaaataatggaaggatg

SEQ ID NO: 992022 - DNA, 22 bp, Artificial Sequence
  chemically synthesized
agagcaaataatggaaggatgc

SEQ ID NO: 992023 - DNA, 22 bp, Artificial Sequence
  chemically synthesized
ggaatcaaagcatttaaaaatg

SEQ ID NO: 992024 - DNA, 22 bp, Artificial Sequence
  chemically synthesized
ttaaatgctttgattcccagct

SEQ ID NO: 992025 - DNA, 22 bp, Artificial Sequence
  chemically synthesized
taaatgctttgattcccagctt

SEQ ID NO: 992026 - DNA, 22 bp, Artificial Sequence
  chemically synthesized
aaatgctttgattcccagcttt

SEQ ID NO: 992027 - DNA, 22 bp, Artificial Sequence
  chemically synthesized
gaggcagaataaaaagctggga

SEQ ID NO: 992028 - DNA, 22 bp, Artificial Sequence
  chemically synthesized
aatgctttgattcccagctttt

SEQ ID NO: 992029 - DNA, 22 bp, Artificial Sequence
  chemically synthesized
gttagaggcagaataaaaagct

SEQ ID NO: 992030 - DNA, 22 bp, Artificial Sequence
  chemically synthesized
tgattcccagctttttattctg

SEQ ID NO: 992031 - DNA, 22 bp, Artificial Sequence
  chemically synthesized
gattcccagctttttattctgc

SEQ ID NO: 992032 - DNA, 22 bp, Artificial Sequence
  chemically synthesized
attcccagctttttattctgcc

SEQ ID NO: 992033 - DNA, 22 bp, Artificial Sequence
  chemically synthesized
taatagctagttagaggcagaa

SEQ ID NO: 992034 - DNA, 22 bp, Artificial Sequence
  chemically synthesized
ccagctttttattctgcctcta

SEQ ID NO: 992035 - DNA, 22 bp, Artificial Sequence
  chemically synthesized
tttattctgcctctaactagct

SEQ ID NO: 992036 - DNA, 22 bp, Artificial Sequence
  chemically synthesized
ttattctgcctctaactagcta

SEQ ID NO: 992037 - DNA, 22 bp, Artificial Sequence
  chemically synthesized
tattctgcctctaactagctat

SEQ ID NO: 992038 - DNA, 22 bp, Artificial Sequence
  chemically synthesized
agtggtattgtaatagctagtt

SEQ ID NO: 992039 - DNA, 22 bp, Artificial Sequence
  chemically synthesized
attctgcctctaactagctatt

SEQ ID NO: 992040 - DNA, 22 bp, Artificial Sequence
  chemically synthesized
ttctgcctctaactagctatta

SEQ ID NO: 992041 - DNA, 22 bp, Artificial Sequence
  chemically synthesized
tgcctctaactagctattacaa

SEQ ID NO: 992042 - DNA, 22 bp, Artificial Sequence
  chemically synthesized
cctctaactagctattacaata

SEQ ID NO: 992043 - DNA, 22 bp, Artificial Sequence
  chemically synthesized
taactagctattacaataccac

SEQ ID NO: 992044 - DNA, 22 bp, Artificial Sequence
  chemically synthesized
aggtccggattaagtggtattg

SEQ ID NO: 992045 - DNA, 22 bp, Artificial Sequence
  chemically synthesized
actagctattacaataccactt

SEQ ID NO: 992046 - DNA, 22 bp, Artificial Sequence
  chemically synthesized
gctattacaataccacttaatc

SEQ ID NO: 992047 - DNA, 22 bp, Artificial Sequence
  chemically synthesized
gaatgctgaggtccggattaag

SEQ ID NO: 992048 - DNA, 22 bp, Artificial Sequence
  chemically synthesized
ttacaataccacttaatccgga

SEQ ID NO: 992049 - DNA, 22 bp, Artificial Sequence
  chemically synthesized
ggaatgctgaggtccggattaa

SEQ ID NO: 992050 - DNA, 22 bp, Artificial Sequence
  chemically synthesized
caataccacttaatccggacct

SEQ ID NO: 992051 - DNA, 22 bp, Artificial Sequence
  chemically synthesized
gtacttggaatgctgaggtccg

SEQ ID NO: 992052 - DNA, 22 bp, Artificial Sequence
  chemically synthesized
ggtacttggaatgctgaggtcc

SEQ ID NO: 992053 - DNA, 22 bp, Artificial Sequence
  chemically synthesized
tggtacttggaatgctgaggtc

SEQ ID NO: 992054 - DNA, 22 bp, Artificial Sequence
  chemically synthesized
aatccggacctcagcattccaa

SEQ ID NO: 992055 - DNA, 22 bp, Artificial Sequence
  chemically synthesized
atccggacctcagcattccaag

SEQ ID NO: 992056 - DNA, 22 bp, Artificial Sequence
  chemically synthesized
agcattccaagtaccaaagcat

SEQ ID NO: 992057 - DNA, 22 bp, Artificial Sequence
  chemically synthesized
caagtaccaaagcatctcctcc

SEQ ID NO: 992058 - DNA, 22 bp, Artificial Sequence
  chemically synthesized
atgcaggagcgtgtgagcagtg

SEQ ID NO: 992059 - DNA, 22 bp, Artificial Sequence
  chemically synthesized
tgatgcaggagcgtgtgagcag

SEQ ID NO: 992060 - DNA, 22 bp, Artificial Sequence
  chemically synthesized
ctcccacccactgctcacacgc

SEQ ID NO: 992061 - DNA, 22 bp, Artificial Sequence
  chemically synthesized
ttctgatgcaggagcgtgtgag

SEQ ID NO: 992062 - DNA, 22 bp, Artificial Sequence
  chemically synthesized
ccacccactgctcacacgctcc

SEQ ID NO: 992063 - DNA, 22 bp, Artificial Sequence
  chemically synthesized
tattctgatgcaggagcgtgtg

SEQ ID NO: 992064 - DNA, 22 bp, Artificial Sequence
  chemically synthesized
ctattctgatgcaggagcgtgt

SEQ ID NO: 992065 - DNA, 22 bp, Artificial Sequence
  chemically synthesized
taagtcttctattctgatgcag

SEQ ID NO: 992066 - DNA, 22 bp, Artificial Sequence
  chemically synthesized
ctcacacgctcctgcatcagaa

SEQ ID NO: 992067 - DNA, 22 bp, Artificial Sequence
  chemically synthesized
tgtaagtcttctattctgatgc

SEQ ID NO: 992068 - DNA, 22 bp, Artificial Sequence
  chemically synthesized
ctgtaagtcttctattctgatg

SEQ ID NO: 992069 - DNA, 22 bp, Artificial Sequence
  chemically synthesized
acacgctcctgcatcagaatag

SEQ ID NO: 992070 - DNA, 22 bp, Artificial Sequence
  chemically synthesized
tctgtaagtcttctattctgat

SEQ ID NO: 992071 - DNA, 22 bp, Artificial Sequence
  chemically synthesized
ttctgtaagtcttctattctga

SEQ ID NO: 992072 - DNA, 22 bp, Artificial Sequence
  chemically synthesized
ctgcatcagaatagaagactta

SEQ ID NO: 992073 - DNA, 22 bp, Artificial Sequence
  chemically synthesized
gcagcttttctgtaagtcttct

SEQ ID NO: 992074 - DNA, 22 bp, Artificial Sequence
  chemically synthesized
catcagaatagaagacttacag

SEQ ID NO: 992075 - DNA, 22 bp, Artificial Sequence
  chemically synthesized
tgggtctggcagcttttctgta

SEQ ID NO: 992076 - DNA, 22 bp, Artificial Sequence
  chemically synthesized
tgtgggtctggcagcttttctg

SEQ ID NO: 992077 - DNA, 22 bp, Artificial Sequence
  chemically synthesized
ctgtgggtctggcagcttttct

SEQ ID NO: 992078 - DNA, 22 bp, Artificial Sequence
  chemically synthesized
ttctgtgggtctggcagctttt

SEQ ID NO: 992079 - DNA, 22 bp, Artificial Sequence
  chemically synthesized
acagaaaagctgccagacccac

SEQ ID NO: 992080 - DNA, 22 bp, Artificial Sequence
  chemically synthesized
cagaaaagctgccagacccaca

SEQ ID NO: 992081 - DNA, 22 bp, Artificial Sequence
  chemically synthesized
agaggaaagtgctcttctgtgg

SEQ ID NO: 992082 - DNA, 22 bp, Artificial Sequence
  chemically synthesized
ttgagaggaaagtgctcttctg

SEQ ID NO: 992083 - DNA, 22 bp, Artificial Sequence
  chemically synthesized
ccagacccacagaagagcactt

SEQ ID NO: 992084 - DNA, 22 bp, Artificial Sequence
  chemically synthesized
gaagacatctgttgagaggaaa

SEQ ID NO: 992085 - DNA, 22 bp, Artificial Sequence
  chemically synthesized
aaagctggaagacatctgttga

SEQ ID NO: 992086 - DNA, 22 bp, Artificial Sequence
  chemically synthesized
tcctctcaacagatgtcttcca

SEQ ID NO: 992087 - DNA, 22 bp, Artificial Sequence
  chemically synthesized
cctctcaacagatgtcttccag

SEQ ID NO: 992088 - DNA, 22 bp, Artificial Sequence
  chemically synthesized
ctctcaacagatgtcttccagc

SEQ ID NO: 992089 - DNA, 22 bp, Artificial Sequence
  chemically synthesized
tcaacagatgtcttccagcttt

SEQ ID NO: 992090 - DNA, 22 bp, Artificial Sequence
  chemically synthesized
aacagatgtcttccagctttta

SEQ ID NO: 992091 - DNA, 22 bp, Artificial Sequence
  chemically synthesized
agtgtgtgtgtgcctaaaagct

SEQ ID NO: 992092 - DNA, 22 bp, Artificial Sequence
  chemically synthesized
ccagcttttaggcacacacaca

SEQ ID NO: 992093 - DNA, 22 bp, Artificial Sequence
  chemically synthesized
cagcttttaggcacacacacac

SEQ ID NO: 992094 - DNA, 22 bp, Artificial Sequence
  chemically synthesized
ttaggcacacacacactcagac

SEQ ID NO: 992095 - DNA, 22 bp, Artificial Sequence
  chemically synthesized
taggcacacacacactcagaca

SEQ ID NO: 992096 - DNA, 22 bp, Artificial Sequence
  chemically synthesized
aggcacacacacactcagacac

SEQ ID NO: 992097 - DNA, 22 bp, Artificial Sequence
  chemically synthesized
aggtaggcaagtgtgtctgagt

SEQ ID NO: 992098 - DNA, 22 bp, Artificial Sequence
  chemically synthesized
ggcacacacacactcagacaca

SEQ ID NO: 992099 - DNA, 22 bp, Artificial Sequence
  chemically synthesized
ttaaggtaggcaagtgtgtctg

SEQ ID NO: 992100 - DNA, 22 bp, Artificial Sequence
  chemically synthesized
attaaggtaggcaagtgtgtct

SEQ ID NO: 992101 - DNA, 22 bp, Artificial Sequence
  chemically synthesized
cacaccttattaaggtaggcaa

SEQ ID NO: 992102 - DNA, 22 bp, Artificial Sequence
  chemically synthesized
gcacaccttattaaggtaggca

SEQ ID NO: 992103 - DNA, 22 bp, Artificial Sequence
  chemically synthesized
tgcacaccttattaaggtaggc

SEQ ID NO: 992104 - DNA, 22 bp, Artificial Sequence
  chemically synthesized
ttgcacaccttattaaggtagg

SEQ ID NO: 992105 - DNA, 22 bp, Artificial Sequence
  chemically synthesized
agacacacttgcctaccttaat

SEQ ID NO: 992106 - DNA, 22 bp, Artificial Sequence
  chemically synthesized
gcctaccttaataaggtgtgca

SEQ ID NO: 992107 - DNA, 22 bp, Artificial Sequence
  chemically synthesized
cctaccttaataaggtgtgcaa

SEQ ID NO: 992108 - DNA, 22 bp, Artificial Sequence
  chemically synthesized
ccttaataaggtgtgcaaaaac

SEQ ID NO: 992109 - DNA, 22 bp, Artificial Sequence
  chemically synthesized
aataaggtgtgcaaaaacctct

SEQ ID NO: 992110 - DNA, 22 bp, Artificial Sequence
  chemically synthesized
ataaggtgtgcaaaaacctctt

SEQ ID NO: 992111 - DNA, 22 bp, Artificial Sequence
  chemically synthesized
aaagcatccgtggggaccgaaa

SEQ ID NO: 992112 - DNA, 22 bp, Artificial Sequence
  chemically synthesized
aactaaaagcatccgtggggac

SEQ ID NO: 992113 - DNA, 22 bp, Artificial Sequence
  chemically synthesized
tgaactaaaagcatccgtgggg

SEQ ID NO: 992114 - DNA, 22 bp, Artificial Sequence
  chemically synthesized
ctctgaactaaaagcatccgtg

SEQ ID NO: 992115 - DNA, 22 bp, Artificial Sequence
  chemically synthesized
tttcggtccccacggatgcttt

SEQ ID NO: 992116 - DNA, 22 bp, Artificial Sequence
  chemically synthesized
tcggtccccacggatgctttta

SEQ ID NO: 992117 - DNA, 22 bp, Artificial Sequence
  chemically synthesized
gctgctctgaactaaaagcatc

SEQ ID NO: 992118 - DNA, 22 bp, Artificial Sequence
  chemically synthesized
cggtccccacggatgcttttag

SEQ ID NO: 992119 - DNA, 22 bp, Artificial Sequence
  chemically synthesized
ggtccccacggatgcttttagt

SEQ ID NO: 992120 - DNA, 22 bp, Artificial Sequence
  chemically synthesized
ctggctgctctgaactaaaagc

SEQ ID NO: 992121 - DNA, 22 bp, Artificial Sequence
  chemically synthesized
tgcggaggcattgctggctgct

SEQ ID NO: 992122 - DNA, 22 bp, Artificial Sequence
  chemically synthesized
gtgcggaggcattgctggctgc

SEQ ID NO: 992123 - DNA, 22 bp, Artificial Sequence
  chemically synthesized
tgtgcggaggcattgctggctg

SEQ ID NO: 992124 - DNA, 22 bp, Artificial Sequence
  chemically synthesized
ttagttcagagcagccagcaat

SEQ ID NO: 992125 - DNA, 22 bp, Artificial Sequence
  chemically synthesized
tagttcagagcagccagcaatg

SEQ ID NO: 992126 - DNA, 22 bp, Artificial Sequence
  chemically synthesized
agttcagagcagccagcaatgc

SEQ ID NO: 992127 - DNA, 22 bp, Artificial Sequence
  chemically synthesized
gttcagagcagccagcaatgcc

SEQ ID NO: 992128 - DNA, 22 bp, Artificial Sequence
  chemically synthesized
agagcagccagcaatgcctccg

SEQ ID NO: 992129 - DNA, 22 bp, Artificial Sequence
  chemically synthesized
gcaatggcaaagctttgtgcgg

SEQ ID NO: 992130 - DNA, 22 bp, Artificial Sequence
  chemically synthesized
acactagcaatggcaaagcttt

SEQ ID NO: 992131 - DNA, 22 bp, Artificial Sequence
  chemically synthesized
cacactagcaatggcaaagctt

SEQ ID NO: 992132 - DNA, 22 bp, Artificial Sequence
  chemically synthesized
ttcacactagcaatggcaaagc

SEQ ID NO: 992133 - DNA, 22 bp, Artificial Sequence
  chemically synthesized
tcttcacactagcaatggcaaa

SEQ ID NO: 992134 - DNA, 22 bp, Artificial Sequence
  chemically synthesized
ctcttcacactagcaatggcaa

SEQ ID NO: 992135 - DNA, 22 bp, Artificial Sequence
  chemically synthesized
cgcacaaagctttgccattgct

SEQ ID NO: 992136 - DNA, 22 bp, Artificial Sequence
  chemically synthesized
tctcttcacactagcaatggca

SEQ ID NO: 992137 - DNA, 22 bp, Artificial Sequence
  chemically synthesized
tttctcttcacactagcaatgg

SEQ ID NO: 992138 - DNA, 22 bp, Artificial Sequence
  chemically synthesized
tgccattgctagtgtgaagaga

SEQ ID NO: 992139 - DNA, 22 bp, Artificial Sequence
  chemically synthesized
gccattgctagtgtgaagagaa

SEQ ID NO: 992140 - DNA, 22 bp, Artificial Sequence
  chemically synthesized
ccattgctagtgtgaagagaaa

SEQ ID NO: 992141 - DNA, 22 bp, Artificial Sequence
  chemically synthesized
agcatcccagcagctctttctc

SEQ ID NO: 992142 - DNA, 22 bp, Artificial Sequence
  chemically synthesized
ctagtgtgaagagaaagagctg

SEQ ID NO: 992143 - DNA, 22 bp, Artificial Sequence
  chemically synthesized
gtgtgaagagaaagagctgctg

SEQ ID NO: 992144 - DNA, 22 bp, Artificial Sequence
  chemically synthesized
atgtgccattcagcatcccagc

SEQ ID NO: 992145 - DNA, 22 bp, Artificial Sequence
  chemically synthesized
gctgatgtgccattcagcatcc

SEQ ID NO: 992146 - DNA, 22 bp, Artificial Sequence
  chemically synthesized
ctgggatgctgaatggcacatc

SEQ ID NO: 992147 - DNA, 22 bp, Artificial Sequence
  chemically synthesized
ggatgctgaatggcacatcagc

SEQ ID NO: 992148 - DNA, 22 bp, Artificial Sequence
  chemically synthesized
cacacaaagttggctgatgtgc

SEQ ID NO: 992149 - DNA, 22 bp, Artificial Sequence
  chemically synthesized
ctacacacaaagttggctgatg

SEQ ID NO: 992150 - DNA, 22 bp, Artificial Sequence
  chemically synthesized
gctacacacaaagttggctgat

SEQ ID NO: 992151 - DNA, 22 bp, Artificial Sequence
  chemically synthesized
tgctacacacaaagttggctga

SEQ ID NO: 992152 - DNA, 22 bp, Artificial Sequence
  chemically synthesized
aatggcacatcagccaactttg

SEQ ID NO: 992153 - DNA, 22 bp, Artificial Sequence
  chemically synthesized
gagcctttgctacacacaaagt

SEQ ID NO: 992154 - DNA, 22 bp, Artificial Sequence
  chemically synthesized
agagcctttgctacacacaaag

SEQ ID NO: 992155 - DNA, 22 bp, Artificial Sequence
  chemically synthesized
tagagcctttgctacacacaaa

SEQ ID NO: 992156 - DNA, 22 bp, Artificial Sequence
  chemically synthesized
tttagagcctttgctacacaca

SEQ ID NO: 992157 - DNA, 22 bp, Artificial Sequence
  chemically synthesized
ctttagagcctttgctacacac

SEQ ID NO: 992158 - DNA, 22 bp, Artificial Sequence
  chemically synthesized
tgtgtgtagcaaaggctctaaa

SEQ ID NO: 992159 - DNA, 22 bp, Artificial Sequence
  chemically synthesized
gtgtgtagcaaaggctctaaag

SEQ ID NO: 992160 - DNA, 22 bp, Artificial Sequence
  chemically synthesized
agcccaggatttctttagagcc

SEQ ID NO: 992161 - DNA, 22 bp, Artificial Sequence
  chemically synthesized
tgtgtagcaaaggctctaaaga

SEQ ID NO: 992162 - DNA, 22 bp, Artificial Sequence
  chemically synthesized
cagcccaggatttctttagagc

SEQ ID NO: 992163 - DNA, 22 bp, Artificial Sequence
  chemically synthesized
taaagaaatcctgggctgaaac

SEQ ID NO: 992164 - DNA, 22 bp, Artificial Sequence
  chemically synthesized
aagaaatcctgggctgaaactc

SEQ ID NO: 992165 - DNA, 22 bp, Artificial Sequence
  chemically synthesized
agtccaatccatgatccagcag

SEQ ID NO: 992166 - DNA, 22 bp, Artificial Sequence
  chemically synthesized
ggctgaaactctgctggatcat

SEQ ID NO: 992167 - DNA, 22 bp, Artificial Sequence
  chemically synthesized
aaactctgctggatcatggatt

SEQ ID NO: 992168 - DNA, 22 bp, Artificial Sequence
  chemically synthesized
tgctggatcatggattggactc

SEQ ID NO: 992169 - DNA, 22 bp, Artificial Sequence
  chemically synthesized
ctggatcatggattggactcaa

SEQ ID NO: 992170 - DNA, 22 bp, Artificial Sequence
  chemically synthesized
tgtgtggagtgaaattgagtcc

SEQ ID NO: 992171 - DNA, 22 bp, Artificial Sequence
  chemically synthesized
gatcatggattggactcaattt

SEQ ID NO: 992172 - DNA, 22 bp, Artificial Sequence
  chemically synthesized
gactcaatttcactccacacac

SEQ ID NO: 992173 - DNA, 22 bp, Artificial Sequence
  chemically synthesized
aatttcactccacacacagtct

SEQ ID NO: 992174 - DNA, 22 bp, Artificial Sequence
  chemically synthesized
catcaggtaatgcagactgtgt

SEQ ID NO: 992175 - DNA, 22 bp, Artificial Sequence
  chemically synthesized
cactccacacacagtctgcatt

SEQ ID NO: 992176 - DNA, 22 bp, Artificial Sequence
  chemically synthesized
actccacacacagtctgcatta

SEQ ID NO: 992177 - DNA, 22 bp, Artificial Sequence
  chemically synthesized
cacacacagtctgcattacctg

SEQ ID NO: 992178 - DNA, 22 bp, Artificial Sequence
  chemically synthesized
cagaaataatctccatcaggta

SEQ ID NO: 992179 - DNA, 22 bp, Artificial Sequence
  chemically synthesized
ccagaaataatctccatcaggt

SEQ ID NO: 992180 - DNA, 22 bp, Artificial Sequence
  chemically synthesized
agtgcttccagaaataatctcc

SEQ ID NO: 992181 - DNA, 22 bp, Artificial Sequence
  chemically synthesized
cattacctgatggagattattt

SEQ ID NO: 992182 - DNA, 22 bp, Artificial Sequence
  chemically synthesized
cctgatggagattatttctgga

SEQ ID NO: 992183 - DNA, 22 bp, Artificial Sequence
  chemically synthesized
atggagattatttctggaagca

SEQ ID NO: 992184 - DNA, 22 bp, Artificial Sequence
  chemically synthesized
tagacaaacatgccctaagtgc

SEQ ID NO: 992185 - DNA, 22 bp, Artificial Sequence
  chemically synthesized
gtagacaaacatgccctaagtg

SEQ ID NO: 992186 - DNA, 22 bp, Artificial Sequence
  chemically synthesized
tgtagacaaacatgccctaagt

SEQ ID NO: 992187 - DNA, 22 bp, Artificial Sequence
  chemically synthesized
tttctggaagcacttagggcat

SEQ ID NO: 992188 - DNA, 22 bp, Artificial Sequence
  chemically synthesized
ttgtagacaaacatgccctaag

SEQ ID NO: 992189 - DNA, 22 bp, Artificial Sequence
  chemically synthesized
tttgtagacaaacatgccctaa

SEQ ID NO: 992190 - DNA, 22 bp, Artificial Sequence
  chemically synthesized
ctggaagcacttagggcatgtt

SEQ ID NO: 992191 - DNA, 22 bp, Artificial Sequence
  chemically synthesized
tggaagcacttagggcatgttt

SEQ ID NO: 992192 - DNA, 22 bp, Artificial Sequence
  chemically synthesized
tctttttgtagacaaacatgcc

SEQ ID NO: 992193 - DNA, 22 bp, Artificial Sequence
  chemically synthesized
gaagcacttagggcatgtttgt

SEQ ID NO: 992194 - DNA, 22 bp, Artificial Sequence
  chemically synthesized
agggcatgtttgtctacaaaaa

SEQ ID NO: 992195 - DNA, 22 bp, Artificial Sequence
  chemically synthesized
gggcatgtttgtctacaaaaag

SEQ ID NO: 992196 - DNA, 22 bp, Artificial Sequence
  chemically synthesized
aggaaagaaaaaggccctatct

SEQ ID NO: 992197 - DNA, 22 bp, Artificial Sequence
  chemically synthesized
gtctacaaaaagatagggcctt

SEQ ID NO: 992198 - DNA, 22 bp, Artificial Sequence
  chemically synthesized
tctacaaaaagatagggccttt

SEQ ID NO: 992199 - DNA, 22 bp, Artificial Sequence
  chemically synthesized
ttaaggaaagaaaaaggcccta

SEQ ID NO: 992200 - DNA, 22 bp, Artificial Sequence
  chemically synthesized
caaaaagatagggcctttttct

SEQ ID NO: 992201 - DNA, 22 bp, Artificial Sequence
  chemically synthesized
aattgttaaggaaagaaaaagg

SEQ ID NO: 992202 - DNA, 22 bp, Artificial Sequence
  chemically synthesized
aaattgttaaggaaagaaaaag

SEQ ID NO: 992203 - DNA, 22 bp, Artificial Sequence
  chemically synthesized
taaattgttaaggaaagaaaaa

SEQ ID NO: 992204 - DNA, 22 bp, Artificial Sequence
  chemically synthesized
ttaaattgttaaggaaagaaaa

SEQ ID NO: 992205 - DNA, 22 bp, Artificial Sequence
  chemically synthesized
tttaaattgttaaggaaagaaa

SEQ ID NO: 992206 - DNA, 22 bp, Artificial Sequence
  chemically synthesized
ccgtattttttaaattgttaag

SEQ ID NO: 992207 - DNA, 22 bp, Artificial Sequence
  chemically synthesized
ttaccgtattttttaaattgtt

SEQ ID NO: 992208 - DNA, 22 bp, Artificial Sequence
  chemically synthesized
tttctttccttaacaatttaaa

SEQ ID NO: 992209 - DNA, 22 bp, Artificial Sequence
  chemically synthesized
gttaccgtattttttaaattgt

SEQ ID NO: 992210 - DNA, 22 bp, Artificial Sequence
  chemically synthesized
ttctttccttaacaatttaaaa

SEQ ID NO: 992211 - DNA, 22 bp, Artificial Sequence
  chemically synthesized
tctttccttaacaatttaaaaa

SEQ ID NO: 992212 - DNA, 22 bp, Artificial Sequence
  chemically synthesized
ctttccttaacaatttaaaaaa

SEQ ID NO: 992213 - DNA, 22 bp, Artificial Sequence
  chemically synthesized
tttccttaacaatttaaaaaat

SEQ ID NO: 992214 - DNA, 22 bp, Artificial Sequence
  chemically synthesized
gtttgttaccgtattttttaaa

SEQ ID NO: 992215 - DNA, 22 bp, Artificial Sequence
  chemically synthesized
tccttaacaatttaaaaaatac

SEQ ID NO: 992216 - DNA, 22 bp, Artificial Sequence
  chemically synthesized
tggtttgttaccgtatttttta

SEQ ID NO: 992217 - DNA, 22 bp, Artificial Sequence
  chemically synthesized
ccttaacaatttaaaaaatacg

SEQ ID NO: 992218 - DNA, 22 bp, Artificial Sequence
  chemically synthesized
cttaacaatttaaaaaatacgg

SEQ ID NO: 992219 - DNA, 22 bp, Artificial Sequence
  chemically synthesized
aacaatttaaaaaatacggtaa

SEQ ID NO: 992220 - DNA, 22 bp, Artificial Sequence
  chemically synthesized
acaatttaaaaaatacggtaac

SEQ ID NO: 992221 - DNA, 22 bp, Artificial Sequence
  chemically synthesized
aaaaaatacggtaacaaaccag

SEQ ID NO: 992222 - DNA, 22 bp, Artificial Sequence
  chemically synthesized
aaaaatacggtaacaaaccaga

SEQ ID NO: 992223 - DNA, 22 bp, Artificial Sequence
  chemically synthesized
aagtatcaggtctctggtttgt

SEQ ID NO: 992224 - DNA, 22 bp, Artificial Sequence
  chemically synthesized
aaagtatcaggtctctggtttg

SEQ ID NO: 992225 - DNA, 22 bp, Artificial Sequence
  chemically synthesized
cttaaagtatcaggtctctggt

SEQ ID NO: 992226 - DNA, 22 bp, Artificial Sequence
  chemically synthesized
ccttaaagtatcaggtctctgg

SEQ ID NO: 992227 - DNA, 22 bp, Artificial Sequence
  chemically synthesized
acaataaatgatcttccttaaa

SEQ ID NO: 992228 - DNA, 22 bp, Artificial Sequence
  chemically synthesized
atactttaaggaagatcattta

SEQ ID NO: 992229 - DNA, 22 bp, Artificial Sequence
  chemically synthesized
atggagctcacaataaatgatc

SEQ ID NO: 992230 - DNA, 22 bp, Artificial Sequence
  chemically synthesized
taaggaagatcatttattgtga

SEQ ID NO: 992231 - DNA, 22 bp, Artificial Sequence
  chemically synthesized
aaggaagatcatttattgtgag

SEQ ID NO: 992232 - DNA, 22 bp, Artificial Sequence
  chemically synthesized
aggaagatcatttattgtgagc

SEQ ID NO: 992233 - DNA, 22 bp, Artificial Sequence
  chemically synthesized
aggccctcatggagctcacaat

SEQ ID NO: 992234 - DNA, 22 bp, Artificial Sequence
  chemically synthesized
attgtgagctccatgagggcct

SEQ ID NO: 992235 - DNA, 22 bp, Artificial Sequence
  chemically synthesized
ttgtgagctccatgagggcctc

SEQ ID NO: 992236 - DNA, 22 bp, Artificial Sequence
  chemically synthesized
gaaacagaccattgaggccctc

SEQ ID NO: 992237 - DNA, 22 bp, Artificial Sequence
  chemically synthesized
cgaaacagaccattgaggccct

SEQ ID NO: 992238 - DNA, 22 bp, Artificial Sequence
  chemically synthesized
tgagctccatgagggcctcaat

SEQ ID NO: 992239 - DNA, 22 bp, Artificial Sequence
  chemically synthesized
caatttcgaaacagaccattga

SEQ ID NO: 992240 - DNA, 22 bp, Artificial Sequence
  chemically synthesized
catgagggcctcaatggtctgt

SEQ ID NO: 992241 - DNA, 22 bp, Artificial Sequence
  chemically synthesized
gggctgcaatttcgaaacagac

SEQ ID NO: 992242 - DNA, 22 bp, Artificial Sequence
  chemically synthesized
gatgctggggctgcaatttcga

SEQ ID NO: 992243 - DNA, 22 bp, Artificial Sequence
  chemically synthesized
aatggtctgtttcgaaattgca

SEQ ID NO: 992244 - DNA, 22 bp, Artificial Sequence
  chemically synthesized
tagatgctggggctgcaatttc

SEQ ID NO: 992245 - DNA, 22 bp, Artificial Sequence
  chemically synthesized
tgttctagatgctggggctgca

SEQ ID NO: 992246 - DNA, 22 bp, Artificial Sequence
  chemically synthesized
tttcgaaattgcagccccagca

SEQ ID NO: 992247 - DNA, 22 bp, Artificial Sequence
  chemically synthesized
actgtgttctagatgctggggc

SEQ ID NO: 992248 - DNA, 22 bp, Artificial Sequence
  chemically synthesized
cgaaattgcagccccagcatct

SEQ ID NO: 992249 - DNA, 22 bp, Artificial Sequence
  chemically synthesized
gaaattgcagccccagcatcta

SEQ ID NO: 992250 - DNA, 22 bp, Artificial Sequence
  chemically synthesized
cagccccagcatctagaacaca

SEQ ID NO: 992251 - DNA, 22 bp, Artificial Sequence
  chemically synthesized
tcaagtgctgactgtgttctag

SEQ ID NO: 992252 - DNA, 22 bp, Artificial Sequence
  chemically synthesized
atcaagtgctgactgtgttcta

SEQ ID NO: 992253 - DNA, 22 bp, Artificial Sequence
  chemically synthesized
gccaaatatttatcaagtgctg

SEQ ID NO: 992254 - DNA, 22 bp, Artificial Sequence
  chemically synthesized
agccaaatatttatcaagtgct

SEQ ID NO: 992255 - DNA, 22 bp, Artificial Sequence
  chemically synthesized
gaacacagtcagcacttgataa

SEQ ID NO: 992256 - DNA, 22 bp, Artificial Sequence
  chemically synthesized
atatttagccaaatatttatca

SEQ ID NO: 992257 - DNA, 22 bp, Artificial Sequence
  chemically synthesized
aatatttagccaaatatttatc

SEQ ID NO: 992258 - DNA, 22 bp, Artificial Sequence
  chemically synthesized
agcatttaatatttagccaaat

SEQ ID NO: 992259 - DNA, 22 bp, Artificial Sequence
  chemically synthesized
gataaatatttggctaaatatt

SEQ ID NO: 992260 - DNA, 22 bp, Artificial Sequence
  chemically synthesized
ataaatatttggctaaatatta

SEQ ID NO: 992261 - DNA, 22 bp, Artificial Sequence
  chemically synthesized
atatcaattgagcatttaatat

SEQ ID NO: 992262 - DNA, 22 bp, Artificial Sequence
  chemically synthesized
ggctaaatattaaatgctcaat

SEQ ID NO: 992263 - DNA, 22 bp, Artificial Sequence
  chemically synthesized
aacctgatatcaattgagcatt

SEQ ID NO: 992264 - DNA, 22 bp, Artificial Sequence
  chemically synthesized
gctaaatattaaatgctcaatt

SEQ ID NO: 992265 - DNA, 22 bp, Artificial Sequence
  chemically synthesized
gaacctgatatcaattgagcat

SEQ ID NO: 992266 - DNA, 22 bp, Artificial Sequence
  chemically synthesized
aatattaaatgctcaattgata

SEQ ID NO: 992267 - DNA, 22 bp, Artificial Sequence
  chemically synthesized
atttgaacctgatatcaattga

SEQ ID NO: 992268 - DNA, 22 bp, Artificial Sequence
  chemically synthesized
taatttgaacctgatatcaatt

SEQ ID NO: 992269 - DNA, 22 bp, Artificial Sequence
  chemically synthesized
aatgctcaattgatatcaggtt

SEQ ID NO: 992270 - DNA, 22 bp, Artificial Sequence
  chemically synthesized
gcaaattctaatttgaacctga

SEQ ID NO: 992271 - DNA, 22 bp, Artificial Sequence
  chemically synthesized
agcaaattctaatttgaacctg

SEQ ID NO: 992272 - DNA, 22 bp, Artificial Sequence
  chemically synthesized
aattgatatcaggttcaaatta

SEQ ID NO: 992273 - DNA, 22 bp, Artificial Sequence
  chemically synthesized
atatcaggttcaaattagaatt

SEQ ID NO: 992274 - DNA, 22 bp, Artificial Sequence
  chemically synthesized
cagtgtgtaaataatttagcaa

SEQ ID NO: 992275 - DNA, 22 bp, Artificial Sequence
  chemically synthesized
aaattagaatttgctaaattat

SEQ ID NO: 992276 - DNA, 22 bp, Artificial Sequence
  chemically synthesized
attacagtgtgtaaataattta

SEQ ID NO: 992277 - DNA, 22 bp, Artificial Sequence
  chemically synthesized
cattacagtgtgtaaataattt

SEQ ID NO: 992278 - DNA, 22 bp, Artificial Sequence
  chemically synthesized
tcattacagtgtgtaaataatt

SEQ ID NO: 992279 - DNA, 22 bp, Artificial Sequence
  chemically synthesized
gaatttgctaaattatttacac

SEQ ID NO: 992280 - DNA, 22 bp, Artificial Sequence
  chemically synthesized
ctttcattacagtgtgtaaata

SEQ ID NO: 992281 - DNA, 22 bp, Artificial Sequence
  chemically synthesized
actttcattacagtgtgtaaat

SEQ ID NO: 992282 - DNA, 22 bp, Artificial Sequence
  chemically synthesized
tactttcattacagtgtgtaaa

SEQ ID NO: 992283 - DNA, 22 bp, Artificial Sequence
  chemically synthesized
ttactttcattacagtgtgtaa

SEQ ID NO: 992284 - DNA, 22 bp, Artificial Sequence
  chemically synthesized
tttactttcattacagtgtgta

SEQ ID NO: 992285 - DNA, 22 bp, Artificial Sequence
  chemically synthesized
gctaaattatttacacactgta

SEQ ID NO: 992286 - DNA, 22 bp, Artificial Sequence
  chemically synthesized
ctaaattatttacacactgtaa

SEQ ID NO: 992287 - DNA, 22 bp, Artificial Sequence
  chemically synthesized
aattatttacacactgtaatga

SEQ ID NO: 992288 - DNA, 22 bp, Artificial Sequence
  chemically synthesized
cattttttactttcattacagt

SEQ ID NO: 992289 - DNA, 22 bp, Artificial Sequence
  chemically synthesized
gcattttttactttcattacag

SEQ ID NO: 992290 - DNA, 22 bp, Artificial Sequence
  chemically synthesized
tttacacactgtaatgaaagta

SEQ ID NO: 992291 - DNA, 22 bp, Artificial Sequence
  chemically synthesized
acacactgtaatgaaagtaaaa

SEQ ID NO: 992292 - DNA, 22 bp, Artificial Sequence
  chemically synthesized
cacactgtaatgaaagtaaaaa

SEQ ID NO: 992293 - DNA, 22 bp, Artificial Sequence
  chemically synthesized
agcaaaccttgcattttttact

SEQ ID NO: 992294 - DNA, 22 bp, Artificial Sequence
  chemically synthesized
ttcagcaaaccttgcatttttt

SEQ ID NO: 992295 - DNA, 22 bp, Artificial Sequence
  chemically synthesized
taatgaaagtaaaaaatgcaag

SEQ ID NO: 992296 - DNA, 22 bp, Artificial Sequence
  chemically synthesized
gagctgttcagcaaaccttgca

SEQ ID NO: 992297 - DNA, 22 bp, Artificial Sequence
  chemically synthesized
tggagctgttcagcaaaccttg

SEQ ID NO: 992298 - DNA, 22 bp, Artificial Sequence
  chemically synthesized
accctctggagctgttcagcaa

SEQ ID NO: 992299 - DNA, 22 bp, Artificial Sequence
  chemically synthesized
ttaaccctctggagctgttcag

SEQ ID NO: 992300 - DNA, 22 bp, Artificial Sequence
  chemically synthesized
attaaccctctggagctgttca

SEQ ID NO: 992301 - DNA, 22 bp, Artificial Sequence
  chemically synthesized
ttattaaccctctggagctgtt

SEQ ID NO: 992302 - DNA, 22 bp, Artificial Sequence
  chemically synthesized
gctgaacagctccagagggtta

SEQ ID NO: 992303 - DNA, 22 bp, Artificial Sequence
  chemically synthesized
ctgaacagctccagagggttaa

SEQ ID NO: 992304 - DNA, 22 bp, Artificial Sequence
  chemically synthesized
aacagctccagagggttaataa

SEQ ID NO: 992305 - DNA, 22 bp, Artificial Sequence
  chemically synthesized
cagagggttaataagagtgtgt

SEQ ID NO: 992306 - DNA, 22 bp, Artificial Sequence
  chemically synthesized
aatgacaaaaggatacacacac

SEQ ID NO: 992307 - DNA, 22 bp, Artificial Sequence
  chemically synthesized
ataagagtgtgtgtgtgtatcc

SEQ ID NO: 992308 - DNA, 22 bp, Artificial Sequence
  chemically synthesized
ttgtcattcaacacacacacac

SEQ ID NO: 992309 - DNA, 22 bp, Artificial Sequence
  chemically synthesized
tgtcattcaacacacacacaca

SEQ ID NO: 992310 - DNA, 22 bp, Artificial Sequence
  chemically synthesized
gtcattcaacacacacacacac

SEQ ID NO: 992311 - DNA, 22 bp, Artificial Sequence
  chemically synthesized
tcattcaacacacacacacaca

SEQ ID NO: 992312 - DNA, 22 bp, Artificial Sequence
  chemically synthesized
aacacacacacacacacacaca

SEQ ID NO: 992313 - DNA, 22 bp, Artificial Sequence
  chemically synthesized
tacaggtgtgtgtgtgtgtgtg

SEQ ID NO: 992314 - DNA, 22 bp, Artificial Sequence
  chemically synthesized
tcatcagctatacaggtgtgtg

SEQ ID NO: 992315 - DNA, 22 bp, Artificial Sequence
  chemically synthesized
atcatcagctatacaggtgtgt

SEQ ID NO: 992316 - DNA, 22 bp, Artificial Sequence
  chemically synthesized
atataatgtatatttatcatca

SEQ ID NO: 992317 - DNA, 22 bp, Artificial Sequence
  chemically synthesized
attgatataatgtatatttatc

SEQ ID NO: 992318 - DNA, 22 bp, Artificial Sequence
  chemically synthesized
tatagctgatgataaatataca

SEQ ID NO: 992319 - DNA, 22 bp, Artificial Sequence
  chemically synthesized
actcattgatataatgtatatt

SEQ ID NO: 992320 - DNA, 22 bp, Artificial Sequence
  chemically synthesized
aactcattgatataatgtatat

SEQ ID NO: 992321 - DNA, 22 bp, Artificial Sequence
  chemically synthesized
taactcattgatataatgtata

SEQ ID NO: 992322 - DNA, 22 bp, Artificial Sequence
  chemically synthesized
ttttaactcattgatataatgt

SEQ ID NO: 992323 - DNA, 22 bp, Artificial Sequence
  chemically synthesized
atgataaatatacattatatca

SEQ ID NO: 992324 - DNA, 22 bp, Artificial Sequence
  chemically synthesized
attttaactcattgatataatg

SEQ ID NO: 992325 - DNA, 22 bp, Artificial Sequence
  chemically synthesized
tattttaactcattgatataat

SEQ ID NO: 992326 - DNA, 22 bp, Artificial Sequence
  chemically synthesized
tatcaatgagttaaaataaagt

SEQ ID NO: 992327 - DNA, 22 bp, Artificial Sequence
  chemically synthesized
agtgaatgaatagcacacttta

SEQ ID NO: 992328 - DNA, 22 bp, Artificial Sequence
  chemically synthesized
ctcagtgaatgaatagcacact

SEQ ID NO: 992329 - DNA, 22 bp, Artificial Sequence
  chemically synthesized
aaataaagtgtgctattcattc

SEQ ID NO: 992330 - DNA, 22 bp, Artificial Sequence
  chemically synthesized
ttcattcactgagcaatggggc

SEQ ID NO: 992331 - DNA, 22 bp, Artificial Sequence
  chemically synthesized
attcactgagcaatggggctat

SEQ ID NO: 992332 - DNA, 22 bp, Artificial Sequence
  chemically synthesized
actgagcaatggggctattgcc

SEQ ID NO: 992333 - DNA, 22 bp, Artificial Sequence
  chemically synthesized
agcaatggggctattgcctggg

SEQ ID NO: 992334 - DNA, 22 bp, Artificial Sequence
  chemically synthesized
caggcgtgagccaccgtgccca

SEQ ID NO: 992335 - DNA, 22 bp, Artificial Sequence
  chemically synthesized
acaggcgtgagccaccgtgccc

SEQ ID NO: 992336 - DNA, 22 bp, Artificial Sequence
  chemically synthesized
ggtttacaggcgtgagccaccg

SEQ ID NO: 992337 - DNA, 22 bp, Artificial Sequence
  chemically synthesized
ttgcctgggcacggtggctcac

SEQ ID NO: 992338 - DNA, 22 bp, Artificial Sequence
  chemically synthesized
cctgggcacggtggctcacgcc

SEQ ID NO: 992339 - DNA, 22 bp, Artificial Sequence
  chemically synthesized
ggcacggtggctcacgcctgta

SEQ ID NO: 992340 - DNA, 22 bp, Artificial Sequence
  chemically synthesized
ccaaagtgctgggtttacaggc

SEQ ID NO: 992341 - DNA, 22 bp, Artificial Sequence
  chemically synthesized
agcctcccaaagtgctgggttt

SEQ ID NO: 992342 - DNA, 22 bp, Artificial Sequence
  chemically synthesized
acgcctgtaaacccagcacttt

SEQ ID NO: 992343 - DNA, 22 bp, Artificial Sequence
  chemically synthesized
cctcagcctcccaaagtgctgg

SEQ ID NO: 992344 - DNA, 22 bp, Artificial Sequence
  chemically synthesized
taaacccagcactttgggaggc

SEQ ID NO: 992345 - DNA, 22 bp, Artificial Sequence
  chemically synthesized
tgatccatctgcctcagcctcc

SEQ ID NO: 992346 - DNA, 22 bp, Artificial Sequence
  chemically synthesized
gtgatccatctgcctcagcctc

SEQ ID NO: 992347 - DNA, 22 bp, Artificial Sequence
  chemically synthesized
accttgtgatccatctgcctca

SEQ ID NO: 992348 - DNA, 22 bp, Artificial Sequence
  chemically synthesized
gaccttgtgatccatctgcctc

SEQ ID NO: 992349 - DNA, 22 bp, Artificial Sequence
  chemically synthesized
ttgaccttgtgatccatctgcc

SEQ ID NO: 992350 - DNA, 22 bp, Artificial Sequence
  chemically synthesized
tgggaggctgaggcagatggat

SEQ ID NO: 992351 - DNA, 22 bp, Artificial Sequence
  chemically synthesized
gggaggctgaggcagatggatc

SEQ ID NO: 992352 - DNA, 22 bp, Artificial Sequence
  chemically synthesized
ggaggctgaggcagatggatca

SEQ ID NO: 992353 - DNA, 22 bp, Artificial Sequence
  chemically synthesized
gatctcttgaccttgtgatcca

SEQ ID NO: 992354 - DNA, 22 bp, Artificial Sequence
  chemically synthesized
aggcagatggatcacaaggtca

SEQ ID NO: 992355 - DNA, 22 bp, Artificial Sequence
  chemically synthesized
gccaggacagtctcgatctctt

SEQ ID NO: 992356 - DNA, 22 bp, Artificial Sequence
  chemically synthesized
accatgttggccaggacagtct

SEQ ID NO: 992357 - DNA, 22 bp, Artificial Sequence
  chemically synthesized
caccatgttggccaggacagtc

SEQ ID NO: 992358 - DNA, 22 bp, Artificial Sequence
  chemically synthesized
tcaccatgttggccaggacagt

SEQ ID NO: 992359 - DNA, 22 bp, Artificial Sequence
  chemically synthesized
gtagagacgggttttcaccatg

SEQ ID NO: 992360 - DNA, 22 bp, Artificial Sequence
  chemically synthesized
agtagagacgggttttcaccat

SEQ ID NO: 992361 - DNA, 22 bp, Artificial Sequence
  chemically synthesized
tcctggccaacatggtgaaaac

SEQ ID NO: 992362 - DNA, 22 bp, Artificial Sequence
  chemically synthesized
tagtagagacgggttttcacca

SEQ ID NO: 992363 - DNA, 22 bp, Artificial Sequence
  chemically synthesized
ttagtagagacgggttttcacc

SEQ ID NO: 992364 - DNA, 22 bp, Artificial Sequence
  chemically synthesized
gccaacatggtgaaaacccgtc

SEQ ID NO: 992365 - DNA, 22 bp, Artificial Sequence
  chemically synthesized
tatttttagtagagacgggttt

SEQ ID NO: 992366 - DNA, 22 bp, Artificial Sequence
  chemically synthesized
gtatttttagtagagacgggtt

SEQ ID NO: 992367 - DNA, 22 bp, Artificial Sequence
  chemically synthesized
tgtatttttagtagagacgggt

SEQ ID NO: 992368 - DNA, 22 bp, Artificial Sequence
  chemically synthesized
ttgtatttttagtagagacggg

SEQ ID NO: 992369 - DNA, 22 bp, Artificial Sequence
  chemically synthesized
atttttgtatttttagtagaga

SEQ ID NO: 992370 - DNA, 22 bp, Artificial Sequence
  chemically synthesized
tactaaaaatacaaaaattaga

SEQ ID NO: 992371 - DNA, 22 bp, Artificial Sequence
  chemically synthesized
ctaaaaatacaaaaattagatg

SEQ ID NO: 992372 - DNA, 22 bp, Artificial Sequence
  chemically synthesized
aaaatacaaaaattagatgggc

SEQ ID NO: 992373 - DNA, 22 bp, Artificial Sequence
  chemically synthesized
caggtgtgcgtcaccatgccca

SEQ ID NO: 992374 - DNA, 22 bp, Artificial Sequence
  chemically synthesized
agattacaggtgtgcgtcacca

SEQ ID NO: 992375 - DNA, 22 bp, Artificial Sequence
  chemically synthesized
gatgggcatggtgacgcacacc

SEQ ID NO: 992376 - DNA, 22 bp, Artificial Sequence
  chemically synthesized
ccgagtagctgagattacaggt

SEQ ID NO: 992377 - DNA, 22 bp, Artificial Sequence
  chemically synthesized
agcctcccgagtagctgagatt

SEQ ID NO: 992378 - DNA, 22 bp, Artificial Sequence
  chemically synthesized
cctcagcctcccgagtagctga

SEQ ID NO: 992379 - DNA, 22 bp, Artificial Sequence
  chemically synthesized
ctacctcagcctcccgagtagc

SEQ ID NO: 992380 - DNA, 22 bp, Artificial Sequence
  chemically synthesized
tcctacctcagcctcccgagta

SEQ ID NO: 992381 - DNA, 22 bp, Artificial Sequence
  chemically synthesized
taatctcagctactcgggaggc

SEQ ID NO: 992382 - DNA, 22 bp, Artificial Sequence
  chemically synthesized
agctactcgggaggctgaggta

SEQ ID NO: 992383 - DNA, 22 bp, Artificial Sequence
  chemically synthesized
aaaagattctcctacctcagcc

SEQ ID NO: 992384 - DNA, 22 bp, Artificial Sequence
  chemically synthesized
ctcgggaggctgaggtaggaga

SEQ ID NO: 992385 - DNA, 22 bp, Artificial Sequence
  chemically synthesized
gggaggctgaggtaggagaatc

SEQ ID NO: 992386 - DNA, 22 bp, Artificial Sequence
  chemically synthesized
ccgggttcaaaagattctccta

SEQ ID NO: 992387 - DNA, 22 bp, Artificial Sequence
  chemically synthesized
cctcccgggttcaaaagattct

SEQ ID NO: 992388 - DNA, 22 bp, Artificial Sequence
  chemically synthesized
aggtaggagaatcttttgaacc

SEQ ID NO: 992389 - DNA, 22 bp, Artificial Sequence
  chemically synthesized
caaccactgcctcccgggttca

SEQ ID NO: 992390 - DNA, 22 bp, Artificial Sequence
  chemically synthesized
actgcaaccactgcctcccggg

SEQ ID NO: 992391 - DNA, 22 bp, Artificial Sequence
  chemically synthesized
ggctcactgcaaccactgcctc

SEQ ID NO: 992392 - DNA, 22 bp, Artificial Sequence
  chemically synthesized
ttgaacccgggaggcagtggtt

SEQ ID NO: 992393 - DNA, 22 bp, Artificial Sequence
  chemically synthesized
tgaacccgggaggcagtggttg

SEQ ID NO: 992394 - DNA, 22 bp, Artificial Sequence
  chemically synthesized
gaacccgggaggcagtggttgc

SEQ ID NO: 992395 - DNA, 22 bp, Artificial Sequence
  chemically synthesized
aacccgggaggcagtggttgca

SEQ ID NO: 992396 - DNA, 22 bp, Artificial Sequence
  chemically synthesized
gagtgcagtggtgcaatctcgg

SEQ ID NO: 992397 - DNA, 22 bp, Artificial Sequence
  chemically synthesized
cagtgagccgagattgcaccac

SEQ ID NO: 992398 - DNA, 22 bp, Artificial Sequence
  chemically synthesized
tcgccaggctggagtgcagtgg

SEQ ID NO: 992399 - DNA, 22 bp, Artificial Sequence
  chemically synthesized
tgtcgccaggctggagtgcagt

SEQ ID NO: 992400 - DNA, 22 bp, Artificial Sequence
  chemically synthesized
gctctgtcgccaggctggagtg

SEQ ID NO: 992401 - DNA, 22 bp, Artificial Sequence
  chemically synthesized
caccactgcactccagcctggc

SEQ ID NO: 992402 - DNA, 22 bp, Artificial Sequence
  chemically synthesized
cactccagcctggcgacagagc

SEQ ID NO: 992403 - DNA, 22 bp, Artificial Sequence
  chemically synthesized
agacgaagtctcgctctgtcgc

SEQ ID NO: 992404 - DNA, 22 bp, Artificial Sequence
  chemically synthesized
gagacgaagtctcgctctgtcg

SEQ ID NO: 992405 - DNA, 22 bp, Artificial Sequence
  chemically synthesized
tgagacgaagtctcgctctgtc

SEQ ID NO: 992406 - DNA, 22 bp, Artificial Sequence
  chemically synthesized
ttgagacgaagtctcgctctgt

SEQ ID NO: 992407 - DNA, 22 bp, Artificial Sequence
  chemically synthesized
tttgagacgaagtctcgctctg

SEQ ID NO: 992408 - DNA, 22 bp, Artificial Sequence
  chemically synthesized
cagcctggcgacagagcgagac

SEQ ID NO: 992409 - DNA, 22 bp, Artificial Sequence
  chemically synthesized
ttttgagacgaagtctcgctct

SEQ ID NO: 992410 - DNA, 22 bp, Artificial Sequence
  chemically synthesized
tttttttgagacgaagtctcgc

SEQ ID NO: 992411 - DNA, 22 bp, Artificial Sequence
  chemically synthesized
atttttttgagacgaagtctcg

SEQ ID NO: 992412 - DNA, 22 bp, Artificial Sequence
  chemically synthesized
gcgacagagcgagacttcgtct

SEQ ID NO: 992413 - DNA, 22 bp, Artificial Sequence
  chemically synthesized
tttatttttttgagacgaagtc

SEQ ID NO: 992414 - DNA, 22 bp, Artificial Sequence
  chemically synthesized
atttatttttttgagacgaagt

SEQ ID NO: 992415 - DNA, 22 bp, Artificial Sequence
  chemically synthesized
caaatttatttatttttttgag

SEQ ID NO: 992416 - DNA, 22 bp, Artificial Sequence
  chemically synthesized
acaaatttatttatttttttga

SEQ ID NO: 992417 - DNA, 22 bp, Artificial Sequence
  chemically synthesized
tacaaatttatttatttttttg

SEQ ID NO: 992418 - DNA, 22 bp, Artificial Sequence
  chemically synthesized
ttacaaatttatttattttttt

SEQ ID NO: 992419 - DNA, 22 bp, Artificial Sequence
  chemically synthesized
tttacaaatttatttatttttt

SEQ ID NO: 992420 - DNA, 22 bp, Artificial Sequence
  chemically synthesized
ttttacaaatttatttattttt

SEQ ID NO: 992421 - DNA, 22 bp, Artificial Sequence
  chemically synthesized
tttttacaaatttatttatttt

SEQ ID NO: 992422 - DNA, 22 bp, Artificial Sequence
  chemically synthesized
cgtctcaaaaaaataaataaat

SEQ ID NO: 992423 - DNA, 22 bp, Artificial Sequence
  chemically synthesized
gtctcaaaaaaataaataaatt

SEQ ID NO: 992424 - DNA, 22 bp, Artificial Sequence
  chemically synthesized
aatctttttttacaaatttatt

SEQ ID NO: 992425 - DNA, 22 bp, Artificial Sequence
  chemically synthesized
aaatctttttttacaaatttat

SEQ ID NO: 992426 - DNA, 22 bp, Artificial Sequence
  chemically synthesized
aaaaaaataaataaatttgtaa

SEQ ID NO: 992427 - DNA, 22 bp, Artificial Sequence
  chemically synthesized
cttaaatctttttttacaaatt

SEQ ID NO: 992428 - DNA, 22 bp, Artificial Sequence
  chemically synthesized
gcttaaatctttttttacaaat

SEQ ID NO: 992429 - DNA, 22 bp, Artificial Sequence
  chemically synthesized
tcagtgggtttgcttaaatctt

SEQ ID NO: 992430 - DNA, 22 bp, Artificial Sequence
  chemically synthesized
ttatcagtgggtttgcttaaat

SEQ ID NO: 992431 - DNA, 22 bp, Artificial Sequence
  chemically synthesized
gtaaaaaaagatttaagcaaac

SEQ ID NO: 992432 - DNA, 22 bp, Artificial Sequence
  chemically synthesized
taaaaaaagatttaagcaaacc

SEQ ID NO: 992433 - DNA, 22 bp, Artificial Sequence
  chemically synthesized
agtattgttatcagtgggtttg

SEQ ID NO: 992434 - DNA, 22 bp, Artificial Sequence
  chemically synthesized
taagtattgttatcagtgggtt

SEQ ID NO: 992435 - DNA, 22 bp, Artificial Sequence
  chemically synthesized
ctaagtattgttatcagtgggt

SEQ ID NO: 992436 - DNA, 22 bp, Artificial Sequence
  chemically synthesized
tctaagtattgttatcagtggg

SEQ ID NO: 992437 - DNA, 22 bp, Artificial Sequence
  chemically synthesized
aagcaaacccactgataacaat

SEQ ID NO: 992438 - DNA, 22 bp, Artificial Sequence
  chemically synthesized
agcaaacccactgataacaata

SEQ ID NO: 992439 - DNA, 22 bp, Artificial Sequence
  chemically synthesized
aacaaactttctaagtattgtt

SEQ ID NO: 992440 - DNA, 22 bp, Artificial Sequence
  chemically synthesized
caacaaactttctaagtattgt

SEQ ID NO: 992441 - DNA, 22 bp, Artificial Sequence
  chemically synthesized
tcaacaaactttctaagtattg

SEQ ID NO: 992442 - DNA, 22 bp, Artificial Sequence
  chemically synthesized
ataacaatacttagaaagtttg

SEQ ID NO: 992443 - DNA, 22 bp, Artificial Sequence
  chemically synthesized
agaaagtttgttgaaaaccgta

SEQ ID NO: 992444 - DNA, 22 bp, Artificial Sequence
  chemically synthesized
gaaagtttgttgaaaaccgtat

SEQ ID NO: 992445 - DNA, 22 bp, Artificial Sequence
  chemically synthesized
gttgaaaaccgtatgtattatt

SEQ ID NO: 992446 - DNA, 22 bp, Artificial Sequence
  chemically synthesized
ttgaaaaccgtatgtattattt

SEQ ID NO: 992447 - DNA, 22 bp, Artificial Sequence
  chemically synthesized
tcagggcaataagcaaataata

SEQ ID NO: 992448 - DNA, 22 bp, Artificial Sequence
  chemically synthesized
aaaaccgtatgtattatttgct

SEQ ID NO: 992449 - DNA, 22 bp, Artificial Sequence
  chemically synthesized
gaaattgtcagggcaataagca

SEQ ID NO: 992450 - DNA, 22 bp, Artificial Sequence
  chemically synthesized
tgatattagaaattgtcagggc

SEQ ID NO: 992451 - DNA, 22 bp, Artificial Sequence
  chemically synthesized
tttgcttattgccctgacaatt

SEQ ID NO: 992452 - DNA, 22 bp, Artificial Sequence
  chemically synthesized
ttatgatattagaaattgtcag

SEQ ID NO: 992453 - DNA, 22 bp, Artificial Sequence
  chemically synthesized
gcttattgccctgacaatttct

SEQ ID NO: 992454 - DNA, 22 bp, Artificial Sequence
  chemically synthesized
cttattgccctgacaatttcta

SEQ ID NO: 992455 - DNA, 22 bp, Artificial Sequence
  chemically synthesized
attgccctgacaatttctaata

SEQ ID NO: 992456 - DNA, 22 bp, Artificial Sequence
  chemically synthesized
ttgccctgacaatttctaatat

SEQ ID NO: 992457 - DNA, 22 bp, Artificial Sequence
  chemically synthesized
ccctgacaatttctaatatcat

SEQ ID NO: 992458 - DNA, 22 bp, Artificial Sequence
  chemically synthesized
taatgaactattatgatattag

SEQ ID NO: 992459 - DNA, 22 bp, Artificial Sequence
  chemically synthesized
ttataatgaactattatgatat

SEQ ID NO: 992460 - DNA, 22 bp, Artificial Sequence
  chemically synthesized
acaatttctaatatcataatag

SEQ ID NO: 992461 - DNA, 22 bp, Artificial Sequence
  chemically synthesized
ctaatatcataatagttcatta

SEQ ID NO: 992462 - DNA, 22 bp, Artificial Sequence
  chemically synthesized
taatatcataatagttcattat

SEQ ID NO: 992463 - DNA, 22 bp, Artificial Sequence
  chemically synthesized
atatcataatagttcattataa

SEQ ID NO: 992464 - DNA, 22 bp, Artificial Sequence
  chemically synthesized
aggaatgggctattataatgaa

SEQ ID NO: 992465 - DNA, 22 bp, Artificial Sequence
  chemically synthesized
actgaggaatgggctattataa

SEQ ID NO: 992466 - DNA, 22 bp, Artificial Sequence
  chemically synthesized
attcactgaggaatgggctatt

SEQ ID NO: 992467 - DNA, 22 bp, Artificial Sequence
  chemically synthesized
ttcattcactgaggaatgggct

SEQ ID NO: 992468 - DNA, 22 bp, Artificial Sequence
  chemically synthesized
attataatagcccattcctcag

SEQ ID NO: 992469 - DNA, 22 bp, Artificial Sequence
  chemically synthesized
taatagcccattcctcagtgaa

SEQ ID NO: 992470 - DNA, 22 bp, Artificial Sequence
  chemically synthesized
aaatgaagtgtgctattcattc

SEQ ID NO: 992471 - DNA, 22 bp, Artificial Sequence
  chemically synthesized
ctcagtgaatgaatagcacact

SEQ ID NO: 992472 - DNA, 22 bp, Artificial Sequence
  chemically synthesized
agtgaatgaatagcacacttca

SEQ ID NO: 992473 - DNA, 22 bp, Artificial Sequence
  chemically synthesized
tatcaatgagttcaaatgaagt

SEQ ID NO: 992474 - DNA, 22 bp, Artificial Sequence
  chemically synthesized
catttgaactcattgatacaat

SEQ ID NO: 992475 - DNA, 22 bp, Artificial Sequence
  chemically synthesized
atttgaactcattgatacaatg

SEQ ID NO: 992476 - DNA, 22 bp, Artificial Sequence
  chemically synthesized
atgataaatatacattgtatca

SEQ ID NO: 992477 - DNA, 22 bp, Artificial Sequence
  chemically synthesized
gaactcattgatacaatgtata

SEQ ID NO: 992478 - DNA, 22 bp, Artificial Sequence
  chemically synthesized
aactcattgatacaatgtatat

SEQ ID NO: 992479 - DNA, 22 bp, Artificial Sequence
  chemically synthesized
tacagctgatgataaatataca

SEQ ID NO: 992480 - DNA, 22 bp, Artificial Sequence
  chemically synthesized
attgatacaatgtatatttatc

SEQ ID NO: 992481 - DNA, 22 bp, Artificial Sequence
  chemically synthesized
atacaatgtatatttatcatca

SEQ ID NO: 992482 - DNA, 22 bp, Artificial Sequence
  chemically synthesized
atcatcagctgtacaggtgtgt

SEQ ID NO: 992483 - DNA, 22 bp, Artificial Sequence
  chemically synthesized
tcatcagctgtacaggtgtgtg

SEQ ID NO: 992484 - DNA, 22 bp, Artificial Sequence
  chemically synthesized
aaaagtatacgtatacacacac

SEQ ID NO: 992485 - DNA, 22 bp, Artificial Sequence
  chemically synthesized
tacaggtgtgtgtgtatacgta

SEQ ID NO: 992486 - DNA, 22 bp, Artificial Sequence
  chemically synthesized
tcattcaaaagtatacgtatac

SEQ ID NO: 992487 - DNA, 22 bp, Artificial Sequence
  chemically synthesized
gtcattcaaaagtatacgtata

SEQ ID NO: 992488 - DNA, 22 bp, Artificial Sequence
  chemically synthesized
tgtcattcaaaagtatacgtat

SEQ ID NO: 992489 - DNA, 22 bp, Artificial Sequence
  chemically synthesized
ttgtcattcaaaagtatacgta

SEQ ID NO: 992490 - DNA, 22 bp, Artificial Sequence
  chemically synthesized
ttgaatgacaaaaggatacaca

SEQ ID NO: 992491 - DNA, 22 bp, Artificial Sequence
  chemically synthesized
tgaatgacaaaaggatacacac

SEQ ID NO: 992492 - DNA, 22 bp, Artificial Sequence
  chemically synthesized
gaatgacaaaaggatacacaca

SEQ ID NO: 992493 - DNA, 22 bp, Artificial Sequence
  chemically synthesized
aatgacaaaaggatacacacac

SEQ ID NO: 992494 - DNA, 22 bp, Artificial Sequence
  chemically synthesized
cgtgcgtgtgtgtgtgtgtgtg

SEQ ID NO: 992495 - DNA, 22 bp, Artificial Sequence
  chemically synthesized
ataattgcgtgcgtgtgtgtgt

SEQ ID NO: 992496 - DNA, 22 bp, Artificial Sequence
  chemically synthesized
cagaaggttaataattgcgtgc

SEQ ID NO: 992497 - DNA, 22 bp, Artificial Sequence
  chemically synthesized
gtgaacagctccagaaggttaa

SEQ ID NO: 992498 - DNA, 22 bp, Artificial Sequence
  chemically synthesized
ggtgaacagctccagaaggtta

SEQ ID NO: 992499 - DNA, 22 bp, Artificial Sequence
  chemically synthesized
ttaaccttctggagctgttcac

SEQ ID NO: 992500 - DNA, 22 bp, Artificial Sequence
  chemically synthesized
atgcaaggcttggtgaacagct

SEQ ID NO: 992501 - DNA, 22 bp, Artificial Sequence
  chemically synthesized
aatgcaaggcttggtgaacagc

SEQ ID NO: 992502 - DNA, 22 bp, Artificial Sequence
  chemically synthesized
accttctggagctgttcaccaa

SEQ ID NO: 992503 - DNA, 22 bp, Artificial Sequence
  chemically synthesized
ctggagctgttcaccaagcctt

SEQ ID NO: 992504 - DNA, 22 bp, Artificial Sequence
  chemically synthesized
tggagctgttcaccaagccttg

SEQ ID NO: 992505 - DNA, 22 bp, Artificial Sequence
  chemically synthesized
gagctgttcaccaagccttgca

SEQ ID NO: 992506 - DNA, 22 bp, Artificial Sequence
  chemically synthesized
aatccaggtttaatgcaaggct

SEQ ID NO: 992507 - DNA, 22 bp, Artificial Sequence
  chemically synthesized
ttcaatccaggtttaatgcaag

SEQ ID NO: 992508 - DNA, 22 bp, Artificial Sequence
  chemically synthesized
attcaatccaggtttaatgcaa

SEQ ID NO: 992509 - DNA, 22 bp, Artificial Sequence
  chemically synthesized
ttcaccaagccttgcattaaac

SEQ ID NO: 992510 - DNA, 22 bp, Artificial Sequence
  chemically synthesized
tattcaatccaggtttaatgca

SEQ ID NO: 992511 - DNA, 22 bp, Artificial Sequence
  chemically synthesized
ttattcaatccaggtttaatgc

SEQ ID NO: 992512 - DNA, 22 bp, Artificial Sequence
  chemically synthesized
accaagccttgcattaaacctg

SEQ ID NO: 992513 - DNA, 22 bp, Artificial Sequence
  chemically synthesized
gcattaaacctggattgaataa

SEQ ID NO: 992514 - DNA, 22 bp, Artificial Sequence
  chemically synthesized
cattaaacctggattgaataaa

SEQ ID NO: 992515 - DNA, 22 bp, Artificial Sequence
  chemically synthesized
aggaatgggagtcttttattca

SEQ ID NO: 992516 - DNA, 22 bp, Artificial Sequence
  chemically synthesized
gaggaatgggagtcttttattc

SEQ ID NO: 992517 - DNA, 22 bp, Artificial Sequence
  chemically synthesized
aacctggattgaataaaagact

SEQ ID NO: 992518 - DNA, 22 bp, Artificial Sequence
  chemically synthesized
cttgaggaatgggagtctttta

SEQ ID NO: 992519 - DNA, 22 bp, Artificial Sequence
  chemically synthesized
ccttgaggaatgggagtctttt

SEQ ID NO: 992520 - DNA, 22 bp, Artificial Sequence
  chemically synthesized
gattgaataaaagactcccatt

SEQ ID NO: 992521 - DNA, 22 bp, Artificial Sequence
  chemically synthesized
aataaaagactcccattcctca

SEQ ID NO: 992522 - DNA, 22 bp, Artificial Sequence
  chemically synthesized
atagaagaagtaaaatttcctt

SEQ ID NO: 992523 - DNA, 22 bp, Artificial Sequence
  chemically synthesized
ccattcctcaaggaaattttac

SEQ ID NO: 992524 - DNA, 22 bp, Artificial Sequence
  chemically synthesized
ctcaaggaaattttacttcttc

SEQ ID NO: 992525 - DNA, 22 bp, Artificial Sequence
  chemically synthesized
agaagtcctcatagaagaagta

SEQ ID NO: 992526 - DNA, 22 bp, Artificial Sequence
  chemically synthesized
aaggaaattttacttcttctat

SEQ ID NO: 992527 - DNA, 22 bp, Artificial Sequence
  chemically synthesized
ctgagaagtcctcatagaagaa

SEQ ID NO: 992528 - DNA, 22 bp, Artificial Sequence
  chemically synthesized
gggttactgagaagtcctcata

SEQ ID NO: 992529 - DNA, 22 bp, Artificial Sequence
  chemically synthesized
agggttactgagaagtcctcat

SEQ ID NO: 992530 - DNA, 22 bp, Artificial Sequence
  chemically synthesized
tacttcttctatgaggacttct

SEQ ID NO: 992531 - DNA, 22 bp, Artificial Sequence
  chemically synthesized
acttcttctatgaggacttctc

SEQ ID NO: 992532 - DNA, 22 bp, Artificial Sequence
  chemically synthesized
cttcttctatgaggacttctca

SEQ ID NO: 992533 - DNA, 22 bp, Artificial Sequence
  chemically synthesized
cttctatgaggacttctcagta

SEQ ID NO: 992534 - DNA, 22 bp, Artificial Sequence
  chemically synthesized
tgaatttagggttactgagaag

SEQ ID NO: 992535 - DNA, 22 bp, Artificial Sequence
  chemically synthesized
ttctatgaggacttctcagtaa

SEQ ID NO: 992536 - DNA, 22 bp, Artificial Sequence
  chemically synthesized
ctatgaggacttctcagtaacc

SEQ ID NO: 992537 - DNA, 22 bp, Artificial Sequence
  chemically synthesized
tatgaggacttctcagtaaccc

SEQ ID NO: 992538 - DNA, 22 bp, Artificial Sequence
  chemically synthesized
tgaggacttctcagtaacccta

SEQ ID NO: 992539 - DNA, 22 bp, Artificial Sequence
  chemically synthesized
ctcagtaaccctaaattcacag

SEQ ID NO: 992540 - DNA, 22 bp, Artificial Sequence
  chemically synthesized
tcagtaaccctaaattcacagg

SEQ ID NO: 992541 - DNA, 22 bp, Artificial Sequence
  chemically synthesized
agtaaccctaaattcacaggca

SEQ ID NO: 992542 - DNA, 22 bp, Artificial Sequence
  chemically synthesized
aattcacaggcatattctttac

SEQ ID NO: 992543 - DNA, 22 bp, Artificial Sequence
  chemically synthesized
ggacagtaacatgtaaagaata

SEQ ID NO: 992544 - DNA, 22 bp, Artificial Sequence
  chemically synthesized
gggacagtaacatgtaaagaat

SEQ ID NO: 992545 - DNA, 22 bp, Artificial Sequence
  chemically synthesized
tgggacagtaacatgtaaagaa

SEQ ID NO: 992546 - DNA, 22 bp, Artificial Sequence
  chemically synthesized
acaggcatattctttacatgtt

SEQ ID NO: 992547 - DNA, 22 bp, Artificial Sequence
  chemically synthesized
ctttgggacagtaacatgtaaa

SEQ ID NO: 992548 - DNA, 22 bp, Artificial Sequence
  chemically synthesized
gctttgggacagtaacatgtaa

SEQ ID NO: 992549 - DNA, 22 bp, Artificial Sequence
  chemically synthesized
tgctttgggacagtaacatgta

SEQ ID NO: 992550 - DNA, 22 bp, Artificial Sequence
  chemically synthesized
cattttgctttgggacagtaac

SEQ ID NO: 992551 - DNA, 22 bp, Artificial Sequence
  chemically synthesized
gcattttgctttgggacagtaa

SEQ ID NO: 992552 - DNA, 22 bp, Artificial Sequence
  chemically synthesized
tttacatgttactgtcccaaag

SEQ ID NO: 992553 - DNA, 22 bp, Artificial Sequence
  chemically synthesized
tacatgttactgtcccaaagca

SEQ ID NO: 992554 - DNA, 22 bp, Artificial Sequence
  chemically synthesized
acatgttactgtcccaaagcaa

SEQ ID NO: 992555 - DNA, 22 bp, Artificial Sequence
  chemically synthesized
catgttactgtcccaaagcaaa

SEQ ID NO: 992556 - DNA, 22 bp, Artificial Sequence
  chemically synthesized
catgccagcttgcattttgctt

SEQ ID NO: 992557 - DNA, 22 bp, Artificial Sequence
  chemically synthesized
ctgtcccaaagcaaaatgcaag

SEQ ID NO: 992558 - DNA, 22 bp, Artificial Sequence
  chemically synthesized
gttccatgccagcttgcatttt

SEQ ID NO: 992559 - DNA, 22 bp, Artificial Sequence
  chemically synthesized
ggttccatgccagcttgcattt

SEQ ID NO: 992560 - DNA, 22 bp, Artificial Sequence
  chemically synthesized
tcccaaagcaaaatgcaagctg

SEQ ID NO: 992561 - DNA, 22 bp, Artificial Sequence
  chemically synthesized
ggcttggttccatgccagcttg

SEQ ID NO: 992562 - DNA, 22 bp, Artificial Sequence
  chemically synthesized
tgggcttggttccatgccagct

SEQ ID NO: 992563 - DNA, 22 bp, Artificial Sequence
  chemically synthesized
acctctgggcttggttccatgc

SEQ ID NO: 992564 - DNA, 22 bp, Artificial Sequence
  chemically synthesized
aggaattaacctctgggcttgg

SEQ ID NO: 992565 - DNA, 22 bp, Artificial Sequence
  chemically synthesized
caggaattaacctctgggcttg

SEQ ID NO: 992566 - DNA, 22 bp, Artificial Sequence
  chemically synthesized
gcatggaaccaagcccagaggt

SEQ ID NO: 992567 - DNA, 22 bp, Artificial Sequence
  chemically synthesized
gcttcaggaattaacctctggg

SEQ ID NO: 992568 - DNA, 22 bp, Artificial Sequence
  chemically synthesized
tagcttcaggaattaacctctg

SEQ ID NO: 992569 - DNA, 22 bp, Artificial Sequence
  chemically synthesized
ctctagcttcaggaattaacct

SEQ ID NO: 992570 - DNA, 22 bp, Artificial Sequence
  chemically synthesized
cctctagcttcaggaattaacc

SEQ ID NO: 992571 - DNA, 22 bp, Artificial Sequence
  chemically synthesized
tcctctagcttcaggaattaac

SEQ ID NO: 992572 - DNA, 22 bp, Artificial Sequence
  chemically synthesized
ttcctctagcttcaggaattaa

SEQ ID NO: 992573 - DNA, 22 bp, Artificial Sequence
  chemically synthesized
gaaccttttcctctagcttcag

SEQ ID NO: 992574 - DNA, 22 bp, Artificial Sequence
  chemically synthesized
ggaaccttttcctctagcttca

SEQ ID NO: 992575 - DNA, 22 bp, Artificial Sequence
  chemically synthesized
tggaaccttttcctctagcttc

SEQ ID NO: 992576 - DNA, 22 bp, Artificial Sequence
  chemically synthesized
attcctgaagctagaggaaaag

SEQ ID NO: 992577 - DNA, 22 bp, Artificial Sequence
  chemically synthesized
ctgaagctagaggaaaaggttc

SEQ ID NO: 992578 - DNA, 22 bp, Artificial Sequence
  chemically synthesized
aagctagaggaaaaggttccaa

SEQ ID NO: 992579 - DNA, 22 bp, Artificial Sequence
  chemically synthesized
ggatgtagggcactttggaacc

SEQ ID NO: 992580 - DNA, 22 bp, Artificial Sequence
  chemically synthesized
gggatgtagggcactttggaac

SEQ ID NO: 992581 - DNA, 22 bp, Artificial Sequence
  chemically synthesized
gaggaaaaggttccaaagtgcc

SEQ ID NO: 992582 - DNA, 22 bp, Artificial Sequence
  chemically synthesized
ggcgaccttgggatgtagggca

SEQ ID NO: 992583 - DNA, 22 bp, Artificial Sequence
  chemically synthesized
ttgggcgaccttgggatgtagg

SEQ ID NO: 992584 - DNA, 22 bp, Artificial Sequence
  chemically synthesized
caaagtgccctacatcccaagg

SEQ ID NO: 992585 - DNA, 22 bp, Artificial Sequence
  chemically synthesized
caggtgtggatctgttgggcga

SEQ ID NO: 992586 - DNA, 22 bp, Artificial Sequence
  chemically synthesized
ccaggtgtggatctgttgggcg

SEQ ID NO: 992587 - DNA, 22 bp, Artificial Sequence
  chemically synthesized
catcccaaggtcgcccaacaga

SEQ ID NO: 992588 - DNA, 22 bp, Artificial Sequence
  chemically synthesized
cttccaggtgtggatctgttgg

SEQ ID NO: 992589 - DNA, 22 bp, Artificial Sequence
  chemically synthesized
gcggagattgcttccaggtgtg

SEQ ID NO: 992590 - DNA, 22 bp, Artificial Sequence
  chemically synthesized
ggcggagattgcttccaggtgt

SEQ ID NO: 992591 - DNA, 22 bp, Artificial Sequence
  chemically synthesized
taaataggcgcttggcggagat

SEQ ID NO: 992592 - DNA, 22 bp, Artificial Sequence
  chemically synthesized
gaagcaatctccgccaagcgcc

SEQ ID NO: 992593 - DNA, 22 bp, Artificial Sequence
  chemically synthesized
tgcctgtaaataggcgcttggc

SEQ ID NO: 992594 - DNA, 22 bp, Artificial Sequence
  chemically synthesized
cgccaagcgcctatttacaggc

SEQ ID NO: 992595 - DNA, 22 bp, Artificial Sequence
  chemically synthesized
tcccgataggcacacacctgtg

SEQ ID NO: 992596 - DNA, 22 bp, Artificial Sequence
  chemically synthesized
tttacaggcacaggtgtgtgcc

SEQ ID NO: 992597 - DNA, 22 bp, Artificial Sequence
  chemically synthesized
agctgtcccgataggcacacac

SEQ ID NO: 992598 - DNA, 22 bp, Artificial Sequence
  chemically synthesized
acaggcacaggtgtgtgcctat

SEQ ID NO: 992599 - DNA, 22 bp, Artificial Sequence
  chemically synthesized
caggcacaggtgtgtgcctatc

SEQ ID NO: 992600 - DNA, 22 bp, Artificial Sequence
  chemically synthesized
ctcagctgtcccgataggcaca

SEQ ID NO: 992601 - DNA, 22 bp, Artificial Sequence
  chemically synthesized
ggtgtgttcctcagctgtcccg

SEQ ID NO: 992602 - DNA, 22 bp, Artificial Sequence
  chemically synthesized
tcaaattaggtgtgttcctcag

SEQ ID NO: 992603 - DNA, 22 bp, Artificial Sequence
  chemically synthesized
tcgggacagctgaggaacacac

SEQ ID NO: 992604 - DNA, 22 bp, Artificial Sequence
  chemically synthesized
aggaacacacctaatttgatag

SEQ ID NO: 992605 - DNA, 22 bp, Artificial Sequence
  chemically synthesized
ccacatcagaatgtcatctatc

SEQ ID NO: 992606 - DNA, 22 bp, Artificial Sequence
  chemically synthesized
atttgatagatgacattctgat

SEQ ID NO: 992607 - DNA, 22 bp, Artificial Sequence
  chemically synthesized
gatagatgacattctgatgtgg

SEQ ID NO: 992608 - DNA, 22 bp, Artificial Sequence
  chemically synthesized
atagatgacattctgatgtggc

SEQ ID NO: 992609 - DNA, 22 bp, Artificial Sequence
  chemically synthesized
tcataaacagcacaataaagcc

SEQ ID NO: 992610 - DNA, 22 bp, Artificial Sequence
  chemically synthesized
tgatgtggcaggctttattgtg

SEQ ID NO: 992611 - DNA, 22 bp, Artificial Sequence
  chemically synthesized
atgtggcaggctttattgtgct

SEQ ID NO: 992612 - DNA, 22 bp, Artificial Sequence
  chemically synthesized
cagatattgtcataaacagcac

SEQ ID NO: 992613 - DNA, 22 bp, Artificial Sequence
  chemically synthesized
tattgtgctgtttatgacaata

SEQ ID NO: 992614 - DNA, 22 bp, Artificial Sequence
  chemically synthesized
attgtgctgtttatgacaatat

SEQ ID NO: 992615 - DNA, 22 bp, Artificial Sequence
  chemically synthesized
ttgtgctgtttatgacaatatc

SEQ ID NO: 992616 - DNA, 22 bp, Artificial Sequence
  chemically synthesized
tgctgtttatgacaatatctgc

SEQ ID NO: 992617 - DNA, 22 bp, Artificial Sequence
  chemically synthesized
tttatgacaatatctgcagatt

SEQ ID NO: 992618 - DNA, 22 bp, Artificial Sequence
  chemically synthesized
aacaagcacatcataatctgca

SEQ ID NO: 992619 - DNA, 22 bp, Artificial Sequence
  chemically synthesized
atgacaatatctgcagattatg

SEQ ID NO: 992620 - DNA, 22 bp, Artificial Sequence
  chemically synthesized
tgacaatatctgcagattatga

SEQ ID NO: 992621 - DNA, 22 bp, Artificial Sequence
  chemically synthesized
ttaaacaagcacatcataatct

SEQ ID NO: 992622 - DNA, 22 bp, Artificial Sequence
  chemically synthesized
attaaacaagcacatcataatc

SEQ ID NO: 992623 - DNA, 22 bp, Artificial Sequence
  chemically synthesized
tttattaaacaagcacatcata

SEQ ID NO: 992624 - DNA, 22 bp, Artificial Sequence
  chemically synthesized
cgctgtttattaaacaagcaca

SEQ ID NO: 992625 - DNA, 22 bp, Artificial Sequence
  chemically synthesized
cagattatgatgtgcttgttta

SEQ ID NO: 992626 - DNA, 22 bp, Artificial Sequence
  chemically synthesized
attacgctgtttattaaacaag

SEQ ID NO: 992627 - DNA, 22 bp, Artificial Sequence
  chemically synthesized
aattacgctgtttattaaacaa

SEQ ID NO: 992628 - DNA, 22 bp, Artificial Sequence
  chemically synthesized
tgatgtgcttgtttaataaaca

SEQ ID NO: 992629 - DNA, 22 bp, Artificial Sequence
  chemically synthesized
tgtgtgcttaattacgctgttt

SEQ ID NO: 992630 - DNA, 22 bp, Artificial Sequence
  chemically synthesized
gtgtgtgcttaattacgctgtt

SEQ ID NO: 992631 - DNA, 22 bp, Artificial Sequence
  chemically synthesized
tgtgtgtgcttaattacgctgt

SEQ ID NO: 992632 - DNA, 22 bp, Artificial Sequence
  chemically synthesized
gtttaataaacagcgtaattaa

SEQ ID NO: 992633 - DNA, 22 bp, Artificial Sequence
  chemically synthesized
ttttgtgtgtgcttaattacgc

SEQ ID NO: 992634 - DNA, 22 bp, Artificial Sequence
  chemically synthesized
tttaataaacagcgtaattaag

SEQ ID NO: 992635 - DNA, 22 bp, Artificial Sequence
  chemically synthesized
gttttgtgtgtgcttaattacg

SEQ ID NO: 992636 - DNA, 22 bp, Artificial Sequence
  chemically synthesized
tgttttgtgtgtgcttaattac

SEQ ID NO: 992637 - DNA, 22 bp, Artificial Sequence
  chemically synthesized
aataaacagcgtaattaagcac

SEQ ID NO: 992638 - DNA, 22 bp, Artificial Sequence
  chemically synthesized
ataaacagcgtaattaagcaca

SEQ ID NO: 992639 - DNA, 22 bp, Artificial Sequence
  chemically synthesized
ttttgttttgtgtgtgcttaat

SEQ ID NO: 992640 - DNA, 22 bp, Artificial Sequence
  chemically synthesized
ctgttttgttttgtgtgtgctt

SEQ ID NO: 992641 - DNA, 22 bp, Artificial Sequence
  chemically synthesized
cctgttttgttttgtgtgtgct

SEQ ID NO: 992642 - DNA, 22 bp, Artificial Sequence
  chemically synthesized
acttcctgttttgttttgtgtg

SEQ ID NO: 992643 - DNA, 22 bp, Artificial Sequence
  chemically synthesized
ggtattaacttcctgttttgtt

SEQ ID NO: 992644 - DNA, 22 bp, Artificial Sequence
  chemically synthesized
agcacacacaaaacaaaacagg

SEQ ID NO: 992645 - DNA, 22 bp, Artificial Sequence
  chemically synthesized
aggtattaacttcctgttttgt

SEQ ID NO: 992646 - DNA, 22 bp, Artificial Sequence
  chemically synthesized
tggtacataaacacgtcagcac

SEQ ID NO: 992647 - DNA, 22 bp, Artificial Sequence
  chemically synthesized
atacctaagtggtgctgacgtg

SEQ ID NO: 992648 - DNA, 22 bp, Artificial Sequence
  chemically synthesized
agtggtgctgacgtgtttatgt

SEQ ID NO: 992649 - DNA, 22 bp, Artificial Sequence
  chemically synthesized
gtcagttgtggtacataaacac

SEQ ID NO: 992650 - DNA, 22 bp, Artificial Sequence
  chemically synthesized
acgtgtttatgtaccacaactg

SEQ ID NO: 992651 - DNA, 22 bp, Artificial Sequence
  chemically synthesized
atgtaccacaactgactagtgt

SEQ ID NO: 992652 - DNA, 22 bp, Artificial Sequence
  chemically synthesized
tgtaccacaactgactagtgta

SEQ ID NO: 992653 - DNA, 22 bp, Artificial Sequence
  chemically synthesized
actagtgtattctttactgcct

SEQ ID NO: 992654 - DNA, 22 bp, Artificial Sequence
  chemically synthesized
agaagtggagtaataggcagta

SEQ ID NO: 992655 - DNA, 22 bp, Artificial Sequence
  chemically synthesized
gtgtattctttactgcctatta

SEQ ID NO: 992656 - DNA, 22 bp, Artificial Sequence
  chemically synthesized
tttactgcctattactccactt

SEQ ID NO: 992657 - DNA, 22 bp, Artificial Sequence
  chemically synthesized
agtggatattaagaagtggagt

SEQ ID NO: 992658 - DNA, 22 bp, Artificial Sequence
  chemically synthesized
tactgcctattactccacttct

SEQ ID NO: 992659 - DNA, 22 bp, Artificial Sequence
  chemically synthesized
cagtggatattaagaagtggag

SEQ ID NO: 992660 - DNA, 22 bp, Artificial Sequence
  chemically synthesized
actgcctattactccacttctt

SEQ ID NO: 992661 - DNA, 22 bp, Artificial Sequence
  chemically synthesized
ctgcctattactccacttctta

SEQ ID NO: 992662 - DNA, 22 bp, Artificial Sequence
  chemically synthesized
cttcagtggatattaagaagtg

SEQ ID NO: 992663 - DNA, 22 bp, Artificial Sequence
  chemically synthesized
cctattactccacttcttaata

SEQ ID NO: 992664 - DNA, 22 bp, Artificial Sequence
  chemically synthesized
ttactccacttcttaatatcca

SEQ ID NO: 992665 - DNA, 22 bp, Artificial Sequence
  chemically synthesized
aggattccttcagtggatatta

SEQ ID NO: 992666 - DNA, 22 bp, Artificial Sequence
  chemically synthesized
ctccacttcttaatatccactg

SEQ ID NO: 992667 - DNA, 22 bp, Artificial Sequence
  chemically synthesized
cacttcttaatatccactgaag

SEQ ID NO: 992668 - DNA, 22 bp, Artificial Sequence
  chemically synthesized
cttaatatccactgaaggaatc

SEQ ID NO: 992669 - DNA, 22 bp, Artificial Sequence
  chemically synthesized
ttaatatccactgaaggaatcc

SEQ ID NO: 992670 - DNA, 22 bp, Artificial Sequence
  chemically synthesized
aatatccactgaaggaatcctc

SEQ ID NO: 992671 - DNA, 22 bp, Artificial Sequence
  chemically synthesized
atatccactgaaggaatcctca

SEQ ID NO: 992672 - DNA, 22 bp, Artificial Sequence
  chemically synthesized
gagatgtgtgtatacagactga

SEQ ID NO: 992673 - DNA, 22 bp, Artificial Sequence
  chemically synthesized
ggagatgtgtgtatacagactg

SEQ ID NO: 992674 - DNA, 22 bp, Artificial Sequence
  chemically synthesized
aaggaatcctcagtctgtatac

SEQ ID NO: 992675 - DNA, 22 bp, Artificial Sequence
  chemically synthesized
ataacttggagatgtgtgtata

SEQ ID NO: 992676 - DNA, 22 bp, Artificial Sequence
  chemically synthesized
agtctgtatacacacatctcca

SEQ ID NO: 992677 - DNA, 22 bp, Artificial Sequence
  chemically synthesized
atgttcataacttggagatgtg

SEQ ID NO: 992678 - DNA, 22 bp, Artificial Sequence
  chemically synthesized
tatacacacatctccaagttat

SEQ ID NO: 992679 - DNA, 22 bp, Artificial Sequence
  chemically synthesized
aggatatgcatgaagttgatgt

SEQ ID NO: 992680 - DNA, 22 bp, Artificial Sequence
  chemically synthesized
caagttatgaacatcaacttca

SEQ ID NO: 992681 - DNA, 22 bp, Artificial Sequence
  chemically synthesized
tgaggatatgcatgaagttgat

SEQ ID NO: 992682 - DNA, 22 bp, Artificial Sequence
  chemically synthesized
ctgaggatatgcatgaagttga

SEQ ID NO: 992683 - DNA, 22 bp, Artificial Sequence
  chemically synthesized
tctgaggatatgcatgaagttg

SEQ ID NO: 992684 - DNA, 22 bp, Artificial Sequence
  chemically synthesized
tgaacatcaacttcatgcatat

SEQ ID NO: 992685 - DNA, 22 bp, Artificial Sequence
  chemically synthesized
catgcatatcctcagaaagacc

SEQ ID NO: 992686 - DNA, 22 bp, Artificial Sequence
  chemically synthesized
caggtgtaagtaggtctttctg

SEQ ID NO: 992687 - DNA, 22 bp, Artificial Sequence
  chemically synthesized
atgcatatcctcagaaagacct

SEQ ID NO: 992688 - DNA, 22 bp, Artificial Sequence
  chemically synthesized
agaaagacctacttacacctgc

SEQ ID NO: 992689 - DNA, 22 bp, Artificial Sequence
  chemically synthesized
cttacacctgcagcctcaccac

SEQ ID NO: 992690 - DNA, 22 bp, Artificial Sequence
  chemically synthesized
acacctgcagcctcaccacata

SEQ ID NO: 992691 - DNA, 22 bp, Artificial Sequence
  chemically synthesized
agggtgtagatatatgtggtga

SEQ ID NO: 992692 - DNA, 22 bp, Artificial Sequence
  chemically synthesized
cacctgcagcctcaccacatat

SEQ ID NO: 992693 - DNA, 22 bp, Artificial Sequence
  chemically synthesized
ttaagggtgtagatatatgtgg

SEQ ID NO: 992694 - DNA, 22 bp, Artificial Sequence
  chemically synthesized
cagcctcaccacatatatctac

SEQ ID NO: 992695 - DNA, 22 bp, Artificial Sequence
  chemically synthesized
aatgcctgttaagggtgtagat

SEQ ID NO: 992696 - DNA, 22 bp, Artificial Sequence
  chemically synthesized
accacatatatctacaccctta

SEQ ID NO: 992697 - DNA, 22 bp, Artificial Sequence
  chemically synthesized
ttgaatgcctgttaagggtgta

SEQ ID NO: 992698 - DNA, 22 bp, Artificial Sequence
  chemically synthesized
attgaatgcctgttaagggtgt

SEQ ID NO: 992699 - DNA, 22 bp, Artificial Sequence
  chemically synthesized
acaagtatttattgaatgcctg

SEQ ID NO: 992700 - DNA, 22 bp, Artificial Sequence
  chemically synthesized
gacaagtatttattgaatgcct

SEQ ID NO: 992701 - DNA, 22 bp, Artificial Sequence
  chemically synthesized
cacccttaacaggcattcaata

SEQ ID NO: 992702 - DNA, 22 bp, Artificial Sequence
  chemically synthesized
atcatttgacaagtatttattg

SEQ ID NO: 992703 - DNA, 22 bp, Artificial Sequence
  chemically synthesized
aacaggcattcaataaatactt

SEQ ID NO: 992704 - DNA, 22 bp, Artificial Sequence
  chemically synthesized
acaggcattcaataaatacttg

SEQ ID NO: 992705 - DNA, 22 bp, Artificial Sequence
  chemically synthesized
tctgatcatttgacaagtattt

SEQ ID NO: 992706 - DNA, 22 bp, Artificial Sequence
  chemically synthesized
atctgatcatttgacaagtatt

SEQ ID NO: 992707 - DNA, 22 bp, Artificial Sequence
  chemically synthesized
tcatttatctgatcatttgaca

SEQ ID NO: 992708 - DNA, 22 bp, Artificial Sequence
  chemically synthesized
atcatttatctgatcatttgac

SEQ ID NO: 992709 - DNA, 22 bp, Artificial Sequence
  chemically synthesized
aataaatacttgtcaaatgatc

SEQ ID NO: 992710 - DNA, 22 bp, Artificial Sequence
  chemically synthesized
atttatcatttatctgatcatt

SEQ ID NO: 992711 - DNA, 22 bp, Artificial Sequence
  chemically synthesized
catttatcatttatctgatcat

SEQ ID NO: 992712 - DNA, 22 bp, Artificial Sequence
  chemically synthesized
cttcatttatcatttatctgat

SEQ ID NO: 992713 - DNA, 22 bp, Artificial Sequence
  chemically synthesized
tccttcatttatcatttatctg

SEQ ID NO: 992714 - DNA, 22 bp, Artificial Sequence
  chemically synthesized
ctccttcatttatcatttatct

SEQ ID NO: 992715 - DNA, 22 bp, Artificial Sequence
  chemically synthesized
gtcaaatgatcagataaatgat

SEQ ID NO: 992716 - DNA, 22 bp, Artificial Sequence
  chemically synthesized
tcaaatgatcagataaatgata

SEQ ID NO: 992717 - DNA, 22 bp, Artificial Sequence
  chemically synthesized
gtatgtttctccttcatttatc

SEQ ID NO: 992718 - DNA, 22 bp, Artificial Sequence
  chemically synthesized
aagatataaatattggtatgtt

SEQ ID NO: 992719 - DNA, 22 bp, Artificial Sequence
  chemically synthesized
gaagatataaatattggtatgt

SEQ ID NO: 992720 - DNA, 22 bp, Artificial Sequence
  chemically synthesized
tatgcccataggagcaatcttg

SEQ ID NO: 992721 - DNA, 22 bp, Artificial Sequence
  chemically synthesized
atatcttcaagattgctcctat

SEQ ID NO: 992722 - DNA, 22 bp, Artificial Sequence
  chemically synthesized
tatcttcaagattgctcctatg

SEQ ID NO: 992723 - DNA, 22 bp, Artificial Sequence
  chemically synthesized
taaaattatatgcccataggag

SEQ ID NO: 992724 - DNA, 22 bp, Artificial Sequence
  chemically synthesized
ctgtaaaattatatgcccatag

SEQ ID NO: 992725 - DNA, 22 bp, Artificial Sequence
  chemically synthesized
caagattgctcctatgggcata

SEQ ID NO: 992726 - DNA, 22 bp, Artificial Sequence
  chemically synthesized
aagattgctcctatgggcatat

SEQ ID NO: 992727 - DNA, 22 bp, Artificial Sequence
  chemically synthesized
ctcctatgggcatataatttta

SEQ ID NO: 992728 - DNA, 22 bp, Artificial Sequence
  chemically synthesized
ctatgggcatataattttacag

SEQ ID NO: 992729 - DNA, 22 bp, Artificial Sequence
  chemically synthesized
tgggcatataattttacaggag

SEQ ID NO: 992730 - DNA, 22 bp, Artificial Sequence
  chemically synthesized
aaaagatagacaatccaagtag

SEQ ID NO: 992731 - DNA, 22 bp, Artificial Sequence
  chemically synthesized
tacaggagttgctacttggatt

SEQ ID NO: 992732 - DNA, 22 bp, Artificial Sequence
  chemically synthesized
acaggagttgctacttggattg

SEQ ID NO: 992733 - DNA, 22 bp, Artificial Sequence
  chemically synthesized
caggagttgctacttggattgt

SEQ ID NO: 992734 - DNA, 22 bp, Artificial Sequence
  chemically synthesized
ctacttggattgtctatctttt

SEQ ID NO: 992735 - DNA, 22 bp, Artificial Sequence
  chemically synthesized
cttggattgtctatcttttcag

SEQ ID NO: 992736 - DNA, 22 bp, Artificial Sequence
  chemically synthesized
ggattgtctatcttttcagtct

SEQ ID NO: 992737 - DNA, 22 bp, Artificial Sequence
  chemically synthesized
gagaaaaaatgtagactgaaaa

SEQ ID NO: 992738 - DNA, 22 bp, Artificial Sequence
  chemically synthesized
gattgtctatcttttcagtcta

SEQ ID NO: 992739 - DNA, 22 bp, Artificial Sequence
  chemically synthesized
agagaaaaaatgtagactgaaa

SEQ ID NO: 992740 - DNA, 22 bp, Artificial Sequence
  chemically synthesized
tagagaaaaaatgtagactgaa

SEQ ID NO: 992741 - DNA, 22 bp, Artificial Sequence
  chemically synthesized
tctatcttttcagtctacattt

SEQ ID NO: 992742 - DNA, 22 bp, Artificial Sequence
  chemically synthesized
tattttagagaaaaaatgtaga

SEQ ID NO: 992743 - DNA, 22 bp, Artificial Sequence
  chemically synthesized
tcttttcagtctacattttttc

SEQ ID NO: 992744 - DNA, 22 bp, Artificial Sequence
  chemically synthesized
ttcagtctacattttttctcta

SEQ ID NO: 992745 - DNA, 22 bp, Artificial Sequence
  chemically synthesized
ccaattatattttagagaaaaa

SEQ ID NO: 992746 - DNA, 22 bp, Artificial Sequence
  chemically synthesized
tcagtctacattttttctctaa

SEQ ID NO: 992747 - DNA, 22 bp, Artificial Sequence
  chemically synthesized
cagtctacattttttctctaaa

SEQ ID NO: 992748 - DNA, 22 bp, Artificial Sequence
  chemically synthesized
agtctacattttttctctaaaa

SEQ ID NO: 992749 - DNA, 22 bp, Artificial Sequence
  chemically synthesized
cattttttctctaaaatataat

SEQ ID NO: 992750 - DNA, 22 bp, Artificial Sequence
  chemically synthesized
tttctctaaaatataattggca

SEQ ID NO: 992751 - DNA, 22 bp, Artificial Sequence
  chemically synthesized
ttctctaaaatataattggcag

SEQ ID NO: 992752 - DNA, 22 bp, Artificial Sequence
  chemically synthesized
tccataaggcaactgccaatta

SEQ ID NO: 992753 - DNA, 22 bp, Artificial Sequence
  chemically synthesized
tctctaaaatataattggcagt

SEQ ID NO: 992754 - DNA, 22 bp, Artificial Sequence
  chemically synthesized
ctctaaaatataattggcagtt

SEQ ID NO: 992755 - DNA, 22 bp, Artificial Sequence
  chemically synthesized
tctaaaatataattggcagttg

SEQ ID NO: 992756 - DNA, 22 bp, Artificial Sequence
  chemically synthesized
taaaatataattggcagttgcc

SEQ ID NO: 992757 - DNA, 22 bp, Artificial Sequence
  chemically synthesized
atctatccataaggcaactgcc

SEQ ID NO: 992758 - DNA, 22 bp, Artificial Sequence
  chemically synthesized
aatctatccataaggcaactgc

SEQ ID NO: 992759 - DNA, 22 bp, Artificial Sequence
  chemically synthesized
aaatataattggcagttgcctt

SEQ ID NO: 992760 - DNA, 22 bp, Artificial Sequence
  chemically synthesized
tcaaatttaatctatccataag

SEQ ID NO: 992761 - DNA, 22 bp, Artificial Sequence
  chemically synthesized
tatcaaatttaatctatccata

SEQ ID NO: 992762 - DNA, 22 bp, Artificial Sequence
  chemically synthesized
gcagttgccttatggatagatt

SEQ ID NO: 992763 - DNA, 22 bp, Artificial Sequence
  chemically synthesized
ccttatggatagattaaatttg

SEQ ID NO: 992764 - DNA, 22 bp, Artificial Sequence
  chemically synthesized
atggatagattaaatttgatag

SEQ ID NO: 992765 - DNA, 22 bp, Artificial Sequence
  chemically synthesized
aagtaccaggctctatcaaatt

SEQ ID NO: 992766 - DNA, 22 bp, Artificial Sequence
  chemically synthesized
tggatagattaaatttgataga

SEQ ID NO: 992767 - DNA, 22 bp, Artificial Sequence
  chemically synthesized
aatttgatagagcctggtactt

SEQ ID NO: 992768 - DNA, 22 bp, Artificial Sequence
  chemically synthesized
aaatagcacctcaagtaccagg

SEQ ID NO: 992769 - DNA, 22 bp, Artificial Sequence
  chemically synthesized
gatagagcctggtacttgaggt

SEQ ID NO: 992770 - DNA, 22 bp, Artificial Sequence
  chemically synthesized
atagagcctggtacttgaggtg

SEQ ID NO: 992771 - DNA, 22 bp, Artificial Sequence
  chemically synthesized
cagaaatggtgctgaaatagca

SEQ ID NO: 992772 - DNA, 22 bp, Artificial Sequence
  chemically synthesized
gtacttgaggtgctatttcagc

SEQ ID NO: 992773 - DNA, 22 bp, Artificial Sequence
  chemically synthesized
gaggtgctatttcagcaccatt

SEQ ID NO: 992774 - DNA, 22 bp, Artificial Sequence
  chemically synthesized
cagaattacagaaatggtgctg

SEQ ID NO: 992775 - DNA, 22 bp, Artificial Sequence
  chemically synthesized
aggtgctatttcagcaccattt

SEQ ID NO: 992776 - DNA, 22 bp, Artificial Sequence
  chemically synthesized
gttccagaattacagaaatggt

SEQ ID NO: 992777 - DNA, 22 bp, Artificial Sequence
  chemically synthesized
tttcagcaccatttctgtaatt

SEQ ID NO: 992778 - DNA, 22 bp, Artificial Sequence
  chemically synthesized
ataactagttccagaattacag

SEQ ID NO: 992779 - DNA, 22 bp, Artificial Sequence
  chemically synthesized
cagcaccatttctgtaattctg

SEQ ID NO: 992780 - DNA, 22 bp, Artificial Sequence
  chemically synthesized
agcaccatttctgtaattctgg

SEQ ID NO: 992781 - DNA, 22 bp, Artificial Sequence
  chemically synthesized
ccaagcctgataactagttcca

SEQ ID NO: 992782 - DNA, 22 bp, Artificial Sequence
  chemically synthesized
ctgtaattctggaactagttat

SEQ ID NO: 992783 - DNA, 22 bp, Artificial Sequence
  chemically synthesized
tgtaattctggaactagttatc

SEQ ID NO: 992784 - DNA, 22 bp, Artificial Sequence
  chemically synthesized
taattctggaactagttatcag

SEQ ID NO: 992785 - DNA, 22 bp, Artificial Sequence
  chemically synthesized
catctgccaagcctgataacta

SEQ ID NO: 992786 - DNA, 22 bp, Artificial Sequence
  chemically synthesized
gcatctgccaagcctgataact

SEQ ID NO: 992787 - DNA, 22 bp, Artificial Sequence
  chemically synthesized
tggaactagttatcaggcttgg

SEQ ID NO: 992788 - DNA, 22 bp, Artificial Sequence
  chemically synthesized
gaactagttatcaggcttggca

SEQ ID NO: 992789 - DNA, 22 bp, Artificial Sequence
  chemically synthesized
catacatttgcatctgccaagc

SEQ ID NO: 992790 - DNA, 22 bp, Artificial Sequence
  chemically synthesized
gttatcaggcttggcagatgca

SEQ ID NO: 992791 - DNA, 22 bp, Artificial Sequence
  chemically synthesized
tcaggcttggcagatgcaaatg

SEQ ID NO: 992792 - DNA, 22 bp, Artificial Sequence
  chemically synthesized
ggcagatgcaaatgtatgcagt

SEQ ID NO: 992793 - DNA, 22 bp, Artificial Sequence
  chemically synthesized
gcagatgcaaatgtatgcagtt

SEQ ID NO: 992794 - DNA, 22 bp, Artificial Sequence
  chemically synthesized
gagagtcgggaagaagatcaaa

SEQ ID NO: 992795 - DNA, 22 bp, Artificial Sequence
  chemically synthesized
cagttagagagtcgggaagaag

SEQ ID NO: 992796 - DNA, 22 bp, Artificial Sequence
  chemically synthesized
tgatcttcttcccgactctcta

SEQ ID NO: 992797 - DNA, 22 bp, Artificial Sequence
  chemically synthesized
gatcttcttcccgactctctaa

SEQ ID NO: 992798 - DNA, 22 bp, Artificial Sequence
  chemically synthesized
taaaatctgcagttagagagtc

SEQ ID NO: 992799 - DNA, 22 bp, Artificial Sequence
  chemically synthesized
atcttcttcccgactctctaac

SEQ ID NO: 992800 - DNA, 22 bp, Artificial Sequence
  chemically synthesized
agttgtaaaatctgcagttaga

SEQ ID NO: 992801 - DNA, 22 bp, Artificial Sequence
  chemically synthesized
cttcccgactctctaactgcag

SEQ ID NO: 992802 - DNA, 22 bp, Artificial Sequence
  chemically synthesized
cagttgtaaaatctgcagttag

SEQ ID NO: 992803 - DNA, 22 bp, Artificial Sequence
  chemically synthesized
ttcccgactctctaactgcaga

SEQ ID NO: 992804 - DNA, 22 bp, Artificial Sequence
  chemically synthesized
ttcagttgtaaaatctgcagtt

SEQ ID NO: 992805 - DNA, 22 bp, Artificial Sequence
  chemically synthesized
cccgactctctaactgcagatt

SEQ ID NO: 992806 - DNA, 22 bp, Artificial Sequence
  chemically synthesized
cttcagttgtaaaatctgcagt

SEQ ID NO: 992807 - DNA, 22 bp, Artificial Sequence
  chemically synthesized
ccgactctctaactgcagattt

SEQ ID NO: 992808 - DNA, 22 bp, Artificial Sequence
  chemically synthesized
tcttcagttgtaaaatctgcag

SEQ ID NO: 992809 - DNA, 22 bp, Artificial Sequence
  chemically synthesized
ctttcttcagttgtaaaatctg

SEQ ID NO: 992810 - DNA, 22 bp, Artificial Sequence
  chemically synthesized
gctttcttcagttgtaaaatct

SEQ ID NO: 992811 - DNA, 22 bp, Artificial Sequence
  chemically synthesized
tctaactgcagattttacaact

SEQ ID NO: 992812 - DNA, 22 bp, Artificial Sequence
  chemically synthesized
taactgcagattttacaactga

SEQ ID NO: 992813 - DNA, 22 bp, Artificial Sequence
  chemically synthesized
cccttgctttcttcagttgtaa

SEQ ID NO: 992814 - DNA, 22 bp, Artificial Sequence
  chemically synthesized
actgcagattttacaactgaag

SEQ ID NO: 992815 - DNA, 22 bp, Artificial Sequence
  chemically synthesized
cagattttacaactgaagaaag

SEQ ID NO: 992816 - DNA, 22 bp, Artificial Sequence
  chemically synthesized
tacaactgaagaaagcaagggg

SEQ ID NO: 992817 - DNA, 22 bp, Artificial Sequence
  chemically synthesized
taaataaaagttccccttgctt

SEQ ID NO: 992818 - DNA, 22 bp, Artificial Sequence
  chemically synthesized
acaactgaagaaagcaagggga

SEQ ID NO: 992819 - DNA, 22 bp, Artificial Sequence
  chemically synthesized
ataaataaaagttccccttgct

SEQ ID NO: 992820 - DNA, 22 bp, Artificial Sequence
  chemically synthesized
caactgaagaaagcaaggggaa

SEQ ID NO: 992821 - DNA, 22 bp, Artificial Sequence
  chemically synthesized
tttataaataaaagttcccctt

SEQ ID NO: 992822 - DNA, 22 bp, Artificial Sequence
  chemically synthesized
aagaaagcaaggggaactttta

SEQ ID NO: 992823 - DNA, 22 bp, Artificial Sequence
  chemically synthesized
tatcgattatttataaataaaa

SEQ ID NO: 992824 - DNA, 22 bp, Artificial Sequence
  chemically synthesized
caaattgtatcgattatttata

SEQ ID NO: 992825 - DNA, 22 bp, Artificial Sequence
  chemically synthesized
acaaattgtatcgattatttat

SEQ ID NO: 992826 - DNA, 22 bp, Artificial Sequence
  chemically synthesized
tttacaaattgtatcgattatt

SEQ ID NO: 992827 - DNA, 22 bp, Artificial Sequence
  chemically synthesized
tatttacaaattgtatcgatta

SEQ ID NO: 992828 - DNA, 22 bp, Artificial Sequence
  chemically synthesized
ttatttataaataatcgataca

SEQ ID NO: 992829 - DNA, 22 bp, Artificial Sequence
  chemically synthesized
ctatttacaaattgtatcgatt

SEQ ID NO: 992830 - DNA, 22 bp, Artificial Sequence
  chemically synthesized
tatttataaataatcgatacaa

SEQ ID NO: 992831 - DNA, 22 bp, Artificial Sequence
  chemically synthesized
atttataaataatcgatacaat

SEQ ID NO: 992832 - DNA, 22 bp, Artificial Sequence
  chemically synthesized
tttataaataatcgatacaatt

SEQ ID NO: 992833 - DNA, 22 bp, Artificial Sequence
  chemically synthesized
ataaataatcgatacaatttgt

SEQ ID NO: 992834 - DNA, 22 bp, Artificial Sequence
  chemically synthesized
taaataatcgatacaatttgta

SEQ ID NO: 992835 - DNA, 22 bp, Artificial Sequence
  chemically synthesized
agagggaaaggatttctattta

SEQ ID NO: 992836 - DNA, 22 bp, Artificial Sequence
  chemically synthesized
ctcagagggaaaggatttctat

SEQ ID NO: 992837 - DNA, 22 bp, Artificial Sequence
  chemically synthesized
tgagctgctcagagggaaagga

SEQ ID NO: 992838 - DNA, 22 bp, Artificial Sequence
  chemically synthesized
gtaaatagaaatcctttccctc

SEQ ID NO: 992839 - DNA, 22 bp, Artificial Sequence
  chemically synthesized
taaatagaaatcctttccctct

SEQ ID NO: 992840 - DNA, 22 bp, Artificial Sequence
  chemically synthesized
gctgtgagctgctcagagggaa

SEQ ID NO: 992841 - DNA, 22 bp, Artificial Sequence
  chemically synthesized
gctggctgtgagctgctcagag

SEQ ID NO: 992842 - DNA, 22 bp, Artificial Sequence
  chemically synthesized
agagctggctggctgtgagctg

SEQ ID NO: 992843 - DNA, 22 bp, Artificial Sequence
  chemically synthesized
tccctctgagcagctcacagcc

SEQ ID NO: 992844 - DNA, 22 bp, Artificial Sequence
  chemically synthesized
ccctctgagcagctcacagcca

SEQ ID NO: 992845 - DNA, 22 bp, Artificial Sequence
  chemically synthesized
cctctgagcagctcacagccag

SEQ ID NO: 992846 - DNA, 22 bp, Artificial Sequence
  chemically synthesized
atctgagagctggctggctgtg

SEQ ID NO: 992847 - DNA, 22 bp, Artificial Sequence
  chemically synthesized
catctgagagctggctggctgt

SEQ ID NO: 992848 - DNA, 22 bp, Artificial Sequence
  chemically synthesized
tgagcagctcacagccagccag

SEQ ID NO: 992849 - DNA, 22 bp, Artificial Sequence
  chemically synthesized
agcagctcacagccagccagct

SEQ ID NO: 992850 - DNA, 22 bp, Artificial Sequence
  chemically synthesized
acgtaccttcatctgagagctg

SEQ ID NO: 992851 - DNA, 22 bp, Artificial Sequence
  chemically synthesized
acagccagccagctctcagatg

SEQ ID NO: 992852 - DNA, 22 bp, Artificial Sequence
  chemically synthesized
gtcaagagagagctgacgtacc

SEQ ID NO: 992853 - DNA, 22 bp, Artificial Sequence
  chemically synthesized
tcagatgaaggtacgtcagctc

SEQ ID NO: 992854 - DNA, 22 bp, Artificial Sequence
  chemically synthesized
agatgaaggtacgtcagctctc

SEQ ID NO: 992855 - DNA, 22 bp, Artificial Sequence
  chemically synthesized
catgatgcagaccacaccatta

SEQ ID NO: 992856 - DNA, 22 bp, Artificial Sequence
  chemically synthesized
tctcttgactaatggtgtggtc

SEQ ID NO: 992857 - DNA, 22 bp, Artificial Sequence
  chemically synthesized
tcttgactaatggtgtggtctg

SEQ ID NO: 992858 - DNA, 22 bp, Artificial Sequence
  chemically synthesized
ttgactaatggtgtggtctgca

SEQ ID NO: 992859 - DNA, 22 bp, Artificial Sequence
  chemically synthesized
gtaacctccatgatgcagacca

SEQ ID NO: 992860 - DNA, 22 bp, Artificial Sequence
  chemically synthesized
gactaatggtgtggtctgcatc

SEQ ID NO: 992861 - DNA, 22 bp, Artificial Sequence
  chemically synthesized
actaatggtgtggtctgcatca

SEQ ID NO: 992862 - DNA, 22 bp, Artificial Sequence
  chemically synthesized
atggtgtggtctgcatcatgga

SEQ ID NO: 992863 - DNA, 22 bp, Artificial Sequence
  chemically synthesized
ccaaggaatgtctggtaacctc

SEQ ID NO: 992864 - DNA, 22 bp, Artificial Sequence
  chemically synthesized
tgccaaggaatgtctggtaacc

SEQ ID NO: 992865 - DNA, 22 bp, Artificial Sequence
  chemically synthesized
catcatggaggttaccagacat

SEQ ID NO: 992866 - DNA, 22 bp, Artificial Sequence
  chemically synthesized
cattctgccaaggaatgtctgg

SEQ ID NO: 992867 - DNA, 22 bp, Artificial Sequence
  chemically synthesized
gcattctgccaaggaatgtctg

SEQ ID NO: 992868 - DNA, 22 bp, Artificial Sequence
  chemically synthesized
atttgcattctgccaaggaatg

SEQ ID NO: 992869 - DNA, 22 bp, Artificial Sequence
  chemically synthesized
gatttgcattctgccaaggaat

SEQ ID NO: 992870 - DNA, 22 bp, Artificial Sequence
  chemically synthesized
ccagacattccttggcagaatg

SEQ ID NO: 992871 - DNA, 22 bp, Artificial Sequence
  chemically synthesized
aagatgtttgatttgcattctg

SEQ ID NO: 992872 - DNA, 22 bp, Artificial Sequence
  chemically synthesized
ccattcaagatgtttgatttgc

SEQ ID NO: 992873 - DNA, 22 bp, Artificial Sequence
  chemically synthesized
cttggcagaatgcaaatcaaac

SEQ ID NO: 992874 - DNA, 22 bp, Artificial Sequence
  chemically synthesized
gccattcaagatgtttgatttg

SEQ ID NO: 992875 - DNA, 22 bp, Artificial Sequence
  chemically synthesized
tgccattcaagatgtttgattt

SEQ ID NO: 992876 - DNA, 22 bp, Artificial Sequence
  chemically synthesized
ttgccattcaagatgtttgatt

SEQ ID NO: 992877 - DNA, 22 bp, Artificial Sequence
  chemically synthesized
ggcagaatgcaaatcaaacatc

SEQ ID NO: 992878 - DNA, 22 bp, Artificial Sequence
  chemically synthesized
gcagaatgcaaatcaaacatct

SEQ ID NO: 992879 - DNA, 22 bp, Artificial Sequence
  chemically synthesized
atccttttgccattcaagatgt

SEQ ID NO: 992880 - DNA, 22 bp, Artificial Sequence
  chemically synthesized
gatccttttgccattcaagatg

SEQ ID NO: 992881 - DNA, 22 bp, Artificial Sequence
  chemically synthesized
tgatccttttgccattcaagat

SEQ ID NO: 992882 - DNA, 22 bp, Artificial Sequence
  chemically synthesized
gatgccgtgctttgatcctttt

SEQ ID NO: 992883 - DNA, 22 bp, Artificial Sequence
  chemically synthesized
agatgccgtgctttgatccttt

SEQ ID NO: 992884 - DNA, 22 bp, Artificial Sequence
  chemically synthesized
gaatggcaaaaggatcaaagca

SEQ ID NO: 992885 - DNA, 22 bp, Artificial Sequence
  chemically synthesized
aatggcaaaaggatcaaagcac

SEQ ID NO: 992886 - DNA, 22 bp, Artificial Sequence
  chemically synthesized
agcaatgtttagatgccgtgct

SEQ ID NO: 992887 - DNA, 22 bp, Artificial Sequence
  chemically synthesized
aacattgctcagacctgctgtt

SEQ ID NO: 992888 - DNA, 22 bp, Artificial Sequence
  chemically synthesized
atgcataaaaatatgaacagca

SEQ ID NO: 992889 - DNA, 22 bp, Artificial Sequence
  chemically synthesized
tgatgcataaaaatatgaacag

SEQ ID NO: 992890 - DNA, 22 bp, Artificial Sequence
  chemically synthesized
ctgatgcataaaaatatgaaca

SEQ ID NO: 992891 - DNA, 22 bp, Artificial Sequence
  chemically synthesized
ctcagacctgctgttcatattt

SEQ ID NO: 992892 - DNA, 22 bp, Artificial Sequence
  chemically synthesized
tctgatgcataaaaatatgaac

SEQ ID NO: 992893 - DNA, 22 bp, Artificial Sequence
  chemically synthesized
agacctgctgttcatattttta

SEQ ID NO: 992894 - DNA, 22 bp, Artificial Sequence
  chemically synthesized
aagttttctgatgcataaaaat

SEQ ID NO: 992895 - DNA, 22 bp, Artificial Sequence
  chemically synthesized
caagttttctgatgcataaaaa

SEQ ID NO: 992896 - DNA, 22 bp, Artificial Sequence
  chemically synthesized
tcaagttttctgatgcataaaa

SEQ ID NO: 992897 - DNA, 22 bp, Artificial Sequence
  chemically synthesized
ctgttcatatttttatgcatca

SEQ ID NO: 992898 - DNA, 22 bp, Artificial Sequence
  chemically synthesized
tttcaagttttctgatgcataa

SEQ ID NO: 992899 - DNA, 22 bp, Artificial Sequence
  chemically synthesized
tctttcaagttttctgatgcat

SEQ ID NO: 992900 - DNA, 22 bp, Artificial Sequence
  chemically synthesized
ttcatatttttatgcatcagaa

SEQ ID NO: 992901 - DNA, 22 bp, Artificial Sequence
  chemically synthesized
ctctttcaagttttctgatgca

SEQ ID NO: 992902 - DNA, 22 bp, Artificial Sequence
  chemically synthesized
atatttttatgcatcagaaaac

SEQ ID NO: 992903 - DNA, 22 bp, Artificial Sequence
  chemically synthesized
atttctctttcaagttttctga

SEQ ID NO: 992904 - DNA, 22 bp, Artificial Sequence
  chemically synthesized
taatttctctttcaagttttct

SEQ ID NO: 992905 - DNA, 22 bp, Artificial Sequence
  chemically synthesized
ttatgcatcagaaaacttgaaa

SEQ ID NO: 992906 - DNA, 22 bp, Artificial Sequence
  chemically synthesized
tatgcatcagaaaacttgaaag

SEQ ID NO: 992907 - DNA, 22 bp, Artificial Sequence
  chemically synthesized
atgcatcagaaaacttgaaaga

SEQ ID NO: 992908 - DNA, 22 bp, Artificial Sequence
  chemically synthesized
aattctaatttctctttcaagt

SEQ ID NO: 992909 - DNA, 22 bp, Artificial Sequence
  chemically synthesized
tgcatcagaaaacttgaaagag

SEQ ID NO: 992910 - DNA, 22 bp, Artificial Sequence
  chemically synthesized
caattctaatttctctttcaag

SEQ ID NO: 992911 - DNA, 22 bp, Artificial Sequence
  chemically synthesized
tcaattctaatttctctttcaa

SEQ ID NO: 992912 - DNA, 22 bp, Artificial Sequence
  chemically synthesized
tctttcaattctaatttctctt

SEQ ID NO: 992913 - DNA, 22 bp, Artificial Sequence
  chemically synthesized
gaaagagaaattagaattgaaa

SEQ ID NO: 992914 - DNA, 22 bp, Artificial Sequence
  chemically synthesized
aaagagaaattagaattgaaag

SEQ ID NO: 992915 - DNA, 22 bp, Artificial Sequence
  chemically synthesized
gaaggtgcaggtgcattatctt

SEQ ID NO: 992916 - DNA, 22 bp, Artificial Sequence
  chemically synthesized
ggaaggtgcaggtgcattatct

SEQ ID NO: 992917 - DNA, 22 bp, Artificial Sequence
  chemically synthesized
tggaaggtgcaggtgcattatc

SEQ ID NO: 992918 - DNA, 22 bp, Artificial Sequence
  chemically synthesized
gaattgaaagataatgcacctg

SEQ ID NO: 992919 - DNA, 22 bp, Artificial Sequence
  chemically synthesized
tacactttggaaggtgcaggtg

SEQ ID NO: 992920 - DNA, 22 bp, Artificial Sequence
  chemically synthesized
aaagataatgcacctgcacctt

SEQ ID NO: 992921 - DNA, 22 bp, Artificial Sequence
  chemically synthesized
aatattatacactttggaaggt

SEQ ID NO: 992922 - DNA, 22 bp, Artificial Sequence
  chemically synthesized
aaaatctcaatattatacactt

SEQ ID NO: 992923 - DNA, 22 bp, Artificial Sequence
  chemically synthesized
caccttccaaagtgtataatat

SEQ ID NO: 992924 - DNA, 22 bp, Artificial Sequence
  chemically synthesized
ccaaagtgtataatattgagat

SEQ ID NO: 992925 - DNA, 22 bp, Artificial Sequence
  chemically synthesized
caaagtgtataatattgagatt

SEQ ID NO: 992926 - DNA, 22 bp, Artificial Sequence
  chemically synthesized
atcccagagggacaaatatgct

SEQ ID NO: 992927 - DNA, 22 bp, Artificial Sequence
  chemically synthesized
agatttttagcatatttgtccc

SEQ ID NO: 992928 - DNA, 22 bp, Artificial Sequence
  chemically synthesized
ttagcatatttgtccctctggg

SEQ ID NO: 992929 - DNA, 22 bp, Artificial Sequence
  chemically synthesized
tagcatatttgtccctctggga

SEQ ID NO: 992930 - DNA, 22 bp, Artificial Sequence
  chemically synthesized
agcatatttgtccctctgggat

SEQ ID NO: 992931 - DNA, 22 bp, Artificial Sequence
  chemically synthesized
gcatatttgtccctctgggatt

SEQ ID NO: 992932 - DNA, 22 bp, Artificial Sequence
  chemically synthesized
caatggaataaaatatactaat

SEQ ID NO: 992933 - DNA, 22 bp, Artificial Sequence
  chemically synthesized
gtccctctgggattagtatatt

SEQ ID NO: 992934 - DNA, 22 bp, Artificial Sequence
  chemically synthesized
tccctctgggattagtatattt

SEQ ID NO: 992935 - DNA, 22 bp, Artificial Sequence
  chemically synthesized
ccctacaatggaataaaatata

SEQ ID NO: 992936 - DNA, 22 bp, Artificial Sequence
  chemically synthesized
tgggattagtatattttattcc

SEQ ID NO: 992937 - DNA, 22 bp, Artificial Sequence
  chemically synthesized
ctgccctacaatggaataaaat

SEQ ID NO: 992938 - DNA, 22 bp, Artificial Sequence
  chemically synthesized
ggattagtatattttattccat

SEQ ID NO: 992939 - DNA, 22 bp, Artificial Sequence
  chemically synthesized
agctgctgccctacaatggaat

SEQ ID NO: 992940 - DNA, 22 bp, Artificial Sequence
  chemically synthesized
gtatattttattccattgtagg

SEQ ID NO: 992941 - DNA, 22 bp, Artificial Sequence
  chemically synthesized
ttcagctgctgccctacaatgg

SEQ ID NO: 992942 - DNA, 22 bp, Artificial Sequence
  chemically synthesized
tattccattgtagggcagcagc

SEQ ID NO: 992943 - DNA, 22 bp, Artificial Sequence
  chemically synthesized
attccattgtagggcagcagct

SEQ ID NO: 992944 - DNA, 22 bp, Artificial Sequence
  chemically synthesized
ttccattgtagggcagcagctg

SEQ ID NO: 992945 - DNA, 22 bp, Artificial Sequence
  chemically synthesized
cacaaacccctgttcagctgct

SEQ ID NO: 992946 - DNA, 22 bp, Artificial Sequence
  chemically synthesized
cattgtagggcagcagctgaac

SEQ ID NO: 992947 - DNA, 22 bp, Artificial Sequence
  chemically synthesized
cctccacaaacccctgttcagc

SEQ ID NO: 992948 - DNA, 22 bp, Artificial Sequence
  chemically synthesized
tagggcagcagctgaacagggg

SEQ ID NO: 992949 - DNA, 22 bp, Artificial Sequence
  chemically synthesized
tgcctccacaaacccctgttca

SEQ ID NO: 992950 - DNA, 22 bp, Artificial Sequence
  chemically synthesized
ctgcctccacaaacccctgttc

SEQ ID NO: 992951 - DNA, 22 bp, Artificial Sequence
  chemically synthesized
aagtcttctgcctccacaaacc

SEQ ID NO: 992952 - DNA, 22 bp, Artificial Sequence
  chemically synthesized
tcaagtcttctgcctccacaaa

SEQ ID NO: 992953 - DNA, 22 bp, Artificial Sequence
  chemically synthesized
aacaggggtttgtggaggcaga

SEQ ID NO: 992954 - DNA, 22 bp, Artificial Sequence
  chemically synthesized
agccaagaggctctcaagtctt

SEQ ID NO: 992955 - DNA, 22 bp, Artificial Sequence
  chemically synthesized
gtggaggcagaagacttgagag

SEQ ID NO: 992956 - DNA, 22 bp, Artificial Sequence
  chemically synthesized
tggaggcagaagacttgagagc

SEQ ID NO: 992957 - DNA, 22 bp, Artificial Sequence
  chemically synthesized
caggtagttgagccaagaggct

SEQ ID NO: 992958 - DNA, 22 bp, Artificial Sequence
  chemically synthesized
acaggtagttgagccaagaggc

SEQ ID NO: 992959 - DNA, 22 bp, Artificial Sequence
  chemically synthesized
gagagcctcttggctcaactac

SEQ ID NO: 992960 - DNA, 22 bp, Artificial Sequence
  chemically synthesized
agagcctcttggctcaactacc

SEQ ID NO: 992961 - DNA, 22 bp, Artificial Sequence
  chemically synthesized
ttggctcaactacctgtaagct

SEQ ID NO: 992962 - DNA, 22 bp, Artificial Sequence
  chemically synthesized
tacaaggtcaaacagcttacag

SEQ ID NO: 992963 - DNA, 22 bp, Artificial Sequence
  chemically synthesized
ggctcaactacctgtaagctgt

SEQ ID NO: 992964 - DNA, 22 bp, Artificial Sequence
  chemically synthesized
gtacaaggtcaaacagcttaca

SEQ ID NO: 992965 - DNA, 22 bp, Artificial Sequence
  chemically synthesized
gctcaactacctgtaagctgtt

SEQ ID NO: 992966 - DNA, 22 bp, Artificial Sequence
  chemically synthesized
aactacctgtaagctgtttgac

SEQ ID NO: 992967 - DNA, 22 bp, Artificial Sequence
  chemically synthesized
aatgacttgtacaaggtcaaac

SEQ ID NO: 992968 - DNA, 22 bp, Artificial Sequence
  chemically synthesized
aaatgacttgtacaaggtcaaa

SEQ ID NO: 992969 - DNA, 22 bp, Artificial Sequence
  chemically synthesized
cctgtaagctgtttgaccttgt

SEQ ID NO: 992970 - DNA, 22 bp, Artificial Sequence
  chemically synthesized
taagctgtttgaccttgtacaa

SEQ ID NO: 992971 - DNA, 22 bp, Artificial Sequence
  chemically synthesized
tttgaccttgtacaagtcattt

SEQ ID NO: 992972 - DNA, 22 bp, Artificial Sequence
  chemically synthesized
aagccagaaagtttaaatgact

SEQ ID NO: 992973 - DNA, 22 bp, Artificial Sequence
  chemically synthesized
gaccttgtacaagtcatttaaa

SEQ ID NO: 992974 - DNA, 22 bp, Artificial Sequence
  chemically synthesized
accttgtacaagtcatttaaac

SEQ ID NO: 992975 - DNA, 22 bp, Artificial Sequence
  chemically synthesized
gtacaagtcatttaaactttct

SEQ ID NO: 992976 - DNA, 22 bp, Artificial Sequence
  chemically synthesized
tacaagtcatttaaactttctg

SEQ ID NO: 992977 - DNA, 22 bp, Artificial Sequence
  chemically synthesized
tggatgtggaagttgaagccag

SEQ ID NO: 992978 - DNA, 22 bp, Artificial Sequence
  chemically synthesized
atggatgtggaagttgaagcca

SEQ ID NO: 992979 - DNA, 22 bp, Artificial Sequence
  chemically synthesized
aaactttctggcttcaacttcc

SEQ ID NO: 992980 - DNA, 22 bp, Artificial Sequence
  chemically synthesized
aactttctggcttcaacttcca

SEQ ID NO: 992981 - DNA, 22 bp, Artificial Sequence
  chemically synthesized
cacttatggatgtggaagttga

SEQ ID NO: 992982 - DNA, 22 bp, Artificial Sequence
  chemically synthesized
attccacttatggatgtggaag

SEQ ID NO: 992983 - DNA, 22 bp, Artificial Sequence
  chemically synthesized
tctggcttcaacttccacatcc

SEQ ID NO: 992984 - DNA, 22 bp, Artificial Sequence
  chemically synthesized
ctggcttcaacttccacatcca

SEQ ID NO: 992985 - DNA, 22 bp, Artificial Sequence
  chemically synthesized
tggcttcaacttccacatccat

SEQ ID NO: 992986 - DNA, 22 bp, Artificial Sequence
  chemically synthesized
ttaattccacttatggatgtgg

SEQ ID NO: 992987 - DNA, 22 bp, Artificial Sequence
  chemically synthesized
gcttcaacttccacatccataa

SEQ ID NO: 992988 - DNA, 22 bp, Artificial Sequence
  chemically synthesized
caacttccacatccataagtgg

SEQ ID NO: 992989 - DNA, 22 bp, Artificial Sequence
  chemically synthesized
aacttccacatccataagtgga

SEQ ID NO: 992990 - DNA, 22 bp, Artificial Sequence
  chemically synthesized
atgaggtattattaattccact

SEQ ID NO: 992991 - DNA, 22 bp, Artificial Sequence
  chemically synthesized
ccacatccataagtggaattaa

SEQ ID NO: 992992 - DNA, 22 bp, Artificial Sequence
  chemically synthesized
gatgaggtattattaattccac

SEQ ID NO: 992993 - DNA, 22 bp, Artificial Sequence
  chemically synthesized
cacatccataagtggaattaat

SEQ ID NO: 992994 - DNA, 22 bp, Artificial Sequence
  chemically synthesized
atcacttgatgaggtattatta

SEQ ID NO: 992995 - DNA, 22 bp, Artificial Sequence
  chemically synthesized
tcatcacttgatgaggtattat

SEQ ID NO: 992996 - DNA, 22 bp, Artificial Sequence
  chemically synthesized
cattctcatcacttgatgaggt

SEQ ID NO: 992997 - DNA, 22 bp, Artificial Sequence
  chemically synthesized
ttccattctcatcacttgatga

SEQ ID NO: 992998 - DNA, 22 bp, Artificial Sequence
  chemically synthesized
ataatacctcatcaagtgatga

SEQ ID NO: 992999 - DNA, 22 bp, Artificial Sequence
  chemically synthesized
atatctattccattctcatcac

SEQ ID NO: 993000 - DNA, 22 bp, Artificial Sequence
  chemically synthesized
aatatctattccattctcatca

SEQ ID NO: 993001 - DNA, 22 bp, Artificial Sequence
  chemically synthesized
taatatctattccattctcatc

SEQ ID NO: 993002 - DNA, 22 bp, Artificial Sequence
  chemically synthesized
atcaagtgatgagaatggaata

SEQ ID NO: 993003 - DNA, 22 bp, Artificial Sequence
  chemically synthesized
aggagcagtgctttaatatcta

SEQ ID NO: 993004 - DNA, 22 bp, Artificial Sequence
  chemically synthesized
gaggagcagtgctttaatatct

SEQ ID NO: 993005 - DNA, 22 bp, Artificial Sequence
  chemically synthesized
tgaggagcagtgctttaatatc

SEQ ID NO: 993006 - DNA, 22 bp, Artificial Sequence
  chemically synthesized
aattttgaggagcagtgcttta

SEQ ID NO: 993007 - DNA, 22 bp, Artificial Sequence
  chemically synthesized
tatcacattaaattttgaggag

SEQ ID NO: 993008 - DNA, 22 bp, Artificial Sequence
  chemically synthesized
gtatcacattaaattttgagga

SEQ ID NO: 993009 - DNA, 22 bp, Artificial Sequence
  chemically synthesized
aagcactgctcctcaaaattta

SEQ ID NO: 993010 - DNA, 22 bp, Artificial Sequence
  chemically synthesized
gcttgtatcacattaaattttg

SEQ ID NO: 993011 - DNA, 22 bp, Artificial Sequence
  chemically synthesized
ctcctcaaaatttaatgtgata

SEQ ID NO: 993012 - DNA, 22 bp, Artificial Sequence
  chemically synthesized
ctcaaaatttaatgtgatacaa

SEQ ID NO: 993013 - DNA, 22 bp, Artificial Sequence
  chemically synthesized
aaaatttaatgtgatacaagcc

SEQ ID NO: 993014 - DNA, 22 bp, Artificial Sequence
  chemically synthesized
aatgtgatacaagccaggtgtg

SEQ ID NO: 993015 - DNA, 22 bp, Artificial Sequence
  chemically synthesized
atgtgatacaagccaggtgtgg

SEQ ID NO: 993016 - DNA, 22 bp, Artificial Sequence
  chemically synthesized
ggatcacagatgtgagccacca

SEQ ID NO: 993017 - DNA, 22 bp, Artificial Sequence
  chemically synthesized
agtagctgggatcacagatgtg

SEQ ID NO: 993018 - DNA, 22 bp, Artificial Sequence
  chemically synthesized
ctaagtagctgggatcacagat

SEQ ID NO: 993019 - DNA, 22 bp, Artificial Sequence
  chemically synthesized
agcctcctaagtagctgggatc

SEQ ID NO: 993020 - DNA, 22 bp, Artificial Sequence
  chemically synthesized
acatctgtgatcccagctactt

SEQ ID NO: 993021 - DNA, 22 bp, Artificial Sequence
  chemically synthesized
ccacctcagcctcctaagtagc

SEQ ID NO: 993022 - DNA, 22 bp, Artificial Sequence
  chemically synthesized
tgatcccagctacttaggaggc

SEQ ID NO: 993023 - DNA, 22 bp, Artificial Sequence
  chemically synthesized
aaatgatcctcccacctcagcc

SEQ ID NO: 993024 - DNA, 22 bp, Artificial Sequence
  chemically synthesized
cttaggaggctgaggtgggagg

SEQ ID NO: 993025 - DNA, 22 bp, Artificial Sequence
  chemically synthesized
agctcaaatgatcctcccacct

SEQ ID NO: 993026 - DNA, 22 bp, Artificial Sequence
  chemically synthesized
aggaggctgaggtgggaggatc

SEQ ID NO: 993027 - DNA, 22 bp, Artificial Sequence
  chemically synthesized
ctgagctcaaatgatcctccca

SEQ ID NO: 993028 - DNA, 22 bp, Artificial Sequence
  chemically synthesized
ggaggctgaggtgggaggatca

SEQ ID NO: 993029 - DNA, 22 bp, Artificial Sequence
  chemically synthesized
aggtgggaggatcatttgagct

SEQ ID NO: 993030 - DNA, 22 bp, Artificial Sequence
  chemically synthesized
gtcacaaactcctgagctcaaa

SEQ ID NO: 993031 - DNA, 22 bp, Artificial Sequence
  chemically synthesized
ccgagtctggtcacaaactcct

SEQ ID NO: 993032 - DNA, 22 bp, Artificial Sequence
  chemically synthesized
gccgagtctggtcacaaactcc

SEQ ID NO: 993033 - DNA, 22 bp, Artificial Sequence
  chemically synthesized
tgccgagtctggtcacaaactc

SEQ ID NO: 993034 - DNA, 22 bp, Artificial Sequence
  chemically synthesized
ttttgccgagtctggtcacaaa

SEQ ID NO: 993035 - DNA, 22 bp, Artificial Sequence
  chemically synthesized
gagctcaggagtttgtgaccag

SEQ ID NO: 993036 - DNA, 22 bp, Artificial Sequence
  chemically synthesized
agctcaggagtttgtgaccaga

SEQ ID NO: 993037 - DNA, 22 bp, Artificial Sequence
  chemically synthesized
ctattttgccgagtctggtcac

SEQ ID NO: 993038 - DNA, 22 bp, Artificial Sequence
  chemically synthesized
gctattttgccgagtctggtca

SEQ ID NO: 993039 - DNA, 22 bp, Artificial Sequence
  chemically synthesized
aggagtttgtgaccagactcgg

SEQ ID NO: 993040 - DNA, 22 bp, Artificial Sequence
  chemically synthesized
gtgaccagactcggcaaaatag

SEQ ID NO: 993041 - DNA, 22 bp, Artificial Sequence
  chemically synthesized
tgaccagactcggcaaaatagc

SEQ ID NO: 993042 - DNA, 22 bp, Artificial Sequence
  chemically synthesized
agatggggtcttgctattttgc

SEQ ID NO: 993043 - DNA, 22 bp, Artificial Sequence
  chemically synthesized
gagatggggtcttgctattttg

SEQ ID NO: 993044 - DNA, 22 bp, Artificial Sequence
  chemically synthesized
tgagatggggtcttgctatttt

SEQ ID NO: 993045 - DNA, 22 bp, Artificial Sequence
  chemically synthesized
ttgagatggggtcttgctattt

SEQ ID NO: 993046 - DNA, 22 bp, Artificial Sequence
  chemically synthesized
tttttgagatggggtcttgcta

SEQ ID NO: 993047 - DNA, 22 bp, Artificial Sequence
  chemically synthesized
gtttttgagatggggtcttgct

SEQ ID NO: 993048 - DNA, 22 bp, Artificial Sequence
  chemically synthesized
tttgtttttgagatggggtctt

SEQ ID NO: 993049 - DNA, 22 bp, Artificial Sequence
  chemically synthesized
ggcaaaatagcaagaccccatc

SEQ ID NO: 993050 - DNA, 22 bp, Artificial Sequence
  chemically synthesized
atttgtttttgagatggggtct

SEQ ID NO: 993051 - DNA, 22 bp, Artificial Sequence
  chemically synthesized
tatttgtttttgagatggggtc

SEQ ID NO: 993052 - DNA, 22 bp, Artificial Sequence
  chemically synthesized
tttatttgtttttgagatgggg

SEQ ID NO: 993053 - DNA, 22 bp, Artificial Sequence
  chemically synthesized
ctttatttgtttttgagatggg

SEQ ID NO: 993054 - DNA, 22 bp, Artificial Sequence
  chemically synthesized
tctttatttgtttttgagatgg

SEQ ID NO: 993055 - DNA, 22 bp, Artificial Sequence
  chemically synthesized
ttctttatttgtttttgagatg

SEQ ID NO: 993056 - DNA, 22 bp, Artificial Sequence
  chemically synthesized
gatgcatttttctttatttgtt

SEQ ID NO: 993057 - DNA, 22 bp, Artificial Sequence
  chemically synthesized
cgatgcatttttctttatttgt

SEQ ID NO: 993058 - DNA, 22 bp, Artificial Sequence
  chemically synthesized
tcgatgcatttttctttatttg

SEQ ID NO: 993059 - DNA, 22 bp, Artificial Sequence
  chemically synthesized
ctttcgatgcatttttctttat

SEQ ID NO: 993060 - DNA, 22 bp, Artificial Sequence
  chemically synthesized
actttcgatgcatttttcttta

SEQ ID NO: 993061 - DNA, 22 bp, Artificial Sequence
  chemically synthesized
tactttcgatgcatttttcttt

SEQ ID NO: 993062 - DNA, 22 bp, Artificial Sequence
  chemically synthesized
aaaaacaaataaagaaaaatgc

SEQ ID NO: 993063 - DNA, 22 bp, Artificial Sequence
  chemically synthesized
tttactttcgatgcatttttct

SEQ ID NO: 993064 - DNA, 22 bp, Artificial Sequence
  chemically synthesized
ctttactttcgatgcatttttc

SEQ ID NO: 993065 - DNA, 22 bp, Artificial Sequence
  chemically synthesized
tctttactttcgatgcattttt

SEQ ID NO: 993066 - DNA, 22 bp, Artificial Sequence
  chemically synthesized
ttctttactttcgatgcatttt

SEQ ID NO: 993067 - DNA, 22 bp, Artificial Sequence
  chemically synthesized
tttctttactttcgatgcattt

SEQ ID NO: 993068 - DNA, 22 bp, Artificial Sequence
  chemically synthesized
ttttctttactttcgatgcatt

SEQ ID NO: 993069 - DNA, 22 bp, Artificial Sequence
  chemically synthesized
ttttttctttactttcgatgca

SEQ ID NO: 993070 - DNA, 22 bp, Artificial Sequence
  chemically synthesized
cttttttctttactttcgatgc

SEQ ID NO: 993071 - DNA, 22 bp, Artificial Sequence
  chemically synthesized
tcttttttctttactttcgatg

SEQ ID NO: 993072 - DNA, 22 bp, Artificial Sequence
  chemically synthesized
ttcttttttctttactttcgat

SEQ ID NO: 993073 - DNA, 22 bp, Artificial Sequence
  chemically synthesized
tttcttttttctttactttcga

SEQ ID NO: 993074 - DNA, 22 bp, Artificial Sequence
  chemically synthesized
ttttcttttttctttactttcg

SEQ ID NO: 993075 - DNA, 22 bp, Artificial Sequence
  chemically synthesized
tttttttcttttttctttactt

SEQ ID NO: 993076 - DNA, 22 bp, Artificial Sequence
  chemically synthesized
ttatttttttcttttttcttta

SEQ ID NO: 993077 - DNA, 22 bp, Artificial Sequence
  chemically synthesized
aattattatttttttctttttt

SEQ ID NO: 993078 - DNA, 22 bp, Artificial Sequence
  chemically synthesized
tattcaattattatttttttct

SEQ ID NO: 993079 - DNA, 22 bp, Artificial Sequence
  chemically synthesized
gtattcaattattatttttttc

SEQ ID NO: 993080 - DNA, 22 bp, Artificial Sequence
  chemically synthesized
aggtcatttgtattcaattatt

SEQ ID NO: 993081 - DNA, 22 bp, Artificial Sequence
  chemically synthesized
aaggtcatttgtattcaattat

SEQ ID NO: 993082 - DNA, 22 bp, Artificial Sequence
  chemically synthesized
taaggtcatttgtattcaatta

SEQ ID NO: 993083 - DNA, 22 bp, Artificial Sequence
  chemically synthesized
ttaaggtcatttgtattcaatt

SEQ ID NO: 993084 - DNA, 22 bp, Artificial Sequence
  chemically synthesized
tttaaggtcatttgtattcaat

SEQ ID NO: 993085 - DNA, 22 bp, Artificial Sequence
  chemically synthesized
ttttaaggtcatttgtattcaa

SEQ ID NO: 993086 - DNA, 22 bp, Artificial Sequence
  chemically synthesized
tttttaaggtcatttgtattca

SEQ ID NO: 993087 - DNA, 22 bp, Artificial Sequence
  chemically synthesized
ctttttttaaggtcatttgtat

SEQ ID NO: 993088 - DNA, 22 bp, Artificial Sequence
  chemically synthesized
tgctttttttaaggtcatttgt

SEQ ID NO: 993089 - DNA, 22 bp, Artificial Sequence
  chemically synthesized
aactctgctttttttaaggtca

SEQ ID NO: 993090 - DNA, 22 bp, Artificial Sequence
  chemically synthesized
aatacaaatgaccttaaaaaaa

SEQ ID NO: 993091 - DNA, 22 bp, Artificial Sequence
  chemically synthesized
aaaaaaagcagagtttaattca

SEQ ID NO: 993092 - DNA, 22 bp, Artificial Sequence
  chemically synthesized
aaaaaagcagagtttaattcat

SEQ ID NO: 993093 - DNA, 22 bp, Artificial Sequence
  chemically synthesized
aggcaccaccgcaggtccaatg

SEQ ID NO: 993094 - DNA, 22 bp, Artificial Sequence
  chemically synthesized
tcaggcaccaccgcaggtccaa

SEQ ID NO: 993095 - DNA, 22 bp, Artificial Sequence
  chemically synthesized
aattcattggacctgcggtggt

SEQ ID NO: 993096 - DNA, 22 bp, Artificial Sequence
  chemically synthesized
attcattggacctgcggtggtg

SEQ ID NO: 993097 - DNA, 22 bp, Artificial Sequence
  chemically synthesized
attggacctgcggtggtgcctg

SEQ ID NO: 993098 - DNA, 22 bp, Artificial Sequence
  chemically synthesized
gaaatggagactctcaggcacc

SEQ ID NO: 993099 - DNA, 22 bp, Artificial Sequence
  chemically synthesized
gacctgcggtggtgcctgagag

SEQ ID NO: 993100 - DNA, 22 bp, Artificial Sequence
  chemically synthesized
ttggaaatggagactctcaggc

SEQ ID NO: 993101 - DNA, 22 bp, Artificial Sequence
  chemically synthesized
attggaaatggagactctcagg

SEQ ID NO: 993102 - DNA, 22 bp, Artificial Sequence
  chemically synthesized
cggtggtgcctgagagtctcca

SEQ ID NO: 993103 - DNA, 22 bp, Artificial Sequence
  chemically synthesized
ggagcttattggaaatggagac

SEQ ID NO: 993104 - DNA, 22 bp, Artificial Sequence
  chemically synthesized
gggagcttattggaaatggaga

SEQ ID NO: 993105 - DNA, 22 bp, Artificial Sequence
  chemically synthesized
agagtctccatttccaataagc

SEQ ID NO: 993106 - DNA, 22 bp, Artificial Sequence
  chemically synthesized
catttccaataagctcccaagt

SEQ ID NO: 993107 - DNA, 22 bp, Artificial Sequence
  chemically synthesized
ccaataagctcccaagtggtac

SEQ ID NO: 993108 - DNA, 22 bp, Artificial Sequence
  chemically synthesized
caataagctcccaagtggtact

SEQ ID NO: 993109 - DNA, 22 bp, Artificial Sequence
  chemically synthesized
ccaagtggtactgctgctctgt

SEQ ID NO: 993110 - DNA, 22 bp, Artificial Sequence
  chemically synthesized
cacacagtggggtccacagagc

SEQ ID NO: 993111 - DNA, 22 bp, Artificial Sequence
  chemically synthesized
ctacacacagtggggtccacag

SEQ ID NO: 993112 - DNA, 22 bp, Artificial Sequence
  chemically synthesized
gctacacacagtggggtccaca

SEQ ID NO: 993113 - DNA, 22 bp, Artificial Sequence
  chemically synthesized
ctgctctgtggaccccactgtg

SEQ ID NO: 993114 - DNA, 22 bp, Artificial Sequence
  chemically synthesized
atatttgctacacacagtgggg

SEQ ID NO: 993115 - DNA, 22 bp, Artificial Sequence
  chemically synthesized
ctctgtggaccccactgtgtgt

SEQ ID NO: 993116 - DNA, 22 bp, Artificial Sequence
  chemically synthesized
cactgatatttgctacacacag

SEQ ID NO: 993117 - DNA, 22 bp, Artificial Sequence
  chemically synthesized
tgtggaccccactgtgtgtagc

SEQ ID NO: 993118 - DNA, 22 bp, Artificial Sequence
  chemically synthesized
ccactgatatttgctacacaca

SEQ ID NO: 993119 - DNA, 22 bp, Artificial Sequence
  chemically synthesized
tccactgatatttgctacacac

SEQ ID NO: 993120 - DNA, 22 bp, Artificial Sequence
  chemically synthesized
tggaccccactgtgtgtagcaa

SEQ ID NO: 993121 - DNA, 22 bp, Artificial Sequence
  chemically synthesized
tgtgtagcaaatatcagtggaa

SEQ ID NO: 993122 - DNA, 22 bp, Artificial Sequence
  chemically synthesized
gaagaataacagtgttttccac

SEQ ID NO: 993123 - DNA, 22 bp, Artificial Sequence
  chemically synthesized
ggaagaataacagtgttttcca

SEQ ID NO: 993124 - DNA, 22 bp, Artificial Sequence
  chemically synthesized
tcatttggaagaataacagtgt

SEQ ID NO: 993125 - DNA, 22 bp, Artificial Sequence
  chemically synthesized
actatcatttggaagaataaca

SEQ ID NO: 993126 - DNA, 22 bp, Artificial Sequence
  chemically synthesized
ttattcttccaaatgatagtga

SEQ ID NO: 993127 - DNA, 22 bp, Artificial Sequence
  chemically synthesized
ttcttccaaatgatagtgaatt

SEQ ID NO: 993128 - DNA, 22 bp, Artificial Sequence
  chemically synthesized
ttccaaatgatagtgaatttgt

SEQ ID NO: 993129 - DNA, 22 bp, Artificial Sequence
  chemically synthesized
ccaaatgatagtgaatttgtgt

SEQ ID NO: 993130 - DNA, 22 bp, Artificial Sequence
  chemically synthesized
caaatgatagtgaatttgtgtc

SEQ ID NO: 993131 - DNA, 22 bp, Artificial Sequence
  chemically synthesized
gtgtcctattgccatttttatt

SEQ ID NO: 993132 - DNA, 22 bp, Artificial Sequence
  chemically synthesized
tgtcctattgccatttttattt

SEQ ID NO: 993133 - DNA, 22 bp, Artificial Sequence
  chemically synthesized
agggaaaacatgcaccaaataa

SEQ ID NO: 993134 - DNA, 22 bp, Artificial Sequence
  chemically synthesized
ttgccatttttatttggtgcat

SEQ ID NO: 993135 - DNA, 22 bp, Artificial Sequence
  chemically synthesized
ccatttttatttggtgcatgtt

SEQ ID NO: 993136 - DNA, 22 bp, Artificial Sequence
  chemically synthesized
ggtagatactgagggaaaacat

SEQ ID NO: 993137 - DNA, 22 bp, Artificial Sequence
  chemically synthesized
ttatttggtgcatgttttccct

SEQ ID NO: 993138 - DNA, 22 bp, Artificial Sequence
  chemically synthesized
tatttggtgcatgttttccctc

SEQ ID NO: 993139 - DNA, 22 bp, Artificial Sequence
  chemically synthesized
atttggtgcatgttttccctca

SEQ ID NO: 993140 - DNA, 22 bp, Artificial Sequence
  chemically synthesized
tttggtgcatgttttccctcag

SEQ ID NO: 993141 - DNA, 22 bp, Artificial Sequence
  chemically synthesized
ggtgcatgttttccctcagtat

SEQ ID NO: 993142 - DNA, 22 bp, Artificial Sequence
  chemically synthesized
acggttgggtagatactgaggg

SEQ ID NO: 993143 - DNA, 22 bp, Artificial Sequence
  chemically synthesized
gtgcatgttttccctcagtatc

SEQ ID NO: 993144 - DNA, 22 bp, Artificial Sequence
  chemically synthesized
gtaattgacggttgggtagata

SEQ ID NO: 993145 - DNA, 22 bp, Artificial Sequence
  chemically synthesized
tccctcagtatctacccaaccg

SEQ ID NO: 993146 - DNA, 22 bp, Artificial Sequence
  chemically synthesized
ccctcagtatctacccaaccgt

SEQ ID NO: 993147 - DNA, 22 bp, Artificial Sequence
  chemically synthesized
cctcagtatctacccaaccgtc

SEQ ID NO: 993148 - DNA, 22 bp, Artificial Sequence
  chemically synthesized
agtatctacccaaccgtcaatt

SEQ ID NO: 993149 - DNA, 22 bp, Artificial Sequence
  chemically synthesized
ccgtagacaagcatctagtaat

SEQ ID NO: 993150 - DNA, 22 bp, Artificial Sequence
  chemically synthesized
cccaaccgtcaattactagatg

SEQ ID NO: 993151 - DNA, 22 bp, Artificial Sequence
  chemically synthesized
cacatcacctgccgtagacaag

SEQ ID NO: 993152 - DNA, 22 bp, Artificial Sequence
  chemically synthesized
ctagatgcttgtctacggcagg

SEQ ID NO: 993153 - DNA, 22 bp, Artificial Sequence
  chemically synthesized
tgtcctgcacatcacctgccgt

SEQ ID NO: 993154 - DNA, 22 bp, Artificial Sequence
  chemically synthesized
gatgcttgtctacggcaggtga

SEQ ID NO: 993155 - DNA, 22 bp, Artificial Sequence
  chemically synthesized
gtctacggcaggtgatgtgcag

SEQ ID NO: 993156 - DNA, 22 bp, Artificial Sequence
  chemically synthesized
tctacggcaggtgatgtgcagg

SEQ ID NO: 993157 - DNA, 22 bp, Artificial Sequence
  chemically synthesized
aaatatctatgtcctgcacatc

SEQ ID NO: 993158 - DNA, 22 bp, Artificial Sequence
  chemically synthesized
aaaatatctatgtcctgcacat

SEQ ID NO: 993159 - DNA, 22 bp, Artificial Sequence
  chemically synthesized
taaaatatctatgtcctgcaca

SEQ ID NO: 993160 - DNA, 22 bp, Artificial Sequence
  chemically synthesized
cggcaggtgatgtgcaggacat

SEQ ID NO: 993161 - DNA, 22 bp, Artificial Sequence
  chemically synthesized
taaactttaaaatatctatgtc

SEQ ID NO: 993162 - DNA, 22 bp, Artificial Sequence
  chemically synthesized
gtaaactttaaaatatctatgt

SEQ ID NO: 993163 - DNA, 22 bp, Artificial Sequence
  chemically synthesized
tgtaaactttaaaatatctatg

SEQ ID NO: 993164 - DNA, 22 bp, Artificial Sequence
  chemically synthesized
aggacagggcaatgtctttgta

SEQ ID NO: 993165 - DNA, 22 bp, Artificial Sequence
  chemically synthesized
ctgaggacagggcaatgtcttt

SEQ ID NO: 993166 - DNA, 22 bp, Artificial Sequence
  chemically synthesized
cctgaggacagggcaatgtctt

SEQ ID NO: 993167 - DNA, 22 bp, Artificial Sequence
  chemically synthesized
taaagtttacaaagacattgcc

SEQ ID NO: 993168 - DNA, 22 bp, Artificial Sequence
  chemically synthesized
aaagtttacaaagacattgccc

SEQ ID NO: 993169 - DNA, 22 bp, Artificial Sequence
  chemically synthesized
aagtttacaaagacattgccct

SEQ ID NO: 993170 - DNA, 22 bp, Artificial Sequence
  chemically synthesized
aaagcttcctgaggacagggca

SEQ ID NO: 993171 - DNA, 22 bp, Artificial Sequence
  chemically synthesized
acaaagacattgccctgtcctc

SEQ ID NO: 993172 - DNA, 22 bp, Artificial Sequence
  chemically synthesized
caaagacattgccctgtcctca

SEQ ID NO: 993173 - DNA, 22 bp, Artificial Sequence
  chemically synthesized
acatagattgaaagcttcctga

SEQ ID NO: 993174 - DNA, 22 bp, Artificial Sequence
  chemically synthesized
tcacatagattgaaagcttcct

SEQ ID NO: 993175 - DNA, 22 bp, Artificial Sequence
  chemically synthesized
ccctgtcctcaggaagctttca

SEQ ID NO: 993176 - DNA, 22 bp, Artificial Sequence
  chemically synthesized
attctcacatagattgaaagct

SEQ ID NO: 993177 - DNA, 22 bp, Artificial Sequence
  chemically synthesized
cattctcacatagattgaaagc

SEQ ID NO: 993178 - DNA, 22 bp, Artificial Sequence
  chemically synthesized
tcctcaggaagctttcaatcta

SEQ ID NO: 993179 - DNA, 22 bp, Artificial Sequence
  chemically synthesized
aggaagctttcaatctatgtga

SEQ ID NO: 993180 - DNA, 22 bp, Artificial Sequence
  chemically synthesized
tcaatctatgtgagaatgaaga

SEQ ID NO: 993181 - DNA, 22 bp, Artificial Sequence
  chemically synthesized
caatctatgtgagaatgaagat

SEQ ID NO: 993182 - DNA, 22 bp, Artificial Sequence
  chemically synthesized
tagtggtaagtgatcttcattc

SEQ ID NO: 993183 - DNA, 22 bp, Artificial Sequence
  chemically synthesized
aatctatgtgagaatgaagatc

SEQ ID NO: 993184 - DNA, 22 bp, Artificial Sequence
  chemically synthesized
gtagtggtaagtgatcttcatt

SEQ ID NO: 993185 - DNA, 22 bp, Artificial Sequence
  chemically synthesized
tttgtagtggtaagtgatcttc

SEQ ID NO: 993186 - DNA, 22 bp, Artificial Sequence
  chemically synthesized
tgtgagaatgaagatcacttac

SEQ ID NO: 993187 - DNA, 22 bp, Artificial Sequence
  chemically synthesized
catgtccaaactgtttgtagtg

SEQ ID NO: 993188 - DNA, 22 bp, Artificial Sequence
  chemically synthesized
gtcctccatgtccaaactgttt

SEQ ID NO: 993189 - DNA, 22 bp, Artificial Sequence
  chemically synthesized
ggtcctccatgtccaaactgtt

SEQ ID NO: 993190 - DNA, 22 bp, Artificial Sequence
  chemically synthesized
tggtcctccatgtccaaactgt

SEQ ID NO: 993191 - DNA, 22 bp, Artificial Sequence
  chemically synthesized
accactacaaacagtttggaca

SEQ ID NO: 993192 - DNA, 22 bp, Artificial Sequence
  chemically synthesized
ccactacaaacagtttggacat

SEQ ID NO: 993193 - DNA, 22 bp, Artificial Sequence
  chemically synthesized
caaacagtttggacatggagga

SEQ ID NO: 993194 - DNA, 22 bp, Artificial Sequence
  chemically synthesized
ggacatggaggaccaaagctac

SEQ ID NO: 993195 - DNA, 22 bp, Artificial Sequence
  chemically synthesized
gacatggaggaccaaagctacc

SEQ ID NO: 993196 - DNA, 22 bp, Artificial Sequence
  chemically synthesized
tgtgagcataaggggtaggtag

SEQ ID NO: 993197 - DNA, 22 bp, Artificial Sequence
  chemically synthesized
cctaccccttatgctcacatag

SEQ ID NO: 993198 - DNA, 22 bp, Artificial Sequence
  chemically synthesized
atgtcgacagccagctatgtga

SEQ ID NO: 993199 - DNA, 22 bp, Artificial Sequence
  chemically synthesized
ccccttatgctcacatagctgg

SEQ ID NO: 993200 - DNA, 22 bp, Artificial Sequence
  chemically synthesized
atgctcacatagctggctgtcg

SEQ ID NO: 993201 - DNA, 22 bp, Artificial Sequence
  chemically synthesized
tgctcacatagctggctgtcga

SEQ ID NO: 993202 - DNA, 22 bp, Artificial Sequence
  chemically synthesized
acatagctggctgtcgacatta

SEQ ID NO: 993203 - DNA, 22 bp, Artificial Sequence
  chemically synthesized
gctgtcgacattaacatggttt

SEQ ID NO: 993204 - DNA, 22 bp, Artificial Sequence
  chemically synthesized
tcgacattaacatggtttacct

SEQ ID NO: 993205 - DNA, 22 bp, Artificial Sequence
  chemically synthesized
atgaagacaatggaaaggtaaa

SEQ ID NO: 993206 - DNA, 22 bp, Artificial Sequence
  chemically synthesized
tgctaatgaagacaatggaaag

SEQ ID NO: 993207 - DNA, 22 bp, Artificial Sequence
  chemically synthesized
acatggtttacctttccattgt

SEQ ID NO: 993208 - DNA, 22 bp, Artificial Sequence
  chemically synthesized
acctttccattgtcttcattag

SEQ ID NO: 993209 - DNA, 22 bp, Artificial Sequence
  chemically synthesized
cctttccattgtcttcattagc

SEQ ID NO: 993210 - DNA, 22 bp, Artificial Sequence
  chemically synthesized
taataggaaagttatgctaatg

SEQ ID NO: 993211 - DNA, 22 bp, Artificial Sequence
  chemically synthesized
tccattgtcttcattagcataa

SEQ ID NO: 993212 - DNA, 22 bp, Artificial Sequence
  chemically synthesized
ccattgtcttcattagcataac

SEQ ID NO: 993213 - DNA, 22 bp, Artificial Sequence
  chemically synthesized
cattgtcttcattagcataact

SEQ ID NO: 993214 - DNA, 22 bp, Artificial Sequence
  chemically synthesized
tctgtaataggaaagttatgct

SEQ ID NO: 993215 - DNA, 22 bp, Artificial Sequence
  chemically synthesized
tcttcattagcataactttcct

SEQ ID NO: 993216 - DNA, 22 bp, Artificial Sequence
  chemically synthesized
cattagcataactttcctatta

SEQ ID NO: 993217 - DNA, 22 bp, Artificial Sequence
  chemically synthesized
attagcataactttcctattac

SEQ ID NO: 993218 - DNA, 22 bp, Artificial Sequence
  chemically synthesized
gccaagagttatctgtaatagg

SEQ ID NO: 993219 - DNA, 22 bp, Artificial Sequence
  chemically synthesized
gcataactttcctattacagat

SEQ ID NO: 993220 - DNA, 22 bp, Artificial Sequence
  chemically synthesized
cctggccaagagttatctgtaa

SEQ ID NO: 993221 - DNA, 22 bp, Artificial Sequence
  chemically synthesized
gcctggccaagagttatctgta

SEQ ID NO: 993222 - DNA, 22 bp, Artificial Sequence
  chemically synthesized
tttgcctggccaagagttatct

SEQ ID NO: 993223 - DNA, 22 bp, Artificial Sequence
  chemically synthesized
tcctattacagataactcttgg

SEQ ID NO: 993224 - DNA, 22 bp, Artificial Sequence
  chemically synthesized
cctattacagataactcttggc

SEQ ID NO: 993225 - DNA, 22 bp, Artificial Sequence
  chemically synthesized
ctattacagataactcttggcc

SEQ ID NO: 993226 - DNA, 22 bp, Artificial Sequence
  chemically synthesized
ttacagataactcttggccagg

SEQ ID NO: 993227 - DNA, 22 bp, Artificial Sequence
  chemically synthesized
cagataactcttggccaggcaa

SEQ ID NO: 993228 - DNA, 22 bp, Artificial Sequence
  chemically synthesized
gtgaacagtcaaattatttgcc

SEQ ID NO: 993229 - DNA, 22 bp, Artificial Sequence
  chemically synthesized
agtgaacagtcaaattatttgc

SEQ ID NO: 993230 - DNA, 22 bp, Artificial Sequence
  chemically synthesized
tagtgaacagtcaaattatttg

SEQ ID NO: 993231 - DNA, 22 bp, Artificial Sequence
  chemically synthesized
ttggccaggcaaataatttgac

SEQ ID NO: 993232 - DNA, 22 bp, Artificial Sequence
  chemically synthesized
ctttagtgaacagtcaaattat

SEQ ID NO: 993233 - DNA, 22 bp, Artificial Sequence
  chemically synthesized
ggccaggcaaataatttgactg

SEQ ID NO: 993234 - DNA, 22 bp, Artificial Sequence
  chemically synthesized
gccaggcaaataatttgactgt

SEQ ID NO: 993235 - DNA, 22 bp, Artificial Sequence
  chemically synthesized
gggaagttactttagtgaacag

SEQ ID NO: 993236 - DNA, 22 bp, Artificial Sequence
  chemically synthesized
ggggaagttactttagtgaaca

SEQ ID NO: 993237 - DNA, 22 bp, Artificial Sequence
  chemically synthesized
gactgttcactaaagtaacttc

SEQ ID NO: 993238 - DNA, 22 bp, Artificial Sequence
  chemically synthesized
actgttcactaaagtaacttcc

SEQ ID NO: 993239 - DNA, 22 bp, Artificial Sequence
  chemically synthesized
atgggagtttggggaagttact

SEQ ID NO: 993240 - DNA, 22 bp, Artificial Sequence
  chemically synthesized
ttcactaaagtaacttccccaa

SEQ ID NO: 993241 - DNA, 22 bp, Artificial Sequence
  chemically synthesized
actaaagtaacttccccaaact

SEQ ID NO: 993242 - DNA, 22 bp, Artificial Sequence
  chemically synthesized
aagagttgatgggagtttgggg

SEQ ID NO: 993243 - DNA, 22 bp, Artificial Sequence
  chemically synthesized
aagtaacttccccaaactccca

SEQ ID NO: 993244 - DNA, 22 bp, Artificial Sequence
  chemically synthesized
ttgaagagttgatgggagtttg

SEQ ID NO: 993245 - DNA, 22 bp, Artificial Sequence
  chemically synthesized
gttgaagagttgatgggagttt

SEQ ID NO: 993246 - DNA, 22 bp, Artificial Sequence
  chemically synthesized
tgttgaagagttgatgggagtt

SEQ ID NO: 993247 - DNA, 22 bp, Artificial Sequence
  chemically synthesized
ttgttgaagagttgatgggagt

SEQ ID NO: 993248 - DNA, 22 bp, Artificial Sequence
  chemically synthesized
tttgttgaagagttgatgggag

SEQ ID NO: 993249 - DNA, 22 bp, Artificial Sequence
  chemically synthesized
ccccaaactcccatcaactctt

SEQ ID NO: 993250 - DNA, 22 bp, Artificial Sequence
  chemically synthesized
cccaaactcccatcaactcttc

SEQ ID NO: 993251 - DNA, 22 bp, Artificial Sequence
  chemically synthesized
atgttttttgttgaagagttga

SEQ ID NO: 993252 - DNA, 22 bp, Artificial Sequence
  chemically synthesized
ttgatgttttttgttgaagagt

SEQ ID NO: 993253 - DNA, 22 bp, Artificial Sequence
  chemically synthesized
tattgatgttttttgttgaaga

SEQ ID NO: 993254 - DNA, 22 bp, Artificial Sequence
  chemically synthesized
ccatcaactcttcaacaaaaaa

SEQ ID NO: 993255 - DNA, 22 bp, Artificial Sequence
  chemically synthesized
aggtgtgaactctattgatgtt

SEQ ID NO: 993256 - DNA, 22 bp, Artificial Sequence
  chemically synthesized
ttcaacaaaaaacatcaataga

SEQ ID NO: 993257 - DNA, 22 bp, Artificial Sequence
  chemically synthesized
ttaaggtgtgaactctattgat

SEQ ID NO: 993258 - DNA, 22 bp, Artificial Sequence
  chemically synthesized
caacaaaaaacatcaatagagt

SEQ ID NO: 993259 - DNA, 22 bp, Artificial Sequence
  chemically synthesized
aacaaaaaacatcaatagagtt

SEQ ID NO: 993260 - DNA, 22 bp, Artificial Sequence
  chemically synthesized
agagactattaaggtgtgaact

SEQ ID NO: 993261 - DNA, 22 bp, Artificial Sequence
  chemically synthesized
gccaagaggctcagagactatt

SEQ ID NO: 993262 - DNA, 22 bp, Artificial Sequence
  chemically synthesized
tagccaagaggctcagagacta

SEQ ID NO: 993263 - DNA, 22 bp, Artificial Sequence
  chemically synthesized
ctagccaagaggctcagagact

SEQ ID NO: 993264 - DNA, 22 bp, Artificial Sequence
  chemically synthesized
acaccttaatagtctctgagcc

SEQ ID NO: 993265 - DNA, 22 bp, Artificial Sequence
  chemically synthesized
aatagtctctgagcctcttggc

SEQ ID NO: 993266 - DNA, 22 bp, Artificial Sequence
  chemically synthesized
atagtctctgagcctcttggct

SEQ ID NO: 993267 - DNA, 22 bp, Artificial Sequence
  chemically synthesized
tgagcctcttggctagaaatct

SEQ ID NO: 993268 - DNA, 22 bp, Artificial Sequence
  chemically synthesized
agcctcttggctagaaatcttc

SEQ ID NO: 993269 - DNA, 22 bp, Artificial Sequence
  chemically synthesized
gtggaaacagcacagtgaagat

SEQ ID NO: 993270 - DNA, 22 bp, Artificial Sequence
  chemically synthesized
ggtggaaacagcacagtgaaga

SEQ ID NO: 993271 - DNA, 22 bp, Artificial Sequence
  chemically synthesized
ttggctagaaatcttcactgtg

SEQ ID NO: 993272 - DNA, 22 bp, Artificial Sequence
  chemically synthesized
ggctagaaatcttcactgtgct

SEQ ID NO: 993273 - DNA, 22 bp, Artificial Sequence
  chemically synthesized
gctagaaatcttcactgtgctg

SEQ ID NO: 993274 - DNA, 22 bp, Artificial Sequence
  chemically synthesized
gtttggtggaaacagcacagtg

SEQ ID NO: 993275 - DNA, 22 bp, Artificial Sequence
  chemically synthesized
agtttggtggaaacagcacagt

SEQ ID NO: 993276 - DNA, 22 bp, Artificial Sequence
  chemically synthesized
gaaatcttcactgtgctgtttc

SEQ ID NO: 993277 - DNA, 22 bp, Artificial Sequence
  chemically synthesized
caacttagtttggtggaaacag

SEQ ID NO: 993278 - DNA, 22 bp, Artificial Sequence
  chemically synthesized
cactgtgctgtttccaccaaac

SEQ ID NO: 993279 - DNA, 22 bp, Artificial Sequence
  chemically synthesized
actgtgctgtttccaccaaact

SEQ ID NO: 993280 - DNA, 22 bp, Artificial Sequence
  chemically synthesized
tgctgtttccaccaaactaagt

SEQ ID NO: 993281 - DNA, 22 bp, Artificial Sequence
  chemically synthesized
tttccaccaaactaagttgtaa

SEQ ID NO: 993282 - DNA, 22 bp, Artificial Sequence
  chemically synthesized
ccaccaaactaagttgtaatac

SEQ ID NO: 993283 - DNA, 22 bp, Artificial Sequence
  chemically synthesized
caccaaactaagttgtaatacc

SEQ ID NO: 993284 - DNA, 22 bp, Artificial Sequence
  chemically synthesized
ggtaaggatcatggtattacaa

SEQ ID NO: 993285 - DNA, 22 bp, Artificial Sequence
  chemically synthesized
ggattgggtaaggatcatggta

SEQ ID NO: 993286 - DNA, 22 bp, Artificial Sequence
  chemically synthesized
agttgtaataccatgatcctta

SEQ ID NO: 993287 - DNA, 22 bp, Artificial Sequence
  chemically synthesized
taataccatgatccttacccaa

SEQ ID NO: 993288 - DNA, 22 bp, Artificial Sequence
  chemically synthesized
tgggggcacaattaggattggg

SEQ ID NO: 993289 - DNA, 22 bp, Artificial Sequence
  chemically synthesized
actgtgggggcacaattaggat

SEQ ID NO: 993290 - DNA, 22 bp, Artificial Sequence
  chemically synthesized
cactgtgggggcacaattagga

SEQ ID NO: 993291 - DNA, 22 bp, Artificial Sequence
  chemically synthesized
tcactgtgggggcacaattagg

SEQ ID NO: 993292 - DNA, 22 bp, Artificial Sequence
  chemically synthesized
acccaatcctaattgtgccccc

SEQ ID NO: 993293 - DNA, 22 bp, Artificial Sequence
  chemically synthesized
gtctttcactgtgggggcacaa

SEQ ID NO: 993294 - DNA, 22 bp, Artificial Sequence
  chemically synthesized
cccaatcctaattgtgccccca

SEQ ID NO: 993295 - DNA, 22 bp, Artificial Sequence
  chemically synthesized
agattggtctttcactgtgggg

SEQ ID NO: 993296 - DNA, 22 bp, Artificial Sequence
  chemically synthesized
aagattggtctttcactgtggg

SEQ ID NO: 993297 - DNA, 22 bp, Artificial Sequence
  chemically synthesized
attgtgcccccacagtgaaaga

SEQ ID NO: 993298 - DNA, 22 bp, Artificial Sequence
  chemically synthesized
gtttaagattggtctttcactg

SEQ ID NO: 993299 - DNA, 22 bp, Artificial Sequence
  chemically synthesized
ggtttaagattggtctttcact

SEQ ID NO: 993300 - DNA, 22 bp, Artificial Sequence
  chemically synthesized
tgcccccacagtgaaagaccaa

SEQ ID NO: 993301 - DNA, 22 bp, Artificial Sequence
  chemically synthesized
ggagtatgaagcttggtttaag

SEQ ID NO: 993302 - DNA, 22 bp, Artificial Sequence
  chemically synthesized
attgggagtatgaagcttggtt

SEQ ID NO: 993303 - DNA, 22 bp, Artificial Sequence
  chemically synthesized
cattgggagtatgaagcttggt

SEQ ID NO: 993304 - DNA, 22 bp, Artificial Sequence
  chemically synthesized
gatttcattgggagtatgaagc

SEQ ID NO: 993305 - DNA, 22 bp, Artificial Sequence
  chemically synthesized
aaaccaagcttcatactcccaa

SEQ ID NO: 993306 - DNA, 22 bp, Artificial Sequence
  chemically synthesized
aaccaagcttcatactcccaat

SEQ ID NO: 993307 - DNA, 22 bp, Artificial Sequence
  chemically synthesized
catactcccaatgaaatccaac

SEQ ID NO: 993308 - DNA, 22 bp, Artificial Sequence
  chemically synthesized
atactcccaatgaaatccaacc

SEQ ID NO: 993309 - DNA, 22 bp, Artificial Sequence
  chemically synthesized
ataaggagaaaggtgaggttgg

SEQ ID NO: 993310 - DNA, 22 bp, Artificial Sequence
  chemically synthesized
cataaggagaaaggtgaggttg

SEQ ID NO: 993311 - DNA, 22 bp, Artificial Sequence
  chemically synthesized
ccaatgaaatccaacctcacct

SEQ ID NO: 993312 - DNA, 22 bp, Artificial Sequence
  chemically synthesized
gtagtatttcataaggagaaag

SEQ ID NO: 993313 - DNA, 22 bp, Artificial Sequence
  chemically synthesized
ggtagtatttcataaggagaaa

SEQ ID NO: 993314 - DNA, 22 bp, Artificial Sequence
  chemically synthesized
tggtagtatttcataaggagaa

SEQ ID NO: 993315 - DNA, 22 bp, Artificial Sequence
  chemically synthesized
acctttctccttatgaaatact

SEQ ID NO: 993316 - DNA, 22 bp, Artificial Sequence
  chemically synthesized
gacaaagctttggtagtatttc

SEQ ID NO: 993317 - DNA, 22 bp, Artificial Sequence
  chemically synthesized
tctccttatgaaatactaccaa

SEQ ID NO: 993318 - DNA, 22 bp, Artificial Sequence
  chemically synthesized
ctccttatgaaatactaccaaa

SEQ ID NO: 993319 - DNA, 22 bp, Artificial Sequence
  chemically synthesized
tccttatgaaatactaccaaag

SEQ ID NO: 993320 - DNA, 22 bp, Artificial Sequence
  chemically synthesized
cttatgaaatactaccaaagct

SEQ ID NO: 993321 - DNA, 22 bp, Artificial Sequence
  chemically synthesized
atgaaatactaccaaagctttg

SEQ ID NO: 993322 - DNA, 22 bp, Artificial Sequence
  chemically synthesized
tgaaatactaccaaagctttgt

SEQ ID NO: 993323 - DNA, 22 bp, Artificial Sequence
  chemically synthesized
ccaaagctttgtccaggctgtg

SEQ ID NO: 993324 - DNA, 22 bp, Artificial Sequence
  chemically synthesized
tggtaagaaagaccacagcctg

SEQ ID NO: 993325 - DNA, 22 bp, Artificial Sequence
  chemically synthesized
ctatggtaagaaagaccacagc

SEQ ID NO: 993326 - DNA, 22 bp, Artificial Sequence
  chemically synthesized
actatggtaagaaagaccacag

SEQ ID NO: 993327 - DNA, 22 bp, Artificial Sequence
  chemically synthesized
cttactatggtaagaaagacca

SEQ ID NO: 993328 - DNA, 22 bp, Artificial Sequence
  chemically synthesized
tgtccaggctgtggtctttctt

SEQ ID NO: 993329 - DNA, 22 bp, Artificial Sequence
  chemically synthesized
gtccaggctgtggtctttctta

SEQ ID NO: 993330 - DNA, 22 bp, Artificial Sequence
  chemically synthesized
tccaggctgtggtctttcttac

SEQ ID NO: 993331 - DNA, 22 bp, Artificial Sequence
  chemically synthesized
ttgcttactatggtaagaaaga

SEQ ID NO: 993332 - DNA, 22 bp, Artificial Sequence
  chemically synthesized
attgcttactatggtaagaaag

SEQ ID NO: 993333 - DNA, 22 bp, Artificial Sequence
  chemically synthesized
aatttattgcttactatggtaa

SEQ ID NO: 993334 - DNA, 22 bp, Artificial Sequence
  chemically synthesized
tggtctttcttaccatagtaag

SEQ ID NO: 993335 - DNA, 22 bp, Artificial Sequence
  chemically synthesized
tcttaccatagtaagcaataaa

SEQ ID NO: 993336 - DNA, 22 bp, Artificial Sequence
  chemically synthesized
cttaccatagtaagcaataaat

SEQ ID NO: 993337 - DNA, 22 bp, Artificial Sequence
  chemically synthesized
ttaccatagtaagcaataaatt

SEQ ID NO: 993338 - DNA, 22 bp, Artificial Sequence
  chemically synthesized
accatagtaagcaataaattta

SEQ ID NO: 993339 - DNA, 22 bp, Artificial Sequence
  chemically synthesized
ataagacaaagttaaatttatt

SEQ ID NO: 993340 - DNA, 22 bp, Artificial Sequence
  chemically synthesized
ccatagtaagcaataaatttaa

SEQ ID NO: 993341 - DNA, 22 bp, Artificial Sequence
  chemically synthesized
ttgataagacaaagttaaattt

SEQ ID NO: 993342 - DNA, 22 bp, Artificial Sequence
  chemically synthesized
aactttgtcttatcaacaggtt

SEQ ID NO: 993343 - DNA, 22 bp, Artificial Sequence
  chemically synthesized
actttgtcttatcaacaggttg

SEQ ID NO: 993344 - DNA, 22 bp, Artificial Sequence
  chemically synthesized
aacatcaccaatacaacctgtt

SEQ ID NO: 993345 - DNA, 22 bp, Artificial Sequence
  chemically synthesized
tgtcttatcaacaggttgtatt

SEQ ID NO: 993346 - DNA, 22 bp, Artificial Sequence
  chemically synthesized
gtcttatcaacaggttgtattg

SEQ ID NO: 993347 - DNA, 22 bp, Artificial Sequence
  chemically synthesized
cctaaacatcaccaatacaacc

SEQ ID NO: 993348 - DNA, 22 bp, Artificial Sequence
  chemically synthesized
tcttatcaacaggttgtattgg

SEQ ID NO: 993349 - DNA, 22 bp, Artificial Sequence
  chemically synthesized
atcaacaggttgtattggtgat

SEQ ID NO: 993350 - DNA, 22 bp, Artificial Sequence
  chemically synthesized
agctccctaaacatcaccaata

SEQ ID NO: 993351 - DNA, 22 bp, Artificial Sequence
  chemically synthesized
tcaacaggttgtattggtgatg

SEQ ID NO: 993352 - DNA, 22 bp, Artificial Sequence
  chemically synthesized
cagctccctaaacatcaccaat

SEQ ID NO: 993353 - DNA, 22 bp, Artificial Sequence
  chemically synthesized
tattggtgatgtttagggagct

SEQ ID NO: 993354 - DNA, 22 bp, Artificial Sequence
  chemically synthesized
catatgggaaatttcagctccc

SEQ ID NO: 993355 - DNA, 22 bp, Artificial Sequence
  chemically synthesized
ccatatgggaaatttcagctcc

SEQ ID NO: 993356 - DNA, 22 bp, Artificial Sequence
  chemically synthesized
gtgatgtttagggagctgaaat

SEQ ID NO: 993357 - DNA, 22 bp, Artificial Sequence
  chemically synthesized
ttccatatgggaaatttcagct

SEQ ID NO: 993358 - DNA, 22 bp, Artificial Sequence
  chemically synthesized
cttccatatgggaaatttcagc

SEQ ID NO: 993359 - DNA, 22 bp, Artificial Sequence
  chemically synthesized
tttcttccatatgggaaatttc

SEQ ID NO: 993360 - DNA, 22 bp, Artificial Sequence
  chemically synthesized
agggagctgaaatttcccatat

SEQ ID NO: 993361 - DNA, 22 bp, Artificial Sequence
  chemically synthesized
gggagctgaaatttcccatatg

SEQ ID NO: 993362 - DNA, 22 bp, Artificial Sequence
  chemically synthesized
ccatgtctatttcttccatatg

SEQ ID NO: 993363 - DNA, 22 bp, Artificial Sequence
  chemically synthesized
aaatttcccatatggaagaaat

SEQ ID NO: 993364 - DNA, 22 bp, Artificial Sequence
  chemically synthesized
attcccatgtctatttcttcca

SEQ ID NO: 993365 - DNA, 22 bp, Artificial Sequence
  chemically synthesized
gattcccatgtctatttcttcc

SEQ ID NO: 993366 - DNA, 22 bp, Artificial Sequence
  chemically synthesized
cccatatggaagaaatagacat

SEQ ID NO: 993367 - DNA, 22 bp, Artificial Sequence
  chemically synthesized
ccatatggaagaaatagacatg

SEQ ID NO: 993368 - DNA, 22 bp, Artificial Sequence
  chemically synthesized
taacatacgtttgattcccatg

SEQ ID NO: 993369 - DNA, 22 bp, Artificial Sequence
  chemically synthesized
gtaacatacgtttgattcccat

SEQ ID NO: 993370 - DNA, 22 bp, Artificial Sequence
  chemically synthesized
cttgtaacatacgtttgattcc

SEQ ID NO: 993371 - DNA, 22 bp, Artificial Sequence
  chemically synthesized
tctccttgtaacatacgtttga

SEQ ID NO: 993372 - DNA, 22 bp, Artificial Sequence
  chemically synthesized
atctccttgtaacatacgtttg

SEQ ID NO: 993373 - DNA, 22 bp, Artificial Sequence
  chemically synthesized
cttatctccttgtaacatacgt

SEQ ID NO: 993374 - DNA, 22 bp, Artificial Sequence
  chemically synthesized
gcaccactgcttatctccttgt

SEQ ID NO: 993375 - DNA, 22 bp, Artificial Sequence
  chemically synthesized
ggcaccactgcttatctccttg

SEQ ID NO: 993376 - DNA, 22 bp, Artificial Sequence
  chemically synthesized
atccaccccttggcaccactgc

SEQ ID NO: 993377 - DNA, 22 bp, Artificial Sequence
  chemically synthesized
caaggagataagcagtggtgcc

SEQ ID NO: 993378 - DNA, 22 bp, Artificial Sequence
  chemically synthesized
aatccaccccttggcaccactg

SEQ ID NO: 993379 - DNA, 22 bp, Artificial Sequence
  chemically synthesized
taatccaccccttggcaccact

SEQ ID NO: 993380 - DNA, 22 bp, Artificial Sequence
  chemically synthesized
ttaatccaccccttggcaccac

SEQ ID NO: 993381 - DNA, 22 bp, Artificial Sequence
  chemically synthesized
gagtcttttaatccaccccttg

SEQ ID NO: 993382 - DNA, 22 bp, Artificial Sequence
  chemically synthesized
tgacaaaaaaggagctagagtc

SEQ ID NO: 993383 - DNA, 22 bp, Artificial Sequence
  chemically synthesized
ttatgacaaaaaaggagctaga

SEQ ID NO: 993384 - DNA, 22 bp, Artificial Sequence
  chemically synthesized
gttatgacaaaaaaggagctag

SEQ ID NO: 993385 - DNA, 22 bp, Artificial Sequence
  chemically synthesized
tttgttatgacaaaaaaggagc

SEQ ID NO: 993386 - DNA, 22 bp, Artificial Sequence
  chemically synthesized
atttgttatgacaaaaaaggag

SEQ ID NO: 993387 - DNA, 22 bp, Artificial Sequence
  chemically synthesized
aaagactctagctccttttttg

SEQ ID NO: 993388 - DNA, 22 bp, Artificial Sequence
  chemically synthesized
gatgtttatttgttatgacaaa

SEQ ID NO: 993389 - DNA, 22 bp, Artificial Sequence
  chemically synthesized
tagctccttttttgtcataaca

SEQ ID NO: 993390 - DNA, 22 bp, Artificial Sequence
  chemically synthesized
gctccttttttgtcataacaaa

SEQ ID NO: 993391 - DNA, 22 bp, Artificial Sequence
  chemically synthesized
aattggatgtttatttgttatg

SEQ ID NO: 993392 - DNA, 22 bp, Artificial Sequence
  chemically synthesized
cttttttgtcataacaaataaa

SEQ ID NO: 993393 - DNA, 22 bp, Artificial Sequence
  chemically synthesized
ttttgtcataacaaataaacat

SEQ ID NO: 993394 - DNA, 22 bp, Artificial Sequence
  chemically synthesized
taattaaattggatgtttattt

SEQ ID NO: 993395 - DNA, 22 bp, Artificial Sequence
  chemically synthesized
tttgtcataacaaataaacatc

SEQ ID NO: 993396 - DNA, 22 bp, Artificial Sequence
  chemically synthesized
ttgtcataacaaataaacatcc

SEQ ID NO: 993397 - DNA, 22 bp, Artificial Sequence
  chemically synthesized
tgtcataacaaataaacatcca

SEQ ID NO: 993398 - DNA, 22 bp, Artificial Sequence
  chemically synthesized
gtcataacaaataaacatccaa

SEQ ID NO: 993399 - DNA, 22 bp, Artificial Sequence
  chemically synthesized
attataattaaattggatgttt

SEQ ID NO: 993400 - DNA, 22 bp, Artificial Sequence
  chemically synthesized
tcataacaaataaacatccaat

SEQ ID NO: 993401 - DNA, 22 bp, Artificial Sequence
  chemically synthesized
cagagaaaaaatgtactgatta

SEQ ID NO: 993402 - DNA, 22 bp, Artificial Sequence
  chemically synthesized
gcagagaaaaaatgtactgatt

SEQ ID NO: 993403 - DNA, 22 bp, Artificial Sequence
  chemically synthesized
agtttgcagagaaaaaatgtac

SEQ ID NO: 993404 - DNA, 22 bp, Artificial Sequence
  chemically synthesized
aattataatcagtacatttttt

SEQ ID NO: 993405 - DNA, 22 bp, Artificial Sequence
  chemically synthesized
attataatcagtacattttttc

SEQ ID NO: 993406 - DNA, 22 bp, Artificial Sequence
  chemically synthesized
aactaagtttgcagagaaaaaa

SEQ ID NO: 993407 - DNA, 22 bp, Artificial Sequence
  chemically synthesized
taatcagtacattttttctctg

SEQ ID NO: 993408 - DNA, 22 bp, Artificial Sequence
  chemically synthesized
ttaaactaagtttgcagagaaa

SEQ ID NO: 993409 - DNA, 22 bp, Artificial Sequence
  chemically synthesized
ttgttaaactaagtttgcagag

SEQ ID NO: 993410 - DNA, 22 bp, Artificial Sequence
  chemically synthesized
gttgttaaactaagtttgcaga

SEQ ID NO: 993411 - DNA, 22 bp, Artificial Sequence
  chemically synthesized
tttctctgcaaacttagtttaa

SEQ ID NO: 993412 - DNA, 22 bp, Artificial Sequence
  chemically synthesized
ttctctgcaaacttagtttaac

SEQ ID NO: 993413 - DNA, 22 bp, Artificial Sequence
  chemically synthesized
tctctgcaaacttagtttaaca

SEQ ID NO: 993414 - DNA, 22 bp, Artificial Sequence
  chemically synthesized
ctctgcaaacttagtttaacaa

SEQ ID NO: 993415 - DNA, 22 bp, Artificial Sequence
  chemically synthesized
tctgcaaacttagtttaacaac

SEQ ID NO: 993416 - DNA, 22 bp, Artificial Sequence
  chemically synthesized
tgcaaacttagtttaacaacaa

SEQ ID NO: 993417 - DNA, 22 bp, Artificial Sequence
  chemically synthesized
caaacttagtttaacaacaagt

SEQ ID NO: 993418 - DNA, 22 bp, Artificial Sequence
  chemically synthesized
agtttaacaacaagtcccctat

SEQ ID NO: 993419 - DNA, 22 bp, Artificial Sequence
  chemically synthesized
gtttaacaacaagtcccctatt

SEQ ID NO: 993420 - DNA, 22 bp, Artificial Sequence
  chemically synthesized
aacaacaagtcccctattctcc

SEQ ID NO: 993421 - DNA, 22 bp, Artificial Sequence
  chemically synthesized
acaacaagtcccctattctcct

SEQ ID NO: 993422 - DNA, 22 bp, Artificial Sequence
  chemically synthesized
ggtgagtaaataagaggagaat

SEQ ID NO: 993423 - DNA, 22 bp, Artificial Sequence
  chemically synthesized
ttctcctcttatttactcaccc

SEQ ID NO: 993424 - DNA, 22 bp, Artificial Sequence
  chemically synthesized
tcctcttatttactcacccagg

SEQ ID NO: 993425 - DNA, 22 bp, Artificial Sequence
  chemically synthesized
ctcttatttactcacccaggca

SEQ ID NO: 993426 - DNA, 22 bp, Artificial Sequence
  chemically synthesized
ttatttactcacccaggcattt

SEQ ID NO: 993427 - DNA, 22 bp, Artificial Sequence
  chemically synthesized
atttactcacccaggcatttgg

SEQ ID NO: 993428 - DNA, 22 bp, Artificial Sequence
  chemically synthesized
tttactcacccaggcatttgga

SEQ ID NO: 993429 - DNA, 22 bp, Artificial Sequence
  chemically synthesized
actcacccaggcatttggatgt

SEQ ID NO: 993430 - DNA, 22 bp, Artificial Sequence
  chemically synthesized
ctcacccaggcatttggatgtt

SEQ ID NO: 993431 - DNA, 22 bp, Artificial Sequence
  chemically synthesized
acccaggcatttggatgttatc

SEQ ID NO: 993432 - DNA, 22 bp, Artificial Sequence
  chemically synthesized
tcacaatcaatgatggcaccag

SEQ ID NO: 993433 - DNA, 22 bp, Artificial Sequence
  chemically synthesized
ggatgttatcactggtgccatc

SEQ ID NO: 993434 - DNA, 22 bp, Artificial Sequence
  chemically synthesized
atcacaatcaatgatggcacca

SEQ ID NO: 993435 - DNA, 22 bp, Artificial Sequence
  chemically synthesized
gatgttatcactggtgccatca

SEQ ID NO: 993436 - DNA, 22 bp, Artificial Sequence
  chemically synthesized
tatcacaatcaatgatggcacc

SEQ ID NO: 993437 - DNA, 22 bp, Artificial Sequence
  chemically synthesized
tcactggtgccatcattgattg

SEQ ID NO: 993438 - DNA, 22 bp, Artificial Sequence
  chemically synthesized
tcaaatattttatcacaatcaa

SEQ ID NO: 993439 - DNA, 22 bp, Artificial Sequence
  chemically synthesized
atcaaatattttatcacaatca

SEQ ID NO: 993440 - DNA, 22 bp, Artificial Sequence
  chemically synthesized
gtgccatcattgattgtgataa

SEQ ID NO: 993441 - DNA, 22 bp, Artificial Sequence
  chemically synthesized
attgtgataaaatatttgataa

SEQ ID NO: 993442 - DNA, 22 bp, Artificial Sequence
  chemically synthesized
aggacataaaacttatcaaata

SEQ ID NO: 993443 - DNA, 22 bp, Artificial Sequence
  chemically synthesized
tgataaaatatttgataagttt

SEQ ID NO: 993444 - DNA, 22 bp, Artificial Sequence
  chemically synthesized
atgaagcattgaggacataaaa

SEQ ID NO: 993445 - DNA, 22 bp, Artificial Sequence
  chemically synthesized
ttaatgaagcattgaggacata

SEQ ID NO: 993446 - DNA, 22 bp, Artificial Sequence
  chemically synthesized
gataagttttatgtcctcaatg

SEQ ID NO: 993447 - DNA, 22 bp, Artificial Sequence
  chemically synthesized
ataagttttatgtcctcaatgc

SEQ ID NO: 993448 - DNA, 22 bp, Artificial Sequence
  chemically synthesized
tactgttaatgaagcattgagg

SEQ ID NO: 993449 - DNA, 22 bp, Artificial Sequence
  chemically synthesized
tatgtcctcaatgcttcattaa

SEQ ID NO: 993450 - DNA, 22 bp, Artificial Sequence
  chemically synthesized
atgtcctcaatgcttcattaac

SEQ ID NO: 993451 - DNA, 22 bp, Artificial Sequence
  chemically synthesized
atgtattatactgttaatgaag

SEQ ID NO: 993452 - DNA, 22 bp, Artificial Sequence
  chemically synthesized
tgtcctcaatgcttcattaaca

SEQ ID NO: 993453 - DNA, 22 bp, Artificial Sequence
  chemically synthesized
tcatgtattatactgttaatga

SEQ ID NO: 993454 - DNA, 22 bp, Artificial Sequence
  chemically synthesized
aatgcttcattaacagtataat

SEQ ID NO: 993455 - DNA, 22 bp, Artificial Sequence
  chemically synthesized
atgtcactctcatgtattatac

SEQ ID NO: 993456 - DNA, 22 bp, Artificial Sequence
  chemically synthesized
cattaacagtataatacatgag

SEQ ID NO: 993457 - DNA, 22 bp, Artificial Sequence
  chemically synthesized
gttaatgtcactctcatgtatt

SEQ ID NO: 993458 - DNA, 22 bp, Artificial Sequence
  chemically synthesized
attaacagtataatacatgaga

SEQ ID NO: 993459 - DNA, 22 bp, Artificial Sequence
  chemically synthesized
ggttaatgtcactctcatgtat

SEQ ID NO: 993460 - DNA, 22 bp, Artificial Sequence
  chemically synthesized
acagtataatacatgagagtga

SEQ ID NO: 993461 - DNA, 22 bp, Artificial Sequence
  chemically synthesized
atcttggttaatgtcactctca

SEQ ID NO: 993462 - DNA, 22 bp, Artificial Sequence
  chemically synthesized
aatcttggttaatgtcactctc

SEQ ID NO: 993463 - DNA, 22 bp, Artificial Sequence
  chemically synthesized
ccttaatcttggttaatgtcac

SEQ ID NO: 993464 - DNA, 22 bp, Artificial Sequence
  chemically synthesized
tcccttaatcttggttaatgtc

SEQ ID NO: 993465 - DNA, 22 bp, Artificial Sequence
  chemically synthesized
ctcccttaatcttggttaatgt

SEQ ID NO: 993466 - DNA, 22 bp, Artificial Sequence
  chemically synthesized
cccttctcccttaatcttggtt

SEQ ID NO: 993467 - DNA, 22 bp, Artificial Sequence
  chemically synthesized
ccccttctcccttaatcttggt

SEQ ID NO: 993468 - DNA, 22 bp, Artificial Sequence
  chemically synthesized
accaagattaagggagaagggg

SEQ ID NO: 993469 - DNA, 22 bp, Artificial Sequence
  chemically synthesized
agggagaaggggaaatcttttg

SEQ ID NO: 993470 - DNA, 22 bp, Artificial Sequence
  chemically synthesized
acatcacaaccaccaaaagatt

SEQ ID NO: 993471 - DNA, 22 bp, Artificial Sequence
  chemically synthesized
gacatcacaaccaccaaaagat

SEQ ID NO: 993472 - DNA, 22 bp, Artificial Sequence
  chemically synthesized
ggtttgacatcacaaccaccaa

SEQ ID NO: 993473 - DNA, 22 bp, Artificial Sequence
  chemically synthesized
aggtttgacatcacaaccacca

SEQ ID NO: 993474 - DNA, 22 bp, Artificial Sequence
  chemically synthesized
taggtttgacatcacaaccacc

SEQ ID NO: 993475 - DNA, 22 bp, Artificial Sequence
  chemically synthesized
ttggtggttgtgatgtcaaacc

SEQ ID NO: 993476 - DNA, 22 bp, Artificial Sequence
  chemically synthesized
catgtagttttaggtttgacat

SEQ ID NO: 993477 - DNA, 22 bp, Artificial Sequence
  chemically synthesized
tggtggttgtgatgtcaaacct

SEQ ID NO: 993478 - DNA, 22 bp, Artificial Sequence
  chemically synthesized
ggtggttgtgatgtcaaaccta

SEQ ID NO: 993479 - DNA, 22 bp, Artificial Sequence
  chemically synthesized
gtggttgtgatgtcaaacctaa

SEQ ID NO: 993480 - DNA, 22 bp, Artificial Sequence
  chemically synthesized
ggcctccatgtagttttaggtt

SEQ ID NO: 993481 - DNA, 22 bp, Artificial Sequence
  chemically synthesized
tgggcctccatgtagttttagg

SEQ ID NO: 993482 - DNA, 22 bp, Artificial Sequence
  chemically synthesized
tgatgtcaaacctaaaactaca

SEQ ID NO: 993483 - DNA, 22 bp, Artificial Sequence
  chemically synthesized
attctgggcctccatgtagttt

SEQ ID NO: 993484 - DNA, 22 bp, Artificial Sequence
  chemically synthesized
cctaattctgggcctccatgta

SEQ ID NO: 993485 - DNA, 22 bp, Artificial Sequence
  chemically synthesized
ccctaattctgggcctccatgt

SEQ ID NO: 993486 - DNA, 22 bp, Artificial Sequence
  chemically synthesized
tccctaattctgggcctccatg

SEQ ID NO: 993487 - DNA, 22 bp, Artificial Sequence
  chemically synthesized
aattttccctaattctgggcct

SEQ ID NO: 993488 - DNA, 22 bp, Artificial Sequence
  chemically synthesized
aaactacatggaggcccagaat

SEQ ID NO: 993489 - DNA, 22 bp, Artificial Sequence
  chemically synthesized
catggaggcccagaattaggga

SEQ ID NO: 993490 - DNA, 22 bp, Artificial Sequence
  chemically synthesized
gatgctgaattttccctaattc

SEQ ID NO: 993491 - DNA, 22 bp, Artificial Sequence
  chemically synthesized
tctggatgctgaattttcccta

SEQ ID NO: 993492 - DNA, 22 bp, Artificial Sequence
  chemically synthesized
tctgtctggatgctgaattttc

SEQ ID NO: 993493 - DNA, 22 bp, Artificial Sequence
  chemically synthesized
cattgtctgtctggatgctgaa

SEQ ID NO: 993494 - DNA, 22 bp, Artificial Sequence
  chemically synthesized
acattgtctgtctggatgctga

SEQ ID NO: 993495 - DNA, 22 bp, Artificial Sequence
  chemically synthesized
gggaaaattcagcatccagaca

SEQ ID NO: 993496 - DNA, 22 bp, Artificial Sequence
  chemically synthesized
agcatccagacagacaatgtaa

SEQ ID NO: 993497 - DNA, 22 bp, Artificial Sequence
  chemically synthesized
aaaataccgtgatcttacattg

SEQ ID NO: 993498 - DNA, 22 bp, Artificial Sequence
  chemically synthesized
cctgaaaataccgtgatcttac

SEQ ID NO: 993499 - DNA, 22 bp, Artificial Sequence
  chemically synthesized
ccctgaaaataccgtgatctta

SEQ ID NO: 993500 - DNA, 22 bp, Artificial Sequence
  chemically synthesized
tccctgaaaataccgtgatctt

SEQ ID NO: 993501 - DNA, 22 bp, Artificial Sequence
  chemically synthesized
ttccctgaaaataccgtgatct

SEQ ID NO: 993502 - DNA, 22 bp, Artificial Sequence
  chemically synthesized
atgtttttccctgaaaataccg

SEQ ID NO: 993503 - DNA, 22 bp, Artificial Sequence
  chemically synthesized
cggttcatgtttttccctgaaa

SEQ ID NO: 993504 - DNA, 22 bp, Artificial Sequence
  chemically synthesized
ctccggttcatgtttttccctg

SEQ ID NO: 993505 - DNA, 22 bp, Artificial Sequence
  chemically synthesized
gctccggttcatgtttttccct

SEQ ID NO: 993506 - DNA, 22 bp, Artificial Sequence
  chemically synthesized
tgctccggttcatgtttttccc

SEQ ID NO: 993507 - DNA, 22 bp, Artificial Sequence
  chemically synthesized
ttgctccggttcatgtttttcc

SEQ ID NO: 993508 - DNA, 22 bp, Artificial Sequence
  chemically synthesized
agcttttgctccggttcatgtt

SEQ ID NO: 993509 - DNA, 22 bp, Artificial Sequence
  chemically synthesized
gagcttttgctccggttcatgt

SEQ ID NO: 993510 - DNA, 22 bp, Artificial Sequence
  chemically synthesized
tgagcttttgctccggttcatg

SEQ ID NO: 993511 - DNA, 22 bp, Artificial Sequence
  chemically synthesized
tcagggaaaaacatgaaccgga

SEQ ID NO: 993512 - DNA, 22 bp, Artificial Sequence
  chemically synthesized
cagggaaaaacatgaaccggag

SEQ ID NO: 993513 - DNA, 22 bp, Artificial Sequence
  chemically synthesized
agggaaaaacatgaaccggagc

SEQ ID NO: 993514 - DNA, 22 bp, Artificial Sequence
  chemically synthesized
cccattttgagcttttgctccg

SEQ ID NO: 993515 - DNA, 22 bp, Artificial Sequence
  chemically synthesized
ccccattttgagcttttgctcc

SEQ ID NO: 993516 - DNA, 22 bp, Artificial Sequence
  chemically synthesized
tccccattttgagcttttgctc

SEQ ID NO: 993517 - DNA, 22 bp, Artificial Sequence
  chemically synthesized
tttccccattttgagcttttgc

SEQ ID NO: 993518 - DNA, 22 bp, Artificial Sequence
  chemically synthesized
gctctttccccattttgagctt

SEQ ID NO: 993519 - DNA, 22 bp, Artificial Sequence
  chemically synthesized
tcgctctttccccattttgagc

SEQ ID NO: 993520 - DNA, 22 bp, Artificial Sequence
  chemically synthesized
tctcgctctttccccattttga

SEQ ID NO: 993521 - DNA, 22 bp, Artificial Sequence
  chemically synthesized
tctctcgctctttccccatttt

SEQ ID NO: 993522 - DNA, 22 bp, Artificial Sequence
  chemically synthesized
ctctctcgctctttccccattt

SEQ ID NO: 993523 - DNA, 22 bp, Artificial Sequence
  chemically synthesized
gtttctctctcgctctttcccc

SEQ ID NO: 993524 - DNA, 22 bp, Artificial Sequence
  chemically synthesized
agtttctctctcgctctttccc

SEQ ID NO: 993525 - DNA, 22 bp, Artificial Sequence
  chemically synthesized
aaaatggggaaagagcgagaga

SEQ ID NO: 993526 - DNA, 22 bp, Artificial Sequence
  chemically synthesized
gacccttagtttctctctcgct

SEQ ID NO: 993527 - DNA, 22 bp, Artificial Sequence
  chemically synthesized
agacccttagtttctctctcgc

SEQ ID NO: 993528 - DNA, 22 bp, Artificial Sequence
  chemically synthesized
tttagacccttagtttctctct

SEQ ID NO: 993529 - DNA, 22 bp, Artificial Sequence
  chemically synthesized
acataaaagactgtttagaccc

SEQ ID NO: 993530 - DNA, 22 bp, Artificial Sequence
  chemically synthesized
gacataaaagactgtttagacc

SEQ ID NO: 993531 - DNA, 22 bp, Artificial Sequence
  chemically synthesized
acttgacataaaagactgttta

SEQ ID NO: 993532 - DNA, 22 bp, Artificial Sequence
  chemically synthesized
aacttgacataaaagactgttt

SEQ ID NO: 993533 - DNA, 22 bp, Artificial Sequence
  chemically synthesized
agggtctaaacagtcttttatg

SEQ ID NO: 993534 - DNA, 22 bp, Artificial Sequence
  chemically synthesized
aacagtcttttatgtcaagtta

SEQ ID NO: 993535 - DNA, 22 bp, Artificial Sequence
  chemically synthesized
ttatgtcaagttaagtggctta

SEQ ID NO: 993536 - DNA, 22 bp, Artificial Sequence
  chemically synthesized
tatgtcaagttaagtggcttat

SEQ ID NO: 993537 - DNA, 22 bp, Artificial Sequence
  chemically synthesized
ggtagcaaagacataagccact

SEQ ID NO: 993538 - DNA, 22 bp, Artificial Sequence
  chemically synthesized
atgtcaagttaagtggcttatg

SEQ ID NO: 993539 - DNA, 22 bp, Artificial Sequence
  chemically synthesized
gggtagcaaagacataagccac

SEQ ID NO: 993540 - DNA, 22 bp, Artificial Sequence
  chemically synthesized
tgtcaagttaagtggcttatgt

SEQ ID NO: 993541 - DNA, 22 bp, Artificial Sequence
  chemically synthesized
tgggtagcaaagacataagcca

SEQ ID NO: 993542 - DNA, 22 bp, Artificial Sequence
  chemically synthesized
agtggcttatgtctttgctacc

SEQ ID NO: 993543 - DNA, 22 bp, Artificial Sequence
  chemically synthesized
cagaccatactttgggtagcaa

SEQ ID NO: 993544 - DNA, 22 bp, Artificial Sequence
  chemically synthesized
gcctgcagaccatactttgggt

SEQ ID NO: 993545 - DNA, 22 bp, Artificial Sequence
  chemically synthesized
atgtctttgctacccaaagtat

SEQ ID NO: 993546 - DNA, 22 bp, Artificial Sequence
  chemically synthesized
ggcctgcagaccatactttggg

SEQ ID NO: 993547 - DNA, 22 bp, Artificial Sequence
  chemically synthesized
tgtctttgctacccaaagtatg

SEQ ID NO: 993548 - DNA, 22 bp, Artificial Sequence
  chemically synthesized
tggcctgcagaccatactttgg

SEQ ID NO: 993549 - DNA, 22 bp, Artificial Sequence
  chemically synthesized
tgctacccaaagtatggtctgc

SEQ ID NO: 993550 - DNA, 22 bp, Artificial Sequence
  chemically synthesized
gctacccaaagtatggtctgca

SEQ ID NO: 993551 - DNA, 22 bp, Artificial Sequence
  chemically synthesized
ctacccaaagtatggtctgcag

SEQ ID NO: 993552 - DNA, 22 bp, Artificial Sequence
  chemically synthesized
cccaaagtatggtctgcaggcc

SEQ ID NO: 993553 - DNA, 22 bp, Artificial Sequence
  chemically synthesized
tagcaatgattttggcctgcag

SEQ ID NO: 993554 - DNA, 22 bp, Artificial Sequence
  chemically synthesized
agggttatagcaatgattttgg

SEQ ID NO: 993555 - DNA, 22 bp, Artificial Sequence
  chemically synthesized
caggccaaaatcattgctataa

SEQ ID NO: 993556 - DNA, 22 bp, Artificial Sequence
  chemically synthesized
gcaagtgctcagggttatagca

SEQ ID NO: 993557 - DNA, 22 bp, Artificial Sequence
  chemically synthesized
tagcaagtgctcagggttatag

SEQ ID NO: 993558 - DNA, 22 bp, Artificial Sequence
  chemically synthesized
ctagcaagtgctcagggttata

SEQ ID NO: 993559 - DNA, 22 bp, Artificial Sequence
  chemically synthesized
catttctagcaagtgctcaggg

SEQ ID NO: 993560 - DNA, 22 bp, Artificial Sequence
  chemically synthesized
tgcatttctagcaagtgctcag

SEQ ID NO: 993561 - DNA, 22 bp, Artificial Sequence
  chemically synthesized
ctataaccctgagcacttgcta

SEQ ID NO: 993562 - DNA, 22 bp, Artificial Sequence
  chemically synthesized
agattctgcatttctagcaagt

SEQ ID NO: 993563 - DNA, 22 bp, Artificial Sequence
  chemically synthesized
taaccctgagcacttgctagaa

SEQ ID NO: 993564 - DNA, 22 bp, Artificial Sequence
  chemically synthesized
tctgagattctgcatttctagc

SEQ ID NO: 993565 - DNA, 22 bp, Artificial Sequence
  chemically synthesized
agcacttgctagaaatgcagaa

SEQ ID NO: 993566 - DNA, 22 bp, Artificial Sequence
  chemically synthesized
gggtattgtctgagattctgca

SEQ ID NO: 993567 - DNA, 22 bp, Artificial Sequence
  chemically synthesized
gctagaaatgcagaatctcaga

SEQ ID NO: 993568 - DNA, 22 bp, Artificial Sequence
  chemically synthesized
ctagaaatgcagaatctcagac

SEQ ID NO: 993569 - DNA, 22 bp, Artificial Sequence
  chemically synthesized
gaaatgcagaatctcagacaat

SEQ ID NO: 993570 - DNA, 22 bp, Artificial Sequence
  chemically synthesized
agtaggtctggggtattgtctg

SEQ ID NO: 993571 - DNA, 22 bp, Artificial Sequence
  chemically synthesized
attcagtaggtctggggtattg

SEQ ID NO: 993572 - DNA, 22 bp, Artificial Sequence
  chemically synthesized
atgctgattcagtaggtctggg

SEQ ID NO: 993573 - DNA, 22 bp, Artificial Sequence
  chemically synthesized
agacaataccccagacctactg

SEQ ID NO: 993574 - DNA, 22 bp, Artificial Sequence
  chemically synthesized
actgatgctgattcagtaggtc

SEQ ID NO: 993575 - DNA, 22 bp, Artificial Sequence
  chemically synthesized
attaactgatgctgattcagta

SEQ ID NO: 993576 - DNA, 22 bp, Artificial Sequence
  chemically synthesized
aattaactgatgctgattcagt

SEQ ID NO: 993577 - DNA, 22 bp, Artificial Sequence
  chemically synthesized
ttaattaactgatgctgattca

SEQ ID NO: 993578 - DNA, 22 bp, Artificial Sequence
  chemically synthesized
cttaattaactgatgctgattc

SEQ ID NO: 993579 - DNA, 22 bp, Artificial Sequence
  chemically synthesized
tcttaattaactgatgctgatt

SEQ ID NO: 993580 - DNA, 22 bp, Artificial Sequence
  chemically synthesized
gggattttcttaattaactgat

SEQ ID NO: 993581 - DNA, 22 bp, Artificial Sequence
  chemically synthesized
ctgaatcagcatcagttaatta

SEQ ID NO: 993582 - DNA, 22 bp, Artificial Sequence
  chemically synthesized
aatcagcatcagttaattaaga

SEQ ID NO: 993583 - DNA, 22 bp, Artificial Sequence
  chemically synthesized
attaagaaaatccccaggtgat

SEQ ID NO: 993584 - DNA, 22 bp, Artificial Sequence
  chemically synthesized
atgtgcatcagaatcacctggg

SEQ ID NO: 993585 - DNA, 22 bp, Artificial Sequence
  chemically synthesized
gatgtgcatcagaatcacctgg

SEQ ID NO: 993586 - DNA, 22 bp, Artificial Sequence
  chemically synthesized
tgatgtgcatcagaatcacctg

SEQ ID NO: 993587 - DNA, 22 bp, Artificial Sequence
  chemically synthesized
agaaaatccccaggtgattctg

SEQ ID NO: 993588 - DNA, 22 bp, Artificial Sequence
  chemically synthesized
aaactttgatgtgcatcagaat

SEQ ID NO: 993589 - DNA, 22 bp, Artificial Sequence
  chemically synthesized
tcaaactttgatgtgcatcaga

SEQ ID NO: 993590 - DNA, 22 bp, Artificial Sequence
  chemically synthesized
ctcaaactttgatgtgcatcag

SEQ ID NO: 993591 - DNA, 22 bp, Artificial Sequence
  chemically synthesized
aatagtgcttctcaaactttga

SEQ ID NO: 993592 - DNA, 22 bp, Artificial Sequence
  chemically synthesized
gaatagtgcttctcaaactttg

SEQ ID NO: 993593 - DNA, 22 bp, Artificial Sequence
  chemically synthesized
tgaatagtgcttctcaaacttt

SEQ ID NO: 993594 - DNA, 22 bp, Artificial Sequence
  chemically synthesized
tgatgcacatcaaagtttgaga

SEQ ID NO: 993595 - DNA, 22 bp, Artificial Sequence
  chemically synthesized
atgcacatcaaagtttgagaag

SEQ ID NO: 993596 - DNA, 22 bp, Artificial Sequence
  chemically synthesized
ttttgaatagtgcttctcaaac

SEQ ID NO: 993597 - DNA, 22 bp, Artificial Sequence
  chemically synthesized
cagcatattattttgaatagtg

SEQ ID NO: 993598 - DNA, 22 bp, Artificial Sequence
  chemically synthesized
gagaagcactattcaaaataat

SEQ ID NO: 993599 - DNA, 22 bp, Artificial Sequence
  chemically synthesized
agaagcactattcaaaataata

SEQ ID NO: 993600 - DNA, 22 bp, Artificial Sequence
  chemically synthesized
ccgtagcctccagcatattatt

SEQ ID NO: 993601 - DNA, 22 bp, Artificial Sequence
  chemically synthesized
cccgtagcctccagcatattat

SEQ ID NO: 993602 - DNA, 22 bp, Artificial Sequence
  chemically synthesized
ttcaaaataatatgctggaggc

SEQ ID NO: 993603 - DNA, 22 bp, Artificial Sequence
  chemically synthesized
agtagcttcccgtagcctccag

SEQ ID NO: 993604 - DNA, 22 bp, Artificial Sequence
  chemically synthesized
aaaataatatgctggaggctac

SEQ ID NO: 993605 - DNA, 22 bp, Artificial Sequence
  chemically synthesized
cagtagcttcccgtagcctcca

SEQ ID NO: 993606 - DNA, 22 bp, Artificial Sequence
  chemically synthesized
aaatccttcagtagcttcccgt

SEQ ID NO: 993607 - DNA, 22 bp, Artificial Sequence
  chemically synthesized
aaaatccttcagtagcttcccg

SEQ ID NO: 993608 - DNA, 22 bp, Artificial Sequence
  chemically synthesized
ttaaaatccttcagtagcttcc

SEQ ID NO: 993609 - DNA, 22 bp, Artificial Sequence
  chemically synthesized
cttaaaatccttcagtagcttc

SEQ ID NO: 993610 - DNA, 22 bp, Artificial Sequence
  chemically synthesized
gaggctacgggaagctactgaa

SEQ ID NO: 993611 - DNA, 22 bp, Artificial Sequence
  chemically synthesized
ccttcttaaaatccttcagtag

SEQ ID NO: 993612 - DNA, 22 bp, Artificial Sequence
  chemically synthesized
cccttcttaaaatccttcagta

SEQ ID NO: 993613 - DNA, 22 bp, Artificial Sequence
  chemically synthesized
cgggaagctactgaaggatttt

SEQ ID NO: 993614 - DNA, 22 bp, Artificial Sequence
  chemically synthesized
tgtcacttcccttcttaaaatc

SEQ ID NO: 993615 - DNA, 22 bp, Artificial Sequence
  chemically synthesized
aattatgtcacttcccttctta

SEQ ID NO: 993616 - DNA, 22 bp, Artificial Sequence
  chemically synthesized
ctgaaggattttaagaagggaa

SEQ ID NO: 993617 - DNA, 22 bp, Artificial Sequence
  chemically synthesized
aaggattttaagaagggaagtg

SEQ ID NO: 993618 - DNA, 22 bp, Artificial Sequence
  chemically synthesized
taagaagggaagtgacataatt

SEQ ID NO: 993619 - DNA, 22 bp, Artificial Sequence
  chemically synthesized
aaatgcaaattcaattatgtca

SEQ ID NO: 993620 - DNA, 22 bp, Artificial Sequence
  chemically synthesized
aagaagggaagtgacataattg

SEQ ID NO: 993621 - DNA, 22 bp, Artificial Sequence
  chemically synthesized
agaagggaagtgacataattga

SEQ ID NO: 993622 - DNA, 22 bp, Artificial Sequence
  chemically synthesized
taaaatgcaaattcaattatgt

SEQ ID NO: 993623 - DNA, 22 bp, Artificial Sequence
  chemically synthesized
ctaaaatgcaaattcaattatg

SEQ ID NO: 993624 - DNA, 22 bp, Artificial Sequence
  chemically synthesized
tctaaaatgcaaattcaattat

SEQ ID NO: 993625 - DNA, 22 bp, Artificial Sequence
  chemically synthesized
ttctaaaatgcaaattcaatta

SEQ ID NO: 993626 - DNA, 22 bp, Artificial Sequence
  chemically synthesized
tttctaaaatgcaaattcaatt

SEQ ID NO: 993627 - DNA, 22 bp, Artificial Sequence
  chemically synthesized
ttttctaaaatgcaaattcaat

SEQ ID NO: 993628 - DNA, 22 bp, Artificial Sequence
  chemically synthesized
tttttctaaaatgcaaattcaa

SEQ ID NO: 993629 - DNA, 22 bp, Artificial Sequence
  chemically synthesized
aatttgcattttagaaaaaaaa

SEQ ID NO: 993630 - DNA, 22 bp, Artificial Sequence
  chemically synthesized
gcattttagaaaaaaaattact

SEQ ID NO: 993631 - DNA, 22 bp, Artificial Sequence
  chemically synthesized
cattttagaaaaaaaattactc

SEQ ID NO: 993632 - DNA, 22 bp, Artificial Sequence
  chemically synthesized
tagaaaaaaaattactctgtgt

SEQ ID NO: 993633 - DNA, 22 bp, Artificial Sequence
  chemically synthesized
agaaaaaaaattactctgtgtc

SEQ ID NO: 993634 - DNA, 22 bp, Artificial Sequence
  chemically synthesized
aaggaatgaatggacacagagt

SEQ ID NO: 993635 - DNA, 22 bp, Artificial Sequence
  chemically synthesized
gaaaaaaaattactctgtgtcc

SEQ ID NO: 993636 - DNA, 22 bp, Artificial Sequence
  chemically synthesized
ctctgtgtccattcattccttc

SEQ ID NO: 993637 - DNA, 22 bp, Artificial Sequence
  chemically synthesized
gcatatatatcctgaaggaatg

SEQ ID NO: 993638 - DNA, 22 bp, Artificial Sequence
  chemically synthesized
ggcatatatatcctgaaggaat

SEQ ID NO: 993639 - DNA, 22 bp, Artificial Sequence
  chemically synthesized
tgtgtccattcattccttcagg

SEQ ID NO: 993640 - DNA, 22 bp, Artificial Sequence
  chemically synthesized
tgtccattcattccttcaggat

SEQ ID NO: 993641 - DNA, 22 bp, Artificial Sequence
  chemically synthesized
attccttcaggatatatatgcc

SEQ ID NO: 993642 - DNA, 22 bp, Artificial Sequence
  chemically synthesized
aggtcaatgcttggcatatata

SEQ ID NO: 993643 - DNA, 22 bp, Artificial Sequence
  chemically synthesized
taaggtcaatgcttggcatata

SEQ ID NO: 993644 - DNA, 22 bp, Artificial Sequence
  chemically synthesized
cttcaggatatatatgccaagc

SEQ ID NO: 993645 - DNA, 22 bp, Artificial Sequence
  chemically synthesized
caggatatatatgccaagcatt

SEQ ID NO: 993646 - DNA, 22 bp, Artificial Sequence
  chemically synthesized
aggatatatatgccaagcattg

SEQ ID NO: 993647 - DNA, 22 bp, Artificial Sequence
  chemically synthesized
cagctctaaggtcaatgcttgg

SEQ ID NO: 993648 - DNA, 22 bp, Artificial Sequence
  chemically synthesized
ccagctctaaggtcaatgcttg

SEQ ID NO: 993649 - DNA, 22 bp, Artificial Sequence
  chemically synthesized
aatttccagctctaaggtcaat

SEQ ID NO: 993650 - DNA, 22 bp, Artificial Sequence
  chemically synthesized
aaaatagtgctgaatttccagc

SEQ ID NO: 993651 - DNA, 22 bp, Artificial Sequence
  chemically synthesized
accttagagctggaaattcagc

SEQ ID NO: 993652 - DNA, 22 bp, Artificial Sequence
  chemically synthesized
atccactcaaaatagtgctgaa

SEQ ID NO: 993653 - DNA, 22 bp, Artificial Sequence
  chemically synthesized
agagctggaaattcagcactat

SEQ ID NO: 993654 - DNA, 22 bp, Artificial Sequence
  chemically synthesized
gagctggaaattcagcactatt

SEQ ID NO: 993655 - DNA, 22 bp, Artificial Sequence
  chemically synthesized
agctaatccactcaaaatagtg

SEQ ID NO: 993656 - DNA, 22 bp, Artificial Sequence
  chemically synthesized
cagctaatccactcaaaatagt

SEQ ID NO: 993657 - DNA, 22 bp, Artificial Sequence
  chemically synthesized
gaaattcagcactattttgagt

SEQ ID NO: 993658 - DNA, 22 bp, Artificial Sequence
  chemically synthesized
agcactattttgagtggattag

SEQ ID NO: 993659 - DNA, 22 bp, Artificial Sequence
  chemically synthesized
aatagggagtttcagctaatcc

SEQ ID NO: 993660 - DNA, 22 bp, Artificial Sequence
  chemically synthesized
ttttgagtggattagctgaaac

SEQ ID NO: 993661 - DNA, 22 bp, Artificial Sequence
  chemically synthesized
tgagtggattagctgaaactcc

SEQ ID NO: 993662 - DNA, 22 bp, Artificial Sequence
  chemically synthesized
gagtggattagctgaaactccc

SEQ ID NO: 993663 - DNA, 22 bp, Artificial Sequence
  chemically synthesized
agtggattagctgaaactccct

SEQ ID NO: 993664 - DNA, 22 bp, Artificial Sequence
  chemically synthesized
aatgaatactgaatagggagtt

SEQ ID NO: 993665 - DNA, 22 bp, Artificial Sequence
  chemically synthesized
attgaatgaatactgaataggg

SEQ ID NO: 993666 - DNA, 22 bp, Artificial Sequence
  chemically synthesized
gctgaaactccctattcagtat

SEQ ID NO: 993667 - DNA, 22 bp, Artificial Sequence
  chemically synthesized
aaactccctattcagtattcat

SEQ ID NO: 993668 - DNA, 22 bp, Artificial Sequence
  chemically synthesized
cctattcagtattcattcaatg

SEQ ID NO: 993669 - DNA, 22 bp, Artificial Sequence
  chemically synthesized
ttcagtattcattcaatgaaca

SEQ ID NO: 993670 - DNA, 22 bp, Artificial Sequence
  chemically synthesized
gaatgcaataaatgttcattga

SEQ ID NO: 993671 - DNA, 22 bp, Artificial Sequence
  chemically synthesized
agtattcattcaatgaacattt

SEQ ID NO: 993672 - DNA, 22 bp, Artificial Sequence
  chemically synthesized
attcaatgaacatttattgcat

SEQ ID NO: 993673 - DNA, 22 bp, Artificial Sequence
  chemically synthesized
aatgaacatttattgcattcca

SEQ ID NO: 993674 - DNA, 22 bp, Artificial Sequence
  chemically synthesized
attgcattccaactttggtttt

SEQ ID NO: 993675 - DNA, 22 bp, Artificial Sequence
  chemically synthesized
ttgcattccaactttggttttt

SEQ ID NO: 993676 - DNA, 22 bp, Artificial Sequence
  chemically synthesized
cattccaactttggtttttttt

SEQ ID NO: 993677 - DNA, 22 bp, Artificial Sequence
  chemically synthesized
caactttggttttttttttttt

SEQ ID NO: 993678 - DNA, 22 bp, Artificial Sequence
  chemically synthesized
tggttttttttttttttgtttg

SEQ ID NO: 993679 - DNA, 22 bp, Artificial Sequence
  chemically synthesized
ggttttttttttttttgtttgc

SEQ ID NO: 993680 - DNA, 22 bp, Artificial Sequence
  chemically synthesized
gttttttttttttttgtttgcg

SEQ ID NO: 993681 - DNA, 22 bp, Artificial Sequence
  chemically synthesized
tttttttttttgtttgcgtgtt

SEQ ID NO: 993682 - DNA, 22 bp, Artificial Sequence
  chemically synthesized
ttttttttttgtttgcgtgttt

SEQ ID NO: 993683 - DNA, 22 bp, Artificial Sequence
  chemically synthesized
tttttttttgtttgcgtgtttg

SEQ ID NO: 993684 - DNA, 22 bp, Artificial Sequence
  chemically synthesized
ttttttttgtttgcgtgtttgt

SEQ ID NO: 993685 - DNA, 22 bp, Artificial Sequence
  chemically synthesized
tttttttgtttgcgtgtttgtt

SEQ ID NO: 993686 - DNA, 22 bp, Artificial Sequence
  chemically synthesized
aaaaaagcaaaaaacaaacacg

SEQ ID NO: 993687 - DNA, 22 bp, Artificial Sequence
  chemically synthesized
ttttttgtttgcgtgtttgttt

SEQ ID NO: 993688 - DNA, 22 bp, Artificial Sequence
  chemically synthesized
caaaaaagcaaaaaacaaacac

SEQ ID NO: 993689 - DNA, 22 bp, Artificial Sequence
  chemically synthesized
tttttgtttgcgtgtttgtttt

SEQ ID NO: 993690 - DNA, 22 bp, Artificial Sequence
  chemically synthesized
ttttgtttgcgtgtttgttttt

SEQ ID NO: 993691 - DNA, 22 bp, Artificial Sequence
  chemically synthesized
tttgtttgcgtgtttgtttttt

SEQ ID NO: 993692 - DNA, 22 bp, Artificial Sequence
  chemically synthesized
ttgtttgcgtgtttgttttttg

SEQ ID NO: 993693 - DNA, 22 bp, Artificial Sequence
  chemically synthesized
tcttcaaaaaagcaaaaaacaa

SEQ ID NO: 993694 - DNA, 22 bp, Artificial Sequence
  chemically synthesized
tgtttgcgtgtttgttttttgc

SEQ ID NO: 993695 - DNA, 22 bp, Artificial Sequence
  chemically synthesized
gtttgcgtgtttgttttttgct

SEQ ID NO: 993696 - DNA, 22 bp, Artificial Sequence
  chemically synthesized
tttgcgtgtttgttttttgctt

SEQ ID NO: 993697 - DNA, 22 bp, Artificial Sequence
  chemically synthesized
gcgtgtttgttttttgcttttt

SEQ ID NO: 993698 - DNA, 22 bp, Artificial Sequence
  chemically synthesized
cgtgtttgttttttgctttttt

SEQ ID NO: 993699 - DNA, 22 bp, Artificial Sequence
  chemically synthesized
gttttttgcttttttgaagaca

SEQ ID NO: 993700 - DNA, 22 bp, Artificial Sequence
  chemically synthesized
ttttttgcttttttgaagacag

SEQ ID NO: 993701 - DNA, 22 bp, Artificial Sequence
  chemically synthesized
tttgcttttttgaagacagggt

SEQ ID NO: 993702 - DNA, 22 bp, Artificial Sequence
  chemically synthesized
ttgcttttttgaagacagggtc

SEQ ID NO: 993703 - DNA, 22 bp, Artificial Sequence
  chemically synthesized
tgcttttttgaagacagggtct

SEQ ID NO: 993704 - DNA, 22 bp, Artificial Sequence
  chemically synthesized
gcttttttgaagacagggtctc

SEQ ID NO: 993705 - DNA, 22 bp, Artificial Sequence
  chemically synthesized
cttttttgaagacagggtctca

SEQ ID NO: 993706 - DNA, 22 bp, Artificial Sequence
  chemically synthesized
ttttgaagacagggtctcactc

SEQ ID NO: 993707 - DNA, 22 bp, Artificial Sequence
  chemically synthesized
tttgaagacagggtctcactct

SEQ ID NO: 993708 - DNA, 22 bp, Artificial Sequence
  chemically synthesized
ttgaagacagggtctcactctg

SEQ ID NO: 993709 - DNA, 22 bp, Artificial Sequence
  chemically synthesized
cagcccacatgacagagtgaga

SEQ ID NO: 993710 - DNA, 22 bp, Artificial Sequence
  chemically synthesized
tgaagacagggtctcactctgt

SEQ ID NO: 993711 - DNA, 22 bp, Artificial Sequence
  chemically synthesized
gaagacagggtctcactctgtc

SEQ ID NO: 993712 - DNA, 22 bp, Artificial Sequence
  chemically synthesized
aagacagggtctcactctgtca

SEQ ID NO: 993713 - DNA, 22 bp, Artificial Sequence
  chemically synthesized
cactccagcccacatgacagag

SEQ ID NO: 993714 - DNA, 22 bp, Artificial Sequence
  chemically synthesized
actctgtcatgtgggctggagt

SEQ ID NO: 993715 - DNA, 22 bp, Artificial Sequence
  chemically synthesized
tgtcatgtgggctggagtgcag

SEQ ID NO: 993716 - DNA, 22 bp, Artificial Sequence
  chemically synthesized
tcatgtgggctggagtgcagtg

SEQ ID NO: 993717 - DNA, 22 bp, Artificial Sequence
  chemically synthesized
cagtgagccgggatcatgccac

SEQ ID NO: 993718 - DNA, 22 bp, Artificial Sequence
  chemically synthesized
gagtgcagtggcatgatcccgg

SEQ ID NO: 993719 - DNA, 22 bp, Artificial Sequence
  chemically synthesized
gggaggcagaggttgcagtgag

SEQ ID NO: 993720 - DNA, 22 bp, Artificial Sequence
  chemically synthesized
aactcgggaggcagaggttgca

SEQ ID NO: 993721 - DNA, 22 bp, Artificial Sequence
  chemically synthesized
gaactcgggaggcagaggttgc

SEQ ID NO: 993722 - DNA, 22 bp, Artificial Sequence
  chemically synthesized
actgcaacctctgcctcccgag

SEQ ID NO: 993723 - DNA, 22 bp, Artificial Sequence
  chemically synthesized
caacctctgcctcccgagttca

SEQ ID NO: 993724 - DNA, 22 bp, Artificial Sequence
  chemically synthesized
aggcacgagaatcacttgaact

SEQ ID NO: 993725 - DNA, 22 bp, Artificial Sequence
  chemically synthesized
tgcctcccgagttcaagtgatt

SEQ ID NO: 993726 - DNA, 22 bp, Artificial Sequence
  chemically synthesized
cctcccgagttcaagtgattct

SEQ ID NO: 993727 - DNA, 22 bp, Artificial Sequence
  chemically synthesized
ccgagttcaagtgattctcgtg

SEQ ID NO: 993728 - DNA, 22 bp, Artificial Sequence
  chemically synthesized
aggagcctgaggcacgagaatc

SEQ ID NO: 993729 - DNA, 22 bp, Artificial Sequence
  chemically synthesized
ctcaggagcctgaggcacgaga

SEQ ID NO: 993730 - DNA, 22 bp, Artificial Sequence
  chemically synthesized
aagtgattctcgtgcctcaggc

SEQ ID NO: 993731 - DNA, 22 bp, Artificial Sequence
  chemically synthesized
taatcccagctactcaggagcc

SEQ ID NO: 993732 - DNA, 22 bp, Artificial Sequence
  chemically synthesized
gtaatcccagctactcaggagc

SEQ ID NO: 993733 - DNA, 22 bp, Artificial Sequence
  chemically synthesized
tcgtgcctcaggctcctgagta

SEQ ID NO: 993734 - DNA, 22 bp, Artificial Sequence
  chemically synthesized
gtgcctcaggctcctgagtagc

SEQ ID NO: 993735 - DNA, 22 bp, Artificial Sequence
  chemically synthesized
aggctcctgagtagctgggatt

SEQ ID NO: 993736 - DNA, 22 bp, Artificial Sequence
  chemically synthesized
tggtgcatgcttgtaatcccag

SEQ ID NO: 993737 - DNA, 22 bp, Artificial Sequence
  chemically synthesized
gtggtgcatgcttgtaatccca

SEQ ID NO: 993738 - DNA, 22 bp, Artificial Sequence
  chemically synthesized
tgtggtgcatgcttgtaatccc

SEQ ID NO: 993739 - DNA, 22 bp, Artificial Sequence
  chemically synthesized
ttgtggtgcatgcttgtaatcc

SEQ ID NO: 993740 - DNA, 22 bp, Artificial Sequence
  chemically synthesized
ctgagtagctgggattacaagc

SEQ ID NO: 993741 - DNA, 22 bp, Artificial Sequence
  chemically synthesized
agtagctgggattacaagcatg

SEQ ID NO: 993742 - DNA, 22 bp, Artificial Sequence
  chemically synthesized
gcttttgtggtgcatgcttgta

SEQ ID NO: 993743 - DNA, 22 bp, Artificial Sequence
  chemically synthesized
gctggcttttgtggtgcatgct

SEQ ID NO: 993744 - DNA, 22 bp, Artificial Sequence
  chemically synthesized
ggattacaagcatgcaccacaa

SEQ ID NO: 993745 - DNA, 22 bp, Artificial Sequence
  chemically synthesized
caagcatgcaccacaaaagcca

SEQ ID NO: 993746 - DNA, 22 bp, Artificial Sequence
  chemically synthesized
aaaatacaaaaattagctggct

SEQ ID NO: 993747 - DNA, 22 bp, Artificial Sequence
  chemically synthesized
ctaaaaatacaaaaattagctg

SEQ ID NO: 993748 - DNA, 22 bp, Artificial Sequence
  chemically synthesized
tactaaaaatacaaaaattagc

SEQ ID NO: 993749 - DNA, 22 bp, Artificial Sequence
  chemically synthesized
atttttgtatttttagtagaga

SEQ ID NO: 993750 - DNA, 22 bp, Artificial Sequence
  chemically synthesized
ttgtatttttagtagagatggg

SEQ ID NO: 993751 - DNA, 22 bp, Artificial Sequence
  chemically synthesized
tgtatttttagtagagatgggg

SEQ ID NO: 993752 - DNA, 22 bp, Artificial Sequence
  chemically synthesized
gtatttttagtagagatggggg

SEQ ID NO: 993753 - DNA, 22 bp, Artificial Sequence
  chemically synthesized
tatttttagtagagatgggggt

SEQ ID NO: 993754 - DNA, 22 bp, Artificial Sequence
  chemically synthesized
gccaacgtggtaaaacccccat

SEQ ID NO: 993755 - DNA, 22 bp, Artificial Sequence
  chemically synthesized
ttagtagagatgggggttttac

SEQ ID NO: 993756 - DNA, 22 bp, Artificial Sequence
  chemically synthesized
tagtagagatgggggttttacc

SEQ ID NO: 993757 - DNA, 22 bp, Artificial Sequence
  chemically synthesized
agtagagatgggggttttacca

SEQ ID NO: 993758 - DNA, 22 bp, Artificial Sequence
  chemically synthesized
gtagagatgggggttttaccac

SEQ ID NO: 993759 - DNA, 22 bp, Artificial Sequence
  chemically synthesized
gagaccagcctggccaacgtgg

SEQ ID NO: 993760 - DNA, 22 bp, Artificial Sequence
  chemically synthesized
taccacgttggccaggctggtc

SEQ ID NO: 993761 - DNA, 22 bp, Artificial Sequence
  chemically synthesized
accacgttggccaggctggtct

SEQ ID NO: 993762 - DNA, 22 bp, Artificial Sequence
  chemically synthesized
ccacgttggccaggctggtctc

SEQ ID NO: 993763 - DNA, 22 bp, Artificial Sequence
  chemically synthesized
aggtcaggagttcgagaccagc

SEQ ID NO: 993764 - DNA, 22 bp, Artificial Sequence
  chemically synthesized
gccaggctggtctcgaactcct

SEQ ID NO: 993765 - DNA, 22 bp, Artificial Sequence
  chemically synthesized
gtctcgaactcctgacctcagg

SEQ ID NO: 993766 - DNA, 22 bp, Artificial Sequence
  chemically synthesized
aggcaggcggatcacctgaggt

SEQ ID NO: 993767 - DNA, 22 bp, Artificial Sequence
  chemically synthesized
gaactcctgacctcaggtgatc

SEQ ID NO: 993768 - DNA, 22 bp, Artificial Sequence
  chemically synthesized
ggatgctgaggcaggcggatca

SEQ ID NO: 993769 - DNA, 22 bp, Artificial Sequence
  chemically synthesized
ctgacctcaggtgatccgcctg

SEQ ID NO: 993770 - DNA, 22 bp, Artificial Sequence
  chemically synthesized
gggatgctgaggcaggcggatc

SEQ ID NO: 993771 - DNA, 22 bp, Artificial Sequence
  chemically synthesized
tgggatgctgaggcaggcggat

SEQ ID NO: 993772 - DNA, 22 bp, Artificial Sequence
  chemically synthesized
acctcaggtgatccgcctgcct

SEQ ID NO: 993773 - DNA, 22 bp, Artificial Sequence
  chemically synthesized
aggtgatccgcctgcctcagca

SEQ ID NO: 993774 - DNA, 22 bp, Artificial Sequence
  chemically synthesized
agcactttgggatgctgaggca

SEQ ID NO: 993775 - DNA, 22 bp, Artificial Sequence
  chemically synthesized
taatctcagcactttgggatgc

SEQ ID NO: 993776 - DNA, 22 bp, Artificial Sequence
  chemically synthesized
cctcagcatcccaaagtgctga

SEQ ID NO: 993777 - DNA, 22 bp, Artificial Sequence
  chemically synthesized
atgcctgtaatctcagcacttt

SEQ ID NO: 993778 - DNA, 22 bp, Artificial Sequence
  chemically synthesized
agcatcccaaagtgctgagatt

SEQ ID NO: 993779 - DNA, 22 bp, Artificial Sequence
  chemically synthesized
agattacaggcatgaaccacca

SEQ ID NO: 993780 - DNA, 22 bp, Artificial Sequence
  chemically synthesized
caagcaggtggggcatggtggt

SEQ ID NO: 993781 - DNA, 22 bp, Artificial Sequence
  chemically synthesized
gcaagcaggtggggcatggtgg

SEQ ID NO: 993782 - DNA, 22 bp, Artificial Sequence
  chemically synthesized
caggcatgaaccaccatgcccc

SEQ ID NO: 993783 - DNA, 22 bp, Artificial Sequence
  chemically synthesized
gaaaagtcaaatgaaagtttgc

SEQ ID NO: 993784 - DNA, 22 bp, Artificial Sequence
  chemically synthesized
ggaaaagtcaaatgaaagtttg

SEQ ID NO: 993785 - DNA, 22 bp, Artificial Sequence
  chemically synthesized
tggaaaagtcaaatgaaagttt

SEQ ID NO: 993786 - DNA, 22 bp, Artificial Sequence
  chemically synthesized
ttggaaaagtcaaatgaaagtt

SEQ ID NO: 993787 - DNA, 22 bp, Artificial Sequence
  chemically synthesized
cttgcaaactttcatttgactt

SEQ ID NO: 993788 - DNA, 22 bp, Artificial Sequence
  chemically synthesized
gcaaactttcatttgacttttc

SEQ ID NO: 993789 - DNA, 22 bp, Artificial Sequence
  chemically synthesized
caaactttcatttgacttttcc

SEQ ID NO: 993790 - DNA, 22 bp, Artificial Sequence
  chemically synthesized
caaatcaagcttttggaaaagt

SEQ ID NO: 993791 - DNA, 22 bp, Artificial Sequence
  chemically synthesized
ccaaatcaagcttttggaaaag

SEQ ID NO: 993792 - DNA, 22 bp, Artificial Sequence
  chemically synthesized
tttccaaatcaagcttttggaa

SEQ ID NO: 993793 - DNA, 22 bp, Artificial Sequence
  chemically synthesized
tcatttgacttttccaaaagct

SEQ ID NO: 993794 - DNA, 22 bp, Artificial Sequence
  chemically synthesized
catttgacttttccaaaagctt

SEQ ID NO: 993795 - DNA, 22 bp, Artificial Sequence
  chemically synthesized
atttgacttttccaaaagcttg

SEQ ID NO: 993796 - DNA, 22 bp, Artificial Sequence
  chemically synthesized
gacttttccaaaagcttgattt

SEQ ID NO: 993797 - DNA, 22 bp, Artificial Sequence
  chemically synthesized
acttttccaaaagcttgatttg

SEQ ID NO: 993798 - DNA, 22 bp, Artificial Sequence
  chemically synthesized
ttccaaaagcttgatttggaaa

SEQ ID NO: 993799 - DNA, 22 bp, Artificial Sequence
  chemically synthesized
tccaaaagcttgatttggaaat

SEQ ID NO: 993800 - DNA, 22 bp, Artificial Sequence
  chemically synthesized
ccaaaagcttgatttggaaata

SEQ ID NO: 993801 - DNA, 22 bp, Artificial Sequence
  chemically synthesized
caaaagcttgatttggaaataa

SEQ ID NO: 993802 - DNA, 22 bp, Artificial Sequence
  chemically synthesized
gatttggaaataatcccacact

SEQ ID NO: 993803 - DNA, 22 bp, Artificial Sequence
  chemically synthesized
atttggaaataatcccacactg

SEQ ID NO: 993804 - DNA, 22 bp, Artificial Sequence
  chemically synthesized
aaaacatagccatcagtgtggg

SEQ ID NO: 993805 - DNA, 22 bp, Artificial Sequence
  chemically synthesized
ggaaataatcccacactgatgg

SEQ ID NO: 993806 - DNA, 22 bp, Artificial Sequence
  chemically synthesized
gaaataatcccacactgatggc

SEQ ID NO: 993807 - DNA, 22 bp, Artificial Sequence
  chemically synthesized
cattaaaaacatagccatcagt

SEQ ID NO: 993808 - DNA, 22 bp, Artificial Sequence
  chemically synthesized
actccattaaaaacatagccat

SEQ ID NO: 993809 - DNA, 22 bp, Artificial Sequence
  chemically synthesized
atggctatgtttttaatggagt

SEQ ID NO: 993810 - DNA, 22 bp, Artificial Sequence
  chemically synthesized
gacaacaaaggttgactccatt

SEQ ID NO: 993811 - DNA, 22 bp, Artificial Sequence
  chemically synthesized
tgtttttaatggagtcaacctt

SEQ ID NO: 993812 - DNA, 22 bp, Artificial Sequence
  chemically synthesized
tcctggacaacaaaggttgact

SEQ ID NO: 993813 - DNA, 22 bp, Artificial Sequence
  chemically synthesized
gtcctggacaacaaaggttgac

SEQ ID NO: 993814 - DNA, 22 bp, Artificial Sequence
  chemically synthesized
tttgtcctggacaacaaaggtt

SEQ ID NO: 993815 - DNA, 22 bp, Artificial Sequence
  chemically synthesized
ttaatggagtcaacctttgttg

SEQ ID NO: 993816 - DNA, 22 bp, Artificial Sequence
  chemically synthesized
taatggagtcaacctttgttgt

SEQ ID NO: 993817 - DNA, 22 bp, Artificial Sequence
  chemically synthesized
aatggagtcaacctttgttgtc

SEQ ID NO: 993818 - DNA, 22 bp, Artificial Sequence
  chemically synthesized
atggagtcaacctttgttgtcc

SEQ ID NO: 993819 - DNA, 22 bp, Artificial Sequence
  chemically synthesized
acagttatttgtcctggacaac

SEQ ID NO: 993820 - DNA, 22 bp, Artificial Sequence
  chemically synthesized
aacagttatttgtcctggacaa

SEQ ID NO: 993821 - DNA, 22 bp, Artificial Sequence
  chemically synthesized
ttaacagttatttgtcctggac

SEQ ID NO: 993822 - DNA, 22 bp, Artificial Sequence
  chemically synthesized
tgttgtccaggacaaataactg

SEQ ID NO: 993823 - DNA, 22 bp, Artificial Sequence
  chemically synthesized
gaagattcttaacagttatttg

SEQ ID NO: 993824 - DNA, 22 bp, Artificial Sequence
  chemically synthesized
gttgtccaggacaaataactgt

SEQ ID NO: 993825 - DNA, 22 bp, Artificial Sequence
  chemically synthesized
ttgtccaggacaaataactgtt

SEQ ID NO: 993826 - DNA, 22 bp, Artificial Sequence
  chemically synthesized
tccaggacaaataactgttaag

SEQ ID NO: 993827 - DNA, 22 bp, Artificial Sequence
  chemically synthesized
agtacagtatgctagaagattc

SEQ ID NO: 993828 - DNA, 22 bp, Artificial Sequence
  chemically synthesized
gagtacagtatgctagaagatt

SEQ ID NO: 993829 - DNA, 22 bp, Artificial Sequence
  chemically synthesized
tgagtacagtatgctagaagat

SEQ ID NO: 993830 - DNA, 22 bp, Artificial Sequence
  chemically synthesized
ttaagaatcttctagcatactg

SEQ ID NO: 993831 - DNA, 22 bp, Artificial Sequence
  chemically synthesized
aggactttgagtacagtatgct

SEQ ID NO: 993832 - DNA, 22 bp, Artificial Sequence
  chemically synthesized
agaatcttctagcatactgtac

SEQ ID NO: 993833 - DNA, 22 bp, Artificial Sequence
  chemically synthesized
atagtgctaaggactttgagta

SEQ ID NO: 993834 - DNA, 22 bp, Artificial Sequence
  chemically synthesized
ctagcatactgtactcaaagtc

SEQ ID NO: 993835 - DNA, 22 bp, Artificial Sequence
  chemically synthesized
tagcatactgtactcaaagtcc

SEQ ID NO: 993836 - DNA, 22 bp, Artificial Sequence
  chemically synthesized
gcatactgtactcaaagtcctt

SEQ ID NO: 993837 - DNA, 22 bp, Artificial Sequence
  chemically synthesized
tactcaaagtccttagcactat

SEQ ID NO: 993838 - DNA, 22 bp, Artificial Sequence
  chemically synthesized
agccaacagcctgatagtgcta

SEQ ID NO: 993839 - DNA, 22 bp, Artificial Sequence
  chemically synthesized
gagccaacagcctgatagtgct

SEQ ID NO: 993840 - DNA, 22 bp, Artificial Sequence
  chemically synthesized
aaagtccttagcactatcaggc

SEQ ID NO: 993841 - DNA, 22 bp, Artificial Sequence
  chemically synthesized
atgtttgagccaacagcctgat

SEQ ID NO: 993842 - DNA, 22 bp, Artificial Sequence
  chemically synthesized
catgtttgagccaacagcctga

SEQ ID NO: 993843 - DNA, 22 bp, Artificial Sequence
  chemically synthesized
tcatgtttgagccaacagcctg

SEQ ID NO: 993844 - DNA, 22 bp, Artificial Sequence
  chemically synthesized
agcactatcaggctgttggctc

SEQ ID NO: 993845 - DNA, 22 bp, Artificial Sequence
  chemically synthesized
gcactatcaggctgttggctca

SEQ ID NO: 993846 - DNA, 22 bp, Artificial Sequence
  chemically synthesized
tcaggctgttggctcaaacatg

SEQ ID NO: 993847 - DNA, 22 bp, Artificial Sequence
  chemically synthesized
catcaaaaaaacctttcatgtt

SEQ ID NO: 993848 - DNA, 22 bp, Artificial Sequence
  chemically synthesized
ttggctcaaacatgaaaggttt

SEQ ID NO: 993849 - DNA, 22 bp, Artificial Sequence
  chemically synthesized
gctcaaacatgaaaggtttttt

SEQ ID NO: 993850 - DNA, 22 bp, Artificial Sequence
  chemically synthesized
caaaactacatcaaaaaaacct

SEQ ID NO: 993851 - DNA, 22 bp, Artificial Sequence
  chemically synthesized
tacaaaactacatcaaaaaaac

SEQ ID NO: 993852 - DNA, 22 bp, Artificial Sequence
  chemically synthesized
aaacatgaaaggtttttttgat

SEQ ID NO: 993853 - DNA, 22 bp, Artificial Sequence
  chemically synthesized
caataacaattctacaaaacta

SEQ ID NO: 993854 - DNA, 22 bp, Artificial Sequence
  chemically synthesized
ttttgatgtagttttgtagaat

SEQ ID NO: 993855 - DNA, 22 bp, Artificial Sequence
  chemically synthesized
tttgatgtagttttgtagaatt

SEQ ID NO: 993856 - DNA, 22 bp, Artificial Sequence
  chemically synthesized
ttgatgtagttttgtagaattg

SEQ ID NO: 993857 - DNA, 22 bp, Artificial Sequence
  chemically synthesized
tgatgtagttttgtagaattgt

SEQ ID NO: 993858 - DNA, 22 bp, Artificial Sequence
  chemically synthesized
gatgtagttttgtagaattgtt

SEQ ID NO: 993859 - DNA, 22 bp, Artificial Sequence
  chemically synthesized
atgtagttttgtagaattgtta

SEQ ID NO: 993860 - DNA, 22 bp, Artificial Sequence
  chemically synthesized
tgtagaattgttattgcaatgg

SEQ ID NO: 993861 - DNA, 22 bp, Artificial Sequence
  chemically synthesized
gtagaattgttattgcaatggt

SEQ ID NO: 993862 - DNA, 22 bp, Artificial Sequence
  chemically synthesized
tagaattgttattgcaatggta

SEQ ID NO: 993863 - DNA, 22 bp, Artificial Sequence
  chemically synthesized
caatacagcaaataccattgca

SEQ ID NO: 993864 - DNA, 22 bp, Artificial Sequence
  chemically synthesized
ttattgcaatggtatttgctgt

SEQ ID NO: 993865 - DNA, 22 bp, Artificial Sequence
  chemically synthesized
ttgcaatggtatttgctgtatt

SEQ ID NO: 993866 - DNA, 22 bp, Artificial Sequence
  chemically synthesized
tgggtcaaattccaatacagca

SEQ ID NO: 993867 - DNA, 22 bp, Artificial Sequence
  chemically synthesized
caatggtatttgctgtattgga

SEQ ID NO: 993868 - DNA, 22 bp, Artificial Sequence
  chemically synthesized
tactgtgggtcaaattccaata

SEQ ID NO: 993869 - DNA, 22 bp, Artificial Sequence
  chemically synthesized
gtactgtgggtcaaattccaat

SEQ ID NO: 993870 - DNA, 22 bp, Artificial Sequence
  chemically synthesized
taacttgtactgtgggtcaaat

SEQ ID NO: 993871 - DNA, 22 bp, Artificial Sequence
  chemically synthesized
gctgtattggaatttgacccac

SEQ ID NO: 993872 - DNA, 22 bp, Artificial Sequence
  chemically synthesized
ctgtattggaatttgacccaca

SEQ ID NO: 993873 - DNA, 22 bp, Artificial Sequence
  chemically synthesized
tattggaatttgacccacagta

SEQ ID NO: 993874 - DNA, 22 bp, Artificial Sequence
  chemically synthesized
tactataacttgtactgtgggt

SEQ ID NO: 993875 - DNA, 22 bp, Artificial Sequence
  chemically synthesized
gtactataacttgtactgtggg

SEQ ID NO: 993876 - DNA, 22 bp, Artificial Sequence
  chemically synthesized
gaatttgacccacagtacaagt

SEQ ID NO: 993877 - DNA, 22 bp, Artificial Sequence
  chemically synthesized
gtatcttgtactataacttgta

SEQ ID NO: 993878 - DNA, 22 bp, Artificial Sequence
  chemically synthesized
gacccacagtacaagttatagt

SEQ ID NO: 993879 - DNA, 22 bp, Artificial Sequence
  chemically synthesized
acccacagtacaagttatagta

SEQ ID NO: 993880 - DNA, 22 bp, Artificial Sequence
  chemically synthesized
attggtatcttgtactataact

SEQ ID NO: 993881 - DNA, 22 bp, Artificial Sequence
  chemically synthesized
acaaaaaacaatattgattggt

SEQ ID NO: 993882 - DNA, 22 bp, Artificial Sequence
  chemically synthesized
tagtacaagataccaatcaata

SEQ ID NO: 993883 - DNA, 22 bp, Artificial Sequence
  chemically synthesized
attaacaaaaaacaatattgat

SEQ ID NO: 993884 - DNA, 22 bp, Artificial Sequence
  chemically synthesized
ttcattaacaaaaaacaatatt

SEQ ID NO: 993885 - DNA, 22 bp, Artificial Sequence
  chemically synthesized
tgttgttcattaacaaaaaaca

SEQ ID NO: 993886 - DNA, 22 bp, Artificial Sequence
  chemically synthesized
atgttgttcattaacaaaaaac

SEQ ID NO: 993887 - DNA, 22 bp, Artificial Sequence
  chemically synthesized
tacatcttatgttgttcattaa

SEQ ID NO: 993888 - DNA, 22 bp, Artificial Sequence
  chemically synthesized
ttttttgttaatgaacaacata

SEQ ID NO: 993889 - DNA, 22 bp, Artificial Sequence
  chemically synthesized
tttgttaatgaacaacataaga

SEQ ID NO: 993890 - DNA, 22 bp, Artificial Sequence
  chemically synthesized
gcaagctgtacatcttatgttg

SEQ ID NO: 993891 - DNA, 22 bp, Artificial Sequence
  chemically synthesized
ttgttaatgaacaacataagat

SEQ ID NO: 993892 - DNA, 22 bp, Artificial Sequence
  chemically synthesized
ggcaagctgtacatcttatgtt

SEQ ID NO: 993893 - DNA, 22 bp, Artificial Sequence
  chemically synthesized
tgttaatgaacaacataagatg

SEQ ID NO: 993894 - DNA, 22 bp, Artificial Sequence
  chemically synthesized
gttaatgaacaacataagatgt

SEQ ID NO: 993895 - DNA, 22 bp, Artificial Sequence
  chemically synthesized
ttaatgaacaacataagatgta

SEQ ID NO: 993896 - DNA, 22 bp, Artificial Sequence
  chemically synthesized
gatttggcaagctgtacatctt

SEQ ID NO: 993897 - DNA, 22 bp, Artificial Sequence
  chemically synthesized
atgaacaacataagatgtacag

SEQ ID NO: 993898 - DNA, 22 bp, Artificial Sequence
  chemically synthesized
agatttggcaagctgtacatct

SEQ ID NO: 993899 - DNA, 22 bp, Artificial Sequence
  chemically synthesized
aagtttagatttggcaagctgt

SEQ ID NO: 993900 - DNA, 22 bp, Artificial Sequence
  chemically synthesized
atattaaagtttagatttggca

SEQ ID NO: 993901 - DNA, 22 bp, Artificial Sequence
  chemically synthesized
taatattaaagtttagatttgg

SEQ ID NO: 993902 - DNA, 22 bp, Artificial Sequence
  chemically synthesized
taatctctaatattaaagttta

SEQ ID NO: 993903 - DNA, 22 bp, Artificial Sequence
  chemically synthesized
gccaaatctaaactttaatatt

SEQ ID NO: 993904 - DNA, 22 bp, Artificial Sequence
  chemically synthesized
ccaaatctaaactttaatatta

SEQ ID NO: 993905 - DNA, 22 bp, Artificial Sequence
  chemically synthesized
atcctataatctctaatattaa

SEQ ID NO: 993906 - DNA, 22 bp, Artificial Sequence
  chemically synthesized
aactttaatattagagattata

SEQ ID NO: 993907 - DNA, 22 bp, Artificial Sequence
  chemically synthesized
taatattagagattataggatc

SEQ ID NO: 993908 - DNA, 22 bp, Artificial Sequence
  chemically synthesized
aatattagagattataggatca

SEQ ID NO: 993909 - DNA, 22 bp, Artificial Sequence
  chemically synthesized
atattagagattataggatcag

SEQ ID NO: 993910 - DNA, 22 bp, Artificial Sequence
  chemically synthesized
gcaaaaaatggtactgatccta

SEQ ID NO: 993911 - DNA, 22 bp, Artificial Sequence
  chemically synthesized
gagattataggatcagtaccat

SEQ ID NO: 993912 - DNA, 22 bp, Artificial Sequence
  chemically synthesized
cataggttagcaaaaaatggta

SEQ ID NO: 993913 - DNA, 22 bp, Artificial Sequence
  chemically synthesized
tgcataggttagcaaaaaatgg

SEQ ID NO: 993914 - DNA, 22 bp, Artificial Sequence
  chemically synthesized
taggatcagtaccattttttgc

SEQ ID NO: 993915 - DNA, 22 bp, Artificial Sequence
  chemically synthesized
tttgctaacctatgcagaggat

SEQ ID NO: 993916 - DNA, 22 bp, Artificial Sequence
  chemically synthesized
ttgctaacctatgcagaggatt

SEQ ID NO: 993917 - DNA, 22 bp, Artificial Sequence
  chemically synthesized
tgctaacctatgcagaggattg

SEQ ID NO: 993918 - DNA, 22 bp, Artificial Sequence
  chemically synthesized
gctaacctatgcagaggattgt

SEQ ID NO: 993919 - DNA, 22 bp, Artificial Sequence
  chemically synthesized
agtcaccaaaggacaatcctct

SEQ ID NO: 993920 - DNA, 22 bp, Artificial Sequence
  chemically synthesized
ctaacctatgcagaggattgtc

SEQ ID NO: 993921 - DNA, 22 bp, Artificial Sequence
  chemically synthesized
cagtcaccaaaggacaatcctc

SEQ ID NO: 993922 - DNA, 22 bp, Artificial Sequence
  chemically synthesized
tcagtcaccaaaggacaatcct

SEQ ID NO: 993923 - DNA, 22 bp, Artificial Sequence
  chemically synthesized
ttcagtcaccaaaggacaatcc

SEQ ID NO: 993924 - DNA, 22 bp, Artificial Sequence
  chemically synthesized
acctatgcagaggattgtcctt

SEQ ID NO: 993925 - DNA, 22 bp, Artificial Sequence
  chemically synthesized
cttttcagtcaccaaaggacaa

SEQ ID NO: 993926 - DNA, 22 bp, Artificial Sequence
  chemically synthesized
ccttttcagtcaccaaaggaca

SEQ ID NO: 993927 - DNA, 22 bp, Artificial Sequence
  chemically synthesized
tccttttcagtcaccaaaggac

SEQ ID NO: 993928 - DNA, 22 bp, Artificial Sequence
  chemically synthesized
tgcagaggattgtcctttggtg

SEQ ID NO: 993929 - DNA, 22 bp, Artificial Sequence
  chemically synthesized
ttttccttttcagtcaccaaag

SEQ ID NO: 993930 - DNA, 22 bp, Artificial Sequence
  chemically synthesized
ttgttttccttttcagtcacca

SEQ ID NO: 993931 - DNA, 22 bp, Artificial Sequence
  chemically synthesized
attgttttccttttcagtcacc

SEQ ID NO: 993932 - DNA, 22 bp, Artificial Sequence
  chemically synthesized
tcctttggtgactgaaaaggaa

SEQ ID NO: 993933 - DNA, 22 bp, Artificial Sequence
  chemically synthesized
tggtgactgaaaaggaaaacaa

SEQ ID NO: 993934 - DNA, 22 bp, Artificial Sequence
  chemically synthesized
ggtgactgaaaaggaaaacaat

SEQ ID NO: 993935 - DNA, 22 bp, Artificial Sequence
  chemically synthesized
gtgactgaaaaggaaaacaata

SEQ ID NO: 993936 - DNA, 22 bp, Artificial Sequence
  chemically synthesized
cacataagtaggaatttattgt

SEQ ID NO: 993937 - DNA, 22 bp, Artificial Sequence
  chemically synthesized
aaaaggaaaacaataaattcct

SEQ ID NO: 993938 - DNA, 22 bp, Artificial Sequence
  chemically synthesized
aaaagacagagactccacataa

SEQ ID NO: 993939 - DNA, 22 bp, Artificial Sequence
  chemically synthesized
ttaaaaagacagagactccaca

SEQ ID NO: 993940 - DNA, 22 bp, Artificial Sequence
  chemically synthesized
ttattaaaaagacagagactcc

SEQ ID NO: 993941 - DNA, 22 bp, Artificial Sequence
  chemically synthesized
ctacttatgtggagtctctgtc

SEQ ID NO: 993942 - DNA, 22 bp, Artificial Sequence
  chemically synthesized
actattattaaaaagacagaga

SEQ ID NO: 993943 - DNA, 22 bp, Artificial Sequence
  chemically synthesized
cttatgtggagtctctgtcttt

SEQ ID NO: 993944 - DNA, 22 bp, Artificial Sequence
  chemically synthesized
atgtggagtctctgtcttttta

SEQ ID NO: 993945 - DNA, 22 bp, Artificial Sequence
  chemically synthesized
tgtggagtctctgtctttttaa

SEQ ID NO: 993946 - DNA, 22 bp, Artificial Sequence
  chemically synthesized
caataagacactgactattatt

SEQ ID NO: 993947 - DNA, 22 bp, Artificial Sequence
  chemically synthesized
tgtctttttaataatagtcagt

SEQ ID NO: 993948 - DNA, 22 bp, Artificial Sequence
  chemically synthesized
tctttttaataatagtcagtgt

SEQ ID NO: 993949 - DNA, 22 bp, Artificial Sequence
  chemically synthesized
tgagttccaataagacactgac

SEQ ID NO: 993950 - DNA, 22 bp, Artificial Sequence
  chemically synthesized
gtgagttccaataagacactga

SEQ ID NO: 993951 - DNA, 22 bp, Artificial Sequence
  chemically synthesized
tttaataatagtcagtgtctta

SEQ ID NO: 993952 - DNA, 22 bp, Artificial Sequence
  chemically synthesized
tgtgagttccaataagacactg

SEQ ID NO: 993953 - DNA, 22 bp, Artificial Sequence
  chemically synthesized
ttaataatagtcagtgtcttat

SEQ ID NO: 993954 - DNA, 22 bp, Artificial Sequence
  chemically synthesized
taataatagtcagtgtcttatt

SEQ ID NO: 993955 - DNA, 22 bp, Artificial Sequence
  chemically synthesized
aataatagtcagtgtcttattg

SEQ ID NO: 993956 - DNA, 22 bp, Artificial Sequence
  chemically synthesized
ataatagtcagtgtcttattgg

SEQ ID NO: 993957 - DNA, 22 bp, Artificial Sequence
  chemically synthesized
acaccaagtctttgtgagttcc

SEQ ID NO: 993958 - DNA, 22 bp, Artificial Sequence
  chemically synthesized
cacaccaagtctttgtgagttc

SEQ ID NO: 993959 - DNA, 22 bp, Artificial Sequence
  chemically synthesized
ttcacaccaagtctttgtgagt

SEQ ID NO: 993960 - DNA, 22 bp, Artificial Sequence
  chemically synthesized
attggaactcacaaagacttgg

SEQ ID NO: 993961 - DNA, 22 bp, Artificial Sequence
  chemically synthesized
ttggaactcacaaagacttggt

SEQ ID NO: 993962 - DNA, 22 bp, Artificial Sequence
  chemically synthesized
tcagagctcttcacaccaagtc

SEQ ID NO: 993963 - DNA, 22 bp, Artificial Sequence
  chemically synthesized
gaactcacaaagacttggtgtg

SEQ ID NO: 993964 - DNA, 22 bp, Artificial Sequence
  chemically synthesized
gtcagagctcttcacaccaagt

SEQ ID NO: 993965 - DNA, 22 bp, Artificial Sequence
  chemically synthesized
gcttgtcagagctcttcacacc

SEQ ID NO: 993966 - DNA, 22 bp, Artificial Sequence
  chemically synthesized
acaaagacttggtgtgaagagc

SEQ ID NO: 993967 - DNA, 22 bp, Artificial Sequence
  chemically synthesized
actagcttgtcagagctcttca

SEQ ID NO: 993968 - DNA, 22 bp, Artificial Sequence
  chemically synthesized
ggtgtgaagagctctgacaagc

SEQ ID NO: 993969 - DNA, 22 bp, Artificial Sequence
  chemically synthesized
gtgtgaagagctctgacaagct

SEQ ID NO: 993970 - DNA, 22 bp, Artificial Sequence
  chemically synthesized
tgacaagctagttagcctattt

SEQ ID NO: 993971 - DNA, 22 bp, Artificial Sequence
  chemically synthesized
acaagctagttagcctatttta

SEQ ID NO: 993972 - DNA, 22 bp, Artificial Sequence
  chemically synthesized
gttagcctattttatgcttgtt

SEQ ID NO: 993973 - DNA, 22 bp, Artificial Sequence
  chemically synthesized
gcctattttatgcttgttttat

SEQ ID NO: 993974 - DNA, 22 bp, Artificial Sequence
  chemically synthesized
catataggaagcaagaataaaa

SEQ ID NO: 993975 - DNA, 22 bp, Artificial Sequence
  chemically synthesized
ttttatgcttgttttattcttg

SEQ ID NO: 993976 - DNA, 22 bp, Artificial Sequence
  chemically synthesized
gcatataggaagcaagaataaa

SEQ ID NO: 993977 - DNA, 22 bp, Artificial Sequence
  chemically synthesized
tatgcttgttttattcttgctt

SEQ ID NO: 993978 - DNA, 22 bp, Artificial Sequence
  chemically synthesized
atgcttgttttattcttgcttc

SEQ ID NO: 993979 - DNA, 22 bp, Artificial Sequence
  chemically synthesized
tgcttgttttattcttgcttcc

SEQ ID NO: 993980 - DNA, 22 bp, Artificial Sequence
  chemically synthesized
tgtttgcatataggaagcaaga

SEQ ID NO: 993981 - DNA, 22 bp, Artificial Sequence
  chemically synthesized
actatgtttgcatataggaagc

SEQ ID NO: 993982 - DNA, 22 bp, Artificial Sequence
  chemically synthesized
gttttattcttgcttcctatat

SEQ ID NO: 993983 - DNA, 22 bp, Artificial Sequence
  chemically synthesized
cactatgtttgcatataggaag

SEQ ID NO: 993984 - DNA, 22 bp, Artificial Sequence
  chemically synthesized
ttttattcttgcttcctatatg

SEQ ID NO: 993985 - DNA, 22 bp, Artificial Sequence
  chemically synthesized
tattcttgcttcctatatgcaa

SEQ ID NO: 993986 - DNA, 22 bp, Artificial Sequence
  chemically synthesized
attcttgcttcctatatgcaaa

SEQ ID NO: 993987 - DNA, 22 bp, Artificial Sequence
  chemically synthesized
tccttcactatgtttgcatata

SEQ ID NO: 993988 - DNA, 22 bp, Artificial Sequence
  chemically synthesized
ttcttgcttcctatatgcaaac

SEQ ID NO: 993989 - DNA, 22 bp, Artificial Sequence
  chemically synthesized
ttgcttcctatatgcaaacata

SEQ ID NO: 993990 - DNA, 22 bp, Artificial Sequence
  chemically synthesized
gcttcctatatgcaaacatagt

SEQ ID NO: 993991 - DNA, 22 bp, Artificial Sequence
  chemically synthesized
cttcctatatgcaaacatagtg

SEQ ID NO: 993992 - DNA, 22 bp, Artificial Sequence
  chemically synthesized
cccgctgtccttcactatgttt

SEQ ID NO: 993993 - DNA, 22 bp, Artificial Sequence
  chemically synthesized
cctatatgcaaacatagtgaag

SEQ ID NO: 993994 - DNA, 22 bp, Artificial Sequence
  chemically synthesized
ctatatgcaaacatagtgaagg

SEQ ID NO: 993995 - DNA, 22 bp, Artificial Sequence
  chemically synthesized
attgcccgctgtccttcactat

SEQ ID NO: 993996 - DNA, 22 bp, Artificial Sequence
  chemically synthesized
tatgcaaacatagtgaaggaca

SEQ ID NO: 993997 - DNA, 22 bp, Artificial Sequence
  chemically synthesized
aaatagaagtgcgagctcattg

SEQ ID NO: 993998 - DNA, 22 bp, Artificial Sequence
  chemically synthesized
gcacttctattttagcgattct

SEQ ID NO: 993999 - DNA, 22 bp, Artificial Sequence
  chemically synthesized
ctattttagcgattctgggtta

SEQ ID NO: 994000 - DNA, 22 bp, Artificial Sequence
  chemically synthesized
tattttagcgattctgggttac

SEQ ID NO: 994001 - DNA, 22 bp, Artificial Sequence
  chemically synthesized
gaggcagcccgagtaacccaga

SEQ ID NO: 994002 - DNA, 22 bp, Artificial Sequence
  chemically synthesized
ttttagcgattctgggttactc

SEQ ID NO: 994003 - DNA, 22 bp, Artificial Sequence
  chemically synthesized
tagcgattctgggttactcggg

SEQ ID NO: 994004 - DNA, 22 bp, Artificial Sequence
  chemically synthesized
agcgattctgggttactcgggc

SEQ ID NO: 994005 - DNA, 22 bp, Artificial Sequence
  chemically synthesized
gcgattctgggttactcgggct

SEQ ID NO: 994006 - DNA, 22 bp, Artificial Sequence
  chemically synthesized
gtagattagaggcagcccgagt

SEQ ID NO: 994007 - DNA, 22 bp, Artificial Sequence
  chemically synthesized
ggtagattagaggcagcccgag

SEQ ID NO: 994008 - DNA, 22 bp, Artificial Sequence
  chemically synthesized
gcttggtagattagaggcagcc

SEQ ID NO: 994009 - DNA, 22 bp, Artificial Sequence
  chemically synthesized
tgggttactcgggctgcctcta

SEQ ID NO: 994010 - DNA, 22 bp, Artificial Sequence
  chemically synthesized
ggttactcgggctgcctctaat

SEQ ID NO: 994011 - DNA, 22 bp, Artificial Sequence
  chemically synthesized
ctcgggctgcctctaatctacc

SEQ ID NO: 994012 - DNA, 22 bp, Artificial Sequence
  chemically synthesized
gggctgcctctaatctaccaag

SEQ ID NO: 994013 - DNA, 22 bp, Artificial Sequence
  chemically synthesized
taataatcctggcttggtagat

SEQ ID NO: 994014 - DNA, 22 bp, Artificial Sequence
  chemically synthesized
ataataatcctggcttggtaga

SEQ ID NO: 994015 - DNA, 22 bp, Artificial Sequence
  chemically synthesized
cttataataatcctggcttggt

SEQ ID NO: 994016 - DNA, 22 bp, Artificial Sequence
  chemically synthesized
ccttataataatcctggcttgg

SEQ ID NO: 994017 - DNA, 22 bp, Artificial Sequence
  chemically synthesized
cctctaatctaccaagccagga

SEQ ID NO: 994018 - DNA, 22 bp, Artificial Sequence
  chemically synthesized
tccttataataatcctggcttg

SEQ ID NO: 994019 - DNA, 22 bp, Artificial Sequence
  chemically synthesized
ttttccttataataatcctggc

SEQ ID NO: 994020 - DNA, 22 bp, Artificial Sequence
  chemically synthesized
taatctaccaagccaggattat

SEQ ID NO: 994021 - DNA, 22 bp, Artificial Sequence
  chemically synthesized
atctaccaagccaggattatta

SEQ ID NO: 994022 - DNA, 22 bp, Artificial Sequence
  chemically synthesized
gttattttccttataataatcc

SEQ ID NO: 994023 - DNA, 22 bp, Artificial Sequence
  chemically synthesized
ccaagccaggattattataagg

SEQ ID NO: 994024 - DNA, 22 bp, Artificial Sequence
  chemically synthesized
cattggttattttccttataat

SEQ ID NO: 994025 - DNA, 22 bp, Artificial Sequence
  chemically synthesized
gctacattggttattttcctta

SEQ ID NO: 994026 - DNA, 22 bp, Artificial Sequence
  chemically synthesized
agctacattggttattttcctt

SEQ ID NO: 994027 - DNA, 22 bp, Artificial Sequence
  chemically synthesized
tagctacattggttattttcct

SEQ ID NO: 994028 - DNA, 22 bp, Artificial Sequence
  chemically synthesized
tctttagctacattggttattt

SEQ ID NO: 994029 - DNA, 22 bp, Artificial Sequence
  chemically synthesized
atctttagctacattggttatt

SEQ ID NO: 994030 - DNA, 22 bp, Artificial Sequence
  chemically synthesized
tatctttagctacattggttat

SEQ ID NO: 994031 - DNA, 22 bp, Artificial Sequence
  chemically synthesized
ttataaggaaaataaccaatgt

SEQ ID NO: 994032 - DNA, 22 bp, Artificial Sequence
  chemically synthesized
taaggaaaataaccaatgtagc

SEQ ID NO: 994033 - DNA, 22 bp, Artificial Sequence
  chemically synthesized
gggaagtgatgactttatcttt

SEQ ID NO: 994034 - DNA, 22 bp, Artificial Sequence
  chemically synthesized
agttagggaagtgatgacttta

SEQ ID NO: 994035 - DNA, 22 bp, Artificial Sequence
  chemically synthesized
aagataaagtcatcacttccct

SEQ ID NO: 994036 - DNA, 22 bp, Artificial Sequence
  chemically synthesized
caaaggaattgagttagggaag

SEQ ID NO: 994037 - DNA, 22 bp, Artificial Sequence
  chemically synthesized
cagctacaaaggaattgagtta

SEQ ID NO: 994038 - DNA, 22 bp, Artificial Sequence
  chemically synthesized
ctgcagctacaaaggaattgag

SEQ ID NO: 994039 - DNA, 22 bp, Artificial Sequence
  chemically synthesized
ccctaactcaattcctttgtag

SEQ ID NO: 994040 - DNA, 22 bp, Artificial Sequence
  chemically synthesized
gtgttcctgcagctacaaagga

SEQ ID NO: 994041 - DNA, 22 bp, Artificial Sequence
  chemically synthesized
cctaactcaattcctttgtagc

SEQ ID NO: 994042 - DNA, 22 bp, Artificial Sequence
  chemically synthesized
agtgttcctgcagctacaaagg

SEQ ID NO: 994043 - DNA, 22 bp, Artificial Sequence
  chemically synthesized
actcaattcctttgtagctgca

SEQ ID NO: 994044 - DNA, 22 bp, Artificial Sequence
  chemically synthesized
aattcctttgtagctgcaggaa

SEQ ID NO: 994045 - DNA, 22 bp, Artificial Sequence
  chemically synthesized
aatgaaatttagtgttcctgca

SEQ ID NO: 994046 - DNA, 22 bp, Artificial Sequence
  chemically synthesized
tgaatgaaatttagtgttcctg

SEQ ID NO: 994047 - DNA, 22 bp, Artificial Sequence
  chemically synthesized
ctttgtagctgcaggaacacta

SEQ ID NO: 994048 - DNA, 22 bp, Artificial Sequence
  chemically synthesized
tgtagctgcaggaacactaaat

SEQ ID NO: 994049 - DNA, 22 bp, Artificial Sequence
  chemically synthesized
gtagctgcaggaacactaaatt

SEQ ID NO: 994050 - DNA, 22 bp, Artificial Sequence
  chemically synthesized
tagctgcaggaacactaaattt

SEQ ID NO: 994051 - DNA, 22 bp, Artificial Sequence
  chemically synthesized
gaattctgaatgaaatttagtg

SEQ ID NO: 994052 - DNA, 22 bp, Artificial Sequence
  chemically synthesized
caggaacactaaatttcattca

SEQ ID NO: 994053 - DNA, 22 bp, Artificial Sequence
  chemically synthesized
ggagttagaattctgaatgaaa

SEQ ID NO: 994054 - DNA, 22 bp, Artificial Sequence
  chemically synthesized
gggagttagaattctgaatgaa

SEQ ID NO: 994055 - DNA, 22 bp, Artificial Sequence
  chemically synthesized
tgggagttagaattctgaatga

SEQ ID NO: 994056 - DNA, 22 bp, Artificial Sequence
  chemically synthesized
ttgggagttagaattctgaatg

SEQ ID NO: 994057 - DNA, 22 bp, Artificial Sequence
  chemically synthesized
tttgggagttagaattctgaat

SEQ ID NO: 994058 - DNA, 22 bp, Artificial Sequence
  chemically synthesized
aatttcattcagaattctaact

SEQ ID NO: 994059 - DNA, 22 bp, Artificial Sequence
  chemically synthesized
cccagctttttgggagttagaa

SEQ ID NO: 994060 - DNA, 22 bp, Artificial Sequence
  chemically synthesized
cattcagaattctaactcccaa

SEQ ID NO: 994061 - DNA, 22 bp, Artificial Sequence
  chemically synthesized
attcagaattctaactcccaaa

SEQ ID NO: 994062 - DNA, 22 bp, Artificial Sequence
  chemically synthesized
gattacccagctttttgggagt

SEQ ID NO: 994063 - DNA, 22 bp, Artificial Sequence
  chemically synthesized
agattacccagctttttgggag

SEQ ID NO: 994064 - DNA, 22 bp, Artificial Sequence
  chemically synthesized
agaattctaactcccaaaaagc

SEQ ID NO: 994065 - DNA, 22 bp, Artificial Sequence
  chemically synthesized
agggtcttagattacccagctt

SEQ ID NO: 994066 - DNA, 22 bp, Artificial Sequence
  chemically synthesized
taactcccaaaaagctgggtaa

SEQ ID NO: 994067 - DNA, 22 bp, Artificial Sequence
  chemically synthesized
actcccaaaaagctgggtaatc

SEQ ID NO: 994068 - DNA, 22 bp, Artificial Sequence
  chemically synthesized
ccaaaaagctgggtaatctaag

SEQ ID NO: 994069 - DNA, 22 bp, Artificial Sequence
  chemically synthesized
taagaaaaccattaagggtctt

SEQ ID NO: 994070 - DNA, 22 bp, Artificial Sequence
  chemically synthesized
ggtaatctaagacccttaatgg

SEQ ID NO: 994071 - DNA, 22 bp, Artificial Sequence
  chemically synthesized
tgaggctataagaaaaccatta

SEQ ID NO: 994072 - DNA, 22 bp, Artificial Sequence
  chemically synthesized
agacccttaatggttttcttat

SEQ ID NO: 994073 - DNA, 22 bp, Artificial Sequence
  chemically synthesized
ccaaaccctatgaggctataag

SEQ ID NO: 994074 - DNA, 22 bp, Artificial Sequence
  chemically synthesized
aatggttttcttatagcctcat

SEQ ID NO: 994075 - DNA, 22 bp, Artificial Sequence
  chemically synthesized
atggttttcttatagcctcata

SEQ ID NO: 994076 - DNA, 22 bp, Artificial Sequence
  chemically synthesized
tcttatagcctcatagggtttg

SEQ ID NO: 994077 - DNA, 22 bp, Artificial Sequence
  chemically synthesized
cttatagcctcatagggtttgg

SEQ ID NO: 994078 - DNA, 22 bp, Artificial Sequence
  chemically synthesized
ttatagcctcatagggtttggc

SEQ ID NO: 994079 - DNA, 22 bp, Artificial Sequence
  chemically synthesized
atagcctcatagggtttggcag

SEQ ID NO: 994080 - DNA, 22 bp, Artificial Sequence
  chemically synthesized
tagcctcatagggtttggcagg

SEQ ID NO: 994081 - DNA, 22 bp, Artificial Sequence
  chemically synthesized
ccagatgtccagggcacctgcc

SEQ ID NO: 994082 - DNA, 22 bp, Artificial Sequence
  chemically synthesized
atagggtttggcaggtgccctg

SEQ ID NO: 994083 - DNA, 22 bp, Artificial Sequence
  chemically synthesized
agggaatctgccagatgtccag

SEQ ID NO: 994084 - DNA, 22 bp, Artificial Sequence
  chemically synthesized
ggcaggtgccctggacatctgg

SEQ ID NO: 994085 - DNA, 22 bp, Artificial Sequence
  chemically synthesized
tcagggaatctgccagatgtcc

SEQ ID NO: 994086 - DNA, 22 bp, Artificial Sequence
  chemically synthesized
gcaggtgccctggacatctggc

SEQ ID NO: 994087 - DNA, 22 bp, Artificial Sequence
  chemically synthesized
tctcagggaatctgccagatgt

SEQ ID NO: 994088 - DNA, 22 bp, Artificial Sequence
  chemically synthesized
ttctctcagggaatctgccaga

SEQ ID NO: 994089 - DNA, 22 bp, Artificial Sequence
  chemically synthesized
gttctctcagggaatctgccag

SEQ ID NO: 994090 - DNA, 22 bp, Artificial Sequence
  chemically synthesized
tgttctctcagggaatctgcca

SEQ ID NO: 994091 - DNA, 22 bp, Artificial Sequence
  chemically synthesized
ttgttctctcagggaatctgcc

SEQ ID NO: 994092 - DNA, 22 bp, Artificial Sequence
  chemically synthesized
gacatctggcagattccctgag

SEQ ID NO: 994093 - DNA, 22 bp, Artificial Sequence
  chemically synthesized
agtttttgttctctcagggaat

SEQ ID NO: 994094 - DNA, 22 bp, Artificial Sequence
  chemically synthesized
tgagtttttgttctctcaggga

SEQ ID NO: 994095 - DNA, 22 bp, Artificial Sequence
  chemically synthesized
ctgagtttttgttctctcaggg

SEQ ID NO: 994096 - DNA, 22 bp, Artificial Sequence
  chemically synthesized
gcagattccctgagagaacaaa

SEQ ID NO: 994097 - DNA, 22 bp, Artificial Sequence
  chemically synthesized
gtagcttctgagtttttgttct

SEQ ID NO: 994098 - DNA, 22 bp, Artificial Sequence
  chemically synthesized
ggtagcttctgagtttttgttc

SEQ ID NO: 994099 - DNA, 22 bp, Artificial Sequence
  chemically synthesized
tggtagcttctgagtttttgtt

SEQ ID NO: 994100 - DNA, 22 bp, Artificial Sequence
  chemically synthesized
cctgagagaacaaaaactcaga

SEQ ID NO: 994101 - DNA, 22 bp, Artificial Sequence
  chemically synthesized
aatctttggtagcttctgagtt

SEQ ID NO: 994102 - DNA, 22 bp, Artificial Sequence
  chemically synthesized
caatctttggtagcttctgagt

SEQ ID NO: 994103 - DNA, 22 bp, Artificial Sequence
  chemically synthesized
agagaacaaaaactcagaagct

SEQ ID NO: 994104 - DNA, 22 bp, Artificial Sequence
  chemically synthesized
aagggagtatttcaatctttgg

SEQ ID NO: 994105 - DNA, 22 bp, Artificial Sequence
  chemically synthesized
agaagctaccaaagattgaaat

SEQ ID NO: 994106 - DNA, 22 bp, Artificial Sequence
  chemically synthesized
gtgggtattgaagggagtattt

SEQ ID NO: 994107 - DNA, 22 bp, Artificial Sequence
  chemically synthesized
ccaaagattgaaatactccctt

SEQ ID NO: 994108 - DNA, 22 bp, Artificial Sequence
  chemically synthesized
gttggtgggtattgaagggagt

SEQ ID NO: 994109 - DNA, 22 bp, Artificial Sequence
  chemically synthesized
ccctagttggtgggtattgaag

SEQ ID NO: 994110 - DNA, 22 bp, Artificial Sequence
  chemically synthesized
aaatactcccttcaatacccac

SEQ ID NO: 994111 - DNA, 22 bp, Artificial Sequence
  chemically synthesized
tataagctcccctagttggtgg

SEQ ID NO: 994112 - DNA, 22 bp, Artificial Sequence
  chemically synthesized
gtataagctcccctagttggtg

SEQ ID NO: 994113 - DNA, 22 bp, Artificial Sequence
  chemically synthesized
ccttcaatacccaccaactagg

SEQ ID NO: 994114 - DNA, 22 bp, Artificial Sequence
  chemically synthesized
caatacccaccaactaggggag

SEQ ID NO: 994115 - DNA, 22 bp, Artificial Sequence
  chemically synthesized
aatacccaccaactaggggagc

SEQ ID NO: 994116 - DNA, 22 bp, Artificial Sequence
  chemically synthesized
ggggagcttatacaagaccgtg

SEQ ID NO: 994117 - DNA, 22 bp, Artificial Sequence
  chemically synthesized
atacaagaccgtgggtttcttt

SEQ ID NO: 994118 - DNA, 22 bp, Artificial Sequence
  chemically synthesized
tacaagaccgtgggtttctttc

SEQ ID NO: 994119 - DNA, 22 bp, Artificial Sequence
  chemically synthesized
tgtaaataaaagaacaaagtag

SEQ ID NO: 994120 - DNA, 22 bp, Artificial Sequence
  chemically synthesized
ttatgtaaataaaagaacaaag

SEQ ID NO: 994121 - DNA, 22 bp, Artificial Sequence
  chemically synthesized
ctattatgtaaataaaagaaca

SEQ ID NO: 994122 - DNA, 22 bp, Artificial Sequence
  chemically synthesized
ctttctactttgttcttttatt

SEQ ID NO: 994123 - DNA, 22 bp, Artificial Sequence
  chemically synthesized
tttctactttgttcttttattt

SEQ ID NO: 994124 - DNA, 22 bp, Artificial Sequence
  chemically synthesized
tctactttgttcttttatttac

SEQ ID NO: 994125 - DNA, 22 bp, Artificial Sequence
  chemically synthesized
ctactttgttcttttatttaca

SEQ ID NO: 994126 - DNA, 22 bp, Artificial Sequence
  chemically synthesized
tcattgctattatgtaaataaa

SEQ ID NO: 994127 - DNA, 22 bp, Artificial Sequence
  chemically synthesized
tactttgttcttttatttacat

SEQ ID NO: 994128 - DNA, 22 bp, Artificial Sequence
  chemically synthesized
ctttgttcttttatttacataa

SEQ ID NO: 994129 - DNA, 22 bp, Artificial Sequence
  chemically synthesized
tgttcttttatttacataatag

SEQ ID NO: 994130 - DNA, 22 bp, Artificial Sequence
  chemically synthesized
gttcttttatttacataatagc

SEQ ID NO: 994131 - DNA, 22 bp, Artificial Sequence
  chemically synthesized
ttcttttatttacataatagca

SEQ ID NO: 994132 - DNA, 22 bp, Artificial Sequence
  chemically synthesized
ttttatttacataatagcaatg

SEQ ID NO: 994133 - DNA, 22 bp, Artificial Sequence
  chemically synthesized
ttatttacataatagcaatgat

SEQ ID NO: 994134 - DNA, 22 bp, Artificial Sequence
  chemically synthesized
tatttacataatagcaatgata

SEQ ID NO: 994135 - DNA, 22 bp, Artificial Sequence
  chemically synthesized
caacaaagatattatcattgct

SEQ ID NO: 994136 - DNA, 22 bp, Artificial Sequence
  chemically synthesized
atttacataatagcaatgataa

SEQ ID NO: 994137 - DNA, 22 bp, Artificial Sequence
  chemically synthesized
tttacataatagcaatgataat

SEQ ID NO: 994138 - DNA, 22 bp, Artificial Sequence
  chemically synthesized
tacaacaaagatattatcattg

SEQ ID NO: 994139 - DNA, 22 bp, Artificial Sequence
  chemically synthesized
acataatagcaatgataatatc

SEQ ID NO: 994140 - DNA, 22 bp, Artificial Sequence
  chemically synthesized
cataatagcaatgataatatct

SEQ ID NO: 994141 - DNA, 22 bp, Artificial Sequence
  chemically synthesized
cgagtaattctacaacaaagat

SEQ ID NO: 994142 - DNA, 22 bp, Artificial Sequence
  chemically synthesized
atcctccgagtaattctacaac

SEQ ID NO: 994143 - DNA, 22 bp, Artificial Sequence
  chemically synthesized
aatcctccgagtaattctacaa

SEQ ID NO: 994144 - DNA, 22 bp, Artificial Sequence
  chemically synthesized
tatttaatcctccgagtaattc

SEQ ID NO: 994145 - DNA, 22 bp, Artificial Sequence
  chemically synthesized
gtatttaatcctccgagtaatt

SEQ ID NO: 994146 - DNA, 22 bp, Artificial Sequence
  chemically synthesized
ttgtatttaatcctccgagtaa

SEQ ID NO: 994147 - DNA, 22 bp, Artificial Sequence
  chemically synthesized
cttgtatttaatcctccgagta

SEQ ID NO: 994148 - DNA, 22 bp, Artificial Sequence
  chemically synthesized
tgttgtagaattactcggagga

SEQ ID NO: 994149 - DNA, 22 bp, Artificial Sequence
  chemically synthesized
tcttgtatttaatcctccgagt

SEQ ID NO: 994150 - DNA, 22 bp, Artificial Sequence
  chemically synthesized
gttgtagaattactcggaggat

SEQ ID NO: 994151 - DNA, 22 bp, Artificial Sequence
  chemically synthesized
ttgtagaattactcggaggatt

SEQ ID NO: 994152 - DNA, 22 bp, Artificial Sequence
  chemically synthesized
tagaattactcggaggattaaa

SEQ ID NO: 994153 - DNA, 22 bp, Artificial Sequence
  chemically synthesized
taaatattttcttgtatttaat

SEQ ID NO: 994154 - DNA, 22 bp, Artificial Sequence
  chemically synthesized
ctcggaggattaaatacaagaa

SEQ ID NO: 994155 - DNA, 22 bp, Artificial Sequence
  chemically synthesized
ggaggattaaatacaagaaaat

SEQ ID NO: 994156 - DNA, 22 bp, Artificial Sequence
  chemically synthesized
ggtactgtaaatattttcttgt

SEQ ID NO: 994157 - DNA, 22 bp, Artificial Sequence
  chemically synthesized
agtgctaggtactgtaaatatt

SEQ ID NO: 994158 - DNA, 22 bp, Artificial Sequence
  chemically synthesized
aatacaagaaaatatttacagt

SEQ ID NO: 994159 - DNA, 22 bp, Artificial Sequence
  chemically synthesized
ttaagtgctaggtactgtaaat

SEQ ID NO: 994160 - DNA, 22 bp, Artificial Sequence
  chemically synthesized
attaagtgctaggtactgtaaa

SEQ ID NO: 994161 - DNA, 22 bp, Artificial Sequence
  chemically synthesized
agagtttattaagtgctaggta

SEQ ID NO: 994162 - DNA, 22 bp, Artificial Sequence
  chemically synthesized
acagtacctagcacttaataaa

SEQ ID NO: 994163 - DNA, 22 bp, Artificial Sequence
  chemically synthesized
cagtacctagcacttaataaac

SEQ ID NO: 994164 - DNA, 22 bp, Artificial Sequence
  chemically synthesized
atatatattgagagtttattaa

SEQ ID NO: 994165 - DNA, 22 bp, Artificial Sequence
  chemically synthesized
gcacttaataaactctcaatat

SEQ ID NO: 994166 - DNA, 22 bp, Artificial Sequence
  chemically synthesized
aataaactctcaatatatatta

SEQ ID NO: 994167 - DNA, 22 bp, Artificial Sequence
  chemically synthesized
ataaactctcaatatatattaa

SEQ ID NO: 994168 - DNA, 22 bp, Artificial Sequence
  chemically synthesized
tcaatatatattaattttcccc

SEQ ID NO: 994169 - DNA, 22 bp, Artificial Sequence
  chemically synthesized
aatatatattaattttccccac

SEQ ID NO: 994170 - DNA, 22 bp, Artificial Sequence
  chemically synthesized
gtaacccagaagggagtgggga

SEQ ID NO: 994171 - DNA, 22 bp, Artificial Sequence
  chemically synthesized
agtaacccagaagggagtgggg

SEQ ID NO: 994172 - DNA, 22 bp, Artificial Sequence
  chemically synthesized
attttccccactcccttctggg

SEQ ID NO: 994173 - DNA, 22 bp, Artificial Sequence
  chemically synthesized
taggggtcttagtaacccagaa

SEQ ID NO: 994174 - DNA, 22 bp, Artificial Sequence
  chemically synthesized
tccccactcccttctgggttac

SEQ ID NO: 994175 - DNA, 22 bp, Artificial Sequence
  chemically synthesized
ataggggtcttagtaacccaga

SEQ ID NO: 994176 - DNA, 22 bp, Artificial Sequence
  chemically synthesized
ccccactcccttctgggttact

SEQ ID NO: 994177 - DNA, 22 bp, Artificial Sequence
  chemically synthesized
tataggggtcttagtaacccag

SEQ ID NO: 994178 - DNA, 22 bp, Artificial Sequence
  chemically synthesized
cccactcccttctgggttacta

SEQ ID NO: 994179 - DNA, 22 bp, Artificial Sequence
  chemically synthesized
cattttataggggtcttagtaa

SEQ ID NO: 994180 - DNA, 22 bp, Artificial Sequence
  chemically synthesized
gcattttataggggtcttagta

SEQ ID NO: 994181 - DNA, 22 bp, Artificial Sequence
  chemically synthesized
ccttctgggttactaagacccc

SEQ ID NO: 994182 - DNA, 22 bp, Artificial Sequence
  chemically synthesized
ctgggttactaagacccctata

SEQ ID NO: 994183 - DNA, 22 bp, Artificial Sequence
  chemically synthesized
tgggttactaagacccctataa

SEQ ID NO: 994184 - DNA, 22 bp, Artificial Sequence
  chemically synthesized
ggttactaagacccctataaaa

SEQ ID NO: 994185 - DNA, 22 bp, Artificial Sequence
  chemically synthesized
ctaagacccctataaaatgcaa

SEQ ID NO: 994186 - DNA, 22 bp, Artificial Sequence
  chemically synthesized
tgatgtaaataaatttgcattt

SEQ ID NO: 994187 - DNA, 22 bp, Artificial Sequence
  chemically synthesized
agacccctataaaatgcaaatt

SEQ ID NO: 994188 - DNA, 22 bp, Artificial Sequence
  chemically synthesized
ctgtgatgtaaataaatttgca

SEQ ID NO: 994189 - DNA, 22 bp, Artificial Sequence
  chemically synthesized
taaaatgcaaatttatttacat

SEQ ID NO: 994190 - DNA, 22 bp, Artificial Sequence
  chemically synthesized
gtgactactgtgatgtaaataa

SEQ ID NO: 994191 - DNA, 22 bp, Artificial Sequence
  chemically synthesized
aaaaatattagtgactactgtg

SEQ ID NO: 994192 - DNA, 22 bp, Artificial Sequence
  chemically synthesized
caaaaatattagtgactactgt

SEQ ID NO: 994193 - DNA, 22 bp, Artificial Sequence
  chemically synthesized
tcaaaaatattagtgactactg

SEQ ID NO: 994194 - DNA, 22 bp, Artificial Sequence
  chemically synthesized
ttcaaaaatattagtgactact

SEQ ID NO: 994195 - DNA, 22 bp, Artificial Sequence
  chemically synthesized
atttacatcacagtagtcacta

SEQ ID NO: 994196 - DNA, 22 bp, Artificial Sequence
  chemically synthesized
tttacatcacagtagtcactaa

SEQ ID NO: 994197 - DNA, 22 bp, Artificial Sequence
  chemically synthesized
acatcacagtagtcactaatat

SEQ ID NO: 994198 - DNA, 22 bp, Artificial Sequence
  chemically synthesized
aacttttcaaaaatattagtga

SEQ ID NO: 994199 - DNA, 22 bp, Artificial Sequence
  chemically synthesized
catcacagtagtcactaatatt

SEQ ID NO: 994200 - DNA, 22 bp, Artificial Sequence
  chemically synthesized
actcaacttttcaaaaatatta

SEQ ID NO: 994201 - DNA, 22 bp, Artificial Sequence
  chemically synthesized
aattaactcaacttttcaaaaa

SEQ ID NO: 994202 - DNA, 22 bp, Artificial Sequence
  chemically synthesized
attcaattaactcaacttttca

SEQ ID NO: 994203 - DNA, 22 bp, Artificial Sequence
  chemically synthesized
ctaattcaattaactcaacttt

SEQ ID NO: 994204 - DNA, 22 bp, Artificial Sequence
  chemically synthesized
cctaattcaattaactcaactt

SEQ ID NO: 994205 - DNA, 22 bp, Artificial Sequence
  chemically synthesized
atatttttgaaaagttgagtta

SEQ ID NO: 994206 - DNA, 22 bp, Artificial Sequence
  chemically synthesized
ttgaaaagttgagttaattgaa

SEQ ID NO: 994207 - DNA, 22 bp, Artificial Sequence
  chemically synthesized
tgaaaagttgagttaattgaat

SEQ ID NO: 994208 - DNA, 22 bp, Artificial Sequence
  chemically synthesized
gaaaagttgagttaattgaatt

SEQ ID NO: 994209 - DNA, 22 bp, Artificial Sequence
  chemically synthesized
aaaagttgagttaattgaatta

SEQ ID NO: 994210 - DNA, 22 bp, Artificial Sequence
  chemically synthesized
taacaggcttcctaattcaatt

SEQ ID NO: 994211 - DNA, 22 bp, Artificial Sequence
  chemically synthesized
ataacaggcttcctaattcaat

SEQ ID NO: 994212 - DNA, 22 bp, Artificial Sequence
  chemically synthesized
tataacaggcttcctaattcaa

SEQ ID NO: 994213 - DNA, 22 bp, Artificial Sequence
  chemically synthesized
tttataacaggcttcctaattc

SEQ ID NO: 994214 - DNA, 22 bp, Artificial Sequence
  chemically synthesized
ttctttataacaggcttcctaa

SEQ ID NO: 994215 - DNA, 22 bp, Artificial Sequence
  chemically synthesized
agttaattgaattaggaagcct

SEQ ID NO: 994216 - DNA, 22 bp, Artificial Sequence
  chemically synthesized
attctttataacaggcttccta

SEQ ID NO: 994217 - DNA, 22 bp, Artificial Sequence
  chemically synthesized
attgaattaggaagcctgttat

SEQ ID NO: 994218 - DNA, 22 bp, Artificial Sequence
  chemically synthesized
agggcttattctttataacagg

SEQ ID NO: 994219 - DNA, 22 bp, Artificial Sequence
  chemically synthesized
aattaggaagcctgttataaag

SEQ ID NO: 994220 - DNA, 22 bp, Artificial Sequence
  chemically synthesized
ctcagggcttattctttataac

SEQ ID NO: 994221 - DNA, 22 bp, Artificial Sequence
  chemically synthesized
actcagggcttattctttataa

SEQ ID NO: 994222 - DNA, 22 bp, Artificial Sequence
  chemically synthesized
tactcagggcttattctttata

SEQ ID NO: 994223 - DNA, 22 bp, Artificial Sequence
  chemically synthesized
ggaagcctgttataaagaataa

SEQ ID NO: 994224 - DNA, 22 bp, Artificial Sequence
  chemically synthesized
tttactcagggcttattcttta

SEQ ID NO: 994225 - DNA, 22 bp, Artificial Sequence
  chemically synthesized
ttataaagaataagccctgagt

SEQ ID NO: 994226 - DNA, 22 bp, Artificial Sequence
  chemically synthesized
taaagaataagccctgagtaaa

SEQ ID NO: 994227 - DNA, 22 bp, Artificial Sequence
  chemically synthesized
gagaacataatacacatcctct

SEQ ID NO: 994228 - DNA, 22 bp, Artificial Sequence
  chemically synthesized
agagaacataatacacatcctc

SEQ ID NO: 994229 - DNA, 22 bp, Artificial Sequence
  chemically synthesized
agtaaagaggatgtgtattatg

SEQ ID NO: 994230 - DNA, 22 bp, Artificial Sequence
  chemically synthesized
acataccttagagaacataata

SEQ ID NO: 994231 - DNA, 22 bp, Artificial Sequence
  chemically synthesized
cacataccttagagaacataat

SEQ ID NO: 994232 - DNA, 22 bp, Artificial Sequence
  chemically synthesized
acacacttcacataccttagag

SEQ ID NO: 994233 - DNA, 22 bp, Artificial Sequence
  chemically synthesized
cacacacttcacataccttaga

SEQ ID NO: 994234 - DNA, 22 bp, Artificial Sequence
  chemically synthesized
tcacacacttcacataccttag

SEQ ID NO: 994235 - DNA, 22 bp, Artificial Sequence
  chemically synthesized
ttcacacacttcacatacctta

SEQ ID NO: 994236 - DNA, 22 bp, Artificial Sequence
  chemically synthesized
ttttcacacacttcacatacct

SEQ ID NO: 994237 - DNA, 22 bp, Artificial Sequence
  chemically synthesized
cttttcacacacttcacatacc

SEQ ID NO: 994238 - DNA, 22 bp, Artificial Sequence
  chemically synthesized
tgttctctaaggtatgtgaagt

SEQ ID NO: 994239 - DNA, 22 bp, Artificial Sequence
  chemically synthesized
gaccttcttttcacacacttca

SEQ ID NO: 994240 - DNA, 22 bp, Artificial Sequence
  chemically synthesized
tctaaggtatgtgaagtgtgtg

SEQ ID NO: 994241 - DNA, 22 bp, Artificial Sequence
  chemically synthesized
ggaccttcttttcacacacttc

SEQ ID NO: 994242 - DNA, 22 bp, Artificial Sequence
  chemically synthesized
tggaccttcttttcacacactt

SEQ ID NO: 994243 - DNA, 22 bp, Artificial Sequence
  chemically synthesized
taaggtatgtgaagtgtgtgaa

SEQ ID NO: 994244 - DNA, 22 bp, Artificial Sequence
  chemically synthesized
ttggaccttcttttcacacact

SEQ ID NO: 994245 - DNA, 22 bp, Artificial Sequence
  chemically synthesized
tttggaccttcttttcacacac

SEQ ID NO: 994246 - DNA, 22 bp, Artificial Sequence
  chemically synthesized
aggtatgtgaagtgtgtgaaaa

SEQ ID NO: 994247 - DNA, 22 bp, Artificial Sequence
  chemically synthesized
ttttggaccttcttttcacaca

SEQ ID NO: 994248 - DNA, 22 bp, Artificial Sequence
  chemically synthesized
cttttttggaccttcttttcac

SEQ ID NO: 994249 - DNA, 22 bp, Artificial Sequence
  chemically synthesized
aagcaagccctccttttttgga

SEQ ID NO: 994250 - DNA, 22 bp, Artificial Sequence
  chemically synthesized
gatatcagtcatctcaagcaag

SEQ ID NO: 994251 - DNA, 22 bp, Artificial Sequence
  chemically synthesized
ggatatcagtcatctcaagcaa

SEQ ID NO: 994252 - DNA, 22 bp, Artificial Sequence
  chemically synthesized
ttggatatcagtcatctcaagc

SEQ ID NO: 994253 - DNA, 22 bp, Artificial Sequence
  chemically synthesized
cttggatatcagtcatctcaag

SEQ ID NO: 994254 - DNA, 22 bp, Artificial Sequence
  chemically synthesized
tcttcttggatatcagtcatct

SEQ ID NO: 994255 - DNA, 22 bp, Artificial Sequence
  chemically synthesized
gcttgagatgactgatatccaa

SEQ ID NO: 994256 - DNA, 22 bp, Artificial Sequence
  chemically synthesized
cttgagatgactgatatccaag

SEQ ID NO: 994257 - DNA, 22 bp, Artificial Sequence
  chemically synthesized
gggtgtactatcttcttggata

SEQ ID NO: 994258 - DNA, 22 bp, Artificial Sequence
  chemically synthesized
gagatgactgatatccaagaag

SEQ ID NO: 994259 - DNA, 22 bp, Artificial Sequence
  chemically synthesized
agatgactgatatccaagaaga

SEQ ID NO: 994260 - DNA, 22 bp, Artificial Sequence
  chemically synthesized
acagctagggtgtactatcttc

SEQ ID NO: 994261 - DNA, 22 bp, Artificial Sequence
  chemically synthesized
tgacagctagggtgtactatct

SEQ ID NO: 994262 - DNA, 22 bp, Artificial Sequence
  chemically synthesized
atatccaagaagatagtacacc

SEQ ID NO: 994263 - DNA, 22 bp, Artificial Sequence
  chemically synthesized
aagtcaatggttctgacagcta

SEQ ID NO: 994264 - DNA, 22 bp, Artificial Sequence
  chemically synthesized
aaagtcaatggttctgacagct

SEQ ID NO: 994265 - DNA, 22 bp, Artificial Sequence
  chemically synthesized
agcccttaaagtcaatggttct

SEQ ID NO: 994266 - DNA, 22 bp, Artificial Sequence
  chemically synthesized
cagcccttaaagtcaatggttc

SEQ ID NO: 994267 - DNA, 22 bp, Artificial Sequence
  chemically synthesized
gctgtcagaaccattgacttta

SEQ ID NO: 994268 - DNA, 22 bp, Artificial Sequence
  chemically synthesized
tcagaaccattgactttaaggg

SEQ ID NO: 994269 - DNA, 22 bp, Artificial Sequence
  chemically synthesized
tgatatcttcagcccttaaagt

SEQ ID NO: 994270 - DNA, 22 bp, Artificial Sequence
  chemically synthesized
atgatatcttcagcccttaaag

SEQ ID NO: 994271 - DNA, 22 bp, Artificial Sequence
  chemically synthesized
tatgatatcttcagcccttaaa

SEQ ID NO: 994272 - DNA, 22 bp, Artificial Sequence
  chemically synthesized
actttaagggctgaagatatca

SEQ ID NO: 994273 - DNA, 22 bp, Artificial Sequence
  chemically synthesized
taagggctgaagatatcataaa

SEQ ID NO: 994274 - DNA, 22 bp, Artificial Sequence
  chemically synthesized
aagggctgaagatatcataaaa

SEQ ID NO: 994275 - DNA, 22 bp, Artificial Sequence
  chemically synthesized
caaaatggatagttttatgata

SEQ ID NO: 994276 - DNA, 22 bp, Artificial Sequence
  chemically synthesized
agggctgaagatatcataaaac

SEQ ID NO: 994277 - DNA, 22 bp, Artificial Sequence
  chemically synthesized
atctgcaaaatggatagtttta

SEQ ID NO: 994278 - DNA, 22 bp, Artificial Sequence
  chemically synthesized
aagatatcataaaactatccat

SEQ ID NO: 994279 - DNA, 22 bp, Artificial Sequence
  chemically synthesized
agtgtcctcatctgcaaaatgg

SEQ ID NO: 994280 - DNA, 22 bp, Artificial Sequence
  chemically synthesized
gcctcagtgtcctcatctgcaa

SEQ ID NO: 994281 - DNA, 22 bp, Artificial Sequence
  chemically synthesized
agcctcagtgtcctcatctgca

SEQ ID NO: 994282 - DNA, 22 bp, Artificial Sequence
  chemically synthesized
tccattttgcagatgaggacac

SEQ ID NO: 994283 - DNA, 22 bp, Artificial Sequence
  chemically synthesized
accgaacttagcctcagtgtcc

SEQ ID NO: 994284 - DNA, 22 bp, Artificial Sequence
  chemically synthesized
caccgaacttagcctcagtgtc

SEQ ID NO: 994285 - DNA, 22 bp, Artificial Sequence
  chemically synthesized
tgcagatgaggacactgaggct

SEQ ID NO: 994286 - DNA, 22 bp, Artificial Sequence
  chemically synthesized
gcagatgaggacactgaggcta

SEQ ID NO: 994287 - DNA, 22 bp, Artificial Sequence
  chemically synthesized
tttcaccgaacttagcctcagt

SEQ ID NO: 994288 - DNA, 22 bp, Artificial Sequence
  chemically synthesized
cagatgaggacactgaggctaa

SEQ ID NO: 994289 - DNA, 22 bp, Artificial Sequence
  chemically synthesized
ggcaagttatttcaccgaactt

SEQ ID NO: 994290 - DNA, 22 bp, Artificial Sequence
  chemically synthesized
aggctaagttcggtgaaataac

SEQ ID NO: 994291 - DNA, 22 bp, Artificial Sequence
  chemically synthesized
aggcctaggcaagttatttcac

SEQ ID NO: 994292 - DNA, 22 bp, Artificial Sequence
  chemically synthesized
taaggcctaggcaagttatttc

SEQ ID NO: 994293 - DNA, 22 bp, Artificial Sequence
  chemically synthesized
agttcggtgaaataacttgcct

SEQ ID NO: 994294 - DNA, 22 bp, Artificial Sequence
  chemically synthesized
actctaaggcctaggcaagtta

SEQ ID NO: 994295 - DNA, 22 bp, Artificial Sequence
  chemically synthesized
taactctaaggcctaggcaagt

SEQ ID NO: 994296 - DNA, 22 bp, Artificial Sequence
  chemically synthesized
ggtgaaataacttgcctaggcc

SEQ ID NO: 994297 - DNA, 22 bp, Artificial Sequence
  chemically synthesized
gtgttctaactctaaggcctag

SEQ ID NO: 994298 - DNA, 22 bp, Artificial Sequence
  chemically synthesized
ctagtgttctaactctaaggcc

SEQ ID NO: 994299 - DNA, 22 bp, Artificial Sequence
  chemically synthesized
gctagtgttctaactctaaggc

SEQ ID NO: 994300 - DNA, 22 bp, Artificial Sequence
  chemically synthesized
ccttgctagtgttctaactcta

SEQ ID NO: 994301 - DNA, 22 bp, Artificial Sequence
  chemically synthesized
gcctaggccttagagttagaac

SEQ ID NO: 994302 - DNA, 22 bp, Artificial Sequence
  chemically synthesized
cctaggccttagagttagaaca

SEQ ID NO: 994303 - DNA, 22 bp, Artificial Sequence
  chemically synthesized
ggccttagagttagaacactag

SEQ ID NO: 994304 - DNA, 22 bp, Artificial Sequence
  chemically synthesized
aatcctgccttgctagtgttct

SEQ ID NO: 994305 - DNA, 22 bp, Artificial Sequence
  chemically synthesized
caatcctgccttgctagtgttc

SEQ ID NO: 994306 - DNA, 22 bp, Artificial Sequence
  chemically synthesized
agagttagaacactagcaaggc

SEQ ID NO: 994307 - DNA, 22 bp, Artificial Sequence
  chemically synthesized
ggtttcaatcctgccttgctag

SEQ ID NO: 994308 - DNA, 22 bp, Artificial Sequence
  chemically synthesized
gagttagaacactagcaaggca

SEQ ID NO: 994309 - DNA, 22 bp, Artificial Sequence
  chemically synthesized
actaggtttcaatcctgccttg

SEQ ID NO: 994310 - DNA, 22 bp, Artificial Sequence
  chemically synthesized
gaacactagcaaggcaggattg

SEQ ID NO: 994311 - DNA, 22 bp, Artificial Sequence
  chemically synthesized
attcactaggtttcaatcctgc

SEQ ID NO: 994312 - DNA, 22 bp, Artificial Sequence
  chemically synthesized
tcattcactaggtttcaatcct

SEQ ID NO: 994313 - DNA, 22 bp, Artificial Sequence
  chemically synthesized
gcaaggcaggattgaaacctag

SEQ ID NO: 994314 - DNA, 22 bp, Artificial Sequence
  chemically synthesized
aagcctctcattcactaggttt

SEQ ID NO: 994315 - DNA, 22 bp, Artificial Sequence
  chemically synthesized
gaagcctctcattcactaggtt

SEQ ID NO: 994316 - DNA, 22 bp, Artificial Sequence
  chemically synthesized
tgaagcctctcattcactaggt

SEQ ID NO: 994317 - DNA, 22 bp, Artificial Sequence
  chemically synthesized
ttgaagcctctcattcactagg

SEQ ID NO: 994318 - DNA, 22 bp, Artificial Sequence
  chemically synthesized
tttgaagcctctcattcactag

SEQ ID NO: 994319 - DNA, 22 bp, Artificial Sequence
  chemically synthesized
tttttgaagcctctcattcact

SEQ ID NO: 994320 - DNA, 22 bp, Artificial Sequence
  chemically synthesized
ctttttgaagcctctcattcac

SEQ ID NO: 994321 - DNA, 22 bp, Artificial Sequence
  chemically synthesized
tctttttgaagcctctcattca

SEQ ID NO: 994322 - DNA, 22 bp, Artificial Sequence
  chemically synthesized
tttctttttgaagcctctcatt

SEQ ID NO: 994323 - DNA, 22 bp, Artificial Sequence
  chemically synthesized
ctttctttttgaagcctctcat

SEQ ID NO: 994324 - DNA, 22 bp, Artificial Sequence
  chemically synthesized
aaacctagtgaatgagaggctt

SEQ ID NO: 994325 - DNA, 22 bp, Artificial Sequence
  chemically synthesized
tctttctttttgaagcctctca

SEQ ID NO: 994326 - DNA, 22 bp, Artificial Sequence
  chemically synthesized
ttttctttctttttgaagcctc

SEQ ID NO: 994327 - DNA, 22 bp, Artificial Sequence
  chemically synthesized
gtgaatgagaggcttcaaaaag

SEQ ID NO: 994328 - DNA, 22 bp, Artificial Sequence
  chemically synthesized
tgtccacattgttttctttctt

SEQ ID NO: 994329 - DNA, 22 bp, Artificial Sequence
  chemically synthesized
cctgtgtccacattgttttctt

SEQ ID NO: 994330 - DNA, 22 bp, Artificial Sequence
  chemically synthesized
ccctgtgtccacattgttttct

SEQ ID NO: 994331 - DNA, 22 bp, Artificial Sequence
  chemically synthesized
tccctgtgtccacattgttttc

SEQ ID NO: 994332 - DNA, 22 bp, Artificial Sequence
  chemically synthesized
ttccctgtgtccacattgtttt

SEQ ID NO: 994333 - DNA, 22 bp, Artificial Sequence
  chemically synthesized
caaaaagaaagaaaacaatgtg

SEQ ID NO: 994334 - DNA, 22 bp, Artificial Sequence
  chemically synthesized
aaaaagaaagaaaacaatgtgg

SEQ ID NO: 994335 - DNA, 22 bp, Artificial Sequence
  chemically synthesized
accttttccctgtgtccacatt

SEQ ID NO: 994336 - DNA, 22 bp, Artificial Sequence
  chemically synthesized
cctcaccttttccctgtgtcca

SEQ ID NO: 994337 - DNA, 22 bp, Artificial Sequence
  chemically synthesized
tccctcaccttttccctgtgtc

SEQ ID NO: 994338 - DNA, 22 bp, Artificial Sequence
  chemically synthesized
atgctctccctcaccttttccc

SEQ ID NO: 994339 - DNA, 22 bp, Artificial Sequence
  chemically synthesized
tcctaatgctctccctcacctt

SEQ ID NO: 994340 - DNA, 22 bp, Artificial Sequence
  chemically synthesized
gtcctaatgctctccctcacct

SEQ ID NO: 994341 - DNA, 22 bp, Artificial Sequence
  chemically synthesized
ggtatttgtcctaatgctctcc

SEQ ID NO: 994342 - DNA, 22 bp, Artificial Sequence
  chemically synthesized
agccccacatgcattaggtatt

SEQ ID NO: 994343 - DNA, 22 bp, Artificial Sequence
  chemically synthesized
aagccccacatgcattaggtat

SEQ ID NO: 994344 - DNA, 22 bp, Artificial Sequence
  chemically synthesized
taagccccacatgcattaggta

SEQ ID NO: 994345 - DNA, 22 bp, Artificial Sequence
  chemically synthesized
ggacaaatacctaatgcatgtg

SEQ ID NO: 994346 - DNA, 22 bp, Artificial Sequence
  chemically synthesized
ggttttaagccccacatgcatt

SEQ ID NO: 994347 - DNA, 22 bp, Artificial Sequence
  chemically synthesized
atgcatgtggggcttaaaacct

SEQ ID NO: 994348 - DNA, 22 bp, Artificial Sequence
  chemically synthesized
cacccatcaacccgtcatctag

SEQ ID NO: 994349 - DNA, 22 bp, Artificial Sequence
  chemically synthesized
ctgcacccatcaacccgtcatc

SEQ ID NO: 994350 - DNA, 22 bp, Artificial Sequence
  chemically synthesized
gctgcacccatcaacccgtcat

SEQ ID NO: 994351 - DNA, 22 bp, Artificial Sequence
  chemically synthesized
aaaacctagatgacgggttgat

SEQ ID NO: 994352 - DNA, 22 bp, Artificial Sequence
  chemically synthesized
aaacctagatgacgggttgatg

SEQ ID NO: 994353 - DNA, 22 bp, Artificial Sequence
  chemically synthesized
gatgacgggttgatgggtgcag

SEQ ID NO: 994354 - DNA, 22 bp, Artificial Sequence
  chemically synthesized
ccacggtggtttgctgcaccca

SEQ ID NO: 994355 - DNA, 22 bp, Artificial Sequence
  chemically synthesized
gccacggtggtttgctgcaccc

SEQ ID NO: 994356 - DNA, 22 bp, Artificial Sequence
  chemically synthesized
atgggtgcagcaaaccaccgtg

SEQ ID NO: 994357 - DNA, 22 bp, Artificial Sequence
  chemically synthesized
cataggtatacatttgccacgg

SEQ ID NO: 994358 - DNA, 22 bp, Artificial Sequence
  chemically synthesized
ttacataggtatacatttgcca

SEQ ID NO: 994359 - DNA, 22 bp, Artificial Sequence
  chemically synthesized
gttacataggtatacatttgcc

SEQ ID NO: 994360 - DNA, 22 bp, Artificial Sequence
  chemically synthesized
ggatacacgtgcagaatgtaca

SEQ ID NO: 994361 - DNA, 22 bp, Artificial Sequence
  chemically synthesized
tgtaacaaacctgtacattctg

SEQ ID NO: 994362 - DNA, 22 bp, Artificial Sequence
  chemically synthesized
tgggatacacgtgcagaatgta

SEQ ID NO: 994363 - DNA, 22 bp, Artificial Sequence
  chemically synthesized
agttctgggatacacgtgcaga

SEQ ID NO: 994364 - DNA, 22 bp, Artificial Sequence
  chemically synthesized
aagttctgggatacacgtgcag

SEQ ID NO: 994365 - DNA, 22 bp, Artificial Sequence
  chemically synthesized
taagttctgggatacacgtgca

SEQ ID NO: 994366 - DNA, 22 bp, Artificial Sequence
  chemically synthesized
tacattctgcacgtgtatccca

SEQ ID NO: 994367 - DNA, 22 bp, Artificial Sequence
  chemically synthesized
tactttaagttctgggatacac

SEQ ID NO: 994368 - DNA, 22 bp, Artificial Sequence
  chemically synthesized
ttatactttaagttctgggata

SEQ ID NO: 994369 - DNA, 22 bp, Artificial Sequence
  chemically synthesized
ttattatactttaagttctggg

SEQ ID NO: 994370 - DNA, 22 bp, Artificial Sequence
  chemically synthesized
tgcacgtgtatcccagaactta

SEQ ID NO: 994371 - DNA, 22 bp, Artificial Sequence
  chemically synthesized
attattatactttaagttctgg

SEQ ID NO: 994372 - DNA, 22 bp, Artificial Sequence
  chemically synthesized
tattattatactttaagttctg

SEQ ID NO: 994373 - DNA, 22 bp, Artificial Sequence
  chemically synthesized
cacgtgtatcccagaacttaaa

SEQ ID NO: 994374 - DNA, 22 bp, Artificial Sequence
  chemically synthesized
ttattattatactttaagttct

SEQ ID NO: 994375 - DNA, 22 bp, Artificial Sequence
  chemically synthesized
tttattattatactttaagttc

SEQ ID NO: 994376 - DNA, 22 bp, Artificial Sequence
  chemically synthesized
ttttattattatactttaagtt

SEQ ID NO: 994377 - DNA, 22 bp, Artificial Sequence
  chemically synthesized
ttttttattattatactttaag

SEQ ID NO: 994378 - DNA, 22 bp, Artificial Sequence
  chemically synthesized
cttttttattattatactttaa

SEQ ID NO: 994379 - DNA, 22 bp, Artificial Sequence
  chemically synthesized
tcttttttattattatacttta

SEQ ID NO: 994380 - DNA, 22 bp, Artificial Sequence
  chemically synthesized
tttcttttttattattatactt

SEQ ID NO: 994381 - DNA, 22 bp, Artificial Sequence
  chemically synthesized
ctttcttttttattattatact

SEQ ID NO: 994382 - DNA, 22 bp, Artificial Sequence
  chemically synthesized
cttctttcttttttattattat

SEQ ID NO: 994383 - DNA, 22 bp, Artificial Sequence
  chemically synthesized
ccttctttcttttttattatta

SEQ ID NO: 994384 - DNA, 22 bp, Artificial Sequence
  chemically synthesized
tccttctttcttttttattatt

SEQ ID NO: 994385 - DNA, 22 bp, Artificial Sequence
  chemically synthesized
ttttccttctttcttttttatt

SEQ ID NO: 994386 - DNA, 22 bp, Artificial Sequence
  chemically synthesized
aaagtataataataaaaaagaa

SEQ ID NO: 994387 - DNA, 22 bp, Artificial Sequence
  chemically synthesized
aagtataataataaaaaagaaa

SEQ ID NO: 994388 - DNA, 22 bp, Artificial Sequence
  chemically synthesized
acattgttttccttctttcttt

SEQ ID NO: 994389 - DNA, 22 bp, Artificial Sequence
  chemically synthesized
cacattgttttccttctttctt

SEQ ID NO: 994390 - DNA, 22 bp, Artificial Sequence
  chemically synthesized
ttcacattgttttccttctttc

SEQ ID NO: 994391 - DNA, 22 bp, Artificial Sequence
  chemically synthesized
attcttcacattgttttccttc

SEQ ID NO: 994392 - DNA, 22 bp, Artificial Sequence
  chemically synthesized
cattcttcacattgttttcctt

SEQ ID NO: 994393 - DNA, 22 bp, Artificial Sequence
  chemically synthesized
tcattcttcacattgttttcct

SEQ ID NO: 994394 - DNA, 22 bp, Artificial Sequence
  chemically synthesized
ctttcattcttcacattgtttt

SEQ ID NO: 994395 - DNA, 22 bp, Artificial Sequence
  chemically synthesized
tcctgctttcattcttcacatt

SEQ ID NO: 994396 - DNA, 22 bp, Artificial Sequence
  chemically synthesized
cctatcctgctttcattcttca

SEQ ID NO: 994397 - DNA, 22 bp, Artificial Sequence
  chemically synthesized
ccctatcctgctttcattcttc

SEQ ID NO: 994398 - DNA, 22 bp, Artificial Sequence
  chemically synthesized
cttccctatcctgctttcattc

SEQ ID NO: 994399 - DNA, 22 bp, Artificial Sequence
  chemically synthesized
cctccttccctatcctgctttc

SEQ ID NO: 994400 - DNA, 22 bp, Artificial Sequence
  chemically synthesized
tagcgctccctccttccctatc

SEQ ID NO: 994401 - DNA, 22 bp, Artificial Sequence
  chemically synthesized
agctgtagcgctccctccttcc

SEQ ID NO: 994402 - DNA, 22 bp, Artificial Sequence
  chemically synthesized
accctgagctgtagcgctccct

SEQ ID NO: 994403 - DNA, 22 bp, Artificial Sequence
  chemically synthesized
caccctgagctgtagcgctccc

SEQ ID NO: 994404 - DNA, 22 bp, Artificial Sequence
  chemically synthesized
cagctcagggtgaagtcttgta

SEQ ID NO: 994405 - DNA, 22 bp, Artificial Sequence
  chemically synthesized
agggtgaagtcttgtatcccct

SEQ ID NO: 994406 - DNA, 22 bp, Artificial Sequence
  chemically synthesized
aggggacagaggcaaaggggat

SEQ ID NO: 994407 - DNA, 22 bp, Artificial Sequence
  chemically synthesized
ctaaggggacagaggcaaaggg

SEQ ID NO: 994408 - DNA, 22 bp, Artificial Sequence
  chemically synthesized
ctactaaggggacagaggcaaa

SEQ ID NO: 994409 - DNA, 22 bp, Artificial Sequence
  chemically synthesized
actactaaggggacagaggcaa

SEQ ID NO: 994410 - DNA, 22 bp, Artificial Sequence
  chemically synthesized
gtatcccctttgcctctgtccc

SEQ ID NO: 994411 - DNA, 22 bp, Artificial Sequence
  chemically synthesized
tatcccctttgcctctgtcccc

SEQ ID NO: 994412 - DNA, 22 bp, Artificial Sequence
  chemically synthesized
tgcctctgtccccttagtagta

SEQ ID NO: 994413 - DNA, 22 bp, Artificial Sequence
  chemically synthesized
gcctctgtccccttagtagtaa

SEQ ID NO: 994414 - DNA, 22 bp, Artificial Sequence
  chemically synthesized
cctctgtccccttagtagtaaa

SEQ ID NO: 994415 - DNA, 22 bp, Artificial Sequence
  chemically synthesized
accccgagaaatatttactact

SEQ ID NO: 994416 - DNA, 22 bp, Artificial Sequence
  chemically synthesized
tgtccccttagtagtaaatatt

SEQ ID NO: 994417 - DNA, 22 bp, Artificial Sequence
  chemically synthesized
attcaccccgagaaatatttac

SEQ ID NO: 994418 - DNA, 22 bp, Artificial Sequence
  chemically synthesized
tccccttagtagtaaatatttc

SEQ ID NO: 994419 - DNA, 22 bp, Artificial Sequence
  chemically synthesized
ctgattcaccccgagaaatatt

SEQ ID NO: 994420 - DNA, 22 bp, Artificial Sequence
  chemically synthesized
agtagtaaatatttctcggggt

SEQ ID NO: 994421 - DNA, 22 bp, Artificial Sequence
  chemically synthesized
gtagtaaatatttctcggggtg

SEQ ID NO: 994422 - DNA, 22 bp, Artificial Sequence
  chemically synthesized
agggatgttactgattcacccc

SEQ ID NO: 994423 - DNA, 22 bp, Artificial Sequence
  chemically synthesized
ctcggggtgaatcagtaacatc

SEQ ID NO: 994424 - DNA, 22 bp, Artificial Sequence
  chemically synthesized
tcggggtgaatcagtaacatcc

SEQ ID NO: 994425 - DNA, 22 bp, Artificial Sequence
  chemically synthesized
ggggtgaatcagtaacatccct

SEQ ID NO: 994426 - DNA, 22 bp, Artificial Sequence
  chemically synthesized
tatgagaggctgagggatgtta

SEQ ID NO: 994427 - DNA, 22 bp, Artificial Sequence
  chemically synthesized
tgtatgagaggctgagggatgt

SEQ ID NO: 994428 - DNA, 22 bp, Artificial Sequence
  chemically synthesized
ctgtatgagaggctgagggatg

SEQ ID NO: 994429 - DNA, 22 bp, Artificial Sequence
  chemically synthesized
gcacttctgtatgagaggctga

SEQ ID NO: 994430 - DNA, 22 bp, Artificial Sequence
  chemically synthesized
tggcacttctgtatgagaggct

SEQ ID NO: 994431 - DNA, 22 bp, Artificial Sequence
  chemically synthesized
agcctctcatacagaagtgcca

SEQ ID NO: 994432 - DNA, 22 bp, Artificial Sequence
  chemically synthesized
tcatacagaagtgccagagtgt

SEQ ID NO: 994433 - DNA, 22 bp, Artificial Sequence
  chemically synthesized
atacagaagtgccagagtgtga

SEQ ID NO: 994434 - DNA, 22 bp, Artificial Sequence
  chemically synthesized
atggcagaatagccagatcaca

SEQ ID NO: 994435 - DNA, 22 bp, Artificial Sequence
  chemically synthesized
aatggcagaatagccagatcac

SEQ ID NO: 994436 - DNA, 22 bp, Artificial Sequence
  chemically synthesized
aatgtttaatggcagaatagcc

SEQ ID NO: 994437 - DNA, 22 bp, Artificial Sequence
  chemically synthesized
gaatgtttaatggcagaatagc

SEQ ID NO: 994438 - DNA, 22 bp, Artificial Sequence
  chemically synthesized
tagaggatcttgaatgtttaat

SEQ ID NO: 994439 - DNA, 22 bp, Artificial Sequence
  chemically synthesized
gctattctgccattaaacattc

SEQ ID NO: 994440 - DNA, 22 bp, Artificial Sequence
  chemically synthesized
ttctgccattaaacattcaaga

SEQ ID NO: 994441 - DNA, 22 bp, Artificial Sequence
  chemically synthesized
atggttgtagaggatcttgaat

SEQ ID NO: 994442 - DNA, 22 bp, Artificial Sequence
  chemically synthesized
tgccattaaacattcaagatcc

SEQ ID NO: 994443 - DNA, 22 bp, Artificial Sequence
  chemically synthesized
ccattaaacattcaagatcctc

SEQ ID NO: 994444 - DNA, 22 bp, Artificial Sequence
  chemically synthesized
tgttcatggttgtagaggatct

SEQ ID NO: 994445 - DNA, 22 bp, Artificial Sequence
  chemically synthesized
tatgttcatggttgtagaggat

SEQ ID NO: 994446 - DNA, 22 bp, Artificial Sequence
  chemically synthesized
ctatgttcatggttgtagagga

SEQ ID NO: 994447 - DNA, 22 bp, Artificial Sequence
  chemically synthesized
aacattcaagatcctctacaac

SEQ ID NO: 994448 - DNA, 22 bp, Artificial Sequence
  chemically synthesized
ttctatgttcatggttgtagag

SEQ ID NO: 994449 - DNA, 22 bp, Artificial Sequence
  chemically synthesized
aagatcctctacaaccatgaac

SEQ ID NO: 994450 - DNA, 22 bp, Artificial Sequence
  chemically synthesized
tacaaccatgaacatagaagaa

SEQ ID NO: 994451 - DNA, 22 bp, Artificial Sequence
  chemically synthesized
caaccatgaacatagaagaatg

SEQ ID NO: 994452 - DNA, 22 bp, Artificial Sequence
  chemically synthesized
atacagcaagaacataaggata

SEQ ID NO: 994453 - DNA, 22 bp, Artificial Sequence
  chemically synthesized
gatacagcaagaacataaggat

SEQ ID NO: 994454 - DNA, 22 bp, Artificial Sequence
  chemically synthesized
tgatacagcaagaacataagga

SEQ ID NO: 994455 - DNA, 22 bp, Artificial Sequence
  chemically synthesized
agagtctttgatacagcaagaa

SEQ ID NO: 994456 - DNA, 22 bp, Artificial Sequence
  chemically synthesized
tgagagtctttgatacagcaag

SEQ ID NO: 994457 - DNA, 22 bp, Artificial Sequence
  chemically synthesized
atccttatgttcttgctgtatc

SEQ ID NO: 994458 - DNA, 22 bp, Artificial Sequence
  chemically synthesized
tccttatgttcttgctgtatca

SEQ ID NO: 994459 - DNA, 22 bp, Artificial Sequence
  chemically synthesized
atgttcttgctgtatcaaagac

SEQ ID NO: 994460 - DNA, 22 bp, Artificial Sequence
  chemically synthesized
tgttcttgctgtatcaaagact

SEQ ID NO: 994461 - DNA, 22 bp, Artificial Sequence
  chemically synthesized
aaaatctctgagagtctttgat

SEQ ID NO: 994462 - DNA, 22 bp, Artificial Sequence
  chemically synthesized
tgaaaatctctgagagtctttg

SEQ ID NO: 994463 - DNA, 22 bp, Artificial Sequence
  chemically synthesized
ttgctgtatcaaagactctcag

SEQ ID NO: 994464 - DNA, 22 bp, Artificial Sequence
  chemically synthesized
gctgtatcaaagactctcagag

SEQ ID NO: 994465 - DNA, 22 bp, Artificial Sequence
  chemically synthesized
ctgtatcaaagactctcagaga

SEQ ID NO: 994466 - DNA, 22 bp, Artificial Sequence
  chemically synthesized
tatcaaagactctcagagattt

SEQ ID NO: 994467 - DNA, 22 bp, Artificial Sequence
  chemically synthesized
tcagagattttcagagacatgc

SEQ ID NO: 994468 - DNA, 22 bp, Artificial Sequence
  chemically synthesized
agagattttcagagacatgcct

SEQ ID NO: 994469 - DNA, 22 bp, Artificial Sequence
  chemically synthesized
atcagtatggaaaaggcatgtc

SEQ ID NO: 994470 - DNA, 22 bp, Artificial Sequence
  chemically synthesized
attgatcagtatggaaaaggca

SEQ ID NO: 994471 - DNA, 22 bp, Artificial Sequence
  chemically synthesized
cattgatcagtatggaaaaggc

SEQ ID NO: 994472 - DNA, 22 bp, Artificial Sequence
  chemically synthesized
tcagagacatgccttttccata

SEQ ID NO: 994473 - DNA, 22 bp, Artificial Sequence
  chemically synthesized
cagagacatgccttttccatac

SEQ ID NO: 994474 - DNA, 22 bp, Artificial Sequence
  chemically synthesized
agagacatgccttttccatact

SEQ ID NO: 994475 - DNA, 22 bp, Artificial Sequence
  chemically synthesized
gtgacccatcttcattgatcag

SEQ ID NO: 994476 - DNA, 22 bp, Artificial Sequence
  chemically synthesized
tggtgacccatcttcattgatc

SEQ ID NO: 994477 - DNA, 22 bp, Artificial Sequence
  chemically synthesized
ctggtgacccatcttcattgat

SEQ ID NO: 994478 - DNA, 22 bp, Artificial Sequence
  chemically synthesized
ttccatactgatcaatgaagat

SEQ ID NO: 994479 - DNA, 22 bp, Artificial Sequence
  chemically synthesized
tccatactgatcaatgaagatg

SEQ ID NO: 994480 - DNA, 22 bp, Artificial Sequence
  chemically synthesized
ccatactgatcaatgaagatgg

SEQ ID NO: 994481 - DNA, 22 bp, Artificial Sequence
  chemically synthesized
catactgatcaatgaagatggg

SEQ ID NO: 994482 - DNA, 22 bp, Artificial Sequence
  chemically synthesized
cgatgtttctggtgacccatct

SEQ ID NO: 994483 - DNA, 22 bp, Artificial Sequence
  chemically synthesized
atcaatgaagatgggtcaccag

SEQ ID NO: 994484 - DNA, 22 bp, Artificial Sequence
  chemically synthesized
actacgatgtttctggtgaccc

SEQ ID NO: 994485 - DNA, 22 bp, Artificial Sequence
  chemically synthesized
gactacgatgtttctggtgacc

SEQ ID NO: 994486 - DNA, 22 bp, Artificial Sequence
  chemically synthesized
tgactacgatgtttctggtgac

SEQ ID NO: 994487 - DNA, 22 bp, Artificial Sequence
  chemically synthesized
tcactttgactacgatgtttct

SEQ ID NO: 994488 - DNA, 22 bp, Artificial Sequence
  chemically synthesized
ggaaggcagtacaaaaactgtc

SEQ ID NO: 994489 - DNA, 22 bp, Artificial Sequence
  chemically synthesized
tctgggaaggcagtacaaaaac

SEQ ID NO: 994490 - DNA, 22 bp, Artificial Sequence
  chemically synthesized
taaaattatctgggaaggcagt

SEQ ID NO: 994491 - DNA, 22 bp, Artificial Sequence
  chemically synthesized
ttgtactgccttcccagataat

SEQ ID NO: 994492 - DNA, 22 bp, Artificial Sequence
  chemically synthesized
tgtactgccttcccagataatt

SEQ ID NO: 994493 - DNA, 22 bp, Artificial Sequence
  chemically synthesized
gtactgccttcccagataattt

SEQ ID NO: 994494 - DNA, 22 bp, Artificial Sequence
  chemically synthesized
tactgccttcccagataatttt

SEQ ID NO: 994495 - DNA, 22 bp, Artificial Sequence
  chemically synthesized
atgtcagtctgtaaaattatct

SEQ ID NO: 994496 - DNA, 22 bp, Artificial Sequence
  chemically synthesized
ccttcccagataattttacaga

SEQ ID NO: 994497 - DNA, 22 bp, Artificial Sequence
  chemically synthesized
aaattcatgtcagtctgtaaaa

SEQ ID NO: 994498 - DNA, 22 bp, Artificial Sequence
  chemically synthesized
caaattcatgtcagtctgtaaa

SEQ ID NO: 994499 - DNA, 22 bp, Artificial Sequence
  chemically synthesized
cccagataattttacagactga

SEQ ID NO: 994500 - DNA, 22 bp, Artificial Sequence
  chemically synthesized
ccagataattttacagactgac

SEQ ID NO: 994501 - DNA, 22 bp, Artificial Sequence
  chemically synthesized
cttcaaattcatgtcagtctgt

SEQ ID NO: 994502 - DNA, 22 bp, Artificial Sequence
  chemically synthesized
ttgcttcaaattcatgtcagtc

SEQ ID NO: 994503 - DNA, 22 bp, Artificial Sequence
  chemically synthesized
gttgcttcaaattcatgtcagt

SEQ ID NO: 994504 - DNA, 22 bp, Artificial Sequence
  chemically synthesized
tacagactgacatgaatttgaa

SEQ ID NO: 994505 - DNA, 22 bp, Artificial Sequence
  chemically synthesized
acagactgacatgaatttgaag

SEQ ID NO: 994506 - DNA, 22 bp, Artificial Sequence
  chemically synthesized
cagactgacatgaatttgaagc

SEQ ID NO: 994507 - DNA, 22 bp, Artificial Sequence
  chemically synthesized
acatgaatttgaagcaacaagc

SEQ ID NO: 994508 - DNA, 22 bp, Artificial Sequence
  chemically synthesized
gaagcaacaagctttttttttt

SEQ ID NO: 994509 - DNA, 22 bp, Artificial Sequence
  chemically synthesized
aagcaacaagcttttttttttt

SEQ ID NO: 994510 - DNA, 22 bp, Artificial Sequence
  chemically synthesized
aaaaaaaaaaaaaaaaaaaaaa

SEQ ID NO: 994511 - DNA, 22 bp, Artificial Sequence
  chemically synthesized
cgcctcaaaaaaaaaaaaaaaa

SEQ ID NO: 994512 - DNA, 22 bp, Artificial Sequence
  chemically synthesized
tttttttttttttttttttttt

SEQ ID NO: 994513 - DNA, 22 bp, Artificial Sequence
  chemically synthesized
tttttttttttttttttttttt

SEQ ID NO: 994514 - DNA, 22 bp, Artificial Sequence
  chemically synthesized
tttttttttttttttttttttt

SEQ ID NO: 994515 - DNA, 22 bp, Artificial Sequence
  chemically synthesized
tttttttttttttttttttttg

SEQ ID NO: 994516 - DNA, 22 bp, Artificial Sequence
  chemically synthesized
ttttttttttttttttttttga

SEQ ID NO: 994517 - DNA, 22 bp, Artificial Sequence
  chemically synthesized
tttttttttttttttttttgag

SEQ ID NO: 994518 - DNA, 22 bp, Artificial Sequence
  chemically synthesized
ttttttttttttttttttgagg

SEQ ID NO: 994519 - DNA, 22 bp, Artificial Sequence
  chemically synthesized
tttttttttttttttttgaggc

SEQ ID NO: 994520 - DNA, 22 bp, Artificial Sequence
  chemically synthesized
ttttttttttttttttgaggcg

SEQ ID NO: 994521 - DNA, 22 bp, Artificial Sequence
  chemically synthesized
tttttttttttttttgaggcgg

SEQ ID NO: 994522 - DNA, 22 bp, Artificial Sequence
  chemically synthesized
ttttttttttttttgaggcgga

SEQ ID NO: 994523 - DNA, 22 bp, Artificial Sequence
  chemically synthesized
tttttttttttttgaggcggag

SEQ ID NO: 994524 - DNA, 22 bp, Artificial Sequence
  chemically synthesized
ttttttttttttgaggcggagt

SEQ ID NO: 994525 - DNA, 22 bp, Artificial Sequence
  chemically synthesized
tttttttttttgaggcggagtt

SEQ ID NO: 994526 - DNA, 22 bp, Artificial Sequence
  chemically synthesized
ttttttttttgaggcggagttt

SEQ ID NO: 994527 - DNA, 22 bp, Artificial Sequence
  chemically synthesized
tttttttttgaggcggagtttt

SEQ ID NO: 994528 - DNA, 22 bp, Artificial Sequence
  chemically synthesized
ggcaacaagagcaaaactccgc

SEQ ID NO: 994529 - DNA, 22 bp, Artificial Sequence
  chemically synthesized
ttttttttgaggcggagttttg

SEQ ID NO: 994530 - DNA, 22 bp, Artificial Sequence
  chemically synthesized
tttttttgaggcggagttttgc

SEQ ID NO: 994531 - DNA, 22 bp, Artificial Sequence
  chemically synthesized
ttttttgaggcggagttttgct

SEQ ID NO: 994532 - DNA, 22 bp, Artificial Sequence
  chemically synthesized
tttttgaggcggagttttgctc

SEQ ID NO: 994533 - DNA, 22 bp, Artificial Sequence
  chemically synthesized
ttttgaggcggagttttgctct

SEQ ID NO: 994534 - DNA, 22 bp, Artificial Sequence
  chemically synthesized
tttgaggcggagttttgctctt

SEQ ID NO: 994535 - DNA, 22 bp, Artificial Sequence
  chemically synthesized
ttgaggcggagttttgctcttg

SEQ ID NO: 994536 - DNA, 22 bp, Artificial Sequence
  chemically synthesized
cagcctgggcaacaagagcaaa

SEQ ID NO: 994537 - DNA, 22 bp, Artificial Sequence
  chemically synthesized
tgaggcggagttttgctcttgt

SEQ ID NO: 994538 - DNA, 22 bp, Artificial Sequence
  chemically synthesized
gaggcggagttttgctcttgtt

SEQ ID NO: 994539 - DNA, 22 bp, Artificial Sequence
  chemically synthesized
aggcggagttttgctcttgttg

SEQ ID NO: 994540 - DNA, 22 bp, Artificial Sequence
  chemically synthesized
cattccagcctgggcaacaaga

SEQ ID NO: 994541 - DNA, 22 bp, Artificial Sequence
  chemically synthesized
tgccattgcattccagcctggg

SEQ ID NO: 994542 - DNA, 22 bp, Artificial Sequence
  chemically synthesized
tgctcttgttgcccaggctgga

SEQ ID NO: 994543 - DNA, 22 bp, Artificial Sequence
  chemically synthesized
gctcttgttgcccaggctggaa

SEQ ID NO: 994544 - DNA, 22 bp, Artificial Sequence
  chemically synthesized
ctcttgttgcccaggctggaat

SEQ ID NO: 994545 - DNA, 22 bp, Artificial Sequence
  chemically synthesized
ttgttgcccaggctggaatgca

SEQ ID NO: 994546 - DNA, 22 bp, Artificial Sequence
  chemically synthesized
gttgcccaggctggaatgcaat

SEQ ID NO: 994547 - DNA, 22 bp, Artificial Sequence
  chemically synthesized
ttgcccaggctggaatgcaatg

SEQ ID NO: 994548 - DNA, 22 bp, Artificial Sequence
  chemically synthesized
agccaagattgtgccattgcat

SEQ ID NO: 994549 - DNA, 22 bp, Artificial Sequence
  chemically synthesized
cccaggctggaatgcaatggca

SEQ ID NO: 994550 - DNA, 22 bp, Artificial Sequence
  chemically synthesized
gaatgcaatggcacaatcttgg

SEQ ID NO: 994551 - DNA, 22 bp, Artificial Sequence
  chemically synthesized
aggcaggagaattgagccaaga

SEQ ID NO: 994552 - DNA, 22 bp, Artificial Sequence
  chemically synthesized
ggaggctgaggcaggagaattg

SEQ ID NO: 994553 - DNA, 22 bp, Artificial Sequence
  chemically synthesized
gggaggctgaggcaggagaatt

SEQ ID NO: 994554 - DNA, 22 bp, Artificial Sequence
  chemically synthesized
ggctcaattctcctgcctcagc

SEQ ID NO: 994555 - DNA, 22 bp, Artificial Sequence
  chemically synthesized
gctcaattctcctgcctcagcc

SEQ ID NO: 994556 - DNA, 22 bp, Artificial Sequence
  chemically synthesized
aattctcctgcctcagcctccc

SEQ ID NO: 994557 - DNA, 22 bp, Artificial Sequence
  chemically synthesized
taatcccaggtacttgggaggc

SEQ ID NO: 994558 - DNA, 22 bp, Artificial Sequence
  chemically synthesized
tcctgcctcagcctcccaagta

SEQ ID NO: 994559 - DNA, 22 bp, Artificial Sequence
  chemically synthesized
ctgcctcagcctcccaagtacc

SEQ ID NO: 994560 - DNA, 22 bp, Artificial Sequence
  chemically synthesized
cctcagcctcccaagtacctgg

SEQ ID NO: 994561 - DNA, 22 bp, Artificial Sequence
  chemically synthesized
agcctcccaagtacctgggatt

SEQ ID NO: 994562 - DNA, 22 bp, Artificial Sequence
  chemically synthesized
tggcacatgcctgtaatcccag

SEQ ID NO: 994563 - DNA, 22 bp, Artificial Sequence
  chemically synthesized
ccaagtacctgggattacaggc

SEQ ID NO: 994564 - DNA, 22 bp, Artificial Sequence
  chemically synthesized
ggcgttgtggcacatgcctgta

SEQ ID NO: 994565 - DNA, 22 bp, Artificial Sequence
  chemically synthesized
gctgggcgttgtggcacatgcc

SEQ ID NO: 994566 - DNA, 22 bp, Artificial Sequence
  chemically synthesized
ggattacaggcatgtgccacaa

SEQ ID NO: 994567 - DNA, 22 bp, Artificial Sequence
  chemically synthesized
caggcatgtgccacaacgccca

SEQ ID NO: 994568 - DNA, 22 bp, Artificial Sequence
  chemically synthesized
aaaatacaaaaaaaaaaaaagt

SEQ ID NO: 994569 - DNA, 22 bp, Artificial Sequence
  chemically synthesized
ctaaaaatacaaaaaaaaaaaa

SEQ ID NO: 994570 - DNA, 22 bp, Artificial Sequence
  chemically synthesized
tactaaaaatacaaaaaaaaaa

SEQ ID NO: 994571 - DNA, 22 bp, Artificial Sequence
  chemically synthesized
actttttttttttttgtatttt

SEQ ID NO: 994572 - DNA, 22 bp, Artificial Sequence
  chemically synthesized
tttttttttttgtatttttagt

SEQ ID NO: 994573 - DNA, 22 bp, Artificial Sequence
  chemically synthesized
ttttttttttgtatttttagta

SEQ ID NO: 994574 - DNA, 22 bp, Artificial Sequence
  chemically synthesized
tttttttttgtatttttagtag

SEQ ID NO: 994575 - DNA, 22 bp, Artificial Sequence
  chemically synthesized
ttttttttgtatttttagtaga

SEQ ID NO: 994576 - DNA, 22 bp, Artificial Sequence
  chemically synthesized
tttttttgtatttttagtagag

SEQ ID NO: 994577 - DNA, 22 bp, Artificial Sequence
  chemically synthesized
gtgaacccccatctctactaaa

SEQ ID NO: 994578 - DNA, 22 bp, Artificial Sequence
  chemically synthesized
ttttttgtatttttagtagaga

SEQ ID NO: 994579 - DNA, 22 bp, Artificial Sequence
  chemically synthesized
ggtgaacccccatctctactaa

SEQ ID NO: 994580 - DNA, 22 bp, Artificial Sequence
  chemically synthesized
tttttgtatttttagtagagat

SEQ ID NO: 994581 - DNA, 22 bp, Artificial Sequence
  chemically synthesized
ttttgtatttttagtagagatg

SEQ ID NO: 994582 - DNA, 22 bp, Artificial Sequence
  chemically synthesized
tttgtatttttagtagagatgg

SEQ ID NO: 994583 - DNA, 22 bp, Artificial Sequence
  chemically synthesized
ttgtatttttagtagagatggg

SEQ ID NO: 994584 - DNA, 22 bp, Artificial Sequence
  chemically synthesized
tgtatttttagtagagatgggg

SEQ ID NO: 994585 - DNA, 22 bp, Artificial Sequence
  chemically synthesized
gtatttttagtagagatggggg

SEQ ID NO: 994586 - DNA, 22 bp, Artificial Sequence
  chemically synthesized
tatttttagtagagatgggggt

SEQ ID NO: 994587 - DNA, 22 bp, Artificial Sequence
  chemically synthesized
atcaacttggtgaacccccatc

SEQ ID NO: 994588 - DNA, 22 bp, Artificial Sequence
  chemically synthesized
ttagtagagatgggggttcacc

SEQ ID NO: 994589 - DNA, 22 bp, Artificial Sequence
  chemically synthesized
tagtagagatgggggttcacca

SEQ ID NO: 994590 - DNA, 22 bp, Artificial Sequence
  chemically synthesized
agtagagatgggggttcaccaa

SEQ ID NO: 994591 - DNA, 22 bp, Artificial Sequence
  chemically synthesized
gtagagatgggggttcaccaag

SEQ ID NO: 994592 - DNA, 22 bp, Artificial Sequence
  chemically synthesized
agaccagcctgatcaacttggt

SEQ ID NO: 994593 - DNA, 22 bp, Artificial Sequence
  chemically synthesized
gagaccagcctgatcaacttgg

SEQ ID NO: 994594 - DNA, 22 bp, Artificial Sequence
  chemically synthesized
accaagttgatcaggctggtct

SEQ ID NO: 994595 - DNA, 22 bp, Artificial Sequence
  chemically synthesized
aggtcaggagtttgagaccagc

SEQ ID NO: 994596 - DNA, 22 bp, Artificial Sequence
  chemically synthesized
gaggtcaggagtttgagaccag

SEQ ID NO: 994597 - DNA, 22 bp, Artificial Sequence
  chemically synthesized
atcaggctggtctcaaactcct

SEQ ID NO: 994598 - DNA, 22 bp, Artificial Sequence
  chemically synthesized
gtctcaaactcctgacctcaag

SEQ ID NO: 994599 - DNA, 22 bp, Artificial Sequence
  chemically synthesized
aggtgggtggaacacttgaggt

SEQ ID NO: 994600 - DNA, 22 bp, Artificial Sequence
  chemically synthesized
aaactcctgacctcaagtgttc

SEQ ID NO: 994601 - DNA, 22 bp, Artificial Sequence
  chemically synthesized
ggagtctgaggtgggtggaaca

SEQ ID NO: 994602 - DNA, 22 bp, Artificial Sequence
  chemically synthesized
ctgacctcaagtgttccaccca

SEQ ID NO: 994603 - DNA, 22 bp, Artificial Sequence
  chemically synthesized
gggagtctgaggtgggtggaac

SEQ ID NO: 994604 - DNA, 22 bp, Artificial Sequence
  chemically synthesized
tgggagtctgaggtgggtggaa

SEQ ID NO: 994605 - DNA, 22 bp, Artificial Sequence
  chemically synthesized
acctcaagtgttccacccacct

SEQ ID NO: 994606 - DNA, 22 bp, Artificial Sequence
  chemically synthesized
aagtgttccacccacctcagac

SEQ ID NO: 994607 - DNA, 22 bp, Artificial Sequence
  chemically synthesized
taatcccagcactttgggagtc

SEQ ID NO: 994608 - DNA, 22 bp, Artificial Sequence
  chemically synthesized
cacccacctcagactcccaaag

SEQ ID NO: 994609 - DNA, 22 bp, Artificial Sequence
  chemically synthesized
catgcctgtaatcccagcactt

SEQ ID NO: 994610 - DNA, 22 bp, Artificial Sequence
  chemically synthesized
agactcccaaagtgctgggatt

SEQ ID NO: 994611 - DNA, 22 bp, Artificial Sequence
  chemically synthesized
ttgcatgcctgtaatcccagca

SEQ ID NO: 994612 - DNA, 22 bp, Artificial Sequence
  chemically synthesized
gttgcatgcctgtaatcccagc

SEQ ID NO: 994613 - DNA, 22 bp, Artificial Sequence
  chemically synthesized
ccaaagtgctgggattacaggc

SEQ ID NO: 994614 - DNA, 22 bp, Artificial Sequence
  chemically synthesized
ataaaaatgcttgttgcatgcc

SEQ ID NO: 994615 - DNA, 22 bp, Artificial Sequence
  chemically synthesized
cataaaaatgcttgttgcatgc

SEQ ID NO: 994616 - DNA, 22 bp, Artificial Sequence
  chemically synthesized
ggattacaggcatgcaacaagc

SEQ ID NO: 994617 - DNA, 22 bp, Artificial Sequence
  chemically synthesized
caggcatgcaacaagcattttt

SEQ ID NO: 994618 - DNA, 22 bp, Artificial Sequence
  chemically synthesized
aggcagggtcttcataaaaatg

SEQ ID NO: 994619 - DNA, 22 bp, Artificial Sequence
  chemically synthesized
ttcaggcagggtcttcataaaa

SEQ ID NO: 994620 - DNA, 22 bp, Artificial Sequence
  chemically synthesized
gaatgaatggctattcaggcag

SEQ ID NO: 994621 - DNA, 22 bp, Artificial Sequence
  chemically synthesized
ttatgaagaccctgcctgaata

SEQ ID NO: 994622 - DNA, 22 bp, Artificial Sequence
  chemically synthesized
ggaatgaatggctattcaggca

SEQ ID NO: 994623 - DNA, 22 bp, Artificial Sequence
  chemically synthesized
tatgaagaccctgcctgaatag

SEQ ID NO: 994624 - DNA, 22 bp, Artificial Sequence
  chemically synthesized
atgaagaccctgcctgaatagc

SEQ ID NO: 994625 - DNA, 22 bp, Artificial Sequence
  chemically synthesized
tgaagaccctgcctgaatagcc

SEQ ID NO: 994626 - DNA, 22 bp, Artificial Sequence
  chemically synthesized
aagtccccttggaatgaatggc

SEQ ID NO: 994627 - DNA, 22 bp, Artificial Sequence
  chemically synthesized
cctgaatagccattcattccaa

SEQ ID NO: 994628 - DNA, 22 bp, Artificial Sequence
  chemically synthesized
aaattcaagtccccttggaatg

SEQ ID NO: 994629 - DNA, 22 bp, Artificial Sequence
  chemically synthesized
aatagccattcattccaagggg

SEQ ID NO: 994630 - DNA, 22 bp, Artificial Sequence
  chemically synthesized
ttcaaattcaagtccccttgga

SEQ ID NO: 994631 - DNA, 22 bp, Artificial Sequence
  chemically synthesized
attccaaggggacttgaatttg

SEQ ID NO: 994632 - DNA, 22 bp, Artificial Sequence
  chemically synthesized
tgtggaggtattattcaaattc

SEQ ID NO: 994633 - DNA, 22 bp, Artificial Sequence
  chemically synthesized
caaggggacttgaatttgaata

SEQ ID NO: 994634 - DNA, 22 bp, Artificial Sequence
  chemically synthesized
agagtcatctgtgtggaggtat

SEQ ID NO: 994635 - DNA, 22 bp, Artificial Sequence
  chemically synthesized
gaatttgaataatacctccaca

SEQ ID NO: 994636 - DNA, 22 bp, Artificial Sequence
  chemically synthesized
gagagtcatctgtgtggaggta

SEQ ID NO: 994637 - DNA, 22 bp, Artificial Sequence
  chemically synthesized
aatttgaataatacctccacac

SEQ ID NO: 994638 - DNA, 22 bp, Artificial Sequence
  chemically synthesized
gaataatacctccacacagatg

SEQ ID NO: 994639 - DNA, 22 bp, Artificial Sequence
  chemically synthesized
aataatacctccacacagatga

SEQ ID NO: 994640 - DNA, 22 bp, Artificial Sequence
  chemically synthesized
gagatgcagatttgagagtcat

SEQ ID NO: 994641 - DNA, 22 bp, Artificial Sequence
  chemically synthesized
cacacagatgactctcaaatct

SEQ ID NO: 994642 - DNA, 22 bp, Artificial Sequence
  chemically synthesized
tcaaatctgcatctctagcaca

SEQ ID NO: 994643 - DNA, 22 bp, Artificial Sequence
  chemically synthesized
agggaagaagtatgtgctagag

SEQ ID NO: 994644 - DNA, 22 bp, Artificial Sequence
  chemically synthesized
aaatctgcatctctagcacata

SEQ ID NO: 994645 - DNA, 22 bp, Artificial Sequence
  chemically synthesized
catctctagcacatacttcttc

SEQ ID NO: 994646 - DNA, 22 bp, Artificial Sequence
  chemically synthesized
tagcacatacttcttccctgaa

SEQ ID NO: 994647 - DNA, 22 bp, Artificial Sequence
  chemically synthesized
gcacatacttcttccctgaatc

SEQ ID NO: 994648 - DNA, 22 bp, Artificial Sequence
  chemically synthesized
gatgaaagtatgggattcaggg

SEQ ID NO: 994649 - DNA, 22 bp, Artificial Sequence
  chemically synthesized
cttccctgaatcccatactttc

SEQ ID NO: 994650 - DNA, 22 bp, Artificial Sequence
  chemically synthesized
ttccctgaatcccatactttca

SEQ ID NO: 994651 - DNA, 22 bp, Artificial Sequence
  chemically synthesized
ccctgaatcccatactttcatc

SEQ ID NO: 994652 - DNA, 22 bp, Artificial Sequence
  chemically synthesized
cctgaatcccatactttcatcc

SEQ ID NO: 994653 - DNA, 22 bp, Artificial Sequence
  chemically synthesized
aatcccatactttcatccaact

SEQ ID NO: 994654 - DNA, 22 bp, Artificial Sequence
  chemically synthesized
tcatccaactgcactctttgtg

SEQ ID NO: 994655 - DNA, 22 bp, Artificial Sequence
  chemically synthesized
catccaactgcactctttgtga

SEQ ID NO: 994656 - DNA, 22 bp, Artificial Sequence
  chemically synthesized
atccaactgcactctttgtgac

SEQ ID NO: 994657 - DNA, 22 bp, Artificial Sequence
  chemically synthesized
gacatcccagtaaagtcacaaa

SEQ ID NO: 994658 - DNA, 22 bp, Artificial Sequence
  chemically synthesized
ttagacatcccagtaaagtcac

SEQ ID NO: 994659 - DNA, 22 bp, Artificial Sequence
  chemically synthesized
gttagacatcccagtaaagtca

SEQ ID NO: 994660 - DNA, 22 bp, Artificial Sequence
  chemically synthesized
cactctttgtgactttactggg

SEQ ID NO: 994661 - DNA, 22 bp, Artificial Sequence
  chemically synthesized
aaatcttgttagacatcccagt

SEQ ID NO: 994662 - DNA, 22 bp, Artificial Sequence
  chemically synthesized
tttgtgactttactgggatgtc

SEQ ID NO: 994663 - DNA, 22 bp, Artificial Sequence
  chemically synthesized
gaaatcttgttagacatcccag

SEQ ID NO: 994664 - DNA, 22 bp, Artificial Sequence
  chemically synthesized
tgtgactttactgggatgtcta

SEQ ID NO: 994665 - DNA, 22 bp, Artificial Sequence
  chemically synthesized
gtgactttactgggatgtctaa

SEQ ID NO: 994666 - DNA, 22 bp, Artificial Sequence
  chemically synthesized
tgactttactgggatgtctaac

SEQ ID NO: 994667 - DNA, 22 bp, Artificial Sequence
  chemically synthesized
ggtttgaaatcttgttagacat

SEQ ID NO: 994668 - DNA, 22 bp, Artificial Sequence
  chemically synthesized
ttaggtttgaaatcttgttaga

SEQ ID NO: 994669 - DNA, 22 bp, Artificial Sequence
  chemically synthesized
tactgggatgtctaacaagatt

SEQ ID NO: 994670 - DNA, 22 bp, Artificial Sequence
  chemically synthesized
actgggatgtctaacaagattt

SEQ ID NO: 994671 - DNA, 22 bp, Artificial Sequence
  chemically synthesized
ctgggatgtctaacaagatttc

SEQ ID NO: 994672 - DNA, 22 bp, Artificial Sequence
  chemically synthesized
gaattgttaggtttgaaatctt

SEQ ID NO: 994673 - DNA, 22 bp, Artificial Sequence
  chemically synthesized
ggatgtctaacaagatttcaaa

SEQ ID NO: 994674 - DNA, 22 bp, Artificial Sequence
  chemically synthesized
ggaattgttaggtttgaaatct

SEQ ID NO: 994675 - DNA, 22 bp, Artificial Sequence
  chemically synthesized
tggaattgttaggtttgaaatc

SEQ ID NO: 994676 - DNA, 22 bp, Artificial Sequence
  chemically synthesized
ttttggaattgttaggtttgaa

SEQ ID NO: 994677 - DNA, 22 bp, Artificial Sequence
  chemically synthesized
gttttggaattgttaggtttga

SEQ ID NO: 994678 - DNA, 22 bp, Artificial Sequence
  chemically synthesized
tgttttggaattgttaggtttg

SEQ ID NO: 994679 - DNA, 22 bp, Artificial Sequence
  chemically synthesized
acaagatttcaaacctaacaat

SEQ ID NO: 994680 - DNA, 22 bp, Artificial Sequence
  chemically synthesized
caaacctaacaattccaaaaca

SEQ ID NO: 994681 - DNA, 22 bp, Artificial Sequence
  chemically synthesized
aaacctaacaattccaaaacaa

SEQ ID NO: 994682 - DNA, 22 bp, Artificial Sequence
  chemically synthesized
acaattccaaaacaaaattatt

SEQ ID NO: 994683 - DNA, 22 bp, Artificial Sequence
  chemically synthesized
caaaacaaaattattgcttcca

SEQ ID NO: 994684 - DNA, 22 bp, Artificial Sequence
  chemically synthesized
gatggtagaggggtaaaggtgg

SEQ ID NO: 994685 - DNA, 22 bp, Artificial Sequence
  chemically synthesized
ttgcttccacctttacccctct

SEQ ID NO: 994686 - DNA, 22 bp, Artificial Sequence
  chemically synthesized
cttccacctttacccctctacc

SEQ ID NO: 994687 - DNA, 22 bp, Artificial Sequence
  chemically synthesized
ccacctttacccctctaccatc

SEQ ID NO: 994688 - DNA, 22 bp, Artificial Sequence
  chemically synthesized
cacctttacccctctaccatct

SEQ ID NO: 994689 - DNA, 22 bp, Artificial Sequence
  chemically synthesized
tacccctctaccatctaacttg

SEQ ID NO: 994690 - DNA, 22 bp, Artificial Sequence
  chemically synthesized
acccctctaccatctaacttga

SEQ ID NO: 994691 - DNA, 22 bp, Artificial Sequence
  chemically synthesized
cccctctaccatctaacttgat

SEQ ID NO: 994692 - DNA, 22 bp, Artificial Sequence
  chemically synthesized
agaaaatggtagaaggatcaag

SEQ ID NO: 994693 - DNA, 22 bp, Artificial Sequence
  chemically synthesized
taccatctaacttgatccttct

SEQ ID NO: 994694 - DNA, 22 bp, Artificial Sequence
  chemically synthesized
ccatctaacttgatccttctac

SEQ ID NO: 994695 - DNA, 22 bp, Artificial Sequence
  chemically synthesized
acttgatccttctaccattttc

SEQ ID NO: 994696 - DNA, 22 bp, Artificial Sequence
  chemically synthesized
gatccttctaccattttctcaa

SEQ ID NO: 994697 - DNA, 22 bp, Artificial Sequence
  chemically synthesized
atccttctaccattttctcaat

SEQ ID NO: 994698 - DNA, 22 bp, Artificial Sequence
  chemically synthesized
ctaccattttctcaattctatt

SEQ ID NO: 994699 - DNA, 22 bp, Artificial Sequence
  chemically synthesized
taccattttctcaattctattc

SEQ ID NO: 994700 - DNA, 22 bp, Artificial Sequence
  chemically synthesized
ccattttctcaattctattcac

SEQ ID NO: 994701 - DNA, 22 bp, Artificial Sequence
  chemically synthesized
tctcaattctattcaccttatc

SEQ ID NO: 994702 - DNA, 22 bp, Artificial Sequence
  chemically synthesized
ctcaattctattcaccttatcc

SEQ ID NO: 994703 - DNA, 22 bp, Artificial Sequence
  chemically synthesized
tcaattctattcaccttatcca

SEQ ID NO: 994704 - DNA, 22 bp, Artificial Sequence
  chemically synthesized
aattctattcaccttatccacc

SEQ ID NO: 994705 - DNA, 22 bp, Artificial Sequence
  chemically synthesized
tattcaccttatccaccttgga

SEQ ID NO: 994706 - DNA, 22 bp, Artificial Sequence
  chemically synthesized
ttcaccttatccaccttggact

SEQ ID NO: 994707 - DNA, 22 bp, Artificial Sequence
  chemically synthesized
accttatccaccttggactcat

SEQ ID NO: 994708 - DNA, 22 bp, Artificial Sequence
  chemically synthesized
atccaccttggactcatcctgg

SEQ ID NO: 994709 - DNA, 22 bp, Artificial Sequence
  chemically synthesized
tccaccttggactcatcctggg

SEQ ID NO: 994710 - DNA, 22 bp, Artificial Sequence
  chemically synthesized
ggactcatcctgggctcttctc

SEQ ID NO: 994711 - DNA, 22 bp, Artificial Sequence
  chemically synthesized
gactcatcctgggctcttctct

SEQ ID NO: 994712 - DNA, 22 bp, Artificial Sequence
  chemically synthesized
atcctgggctcttctctttctt

SEQ ID NO: 994713 - DNA, 22 bp, Artificial Sequence
  chemically synthesized
ggctcttctctttctttcccac

SEQ ID NO: 994714 - DNA, 22 bp, Artificial Sequence
  chemically synthesized
atgaatggggtatggggtggga

SEQ ID NO: 994715 - DNA, 22 bp, Artificial Sequence
  chemically synthesized
ttctctttctttcccaccccat

SEQ ID NO: 994716 - DNA, 22 bp, Artificial Sequence
  chemically synthesized
ctctttctttcccaccccatac

SEQ ID NO: 994717 - DNA, 22 bp, Artificial Sequence
  chemically synthesized
ctgatgaatggggtatggggtg

SEQ ID NO: 994718 - DNA, 22 bp, Artificial Sequence
  chemically synthesized
tctttctttcccaccccatacc

SEQ ID NO: 994719 - DNA, 22 bp, Artificial Sequence
  chemically synthesized
gctgatgaatggggtatggggt

SEQ ID NO: 994720 - DNA, 22 bp, Artificial Sequence
  chemically synthesized
tttctttcccaccccatacccc

SEQ ID NO: 994721 - DNA, 22 bp, Artificial Sequence
  chemically synthesized
tctttcccaccccataccccat

SEQ ID NO: 994722 - DNA, 22 bp, Artificial Sequence
  chemically synthesized
ctttcccaccccataccccatt

SEQ ID NO: 994723 - DNA, 22 bp, Artificial Sequence
  chemically synthesized
tttcccaccccataccccattc

SEQ ID NO: 994724 - DNA, 22 bp, Artificial Sequence
  chemically synthesized
tcccaccccataccccattcat

SEQ ID NO: 994725 - DNA, 22 bp, Artificial Sequence
  chemically synthesized
ccaggtttgctgatgaatgggg

SEQ ID NO: 994726 - DNA, 22 bp, Artificial Sequence
  chemically synthesized
cccaccccataccccattcatc

SEQ ID NO: 994727 - DNA, 22 bp, Artificial Sequence
  chemically synthesized
ccaccccataccccattcatca

SEQ ID NO: 994728 - DNA, 22 bp, Artificial Sequence
  chemically synthesized
gaaggtagcactaccaggtttg

SEQ ID NO: 994729 - DNA, 22 bp, Artificial Sequence
  chemically synthesized
ggaaggtagcactaccaggttt

SEQ ID NO: 994730 - DNA, 22 bp, Artificial Sequence
  chemically synthesized
tggaaggtagcactaccaggtt

SEQ ID NO: 994731 - DNA, 22 bp, Artificial Sequence
  chemically synthesized
ttggaaggtagcactaccaggt

SEQ ID NO: 994732 - DNA, 22 bp, Artificial Sequence
  chemically synthesized
atcagcaaacctggtagtgcta

SEQ ID NO: 994733 - DNA, 22 bp, Artificial Sequence
  chemically synthesized
ggtatttttggaaggtagcact

SEQ ID NO: 994734 - DNA, 22 bp, Artificial Sequence
  chemically synthesized
tgggtatttttggaaggtagca

SEQ ID NO: 994735 - DNA, 22 bp, Artificial Sequence
  chemically synthesized
gtagtgctaccttccaaaaata

SEQ ID NO: 994736 - DNA, 22 bp, Artificial Sequence
  chemically synthesized
ccttccaaaaatacccagaatc

SEQ ID NO: 994737 - DNA, 22 bp, Artificial Sequence
  chemically synthesized
ccaaaaatacccagaatccatg

SEQ ID NO: 994738 - DNA, 22 bp, Artificial Sequence
  chemically synthesized
caaaaatacccagaatccatgt

SEQ ID NO: 994739 - DNA, 22 bp, Artificial Sequence
  chemically synthesized
agtgaaaacaatgagaggtaca

SEQ ID NO: 994740 - DNA, 22 bp, Artificial Sequence
  chemically synthesized
cagtgaaaacaatgagaggtac

SEQ ID NO: 994741 - DNA, 22 bp, Artificial Sequence
  chemically synthesized
tcagtgaaaacaatgagaggta

SEQ ID NO: 994742 - DNA, 22 bp, Artificial Sequence
  chemically synthesized
aaccaggaagctttcagtgaaa

SEQ ID NO: 994743 - DNA, 22 bp, Artificial Sequence
  chemically synthesized
taaaccaggaagctttcagtga

SEQ ID NO: 994744 - DNA, 22 bp, Artificial Sequence
  chemically synthesized
tcattgttttcactgaaagctt

SEQ ID NO: 994745 - DNA, 22 bp, Artificial Sequence
  chemically synthesized
attgttttcactgaaagcttcc

SEQ ID NO: 994746 - DNA, 22 bp, Artificial Sequence
  chemically synthesized
ttttcactgaaagcttcctggt

SEQ ID NO: 994747 - DNA, 22 bp, Artificial Sequence
  chemically synthesized
tcactgaaagcttcctggttta

SEQ ID NO: 994748 - DNA, 22 bp, Artificial Sequence
  chemically synthesized
cactgaaagcttcctggtttag

SEQ ID NO: 994749 - DNA, 22 bp, Artificial Sequence
  chemically synthesized
actgaaagcttcctggtttaga

SEQ ID NO: 994750 - DNA, 22 bp, Artificial Sequence
  chemically synthesized
aaagcttcctggtttagaatca

SEQ ID NO: 994751 - DNA, 22 bp, Artificial Sequence
  chemically synthesized
aaatgagaaataatggtgattc

SEQ ID NO: 994752 - DNA, 22 bp, Artificial Sequence
  chemically synthesized
cctggtttagaatcaccattat

SEQ ID NO: 994753 - DNA, 22 bp, Artificial Sequence
  chemically synthesized
ctggtttagaatcaccattatt

SEQ ID NO: 994754 - DNA, 22 bp, Artificial Sequence
  chemically synthesized
gtttagaatcaccattatttct

SEQ ID NO: 994755 - DNA, 22 bp, Artificial Sequence
  chemically synthesized
caataattcaaatgagaaataa

SEQ ID NO: 994756 - DNA, 22 bp, Artificial Sequence
  chemically synthesized
agaatcaccattatttctcatt

SEQ ID NO: 994757 - DNA, 22 bp, Artificial Sequence
  chemically synthesized
gaatcaccattatttctcattt

SEQ ID NO: 994758 - DNA, 22 bp, Artificial Sequence
  chemically synthesized
tttctcatttgaattattgcaa

SEQ ID NO: 994759 - DNA, 22 bp, Artificial Sequence
  chemically synthesized
ctcatttgaattattgcaatga

SEQ ID NO: 994760 - DNA, 22 bp, Artificial Sequence
  chemically synthesized
aagcagagggagtcattgcaat

SEQ ID NO: 994761 - DNA, 22 bp, Artificial Sequence
  chemically synthesized
tcatttgaattattgcaatgac

SEQ ID NO: 994762 - DNA, 22 bp, Artificial Sequence
  chemically synthesized
atttgaattattgcaatgactc

SEQ ID NO: 994763 - DNA, 22 bp, Artificial Sequence
  chemically synthesized
ttgaagcagagggagtcattgc

SEQ ID NO: 994764 - DNA, 22 bp, Artificial Sequence
  chemically synthesized
gaattattgcaatgactccctc

SEQ ID NO: 994765 - DNA, 22 bp, Artificial Sequence
  chemically synthesized
aattattgcaatgactccctct

SEQ ID NO: 994766 - DNA, 22 bp, Artificial Sequence
  chemically synthesized
ttgcaatgactccctctgcttc

SEQ ID NO: 994767 - DNA, 22 bp, Artificial Sequence
  chemically synthesized
caatgactccctctgcttcaat

SEQ ID NO: 994768 - DNA, 22 bp, Artificial Sequence
  chemically synthesized
cctctgcttcaataggtactct

SEQ ID NO: 994769 - DNA, 22 bp, Artificial Sequence
  chemically synthesized
tgcttcaataggtactcttact

SEQ ID NO: 994770 - DNA, 22 bp, Artificial Sequence
  chemically synthesized
cttcaataggtactcttactct

SEQ ID NO: 994771 - DNA, 22 bp, Artificial Sequence
  chemically synthesized
caataggtactcttactctctg

SEQ ID NO: 994772 - DNA, 22 bp, Artificial Sequence
  chemically synthesized
aataggtactcttactctctgt

SEQ ID NO: 994773 - DNA, 22 bp, Artificial Sequence
  chemically synthesized
gccacggagtggagaacagaga

SEQ ID NO: 994774 - DNA, 22 bp, Artificial Sequence
  chemically synthesized
tagccacggagtggagaacaga

SEQ ID NO: 994775 - DNA, 22 bp, Artificial Sequence
  chemically synthesized
ttctagccacggagtggagaac

SEQ ID NO: 994776 - DNA, 22 bp, Artificial Sequence
  chemically synthesized
ttactctctgttctccactccg

SEQ ID NO: 994777 - DNA, 22 bp, Artificial Sequence
  chemically synthesized
actctctgttctccactccgtg

SEQ ID NO: 994778 - DNA, 22 bp, Artificial Sequence
  chemically synthesized
ctctctgttctccactccgtgg

SEQ ID NO: 994779 - DNA, 22 bp, Artificial Sequence
  chemically synthesized
tctgttctccactccgtggcta

SEQ ID NO: 994780 - DNA, 22 bp, Artificial Sequence
  chemically synthesized
tgttctccactccgtggctaga

SEQ ID NO: 994781 - DNA, 22 bp, Artificial Sequence
  chemically synthesized
ttctccactccgtggctagaac

SEQ ID NO: 994782 - DNA, 22 bp, Artificial Sequence
  chemically synthesized
tccactccgtggctagaacaat

SEQ ID NO: 994783 - DNA, 22 bp, Artificial Sequence
  chemically synthesized
cactccgtggctagaacaattc

SEQ ID NO: 994784 - DNA, 22 bp, Artificial Sequence
  chemically synthesized
gggaaagaaaggagatgaattg

SEQ ID NO: 994785 - DNA, 22 bp, Artificial Sequence
  chemically synthesized
cgtggctagaacaattcatctc

SEQ ID NO: 994786 - DNA, 22 bp, Artificial Sequence
  chemically synthesized
ggggaaagaaaggagatgaatt

SEQ ID NO: 994787 - DNA, 22 bp, Artificial Sequence
  chemically synthesized
atttggggaaagaaaggagatg

SEQ ID NO: 994788 - DNA, 22 bp, Artificial Sequence
  chemically synthesized
gaacaattcatctcctttcttt

SEQ ID NO: 994789 - DNA, 22 bp, Artificial Sequence
  chemically synthesized
agtaaactcatttggggaaaga

SEQ ID NO: 994790 - DNA, 22 bp, Artificial Sequence
  chemically synthesized
taagtaaactcatttggggaaa

SEQ ID NO: 994791 - DNA, 22 bp, Artificial Sequence
  chemically synthesized
ctaagtaaactcatttggggaa

SEQ ID NO: 994792 - DNA, 22 bp, Artificial Sequence
  chemically synthesized
atctcctttctttccccaaatg

SEQ ID NO: 994793 - DNA, 22 bp, Artificial Sequence
  chemically synthesized
tctaagtaaactcatttgggga

SEQ ID NO: 994794 - DNA, 22 bp, Artificial Sequence
  chemically synthesized
ctttctttccccaaatgagttt

SEQ ID NO: 994795 - DNA, 22 bp, Artificial Sequence
  chemically synthesized
tctttccccaaatgagtttact

SEQ ID NO: 994796 - DNA, 22 bp, Artificial Sequence
  chemically synthesized
ctttccccaaatgagtttactt

SEQ ID NO: 994797 - DNA, 22 bp, Artificial Sequence
  chemically synthesized
tttccccaaatgagtttactta

SEQ ID NO: 994798 - DNA, 22 bp, Artificial Sequence
  chemically synthesized
aagggagttttctaagtaaact

SEQ ID NO: 994799 - DNA, 22 bp, Artificial Sequence
  chemically synthesized
caagggagttttctaagtaaac

SEQ ID NO: 994800 - DNA, 22 bp, Artificial Sequence
  chemically synthesized
tccccaaatgagtttacttaga

SEQ ID NO: 994801 - DNA, 22 bp, Artificial Sequence
  chemically synthesized
tcaagggagttttctaagtaaa

SEQ ID NO: 994802 - DNA, 22 bp, Artificial Sequence
  chemically synthesized
ccccaaatgagtttacttagaa

SEQ ID NO: 994803 - DNA, 22 bp, Artificial Sequence
  chemically synthesized
ttcaagggagttttctaagtaa

SEQ ID NO: 994804 - DNA, 22 bp, Artificial Sequence
  chemically synthesized
cccaaatgagtttacttagaaa

SEQ ID NO: 994805 - DNA, 22 bp, Artificial Sequence
  chemically synthesized
tcttttcaagggagttttctaa

SEQ ID NO: 994806 - DNA, 22 bp, Artificial Sequence
  chemically synthesized
gtcttttcaagggagttttcta

SEQ ID NO: 994807 - DNA, 22 bp, Artificial Sequence
  chemically synthesized
tgtcttttcaagggagttttct

SEQ ID NO: 994808 - DNA, 22 bp, Artificial Sequence
  chemically synthesized
tgattttgtcttttcaagggag

SEQ ID NO: 994809 - DNA, 22 bp, Artificial Sequence
  chemically synthesized
acttagaaaactcccttgaaaa

SEQ ID NO: 994810 - DNA, 22 bp, Artificial Sequence
  chemically synthesized
tatgattttgtcttttcaaggg

SEQ ID NO: 994811 - DNA, 22 bp, Artificial Sequence
  chemically synthesized
cttagaaaactcccttgaaaag

SEQ ID NO: 994812 - DNA, 22 bp, Artificial Sequence
  chemically synthesized
agaaaactcccttgaaaagaca

SEQ ID NO: 994813 - DNA, 22 bp, Artificial Sequence
  chemically synthesized
gaaaactcccttgaaaagacaa

SEQ ID NO: 994814 - DNA, 22 bp, Artificial Sequence
  chemically synthesized
catctctatgattttgtctttt

SEQ ID NO: 994815 - DNA, 22 bp, Artificial Sequence
  chemically synthesized
tccatctctatgattttgtctt

SEQ ID NO: 994816 - DNA, 22 bp, Artificial Sequence
  chemically synthesized
ttctccatctctatgattttgt

SEQ ID NO: 994817 - DNA, 22 bp, Artificial Sequence
  chemically synthesized
ccttgaaaagacaaaatcatag

SEQ ID NO: 994818 - DNA, 22 bp, Artificial Sequence
  chemically synthesized
atctgttctccatctctatgat

SEQ ID NO: 994819 - DNA, 22 bp, Artificial Sequence
  chemically synthesized
gaaaagacaaaatcatagagat

SEQ ID NO: 994820 - DNA, 22 bp, Artificial Sequence
  chemically synthesized
aaaagacaaaatcatagagatg

SEQ ID NO: 994821 - DNA, 22 bp, Artificial Sequence
  chemically synthesized
gcaacccctaatctgttctcca

SEQ ID NO: 994822 - DNA, 22 bp, Artificial Sequence
  chemically synthesized
aatcactagcaacccctaatct

SEQ ID NO: 994823 - DNA, 22 bp, Artificial Sequence
  chemically synthesized
ctgaatcactagcaacccctaa

SEQ ID NO: 994824 - DNA, 22 bp, Artificial Sequence
  chemically synthesized
cctgaatcactagcaaccccta

SEQ ID NO: 994825 - DNA, 22 bp, Artificial Sequence
  chemically synthesized
cttcctgaatcactagcaaccc

SEQ ID NO: 994826 - DNA, 22 bp, Artificial Sequence
  chemically synthesized
tacttcctgaatcactagcaac

SEQ ID NO: 994827 - DNA, 22 bp, Artificial Sequence
  chemically synthesized
ccattctacttcctgaatcact

SEQ ID NO: 994828 - DNA, 22 bp, Artificial Sequence
  chemically synthesized
ggggttgctagtgattcaggaa

SEQ ID NO: 994829 - DNA, 22 bp, Artificial Sequence
  chemically synthesized
ctagtgattcaggaagtagaat

SEQ ID NO: 994830 - DNA, 22 bp, Artificial Sequence
  chemically synthesized
gtgattcaggaagtagaatggg

SEQ ID NO: 994831 - DNA, 22 bp, Artificial Sequence
  chemically synthesized
tcacacccatccaatctcccat

SEQ ID NO: 994832 - DNA, 22 bp, Artificial Sequence
  chemically synthesized
aggaagtagaatgggagattgg

SEQ ID NO: 994833 - DNA, 22 bp, Artificial Sequence
  chemically synthesized
attgtcacacccatccaatctc

SEQ ID NO: 994834 - DNA, 22 bp, Artificial Sequence
  chemically synthesized
aattgtcacacccatccaatct

SEQ ID NO: 994835 - DNA, 22 bp, Artificial Sequence
  chemically synthesized
taattgtcacacccatccaatc

SEQ ID NO: 994836 - DNA, 22 bp, Artificial Sequence
  chemically synthesized
aagccaccctttaattgtcaca

SEQ ID NO: 994837 - DNA, 22 bp, Artificial Sequence
  chemically synthesized
tctcaagccaccctttaattgt

SEQ ID NO: 994838 - DNA, 22 bp, Artificial Sequence
  chemically synthesized
gatgggtgtgacaattaaaggg

SEQ ID NO: 994839 - DNA, 22 bp, Artificial Sequence
  chemically synthesized
aagggtggcttgagatagttcc

SEQ ID NO: 994840 - DNA, 22 bp, Artificial Sequence
  chemically synthesized
cagcgtcacaaaggaactatct

SEQ ID NO: 994841 - DNA, 22 bp, Artificial Sequence
  chemically synthesized
aatagttccagcgtcacaaagg

SEQ ID NO: 994842 - DNA, 22 bp, Artificial Sequence
  chemically synthesized
gagatagttcctttgtgacgct

SEQ ID NO: 994843 - DNA, 22 bp, Artificial Sequence
  chemically synthesized
agatagttcctttgtgacgctg

SEQ ID NO: 994844 - DNA, 22 bp, Artificial Sequence
  chemically synthesized
ctttgtgacgctggaactattc

SEQ ID NO: 994845 - DNA, 22 bp, Artificial Sequence
  chemically synthesized
atacatggtactgaatagttcc

SEQ ID NO: 994846 - DNA, 22 bp, Artificial Sequence
  chemically synthesized
gatacatggtactgaatagttc

SEQ ID NO: 994847 - DNA, 22 bp, Artificial Sequence
  chemically synthesized
tgatacatggtactgaatagtt

SEQ ID NO: 994848 - DNA, 22 bp, Artificial Sequence
  chemically synthesized
tgtgacgctggaactattcagt

SEQ ID NO: 994849 - DNA, 22 bp, Artificial Sequence
  chemically synthesized
gtgacgctggaactattcagta

SEQ ID NO: 994850 - DNA, 22 bp, Artificial Sequence
  chemically synthesized
tgacgctggaactattcagtac

SEQ ID NO: 994851 - DNA, 22 bp, Artificial Sequence
  chemically synthesized
ttttgatacatggtactgaata

SEQ ID NO: 994852 - DNA, 22 bp, Artificial Sequence
  chemically synthesized
cccctattttgatacatggtac

SEQ ID NO: 994853 - DNA, 22 bp, Artificial Sequence
  chemically synthesized
gaactattcagtaccatgtatc

SEQ ID NO: 994854 - DNA, 22 bp, Artificial Sequence
  chemically synthesized
ttcagtaccatgtatcaaaata

SEQ ID NO: 994855 - DNA, 22 bp, Artificial Sequence
  chemically synthesized
agtaccatgtatcaaaataggg

SEQ ID NO: 994856 - DNA, 22 bp, Artificial Sequence
  chemically synthesized
gagtcatataacaactacccct

SEQ ID NO: 994857 - DNA, 22 bp, Artificial Sequence
  chemically synthesized
agagtcatataacaactacccc

SEQ ID NO: 994858 - DNA, 22 bp, Artificial Sequence
  chemically synthesized
taccatgtttagagtcatataa

SEQ ID NO: 994859 - DNA, 22 bp, Artificial Sequence
  chemically synthesized
ataccatgtttagagtcatata

SEQ ID NO: 994860 - DNA, 22 bp, Artificial Sequence
  chemically synthesized
tataccatgtttagagtcatat

SEQ ID NO: 994861 - DNA, 22 bp, Artificial Sequence
  chemically synthesized
tgcaattttataccatgtttag

SEQ ID NO: 994862 - DNA, 22 bp, Artificial Sequence
  chemically synthesized
ttatatgactctaaacatggta

SEQ ID NO: 994863 - DNA, 22 bp, Artificial Sequence
  chemically synthesized
tatgcaattttataccatgttt

SEQ ID NO: 994864 - DNA, 22 bp, Artificial Sequence
  chemically synthesized
tatgactctaaacatggtataa

SEQ ID NO: 994865 - DNA, 22 bp, Artificial Sequence
  chemically synthesized
tcattctatgcaattttatacc

SEQ ID NO: 994866 - DNA, 22 bp, Artificial Sequence
  chemically synthesized
taaacatggtataaaattgcat

SEQ ID NO: 994867 - DNA, 22 bp, Artificial Sequence
  chemically synthesized
tgtctgtcattctatgcaattt

SEQ ID NO: 994868 - DNA, 22 bp, Artificial Sequence
  chemically synthesized
aacatggtataaaattgcatag

SEQ ID NO: 994869 - DNA, 22 bp, Artificial Sequence
  chemically synthesized
tctgtgtctgtcattctatgca

SEQ ID NO: 994870 - DNA, 22 bp, Artificial Sequence
  chemically synthesized
atctgtgtctgtcattctatgc

SEQ ID NO: 994871 - DNA, 22 bp, Artificial Sequence
  chemically synthesized
catgcacttatctgtgtctgtc

SEQ ID NO: 994872 - DNA, 22 bp, Artificial Sequence
  chemically synthesized
acatgcacttatctgtgtctgt

SEQ ID NO: 994873 - DNA, 22 bp, Artificial Sequence
  chemically synthesized
tacatgcacttatctgtgtctg

SEQ ID NO: 994874 - DNA, 22 bp, Artificial Sequence
  chemically synthesized
ttacatgcacttatctgtgtct

SEQ ID NO: 994875 - DNA, 22 bp, Artificial Sequence
  chemically synthesized
catagaatgacagacacagata

SEQ ID NO: 994876 - DNA, 22 bp, Artificial Sequence
  chemically synthesized
accagcttttacatgcacttat

SEQ ID NO: 994877 - DNA, 22 bp, Artificial Sequence
  chemically synthesized
agatctcaccagcttttacatg

SEQ ID NO: 994878 - DNA, 22 bp, Artificial Sequence
  chemically synthesized
ttcagatctcaccagcttttac

SEQ ID NO: 994879 - DNA, 22 bp, Artificial Sequence
  chemically synthesized
attcagatctcaccagctttta

SEQ ID NO: 994880 - DNA, 22 bp, Artificial Sequence
  chemically synthesized
tgccttattcagatctcaccag

SEQ ID NO: 994881 - DNA, 22 bp, Artificial Sequence
  chemically synthesized
acacaatctatgccttattcag

SEQ ID NO: 994882 - DNA, 22 bp, Artificial Sequence
  chemically synthesized
gtgagatctgaataaggcatag

SEQ ID NO: 994883 - DNA, 22 bp, Artificial Sequence
  chemically synthesized
atattaacacaatctatgcctt

SEQ ID NO: 994884 - DNA, 22 bp, Artificial Sequence
  chemically synthesized
aataaggcatagattgtgttaa

SEQ ID NO: 994885 - DNA, 22 bp, Artificial Sequence
  chemically synthesized
tgttaatatcaatttcctggtt

SEQ ID NO: 994886 - DNA, 22 bp, Artificial Sequence
  chemically synthesized
tgcacaatataaaaaccaggaa

SEQ ID NO: 994887 - DNA, 22 bp, Artificial Sequence
  chemically synthesized
atatcaatttcctggtttttat

SEQ ID NO: 994888 - DNA, 22 bp, Artificial Sequence
  chemically synthesized
catagctatgcacaatataaaa

SEQ ID NO: 994889 - DNA, 22 bp, Artificial Sequence
  chemically synthesized
acatagctatgcacaatataaa

SEQ ID NO: 994890 - DNA, 22 bp, Artificial Sequence
  chemically synthesized
cctggtttttatattgtgcata

SEQ ID NO: 994891 - DNA, 22 bp, Artificial Sequence
  chemically synthesized
ctggtttttatattgtgcatag

SEQ ID NO: 994892 - DNA, 22 bp, Artificial Sequence
  chemically synthesized
acatcttacatagctatgcaca

SEQ ID NO: 994893 - DNA, 22 bp, Artificial Sequence
  chemically synthesized
gtttttatattgtgcatagcta

SEQ ID NO: 994894 - DNA, 22 bp, Artificial Sequence
  chemically synthesized
ttatattgtgcatagctatgta

SEQ ID NO: 994895 - DNA, 22 bp, Artificial Sequence
  chemically synthesized
tatattgtgcatagctatgtaa

SEQ ID NO: 994896 - DNA, 22 bp, Artificial Sequence
  chemically synthesized
agatctcacatcttacatagct

SEQ ID NO: 994897 - DNA, 22 bp, Artificial Sequence
  chemically synthesized
atattgtgcatagctatgtaag

SEQ ID NO: 994898 - DNA, 22 bp, Artificial Sequence
  chemically synthesized
tattgtgcatagctatgtaaga

SEQ ID NO: 994899 - DNA, 22 bp, Artificial Sequence
  chemically synthesized
ttcagatctcacatcttacata

SEQ ID NO: 994900 - DNA, 22 bp, Artificial Sequence
  chemically synthesized
attcagatctcacatcttacat

SEQ ID NO: 994901 - DNA, 22 bp, Artificial Sequence
  chemically synthesized
tattcagatctcacatcttaca

SEQ ID NO: 994902 - DNA, 22 bp, Artificial Sequence
  chemically synthesized
tgcatagctatgtaagatgtga

SEQ ID NO: 994903 - DNA, 22 bp, Artificial Sequence
  chemically synthesized
tgctttattcagatctcacatc

SEQ ID NO: 994904 - DNA, 22 bp, Artificial Sequence
  chemically synthesized
tgtaagatgtgagatctgaata

SEQ ID NO: 994905 - DNA, 22 bp, Artificial Sequence
  chemically synthesized
atacaatctatgctttattcag

SEQ ID NO: 994906 - DNA, 22 bp, Artificial Sequence
  chemically synthesized
atgttgatacaatctatgcttt

SEQ ID NO: 994907 - DNA, 22 bp, Artificial Sequence
  chemically synthesized
aataaagcatagattgtatcaa

SEQ ID NO: 994908 - DNA, 22 bp, Artificial Sequence
  chemically synthesized
tatcaacatcaatttcctggtt

SEQ ID NO: 994909 - DNA, 22 bp, Artificial Sequence
  chemically synthesized
tatgtaatatcaaagccaggaa

SEQ ID NO: 994910 - DNA, 22 bp, Artificial Sequence
  chemically synthesized
cctggtttcctggctttgatat

SEQ ID NO: 994911 - DNA, 22 bp, Artificial Sequence
  chemically synthesized
ctggtttcctggctttgatatt

SEQ ID NO: 994912 - DNA, 22 bp, Artificial Sequence
  chemically synthesized
cataattatatgtaatatcaaa

SEQ ID NO: 994913 - DNA, 22 bp, Artificial Sequence
  chemically synthesized
acataattatatgtaatatcaa

SEQ ID NO: 994914 - DNA, 22 bp, Artificial Sequence
  chemically synthesized
gtttcctggctttgatattaca

SEQ ID NO: 994915 - DNA, 22 bp, Artificial Sequence
  chemically synthesized
cctggctttgatattacatata

SEQ ID NO: 994916 - DNA, 22 bp, Artificial Sequence
  chemically synthesized
ctggctttgatattacatataa

SEQ ID NO: 994917 - DNA, 22 bp, Artificial Sequence
  chemically synthesized
catcttacataattatatgtaa

SEQ ID NO: 994918 - DNA, 22 bp, Artificial Sequence
  chemically synthesized
gctttgatattacatataatta

SEQ ID NO: 994919 - DNA, 22 bp, Artificial Sequence
  chemically synthesized
tgatattacatataattatgta

SEQ ID NO: 994920 - DNA, 22 bp, Artificial Sequence
  chemically synthesized
atggttacatcttacataatta

SEQ ID NO: 994921 - DNA, 22 bp, Artificial Sequence
  chemically synthesized
gatattacatataattatgtaa

SEQ ID NO: 994922 - DNA, 22 bp, Artificial Sequence
  chemically synthesized
atattacatataattatgtaag

SEQ ID NO: 994923 - DNA, 22 bp, Artificial Sequence
  chemically synthesized
agctaatggttacatcttacat

SEQ ID NO: 994924 - DNA, 22 bp, Artificial Sequence
  chemically synthesized
cagctaatggttacatcttaca

SEQ ID NO: 994925 - DNA, 22 bp, Artificial Sequence
  chemically synthesized
catataattatgtaagatgtaa

SEQ ID NO: 994926 - DNA, 22 bp, Artificial Sequence
  chemically synthesized
atcttcagctaatggttacatc

SEQ ID NO: 994927 - DNA, 22 bp, Artificial Sequence
  chemically synthesized
actcatcttcagctaatggtta

SEQ ID NO: 994928 - DNA, 22 bp, Artificial Sequence
  chemically synthesized
cactcatcttcagctaatggtt

SEQ ID NO: 994929 - DNA, 22 bp, Artificial Sequence
  chemically synthesized
tgtaagatgtaaccattagctg

SEQ ID NO: 994930 - DNA, 22 bp, Artificial Sequence
  chemically synthesized
gctgaagatgagtgaagggtac

SEQ ID NO: 994931 - DNA, 22 bp, Artificial Sequence
  chemically synthesized
agaaagatcatgagtacccttc

SEQ ID NO: 994932 - DNA, 22 bp, Artificial Sequence
  chemically synthesized
aagatgagtgaagggtactcat

SEQ ID NO: 994933 - DNA, 22 bp, Artificial Sequence
  chemically synthesized
caaaagtattaagaaagatcat

SEQ ID NO: 994934 - DNA, 22 bp, Artificial Sequence
  chemically synthesized
caggaagttgcaaaagtattaa

SEQ ID NO: 994935 - DNA, 22 bp, Artificial Sequence
  chemically synthesized
acaggaagttgcaaaagtatta

SEQ ID NO: 994936 - DNA, 22 bp, Artificial Sequence
  chemically synthesized
atgatctttcttaatacttttg

SEQ ID NO: 994937 - DNA, 22 bp, Artificial Sequence
  chemically synthesized
tcttaatacttttgcaacttcc

SEQ ID NO: 994938 - DNA, 22 bp, Artificial Sequence
  chemically synthesized
cttaatacttttgcaacttcct

SEQ ID NO: 994939 - DNA, 22 bp, Artificial Sequence
  chemically synthesized
ttaatacttttgcaacttcctg

SEQ ID NO: 994940 - DNA, 22 bp, Artificial Sequence
  chemically synthesized
aatacttttgcaacttcctgta

SEQ ID NO: 994941 - DNA, 22 bp, Artificial Sequence
  chemically synthesized
atacttttgcaacttcctgtaa

SEQ ID NO: 994942 - DNA, 22 bp, Artificial Sequence
  chemically synthesized
aaatacatatacacttacagga

SEQ ID NO: 994943 - DNA, 22 bp, Artificial Sequence
  chemically synthesized
gaaatacatatacacttacagg

SEQ ID NO: 994944 - DNA, 22 bp, Artificial Sequence
  chemically synthesized
tgaaatacatatacacttacag

SEQ ID NO: 994945 - DNA, 22 bp, Artificial Sequence
  chemically synthesized
ttgcaacttcctgtaagtgtat

SEQ ID NO: 994946 - DNA, 22 bp, Artificial Sequence
  chemically synthesized
tgcaacttcctgtaagtgtata

SEQ ID NO: 994947 - DNA, 22 bp, Artificial Sequence
  chemically synthesized
ttttgaaatacatatacactta

SEQ ID NO: 994948 - DNA, 22 bp, Artificial Sequence
  chemically synthesized
gcaacttcctgtaagtgtatat

SEQ ID NO: 994949 - DNA, 22 bp, Artificial Sequence
  chemically synthesized
caacttcctgtaagtgtatatg

SEQ ID NO: 994950 - DNA, 22 bp, Artificial Sequence
  chemically synthesized
ttattttgaaatacatatacac

SEQ ID NO: 994951 - DNA, 22 bp, Artificial Sequence
  chemically synthesized
gttattttgaaatacatataca

SEQ ID NO: 994952 - DNA, 22 bp, Artificial Sequence
  chemically synthesized
cctgtaagtgtatatgtatttc

SEQ ID NO: 994953 - DNA, 22 bp, Artificial Sequence
  chemically synthesized
ctgtaagtgtatatgtatttca

SEQ ID NO: 994954 - DNA, 22 bp, Artificial Sequence
  chemically synthesized
aaacttgttattttgaaataca

SEQ ID NO: 994955 - DNA, 22 bp, Artificial Sequence
  chemically synthesized
caaacttgttattttgaaatac

SEQ ID NO: 994956 - DNA, 22 bp, Artificial Sequence
  chemically synthesized
taagtgtatatgtatttcaaaa

SEQ ID NO: 994957 - DNA, 22 bp, Artificial Sequence
  chemically synthesized
tcaaacttgttattttgaaata

SEQ ID NO: 994958 - DNA, 22 bp, Artificial Sequence
  chemically synthesized
ttcaaacttgttattttgaaat

SEQ ID NO: 994959 - DNA, 22 bp, Artificial Sequence
  chemically synthesized
caaaataacaagtttgaaaaat

SEQ ID NO: 994960 - DNA, 22 bp, Artificial Sequence
  chemically synthesized
aaaataacaagtttgaaaaata

SEQ ID NO: 994961 - DNA, 22 bp, Artificial Sequence
  chemically synthesized
aggaatgccgtgtatatgcagt

SEQ ID NO: 994962 - DNA, 22 bp, Artificial Sequence
  chemically synthesized
gaggaatgccgtgtatatgcag

SEQ ID NO: 994963 - DNA, 22 bp, Artificial Sequence
  chemically synthesized
gaaaaatactgcatatacacgg

SEQ ID NO: 994964 - DNA, 22 bp, Artificial Sequence
  chemically synthesized
aaaaatactgcatatacacggc

SEQ ID NO: 994965 - DNA, 22 bp, Artificial Sequence
  chemically synthesized
catatacacggcattcctcaag

SEQ ID NO: 994966 - DNA, 22 bp, Artificial Sequence
  chemically synthesized
ctcaagactacggattttctgt

SEQ ID NO: 994967 - DNA, 22 bp, Artificial Sequence
  chemically synthesized
caggtagaagaaacagaaaatc

SEQ ID NO: 994968 - DNA, 22 bp, Artificial Sequence
  chemically synthesized
aagactacggattttctgtttc

SEQ ID NO: 994969 - DNA, 22 bp, Artificial Sequence
  chemically synthesized
cggattttctgtttcttctacc

SEQ ID NO: 994970 - DNA, 22 bp, Artificial Sequence
  chemically synthesized
gggaaagagcattccaggtaga

SEQ ID NO: 994971 - DNA, 22 bp, Artificial Sequence
  chemically synthesized
ggggaaagagcattccaggtag

SEQ ID NO: 994972 - DNA, 22 bp, Artificial Sequence
  chemically synthesized
tctgtttcttctacctggaatg

SEQ ID NO: 994973 - DNA, 22 bp, Artificial Sequence
  chemically synthesized
ctgtttcttctacctggaatgc

SEQ ID NO: 994974 - DNA, 22 bp, Artificial Sequence
  chemically synthesized
tgtttcttctacctggaatgct

SEQ ID NO: 994975 - DNA, 22 bp, Artificial Sequence
  chemically synthesized
tttcttctacctggaatgctct

SEQ ID NO: 994976 - DNA, 22 bp, Artificial Sequence
  chemically synthesized
catatttggggaaagagcattc

SEQ ID NO: 994977 - DNA, 22 bp, Artificial Sequence
  chemically synthesized
acatatttggggaaagagcatt

SEQ ID NO: 994978 - DNA, 22 bp, Artificial Sequence
  chemically synthesized
cttctacctggaatgctctttc

SEQ ID NO: 994979 - DNA, 22 bp, Artificial Sequence
  chemically synthesized
ttctacctggaatgctctttcc

SEQ ID NO: 994980 - DNA, 22 bp, Artificial Sequence
  chemically synthesized
ctacctggaatgctctttcccc

SEQ ID NO: 994981 - DNA, 22 bp, Artificial Sequence
  chemically synthesized
tacctggaatgctctttcccca

SEQ ID NO: 994982 - DNA, 22 bp, Artificial Sequence
  chemically synthesized
cctggaatgctctttccccaaa

SEQ ID NO: 994983 - DNA, 22 bp, Artificial Sequence
  chemically synthesized
tccatttacatatttggggaaa

SEQ ID NO: 994984 - DNA, 22 bp, Artificial Sequence
  chemically synthesized
gaatgctctttccccaaatatg

SEQ ID NO: 994985 - DNA, 22 bp, Artificial Sequence
  chemically synthesized
tttccccaaatatgtaaatgga

SEQ ID NO: 994986 - DNA, 22 bp, Artificial Sequence
  chemically synthesized
tccccaaatatgtaaatggata

SEQ ID NO: 994987 - DNA, 22 bp, Artificial Sequence
  chemically synthesized
ccccaaatatgtaaatggataa

SEQ ID NO: 994988 - DNA, 22 bp, Artificial Sequence
  chemically synthesized
cccaaatatgtaaatggataat

SEQ ID NO: 994989 - DNA, 22 bp, Artificial Sequence
  chemically synthesized
aaggaaggggagaaattatcca

SEQ ID NO: 994990 - DNA, 22 bp, Artificial Sequence
  chemically synthesized
aacagaaatctcaaggaagggg

SEQ ID NO: 994991 - DNA, 22 bp, Artificial Sequence
  chemically synthesized
gaacagaaatctcaaggaaggg

SEQ ID NO: 994992 - DNA, 22 bp, Artificial Sequence
  chemically synthesized
ctccccttccttgagatttctg

SEQ ID NO: 994993 - DNA, 22 bp, Artificial Sequence
  chemically synthesized
tccccttccttgagatttctgt

SEQ ID NO: 994994 - DNA, 22 bp, Artificial Sequence
  chemically synthesized
cccttccttgagatttctgttc

SEQ ID NO: 994995 - DNA, 22 bp, Artificial Sequence
  chemically synthesized
tgaggtgacatttgaacagaaa

SEQ ID NO: 994996 - DNA, 22 bp, Artificial Sequence
  chemically synthesized
tatgaggtgacatttgaacaga

SEQ ID NO: 994997 - DNA, 22 bp, Artificial Sequence
  chemically synthesized
ccttgagatttctgttcaaatg

SEQ ID NO: 994998 - DNA, 22 bp, Artificial Sequence
  chemically synthesized
cttgagatttctgttcaaatgt

SEQ ID NO: 994999 - DNA, 22 bp, Artificial Sequence
  chemically synthesized
gagatttctgttcaaatgtcac

SEQ ID NO: 995000 - DNA, 22 bp, Artificial Sequence
  chemically synthesized
agatttctgttcaaatgtcacc

SEQ ID NO: 995001 - DNA, 22 bp, Artificial Sequence
  chemically synthesized
ggcagacctctatgaggtgaca

SEQ ID NO: 995002 - DNA, 22 bp, Artificial Sequence
  chemically synthesized
tgggcagacctctatgaggtga

SEQ ID NO: 995003 - DNA, 22 bp, Artificial Sequence
  chemically synthesized
ctgttcaaatgtcacctcatag

SEQ ID NO: 995004 - DNA, 22 bp, Artificial Sequence
  chemically synthesized
tgttcaaatgtcacctcataga

SEQ ID NO: 995005 - DNA, 22 bp, Artificial Sequence
  chemically synthesized
ttcaaatgtcacctcatagagg

SEQ ID NO: 995006 - DNA, 22 bp, Artificial Sequence
  chemically synthesized
aaatgtcacctcatagaggtct

SEQ ID NO: 995007 - DNA, 22 bp, Artificial Sequence
  chemically synthesized
tgtatgacactctgggcagacc

SEQ ID NO: 995008 - DNA, 22 bp, Artificial Sequence
  chemically synthesized
atgtatgacactctgggcagac

SEQ ID NO: 995009 - DNA, 22 bp, Artificial Sequence
  chemically synthesized
tatgtatgacactctgggcaga

SEQ ID NO: 995010 - DNA, 22 bp, Artificial Sequence
  chemically synthesized
atagaggtctgcccagagtgtc

SEQ ID NO: 995011 - DNA, 22 bp, Artificial Sequence
  chemically synthesized
atattttatgtatgacactctg

SEQ ID NO: 995012 - DNA, 22 bp, Artificial Sequence
  chemically synthesized
cccagagtgtcatacataaaat

SEQ ID NO: 995013 - DNA, 22 bp, Artificial Sequence
  chemically synthesized
tgccgagccaaaattgatattt

SEQ ID NO: 995014 - DNA, 22 bp, Artificial Sequence
  chemically synthesized
cagacatggtccattgtgccga

SEQ ID NO: 995015 - DNA, 22 bp, Artificial Sequence
  chemically synthesized
aaattacagacatggtccattg

SEQ ID NO: 995016 - DNA, 22 bp, Artificial Sequence
  chemically synthesized
tggctcggcacaatggaccatg

SEQ ID NO: 995017 - DNA, 22 bp, Artificial Sequence
  chemically synthesized
ggctcggcacaatggaccatgt

SEQ ID NO: 995018 - DNA, 22 bp, Artificial Sequence
  chemically synthesized
gctcggcacaatggaccatgtc

SEQ ID NO: 995019 - DNA, 22 bp, Artificial Sequence
  chemically synthesized
ggcacaatggaccatgtctgta

SEQ ID NO: 995020 - DNA, 22 bp, Artificial Sequence
  chemically synthesized
aagtgctgaaattacagacatg

SEQ ID NO: 995021 - DNA, 22 bp, Artificial Sequence
  chemically synthesized
cacccctaaagtgctgaaatta

SEQ ID NO: 995022 - DNA, 22 bp, Artificial Sequence
  chemically synthesized
cctccacccctaaagtgctgaa

SEQ ID NO: 995023 - DNA, 22 bp, Artificial Sequence
  chemically synthesized
gcctccacccctaaagtgctga

SEQ ID NO: 995024 - DNA, 22 bp, Artificial Sequence
  chemically synthesized
cttgcctccacccctaaagtgc

SEQ ID NO: 995025 - DNA, 22 bp, Artificial Sequence
  chemically synthesized
taatttcagcactttaggggtg

SEQ ID NO: 995026 - DNA, 22 bp, Artificial Sequence
  chemically synthesized
cagcactttaggggtggaggca

SEQ ID NO: 995027 - DNA, 22 bp, Artificial Sequence
  chemically synthesized
aagcgatctgcttgcctccacc

SEQ ID NO: 995028 - DNA, 22 bp, Artificial Sequence
  chemically synthesized
agcactttaggggtggaggcaa

SEQ ID NO: 995029 - DNA, 22 bp, Artificial Sequence
  chemically synthesized
cgctcaagcgatctgcttgcct

SEQ ID NO: 995030 - DNA, 22 bp, Artificial Sequence
  chemically synthesized
taggggtggaggcaagcagatc

SEQ ID NO: 995031 - DNA, 22 bp, Artificial Sequence
  chemically synthesized
ctgcgctcaagcgatctgcttg

SEQ ID NO: 995032 - DNA, 22 bp, Artificial Sequence
  chemically synthesized
aggggtggaggcaagcagatcg

SEQ ID NO: 995033 - DNA, 22 bp, Artificial Sequence
  chemically synthesized
ggggtggaggcaagcagatcgc

SEQ ID NO: 995034 - DNA, 22 bp, Artificial Sequence
  chemically synthesized
actcctgcgctcaagcgatctg

SEQ ID NO: 995035 - DNA, 22 bp, Artificial Sequence
  chemically synthesized
aactcctgcgctcaagcgatct

SEQ ID NO: 995036 - DNA, 22 bp, Artificial Sequence
  chemically synthesized
gtcttaactcctgcgctcaagc

SEQ ID NO: 995037 - DNA, 22 bp, Artificial Sequence
  chemically synthesized
agtaccactggtcttaactcct

SEQ ID NO: 995038 - DNA, 22 bp, Artificial Sequence
  chemically synthesized
cctcagtaccactggtcttaac

SEQ ID NO: 995039 - DNA, 22 bp, Artificial Sequence
  chemically synthesized
gagcgcaggagttaagaccagt

SEQ ID NO: 995040 - DNA, 22 bp, Artificial Sequence
  chemically synthesized
agcgcaggagttaagaccagtg

SEQ ID NO: 995041 - DNA, 22 bp, Artificial Sequence
  chemically synthesized
actacctcagtaccactggtct

SEQ ID NO: 995042 - DNA, 22 bp, Artificial Sequence
  chemically synthesized
agaccagtggtactgaggtagt

SEQ ID NO: 995043 - DNA, 22 bp, Artificial Sequence
  chemically synthesized
tagcagtacctcactacctcag

SEQ ID NO: 995044 - DNA, 22 bp, Artificial Sequence
  chemically synthesized
atagcagtacctcactacctca

SEQ ID NO: 995045 - DNA, 22 bp, Artificial Sequence
  chemically synthesized
tatagcagtacctcactacctc

SEQ ID NO: 995046 - DNA, 22 bp, Artificial Sequence
  chemically synthesized
aagtatctttatagcagtacct

SEQ ID NO: 995047 - DNA, 22 bp, Artificial Sequence
  chemically synthesized
caagtatctttatagcagtacc

SEQ ID NO: 995048 - DNA, 22 bp, Artificial Sequence
  chemically synthesized
tcaagtatctttatagcagtac

SEQ ID NO: 995049 - DNA, 22 bp, Artificial Sequence
  chemically synthesized
aggtagtgaggtactgctataa

SEQ ID NO: 995050 - DNA, 22 bp, Artificial Sequence
  chemically synthesized
cacattttcaagtatctttata

SEQ ID NO: 995051 - DNA, 22 bp, Artificial Sequence
  chemically synthesized
ccacattttcaagtatctttat

SEQ ID NO: 995052 - DNA, 22 bp, Artificial Sequence
  chemically synthesized
cttccacattttcaagtatctt

SEQ ID NO: 995053 - DNA, 22 bp, Artificial Sequence
  chemically synthesized
aagttgcttccacattttcaag

SEQ ID NO: 995054 - DNA, 22 bp, Artificial Sequence
  chemically synthesized
ctataaagatacttgaaaatgt

SEQ ID NO: 995055 - DNA, 22 bp, Artificial Sequence
  chemically synthesized
taaagttgcttccacattttca

SEQ ID NO: 995056 - DNA, 22 bp, Artificial Sequence
  chemically synthesized
taaagatacttgaaaatgtgga

SEQ ID NO: 995057 - DNA, 22 bp, Artificial Sequence
  chemically synthesized
cccagttctaaagttgcttcca

SEQ ID NO: 995058 - DNA, 22 bp, Artificial Sequence
  chemically synthesized
ttacccagttctaaagttgctt

SEQ ID NO: 995059 - DNA, 22 bp, Artificial Sequence
  chemically synthesized
gaaaatgtggaagcaactttag

SEQ ID NO: 995060 - DNA, 22 bp, Artificial Sequence
  chemically synthesized
aaaatgtggaagcaactttaga

SEQ ID NO: 995061 - DNA, 22 bp, Artificial Sequence
  chemically synthesized
cctattacccagttctaaagtt

SEQ ID NO: 995062 - DNA, 22 bp, Artificial Sequence
  chemically synthesized
caacccctgcctattacccagt

SEQ ID NO: 995063 - DNA, 22 bp, Artificial Sequence
  chemically synthesized
ttccaacccctgcctattaccc

SEQ ID NO: 995064 - DNA, 22 bp, Artificial Sequence
  chemically synthesized
actgttccaacccctgcctatt

SEQ ID NO: 995065 - DNA, 22 bp, Artificial Sequence
  chemically synthesized
tagaactgggtaataggcaggg

SEQ ID NO: 995066 - DNA, 22 bp, Artificial Sequence
  chemically synthesized
agaactgggtaataggcagggg

SEQ ID NO: 995067 - DNA, 22 bp, Artificial Sequence
  chemically synthesized
gaactgggtaataggcaggggt

SEQ ID NO: 995068 - DNA, 22 bp, Artificial Sequence
  chemically synthesized
ctaactgttccaacccctgcct

SEQ ID NO: 995069 - DNA, 22 bp, Artificial Sequence
  chemically synthesized
ggtaataggcaggggttggaac

SEQ ID NO: 995070 - DNA, 22 bp, Artificial Sequence
  chemically synthesized
agcctcctaactgttccaaccc

SEQ ID NO: 995071 - DNA, 22 bp, Artificial Sequence
  chemically synthesized
tgagcctcctaactgttccaac

SEQ ID NO: 995072 - DNA, 22 bp, Artificial Sequence
  chemically synthesized
ctgagcctcctaactgttccaa

SEQ ID NO: 995073 - DNA, 22 bp, Artificial Sequence
  chemically synthesized
ttctgagcctcctaactgttcc

SEQ ID NO: 995074 - DNA, 22 bp, Artificial Sequence
  chemically synthesized
cttctgagcctcctaactgttc

SEQ ID NO: 995075 - DNA, 22 bp, Artificial Sequence
  chemically synthesized
tcttcttctgagcctcctaact

SEQ ID NO: 995076 - DNA, 22 bp, Artificial Sequence
  chemically synthesized
ctgtcttcttctgagcctccta

SEQ ID NO: 995077 - DNA, 22 bp, Artificial Sequence
  chemically synthesized
cctgtcttcttctgagcctcct

SEQ ID NO: 995078 - DNA, 22 bp, Artificial Sequence
  chemically synthesized
tcctgtcttcttctgagcctcc

SEQ ID NO: 995079 - DNA, 22 bp, Artificial Sequence
  chemically synthesized
gaacagttaggaggctcagaag

SEQ ID NO: 995080 - DNA, 22 bp, Artificial Sequence
  chemically synthesized
cacattttcctgtcttcttctg

SEQ ID NO: 995081 - DNA, 22 bp, Artificial Sequence
  chemically synthesized
ccacattttcctgtcttcttct

SEQ ID NO: 995082 - DNA, 22 bp, Artificial Sequence
  chemically synthesized
tccacattttcctgtcttcttc

SEQ ID NO: 995083 - DNA, 22 bp, Artificial Sequence
  chemically synthesized
ttccacattttcctgtcttctt

SEQ ID NO: 995084 - DNA, 22 bp, Artificial Sequence
  chemically synthesized
ggaggctcagaagaagacagga

SEQ ID NO: 995085 - DNA, 22 bp, Artificial Sequence
  chemically synthesized
caaacttttccacattttcctg

SEQ ID NO: 995086 - DNA, 22 bp, Artificial Sequence
  chemically synthesized
agaagaagacaggaaaatgtgg

SEQ ID NO: 995087 - DNA, 22 bp, Artificial Sequence
  chemically synthesized
ggaagttccaaacttttccaca

SEQ ID NO: 995088 - DNA, 22 bp, Artificial Sequence
  chemically synthesized
taggaagttccaaacttttcca

SEQ ID NO: 995089 - DNA, 22 bp, Artificial Sequence
  chemically synthesized
aacaagtctctaggaagttcca

SEQ ID NO: 995090 - DNA, 22 bp, Artificial Sequence
  chemically synthesized
ggaacttcctagagacttgttg

SEQ ID NO: 995091 - DNA, 22 bp, Artificial Sequence
  chemically synthesized
gtcaaaaccattcaacaagtct

SEQ ID NO: 995092 - DNA, 22 bp, Artificial Sequence
  chemically synthesized
gaacttcctagagacttgttga

SEQ ID NO: 995093 - DNA, 22 bp, Artificial Sequence
  chemically synthesized
ggtcaaaaccattcaacaagtc

SEQ ID NO: 995094 - DNA, 22 bp, Artificial Sequence
  chemically synthesized
tggtcaaaaccattcaacaagt

SEQ ID NO: 995095 - DNA, 22 bp, Artificial Sequence
  chemically synthesized
cctagagacttgttgaatggtt

SEQ ID NO: 995096 - DNA, 22 bp, Artificial Sequence
  chemically synthesized
ctagagacttgttgaatggttt

SEQ ID NO: 995097 - DNA, 22 bp, Artificial Sequence
  chemically synthesized
gagacttgttgaatggttttga

SEQ ID NO: 995098 - DNA, 22 bp, Artificial Sequence
  chemically synthesized
tcagcattttggtcaaaaccat

SEQ ID NO: 995099 - DNA, 22 bp, Artificial Sequence
  chemically synthesized
gttgaatggttttgaccaaaat

SEQ ID NO: 995100 - DNA, 22 bp, Artificial Sequence
  chemically synthesized
ttgaatggttttgaccaaaatg

SEQ ID NO: 995101 - DNA, 22 bp, Artificial Sequence
  chemically synthesized
gtatcactatcagcattttggt

SEQ ID NO: 995102 - DNA, 22 bp, Artificial Sequence
  chemically synthesized
aatggttttgaccaaaatgctg

SEQ ID NO: 995103 - DNA, 22 bp, Artificial Sequence
  chemically synthesized
agtgttcgtatcactatcagca

SEQ ID NO: 995104 - DNA, 22 bp, Artificial Sequence
  chemically synthesized
cagtgttcgtatcactatcagc

SEQ ID NO: 995105 - DNA, 22 bp, Artificial Sequence
  chemically synthesized
tgaccaaaatgctgatagtgat

SEQ ID NO: 995106 - DNA, 22 bp, Artificial Sequence
  chemically synthesized
gaccaaaatgctgatagtgata

SEQ ID NO: 995107 - DNA, 22 bp, Artificial Sequence
  chemically synthesized
accaaaatgctgatagtgatac

SEQ ID NO: 995108 - DNA, 22 bp, Artificial Sequence
  chemically synthesized
gacttcagtgttcgtatcacta

SEQ ID NO: 995109 - DNA, 22 bp, Artificial Sequence
  chemically synthesized
cctggacttcagtgttcgtatc

SEQ ID NO: 995110 - DNA, 22 bp, Artificial Sequence
  chemically synthesized
tgcctggacttcagtgttcgta

SEQ ID NO: 995111 - DNA, 22 bp, Artificial Sequence
  chemically synthesized
atagtgatacgaacactgaagt

SEQ ID NO: 995112 - DNA, 22 bp, Artificial Sequence
  chemically synthesized
agaccacctctgcctggacttc

SEQ ID NO: 995113 - DNA, 22 bp, Artificial Sequence
  chemically synthesized
catctgagaccacctctgcctg

SEQ ID NO: 995114 - DNA, 22 bp, Artificial Sequence
  chemically synthesized
atctccatctgagaccacctct

SEQ ID NO: 995115 - DNA, 22 bp, Artificial Sequence
  chemically synthesized
catctccatctgagaccacctc

SEQ ID NO: 995116 - DNA, 22 bp, Artificial Sequence
  chemically synthesized
aagtccaggcagaggtggtctc

SEQ ID NO: 995117 - DNA, 22 bp, Artificial Sequence
  chemically synthesized
ttcatctccatctgagaccacc

SEQ ID NO: 995118 - DNA, 22 bp, Artificial Sequence
  chemically synthesized
ccaataagttcttcatctccat

SEQ ID NO: 995119 - DNA, 22 bp, Artificial Sequence
  chemically synthesized
cagttaccaataagttcttcat

SEQ ID NO: 995120 - DNA, 22 bp, Artificial Sequence
  chemically synthesized
ctccagttaccaataagttctt

SEQ ID NO: 995121 - DNA, 22 bp, Artificial Sequence
  chemically synthesized
agatggagatgaagaacttatt

SEQ ID NO: 995122 - DNA, 22 bp, Artificial Sequence
  chemically synthesized
actccagttaccaataagttct

SEQ ID NO: 995123 - DNA, 22 bp, Artificial Sequence
  chemically synthesized
tactccagttaccaataagttc

SEQ ID NO: 995124 - DNA, 22 bp, Artificial Sequence
  chemically synthesized
attggtaactggagtaaaggtc

SEQ ID NO: 995125 - DNA, 22 bp, Artificial Sequence
  chemically synthesized
ttggtaactggagtaaaggtca

SEQ ID NO: 995126 - DNA, 22 bp, Artificial Sequence
  chemically synthesized
gtcatagcaagaatgaccttta

SEQ ID NO: 995127 - DNA, 22 bp, Artificial Sequence
  chemically synthesized
gtaactggagtaaaggtcattc

SEQ ID NO: 995128 - DNA, 22 bp, Artificial Sequence
  chemically synthesized
ttagtcatagcaagaatgacct

SEQ ID NO: 995129 - DNA, 22 bp, Artificial Sequence
  chemically synthesized
gttagtcatagcaagaatgacc

SEQ ID NO: 995130 - DNA, 22 bp, Artificial Sequence
  chemically synthesized
tgttagtcatagcaagaatgac

SEQ ID NO: 995131 - DNA, 22 bp, Artificial Sequence
  chemically synthesized
tttgttagtcatagcaagaatg

SEQ ID NO: 995132 - DNA, 22 bp, Artificial Sequence
  chemically synthesized
gagtaaaggtcattcttgctat

SEQ ID NO: 995133 - DNA, 22 bp, Artificial Sequence
  chemically synthesized
ttgctatgactaacaaagagac

SEQ ID NO: 995134 - DNA, 22 bp, Artificial Sequence
  chemically synthesized
gctatgactaacaaagagactg

SEQ ID NO: 995135 - DNA, 22 bp, Artificial Sequence
  chemically synthesized
ctatgactaacaaagagactgg

SEQ ID NO: 995136 - DNA, 22 bp, Artificial Sequence
  chemically synthesized
tgactaacaaagagactggcat

SEQ ID NO: 995137 - DNA, 22 bp, Artificial Sequence
  chemically synthesized
ggtcagggtcaaaatgatgcca

SEQ ID NO: 995138 - DNA, 22 bp, Artificial Sequence
  chemically synthesized
acaaagagactggcatcatttt

SEQ ID NO: 995139 - DNA, 22 bp, Artificial Sequence
  chemically synthesized
taggtcagggtcaaaatgatgc

SEQ ID NO: 995140 - DNA, 22 bp, Artificial Sequence
  chemically synthesized
cacagatctctaggtcagggtc

SEQ ID NO: 995141 - DNA, 22 bp, Artificial Sequence
  chemically synthesized
gcatcattttgaccctgaccta

SEQ ID NO: 995142 - DNA, 22 bp, Artificial Sequence
  chemically synthesized
aaagttccacagatctctaggt

SEQ ID NO: 995143 - DNA, 22 bp, Artificial Sequence
  chemically synthesized
tgaccctgacctagagatctgt

SEQ ID NO: 995144 - DNA, 22 bp, Artificial Sequence
  chemically synthesized
gaccctgacctagagatctgtg

SEQ ID NO: 995145 - DNA, 22 bp, Artificial Sequence
  chemically synthesized
accctgacctagagatctgtgg

SEQ ID NO: 995146 - DNA, 22 bp, Artificial Sequence
  chemically synthesized
aagttcaaagttccacagatct

SEQ ID NO: 995147 - DNA, 22 bp, Artificial Sequence
  chemically synthesized
tcaagttcaaagttccacagat

SEQ ID NO: 995148 - DNA, 22 bp, Artificial Sequence
  chemically synthesized
acctagagatctgtggaacttt

SEQ ID NO: 995149 - DNA, 22 bp, Artificial Sequence
  chemically synthesized
gagatctgtggaactttgaact

SEQ ID NO: 995150 - DNA, 22 bp, Artificial Sequence
  chemically synthesized
aatcatctctcaagttcaaagt

SEQ ID NO: 995151 - DNA, 22 bp, Artificial Sequence
  chemically synthesized
aaatcatctctcaagttcaaag

SEQ ID NO: 995152 - DNA, 22 bp, Artificial Sequence
  chemically synthesized
tggaactttgaacttgagagat

SEQ ID NO: 995153 - DNA, 22 bp, Artificial Sequence
  chemically synthesized
tcagataccttaaatcatctct

SEQ ID NO: 995154 - DNA, 22 bp, Artificial Sequence
  chemically synthesized
tgtcagataccttaaatcatct

SEQ ID NO: 995155 - DNA, 22 bp, Artificial Sequence
  chemically synthesized
ctgtcagataccttaaatcatc

SEQ ID NO: 995156 - DNA, 22 bp, Artificial Sequence
  chemically synthesized
tgaacttgagagatgatttaag

SEQ ID NO: 995157 - DNA, 22 bp, Artificial Sequence
  chemically synthesized
gaacttgagagatgatttaagg

SEQ ID NO: 995158 - DNA, 22 bp, Artificial Sequence
  chemically synthesized
ttctgtcagataccttaaatca

SEQ ID NO: 995159 - DNA, 22 bp, Artificial Sequence
  chemically synthesized
aacttgagagatgatttaaggt

SEQ ID NO: 995160 - DNA, 22 bp, Artificial Sequence
  chemically synthesized
cttctgtcagataccttaaatc

SEQ ID NO: 995161 - DNA, 22 bp, Artificial Sequence
  chemically synthesized
gagagatgatttaaggtatctg

SEQ ID NO: 995162 - DNA, 22 bp, Artificial Sequence
  chemically synthesized
agagatgatttaaggtatctga

SEQ ID NO: 995163 - DNA, 22 bp, Artificial Sequence
  chemically synthesized
gaaatttcttctgtcagatacc

SEQ ID NO: 995164 - DNA, 22 bp, Artificial Sequence
  chemically synthesized
agaaatttcttctgtcagatac

SEQ ID NO: 995165 - DNA, 22 bp, Artificial Sequence
  chemically synthesized
cttagaaatttcttctgtcaga

SEQ ID NO: 995166 - DNA, 22 bp, Artificial Sequence
  chemically synthesized
ctgcttagaaatttcttctgtc

SEQ ID NO: 995167 - DNA, 22 bp, Artificial Sequence
  chemically synthesized
gctgcttagaaatttcttctgt

SEQ ID NO: 995168 - DNA, 22 bp, Artificial Sequence
  chemically synthesized
tgctgcttagaaatttcttctg

SEQ ID NO: 995169 - DNA, 22 bp, Artificial Sequence
  chemically synthesized
aaggtatctgacagaagaaatt

SEQ ID NO: 995170 - DNA, 22 bp, Artificial Sequence
  chemically synthesized
aggtatctgacagaagaaattt

SEQ ID NO: 995171 - DNA, 22 bp, Artificial Sequence
  chemically synthesized
aatgctttgctgcttagaaatt

SEQ ID NO: 995172 - DNA, 22 bp, Artificial Sequence
  chemically synthesized
gaatgctttgctgcttagaaat

SEQ ID NO: 995173 - DNA, 22 bp, Artificial Sequence
  chemically synthesized
ttgaatgctttgctgcttagaa

SEQ ID NO: 995174 - DNA, 22 bp, Artificial Sequence
  chemically synthesized
acagaagaaatttctaagcagc

SEQ ID NO: 995175 - DNA, 22 bp, Artificial Sequence
  chemically synthesized
tgacctcttgaatgctttgctg

SEQ ID NO: 995176 - DNA, 22 bp, Artificial Sequence
  chemically synthesized
tgtgacctcttgaatgctttgc

SEQ ID NO: 995177 - DNA, 22 bp, Artificial Sequence
  chemically synthesized
ctaagcagcaaagcattcaaga

SEQ ID NO: 995178 - DNA, 22 bp, Artificial Sequence
  chemically synthesized
tgctctgtgacctcttgaatgc

SEQ ID NO: 995179 - DNA, 22 bp, Artificial Sequence
  chemically synthesized
taagcagcaaagcattcaagag

SEQ ID NO: 995180 - DNA, 22 bp, Artificial Sequence
  chemically synthesized
atgctctgtgacctcttgaatg

SEQ ID NO: 995181 - DNA, 22 bp, Artificial Sequence
  chemically synthesized
tatgctctgtgacctcttgaat

SEQ ID NO: 995182 - DNA, 22 bp, Artificial Sequence
  chemically synthesized
agcagcaaagcattcaagaggt

SEQ ID NO: 995183 - DNA, 22 bp, Artificial Sequence
  chemically synthesized
ttatgctctgtgacctcttgaa

SEQ ID NO: 995184 - DNA, 22 bp, Artificial Sequence
  chemically synthesized
aaacttttatgctctgtgacct

SEQ ID NO: 995185 - DNA, 22 bp, Artificial Sequence
  chemically synthesized
caaacttttatgctctgtgacc

SEQ ID NO: 995186 - DNA, 22 bp, Artificial Sequence
  chemically synthesized
tcaaacttttatgctctgtgac

SEQ ID NO: 995187 - DNA, 22 bp, Artificial Sequence
  chemically synthesized
ttcaaacttttatgctctgtga

SEQ ID NO: 995188 - DNA, 22 bp, Artificial Sequence
  chemically synthesized
aagaggtcacagagcataaaag

SEQ ID NO: 995189 - DNA, 22 bp, Artificial Sequence
  chemically synthesized
caaatttttcaaacttttatgc

SEQ ID NO: 995190 - DNA, 22 bp, Artificial Sequence
  chemically synthesized
tcaggttgcaaatttttcaaac

SEQ ID NO: 995191 - DNA, 22 bp, Artificial Sequence
  chemically synthesized
cattgtcaggttgcaaattttt

SEQ ID NO: 995192 - DNA, 22 bp, Artificial Sequence
  chemically synthesized
ctgcattgtcaggttgcaaatt

SEQ ID NO: 995193 - DNA, 22 bp, Artificial Sequence
  chemically synthesized
tactgcattgtcaggttgcaaa

SEQ ID NO: 995194 - DNA, 22 bp, Artificial Sequence
  chemically synthesized
ctactgcattgtcaggttgcaa

SEQ ID NO: 995195 - DNA, 22 bp, Artificial Sequence
  chemically synthesized
tctactgcattgtcaggttgca

SEQ ID NO: 995196 - DNA, 22 bp, Artificial Sequence
  chemically synthesized
ttctactgcattgtcaggttgc

SEQ ID NO: 995197 - DNA, 22 bp, Artificial Sequence
  chemically synthesized
ttttctactgcattgtcaggtt

SEQ ID NO: 995198 - DNA, 22 bp, Artificial Sequence
  chemically synthesized
gaaaaatttgcaacctgacaat

SEQ ID NO: 995199 - DNA, 22 bp, Artificial Sequence
  chemically synthesized
cttttctactgcattgtcaggt

SEQ ID NO: 995200 - DNA, 22 bp, Artificial Sequence
  chemically synthesized
aaaaatttgcaacctgacaatg

SEQ ID NO: 995201 - DNA, 22 bp, Artificial Sequence
  chemically synthesized
tcttttctactgcattgtcagg

SEQ ID NO: 995202 - DNA, 22 bp, Artificial Sequence
  chemically synthesized
ttcttttctactgcattgtcag

SEQ ID NO: 995203 - DNA, 22 bp, Artificial Sequence
  chemically synthesized
gcaacctgacaatgcagtagaa

SEQ ID NO: 995204 - DNA, 22 bp, Artificial Sequence
  chemically synthesized
caacctgacaatgcagtagaaa

SEQ ID NO: 995205 - DNA, 22 bp, Artificial Sequence
  chemically synthesized
cagaaaatgggtttttcttttc

SEQ ID NO: 995206 - DNA, 22 bp, Artificial Sequence
  chemically synthesized
acaatgcagtagaaaagaaaaa

SEQ ID NO: 995207 - DNA, 22 bp, Artificial Sequence
  chemically synthesized
tccagaaaatgggtttttcttt

SEQ ID NO: 995208 - DNA, 22 bp, Artificial Sequence
  chemically synthesized
cagccagcctctccagaaaatg

SEQ ID NO: 995209 - DNA, 22 bp, Artificial Sequence
  chemically synthesized
tacagccagcctctccagaaaa

SEQ ID NO: 995210 - DNA, 22 bp, Artificial Sequence
  chemically synthesized
ctacagccagcctctccagaaa

SEQ ID NO: 995211 - DNA, 22 bp, Artificial Sequence
  chemically synthesized
aatatgcaaatttctacagcca

SEQ ID NO: 995212 - DNA, 22 bp, Artificial Sequence
  chemically synthesized
tctggagaggctggctgtagaa

SEQ ID NO: 995213 - DNA, 22 bp, Artificial Sequence
  chemically synthesized
ctggagaggctggctgtagaaa

SEQ ID NO: 995214 - DNA, 22 bp, Artificial Sequence
  chemically synthesized
tggagaggctggctgtagaaat

SEQ ID NO: 995215 - DNA, 22 bp, Artificial Sequence
  chemically synthesized
ttaaatatgcaaatttctacag

SEQ ID NO: 995216 - DNA, 22 bp, Artificial Sequence
  chemically synthesized
gttaaatatgcaaatttctaca

SEQ ID NO: 995217 - DNA, 22 bp, Artificial Sequence
  chemically synthesized
gagaggctggctgtagaaattt

SEQ ID NO: 995218 - DNA, 22 bp, Artificial Sequence
  chemically synthesized
cttgttaaatatgcaaatttct

SEQ ID NO: 995219 - DNA, 22 bp, Artificial Sequence
  chemically synthesized
ggctccttgttaaatatgcaaa

SEQ ID NO: 995220 - DNA, 22 bp, Artificial Sequence
  chemically synthesized
gctgtagaaatttgcatattta

SEQ ID NO: 995221 - DNA, 22 bp, Artificial Sequence
  chemically synthesized
tagaaatttgcatatttaacaa

SEQ ID NO: 995222 - DNA, 22 bp, Artificial Sequence
  chemically synthesized
acattgggctccttgttaaata

SEQ ID NO: 995223 - DNA, 22 bp, Artificial Sequence
  chemically synthesized
ttaacattgggctccttgttaa

SEQ ID NO: 995224 - DNA, 22 bp, Artificial Sequence
  chemically synthesized
cctattaacattgggctccttg

SEQ ID NO: 995225 - DNA, 22 bp, Artificial Sequence
  chemically synthesized
gcctattaacattgggctcctt

SEQ ID NO: 995226 - DNA, 22 bp, Artificial Sequence
  chemically synthesized
gcatatttaacaaggagcccaa

SEQ ID NO: 995227 - DNA, 22 bp, Artificial Sequence
  chemically synthesized
catatttaacaaggagcccaat

SEQ ID NO: 995228 - DNA, 22 bp, Artificial Sequence
  chemically synthesized
tcttgcctattaacattgggct

SEQ ID NO: 995229 - DNA, 22 bp, Artificial Sequence
  chemically synthesized
aacaaggagcccaatgttaata

SEQ ID NO: 995230 - DNA, 22 bp, Artificial Sequence
  chemically synthesized
acaaggagcccaatgttaatag

SEQ ID NO: 995231 - DNA, 22 bp, Artificial Sequence
  chemically synthesized
cccattgtcttgcctattaaca

SEQ ID NO: 995232 - DNA, 22 bp, Artificial Sequence
  chemically synthesized
ccccattgtcttgcctattaac

SEQ ID NO: 995233 - DNA, 22 bp, Artificial Sequence
  chemically synthesized
tccccattgtcttgcctattaa

SEQ ID NO: 995234 - DNA, 22 bp, Artificial Sequence
  chemically synthesized
gagacattttccccattgtctt

SEQ ID NO: 995235 - DNA, 22 bp, Artificial Sequence
  chemically synthesized
ccctggagacattttccccatt

SEQ ID NO: 995236 - DNA, 22 bp, Artificial Sequence
  chemically synthesized
ataggcaagacaatggggaaaa

SEQ ID NO: 995237 - DNA, 22 bp, Artificial Sequence
  chemically synthesized
gccctggagacattttccccat

SEQ ID NO: 995238 - DNA, 22 bp, Artificial Sequence
  chemically synthesized
acttgccctggagacattttcc

SEQ ID NO: 995239 - DNA, 22 bp, Artificial Sequence
  chemically synthesized
tgacttgccctggagacatttt

SEQ ID NO: 995240 - DNA, 22 bp, Artificial Sequence
  chemically synthesized
cagggcaagtcagagaccttca

SEQ ID NO: 995241 - DNA, 22 bp, Artificial Sequence
  chemically synthesized
tgatgggaggagccgcaatgaa

SEQ ID NO: 995242 - DNA, 22 bp, Artificial Sequence
  chemically synthesized
ggtctgtgatgggaggagccgc

SEQ ID NO: 995243 - DNA, 22 bp, Artificial Sequence
  chemically synthesized
tgggtctgtgatgggaggagcc

SEQ ID NO: 995244 - DNA, 22 bp, Artificial Sequence
  chemically synthesized
cattgcggctcctcccatcaca

SEQ ID NO: 995245 - DNA, 22 bp, Artificial Sequence
  chemically synthesized
gacctctgggtctgtgatggga

SEQ ID NO: 995246 - DNA, 22 bp, Artificial Sequence
  chemically synthesized
attgcggctcctcccatcacag

SEQ ID NO: 995247 - DNA, 22 bp, Artificial Sequence
  chemically synthesized
ctagacctctgggtctgtgatg

SEQ ID NO: 995248 - DNA, 22 bp, Artificial Sequence
  chemically synthesized
cggctcctcccatcacagaccc

SEQ ID NO: 995249 - DNA, 22 bp, Artificial Sequence
  chemically synthesized
cctcctagacctctgggtctgt

SEQ ID NO: 995250 - DNA, 22 bp, Artificial Sequence
  chemically synthesized
gcctcctagacctctgggtctg

SEQ ID NO: 995251 - DNA, 22 bp, Artificial Sequence
  chemically synthesized
tgcctcctagacctctgggtct

SEQ ID NO: 995252 - DNA, 22 bp, Artificial Sequence
  chemically synthesized
ttgcctcctagacctctgggtc

SEQ ID NO: 995253 - DNA, 22 bp, Artificial Sequence
  chemically synthesized
ctcccatcacagacccagaggt

SEQ ID NO: 995254 - DNA, 22 bp, Artificial Sequence
  chemically synthesized
ccatcacagacccagaggtcta

SEQ ID NO: 995255 - DNA, 22 bp, Artificial Sequence
  chemically synthesized
gtccacgaaaccatttttgcct

SEQ ID NO: 995256 - DNA, 22 bp, Artificial Sequence
  chemically synthesized
ggaggcaaaaatggtttcgtgg

SEQ ID NO: 995257 - DNA, 22 bp, Artificial Sequence
  chemically synthesized
ggggggggacctggtccacgaa

SEQ ID NO: 995258 - DNA, 22 bp, Artificial Sequence
  chemically synthesized
cgtggaccaggtccccccccca

SEQ ID NO: 995259 - DNA, 22 bp, Artificial Sequence
  chemically synthesized
gtggaccaggtcccccccccaa

SEQ ID NO: 995260 - DNA, 22 bp, Artificial Sequence
  chemically synthesized
atgccgcacacagtggtggggt

SEQ ID NO: 995261 - DNA, 22 bp, Artificial Sequence
  chemically synthesized
ggacacaaggcaccaagtcctg

SEQ ID NO: 995262 - DNA, 22 bp, Artificial Sequence
  chemically synthesized
tgtgcggcatcaggacttggtg

SEQ ID NO: 995263 - DNA, 22 bp, Artificial Sequence
  chemically synthesized
gagtggctgggacacaaggcac

SEQ ID NO: 995264 - DNA, 22 bp, Artificial Sequence
  chemically synthesized
tccatggctggagtggctggga

SEQ ID NO: 995265 - DNA, 22 bp, Artificial Sequence
  chemically synthesized
ggtgccttgtgtcccagccact

SEQ ID NO: 995266 - DNA, 22 bp, Artificial Sequence
  chemically synthesized
atccatggctggagtggctggg

SEQ ID NO: 995267 - DNA, 22 bp, Artificial Sequence
  chemically synthesized
gtgccttgtgtcccagccactc

SEQ ID NO: 995268 - DNA, 22 bp, Artificial Sequence
  chemically synthesized
tatccatggctggagtggctgg

SEQ ID NO: 995269 - DNA, 22 bp, Artificial Sequence
  chemically synthesized
ttatccatggctggagtggctg

SEQ ID NO: 995270 - DNA, 22 bp, Artificial Sequence
  chemically synthesized
gtgtcccagccactccagccat

SEQ ID NO: 995271 - DNA, 22 bp, Artificial Sequence
  chemically synthesized
tgtcccagccactccagccatg

SEQ ID NO: 995272 - DNA, 22 bp, Artificial Sequence
  chemically synthesized
gccccttttatccatggctgga

SEQ ID NO: 995273 - DNA, 22 bp, Artificial Sequence
  chemically synthesized
ggccccttttatccatggctgg

SEQ ID NO: 995274 - DNA, 22 bp, Artificial Sequence
  chemically synthesized
taccttggccccttttatccat

SEQ ID NO: 995275 - DNA, 22 bp, Artificial Sequence
  chemically synthesized
cagccatggataaaaggggcca

SEQ ID NO: 995276 - DNA, 22 bp, Artificial Sequence
  chemically synthesized
aagcaatggtccgaactgtacc

SEQ ID NO: 995277 - DNA, 22 bp, Artificial Sequence
  chemically synthesized
tgaagcaatggtccgaactgta

SEQ ID NO: 995278 - DNA, 22 bp, Artificial Sequence
  chemically synthesized
cctctgaagcaatggtccgaac

SEQ ID NO: 995279 - DNA, 22 bp, Artificial Sequence
  chemically synthesized
ctccctctgaagcaatggtccg

SEQ ID NO: 995280 - DNA, 22 bp, Artificial Sequence
  chemically synthesized
gctccctctgaagcaatggtcc

SEQ ID NO: 995281 - DNA, 22 bp, Artificial Sequence
  chemically synthesized
ggacttgctccctctgaagcaa

SEQ ID NO: 995282 - DNA, 22 bp, Artificial Sequence
  chemically synthesized
gggacttgctccctctgaagca

SEQ ID NO: 995283 - DNA, 22 bp, Artificial Sequence
  chemically synthesized
ggaccattgcttcagagggagc

SEQ ID NO: 995284 - DNA, 22 bp, Artificial Sequence
  chemically synthesized
ccaaagcttgggacttgctccc

SEQ ID NO: 995285 - DNA, 22 bp, Artificial Sequence
  chemically synthesized
cttcagagggagcaagtcccaa

SEQ ID NO: 995286 - DNA, 22 bp, Artificial Sequence
  chemically synthesized
cagagggagcaagtcccaagct

SEQ ID NO: 995287 - DNA, 22 bp, Artificial Sequence
  chemically synthesized
agagggagcaagtcccaagctt

SEQ ID NO: 995288 - DNA, 22 bp, Artificial Sequence
  chemically synthesized
aacaccacgtggcagttgccaa

SEQ ID NO: 995289 - DNA, 22 bp, Artificial Sequence
  chemically synthesized
tggcaactgccacgtggtgttg

SEQ ID NO: 995290 - DNA, 22 bp, Artificial Sequence
  chemically synthesized
ggcaactgccacgtggtgttga

SEQ ID NO: 995291 - DNA, 22 bp, Artificial Sequence
  chemically synthesized
gcaactgccacgtggtgttgag

SEQ ID NO: 995292 - DNA, 22 bp, Artificial Sequence
  chemically synthesized
tgtatccacagactcaacacca

SEQ ID NO: 995293 - DNA, 22 bp, Artificial Sequence
  chemically synthesized
tgtgtatccacagactcaacac

SEQ ID NO: 995294 - DNA, 22 bp, Artificial Sequence
  chemically synthesized
ccacgtggtgttgagtctgtgg

SEQ ID NO: 995295 - DNA, 22 bp, Artificial Sequence
  chemically synthesized
aattctgtgtatccacagactc

SEQ ID NO: 995296 - DNA, 22 bp, Artificial Sequence
  chemically synthesized
gaattctgtgtatccacagact

SEQ ID NO: 995297 - DNA, 22 bp, Artificial Sequence
  chemically synthesized
ttgaattctgtgtatccacaga

SEQ ID NO: 995298 - DNA, 22 bp, Artificial Sequence
  chemically synthesized
aattcttgaattctgtgtatcc

SEQ ID NO: 995299 - DNA, 22 bp, Artificial Sequence
  chemically synthesized
caattcttgaattctgtgtatc

SEQ ID NO: 995300 - DNA, 22 bp, Artificial Sequence
  chemically synthesized
agtctgtggatacacagaattc

SEQ ID NO: 995301 - DNA, 22 bp, Artificial Sequence
  chemically synthesized
ccaaacttcaattcttgaattc

SEQ ID NO: 995302 - DNA, 22 bp, Artificial Sequence
  chemically synthesized
tggatacacagaattcaagaat

SEQ ID NO: 995303 - DNA, 22 bp, Artificial Sequence
  chemically synthesized
ggcagaggttcccaaacttcaa

SEQ ID NO: 995304 - DNA, 22 bp, Artificial Sequence
  chemically synthesized
aagaattgaagtttgggaacct

SEQ ID NO: 995305 - DNA, 22 bp, Artificial Sequence
  chemically synthesized
aaatctaggcagaggttcccaa

SEQ ID NO: 995306 - DNA, 22 bp, Artificial Sequence
  chemically synthesized
tgaaatctaggcagaggttccc

SEQ ID NO: 995307 - DNA, 22 bp, Artificial Sequence
  chemically synthesized
aagtttgggaacctctgcctag

SEQ ID NO: 995308 - DNA, 22 bp, Artificial Sequence
  chemically synthesized
catacatcctctgaaatctagg

SEQ ID NO: 995309 - DNA, 22 bp, Artificial Sequence
  chemically synthesized
gggaacctctgcctagatttca

SEQ ID NO: 995310 - DNA, 22 bp, Artificial Sequence
  chemically synthesized
ccatacatcctctgaaatctag

SEQ ID NO: 995311 - DNA, 22 bp, Artificial Sequence
  chemically synthesized
ggaacctctgcctagatttcag

SEQ ID NO: 995312 - DNA, 22 bp, Artificial Sequence
  chemically synthesized
tgcctagatttcagaggatgta

SEQ ID NO: 995313 - DNA, 22 bp, Artificial Sequence
  chemically synthesized
cctagatttcagaggatgtatg

SEQ ID NO: 995314 - DNA, 22 bp, Artificial Sequence
  chemically synthesized
gatttcagaggatgtatggaaa

SEQ ID NO: 995315 - DNA, 22 bp, Artificial Sequence
  chemically synthesized
gacatccaggagtttccataca

SEQ ID NO: 995316 - DNA, 22 bp, Artificial Sequence
  chemically synthesized
cctggacatccaggagtttcca

SEQ ID NO: 995317 - DNA, 22 bp, Artificial Sequence
  chemically synthesized
cagaggatgtatggaaactcct

SEQ ID NO: 995318 - DNA, 22 bp, Artificial Sequence
  chemically synthesized
agaggatgtatggaaactcctg

SEQ ID NO: 995319 - DNA, 22 bp, Artificial Sequence
  chemically synthesized
tgcctggacatccaggagtttc

SEQ ID NO: 995320 - DNA, 22 bp, Artificial Sequence
  chemically synthesized
ctgcctggacatccaggagttt

SEQ ID NO: 995321 - DNA, 22 bp, Artificial Sequence
  chemically synthesized
cagcagacttctgcctggacat

SEQ ID NO: 995322 - DNA, 22 bp, Artificial Sequence
  chemically synthesized
ctgcagcagacttctgcctgga

SEQ ID NO: 995323 - DNA, 22 bp, Artificial Sequence
  chemically synthesized
attcctgcagcagacttctgcc

SEQ ID NO: 995324 - DNA, 22 bp, Artificial Sequence
  chemically synthesized
ctggatgtccaggcagaagtct

SEQ ID NO: 995325 - DNA, 22 bp, Artificial Sequence
  chemically synthesized
cattcctgcagcagacttctgc

SEQ ID NO: 995326 - DNA, 22 bp, Artificial Sequence
  chemically synthesized
gatgtccaggcagaagtctgct

SEQ ID NO: 995327 - DNA, 22 bp, Artificial Sequence
  chemically synthesized
catgaggtcttcattcctgcag

SEQ ID NO: 995328 - DNA, 22 bp, Artificial Sequence
  chemically synthesized
tccatgaggtcttcattcctgc

SEQ ID NO: 995329 - DNA, 22 bp, Artificial Sequence
  chemically synthesized
ctgcaggaatgaagacctcatg

SEQ ID NO: 995330 - DNA, 22 bp, Artificial Sequence
  chemically synthesized
gccgaggttctccatgaggtct

SEQ ID NO: 995331 - DNA, 22 bp, Artificial Sequence
  chemically synthesized
caggaatgaagacctcatggag

SEQ ID NO: 995332 - DNA, 22 bp, Artificial Sequence
  chemically synthesized
tcctagccgaggttctccatga

SEQ ID NO: 995333 - DNA, 22 bp, Artificial Sequence
  chemically synthesized
cacactgtcctagccgaggttc

SEQ ID NO: 995334 - DNA, 22 bp, Artificial Sequence
  chemically synthesized
ccacactgtcctagccgaggtt

SEQ ID NO: 995335 - DNA, 22 bp, Artificial Sequence
  chemically synthesized
ccttccacactgtcctagccga

SEQ ID NO: 995336 - DNA, 22 bp, Artificial Sequence
  chemically synthesized
cccttccacactgtcctagccg

SEQ ID NO: 995337 - DNA, 22 bp, Artificial Sequence
  chemically synthesized
atggagaacctcggctaggaca

SEQ ID NO: 995338 - DNA, 22 bp, Artificial Sequence
  chemically synthesized
ggctaggacagtgtggaaggga

SEQ ID NO: 995339 - DNA, 22 bp, Artificial Sequence
  chemically synthesized
caaccccacatttcccttccac

SEQ ID NO: 995340 - DNA, 22 bp, Artificial Sequence
  chemically synthesized
ggacagtgtggaagggaaatgt

SEQ ID NO: 995341 - DNA, 22 bp, Artificial Sequence
  chemically synthesized
gggctccaaccccacatttccc

SEQ ID NO: 995342 - DNA, 22 bp, Artificial Sequence
  chemically synthesized
tgttggggctccaaccccacat

SEQ ID NO: 995343 - DNA, 22 bp, Artificial Sequence
  chemically synthesized
tgtgttggggctccaaccccac

SEQ ID NO: 995344 - DNA, 22 bp, Artificial Sequence
  chemically synthesized
gagccccaacacagagtcccca

SEQ ID NO: 995345 - DNA, 22 bp, Artificial Sequence
  chemically synthesized
ggcagtgccccagtggggactc

SEQ ID NO: 995346 - DNA, 22 bp, Artificial Sequence
  chemically synthesized
cgctaggcagtgccccagtggg

SEQ ID NO: 995347 - DNA, 22 bp, Artificial Sequence
  chemically synthesized
atagctccgctaggcagtgccc

SEQ ID NO: 995348 - DNA, 22 bp, Artificial Sequence
  chemically synthesized
tcatagctccgctaggcagtgc

SEQ ID NO: 995349 - DNA, 22 bp, Artificial Sequence
  chemically synthesized
ctcatagctccgctaggcagtg

SEQ ID NO: 995350 - DNA, 22 bp, Artificial Sequence
  chemically synthesized
ttctcatagctccgctaggcag

SEQ ID NO: 995351 - DNA, 22 bp, Artificial Sequence
  chemically synthesized
gggcactgcctagcggagctat

SEQ ID NO: 995352 - DNA, 22 bp, Artificial Sequence
  chemically synthesized
cctagcggagctatgagaagag

SEQ ID NO: 995353 - DNA, 22 bp, Artificial Sequence
  chemically synthesized
gtggacagtggccctcttctca

SEQ ID NO: 995354 - DNA, 22 bp, Artificial Sequence
  chemically synthesized
gcggagctatgagaagagggcc

SEQ ID NO: 995355 - DNA, 22 bp, Artificial Sequence
  chemically synthesized
tggggtctggtggacagtggcc

SEQ ID NO: 995356 - DNA, 22 bp, Artificial Sequence
  chemically synthesized
tgagaagagggccactgtccac

SEQ ID NO: 995357 - DNA, 22 bp, Artificial Sequence
  chemically synthesized
ccattgtggggtctggtggaca

SEQ ID NO: 995358 - DNA, 22 bp, Artificial Sequence
  chemically synthesized
taccattgtggggtctggtgga

SEQ ID NO: 995359 - DNA, 22 bp, Artificial Sequence
  chemically synthesized
atcgctctaccattgtggggtc

SEQ ID NO: 995360 - DNA, 22 bp, Artificial Sequence
  chemically synthesized
ttgatcgctctaccattgtggg

SEQ ID NO: 995361 - DNA, 22 bp, Artificial Sequence
  chemically synthesized
tccaccagaccccacaatggta

SEQ ID NO: 995362 - DNA, 22 bp, Artificial Sequence
  chemically synthesized
caggcacgtggtgcaagctgtt

SEQ ID NO: 995363 - DNA, 22 bp, Artificial Sequence
  chemically synthesized
ccaggcacgtggtgcaagctgt

SEQ ID NO: 995364 - DNA, 22 bp, Artificial Sequence
  chemically synthesized
tccaggcacgtggtgcaagctg

SEQ ID NO: 995365 - DNA, 22 bp, Artificial Sequence
  chemically synthesized
ttccaggcacgtggtgcaagct

SEQ ID NO: 995366 - DNA, 22 bp, Artificial Sequence
  chemically synthesized
cagcttttccaggcacgtggtg

SEQ ID NO: 995367 - DNA, 22 bp, Artificial Sequence
  chemically synthesized
agtgtctgcagcttttccaggc

SEQ ID NO: 995368 - DNA, 22 bp, Artificial Sequence
  chemically synthesized
gcaccacgtgcctggaaaagct

SEQ ID NO: 995369 - DNA, 22 bp, Artificial Sequence
  chemically synthesized
caccacgtgcctggaaaagctg

SEQ ID NO: 995370 - DNA, 22 bp, Artificial Sequence
  chemically synthesized
gcattgagtgtctgcagctttt

SEQ ID NO: 995371 - DNA, 22 bp, Artificial Sequence
  chemically synthesized
caggctggcattgagtgtctgc

SEQ ID NO: 995372 - DNA, 22 bp, Artificial Sequence
  chemically synthesized
acaggctggcattgagtgtctg

SEQ ID NO: 995373 - DNA, 22 bp, Artificial Sequence
  chemically synthesized
tacaggctggcattgagtgtct

SEQ ID NO: 995374 - DNA, 22 bp, Artificial Sequence
  chemically synthesized
ttacaggctggcattgagtgtc

SEQ ID NO: 995375 - DNA, 22 bp, Artificial Sequence
  chemically synthesized
gaaaagctgcagacactcaatg

SEQ ID NO: 995376 - DNA, 22 bp, Artificial Sequence
  chemically synthesized
cttttacaggctggcattgagt

SEQ ID NO: 995377 - DNA, 22 bp, Artificial Sequence
  chemically synthesized
gctgcttttacaggctggcatt

SEQ ID NO: 995378 - DNA, 22 bp, Artificial Sequence
  chemically synthesized
cagacactcaatgccagcctgt

SEQ ID NO: 995379 - DNA, 22 bp, Artificial Sequence
  chemically synthesized
ctggctgcttttacaggctggc

SEQ ID NO: 995380 - DNA, 22 bp, Artificial Sequence
  chemically synthesized
tcctggctgcttttacaggctg

SEQ ID NO: 995381 - DNA, 22 bp, Artificial Sequence
  chemically synthesized
aatgccagcctgtaaaagcagc

SEQ ID NO: 995382 - DNA, 22 bp, Artificial Sequence
  chemically synthesized
cagggtagagcccctctcctgg

SEQ ID NO: 995383 - DNA, 22 bp, Artificial Sequence
  chemically synthesized
gcagggtagagcccctctcctg

SEQ ID NO: 995384 - DNA, 22 bp, Artificial Sequence
  chemically synthesized
taaaagcagccaggagaggggc

SEQ ID NO: 995385 - DNA, 22 bp, Artificial Sequence
  chemically synthesized
tgggtttgcagggtagagcccc

SEQ ID NO: 995386 - DNA, 22 bp, Artificial Sequence
  chemically synthesized
cacccctgtgggtttgcagggt

SEQ ID NO: 995387 - DNA, 22 bp, Artificial Sequence
  chemically synthesized
gtaagctccacccctgtgggtt

SEQ ID NO: 995388 - DNA, 22 bp, Artificial Sequence
  chemically synthesized
ggtaagctccacccctgtgggt

SEQ ID NO: 995389 - DNA, 22 bp, Artificial Sequence
  chemically synthesized
taccctgcaaacccacaggggt

SEQ ID NO: 995390 - DNA, 22 bp, Artificial Sequence
  chemically synthesized
ccctgcaaacccacaggggtgg

SEQ ID NO: 995391 - DNA, 22 bp, Artificial Sequence
  chemically synthesized
caaacccacaggggtggagctt

SEQ ID NO: 995392 - DNA, 22 bp, Artificial Sequence
  chemically synthesized
ccatggtcttggtaagctccac

SEQ ID NO: 995393 - DNA, 22 bp, Artificial Sequence
  chemically synthesized
atgcaagaggtgggttcccatg

SEQ ID NO: 995394 - DNA, 22 bp, Artificial Sequence
  chemically synthesized
accaagaccatgggaacccacc

SEQ ID NO: 995395 - DNA, 22 bp, Artificial Sequence
  chemically synthesized
ccaagaccatgggaacccacct

SEQ ID NO: 995396 - DNA, 22 bp, Artificial Sequence
  chemically synthesized
acatccaggtaacactgatgca

SEQ ID NO: 995397 - DNA, 22 bp, Artificial Sequence
  chemically synthesized
tcacatccaggtaacactgatg

SEQ ID NO: 995398 - DNA, 22 bp, Artificial Sequence
  chemically synthesized
ctcacatccaggtaacactgat

SEQ ID NO: 995399 - DNA, 22 bp, Artificial Sequence
  chemically synthesized
catttctcacatccaggtaaca

SEQ ID NO: 995400 - DNA, 22 bp, Artificial Sequence
  chemically synthesized
ttgcatcagtgttacctggatg

SEQ ID NO: 995401 - DNA, 22 bp, Artificial Sequence
  chemically synthesized
actccatttctcacatccaggt

SEQ ID NO: 995402 - DNA, 22 bp, Artificial Sequence
  chemically synthesized
gcatcagtgttacctggatgtg

SEQ ID NO: 995403 - DNA, 22 bp, Artificial Sequence
  chemically synthesized
gactccatttctcacatccagg

SEQ ID NO: 995404 - DNA, 22 bp, Artificial Sequence
  chemically synthesized
catcagtgttacctggatgtga

SEQ ID NO: 995405 - DNA, 22 bp, Artificial Sequence
  chemically synthesized
tgactccatttctcacatccag

SEQ ID NO: 995406 - DNA, 22 bp, Artificial Sequence
  chemically synthesized
ctttgactccatttctcacatc

SEQ ID NO: 995407 - DNA, 22 bp, Artificial Sequence
  chemically synthesized
tctcctttgactccatttctca

SEQ ID NO: 995408 - DNA, 22 bp, Artificial Sequence
  chemically synthesized
cctggatgtgagaaatggagtc

SEQ ID NO: 995409 - DNA, 22 bp, Artificial Sequence
  chemically synthesized
aagttgtctcctttgactccat

SEQ ID NO: 995410 - DNA, 22 bp, Artificial Sequence
  chemically synthesized
gatgtgagaaatggagtcaaag

SEQ ID NO: 995411 - DNA, 22 bp, Artificial Sequence
  chemically synthesized
tgaagttgtctcctttgactcc

SEQ ID NO: 995412 - DNA, 22 bp, Artificial Sequence
  chemically synthesized
cagctctgaagttgtctccttt

SEQ ID NO: 995413 - DNA, 22 bp, Artificial Sequence
  chemically synthesized
acagctctgaagttgtctcctt

SEQ ID NO: 995414 - DNA, 22 bp, Artificial Sequence
  chemically synthesized
tcagggcagtcaaatcttacag

SEQ ID NO: 995415 - DNA, 22 bp, Artificial Sequence
  chemically synthesized
cagagctgtaagatttgactgc

SEQ ID NO: 995416 - DNA, 22 bp, Artificial Sequence
  chemically synthesized
agagctgtaagatttgactgcc

SEQ ID NO: 995417 - DNA, 22 bp, Artificial Sequence
  chemically synthesized
taagatttgactgccctgatag

SEQ ID NO: 995418 - DNA, 22 bp, Artificial Sequence
  chemically synthesized
gactgccctgatagattttgga

SEQ ID NO: 995419 - DNA, 22 bp, Artificial Sequence
  chemically synthesized
actgccctgatagattttggac

SEQ ID NO: 995420 - DNA, 22 bp, Artificial Sequence
  chemically synthesized
caggccccaagccagtccaaaa

SEQ ID NO: 995421 - DNA, 22 bp, Artificial Sequence
  chemically synthesized
ccctgatagattttggactggc

SEQ ID NO: 995422 - DNA, 22 bp, Artificial Sequence
  chemically synthesized
atagattttggactggcttggg

SEQ ID NO: 995423 - DNA, 22 bp, Artificial Sequence
  chemically synthesized
tggactggcttggggcctgtag

SEQ ID NO: 995424 - DNA, 22 bp, Artificial Sequence
  chemically synthesized
ggactggcttggggcctgtagc

SEQ ID NO: 995425 - DNA, 22 bp, Artificial Sequence
  chemically synthesized
gactggcttggggcctgtagcc

SEQ ID NO: 995426 - DNA, 22 bp, Artificial Sequence
  chemically synthesized
gccaaaatgaaggggctacagg

SEQ ID NO: 995427 - DNA, 22 bp, Artificial Sequence
  chemically synthesized
gcttggggcctgtagccccttc

SEQ ID NO: 995428 - DNA, 22 bp, Artificial Sequence
  chemically synthesized
ggggcctgtagccccttcattt

SEQ ID NO: 995429 - DNA, 22 bp, Artificial Sequence
  chemically synthesized
gggcctgtagccccttcatttt

SEQ ID NO: 995430 - DNA, 22 bp, Artificial Sequence
  chemically synthesized
tagccccttcattttggctaat

SEQ ID NO: 995431 - DNA, 22 bp, Artificial Sequence
  chemically synthesized
caaatgggagaaattagccaaa

SEQ ID NO: 995432 - DNA, 22 bp, Artificial Sequence
  chemically synthesized
cattttggctaatttctcccat

SEQ ID NO: 995433 - DNA, 22 bp, Artificial Sequence
  chemically synthesized
attttggctaatttctcccatt

SEQ ID NO: 995434 - DNA, 22 bp, Artificial Sequence
  chemically synthesized
tggctaatttctcccatttgta

SEQ ID NO: 995435 - DNA, 22 bp, Artificial Sequence
  chemically synthesized
ggctaatttctcccatttgtaa

SEQ ID NO: 995436 - DNA, 22 bp, Artificial Sequence
  chemically synthesized
gctaatttctcccatttgtaat

SEQ ID NO: 995437 - DNA, 22 bp, Artificial Sequence
  chemically synthesized
ggtaaatatacccattacaaat

SEQ ID NO: 995438 - DNA, 22 bp, Artificial Sequence
  chemically synthesized
atttctcccatttgtaatgggt

SEQ ID NO: 995439 - DNA, 22 bp, Artificial Sequence
  chemically synthesized
ctcccatttgtaatgggtatat

SEQ ID NO: 995440 - DNA, 22 bp, Artificial Sequence
  chemically synthesized
tcccatttgtaatgggtatatt

SEQ ID NO: 995441 - DNA, 22 bp, Artificial Sequence
  chemically synthesized
ccatttgtaatgggtatattta

SEQ ID NO: 995442 - DNA, 22 bp, Artificial Sequence
  chemically synthesized
gtaatgggtatatttacccagt

SEQ ID NO: 995443 - DNA, 22 bp, Artificial Sequence
  chemically synthesized
taatgggtatatttacccagtg

SEQ ID NO: 995444 - DNA, 22 bp, Artificial Sequence
  chemically synthesized
gataaaatggaagcacaggcac

SEQ ID NO: 995445 - DNA, 22 bp, Artificial Sequence
  chemically synthesized
ctagataaaatggaagcacagg

SEQ ID NO: 995446 - DNA, 22 bp, Artificial Sequence
  chemically synthesized
cctagataaaatggaagcacag

SEQ ID NO: 995447 - DNA, 22 bp, Artificial Sequence
  chemically synthesized
acccagtgcctgtgcttccatt

SEQ ID NO: 995448 - DNA, 22 bp, Artificial Sequence
  chemically synthesized
cttcctagataaaatggaagca

SEQ ID NO: 995449 - DNA, 22 bp, Artificial Sequence
  chemically synthesized
cccagtgcctgtgcttccattt

SEQ ID NO: 995450 - DNA, 22 bp, Artificial Sequence
  chemically synthesized
gttacttcctagataaaatgga

SEQ ID NO: 995451 - DNA, 22 bp, Artificial Sequence
  chemically synthesized
tgcttccattttatctaggaag

SEQ ID NO: 995452 - DNA, 22 bp, Artificial Sequence
  chemically synthesized
ccattttatctaggaagtaact

SEQ ID NO: 995453 - DNA, 22 bp, Artificial Sequence
  chemically synthesized
cattttatctaggaagtaacta

SEQ ID NO: 995454 - DNA, 22 bp, Artificial Sequence
  chemically synthesized
tatctaggaagtaactaacttg

SEQ ID NO: 995455 - DNA, 22 bp, Artificial Sequence
  chemically synthesized
taaaatcaaaagcaagttagtt

SEQ ID NO: 995456 - DNA, 22 bp, Artificial Sequence
  chemically synthesized
atctaggaagtaactaacttgc

SEQ ID NO: 995457 - DNA, 22 bp, Artificial Sequence
  chemically synthesized
tctaggaagtaactaacttgct

SEQ ID NO: 995458 - DNA, 22 bp, Artificial Sequence
  chemically synthesized
ggaagtaactaacttgcttttg

SEQ ID NO: 995459 - DNA, 22 bp, Artificial Sequence
  chemically synthesized
tgagcctgtaaaatcaaaagca

SEQ ID NO: 995460 - DNA, 22 bp, Artificial Sequence
  chemically synthesized
cctgtgagcctgtaaaatcaaa

SEQ ID NO: 995461 - DNA, 22 bp, Artificial Sequence
  chemically synthesized
tgcctgtgagcctgtaaaatca

SEQ ID NO: 995462 - DNA, 22 bp, Artificial Sequence
  chemically synthesized
acttgcttttgattttacaggc

SEQ ID NO: 995463 - DNA, 22 bp, Artificial Sequence
  chemically synthesized
ttctgcctgtgagcctgtaaaa

SEQ ID NO: 995464 - DNA, 22 bp, Artificial Sequence
  chemically synthesized
gcttttgattttacaggctcac

SEQ ID NO: 995465 - DNA, 22 bp, Artificial Sequence
  chemically synthesized
cttttgattttacaggctcaca

SEQ ID NO: 995466 - DNA, 22 bp, Artificial Sequence
  chemically synthesized
ttgattttacaggctcacaggc

SEQ ID NO: 995467 - DNA, 22 bp, Artificial Sequence
  chemically synthesized
tgattttacaggctcacaggca

SEQ ID NO: 995468 - DNA, 22 bp, Artificial Sequence
  chemically synthesized
gattttacaggctcacaggcag

SEQ ID NO: 995469 - DNA, 22 bp, Artificial Sequence
  chemically synthesized
attttacaggctcacaggcaga

SEQ ID NO: 995470 - DNA, 22 bp, Artificial Sequence
  chemically synthesized
tacaggctcacaggcagaacag

SEQ ID NO: 995471 - DNA, 22 bp, Artificial Sequence
  chemically synthesized
acaggctcacaggcagaacaga

SEQ ID NO: 995472 - DNA, 22 bp, Artificial Sequence
  chemically synthesized
agacaaggcaagtctgttctgc

SEQ ID NO: 995473 - DNA, 22 bp, Artificial Sequence
  chemically synthesized
caggctcacaggcagaacagac

SEQ ID NO: 995474 - DNA, 22 bp, Artificial Sequence
  chemically synthesized
atctgagacaaggcaagtctgt

SEQ ID NO: 995475 - DNA, 22 bp, Artificial Sequence
  chemically synthesized
acaggcagaacagacttgcctt

SEQ ID NO: 995476 - DNA, 22 bp, Artificial Sequence
  chemically synthesized
gccttgtctcagatgagacttt

SEQ ID NO: 995477 - DNA, 22 bp, Artificial Sequence
  chemically synthesized
ccttgtctcagatgagactttg

SEQ ID NO: 995478 - DNA, 22 bp, Artificial Sequence
  chemically synthesized
gtctcagatgagactttggact

SEQ ID NO: 995479 - DNA, 22 bp, Artificial Sequence
  chemically synthesized
tctcagatgagactttggactt

SEQ ID NO: 995480 - DNA, 22 bp, Artificial Sequence
  chemically synthesized
acccaaaagtccaagtccaaag

SEQ ID NO: 995481 - DNA, 22 bp, Artificial Sequence
  chemically synthesized
agatgagactttggacttggac

SEQ ID NO: 995482 - DNA, 22 bp, Artificial Sequence
  chemically synthesized
agcattaacccaaaagtccaag

SEQ ID NO: 995483 - DNA, 22 bp, Artificial Sequence
  chemically synthesized
cagcattaacccaaaagtccaa

SEQ ID NO: 995484 - DNA, 22 bp, Artificial Sequence
  chemically synthesized
atttcagcattaacccaaaagt

SEQ ID NO: 995485 - DNA, 22 bp, Artificial Sequence
  chemically synthesized
tggacttggacttttgggttaa

SEQ ID NO: 995486 - DNA, 22 bp, Artificial Sequence
  chemically synthesized
ggacttggacttttgggttaat

SEQ ID NO: 995487 - DNA, 22 bp, Artificial Sequence
  chemically synthesized
attcatttcagcattaacccaa

SEQ ID NO: 995488 - DNA, 22 bp, Artificial Sequence
  chemically synthesized
gacttggacttttgggttaatg

SEQ ID NO: 995489 - DNA, 22 bp, Artificial Sequence
  chemically synthesized
ggacttttgggttaatgctgaa

SEQ ID NO: 995490 - DNA, 22 bp, Artificial Sequence
  chemically synthesized
gacttttgggttaatgctgaaa

SEQ ID NO: 995491 - DNA, 22 bp, Artificial Sequence
  chemically synthesized
caaagtattaattcatttcagc

SEQ ID NO: 995492 - DNA, 22 bp, Artificial Sequence
  chemically synthesized
ttgggttaatgctgaaatgaat

SEQ ID NO: 995493 - DNA, 22 bp, Artificial Sequence
  chemically synthesized
tgggttaatgctgaaatgaatt

SEQ ID NO: 995494 - DNA, 22 bp, Artificial Sequence
  chemically synthesized
gggttaatgctgaaatgaatta

SEQ ID NO: 995495 - DNA, 22 bp, Artificial Sequence
  chemically synthesized
ggttaatgctgaaatgaattaa

SEQ ID NO: 995496 - DNA, 22 bp, Artificial Sequence
  chemically synthesized
atgctgaaatgaattaatactt

SEQ ID NO: 995497 - DNA, 22 bp, Artificial Sequence
  chemically synthesized
acaacagtactccaaagtatta

SEQ ID NO: 995498 - DNA, 22 bp, Artificial Sequence
  chemically synthesized
gacaacagtactccaaagtatt

SEQ ID NO: 995499 - DNA, 22 bp, Artificial Sequence
  chemically synthesized
aaatgaattaatactttggagt

SEQ ID NO: 995500 - DNA, 22 bp, Artificial Sequence
  chemically synthesized
atactttggagtactgttgtca

SEQ ID NO: 995501 - DNA, 22 bp, Artificial Sequence
  chemically synthesized
aaaaccaatcatgccttgacaa

SEQ ID NO: 995502 - DNA, 22 bp, Artificial Sequence
  chemically synthesized
caaaaccaatcatgccttgaca

SEQ ID NO: 995503 - DNA, 22 bp, Artificial Sequence
  chemically synthesized
tggagtactgttgtcaaggcat

SEQ ID NO: 995504 - DNA, 22 bp, Artificial Sequence
  chemically synthesized
ggagtactgttgtcaaggcatg

SEQ ID NO: 995505 - DNA, 22 bp, Artificial Sequence
  chemically synthesized
gagtactgttgtcaaggcatga

SEQ ID NO: 995506 - DNA, 22 bp, Artificial Sequence
  chemically synthesized
acatttcaaaaccaatcatgcc

SEQ ID NO: 995507 - DNA, 22 bp, Artificial Sequence
  chemically synthesized
cacatttcaaaaccaatcatgc

SEQ ID NO: 995508 - DNA, 22 bp, Artificial Sequence
  chemically synthesized
tcacatttcaaaaccaatcatg

SEQ ID NO: 995509 - DNA, 22 bp, Artificial Sequence
  chemically synthesized
ttgtcaaggcatgattggtttt

SEQ ID NO: 995510 - DNA, 22 bp, Artificial Sequence
  chemically synthesized
tcaaggcatgattggttttgaa

SEQ ID NO: 995511 - DNA, 22 bp, Artificial Sequence
  chemically synthesized
atgtccctttcacatttcaaaa

SEQ ID NO: 995512 - DNA, 22 bp, Artificial Sequence
  chemically synthesized
ccaaatctcatgtccctttcac

SEQ ID NO: 995513 - DNA, 22 bp, Artificial Sequence
  chemically synthesized
gttttgaaatgtgaaagggaca

SEQ ID NO: 995514 - DNA, 22 bp, Artificial Sequence
  chemically synthesized
tgaaatgtgaaagggacatgag

SEQ ID NO: 995515 - DNA, 22 bp, Artificial Sequence
  chemically synthesized
gaaatgtgaaagggacatgaga

SEQ ID NO: 995516 - DNA, 22 bp, Artificial Sequence
  chemically synthesized
gcccctcccaaatctcatgtcc

SEQ ID NO: 995517 - DNA, 22 bp, Artificial Sequence
  chemically synthesized
aaatgtgaaagggacatgagat

SEQ ID NO: 995518 - DNA, 22 bp, Artificial Sequence
  chemically synthesized
ctggcccctcccaaatctcatg

SEQ ID NO: 995519 - DNA, 22 bp, Artificial Sequence
  chemically synthesized
ctcctggcccctcccaaatctc

SEQ ID NO: 995520 - DNA, 22 bp, Artificial Sequence
  chemically synthesized
gctcctggcccctcccaaatct

SEQ ID NO: 995521 - DNA, 22 bp, Artificial Sequence
  chemically synthesized
tgctcctggcccctcccaaatc

SEQ ID NO: 995522 - DNA, 22 bp, Artificial Sequence
  chemically synthesized
gggaggggccaggagcaaaatg

SEQ ID NO: 995523 - DNA, 22 bp, Artificial Sequence
  chemically synthesized
ggaggggccaggagcaaaatga

SEQ ID NO: 995524 - DNA, 22 bp, Artificial Sequence
  chemically synthesized
ggtggggacacaaagcccaaac

SEQ ID NO: 995525 - DNA, 22 bp, Artificial Sequence
  chemically synthesized
gggtggggacacaaagcccaaa

SEQ ID NO: 995526 - DNA, 22 bp, Artificial Sequence
  chemically synthesized
aagatgagatttgggtggggac

SEQ ID NO: 995527 - DNA, 22 bp, Artificial Sequence
  chemically synthesized
gggctttgtgtccccacccaaa

SEQ ID NO: 995528 - DNA, 22 bp, Artificial Sequence
  chemically synthesized
ggctttgtgtccccacccaaat

SEQ ID NO: 995529 - DNA, 22 bp, Artificial Sequence
  chemically synthesized
caattcaagatgagatttgggt

SEQ ID NO: 995530 - DNA, 22 bp, Artificial Sequence
  chemically synthesized
tgtgtccccacccaaatctcat

SEQ ID NO: 995531 - DNA, 22 bp, Artificial Sequence
  chemically synthesized
gtgtccccacccaaatctcatc

SEQ ID NO: 995532 - DNA, 22 bp, Artificial Sequence
  chemically synthesized
tgtccccacccaaatctcatct

SEQ ID NO: 995533 - DNA, 22 bp, Artificial Sequence
  chemically synthesized
taaggattacaattcaagatga

SEQ ID NO: 995534 - DNA, 22 bp, Artificial Sequence
  chemically synthesized
tggggattataaggattacaat

SEQ ID NO: 995535 - DNA, 22 bp, Artificial Sequence
  chemically synthesized
atcttgaattgtaatccttata

SEQ ID NO: 995536 - DNA, 22 bp, Artificial Sequence
  chemically synthesized
gggattatggggattataagga

SEQ ID NO: 995537 - DNA, 22 bp, Artificial Sequence
  chemically synthesized
gaattgtaatccttataatccc

SEQ ID NO: 995538 - DNA, 22 bp, Artificial Sequence
  chemically synthesized
aattgtaatccttataatcccc

SEQ ID NO: 995539 - DNA, 22 bp, Artificial Sequence
  chemically synthesized
acacctggggattatggggatt

SEQ ID NO: 995540 - DNA, 22 bp, Artificial Sequence
  chemically synthesized
gacacctggggattatggggat

SEQ ID NO: 995541 - DNA, 22 bp, Artificial Sequence
  chemically synthesized
taatccttataatccccataat

SEQ ID NO: 995542 - DNA, 22 bp, Artificial Sequence
  chemically synthesized
tgacacctggggattatgggga

SEQ ID NO: 995543 - DNA, 22 bp, Artificial Sequence
  chemically synthesized
ctttgacacctggggattatgg

SEQ ID NO: 995544 - DNA, 22 bp, Artificial Sequence
  chemically synthesized
tcctttgacacctggggattat

SEQ ID NO: 995545 - DNA, 22 bp, Artificial Sequence
  chemically synthesized
ataatccccataatccccaggt

SEQ ID NO: 995546 - DNA, 22 bp, Artificial Sequence
  chemically synthesized
taatccccataatccccaggtg

SEQ ID NO: 995547 - DNA, 22 bp, Artificial Sequence
  chemically synthesized
cacatagcctctcctttgacac

SEQ ID NO: 995548 - DNA, 22 bp, Artificial Sequence
  chemically synthesized
cctccacatagcctctcctttg

SEQ ID NO: 995549 - DNA, 22 bp, Artificial Sequence
  chemically synthesized
aattacctccacatagcctctc

SEQ ID NO: 995550 - DNA, 22 bp, Artificial Sequence
  chemically synthesized
tgtggaggtaattgaatcatgg

SEQ ID NO: 995551 - DNA, 22 bp, Artificial Sequence
  chemically synthesized
aatcatggggttggcttccccc

SEQ ID NO: 995552 - DNA, 22 bp, Artificial Sequence
  chemically synthesized
tcatgagaacagcatgggggaa

SEQ ID NO: 995553 - DNA, 22 bp, Artificial Sequence
  chemically synthesized
actatcatgagaacagcatggg

SEQ ID NO: 995554 - DNA, 22 bp, Artificial Sequence
  chemically synthesized
actcactatcatgagaacagca

SEQ ID NO: 995555 - DNA, 22 bp, Artificial Sequence
  chemically synthesized
gcttcccccatgctgttctcat

SEQ ID NO: 995556 - DNA, 22 bp, Artificial Sequence
  chemically synthesized
cccccatgctgttctcatgata

SEQ ID NO: 995557 - DNA, 22 bp, Artificial Sequence
  chemically synthesized
ccccatgctgttctcatgatag

SEQ ID NO: 995558 - DNA, 22 bp, Artificial Sequence
  chemically synthesized
ggagaattcactcactatcatg

SEQ ID NO: 995559 - DNA, 22 bp, Artificial Sequence
  chemically synthesized
gggagaattcactcactatcat

SEQ ID NO: 995560 - DNA, 22 bp, Artificial Sequence
  chemically synthesized
tgggagaattcactcactatca

SEQ ID NO: 995561 - DNA, 22 bp, Artificial Sequence
  chemically synthesized
ttctcatgatagtgagtgaatt

SEQ ID NO: 995562 - DNA, 22 bp, Artificial Sequence
  chemically synthesized
tcatgatagtgagtgaattctc

SEQ ID NO: 995563 - DNA, 22 bp, Artificial Sequence
  chemically synthesized
atgatagtgagtgaattctccc

SEQ ID NO: 995564 - DNA, 22 bp, Artificial Sequence
  chemically synthesized
taaaaccatcagattttgggag

SEQ ID NO: 995565 - DNA, 22 bp, Artificial Sequence
  chemically synthesized
ataaaaccatcagattttggga

SEQ ID NO: 995566 - DNA, 22 bp, Artificial Sequence
  chemically synthesized
tcccaaaatctgatggttttat

SEQ ID NO: 995567 - DNA, 22 bp, Artificial Sequence
  chemically synthesized
ccaaaatctgatggttttataa

SEQ ID NO: 995568 - DNA, 22 bp, Artificial Sequence
  chemically synthesized
aggaaagggggaagagaccctt

SEQ ID NO: 995569 - DNA, 22 bp, Artificial Sequence
  chemically synthesized
atggttttataagggtctcttc

SEQ ID NO: 995570 - DNA, 22 bp, Artificial Sequence
  chemically synthesized
tataagggtctcttcccccttt

SEQ ID NO: 995571 - DNA, 22 bp, Artificial Sequence
  chemically synthesized
ataagggtctcttccccctttc

SEQ ID NO: 995572 - DNA, 22 bp, Artificial Sequence
  chemically synthesized
taagggtctcttccccctttcc

SEQ ID NO: 995573 - DNA, 22 bp, Artificial Sequence
  chemically synthesized
ttccccctttcctcagtacttc

SEQ ID NO: 995574 - DNA, 22 bp, Artificial Sequence
  chemically synthesized
ccccctttcctcagtacttctc

SEQ ID NO: 995575 - DNA, 22 bp, Artificial Sequence
  chemically synthesized
cccctttcctcagtacttctcc

SEQ ID NO: 995576 - DNA, 22 bp, Artificial Sequence
  chemically synthesized
acaaggtggcaggaaggagaag

SEQ ID NO: 995577 - DNA, 22 bp, Artificial Sequence
  chemically synthesized
cacaaggtggcaggaaggagaa

SEQ ID NO: 995578 - DNA, 22 bp, Artificial Sequence
  chemically synthesized
tcctcagtacttctccttcctg

SEQ ID NO: 995579 - DNA, 22 bp, Artificial Sequence
  chemically synthesized
ttcacaaggtggcaggaaggag

SEQ ID NO: 995580 - DNA, 22 bp, Artificial Sequence
  chemically synthesized
cctcagtacttctccttcctgc

SEQ ID NO: 995581 - DNA, 22 bp, Artificial Sequence
  chemically synthesized
cttcacaaggtggcaggaagga

SEQ ID NO: 995582 - DNA, 22 bp, Artificial Sequence
  chemically synthesized
ctcagtacttctccttcctgcc

SEQ ID NO: 995583 - DNA, 22 bp, Artificial Sequence
  chemically synthesized
agtacttctccttcctgccacc

SEQ ID NO: 995584 - DNA, 22 bp, Artificial Sequence
  chemically synthesized
ctccttcctgccaccttgtgaa

SEQ ID NO: 995585 - DNA, 22 bp, Artificial Sequence
  chemically synthesized
tccttcctgccaccttgtgaag

SEQ ID NO: 995586 - DNA, 22 bp, Artificial Sequence
  chemically synthesized
cttcctgccaccttgtgaagaa

SEQ ID NO: 995587 - DNA, 22 bp, Artificial Sequence
  chemically synthesized
cctgccaccttgtgaagaaggt

SEQ ID NO: 995588 - DNA, 22 bp, Artificial Sequence
  chemically synthesized
ctgccaccttgtgaagaaggtg

SEQ ID NO: 995589 - DNA, 22 bp, Artificial Sequence
  chemically synthesized
ccaccttgtgaagaaggtgcct

SEQ ID NO: 995590 - DNA, 22 bp, Artificial Sequence
  chemically synthesized
gtgaagaaggtgcctcgcttcc

SEQ ID NO: 995591 - DNA, 22 bp, Artificial Sequence
  chemically synthesized
tgaagaaggtgcctcgcttccc

SEQ ID NO: 995592 - DNA, 22 bp, Artificial Sequence
  chemically synthesized
aaatcatggcagaaaatgaagg

SEQ ID NO: 995593 - DNA, 22 bp, Artificial Sequence
  chemically synthesized
aaaatcatggcagaaaatgaag

SEQ ID NO: 995594 - DNA, 22 bp, Artificial Sequence
  chemically synthesized
gcttccccttcattttctgcca

SEQ ID NO: 995595 - DNA, 22 bp, Artificial Sequence
  chemically synthesized
ccccttcattttctgccatgat

SEQ ID NO: 995596 - DNA, 22 bp, Artificial Sequence
  chemically synthesized
aggaaacttaaaatcatggcag

SEQ ID NO: 995597 - DNA, 22 bp, Artificial Sequence
  chemically synthesized
cccttcattttctgccatgatt

SEQ ID NO: 995598 - DNA, 22 bp, Artificial Sequence
  chemically synthesized
cattttctgccatgattttaag

SEQ ID NO: 995599 - DNA, 22 bp, Artificial Sequence
  chemically synthesized
attttctgccatgattttaagt

SEQ ID NO: 995600 - DNA, 22 bp, Artificial Sequence
  chemically synthesized
gggaggcctcaggaaacttaaa

SEQ ID NO: 995601 - DNA, 22 bp, Artificial Sequence
  chemically synthesized
tctgccatgattttaagtttcc

SEQ ID NO: 995602 - DNA, 22 bp, Artificial Sequence
  chemically synthesized
ctgccatgattttaagtttcct

SEQ ID NO: 995603 - DNA, 22 bp, Artificial Sequence
  chemically synthesized
tgccatgattttaagtttcctg

SEQ ID NO: 995604 - DNA, 22 bp, Artificial Sequence
  chemically synthesized
ccatgattttaagtttcctgag

SEQ ID NO: 995605 - DNA, 22 bp, Artificial Sequence
  chemically synthesized
aatatggctggggaggcctcag

SEQ ID NO: 995606 - DNA, 22 bp, Artificial Sequence
  chemically synthesized
taagtttcctgaggcctcccca

SEQ ID NO: 995607 - DNA, 22 bp, Artificial Sequence
  chemically synthesized
aagtttcctgaggcctccccag

SEQ ID NO: 995608 - DNA, 22 bp, Artificial Sequence
  chemically synthesized
agtttcctgaggcctccccagc

SEQ ID NO: 995609 - DNA, 22 bp, Artificial Sequence
  chemically synthesized
acagttcaatatggctggggag

SEQ ID NO: 995610 - DNA, 22 bp, Artificial Sequence
  chemically synthesized
cctgaggcctccccagccatat

SEQ ID NO: 995611 - DNA, 22 bp, Artificial Sequence
  chemically synthesized
actcacagttcaatatggctgg

SEQ ID NO: 995612 - DNA, 22 bp, Artificial Sequence
  chemically synthesized
ctgaggcctccccagccatatt

SEQ ID NO: 995613 - DNA, 22 bp, Artificial Sequence
  chemically synthesized
aggcctccccagccatattgaa

SEQ ID NO: 995614 - DNA, 22 bp, Artificial Sequence
  chemically synthesized
attgactcacagttcaatatgg

SEQ ID NO: 995615 - DNA, 22 bp, Artificial Sequence
  chemically synthesized
aattgactcacagttcaatatg

SEQ ID NO: 995616 - DNA, 22 bp, Artificial Sequence
  chemically synthesized
cccagccatattgaactgtgag

SEQ ID NO: 995617 - DNA, 22 bp, Artificial Sequence
  chemically synthesized
taaaggaaagaggtttaattga

SEQ ID NO: 995618 - DNA, 22 bp, Artificial Sequence
  chemically synthesized
ataaaggaaagaggtttaattg

SEQ ID NO: 995619 - DNA, 22 bp, Artificial Sequence
  chemically synthesized
aactgtgagtcaattaaacctc

SEQ ID NO: 995620 - DNA, 22 bp, Artificial Sequence
  chemically synthesized
tgagtcaattaaacctctttcc

SEQ ID NO: 995621 - DNA, 22 bp, Artificial Sequence
  chemically synthesized
ggtaatttataaaggaaagagg

SEQ ID NO: 995622 - DNA, 22 bp, Artificial Sequence
  chemically synthesized
aacctctttcctttataaatta

SEQ ID NO: 995623 - DNA, 22 bp, Artificial Sequence
  chemically synthesized
cccgagattgggtaatttataa

SEQ ID NO: 995624 - DNA, 22 bp, Artificial Sequence
  chemically synthesized
tttcctttataaattacccaat

SEQ ID NO: 995625 - DNA, 22 bp, Artificial Sequence
  chemically synthesized
tcctttataaattacccaatct

SEQ ID NO: 995626 - DNA, 22 bp, Artificial Sequence
  chemically synthesized
cctttataaattacccaatctc

SEQ ID NO: 995627 - DNA, 22 bp, Artificial Sequence
  chemically synthesized
ctttataaattacccaatctcg

SEQ ID NO: 995628 - DNA, 22 bp, Artificial Sequence
  chemically synthesized
gaaagaactgcccgagattggg

SEQ ID NO: 995629 - DNA, 22 bp, Artificial Sequence
  chemically synthesized
tataaattacccaatctcgggc

SEQ ID NO: 995630 - DNA, 22 bp, Artificial Sequence
  chemically synthesized
ataaattacccaatctcgggca

SEQ ID NO: 995631 - DNA, 22 bp, Artificial Sequence
  chemically synthesized
taaattacccaatctcgggcag

SEQ ID NO: 995632 - DNA, 22 bp, Artificial Sequence
  chemically synthesized
ataccgctagaaagaactgccc

SEQ ID NO: 995633 - DNA, 22 bp, Artificial Sequence
  chemically synthesized
cataccgctagaaagaactgcc

SEQ ID NO: 995634 - DNA, 22 bp, Artificial Sequence
  chemically synthesized
tcataccgctagaaagaactgc

SEQ ID NO: 995635 - DNA, 22 bp, Artificial Sequence
  chemically synthesized
cccaatctcgggcagttctttc

SEQ ID NO: 995636 - DNA, 22 bp, Artificial Sequence
  chemically synthesized
gcccgttttcataccgctagaa

SEQ ID NO: 995637 - DNA, 22 bp, Artificial Sequence
  chemically synthesized
gggcagttctttctagcggtat

SEQ ID NO: 995638 - DNA, 22 bp, Artificial Sequence
  chemically synthesized
tttctagcggtatgaaaacggg

SEQ ID NO: 995639 - DNA, 22 bp, Artificial Sequence
  chemically synthesized
tctagcggtatgaaaacgggct

SEQ ID NO: 995640 - DNA, 22 bp, Artificial Sequence
  chemically synthesized
ctagcggtatgaaaacgggcta

SEQ ID NO: 995641 - DNA, 22 bp, Artificial Sequence
  chemically synthesized
tagcggtatgaaaacgggctaa

SEQ ID NO: 995642 - DNA, 22 bp, Artificial Sequence
  chemically synthesized
gcggtatgaaaacgggctaata

SEQ ID NO: 995643 - DNA, 22 bp, Artificial Sequence
  chemically synthesized
aagagagggagtgtattagccc

SEQ ID NO: 995644 - DNA, 22 bp, Artificial Sequence
  chemically synthesized
aacagaaatctcaagagaggga

SEQ ID NO: 995645 - DNA, 22 bp, Artificial Sequence
  chemically synthesized
gaacagaaatctcaagagaggg

SEQ ID NO: 995646 - DNA, 22 bp, Artificial Sequence
  chemically synthesized
atacactccctctcttgagatt

SEQ ID NO: 995647 - DNA, 22 bp, Artificial Sequence
  chemically synthesized
atgtgatatttgaacagaaatc

SEQ ID NO: 995648 - DNA, 22 bp, Artificial Sequence
  chemically synthesized
gatgtgatatttgaacagaaat

SEQ ID NO: 995649 - DNA, 22 bp, Artificial Sequence
  chemically synthesized
cctctcttgagatttctgttca

SEQ ID NO: 995650 - DNA, 22 bp, Artificial Sequence
  chemically synthesized
tgatgtgatatttgaacagaaa

SEQ ID NO: 995651 - DNA, 22 bp, Artificial Sequence
  chemically synthesized
tttgatgtgatatttgaacaga

SEQ ID NO: 995652 - DNA, 22 bp, Artificial Sequence
  chemically synthesized
tcttgagatttctgttcaaata

SEQ ID NO: 995653 - DNA, 22 bp, Artificial Sequence
  chemically synthesized
ttgagatttctgttcaaatatc

SEQ ID NO: 995654 - DNA, 22 bp, Artificial Sequence
  chemically synthesized
gagatttctgttcaaatatcac

SEQ ID NO: 995655 - DNA, 22 bp, Artificial Sequence
  chemically synthesized
agatttctgttcaaatatcaca

SEQ ID NO: 995656 - DNA, 22 bp, Artificial Sequence
  chemically synthesized
ggcagacctctttgatgtgata

SEQ ID NO: 995657 - DNA, 22 bp, Artificial Sequence
  chemically synthesized
ctgttcaaatatcacatcaaag

SEQ ID NO: 995658 - DNA, 22 bp, Artificial Sequence
  chemically synthesized
tgttcaaatatcacatcaaaga

SEQ ID NO: 995659 - DNA, 22 bp, Artificial Sequence
  chemically synthesized
ttcaaatatcacatcaaagagg

SEQ ID NO: 995660 - DNA, 22 bp, Artificial Sequence
  chemically synthesized
aaatatcacatcaaagaggtct

SEQ ID NO: 995661 - DNA, 22 bp, Artificial Sequence
  chemically synthesized
tatatggcagtctgggcagacc

SEQ ID NO: 995662 - DNA, 22 bp, Artificial Sequence
  chemically synthesized
atatatggcagtctgggcagac

SEQ ID NO: 995663 - DNA, 22 bp, Artificial Sequence
  chemically synthesized
tatatatggcagtctgggcaga

SEQ ID NO: 995664 - DNA, 22 bp, Artificial Sequence
  chemically synthesized
atgttttatatatggcagtctg

SEQ ID NO: 995665 - DNA, 22 bp, Artificial Sequence
  chemically synthesized
cccagactgccatatataaaac

SEQ ID NO: 995666 - DNA, 22 bp, Artificial Sequence
  chemically synthesized
ccatatataaaacatcaatttc

SEQ ID NO: 995667 - DNA, 22 bp, Artificial Sequence
  chemically synthesized
caggcatgaaccaccatgccca

SEQ ID NO: 995668 - DNA, 22 bp, Artificial Sequence
  chemically synthesized
gaattacaggcatgaaccacca

SEQ ID NO: 995669 - DNA, 22 bp, Artificial Sequence
  chemically synthesized
cggctgggcatggtggttcatg

SEQ ID NO: 995670 - DNA, 22 bp, Artificial Sequence
  chemically synthesized
ggctgggcatggtggttcatgc

SEQ ID NO: 995671 - DNA, 22 bp, Artificial Sequence
  chemically synthesized
ggcatggtggttcatgcctgta

SEQ ID NO: 995672 - DNA, 22 bp, Artificial Sequence
  chemically synthesized
aggtgctggaattacaggcatg

SEQ ID NO: 995673 - DNA, 22 bp, Artificial Sequence
  chemically synthesized
ctaaggtgctggaattacaggc

SEQ ID NO: 995674 - DNA, 22 bp, Artificial Sequence
  chemically synthesized
cctcctaaggtgctggaattac

SEQ ID NO: 995675 - DNA, 22 bp, Artificial Sequence
  chemically synthesized
atgcctgtaattccagcacctt

SEQ ID NO: 995676 - DNA, 22 bp, Artificial Sequence
  chemically synthesized
taattccagcaccttaggaggt

SEQ ID NO: 995677 - DNA, 22 bp, Artificial Sequence
  chemically synthesized
cagcaccttaggaggtagatgt

SEQ ID NO: 995678 - DNA, 22 bp, Artificial Sequence
  chemically synthesized
aagcagtccacccacatctacc

SEQ ID NO: 995679 - DNA, 22 bp, Artificial Sequence
  chemically synthesized
aggaggtagatgtgggtggact

SEQ ID NO: 995680 - DNA, 22 bp, Artificial Sequence
  chemically synthesized
cggggctcaagcagtccaccca

SEQ ID NO: 995681 - DNA, 22 bp, Artificial Sequence
  chemically synthesized
ggaggtagatgtgggtggactg

SEQ ID NO: 995682 - DNA, 22 bp, Artificial Sequence
  chemically synthesized
aactccggggctcaagcagtcc

SEQ ID NO: 995683 - DNA, 22 bp, Artificial Sequence
  chemically synthesized
gaactccggggctcaagcagtc

SEQ ID NO: 995684 - DNA, 22 bp, Artificial Sequence
  chemically synthesized
ttgaactccggggctcaagcag

SEQ ID NO: 995685 - DNA, 22 bp, Artificial Sequence
  chemically synthesized
ttcttgaactccggggctcaag

SEQ ID NO: 995686 - DNA, 22 bp, Artificial Sequence
  chemically synthesized
cccaggctgttcttgaactccg

SEQ ID NO: 995687 - DNA, 22 bp, Artificial Sequence
  chemically synthesized
cttgagccccggagttcaagaa

SEQ ID NO: 995688 - DNA, 22 bp, Artificial Sequence
  chemically synthesized
tgttgcccaggctgttcttgaa

SEQ ID NO: 995689 - DNA, 22 bp, Artificial Sequence
  chemically synthesized
gagccccggagttcaagaacag

SEQ ID NO: 995690 - DNA, 22 bp, Artificial Sequence
  chemically synthesized
agccccggagttcaagaacagc

SEQ ID NO: 995691 - DNA, 22 bp, Artificial Sequence
  chemically synthesized
actgtgttgcccaggctgttct

SEQ ID NO: 995692 - DNA, 22 bp, Artificial Sequence
  chemically synthesized
aagaacagcctgggcaacacag

SEQ ID NO: 995693 - DNA, 22 bp, Artificial Sequence
  chemically synthesized
tagagacagagtctcactgtgt

SEQ ID NO: 995694 - DNA, 22 bp, Artificial Sequence
  chemically synthesized
atagagacagagtctcactgtg

SEQ ID NO: 995695 - DNA, 22 bp, Artificial Sequence
  chemically synthesized
ttatagagacagagtctcactg

SEQ ID NO: 995696 - DNA, 22 bp, Artificial Sequence
  chemically synthesized
cttatagagacagagtctcact

SEQ ID NO: 995697 - DNA, 22 bp, Artificial Sequence
  chemically synthesized
tcttatagagacagagtctcac

SEQ ID NO: 995698 - DNA, 22 bp, Artificial Sequence
  chemically synthesized
ttcttatagagacagagtctca

SEQ ID NO: 995699 - DNA, 22 bp, Artificial Sequence
  chemically synthesized
ggcaacacagtgagactctgtc

SEQ ID NO: 995700 - DNA, 22 bp, Artificial Sequence
  chemically synthesized
ttttcttatagagacagagtct

SEQ ID NO: 995701 - DNA, 22 bp, Artificial Sequence
  chemically synthesized
cttttcttatagagacagagtc

SEQ ID NO: 995702 - DNA, 22 bp, Artificial Sequence
  chemically synthesized
tcttttcttatagagacagagt

SEQ ID NO: 995703 - DNA, 22 bp, Artificial Sequence
  chemically synthesized
acacgttttcttttcttataga

SEQ ID NO: 995704 - DNA, 22 bp, Artificial Sequence
  chemically synthesized
tgtctctataagaaaagaaaac

SEQ ID NO: 995705 - DNA, 22 bp, Artificial Sequence
  chemically synthesized
tctctataagaaaagaaaacgt

SEQ ID NO: 995706 - DNA, 22 bp, Artificial Sequence
  chemically synthesized
tataagaaaagaaaacgtgtta

SEQ ID NO: 995707 - DNA, 22 bp, Artificial Sequence
  chemically synthesized
taagaaaagaaaacgtgttagc

SEQ ID NO: 995708 - DNA, 22 bp, Artificial Sequence
  chemically synthesized
caggcatgtaccacgataccca

SEQ ID NO: 995709 - DNA, 22 bp, Artificial Sequence
  chemically synthesized
gctgggtatcgtggtacatgcc

SEQ ID NO: 995710 - DNA, 22 bp, Artificial Sequence
  chemically synthesized
ggtatcgtggtacatgcctgta

SEQ ID NO: 995711 - DNA, 22 bp, Artificial Sequence
  chemically synthesized
ccaagtagccaggtctacaggc

SEQ ID NO: 995712 - DNA, 22 bp, Artificial Sequence
  chemically synthesized
ccacatcagcctcccaagtagc

SEQ ID NO: 995713 - DNA, 22 bp, Artificial Sequence
  chemically synthesized
tagacctggctacttgggaggc

SEQ ID NO: 995714 - DNA, 22 bp, Artificial Sequence
  chemically synthesized
agatgatcctcccacatcagcc

SEQ ID NO: 995715 - DNA, 22 bp, Artificial Sequence
  chemically synthesized
gctacttgggaggctgatgtgg

SEQ ID NO: 995716 - DNA, 22 bp, Artificial Sequence
  chemically synthesized
cttgggaggctgatgtgggagg

SEQ ID NO: 995717 - DNA, 22 bp, Artificial Sequence
  chemically synthesized
ggctcagatgatcctcccacat

SEQ ID NO: 995718 - DNA, 22 bp, Artificial Sequence
  chemically synthesized
gggaggctgatgtgggaggatc

SEQ ID NO: 995719 - DNA, 22 bp, Artificial Sequence
  chemically synthesized
ggaggctgatgtgggaggatca

SEQ ID NO: 995720 - DNA, 22 bp, Artificial Sequence
  chemically synthesized
cctgggctcagatgatcctccc

SEQ ID NO: 995721 - DNA, 22 bp, Artificial Sequence
  chemically synthesized
acctccctgggctcagatgatc

SEQ ID NO: 995722 - DNA, 22 bp, Artificial Sequence
  chemically synthesized
gacctccctgggctcagatgat

SEQ ID NO: 995723 - DNA, 22 bp, Artificial Sequence
  chemically synthesized
atgtgggaggatcatctgagcc

SEQ ID NO: 995724 - DNA, 22 bp, Artificial Sequence
  chemically synthesized
cagccttgacctccctgggctc

SEQ ID NO: 995725 - DNA, 22 bp, Artificial Sequence
  chemically synthesized
actgcagccttgacctccctgg

SEQ ID NO: 995726 - DNA, 22 bp, Artificial Sequence
  chemically synthesized
agcccagggaggtcaaggctgc

SEQ ID NO: 995727 - DNA, 22 bp, Artificial Sequence
  chemically synthesized
gtgtgcagtgacgtgatcatgg

SEQ ID NO: 995728 - DNA, 22 bp, Artificial Sequence
  chemically synthesized
cagtgagccatgatcacgtcac

SEQ ID NO: 995729 - DNA, 22 bp, Artificial Sequence
  chemically synthesized
agctggtgtgcagtgacgtgat

SEQ ID NO: 995730 - DNA, 22 bp, Artificial Sequence
  chemically synthesized
cctaagctggtgtgcagtgacg

SEQ ID NO: 995731 - DNA, 22 bp, Artificial Sequence
  chemically synthesized
ttgcctaagctggtgtgcagtg

SEQ ID NO: 995732 - DNA, 22 bp, Artificial Sequence
  chemically synthesized
tgttgcctaagctggtgtgcag

SEQ ID NO: 995733 - DNA, 22 bp, Artificial Sequence
  chemically synthesized
attctgttgcctaagctggtgt

SEQ ID NO: 995734 - DNA, 22 bp, Artificial Sequence
  chemically synthesized
cacaccagcttaggcaacagaa

SEQ ID NO: 995735 - DNA, 22 bp, Artificial Sequence
  chemically synthesized
agacagggtctcattctgttgc

SEQ ID NO: 995736 - DNA, 22 bp, Artificial Sequence
  chemically synthesized
gagacagggtctcattctgttg

SEQ ID NO: 995737 - DNA, 22 bp, Artificial Sequence
  chemically synthesized
tgagacagggtctcattctgtt

SEQ ID NO: 995738 - DNA, 22 bp, Artificial Sequence
  chemically synthesized
ttgagacagggtctcattctgt

SEQ ID NO: 995739 - DNA, 22 bp, Artificial Sequence
  chemically synthesized
tttgagacagggtctcattctg

SEQ ID NO: 995740 - DNA, 22 bp, Artificial Sequence
  chemically synthesized
aggcaacagaatgagaccctgt

SEQ ID NO: 995741 - DNA, 22 bp, Artificial Sequence
  chemically synthesized
ggcaacagaatgagaccctgtc

SEQ ID NO: 995742 - DNA, 22 bp, Artificial Sequence
  chemically synthesized
tatatattttttgagacagggt

SEQ ID NO: 995743 - DNA, 22 bp, Artificial Sequence
  chemically synthesized
atatatattttttgagacaggg

SEQ ID NO: 995744 - DNA, 22 bp, Artificial Sequence
  chemically synthesized
tttatatatattttttgagaca

SEQ ID NO: 995745 - DNA, 22 bp, Artificial Sequence
  chemically synthesized
atttatatatattttttgagac

SEQ ID NO: 995746 - DNA, 22 bp, Artificial Sequence
  chemically synthesized
tatttatatatattttttgaga

SEQ ID NO: 995747 - DNA, 22 bp, Artificial Sequence
  chemically synthesized
ttatttatatatattttttgag

SEQ ID NO: 995748 - DNA, 22 bp, Artificial Sequence
  chemically synthesized
tttatttatatatattttttga

SEQ ID NO: 995749 - DNA, 22 bp, Artificial Sequence
  chemically synthesized
ttttttatttatatatattttt

SEQ ID NO: 995750 - DNA, 22 bp, Artificial Sequence
  chemically synthesized
attttttatttatatatatttt

SEQ ID NO: 995751 - DNA, 22 bp, Artificial Sequence
  chemically synthesized
tattttttatttatatatattt

SEQ ID NO: 995752 - DNA, 22 bp, Artificial Sequence
  chemically synthesized
tctcaaaaaatatatataaata

SEQ ID NO: 995753 - DNA, 22 bp, Artificial Sequence
  chemically synthesized
aaaaaatatatataaataaaaa

SEQ ID NO: 995754 - DNA, 22 bp, Artificial Sequence
  chemically synthesized
acaagatagggaaaaagtgaca

SEQ ID NO: 995755 - DNA, 22 bp, Artificial Sequence
  chemically synthesized
ctgtcactttttccctatcttg

SEQ ID NO: 995756 - DNA, 22 bp, Artificial Sequence
  chemically synthesized
tcactttttccctatcttgtta

SEQ ID NO: 995757 - DNA, 22 bp, Artificial Sequence
  chemically synthesized
agaagaaaagagaaactaacaa

SEQ ID NO: 995758 - DNA, 22 bp, Artificial Sequence
  chemically synthesized
tttccctatcttgttagtttct

SEQ ID NO: 995759 - DNA, 22 bp, Artificial Sequence
  chemically synthesized
ttccctatcttgttagtttctc

SEQ ID NO: 995760 - DNA, 22 bp, Artificial Sequence
  chemically synthesized
tccctatcttgttagtttctct

SEQ ID NO: 995761 - DNA, 22 bp, Artificial Sequence
  chemically synthesized
ccctatcttgttagtttctctt

SEQ ID NO: 995762 - DNA, 22 bp, Artificial Sequence
  chemically synthesized
cctatcttgttagtttctcttt

SEQ ID NO: 995763 - DNA, 22 bp, Artificial Sequence
  chemically synthesized
aagtgttaagaagaaaagagaa

SEQ ID NO: 995764 - DNA, 22 bp, Artificial Sequence
  chemically synthesized
tcttgttagtttctcttttctt

SEQ ID NO: 995765 - DNA, 22 bp, Artificial Sequence
  chemically synthesized
gttagtttctcttttcttctta

SEQ ID NO: 995766 - DNA, 22 bp, Artificial Sequence
  chemically synthesized
ttagtttctcttttcttcttaa

SEQ ID NO: 995767 - DNA, 22 bp, Artificial Sequence
  chemically synthesized
gtttctcttttcttcttaacac

SEQ ID NO: 995768 - DNA, 22 bp, Artificial Sequence
  chemically synthesized
ctcttttcttcttaacacttta

SEQ ID NO: 995769 - DNA, 22 bp, Artificial Sequence
  chemically synthesized
aaatggaagtattaaagtgtta

SEQ ID NO: 995770 - DNA, 22 bp, Artificial Sequence
  chemically synthesized
tcttttcttcttaacactttaa

SEQ ID NO: 995771 - DNA, 22 bp, Artificial Sequence
  chemically synthesized
caaatggaagtattaaagtgtt

SEQ ID NO: 995772 - DNA, 22 bp, Artificial Sequence
  chemically synthesized
ttttcttcttaacactttaata

SEQ ID NO: 995773 - DNA, 22 bp, Artificial Sequence
  chemically synthesized
ttcttcttaacactttaatact

SEQ ID NO: 995774 - DNA, 22 bp, Artificial Sequence
  chemically synthesized
tcttcttaacactttaatactt

SEQ ID NO: 995775 - DNA, 22 bp, Artificial Sequence
  chemically synthesized
cttcttaacactttaatacttc

SEQ ID NO: 995776 - DNA, 22 bp, Artificial Sequence
  chemically synthesized
ttcttaacactttaatacttcc

SEQ ID NO: 995777 - DNA, 22 bp, Artificial Sequence
  chemically synthesized
cttaacactttaatacttccat

SEQ ID NO: 995778 - DNA, 22 bp, Artificial Sequence
  chemically synthesized
ttaacactttaatacttccatt

SEQ ID NO: 995779 - DNA, 22 bp, Artificial Sequence
  chemically synthesized
aacactttaatacttccatttg

SEQ ID NO: 995780 - DNA, 22 bp, Artificial Sequence
  chemically synthesized
acactttaatacttccatttga

SEQ ID NO: 995781 - DNA, 22 bp, Artificial Sequence
  chemically synthesized
taatacttccatttgaaatacc

SEQ ID NO: 995782 - DNA, 22 bp, Artificial Sequence
  chemically synthesized
aatacttccatttgaaatacca

SEQ ID NO: 995783 - DNA, 22 bp, Artificial Sequence
  chemically synthesized
atacttccatttgaaataccac

SEQ ID NO: 995784 - DNA, 22 bp, Artificial Sequence
  chemically synthesized
ccatttgaaataccacatattt

SEQ ID NO: 995785 - DNA, 22 bp, Artificial Sequence
  chemically synthesized
catttgaaataccacatattta

SEQ ID NO: 995786 - DNA, 22 bp, Artificial Sequence
  chemically synthesized
ggaaaggagaaaataaatatgt

SEQ ID NO: 995787 - DNA, 22 bp, Artificial Sequence
  chemically synthesized
gaaataccacatatttattttc

SEQ ID NO: 995788 - DNA, 22 bp, Artificial Sequence
  chemically synthesized
aaataccacatatttattttct

SEQ ID NO: 995789 - DNA, 22 bp, Artificial Sequence
  chemically synthesized
atatagtaatgggaagttagga

SEQ ID NO: 995790 - DNA, 22 bp, Artificial Sequence
  chemically synthesized
attttctcctttcctaacttcc

SEQ ID NO: 995791 - DNA, 22 bp, Artificial Sequence
  chemically synthesized
ttttctcctttcctaacttccc

SEQ ID NO: 995792 - DNA, 22 bp, Artificial Sequence
  chemically synthesized
tctcctttcctaacttcccatt

SEQ ID NO: 995793 - DNA, 22 bp, Artificial Sequence
  chemically synthesized
ctcctttcctaacttcccatta

SEQ ID NO: 995794 - DNA, 22 bp, Artificial Sequence
  chemically synthesized
tcctttcctaacttcccattac

SEQ ID NO: 995795 - DNA, 22 bp, Artificial Sequence
  chemically synthesized
ctttcctaacttcccattacta

SEQ ID NO: 995796 - DNA, 22 bp, Artificial Sequence
  chemically synthesized
aaggagctcatatagtaatggg

SEQ ID NO: 995797 - DNA, 22 bp, Artificial Sequence
  chemically synthesized
caaggagctcatatagtaatgg

SEQ ID NO: 995798 - DNA, 22 bp, Artificial Sequence
  chemically synthesized
tcaaggagctcatatagtaatg

SEQ ID NO: 995799 - DNA, 22 bp, Artificial Sequence
  chemically synthesized
tcctaacttcccattactatat

SEQ ID NO: 995800 - DNA, 22 bp, Artificial Sequence
  chemically synthesized
cctaacttcccattactatatg

SEQ ID NO: 995801 - DNA, 22 bp, Artificial Sequence
  chemically synthesized
ctaacttcccattactatatga

SEQ ID NO: 995802 - DNA, 22 bp, Artificial Sequence
  chemically synthesized
tcctttcaaggagctcatatag

SEQ ID NO: 995803 - DNA, 22 bp, Artificial Sequence
  chemically synthesized
acttcccattactatatgagct

SEQ ID NO: 995804 - DNA, 22 bp, Artificial Sequence
  chemically synthesized
cccattactatatgagctcctt

SEQ ID NO: 995805 - DNA, 22 bp, Artificial Sequence
  chemically synthesized
ccattactatatgagctccttg

SEQ ID NO: 995806 - DNA, 22 bp, Artificial Sequence
  chemically synthesized
ctatatgagctccttgaaagga

SEQ ID NO: 995807 - DNA, 22 bp, Artificial Sequence
  chemically synthesized
tatgagctccttgaaaggacag

SEQ ID NO: 995808 - DNA, 22 bp, Artificial Sequence
  chemically synthesized
cttgaaaggacagcgtttgtct

SEQ ID NO: 995809 - DNA, 22 bp, Artificial Sequence
  chemically synthesized
gaaaggacagcgtttgtctgtt

SEQ ID NO: 995810 - DNA, 22 bp, Artificial Sequence
  chemically synthesized
aaaggacagcgtttgtctgttt

SEQ ID NO: 995811 - DNA, 22 bp, Artificial Sequence
  chemically synthesized
atataggcacaaggataaccaa

SEQ ID NO: 995812 - DNA, 22 bp, Artificial Sequence
  chemically synthesized
gtctgtttttggttatccttgt

SEQ ID NO: 995813 - DNA, 22 bp, Artificial Sequence
  chemically synthesized
tctgtttttggttatccttgtg

SEQ ID NO: 995814 - DNA, 22 bp, Artificial Sequence
  chemically synthesized
tttttggttatccttgtgccta

SEQ ID NO: 995815 - DNA, 22 bp, Artificial Sequence
  chemically synthesized
ttggttatccttgtgcctatat

SEQ ID NO: 995816 - DNA, 22 bp, Artificial Sequence
  chemically synthesized
tggttatccttgtgcctatatt

SEQ ID NO: 995817 - DNA, 22 bp, Artificial Sequence
  chemically synthesized
ggttatccttgtgcctatatta

SEQ ID NO: 995818 - DNA, 22 bp, Artificial Sequence
  chemically synthesized
tgtgccacatactaatataggc

SEQ ID NO: 995819 - DNA, 22 bp, Artificial Sequence
  chemically synthesized
gttatccttgtgcctatattag

SEQ ID NO: 995820 - DNA, 22 bp, Artificial Sequence
  chemically synthesized
ttgtgtgccacatactaatata

SEQ ID NO: 995821 - DNA, 22 bp, Artificial Sequence
  chemically synthesized
tccttgtgcctatattagtatg

SEQ ID NO: 995822 - DNA, 22 bp, Artificial Sequence
  chemically synthesized
gtgcctatattagtatgtggca

SEQ ID NO: 995823 - DNA, 22 bp, Artificial Sequence
  chemically synthesized
tgcctatattagtatgtggcac

SEQ ID NO: 995824 - DNA, 22 bp, Artificial Sequence
  chemically synthesized
tagagtgactattgtgtgccac

SEQ ID NO: 995825 - DNA, 22 bp, Artificial Sequence
  chemically synthesized
gtagagtgactattgtgtgcca

SEQ ID NO: 995826 - DNA, 22 bp, Artificial Sequence
  chemically synthesized
tattagtatgtggcacacaata

SEQ ID NO: 995827 - DNA, 22 bp, Artificial Sequence
  chemically synthesized
gtatgtggcacacaatagtcac

SEQ ID NO: 995828 - DNA, 22 bp, Artificial Sequence
  chemically synthesized
atcaaatatttgtagagtgact

SEQ ID NO: 995829 - DNA, 22 bp, Artificial Sequence
  chemically synthesized
attcatcaaatatttgtagagt

SEQ ID NO: 995830 - DNA, 22 bp, Artificial Sequence
  chemically synthesized
ttaattcatcaaatatttgtag

SEQ ID NO: 995831 - DNA, 22 bp, Artificial Sequence
  chemically synthesized
attaattcatcaaatatttgta

SEQ ID NO: 995832 - DNA, 22 bp, Artificial Sequence
  chemically synthesized
atttattaattcatcaaatatt

SEQ ID NO: 995833 - DNA, 22 bp, Artificial Sequence
  chemically synthesized
actcatttattaattcatcaaa

SEQ ID NO: 995834 - DNA, 22 bp, Artificial Sequence
  chemically synthesized
ttcactcatttattaattcatc

SEQ ID NO: 995835 - DNA, 22 bp, Artificial Sequence
  chemically synthesized
tacaaatatttgatgaattaat

SEQ ID NO: 995836 - DNA, 22 bp, Artificial Sequence
  chemically synthesized
caaatatttgatgaattaataa

SEQ ID NO: 995837 - DNA, 22 bp, Artificial Sequence
  chemically synthesized
cctgttcactcatttattaatt

SEQ ID NO: 995838 - DNA, 22 bp, Artificial Sequence
  chemically synthesized
acctgttcactcatttattaat

SEQ ID NO: 995839 - DNA, 22 bp, Artificial Sequence
  chemically synthesized
tacctgttcactcatttattaa

SEQ ID NO: 995840 - DNA, 22 bp, Artificial Sequence
  chemically synthesized
gctttacctgttcactcattta

SEQ ID NO: 995841 - DNA, 22 bp, Artificial Sequence
  chemically synthesized
gatgaattaataaatgagtgaa

SEQ ID NO: 995842 - DNA, 22 bp, Artificial Sequence
  chemically synthesized
atgaattaataaatgagtgaac

SEQ ID NO: 995843 - DNA, 22 bp, Artificial Sequence
  chemically synthesized
ctagctttacctgttcactcat

SEQ ID NO: 995844 - DNA, 22 bp, Artificial Sequence
  chemically synthesized
tactagctttacctgttcactc

SEQ ID NO: 995845 - DNA, 22 bp, Artificial Sequence
  chemically synthesized
ctactagctttacctgttcact

SEQ ID NO: 995846 - DNA, 22 bp, Artificial Sequence
  chemically synthesized
cttctactagctttacctgttc

SEQ ID NO: 995847 - DNA, 22 bp, Artificial Sequence
  chemically synthesized
ataaatgagtgaacaggtaaag

SEQ ID NO: 995848 - DNA, 22 bp, Artificial Sequence
  chemically synthesized
ttccttctactagctttacctg

SEQ ID NO: 995849 - DNA, 22 bp, Artificial Sequence
  chemically synthesized
catgactgttccttctactagc

SEQ ID NO: 995850 - DNA, 22 bp, Artificial Sequence
  chemically synthesized
agccaatctgcatgactgttcc

SEQ ID NO: 995851 - DNA, 22 bp, Artificial Sequence
  chemically synthesized
ttaagccaatctgcatgactgt

SEQ ID NO: 995852 - DNA, 22 bp, Artificial Sequence
  chemically synthesized
gtagaaggaacagtcatgcaga

SEQ ID NO: 995853 - DNA, 22 bp, Artificial Sequence
  chemically synthesized
ctattaagccaatctgcatgac

SEQ ID NO: 995854 - DNA, 22 bp, Artificial Sequence
  chemically synthesized
cctattaagccaatctgcatga

SEQ ID NO: 995855 - DNA, 22 bp, Artificial Sequence
  chemically synthesized
tatttcctattaagccaatctg

SEQ ID NO: 995856 - DNA, 22 bp, Artificial Sequence
  chemically synthesized
gtatttcctattaagccaatct

SEQ ID NO: 995857 - DNA, 22 bp, Artificial Sequence
  chemically synthesized
tcagacttgtatttcctattaa

SEQ ID NO: 995858 - DNA, 22 bp, Artificial Sequence
  chemically synthesized
gtcagacttgtatttcctatta

SEQ ID NO: 995859 - DNA, 22 bp, Artificial Sequence
  chemically synthesized
tgtcagacttgtatttcctatt

SEQ ID NO: 995860 - DNA, 22 bp, Artificial Sequence
  chemically synthesized
gcttaataggaaatacaagtct

SEQ ID NO: 995861 - DNA, 22 bp, Artificial Sequence
  chemically synthesized
aataggaaatacaagtctgaca

SEQ ID NO: 995862 - DNA, 22 bp, Artificial Sequence
  chemically synthesized
ataggaaatacaagtctgacaa

SEQ ID NO: 995863 - DNA, 22 bp, Artificial Sequence
  chemically synthesized
ccaaggaatgtgattttgtcag

SEQ ID NO: 995864 - DNA, 22 bp, Artificial Sequence
  chemically synthesized
agtactgccaaggaatgtgatt

SEQ ID NO: 995865 - DNA, 22 bp, Artificial Sequence
  chemically synthesized
aagtactgccaaggaatgtgat

SEQ ID NO: 995866 - DNA, 22 bp, Artificial Sequence
  chemically synthesized
taagtactgccaaggaatgtga

SEQ ID NO: 995867 - DNA, 22 bp, Artificial Sequence
  chemically synthesized
ttaagtactgccaaggaatgtg

SEQ ID NO: 995868 - DNA, 22 bp, Artificial Sequence
  chemically synthesized
tttaagtactgccaaggaatgt

SEQ ID NO: 995869 - DNA, 22 bp, Artificial Sequence
  chemically synthesized
ttttaagtactgccaaggaatg

SEQ ID NO: 995870 - DNA, 22 bp, Artificial Sequence
  chemically synthesized
acaaaatcacattccttggcag

SEQ ID NO: 995871 - DNA, 22 bp, Artificial Sequence
  chemically synthesized
ccagtttttttaagtactgcca

SEQ ID NO: 995872 - DNA, 22 bp, Artificial Sequence
  chemically synthesized
cccagtttttttaagtactgcc

SEQ ID NO: 995873 - DNA, 22 bp, Artificial Sequence
  chemically synthesized
cttcccagtttttttaagtact

SEQ ID NO: 995874 - DNA, 22 bp, Artificial Sequence
  chemically synthesized
ccttcccagtttttttaagtac

SEQ ID NO: 995875 - DNA, 22 bp, Artificial Sequence
  chemically synthesized
tccttcccagtttttttaagta

SEQ ID NO: 995876 - DNA, 22 bp, Artificial Sequence
  chemically synthesized
ttccttcccagtttttttaagt

SEQ ID NO: 995877 - DNA, 22 bp, Artificial Sequence
  chemically synthesized
tttccttcccagtttttttaag

SEQ ID NO: 995878 - DNA, 22 bp, Artificial Sequence
  chemically synthesized
cttggcagtacttaaaaaaact

SEQ ID NO: 995879 - DNA, 22 bp, Artificial Sequence
  chemically synthesized
tttttccttcccagttttttta

SEQ ID NO: 995880 - DNA, 22 bp, Artificial Sequence
  chemically synthesized
ctttttccttcccagttttttt

SEQ ID NO: 995881 - DNA, 22 bp, Artificial Sequence
  chemically synthesized
tctttttccttcccagtttttt

SEQ ID NO: 995882 - DNA, 22 bp, Artificial Sequence
  chemically synthesized
ggcagtacttaaaaaaactggg

SEQ ID NO: 995883 - DNA, 22 bp, Artificial Sequence
  chemically synthesized
gcagtacttaaaaaaactggga

SEQ ID NO: 995884 - DNA, 22 bp, Artificial Sequence
  chemically synthesized
aaaaaaactgggaaggaaaaag

SEQ ID NO: 995885 - DNA, 22 bp, Artificial Sequence
  chemically synthesized
aaaaaactgggaaggaaaaaga

SEQ ID NO: 995886 - DNA, 22 bp, Artificial Sequence
  chemically synthesized
ggaaggaaaaagaaaacttgct

SEQ ID NO: 995887 - DNA, 22 bp, Artificial Sequence
  chemically synthesized
tatcacagaagcagcaggagca

SEQ ID NO: 995888 - DNA, 22 bp, Artificial Sequence
  chemically synthesized
gtatcacagaagcagcaggagc

SEQ ID NO: 995889 - DNA, 22 bp, Artificial Sequence
  chemically synthesized
tgtatcacagaagcagcaggag

SEQ ID NO: 995890 - DNA, 22 bp, Artificial Sequence
  chemically synthesized
tttgtatcacagaagcagcagg

SEQ ID NO: 995891 - DNA, 22 bp, Artificial Sequence
  chemically synthesized
ctttgtatcacagaagcagcag

SEQ ID NO: 995892 - DNA, 22 bp, Artificial Sequence
  chemically synthesized
tctttgtatcacagaagcagca

SEQ ID NO: 995893 - DNA, 22 bp, Artificial Sequence
  chemically synthesized
ttctttgtatcacagaagcagc

SEQ ID NO: 995894 - DNA, 22 bp, Artificial Sequence
  chemically synthesized
gctcctgctgcttctgtgatac

SEQ ID NO: 995895 - DNA, 22 bp, Artificial Sequence
  chemically synthesized
ctcctgctgcttctgtgataca

SEQ ID NO: 995896 - DNA, 22 bp, Artificial Sequence
  chemically synthesized
ctgctgcttctgtgatacaaag

SEQ ID NO: 995897 - DNA, 22 bp, Artificial Sequence
  chemically synthesized
ataatgaggtttttctttgtat

SEQ ID NO: 995898 - DNA, 22 bp, Artificial Sequence
  chemically synthesized
ctgcttctgtgatacaaagaaa

SEQ ID NO: 995899 - DNA, 22 bp, Artificial Sequence
  chemically synthesized
ctaataatgaggtttttctttg

SEQ ID NO: 995900 - DNA, 22 bp, Artificial Sequence
  chemically synthesized
cttctgtgatacaaagaaaaac

SEQ ID NO: 995901 - DNA, 22 bp, Artificial Sequence
  chemically synthesized
ctgtgatacaaagaaaaacctc

SEQ ID NO: 995902 - DNA, 22 bp, Artificial Sequence
  chemically synthesized
tgtgatacaaagaaaaacctca

SEQ ID NO: 995903 - DNA, 22 bp, Artificial Sequence
  chemically synthesized
tgatacaaagaaaaacctcatt

SEQ ID NO: 995904 - DNA, 22 bp, Artificial Sequence
  chemically synthesized
aaaaaactgctaataatgaggt

SEQ ID NO: 995905 - DNA, 22 bp, Artificial Sequence
  chemically synthesized
aaaaaaactgctaataatgagg

SEQ ID NO: 995906 - DNA, 22 bp, Artificial Sequence
  chemically synthesized
tttaaaaaaactgctaataatg

SEQ ID NO: 995907 - DNA, 22 bp, Artificial Sequence
  chemically synthesized
ttatttaaaaaaactgctaata

SEQ ID NO: 995908 - DNA, 22 bp, Artificial Sequence
  chemically synthesized
attatttaaaaaaactgctaat

SEQ ID NO: 995909 - DNA, 22 bp, Artificial Sequence
  chemically synthesized
tattatttaaaaaaactgctaa

SEQ ID NO: 995910 - DNA, 22 bp, Artificial Sequence
  chemically synthesized
aactttattatttaaaaaaact

SEQ ID NO: 995911 - DNA, 22 bp, Artificial Sequence
  chemically synthesized
attattagcagtttttttaaat

SEQ ID NO: 995912 - DNA, 22 bp, Artificial Sequence
  chemically synthesized
ttagcagtttttttaaataata

SEQ ID NO: 995913 - DNA, 22 bp, Artificial Sequence
  chemically synthesized
gcagtttttttaaataataaag

SEQ ID NO: 995914 - DNA, 22 bp, Artificial Sequence
  chemically synthesized
catggtaatgctcaactttatt

SEQ ID NO: 995915 - DNA, 22 bp, Artificial Sequence
  chemically synthesized
tacatggtaatgctcaacttta

SEQ ID NO: 995916 - DNA, 22 bp, Artificial Sequence
  chemically synthesized
ttttaaataataaagttgagca

SEQ ID NO: 995917 - DNA, 22 bp, Artificial Sequence
  chemically synthesized
tttaaataataaagttgagcat

SEQ ID NO: 995918 - DNA, 22 bp, Artificial Sequence
  chemically synthesized
ttaaataataaagttgagcatt

SEQ ID NO: 995919 - DNA, 22 bp, Artificial Sequence
  chemically synthesized
taaataataaagttgagcatta

SEQ ID NO: 995920 - DNA, 22 bp, Artificial Sequence
  chemically synthesized
aaataataaagttgagcattac

SEQ ID NO: 995921 - DNA, 22 bp, Artificial Sequence
  chemically synthesized
aataataaagttgagcattacc

SEQ ID NO: 995922 - DNA, 22 bp, Artificial Sequence
  chemically synthesized
tccataataccattctacatgg

SEQ ID NO: 995923 - DNA, 22 bp, Artificial Sequence
  chemically synthesized
tgtccataataccattctacat

SEQ ID NO: 995924 - DNA, 22 bp, Artificial Sequence
  chemically synthesized
agcattaccatgtagaatggta

SEQ ID NO: 995925 - DNA, 22 bp, Artificial Sequence
  chemically synthesized
ccatgtagaatggtattatgga

SEQ ID NO: 995926 - DNA, 22 bp, Artificial Sequence
  chemically synthesized
tacatatgtggtgtgttctgtc

SEQ ID NO: 995927 - DNA, 22 bp, Artificial Sequence
  chemically synthesized
atacatatgtggtgtgttctgt

SEQ ID NO: 995928 - DNA, 22 bp, Artificial Sequence
  chemically synthesized
tatacatatgtggtgtgttctg

SEQ ID NO: 995929 - DNA, 22 bp, Artificial Sequence
  chemically synthesized
ttatacatatgtggtgtgttct

SEQ ID NO: 995930 - DNA, 22 bp, Artificial Sequence
  chemically synthesized
tttttatacatatgtggtgtgt

SEQ ID NO: 995931 - DNA, 22 bp, Artificial Sequence
  chemically synthesized
atttttatacatatgtggtgtg

SEQ ID NO: 995932 - DNA, 22 bp, Artificial Sequence
  chemically synthesized
tggacagaacacaccacatatg

SEQ ID NO: 995933 - DNA, 22 bp, Artificial Sequence
  chemically synthesized
cttatttttatacatatgtggt

SEQ ID NO: 995934 - DNA, 22 bp, Artificial Sequence
  chemically synthesized
ccagggaagttacttattttta

SEQ ID NO: 995935 - DNA, 22 bp, Artificial Sequence
  chemically synthesized
cccagggaagttacttattttt

SEQ ID NO: 995936 - DNA, 22 bp, Artificial Sequence
  chemically synthesized
ttcccagggaagttacttattt

SEQ ID NO: 995937 - DNA, 22 bp, Artificial Sequence
  chemically synthesized
attcttcccagggaagttactt

SEQ ID NO: 995938 - DNA, 22 bp, Artificial Sequence
  chemically synthesized
tattgattcttcccagggaagt

SEQ ID NO: 995939 - DNA, 22 bp, Artificial Sequence
  chemically synthesized
tctgtattgattcttcccaggg

SEQ ID NO: 995940 - DNA, 22 bp, Artificial Sequence
  chemically synthesized
gggactatctgtattgattctt

SEQ ID NO: 995941 - DNA, 22 bp, Artificial Sequence
  chemically synthesized
ccctgggaagaatcaatacaga

SEQ ID NO: 995942 - DNA, 22 bp, Artificial Sequence
  chemically synthesized
cctgggaagaatcaatacagat

SEQ ID NO: 995943 - DNA, 22 bp, Artificial Sequence
  chemically synthesized
taatctagggactatctgtatt

SEQ ID NO: 995944 - DNA, 22 bp, Artificial Sequence
  chemically synthesized
gtaatctagggactatctgtat

SEQ ID NO: 995945 - DNA, 22 bp, Artificial Sequence
  chemically synthesized
ggaagaatcaatacagatagtc

SEQ ID NO: 995946 - DNA, 22 bp, Artificial Sequence
  chemically synthesized
atttgtaatctagggactatct

SEQ ID NO: 995947 - DNA, 22 bp, Artificial Sequence
  chemically synthesized
aaatgtgcagaacacaactcat

SEQ ID NO: 995948 - DNA, 22 bp, Artificial Sequence
  chemically synthesized
caaatgtgcagaacacaactca

SEQ ID NO: 995949 - DNA, 22 bp, Artificial Sequence
  chemically synthesized
tcaaatgtgcagaacacaactc

SEQ ID NO: 995950 - DNA, 22 bp, Artificial Sequence
  chemically synthesized
gattacaaatgagttgtgttct

SEQ ID NO: 995951 - DNA, 22 bp, Artificial Sequence
  chemically synthesized
tctttcaaatgtgcagaacaca

SEQ ID NO: 995952 - DNA, 22 bp, Artificial Sequence
  chemically synthesized
caaatgagttgtgttctgcaca

SEQ ID NO: 995953 - DNA, 22 bp, Artificial Sequence
  chemically synthesized
agcagctgtctttcaaatgtgc

SEQ ID NO: 995954 - DNA, 22 bp, Artificial Sequence
  chemically synthesized
tgttctgcacatttgaaagaca

SEQ ID NO: 995955 - DNA, 22 bp, Artificial Sequence
  chemically synthesized
tgcacatttgaaagacagctgc

SEQ ID NO: 995956 - DNA, 22 bp, Artificial Sequence
  chemically synthesized
cacatttgaaagacagctgctt

SEQ ID NO: 995957 - DNA, 22 bp, Artificial Sequence
  chemically synthesized
gaaagacagctgcttaatgatc

SEQ ID NO: 995958 - DNA, 22 bp, Artificial Sequence
  chemically synthesized
aaagacagctgcttaatgatct

SEQ ID NO: 995959 - DNA, 22 bp, Artificial Sequence
  chemically synthesized
gagagcatcgagcagatcatta

SEQ ID NO: 995960 - DNA, 22 bp, Artificial Sequence
  chemically synthesized
agagagcatcgagcagatcatt

SEQ ID NO: 995961 - DNA, 22 bp, Artificial Sequence
  chemically synthesized
cttaatgatctgctcgatgctc

SEQ ID NO: 995962 - DNA, 22 bp, Artificial Sequence
  chemically synthesized
aatgatctgctcgatgctctct

SEQ ID NO: 995963 - DNA, 22 bp, Artificial Sequence
  chemically synthesized
atgatctgctcgatgctctcta

SEQ ID NO: 995964 - DNA, 22 bp, Artificial Sequence
  chemically synthesized
ctcgatgctctctaaattttct

SEQ ID NO: 995965 - DNA, 22 bp, Artificial Sequence
  chemically synthesized
gatgctctctaaattttctgac

SEQ ID NO: 995966 - DNA, 22 bp, Artificial Sequence
  chemically synthesized
tctaaattttctgaccgggttc

SEQ ID NO: 995967 - DNA, 22 bp, Artificial Sequence
  chemically synthesized
taaattttctgaccgggttcac

SEQ ID NO: 995968 - DNA, 22 bp, Artificial Sequence
  chemically synthesized
aattttctgaccgggttcactt

SEQ ID NO: 995969 - DNA, 22 bp, Artificial Sequence
  chemically synthesized
tctgaccgggttcacttcaccc

SEQ ID NO: 995970 - DNA, 22 bp, Artificial Sequence
  chemically synthesized
ctgaccgggttcacttcacccc

SEQ ID NO: 995971 - DNA, 22 bp, Artificial Sequence
  chemically synthesized
aatgcacaggtaggggtgaagt

SEQ ID NO: 995972 - DNA, 22 bp, Artificial Sequence
  chemically synthesized
tgaccgggttcacttcacccct

SEQ ID NO: 995973 - DNA, 22 bp, Artificial Sequence
  chemically synthesized
accgggttcacttcacccctac

SEQ ID NO: 995974 - DNA, 22 bp, Artificial Sequence
  chemically synthesized
acttcacccctacctgtgcatt

SEQ ID NO: 995975 - DNA, 22 bp, Artificial Sequence
  chemically synthesized
cacccctacctgtgcattcagt

SEQ ID NO: 995976 - DNA, 22 bp, Artificial Sequence
  chemically synthesized
acccctacctgtgcattcagtc

SEQ ID NO: 995977 - DNA, 22 bp, Artificial Sequence
  chemically synthesized
cagggaatagagtatgactgaa

SEQ ID NO: 995978 - DNA, 22 bp, Artificial Sequence
  chemically synthesized
cctgtgcattcagtcatactct

SEQ ID NO: 995979 - DNA, 22 bp, Artificial Sequence
  chemically synthesized
gtgattccagggaatagagtat

SEQ ID NO: 995980 - DNA, 22 bp, Artificial Sequence
  chemically synthesized
tgcattcagtcatactctattc

SEQ ID NO: 995981 - DNA, 22 bp, Artificial Sequence
  chemically synthesized
ggtgattccagggaatagagta

SEQ ID NO: 995982 - DNA, 22 bp, Artificial Sequence
  chemically synthesized
agtcatactctattccctggaa

SEQ ID NO: 995983 - DNA, 22 bp, Artificial Sequence
  chemically synthesized
ggtacaggtttggtgattccag

SEQ ID NO: 995984 - DNA, 22 bp, Artificial Sequence
  chemically synthesized
ttaggtacaggtttggtgattc

SEQ ID NO: 995985 - DNA, 22 bp, Artificial Sequence
  chemically synthesized
tgttaggtacaggtttggtgat

SEQ ID NO: 995986 - DNA, 22 bp, Artificial Sequence
  chemically synthesized
tattccctggaatcaccaaacc

SEQ ID NO: 995987 - DNA, 22 bp, Artificial Sequence
  chemically synthesized
ttccctggaatcaccaaacctg

SEQ ID NO: 995988 - DNA, 22 bp, Artificial Sequence
  chemically synthesized
ctctgttaggtacaggtttggt

SEQ ID NO: 995989 - DNA, 22 bp, Artificial Sequence
  chemically synthesized
cctggaatcaccaaacctgtac

SEQ ID NO: 995990 - DNA, 22 bp, Artificial Sequence
  chemically synthesized
aattcctctgttaggtacaggt

SEQ ID NO: 995991 - DNA, 22 bp, Artificial Sequence
  chemically synthesized
gaatcaccaaacctgtacctaa

SEQ ID NO: 995992 - DNA, 22 bp, Artificial Sequence
  chemically synthesized
tacctaacagaggaattcaatg

SEQ ID NO: 995993 - DNA, 22 bp, Artificial Sequence
  chemically synthesized
tgaaatgtaaccacattgaatt

SEQ ID NO: 995994 - DNA, 22 bp, Artificial Sequence
  chemically synthesized
acagaggaattcaatgtggtta

SEQ ID NO: 995995 - DNA, 22 bp, Artificial Sequence
  chemically synthesized
acctatgaaatgtaaccacatt

SEQ ID NO: 995996 - DNA, 22 bp, Artificial Sequence
  chemically synthesized
tggactaacctatgaaatgtaa

SEQ ID NO: 995997 - DNA, 22 bp, Artificial Sequence
  chemically synthesized
gtggactaacctatgaaatgta

SEQ ID NO: 995998 - DNA, 22 bp, Artificial Sequence
  chemically synthesized
tgtggactaacctatgaaatgt

SEQ ID NO: 995999 - DNA, 22 bp, Artificial Sequence
  chemically synthesized
aatgtggttacatttcataggt

SEQ ID NO: 996000 - DNA, 22 bp, Artificial Sequence
  chemically synthesized
ttttgtggactaacctatgaaa

SEQ ID NO: 996001 - DNA, 22 bp, Artificial Sequence
  chemically synthesized
ttattttgtggactaacctatg

SEQ ID NO: 996002 - DNA, 22 bp, Artificial Sequence
  chemically synthesized
catttcataggttagtccacaa

SEQ ID NO: 996003 - DNA, 22 bp, Artificial Sequence
  chemically synthesized
taagtgaactattattttgtgg

SEQ ID NO: 996004 - DNA, 22 bp, Artificial Sequence
  chemically synthesized
cataggttagtccacaaaataa

SEQ ID NO: 996005 - DNA, 22 bp, Artificial Sequence
  chemically synthesized
ataagtgaactattattttgtg

SEQ ID NO: 996006 - DNA, 22 bp, Artificial Sequence
  chemically synthesized
ataggttagtccacaaaataat

SEQ ID NO: 996007 - DNA, 22 bp, Artificial Sequence
  chemically synthesized
gtttataagtgaactattattt

SEQ ID NO: 996008 - DNA, 22 bp, Artificial Sequence
  chemically synthesized
gtccacaaaataatagttcact

SEQ ID NO: 996009 - DNA, 22 bp, Artificial Sequence
  chemically synthesized
agctcgtttataagtgaactat

SEQ ID NO: 996010 - DNA, 22 bp, Artificial Sequence
  chemically synthesized
cagctcgtttataagtgaacta

SEQ ID NO: 996011 - DNA, 22 bp, Artificial Sequence
  chemically synthesized
tacttcagctcgtttataagtg

SEQ ID NO: 996012 - DNA, 22 bp, Artificial Sequence
  chemically synthesized
cactatacttcagctcgtttat

SEQ ID NO: 996013 - DNA, 22 bp, Artificial Sequence
  chemically synthesized
acactatacttcagctcgttta

SEQ ID NO: 996014 - DNA, 22 bp, Artificial Sequence
  chemically synthesized
tttacactatacttcagctcgt

SEQ ID NO: 996015 - DNA, 22 bp, Artificial Sequence
  chemically synthesized
acttataaacgagctgaagtat

SEQ ID NO: 996016 - DNA, 22 bp, Artificial Sequence
  chemically synthesized
ataaacgagctgaagtatagtg

SEQ ID NO: 996017 - DNA, 22 bp, Artificial Sequence
  chemically synthesized
taaacgagctgaagtatagtgt

SEQ ID NO: 996018 - DNA, 22 bp, Artificial Sequence
  chemically synthesized
aaaccagcattatttacactat

SEQ ID NO: 996019 - DNA, 22 bp, Artificial Sequence
  chemically synthesized
aagtatagtgtaaataatgctg

SEQ ID NO: 996020 - DNA, 22 bp, Artificial Sequence
  chemically synthesized
caacgtgcagagttaaaaccag

SEQ ID NO: 996021 - DNA, 22 bp, Artificial Sequence
  chemically synthesized
acaacgtgcagagttaaaacca

SEQ ID NO: 996022 - DNA, 22 bp, Artificial Sequence
  chemically synthesized
cttacaacgtgcagagttaaaa

SEQ ID NO: 996023 - DNA, 22 bp, Artificial Sequence
  chemically synthesized
aattacttacaacgtgcagagt

SEQ ID NO: 996024 - DNA, 22 bp, Artificial Sequence
  chemically synthesized
gaattacttacaacgtgcagag

SEQ ID NO: 996025 - DNA, 22 bp, Artificial Sequence
  chemically synthesized
gttttaactctgcacgttgtaa

SEQ ID NO: 996026 - DNA, 22 bp, Artificial Sequence
  chemically synthesized
agcatttgaattacttacaacg

SEQ ID NO: 996027 - DNA, 22 bp, Artificial Sequence
  chemically synthesized
taactctgcacgttgtaagtaa

SEQ ID NO: 996028 - DNA, 22 bp, Artificial Sequence
  chemically synthesized
taagcatttgaattacttacaa

SEQ ID NO: 996029 - DNA, 22 bp, Artificial Sequence
  chemically synthesized
aactctgcacgttgtaagtaat

SEQ ID NO: 996030 - DNA, 22 bp, Artificial Sequence
  chemically synthesized
actctgcacgttgtaagtaatt

SEQ ID NO: 996031 - DNA, 22 bp, Artificial Sequence
  chemically synthesized
tgcacgttgtaagtaattcaaa

SEQ ID NO: 996032 - DNA, 22 bp, Artificial Sequence
  chemically synthesized
cacgttgtaagtaattcaaatg

SEQ ID NO: 996033 - DNA, 22 bp, Artificial Sequence
  chemically synthesized
taagtaattcaaatgcttagag

SEQ ID NO: 996034 - DNA, 22 bp, Artificial Sequence
  chemically synthesized
aatgtgatacaactctaagcat

SEQ ID NO: 996035 - DNA, 22 bp, Artificial Sequence
  chemically synthesized
aaatgcttagagttgtatcaca

SEQ ID NO: 996036 - DNA, 22 bp, Artificial Sequence
  chemically synthesized
aggtaaatataccattaaatgt

SEQ ID NO: 996037 - DNA, 22 bp, Artificial Sequence
  chemically synthesized
agagttgtatcacatttaatgg

SEQ ID NO: 996038 - DNA, 22 bp, Artificial Sequence
  chemically synthesized
gagttgtatcacatttaatggt

SEQ ID NO: 996039 - DNA, 22 bp, Artificial Sequence
  chemically synthesized
tcaggtaaatataccattaaat

SEQ ID NO: 996040 - DNA, 22 bp, Artificial Sequence
  chemically synthesized
ctcaggtaaatataccattaaa

SEQ ID NO: 996041 - DNA, 22 bp, Artificial Sequence
  chemically synthesized
tctcaggtaaatataccattaa

SEQ ID NO: 996042 - DNA, 22 bp, Artificial Sequence
  chemically synthesized
tatcacatttaatggtatattt

SEQ ID NO: 996043 - DNA, 22 bp, Artificial Sequence
  chemically synthesized
cctttctcaggtaaatatacca

SEQ ID NO: 996044 - DNA, 22 bp, Artificial Sequence
  chemically synthesized
atattgcctttctcaggtaaat

SEQ ID NO: 996045 - DNA, 22 bp, Artificial Sequence
  chemically synthesized
aatattgcctttctcaggtaaa

SEQ ID NO: 996046 - DNA, 22 bp, Artificial Sequence
  chemically synthesized
aatggtatatttacctgagaaa

SEQ ID NO: 996047 - DNA, 22 bp, Artificial Sequence
  chemically synthesized
atggtatatttacctgagaaag

SEQ ID NO: 996048 - DNA, 22 bp, Artificial Sequence
  chemically synthesized
cacgtttaatattgcctttctc

SEQ ID NO: 996049 - DNA, 22 bp, Artificial Sequence
  chemically synthesized
gcacgtttaatattgcctttct

SEQ ID NO: 996050 - DNA, 22 bp, Artificial Sequence
  chemically synthesized
cttgcacgtttaatattgcctt

SEQ ID NO: 996051 - DNA, 22 bp, Artificial Sequence
  chemically synthesized
ccttgcacgtttaatattgcct

SEQ ID NO: 996052 - DNA, 22 bp, Artificial Sequence
  chemically synthesized
acctgagaaaggcaatattaaa

SEQ ID NO: 996053 - DNA, 22 bp, Artificial Sequence
  chemically synthesized
cctgagaaaggcaatattaaac

SEQ ID NO: 996054 - DNA, 22 bp, Artificial Sequence
  chemically synthesized
agaaaggcaatattaaacgtgc

SEQ ID NO: 996055 - DNA, 22 bp, Artificial Sequence
  chemically synthesized
aaggcccacatttccttgcacg

SEQ ID NO: 996056 - DNA, 22 bp, Artificial Sequence
  chemically synthesized
caaggcccacatttccttgcac

SEQ ID NO: 996057 - DNA, 22 bp, Artificial Sequence
  chemically synthesized
acttcaaggcccacatttcctt

SEQ ID NO: 996058 - DNA, 22 bp, Artificial Sequence
  chemically synthesized
gacttcaaggcccacatttcct

SEQ ID NO: 996059 - DNA, 22 bp, Artificial Sequence
  chemically synthesized
aacgtgcaaggaaatgtgggcc

SEQ ID NO: 996060 - DNA, 22 bp, Artificial Sequence
  chemically synthesized
aaagtgtacttgacttcaaggc

SEQ ID NO: 996061 - DNA, 22 bp, Artificial Sequence
  chemically synthesized
caaagtgtacttgacttcaagg

SEQ ID NO: 996062 - DNA, 22 bp, Artificial Sequence
  chemically synthesized
atttcaaagtgtacttgacttc

SEQ ID NO: 996063 - DNA, 22 bp, Artificial Sequence
  chemically synthesized
gatttcaaagtgtacttgactt

SEQ ID NO: 996064 - DNA, 22 bp, Artificial Sequence
  chemically synthesized
gaagtcaagtacactttgaaat

SEQ ID NO: 996065 - DNA, 22 bp, Artificial Sequence
  chemically synthesized
aagtcaagtacactttgaaatc

SEQ ID NO: 996066 - DNA, 22 bp, Artificial Sequence
  chemically synthesized
tgaaatcaaactgtcactctga

SEQ ID NO: 996067 - DNA, 22 bp, Artificial Sequence
  chemically synthesized
gaaatcaaactgtcactctgat

SEQ ID NO: 996068 - DNA, 22 bp, Artificial Sequence
  chemically synthesized
aaatcaaactgtcactctgatg

SEQ ID NO: 996069 - DNA, 22 bp, Artificial Sequence
  chemically synthesized
gaccaacatcacaaaggtagca

SEQ ID NO: 996070 - DNA, 22 bp, Artificial Sequence
  chemically synthesized
tcactctgatgctacctttgtg

SEQ ID NO: 996071 - DNA, 22 bp, Artificial Sequence
  chemically synthesized
agaaactggaccaacatcacaa

SEQ ID NO: 996072 - DNA, 22 bp, Artificial Sequence
  chemically synthesized
tgatgctacctttgtgatgttg

SEQ ID NO: 996073 - DNA, 22 bp, Artificial Sequence
  chemically synthesized
atgctacctttgtgatgttggt

SEQ ID NO: 996074 - DNA, 22 bp, Artificial Sequence
  chemically synthesized
cctttgtgatgttggtccagtt

SEQ ID NO: 996075 - DNA, 22 bp, Artificial Sequence
  chemically synthesized
aagaagttaagaaactggacca

SEQ ID NO: 996076 - DNA, 22 bp, Artificial Sequence
  chemically synthesized
caagaagttaagaaactggacc

SEQ ID NO: 996077 - DNA, 22 bp, Artificial Sequence
  chemically synthesized
tgtgatgttggtccagtttctt

SEQ ID NO: 996078 - DNA, 22 bp, Artificial Sequence
  chemically synthesized
gtgatgttggtccagtttctta

SEQ ID NO: 996079 - DNA, 22 bp, Artificial Sequence
  chemically synthesized
tgatgttggtccagtttcttaa

SEQ ID NO: 996080 - DNA, 22 bp, Artificial Sequence
  chemically synthesized
aggcttcaagaagttaagaaac

SEQ ID NO: 996081 - DNA, 22 bp, Artificial Sequence
  chemically synthesized
gtccagtttcttaacttcttga

SEQ ID NO: 996082 - DNA, 22 bp, Artificial Sequence
  chemically synthesized
aggaaattaaggcttcaagaag

SEQ ID NO: 996083 - DNA, 22 bp, Artificial Sequence
  chemically synthesized
cttaacttcttgaagccttaat

SEQ ID NO: 996084 - DNA, 22 bp, Artificial Sequence
  chemically synthesized
ttaacttcttgaagccttaatt

SEQ ID NO: 996085 - DNA, 22 bp, Artificial Sequence
  chemically synthesized
aacttcttgaagccttaatttc

SEQ ID NO: 996086 - DNA, 22 bp, Artificial Sequence
  chemically synthesized
acttcttgaagccttaatttcc

SEQ ID NO: 996087 - DNA, 22 bp, Artificial Sequence
  chemically synthesized
caagtcacagttgaggaaatta

SEQ ID NO: 996088 - DNA, 22 bp, Artificial Sequence
  chemically synthesized
cttgaagccttaatttcctcaa

SEQ ID NO: 996089 - DNA, 22 bp, Artificial Sequence
  chemically synthesized
ttgaagccttaatttcctcaac

SEQ ID NO: 996090 - DNA, 22 bp, Artificial Sequence
  chemically synthesized
gaagccttaatttcctcaactg

SEQ ID NO: 996091 - DNA, 22 bp, Artificial Sequence
  chemically synthesized
aagccttaatttcctcaactgt

SEQ ID NO: 996092 - DNA, 22 bp, Artificial Sequence
  chemically synthesized
aatgatcatctccaagtcacag

SEQ ID NO: 996093 - DNA, 22 bp, Artificial Sequence
  chemically synthesized
aatttcctcaactgtgacttgg

SEQ ID NO: 996094 - DNA, 22 bp, Artificial Sequence
  chemically synthesized
atttcctcaactgtgacttgga

SEQ ID NO: 996095 - DNA, 22 bp, Artificial Sequence
  chemically synthesized
cctcaactgtgacttggagatg

SEQ ID NO: 996096 - DNA, 22 bp, Artificial Sequence
  chemically synthesized
ctcaactgtgacttggagatga

SEQ ID NO: 996097 - DNA, 22 bp, Artificial Sequence
  chemically synthesized
aactgtgacttggagatgatca

SEQ ID NO: 996098 - DNA, 22 bp, Artificial Sequence
  chemically synthesized
gtgggtagtctcaatgatcatc

SEQ ID NO: 996099 - DNA, 22 bp, Artificial Sequence
  chemically synthesized
tgacttggagatgatcattgag

SEQ ID NO: 996100 - DNA, 22 bp, Artificial Sequence
  chemically synthesized
ggagatgatcattgagactacc

SEQ ID NO: 996101 - DNA, 22 bp, Artificial Sequence
  chemically synthesized
gagatgatcattgagactaccc

SEQ ID NO: 996102 - DNA, 22 bp, Artificial Sequence
  chemically synthesized
aaacaatcctggtgggtagtct

SEQ ID NO: 996103 - DNA, 22 bp, Artificial Sequence
  chemically synthesized
atcctaaaacaatcctggtggg

SEQ ID NO: 996104 - DNA, 22 bp, Artificial Sequence
  chemically synthesized
aatcctaaaacaatcctggtgg

SEQ ID NO: 996105 - DNA, 22 bp, Artificial Sequence
  chemically synthesized
taatcctaaaacaatcctggtg

SEQ ID NO: 996106 - DNA, 22 bp, Artificial Sequence
  chemically synthesized
ctttaatcctaaaacaatcctg

SEQ ID NO: 996107 - DNA, 22 bp, Artificial Sequence
  chemically synthesized
agactacccaccaggattgttt

SEQ ID NO: 996108 - DNA, 22 bp, Artificial Sequence
  chemically synthesized
tctcctttaatcctaaaacaat

SEQ ID NO: 996109 - DNA, 22 bp, Artificial Sequence
  chemically synthesized
atctcctttaatcctaaaacaa

SEQ ID NO: 996110 - DNA, 22 bp, Artificial Sequence
  chemically synthesized
cccaccaggattgttttaggat

SEQ ID NO: 996111 - DNA, 22 bp, Artificial Sequence
  chemically synthesized
aagacttatctcctttaatcct

SEQ ID NO: 996112 - DNA, 22 bp, Artificial Sequence
  chemically synthesized
tgctgaagacttatctccttta

SEQ ID NO: 996113 - DNA, 22 bp, Artificial Sequence
  chemically synthesized
ttttaggattaaaggagataag

SEQ ID NO: 996114 - DNA, 22 bp, Artificial Sequence
  chemically synthesized
taggattaaaggagataagtct

SEQ ID NO: 996115 - DNA, 22 bp, Artificial Sequence
  chemically synthesized
agtctgtgctgaagacttatct

SEQ ID NO: 996116 - DNA, 22 bp, Artificial Sequence
  chemically synthesized
aggattaaaggagataagtctt

SEQ ID NO: 996117 - DNA, 22 bp, Artificial Sequence
  chemically synthesized
ggattaaaggagataagtcttc

SEQ ID NO: 996118 - DNA, 22 bp, Artificial Sequence
  chemically synthesized
aaggagataagtcttcagcaca

SEQ ID NO: 996119 - DNA, 22 bp, Artificial Sequence
  chemically synthesized
tggaacactaagtctgtgctga

SEQ ID NO: 996120 - DNA, 22 bp, Artificial Sequence
  chemically synthesized
cagcacagacttagtgttccat

SEQ ID NO: 996121 - DNA, 22 bp, Artificial Sequence
  chemically synthesized
agcacagacttagtgttccata

SEQ ID NO: 996122 - DNA, 22 bp, Artificial Sequence
  chemically synthesized
aatataataagatgtaatgtta

SEQ ID NO: 996123 - DNA, 22 bp, Artificial Sequence
  chemically synthesized
agtgttccataacattacatct

SEQ ID NO: 996124 - DNA, 22 bp, Artificial Sequence
  chemically synthesized
gtgttccataacattacatctt

SEQ ID NO: 996125 - DNA, 22 bp, Artificial Sequence
  chemically synthesized
gaagtgctcaatataataagat

SEQ ID NO: 996126 - DNA, 22 bp, Artificial Sequence
  chemically synthesized
cataacattacatcttattata

SEQ ID NO: 996127 - DNA, 22 bp, Artificial Sequence
  chemically synthesized
actggaagtgctcaatataata

SEQ ID NO: 996128 - DNA, 22 bp, Artificial Sequence
  chemically synthesized
agactaactggaagtgctcaat

SEQ ID NO: 996129 - DNA, 22 bp, Artificial Sequence
  chemically synthesized
catcttattatattgagcactt

SEQ ID NO: 996130 - DNA, 22 bp, Artificial Sequence
  chemically synthesized
taactcagactaactggaagtg

SEQ ID NO: 996131 - DNA, 22 bp, Artificial Sequence
  chemically synthesized
attatattgagcacttccagtt

SEQ ID NO: 996132 - DNA, 22 bp, Artificial Sequence
  chemically synthesized
gtaactcagactaactggaagt

SEQ ID NO: 996133 - DNA, 22 bp, Artificial Sequence
  chemically synthesized
ttatattgagcacttccagtta

SEQ ID NO: 996134 - DNA, 22 bp, Artificial Sequence
  chemically synthesized
tattgagcacttccagttagtc

SEQ ID NO: 996135 - DNA, 22 bp, Artificial Sequence
  chemically synthesized
agcacttccagttagtctgagt

SEQ ID NO: 996136 - DNA, 22 bp, Artificial Sequence
  chemically synthesized
ccagttagtctgagttacaaat

SEQ ID NO: 996137 - DNA, 22 bp, Artificial Sequence
  chemically synthesized
cagttagtctgagttacaaatg

SEQ ID NO: 996138 - DNA, 22 bp, Artificial Sequence
  chemically synthesized
gtctgagttacaaatgatattt

SEQ ID NO: 996139 - DNA, 22 bp, Artificial Sequence
  chemically synthesized
cgatgatgtgtaaaatatcatt

SEQ ID NO: 996140 - DNA, 22 bp, Artificial Sequence
  chemically synthesized
acgatgatgtgtaaaatatcat

SEQ ID NO: 996141 - DNA, 22 bp, Artificial Sequence
  chemically synthesized
agttacaaatgatattttacac

SEQ ID NO: 996142 - DNA, 22 bp, Artificial Sequence
  chemically synthesized
gtttacgatgatgtgtaaaata

SEQ ID NO: 996143 - DNA, 22 bp, Artificial Sequence
  chemically synthesized
caaatgatattttacacatcat

SEQ ID NO: 996144 - DNA, 22 bp, Artificial Sequence
  chemically synthesized
gaccgttggtttacgatgatgt

SEQ ID NO: 996145 - DNA, 22 bp, Artificial Sequence
  chemically synthesized
ttagaccgttggtttacgatga

SEQ ID NO: 996146 - DNA, 22 bp, Artificial Sequence
  chemically synthesized
tacacatcatcgtaaaccaacg

SEQ ID NO: 996147 - DNA, 22 bp, Artificial Sequence
  chemically synthesized
acacatcatcgtaaaccaacgg

SEQ ID NO: 996148 - DNA, 22 bp, Artificial Sequence
  chemically synthesized
cacatcatcgtaaaccaacggt

SEQ ID NO: 996149 - DNA, 22 bp, Artificial Sequence
  chemically synthesized
accgtgtatcagggacgttgtt

SEQ ID NO: 996150 - DNA, 22 bp, Artificial Sequence
  chemically synthesized
gcattaaccgtgtatcagggac

SEQ ID NO: 996151 - DNA, 22 bp, Artificial Sequence
  chemically synthesized
agcattaaccgtgtatcaggga

SEQ ID NO: 996152 - DNA, 22 bp, Artificial Sequence
  chemically synthesized
acaacgtccctgatacacggtt

SEQ ID NO: 996153 - DNA, 22 bp, Artificial Sequence
  chemically synthesized
acatatttagcattaaccgtgt

SEQ ID NO: 996154 - DNA, 22 bp, Artificial Sequence
  chemically synthesized
acctcacatatttagcattaac

SEQ ID NO: 996155 - DNA, 22 bp, Artificial Sequence
  chemically synthesized
attcacctcacatatttagcat

SEQ ID NO: 996156 - DNA, 22 bp, Artificial Sequence
  chemically synthesized
atacacggttaatgctaaatat

SEQ ID NO: 996157 - DNA, 22 bp, Artificial Sequence
  chemically synthesized
aatattcattcacctcacatat

SEQ ID NO: 996158 - DNA, 22 bp, Artificial Sequence
  chemically synthesized
ttaaatattcattcacctcaca

SEQ ID NO: 996159 - DNA, 22 bp, Artificial Sequence
  chemically synthesized
gttaaatattcattcacctcac

SEQ ID NO: 996160 - DNA, 22 bp, Artificial Sequence
  chemically synthesized
atgctaaatatgtgaggtgaat

SEQ ID NO: 996161 - DNA, 22 bp, Artificial Sequence
  chemically synthesized
aatatgtgaggtgaatgaatat

SEQ ID NO: 996162 - DNA, 22 bp, Artificial Sequence
  chemically synthesized
cagtatgtgaatcaatgtactt

SEQ ID NO: 996163 - DNA, 22 bp, Artificial Sequence
  chemically synthesized
tccagtatgtgaatcaatgtac

SEQ ID NO: 996164 - DNA, 22 bp, Artificial Sequence
  chemically synthesized
aacaagtacattgattcacata

SEQ ID NO: 996165 - DNA, 22 bp, Artificial Sequence
  chemically synthesized
atccctctccagtatgtgaatc

SEQ ID NO: 996166 - DNA, 22 bp, Artificial Sequence
  chemically synthesized
acaagtacattgattcacatac

SEQ ID NO: 996167 - DNA, 22 bp, Artificial Sequence
  chemically synthesized
ttcatccctctccagtatgtga

SEQ ID NO: 996168 - DNA, 22 bp, Artificial Sequence
  chemically synthesized
atgcctattcatccctctccag

SEQ ID NO: 996169 - DNA, 22 bp, Artificial Sequence
  chemically synthesized
catgcctattcatccctctcca

SEQ ID NO: 996170 - DNA, 22 bp, Artificial Sequence
  chemically synthesized
attcacatactggagagggatg

SEQ ID NO: 996171 - DNA, 22 bp, Artificial Sequence
  chemically synthesized
tccttcatgcctattcatccct

SEQ ID NO: 996172 - DNA, 22 bp, Artificial Sequence
  chemically synthesized
acatactggagagggatgaata

SEQ ID NO: 996173 - DNA, 22 bp, Artificial Sequence
  chemically synthesized
gtgcctgtccttcatgcctatt

SEQ ID NO: 996174 - DNA, 22 bp, Artificial Sequence
  chemically synthesized
cgtgcctgtccttcatgcctat

SEQ ID NO: 996175 - DNA, 22 bp, Artificial Sequence
  chemically synthesized
gagagggatgaataggcatgaa

SEQ ID NO: 996176 - DNA, 22 bp, Artificial Sequence
  chemically synthesized
aaggccttcgtgcctgtccttc

SEQ ID NO: 996177 - DNA, 22 bp, Artificial Sequence
  chemically synthesized
acaaacattaaaggccttcgtg

SEQ ID NO: 996178 - DNA, 22 bp, Artificial Sequence
  chemically synthesized
taatgtttgtgagcctatccat

SEQ ID NO: 996179 - DNA, 22 bp, Artificial Sequence
  chemically synthesized
aatgtttgtgagcctatccatc

SEQ ID NO: 996180 - DNA, 22 bp, Artificial Sequence
  chemically synthesized
atgtttgtgagcctatccatct

SEQ ID NO: 996181 - DNA, 22 bp, Artificial Sequence
  chemically synthesized
gtgagcctatccatctatgatg

SEQ ID NO: 996182 - DNA, 22 bp, Artificial Sequence
  chemically synthesized
tgagcctatccatctatgatgt

SEQ ID NO: 996183 - DNA, 22 bp, Artificial Sequence
  chemically synthesized
tccatctatgatgttttccttt

SEQ ID NO: 996184 - DNA, 22 bp, Artificial Sequence
  chemically synthesized
tgatgttttccttttaccttcc

SEQ ID NO: 996185 - DNA, 22 bp, Artificial Sequence
  chemically synthesized
gaaggtaatgggaggaaggtaa

SEQ ID NO: 996186 - DNA, 22 bp, Artificial Sequence
  chemically synthesized
tccttttaccttcctcccatta

SEQ ID NO: 996187 - DNA, 22 bp, Artificial Sequence
  chemically synthesized
ccttttaccttcctcccattac

SEQ ID NO: 996188 - DNA, 22 bp, Artificial Sequence
  chemically synthesized
cttttaccttcctcccattacc

SEQ ID NO: 996189 - DNA, 22 bp, Artificial Sequence
  chemically synthesized
ttaccttcctcccattaccttc

SEQ ID NO: 996190 - DNA, 22 bp, Artificial Sequence
  chemically synthesized
taccttcctcccattaccttct

SEQ ID NO: 996191 - DNA, 22 bp, Artificial Sequence
  chemically synthesized
accttcctcccattaccttcta

SEQ ID NO: 996192 - DNA, 22 bp, Artificial Sequence
  chemically synthesized
tgagtagagaattagaaggtaa

SEQ ID NO: 996193 - DNA, 22 bp, Artificial Sequence
  chemically synthesized
ccttcctcccattaccttctaa

SEQ ID NO: 996194 - DNA, 22 bp, Artificial Sequence
  chemically synthesized
cctcccattaccttctaattct

SEQ ID NO: 996195 - DNA, 22 bp, Artificial Sequence
  chemically synthesized
ctcccattaccttctaattctc

SEQ ID NO: 996196 - DNA, 22 bp, Artificial Sequence
  chemically synthesized
ccattaccttctaattctctac

SEQ ID NO: 996197 - DNA, 22 bp, Artificial Sequence
  chemically synthesized
gcaaacctgtgagtagagaatt

SEQ ID NO: 996198 - DNA, 22 bp, Artificial Sequence
  chemically synthesized
agcaaacctgtgagtagagaat

SEQ ID NO: 996199 - DNA, 22 bp, Artificial Sequence
  chemically synthesized
tagcaaacctgtgagtagagaa

SEQ ID NO: 996200 - DNA, 22 bp, Artificial Sequence
  chemically synthesized
ttagcaaacctgtgagtagaga

SEQ ID NO: 996201 - DNA, 22 bp, Artificial Sequence
  chemically synthesized
ccttctaattctctactcacag

SEQ ID NO: 996202 - DNA, 22 bp, Artificial Sequence
  chemically synthesized
ctaattctctactcacaggttt

SEQ ID NO: 996203 - DNA, 22 bp, Artificial Sequence
  chemically synthesized
taattctctactcacaggtttg

SEQ ID NO: 996204 - DNA, 22 bp, Artificial Sequence
  chemically synthesized
attctctactcacaggtttgct

SEQ ID NO: 996205 - DNA, 22 bp, Artificial Sequence
  chemically synthesized
tctactcacaggtttgctaaaa

SEQ ID NO: 996206 - DNA, 22 bp, Artificial Sequence
  chemically synthesized
tactcacaggtttgctaaaaga

SEQ ID NO: 996207 - DNA, 22 bp, Artificial Sequence
  chemically synthesized
ctcacaggtttgctaaaagatc

SEQ ID NO: 996208 - DNA, 22 bp, Artificial Sequence
  chemically synthesized
acaggtttgctaaaagatctct

SEQ ID NO: 996209 - DNA, 22 bp, Artificial Sequence
  chemically synthesized
gctaaaagatctctcttccacc

SEQ ID NO: 996210 - DNA, 22 bp, Artificial Sequence
  chemically synthesized
ctaaaagatctctcttccacca

SEQ ID NO: 996211 - DNA, 22 bp, Artificial Sequence
  chemically synthesized
aaagatctctcttccaccacca

SEQ ID NO: 996212 - DNA, 22 bp, Artificial Sequence
  chemically synthesized
tggggacaaggagtggtggtgg

SEQ ID NO: 996213 - DNA, 22 bp, Artificial Sequence
  chemically synthesized
ccactgtggggacaaggagtgg

SEQ ID NO: 996214 - DNA, 22 bp, Artificial Sequence
  chemically synthesized
tcttccaccaccactccttgtc

SEQ ID NO: 996215 - DNA, 22 bp, Artificial Sequence
  chemically synthesized
ctcccactgtggggacaaggag

SEQ ID NO: 996216 - DNA, 22 bp, Artificial Sequence
  chemically synthesized
ttccaccaccactccttgtccc

SEQ ID NO: 996217 - DNA, 22 bp, Artificial Sequence
  chemically synthesized
ccaccaccactccttgtcccca

SEQ ID NO: 996218 - DNA, 22 bp, Artificial Sequence
  chemically synthesized
caccaccactccttgtccccac

SEQ ID NO: 996219 - DNA, 22 bp, Artificial Sequence
  chemically synthesized
atgctcctcccactgtggggac

SEQ ID NO: 996220 - DNA, 22 bp, Artificial Sequence
  chemically synthesized
cctcatgctcctcccactgtgg

SEQ ID NO: 996221 - DNA, 22 bp, Artificial Sequence
  chemically synthesized
ccctcatgctcctcccactgtg

SEQ ID NO: 996222 - DNA, 22 bp, Artificial Sequence
  chemically synthesized
cttgtccccacagtgggaggag

SEQ ID NO: 996223 - DNA, 22 bp, Artificial Sequence
  chemically synthesized
aatttccctcatgctcctccca

SEQ ID NO: 996224 - DNA, 22 bp, Artificial Sequence
  chemically synthesized
gaatttccctcatgctcctccc

SEQ ID NO: 996225 - DNA, 22 bp, Artificial Sequence
  chemically synthesized
gtccccacagtgggaggagcat

SEQ ID NO: 996226 - DNA, 22 bp, Artificial Sequence
  chemically synthesized
tgaatttccctcatgctcctcc

SEQ ID NO: 996227 - DNA, 22 bp, Artificial Sequence
  chemically synthesized
tccccacagtgggaggagcatg

SEQ ID NO: 996228 - DNA, 22 bp, Artificial Sequence
  chemically synthesized
ttgaatttccctcatgctcctc

SEQ ID NO: 996229 - DNA, 22 bp, Artificial Sequence
  chemically synthesized
tttttgaatttccctcatgctc

SEQ ID NO: 996230 - DNA, 22 bp, Artificial Sequence
  chemically synthesized
atttttgaatttccctcatgct

SEQ ID NO: 996231 - DNA, 22 bp, Artificial Sequence
  chemically synthesized
cataagtggtatttatttttga

SEQ ID NO: 996232 - DNA, 22 bp, Artificial Sequence
  chemically synthesized
aaaaataaataccacttatgta

SEQ ID NO: 996233 - DNA, 22 bp, Artificial Sequence
  chemically synthesized
caaccaaaaaatgctacataag

SEQ ID NO: 996234 - DNA, 22 bp, Artificial Sequence
  chemically synthesized
aaattccaaccaaaaaatgcta

SEQ ID NO: 996235 - DNA, 22 bp, Artificial Sequence
  chemically synthesized
accctaaaattccaaccaaaaa

SEQ ID NO: 996236 - DNA, 22 bp, Artificial Sequence
  chemically synthesized
atgtagcattttttggttggaa

SEQ ID NO: 996237 - DNA, 22 bp, Artificial Sequence
  chemically synthesized
tgtagcattttttggttggaat

SEQ ID NO: 996238 - DNA, 22 bp, Artificial Sequence
  chemically synthesized
aatattgaccctaaaattccaa

SEQ ID NO: 996239 - DNA, 22 bp, Artificial Sequence
  chemically synthesized
aaactaaatattgaccctaaaa

SEQ ID NO: 996240 - DNA, 22 bp, Artificial Sequence
  chemically synthesized
tttggttggaattttagggtca

SEQ ID NO: 996241 - DNA, 22 bp, Artificial Sequence
  chemically synthesized
aaaactaaatattgaccctaaa

SEQ ID NO: 996242 - DNA, 22 bp, Artificial Sequence
  chemically synthesized
ttggttggaattttagggtcaa

SEQ ID NO: 996243 - DNA, 22 bp, Artificial Sequence
  chemically synthesized
taaaactaaatattgaccctaa

SEQ ID NO: 996244 - DNA, 22 bp, Artificial Sequence
  chemically synthesized
tggttggaattttagggtcaat

SEQ ID NO: 996245 - DNA, 22 bp, Artificial Sequence
  chemically synthesized
ggttggaattttagggtcaata

SEQ ID NO: 996246 - DNA, 22 bp, Artificial Sequence
  chemically synthesized
gttggaattttagggtcaatat

SEQ ID NO: 996247 - DNA, 22 bp, Artificial Sequence
  chemically synthesized
gaattttagggtcaatatttag

SEQ ID NO: 996248 - DNA, 22 bp, Artificial Sequence
  chemically synthesized
acacattttaaaactaaatatt

SEQ ID NO: 996249 - DNA, 22 bp, Artificial Sequence
  chemically synthesized
aacacattttaaaactaaatat

SEQ ID NO: 996250 - DNA, 22 bp, Artificial Sequence
  chemically synthesized
tagggtcaatatttagttttaa

SEQ ID NO: 996251 - DNA, 22 bp, Artificial Sequence
  chemically synthesized
agggtcaatatttagttttaaa

SEQ ID NO: 996252 - DNA, 22 bp, Artificial Sequence
  chemically synthesized
gggtcaatatttagttttaaaa

SEQ ID NO: 996253 - DNA, 22 bp, Artificial Sequence
  chemically synthesized
atgaaaatgtacatttaacaca

SEQ ID NO: 996254 - DNA, 22 bp, Artificial Sequence
  chemically synthesized
aatgaaaatgtacatttaacac

SEQ ID NO: 996255 - DNA, 22 bp, Artificial Sequence
  chemically synthesized
agttttaaaatgtgttaaatgt

SEQ ID NO: 996256 - DNA, 22 bp, Artificial Sequence
  chemically synthesized
taatgaaaatgtacatttaaca

SEQ ID NO: 996257 - DNA, 22 bp, Artificial Sequence
  chemically synthesized
gttttaaaatgtgttaaatgta

SEQ ID NO: 996258 - DNA, 22 bp, Artificial Sequence
  chemically synthesized
ttaatgaaaatgtacatttaac

SEQ ID NO: 996259 - DNA, 22 bp, Artificial Sequence
  chemically synthesized
tttaatgaaaatgtacatttaa

SEQ ID NO: 996260 - DNA, 22 bp, Artificial Sequence
  chemically synthesized
tttttaatgaaaatgtacattt

SEQ ID NO: 996261 - DNA, 22 bp, Artificial Sequence
  chemically synthesized
taaaatgtgttaaatgtacatt

SEQ ID NO: 996262 - DNA, 22 bp, Artificial Sequence
  chemically synthesized
ctttttaatgaaaatgtacatt

SEQ ID NO: 996263 - DNA, 22 bp, Artificial Sequence
  chemically synthesized
aaaatgtgttaaatgtacattt

SEQ ID NO: 996264 - DNA, 22 bp, Artificial Sequence
  chemically synthesized
tctttttaatgaaaatgtacat

SEQ ID NO: 996265 - DNA, 22 bp, Artificial Sequence
  chemically synthesized
aaatgtgttaaatgtacatttt

SEQ ID NO: 996266 - DNA, 22 bp, Artificial Sequence
  chemically synthesized
ttctttttaatgaaaatgtaca

SEQ ID NO: 996267 - DNA, 22 bp, Artificial Sequence
  chemically synthesized
ttttctttttaatgaaaatgta

SEQ ID NO: 996268 - DNA, 22 bp, Artificial Sequence
  chemically synthesized
cttttctttttaatgaaaatgt

SEQ ID NO: 996269 - DNA, 22 bp, Artificial Sequence
  chemically synthesized
tcttttctttttaatgaaaatg

SEQ ID NO: 996270 - DNA, 22 bp, Artificial Sequence
  chemically synthesized
aatgtacattttcattaaaaag

SEQ ID NO: 996271 - DNA, 22 bp, Artificial Sequence
  chemically synthesized
tataaatcatgttttcttttct

SEQ ID NO: 996272 - DNA, 22 bp, Artificial Sequence
  chemically synthesized
gtataaatcatgttttcttttc

SEQ ID NO: 996273 - DNA, 22 bp, Artificial Sequence
  chemically synthesized
tcattaaaaagaaaagaaaaca

SEQ ID NO: 996274 - DNA, 22 bp, Artificial Sequence
  chemically synthesized
cattaaaaagaaaagaaaacat

SEQ ID NO: 996275 - DNA, 22 bp, Artificial Sequence
  chemically synthesized
attaaaaagaaaagaaaacatg

SEQ ID NO: 996276 - DNA, 22 bp, Artificial Sequence
  chemically synthesized
tcttgtataaatcatgttttct

SEQ ID NO: 996277 - DNA, 22 bp, Artificial Sequence
  chemically synthesized
atcttgtataaatcatgttttc

SEQ ID NO: 996278 - DNA, 22 bp, Artificial Sequence
  chemically synthesized
aaaagaaaagaaaacatgattt

SEQ ID NO: 996279 - DNA, 22 bp, Artificial Sequence
  chemically synthesized
atacaagataagcatgacttct

SEQ ID NO: 996280 - DNA, 22 bp, Artificial Sequence
  chemically synthesized
tacaagataagcatgacttctt

SEQ ID NO: 996281 - DNA, 22 bp, Artificial Sequence
  chemically synthesized
aggtcaaaaagatgcagcagtg

SEQ ID NO: 996282 - DNA, 22 bp, Artificial Sequence
  chemically synthesized
taaactaaggtcaaaaagatgc

SEQ ID NO: 996283 - DNA, 22 bp, Artificial Sequence
  chemically synthesized
cttcactgctgcatctttttga

SEQ ID NO: 996284 - DNA, 22 bp, Artificial Sequence
  chemically synthesized
tataaactaaggtcaaaaagat

SEQ ID NO: 996285 - DNA, 22 bp, Artificial Sequence
  chemically synthesized
ttcactgctgcatctttttgac

SEQ ID NO: 996286 - DNA, 22 bp, Artificial Sequence
  chemically synthesized
cactgctgcatctttttgacct

SEQ ID NO: 996287 - DNA, 22 bp, Artificial Sequence
  chemically synthesized
actgctgcatctttttgacctt

SEQ ID NO: 996288 - DNA, 22 bp, Artificial Sequence
  chemically synthesized
agattctataaactaaggtcaa

SEQ ID NO: 996289 - DNA, 22 bp, Artificial Sequence
  chemically synthesized
ctgcatctttttgaccttagtt

SEQ ID NO: 996290 - DNA, 22 bp, Artificial Sequence
  chemically synthesized
catctttttgaccttagtttat

SEQ ID NO: 996291 - DNA, 22 bp, Artificial Sequence
  chemically synthesized
cagttgagattctataaactaa

SEQ ID NO: 996292 - DNA, 22 bp, Artificial Sequence
  chemically synthesized
tttgaccttagtttatagaatc

SEQ ID NO: 996293 - DNA, 22 bp, Artificial Sequence
  chemically synthesized
ttgaccttagtttatagaatct

SEQ ID NO: 996294 - DNA, 22 bp, Artificial Sequence
  chemically synthesized
tgaccttagtttatagaatctc

SEQ ID NO: 996295 - DNA, 22 bp, Artificial Sequence
  chemically synthesized
gaccttagtttatagaatctca

SEQ ID NO: 996296 - DNA, 22 bp, Artificial Sequence
  chemically synthesized
accttagtttatagaatctcaa

SEQ ID NO: 996297 - DNA, 22 bp, Artificial Sequence
  chemically synthesized
agtttatagaatctcaactgca

SEQ ID NO: 996298 - DNA, 22 bp, Artificial Sequence
  chemically synthesized
gtttatagaatctcaactgcag

SEQ ID NO: 996299 - DNA, 22 bp, Artificial Sequence
  chemically synthesized
atagaatctcaactgcagcctg

SEQ ID NO: 996300 - DNA, 22 bp, Artificial Sequence
  chemically synthesized
tagaatctcaactgcagcctgg

SEQ ID NO: 996301 - DNA, 22 bp, Artificial Sequence
  chemically synthesized
agagatggggcaggccccaggc

SEQ ID NO: 996302 - DNA, 22 bp, Artificial Sequence
  chemically synthesized
cagagatggggcaggccccagg

SEQ ID NO: 996303 - DNA, 22 bp, Artificial Sequence
  chemically synthesized
aactgcagcctggggcctgccc

SEQ ID NO: 996304 - DNA, 22 bp, Artificial Sequence
  chemically synthesized
cagcctggggcctgccccatct

SEQ ID NO: 996305 - DNA, 22 bp, Artificial Sequence
  chemically synthesized
ggcagcacggtcttcagagatg

SEQ ID NO: 996306 - DNA, 22 bp, Artificial Sequence
  chemically synthesized
gggcagcacggtcttcagagat

SEQ ID NO: 996307 - DNA, 22 bp, Artificial Sequence
  chemically synthesized
gggcctgccccatctctgaaga

SEQ ID NO: 996308 - DNA, 22 bp, Artificial Sequence
  chemically synthesized
tgggcagcacggtcttcagaga

SEQ ID NO: 996309 - DNA, 22 bp, Artificial Sequence
  chemically synthesized
atcctttgggcagcacggtctt

SEQ ID NO: 996310 - DNA, 22 bp, Artificial Sequence
  chemically synthesized
ccccatctctgaagaccgtgct

SEQ ID NO: 996311 - DNA, 22 bp, Artificial Sequence
  chemically synthesized
atatcctcatcctttgggcagc

SEQ ID NO: 996312 - DNA, 22 bp, Artificial Sequence
  chemically synthesized
catatcctcatcctttgggcag

SEQ ID NO: 996313 - DNA, 22 bp, Artificial Sequence
  chemically synthesized
tgaagaccgtgctgcccaaagg

SEQ ID NO: 996314 - DNA, 22 bp, Artificial Sequence
  chemically synthesized
aagaccgtgctgcccaaaggat

SEQ ID NO: 996315 - DNA, 22 bp, Artificial Sequence
  chemically synthesized
acagggtacttcatatcctcat

SEQ ID NO: 996316 - DNA, 22 bp, Artificial Sequence
  chemically synthesized
aacagggtacttcatatcctca

SEQ ID NO: 996317 - DNA, 22 bp, Artificial Sequence
  chemically synthesized
taacagggtacttcatatcctc

SEQ ID NO: 996318 - DNA, 22 bp, Artificial Sequence
  chemically synthesized
cccaaaggatgaggatatgaag

SEQ ID NO: 996319 - DNA, 22 bp, Artificial Sequence
  chemically synthesized
ctttaacagggtacttcatatc

SEQ ID NO: 996320 - DNA, 22 bp, Artificial Sequence
  chemically synthesized
ttaaagtaattcattggcatga

SEQ ID NO: 996321 - DNA, 22 bp, Artificial Sequence
  chemically synthesized
aagtaattcattggcatgactg

SEQ ID NO: 996322 - DNA, 22 bp, Artificial Sequence
  chemically synthesized
atccaggacaaaccaagcagtc

SEQ ID NO: 996323 - DNA, 22 bp, Artificial Sequence
  chemically synthesized
attggcatgactgcttggtttg

SEQ ID NO: 996324 - DNA, 22 bp, Artificial Sequence
  chemically synthesized
gcatgactgcttggtttgtcct

SEQ ID NO: 996325 - DNA, 22 bp, Artificial Sequence
  chemically synthesized
agagagatgattaatccaggac

SEQ ID NO: 996326 - DNA, 22 bp, Artificial Sequence
  chemically synthesized
gagagagatgattaatccagga

SEQ ID NO: 996327 - DNA, 22 bp, Artificial Sequence
  chemically synthesized
cttggtttgtcctggattaatc

SEQ ID NO: 996328 - DNA, 22 bp, Artificial Sequence
  chemically synthesized
cttgagagagatgattaatcca

SEQ ID NO: 996329 - DNA, 22 bp, Artificial Sequence
  chemically synthesized
ggtttgtcctggattaatcatc

SEQ ID NO: 996330 - DNA, 22 bp, Artificial Sequence
  chemically synthesized
gtttgtcctggattaatcatct

SEQ ID NO: 996331 - DNA, 22 bp, Artificial Sequence
  chemically synthesized
aaatctccttgagagagatgat

SEQ ID NO: 996332 - DNA, 22 bp, Artificial Sequence
  chemically synthesized
gtcctggattaatcatctctct

SEQ ID NO: 996333 - DNA, 22 bp, Artificial Sequence
  chemically synthesized
tcctggattaatcatctctctc

SEQ ID NO: 996334 - DNA, 22 bp, Artificial Sequence
  chemically synthesized
gattaatcatctctctcaagga

SEQ ID NO: 996335 - DNA, 22 bp, Artificial Sequence
  chemically synthesized
atcatctctctcaaggagattt

SEQ ID NO: 996336 - DNA, 22 bp, Artificial Sequence
  chemically synthesized
tctcaaggagattttagcccat

SEQ ID NO: 996337 - DNA, 22 bp, Artificial Sequence
  chemically synthesized
tcaaggagattttagcccatcg

SEQ ID NO: 996338 - DNA, 22 bp, Artificial Sequence
  chemically synthesized
cacaggaatgggccgatgggct

SEQ ID NO: 996339 - DNA, 22 bp, Artificial Sequence
  chemically synthesized
aaggagattttagcccatcggc

SEQ ID NO: 996340 - DNA, 22 bp, Artificial Sequence
  chemically synthesized
gcacaggaatgggccgatgggc

SEQ ID NO: 996341 - DNA, 22 bp, Artificial Sequence
  chemically synthesized
ggcatcttgcacaggaatgggc

SEQ ID NO: 996342 - DNA, 22 bp, Artificial Sequence
  chemically synthesized
tagcccatcggcccattcctgt

SEQ ID NO: 996343 - DNA, 22 bp, Artificial Sequence
  chemically synthesized
agcccatcggcccattcctgtg

SEQ ID NO: 996344 - DNA, 22 bp, Artificial Sequence
  chemically synthesized
gcccatcggcccattcctgtgc

SEQ ID NO: 996345 - DNA, 22 bp, Artificial Sequence
  chemically synthesized
ggaatcaggttaggcatcttgc

SEQ ID NO: 996346 - DNA, 22 bp, Artificial Sequence
  chemically synthesized
ctgtgcaagatgcctaacctga

SEQ ID NO: 996347 - DNA, 22 bp, Artificial Sequence
  chemically synthesized
ggagcctaggaatcaggttagg

SEQ ID NO: 996348 - DNA, 22 bp, Artificial Sequence
  chemically synthesized
gggagcctaggaatcaggttag

SEQ ID NO: 996349 - DNA, 22 bp, Artificial Sequence
  chemically synthesized
tgcaagatgcctaacctgattc

SEQ ID NO: 996350 - DNA, 22 bp, Artificial Sequence
  chemically synthesized
gcttgggagcctaggaatcagg

SEQ ID NO: 996351 - DNA, 22 bp, Artificial Sequence
  chemically synthesized
tagcttgggagcctaggaatca

SEQ ID NO: 996352 - DNA, 22 bp, Artificial Sequence
  chemically synthesized
attctagcttgggagcctagga

SEQ ID NO: 996353 - DNA, 22 bp, Artificial Sequence
  chemically synthesized
cattctagcttgggagcctagg

SEQ ID NO: 996354 - DNA, 22 bp, Artificial Sequence
  chemically synthesized
acctgattcctaggctcccaag

SEQ ID NO: 996355 - DNA, 22 bp, Artificial Sequence
  chemically synthesized
gtatcttcattctagcttggga

SEQ ID NO: 996356 - DNA, 22 bp, Artificial Sequence
  chemically synthesized
attcctaggctcccaagctaga

SEQ ID NO: 996357 - DNA, 22 bp, Artificial Sequence
  chemically synthesized
ctaggctcccaagctagaatga

SEQ ID NO: 996358 - DNA, 22 bp, Artificial Sequence
  chemically synthesized
tagctagtatcttcattctagc

SEQ ID NO: 996359 - DNA, 22 bp, Artificial Sequence
  chemically synthesized
gtagctagtatcttcattctag

SEQ ID NO: 996360 - DNA, 22 bp, Artificial Sequence
  chemically synthesized
ggctcccaagctagaatgaaga

SEQ ID NO: 996361 - DNA, 22 bp, Artificial Sequence
  chemically synthesized
ccaagctagaatgaagatacta

SEQ ID NO: 996362 - DNA, 22 bp, Artificial Sequence
  chemically synthesized
gggaggacttgtagctagtatc

SEQ ID NO: 996363 - DNA, 22 bp, Artificial Sequence
  chemically synthesized
gaatgaagatactagctacaag

SEQ ID NO: 996364 - DNA, 22 bp, Artificial Sequence
  chemically synthesized
gcattggggaggacttgtagct

SEQ ID NO: 996365 - DNA, 22 bp, Artificial Sequence
  chemically synthesized
gtctagcattggggaggacttg

SEQ ID NO: 996366 - DNA, 22 bp, Artificial Sequence
  chemically synthesized
tatgttagtctagcattgggga

SEQ ID NO: 996367 - DNA, 22 bp, Artificial Sequence
  chemically synthesized
gctacaagtcctccccaatgct

SEQ ID NO: 996368 - DNA, 22 bp, Artificial Sequence
  chemically synthesized
caagtcctccccaatgctagac

SEQ ID NO: 996369 - DNA, 22 bp, Artificial Sequence
  chemically synthesized
cccaatgctagactaacataca

SEQ ID NO: 996370 - DNA, 22 bp, Artificial Sequence
  chemically synthesized
cagagatcaaaattgtatgtta

SEQ ID NO: 996371 - DNA, 22 bp, Artificial Sequence
  chemically synthesized
gaattccagagatcaaaattgt

SEQ ID NO: 996372 - DNA, 22 bp, Artificial Sequence
  chemically synthesized
gactaacatacaattttgatct

SEQ ID NO: 996373 - DNA, 22 bp, Artificial Sequence
  chemically synthesized
actagaattccagagatcaaaa

SEQ ID NO: 996374 - DNA, 22 bp, Artificial Sequence
  chemically synthesized
acatacaattttgatctctgga

SEQ ID NO: 996375 - DNA, 22 bp, Artificial Sequence
  chemically synthesized
gtaggatcattgactagaattc

SEQ ID NO: 996376 - DNA, 22 bp, Artificial Sequence
  chemically synthesized
tgatctctggaattctagtcaa

SEQ ID NO: 996377 - DNA, 22 bp, Artificial Sequence
  chemically synthesized
gatctctggaattctagtcaat

SEQ ID NO: 996378 - DNA, 22 bp, Artificial Sequence
  chemically synthesized
atctctggaattctagtcaatg

SEQ ID NO: 996379 - DNA, 22 bp, Artificial Sequence
  chemically synthesized
acattggtaggatcattgacta

SEQ ID NO: 996380 - DNA, 22 bp, Artificial Sequence
  chemically synthesized
tggaattctagtcaatgatcct

SEQ ID NO: 996381 - DNA, 22 bp, Artificial Sequence
  chemically synthesized
gaattctagtcaatgatcctac

SEQ ID NO: 996382 - DNA, 22 bp, Artificial Sequence
  chemically synthesized
tagtcaatgatcctaccaatgt

SEQ ID NO: 996383 - DNA, 22 bp, Artificial Sequence
  chemically synthesized
gtcaatgatcctaccaatgtga

SEQ ID NO: 996384 - DNA, 22 bp, Artificial Sequence
  chemically synthesized
ggggccatgaagaggtagagct

SEQ ID NO: 996385 - DNA, 22 bp, Artificial Sequence
  chemically synthesized
aggggccatgaagaggtagagc

SEQ ID NO: 996386 - DNA, 22 bp, Artificial Sequence
  chemically synthesized
ccaatgtgagctctacctcttc

SEQ ID NO: 996387 - DNA, 22 bp, Artificial Sequence
  chemically synthesized
tacctcttcatggcccctaaac

SEQ ID NO: 996388 - DNA, 22 bp, Artificial Sequence
  chemically synthesized
cctcttcatggcccctaaacgc

SEQ ID NO: 996389 - DNA, 22 bp, Artificial Sequence
  chemically synthesized
aaagcagatatcagcgtttagg

SEQ ID NO: 996390 - DNA, 22 bp, Artificial Sequence
  chemically synthesized
ttcatggcccctaaacgctgat

SEQ ID NO: 996391 - DNA, 22 bp, Artificial Sequence
  chemically synthesized
catggcccctaaacgctgatat

SEQ ID NO: 996392 - DNA, 22 bp, Artificial Sequence
  chemically synthesized
atggcccctaaacgctgatatc

SEQ ID NO: 996393 - DNA, 22 bp, Artificial Sequence
  chemically synthesized
tatggtaaggctgaaagcagat

SEQ ID NO: 996394 - DNA, 22 bp, Artificial Sequence
  chemically synthesized
aacgctgatatctgctttcagc

SEQ ID NO: 996395 - DNA, 22 bp, Artificial Sequence
  chemically synthesized
atatctgctttcagccttacca

SEQ ID NO: 996396 - DNA, 22 bp, Artificial Sequence
  chemically synthesized
ctttcagccttaccatataatg

SEQ ID NO: 996397 - DNA, 22 bp, Artificial Sequence
  chemically synthesized
tcagccttaccatataatgctc

SEQ ID NO: 996398 - DNA, 22 bp, Artificial Sequence
  chemically synthesized
cagccttaccatataatgctct

SEQ ID NO: 996399 - DNA, 22 bp, Artificial Sequence
  chemically synthesized
agccttaccatataatgctctt

SEQ ID NO: 996400 - DNA, 22 bp, Artificial Sequence
  chemically synthesized
aagaggaagagcataagagcat

SEQ ID NO: 996401 - DNA, 22 bp, Artificial Sequence
  chemically synthesized
caagaggaagagcataagagca

SEQ ID NO: 996402 - DNA, 22 bp, Artificial Sequence
  chemically synthesized
accatataatgctcttatgctc

SEQ ID NO: 996403 - DNA, 22 bp, Artificial Sequence
  chemically synthesized
ccatataatgctcttatgctct

SEQ ID NO: 996404 - DNA, 22 bp, Artificial Sequence
  chemically synthesized
acatgtgtttcaagaggaagag

SEQ ID NO: 996405 - DNA, 22 bp, Artificial Sequence
  chemically synthesized
aacatgtgtttcaagaggaaga

SEQ ID NO: 996406 - DNA, 22 bp, Artificial Sequence
  chemically synthesized
ttaacatgtgtttcaagaggaa

SEQ ID NO: 996407 - DNA, 22 bp, Artificial Sequence
  chemically synthesized
ttatgctcttcctcttgaaaca

SEQ ID NO: 996408 - DNA, 22 bp, Artificial Sequence
  chemically synthesized
atgctcttcctcttgaaacaca

SEQ ID NO: 996409 - DNA, 22 bp, Artificial Sequence
  chemically synthesized
tgctcttcctcttgaaacacat

SEQ ID NO: 996410 - DNA, 22 bp, Artificial Sequence
  chemically synthesized
ttcctcttgaaacacatgttaa

SEQ ID NO: 996411 - DNA, 22 bp, Artificial Sequence
  chemically synthesized
cctcttgaaacacatgttaaga

SEQ ID NO: 996412 - DNA, 22 bp, Artificial Sequence
  chemically synthesized
ctcttgaaacacatgttaagaa

SEQ ID NO: 996413 - DNA, 22 bp, Artificial Sequence
  chemically synthesized
ttgaaacacatgttaagaatga

SEQ ID NO: 996414 - DNA, 22 bp, Artificial Sequence
  chemically synthesized
gaaacacatgttaagaatgacc

SEQ ID NO: 996415 - DNA, 22 bp, Artificial Sequence
  chemically synthesized
aaacacatgttaagaatgaccc

SEQ ID NO: 996416 - DNA, 22 bp, Artificial Sequence
  chemically synthesized
caaagggaagatgggtcattct

SEQ ID NO: 996417 - DNA, 22 bp, Artificial Sequence
  chemically synthesized
ccaaagggaagatgggtcattc

SEQ ID NO: 996418 - DNA, 22 bp, Artificial Sequence
  chemically synthesized
ttccaaagggaagatgggtcat

SEQ ID NO: 996419 - DNA, 22 bp, Artificial Sequence
  chemically synthesized
aactcttccaaagggaagatgg

SEQ ID NO: 996420 - DNA, 22 bp, Artificial Sequence
  chemically synthesized
aaactcttccaaagggaagatg

SEQ ID NO: 996421 - DNA, 22 bp, Artificial Sequence
  chemically synthesized
agaatgacccatcttccctttg

SEQ ID NO: 996422 - DNA, 22 bp, Artificial Sequence
  chemically synthesized
cttaaactcttccaaagggaag

SEQ ID NO: 996423 - DNA, 22 bp, Artificial Sequence
  chemically synthesized
tgaaaactgcttaaactcttcc

SEQ ID NO: 996424 - DNA, 22 bp, Artificial Sequence
  chemically synthesized
ccctttggaagagtttaagcag

SEQ ID NO: 996425 - DNA, 22 bp, Artificial Sequence
  chemically synthesized
cctttggaagagtttaagcagt

SEQ ID NO: 996426 - DNA, 22 bp, Artificial Sequence
  chemically synthesized
aagagattatgaaaactgctta

SEQ ID NO: 996427 - DNA, 22 bp, Artificial Sequence
  chemically synthesized
aaagagattatgaaaactgctt

SEQ ID NO: 996428 - DNA, 22 bp, Artificial Sequence
  chemically synthesized
tggaagagtttaagcagttttc

SEQ ID NO: 996429 - DNA, 22 bp, Artificial Sequence
  chemically synthesized
taaagagattatgaaaactgct

SEQ ID NO: 996430 - DNA, 22 bp, Artificial Sequence
  chemically synthesized
ggaagagtttaagcagttttca

SEQ ID NO: 996431 - DNA, 22 bp, Artificial Sequence
  chemically synthesized
ttaaagagattatgaaaactgc

SEQ ID NO: 996432 - DNA, 22 bp, Artificial Sequence
  chemically synthesized
gaagagtttaagcagttttcat

SEQ ID NO: 996433 - DNA, 22 bp, Artificial Sequence
  chemically synthesized
tttaaagagattatgaaaactg

SEQ ID NO: 996434 - DNA, 22 bp, Artificial Sequence
  chemically synthesized
ttttaaagagattatgaaaact

SEQ ID NO: 996435 - DNA, 22 bp, Artificial Sequence
  chemically synthesized
aagcagttttcataatctcttt

SEQ ID NO: 996436 - DNA, 22 bp, Artificial Sequence
  chemically synthesized
agcagttttcataatctcttta

SEQ ID NO: 996437 - DNA, 22 bp, Artificial Sequence
  chemically synthesized
atgccagtcaaatttttttaaa

SEQ ID NO: 996438 - DNA, 22 bp, Artificial Sequence
  chemically synthesized
gatgccagtcaaatttttttaa

SEQ ID NO: 996439 - DNA, 22 bp, Artificial Sequence
  chemically synthesized
tcataatctctttaaaaaaatt

SEQ ID NO: 996440 - DNA, 22 bp, Artificial Sequence
  chemically synthesized
cataatctctttaaaaaaattt

SEQ ID NO: 996441 - DNA, 22 bp, Artificial Sequence
  chemically synthesized
ataatctctttaaaaaaatttg

SEQ ID NO: 996442 - DNA, 22 bp, Artificial Sequence
  chemically synthesized
atttgatgccagtcaaattttt

SEQ ID NO: 996443 - DNA, 22 bp, Artificial Sequence
  chemically synthesized
gatttgatgccagtcaaatttt

SEQ ID NO: 996444 - DNA, 22 bp, Artificial Sequence
  chemically synthesized
tttaaaaaaatttgactggcat

SEQ ID NO: 996445 - DNA, 22 bp, Artificial Sequence
  chemically synthesized
taaaaaaatttgactggcatca

SEQ ID NO: 996446 - DNA, 22 bp, Artificial Sequence
  chemically synthesized
aaaaaaatttgactggcatcaa

SEQ ID NO: 996447 - DNA, 22 bp, Artificial Sequence
  chemically synthesized
aaaaaatttgactggcatcaaa

SEQ ID NO: 996448 - DNA, 22 bp, Artificial Sequence
  chemically synthesized
gtcagagcttgatttgatgcca

SEQ ID NO: 996449 - DNA, 22 bp, Artificial Sequence
  chemically synthesized
tcattggtcagagcttgatttg

SEQ ID NO: 996450 - DNA, 22 bp, Artificial Sequence
  chemically synthesized
gactggcatcaaatcaagctct

SEQ ID NO: 996451 - DNA, 22 bp, Artificial Sequence
  chemically synthesized
actggcatcaaatcaagctctg

SEQ ID NO: 996452 - DNA, 22 bp, Artificial Sequence
  chemically synthesized
taactgtcattggtcagagctt

SEQ ID NO: 996453 - DNA, 22 bp, Artificial Sequence
  chemically synthesized
ataactgtcattggtcagagct

SEQ ID NO: 996454 - DNA, 22 bp, Artificial Sequence
  chemically synthesized
gcatcaaatcaagctctgacca

SEQ ID NO: 996455 - DNA, 22 bp, Artificial Sequence
  chemically synthesized
tataactgtcattggtcagagc

SEQ ID NO: 996456 - DNA, 22 bp, Artificial Sequence
  chemically synthesized
ttataactgtcattggtcagag

SEQ ID NO: 996457 - DNA, 22 bp, Artificial Sequence
  chemically synthesized
tttataactgtcattggtcaga

SEQ ID NO: 996458 - DNA, 22 bp, Artificial Sequence
  chemically synthesized
ttttataactgtcattggtcag

SEQ ID NO: 996459 - DNA, 22 bp, Artificial Sequence
  chemically synthesized
tttttataactgtcattggtca

SEQ ID NO: 996460 - DNA, 22 bp, Artificial Sequence
  chemically synthesized
ttttttataactgtcattggtc

SEQ ID NO: 996461 - DNA, 22 bp, Artificial Sequence
  chemically synthesized
tttttttataactgtcattggt

SEQ ID NO: 996462 - DNA, 22 bp, Artificial Sequence
  chemically synthesized
ttttttttataactgtcattgg

SEQ ID NO: 996463 - DNA, 22 bp, Artificial Sequence
  chemically synthesized
tttttttttataactgtcattg

SEQ ID NO: 996464 - DNA, 22 bp, Artificial Sequence
  chemically synthesized
ttttttttttataactgtcatt

SEQ ID NO: 996465 - DNA, 22 bp, Artificial Sequence
  chemically synthesized
tttttttttttataactgtcat

SEQ ID NO: 996466 - DNA, 22 bp, Artificial Sequence
  chemically synthesized
ttttttttttttataactgtca

SEQ ID NO: 996467 - DNA, 22 bp, Artificial Sequence
  chemically synthesized
tttttttttttttataactgtc

SEQ ID NO: 996468 - DNA, 22 bp, Artificial Sequence
  chemically synthesized
ttttttttttttttataactgt

SEQ ID NO: 996469 - DNA, 22 bp, Artificial Sequence
  chemically synthesized
tttttttttttttttataactg

SEQ ID NO: 996470 - DNA, 22 bp, Artificial Sequence
  chemically synthesized
ttttttttttttttttataact

SEQ ID NO: 996471 - DNA, 22 bp, Artificial Sequence
  chemically synthesized
tgaccaatgacagttataaaaa

SEQ ID NO: 996472 - DNA, 22 bp, Artificial Sequence
  chemically synthesized
accaatgacagttataaaaaaa

SEQ ID NO: 996473 - DNA, 22 bp, Artificial Sequence
  chemically synthesized
gtttttttttttttttttttat

SEQ ID NO: 996474 - DNA, 22 bp, Artificial Sequence
  chemically synthesized
ttggtttttttttttttttttt

SEQ ID NO: 996475 - DNA, 22 bp, Artificial Sequence
  chemically synthesized
gttggttttttttttttttttt

SEQ ID NO: 996476 - DNA, 22 bp, Artificial Sequence
  chemically synthesized
tgttggtttttttttttttttt

SEQ ID NO: 996477 - DNA, 22 bp, Artificial Sequence
  chemically synthesized
ttgttggttttttttttttttt

SEQ ID NO: 996478 - DNA, 22 bp, Artificial Sequence
  chemically synthesized
tttgttggtttttttttttttt

SEQ ID NO: 996479 - DNA, 22 bp, Artificial Sequence
  chemically synthesized
ttttgttggttttttttttttt

SEQ ID NO: 996480 - DNA, 22 bp, Artificial Sequence
  chemically synthesized
gtttttttgttggttttttttt

SEQ ID NO: 996481 - DNA, 22 bp, Artificial Sequence
  chemically synthesized
taaaaaaaaaaaaaaaaaaacc

SEQ ID NO: 996482 - DNA, 22 bp, Artificial Sequence
  chemically synthesized
agtttttttgttggtttttttt

SEQ ID NO: 996483 - DNA, 22 bp, Artificial Sequence
  chemically synthesized
agggaatttagtttttttgttg

SEQ ID NO: 996484 - DNA, 22 bp, Artificial Sequence
  chemically synthesized
tgagggaatttagtttttttgt

SEQ ID NO: 996485 - DNA, 22 bp, Artificial Sequence
  chemically synthesized
tctgagggaatttagttttttt

SEQ ID NO: 996486 - DNA, 22 bp, Artificial Sequence
  chemically synthesized
ctctgagggaatttagtttttt

SEQ ID NO: 996487 - DNA, 22 bp, Artificial Sequence
  chemically synthesized
tctctgagggaatttagttttt

SEQ ID NO: 996488 - DNA, 22 bp, Artificial Sequence
  chemically synthesized
ttttctctgagggaatttagtt

SEQ ID NO: 996489 - DNA, 22 bp, Artificial Sequence
  chemically synthesized
ctgttttctctgagggaattta

SEQ ID NO: 996490 - DNA, 22 bp, Artificial Sequence
  chemically synthesized
cctgttttctctgagggaattt

SEQ ID NO: 996491 - DNA, 22 bp, Artificial Sequence
  chemically synthesized
tcctgttttctctgagggaatt

SEQ ID NO: 996492 - DNA, 22 bp, Artificial Sequence
  chemically synthesized
ccatactttcctgttttctctg

SEQ ID NO: 996493 - DNA, 22 bp, Artificial Sequence
  chemically synthesized
ctcccatactttcctgttttct

SEQ ID NO: 996494 - DNA, 22 bp, Artificial Sequence
  chemically synthesized
aattccctcagagaaaacagga

SEQ ID NO: 996495 - DNA, 22 bp, Artificial Sequence
  chemically synthesized
cctcagagaaaacaggaaagta

SEQ ID NO: 996496 - DNA, 22 bp, Artificial Sequence
  chemically synthesized
aagttgctcccatactttcctg

SEQ ID NO: 996497 - DNA, 22 bp, Artificial Sequence
  chemically synthesized
aaagttgctcccatactttcct

SEQ ID NO: 996498 - DNA, 22 bp, Artificial Sequence
  chemically synthesized
ttaaagttgctcccatactttc

SEQ ID NO: 996499 - DNA, 22 bp, Artificial Sequence
  chemically synthesized
agagaaaacaggaaagtatggg

SEQ ID NO: 996500 - DNA, 22 bp, Artificial Sequence
  chemically synthesized
cttaaagttgctcccatacttt

SEQ ID NO: 996501 - DNA, 22 bp, Artificial Sequence
  chemically synthesized
tcttaaagttgctcccatactt

SEQ ID NO: 996502 - DNA, 22 bp, Artificial Sequence
  chemically synthesized
caagtgttttcttaaagttgct

SEQ ID NO: 996503 - DNA, 22 bp, Artificial Sequence
  chemically synthesized
ttccaagtgttttcttaaagtt

SEQ ID NO: 996504 - DNA, 22 bp, Artificial Sequence
  chemically synthesized
ttattccaagtgttttcttaaa

SEQ ID NO: 996505 - DNA, 22 bp, Artificial Sequence
  chemically synthesized
ttattattccaagtgttttctt

SEQ ID NO: 996506 - DNA, 22 bp, Artificial Sequence
  chemically synthesized
gttattattccaagtgttttct

SEQ ID NO: 996507 - DNA, 22 bp, Artificial Sequence
  chemically synthesized
taagaaaacacttggaataata

SEQ ID NO: 996508 - DNA, 22 bp, Artificial Sequence
  chemically synthesized
aagaaaacacttggaataataa

SEQ ID NO: 996509 - DNA, 22 bp, Artificial Sequence
  chemically synthesized
agtaacagtttgttattattcc

SEQ ID NO: 996510 - DNA, 22 bp, Artificial Sequence
  chemically synthesized
agaaaacacttggaataataac

SEQ ID NO: 996511 - DNA, 22 bp, Artificial Sequence
  chemically synthesized
aatattaagtaacagtttgtta

SEQ ID NO: 996512 - DNA, 22 bp, Artificial Sequence
  chemically synthesized
ggaataataacaaactgttact

SEQ ID NO: 996513 - DNA, 22 bp, Artificial Sequence
  chemically synthesized
gaataataacaaactgttactt

SEQ ID NO: 996514 - DNA, 22 bp, Artificial Sequence
  chemically synthesized
ggggaaaagataggttaaatat

SEQ ID NO: 996515 - DNA, 22 bp, Artificial Sequence
  chemically synthesized
cggggaaaagataggttaaata

SEQ ID NO: 996516 - DNA, 22 bp, Artificial Sequence
  chemically synthesized
ttacttaatatttaacctatct

SEQ ID NO: 996517 - DNA, 22 bp, Artificial Sequence
  chemically synthesized
cttaatatttaacctatctttt

SEQ ID NO: 996518 - DNA, 22 bp, Artificial Sequence
  chemically synthesized
agcccttcggggaaaagatagg

SEQ ID NO: 996519 - DNA, 22 bp, Artificial Sequence
  chemically synthesized
gagcccttcggggaaaagatag

SEQ ID NO: 996520 - DNA, 22 bp, Artificial Sequence
  chemically synthesized
aatatttaacctatcttttccc

SEQ ID NO: 996521 - DNA, 22 bp, Artificial Sequence
  chemically synthesized
atatttaacctatcttttcccc

SEQ ID NO: 996522 - DNA, 22 bp, Artificial Sequence
  chemically synthesized
aacctatcttttccccgaaggg

SEQ ID NO: 996523 - DNA, 22 bp, Artificial Sequence
  chemically synthesized
acctatcttttccccgaagggc

SEQ ID NO: 996524 - DNA, 22 bp, Artificial Sequence
  chemically synthesized
tcttttccccgaagggctcaag

SEQ ID NO: 996525 - DNA, 22 bp, Artificial Sequence
  chemically synthesized
ttccccgaagggctcaagctga

SEQ ID NO: 996526 - DNA, 22 bp, Artificial Sequence
  chemically synthesized
tccccgaagggctcaagctgat

SEQ ID NO: 996527 - DNA, 22 bp, Artificial Sequence
  chemically synthesized
ccccgaagggctcaagctgatt

SEQ ID NO: 996528 - DNA, 22 bp, Artificial Sequence
  chemically synthesized
cccgaagggctcaagctgatta

SEQ ID NO: 996529 - DNA, 22 bp, Artificial Sequence
  chemically synthesized
gccgtcaaaagcaagaaaataa

SEQ ID NO: 996530 - DNA, 22 bp, Artificial Sequence
  chemically synthesized
actagccgtcaaaagcaagaaa

SEQ ID NO: 996531 - DNA, 22 bp, Artificial Sequence
  chemically synthesized
aagctgattattttcttgcttt

SEQ ID NO: 996532 - DNA, 22 bp, Artificial Sequence
  chemically synthesized
cactagccgtcaaaagcaagaa

SEQ ID NO: 996533 - DNA, 22 bp, Artificial Sequence
  chemically synthesized
tcactagccgtcaaaagcaaga

SEQ ID NO: 996534 - DNA, 22 bp, Artificial Sequence
  chemically synthesized
ttttcactagccgtcaaaagca

SEQ ID NO: 996535 - DNA, 22 bp, Artificial Sequence
  chemically synthesized
attattttcttgcttttgacgg

SEQ ID NO: 996536 - DNA, 22 bp, Artificial Sequence
  chemically synthesized
ttttcttgcttttgacggctag

SEQ ID NO: 996537 - DNA, 22 bp, Artificial Sequence
  chemically synthesized
tcttgcttttgacggctagtga

SEQ ID NO: 996538 - DNA, 22 bp, Artificial Sequence
  chemically synthesized
cttgcttttgacggctagtgaa

SEQ ID NO: 996539 - DNA, 22 bp, Artificial Sequence
  chemically synthesized
ttgcttttgacggctagtgaaa

SEQ ID NO: 996540 - DNA, 22 bp, Artificial Sequence
  chemically synthesized
gcttttgacggctagtgaaaat

SEQ ID NO: 996541 - DNA, 22 bp, Artificial Sequence
  chemically synthesized
cttttgacggctagtgaaaata

SEQ ID NO: 996542 - DNA, 22 bp, Artificial Sequence
  chemically synthesized
ttgacggctagtgaaaataatt

SEQ ID NO: 996543 - DNA, 22 bp, Artificial Sequence
  chemically synthesized
tgacggctagtgaaaataattg

SEQ ID NO: 996544 - DNA, 22 bp, Artificial Sequence
  chemically synthesized
gacggctagtgaaaataattgg

SEQ ID NO: 996545 - DNA, 22 bp, Artificial Sequence
  chemically synthesized
acggctagtgaaaataattggt

SEQ ID NO: 996546 - DNA, 22 bp, Artificial Sequence
  chemically synthesized
gtgaaaataattggttcctctc

SEQ ID NO: 996547 - DNA, 22 bp, Artificial Sequence
  chemically synthesized
aaggaggtgacaaagaagagag

SEQ ID NO: 996548 - DNA, 22 bp, Artificial Sequence
  chemically synthesized
atagttcaaggaggtgacaaag

SEQ ID NO: 996549 - DNA, 22 bp, Artificial Sequence
  chemically synthesized
gttcctctcttctttgtcacct

SEQ ID NO: 996550 - DNA, 22 bp, Artificial Sequence
  chemically synthesized
aatagttcaaggaggtgacaaa

SEQ ID NO: 996551 - DNA, 22 bp, Artificial Sequence
  chemically synthesized
ctctcttctttgtcacctcctt

SEQ ID NO: 996552 - DNA, 22 bp, Artificial Sequence
  chemically synthesized
tcttctttgtcacctccttgaa

SEQ ID NO: 996553 - DNA, 22 bp, Artificial Sequence
  chemically synthesized
ttctttgtcacctccttgaact

SEQ ID NO: 996554 - DNA, 22 bp, Artificial Sequence
  chemically synthesized
ctttgtcacctccttgaactat

SEQ ID NO: 996555 - DNA, 22 bp, Artificial Sequence
  chemically synthesized
tttgtcacctccttgaactatt

SEQ ID NO: 996556 - DNA, 22 bp, Artificial Sequence
  chemically synthesized
tgtcacctccttgaactattaa

SEQ ID NO: 996557 - DNA, 22 bp, Artificial Sequence
  chemically synthesized
gtcacctccttgaactattaag

SEQ ID NO: 996558 - DNA, 22 bp, Artificial Sequence
  chemically synthesized
tcacctccttgaactattaagt

SEQ ID NO: 996559 - DNA, 22 bp, Artificial Sequence
  chemically synthesized
cttgaactattaagttttccct

SEQ ID NO: 996560 - DNA, 22 bp, Artificial Sequence
  chemically synthesized
gaactattaagttttcccttga

SEQ ID NO: 996561 - DNA, 22 bp, Artificial Sequence
  chemically synthesized
aactattaagttttcccttgat

SEQ ID NO: 996562 - DNA, 22 bp, Artificial Sequence
  chemically synthesized
atgcatgagaaaacatcaaggg

SEQ ID NO: 996563 - DNA, 22 bp, Artificial Sequence
  chemically synthesized
ttaagttttcccttgatgtttt

SEQ ID NO: 996564 - DNA, 22 bp, Artificial Sequence
  chemically synthesized
agttttcccttgatgttttctc

SEQ ID NO: 996565 - DNA, 22 bp, Artificial Sequence
  chemically synthesized
gcatattcatgcatgagaaaac

SEQ ID NO: 996566 - DNA, 22 bp, Artificial Sequence
  chemically synthesized
tcccttgatgttttctcatgca

SEQ ID NO: 996567 - DNA, 22 bp, Artificial Sequence
  chemically synthesized
cccttgatgttttctcatgcat

SEQ ID NO: 996568 - DNA, 22 bp, Artificial Sequence
  chemically synthesized
ccttgatgttttctcatgcatg

SEQ ID NO: 996569 - DNA, 22 bp, Artificial Sequence
  chemically synthesized
gatgttttctcatgcatgaata

SEQ ID NO: 996570 - DNA, 22 bp, Artificial Sequence
  chemically synthesized
atgttttctcatgcatgaatat

SEQ ID NO: 996571 - DNA, 22 bp, Artificial Sequence
  chemically synthesized
tgtaagtggtactggcatattc

SEQ ID NO: 996572 - DNA, 22 bp, Artificial Sequence
  chemically synthesized
tctcatgcatgaatatgccagt

SEQ ID NO: 996573 - DNA, 22 bp, Artificial Sequence
  chemically synthesized
ctcatgcatgaatatgccagta

SEQ ID NO: 996574 - DNA, 22 bp, Artificial Sequence
  chemically synthesized
tcatgcatgaatatgccagtac

SEQ ID NO: 996575 - DNA, 22 bp, Artificial Sequence
  chemically synthesized
atgcatgaatatgccagtacca

SEQ ID NO: 996576 - DNA, 22 bp, Artificial Sequence
  chemically synthesized
caagacctgtgtaagtggtact

SEQ ID NO: 996577 - DNA, 22 bp, Artificial Sequence
  chemically synthesized
acaagacctgtgtaagtggtac

SEQ ID NO: 996578 - DNA, 22 bp, Artificial Sequence
  chemically synthesized
tttacaagacctgtgtaagtgg

SEQ ID NO: 996579 - DNA, 22 bp, Artificial Sequence
  chemically synthesized
gtttacaagacctgtgtaagtg

SEQ ID NO: 996580 - DNA, 22 bp, Artificial Sequence
  chemically synthesized
aaacttgtttacaagacctgtg

SEQ ID NO: 996581 - DNA, 22 bp, Artificial Sequence
  chemically synthesized
gaaacttgtttacaagacctgt

SEQ ID NO: 996582 - DNA, 22 bp, Artificial Sequence
  chemically synthesized
tgaaacttgtttacaagacctg

SEQ ID NO: 996583 - DNA, 22 bp, Artificial Sequence
  chemically synthesized
ttgaaacttgtttacaagacct

SEQ ID NO: 996584 - DNA, 22 bp, Artificial Sequence
  chemically synthesized
atagcttttgaaacttgtttac

SEQ ID NO: 996585 - DNA, 22 bp, Artificial Sequence
  chemically synthesized
acacaggtcttgtaaacaagtt

SEQ ID NO: 996586 - DNA, 22 bp, Artificial Sequence
  chemically synthesized
cacaggtcttgtaaacaagttt

SEQ ID NO: 996587 - DNA, 22 bp, Artificial Sequence
  chemically synthesized
tgtgggtctaatagcttttgaa

SEQ ID NO: 996588 - DNA, 22 bp, Artificial Sequence
  chemically synthesized
atgtgggtctaatagcttttga

SEQ ID NO: 996589 - DNA, 22 bp, Artificial Sequence
  chemically synthesized
gtaaacaagtttcaaaagctat

SEQ ID NO: 996590 - DNA, 22 bp, Artificial Sequence
  chemically synthesized
taaacaagtttcaaaagctatt

SEQ ID NO: 996591 - DNA, 22 bp, Artificial Sequence
  chemically synthesized
tgtaatttatgtgggtctaata

SEQ ID NO: 996592 - DNA, 22 bp, Artificial Sequence
  chemically synthesized
gtgtaatttatgtgggtctaat

SEQ ID NO: 996593 - DNA, 22 bp, Artificial Sequence
  chemically synthesized
tgtgtaatttatgtgggtctaa

SEQ ID NO: 996594 - DNA, 22 bp, Artificial Sequence
  chemically synthesized
caaaagctattagacccacata

SEQ ID NO: 996595 - DNA, 22 bp, Artificial Sequence
  chemically synthesized
aaaagctattagacccacataa

SEQ ID NO: 996596 - DNA, 22 bp, Artificial Sequence
  chemically synthesized
aaacatattttgtgtaatttat

SEQ ID NO: 996597 - DNA, 22 bp, Artificial Sequence
  chemically synthesized
ttagacccacataaattacaca

SEQ ID NO: 996598 - DNA, 22 bp, Artificial Sequence
  chemically synthesized
gacccacataaattacacaaaa

SEQ ID NO: 996599 - DNA, 22 bp, Artificial Sequence
  chemically synthesized
gtagggactgaaacatattttg

SEQ ID NO: 996600 - DNA, 22 bp, Artificial Sequence
  chemically synthesized
ggtagggactgaaacatatttt

SEQ ID NO: 996601 - DNA, 22 bp, Artificial Sequence
  chemically synthesized
ggaaatttggtagggactgaaa

SEQ ID NO: 996602 - DNA, 22 bp, Artificial Sequence
  chemically synthesized
cacaaaatatgtttcagtccct

SEQ ID NO: 996603 - DNA, 22 bp, Artificial Sequence
  chemically synthesized
aggaaatttggtagggactgaa

SEQ ID NO: 996604 - DNA, 22 bp, Artificial Sequence
  chemically synthesized
taggaaatttggtagggactga

SEQ ID NO: 996605 - DNA, 22 bp, Artificial Sequence
  chemically synthesized
tggctttaggaaatttggtagg

SEQ ID NO: 996606 - DNA, 22 bp, Artificial Sequence
  chemically synthesized
cagtccctaccaaatttcctaa

SEQ ID NO: 996607 - DNA, 22 bp, Artificial Sequence
  chemically synthesized
agtccctaccaaatttcctaaa

SEQ ID NO: 996608 - DNA, 22 bp, Artificial Sequence
  chemically synthesized
ccaaatttcctaaagccatagt

SEQ ID NO: 996609 - DNA, 22 bp, Artificial Sequence
  chemically synthesized
atgtggacagacgaactatggc

SEQ ID NO: 996610 - DNA, 22 bp, Artificial Sequence
  chemically synthesized
cctaaagccatagttcgtctgt

SEQ ID NO: 996611 - DNA, 22 bp, Artificial Sequence
  chemically synthesized
ctaaagccatagttcgtctgtc

SEQ ID NO: 996612 - DNA, 22 bp, Artificial Sequence
  chemically synthesized
aagccatagttcgtctgtccac

SEQ ID NO: 996613 - DNA, 22 bp, Artificial Sequence
  chemically synthesized
gtctgtccacatcaacccactc

SEQ ID NO: 996614 - DNA, 22 bp, Artificial Sequence
  chemically synthesized
tccacatcaacccactcccttc

SEQ ID NO: 996615 - DNA, 22 bp, Artificial Sequence
  chemically synthesized
aagcagggataataaaagaagg

SEQ ID NO: 996616 - DNA, 22 bp, Artificial Sequence
  chemically synthesized
ccttcttttattatccctgctt

SEQ ID NO: 996617 - DNA, 22 bp, Artificial Sequence
  chemically synthesized
cttttattatccctgctttagc

SEQ ID NO: 996618 - DNA, 22 bp, Artificial Sequence
  chemically synthesized
agtgacaaggtagctaaagcag

SEQ ID NO: 996619 - DNA, 22 bp, Artificial Sequence
  chemically synthesized
ttttattatccctgctttagct

SEQ ID NO: 996620 - DNA, 22 bp, Artificial Sequence
  chemically synthesized
gagtgacaaggtagctaaagca

SEQ ID NO: 996621 - DNA, 22 bp, Artificial Sequence
  chemically synthesized
ttattatccctgctttagctac

SEQ ID NO: 996622 - DNA, 22 bp, Artificial Sequence
  chemically synthesized
tattatccctgctttagctacc

SEQ ID NO: 996623 - DNA, 22 bp, Artificial Sequence
  chemically synthesized
tttgagtgacaaggtagctaaa

SEQ ID NO: 996624 - DNA, 22 bp, Artificial Sequence
  chemically synthesized
attatccctgctttagctacct

SEQ ID NO: 996625 - DNA, 22 bp, Artificial Sequence
  chemically synthesized
atttgagtgacaaggtagctaa

SEQ ID NO: 996626 - DNA, 22 bp, Artificial Sequence
  chemically synthesized
ttatccctgctttagctacctt

SEQ ID NO: 996627 - DNA, 22 bp, Artificial Sequence
  chemically synthesized
tccctgctttagctaccttgtc

SEQ ID NO: 996628 - DNA, 22 bp, Artificial Sequence
  chemically synthesized
cacagtttatttgagtgacaag

SEQ ID NO: 996629 - DNA, 22 bp, Artificial Sequence
  chemically synthesized
ctttagctaccttgtcactcaa

SEQ ID NO: 996630 - DNA, 22 bp, Artificial Sequence
  chemically synthesized
tagctaccttgtcactcaaata

SEQ ID NO: 996631 - DNA, 22 bp, Artificial Sequence
  chemically synthesized
agctaccttgtcactcaaataa

SEQ ID NO: 996632 - DNA, 22 bp, Artificial Sequence
  chemically synthesized
gctaccttgtcactcaaataaa

SEQ ID NO: 996633 - DNA, 22 bp, Artificial Sequence
  chemically synthesized
ccttgtcactcaaataaactgt

SEQ ID NO: 996634 - DNA, 22 bp, Artificial Sequence
  chemically synthesized
gtcactcaaataaactgtgtaa

SEQ ID NO: 996635 - DNA, 22 bp, Artificial Sequence
  chemically synthesized
tcactcaaataaactgtgtaat

SEQ ID NO: 996636 - DNA, 22 bp, Artificial Sequence
  chemically synthesized
aaagcaggtgtgaattacacag

SEQ ID NO: 996637 - DNA, 22 bp, Artificial Sequence
  chemically synthesized
aaataaactgtgtaattcacac

SEQ ID NO: 996638 - DNA, 22 bp, Artificial Sequence
  chemically synthesized
tgtaattcacacctgctttgag

SEQ ID NO: 996639 - DNA, 22 bp, Artificial Sequence
  chemically synthesized
acacctgctttgagctgattgg

SEQ ID NO: 996640 - DNA, 22 bp, Artificial Sequence
  chemically synthesized
ctttgagctgattggttgatct

SEQ ID NO: 996641 - DNA, 22 bp, Artificial Sequence
  chemically synthesized
ggacaatcaaggacagatcaac

SEQ ID NO: 996642 - DNA, 22 bp, Artificial Sequence
  chemically synthesized
tgagctgattggttgatctgtc

SEQ ID NO: 996643 - DNA, 22 bp, Artificial Sequence
  chemically synthesized
gagctgattggttgatctgtcc

SEQ ID NO: 996644 - DNA, 22 bp, Artificial Sequence
  chemically synthesized
agctgattggttgatctgtcct

SEQ ID NO: 996645 - DNA, 22 bp, Artificial Sequence
  chemically synthesized
attggttgatctgtccttgatt

SEQ ID NO: 996646 - DNA, 22 bp, Artificial Sequence
  chemically synthesized
gttgatctgtccttgattgtcc

SEQ ID NO: 996647 - DNA, 22 bp, Artificial Sequence
  chemically synthesized
atctgtccttgattgtcccagg

SEQ ID NO: 996648 - DNA, 22 bp, Artificial Sequence
  chemically synthesized
agggagaataaatccacctggg

SEQ ID NO: 996649 - DNA, 22 bp, Artificial Sequence
  chemically synthesized
tccttgattgtcccaggtggat

SEQ ID NO: 996650 - DNA, 22 bp, Artificial Sequence
  chemically synthesized
aagggagaataaatccacctgg

SEQ ID NO: 996651 - DNA, 22 bp, Artificial Sequence
  chemically synthesized
gattgtcccaggtggatttatt

SEQ ID NO: 996652 - DNA, 22 bp, Artificial Sequence
  chemically synthesized
attgtcccaggtggatttattc

SEQ ID NO: 996653 - DNA, 22 bp, Artificial Sequence
  chemically synthesized
aagcttaagggagaataaatcc

SEQ ID NO: 996654 - DNA, 22 bp, Artificial Sequence
  chemically synthesized
tcccaggtggatttattctccc

SEQ ID NO: 996655 - DNA, 22 bp, Artificial Sequence
  chemically synthesized
cctgaagcttaagggagaataa

SEQ ID NO: 996656 - DNA, 22 bp, Artificial Sequence
  chemically synthesized
ctacctgaagcttaagggagaa

SEQ ID NO: 996657 - DNA, 22 bp, Artificial Sequence
  chemically synthesized
caggattcctacctgaagctta

SEQ ID NO: 996658 - DNA, 22 bp, Artificial Sequence
  chemically synthesized
attctcccttaagcttcaggta

SEQ ID NO: 996659 - DNA, 22 bp, Artificial Sequence
  chemically synthesized
ttctcccttaagcttcaggtag

SEQ ID NO: 996660 - DNA, 22 bp, Artificial Sequence
  chemically synthesized
tcccttaagcttcaggtaggaa

SEQ ID NO: 996661 - DNA, 22 bp, Artificial Sequence
  chemically synthesized
ccttaagcttcaggtaggaatc

SEQ ID NO: 996662 - DNA, 22 bp, Artificial Sequence
  chemically synthesized
aagcttcaggtaggaatcctgc

SEQ ID NO: 996663 - DNA, 22 bp, Artificial Sequence
  chemically synthesized
agcttcaggtaggaatcctgca

SEQ ID NO: 996664 - DNA, 22 bp, Artificial Sequence
  chemically synthesized
caggtatgaacctgcaggattc

SEQ ID NO: 996665 - DNA, 22 bp, Artificial Sequence
  chemically synthesized
tccaggtatgaacctgcaggat

SEQ ID NO: 996666 - DNA, 22 bp, Artificial Sequence
  chemically synthesized
ctccaggtatgaacctgcagga

SEQ ID NO: 996667 - DNA, 22 bp, Artificial Sequence
  chemically synthesized
caggtaggaatcctgcaggttc

SEQ ID NO: 996668 - DNA, 22 bp, Artificial Sequence
  chemically synthesized
aggtaggaatcctgcaggttca

SEQ ID NO: 996669 - DNA, 22 bp, Artificial Sequence
  chemically synthesized
cttctccaggtatgaacctgca

SEQ ID NO: 996670 - DNA, 22 bp, Artificial Sequence
  chemically synthesized
tctccttctccaggtatgaacc

SEQ ID NO: 996671 - DNA, 22 bp, Artificial Sequence
  chemically synthesized
atctccttctccaggtatgaac

SEQ ID NO: 996672 - DNA, 22 bp, Artificial Sequence
  chemically synthesized
caggttcatacctggagaagga

SEQ ID NO: 996673 - DNA, 22 bp, Artificial Sequence
  chemically synthesized
aggcataggtttatctccttct

SEQ ID NO: 996674 - DNA, 22 bp, Artificial Sequence
  chemically synthesized
aaggcataggtttatctccttc

SEQ ID NO: 996675 - DNA, 22 bp, Artificial Sequence
  chemically synthesized
atacctggagaaggagataaac

SEQ ID NO: 996676 - DNA, 22 bp, Artificial Sequence
  chemically synthesized
catttaaggcataggtttatct

SEQ ID NO: 996677 - DNA, 22 bp, Artificial Sequence
  chemically synthesized
gagaaggagataaacctatgcc

SEQ ID NO: 996678 - DNA, 22 bp, Artificial Sequence
  chemically synthesized
atgaacattgcatttaaggcat

SEQ ID NO: 996679 - DNA, 22 bp, Artificial Sequence
  chemically synthesized
tccattaatgaacattgcattt

SEQ ID NO: 996680 - DNA, 22 bp, Artificial Sequence
  chemically synthesized
atccattaatgaacattgcatt

SEQ ID NO: 996681 - DNA, 22 bp, Artificial Sequence
  chemically synthesized
tgccttaaatgcaatgttcatt

SEQ ID NO: 996682 - DNA, 22 bp, Artificial Sequence
  chemically synthesized
tgaatttatccattaatgaaca

SEQ ID NO: 996683 - DNA, 22 bp, Artificial Sequence
  chemically synthesized
aaatgcaatgttcattaatgga

SEQ ID NO: 996684 - DNA, 22 bp, Artificial Sequence
  chemically synthesized
aatgcaatgttcattaatggat

SEQ ID NO: 996685 - DNA, 22 bp, Artificial Sequence
  chemically synthesized
ccagttatgaatttatccatta

SEQ ID NO: 996686 - DNA, 22 bp, Artificial Sequence
  chemically synthesized
gtaccattgccagttatgaatt

SEQ ID NO: 996687 - DNA, 22 bp, Artificial Sequence
  chemically synthesized
attaatggataaattcataact

SEQ ID NO: 996688 - DNA, 22 bp, Artificial Sequence
  chemically synthesized
ggtaccattgccagttatgaat

SEQ ID NO: 996689 - DNA, 22 bp, Artificial Sequence
  chemically synthesized
ttggtaccattgccagttatga

SEQ ID NO: 996690 - DNA, 22 bp, Artificial Sequence
  chemically synthesized
atggataaattcataactggca

SEQ ID NO: 996691 - DNA, 22 bp, Artificial Sequence
  chemically synthesized
taactcttggtaccattgccag

SEQ ID NO: 996692 - DNA, 22 bp, Artificial Sequence
  chemically synthesized
ataactggcaatggtaccaaga

SEQ ID NO: 996693 - DNA, 22 bp, Artificial Sequence
  chemically synthesized
gcaatggtaccaagagttacag

SEQ ID NO: 996694 - DNA, 22 bp, Artificial Sequence
  chemically synthesized
atagaggaagatgctgtaactc

SEQ ID NO: 996695 - DNA, 22 bp, Artificial Sequence
  chemically synthesized
aatagaggaagatgctgtaact

SEQ ID NO: 996696 - DNA, 22 bp, Artificial Sequence
  chemically synthesized
taatagaggaagatgctgtaac

SEQ ID NO: 996697 - DNA, 22 bp, Artificial Sequence
  chemically synthesized
ttaatagaggaagatgctgtaa

SEQ ID NO: 996698 - DNA, 22 bp, Artificial Sequence
  chemically synthesized
cttttaatagaggaagatgctg

SEQ ID NO: 996699 - DNA, 22 bp, Artificial Sequence
  chemically synthesized
tgcttttaatagaggaagatgc

SEQ ID NO: 996700 - DNA, 22 bp, Artificial Sequence
  chemically synthesized
ctctgcttttaatagaggaaga

SEQ ID NO: 996701 - DNA, 22 bp, Artificial Sequence
  chemically synthesized
cagcatcttcctctattaaaag

SEQ ID NO: 996702 - DNA, 22 bp, Artificial Sequence
  chemically synthesized
cctctattaaaagcagagcagc

SEQ ID NO: 996703 - DNA, 22 bp, Artificial Sequence
  chemically synthesized
gccatcccataggctgctctgc

SEQ ID NO: 996704 - DNA, 22 bp, Artificial Sequence
  chemically synthesized
ctctattaaaagcagagcagcc

SEQ ID NO: 996705 - DNA, 22 bp, Artificial Sequence
  chemically synthesized
ggccatcccataggctgctctg

SEQ ID NO: 996706 - DNA, 22 bp, Artificial Sequence
  chemically synthesized
tattaaaagcagagcagcctat

SEQ ID NO: 996707 - DNA, 22 bp, Artificial Sequence
  chemically synthesized
ttaaaagcagagcagcctatgg

SEQ ID NO: 996708 - DNA, 22 bp, Artificial Sequence
  chemically synthesized
aaagcagagcagcctatgggat

SEQ ID NO: 996709 - DNA, 22 bp, Artificial Sequence
  chemically synthesized
aaggacttggccatcccatagg

SEQ ID NO: 996710 - DNA, 22 bp, Artificial Sequence
  chemically synthesized
caaggacttggccatcccatag

SEQ ID NO: 996711 - DNA, 22 bp, Artificial Sequence
  chemically synthesized
tcaccttcaaggacttggccat

SEQ ID NO: 996712 - DNA, 22 bp, Artificial Sequence
  chemically synthesized
tgggatggccaagtccttgaag

SEQ ID NO: 996713 - DNA, 22 bp, Artificial Sequence
  chemically synthesized
tcaaatccctgtcaccttcaag

SEQ ID NO: 996714 - DNA, 22 bp, Artificial Sequence
  chemically synthesized
gtcaaatccctgtcaccttcaa

SEQ ID NO: 996715 - DNA, 22 bp, Artificial Sequence
  chemically synthesized
tgtcaaatccctgtcaccttca

SEQ ID NO: 996716 - DNA, 22 bp, Artificial Sequence
  chemically synthesized
ttgtcaaatccctgtcaccttc

SEQ ID NO: 996717 - DNA, 22 bp, Artificial Sequence
  chemically synthesized
catttttgtcaaatccctgtca

SEQ ID NO: 996718 - DNA, 22 bp, Artificial Sequence
  chemically synthesized
gaaggtgacagggatttgacaa

SEQ ID NO: 996719 - DNA, 22 bp, Artificial Sequence
  chemically synthesized
aaggtgacagggatttgacaaa

SEQ ID NO: 996720 - DNA, 22 bp, Artificial Sequence
  chemically synthesized
ataccctccatttttgtcaaat

SEQ ID NO: 996721 - DNA, 22 bp, Artificial Sequence
  chemically synthesized
taatatagcccattcataccct

SEQ ID NO: 996722 - DNA, 22 bp, Artificial Sequence
  chemically synthesized
gacaaaaatggagggtatgaat

SEQ ID NO: 996723 - DNA, 22 bp, Artificial Sequence
  chemically synthesized
acaaaaatggagggtatgaatg

SEQ ID NO: 996724 - DNA, 22 bp, Artificial Sequence
  chemically synthesized
actataatatagcccattcata

SEQ ID NO: 996725 - DNA, 22 bp, Artificial Sequence
  chemically synthesized
aaatcattaactataatatagc

SEQ ID NO: 996726 - DNA, 22 bp, Artificial Sequence
  chemically synthesized
caaatcattaactataatatag

SEQ ID NO: 996727 - DNA, 22 bp, Artificial Sequence
  chemically synthesized
aacaatgatttcaaatcattaa

SEQ ID NO: 996728 - DNA, 22 bp, Artificial Sequence
  chemically synthesized
taaacaatgatttcaaatcatt

SEQ ID NO: 996729 - DNA, 22 bp, Artificial Sequence
  chemically synthesized
ctaaacaatgatttcaaatcat

SEQ ID NO: 996730 - DNA, 22 bp, Artificial Sequence
  chemically synthesized
tattatagttaatgatttgaaa

SEQ ID NO: 996731 - DNA, 22 bp, Artificial Sequence
  chemically synthesized
tttctaaacaatgatttcaaat

SEQ ID NO: 996732 - DNA, 22 bp, Artificial Sequence
  chemically synthesized
tagttaatgatttgaaatcatt

SEQ ID NO: 996733 - DNA, 22 bp, Artificial Sequence
  chemically synthesized
ggcaattatttctaaacaatga

SEQ ID NO: 996734 - DNA, 22 bp, Artificial Sequence
  chemically synthesized
atgatttgaaatcattgtttag

SEQ ID NO: 996735 - DNA, 22 bp, Artificial Sequence
  chemically synthesized
tctaggcaattatttctaaaca

SEQ ID NO: 996736 - DNA, 22 bp, Artificial Sequence
  chemically synthesized
gtctaggcaattatttctaaac

SEQ ID NO: 996737 - DNA, 22 bp, Artificial Sequence
  chemically synthesized
gaaatcattgtttagaaataat

SEQ ID NO: 996738 - DNA, 22 bp, Artificial Sequence
  chemically synthesized
aaatcattgtttagaaataatt

SEQ ID NO: 996739 - DNA, 22 bp, Artificial Sequence
  chemically synthesized
tcttgtctaggcaattatttct

SEQ ID NO: 996740 - DNA, 22 bp, Artificial Sequence
  chemically synthesized
atcttgtctaggcaattatttc

SEQ ID NO: 996741 - DNA, 22 bp, Artificial Sequence
  chemically synthesized
acttatcttgtctaggcaatta

SEQ ID NO: 996742 - DNA, 22 bp, Artificial Sequence
  chemically synthesized
tttagaaataattgcctagaca

SEQ ID NO: 996743 - DNA, 22 bp, Artificial Sequence
  chemically synthesized
agaaataattgcctagacaaga

SEQ ID NO: 996744 - DNA, 22 bp, Artificial Sequence
  chemically synthesized
gaaataattgcctagacaagat

SEQ ID NO: 996745 - DNA, 22 bp, Artificial Sequence
  chemically synthesized
tagagatcagttaacttatctt

SEQ ID NO: 996746 - DNA, 22 bp, Artificial Sequence
  chemically synthesized
gtagagatcagttaacttatct

SEQ ID NO: 996747 - DNA, 22 bp, Artificial Sequence
  chemically synthesized
cctagacaagataagttaactg

SEQ ID NO: 996748 - DNA, 22 bp, Artificial Sequence
  chemically synthesized
gacaagataagttaactgatct

SEQ ID NO: 996749 - DNA, 22 bp, Artificial Sequence
  chemically synthesized
actgatctctacaaacttgcat

SEQ ID NO: 996750 - DNA, 22 bp, Artificial Sequence
  chemically synthesized
atctctacaaacttgcattata

SEQ ID NO: 996751 - DNA, 22 bp, Artificial Sequence
  chemically synthesized
tacaaacttgcattatatatat

SEQ ID NO: 996752 - DNA, 22 bp, Artificial Sequence
  chemically synthesized
caaacttgcattatatatattt

SEQ ID NO: 996753 - DNA, 22 bp, Artificial Sequence
  chemically synthesized
tgcatagtgatgagaaatatat

SEQ ID NO: 996754 - DNA, 22 bp, Artificial Sequence
  chemically synthesized
gcattatatatatttctcatca

SEQ ID NO: 996755 - DNA, 22 bp, Artificial Sequence
  chemically synthesized
cattatatatatttctcatcac

SEQ ID NO: 996756 - DNA, 22 bp, Artificial Sequence
  chemically synthesized
tatatatttctcatcactatgc

SEQ ID NO: 996757 - DNA, 22 bp, Artificial Sequence
  chemically synthesized
taataaaaattatgcatagtga

SEQ ID NO: 996758 - DNA, 22 bp, Artificial Sequence
  chemically synthesized
ctcatcactatgcataattttt

SEQ ID NO: 996759 - DNA, 22 bp, Artificial Sequence
  chemically synthesized
tcatcactatgcataattttta

SEQ ID NO: 996760 - DNA, 22 bp, Artificial Sequence
  chemically synthesized
atcactatgcataatttttatt

SEQ ID NO: 996761 - DNA, 22 bp, Artificial Sequence
  chemically synthesized
aagggacaaatctataataaaa

SEQ ID NO: 996762 - DNA, 22 bp, Artificial Sequence
  chemically synthesized
tgcataatttttattatagatt

SEQ ID NO: 996763 - DNA, 22 bp, Artificial Sequence
  chemically synthesized
gacctcaagggacaaatctata

SEQ ID NO: 996764 - DNA, 22 bp, Artificial Sequence
  chemically synthesized
tggacctcaagggacaaatcta

SEQ ID NO: 996765 - DNA, 22 bp, Artificial Sequence
  chemically synthesized
ctggacctcaagggacaaatct

SEQ ID NO: 996766 - DNA, 22 bp, Artificial Sequence
  chemically synthesized
ttattatagatttgtcccttga

SEQ ID NO: 996767 - DNA, 22 bp, Artificial Sequence
  chemically synthesized
tgcttctggacctcaagggaca

SEQ ID NO: 996768 - DNA, 22 bp, Artificial Sequence
  chemically synthesized
tattatagatttgtcccttgag

SEQ ID NO: 996769 - DNA, 22 bp, Artificial Sequence
  chemically synthesized
gtgcttctggacctcaagggac

SEQ ID NO: 996770 - DNA, 22 bp, Artificial Sequence
  chemically synthesized
attatagatttgtcccttgagg

SEQ ID NO: 996771 - DNA, 22 bp, Artificial Sequence
  chemically synthesized
tgtgcttctggacctcaaggga

SEQ ID NO: 996772 - DNA, 22 bp, Artificial Sequence
  chemically synthesized
ttatagatttgtcccttgaggt

SEQ ID NO: 996773 - DNA, 22 bp, Artificial Sequence
  chemically synthesized
tagatttgtcccttgaggtcca

SEQ ID NO: 996774 - DNA, 22 bp, Artificial Sequence
  chemically synthesized
gtcccttgaggtccagaagcac

SEQ ID NO: 996775 - DNA, 22 bp, Artificial Sequence
  chemically synthesized
tgagaatgctttgtgcttctgg

SEQ ID NO: 996776 - DNA, 22 bp, Artificial Sequence
  chemically synthesized
tcccttgaggtccagaagcaca

SEQ ID NO: 996777 - DNA, 22 bp, Artificial Sequence
  chemically synthesized
gaggtccagaagcacaaagcat

SEQ ID NO: 996778 - DNA, 22 bp, Artificial Sequence
  chemically synthesized
aggtccagaagcacaaagcatt

SEQ ID NO: 996779 - DNA, 22 bp, Artificial Sequence
  chemically synthesized
ggggactatgagaatgctttgt

SEQ ID NO: 996780 - DNA, 22 bp, Artificial Sequence
  chemically synthesized
ttgggggactatgagaatgctt

SEQ ID NO: 996781 - DNA, 22 bp, Artificial Sequence
  chemically synthesized
aagaaagatgcctgttggggga

SEQ ID NO: 996782 - DNA, 22 bp, Artificial Sequence
  chemically synthesized
aaagaaagatgcctgttggggg

SEQ ID NO: 996783 - DNA, 22 bp, Artificial Sequence
  chemically synthesized
ttaaagaaagatgcctgttggg

SEQ ID NO: 996784 - DNA, 22 bp, Artificial Sequence
  chemically synthesized
tcatagtcccccaacaggcatc

SEQ ID NO: 996785 - DNA, 22 bp, Artificial Sequence
  chemically synthesized
tctcttaaagaaagatgcctgt

SEQ ID NO: 996786 - DNA, 22 bp, Artificial Sequence
  chemically synthesized
atagtcccccaacaggcatctt

SEQ ID NO: 996787 - DNA, 22 bp, Artificial Sequence
  chemically synthesized
gtctcttaaagaaagatgcctg

SEQ ID NO: 996788 - DNA, 22 bp, Artificial Sequence
  chemically synthesized
tgtctcttaaagaaagatgcct

SEQ ID NO: 996789 - DNA, 22 bp, Artificial Sequence
  chemically synthesized
ctttgtctcttaaagaaagatg

SEQ ID NO: 996790 - DNA, 22 bp, Artificial Sequence
  chemically synthesized
gctttgtctcttaaagaaagat

SEQ ID NO: 996791 - DNA, 22 bp, Artificial Sequence
  chemically synthesized
ccttgctttgtctcttaaagaa

SEQ ID NO: 996792 - DNA, 22 bp, Artificial Sequence
  chemically synthesized
ttgccttgctttgtctcttaaa

SEQ ID NO: 996793 - DNA, 22 bp, Artificial Sequence
  chemically synthesized
attgccttgctttgtctcttaa

SEQ ID NO: 996794 - DNA, 22 bp, Artificial Sequence
  chemically synthesized
tattgccttgctttgtctctta

SEQ ID NO: 996795 - DNA, 22 bp, Artificial Sequence
  chemically synthesized
ttattgccttgctttgtctctt

SEQ ID NO: 996796 - DNA, 22 bp, Artificial Sequence
  chemically synthesized
tctttaagagacaaagcaaggc

SEQ ID NO: 996797 - DNA, 22 bp, Artificial Sequence
  chemically synthesized
ctttaagagacaaagcaaggca

SEQ ID NO: 996798 - DNA, 22 bp, Artificial Sequence
  chemically synthesized
tttaagagacaaagcaaggcaa

SEQ ID NO: 996799 - DNA, 22 bp, Artificial Sequence
  chemically synthesized
taagagacaaagcaaggcaata

SEQ ID NO: 996800 - DNA, 22 bp, Artificial Sequence
  chemically synthesized
aagagacaaagcaaggcaataa

SEQ ID NO: 996801 - DNA, 22 bp, Artificial Sequence
  chemically synthesized
agagacaaagcaaggcaataaa

SEQ ID NO: 996802 - DNA, 22 bp, Artificial Sequence
  chemically synthesized
ggcgataaataaaatacccccc

SEQ ID NO: 996803 - DNA, 22 bp, Artificial Sequence
  chemically synthesized
tgaattgggcgataaataaaat

SEQ ID NO: 996804 - DNA, 22 bp, Artificial Sequence
  chemically synthesized
tatttatcgcccaattcacagc

SEQ ID NO: 996805 - DNA, 22 bp, Artificial Sequence
  chemically synthesized
atttatcgcccaattcacagca

SEQ ID NO: 996806 - DNA, 22 bp, Artificial Sequence
  chemically synthesized
tttatcgcccaattcacagcat

SEQ ID NO: 996807 - DNA, 22 bp, Artificial Sequence
  chemically synthesized
atcgcccaattcacagcatttc

SEQ ID NO: 996808 - DNA, 22 bp, Artificial Sequence
  chemically synthesized
agagtcaagacagaaatgctgt

SEQ ID NO: 996809 - DNA, 22 bp, Artificial Sequence
  chemically synthesized
tcgcccaattcacagcatttct

SEQ ID NO: 996810 - DNA, 22 bp, Artificial Sequence
  chemically synthesized
tcagagtcaagacagaaatgct

SEQ ID NO: 996811 - DNA, 22 bp, Artificial Sequence
  chemically synthesized
ctcagagtcaagacagaaatgc

SEQ ID NO: 996812 - DNA, 22 bp, Artificial Sequence
  chemically synthesized
cacttctcagagtcaagacaga

SEQ ID NO: 996813 - DNA, 22 bp, Artificial Sequence
  chemically synthesized
acacttctcagagtcaagacag

SEQ ID NO: 996814 - DNA, 22 bp, Artificial Sequence
  chemically synthesized
acagcatttctgtcttgactct

SEQ ID NO: 996815 - DNA, 22 bp, Artificial Sequence
  chemically synthesized
tgaatttacacttctcagagtc

SEQ ID NO: 996816 - DNA, 22 bp, Artificial Sequence
  chemically synthesized
ttatgaatttacacttctcaga

SEQ ID NO: 996817 - DNA, 22 bp, Artificial Sequence
  chemically synthesized
ctgtcttgactctgagaagtgt

SEQ ID NO: 996818 - DNA, 22 bp, Artificial Sequence
  chemically synthesized
tgtcttgactctgagaagtgta

SEQ ID NO: 996819 - DNA, 22 bp, Artificial Sequence
  chemically synthesized
ctgttatgaatttacacttctc

SEQ ID NO: 996820 - DNA, 22 bp, Artificial Sequence
  chemically synthesized
tcttgactctgagaagtgtaaa

SEQ ID NO: 996821 - DNA, 22 bp, Artificial Sequence
  chemically synthesized
gactctgagaagtgtaaattca

SEQ ID NO: 996822 - DNA, 22 bp, Artificial Sequence
  chemically synthesized
actctgagaagtgtaaattcat

SEQ ID NO: 996823 - DNA, 22 bp, Artificial Sequence
  chemically synthesized
gaaacctcctgttatgaattta

SEQ ID NO: 996824 - DNA, 22 bp, Artificial Sequence
  chemically synthesized
tgagaagtgtaaattcataaca

SEQ ID NO: 996825 - DNA, 22 bp, Artificial Sequence
  chemically synthesized
agaagtgtaaattcataacagg

SEQ ID NO: 996826 - DNA, 22 bp, Artificial Sequence
  chemically synthesized
tatgtatgtctagaaacctcct

SEQ ID NO: 996827 - DNA, 22 bp, Artificial Sequence
  chemically synthesized
tatatgtatgtctagaaacctc

SEQ ID NO: 996828 - DNA, 22 bp, Artificial Sequence
  chemically synthesized
ctatatgtatgtctagaaacct

SEQ ID NO: 996829 - DNA, 22 bp, Artificial Sequence
  chemically synthesized
ataacaggaggtttctagacat

SEQ ID NO: 996830 - DNA, 22 bp, Artificial Sequence
  chemically synthesized
ctagacatacatatagaaggtg

SEQ ID NO: 996831 - DNA, 22 bp, Artificial Sequence
  chemically synthesized
gatcaccagcatcaccttctat

SEQ ID NO: 996832 - DNA, 22 bp, Artificial Sequence
  chemically synthesized
tagacatacatatagaaggtga

SEQ ID NO: 996833 - DNA, 22 bp, Artificial Sequence
  chemically synthesized
ggatcaccagcatcaccttcta

SEQ ID NO: 996834 - DNA, 22 bp, Artificial Sequence
  chemically synthesized
tggatcaccagcatcaccttct

SEQ ID NO: 996835 - DNA, 22 bp, Artificial Sequence
  chemically synthesized
gacatacatatagaaggtgatg

SEQ ID NO: 996836 - DNA, 22 bp, Artificial Sequence
  chemically synthesized
ttggatcaccagcatcaccttc

SEQ ID NO: 996837 - DNA, 22 bp, Artificial Sequence
  chemically synthesized
tttggatcaccagcatcacctt

SEQ ID NO: 996838 - DNA, 22 bp, Artificial Sequence
  chemically synthesized
tcaatattttttggatcaccag

SEQ ID NO: 996839 - DNA, 22 bp, Artificial Sequence
  chemically synthesized
tcaattgtcaatattttttgga

SEQ ID NO: 996840 - DNA, 22 bp, Artificial Sequence
  chemically synthesized
atcaattgtcaatattttttgg

SEQ ID NO: 996841 - DNA, 22 bp, Artificial Sequence
  chemically synthesized
tatcaattgtcaatattttttg

SEQ ID NO: 996842 - DNA, 22 bp, Artificial Sequence
  chemically synthesized
tttatcaattgtcaatattttt

SEQ ID NO: 996843 - DNA, 22 bp, Artificial Sequence
  chemically synthesized
ctttatcaattgtcaatatttt

SEQ ID NO: 996844 - DNA, 22 bp, Artificial Sequence
  chemically synthesized
gtgatccaaaaaatattgacaa

SEQ ID NO: 996845 - DNA, 22 bp, Artificial Sequence
  chemically synthesized
agcatttctttatcaattgtca

SEQ ID NO: 996846 - DNA, 22 bp, Artificial Sequence
  chemically synthesized
cagcatttctttatcaattgtc

SEQ ID NO: 996847 - DNA, 22 bp, Artificial Sequence
  chemically synthesized
cttcagcatttctttatcaatt

SEQ ID NO: 996848 - DNA, 22 bp, Artificial Sequence
  chemically synthesized
acaattgataaagaaatgctga

SEQ ID NO: 996849 - DNA, 22 bp, Artificial Sequence
  chemically synthesized
gtaatagtgacacctccttcag

SEQ ID NO: 996850 - DNA, 22 bp, Artificial Sequence
  chemically synthesized
ataaagaaatgctgaaggaggt

SEQ ID NO: 996851 - DNA, 22 bp, Artificial Sequence
  chemically synthesized
tagtaatagtgacacctccttc

SEQ ID NO: 996852 - DNA, 22 bp, Artificial Sequence
  chemically synthesized
ctagtaatagtgacacctcctt

SEQ ID NO: 996853 - DNA, 22 bp, Artificial Sequence
  chemically synthesized
cttctagtaatagtgacacctc

SEQ ID NO: 996854 - DNA, 22 bp, Artificial Sequence
  chemically synthesized
acttctagtaatagtgacacct

SEQ ID NO: 996855 - DNA, 22 bp, Artificial Sequence
  chemically synthesized
tacttctagtaatagtgacacc

SEQ ID NO: 996856 - DNA, 22 bp, Artificial Sequence
  chemically synthesized
ttacttctagtaatagtgacac

SEQ ID NO: 996857 - DNA, 22 bp, Artificial Sequence
  chemically synthesized
aaggaggtgtcactattactag

SEQ ID NO: 996858 - DNA, 22 bp, Artificial Sequence
  chemically synthesized
aaacttttacttctagtaatag

SEQ ID NO: 996859 - DNA, 22 bp, Artificial Sequence
  chemically synthesized
ttaaaacttttacttctagtaa

SEQ ID NO: 996860 - DNA, 22 bp, Artificial Sequence
  chemically synthesized
ttgttaaaacttttacttctag

SEQ ID NO: 996861 - DNA, 22 bp, Artificial Sequence
  chemically synthesized
ttattgttaaaacttttacttc

SEQ ID NO: 996862 - DNA, 22 bp, Artificial Sequence
  chemically synthesized
ttgttattgttaaaacttttac

SEQ ID NO: 996863 - DNA, 22 bp, Artificial Sequence
  chemically synthesized
attgttattgttaaaactttta

SEQ ID NO: 996864 - DNA, 22 bp, Artificial Sequence
  chemically synthesized
ttactagaagtaaaagttttaa

SEQ ID NO: 996865 - DNA, 22 bp, Artificial Sequence
  chemically synthesized
atttattgttattgttaaaact

SEQ ID NO: 996866 - DNA, 22 bp, Artificial Sequence
  chemically synthesized
ctagaagtaaaagttttaacaa

SEQ ID NO: 996867 - DNA, 22 bp, Artificial Sequence
  chemically synthesized
gaagtaaaagttttaacaataa

SEQ ID NO: 996868 - DNA, 22 bp, Artificial Sequence
  chemically synthesized
taacaataacaataaatgaggc

SEQ ID NO: 996869 - DNA, 22 bp, Artificial Sequence
  chemically synthesized
aacaataacaataaatgaggcc

SEQ ID NO: 996870 - DNA, 22 bp, Artificial Sequence
  chemically synthesized
acaataacaataaatgaggcct

SEQ ID NO: 996871 - DNA, 22 bp, Artificial Sequence
  chemically synthesized
tggacagatggacacagaaaga

SEQ ID NO: 996872 - DNA, 22 bp, Artificial Sequence
  chemically synthesized
tttctgtgtccatctgtccaca

SEQ ID NO: 996873 - DNA, 22 bp, Artificial Sequence
  chemically synthesized
tctgtgtccatctgtccacaat

SEQ ID NO: 996874 - DNA, 22 bp, Artificial Sequence
  chemically synthesized
ctgtgtccatctgtccacaatc

SEQ ID NO: 996875 - DNA, 22 bp, Artificial Sequence
  chemically synthesized
tgtgtccatctgtccacaatcc

SEQ ID NO: 996876 - DNA, 22 bp, Artificial Sequence
  chemically synthesized
tgtccatctgtccacaatccca

SEQ ID NO: 996877 - DNA, 22 bp, Artificial Sequence
  chemically synthesized
gagaaggggtagatggcatggg

SEQ ID NO: 996878 - DNA, 22 bp, Artificial Sequence
  chemically synthesized
tagagaaggggtagatggcatg

SEQ ID NO: 996879 - DNA, 22 bp, Artificial Sequence
  chemically synthesized
tccacaatcccatgccatctac

SEQ ID NO: 996880 - DNA, 22 bp, Artificial Sequence
  chemically synthesized
catggcaactctagagaagggg

SEQ ID NO: 996881 - DNA, 22 bp, Artificial Sequence
  chemically synthesized
ccatggcaactctagagaaggg

SEQ ID NO: 996882 - DNA, 22 bp, Artificial Sequence
  chemically synthesized
ttccatggcaactctagagaag

SEQ ID NO: 996883 - DNA, 22 bp, Artificial Sequence
  chemically synthesized
tcttccatggcaactctagaga

SEQ ID NO: 996884 - DNA, 22 bp, Artificial Sequence
  chemically synthesized
ctcttccatggcaactctagag

SEQ ID NO: 996885 - DNA, 22 bp, Artificial Sequence
  chemically synthesized
tctcttccatggcaactctaga

SEQ ID NO: 996886 - DNA, 22 bp, Artificial Sequence
  chemically synthesized
ccccttctctagagttgccatg

SEQ ID NO: 996887 - DNA, 22 bp, Artificial Sequence
  chemically synthesized
ctctagagttgccatggaagag

SEQ ID NO: 996888 - DNA, 22 bp, Artificial Sequence
  chemically synthesized
tctagagttgccatggaagaga

SEQ ID NO: 996889 - DNA, 22 bp, Artificial Sequence
  chemically synthesized
tagagttgccatggaagagaaa

SEQ ID NO: 996890 - DNA, 22 bp, Artificial Sequence
  chemically synthesized
aagtagtggaactttctcttcc

SEQ ID NO: 996891 - DNA, 22 bp, Artificial Sequence
  chemically synthesized
gagttgccatggaagagaaagt

SEQ ID NO: 996892 - DNA, 22 bp, Artificial Sequence
  chemically synthesized
ccatggaagagaaagttccact

SEQ ID NO: 996893 - DNA, 22 bp, Artificial Sequence
  chemically synthesized
caaatagaaatgacgtaactga

SEQ ID NO: 996894 - DNA, 22 bp, Artificial Sequence
  chemically synthesized
ctccaaatagaaatgacgtaac

SEQ ID NO: 996895 - DNA, 22 bp, Artificial Sequence
  chemically synthesized
cctccaaatagaaatgacgtaa

SEQ ID NO: 996896 - DNA, 22 bp, Artificial Sequence
  chemically synthesized
cactacttcagttacgtcattt

SEQ ID NO: 996897 - DNA, 22 bp, Artificial Sequence
  chemically synthesized
tcctccaaatagaaatgacgta

SEQ ID NO: 996898 - DNA, 22 bp, Artificial Sequence
  chemically synthesized
cttcagttacgtcatttctatt

SEQ ID NO: 996899 - DNA, 22 bp, Artificial Sequence
  chemically synthesized
cagttacgtcatttctatttgg

SEQ ID NO: 996900 - DNA, 22 bp, Artificial Sequence
  chemically synthesized
agttacgtcatttctatttgga

SEQ ID NO: 996901 - DNA, 22 bp, Artificial Sequence
  chemically synthesized
cgtcatttctatttggaggaaa

SEQ ID NO: 996902 - DNA, 22 bp, Artificial Sequence
  chemically synthesized
gaaaaaatgacccccatctttc

SEQ ID NO: 996903 - DNA, 22 bp, Artificial Sequence
  chemically synthesized
ctatttggaggaaagatggggg

SEQ ID NO: 996904 - DNA, 22 bp, Artificial Sequence
  chemically synthesized
tatttggaggaaagatgggggt

SEQ ID NO: 996905 - DNA, 22 bp, Artificial Sequence
  chemically synthesized
tttggaggaaagatgggggtca

SEQ ID NO: 996906 - DNA, 22 bp, Artificial Sequence
  chemically synthesized
aattagaaaaaatgacccccat

SEQ ID NO: 996907 - DNA, 22 bp, Artificial Sequence
  chemically synthesized
caattagaaaaaatgaccccca

SEQ ID NO: 996908 - DNA, 22 bp, Artificial Sequence
  chemically synthesized
ggaggaaagatgggggtcattt

SEQ ID NO: 996909 - DNA, 22 bp, Artificial Sequence
  chemically synthesized
ttcaattagaaaaaatgacccc

SEQ ID NO: 996910 - DNA, 22 bp, Artificial Sequence
  chemically synthesized
gaggaaagatgggggtcatttt

SEQ ID NO: 996911 - DNA, 22 bp, Artificial Sequence
  chemically synthesized
tttctaattgaagagtgttgtg

SEQ ID NO: 996912 - DNA, 22 bp, Artificial Sequence
  chemically synthesized
ttctaattgaagagtgttgtga

SEQ ID NO: 996913 - DNA, 22 bp, Artificial Sequence
  chemically synthesized
tctaattgaagagtgttgtgac

SEQ ID NO: 996914 - DNA, 22 bp, Artificial Sequence
  chemically synthesized
ctaattgaagagtgttgtgaca

SEQ ID NO: 996915 - DNA, 22 bp, Artificial Sequence
  chemically synthesized
taattgaagagtgttgtgacat

SEQ ID NO: 996916 - DNA, 22 bp, Artificial Sequence
  chemically synthesized
attgaagagtgttgtgacattt

SEQ ID NO: 996917 - DNA, 22 bp, Artificial Sequence
  chemically synthesized
aagagtgttgtgacattttttt

SEQ ID NO: 996918 - DNA, 22 bp, Artificial Sequence
  chemically synthesized
tgacatttttttcctcgcattg

SEQ ID NO: 996919 - DNA, 22 bp, Artificial Sequence
  chemically synthesized
ttttcctcgcattgtttcattt

SEQ ID NO: 996920 - DNA, 22 bp, Artificial Sequence
  chemically synthesized
tttcctcgcattgtttcatttc

SEQ ID NO: 996921 - DNA, 22 bp, Artificial Sequence
  chemically synthesized
ttcctcgcattgtttcatttca

SEQ ID NO: 996922 - DNA, 22 bp, Artificial Sequence
  chemically synthesized
tcctcgcattgtttcatttcat

SEQ ID NO: 996923 - DNA, 22 bp, Artificial Sequence
  chemically synthesized
cctcgcattgtttcatttcatt

SEQ ID NO: 996924 - DNA, 22 bp, Artificial Sequence
  chemically synthesized
ctcgcattgtttcatttcattt

SEQ ID NO: 996925 - DNA, 22 bp, Artificial Sequence
  chemically synthesized
gcattgtttcatttcatttcga

SEQ ID NO: 996926 - DNA, 22 bp, Artificial Sequence
  chemically synthesized
tttcatttcatttcgacttatc

SEQ ID NO: 996927 - DNA, 22 bp, Artificial Sequence
  chemically synthesized
taagtgggaaaaaagataagtc

SEQ ID NO: 996928 - DNA, 22 bp, Artificial Sequence
  chemically synthesized
catttcatttcgacttatcttt

SEQ ID NO: 996929 - DNA, 22 bp, Artificial Sequence
  chemically synthesized
atttcatttcgacttatctttt

SEQ ID NO: 996930 - DNA, 22 bp, Artificial Sequence
  chemically synthesized
catttcgacttatcttttttcc

SEQ ID NO: 996931 - DNA, 22 bp, Artificial Sequence
  chemically synthesized
atttcgacttatcttttttccc

SEQ ID NO: 996932 - DNA, 22 bp, Artificial Sequence
  chemically synthesized
cgacttatcttttttcccactt

SEQ ID NO: 996933 - DNA, 22 bp, Artificial Sequence
  chemically synthesized
gacttatcttttttcccactta

SEQ ID NO: 996934 - DNA, 22 bp, Artificial Sequence
  chemically synthesized
atcttttttcccacttataatg

SEQ ID NO: 996935 - DNA, 22 bp, Artificial Sequence
  chemically synthesized
tcttttttcccacttataatgt

SEQ ID NO: 996936 - DNA, 22 bp, Artificial Sequence
  chemically synthesized
ttttcccacttataatgtgcat

SEQ ID NO: 996937 - DNA, 22 bp, Artificial Sequence
  chemically synthesized
tttcccacttataatgtgcata

SEQ ID NO: 996938 - DNA, 22 bp, Artificial Sequence
  chemically synthesized
ttcccacttataatgtgcatat

SEQ ID NO: 996939 - DNA, 22 bp, Artificial Sequence
  chemically synthesized
tcccacttataatgtgcatatt

SEQ ID NO: 996940 - DNA, 22 bp, Artificial Sequence
  chemically synthesized
atgtcaaaaaataatatgcaca

SEQ ID NO: 996941 - DNA, 22 bp, Artificial Sequence
  chemically synthesized
cccacttataatgtgcatatta

SEQ ID NO: 996942 - DNA, 22 bp, Artificial Sequence
  chemically synthesized
gatgtcaaaaaataatatgcac

SEQ ID NO: 996943 - DNA, 22 bp, Artificial Sequence
  chemically synthesized
ccacttataatgtgcatattat

SEQ ID NO: 996944 - DNA, 22 bp, Artificial Sequence
  chemically synthesized
tcttgatgtcaaaaaataatat

SEQ ID NO: 996945 - DNA, 22 bp, Artificial Sequence
  chemically synthesized
ataatgtgcatattattttttg

SEQ ID NO: 996946 - DNA, 22 bp, Artificial Sequence
  chemically synthesized
taatgtgcatattattttttga

SEQ ID NO: 996947 - DNA, 22 bp, Artificial Sequence
  chemically synthesized
tcattatcttgatgtcaaaaaa

SEQ ID NO: 996948 - DNA, 22 bp, Artificial Sequence
  chemically synthesized
ttgtcattatcttgatgtcaaa

SEQ ID NO: 996949 - DNA, 22 bp, Artificial Sequence
  chemically synthesized
attgtcattatcttgatgtcaa

SEQ ID NO: 996950 - DNA, 22 bp, Artificial Sequence
  chemically synthesized
tattgtcattatcttgatgtca

SEQ ID NO: 996951 - DNA, 22 bp, Artificial Sequence
  chemically synthesized
tttattgtcattatcttgatgt

SEQ ID NO: 996952 - DNA, 22 bp, Artificial Sequence
  chemically synthesized
ctttattgtcattatcttgatg

SEQ ID NO: 996953 - DNA, 22 bp, Artificial Sequence
  chemically synthesized
tctttattgtcattatcttgat

SEQ ID NO: 996954 - DNA, 22 bp, Artificial Sequence
  chemically synthesized
ttctttattgtcattatcttga

SEQ ID NO: 996955 - DNA, 22 bp, Artificial Sequence
  chemically synthesized
tttctttattgtcattatcttg

SEQ ID NO: 996956 - DNA, 22 bp, Artificial Sequence
  chemically synthesized
ttttttgacatcaagataatga

SEQ ID NO: 996957 - DNA, 22 bp, Artificial Sequence
  chemically synthesized
ttttctttattgtcattatctt

SEQ ID NO: 996958 - DNA, 22 bp, Artificial Sequence
  chemically synthesized
tttttctttattgtcattatct

SEQ ID NO: 996959 - DNA, 22 bp, Artificial Sequence
  chemically synthesized
tttgacatcaagataatgacaa

SEQ ID NO: 996960 - DNA, 22 bp, Artificial Sequence
  chemically synthesized
ttgacatcaagataatgacaat

SEQ ID NO: 996961 - DNA, 22 bp, Artificial Sequence
  chemically synthesized
tgacatcaagataatgacaata

SEQ ID NO: 996962 - DNA, 22 bp, Artificial Sequence
  chemically synthesized
gacatcaagataatgacaataa

SEQ ID NO: 996963 - DNA, 22 bp, Artificial Sequence
  chemically synthesized
acatcaagataatgacaataaa

SEQ ID NO: 996964 - DNA, 22 bp, Artificial Sequence
  chemically synthesized
agaagacagtgagttttttttc

SEQ ID NO: 996965 - DNA, 22 bp, Artificial Sequence
  chemically synthesized
aaattgagaagacagtgagttt

SEQ ID NO: 996966 - DNA, 22 bp, Artificial Sequence
  chemically synthesized
aaaattgagaagacagtgagtt

SEQ ID NO: 996967 - DNA, 22 bp, Artificial Sequence
  chemically synthesized
taaaattgagaagacagtgagt

SEQ ID NO: 996968 - DNA, 22 bp, Artificial Sequence
  chemically synthesized
ttaaaattgagaagacagtgag

SEQ ID NO: 996969 - DNA, 22 bp, Artificial Sequence
  chemically synthesized
ttttaaaattgagaagacagtg

SEQ ID NO: 996970 - DNA, 22 bp, Artificial Sequence
  chemically synthesized
cttttaaaattgagaagacagt

SEQ ID NO: 996971 - DNA, 22 bp, Artificial Sequence
  chemically synthesized
tcttttaaaattgagaagacag

SEQ ID NO: 996972 - DNA, 22 bp, Artificial Sequence
  chemically synthesized
ttcttttaaaattgagaagaca

SEQ ID NO: 996973 - DNA, 22 bp, Artificial Sequence
  chemically synthesized
tttcttttaaaattgagaagac

SEQ ID NO: 996974 - DNA, 22 bp, Artificial Sequence
  chemically synthesized
ttttttcttttaaaattgagaa

SEQ ID NO: 996975 - DNA, 22 bp, Artificial Sequence
  chemically synthesized
ctattttttcttttaaaattga

SEQ ID NO: 996976 - DNA, 22 bp, Artificial Sequence
  chemically synthesized
gctattttttcttttaaaattg

SEQ ID NO: 996977 - DNA, 22 bp, Artificial Sequence
  chemically synthesized
actgtcttctcaattttaaaag

SEQ ID NO: 996978 - DNA, 22 bp, Artificial Sequence
  chemically synthesized
cttgctattttttcttttaaaa

SEQ ID NO: 996979 - DNA, 22 bp, Artificial Sequence
  chemically synthesized
ccttgctattttttcttttaaa

SEQ ID NO: 996980 - DNA, 22 bp, Artificial Sequence
  chemically synthesized
tccttgctattttttcttttaa

SEQ ID NO: 996981 - DNA, 22 bp, Artificial Sequence
  chemically synthesized
tcttctcaattttaaaagaaaa

SEQ ID NO: 996982 - DNA, 22 bp, Artificial Sequence
  chemically synthesized
ttccttgctattttttctttta

SEQ ID NO: 996983 - DNA, 22 bp, Artificial Sequence
  chemically synthesized
ctcaattttaaaagaaaaaata

SEQ ID NO: 996984 - DNA, 22 bp, Artificial Sequence
  chemically synthesized
tcaattttaaaagaaaaaatag

SEQ ID NO: 996985 - DNA, 22 bp, Artificial Sequence
  chemically synthesized
aattttaaaagaaaaaatagca

SEQ ID NO: 996986 - DNA, 22 bp, Artificial Sequence
  chemically synthesized
atcatttttccttgctattttt

SEQ ID NO: 996987 - DNA, 22 bp, Artificial Sequence
  chemically synthesized
gctgatcatttttccttgctat

SEQ ID NO: 996988 - DNA, 22 bp, Artificial Sequence
  chemically synthesized
taaaagaaaaaatagcaaggaa

SEQ ID NO: 996989 - DNA, 22 bp, Artificial Sequence
  chemically synthesized
agctgatcatttttccttgcta

SEQ ID NO: 996990 - DNA, 22 bp, Artificial Sequence
  chemically synthesized
aaaagaaaaaatagcaaggaaa

SEQ ID NO: 996991 - DNA, 22 bp, Artificial Sequence
  chemically synthesized
tagctgatcatttttccttgct

SEQ ID NO: 996992 - DNA, 22 bp, Artificial Sequence
  chemically synthesized
aaagaaaaaatagcaaggaaaa

SEQ ID NO: 996993 - DNA, 22 bp, Artificial Sequence
  chemically synthesized
aatcctttagctgatcattttt

SEQ ID NO: 996994 - DNA, 22 bp, Artificial Sequence
  chemically synthesized
aaattaaatcctttagctgatc

SEQ ID NO: 996995 - DNA, 22 bp, Artificial Sequence
  chemically synthesized
tcacaacattaaaattaaatcc

SEQ ID NO: 996996 - DNA, 22 bp, Artificial Sequence
  chemically synthesized
atcacaacattaaaattaaatc

SEQ ID NO: 996997 - DNA, 22 bp, Artificial Sequence
  chemically synthesized
aaggatttaattttaatgttgt

SEQ ID NO: 996998 - DNA, 22 bp, Artificial Sequence
  chemically synthesized
gaaaaatagcttatcacaacat

SEQ ID NO: 996999 - DNA, 22 bp, Artificial Sequence
  chemically synthesized
agaaaaatagcttatcacaaca

SEQ ID NO: 997000 - DNA, 22 bp, Artificial Sequence
  chemically synthesized
aattttaatgttgtgataagct

SEQ ID NO: 997001 - DNA, 22 bp, Artificial Sequence
  chemically synthesized
attttaatgttgtgataagcta

SEQ ID NO: 997002 - DNA, 22 bp, Artificial Sequence
  chemically synthesized
taatgttgtgataagctatttt

SEQ ID NO: 997003 - DNA, 22 bp, Artificial Sequence
  chemically synthesized
aatgttgtgataagctattttt

SEQ ID NO: 997004 - DNA, 22 bp, Artificial Sequence
  chemically synthesized
atgttgtgataagctatttttc

SEQ ID NO: 997005 - DNA, 22 bp, Artificial Sequence
  chemically synthesized
tgtggaaaatcatttagaaaaa

SEQ ID NO: 997006 - DNA, 22 bp, Artificial Sequence
  chemically synthesized
tgataagctatttttctaaatg

SEQ ID NO: 997007 - DNA, 22 bp, Artificial Sequence
  chemically synthesized
tttttctaaatgattttccaca

SEQ ID NO: 997008 - DNA, 22 bp, Artificial Sequence
  chemically synthesized
aagcacagattatgtggaaaat

SEQ ID NO: 997009 - DNA, 22 bp, Artificial Sequence
  chemically synthesized
ttctaaatgattttccacataa

SEQ ID NO: 997010 - DNA, 22 bp, Artificial Sequence
  chemically synthesized
ctaaagcacagattatgtggaa

SEQ ID NO: 997011 - DNA, 22 bp, Artificial Sequence
  chemically synthesized
tctaaatgattttccacataat

SEQ ID NO: 997012 - DNA, 22 bp, Artificial Sequence
  chemically synthesized
gctaaagcacagattatgtgga

SEQ ID NO: 997013 - DNA, 22 bp, Artificial Sequence
  chemically synthesized
ctaaatgattttccacataatc

SEQ ID NO: 997014 - DNA, 22 bp, Artificial Sequence
  chemically synthesized
tgctaaagcacagattatgtgg

SEQ ID NO: 997015 - DNA, 22 bp, Artificial Sequence
  chemically synthesized
taaatgattttccacataatct

SEQ ID NO: 997016 - DNA, 22 bp, Artificial Sequence
  chemically synthesized
aatgattttccacataatctgt

SEQ ID NO: 997017 - DNA, 22 bp, Artificial Sequence
  chemically synthesized
tccacataatctgtgctttagc

SEQ ID NO: 997018 - DNA, 22 bp, Artificial Sequence
  chemically synthesized
ccacataatctgtgctttagca

SEQ ID NO: 997019 - DNA, 22 bp, Artificial Sequence
  chemically synthesized
cacataatctgtgctttagcaa

SEQ ID NO: 997020 - DNA, 22 bp, Artificial Sequence
  chemically synthesized
gaaaaaaaagagaagatctttg

SEQ ID NO: 997021 - DNA, 22 bp, Artificial Sequence
  chemically synthesized
tgctttagcaaagatcttctct

SEQ ID NO: 997022 - DNA, 22 bp, Artificial Sequence
  chemically synthesized
tagcaaagatcttctctttttt

SEQ ID NO: 997023 - DNA, 22 bp, Artificial Sequence
  chemically synthesized
agcaaagatcttctcttttttt

SEQ ID NO: 997024 - DNA, 22 bp, Artificial Sequence
  chemically synthesized
gcaaagatcttctctttttttt

SEQ ID NO: 997025 - DNA, 22 bp, Artificial Sequence
  chemically synthesized
agatggaaactagaaaaaaaag

SEQ ID NO: 997026 - DNA, 22 bp, Artificial Sequence
  chemically synthesized
atctcagatggaaactagaaaa

SEQ ID NO: 997027 - DNA, 22 bp, Artificial Sequence
  chemically synthesized
tctaatctcagatggaaactag

SEQ ID NO: 997028 - DNA, 22 bp, Artificial Sequence
  chemically synthesized
ctcttttttttctagtttccat

SEQ ID NO: 997029 - DNA, 22 bp, Artificial Sequence
  chemically synthesized
tcttttttttctagtttccatc

SEQ ID NO: 997030 - DNA, 22 bp, Artificial Sequence
  chemically synthesized
ttttttttctagtttccatctg

SEQ ID NO: 997031 - DNA, 22 bp, Artificial Sequence
  chemically synthesized
ttttttctagtttccatctgag

SEQ ID NO: 997032 - DNA, 22 bp, Artificial Sequence
  chemically synthesized
tttttctagtttccatctgaga

SEQ ID NO: 997033 - DNA, 22 bp, Artificial Sequence
  chemically synthesized
ttttctagtttccatctgagat

SEQ ID NO: 997034 - DNA, 22 bp, Artificial Sequence
  chemically synthesized
tttctagtttccatctgagatt

SEQ ID NO: 997035 - DNA, 22 bp, Artificial Sequence
  chemically synthesized
ttctagtttccatctgagatta

SEQ ID NO: 997036 - DNA, 22 bp, Artificial Sequence
  chemically synthesized
tctagtttccatctgagattag

SEQ ID NO: 997037 - DNA, 22 bp, Artificial Sequence
  chemically synthesized
ctagtttccatctgagattaga

SEQ ID NO: 997038 - DNA, 22 bp, Artificial Sequence
  chemically synthesized
tagtttccatctgagattagat

SEQ ID NO: 997039 - DNA, 22 bp, Artificial Sequence
  chemically synthesized
gtttccatctgagattagataa

SEQ ID NO: 997040 - DNA, 22 bp, Artificial Sequence
  chemically synthesized
ccatctgagattagataatggg

SEQ ID NO: 997041 - DNA, 22 bp, Artificial Sequence
  chemically synthesized
catctgagattagataatgggc

SEQ ID NO: 997042 - DNA, 22 bp, Artificial Sequence
  chemically synthesized
agattagataatgggctgtatc

SEQ ID NO: 997043 - DNA, 22 bp, Artificial Sequence
  chemically synthesized
cagcatgcacataatgggatac

SEQ ID NO: 997044 - DNA, 22 bp, Artificial Sequence
  chemically synthesized
gataatgggctgtatcccatta

SEQ ID NO: 997045 - DNA, 22 bp, Artificial Sequence
  chemically synthesized
tatcccattatgtgcatgctgt

SEQ ID NO: 997046 - DNA, 22 bp, Artificial Sequence
  chemically synthesized
tgtgcatgctgtaactccacca

SEQ ID NO: 997047 - DNA, 22 bp, Artificial Sequence
  chemically synthesized
taactccaccacacctgttact

SEQ ID NO: 997048 - DNA, 22 bp, Artificial Sequence
  chemically synthesized
caccacacctgttacttttgac

SEQ ID NO: 997049 - DNA, 22 bp, Artificial Sequence
  chemically synthesized
agaaatataaaaatatgtcaaa

SEQ ID NO: 997050 - DNA, 22 bp, Artificial Sequence
  chemically synthesized
ttgagaaatataaaaatatgtc

SEQ ID NO: 997051 - DNA, 22 bp, Artificial Sequence
  chemically synthesized
ttacttttgacatatttttata

SEQ ID NO: 997052 - DNA, 22 bp, Artificial Sequence
  chemically synthesized
attattgagaaatataaaaata

SEQ ID NO: 997053 - DNA, 22 bp, Artificial Sequence
  chemically synthesized
aattattgagaaatataaaaat

SEQ ID NO: 997054 - DNA, 22 bp, Artificial Sequence
  chemically synthesized
taattattgagaaatataaaaa

SEQ ID NO: 997055 - DNA, 22 bp, Artificial Sequence
  chemically synthesized
cttttgacatatttttatattt

SEQ ID NO: 997056 - DNA, 22 bp, Artificial Sequence
  chemically synthesized
ttaattattgagaaatataaaa

SEQ ID NO: 997057 - DNA, 22 bp, Artificial Sequence
  chemically synthesized
tttaattattgagaaatataaa

SEQ ID NO: 997058 - DNA, 22 bp, Artificial Sequence
  chemically synthesized
ttttaattattgagaaatataa

SEQ ID NO: 997059 - DNA, 22 bp, Artificial Sequence
  chemically synthesized
ttgacatatttttatatttctc

SEQ ID NO: 997060 - DNA, 22 bp, Artificial Sequence
  chemically synthesized
tgacatatttttatatttctca

SEQ ID NO: 997061 - DNA, 22 bp, Artificial Sequence
  chemically synthesized
ttttttaattattgagaaatat

SEQ ID NO: 997062 - DNA, 22 bp, Artificial Sequence
  chemically synthesized
gacatatttttatatttctcaa

SEQ ID NO: 997063 - DNA, 22 bp, Artificial Sequence
  chemically synthesized
cttttttaattattgagaaata

SEQ ID NO: 997064 - DNA, 22 bp, Artificial Sequence
  chemically synthesized
acatatttttatatttctcaat

SEQ ID NO: 997065 - DNA, 22 bp, Artificial Sequence
  chemically synthesized
tcttttttaattattgagaaat

SEQ ID NO: 997066 - DNA, 22 bp, Artificial Sequence
  chemically synthesized
tttcttttttaattattgagaa

SEQ ID NO: 997067 - DNA, 22 bp, Artificial Sequence
  chemically synthesized
ttatatttctcaataattaaaa

SEQ ID NO: 997068 - DNA, 22 bp, Artificial Sequence
  chemically synthesized
tatatttctcaataattaaaaa

SEQ ID NO: 997069 - DNA, 22 bp, Artificial Sequence
  chemically synthesized
atatttctcaataattaaaaaa

SEQ ID NO: 997070 - DNA, 22 bp, Artificial Sequence
  chemically synthesized
gcccactctttcttttttaatt

SEQ ID NO: 997071 - DNA, 22 bp, Artificial Sequence
  chemically synthesized
tatttctcaataattaaaaaag

SEQ ID NO: 997072 - DNA, 22 bp, Artificial Sequence
  chemically synthesized
ctcaataattaaaaaagaaaga

SEQ ID NO: 997073 - DNA, 22 bp, Artificial Sequence
  chemically synthesized
tcaataattaaaaaagaaagag

SEQ ID NO: 997074 - DNA, 22 bp, Artificial Sequence
  chemically synthesized
aataattaaaaaagaaagagtg

SEQ ID NO: 997075 - DNA, 22 bp, Artificial Sequence
  chemically synthesized
aaaaagaaagagtgggccaggt

SEQ ID NO: 997076 - DNA, 22 bp, Artificial Sequence
  chemically synthesized
caggcatgagccaccacacctg

SEQ ID NO: 997077 - DNA, 22 bp, Artificial Sequence
  chemically synthesized
ggattacaggcatgagccacca

SEQ ID NO: 997078 - DNA, 22 bp, Artificial Sequence
  chemically synthesized
ccaaagtgctgggattacaggc

SEQ ID NO: 997079 - DNA, 22 bp, Artificial Sequence
  chemically synthesized
agcctcccaaagtgctgggatt

SEQ ID NO: 997080 - DNA, 22 bp, Artificial Sequence
  chemically synthesized
atgcctgtaatcccagcacttt

SEQ ID NO: 997081 - DNA, 22 bp, Artificial Sequence
  chemically synthesized
taatcccagcactttgggaggc

SEQ ID NO: 997082 - DNA, 22 bp, Artificial Sequence
  chemically synthesized
agatgatccatccacctcagcc

SEQ ID NO: 997083 - DNA, 22 bp, Artificial Sequence
  chemically synthesized
acctcagatgatccatccacct

SEQ ID NO: 997084 - DNA, 22 bp, Artificial Sequence
  chemically synthesized
tgggaggctgaggtggatggat

SEQ ID NO: 997085 - DNA, 22 bp, Artificial Sequence
  chemically synthesized
gggaggctgaggtggatggatc

SEQ ID NO: 997086 - DNA, 22 bp, Artificial Sequence
  chemically synthesized
ctgacctcagatgatccatcca

SEQ ID NO: 997087 - DNA, 22 bp, Artificial Sequence
  chemically synthesized
ggaggctgaggtggatggatca

SEQ ID NO: 997088 - DNA, 22 bp, Artificial Sequence
  chemically synthesized
gaactcctgacctcagatgatc

SEQ ID NO: 997089 - DNA, 22 bp, Artificial Sequence
  chemically synthesized
aggtggatggatcatctgaggt

SEQ ID NO: 997090 - DNA, 22 bp, Artificial Sequence
  chemically synthesized
gtctcgaactcctgacctcaga

SEQ ID NO: 997091 - DNA, 22 bp, Artificial Sequence
  chemically synthesized
gtcaggctggtctcgaactcct

SEQ ID NO: 997092 - DNA, 22 bp, Artificial Sequence
  chemically synthesized
aggtcaggagttcgagaccagc

SEQ ID NO: 997093 - DNA, 22 bp, Artificial Sequence
  chemically synthesized
accatgttggtcaggctggtct

SEQ ID NO: 997094 - DNA, 22 bp, Artificial Sequence
  chemically synthesized
caccatgttggtcaggctggtc

SEQ ID NO: 997095 - DNA, 22 bp, Artificial Sequence
  chemically synthesized
gagaccagcctgaccaacatgg

SEQ ID NO: 997096 - DNA, 22 bp, Artificial Sequence
  chemically synthesized
gtagaaacggggtttcaccatg

SEQ ID NO: 997097 - DNA, 22 bp, Artificial Sequence
  chemically synthesized
ggtagaaacggggtttcaccat

SEQ ID NO: 997098 - DNA, 22 bp, Artificial Sequence
  chemically synthesized
tggtagaaacggggtttcacca

SEQ ID NO: 997099 - DNA, 22 bp, Artificial Sequence
  chemically synthesized
ttggtagaaacggggtttcacc

SEQ ID NO: 997100 - DNA, 22 bp, Artificial Sequence
  chemically synthesized
accaacatggtgaaaccccgtt

SEQ ID NO: 997101 - DNA, 22 bp, Artificial Sequence
  chemically synthesized
tatttttggtagaaacggggtt

SEQ ID NO: 997102 - DNA, 22 bp, Artificial Sequence
  chemically synthesized
gtatttttggtagaaacggggt

SEQ ID NO: 997103 - DNA, 22 bp, Artificial Sequence
  chemically synthesized
tgtatttttggtagaaacgggg

SEQ ID NO: 997104 - DNA, 22 bp, Artificial Sequence
  chemically synthesized
ttgtatttttggtagaaacggg

SEQ ID NO: 997105 - DNA, 22 bp, Artificial Sequence
  chemically synthesized
tttgtatttttggtagaaacgg

SEQ ID NO: 997106 - DNA, 22 bp, Artificial Sequence
  chemically synthesized
attttttgtatttttggtagaa

SEQ ID NO: 997107 - DNA, 22 bp, Artificial Sequence
  chemically synthesized
ccagttaattttttgtattttt

SEQ ID NO: 997108 - DNA, 22 bp, Artificial Sequence
  chemically synthesized
ctaccaaaaatacaaaaaatta

SEQ ID NO: 997109 - DNA, 22 bp, Artificial Sequence
  chemically synthesized
taccaaaaatacaaaaaattaa

SEQ ID NO: 997110 - DNA, 22 bp, Artificial Sequence
  chemically synthesized
ccaaaaatacaaaaaattaact

SEQ ID NO: 997111 - DNA, 22 bp, Artificial Sequence
  chemically synthesized
caggtgtgcaccacccctccca

SEQ ID NO: 997112 - DNA, 22 bp, Artificial Sequence
  chemically synthesized
ggattacaggtgtgcaccaccc

SEQ ID NO: 997113 - DNA, 22 bp, Artificial Sequence
  chemically synthesized
actgggaggggtggtgcacacc

SEQ ID NO: 997114 - DNA, 22 bp, Artificial Sequence
  chemically synthesized
ggaggggtggtgcacacctgta

SEQ ID NO: 997115 - DNA, 22 bp, Artificial Sequence
  chemically synthesized
aatagctgggattacaggtgtg

SEQ ID NO: 997116 - DNA, 22 bp, Artificial Sequence
  chemically synthesized
ctgaatagctgggattacaggt

SEQ ID NO: 997117 - DNA, 22 bp, Artificial Sequence
  chemically synthesized
agcctcctgaatagctgggatt

SEQ ID NO: 997118 - DNA, 22 bp, Artificial Sequence
  chemically synthesized
cctcagcctcctgaatagctgg

SEQ ID NO: 997119 - DNA, 22 bp, Artificial Sequence
  chemically synthesized
ctgcctcagcctcctgaatagc

SEQ ID NO: 997120 - DNA, 22 bp, Artificial Sequence
  chemically synthesized
tcctgcctcagcctcctgaata

SEQ ID NO: 997121 - DNA, 22 bp, Artificial Sequence
  chemically synthesized
taatcccagctattcaggaggc

SEQ ID NO: 997122 - DNA, 22 bp, Artificial Sequence
  chemically synthesized
aagcgattctcctgcctcagcc

SEQ ID NO: 997123 - DNA, 22 bp, Artificial Sequence
  chemically synthesized
ttcaggaggctgaggcaggaga

SEQ ID NO: 997124 - DNA, 22 bp, Artificial Sequence
  chemically synthesized
aggaggctgaggcaggagaatc

SEQ ID NO: 997125 - DNA, 22 bp, Artificial Sequence
  chemically synthesized
ccagattcaagcgattctcctg

SEQ ID NO: 997126 - DNA, 22 bp, Artificial Sequence
  chemically synthesized
cctcccagattcaagcgattct

SEQ ID NO: 997127 - DNA, 22 bp, Artificial Sequence
  chemically synthesized
tgcctcccagattcaagcgatt

SEQ ID NO: 997128 - DNA, 22 bp, Artificial Sequence
  chemically synthesized
aggcaggagaatcgcttgaatc

SEQ ID NO: 997129 - DNA, 22 bp, Artificial Sequence
  chemically synthesized
aacctctgcctcccagattcaa

SEQ ID NO: 997130 - DNA, 22 bp, Artificial Sequence
  chemically synthesized
caacctctgcctcccagattca

SEQ ID NO: 997131 - DNA, 22 bp, Artificial Sequence
  chemically synthesized
acttcaacctctgcctcccaga

SEQ ID NO: 997132 - DNA, 22 bp, Artificial Sequence
  chemically synthesized
gactcacttcaacctctgcctc

SEQ ID NO: 997133 - DNA, 22 bp, Artificial Sequence
  chemically synthesized
gaatctgggaggcagaggttga

SEQ ID NO: 997134 - DNA, 22 bp, Artificial Sequence
  chemically synthesized
aatctgggaggcagaggttgaa

SEQ ID NO: 997135 - DNA, 22 bp, Artificial Sequence
  chemically synthesized
ggaggcagaggttgaagtgagt

SEQ ID NO: 997136 - DNA, 22 bp, Artificial Sequence
  chemically synthesized
gagtacaatggtacaatctcga

SEQ ID NO: 997137 - DNA, 22 bp, Artificial Sequence
  chemically synthesized
aagtgagtcgagattgtaccat

SEQ ID NO: 997138 - DNA, 22 bp, Artificial Sequence
  chemically synthesized
cccgggttggagtacaatggta

SEQ ID NO: 997139 - DNA, 22 bp, Artificial Sequence
  chemically synthesized
ttgcccgggttggagtacaatg

SEQ ID NO: 997140 - DNA, 22 bp, Artificial Sequence
  chemically synthesized
tgttgcccgggttggagtacaa

SEQ ID NO: 997141 - DNA, 22 bp, Artificial Sequence
  chemically synthesized
gctctgttgcccgggttggagt

SEQ ID NO: 997142 - DNA, 22 bp, Artificial Sequence
  chemically synthesized
cgctctgttgcccgggttggag

SEQ ID NO: 997143 - DNA, 22 bp, Artificial Sequence
  chemically synthesized
taccattgtactccaacccggg

SEQ ID NO: 997144 - DNA, 22 bp, Artificial Sequence
  chemically synthesized
tactccaacccgggcaacagag

SEQ ID NO: 997145 - DNA, 22 bp, Artificial Sequence
  chemically synthesized
agatggagtttcgctctgttgc

SEQ ID NO: 997146 - DNA, 22 bp, Artificial Sequence
  chemically synthesized
gagatggagtttcgctctgttg

SEQ ID NO: 997147 - DNA, 22 bp, Artificial Sequence
  chemically synthesized
caacccgggcaacagagcgaaa

SEQ ID NO: 997148 - DNA, 22 bp, Artificial Sequence
  chemically synthesized
tttgagatggagtttcgctctg

SEQ ID NO: 997149 - DNA, 22 bp, Artificial Sequence
  chemically synthesized
ttatttgagatggagtttcgct

SEQ ID NO: 997150 - DNA, 22 bp, Artificial Sequence
  chemically synthesized
ttattatttgagatggagtttc

SEQ ID NO: 997151 - DNA, 22 bp, Artificial Sequence
  chemically synthesized
ttattattatttgagatggagt

SEQ ID NO: 997152 - DNA, 22 bp, Artificial Sequence
  chemically synthesized
ttattattattatttgagatgg

SEQ ID NO: 997153 - DNA, 22 bp, Artificial Sequence
  chemically synthesized
catctcaaataataataataat

SEQ ID NO: 997154 - DNA, 22 bp, Artificial Sequence
  chemically synthesized
aaataataataataataattat

SEQ ID NO: 997155 - DNA, 22 bp, Artificial Sequence
  chemically synthesized
tagtaataataataataattat

SEQ ID NO: 997156 - DNA, 22 bp, Artificial Sequence
  chemically synthesized
atagtaataataataataatta

SEQ ID NO: 997157 - DNA, 22 bp, Artificial Sequence
  chemically synthesized
ttatagtaataataataataat

SEQ ID NO: 997158 - DNA, 22 bp, Artificial Sequence
  chemically synthesized
ttcttatagtaataataataat

SEQ ID NO: 997159 - DNA, 22 bp, Artificial Sequence
  chemically synthesized
attcttatagtaataataataa

SEQ ID NO: 997160 - DNA, 22 bp, Artificial Sequence
  chemically synthesized
ccatttattcttatagtaataa

SEQ ID NO: 997161 - DNA, 22 bp, Artificial Sequence
  chemically synthesized
ttattattattactataagaat

SEQ ID NO: 997162 - DNA, 22 bp, Artificial Sequence
  chemically synthesized
ttattattactataagaataaa

SEQ ID NO: 997163 - DNA, 22 bp, Artificial Sequence
  chemically synthesized
ttattactataagaataaatgg

SEQ ID NO: 997164 - DNA, 22 bp, Artificial Sequence
  chemically synthesized
ttactataagaataaatggtag

SEQ ID NO: 997165 - DNA, 22 bp, Artificial Sequence
  chemically synthesized
ggtaaaaataagctaccattta

SEQ ID NO: 997166 - DNA, 22 bp, Artificial Sequence
  chemically synthesized
aggtaaaaataagctaccattt

SEQ ID NO: 997167 - DNA, 22 bp, Artificial Sequence
  chemically synthesized
ctataagaataaatggtagctt

SEQ ID NO: 997168 - DNA, 22 bp, Artificial Sequence
  chemically synthesized
taagaataaatggtagcttatt

SEQ ID NO: 997169 - DNA, 22 bp, Artificial Sequence
  chemically synthesized
cgtttaggtaaaaataagctac

SEQ ID NO: 997170 - DNA, 22 bp, Artificial Sequence
  chemically synthesized
ctacgtttaggtaaaaataagc

SEQ ID NO: 997171 - DNA, 22 bp, Artificial Sequence
  chemically synthesized
atttttacctaaacgtagtagt

SEQ ID NO: 997172 - DNA, 22 bp, Artificial Sequence
  chemically synthesized
tggcatgaagccactactacgt

SEQ ID NO: 997173 - DNA, 22 bp, Artificial Sequence
  chemically synthesized
tttttacctaaacgtagtagtg

SEQ ID NO: 997174 - DNA, 22 bp, Artificial Sequence
  chemically synthesized
ttacctaaacgtagtagtggct

SEQ ID NO: 997175 - DNA, 22 bp, Artificial Sequence
  chemically synthesized
tacctaaacgtagtagtggctt

SEQ ID NO: 997176 - DNA, 22 bp, Artificial Sequence
  chemically synthesized
acctaaacgtagtagtggcttc

SEQ ID NO: 997177 - DNA, 22 bp, Artificial Sequence
  chemically synthesized
cctaaacgtagtagtggcttca

SEQ ID NO: 997178 - DNA, 22 bp, Artificial Sequence
  chemically synthesized
gcaactgtggcatgaagccact

SEQ ID NO: 997179 - DNA, 22 bp, Artificial Sequence
  chemically synthesized
aacgtagtagtggcttcatgcc

SEQ ID NO: 997180 - DNA, 22 bp, Artificial Sequence
  chemically synthesized
agagattagcaactgtggcatg

SEQ ID NO: 997181 - DNA, 22 bp, Artificial Sequence
  chemically synthesized
catgccacagttgctaatctct

SEQ ID NO: 997182 - DNA, 22 bp, Artificial Sequence
  chemically synthesized
atgccacagttgctaatctctg

SEQ ID NO: 997183 - DNA, 22 bp, Artificial Sequence
  chemically synthesized
aacaaaggatagtgagatggct

SEQ ID NO: 997184 - DNA, 22 bp, Artificial Sequence
  chemically synthesized
ctaatctctgagccatctcact

SEQ ID NO: 997185 - DNA, 22 bp, Artificial Sequence
  chemically synthesized
atctctgagccatctcactatc

SEQ ID NO: 997186 - DNA, 22 bp, Artificial Sequence
  chemically synthesized
acaagctgaacaaaggatagtg

SEQ ID NO: 997187 - DNA, 22 bp, Artificial Sequence
  chemically synthesized
aacaagctgaacaaaggatagt

SEQ ID NO: 997188 - DNA, 22 bp, Artificial Sequence
  chemically synthesized
tgagccatctcactatcctttg

SEQ ID NO: 997189 - DNA, 22 bp, Artificial Sequence
  chemically synthesized
agccatctcactatcctttgtt

SEQ ID NO: 997190 - DNA, 22 bp, Artificial Sequence
  chemically synthesized
actatcctttgttcagcttgtt

SEQ ID NO: 997191 - DNA, 22 bp, Artificial Sequence
  chemically synthesized
tcctttgttcagcttgttaaat

SEQ ID NO: 997192 - DNA, 22 bp, Artificial Sequence
  chemically synthesized
cgaaagtatagagacatttaac

SEQ ID NO: 997193 - DNA, 22 bp, Artificial Sequence
  chemically synthesized
tgttcagcttgttaaatgtctc

SEQ ID NO: 997194 - DNA, 22 bp, Artificial Sequence
  chemically synthesized
gttcagcttgttaaatgtctct

SEQ ID NO: 997195 - DNA, 22 bp, Artificial Sequence
  chemically synthesized
ttcagcttgttaaatgtctcta

SEQ ID NO: 997196 - DNA, 22 bp, Artificial Sequence
  chemically synthesized
gttacgaaagtatagagacatt

SEQ ID NO: 997197 - DNA, 22 bp, Artificial Sequence
  chemically synthesized
agcttgttaaatgtctctatac

SEQ ID NO: 997198 - DNA, 22 bp, Artificial Sequence
  chemically synthesized
gttaaatgtctctatactttcg

SEQ ID NO: 997199 - DNA, 22 bp, Artificial Sequence
  chemically synthesized
ttaaatgtctctatactttcgt

SEQ ID NO: 997200 - DNA, 22 bp, Artificial Sequence
  chemically synthesized
tgaggaactagttacgaaagta

SEQ ID NO: 997201 - DNA, 22 bp, Artificial Sequence
  chemically synthesized
aatgtctctatactttcgtaac

SEQ ID NO: 997202 - DNA, 22 bp, Artificial Sequence
  chemically synthesized
ctatgaggaactagttacgaaa

SEQ ID NO: 997203 - DNA, 22 bp, Artificial Sequence
  chemically synthesized
actatgaggaactagttacgaa

SEQ ID NO: 997204 - DNA, 22 bp, Artificial Sequence
  chemically synthesized
tatactttcgtaactagttcct

SEQ ID NO: 997205 - DNA, 22 bp, Artificial Sequence
  chemically synthesized
tactttcgtaactagttcctca

SEQ ID NO: 997206 - DNA, 22 bp, Artificial Sequence
  chemically synthesized
tcgtaactagttcctcatagta

SEQ ID NO: 997207 - DNA, 22 bp, Artificial Sequence
  chemically synthesized
gaagaaggaatttactatgagg

SEQ ID NO: 997208 - DNA, 22 bp, Artificial Sequence
  chemically synthesized
cgtaactagttcctcatagtaa

SEQ ID NO: 997209 - DNA, 22 bp, Artificial Sequence
  chemically synthesized
gtaactagttcctcatagtaaa

SEQ ID NO: 997210 - DNA, 22 bp, Artificial Sequence
  chemically synthesized
gtctggaagaaggaatttacta

SEQ ID NO: 997211 - DNA, 22 bp, Artificial Sequence
  chemically synthesized
gttcctcatagtaaattccttc

SEQ ID NO: 997212 - DNA, 22 bp, Artificial Sequence
  chemically synthesized
ctcatagtaaattccttcttcc

SEQ ID NO: 997213 - DNA, 22 bp, Artificial Sequence
  chemically synthesized
ggaaacactggtctggaagaag

SEQ ID NO: 997214 - DNA, 22 bp, Artificial Sequence
  chemically synthesized
atagtaaattccttcttccaga

SEQ ID NO: 997215 - DNA, 22 bp, Artificial Sequence
  chemically synthesized
tggtgaggttgggaaacactgg

SEQ ID NO: 997216 - DNA, 22 bp, Artificial Sequence
  chemically synthesized
cttcttccagaccagtgtttcc

SEQ ID NO: 997217 - DNA, 22 bp, Artificial Sequence
  chemically synthesized
cttccagaccagtgtttcccaa

SEQ ID NO: 997218 - DNA, 22 bp, Artificial Sequence
  chemically synthesized
ttccagaccagtgtttcccaac

SEQ ID NO: 997219 - DNA, 22 bp, Artificial Sequence
  chemically synthesized
ccagaccagtgtttcccaacct

SEQ ID NO: 997220 - DNA, 22 bp, Artificial Sequence
  chemically synthesized
cagaccagtgtttcccaacctc

SEQ ID NO: 997221 - DNA, 22 bp, Artificial Sequence
  chemically synthesized
tccaaaatgtcagttgtggtga

SEQ ID NO: 997222 - DNA, 22 bp, Artificial Sequence
  chemically synthesized
tgtccaaaatgtcagttgtggt

SEQ ID NO: 997223 - DNA, 22 bp, Artificial Sequence
  chemically synthesized
cccaacctcaccacaactgaca

SEQ ID NO: 997224 - DNA, 22 bp, Artificial Sequence
  chemically synthesized
ttctgtccaaaatgtcagttgt

SEQ ID NO: 997225 - DNA, 22 bp, Artificial Sequence
  chemically synthesized
ccaacctcaccacaactgacat

SEQ ID NO: 997226 - DNA, 22 bp, Artificial Sequence
  chemically synthesized
accacaactgacattttggaca

SEQ ID NO: 997227 - DNA, 22 bp, Artificial Sequence
  chemically synthesized
caacaaagaattattctgtcca

SEQ ID NO: 997228 - DNA, 22 bp, Artificial Sequence
  chemically synthesized
acaacaaagaattattctgtcc

SEQ ID NO: 997229 - DNA, 22 bp, Artificial Sequence
  chemically synthesized
ttacaacaaagaattattctgt

SEQ ID NO: 997230 - DNA, 22 bp, Artificial Sequence
  chemically synthesized
acattttggacagaataattct

SEQ ID NO: 997231 - DNA, 22 bp, Artificial Sequence
  chemically synthesized
tggacagaataattctttgttg

SEQ ID NO: 997232 - DNA, 22 bp, Artificial Sequence
  chemically synthesized
ggacagaataattctttgttgt

SEQ ID NO: 997233 - DNA, 22 bp, Artificial Sequence
  chemically synthesized
gacagaataattctttgttgta

SEQ ID NO: 997234 - DNA, 22 bp, Artificial Sequence
  chemically synthesized
tacaggacacaggaaagtctct

SEQ ID NO: 997235 - DNA, 22 bp, Artificial Sequence
  chemically synthesized
tttgttgtaagagactttcctg

SEQ ID NO: 997236 - DNA, 22 bp, Artificial Sequence
  chemically synthesized
tgttgtaagagactttcctgtg

SEQ ID NO: 997237 - DNA, 22 bp, Artificial Sequence
  chemically synthesized
gttgtaagagactttcctgtgt

SEQ ID NO: 997238 - DNA, 22 bp, Artificial Sequence
  chemically synthesized
ttgtaagagactttcctgtgtc

SEQ ID NO: 997239 - DNA, 22 bp, Artificial Sequence
  chemically synthesized
taagagactttcctgtgtcctg

SEQ ID NO: 997240 - DNA, 22 bp, Artificial Sequence
  chemically synthesized
gtagacactgtacaggacacag

SEQ ID NO: 997241 - DNA, 22 bp, Artificial Sequence
  chemically synthesized
tcctgtgtcctgtacagtgtct

SEQ ID NO: 997242 - DNA, 22 bp, Artificial Sequence
  chemically synthesized
cctgtgtcctgtacagtgtcta

SEQ ID NO: 997243 - DNA, 22 bp, Artificial Sequence
  chemically synthesized
ctgtgtcctgtacagtgtctac

SEQ ID NO: 997244 - DNA, 22 bp, Artificial Sequence
  chemically synthesized
tgtcctgtacagtgtctaccaa

SEQ ID NO: 997245 - DNA, 22 bp, Artificial Sequence
  chemically synthesized
gtagagacagagatattggtag

SEQ ID NO: 997246 - DNA, 22 bp, Artificial Sequence
  chemically synthesized
ggtagagacagagatattggta

SEQ ID NO: 997247 - DNA, 22 bp, Artificial Sequence
  chemically synthesized
tacagtgtctaccaatatctct

SEQ ID NO: 997248 - DNA, 22 bp, Artificial Sequence
  chemically synthesized
atttggtagagacagagatatt

SEQ ID NO: 997249 - DNA, 22 bp, Artificial Sequence
  chemically synthesized
gtattcatttggtagagacaga

SEQ ID NO: 997250 - DNA, 22 bp, Artificial Sequence
  chemically synthesized
ctggtattcatttggtagagac

SEQ ID NO: 997251 - DNA, 22 bp, Artificial Sequence
  chemically synthesized
ccaatatctctgtctctaccaa

SEQ ID NO: 997252 - DNA, 22 bp, Artificial Sequence
  chemically synthesized
tgtctctaccaaatgaatacca

SEQ ID NO: 997253 - DNA, 22 bp, Artificial Sequence
  chemically synthesized
caggagtgttactggtattcat

SEQ ID NO: 997254 - DNA, 22 bp, Artificial Sequence
  chemically synthesized
tctctaccaaatgaataccagt

SEQ ID NO: 997255 - DNA, 22 bp, Artificial Sequence
  chemically synthesized
taccaaatgaataccagtaaca

SEQ ID NO: 997256 - DNA, 22 bp, Artificial Sequence
  chemically synthesized
ccaaatgaataccagtaacact

SEQ ID NO: 997257 - DNA, 22 bp, Artificial Sequence
  chemically synthesized
tgacaattgcaggagtgttact

SEQ ID NO: 997258 - DNA, 22 bp, Artificial Sequence
  chemically synthesized
gttgtgacaattgcaggagtgt

SEQ ID NO: 997259 - DNA, 22 bp, Artificial Sequence
  chemically synthesized
ggttgtgacaattgcaggagtg

SEQ ID NO: 997260 - DNA, 22 bp, Artificial Sequence
  chemically synthesized
tggttgtgacaattgcaggagt

SEQ ID NO: 997261 - DNA, 22 bp, Artificial Sequence
  chemically synthesized
ttggttgtgacaattgcaggag

SEQ ID NO: 997262 - DNA, 22 bp, Artificial Sequence
  chemically synthesized
gagacatttttggttgtgacaa

SEQ ID NO: 997263 - DNA, 22 bp, Artificial Sequence
  chemically synthesized
tggagacatttttggttgtgac

SEQ ID NO: 997264 - DNA, 22 bp, Artificial Sequence
  chemically synthesized
ctggagacatttttggttgtga

SEQ ID NO: 997265 - DNA, 22 bp, Artificial Sequence
  chemically synthesized
ctgcaattgtcacaaccaaaaa

SEQ ID NO: 997266 - DNA, 22 bp, Artificial Sequence
  chemically synthesized
caattgtcacaaccaaaaatgt

SEQ ID NO: 997267 - DNA, 22 bp, Artificial Sequence
  chemically synthesized
gcaatttctggagacatttttg

SEQ ID NO: 997268 - DNA, 22 bp, Artificial Sequence
  chemically synthesized
tcacaaccaaaaatgtctccag

SEQ ID NO: 997269 - DNA, 22 bp, Artificial Sequence
  chemically synthesized
agggataaattggcaatttctg

SEQ ID NO: 997270 - DNA, 22 bp, Artificial Sequence
  chemically synthesized
cacgctgagggataaattggca

SEQ ID NO: 997271 - DNA, 22 bp, Artificial Sequence
  chemically synthesized
ctgcacgctgagggataaattg

SEQ ID NO: 997272 - DNA, 22 bp, Artificial Sequence
  chemically synthesized
cagaaattgccaatttatccct

SEQ ID NO: 997273 - DNA, 22 bp, Artificial Sequence
  chemically synthesized
tgctgcacgctgagggataaat

SEQ ID NO: 997274 - DNA, 22 bp, Artificial Sequence
  chemically synthesized
ccaatttatccctcagcgtgca

SEQ ID NO: 997275 - DNA, 22 bp, Artificial Sequence
  chemically synthesized
agccaggggtgattctgctgca

SEQ ID NO: 997276 - DNA, 22 bp, Artificial Sequence
  chemically synthesized
atccctcagcgtgcagcagaat

SEQ ID NO: 997277 - DNA, 22 bp, Artificial Sequence
  chemically synthesized
tccctcagcgtgcagcagaatc

SEQ ID NO: 997278 - DNA, 22 bp, Artificial Sequence
  chemically synthesized
tcagccaggggtgattctgctg

SEQ ID NO: 997279 - DNA, 22 bp, Artificial Sequence
  chemically synthesized
agcgtgcagcagaatcacccct

SEQ ID NO: 997280 - DNA, 22 bp, Artificial Sequence
  chemically synthesized
atacagtggttctcagccaggg

SEQ ID NO: 997281 - DNA, 22 bp, Artificial Sequence
  chemically synthesized
gtctaatacagtggttctcagc

SEQ ID NO: 997282 - DNA, 22 bp, Artificial Sequence
  chemically synthesized
tagtctaatacagtggttctca

SEQ ID NO: 997283 - DNA, 22 bp, Artificial Sequence
  chemically synthesized
ctagtctaatacagtggttctc

SEQ ID NO: 997284 - DNA, 22 bp, Artificial Sequence
  chemically synthesized
gctgagaaccactgtattagac

SEQ ID NO: 997285 - DNA, 22 bp, Artificial Sequence
  chemically synthesized
agaaccactgtattagactaga

SEQ ID NO: 997286 - DNA, 22 bp, Artificial Sequence
  chemically synthesized
tattagactagaagatctttac

SEQ ID NO: 997287 - DNA, 22 bp, Artificial Sequence
  chemically synthesized
ggagtcagtcagaaaagtaaag

SEQ ID NO: 997288 - DNA, 22 bp, Artificial Sequence
  chemically synthesized
gactagaagatctttacttttc

SEQ ID NO: 997289 - DNA, 22 bp, Artificial Sequence
  chemically synthesized
aggagtcagtcagaaaagtaaa

SEQ ID NO: 997290 - DNA, 22 bp, Artificial Sequence
  chemically synthesized
gaagatctttacttttctgact

SEQ ID NO: 997291 - DNA, 22 bp, Artificial Sequence
  chemically synthesized
tacttttctgactgactcctaa

SEQ ID NO: 997292 - DNA, 22 bp, Artificial Sequence
  chemically synthesized
acttttctgactgactcctaag

SEQ ID NO: 997293 - DNA, 22 bp, Artificial Sequence
  chemically synthesized
cttttctgactgactcctaagt

SEQ ID NO: 997294 - DNA, 22 bp, Artificial Sequence
  chemically synthesized
aaaggagtatatcacttaggag

SEQ ID NO: 997295 - DNA, 22 bp, Artificial Sequence
  chemically synthesized
gaaaggagtatatcacttagga

SEQ ID NO: 997296 - DNA, 22 bp, Artificial Sequence
  chemically synthesized
ttctgactgactcctaagtgat

SEQ ID NO: 997297 - DNA, 22 bp, Artificial Sequence
  chemically synthesized
tctgactgactcctaagtgata

SEQ ID NO: 997298 - DNA, 22 bp, Artificial Sequence
  chemically synthesized
ctgactgactcctaagtgatat

SEQ ID NO: 997299 - DNA, 22 bp, Artificial Sequence
  chemically synthesized
tgactgactcctaagtgatata

SEQ ID NO: 997300 - DNA, 22 bp, Artificial Sequence
  chemically synthesized
actgactcctaagtgatatact

SEQ ID NO: 997301 - DNA, 22 bp, Artificial Sequence
  chemically synthesized
actcctaagtgatatactcctt

SEQ ID NO: 997302 - DNA, 22 bp, Artificial Sequence
  chemically synthesized
ctaagtgatatactcctttcaa

SEQ ID NO: 997303 - DNA, 22 bp, Artificial Sequence
  chemically synthesized
agtgatatactcctttcaagcg

SEQ ID NO: 997304 - DNA, 22 bp, Artificial Sequence
  chemically synthesized
catataacaggtataaatatgc

SEQ ID NO: 997305 - DNA, 22 bp, Artificial Sequence
  chemically synthesized
acatataacaggtataaatatg

SEQ ID NO: 997306 - DNA, 22 bp, Artificial Sequence
  chemically synthesized
tacatataacaggtataaatat

SEQ ID NO: 997307 - DNA, 22 bp, Artificial Sequence
  chemically synthesized
ctttcaagcgcatatttatacc

SEQ ID NO: 997308 - DNA, 22 bp, Artificial Sequence
  chemically synthesized
ttacatataacaggtataaata

SEQ ID NO: 997309 - DNA, 22 bp, Artificial Sequence
  chemically synthesized
tcaagcgcatatttatacctgt

SEQ ID NO: 997310 - DNA, 22 bp, Artificial Sequence
  chemically synthesized
tttttacatataacaggtataa

SEQ ID NO: 997311 - DNA, 22 bp, Artificial Sequence
  chemically synthesized
caagcgcatatttatacctgtt

SEQ ID NO: 997312 - DNA, 22 bp, Artificial Sequence
  chemically synthesized
atttttacatataacaggtata

SEQ ID NO: 997313 - DNA, 22 bp, Artificial Sequence
  chemically synthesized
aagcgcatatttatacctgtta

SEQ ID NO: 997314 - DNA, 22 bp, Artificial Sequence
  chemically synthesized
caatcttatttttacatataac

SEQ ID NO: 997315 - DNA, 22 bp, Artificial Sequence
  chemically synthesized
ttccaatcttatttttacatat

SEQ ID NO: 997316 - DNA, 22 bp, Artificial Sequence
  chemically synthesized
attccaatcttatttttacata

SEQ ID NO: 997317 - DNA, 22 bp, Artificial Sequence
  chemically synthesized
tattccaatcttatttttacat

SEQ ID NO: 997318 - DNA, 22 bp, Artificial Sequence
  chemically synthesized
atacctgttatatgtaaaaata

SEQ ID NO: 997319 - DNA, 22 bp, Artificial Sequence
  chemically synthesized
tacctgttatatgtaaaaataa

SEQ ID NO: 997320 - DNA, 22 bp, Artificial Sequence
  chemically synthesized
ttttattccaatcttattttta

SEQ ID NO: 997321 - DNA, 22 bp, Artificial Sequence
  chemically synthesized
ttatatgtaaaaataagattgg

SEQ ID NO: 997322 - DNA, 22 bp, Artificial Sequence
  chemically synthesized
tatgtaaaaataagattggaat

SEQ ID NO: 997323 - DNA, 22 bp, Artificial Sequence
  chemically synthesized
tagggacacagatagatagatg

SEQ ID NO: 997324 - DNA, 22 bp, Artificial Sequence
  chemically synthesized
gaataaaataacatctatctat

SEQ ID NO: 997325 - DNA, 22 bp, Artificial Sequence
  chemically synthesized
atagggacacagatagatagat

SEQ ID NO: 997326 - DNA, 22 bp, Artificial Sequence
  chemically synthesized
tatagggacacagatagataga

SEQ ID NO: 997327 - DNA, 22 bp, Artificial Sequence
  chemically synthesized
attttatagggacacagataga

SEQ ID NO: 997328 - DNA, 22 bp, Artificial Sequence
  chemically synthesized
tctatctgtgtccctataaaat

SEQ ID NO: 997329 - DNA, 22 bp, Artificial Sequence
  chemically synthesized
tctgtgtccctataaaattagt

SEQ ID NO: 997330 - DNA, 22 bp, Artificial Sequence
  chemically synthesized
tgtccctataaaattagtcata

SEQ ID NO: 997331 - DNA, 22 bp, Artificial Sequence
  chemically synthesized
taaaattagtcatactgtggtg

SEQ ID NO: 997332 - DNA, 22 bp, Artificial Sequence
  chemically synthesized
tagagatgtagatatcaccaca

SEQ ID NO: 997333 - DNA, 22 bp, Artificial Sequence
  chemically synthesized
atagagatgtagatatcaccac

SEQ ID NO: 997334 - DNA, 22 bp, Artificial Sequence
  chemically synthesized
tatagagatgtagatatcacca

SEQ ID NO: 997335 - DNA, 22 bp, Artificial Sequence
  chemically synthesized
gtcatactgtggtgatatctac

SEQ ID NO: 997336 - DNA, 22 bp, Artificial Sequence
  chemically synthesized
gttttatagagatgtagatatc

SEQ ID NO: 997337 - DNA, 22 bp, Artificial Sequence
  chemically synthesized
ctagttttatagagatgtagat

SEQ ID NO: 997338 - DNA, 22 bp, Artificial Sequence
  chemically synthesized
tggtgatatctacatctctata

SEQ ID NO: 997339 - DNA, 22 bp, Artificial Sequence
  chemically synthesized
ccaatattactagttttataga

SEQ ID NO: 997340 - DNA, 22 bp, Artificial Sequence
  chemically synthesized
accaatattactagttttatag

SEQ ID NO: 997341 - DNA, 22 bp, Artificial Sequence
  chemically synthesized
tttaccaatattactagtttta

SEQ ID NO: 997342 - DNA, 22 bp, Artificial Sequence
  chemically synthesized
ttgtttaccaatattactagtt

SEQ ID NO: 997343 - DNA, 22 bp, Artificial Sequence
  chemically synthesized
catctctataaaactagtaata

SEQ ID NO: 997344 - DNA, 22 bp, Artificial Sequence
  chemically synthesized
attgtttaccaatattactagt

SEQ ID NO: 997345 - DNA, 22 bp, Artificial Sequence
  chemically synthesized
tattgtttaccaatattactag

SEQ ID NO: 997346 - DNA, 22 bp, Artificial Sequence
  chemically synthesized
ttattgtttaccaatattacta

SEQ ID NO: 997347 - DNA, 22 bp, Artificial Sequence
  chemically synthesized
tataaaactagtaatattggta

SEQ ID NO: 997348 - DNA, 22 bp, Artificial Sequence
  chemically synthesized
taaaactagtaatattggtaaa

SEQ ID NO: 997349 - DNA, 22 bp, Artificial Sequence
  chemically synthesized
aataagcttttattgtttacca

SEQ ID NO: 997350 - DNA, 22 bp, Artificial Sequence
  chemically synthesized
ctgaataagcttttattgttta

SEQ ID NO: 997351 - DNA, 22 bp, Artificial Sequence
  chemically synthesized
gctgaataagcttttattgttt

SEQ ID NO: 997352 - DNA, 22 bp, Artificial Sequence
  chemically synthesized
gtaatattggtaaacaataaaa

SEQ ID NO: 997353 - DNA, 22 bp, Artificial Sequence
  chemically synthesized
atttgctgaataagcttttatt

SEQ ID NO: 997354 - DNA, 22 bp, Artificial Sequence
  chemically synthesized
gtaaacaataaaagcttattca

SEQ ID NO: 997355 - DNA, 22 bp, Artificial Sequence
  chemically synthesized
atatcaatatattcatttgctg

SEQ ID NO: 997356 - DNA, 22 bp, Artificial Sequence
  chemically synthesized
catatcaatatattcatttgct

SEQ ID NO: 997357 - DNA, 22 bp, Artificial Sequence
  chemically synthesized
tcatatcaatatattcatttgc

SEQ ID NO: 997358 - DNA, 22 bp, Artificial Sequence
  chemically synthesized
ttcatatcaatatattcatttg

SEQ ID NO: 997359 - DNA, 22 bp, Artificial Sequence
  chemically synthesized
attcagcaaatgaatatattga

SEQ ID NO: 997360 - DNA, 22 bp, Artificial Sequence
  chemically synthesized
ttcagcaaatgaatatattgat

SEQ ID NO: 997361 - DNA, 22 bp, Artificial Sequence
  chemically synthesized
cagatcttttcatatcaatata

SEQ ID NO: 997362 - DNA, 22 bp, Artificial Sequence
  chemically synthesized
gcagatcttttcatatcaatat

SEQ ID NO: 997363 - DNA, 22 bp, Artificial Sequence
  chemically synthesized
agcaaatgaatatattgatatg

SEQ ID NO: 997364 - DNA, 22 bp, Artificial Sequence
  chemically synthesized
tgcagatcttttcatatcaata

SEQ ID NO: 997365 - DNA, 22 bp, Artificial Sequence
  chemically synthesized
atatgaaaagatctgcaaaacc

SEQ ID NO: 997366 - DNA, 22 bp, Artificial Sequence
  chemically synthesized
gaaaaagtagatcaaggttttg

SEQ ID NO: 997367 - DNA, 22 bp, Artificial Sequence
  chemically synthesized
ggaaaaagtagatcaaggtttt

SEQ ID NO: 997368 - DNA, 22 bp, Artificial Sequence
  chemically synthesized
tggaaaaagtagatcaaggttt

SEQ ID NO: 997369 - DNA, 22 bp, Artificial Sequence
  chemically synthesized
attttggaaaaagtagatcaag

SEQ ID NO: 997370 - DNA, 22 bp, Artificial Sequence
  chemically synthesized
caaaaccttgatctactttttc

SEQ ID NO: 997371 - DNA, 22 bp, Artificial Sequence
  chemically synthesized
gatctactttttccaaaattaa

SEQ ID NO: 997372 - DNA, 22 bp, Artificial Sequence
  chemically synthesized
atctactttttccaaaattaat

SEQ ID NO: 997373 - DNA, 22 bp, Artificial Sequence
  chemically synthesized
ctttttccaaaattaatacata

SEQ ID NO: 997374 - DNA, 22 bp, Artificial Sequence
  chemically synthesized
gacaaaataaaatatgtattaa

SEQ ID NO: 997375 - DNA, 22 bp, Artificial Sequence
  chemically synthesized
tttccaaaattaatacatattt

SEQ ID NO: 997376 - DNA, 22 bp, Artificial Sequence
  chemically synthesized
ttccaaaattaatacatatttt

SEQ ID NO: 997377 - DNA, 22 bp, Artificial Sequence
  chemically synthesized
gctggacaaaataaaatatgta

SEQ ID NO: 997378 - DNA, 22 bp, Artificial Sequence
  chemically synthesized
tccaaaattaatacatatttta

SEQ ID NO: 997379 - DNA, 22 bp, Artificial Sequence
  chemically synthesized
ccaaaattaatacatattttat

SEQ ID NO: 997380 - DNA, 22 bp, Artificial Sequence
  chemically synthesized
caaaattaatacatattttatt

SEQ ID NO: 997381 - DNA, 22 bp, Artificial Sequence
  chemically synthesized
aatattagctggacaaaataaa

SEQ ID NO: 997382 - DNA, 22 bp, Artificial Sequence
  chemically synthesized
atacatattttattttgtccag

SEQ ID NO: 997383 - DNA, 22 bp, Artificial Sequence
  chemically synthesized
tattttgtccagctaatattta

SEQ ID NO: 997384 - DNA, 22 bp, Artificial Sequence
  chemically synthesized
attttgtccagctaatatttaa

SEQ ID NO: 997385 - DNA, 22 bp, Artificial Sequence
  chemically synthesized
aataaaaatatattaaatatta

SEQ ID NO: 997386 - DNA, 22 bp, Artificial Sequence
  chemically synthesized
ttttgtccagctaatatttaat

SEQ ID NO: 997387 - DNA, 22 bp, Artificial Sequence
  chemically synthesized
tgtccagctaatatttaatata

SEQ ID NO: 997388 - DNA, 22 bp, Artificial Sequence
  chemically synthesized
attaaataaaaatatattaaat

SEQ ID NO: 997389 - DNA, 22 bp, Artificial Sequence
  chemically synthesized
gtccagctaatatttaatatat

SEQ ID NO: 997390 - DNA, 22 bp, Artificial Sequence
  chemically synthesized
tccagctaatatttaatatatt

SEQ ID NO: 997391 - DNA, 22 bp, Artificial Sequence
  chemically synthesized
tgatggctaattaaataaaaat

SEQ ID NO: 997392 - DNA, 22 bp, Artificial Sequence
  chemically synthesized
atatttaatatatttttattta

SEQ ID NO: 997393 - DNA, 22 bp, Artificial Sequence
  chemically synthesized
aatatatttttatttaattagc

SEQ ID NO: 997394 - DNA, 22 bp, Artificial Sequence
  chemically synthesized
atatatttttatttaattagcc

SEQ ID NO: 997395 - DNA, 22 bp, Artificial Sequence
  chemically synthesized
aaaggccctatgatggctaatt

SEQ ID NO: 997396 - DNA, 22 bp, Artificial Sequence
  chemically synthesized
caaaggccctatgatggctaat

SEQ ID NO: 997397 - DNA, 22 bp, Artificial Sequence
  chemically synthesized
tttcaaaggccctatgatggct

SEQ ID NO: 997398 - DNA, 22 bp, Artificial Sequence
  chemically synthesized
ttatttaattagccatcatagg

SEQ ID NO: 997399 - DNA, 22 bp, Artificial Sequence
  chemically synthesized
tatttaattagccatcataggg

SEQ ID NO: 997400 - DNA, 22 bp, Artificial Sequence
  chemically synthesized
atttaattagccatcatagggc

SEQ ID NO: 997401 - DNA, 22 bp, Artificial Sequence
  chemically synthesized
tttaattagccatcatagggcc

SEQ ID NO: 997402 - DNA, 22 bp, Artificial Sequence
  chemically synthesized
aattagccatcatagggccttt

SEQ ID NO: 997403 - DNA, 22 bp, Artificial Sequence
  chemically synthesized
attagccatcatagggcctttg

SEQ ID NO: 997404 - DNA, 22 bp, Artificial Sequence
  chemically synthesized
gccatcatagggcctttgaaat

SEQ ID NO: 997405 - DNA, 22 bp, Artificial Sequence
  chemically synthesized
tgaaatagttcatacattatga

SEQ ID NO: 997406 - DNA, 22 bp, Artificial Sequence
  chemically synthesized
gtatataaggcatcataatgta

SEQ ID NO: 997407 - DNA, 22 bp, Artificial Sequence
  chemically synthesized
gaaatagttcatacattatgat

SEQ ID NO: 997408 - DNA, 22 bp, Artificial Sequence
  chemically synthesized
agtatataaggcatcataatgt

SEQ ID NO: 997409 - DNA, 22 bp, Artificial Sequence
  chemically synthesized
aaatagttcatacattatgatg

SEQ ID NO: 997410 - DNA, 22 bp, Artificial Sequence
  chemically synthesized
tagtatataaggcatcataatg

SEQ ID NO: 997411 - DNA, 22 bp, Artificial Sequence
  chemically synthesized
actttagtatataaggcatcat

SEQ ID NO: 997412 - DNA, 22 bp, Artificial Sequence
  chemically synthesized
ctcactttagtatataaggcat

SEQ ID NO: 997413 - DNA, 22 bp, Artificial Sequence
  chemically synthesized
actcactttagtatataaggca

SEQ ID NO: 997414 - DNA, 22 bp, Artificial Sequence
  chemically synthesized
atacattatgatgccttatata

SEQ ID NO: 997415 - DNA, 22 bp, Artificial Sequence
  chemically synthesized
tactcactttagtatataaggc

SEQ ID NO: 997416 - DNA, 22 bp, Artificial Sequence
  chemically synthesized
attttactcactttagtatata

SEQ ID NO: 997417 - DNA, 22 bp, Artificial Sequence
  chemically synthesized
aattttactcactttagtatat

SEQ ID NO: 997418 - DNA, 22 bp, Artificial Sequence
  chemically synthesized
tgatgccttatatactaaagtg

SEQ ID NO: 997419 - DNA, 22 bp, Artificial Sequence
  chemically synthesized
acagatgtttaattttactcac

SEQ ID NO: 997420 - DNA, 22 bp, Artificial Sequence
  chemically synthesized
atatactaaagtgagtaaaatt

SEQ ID NO: 997421 - DNA, 22 bp, Artificial Sequence
  chemically synthesized
tatactaaagtgagtaaaatta

SEQ ID NO: 997422 - DNA, 22 bp, Artificial Sequence
  chemically synthesized
aagtgagtaaaattaaacatct

SEQ ID NO: 997423 - DNA, 22 bp, Artificial Sequence
  chemically synthesized
tgtcagccgtattaacagatgt

SEQ ID NO: 997424 - DNA, 22 bp, Artificial Sequence
  chemically synthesized
tgtgtcagccgtattaacagat

SEQ ID NO: 997425 - DNA, 22 bp, Artificial Sequence
  chemically synthesized
ctgtgtcagccgtattaacaga

SEQ ID NO: 997426 - DNA, 22 bp, Artificial Sequence
  chemically synthesized
tctgtgtcagccgtattaacag

SEQ ID NO: 997427 - DNA, 22 bp, Artificial Sequence
  chemically synthesized
ttctgtgtcagccgtattaaca

SEQ ID NO: 997428 - DNA, 22 bp, Artificial Sequence
  chemically synthesized
tgtttttctgtgtcagccgtat

SEQ ID NO: 997429 - DNA, 22 bp, Artificial Sequence
  chemically synthesized
aacatctgttaatacggctgac

SEQ ID NO: 997430 - DNA, 22 bp, Artificial Sequence
  chemically synthesized
actgtgtttttctgtgtcagcc

SEQ ID NO: 997431 - DNA, 22 bp, Artificial Sequence
  chemically synthesized
tctgactgtgtttttctgtgtc

SEQ ID NO: 997432 - DNA, 22 bp, Artificial Sequence
  chemically synthesized
ttaatacggctgacacagaaaa

SEQ ID NO: 997433 - DNA, 22 bp, Artificial Sequence
  chemically synthesized
atacggctgacacagaaaaaca

SEQ ID NO: 997434 - DNA, 22 bp, Artificial Sequence
  chemically synthesized
cctatctgactgtgtttttctg

SEQ ID NO: 997435 - DNA, 22 bp, Artificial Sequence
  chemically synthesized
aaactgcctatctgactgtgtt

SEQ ID NO: 997436 - DNA, 22 bp, Artificial Sequence
  chemically synthesized
taaaactgcctatctgactgtg

SEQ ID NO: 997437 - DNA, 22 bp, Artificial Sequence
  chemically synthesized
acacagaaaaacacagtcagat

SEQ ID NO: 997438 - DNA, 22 bp, Artificial Sequence
  chemically synthesized
tctaaaactgcctatctgactg

SEQ ID NO: 997439 - DNA, 22 bp, Artificial Sequence
  chemically synthesized
ctctctaaaactgcctatctga

SEQ ID NO: 997440 - DNA, 22 bp, Artificial Sequence
  chemically synthesized
tcctctctaaaactgcctatct

SEQ ID NO: 997441 - DNA, 22 bp, Artificial Sequence
  chemically synthesized
ctcctctctaaaactgcctatc

SEQ ID NO: 997442 - DNA, 22 bp, Artificial Sequence
  chemically synthesized
tatatttctcctctctaaaact

SEQ ID NO: 997443 - DNA, 22 bp, Artificial Sequence
  chemically synthesized
ttgtatatttctcctctctaaa

SEQ ID NO: 997444 - DNA, 22 bp, Artificial Sequence
  chemically synthesized
ttattgtatatttctcctctct

SEQ ID NO: 997445 - DNA, 22 bp, Artificial Sequence
  chemically synthesized
tagagaggagaaatatacaata

SEQ ID NO: 997446 - DNA, 22 bp, Artificial Sequence
  chemically synthesized
agagaggagaaatatacaataa

SEQ ID NO: 997447 - DNA, 22 bp, Artificial Sequence
  chemically synthesized
gagaggagaaatatacaataat

SEQ ID NO: 997448 - DNA, 22 bp, Artificial Sequence
  chemically synthesized
ataatgtgaggtgggaaaaaga

SEQ ID NO: 997449 - DNA, 22 bp, Artificial Sequence
  chemically synthesized
ttcataatgtgaggtgggaaaa

SEQ ID NO: 997450 - DNA, 22 bp, Artificial Sequence
  chemically synthesized
cctgttcataatgtgaggtggg

SEQ ID NO: 997451 - DNA, 22 bp, Artificial Sequence
  chemically synthesized
ccctgttcataatgtgaggtgg

SEQ ID NO: 997452 - DNA, 22 bp, Artificial Sequence
  chemically synthesized
ttctttttcccacctcacatta

SEQ ID NO: 997453 - DNA, 22 bp, Artificial Sequence
  chemically synthesized
ctttttcccacctcacattatg

SEQ ID NO: 997454 - DNA, 22 bp, Artificial Sequence
  chemically synthesized
tttttcccacctcacattatga

SEQ ID NO: 997455 - DNA, 22 bp, Artificial Sequence
  chemically synthesized
tttcccacctcacattatgaac

SEQ ID NO: 997456 - DNA, 22 bp, Artificial Sequence
  chemically synthesized
ttcccacctcacattatgaaca

SEQ ID NO: 997457 - DNA, 22 bp, Artificial Sequence
  chemically synthesized
tcccacctcacattatgaacag

SEQ ID NO: 997458 - DNA, 22 bp, Artificial Sequence
  chemically synthesized
cccacctcacattatgaacagg

SEQ ID NO: 997459 - DNA, 22 bp, Artificial Sequence
  chemically synthesized
aggaaaaacttccctgttcata

SEQ ID NO: 997460 - DNA, 22 bp, Artificial Sequence
  chemically synthesized
ccacctcacattatgaacaggg

SEQ ID NO: 997461 - DNA, 22 bp, Artificial Sequence
  chemically synthesized
gtgctaaggaaaaacttccctg

SEQ ID NO: 997462 - DNA, 22 bp, Artificial Sequence
  chemically synthesized
acattatgaacagggaagtttt

SEQ ID NO: 997463 - DNA, 22 bp, Artificial Sequence
  chemically synthesized
tgaacagggaagtttttcctta

SEQ ID NO: 997464 - DNA, 22 bp, Artificial Sequence
  chemically synthesized
agatgttagtgctaaggaaaaa

SEQ ID NO: 997465 - DNA, 22 bp, Artificial Sequence
  chemically synthesized
ctgagatgttagtgctaaggaa

SEQ ID NO: 997466 - DNA, 22 bp, Artificial Sequence
  chemically synthesized
cgtattgctgagatgttagtgc

SEQ ID NO: 997467 - DNA, 22 bp, Artificial Sequence
  chemically synthesized
acgtattgctgagatgttagtg

SEQ ID NO: 997468 - DNA, 22 bp, Artificial Sequence
  chemically synthesized
tacgtattgctgagatgttagt

SEQ ID NO: 997469 - DNA, 22 bp, Artificial Sequence
  chemically synthesized
ttccttagcactaacatctcag

SEQ ID NO: 997470 - DNA, 22 bp, Artificial Sequence
  chemically synthesized
tccttagcactaacatctcagc

SEQ ID NO: 997471 - DNA, 22 bp, Artificial Sequence
  chemically synthesized
ccttagcactaacatctcagca

SEQ ID NO: 997472 - DNA, 22 bp, Artificial Sequence
  chemically synthesized
cttagcactaacatctcagcaa

SEQ ID NO: 997473 - DNA, 22 bp, Artificial Sequence
  chemically synthesized
agcactaacatctcagcaatac

SEQ ID NO: 997474 - DNA, 22 bp, Artificial Sequence
  chemically synthesized
gcactaacatctcagcaatacg

SEQ ID NO: 997475 - DNA, 22 bp, Artificial Sequence
  chemically synthesized
acatctcagcaatacgtaaaga

SEQ ID NO: 997476 - DNA, 22 bp, Artificial Sequence
  chemically synthesized
agcaatacgtaaagatatcaca

SEQ ID NO: 997477 - DNA, 22 bp, Artificial Sequence
  chemically synthesized
ataaatacaaaataagggatgt

SEQ ID NO: 997478 - DNA, 22 bp, Artificial Sequence
  chemically synthesized
aaagaaggattaataaatacaa

SEQ ID NO: 997479 - DNA, 22 bp, Artificial Sequence
  chemically synthesized
attttgtatttattaatccttc

SEQ ID NO: 997480 - DNA, 22 bp, Artificial Sequence
  chemically synthesized
ttttgtatttattaatccttct

SEQ ID NO: 997481 - DNA, 22 bp, Artificial Sequence
  chemically synthesized
tgtatttattaatccttctttt

SEQ ID NO: 997482 - DNA, 22 bp, Artificial Sequence
  chemically synthesized
gtatttattaatccttctttta

SEQ ID NO: 997483 - DNA, 22 bp, Artificial Sequence
  chemically synthesized
tatttattaatccttcttttaa

SEQ ID NO: 997484 - DNA, 22 bp, Artificial Sequence
  chemically synthesized
gcaacagaagcattaaaagaag

SEQ ID NO: 997485 - DNA, 22 bp, Artificial Sequence
  chemically synthesized
attaatccttcttttaatgctt

SEQ ID NO: 997486 - DNA, 22 bp, Artificial Sequence
  chemically synthesized
ttaatccttcttttaatgcttc

SEQ ID NO: 997487 - DNA, 22 bp, Artificial Sequence
  chemically synthesized
aaaaattagcaacagaagcatt

SEQ ID NO: 997488 - DNA, 22 bp, Artificial Sequence
  chemically synthesized
atccttcttttaatgcttctgt

SEQ ID NO: 997489 - DNA, 22 bp, Artificial Sequence
  chemically synthesized
cttttaatgcttctgttgctaa

SEQ ID NO: 997490 - DNA, 22 bp, Artificial Sequence
  chemically synthesized
ttttaatgcttctgttgctaat

SEQ ID NO: 997491 - DNA, 22 bp, Artificial Sequence
  chemically synthesized
ttaatgcttctgttgctaattt

SEQ ID NO: 997492 - DNA, 22 bp, Artificial Sequence
  chemically synthesized
taatgcttctgttgctaatttt

SEQ ID NO: 997493 - DNA, 22 bp, Artificial Sequence
  chemically synthesized
aatgcttctgttgctaattttt

SEQ ID NO: 997494 - DNA, 22 bp, Artificial Sequence
  chemically synthesized
atgcttctgttgctaatttttt

SEQ ID NO: 997495 - DNA, 22 bp, Artificial Sequence
  chemically synthesized
ctgttgctaattttttaattga

SEQ ID NO: 997496 - DNA, 22 bp, Artificial Sequence
  chemically synthesized
tgttgctaattttttaattgac

SEQ ID NO: 997497 - DNA, 22 bp, Artificial Sequence
  chemically synthesized
ggtaaggacaaagtcaattaaa

SEQ ID NO: 997498 - DNA, 22 bp, Artificial Sequence
  chemically synthesized
ttgctaattttttaattgactt

SEQ ID NO: 997499 - DNA, 22 bp, Artificial Sequence
  chemically synthesized
ctaattttttaattgactttgt

SEQ ID NO: 997500 - DNA, 22 bp, Artificial Sequence
  chemically synthesized
gtattcggtaaggacaaagtca

SEQ ID NO: 997501 - DNA, 22 bp, Artificial Sequence
  chemically synthesized
attttttaattgactttgtcct

SEQ ID NO: 997502 - DNA, 22 bp, Artificial Sequence
  chemically synthesized
tttaattgactttgtccttacc

SEQ ID NO: 997503 - DNA, 22 bp, Artificial Sequence
  chemically synthesized
tcactagtattcggtaaggaca

SEQ ID NO: 997504 - DNA, 22 bp, Artificial Sequence
  chemically synthesized
ttaattgactttgtccttaccg

SEQ ID NO: 997505 - DNA, 22 bp, Artificial Sequence
  chemically synthesized
taattgactttgtccttaccga

SEQ ID NO: 997506 - DNA, 22 bp, Artificial Sequence
  chemically synthesized
aattgactttgtccttaccgaa

SEQ ID NO: 997507 - DNA, 22 bp, Artificial Sequence
  chemically synthesized
attgactttgtccttaccgaat

SEQ ID NO: 997508 - DNA, 22 bp, Artificial Sequence
  chemically synthesized
actttgtccttaccgaatacta

SEQ ID NO: 997509 - DNA, 22 bp, Artificial Sequence
  chemically synthesized
taaatcctatcactagtattcg

SEQ ID NO: 997510 - DNA, 22 bp, Artificial Sequence
  chemically synthesized
ataaatcctatcactagtattc

SEQ ID NO: 997511 - DNA, 22 bp, Artificial Sequence
  chemically synthesized
tataaatcctatcactagtatt

SEQ ID NO: 997512 - DNA, 22 bp, Artificial Sequence
  chemically synthesized
tgtccttaccgaatactagtga

SEQ ID NO: 997513 - DNA, 22 bp, Artificial Sequence
  chemically synthesized
gtccttaccgaatactagtgat

SEQ ID NO: 997514 - DNA, 22 bp, Artificial Sequence
  chemically synthesized
tccttaccgaatactagtgata

SEQ ID NO: 997515 - DNA, 22 bp, Artificial Sequence
  chemically synthesized
accgaatactagtgataggatt

SEQ ID NO: 997516 - DNA, 22 bp, Artificial Sequence
  chemically synthesized
ccgaatactagtgataggattt

SEQ ID NO: 997517 - DNA, 22 bp, Artificial Sequence
  chemically synthesized
atcatcctttataaatcctatc

SEQ ID NO: 997518 - DNA, 22 bp, Artificial Sequence
  chemically synthesized
aatcatcctttataaatcctat

SEQ ID NO: 997519 - DNA, 22 bp, Artificial Sequence
  chemically synthesized
gtgataggatttataaaggatg

SEQ ID NO: 997520 - DNA, 22 bp, Artificial Sequence
  chemically synthesized
gtccatgacttaatcatccttt

SEQ ID NO: 997521 - DNA, 22 bp, Artificial Sequence
  chemically synthesized
aattagtccatgacttaatcat

SEQ ID NO: 997522 - DNA, 22 bp, Artificial Sequence
  chemically synthesized
aaattagtccatgacttaatca

SEQ ID NO: 997523 - DNA, 22 bp, Artificial Sequence
  chemically synthesized
ataaaggatgattaagtcatgg

SEQ ID NO: 997524 - DNA, 22 bp, Artificial Sequence
  chemically synthesized
taaaggatgattaagtcatgga

SEQ ID NO: 997525 - DNA, 22 bp, Artificial Sequence
  chemically synthesized
aacaaagtttaaattagtccat

SEQ ID NO: 997526 - DNA, 22 bp, Artificial Sequence
  chemically synthesized
agtcatggactaatttaaactt

SEQ ID NO: 997527 - DNA, 22 bp, Artificial Sequence
  chemically synthesized
tatgagttcaacaaagtttaaa

SEQ ID NO: 997528 - DNA, 22 bp, Artificial Sequence
  chemically synthesized
ttatatgagttcaacaaagttt

SEQ ID NO: 997529 - DNA, 22 bp, Artificial Sequence
  chemically synthesized
actgttatatgagttcaacaaa

SEQ ID NO: 997530 - DNA, 22 bp, Artificial Sequence
  chemically synthesized
atttaaactttgttgaactcat

SEQ ID NO: 997531 - DNA, 22 bp, Artificial Sequence
  chemically synthesized
aaactcactgttatatgagttc

SEQ ID NO: 997532 - DNA, 22 bp, Artificial Sequence
  chemically synthesized
aaactttgttgaactcatataa

SEQ ID NO: 997533 - DNA, 22 bp, Artificial Sequence
  chemically synthesized
aactttgttgaactcatataac

SEQ ID NO: 997534 - DNA, 22 bp, Artificial Sequence
  chemically synthesized
attgaaactcactgttatatga

SEQ ID NO: 997535 - DNA, 22 bp, Artificial Sequence
  chemically synthesized
cattgaaactcactgttatatg

SEQ ID NO: 997536 - DNA, 22 bp, Artificial Sequence
  chemically synthesized
tgttgaactcatataacagtga

SEQ ID NO: 997537 - DNA, 22 bp, Artificial Sequence
  chemically synthesized
gttgaactcatataacagtgag

SEQ ID NO: 997538 - DNA, 22 bp, Artificial Sequence
  chemically synthesized
ttgaactcatataacagtgagt

SEQ ID NO: 997539 - DNA, 22 bp, Artificial Sequence
  chemically synthesized
aactcatataacagtgagtttc

SEQ ID NO: 997540 - DNA, 22 bp, Artificial Sequence
  chemically synthesized
gtgtgatttcattgaaactcac

SEQ ID NO: 997541 - DNA, 22 bp, Artificial Sequence
  chemically synthesized
agtgtgatttcattgaaactca

SEQ ID NO: 997542 - DNA, 22 bp, Artificial Sequence
  chemically synthesized
ttagtgtgatttcattgaaact

SEQ ID NO: 997543 - DNA, 22 bp, Artificial Sequence
  chemically synthesized
atataacagtgagtttcaatga

SEQ ID NO: 997544 - DNA, 22 bp, Artificial Sequence
  chemically synthesized
cagagaattcttagtgtgattt

SEQ ID NO: 997545 - DNA, 22 bp, Artificial Sequence
  chemically synthesized
caatgaaatcacactaagaatt

SEQ ID NO: 997546 - DNA, 22 bp, Artificial Sequence
  chemically synthesized
aatgaaatcacactaagaattc

SEQ ID NO: 997547 - DNA, 22 bp, Artificial Sequence
  chemically synthesized
gaacaaagcattacagagaatt

SEQ ID NO: 997548 - DNA, 22 bp, Artificial Sequence
  chemically synthesized
tagctggaacaaagcattacag

SEQ ID NO: 997549 - DNA, 22 bp, Artificial Sequence
  chemically synthesized
atagctggaacaaagcattaca

SEQ ID NO: 997550 - DNA, 22 bp, Artificial Sequence
  chemically synthesized
ttatagctggaacaaagcatta

SEQ ID NO: 997551 - DNA, 22 bp, Artificial Sequence
  chemically synthesized
agaattctctgtaatgctttgt

SEQ ID NO: 997552 - DNA, 22 bp, Artificial Sequence
  chemically synthesized
cttatagctggaacaaagcatt

SEQ ID NO: 997553 - DNA, 22 bp, Artificial Sequence
  chemically synthesized
tcttatagctggaacaaagcat

SEQ ID NO: 997554 - DNA, 22 bp, Artificial Sequence
  chemically synthesized
ttttcttatagctggaacaaag

SEQ ID NO: 997555 - DNA, 22 bp, Artificial Sequence
  chemically synthesized
tctgtaatgctttgttccagct

SEQ ID NO: 997556 - DNA, 22 bp, Artificial Sequence
  chemically synthesized
tgtaatgctttgttccagctat

SEQ ID NO: 997557 - DNA, 22 bp, Artificial Sequence
  chemically synthesized
taatgctttgttccagctataa

SEQ ID NO: 997558 - DNA, 22 bp, Artificial Sequence
  chemically synthesized
ggtattgttttcttatagctgg

SEQ ID NO: 997559 - DNA, 22 bp, Artificial Sequence
  chemically synthesized
tgttccagctataagaaaacaa

SEQ ID NO: 997560 - DNA, 22 bp, Artificial Sequence
  chemically synthesized
gttccagctataagaaaacaat

SEQ ID NO: 997561 - DNA, 22 bp, Artificial Sequence
  chemically synthesized
ttccagctataagaaaacaata

SEQ ID NO: 997562 - DNA, 22 bp, Artificial Sequence
  chemically synthesized
gatgaaattgggtattgttttc

SEQ ID NO: 997563 - DNA, 22 bp, Artificial Sequence
  chemically synthesized
agatgaaattgggtattgtttt

SEQ ID NO: 997564 - DNA, 22 bp, Artificial Sequence
  chemically synthesized
cagctataagaaaacaataccc

SEQ ID NO: 997565 - DNA, 22 bp, Artificial Sequence
  chemically synthesized
ttagatgaaattgggtattgtt

SEQ ID NO: 997566 - DNA, 22 bp, Artificial Sequence
  chemically synthesized
atctcttagatgaaattgggta

SEQ ID NO: 997567 - DNA, 22 bp, Artificial Sequence
  chemically synthesized
taagaaaacaatacccaatttc

SEQ ID NO: 997568 - DNA, 22 bp, Artificial Sequence
  chemically synthesized
catctcttagatgaaattgggt

SEQ ID NO: 997569 - DNA, 22 bp, Artificial Sequence
  chemically synthesized
tcatctcttagatgaaattggg

SEQ ID NO: 997570 - DNA, 22 bp, Artificial Sequence
  chemically synthesized
ttcatctcttagatgaaattgg

SEQ ID NO: 997571 - DNA, 22 bp, Artificial Sequence
  chemically synthesized
tttttcatctcttagatgaaat

SEQ ID NO: 997572 - DNA, 22 bp, Artificial Sequence
  chemically synthesized
atttttcatctcttagatgaaa

SEQ ID NO: 997573 - DNA, 22 bp, Artificial Sequence
  chemically synthesized
tatttttcatctcttagatgaa

SEQ ID NO: 997574 - DNA, 22 bp, Artificial Sequence
  chemically synthesized
tttatttttcatctcttagatg

SEQ ID NO: 997575 - DNA, 22 bp, Artificial Sequence
  chemically synthesized
ctttatttttcatctcttagat

SEQ ID NO: 997576 - DNA, 22 bp, Artificial Sequence
  chemically synthesized
tctttatttttcatctcttaga

SEQ ID NO: 997577 - DNA, 22 bp, Artificial Sequence
  chemically synthesized
acatactttctttatttttcat

SEQ ID NO: 997578 - DNA, 22 bp, Artificial Sequence
  chemically synthesized
cacatactttctttatttttca

SEQ ID NO: 997579 - DNA, 22 bp, Artificial Sequence
  chemically synthesized
catctaagagatgaaaaataaa

SEQ ID NO: 997580 - DNA, 22 bp, Artificial Sequence
  chemically synthesized
atctaagagatgaaaaataaag

SEQ ID NO: 997581 - DNA, 22 bp, Artificial Sequence
  chemically synthesized
tcttcacatactttctttattt

SEQ ID NO: 997582 - DNA, 22 bp, Artificial Sequence
  chemically synthesized
agagatgaaaaataaagaaagt

SEQ ID NO: 997583 - DNA, 22 bp, Artificial Sequence
  chemically synthesized
aatatgattatcttcacatact

SEQ ID NO: 997584 - DNA, 22 bp, Artificial Sequence
  chemically synthesized
ttgaatatgattatcttcacat

SEQ ID NO: 997585 - DNA, 22 bp, Artificial Sequence
  chemically synthesized
tcataatataataactattgaa

SEQ ID NO: 997586 - DNA, 22 bp, Artificial Sequence
  chemically synthesized
catatgcaaattatcataatat

SEQ ID NO: 997587 - DNA, 22 bp, Artificial Sequence
  chemically synthesized
aatagttattatattatgataa

SEQ ID NO: 997588 - DNA, 22 bp, Artificial Sequence
  chemically synthesized
ttatattatgataatttgcata

SEQ ID NO: 997589 - DNA, 22 bp, Artificial Sequence
  chemically synthesized
aaggatgtctacatatgcaaat

SEQ ID NO: 997590 - DNA, 22 bp, Artificial Sequence
  chemically synthesized
caaggatgtctacatatgcaaa

SEQ ID NO: 997591 - DNA, 22 bp, Artificial Sequence
  chemically synthesized
tattatgataatttgcatatgt

SEQ ID NO: 997592 - DNA, 22 bp, Artificial Sequence
  chemically synthesized
tgataatttgcatatgtagaca

SEQ ID NO: 997593 - DNA, 22 bp, Artificial Sequence
  chemically synthesized
tgtacatttcaaggatgtctac

SEQ ID NO: 997594 - DNA, 22 bp, Artificial Sequence
  chemically synthesized
gcatatgtagacatccttgaaa

SEQ ID NO: 997595 - DNA, 22 bp, Artificial Sequence
  chemically synthesized
catatgtagacatccttgaaat

SEQ ID NO: 997596 - DNA, 22 bp, Artificial Sequence
  chemically synthesized
aataaaggtctatgtacatttc

SEQ ID NO: 997597 - DNA, 22 bp, Artificial Sequence
  chemically synthesized
gaataaaggtctatgtacattt

SEQ ID NO: 997598 - DNA, 22 bp, Artificial Sequence
  chemically synthesized
gaaatgtacatagacctttatt

SEQ ID NO: 997599 - DNA, 22 bp, Artificial Sequence
  chemically synthesized
aaatgtacatagacctttattc

SEQ ID NO: 997600 - DNA, 22 bp, Artificial Sequence
  chemically synthesized
aaatgtatgggaaagatcttga

SEQ ID NO: 997601 - DNA, 22 bp, Artificial Sequence
  chemically synthesized
tgaaatgtatgggaaagatctt

SEQ ID NO: 997602 - DNA, 22 bp, Artificial Sequence
  chemically synthesized
tattcaagatctttcccataca

SEQ ID NO: 997603 - DNA, 22 bp, Artificial Sequence
  chemically synthesized
attcaagatctttcccatacat

SEQ ID NO: 997604 - DNA, 22 bp, Artificial Sequence
  chemically synthesized
ttcaagatctttcccatacatt

SEQ ID NO: 997605 - DNA, 22 bp, Artificial Sequence
  chemically synthesized
aagatctttcccatacatttca

SEQ ID NO: 997606 - DNA, 22 bp, Artificial Sequence
  chemically synthesized
tcccatacatttcagaattcgt

SEQ ID NO: 997607 - DNA, 22 bp, Artificial Sequence
  chemically synthesized
cccatacatttcagaattcgtt

SEQ ID NO: 997608 - DNA, 22 bp, Artificial Sequence
  chemically synthesized
ccatacatttcagaattcgttt

SEQ ID NO: 997609 - DNA, 22 bp, Artificial Sequence
  chemically synthesized
tcaaatgtatgaatgataaaaa

SEQ ID NO: 997610 - DNA, 22 bp, Artificial Sequence
  chemically synthesized
atcaaatgtatgaatgataaaa

SEQ ID NO: 997611 - DNA, 22 bp, Artificial Sequence
  chemically synthesized
cagaattcgtttttatcattca

SEQ ID NO: 997612 - DNA, 22 bp, Artificial Sequence
  chemically synthesized
agaattcgtttttatcattcat

SEQ ID NO: 997613 - DNA, 22 bp, Artificial Sequence
  chemically synthesized
gtttttatcattcatacatttg

SEQ ID NO: 997614 - DNA, 22 bp, Artificial Sequence
  chemically synthesized
aaatatgtttatcaaatgtatg

SEQ ID NO: 997615 - DNA, 22 bp, Artificial Sequence
  chemically synthesized
aaaatatgtttatcaaatgtat

SEQ ID NO: 997616 - DNA, 22 bp, Artificial Sequence
  chemically synthesized
ttatcattcatacatttgataa

SEQ ID NO: 997617 - DNA, 22 bp, Artificial Sequence
  chemically synthesized
tatcattcatacatttgataaa

SEQ ID NO: 997618 - DNA, 22 bp, Artificial Sequence
  chemically synthesized
atcattcatacatttgataaac

SEQ ID NO: 997619 - DNA, 22 bp, Artificial Sequence
  chemically synthesized
cacttaaaatatgtttatcaaa

SEQ ID NO: 997620 - DNA, 22 bp, Artificial Sequence
  chemically synthesized
tcattcatacatttgataaaca

SEQ ID NO: 997621 - DNA, 22 bp, Artificial Sequence
  chemically synthesized
atacatttgataaacatatttt

SEQ ID NO: 997622 - DNA, 22 bp, Artificial Sequence
  chemically synthesized
gataaacatattttaagtgtaa

SEQ ID NO: 997623 - DNA, 22 bp, Artificial Sequence
  chemically synthesized
ataagataaatattacacttaa

SEQ ID NO: 997624 - DNA, 22 bp, Artificial Sequence
  chemically synthesized
ataaacatattttaagtgtaat

SEQ ID NO: 997625 - DNA, 22 bp, Artificial Sequence
  chemically synthesized
catgttgataagataaatatta

SEQ ID NO: 997626 - DNA, 22 bp, Artificial Sequence
  chemically synthesized
taagtgtaatatttatcttatc

SEQ ID NO: 997627 - DNA, 22 bp, Artificial Sequence
  chemically synthesized
aagtgtaatatttatcttatca

SEQ ID NO: 997628 - DNA, 22 bp, Artificial Sequence
  chemically synthesized
agtgtaatatttatcttatcaa

SEQ ID NO: 997629 - DNA, 22 bp, Artificial Sequence
  chemically synthesized
agtatgcattacatgttgataa

SEQ ID NO: 997630 - DNA, 22 bp, Artificial Sequence
  chemically synthesized
ttaagtatgcattacatgttga

SEQ ID NO: 997631 - DNA, 22 bp, Artificial Sequence
  chemically synthesized
atcttatcaacatgtaatgcat

SEQ ID NO: 997632 - DNA, 22 bp, Artificial Sequence
  chemically synthesized
tcttatcaacatgtaatgcata

SEQ ID NO: 997633 - DNA, 22 bp, Artificial Sequence
  chemically synthesized
cacattgttaagtatgcattac

SEQ ID NO: 997634 - DNA, 22 bp, Artificial Sequence
  chemically synthesized
atcaacatgtaatgcatactta

SEQ ID NO: 997635 - DNA, 22 bp, Artificial Sequence
  chemically synthesized
tcaacatgtaatgcatacttaa

SEQ ID NO: 997636 - DNA, 22 bp, Artificial Sequence
  chemically synthesized
ataagatcaatattacacattg

SEQ ID NO: 997637 - DNA, 22 bp, Artificial Sequence
  chemically synthesized
aacaatgtgtaatattgatctt

SEQ ID NO: 997638 - DNA, 22 bp, Artificial Sequence
  chemically synthesized
acaatgtgtaatattgatctta

SEQ ID NO: 997639 - DNA, 22 bp, Artificial Sequence
  chemically synthesized
gtagagtagcattgataagatc

SEQ ID NO: 997640 - DNA, 22 bp, Artificial Sequence
  chemically synthesized
ggtagagtagcattgataagat

SEQ ID NO: 997641 - DNA, 22 bp, Artificial Sequence
  chemically synthesized
tggtagagtagcattgataaga

SEQ ID NO: 997642 - DNA, 22 bp, Artificial Sequence
  chemically synthesized
attttggtagagtagcattgat

SEQ ID NO: 997643 - DNA, 22 bp, Artificial Sequence
  chemically synthesized
aattttggtagagtagcattga

SEQ ID NO: 997644 - DNA, 22 bp, Artificial Sequence
  chemically synthesized
taattttggtagagtagcattg

SEQ ID NO: 997645 - DNA, 22 bp, Artificial Sequence
  chemically synthesized
ttaattttggtagagtagcatt

SEQ ID NO: 997646 - DNA, 22 bp, Artificial Sequence
  chemically synthesized
cttttaattttggtagagtagc

SEQ ID NO: 997647 - DNA, 22 bp, Artificial Sequence
  chemically synthesized
atcttatcaatgctactctacc

SEQ ID NO: 997648 - DNA, 22 bp, Artificial Sequence
  chemically synthesized
atcaatgctactctaccaaaat

SEQ ID NO: 997649 - DNA, 22 bp, Artificial Sequence
  chemically synthesized
tcaatgctactctaccaaaatt

SEQ ID NO: 997650 - DNA, 22 bp, Artificial Sequence
  chemically synthesized
atgatctacttttaattttggt

SEQ ID NO: 997651 - DNA, 22 bp, Artificial Sequence
  chemically synthesized
aatgatctacttttaattttgg

SEQ ID NO: 997652 - DNA, 22 bp, Artificial Sequence
  chemically synthesized
taatgatctacttttaattttg

SEQ ID NO: 997653 - DNA, 22 bp, Artificial Sequence
  chemically synthesized
tttaatgatctacttttaattt

SEQ ID NO: 997654 - DNA, 22 bp, Artificial Sequence
  chemically synthesized
ctttaatgatctacttttaatt

SEQ ID NO: 997655 - DNA, 22 bp, Artificial Sequence
  chemically synthesized
tctttaatgatctacttttaat

SEQ ID NO: 997656 - DNA, 22 bp, Artificial Sequence
  chemically synthesized
ttctttaatgatctacttttaa

SEQ ID NO: 997657 - DNA, 22 bp, Artificial Sequence
  chemically synthesized
ctctaccaaaattaaaagtaga

SEQ ID NO: 997658 - DNA, 22 bp, Artificial Sequence
  chemically synthesized
tttctttaatgatctactttta

SEQ ID NO: 997659 - DNA, 22 bp, Artificial Sequence
  chemically synthesized
ttttctttaatgatctactttt

SEQ ID NO: 997660 - DNA, 22 bp, Artificial Sequence
  chemically synthesized
taccaaaattaaaagtagatca

SEQ ID NO: 997661 - DNA, 22 bp, Artificial Sequence
  chemically synthesized
ccaaaattaaaagtagatcatt

SEQ ID NO: 997662 - DNA, 22 bp, Artificial Sequence
  chemically synthesized
atttttttctttaatgatctac

SEQ ID NO: 997663 - DNA, 22 bp, Artificial Sequence
  chemically synthesized
gatttttttctttaatgatcta

SEQ ID NO: 997664 - DNA, 22 bp, Artificial Sequence
  chemically synthesized
aaagtagatcattaaagaaaaa

SEQ ID NO: 997665 - DNA, 22 bp, Artificial Sequence
  chemically synthesized
agaggaatttgatttttttctt

SEQ ID NO: 997666 - DNA, 22 bp, Artificial Sequence
  chemically synthesized
tgacattaagaggaatttgatt

SEQ ID NO: 997667 - DNA, 22 bp, Artificial Sequence
  chemically synthesized
tatgacattaagaggaatttga

SEQ ID NO: 997668 - DNA, 22 bp, Artificial Sequence
  chemically synthesized
ctatgacattaagaggaatttg

SEQ ID NO: 997669 - DNA, 22 bp, Artificial Sequence
  chemically synthesized
aagaaaaaaatcaaattcctct

SEQ ID NO: 997670 - DNA, 22 bp, Artificial Sequence
  chemically synthesized
tctatgacattaagaggaattt

SEQ ID NO: 997671 - DNA, 22 bp, Artificial Sequence
  chemically synthesized
ttctatgacattaagaggaatt

SEQ ID NO: 997672 - DNA, 22 bp, Artificial Sequence
  chemically synthesized
atagagaagaatgtttttctat

SEQ ID NO: 997673 - DNA, 22 bp, Artificial Sequence
  chemically synthesized
ctcttaatgtcatagaaaaaca

SEQ ID NO: 997674 - DNA, 22 bp, Artificial Sequence
  chemically synthesized
aatagagaagaatgtttttcta

SEQ ID NO: 997675 - DNA, 22 bp, Artificial Sequence
  chemically synthesized
ttaatgtcatagaaaaacattc

SEQ ID NO: 997676 - DNA, 22 bp, Artificial Sequence
  chemically synthesized
tcttaatagagaagaatgtttt

SEQ ID NO: 997677 - DNA, 22 bp, Artificial Sequence
  chemically synthesized
aatgtcatagaaaaacattctt

SEQ ID NO: 997678 - DNA, 22 bp, Artificial Sequence
  chemically synthesized
atcttaatagagaagaatgttt

SEQ ID NO: 997679 - DNA, 22 bp, Artificial Sequence
  chemically synthesized
atgtcatagaaaaacattcttc

SEQ ID NO: 997680 - DNA, 22 bp, Artificial Sequence
  chemically synthesized
tatcttaatagagaagaatgtt

SEQ ID NO: 997681 - DNA, 22 bp, Artificial Sequence
  chemically synthesized
tcctttatcttaatagagaaga

SEQ ID NO: 997682 - DNA, 22 bp, Artificial Sequence
  chemically synthesized
agttgtcctttatcttaataga

SEQ ID NO: 997683 - DNA, 22 bp, Artificial Sequence
  chemically synthesized
ttaagttgtcctttatcttaat

SEQ ID NO: 997684 - DNA, 22 bp, Artificial Sequence
  chemically synthesized
attaagttgtcctttatcttaa

SEQ ID NO: 997685 - DNA, 22 bp, Artificial Sequence
  chemically synthesized
ttctctattaagataaaggaca

SEQ ID NO: 997686 - DNA, 22 bp, Artificial Sequence
  chemically synthesized
gatttattaagttgtcctttat

SEQ ID NO: 997687 - DNA, 22 bp, Artificial Sequence
  chemically synthesized
ctctattaagataaaggacaac

SEQ ID NO: 997688 - DNA, 22 bp, Artificial Sequence
  chemically synthesized
tctattaagataaaggacaact

SEQ ID NO: 997689 - DNA, 22 bp, Artificial Sequence
  chemically synthesized
tattaagataaaggacaactta

SEQ ID NO: 997690 - DNA, 22 bp, Artificial Sequence
  chemically synthesized
ttaagataaaggacaacttaat

SEQ ID NO: 997691 - DNA, 22 bp, Artificial Sequence
  chemically synthesized
agataaaggacaacttaataaa

SEQ ID NO: 997692 - DNA, 22 bp, Artificial Sequence
  chemically synthesized
tgaaaatattagatttattaag

SEQ ID NO: 997693 - DNA, 22 bp, Artificial Sequence
  chemically synthesized
tatgagctatgaaaatattaga

SEQ ID NO: 997694 - DNA, 22 bp, Artificial Sequence
  chemically synthesized
atatgagctatgaaaatattag

SEQ ID NO: 997695 - DNA, 22 bp, Artificial Sequence
  chemically synthesized
tatatgagctatgaaaatatta

SEQ ID NO: 997696 - DNA, 22 bp, Artificial Sequence
  chemically synthesized
tttatatgagctatgaaaatat

SEQ ID NO: 997697 - DNA, 22 bp, Artificial Sequence
  chemically synthesized
ctttatatgagctatgaaaata

SEQ ID NO: 997698 - DNA, 22 bp, Artificial Sequence
  chemically synthesized
aataaatctaatattttcatag

SEQ ID NO: 997699 - DNA, 22 bp, Artificial Sequence
  chemically synthesized
ataaatctaatattttcatagc

SEQ ID NO: 997700 - DNA, 22 bp, Artificial Sequence
  chemically synthesized
tatttctttatatgagctatga

SEQ ID NO: 997701 - DNA, 22 bp, Artificial Sequence
  chemically synthesized
tctatatttctttatatgagct

SEQ ID NO: 997702 - DNA, 22 bp, Artificial Sequence
  chemically synthesized
atattttcatagctcatataaa

SEQ ID NO: 997703 - DNA, 22 bp, Artificial Sequence
  chemically synthesized
atcctatctatatttctttata

SEQ ID NO: 997704 - DNA, 22 bp, Artificial Sequence
  chemically synthesized
tcatagctcatataaagaaata

SEQ ID NO: 997705 - DNA, 22 bp, Artificial Sequence
  chemically synthesized
catagctcatataaagaaatat

SEQ ID NO: 997706 - DNA, 22 bp, Artificial Sequence
  chemically synthesized
atagctcatataaagaaatata

SEQ ID NO: 997707 - DNA, 22 bp, Artificial Sequence
  chemically synthesized
tctaatcctatctatatttctt

SEQ ID NO: 997708 - DNA, 22 bp, Artificial Sequence
  chemically synthesized
gtctaatcctatctatatttct

SEQ ID NO: 997709 - DNA, 22 bp, Artificial Sequence
  chemically synthesized
tttgtctaatcctatctatatt

SEQ ID NO: 997710 - DNA, 22 bp, Artificial Sequence
  chemically synthesized
tatttgtctaatcctatctata

SEQ ID NO: 997711 - DNA, 22 bp, Artificial Sequence
  chemically synthesized
atataaagaaatatagatagga

SEQ ID NO: 997712 - DNA, 22 bp, Artificial Sequence
  chemically synthesized
ctatttgtctaatcctatctat

SEQ ID NO: 997713 - DNA, 22 bp, Artificial Sequence
  chemically synthesized
cttctatttgtctaatcctatc

SEQ ID NO: 997714 - DNA, 22 bp, Artificial Sequence
  chemically synthesized
ttccttctatttgtctaatcct

SEQ ID NO: 997715 - DNA, 22 bp, Artificial Sequence
  chemically synthesized
gttccttctatttgtctaatcc

SEQ ID NO: 997716 - DNA, 22 bp, Artificial Sequence
  chemically synthesized
atttgttccttctatttgtcta

SEQ ID NO: 997717 - DNA, 22 bp, Artificial Sequence
  chemically synthesized
catttgttccttctatttgtct

SEQ ID NO: 997718 - DNA, 22 bp, Artificial Sequence
  chemically synthesized
tcatttgttccttctatttgtc

SEQ ID NO: 997719 - DNA, 22 bp, Artificial Sequence
  chemically synthesized
ggctttcatttgttccttctat

SEQ ID NO: 997720 - DNA, 22 bp, Artificial Sequence
  chemically synthesized
ctgggctttcatttgttccttc

SEQ ID NO: 997721 - DNA, 22 bp, Artificial Sequence
  chemically synthesized
gacaaatagaaggaacaaatga

SEQ ID NO: 997722 - DNA, 22 bp, Artificial Sequence
  chemically synthesized
gtaatctactgggctttcattt

SEQ ID NO: 997723 - DNA, 22 bp, Artificial Sequence
  chemically synthesized
aaaacactggtaatctactggg

SEQ ID NO: 997724 - DNA, 22 bp, Artificial Sequence
  chemically synthesized
aggctcaaaacactggtaatct

SEQ ID NO: 997725 - DNA, 22 bp, Artificial Sequence
  chemically synthesized
aattaaggctcaaaacactggt

SEQ ID NO: 997726 - DNA, 22 bp, Artificial Sequence
  chemically synthesized
ctaaattaaggctcaaaacact

SEQ ID NO: 997727 - DNA, 22 bp, Artificial Sequence
  chemically synthesized
cctaaattaaggctcaaaacac

SEQ ID NO: 997728 - DNA, 22 bp, Artificial Sequence
  chemically synthesized
ataacttcctaaattaaggctc

SEQ ID NO: 997729 - DNA, 22 bp, Artificial Sequence
  chemically synthesized
gataacttcctaaattaaggct

SEQ ID NO: 997730 - DNA, 22 bp, Artificial Sequence
  chemically synthesized
ccagtgttttgagccttaattt

SEQ ID NO: 997731 - DNA, 22 bp, Artificial Sequence
  chemically synthesized
tgagccttaatttaggaagtta

SEQ ID NO: 997732 - DNA, 22 bp, Artificial Sequence
  chemically synthesized
gagccttaatttaggaagttat

SEQ ID NO: 997733 - DNA, 22 bp, Artificial Sequence
  chemically synthesized
agccttaatttaggaagttatc

SEQ ID NO: 997734 - DNA, 22 bp, Artificial Sequence
  chemically synthesized
aatttaggaagttatcaaatat

SEQ ID NO: 997735 - DNA, 22 bp, Artificial Sequence
  chemically synthesized
atttaggaagttatcaaatatg

SEQ ID NO: 997736 - DNA, 22 bp, Artificial Sequence
  chemically synthesized
aaatgaataagtacatatttga

SEQ ID NO: 997737 - DNA, 22 bp, Artificial Sequence
  chemically synthesized
aggaagttatcaaatatgtact

SEQ ID NO: 997738 - DNA, 22 bp, Artificial Sequence
  chemically synthesized
ggaagttatcaaatatgtactt

SEQ ID NO: 997739 - DNA, 22 bp, Artificial Sequence
  chemically synthesized
cctgaaatgaataagtacatat

SEQ ID NO: 997740 - DNA, 22 bp, Artificial Sequence
  chemically synthesized
tcaaatatgtacttattcattt

SEQ ID NO: 997741 - DNA, 22 bp, Artificial Sequence
  chemically synthesized
aaaccatacaattccctgaaat

SEQ ID NO: 997742 - DNA, 22 bp, Artificial Sequence
  chemically synthesized
tgaaaccatacaattccctgaa

SEQ ID NO: 997743 - DNA, 22 bp, Artificial Sequence
  chemically synthesized
ctgaaaccatacaattccctga

SEQ ID NO: 997744 - DNA, 22 bp, Artificial Sequence
  chemically synthesized
tttctgaaaccatacaattccc

SEQ ID NO: 997745 - DNA, 22 bp, Artificial Sequence
  chemically synthesized
atttctgaaaccatacaattcc

SEQ ID NO: 997746 - DNA, 22 bp, Artificial Sequence
  chemically synthesized
attcatttcagggaattgtatg

SEQ ID NO: 997747 - DNA, 22 bp, Artificial Sequence
  chemically synthesized
ttcatttcagggaattgtatgg

SEQ ID NO: 997748 - DNA, 22 bp, Artificial Sequence
  chemically synthesized
ttatttctgaaaccatacaatt

SEQ ID NO: 997749 - DNA, 22 bp, Artificial Sequence
  chemically synthesized
cttatttctgaaaccatacaat

SEQ ID NO: 997750 - DNA, 22 bp, Artificial Sequence
  chemically synthesized
tcttatttctgaaaccatacaa

SEQ ID NO: 997751 - DNA, 22 bp, Artificial Sequence
  chemically synthesized
atttcagggaattgtatggttt

SEQ ID NO: 997752 - DNA, 22 bp, Artificial Sequence
  chemically synthesized
ttcttatttctgaaaccataca

SEQ ID NO: 997753 - DNA, 22 bp, Artificial Sequence
  chemically synthesized
cagggaattgtatggtttcaga

SEQ ID NO: 997754 - DNA, 22 bp, Artificial Sequence
  chemically synthesized
agggaattgtatggtttcagaa

SEQ ID NO: 997755 - DNA, 22 bp, Artificial Sequence
  chemically synthesized
tcgcttttcttatttctgaaac

SEQ ID NO: 997756 - DNA, 22 bp, Artificial Sequence
  chemically synthesized
ttgtcgcttttcttatttctga

SEQ ID NO: 997757 - DNA, 22 bp, Artificial Sequence
  chemically synthesized
gttgtcgcttttcttatttctg

SEQ ID NO: 997758 - DNA, 22 bp, Artificial Sequence
  chemically synthesized
tgttgtcgcttttcttatttct

SEQ ID NO: 997759 - DNA, 22 bp, Artificial Sequence
  chemically synthesized
tatggtttcagaaataagaaaa

SEQ ID NO: 997760 - DNA, 22 bp, Artificial Sequence
  chemically synthesized
accgttttgttgtcgcttttct

SEQ ID NO: 997761 - DNA, 22 bp, Artificial Sequence
  chemically synthesized
gaccgttttgttgtcgcttttc

SEQ ID NO: 997762 - DNA, 22 bp, Artificial Sequence
  chemically synthesized
cagaaataagaaaagcgacaac

SEQ ID NO: 997763 - DNA, 22 bp, Artificial Sequence
  chemically synthesized
agaaataagaaaagcgacaaca

SEQ ID NO: 997764 - DNA, 22 bp, Artificial Sequence
  chemically synthesized
aggcaaatttgaccgttttgtt

SEQ ID NO: 997765 - DNA, 22 bp, Artificial Sequence
  chemically synthesized
accaatcattcaggcaaatttg

SEQ ID NO: 997766 - DNA, 22 bp, Artificial Sequence
  chemically synthesized
gaatgaacaaagctgaccaatc

SEQ ID NO: 997767 - DNA, 22 bp, Artificial Sequence
  chemically synthesized
agaatgaacaaagctgaccaat

SEQ ID NO: 997768 - DNA, 22 bp, Artificial Sequence
  chemically synthesized
gcctgaatgattggtcagcttt

SEQ ID NO: 997769 - DNA, 22 bp, Artificial Sequence
  chemically synthesized
cctgaatgattggtcagctttg

SEQ ID NO: 997770 - DNA, 22 bp, Artificial Sequence
  chemically synthesized
agtttagaatgaacaaagctga

SEQ ID NO: 997771 - DNA, 22 bp, Artificial Sequence
  chemically synthesized
aatgattggtcagctttgttca

SEQ ID NO: 997772 - DNA, 22 bp, Artificial Sequence
  chemically synthesized
ttaagtttagaatgaacaaagc

SEQ ID NO: 997773 - DNA, 22 bp, Artificial Sequence
  chemically synthesized
gtcagctttgttcattctaaac

SEQ ID NO: 997774 - DNA, 22 bp, Artificial Sequence
  chemically synthesized
gtaaaggattattaagtttaga

SEQ ID NO: 997775 - DNA, 22 bp, Artificial Sequence
  chemically synthesized
tgttcattctaaacttaataat

SEQ ID NO: 997776 - DNA, 22 bp, Artificial Sequence
  chemically synthesized
aattagtaaaggattattaagt

SEQ ID NO: 997777 - DNA, 22 bp, Artificial Sequence
  chemically synthesized
gttcattctaaacttaataatc

SEQ ID NO: 997778 - DNA, 22 bp, Artificial Sequence
  chemically synthesized
ttcattctaaacttaataatcc

SEQ ID NO: 997779 - DNA, 22 bp, Artificial Sequence
  chemically synthesized
ctgaattagtaaaggattatta

SEQ ID NO: 997780 - DNA, 22 bp, Artificial Sequence
  chemically synthesized
gctgaattagtaaaggattatt

SEQ ID NO: 997781 - DNA, 22 bp, Artificial Sequence
  chemically synthesized
attctaaacttaataatccttt

SEQ ID NO: 997782 - DNA, 22 bp, Artificial Sequence
  chemically synthesized
tgctgaattagtaaaggattat

SEQ ID NO: 997783 - DNA, 22 bp, Artificial Sequence
  chemically synthesized
taaacttaataatcctttacta

SEQ ID NO: 997784 - DNA, 22 bp, Artificial Sequence
  chemically synthesized
aacttaataatcctttactaat

SEQ ID NO: 997785 - DNA, 22 bp, Artificial Sequence
  chemically synthesized
taagactttgctgaattagtaa

SEQ ID NO: 997786 - DNA, 22 bp, Artificial Sequence
  chemically synthesized
ataagactttgctgaattagta

SEQ ID NO: 997787 - DNA, 22 bp, Artificial Sequence
  chemically synthesized
tataagactttgctgaattagt

SEQ ID NO: 997788 - DNA, 22 bp, Artificial Sequence
  chemically synthesized
aataatcctttactaattcagc

SEQ ID NO: 997789 - DNA, 22 bp, Artificial Sequence
  chemically synthesized
ttataagactttgctgaattag

SEQ ID NO: 997790 - DNA, 22 bp, Artificial Sequence
  chemically synthesized
ataatcctttactaattcagca

SEQ ID NO: 997791 - DNA, 22 bp, Artificial Sequence
  chemically synthesized
tttataagactttgctgaatta

SEQ ID NO: 997792 - DNA, 22 bp, Artificial Sequence
  chemically synthesized
ataaattttttataagactttg

SEQ ID NO: 997793 - DNA, 22 bp, Artificial Sequence
  chemically synthesized
tactaattcagcaaagtcttat

SEQ ID NO: 997794 - DNA, 22 bp, Artificial Sequence
  chemically synthesized
actaattcagcaaagtcttata

SEQ ID NO: 997795 - DNA, 22 bp, Artificial Sequence
  chemically synthesized
ctaattcagcaaagtcttataa

SEQ ID NO: 997796 - DNA, 22 bp, Artificial Sequence
  chemically synthesized
attcagcaaagtcttataaaaa

SEQ ID NO: 997797 - DNA, 22 bp, Artificial Sequence
  chemically synthesized
agcaaagtcttataaaaaattt

SEQ ID NO: 997798 - DNA, 22 bp, Artificial Sequence
  chemically synthesized
tgaacaatgacctgataaattt

SEQ ID NO: 997799 - DNA, 22 bp, Artificial Sequence
  chemically synthesized
ataaaaaatttatcaggtcatt

SEQ ID NO: 997800 - DNA, 22 bp, Artificial Sequence
  chemically synthesized
taaaaaatttatcaggtcattg

SEQ ID NO: 997801 - DNA, 22 bp, Artificial Sequence
  chemically synthesized
atatcattatgaacaatgacct

SEQ ID NO: 997802 - DNA, 22 bp, Artificial Sequence
  chemically synthesized
ctcatatcattatgaacaatga

SEQ ID NO: 997803 - DNA, 22 bp, Artificial Sequence
  chemically synthesized
gctcatatcattatgaacaatg

SEQ ID NO: 997804 - DNA, 22 bp, Artificial Sequence
  chemically synthesized
tgctcatatcattatgaacaat

SEQ ID NO: 997805 - DNA, 22 bp, Artificial Sequence
  chemically synthesized
ttgctcatatcattatgaacaa

SEQ ID NO: 997806 - DNA, 22 bp, Artificial Sequence
  chemically synthesized
tttgctcatatcattatgaaca

SEQ ID NO: 997807 - DNA, 22 bp, Artificial Sequence
  chemically synthesized
atcaggtcattgttcataatga

SEQ ID NO: 997808 - DNA, 22 bp, Artificial Sequence
  chemically synthesized
tcaggtcattgttcataatgat

SEQ ID NO: 997809 - DNA, 22 bp, Artificial Sequence
  chemically synthesized
ctttttgctcatatcattatga

SEQ ID NO: 997810 - DNA, 22 bp, Artificial Sequence
  chemically synthesized
cctttttgctcatatcattatg

SEQ ID NO: 997811 - DNA, 22 bp, Artificial Sequence
  chemically synthesized
catttcctttttgctcatatca

SEQ ID NO: 997812 - DNA, 22 bp, Artificial Sequence
  chemically synthesized
ccatttcctttttgctcatatc

SEQ ID NO: 997813 - DNA, 22 bp, Artificial Sequence
  chemically synthesized
tttccatttcctttttgctcat

SEQ ID NO: 997814 - DNA, 22 bp, Artificial Sequence
  chemically synthesized
ttcataatgatatgagcaaaaa

SEQ ID NO: 997815 - DNA, 22 bp, Artificial Sequence
  chemically synthesized
ataatgatatgagcaaaaagga

SEQ ID NO: 997816 - DNA, 22 bp, Artificial Sequence
  chemically synthesized
tctatttccatttcctttttgc

SEQ ID NO: 997817 - DNA, 22 bp, Artificial Sequence
  chemically synthesized
ttatctatttccatttcctttt

SEQ ID NO: 997818 - DNA, 22 bp, Artificial Sequence
  chemically synthesized
aatgaaatccatcatatgacct

SEQ ID NO: 997819 - DNA, 22 bp, Artificial Sequence
  chemically synthesized
gaatgaaatccatcatatgacc

SEQ ID NO: 997820 - DNA, 22 bp, Artificial Sequence
  chemically synthesized
taacatttgaatgaaatccatc

SEQ ID NO: 997821 - DNA, 22 bp, Artificial Sequence
  chemically synthesized
ataacatttgaatgaaatccat

SEQ ID NO: 997822 - DNA, 22 bp, Artificial Sequence
  chemically synthesized
acacaaaatgccttataacatt

SEQ ID NO: 997823 - DNA, 22 bp, Artificial Sequence
  chemically synthesized
aacacaaaatgccttataacat

SEQ ID NO: 997824 - DNA, 22 bp, Artificial Sequence
  chemically synthesized
cattcaaatgttataaggcatt

SEQ ID NO: 997825 - DNA, 22 bp, Artificial Sequence
  chemically synthesized
attcaaatgttataaggcattt

SEQ ID NO: 997826 - DNA, 22 bp, Artificial Sequence
  chemically synthesized
aaatgttataaggcattttgtg

SEQ ID NO: 997827 - DNA, 22 bp, Artificial Sequence
  chemically synthesized
taaggcattttgtgttaaatat

SEQ ID NO: 997828 - DNA, 22 bp, Artificial Sequence
  chemically synthesized
tgtaatatgaatgacaaatatt

SEQ ID NO: 997829 - DNA, 22 bp, Artificial Sequence
  chemically synthesized
tatgtaatatgaatgacaaata

SEQ ID NO: 997830 - DNA, 22 bp, Artificial Sequence
  chemically synthesized
ctatgtaatatgaatgacaaat

SEQ ID NO: 997831 - DNA, 22 bp, Artificial Sequence
  chemically synthesized
tgtgttaaatatttgtcattca

SEQ ID NO: 997832 - DNA, 22 bp, Artificial Sequence
  chemically synthesized
gtgttaaatatttgtcattcat

SEQ ID NO: 997833 - DNA, 22 bp, Artificial Sequence
  chemically synthesized
tgttaaatatttgtcattcata

SEQ ID NO: 997834 - DNA, 22 bp, Artificial Sequence
  chemically synthesized
tatttctatgtaatatgaatga

SEQ ID NO: 997835 - DNA, 22 bp, Artificial Sequence
  chemically synthesized
aatatttgtcattcatattaca

SEQ ID NO: 997836 - DNA, 22 bp, Artificial Sequence
  chemically synthesized
cataaattatatttctatgtaa

SEQ ID NO: 997837 - DNA, 22 bp, Artificial Sequence
  chemically synthesized
gtcattcatattacatagaaat

SEQ ID NO: 997838 - DNA, 22 bp, Artificial Sequence
  chemically synthesized
tacataaattatatttctatgt

SEQ ID NO: 997839 - DNA, 22 bp, Artificial Sequence
  chemically synthesized
tcattcatattacatagaaata

SEQ ID NO: 997840 - DNA, 22 bp, Artificial Sequence
  chemically synthesized
ctctacataaattatatttcta

SEQ ID NO: 997841 - DNA, 22 bp, Artificial Sequence
  chemically synthesized
atattacatagaaatataattt

SEQ ID NO: 997842 - DNA, 22 bp, Artificial Sequence
  chemically synthesized
cattcctctacataaattatat

SEQ ID NO: 997843 - DNA, 22 bp, Artificial Sequence
  chemically synthesized
ttacattcctctacataaatta

SEQ ID NO: 997844 - DNA, 22 bp, Artificial Sequence
  chemically synthesized
attacattcctctacataaatt

SEQ ID NO: 997845 - DNA, 22 bp, Artificial Sequence
  chemically synthesized
catagaaatataatttatgtag

SEQ ID NO: 997846 - DNA, 22 bp, Artificial Sequence
  chemically synthesized
aaaagagtaatgtttattacat

SEQ ID NO: 997847 - DNA, 22 bp, Artificial Sequence
  chemically synthesized
aaaaagagtaatgtttattaca

SEQ ID NO: 997848 - DNA, 22 bp, Artificial Sequence
  chemically synthesized
atgtagaggaatgtaataaaca

SEQ ID NO: 997849 - DNA, 22 bp, Artificial Sequence
  chemically synthesized
taaaaagagtaatgtttattac

SEQ ID NO: 997850 - DNA, 22 bp, Artificial Sequence
  chemically synthesized
tgtagaggaatgtaataaacat

SEQ ID NO: 997851 - DNA, 22 bp, Artificial Sequence
  chemically synthesized
ttaaaaagagtaatgtttatta

SEQ ID NO: 997852 - DNA, 22 bp, Artificial Sequence
  chemically synthesized
atgtttttaaaaagagtaatgt

SEQ ID NO: 997853 - DNA, 22 bp, Artificial Sequence
  chemically synthesized
ggaaactgatgtttttaaaaag

SEQ ID NO: 997854 - DNA, 22 bp, Artificial Sequence
  chemically synthesized
ctctttttaaaaacatcagttt

SEQ ID NO: 997855 - DNA, 22 bp, Artificial Sequence
  chemically synthesized
tggcatattcggaaactgatgt

SEQ ID NO: 997856 - DNA, 22 bp, Artificial Sequence
  chemically synthesized
tgtggcatattcggaaactgat

SEQ ID NO: 997857 - DNA, 22 bp, Artificial Sequence
  chemically synthesized
tttttaaaaacatcagtttccg

SEQ ID NO: 997858 - DNA, 22 bp, Artificial Sequence
  chemically synthesized
tttaaaaacatcagtttccgaa

SEQ ID NO: 997859 - DNA, 22 bp, Artificial Sequence
  chemically synthesized
ttaaaaacatcagtttccgaat

SEQ ID NO: 997860 - DNA, 22 bp, Artificial Sequence
  chemically synthesized
taaaaacatcagtttccgaata

SEQ ID NO: 997861 - DNA, 22 bp, Artificial Sequence
  chemically synthesized
aaaaacatcagtttccgaatat

SEQ ID NO: 997862 - DNA, 22 bp, Artificial Sequence
  chemically synthesized
agattctgtggcatattcggaa

SEQ ID NO: 997863 - DNA, 22 bp, Artificial Sequence
  chemically synthesized
aaaacatcagtttccgaatatg

SEQ ID NO: 997864 - DNA, 22 bp, Artificial Sequence
  chemically synthesized
aatcaaattaagattctgtggc

SEQ ID NO: 997865 - DNA, 22 bp, Artificial Sequence
  chemically synthesized
caatcaaattaagattctgtgg

SEQ ID NO: 997866 - DNA, 22 bp, Artificial Sequence
  chemically synthesized
ccgaatatgccacagaatctta

SEQ ID NO: 997867 - DNA, 22 bp, Artificial Sequence
  chemically synthesized
cgaatatgccacagaatcttaa

SEQ ID NO: 997868 - DNA, 22 bp, Artificial Sequence
  chemically synthesized
aatttgattgaaatgccctccc

SEQ ID NO: 997869 - DNA, 22 bp, Artificial Sequence
  chemically synthesized
agagaagggagagggagggcat

SEQ ID NO: 997870 - DNA, 22 bp, Artificial Sequence
  chemically synthesized
atttgattgaaatgccctccct

SEQ ID NO: 997871 - DNA, 22 bp, Artificial Sequence
  chemically synthesized
ttgagagaagggagagggaggg

SEQ ID NO: 997872 - DNA, 22 bp, Artificial Sequence
  chemically synthesized
gattgaaatgccctccctctcc

SEQ ID NO: 997873 - DNA, 22 bp, Artificial Sequence
  chemically synthesized
attgaaatgccctccctctccc

SEQ ID NO: 997874 - DNA, 22 bp, Artificial Sequence
  chemically synthesized
actgttgagagaagggagaggg

SEQ ID NO: 997875 - DNA, 22 bp, Artificial Sequence
  chemically synthesized
aaatgccctccctctcccttct

SEQ ID NO: 997876 - DNA, 22 bp, Artificial Sequence
  chemically synthesized
cctctcccttctctcaacagtg

SEQ ID NO: 997877 - DNA, 22 bp, Artificial Sequence
  chemically synthesized
tcccttctctcaacagtgagtc

SEQ ID NO: 997878 - DNA, 22 bp, Artificial Sequence
  chemically synthesized
aacacaaaataagactcactgt

SEQ ID NO: 997879 - DNA, 22 bp, Artificial Sequence
  chemically synthesized
ccttctctcaacagtgagtctt

SEQ ID NO: 997880 - DNA, 22 bp, Artificial Sequence
  chemically synthesized
ttgaacacaaaataagactcac

SEQ ID NO: 997881 - DNA, 22 bp, Artificial Sequence
  chemically synthesized
ctctcaacagtgagtcttattt

SEQ ID NO: 997882 - DNA, 22 bp, Artificial Sequence
  chemically synthesized
ctattgaacacaaaataagact

SEQ ID NO: 997883 - DNA, 22 bp, Artificial Sequence
  chemically synthesized
tctcaacagtgagtcttatttt

SEQ ID NO: 997884 - DNA, 22 bp, Artificial Sequence
  chemically synthesized
tcaacagtgagtcttattttgt

SEQ ID NO: 997885 - DNA, 22 bp, Artificial Sequence
  chemically synthesized
gttgctattgaacacaaaataa

SEQ ID NO: 997886 - DNA, 22 bp, Artificial Sequence
  chemically synthesized
aacagtgagtcttattttgtgt

SEQ ID NO: 997887 - DNA, 22 bp, Artificial Sequence
  chemically synthesized
agttgctattgaacacaaaata

SEQ ID NO: 997888 - DNA, 22 bp, Artificial Sequence
  chemically synthesized
gaaacatttagttgctattgaa

SEQ ID NO: 997889 - DNA, 22 bp, Artificial Sequence
  chemically synthesized
attttgtgttcaatagcaacta

SEQ ID NO: 997890 - DNA, 22 bp, Artificial Sequence
  chemically synthesized
ttttgtgttcaatagcaactaa

SEQ ID NO: 997891 - DNA, 22 bp, Artificial Sequence
  chemically synthesized
tgtgttcaatagcaactaaatg

SEQ ID NO: 997892 - DNA, 22 bp, Artificial Sequence
  chemically synthesized
acagtctggaaacatttagttg

SEQ ID NO: 997893 - DNA, 22 bp, Artificial Sequence
  chemically synthesized
gtgttcaatagcaactaaatgt

SEQ ID NO: 997894 - DNA, 22 bp, Artificial Sequence
  chemically synthesized
cacagtctggaaacatttagtt

SEQ ID NO: 997895 - DNA, 22 bp, Artificial Sequence
  chemically synthesized
tgttcaatagcaactaaatgtt

SEQ ID NO: 997896 - DNA, 22 bp, Artificial Sequence
  chemically synthesized
aatagcaactaaatgtttccag

SEQ ID NO: 997897 - DNA, 22 bp, Artificial Sequence
  chemically synthesized
agaaaggcttcacagtctggaa

SEQ ID NO: 997898 - DNA, 22 bp, Artificial Sequence
  chemically synthesized
gagaaaggcttcacagtctgga

SEQ ID NO: 997899 - DNA, 22 bp, Artificial Sequence
  chemically synthesized
aatgtttccagactgtgaagcc

SEQ ID NO: 997900 - DNA, 22 bp, Artificial Sequence
  chemically synthesized
tgggacttgagaaaggcttcac

SEQ ID NO: 997901 - DNA, 22 bp, Artificial Sequence
  chemically synthesized
ccagactgtgaagcctttctca

SEQ ID NO: 997902 - DNA, 22 bp, Artificial Sequence
  chemically synthesized
cagactgtgaagcctttctcaa

SEQ ID NO: 997903 - DNA, 22 bp, Artificial Sequence
  chemically synthesized
ccgttgtgggacttgagaaagg

SEQ ID NO: 997904 - DNA, 22 bp, Artificial Sequence
  chemically synthesized
tgaagcctttctcaagtcccac

SEQ ID NO: 997905 - DNA, 22 bp, Artificial Sequence
  chemically synthesized
tctcaagtcccacaacgggagt

SEQ ID NO: 997906 - DNA, 22 bp, Artificial Sequence
  chemically synthesized
ctcaagtcccacaacgggagtt

SEQ ID NO: 997907 - DNA, 22 bp, Artificial Sequence
  chemically synthesized
tcaagtcccacaacgggagtta

SEQ ID NO: 997908 - DNA, 22 bp, Artificial Sequence
  chemically synthesized
aagtcccacaacgggagttata

SEQ ID NO: 997909 - DNA, 22 bp, Artificial Sequence
  chemically synthesized
tgggatcataggtgacagatat

SEQ ID NO: 997910 - DNA, 22 bp, Artificial Sequence
  chemically synthesized
tatctgtcacctatgatcccac

SEQ ID NO: 997911 - DNA, 22 bp, Artificial Sequence
  chemically synthesized
tcacctatgatcccacagcacc

SEQ ID NO: 997912 - DNA, 22 bp, Artificial Sequence
  chemically synthesized
taatagaggatgaagagggtgc

SEQ ID NO: 997913 - DNA, 22 bp, Artificial Sequence
  chemically synthesized
ataatagaggatgaagagggtg

SEQ ID NO: 997914 - DNA, 22 bp, Artificial Sequence
  chemically synthesized
tgatcccacagcaccctcttca

SEQ ID NO: 997915 - DNA, 22 bp, Artificial Sequence
  chemically synthesized
tataatagaggatgaagagggt

SEQ ID NO: 997916 - DNA, 22 bp, Artificial Sequence
  chemically synthesized
aaatggtagtattttataatag

SEQ ID NO: 997917 - DNA, 22 bp, Artificial Sequence
  chemically synthesized
ttcatcctctattataaaatac

SEQ ID NO: 997918 - DNA, 22 bp, Artificial Sequence
  chemically synthesized
catcctctattataaaatacta

SEQ ID NO: 997919 - DNA, 22 bp, Artificial Sequence
  chemically synthesized
atcctctattataaaatactac

SEQ ID NO: 997920 - DNA, 22 bp, Artificial Sequence
  chemically synthesized
tattataaaatactaccatttt

SEQ ID NO: 997921 - DNA, 22 bp, Artificial Sequence
  chemically synthesized
ttataaaatactaccattttag

SEQ ID NO: 997922 - DNA, 22 bp, Artificial Sequence
  chemically synthesized
tagagtataagtctaaaatggt

SEQ ID NO: 997923 - DNA, 22 bp, Artificial Sequence
  chemically synthesized
taaaatactaccattttagact

SEQ ID NO: 997924 - DNA, 22 bp, Artificial Sequence
  chemically synthesized
ccattttagacttatactctat

SEQ ID NO: 997925 - DNA, 22 bp, Artificial Sequence
  chemically synthesized
tagacttatactctatagtgtt

SEQ ID NO: 997926 - DNA, 22 bp, Artificial Sequence
  chemically synthesized
agacttatactctatagtgttc

SEQ ID NO: 997927 - DNA, 22 bp, Artificial Sequence
  chemically synthesized
gacttatactctatagtgttct

SEQ ID NO: 997928 - DNA, 22 bp, Artificial Sequence
  chemically synthesized
atactctatagtgttctgattt

SEQ ID NO: 997929 - DNA, 22 bp, Artificial Sequence
  chemically synthesized
ggcatatgggcaaaatcagaac

SEQ ID NO: 997930 - DNA, 22 bp, Artificial Sequence
  chemically synthesized
tactctatagtgttctgatttt

SEQ ID NO: 997931 - DNA, 22 bp, Artificial Sequence
  chemically synthesized
tatagtgttctgattttgccca

SEQ ID NO: 997932 - DNA, 22 bp, Artificial Sequence
  chemically synthesized
tagtgttctgattttgcccata

SEQ ID NO: 997933 - DNA, 22 bp, Artificial Sequence
  chemically synthesized
atgtgtgagttaggcatatggg

SEQ ID NO: 997934 - DNA, 22 bp, Artificial Sequence
  chemically synthesized
tgattttgcccatatgcctaac

SEQ ID NO: 997935 - DNA, 22 bp, Artificial Sequence
  chemically synthesized
attttgcccatatgcctaactc

SEQ ID NO: 997936 - DNA, 22 bp, Artificial Sequence
  chemically synthesized
gtgatctcatgtgtgagttagg

SEQ ID NO: 997937 - DNA, 22 bp, Artificial Sequence
  chemically synthesized
agtgatctcatgtgtgagttag

SEQ ID NO: 997938 - DNA, 22 bp, Artificial Sequence
  chemically synthesized
tgcccatatgcctaactcacac

SEQ ID NO: 997939 - DNA, 22 bp, Artificial Sequence
  chemically synthesized
gcccatatgcctaactcacaca

SEQ ID NO: 997940 - DNA, 22 bp, Artificial Sequence
  chemically synthesized
cccatatgcctaactcacacat

SEQ ID NO: 997941 - DNA, 22 bp, Artificial Sequence
  chemically synthesized
gccttagtgatctcatgtgtga

SEQ ID NO: 997942 - DNA, 22 bp, Artificial Sequence
  chemically synthesized
tggccttagtgatctcatgtgt

SEQ ID NO: 997943 - DNA, 22 bp, Artificial Sequence
  chemically synthesized
ctggccttagtgatctcatgtg

SEQ ID NO: 997944 - DNA, 22 bp, Artificial Sequence
  chemically synthesized
actcacacatgagatcactaag

SEQ ID NO: 997945 - DNA, 22 bp, Artificial Sequence
  chemically synthesized
acacatgagatcactaaggcca

SEQ ID NO: 997946 - DNA, 22 bp, Artificial Sequence
  chemically synthesized
aataacatatggtttctggcct

SEQ ID NO: 997947 - DNA, 22 bp, Artificial Sequence
  chemically synthesized
aggccagaaaccatatgttatt

SEQ ID NO: 997948 - DNA, 22 bp, Artificial Sequence
  chemically synthesized
gccacataaacagaaaattgaa

SEQ ID NO: 997949 - DNA, 22 bp, Artificial Sequence
  chemically synthesized
taaggaactggccacataaaca

SEQ ID NO: 997950 - DNA, 22 bp, Artificial Sequence
  chemically synthesized
ttcaattttctgtttatgtggc

SEQ ID NO: 997951 - DNA, 22 bp, Artificial Sequence
  chemically synthesized
aattttctgtttatgtggccag

SEQ ID NO: 997952 - DNA, 22 bp, Artificial Sequence
  chemically synthesized
tctgtttatgtggccagttcct

SEQ ID NO: 997953 - DNA, 22 bp, Artificial Sequence
  chemically synthesized
ctgtttatgtggccagttcctt

SEQ ID NO: 997954 - DNA, 22 bp, Artificial Sequence
  chemically synthesized
tgtttatgtggccagttcctta

SEQ ID NO: 997955 - DNA, 22 bp, Artificial Sequence
  chemically synthesized
tttatgtggccagttccttaca

SEQ ID NO: 997956 - DNA, 22 bp, Artificial Sequence
  chemically synthesized
tataagcaaggttgtaaggaac

SEQ ID NO: 997957 - DNA, 22 bp, Artificial Sequence
  chemically synthesized
atataagcaaggttgtaaggaa

SEQ ID NO: 997958 - DNA, 22 bp, Artificial Sequence
  chemically synthesized
tatataagcaaggttgtaagga

SEQ ID NO: 997959 - DNA, 22 bp, Artificial Sequence
  chemically synthesized
atgtggccagttccttacaacc

SEQ ID NO: 997960 - DNA, 22 bp, Artificial Sequence
  chemically synthesized
tgtggccagttccttacaacct

SEQ ID NO: 997961 - DNA, 22 bp, Artificial Sequence
  chemically synthesized
tttatataagcaaggttgtaag

SEQ ID NO: 997962 - DNA, 22 bp, Artificial Sequence
  chemically synthesized
tgaatgtcctctttatataagc

SEQ ID NO: 997963 - DNA, 22 bp, Artificial Sequence
  chemically synthesized
cttacaaccttgcttatataaa

SEQ ID NO: 997964 - DNA, 22 bp, Artificial Sequence
  chemically synthesized
acaaccttgcttatataaagag

SEQ ID NO: 997965 - DNA, 22 bp, Artificial Sequence
  chemically synthesized
caaccttgcttatataaagagg

SEQ ID NO: 997966 - DNA, 22 bp, Artificial Sequence
  chemically synthesized
taaacatgttgtgaatgtcctc

SEQ ID NO: 997967 - DNA, 22 bp, Artificial Sequence
  chemically synthesized
gcttatataaagaggacattca

SEQ ID NO: 997968 - DNA, 22 bp, Artificial Sequence
  chemically synthesized
ataaacatgttgtgaatgtcct

SEQ ID NO: 997969 - DNA, 22 bp, Artificial Sequence
  chemically synthesized
cttatataaagaggacattcac

SEQ ID NO: 997970 - DNA, 22 bp, Artificial Sequence
  chemically synthesized
tataaacatgttgtgaatgtcc

SEQ ID NO: 997971 - DNA, 22 bp, Artificial Sequence
  chemically synthesized
atataaagaggacattcacaac

SEQ ID NO: 997972 - DNA, 22 bp, Artificial Sequence
  chemically synthesized
tataaagaggacattcacaaca

SEQ ID NO: 997973 - DNA, 22 bp, Artificial Sequence
  chemically synthesized
aattttataaacatgttgtgaa

SEQ ID NO: 997974 - DNA, 22 bp, Artificial Sequence
  chemically synthesized
aattcaattttataaacatgtt

SEQ ID NO: 997975 - DNA, 22 bp, Artificial Sequence
  chemically synthesized
agctgaattcaattttataaac

SEQ ID NO: 997976 - DNA, 22 bp, Artificial Sequence
  chemically synthesized
cagctgaattcaattttataaa

SEQ ID NO: 997977 - DNA, 22 bp, Artificial Sequence
  chemically synthesized
tcagctgaattcaattttataa

SEQ ID NO: 997978 - DNA, 22 bp, Artificial Sequence
  chemically synthesized
acaacatgtttataaaattgaa

SEQ ID NO: 997979 - DNA, 22 bp, Artificial Sequence
  chemically synthesized
aaaattttcagctgaattcaat

SEQ ID NO: 997980 - DNA, 22 bp, Artificial Sequence
  chemically synthesized
attaaaaattttcagctgaatt

SEQ ID NO: 997981 - DNA, 22 bp, Artificial Sequence
  chemically synthesized
ataaaattgaattcagctgaaa

SEQ ID NO: 997982 - DNA, 22 bp, Artificial Sequence
  chemically synthesized
taaaattgaattcagctgaaaa

SEQ ID NO: 997983 - DNA, 22 bp, Artificial Sequence
  chemically synthesized
agtgcaaactcattaaaaattt

SEQ ID NO: 997984 - DNA, 22 bp, Artificial Sequence
  chemically synthesized
aattcagctgaaaatttttaat

SEQ ID NO: 997985 - DNA, 22 bp, Artificial Sequence
  chemically synthesized
tcagtgcaaactcattaaaaat

SEQ ID NO: 997986 - DNA, 22 bp, Artificial Sequence
  chemically synthesized
ctcagtgcaaactcattaaaaa

SEQ ID NO: 997987 - DNA, 22 bp, Artificial Sequence
  chemically synthesized
agctgaaaatttttaatgagtt

SEQ ID NO: 997988 - DNA, 22 bp, Artificial Sequence
  chemically synthesized
atttctcagtgcaaactcatta

SEQ ID NO: 997989 - DNA, 22 bp, Artificial Sequence
  chemically synthesized
aaaatttttaatgagtttgcac

SEQ ID NO: 997990 - DNA, 22 bp, Artificial Sequence
  chemically synthesized
tctcatttctcagtgcaaactc

SEQ ID NO: 997991 - DNA, 22 bp, Artificial Sequence
  chemically synthesized
atctcatttctcagtgcaaact

SEQ ID NO: 997992 - DNA, 22 bp, Artificial Sequence
  chemically synthesized
tatctcatttctcagtgcaaac

SEQ ID NO: 997993 - DNA, 22 bp, Artificial Sequence
  chemically synthesized
ttaatgagtttgcactgagaaa

SEQ ID NO: 997994 - DNA, 22 bp, Artificial Sequence
  chemically synthesized
taatgagtttgcactgagaaat

SEQ ID NO: 997995 - DNA, 22 bp, Artificial Sequence
  chemically synthesized
aagttttatctcatttctcagt

SEQ ID NO: 997996 - DNA, 22 bp, Artificial Sequence
  chemically synthesized
aatgagtttgcactgagaaatg

SEQ ID NO: 997997 - DNA, 22 bp, Artificial Sequence
  chemically synthesized
caagttttatctcatttctcag

SEQ ID NO: 997998 - DNA, 22 bp, Artificial Sequence
  chemically synthesized
atgagtttgcactgagaaatga

SEQ ID NO: 997999 - DNA, 22 bp, Artificial Sequence
  chemically synthesized
gcactgagaaatgagataaaac

SEQ ID NO: 998000 - DNA, 22 bp, Artificial Sequence
  chemically synthesized
cactgagaaatgagataaaact

SEQ ID NO: 998001 - DNA, 22 bp, Artificial Sequence
  chemically synthesized
agaaatgagataaaacttgaag

SEQ ID NO: 998002 - DNA, 22 bp, Artificial Sequence
  chemically synthesized
tcatgcaaataccttcaagttt

SEQ ID NO: 998003 - DNA, 22 bp, Artificial Sequence
  chemically synthesized
agttatcatgcaaataccttca

SEQ ID NO: 998004 - DNA, 22 bp, Artificial Sequence
  chemically synthesized
cagttatcatgcaaataccttc

SEQ ID NO: 998005 - DNA, 22 bp, Artificial Sequence
  chemically synthesized
tcagttatcatgcaaatacctt

SEQ ID NO: 998006 - DNA, 22 bp, Artificial Sequence
  chemically synthesized
ttcagttatcatgcaaatacct

SEQ ID NO: 998007 - DNA, 22 bp, Artificial Sequence
  chemically synthesized
gaaggtatttgcatgataactg

SEQ ID NO: 998008 - DNA, 22 bp, Artificial Sequence
  chemically synthesized
aaggtatttgcatgataactga

SEQ ID NO: 998009 - DNA, 22 bp, Artificial Sequence
  chemically synthesized
atccacagcttttcagttatca

SEQ ID NO: 998010 - DNA, 22 bp, Artificial Sequence
  chemically synthesized
gatccacagcttttcagttatc

SEQ ID NO: 998011 - DNA, 22 bp, Artificial Sequence
  chemically synthesized
atttgatccacagcttttcagt

SEQ ID NO: 998012 - DNA, 22 bp, Artificial Sequence
  chemically synthesized
gatttgatccacagcttttcag

SEQ ID NO: 998013 - DNA, 22 bp, Artificial Sequence
  chemically synthesized
tgatttgatccacagcttttca

SEQ ID NO: 998014 - DNA, 22 bp, Artificial Sequence
  chemically synthesized
gcatgataactgaaaagctgtg

SEQ ID NO: 998015 - DNA, 22 bp, Artificial Sequence
  chemically synthesized
catgataactgaaaagctgtgg

SEQ ID NO: 998016 - DNA, 22 bp, Artificial Sequence
  chemically synthesized
tgatctttgatttgatccacag

SEQ ID NO: 998017 - DNA, 22 bp, Artificial Sequence
  chemically synthesized
tatgatctttgatttgatccac

SEQ ID NO: 998018 - DNA, 22 bp, Artificial Sequence
  chemically synthesized
aaaagctgtggatcaaatcaaa

SEQ ID NO: 998019 - DNA, 22 bp, Artificial Sequence
  chemically synthesized
caagatacctctatgatctttg

SEQ ID NO: 998020 - DNA, 22 bp, Artificial Sequence
  chemically synthesized
tggatcaaatcaaagatcatag

SEQ ID NO: 998021 - DNA, 22 bp, Artificial Sequence
  chemically synthesized
tggtgtattccaagatacctct

SEQ ID NO: 998022 - DNA, 22 bp, Artificial Sequence
  chemically synthesized
caaactgtggtgtattccaaga

SEQ ID NO: 998023 - DNA, 22 bp, Artificial Sequence
  chemically synthesized
atacctccaaactgtggtgtat

SEQ ID NO: 998024 - DNA, 22 bp, Artificial Sequence
  chemically synthesized
tgatacctccaaactgtggtgt

SEQ ID NO: 998025 - DNA, 22 bp, Artificial Sequence
  chemically synthesized
ggaatacaccacagtttggagg

SEQ ID NO: 998026 - DNA, 22 bp, Artificial Sequence
  chemically synthesized
gaatacaccacagtttggaggt

SEQ ID NO: 998027 - DNA, 22 bp, Artificial Sequence
  chemically synthesized
gccagatcattctgatacctcc

SEQ ID NO: 998028 - DNA, 22 bp, Artificial Sequence
  chemically synthesized
agccagatcattctgatacctc

SEQ ID NO: 998029 - DNA, 22 bp, Artificial Sequence
  chemically synthesized
ggaggtatcagaatgatctggc

SEQ ID NO: 998030 - DNA, 22 bp, Artificial Sequence
  chemically synthesized
gaggtatcagaatgatctggct

SEQ ID NO: 998031 - DNA, 22 bp, Artificial Sequence
  chemically synthesized
caacaaatacttagccagatca

SEQ ID NO: 998032 - DNA, 22 bp, Artificial Sequence
  chemically synthesized
tactgcaacaaatacttagcca

SEQ ID NO: 998033 - DNA, 22 bp, Artificial Sequence
  chemically synthesized
aaacaaaatcctatactgcaac

SEQ ID NO: 998034 - DNA, 22 bp, Artificial Sequence
  chemically synthesized
gctaagtatttgttgcagtata

SEQ ID NO: 998035 - DNA, 22 bp, Artificial Sequence
  chemically synthesized
aaaacaaaatcctatactgcaa

SEQ ID NO: 998036 - DNA, 22 bp, Artificial Sequence
  chemically synthesized
agtatttgttgcagtataggat

SEQ ID NO: 998037 - DNA, 22 bp, Artificial Sequence
  chemically synthesized
atgtccttaaaacaaaatccta

SEQ ID NO: 998038 - DNA, 22 bp, Artificial Sequence
  chemically synthesized
gttgcagtataggattttgttt

SEQ ID NO: 998039 - DNA, 22 bp, Artificial Sequence
  chemically synthesized
ttgcagtataggattttgtttt

SEQ ID NO: 998040 - DNA, 22 bp, Artificial Sequence
  chemically synthesized
cagtataggattttgttttaag

SEQ ID NO: 998041 - DNA, 22 bp, Artificial Sequence
  chemically synthesized
agcagttaatgtccttaaaaca

SEQ ID NO: 998042 - DNA, 22 bp, Artificial Sequence
  chemically synthesized
attgagcagttaatgtccttaa

SEQ ID NO: 998043 - DNA, 22 bp, Artificial Sequence
  chemically synthesized
aattgagcagttaatgtcctta

SEQ ID NO: 998044 - DNA, 22 bp, Artificial Sequence
  chemically synthesized
taattgagcagttaatgtcctt

SEQ ID NO: 998045 - DNA, 22 bp, Artificial Sequence
  chemically synthesized
ttaattgagcagttaatgtcct

SEQ ID NO: 998046 - DNA, 22 bp, Artificial Sequence
  chemically synthesized
tttaattgagcagttaatgtcc

SEQ ID NO: 998047 - DNA, 22 bp, Artificial Sequence
  chemically synthesized
ttttaattgagcagttaatgtc

SEQ ID NO: 998048 - DNA, 22 bp, Artificial Sequence
  chemically synthesized
tttttaattgagcagttaatgt

SEQ ID NO: 998049 - DNA, 22 bp, Artificial Sequence
  chemically synthesized
ttttttaattgagcagttaatg

SEQ ID NO: 998050 - DNA, 22 bp, Artificial Sequence
  chemically synthesized
tgttttaaggacattaactgct

SEQ ID NO: 998051 - DNA, 22 bp, Artificial Sequence
  chemically synthesized
gttttaaggacattaactgctc

SEQ ID NO: 998052 - DNA, 22 bp, Artificial Sequence
  chemically synthesized
ttttaaggacattaactgctca

SEQ ID NO: 998053 - DNA, 22 bp, Artificial Sequence
  chemically synthesized
taaggacattaactgctcaatt

SEQ ID NO: 998054 - DNA, 22 bp, Artificial Sequence
  chemically synthesized
aaggacattaactgctcaatta

SEQ ID NO: 998055 - DNA, 22 bp, Artificial Sequence
  chemically synthesized
aggacattaactgctcaattaa

SEQ ID NO: 998056 - DNA, 22 bp, Artificial Sequence
  chemically synthesized
agtccaatttttttttaattga

SEQ ID NO: 998057 - DNA, 22 bp, Artificial Sequence
  chemically synthesized
actgctcaattaaaaaaaaatt

SEQ ID NO: 998058 - DNA, 22 bp, Artificial Sequence
  chemically synthesized
ctcaattaaaaaaaaattggac

SEQ ID NO: 998059 - DNA, 22 bp, Artificial Sequence
  chemically synthesized
aaaataaaattgagtccaattt

SEQ ID NO: 998060 - DNA, 22 bp, Artificial Sequence
  chemically synthesized
aattaaaaaaaaattggactca

SEQ ID NO: 998061 - DNA, 22 bp, Artificial Sequence
  chemically synthesized
aaaaaaaattggactcaatttt

SEQ ID NO: 998062 - DNA, 22 bp, Artificial Sequence
  chemically synthesized
gactcaattttattttcagctt

SEQ ID NO: 998063 - DNA, 22 bp, Artificial Sequence
  chemically synthesized
aattttattttcagcttgtgat

SEQ ID NO: 998064 - DNA, 22 bp, Artificial Sequence
  chemically synthesized
tattttcagcttgtgatacctg

SEQ ID NO: 998065 - DNA, 22 bp, Artificial Sequence
  chemically synthesized
attttcagcttgtgatacctga

SEQ ID NO: 998066 - DNA, 22 bp, Artificial Sequence
  chemically synthesized
ttttcagcttgtgatacctgat

SEQ ID NO: 998067 - DNA, 22 bp, Artificial Sequence
  chemically synthesized
tcagcttgtgatacctgatttt

SEQ ID NO: 998068 - DNA, 22 bp, Artificial Sequence
  chemically synthesized
cagcttgtgatacctgattttg

SEQ ID NO: 998069 - DNA, 22 bp, Artificial Sequence
  chemically synthesized
agcttgtgatacctgattttgg

SEQ ID NO: 998070 - DNA, 22 bp, Artificial Sequence
  chemically synthesized
gtgatacctgattttggtgtgt

SEQ ID NO: 998071 - DNA, 22 bp, Artificial Sequence
  chemically synthesized
tgatacctgattttggtgtgtg

SEQ ID NO: 998072 - DNA, 22 bp, Artificial Sequence
  chemically synthesized
attttggtgtgtgtgtgtgtgt

SEQ ID NO: 998073 - DNA, 22 bp, Artificial Sequence
  chemically synthesized
tggtgtgtgtgtgtgtgtgtgt

SEQ ID NO: 998074 - DNA, 22 bp, Artificial Sequence
  chemically synthesized
ggtgtgtgtgtgtgtgtgtgtg

SEQ ID NO: 998075 - DNA, 22 bp, Artificial Sequence
  chemically synthesized
gtgtgtgtgtgtgtgtgtgtgt

SEQ ID NO: 998076 - DNA, 22 bp, Artificial Sequence
  chemically synthesized
aaaatgtaaaagtacacacata

SEQ ID NO: 998077 - DNA, 22 bp, Artificial Sequence
  chemically synthesized
ctgaaaatgtaaaagtacacac

SEQ ID NO: 998078 - DNA, 22 bp, Artificial Sequence
  chemically synthesized
ccacatgctgctgaaaatgtaa

SEQ ID NO: 998079 - DNA, 22 bp, Artificial Sequence
  chemically synthesized
ttacattttcagcagcatgtgg

SEQ ID NO: 998080 - DNA, 22 bp, Artificial Sequence
  chemically synthesized
aaaagccacctgccacatgctg

SEQ ID NO: 998081 - DNA, 22 bp, Artificial Sequence
  chemically synthesized
tacattttcagcagcatgtggc

SEQ ID NO: 998082 - DNA, 22 bp, Artificial Sequence
  chemically synthesized
acattttcagcagcatgtggca

SEQ ID NO: 998083 - DNA, 22 bp, Artificial Sequence
  chemically synthesized
cattttcagcagcatgtggcag

SEQ ID NO: 998084 - DNA, 22 bp, Artificial Sequence
  chemically synthesized
tcagcagcatgtggcaggtggc

SEQ ID NO: 998085 - DNA, 22 bp, Artificial Sequence
  chemically synthesized
cagcagcatgtggcaggtggct

SEQ ID NO: 998086 - DNA, 22 bp, Artificial Sequence
  chemically synthesized
agcagcatgtggcaggtggctt

SEQ ID NO: 998087 - DNA, 22 bp, Artificial Sequence
  chemically synthesized
tttagggtacactattcctgtg

SEQ ID NO: 998088 - DNA, 22 bp, Artificial Sequence
  chemically synthesized
ttagggtacactattcctgtga

SEQ ID NO: 998089 - DNA, 22 bp, Artificial Sequence
  chemically synthesized
tagggtacactattcctgtgac

SEQ ID NO: 998090 - DNA, 22 bp, Artificial Sequence
  chemically synthesized
tcacgtcaacaggtcacaggaa

SEQ ID NO: 998091 - DNA, 22 bp, Artificial Sequence
  chemically synthesized
agggtacactattcctgtgacc

SEQ ID NO: 998092 - DNA, 22 bp, Artificial Sequence
  chemically synthesized
gtcacgtcaacaggtcacagga

SEQ ID NO: 998093 - DNA, 22 bp, Artificial Sequence
  chemically synthesized
gggtacactattcctgtgacct

SEQ ID NO: 998094 - DNA, 22 bp, Artificial Sequence
  chemically synthesized
tgtcacgtcaacaggtcacagg

SEQ ID NO: 998095 - DNA, 22 bp, Artificial Sequence
  chemically synthesized
tttgtcacgtcaacaggtcaca

SEQ ID NO: 998096 - DNA, 22 bp, Artificial Sequence
  chemically synthesized
ttcctgtgacctgttgacgtga

SEQ ID NO: 998097 - DNA, 22 bp, Artificial Sequence
  chemically synthesized
caacgacctctttgtcacgtca

SEQ ID NO: 998098 - DNA, 22 bp, Artificial Sequence
  chemically synthesized
ctgtgacctgttgacgtgacaa

SEQ ID NO: 998099 - DNA, 22 bp, Artificial Sequence
  chemically synthesized
tccaacgacctctttgtcacgt

SEQ ID NO: 998100 - DNA, 22 bp, Artificial Sequence
  chemically synthesized
ctccaacgacctctttgtcacg

SEQ ID NO: 998101 - DNA, 22 bp, Artificial Sequence
  chemically synthesized
tgacctgttgacgtgacaaaga

SEQ ID NO: 998102 - DNA, 22 bp, Artificial Sequence
  chemically synthesized
tctccaacgacctctttgtcac

SEQ ID NO: 998103 - DNA, 22 bp, Artificial Sequence
  chemically synthesized
ttctccaacgacctctttgtca

SEQ ID NO: 998104 - DNA, 22 bp, Artificial Sequence
  chemically synthesized
tttctccaacgacctctttgtc

SEQ ID NO: 998105 - DNA, 22 bp, Artificial Sequence
  chemically synthesized
ttttctccaacgacctctttgt

SEQ ID NO: 998106 - DNA, 22 bp, Artificial Sequence
  chemically synthesized
ttgacgtgacaaagaggtcgtt

SEQ ID NO: 998107 - DNA, 22 bp, Artificial Sequence
  chemically synthesized
acgtgacaaagaggtcgttgga

SEQ ID NO: 998108 - DNA, 22 bp, Artificial Sequence
  chemically synthesized
atgaggagtgatttttttctcc

SEQ ID NO: 998109 - DNA, 22 bp, Artificial Sequence
  chemically synthesized
tactcatgaggagtgatttttt

SEQ ID NO: 998110 - DNA, 22 bp, Artificial Sequence
  chemically synthesized
ctgtactcatgaggagtgattt

SEQ ID NO: 998111 - DNA, 22 bp, Artificial Sequence
  chemically synthesized
gagaaaaaaatcactcctcatg

SEQ ID NO: 998112 - DNA, 22 bp, Artificial Sequence
  chemically synthesized
ggatactactgtactcatgagg

SEQ ID NO: 998113 - DNA, 22 bp, Artificial Sequence
  chemically synthesized
gggatactactgtactcatgag

SEQ ID NO: 998114 - DNA, 22 bp, Artificial Sequence
  chemically synthesized
ttgggatactactgtactcatg

SEQ ID NO: 998115 - DNA, 22 bp, Artificial Sequence
  chemically synthesized
tcttgggatactactgtactca

SEQ ID NO: 998116 - DNA, 22 bp, Artificial Sequence
  chemically synthesized
cctctcttgggatactactgta

SEQ ID NO: 998117 - DNA, 22 bp, Artificial Sequence
  chemically synthesized
ctcatgagtacagtagtatccc

SEQ ID NO: 998118 - DNA, 22 bp, Artificial Sequence
  chemically synthesized
atgagtacagtagtatcccaag

SEQ ID NO: 998119 - DNA, 22 bp, Artificial Sequence
  chemically synthesized
tgtcatgtgtgagtgtgatctg

SEQ ID NO: 998120 - DNA, 22 bp, Artificial Sequence
  chemically synthesized
atgtcatgtgtgagtgtgatct

SEQ ID NO: 998121 - DNA, 22 bp, Artificial Sequence
  chemically synthesized
ttatgtcatgtgtgagtgtgat

SEQ ID NO: 998122 - DNA, 22 bp, Artificial Sequence
  chemically synthesized
attcttatgtcatgtgtgagtg

SEQ ID NO: 998123 - DNA, 22 bp, Artificial Sequence
  chemically synthesized
gattcttatgtcatgtgtgagt

SEQ ID NO: 998124 - DNA, 22 bp, Artificial Sequence
  chemically synthesized
agtaaaacttgattcttatgtc

SEQ ID NO: 998125 - DNA, 22 bp, Artificial Sequence
  chemically synthesized
cagtaaaacttgattcttatgt

SEQ ID NO: 998126 - DNA, 22 bp, Artificial Sequence
  chemically synthesized
tcagtaaaacttgattcttatg

SEQ ID NO: 998127 - DNA, 22 bp, Artificial Sequence
  chemically synthesized
ttcagtaaaacttgattcttat

SEQ ID NO: 998128 - DNA, 22 bp, Artificial Sequence
  chemically synthesized
acacatgacataagaatcaagt

SEQ ID NO: 998129 - DNA, 22 bp, Artificial Sequence
  chemically synthesized
tgatttttcagtaaaacttgat

SEQ ID NO: 998130 - DNA, 22 bp, Artificial Sequence
  chemically synthesized
tatgatttttcagtaaaacttg

SEQ ID NO: 998131 - DNA, 22 bp, Artificial Sequence
  chemically synthesized
aaaacacctctatgatttttca

SEQ ID NO: 998132 - DNA, 22 bp, Artificial Sequence
  chemically synthesized
ctaaaaacacctctatgatttt

SEQ ID NO: 998133 - DNA, 22 bp, Artificial Sequence
  chemically synthesized
actaaaaacacctctatgattt

SEQ ID NO: 998134 - DNA, 22 bp, Artificial Sequence
  chemically synthesized
tactaaaaacacctctatgatt

SEQ ID NO: 998135 - DNA, 22 bp, Artificial Sequence
  chemically synthesized
ctttactaaaaacacctctatg

SEQ ID NO: 998136 - DNA, 22 bp, Artificial Sequence
  chemically synthesized
tactgaaaaatcatagaggtgt

SEQ ID NO: 998137 - DNA, 22 bp, Artificial Sequence
  chemically synthesized
actgaaaaatcatagaggtgtt

SEQ ID NO: 998138 - DNA, 22 bp, Artificial Sequence
  chemically synthesized
ctgaaaaatcatagaggtgttt

SEQ ID NO: 998139 - DNA, 22 bp, Artificial Sequence
  chemically synthesized
attgctttactaaaaacacctc

SEQ ID NO: 998140 - DNA, 22 bp, Artificial Sequence
  chemically synthesized
aattgctttactaaaaacacct

SEQ ID NO: 998141 - DNA, 22 bp, Artificial Sequence
  chemically synthesized
aaaaatcatagaggtgttttta

SEQ ID NO: 998142 - DNA, 22 bp, Artificial Sequence
  chemically synthesized
ttaattgctttactaaaaacac

SEQ ID NO: 998143 - DNA, 22 bp, Artificial Sequence
  chemically synthesized
cttaattgctttactaaaaaca

SEQ ID NO: 998144 - DNA, 22 bp, Artificial Sequence
  chemically synthesized
tcttaattgctttactaaaaac

SEQ ID NO: 998145 - DNA, 22 bp, Artificial Sequence
  chemically synthesized
ttttcttaattgctttactaaa

SEQ ID NO: 998146 - DNA, 22 bp, Artificial Sequence
  chemically synthesized
ttagtaaagcaattaagaaaat

SEQ ID NO: 998147 - DNA, 22 bp, Artificial Sequence
  chemically synthesized
tagtaaagcaattaagaaaata

SEQ ID NO: 998148 - DNA, 22 bp, Artificial Sequence
  chemically synthesized
agtaaagcaattaagaaaataa

SEQ ID NO: 998149 - DNA, 22 bp, Artificial Sequence
  chemically synthesized
gtaaagcaattaagaaaataat

SEQ ID NO: 998150 - DNA, 22 bp, Artificial Sequence
  chemically synthesized
agaaaataatctttttcttata

SEQ ID NO: 998151 - DNA, 22 bp, Artificial Sequence
  chemically synthesized
ggaagcatcagaaatatataag

SEQ ID NO: 998152 - DNA, 22 bp, Artificial Sequence
  chemically synthesized
aggaagcatcagaaatatataa

SEQ ID NO: 998153 - DNA, 22 bp, Artificial Sequence
  chemically synthesized
taggaagcatcagaaatatata

SEQ ID NO: 998154 - DNA, 22 bp, Artificial Sequence
  chemically synthesized
ttaggaagcatcagaaatatat

SEQ ID NO: 998155 - DNA, 22 bp, Artificial Sequence
  chemically synthesized
tttcttatatatttctgatgct

SEQ ID NO: 998156 - DNA, 22 bp, Artificial Sequence
  chemically synthesized
ttcttatatatttctgatgctt

SEQ ID NO: 998157 - DNA, 22 bp, Artificial Sequence
  chemically synthesized
tcttatatatttctgatgcttc

SEQ ID NO: 998158 - DNA, 22 bp, Artificial Sequence
  chemically synthesized
cttatatatttctgatgcttcc

SEQ ID NO: 998159 - DNA, 22 bp, Artificial Sequence
  chemically synthesized
ttatatatttctgatgcttcct

SEQ ID NO: 998160 - DNA, 22 bp, Artificial Sequence
  chemically synthesized
atatatttctgatgcttcctaa

SEQ ID NO: 998161 - DNA, 22 bp, Artificial Sequence
  chemically synthesized
tatatttctgatgcttcctaaa

SEQ ID NO: 998162 - DNA, 22 bp, Artificial Sequence
  chemically synthesized
ctgatgcttcctaaaaattatt

SEQ ID NO: 998163 - DNA, 22 bp, Artificial Sequence
  chemically synthesized
tgatgcttcctaaaaattatta

SEQ ID NO: 998164 - DNA, 22 bp, Artificial Sequence
  chemically synthesized
atgcttcctaaaaattattatt

SEQ ID NO: 998165 - DNA, 22 bp, Artificial Sequence
  chemically synthesized
cctaaaaattattattatgatt

SEQ ID NO: 998166 - DNA, 22 bp, Artificial Sequence
  chemically synthesized
aataataatcataatcataata

SEQ ID NO: 998167 - DNA, 22 bp, Artificial Sequence
  chemically synthesized
ctaaaaattattattatgatta

SEQ ID NO: 998168 - DNA, 22 bp, Artificial Sequence
  chemically synthesized
aaaattattattatgattatga

SEQ ID NO: 998169 - DNA, 22 bp, Artificial Sequence
  chemically synthesized
cgtctcaataataatcataatc

SEQ ID NO: 998170 - DNA, 22 bp, Artificial Sequence
  chemically synthesized
ttattatgattatgattattat

SEQ ID NO: 998171 - DNA, 22 bp, Artificial Sequence
  chemically synthesized
gactccgtctcaataataatca

SEQ ID NO: 998172 - DNA, 22 bp, Artificial Sequence
  chemically synthesized
ttatgattatgattattattga

SEQ ID NO: 998173 - DNA, 22 bp, Artificial Sequence
  chemically synthesized
tgattatgattattattgagac

SEQ ID NO: 998174 - DNA, 22 bp, Artificial Sequence
  chemically synthesized
tgattattattgagacggagtc

SEQ ID NO: 998175 - DNA, 22 bp, Artificial Sequence
  chemically synthesized
gtgacagagctagactccgtct

SEQ ID NO: 998176 - DNA, 22 bp, Artificial Sequence
  chemically synthesized
ttattgagacggagtctagctc

SEQ ID NO: 998177 - DNA, 22 bp, Artificial Sequence
  chemically synthesized
cagcctggtgacagagctagac

SEQ ID NO: 998178 - DNA, 22 bp, Artificial Sequence
  chemically synthesized
ttgagacggagtctagctctgt

SEQ ID NO: 998179 - DNA, 22 bp, Artificial Sequence
  chemically synthesized
agacggagtctagctctgtcac

SEQ ID NO: 998180 - DNA, 22 bp, Artificial Sequence
  chemically synthesized
cactccagcctggtgacagagc

SEQ ID NO: 998181 - DNA, 22 bp, Artificial Sequence
  chemically synthesized
gctctgtcaccaggctggagtg

SEQ ID NO: 998182 - DNA, 22 bp, Artificial Sequence
  chemically synthesized
tgtcaccaggctggagtgcagt

SEQ ID NO: 998183 - DNA, 22 bp, Artificial Sequence
  chemically synthesized
tcaccaggctggagtgcagtgg

SEQ ID NO: 998184 - DNA, 22 bp, Artificial Sequence
  chemically synthesized
cagtgagccgagatcgcgccac

SEQ ID NO: 998185 - DNA, 22 bp, Artificial Sequence
  chemically synthesized
gagtgcagtggcgcgatctcgg

SEQ ID NO: 998186 - DNA, 22 bp, Artificial Sequence
  chemically synthesized
ggaggcggaggttgcagtgagc

SEQ ID NO: 998187 - DNA, 22 bp, Artificial Sequence
  chemically synthesized
aacctgggaggcggaggttgca

SEQ ID NO: 998188 - DNA, 22 bp, Artificial Sequence
  chemically synthesized
gaacctgggaggcggaggttgc

SEQ ID NO: 998189 - DNA, 22 bp, Artificial Sequence
  chemically synthesized
ggctcactgcaacctccgcctc

SEQ ID NO: 998190 - DNA, 22 bp, Artificial Sequence
  chemically synthesized
actgcaacctccgcctcccagg

SEQ ID NO: 998191 - DNA, 22 bp, Artificial Sequence
  chemically synthesized
caacctccgcctcccaggttca

SEQ ID NO: 998192 - DNA, 22 bp, Artificial Sequence
  chemically synthesized
aggcaggagaatcacttgaacc

SEQ ID NO: 998193 - DNA, 22 bp, Artificial Sequence
  chemically synthesized
cgcctcccaggttcaagtgatt

SEQ ID NO: 998194 - DNA, 22 bp, Artificial Sequence
  chemically synthesized
ccaggttcaagtgattctcctg

SEQ ID NO: 998195 - DNA, 22 bp, Artificial Sequence
  chemically synthesized
gggaggctgaggcaggagaatc

SEQ ID NO: 998196 - DNA, 22 bp, Artificial Sequence
  chemically synthesized
ctcgggaggctgaggcaggaga

SEQ ID NO: 998197 - DNA, 22 bp, Artificial Sequence
  chemically synthesized
aagtgattctcctgcctcagcc

SEQ ID NO: 998198 - DNA, 22 bp, Artificial Sequence
  chemically synthesized
taatcccagctactcgggaggc

SEQ ID NO: 998199 - DNA, 22 bp, Artificial Sequence
  chemically synthesized
tcctgcctcagcctcccgagta

SEQ ID NO: 998200 - DNA, 22 bp, Artificial Sequence
  chemically synthesized
ctgcctcagcctcccgagtagc

SEQ ID NO: 998201 - DNA, 22 bp, Artificial Sequence
  chemically synthesized
cctcagcctcccgagtagctgg

SEQ ID NO: 998202 - DNA, 22 bp, Artificial Sequence
  chemically synthesized
agcctcccgagtagctgggatt

SEQ ID NO: 998203 - DNA, 22 bp, Artificial Sequence
  chemically synthesized
ccgagtagctgggattacaggc

SEQ ID NO: 998204 - DNA, 22 bp, Artificial Sequence
  chemically synthesized
gccgtgcatggcagcgcatgcc

SEQ ID NO: 998205 - DNA, 22 bp, Artificial Sequence
  chemically synthesized
ggattacaggcatgcgctgcca

SEQ ID NO: 998206 - DNA, 22 bp, Artificial Sequence
  chemically synthesized
caggcatgcgctgccatgcacg

SEQ ID NO: 998207 - DNA, 22 bp, Artificial Sequence
  chemically synthesized
aaaatacaaaaattagccgtgc

SEQ ID NO: 998208 - DNA, 22 bp, Artificial Sequence
  chemically synthesized
ctaaaaatacaaaaattagccg

SEQ ID NO: 998209 - DNA, 22 bp, Artificial Sequence
  chemically synthesized
tactaaaaatacaaaaattagc

SEQ ID NO: 998210 - DNA, 22 bp, Artificial Sequence
  chemically synthesized
ccatgcacggctaatttttgta

SEQ ID NO: 998211 - DNA, 22 bp, Artificial Sequence
  chemically synthesized
cgtctctactaaaaatacaaaa

SEQ ID NO: 998212 - DNA, 22 bp, Artificial Sequence
  chemically synthesized
atttttgtatttttagtagaga

SEQ ID NO: 998213 - DNA, 22 bp, Artificial Sequence
  chemically synthesized
ttgtatttttagtagagacgga

SEQ ID NO: 998214 - DNA, 22 bp, Artificial Sequence
  chemically synthesized
acacggtgaaactccgtctcta

SEQ ID NO: 998215 - DNA, 22 bp, Artificial Sequence
  chemically synthesized
tgtatttttagtagagacggag

SEQ ID NO: 998216 - DNA, 22 bp, Artificial Sequence
  chemically synthesized
gtatttttagtagagacggagt

SEQ ID NO: 998217 - DNA, 22 bp, Artificial Sequence
  chemically synthesized
tatttttagtagagacggagtt

SEQ ID NO: 998218 - DNA, 22 bp, Artificial Sequence
  chemically synthesized
gctaacacggtgaaactccgtc

SEQ ID NO: 998219 - DNA, 22 bp, Artificial Sequence
  chemically synthesized
ttagtagagacggagtttcacc

SEQ ID NO: 998220 - DNA, 22 bp, Artificial Sequence
  chemically synthesized
tagtagagacggagtttcaccg

SEQ ID NO: 998221 - DNA, 22 bp, Artificial Sequence
  chemically synthesized
agtagagacggagtttcaccgt

SEQ ID NO: 998222 - DNA, 22 bp, Artificial Sequence
  chemically synthesized
gtagagacggagtttcaccgtg

SEQ ID NO: 998223 - DNA, 22 bp, Artificial Sequence
  chemically synthesized
caccgtgttagccaggatggtc

SEQ ID NO: 998224 - DNA, 22 bp, Artificial Sequence
  chemically synthesized
accgtgttagccaggatggtct

SEQ ID NO: 998225 - DNA, 22 bp, Artificial Sequence
  chemically synthesized
gccaggatggtctcgatttcct

SEQ ID NO: 998226 - DNA, 22 bp, Artificial Sequence
  chemically synthesized
gatttcctgacctcatgatctg

SEQ ID NO: 998227 - DNA, 22 bp, Artificial Sequence
  chemically synthesized
ggaggccgaggtgggcagatca

SEQ ID NO: 998228 - DNA, 22 bp, Artificial Sequence
  chemically synthesized
gggaggccgaggtgggcagatc

SEQ ID NO: 998229 - DNA, 22 bp, Artificial Sequence
  chemically synthesized
cctgacctcatgatctgcccac

SEQ ID NO: 998230 - DNA, 22 bp, Artificial Sequence
  chemically synthesized
tgggaggccgaggtgggcagat

SEQ ID NO: 998231 - DNA, 22 bp, Artificial Sequence
  chemically synthesized
ctgacctcatgatctgcccacc

SEQ ID NO: 998232 - DNA, 22 bp, Artificial Sequence
  chemically synthesized
acctcatgatctgcccacctcg

SEQ ID NO: 998233 - DNA, 22 bp, Artificial Sequence
  chemically synthesized
atgatctgcccacctcggcctc

SEQ ID NO: 998234 - DNA, 22 bp, Artificial Sequence
  chemically synthesized
taatcccagcactttgggaggc

SEQ ID NO: 998235 - DNA, 22 bp, Artificial Sequence
  chemically synthesized
cccacctcggcctcccaaagtg

SEQ ID NO: 998236 - DNA, 22 bp, Artificial Sequence
  chemically synthesized
acacctgtaatcccagcacttt

SEQ ID NO: 998237 - DNA, 22 bp, Artificial Sequence
  chemically synthesized
ggcctcccaaagtgctgggatt

SEQ ID NO: 998238 - DNA, 22 bp, Artificial Sequence
  chemically synthesized
cggtggctcacacctgtaatcc

SEQ ID NO: 998239 - DNA, 22 bp, Artificial Sequence
  chemically synthesized
ccaaagtgctgggattacaggt

SEQ ID NO: 998240 - DNA, 22 bp, Artificial Sequence
  chemically synthesized
gttgcggtggctcacacctgta

SEQ ID NO: 998241 - DNA, 22 bp, Artificial Sequence
  chemically synthesized
ggattacaggtgtgagccaccg

SEQ ID NO: 998242 - DNA, 22 bp, Artificial Sequence
  chemically synthesized
ggaggctggttgcggtggctca

SEQ ID NO: 998243 - DNA, 22 bp, Artificial Sequence
  chemically synthesized
aggaggctggttgcggtggctc

SEQ ID NO: 998244 - DNA, 22 bp, Artificial Sequence
  chemically synthesized
taggaggctggttgcggtggct

SEQ ID NO: 998245 - DNA, 22 bp, Artificial Sequence
  chemically synthesized
ttaggaggctggttgcggtggc

SEQ ID NO: 998246 - DNA, 22 bp, Artificial Sequence
  chemically synthesized
caggtgtgagccaccgcaacca

SEQ ID NO: 998247 - DNA, 22 bp, Artificial Sequence
  chemically synthesized
taagataatttttaggaggctg

SEQ ID NO: 998248 - DNA, 22 bp, Artificial Sequence
  chemically synthesized
ataagataatttttaggaggct

SEQ ID NO: 998249 - DNA, 22 bp, Artificial Sequence
  chemically synthesized
tttataagataatttttaggag

SEQ ID NO: 998250 - DNA, 22 bp, Artificial Sequence
  chemically synthesized
atttataagataatttttagga

SEQ ID NO: 998251 - DNA, 22 bp, Artificial Sequence
  chemically synthesized
gtcttatttataagataatttt

SEQ ID NO: 998252 - DNA, 22 bp, Artificial Sequence
  chemically synthesized
attagtcttatttataagataa

SEQ ID NO: 998253 - DNA, 22 bp, Artificial Sequence
  chemically synthesized
attgattagtcttatttataag

SEQ ID NO: 998254 - DNA, 22 bp, Artificial Sequence
  chemically synthesized
ctaaaaattatcttataaataa

SEQ ID NO: 998255 - DNA, 22 bp, Artificial Sequence
  chemically synthesized
aattgattagtcttatttataa

SEQ ID NO: 998256 - DNA, 22 bp, Artificial Sequence
  chemically synthesized
taattgattagtcttatttata

SEQ ID NO: 998257 - DNA, 22 bp, Artificial Sequence
  chemically synthesized
aaaattatcttataaataagac

SEQ ID NO: 998258 - DNA, 22 bp, Artificial Sequence
  chemically synthesized
aaatattttaattgattagtct

SEQ ID NO: 998259 - DNA, 22 bp, Artificial Sequence
  chemically synthesized
tcttataaataagactaatcaa

SEQ ID NO: 998260 - DNA, 22 bp, Artificial Sequence
  chemically synthesized
aaaatattttaattgattagtc

SEQ ID NO: 998261 - DNA, 22 bp, Artificial Sequence
  chemically synthesized
taaaatattttaattgattagt

SEQ ID NO: 998262 - DNA, 22 bp, Artificial Sequence
  chemically synthesized
ataaataagactaatcaattaa

SEQ ID NO: 998263 - DNA, 22 bp, Artificial Sequence
  chemically synthesized
taaataagactaatcaattaaa

SEQ ID NO: 998264 - DNA, 22 bp, Artificial Sequence
  chemically synthesized
gaagaaaaatatctttaaaata

SEQ ID NO: 998265 - DNA, 22 bp, Artificial Sequence
  chemically synthesized
atcaattaaaatattttaaaga

SEQ ID NO: 998266 - DNA, 22 bp, Artificial Sequence
  chemically synthesized
aaatattttaaagatatttttc

SEQ ID NO: 998267 - DNA, 22 bp, Artificial Sequence
  chemically synthesized
gaagtatagttagaagaaaaat

SEQ ID NO: 998268 - DNA, 22 bp, Artificial Sequence
  chemically synthesized
ggaagtatagttagaagaaaaa

SEQ ID NO: 998269 - DNA, 22 bp, Artificial Sequence
  chemically synthesized
taaagatatttttcttctaact

SEQ ID NO: 998270 - DNA, 22 bp, Artificial Sequence
  chemically synthesized
aaagatatttttcttctaacta

SEQ ID NO: 998271 - DNA, 22 bp, Artificial Sequence
  chemically synthesized
aagatatttttcttctaactat

SEQ ID NO: 998272 - DNA, 22 bp, Artificial Sequence
  chemically synthesized
ttcttctaactatacttccaaa

SEQ ID NO: 998273 - DNA, 22 bp, Artificial Sequence
  chemically synthesized
tcttctaactatacttccaaat

SEQ ID NO: 998274 - DNA, 22 bp, Artificial Sequence
  chemically synthesized
cttctaactatacttccaaata

SEQ ID NO: 998275 - DNA, 22 bp, Artificial Sequence
  chemically synthesized
ttctaactatacttccaaatat

SEQ ID NO: 998276 - DNA, 22 bp, Artificial Sequence
  chemically synthesized
ctaactatacttccaaatattt

SEQ ID NO: 998277 - DNA, 22 bp, Artificial Sequence
  chemically synthesized
aagcatacatataaatatttgg

SEQ ID NO: 998278 - DNA, 22 bp, Artificial Sequence
  chemically synthesized
taactatacttccaaatattta

SEQ ID NO: 998279 - DNA, 22 bp, Artificial Sequence
  chemically synthesized
actatacttccaaatatttata

SEQ ID NO: 998280 - DNA, 22 bp, Artificial Sequence
  chemically synthesized
ctaaagcatacatataaatatt

SEQ ID NO: 998281 - DNA, 22 bp, Artificial Sequence
  chemically synthesized
cctaaagcatacatataaatat

SEQ ID NO: 998282 - DNA, 22 bp, Artificial Sequence
  chemically synthesized
tacttccaaatatttatatgta

SEQ ID NO: 998283 - DNA, 22 bp, Artificial Sequence
  chemically synthesized
aatttcctaaagcatacatata

SEQ ID NO: 998284 - DNA, 22 bp, Artificial Sequence
  chemically synthesized
ccaaatatttatatgtatgctt

SEQ ID NO: 998285 - DNA, 22 bp, Artificial Sequence
  chemically synthesized
caaatatttatatgtatgcttt

SEQ ID NO: 998286 - DNA, 22 bp, Artificial Sequence
  chemically synthesized
aaaactcaatttcctaaagcat

SEQ ID NO: 998287 - DNA, 22 bp, Artificial Sequence
  chemically synthesized
aaaaactcaatttcctaaagca

SEQ ID NO: 998288 - DNA, 22 bp, Artificial Sequence
  chemically synthesized
acttaaaaactcaatttcctaa

SEQ ID NO: 998289 - DNA, 22 bp, Artificial Sequence
  chemically synthesized
atatgtatgctttaggaaattg

SEQ ID NO: 998290 - DNA, 22 bp, Artificial Sequence
  chemically synthesized
cacttaaaaactcaatttccta

SEQ ID NO: 998291 - DNA, 22 bp, Artificial Sequence
  chemically synthesized
tatgtatgctttaggaaattga

SEQ ID NO: 998292 - DNA, 22 bp, Artificial Sequence
  chemically synthesized
atatttcacttaaaaactcaat

SEQ ID NO: 998293 - DNA, 22 bp, Artificial Sequence
  chemically synthesized
aatatttcacttaaaaactcaa

SEQ ID NO: 998294 - DNA, 22 bp, Artificial Sequence
  chemically synthesized
taatatttcacttaaaaactca

SEQ ID NO: 998295 - DNA, 22 bp, Artificial Sequence
  chemically synthesized
taggaaattgagtttttaagtg

SEQ ID NO: 998296 - DNA, 22 bp, Artificial Sequence
  chemically synthesized
aggaaattgagtttttaagtga

SEQ ID NO: 998297 - DNA, 22 bp, Artificial Sequence
  chemically synthesized
ggaaattgagtttttaagtgaa

SEQ ID NO: 998298 - DNA, 22 bp, Artificial Sequence
  chemically synthesized
agtttttaagtgaaatattaaa

SEQ ID NO: 998299 - DNA, 22 bp, Artificial Sequence
  chemically synthesized
ttaagtgaaatattaaagacat

SEQ ID NO: 998300 - DNA, 22 bp, Artificial Sequence
  chemically synthesized
taagtgaaatattaaagacatc

SEQ ID NO: 998301 - DNA, 22 bp, Artificial Sequence
  chemically synthesized
aagtgaaatattaaagacatct

SEQ ID NO: 998302 - DNA, 22 bp, Artificial Sequence
  chemically synthesized
agtgaaatattaaagacatctc

SEQ ID NO: 998303 - DNA, 22 bp, Artificial Sequence
  chemically synthesized
aagacatctcattttcctgtta

SEQ ID NO: 998304 - DNA, 22 bp, Artificial Sequence
  chemically synthesized
aatgaacagtaatcaggtaaca

SEQ ID NO: 998305 - DNA, 22 bp, Artificial Sequence
  chemically synthesized
attttcctgttacctgattact

SEQ ID NO: 998306 - DNA, 22 bp, Artificial Sequence
  chemically synthesized
tcctgttacctgattactgttc

SEQ ID NO: 998307 - DNA, 22 bp, Artificial Sequence
  chemically synthesized
cctgttacctgattactgttca

SEQ ID NO: 998308 - DNA, 22 bp, Artificial Sequence
  chemically synthesized
ctgttacctgattactgttcat

SEQ ID NO: 998309 - DNA, 22 bp, Artificial Sequence
  chemically synthesized
ttacctgattactgttcattca

SEQ ID NO: 998310 - DNA, 22 bp, Artificial Sequence
  chemically synthesized
cctgattactgttcattcaacc

SEQ ID NO: 998311 - DNA, 22 bp, Artificial Sequence
  chemically synthesized
attactgttcattcaacctgtt

SEQ ID NO: 998312 - DNA, 22 bp, Artificial Sequence
  chemically synthesized
ctgttcattcaacctgttgctg

SEQ ID NO: 998313 - DNA, 22 bp, Artificial Sequence
  chemically synthesized
ttcattcaacctgttgctgtat

SEQ ID NO: 998314 - DNA, 22 bp, Artificial Sequence
  chemically synthesized
attcaacctgttgctgtattgt

SEQ ID NO: 998315 - DNA, 22 bp, Artificial Sequence
  chemically synthesized
aacctgttgctgtattgttcca

SEQ ID NO: 998316 - DNA, 22 bp, Artificial Sequence
  chemically synthesized
ttgctgtattgttccattttta

SEQ ID NO: 998317 - DNA, 22 bp, Artificial Sequence
  chemically synthesized
tggtatatcatataaaaatgga

SEQ ID NO: 998318 - DNA, 22 bp, Artificial Sequence
  chemically synthesized
atggtatatcatataaaaatgg

SEQ ID NO: 998319 - DNA, 22 bp, Artificial Sequence
  chemically synthesized
ctgtattgttccatttttatat

SEQ ID NO: 998320 - DNA, 22 bp, Artificial Sequence
  chemically synthesized
ttatggtatatcatataaaaat

SEQ ID NO: 998321 - DNA, 22 bp, Artificial Sequence
  chemically synthesized
tattgttccatttttatatgat

SEQ ID NO: 998322 - DNA, 22 bp, Artificial Sequence
  chemically synthesized
ttccatttttatatgatatacc

SEQ ID NO: 998323 - DNA, 22 bp, Artificial Sequence
  chemically synthesized
catttttatatgatataccata

SEQ ID NO: 998324 - DNA, 22 bp, Artificial Sequence
  chemically synthesized
acacatagcctcttatggtata

SEQ ID NO: 998325 - DNA, 22 bp, Artificial Sequence
  chemically synthesized
ttcacacatagcctcttatggt

SEQ ID NO: 998326 - DNA, 22 bp, Artificial Sequence
  chemically synthesized
ttatatgatataccataagagg

SEQ ID NO: 998327 - DNA, 22 bp, Artificial Sequence
  chemically synthesized
attcacacatagcctcttatgg

SEQ ID NO: 998328 - DNA, 22 bp, Artificial Sequence
  chemically synthesized
tatatgatataccataagaggc

SEQ ID NO: 998329 - DNA, 22 bp, Artificial Sequence
  chemically synthesized
atatgatataccataagaggct

SEQ ID NO: 998330 - DNA, 22 bp, Artificial Sequence
  chemically synthesized
tatgatataccataagaggcta

SEQ ID NO: 998331 - DNA, 22 bp, Artificial Sequence
  chemically synthesized
ccttattcacacatagcctctt

SEQ ID NO: 998332 - DNA, 22 bp, Artificial Sequence
  chemically synthesized
catcatgtatattgccttattc

SEQ ID NO: 998333 - DNA, 22 bp, Artificial Sequence
  chemically synthesized
tgtgtgaataaggcaatataca

SEQ ID NO: 998334 - DNA, 22 bp, Artificial Sequence
  chemically synthesized
aaaatgtgaatacaaagtaatg

SEQ ID NO: 998335 - DNA, 22 bp, Artificial Sequence
  chemically synthesized
gaaaatgtgaatacaaagtaat

SEQ ID NO: 998336 - DNA, 22 bp, Artificial Sequence
  chemically synthesized
tacaccttgaaaatgtgaatac

SEQ ID NO: 998337 - DNA, 22 bp, Artificial Sequence
  chemically synthesized
tatacaccttgaaaatgtgaat

SEQ ID NO: 998338 - DNA, 22 bp, Artificial Sequence
  chemically synthesized
ctatacaccttgaaaatgtgaa

SEQ ID NO: 998339 - DNA, 22 bp, Artificial Sequence
  chemically synthesized
tctatacaccttgaaaatgtga

SEQ ID NO: 998340 - DNA, 22 bp, Artificial Sequence
  chemically synthesized
ctttgtattcacattttcaagg

SEQ ID NO: 998341 - DNA, 22 bp, Artificial Sequence
  chemically synthesized
tgtattcacattttcaaggtgt

SEQ ID NO: 998342 - DNA, 22 bp, Artificial Sequence
  chemically synthesized
aaaattttctatacaccttgaa

SEQ ID NO: 998343 - DNA, 22 bp, Artificial Sequence
  chemically synthesized
gtattcacattttcaaggtgta

SEQ ID NO: 998344 - DNA, 22 bp, Artificial Sequence
  chemically synthesized
aaaaattttctatacaccttga

SEQ ID NO: 998345 - DNA, 22 bp, Artificial Sequence
  chemically synthesized
tattcacattttcaaggtgtat

SEQ ID NO: 998346 - DNA, 22 bp, Artificial Sequence
  chemically synthesized
taaaaattttctatacaccttg

SEQ ID NO: 998347 - DNA, 22 bp, Artificial Sequence
  chemically synthesized
ttaaaaattttctatacacctt

SEQ ID NO: 998348 - DNA, 22 bp, Artificial Sequence
  chemically synthesized
tttaaaaattttctatacacct

SEQ ID NO: 998349 - DNA, 22 bp, Artificial Sequence
  chemically synthesized
acattttcaaggtgtatagaaa

SEQ ID NO: 998350 - DNA, 22 bp, Artificial Sequence
  chemically synthesized
acatctttttaaaaattttcta

SEQ ID NO: 998351 - DNA, 22 bp, Artificial Sequence
  chemically synthesized
aacatctttttaaaaattttct

SEQ ID NO: 998352 - DNA, 22 bp, Artificial Sequence
  chemically synthesized
tcaaggtgtatagaaaattttt

SEQ ID NO: 998353 - DNA, 22 bp, Artificial Sequence
  chemically synthesized
taacatctttttaaaaattttc

SEQ ID NO: 998354 - DNA, 22 bp, Artificial Sequence
  chemically synthesized
caaggtgtatagaaaattttta

SEQ ID NO: 998355 - DNA, 22 bp, Artificial Sequence
  chemically synthesized
ttaacatctttttaaaaatttt

SEQ ID NO: 998356 - DNA, 22 bp, Artificial Sequence
  chemically synthesized
aaggtgtatagaaaatttttaa

SEQ ID NO: 998357 - DNA, 22 bp, Artificial Sequence
  chemically synthesized
tttaacatctttttaaaaattt

SEQ ID NO: 998358 - DNA, 22 bp, Artificial Sequence
  chemically synthesized
cctttttaacatctttttaaaa

SEQ ID NO: 998359 - DNA, 22 bp, Artificial Sequence
  chemically synthesized
acctttttaacatctttttaaa

SEQ ID NO: 998360 - DNA, 22 bp, Artificial Sequence
  chemically synthesized
tttacctttttaacatcttttt

SEQ ID NO: 998361 - DNA, 22 bp, Artificial Sequence
  chemically synthesized
atttacctttttaacatctttt

SEQ ID NO: 998362 - DNA, 22 bp, Artificial Sequence
  chemically synthesized
ttaaaaagatgttaaaaaggta

SEQ ID NO: 998363 - DNA, 22 bp, Artificial Sequence
  chemically synthesized
taaaaagatgttaaaaaggtaa

SEQ ID NO: 998364 - DNA, 22 bp, Artificial Sequence
  chemically synthesized
aaaaagatgttaaaaaggtaaa

SEQ ID NO: 998365 - DNA, 22 bp, Artificial Sequence
  chemically synthesized
acaatgaacttatttacctttt

SEQ ID NO: 998366 - DNA, 22 bp, Artificial Sequence
  chemically synthesized
aaaagatgttaaaaaggtaaat

SEQ ID NO: 998367 - DNA, 22 bp, Artificial Sequence
  chemically synthesized
taacaattaacaatgaacttat

SEQ ID NO: 998368 - DNA, 22 bp, Artificial Sequence
  chemically synthesized
tataacaattaacaatgaactt

SEQ ID NO: 998369 - DNA, 22 bp, Artificial Sequence
  chemically synthesized
aaaaggtaaataagttcattgt

SEQ ID NO: 998370 - DNA, 22 bp, Artificial Sequence
  chemically synthesized
ctataacaattaacaatgaact

SEQ ID NO: 998371 - DNA, 22 bp, Artificial Sequence
  chemically synthesized
tctataacaattaacaatgaac

SEQ ID NO: 998372 - DNA, 22 bp, Artificial Sequence
  chemically synthesized
tttctataacaattaacaatga

SEQ ID NO: 998373 - DNA, 22 bp, Artificial Sequence
  chemically synthesized
ctctttctataacaattaacaa

SEQ ID NO: 998374 - DNA, 22 bp, Artificial Sequence
  chemically synthesized
tctactctttctataacaatta

SEQ ID NO: 998375 - DNA, 22 bp, Artificial Sequence
  chemically synthesized
gtctactctttctataacaatt

SEQ ID NO: 998376 - DNA, 22 bp, Artificial Sequence
  chemically synthesized
ttgtctactctttctataacaa

SEQ ID NO: 998377 - DNA, 22 bp, Artificial Sequence
  chemically synthesized
tcttgtctactctttctataac

SEQ ID NO: 998378 - DNA, 22 bp, Artificial Sequence
  chemically synthesized
attgttaattgttatagaaaga

SEQ ID NO: 998379 - DNA, 22 bp, Artificial Sequence
  chemically synthesized
tctcttgtctactctttctata

SEQ ID NO: 998380 - DNA, 22 bp, Artificial Sequence
  chemically synthesized
ctctcttgtctactctttctat

SEQ ID NO: 998381 - DNA, 22 bp, Artificial Sequence
  chemically synthesized
ttaattgttatagaaagagtag

SEQ ID NO: 998382 - DNA, 22 bp, Artificial Sequence
  chemically synthesized
attgttatagaaagagtagaca

SEQ ID NO: 998383 - DNA, 22 bp, Artificial Sequence
  chemically synthesized
agtcttctctcttgtctactct

SEQ ID NO: 998384 - DNA, 22 bp, Artificial Sequence
  chemically synthesized
ttatagaaagagtagacaagag

SEQ ID NO: 998385 - DNA, 22 bp, Artificial Sequence
  chemically synthesized
tagaaagagtagacaagagaga

SEQ ID NO: 998386 - DNA, 22 bp, Artificial Sequence
  chemically synthesized
ccgaaatgtagactcagtcttc

SEQ ID NO: 998387 - DNA, 22 bp, Artificial Sequence
  chemically synthesized
gccgaaatgtagactcagtctt

SEQ ID NO: 998388 - DNA, 22 bp, Artificial Sequence
  chemically synthesized
tgccgaaatgtagactcagtct

SEQ ID NO: 998389 - DNA, 22 bp, Artificial Sequence
  chemically synthesized
ttgccgaaatgtagactcagtc

SEQ ID NO: 998390 - DNA, 22 bp, Artificial Sequence
  chemically synthesized
tttgccgaaatgtagactcagt

SEQ ID NO: 998391 - DNA, 22 bp, Artificial Sequence
  chemically synthesized
tgaagactttttgccgaaatgt

SEQ ID NO: 998392 - DNA, 22 bp, Artificial Sequence
  chemically synthesized
atgaagactttttgccgaaatg

SEQ ID NO: 998393 - DNA, 22 bp, Artificial Sequence
  chemically synthesized
tatgaagactttttgccgaaat

SEQ ID NO: 998394 - DNA, 22 bp, Artificial Sequence
  chemically synthesized
ttatgaagactttttgccgaaa

SEQ ID NO: 998395 - DNA, 22 bp, Artificial Sequence
  chemically synthesized
agtctacatttcggcaaaaagt

SEQ ID NO: 998396 - DNA, 22 bp, Artificial Sequence
  chemically synthesized
atttttatgaagactttttgcc

SEQ ID NO: 998397 - DNA, 22 bp, Artificial Sequence
  chemically synthesized
taatttttatgaagactttttg

SEQ ID NO: 998398 - DNA, 22 bp, Artificial Sequence
  chemically synthesized
ctaatttttatgaagacttttt

SEQ ID NO: 998399 - DNA, 22 bp, Artificial Sequence
  chemically synthesized
tctaatttttatgaagactttt

SEQ ID NO: 998400 - DNA, 22 bp, Artificial Sequence
  chemically synthesized
catttcggcaaaaagtcttcat

SEQ ID NO: 998401 - DNA, 22 bp, Artificial Sequence
  chemically synthesized
cggcaaaaagtcttcataaaaa

SEQ ID NO: 998402 - DNA, 22 bp, Artificial Sequence
  chemically synthesized
ggcaaaaagtcttcataaaaat

SEQ ID NO: 998403 - DNA, 22 bp, Artificial Sequence
  chemically synthesized
accaattttctaatttttatga

SEQ ID NO: 998404 - DNA, 22 bp, Artificial Sequence
  chemically synthesized
ctcaccaattttctaattttta

SEQ ID NO: 998405 - DNA, 22 bp, Artificial Sequence
  chemically synthesized
actcaccaattttctaattttt

SEQ ID NO: 998406 - DNA, 22 bp, Artificial Sequence
  chemically synthesized
acttactcaccaattttctaat

SEQ ID NO: 998407 - DNA, 22 bp, Artificial Sequence
  chemically synthesized
attgacttactcaccaattttc

SEQ ID NO: 998408 - DNA, 22 bp, Artificial Sequence
  chemically synthesized
cataaaaattagaaaattggtg

SEQ ID NO: 998409 - DNA, 22 bp, Artificial Sequence
  chemically synthesized
cattgacttactcaccaatttt

SEQ ID NO: 998410 - DNA, 22 bp, Artificial Sequence
  chemically synthesized
ataaaaattagaaaattggtga

SEQ ID NO: 998411 - DNA, 22 bp, Artificial Sequence
  chemically synthesized
acaatgcttcattgacttactc

SEQ ID NO: 998412 - DNA, 22 bp, Artificial Sequence
  chemically synthesized
gacaatgcttcattgacttact

SEQ ID NO: 998413 - DNA, 22 bp, Artificial Sequence
  chemically synthesized
gaaaattggtgagtaagtcaat

SEQ ID NO: 998414 - DNA, 22 bp, Artificial Sequence
  chemically synthesized
tgacaatgcttcattgacttac

SEQ ID NO: 998415 - DNA, 22 bp, Artificial Sequence
  chemically synthesized
tgactttgacaatgcttcattg

SEQ ID NO: 998416 - DNA, 22 bp, Artificial Sequence
  chemically synthesized
gtgactttgacaatgcttcatt

SEQ ID NO: 998417 - DNA, 22 bp, Artificial Sequence
  chemically synthesized
gtgagtaagtcaatgaagcatt

SEQ ID NO: 998418 - DNA, 22 bp, Artificial Sequence
  chemically synthesized
tttgtgactttgacaatgcttc

SEQ ID NO: 998419 - DNA, 22 bp, Artificial Sequence
  chemically synthesized
gtttgtgactttgacaatgctt

SEQ ID NO: 998420 - DNA, 22 bp, Artificial Sequence
  chemically synthesized
tgtttgtgactttgacaatgct

SEQ ID NO: 998421 - DNA, 22 bp, Artificial Sequence
  chemically synthesized
ttgtttgtgactttgacaatgc

SEQ ID NO: 998422 - DNA, 22 bp, Artificial Sequence
  chemically synthesized
tcaaagtcacaaacaaaaggtg

SEQ ID NO: 998423 - DNA, 22 bp, Artificial Sequence
  chemically synthesized
taataatgtggagtcacctttt

SEQ ID NO: 998424 - DNA, 22 bp, Artificial Sequence
  chemically synthesized
acaggggaattataataatgtg

SEQ ID NO: 998425 - DNA, 22 bp, Artificial Sequence
  chemically synthesized
tgacaggggaattataataatg

SEQ ID NO: 998426 - DNA, 22 bp, Artificial Sequence
  chemically synthesized
ctgacaggggaattataataat

SEQ ID NO: 998427 - DNA, 22 bp, Artificial Sequence
  chemically synthesized
tctgacaggggaattataataa

SEQ ID NO: 998428 - DNA, 22 bp, Artificial Sequence
  chemically synthesized
ctttctgacaggggaattataa

SEQ ID NO: 998429 - DNA, 22 bp, Artificial Sequence
  chemically synthesized
cacattattataattcccctgt

SEQ ID NO: 998430 - DNA, 22 bp, Artificial Sequence
  chemically synthesized
ccatgtctactttctgacaggg

SEQ ID NO: 998431 - DNA, 22 bp, Artificial Sequence
  chemically synthesized
gccatgtctactttctgacagg

SEQ ID NO: 998432 - DNA, 22 bp, Artificial Sequence
  chemically synthesized
ttataattcccctgtcagaaag

SEQ ID NO: 998433 - DNA, 22 bp, Artificial Sequence
  chemically synthesized
taattcccctgtcagaaagtag

SEQ ID NO: 998434 - DNA, 22 bp, Artificial Sequence
  chemically synthesized
ccctgtcagaaagtagacatgg

SEQ ID NO: 998435 - DNA, 22 bp, Artificial Sequence
  chemically synthesized
aagtcataagtttgccatgtct

SEQ ID NO: 998436 - DNA, 22 bp, Artificial Sequence
  chemically synthesized
tcagaaagtagacatggcaaac

SEQ ID NO: 998437 - DNA, 22 bp, Artificial Sequence
  chemically synthesized
agaggttgaagtcataagtttg

SEQ ID NO: 998438 - DNA, 22 bp, Artificial Sequence
  chemically synthesized
cagaggttgaagtcataagttt

SEQ ID NO: 998439 - DNA, 22 bp, Artificial Sequence
  chemically synthesized
tcagaggttgaagtcataagtt

SEQ ID NO: 998440 - DNA, 22 bp, Artificial Sequence
  chemically synthesized
attttcagaggttgaagtcata

SEQ ID NO: 998441 - DNA, 22 bp, Artificial Sequence
  chemically synthesized
tgatcctcattttcagaggttg

SEQ ID NO: 998442 - DNA, 22 bp, Artificial Sequence
  chemically synthesized
tgtgatcctcattttcagaggt

SEQ ID NO: 998443 - DNA, 22 bp, Artificial Sequence
  chemically synthesized
atgacttcaacctctgaaaatg

SEQ ID NO: 998444 - DNA, 22 bp, Artificial Sequence
  chemically synthesized
ctctgtgatcctcattttcaga

SEQ ID NO: 998445 - DNA, 22 bp, Artificial Sequence
  chemically synthesized
tgacttcaacctctgaaaatga

SEQ ID NO: 998446 - DNA, 22 bp, Artificial Sequence
  chemically synthesized
tcctctgtgatcctcattttca

SEQ ID NO: 998447 - DNA, 22 bp, Artificial Sequence
  chemically synthesized
ctcctctgtgatcctcattttc

SEQ ID NO: 998448 - DNA, 22 bp, Artificial Sequence
  chemically synthesized
tttctcctctgtgatcctcatt

SEQ ID NO: 998449 - DNA, 22 bp, Artificial Sequence
  chemically synthesized
caacctctgaaaatgaggatca

SEQ ID NO: 998450 - DNA, 22 bp, Artificial Sequence
  chemically synthesized
atttctcctctgtgatcctcat

SEQ ID NO: 998451 - DNA, 22 bp, Artificial Sequence
  chemically synthesized
aacctctgaaaatgaggatcac

SEQ ID NO: 998452 - DNA, 22 bp, Artificial Sequence
  chemically synthesized
tgaaaatgaggatcacagagga

SEQ ID NO: 998453 - DNA, 22 bp, Artificial Sequence
  chemically synthesized
aaaatgaggatcacagaggaga

SEQ ID NO: 998454 - DNA, 22 bp, Artificial Sequence
  chemically synthesized
tccagtcttatttctcctctgt

SEQ ID NO: 998455 - DNA, 22 bp, Artificial Sequence
  chemically synthesized
ttgtccagtcttatttctcctc

SEQ ID NO: 998456 - DNA, 22 bp, Artificial Sequence
  chemically synthesized
gaagcctgttgtccagtcttat

SEQ ID NO: 998457 - DNA, 22 bp, Artificial Sequence
  chemically synthesized
gaaacacagctggaagcctgtt

SEQ ID NO: 998458 - DNA, 22 bp, Artificial Sequence
  chemically synthesized
ttagaaacacagctggaagcct

SEQ ID NO: 998459 - DNA, 22 bp, Artificial Sequence
  chemically synthesized
gttagaaacacagctggaagcc

SEQ ID NO: 998460 - DNA, 22 bp, Artificial Sequence
  chemically synthesized
gacaacaggcttccagctgtgt

SEQ ID NO: 998461 - DNA, 22 bp, Artificial Sequence
  chemically synthesized
tacttgttagaaacacagctgg

SEQ ID NO: 998462 - DNA, 22 bp, Artificial Sequence
  chemically synthesized
ccagctgtgtttctaacaagta

SEQ ID NO: 998463 - DNA, 22 bp, Artificial Sequence
  chemically synthesized
cagctgtgtttctaacaagtat

SEQ ID NO: 998464 - DNA, 22 bp, Artificial Sequence
  chemically synthesized
tgtttctaacaagtataattac

SEQ ID NO: 998465 - DNA, 22 bp, Artificial Sequence
  chemically synthesized
ctaacaagtataattacactgg

SEQ ID NO: 998466 - DNA, 22 bp, Artificial Sequence
  chemically synthesized
taacaagtataattacactggt

SEQ ID NO: 998467 - DNA, 22 bp, Artificial Sequence
  chemically synthesized
atgataatgtccaaccagtgta

SEQ ID NO: 998468 - DNA, 22 bp, Artificial Sequence
  chemically synthesized
acaagtataattacactggttg

SEQ ID NO: 998469 - DNA, 22 bp, Artificial Sequence
  chemically synthesized
gaaatgtagttaatgataatgt

SEQ ID NO: 998470 - DNA, 22 bp, Artificial Sequence
  chemically synthesized
cactggttggacattatcatta

SEQ ID NO: 998471 - DNA, 22 bp, Artificial Sequence
  chemically synthesized
gttggacattatcattaactac

SEQ ID NO: 998472 - DNA, 22 bp, Artificial Sequence
  chemically synthesized
gacattatcattaactacattt

SEQ ID NO: 998473 - DNA, 22 bp, Artificial Sequence
  chemically synthesized
tgagaagaattagaaatgtagt

SEQ ID NO: 998474 - DNA, 22 bp, Artificial Sequence
  chemically synthesized
aattatgagaagaattagaaat

SEQ ID NO: 998475 - DNA, 22 bp, Artificial Sequence
  chemically synthesized
tcattaactacatttctaattc

SEQ ID NO: 998476 - DNA, 22 bp, Artificial Sequence
  chemically synthesized
gaattatgagaagaattagaaa

SEQ ID NO: 998477 - DNA, 22 bp, Artificial Sequence
  chemically synthesized
tgaattatgagaagaattagaa

SEQ ID NO: 998478 - DNA, 22 bp, Artificial Sequence
  chemically synthesized
ttgaattatgagaagaattaga

SEQ ID NO: 998479 - DNA, 22 bp, Artificial Sequence
  chemically synthesized
tttgaattatgagaagaattag

SEQ ID NO: 998480 - DNA, 22 bp, Artificial Sequence
  chemically synthesized
actacatttctaattcttctca

SEQ ID NO: 998481 - DNA, 22 bp, Artificial Sequence
  chemically synthesized
actttttgaattatgagaagaa

SEQ ID NO: 998482 - DNA, 22 bp, Artificial Sequence
  chemically synthesized
tcactttttgaattatgagaag

SEQ ID NO: 998483 - DNA, 22 bp, Artificial Sequence
  chemically synthesized
catttctaattcttctcataat

SEQ ID NO: 998484 - DNA, 22 bp, Artificial Sequence
  chemically synthesized
tctcactttttgaattatgaga

SEQ ID NO: 998485 - DNA, 22 bp, Artificial Sequence
  chemically synthesized
tctctcactttttgaattatga

SEQ ID NO: 998486 - DNA, 22 bp, Artificial Sequence
  chemically synthesized
ctctctcactttttgaattatg

SEQ ID NO: 998487 - DNA, 22 bp, Artificial Sequence
  chemically synthesized
ctaattcttctcataattcaaa

SEQ ID NO: 998488 - DNA, 22 bp, Artificial Sequence
  chemically synthesized
tctctctcactttttgaattat

SEQ ID NO: 998489 - DNA, 22 bp, Artificial Sequence
  chemically synthesized
taattcttctcataattcaaaa

SEQ ID NO: 998490 - DNA, 22 bp, Artificial Sequence
  chemically synthesized
ttctctctcactttttgaatta

SEQ ID NO: 998491 - DNA, 22 bp, Artificial Sequence
  chemically synthesized
tttctctctcactttttgaatt

SEQ ID NO: 998492 - DNA, 22 bp, Artificial Sequence
  chemically synthesized
attcttctcataattcaaaaag

SEQ ID NO: 998493 - DNA, 22 bp, Artificial Sequence
  chemically synthesized
ctttttctctctcactttttga

SEQ ID NO: 998494 - DNA, 22 bp, Artificial Sequence
  chemically synthesized
cctttttctctctcactttttg

SEQ ID NO: 998495 - DNA, 22 bp, Artificial Sequence
  chemically synthesized
ttctcataattcaaaaagtgag

SEQ ID NO: 998496 - DNA, 22 bp, Artificial Sequence
  chemically synthesized
ctcataattcaaaaagtgagag

SEQ ID NO: 998497 - DNA, 22 bp, Artificial Sequence
  chemically synthesized
tcataattcaaaaagtgagaga

SEQ ID NO: 998498 - DNA, 22 bp, Artificial Sequence
  chemically synthesized
ataattcaaaaagtgagagaga

SEQ ID NO: 998499 - DNA, 22 bp, Artificial Sequence
  chemically synthesized
tcccttcctttttctctctcac

SEQ ID NO: 998500 - DNA, 22 bp, Artificial Sequence
  chemically synthesized
aaaaagtgagagagaaaaagga

SEQ ID NO: 998501 - DNA, 22 bp, Artificial Sequence
  chemically synthesized
taacaccaaaaagagttatccc

SEQ ID NO: 998502 - DNA, 22 bp, Artificial Sequence
  chemically synthesized
caatgaggtactataacaccaa

SEQ ID NO: 998503 - DNA, 22 bp, Artificial Sequence
  chemically synthesized
gaaacctacaatgaggtactat

SEQ ID NO: 998504 - DNA, 22 bp, Artificial Sequence
  chemically synthesized
tttttggtgttatagtacctca

SEQ ID NO: 998505 - DNA, 22 bp, Artificial Sequence
  chemically synthesized
ggaaacctacaatgaggtacta

SEQ ID NO: 998506 - DNA, 22 bp, Artificial Sequence
  chemically synthesized
tggaaacctacaatgaggtact

SEQ ID NO: 998507 - DNA, 22 bp, Artificial Sequence
  chemically synthesized
tttggtgttatagtacctcatt

SEQ ID NO: 998508 - DNA, 22 bp, Artificial Sequence
  chemically synthesized
ttggaaacctacaatgaggtac

SEQ ID NO: 998509 - DNA, 22 bp, Artificial Sequence
  chemically synthesized
ttggtgttatagtacctcattg

SEQ ID NO: 998510 - DNA, 22 bp, Artificial Sequence
  chemically synthesized
tggtgttatagtacctcattgt

SEQ ID NO: 998511 - DNA, 22 bp, Artificial Sequence
  chemically synthesized
ggtgttatagtacctcattgta

SEQ ID NO: 998512 - DNA, 22 bp, Artificial Sequence
  chemically synthesized
tttttggaaacctacaatgagg

SEQ ID NO: 998513 - DNA, 22 bp, Artificial Sequence
  chemically synthesized
gtgttatagtacctcattgtag

SEQ ID NO: 998514 - DNA, 22 bp, Artificial Sequence
  chemically synthesized
gtttttggaaacctacaatgag

SEQ ID NO: 998515 - DNA, 22 bp, Artificial Sequence
  chemically synthesized
tagtacctcattgtaggtttcc

SEQ ID NO: 998516 - DNA, 22 bp, Artificial Sequence
  chemically synthesized
tcaggagtcacttgtttttgga

SEQ ID NO: 998517 - DNA, 22 bp, Artificial Sequence
  chemically synthesized
attgtaggtttccaaaaacaag

SEQ ID NO: 998518 - DNA, 22 bp, Artificial Sequence
  chemically synthesized
ttgtcaggagtcacttgttttt

SEQ ID NO: 998519 - DNA, 22 bp, Artificial Sequence
  chemically synthesized
taggtttccaaaaacaagtgac

SEQ ID NO: 998520 - DNA, 22 bp, Artificial Sequence
  chemically synthesized
acagttgttgtcaggagtcact

SEQ ID NO: 998521 - DNA, 22 bp, Artificial Sequence
  chemically synthesized
ccaaaaacaagtgactcctgac

SEQ ID NO: 998522 - DNA, 22 bp, Artificial Sequence
  chemically synthesized
caaaaacaagtgactcctgaca

SEQ ID NO: 998523 - DNA, 22 bp, Artificial Sequence
  chemically synthesized
agagctaacagttgttgtcagg

SEQ ID NO: 998524 - DNA, 22 bp, Artificial Sequence
  chemically synthesized
cagagctaacagttgttgtcag

SEQ ID NO: 998525 - DNA, 22 bp, Artificial Sequence
  chemically synthesized
acttcagagctaacagttgttg

SEQ ID NO: 998526 - DNA, 22 bp, Artificial Sequence
  chemically synthesized
tcacttcagagctaacagttgt

SEQ ID NO: 998527 - DNA, 22 bp, Artificial Sequence
  chemically synthesized
ctgacaacaactgttagctctg

SEQ ID NO: 998528 - DNA, 22 bp, Artificial Sequence
  chemically synthesized
cagactctcacttcagagctaa

SEQ ID NO: 998529 - DNA, 22 bp, Artificial Sequence
  chemically synthesized
gcagactctcacttcagagcta

SEQ ID NO: 998530 - DNA, 22 bp, Artificial Sequence
  chemically synthesized
acaacaactgttagctctgaag

SEQ ID NO: 998531 - DNA, 22 bp, Artificial Sequence
  chemically synthesized
cagtttgcagactctcacttca

SEQ ID NO: 998532 - DNA, 22 bp, Artificial Sequence
  chemically synthesized
ttagctctgaagtgagagtctg

SEQ ID NO: 998533 - DNA, 22 bp, Artificial Sequence
  chemically synthesized
agggctgcagtttgcagactct

SEQ ID NO: 998534 - DNA, 22 bp, Artificial Sequence
  chemically synthesized
gctctgaagtgagagtctgcaa

SEQ ID NO: 998535 - DNA, 22 bp, Artificial Sequence
  chemically synthesized
gagggctgcagtttgcagactc

SEQ ID NO: 998536 - DNA, 22 bp, Artificial Sequence
  chemically synthesized
tgaagtgagagtctgcaaactg

SEQ ID NO: 998537 - DNA, 22 bp, Artificial Sequence
  chemically synthesized
aagtgagagtctgcaaactgca

SEQ ID NO: 998538 - DNA, 22 bp, Artificial Sequence
  chemically synthesized
cggcttgagggctgcagtttgc

SEQ ID NO: 998539 - DNA, 22 bp, Artificial Sequence
  chemically synthesized
gttacggcttgagggctgcagt

SEQ ID NO: 998540 - DNA, 22 bp, Artificial Sequence
  chemically synthesized
caaactgcagccctcaagccgt

SEQ ID NO: 998541 - DNA, 22 bp, Artificial Sequence
  chemically synthesized
cagccctcaagccgtaactagc

SEQ ID NO: 998542 - DNA, 22 bp, Artificial Sequence
  chemically synthesized
caaaaatggcaatgggctagtt

SEQ ID NO: 998543 - DNA, 22 bp, Artificial Sequence
  chemically synthesized
acaaaaatggcaatgggctagt

SEQ ID NO: 998544 - DNA, 22 bp, Artificial Sequence
  chemically synthesized
tttacaaaaatggcaatgggct

SEQ ID NO: 998545 - DNA, 22 bp, Artificial Sequence
  chemically synthesized
aagccgtaactagcccattgcc

SEQ ID NO: 998546 - DNA, 22 bp, Artificial Sequence
  chemically synthesized
atttacaaaaatggcaatgggc

SEQ ID NO: 998547 - DNA, 22 bp, Artificial Sequence
  chemically synthesized
tatttacaaaaatggcaatggg

SEQ ID NO: 998548 - DNA, 22 bp, Artificial Sequence
  chemically synthesized
gcccattgccatttttgtaaat

SEQ ID NO: 998549 - DNA, 22 bp, Artificial Sequence
  chemically synthesized
tgatccaataaaactttattta

SEQ ID NO: 998550 - DNA, 22 bp, Artificial Sequence
  chemically synthesized
ccatttttgtaaataaagtttt

SEQ ID NO: 998551 - DNA, 22 bp, Artificial Sequence
  chemically synthesized
ttgtaaataaagttttattgga

SEQ ID NO: 998552 - DNA, 22 bp, Artificial Sequence
  chemically synthesized
tgtaaataaagttttattggat

SEQ ID NO: 998553 - DNA, 22 bp, Artificial Sequence
  chemically synthesized
gtaaataaagttttattggatc

SEQ ID NO: 998554 - DNA, 22 bp, Artificial Sequence
  chemically synthesized
taaataaagttttattggatca

SEQ ID NO: 998555 - DNA, 22 bp, Artificial Sequence
  chemically synthesized
tattggatcacaatgacacatc

SEQ ID NO: 998556 - DNA, 22 bp, Artificial Sequence
  chemically synthesized
attggatcacaatgacacatct

SEQ ID NO: 998557 - DNA, 22 bp, Artificial Sequence
  chemically synthesized
ttggatcacaatgacacatctt

SEQ ID NO: 998558 - DNA, 22 bp, Artificial Sequence
  chemically synthesized
gatcacaatgacacatcttcat

SEQ ID NO: 998559 - DNA, 22 bp, Artificial Sequence
  chemically synthesized
aagcagtcatagacaatagaga

SEQ ID NO: 998560 - DNA, 22 bp, Artificial Sequence
  chemically synthesized
catttctctattgtctatgact

SEQ ID NO: 998561 - DNA, 22 bp, Artificial Sequence
  chemically synthesized
gaatgttgaagcagtcatagac

SEQ ID NO: 998562 - DNA, 22 bp, Artificial Sequence
  chemically synthesized
atttctctattgtctatgactg

SEQ ID NO: 998563 - DNA, 22 bp, Artificial Sequence
  chemically synthesized
ttagaatgttgaagcagtcata

SEQ ID NO: 998564 - DNA, 22 bp, Artificial Sequence
  chemically synthesized
ctctattgtctatgactgcttc

SEQ ID NO: 998565 - DNA, 22 bp, Artificial Sequence
  chemically synthesized
tctattgtctatgactgcttca

SEQ ID NO: 998566 - DNA, 22 bp, Artificial Sequence
  chemically synthesized
ctgttagaatgttgaagcagtc

SEQ ID NO: 998567 - DNA, 22 bp, Artificial Sequence
  chemically synthesized
tattgtctatgactgcttcaac

SEQ ID NO: 998568 - DNA, 22 bp, Artificial Sequence
  chemically synthesized
tgctgttagaatgttgaagcag

SEQ ID NO: 998569 - DNA, 22 bp, Artificial Sequence
  chemically synthesized
ttgtctatgactgcttcaacat

SEQ ID NO: 998570 - DNA, 22 bp, Artificial Sequence
  chemically synthesized
tctatgactgcttcaacattct

SEQ ID NO: 998571 - DNA, 22 bp, Artificial Sequence
  chemically synthesized
aactctgctgttagaatgttga

SEQ ID NO: 998572 - DNA, 22 bp, Artificial Sequence
  chemically synthesized
ttcaactctgctgttagaatgt

SEQ ID NO: 998573 - DNA, 22 bp, Artificial Sequence
  chemically synthesized
tgactgcttcaacattctaaca

SEQ ID NO: 998574 - DNA, 22 bp, Artificial Sequence
  chemically synthesized
caactattcaactctgctgtta

SEQ ID NO: 998575 - DNA, 22 bp, Artificial Sequence
  chemically synthesized
cttcaacattctaacagcagag

SEQ ID NO: 998576 - DNA, 22 bp, Artificial Sequence
  chemically synthesized
ttgcaactattcaactctgctg

SEQ ID NO: 998577 - DNA, 22 bp, Artificial Sequence
  chemically synthesized
caacattctaacagcagagttg

SEQ ID NO: 998578 - DNA, 22 bp, Artificial Sequence
  chemically synthesized
aacattctaacagcagagttga

SEQ ID NO: 998579 - DNA, 22 bp, Artificial Sequence
  chemically synthesized
tgttgcaactattcaactctgc

SEQ ID NO: 998580 - DNA, 22 bp, Artificial Sequence
  chemically synthesized
tactctgttgcaactattcaac

SEQ ID NO: 998581 - DNA, 22 bp, Artificial Sequence
  chemically synthesized
taacagcagagttgaatagttg

SEQ ID NO: 998582 - DNA, 22 bp, Artificial Sequence
  chemically synthesized
tatactctgttgcaactattca

SEQ ID NO: 998583 - DNA, 22 bp, Artificial Sequence
  chemically synthesized
ctatactctgttgcaactattc

SEQ ID NO: 998584 - DNA, 22 bp, Artificial Sequence
  chemically synthesized
acagcagagttgaatagttgca

SEQ ID NO: 998585 - DNA, 22 bp, Artificial Sequence
  chemically synthesized
tctatactctgttgcaactatt

SEQ ID NO: 998586 - DNA, 22 bp, Artificial Sequence
  chemically synthesized
ttttctatactctgttgcaact

SEQ ID NO: 998587 - DNA, 22 bp, Artificial Sequence
  chemically synthesized
gttttctatactctgttgcaac

SEQ ID NO: 998588 - DNA, 22 bp, Artificial Sequence
  chemically synthesized
tgttttctatactctgttgcaa

SEQ ID NO: 998589 - DNA, 22 bp, Artificial Sequence
  chemically synthesized
ggctttgttttctatactctgt

SEQ ID NO: 998590 - DNA, 22 bp, Artificial Sequence
  chemically synthesized
aggctttgttttctatactctg

SEQ ID NO: 998591 - DNA, 22 bp, Artificial Sequence
  chemically synthesized
aatagttgcaacagagtataga

SEQ ID NO: 998592 - DNA, 22 bp, Artificial Sequence
  chemically synthesized
taggctttgttttctatactct

SEQ ID NO: 998593 - DNA, 22 bp, Artificial Sequence
  chemically synthesized
caacagagtatagaaaacaaag

SEQ ID NO: 998594 - DNA, 22 bp, Artificial Sequence
  chemically synthesized
aaatatttactctctggccctt

SEQ ID NO: 998595 - DNA, 22 bp, Artificial Sequence
  chemically synthesized
taatgtaaacgtaaagggccag

SEQ ID NO: 998596 - DNA, 22 bp, Artificial Sequence
  chemically synthesized
tgtaatgtaaacgtaaagggcc

SEQ ID NO: 998597 - DNA, 22 bp, Artificial Sequence
  chemically synthesized
ctgtaatgtaaacgtaaagggc

SEQ ID NO: 998598 - DNA, 22 bp, Artificial Sequence
  chemically synthesized
tctgtaatgtaaacgtaaaggg

SEQ ID NO: 998599 - DNA, 22 bp, Artificial Sequence
  chemically synthesized
actctctggccctttacgttta

SEQ ID NO: 998600 - DNA, 22 bp, Artificial Sequence
  chemically synthesized
ctctctggccctttacgtttac

SEQ ID NO: 998601 - DNA, 22 bp, Artificial Sequence
  chemically synthesized
tctggccctttacgtttacatt

SEQ ID NO: 998602 - DNA, 22 bp, Artificial Sequence
  chemically synthesized
tggccctttacgtttacattac

SEQ ID NO: 998603 - DNA, 22 bp, Artificial Sequence
  chemically synthesized
gcaagtgttttctgtaatgtaa

SEQ ID NO: 998604 - DNA, 22 bp, Artificial Sequence
  chemically synthesized
gccctttacgtttacattacag

SEQ ID NO: 998605 - DNA, 22 bp, Artificial Sequence
  chemically synthesized
tacgtttacattacagaaaaca

SEQ ID NO: 998606 - DNA, 22 bp, Artificial Sequence
  chemically synthesized
acgtttacattacagaaaacac

SEQ ID NO: 998607 - DNA, 22 bp, Artificial Sequence
  chemically synthesized
cgtttacattacagaaaacact

SEQ ID NO: 998608 - DNA, 22 bp, Artificial Sequence
  chemically synthesized
tagtaggggttagcaagtgttt

SEQ ID NO: 998609 - DNA, 22 bp, Artificial Sequence
  chemically synthesized
atagtaggggttagcaagtgtt

SEQ ID NO: 998610 - DNA, 22 bp, Artificial Sequence
  chemically synthesized
acattacagaaaacacttgcta

SEQ ID NO: 998611 - DNA, 22 bp, Artificial Sequence
  chemically synthesized
tatagtaggggttagcaagtgt

SEQ ID NO: 998612 - DNA, 22 bp, Artificial Sequence
  chemically synthesized
cattacagaaaacacttgctaa

SEQ ID NO: 998613 - DNA, 22 bp, Artificial Sequence
  chemically synthesized
ttttatagtaggggttagcaag

SEQ ID NO: 998614 - DNA, 22 bp, Artificial Sequence
  chemically synthesized
cagaaaacacttgctaacccct

SEQ ID NO: 998615 - DNA, 22 bp, Artificial Sequence
  chemically synthesized
caaagacaacattgttttatag

SEQ ID NO: 998616 - DNA, 22 bp, Artificial Sequence
  chemically synthesized
gctaacccctactataaaacaa

SEQ ID NO: 998617 - DNA, 22 bp, Artificial Sequence
  chemically synthesized
ccaaagacaacattgttttata

SEQ ID NO: 998618 - DNA, 22 bp, Artificial Sequence
  chemically synthesized
ctaacccctactataaaacaat

SEQ ID NO: 998619 - DNA, 22 bp, Artificial Sequence
  chemically synthesized
acccctactataaaacaatgtt

SEQ ID NO: 998620 - DNA, 22 bp, Artificial Sequence
  chemically synthesized
ccatagcttccaaagacaacat

SEQ ID NO: 998621 - DNA, 22 bp, Artificial Sequence
  chemically synthesized
accatagcttccaaagacaaca

SEQ ID NO: 998622 - DNA, 22 bp, Artificial Sequence
  chemically synthesized
ctataaaacaatgttgtctttg

SEQ ID NO: 998623 - DNA, 22 bp, Artificial Sequence
  chemically synthesized
taaaacaatgttgtctttggaa

SEQ ID NO: 998624 - DNA, 22 bp, Artificial Sequence
  chemically synthesized
atttaccatagcttccaaagac

SEQ ID NO: 998625 - DNA, 22 bp, Artificial Sequence
  chemically synthesized
aatttaccatagcttccaaaga

SEQ ID NO: 998626 - DNA, 22 bp, Artificial Sequence
  chemically synthesized
taatttaccatagcttccaaag

SEQ ID NO: 998627 - DNA, 22 bp, Artificial Sequence
  chemically synthesized
ttaatttaccatagcttccaaa

SEQ ID NO: 998628 - DNA, 22 bp, Artificial Sequence
  chemically synthesized
tttttaatttaccatagcttcc

SEQ ID NO: 998629 - DNA, 22 bp, Artificial Sequence
  chemically synthesized
tgtttttaatttaccatagctt

SEQ ID NO: 998630 - DNA, 22 bp, Artificial Sequence
  chemically synthesized
ttctgtttttaatttaccatag

SEQ ID NO: 998631 - DNA, 22 bp, Artificial Sequence
  chemically synthesized
attctgtttttaatttaccata

SEQ ID NO: 998632 - DNA, 22 bp, Artificial Sequence
  chemically synthesized
tctttggaagctatggtaaatt

SEQ ID NO: 998633 - DNA, 22 bp, Artificial Sequence
  chemically synthesized
tattctgtttttaatttaccat

SEQ ID NO: 998634 - DNA, 22 bp, Artificial Sequence
  chemically synthesized
tggaagctatggtaaattaaaa

SEQ ID NO: 998635 - DNA, 22 bp, Artificial Sequence
  chemically synthesized
ggaagctatggtaaattaaaaa

SEQ ID NO: 998636 - DNA, 22 bp, Artificial Sequence
  chemically synthesized
gaagctatggtaaattaaaaac

SEQ ID NO: 998637 - DNA, 22 bp, Artificial Sequence
  chemically synthesized
tggtaaattaaaaacagaataa

SEQ ID NO: 998638 - DNA, 22 bp, Artificial Sequence
  chemically synthesized
aaaacagaataaaactattgct

SEQ ID NO: 998639 - DNA, 22 bp, Artificial Sequence
  chemically synthesized
aaaataaaatatacgtgagcaa

SEQ ID NO: 998640 - DNA, 22 bp, Artificial Sequence
  chemically synthesized
gaaaataaaatatacgtgagca

SEQ ID NO: 998641 - DNA, 22 bp, Artificial Sequence
  chemically synthesized
tgaaaataaaatatacgtgagc

SEQ ID NO: 998642 - DNA, 22 bp, Artificial Sequence
  chemically synthesized
ctttgaaaataaaatatacgtg

SEQ ID NO: 998643 - DNA, 22 bp, Artificial Sequence
  chemically synthesized
actttgaaaataaaatatacgt

SEQ ID NO: 998644 - DNA, 22 bp, Artificial Sequence
  chemically synthesized
tactttgaaaataaaatatacg

SEQ ID NO: 998645 - DNA, 22 bp, Artificial Sequence
  chemically synthesized
ttgctcacgtatattttatttt

SEQ ID NO: 998646 - DNA, 22 bp, Artificial Sequence
  chemically synthesized
ctcacgtatattttattttcaa

SEQ ID NO: 998647 - DNA, 22 bp, Artificial Sequence
  chemically synthesized
acgtatattttattttcaaagt

SEQ ID NO: 998648 - DNA, 22 bp, Artificial Sequence
  chemically synthesized
tattttcaaagtaaaattactt

SEQ ID NO: 998649 - DNA, 22 bp, Artificial Sequence
  chemically synthesized
attttcaaagtaaaattacttt

SEQ ID NO: 998650 - DNA, 22 bp, Artificial Sequence
  chemically synthesized
tagaaggggaaaaaagtaattt

SEQ ID NO: 998651 - DNA, 22 bp, Artificial Sequence
  chemically synthesized
ttttcaaagtaaaattactttt

SEQ ID NO: 998652 - DNA, 22 bp, Artificial Sequence
  chemically synthesized
tcaaagtaaaattacttttttc

SEQ ID NO: 998653 - DNA, 22 bp, Artificial Sequence
  chemically synthesized
caaagtaaaattacttttttcc

SEQ ID NO: 998654 - DNA, 22 bp, Artificial Sequence
  chemically synthesized
aaagtaaaattacttttttccc

SEQ ID NO: 998655 - DNA, 22 bp, Artificial Sequence
  chemically synthesized
cttttttccccttctatagata

SEQ ID NO: 998656 - DNA, 22 bp, Artificial Sequence
  chemically synthesized
ttttccccttctatagatattt

SEQ ID NO: 998657 - DNA, 22 bp, Artificial Sequence
  chemically synthesized
tttccccttctatagatatttt

SEQ ID NO: 998658 - DNA, 22 bp, Artificial Sequence
  chemically synthesized
caggaaaaaaaaaaaatatcta

SEQ ID NO: 998659 - DNA, 22 bp, Artificial Sequence
  chemically synthesized
ttccccttctatagatattttt

SEQ ID NO: 998660 - DNA, 22 bp, Artificial Sequence
  chemically synthesized
ccaggaaaaaaaaaaaatatct

SEQ ID NO: 998661 - DNA, 22 bp, Artificial Sequence
  chemically synthesized
tccccttctatagatatttttt

SEQ ID NO: 998662 - DNA, 22 bp, Artificial Sequence
  chemically synthesized
ccccttctatagatattttttt

SEQ ID NO: 998663 - DNA, 22 bp, Artificial Sequence
  chemically synthesized
cccttctatagatatttttttt

SEQ ID NO: 998664 - DNA, 22 bp, Artificial Sequence
  chemically synthesized
cttccaggaaaaaaaaaaaata

SEQ ID NO: 998665 - DNA, 22 bp, Artificial Sequence
  chemically synthesized
ctatagatattttttttttttc

SEQ ID NO: 998666 - DNA, 22 bp, Artificial Sequence
  chemically synthesized
tatagatattttttttttttcc

SEQ ID NO: 998667 - DNA, 22 bp, Artificial Sequence
  chemically synthesized
gaagctccttccaggaaaaaaa

SEQ ID NO: 998668 - DNA, 22 bp, Artificial Sequence
  chemically synthesized
tagatattttttttttttcctg

SEQ ID NO: 998669 - DNA, 22 bp, Artificial Sequence
  chemically synthesized
aaattggaagctccttccagga

SEQ ID NO: 998670 - DNA, 22 bp, Artificial Sequence
  chemically synthesized
gaaattggaagctccttccagg

SEQ ID NO: 998671 - DNA, 22 bp, Artificial Sequence
  chemically synthesized
tttttttttcctggaaggagct

SEQ ID NO: 998672 - DNA, 22 bp, Artificial Sequence
  chemically synthesized
cttgaaattggaagctccttcc

SEQ ID NO: 998673 - DNA, 22 bp, Artificial Sequence
  chemically synthesized
ttttttttcctggaaggagctt

SEQ ID NO: 998674 - DNA, 22 bp, Artificial Sequence
  chemically synthesized
gcttgaaattggaagctccttc

SEQ ID NO: 998675 - DNA, 22 bp, Artificial Sequence
  chemically synthesized
tttttttcctggaaggagcttc

SEQ ID NO: 998676 - DNA, 22 bp, Artificial Sequence
  chemically synthesized
ttttttcctggaaggagcttcc

SEQ ID NO: 998677 - DNA, 22 bp, Artificial Sequence
  chemically synthesized
ttgcttgaaattggaagctcct

SEQ ID NO: 998678 - DNA, 22 bp, Artificial Sequence
  chemically synthesized
tttttcctggaaggagcttcca

SEQ ID NO: 998679 - DNA, 22 bp, Artificial Sequence
  chemically synthesized
ttttcctggaaggagcttccaa

SEQ ID NO: 998680 - DNA, 22 bp, Artificial Sequence
  chemically synthesized
tttcctggaaggagcttccaat

SEQ ID NO: 998681 - DNA, 22 bp, Artificial Sequence
  chemically synthesized
ttcttgcttgaaattggaagct

SEQ ID NO: 998682 - DNA, 22 bp, Artificial Sequence
  chemically synthesized
ttcctggaaggagcttccaatt

SEQ ID NO: 998683 - DNA, 22 bp, Artificial Sequence
  chemically synthesized
tcctggaaggagcttccaattt

SEQ ID NO: 998684 - DNA, 22 bp, Artificial Sequence
  chemically synthesized
tgttcttgcttgaaattggaag

SEQ ID NO: 998685 - DNA, 22 bp, Artificial Sequence
  chemically synthesized
cctggaaggagcttccaatttc

SEQ ID NO: 998686 - DNA, 22 bp, Artificial Sequence
  chemically synthesized
ctgttcttgcttgaaattggaa

SEQ ID NO: 998687 - DNA, 22 bp, Artificial Sequence
  chemically synthesized
ctggaaggagcttccaatttca

SEQ ID NO: 998688 - DNA, 22 bp, Artificial Sequence
  chemically synthesized
cttctgttcttgcttgaaattg

SEQ ID NO: 998689 - DNA, 22 bp, Artificial Sequence
  chemically synthesized
gaaggagcttccaatttcaagc

SEQ ID NO: 998690 - DNA, 22 bp, Artificial Sequence
  chemically synthesized
tgcttctgttcttgcttgaaat

SEQ ID NO: 998691 - DNA, 22 bp, Artificial Sequence
  chemically synthesized
ctgcttctgttcttgcttgaaa

SEQ ID NO: 998692 - DNA, 22 bp, Artificial Sequence
  chemically synthesized
ccaatttcaagcaagaacagaa

SEQ ID NO: 998693 - DNA, 22 bp, Artificial Sequence
  chemically synthesized
gagtgcttctgcttctgttctt

SEQ ID NO: 998694 - DNA, 22 bp, Artificial Sequence
  chemically synthesized
caatttcaagcaagaacagaag

SEQ ID NO: 998695 - DNA, 22 bp, Artificial Sequence
  chemically synthesized
ttggagtgcttctgcttctgtt

SEQ ID NO: 998696 - DNA, 22 bp, Artificial Sequence
  chemically synthesized
attggagtgcttctgcttctgt

SEQ ID NO: 998697 - DNA, 22 bp, Artificial Sequence
  chemically synthesized
caagcaagaacagaagcagaag

SEQ ID NO: 998698 - DNA, 22 bp, Artificial Sequence
  chemically synthesized
aagcaagaacagaagcagaagc

SEQ ID NO: 998699 - DNA, 22 bp, Artificial Sequence
  chemically synthesized
atgtaaccaagcacacttattg

SEQ ID NO: 998700 - DNA, 22 bp, Artificial Sequence
  chemically synthesized
ttcatgtaaccaagcacactta

SEQ ID NO: 998701 - DNA, 22 bp, Artificial Sequence
  chemically synthesized
caataagtgtgcttggttacat

SEQ ID NO: 998702 - DNA, 22 bp, Artificial Sequence
  chemically synthesized
ggttacatgaataacttgtgat

SEQ ID NO: 998703 - DNA, 22 bp, Artificial Sequence
  chemically synthesized
gttacatgaataacttgtgatg

SEQ ID NO: 998704 - DNA, 22 bp, Artificial Sequence
  chemically synthesized
catgaataacttgtgatggttt

SEQ ID NO: 998705 - DNA, 22 bp, Artificial Sequence
  chemically synthesized
ccaggaagtatatccaaaccat

SEQ ID NO: 998706 - DNA, 22 bp, Artificial Sequence
  chemically synthesized
cgtgttgccaggaagtatatcc

SEQ ID NO: 998707 - DNA, 22 bp, Artificial Sequence
  chemically synthesized
gtgatggtttggatatacttcc

SEQ ID NO: 998708 - DNA, 22 bp, Artificial Sequence
  chemically synthesized
tgatggtttggatatacttcct

SEQ ID NO: 998709 - DNA, 22 bp, Artificial Sequence
  chemically synthesized
acattgcgtgttgccaggaagt

SEQ ID NO: 998710 - DNA, 22 bp, Artificial Sequence
  chemically synthesized
taacattgcgtgttgccaggaa

SEQ ID NO: 998711 - DNA, 22 bp, Artificial Sequence
  chemically synthesized
ctaacattgcgtgttgccagga

SEQ ID NO: 998712 - DNA, 22 bp, Artificial Sequence
  chemically synthesized
ggatatacttcctggcaacacg

SEQ ID NO: 998713 - DNA, 22 bp, Artificial Sequence
  chemically synthesized
gatatacttcctggcaacacgc

SEQ ID NO: 998714 - DNA, 22 bp, Artificial Sequence
  chemically synthesized
ggtttctaacattgcgtgttgc

SEQ ID NO: 998715 - DNA, 22 bp, Artificial Sequence
  chemically synthesized
taggtttctaacattgcgtgtt

SEQ ID NO: 998716 - DNA, 22 bp, Artificial Sequence
  chemically synthesized
ctaggtttctaacattgcgtgt

SEQ ID NO: 998717 - DNA, 22 bp, Artificial Sequence
  chemically synthesized
cctggcaacacgcaatgttaga

SEQ ID NO: 998718 - DNA, 22 bp, Artificial Sequence
  chemically synthesized
ctggcaacacgcaatgttagaa

SEQ ID NO: 998719 - DNA, 22 bp, Artificial Sequence
  chemically synthesized
gcaacacgcaatgttagaaacc

SEQ ID NO: 998720 - DNA, 22 bp, Artificial Sequence
  chemically synthesized
aaagtaccaggcagacatattt

SEQ ID NO: 998721 - DNA, 22 bp, Artificial Sequence
  chemically synthesized
aaaagtaccaggcagacatatt

SEQ ID NO: 998722 - DNA, 22 bp, Artificial Sequence
  chemically synthesized
gaaacctagaaatatgtctgcc

SEQ ID NO: 998723 - DNA, 22 bp, Artificial Sequence
  chemically synthesized
cccttaaaagtaccaggcagac

SEQ ID NO: 998724 - DNA, 22 bp, Artificial Sequence
  chemically synthesized
gaaatatgtctgcctggtactt

SEQ ID NO: 998725 - DNA, 22 bp, Artificial Sequence
  chemically synthesized
tatattccccttaaaagtacca

SEQ ID NO: 998726 - DNA, 22 bp, Artificial Sequence
  chemically synthesized
tatatattccccttaaaagtac

SEQ ID NO: 998727 - DNA, 22 bp, Artificial Sequence
  chemically synthesized
tctatatattccccttaaaagt

SEQ ID NO: 998728 - DNA, 22 bp, Artificial Sequence
  chemically synthesized
cctggtacttttaaggggaata

SEQ ID NO: 998729 - DNA, 22 bp, Artificial Sequence
  chemically synthesized
gtacttttaaggggaatatata

SEQ ID NO: 998730 - DNA, 22 bp, Artificial Sequence
  chemically synthesized
aaaagaggctctctatatattc

SEQ ID NO: 998731 - DNA, 22 bp, Artificial Sequence
  chemically synthesized
caaaagaggctctctatatatt

SEQ ID NO: 998732 - DNA, 22 bp, Artificial Sequence
  chemically synthesized
ttaaggggaatatatagagagc

SEQ ID NO: 998733 - DNA, 22 bp, Artificial Sequence
  chemically synthesized
taaggggaatatatagagagcc

SEQ ID NO: 998734 - DNA, 22 bp, Artificial Sequence
  chemically synthesized
aaggggaatatatagagagcct

SEQ ID NO: 998735 - DNA, 22 bp, Artificial Sequence
  chemically synthesized
aggggaatatatagagagcctc

SEQ ID NO: 998736 - DNA, 22 bp, Artificial Sequence
  chemically synthesized
aaagtttcaaaagaggctctct

SEQ ID NO: 998737 - DNA, 22 bp, Artificial Sequence
  chemically synthesized
caaagtttcaaaagaggctctc

SEQ ID NO: 998738 - DNA, 22 bp, Artificial Sequence
  chemically synthesized
tcaaagtttcaaaagaggctct

SEQ ID NO: 998739 - DNA, 22 bp, Artificial Sequence
  chemically synthesized
ttcaaagtttcaaaagaggctc

SEQ ID NO: 998740 - DNA, 22 bp, Artificial Sequence
  chemically synthesized
ttttgaaactttgaaaagattt

SEQ ID NO: 998741 - DNA, 22 bp, Artificial Sequence
  chemically synthesized
cagaatagaaaataaatctttt

SEQ ID NO: 998742 - DNA, 22 bp, Artificial Sequence
  chemically synthesized
ttgaaactttgaaaagatttat

SEQ ID NO: 998743 - DNA, 22 bp, Artificial Sequence
  chemically synthesized
tgaaactttgaaaagatttatt

SEQ ID NO: 998744 - DNA, 22 bp, Artificial Sequence
  chemically synthesized
gaaactttgaaaagatttattt

SEQ ID NO: 998745 - DNA, 22 bp, Artificial Sequence
  chemically synthesized
aaactttgaaaagatttatttt

SEQ ID NO: 998746 - DNA, 22 bp, Artificial Sequence
  chemically synthesized
aaatgtctccagaatagaaaat

SEQ ID NO: 998747 - DNA, 22 bp, Artificial Sequence
  chemically synthesized
tgaaaagatttattttctattc

SEQ ID NO: 998748 - DNA, 22 bp, Artificial Sequence
  chemically synthesized
gaaaagatttattttctattct

SEQ ID NO: 998749 - DNA, 22 bp, Artificial Sequence
  chemically synthesized
aaaagatttattttctattctg

SEQ ID NO: 998750 - DNA, 22 bp, Artificial Sequence
  chemically synthesized
catactaaaatgtctccagaat

SEQ ID NO: 998751 - DNA, 22 bp, Artificial Sequence
  chemically synthesized
tccatactaaaatgtctccaga

SEQ ID NO: 998752 - DNA, 22 bp, Artificial Sequence
  chemically synthesized
attttctattctggagacattt

SEQ ID NO: 998753 - DNA, 22 bp, Artificial Sequence
  chemically synthesized
ttttctattctggagacatttt

SEQ ID NO: 998754 - DNA, 22 bp, Artificial Sequence
  chemically synthesized
aactctccatactaaaatgtct

SEQ ID NO: 998755 - DNA, 22 bp, Artificial Sequence
  chemically synthesized
caactctccatactaaaatgtc

SEQ ID NO: 998756 - DNA, 22 bp, Artificial Sequence
  chemically synthesized
tctattctggagacattttagt

SEQ ID NO: 998757 - DNA, 22 bp, Artificial Sequence
  chemically synthesized
ctattctggagacattttagta

SEQ ID NO: 998758 - DNA, 22 bp, Artificial Sequence
  chemically synthesized
tattctggagacattttagtat

SEQ ID NO: 998759 - DNA, 22 bp, Artificial Sequence
  chemically synthesized
ttctggagacattttagtatgg

SEQ ID NO: 998760 - DNA, 22 bp, Artificial Sequence
  chemically synthesized
tggagacattttagtatggaga

SEQ ID NO: 998761 - DNA, 22 bp, Artificial Sequence
  chemically synthesized
tgcaaccttcaactctccatac

SEQ ID NO: 998762 - DNA, 22 bp, Artificial Sequence
  chemically synthesized
gagacattttagtatggagagt

SEQ ID NO: 998763 - DNA, 22 bp, Artificial Sequence
  chemically synthesized
atgcaaccttcaactctccata

SEQ ID NO: 998764 - DNA, 22 bp, Artificial Sequence
  chemically synthesized
tatgcaaccttcaactctccat

SEQ ID NO: 998765 - DNA, 22 bp, Artificial Sequence
  chemically synthesized
ttatgcaaccttcaactctcca

SEQ ID NO: 998766 - DNA, 22 bp, Artificial Sequence
  chemically synthesized
tatttttatgcaaccttcaact

SEQ ID NO: 998767 - DNA, 22 bp, Artificial Sequence
  chemically synthesized
tagtatggagagttgaaggttg

SEQ ID NO: 998768 - DNA, 22 bp, Artificial Sequence
  chemically synthesized
agtatggagagttgaaggttgc

SEQ ID NO: 998769 - DNA, 22 bp, Artificial Sequence
  chemically synthesized
ctgtatttttatgcaaccttca

SEQ ID NO: 998770 - DNA, 22 bp, Artificial Sequence
  chemically synthesized
gtatggagagttgaaggttgca

SEQ ID NO: 998771 - DNA, 22 bp, Artificial Sequence
  chemically synthesized
gttgctgtatttttatgcaacc

SEQ ID NO: 998772 - DNA, 22 bp, Artificial Sequence
  chemically synthesized
agttgctgtatttttatgcaac

SEQ ID NO: 998773 - DNA, 22 bp, Artificial Sequence
  chemically synthesized
tcttagttgctgtatttttatg

SEQ ID NO: 998774 - DNA, 22 bp, Artificial Sequence
  chemically synthesized
aaggttgcataaaaatacagca

SEQ ID NO: 998775 - DNA, 22 bp, Artificial Sequence
  chemically synthesized
caactatcttagttgctgtatt

SEQ ID NO: 998776 - DNA, 22 bp, Artificial Sequence
  chemically synthesized
ttccaactatcttagttgctgt

SEQ ID NO: 998777 - DNA, 22 bp, Artificial Sequence
  chemically synthesized
cataaaaatacagcaactaaga

SEQ ID NO: 998778 - DNA, 22 bp, Artificial Sequence
  chemically synthesized
gagaataactattccaactatc

SEQ ID NO: 998779 - DNA, 22 bp, Artificial Sequence
  chemically synthesized
cctagagaataactattccaac

SEQ ID NO: 998780 - DNA, 22 bp, Artificial Sequence
  chemically synthesized
ccctagagaataactattccaa

SEQ ID NO: 998781 - DNA, 22 bp, Artificial Sequence
  chemically synthesized
agatagttggaatagttattct

SEQ ID NO: 998782 - DNA, 22 bp, Artificial Sequence
  chemically synthesized
gggccaaatgtttccctagaga

SEQ ID NO: 998783 - DNA, 22 bp, Artificial Sequence
  chemically synthesized
agggccaaatgtttccctagag

SEQ ID NO: 998784 - DNA, 22 bp, Artificial Sequence
  chemically synthesized
gaatagttattctctagggaaa

SEQ ID NO: 998785 - DNA, 22 bp, Artificial Sequence
  chemically synthesized
tcttagggccaaatgtttccct

SEQ ID NO: 998786 - DNA, 22 bp, Artificial Sequence
  chemically synthesized
gtcttagggccaaatgtttccc

SEQ ID NO: 998787 - DNA, 22 bp, Artificial Sequence
  chemically synthesized
ttctctagggaaacatttggcc

SEQ ID NO: 998788 - DNA, 22 bp, Artificial Sequence
  chemically synthesized
tctagggaaacatttggcccta

SEQ ID NO: 998789 - DNA, 22 bp, Artificial Sequence
  chemically synthesized
tagggaaacatttggccctaag

SEQ ID NO: 998790 - DNA, 22 bp, Artificial Sequence
  chemically synthesized
caacatgtcttgtcttagggcc

SEQ ID NO: 998791 - DNA, 22 bp, Artificial Sequence
  chemically synthesized
gggaaacatttggccctaagac

SEQ ID NO: 998792 - DNA, 22 bp, Artificial Sequence
  chemically synthesized
ccaacatgtcttgtcttagggc

SEQ ID NO: 998793 - DNA, 22 bp, Artificial Sequence
  chemically synthesized
tgtgtttccaacatgtcttgtc

SEQ ID NO: 998794 - DNA, 22 bp, Artificial Sequence
  chemically synthesized
atgtgtttccaacatgtcttgt

SEQ ID NO: 998795 - DNA, 22 bp, Artificial Sequence
  chemically synthesized
ggccctaagacaagacatgttg

SEQ ID NO: 998796 - DNA, 22 bp, Artificial Sequence
  chemically synthesized
tttatgtgtttccaacatgtct

SEQ ID NO: 998797 - DNA, 22 bp, Artificial Sequence
  chemically synthesized
gccctaagacaagacatgttgg

SEQ ID NO: 998798 - DNA, 22 bp, Artificial Sequence
  chemically synthesized
gtttatgtgtttccaacatgtc

SEQ ID NO: 998799 - DNA, 22 bp, Artificial Sequence
  chemically synthesized
cttgtttatgtgtttccaacat

SEQ ID NO: 998800 - DNA, 22 bp, Artificial Sequence
  chemically synthesized
gcttgtttatgtgtttccaaca

SEQ ID NO: 998801 - DNA, 22 bp, Artificial Sequence
  chemically synthesized
agacaagacatgttggaaacac

SEQ ID NO: 998802 - DNA, 22 bp, Artificial Sequence
  chemically synthesized
tttgcttgtttatgtgtttcca

SEQ ID NO: 998803 - DNA, 22 bp, Artificial Sequence
  chemically synthesized
atttgcttgtttatgtgtttcc

SEQ ID NO: 998804 - DNA, 22 bp, Artificial Sequence
  chemically synthesized
tatttgcttgtttatgtgtttc

SEQ ID NO: 998805 - DNA, 22 bp, Artificial Sequence
  chemically synthesized
ccaattttatttgcttgtttat

SEQ ID NO: 998806 - DNA, 22 bp, Artificial Sequence
  chemically synthesized
gccaattttatttgcttgttta

SEQ ID NO: 998807 - DNA, 22 bp, Artificial Sequence
  chemically synthesized
gaaacacataaacaagcaaata

SEQ ID NO: 998808 - DNA, 22 bp, Artificial Sequence
  chemically synthesized
catttgccaattttatttgctt

SEQ ID NO: 998809 - DNA, 22 bp, Artificial Sequence
  chemically synthesized
acatttgccaattttatttgct

SEQ ID NO: 998810 - DNA, 22 bp, Artificial Sequence
  chemically synthesized
acgagcatatatgaatcaaaac

SEQ ID NO: 998811 - DNA, 22 bp, Artificial Sequence
  chemically synthesized
cacgagcatatatgaatcaaaa

SEQ ID NO: 998812 - DNA, 22 bp, Artificial Sequence
  chemically synthesized
gcaaatgtaagttttgattcat

SEQ ID NO: 998813 - DNA, 22 bp, Artificial Sequence
  chemically synthesized
agaatatagtttcacgagcata

SEQ ID NO: 998814 - DNA, 22 bp, Artificial Sequence
  chemically synthesized
tgattcatatatgctcgtgaaa

SEQ ID NO: 998815 - DNA, 22 bp, Artificial Sequence
  chemically synthesized
gattcatatatgctcgtgaaac

SEQ ID NO: 998816 - DNA, 22 bp, Artificial Sequence
  chemically synthesized
attcatatatgctcgtgaaact

SEQ ID NO: 998817 - DNA, 22 bp, Artificial Sequence
  chemically synthesized
atatatgctcgtgaaactatat

SEQ ID NO: 998818 - DNA, 22 bp, Artificial Sequence
  chemically synthesized
aatagcattaagaatatagttt

SEQ ID NO: 998819 - DNA, 22 bp, Artificial Sequence
  chemically synthesized
tcaatagcattaagaatatagt

SEQ ID NO: 998820 - DNA, 22 bp, Artificial Sequence
  chemically synthesized
acctctcaatagcattaagaat

SEQ ID NO: 998821 - DNA, 22 bp, Artificial Sequence
  chemically synthesized
gtgaaactatattcttaatgct

SEQ ID NO: 998822 - DNA, 22 bp, Artificial Sequence
  chemically synthesized
gcctcacctctcaatagcatta

SEQ ID NO: 998823 - DNA, 22 bp, Artificial Sequence
  chemically synthesized
tattcttaatgctattgagagg

SEQ ID NO: 998824 - DNA, 22 bp, Artificial Sequence
  chemically synthesized
ttaatgctattgagaggtgagg

SEQ ID NO: 998825 - DNA, 22 bp, Artificial Sequence
  chemically synthesized
aatgctattgagaggtgaggcc

SEQ ID NO: 998826 - DNA, 22 bp, Artificial Sequence
  chemically synthesized
atgctattgagaggtgaggcca

SEQ ID NO: 998827 - DNA, 22 bp, Artificial Sequence
  chemically synthesized
gacccagaaagtccagctggcc

SEQ ID NO: 998828 - DNA, 22 bp, Artificial Sequence
  chemically synthesized
ttgagaggtgaggccagctgga

SEQ ID NO: 998829 - DNA, 22 bp, Artificial Sequence
  chemically synthesized
agaggtgaggccagctggactt

SEQ ID NO: 998830 - DNA, 22 bp, Artificial Sequence
  chemically synthesized
cccaagtccccactcgacccag

SEQ ID NO: 998831 - DNA, 22 bp, Artificial Sequence
  chemically synthesized
gactttctgggtcgagtgggga

SEQ ID NO: 998832 - DNA, 22 bp, Artificial Sequence
  chemically synthesized
tctgggtcgagtggggacttgg

SEQ ID NO: 998833 - DNA, 22 bp, Artificial Sequence
  chemically synthesized
ctgggtcgagtggggacttggg

SEQ ID NO: 998834 - DNA, 22 bp, Artificial Sequence
  chemically synthesized
tgggtcgagtggggacttgggg

SEQ ID NO: 998835 - DNA, 22 bp, Artificial Sequence
  chemically synthesized
ggtcgagtggggacttggggaa

SEQ ID NO: 998836 - DNA, 22 bp, Artificial Sequence
  chemically synthesized
taagacagaaaagttccccaag

SEQ ID NO: 998837 - DNA, 22 bp, Artificial Sequence
  chemically synthesized
gtaagacagaaaagttccccaa

SEQ ID NO: 998838 - DNA, 22 bp, Artificial Sequence
  chemically synthesized
ttgtaagacagaaaagttcccc

SEQ ID NO: 998839 - DNA, 22 bp, Artificial Sequence
  chemically synthesized
caatcctcttgtaagacagaaa

SEQ ID NO: 998840 - DNA, 22 bp, Artificial Sequence
  chemically synthesized
acaatcctcttgtaagacagaa

SEQ ID NO: 998841 - DNA, 22 bp, Artificial Sequence
  chemically synthesized
tacaatcctcttgtaagacaga

SEQ ID NO: 998842 - DNA, 22 bp, Artificial Sequence
  chemically synthesized
ggggaacttttctgtcttacaa

SEQ ID NO: 998843 - DNA, 22 bp, Artificial Sequence
  chemically synthesized
gggaacttttctgtcttacaag

SEQ ID NO: 998844 - DNA, 22 bp, Artificial Sequence
  chemically synthesized
gtgcgttttacaatcctcttgt

SEQ ID NO: 998845 - DNA, 22 bp, Artificial Sequence
  chemically synthesized
ttctgtcttacaagaggattgt

SEQ ID NO: 998846 - DNA, 22 bp, Artificial Sequence
  chemically synthesized
tctgtcttacaagaggattgta

SEQ ID NO: 998847 - DNA, 22 bp, Artificial Sequence
  chemically synthesized
attggtgcgttttacaatcctc

SEQ ID NO: 998848 - DNA, 22 bp, Artificial Sequence
  chemically synthesized
ctgtcttacaagaggattgtaa

SEQ ID NO: 998849 - DNA, 22 bp, Artificial Sequence
  chemically synthesized
tgtcttacaagaggattgtaaa

SEQ ID NO: 998850 - DNA, 22 bp, Artificial Sequence
  chemically synthesized
ctgattggtgcgttttacaatc

SEQ ID NO: 998851 - DNA, 22 bp, Artificial Sequence
  chemically synthesized
tcttacaagaggattgtaaaac

SEQ ID NO: 998852 - DNA, 22 bp, Artificial Sequence
  chemically synthesized
acaagaggattgtaaaacgcac

SEQ ID NO: 998853 - DNA, 22 bp, Artificial Sequence
  chemically synthesized
caagaggattgtaaaacgcacc

SEQ ID NO: 998854 - DNA, 22 bp, Artificial Sequence
  chemically synthesized
taagacgggaaggttcctgatt

SEQ ID NO: 998855 - DNA, 22 bp, Artificial Sequence
  chemically synthesized
taaaacgcaccaatcaggaacc

SEQ ID NO: 998856 - DNA, 22 bp, Artificial Sequence
  chemically synthesized
gtaagacgggaaggttcctgat

SEQ ID NO: 998857 - DNA, 22 bp, Artificial Sequence
  chemically synthesized
ttgtaagacgggaaggttcctg

SEQ ID NO: 998858 - DNA, 22 bp, Artificial Sequence
  chemically synthesized
caatcctcttgtaagacgggaa

SEQ ID NO: 998859 - DNA, 22 bp, Artificial Sequence
  chemically synthesized
acaatcctcttgtaagacggga

SEQ ID NO: 998860 - DNA, 22 bp, Artificial Sequence
  chemically synthesized
tacaatcctcttgtaagacggg

SEQ ID NO: 998861 - DNA, 22 bp, Artificial Sequence
  chemically synthesized
gtgcgttttacaatcctcttgt

SEQ ID NO: 998862 - DNA, 22 bp, Artificial Sequence
  chemically synthesized
cccgtcttacaagaggattgta

SEQ ID NO: 998863 - DNA, 22 bp, Artificial Sequence
  chemically synthesized
attggtgcgttttacaatcctc

SEQ ID NO: 998864 - DNA, 22 bp, Artificial Sequence
  chemically synthesized
ccgtcttacaagaggattgtaa

SEQ ID NO: 998865 - DNA, 22 bp, Artificial Sequence
  chemically synthesized
acaagaggattgtaaaacgcac

SEQ ID NO: 998866 - DNA, 22 bp, Artificial Sequence
  chemically synthesized
caagaggattgtaaaacgcacc

SEQ ID NO: 998867 - DNA, 22 bp, Artificial Sequence
  chemically synthesized
cagagcgctgattggtgcgttt

SEQ ID NO: 998868 - DNA, 22 bp, Artificial Sequence
  chemically synthesized
acagagcgctgattggtgcgtt

SEQ ID NO: 998869 - DNA, 22 bp, Artificial Sequence
  chemically synthesized
tacagagcgctgattggtgcgt

SEQ ID NO: 998870 - DNA, 22 bp, Artificial Sequence
  chemically synthesized
taaaacgcaccaatcagcgctc

SEQ ID NO: 998871 - DNA, 22 bp, Artificial Sequence
  chemically synthesized
gtgcattttacagagcgctgat

SEQ ID NO: 998872 - DNA, 22 bp, Artificial Sequence
  chemically synthesized
attggtgcattttacagagcgc

SEQ ID NO: 998873 - DNA, 22 bp, Artificial Sequence
  chemically synthesized
ctgattggtgcattttacagag

SEQ ID NO: 998874 - DNA, 22 bp, Artificial Sequence
  chemically synthesized
gaatcctactgattggtgcatt

SEQ ID NO: 998875 - DNA, 22 bp, Artificial Sequence
  chemically synthesized
agaatcctactgattggtgcat

SEQ ID NO: 998876 - DNA, 22 bp, Artificial Sequence
  chemically synthesized
tagaatcctactgattggtgca

SEQ ID NO: 998877 - DNA, 22 bp, Artificial Sequence
  chemically synthesized
ttagaatcctactgattggtgc

SEQ ID NO: 998878 - DNA, 22 bp, Artificial Sequence
  chemically synthesized
cttttagaatcctactgattgg

SEQ ID NO: 998879 - DNA, 22 bp, Artificial Sequence
  chemically synthesized
tgtaaaatgcaccaatcagtag

SEQ ID NO: 998880 - DNA, 22 bp, Artificial Sequence
  chemically synthesized
taaaatgcaccaatcagtagga

SEQ ID NO: 998881 - DNA, 22 bp, Artificial Sequence
  chemically synthesized
gctacttttagaatcctactga

SEQ ID NO: 998882 - DNA, 22 bp, Artificial Sequence
  chemically synthesized
cccacgattggctacttttaga

SEQ ID NO: 998883 - DNA, 22 bp, Artificial Sequence
  chemically synthesized
aatcctccccacgattggctac

SEQ ID NO: 998884 - DNA, 22 bp, Artificial Sequence
  chemically synthesized
caatcctccccacgattggcta

SEQ ID NO: 998885 - DNA, 22 bp, Artificial Sequence
  chemically synthesized
tcaatcctccccacgattggct

SEQ ID NO: 998886 - DNA, 22 bp, Artificial Sequence
  chemically synthesized
ttcaatcctccccacgattggc

SEQ ID NO: 998887 - DNA, 22 bp, Artificial Sequence
  chemically synthesized
tttcaatcctccccacgattgg

SEQ ID NO: 998888 - DNA, 22 bp, Artificial Sequence
  chemically synthesized
ttttcaatcctccccacgattg

SEQ ID NO: 998889 - DNA, 22 bp, Artificial Sequence
  chemically synthesized
taaaagtagccaatcgtgggga

SEQ ID NO: 998890 - DNA, 22 bp, Artificial Sequence
  chemically synthesized
aaagtagccaatcgtggggagg

SEQ ID NO: 998891 - DNA, 22 bp, Artificial Sequence
  chemically synthesized
tcagagtgcccttttttcaatc

SEQ ID NO: 998892 - DNA, 22 bp, Artificial Sequence
  chemically synthesized
tcctatcagagtgccctttttt

SEQ ID NO: 998893 - DNA, 22 bp, Artificial Sequence
  chemically synthesized
tgtcctatcagagtgccctttt

SEQ ID NO: 998894 - DNA, 22 bp, Artificial Sequence
  chemically synthesized
ctgtcctatcagagtgcccttt

SEQ ID NO: 998895 - DNA, 22 bp, Artificial Sequence
  chemically synthesized
catttctgtcctatcagagtgc

SEQ ID NO: 998896 - DNA, 22 bp, Artificial Sequence
  chemically synthesized
aaaaaagggcactctgatagga

SEQ ID NO: 998897 - DNA, 22 bp, Artificial Sequence
  chemically synthesized
ccatgttccatttctgtcctat

SEQ ID NO: 998898 - DNA, 22 bp, Artificial Sequence
  chemically synthesized
tcccctcccatgttccatttct

SEQ ID NO: 998899 - DNA, 22 bp, Artificial Sequence
  chemically synthesized
tgataggacagaaatggaacat

SEQ ID NO: 998900 - DNA, 22 bp, Artificial Sequence
  chemically synthesized
ctgtcccctcccatgttccatt

SEQ ID NO: 998901 - DNA, 22 bp, Artificial Sequence
  chemically synthesized
actgtcccctcccatgttccat

SEQ ID NO: 998902 - DNA, 22 bp, Artificial Sequence
  chemically synthesized
ataggacagaaatggaacatgg

SEQ ID NO: 998903 - DNA, 22 bp, Artificial Sequence
  chemically synthesized
ccttactgtcccctcccatgtt

SEQ ID NO: 998904 - DNA, 22 bp, Artificial Sequence
  chemically synthesized
ttcccttactgtcccctcccat

SEQ ID NO: 998905 - DNA, 22 bp, Artificial Sequence
  chemically synthesized
attcccttactgtcccctccca

SEQ ID NO: 998906 - DNA, 22 bp, Artificial Sequence
  chemically synthesized
tattcccttactgtcccctccc

SEQ ID NO: 998907 - DNA, 22 bp, Artificial Sequence
  chemically synthesized
ttattcccttactgtcccctcc

SEQ ID NO: 998908 - DNA, 22 bp, Artificial Sequence
  chemically synthesized
ggtggccagcttttattccctt

SEQ ID NO: 998909 - DNA, 22 bp, Artificial Sequence
  chemically synthesized
gggtggccagcttttattccct

SEQ ID NO: 998910 - DNA, 22 bp, Artificial Sequence
  chemically synthesized
gcttgggtggccagcttttatt

SEQ ID NO: 998911 - DNA, 22 bp, Artificial Sequence
  chemically synthesized
ctggcttgggtggccagctttt

SEQ ID NO: 998912 - DNA, 22 bp, Artificial Sequence
  chemically synthesized
ccgctgctggcttgggtggcca

SEQ ID NO: 998913 - DNA, 22 bp, Artificial Sequence
  chemically synthesized
gccacccaagccagcagcggca

SEQ ID NO: 998914 - DNA, 22 bp, Artificial Sequence
  chemically synthesized
cacaacgtggaaggggacccaa

SEQ ID NO: 998915 - DNA, 22 bp, Artificial Sequence
  chemically synthesized
ccacaacgtggaaggggaccca

SEQ ID NO: 998916 - DNA, 22 bp, Artificial Sequence
  chemically synthesized
cttgggtccccttccacgttgt

SEQ ID NO: 998917 - DNA, 22 bp, Artificial Sequence
  chemically synthesized
gggtccccttccacgttgtgga

SEQ ID NO: 998918 - DNA, 22 bp, Artificial Sequence
  chemically synthesized
ggtccccttccacgttgtggaa

SEQ ID NO: 998919 - DNA, 22 bp, Artificial Sequence
  chemically synthesized
ccacgttgtggaagctttgttc

SEQ ID NO: 998920 - DNA, 22 bp, Artificial Sequence
  chemically synthesized
tgaagagcaaaagaacaaagct

SEQ ID NO: 998921 - DNA, 22 bp, Artificial Sequence
  chemically synthesized
cacgttgtggaagctttgttct

SEQ ID NO: 998922 - DNA, 22 bp, Artificial Sequence
  chemically synthesized
ttgtgaagagcaaaagaacaaa

SEQ ID NO: 998923 - DNA, 22 bp, Artificial Sequence
  chemically synthesized
attgtgaagagcaaaagaacaa

SEQ ID NO: 998924 - DNA, 22 bp, Artificial Sequence
  chemically synthesized
tggaagctttgttcttttgctc

SEQ ID NO: 998925 - DNA, 22 bp, Artificial Sequence
  chemically synthesized
tgttcttttgctcttcacaata

SEQ ID NO: 998926 - DNA, 22 bp, Artificial Sequence
  chemically synthesized
gttcttttgctcttcacaataa

SEQ ID NO: 998927 - DNA, 22 bp, Artificial Sequence
  chemically synthesized
ttcttttgctcttcacaataaa

SEQ ID NO: 998928 - DNA, 22 bp, Artificial Sequence
  chemically synthesized
ttttgctcttcacaataaatct

SEQ ID NO: 998929 - DNA, 22 bp, Artificial Sequence
  chemically synthesized
ttgctcttcacaataaatcttg

SEQ ID NO: 998930 - DNA, 22 bp, Artificial Sequence
  chemically synthesized
tgctcttcacaataaatcttgc

SEQ ID NO: 998931 - DNA, 22 bp, Artificial Sequence
  chemically synthesized
gctcttcacaataaatcttgct

SEQ ID NO: 998932 - DNA, 22 bp, Artificial Sequence
  chemically synthesized
ctcttcacaataaatcttgctg

SEQ ID NO: 998933 - DNA, 22 bp, Artificial Sequence
  chemically synthesized
ttcacaataaatcttgctgctg

SEQ ID NO: 998934 - DNA, 22 bp, Artificial Sequence
  chemically synthesized
cacaataaatcttgctgctgct

SEQ ID NO: 998935 - DNA, 22 bp, Artificial Sequence
  chemically synthesized
acaataaatcttgctgctgctc

SEQ ID NO: 998936 - DNA, 22 bp, Artificial Sequence
  chemically synthesized
aaggtggcacgaacccaaacag

SEQ ID NO: 998937 - DNA, 22 bp, Artificial Sequence
  chemically synthesized
gctgctgctcgctgtttgggtt

SEQ ID NO: 998938 - DNA, 22 bp, Artificial Sequence
  chemically synthesized
aaaggtggcacgaacccaaaca

SEQ ID NO: 998939 - DNA, 22 bp, Artificial Sequence
  chemically synthesized
ctgctgctcgctgtttgggttc

SEQ ID NO: 998940 - DNA, 22 bp, Artificial Sequence
  chemically synthesized
ttaaaggtggcacgaacccaaa

SEQ ID NO: 998941 - DNA, 22 bp, Artificial Sequence
  chemically synthesized
ctgctcgctgtttgggttcgtg

SEQ ID NO: 998942 - DNA, 22 bp, Artificial Sequence
  chemically synthesized
ctcgctgtttgggttcgtgcca

SEQ ID NO: 998943 - DNA, 22 bp, Artificial Sequence
  chemically synthesized
cagctcttaaaggtggcacgaa

SEQ ID NO: 998944 - DNA, 22 bp, Artificial Sequence
  chemically synthesized
gctgtttgggttcgtgccacct

SEQ ID NO: 998945 - DNA, 22 bp, Artificial Sequence
  chemically synthesized
ttacagctcttaaaggtggcac

SEQ ID NO: 998946 - DNA, 22 bp, Artificial Sequence
  chemically synthesized
tttgggttcgtgccacctttaa

SEQ ID NO: 998947 - DNA, 22 bp, Artificial Sequence
  chemically synthesized
gggttcgtgccacctttaagag

SEQ ID NO: 998948 - DNA, 22 bp, Artificial Sequence
  chemically synthesized
ggttcgtgccacctttaagagc

SEQ ID NO: 998949 - DNA, 22 bp, Artificial Sequence
  chemically synthesized
cggtgactgttacagctcttaa

SEQ ID NO: 998950 - DNA, 22 bp, Artificial Sequence
  chemically synthesized
tgcggtgactgttacagctctt

SEQ ID NO: 998951 - DNA, 22 bp, Artificial Sequence
  chemically synthesized
gtgccacctttaagagctgtaa

SEQ ID NO: 998952 - DNA, 22 bp, Artificial Sequence
  chemically synthesized
taagagctgtaacagtcaccgc

SEQ ID NO: 998953 - DNA, 22 bp, Artificial Sequence
  chemically synthesized
aagagctgtaacagtcaccgca

SEQ ID NO: 998954 - DNA, 22 bp, Artificial Sequence
  chemically synthesized
agagctgtaacagtcaccgcag

SEQ ID NO: 998955 - DNA, 22 bp, Artificial Sequence
  chemically synthesized
taacagtcaccgcagaggtccg

SEQ ID NO: 998956 - DNA, 22 bp, Artificial Sequence
  chemically synthesized
aagaacgaagccacggacctct

SEQ ID NO: 998957 - DNA, 22 bp, Artificial Sequence
  chemically synthesized
caagaacgaagccacggacctc

SEQ ID NO: 998958 - DNA, 22 bp, Artificial Sequence
  chemically synthesized
acttcaagaacgaagccacgga

SEQ ID NO: 998959 - DNA, 22 bp, Artificial Sequence
  chemically synthesized
gctgacttcaagaacgaagcca

SEQ ID NO: 998960 - DNA, 22 bp, Artificial Sequence
  chemically synthesized
gtggtctcgctgacttcaagaa

SEQ ID NO: 998961 - DNA, 22 bp, Artificial Sequence
  chemically synthesized
cgttcttgaagtcagcgagacc

SEQ ID NO: 998962 - DNA, 22 bp, Artificial Sequence
  chemically synthesized
gttcttgaagtcagcgagacca

SEQ ID NO: 998963 - DNA, 22 bp, Artificial Sequence
  chemically synthesized
ccgccggtgggttcgtggtctc

SEQ ID NO: 998964 - DNA, 22 bp, Artificial Sequence
  chemically synthesized
ttgaagtcagcgagaccacgaa

SEQ ID NO: 998965 - DNA, 22 bp, Artificial Sequence
  chemically synthesized
gaagtcagcgagaccacgaacc

SEQ ID NO: 998966 - DNA, 22 bp, Artificial Sequence
  chemically synthesized
aagtcagcgagaccacgaaccc

SEQ ID NO: 998967 - DNA, 22 bp, Artificial Sequence
  chemically synthesized
gttcccgccggtgggttcgtgg

SEQ ID NO: 998968 - DNA, 22 bp, Artificial Sequence
  chemically synthesized
aggtcatagtgtgtccagagtt

SEQ ID NO: 998969 - DNA, 22 bp, Artificial Sequence
  chemically synthesized
aaggtcatagtgtgtccagagt

SEQ ID NO: 998970 - DNA, 22 bp, Artificial Sequence
  chemically synthesized
cttaaggtcatagtgtgtccag

SEQ ID NO: 998971 - DNA, 22 bp, Artificial Sequence
  chemically synthesized
acttaaggtcatagtgtgtcca

SEQ ID NO: 998972 - DNA, 22 bp, Artificial Sequence
  chemically synthesized
tggacacactatgaccttaagt

SEQ ID NO: 998973 - DNA, 22 bp, Artificial Sequence
  chemically synthesized
gacacactatgaccttaagtaa

SEQ ID NO: 998974 - DNA, 22 bp, Artificial Sequence
  chemically synthesized
ggatccatgaagacagacttac

SEQ ID NO: 998975 - DNA, 22 bp, Artificial Sequence
  chemically synthesized
tgaccttaagtaagtctgtctt

SEQ ID NO: 998976 - DNA, 22 bp, Artificial Sequence
  chemically synthesized
aagtaagtctgtcttcatggat

SEQ ID NO: 998977 - DNA, 22 bp, Artificial Sequence
  chemically synthesized
agtaagtctgtcttcatggatc

SEQ ID NO: 998978 - DNA, 22 bp, Artificial Sequence
  chemically synthesized
ggaaatatctaggatccatgaa

SEQ ID NO: 998979 - DNA, 22 bp, Artificial Sequence
  chemically synthesized
tcttcatggatcctagatattt

SEQ ID NO: 998980 - DNA, 22 bp, Artificial Sequence
  chemically synthesized
catggatcctagatatttccta

SEQ ID NO: 998981 - DNA, 22 bp, Artificial Sequence
  chemically synthesized
atggatcctagatatttcctag

SEQ ID NO: 998982 - DNA, 22 bp, Artificial Sequence
  chemically synthesized
aggaagatacaaaggctaggaa

SEQ ID NO: 998983 - DNA, 22 bp, Artificial Sequence
  chemically synthesized
aaggaagatacaaaggctagga

SEQ ID NO: 998984 - DNA, 22 bp, Artificial Sequence
  chemically synthesized
taaggaagatacaaaggctagg

SEQ ID NO: 998985 - DNA, 22 bp, Artificial Sequence
  chemically synthesized
gatatttcctagcctttgtatc

SEQ ID NO: 998986 - DNA, 22 bp, Artificial Sequence
  chemically synthesized
aaggtaacctttaaggaagata

SEQ ID NO: 998987 - DNA, 22 bp, Artificial Sequence
  chemically synthesized
cctagcctttgtatcttcctta

SEQ ID NO: 998988 - DNA, 22 bp, Artificial Sequence
  chemically synthesized
ctagcctttgtatcttccttaa

SEQ ID NO: 998989 - DNA, 22 bp, Artificial Sequence
  chemically synthesized
gcctttgtatcttccttaaagg

SEQ ID NO: 998990 - DNA, 22 bp, Artificial Sequence
  chemically synthesized
tgtatcttccttaaaggttacc

SEQ ID NO: 998991 - DNA, 22 bp, Artificial Sequence
  chemically synthesized
gtatcttccttaaaggttacct

SEQ ID NO: 998992 - DNA, 22 bp, Artificial Sequence
  chemically synthesized
aaaagcacctgaaggtaacctt

SEQ ID NO: 998993 - DNA, 22 bp, Artificial Sequence
  chemically synthesized
tatcttccttaaaggttacctt

SEQ ID NO: 998994 - DNA, 22 bp, Artificial Sequence
  chemically synthesized
caaaagcacctgaaggtaacct

SEQ ID NO: 998995 - DNA, 22 bp, Artificial Sequence
  chemically synthesized
ccttaaaggttaccttcaggtg

SEQ ID NO: 998996 - DNA, 22 bp, Artificial Sequence
  chemically synthesized
cttaaaggttaccttcaggtgc

SEQ ID NO: 998997 - DNA, 22 bp, Artificial Sequence
  chemically synthesized
aaaggttaccttcaggtgcttt

SEQ ID NO: 998998 - DNA, 22 bp, Artificial Sequence
  chemically synthesized
aaggttaccttcaggtgctttt

SEQ ID NO: 998999 - DNA, 22 bp, Artificial Sequence
  chemically synthesized
ccttcaggtgcttttgaagttg

SEQ ID NO: 999000 - DNA, 22 bp, Artificial Sequence
  chemically synthesized
tacatgtggtcataacaacttc

SEQ ID NO: 999001 - DNA, 22 bp, Artificial Sequence
  chemically synthesized
caggtgcttttgaagttgttat

SEQ ID NO: 999002 - DNA, 22 bp, Artificial Sequence
  chemically synthesized
aggtgcttttgaagttgttatg

SEQ ID NO: 999003 - DNA, 22 bp, Artificial Sequence
  chemically synthesized
ttgaagttgttatgaccacatg

SEQ ID NO: 999004 - DNA, 22 bp, Artificial Sequence
  chemically synthesized
tgaagttgttatgaccacatgt

SEQ ID NO: 999005 - DNA, 22 bp, Artificial Sequence
  chemically synthesized
gaagttgttatgaccacatgta

SEQ ID NO: 999006 - DNA, 22 bp, Artificial Sequence
  chemically synthesized
aagttgttatgaccacatgtac

SEQ ID NO: 999007 - DNA, 22 bp, Artificial Sequence
  chemically synthesized
ttatgaccacatgtacagtcct

SEQ ID NO: 999008 - DNA, 22 bp, Artificial Sequence
  chemically synthesized
atgtacaaaaggtaaggactgt

SEQ ID NO: 999009 - DNA, 22 bp, Artificial Sequence
  chemically synthesized
tgaccacatgtacagtccttac

SEQ ID NO: 999010 - DNA, 22 bp, Artificial Sequence
  chemically synthesized
catgtacaaaaggtaaggactg

SEQ ID NO: 999011 - DNA, 22 bp, Artificial Sequence
  chemically synthesized
agtttcatgtacaaaaggtaag

SEQ ID NO: 999012 - DNA, 22 bp, Artificial Sequence
  chemically synthesized
accttttgtacatgaaactcaa

SEQ ID NO: 999013 - DNA, 22 bp, Artificial Sequence
  chemically synthesized
ccttttgtacatgaaactcaac

SEQ ID NO: 999014 - DNA, 22 bp, Artificial Sequence
  chemically synthesized
ttgtacatgaaactcaactttt

SEQ ID NO: 999015 - DNA, 22 bp, Artificial Sequence
  chemically synthesized
tgtacatgaaactcaacttttg

SEQ ID NO: 999016 - DNA, 22 bp, Artificial Sequence
  chemically synthesized
gtacatgaaactcaacttttga

SEQ ID NO: 999017 - DNA, 22 bp, Artificial Sequence
  chemically synthesized
tacatgaaactcaacttttgat

SEQ ID NO: 999018 - DNA, 22 bp, Artificial Sequence
  chemically synthesized
atggaaacataaaataggaatc

SEQ ID NO: 999019 - DNA, 22 bp, Artificial Sequence
  chemically synthesized
aacttttgattcctattttatg

SEQ ID NO: 999020 - DNA, 22 bp, Artificial Sequence
  chemically synthesized
ttgattcctattttatgtttcc

SEQ ID NO: 999021 - DNA, 22 bp, Artificial Sequence
  chemically synthesized
tgattcctattttatgtttcca

SEQ ID NO: 999022 - DNA, 22 bp, Artificial Sequence
  chemically synthesized
gattcctattttatgtttccat

SEQ ID NO: 999023 - DNA, 22 bp, Artificial Sequence
  chemically synthesized
attcctattttatgtttccatt

SEQ ID NO: 999024 - DNA, 22 bp, Artificial Sequence
  chemically synthesized
catacgtagccatctaatggaa

SEQ ID NO: 999025 - DNA, 22 bp, Artificial Sequence
  chemically synthesized
ctattttatgtttccattagat

SEQ ID NO: 999026 - DNA, 22 bp, Artificial Sequence
  chemically synthesized
acatacgtagccatctaatgga

SEQ ID NO: 999027 - DNA, 22 bp, Artificial Sequence
  chemically synthesized
ttttatgtttccattagatggc

SEQ ID NO: 999028 - DNA, 22 bp, Artificial Sequence
  chemically synthesized
tttacatacgtagccatctaat

SEQ ID NO: 999029 - DNA, 22 bp, Artificial Sequence
  chemically synthesized
gtttacatacgtagccatctaa

SEQ ID NO: 999030 - DNA, 22 bp, Artificial Sequence
  chemically synthesized
tgtttacatacgtagccatcta

SEQ ID NO: 999031 - DNA, 22 bp, Artificial Sequence
  chemically synthesized
tatgtttccattagatggctac

SEQ ID NO: 999032 - DNA, 22 bp, Artificial Sequence
  chemically synthesized
ttgtttacatacgtagccatct

SEQ ID NO: 999033 - DNA, 22 bp, Artificial Sequence
  chemically synthesized
atgtttccattagatggctacg

SEQ ID NO: 999034 - DNA, 22 bp, Artificial Sequence
  chemically synthesized
tttgtttacatacgtagccatc

SEQ ID NO: 999035 - DNA, 22 bp, Artificial Sequence
  chemically synthesized
tgtttccattagatggctacgt

SEQ ID NO: 999036 - DNA, 22 bp, Artificial Sequence
  chemically synthesized
ttttgtttacatacgtagccat

SEQ ID NO: 999037 - DNA, 22 bp, Artificial Sequence
  chemically synthesized
tttttgtttacatacgtagcca

SEQ ID NO: 999038 - DNA, 22 bp, Artificial Sequence
  chemically synthesized
ccattagatggctacgtatgta

SEQ ID NO: 999039 - DNA, 22 bp, Artificial Sequence
  chemically synthesized
cattagatggctacgtatgtaa

SEQ ID NO: 999040 - DNA, 22 bp, Artificial Sequence
  chemically synthesized
gatggctacgtatgtaaacaaa

SEQ ID NO: 999041 - DNA, 22 bp, Artificial Sequence
  chemically synthesized
agtgtcacaaaaactttttttg

SEQ ID NO: 999042 - DNA, 22 bp, Artificial Sequence
  chemically synthesized
cgtatgtaaacaaaaaaagttt

SEQ ID NO: 999043 - DNA, 22 bp, Artificial Sequence
  chemically synthesized
cgtagtaatgcctgagtgtcac

SEQ ID NO: 999044 - DNA, 22 bp, Artificial Sequence
  chemically synthesized
cctccgtagtaatgcctgagtg

SEQ ID NO: 999045 - DNA, 22 bp, Artificial Sequence
  chemically synthesized
acctccctccgtagtaatgcct

SEQ ID NO: 999046 - DNA, 22 bp, Artificial Sequence
  chemically synthesized
ttgtgacactcaggcattacta

SEQ ID NO: 999047 - DNA, 22 bp, Artificial Sequence
  chemically synthesized
tgtgacactcaggcattactac

SEQ ID NO: 999048 - DNA, 22 bp, Artificial Sequence
  chemically synthesized
gtgacactcaggcattactacg

SEQ ID NO: 999049 - DNA, 22 bp, Artificial Sequence
  chemically synthesized
tgacactcaggcattactacgg

SEQ ID NO: 999050 - DNA, 22 bp, Artificial Sequence
  chemically synthesized
atgaacgttcacctccctccgt

SEQ ID NO: 999051 - DNA, 22 bp, Artificial Sequence
  chemically synthesized
aatgaacgttcacctccctccg

SEQ ID NO: 999052 - DNA, 22 bp, Artificial Sequence
  chemically synthesized
aggcattactacggagggaggt

SEQ ID NO: 999053 - DNA, 22 bp, Artificial Sequence
  chemically synthesized
ctacggagggaggtgaacgttc

SEQ ID NO: 999054 - DNA, 22 bp, Artificial Sequence
  chemically synthesized
cggagggaggtgaacgttcatt

SEQ ID NO: 999055 - DNA, 22 bp, Artificial Sequence
  chemically synthesized
agataaatgtcttaatgaacgt

SEQ ID NO: 999056 - DNA, 22 bp, Artificial Sequence
  chemically synthesized
gagataaatgtcttaatgaacg

SEQ ID NO: 999057 - DNA, 22 bp, Artificial Sequence
  chemically synthesized
gatgcaatatttgagataaatg

SEQ ID NO: 999058 - DNA, 22 bp, Artificial Sequence
  chemically synthesized
tggatgcaatatttgagataaa

SEQ ID NO: 999059 - DNA, 22 bp, Artificial Sequence
  chemically synthesized
ctggatgcaatatttgagataa

SEQ ID NO: 999060 - DNA, 22 bp, Artificial Sequence
  chemically synthesized
attaagacatttatctcaaata

SEQ ID NO: 999061 - DNA, 22 bp, Artificial Sequence
  chemically synthesized
ttctggatgcaatatttgagat

SEQ ID NO: 999062 - DNA, 22 bp, Artificial Sequence
  chemically synthesized
agacatttatctcaaatattgc

SEQ ID NO: 999063 - DNA, 22 bp, Artificial Sequence
  chemically synthesized
gtgtcattcttctggatgcaat

SEQ ID NO: 999064 - DNA, 22 bp, Artificial Sequence
  chemically synthesized
agtgtcattcttctggatgcaa

SEQ ID NO: 999065 - DNA, 22 bp, Artificial Sequence
  chemically synthesized
atctcaaatattgcatccagaa

SEQ ID NO: 999066 - DNA, 22 bp, Artificial Sequence
  chemically synthesized
ttagtgtcattcttctggatgc

SEQ ID NO: 999067 - DNA, 22 bp, Artificial Sequence
  chemically synthesized
tctcaaatattgcatccagaag

SEQ ID NO: 999068 - DNA, 22 bp, Artificial Sequence
  chemically synthesized
ttcttagtgtcattcttctgga

SEQ ID NO: 999069 - DNA, 22 bp, Artificial Sequence
  chemically synthesized
attcttagtgtcattcttctgg

SEQ ID NO: 999070 - DNA, 22 bp, Artificial Sequence
  chemically synthesized
aaatattgcatccagaagaatg

SEQ ID NO: 999071 - DNA, 22 bp, Artificial Sequence
  chemically synthesized
agtttattcttagtgtcattct

SEQ ID NO: 999072 - DNA, 22 bp, Artificial Sequence
  chemically synthesized
catccagaagaatgacactaag

SEQ ID NO: 999073 - DNA, 22 bp, Artificial Sequence
  chemically synthesized
aattgagtttattcttagtgtc

SEQ ID NO: 999074 - DNA, 22 bp, Artificial Sequence
  chemically synthesized
caattgagtttattcttagtgt

SEQ ID NO: 999075 - DNA, 22 bp, Artificial Sequence
  chemically synthesized
atacttcaattgagtttattct

SEQ ID NO: 999076 - DNA, 22 bp, Artificial Sequence
  chemically synthesized
tctcatacttcaattgagttta

SEQ ID NO: 999077 - DNA, 22 bp, Artificial Sequence
  chemically synthesized
agaataaactcaattgaagtat

SEQ ID NO: 999078 - DNA, 22 bp, Artificial Sequence
  chemically synthesized
aagcacattatctcatacttca

SEQ ID NO: 999079 - DNA, 22 bp, Artificial Sequence
  chemically synthesized
gaagcacattatctcatacttc

SEQ ID NO: 999080 - DNA, 22 bp, Artificial Sequence
  chemically synthesized
tgaagcacattatctcatactt

SEQ ID NO: 999081 - DNA, 22 bp, Artificial Sequence
  chemically synthesized
gtctttgaagcacattatctca

SEQ ID NO: 999082 - DNA, 22 bp, Artificial Sequence
  chemically synthesized
agtctttgaagcacattatctc

SEQ ID NO: 999083 - DNA, 22 bp, Artificial Sequence
  chemically synthesized
aattgaagtatgagataatgtg

SEQ ID NO: 999084 - DNA, 22 bp, Artificial Sequence
  chemically synthesized
aagtatgagataatgtgcttca

SEQ ID NO: 999085 - DNA, 22 bp, Artificial Sequence
  chemically synthesized
gtcccttagtctttgaagcaca

SEQ ID NO: 999086 - DNA, 22 bp, Artificial Sequence
  chemically synthesized
agtcccttagtctttgaagcac

SEQ ID NO: 999087 - DNA, 22 bp, Artificial Sequence
  chemically synthesized
tttagtcccttagtctttgaag

SEQ ID NO: 999088 - DNA, 22 bp, Artificial Sequence
  chemically synthesized
caaagactaagggactaaataa

SEQ ID NO: 999089 - DNA, 22 bp, Artificial Sequence
  chemically synthesized
aaagactaagggactaaataac

SEQ ID NO: 999090 - DNA, 22 bp, Artificial Sequence
  chemically synthesized
ggaagaggatgagttatttagt

SEQ ID NO: 999091 - DNA, 22 bp, Artificial Sequence
  chemically synthesized
agggactaaataactcatcctc

SEQ ID NO: 999092 - DNA, 22 bp, Artificial Sequence
  chemically synthesized
taaggtaattaggaagaggatg

SEQ ID NO: 999093 - DNA, 22 bp, Artificial Sequence
  chemically synthesized
aataactcatcctcttcctaat

SEQ ID NO: 999094 - DNA, 22 bp, Artificial Sequence
  chemically synthesized
aggtatctataaggtaattagg

SEQ ID NO: 999095 - DNA, 22 bp, Artificial Sequence
  chemically synthesized
atcctcttcctaattaccttat

SEQ ID NO: 999096 - DNA, 22 bp, Artificial Sequence
  chemically synthesized
ttcctaattaccttatagatac

SEQ ID NO: 999097 - DNA, 22 bp, Artificial Sequence
  chemically synthesized
cctaattaccttatagatacct

SEQ ID NO: 999098 - DNA, 22 bp, Artificial Sequence
  chemically synthesized
ctaattaccttatagatacctt

SEQ ID NO: 999099 - DNA, 22 bp, Artificial Sequence
  chemically synthesized
attaccttatagataccttagt

SEQ ID NO: 999100 - DNA, 22 bp, Artificial Sequence
  chemically synthesized
ccttatagataccttagttctc

SEQ ID NO: 999101 - DNA, 22 bp, Artificial Sequence
  chemically synthesized
gagaaggataaagagaactaag

SEQ ID NO: 999102 - DNA, 22 bp, Artificial Sequence
  chemically synthesized
atagataccttagttctcttta

SEQ ID NO: 999103 - DNA, 22 bp, Artificial Sequence
  chemically synthesized
tagataccttagttctctttat

SEQ ID NO: 999104 - DNA, 22 bp, Artificial Sequence
  chemically synthesized
tatgttggagaaggataaagag

SEQ ID NO: 999105 - DNA, 22 bp, Artificial Sequence
  chemically synthesized
gtatgttggagaaggataaaga

SEQ ID NO: 999106 - DNA, 22 bp, Artificial Sequence
  chemically synthesized
tgtatgttggagaaggataaag

SEQ ID NO: 999107 - DNA, 22 bp, Artificial Sequence
  chemically synthesized
gctttgtatgttggagaaggat

SEQ ID NO: 999108 - DNA, 22 bp, Artificial Sequence
  chemically synthesized
agttctctttatccttctccaa

SEQ ID NO: 999109 - DNA, 22 bp, Artificial Sequence
  chemically synthesized
gttctctttatccttctccaac

SEQ ID NO: 999110 - DNA, 22 bp, Artificial Sequence
  chemically synthesized
tctttatccttctccaacatac

SEQ ID NO: 999111 - DNA, 22 bp, Artificial Sequence
  chemically synthesized
tttatccttctccaacatacaa

SEQ ID NO: 999112 - DNA, 22 bp, Artificial Sequence
  chemically synthesized
tatccttctccaacatacaaag

SEQ ID NO: 999113 - DNA, 22 bp, Artificial Sequence
  chemically synthesized
aaaatgaactagctttgtatgt

SEQ ID NO: 999114 - DNA, 22 bp, Artificial Sequence
  chemically synthesized
atccttctccaacatacaaagc

SEQ ID NO: 999115 - DNA, 22 bp, Artificial Sequence
  chemically synthesized
aaaaatgaactagctttgtatg

SEQ ID NO: 999116 - DNA, 22 bp, Artificial Sequence
  chemically synthesized
tccttctccaacatacaaagct

SEQ ID NO: 999117 - DNA, 22 bp, Artificial Sequence
  chemically synthesized
ctccaacatacaaagctagttc

SEQ ID NO: 999118 - DNA, 22 bp, Artificial Sequence
  chemically synthesized
tccaacatacaaagctagttca

SEQ ID NO: 999119 - DNA, 22 bp, Artificial Sequence
  chemically synthesized
caacatacaaagctagttcatt

SEQ ID NO: 999120 - DNA, 22 bp, Artificial Sequence
  chemically synthesized
tgcaaagaccttaaaaatgaac

SEQ ID NO: 999121 - DNA, 22 bp, Artificial Sequence
  chemically synthesized
atgcaaagaccttaaaaatgaa

SEQ ID NO: 999122 - DNA, 22 bp, Artificial Sequence
  chemically synthesized
gttcatttttaaggtctttgca

SEQ ID NO: 999123 - DNA, 22 bp, Artificial Sequence
  chemically synthesized
atttttaaggtctttgcataag

SEQ ID NO: 999124 - DNA, 22 bp, Artificial Sequence
  chemically synthesized
ttaaggtctttgcataagctgt

SEQ ID NO: 999125 - DNA, 22 bp, Artificial Sequence
  chemically synthesized
cgggcacaagggacagcttatg

SEQ ID NO: 999126 - DNA, 22 bp, Artificial Sequence
  chemically synthesized
taaggtctttgcataagctgtc

SEQ ID NO: 999127 - DNA, 22 bp, Artificial Sequence
  chemically synthesized
aaggtctttgcataagctgtcc

SEQ ID NO: 999128 - DNA, 22 bp, Artificial Sequence
  chemically synthesized
aggtctttgcataagctgtccc

SEQ ID NO: 999129 - DNA, 22 bp, Artificial Sequence
  chemically synthesized
tgcataagctgtcccttgtgcc

SEQ ID NO: 999130 - DNA, 22 bp, Artificial Sequence
  chemically synthesized
gcataagctgtcccttgtgccc

SEQ ID NO: 999131 - DNA, 22 bp, Artificial Sequence
  chemically synthesized
cataagctgtcccttgtgcccg

SEQ ID NO: 999132 - DNA, 22 bp, Artificial Sequence
  chemically synthesized
tcccttgtgcccggaatgcttt

SEQ ID NO: 999133 - DNA, 22 bp, Artificial Sequence
  chemically synthesized
gtgcccggaatgctttgcccct

SEQ ID NO: 999134 - DNA, 22 bp, Artificial Sequence
  chemically synthesized
tgcccggaatgctttgccccta

SEQ ID NO: 999135 - DNA, 22 bp, Artificial Sequence
  chemically synthesized
gagtcagccatgtaatgatgta

SEQ ID NO: 999136 - DNA, 22 bp, Artificial Sequence
  chemically synthesized
tgcccctacatcattacatggc

SEQ ID NO: 999137 - DNA, 22 bp, Artificial Sequence
  chemically synthesized
gcccctacatcattacatggct

SEQ ID NO: 999138 - DNA, 22 bp, Artificial Sequence
  chemically synthesized
cccctacatcattacatggctg

SEQ ID NO: 999139 - DNA, 22 bp, Artificial Sequence
  chemically synthesized
atggacaaactagagtcagcca

SEQ ID NO: 999140 - DNA, 22 bp, Artificial Sequence
  chemically synthesized
catcattacatggctgactcta

SEQ ID NO: 999141 - DNA, 22 bp, Artificial Sequence
  chemically synthesized
catggctgactctagtttgtcc

SEQ ID NO: 999142 - DNA, 22 bp, Artificial Sequence
  chemically synthesized
aagaagaactgatggacaaact

SEQ ID NO: 999143 - DNA, 22 bp, Artificial Sequence
  chemically synthesized
gaagaagaactgatggacaaac

SEQ ID NO: 999144 - DNA, 22 bp, Artificial Sequence
  chemically synthesized
tgaagaagaactgatggacaaa

SEQ ID NO: 999145 - DNA, 22 bp, Artificial Sequence
  chemically synthesized
actctagtttgtccatcagttc

SEQ ID NO: 999146 - DNA, 22 bp, Artificial Sequence
  chemically synthesized
tagtttgtccatcagttcttct

SEQ ID NO: 999147 - DNA, 22 bp, Artificial Sequence
  chemically synthesized
gtttgtccatcagttcttcttc

SEQ ID NO: 999148 - DNA, 22 bp, Artificial Sequence
  chemically synthesized
gaaggtgattttgaagaagaac

SEQ ID NO: 999149 - DNA, 22 bp, Artificial Sequence
  chemically synthesized
ggaaggtgattttgaagaagaa

SEQ ID NO: 999150 - DNA, 22 bp, Artificial Sequence
  chemically synthesized
gtccatcagttcttcttcaaaa

SEQ ID NO: 999151 - DNA, 22 bp, Artificial Sequence
  chemically synthesized
tccatcagttcttcttcaaaat

SEQ ID NO: 999152 - DNA, 22 bp, Artificial Sequence
  chemically synthesized
acttggaaggtgattttgaaga

SEQ ID NO: 999153 - DNA, 22 bp, Artificial Sequence
  chemically synthesized
aatacctcacttggaaggtgat

SEQ ID NO: 999154 - DNA, 22 bp, Artificial Sequence
  chemically synthesized
caatacctcacttggaaggtga

SEQ ID NO: 999155 - DNA, 22 bp, Artificial Sequence
  chemically synthesized
ttcttcaaaatcaccttccaag

SEQ ID NO: 999156 - DNA, 22 bp, Artificial Sequence
  chemically synthesized
cttcaaaatcaccttccaagtg

SEQ ID NO: 999157 - DNA, 22 bp, Artificial Sequence
  chemically synthesized
ttcaaaatcaccttccaagtga

SEQ ID NO: 999158 - DNA, 22 bp, Artificial Sequence
  chemically synthesized
caaaatcaccttccaagtgagg

SEQ ID NO: 999159 - DNA, 22 bp, Artificial Sequence
  chemically synthesized
aaaatcaccttccaagtgaggt

SEQ ID NO: 999160 - DNA, 22 bp, Artificial Sequence
  chemically synthesized
aaaaagtcttcaatacctcact

SEQ ID NO: 999161 - DNA, 22 bp, Artificial Sequence
  chemically synthesized
gaaaaagtcttcaatacctcac

SEQ ID NO: 999162 - DNA, 22 bp, Artificial Sequence
  chemically synthesized
ccaagtgaggtattgaagactt

SEQ ID NO: 999163 - DNA, 22 bp, Artificial Sequence
  chemically synthesized
caagtgaggtattgaagacttt

SEQ ID NO: 999164 - DNA, 22 bp, Artificial Sequence
  chemically synthesized
ataaaaaagagaaaaatcttga

SEQ ID NO: 999165 - DNA, 22 bp, Artificial Sequence
  chemically synthesized
aagactttttcaagatttttct

SEQ ID NO: 999166 - DNA, 22 bp, Artificial Sequence
  chemically synthesized
tttcaagatttttctctttttt

SEQ ID NO: 999167 - DNA, 22 bp, Artificial Sequence
  chemically synthesized
ttcaagatttttctctttttta

SEQ ID NO: 999168 - DNA, 22 bp, Artificial Sequence
  chemically synthesized
tcaagatttttctcttttttat

SEQ ID NO: 999169 - DNA, 22 bp, Artificial Sequence
  chemically synthesized
tgcacagaattaataaaaaaga

SEQ ID NO: 999170 - DNA, 22 bp, Artificial Sequence
  chemically synthesized
caagatttttctcttttttatt

SEQ ID NO: 999171 - DNA, 22 bp, Artificial Sequence
  chemically synthesized
aagatttttctcttttttatta

SEQ ID NO: 999172 - DNA, 22 bp, Artificial Sequence
  chemically synthesized
ttctcttttttattaattctgt

SEQ ID NO: 999173 - DNA, 22 bp, Artificial Sequence
  chemically synthesized
tctcttttttattaattctgtg

SEQ ID NO: 999174 - DNA, 22 bp, Artificial Sequence
  chemically synthesized
ctcttttttattaattctgtgc

SEQ ID NO: 999175 - DNA, 22 bp, Artificial Sequence
  chemically synthesized
tcttttttattaattctgtgca

SEQ ID NO: 999176 - DNA, 22 bp, Artificial Sequence
  chemically synthesized
ttttttattaattctgtgcata

SEQ ID NO: 999177 - DNA, 22 bp, Artificial Sequence
  chemically synthesized
ttttattaattctgtgcataat

SEQ ID NO: 999178 - DNA, 22 bp, Artificial Sequence
  chemically synthesized
tttattaattctgtgcataata

SEQ ID NO: 999179 - DNA, 22 bp, Artificial Sequence
  chemically synthesized
gaaagtgggaaatattatgcac

SEQ ID NO: 999180 - DNA, 22 bp, Artificial Sequence
  chemically synthesized
ttattaattctgtgcataatat

SEQ ID NO: 999181 - DNA, 22 bp, Artificial Sequence
  chemically synthesized
agaaagtgggaaatattatgca

SEQ ID NO: 999182 - DNA, 22 bp, Artificial Sequence
  chemically synthesized
tattaattctgtgcataatatt

SEQ ID NO: 999183 - DNA, 22 bp, Artificial Sequence
  chemically synthesized
attaattctgtgcataatattt

SEQ ID NO: 999184 - DNA, 22 bp, Artificial Sequence
  chemically synthesized
ttaattctgtgcataatatttc

SEQ ID NO: 999185 - DNA, 22 bp, Artificial Sequence
  chemically synthesized
attctgtgcataatatttccca

SEQ ID NO: 999186 - DNA, 22 bp, Artificial Sequence
  chemically synthesized
tgtgcataatatttcccacttt

SEQ ID NO: 999187 - DNA, 22 bp, Artificial Sequence
  chemically synthesized
tgcataatatttcccactttct

SEQ ID NO: 999188 - DNA, 22 bp, Artificial Sequence
  chemically synthesized
agaaaggaaaacaatttagaaa

SEQ ID NO: 999189 - DNA, 22 bp, Artificial Sequence
  chemically synthesized
cccactttctaaattgttttcc

SEQ ID NO: 999190 - DNA, 22 bp, Artificial Sequence
  chemically synthesized
ccactttctaaattgttttcct

SEQ ID NO: 999191 - DNA, 22 bp, Artificial Sequence
  chemically synthesized
tctaaattgttttcctttctca

SEQ ID NO: 999192 - DNA, 22 bp, Artificial Sequence
  chemically synthesized
ctaaattgttttcctttctcag

SEQ ID NO: 999193 - DNA, 22 bp, Artificial Sequence
  chemically synthesized
taaattgttttcctttctcagt

SEQ ID NO: 999194 - DNA, 22 bp, Artificial Sequence
  chemically synthesized
aattgttttcctttctcagttt

SEQ ID NO: 999195 - DNA, 22 bp, Artificial Sequence
  chemically synthesized
ttttcctttctcagtttgtatc

SEQ ID NO: 999196 - DNA, 22 bp, Artificial Sequence
  chemically synthesized
gtaagcagggataggatacaaa

SEQ ID NO: 999197 - DNA, 22 bp, Artificial Sequence
  chemically synthesized
tcctttctcagtttgtatccta

SEQ ID NO: 999198 - DNA, 22 bp, Artificial Sequence
  chemically synthesized
agtaagcagggataggatacaa

SEQ ID NO: 999199 - DNA, 22 bp, Artificial Sequence
  chemically synthesized
cctttctcagtttgtatcctat

SEQ ID NO: 999200 - DNA, 22 bp, Artificial Sequence
  chemically synthesized
tagtaagcagggataggataca

SEQ ID NO: 999201 - DNA, 22 bp, Artificial Sequence
  chemically synthesized
ctttctcagtttgtatcctatc

SEQ ID NO: 999202 - DNA, 22 bp, Artificial Sequence
  chemically synthesized
tctcagtttgtatcctatccct

SEQ ID NO: 999203 - DNA, 22 bp, Artificial Sequence
  chemically synthesized
ctcagtttgtatcctatccctg

SEQ ID NO: 999204 - DNA, 22 bp, Artificial Sequence
  chemically synthesized
tcagtttgtatcctatccctgc

SEQ ID NO: 999205 - DNA, 22 bp, Artificial Sequence
  chemically synthesized
taattttagtaagcagggatag

SEQ ID NO: 999206 - DNA, 22 bp, Artificial Sequence
  chemically synthesized
agtttgtatcctatccctgctt

SEQ ID NO: 999207 - DNA, 22 bp, Artificial Sequence
  chemically synthesized
gtatcctatccctgcttactaa

SEQ ID NO: 999208 - DNA, 22 bp, Artificial Sequence
  chemically synthesized
tatcctatccctgcttactaaa

SEQ ID NO: 999209 - DNA, 22 bp, Artificial Sequence
  chemically synthesized
atgaaactgtaattttagtaag

SEQ ID NO: 999210 - DNA, 22 bp, Artificial Sequence
  chemically synthesized
tccctgcttactaaaattacag

SEQ ID NO: 999211 - DNA, 22 bp, Artificial Sequence
  chemically synthesized
cttactaaaattacagtttcat

SEQ ID NO: 999212 - DNA, 22 bp, Artificial Sequence
  chemically synthesized
actaaaattacagtttcatgag

SEQ ID NO: 999213 - DNA, 22 bp, Artificial Sequence
  chemically synthesized
ctaaaattacagtttcatgagc

SEQ ID NO: 999214 - DNA, 22 bp, Artificial Sequence
  chemically synthesized
aaattacagtttcatgagcaca

SEQ ID NO: 999215 - DNA, 22 bp, Artificial Sequence
  chemically synthesized
cagtttcatgagcacacgggac

SEQ ID NO: 999216 - DNA, 22 bp, Artificial Sequence
  chemically synthesized
cgtacaaggaagcataggtccc

SEQ ID NO: 999217 - DNA, 22 bp, Artificial Sequence
  chemically synthesized
catgagcacacgggacctatgc

SEQ ID NO: 999218 - DNA, 22 bp, Artificial Sequence
  chemically synthesized
atgagcacacgggacctatgct

SEQ ID NO: 999219 - DNA, 22 bp, Artificial Sequence
  chemically synthesized
cacactacgtacaaggaagcat

SEQ ID NO: 999220 - DNA, 22 bp, Artificial Sequence
  chemically synthesized
tgcttccttgtacgtagtgtgc

SEQ ID NO: 999221 - DNA, 22 bp, Artificial Sequence
  chemically synthesized
caagtaatatcctgcacactac

SEQ ID NO: 999222 - DNA, 22 bp, Artificial Sequence
  chemically synthesized
ccttgtacgtagtgtgcaggat

SEQ ID NO: 999223 - DNA, 22 bp, Artificial Sequence
  chemically synthesized
cttgtacgtagtgtgcaggata

SEQ ID NO: 999224 - DNA, 22 bp, Artificial Sequence
  chemically synthesized
tattccaagtaatatcctgcac

SEQ ID NO: 999225 - DNA, 22 bp, Artificial Sequence
  chemically synthesized
gtacgtagtgtgcaggatatta

SEQ ID NO: 999226 - DNA, 22 bp, Artificial Sequence
  chemically synthesized
tacgtagtgtgcaggatattac

SEQ ID NO: 999227 - DNA, 22 bp, Artificial Sequence
  chemically synthesized
ggtgcccactatattccaagta

SEQ ID NO: 999228 - DNA, 22 bp, Artificial Sequence
  chemically synthesized
atatattgggtgcccactatat

SEQ ID NO: 999229 - DNA, 22 bp, Artificial Sequence
  chemically synthesized
attaatatattgggtgcccact

SEQ ID NO: 999230 - DNA, 22 bp, Artificial Sequence
  chemically synthesized
cttggaatatagtgggcaccca

SEQ ID NO: 999231 - DNA, 22 bp, Artificial Sequence
  chemically synthesized
ggaatatagtgggcacccaata

SEQ ID NO: 999232 - DNA, 22 bp, Artificial Sequence
  chemically synthesized
tattcattaatatattgggtgc

SEQ ID NO: 999233 - DNA, 22 bp, Artificial Sequence
  chemically synthesized
gaatatagtgggcacccaatat

SEQ ID NO: 999234 - DNA, 22 bp, Artificial Sequence
  chemically synthesized
caatgattgtattcattaatat

SEQ ID NO: 999235 - DNA, 22 bp, Artificial Sequence
  chemically synthesized
tacaatgattgtattcattaat

SEQ ID NO: 999236 - DNA, 22 bp, Artificial Sequence
  chemically synthesized
ctacaatgattgtattcattaa

SEQ ID NO: 999237 - DNA, 22 bp, Artificial Sequence
  chemically synthesized
tctacaatgattgtattcatta

SEQ ID NO: 999238 - DNA, 22 bp, Artificial Sequence
  chemically synthesized
actttctacaatgattgtattc

SEQ ID NO: 999239 - DNA, 22 bp, Artificial Sequence
  chemically synthesized
aactttctacaatgattgtatt

SEQ ID NO: 999240 - DNA, 22 bp, Artificial Sequence
  chemically synthesized
tggatttaactttctacaatga

SEQ ID NO: 999241 - DNA, 22 bp, Artificial Sequence
  chemically synthesized
atgaatacaatcattgtagaaa

SEQ ID NO: 999242 - DNA, 22 bp, Artificial Sequence
  chemically synthesized
gaccactgtggatttaactttc

SEQ ID NO: 999243 - DNA, 22 bp, Artificial Sequence
  chemically synthesized
tagaaagttaaatccacagtgg

SEQ ID NO: 999244 - DNA, 22 bp, Artificial Sequence
  chemically synthesized
acaccacatctggaccactgtg

SEQ ID NO: 999245 - DNA, 22 bp, Artificial Sequence
  chemically synthesized
aacaccacatctggaccactgt

SEQ ID NO: 999246 - DNA, 22 bp, Artificial Sequence
  chemically synthesized
atgcttaacaccacatctggac

SEQ ID NO: 999247 - DNA, 22 bp, Artificial Sequence
  chemically synthesized
aatccacagtggtccagatgtg

SEQ ID NO: 999248 - DNA, 22 bp, Artificial Sequence
  chemically synthesized
ggttcatgcttaacaccacatc

SEQ ID NO: 999249 - DNA, 22 bp, Artificial Sequence
  chemically synthesized
aggttcatgcttaacaccacat

SEQ ID NO: 999250 - DNA, 22 bp, Artificial Sequence
  chemically synthesized
aaggtagaagatttaggttcat

SEQ ID NO: 999251 - DNA, 22 bp, Artificial Sequence
  chemically synthesized
gaaggtagaagatttaggttca

SEQ ID NO: 999252 - DNA, 22 bp, Artificial Sequence
  chemically synthesized
agcatgaacctaaatcttctac

SEQ ID NO: 999253 - DNA, 22 bp, Artificial Sequence
  chemically synthesized
ggagcaccttgaaggtagaaga

SEQ ID NO: 999254 - DNA, 22 bp, Artificial Sequence
  chemically synthesized
aatcttctaccttcaaggtgct

SEQ ID NO: 999255 - DNA, 22 bp, Artificial Sequence
  chemically synthesized
ctaccttcaaggtgctcctaat

SEQ ID NO: 999256 - DNA, 22 bp, Artificial Sequence
  chemically synthesized
taccttcaaggtgctcctaata

SEQ ID NO: 999257 - DNA, 22 bp, Artificial Sequence
  chemically synthesized
ccttcaaggtgctcctaatatg

SEQ ID NO: 999258 - DNA, 22 bp, Artificial Sequence
  chemically synthesized
caaggtgctcctaatatggttg

SEQ ID NO: 999259 - DNA, 22 bp, Artificial Sequence
  chemically synthesized
aaggtgctcctaatatggttgg

SEQ ID NO: 999260 - DNA, 22 bp, Artificial Sequence
  chemically synthesized
tatgtgatcatcaacccaacca

SEQ ID NO: 999261 - DNA, 22 bp, Artificial Sequence
  chemically synthesized
gtatgtgatcatcaacccaacc

SEQ ID NO: 999262 - DNA, 22 bp, Artificial Sequence
  chemically synthesized
atttgtatgtgatcatcaaccc

SEQ ID NO: 999263 - DNA, 22 bp, Artificial Sequence
  chemically synthesized
ctaatatggttgggttgatgat

SEQ ID NO: 999264 - DNA, 22 bp, Artificial Sequence
  chemically synthesized
atatggttgggttgatgatcac

SEQ ID NO: 999265 - DNA, 22 bp, Artificial Sequence
  chemically synthesized
tctgatttgtatgtgatcatca

SEQ ID NO: 999266 - DNA, 22 bp, Artificial Sequence
  chemically synthesized
ggttgatgatcacatacaaatc

SEQ ID NO: 999267 - DNA, 22 bp, Artificial Sequence
  chemically synthesized
atgatcacatacaaatcagata

SEQ ID NO: 999268 - DNA, 22 bp, Artificial Sequence
  chemically synthesized
aagtggtataattatctgattt

SEQ ID NO: 999269 - DNA, 22 bp, Artificial Sequence
  chemically synthesized
ctcaagtggtataattatctga

SEQ ID NO: 999270 - DNA, 22 bp, Artificial Sequence
  chemically synthesized
atgttcctcaagtggtataatt

SEQ ID NO: 999271 - DNA, 22 bp, Artificial Sequence
  chemically synthesized
taaacctaatgttcctcaagtg

SEQ ID NO: 999272 - DNA, 22 bp, Artificial Sequence
  chemically synthesized
gtaaacctaatgttcctcaagt

SEQ ID NO: 999273 - DNA, 22 bp, Artificial Sequence
  chemically synthesized
gtttgtaaacctaatgttcctc

SEQ ID NO: 999274 - DNA, 22 bp, Artificial Sequence
  chemically synthesized
agtttgtaaacctaatgttcct

SEQ ID NO: 999275 - DNA, 22 bp, Artificial Sequence
  chemically synthesized
taccacttgaggaacattaggt

SEQ ID NO: 999276 - DNA, 22 bp, Artificial Sequence
  chemically synthesized
gaggaacattaggtttacaaac

SEQ ID NO: 999277 - DNA, 22 bp, Artificial Sequence
  chemically synthesized
aggaacattaggtttacaaact

SEQ ID NO: 999278 - DNA, 22 bp, Artificial Sequence
  chemically synthesized
ggtttacaaactaagcattatt

SEQ ID NO: 999279 - DNA, 22 bp, Artificial Sequence
  chemically synthesized
ataaaatgatataataatgctt

SEQ ID NO: 999280 - DNA, 22 bp, Artificial Sequence
  chemically synthesized
aataaaatgatataataatgct

SEQ ID NO: 999281 - DNA, 22 bp, Artificial Sequence
  chemically synthesized
taataaaatgatataataatgc

SEQ ID NO: 999282 - DNA, 22 bp, Artificial Sequence
  chemically synthesized
acaaactaagcattattatatc

SEQ ID NO: 999283 - DNA, 22 bp, Artificial Sequence
  chemically synthesized
caaactaagcattattatatca

SEQ ID NO: 999284 - DNA, 22 bp, Artificial Sequence
  chemically synthesized
agcattattatatcattttatt

SEQ ID NO: 999285 - DNA, 22 bp, Artificial Sequence
  chemically synthesized
atatgaatacattttaataaaa

SEQ ID NO: 999286 - DNA, 22 bp, Artificial Sequence
  chemically synthesized
ctgatatgaatacattttaata

SEQ ID NO: 999287 - DNA, 22 bp, Artificial Sequence
  chemically synthesized
ttatatcattttattaaaatgt

SEQ ID NO: 999288 - DNA, 22 bp, Artificial Sequence
  chemically synthesized
actgatatgaatacattttaat

SEQ ID NO: 999289 - DNA, 22 bp, Artificial Sequence
  chemically synthesized
tactgatatgaatacattttaa

SEQ ID NO: 999290 - DNA, 22 bp, Artificial Sequence
  chemically synthesized
tatcattttattaaaatgtatt

SEQ ID NO: 999291 - DNA, 22 bp, Artificial Sequence
  chemically synthesized
tattaaaatgtattcatatcag

SEQ ID NO: 999292 - DNA, 22 bp, Artificial Sequence
  chemically synthesized
attaaaatgtattcatatcagt

SEQ ID NO: 999293 - DNA, 22 bp, Artificial Sequence
  chemically synthesized
ttaaaatgtattcatatcagta

SEQ ID NO: 999294 - DNA, 22 bp, Artificial Sequence
  chemically synthesized
caccgtccccactttactgata

SEQ ID NO: 999295 - DNA, 22 bp, Artificial Sequence
  chemically synthesized
aaatgtattcatatcagtaaag

SEQ ID NO: 999296 - DNA, 22 bp, Artificial Sequence
  chemically synthesized
actccaccgtccccactttact

SEQ ID NO: 999297 - DNA, 22 bp, Artificial Sequence
  chemically synthesized
gactccaccgtccccactttac

SEQ ID NO: 999298 - DNA, 22 bp, Artificial Sequence
  chemically synthesized
cttgactccaccgtccccactt

SEQ ID NO: 999299 - DNA, 22 bp, Artificial Sequence
  chemically synthesized
ccttgactccaccgtccccact

SEQ ID NO: 999300 - DNA, 22 bp, Artificial Sequence
  chemically synthesized
atatcagtaaagtggggacggt

SEQ ID NO: 999301 - DNA, 22 bp, Artificial Sequence
  chemically synthesized
ttccttgactccaccgtcccca

SEQ ID NO: 999302 - DNA, 22 bp, Artificial Sequence
  chemically synthesized
cttccttgactccaccgtcccc

SEQ ID NO: 999303 - DNA, 22 bp, Artificial Sequence
  chemically synthesized
caatacttcttccttgactcca

SEQ ID NO: 999304 - DNA, 22 bp, Artificial Sequence
  chemically synthesized
aaatgtcacctacaatacttct

SEQ ID NO: 999305 - DNA, 22 bp, Artificial Sequence
  chemically synthesized
agctaaaatgtcacctacaata

SEQ ID NO: 999306 - DNA, 22 bp, Artificial Sequence
  chemically synthesized
tactcagctaaaatgtcaccta

SEQ ID NO: 999307 - DNA, 22 bp, Artificial Sequence
  chemically synthesized
tatactcagctaaaatgtcacc

SEQ ID NO: 999308 - DNA, 22 bp, Artificial Sequence
  chemically synthesized
ctatactcagctaaaatgtcac

SEQ ID NO: 999309 - DNA, 22 bp, Artificial Sequence
  chemically synthesized
tctatactcagctaaaatgtca

SEQ ID NO: 999310 - DNA, 22 bp, Artificial Sequence
  chemically synthesized
cctttctatactcagctaaaat

SEQ ID NO: 999311 - DNA, 22 bp, Artificial Sequence
  chemically synthesized
taggtgacattttagctgagta

SEQ ID NO: 999312 - DNA, 22 bp, Artificial Sequence
  chemically synthesized
acctccctttctatactcagct

SEQ ID NO: 999313 - DNA, 22 bp, Artificial Sequence
  chemically synthesized
atccctaacctccctttctata

SEQ ID NO: 999314 - DNA, 22 bp, Artificial Sequence
  chemically synthesized
catccctaacctccctttctat

SEQ ID NO: 999315 - DNA, 22 bp, Artificial Sequence
  chemically synthesized
tagctgagtatagaaagggagg

SEQ ID NO: 999316 - DNA, 22 bp, Artificial Sequence
  chemically synthesized
agctgagtatagaaagggaggt

SEQ ID NO: 999317 - DNA, 22 bp, Artificial Sequence
  chemically synthesized
gctgagtatagaaagggaggtt

SEQ ID NO: 999318 - DNA, 22 bp, Artificial Sequence
  chemically synthesized
gtgcttcatccctaacctccct

SEQ ID NO: 999319 - DNA, 22 bp, Artificial Sequence
  chemically synthesized
agtatagaaagggaggttaggg

SEQ ID NO: 999320 - DNA, 22 bp, Artificial Sequence
  chemically synthesized
cctggtgcttcatccctaacct

SEQ ID NO: 999321 - DNA, 22 bp, Artificial Sequence
  chemically synthesized
gcctggtgcttcatccctaacc

SEQ ID NO: 999322 - DNA, 22 bp, Artificial Sequence
  chemically synthesized
tgacaagcatttgcctggtgct

SEQ ID NO: 999323 - DNA, 22 bp, Artificial Sequence
  chemically synthesized
gtgacaagcatttgcctggtgc

SEQ ID NO: 999324 - DNA, 22 bp, Artificial Sequence
  chemically synthesized
gggatgaagcaccaggcaaatg

SEQ ID NO: 999325 - DNA, 22 bp, Artificial Sequence
  chemically synthesized
acaaggtcacttgtgacaagca

SEQ ID NO: 999326 - DNA, 22 bp, Artificial Sequence
  chemically synthesized
atgtcacaagtgactcacaagg

SEQ ID NO: 999327 - DNA, 22 bp, Artificial Sequence
  chemically synthesized
gtcacaagtgaccttgtgagtc

SEQ ID NO: 999328 - DNA, 22 bp, Artificial Sequence
  chemically synthesized
catgtcacaagtgactcacaag

SEQ ID NO: 999329 - DNA, 22 bp, Artificial Sequence
  chemically synthesized
tcacaagtgaccttgtgagtca

SEQ ID NO: 999330 - DNA, 22 bp, Artificial Sequence
  chemically synthesized
acttcatgtcacaagtgactca

SEQ ID NO: 999331 - DNA, 22 bp, Artificial Sequence
  chemically synthesized
gtgagtcacttgtgacatgaag

SEQ ID NO: 999332 - DNA, 22 bp, Artificial Sequence
  chemically synthesized
tgagtcacttgtgacatgaagt

SEQ ID NO: 999333 - DNA, 22 bp, Artificial Sequence
  chemically synthesized
atgtcacaagtgactcacttca

SEQ ID NO: 999334 - DNA, 22 bp, Artificial Sequence
  chemically synthesized
catgtcacaagtgactcacttc

SEQ ID NO: 999335 - DNA, 22 bp, Artificial Sequence
  chemically synthesized
gtgacatgaagtgagtcacttg

SEQ ID NO: 999336 - DNA, 22 bp, Artificial Sequence
  chemically synthesized
tgacatgaagtgagtcacttgt

SEQ ID NO: 999337 - DNA, 22 bp, Artificial Sequence
  chemically synthesized
tacagcttcatgtcacaagtga

SEQ ID NO: 999338 - DNA, 22 bp, Artificial Sequence
  chemically synthesized
agcacgttatacagcttcatgt

SEQ ID NO: 999339 - DNA, 22 bp, Artificial Sequence
  chemically synthesized
taagcacgttatacagcttcat

SEQ ID NO: 999340 - DNA, 22 bp, Artificial Sequence
  chemically synthesized
ctctaagcacgttatacagctt

SEQ ID NO: 999341 - DNA, 22 bp, Artificial Sequence
  chemically synthesized
cctctaagcacgttatacagct

SEQ ID NO: 999342 - DNA, 22 bp, Artificial Sequence
  chemically synthesized
gtgacatgaagctgtataacgt

SEQ ID NO: 999343 - DNA, 22 bp, Artificial Sequence
  chemically synthesized
tgacatgaagctgtataacgtg

SEQ ID NO: 999344 - DNA, 22 bp, Artificial Sequence
  chemically synthesized
tatgtcttcctctaagcacgtt

SEQ ID NO: 999345 - DNA, 22 bp, Artificial Sequence
  chemically synthesized
tataacgtgcttagaggaagac

SEQ ID NO: 999346 - DNA, 22 bp, Artificial Sequence
  chemically synthesized
agaggaagacatacagttcatc

SEQ ID NO: 999347 - DNA, 22 bp, Artificial Sequence
  chemically synthesized
gaggaagacatacagttcatca

SEQ ID NO: 999348 - DNA, 22 bp, Artificial Sequence
  chemically synthesized
atcacggtcacctttcgtcctg

SEQ ID NO: 999349 - DNA, 22 bp, Artificial Sequence
  chemically synthesized
tcgtcctgacatccacattcat

SEQ ID NO: 999350 - DNA, 22 bp, Artificial Sequence
  chemically synthesized
cgtcctgacatccacattcatt

SEQ ID NO: 999351 - DNA, 22 bp, Artificial Sequence
  chemically synthesized
ggtagtcagagaaatgaatgtg

SEQ ID NO: 999352 - DNA, 22 bp, Artificial Sequence
  chemically synthesized
gtcctgacatccacattcattt

SEQ ID NO: 999353 - DNA, 22 bp, Artificial Sequence
  chemically synthesized
acatccacattcatttctctga

SEQ ID NO: 999354 - DNA, 22 bp, Artificial Sequence
  chemically synthesized
atttctctgactacccaacccc

SEQ ID NO: 999355 - DNA, 22 bp, Artificial Sequence
  chemically synthesized
aaaaatccaagtgaggggttgg

SEQ ID NO: 999356 - DNA, 22 bp, Artificial Sequence
  chemically synthesized
gaaaaatccaagtgaggggttg

SEQ ID NO: 999357 - DNA, 22 bp, Artificial Sequence
  chemically synthesized
ctctgactacccaacccctcac

SEQ ID NO: 999358 - DNA, 22 bp, Artificial Sequence
  chemically synthesized
tgaaaaatccaagtgaggggtt

SEQ ID NO: 999359 - DNA, 22 bp, Artificial Sequence
  chemically synthesized
tctgactacccaacccctcact

SEQ ID NO: 999360 - DNA, 22 bp, Artificial Sequence
  chemically synthesized
tgactacccaacccctcacttg

SEQ ID NO: 999361 - DNA, 22 bp, Artificial Sequence
  chemically synthesized
actacccaacccctcacttgga

SEQ ID NO: 999362 - DNA, 22 bp, Artificial Sequence
  chemically synthesized
cccaacccctcacttggatttt

SEQ ID NO: 999363 - DNA, 22 bp, Artificial Sequence
  chemically synthesized
agatacctttgaaaaatccaag

SEQ ID NO: 999364 - DNA, 22 bp, Artificial Sequence
  chemically synthesized
gagatacctttgaaaaatccaa

SEQ ID NO: 999365 - DNA, 22 bp, Artificial Sequence
  chemically synthesized
tgagatacctttgaaaaatcca

SEQ ID NO: 999366 - DNA, 22 bp, Artificial Sequence
  chemically synthesized
attttgagatacctttgaaaaa

SEQ ID NO: 999367 - DNA, 22 bp, Artificial Sequence
  chemically synthesized
acttggatttttcaaaggtatc

SEQ ID NO: 999368 - DNA, 22 bp, Artificial Sequence
  chemically synthesized
ggatttttcaaaggtatctcaa

SEQ ID NO: 999369 - DNA, 22 bp, Artificial Sequence
  chemically synthesized
gatgtgttaattttgagatacc

SEQ ID NO: 999370 - DNA, 22 bp, Artificial Sequence
  chemically synthesized
gatttttcaaaggtatctcaaa

SEQ ID NO: 999371 - DNA, 22 bp, Artificial Sequence
  chemically synthesized
ggatgtgttaattttgagatac

SEQ ID NO: 999372 - DNA, 22 bp, Artificial Sequence
  chemically synthesized
tggatgtgttaattttgagata

SEQ ID NO: 999373 - DNA, 22 bp, Artificial Sequence
  chemically synthesized
ttcaaaggtatctcaaaattaa

SEQ ID NO: 999374 - DNA, 22 bp, Artificial Sequence
  chemically synthesized
tcaaaggtatctcaaaattaac

SEQ ID NO: 999375 - DNA, 22 bp, Artificial Sequence
  chemically synthesized
caaaggtatctcaaaattaaca

SEQ ID NO: 999376 - DNA, 22 bp, Artificial Sequence
  chemically synthesized
aaaggtatctcaaaattaacac

SEQ ID NO: 999377 - DNA, 22 bp, Artificial Sequence
  chemically synthesized
aaaattaacacatccaaaatac

SEQ ID NO: 999378 - DNA, 22 bp, Artificial Sequence
  chemically synthesized
cagagaaagagagtaaacgtat

SEQ ID NO: 999379 - DNA, 22 bp, Artificial Sequence
  chemically synthesized
acacatccaaaatacgtttact

SEQ ID NO: 999380 - DNA, 22 bp, Artificial Sequence
  chemically synthesized
actctctttctctgcaactctt

SEQ ID NO: 999381 - DNA, 22 bp, Artificial Sequence
  chemically synthesized
ctctctttctctgcaactcttt

SEQ ID NO: 999382 - DNA, 22 bp, Artificial Sequence
  chemically synthesized
tctttctctgcaactcttttcc

SEQ ID NO: 999383 - DNA, 22 bp, Artificial Sequence
  chemically synthesized
tttctctgcaactcttttcctc

SEQ ID NO: 999384 - DNA, 22 bp, Artificial Sequence
  chemically synthesized
tctctgcaactcttttcctctc

SEQ ID NO: 999385 - DNA, 22 bp, Artificial Sequence
  chemically synthesized
aatgcataaggggagaggaaaa

SEQ ID NO: 999386 - DNA, 22 bp, Artificial Sequence
  chemically synthesized
ctctgcaactcttttcctctcc

SEQ ID NO: 999387 - DNA, 22 bp, Artificial Sequence
  chemically synthesized
tctgcaactcttttcctctccc

SEQ ID NO: 999388 - DNA, 22 bp, Artificial Sequence
  chemically synthesized
tgcaactcttttcctctcccct

SEQ ID NO: 999389 - DNA, 22 bp, Artificial Sequence
  chemically synthesized
caactcttttcctctcccctta

SEQ ID NO: 999390 - DNA, 22 bp, Artificial Sequence
  chemically synthesized
ttttcctctccccttatgcatt

SEQ ID NO: 999391 - DNA, 22 bp, Artificial Sequence
  chemically synthesized
ttcctctccccttatgcattta

SEQ ID NO: 999392 - DNA, 22 bp, Artificial Sequence
  chemically synthesized
tcctctccccttatgcatttaa

SEQ ID NO: 999393 - DNA, 22 bp, Artificial Sequence
  chemically synthesized
cctctccccttatgcatttaac

SEQ ID NO: 999394 - DNA, 22 bp, Artificial Sequence
  chemically synthesized
ctctccccttatgcatttaacc

SEQ ID NO: 999395 - DNA, 22 bp, Artificial Sequence
  chemically synthesized
tccccttatgcatttaaccatt

SEQ ID NO: 999396 - DNA, 22 bp, Artificial Sequence
  chemically synthesized
gataaaataatgaatggttaaa

SEQ ID NO: 999397 - DNA, 22 bp, Artificial Sequence
  chemically synthesized
cccttatgcatttaaccattca

SEQ ID NO: 999398 - DNA, 22 bp, Artificial Sequence
  chemically synthesized
atgcatttaaccattcattatt

SEQ ID NO: 999399 - DNA, 22 bp, Artificial Sequence
  chemically synthesized
tgcatttaaccattcattattt

SEQ ID NO: 999400 - DNA, 22 bp, Artificial Sequence
  chemically synthesized
aaccattcattattttatccaa

SEQ ID NO: 999401 - DNA, 22 bp, Artificial Sequence
  chemically synthesized
accattcattattttatccaat

SEQ ID NO: 999402 - DNA, 22 bp, Artificial Sequence
  chemically synthesized
attattttatccaatacgtact

SEQ ID NO: 999403 - DNA, 22 bp, Artificial Sequence
  chemically synthesized
ttttatccaatacgtacttact

SEQ ID NO: 999404 - DNA, 22 bp, Artificial Sequence
  chemically synthesized
tatccaatacgtacttactgat

SEQ ID NO: 999405 - DNA, 22 bp, Artificial Sequence
  chemically synthesized
atccaatacgtacttactgatc

SEQ ID NO: 999406 - DNA, 22 bp, Artificial Sequence
  chemically synthesized
tccaatacgtacttactgatca

SEQ ID NO: 999407 - DNA, 22 bp, Artificial Sequence
  chemically synthesized
aaatgggaaaataataagtgat

SEQ ID NO: 999408 - DNA, 22 bp, Artificial Sequence
  chemically synthesized
gaaatgggaaaataataagtga

SEQ ID NO: 999409 - DNA, 22 bp, Artificial Sequence
  chemically synthesized
tgaaatgggaaaataataagtg

SEQ ID NO: 999410 - DNA, 22 bp, Artificial Sequence
  chemically synthesized
ttgaaatgggaaaataataagt

SEQ ID NO: 999411 - DNA, 22 bp, Artificial Sequence
  chemically synthesized
ttttgaaatgggaaaataataa

SEQ ID NO: 999412 - DNA, 22 bp, Artificial Sequence
  chemically synthesized
cttttgaaatgggaaaataata

SEQ ID NO: 999413 - DNA, 22 bp, Artificial Sequence
  chemically synthesized
actgatcacttattattttccc

SEQ ID NO: 999414 - DNA, 22 bp, Artificial Sequence
  chemically synthesized
ctgatcacttattattttccca

SEQ ID NO: 999415 - DNA, 22 bp, Artificial Sequence
  chemically synthesized
atcacttattattttcccattt

SEQ ID NO: 999416 - DNA, 22 bp, Artificial Sequence
  chemically synthesized
ccatttcttttgaaatgggaaa

SEQ ID NO: 999417 - DNA, 22 bp, Artificial Sequence
  chemically synthesized
attattttcccatttcaaaaga

SEQ ID NO: 999418 - DNA, 22 bp, Artificial Sequence
  chemically synthesized
ttattttcccatttcaaaagaa

SEQ ID NO: 999419 - DNA, 22 bp, Artificial Sequence
  chemically synthesized
ttttcccatttcaaaagaaatg

SEQ ID NO: 999420 - DNA, 22 bp, Artificial Sequence
  chemically synthesized
gagataacactgccatttcttt

SEQ ID NO: 999421 - DNA, 22 bp, Artificial Sequence
  chemically synthesized
tcccatttcaaaagaaatggca

SEQ ID NO: 999422 - DNA, 22 bp, Artificial Sequence
  chemically synthesized
tggagataacactgccatttct

SEQ ID NO: 999423 - DNA, 22 bp, Artificial Sequence
  chemically synthesized
cccatttcaaaagaaatggcag

SEQ ID NO: 999424 - DNA, 22 bp, Artificial Sequence
  chemically synthesized
ccatttcaaaagaaatggcagt

SEQ ID NO: 999425 - DNA, 22 bp, Artificial Sequence
  chemically synthesized
caaaagaaatggcagtgttatc

SEQ ID NO: 999426 - DNA, 22 bp, Artificial Sequence
  chemically synthesized
aaaagaaatggcagtgttatct

SEQ ID NO: 999427 - DNA, 22 bp, Artificial Sequence
  chemically synthesized
atgtcatacacctctggagata

SEQ ID NO: 999428 - DNA, 22 bp, Artificial Sequence
  chemically synthesized
tgatgtcatacacctctggaga

SEQ ID NO: 999429 - DNA, 22 bp, Artificial Sequence
  chemically synthesized
ctgatgtcatacacctctggag

SEQ ID NO: 999430 - DNA, 22 bp, Artificial Sequence
  chemically synthesized
ccagtttctgatgtcatacacc

SEQ ID NO: 999431 - DNA, 22 bp, Artificial Sequence
  chemically synthesized
tctccagaggtgtatgacatca

SEQ ID NO: 999432 - DNA, 22 bp, Artificial Sequence
  chemically synthesized
cagaggtgtatgacatcagaaa

SEQ ID NO: 999433 - DNA, 22 bp, Artificial Sequence
  chemically synthesized
aggaaagtgtcatatatcattc

SEQ ID NO: 999434 - DNA, 22 bp, Artificial Sequence
  chemically synthesized
gaggaaagtgtcatatatcatt

SEQ ID NO: 999435 - DNA, 22 bp, Artificial Sequence
  chemically synthesized
aatttgaggaaagtgtcatata

SEQ ID NO: 999436 - DNA, 22 bp, Artificial Sequence
  chemically synthesized
ggaatgatatatgacactttcc

SEQ ID NO: 999437 - DNA, 22 bp, Artificial Sequence
  chemically synthesized
cagagttgaatttgaggaaagt

SEQ ID NO: 999438 - DNA, 22 bp, Artificial Sequence
  chemically synthesized
aacgattgcagagttgaatttg

SEQ ID NO: 999439 - DNA, 22 bp, Artificial Sequence
  chemically synthesized
agttgaacgattgcagagttga

SEQ ID NO: 999440 - DNA, 22 bp, Artificial Sequence
  chemically synthesized
tcctcaaattcaactctgcaat

SEQ ID NO: 999441 - DNA, 22 bp, Artificial Sequence
  chemically synthesized
cctcaaattcaactctgcaatc

SEQ ID NO: 999442 - DNA, 22 bp, Artificial Sequence
  chemically synthesized
ctcaaattcaactctgcaatcg

SEQ ID NO: 999443 - DNA, 22 bp, Artificial Sequence
  chemically synthesized
gtgttaagttgaacgattgcag

SEQ ID NO: 999444 - DNA, 22 bp, Artificial Sequence
  chemically synthesized
aaattcaactctgcaatcgttc

SEQ ID NO: 999445 - DNA, 22 bp, Artificial Sequence
  chemically synthesized
aactctgcaatcgttcaactta

SEQ ID NO: 999446 - DNA, 22 bp, Artificial Sequence
  chemically synthesized
acgggggttagtgttaagttga

SEQ ID NO: 999447 - DNA, 22 bp, Artificial Sequence
  chemically synthesized
tgcaatcgttcaacttaacact

SEQ ID NO: 999448 - DNA, 22 bp, Artificial Sequence
  chemically synthesized
caatcgttcaacttaacactaa

SEQ ID NO: 999449 - DNA, 22 bp, Artificial Sequence
  chemically synthesized
aacttaacactaacccccgtca

SEQ ID NO: 999450 - DNA, 22 bp, Artificial Sequence
  chemically synthesized
aacactaacccccgtcaattac

SEQ ID NO: 999451 - DNA, 22 bp, Artificial Sequence
  chemically synthesized
acactaacccccgtcaattacg

SEQ ID NO: 999452 - DNA, 22 bp, Artificial Sequence
  chemically synthesized
agaaaaatacaggagacgtaat

SEQ ID NO: 999453 - DNA, 22 bp, Artificial Sequence
  chemically synthesized
acccccgtcaattacgtctcct

SEQ ID NO: 999454 - DNA, 22 bp, Artificial Sequence
  chemically synthesized
cgtctcctgtatttttctcagg

SEQ ID NO: 999455 - DNA, 22 bp, Artificial Sequence
  chemically synthesized
ctgtatttttctcaggtttgtt

SEQ ID NO: 999456 - DNA, 22 bp, Artificial Sequence
  chemically synthesized
gtgagaatgtgacaacaaacct

SEQ ID NO: 999457 - DNA, 22 bp, Artificial Sequence
  chemically synthesized
tatttttctcaggtttgttgtc

SEQ ID NO: 999458 - DNA, 22 bp, Artificial Sequence
  chemically synthesized
tagtgagaatgtgacaacaaac

SEQ ID NO: 999459 - DNA, 22 bp, Artificial Sequence
  chemically synthesized
ttctcaggtttgttgtcacatt

SEQ ID NO: 999460 - DNA, 22 bp, Artificial Sequence
  chemically synthesized
tctcaggtttgttgtcacattc

SEQ ID NO: 999461 - DNA, 22 bp, Artificial Sequence
  chemically synthesized
ctcaggtttgttgtcacattct

SEQ ID NO: 999462 - DNA, 22 bp, Artificial Sequence
  chemically synthesized
tcaggtttgttgtcacattctc

SEQ ID NO: 999463 - DNA, 22 bp, Artificial Sequence
  chemically synthesized
aaatagttctagtgagaatgtg

SEQ ID NO: 999464 - DNA, 22 bp, Artificial Sequence
  chemically synthesized
aggtttgttgtcacattctcac

SEQ ID NO: 999465 - DNA, 22 bp, Artificial Sequence
  chemically synthesized
actaaaatagttctagtgagaa

SEQ ID NO: 999466 - DNA, 22 bp, Artificial Sequence
  chemically synthesized
gactaaaatagttctagtgaga

SEQ ID NO: 999467 - DNA, 22 bp, Artificial Sequence
  chemically synthesized
gttgtcacattctcactagaac

SEQ ID NO: 999468 - DNA, 22 bp, Artificial Sequence
  chemically synthesized
ttgtcacattctcactagaact

SEQ ID NO: 999469 - DNA, 22 bp, Artificial Sequence
  chemically synthesized
tcacattctcactagaactatt

SEQ ID NO: 999470 - DNA, 22 bp, Artificial Sequence
  chemically synthesized
tcactagaactattttagtcaa

SEQ ID NO: 999471 - DNA, 22 bp, Artificial Sequence
  chemically synthesized
actagaactattttagtcaaga

SEQ ID NO: 999472 - DNA, 22 bp, Artificial Sequence
  chemically synthesized
gaactattttagtcaagaccac

SEQ ID NO: 999473 - DNA, 22 bp, Artificial Sequence
  chemically synthesized
gcaagaagcgatggtggtcttg

SEQ ID NO: 999474 - DNA, 22 bp, Artificial Sequence
  chemically synthesized
ggcaagaagcgatggtggtctt

SEQ ID NO: 999475 - DNA, 22 bp, Artificial Sequence
  chemically synthesized
ttttagtcaagaccaccatcgc

SEQ ID NO: 999476 - DNA, 22 bp, Artificial Sequence
  chemically synthesized
tagtcaagaccaccatcgcttc

SEQ ID NO: 999477 - DNA, 22 bp, Artificial Sequence
  chemically synthesized
taatcttggcaagaagcgatgg

SEQ ID NO: 999478 - DNA, 22 bp, Artificial Sequence
  chemically synthesized
agtcaagaccaccatcgcttct

SEQ ID NO: 999479 - DNA, 22 bp, Artificial Sequence
  chemically synthesized
gtcaagaccaccatcgcttctt

SEQ ID NO: 999480 - DNA, 22 bp, Artificial Sequence
  chemically synthesized
ttgtaatcttggcaagaagcga

SEQ ID NO: 999481 - DNA, 22 bp, Artificial Sequence
  chemically synthesized
ttattgtaatcttggcaagaag

SEQ ID NO: 999482 - DNA, 22 bp, Artificial Sequence
  chemically synthesized
cttgccaagattacaataataa

SEQ ID NO: 999483 - DNA, 22 bp, Artificial Sequence
  chemically synthesized
ttgccaagattacaataataac

SEQ ID NO: 999484 - DNA, 22 bp, Artificial Sequence
  chemically synthesized
gccaagattacaataataacct

SEQ ID NO: 999485 - DNA, 22 bp, Artificial Sequence
  chemically synthesized
aatggacaaaagaggttattat

SEQ ID NO: 999486 - DNA, 22 bp, Artificial Sequence
  chemically synthesized
ccaagattacaataataacctc

SEQ ID NO: 999487 - DNA, 22 bp, Artificial Sequence
  chemically synthesized
caataataacctcttttgtcca

SEQ ID NO: 999488 - DNA, 22 bp, Artificial Sequence
  chemically synthesized
agagagaagcaaatctgaatgg

SEQ ID NO: 999489 - DNA, 22 bp, Artificial Sequence
  chemically synthesized
ttttgtccattcagatttgctt

SEQ ID NO: 999490 - DNA, 22 bp, Artificial Sequence
  chemically synthesized
ttgtccattcagatttgcttct

SEQ ID NO: 999491 - DNA, 22 bp, Artificial Sequence
  chemically synthesized
tgtccattcagatttgcttctc

SEQ ID NO: 999492 - DNA, 22 bp, Artificial Sequence
  chemically synthesized
gtccattcagatttgcttctct

SEQ ID NO: 999493 - DNA, 22 bp, Artificial Sequence
  chemically synthesized
tccattcagatttgcttctctc

SEQ ID NO: 999494 - DNA, 22 bp, Artificial Sequence
  chemically synthesized
agatttgcttctctctgaacca

SEQ ID NO: 999495 - DNA, 22 bp, Artificial Sequence
  chemically synthesized
aagtgtggagaatggttcagag

SEQ ID NO: 999496 - DNA, 22 bp, Artificial Sequence
  chemically synthesized
gctgaagtgtggagaatggttc

SEQ ID NO: 999497 - DNA, 22 bp, Artificial Sequence
  chemically synthesized
cgctgaagtgtggagaatggtt

SEQ ID NO: 999498 - DNA, 22 bp, Artificial Sequence
  chemically synthesized
gcttctctctgaaccattctcc

SEQ ID NO: 999499 - DNA, 22 bp, Artificial Sequence
  chemically synthesized
tcgctgaagtgtggagaatggt

SEQ ID NO: 999500 - DNA, 22 bp, Artificial Sequence
  chemically synthesized
cttctctctgaaccattctcca

SEQ ID NO: 999501 - DNA, 22 bp, Artificial Sequence
  chemically synthesized
tttcgctgaagtgtggagaatg

SEQ ID NO: 999502 - DNA, 22 bp, Artificial Sequence
  chemically synthesized
ctttcgctgaagtgtggagaat

SEQ ID NO: 999503 - DNA, 22 bp, Artificial Sequence
  chemically synthesized
ctctctgaaccattctccacac

SEQ ID NO: 999504 - DNA, 22 bp, Artificial Sequence
  chemically synthesized
tctctgaaccattctccacact

SEQ ID NO: 999505 - DNA, 22 bp, Artificial Sequence
  chemically synthesized
tctgaaccattctccacacttc

SEQ ID NO: 999506 - DNA, 22 bp, Artificial Sequence
  chemically synthesized
tgaaccattctccacacttcag

SEQ ID NO: 999507 - DNA, 22 bp, Artificial Sequence
  chemically synthesized
aaccattctccacacttcagcg

SEQ ID NO: 999508 - DNA, 22 bp, Artificial Sequence
  chemically synthesized
agagacttctttcgctgaagtg

SEQ ID NO: 999509 - DNA, 22 bp, Artificial Sequence
  chemically synthesized
attcagagacttctttcgctga

SEQ ID NO: 999510 - DNA, 22 bp, Artificial Sequence
  chemically synthesized
gattcagagacttctttcgctg

SEQ ID NO: 999511 - DNA, 22 bp, Artificial Sequence
  chemically synthesized
tgattcagagacttctttcgct

SEQ ID NO: 999512 - DNA, 22 bp, Artificial Sequence
  chemically synthesized
tccacacttcagcgaaagaagt

SEQ ID NO: 999513 - DNA, 22 bp, Artificial Sequence
  chemically synthesized
cacacttcagcgaaagaagtct

SEQ ID NO: 999514 - DNA, 22 bp, Artificial Sequence
  chemically synthesized
gagctttgattcagagacttct

SEQ ID NO: 999515 - DNA, 22 bp, Artificial Sequence
  chemically synthesized
cagcgaaagaagtctctgaatc

SEQ ID NO: 999516 - DNA, 22 bp, Artificial Sequence
  chemically synthesized
agcgaaagaagtctctgaatca

SEQ ID NO: 999517 - DNA, 22 bp, Artificial Sequence
  chemically synthesized
tcaggaaagagtcatgattaga

SEQ ID NO: 999518 - DNA, 22 bp, Artificial Sequence
  chemically synthesized
tgaatcaaagctctaatcatga

SEQ ID NO: 999519 - DNA, 22 bp, Artificial Sequence
  chemically synthesized
aatcaaagctctaatcatgact

SEQ ID NO: 999520 - DNA, 22 bp, Artificial Sequence
  chemically synthesized
tcacgtggttgtcaggaaagag

SEQ ID NO: 999521 - DNA, 22 bp, Artificial Sequence
  chemically synthesized
gtcacgtggttgtcaggaaaga

SEQ ID NO: 999522 - DNA, 22 bp, Artificial Sequence
  chemically synthesized
tgtcacgtggttgtcaggaaag

SEQ ID NO: 999523 - DNA, 22 bp, Artificial Sequence
  chemically synthesized
taatcatgactctttcctgaca

SEQ ID NO: 999524 - DNA, 22 bp, Artificial Sequence
  chemically synthesized
atcatgactctttcctgacaac

SEQ ID NO: 999525 - DNA, 22 bp, Artificial Sequence
  chemically synthesized
tttcctgacaaccacgtgacaa

SEQ ID NO: 999526 - DNA, 22 bp, Artificial Sequence
  chemically synthesized
cccagaagggctttgtcacgtg

SEQ ID NO: 999527 - DNA, 22 bp, Artificial Sequence
  chemically synthesized
tcctgacaaccacgtgacaaag

SEQ ID NO: 999528 - DNA, 22 bp, Artificial Sequence
  chemically synthesized
tgcccagaagggctttgtcacg

SEQ ID NO: 999529 - DNA, 22 bp, Artificial Sequence
  chemically synthesized
cctgacaaccacgtgacaaagc

SEQ ID NO: 999530 - DNA, 22 bp, Artificial Sequence
  chemically synthesized
ctgacaaccacgtgacaaagcc

SEQ ID NO: 999531 - DNA, 22 bp, Artificial Sequence
  chemically synthesized
tctgcccagaagggctttgtca

SEQ ID NO: 999532 - DNA, 22 bp, Artificial Sequence
  chemically synthesized
ctctgcccagaagggctttgtc

SEQ ID NO: 999533 - DNA, 22 bp, Artificial Sequence
  chemically synthesized
tctctgcccagaagggctttgt

SEQ ID NO: 999534 - DNA, 22 bp, Artificial Sequence
  chemically synthesized
acaaccacgtgacaaagccctt

SEQ ID NO: 999535 - DNA, 22 bp, Artificial Sequence
  chemically synthesized
ttctctgcccagaagggctttg

SEQ ID NO: 999536 - DNA, 22 bp, Artificial Sequence
  chemically synthesized
tttctctgcccagaagggcttt

SEQ ID NO: 999537 - DNA, 22 bp, Artificial Sequence
  chemically synthesized
ggagttttttctctgcccagaa

SEQ ID NO: 999538 - DNA, 22 bp, Artificial Sequence
  chemically synthesized
ttgggagttttttctctgccca

SEQ ID NO: 999539 - DNA, 22 bp, Artificial Sequence
  chemically synthesized
gggtcctgttgggagttttttc

SEQ ID NO: 999540 - DNA, 22 bp, Artificial Sequence
  chemically synthesized
cgggtcctgttgggagtttttt

SEQ ID NO: 999541 - DNA, 22 bp, Artificial Sequence
  chemically synthesized
ctgggcagagaaaaaactccca

SEQ ID NO: 999542 - DNA, 22 bp, Artificial Sequence
  chemically synthesized
tgggcagagaaaaaactcccaa

SEQ ID NO: 999543 - DNA, 22 bp, Artificial Sequence
  chemically synthesized
ggcagagaaaaaactcccaaca

SEQ ID NO: 999544 - DNA, 22 bp, Artificial Sequence
  chemically synthesized
gagggtccttcgggtcctgttg

SEQ ID NO: 999545 - DNA, 22 bp, Artificial Sequence
  chemically synthesized
gaacctggagggtccttcgggt

SEQ ID NO: 999546 - DNA, 22 bp, Artificial Sequence
  chemically synthesized
ccaacaggacccgaaggaccct

SEQ ID NO: 999547 - DNA, 22 bp, Artificial Sequence
  chemically synthesized
aagaggagatggggctagaacc

SEQ ID NO: 999548 - DNA, 22 bp, Artificial Sequence
  chemically synthesized
caggttctagccccatctcctc

SEQ ID NO: 999549 - DNA, 22 bp, Artificial Sequence
  chemically synthesized
aagagaccaagctaaagaggag

SEQ ID NO: 999550 - DNA, 22 bp, Artificial Sequence
  chemically synthesized
tagccccatctcctctttagct

SEQ ID NO: 999551 - DNA, 22 bp, Artificial Sequence
  chemically synthesized
gccccatctcctctttagcttg

SEQ ID NO: 999552 - DNA, 22 bp, Artificial Sequence
  chemically synthesized
gaagaaagatgttcaagagacc

SEQ ID NO: 999553 - DNA, 22 bp, Artificial Sequence
  chemically synthesized
ctctttagcttggtctcttgaa

SEQ ID NO: 999554 - DNA, 22 bp, Artificial Sequence
  chemically synthesized
ggaagaaagatgttcaagagac

SEQ ID NO: 999555 - DNA, 22 bp, Artificial Sequence
  chemically synthesized
tttagcttggtctcttgaacat

SEQ ID NO: 999556 - DNA, 22 bp, Artificial Sequence
  chemically synthesized
tagcttggtctcttgaacatct

SEQ ID NO: 999557 - DNA, 22 bp, Artificial Sequence
  chemically synthesized
tgtttggaagaaagatgttcaa

SEQ ID NO: 999558 - DNA, 22 bp, Artificial Sequence
  chemically synthesized
agcttggtctcttgaacatctt

SEQ ID NO: 999559 - DNA, 22 bp, Artificial Sequence
  chemically synthesized
gcttggtctcttgaacatcttt

SEQ ID NO: 999560 - DNA, 22 bp, Artificial Sequence
  chemically synthesized
ggtctcttgaacatctttcttc

SEQ ID NO: 999561 - DNA, 22 bp, Artificial Sequence
  chemically synthesized
gtctcttgaacatctttcttcc

SEQ ID NO: 999562 - DNA, 22 bp, Artificial Sequence
  chemically synthesized
ttgaacatctttcttccaaaca

SEQ ID NO: 999563 - DNA, 22 bp, Artificial Sequence
  chemically synthesized
gaacatctttcttccaaacata

SEQ ID NO: 999564 - DNA, 22 bp, Artificial Sequence
  chemically synthesized
aacatctttcttccaaacataa

SEQ ID NO: 999565 - DNA, 22 bp, Artificial Sequence
  chemically synthesized
tcttccaaacataatctgctgt

SEQ ID NO: 999566 - DNA, 22 bp, Artificial Sequence
  chemically synthesized
cttccaaacataatctgctgtc

SEQ ID NO: 999567 - DNA, 22 bp, Artificial Sequence
  chemically synthesized
ttccaaacataatctgctgtca

SEQ ID NO: 999568 - DNA, 22 bp, Artificial Sequence
  chemically synthesized
ccaaacataatctgctgtcaca

SEQ ID NO: 999569 - DNA, 22 bp, Artificial Sequence
  chemically synthesized
caaacataatctgctgtcacat

SEQ ID NO: 999570 - DNA, 22 bp, Artificial Sequence
  chemically synthesized
ctgtcacattctttctgttcct

SEQ ID NO: 999571 - DNA, 22 bp, Artificial Sequence
  chemically synthesized
tcacattctttctgttccttta

SEQ ID NO: 999572 - DNA, 22 bp, Artificial Sequence
  chemically synthesized
agagtgtcagagataaaggaac

SEQ ID NO: 999573 - DNA, 22 bp, Artificial Sequence
  chemically synthesized
agcctgagagtgtcagagataa

SEQ ID NO: 999574 - DNA, 22 bp, Artificial Sequence
  chemically synthesized
tttctgttcctttatctctgac

SEQ ID NO: 999575 - DNA, 22 bp, Artificial Sequence
  chemically synthesized
tctgttcctttatctctgacac

SEQ ID NO: 999576 - DNA, 22 bp, Artificial Sequence
  chemically synthesized
ctgttcctttatctctgacact

SEQ ID NO: 999577 - DNA, 22 bp, Artificial Sequence
  chemically synthesized
tgttcctttatctctgacactc

SEQ ID NO: 999578 - DNA, 22 bp, Artificial Sequence
  chemically synthesized
ttcctttatctctgacactctc

SEQ ID NO: 999579 - DNA, 22 bp, Artificial Sequence
  chemically synthesized
aagagctaagcctgagagtgtc

SEQ ID NO: 999580 - DNA, 22 bp, Artificial Sequence
  chemically synthesized
aaagagctaagcctgagagtgt

SEQ ID NO: 999581 - DNA, 22 bp, Artificial Sequence
  chemically synthesized
ctttatctctgacactctcagg

SEQ ID NO: 999582 - DNA, 22 bp, Artificial Sequence
  chemically synthesized
tatctctgacactctcaggctt

SEQ ID NO: 999583 - DNA, 22 bp, Artificial Sequence
  chemically synthesized
atctctgacactctcaggctta

SEQ ID NO: 999584 - DNA, 22 bp, Artificial Sequence
  chemically synthesized
tctctgacactctcaggcttag

SEQ ID NO: 999585 - DNA, 22 bp, Artificial Sequence
  chemically synthesized
tgacactctcaggcttagctct

SEQ ID NO: 999586 - DNA, 22 bp, Artificial Sequence
  chemically synthesized
acactctcaggcttagctcttt

SEQ ID NO: 999587 - DNA, 22 bp, Artificial Sequence
  chemically synthesized
tgcagagtaccacatttaaaga

SEQ ID NO: 999588 - DNA, 22 bp, Artificial Sequence
  chemically synthesized
tcaggcttagctctttaaatgt

SEQ ID NO: 999589 - DNA, 22 bp, Artificial Sequence
  chemically synthesized
tatgcagagtaccacatttaaa

SEQ ID NO: 999590 - DNA, 22 bp, Artificial Sequence
  chemically synthesized
aggcttagctctttaaatgtgg

SEQ ID NO: 999591 - DNA, 22 bp, Artificial Sequence
  chemically synthesized
ctatgcagagtaccacatttaa

SEQ ID NO: 999592 - DNA, 22 bp, Artificial Sequence
  chemically synthesized
tctatgcagagtaccacattta

SEQ ID NO: 999593 - DNA, 22 bp, Artificial Sequence
  chemically synthesized
ttctatgcagagtaccacattt

SEQ ID NO: 999594 - DNA, 22 bp, Artificial Sequence
  chemically synthesized
agctctttaaatgtggtactct

SEQ ID NO: 999595 - DNA, 22 bp, Artificial Sequence
  chemically synthesized
gctctttaaatgtggtactctg

SEQ ID NO: 999596 - DNA, 22 bp, Artificial Sequence
  chemically synthesized
tttaaatgtggtactctgcata

SEQ ID NO: 999597 - DNA, 22 bp, Artificial Sequence
  chemically synthesized
taaatgtggtactctgcataga

SEQ ID NO: 999598 - DNA, 22 bp, Artificial Sequence
  chemically synthesized
aaatgtggtactctgcatagaa

SEQ ID NO: 999599 - DNA, 22 bp, Artificial Sequence
  chemically synthesized
aatgtggtactctgcatagaaa

SEQ ID NO: 999600 - DNA, 22 bp, Artificial Sequence
  chemically synthesized
ccgtgaaggtggtggaaatttt

SEQ ID NO: 999601 - DNA, 22 bp, Artificial Sequence
  chemically synthesized
tgcatagaaaaatttccaccac

SEQ ID NO: 999602 - DNA, 22 bp, Artificial Sequence
  chemically synthesized
catagaaaaatttccaccacct

SEQ ID NO: 999603 - DNA, 22 bp, Artificial Sequence
  chemically synthesized
gccacacaaaactaccgtgaag

SEQ ID NO: 999604 - DNA, 22 bp, Artificial Sequence
  chemically synthesized
ggccacacaaaactaccgtgaa

SEQ ID NO: 999605 - DNA, 22 bp, Artificial Sequence
  chemically synthesized
ccaccaccttcacggtagtttt

SEQ ID NO: 999606 - DNA, 22 bp, Artificial Sequence
  chemically synthesized
caccaccttcacggtagttttg

SEQ ID NO: 999607 - DNA, 22 bp, Artificial Sequence
  chemically synthesized
cacggtagttttgtgtggccaa

SEQ ID NO: 999608 - DNA, 22 bp, Artificial Sequence
  chemically synthesized
acggtagttttgtgtggccaag

SEQ ID NO: 999609 - DNA, 22 bp, Artificial Sequence
  chemically synthesized
tgaagaagtgatatagacttgg

SEQ ID NO: 999610 - DNA, 22 bp, Artificial Sequence
  chemically synthesized
tgtgaagaagtgatatagactt

SEQ ID NO: 999611 - DNA, 22 bp, Artificial Sequence
  chemically synthesized
ctgtgaagaagtgatatagact

SEQ ID NO: 999612 - DNA, 22 bp, Artificial Sequence
  chemically synthesized
tgtgtggccaagtctatatcac

SEQ ID NO: 999613 - DNA, 22 bp, Artificial Sequence
  chemically synthesized
gtgtggccaagtctatatcact

SEQ ID NO: 999614 - DNA, 22 bp, Artificial Sequence
  chemically synthesized
tgtggccaagtctatatcactt

SEQ ID NO: 999615 - DNA, 22 bp, Artificial Sequence
  chemically synthesized
ggtcaccaaaagcttctgtgaa

SEQ ID NO: 999616 - DNA, 22 bp, Artificial Sequence
  chemically synthesized
tatcacttcttcacagaagctt

SEQ ID NO: 999617 - DNA, 22 bp, Artificial Sequence
  chemically synthesized
gtatctgggtcaccaaaagctt

SEQ ID NO: 999618 - DNA, 22 bp, Artificial Sequence
  chemically synthesized
cttcacagaagcttttggtgac

SEQ ID NO: 999619 - DNA, 22 bp, Artificial Sequence
  chemically synthesized
ttcacagaagcttttggtgacc

SEQ ID NO: 999620 - DNA, 22 bp, Artificial Sequence
  chemically synthesized
aattagtatctgggtcaccaaa

SEQ ID NO: 999621 - DNA, 22 bp, Artificial Sequence
  chemically synthesized
gaattagtatctgggtcaccaa

SEQ ID NO: 999622 - DNA, 22 bp, Artificial Sequence
  chemically synthesized
cacagaagcttttggtgaccca

SEQ ID NO: 999623 - DNA, 22 bp, Artificial Sequence
  chemically synthesized
acagaagcttttggtgacccag

SEQ ID NO: 999624 - DNA, 22 bp, Artificial Sequence
  chemically synthesized
gaaatttgaattagtatctggg

SEQ ID NO: 999625 - DNA, 22 bp, Artificial Sequence
  chemically synthesized
ttggtgacccagatactaattc

SEQ ID NO: 999626 - DNA, 22 bp, Artificial Sequence
  chemically synthesized
tggtgacccagatactaattca

SEQ ID NO: 999627 - DNA, 22 bp, Artificial Sequence
  chemically synthesized
ggtgacccagatactaattcaa

SEQ ID NO: 999628 - DNA, 22 bp, Artificial Sequence
  chemically synthesized
gtgacccagatactaattcaaa

SEQ ID NO: 999629 - DNA, 22 bp, Artificial Sequence
  chemically synthesized
gtgtccgagttagaaatttgaa

SEQ ID NO: 999630 - DNA, 22 bp, Artificial Sequence
  chemically synthesized
attcaaatttctaactcggaca

SEQ ID NO: 999631 - DNA, 22 bp, Artificial Sequence
  chemically synthesized
aaatttctaactcggacaccag

SEQ ID NO: 999632 - DNA, 22 bp, Artificial Sequence
  chemically synthesized
ctaactcggacaccagtggttc

SEQ ID NO: 999633 - DNA, 22 bp, Artificial Sequence
  chemically synthesized
taactcggacaccagtggttcc

SEQ ID NO: 999634 - DNA, 22 bp, Artificial Sequence
  chemically synthesized
actcggacaccagtggttcccc

SEQ ID NO: 999635 - DNA, 22 bp, Artificial Sequence
  chemically synthesized
agagagagagagaaaggggaac

SEQ ID NO: 999636 - DNA, 22 bp, Artificial Sequence
  chemically synthesized
ggacaccagtggttcccctttc

SEQ ID NO: 999637 - DNA, 22 bp, Artificial Sequence
  chemically synthesized
ccctttctctctctctctcaat

SEQ ID NO: 999638 - DNA, 22 bp, Artificial Sequence
  chemically synthesized
agagagagagagagagattgag

SEQ ID NO: 999639 - DNA, 22 bp, Artificial Sequence
  chemically synthesized
tctctctctctctcaatctctc

SEQ ID NO: 999640 - DNA, 22 bp, Artificial Sequence
  chemically synthesized
ctctctctctctcaatctctct

SEQ ID NO: 999641 - DNA, 22 bp, Artificial Sequence
  chemically synthesized
tgagagagagagagagagattg

SEQ ID NO: 999642 - DNA, 22 bp, Artificial Sequence
  chemically synthesized
tctctctctctcaatctctctc

SEQ ID NO: 999643 - DNA, 22 bp, Artificial Sequence
  chemically synthesized
tctctctctcaatctctctctc

SEQ ID NO: 999644 - DNA, 22 bp, Artificial Sequence
  chemically synthesized
tctctctcaatctctctctctc

SEQ ID NO: 999645 - DNA, 22 bp, Artificial Sequence
  chemically synthesized
tctctcaatctctctctctctc

SEQ ID NO: 999646 - DNA, 22 bp, Artificial Sequence
  chemically synthesized
tctcaatctctctctctctctc

SEQ ID NO: 999647 - DNA, 22 bp, Artificial Sequence
  chemically synthesized
atgagattctgagagagagaga

SEQ ID NO: 999648 - DNA, 22 bp, Artificial Sequence
  chemically synthesized
tcaatctctctctctctctctc

SEQ ID NO: 999649 - DNA, 22 bp, Artificial Sequence
  chemically synthesized
aatctctctctctctctctcag

SEQ ID NO: 999650 - DNA, 22 bp, Artificial Sequence
  chemically synthesized
tctctctctctctcagaatctc

SEQ ID NO: 999651 - DNA, 22 bp, Artificial Sequence
  chemically synthesized
tctctctctctcagaatctcat

SEQ ID NO: 999652 - DNA, 22 bp, Artificial Sequence
  chemically synthesized
tctctctctcagaatctcatga

SEQ ID NO: 999653 - DNA, 22 bp, Artificial Sequence
  chemically synthesized
tctctctcagaatctcatgaga

SEQ ID NO: 999654 - DNA, 22 bp, Artificial Sequence
  chemically synthesized
tctctcagaatctcatgagatt

SEQ ID NO: 999655 - DNA, 22 bp, Artificial Sequence
  chemically synthesized
tctcagaatctcatgagattca

SEQ ID NO: 999656 - DNA, 22 bp, Artificial Sequence
  chemically synthesized
tcagaatctcatgagattcatc

SEQ ID NO: 999657 - DNA, 22 bp, Artificial Sequence
  chemically synthesized
agaatctcatgagattcatcat

SEQ ID NO: 999658 - DNA, 22 bp, Artificial Sequence
  chemically synthesized
tgcaagtaatcaaccatgatga

SEQ ID NO: 999659 - DNA, 22 bp, Artificial Sequence
  chemically synthesized
atgcaagtaatcaaccatgatg

SEQ ID NO: 999660 - DNA, 22 bp, Artificial Sequence
  chemically synthesized
tatgcaagtaatcaaccatgat

SEQ ID NO: 999661 - DNA, 22 bp, Artificial Sequence
  chemically synthesized
atgagattcatcatggttgatt

SEQ ID NO: 999662 - DNA, 22 bp, Artificial Sequence
  chemically synthesized
atcatggttgattacttgcata

SEQ ID NO: 999663 - DNA, 22 bp, Artificial Sequence
  chemically synthesized
attacttgcataaagtctgaca

SEQ ID NO: 999664 - DNA, 22 bp, Artificial Sequence
  chemically synthesized
cttgcataaagtctgacatccc

SEQ ID NO: 999665 - DNA, 22 bp, Artificial Sequence
  chemically synthesized
gcataaagtctgacatccctgc

SEQ ID NO: 999666 - DNA, 22 bp, Artificial Sequence
  chemically synthesized
cataaagtctgacatccctgct

SEQ ID NO: 999667 - DNA, 22 bp, Artificial Sequence
  chemically synthesized
acatccctgctgggattatgtc

SEQ ID NO: 999668 - DNA, 22 bp, Artificial Sequence
  chemically synthesized
ctgggattatgtctgtcatgtt

SEQ ID NO: 999669 - DNA, 22 bp, Artificial Sequence
  chemically synthesized
agcatacagaagtgaacatgac

SEQ ID NO: 999670 - DNA, 22 bp, Artificial Sequence
  chemically synthesized
ggattatgtctgtcatgttcac

SEQ ID NO: 999671 - DNA, 22 bp, Artificial Sequence
  chemically synthesized
tgtctgtcatgttcacttctgt

SEQ ID NO: 999672 - DNA, 22 bp, Artificial Sequence
  chemically synthesized
gatgctgagcatacagaagtga

SEQ ID NO: 999673 - DNA, 22 bp, Artificial Sequence
  chemically synthesized
tcatgttcacttctgtatgctc

SEQ ID NO: 999674 - DNA, 22 bp, Artificial Sequence
  chemically synthesized
taactagatgctgagcatacag

SEQ ID NO: 999675 - DNA, 22 bp, Artificial Sequence
  chemically synthesized
attataactagatgctgagcat

SEQ ID NO: 999676 - DNA, 22 bp, Artificial Sequence
  chemically synthesized
ttaattataactagatgctgag

SEQ ID NO: 999677 - DNA, 22 bp, Artificial Sequence
  chemically synthesized
acttctgtatgctcagcatcta

SEQ ID NO: 999678 - DNA, 22 bp, Artificial Sequence
  chemically synthesized
ttattaattataactagatgct

SEQ ID NO: 999679 - DNA, 22 bp, Artificial Sequence
  chemically synthesized
ctgtatgctcagcatctagtta

SEQ ID NO: 999680 - DNA, 22 bp, Artificial Sequence
  chemically synthesized
tgtatgctcagcatctagttat

SEQ ID NO: 999681 - DNA, 22 bp, Artificial Sequence
  chemically synthesized
ttattattaattataactagat

SEQ ID NO: 999682 - DNA, 22 bp, Artificial Sequence
  chemically synthesized
tatgctcagcatctagttataa

SEQ ID NO: 999683 - DNA, 22 bp, Artificial Sequence
  chemically synthesized
gtattattattattaattataa

SEQ ID NO: 999684 - DNA, 22 bp, Artificial Sequence
  chemically synthesized
agcatctagttataattaataa

SEQ ID NO: 999685 - DNA, 22 bp, Artificial Sequence
  chemically synthesized
agtaattagtattattattatt

SEQ ID NO: 999686 - DNA, 22 bp, Artificial Sequence
  chemically synthesized
gttataattaataataataata

SEQ ID NO: 999687 - DNA, 22 bp, Artificial Sequence
  chemically synthesized
cctcagtaattagtattattat

SEQ ID NO: 999688 - DNA, 22 bp, Artificial Sequence
  chemically synthesized
taattaataataataatactaa

SEQ ID NO: 999689 - DNA, 22 bp, Artificial Sequence
  chemically synthesized
gctccctcagtaattagtatta

SEQ ID NO: 999690 - DNA, 22 bp, Artificial Sequence
  chemically synthesized
agctccctcagtaattagtatt

SEQ ID NO: 999691 - DNA, 22 bp, Artificial Sequence
  chemically synthesized
ataataataatactaattactg

SEQ ID NO: 999692 - DNA, 22 bp, Artificial Sequence
  chemically synthesized
attactgagggagctaaatact

SEQ ID NO: 999693 - DNA, 22 bp, Artificial Sequence
  chemically synthesized
atccaacaaataagtatttagc

SEQ ID NO: 999694 - DNA, 22 bp, Artificial Sequence
  chemically synthesized
ctgagggagctaaatacttatt

SEQ ID NO: 999695 - DNA, 22 bp, Artificial Sequence
  chemically synthesized
agggagctaaatacttatttgt

SEQ ID NO: 999696 - DNA, 22 bp, Artificial Sequence
  chemically synthesized
ccacaatcactcatccaacaaa

SEQ ID NO: 999697 - DNA, 22 bp, Artificial Sequence
  chemically synthesized
accacaatcactcatccaacaa

SEQ ID NO: 999698 - DNA, 22 bp, Artificial Sequence
  chemically synthesized
taccacaatcactcatccaaca

SEQ ID NO: 999699 - DNA, 22 bp, Artificial Sequence
  chemically synthesized
ttaccacaatcactcatccaac

SEQ ID NO: 999700 - DNA, 22 bp, Artificial Sequence
  chemically synthesized
aatacttatttgttggatgagt

SEQ ID NO: 999701 - DNA, 22 bp, Artificial Sequence
  chemically synthesized
atttttaccacaatcactcatc

SEQ ID NO: 999702 - DNA, 22 bp, Artificial Sequence
  chemically synthesized
catttttaccacaatcactcat

SEQ ID NO: 999703 - DNA, 22 bp, Artificial Sequence
  chemically synthesized
tcatttttaccacaatcactca

SEQ ID NO: 999704 - DNA, 22 bp, Artificial Sequence
  chemically synthesized
atttgttggatgagtgattgtg

SEQ ID NO: 999705 - DNA, 22 bp, Artificial Sequence
  chemically synthesized
tttgttggatgagtgattgtgg

SEQ ID NO: 999706 - DNA, 22 bp, Artificial Sequence
  chemically synthesized
attttcatttttaccacaatca

SEQ ID NO: 999707 - DNA, 22 bp, Artificial Sequence
  chemically synthesized
cattttcatttttaccacaatc

SEQ ID NO: 999708 - DNA, 22 bp, Artificial Sequence
  chemically synthesized
gttggatgagtgattgtggtaa

SEQ ID NO: 999709 - DNA, 22 bp, Artificial Sequence
  chemically synthesized
ttggatgagtgattgtggtaaa

SEQ ID NO: 999710 - DNA, 22 bp, Artificial Sequence
  chemically synthesized
gatgagtgattgtggtaaaaat

SEQ ID NO: 999711 - DNA, 22 bp, Artificial Sequence
  chemically synthesized
catcatttcattttcattttta

SEQ ID NO: 999712 - DNA, 22 bp, Artificial Sequence
  chemically synthesized
acatcatttcattttcattttt

SEQ ID NO: 999713 - DNA, 22 bp, Artificial Sequence
  chemically synthesized
tacatcatttcattttcatttt

SEQ ID NO: 999714 - DNA, 22 bp, Artificial Sequence
  chemically synthesized
ttttacatcatttcattttcat

SEQ ID NO: 999715 - DNA, 22 bp, Artificial Sequence
  chemically synthesized
tggtaaaaatgaaaatgaaatg

SEQ ID NO: 999716 - DNA, 22 bp, Artificial Sequence
  chemically synthesized
cactattttacatcatttcatt

SEQ ID NO: 999717 - DNA, 22 bp, Artificial Sequence
  chemically synthesized
tcattccactattttacatcat

SEQ ID NO: 999718 - DNA, 22 bp, Artificial Sequence
  chemically synthesized
atcattccactattttacatca

SEQ ID NO: 999719 - DNA, 22 bp, Artificial Sequence
  chemically synthesized
tatcattccactattttacatc

SEQ ID NO: 999720 - DNA, 22 bp, Artificial Sequence
  chemically synthesized
ttttatcattccactattttac

SEQ ID NO: 999721 - DNA, 22 bp, Artificial Sequence
  chemically synthesized
tgttttatcattccactatttt

SEQ ID NO: 999722 - DNA, 22 bp, Artificial Sequence
  chemically synthesized
aacactctgttttatcattcca

SEQ ID NO: 999723 - DNA, 22 bp, Artificial Sequence
  chemically synthesized
caacactctgttttatcattcc

SEQ ID NO: 999724 - DNA, 22 bp, Artificial Sequence
  chemically synthesized
tcaacactctgttttatcattc

SEQ ID NO: 999725 - DNA, 22 bp, Artificial Sequence
  chemically synthesized
atcaacattttcaacactctgt

SEQ ID NO: 999726 - DNA, 22 bp, Artificial Sequence
  chemically synthesized
tcatcaacattttcaacactct

SEQ ID NO: 999727 - DNA, 22 bp, Artificial Sequence
  chemically synthesized
gctctcatcaacattttcaaca

SEQ ID NO: 999728 - DNA, 22 bp, Artificial Sequence
  chemically synthesized
taatctggctctcatcaacatt

SEQ ID NO: 999729 - DNA, 22 bp, Artificial Sequence
  chemically synthesized
ataatctggctctcatcaacat

SEQ ID NO: 999730 - DNA, 22 bp, Artificial Sequence
  chemically synthesized
aaaatgttgatgagagccagat

SEQ ID NO: 999731 - DNA, 22 bp, Artificial Sequence
  chemically synthesized
aaagcatttataatctggctct

SEQ ID NO: 999732 - DNA, 22 bp, Artificial Sequence
  chemically synthesized
tcaaagcatttataatctggct

SEQ ID NO: 999733 - DNA, 22 bp, Artificial Sequence
  chemically synthesized
ctcaaagcatttataatctggc

SEQ ID NO: 999734 - DNA, 22 bp, Artificial Sequence
  chemically synthesized
atgagagccagattataaatgc

SEQ ID NO: 999735 - DNA, 22 bp, Artificial Sequence
  chemically synthesized
aaatatttctcaaagcatttat

SEQ ID NO: 999736 - DNA, 22 bp, Artificial Sequence
  chemically synthesized
tgaaatatttctcaaagcattt

SEQ ID NO: 999737 - DNA, 22 bp, Artificial Sequence
  chemically synthesized
taaatgctttgagaaatatttc

SEQ ID NO: 999738 - DNA, 22 bp, Artificial Sequence
  chemically synthesized
tcagcacagcctctgaaatatt

SEQ ID NO: 999739 - DNA, 22 bp, Artificial Sequence
  chemically synthesized
tgagaaatatttcagaggctgt

SEQ ID NO: 999740 - DNA, 22 bp, Artificial Sequence
  chemically synthesized
gagaaatatttcagaggctgtg

SEQ ID NO: 999741 - DNA, 22 bp, Artificial Sequence
  chemically synthesized
agaaatatttcagaggctgtgc

SEQ ID NO: 999742 - DNA, 22 bp, Artificial Sequence
  chemically synthesized
ccaaaatcctgtcagcacagcc

SEQ ID NO: 999743 - DNA, 22 bp, Artificial Sequence
  chemically synthesized
taccaaaatcctgtcagcacag

SEQ ID NO: 999744 - DNA, 22 bp, Artificial Sequence
  chemically synthesized
cagaggctgtgctgacaggatt

SEQ ID NO: 999745 - DNA, 22 bp, Artificial Sequence
  chemically synthesized
agaggctgtgctgacaggattt

SEQ ID NO: 999746 - DNA, 22 bp, Artificial Sequence
  chemically synthesized
cccaaatctctaccaaaatcct

SEQ ID NO: 999747 - DNA, 22 bp, Artificial Sequence
  chemically synthesized
ttgcccaaatctctaccaaaat

SEQ ID NO: 999748 - DNA, 22 bp, Artificial Sequence
  chemically synthesized
attgcccaaatctctaccaaaa

SEQ ID NO: 999749 - DNA, 22 bp, Artificial Sequence
  chemically synthesized
tgctgacaggattttggtagag

SEQ ID NO: 999750 - DNA, 22 bp, Artificial Sequence
  chemically synthesized
tattgcccaaatctctaccaaa

SEQ ID NO: 999751 - DNA, 22 bp, Artificial Sequence
  chemically synthesized
tttattgcccaaatctctacca

SEQ ID NO: 999752 - DNA, 22 bp, Artificial Sequence
  chemically synthesized
acaggattttggtagagatttg

SEQ ID NO: 999753 - DNA, 22 bp, Artificial Sequence
  chemically synthesized
gctctttattgcccaaatctct

SEQ ID NO: 999754 - DNA, 22 bp, Artificial Sequence
  chemically synthesized
tggctctttattgcccaaatct

SEQ ID NO: 999755 - DNA, 22 bp, Artificial Sequence
  chemically synthesized
tggtagagatttgggcaataaa

SEQ ID NO: 999756 - DNA, 22 bp, Artificial Sequence
  chemically synthesized
ggtagagatttgggcaataaag

SEQ ID NO: 999757 - DNA, 22 bp, Artificial Sequence
  chemically synthesized
tccattctggctctttattgcc

SEQ ID NO: 999758 - DNA, 22 bp, Artificial Sequence
  chemically synthesized
gtagagatttgggcaataaaga

SEQ ID NO: 999759 - DNA, 22 bp, Artificial Sequence
  chemically synthesized
gggcaataaagagccagaatgg

SEQ ID NO: 999760 - DNA, 22 bp, Artificial Sequence
  chemically synthesized
ggcaataaagagccagaatgga

SEQ ID NO: 999761 - DNA, 22 bp, Artificial Sequence
  chemically synthesized
tcatatatccctatccattctg

SEQ ID NO: 999762 - DNA, 22 bp, Artificial Sequence
  chemically synthesized
cagttatcatatatccctatcc

SEQ ID NO: 999763 - DNA, 22 bp, Artificial Sequence
  chemically synthesized
aaaaaccctgcagttatcatat

SEQ ID NO: 999764 - DNA, 22 bp, Artificial Sequence
  chemically synthesized
tgaaaaaccctgcagttatcat

SEQ ID NO: 999765 - DNA, 22 bp, Artificial Sequence
  chemically synthesized
tctgaaaaaccctgcagttatc

SEQ ID NO: 999766 - DNA, 22 bp, Artificial Sequence
  chemically synthesized
ctctgaaaaaccctgcagttat

SEQ ID NO: 999767 - DNA, 22 bp, Artificial Sequence
  chemically synthesized
tctctgaaaaaccctgcagtta

SEQ ID NO: 999768 - DNA, 22 bp, Artificial Sequence
  chemically synthesized
actttctctgaaaaaccctgca

SEQ ID NO: 999769 - DNA, 22 bp, Artificial Sequence
  chemically synthesized
taattcactttctctgaaaaac

SEQ ID NO: 999770 - DNA, 22 bp, Artificial Sequence
  chemically synthesized
ataattcactttctctgaaaaa

SEQ ID NO: 999771 - DNA, 22 bp, Artificial Sequence
  chemically synthesized
cagggtttttcagagaaagtga

SEQ ID NO: 999772 - DNA, 22 bp, Artificial Sequence
  chemically synthesized
atggatttataattcactttct

SEQ ID NO: 999773 - DNA, 22 bp, Artificial Sequence
  chemically synthesized
actgatggatttataattcact

SEQ ID NO: 999774 - DNA, 22 bp, Artificial Sequence
  chemically synthesized
ttcagagaaagtgaattataaa

SEQ ID NO: 999775 - DNA, 22 bp, Artificial Sequence
  chemically synthesized
tcagagaaagtgaattataaat

SEQ ID NO: 999776 - DNA, 22 bp, Artificial Sequence
  chemically synthesized
cagagaaagtgaattataaatc

SEQ ID NO: 999777 - DNA, 22 bp, Artificial Sequence
  chemically synthesized
tattgactgatggatttataat

SEQ ID NO: 999778 - DNA, 22 bp, Artificial Sequence
  chemically synthesized
agagaaagtgaattataaatcc

SEQ ID NO: 999779 - DNA, 22 bp, Artificial Sequence
  chemically synthesized
atattgactgatggatttataa

SEQ ID NO: 999780 - DNA, 22 bp, Artificial Sequence
  chemically synthesized
ttatattgactgatggatttat

SEQ ID NO: 999781 - DNA, 22 bp, Artificial Sequence
  chemically synthesized
cttatattgactgatggattta

SEQ ID NO: 999782 - DNA, 22 bp, Artificial Sequence
  chemically synthesized
catttcttatattgactgatgg

SEQ ID NO: 999783 - DNA, 22 bp, Artificial Sequence
  chemically synthesized
tgcatttcttatattgactgat

SEQ ID NO: 999784 - DNA, 22 bp, Artificial Sequence
  chemically synthesized
ctgcatttcttatattgactga

SEQ ID NO: 999785 - DNA, 22 bp, Artificial Sequence
  chemically synthesized
tctgcatttcttatattgactg

SEQ ID NO: 999786 - DNA, 22 bp, Artificial Sequence
  chemically synthesized
tttctgcatttcttatattgac

SEQ ID NO: 999787 - DNA, 22 bp, Artificial Sequence
  chemically synthesized
taaatccatcagtcaatataag

SEQ ID NO: 999788 - DNA, 22 bp, Artificial Sequence
  chemically synthesized
ctttctgcatttcttatattga

SEQ ID NO: 999789 - DNA, 22 bp, Artificial Sequence
  chemically synthesized
tctttctgcatttcttatattg

SEQ ID NO: 999790 - DNA, 22 bp, Artificial Sequence
  chemically synthesized
ttctttctgcatttcttatatt

SEQ ID NO: 999791 - DNA, 22 bp, Artificial Sequence
  chemically synthesized
tttttctttctgcatttcttat

SEQ ID NO: 999792 - DNA, 22 bp, Artificial Sequence
  chemically synthesized
acatccgcaacattgtttttct

SEQ ID NO: 999793 - DNA, 22 bp, Artificial Sequence
  chemically synthesized
taacatccgcaacattgttttt

SEQ ID NO: 999794 - DNA, 22 bp, Artificial Sequence
  chemically synthesized
ctaacatccgcaacattgtttt

SEQ ID NO: 999795 - DNA, 22 bp, Artificial Sequence
  chemically synthesized
tctaacatccgcaacattgttt

SEQ ID NO: 999796 - DNA, 22 bp, Artificial Sequence
  chemically synthesized
aatcctttctaacatccgcaac

SEQ ID NO: 999797 - DNA, 22 bp, Artificial Sequence
  chemically synthesized
tcaatcctttctaacatccgca

SEQ ID NO: 999798 - DNA, 22 bp, Artificial Sequence
  chemically synthesized
agaatctctcaatcctttctaa

SEQ ID NO: 999799 - DNA, 22 bp, Artificial Sequence
  chemically synthesized
cagaatctctcaatcctttcta

SEQ ID NO: 999800 - DNA, 22 bp, Artificial Sequence
  chemically synthesized
cggatgttagaaaggattgaga

SEQ ID NO: 999801 - DNA, 22 bp, Artificial Sequence
  chemically synthesized
gaaaggattgagagattctgaa

SEQ ID NO: 999802 - DNA, 22 bp, Artificial Sequence
  chemically synthesized
aacatcccatcacttcagaatc

SEQ ID NO: 999803 - DNA, 22 bp, Artificial Sequence
  chemically synthesized
ctgaacatcccatcacttcaga

SEQ ID NO: 999804 - DNA, 22 bp, Artificial Sequence
  chemically synthesized
cctgaacatcccatcacttcag

SEQ ID NO: 999805 - DNA, 22 bp, Artificial Sequence
  chemically synthesized
agagattctgaagtgatgggat

SEQ ID NO: 999806 - DNA, 22 bp, Artificial Sequence
  chemically synthesized
gatttcctgaacatcccatcac

SEQ ID NO: 999807 - DNA, 22 bp, Artificial Sequence
  chemically synthesized
cgatttcctgaacatcccatca

SEQ ID NO: 999808 - DNA, 22 bp, Artificial Sequence
  chemically synthesized
acttcgatttcctgaacatccc

SEQ ID NO: 999809 - DNA, 22 bp, Artificial Sequence
  chemically synthesized
aacttcgatttcctgaacatcc

SEQ ID NO: 999810 - DNA, 22 bp, Artificial Sequence
  chemically synthesized
tgaagtgatgggatgttcagga

SEQ ID NO: 999811 - DNA, 22 bp, Artificial Sequence
  chemically synthesized
aagtgatgggatgttcaggaaa

SEQ ID NO: 999812 - DNA, 22 bp, Artificial Sequence
  chemically synthesized
gatatcttaacttcgatttcct

SEQ ID NO: 999813 - DNA, 22 bp, Artificial Sequence
  chemically synthesized
ctagatatcttaacttcgattt

SEQ ID NO: 999814 - DNA, 22 bp, Artificial Sequence
  chemically synthesized
cctactagatatcttaacttcg

SEQ ID NO: 999815 - DNA, 22 bp, Artificial Sequence
  chemically synthesized
gcctactagatatcttaacttc

SEQ ID NO: 999816 - DNA, 22 bp, Artificial Sequence
  chemically synthesized
cttgcctactagatatcttaac

SEQ ID NO: 999817 - DNA, 22 bp, Artificial Sequence
  chemically synthesized
aggaaatcgaagttaagatatc

SEQ ID NO: 999818 - DNA, 22 bp, Artificial Sequence
  chemically synthesized
tgcttgcctactagatatctta

SEQ ID NO: 999819 - DNA, 22 bp, Artificial Sequence
  chemically synthesized
ctgcttgcctactagatatctt

SEQ ID NO: 999820 - DNA, 22 bp, Artificial Sequence
  chemically synthesized
agatatctagtaggcaagcaga

SEQ ID NO: 999821 - DNA, 22 bp, Artificial Sequence
  chemically synthesized
gccataaggtaggtttctgctt

SEQ ID NO: 999822 - DNA, 22 bp, Artificial Sequence
  chemically synthesized
tggccataaggtaggtttctgc

SEQ ID NO: 999823 - DNA, 22 bp, Artificial Sequence
  chemically synthesized
gtaggcaagcagaaacctacct

SEQ ID NO: 999824 - DNA, 22 bp, Artificial Sequence
  chemically synthesized
ggtcagagaatgttctggccat

SEQ ID NO: 999825 - DNA, 22 bp, Artificial Sequence
  chemically synthesized
gggtcagagaatgttctggcca

SEQ ID NO: 999826 - DNA, 22 bp, Artificial Sequence
  chemically synthesized
tgggtcagagaatgttctggcc

SEQ ID NO: 999827 - DNA, 22 bp, Artificial Sequence
  chemically synthesized
ttgggtcagagaatgttctggc

SEQ ID NO: 999828 - DNA, 22 bp, Artificial Sequence
  chemically synthesized
ccttatggccagaacattctct

SEQ ID NO: 999829 - DNA, 22 bp, Artificial Sequence
  chemically synthesized
agacttttgggtcagagaatgt

SEQ ID NO: 999830 - DNA, 22 bp, Artificial Sequence
  chemically synthesized
gagacttttgggtcagagaatg

SEQ ID NO: 999831 - DNA, 22 bp, Artificial Sequence
  chemically synthesized
atggccagaacattctctgacc

SEQ ID NO: 999832 - DNA, 22 bp, Artificial Sequence
  chemically synthesized
tggccagaacattctctgaccc

SEQ ID NO: 999833 - DNA, 22 bp, Artificial Sequence
  chemically synthesized
tctgacccaaaagtctcaagac

SEQ ID NO: 999834 - DNA, 22 bp, Artificial Sequence
  chemically synthesized
tgacccaaaagtctcaagacca

SEQ ID NO: 999835 - DNA, 22 bp, Artificial Sequence
  chemically synthesized
acccaaaagtctcaagaccatt

SEQ ID NO: 999836 - DNA, 22 bp, Artificial Sequence
  chemically synthesized
taaaaaaaaaaaaaatggtctt

SEQ ID NO: 999837 - DNA, 22 bp, Artificial Sequence
  chemically synthesized
gttgtaaaaaaaaaaaaaatgg

SEQ ID NO: 999838 - DNA, 22 bp, Artificial Sequence
  chemically synthesized
acattagttgtaaaaaaaaaaa

SEQ ID NO: 999839 - DNA, 22 bp, Artificial Sequence
  chemically synthesized
aagaccatttttttttttttta

SEQ ID NO: 999840 - DNA, 22 bp, Artificial Sequence
  chemically synthesized
ttgacattagttgtaaaaaaaa

SEQ ID NO: 999841 - DNA, 22 bp, Artificial Sequence
  chemically synthesized
attgacattagttgtaaaaaaa

SEQ ID NO: 999842 - DNA, 22 bp, Artificial Sequence
  chemically synthesized
tttttttttttacaactaatgt

SEQ ID NO: 999843 - DNA, 22 bp, Artificial Sequence
  chemically synthesized
ttttttttttacaactaatgtc

SEQ ID NO: 999844 - DNA, 22 bp, Artificial Sequence
  chemically synthesized
tttttttttacaactaatgtca

SEQ ID NO: 999845 - DNA, 22 bp, Artificial Sequence
  chemically synthesized
ttttttttacaactaatgtcaa

SEQ ID NO: 999846 - DNA, 22 bp, Artificial Sequence
  chemically synthesized
tttttttacaactaatgtcaat

SEQ ID NO: 999847 - DNA, 22 bp, Artificial Sequence
  chemically synthesized
ttttttacaactaatgtcaata

SEQ ID NO: 999848 - DNA, 22 bp, Artificial Sequence
  chemically synthesized
tttttacaactaatgtcaataa

SEQ ID NO: 999849 - DNA, 22 bp, Artificial Sequence
  chemically synthesized
ttttacaactaatgtcaataaa

SEQ ID NO: 999850 - DNA, 22 bp, Artificial Sequence
  chemically synthesized
tttacaactaatgtcaataaac

SEQ ID NO: 999851 - DNA, 22 bp, Artificial Sequence
  chemically synthesized
ttacaactaatgtcaataaact

SEQ ID NO: 999852 - DNA, 22 bp, Artificial Sequence
  chemically synthesized
tacaactaatgtcaataaacta

SEQ ID NO: 999853 - DNA, 22 bp, Artificial Sequence
  chemically synthesized
acaactaatgtcaataaactac

SEQ ID NO: 999854 - DNA, 22 bp, Artificial Sequence
  chemically synthesized
caactaatgtcaataaactact

SEQ ID NO: 999855 - DNA, 22 bp, Artificial Sequence
  chemically synthesized
gtgtacatgaaaagtagtttat

SEQ ID NO: 999856 - DNA, 22 bp, Artificial Sequence
  chemically synthesized
tagtgtacatgaaaagtagttt

SEQ ID NO: 999857 - DNA, 22 bp, Artificial Sequence
  chemically synthesized
ctagtgtacatgaaaagtagtt

SEQ ID NO: 999858 - DNA, 22 bp, Artificial Sequence
  chemically synthesized
atgtcaataaactacttttcat

SEQ ID NO: 999859 - DNA, 22 bp, Artificial Sequence
  chemically synthesized
tcatttctagtgtacatgaaaa

SEQ ID NO: 999860 - DNA, 22 bp, Artificial Sequence
  chemically synthesized
acactatcatttctagtgtaca

SEQ ID NO: 999861 - DNA, 22 bp, Artificial Sequence
  chemically synthesized
cacactatcatttctagtgtac

SEQ ID NO: 999862 - DNA, 22 bp, Artificial Sequence
  chemically synthesized
cttttcatgtacactagaaatg

SEQ ID NO: 999863 - DNA, 22 bp, Artificial Sequence
  chemically synthesized
ttcatgtacactagaaatgata

SEQ ID NO: 999864 - DNA, 22 bp, Artificial Sequence
  chemically synthesized
tcatgtacactagaaatgatag

SEQ ID NO: 999865 - DNA, 22 bp, Artificial Sequence
  chemically synthesized
atatatttcacactatcatttc

SEQ ID NO: 999866 - DNA, 22 bp, Artificial Sequence
  chemically synthesized
catgtacactagaaatgatagt

SEQ ID NO: 999867 - DNA, 22 bp, Artificial Sequence
  chemically synthesized
atgtacactagaaatgatagtg

SEQ ID NO: 999868 - DNA, 22 bp, Artificial Sequence
  chemically synthesized
attaatatatttcacactatca

SEQ ID NO: 999869 - DNA, 22 bp, Artificial Sequence
  chemically synthesized
acctcattaatatatttcacac

SEQ ID NO: 999870 - DNA, 22 bp, Artificial Sequence
  chemically synthesized
gaaatgatagtgtgaaatatat

SEQ ID NO: 999871 - DNA, 22 bp, Artificial Sequence
  chemically synthesized
acaatagttaacctcattaata

SEQ ID NO: 999872 - DNA, 22 bp, Artificial Sequence
  chemically synthesized
aacaatagttaacctcattaat

SEQ ID NO: 999873 - DNA, 22 bp, Artificial Sequence
  chemically synthesized
taacaatagttaacctcattaa

SEQ ID NO: 999874 - DNA, 22 bp, Artificial Sequence
  chemically synthesized
ttaacaatagttaacctcatta

SEQ ID NO: 999875 - DNA, 22 bp, Artificial Sequence
  chemically synthesized
atttttaacaatagttaacctc

SEQ ID NO: 999876 - DNA, 22 bp, Artificial Sequence
  chemically synthesized
tgatttttaacaatagttaacc

SEQ ID NO: 999877 - DNA, 22 bp, Artificial Sequence
  chemically synthesized
atgaggttaactattgttaaaa

SEQ ID NO: 999878 - DNA, 22 bp, Artificial Sequence
  chemically synthesized
ggaatgcatattctgattttta

SEQ ID NO: 999879 - DNA, 22 bp, Artificial Sequence
  chemically synthesized
actattgttaaaaatcagaata

SEQ ID NO: 999880 - DNA, 22 bp, Artificial Sequence
  chemically synthesized
ttgttaaaaatcagaatatgca

SEQ ID NO: 999881 - DNA, 22 bp, Artificial Sequence
  chemically synthesized
ttaaaaatcagaatatgcattc

SEQ ID NO: 999882 - DNA, 22 bp, Artificial Sequence
  chemically synthesized
caaacacatattaggaatgcat

SEQ ID NO: 999883 - DNA, 22 bp, Artificial Sequence
  chemically synthesized
aaaatcagaatatgcattccta

SEQ ID NO: 999884 - DNA, 22 bp, Artificial Sequence
  chemically synthesized
acaaacacatattaggaatgca

SEQ ID NO: 999885 - DNA, 22 bp, Artificial Sequence
  chemically synthesized
tacaaacacatattaggaatgc

SEQ ID NO: 999886 - DNA, 22 bp, Artificial Sequence
  chemically synthesized
ttttacaaacacatattaggaa

SEQ ID NO: 999887 - DNA, 22 bp, Artificial Sequence
  chemically synthesized
attttacaaacacatattagga

SEQ ID NO: 999888 - DNA, 22 bp, Artificial Sequence
  chemically synthesized
ctaatatgtgtttgtaaaataa

SEQ ID NO: 999889 - DNA, 22 bp, Artificial Sequence
  chemically synthesized
atatgtgtttgtaaaataaatt

SEQ ID NO: 999890 - DNA, 22 bp, Artificial Sequence
  chemically synthesized
aatatatacaataaaatttatt

SEQ ID NO: 999891 - DNA, 22 bp, Artificial Sequence
  chemically synthesized
aaatatatacaataaaatttat

SEQ ID NO: 999892 - DNA, 22 bp, Artificial Sequence
  chemically synthesized
gtaaaataaattttattgtata

SEQ ID NO: 999893 - DNA, 22 bp, Artificial Sequence
  chemically synthesized
taaaataaattttattgtatat

SEQ ID NO: 999894 - DNA, 22 bp, Artificial Sequence
  chemically synthesized
tgtggtatcccttaaatatata

SEQ ID NO: 999895 - DNA, 22 bp, Artificial Sequence
  chemically synthesized
tattgtatatatttaagggata

SEQ ID NO: 999896 - DNA, 22 bp, Artificial Sequence
  chemically synthesized
attgtatatatttaagggatac

SEQ ID NO: 999897 - DNA, 22 bp, Artificial Sequence
  chemically synthesized
caccattatgtggtatccctta

SEQ ID NO: 999898 - DNA, 22 bp, Artificial Sequence
  chemically synthesized
ttgtatatatttaagggatacc

SEQ ID NO: 999899 - DNA, 22 bp, Artificial Sequence
  chemically synthesized
acaccattatgtggtatccctt

SEQ ID NO: 999900 - DNA, 22 bp, Artificial Sequence
  chemically synthesized
tatatatttaagggataccaca

SEQ ID NO: 999901 - DNA, 22 bp, Artificial Sequence
  chemically synthesized
tgcatcttacaccattatgtgg

SEQ ID NO: 999902 - DNA, 22 bp, Artificial Sequence
  chemically synthesized
aagggataccacataatggtgt

SEQ ID NO: 999903 - DNA, 22 bp, Artificial Sequence
  chemically synthesized
agggataccacataatggtgta

SEQ ID NO: 999904 - DNA, 22 bp, Artificial Sequence
  chemically synthesized
tatatataaatatctatgcatc

SEQ ID NO: 999905 - DNA, 22 bp, Artificial Sequence
  chemically synthesized
cactatatatataaatatctat

SEQ ID NO: 999906 - DNA, 22 bp, Artificial Sequence
  chemically synthesized
acactatatatataaatatcta

SEQ ID NO: 999907 - DNA, 22 bp, Artificial Sequence
  chemically synthesized
tacactatatatataaatatct

SEQ ID NO: 999908 - DNA, 22 bp, Artificial Sequence
  chemically synthesized
ttttacactatatatataaata

SEQ ID NO: 999909 - DNA, 22 bp, Artificial Sequence
  chemically synthesized
cacaatggtaactattttacac

SEQ ID NO: 999910 - DNA, 22 bp, Artificial Sequence
  chemically synthesized
tccacaatggtaactattttac

SEQ ID NO: 999911 - DNA, 22 bp, Artificial Sequence
  chemically synthesized
atatatatagtgtaaaatagtt

SEQ ID NO: 999912 - DNA, 22 bp, Artificial Sequence
  chemically synthesized
tatatatagtgtaaaatagtta

SEQ ID NO: 999913 - DNA, 22 bp, Artificial Sequence
  chemically synthesized
ccattgtggagaacattatcat

SEQ ID NO: 999914 - DNA, 22 bp, Artificial Sequence
  chemically synthesized
tgaaatgatagatatgataatg

SEQ ID NO: 999915 - DNA, 22 bp, Artificial Sequence
  chemically synthesized
tggagaacattatcatatctat

SEQ ID NO: 999916 - DNA, 22 bp, Artificial Sequence
  chemically synthesized
tcatatctatcatttcacagtt

SEQ ID NO: 999917 - DNA, 22 bp, Artificial Sequence
  chemically synthesized
ccacagagtgaaaaatgggtaa

SEQ ID NO: 999918 - DNA, 22 bp, Artificial Sequence
  chemically synthesized
tcatttcacagttacccatttt

SEQ ID NO: 999919 - DNA, 22 bp, Artificial Sequence
  chemically synthesized
gccacagagtgaaaaatgggta

SEQ ID NO: 999920 - DNA, 22 bp, Artificial Sequence
  chemically synthesized
ttgccacagagtgaaaaatggg

SEQ ID NO: 999921 - DNA, 22 bp, Artificial Sequence
  chemically synthesized
ttcttgccacagagtgaaaaat

SEQ ID NO: 999922 - DNA, 22 bp, Artificial Sequence
  chemically synthesized
cacagttacccatttttcactc

SEQ ID NO: 999923 - DNA, 22 bp, Artificial Sequence
  chemically synthesized
acagttacccatttttcactct

SEQ ID NO: 999924 - DNA, 22 bp, Artificial Sequence
  chemically synthesized
tagctgttcttgccacagagtg

SEQ ID NO: 999925 - DNA, 22 bp, Artificial Sequence
  chemically synthesized
cccatttttcactctgtggcaa

SEQ ID NO: 999926 - DNA, 22 bp, Artificial Sequence
  chemically synthesized
ttcactctgtggcaagaacagc

SEQ ID NO: 999927 - DNA, 22 bp, Artificial Sequence
  chemically synthesized
tcactctgtggcaagaacagct

SEQ ID NO: 999928 - DNA, 22 bp, Artificial Sequence
  chemically synthesized
cactctgtggcaagaacagcta

SEQ ID NO: 999929 - DNA, 22 bp, Artificial Sequence
  chemically synthesized
actctgtggcaagaacagctat

SEQ ID NO: 999930 - DNA, 22 bp, Artificial Sequence
  chemically synthesized
ataaatgaatagattatagctg

SEQ ID NO: 999931 - DNA, 22 bp, Artificial Sequence
  chemically synthesized
tgtggcaagaacagctataatc

SEQ ID NO: 999932 - DNA, 22 bp, Artificial Sequence
  chemically synthesized
gataaatgaatagattatagct

SEQ ID NO: 999933 - DNA, 22 bp, Artificial Sequence
  chemically synthesized
tgataaatgaatagattatagc

SEQ ID NO: 999934 - DNA, 22 bp, Artificial Sequence
  chemically synthesized
tggcaagaacagctataatcta

SEQ ID NO: 999935 - DNA, 22 bp, Artificial Sequence
  chemically synthesized
ttgataaatgaatagattatag

SEQ ID NO: 999936 - DNA, 22 bp, Artificial Sequence
  chemically synthesized
aagatttttgataaatgaatag

SEQ ID NO: 999937 - DNA, 22 bp, Artificial Sequence
  chemically synthesized
taatctattcatttatcaaaaa

SEQ ID NO: 999938 - DNA, 22 bp, Artificial Sequence
  chemically synthesized
ttcatttatcaaaaatcttgaa

SEQ ID NO: 999939 - DNA, 22 bp, Artificial Sequence
  chemically synthesized
ataatagtgtgtattcaagatt

SEQ ID NO: 999940 - DNA, 22 bp, Artificial Sequence
  chemically synthesized
atttatcaaaaatcttgaatac

SEQ ID NO: 999941 - DNA, 22 bp, Artificial Sequence
  chemically synthesized
atcaaaaatcttgaatacacac

SEQ ID NO: 999942 - DNA, 22 bp, Artificial Sequence
  chemically synthesized
cagttaataatagtgtgtattc

SEQ ID NO: 999943 - DNA, 22 bp, Artificial Sequence
  chemically synthesized
tcaaaaatcttgaatacacact

SEQ ID NO: 999944 - DNA, 22 bp, Artificial Sequence
  chemically synthesized
gaatacacactattattaactg

SEQ ID NO: 999945 - DNA, 22 bp, Artificial Sequence
  chemically synthesized
aatacacactattattaactgt

SEQ ID NO: 999946 - DNA, 22 bp, Artificial Sequence
  chemically synthesized
ttattaactgtagtcctcatga

SEQ ID NO: 999947 - DNA, 22 bp, Artificial Sequence
  chemically synthesized
ttaactgtagtcctcatgatgt

SEQ ID NO: 999948 - DNA, 22 bp, Artificial Sequence
  chemically synthesized
aaagatataatatacatcatga

SEQ ID NO: 999949 - DNA, 22 bp, Artificial Sequence
  chemically synthesized
actgtagtcctcatgatgtata

SEQ ID NO: 999950 - DNA, 22 bp, Artificial Sequence
  chemically synthesized
tagtcctcatgatgtatattat

SEQ ID NO: 999951 - DNA, 22 bp, Artificial Sequence
  chemically synthesized
atatattaaaagatataatata

SEQ ID NO: 999952 - DNA, 22 bp, Artificial Sequence
  chemically synthesized
atgatgtatattatatctttta

SEQ ID NO: 999953 - DNA, 22 bp, Artificial Sequence
  chemically synthesized
aaatatattaatatattaaaag

SEQ ID NO: 999954 - DNA, 22 bp, Artificial Sequence
  chemically synthesized
tatcttttaatatattaatata

SEQ ID NO: 999955 - DNA, 22 bp, Artificial Sequence
  chemically synthesized
ttaatatattaatatattttaa

SEQ ID NO: 999956 - DNA, 22 bp, Artificial Sequence
  chemically synthesized
taatatattaatatattttaat

SEQ ID NO: 999957 - DNA, 22 bp, Artificial Sequence
  chemically synthesized
aatatattaatatattttaatc

SEQ ID NO: 999958 - DNA, 22 bp, Artificial Sequence
  chemically synthesized
atatattaatatattttaatca

SEQ ID NO: 999959 - DNA, 22 bp, Artificial Sequence
  chemically synthesized
atatattttaatcatttgtatc

SEQ ID NO: 999960 - DNA, 22 bp, Artificial Sequence
  chemically synthesized
taatcatttgtatcctatgacc

SEQ ID NO: 999961 - DNA, 22 bp, Artificial Sequence
  chemically synthesized
aatcatttgtatcctatgacct

SEQ ID NO: 999962 - DNA, 22 bp, Artificial Sequence
  chemically synthesized
atcatttgtatcctatgaccta

SEQ ID NO: 999963 - DNA, 22 bp, Artificial Sequence
  chemically synthesized
tgaggaaatggggcaatgtagg

SEQ ID NO: 999964 - DNA, 22 bp, Artificial Sequence
  chemically synthesized
gtatcctatgacctacattgcc

SEQ ID NO: 999965 - DNA, 22 bp, Artificial Sequence
  chemically synthesized
tatcctatgacctacattgccc

SEQ ID NO: 999966 - DNA, 22 bp, Artificial Sequence
  chemically synthesized
tgacctacattgccccatttcc

SEQ ID NO: 999967 - DNA, 22 bp, Artificial Sequence
  chemically synthesized
cattgccccatttcctcacaac

SEQ ID NO: 999968 - DNA, 22 bp, Artificial Sequence
  chemically synthesized
ccagggtcagggtagttgtgag

SEQ ID NO: 999969 - DNA, 22 bp, Artificial Sequence
  chemically synthesized
ccccatttcctcacaactaccc

SEQ ID NO: 999970 - DNA, 22 bp, Artificial Sequence
  chemically synthesized
cctcacaactaccctgaccctg

SEQ ID NO: 999971 - DNA, 22 bp, Artificial Sequence
  chemically synthesized
aacagtggttaccagggtcagg

SEQ ID NO: 999972 - DNA, 22 bp, Artificial Sequence
  chemically synthesized
ctcacaactaccctgaccctgg

SEQ ID NO: 999973 - DNA, 22 bp, Artificial Sequence
  chemically synthesized
acaactaccctgaccctggtaa

SEQ ID NO: 999974 - DNA, 22 bp, Artificial Sequence
  chemically synthesized
ccctgaccctggtaaccactgt

SEQ ID NO: 999975 - DNA, 22 bp, Artificial Sequence
  chemically synthesized
accctggtaaccactgtttaat

SEQ ID NO: 999976 - DNA, 22 bp, Artificial Sequence
  chemically synthesized
gtaaccactgtttaattcacta

SEQ ID NO: 999977 - DNA, 22 bp, Artificial Sequence
  chemically synthesized
tttaattcactatctgtatata

SEQ ID NO: 999978 - DNA, 22 bp, Artificial Sequence
  chemically synthesized
aaaaaggtcaaatatatacaga

SEQ ID NO: 999979 - DNA, 22 bp, Artificial Sequence
  chemically synthesized
aaaaaaggtcaaatatatacag

SEQ ID NO: 999980 - DNA, 22 bp, Artificial Sequence
  chemically synthesized
taaaaaaggtcaaatatataca

SEQ ID NO: 999981 - DNA, 22 bp, Artificial Sequence
  chemically synthesized
aattcactatctgtatatattt

SEQ ID NO: 999982 - DNA, 22 bp, Artificial Sequence
  chemically synthesized
ttaaaaaaggtcaaatatatac

SEQ ID NO: 999983 - DNA, 22 bp, Artificial Sequence
  chemically synthesized
attcactatctgtatatatttg

SEQ ID NO: 999984 - DNA, 22 bp, Artificial Sequence
  chemically synthesized
tttaaaaaaggtcaaatatata

SEQ ID NO: 999985 - DNA, 22 bp, Artificial Sequence
  chemically synthesized
ttttaaaaaaggtcaaatatat

SEQ ID NO: 999986 - DNA, 22 bp, Artificial Sequence
  chemically synthesized
tttttaaaaaaggtcaaatata

SEQ ID NO: 999987 - DNA, 22 bp, Artificial Sequence
  chemically synthesized
actatctgtatatatttgacct

SEQ ID NO: 999988 - DNA, 22 bp, Artificial Sequence
  chemically synthesized
tctgtatatatttgaccttttt

SEQ ID NO: 999989 - DNA, 22 bp, Artificial Sequence
  chemically synthesized
tatatatttgaccttttttaaa

SEQ ID NO: 999990 - DNA, 22 bp, Artificial Sequence
  chemically synthesized
tatatggaatctttttttaaaa

SEQ ID NO: 999991 - DNA, 22 bp, Artificial Sequence
  chemically synthesized
atatatggaatctttttttaaa

SEQ ID NO: 999992 - DNA, 22 bp, Artificial Sequence
  chemically synthesized
acttatatatggaatctttttt

SEQ ID NO: 999993 - DNA, 22 bp, Artificial Sequence
  chemically synthesized
gaccttttttaaaaaaagattc

SEQ ID NO: 999994 - DNA, 22 bp, Artificial Sequence
  chemically synthesized
accttttttaaaaaaagattcc

SEQ ID NO: 999995 - DNA, 22 bp, Artificial Sequence
  chemically synthesized
ttttaaaaaaagattccatata

SEQ ID NO: 999996 - DNA, 22 bp, Artificial Sequence
  chemically synthesized
tttaaaaaaagattccatatat

SEQ ID NO: 999997 - DNA, 22 bp, Artificial Sequence
  chemically synthesized
ttaaaaaaagattccatatata

SEQ ID NO: 999998 - DNA, 22 bp, Artificial Sequence
  chemically synthesized
tatgatctcacttatatatgga

SEQ ID NO: 999999 - DNA, 22 bp, Artificial Sequence
  chemically synthesized
taaaaaaagattccatatataa

SEQ ID NO: 1000000 - DNA, 22 bp, Artificial Sequence
  chemically synthesized
aaaaaaagattccatatataag

SEQ ID NO: 1000001 - DNA, 22 bp, Artificial Sequence
  chemically synthesized
aaaaaagattccatatataagt

SEQ ID NO: 1000002 - DNA, 22 bp, Artificial Sequence
  chemically synthesized
catatataagtgagatcataca

SEQ ID NO: 1000003 - DNA, 22 bp, Artificial Sequence
  chemically synthesized
aatgaaataagccagaccaaga

SEQ ID NO: 1000004 - DNA, 22 bp, Artificial Sequence
  chemically synthesized
tgctaaatgaaataagccagac

SEQ ID NO: 1000005 - DNA, 22 bp, Artificial Sequence
  chemically synthesized
atgctaaatgaaataagccaga

SEQ ID NO: 1000006 - DNA, 22 bp, Artificial Sequence
  chemically synthesized
ttctttcttggtctggcttatt

SEQ ID NO: 1000007 - DNA, 22 bp, Artificial Sequence
  chemically synthesized
tctttcttggtctggcttattt

SEQ ID NO: 1000008 - DNA, 22 bp, Artificial Sequence
  chemically synthesized
ctttcttggtctggcttatttc

SEQ ID NO: 1000009 - DNA, 22 bp, Artificial Sequence
  chemically synthesized
tttcttggtctggcttatttca

SEQ ID NO: 1000010 - DNA, 22 bp, Artificial Sequence
  chemically synthesized
tcttggtctggcttatttcatt

SEQ ID NO: 1000011 - DNA, 22 bp, Artificial Sequence
  chemically synthesized
cttggtctggcttatttcattt

SEQ ID NO: 1000012 - DNA, 22 bp, Artificial Sequence
  chemically synthesized
ttggtctggcttatttcattta

SEQ ID NO: 1000013 - DNA, 22 bp, Artificial Sequence
  chemically synthesized
gaggaccttatgctaaatgaaa

SEQ ID NO: 1000014 - DNA, 22 bp, Artificial Sequence
  chemically synthesized
ggtctggcttatttcatttagc

SEQ ID NO: 1000015 - DNA, 22 bp, Artificial Sequence
  chemically synthesized
gtctggcttatttcatttagca

SEQ ID NO: 1000016 - DNA, 22 bp, Artificial Sequence
  chemically synthesized
gcttatttcatttagcataagg

SEQ ID NO: 1000017 - DNA, 22 bp, Artificial Sequence
  chemically synthesized
atttcatttagcataaggtcct

SEQ ID NO: 1000018 - DNA, 22 bp, Artificial Sequence
  chemically synthesized
tttcatttagcataaggtcctc

SEQ ID NO: 1000019 - DNA, 22 bp, Artificial Sequence
  chemically synthesized
catttagcataaggtcctccag

SEQ ID NO: 1000020 - DNA, 22 bp, Artificial Sequence
  chemically synthesized
atttagcataaggtcctccagg

SEQ ID NO: 1000021 - DNA, 22 bp, Artificial Sequence
  chemically synthesized
agcataaggtcctccaggtcca

SEQ ID NO: 1000022 - DNA, 22 bp, Artificial Sequence
  chemically synthesized
tcccaacatggatggacctgga

SEQ ID NO: 1000023 - DNA, 22 bp, Artificial Sequence
  chemically synthesized
gcataaggtcctccaggtccat

SEQ ID NO: 1000024 - DNA, 22 bp, Artificial Sequence
  chemically synthesized
gtcccaacatggatggacctgg

SEQ ID NO: 1000025 - DNA, 22 bp, Artificial Sequence
  chemically synthesized
tcatttgtcccaacatggatgg

SEQ ID NO: 1000026 - DNA, 22 bp, Artificial Sequence
  chemically synthesized
caggtccatccatgttgggaca

SEQ ID NO: 1000027 - DNA, 22 bp, Artificial Sequence
  chemically synthesized
aaaagaagaagatctgtcattt

SEQ ID NO: 1000028 - DNA, 22 bp, Artificial Sequence
  chemically synthesized
aaaaagaagaagatctgtcatt

SEQ ID NO: 1000029 - DNA, 22 bp, Artificial Sequence
  chemically synthesized
agccttaaaaagaagaagatct

SEQ ID NO: 1000030 - DNA, 22 bp, Artificial Sequence
  chemically synthesized
ggacaaatgacagatcttcttc

SEQ ID NO: 1000031 - DNA, 22 bp, Artificial Sequence
  chemically synthesized
cagccttaaaaagaagaagatc

SEQ ID NO: 1000032 - DNA, 22 bp, Artificial Sequence
  chemically synthesized
tcagccttaaaaagaagaagat

SEQ ID NO: 1000033 - DNA, 22 bp, Artificial Sequence
  chemically synthesized
ttcagccttaaaaagaagaaga

SEQ ID NO: 1000034 - DNA, 22 bp, Artificial Sequence
  chemically synthesized
gaatatttttcagccttaaaaa

SEQ ID NO: 1000035 - DNA, 22 bp, Artificial Sequence
  chemically synthesized
cttctttttaaggctgaaaaat

SEQ ID NO: 1000036 - DNA, 22 bp, Artificial Sequence
  chemically synthesized
ttctttttaaggctgaaaaata

SEQ ID NO: 1000037 - DNA, 22 bp, Artificial Sequence
  chemically synthesized
ctttttaaggctgaaaaatatt

SEQ ID NO: 1000038 - DNA, 22 bp, Artificial Sequence
  chemically synthesized
tttttaaggctgaaaaatattc

SEQ ID NO: 1000039 - DNA, 22 bp, Artificial Sequence
  chemically synthesized
tttaaggctgaaaaatattcca

SEQ ID NO: 1000040 - DNA, 22 bp, Artificial Sequence
  chemically synthesized
ttaaggctgaaaaatattccag

SEQ ID NO: 1000041 - DNA, 22 bp, Artificial Sequence
  chemically synthesized
taaggctgaaaaatattccagg

SEQ ID NO: 1000042 - DNA, 22 bp, Artificial Sequence
  chemically synthesized
aaggctgaaaaatattccaggg

SEQ ID NO: 1000043 - DNA, 22 bp, Artificial Sequence
  chemically synthesized
aggctgaaaaatattccagggg

SEQ ID NO: 1000044 - DNA, 22 bp, Artificial Sequence
  chemically synthesized
aaaaatattccagggggtgtgt

SEQ ID NO: 1000045 - DNA, 22 bp, Artificial Sequence
  chemically synthesized
cagggggtgtgtgtgtgtgtgt

SEQ ID NO: 1000046 - DNA, 22 bp, Artificial Sequence
  chemically synthesized
caaagaaatatggtccaagaat

SEQ ID NO: 1000047 - DNA, 22 bp, Artificial Sequence
  chemically synthesized
acaaagaaatatggtccaagaa

SEQ ID NO: 1000048 - DNA, 22 bp, Artificial Sequence
  chemically synthesized
ttggaccatatttctttgtaaa

SEQ ID NO: 1000049 - DNA, 22 bp, Artificial Sequence
  chemically synthesized
ggaccatatttctttgtaaact

SEQ ID NO: 1000050 - DNA, 22 bp, Artificial Sequence
  chemically synthesized
gaccatatttctttgtaaactg

SEQ ID NO: 1000051 - DNA, 22 bp, Artificial Sequence
  chemically synthesized
agaatatgtagaaaacagttta

SEQ ID NO: 1000052 - DNA, 22 bp, Artificial Sequence
  chemically synthesized
ctttgtaaactgttttctacat

SEQ ID NO: 1000053 - DNA, 22 bp, Artificial Sequence
  chemically synthesized
tttgtaaactgttttctacata

SEQ ID NO: 1000054 - DNA, 22 bp, Artificial Sequence
  chemically synthesized
tgtaaactgttttctacatatt

SEQ ID NO: 1000055 - DNA, 22 bp, Artificial Sequence
  chemically synthesized
gtaaactgttttctacatattc

SEQ ID NO: 1000056 - DNA, 22 bp, Artificial Sequence
  chemically synthesized
tggaagggctaagaatatgtag

SEQ ID NO: 1000057 - DNA, 22 bp, Artificial Sequence
  chemically synthesized
taaactgttttctacatattct

SEQ ID NO: 1000058 - DNA, 22 bp, Artificial Sequence
  chemically synthesized
tatggaagggctaagaatatgt

SEQ ID NO: 1000059 - DNA, 22 bp, Artificial Sequence
  chemically synthesized
ctatggaagggctaagaatatg

SEQ ID NO: 1000060 - DNA, 22 bp, Artificial Sequence
  chemically synthesized
ttttctacatattcttagccct

SEQ ID NO: 1000061 - DNA, 22 bp, Artificial Sequence
  chemically synthesized
gggtttctatggaagggctaag

SEQ ID NO: 1000062 - DNA, 22 bp, Artificial Sequence
  chemically synthesized
tctacatattcttagcccttcc

SEQ ID NO: 1000063 - DNA, 22 bp, Artificial Sequence
  chemically synthesized
ctacatattcttagcccttcca

SEQ ID NO: 1000064 - DNA, 22 bp, Artificial Sequence
  chemically synthesized
tacatattcttagcccttccat

SEQ ID NO: 1000065 - DNA, 22 bp, Artificial Sequence
  chemically synthesized
catattcttagcccttccatag

SEQ ID NO: 1000066 - DNA, 22 bp, Artificial Sequence
  chemically synthesized
ttagcccttccatagaaacccc

SEQ ID NO: 1000067 - DNA, 22 bp, Artificial Sequence
  chemically synthesized
agcccttccatagaaaccccag

SEQ ID NO: 1000068 - DNA, 22 bp, Artificial Sequence
  chemically synthesized
gcccttccatagaaaccccaga

SEQ ID NO: 1000069 - DNA, 22 bp, Artificial Sequence
  chemically synthesized
ccatagaaaccccagattctct

SEQ ID NO: 1000070 - DNA, 22 bp, Artificial Sequence
  chemically synthesized
catagaaaccccagattctctc

SEQ ID NO: 1000071 - DNA, 22 bp, Artificial Sequence
  chemically synthesized
tctctctctctctctctctctc

SEQ ID NO: 1000072 - DNA, 22 bp, Artificial Sequence
  chemically synthesized
tctctctctctctctctctctc

SEQ ID NO: 1000073 - DNA, 22 bp, Artificial Sequence
  chemically synthesized
tctctctctctctctctctctc

SEQ ID NO: 1000074 - DNA, 22 bp, Artificial Sequence
  chemically synthesized
tctctctctctctctctctctc

SEQ ID NO: 1000075 - DNA, 22 bp, Artificial Sequence
  chemically synthesized
tctctctctctctctctctctc

SEQ ID NO: 1000076 - DNA, 22 bp, Artificial Sequence
  chemically synthesized
tctctctctctctctctctctc

SEQ ID NO: 1000077 - DNA, 22 bp, Artificial Sequence
  chemically synthesized
tctctctctctctctctctctc

SEQ ID NO: 1000078 - DNA, 22 bp, Artificial Sequence
  chemically synthesized
tctctctctctctctctctctc

SEQ ID NO: 1000079 - DNA, 22 bp, Artificial Sequence
  chemically synthesized
tctctctctctctctctctctc

SEQ ID NO: 1000080 - DNA, 22 bp, Artificial Sequence
  chemically synthesized
tctctctctctctctctctctc

SEQ ID NO: 1000081 - DNA, 22 bp, Artificial Sequence
  chemically synthesized
tctctctctctctctctctccc

SEQ ID NO: 1000082 - DNA, 22 bp, Artificial Sequence
  chemically synthesized
tctctctctctctctctccctc

SEQ ID NO: 1000083 - DNA, 22 bp, Artificial Sequence
  chemically synthesized
tctctctctctctctccctctc

SEQ ID NO: 1000084 - DNA, 22 bp, Artificial Sequence
  chemically synthesized
tctctctctctctccctctcct

SEQ ID NO: 1000085 - DNA, 22 bp, Artificial Sequence
  chemically synthesized
tctctctctctccctctcctcc

SEQ ID NO: 1000086 - DNA, 22 bp, Artificial Sequence
  chemically synthesized
tctctctctccctctcctcctg

SEQ ID NO: 1000087 - DNA, 22 bp, Artificial Sequence
  chemically synthesized
tctctctccctctcctcctgct

SEQ ID NO: 1000088 - DNA, 22 bp, Artificial Sequence
  chemically synthesized
tctctccctctcctcctgctcc

SEQ ID NO: 1000089 - DNA, 22 bp, Artificial Sequence
  chemically synthesized
tctccctctcctcctgctcctc

SEQ ID NO: 1000090 - DNA, 22 bp, Artificial Sequence
  chemically synthesized
tccctctcctcctgctcctcct

SEQ ID NO: 1000091 - DNA, 22 bp, Artificial Sequence
  chemically synthesized
cctctcctcctgctcctcctcc

SEQ ID NO: 1000092 - DNA, 22 bp, Artificial Sequence
  chemically synthesized
tcctcctgctcctcctcctcct

SEQ ID NO: 1000093 - DNA, 22 bp, Artificial Sequence
  chemically synthesized
ctcctgctcctcctcctcctgc

SEQ ID NO: 1000094 - DNA, 22 bp, Artificial Sequence
  chemically synthesized
ctgctcctcctcctcctgccta

SEQ ID NO: 1000095 - DNA, 22 bp, Artificial Sequence
  chemically synthesized
ctcctcctcctcctgcctacat

SEQ ID NO: 1000096 - DNA, 22 bp, Artificial Sequence
  chemically synthesized
ctcctcctcctgcctacatctc

SEQ ID NO: 1000097 - DNA, 22 bp, Artificial Sequence
  chemically synthesized
ctcctcctgcctacatctctct

SEQ ID NO: 1000098 - DNA, 22 bp, Artificial Sequence
  chemically synthesized
agaggaagggagagagagatgt

SEQ ID NO: 1000099 - DNA, 22 bp, Artificial Sequence
  chemically synthesized
aagaggaagggagagagagatg

SEQ ID NO: 1000100 - DNA, 22 bp, Artificial Sequence
  chemically synthesized
taagaggaagggagagagagat

SEQ ID NO: 1000101 - DNA, 22 bp, Artificial Sequence
  chemically synthesized
ctcctgcctacatctctctctc

SEQ ID NO: 1000102 - DNA, 22 bp, Artificial Sequence
  chemically synthesized
ctttaagaggaagggagagaga

SEQ ID NO: 1000103 - DNA, 22 bp, Artificial Sequence
  chemically synthesized
ctgcctacatctctctctccct

SEQ ID NO: 1000104 - DNA, 22 bp, Artificial Sequence
  chemically synthesized
cctacatctctctctcccttcc

SEQ ID NO: 1000105 - DNA, 22 bp, Artificial Sequence
  chemically synthesized
gagttactttaagaggaaggga

SEQ ID NO: 1000106 - DNA, 22 bp, Artificial Sequence
  chemically synthesized
agagttactttaagaggaaggg

SEQ ID NO: 1000107 - DNA, 22 bp, Artificial Sequence
  chemically synthesized
catctctctctcccttcctctt

SEQ ID NO: 1000108 - DNA, 22 bp, Artificial Sequence
  chemically synthesized
tagagttactttaagaggaagg

SEQ ID NO: 1000109 - DNA, 22 bp, Artificial Sequence
  chemically synthesized
tattttagagttactttaagag

SEQ ID NO: 1000110 - DNA, 22 bp, Artificial Sequence
  chemically synthesized
tctctcccttcctcttaaagta

SEQ ID NO: 1000111 - DNA, 22 bp, Artificial Sequence
  chemically synthesized
tctcccttcctcttaaagtaac

SEQ ID NO: 1000112 - DNA, 22 bp, Artificial Sequence
  chemically synthesized
tcccttcctcttaaagtaactc

SEQ ID NO: 1000113 - DNA, 22 bp, Artificial Sequence
  chemically synthesized
aaattatattttagagttactt

SEQ ID NO: 1000114 - DNA, 22 bp, Artificial Sequence
  chemically synthesized
ccttcctcttaaagtaactcta

SEQ ID NO: 1000115 - DNA, 22 bp, Artificial Sequence
  chemically synthesized
aaaattatattttagagttact

SEQ ID NO: 1000116 - DNA, 22 bp, Artificial Sequence
  chemically synthesized
cctcttaaagtaactctaaaat

SEQ ID NO: 1000117 - DNA, 22 bp, Artificial Sequence
  chemically synthesized
ctcttaaagtaactctaaaata

SEQ ID NO: 1000118 - DNA, 22 bp, Artificial Sequence
  chemically synthesized
ttaaagtaactctaaaatataa

SEQ ID NO: 1000119 - DNA, 22 bp, Artificial Sequence
  chemically synthesized
aaagtaactctaaaatataatt

SEQ ID NO: 1000120 - DNA, 22 bp, Artificial Sequence
  chemically synthesized
aagtaactctaaaatataattt

SEQ ID NO: 1000121 - DNA, 22 bp, Artificial Sequence
  chemically synthesized
taaaatataattttaaatattc

SEQ ID NO: 1000122 - DNA, 22 bp, Artificial Sequence
  chemically synthesized
aaatataattttaaatattctt

SEQ ID NO: 1000123 - DNA, 22 bp, Artificial Sequence
  chemically synthesized
gcaccagacaaaataagaatat

SEQ ID NO: 1000124 - DNA, 22 bp, Artificial Sequence
  chemically synthesized
taaatattcttattttgtctgg

SEQ ID NO: 1000125 - DNA, 22 bp, Artificial Sequence
  chemically synthesized
aaatattcttattttgtctggt

SEQ ID NO: 1000126 - DNA, 22 bp, Artificial Sequence
  chemically synthesized
aatattcttattttgtctggtg

SEQ ID NO: 1000127 - DNA, 22 bp, Artificial Sequence
  chemically synthesized
gtgtccaaaacagtctggcacc

SEQ ID NO: 1000128 - DNA, 22 bp, Artificial Sequence
  chemically synthesized
ttattttgtctggtgccagact

SEQ ID NO: 1000129 - DNA, 22 bp, Artificial Sequence
  chemically synthesized
attttgtctggtgccagactgt

SEQ ID NO: 1000130 - DNA, 22 bp, Artificial Sequence
  chemically synthesized
ttttgtctggtgccagactgtt

SEQ ID NO: 1000131 - DNA, 22 bp, Artificial Sequence
  chemically synthesized
tggctagtgtccaaaacagtct

SEQ ID NO: 1000132 - DNA, 22 bp, Artificial Sequence
  chemically synthesized
tgtctggtgccagactgttttg

SEQ ID NO: 1000133 - DNA, 22 bp, Artificial Sequence
  chemically synthesized
atggctagtgtccaaaacagtc

SEQ ID NO: 1000134 - DNA, 22 bp, Artificial Sequence
  chemically synthesized
gtctggtgccagactgttttgg

SEQ ID NO: 1000135 - DNA, 22 bp, Artificial Sequence
  chemically synthesized
tatggctagtgtccaaaacagt

SEQ ID NO: 1000136 - DNA, 22 bp, Artificial Sequence
  chemically synthesized
tctggtgccagactgttttgga

SEQ ID NO: 1000137 - DNA, 22 bp, Artificial Sequence
  chemically synthesized
gtgccagactgttttggacact

SEQ ID NO: 1000138 - DNA, 22 bp, Artificial Sequence
  chemically synthesized
aaaatattttatggctagtgtc

SEQ ID NO: 1000139 - DNA, 22 bp, Artificial Sequence
  chemically synthesized
ttttggacactagccataaaat

SEQ ID NO: 1000140 - DNA, 22 bp, Artificial Sequence
  chemically synthesized
tggacactagccataaaatatt

SEQ ID NO: 1000141 - DNA, 22 bp, Artificial Sequence
  chemically synthesized
ggacactagccataaaatattt

SEQ ID NO: 1000142 - DNA, 22 bp, Artificial Sequence
  chemically synthesized
gacactagccataaaatatttt

SEQ ID NO: 1000143 - DNA, 22 bp, Artificial Sequence
  chemically synthesized
aatgaacacagctaaaaatatt

SEQ ID NO: 1000144 - DNA, 22 bp, Artificial Sequence
  chemically synthesized
aaatgaacacagctaaaaatat

SEQ ID NO: 1000145 - DNA, 22 bp, Artificial Sequence
  chemically synthesized
gccataaaatatttttagctgt

SEQ ID NO: 1000146 - DNA, 22 bp, Artificial Sequence
  chemically synthesized
tatggtagcttaaatgaacaca

SEQ ID NO: 1000147 - DNA, 22 bp, Artificial Sequence
  chemically synthesized
gtatggtagcttaaatgaacac

SEQ ID NO: 1000148 - DNA, 22 bp, Artificial Sequence
  chemically synthesized
gcttgtatggtagcttaaatga

SEQ ID NO: 1000149 - DNA, 22 bp, Artificial Sequence
  chemically synthesized
ttagctgtgttcatttaagcta

SEQ ID NO: 1000150 - DNA, 22 bp, Artificial Sequence
  chemically synthesized
tagctgtgttcatttaagctac

SEQ ID NO: 1000151 - DNA, 22 bp, Artificial Sequence
  chemically synthesized
agctgtgttcatttaagctacc

SEQ ID NO: 1000152 - DNA, 22 bp, Artificial Sequence
  chemically synthesized
gctgtgttcatttaagctacca

SEQ ID NO: 1000153 - DNA, 22 bp, Artificial Sequence
  chemically synthesized
tgttcatttaagctaccataca

SEQ ID NO: 1000154 - DNA, 22 bp, Artificial Sequence
  chemically synthesized
atttaagctaccatacaagcca

SEQ ID NO: 1000155 - DNA, 22 bp, Artificial Sequence
  chemically synthesized
tagatgtagcgcctggcttgta

SEQ ID NO: 1000156 - DNA, 22 bp, Artificial Sequence
  chemically synthesized
tgtagatgtagcgcctggcttg

SEQ ID NO: 1000157 - DNA, 22 bp, Artificial Sequence
  chemically synthesized
aagctaccatacaagccaggcg

SEQ ID NO: 1000158 - DNA, 22 bp, Artificial Sequence
  chemically synthesized
agctaccatacaagccaggcgc

SEQ ID NO: 1000159 - DNA, 22 bp, Artificial Sequence
  chemically synthesized
ccatacaagccaggcgctacat

SEQ ID NO: 1000160 - DNA, 22 bp, Artificial Sequence
  chemically synthesized
caaagtaaaaagaaaggtgttc

SEQ ID NO: 1000161 - DNA, 22 bp, Artificial Sequence
  chemically synthesized
acaaagtaaaaagaaaggtgtt

SEQ ID NO: 1000162 - DNA, 22 bp, Artificial Sequence
  chemically synthesized
catctacagaacacctttcttt

SEQ ID NO: 1000163 - DNA, 22 bp, Artificial Sequence
  chemically synthesized
cagaacacctttctttttactt

SEQ ID NO: 1000164 - DNA, 22 bp, Artificial Sequence
  chemically synthesized
taaaagaacttacaaagtaaaa

SEQ ID NO: 1000165 - DNA, 22 bp, Artificial Sequence
  chemically synthesized
tctttttactttgtaagttctt

SEQ ID NO: 1000166 - DNA, 22 bp, Artificial Sequence
  chemically synthesized
ctttttactttgtaagttcttt

SEQ ID NO: 1000167 - DNA, 22 bp, Artificial Sequence
  chemically synthesized
tttttactttgtaagttctttt

SEQ ID NO: 1000168 - DNA, 22 bp, Artificial Sequence
  chemically synthesized
tttactttgtaagttcttttat

SEQ ID NO: 1000169 - DNA, 22 bp, Artificial Sequence
  chemically synthesized
ttactttgtaagttcttttata

SEQ ID NO: 1000170 - DNA, 22 bp, Artificial Sequence
  chemically synthesized
tactttgtaagttcttttataa

SEQ ID NO: 1000171 - DNA, 22 bp, Artificial Sequence
  chemically synthesized
actttgtaagttcttttataat

SEQ ID NO: 1000172 - DNA, 22 bp, Artificial Sequence
  chemically synthesized
ctttgtaagttcttttataata

SEQ ID NO: 1000173 - DNA, 22 bp, Artificial Sequence
  chemically synthesized
atcaccacatccaatattataa

SEQ ID NO: 1000174 - DNA, 22 bp, Artificial Sequence
  chemically synthesized
tgtaagttcttttataatattg

SEQ ID NO: 1000175 - DNA, 22 bp, Artificial Sequence
  chemically synthesized
gtaagttcttttataatattgg

SEQ ID NO: 1000176 - DNA, 22 bp, Artificial Sequence
  chemically synthesized
taagttcttttataatattgga

SEQ ID NO: 1000177 - DNA, 22 bp, Artificial Sequence
  chemically synthesized
tctcatcaccacatccaatatt

SEQ ID NO: 1000178 - DNA, 22 bp, Artificial Sequence
  chemically synthesized
atctcatcaccacatccaatat

SEQ ID NO: 1000179 - DNA, 22 bp, Artificial Sequence
  chemically synthesized
tatctcatcaccacatccaata

SEQ ID NO: 1000180 - DNA, 22 bp, Artificial Sequence
  chemically synthesized
tttatctcatcaccacatccaa

SEQ ID NO: 1000181 - DNA, 22 bp, Artificial Sequence
  chemically synthesized
ctttatctcatcaccacatcca

SEQ ID NO: 1000182 - DNA, 22 bp, Artificial Sequence
  chemically synthesized
ttttataatattggatgtggtg

SEQ ID NO: 1000183 - DNA, 22 bp, Artificial Sequence
  chemically synthesized
tctttatctcatcaccacatcc

SEQ ID NO: 1000184 - DNA, 22 bp, Artificial Sequence
  chemically synthesized
ttctttatctcatcaccacatc

SEQ ID NO: 1000185 - DNA, 22 bp, Artificial Sequence
  chemically synthesized
ttataatattggatgtggtgat

SEQ ID NO: 1000186 - DNA, 22 bp, Artificial Sequence
  chemically synthesized
tataatattggatgtggtgatg

SEQ ID NO: 1000187 - DNA, 22 bp, Artificial Sequence
  chemically synthesized
ttttctttatctcatcaccaca

SEQ ID NO: 1000188 - DNA, 22 bp, Artificial Sequence
  chemically synthesized
ataatattggatgtggtgatga

SEQ ID NO: 1000189 - DNA, 22 bp, Artificial Sequence
  chemically synthesized
taatattggatgtggtgatgag

SEQ ID NO: 1000190 - DNA, 22 bp, Artificial Sequence
  chemically synthesized
actcttttctttatctcatcac

SEQ ID NO: 1000191 - DNA, 22 bp, Artificial Sequence
  chemically synthesized
gatgtggtgatgagataaagaa

SEQ ID NO: 1000192 - DNA, 22 bp, Artificial Sequence
  chemically synthesized
tacctcactcttttctttatct

SEQ ID NO: 1000193 - DNA, 22 bp, Artificial Sequence
  chemically synthesized
ggaagaccattatacctcactc

SEQ ID NO: 1000194 - DNA, 22 bp, Artificial Sequence
  chemically synthesized
atacctaggaagaccattatac

SEQ ID NO: 1000195 - DNA, 22 bp, Artificial Sequence
  chemically synthesized
tgatacctaggaagaccattat

SEQ ID NO: 1000196 - DNA, 22 bp, Artificial Sequence
  chemically synthesized
aaaaagaaaattctgataccta

SEQ ID NO: 1000197 - DNA, 22 bp, Artificial Sequence
  chemically synthesized
tcaaaaagaaaattctgatacc

SEQ ID NO: 1000198 - DNA, 22 bp, Artificial Sequence
  chemically synthesized
ctcaaaaagaaaattctgatac

SEQ ID NO: 1000199 - DNA, 22 bp, Artificial Sequence
  chemically synthesized
cctaggtatcagaattttcttt

SEQ ID NO: 1000200 - DNA, 22 bp, Artificial Sequence
  chemically synthesized
ctaggtatcagaattttctttt

SEQ ID NO: 1000201 - DNA, 22 bp, Artificial Sequence
  chemically synthesized
ggtatcagaattttctttttga

SEQ ID NO: 1000202 - DNA, 22 bp, Artificial Sequence
  chemically synthesized
aaggaagaaaaacagtttctca

SEQ ID NO: 1000203 - DNA, 22 bp, Artificial Sequence
  chemically synthesized
ctaaaggaagaaaaacagtttc

SEQ ID NO: 1000204 - DNA, 22 bp, Artificial Sequence
  chemically synthesized
tctttttgagaaactgtttttc

SEQ ID NO: 1000205 - DNA, 22 bp, Artificial Sequence
  chemically synthesized
ctttttgagaaactgtttttct

SEQ ID NO: 1000206 - DNA, 22 bp, Artificial Sequence
  chemically synthesized
gttactaaaggaagaaaaacag

SEQ ID NO: 1000207 - DNA, 22 bp, Artificial Sequence
  chemically synthesized
tttttgagaaactgtttttctt

SEQ ID NO: 1000208 - DNA, 22 bp, Artificial Sequence
  chemically synthesized
cgttactaaaggaagaaaaaca

SEQ ID NO: 1000209 - DNA, 22 bp, Artificial Sequence
  chemically synthesized
tcgttactaaaggaagaaaaac

SEQ ID NO: 1000210 - DNA, 22 bp, Artificial Sequence
  chemically synthesized
tttgagaaactgtttttcttcc

SEQ ID NO: 1000211 - DNA, 22 bp, Artificial Sequence
  chemically synthesized
ttgagaaactgtttttcttcct

SEQ ID NO: 1000212 - DNA, 22 bp, Artificial Sequence
  chemically synthesized
tgagaaactgtttttcttcctt

SEQ ID NO: 1000213 - DNA, 22 bp, Artificial Sequence
  chemically synthesized
ttttcgttactaaaggaagaaa

SEQ ID NO: 1000214 - DNA, 22 bp, Artificial Sequence
  chemically synthesized
gagaaactgtttttcttccttt

SEQ ID NO: 1000215 - DNA, 22 bp, Artificial Sequence
  chemically synthesized
gttttcgttactaaaggaagaa

SEQ ID NO: 1000216 - DNA, 22 bp, Artificial Sequence
  chemically synthesized
agaaactgtttttcttccttta

SEQ ID NO: 1000217 - DNA, 22 bp, Artificial Sequence
  chemically synthesized
ttgttttcgttactaaaggaag

SEQ ID NO: 1000218 - DNA, 22 bp, Artificial Sequence
  chemically synthesized
gctcttgttttcgttactaaag

SEQ ID NO: 1000219 - DNA, 22 bp, Artificial Sequence
  chemically synthesized
tttttcttcctttagtaacgaa

SEQ ID NO: 1000220 - DNA, 22 bp, Artificial Sequence
  chemically synthesized
tgttggctcttgttttcgttac

SEQ ID NO: 1000221 - DNA, 22 bp, Artificial Sequence
  chemically synthesized
ttcttcctttagtaacgaaaac

SEQ ID NO: 1000222 - DNA, 22 bp, Artificial Sequence
  chemically synthesized
tcttcctttagtaacgaaaaca

SEQ ID NO: 1000223 - DNA, 22 bp, Artificial Sequence
  chemically synthesized
cttcctttagtaacgaaaacaa

SEQ ID NO: 1000224 - DNA, 22 bp, Artificial Sequence
  chemically synthesized
ttcctttagtaacgaaaacaag

SEQ ID NO: 1000225 - DNA, 22 bp, Artificial Sequence
  chemically synthesized
cctttagtaacgaaaacaagag

SEQ ID NO: 1000226 - DNA, 22 bp, Artificial Sequence
  chemically synthesized
ctttagtaacgaaaacaagagc

SEQ ID NO: 1000227 - DNA, 22 bp, Artificial Sequence
  chemically synthesized
agatcattatgttggctcttgt

SEQ ID NO: 1000228 - DNA, 22 bp, Artificial Sequence
  chemically synthesized
tagtaacgaaaacaagagccaa

SEQ ID NO: 1000229 - DNA, 22 bp, Artificial Sequence
  chemically synthesized
agtaacgaaaacaagagccaac

SEQ ID NO: 1000230 - DNA, 22 bp, Artificial Sequence
  chemically synthesized
gtaacgaaaacaagagccaaca

SEQ ID NO: 1000231 - DNA, 22 bp, Artificial Sequence
  chemically synthesized
tcagaactcagatcattatgtt

SEQ ID NO: 1000232 - DNA, 22 bp, Artificial Sequence
  chemically synthesized
attatcagaactcagatcatta

SEQ ID NO: 1000233 - DNA, 22 bp, Artificial Sequence
  chemically synthesized
tgccaaaacacactcattatca

SEQ ID NO: 1000234 - DNA, 22 bp, Artificial Sequence
  chemically synthesized
gtgccaaaacacactcattatc

SEQ ID NO: 1000235 - DNA, 22 bp, Artificial Sequence
  chemically synthesized
agttctgataatgagtgtgttt

SEQ ID NO: 1000236 - DNA, 22 bp, Artificial Sequence
  chemically synthesized
tgataatgagtgtgttttggca

SEQ ID NO: 1000237 - DNA, 22 bp, Artificial Sequence
  chemically synthesized
atgtgacagtttgtgccaaaac

SEQ ID NO: 1000238 - DNA, 22 bp, Artificial Sequence
  chemically synthesized
ataatgagtgtgttttggcaca

SEQ ID NO: 1000239 - DNA, 22 bp, Artificial Sequence
  chemically synthesized
attcatgtgacagtttgtgcca

SEQ ID NO: 1000240 - DNA, 22 bp, Artificial Sequence
  chemically synthesized
gattcatgtgacagtttgtgcc

SEQ ID NO: 1000241 - DNA, 22 bp, Artificial Sequence
  chemically synthesized
tgattcatgtgacagtttgtgc

SEQ ID NO: 1000242 - DNA, 22 bp, Artificial Sequence
  chemically synthesized
cctttgattcatgtgacagttt

SEQ ID NO: 1000243 - DNA, 22 bp, Artificial Sequence
  chemically synthesized
tggcacaaactgtcacatgaat

SEQ ID NO: 1000244 - DNA, 22 bp, Artificial Sequence
  chemically synthesized
aagttacctttgattcatgtga

SEQ ID NO: 1000245 - DNA, 22 bp, Artificial Sequence
  chemically synthesized
ggcacaaactgtcacatgaatc

SEQ ID NO: 1000246 - DNA, 22 bp, Artificial Sequence
  chemically synthesized
gcacaaactgtcacatgaatca

SEQ ID NO: 1000247 - DNA, 22 bp, Artificial Sequence
  chemically synthesized
tacatgttcaagttacctttga

SEQ ID NO: 1000248 - DNA, 22 bp, Artificial Sequence
  chemically synthesized
atacatgttcaagttacctttg

SEQ ID NO: 1000249 - DNA, 22 bp, Artificial Sequence
  chemically synthesized
tcacatgaatcaaaggtaactt

SEQ ID NO: 1000250 - DNA, 22 bp, Artificial Sequence
  chemically synthesized
atttatacatgttcaagttacc

SEQ ID NO: 1000251 - DNA, 22 bp, Artificial Sequence
  chemically synthesized
tggaatgttaatttatacatgt

SEQ ID NO: 1000252 - DNA, 22 bp, Artificial Sequence
  chemically synthesized
gctgtggaatgttaatttatac

SEQ ID NO: 1000253 - DNA, 22 bp, Artificial Sequence
  chemically synthesized
tggctgtggaatgttaatttat

SEQ ID NO: 1000254 - DNA, 22 bp, Artificial Sequence
  chemically synthesized
ctggctgtggaatgttaattta

SEQ ID NO: 1000255 - DNA, 22 bp, Artificial Sequence
  chemically synthesized
tctggctgtggaatgttaattt

SEQ ID NO: 1000256 - DNA, 22 bp, Artificial Sequence
  chemically synthesized
gaacatgtataaattaacattc

SEQ ID NO: 1000257 - DNA, 22 bp, Artificial Sequence
  chemically synthesized
aacatgtataaattaacattcc

SEQ ID NO: 1000258 - DNA, 22 bp, Artificial Sequence
  chemically synthesized
aatattttctggctgtggaatg

SEQ ID NO: 1000259 - DNA, 22 bp, Artificial Sequence
  chemically synthesized
gtgaatctaaatattttctggc

SEQ ID NO: 1000260 - DNA, 22 bp, Artificial Sequence
  chemically synthesized
agtgaatctaaatattttctgg

SEQ ID NO: 1000261 - DNA, 22 bp, Artificial Sequence
  chemically synthesized
acattccacagccagaaaatat

SEQ ID NO: 1000262 - DNA, 22 bp, Artificial Sequence
  chemically synthesized
cacagccagaaaatatttagat

SEQ ID NO: 1000263 - DNA, 22 bp, Artificial Sequence
  chemically synthesized
gagtaacagatttagtgaatct

SEQ ID NO: 1000264 - DNA, 22 bp, Artificial Sequence
  chemically synthesized
agagtaacagatttagtgaatc

SEQ ID NO: 1000265 - DNA, 22 bp, Artificial Sequence
  chemically synthesized
cttagagtaacagatttagtga

SEQ ID NO: 1000266 - DNA, 22 bp, Artificial Sequence
  chemically synthesized
gcttagagtaacagatttagtg

SEQ ID NO: 1000267 - DNA, 22 bp, Artificial Sequence
  chemically synthesized
tgcttagagtaacagatttagt

SEQ ID NO: 1000268 - DNA, 22 bp, Artificial Sequence
  chemically synthesized
aattttgcttagagtaacagat

SEQ ID NO: 1000269 - DNA, 22 bp, Artificial Sequence
  chemically synthesized
agattcactaaatctgttactc

SEQ ID NO: 1000270 - DNA, 22 bp, Artificial Sequence
  chemically synthesized
gattcactaaatctgttactct

SEQ ID NO: 1000271 - DNA, 22 bp, Artificial Sequence
  chemically synthesized
ctgaattttgcttagagtaaca

SEQ ID NO: 1000272 - DNA, 22 bp, Artificial Sequence
  chemically synthesized
actaaatctgttactctaagca

SEQ ID NO: 1000273 - DNA, 22 bp, Artificial Sequence
  chemically synthesized
actcctgaattttgcttagagt

SEQ ID NO: 1000274 - DNA, 22 bp, Artificial Sequence
  chemically synthesized
aactcctgaattttgcttagag

SEQ ID NO: 1000275 - DNA, 22 bp, Artificial Sequence
  chemically synthesized
aatctgttactctaagcaaaat

SEQ ID NO: 1000276 - DNA, 22 bp, Artificial Sequence
  chemically synthesized
acttaactcctgaattttgctt

SEQ ID NO: 1000277 - DNA, 22 bp, Artificial Sequence
  chemically synthesized
ttactctaagcaaaattcagga

SEQ ID NO: 1000278 - DNA, 22 bp, Artificial Sequence
  chemically synthesized
tcattgacttaactcctgaatt

SEQ ID NO: 1000279 - DNA, 22 bp, Artificial Sequence
  chemically synthesized
ctctaagcaaaattcaggagtt

SEQ ID NO: 1000280 - DNA, 22 bp, Artificial Sequence
  chemically synthesized
taagcaaaattcaggagttaag

SEQ ID NO: 1000281 - DNA, 22 bp, Artificial Sequence
  chemically synthesized
agcaaaattcaggagttaagtc

SEQ ID NO: 1000282 - DNA, 22 bp, Artificial Sequence
  chemically synthesized
aggagttaagtcaatgatagat

SEQ ID NO: 1000283 - DNA, 22 bp, Artificial Sequence
  chemically synthesized
agtcaatgatagatggccattt

SEQ ID NO: 1000284 - DNA, 22 bp, Artificial Sequence
  chemically synthesized
agatccagacaccaaaatggcc

SEQ ID NO: 1000285 - DNA, 22 bp, Artificial Sequence
  chemically synthesized
ctaagatccagacaccaaaatg

SEQ ID NO: 1000286 - DNA, 22 bp, Artificial Sequence
  chemically synthesized
tcctaagatccagacaccaaaa

SEQ ID NO: 1000287 - DNA, 22 bp, Artificial Sequence
  chemically synthesized
ctcctaagatccagacaccaaa

SEQ ID NO: 1000288 - DNA, 22 bp, Artificial Sequence
  chemically synthesized
tctcctaagatccagacaccaa

SEQ ID NO: 1000289 - DNA, 22 bp, Artificial Sequence
  chemically synthesized
ttttctcctaagatccagacac

SEQ ID NO: 1000290 - DNA, 22 bp, Artificial Sequence
  chemically synthesized
tggtcctattttctcctaagat

SEQ ID NO: 1000291 - DNA, 22 bp, Artificial Sequence
  chemically synthesized
atggtcctattttctcctaaga

SEQ ID NO: 1000292 - DNA, 22 bp, Artificial Sequence
  chemically synthesized
tggtgtctggatcttaggagaa

SEQ ID NO: 1000293 - DNA, 22 bp, Artificial Sequence
  chemically synthesized
ggtgtctggatcttaggagaaa

SEQ ID NO: 1000294 - DNA, 22 bp, Artificial Sequence
  chemically synthesized
ttatggtcctattttctcctaa

SEQ ID NO: 1000295 - DNA, 22 bp, Artificial Sequence
  chemically synthesized
gtgtctggatcttaggagaaaa

SEQ ID NO: 1000296 - DNA, 22 bp, Artificial Sequence
  chemically synthesized
cttatggtcctattttctccta

SEQ ID NO: 1000297 - DNA, 22 bp, Artificial Sequence
  chemically synthesized
tttcttatggtcctattttctc

SEQ ID NO: 1000298 - DNA, 22 bp, Artificial Sequence
  chemically synthesized
atttcttatggtcctattttct

SEQ ID NO: 1000299 - DNA, 22 bp, Artificial Sequence
  chemically synthesized
gatcttaggagaaaataggacc

SEQ ID NO: 1000300 - DNA, 22 bp, Artificial Sequence
  chemically synthesized
aggagaaaataggaccataaga

SEQ ID NO: 1000301 - DNA, 22 bp, Artificial Sequence
  chemically synthesized
ggagaaaataggaccataagaa

SEQ ID NO: 1000302 - DNA, 22 bp, Artificial Sequence
  chemically synthesized
taaggacagtgtttatttctta

SEQ ID NO: 1000303 - DNA, 22 bp, Artificial Sequence
  chemically synthesized
gtaaggacagtgtttatttctt

SEQ ID NO: 1000304 - DNA, 22 bp, Artificial Sequence
  chemically synthesized
tgtaaggacagtgtttatttct

SEQ ID NO: 1000305 - DNA, 22 bp, Artificial Sequence
  chemically synthesized
tttgtaaggacagtgtttattt

SEQ ID NO: 1000306 - DNA, 22 bp, Artificial Sequence
  chemically synthesized
ctttgtaaggacagtgtttatt

SEQ ID NO: 1000307 - DNA, 22 bp, Artificial Sequence
  chemically synthesized
tttctttgtaaggacagtgttt

SEQ ID NO: 1000308 - DNA, 22 bp, Artificial Sequence
  chemically synthesized
atttctttgtaaggacagtgtt

SEQ ID NO: 1000309 - DNA, 22 bp, Artificial Sequence
  chemically synthesized
caggacaaaagtttatttcttt

SEQ ID NO: 1000310 - DNA, 22 bp, Artificial Sequence
  chemically synthesized
actccaggacaaaagtttattt

SEQ ID NO: 1000311 - DNA, 22 bp, Artificial Sequence
  chemically synthesized
tccttacaaagaaataaacttt

SEQ ID NO: 1000312 - DNA, 22 bp, Artificial Sequence
  chemically synthesized
aactccaggacaaaagtttatt

SEQ ID NO: 1000313 - DNA, 22 bp, Artificial Sequence
  chemically synthesized
acaaagaaataaacttttgtcc

SEQ ID NO: 1000314 - DNA, 22 bp, Artificial Sequence
  chemically synthesized
caaagaaataaacttttgtcct

SEQ ID NO: 1000315 - DNA, 22 bp, Artificial Sequence
  chemically synthesized
ccatttaactccaggacaaaag

SEQ ID NO: 1000316 - DNA, 22 bp, Artificial Sequence
  chemically synthesized
accatttaactccaggacaaaa

SEQ ID NO: 1000317 - DNA, 22 bp, Artificial Sequence
  chemically synthesized
taccatttaactccaggacaaa

SEQ ID NO: 1000318 - DNA, 22 bp, Artificial Sequence
  chemically synthesized
ttaccatttaactccaggacaa

SEQ ID NO: 1000319 - DNA, 22 bp, Artificial Sequence
  chemically synthesized
tttaccatttaactccaggaca

SEQ ID NO: 1000320 - DNA, 22 bp, Artificial Sequence
  chemically synthesized
ttgtcctggagttaaatggtaa

SEQ ID NO: 1000321 - DNA, 22 bp, Artificial Sequence
  chemically synthesized
tgtcctggagttaaatggtaaa

SEQ ID NO: 1000322 - DNA, 22 bp, Artificial Sequence
  chemically synthesized
gtcctggagttaaatggtaaaa

SEQ ID NO: 1000323 - DNA, 22 bp, Artificial Sequence
  chemically synthesized
agggggcgtcctttttaccatt

SEQ ID NO: 1000324 - DNA, 22 bp, Artificial Sequence
  chemically synthesized
tcctggagttaaatggtaaaaa

SEQ ID NO: 1000325 - DNA, 22 bp, Artificial Sequence
  chemically synthesized
ccctgagggggcgtccttttta

SEQ ID NO: 1000326 - DNA, 22 bp, Artificial Sequence
  chemically synthesized
gagttaaatggtaaaaaggacg

SEQ ID NO: 1000327 - DNA, 22 bp, Artificial Sequence
  chemically synthesized
aatggtaaaaaggacgccccct

SEQ ID NO: 1000328 - DNA, 22 bp, Artificial Sequence
  chemically synthesized
tcaaggtatgctcccctgaggg

SEQ ID NO: 1000329 - DNA, 22 bp, Artificial Sequence
  chemically synthesized
gatgatcaatattatcaaggta

SEQ ID NO: 1000330 - DNA, 22 bp, Artificial Sequence
  chemically synthesized
ggatgatcaatattatcaaggt

SEQ ID NO: 1000331 - DNA, 22 bp, Artificial Sequence
  chemically synthesized
aggggagcataccttgataata

SEQ ID NO: 1000332 - DNA, 22 bp, Artificial Sequence
  chemically synthesized
tttggatgatcaatattatcaa

SEQ ID NO: 1000333 - DNA, 22 bp, Artificial Sequence
  chemically synthesized
gataatattgatcatccaaata

SEQ ID NO: 1000334 - DNA, 22 bp, Artificial Sequence
  chemically synthesized
ataatattgatcatccaaatag

SEQ ID NO: 1000335 - DNA, 22 bp, Artificial Sequence
  chemically synthesized
atcatccaaataggatgatatg

SEQ ID NO: 1000336 - DNA, 22 bp, Artificial Sequence
  chemically synthesized
gatggggacacagccaaaccat

SEQ ID NO: 1000337 - DNA, 22 bp, Artificial Sequence
  chemically synthesized
ggatggggacacagccaaacca

SEQ ID NO: 1000338 - DNA, 22 bp, Artificial Sequence
  chemically synthesized
aagatgagatttggatggggac

SEQ ID NO: 1000339 - DNA, 22 bp, Artificial Sequence
  chemically synthesized
ggctgtgtccccatccaaatct

SEQ ID NO: 1000340 - DNA, 22 bp, Artificial Sequence
  chemically synthesized
caattcaagatgagatttggat

SEQ ID NO: 1000341 - DNA, 22 bp, Artificial Sequence
  chemically synthesized
gctgtgtccccatccaaatctc

SEQ ID NO: 1000342 - DNA, 22 bp, Artificial Sequence
  chemically synthesized
tgtccccatccaaatctcatct

SEQ ID NO: 1000343 - DNA, 22 bp, Artificial Sequence
  chemically synthesized
tgggagctacaattcaagatga

SEQ ID NO: 1000344 - DNA, 22 bp, Artificial Sequence
  chemically synthesized
atcttgaattgtagctcccata

SEQ ID NO: 1000345 - DNA, 22 bp, Artificial Sequence
  chemically synthesized
gaattgtagctcccataatccc

SEQ ID NO: 1000346 - DNA, 22 bp, Artificial Sequence
  chemically synthesized
ccatgacacatggggattatgg

SEQ ID NO: 1000347 - DNA, 22 bp, Artificial Sequence
  chemically synthesized
aattgtagctcccataatcccc

SEQ ID NO: 1000348 - DNA, 22 bp, Artificial Sequence
  chemically synthesized
tagctcccataatccccatgtg

SEQ ID NO: 1000349 - DNA, 22 bp, Artificial Sequence
  chemically synthesized
ccataatccccatgtgtcatgg

SEQ ID NO: 1000350 - DNA, 22 bp, Artificial Sequence
  chemically synthesized
ccaccaggtcactcccatgaca

SEQ ID NO: 1000351 - DNA, 22 bp, Artificial Sequence
  chemically synthesized
cctcccaccaggtcactcccat

SEQ ID NO: 1000352 - DNA, 22 bp, Artificial Sequence
  chemically synthesized
aattacctcccaccaggtcact

SEQ ID NO: 1000353 - DNA, 22 bp, Artificial Sequence
  chemically synthesized
gtgggaggtaattgaatcacgg

SEQ ID NO: 1000354 - DNA, 22 bp, Artificial Sequence
  chemically synthesized
agcacagaaccatccccgtgat

SEQ ID NO: 1000355 - DNA, 22 bp, Artificial Sequence
  chemically synthesized
cctcagcacagaaccatccccg

SEQ ID NO: 1000356 - DNA, 22 bp, Artificial Sequence
  chemically synthesized
gctccctcagcacagaaccatc

SEQ ID NO: 1000357 - DNA, 22 bp, Artificial Sequence
  chemically synthesized
agctccctcagcacagaaccat

SEQ ID NO: 1000358 - DNA, 22 bp, Artificial Sequence
  chemically synthesized
aatcacggggatggttctgtgc

SEQ ID NO: 1000359 - DNA, 22 bp, Artificial Sequence
  chemically synthesized
tgtgctgagggagctaaatact

SEQ ID NO: 1000360 - DNA, 22 bp, Artificial Sequence
  chemically synthesized
tgctgagggagctaaatacttg

SEQ ID NO: 1000361 - DNA, 22 bp, Artificial Sequence
  chemically synthesized
ccataaggacagcacaagtatt

SEQ ID NO: 1000362 - DNA, 22 bp, Artificial Sequence
  chemically synthesized
agggagctaaatacttgtgctg

SEQ ID NO: 1000363 - DNA, 22 bp, Artificial Sequence
  chemically synthesized
actgccataaggacagcacaag

SEQ ID NO: 1000364 - DNA, 22 bp, Artificial Sequence
  chemically synthesized
ttcactgccataaggacagcac

SEQ ID NO: 1000365 - DNA, 22 bp, Artificial Sequence
  chemically synthesized
attcactgccataaggacagca

SEQ ID NO: 1000366 - DNA, 22 bp, Artificial Sequence
  chemically synthesized
aatacttgtgctgtccttatgg

SEQ ID NO: 1000367 - DNA, 22 bp, Artificial Sequence
  chemically synthesized
agacttattcactgccataagg

SEQ ID NO: 1000368 - DNA, 22 bp, Artificial Sequence
  chemically synthesized
ctgagacttattcactgccata

SEQ ID NO: 1000369 - DNA, 22 bp, Artificial Sequence
  chemically synthesized
gtgctgtccttatggcagtgaa

SEQ ID NO: 1000370 - DNA, 22 bp, Artificial Sequence
  chemically synthesized
tgctgtccttatggcagtgaat

SEQ ID NO: 1000371 - DNA, 22 bp, Artificial Sequence
  chemically synthesized
tccttatggcagtgaataagtc

SEQ ID NO: 1000372 - DNA, 22 bp, Artificial Sequence
  chemically synthesized
atggcagtgaataagtctcagg

SEQ ID NO: 1000373 - DNA, 22 bp, Artificial Sequence
  chemically synthesized
tggcagtgaataagtctcagga

SEQ ID NO: 1000374 - DNA, 22 bp, Artificial Sequence
  chemically synthesized
taaaaccatcagatctcctgag

SEQ ID NO: 1000375 - DNA, 22 bp, Artificial Sequence
  chemically synthesized
ataaaaccatcagatctcctga

SEQ ID NO: 1000376 - DNA, 22 bp, Artificial Sequence
  chemically synthesized
tataaaaccatcagatctcctg

SEQ ID NO: 1000377 - DNA, 22 bp, Artificial Sequence
  chemically synthesized
ccctttataaaaccatcagatc

SEQ ID NO: 1000378 - DNA, 22 bp, Artificial Sequence
  chemically synthesized
aggagatctgatggttttataa

SEQ ID NO: 1000379 - DNA, 22 bp, Artificial Sequence
  chemically synthesized
atggttttataaagggcaattt

SEQ ID NO: 1000380 - DNA, 22 bp, Artificial Sequence
  chemically synthesized
tataaagggcaattttcctgca

SEQ ID NO: 1000381 - DNA, 22 bp, Artificial Sequence
  chemically synthesized
ataaagggcaattttcctgcac

SEQ ID NO: 1000382 - DNA, 22 bp, Artificial Sequence
  chemically synthesized
taaagggcaattttcctgcaca

SEQ ID NO: 1000383 - DNA, 22 bp, Artificial Sequence
  chemically synthesized
catggtggcaggcaagagcgtg

SEQ ID NO: 1000384 - DNA, 22 bp, Artificial Sequence
  chemically synthesized
acatggtggcaggcaagagcgt

SEQ ID NO: 1000385 - DNA, 22 bp, Artificial Sequence
  chemically synthesized
tcctgcacacgctcttgcctgc

SEQ ID NO: 1000386 - DNA, 22 bp, Artificial Sequence
  chemically synthesized
cctgcacacgctcttgcctgcc

SEQ ID NO: 1000387 - DNA, 22 bp, Artificial Sequence
  chemically synthesized
ctgcacacgctcttgcctgcca

SEQ ID NO: 1000388 - DNA, 22 bp, Artificial Sequence
  chemically synthesized
cacacgctcttgcctgccacca

SEQ ID NO: 1000389 - DNA, 22 bp, Artificial Sequence
  chemically synthesized
ttgcctgccaccatgtaagcca

SEQ ID NO: 1000390 - DNA, 22 bp, Artificial Sequence
  chemically synthesized
gcctgccaccatgtaagccatg

SEQ ID NO: 1000391 - DNA, 22 bp, Artificial Sequence
  chemically synthesized
cctgccaccatgtaagccatgc

SEQ ID NO: 1000392 - DNA, 22 bp, Artificial Sequence
  chemically synthesized
ccaccatgtaagccatgccttt

SEQ ID NO: 1000393 - DNA, 22 bp, Artificial Sequence
  chemically synthesized
acaatcatggtggaaggtgaag

SEQ ID NO: 1000394 - DNA, 22 bp, Artificial Sequence
  chemically synthesized
tgctaccccttcaccttccacc

SEQ ID NO: 1000395 - DNA, 22 bp, Artificial Sequence
  chemically synthesized
gctaccccttcaccttccacca

SEQ ID NO: 1000396 - DNA, 22 bp, Artificial Sequence
  chemically synthesized
ctaccccttcaccttccaccat

SEQ ID NO: 1000397 - DNA, 22 bp, Artificial Sequence
  chemically synthesized
ccccttcaccttccaccatgat

SEQ ID NO: 1000398 - DNA, 22 bp, Artificial Sequence
  chemically synthesized
gggaggcctcacaatcatggtg

SEQ ID NO: 1000399 - DNA, 22 bp, Artificial Sequence
  chemically synthesized
caccttccaccatgattgtgag

SEQ ID NO: 1000400 - DNA, 22 bp, Artificial Sequence
  chemically synthesized
accttccaccatgattgtgagg

SEQ ID NO: 1000401 - DNA, 22 bp, Artificial Sequence
  chemically synthesized
acatgactagggaggcctcaca

SEQ ID NO: 1000402 - DNA, 22 bp, Artificial Sequence
  chemically synthesized
ccaccatgattgtgaggcctcc

SEQ ID NO: 1000403 - DNA, 22 bp, Artificial Sequence
  chemically synthesized
caccatgattgtgaggcctccc

SEQ ID NO: 1000404 - DNA, 22 bp, Artificial Sequence
  chemically synthesized
acagtctcacatgactagggag

SEQ ID NO: 1000405 - DNA, 22 bp, Artificial Sequence
  chemically synthesized
tgaggcctccctagtcatgtga

SEQ ID NO: 1000406 - DNA, 22 bp, Artificial Sequence
  chemically synthesized
atggactcacagtctcacatga

SEQ ID NO: 1000407 - DNA, 22 bp, Artificial Sequence
  chemically synthesized
aatggactcacagtctcacatg

SEQ ID NO: 1000408 - DNA, 22 bp, Artificial Sequence
  chemically synthesized
cctagtcatgtgagactgtgag

SEQ ID NO: 1000409 - DNA, 22 bp, Artificial Sequence
  chemically synthesized
gtcatgtgagactgtgagtcca

SEQ ID NO: 1000410 - DNA, 22 bp, Artificial Sequence
  chemically synthesized
taagtaaaaagaggcttaatgg

SEQ ID NO: 1000411 - DNA, 22 bp, Artificial Sequence
  chemically synthesized
ataagtaaaaagaggcttaatg

SEQ ID NO: 1000412 - DNA, 22 bp, Artificial Sequence
  chemically synthesized
tgagtccattaagcctcttttt

SEQ ID NO: 1000413 - DNA, 22 bp, Artificial Sequence
  chemically synthesized
ggtaatttataagtaaaaagag

SEQ ID NO: 1000414 - DNA, 22 bp, Artificial Sequence
  chemically synthesized
agcctctttttacttataaatt

SEQ ID NO: 1000415 - DNA, 22 bp, Artificial Sequence
  chemically synthesized
tttttacttataaattacccag

SEQ ID NO: 1000416 - DNA, 22 bp, Artificial Sequence
  chemically synthesized
tttacttataaattacccagtc

SEQ ID NO: 1000417 - DNA, 22 bp, Artificial Sequence
  chemically synthesized
ttacttataaattacccagtct

SEQ ID NO: 1000418 - DNA, 22 bp, Artificial Sequence
  chemically synthesized
tacttataaattacccagtctt

SEQ ID NO: 1000419 - DNA, 22 bp, Artificial Sequence
  chemically synthesized
acttataaattacccagtcttg

SEQ ID NO: 1000420 - DNA, 22 bp, Artificial Sequence
  chemically synthesized
tgaagaaatacccaagactggg

SEQ ID NO: 1000421 - DNA, 22 bp, Artificial Sequence
  chemically synthesized
cttataaattacccagtcttgg

SEQ ID NO: 1000422 - DNA, 22 bp, Artificial Sequence
  chemically synthesized
ctatgaagaaatacccaagact

SEQ ID NO: 1000423 - DNA, 22 bp, Artificial Sequence
  chemically synthesized
ataaattacccagtcttgggta

SEQ ID NO: 1000424 - DNA, 22 bp, Artificial Sequence
  chemically synthesized
taaattacccagtcttgggtat

SEQ ID NO: 1000425 - DNA, 22 bp, Artificial Sequence
  chemically synthesized
ctgctatgaagaaatacccaag

SEQ ID NO: 1000426 - DNA, 22 bp, Artificial Sequence
  chemically synthesized
ctactgctatgaagaaataccc

SEQ ID NO: 1000427 - DNA, 22 bp, Artificial Sequence
  chemically synthesized
cctactgctatgaagaaatacc

SEQ ID NO: 1000428 - DNA, 22 bp, Artificial Sequence
  chemically synthesized
tcctactgctatgaagaaatac

SEQ ID NO: 1000429 - DNA, 22 bp, Artificial Sequence
  chemically synthesized
cccagtcttgggtatttcttca

SEQ ID NO: 1000430 - DNA, 22 bp, Artificial Sequence
  chemically synthesized
attttcctactgctatgaagaa

SEQ ID NO: 1000431 - DNA, 22 bp, Artificial Sequence
  chemically synthesized
gttcattttcctactgctatga

SEQ ID NO: 1000432 - DNA, 22 bp, Artificial Sequence
  chemically synthesized
gggtatttcttcatagcagtag

SEQ ID NO: 1000433 - DNA, 22 bp, Artificial Sequence
  chemically synthesized
ggtatttcttcatagcagtagg

SEQ ID NO: 1000434 - DNA, 22 bp, Artificial Sequence
  chemically synthesized
tgtattagttcattttcctact

SEQ ID NO: 1000435 - DNA, 22 bp, Artificial Sequence
  chemically synthesized
cttcatagcagtaggaaaatga

SEQ ID NO: 1000436 - DNA, 22 bp, Artificial Sequence
  chemically synthesized
ttcatagcagtaggaaaatgaa

SEQ ID NO: 1000437 - DNA, 22 bp, Artificial Sequence
  chemically synthesized
catagcagtaggaaaatgaact

SEQ ID NO: 1000438 - DNA, 22 bp, Artificial Sequence
  chemically synthesized
atagcagtaggaaaatgaacta

SEQ ID NO: 1000439 - DNA, 22 bp, Artificial Sequence
  chemically synthesized
aataatcctatgtattagttca

SEQ ID NO: 1000440 - DNA, 22 bp, Artificial Sequence
  chemically synthesized
tcaataatcctatgtattagtt

SEQ ID NO: 1000441 - DNA, 22 bp, Artificial Sequence
  chemically synthesized
ctcaataatcctatgtattagt

SEQ ID NO: 1000442 - DNA, 22 bp, Artificial Sequence
  chemically synthesized
atgtatatttctcaataatcct

SEQ ID NO: 1000443 - DNA, 22 bp, Artificial Sequence
  chemically synthesized
gatgtatatttctcaataatcc

SEQ ID NO: 1000444 - DNA, 22 bp, Artificial Sequence
  chemically synthesized
atacataggattattgagaaat

SEQ ID NO: 1000445 - DNA, 22 bp, Artificial Sequence
  chemically synthesized
tatttgatgtatatttctcaat

SEQ ID NO: 1000446 - DNA, 22 bp, Artificial Sequence
  chemically synthesized
atatttgatgtatatttctcaa

SEQ ID NO: 1000447 - DNA, 22 bp, Artificial Sequence
  chemically synthesized
tatatttgatgtatatttctca

SEQ ID NO: 1000448 - DNA, 22 bp, Artificial Sequence
  chemically synthesized
ttgagaaatatacatcaaatat

SEQ ID NO: 1000449 - DNA, 22 bp, Artificial Sequence
  chemically synthesized
aaaatcacattttatatttgat

SEQ ID NO: 1000450 - DNA, 22 bp, Artificial Sequence
  chemically synthesized
agaaatatacatcaaatataaa

SEQ ID NO: 1000451 - DNA, 22 bp, Artificial Sequence
  chemically synthesized
catcagacatcaatcgagaaaa

SEQ ID NO: 1000452 - DNA, 22 bp, Artificial Sequence
  chemically synthesized
ttaatgattttttctcgattga

SEQ ID NO: 1000453 - DNA, 22 bp, Artificial Sequence
  chemically synthesized
taatgattttttctcgattgat

SEQ ID NO: 1000454 - DNA, 22 bp, Artificial Sequence
  chemically synthesized
aatgattttttctcgattgatg

SEQ ID NO: 1000455 - DNA, 22 bp, Artificial Sequence
  chemically synthesized
gtctccatcagacatcaatcga

SEQ ID NO: 1000456 - DNA, 22 bp, Artificial Sequence
  chemically synthesized
atgattttttctcgattgatgt

SEQ ID NO: 1000457 - DNA, 22 bp, Artificial Sequence
  chemically synthesized
agtctccatcagacatcaatcg

SEQ ID NO: 1000458 - DNA, 22 bp, Artificial Sequence
  chemically synthesized
tttctcgattgatgtctgatgg

SEQ ID NO: 1000459 - DNA, 22 bp, Artificial Sequence
  chemically synthesized
agcacttagtctccatcagaca

SEQ ID NO: 1000460 - DNA, 22 bp, Artificial Sequence
  chemically synthesized
ttctcgattgatgtctgatgga

SEQ ID NO: 1000461 - DNA, 22 bp, Artificial Sequence
  chemically synthesized
tctcgattgatgtctgatggag

SEQ ID NO: 1000462 - DNA, 22 bp, Artificial Sequence
  chemically synthesized
ctcgattgatgtctgatggaga

SEQ ID NO: 1000463 - DNA, 22 bp, Artificial Sequence
  chemically synthesized
tcgattgatgtctgatggagac

SEQ ID NO: 1000464 - DNA, 22 bp, Artificial Sequence
  chemically synthesized
gattgatgtctgatggagacta

SEQ ID NO: 1000465 - DNA, 22 bp, Artificial Sequence
  chemically synthesized
atattaagcacttagtctccat

SEQ ID NO: 1000466 - DNA, 22 bp, Artificial Sequence
  chemically synthesized
catattaagcacttagtctcca

SEQ ID NO: 1000467 - DNA, 22 bp, Artificial Sequence
  chemically synthesized
tcatattaagcacttagtctcc

SEQ ID NO: 1000468 - DNA, 22 bp, Artificial Sequence
  chemically synthesized
atgtctgatggagactaagtgc

SEQ ID NO: 1000469 - DNA, 22 bp, Artificial Sequence
  chemically synthesized
ttttcatattaagcacttagtc

SEQ ID NO: 1000470 - DNA, 22 bp, Artificial Sequence
  chemically synthesized
tgttttcatattaagcacttag

SEQ ID NO: 1000471 - DNA, 22 bp, Artificial Sequence
  chemically synthesized
atggagactaagtgcttaatat

SEQ ID NO: 1000472 - DNA, 22 bp, Artificial Sequence
  chemically synthesized
agtgcttaatatgaaaacagaa

SEQ ID NO: 1000473 - DNA, 22 bp, Artificial Sequence
  chemically synthesized
aatatgaaaacagaactcatgg

SEQ ID NO: 1000474 - DNA, 22 bp, Artificial Sequence
  chemically synthesized
atatgaaaacagaactcatggt

SEQ ID NO: 1000475 - DNA, 22 bp, Artificial Sequence
  chemically synthesized
cgcagaagaaaacaccatgagt

SEQ ID NO: 1000476 - DNA, 22 bp, Artificial Sequence
  chemically synthesized
ccgcagaagaaaacaccatgag

SEQ ID NO: 1000477 - DNA, 22 bp, Artificial Sequence
  chemically synthesized
tccgcagaagaaaacaccatga

SEQ ID NO: 1000478 - DNA, 22 bp, Artificial Sequence
  chemically synthesized
ctttccgcagaagaaaacacca

SEQ ID NO: 1000479 - DNA, 22 bp, Artificial Sequence
  chemically synthesized
gctttccgcagaagaaaacacc

SEQ ID NO: 1000480 - DNA, 22 bp, Artificial Sequence
  chemically synthesized
acttgctttccgcagaagaaaa

SEQ ID NO: 1000481 - DNA, 22 bp, Artificial Sequence
  chemically synthesized
cactaacttgctttccgcagaa

SEQ ID NO: 1000482 - DNA, 22 bp, Artificial Sequence
  chemically synthesized
atggtgttttcttctgcggaaa

SEQ ID NO: 1000483 - DNA, 22 bp, Artificial Sequence
  chemically synthesized
gactacactaacttgctttccg

SEQ ID NO: 1000484 - DNA, 22 bp, Artificial Sequence
  chemically synthesized
tcttctgcggaaagcaagttag

SEQ ID NO: 1000485 - DNA, 22 bp, Artificial Sequence
  chemically synthesized
cttctgcggaaagcaagttagt

SEQ ID NO: 1000486 - DNA, 22 bp, Artificial Sequence
  chemically synthesized
ttctgcggaaagcaagttagtg

SEQ ID NO: 1000487 - DNA, 22 bp, Artificial Sequence
  chemically synthesized
caagcctggactacactaactt

SEQ ID NO: 1000488 - DNA, 22 bp, Artificial Sequence
  chemically synthesized
ctgcggaaagcaagttagtgta

SEQ ID NO: 1000489 - DNA, 22 bp, Artificial Sequence
  chemically synthesized
tgcggaaagcaagttagtgtag

SEQ ID NO: 1000490 - DNA, 22 bp, Artificial Sequence
  chemically synthesized
cggaaagcaagttagtgtagtc

SEQ ID NO: 1000491 - DNA, 22 bp, Artificial Sequence
  chemically synthesized
taccagcaagttacaagcctgg

SEQ ID NO: 1000492 - DNA, 22 bp, Artificial Sequence
  chemically synthesized
ataccagcaagttacaagcctg

SEQ ID NO: 1000493 - DNA, 22 bp, Artificial Sequence
  chemically synthesized
ttataccagcaagttacaagcc

SEQ ID NO: 1000494 - DNA, 22 bp, Artificial Sequence
  chemically synthesized
cttataccagcaagttacaagc

SEQ ID NO: 1000495 - DNA, 22 bp, Artificial Sequence
  chemically synthesized
gtgtagtccaggcttgtaactt

SEQ ID NO: 1000496 - DNA, 22 bp, Artificial Sequence
  chemically synthesized
tcttataccagcaagttacaag

SEQ ID NO: 1000497 - DNA, 22 bp, Artificial Sequence
  chemically synthesized
ttcttataccagcaagttacaa

SEQ ID NO: 1000498 - DNA, 22 bp, Artificial Sequence
  chemically synthesized
ggatcttttcttataccagcaa

SEQ ID NO: 1000499 - DNA, 22 bp, Artificial Sequence
  chemically synthesized
gtaacttgctggtataagaaaa

SEQ ID NO: 1000500 - DNA, 22 bp, Artificial Sequence
  chemically synthesized
taacttgctggtataagaaaag

SEQ ID NO: 1000501 - DNA, 22 bp, Artificial Sequence
  chemically synthesized
gaaagtctaggatcttttctta

SEQ ID NO: 1000502 - DNA, 22 bp, Artificial Sequence
  chemically synthesized
ggaaagtctaggatcttttctt

SEQ ID NO: 1000503 - DNA, 22 bp, Artificial Sequence
  chemically synthesized
tggaaagtctaggatcttttct

SEQ ID NO: 1000504 - DNA, 22 bp, Artificial Sequence
  chemically synthesized
gctggtataagaaaagatccta

SEQ ID NO: 1000505 - DNA, 22 bp, Artificial Sequence
  chemically synthesized
ctggtataagaaaagatcctag

SEQ ID NO: 1000506 - DNA, 22 bp, Artificial Sequence
  chemically synthesized
cctttggaaagtctaggatctt

SEQ ID NO: 1000507 - DNA, 22 bp, Artificial Sequence
  chemically synthesized
ccctttggaaagtctaggatct

SEQ ID NO: 1000508 - DNA, 22 bp, Artificial Sequence
  chemically synthesized
tccctttggaaagtctaggatc

SEQ ID NO: 1000509 - DNA, 22 bp, Artificial Sequence
  chemically synthesized
gtataagaaaagatcctagact

SEQ ID NO: 1000510 - DNA, 22 bp, Artificial Sequence
  chemically synthesized
ttccctttggaaagtctaggat

SEQ ID NO: 1000511 - DNA, 22 bp, Artificial Sequence
  chemically synthesized
tccatttttccctttggaaagt

SEQ ID NO: 1000512 - DNA, 22 bp, Artificial Sequence
  chemically synthesized
tgtccatttttccctttggaaa

SEQ ID NO: 1000513 - DNA, 22 bp, Artificial Sequence
  chemically synthesized
ctgtccatttttccctttggaa

SEQ ID NO: 1000514 - DNA, 22 bp, Artificial Sequence
  chemically synthesized
gactttccaaagggaaaaatgg

SEQ ID NO: 1000515 - DNA, 22 bp, Artificial Sequence
  chemically synthesized
cgatgtaaccttctgtccattt

SEQ ID NO: 1000516 - DNA, 22 bp, Artificial Sequence
  chemically synthesized
tccaaagggaaaaatggacaga

SEQ ID NO: 1000517 - DNA, 22 bp, Artificial Sequence
  chemically synthesized
ccaaagggaaaaatggacagaa

SEQ ID NO: 1000518 - DNA, 22 bp, Artificial Sequence
  chemically synthesized
caaagggaaaaatggacagaag

SEQ ID NO: 1000519 - DNA, 22 bp, Artificial Sequence
  chemically synthesized
accctacgatgtaaccttctgt

SEQ ID NO: 1000520 - DNA, 22 bp, Artificial Sequence
  chemically synthesized
ctgaccctacgatgtaaccttc

SEQ ID NO: 1000521 - DNA, 22 bp, Artificial Sequence
  chemically synthesized
agaaactgctgaccctacgatg

SEQ ID NO: 1000522 - DNA, 22 bp, Artificial Sequence
  chemically synthesized
catcgtagggtcagcagtttct

SEQ ID NO: 1000523 - DNA, 22 bp, Artificial Sequence
  chemically synthesized
taaccagatgaccacatctaag

SEQ ID NO: 1000524 - DNA, 22 bp, Artificial Sequence
  chemically synthesized
cttagatgtggtcatctggtta

SEQ ID NO: 1000525 - DNA, 22 bp, Artificial Sequence
  chemically synthesized
agagtaatactataaccagatg

SEQ ID NO: 1000526 - DNA, 22 bp, Artificial Sequence
  chemically synthesized
ttagatgtggtcatctggttat

SEQ ID NO: 1000527 - DNA, 22 bp, Artificial Sequence
  chemically synthesized
cagagtaatactataaccagat

SEQ ID NO: 1000528 - DNA, 22 bp, Artificial Sequence
  chemically synthesized
agatgtggtcatctggttatag

SEQ ID NO: 1000529 - DNA, 22 bp, Artificial Sequence
  chemically synthesized
gatgtggtcatctggttatagt

SEQ ID NO: 1000530 - DNA, 22 bp, Artificial Sequence
  chemically synthesized
gaaggaggtaatatttcagagt

SEQ ID NO: 1000531 - DNA, 22 bp, Artificial Sequence
  chemically synthesized
gttatagtattactctgaaata

SEQ ID NO: 1000532 - DNA, 22 bp, Artificial Sequence
  chemically synthesized
tagtattactctgaaatattac

SEQ ID NO: 1000533 - DNA, 22 bp, Artificial Sequence
  chemically synthesized
tcaaaaacctagaaggaggtaa

SEQ ID NO: 1000534 - DNA, 22 bp, Artificial Sequence
  chemically synthesized
ctctgaaatattacctccttct

SEQ ID NO: 1000535 - DNA, 22 bp, Artificial Sequence
  chemically synthesized
ctatcaaaaacctagaaggagg

SEQ ID NO: 1000536 - DNA, 22 bp, Artificial Sequence
  chemically synthesized
tgaaatattacctccttctagg

SEQ ID NO: 1000537 - DNA, 22 bp, Artificial Sequence
  chemically synthesized
aaatattacctccttctaggtt

SEQ ID NO: 1000538 - DNA, 22 bp, Artificial Sequence
  chemically synthesized
caatcccactcctatcaaaaac

SEQ ID NO: 1000539 - DNA, 22 bp, Artificial Sequence
  chemically synthesized
cctccttctaggtttttgatag

SEQ ID NO: 1000540 - DNA, 22 bp, Artificial Sequence
  chemically synthesized
tctgcaatcccactcctatcaa

SEQ ID NO: 1000541 - DNA, 22 bp, Artificial Sequence
  chemically synthesized
cttctaggtttttgataggagt

SEQ ID NO: 1000542 - DNA, 22 bp, Artificial Sequence
  chemically synthesized
ctaggtttttgataggagtggg

SEQ ID NO: 1000543 - DNA, 22 bp, Artificial Sequence
  chemically synthesized
taggtttttgataggagtggga

SEQ ID NO: 1000544 - DNA, 22 bp, Artificial Sequence
  chemically synthesized
aaattgtctgcaatcccactcc

SEQ ID NO: 1000545 - DNA, 22 bp, Artificial Sequence
  chemically synthesized
ggtttttgataggagtgggatt

SEQ ID NO: 1000546 - DNA, 22 bp, Artificial Sequence
  chemically synthesized
caaattgtctgcaatcccactc

SEQ ID NO: 1000547 - DNA, 22 bp, Artificial Sequence
  chemically synthesized
ttgataggagtgggattgcaga

SEQ ID NO: 1000548 - DNA, 22 bp, Artificial Sequence
  chemically synthesized
tgataggagtgggattgcagac

SEQ ID NO: 1000549 - DNA, 22 bp, Artificial Sequence
  chemically synthesized
gataggagtgggattgcagaca

SEQ ID NO: 1000550 - DNA, 22 bp, Artificial Sequence
  chemically synthesized
ataggagtgggattgcagacaa

SEQ ID NO: 1000551 - DNA, 22 bp, Artificial Sequence
  chemically synthesized
atcataaagtagagcttcaaat

SEQ ID NO: 1000552 - DNA, 22 bp, Artificial Sequence
  chemically synthesized
catcataaagtagagcttcaaa

SEQ ID NO: 1000553 - DNA, 22 bp, Artificial Sequence
  chemically synthesized
tcatcataaagtagagcttcaa

SEQ ID NO: 1000554 - DNA, 22 bp, Artificial Sequence
  chemically synthesized
cagacaatttgaagctctactt

SEQ ID NO: 1000555 - DNA, 22 bp, Artificial Sequence
  chemically synthesized
accaggctttcatcataaagta

SEQ ID NO: 1000556 - DNA, 22 bp, Artificial Sequence
  chemically synthesized
gaagctctactttatgatgaaa

SEQ ID NO: 1000557 - DNA, 22 bp, Artificial Sequence
  chemically synthesized
aagctctactttatgatgaaag

SEQ ID NO: 1000558 - DNA, 22 bp, Artificial Sequence
  chemically synthesized
gagctcaccaggctttcatcat

SEQ ID NO: 1000559 - DNA, 22 bp, Artificial Sequence
  chemically synthesized
aattagagctcaccaggctttc

SEQ ID NO: 1000560 - DNA, 22 bp, Artificial Sequence
  chemically synthesized
tactttatgatgaaagcctggt

SEQ ID NO: 1000561 - DNA, 22 bp, Artificial Sequence
  chemically synthesized
tcaattagagctcaccaggctt

SEQ ID NO: 1000562 - DNA, 22 bp, Artificial Sequence
  chemically synthesized
ctttatgatgaaagcctggtga

SEQ ID NO: 1000563 - DNA, 22 bp, Artificial Sequence
  chemically synthesized
ctcaattagagctcaccaggct

SEQ ID NO: 1000564 - DNA, 22 bp, Artificial Sequence
  chemically synthesized
tatgatgaaagcctggtgagct

SEQ ID NO: 1000565 - DNA, 22 bp, Artificial Sequence
  chemically synthesized
atgatgaaagcctggtgagctc

SEQ ID NO: 1000566 - DNA, 22 bp, Artificial Sequence
  chemically synthesized
tgatgaaagcctggtgagctct

SEQ ID NO: 1000567 - DNA, 22 bp, Artificial Sequence
  chemically synthesized
tatttctcaattagagctcacc

SEQ ID NO: 1000568 - DNA, 22 bp, Artificial Sequence
  chemically synthesized
gtgagctctaattgagaaatac

SEQ ID NO: 1000569 - DNA, 22 bp, Artificial Sequence
  chemically synthesized
gtatccaaaccaggtctgtatt

SEQ ID NO: 1000570 - DNA, 22 bp, Artificial Sequence
  chemically synthesized
agtatccaaaccaggtctgtat

SEQ ID NO: 1000571 - DNA, 22 bp, Artificial Sequence
  chemically synthesized
taattgagaaatacagacctgg

SEQ ID NO: 1000572 - DNA, 22 bp, Artificial Sequence
  chemically synthesized
attgagaaatacagacctggtt

SEQ ID NO: 1000573 - DNA, 22 bp, Artificial Sequence
  chemically synthesized
atttagtatccaaaccaggtct

SEQ ID NO: 1000574 - DNA, 22 bp, Artificial Sequence
  chemically synthesized
ctcatttagtatccaaaccagg

SEQ ID NO: 1000575 - DNA, 22 bp, Artificial Sequence
  chemically synthesized
agaaatacagacctggtttgga

SEQ ID NO: 1000576 - DNA, 22 bp, Artificial Sequence
  chemically synthesized
ataaacacctactcatttagta

SEQ ID NO: 1000577 - DNA, 22 bp, Artificial Sequence
  chemically synthesized
gtttggatactaaatgagtagg

SEQ ID NO: 1000578 - DNA, 22 bp, Artificial Sequence
  chemically synthesized
ggatactaaatgagtaggtgtt

SEQ ID NO: 1000579 - DNA, 22 bp, Artificial Sequence
  chemically synthesized
gatactaaatgagtaggtgttt

SEQ ID NO: 1000580 - DNA, 22 bp, Artificial Sequence
  chemically synthesized
acagtgtgttaataaacaccta

SEQ ID NO: 1000581 - DNA, 22 bp, Artificial Sequence
  chemically synthesized
ctaacagtgtgttaataaacac

SEQ ID NO: 1000582 - DNA, 22 bp, Artificial Sequence
  chemically synthesized
cctaacagtgtgttaataaaca

SEQ ID NO: 1000583 - DNA, 22 bp, Artificial Sequence
  chemically synthesized
tcctaacagtgtgttaataaac

SEQ ID NO: 1000584 - DNA, 22 bp, Artificial Sequence
  chemically synthesized
aatgagtaggtgtttattaaca

SEQ ID NO: 1000585 - DNA, 22 bp, Artificial Sequence
  chemically synthesized
aattttcctaacagtgtgttaa

SEQ ID NO: 1000586 - DNA, 22 bp, Artificial Sequence
  chemically synthesized
tcaattttcctaacagtgtgtt

SEQ ID NO: 1000587 - DNA, 22 bp, Artificial Sequence
  chemically synthesized
attaacacactgttaggaaaat

SEQ ID NO: 1000588 - DNA, 22 bp, Artificial Sequence
  chemically synthesized
ccagaattctcaattttcctaa

SEQ ID NO: 1000589 - DNA, 22 bp, Artificial Sequence
  chemically synthesized
ttaacacactgttaggaaaatt

SEQ ID NO: 1000590 - DNA, 22 bp, Artificial Sequence
  chemically synthesized
acacactgttaggaaaattgag

SEQ ID NO: 1000591 - DNA, 22 bp, Artificial Sequence
  chemically synthesized
aaacctgccagaattctcaatt

SEQ ID NO: 1000592 - DNA, 22 bp, Artificial Sequence
  chemically synthesized
ttaggaaaattgagaattctgg

SEQ ID NO: 1000593 - DNA, 22 bp, Artificial Sequence
  chemically synthesized
agcactaaaacctgccagaatt

SEQ ID NO: 1000594 - DNA, 22 bp, Artificial Sequence
  chemically synthesized
ggaaaattgagaattctggcag

SEQ ID NO: 1000595 - DNA, 22 bp, Artificial Sequence
  chemically synthesized
gagcactaaaacctgccagaat

SEQ ID NO: 1000596 - DNA, 22 bp, Artificial Sequence
  chemically synthesized
tgagcactaaaacctgccagaa

SEQ ID NO: 1000597 - DNA, 22 bp, Artificial Sequence
  chemically synthesized
ctttgagcactaaaacctgcca

SEQ ID NO: 1000598 - DNA, 22 bp, Artificial Sequence
  chemically synthesized
actttgagcactaaaacctgcc

SEQ ID NO: 1000599 - DNA, 22 bp, Artificial Sequence
  chemically synthesized
tactttgagcactaaaacctgc

SEQ ID NO: 1000600 - DNA, 22 bp, Artificial Sequence
  chemically synthesized
agaattctggcaggttttagtg

SEQ ID NO: 1000601 - DNA, 22 bp, Artificial Sequence
  chemically synthesized
tggcaggttttagtgctcaaag

SEQ ID NO: 1000602 - DNA, 22 bp, Artificial Sequence
  chemically synthesized
gcaggttttagtgctcaaagta

SEQ ID NO: 1000603 - DNA, 22 bp, Artificial Sequence
  chemically synthesized
taaatgggaaaggttttacttt

SEQ ID NO: 1000604 - DNA, 22 bp, Artificial Sequence
  chemically synthesized
tgtaaatgggaaaggttttact

SEQ ID NO: 1000605 - DNA, 22 bp, Artificial Sequence
  chemically synthesized
tagtgctcaaagtaaaaccttt

SEQ ID NO: 1000606 - DNA, 22 bp, Artificial Sequence
  chemically synthesized
tctgtaaatgggaaaggtttta

SEQ ID NO: 1000607 - DNA, 22 bp, Artificial Sequence
  chemically synthesized
agtgctcaaagtaaaacctttc

SEQ ID NO: 1000608 - DNA, 22 bp, Artificial Sequence
  chemically synthesized
gtgctcaaagtaaaacctttcc

SEQ ID NO: 1000609 - DNA, 22 bp, Artificial Sequence
  chemically synthesized
tctctgtaaatgggaaaggttt

SEQ ID NO: 1000610 - DNA, 22 bp, Artificial Sequence
  chemically synthesized
aaagtaaaacctttcccattta

SEQ ID NO: 1000611 - DNA, 22 bp, Artificial Sequence
  chemically synthesized
caagcccacctctctctgtaaa

SEQ ID NO: 1000612 - DNA, 22 bp, Artificial Sequence
  chemically synthesized
tccaagcccacctctctctgta

SEQ ID NO: 1000613 - DNA, 22 bp, Artificial Sequence
  chemically synthesized
tcccatttacagagagaggtgg

SEQ ID NO: 1000614 - DNA, 22 bp, Artificial Sequence
  chemically synthesized
cccatttacagagagaggtggg

SEQ ID NO: 1000615 - DNA, 22 bp, Artificial Sequence
  chemically synthesized
ccatttacagagagaggtgggc

SEQ ID NO: 1000616 - DNA, 22 bp, Artificial Sequence
  chemically synthesized
aagggtctctccaagcccacct

SEQ ID NO: 1000617 - DNA, 22 bp, Artificial Sequence
  chemically synthesized
tgaagggtctctccaagcccac

SEQ ID NO: 1000618 - DNA, 22 bp, Artificial Sequence
  chemically synthesized
acagagagaggtgggcttggag

SEQ ID NO: 1000619 - DNA, 22 bp, Artificial Sequence
  chemically synthesized
cagagagaggtgggcttggaga

SEQ ID NO: 1000620 - DNA, 22 bp, Artificial Sequence
  chemically synthesized
attctgaagggtctctccaagc

SEQ ID NO: 1000621 - DNA, 22 bp, Artificial Sequence
  chemically synthesized
ggagagacccttcagaatgagt

SEQ ID NO: 1000622 - DNA, 22 bp, Artificial Sequence
  chemically synthesized
aggaaggtcccaactcattctg

SEQ ID NO: 1000623 - DNA, 22 bp, Artificial Sequence
  chemically synthesized
gagagacccttcagaatgagtt

SEQ ID NO: 1000624 - DNA, 22 bp, Artificial Sequence
  chemically synthesized
caggaaggtcccaactcattct

SEQ ID NO: 1000625 - DNA, 22 bp, Artificial Sequence
  chemically synthesized
ttcaggaaggtcccaactcatt

SEQ ID NO: 1000626 - DNA, 22 bp, Artificial Sequence
  chemically synthesized
cttcaggaaggtcccaactcat

SEQ ID NO: 1000627 - DNA, 22 bp, Artificial Sequence
  chemically synthesized
cttcttcaggaaggtcccaact

SEQ ID NO: 1000628 - DNA, 22 bp, Artificial Sequence
  chemically synthesized
cagaatgagttgggaccttcct

SEQ ID NO: 1000629 - DNA, 22 bp, Artificial Sequence
  chemically synthesized
agaatgagttgggaccttcctg

SEQ ID NO: 1000630 - DNA, 22 bp, Artificial Sequence
  chemically synthesized
aacggatccagagctccttctt

SEQ ID NO: 1000631 - DNA, 22 bp, Artificial Sequence
  chemically synthesized
ggaccttcctgaagaaggagct

SEQ ID NO: 1000632 - DNA, 22 bp, Artificial Sequence
  chemically synthesized
gaacggatccagagctccttct

SEQ ID NO: 1000633 - DNA, 22 bp, Artificial Sequence
  chemically synthesized
cctgaagaaggagctctggatc

SEQ ID NO: 1000634 - DNA, 22 bp, Artificial Sequence
  chemically synthesized
ctgaagaaggagctctggatcc

SEQ ID NO: 1000635 - DNA, 22 bp, Artificial Sequence
  chemically synthesized
aagaaggagctctggatccgtt

SEQ ID NO: 1000636 - DNA, 22 bp, Artificial Sequence
  chemically synthesized
agaagtcacagtgatgcttgaa

SEQ ID NO: 1000637 - DNA, 22 bp, Artificial Sequence
  chemically synthesized
tcagaagtcacagtgatgcttg

SEQ ID NO: 1000638 - DNA, 22 bp, Artificial Sequence
  chemically synthesized
tggatccgttcaagcatcactg

SEQ ID NO: 1000639 - DNA, 22 bp, Artificial Sequence
  chemically synthesized
gatccgttcaagcatcactgtg

SEQ ID NO: 1000640 - DNA, 22 bp, Artificial Sequence
  chemically synthesized
aagcatcactgtgacttctgag

SEQ ID NO: 1000641 - DNA, 22 bp, Artificial Sequence
  chemically synthesized
atagagacgtgtctctcagaag

SEQ ID NO: 1000642 - DNA, 22 bp, Artificial Sequence
  chemically synthesized
tgacttctgagagacacgtctc

SEQ ID NO: 1000643 - DNA, 22 bp, Artificial Sequence
  chemically synthesized
ctgagagacacgtctctattag

SEQ ID NO: 1000644 - DNA, 22 bp, Artificial Sequence
  chemically synthesized
tgagagacacgtctctattagt

SEQ ID NO: 1000645 - DNA, 22 bp, Artificial Sequence
  chemically synthesized
agagacacgtctctattagtcc

SEQ ID NO: 1000646 - DNA, 22 bp, Artificial Sequence
  chemically synthesized
tagcagtatgaaaatggactaa

SEQ ID NO: 1000647 - DNA, 22 bp, Artificial Sequence
  chemically synthesized
atagcagtatgaaaatggacta

SEQ ID NO: 1000648 - DNA, 22 bp, Artificial Sequence
  chemically synthesized
tatagcagtatgaaaatggact

SEQ ID NO: 1000649 - DNA, 22 bp, Artificial Sequence
  chemically synthesized
tttatagcagtatgaaaatgga

SEQ ID NO: 1000650 - DNA, 22 bp, Artificial Sequence
  chemically synthesized
tattagtccattttcatactgc

SEQ ID NO: 1000651 - DNA, 22 bp, Artificial Sequence
  chemically synthesized
ttagtccattttcatactgcta

SEQ ID NO: 1000652 - DNA, 22 bp, Artificial Sequence
  chemically synthesized
aggcagttctttatagcagtat

SEQ ID NO: 1000653 - DNA, 22 bp, Artificial Sequence
  chemically synthesized
gtccattttcatactgctataa

SEQ ID NO: 1000654 - DNA, 22 bp, Artificial Sequence
  chemically synthesized
cccagtctcaggcagttcttta

SEQ ID NO: 1000655 - DNA, 22 bp, Artificial Sequence
  chemically synthesized
tcatactgctataaagaactgc

SEQ ID NO: 1000656 - DNA, 22 bp, Artificial Sequence
  chemically synthesized
catactgctataaagaactgcc

SEQ ID NO: 1000657 - DNA, 22 bp, Artificial Sequence
  chemically synthesized
atactgctataaagaactgcct

SEQ ID NO: 1000658 - DNA, 22 bp, Artificial Sequence
  chemically synthesized
taaattacccagtctcaggcag

SEQ ID NO: 1000659 - DNA, 22 bp, Artificial Sequence
  chemically synthesized
ataaattacccagtctcaggca

SEQ ID NO: 1000660 - DNA, 22 bp, Artificial Sequence
  chemically synthesized
ctataaagaactgcctgagact

SEQ ID NO: 1000661 - DNA, 22 bp, Artificial Sequence
  chemically synthesized
tataaattacccagtctcaggc

SEQ ID NO: 1000662 - DNA, 22 bp, Artificial Sequence
  chemically synthesized
ttataaattacccagtctcagg

SEQ ID NO: 1000663 - DNA, 22 bp, Artificial Sequence
  chemically synthesized
taaagaactgcctgagactggg

SEQ ID NO: 1000664 - DNA, 22 bp, Artificial Sequence
  chemically synthesized
ttttataaattacccagtctca

SEQ ID NO: 1000665 - DNA, 22 bp, Artificial Sequence
  chemically synthesized
cttttataaattacccagtctc

SEQ ID NO: 1000666 - DNA, 22 bp, Artificial Sequence
  chemically synthesized
tcttttataaattacccagtct

SEQ ID NO: 1000667 - DNA, 22 bp, Artificial Sequence
  chemically synthesized
tttcttttataaattacccagt

SEQ ID NO: 1000668 - DNA, 22 bp, Artificial Sequence
  chemically synthesized
cctgagactgggtaatttataa

SEQ ID NO: 1000669 - DNA, 22 bp, Artificial Sequence
  chemically synthesized
aacctctttcttttataaatta

SEQ ID NO: 1000670 - DNA, 22 bp, Artificial Sequence
  chemically synthesized
agactgggtaatttataaaaga

SEQ ID NO: 1000671 - DNA, 22 bp, Artificial Sequence
  chemically synthesized
ggtaatttataaaagaaagagg

SEQ ID NO: 1000672 - DNA, 22 bp, Artificial Sequence
  chemically synthesized
tgtgtcaattaaacctctttct

SEQ ID NO: 1000673 - DNA, 22 bp, Artificial Sequence
  chemically synthesized
aactgtgtgtcaattaaacctc

SEQ ID NO: 1000674 - DNA, 22 bp, Artificial Sequence
  chemically synthesized
ataaaagaaagaggtttaattg

SEQ ID NO: 1000675 - DNA, 22 bp, Artificial Sequence
  chemically synthesized
taaaagaaagaggtttaattga

SEQ ID NO: 1000676 - DNA, 22 bp, Artificial Sequence
  chemically synthesized
cccagccatgctgaactgtgtg

SEQ ID NO: 1000677 - DNA, 22 bp, Artificial Sequence
  chemically synthesized
aattgacacacagttcagcatg

SEQ ID NO: 1000678 - DNA, 22 bp, Artificial Sequence
  chemically synthesized
attgacacacagttcagcatgg

SEQ ID NO: 1000679 - DNA, 22 bp, Artificial Sequence
  chemically synthesized
aggcctccccagccatgctgaa

SEQ ID NO: 1000680 - DNA, 22 bp, Artificial Sequence
  chemically synthesized
ctgaggcctccccagccatgct

SEQ ID NO: 1000681 - DNA, 22 bp, Artificial Sequence
  chemically synthesized
acacacagttcagcatggctgg

SEQ ID NO: 1000682 - DNA, 22 bp, Artificial Sequence
  chemically synthesized
cctgaggcctccccagccatgc

SEQ ID NO: 1000683 - DNA, 22 bp, Artificial Sequence
  chemically synthesized
agcatggctggggaggcctcag

SEQ ID NO: 1000684 - DNA, 22 bp, Artificial Sequence
  chemically synthesized
tgccacgatggtaagtttcctg

SEQ ID NO: 1000685 - DNA, 22 bp, Artificial Sequence
  chemically synthesized
atgccacgatggtaagtttcct

SEQ ID NO: 1000686 - DNA, 22 bp, Artificial Sequence
  chemically synthesized
gggaggcctcaggaaacttacc

SEQ ID NO: 1000687 - DNA, 22 bp, Artificial Sequence
  chemically synthesized
accttatgccacgatggtaagt

SEQ ID NO: 1000688 - DNA, 22 bp, Artificial Sequence
  chemically synthesized
tcaccttatgccacgatggtaa

SEQ ID NO: 1000689 - DNA, 22 bp, Artificial Sequence
  chemically synthesized
ctcaccttatgccacgatggta

SEQ ID NO: 1000690 - DNA, 22 bp, Artificial Sequence
  chemically synthesized
cttctcaccttatgccacgatg

SEQ ID NO: 1000691 - DNA, 22 bp, Artificial Sequence
  chemically synthesized
aggaaacttaccatcgtggcat

SEQ ID NO: 1000692 - DNA, 22 bp, Artificial Sequence
  chemically synthesized
ctccttctcaccttatgccacg

SEQ ID NO: 1000693 - DNA, 22 bp, Artificial Sequence
  chemically synthesized
gctccttctcaccttatgccac

SEQ ID NO: 1000694 - DNA, 22 bp, Artificial Sequence
  chemically synthesized
accatcgtggcataaggtgaga

SEQ ID NO: 1000695 - DNA, 22 bp, Artificial Sequence
  chemically synthesized
ccatcgtggcataaggtgagaa

SEQ ID NO: 1000696 - DNA, 22 bp, Artificial Sequence
  chemically synthesized
tgaagaaggtggcttgctcctt

SEQ ID NO: 1000697 - DNA, 22 bp, Artificial Sequence
  chemically synthesized
ccacctgtgaagaaggtggctt

SEQ ID NO: 1000698 - DNA, 22 bp, Artificial Sequence
  chemically synthesized
ctgccacctgtgaagaaggtgg

SEQ ID NO: 1000699 - DNA, 22 bp, Artificial Sequence
  chemically synthesized
cctgccacctgtgaagaaggtg

SEQ ID NO: 1000700 - DNA, 22 bp, Artificial Sequence
  chemically synthesized
ttcctgccacctgtgaagaagg

SEQ ID NO: 1000701 - DNA, 22 bp, Artificial Sequence
  chemically synthesized
cttcctgccacctgtgaagaag

SEQ ID NO: 1000702 - DNA, 22 bp, Artificial Sequence
  chemically synthesized
ggcacttcttcctgccacctgt

SEQ ID NO: 1000703 - DNA, 22 bp, Artificial Sequence
  chemically synthesized
actgggcacttcttcctgccac

SEQ ID NO: 1000704 - DNA, 22 bp, Artificial Sequence
  chemically synthesized
cactgggcacttcttcctgcca

SEQ ID NO: 1000705 - DNA, 22 bp, Artificial Sequence
  chemically synthesized
cttcacaggtggcaggaagaag

SEQ ID NO: 1000706 - DNA, 22 bp, Artificial Sequence
  chemically synthesized
cttcactgggcacttcttcctg

SEQ ID NO: 1000707 - DNA, 22 bp, Artificial Sequence
  chemically synthesized
ttcacaggtggcaggaagaagt

SEQ ID NO: 1000708 - DNA, 22 bp, Artificial Sequence
  chemically synthesized
cacaggtggcaggaagaagtgc

SEQ ID NO: 1000709 - DNA, 22 bp, Artificial Sequence
  chemically synthesized
ctgcttcactgggcacttcttc

SEQ ID NO: 1000710 - DNA, 22 bp, Artificial Sequence
  chemically synthesized
acaggtggcaggaagaagtgcc

SEQ ID NO: 1000711 - DNA, 22 bp, Artificial Sequence
  chemically synthesized
cctgcttcactgggcacttctt

SEQ ID NO: 1000712 - DNA, 22 bp, Artificial Sequence
  chemically synthesized
ttcctgcttcactgggcacttc

SEQ ID NO: 1000713 - DNA, 22 bp, Artificial Sequence
  chemically synthesized
taaggggctcttcctgcttcac

SEQ ID NO: 1000714 - DNA, 22 bp, Artificial Sequence
  chemically synthesized
ataaggggctcttcctgcttca

SEQ ID NO: 1000715 - DNA, 22 bp, Artificial Sequence
  chemically synthesized
tataaggggctcttcctgcttc

SEQ ID NO: 1000716 - DNA, 22 bp, Artificial Sequence
  chemically synthesized
ttttataaggggctcttcctgc

SEQ ID NO: 1000717 - DNA, 22 bp, Artificial Sequence
  chemically synthesized
attgttttataaggggctcttc

SEQ ID NO: 1000718 - DNA, 22 bp, Artificial Sequence
  chemically synthesized
acaagatctgattgttttataa

SEQ ID NO: 1000719 - DNA, 22 bp, Artificial Sequence
  chemically synthesized
tcacaagatctgattgttttat

SEQ ID NO: 1000720 - DNA, 22 bp, Artificial Sequence
  chemically synthesized
ataaaacaatcagatcttgtga

SEQ ID NO: 1000721 - DNA, 22 bp, Artificial Sequence
  chemically synthesized
taaaacaatcagatcttgtgag

SEQ ID NO: 1000722 - DNA, 22 bp, Artificial Sequence
  chemically synthesized
atagtgagtgagttctcacaag

SEQ ID NO: 1000723 - DNA, 22 bp, Artificial Sequence
  chemically synthesized
ctgatagtgagtgagttctcac

SEQ ID NO: 1000724 - DNA, 22 bp, Artificial Sequence
  chemically synthesized
tcctgatagtgagtgagttctc

SEQ ID NO: 1000725 - DNA, 22 bp, Artificial Sequence
  chemically synthesized
ttctcctgatagtgagtgagtt

SEQ ID NO: 1000726 - DNA, 22 bp, Artificial Sequence
  chemically synthesized
gtgagaactcactcactatcag

SEQ ID NO: 1000727 - DNA, 22 bp, Artificial Sequence
  chemically synthesized
tgagaactcactcactatcagg

SEQ ID NO: 1000728 - DNA, 22 bp, Artificial Sequence
  chemically synthesized
ccatgctgttctcctgatagtg

SEQ ID NO: 1000729 - DNA, 22 bp, Artificial Sequence
  chemically synthesized
tcccatgctgttctcctgatag

SEQ ID NO: 1000730 - DNA, 22 bp, Artificial Sequence
  chemically synthesized
ctcccatgctgttctcctgata

SEQ ID NO: 1000731 - DNA, 22 bp, Artificial Sequence
  chemically synthesized
actcactatcaggagaacagca

SEQ ID NO: 1000732 - DNA, 22 bp, Artificial Sequence
  chemically synthesized
actatcaggagaacagcatggg

SEQ ID NO: 1000733 - DNA, 22 bp, Artificial Sequence
  chemically synthesized
tcaggagaacagcatgggagaa

SEQ ID NO: 1000734 - DNA, 22 bp, Artificial Sequence
  chemically synthesized
aatcatgggagcaatttctccc

SEQ ID NO: 1000735 - DNA, 22 bp, Artificial Sequence
  chemically synthesized
ctcccatgattcagttacctcc

SEQ ID NO: 1000736 - DNA, 22 bp, Artificial Sequence
  chemically synthesized
ccatgattcagttacctccacc

SEQ ID NO: 1000737 - DNA, 22 bp, Artificial Sequence
  chemically synthesized
agttacctccacctggtctctc

SEQ ID NO: 1000738 - DNA, 22 bp, Artificial Sequence
  chemically synthesized
cctccacctggtctctctccct

SEQ ID NO: 1000739 - DNA, 22 bp, Artificial Sequence
  chemically synthesized
cacctggtctctctcccttgac

SEQ ID NO: 1000740 - DNA, 22 bp, Artificial Sequence
  chemically synthesized
gtctctctcccttgacatgtgg

SEQ ID NO: 1000741 - DNA, 22 bp, Artificial Sequence
  chemically synthesized
taatccccacaatccccacatg

SEQ ID NO: 1000742 - DNA, 22 bp, Artificial Sequence
  chemically synthesized
tctcccttgacatgtggggatt

SEQ ID NO: 1000743 - DNA, 22 bp, Artificial Sequence
  chemically synthesized
tcccttgacatgtggggattgt

SEQ ID NO: 1000744 - DNA, 22 bp, Artificial Sequence
  chemically synthesized
aattgtaatccccacaatcccc

SEQ ID NO: 1000745 - DNA, 22 bp, Artificial Sequence
  chemically synthesized
ccttgacatgtggggattgtgg

SEQ ID NO: 1000746 - DNA, 22 bp, Artificial Sequence
  chemically synthesized
gaattgtaatccccacaatccc

SEQ ID NO: 1000747 - DNA, 22 bp, Artificial Sequence
  chemically synthesized
tgaattgtaatccccacaatcc

SEQ ID NO: 1000748 - DNA, 22 bp, Artificial Sequence
  chemically synthesized
gacatgtggggattgtggggat

SEQ ID NO: 1000749 - DNA, 22 bp, Artificial Sequence
  chemically synthesized
acatgtggggattgtggggatt

SEQ ID NO: 1000750 - DNA, 22 bp, Artificial Sequence
  chemically synthesized
attttgaattgtaatccccaca

SEQ ID NO: 1000751 - DNA, 22 bp, Artificial Sequence
  chemically synthesized
tggggattacaattcaaaatga

SEQ ID NO: 1000752 - DNA, 22 bp, Artificial Sequence
  chemically synthesized
tgtccccacccaaatctcattt

SEQ ID NO: 1000753 - DNA, 22 bp, Artificial Sequence
  chemically synthesized
gtgtccccacccaaatctcatt

SEQ ID NO: 1000754 - DNA, 22 bp, Artificial Sequence
  chemically synthesized
tgtgtccccacccaaatctcat

SEQ ID NO: 1000755 - DNA, 22 bp, Artificial Sequence
  chemically synthesized
caattcaaaatgagatttgggt

SEQ ID NO: 1000756 - DNA, 22 bp, Artificial Sequence
  chemically synthesized
gctttgtgtccccacccaaatc

SEQ ID NO: 1000757 - DNA, 22 bp, Artificial Sequence
  chemically synthesized
ggctttgtgtccccacccaaat

SEQ ID NO: 1000758 - DNA, 22 bp, Artificial Sequence
  chemically synthesized
aaaatgagatttgggtggggac

SEQ ID NO: 1000759 - DNA, 22 bp, Artificial Sequence
  chemically synthesized
tggtttggctttgtgtccccac

SEQ ID NO: 1000760 - DNA, 22 bp, Artificial Sequence
  chemically synthesized
gggtggggacacaaagccaaac

SEQ ID NO: 1000761 - DNA, 22 bp, Artificial Sequence
  chemically synthesized
atggatcctatggtttggcttt

SEQ ID NO: 1000762 - DNA, 22 bp, Artificial Sequence
  chemically synthesized
ggtggggacacaaagccaaacc

SEQ ID NO: 1000763 - DNA, 22 bp, Artificial Sequence
  chemically synthesized
gatggatcctatggtttggctt

SEQ ID NO: 1000764 - DNA, 22 bp, Artificial Sequence
  chemically synthesized
ggatttgatggatcctatggtt

SEQ ID NO: 1000765 - DNA, 22 bp, Artificial Sequence
  chemically synthesized
tggggatggagaaccatcatcc

SEQ ID NO: 1000766 - DNA, 22 bp, Artificial Sequence
  chemically synthesized
cacacattgtggggatggagaa

SEQ ID NO: 1000767 - DNA, 22 bp, Artificial Sequence
  chemically synthesized
aaatattgcacacattgtgggg

SEQ ID NO: 1000768 - DNA, 22 bp, Artificial Sequence
  chemically synthesized
ctaaaatattgcacacattgtg

SEQ ID NO: 1000769 - DNA, 22 bp, Artificial Sequence
  chemically synthesized
tccatccccacaatgtgtgcaa

SEQ ID NO: 1000770 - DNA, 22 bp, Artificial Sequence
  chemically synthesized
catccccacaatgtgtgcaata

SEQ ID NO: 1000771 - DNA, 22 bp, Artificial Sequence
  chemically synthesized
tgagtaacaaaagactcctaaa

SEQ ID NO: 1000772 - DNA, 22 bp, Artificial Sequence
  chemically synthesized
ttatgagtaacaaaagactcct

SEQ ID NO: 1000773 - DNA, 22 bp, Artificial Sequence
  chemically synthesized
gctattatgagtaacaaaagac

SEQ ID NO: 1000774 - DNA, 22 bp, Artificial Sequence
  chemically synthesized
agctattatgagtaacaaaaga

SEQ ID NO: 1000775 - DNA, 22 bp, Artificial Sequence
  chemically synthesized
tagctattatgagtaacaaaag

SEQ ID NO: 1000776 - DNA, 22 bp, Artificial Sequence
  chemically synthesized
taggagtcttttgttactcata

SEQ ID NO: 1000777 - DNA, 22 bp, Artificial Sequence
  chemically synthesized
tactttagctattatgagtaac

SEQ ID NO: 1000778 - DNA, 22 bp, Artificial Sequence
  chemically synthesized
aggagtcttttgttactcataa

SEQ ID NO: 1000779 - DNA, 22 bp, Artificial Sequence
  chemically synthesized
ggagtcttttgttactcataat

SEQ ID NO: 1000780 - DNA, 22 bp, Artificial Sequence
  chemically synthesized
ttgttactcataatagctaaag

SEQ ID NO: 1000781 - DNA, 22 bp, Artificial Sequence
  chemically synthesized
caaagatctgtactttagctat

SEQ ID NO: 1000782 - DNA, 22 bp, Artificial Sequence
  chemically synthesized
tgttactcataatagctaaagt

SEQ ID NO: 1000783 - DNA, 22 bp, Artificial Sequence
  chemically synthesized
gcaaagatctgtactttagcta

SEQ ID NO: 1000784 - DNA, 22 bp, Artificial Sequence
  chemically synthesized
gttactcataatagctaaagta

SEQ ID NO: 1000785 - DNA, 22 bp, Artificial Sequence
  chemically synthesized
ttactcataatagctaaagtac

SEQ ID NO: 1000786 - DNA, 22 bp, Artificial Sequence
  chemically synthesized
cttgcaaagatctgtactttag

SEQ ID NO: 1000787 - DNA, 22 bp, Artificial Sequence
  chemically synthesized
ctcataatagctaaagtacaga

SEQ ID NO: 1000788 - DNA, 22 bp, Artificial Sequence
  chemically synthesized
ataatagctaaagtacagatct

SEQ ID NO: 1000789 - DNA, 22 bp, Artificial Sequence
  chemically synthesized
aagtacagatctttgcaagtag

SEQ ID NO: 1000790 - DNA, 22 bp, Artificial Sequence
  chemically synthesized
gtggaagatgaaactacttgca

SEQ ID NO: 1000791 - DNA, 22 bp, Artificial Sequence
  chemically synthesized
actcgtggaagatgaaactact

SEQ ID NO: 1000792 - DNA, 22 bp, Artificial Sequence
  chemically synthesized
cactcgtggaagatgaaactac

SEQ ID NO: 1000793 - DNA, 22 bp, Artificial Sequence
  chemically synthesized
tcactcgtggaagatgaaacta

SEQ ID NO: 1000794 - DNA, 22 bp, Artificial Sequence
  chemically synthesized
ctttcactcgtggaagatgaaa

SEQ ID NO: 1000795 - DNA, 22 bp, Artificial Sequence
  chemically synthesized
tgcaagtagtttcatcttccac

SEQ ID NO: 1000796 - DNA, 22 bp, Artificial Sequence
  chemically synthesized
gcaagtagtttcatcttccacg

SEQ ID NO: 1000797 - DNA, 22 bp, Artificial Sequence
  chemically synthesized
caagtagtttcatcttccacga

SEQ ID NO: 1000798 - DNA, 22 bp, Artificial Sequence
  chemically synthesized
aatctgctttcactcgtggaag

SEQ ID NO: 1000799 - DNA, 22 bp, Artificial Sequence
  chemically synthesized
gaatctgctttcactcgtggaa

SEQ ID NO: 1000800 - DNA, 22 bp, Artificial Sequence
  chemically synthesized
tttgaatctgctttcactcgtg

SEQ ID NO: 1000801 - DNA, 22 bp, Artificial Sequence
  chemically synthesized
gtttgaatctgctttcactcgt

SEQ ID NO: 1000802 - DNA, 22 bp, Artificial Sequence
  chemically synthesized
tgtttgaatctgctttcactcg

SEQ ID NO: 1000803 - DNA, 22 bp, Artificial Sequence
  chemically synthesized
ttgtttgaatctgctttcactc

SEQ ID NO: 1000804 - DNA, 22 bp, Artificial Sequence
  chemically synthesized
catcttccacgagtgaaagcag

SEQ ID NO: 1000805 - DNA, 22 bp, Artificial Sequence
  chemically synthesized
atcttccacgagtgaaagcaga

SEQ ID NO: 1000806 - DNA, 22 bp, Artificial Sequence
  chemically synthesized
ccacgagtgaaagcagattcaa

SEQ ID NO: 1000807 - DNA, 22 bp, Artificial Sequence
  chemically synthesized
cacgagtgaaagcagattcaaa

SEQ ID NO: 1000808 - DNA, 22 bp, Artificial Sequence
  chemically synthesized
aaacaaaaacattactctcacc

SEQ ID NO: 1000809 - DNA, 22 bp, Artificial Sequence
  chemically synthesized
gaaaacgtatgatgcaggtgag

SEQ ID NO: 1000810 - DNA, 22 bp, Artificial Sequence
  chemically synthesized
tcgaaaacgtatgatgcaggtg

SEQ ID NO: 1000811 - DNA, 22 bp, Artificial Sequence
  chemically synthesized
actctcgaaaacgtatgatgca

SEQ ID NO: 1000812 - DNA, 22 bp, Artificial Sequence
  chemically synthesized
ctcactctcgaaaacgtatgat

SEQ ID NO: 1000813 - DNA, 22 bp, Artificial Sequence
  chemically synthesized
ctctcacctgcatcatacgttt

SEQ ID NO: 1000814 - DNA, 22 bp, Artificial Sequence
  chemically synthesized
tcacctgcatcatacgttttcg

SEQ ID NO: 1000815 - DNA, 22 bp, Artificial Sequence
  chemically synthesized
acctgcatcatacgttttcgag

SEQ ID NO: 1000816 - DNA, 22 bp, Artificial Sequence
  chemically synthesized
cagcacactgctcactctcgaa

SEQ ID NO: 1000817 - DNA, 22 bp, Artificial Sequence
  chemically synthesized
catcatacgttttcgagagtga

SEQ ID NO: 1000818 - DNA, 22 bp, Artificial Sequence
  chemically synthesized
ccagcacactgctcactctcga

SEQ ID NO: 1000819 - DNA, 22 bp, Artificial Sequence
  chemically synthesized
gggcaatttccagcacactgct

SEQ ID NO: 1000820 - DNA, 22 bp, Artificial Sequence
  chemically synthesized
tcgagagtgagcagtgtgctgg

SEQ ID NO: 1000821 - DNA, 22 bp, Artificial Sequence
  chemically synthesized
cgagagtgagcagtgtgctgga

SEQ ID NO: 1000822 - DNA, 22 bp, Artificial Sequence
  chemically synthesized
gagagtgagcagtgtgctggaa

SEQ ID NO: 1000823 - DNA, 22 bp, Artificial Sequence
  chemically synthesized
cataaaacagcatgggttgggg

SEQ ID NO: 1000824 - DNA, 22 bp, Artificial Sequence
  chemically synthesized
acataaaacagcatgggttggg

SEQ ID NO: 1000825 - DNA, 22 bp, Artificial Sequence
  chemically synthesized
gaaattgccccaacccatgctg

SEQ ID NO: 1000826 - DNA, 22 bp, Artificial Sequence
  chemically synthesized
tggcttacataaaacagcatgg

SEQ ID NO: 1000827 - DNA, 22 bp, Artificial Sequence
  chemically synthesized
ccccaacccatgctgttttatg

SEQ ID NO: 1000828 - DNA, 22 bp, Artificial Sequence
  chemically synthesized
aggactatggcttacataaaac

SEQ ID NO: 1000829 - DNA, 22 bp, Artificial Sequence
  chemically synthesized
taaggactatggcttacataaa

SEQ ID NO: 1000830 - DNA, 22 bp, Artificial Sequence
  chemically synthesized
cattctaaggactatggcttac

SEQ ID NO: 1000831 - DNA, 22 bp, Artificial Sequence
  chemically synthesized
ttttatgtaagccatagtcctt

SEQ ID NO: 1000832 - DNA, 22 bp, Artificial Sequence
  chemically synthesized
agtacctacattctaaggacta

SEQ ID NO: 1000833 - DNA, 22 bp, Artificial Sequence
  chemically synthesized
tatgtaagccatagtccttaga

SEQ ID NO: 1000834 - DNA, 22 bp, Artificial Sequence
  chemically synthesized
atgtaagccatagtccttagaa

SEQ ID NO: 1000835 - DNA, 22 bp, Artificial Sequence
  chemically synthesized
tgagtacctacattctaaggac

SEQ ID NO: 1000836 - DNA, 22 bp, Artificial Sequence
  chemically synthesized
tgtaagccatagtccttagaat

SEQ ID NO: 1000837 - DNA, 22 bp, Artificial Sequence
  chemically synthesized
tctgagtacctacattctaagg

SEQ ID NO: 1000838 - DNA, 22 bp, Artificial Sequence
  chemically synthesized
ctctgagtacctacattctaag

SEQ ID NO: 1000839 - DNA, 22 bp, Artificial Sequence
  chemically synthesized
ttctctgagtacctacattcta

SEQ ID NO: 1000840 - DNA, 22 bp, Artificial Sequence
  chemically synthesized
ctcttctctgagtacctacatt

SEQ ID NO: 1000841 - DNA, 22 bp, Artificial Sequence
  chemically synthesized
agaatgtaggtactcagagaag

SEQ ID NO: 1000842 - DNA, 22 bp, Artificial Sequence
  chemically synthesized
gaatgtaggtactcagagaaga

SEQ ID NO: 1000843 - DNA, 22 bp, Artificial Sequence
  chemically synthesized
gcacaaaaaagtacctgctctt

SEQ ID NO: 1000844 - DNA, 22 bp, Artificial Sequence
  chemically synthesized
ctagcacaaaaaagtacctgct

SEQ ID NO: 1000845 - DNA, 22 bp, Artificial Sequence
  chemically synthesized
cctagcacaaaaaagtacctgc

SEQ ID NO: 1000846 - DNA, 22 bp, Artificial Sequence
  chemically synthesized
ttcctagcacaaaaaagtacct

SEQ ID NO: 1000847 - DNA, 22 bp, Artificial Sequence
  chemically synthesized
cttcctagcacaaaaaagtacc

SEQ ID NO: 1000848 - DNA, 22 bp, Artificial Sequence
  chemically synthesized
agagaagagcaggtactttttt

SEQ ID NO: 1000849 - DNA, 22 bp, Artificial Sequence
  chemically synthesized
gccatgtttcttcctagcacaa

SEQ ID NO: 1000850 - DNA, 22 bp, Artificial Sequence
  chemically synthesized
ggccatgtttcttcctagcaca

SEQ ID NO: 1000851 - DNA, 22 bp, Artificial Sequence
  chemically synthesized
cttggccatgtttcttcctagc

SEQ ID NO: 1000852 - DNA, 22 bp, Artificial Sequence
  chemically synthesized
ttttgtgctaggaagaaacatg

SEQ ID NO: 1000853 - DNA, 22 bp, Artificial Sequence
  chemically synthesized
tttgtgctaggaagaaacatgg

SEQ ID NO: 1000854 - DNA, 22 bp, Artificial Sequence
  chemically synthesized
ttgtgctaggaagaaacatggc

SEQ ID NO: 1000855 - DNA, 22 bp, Artificial Sequence
  chemically synthesized
tgtgctaggaagaaacatggcc

SEQ ID NO: 1000856 - DNA, 22 bp, Artificial Sequence
  chemically synthesized
gtgctaggaagaaacatggcca

SEQ ID NO: 1000857 - DNA, 22 bp, Artificial Sequence
  chemically synthesized
tgctaggaagaaacatggccaa

SEQ ID NO: 1000858 - DNA, 22 bp, Artificial Sequence
  chemically synthesized
ggaagaaacatggccaagcaat

SEQ ID NO: 1000859 - DNA, 22 bp, Artificial Sequence
  chemically synthesized
gtcagatagcagtattgcttgg

SEQ ID NO: 1000860 - DNA, 22 bp, Artificial Sequence
  chemically synthesized
ctcgtcagatagcagtattgct

SEQ ID NO: 1000861 - DNA, 22 bp, Artificial Sequence
  chemically synthesized
cctcgtcagatagcagtattgc

SEQ ID NO: 1000862 - DNA, 22 bp, Artificial Sequence
  chemically synthesized
aagaacaacagcttcctcgtca

SEQ ID NO: 1000863 - DNA, 22 bp, Artificial Sequence
  chemically synthesized
ctatctgacgaggaagctgttg

SEQ ID NO: 1000864 - DNA, 22 bp, Artificial Sequence
  chemically synthesized
tctgacgaggaagctgttgttc

SEQ ID NO: 1000865 - DNA, 22 bp, Artificial Sequence
  chemically synthesized
acgaggaagctgttgttcttta

SEQ ID NO: 1000866 - DNA, 22 bp, Artificial Sequence
  chemically synthesized
aaaatggtccaggttaaagaac

SEQ ID NO: 1000867 - DNA, 22 bp, Artificial Sequence
  chemically synthesized
tgaaaatggtccaggttaaaga

SEQ ID NO: 1000868 - DNA, 22 bp, Artificial Sequence
  chemically synthesized
ctctgaaaatggtccaggttaa

SEQ ID NO: 1000869 - DNA, 22 bp, Artificial Sequence
  chemically synthesized
ttgttctttaacctggaccatt

SEQ ID NO: 1000870 - DNA, 22 bp, Artificial Sequence
  chemically synthesized
ttctttaacctggaccattttc

SEQ ID NO: 1000871 - DNA, 22 bp, Artificial Sequence
  chemically synthesized
aaatgcctactctgaaaatggt

SEQ ID NO: 1000872 - DNA, 22 bp, Artificial Sequence
  chemically synthesized
aaaatgcctactctgaaaatgg

SEQ ID NO: 1000873 - DNA, 22 bp, Artificial Sequence
  chemically synthesized
tttaacctggaccattttcaga

SEQ ID NO: 1000874 - DNA, 22 bp, Artificial Sequence
  chemically synthesized
taaaatgcctactctgaaaatg

SEQ ID NO: 1000875 - DNA, 22 bp, Artificial Sequence
  chemically synthesized
ttaaaatgcctactctgaaaat

SEQ ID NO: 1000876 - DNA, 22 bp, Artificial Sequence
  chemically synthesized
taacctggaccattttcagagt

SEQ ID NO: 1000877 - DNA, 22 bp, Artificial Sequence
  chemically synthesized
aacctggaccattttcagagta

SEQ ID NO: 1000878 - DNA, 22 bp, Artificial Sequence
  chemically synthesized
acctggaccattttcagagtag

SEQ ID NO: 1000879 - DNA, 22 bp, Artificial Sequence
  chemically synthesized
gaccattttcagagtaggcatt

SEQ ID NO: 1000880 - DNA, 22 bp, Artificial Sequence
  chemically synthesized
atcaggcagcttttaaaatgcc

SEQ ID NO: 1000881 - DNA, 22 bp, Artificial Sequence
  chemically synthesized
tcatcaggcagcttttaaaatg

SEQ ID NO: 1000882 - DNA, 22 bp, Artificial Sequence
  chemically synthesized
tcagagtaggcattttaaaagc

SEQ ID NO: 1000883 - DNA, 22 bp, Artificial Sequence
  chemically synthesized
cagagtaggcattttaaaagct

SEQ ID NO: 1000884 - DNA, 22 bp, Artificial Sequence
  chemically synthesized
agagtaggcattttaaaagctg

SEQ ID NO: 1000885 - DNA, 22 bp, Artificial Sequence
  chemically synthesized
aaaaagttctcatcaggcagct

SEQ ID NO: 1000886 - DNA, 22 bp, Artificial Sequence
  chemically synthesized
caaaaagttctcatcaggcagc

SEQ ID NO: 1000887 - DNA, 22 bp, Artificial Sequence
  chemically synthesized
cagtttcaaaaagttctcatca

SEQ ID NO: 1000888 - DNA, 22 bp, Artificial Sequence
  chemically synthesized
taaaagctgcctgatgagaact

SEQ ID NO: 1000889 - DNA, 22 bp, Artificial Sequence
  chemically synthesized
aaaagctgcctgatgagaactt

SEQ ID NO: 1000890 - DNA, 22 bp, Artificial Sequence
  chemically synthesized
aaagctgcctgatgagaacttt

SEQ ID NO: 1000891 - DNA, 22 bp, Artificial Sequence
  chemically synthesized
ctacagtttcaaaaagttctca

SEQ ID NO: 1000892 - DNA, 22 bp, Artificial Sequence
  chemically synthesized
tgctacagtttcaaaaagttct

SEQ ID NO: 1000893 - DNA, 22 bp, Artificial Sequence
  chemically synthesized
cctgatgagaactttttgaaac

SEQ ID NO: 1000894 - DNA, 22 bp, Artificial Sequence
  chemically synthesized
atgagaactttttgaaactgta

SEQ ID NO: 1000895 - DNA, 22 bp, Artificial Sequence
  chemically synthesized
tttgaaactgtagcagagcttc

SEQ ID NO: 1000896 - DNA, 22 bp, Artificial Sequence
  chemically synthesized
ttgaaactgtagcagagcttcc

SEQ ID NO: 1000897 - DNA, 22 bp, Artificial Sequence
  chemically synthesized
tgaaactgtagcagagcttcca

SEQ ID NO: 1000898 - DNA, 22 bp, Artificial Sequence
  chemically synthesized
gaaactgtagcagagcttccat

SEQ ID NO: 1000899 - DNA, 22 bp, Artificial Sequence
  chemically synthesized
aaactgtagcagagcttccatg

SEQ ID NO: 1000900 - DNA, 22 bp, Artificial Sequence
  chemically synthesized
tagcagagcttccatggatatt

SEQ ID NO: 1000901 - DNA, 22 bp, Artificial Sequence
  chemically synthesized
ccatggatattctgattggata

SEQ ID NO: 1000902 - DNA, 22 bp, Artificial Sequence
  chemically synthesized
catggatattctgattggatat

SEQ ID NO: 1000903 - DNA, 22 bp, Artificial Sequence
  chemically synthesized
agcaggaagcaatgatatatcc

SEQ ID NO: 1000904 - DNA, 22 bp, Artificial Sequence
  chemically synthesized
tgattggatatatcattgcttc

SEQ ID NO: 1000905 - DNA, 22 bp, Artificial Sequence
  chemically synthesized
gcaagctgagcaggaagcaatg

SEQ ID NO: 1000906 - DNA, 22 bp, Artificial Sequence
  chemically synthesized
attggatatatcattgcttcct

SEQ ID NO: 1000907 - DNA, 22 bp, Artificial Sequence
  chemically synthesized
agcaagctgagcaggaagcaat

SEQ ID NO: 1000908 - DNA, 22 bp, Artificial Sequence
  chemically synthesized
gatatatcattgcttcctgctc

SEQ ID NO: 1000909 - DNA, 22 bp, Artificial Sequence
  chemically synthesized
tcttagcaagctgagcaggaag

SEQ ID NO: 1000910 - DNA, 22 bp, Artificial Sequence
  chemically synthesized
aagttatcttagcaagctgagc

SEQ ID NO: 1000911 - DNA, 22 bp, Artificial Sequence
  chemically synthesized
caagttatcttagcaagctgag

SEQ ID NO: 1000912 - DNA, 22 bp, Artificial Sequence
  chemically synthesized
tcaagttatcttagcaagctga

SEQ ID NO: 1000913 - DNA, 22 bp, Artificial Sequence
  chemically synthesized
ttttcaagttatcttagcaagc

SEQ ID NO: 1000914 - DNA, 22 bp, Artificial Sequence
  chemically synthesized
cttcctgctcagcttgctaaga

SEQ ID NO: 1000915 - DNA, 22 bp, Artificial Sequence
  chemically synthesized
tgttttcaagttatcttagcaa

SEQ ID NO: 1000916 - DNA, 22 bp, Artificial Sequence
  chemically synthesized
ctgttttcaagttatcttagca

SEQ ID NO: 1000917 - DNA, 22 bp, Artificial Sequence
  chemically synthesized
cctgctcagcttgctaagataa

SEQ ID NO: 1000918 - DNA, 22 bp, Artificial Sequence
  chemically synthesized
tctgttttcaagttatcttagc

SEQ ID NO: 1000919 - DNA, 22 bp, Artificial Sequence
  chemically synthesized
ctgctcagcttgctaagataac

SEQ ID NO: 1000920 - DNA, 22 bp, Artificial Sequence
  chemically synthesized
ctcagcttgctaagataacttg

SEQ ID NO: 1000921 - DNA, 22 bp, Artificial Sequence
  chemically synthesized
agcttgctaagataacttgaaa

SEQ ID NO: 1000922 - DNA, 22 bp, Artificial Sequence
  chemically synthesized
gctaagataacttgaaaacaga

SEQ ID NO: 1000923 - DNA, 22 bp, Artificial Sequence
  chemically synthesized
ctaagataacttgaaaacagaa

SEQ ID NO: 1000924 - DNA, 22 bp, Artificial Sequence
  chemically synthesized
cagacaaaaggattttctgttt

SEQ ID NO: 1000925 - DNA, 22 bp, Artificial Sequence
  chemically synthesized
agataacttgaaaacagaaaat

SEQ ID NO: 1000926 - DNA, 22 bp, Artificial Sequence
  chemically synthesized
ctccagacaaaaggattttctg

SEQ ID NO: 1000927 - DNA, 22 bp, Artificial Sequence
  chemically synthesized
gaaaacagaaaatccttttgtc

SEQ ID NO: 1000928 - DNA, 22 bp, Artificial Sequence
  chemically synthesized
aaaacagaaaatccttttgtct

SEQ ID NO: 1000929 - DNA, 22 bp, Artificial Sequence
  chemically synthesized
aatacctactccagacaaaagg

SEQ ID NO: 1000930 - DNA, 22 bp, Artificial Sequence
  chemically synthesized
attaaatacctactccagacaa

SEQ ID NO: 1000931 - DNA, 22 bp, Artificial Sequence
  chemically synthesized
gttaattaaatacctactccag

SEQ ID NO: 1000932 - DNA, 22 bp, Artificial Sequence
  chemically synthesized
ggttaattaaatacctactcca

SEQ ID NO: 1000933 - DNA, 22 bp, Artificial Sequence
  chemically synthesized
acatttggttaattaaatacct

SEQ ID NO: 1000934 - DNA, 22 bp, Artificial Sequence
  chemically synthesized
ttgtctggagtaggtatttaat

SEQ ID NO: 1000935 - DNA, 22 bp, Artificial Sequence
  chemically synthesized
aacatttggttaattaaatacc

SEQ ID NO: 1000936 - DNA, 22 bp, Artificial Sequence
  chemically synthesized
tgtctggagtaggtatttaatt

SEQ ID NO: 1000937 - DNA, 22 bp, Artificial Sequence
  chemically synthesized
gtctggagtaggtatttaatta

SEQ ID NO: 1000938 - DNA, 22 bp, Artificial Sequence
  chemically synthesized
tctggagtaggtatttaattaa

SEQ ID NO: 1000939 - DNA, 22 bp, Artificial Sequence
  chemically synthesized
gagtaggtatttaattaaccaa

SEQ ID NO: 1000940 - DNA, 22 bp, Artificial Sequence
  chemically synthesized
aaaaaatacacaatacttaaca

SEQ ID NO: 1000941 - DNA, 22 bp, Artificial Sequence
  chemically synthesized
aattaaccaaatgttaagtatt

SEQ ID NO: 1000942 - DNA, 22 bp, Artificial Sequence
  chemically synthesized
attaaccaaatgttaagtattg

SEQ ID NO: 1000943 - DNA, 22 bp, Artificial Sequence
  chemically synthesized
accaaatgttaagtattgtgta

SEQ ID NO: 1000944 - DNA, 22 bp, Artificial Sequence
  chemically synthesized
agcaactgaaaaaatacacaat

SEQ ID NO: 1000945 - DNA, 22 bp, Artificial Sequence
  chemically synthesized
aagcaactgaaaaaatacacaa

SEQ ID NO: 1000946 - DNA, 22 bp, Artificial Sequence
  chemically synthesized
cacttaagcaactgaaaaaata

SEQ ID NO: 1000947 - DNA, 22 bp, Artificial Sequence
  chemically synthesized
ccacttaagcaactgaaaaaat

SEQ ID NO: 1000948 - DNA, 22 bp, Artificial Sequence
  chemically synthesized
tccacttaagcaactgaaaaaa

SEQ ID NO: 1000949 - DNA, 22 bp, Artificial Sequence
  chemically synthesized
agtattgtgtattttttcagtt

SEQ ID NO: 1000950 - DNA, 22 bp, Artificial Sequence
  chemically synthesized
tgtattttttcagttgcttaag

SEQ ID NO: 1000951 - DNA, 22 bp, Artificial Sequence
  chemically synthesized
tttcagttgcttaagtggaaag

SEQ ID NO: 1000952 - DNA, 22 bp, Artificial Sequence
  chemically synthesized
aggtaataatgtctttccactt

SEQ ID NO: 1000953 - DNA, 22 bp, Artificial Sequence
  chemically synthesized
ttcagttgcttaagtggaaaga

SEQ ID NO: 1000954 - DNA, 22 bp, Artificial Sequence
  chemically synthesized
tcagttgcttaagtggaaagac

SEQ ID NO: 1000955 - DNA, 22 bp, Artificial Sequence
  chemically synthesized
cagttgcttaagtggaaagaca

SEQ ID NO: 1000956 - DNA, 22 bp, Artificial Sequence
  chemically synthesized
agttgcttaagtggaaagacat

SEQ ID NO: 1000957 - DNA, 22 bp, Artificial Sequence
  chemically synthesized
tattcaggtaataatgtctttc

SEQ ID NO: 1000958 - DNA, 22 bp, Artificial Sequence
  chemically synthesized
cttaagtggaaagacattatta

SEQ ID NO: 1000959 - DNA, 22 bp, Artificial Sequence
  chemically synthesized
aagtggaaagacattattacct

SEQ ID NO: 1000960 - DNA, 22 bp, Artificial Sequence
  chemically synthesized
agtggaaagacattattacctg

SEQ ID NO: 1000961 - DNA, 22 bp, Artificial Sequence
  chemically synthesized
ataaaaaaactatattcaggta

SEQ ID NO: 1000962 - DNA, 22 bp, Artificial Sequence
  chemically synthesized
ttcataaaaaaactatattcag

SEQ ID NO: 1000963 - DNA, 22 bp, Artificial Sequence
  chemically synthesized
ggttgttcataaaaaaactata

SEQ ID NO: 1000964 - DNA, 22 bp, Artificial Sequence
  chemically synthesized
tgggttgttcataaaaaaacta

SEQ ID NO: 1000965 - DNA, 22 bp, Artificial Sequence
  chemically synthesized
ttacctgaatatagttttttta

SEQ ID NO: 1000966 - DNA, 22 bp, Artificial Sequence
  chemically synthesized
cctgaatatagtttttttatga

SEQ ID NO: 1000967 - DNA, 22 bp, Artificial Sequence
  chemically synthesized
aatatagtttttttatgaacaa

SEQ ID NO: 1000968 - DNA, 22 bp, Artificial Sequence
  chemically synthesized
acccggtaatattctgggttgt

SEQ ID NO: 1000969 - DNA, 22 bp, Artificial Sequence
  chemically synthesized
aacccggtaatattctgggttg

SEQ ID NO: 1000970 - DNA, 22 bp, Artificial Sequence
  chemically synthesized
taacccggtaatattctgggtt

SEQ ID NO: 1000971 - DNA, 22 bp, Artificial Sequence
  chemically synthesized
ttttatgaacaacccagaatat

SEQ ID NO: 1000972 - DNA, 22 bp, Artificial Sequence
  chemically synthesized
tttatgaacaacccagaatatt

SEQ ID NO: 1000973 - DNA, 22 bp, Artificial Sequence
  chemically synthesized
ttatgaacaacccagaatatta

SEQ ID NO: 1000974 - DNA, 22 bp, Artificial Sequence
  chemically synthesized
tatgaacaacccagaatattac

SEQ ID NO: 1000975 - DNA, 22 bp, Artificial Sequence
  chemically synthesized
atgaacaacccagaatattacc

SEQ ID NO: 1000976 - DNA, 22 bp, Artificial Sequence
  chemically synthesized
tgaacaacccagaatattaccg

SEQ ID NO: 1000977 - DNA, 22 bp, Artificial Sequence
  chemically synthesized
agtaataaaccaatgaccttta

SEQ ID NO: 1000978 - DNA, 22 bp, Artificial Sequence
  chemically synthesized
ggttaagtaataaaccaatgac

SEQ ID NO: 1000979 - DNA, 22 bp, Artificial Sequence
  chemically synthesized
ccgggttaaaggtcattggttt

SEQ ID NO: 1000980 - DNA, 22 bp, Artificial Sequence
  chemically synthesized
aggttaagtaataaaccaatga

SEQ ID NO: 1000981 - DNA, 22 bp, Artificial Sequence
  chemically synthesized
taggttaagtaataaaccaatg

SEQ ID NO: 1000982 - DNA, 22 bp, Artificial Sequence
  chemically synthesized
ttaggttaagtaataaaccaat

SEQ ID NO: 1000983 - DNA, 22 bp, Artificial Sequence
  chemically synthesized
tttttaggttaagtaataaacc

SEQ ID NO: 1000984 - DNA, 22 bp, Artificial Sequence
  chemically synthesized
aaggtcattggtttattactta

SEQ ID NO: 1000985 - DNA, 22 bp, Artificial Sequence
  chemically synthesized
gtttattacttaacctaaaaat

SEQ ID NO: 1000986 - DNA, 22 bp, Artificial Sequence
  chemically synthesized
attacttaacctaaaaataatt

SEQ ID NO: 1000987 - DNA, 22 bp, Artificial Sequence
  chemically synthesized
ttacttaacctaaaaataattg

SEQ ID NO: 1000988 - DNA, 22 bp, Artificial Sequence
  chemically synthesized
catatatgtcaaagcaattatt

SEQ ID NO: 1000989 - DNA, 22 bp, Artificial Sequence
  chemically synthesized
cttaacctaaaaataattgctt

SEQ ID NO: 1000990 - DNA, 22 bp, Artificial Sequence
  chemically synthesized
aacctaaaaataattgctttga

SEQ ID NO: 1000991 - DNA, 22 bp, Artificial Sequence
  chemically synthesized
acctaaaaataattgctttgac

SEQ ID NO: 1000992 - DNA, 22 bp, Artificial Sequence
  chemically synthesized
aaaataattgctttgacatata

SEQ ID NO: 1000993 - DNA, 22 bp, Artificial Sequence
  chemically synthesized
ctttgacatatatggaatattg

SEQ ID NO: 1000994 - DNA, 22 bp, Artificial Sequence
  chemically synthesized
tgacatatatggaatattgtat

SEQ ID NO: 1000995 - DNA, 22 bp, Artificial Sequence
  chemically synthesized
gacatatatggaatattgtata

SEQ ID NO: 1000996 - DNA, 22 bp, Artificial Sequence
  chemically synthesized
acatatatggaatattgtatat

SEQ ID NO: 1000997 - DNA, 22 bp, Artificial Sequence
  chemically synthesized
tcaaaaaataatgagatataca

SEQ ID NO: 1000998 - DNA, 22 bp, Artificial Sequence
  chemically synthesized
aagttatcaaaaaataatgaga

SEQ ID NO: 1000999 - DNA, 22 bp, Artificial Sequence
  chemically synthesized
tgaagttatcaaaaaataatga

SEQ ID NO: 1001000 - DNA, 22 bp, Artificial Sequence
  chemically synthesized
ctgaagttatcaaaaaataatg

SEQ ID NO: 1001001 - DNA, 22 bp, Artificial Sequence
  chemically synthesized
ttctgaagttatcaaaaaataa

SEQ ID NO: 1001002 - DNA, 22 bp, Artificial Sequence
  chemically synthesized
tatatctcattattttttgata

SEQ ID NO: 1001003 - DNA, 22 bp, Artificial Sequence
  chemically synthesized
gctcttctgaagttatcaaaaa

SEQ ID NO: 1001004 - DNA, 22 bp, Artificial Sequence
  chemically synthesized
tattagctcttctgaagttatc

SEQ ID NO: 1001005 - DNA, 22 bp, Artificial Sequence
  chemically synthesized
attattttttgataacttcaga

SEQ ID NO: 1001006 - DNA, 22 bp, Artificial Sequence
  chemically synthesized
ttttttgataacttcagaagag

SEQ ID NO: 1001007 - DNA, 22 bp, Artificial Sequence
  chemically synthesized
cgattatattagctcttctgaa

SEQ ID NO: 1001008 - DNA, 22 bp, Artificial Sequence
  chemically synthesized
tttgataacttcagaagagcta

SEQ ID NO: 1001009 - DNA, 22 bp, Artificial Sequence
  chemically synthesized
ttgataacttcagaagagctaa

SEQ ID NO: 1001010 - DNA, 22 bp, Artificial Sequence
  chemically synthesized
cctccgattatattagctcttc

SEQ ID NO: 1001011 - DNA, 22 bp, Artificial Sequence
  chemically synthesized
tgataacttcagaagagctaat

SEQ ID NO: 1001012 - DNA, 22 bp, Artificial Sequence
  chemically synthesized
gataacttcagaagagctaata

SEQ ID NO: 1001013 - DNA, 22 bp, Artificial Sequence
  chemically synthesized
ataacttcagaagagctaatat

SEQ ID NO: 1001014 - DNA, 22 bp, Artificial Sequence
  chemically synthesized
tagatctgcctccgattatatt

SEQ ID NO: 1001015 - DNA, 22 bp, Artificial Sequence
  chemically synthesized
cagaagagctaatataatcgga

SEQ ID NO: 1001016 - DNA, 22 bp, Artificial Sequence
  chemically synthesized
agaagagctaatataatcggag

SEQ ID NO: 1001017 - DNA, 22 bp, Artificial Sequence
  chemically synthesized
cactgtagatctgcctccgatt

SEQ ID NO: 1001018 - DNA, 22 bp, Artificial Sequence
  chemically synthesized
ttccactgtagatctgcctccg

SEQ ID NO: 1001019 - DNA, 22 bp, Artificial Sequence
  chemically synthesized
cctattccactgtagatctgcc

SEQ ID NO: 1001020 - DNA, 22 bp, Artificial Sequence
  chemically synthesized
atataatcggaggcagatctac

SEQ ID NO: 1001021 - DNA, 22 bp, Artificial Sequence
  chemically synthesized
aattccctattccactgtagat

SEQ ID NO: 1001022 - DNA, 22 bp, Artificial Sequence
  chemically synthesized
tgaattccctattccactgtag

SEQ ID NO: 1001023 - DNA, 22 bp, Artificial Sequence
  chemically synthesized
gaatataaattctgaattccct

SEQ ID NO: 1001024 - DNA, 22 bp, Artificial Sequence
  chemically synthesized
cagtggaatagggaattcagaa

SEQ ID NO: 1001025 - DNA, 22 bp, Artificial Sequence
  chemically synthesized
ttagaatataaattctgaattc

SEQ ID NO: 1001026 - DNA, 22 bp, Artificial Sequence
  chemically synthesized
tgttagaatataaattctgaat

SEQ ID NO: 1001027 - DNA, 22 bp, Artificial Sequence
  chemically synthesized
ctgttagaatataaattctgaa

SEQ ID NO: 1001028 - DNA, 22 bp, Artificial Sequence
  chemically synthesized
tctgttagaatataaattctga

SEQ ID NO: 1001029 - DNA, 22 bp, Artificial Sequence
  chemically synthesized
ttctgttagaatataaattctg

SEQ ID NO: 1001030 - DNA, 22 bp, Artificial Sequence
  chemically synthesized
tatccttttctgttagaatata

SEQ ID NO: 1001031 - DNA, 22 bp, Artificial Sequence
  chemically synthesized
ctgtatccttttctgttagaat

SEQ ID NO: 1001032 - DNA, 22 bp, Artificial Sequence
  chemically synthesized
agaatttatattctaacagaaa

SEQ ID NO: 1001033 - DNA, 22 bp, Artificial Sequence
  chemically synthesized
tcatattactgtatccttttct

SEQ ID NO: 1001034 - DNA, 22 bp, Artificial Sequence
  chemically synthesized
gtcatattactgtatccttttc

SEQ ID NO: 1001035 - DNA, 22 bp, Artificial Sequence
  chemically synthesized
atattctaacagaaaaggatac

SEQ ID NO: 1001036 - DNA, 22 bp, Artificial Sequence
  chemically synthesized
tattctaacagaaaaggataca

SEQ ID NO: 1001037 - DNA, 22 bp, Artificial Sequence
  chemically synthesized
cttgtcatattactgtatcctt

SEQ ID NO: 1001038 - DNA, 22 bp, Artificial Sequence
  chemically synthesized
ccttgtcatattactgtatcct

SEQ ID NO: 1001039 - DNA, 22 bp, Artificial Sequence
  chemically synthesized
taacagaaaaggatacagtaat

SEQ ID NO: 1001040 - DNA, 22 bp, Artificial Sequence
  chemically synthesized
acagaaaaggatacagtaatat

SEQ ID NO: 1001041 - DNA, 22 bp, Artificial Sequence
  chemically synthesized
ggaatttccttgtcatattact

SEQ ID NO: 1001042 - DNA, 22 bp, Artificial Sequence
  chemically synthesized
aggaatttccttgtcatattac

SEQ ID NO: 1001043 - DNA, 22 bp, Artificial Sequence
  chemically synthesized
taggaatttccttgtcatatta

SEQ ID NO: 1001044 - DNA, 22 bp, Artificial Sequence
  chemically synthesized
ttaggaatttccttgtcatatt

SEQ ID NO: 1001045 - DNA, 22 bp, Artificial Sequence
  chemically synthesized
tatttttaggaatttccttgtc

SEQ ID NO: 1001046 - DNA, 22 bp, Artificial Sequence
  chemically synthesized
acatggaaaatatactatattt

SEQ ID NO: 1001047 - DNA, 22 bp, Artificial Sequence
  chemically synthesized
cacatggaaaatatactatatt

SEQ ID NO: 1001048 - DNA, 22 bp, Artificial Sequence
  chemically synthesized
tcacatggaaaatatactatat

SEQ ID NO: 1001049 - DNA, 22 bp, Artificial Sequence
  chemically synthesized
ctaaaaatatagtatattttcc

SEQ ID NO: 1001050 - DNA, 22 bp, Artificial Sequence
  chemically synthesized
aaaatatagtatattttccatg

SEQ ID NO: 1001051 - DNA, 22 bp, Artificial Sequence
  chemically synthesized
gaaatatgttttcacatggaaa

SEQ ID NO: 1001052 - DNA, 22 bp, Artificial Sequence
  chemically synthesized
gtctggaaatatgttttcacat

SEQ ID NO: 1001053 - DNA, 22 bp, Artificial Sequence
  chemically synthesized
aaattggtctggaaatatgttt

SEQ ID NO: 1001054 - DNA, 22 bp, Artificial Sequence
  chemically synthesized
gaaattggtctggaaatatgtt

SEQ ID NO: 1001055 - DNA, 22 bp, Artificial Sequence
  chemically synthesized
tgaaattggtctggaaatatgt

SEQ ID NO: 1001056 - DNA, 22 bp, Artificial Sequence
  chemically synthesized
tccatgtgaaaacatatttcca

SEQ ID NO: 1001057 - DNA, 22 bp, Artificial Sequence
  chemically synthesized
ttgaaattggtctggaaatatg

SEQ ID NO: 1001058 - DNA, 22 bp, Artificial Sequence
  chemically synthesized
ccatgtgaaaacatatttccag

SEQ ID NO: 1001059 - DNA, 22 bp, Artificial Sequence
  chemically synthesized
catgtgaaaacatatttccaga

SEQ ID NO: 1001060 - DNA, 22 bp, Artificial Sequence
  chemically synthesized
ttttgaaattggtctggaaata

SEQ ID NO: 1001061 - DNA, 22 bp, Artificial Sequence
  chemically synthesized
tcattcttttgaaattggtctg

SEQ ID NO: 1001062 - DNA, 22 bp, Artificial Sequence
  chemically synthesized
agctatcattcttttgaaattg

SEQ ID NO: 1001063 - DNA, 22 bp, Artificial Sequence
  chemically synthesized
ccagaccaatttcaaaagaatg

SEQ ID NO: 1001064 - DNA, 22 bp, Artificial Sequence
  chemically synthesized
cagaccaatttcaaaagaatga

SEQ ID NO: 1001065 - DNA, 22 bp, Artificial Sequence
  chemically synthesized
cagcagagaggaatctaagcta

SEQ ID NO: 1001066 - DNA, 22 bp, Artificial Sequence
  chemically synthesized
caaaagaatgatagcttagatt

SEQ ID NO: 1001067 - DNA, 22 bp, Artificial Sequence
  chemically synthesized
aaaagaatgatagcttagattc

SEQ ID NO: 1001068 - DNA, 22 bp, Artificial Sequence
  chemically synthesized
ctgcagcagagaggaatctaag

SEQ ID NO: 1001069 - DNA, 22 bp, Artificial Sequence
  chemically synthesized
actgcagcagagaggaatctaa

SEQ ID NO: 1001070 - DNA, 22 bp, Artificial Sequence
  chemically synthesized
agattcctctctgctgcagtaa

SEQ ID NO: 1001071 - DNA, 22 bp, Artificial Sequence
  chemically synthesized
gattcctctctgctgcagtaag

SEQ ID NO: 1001072 - DNA, 22 bp, Artificial Sequence
  chemically synthesized
aagtgggggatatagcttactg

SEQ ID NO: 1001073 - DNA, 22 bp, Artificial Sequence
  chemically synthesized
caagtgggggatatagcttact

SEQ ID NO: 1001074 - DNA, 22 bp, Artificial Sequence
  chemically synthesized
ctctctgctgcagtaagctata

SEQ ID NO: 1001075 - DNA, 22 bp, Artificial Sequence
  chemically synthesized
tctgctgcagtaagctatatcc

SEQ ID NO: 1001076 - DNA, 22 bp, Artificial Sequence
  chemically synthesized
tgctgcagtaagctatatcccc

SEQ ID NO: 1001077 - DNA, 22 bp, Artificial Sequence
  chemically synthesized
ctgcagtaagctatatccccca

SEQ ID NO: 1001078 - DNA, 22 bp, Artificial Sequence
  chemically synthesized
cagtaagctatatcccccactt

SEQ ID NO: 1001079 - DNA, 22 bp, Artificial Sequence
  chemically synthesized
tatcccccacttgaaatacatc

SEQ ID NO: 1001080 - DNA, 22 bp, Artificial Sequence
  chemically synthesized
taggaaaggtgggatgtatttc

SEQ ID NO: 1001081 - DNA, 22 bp, Artificial Sequence
  chemically synthesized
gaaatacatcccacctttccta

SEQ ID NO: 1001082 - DNA, 22 bp, Artificial Sequence
  chemically synthesized
aaatacatcccacctttcctat

SEQ ID NO: 1001083 - DNA, 22 bp, Artificial Sequence
  chemically synthesized
gtggaagaggtaattataggaa

SEQ ID NO: 1001084 - DNA, 22 bp, Artificial Sequence
  chemically synthesized
tggtggaagaggtaattatagg

SEQ ID NO: 1001085 - DNA, 22 bp, Artificial Sequence
  chemically synthesized
caattctggtggaagaggtaat

SEQ ID NO: 1001086 - DNA, 22 bp, Artificial Sequence
  chemically synthesized
tcctataattacctcttccacc

SEQ ID NO: 1001087 - DNA, 22 bp, Artificial Sequence
  chemically synthesized
cctataattacctcttccacca

SEQ ID NO: 1001088 - DNA, 22 bp, Artificial Sequence
  chemically synthesized
ctataattacctcttccaccag

SEQ ID NO: 1001089 - DNA, 22 bp, Artificial Sequence
  chemically synthesized
taattacctcttccaccagaat

SEQ ID NO: 1001090 - DNA, 22 bp, Artificial Sequence
  chemically synthesized
cctcttccaccagaattgcaat

SEQ ID NO: 1001091 - DNA, 22 bp, Artificial Sequence
  chemically synthesized
aaagaaatgtataattgcaatt

SEQ ID NO: 1001092 - DNA, 22 bp, Artificial Sequence
  chemically synthesized
ttccaccagaattgcaattata

SEQ ID NO: 1001093 - DNA, 22 bp, Artificial Sequence
  chemically synthesized
ccaccagaattgcaattataca

SEQ ID NO: 1001094 - DNA, 22 bp, Artificial Sequence
  chemically synthesized
caccagaattgcaattatacat

SEQ ID NO: 1001095 - DNA, 22 bp, Artificial Sequence
  chemically synthesized
aaaagtaaaagattaaaagaaa

SEQ ID NO: 1001096 - DNA, 22 bp, Artificial Sequence
  chemically synthesized
gaaaagtaaaagattaaaagaa

SEQ ID NO: 1001097 - DNA, 22 bp, Artificial Sequence
  chemically synthesized
caattatacatttcttttaatc

SEQ ID NO: 1001098 - DNA, 22 bp, Artificial Sequence
  chemically synthesized
tgaaaagtaaaagattaaaaga

SEQ ID NO: 1001099 - DNA, 22 bp, Artificial Sequence
  chemically synthesized
ttgaaaagtaaaagattaaaag

SEQ ID NO: 1001100 - DNA, 22 bp, Artificial Sequence
  chemically synthesized
tttttgaaaagtaaaagattaa

SEQ ID NO: 1001101 - DNA, 22 bp, Artificial Sequence
  chemically synthesized
tacatttcttttaatcttttac

SEQ ID NO: 1001102 - DNA, 22 bp, Artificial Sequence
  chemically synthesized
cattatttttgaaaagtaaaag

SEQ ID NO: 1001103 - DNA, 22 bp, Artificial Sequence
  chemically synthesized
ccattatttttgaaaagtaaaa

SEQ ID NO: 1001104 - DNA, 22 bp, Artificial Sequence
  chemically synthesized
cttttaatcttttacttttcaa

SEQ ID NO: 1001105 - DNA, 22 bp, Artificial Sequence
  chemically synthesized
ttttaatcttttacttttcaaa

SEQ ID NO: 1001106 - DNA, 22 bp, Artificial Sequence
  chemically synthesized
aatttccattatttttgaaaag

SEQ ID NO: 1001107 - DNA, 22 bp, Artificial Sequence
  chemically synthesized
ttaatcttttacttttcaaaaa

SEQ ID NO: 1001108 - DNA, 22 bp, Artificial Sequence
  chemically synthesized
aaatttccattatttttgaaaa

SEQ ID NO: 1001109 - DNA, 22 bp, Artificial Sequence
  chemically synthesized
taatcttttacttttcaaaaat

SEQ ID NO: 1001110 - DNA, 22 bp, Artificial Sequence
  chemically synthesized
aatcttttacttttcaaaaata

SEQ ID NO: 1001111 - DNA, 22 bp, Artificial Sequence
  chemically synthesized
atcttttacttttcaaaaataa

SEQ ID NO: 1001112 - DNA, 22 bp, Artificial Sequence
  chemically synthesized
ccaatttaaatttccattattt

SEQ ID NO: 1001113 - DNA, 22 bp, Artificial Sequence
  chemically synthesized
ttacttttcaaaaataatggaa

SEQ ID NO: 1001114 - DNA, 22 bp, Artificial Sequence
  chemically synthesized
tacttttcaaaaataatggaaa

SEQ ID NO: 1001115 - DNA, 22 bp, Artificial Sequence
  chemically synthesized
acttttcaaaaataatggaaat

SEQ ID NO: 1001116 - DNA, 22 bp, Artificial Sequence
  chemically synthesized
cttttcaaaaataatggaaatt

SEQ ID NO: 1001117 - DNA, 22 bp, Artificial Sequence
  chemically synthesized
attcccaatttaaatttccatt

SEQ ID NO: 1001118 - DNA, 22 bp, Artificial Sequence
  chemically synthesized
aattcccaatttaaatttccat

SEQ ID NO: 1001119 - DNA, 22 bp, Artificial Sequence
  chemically synthesized
ttcaaaaataatggaaatttaa

SEQ ID NO: 1001120 - DNA, 22 bp, Artificial Sequence
  chemically synthesized
tcaaaaataatggaaatttaaa

SEQ ID NO: 1001121 - DNA, 22 bp, Artificial Sequence
  chemically synthesized
caaaaataatggaaatttaaat

SEQ ID NO: 1001122 - DNA, 22 bp, Artificial Sequence
  chemically synthesized
aaaaataatggaaatttaaatt

SEQ ID NO: 1001123 - DNA, 22 bp, Artificial Sequence
  chemically synthesized
aatgcaacttaattcccaattt

SEQ ID NO: 1001124 - DNA, 22 bp, Artificial Sequence
  chemically synthesized
gaaattaaatgcaacttaattc

SEQ ID NO: 1001125 - DNA, 22 bp, Artificial Sequence
  chemically synthesized
aaattgggaattaagttgcatt

SEQ ID NO: 1001126 - DNA, 22 bp, Artificial Sequence
  chemically synthesized
aattgggaattaagttgcattt

SEQ ID NO: 1001127 - DNA, 22 bp, Artificial Sequence
  chemically synthesized
ggaattaagttgcatttaattt

SEQ ID NO: 1001128 - DNA, 22 bp, Artificial Sequence
  chemically synthesized
aaatgcgaaactggaaattaaa

SEQ ID NO: 1001129 - DNA, 22 bp, Artificial Sequence
  chemically synthesized
agttgcatttaatttccagttt

SEQ ID NO: 1001130 - DNA, 22 bp, Artificial Sequence
  chemically synthesized
aaagattaaaatgcgaaactgg

SEQ ID NO: 1001131 - DNA, 22 bp, Artificial Sequence
  chemically synthesized
caaagattaaaatgcgaaactg

SEQ ID NO: 1001132 - DNA, 22 bp, Artificial Sequence
  chemically synthesized
catttaatttccagtttcgcat

SEQ ID NO: 1001133 - DNA, 22 bp, Artificial Sequence
  chemically synthesized
tcaaagattaaaatgcgaaact

SEQ ID NO: 1001134 - DNA, 22 bp, Artificial Sequence
  chemically synthesized
ttttcaaagattaaaatgcgaa

SEQ ID NO: 1001135 - DNA, 22 bp, Artificial Sequence
  chemically synthesized
aatttccagtttcgcattttaa

SEQ ID NO: 1001136 - DNA, 22 bp, Artificial Sequence
  chemically synthesized
atttccagtttcgcattttaat

SEQ ID NO: 1001137 - DNA, 22 bp, Artificial Sequence
  chemically synthesized
ggctattttcaaagattaaaat

SEQ ID NO: 1001138 - DNA, 22 bp, Artificial Sequence
  chemically synthesized
ccagtttcgcattttaatcttt

SEQ ID NO: 1001139 - DNA, 22 bp, Artificial Sequence
  chemically synthesized
cagtttcgcattttaatctttg

SEQ ID NO: 1001140 - DNA, 22 bp, Artificial Sequence
  chemically synthesized
tggctaggctattttcaaagat

SEQ ID NO: 1001141 - DNA, 22 bp, Artificial Sequence
  chemically synthesized
cgcattttaatctttgaaaata

SEQ ID NO: 1001142 - DNA, 22 bp, Artificial Sequence
  chemically synthesized
gcattttaatctttgaaaatag

SEQ ID NO: 1001143 - DNA, 22 bp, Artificial Sequence
  chemically synthesized
cctgtggctaggctattttcaa

SEQ ID NO: 1001144 - DNA, 22 bp, Artificial Sequence
  chemically synthesized
gcctgtggctaggctattttca

SEQ ID NO: 1001145 - DNA, 22 bp, Artificial Sequence
  chemically synthesized
taatctttgaaaatagcctagc

SEQ ID NO: 1001146 - DNA, 22 bp, Artificial Sequence
  chemically synthesized
aatctttgaaaatagcctagcc

SEQ ID NO: 1001147 - DNA, 22 bp, Artificial Sequence
  chemically synthesized
caccttgcctgtggctaggcta

SEQ ID NO: 1001148 - DNA, 22 bp, Artificial Sequence
  chemically synthesized
atctttgaaaatagcctagcca

SEQ ID NO: 1001149 - DNA, 22 bp, Artificial Sequence
  chemically synthesized
agctgcaccttgcctgtggcta

SEQ ID NO: 1001150 - DNA, 22 bp, Artificial Sequence
  chemically synthesized
tgaaaatagcctagccacaggc

SEQ ID NO: 1001151 - DNA, 22 bp, Artificial Sequence
  chemically synthesized
cagctgcaccttgcctgtggct

SEQ ID NO: 1001152 - DNA, 22 bp, Artificial Sequence
  chemically synthesized
gaaaatagcctagccacaggca

SEQ ID NO: 1001153 - DNA, 22 bp, Artificial Sequence
  chemically synthesized
tcagctgcaccttgcctgtggc

SEQ ID NO: 1001154 - DNA, 22 bp, Artificial Sequence
  chemically synthesized
aaaatagcctagccacaggcaa

SEQ ID NO: 1001155 - DNA, 22 bp, Artificial Sequence
  chemically synthesized
aagctttcagctgcaccttgcc

SEQ ID NO: 1001156 - DNA, 22 bp, Artificial Sequence
  chemically synthesized
gccacaggcaaggtgcagctga

SEQ ID NO: 1001157 - DNA, 22 bp, Artificial Sequence
  chemically synthesized
tcattgaagctttcagctgcac

SEQ ID NO: 1001158 - DNA, 22 bp, Artificial Sequence
  chemically synthesized
ggtgtgctgtcattgaagcttt

SEQ ID NO: 1001159 - DNA, 22 bp, Artificial Sequence
  chemically synthesized
aggtgtgctgtcattgaagctt

SEQ ID NO: 1001160 - DNA, 22 bp, Artificial Sequence
  chemically synthesized
taggtgtgctgtcattgaagct

SEQ ID NO: 1001161 - DNA, 22 bp, Artificial Sequence
  chemically synthesized
ccattttaggtgtgctgtcatt

SEQ ID NO: 1001162 - DNA, 22 bp, Artificial Sequence
  chemically synthesized
aaagcttcaatgacagcacacc

SEQ ID NO: 1001163 - DNA, 22 bp, Artificial Sequence
  chemically synthesized
acaggcctcccattttaggtgt

SEQ ID NO: 1001164 - DNA, 22 bp, Artificial Sequence
  chemically synthesized
caatgacagcacacctaaaatg

SEQ ID NO: 1001165 - DNA, 22 bp, Artificial Sequence
  chemically synthesized
aatgacagcacacctaaaatgg

SEQ ID NO: 1001166 - DNA, 22 bp, Artificial Sequence
  chemically synthesized
atatgtcaaatctgacaggcct

SEQ ID NO: 1001167 - DNA, 22 bp, Artificial Sequence
  chemically synthesized
catatgtcaaatctgacaggcc

SEQ ID NO: 1001168 - DNA, 22 bp, Artificial Sequence
  chemically synthesized
aaatgggaggcctgtcagattt

SEQ ID NO: 1001169 - DNA, 22 bp, Artificial Sequence
  chemically synthesized
tcagatttgacatatgaagtgg

SEQ ID NO: 1001170 - DNA, 22 bp, Artificial Sequence
  chemically synthesized
gaagccaaaccaccacttcata

SEQ ID NO: 1001171 - DNA, 22 bp, Artificial Sequence
  chemically synthesized
ctggaagccaaaccaccacttc

SEQ ID NO: 1001172 - DNA, 22 bp, Artificial Sequence
  chemically synthesized
gctggaagccaaaccaccactt

SEQ ID NO: 1001173 - DNA, 22 bp, Artificial Sequence
  chemically synthesized
tgctggaagccaaaccaccact

SEQ ID NO: 1001174 - DNA, 22 bp, Artificial Sequence
  chemically synthesized
gacatatgaagtggtggtttgg

SEQ ID NO: 1001175 - DNA, 22 bp, Artificial Sequence
  chemically synthesized
acatatgaagtggtggtttggc

SEQ ID NO: 1001176 - DNA, 22 bp, Artificial Sequence
  chemically synthesized
ggcttccagcaaagctttgtcc

SEQ ID NO: 1001177 - DNA, 22 bp, Artificial Sequence
  chemically synthesized
gcttccagcaaagctttgtcca

SEQ ID NO: 1001178 - DNA, 22 bp, Artificial Sequence
  chemically synthesized
ccagcaaagctttgtccattat

SEQ ID NO: 1001179 - DNA, 22 bp, Artificial Sequence
  chemically synthesized
cagcaaagctttgtccattatg

SEQ ID NO: 1001180 - DNA, 22 bp, Artificial Sequence
  chemically synthesized
tgtccattatgctccctctctt

SEQ ID NO: 1001181 - DNA, 22 bp, Artificial Sequence
  chemically synthesized
gtccattatgctccctctcttg

SEQ ID NO: 1001182 - DNA, 22 bp, Artificial Sequence
  chemically synthesized
tccattatgctccctctcttgt

SEQ ID NO: 1001183 - DNA, 22 bp, Artificial Sequence
  chemically synthesized
gagggagaggtgaacaagagag

SEQ ID NO: 1001184 - DNA, 22 bp, Artificial Sequence
  chemically synthesized
tgctccctctcttgttcacctc

SEQ ID NO: 1001185 - DNA, 22 bp, Artificial Sequence
  chemically synthesized
cctctcttgttcacctctccct

SEQ ID NO: 1001186 - DNA, 22 bp, Artificial Sequence
  chemically synthesized
tcttgttcacctctccctctag

SEQ ID NO: 1001187 - DNA, 22 bp, Artificial Sequence
  chemically synthesized
ttgttcacctctccctctagct

SEQ ID NO: 1001188 - DNA, 22 bp, Artificial Sequence
  chemically synthesized
acagtggaagaaaagctagagg

SEQ ID NO: 1001189 - DNA, 22 bp, Artificial Sequence
  chemically synthesized
gttcacctctccctctagcttt

SEQ ID NO: 1001190 - DNA, 22 bp, Artificial Sequence
  chemically synthesized
ttcacctctccctctagctttt

SEQ ID NO: 1001191 - DNA, 22 bp, Artificial Sequence
  chemically synthesized
tgacagtggaagaaaagctaga

SEQ ID NO: 1001192 - DNA, 22 bp, Artificial Sequence
  chemically synthesized
tctgacagtggaagaaaagcta

SEQ ID NO: 1001193 - DNA, 22 bp, Artificial Sequence
  chemically synthesized
acctctccctctagcttttctt

SEQ ID NO: 1001194 - DNA, 22 bp, Artificial Sequence
  chemically synthesized
agctctctgacagtggaagaaa

SEQ ID NO: 1001195 - DNA, 22 bp, Artificial Sequence
  chemically synthesized
tccctctagcttttcttccact

SEQ ID NO: 1001196 - DNA, 22 bp, Artificial Sequence
  chemically synthesized
cagctctctgacagtggaagaa

SEQ ID NO: 1001197 - DNA, 22 bp, Artificial Sequence
  chemically synthesized
cctctagcttttcttccactgt

SEQ ID NO: 1001198 - DNA, 22 bp, Artificial Sequence
  chemically synthesized
tagcttttcttccactgtcaga

SEQ ID NO: 1001199 - DNA, 22 bp, Artificial Sequence
  chemically synthesized
gcatttcagctctctgacagtg

SEQ ID NO: 1001200 - DNA, 22 bp, Artificial Sequence
  chemically synthesized
gcttttcttccactgtcagaga

SEQ ID NO: 1001201 - DNA, 22 bp, Artificial Sequence
  chemically synthesized
ttcgcatttcagctctctgaca

SEQ ID NO: 1001202 - DNA, 22 bp, Artificial Sequence
  chemically synthesized
ttcttccactgtcagagagctg

SEQ ID NO: 1001203 - DNA, 22 bp, Artificial Sequence
  chemically synthesized
tcttccactgtcagagagctga

SEQ ID NO: 1001204 - DNA, 22 bp, Artificial Sequence
  chemically synthesized
cttccactgtcagagagctgaa

SEQ ID NO: 1001205 - DNA, 22 bp, Artificial Sequence
  chemically synthesized
ttccactgtcagagagctgaaa

SEQ ID NO: 1001206 - DNA, 22 bp, Artificial Sequence
  chemically synthesized
ccactgtcagagagctgaaatg

SEQ ID NO: 1001207 - DNA, 22 bp, Artificial Sequence
  chemically synthesized
cactgtcagagagctgaaatgc

SEQ ID NO: 1001208 - DNA, 22 bp, Artificial Sequence
  chemically synthesized
gagtagaattattcgcatttca

SEQ ID NO: 1001209 - DNA, 22 bp, Artificial Sequence
  chemically synthesized
tcagagagctgaaatgcgaata

SEQ ID NO: 1001210 - DNA, 22 bp, Artificial Sequence
  chemically synthesized
ctggagtagaattattcgcatt

SEQ ID NO: 1001211 - DNA, 22 bp, Artificial Sequence
  chemically synthesized
cctggagtagaattattcgcat

SEQ ID NO: 1001212 - DNA, 22 bp, Artificial Sequence
  chemically synthesized
aaatgcgaataattctactcca

SEQ ID NO: 1001213 - DNA, 22 bp, Artificial Sequence
  chemically synthesized
tgtgaaatatgtttcctggagt

SEQ ID NO: 1001214 - DNA, 22 bp, Artificial Sequence
  chemically synthesized
tagaaattatgtgaaatatgtt

SEQ ID NO: 1001215 - DNA, 22 bp, Artificial Sequence
  chemically synthesized
tactccaggaaacatatttcac

SEQ ID NO: 1001216 - DNA, 22 bp, Artificial Sequence
  chemically synthesized
ctccaggaaacatatttcacat

SEQ ID NO: 1001217 - DNA, 22 bp, Artificial Sequence
  chemically synthesized
gtgttatagaaattatgtgaaa

SEQ ID NO: 1001218 - DNA, 22 bp, Artificial Sequence
  chemically synthesized
caggaaacatatttcacataat

SEQ ID NO: 1001219 - DNA, 22 bp, Artificial Sequence
  chemically synthesized
ggtgttatagaaattatgtgaa

SEQ ID NO: 1001220 - DNA, 22 bp, Artificial Sequence
  chemically synthesized
atttggtgttatagaaattatg

SEQ ID NO: 1001221 - DNA, 22 bp, Artificial Sequence
  chemically synthesized
catttggtgttatagaaattat

SEQ ID NO: 1001222 - DNA, 22 bp, Artificial Sequence
  chemically synthesized
tcatttggtgttatagaaatta

SEQ ID NO: 1001223 - DNA, 22 bp, Artificial Sequence
  chemically synthesized
ttcatttggtgttatagaaatt

SEQ ID NO: 1001224 - DNA, 22 bp, Artificial Sequence
  chemically synthesized
cacataatttctataacaccaa

SEQ ID NO: 1001225 - DNA, 22 bp, Artificial Sequence
  chemically synthesized
aaggcttttcatttggtgttat

SEQ ID NO: 1001226 - DNA, 22 bp, Artificial Sequence
  chemically synthesized
acataatttctataacaccaaa

SEQ ID NO: 1001227 - DNA, 22 bp, Artificial Sequence
  chemically synthesized
ctataacaccaaatgaaaagcc

SEQ ID NO: 1001228 - DNA, 22 bp, Artificial Sequence
  chemically synthesized
tataacaccaaatgaaaagcct

SEQ ID NO: 1001229 - DNA, 22 bp, Artificial Sequence
  chemically synthesized
taacaccaaatgaaaagccttt

SEQ ID NO: 1001230 - DNA, 22 bp, Artificial Sequence
  chemically synthesized
tgataatatagtctaaaggctt

SEQ ID NO: 1001231 - DNA, 22 bp, Artificial Sequence
  chemically synthesized
tatgataatatagtctaaaggc

SEQ ID NO: 1001232 - DNA, 22 bp, Artificial Sequence
  chemically synthesized
ctatgataatatagtctaaagg

SEQ ID NO: 1001233 - DNA, 22 bp, Artificial Sequence
  chemically synthesized
gcttctatgataatatagtcta

SEQ ID NO: 1001234 - DNA, 22 bp, Artificial Sequence
  chemically synthesized
aataaggactagcttctatgat

SEQ ID NO: 1001235 - DNA, 22 bp, Artificial Sequence
  chemically synthesized
tagactatattatcatagaagc

SEQ ID NO: 1001236 - DNA, 22 bp, Artificial Sequence
  chemically synthesized
agactatattatcatagaagct

SEQ ID NO: 1001237 - DNA, 22 bp, Artificial Sequence
  chemically synthesized
gactatattatcatagaagcta

SEQ ID NO: 1001238 - DNA, 22 bp, Artificial Sequence
  chemically synthesized
gtgttaaataaggactagcttc

SEQ ID NO: 1001239 - DNA, 22 bp, Artificial Sequence
  chemically synthesized
tattatcatagaagctagtcct

SEQ ID NO: 1001240 - DNA, 22 bp, Artificial Sequence
  chemically synthesized
tcatagaagctagtccttattt

SEQ ID NO: 1001241 - DNA, 22 bp, Artificial Sequence
  chemically synthesized
catatccaataaaatctggtgt

SEQ ID NO: 1001242 - DNA, 22 bp, Artificial Sequence
  chemically synthesized
gtccttatttaacaccagattt

SEQ ID NO: 1001243 - DNA, 22 bp, Artificial Sequence
  chemically synthesized
atttaacaccagattttattgg

SEQ ID NO: 1001244 - DNA, 22 bp, Artificial Sequence
  chemically synthesized
tttaacaccagattttattgga

SEQ ID NO: 1001245 - DNA, 22 bp, Artificial Sequence
  chemically synthesized
aacaccagattttattggatat

SEQ ID NO: 1001246 - DNA, 22 bp, Artificial Sequence
  chemically synthesized
acaccagattttattggatatg

SEQ ID NO: 1001247 - DNA, 22 bp, Artificial Sequence
  chemically synthesized
tattggatatgtaattttatat

SEQ ID NO: 1001248 - DNA, 22 bp, Artificial Sequence
  chemically synthesized
attggatatgtaattttatata

SEQ ID NO: 1001249 - DNA, 22 bp, Artificial Sequence
  chemically synthesized
ttggatatgtaattttatatac

SEQ ID NO: 1001250 - DNA, 22 bp, Artificial Sequence
  chemically synthesized
gatatgtaattttatatacata

SEQ ID NO: 1001251 - DNA, 22 bp, Artificial Sequence
  chemically synthesized
ggtagaggtatgtaatacaata

SEQ ID NO: 1001252 - DNA, 22 bp, Artificial Sequence
  chemically synthesized
aggtagaggtatgtaatacaat

SEQ ID NO: 1001253 - DNA, 22 bp, Artificial Sequence
  chemically synthesized
tatatacatattgtattacata

SEQ ID NO: 1001254 - DNA, 22 bp, Artificial Sequence
  chemically synthesized
atatacatattgtattacatac

SEQ ID NO: 1001255 - DNA, 22 bp, Artificial Sequence
  chemically synthesized
tatacatattgtattacatacc

SEQ ID NO: 1001256 - DNA, 22 bp, Artificial Sequence
  chemically synthesized
tatttaggtagaggtatgtaat

SEQ ID NO: 1001257 - DNA, 22 bp, Artificial Sequence
  chemically synthesized
tgtatttaggtagaggtatgta

SEQ ID NO: 1001258 - DNA, 22 bp, Artificial Sequence
  chemically synthesized
ctgtatttaggtagaggtatgt

SEQ ID NO: 1001259 - DNA, 22 bp, Artificial Sequence
  chemically synthesized
tattacatacctctacctaaat

SEQ ID NO: 1001260 - DNA, 22 bp, Artificial Sequence
  chemically synthesized
taaagtatttctgtatttaggt

SEQ ID NO: 1001261 - DNA, 22 bp, Artificial Sequence
  chemically synthesized
catacctctacctaaatacaga

SEQ ID NO: 1001262 - DNA, 22 bp, Artificial Sequence
  chemically synthesized
tacctaaatacagaaatacttt

SEQ ID NO: 1001263 - DNA, 22 bp, Artificial Sequence
  chemically synthesized
cctaaatacagaaatactttac

SEQ ID NO: 1001264 - DNA, 22 bp, Artificial Sequence
  chemically synthesized
cacataataaggctgtaaagta

SEQ ID NO: 1001265 - DNA, 22 bp, Artificial Sequence
  chemically synthesized
aatacagaaatactttacagcc

SEQ ID NO: 1001266 - DNA, 22 bp, Artificial Sequence
  chemically synthesized
ttacacataataaggctgtaaa

SEQ ID NO: 1001267 - DNA, 22 bp, Artificial Sequence
  chemically synthesized
attacacataataaggctgtaa

SEQ ID NO: 1001268 - DNA, 22 bp, Artificial Sequence
  chemically synthesized
tattacacataataaggctgta

SEQ ID NO: 1001269 - DNA, 22 bp, Artificial Sequence
  chemically synthesized
ttattacacataataaggctgt

SEQ ID NO: 1001270 - DNA, 22 bp, Artificial Sequence
  chemically synthesized
tttattacacataataaggctg

SEQ ID NO: 1001271 - DNA, 22 bp, Artificial Sequence
  chemically synthesized
ttttattacacataataaggct

SEQ ID NO: 1001272 - DNA, 22 bp, Artificial Sequence
  chemically synthesized
gatttttttattacacataata

SEQ ID NO: 1001273 - DNA, 22 bp, Artificial Sequence
  chemically synthesized
tacagccttattatgtgtaata

SEQ ID NO: 1001274 - DNA, 22 bp, Artificial Sequence
  chemically synthesized
acagccttattatgtgtaataa

SEQ ID NO: 1001275 - DNA, 22 bp, Artificial Sequence
  chemically synthesized
cagccttattatgtgtaataaa

SEQ ID NO: 1001276 - DNA, 22 bp, Artificial Sequence
  chemically synthesized
agaagatgttagatttttttat

SEQ ID NO: 1001277 - DNA, 22 bp, Artificial Sequence
  chemically synthesized
gagaagatgttagattttttta

SEQ ID NO: 1001278 - DNA, 22 bp, Artificial Sequence
  chemically synthesized
attatgtgtaataaaaaaatct

SEQ ID NO: 1001279 - DNA, 22 bp, Artificial Sequence
  chemically synthesized
ttatgtgtaataaaaaaatcta

SEQ ID NO: 1001280 - DNA, 22 bp, Artificial Sequence
  chemically synthesized
tgtgtaataaaaaaatctaaca

SEQ ID NO: 1001281 - DNA, 22 bp, Artificial Sequence
  chemically synthesized
caatgtggcttgagaagatgtt

SEQ ID NO: 1001282 - DNA, 22 bp, Artificial Sequence
  chemically synthesized
ccatctgcaatgtggcttgaga

SEQ ID NO: 1001283 - DNA, 22 bp, Artificial Sequence
  chemically synthesized
acatcttctcaagccacattgc

SEQ ID NO: 1001284 - DNA, 22 bp, Artificial Sequence
  chemically synthesized
ctcaagccacattgcagatggt

SEQ ID NO: 1001285 - DNA, 22 bp, Artificial Sequence
  chemically synthesized
tcaagccacattgcagatggta

SEQ ID NO: 1001286 - DNA, 22 bp, Artificial Sequence
  chemically synthesized
aagccacattgcagatggtagt

SEQ ID NO: 1001287 - DNA, 22 bp, Artificial Sequence
  chemically synthesized
atgaggcaccatccagataata

SEQ ID NO: 1001288 - DNA, 22 bp, Artificial Sequence
  chemically synthesized
cagatggtagtattatctggat

SEQ ID NO: 1001289 - DNA, 22 bp, Artificial Sequence
  chemically synthesized
ttcatgaggcaccatccagata

SEQ ID NO: 1001290 - DNA, 22 bp, Artificial Sequence
  chemically synthesized
gttcatgaggcaccatccagat

SEQ ID NO: 1001291 - DNA, 22 bp, Artificial Sequence
  chemically synthesized
aagtttgttcatgaggcaccat

SEQ ID NO: 1001292 - DNA, 22 bp, Artificial Sequence
  chemically synthesized
gaagtttgttcatgaggcacca

SEQ ID NO: 1001293 - DNA, 22 bp, Artificial Sequence
  chemically synthesized
tgaagtttgttcatgaggcacc

SEQ ID NO: 1001294 - DNA, 22 bp, Artificial Sequence
  chemically synthesized
ttgaagtttgttcatgaggcac

SEQ ID NO: 1001295 - DNA, 22 bp, Artificial Sequence
  chemically synthesized
cttttgaagtttgttcatgagg

SEQ ID NO: 1001296 - DNA, 22 bp, Artificial Sequence
  chemically synthesized
tctggatggtgcctcatgaaca

SEQ ID NO: 1001297 - DNA, 22 bp, Artificial Sequence
  chemically synthesized
ccttttgaagtttgttcatgag

SEQ ID NO: 1001298 - DNA, 22 bp, Artificial Sequence
  chemically synthesized
gatggtgcctcatgaacaaact

SEQ ID NO: 1001299 - DNA, 22 bp, Artificial Sequence
  chemically synthesized
acatcaacatttccttttgaag

SEQ ID NO: 1001300 - DNA, 22 bp, Artificial Sequence
  chemically synthesized
tcacatcaacatttccttttga

SEQ ID NO: 1001301 - DNA, 22 bp, Artificial Sequence
  chemically synthesized
atgaacaaacttcaaaaggaaa

SEQ ID NO: 1001302 - DNA, 22 bp, Artificial Sequence
  chemically synthesized
ctcacatcaacatttccttttg

SEQ ID NO: 1001303 - DNA, 22 bp, Artificial Sequence
  chemically synthesized
caaaaggaaatgttgatgtgag

SEQ ID NO: 1001304 - DNA, 22 bp, Artificial Sequence
  chemically synthesized
aaaaggaaatgttgatgtgaga

SEQ ID NO: 1001305 - DNA, 22 bp, Artificial Sequence
  chemically synthesized
ccagaaccataggaatcttctc

SEQ ID NO: 1001306 - DNA, 22 bp, Artificial Sequence
  chemically synthesized
accagaaccataggaatcttct

SEQ ID NO: 1001307 - DNA, 22 bp, Artificial Sequence
  chemically synthesized
atgtgagaagattcctatggtt

SEQ ID NO: 1001308 - DNA, 22 bp, Artificial Sequence
  chemically synthesized
ctatggttctggtaagactcta

SEQ ID NO: 1001309 - DNA, 22 bp, Artificial Sequence
  chemically synthesized
gggggagggggatgtagagtct

SEQ ID NO: 1001310 - DNA, 22 bp, Artificial Sequence
  chemically synthesized
tggttctggtaagactctacat

SEQ ID NO: 1001311 - DNA, 22 bp, Artificial Sequence
  chemically synthesized
tggtaagactctacatccccct

SEQ ID NO: 1001312 - DNA, 22 bp, Artificial Sequence
  chemically synthesized
gtaagactctacatccccctcc

SEQ ID NO: 1001313 - DNA, 22 bp, Artificial Sequence
  chemically synthesized
cacagacctggggggaggggga

SEQ ID NO: 1001314 - DNA, 22 bp, Artificial Sequence
  chemically synthesized
ttccacagacctggggggaggg

SEQ ID NO: 1001315 - DNA, 22 bp, Artificial Sequence
  chemically synthesized
tacatccccctccccccaggtc

SEQ ID NO: 1001316 - DNA, 22 bp, Artificial Sequence
  chemically synthesized
catccccctccccccaggtctg

SEQ ID NO: 1001317 - DNA, 22 bp, Artificial Sequence
  chemically synthesized
tacattattccacagacctggg

SEQ ID NO: 1001318 - DNA, 22 bp, Artificial Sequence
  chemically synthesized
tatgcctatacattattccaca

SEQ ID NO: 1001319 - DNA, 22 bp, Artificial Sequence
  chemically synthesized
atatgcctatacattattccac

SEQ ID NO: 1001320 - DNA, 22 bp, Artificial Sequence
  chemically synthesized
cccccaggtctgtggaataatg

SEQ ID NO: 1001321 - DNA, 22 bp, Artificial Sequence
  chemically synthesized
tttatatgcctatacattattc

SEQ ID NO: 1001322 - DNA, 22 bp, Artificial Sequence
  chemically synthesized
tggaataatgtataggcatata

SEQ ID NO: 1001323 - DNA, 22 bp, Artificial Sequence
  chemically synthesized
atgccatgtatgtactgtttat

SEQ ID NO: 1001324 - DNA, 22 bp, Artificial Sequence
  chemically synthesized
taacaattgatgccatgtatgt

SEQ ID NO: 1001325 - DNA, 22 bp, Artificial Sequence
  chemically synthesized
aacacgcacacacatatatatg

SEQ ID NO: 1001326 - DNA, 22 bp, Artificial Sequence
  chemically synthesized
aaacacgcacacacatatatat

SEQ ID NO: 1001327 - DNA, 22 bp, Artificial Sequence
  chemically synthesized
ttataaccatatatatgtgtgt

SEQ ID NO: 1001328 - DNA, 22 bp, Artificial Sequence
  chemically synthesized
taaccatatatatgtgtgtgcg

SEQ ID NO: 1001329 - DNA, 22 bp, Artificial Sequence
  chemically synthesized
atacaatttaaacacgcacaca

SEQ ID NO: 1001330 - DNA, 22 bp, Artificial Sequence
  chemically synthesized
ttaatacaatttaaacacgcac

SEQ ID NO: 1001331 - DNA, 22 bp, Artificial Sequence
  chemically synthesized
attaatacaatttaaacacgca

SEQ ID NO: 1001332 - DNA, 22 bp, Artificial Sequence
  chemically synthesized
agtgtataaaaaaatcttatta

SEQ ID NO: 1001333 - DNA, 22 bp, Artificial Sequence
  chemically synthesized
aaattgtattaataagattttt

SEQ ID NO: 1001334 - DNA, 22 bp, Artificial Sequence
  chemically synthesized
aattgtattaataagatttttt

SEQ ID NO: 1001335 - DNA, 22 bp, Artificial Sequence
  chemically synthesized
ggtgctgagtgtataaaaaaat

SEQ ID NO: 1001336 - DNA, 22 bp, Artificial Sequence
  chemically synthesized
tattaataagatttttttatac

SEQ ID NO: 1001337 - DNA, 22 bp, Artificial Sequence
  chemically synthesized
ttaggtgctgagtgtataaaaa

SEQ ID NO: 1001338 - DNA, 22 bp, Artificial Sequence
  chemically synthesized
ataagatttttttatacactca

SEQ ID NO: 1001339 - DNA, 22 bp, Artificial Sequence
  chemically synthesized
gacactgttaggtgctgagtgt

SEQ ID NO: 1001340 - DNA, 22 bp, Artificial Sequence
  chemically synthesized
ttttatacactcagcacctaac

SEQ ID NO: 1001341 - DNA, 22 bp, Artificial Sequence
  chemically synthesized
tttatacactcagcacctaaca

SEQ ID NO: 1001342 - DNA, 22 bp, Artificial Sequence
  chemically synthesized
ttatacactcagcacctaacag

SEQ ID NO: 1001343 - DNA, 22 bp, Artificial Sequence
  chemically synthesized
tatacactcagcacctaacagt

SEQ ID NO: 1001344 - DNA, 22 bp, Artificial Sequence
  chemically synthesized
atacactcagcacctaacagtg

SEQ ID NO: 1001345 - DNA, 22 bp, Artificial Sequence
  chemically synthesized
tacactcagcacctaacagtgt

SEQ ID NO: 1001346 - DNA, 22 bp, Artificial Sequence
  chemically synthesized
agcacctaacagtgtctaacac

SEQ ID NO: 1001347 - DNA, 22 bp, Artificial Sequence
  chemically synthesized
gaagatataaaatgtgttagac

SEQ ID NO: 1001348 - DNA, 22 bp, Artificial Sequence
  chemically synthesized
ttggaagatataaaatgtgtta

SEQ ID NO: 1001349 - DNA, 22 bp, Artificial Sequence
  chemically synthesized
attggaagatataaaatgtgtt

SEQ ID NO: 1001350 - DNA, 22 bp, Artificial Sequence
  chemically synthesized
acagtgtctaacacattttata

SEQ ID NO: 1001351 - DNA, 22 bp, Artificial Sequence
  chemically synthesized
atttattggaagatataaaatg

SEQ ID NO: 1001352 - DNA, 22 bp, Artificial Sequence
  chemically synthesized
attcatttattggaagatataa

SEQ ID NO: 1001353 - DNA, 22 bp, Artificial Sequence
  chemically synthesized
cattcatttattggaagatata

SEQ ID NO: 1001354 - DNA, 22 bp, Artificial Sequence
  chemically synthesized
cttcattcatttattggaagat

SEQ ID NO: 1001355 - DNA, 22 bp, Artificial Sequence
  chemically synthesized
acacattttatatcttccaata

SEQ ID NO: 1001356 - DNA, 22 bp, Artificial Sequence
  chemically synthesized
gcttcattcatttattggaaga

SEQ ID NO: 1001357 - DNA, 22 bp, Artificial Sequence
  chemically synthesized
atttgcttcattcatttattgg

SEQ ID NO: 1001358 - DNA, 22 bp, Artificial Sequence
  chemically synthesized
catttgcttcattcatttattg

SEQ ID NO: 1001359 - DNA, 22 bp, Artificial Sequence
  chemically synthesized
tcatttgcttcattcatttatt

SEQ ID NO: 1001360 - DNA, 22 bp, Artificial Sequence
  chemically synthesized
tatatcttccaataaatgaatg

SEQ ID NO: 1001361 - DNA, 22 bp, Artificial Sequence
  chemically synthesized
atatcttccaataaatgaatga

SEQ ID NO: 1001362 - DNA, 22 bp, Artificial Sequence
  chemically synthesized
tatcttccaataaatgaatgaa

SEQ ID NO: 1001363 - DNA, 22 bp, Artificial Sequence
  chemically synthesized
atgttttcatttgcttcattca

SEQ ID NO: 1001364 - DNA, 22 bp, Artificial Sequence
  chemically synthesized
ctgatgttttcatttgcttcat

SEQ ID NO: 1001365 - DNA, 22 bp, Artificial Sequence
  chemically synthesized
ccaataaatgaatgaagcaaat

SEQ ID NO: 1001366 - DNA, 22 bp, Artificial Sequence
  chemically synthesized
actgatgttttcatttgcttca

SEQ ID NO: 1001367 - DNA, 22 bp, Artificial Sequence
  chemically synthesized
caataaatgaatgaagcaaatg

SEQ ID NO: 1001368 - DNA, 22 bp, Artificial Sequence
  chemically synthesized
tttactgatgttttcatttgct

SEQ ID NO: 1001369 - DNA, 22 bp, Artificial Sequence
  chemically synthesized
tgtttactgatgttttcatttg

SEQ ID NO: 1001370 - DNA, 22 bp, Artificial Sequence
  chemically synthesized
ctgtttactgatgttttcattt

SEQ ID NO: 1001371 - DNA, 22 bp, Artificial Sequence
  chemically synthesized
tctgtttactgatgttttcatt

SEQ ID NO: 1001372 - DNA, 22 bp, Artificial Sequence
  chemically synthesized
ttctgtttactgatgttttcat

SEQ ID NO: 1001373 - DNA, 22 bp, Artificial Sequence
  chemically synthesized
tttctgtttactgatgttttca

SEQ ID NO: 1001374 - DNA, 22 bp, Artificial Sequence
  chemically synthesized
ttttctgtttactgatgttttc

SEQ ID NO: 1001375 - DNA, 22 bp, Artificial Sequence
  chemically synthesized
tttttttctgtttactgatgtt

SEQ ID NO: 1001376 - DNA, 22 bp, Artificial Sequence
  chemically synthesized
aataaaatgcctgtttttttct

SEQ ID NO: 1001377 - DNA, 22 bp, Artificial Sequence
  chemically synthesized
aagtaaactgaataaaatgcct

SEQ ID NO: 1001378 - DNA, 22 bp, Artificial Sequence
  chemically synthesized
aaattaaagtaaactgaataaa

SEQ ID NO: 1001379 - DNA, 22 bp, Artificial Sequence
  chemically synthesized
tattcagtttactttaatttga

SEQ ID NO: 1001380 - DNA, 22 bp, Artificial Sequence
  chemically synthesized
attcagtttactttaatttgag

SEQ ID NO: 1001381 - DNA, 22 bp, Artificial Sequence
  chemically synthesized
ttcagtttactttaatttgagt

SEQ ID NO: 1001382 - DNA, 22 bp, Artificial Sequence
  chemically synthesized
caaccaaacaccactcaaatta

SEQ ID NO: 1001383 - DNA, 22 bp, Artificial Sequence
  chemically synthesized
agtttactttaatttgagtggt

SEQ ID NO: 1001384 - DNA, 22 bp, Artificial Sequence
  chemically synthesized
actttaatttgagtggtgtttg

SEQ ID NO: 1001385 - DNA, 22 bp, Artificial Sequence
  chemically synthesized
ctttaatttgagtggtgtttgg

SEQ ID NO: 1001386 - DNA, 22 bp, Artificial Sequence
  chemically synthesized
tcagatattacaaccaaacacc

SEQ ID NO: 1001387 - DNA, 22 bp, Artificial Sequence
  chemically synthesized
gtcagatattacaaccaaacac

SEQ ID NO: 1001388 - DNA, 22 bp, Artificial Sequence
  chemically synthesized
taatttgagtggtgtttggttg

SEQ ID NO: 1001389 - DNA, 22 bp, Artificial Sequence
  chemically synthesized
tgtcagatattacaaccaaaca

SEQ ID NO: 1001390 - DNA, 22 bp, Artificial Sequence
  chemically synthesized
aatttgagtggtgtttggttgt

SEQ ID NO: 1001391 - DNA, 22 bp, Artificial Sequence
  chemically synthesized
ttgtcagatattacaaccaaac

SEQ ID NO: 1001392 - DNA, 22 bp, Artificial Sequence
  chemically synthesized
atttgagtggtgtttggttgta

SEQ ID NO: 1001393 - DNA, 22 bp, Artificial Sequence
  chemically synthesized
acttttgtcagatattacaacc

SEQ ID NO: 1001394 - DNA, 22 bp, Artificial Sequence
  chemically synthesized
gagtggtgtttggttgtaatat

SEQ ID NO: 1001395 - DNA, 22 bp, Artificial Sequence
  chemically synthesized
agtggtgtttggttgtaatatc

SEQ ID NO: 1001396 - DNA, 22 bp, Artificial Sequence
  chemically synthesized
aatagcactaacttttgtcaga

SEQ ID NO: 1001397 - DNA, 22 bp, Artificial Sequence
  chemically synthesized
ggttgtaatatctgacaaaagt

SEQ ID NO: 1001398 - DNA, 22 bp, Artificial Sequence
  chemically synthesized
gttgtaatatctgacaaaagtt

SEQ ID NO: 1001399 - DNA, 22 bp, Artificial Sequence
  chemically synthesized
taatatctgacaaaagttagtg

SEQ ID NO: 1001400 - DNA, 22 bp, Artificial Sequence
  chemically synthesized
aaccattaaatagcactaactt

SEQ ID NO: 1001401 - DNA, 22 bp, Artificial Sequence
  chemically synthesized
aaaccattaaatagcactaact

SEQ ID NO: 1001402 - DNA, 22 bp, Artificial Sequence
  chemically synthesized
taaaccattaaatagcactaac

SEQ ID NO: 1001403 - DNA, 22 bp, Artificial Sequence
  chemically synthesized
ttttaaaccattaaatagcact

SEQ ID NO: 1001404 - DNA, 22 bp, Artificial Sequence
  chemically synthesized
acaaaagttagtgctatttaat

SEQ ID NO: 1001405 - DNA, 22 bp, Artificial Sequence
  chemically synthesized
aattattttaaaccattaaata

SEQ ID NO: 1001406 - DNA, 22 bp, Artificial Sequence
  chemically synthesized
cacattaaattattttaaacca

SEQ ID NO: 1001407 - DNA, 22 bp, Artificial Sequence
  chemically synthesized
gtgctatttaatggtttaaaat

SEQ ID NO: 1001408 - DNA, 22 bp, Artificial Sequence
  chemically synthesized
tttaatggtttaaaataattta

SEQ ID NO: 1001409 - DNA, 22 bp, Artificial Sequence
  chemically synthesized
aatggtttaaaataatttaatg

SEQ ID NO: 1001410 - DNA, 22 bp, Artificial Sequence
  chemically synthesized
atggtttaaaataatttaatgt

SEQ ID NO: 1001411 - DNA, 22 bp, Artificial Sequence
  chemically synthesized
aaggggaaaactacacattaaa

SEQ ID NO: 1001412 - DNA, 22 bp, Artificial Sequence
  chemically synthesized
aaaggggaaaactacacattaa

SEQ ID NO: 1001413 - DNA, 22 bp, Artificial Sequence
  chemically synthesized
aaaataatttaatgtgtagttt

SEQ ID NO: 1001414 - DNA, 22 bp, Artificial Sequence
  chemically synthesized
aaataatttaatgtgtagtttt

SEQ ID NO: 1001415 - DNA, 22 bp, Artificial Sequence
  chemically synthesized
aatgtgtagttttcccctttaa

SEQ ID NO: 1001416 - DNA, 22 bp, Artificial Sequence
  chemically synthesized
atgtgtagttttcccctttaag

SEQ ID NO: 1001417 - DNA, 22 bp, Artificial Sequence
  chemically synthesized
tcccctttaagttttgccctgt

SEQ ID NO: 1001418 - DNA, 22 bp, Artificial Sequence
  chemically synthesized
cccctttaagttttgccctgta

SEQ ID NO: 1001419 - DNA, 22 bp, Artificial Sequence
  chemically synthesized
ccctttaagttttgccctgtat

SEQ ID NO: 1001420 - DNA, 22 bp, Artificial Sequence
  chemically synthesized
taagttttgccctgtatctttt

SEQ ID NO: 1001421 - DNA, 22 bp, Artificial Sequence
  chemically synthesized
acagaccatagcaaaagataca

SEQ ID NO: 1001422 - DNA, 22 bp, Artificial Sequence
  chemically synthesized
aagttttgccctgtatcttttg

SEQ ID NO: 1001423 - DNA, 22 bp, Artificial Sequence
  chemically synthesized
agttttgccctgtatcttttgc

SEQ ID NO: 1001424 - DNA, 22 bp, Artificial Sequence
  chemically synthesized
tagctgacagaccatagcaaaa

SEQ ID NO: 1001425 - DNA, 22 bp, Artificial Sequence
  chemically synthesized
tgccctgtatcttttgctatgg

SEQ ID NO: 1001426 - DNA, 22 bp, Artificial Sequence
  chemically synthesized
gccctgtatcttttgctatggt

SEQ ID NO: 1001427 - DNA, 22 bp, Artificial Sequence
  chemically synthesized
ccctgtatcttttgctatggtc

SEQ ID NO: 1001428 - DNA, 22 bp, Artificial Sequence
  chemically synthesized
tatcttttgctatggtctgtca

SEQ ID NO: 1001429 - DNA, 22 bp, Artificial Sequence
  chemically synthesized
aacaaattatagctgacagacc

SEQ ID NO: 1001430 - DNA, 22 bp, Artificial Sequence
  chemically synthesized
ttgctatggtctgtcagctata

SEQ ID NO: 1001431 - DNA, 22 bp, Artificial Sequence
  chemically synthesized
tgctatggtctgtcagctataa

SEQ ID NO: 1001432 - DNA, 22 bp, Artificial Sequence
  chemically synthesized
gctatggtctgtcagctataat

SEQ ID NO: 1001433 - DNA, 22 bp, Artificial Sequence
  chemically synthesized
ctatggtctgtcagctataatt

SEQ ID NO: 1001434 - DNA, 22 bp, Artificial Sequence
  chemically synthesized
tggtctgtcagctataatttgt

SEQ ID NO: 1001435 - DNA, 22 bp, Artificial Sequence
  chemically synthesized
cacaaaagattgaacaaattat

SEQ ID NO: 1001436 - DNA, 22 bp, Artificial Sequence
  chemically synthesized
tcagctataatttgttcaatct

SEQ ID NO: 1001437 - DNA, 22 bp, Artificial Sequence
  chemically synthesized
ggaagaaagctacacaaaagat

SEQ ID NO: 1001438 - DNA, 22 bp, Artificial Sequence
  chemically synthesized
taatttgttcaatcttttgtgt

SEQ ID NO: 1001439 - DNA, 22 bp, Artificial Sequence
  chemically synthesized
gttcaatcttttgtgtagcttt

SEQ ID NO: 1001440 - DNA, 22 bp, Artificial Sequence
  chemically synthesized
ttcaatcttttgtgtagctttc

SEQ ID NO: 1001441 - DNA, 22 bp, Artificial Sequence
  chemically synthesized
taagactgggaagaaagctaca

SEQ ID NO: 1001442 - DNA, 22 bp, Artificial Sequence
  chemically synthesized
gtaagactgggaagaaagctac

SEQ ID NO: 1001443 - DNA, 22 bp, Artificial Sequence
  chemically synthesized
aatcttttgtgtagctttcttc

SEQ ID NO: 1001444 - DNA, 22 bp, Artificial Sequence
  chemically synthesized
gacttgtaagactgggaagaaa

SEQ ID NO: 1001445 - DNA, 22 bp, Artificial Sequence
  chemically synthesized
ttgtgtagctttcttcccagtc

SEQ ID NO: 1001446 - DNA, 22 bp, Artificial Sequence
  chemically synthesized
tgtgtagctttcttcccagtct

SEQ ID NO: 1001447 - DNA, 22 bp, Artificial Sequence
  chemically synthesized
gtgtagctttcttcccagtctt

SEQ ID NO: 1001448 - DNA, 22 bp, Artificial Sequence
  chemically synthesized
tgtagctttcttcccagtctta

SEQ ID NO: 1001449 - DNA, 22 bp, Artificial Sequence
  chemically synthesized
cccaattagacttgtaagactg

SEQ ID NO: 1001450 - DNA, 22 bp, Artificial Sequence
  chemically synthesized
ccccaattagacttgtaagact

SEQ ID NO: 1001451 - DNA, 22 bp, Artificial Sequence
  chemically synthesized
tccccaattagacttgtaagac

SEQ ID NO: 1001452 - DNA, 22 bp, Artificial Sequence
  chemically synthesized
ctttccccaattagacttgtaa

SEQ ID NO: 1001453 - DNA, 22 bp, Artificial Sequence
  chemically synthesized
tcttcccagtcttacaagtcta

SEQ ID NO: 1001454 - DNA, 22 bp, Artificial Sequence
  chemically synthesized
actttccccaattagacttgta

SEQ ID NO: 1001455 - DNA, 22 bp, Artificial Sequence
  chemically synthesized
cttcccagtcttacaagtctaa

SEQ ID NO: 1001456 - DNA, 22 bp, Artificial Sequence
  chemically synthesized
ttcccagtcttacaagtctaat

SEQ ID NO: 1001457 - DNA, 22 bp, Artificial Sequence
  chemically synthesized
cccagtcttacaagtctaattg

SEQ ID NO: 1001458 - DNA, 22 bp, Artificial Sequence
  chemically synthesized
ccttactttccccaattagact

SEQ ID NO: 1001459 - DNA, 22 bp, Artificial Sequence
  chemically synthesized
ccagtcttacaagtctaattgg

SEQ ID NO: 1001460 - DNA, 22 bp, Artificial Sequence
  chemically synthesized
attcccttactttccccaatta

SEQ ID NO: 1001461 - DNA, 22 bp, Artificial Sequence
  chemically synthesized
ttaattcccttactttccccaa

SEQ ID NO: 1001462 - DNA, 22 bp, Artificial Sequence
  chemically synthesized
acaagtctaattggggaaagta

SEQ ID NO: 1001463 - DNA, 22 bp, Artificial Sequence
  chemically synthesized
caagtctaattggggaaagtaa

SEQ ID NO: 1001464 - DNA, 22 bp, Artificial Sequence
  chemically synthesized
atcattgttaattcccttactt

SEQ ID NO: 1001465 - DNA, 22 bp, Artificial Sequence
  chemically synthesized
gatcattgttaattcccttact

SEQ ID NO: 1001466 - DNA, 22 bp, Artificial Sequence
  chemically synthesized
tgatcattgttaattcccttac

SEQ ID NO: 1001467 - DNA, 22 bp, Artificial Sequence
  chemically synthesized
ttgatcattgttaattccctta

SEQ ID NO: 1001468 - DNA, 22 bp, Artificial Sequence
  chemically synthesized
attggggaaagtaagggaatta

SEQ ID NO: 1001469 - DNA, 22 bp, Artificial Sequence
  chemically synthesized
gggaaagtaagggaattaacaa

SEQ ID NO: 1001470 - DNA, 22 bp, Artificial Sequence
  chemically synthesized
gaaaaagaatagacttttgatc

SEQ ID NO: 1001471 - DNA, 22 bp, Artificial Sequence
  chemically synthesized
agaaaaagaatagacttttgat

SEQ ID NO: 1001472 - DNA, 22 bp, Artificial Sequence
  chemically synthesized
acaatgatcaaaagtctattct

SEQ ID NO: 1001473 - DNA, 22 bp, Artificial Sequence
  chemically synthesized
aaagatatgtgaatgtttagaa

SEQ ID NO: 1001474 - DNA, 22 bp, Artificial Sequence
  chemically synthesized
ttctttttctaaacattcacat

SEQ ID NO: 1001475 - DNA, 22 bp, Artificial Sequence
  chemically synthesized
tttttctaaacattcacatatc

SEQ ID NO: 1001476 - DNA, 22 bp, Artificial Sequence
  chemically synthesized
tagagattcaaagatatgtgaa

SEQ ID NO: 1001477 - DNA, 22 bp, Artificial Sequence
  chemically synthesized
tttctaaacattcacatatctt

SEQ ID NO: 1001478 - DNA, 22 bp, Artificial Sequence
  chemically synthesized
ttctaaacattcacatatcttt

SEQ ID NO: 1001479 - DNA, 22 bp, Artificial Sequence
  chemically synthesized
ctgtagagattcaaagatatgt

SEQ ID NO: 1001480 - DNA, 22 bp, Artificial Sequence
  chemically synthesized
tctaaacattcacatatctttg

SEQ ID NO: 1001481 - DNA, 22 bp, Artificial Sequence
  chemically synthesized
ctaaacattcacatatctttga

SEQ ID NO: 1001482 - DNA, 22 bp, Artificial Sequence
  chemically synthesized
taaacattcacatatctttgaa

SEQ ID NO: 1001483 - DNA, 22 bp, Artificial Sequence
  chemically synthesized
aacattcacatatctttgaatc

SEQ ID NO: 1001484 - DNA, 22 bp, Artificial Sequence
  chemically synthesized
caggattcctgtagagattcaa

SEQ ID NO: 1001485 - DNA, 22 bp, Artificial Sequence
  chemically synthesized
ccaggattcctgtagagattca

SEQ ID NO: 1001486 - DNA, 22 bp, Artificial Sequence
  chemically synthesized
tccaggattcctgtagagattc

SEQ ID NO: 1001487 - DNA, 22 bp, Artificial Sequence
  chemically synthesized
ttccaggattcctgtagagatt

SEQ ID NO: 1001488 - DNA, 22 bp, Artificial Sequence
  chemically synthesized
acatatctttgaatctctacag

SEQ ID NO: 1001489 - DNA, 22 bp, Artificial Sequence
  chemically synthesized
ttttccaggattcctgtagaga

SEQ ID NO: 1001490 - DNA, 22 bp, Artificial Sequence
  chemically synthesized
tgaatctctacaggaatcctgg

SEQ ID NO: 1001491 - DNA, 22 bp, Artificial Sequence
  chemically synthesized
gaatctctacaggaatcctgga

SEQ ID NO: 1001492 - DNA, 22 bp, Artificial Sequence
  chemically synthesized
aatctctacaggaatcctggaa

SEQ ID NO: 1001493 - DNA, 22 bp, Artificial Sequence
  chemically synthesized
caaaatgatcctcttttccagg

SEQ ID NO: 1001494 - DNA, 22 bp, Artificial Sequence
  chemically synthesized
tgcaaaatgatcctcttttcca

SEQ ID NO: 1001495 - DNA, 22 bp, Artificial Sequence
  chemically synthesized
tacaggaatcctggaaaagagg

SEQ ID NO: 1001496 - DNA, 22 bp, Artificial Sequence
  chemically synthesized
ctgcaaaatgatcctcttttcc

SEQ ID NO: 1001497 - DNA, 22 bp, Artificial Sequence
  chemically synthesized
tctgcaaaatgatcctcttttc

SEQ ID NO: 1001498 - DNA, 22 bp, Artificial Sequence
  chemically synthesized
caggaatcctggaaaagaggat

SEQ ID NO: 1001499 - DNA, 22 bp, Artificial Sequence
  chemically synthesized
ttctgcaaaatgatcctctttt

SEQ ID NO: 1001500 - DNA, 22 bp, Artificial Sequence
  chemically synthesized
tttctgcaaaatgatcctcttt

SEQ ID NO: 1001501 - DNA, 22 bp, Artificial Sequence
  chemically synthesized
ttttctgcaaaatgatcctctt

SEQ ID NO: 1001502 - DNA, 22 bp, Artificial Sequence
  chemically synthesized
tttttctgcaaaatgatcctct

SEQ ID NO: 1001503 - DNA, 22 bp, Artificial Sequence
  chemically synthesized
tgttttttttctgcaaaatgat

SEQ ID NO: 1001504 - DNA, 22 bp, Artificial Sequence
  chemically synthesized
gaaaagaggatcattttgcaga

SEQ ID NO: 1001505 - DNA, 22 bp, Artificial Sequence
  chemically synthesized
gcctatgttttttttctgcaaa

SEQ ID NO: 1001506 - DNA, 22 bp, Artificial Sequence
  chemically synthesized
tagcctatgttttttttctgca

SEQ ID NO: 1001507 - DNA, 22 bp, Artificial Sequence
  chemically synthesized
agaaactctagcctatgttttt

SEQ ID NO: 1001508 - DNA, 22 bp, Artificial Sequence
  chemically synthesized
tgcagaaaaaaaacataggcta

SEQ ID NO: 1001509 - DNA, 22 bp, Artificial Sequence
  chemically synthesized
gcagaaaaaaaacataggctag

SEQ ID NO: 1001510 - DNA, 22 bp, Artificial Sequence
  chemically synthesized
cagaaaaaaaacataggctaga

SEQ ID NO: 1001511 - DNA, 22 bp, Artificial Sequence
  chemically synthesized
ggacaaggtgttcagaaactct

SEQ ID NO: 1001512 - DNA, 22 bp, Artificial Sequence
  chemically synthesized
gggacaaggtgttcagaaactc

SEQ ID NO: 1001513 - DNA, 22 bp, Artificial Sequence
  chemically synthesized
tgggacaaggtgttcagaaact

SEQ ID NO: 1001514 - DNA, 22 bp, Artificial Sequence
  chemically synthesized
tacctttgggacaaggtgttca

SEQ ID NO: 1001515 - DNA, 22 bp, Artificial Sequence
  chemically synthesized
gctgtacctttgggacaaggtg

SEQ ID NO: 1001516 - DNA, 22 bp, Artificial Sequence
  chemically synthesized
gagtttctgaacaccttgtccc

SEQ ID NO: 1001517 - DNA, 22 bp, Artificial Sequence
  chemically synthesized
tggctgtacctttgggacaagg

SEQ ID NO: 1001518 - DNA, 22 bp, Artificial Sequence
  chemically synthesized
ctgaacaccttgtcccaaaggt

SEQ ID NO: 1001519 - DNA, 22 bp, Artificial Sequence
  chemically synthesized
tgaacaccttgtcccaaaggta

SEQ ID NO: 1001520 - DNA, 22 bp, Artificial Sequence
  chemically synthesized
aaactctggctgtacctttggg

SEQ ID NO: 1001521 - DNA, 22 bp, Artificial Sequence
  chemically synthesized
aacaccttgtcccaaaggtaca

SEQ ID NO: 1001522 - DNA, 22 bp, Artificial Sequence
  chemically synthesized
gattcaaactctggctgtacct

SEQ ID NO: 1001523 - DNA, 22 bp, Artificial Sequence
  chemically synthesized
ggattcaaactctggctgtacc

SEQ ID NO: 1001524 - DNA, 22 bp, Artificial Sequence
  chemically synthesized
gtcccaaaggtacagccagagt

SEQ ID NO: 1001525 - DNA, 22 bp, Artificial Sequence
  chemically synthesized
acttggattcaaactctggctg

SEQ ID NO: 1001526 - DNA, 22 bp, Artificial Sequence
  chemically synthesized
tcccaaaggtacagccagagtt

SEQ ID NO: 1001527 - DNA, 22 bp, Artificial Sequence
  chemically synthesized
gactgacttggattcaaactct

SEQ ID NO: 1001528 - DNA, 22 bp, Artificial Sequence
  chemically synthesized
gaattagactgacttggattca

SEQ ID NO: 1001529 - DNA, 22 bp, Artificial Sequence
  chemically synthesized
ggaattagactgacttggattc

SEQ ID NO: 1001530 - DNA, 22 bp, Artificial Sequence
  chemically synthesized
tgtttggaattagactgacttg

SEQ ID NO: 1001531 - DNA, 22 bp, Artificial Sequence
  chemically synthesized
gaatccaagtcagtctaattcc

SEQ ID NO: 1001532 - DNA, 22 bp, Artificial Sequence
  chemically synthesized
aatccaagtcagtctaattcca

SEQ ID NO: 1001533 - DNA, 22 bp, Artificial Sequence
  chemically synthesized
aggaaaagatctatgtttggaa

SEQ ID NO: 1001534 - DNA, 22 bp, Artificial Sequence
  chemically synthesized
gaggaaaagatctatgtttgga

SEQ ID NO: 1001535 - DNA, 22 bp, Artificial Sequence
  chemically synthesized
tggtttgaggaaaagatctatg

SEQ ID NO: 1001536 - DNA, 22 bp, Artificial Sequence
  chemically synthesized
attccaaacatagatcttttcc

SEQ ID NO: 1001537 - DNA, 22 bp, Artificial Sequence
  chemically synthesized
caaacatagatcttttcctcaa

SEQ ID NO: 1001538 - DNA, 22 bp, Artificial Sequence
  chemically synthesized
aaaatgttatggtttgaggaaa

SEQ ID NO: 1001539 - DNA, 22 bp, Artificial Sequence
  chemically synthesized
gaaaatgttatggtttgaggaa

SEQ ID NO: 1001540 - DNA, 22 bp, Artificial Sequence
  chemically synthesized
ttgaaaatgttatggtttgagg

SEQ ID NO: 1001541 - DNA, 22 bp, Artificial Sequence
  chemically synthesized
ttcctcaaaccataacattttc

SEQ ID NO: 1001542 - DNA, 22 bp, Artificial Sequence
  chemically synthesized
tcctcaaaccataacattttca

SEQ ID NO: 1001543 - DNA, 22 bp, Artificial Sequence
  chemically synthesized
cctcaaaccataacattttcaa

SEQ ID NO: 1001544 - DNA, 22 bp, Artificial Sequence
  chemically synthesized
ctcaaaccataacattttcaag

SEQ ID NO: 1001545 - DNA, 22 bp, Artificial Sequence
  chemically synthesized
aaaccataacattttcaagaac

SEQ ID NO: 1001546 - DNA, 22 bp, Artificial Sequence
  chemically synthesized
tcaagaactgtattttatcatt

SEQ ID NO: 1001547 - DNA, 22 bp, Artificial Sequence
  chemically synthesized
caagaactgtattttatcattt

SEQ ID NO: 1001548 - DNA, 22 bp, Artificial Sequence
  chemically synthesized
aagaactgtattttatcatttc

SEQ ID NO: 1001549 - DNA, 22 bp, Artificial Sequence
  chemically synthesized
gcagggatcataagaaatgata

SEQ ID NO: 1001550 - DNA, 22 bp, Artificial Sequence
  chemically synthesized
tattttatcatttcttatgatc

SEQ ID NO: 1001551 - DNA, 22 bp, Artificial Sequence
  chemically synthesized
tgagtaagttggcagggatcat

SEQ ID NO: 1001552 - DNA, 22 bp, Artificial Sequence
  chemically synthesized
tatcatttcttatgatccctgc

SEQ ID NO: 1001553 - DNA, 22 bp, Artificial Sequence
  chemically synthesized
atcatttcttatgatccctgcc

SEQ ID NO: 1001554 - DNA, 22 bp, Artificial Sequence
  chemically synthesized
tcatttcttatgatccctgcca

SEQ ID NO: 1001555 - DNA, 22 bp, Artificial Sequence
  chemically synthesized
cttatgatccctgccaacttac

SEQ ID NO: 1001556 - DNA, 22 bp, Artificial Sequence
  chemically synthesized
ataatattgtgagtaagttggc

SEQ ID NO: 1001557 - DNA, 22 bp, Artificial Sequence
  chemically synthesized
ttatgatccctgccaacttact

SEQ ID NO: 1001558 - DNA, 22 bp, Artificial Sequence
  chemically synthesized
atgatccctgccaacttactca

SEQ ID NO: 1001559 - DNA, 22 bp, Artificial Sequence
  chemically synthesized
ctgataatattgtgagtaagtt

SEQ ID NO: 1001560 - DNA, 22 bp, Artificial Sequence
  chemically synthesized
tgatccctgccaacttactcac

SEQ ID NO: 1001561 - DNA, 22 bp, Artificial Sequence
  chemically synthesized
ggctactgataatattgtgagt

SEQ ID NO: 1001562 - DNA, 22 bp, Artificial Sequence
  chemically synthesized
ccaacttactcacaatattatc

SEQ ID NO: 1001563 - DNA, 22 bp, Artificial Sequence
  chemically synthesized
gtgaatgtctaggctactgata

SEQ ID NO: 1001564 - DNA, 22 bp, Artificial Sequence
  chemically synthesized
actcacaatattatcagtagcc

SEQ ID NO: 1001565 - DNA, 22 bp, Artificial Sequence
  chemically synthesized
agtgaatgtctaggctactgat

SEQ ID NO: 1001566 - DNA, 22 bp, Artificial Sequence
  chemically synthesized
ctcacaatattatcagtagcct

SEQ ID NO: 1001567 - DNA, 22 bp, Artificial Sequence
  chemically synthesized
acaatattatcagtagcctaga

SEQ ID NO: 1001568 - DNA, 22 bp, Artificial Sequence
  chemically synthesized
gcatttagtgaatgtctaggct

SEQ ID NO: 1001569 - DNA, 22 bp, Artificial Sequence
  chemically synthesized
tcagtagcctagacattcacta

SEQ ID NO: 1001570 - DNA, 22 bp, Artificial Sequence
  chemically synthesized
acagttggcatttagtgaatgt

SEQ ID NO: 1001571 - DNA, 22 bp, Artificial Sequence
  chemically synthesized
ttcacagttggcatttagtgaa

SEQ ID NO: 1001572 - DNA, 22 bp, Artificial Sequence
  chemically synthesized
gttcacagttggcatttagtga

SEQ ID NO: 1001573 - DNA, 22 bp, Artificial Sequence
  chemically synthesized
acttgttcacagttggcattta

SEQ ID NO: 1001574 - DNA, 22 bp, Artificial Sequence
  chemically synthesized
cacttgttcacagttggcattt

SEQ ID NO: 1001575 - DNA, 22 bp, Artificial Sequence
  chemically synthesized
gacattcactaaatgccaactg

SEQ ID NO: 1001576 - DNA, 22 bp, Artificial Sequence
  chemically synthesized
aaggcttcacttgttcacagtt

SEQ ID NO: 1001577 - DNA, 22 bp, Artificial Sequence
  chemically synthesized
aaaggcttcacttgttcacagt

SEQ ID NO: 1001578 - DNA, 22 bp, Artificial Sequence
  chemically synthesized
actaaatgccaactgtgaacaa

SEQ ID NO: 1001579 - DNA, 22 bp, Artificial Sequence
  chemically synthesized
aatgccaactgtgaacaagtga

SEQ ID NO: 1001580 - DNA, 22 bp, Artificial Sequence
  chemically synthesized
tgaacaagtgaagcctttaaga

SEQ ID NO: 1001581 - DNA, 22 bp, Artificial Sequence
  chemically synthesized
aacaccatccaagtcttaaagg

SEQ ID NO: 1001582 - DNA, 22 bp, Artificial Sequence
  chemically synthesized
caacaccatccaagtcttaaag

SEQ ID NO: 1001583 - DNA, 22 bp, Artificial Sequence
  chemically synthesized
taagacttggatggtgttgaag

SEQ ID NO: 1001584 - DNA, 22 bp, Artificial Sequence
  chemically synthesized
aagacttggatggtgttgaagt

SEQ ID NO: 1001585 - DNA, 22 bp, Artificial Sequence
  chemically synthesized
agacttggatggtgttgaagtt

SEQ ID NO: 1001586 - DNA, 22 bp, Artificial Sequence
  chemically synthesized
aaatatcacaccagggaacttc

SEQ ID NO: 1001587 - DNA, 22 bp, Artificial Sequence
  chemically synthesized
ggatggtgttgaagttccctgg

SEQ ID NO: 1001588 - DNA, 22 bp, Artificial Sequence
  chemically synthesized
gatggtgttgaagttccctggt

SEQ ID NO: 1001589 - DNA, 22 bp, Artificial Sequence
  chemically synthesized
agtaaactgaaatatcacacca

SEQ ID NO: 1001590 - DNA, 22 bp, Artificial Sequence
  chemically synthesized
aagttccctggtgtgatatttc

SEQ ID NO: 1001591 - DNA, 22 bp, Artificial Sequence
  chemically synthesized
cctggtgtgatatttcagttta

SEQ ID NO: 1001592 - DNA, 22 bp, Artificial Sequence
  chemically synthesized
aggtgggtactgagtaaactga

SEQ ID NO: 1001593 - DNA, 22 bp, Artificial Sequence
  chemically synthesized
gtgtgatatttcagtttactca

SEQ ID NO: 1001594 - DNA, 22 bp, Artificial Sequence
  chemically synthesized
attcaggtgggtactgagtaaa

SEQ ID NO: 1001595 - DNA, 22 bp, Artificial Sequence
  chemically synthesized
cagtttactcagtacccacctg

SEQ ID NO: 1001596 - DNA, 22 bp, Artificial Sequence
  chemically synthesized
aaagcattcattcaggtgggta

SEQ ID NO: 1001597 - DNA, 22 bp, Artificial Sequence
  chemically synthesized
agtttactcagtacccacctga

SEQ ID NO: 1001598 - DNA, 22 bp, Artificial Sequence
  chemically synthesized
caaagcattcattcaggtgggt

SEQ ID NO: 1001599 - DNA, 22 bp, Artificial Sequence
  chemically synthesized
ttcaaagcattcattcaggtgg

SEQ ID NO: 1001600 - DNA, 22 bp, Artificial Sequence
  chemically synthesized
cttcaaagcattcattcaggtg

SEQ ID NO: 1001601 - DNA, 22 bp, Artificial Sequence
  chemically synthesized
tcttcaaagcattcattcaggt

SEQ ID NO: 1001602 - DNA, 22 bp, Artificial Sequence
  chemically synthesized
actcagtacccacctgaatgaa

SEQ ID NO: 1001603 - DNA, 22 bp, Artificial Sequence
  chemically synthesized
ctcagtacccacctgaatgaat

SEQ ID NO: 1001604 - DNA, 22 bp, Artificial Sequence
  chemically synthesized
ttttcttcaaagcattcattca

SEQ ID NO: 1001605 - DNA, 22 bp, Artificial Sequence
  chemically synthesized
attttcttcaaagcattcattc

SEQ ID NO: 1001606 - DNA, 22 bp, Artificial Sequence
  chemically synthesized
agtacccacctgaatgaatgct

SEQ ID NO: 1001607 - DNA, 22 bp, Artificial Sequence
  chemically synthesized
tttattttcttcaaagcattca

SEQ ID NO: 1001608 - DNA, 22 bp, Artificial Sequence
  chemically synthesized
gtttattttcttcaaagcattc

SEQ ID NO: 1001609 - DNA, 22 bp, Artificial Sequence
  chemically synthesized
acttgtttattttcttcaaagc

SEQ ID NO: 1001610 - DNA, 22 bp, Artificial Sequence
  chemically synthesized
cacttgtttattttcttcaaag

SEQ ID NO: 1001611 - DNA, 22 bp, Artificial Sequence
  chemically synthesized
aatgaatgctttgaagaaaata

SEQ ID NO: 1001612 - DNA, 22 bp, Artificial Sequence
  chemically synthesized
agcttcacttgtttattttctt

SEQ ID NO: 1001613 - DNA, 22 bp, Artificial Sequence
  chemically synthesized
attaagcttcacttgtttattt

SEQ ID NO: 1001614 - DNA, 22 bp, Artificial Sequence
  chemically synthesized
gctgattaagcttcacttgttt

SEQ ID NO: 1001615 - DNA, 22 bp, Artificial Sequence
  chemically synthesized
agctgattaagcttcacttgtt

SEQ ID NO: 1001616 - DNA, 22 bp, Artificial Sequence
  chemically synthesized
tgaagaaaataaacaagtgaag

SEQ ID NO: 1001617 - DNA, 22 bp, Artificial Sequence
  chemically synthesized
gaagaaaataaacaagtgaagc

SEQ ID NO: 1001618 - DNA, 22 bp, Artificial Sequence
  chemically synthesized
aagaaaataaacaagtgaagct

SEQ ID NO: 1001619 - DNA, 22 bp, Artificial Sequence
  chemically synthesized
cttagctgattaagcttcactt

SEQ ID NO: 1001620 - DNA, 22 bp, Artificial Sequence
  chemically synthesized
acttagctgattaagcttcact

SEQ ID NO: 1001621 - DNA, 22 bp, Artificial Sequence
  chemically synthesized
tccaaacatttacttagctgat

SEQ ID NO: 1001622 - DNA, 22 bp, Artificial Sequence
  chemically synthesized
atccaaacatttacttagctga

SEQ ID NO: 1001623 - DNA, 22 bp, Artificial Sequence
  chemically synthesized
tatccaaacatttacttagctg

SEQ ID NO: 1001624 - DNA, 22 bp, Artificial Sequence
  chemically synthesized
ttatccaaacatttacttagct

SEQ ID NO: 1001625 - DNA, 22 bp, Artificial Sequence
  chemically synthesized
tttatccaaacatttacttagc

SEQ ID NO: 1001626 - DNA, 22 bp, Artificial Sequence
  chemically synthesized
ttttatccaaacatttacttag

SEQ ID NO: 1001627 - DNA, 22 bp, Artificial Sequence
  chemically synthesized
atttttttatccaaacatttac

SEQ ID NO: 1001628 - DNA, 22 bp, Artificial Sequence
  chemically synthesized
catttttttatccaaacattta

SEQ ID NO: 1001629 - DNA, 22 bp, Artificial Sequence
  chemically synthesized
aatcagctaagtaaatgtttgg

SEQ ID NO: 1001630 - DNA, 22 bp, Artificial Sequence
  chemically synthesized
atcagctaagtaaatgtttgga

SEQ ID NO: 1001631 - DNA, 22 bp, Artificial Sequence
  chemically synthesized
aacaagcttcatttttttatcc

SEQ ID NO: 1001632 - DNA, 22 bp, Artificial Sequence
  chemically synthesized
agtaaatgtttggataaaaaaa

SEQ ID NO: 1001633 - DNA, 22 bp, Artificial Sequence
  chemically synthesized
aaacaagcttcatttttttatc

SEQ ID NO: 1001634 - DNA, 22 bp, Artificial Sequence
  chemically synthesized
tttaaacaagcttcattttttt

SEQ ID NO: 1001635 - DNA, 22 bp, Artificial Sequence
  chemically synthesized
atttaaacaagcttcatttttt

SEQ ID NO: 1001636 - DNA, 22 bp, Artificial Sequence
  chemically synthesized
ccttatttaaacaagcttcatt

SEQ ID NO: 1001637 - DNA, 22 bp, Artificial Sequence
  chemically synthesized
cccttatttaaacaagcttcat

SEQ ID NO: 1001638 - DNA, 22 bp, Artificial Sequence
  chemically synthesized
tcccttatttaaacaagcttca

SEQ ID NO: 1001639 - DNA, 22 bp, Artificial Sequence
  chemically synthesized
ggataaaaaaatgaagcttgtt

SEQ ID NO: 1001640 - DNA, 22 bp, Artificial Sequence
  chemically synthesized
gataaaaaaatgaagcttgttt

SEQ ID NO: 1001641 - DNA, 22 bp, Artificial Sequence
  chemically synthesized
gtttaaataagggaaagccctt

SEQ ID NO: 1001642 - DNA, 22 bp, Artificial Sequence
  chemically synthesized
tttaaataagggaaagccctta

SEQ ID NO: 1001643 - DNA, 22 bp, Artificial Sequence
  chemically synthesized
aaataagggaaagcccttattc

SEQ ID NO: 1001644 - DNA, 22 bp, Artificial Sequence
  chemically synthesized
aataagggaaagcccttattct

SEQ ID NO: 1001645 - DNA, 22 bp, Artificial Sequence
  chemically synthesized
aatgagtagatcagagaagaat

SEQ ID NO: 1001646 - DNA, 22 bp, Artificial Sequence
  chemically synthesized
aaatgagtagatcagagaagaa

SEQ ID NO: 1001647 - DNA, 22 bp, Artificial Sequence
  chemically synthesized
acttaaatgagtagatcagaga

SEQ ID NO: 1001648 - DNA, 22 bp, Artificial Sequence
  chemically synthesized
gacttaaatgagtagatcagag

SEQ ID NO: 1001649 - DNA, 22 bp, Artificial Sequence
  chemically synthesized
tttgacttaaatgagtagatca

SEQ ID NO: 1001650 - DNA, 22 bp, Artificial Sequence
  chemically synthesized
attcttctctgatctactcatt

SEQ ID NO: 1001651 - DNA, 22 bp, Artificial Sequence
  chemically synthesized
ttcttctctgatctactcattt

SEQ ID NO: 1001652 - DNA, 22 bp, Artificial Sequence
  chemically synthesized
ttctctgatctactcatttaag

SEQ ID NO: 1001653 - DNA, 22 bp, Artificial Sequence
  chemically synthesized
ctctgatctactcatttaagtc

SEQ ID NO: 1001654 - DNA, 22 bp, Artificial Sequence
  chemically synthesized
tggtaattgtttgacttaaatg

SEQ ID NO: 1001655 - DNA, 22 bp, Artificial Sequence
  chemically synthesized
tctgatctactcatttaagtca

SEQ ID NO: 1001656 - DNA, 22 bp, Artificial Sequence
  chemically synthesized
atggtaattgtttgacttaaat

SEQ ID NO: 1001657 - DNA, 22 bp, Artificial Sequence
  chemically synthesized
tatggtaattgtttgacttaaa

SEQ ID NO: 1001658 - DNA, 22 bp, Artificial Sequence
  chemically synthesized
tgatctactcatttaagtcaaa

SEQ ID NO: 1001659 - DNA, 22 bp, Artificial Sequence
  chemically synthesized
atctactcatttaagtcaaaca

SEQ ID NO: 1001660 - DNA, 22 bp, Artificial Sequence
  chemically synthesized
gctttatggtaattgtttgact

SEQ ID NO: 1001661 - DNA, 22 bp, Artificial Sequence
  chemically synthesized
ctcatttaagtcaaacaattac

SEQ ID NO: 1001662 - DNA, 22 bp, Artificial Sequence
  chemically synthesized
atttaagtcaaacaattaccat

SEQ ID NO: 1001663 - DNA, 22 bp, Artificial Sequence
  chemically synthesized
agaattagctttatggtaattg

SEQ ID NO: 1001664 - DNA, 22 bp, Artificial Sequence
  chemically synthesized
gagaattagctttatggtaatt

SEQ ID NO: 1001665 - DNA, 22 bp, Artificial Sequence
  chemically synthesized
tgagaattagctttatggtaat

SEQ ID NO: 1001666 - DNA, 22 bp, Artificial Sequence
  chemically synthesized
aagtcaaacaattaccataaag

SEQ ID NO: 1001667 - DNA, 22 bp, Artificial Sequence
  chemically synthesized
agtcaaacaattaccataaagc

SEQ ID NO: 1001668 - DNA, 22 bp, Artificial Sequence
  chemically synthesized
aagaaaacataattttgagaat

SEQ ID NO: 1001669 - DNA, 22 bp, Artificial Sequence
  chemically synthesized
ccataaagctaattctcaaaat

SEQ ID NO: 1001670 - DNA, 22 bp, Artificial Sequence
  chemically synthesized
aataattaaagaaaacataatt

SEQ ID NO: 1001671 - DNA, 22 bp, Artificial Sequence
  chemically synthesized
attctcaaaattatgttttctt

SEQ ID NO: 1001672 - DNA, 22 bp, Artificial Sequence
  chemically synthesized
tcaaaattatgttttctttaat

SEQ ID NO: 1001673 - DNA, 22 bp, Artificial Sequence
  chemically synthesized
acccaattcaataattaaagaa

SEQ ID NO: 1001674 - DNA, 22 bp, Artificial Sequence
  chemically synthesized
aaaattatgttttctttaatta

SEQ ID NO: 1001675 - DNA, 22 bp, Artificial Sequence
  chemically synthesized
tgttttctttaattattgaatt

SEQ ID NO: 1001676 - DNA, 22 bp, Artificial Sequence
  chemically synthesized
tctttaattattgaattgggtt

SEQ ID NO: 1001677 - DNA, 22 bp, Artificial Sequence
  chemically synthesized
ctttaattattgaattgggtta

SEQ ID NO: 1001678 - DNA, 22 bp, Artificial Sequence
  chemically synthesized
tttaattattgaattgggttag

SEQ ID NO: 1001679 - DNA, 22 bp, Artificial Sequence
  chemically synthesized
taattattgaattgggttagta

SEQ ID NO: 1001680 - DNA, 22 bp, Artificial Sequence
  chemically synthesized
aattattgaattgggttagtac

SEQ ID NO: 1001681 - DNA, 22 bp, Artificial Sequence
  chemically synthesized
attattgaattgggttagtact

SEQ ID NO: 1001682 - DNA, 22 bp, Artificial Sequence
  chemically synthesized
atgggtcaaaggacagtactaa

SEQ ID NO: 1001683 - DNA, 22 bp, Artificial Sequence
  chemically synthesized
ttgaattgggttagtactgtcc

SEQ ID NO: 1001684 - DNA, 22 bp, Artificial Sequence
  chemically synthesized
aattgggttagtactgtccttt

SEQ ID NO: 1001685 - DNA, 22 bp, Artificial Sequence
  chemically synthesized
gactaatgggtcaaaggacagt

SEQ ID NO: 1001686 - DNA, 22 bp, Artificial Sequence
  chemically synthesized
ggactaatgggtcaaaggacag

SEQ ID NO: 1001687 - DNA, 22 bp, Artificial Sequence
  chemically synthesized
ggttagtactgtcctttgaccc

SEQ ID NO: 1001688 - DNA, 22 bp, Artificial Sequence
  chemically synthesized
gtactgtcctttgacccattag

SEQ ID NO: 1001689 - DNA, 22 bp, Artificial Sequence
  chemically synthesized
tcctttgacccattagtccaaa

SEQ ID NO: 1001690 - DNA, 22 bp, Artificial Sequence
  chemically synthesized
tgcatgtgtgtatttggactaa

SEQ ID NO: 1001691 - DNA, 22 bp, Artificial Sequence
  chemically synthesized
tgacccattagtccaaatacac

SEQ ID NO: 1001692 - DNA, 22 bp, Artificial Sequence
  chemically synthesized
gacccattagtccaaatacaca

SEQ ID NO: 1001693 - DNA, 22 bp, Artificial Sequence
  chemically synthesized
acccattagtccaaatacacac

SEQ ID NO: 1001694 - DNA, 22 bp, Artificial Sequence
  chemically synthesized
tgtagctgtgcatgtgtgtatt

SEQ ID NO: 1001695 - DNA, 22 bp, Artificial Sequence
  chemically synthesized
gtgtagctgtgcatgtgtgtat

SEQ ID NO: 1001696 - DNA, 22 bp, Artificial Sequence
  chemically synthesized
gtccaaatacacacatgcacag

SEQ ID NO: 1001697 - DNA, 22 bp, Artificial Sequence
  chemically synthesized
tatatatatatatatttgtgta

SEQ ID NO: 1001698 - DNA, 22 bp, Artificial Sequence
  chemically synthesized
atatatatatatatatttgtgt

SEQ ID NO: 1001699 - DNA, 22 bp, Artificial Sequence
  chemically synthesized
cacaaatatatatatatatata

SEQ ID NO: 1001700 - DNA, 22 bp, Artificial Sequence
  chemically synthesized
tgtatacatacatatatatata

SEQ ID NO: 1001701 - DNA, 22 bp, Artificial Sequence
  chemically synthesized
tatgtatacatacatatatata

SEQ ID NO: 1001702 - DNA, 22 bp, Artificial Sequence
  chemically synthesized
tctatgtatacatacatatata

SEQ ID NO: 1001703 - DNA, 22 bp, Artificial Sequence
  chemically synthesized
tctctatgtatacatacatata

SEQ ID NO: 1001704 - DNA, 22 bp, Artificial Sequence
  chemically synthesized
gattctctctatgtatacatac

SEQ ID NO: 1001705 - DNA, 22 bp, Artificial Sequence
  chemically synthesized
agattctctctatgtatacata

SEQ ID NO: 1001706 - DNA, 22 bp, Artificial Sequence
  chemically synthesized
tagattctctctatgtatacat

SEQ ID NO: 1001707 - DNA, 22 bp, Artificial Sequence
  chemically synthesized
ttagattctctctatgtataca

SEQ ID NO: 1001708 - DNA, 22 bp, Artificial Sequence
  chemically synthesized
tttagattctctctatgtatac

SEQ ID NO: 1001709 - DNA, 22 bp, Artificial Sequence
  chemically synthesized
gagtattttttagattctctct

SEQ ID NO: 1001710 - DNA, 22 bp, Artificial Sequence
  chemically synthesized
tcagttagagtattttttagat

SEQ ID NO: 1001711 - DNA, 22 bp, Artificial Sequence
  chemically synthesized
gtcagttagagtattttttaga

SEQ ID NO: 1001712 - DNA, 22 bp, Artificial Sequence
  chemically synthesized
catcttgtcagttagagtattt

SEQ ID NO: 1001713 - DNA, 22 bp, Artificial Sequence
  chemically synthesized
aaaaatactctaactgacaaga

SEQ ID NO: 1001714 - DNA, 22 bp, Artificial Sequence
  chemically synthesized
gtgtcatctccatcttgtcagt

SEQ ID NO: 1001715 - DNA, 22 bp, Artificial Sequence
  chemically synthesized
taactgacaagatggagatgac

SEQ ID NO: 1001716 - DNA, 22 bp, Artificial Sequence
  chemically synthesized
actgacaagatggagatgacac

SEQ ID NO: 1001717 - DNA, 22 bp, Artificial Sequence
  chemically synthesized
acaagatggagatgacactaat

SEQ ID NO: 1001718 - DNA, 22 bp, Artificial Sequence
  chemically synthesized
atatatgcataaattagtgtca

SEQ ID NO: 1001719 - DNA, 22 bp, Artificial Sequence
  chemically synthesized
ccctgatatatgcataaattag

SEQ ID NO: 1001720 - DNA, 22 bp, Artificial Sequence
  chemically synthesized
aaattgccctgatatatgcata

SEQ ID NO: 1001721 - DNA, 22 bp, Artificial Sequence
  chemically synthesized
atttatgcatatatcagggcaa

SEQ ID NO: 1001722 - DNA, 22 bp, Artificial Sequence
  chemically synthesized
atgcatatatcagggcaatttc

SEQ ID NO: 1001723 - DNA, 22 bp, Artificial Sequence
  chemically synthesized
tgcatatatcagggcaatttca

SEQ ID NO: 1001724 - DNA, 22 bp, Artificial Sequence
  chemically synthesized
aaatgcagaaattgaaattgcc

SEQ ID NO: 1001725 - DNA, 22 bp, Artificial Sequence
  chemically synthesized
ttaaaatgcagaaattgaaatt

SEQ ID NO: 1001726 - DNA, 22 bp, Artificial Sequence
  chemically synthesized
caatttctgcattttaatagct

SEQ ID NO: 1001727 - DNA, 22 bp, Artificial Sequence
  chemically synthesized
aatttctgcattttaatagctt

SEQ ID NO: 1001728 - DNA, 22 bp, Artificial Sequence
  chemically synthesized
caaatatcagagataagctatt

SEQ ID NO: 1001729 - DNA, 22 bp, Artificial Sequence
  chemically synthesized
gcaaatatcagagataagctat

SEQ ID NO: 1001730 - DNA, 22 bp, Artificial Sequence
  chemically synthesized
ctgcattttaatagcttatctc

SEQ ID NO: 1001731 - DNA, 22 bp, Artificial Sequence
  chemically synthesized
tgcattttaatagcttatctct

SEQ ID NO: 1001732 - DNA, 22 bp, Artificial Sequence
  chemically synthesized
gtttgcaaatatcagagataag

SEQ ID NO: 1001733 - DNA, 22 bp, Artificial Sequence
  chemically synthesized
cattttaatagcttatctctga

SEQ ID NO: 1001734 - DNA, 22 bp, Artificial Sequence
  chemically synthesized
agtttgcaaatatcagagataa

SEQ ID NO: 1001735 - DNA, 22 bp, Artificial Sequence
  chemically synthesized
ttagtttgcaaatatcagagat

SEQ ID NO: 1001736 - DNA, 22 bp, Artificial Sequence
  chemically synthesized
taatagcttatctctgatattt

SEQ ID NO: 1001737 - DNA, 22 bp, Artificial Sequence
  chemically synthesized
aatagcttatctctgatatttg

SEQ ID NO: 1001738 - DNA, 22 bp, Artificial Sequence
  chemically synthesized
atagcttatctctgatatttgc

SEQ ID NO: 1001739 - DNA, 22 bp, Artificial Sequence
  chemically synthesized
atctctgatatttgcaaactaa

SEQ ID NO: 1001740 - DNA, 22 bp, Artificial Sequence
  chemically synthesized
taaatgaagctcttagtttgca

SEQ ID NO: 1001741 - DNA, 22 bp, Artificial Sequence
  chemically synthesized
tctctgatatttgcaaactaag

SEQ ID NO: 1001742 - DNA, 22 bp, Artificial Sequence
  chemically synthesized
tgatatttgcaaactaagagct

SEQ ID NO: 1001743 - DNA, 22 bp, Artificial Sequence
  chemically synthesized
atatttgcaaactaagagcttc

SEQ ID NO: 1001744 - DNA, 22 bp, Artificial Sequence
  chemically synthesized
gcaaactaagagcttcatttac

SEQ ID NO: 1001745 - DNA, 22 bp, Artificial Sequence
  chemically synthesized
caaactaagagcttcatttaca

SEQ ID NO: 1001746 - DNA, 22 bp, Artificial Sequence
  chemically synthesized
atgatacaagtacagtctgtaa

SEQ ID NO: 1001747 - DNA, 22 bp, Artificial Sequence
  chemically synthesized
agagcttcatttacagactgta

SEQ ID NO: 1001748 - DNA, 22 bp, Artificial Sequence
  chemically synthesized
ggaactcatgatacaagtacag

SEQ ID NO: 1001749 - DNA, 22 bp, Artificial Sequence
  chemically synthesized
gggaactcatgatacaagtaca

SEQ ID NO: 1001750 - DNA, 22 bp, Artificial Sequence
  chemically synthesized
catttacagactgtacttgtat

SEQ ID NO: 1001751 - DNA, 22 bp, Artificial Sequence
  chemically synthesized
atttacagactgtacttgtatc

SEQ ID NO: 1001752 - DNA, 22 bp, Artificial Sequence
  chemically synthesized
acagactgtacttgtatcatga

SEQ ID NO: 1001753 - DNA, 22 bp, Artificial Sequence
  chemically synthesized
tagtttgggaactcatgataca

SEQ ID NO: 1001754 - DNA, 22 bp, Artificial Sequence
  chemically synthesized
cagactgtacttgtatcatgag

SEQ ID NO: 1001755 - DNA, 22 bp, Artificial Sequence
  chemically synthesized
tagttgtagtttgggaactcat

SEQ ID NO: 1001756 - DNA, 22 bp, Artificial Sequence
  chemically synthesized
gtagttgtagtttgggaactca

SEQ ID NO: 1001757 - DNA, 22 bp, Artificial Sequence
  chemically synthesized
tacttgtatcatgagttcccaa

SEQ ID NO: 1001758 - DNA, 22 bp, Artificial Sequence
  chemically synthesized
gtatcatgagttcccaaactac

SEQ ID NO: 1001759 - DNA, 22 bp, Artificial Sequence
  chemically synthesized
tatcatgagttcccaaactaca

SEQ ID NO: 1001760 - DNA, 22 bp, Artificial Sequence
  chemically synthesized
aacatttgtagttgtagtttgg

SEQ ID NO: 1001761 - DNA, 22 bp, Artificial Sequence
  chemically synthesized
aaacatttgtagttgtagtttg

SEQ ID NO: 1001762 - DNA, 22 bp, Artificial Sequence
  chemically synthesized
ccaaactacaactacaaatgtt

SEQ ID NO: 1001763 - DNA, 22 bp, Artificial Sequence
  chemically synthesized
aaaagatatttaaacatttgta

SEQ ID NO: 1001764 - DNA, 22 bp, Artificial Sequence
  chemically synthesized
aaaaagatatttaaacatttgt

SEQ ID NO: 1001765 - DNA, 22 bp, Artificial Sequence
  chemically synthesized
agtttaaaaagatatttaaaca

SEQ ID NO: 1001766 - DNA, 22 bp, Artificial Sequence
  chemically synthesized
caactacaaatgtttaaatatc

SEQ ID NO: 1001767 - DNA, 22 bp, Artificial Sequence
  chemically synthesized
caaatgtttaaatatcttttta

SEQ ID NO: 1001768 - DNA, 22 bp, Artificial Sequence
  chemically synthesized
atgcacactcagtttaaaaaga

SEQ ID NO: 1001769 - DNA, 22 bp, Artificial Sequence
  chemically synthesized
aaatatctttttaaactgagtg

SEQ ID NO: 1001770 - DNA, 22 bp, Artificial Sequence
  chemically synthesized
aatatctttttaaactgagtgt

SEQ ID NO: 1001771 - DNA, 22 bp, Artificial Sequence
  chemically synthesized
ataaaaaacattcatgcacact

SEQ ID NO: 1001772 - DNA, 22 bp, Artificial Sequence
  chemically synthesized
tgataaaaaacattcatgcaca

SEQ ID NO: 1001773 - DNA, 22 bp, Artificial Sequence
  chemically synthesized
tttaaactgagtgtgcatgaat

SEQ ID NO: 1001774 - DNA, 22 bp, Artificial Sequence
  chemically synthesized
ctgataaaaaacattcatgcac

SEQ ID NO: 1001775 - DNA, 22 bp, Artificial Sequence
  chemically synthesized
ttaaactgagtgtgcatgaatg

SEQ ID NO: 1001776 - DNA, 22 bp, Artificial Sequence
  chemically synthesized
taaactgagtgtgcatgaatgt

SEQ ID NO: 1001777 - DNA, 22 bp, Artificial Sequence
  chemically synthesized
aaactgagtgtgcatgaatgtt

SEQ ID NO: 1001778 - DNA, 22 bp, Artificial Sequence
  chemically synthesized
aactgagtgtgcatgaatgttt

SEQ ID NO: 1001779 - DNA, 22 bp, Artificial Sequence
  chemically synthesized
agtgtgcatgaatgttttttat

SEQ ID NO: 1001780 - DNA, 22 bp, Artificial Sequence
  chemically synthesized
aataatgcttctgataaaaaac

SEQ ID NO: 1001781 - DNA, 22 bp, Artificial Sequence
  chemically synthesized
aaataatgcttctgataaaaaa

SEQ ID NO: 1001782 - DNA, 22 bp, Artificial Sequence
  chemically synthesized
taaataatgcttctgataaaaa

SEQ ID NO: 1001783 - DNA, 22 bp, Artificial Sequence
  chemically synthesized
ttttaaataatgcttctgataa

SEQ ID NO: 1001784 - DNA, 22 bp, Artificial Sequence
  chemically synthesized
tttatcagaagcattatttaaa

SEQ ID NO: 1001785 - DNA, 22 bp, Artificial Sequence
  chemically synthesized
ttatcagaagcattatttaaaa

SEQ ID NO: 1001786 - DNA, 22 bp, Artificial Sequence
  chemically synthesized
tatcagaagcattatttaaaat

SEQ ID NO: 1001787 - DNA, 22 bp, Artificial Sequence
  chemically synthesized
atcagaagcattatttaaaata

SEQ ID NO: 1001788 - DNA, 22 bp, Artificial Sequence
  chemically synthesized
tcagaagcattatttaaaataa

SEQ ID NO: 1001789 - DNA, 22 bp, Artificial Sequence
  chemically synthesized
aaagataatagtaattatttta

SEQ ID NO: 1001790 - DNA, 22 bp, Artificial Sequence
  chemically synthesized
aaaagataatagtaattatttt

SEQ ID NO: 1001791 - DNA, 22 bp, Artificial Sequence
  chemically synthesized
cttaaaagataatagtaattat

SEQ ID NO: 1001792 - DNA, 22 bp, Artificial Sequence
  chemically synthesized
tttaaaataattactattatct

SEQ ID NO: 1001793 - DNA, 22 bp, Artificial Sequence
  chemically synthesized
atgctacttaaaagataatagt

SEQ ID NO: 1001794 - DNA, 22 bp, Artificial Sequence
  chemically synthesized
aaaataattactattatctttt

SEQ ID NO: 1001795 - DNA, 22 bp, Artificial Sequence
  chemically synthesized
aaataattactattatctttta

SEQ ID NO: 1001796 - DNA, 22 bp, Artificial Sequence
  chemically synthesized
caacagcctgatgctacttaaa

SEQ ID NO: 1001797 - DNA, 22 bp, Artificial Sequence
  chemically synthesized
ctattatcttttaagtagcatc

SEQ ID NO: 1001798 - DNA, 22 bp, Artificial Sequence
  chemically synthesized
ttatcttttaagtagcatcagg

SEQ ID NO: 1001799 - DNA, 22 bp, Artificial Sequence
  chemically synthesized
gcaaattccaacagcctgatgc

SEQ ID NO: 1001800 - DNA, 22 bp, Artificial Sequence
  chemically synthesized
tcttttaagtagcatcaggctg

SEQ ID NO: 1001801 - DNA, 22 bp, Artificial Sequence
  chemically synthesized
ctagcaaattccaacagcctga

SEQ ID NO: 1001802 - DNA, 22 bp, Artificial Sequence
  chemically synthesized
ttaagtagcatcaggctgttgg

SEQ ID NO: 1001803 - DNA, 22 bp, Artificial Sequence
  chemically synthesized
taagtagcatcaggctgttgga

SEQ ID NO: 1001804 - DNA, 22 bp, Artificial Sequence
  chemically synthesized
aagtagcatcaggctgttggaa

SEQ ID NO: 1001805 - DNA, 22 bp, Artificial Sequence
  chemically synthesized
agtagcatcaggctgttggaat

SEQ ID NO: 1001806 - DNA, 22 bp, Artificial Sequence
  chemically synthesized
gtagttcctagcaaattccaac

SEQ ID NO: 1001807 - DNA, 22 bp, Artificial Sequence
  chemically synthesized
ttggtagttcctagcaaattcc

SEQ ID NO: 1001808 - DNA, 22 bp, Artificial Sequence
  chemically synthesized
gttggtagttcctagcaaattc

SEQ ID NO: 1001809 - DNA, 22 bp, Artificial Sequence
  chemically synthesized
ttggaatttgctaggaactacc

SEQ ID NO: 1001810 - DNA, 22 bp, Artificial Sequence
  chemically synthesized
gaatttgctaggaactaccaac

SEQ ID NO: 1001811 - DNA, 22 bp, Artificial Sequence
  chemically synthesized
agagaaggtatttgttggtagt

SEQ ID NO: 1001812 - DNA, 22 bp, Artificial Sequence
  chemically synthesized
aagagaaggtatttgttggtag

SEQ ID NO: 1001813 - DNA, 22 bp, Artificial Sequence
  chemically synthesized
taagagaaggtatttgttggta

SEQ ID NO: 1001814 - DNA, 22 bp, Artificial Sequence
  chemically synthesized
gctaggaactaccaacaaatac

SEQ ID NO: 1001815 - DNA, 22 bp, Artificial Sequence
  chemically synthesized
ctaggaactaccaacaaatacc

SEQ ID NO: 1001816 - DNA, 22 bp, Artificial Sequence
  chemically synthesized
ggaactaccaacaaataccttc

SEQ ID NO: 1001817 - DNA, 22 bp, Artificial Sequence
  chemically synthesized
atcagtatctttaagagaaggt

SEQ ID NO: 1001818 - DNA, 22 bp, Artificial Sequence
  chemically synthesized
ccaacaaataccttctcttaaa

SEQ ID NO: 1001819 - DNA, 22 bp, Artificial Sequence
  chemically synthesized
cctgatcagtatctttaagaga

SEQ ID NO: 1001820 - DNA, 22 bp, Artificial Sequence
  chemically synthesized
gagttccctgatcagtatcttt

SEQ ID NO: 1001821 - DNA, 22 bp, Artificial Sequence
  chemically synthesized
ggagttccctgatcagtatctt

SEQ ID NO: 1001822 - DNA, 22 bp, Artificial Sequence
  chemically synthesized
ctcttaaagatactgatcaggg

SEQ ID NO: 1001823 - DNA, 22 bp, Artificial Sequence
  chemically synthesized
tcttaaagatactgatcaggga

SEQ ID NO: 1001824 - DNA, 22 bp, Artificial Sequence
  chemically synthesized
ttaaagatactgatcagggaac

SEQ ID NO: 1001825 - DNA, 22 bp, Artificial Sequence
  chemically synthesized
aaagatactgatcagggaactc

SEQ ID NO: 1001826 - DNA, 22 bp, Artificial Sequence
  chemically synthesized
aagatactgatcagggaactcc

SEQ ID NO: 1001827 - DNA, 22 bp, Artificial Sequence
  chemically synthesized
atcagggaactccaaacattct

SEQ ID NO: 1001828 - DNA, 22 bp, Artificial Sequence
  chemically synthesized
ggggatacagaagcaagaatgt

SEQ ID NO: 1001829 - DNA, 22 bp, Artificial Sequence
  chemically synthesized
aggggatacagaagcaagaatg

SEQ ID NO: 1001830 - DNA, 22 bp, Artificial Sequence
  chemically synthesized
taggggatacagaagcaagaat

SEQ ID NO: 1001831 - DNA, 22 bp, Artificial Sequence
  chemically synthesized
ttaggggatacagaagcaagaa

SEQ ID NO: 1001832 - DNA, 22 bp, Artificial Sequence
  chemically synthesized
tttaggggatacagaagcaaga

SEQ ID NO: 1001833 - DNA, 22 bp, Artificial Sequence
  chemically synthesized
caaacattcttgcttctgtatc

SEQ ID NO: 1001834 - DNA, 22 bp, Artificial Sequence
  chemically synthesized
aagagtctttttaggggataca

SEQ ID NO: 1001835 - DNA, 22 bp, Artificial Sequence
  chemically synthesized
caagagtctttttaggggatac

SEQ ID NO: 1001836 - DNA, 22 bp, Artificial Sequence
  chemically synthesized
tcaagagtctttttaggggata

SEQ ID NO: 1001837 - DNA, 22 bp, Artificial Sequence
  chemically synthesized
ttcaagagtctttttaggggat

SEQ ID NO: 1001838 - DNA, 22 bp, Artificial Sequence
  chemically synthesized
ttgcttctgtatcccctaaaaa

SEQ ID NO: 1001839 - DNA, 22 bp, Artificial Sequence
  chemically synthesized
gcttctgtatcccctaaaaaga

SEQ ID NO: 1001840 - DNA, 22 bp, Artificial Sequence
  chemically synthesized
atttttcaagagtctttttagg

SEQ ID NO: 1001841 - DNA, 22 bp, Artificial Sequence
  chemically synthesized
cttctgtatcccctaaaaagac

SEQ ID NO: 1001842 - DNA, 22 bp, Artificial Sequence
  chemically synthesized
ctgtatcccctaaaaagactct

SEQ ID NO: 1001843 - DNA, 22 bp, Artificial Sequence
  chemically synthesized
actcatttttcaagagtctttt

SEQ ID NO: 1001844 - DNA, 22 bp, Artificial Sequence
  chemically synthesized
tgtatcccctaaaaagactctt

SEQ ID NO: 1001845 - DNA, 22 bp, Artificial Sequence
  chemically synthesized
tatcccctaaaaagactcttga

SEQ ID NO: 1001846 - DNA, 22 bp, Artificial Sequence
  chemically synthesized
caagggttgactcatttttcaa

SEQ ID NO: 1001847 - DNA, 22 bp, Artificial Sequence
  chemically synthesized
aaaagactcttgaaaaatgagt

SEQ ID NO: 1001848 - DNA, 22 bp, Artificial Sequence
  chemically synthesized
aatctgcaagggttgactcatt

SEQ ID NO: 1001849 - DNA, 22 bp, Artificial Sequence
  chemically synthesized
aaatctgcaagggttgactcat

SEQ ID NO: 1001850 - DNA, 22 bp, Artificial Sequence
  chemically synthesized
taaatctgcaagggttgactca

SEQ ID NO: 1001851 - DNA, 22 bp, Artificial Sequence
  chemically synthesized
ttgaaaaatgagtcaacccttg

SEQ ID NO: 1001852 - DNA, 22 bp, Artificial Sequence
  chemically synthesized
gaaaaatgagtcaacccttgca

SEQ ID NO: 1001853 - DNA, 22 bp, Artificial Sequence
  chemically synthesized
aaaaatgagtcaacccttgcag

SEQ ID NO: 1001854 - DNA, 22 bp, Artificial Sequence
  chemically synthesized
gaatgcggattttaaatctgca

SEQ ID NO: 1001855 - DNA, 22 bp, Artificial Sequence
  chemically synthesized
cgaatgcggattttaaatctgc

SEQ ID NO: 1001856 - DNA, 22 bp, Artificial Sequence
  chemically synthesized
gcagatttaaaatccgcattcg

SEQ ID NO: 1001857 - DNA, 22 bp, Artificial Sequence
  chemically synthesized
cagatttaaaatccgcattcga

SEQ ID NO: 1001858 - DNA, 22 bp, Artificial Sequence
  chemically synthesized
agaatgaaaagtacatttcgaa

SEQ ID NO: 1001859 - DNA, 22 bp, Artificial Sequence
  chemically synthesized
aagaatgaaaagtacatttcga

SEQ ID NO: 1001860 - DNA, 22 bp, Artificial Sequence
  chemically synthesized
aaaatccgcattcgaaatgtac

SEQ ID NO: 1001861 - DNA, 22 bp, Artificial Sequence
  chemically synthesized
aaatccgcattcgaaatgtact

SEQ ID NO: 1001862 - DNA, 22 bp, Artificial Sequence
  chemically synthesized
agtcatttaagaatgaaaagta

SEQ ID NO: 1001863 - DNA, 22 bp, Artificial Sequence
  chemically synthesized
cagtcatttaagaatgaaaagt

SEQ ID NO: 1001864 - DNA, 22 bp, Artificial Sequence
  chemically synthesized
tcagtcatttaagaatgaaaag

SEQ ID NO: 1001865 - DNA, 22 bp, Artificial Sequence
  chemically synthesized
ttttcagtcatttaagaatgaa

SEQ ID NO: 1001866 - DNA, 22 bp, Artificial Sequence
  chemically synthesized
gaaatgtacttttcattcttaa

SEQ ID NO: 1001867 - DNA, 22 bp, Artificial Sequence
  chemically synthesized
tattattttcagtcatttaaga

SEQ ID NO: 1001868 - DNA, 22 bp, Artificial Sequence
  chemically synthesized
aaattatattattttcagtcat

SEQ ID NO: 1001869 - DNA, 22 bp, Artificial Sequence
  chemically synthesized
ttcattcttaaatgactgaaaa

SEQ ID NO: 1001870 - DNA, 22 bp, Artificial Sequence
  chemically synthesized
tcattcttaaatgactgaaaat

SEQ ID NO: 1001871 - DNA, 22 bp, Artificial Sequence
  chemically synthesized
cattcttaaatgactgaaaata

SEQ ID NO: 1001872 - DNA, 22 bp, Artificial Sequence
  chemically synthesized
attcttaaatgactgaaaataa

SEQ ID NO: 1001873 - DNA, 22 bp, Artificial Sequence
  chemically synthesized
ttaaatgactgaaaataatata

SEQ ID NO: 1001874 - DNA, 22 bp, Artificial Sequence
  chemically synthesized
aaatgactgaaaataatataat

SEQ ID NO: 1001875 - DNA, 22 bp, Artificial Sequence
  chemically synthesized
aatgactgaaaataatataatt

SEQ ID NO: 1001876 - DNA, 22 bp, Artificial Sequence
  chemically synthesized
caatgtccctcaaattatatta

SEQ ID NO: 1001877 - DNA, 22 bp, Artificial Sequence
  chemically synthesized
acaatgtccctcaaattatatt

SEQ ID NO: 1001878 - DNA, 22 bp, Artificial Sequence
  chemically synthesized
aaaataatataatttgagggac

SEQ ID NO: 1001879 - DNA, 22 bp, Artificial Sequence
  chemically synthesized
agatatcgatatttacaatgtc

SEQ ID NO: 1001880 - DNA, 22 bp, Artificial Sequence
  chemically synthesized
aagatatcgatatttacaatgt

SEQ ID NO: 1001881 - DNA, 22 bp, Artificial Sequence
  chemically synthesized
taagatatcgatatttacaatg

SEQ ID NO: 1001882 - DNA, 22 bp, Artificial Sequence
  chemically synthesized
gttttaagatatcgatatttac

SEQ ID NO: 1001883 - DNA, 22 bp, Artificial Sequence
  chemically synthesized
agttttaagatatcgatattta

SEQ ID NO: 1001884 - DNA, 22 bp, Artificial Sequence
  chemically synthesized
gagggacattgtaaatatcgat

SEQ ID NO: 1001885 - DNA, 22 bp, Artificial Sequence
  chemically synthesized
agggacattgtaaatatcgata

SEQ ID NO: 1001886 - DNA, 22 bp, Artificial Sequence
  chemically synthesized
taaatatcgatatcttaaaact

SEQ ID NO: 1001887 - DNA, 22 bp, Artificial Sequence
  chemically synthesized
aggcataaacatatatcttagt

SEQ ID NO: 1001888 - DNA, 22 bp, Artificial Sequence
  chemically synthesized
caggcataaacatatatcttag

SEQ ID NO: 1001889 - DNA, 22 bp, Artificial Sequence
  chemically synthesized
tcaggcataaacatatatctta

SEQ ID NO: 1001890 - DNA, 22 bp, Artificial Sequence
  chemically synthesized
ttcaggcataaacatatatctt

SEQ ID NO: 1001891 - DNA, 22 bp, Artificial Sequence
  chemically synthesized
tttcaggcataaacatatatct

SEQ ID NO: 1001892 - DNA, 22 bp, Artificial Sequence
  chemically synthesized
aaaactaagatatatgtttatg

SEQ ID NO: 1001893 - DNA, 22 bp, Artificial Sequence
  chemically synthesized
aaactaagatatatgtttatgc

SEQ ID NO: 1001894 - DNA, 22 bp, Artificial Sequence
  chemically synthesized
agatatatgtttatgcctgaaa

SEQ ID NO: 1001895 - DNA, 22 bp, Artificial Sequence
  chemically synthesized
ggtgatcaataagattttttca

SEQ ID NO: 1001896 - DNA, 22 bp, Artificial Sequence
  chemically synthesized
atgcctgaaaaaatcttattga

SEQ ID NO: 1001897 - DNA, 22 bp, Artificial Sequence
  chemically synthesized
tgcctgaaaaaatcttattgat

SEQ ID NO: 1001898 - DNA, 22 bp, Artificial Sequence
  chemically synthesized
aaaaaatcttattgatcaccta

SEQ ID NO: 1001899 - DNA, 22 bp, Artificial Sequence
  chemically synthesized
agaaaagtatactaggtgatca

SEQ ID NO: 1001900 - DNA, 22 bp, Artificial Sequence
  chemically synthesized
aagaaaagtatactaggtgatc

SEQ ID NO: 1001901 - DNA, 22 bp, Artificial Sequence
  chemically synthesized
tttaagaaaagtatactaggtg

SEQ ID NO: 1001902 - DNA, 22 bp, Artificial Sequence
  chemically synthesized
attgatcacctagtatactttt

SEQ ID NO: 1001903 - DNA, 22 bp, Artificial Sequence
  chemically synthesized
ttgatcacctagtatacttttc

SEQ ID NO: 1001904 - DNA, 22 bp, Artificial Sequence
  chemically synthesized
atcacctagtatacttttctta

SEQ ID NO: 1001905 - DNA, 22 bp, Artificial Sequence
  chemically synthesized
tgtatacatactgtttaagaaa

SEQ ID NO: 1001906 - DNA, 22 bp, Artificial Sequence
  chemically synthesized
attgtgtatacatactgtttaa

SEQ ID NO: 1001907 - DNA, 22 bp, Artificial Sequence
  chemically synthesized
gtatacttttcttaaacagtat

SEQ ID NO: 1001908 - DNA, 22 bp, Artificial Sequence
  chemically synthesized
ttcttaaacagtatgtatacac

SEQ ID NO: 1001909 - DNA, 22 bp, Artificial Sequence
  chemically synthesized
tcttaaacagtatgtatacaca

SEQ ID NO: 1001910 - DNA, 22 bp, Artificial Sequence
  chemically synthesized
cttaaacagtatgtatacacaa

SEQ ID NO: 1001911 - DNA, 22 bp, Artificial Sequence
  chemically synthesized
ttaaacagtatgtatacacaat

SEQ ID NO: 1001912 - DNA, 22 bp, Artificial Sequence
  chemically synthesized
aaacagtatgtatacacaatga

SEQ ID NO: 1001913 - DNA, 22 bp, Artificial Sequence
  chemically synthesized
aacagtatgtatacacaatgag

SEQ ID NO: 1001914 - DNA, 22 bp, Artificial Sequence
  chemically synthesized
cagtaacagaaaaaaaacactc

SEQ ID NO: 1001915 - DNA, 22 bp, Artificial Sequence
  chemically synthesized
acagtaacagaaaaaaaacact

SEQ ID NO: 1001916 - DNA, 22 bp, Artificial Sequence
  chemically synthesized
ggacttacagtaacagaaaaaa

SEQ ID NO: 1001917 - DNA, 22 bp, Artificial Sequence
  chemically synthesized
aggacttacagtaacagaaaaa

SEQ ID NO: 1001918 - DNA, 22 bp, Artificial Sequence
  chemically synthesized
catttaggacttacagtaacag

SEQ ID NO: 1001919 - DNA, 22 bp, Artificial Sequence
  chemically synthesized
acatttaggacttacagtaaca

SEQ ID NO: 1001920 - DNA, 22 bp, Artificial Sequence
  chemically synthesized
tacatttaggacttacagtaac

SEQ ID NO: 1001921 - DNA, 22 bp, Artificial Sequence
  chemically synthesized
ttacatttaggacttacagtaa

SEQ ID NO: 1001922 - DNA, 22 bp, Artificial Sequence
  chemically synthesized
tttacatttaggacttacagta

SEQ ID NO: 1001923 - DNA, 22 bp, Artificial Sequence
  chemically synthesized
tttttctgttactgtaagtcct

SEQ ID NO: 1001924 - DNA, 22 bp, Artificial Sequence
  chemically synthesized
ttttttacatttaggacttaca

SEQ ID NO: 1001925 - DNA, 22 bp, Artificial Sequence
  chemically synthesized
ttttctgttactgtaagtccta

SEQ ID NO: 1001926 - DNA, 22 bp, Artificial Sequence
  chemically synthesized
gttttttacatttaggacttac

SEQ ID NO: 1001927 - DNA, 22 bp, Artificial Sequence
  chemically synthesized
tttctgttactgtaagtcctaa

SEQ ID NO: 1001928 - DNA, 22 bp, Artificial Sequence
  chemically synthesized
ttctgttactgtaagtcctaaa

SEQ ID NO: 1001929 - DNA, 22 bp, Artificial Sequence
  chemically synthesized
tctgttactgtaagtcctaaat

SEQ ID NO: 1001930 - DNA, 22 bp, Artificial Sequence
  chemically synthesized
ctgttactgtaagtcctaaatg

SEQ ID NO: 1001931 - DNA, 22 bp, Artificial Sequence
  chemically synthesized
tgttactgtaagtcctaaatgt

SEQ ID NO: 1001932 - DNA, 22 bp, Artificial Sequence
  chemically synthesized
ttactgtaagtcctaaatgtaa

SEQ ID NO: 1001933 - DNA, 22 bp, Artificial Sequence
  chemically synthesized
aaaaggtttgttttttacattt

SEQ ID NO: 1001934 - DNA, 22 bp, Artificial Sequence
  chemically synthesized
ctgtaagtcctaaatgtaaaaa

SEQ ID NO: 1001935 - DNA, 22 bp, Artificial Sequence
  chemically synthesized
taagtcctaaatgtaaaaaaca

SEQ ID NO: 1001936 - DNA, 22 bp, Artificial Sequence
  chemically synthesized
aattgaaaaggtttgtttttta

SEQ ID NO: 1001937 - DNA, 22 bp, Artificial Sequence
  chemically synthesized
aatgtaaaaaacaaaccttttc

SEQ ID NO: 1001938 - DNA, 22 bp, Artificial Sequence
  chemically synthesized
taacaatacctcaattgaaaag

SEQ ID NO: 1001939 - DNA, 22 bp, Artificial Sequence
  chemically synthesized
ataattgtaacaatacctcaat

SEQ ID NO: 1001940 - DNA, 22 bp, Artificial Sequence
  chemically synthesized
cacgttaataattgtaacaata

SEQ ID NO: 1001941 - DNA, 22 bp, Artificial Sequence
  chemically synthesized
ttcaattgaggtattgttacaa

SEQ ID NO: 1001942 - DNA, 22 bp, Artificial Sequence
  chemically synthesized
tcaattgaggtattgttacaat

SEQ ID NO: 1001943 - DNA, 22 bp, Artificial Sequence
  chemically synthesized
caattgaggtattgttacaatt

SEQ ID NO: 1001944 - DNA, 22 bp, Artificial Sequence
  chemically synthesized
aattgaggtattgttacaatta

SEQ ID NO: 1001945 - DNA, 22 bp, Artificial Sequence
  chemically synthesized
gtcaattgcacgttaataattg

SEQ ID NO: 1001946 - DNA, 22 bp, Artificial Sequence
  chemically synthesized
aggtattgttacaattattaac

SEQ ID NO: 1001947 - DNA, 22 bp, Artificial Sequence
  chemically synthesized
ggtcaattgcacgttaataatt

SEQ ID NO: 1001948 - DNA, 22 bp, Artificial Sequence
  chemically synthesized
tggtcaattgcacgttaataat

SEQ ID NO: 1001949 - DNA, 22 bp, Artificial Sequence
  chemically synthesized
ttttggtcaattgcacgttaat

SEQ ID NO: 1001950 - DNA, 22 bp, Artificial Sequence
  chemically synthesized
ttacaattattaacgtgcaatt

SEQ ID NO: 1001951 - DNA, 22 bp, Artificial Sequence
  chemically synthesized
caattattaacgtgcaattgac

SEQ ID NO: 1001952 - DNA, 22 bp, Artificial Sequence
  chemically synthesized
ttaacgtgcaattgaccaaaac

SEQ ID NO: 1001953 - DNA, 22 bp, Artificial Sequence
  chemically synthesized
acgtgcaattgaccaaaacaat

SEQ ID NO: 1001954 - DNA, 22 bp, Artificial Sequence
  chemically synthesized
taatatacatatattgttttgg

SEQ ID NO: 1001955 - DNA, 22 bp, Artificial Sequence
  chemically synthesized
ataatatacatatattgttttg

SEQ ID NO: 1001956 - DNA, 22 bp, Artificial Sequence
  chemically synthesized
tataatatacatatattgtttt

SEQ ID NO: 1001957 - DNA, 22 bp, Artificial Sequence
  chemically synthesized
tcaaattttataatatacatat

SEQ ID NO: 1001958 - DNA, 22 bp, Artificial Sequence
  chemically synthesized
accaaaacaatatatgtatatt

SEQ ID NO: 1001959 - DNA, 22 bp, Artificial Sequence
  chemically synthesized
atcaaattttataatatacata

SEQ ID NO: 1001960 - DNA, 22 bp, Artificial Sequence
  chemically synthesized
tgtttatcaaattttataatat

SEQ ID NO: 1001961 - DNA, 22 bp, Artificial Sequence
  chemically synthesized
atgtttatcaaattttataata

SEQ ID NO: 1001962 - DNA, 22 bp, Artificial Sequence
  chemically synthesized
tatgtttatcaaattttataat

SEQ ID NO: 1001963 - DNA, 22 bp, Artificial Sequence
  chemically synthesized
ttatgtttatcaaattttataa

SEQ ID NO: 1001964 - DNA, 22 bp, Artificial Sequence
  chemically synthesized
tttttatgtttatcaaatttta

SEQ ID NO: 1001965 - DNA, 22 bp, Artificial Sequence
  chemically synthesized
atttttatgtttatcaaatttt

SEQ ID NO: 1001966 - DNA, 22 bp, Artificial Sequence
  chemically synthesized
tatttttatgtttatcaaattt

SEQ ID NO: 1001967 - DNA, 22 bp, Artificial Sequence
  chemically synthesized
taaaatttgataaacataaaaa

SEQ ID NO: 1001968 - DNA, 22 bp, Artificial Sequence
  chemically synthesized
aataaaattttatttttatgtt

SEQ ID NO: 1001969 - DNA, 22 bp, Artificial Sequence
  chemically synthesized
caataaaattttatttttatgt

SEQ ID NO: 1001970 - DNA, 22 bp, Artificial Sequence
  chemically synthesized
tcaataaaattttatttttatg

SEQ ID NO: 1001971 - DNA, 22 bp, Artificial Sequence
  chemically synthesized
gataaacataaaaataaaattt

SEQ ID NO: 1001972 - DNA, 22 bp, Artificial Sequence
  chemically synthesized
ataaacataaaaataaaatttt

SEQ ID NO: 1001973 - DNA, 22 bp, Artificial Sequence
  chemically synthesized
agagatgtattttcaataaaat

SEQ ID NO: 1001974 - DNA, 22 bp, Artificial Sequence
  chemically synthesized
ttaagagatgtattttcaataa

SEQ ID NO: 1001975 - DNA, 22 bp, Artificial Sequence
  chemically synthesized
attaagagatgtattttcaata

SEQ ID NO: 1001976 - DNA, 22 bp, Artificial Sequence
  chemically synthesized
tattgaaaatacatctcttaat

SEQ ID NO: 1001977 - DNA, 22 bp, Artificial Sequence
  chemically synthesized
attgaaaatacatctcttaata

SEQ ID NO: 1001978 - DNA, 22 bp, Artificial Sequence
  chemically synthesized
ttgaaaatacatctcttaataa

SEQ ID NO: 1001979 - DNA, 22 bp, Artificial Sequence
  chemically synthesized
aatacccatccatcttattaag

SEQ ID NO: 1001980 - DNA, 22 bp, Artificial Sequence
  chemically synthesized
aaaatacatctcttaataagat

SEQ ID NO: 1001981 - DNA, 22 bp, Artificial Sequence
  chemically synthesized
ttaaatacccatccatcttatt

SEQ ID NO: 1001982 - DNA, 22 bp, Artificial Sequence
  chemically synthesized
ttaataagatggatgggtattt

SEQ ID NO: 1001983 - DNA, 22 bp, Artificial Sequence
  chemically synthesized
aataagatggatgggtatttaa

SEQ ID NO: 1001984 - DNA, 22 bp, Artificial Sequence
  chemically synthesized
ataagatggatgggtatttaac

SEQ ID NO: 1001985 - DNA, 22 bp, Artificial Sequence
  chemically synthesized
aaggtgtataaattgttaaata

SEQ ID NO: 1001986 - DNA, 22 bp, Artificial Sequence
  chemically synthesized
tgaaggtgtataaattgttaaa

SEQ ID NO: 1001987 - DNA, 22 bp, Artificial Sequence
  chemically synthesized
ctgaaggtgtataaattgttaa

SEQ ID NO: 1001988 - DNA, 22 bp, Artificial Sequence
  chemically synthesized
ttctgaaggtgtataaattgtt

SEQ ID NO: 1001989 - DNA, 22 bp, Artificial Sequence
  chemically synthesized
tattcttctgaaggtgtataaa

SEQ ID NO: 1001990 - DNA, 22 bp, Artificial Sequence
  chemically synthesized
atattcttctgaaggtgtataa

SEQ ID NO: 1001991 - DNA, 22 bp, Artificial Sequence
  chemically synthesized
atttatattcttctgaaggtgt

SEQ ID NO: 1001992 - DNA, 22 bp, Artificial Sequence
  chemically synthesized
aacaatttatacaccttcagaa

SEQ ID NO: 1001993 - DNA, 22 bp, Artificial Sequence
  chemically synthesized
acaatttatacaccttcagaag

SEQ ID NO: 1001994 - DNA, 22 bp, Artificial Sequence
  chemically synthesized
tagaattaatttatattcttct

SEQ ID NO: 1001995 - DNA, 22 bp, Artificial Sequence
  chemically synthesized
atacaccttcagaagaatataa

SEQ ID NO: 1001996 - DNA, 22 bp, Artificial Sequence
  chemically synthesized
tacaccttcagaagaatataaa

SEQ ID NO: 1001997 - DNA, 22 bp, Artificial Sequence
  chemically synthesized
caattgtagaattaatttatat

SEQ ID NO: 1001998 - DNA, 22 bp, Artificial Sequence
  chemically synthesized
ccaattgtagaattaatttata

SEQ ID NO: 1001999 - DNA, 22 bp, Artificial Sequence
  chemically synthesized
tccaattgtagaattaatttat

SEQ ID NO: 1002000 - DNA, 22 bp, Artificial Sequence
  chemically synthesized
cagaagaatataaattaattct

SEQ ID NO: 1002001 - DNA, 22 bp, Artificial Sequence
  chemically synthesized
agaagaatataaattaattcta

SEQ ID NO: 1002002 - DNA, 22 bp, Artificial Sequence
  chemically synthesized
aagcctttccaattgtagaatt

SEQ ID NO: 1002003 - DNA, 22 bp, Artificial Sequence
  chemically synthesized
atgctgaagcctttccaattgt

SEQ ID NO: 1002004 - DNA, 22 bp, Artificial Sequence
  chemically synthesized
attctacaattggaaaggcttc

SEQ ID NO: 1002005 - DNA, 22 bp, Artificial Sequence
  chemically synthesized
tacaattggaaaggcttcagca

SEQ ID NO: 1002006 - DNA, 22 bp, Artificial Sequence
  chemically synthesized
gggatagaattgatgctgaagc

SEQ ID NO: 1002007 - DNA, 22 bp, Artificial Sequence
  chemically synthesized
caattggaaaggcttcagcatc

SEQ ID NO: 1002008 - DNA, 22 bp, Artificial Sequence
  chemically synthesized
gaaaggcttcagcatcaattct

SEQ ID NO: 1002009 - DNA, 22 bp, Artificial Sequence
  chemically synthesized
tacagacaaaaattagggatag

SEQ ID NO: 1002010 - DNA, 22 bp, Artificial Sequence
  chemically synthesized
cagcatcaattctatccctaat

SEQ ID NO: 1002011 - DNA, 22 bp, Artificial Sequence
  chemically synthesized
agcatcaattctatccctaatt

SEQ ID NO: 1002012 - DNA, 22 bp, Artificial Sequence
  chemically synthesized
catctatacagacaaaaattag

SEQ ID NO: 1002013 - DNA, 22 bp, Artificial Sequence
  chemically synthesized
acatctatacagacaaaaatta

SEQ ID NO: 1002014 - DNA, 22 bp, Artificial Sequence
  chemically synthesized
tatccctaatttttgtctgtat

SEQ ID NO: 1002015 - DNA, 22 bp, Artificial Sequence
  chemically synthesized
atcatttacatctatacagaca

SEQ ID NO: 1002016 - DNA, 22 bp, Artificial Sequence
  chemically synthesized
tccctaatttttgtctgtatag

SEQ ID NO: 1002017 - DNA, 22 bp, Artificial Sequence
  chemically synthesized
catcatttacatctatacagac

SEQ ID NO: 1002018 - DNA, 22 bp, Artificial Sequence
  chemically synthesized
tcatcatttacatctatacaga

SEQ ID NO: 1002019 - DNA, 22 bp, Artificial Sequence
  chemically synthesized
ttcatcatttacatctatacag

SEQ ID NO: 1002020 - DNA, 22 bp, Artificial Sequence
  chemically synthesized
atttttgtctgtatagatgtaa

SEQ ID NO: 1002021 - DNA, 22 bp, Artificial Sequence
  chemically synthesized
ttgtctgtatagatgtaaatga

SEQ ID NO: 1002022 - DNA, 22 bp, Artificial Sequence
  chemically synthesized
tgtctgtatagatgtaaatgat

SEQ ID NO: 1002023 - DNA, 22 bp, Artificial Sequence
  chemically synthesized
gtctgtatagatgtaaatgatg

SEQ ID NO: 1002024 - DNA, 22 bp, Artificial Sequence
  chemically synthesized
aataagatttttcatcatttac

SEQ ID NO: 1002025 - DNA, 22 bp, Artificial Sequence
  chemically synthesized
tctgtatagatgtaaatgatga

SEQ ID NO: 1002026 - DNA, 22 bp, Artificial Sequence
  chemically synthesized
gaataagatttttcatcattta

SEQ ID NO: 1002027 - DNA, 22 bp, Artificial Sequence
  chemically synthesized
tttgaataagatttttcatcat

SEQ ID NO: 1002028 - DNA, 22 bp, Artificial Sequence
  chemically synthesized
tatagatgtaaatgatgaaaaa

SEQ ID NO: 1002029 - DNA, 22 bp, Artificial Sequence
  chemically synthesized
acctatttgaataagatttttc

SEQ ID NO: 1002030 - DNA, 22 bp, Artificial Sequence
  chemically synthesized
ctcacctatttgaataagattt

SEQ ID NO: 1002031 - DNA, 22 bp, Artificial Sequence
  chemically synthesized
tactcacctatttgaataagat

SEQ ID NO: 1002032 - DNA, 22 bp, Artificial Sequence
  chemically synthesized
ctactcacctatttgaataaga

SEQ ID NO: 1002033 - DNA, 22 bp, Artificial Sequence
  chemically synthesized
tctactcacctatttgaataag

SEQ ID NO: 1002034 - DNA, 22 bp, Artificial Sequence
  chemically synthesized
tttctactcacctatttgaata

SEQ ID NO: 1002035 - DNA, 22 bp, Artificial Sequence
  chemically synthesized
ctttctactcacctatttgaat

SEQ ID NO: 1002036 - DNA, 22 bp, Artificial Sequence
  chemically synthesized
cgtttctttctactcacctatt

SEQ ID NO: 1002037 - DNA, 22 bp, Artificial Sequence
  chemically synthesized
ccgtttctttctactcacctat

SEQ ID NO: 1002038 - DNA, 22 bp, Artificial Sequence
  chemically synthesized
cttccgtttctttctactcacc

SEQ ID NO: 1002039 - DNA, 22 bp, Artificial Sequence
  chemically synthesized
attcaaataggtgagtagaaag

SEQ ID NO: 1002040 - DNA, 22 bp, Artificial Sequence
  chemically synthesized
ttcaaataggtgagtagaaaga

SEQ ID NO: 1002041 - DNA, 22 bp, Artificial Sequence
  chemically synthesized
aaataggtgagtagaaagaaac

SEQ ID NO: 1002042 - DNA, 22 bp, Artificial Sequence
  chemically synthesized
taatacaattccttccgtttct

SEQ ID NO: 1002043 - DNA, 22 bp, Artificial Sequence
  chemically synthesized
ctataatacaattccttccgtt

SEQ ID NO: 1002044 - DNA, 22 bp, Artificial Sequence
  chemically synthesized
agcaatgctactataatacaat

SEQ ID NO: 1002045 - DNA, 22 bp, Artificial Sequence
  chemically synthesized
tattatagtagcattgcttaat

SEQ ID NO: 1002046 - DNA, 22 bp, Artificial Sequence
  chemically synthesized
tagtagcattgcttaatcattt

SEQ ID NO: 1002047 - DNA, 22 bp, Artificial Sequence
  chemically synthesized
gcatatgccatagcaggagcac

SEQ ID NO: 1002048 - DNA, 22 bp, Artificial Sequence
  chemically synthesized
cttaatcatttgtgctcctgct

SEQ ID NO: 1002049 - DNA, 22 bp, Artificial Sequence
  chemically synthesized
agcatatgccatagcaggagca

SEQ ID NO: 1002050 - DNA, 22 bp, Artificial Sequence
  chemically synthesized
tagcatatgccatagcaggagc

SEQ ID NO: 1002051 - DNA, 22 bp, Artificial Sequence
  chemically synthesized
ttagcatatgccatagcaggag

SEQ ID NO: 1002052 - DNA, 22 bp, Artificial Sequence
  chemically synthesized
aatcatttgtgctcctgctatg

SEQ ID NO: 1002053 - DNA, 22 bp, Artificial Sequence
  chemically synthesized
atcatttgtgctcctgctatgg

SEQ ID NO: 1002054 - DNA, 22 bp, Artificial Sequence
  chemically synthesized
gtgctcctgctatggcatatgc

SEQ ID NO: 1002055 - DNA, 22 bp, Artificial Sequence
  chemically synthesized
tgctcctgctatggcatatgct

SEQ ID NO: 1002056 - DNA, 22 bp, Artificial Sequence
  chemically synthesized
ctgctatggcatatgctaaaag

SEQ ID NO: 1002057 - DNA, 22 bp, Artificial Sequence
  chemically synthesized
ctatggcatatgctaaaagtac

SEQ ID NO: 1002058 - DNA, 22 bp, Artificial Sequence
  chemically synthesized
tggcatatgctaaaagtacatg

SEQ ID NO: 1002059 - DNA, 22 bp, Artificial Sequence
  chemically synthesized
gtaagcaatcatcatgtacttt

SEQ ID NO: 1002060 - DNA, 22 bp, Artificial Sequence
  chemically synthesized
ggtaagcaatcatcatgtactt

SEQ ID NO: 1002061 - DNA, 22 bp, Artificial Sequence
  chemically synthesized
tggtaagcaatcatcatgtact

SEQ ID NO: 1002062 - DNA, 22 bp, Artificial Sequence
  chemically synthesized
aaagtacatgatgattgcttac

SEQ ID NO: 1002063 - DNA, 22 bp, Artificial Sequence
  chemically synthesized
aaaatacgttttggtaagcaat

SEQ ID NO: 1002064 - DNA, 22 bp, Artificial Sequence
  chemically synthesized
cttaccaaaacgtatttttaat

SEQ ID NO: 1002065 - DNA, 22 bp, Artificial Sequence
  chemically synthesized
tcagccgatagatcattaaaaa

SEQ ID NO: 1002066 - DNA, 22 bp, Artificial Sequence
  chemically synthesized
accaaaacgtatttttaatgat

SEQ ID NO: 1002067 - DNA, 22 bp, Artificial Sequence
  chemically synthesized
ccaaaacgtatttttaatgatc

SEQ ID NO: 1002068 - DNA, 22 bp, Artificial Sequence
  chemically synthesized
ataagttgtcagccgatagatc

SEQ ID NO: 1002069 - DNA, 22 bp, Artificial Sequence
  chemically synthesized
ttaatgatctatcggctgacaa

SEQ ID NO: 1002070 - DNA, 22 bp, Artificial Sequence
  chemically synthesized
taatgatctatcggctgacaac

SEQ ID NO: 1002071 - DNA, 22 bp, Artificial Sequence
  chemically synthesized
aatgatctatcggctgacaact

SEQ ID NO: 1002072 - DNA, 22 bp, Artificial Sequence
  chemically synthesized
atgatctatcggctgacaactt

SEQ ID NO: 1002073 - DNA, 22 bp, Artificial Sequence
  chemically synthesized
tcggctgacaacttatcaggtc

SEQ ID NO: 1002074 - DNA, 22 bp, Artificial Sequence
  chemically synthesized
aacccgaagagaagacctgata

SEQ ID NO: 1002075 - DNA, 22 bp, Artificial Sequence
  chemically synthesized
aactgaacccgaagagaagacc

SEQ ID NO: 1002076 - DNA, 22 bp, Artificial Sequence
  chemically synthesized
acaacttatcaggtcttctctt

SEQ ID NO: 1002077 - DNA, 22 bp, Artificial Sequence
  chemically synthesized
caactgaacccgaagagaagac

SEQ ID NO: 1002078 - DNA, 22 bp, Artificial Sequence
  chemically synthesized
tcaactgaacccgaagagaaga

SEQ ID NO: 1002079 - DNA, 22 bp, Artificial Sequence
  chemically synthesized
ctttcaactgaacccgaagaga

SEQ ID NO: 1002080 - DNA, 22 bp, Artificial Sequence
  chemically synthesized
gctttcaactgaacccgaagag

SEQ ID NO: 1002081 - DNA, 22 bp, Artificial Sequence
  chemically synthesized
tgctttcaactgaacccgaaga

SEQ ID NO: 1002082 - DNA, 22 bp, Artificial Sequence
  chemically synthesized
atcaggtcttctcttcgggttc

SEQ ID NO: 1002083 - DNA, 22 bp, Artificial Sequence
  chemically synthesized
tcaggtcttctcttcgggttca

SEQ ID NO: 1002084 - DNA, 22 bp, Artificial Sequence
  chemically synthesized
tttgctttcaactgaacccgaa

SEQ ID NO: 1002085 - DNA, 22 bp, Artificial Sequence
  chemically synthesized
actctttgctttcaactgaacc

SEQ ID NO: 1002086 - DNA, 22 bp, Artificial Sequence
  chemically synthesized
ctaactctttgctttcaactga

SEQ ID NO: 1002087 - DNA, 22 bp, Artificial Sequence
  chemically synthesized
ctcttcgggttcagttgaaagc

SEQ ID NO: 1002088 - DNA, 22 bp, Artificial Sequence
  chemically synthesized
tcttcgggttcagttgaaagca

SEQ ID NO: 1002089 - DNA, 22 bp, Artificial Sequence
  chemically synthesized
ttcgggttcagttgaaagcaaa

SEQ ID NO: 1002090 - DNA, 22 bp, Artificial Sequence
  chemically synthesized
cgggttcagttgaaagcaaaga

SEQ ID NO: 1002091 - DNA, 22 bp, Artificial Sequence
  chemically synthesized
gggttcagttgaaagcaaagag

SEQ ID NO: 1002092 - DNA, 22 bp, Artificial Sequence
  chemically synthesized
agttgaaagcaaagagttagca

SEQ ID NO: 1002093 - DNA, 22 bp, Artificial Sequence
  chemically synthesized
caagaagagtggttgctaactc

SEQ ID NO: 1002094 - DNA, 22 bp, Artificial Sequence
  chemically synthesized
gcaagaagagtggttgctaact

SEQ ID NO: 1002095 - DNA, 22 bp, Artificial Sequence
  chemically synthesized
tgcaagaagagtggttgctaac

SEQ ID NO: 1002096 - DNA, 22 bp, Artificial Sequence
  chemically synthesized
ttgcaagaagagtggttgctaa

SEQ ID NO: 1002097 - DNA, 22 bp, Artificial Sequence
  chemically synthesized
aaagcaaagagttagcaaccac

SEQ ID NO: 1002098 - DNA, 22 bp, Artificial Sequence
  chemically synthesized
tttgcaagaagagtggttgcta

SEQ ID NO: 1002099 - DNA, 22 bp, Artificial Sequence
  chemically synthesized
gcaaccactcttcttgcaaaaa

SEQ ID NO: 1002100 - DNA, 22 bp, Artificial Sequence
  chemically synthesized
atgacagggcaacatagctttt

SEQ ID NO: 1002101 - DNA, 22 bp, Artificial Sequence
  chemically synthesized
catgacagggcaacatagcttt

SEQ ID NO: 1002102 - DNA, 22 bp, Artificial Sequence
  chemically synthesized
tcatgacagggcaacatagctt

SEQ ID NO: 1002103 - DNA, 22 bp, Artificial Sequence
  chemically synthesized
ttcttgcaaaaagctatgttgc

SEQ ID NO: 1002104 - DNA, 22 bp, Artificial Sequence
  chemically synthesized
cttgcaaaaagctatgttgccc

SEQ ID NO: 1002105 - DNA, 22 bp, Artificial Sequence
  chemically synthesized
ttgcaaaaagctatgttgccct

SEQ ID NO: 1002106 - DNA, 22 bp, Artificial Sequence
  chemically synthesized
gcaaaaagctatgttgccctgt

SEQ ID NO: 1002107 - DNA, 22 bp, Artificial Sequence
  chemically synthesized
caaaaagctatgttgccctgtc

SEQ ID NO: 1002108 - DNA, 22 bp, Artificial Sequence
  chemically synthesized
tgttgccctgtcatgaaagtca

SEQ ID NO: 1002109 - DNA, 22 bp, Artificial Sequence
  chemically synthesized
ccctgtcatgaaagtcattcat

SEQ ID NO: 1002110 - DNA, 22 bp, Artificial Sequence
  chemically synthesized
aaacaaaagaagcatgaatgac

SEQ ID NO: 1002111 - DNA, 22 bp, Artificial Sequence
  chemically synthesized
caaacaaaagaagcatgaatga

SEQ ID NO: 1002112 - DNA, 22 bp, Artificial Sequence
  chemically synthesized
tcatgaaagtcattcatgcttc

SEQ ID NO: 1002113 - DNA, 22 bp, Artificial Sequence
  chemically synthesized
aggcttcaaacaaaagaagcat

SEQ ID NO: 1002114 - DNA, 22 bp, Artificial Sequence
  chemically synthesized
ctaaggcttcaaacaaaagaag

SEQ ID NO: 1002115 - DNA, 22 bp, Artificial Sequence
  chemically synthesized
actaaggcttcaaacaaaagaa

SEQ ID NO: 1002116 - DNA, 22 bp, Artificial Sequence
  chemically synthesized
atcttactaaggcttcaaacaa

SEQ ID NO: 1002117 - DNA, 22 bp, Artificial Sequence
  chemically synthesized
tgatcttactaaggcttcaaac

SEQ ID NO: 1002118 - DNA, 22 bp, Artificial Sequence
  chemically synthesized
atgcttcttttgtttgaagcct

SEQ ID NO: 1002119 - DNA, 22 bp, Artificial Sequence
  chemically synthesized
cttttgtttgaagccttagtaa

SEQ ID NO: 1002120 - DNA, 22 bp, Artificial Sequence
  chemically synthesized
ttttgtttgaagccttagtaag

SEQ ID NO: 1002121 - DNA, 22 bp, Artificial Sequence
  chemically synthesized
atccaactctgatcttactaag

SEQ ID NO: 1002122 - DNA, 22 bp, Artificial Sequence
  chemically synthesized
ttgtttgaagccttagtaagat

SEQ ID NO: 1002123 - DNA, 22 bp, Artificial Sequence
  chemically synthesized
catccaactctgatcttactaa

SEQ ID NO: 1002124 - DNA, 22 bp, Artificial Sequence
  chemically synthesized
tgtttgaagccttagtaagatc

SEQ ID NO: 1002125 - DNA, 22 bp, Artificial Sequence
  chemically synthesized
gtttgaagccttagtaagatca

SEQ ID NO: 1002126 - DNA, 22 bp, Artificial Sequence
  chemically synthesized
tttgaagccttagtaagatcag

SEQ ID NO: 1002127 - DNA, 22 bp, Artificial Sequence
  chemically synthesized
tatttcatccaactctgatctt

SEQ ID NO: 1002128 - DNA, 22 bp, Artificial Sequence
  chemically synthesized
gaagccttagtaagatcagagt

SEQ ID NO: 1002129 - DNA, 22 bp, Artificial Sequence
  chemically synthesized
atatttcatccaactctgatct

SEQ ID NO: 1002130 - DNA, 22 bp, Artificial Sequence
  chemically synthesized
aagccttagtaagatcagagtt

SEQ ID NO: 1002131 - DNA, 22 bp, Artificial Sequence
  chemically synthesized
agtaagatcagagttggatgaa

SEQ ID NO: 1002132 - DNA, 22 bp, Artificial Sequence
  chemically synthesized
gtaagatcagagttggatgaaa

SEQ ID NO: 1002133 - DNA, 22 bp, Artificial Sequence
  chemically synthesized
agaaaaaaagccttatatttca

SEQ ID NO: 1002134 - DNA, 22 bp, Artificial Sequence
  chemically synthesized
aagaaaaaaagccttatatttc

SEQ ID NO: 1002135 - DNA, 22 bp, Artificial Sequence
  chemically synthesized
ccaatttaagaaaaaaagcctt

SEQ ID NO: 1002136 - DNA, 22 bp, Artificial Sequence
  chemically synthesized
gatgaaatataaggcttttttt

SEQ ID NO: 1002137 - DNA, 22 bp, Artificial Sequence
  chemically synthesized
tcccaatttaagaaaaaaagcc

SEQ ID NO: 1002138 - DNA, 22 bp, Artificial Sequence
  chemically synthesized
ctcccaatttaagaaaaaaagc

SEQ ID NO: 1002139 - DNA, 22 bp, Artificial Sequence
  chemically synthesized
accacttctcccaatttaagaa

SEQ ID NO: 1002140 - DNA, 22 bp, Artificial Sequence
  chemically synthesized
taaccacttctcccaatttaag

SEQ ID NO: 1002141 - DNA, 22 bp, Artificial Sequence
  chemically synthesized
ctaaccacttctcccaatttaa

SEQ ID NO: 1002142 - DNA, 22 bp, Artificial Sequence
  chemically synthesized
tctaaccacttctcccaattta

SEQ ID NO: 1002143 - DNA, 22 bp, Artificial Sequence
  chemically synthesized
ttctaaccacttctcccaattt

SEQ ID NO: 1002144 - DNA, 22 bp, Artificial Sequence
  chemically synthesized
tttttcttaaattgggagaagt

SEQ ID NO: 1002145 - DNA, 22 bp, Artificial Sequence
  chemically synthesized
ccttttctaaccacttctccca

SEQ ID NO: 1002146 - DNA, 22 bp, Artificial Sequence
  chemically synthesized
ttttcttaaattgggagaagtg

SEQ ID NO: 1002147 - DNA, 22 bp, Artificial Sequence
  chemically synthesized
gccttttctaaccacttctccc

SEQ ID NO: 1002148 - DNA, 22 bp, Artificial Sequence
  chemically synthesized
tttcttaaattgggagaagtgg

SEQ ID NO: 1002149 - DNA, 22 bp, Artificial Sequence
  chemically synthesized
ttcttaaattgggagaagtggt

SEQ ID NO: 1002150 - DNA, 22 bp, Artificial Sequence
  chemically synthesized
tcttaaattgggagaagtggtt

SEQ ID NO: 1002151 - DNA, 22 bp, Artificial Sequence
  chemically synthesized
cttaaattgggagaagtggtta

SEQ ID NO: 1002152 - DNA, 22 bp, Artificial Sequence
  chemically synthesized
ttaaattgggagaagtggttag

SEQ ID NO: 1002153 - DNA, 22 bp, Artificial Sequence
  chemically synthesized
aaattgggagaagtggttagaa

SEQ ID NO: 1002154 - DNA, 22 bp, Artificial Sequence
  chemically synthesized
accacttgccttttctaaccac

SEQ ID NO: 1002155 - DNA, 22 bp, Artificial Sequence
  chemically synthesized
aattgggagaagtggttagaaa

SEQ ID NO: 1002156 - DNA, 22 bp, Artificial Sequence
  chemically synthesized
taaccacttgccttttctaacc

SEQ ID NO: 1002157 - DNA, 22 bp, Artificial Sequence
  chemically synthesized
ctaaccacttgccttttctaac

SEQ ID NO: 1002158 - DNA, 22 bp, Artificial Sequence
  chemically synthesized
tctaaccacttgccttttctaa

SEQ ID NO: 1002159 - DNA, 22 bp, Artificial Sequence
  chemically synthesized
ggagaagtggttagaaaaggca

SEQ ID NO: 1002160 - DNA, 22 bp, Artificial Sequence
  chemically synthesized
ctttctaaccacttgccttttc

SEQ ID NO: 1002161 - DNA, 22 bp, Artificial Sequence
  chemically synthesized
tcctttctaaccacttgccttt

SEQ ID NO: 1002162 - DNA, 22 bp, Artificial Sequence
  chemically synthesized
ctcctttctaaccacttgcctt

SEQ ID NO: 1002163 - DNA, 22 bp, Artificial Sequence
  chemically synthesized
tttctcctttctaaccacttgc

SEQ ID NO: 1002164 - DNA, 22 bp, Artificial Sequence
  chemically synthesized
gaaaaggcaagtggttagaaag

SEQ ID NO: 1002165 - DNA, 22 bp, Artificial Sequence
  chemically synthesized
aggctgtttctcctttctaacc

SEQ ID NO: 1002166 - DNA, 22 bp, Artificial Sequence
  chemically synthesized
tagtcaagacctcaggctgttt

SEQ ID NO: 1002167 - DNA, 22 bp, Artificial Sequence
  chemically synthesized
gaaaggagaaacagcctgaggt

SEQ ID NO: 1002168 - DNA, 22 bp, Artificial Sequence
  chemically synthesized
aggtcttgactacagatgtctt

SEQ ID NO: 1002169 - DNA, 22 bp, Artificial Sequence
  chemically synthesized
gactacagatgtcttttttttt

SEQ ID NO: 1002170 - DNA, 22 bp, Artificial Sequence
  chemically synthesized
actacagatgtctttttttttt

SEQ ID NO: 1002171 - DNA, 22 bp, Artificial Sequence
  chemically synthesized
aaaaaaaaaaaaaaaaaaaaaa

SEQ ID NO: 1002172 - DNA, 22 bp, Artificial Sequence
  chemically synthesized
cagatgtctttttttttttttt

SEQ ID NO: 1002173 - DNA, 22 bp, Artificial Sequence
  chemically synthesized
cctgaaaaaaaaaaaaaaaaaa

SEQ ID NO: 1002174 - DNA, 22 bp, Artificial Sequence
  chemically synthesized
aattgcctgaaaaaaaaaaaaa

SEQ ID NO: 1002175 - DNA, 22 bp, Artificial Sequence
  chemically synthesized
ttttttttttttttttttttca

SEQ ID NO: 1002176 - DNA, 22 bp, Artificial Sequence
  chemically synthesized
tttttttttttttttttttcag

SEQ ID NO: 1002177 - DNA, 22 bp, Artificial Sequence
  chemically synthesized
ttttttttttttttttttcagg

SEQ ID NO: 1002178 - DNA, 22 bp, Artificial Sequence
  chemically synthesized
aaaactgaattgcctgaaaaaa

SEQ ID NO: 1002179 - DNA, 22 bp, Artificial Sequence
  chemically synthesized
tttttttttttttttttcaggc

SEQ ID NO: 1002180 - DNA, 22 bp, Artificial Sequence
  chemically synthesized
ttttttttttttttttcaggca

SEQ ID NO: 1002181 - DNA, 22 bp, Artificial Sequence
  chemically synthesized
tttttttttttttttcaggcaa

SEQ ID NO: 1002182 - DNA, 22 bp, Artificial Sequence
  chemically synthesized
ctgaaaactgaattgcctgaaa

SEQ ID NO: 1002183 - DNA, 22 bp, Artificial Sequence
  chemically synthesized
ttttttttttttttcaggcaat

SEQ ID NO: 1002184 - DNA, 22 bp, Artificial Sequence
  chemically synthesized
cctgaaaactgaattgcctgaa

SEQ ID NO: 1002185 - DNA, 22 bp, Artificial Sequence
  chemically synthesized
tttttttttttttcaggcaatt

SEQ ID NO: 1002186 - DNA, 22 bp, Artificial Sequence
  chemically synthesized
ttttttttttttcaggcaattc

SEQ ID NO: 1002187 - DNA, 22 bp, Artificial Sequence
  chemically synthesized
ttcctgaaaactgaattgcctg

SEQ ID NO: 1002188 - DNA, 22 bp, Artificial Sequence
  chemically synthesized
tttttttttttcaggcaattca

SEQ ID NO: 1002189 - DNA, 22 bp, Artificial Sequence
  chemically synthesized
ttttttttttcaggcaattcag

SEQ ID NO: 1002190 - DNA, 22 bp, Artificial Sequence
  chemically synthesized
tttttttttcaggcaattcagt

SEQ ID NO: 1002191 - DNA, 22 bp, Artificial Sequence
  chemically synthesized
ttttttttcaggcaattcagtt

SEQ ID NO: 1002192 - DNA, 22 bp, Artificial Sequence
  chemically synthesized
tttttttcaggcaattcagttt

SEQ ID NO: 1002193 - DNA, 22 bp, Artificial Sequence
  chemically synthesized
tactcttcctgaaaactgaatt

SEQ ID NO: 1002194 - DNA, 22 bp, Artificial Sequence
  chemically synthesized
ttttttcaggcaattcagtttt

SEQ ID NO: 1002195 - DNA, 22 bp, Artificial Sequence
  chemically synthesized
gtactcttcctgaaaactgaat

SEQ ID NO: 1002196 - DNA, 22 bp, Artificial Sequence
  chemically synthesized
tttttcaggcaattcagttttc

SEQ ID NO: 1002197 - DNA, 22 bp, Artificial Sequence
  chemically synthesized
tgtactcttcctgaaaactgaa

SEQ ID NO: 1002198 - DNA, 22 bp, Artificial Sequence
  chemically synthesized
ttttcaggcaattcagttttca

SEQ ID NO: 1002199 - DNA, 22 bp, Artificial Sequence
  chemically synthesized
tttcaggcaattcagttttcag

SEQ ID NO: 1002200 - DNA, 22 bp, Artificial Sequence
  chemically synthesized
ttcaggcaattcagttttcagg

SEQ ID NO: 1002201 - DNA, 22 bp, Artificial Sequence
  chemically synthesized
ttttgtactcttcctgaaaact

SEQ ID NO: 1002202 - DNA, 22 bp, Artificial Sequence
  chemically synthesized
tcaggcaattcagttttcagga

SEQ ID NO: 1002203 - DNA, 22 bp, Artificial Sequence
  chemically synthesized
attttgtactcttcctgaaaac

SEQ ID NO: 1002204 - DNA, 22 bp, Artificial Sequence
  chemically synthesized
caggcaattcagttttcaggaa

SEQ ID NO: 1002205 - DNA, 22 bp, Artificial Sequence
  chemically synthesized
tattttgtactcttcctgaaaa

SEQ ID NO: 1002206 - DNA, 22 bp, Artificial Sequence
  chemically synthesized
aggcaattcagttttcaggaag

SEQ ID NO: 1002207 - DNA, 22 bp, Artificial Sequence
  chemically synthesized
ctttattttgtactcttcctga

SEQ ID NO: 1002208 - DNA, 22 bp, Artificial Sequence
  chemically synthesized
tactttattttgtactcttcct

SEQ ID NO: 1002209 - DNA, 22 bp, Artificial Sequence
  chemically synthesized
ctactttattttgtactcttcc

SEQ ID NO: 1002210 - DNA, 22 bp, Artificial Sequence
  chemically synthesized
agttttcaggaagagtacaaaa

SEQ ID NO: 1002211 - DNA, 22 bp, Artificial Sequence
  chemically synthesized
gatcttctactttattttgtac

SEQ ID NO: 1002212 - DNA, 22 bp, Artificial Sequence
  chemically synthesized
tagatcttctactttattttgt

SEQ ID NO: 1002213 - DNA, 22 bp, Artificial Sequence
  chemically synthesized
tcaggaagagtacaaaataaag

SEQ ID NO: 1002214 - DNA, 22 bp, Artificial Sequence
  chemically synthesized
ctagatcttctactttattttg

SEQ ID NO: 1002215 - DNA, 22 bp, Artificial Sequence
  chemically synthesized
caggaagagtacaaaataaagt

SEQ ID NO: 1002216 - DNA, 22 bp, Artificial Sequence
  chemically synthesized
aggaagagtacaaaataaagta

SEQ ID NO: 1002217 - DNA, 22 bp, Artificial Sequence
  chemically synthesized
tttctagatcttctactttatt

SEQ ID NO: 1002218 - DNA, 22 bp, Artificial Sequence
  chemically synthesized
atttctagatcttctactttat

SEQ ID NO: 1002219 - DNA, 22 bp, Artificial Sequence
  chemically synthesized
agggaatttatttctagatctt

SEQ ID NO: 1002220 - DNA, 22 bp, Artificial Sequence
  chemically synthesized
aagggaatttatttctagatct

SEQ ID NO: 1002221 - DNA, 22 bp, Artificial Sequence
  chemically synthesized
taagggaatttatttctagatc

SEQ ID NO: 1002222 - DNA, 22 bp, Artificial Sequence
  chemically synthesized
gaaataaattcccttaaaacta

SEQ ID NO: 1002223 - DNA, 22 bp, Artificial Sequence
  chemically synthesized
caaggagtaggcacagatagtt

SEQ ID NO: 1002224 - DNA, 22 bp, Artificial Sequence
  chemically synthesized
ccttaaaactatctgtgcctac

SEQ ID NO: 1002225 - DNA, 22 bp, Artificial Sequence
  chemically synthesized
aaaactatctgtgcctactcct

SEQ ID NO: 1002226 - DNA, 22 bp, Artificial Sequence
  chemically synthesized
aaactatctgtgcctactcctt

SEQ ID NO: 1002227 - DNA, 22 bp, Artificial Sequence
  chemically synthesized
tctgtgcctactccttggaatg

SEQ ID NO: 1002228 - DNA, 22 bp, Artificial Sequence
  chemically synthesized
ggagtacatgaaggcattccaa

SEQ ID NO: 1002229 - DNA, 22 bp, Artificial Sequence
  chemically synthesized
tgcctactccttggaatgcctt

SEQ ID NO: 1002230 - DNA, 22 bp, Artificial Sequence
  chemically synthesized
ctccttggaatgccttcatgta

SEQ ID NO: 1002231 - DNA, 22 bp, Artificial Sequence
  chemically synthesized
cttggaatgccttcatgtactc

SEQ ID NO: 1002232 - DNA, 22 bp, Artificial Sequence
  chemically synthesized
ggaatgccttcatgtactccca

SEQ ID NO: 1002233 - DNA, 22 bp, Artificial Sequence
  chemically synthesized
gaatgccttcatgtactcccag

SEQ ID NO: 1002234 - DNA, 22 bp, Artificial Sequence
  chemically synthesized
acagtggagtaacctgggagta

SEQ ID NO: 1002235 - DNA, 22 bp, Artificial Sequence
  chemically synthesized
tcctcacagtggagtaacctgg

SEQ ID NO: 1002236 - DNA, 22 bp, Artificial Sequence
  chemically synthesized
catgtactcccaggttactcca

SEQ ID NO: 1002237 - DNA, 22 bp, Artificial Sequence
  chemically synthesized
atgtactcccaggttactccac

SEQ ID NO: 1002238 - DNA, 22 bp, Artificial Sequence
  chemically synthesized
aaacagctgtcctcacagtgga

SEQ ID NO: 1002239 - DNA, 22 bp, Artificial Sequence
  chemically synthesized
aaaacagctgtcctcacagtgg

SEQ ID NO: 1002240 - DNA, 22 bp, Artificial Sequence
  chemically synthesized
ccaggttactccactgtgagga

SEQ ID NO: 1002241 - DNA, 22 bp, Artificial Sequence
  chemically synthesized
ttaaaacagctgtcctcacagt

SEQ ID NO: 1002242 - DNA, 22 bp, Artificial Sequence
  chemically synthesized
cttaaaacagctgtcctcacag

SEQ ID NO: 1002243 - DNA, 22 bp, Artificial Sequence
  chemically synthesized
ctccactgtgaggacagctgtt

SEQ ID NO: 1002244 - DNA, 22 bp, Artificial Sequence
  chemically synthesized
gaaatttcttaaaacagctgtc

SEQ ID NO: 1002245 - DNA, 22 bp, Artificial Sequence
  chemically synthesized
cactgtgaggacagctgtttta

SEQ ID NO: 1002246 - DNA, 22 bp, Artificial Sequence
  chemically synthesized
tgaggacagctgttttaagaaa

SEQ ID NO: 1002247 - DNA, 22 bp, Artificial Sequence
  chemically synthesized
tcacaggtaatgattcgaaatt

SEQ ID NO: 1002248 - DNA, 22 bp, Artificial Sequence
  chemically synthesized
gtcacaggtaatgattcgaaat

SEQ ID NO: 1002249 - DNA, 22 bp, Artificial Sequence
  chemically synthesized
ttgtcacaggtaatgattcgaa

SEQ ID NO: 1002250 - DNA, 22 bp, Artificial Sequence
  chemically synthesized
ttttaagaaatttcgaatcatt

SEQ ID NO: 1002251 - DNA, 22 bp, Artificial Sequence
  chemically synthesized
cttgtcacaggtaatgattcga

SEQ ID NO: 1002252 - DNA, 22 bp, Artificial Sequence
  chemically synthesized
taagaaatttcgaatcattacc

SEQ ID NO: 1002253 - DNA, 22 bp, Artificial Sequence
  chemically synthesized
aagaaatttcgaatcattacct

SEQ ID NO: 1002254 - DNA, 22 bp, Artificial Sequence
  chemically synthesized
agaaatttcgaatcattacctg

SEQ ID NO: 1002255 - DNA, 22 bp, Artificial Sequence
  chemically synthesized
tatttcttgtcacaggtaatga

SEQ ID NO: 1002256 - DNA, 22 bp, Artificial Sequence
  chemically synthesized
atatttcttgtcacaggtaatg

SEQ ID NO: 1002257 - DNA, 22 bp, Artificial Sequence
  chemically synthesized
cgaatcattacctgtgacaaga

SEQ ID NO: 1002258 - DNA, 22 bp, Artificial Sequence
  chemically synthesized
gaatcattacctgtgacaagaa

SEQ ID NO: 1002259 - DNA, 22 bp, Artificial Sequence
  chemically synthesized
atgtgccagtttatatttcttg

SEQ ID NO: 1002260 - DNA, 22 bp, Artificial Sequence
  chemically synthesized
tgatgtgccagtttatatttct

SEQ ID NO: 1002261 - DNA, 22 bp, Artificial Sequence
  chemically synthesized
cctgtgacaagaaatataaact

SEQ ID NO: 1002262 - DNA, 22 bp, Artificial Sequence
  chemically synthesized
tgacaagaaatataaactggca

SEQ ID NO: 1002263 - DNA, 22 bp, Artificial Sequence
  chemically synthesized
tcaggagattctgatgtgccag

SEQ ID NO: 1002264 - DNA, 22 bp, Artificial Sequence
  chemically synthesized
gcacatcagaatctcctgataa

SEQ ID NO: 1002265 - DNA, 22 bp, Artificial Sequence
  chemically synthesized
aggaagtggacacacaagttat

SEQ ID NO: 1002266 - DNA, 22 bp, Artificial Sequence
  chemically synthesized
ctgataacttgtgtgtccactt

SEQ ID NO: 1002267 - DNA, 22 bp, Artificial Sequence
  chemically synthesized
ataacttgtgtgtccacttcct

SEQ ID NO: 1002268 - DNA, 22 bp, Artificial Sequence
  chemically synthesized
tgaggtacaactgaggaagtgg

SEQ ID NO: 1002269 - DNA, 22 bp, Artificial Sequence
  chemically synthesized
gctgtgaggtacaactgaggaa

SEQ ID NO: 1002270 - DNA, 22 bp, Artificial Sequence
  chemically synthesized
agctgtgaggtacaactgagga

SEQ ID NO: 1002271 - DNA, 22 bp, Artificial Sequence
  chemically synthesized
gtgtgtccacttcctcagttgt

SEQ ID NO: 1002272 - DNA, 22 bp, Artificial Sequence
  chemically synthesized
tgtgtccacttcctcagttgta

SEQ ID NO: 1002273 - DNA, 22 bp, Artificial Sequence
  chemically synthesized
tttagctgtgaggtacaactga

SEQ ID NO: 1002274 - DNA, 22 bp, Artificial Sequence
  chemically synthesized
cctcagttgtacctcacagcta

SEQ ID NO: 1002275 - DNA, 22 bp, Artificial Sequence
  chemically synthesized
ctcagttgtacctcacagctaa

SEQ ID NO: 1002276 - DNA, 22 bp, Artificial Sequence
  chemically synthesized
acagataactatttagctgtga

SEQ ID NO: 1002277 - DNA, 22 bp, Artificial Sequence
  chemically synthesized
aacagataactatttagctgtg

SEQ ID NO: 1002278 - DNA, 22 bp, Artificial Sequence
  chemically synthesized
agttgtacctcacagctaaata

SEQ ID NO: 1002279 - DNA, 22 bp, Artificial Sequence
  chemically synthesized
gtttaacagataactatttagc

SEQ ID NO: 1002280 - DNA, 22 bp, Artificial Sequence
  chemically synthesized
ggtttaacagataactatttag

SEQ ID NO: 1002281 - DNA, 22 bp, Artificial Sequence
  chemically synthesized
tacctcacagctaaatagttat

SEQ ID NO: 1002282 - DNA, 22 bp, Artificial Sequence
  chemically synthesized
ttggtttaacagataactattt

SEQ ID NO: 1002283 - DNA, 22 bp, Artificial Sequence
  chemically synthesized
tcttggtttaacagataactat

SEQ ID NO: 1002284 - DNA, 22 bp, Artificial Sequence
  chemically synthesized
ctcttggtttaacagataacta

SEQ ID NO: 1002285 - DNA, 22 bp, Artificial Sequence
  chemically synthesized
acagctaaatagttatctgtta

SEQ ID NO: 1002286 - DNA, 22 bp, Artificial Sequence
  chemically synthesized
caacttctcttggtttaacaga

SEQ ID NO: 1002287 - DNA, 22 bp, Artificial Sequence
  chemically synthesized
aatagttatctgttaaaccaag

SEQ ID NO: 1002288 - DNA, 22 bp, Artificial Sequence
  chemically synthesized
tctgttaaaccaagagaagttg

SEQ ID NO: 1002289 - DNA, 22 bp, Artificial Sequence
  chemically synthesized
cccccagaactgcaacttctct

SEQ ID NO: 1002290 - DNA, 22 bp, Artificial Sequence
  chemically synthesized
ttgcccccagaactgcaacttc

SEQ ID NO: 1002291 - DNA, 22 bp, Artificial Sequence
  chemically synthesized
ttaaaccaagagaagttgcagt

SEQ ID NO: 1002292 - DNA, 22 bp, Artificial Sequence
  chemically synthesized
aaccaagagaagttgcagttct

SEQ ID NO: 1002293 - DNA, 22 bp, Artificial Sequence
  chemically synthesized
cagttctgggggcaatagcctt

SEQ ID NO: 1002294 - DNA, 22 bp, Artificial Sequence
  chemically synthesized
aggcacaaataccaataaggct

SEQ ID NO: 1002295 - DNA, 22 bp, Artificial Sequence
  chemically synthesized
tgggggcaatagccttattggt

SEQ ID NO: 1002296 - DNA, 22 bp, Artificial Sequence
  chemically synthesized
ggggcaatagccttattggtat

SEQ ID NO: 1002297 - DNA, 22 bp, Artificial Sequence
  chemically synthesized
tattcaggcacaaataccaata

SEQ ID NO: 1002298 - DNA, 22 bp, Artificial Sequence
  chemically synthesized
agaattatattcaggcacaaat

SEQ ID NO: 1002299 - DNA, 22 bp, Artificial Sequence
  chemically synthesized
attggtatttgtgcctgaatat

SEQ ID NO: 1002300 - DNA, 22 bp, Artificial Sequence
  chemically synthesized
ttggtatttgtgcctgaatata

SEQ ID NO: 1002301 - DNA, 22 bp, Artificial Sequence
  chemically synthesized
gtatttgtgcctgaatataatt

SEQ ID NO: 1002302 - DNA, 22 bp, Artificial Sequence
  chemically synthesized
gtgcctgaatataattctgaac

SEQ ID NO: 1002303 - DNA, 22 bp, Artificial Sequence
  chemically synthesized
tgcctgaatataattctgaact

SEQ ID NO: 1002304 - DNA, 22 bp, Artificial Sequence
  chemically synthesized
gaaggtagaaaagagggagttc

SEQ ID NO: 1002305 - DNA, 22 bp, Artificial Sequence
  chemically synthesized
aatataattctgaactccctct

SEQ ID NO: 1002306 - DNA, 22 bp, Artificial Sequence
  chemically synthesized
aaagcctagaaggtagaaaaga

SEQ ID NO: 1002307 - DNA, 22 bp, Artificial Sequence
  chemically synthesized
tgaactccctcttttctacctt

SEQ ID NO: 1002308 - DNA, 22 bp, Artificial Sequence
  chemically synthesized
aactccctcttttctaccttct

SEQ ID NO: 1002309 - DNA, 22 bp, Artificial Sequence
  chemically synthesized
cctcttttctaccttctaggct

SEQ ID NO: 1002310 - DNA, 22 bp, Artificial Sequence
  chemically synthesized
ttttctaccttctaggctttga

SEQ ID NO: 1002311 - DNA, 22 bp, Artificial Sequence
  chemically synthesized
aaataaatgaactcaaagccta

SEQ ID NO: 1002312 - DNA, 22 bp, Artificial Sequence
  chemically synthesized
ttctaccttctaggctttgagt

SEQ ID NO: 1002313 - DNA, 22 bp, Artificial Sequence
  chemically synthesized
tctaccttctaggctttgagtt

SEQ ID NO: 1002314 - DNA, 22 bp, Artificial Sequence
  chemically synthesized
ctgaaataaatgaactcaaagc

SEQ ID NO: 1002315 - DNA, 22 bp, Artificial Sequence
  chemically synthesized
ctaccttctaggctttgagttc

SEQ ID NO: 1002316 - DNA, 22 bp, Artificial Sequence
  chemically synthesized
taccttctaggctttgagttca

SEQ ID NO: 1002317 - DNA, 22 bp, Artificial Sequence
  chemically synthesized
ctgctgaaataaatgaactcaa

SEQ ID NO: 1002318 - DNA, 22 bp, Artificial Sequence
  chemically synthesized
ccttctaggctttgagttcatt

SEQ ID NO: 1002319 - DNA, 22 bp, Artificial Sequence
  chemically synthesized
gctgctgaaataaatgaactca

SEQ ID NO: 1002320 - DNA, 22 bp, Artificial Sequence
  chemically synthesized
tgctgctgaaataaatgaactc

SEQ ID NO: 1002321 - DNA, 22 bp, Artificial Sequence
  chemically synthesized
ttgctgctgaaataaatgaact

SEQ ID NO: 1002322 - DNA, 22 bp, Artificial Sequence
  chemically synthesized
ctaggctttgagttcatttatt

SEQ ID NO: 1002323 - DNA, 22 bp, Artificial Sequence
  chemically synthesized
taggctttgagttcatttattt

SEQ ID NO: 1002324 - DNA, 22 bp, Artificial Sequence
  chemically synthesized
ggctttgagttcatttatttca

SEQ ID NO: 1002325 - DNA, 22 bp, Artificial Sequence
  chemically synthesized
acatcttttgctgctgaaataa

SEQ ID NO: 1002326 - DNA, 22 bp, Artificial Sequence
  chemically synthesized
tgagttcatttatttcagcagc

SEQ ID NO: 1002327 - DNA, 22 bp, Artificial Sequence
  chemically synthesized
ctgacatcttttgctgctgaaa

SEQ ID NO: 1002328 - DNA, 22 bp, Artificial Sequence
  chemically synthesized
gagttcatttatttcagcagca

SEQ ID NO: 1002329 - DNA, 22 bp, Artificial Sequence
  chemically synthesized
agttcatttatttcagcagcaa

SEQ ID NO: 1002330 - DNA, 22 bp, Artificial Sequence
  chemically synthesized
ctcctgacatcttttgctgctg

SEQ ID NO: 1002331 - DNA, 22 bp, Artificial Sequence
  chemically synthesized
gctcctgacatcttttgctgct

SEQ ID NO: 1002332 - DNA, 22 bp, Artificial Sequence
  chemically synthesized
ttgctcctgacatcttttgctg

SEQ ID NO: 1002333 - DNA, 22 bp, Artificial Sequence
  chemically synthesized
atttatttcagcagcaaaagat

SEQ ID NO: 1002334 - DNA, 22 bp, Artificial Sequence
  chemically synthesized
cctcttgctcctgacatctttt

SEQ ID NO: 1002335 - DNA, 22 bp, Artificial Sequence
  chemically synthesized
atttcagcagcaaaagatgtca

SEQ ID NO: 1002336 - DNA, 22 bp, Artificial Sequence
  chemically synthesized
tttcagcagcaaaagatgtcag

SEQ ID NO: 1002337 - DNA, 22 bp, Artificial Sequence
  chemically synthesized
cagcagcaaaagatgtcaggag

SEQ ID NO: 1002338 - DNA, 22 bp, Artificial Sequence
  chemically synthesized
agcagcaaaagatgtcaggagc

SEQ ID NO: 1002339 - DNA, 22 bp, Artificial Sequence
  chemically synthesized
tgtgggactgcctcttgctcct

SEQ ID NO: 1002340 - DNA, 22 bp, Artificial Sequence
  chemically synthesized
cactatgtgggactgcctcttg

SEQ ID NO: 1002341 - DNA, 22 bp, Artificial Sequence
  chemically synthesized
aatgaatctacactatgtggga

SEQ ID NO: 1002342 - DNA, 22 bp, Artificial Sequence
  chemically synthesized
attcaatgaatctacactatgt

SEQ ID NO: 1002343 - DNA, 22 bp, Artificial Sequence
  chemically synthesized
cctcattcaatgaatctacact

SEQ ID NO: 1002344 - DNA, 22 bp, Artificial Sequence
  chemically synthesized
gctccctcattcaatgaatcta

SEQ ID NO: 1002345 - DNA, 22 bp, Artificial Sequence
  chemically synthesized
ggctccctcattcaatgaatct

SEQ ID NO: 1002346 - DNA, 22 bp, Artificial Sequence
  chemically synthesized
tttggctccctcattcaatgaa

SEQ ID NO: 1002347 - DNA, 22 bp, Artificial Sequence
  chemically synthesized
aatcactgtttggctccctcat

SEQ ID NO: 1002348 - DNA, 22 bp, Artificial Sequence
  chemically synthesized
taaatcactgtttggctccctc

SEQ ID NO: 1002349 - DNA, 22 bp, Artificial Sequence
  chemically synthesized
ctaaatcactgtttggctccct

SEQ ID NO: 1002350 - DNA, 22 bp, Artificial Sequence
  chemically synthesized
tttctaaatcactgtttggctc

SEQ ID NO: 1002351 - DNA, 22 bp, Artificial Sequence
  chemically synthesized
attgaatgagggagccaaacag

SEQ ID NO: 1002352 - DNA, 22 bp, Artificial Sequence
  chemically synthesized
aatgagggagccaaacagtgat

SEQ ID NO: 1002353 - DNA, 22 bp, Artificial Sequence
  chemically synthesized
gcaatgttgtttctaaatcact

SEQ ID NO: 1002354 - DNA, 22 bp, Artificial Sequence
  chemically synthesized
ctggcaatgttgtttctaaatc

SEQ ID NO: 1002355 - DNA, 22 bp, Artificial Sequence
  chemically synthesized
atcagatagttactggcaatgt

SEQ ID NO: 1002356 - DNA, 22 bp, Artificial Sequence
  chemically synthesized
agaaacaacattgccagtaact

SEQ ID NO: 1002357 - DNA, 22 bp, Artificial Sequence
  chemically synthesized
gaaacaacattgccagtaacta

SEQ ID NO: 1002358 - DNA, 22 bp, Artificial Sequence
  chemically synthesized
aggctaatcagatagttactgg

SEQ ID NO: 1002359 - DNA, 22 bp, Artificial Sequence
  chemically synthesized
cctaaggctaatcagatagtta

SEQ ID NO: 1002360 - DNA, 22 bp, Artificial Sequence
  chemically synthesized
gcctaaggctaatcagatagtt

SEQ ID NO: 1002361 - DNA, 22 bp, Artificial Sequence
  chemically synthesized
ccagtaactatctgattagcct

SEQ ID NO: 1002362 - DNA, 22 bp, Artificial Sequence
  chemically synthesized
agaaacttgcctaaggctaatc

SEQ ID NO: 1002363 - DNA, 22 bp, Artificial Sequence
  chemically synthesized
tctgattagccttaggcaagtt

SEQ ID NO: 1002364 - DNA, 22 bp, Artificial Sequence
  chemically synthesized
aggaaggttgagaaacttgcct

SEQ ID NO: 1002365 - DNA, 22 bp, Artificial Sequence
  chemically synthesized
attagccttaggcaagtttctc

SEQ ID NO: 1002366 - DNA, 22 bp, Artificial Sequence
  chemically synthesized
gccttaggcaagtttctcaacc

SEQ ID NO: 1002367 - DNA, 22 bp, Artificial Sequence
  chemically synthesized
aggcaagtttctcaaccttcct

SEQ ID NO: 1002368 - DNA, 22 bp, Artificial Sequence
  chemically synthesized
ggcaagtttctcaaccttcctg

SEQ ID NO: 1002369 - DNA, 22 bp, Artificial Sequence
  chemically synthesized
tgaagaaacagattcaggaagg

SEQ ID NO: 1002370 - DNA, 22 bp, Artificial Sequence
  chemically synthesized
ttgtgaagaaacagattcagga

SEQ ID NO: 1002371 - DNA, 22 bp, Artificial Sequence
  chemically synthesized
ctcaaccttcctgaatctgttt

SEQ ID NO: 1002372 - DNA, 22 bp, Artificial Sequence
  chemically synthesized
tcaaccttcctgaatctgtttc

SEQ ID NO: 1002373 - DNA, 22 bp, Artificial Sequence
  chemically synthesized
aaccttcctgaatctgtttctt

SEQ ID NO: 1002374 - DNA, 22 bp, Artificial Sequence
  chemically synthesized
ggagttattgtgaagaaacaga

SEQ ID NO: 1002375 - DNA, 22 bp, Artificial Sequence
  chemically synthesized
cctgaatctgtttcttcacaat

SEQ ID NO: 1002376 - DNA, 22 bp, Artificial Sequence
  chemically synthesized
ctgaatctgtttcttcacaata

SEQ ID NO: 1002377 - DNA, 22 bp, Artificial Sequence
  chemically synthesized
aatctgtttcttcacaataact

SEQ ID NO: 1002378 - DNA, 22 bp, Artificial Sequence
  chemically synthesized
tttcttcacaataactcccagt

SEQ ID NO: 1002379 - DNA, 22 bp, Artificial Sequence
  chemically synthesized
cttcacaataactcccagtctg

SEQ ID NO: 1002380 - DNA, 22 bp, Artificial Sequence
  chemically synthesized
ttcacaataactcccagtctgg

SEQ ID NO: 1002381 - DNA, 22 bp, Artificial Sequence
  chemically synthesized
cacaataactcccagtctggct

SEQ ID NO: 1002382 - DNA, 22 bp, Artificial Sequence
  chemically synthesized
acaataactcccagtctggctg

SEQ ID NO: 1002383 - DNA, 22 bp, Artificial Sequence
  chemically synthesized
tgtgagtcgaaggtgcagccag

SEQ ID NO: 1002384 - DNA, 22 bp, Artificial Sequence
  chemically synthesized
gtgtgagtcgaaggtgcagcca

SEQ ID NO: 1002385 - DNA, 22 bp, Artificial Sequence
  chemically synthesized
tgtgtgagtcgaaggtgcagcc

SEQ ID NO: 1002386 - DNA, 22 bp, Artificial Sequence
  chemically synthesized
ccagtctggctgcaccttcgac

SEQ ID NO: 1002387 - DNA, 22 bp, Artificial Sequence
  chemically synthesized
aagatctttgtgtgagtcgaag

SEQ ID NO: 1002388 - DNA, 22 bp, Artificial Sequence
  chemically synthesized
aaagatctttgtgtgagtcgaa

SEQ ID NO: 1002389 - DNA, 22 bp, Artificial Sequence
  chemically synthesized
taaagatctttgtgtgagtcga

SEQ ID NO: 1002390 - DNA, 22 bp, Artificial Sequence
  chemically synthesized
tttaaagatctttgtgtgagtc

SEQ ID NO: 1002391 - DNA, 22 bp, Artificial Sequence
  chemically synthesized
gctgcaccttcgactcacacaa

SEQ ID NO: 1002392 - DNA, 22 bp, Artificial Sequence
  chemically synthesized
caccttcgactcacacaaagat

SEQ ID NO: 1002393 - DNA, 22 bp, Artificial Sequence
  chemically synthesized
cgactcacacaaagatctttaa

SEQ ID NO: 1002394 - DNA, 22 bp, Artificial Sequence
  chemically synthesized
gactcacacaaagatctttaaa

SEQ ID NO: 1002395 - DNA, 22 bp, Artificial Sequence
  chemically synthesized
gacaacagtatctctttaaaga

SEQ ID NO: 1002396 - DNA, 22 bp, Artificial Sequence
  chemically synthesized
ggacaacagtatctctttaaag

SEQ ID NO: 1002397 - DNA, 22 bp, Artificial Sequence
  chemically synthesized
acacaaagatctttaaagagat

SEQ ID NO: 1002398 - DNA, 22 bp, Artificial Sequence
  chemically synthesized
ggggcgatgcttggacaacagt

SEQ ID NO: 1002399 - DNA, 22 bp, Artificial Sequence
  chemically synthesized
taaagagatactgttgtccaag

SEQ ID NO: 1002400 - DNA, 22 bp, Artificial Sequence
  chemically synthesized
ctgggggcgatgcttggacaac

SEQ ID NO: 1002401 - DNA, 22 bp, Artificial Sequence
  chemically synthesized
aaagagatactgttgtccaagc

SEQ ID NO: 1002402 - DNA, 22 bp, Artificial Sequence
  chemically synthesized
aagagatactgttgtccaagca

SEQ ID NO: 1002403 - DNA, 22 bp, Artificial Sequence
  chemically synthesized
ttgtccaagcatcgcccccagg

SEQ ID NO: 1002404 - DNA, 22 bp, Artificial Sequence
  chemically synthesized
tccaagcatcgcccccaggaat

SEQ ID NO: 1002405 - DNA, 22 bp, Artificial Sequence
  chemically synthesized
agcagagaatcaaatccatatt

SEQ ID NO: 1002406 - DNA, 22 bp, Artificial Sequence
  chemically synthesized
gaattaagcagagaatcaaatc

SEQ ID NO: 1002407 - DNA, 22 bp, Artificial Sequence
  chemically synthesized
agaattaagcagagaatcaaat

SEQ ID NO: 1002408 - DNA, 22 bp, Artificial Sequence
  chemically synthesized
tagaattaagcagagaatcaaa

SEQ ID NO: 1002409 - DNA, 22 bp, Artificial Sequence
  chemically synthesized
actttagaattaagcagagaat

SEQ ID NO: 1002410 - DNA, 22 bp, Artificial Sequence
  chemically synthesized
cactttagaattaagcagagaa

SEQ ID NO: 1002411 - DNA, 22 bp, Artificial Sequence
  chemically synthesized
ccttcactttagaattaagcag

SEQ ID NO: 1002412 - DNA, 22 bp, Artificial Sequence
  chemically synthesized
gccttcactttagaattaagca

SEQ ID NO: 1002413 - DNA, 22 bp, Artificial Sequence
  chemically synthesized
tgccttcactttagaattaagc

SEQ ID NO: 1002414 - DNA, 22 bp, Artificial Sequence
  chemically synthesized
ttttgccttcactttagaatta

SEQ ID NO: 1002415 - DNA, 22 bp, Artificial Sequence
  chemically synthesized
gattctctgcttaattctaaag

SEQ ID NO: 1002416 - DNA, 22 bp, Artificial Sequence
  chemically synthesized
attctctgcttaattctaaagt

SEQ ID NO: 1002417 - DNA, 22 bp, Artificial Sequence
  chemically synthesized
ctgttttgccttcactttagaa

SEQ ID NO: 1002418 - DNA, 22 bp, Artificial Sequence
  chemically synthesized
cctgttttgccttcactttaga

SEQ ID NO: 1002419 - DNA, 22 bp, Artificial Sequence
  chemically synthesized
tcctgttttgccttcactttag

SEQ ID NO: 1002420 - DNA, 22 bp, Artificial Sequence
  chemically synthesized
tctgcttaattctaaagtgaag

SEQ ID NO: 1002421 - DNA, 22 bp, Artificial Sequence
  chemically synthesized
ttcctgttttgccttcacttta

SEQ ID NO: 1002422 - DNA, 22 bp, Artificial Sequence
  chemically synthesized
tgcttaattctaaagtgaaggc

SEQ ID NO: 1002423 - DNA, 22 bp, Artificial Sequence
  chemically synthesized
cttaattctaaagtgaaggcaa

SEQ ID NO: 1002424 - DNA, 22 bp, Artificial Sequence
  chemically synthesized
acttttcctgttttgccttcac

SEQ ID NO: 1002425 - DNA, 22 bp, Artificial Sequence
  chemically synthesized
gacttttcctgttttgccttca

SEQ ID NO: 1002426 - DNA, 22 bp, Artificial Sequence
  chemically synthesized
tgacttttcctgttttgccttc

SEQ ID NO: 1002427 - DNA, 22 bp, Artificial Sequence
  chemically synthesized
aattctaaagtgaaggcaaaac

SEQ ID NO: 1002428 - DNA, 22 bp, Artificial Sequence
  chemically synthesized
attctaaagtgaaggcaaaaca

SEQ ID NO: 1002429 - DNA, 22 bp, Artificial Sequence
  chemically synthesized
actttgacttttcctgttttgc

SEQ ID NO: 1002430 - DNA, 22 bp, Artificial Sequence
  chemically synthesized
taaagtgaaggcaaaacaggaa

SEQ ID NO: 1002431 - DNA, 22 bp, Artificial Sequence
  chemically synthesized
taactttgacttttcctgtttt

SEQ ID NO: 1002432 - DNA, 22 bp, Artificial Sequence
  chemically synthesized
aagtgaaggcaaaacaggaaaa

SEQ ID NO: 1002433 - DNA, 22 bp, Artificial Sequence
  chemically synthesized
tatggataatgattctaacttt

SEQ ID NO: 1002434 - DNA, 22 bp, Artificial Sequence
  chemically synthesized
aaagactatatggataatgatt

SEQ ID NO: 1002435 - DNA, 22 bp, Artificial Sequence
  chemically synthesized
gaaagactatatggataatgat

SEQ ID NO: 1002436 - DNA, 22 bp, Artificial Sequence
  chemically synthesized
tgaaagactatatggataatga

SEQ ID NO: 1002437 - DNA, 22 bp, Artificial Sequence
  chemically synthesized
ttgaaagactatatggataatg

SEQ ID NO: 1002438 - DNA, 22 bp, Artificial Sequence
  chemically synthesized
tttgaaagactatatggataat

SEQ ID NO: 1002439 - DNA, 22 bp, Artificial Sequence
  chemically synthesized
gaatcattatccatatagtctt

SEQ ID NO: 1002440 - DNA, 22 bp, Artificial Sequence
  chemically synthesized
tatattttttgaaagactatat

SEQ ID NO: 1002441 - DNA, 22 bp, Artificial Sequence
  chemically synthesized
ttatatattttttgaaagacta

SEQ ID NO: 1002442 - DNA, 22 bp, Artificial Sequence
  chemically synthesized
attatatattttttgaaagact

SEQ ID NO: 1002443 - DNA, 22 bp, Artificial Sequence
  chemically synthesized
tccatatagtctttcaaaaaat

SEQ ID NO: 1002444 - DNA, 22 bp, Artificial Sequence
  chemically synthesized
atgataggcacttattatatat

SEQ ID NO: 1002445 - DNA, 22 bp, Artificial Sequence
  chemically synthesized
ctcatgataggcacttattata

SEQ ID NO: 1002446 - DNA, 22 bp, Artificial Sequence
  chemically synthesized
tcaaaaaatatataataagtgc

SEQ ID NO: 1002447 - DNA, 22 bp, Artificial Sequence
  chemically synthesized
caaaaaatatataataagtgcc

SEQ ID NO: 1002448 - DNA, 22 bp, Artificial Sequence
  chemically synthesized
aaaaaatatataataagtgcct

SEQ ID NO: 1002449 - DNA, 22 bp, Artificial Sequence
  chemically synthesized
caacactgctcatgataggcac

SEQ ID NO: 1002450 - DNA, 22 bp, Artificial Sequence
  chemically synthesized
gcaacactgctcatgataggca

SEQ ID NO: 1002451 - DNA, 22 bp, Artificial Sequence
  chemically synthesized
acacagaaaacttgcaacactg

SEQ ID NO: 1002452 - DNA, 22 bp, Artificial Sequence
  chemically synthesized
aacacagaaaacttgcaacact

SEQ ID NO: 1002453 - DNA, 22 bp, Artificial Sequence
  chemically synthesized
taacacagaaaacttgcaacac

SEQ ID NO: 1002454 - DNA, 22 bp, Artificial Sequence
  chemically synthesized
tcatgagcagtgttgcaagttt

SEQ ID NO: 1002455 - DNA, 22 bp, Artificial Sequence
  chemically synthesized
tagatattttaacacagaaaac

SEQ ID NO: 1002456 - DNA, 22 bp, Artificial Sequence
  chemically synthesized
gtagatattttaacacagaaaa

SEQ ID NO: 1002457 - DNA, 22 bp, Artificial Sequence
  chemically synthesized
caagttttctgtgttaaaatat

SEQ ID NO: 1002458 - DNA, 22 bp, Artificial Sequence
  chemically synthesized
gaagtataatttgtagatattt

SEQ ID NO: 1002459 - DNA, 22 bp, Artificial Sequence
  chemically synthesized
agaagtataatttgtagatatt

SEQ ID NO: 1002460 - DNA, 22 bp, Artificial Sequence
  chemically synthesized
tagaagtataatttgtagatat

SEQ ID NO: 1002461 - DNA, 22 bp, Artificial Sequence
  chemically synthesized
tctgtgttaaaatatctacaaa

SEQ ID NO: 1002462 - DNA, 22 bp, Artificial Sequence
  chemically synthesized
ctgtgttaaaatatctacaaat

SEQ ID NO: 1002463 - DNA, 22 bp, Artificial Sequence
  chemically synthesized
tttagaagtataatttgtagat

SEQ ID NO: 1002464 - DNA, 22 bp, Artificial Sequence
  chemically synthesized
tgtgttaaaatatctacaaatt

SEQ ID NO: 1002465 - DNA, 22 bp, Artificial Sequence
  chemically synthesized
ctttagaagtataatttgtaga

SEQ ID NO: 1002466 - DNA, 22 bp, Artificial Sequence
  chemically synthesized
tctttagaagtataatttgtag

SEQ ID NO: 1002467 - DNA, 22 bp, Artificial Sequence
  chemically synthesized
tgttaaaatatctacaaattat

SEQ ID NO: 1002468 - DNA, 22 bp, Artificial Sequence
  chemically synthesized
ttctttagaagtataatttgta

SEQ ID NO: 1002469 - DNA, 22 bp, Artificial Sequence
  chemically synthesized
aaatatctacaaattatacttc

SEQ ID NO: 1002470 - DNA, 22 bp, Artificial Sequence
  chemically synthesized
aatttttctttagaagtataat

SEQ ID NO: 1002471 - DNA, 22 bp, Artificial Sequence
  chemically synthesized
caaattatacttctaaagaaaa

SEQ ID NO: 1002472 - DNA, 22 bp, Artificial Sequence
  chemically synthesized
aagtagcattcaatttttcttt

SEQ ID NO: 1002473 - DNA, 22 bp, Artificial Sequence
  chemically synthesized
tacttctaaagaaaaattgaat

SEQ ID NO: 1002474 - DNA, 22 bp, Artificial Sequence
  chemically synthesized
tattcaagtagcattcaatttt

SEQ ID NO: 1002475 - DNA, 22 bp, Artificial Sequence
  chemically synthesized
ttgtattcaagtagcattcaat

SEQ ID NO: 1002476 - DNA, 22 bp, Artificial Sequence
  chemically synthesized
attgtattcaagtagcattcaa

SEQ ID NO: 1002477 - DNA, 22 bp, Artificial Sequence
  chemically synthesized
ctaaagaaaaattgaatgctac

SEQ ID NO: 1002478 - DNA, 22 bp, Artificial Sequence
  chemically synthesized
taaagaaaaattgaatgctact

SEQ ID NO: 1002479 - DNA, 22 bp, Artificial Sequence
  chemically synthesized
aagaaaaattgaatgctacttg

SEQ ID NO: 1002480 - DNA, 22 bp, Artificial Sequence
  chemically synthesized
aaatgtatcatttattgtattc

SEQ ID NO: 1002481 - DNA, 22 bp, Artificial Sequence
  chemically synthesized
aatgctacttgaatacaataaa

SEQ ID NO: 1002482 - DNA, 22 bp, Artificial Sequence
  chemically synthesized
ataagctcaaatgtatcattta

SEQ ID NO: 1002483 - DNA, 22 bp, Artificial Sequence
  chemically synthesized
cttgaatacaataaatgataca

SEQ ID NO: 1002484 - DNA, 22 bp, Artificial Sequence
  chemically synthesized
gaatacaataaatgatacattt

SEQ ID NO: 1002485 - DNA, 22 bp, Artificial Sequence
  chemically synthesized
aatacaataaatgatacatttg

SEQ ID NO: 1002486 - DNA, 22 bp, Artificial Sequence
  chemically synthesized
aagactgataagctcaaatgta

SEQ ID NO: 1002487 - DNA, 22 bp, Artificial Sequence
  chemically synthesized
caagactgataagctcaaatgt

SEQ ID NO: 1002488 - DNA, 22 bp, Artificial Sequence
  chemically synthesized
tcaagactgataagctcaaatg

SEQ ID NO: 1002489 - DNA, 22 bp, Artificial Sequence
  chemically synthesized
aacaaaggattttcaagactga

SEQ ID NO: 1002490 - DNA, 22 bp, Artificial Sequence
  chemically synthesized
gaacaaaggattttcaagactg

SEQ ID NO: 1002491 - DNA, 22 bp, Artificial Sequence
  chemically synthesized
tgaacaaaggattttcaagact

SEQ ID NO: 1002492 - DNA, 22 bp, Artificial Sequence
  chemically synthesized
ttgaacaaaggattttcaagac

SEQ ID NO: 1002493 - DNA, 22 bp, Artificial Sequence
  chemically synthesized
gagcttatcagtcttgaaaatc

SEQ ID NO: 1002494 - DNA, 22 bp, Artificial Sequence
  chemically synthesized
agcttatcagtcttgaaaatcc

SEQ ID NO: 1002495 - DNA, 22 bp, Artificial Sequence
  chemically synthesized
atcagtcttgaaaatcctttgt

SEQ ID NO: 1002496 - DNA, 22 bp, Artificial Sequence
  chemically synthesized
catcgtttttgaacaaaggatt

SEQ ID NO: 1002497 - DNA, 22 bp, Artificial Sequence
  chemically synthesized
tcagtcttgaaaatcctttgtt

SEQ ID NO: 1002498 - DNA, 22 bp, Artificial Sequence
  chemically synthesized
gcatcgtttttgaacaaaggat

SEQ ID NO: 1002499 - DNA, 22 bp, Artificial Sequence
  chemically synthesized
tgcatcgtttttgaacaaagga

SEQ ID NO: 1002500 - DNA, 22 bp, Artificial Sequence
  chemically synthesized
ctttgcatcgtttttgaacaaa

SEQ ID NO: 1002501 - DNA, 22 bp, Artificial Sequence
  chemically synthesized
tactttgcatcgtttttgaaca

SEQ ID NO: 1002502 - DNA, 22 bp, Artificial Sequence
  chemically synthesized
gaaaatcctttgttcaaaaacg

SEQ ID NO: 1002503 - DNA, 22 bp, Artificial Sequence
  chemically synthesized
tctactttgcatcgtttttgaa

SEQ ID NO: 1002504 - DNA, 22 bp, Artificial Sequence
  chemically synthesized
aaaatcctttgttcaaaaacga

SEQ ID NO: 1002505 - DNA, 22 bp, Artificial Sequence
  chemically synthesized
ccctctctactttgcatcgttt

SEQ ID NO: 1002506 - DNA, 22 bp, Artificial Sequence
  chemically synthesized
tgttcaaaaacgatgcaaagta

SEQ ID NO: 1002507 - DNA, 22 bp, Artificial Sequence
  chemically synthesized
aattgccctctctactttgcat

SEQ ID NO: 1002508 - DNA, 22 bp, Artificial Sequence
  chemically synthesized
gttcaaaaacgatgcaaagtag

SEQ ID NO: 1002509 - DNA, 22 bp, Artificial Sequence
  chemically synthesized
ttcaaaaacgatgcaaagtaga

SEQ ID NO: 1002510 - DNA, 22 bp, Artificial Sequence
  chemically synthesized
aaaaacgatgcaaagtagagag

SEQ ID NO: 1002511 - DNA, 22 bp, Artificial Sequence
  chemically synthesized
tagactaaattgccctctctac

SEQ ID NO: 1002512 - DNA, 22 bp, Artificial Sequence
  chemically synthesized
gtagactaaattgccctctcta

SEQ ID NO: 1002513 - DNA, 22 bp, Artificial Sequence
  chemically synthesized
tgtagactaaattgccctctct

SEQ ID NO: 1002514 - DNA, 22 bp, Artificial Sequence
  chemically synthesized
ttgtagactaaattgccctctc

SEQ ID NO: 1002515 - DNA, 22 bp, Artificial Sequence
  chemically synthesized
aataaaagtttttgtagactaa

SEQ ID NO: 1002516 - DNA, 22 bp, Artificial Sequence
  chemically synthesized
aaataaaagtttttgtagacta

SEQ ID NO: 1002517 - DNA, 22 bp, Artificial Sequence
  chemically synthesized
taaataaaagtttttgtagact

SEQ ID NO: 1002518 - DNA, 22 bp, Artificial Sequence
  chemically synthesized
ttaaataaaagtttttgtagac

SEQ ID NO: 1002519 - DNA, 22 bp, Artificial Sequence
  chemically synthesized
tttaaataaaagtttttgtaga

SEQ ID NO: 1002520 - DNA, 22 bp, Artificial Sequence
  chemically synthesized
ttttaaataaaagtttttgtag

SEQ ID NO: 1002521 - DNA, 22 bp, Artificial Sequence
  chemically synthesized
agtttttttaaataaaagtttt

SEQ ID NO: 1002522 - DNA, 22 bp, Artificial Sequence
  chemically synthesized
ttcagtttttttaaataaaagt

SEQ ID NO: 1002523 - DNA, 22 bp, Artificial Sequence
  chemically synthesized
agtctacaaaaacttttattta

SEQ ID NO: 1002524 - DNA, 22 bp, Artificial Sequence
  chemically synthesized
attcagtttttttaaataaaag

SEQ ID NO: 1002525 - DNA, 22 bp, Artificial Sequence
  chemically synthesized
gtctacaaaaacttttatttaa

SEQ ID NO: 1002526 - DNA, 22 bp, Artificial Sequence
  chemically synthesized
tttattcagtttttttaaataa

SEQ ID NO: 1002527 - DNA, 22 bp, Artificial Sequence
  chemically synthesized
caaaaacttttatttaaaaaaa

SEQ ID NO: 1002528 - DNA, 22 bp, Artificial Sequence
  chemically synthesized
tgctatttattcagttttttta

SEQ ID NO: 1002529 - DNA, 22 bp, Artificial Sequence
  chemically synthesized
ttatttaaaaaaactgaataaa

SEQ ID NO: 1002530 - DNA, 22 bp, Artificial Sequence
  chemically synthesized
tatttaaaaaaactgaataaat

SEQ ID NO: 1002531 - DNA, 22 bp, Artificial Sequence
  chemically synthesized
atttaaaaaaactgaataaata

SEQ ID NO: 1002532 - DNA, 22 bp, Artificial Sequence
  chemically synthesized
tttaaaaaaactgaataaatag

SEQ ID NO: 1002533 - DNA, 22 bp, Artificial Sequence
  chemically synthesized
gatgtgtctgtgctatttattc

SEQ ID NO: 1002534 - DNA, 22 bp, Artificial Sequence
  chemically synthesized
ggatgtgtctgtgctatttatt

SEQ ID NO: 1002535 - DNA, 22 bp, Artificial Sequence
  chemically synthesized
tggatgtgtctgtgctatttat

SEQ ID NO: 1002536 - DNA, 22 bp, Artificial Sequence
  chemically synthesized
aaaaaaactgaataaatagcac

SEQ ID NO: 1002537 - DNA, 22 bp, Artificial Sequence
  chemically synthesized
ttggatgtgtctgtgctattta

SEQ ID NO: 1002538 - DNA, 22 bp, Artificial Sequence
  chemically synthesized
aaaaaactgaataaatagcaca

SEQ ID NO: 1002539 - DNA, 22 bp, Artificial Sequence
  chemically synthesized
tttggatgtgtctgtgctattt

SEQ ID NO: 1002540 - DNA, 22 bp, Artificial Sequence
  chemically synthesized
tacactttttggatgtgtctgt

SEQ ID NO: 1002541 - DNA, 22 bp, Artificial Sequence
  chemically synthesized
aataaatagcacagacacatcc

SEQ ID NO: 1002542 - DNA, 22 bp, Artificial Sequence
  chemically synthesized
catgctatacactttttggatg

SEQ ID NO: 1002543 - DNA, 22 bp, Artificial Sequence
  chemically synthesized
ccatgctatacactttttggat

SEQ ID NO: 1002544 - DNA, 22 bp, Artificial Sequence
  chemically synthesized
tccatgctatacactttttgga

SEQ ID NO: 1002545 - DNA, 22 bp, Artificial Sequence
  chemically synthesized
ttccatgctatacactttttgg

SEQ ID NO: 1002546 - DNA, 22 bp, Artificial Sequence
  chemically synthesized
aatttttccatgctatacactt

SEQ ID NO: 1002547 - DNA, 22 bp, Artificial Sequence
  chemically synthesized
ttgaatttttccatgctataca

SEQ ID NO: 1002548 - DNA, 22 bp, Artificial Sequence
  chemically synthesized
tacattattgaatttttccatg

SEQ ID NO: 1002549 - DNA, 22 bp, Artificial Sequence
  chemically synthesized
tgctatacattattgaattttt

SEQ ID NO: 1002550 - DNA, 22 bp, Artificial Sequence
  chemically synthesized
tgtgctatacattattgaattt

SEQ ID NO: 1002551 - DNA, 22 bp, Artificial Sequence
  chemically synthesized
ggggtgtctctgtgctatacat

SEQ ID NO: 1002552 - DNA, 22 bp, Artificial Sequence
  chemically synthesized
gggggtgtctctgtgctataca

SEQ ID NO: 1002553 - DNA, 22 bp, Artificial Sequence
  chemically synthesized
aataatgtatagcacagagaca

SEQ ID NO: 1002554 - DNA, 22 bp, Artificial Sequence
  chemically synthesized
agaccatgatgcaacatgataa

SEQ ID NO: 1002555 - DNA, 22 bp, Artificial Sequence
  chemically synthesized
gtgttgtttatcatgttgcatc

SEQ ID NO: 1002556 - DNA, 22 bp, Artificial Sequence
  chemically synthesized
tgttgtttatcatgttgcatca

SEQ ID NO: 1002557 - DNA, 22 bp, Artificial Sequence
  chemically synthesized
tttatcatgttgcatcatggtc

SEQ ID NO: 1002558 - DNA, 22 bp, Artificial Sequence
  chemically synthesized
atcatgttgcatcatggtctta

SEQ ID NO: 1002559 - DNA, 22 bp, Artificial Sequence
  chemically synthesized
tcatgttgcatcatggtcttaa

SEQ ID NO: 1002560 - DNA, 22 bp, Artificial Sequence
  chemically synthesized
catgaaatgtggaattaagacc

SEQ ID NO: 1002561 - DNA, 22 bp, Artificial Sequence
  chemically synthesized
ctacatgaaatgtggaattaag

SEQ ID NO: 1002562 - DNA, 22 bp, Artificial Sequence
  chemically synthesized
tgctacatgaaatgtggaatta

SEQ ID NO: 1002563 - DNA, 22 bp, Artificial Sequence
  chemically synthesized
catcatggtcttaattccacat

SEQ ID NO: 1002564 - DNA, 22 bp, Artificial Sequence
  chemically synthesized
aattccacatttcatgtagcag

SEQ ID NO: 1002565 - DNA, 22 bp, Artificial Sequence
  chemically synthesized
attccacatttcatgtagcaga

SEQ ID NO: 1002566 - DNA, 22 bp, Artificial Sequence
  chemically synthesized
cacatttcatgtagcagaatgt

SEQ ID NO: 1002567 - DNA, 22 bp, Artificial Sequence
  chemically synthesized
aaaatgaagggatacattctgc

SEQ ID NO: 1002568 - DNA, 22 bp, Artificial Sequence
  chemically synthesized
catgtagcagaatgtatccctt

SEQ ID NO: 1002569 - DNA, 22 bp, Artificial Sequence
  chemically synthesized
gatctcaaaatgaagggataca

SEQ ID NO: 1002570 - DNA, 22 bp, Artificial Sequence
  chemically synthesized
atgtagcagaatgtatcccttc

SEQ ID NO: 1002571 - DNA, 22 bp, Artificial Sequence
  chemically synthesized
tggatctcaaaatgaagggata

SEQ ID NO: 1002572 - DNA, 22 bp, Artificial Sequence
  chemically synthesized
ctggatctcaaaatgaagggat

SEQ ID NO: 1002573 - DNA, 22 bp, Artificial Sequence
  chemically synthesized
tccttctggatctcaaaatgaa

SEQ ID NO: 1002574 - DNA, 22 bp, Artificial Sequence
  chemically synthesized
gtccttctggatctcaaaatga

SEQ ID NO: 1002575 - DNA, 22 bp, Artificial Sequence
  chemically synthesized
tgtccttctggatctcaaaatg

SEQ ID NO: 1002576 - DNA, 22 bp, Artificial Sequence
  chemically synthesized
ttgtccttctggatctcaaaat

SEQ ID NO: 1002577 - DNA, 22 bp, Artificial Sequence
  chemically synthesized
tgcaacccttttgtccttctgg

SEQ ID NO: 1002578 - DNA, 22 bp, Artificial Sequence
  chemically synthesized
cattttgagatccagaaggaca

SEQ ID NO: 1002579 - DNA, 22 bp, Artificial Sequence
  chemically synthesized
attttgagatccagaaggacaa

SEQ ID NO: 1002580 - DNA, 22 bp, Artificial Sequence
  chemically synthesized
tgagatccagaaggacaaaagg

SEQ ID NO: 1002581 - DNA, 22 bp, Artificial Sequence
  chemically synthesized
gagatccagaaggacaaaaggg

SEQ ID NO: 1002582 - DNA, 22 bp, Artificial Sequence
  chemically synthesized
agatccagaaggacaaaagggt

SEQ ID NO: 1002583 - DNA, 22 bp, Artificial Sequence
  chemically synthesized
cgagaggcagaaaaaggggaac

SEQ ID NO: 1002584 - DNA, 22 bp, Artificial Sequence
  chemically synthesized
agatctccgagaggcagaaaaa

SEQ ID NO: 1002585 - DNA, 22 bp, Artificial Sequence
  chemically synthesized
cacagttcccctttttctgcct

SEQ ID NO: 1002586 - DNA, 22 bp, Artificial Sequence
  chemically synthesized
aagatctccgagaggcagaaaa

SEQ ID NO: 1002587 - DNA, 22 bp, Artificial Sequence
  chemically synthesized
taagatctccgagaggcagaaa

SEQ ID NO: 1002588 - DNA, 22 bp, Artificial Sequence
  chemically synthesized
ttaagatctccgagaggcagaa

SEQ ID NO: 1002589 - DNA, 22 bp, Artificial Sequence
  chemically synthesized
atttttaagatctccgagaggc

SEQ ID NO: 1002590 - DNA, 22 bp, Artificial Sequence
  chemically synthesized
ccctttttctgcctctcggaga

SEQ ID NO: 1002591 - DNA, 22 bp, Artificial Sequence
  chemically synthesized
tcattcatttttaagatctccg

SEQ ID NO: 1002592 - DNA, 22 bp, Artificial Sequence
  chemically synthesized
tttctgcctctcggagatctta

SEQ ID NO: 1002593 - DNA, 22 bp, Artificial Sequence
  chemically synthesized
atcattcatttttaagatctcc

SEQ ID NO: 1002594 - DNA, 22 bp, Artificial Sequence
  chemically synthesized
ttctgcctctcggagatcttaa

SEQ ID NO: 1002595 - DNA, 22 bp, Artificial Sequence
  chemically synthesized
tctgcctctcggagatcttaaa

SEQ ID NO: 1002596 - DNA, 22 bp, Artificial Sequence
  chemically synthesized
ctgcctctcggagatcttaaaa

SEQ ID NO: 1002597 - DNA, 22 bp, Artificial Sequence
  chemically synthesized
tttatcattcatttttaagatc

SEQ ID NO: 1002598 - DNA, 22 bp, Artificial Sequence
  chemically synthesized
tgcctctcggagatcttaaaaa

SEQ ID NO: 1002599 - DNA, 22 bp, Artificial Sequence
  chemically synthesized
cctctcggagatcttaaaaatg

SEQ ID NO: 1002600 - DNA, 22 bp, Artificial Sequence
  chemically synthesized
attgtttatcattcatttttaa

SEQ ID NO: 1002601 - DNA, 22 bp, Artificial Sequence
  chemically synthesized
tcggagatcttaaaaatgaatg

SEQ ID NO: 1002602 - DNA, 22 bp, Artificial Sequence
  chemically synthesized
ggagatcttaaaaatgaatgat

SEQ ID NO: 1002603 - DNA, 22 bp, Artificial Sequence
  chemically synthesized
ggtagaattaattgtttatcat

SEQ ID NO: 1002604 - DNA, 22 bp, Artificial Sequence
  chemically synthesized
aaaaatgaatgataaacaatta

SEQ ID NO: 1002605 - DNA, 22 bp, Artificial Sequence
  chemically synthesized
aaaatgaatgataaacaattaa

SEQ ID NO: 1002606 - DNA, 22 bp, Artificial Sequence
  chemically synthesized
gtatcctgggtagaattaattg

SEQ ID NO: 1002607 - DNA, 22 bp, Artificial Sequence
  chemically synthesized
attggtatcctgggtagaatta

SEQ ID NO: 1002608 - DNA, 22 bp, Artificial Sequence
  chemically synthesized
cattggtatcctgggtagaatt

SEQ ID NO: 1002609 - DNA, 22 bp, Artificial Sequence
  chemically synthesized
tcattggtatcctgggtagaat

SEQ ID NO: 1002610 - DNA, 22 bp, Artificial Sequence
  chemically synthesized
attctacccaggataccaatga

SEQ ID NO: 1002611 - DNA, 22 bp, Artificial Sequence
  chemically synthesized
tacccaggataccaatgaaaat

SEQ ID NO: 1002612 - DNA, 22 bp, Artificial Sequence
  chemically synthesized
cccaggataccaatgaaaatct

SEQ ID NO: 1002613 - DNA, 22 bp, Artificial Sequence
  chemically synthesized
ggaaaaagaaaagaaaatagat

SEQ ID NO: 1002614 - DNA, 22 bp, Artificial Sequence
  chemically synthesized
gggaaaaagaaaagaaaataga

SEQ ID NO: 1002615 - DNA, 22 bp, Artificial Sequence
  chemically synthesized
tttgggaaaaagaaaagaaaat

SEQ ID NO: 1002616 - DNA, 22 bp, Artificial Sequence
  chemically synthesized
gtttgggaaaaagaaaagaaaa

SEQ ID NO: 1002617 - DNA, 22 bp, Artificial Sequence
  chemically synthesized
tgtttgggaaaaagaaaagaaa

SEQ ID NO: 1002618 - DNA, 22 bp, Artificial Sequence
  chemically synthesized
ttgtttgggaaaaagaaaagaa

SEQ ID NO: 1002619 - DNA, 22 bp, Artificial Sequence
  chemically synthesized
aggtttttgtttgggaaaaaga

SEQ ID NO: 1002620 - DNA, 22 bp, Artificial Sequence
  chemically synthesized
tgaggtttttgtttgggaaaaa

SEQ ID NO: 1002621 - DNA, 22 bp, Artificial Sequence
  chemically synthesized
ctgaggtttttgtttgggaaaa

SEQ ID NO: 1002622 - DNA, 22 bp, Artificial Sequence
  chemically synthesized
ttttcttttctttttcccaaac

SEQ ID NO: 1002623 - DNA, 22 bp, Artificial Sequence
  chemically synthesized
tcttttctttttcccaaacaaa

SEQ ID NO: 1002624 - DNA, 22 bp, Artificial Sequence
  chemically synthesized
ccttctgaggtttttgtttggg

SEQ ID NO: 1002625 - DNA, 22 bp, Artificial Sequence
  chemically synthesized
cttttctttttcccaaacaaaa

SEQ ID NO: 1002626 - DNA, 22 bp, Artificial Sequence
  chemically synthesized
gccttctgaggtttttgtttgg

SEQ ID NO: 1002627 - DNA, 22 bp, Artificial Sequence
  chemically synthesized
ttttctttttcccaaacaaaaa

SEQ ID NO: 1002628 - DNA, 22 bp, Artificial Sequence
  chemically synthesized
ttctttttcccaaacaaaaacc

SEQ ID NO: 1002629 - DNA, 22 bp, Artificial Sequence
  chemically synthesized
cttgccttctgaggtttttgtt

SEQ ID NO: 1002630 - DNA, 22 bp, Artificial Sequence
  chemically synthesized
tctttttcccaaacaaaaacct

SEQ ID NO: 1002631 - DNA, 22 bp, Artificial Sequence
  chemically synthesized
acttgccttctgaggtttttgt

SEQ ID NO: 1002632 - DNA, 22 bp, Artificial Sequence
  chemically synthesized
ctttttcccaaacaaaaacctc

SEQ ID NO: 1002633 - DNA, 22 bp, Artificial Sequence
  chemically synthesized
tttttcccaaacaaaaacctca

SEQ ID NO: 1002634 - DNA, 22 bp, Artificial Sequence
  chemically synthesized
tttcccaaacaaaaacctcaga

SEQ ID NO: 1002635 - DNA, 22 bp, Artificial Sequence
  chemically synthesized
ttcccaaacaaaaacctcagaa

SEQ ID NO: 1002636 - DNA, 22 bp, Artificial Sequence
  chemically synthesized
tcccaaacaaaaacctcagaag

SEQ ID NO: 1002637 - DNA, 22 bp, Artificial Sequence
  chemically synthesized
cccaaacaaaaacctcagaagg

SEQ ID NO: 1002638 - DNA, 22 bp, Artificial Sequence
  chemically synthesized
ccaaacaaaaacctcagaaggc

SEQ ID NO: 1002639 - DNA, 22 bp, Artificial Sequence
  chemically synthesized
aaaggtcagtttacttgccttc

SEQ ID NO: 1002640 - DNA, 22 bp, Artificial Sequence
  chemically synthesized
aaaaggtcagtttacttgcctt

SEQ ID NO: 1002641 - DNA, 22 bp, Artificial Sequence
  chemically synthesized
atttaaaaggtcagtttacttg

SEQ ID NO: 1002642 - DNA, 22 bp, Artificial Sequence
  chemically synthesized
ttcatttaaaaggtcagtttac

SEQ ID NO: 1002643 - DNA, 22 bp, Artificial Sequence
  chemically synthesized
gttcatttaaaaggtcagttta

SEQ ID NO: 1002644 - DNA, 22 bp, Artificial Sequence
  chemically synthesized
agaaggcaagtaaactgacctt

SEQ ID NO: 1002645 - DNA, 22 bp, Artificial Sequence
  chemically synthesized
aatcatgtcagatcttgttcat

SEQ ID NO: 1002646 - DNA, 22 bp, Artificial Sequence
  chemically synthesized
accttttaaatgaacaagatct

SEQ ID NO: 1002647 - DNA, 22 bp, Artificial Sequence
  chemically synthesized
gctcaatcatgtcagatcttgt

SEQ ID NO: 1002648 - DNA, 22 bp, Artificial Sequence
  chemically synthesized
ttaaatgaacaagatctgacat

SEQ ID NO: 1002649 - DNA, 22 bp, Artificial Sequence
  chemically synthesized
taaatgaacaagatctgacatg

SEQ ID NO: 1002650 - DNA, 22 bp, Artificial Sequence
  chemically synthesized
ggttagctcaatcatgtcagat

SEQ ID NO: 1002651 - DNA, 22 bp, Artificial Sequence
  chemically synthesized
aaatgaacaagatctgacatga

SEQ ID NO: 1002652 - DNA, 22 bp, Artificial Sequence
  chemically synthesized
gggttagctcaatcatgtcaga

SEQ ID NO: 1002653 - DNA, 22 bp, Artificial Sequence
  chemically synthesized
aatgaacaagatctgacatgat

SEQ ID NO: 1002654 - DNA, 22 bp, Artificial Sequence
  chemically synthesized
ttgggttagctcaatcatgtca

SEQ ID NO: 1002655 - DNA, 22 bp, Artificial Sequence
  chemically synthesized
cttgggttagctcaatcatgtc

SEQ ID NO: 1002656 - DNA, 22 bp, Artificial Sequence
  chemically synthesized
tcttgggttagctcaatcatgt

SEQ ID NO: 1002657 - DNA, 22 bp, Artificial Sequence
  chemically synthesized
tttcttgggttagctcaatcat

SEQ ID NO: 1002658 - DNA, 22 bp, Artificial Sequence
  chemically synthesized
ctttcttgggttagctcaatca

SEQ ID NO: 1002659 - DNA, 22 bp, Artificial Sequence
  chemically synthesized
tctttcttgggttagctcaatc

SEQ ID NO: 1002660 - DNA, 22 bp, Artificial Sequence
  chemically synthesized
acatgattgagctaacccaaga

SEQ ID NO: 1002661 - DNA, 22 bp, Artificial Sequence
  chemically synthesized
agaggggaattttctttcttgg

SEQ ID NO: 1002662 - DNA, 22 bp, Artificial Sequence
  chemically synthesized
cagaggggaattttctttcttg

SEQ ID NO: 1002663 - DNA, 22 bp, Artificial Sequence
  chemically synthesized
agctaacccaagaaagaaaatt

SEQ ID NO: 1002664 - DNA, 22 bp, Artificial Sequence
  chemically synthesized
acttcagaggggaattttcttt

SEQ ID NO: 1002665 - DNA, 22 bp, Artificial Sequence
  chemically synthesized
ttcacttcagaggggaattttc

SEQ ID NO: 1002666 - DNA, 22 bp, Artificial Sequence
  chemically synthesized
acccaagaaagaaaattcccct

SEQ ID NO: 1002667 - DNA, 22 bp, Artificial Sequence
  chemically synthesized
aaaaattattcacttcagaggg

SEQ ID NO: 1002668 - DNA, 22 bp, Artificial Sequence
  chemically synthesized
attaaaaaattattcacttcag

SEQ ID NO: 1002669 - DNA, 22 bp, Artificial Sequence
  chemically synthesized
aattaaaaaattattcacttca

SEQ ID NO: 1002670 - DNA, 22 bp, Artificial Sequence
  chemically synthesized
taattaaaaaattattcacttc

SEQ ID NO: 1002671 - DNA, 22 bp, Artificial Sequence
  chemically synthesized
ttaattaaaaaattattcactt

SEQ ID NO: 1002672 - DNA, 22 bp, Artificial Sequence
  chemically synthesized
ccctctgaagtgaataattttt

SEQ ID NO: 1002673 - DNA, 22 bp, Artificial Sequence
  chemically synthesized
accttttaattaaaaaattatt

SEQ ID NO: 1002674 - DNA, 22 bp, Artificial Sequence
  chemically synthesized
caccttttaattaaaaaattat

SEQ ID NO: 1002675 - DNA, 22 bp, Artificial Sequence
  chemically synthesized
tgaagtgaataattttttaatt

SEQ ID NO: 1002676 - DNA, 22 bp, Artificial Sequence
  chemically synthesized
aagtgaataattttttaattaa

SEQ ID NO: 1002677 - DNA, 22 bp, Artificial Sequence
  chemically synthesized
tttaattaaaaggtgaaatctg

SEQ ID NO: 1002678 - DNA, 22 bp, Artificial Sequence
  chemically synthesized
ttaattaaaaggtgaaatctga

SEQ ID NO: 1002679 - DNA, 22 bp, Artificial Sequence
  chemically synthesized
taattaaaaggtgaaatctgac

SEQ ID NO: 1002680 - DNA, 22 bp, Artificial Sequence
  chemically synthesized
aattaaaaggtgaaatctgaca

SEQ ID NO: 1002681 - DNA, 22 bp, Artificial Sequence
  chemically synthesized
attaaaaggtgaaatctgacac

SEQ ID NO: 1002682 - DNA, 22 bp, Artificial Sequence
  chemically synthesized
aaaggtgaaatctgacacatca

SEQ ID NO: 1002683 - DNA, 22 bp, Artificial Sequence
  chemically synthesized
acacatcacactggttttgtta

SEQ ID NO: 1002684 - DNA, 22 bp, Artificial Sequence
  chemically synthesized
atggaagaaaacaacaataata

SEQ ID NO: 1002685 - DNA, 22 bp, Artificial Sequence
  chemically synthesized
gttttgttattattgttgtttt

SEQ ID NO: 1002686 - DNA, 22 bp, Artificial Sequence
  chemically synthesized
tgttattattgttgttttcttc

SEQ ID NO: 1002687 - DNA, 22 bp, Artificial Sequence
  chemically synthesized
gttattattgttgttttcttcc

SEQ ID NO: 1002688 - DNA, 22 bp, Artificial Sequence
  chemically synthesized
ttattattgttgttttcttcca

SEQ ID NO: 1002689 - DNA, 22 bp, Artificial Sequence
  chemically synthesized
ttattgttgttttcttccatta

SEQ ID NO: 1002690 - DNA, 22 bp, Artificial Sequence
  chemically synthesized
cgagtgtgagattaatggaaga

SEQ ID NO: 1002691 - DNA, 22 bp, Artificial Sequence
  chemically synthesized
acgagtgtgagattaatggaag

SEQ ID NO: 1002692 - DNA, 22 bp, Artificial Sequence
  chemically synthesized
ttgttgttttcttccattaatc

SEQ ID NO: 1002693 - DNA, 22 bp, Artificial Sequence
  chemically synthesized
ttacgagtgtgagattaatgga

SEQ ID NO: 1002694 - DNA, 22 bp, Artificial Sequence
  chemically synthesized
cttacgagtgtgagattaatgg

SEQ ID NO: 1002695 - DNA, 22 bp, Artificial Sequence
  chemically synthesized
tcttacgagtgtgagattaatg

SEQ ID NO: 1002696 - DNA, 22 bp, Artificial Sequence
  chemically synthesized
ttgttttcttccattaatctca

SEQ ID NO: 1002697 - DNA, 22 bp, Artificial Sequence
  chemically synthesized
ttcttacgagtgtgagattaat

SEQ ID NO: 1002698 - DNA, 22 bp, Artificial Sequence
  chemically synthesized
tttcttacgagtgtgagattaa

SEQ ID NO: 1002699 - DNA, 22 bp, Artificial Sequence
  chemically synthesized
ttttcttacgagtgtgagatta

SEQ ID NO: 1002700 - DNA, 22 bp, Artificial Sequence
  chemically synthesized
ttttcttccattaatctcacac

SEQ ID NO: 1002701 - DNA, 22 bp, Artificial Sequence
  chemically synthesized
tttttcttacgagtgtgagatt

SEQ ID NO: 1002702 - DNA, 22 bp, Artificial Sequence
  chemically synthesized
tcttccattaatctcacactcg

SEQ ID NO: 1002703 - DNA, 22 bp, Artificial Sequence
  chemically synthesized
cttccattaatctcacactcgt

SEQ ID NO: 1002704 - DNA, 22 bp, Artificial Sequence
  chemically synthesized
attttttttcttacgagtgtga

SEQ ID NO: 1002705 - DNA, 22 bp, Artificial Sequence
  chemically synthesized
ttccattaatctcacactcgta

SEQ ID NO: 1002706 - DNA, 22 bp, Artificial Sequence
  chemically synthesized
ccattaatctcacactcgtaag

SEQ ID NO: 1002707 - DNA, 22 bp, Artificial Sequence
  chemically synthesized
cattaatctcacactcgtaaga

SEQ ID NO: 1002708 - DNA, 22 bp, Artificial Sequence
  chemically synthesized
atctcacactcgtaagaaaaaa

SEQ ID NO: 1002709 - DNA, 22 bp, Artificial Sequence
  chemically synthesized
acactcgtaagaaaaaaaatga

SEQ ID NO: 1002710 - DNA, 22 bp, Artificial Sequence
  chemically synthesized
gtaagaaaaaaaatgagtgtat

SEQ ID NO: 1002711 - DNA, 22 bp, Artificial Sequence
  chemically synthesized
taaaacacagtcatatataata

SEQ ID NO: 1002712 - DNA, 22 bp, Artificial Sequence
  chemically synthesized
tatatgactgtgttttatagat

SEQ ID NO: 1002713 - DNA, 22 bp, Artificial Sequence
  chemically synthesized
tgttttatagatgcatatattc

SEQ ID NO: 1002714 - DNA, 22 bp, Artificial Sequence
  chemically synthesized
aaatggatagagtagaatatat

SEQ ID NO: 1002715 - DNA, 22 bp, Artificial Sequence
  chemically synthesized
tatagatgcatatattctactc

SEQ ID NO: 1002716 - DNA, 22 bp, Artificial Sequence
  chemically synthesized
atagatgcatatattctactct

SEQ ID NO: 1002717 - DNA, 22 bp, Artificial Sequence
  chemically synthesized
tagatgcatatattctactcta

SEQ ID NO: 1002718 - DNA, 22 bp, Artificial Sequence
  chemically synthesized
agaaaagatggactgaaatgga

SEQ ID NO: 1002719 - DNA, 22 bp, Artificial Sequence
  chemically synthesized
tactctatccatttcagtccat

SEQ ID NO: 1002720 - DNA, 22 bp, Artificial Sequence
  chemically synthesized
ctctatccatttcagtccatct

SEQ ID NO: 1002721 - DNA, 22 bp, Artificial Sequence
  chemically synthesized
tatccatttcagtccatctttt

SEQ ID NO: 1002722 - DNA, 22 bp, Artificial Sequence
  chemically synthesized
tccatttcagtccatcttttct

SEQ ID NO: 1002723 - DNA, 22 bp, Artificial Sequence
  chemically synthesized
cagtccatcttttcttaatgca

SEQ ID NO: 1002724 - DNA, 22 bp, Artificial Sequence
  chemically synthesized
agtccatcttttcttaatgcat

SEQ ID NO: 1002725 - DNA, 22 bp, Artificial Sequence
  chemically synthesized
ttcttaatgcatttgtcctgtc

SEQ ID NO: 1002726 - DNA, 22 bp, Artificial Sequence
  chemically synthesized
tcttaatgcatttgtcctgtca

SEQ ID NO: 1002727 - DNA, 22 bp, Artificial Sequence
  chemically synthesized
cttaatgcatttgtcctgtcac

SEQ ID NO: 1002728 - DNA, 22 bp, Artificial Sequence
  chemically synthesized
cagtgagtaaaagtgacaggac

SEQ ID NO: 1002729 - DNA, 22 bp, Artificial Sequence
  chemically synthesized
ttaatgcatttgtcctgtcact

SEQ ID NO: 1002730 - DNA, 22 bp, Artificial Sequence
  chemically synthesized
aatgcatttgtcctgtcacttt

SEQ ID NO: 1002731 - DNA, 22 bp, Artificial Sequence
  chemically synthesized
atgcatttgtcctgtcactttt

SEQ ID NO: 1002732 - DNA, 22 bp, Artificial Sequence
  chemically synthesized
aattacagtgagtaaaagtgac

SEQ ID NO: 1002733 - DNA, 22 bp, Artificial Sequence
  chemically synthesized
gtcctgtcacttttactcactg

SEQ ID NO: 1002734 - DNA, 22 bp, Artificial Sequence
  chemically synthesized
tcctgtcacttttactcactgt

SEQ ID NO: 1002735 - DNA, 22 bp, Artificial Sequence
  chemically synthesized
acaaaattgaattacagtgagt

SEQ ID NO: 1002736 - DNA, 22 bp, Artificial Sequence
  chemically synthesized
ctaacaaaattgaattacagtg

SEQ ID NO: 1002737 - DNA, 22 bp, Artificial Sequence
  chemically synthesized
tcacttttactcactgtaattc

SEQ ID NO: 1002738 - DNA, 22 bp, Artificial Sequence
  chemically synthesized
cctaacaaaattgaattacagt

SEQ ID NO: 1002739 - DNA, 22 bp, Artificial Sequence
  chemically synthesized
catttcctaacaaaattgaatt

SEQ ID NO: 1002740 - DNA, 22 bp, Artificial Sequence
  chemically synthesized
ttactcactgtaattcaatttt

SEQ ID NO: 1002741 - DNA, 22 bp, Artificial Sequence
  chemically synthesized
tactcactgtaattcaattttg

SEQ ID NO: 1002742 - DNA, 22 bp, Artificial Sequence
  chemically synthesized
actcactgtaattcaattttgt

SEQ ID NO: 1002743 - DNA, 22 bp, Artificial Sequence
  chemically synthesized
ctcactgtaattcaattttgtt

SEQ ID NO: 1002744 - DNA, 22 bp, Artificial Sequence
  chemically synthesized
actgtaattcaattttgttagg

SEQ ID NO: 1002745 - DNA, 22 bp, Artificial Sequence
  chemically synthesized
taattcaattttgttaggaaat

SEQ ID NO: 1002746 - DNA, 22 bp, Artificial Sequence
  chemically synthesized
aattttgttaggaaatgtaact

SEQ ID NO: 1002747 - DNA, 22 bp, Artificial Sequence
  chemically synthesized
tgttaggaaatgtaactcgctg

SEQ ID NO: 1002748 - DNA, 22 bp, Artificial Sequence
  chemically synthesized
gttaggaaatgtaactcgctgt

SEQ ID NO: 1002749 - DNA, 22 bp, Artificial Sequence
  chemically synthesized
ttaggaaatgtaactcgctgtt

SEQ ID NO: 1002750 - DNA, 22 bp, Artificial Sequence
  chemically synthesized
ggaaatgtaactcgctgtttta

SEQ ID NO: 1002751 - DNA, 22 bp, Artificial Sequence
  chemically synthesized
catcaggtgaaatatataaagc

SEQ ID NO: 1002752 - DNA, 22 bp, Artificial Sequence
  chemically synthesized
gcatcaggtgaaatatataaag

SEQ ID NO: 1002753 - DNA, 22 bp, Artificial Sequence
  chemically synthesized
gctgttttatgctttatatatt

SEQ ID NO: 1002754 - DNA, 22 bp, Artificial Sequence
  chemically synthesized
tgcatcaggtgaaatatataaa

SEQ ID NO: 1002755 - DNA, 22 bp, Artificial Sequence
  chemically synthesized
ttttatgctttatatatttcac

SEQ ID NO: 1002756 - DNA, 22 bp, Artificial Sequence
  chemically synthesized
tatgctttatatatttcacctg

SEQ ID NO: 1002757 - DNA, 22 bp, Artificial Sequence
  chemically synthesized
atgctttatatatttcacctga

SEQ ID NO: 1002758 - DNA, 22 bp, Artificial Sequence
  chemically synthesized
tgctttatatatttcacctgat

SEQ ID NO: 1002759 - DNA, 22 bp, Artificial Sequence
  chemically synthesized
tatatatttcacctgatgcaaa

SEQ ID NO: 1002760 - DNA, 22 bp, Artificial Sequence
  chemically synthesized
atatatttcacctgatgcaaaa

SEQ ID NO: 1002761 - DNA, 22 bp, Artificial Sequence
  chemically synthesized
tatatttcacctgatgcaaaat

SEQ ID NO: 1002762 - DNA, 22 bp, Artificial Sequence
  chemically synthesized
cacctgatgcaaaatggactac

SEQ ID NO: 1002763 - DNA, 22 bp, Artificial Sequence
  chemically synthesized
acctgatgcaaaatggactacc

SEQ ID NO: 1002764 - DNA, 22 bp, Artificial Sequence
  chemically synthesized
atgcaaaatggactacctgatt

SEQ ID NO: 1002765 - DNA, 22 bp, Artificial Sequence
  chemically synthesized
aaaatgcagaatcaatcaggta

SEQ ID NO: 1002766 - DNA, 22 bp, Artificial Sequence
  chemically synthesized
aaaggtggactaaaaatgcaga

SEQ ID NO: 1002767 - DNA, 22 bp, Artificial Sequence
  chemically synthesized
cctgattgattctgcattttta

SEQ ID NO: 1002768 - DNA, 22 bp, Artificial Sequence
  chemically synthesized
attgattctgcatttttagtcc

SEQ ID NO: 1002769 - DNA, 22 bp, Artificial Sequence
  chemically synthesized
taaattcaaaggtggactaaaa

SEQ ID NO: 1002770 - DNA, 22 bp, Artificial Sequence
  chemically synthesized
attctgcatttttagtccacct

SEQ ID NO: 1002771 - DNA, 22 bp, Artificial Sequence
  chemically synthesized
tctataaattcaaaggtggact

SEQ ID NO: 1002772 - DNA, 22 bp, Artificial Sequence
  chemically synthesized
atctataaattcaaaggtggac

SEQ ID NO: 1002773 - DNA, 22 bp, Artificial Sequence
  chemically synthesized
tatctataaattcaaaggtgga

SEQ ID NO: 1002774 - DNA, 22 bp, Artificial Sequence
  chemically synthesized
tgcatttttagtccacctttga

SEQ ID NO: 1002775 - DNA, 22 bp, Artificial Sequence
  chemically synthesized
catttttagtccacctttgaat

SEQ ID NO: 1002776 - DNA, 22 bp, Artificial Sequence
  chemically synthesized
atctttatctataaattcaaag

SEQ ID NO: 1002777 - DNA, 22 bp, Artificial Sequence
  chemically synthesized
ttagtccacctttgaatttata

SEQ ID NO: 1002778 - DNA, 22 bp, Artificial Sequence
  chemically synthesized
ttgatctttatctataaattca

SEQ ID NO: 1002779 - DNA, 22 bp, Artificial Sequence
  chemically synthesized
tagtccacctttgaatttatag

SEQ ID NO: 1002780 - DNA, 22 bp, Artificial Sequence
  chemically synthesized
agtccacctttgaatttataga

SEQ ID NO: 1002781 - DNA, 22 bp, Artificial Sequence
  chemically synthesized
gtccacctttgaatttatagat

SEQ ID NO: 1002782 - DNA, 22 bp, Artificial Sequence
  chemically synthesized
attgttgatctttatctataaa

SEQ ID NO: 1002783 - DNA, 22 bp, Artificial Sequence
  chemically synthesized
aagttaattgttgatctttatc

SEQ ID NO: 1002784 - DNA, 22 bp, Artificial Sequence
  chemically synthesized
aaagttaattgttgatctttat

SEQ ID NO: 1002785 - DNA, 22 bp, Artificial Sequence
  chemically synthesized
tgaatttatagataaagatcaa

SEQ ID NO: 1002786 - DNA, 22 bp, Artificial Sequence
  chemically synthesized
gaatttatagataaagatcaac

SEQ ID NO: 1002787 - DNA, 22 bp, Artificial Sequence
  chemically synthesized
aatttatagataaagatcaaca

SEQ ID NO: 1002788 - DNA, 22 bp, Artificial Sequence
  chemically synthesized
atagataaagatcaacaattaa

SEQ ID NO: 1002789 - DNA, 22 bp, Artificial Sequence
  chemically synthesized
tagataaagatcaacaattaac

SEQ ID NO: 1002790 - DNA, 22 bp, Artificial Sequence
  chemically synthesized
gcataatgcttaaagttaattg

SEQ ID NO: 1002791 - DNA, 22 bp, Artificial Sequence
  chemically synthesized
agcataatgcttaaagttaatt

SEQ ID NO: 1002792 - DNA, 22 bp, Artificial Sequence
  chemically synthesized
tagcataatgcttaaagttaat

SEQ ID NO: 1002793 - DNA, 22 bp, Artificial Sequence
  chemically synthesized
ttagcataatgcttaaagttaa

SEQ ID NO: 1002794 - DNA, 22 bp, Artificial Sequence
  chemically synthesized
tttagcataatgcttaaagtta

SEQ ID NO: 1002795 - DNA, 22 bp, Artificial Sequence
  chemically synthesized
ttttagcataatgcttaaagtt

SEQ ID NO: 1002796 - DNA, 22 bp, Artificial Sequence
  chemically synthesized
agatttttttagcataatgctt

SEQ ID NO: 1002797 - DNA, 22 bp, Artificial Sequence
  chemically synthesized
gctaagatttttttagcataat

SEQ ID NO: 1002798 - DNA, 22 bp, Artificial Sequence
  chemically synthesized
tggctaagatttttttagcata

SEQ ID NO: 1002799 - DNA, 22 bp, Artificial Sequence
  chemically synthesized
actttaagcattatgctaaaaa

SEQ ID NO: 1002800 - DNA, 22 bp, Artificial Sequence
  chemically synthesized
ctggctaagatttttttagcat

SEQ ID NO: 1002801 - DNA, 22 bp, Artificial Sequence
  chemically synthesized
taagcattatgctaaaaaaatc

SEQ ID NO: 1002802 - DNA, 22 bp, Artificial Sequence
  chemically synthesized
aagcattatgctaaaaaaatct

SEQ ID NO: 1002803 - DNA, 22 bp, Artificial Sequence
  chemically synthesized
agcattatgctaaaaaaatctt

SEQ ID NO: 1002804 - DNA, 22 bp, Artificial Sequence
  chemically synthesized
tgctaaaaaaatcttagccaga

SEQ ID NO: 1002805 - DNA, 22 bp, Artificial Sequence
  chemically synthesized
aggaagcaatccttctggctaa

SEQ ID NO: 1002806 - DNA, 22 bp, Artificial Sequence
  chemically synthesized
caggaagcaatccttctggcta

SEQ ID NO: 1002807 - DNA, 22 bp, Artificial Sequence
  chemically synthesized
tcaggaagcaatccttctggct

SEQ ID NO: 1002808 - DNA, 22 bp, Artificial Sequence
  chemically synthesized
aaaaaatcttagccagaaggat

SEQ ID NO: 1002809 - DNA, 22 bp, Artificial Sequence
  chemically synthesized
aatcattttcaggaagcaatcc

SEQ ID NO: 1002810 - DNA, 22 bp, Artificial Sequence
  chemically synthesized
agccagaaggattgcttcctga

SEQ ID NO: 1002811 - DNA, 22 bp, Artificial Sequence
  chemically synthesized
gccagaaggattgcttcctgaa

SEQ ID NO: 1002812 - DNA, 22 bp, Artificial Sequence
  chemically synthesized
agaaaaatacaaattaaatcat

SEQ ID NO: 1002813 - DNA, 22 bp, Artificial Sequence
  chemically synthesized
aagaaaaatacaaattaaatca

SEQ ID NO: 1002814 - DNA, 22 bp, Artificial Sequence
  chemically synthesized
cttcctgaaaatgatttaattt

SEQ ID NO: 1002815 - DNA, 22 bp, Artificial Sequence
  chemically synthesized
cctgaaaatgatttaatttgta

SEQ ID NO: 1002816 - DNA, 22 bp, Artificial Sequence
  chemically synthesized
ctgaaaatgatttaatttgtat

SEQ ID NO: 1002817 - DNA, 22 bp, Artificial Sequence
  chemically synthesized
tatttaagaaaaatacaaatta

SEQ ID NO: 1002818 - DNA, 22 bp, Artificial Sequence
  chemically synthesized
aaaatgatttaatttgtatttt

SEQ ID NO: 1002819 - DNA, 22 bp, Artificial Sequence
  chemically synthesized
ttatatttaagaaaaatacaaa

SEQ ID NO: 1002820 - DNA, 22 bp, Artificial Sequence
  chemically synthesized
attatatttaagaaaaatacaa

SEQ ID NO: 1002821 - DNA, 22 bp, Artificial Sequence
  chemically synthesized
tattatatttaagaaaaataca

SEQ ID NO: 1002822 - DNA, 22 bp, Artificial Sequence
  chemically synthesized
aatttgtatttttcttaaatat

SEQ ID NO: 1002823 - DNA, 22 bp, Artificial Sequence
  chemically synthesized
atttgtatttttcttaaatata

SEQ ID NO: 1002824 - DNA, 22 bp, Artificial Sequence
  chemically synthesized
tcagggcattttattatattta

SEQ ID NO: 1002825 - DNA, 22 bp, Artificial Sequence
  chemically synthesized
atcagggcattttattatattt

SEQ ID NO: 1002826 - DNA, 22 bp, Artificial Sequence
  chemically synthesized
gtatttttcttaaatataataa

SEQ ID NO: 1002827 - DNA, 22 bp, Artificial Sequence
  chemically synthesized
tatttttcttaaatataataaa

SEQ ID NO: 1002828 - DNA, 22 bp, Artificial Sequence
  chemically synthesized
ttatcagggcattttattatat

SEQ ID NO: 1002829 - DNA, 22 bp, Artificial Sequence
  chemically synthesized
cttatcagggcattttattata

SEQ ID NO: 1002830 - DNA, 22 bp, Artificial Sequence
  chemically synthesized
cttcttatcagggcattttatt

SEQ ID NO: 1002831 - DNA, 22 bp, Artificial Sequence
  chemically synthesized
ttcttaaatataataaaatgcc

SEQ ID NO: 1002832 - DNA, 22 bp, Artificial Sequence
  chemically synthesized
tcttaaatataataaaatgccc

SEQ ID NO: 1002833 - DNA, 22 bp, Artificial Sequence
  chemically synthesized
cttaaatataataaaatgccct

SEQ ID NO: 1002834 - DNA, 22 bp, Artificial Sequence
  chemically synthesized
ttaaatataataaaatgccctg

SEQ ID NO: 1002835 - DNA, 22 bp, Artificial Sequence
  chemically synthesized
attacttcttatcagggcattt

SEQ ID NO: 1002836 - DNA, 22 bp, Artificial Sequence
  chemically synthesized
aaatataataaaatgccctgat

SEQ ID NO: 1002837 - DNA, 22 bp, Artificial Sequence
  chemically synthesized
aatataataaaatgccctgata

SEQ ID NO: 1002838 - DNA, 22 bp, Artificial Sequence
  chemically synthesized
ttgattacttcttatcagggca

SEQ ID NO: 1002839 - DNA, 22 bp, Artificial Sequence
  chemically synthesized
gaatcaaaattgttgattactt

SEQ ID NO: 1002840 - DNA, 22 bp, Artificial Sequence
  chemically synthesized
ataagaagtaatcaacaatttt

SEQ ID NO: 1002841 - DNA, 22 bp, Artificial Sequence
  chemically synthesized
aaatcaaatggaaaactagaat

SEQ ID NO: 1002842 - DNA, 22 bp, Artificial Sequence
  chemically synthesized
tgattctagttttccatttgat

SEQ ID NO: 1002843 - DNA, 22 bp, Artificial Sequence
  chemically synthesized
gattctagttttccatttgatt

SEQ ID NO: 1002844 - DNA, 22 bp, Artificial Sequence
  chemically synthesized
attctagttttccatttgattt

SEQ ID NO: 1002845 - DNA, 22 bp, Artificial Sequence
  chemically synthesized
tagttttccatttgatttgaac

SEQ ID NO: 1002846 - DNA, 22 bp, Artificial Sequence
  chemically synthesized
aaataatgtacatgttcaaatc

SEQ ID NO: 1002847 - DNA, 22 bp, Artificial Sequence
  chemically synthesized
gttttccatttgatttgaacat

SEQ ID NO: 1002848 - DNA, 22 bp, Artificial Sequence
  chemically synthesized
tccatttgatttgaacatgtac

SEQ ID NO: 1002849 - DNA, 22 bp, Artificial Sequence
  chemically synthesized
ccatttgatttgaacatgtaca

SEQ ID NO: 1002850 - DNA, 22 bp, Artificial Sequence
  chemically synthesized
catttgatttgaacatgtacat

SEQ ID NO: 1002851 - DNA, 22 bp, Artificial Sequence
  chemically synthesized
gatttgaacatgtacattattt

SEQ ID NO: 1002852 - DNA, 22 bp, Artificial Sequence
  chemically synthesized
atttgaacatgtacattatttc

SEQ ID NO: 1002853 - DNA, 22 bp, Artificial Sequence
  chemically synthesized
gaacatgtacattatttcagca

SEQ ID NO: 1002854 - DNA, 22 bp, Artificial Sequence
  chemically synthesized
aacatgtacattatttcagcat

SEQ ID NO: 1002855 - DNA, 22 bp, Artificial Sequence
  chemically synthesized
tagatatgtatcatccaccatg

SEQ ID NO: 1002856 - DNA, 22 bp, Artificial Sequence
  chemically synthesized
tttcagcatggtggatgataca

SEQ ID NO: 1002857 - DNA, 22 bp, Artificial Sequence
  chemically synthesized
aagctgtagatatgtatcatcc

SEQ ID NO: 1002858 - DNA, 22 bp, Artificial Sequence
  chemically synthesized
caagctgtagatatgtatcatc

SEQ ID NO: 1002859 - DNA, 22 bp, Artificial Sequence
  chemically synthesized
cagcatggtggatgatacatat

SEQ ID NO: 1002860 - DNA, 22 bp, Artificial Sequence
  chemically synthesized
agcatggtggatgatacatatc

SEQ ID NO: 1002861 - DNA, 22 bp, Artificial Sequence
  chemically synthesized
cccaatgcacatatttcaagct

SEQ ID NO: 1002862 - DNA, 22 bp, Artificial Sequence
  chemically synthesized
cagcttgaaatatgtgcattgg

SEQ ID NO: 1002863 - DNA, 22 bp, Artificial Sequence
  chemically synthesized
aacaaaacctccccaatgcaca

SEQ ID NO: 1002864 - DNA, 22 bp, Artificial Sequence
  chemically synthesized
gaaatatgtgcattggggaggt

SEQ ID NO: 1002865 - DNA, 22 bp, Artificial Sequence
  chemically synthesized
gcattcaacaaaacctccccaa

SEQ ID NO: 1002866 - DNA, 22 bp, Artificial Sequence
  chemically synthesized
aaatatgtgcattggggaggtt

SEQ ID NO: 1002867 - DNA, 22 bp, Artificial Sequence
  chemically synthesized
gggaggttttgttgaatgctag

SEQ ID NO: 1002868 - DNA, 22 bp, Artificial Sequence
  chemically synthesized
cagcaaaacagcaatctagcat

SEQ ID NO: 1002869 - DNA, 22 bp, Artificial Sequence
  chemically synthesized
tgttgaatgctagattgctgtt

SEQ ID NO: 1002870 - DNA, 22 bp, Artificial Sequence
  chemically synthesized
gttgaatgctagattgctgttt

SEQ ID NO: 1002871 - DNA, 22 bp, Artificial Sequence
  chemically synthesized
ttgaatgctagattgctgtttt

SEQ ID NO: 1002872 - DNA, 22 bp, Artificial Sequence
  chemically synthesized
aatgctagattgctgttttgct

SEQ ID NO: 1002873 - DNA, 22 bp, Artificial Sequence
  chemically synthesized
gattgctgttttgctgtagttt

SEQ ID NO: 1002874 - DNA, 22 bp, Artificial Sequence
  chemically synthesized
acacaaataaatcaaactacag

SEQ ID NO: 1002875 - DNA, 22 bp, Artificial Sequence
  chemically synthesized
ctgttttgctgtagtttgattt

SEQ ID NO: 1002876 - DNA, 22 bp, Artificial Sequence
  chemically synthesized
ttttgctgtagtttgatttatt

SEQ ID NO: 1002877 - DNA, 22 bp, Artificial Sequence
  chemically synthesized
ataactcacacaaataaatcaa

SEQ ID NO: 1002878 - DNA, 22 bp, Artificial Sequence
  chemically synthesized
tgctgtagtttgatttatttgt

SEQ ID NO: 1002879 - DNA, 22 bp, Artificial Sequence
  chemically synthesized
gctgtagtttgatttatttgtg

SEQ ID NO: 1002880 - DNA, 22 bp, Artificial Sequence
  chemically synthesized
ctgtagtttgatttatttgtgt

SEQ ID NO: 1002881 - DNA, 22 bp, Artificial Sequence
  chemically synthesized
tagtttgatttatttgtgtgag

SEQ ID NO: 1002882 - DNA, 22 bp, Artificial Sequence
  chemically synthesized
caatatcaagctaataactcac

SEQ ID NO: 1002883 - DNA, 22 bp, Artificial Sequence
  chemically synthesized
gatttatttgtgtgagttatta

SEQ ID NO: 1002884 - DNA, 22 bp, Artificial Sequence
  chemically synthesized
ccaatatcaagctaataactca

SEQ ID NO: 1002885 - DNA, 22 bp, Artificial Sequence
  chemically synthesized
atttatttgtgtgagttattag

SEQ ID NO: 1002886 - DNA, 22 bp, Artificial Sequence
  chemically synthesized
tccaatatcaagctaataactc

SEQ ID NO: 1002887 - DNA, 22 bp, Artificial Sequence
  chemically synthesized
ctttccaatatcaagctaataa

SEQ ID NO: 1002888 - DNA, 22 bp, Artificial Sequence
  chemically synthesized
atttgtgtgagttattagcttg

SEQ ID NO: 1002889 - DNA, 22 bp, Artificial Sequence
  chemically synthesized
tttgtgtgagttattagcttga

SEQ ID NO: 1002890 - DNA, 22 bp, Artificial Sequence
  chemically synthesized
gttactttccaatatcaagcta

SEQ ID NO: 1002891 - DNA, 22 bp, Artificial Sequence
  chemically synthesized
gtgtgagttattagcttgatat

SEQ ID NO: 1002892 - DNA, 22 bp, Artificial Sequence
  chemically synthesized
agttactttccaatatcaagct

SEQ ID NO: 1002893 - DNA, 22 bp, Artificial Sequence
  chemically synthesized
tgtgagttattagcttgatatt

SEQ ID NO: 1002894 - DNA, 22 bp, Artificial Sequence
  chemically synthesized
tagttactttccaatatcaagc

SEQ ID NO: 1002895 - DNA, 22 bp, Artificial Sequence
  chemically synthesized
aaattttagttactttccaata

SEQ ID NO: 1002896 - DNA, 22 bp, Artificial Sequence
  chemically synthesized
ttagcttgatattggaaagtaa

SEQ ID NO: 1002897 - DNA, 22 bp, Artificial Sequence
  chemically synthesized
gcttgatattggaaagtaacta

SEQ ID NO: 1002898 - DNA, 22 bp, Artificial Sequence
  chemically synthesized
gatattggaaagtaactaaaat

SEQ ID NO: 1002899 - DNA, 22 bp, Artificial Sequence
  chemically synthesized
atattggaaagtaactaaaatt

SEQ ID NO: 1002900 - DNA, 22 bp, Artificial Sequence
  chemically synthesized
gaaagtaactaaaatttgaata

SEQ ID NO: 1002901 - DNA, 22 bp, Artificial Sequence
  chemically synthesized
agaagcagagatatcatatatt

SEQ ID NO: 1002902 - DNA, 22 bp, Artificial Sequence
  chemically synthesized
cagaagcagagatatcatatat

SEQ ID NO: 1002903 - DNA, 22 bp, Artificial Sequence
  chemically synthesized
tttcagaagcagagatatcata

SEQ ID NO: 1002904 - DNA, 22 bp, Artificial Sequence
  chemically synthesized
aaatttgaatatatgatatctc

SEQ ID NO: 1002905 - DNA, 22 bp, Artificial Sequence
  chemically synthesized
atttcagaagcagagatatcat

SEQ ID NO: 1002906 - DNA, 22 bp, Artificial Sequence
  chemically synthesized
tatttatttcagaagcagagat

SEQ ID NO: 1002907 - DNA, 22 bp, Artificial Sequence
  chemically synthesized
gaatatatgatatctctgcttc

SEQ ID NO: 1002908 - DNA, 22 bp, Artificial Sequence
  chemically synthesized
aatatatgatatctctgcttct

SEQ ID NO: 1002909 - DNA, 22 bp, Artificial Sequence
  chemically synthesized
aatcgctatatttatttcagaa

SEQ ID NO: 1002910 - DNA, 22 bp, Artificial Sequence
  chemically synthesized
caatcgctatatttatttcaga

SEQ ID NO: 1002911 - DNA, 22 bp, Artificial Sequence
  chemically synthesized
tcaatcgctatatttatttcag

SEQ ID NO: 1002912 - DNA, 22 bp, Artificial Sequence
  chemically synthesized
tgcttctgaaataaatatagcg

SEQ ID NO: 1002913 - DNA, 22 bp, Artificial Sequence
  chemically synthesized
cttctgaaataaatatagcgat

SEQ ID NO: 1002914 - DNA, 22 bp, Artificial Sequence
  chemically synthesized
ctgaaataaatatagcgattga

SEQ ID NO: 1002915 - DNA, 22 bp, Artificial Sequence
  chemically synthesized
tgaaataaatatagcgattgaa

SEQ ID NO: 1002916 - DNA, 22 bp, Artificial Sequence
  chemically synthesized
aaataaatatagcgattgaaaa

SEQ ID NO: 1002917 - DNA, 22 bp, Artificial Sequence
  chemically synthesized
ataaaaggtccattttcaatcg

SEQ ID NO: 1002918 - DNA, 22 bp, Artificial Sequence
  chemically synthesized
aacgttcataaaaggtccattt

SEQ ID NO: 1002919 - DNA, 22 bp, Artificial Sequence
  chemically synthesized
ccccactcaacgttcataaaag

SEQ ID NO: 1002920 - DNA, 22 bp, Artificial Sequence
  chemically synthesized
aaaatggaccttttatgaacgt

SEQ ID NO: 1002921 - DNA, 22 bp, Artificial Sequence
  chemically synthesized
ccagaaattgccccactcaacg

SEQ ID NO: 1002922 - DNA, 22 bp, Artificial Sequence
  chemically synthesized
ttatgaacgttgagtggggcaa

SEQ ID NO: 1002923 - DNA, 22 bp, Artificial Sequence
  chemically synthesized
tatgaacgttgagtggggcaat

SEQ ID NO: 1002924 - DNA, 22 bp, Artificial Sequence
  chemically synthesized
atgaacgttgagtggggcaatt

SEQ ID NO: 1002925 - DNA, 22 bp, Artificial Sequence
  chemically synthesized
tgaacgttgagtggggcaattt

SEQ ID NO: 1002926 - DNA, 22 bp, Artificial Sequence
  chemically synthesized
cccacctgccagaaattgcccc

SEQ ID NO: 1002927 - DNA, 22 bp, Artificial Sequence
  chemically synthesized
ccccacctgccagaaattgccc

SEQ ID NO: 1002928 - DNA, 22 bp, Artificial Sequence
  chemically synthesized
ttccccacctgccagaaattgc

SEQ ID NO: 1002929 - DNA, 22 bp, Artificial Sequence
  chemically synthesized
tcttccccacctgccagaaatt

SEQ ID NO: 1002930 - DNA, 22 bp, Artificial Sequence
  chemically synthesized
ctctcttccccacctgccagaa

SEQ ID NO: 1002931 - DNA, 22 bp, Artificial Sequence
  chemically synthesized
agtggggcaatttctggcaggt

SEQ ID NO: 1002932 - DNA, 22 bp, Artificial Sequence
  chemically synthesized
actctcttccccacctgccaga

SEQ ID NO: 1002933 - DNA, 22 bp, Artificial Sequence
  chemically synthesized
tactctcttccccacctgccag

SEQ ID NO: 1002934 - DNA, 22 bp, Artificial Sequence
  chemically synthesized
tttactctcttccccacctgcc

SEQ ID NO: 1002935 - DNA, 22 bp, Artificial Sequence
  chemically synthesized
ctttactctcttccccacctgc

SEQ ID NO: 1002936 - DNA, 22 bp, Artificial Sequence
  chemically synthesized
ctggcaggtggggaagagagta

SEQ ID NO: 1002937 - DNA, 22 bp, Artificial Sequence
  chemically synthesized
tggcaggtggggaagagagtaa

SEQ ID NO: 1002938 - DNA, 22 bp, Artificial Sequence
  chemically synthesized
gcaggtggggaagagagtaaag

SEQ ID NO: 1002939 - DNA, 22 bp, Artificial Sequence
  chemically synthesized
atacaatgaatcttctttactc

SEQ ID NO: 1002940 - DNA, 22 bp, Artificial Sequence
  chemically synthesized
catacaatgaatcttctttact

SEQ ID NO: 1002941 - DNA, 22 bp, Artificial Sequence
  chemically synthesized
tcatacaatgaatcttctttac

SEQ ID NO: 1002942 - DNA, 22 bp, Artificial Sequence
  chemically synthesized
ctttcatacaatgaatcttctt

SEQ ID NO: 1002943 - DNA, 22 bp, Artificial Sequence
  chemically synthesized
gctttcatacaatgaatcttct

SEQ ID NO: 1002944 - DNA, 22 bp, Artificial Sequence
  chemically synthesized
tgctttcatacaatgaatcttc

SEQ ID NO: 1002945 - DNA, 22 bp, Artificial Sequence
  chemically synthesized
ctttgctttcatacaatgaatc

SEQ ID NO: 1002946 - DNA, 22 bp, Artificial Sequence
  chemically synthesized
gctttgctttcatacaatgaat

SEQ ID NO: 1002947 - DNA, 22 bp, Artificial Sequence
  chemically synthesized
tgtgtatttgctttgctttcat

SEQ ID NO: 1002948 - DNA, 22 bp, Artificial Sequence
  chemically synthesized
tatgtgtatttgctttgctttc

SEQ ID NO: 1002949 - DNA, 22 bp, Artificial Sequence
  chemically synthesized
attgtatgaaagcaaagcaaat

SEQ ID NO: 1002950 - DNA, 22 bp, Artificial Sequence
  chemically synthesized
caagttctatgtgtatttgctt

SEQ ID NO: 1002951 - DNA, 22 bp, Artificial Sequence
  chemically synthesized
tatgaaagcaaagcaaatacac

SEQ ID NO: 1002952 - DNA, 22 bp, Artificial Sequence
  chemically synthesized
aattacaagttctatgtgtatt

SEQ ID NO: 1002953 - DNA, 22 bp, Artificial Sequence
  chemically synthesized
cgttaaattacaagttctatgt

SEQ ID NO: 1002954 - DNA, 22 bp, Artificial Sequence
  chemically synthesized
atatgttccgttaaattacaag

SEQ ID NO: 1002955 - DNA, 22 bp, Artificial Sequence
  chemically synthesized
ctgatatgttccgttaaattac

SEQ ID NO: 1002956 - DNA, 22 bp, Artificial Sequence
  chemically synthesized
gtaatttaacggaacatatcag

SEQ ID NO: 1002957 - DNA, 22 bp, Artificial Sequence
  chemically synthesized
taatttaacggaacatatcagc

SEQ ID NO: 1002958 - DNA, 22 bp, Artificial Sequence
  chemically synthesized
agaaccacatctgctgatatgt

SEQ ID NO: 1002959 - DNA, 22 bp, Artificial Sequence
  chemically synthesized
tgagaaccacatctgctgatat

SEQ ID NO: 1002960 - DNA, 22 bp, Artificial Sequence
  chemically synthesized
aacggaacatatcagcagatgt

SEQ ID NO: 1002961 - DNA, 22 bp, Artificial Sequence
  chemically synthesized
acggaacatatcagcagatgtg

SEQ ID NO: 1002962 - DNA, 22 bp, Artificial Sequence
  chemically synthesized
atgtaaatgtaagagtcattct

SEQ ID NO: 1002963 - DNA, 22 bp, Artificial Sequence
  chemically synthesized
tcagaatgactcttacatttac

SEQ ID NO: 1002964 - DNA, 22 bp, Artificial Sequence
  chemically synthesized
gatagtcattaatgtaaatgta

SEQ ID NO: 1002965 - DNA, 22 bp, Artificial Sequence
  chemically synthesized
agaatgactcttacatttacat

SEQ ID NO: 1002966 - DNA, 22 bp, Artificial Sequence
  chemically synthesized
agatagtcattaatgtaaatgt

SEQ ID NO: 1002967 - DNA, 22 bp, Artificial Sequence
  chemically synthesized
tagatagtcattaatgtaaatg

SEQ ID NO: 1002968 - DNA, 22 bp, Artificial Sequence
  chemically synthesized
ttagatagtcattaatgtaaat

SEQ ID NO: 1002969 - DNA, 22 bp, Artificial Sequence
  chemically synthesized
tttagatagtcattaatgtaaa

SEQ ID NO: 1002970 - DNA, 22 bp, Artificial Sequence
  chemically synthesized
tttttagatagtcattaatgta

SEQ ID NO: 1002971 - DNA, 22 bp, Artificial Sequence
  chemically synthesized
attctttttagatagtcattaa

SEQ ID NO: 1002972 - DNA, 22 bp, Artificial Sequence
  chemically synthesized
ttacatttacattaatgactat

SEQ ID NO: 1002973 - DNA, 22 bp, Artificial Sequence
  chemically synthesized
acatttacattaatgactatct

SEQ ID NO: 1002974 - DNA, 22 bp, Artificial Sequence
  chemically synthesized
catttacattaatgactatcta

SEQ ID NO: 1002975 - DNA, 22 bp, Artificial Sequence
  chemically synthesized
tctaattctttttagatagtca

SEQ ID NO: 1002976 - DNA, 22 bp, Artificial Sequence
  chemically synthesized
acattaatgactatctaaaaag

SEQ ID NO: 1002977 - DNA, 22 bp, Artificial Sequence
  chemically synthesized
cattaatgactatctaaaaaga

SEQ ID NO: 1002978 - DNA, 22 bp, Artificial Sequence
  chemically synthesized
acggtgctgtctaattcttttt

SEQ ID NO: 1002979 - DNA, 22 bp, Artificial Sequence
  chemically synthesized
atgactatctaaaaagaattag

SEQ ID NO: 1002980 - DNA, 22 bp, Artificial Sequence
  chemically synthesized
tctaaaaagaattagacagcac

SEQ ID NO: 1002981 - DNA, 22 bp, Artificial Sequence
  chemically synthesized
aaaagaattagacagcaccgtg

SEQ ID NO: 1002982 - DNA, 22 bp, Artificial Sequence
  chemically synthesized
aaaaaggaagttcacggtgctg

SEQ ID NO: 1002983 - DNA, 22 bp, Artificial Sequence
  chemically synthesized
gaaaaaggaagttcacggtgct

SEQ ID NO: 1002984 - DNA, 22 bp, Artificial Sequence
  chemically synthesized
tgaaaaaggaagttcacggtgc

SEQ ID NO: 1002985 - DNA, 22 bp, Artificial Sequence
  chemically synthesized
attttgaaaaaggaagttcacg

SEQ ID NO: 1002986 - DNA, 22 bp, Artificial Sequence
  chemically synthesized
aattttgaaaaaggaagttcac

SEQ ID NO: 1002987 - DNA, 22 bp, Artificial Sequence
  chemically synthesized
taattttgaaaaaggaagttca

SEQ ID NO: 1002988 - DNA, 22 bp, Artificial Sequence
  chemically synthesized
ttaattttgaaaaaggaagttc

SEQ ID NO: 1002989 - DNA, 22 bp, Artificial Sequence
  chemically synthesized
gacagcaccgtgaacttccttt

SEQ ID NO: 1002990 - DNA, 22 bp, Artificial Sequence
  chemically synthesized
aaaaaaacttttaattttgaaa

SEQ ID NO: 1002991 - DNA, 22 bp, Artificial Sequence
  chemically synthesized
aaaaaaaacttttaattttgaa

SEQ ID NO: 1002992 - DNA, 22 bp, Artificial Sequence
  chemically synthesized
taaaaaaaacttttaattttga

SEQ ID NO: 1002993 - DNA, 22 bp, Artificial Sequence
  chemically synthesized
ttttaaaaaaaacttttaattt

SEQ ID NO: 1002994 - DNA, 22 bp, Artificial Sequence
  chemically synthesized
attttaaaaaaaacttttaatt

SEQ ID NO: 1002995 - DNA, 22 bp, Artificial Sequence
  chemically synthesized
tattttaaaaaaaacttttaat

SEQ ID NO: 1002996 - DNA, 22 bp, Artificial Sequence
  chemically synthesized
cctttttcaaaattaaaagttt

SEQ ID NO: 1002997 - DNA, 22 bp, Artificial Sequence
  chemically synthesized
ctttttcaaaattaaaagtttt

SEQ ID NO: 1002998 - DNA, 22 bp, Artificial Sequence
  chemically synthesized
tttattttaaaaaaaactttta

SEQ ID NO: 1002999 - DNA, 22 bp, Artificial Sequence
  chemically synthesized
ctttattttaaaaaaaactttt

SEQ ID NO: 1003000 - DNA, 22 bp, Artificial Sequence
  chemically synthesized
tttcaaaattaaaagttttttt

SEQ ID NO: 1003001 - DNA, 22 bp, Artificial Sequence
  chemically synthesized
ttcaaaattaaaagtttttttt

SEQ ID NO: 1003002 - DNA, 22 bp, Artificial Sequence
  chemically synthesized
tcaaaattaaaagtttttttta

SEQ ID NO: 1003003 - DNA, 22 bp, Artificial Sequence
  chemically synthesized
caaaattaaaagttttttttaa

SEQ ID NO: 1003004 - DNA, 22 bp, Artificial Sequence
  chemically synthesized
aacttctttattttaaaaaaaa

SEQ ID NO: 1003005 - DNA, 22 bp, Artificial Sequence
  chemically synthesized
aaaattaaaagttttttttaaa

SEQ ID NO: 1003006 - DNA, 22 bp, Artificial Sequence
  chemically synthesized
aaatctgaacttctttatttta

SEQ ID NO: 1003007 - DNA, 22 bp, Artificial Sequence
  chemically synthesized
aaagttttttttaaaataaaga

SEQ ID NO: 1003008 - DNA, 22 bp, Artificial Sequence
  chemically synthesized
atgctaaaatctgaacttcttt

SEQ ID NO: 1003009 - DNA, 22 bp, Artificial Sequence
  chemically synthesized
tttttaaaataaagaagttcag

SEQ ID NO: 1003010 - DNA, 22 bp, Artificial Sequence
  chemically synthesized
ttttaaaataaagaagttcaga

SEQ ID NO: 1003011 - DNA, 22 bp, Artificial Sequence
  chemically synthesized
tttaaaataaagaagttcagat

SEQ ID NO: 1003012 - DNA, 22 bp, Artificial Sequence
  chemically synthesized
ttaaaataaagaagttcagatt

SEQ ID NO: 1003013 - DNA, 22 bp, Artificial Sequence
  chemically synthesized
taaaataaagaagttcagattt

SEQ ID NO: 1003014 - DNA, 22 bp, Artificial Sequence
  chemically synthesized
aaaataaagaagttcagatttt

SEQ ID NO: 1003015 - DNA, 22 bp, Artificial Sequence
  chemically synthesized
aaataaagaagttcagatttta

SEQ ID NO: 1003016 - DNA, 22 bp, Artificial Sequence
  chemically synthesized
gtcagttgatgctaaaatctga

SEQ ID NO: 1003017 - DNA, 22 bp, Artificial Sequence
  chemically synthesized
ggtcagttgatgctaaaatctg

SEQ ID NO: 1003018 - DNA, 22 bp, Artificial Sequence
  chemically synthesized
tggtcagttgatgctaaaatct

SEQ ID NO: 1003019 - DNA, 22 bp, Artificial Sequence
  chemically synthesized
tgctttggtcagttgatgctaa

SEQ ID NO: 1003020 - DNA, 22 bp, Artificial Sequence
  chemically synthesized
atgctttggtcagttgatgcta

SEQ ID NO: 1003021 - DNA, 22 bp, Artificial Sequence
  chemically synthesized
agattttagcatcaactgacca

SEQ ID NO: 1003022 - DNA, 22 bp, Artificial Sequence
  chemically synthesized
gatggccccttatgctttggtc

SEQ ID NO: 1003023 - DNA, 22 bp, Artificial Sequence
  chemically synthesized
tagcatcaactgaccaaagcat

SEQ ID NO: 1003024 - DNA, 22 bp, Artificial Sequence
  chemically synthesized
ggatggccccttatgctttggt

SEQ ID NO: 1003025 - DNA, 22 bp, Artificial Sequence
  chemically synthesized
agcatcaactgaccaaagcata

SEQ ID NO: 1003026 - DNA, 22 bp, Artificial Sequence
  chemically synthesized
gcatcaactgaccaaagcataa

SEQ ID NO: 1003027 - DNA, 22 bp, Artificial Sequence
  chemically synthesized
ttggatggccccttatgctttg

SEQ ID NO: 1003028 - DNA, 22 bp, Artificial Sequence
  chemically synthesized
cttggatggccccttatgcttt

SEQ ID NO: 1003029 - DNA, 22 bp, Artificial Sequence
  chemically synthesized
tcttggatggccccttatgctt

SEQ ID NO: 1003030 - DNA, 22 bp, Artificial Sequence
  chemically synthesized
ttcttggatggccccttatgct

SEQ ID NO: 1003031 - DNA, 22 bp, Artificial Sequence
  chemically synthesized
tttcttggatggccccttatgc

SEQ ID NO: 1003032 - DNA, 22 bp, Artificial Sequence
  chemically synthesized
ttttcttggatggccccttatg

SEQ ID NO: 1003033 - DNA, 22 bp, Artificial Sequence
  chemically synthesized
tttttcttggatggccccttat

SEQ ID NO: 1003034 - DNA, 22 bp, Artificial Sequence
  chemically synthesized
ttttttttcttggatggcccct

SEQ ID NO: 1003035 - DNA, 22 bp, Artificial Sequence
  chemically synthesized
accaaagcataaggggccatcc

SEQ ID NO: 1003036 - DNA, 22 bp, Artificial Sequence
  chemically synthesized
agattattttttttcttggatg

SEQ ID NO: 1003037 - DNA, 22 bp, Artificial Sequence
  chemically synthesized
cagattattttttttcttggat

SEQ ID NO: 1003038 - DNA, 22 bp, Artificial Sequence
  chemically synthesized
tgaaagtgcttcagattatttt

SEQ ID NO: 1003039 - DNA, 22 bp, Artificial Sequence
  chemically synthesized
atgaaagtgcttcagattattt

SEQ ID NO: 1003040 - DNA, 22 bp, Artificial Sequence
  chemically synthesized
tatgaaagtgcttcagattatt

SEQ ID NO: 1003041 - DNA, 22 bp, Artificial Sequence
  chemically synthesized
taacatcgttttatgaaagtgc

SEQ ID NO: 1003042 - DNA, 22 bp, Artificial Sequence
  chemically synthesized
gtaacatcgttttatgaaagtg

SEQ ID NO: 1003043 - DNA, 22 bp, Artificial Sequence
  chemically synthesized
atttgtaacatcgttttatgaa

SEQ ID NO: 1003044 - DNA, 22 bp, Artificial Sequence
  chemically synthesized
aagcactttcataaaacgatgt

SEQ ID NO: 1003045 - DNA, 22 bp, Artificial Sequence
  chemically synthesized
aaatattgatttgtaacatcgt

SEQ ID NO: 1003046 - DNA, 22 bp, Artificial Sequence
  chemically synthesized
tcataaaacgatgttacaaatc

SEQ ID NO: 1003047 - DNA, 22 bp, Artificial Sequence
  chemically synthesized
cataaaacgatgttacaaatca

SEQ ID NO: 1003048 - DNA, 22 bp, Artificial Sequence
  chemically synthesized
ataaaacgatgttacaaatcaa

SEQ ID NO: 1003049 - DNA, 22 bp, Artificial Sequence
  chemically synthesized
aaagtgtctaaaatattgattt

SEQ ID NO: 1003050 - DNA, 22 bp, Artificial Sequence
  chemically synthesized
caaagtgtctaaaatattgatt

SEQ ID NO: 1003051 - DNA, 22 bp, Artificial Sequence
  chemically synthesized
caaatcaatattttagacactt

SEQ ID NO: 1003052 - DNA, 22 bp, Artificial Sequence
  chemically synthesized
aaaagcaaggagatgatcttca

SEQ ID NO: 1003053 - DNA, 22 bp, Artificial Sequence
  chemically synthesized
tagacactttgaagatcatctc

SEQ ID NO: 1003054 - DNA, 22 bp, Artificial Sequence
  chemically synthesized
agacactttgaagatcatctcc

SEQ ID NO: 1003055 - DNA, 22 bp, Artificial Sequence
  chemically synthesized
gacactttgaagatcatctcct

SEQ ID NO: 1003056 - DNA, 22 bp, Artificial Sequence
  chemically synthesized
tgaagatcatctccttgctttt

SEQ ID NO: 1003057 - DNA, 22 bp, Artificial Sequence
  chemically synthesized
gaagatcatctccttgcttttc

SEQ ID NO: 1003058 - DNA, 22 bp, Artificial Sequence
  chemically synthesized
aagatcatctccttgcttttca

SEQ ID NO: 1003059 - DNA, 22 bp, Artificial Sequence
  chemically synthesized
ggaagtgtgaaggttgaaaagc

SEQ ID NO: 1003060 - DNA, 22 bp, Artificial Sequence
  chemically synthesized
tctcggaagtgtgaaggttgaa

SEQ ID NO: 1003061 - DNA, 22 bp, Artificial Sequence
  chemically synthesized
cttgcttttcaaccttcacact

SEQ ID NO: 1003062 - DNA, 22 bp, Artificial Sequence
  chemically synthesized
gcttttcaaccttcacacttcc

SEQ ID NO: 1003063 - DNA, 22 bp, Artificial Sequence
  chemically synthesized
cttttcaaccttcacacttccg

SEQ ID NO: 1003064 - DNA, 22 bp, Artificial Sequence
  chemically synthesized
ttcaaccttcacacttccgaga

SEQ ID NO: 1003065 - DNA, 22 bp, Artificial Sequence
  chemically synthesized
tcaaccttcacacttccgagac

SEQ ID NO: 1003066 - DNA, 22 bp, Artificial Sequence
  chemically synthesized
caaccttcacacttccgagaca

SEQ ID NO: 1003067 - DNA, 22 bp, Artificial Sequence
  chemically synthesized
aaccttcacacttccgagacag

SEQ ID NO: 1003068 - DNA, 22 bp, Artificial Sequence
  chemically synthesized
cacacttccgagacaggggata

SEQ ID NO: 1003069 - DNA, 22 bp, Artificial Sequence
  chemically synthesized
acacttccgagacaggggatat

SEQ ID NO: 1003070 - DNA, 22 bp, Artificial Sequence
  chemically synthesized
ccgagacaggggatatatatgt

SEQ ID NO: 1003071 - DNA, 22 bp, Artificial Sequence
  chemically synthesized
cgagacaggggatatatatgtt

SEQ ID NO: 1003072 - DNA, 22 bp, Artificial Sequence
  chemically synthesized
gaaaaagagatgatataaacat

SEQ ID NO: 1003073 - DNA, 22 bp, Artificial Sequence
  chemically synthesized
agaaaaagagatgatataaaca

SEQ ID NO: 1003074 - DNA, 22 bp, Artificial Sequence
  chemically synthesized
tagaaaaagagatgatataaac

SEQ ID NO: 1003075 - DNA, 22 bp, Artificial Sequence
  chemically synthesized
ttttagaaaaagagatgatata

SEQ ID NO: 1003076 - DNA, 22 bp, Artificial Sequence
  chemically synthesized
attttagaaaaagagatgatat

SEQ ID NO: 1003077 - DNA, 22 bp, Artificial Sequence
  chemically synthesized
atatcatctctttttctaaaat

SEQ ID NO: 1003078 - DNA, 22 bp, Artificial Sequence
  chemically synthesized
tatcatctctttttctaaaata

SEQ ID NO: 1003079 - DNA, 22 bp, Artificial Sequence
  chemically synthesized
aatcagaaatgatttattttag

SEQ ID NO: 1003080 - DNA, 22 bp, Artificial Sequence
  chemically synthesized
tttttctaaaataaatcatttc

SEQ ID NO: 1003081 - DNA, 22 bp, Artificial Sequence
  chemically synthesized
tttctaaaataaatcatttctg

SEQ ID NO: 1003082 - DNA, 22 bp, Artificial Sequence
  chemically synthesized
ttctaaaataaatcatttctga

SEQ ID NO: 1003083 - DNA, 22 bp, Artificial Sequence
  chemically synthesized
tctaaaataaatcatttctgat

SEQ ID NO: 1003084 - DNA, 22 bp, Artificial Sequence
  chemically synthesized
ctaaaataaatcatttctgatt

SEQ ID NO: 1003085 - DNA, 22 bp, Artificial Sequence
  chemically synthesized
taaaagatgctcaatcagaaat

SEQ ID NO: 1003086 - DNA, 22 bp, Artificial Sequence
  chemically synthesized
taaaataaatcatttctgattg

SEQ ID NO: 1003087 - DNA, 22 bp, Artificial Sequence
  chemically synthesized
tgtaaaagatgctcaatcagaa

SEQ ID NO: 1003088 - DNA, 22 bp, Artificial Sequence
  chemically synthesized
aaataaatcatttctgattgag

SEQ ID NO: 1003089 - DNA, 22 bp, Artificial Sequence
  chemically synthesized
ctgtaaaagatgctcaatcaga

SEQ ID NO: 1003090 - DNA, 22 bp, Artificial Sequence
  chemically synthesized
ttctgtaaaagatgctcaatca

SEQ ID NO: 1003091 - DNA, 22 bp, Artificial Sequence
  chemically synthesized
cagtgggctcttctgtaaaaga

SEQ ID NO: 1003092 - DNA, 22 bp, Artificial Sequence
  chemically synthesized
ctgattgagcatcttttacaga

SEQ ID NO: 1003093 - DNA, 22 bp, Artificial Sequence
  chemically synthesized
gcagtgggctcttctgtaaaag

SEQ ID NO: 1003094 - DNA, 22 bp, Artificial Sequence
  chemically synthesized
tgattgagcatcttttacagaa

SEQ ID NO: 1003095 - DNA, 22 bp, Artificial Sequence
  chemically synthesized
attgagcatcttttacagaaga

SEQ ID NO: 1003096 - DNA, 22 bp, Artificial Sequence
  chemically synthesized
acatttgcagtgggctcttctg

SEQ ID NO: 1003097 - DNA, 22 bp, Artificial Sequence
  chemically synthesized
agcatcttttacagaagagccc

SEQ ID NO: 1003098 - DNA, 22 bp, Artificial Sequence
  chemically synthesized
ttacagaagagcccactgcaaa

SEQ ID NO: 1003099 - DNA, 22 bp, Artificial Sequence
  chemically synthesized
taaaaattgacatttgcagtgg

SEQ ID NO: 1003100 - DNA, 22 bp, Artificial Sequence
  chemically synthesized
tacagaagagcccactgcaaat

SEQ ID NO: 1003101 - DNA, 22 bp, Artificial Sequence
  chemically synthesized
acagaagagcccactgcaaatg

SEQ ID NO: 1003102 - DNA, 22 bp, Artificial Sequence
  chemically synthesized
cagaagagcccactgcaaatgt

SEQ ID NO: 1003103 - DNA, 22 bp, Artificial Sequence
  chemically synthesized
ggcaattataaaaattgacatt

SEQ ID NO: 1003104 - DNA, 22 bp, Artificial Sequence
  chemically synthesized
caaatgtcaatttttataattg

SEQ ID NO: 1003105 - DNA, 22 bp, Artificial Sequence
  chemically synthesized
ccacaagtatggtctgggcaat

SEQ ID NO: 1003106 - DNA, 22 bp, Artificial Sequence
  chemically synthesized
cccacaagtatggtctgggcaa

SEQ ID NO: 1003107 - DNA, 22 bp, Artificial Sequence
  chemically synthesized
tcccacaagtatggtctgggca

SEQ ID NO: 1003108 - DNA, 22 bp, Artificial Sequence
  chemically synthesized
ttcccacaagtatggtctgggc

SEQ ID NO: 1003109 - DNA, 22 bp, Artificial Sequence
  chemically synthesized
ttataattgcccagaccatact

SEQ ID NO: 1003110 - DNA, 22 bp, Artificial Sequence
  chemically synthesized
atttttcccacaagtatggtct

SEQ ID NO: 1003111 - DNA, 22 bp, Artificial Sequence
  chemically synthesized
tataattgcccagaccatactt

SEQ ID NO: 1003112 - DNA, 22 bp, Artificial Sequence
  chemically synthesized
catttttcccacaagtatggtc

SEQ ID NO: 1003113 - DNA, 22 bp, Artificial Sequence
  chemically synthesized
ataattgcccagaccatacttg

SEQ ID NO: 1003114 - DNA, 22 bp, Artificial Sequence
  chemically synthesized
taattgcccagaccatacttgt

SEQ ID NO: 1003115 - DNA, 22 bp, Artificial Sequence
  chemically synthesized
tcccttcatttttcccacaagt

SEQ ID NO: 1003116 - DNA, 22 bp, Artificial Sequence
  chemically synthesized
gtcccttcatttttcccacaag

SEQ ID NO: 1003117 - DNA, 22 bp, Artificial Sequence
  chemically synthesized
cccagaccatacttgtgggaaa

SEQ ID NO: 1003118 - DNA, 22 bp, Artificial Sequence
  chemically synthesized
ttgtcccttcatttttcccaca

SEQ ID NO: 1003119 - DNA, 22 bp, Artificial Sequence
  chemically synthesized
ctcttgtcccttcatttttccc

SEQ ID NO: 1003120 - DNA, 22 bp, Artificial Sequence
  chemically synthesized
ctactcttgtcccttcattttt

SEQ ID NO: 1003121 - DNA, 22 bp, Artificial Sequence
  chemically synthesized
cctactcttgtcccttcatttt

SEQ ID NO: 1003122 - DNA, 22 bp, Artificial Sequence
  chemically synthesized
gtgggaaaaatgaagggacaag

SEQ ID NO: 1003123 - DNA, 22 bp, Artificial Sequence
  chemically synthesized
tgggaaaaatgaagggacaaga

SEQ ID NO: 1003124 - DNA, 22 bp, Artificial Sequence
  chemically synthesized
aatgaccttcctactcttgtcc

SEQ ID NO: 1003125 - DNA, 22 bp, Artificial Sequence
  chemically synthesized
agtgaccctgaatgaccttcct

SEQ ID NO: 1003126 - DNA, 22 bp, Artificial Sequence
  chemically synthesized
tggtagaaatgtattcagtgac

SEQ ID NO: 1003127 - DNA, 22 bp, Artificial Sequence
  chemically synthesized
ctgtggtagaaatgtattcagt

SEQ ID NO: 1003128 - DNA, 22 bp, Artificial Sequence
  chemically synthesized
cctgtggtagaaatgtattcag

SEQ ID NO: 1003129 - DNA, 22 bp, Artificial Sequence
  chemically synthesized
tcctgtggtagaaatgtattca

SEQ ID NO: 1003130 - DNA, 22 bp, Artificial Sequence
  chemically synthesized
agggtcactgaatacatttcta

SEQ ID NO: 1003131 - DNA, 22 bp, Artificial Sequence
  chemically synthesized
aatacatttctaccacaggaaa

SEQ ID NO: 1003132 - DNA, 22 bp, Artificial Sequence
  chemically synthesized
ctaccacaggaaagcattacgt

SEQ ID NO: 1003133 - DNA, 22 bp, Artificial Sequence
  chemically synthesized
taccacaggaaagcattacgtc

SEQ ID NO: 1003134 - DNA, 22 bp, Artificial Sequence
  chemically synthesized
ccacaggaaagcattacgtctt

SEQ ID NO: 1003135 - DNA, 22 bp, Artificial Sequence
  chemically synthesized
aagaaataaagtgcaaaagacg

SEQ ID NO: 1003136 - DNA, 22 bp, Artificial Sequence
  chemically synthesized
gaagaaataaagtgcaaaagac

SEQ ID NO: 1003137 - DNA, 22 bp, Artificial Sequence
  chemically synthesized
cgtcttttgcactttatttctt

SEQ ID NO: 1003138 - DNA, 22 bp, Artificial Sequence
  chemically synthesized
gaagggaatggcttgaagaaat

SEQ ID NO: 1003139 - DNA, 22 bp, Artificial Sequence
  chemically synthesized
ttgcactttatttcttcaagcc

SEQ ID NO: 1003140 - DNA, 22 bp, Artificial Sequence
  chemically synthesized
tgcactttatttcttcaagcca

SEQ ID NO: 1003141 - DNA, 22 bp, Artificial Sequence
  chemically synthesized
gcactttatttcttcaagccat

SEQ ID NO: 1003142 - DNA, 22 bp, Artificial Sequence
  chemically synthesized
cactttatttcttcaagccatt

SEQ ID NO: 1003143 - DNA, 22 bp, Artificial Sequence
  chemically synthesized
tatttcttcaagccattccctt

SEQ ID NO: 1003144 - DNA, 22 bp, Artificial Sequence
  chemically synthesized
atttcttcaagccattcccttc

SEQ ID NO: 1003145 - DNA, 22 bp, Artificial Sequence
  chemically synthesized
tttcttcaagccattcccttcc

SEQ ID NO: 1003146 - DNA, 22 bp, Artificial Sequence
  chemically synthesized
cttcaagccattcccttccaac

SEQ ID NO: 1003147 - DNA, 22 bp, Artificial Sequence
  chemically synthesized
ttcaagccattcccttccaaca

SEQ ID NO: 1003148 - DNA, 22 bp, Artificial Sequence
  chemically synthesized
caagccattcccttccaacatc

SEQ ID NO: 1003149 - DNA, 22 bp, Artificial Sequence
  chemically synthesized
aagccattcccttccaacatct

SEQ ID NO: 1003150 - DNA, 22 bp, Artificial Sequence
  chemically synthesized
gggggacagggatatgagatgt

SEQ ID NO: 1003151 - DNA, 22 bp, Artificial Sequence
  chemically synthesized
tggggggacagggatatgagat

SEQ ID NO: 1003152 - DNA, 22 bp, Artificial Sequence
  chemically synthesized
ctggggggacagggatatgaga

SEQ ID NO: 1003153 - DNA, 22 bp, Artificial Sequence
  chemically synthesized
tctggggggacagggatatgag

SEQ ID NO: 1003154 - DNA, 22 bp, Artificial Sequence
  chemically synthesized
ccttccaacatctcatatccct

SEQ ID NO: 1003155 - DNA, 22 bp, Artificial Sequence
  chemically synthesized
ccaacatctcatatccctgtcc

SEQ ID NO: 1003156 - DNA, 22 bp, Artificial Sequence
  chemically synthesized
caacatctcatatccctgtccc

SEQ ID NO: 1003157 - DNA, 22 bp, Artificial Sequence
  chemically synthesized
caactttctggggggacaggga

SEQ ID NO: 1003158 - DNA, 22 bp, Artificial Sequence
  chemically synthesized
tgactccaactttctgggggga

SEQ ID NO: 1003159 - DNA, 22 bp, Artificial Sequence
  chemically synthesized
atatccctgtccccccagaaag

SEQ ID NO: 1003160 - DNA, 22 bp, Artificial Sequence
  chemically synthesized
tgtcacctgtgactccaacttt

SEQ ID NO: 1003161 - DNA, 22 bp, Artificial Sequence
  chemically synthesized
tccccccagaaagttggagtca

SEQ ID NO: 1003162 - DNA, 22 bp, Artificial Sequence
  chemically synthesized
ccagctgtgtcacctgtgactc

SEQ ID NO: 1003163 - DNA, 22 bp, Artificial Sequence
  chemically synthesized
cccagctgtgtcacctgtgact

SEQ ID NO: 1003164 - DNA, 22 bp, Artificial Sequence
  chemically synthesized
tcccagctgtgtcacctgtgac

SEQ ID NO: 1003165 - DNA, 22 bp, Artificial Sequence
  chemically synthesized
gagtcacaggtgacacagctgg

SEQ ID NO: 1003166 - DNA, 22 bp, Artificial Sequence
  chemically synthesized
ataaagaaagttttcccagctg

SEQ ID NO: 1003167 - DNA, 22 bp, Artificial Sequence
  chemically synthesized
cataaagaaagttttcccagct

SEQ ID NO: 1003168 - DNA, 22 bp, Artificial Sequence
  chemically synthesized
tcataaagaaagttttcccagc

SEQ ID NO: 1003169 - DNA, 22 bp, Artificial Sequence
  chemically synthesized
ttcataaagaaagttttcccag

SEQ ID NO: 1003170 - DNA, 22 bp, Artificial Sequence
  chemically synthesized
atcttttcataaagaaagtttt

SEQ ID NO: 1003171 - DNA, 22 bp, Artificial Sequence
  chemically synthesized
ggaaaactttctttatgaaaag

SEQ ID NO: 1003172 - DNA, 22 bp, Artificial Sequence
  chemically synthesized
aaacatgtgttaatcttttcat

SEQ ID NO: 1003173 - DNA, 22 bp, Artificial Sequence
  chemically synthesized
aaaacatgtgttaatcttttca

SEQ ID NO: 1003174 - DNA, 22 bp, Artificial Sequence
  chemically synthesized
taaaacatgtgttaatcttttc

SEQ ID NO: 1003175 - DNA, 22 bp, Artificial Sequence
  chemically synthesized
ttaaaacatgtgttaatctttt

SEQ ID NO: 1003176 - DNA, 22 bp, Artificial Sequence
  chemically synthesized
tttaaaacatgtgttaatcttt

SEQ ID NO: 1003177 - DNA, 22 bp, Artificial Sequence
  chemically synthesized
tttttaaaacatgtgttaatct

SEQ ID NO: 1003178 - DNA, 22 bp, Artificial Sequence
  chemically synthesized
tctttatgaaaagattaacaca

SEQ ID NO: 1003179 - DNA, 22 bp, Artificial Sequence
  chemically synthesized
ctttatgaaaagattaacacat

SEQ ID NO: 1003180 - DNA, 22 bp, Artificial Sequence
  chemically synthesized
tttatgaaaagattaacacatg

SEQ ID NO: 1003181 - DNA, 22 bp, Artificial Sequence
  chemically synthesized
tatgaaaagattaacacatgtt

SEQ ID NO: 1003182 - DNA, 22 bp, Artificial Sequence
  chemically synthesized
atgaaaagattaacacatgttt

SEQ ID NO: 1003183 - DNA, 22 bp, Artificial Sequence
  chemically synthesized
tgaaaagattaacacatgtttt

SEQ ID NO: 1003184 - DNA, 22 bp, Artificial Sequence
  chemically synthesized
acatacatatgtatctcttttt

SEQ ID NO: 1003185 - DNA, 22 bp, Artificial Sequence
  chemically synthesized
acacatgttttaaaaagagata

SEQ ID NO: 1003186 - DNA, 22 bp, Artificial Sequence
  chemically synthesized
gacatacatatgtatctctttt

SEQ ID NO: 1003187 - DNA, 22 bp, Artificial Sequence
  chemically synthesized
tgacatacatatgtatctcttt

SEQ ID NO: 1003188 - DNA, 22 bp, Artificial Sequence
  chemically synthesized
taaaaagagatacatatgtatg

SEQ ID NO: 1003189 - DNA, 22 bp, Artificial Sequence
  chemically synthesized
gaataattttgacatacatatg

SEQ ID NO: 1003190 - DNA, 22 bp, Artificial Sequence
  chemically synthesized
aaaaagagatacatatgtatgt

SEQ ID NO: 1003191 - DNA, 22 bp, Artificial Sequence
  chemically synthesized
aaaagagatacatatgtatgtc

SEQ ID NO: 1003192 - DNA, 22 bp, Artificial Sequence
  chemically synthesized
tggaataattttgacatacata

SEQ ID NO: 1003193 - DNA, 22 bp, Artificial Sequence
  chemically synthesized
agaacagtgttctggaataatt

SEQ ID NO: 1003194 - DNA, 22 bp, Artificial Sequence
  chemically synthesized
tgagaacagtgttctggaataa

SEQ ID NO: 1003195 - DNA, 22 bp, Artificial Sequence
  chemically synthesized
ctgagaacagtgttctggaata

SEQ ID NO: 1003196 - DNA, 22 bp, Artificial Sequence
  chemically synthesized
cccttctgagaacagtgttctg

SEQ ID NO: 1003197 - DNA, 22 bp, Artificial Sequence
  chemically synthesized
ctgcccttctgagaacagtgtt

SEQ ID NO: 1003198 - DNA, 22 bp, Artificial Sequence
  chemically synthesized
ttccagaacactgttctcagaa

SEQ ID NO: 1003199 - DNA, 22 bp, Artificial Sequence
  chemically synthesized
cagttactgcccttctgagaac

SEQ ID NO: 1003200 - DNA, 22 bp, Artificial Sequence
  chemically synthesized
cagaacactgttctcagaaggg

SEQ ID NO: 1003201 - DNA, 22 bp, Artificial Sequence
  chemically synthesized
gttgcagttactgcccttctga

SEQ ID NO: 1003202 - DNA, 22 bp, Artificial Sequence
  chemically synthesized
ggttgcagttactgcccttctg

SEQ ID NO: 1003203 - DNA, 22 bp, Artificial Sequence
  chemically synthesized
acttggttgcagttactgccct

SEQ ID NO: 1003204 - DNA, 22 bp, Artificial Sequence
  chemically synthesized
ttctcagaagggcagtaactgc

SEQ ID NO: 1003205 - DNA, 22 bp, Artificial Sequence
  chemically synthesized
tcagaagggcagtaactgcaac

SEQ ID NO: 1003206 - DNA, 22 bp, Artificial Sequence
  chemically synthesized
agaagggcagtaactgcaacca

SEQ ID NO: 1003207 - DNA, 22 bp, Artificial Sequence
  chemically synthesized
aatagcagaaactaacttggtt

SEQ ID NO: 1003208 - DNA, 22 bp, Artificial Sequence
  chemically synthesized
caatagcagaaactaacttggt

SEQ ID NO: 1003209 - DNA, 22 bp, Artificial Sequence
  chemically synthesized
tttcaatagcagaaactaactt

SEQ ID NO: 1003210 - DNA, 22 bp, Artificial Sequence
  chemically synthesized
gtttcaatagcagaaactaact

SEQ ID NO: 1003211 - DNA, 22 bp, Artificial Sequence
  chemically synthesized
tgtttcaatagcagaaactaac

SEQ ID NO: 1003212 - DNA, 22 bp, Artificial Sequence
  chemically synthesized
caaccaagttagtttctgctat

SEQ ID NO: 1003213 - DNA, 22 bp, Artificial Sequence
  chemically synthesized
acattttgtttcaatagcagaa

SEQ ID NO: 1003214 - DNA, 22 bp, Artificial Sequence
  chemically synthesized
cacattttgtttcaatagcaga

SEQ ID NO: 1003215 - DNA, 22 bp, Artificial Sequence
  chemically synthesized
gtttctgctattgaaacaaaat

SEQ ID NO: 1003216 - DNA, 22 bp, Artificial Sequence
  chemically synthesized
cccatgagcttcacattttgtt

SEQ ID NO: 1003217 - DNA, 22 bp, Artificial Sequence
  chemically synthesized
ccccatgagcttcacattttgt

SEQ ID NO: 1003218 - DNA, 22 bp, Artificial Sequence
  chemically synthesized
ctgctattgaaacaaaatgtga

SEQ ID NO: 1003219 - DNA, 22 bp, Artificial Sequence
  chemically synthesized
tgctattgaaacaaaatgtgaa

SEQ ID NO: 1003220 - DNA, 22 bp, Artificial Sequence
  chemically synthesized
ctattgaaacaaaatgtgaagc

SEQ ID NO: 1003221 - DNA, 22 bp, Artificial Sequence
  chemically synthesized
ttgaaacaaaatgtgaagctca

SEQ ID NO: 1003222 - DNA, 22 bp, Artificial Sequence
  chemically synthesized
aaacaaaatgtgaagctcatgg

SEQ ID NO: 1003223 - DNA, 22 bp, Artificial Sequence
  chemically synthesized
tgatgaaatttccccatgagct

SEQ ID NO: 1003224 - DNA, 22 bp, Artificial Sequence
  chemically synthesized
atagacagcatattgtgatgaa

SEQ ID NO: 1003225 - DNA, 22 bp, Artificial Sequence
  chemically synthesized
atggggaaatttcatcacaata

SEQ ID NO: 1003226 - DNA, 22 bp, Artificial Sequence
  chemically synthesized
attcatagacagcatattgtga

SEQ ID NO: 1003227 - DNA, 22 bp, Artificial Sequence
  chemically synthesized
aattcatagacagcatattgtg

SEQ ID NO: 1003228 - DNA, 22 bp, Artificial Sequence
  chemically synthesized
taattcatagacagcatattgt

SEQ ID NO: 1003229 - DNA, 22 bp, Artificial Sequence
  chemically synthesized
ttaattcatagacagcatattg

SEQ ID NO: 1003230 - DNA, 22 bp, Artificial Sequence
  chemically synthesized
catcacaatatgctgtctatga

SEQ ID NO: 1003231 - DNA, 22 bp, Artificial Sequence
  chemically synthesized
atcacaatatgctgtctatgaa

SEQ ID NO: 1003232 - DNA, 22 bp, Artificial Sequence
  chemically synthesized
aatggatttttaattcatagac

SEQ ID NO: 1003233 - DNA, 22 bp, Artificial Sequence
  chemically synthesized
tattaaatggatttttaattca

SEQ ID NO: 1003234 - DNA, 22 bp, Artificial Sequence
  chemically synthesized
atattaaatggatttttaattc

SEQ ID NO: 1003235 - DNA, 22 bp, Artificial Sequence
  chemically synthesized
tatattaaatggatttttaatt

SEQ ID NO: 1003236 - DNA, 22 bp, Artificial Sequence
  chemically synthesized
tctatgaattaaaaatccattt

SEQ ID NO: 1003237 - DNA, 22 bp, Artificial Sequence
  chemically synthesized
gaggctttatattaaatggatt

SEQ ID NO: 1003238 - DNA, 22 bp, Artificial Sequence
  chemically synthesized
ggaggctttatattaaatggat

SEQ ID NO: 1003239 - DNA, 22 bp, Artificial Sequence
  chemically synthesized
tgaattaaaaatccatttaata

SEQ ID NO: 1003240 - DNA, 22 bp, Artificial Sequence
  chemically synthesized
ttggaggctttatattaaatgg

SEQ ID NO: 1003241 - DNA, 22 bp, Artificial Sequence
  chemically synthesized
cttggaggctttatattaaatg

SEQ ID NO: 1003242 - DNA, 22 bp, Artificial Sequence
  chemically synthesized
tttcttggaggctttatattaa

SEQ ID NO: 1003243 - DNA, 22 bp, Artificial Sequence
  chemically synthesized
gtttcttggaggctttatatta

SEQ ID NO: 1003244 - DNA, 22 bp, Artificial Sequence
  chemically synthesized
tgtttcttggaggctttatatt

SEQ ID NO: 1003245 - DNA, 22 bp, Artificial Sequence
  chemically synthesized
aaaatccatttaatataaagcc

SEQ ID NO: 1003246 - DNA, 22 bp, Artificial Sequence
  chemically synthesized
tttgtttcttggaggctttata

SEQ ID NO: 1003247 - DNA, 22 bp, Artificial Sequence
  chemically synthesized
ctttgtttcttggaggctttat

SEQ ID NO: 1003248 - DNA, 22 bp, Artificial Sequence
  chemically synthesized
tctttgtttcttggaggcttta

SEQ ID NO: 1003249 - DNA, 22 bp, Artificial Sequence
  chemically synthesized
aatataaagcctccaagaaaca

SEQ ID NO: 1003250 - DNA, 22 bp, Artificial Sequence
  chemically synthesized
atataaagcctccaagaaacaa

SEQ ID NO: 1003251 - DNA, 22 bp, Artificial Sequence
  chemically synthesized
taaaaataaaaaacaagttttc

SEQ ID NO: 1003252 - DNA, 22 bp, Artificial Sequence
  chemically synthesized
caagaaacaaagaaaacttgtt

SEQ ID NO: 1003253 - DNA, 22 bp, Artificial Sequence
  chemically synthesized
tgtaaaaataaaaaacaagttt

SEQ ID NO: 1003254 - DNA, 22 bp, Artificial Sequence
  chemically synthesized
ctgtaaaaataaaaaacaagtt

SEQ ID NO: 1003255 - DNA, 22 bp, Artificial Sequence
  chemically synthesized
tcttctgtaaaaataaaaaaca

SEQ ID NO: 1003256 - DNA, 22 bp, Artificial Sequence
  chemically synthesized
tacgttgtcttctgtaaaaata

SEQ ID NO: 1003257 - DNA, 22 bp, Artificial Sequence
  chemically synthesized
gttttttatttttacagaagac

SEQ ID NO: 1003258 - DNA, 22 bp, Artificial Sequence
  chemically synthesized
ttttttatttttacagaagaca

SEQ ID NO: 1003259 - DNA, 22 bp, Artificial Sequence
  chemically synthesized
aaaagttgtacgttgtcttctg

SEQ ID NO: 1003260 - DNA, 22 bp, Artificial Sequence
  chemically synthesized
tttatttttacagaagacaacg

SEQ ID NO: 1003261 - DNA, 22 bp, Artificial Sequence
  chemically synthesized
ttatttttacagaagacaacgt

SEQ ID NO: 1003262 - DNA, 22 bp, Artificial Sequence
  chemically synthesized
tatttttacagaagacaacgta

SEQ ID NO: 1003263 - DNA, 22 bp, Artificial Sequence
  chemically synthesized
atttttacagaagacaacgtac

SEQ ID NO: 1003264 - DNA, 22 bp, Artificial Sequence
  chemically synthesized
tttttacagaagacaacgtaca

SEQ ID NO: 1003265 - DNA, 22 bp, Artificial Sequence
  chemically synthesized
ggggttaaaaagttgtacgttg

SEQ ID NO: 1003266 - DNA, 22 bp, Artificial Sequence
  chemically synthesized
ttacagaagacaacgtacaact

SEQ ID NO: 1003267 - DNA, 22 bp, Artificial Sequence
  chemically synthesized
tacagaagacaacgtacaactt

SEQ ID NO: 1003268 - DNA, 22 bp, Artificial Sequence
  chemically synthesized
acagaagacaacgtacaacttt

SEQ ID NO: 1003269 - DNA, 22 bp, Artificial Sequence
  chemically synthesized
cagaagacaacgtacaactttt

SEQ ID NO: 1003270 - DNA, 22 bp, Artificial Sequence
  chemically synthesized
ggttaggggttaaaaagttgta

SEQ ID NO: 1003271 - DNA, 22 bp, Artificial Sequence
  chemically synthesized
aaaaattaggttaggggttaaa

SEQ ID NO: 1003272 - DNA, 22 bp, Artificial Sequence
  chemically synthesized
aaaaaattaggttaggggttaa

SEQ ID NO: 1003273 - DNA, 22 bp, Artificial Sequence
  chemically synthesized
gtttaaaaaattaggttagggg

SEQ ID NO: 1003274 - DNA, 22 bp, Artificial Sequence
  chemically synthesized
ggtttaaaaaattaggttaggg

SEQ ID NO: 1003275 - DNA, 22 bp, Artificial Sequence
  chemically synthesized
tggtttaaaaaattaggttagg

SEQ ID NO: 1003276 - DNA, 22 bp, Artificial Sequence
  chemically synthesized
gttttggtttaaaaaattaggt

SEQ ID NO: 1003277 - DNA, 22 bp, Artificial Sequence
  chemically synthesized
tttaacccctaacctaattttt

SEQ ID NO: 1003278 - DNA, 22 bp, Artificial Sequence
  chemically synthesized
ttaacccctaacctaatttttt

SEQ ID NO: 1003279 - DNA, 22 bp, Artificial Sequence
  chemically synthesized
tggttttggtttaaaaaattag

SEQ ID NO: 1003280 - DNA, 22 bp, Artificial Sequence
  chemically synthesized
taacccctaacctaatttttta

SEQ ID NO: 1003281 - DNA, 22 bp, Artificial Sequence
  chemically synthesized
aacccctaacctaattttttaa

SEQ ID NO: 1003282 - DNA, 22 bp, Artificial Sequence
  chemically synthesized
acccctaacctaattttttaaa

SEQ ID NO: 1003283 - DNA, 22 bp, Artificial Sequence
  chemically synthesized
acctaattttttaaaccaaaac

SEQ ID NO: 1003284 - DNA, 22 bp, Artificial Sequence
  chemically synthesized
attttttaaaccaaaaccagaa

SEQ ID NO: 1003285 - DNA, 22 bp, Artificial Sequence
  chemically synthesized
tttaaaccaaaaccagaattat

SEQ ID NO: 1003286 - DNA, 22 bp, Artificial Sequence
  chemically synthesized
ttaaaccaaaaccagaattatt

SEQ ID NO: 1003287 - DNA, 22 bp, Artificial Sequence
  chemically synthesized
taaaccaaaaccagaattattt

SEQ ID NO: 1003288 - DNA, 22 bp, Artificial Sequence
  chemically synthesized
aaaagaaaaaaaaaataattct

SEQ ID NO: 1003289 - DNA, 22 bp, Artificial Sequence
  chemically synthesized
aaaccaaaaccagaattatttt

SEQ ID NO: 1003290 - DNA, 22 bp, Artificial Sequence
  chemically synthesized
aaccaaaaccagaattattttt

SEQ ID NO: 1003291 - DNA, 22 bp, Artificial Sequence
  chemically synthesized
aaagctaaaaagaaaaaaaaaa

SEQ ID NO: 1003292 - DNA, 22 bp, Artificial Sequence
  chemically synthesized
attgaaagctaaaaagaaaaaa

SEQ ID NO: 1003293 - DNA, 22 bp, Artificial Sequence
  chemically synthesized
cattgaaagctaaaaagaaaaa

SEQ ID NO: 1003294 - DNA, 22 bp, Artificial Sequence
  chemically synthesized
tgcttcattgaaagctaaaaag

SEQ ID NO: 1003295 - DNA, 22 bp, Artificial Sequence
  chemically synthesized
ttttttttttctttttagcttt

SEQ ID NO: 1003296 - DNA, 22 bp, Artificial Sequence
  chemically synthesized
attgtgcttcattgaaagctaa

SEQ ID NO: 1003297 - DNA, 22 bp, Artificial Sequence
  chemically synthesized
tttttttctttttagctttcaa

SEQ ID NO: 1003298 - DNA, 22 bp, Artificial Sequence
  chemically synthesized
gattgtgcttcattgaaagcta

SEQ ID NO: 1003299 - DNA, 22 bp, Artificial Sequence
  chemically synthesized
ttttttctttttagctttcaat

SEQ ID NO: 1003300 - DNA, 22 bp, Artificial Sequence
  chemically synthesized
tttttctttttagctttcaatg

SEQ ID NO: 1003301 - DNA, 22 bp, Artificial Sequence
  chemically synthesized
ttttctttttagctttcaatga

SEQ ID NO: 1003302 - DNA, 22 bp, Artificial Sequence
  chemically synthesized
tttctttttagctttcaatgaa

SEQ ID NO: 1003303 - DNA, 22 bp, Artificial Sequence
  chemically synthesized
ttctttttagctttcaatgaag

SEQ ID NO: 1003304 - DNA, 22 bp, Artificial Sequence
  chemically synthesized
tctttttagctttcaatgaagc

SEQ ID NO: 1003305 - DNA, 22 bp, Artificial Sequence
  chemically synthesized
ctttttagctttcaatgaagca

SEQ ID NO: 1003306 - DNA, 22 bp, Artificial Sequence
  chemically synthesized
tttttagctttcaatgaagcac

SEQ ID NO: 1003307 - DNA, 22 bp, Artificial Sequence
  chemically synthesized
caggaatttgattgtgcttcat

SEQ ID NO: 1003308 - DNA, 22 bp, Artificial Sequence
  chemically synthesized
tttagctttcaatgaagcacaa

SEQ ID NO: 1003309 - DNA, 22 bp, Artificial Sequence
  chemically synthesized
ttagctttcaatgaagcacaat

SEQ ID NO: 1003310 - DNA, 22 bp, Artificial Sequence
  chemically synthesized
tccaggaatttgattgtgcttc

SEQ ID NO: 1003311 - DNA, 22 bp, Artificial Sequence
  chemically synthesized
tagctttcaatgaagcacaatc

SEQ ID NO: 1003312 - DNA, 22 bp, Artificial Sequence
  chemically synthesized
ctccaggaatttgattgtgctt

SEQ ID NO: 1003313 - DNA, 22 bp, Artificial Sequence
  chemically synthesized
agctttcaatgaagcacaatca

SEQ ID NO: 1003314 - DNA, 22 bp, Artificial Sequence
  chemically synthesized
tctccaggaatttgattgtgct

SEQ ID NO: 1003315 - DNA, 22 bp, Artificial Sequence
  chemically synthesized
gctttcaatgaagcacaatcaa

SEQ ID NO: 1003316 - DNA, 22 bp, Artificial Sequence
  chemically synthesized
ttctccaggaatttgattgtgc

SEQ ID NO: 1003317 - DNA, 22 bp, Artificial Sequence
  chemically synthesized
tcaatgaagcacaatcaaattc

SEQ ID NO: 1003318 - DNA, 22 bp, Artificial Sequence
  chemically synthesized
caatgaagcacaatcaaattcc

SEQ ID NO: 1003319 - DNA, 22 bp, Artificial Sequence
  chemically synthesized
aatgaagcacaatcaaattcct

SEQ ID NO: 1003320 - DNA, 22 bp, Artificial Sequence
  chemically synthesized
ccatcttttctccaggaatttg

SEQ ID NO: 1003321 - DNA, 22 bp, Artificial Sequence
  chemically synthesized
cccatcttttctccaggaattt

SEQ ID NO: 1003322 - DNA, 22 bp, Artificial Sequence
  chemically synthesized
tcccatcttttctccaggaatt

SEQ ID NO: 1003323 - DNA, 22 bp, Artificial Sequence
  chemically synthesized
tgccgttttcccatcttttctc

SEQ ID NO: 1003324 - DNA, 22 bp, Artificial Sequence
  chemically synthesized
atgccgttttcccatcttttct

SEQ ID NO: 1003325 - DNA, 22 bp, Artificial Sequence
  chemically synthesized
tatgccgttttcccatcttttc

SEQ ID NO: 1003326 - DNA, 22 bp, Artificial Sequence
  chemically synthesized
ttttatgccgttttcccatctt

SEQ ID NO: 1003327 - DNA, 22 bp, Artificial Sequence
  chemically synthesized
gttttatgccgttttcccatct

SEQ ID NO: 1003328 - DNA, 22 bp, Artificial Sequence
  chemically synthesized
tgttttatgccgttttcccatc

SEQ ID NO: 1003329 - DNA, 22 bp, Artificial Sequence
  chemically synthesized
ctggagaaaagatgggaaaacg

SEQ ID NO: 1003330 - DNA, 22 bp, Artificial Sequence
  chemically synthesized
gagaaaagatgggaaaacggca

SEQ ID NO: 1003331 - DNA, 22 bp, Artificial Sequence
  chemically synthesized
gtgctttgttttatgccgtttt

SEQ ID NO: 1003332 - DNA, 22 bp, Artificial Sequence
  chemically synthesized
aataccgtgttcgtgctttgtt

SEQ ID NO: 1003333 - DNA, 22 bp, Artificial Sequence
  chemically synthesized
aaataccgtgttcgtgctttgt

SEQ ID NO: 1003334 - DNA, 22 bp, Artificial Sequence
  chemically synthesized
gatttaaataccgtgttcgtgc

SEQ ID NO: 1003335 - DNA, 22 bp, Artificial Sequence
  chemically synthesized
ggatttaaataccgtgttcgtg

SEQ ID NO: 1003336 - DNA, 22 bp, Artificial Sequence
  chemically synthesized
tggcaaacttggatttaaatac

SEQ ID NO: 1003337 - DNA, 22 bp, Artificial Sequence
  chemically synthesized
gtggcaaacttggatttaaata

SEQ ID NO: 1003338 - DNA, 22 bp, Artificial Sequence
  chemically synthesized
tgtggcaaacttggatttaaat

SEQ ID NO: 1003339 - DNA, 22 bp, Artificial Sequence
  chemically synthesized
cattttgtggcaaacttggatt

SEQ ID NO: 1003340 - DNA, 22 bp, Artificial Sequence
  chemically synthesized
acattttgtggcaaacttggat

SEQ ID NO: 1003341 - DNA, 22 bp, Artificial Sequence
  chemically synthesized
aaatccaagtttgccacaaaat

SEQ ID NO: 1003342 - DNA, 22 bp, Artificial Sequence
  chemically synthesized
aaatacatttacattttgtggc

SEQ ID NO: 1003343 - DNA, 22 bp, Artificial Sequence
  chemically synthesized
aatccaagtttgccacaaaatg

SEQ ID NO: 1003344 - DNA, 22 bp, Artificial Sequence
  chemically synthesized
ctgaaatacatttacattttgt

SEQ ID NO: 1003345 - DNA, 22 bp, Artificial Sequence
  chemically synthesized
actgaaatacatttacattttg

SEQ ID NO: 1003346 - DNA, 22 bp, Artificial Sequence
  chemically synthesized
gccacaaaatgtaaatgtattt

SEQ ID NO: 1003347 - DNA, 22 bp, Artificial Sequence
  chemically synthesized
ccacaaaatgtaaatgtatttc

SEQ ID NO: 1003348 - DNA, 22 bp, Artificial Sequence
  chemically synthesized
tagaacatttactgaaatacat

SEQ ID NO: 1003349 - DNA, 22 bp, Artificial Sequence
  chemically synthesized
caaatcctatagaacatttact

SEQ ID NO: 1003350 - DNA, 22 bp, Artificial Sequence
  chemically synthesized
acaaatcctatagaacatttac

SEQ ID NO: 1003351 - DNA, 22 bp, Artificial Sequence
  chemically synthesized
tttacaaatcctatagaacatt

SEQ ID NO: 1003352 - DNA, 22 bp, Artificial Sequence
  chemically synthesized
aattgtttacaaatcctataga

SEQ ID NO: 1003353 - DNA, 22 bp, Artificial Sequence
  chemically synthesized
caattgtttacaaatcctatag

SEQ ID NO: 1003354 - DNA, 22 bp, Artificial Sequence
  chemically synthesized
cagtaaatgttctataggattt

SEQ ID NO: 1003355 - DNA, 22 bp, Artificial Sequence
  chemically synthesized
tcaattgtttacaaatcctata

SEQ ID NO: 1003356 - DNA, 22 bp, Artificial Sequence
  chemically synthesized
agtaaatgttctataggatttg

SEQ ID NO: 1003357 - DNA, 22 bp, Artificial Sequence
  chemically synthesized
ttcaattgtttacaaatcctat

SEQ ID NO: 1003358 - DNA, 22 bp, Artificial Sequence
  chemically synthesized
tataggatttgtaaacaattga

SEQ ID NO: 1003359 - DNA, 22 bp, Artificial Sequence
  chemically synthesized
taggatttgtaaacaattgaaa

SEQ ID NO: 1003360 - DNA, 22 bp, Artificial Sequence
  chemically synthesized
taaaagaaataacagcttttca

SEQ ID NO: 1003361 - DNA, 22 bp, Artificial Sequence
  chemically synthesized
gtaaacaattgaaaagctgtta

SEQ ID NO: 1003362 - DNA, 22 bp, Artificial Sequence
  chemically synthesized
taaacaattgaaaagctgttat

SEQ ID NO: 1003363 - DNA, 22 bp, Artificial Sequence
  chemically synthesized
cagttgtaaaagaaataacagc

SEQ ID NO: 1003364 - DNA, 22 bp, Artificial Sequence
  chemically synthesized
tgttgcagttgtaaaagaaata

SEQ ID NO: 1003365 - DNA, 22 bp, Artificial Sequence
  chemically synthesized
aaaagctgttatttcttttaca

SEQ ID NO: 1003366 - DNA, 22 bp, Artificial Sequence
  chemically synthesized
ttatgttgcagttgtaaaagaa

SEQ ID NO: 1003367 - DNA, 22 bp, Artificial Sequence
  chemically synthesized
attatgttgcagttgtaaaaga

SEQ ID NO: 1003368 - DNA, 22 bp, Artificial Sequence
  chemically synthesized
ttatttcttttacaactgcaac

SEQ ID NO: 1003369 - DNA, 22 bp, Artificial Sequence
  chemically synthesized
taatgtttattatgttgcagtt

SEQ ID NO: 1003370 - DNA, 22 bp, Artificial Sequence
  chemically synthesized
tttcttttacaactgcaacata

SEQ ID NO: 1003371 - DNA, 22 bp, Artificial Sequence
  chemically synthesized
ttataatgtttattatgttgca

SEQ ID NO: 1003372 - DNA, 22 bp, Artificial Sequence
  chemically synthesized
cttttacaactgcaacataata

SEQ ID NO: 1003373 - DNA, 22 bp, Artificial Sequence
  chemically synthesized
ttttacaactgcaacataataa

SEQ ID NO: 1003374 - DNA, 22 bp, Artificial Sequence
  chemically synthesized
ttacaactgcaacataataaac

SEQ ID NO: 1003375 - DNA, 22 bp, Artificial Sequence
  chemically synthesized
tacaactgcaacataataaaca

SEQ ID NO: 1003376 - DNA, 22 bp, Artificial Sequence
  chemically synthesized
acaactgcaacataataaacat

SEQ ID NO: 1003377 - DNA, 22 bp, Artificial Sequence
  chemically synthesized
caactgcaacataataaacatt

SEQ ID NO: 1003378 - DNA, 22 bp, Artificial Sequence
  chemically synthesized
caacataataaacattataata

SEQ ID NO: 1003379 - DNA, 22 bp, Artificial Sequence
  chemically synthesized
ccagaaaggtatattattataa

SEQ ID NO: 1003380 - DNA, 22 bp, Artificial Sequence
  chemically synthesized
tatcattaccagaaaggtatat

SEQ ID NO: 1003381 - DNA, 22 bp, Artificial Sequence
  chemically synthesized
tatatcattaccagaaaggtat

SEQ ID NO: 1003382 - DNA, 22 bp, Artificial Sequence
  chemically synthesized
taataatatacctttctggtaa

SEQ ID NO: 1003383 - DNA, 22 bp, Artificial Sequence
  chemically synthesized
tcaccagataaaaaattctata

SEQ ID NO: 1003384 - DNA, 22 bp, Artificial Sequence
  chemically synthesized
tctggtaatgatatagaatttt

SEQ ID NO: 1003385 - DNA, 22 bp, Artificial Sequence
  chemically synthesized
gtcaccagataaaaaattctat

SEQ ID NO: 1003386 - DNA, 22 bp, Artificial Sequence
  chemically synthesized
ctggtaatgatatagaattttt

SEQ ID NO: 1003387 - DNA, 22 bp, Artificial Sequence
  chemically synthesized
tggtaatgatatagaatttttt

SEQ ID NO: 1003388 - DNA, 22 bp, Artificial Sequence
  chemically synthesized
tttgtcaccagataaaaaattc

SEQ ID NO: 1003389 - DNA, 22 bp, Artificial Sequence
  chemically synthesized
gtaatgatatagaattttttat

SEQ ID NO: 1003390 - DNA, 22 bp, Artificial Sequence
  chemically synthesized
gcagaactatttgtcaccagat

SEQ ID NO: 1003391 - DNA, 22 bp, Artificial Sequence
  chemically synthesized
ggcagaactatttgtcaccaga

SEQ ID NO: 1003392 - DNA, 22 bp, Artificial Sequence
  chemically synthesized
tggcagaactatttgtcaccag

SEQ ID NO: 1003393 - DNA, 22 bp, Artificial Sequence
  chemically synthesized
ttggcagaactatttgtcacca

SEQ ID NO: 1003394 - DNA, 22 bp, Artificial Sequence
  chemically synthesized
tcttttggcagaactatttgtc

SEQ ID NO: 1003395 - DNA, 22 bp, Artificial Sequence
  chemically synthesized
tttatctggtgacaaatagttc

SEQ ID NO: 1003396 - DNA, 22 bp, Artificial Sequence
  chemically synthesized
ttatctggtgacaaatagttct

SEQ ID NO: 1003397 - DNA, 22 bp, Artificial Sequence
  chemically synthesized
tatctggtgacaaatagttctg

SEQ ID NO: 1003398 - DNA, 22 bp, Artificial Sequence
  chemically synthesized
tctgtcttttggcagaactatt

SEQ ID NO: 1003399 - DNA, 22 bp, Artificial Sequence
  chemically synthesized
atctggtgacaaatagttctgc

SEQ ID NO: 1003400 - DNA, 22 bp, Artificial Sequence
  chemically synthesized
atctgtcttttggcagaactat

SEQ ID NO: 1003401 - DNA, 22 bp, Artificial Sequence
  chemically synthesized
tctggtgacaaatagttctgcc

SEQ ID NO: 1003402 - DNA, 22 bp, Artificial Sequence
  chemically synthesized
tatctgtcttttggcagaacta

SEQ ID NO: 1003403 - DNA, 22 bp, Artificial Sequence
  chemically synthesized
ctttatctgtcttttggcagaa

SEQ ID NO: 1003404 - DNA, 22 bp, Artificial Sequence
  chemically synthesized
gtgacaaatagttctgccaaaa

SEQ ID NO: 1003405 - DNA, 22 bp, Artificial Sequence
  chemically synthesized
actttatctgtcttttggcaga

SEQ ID NO: 1003406 - DNA, 22 bp, Artificial Sequence
  chemically synthesized
atttactttatctgtcttttgg

SEQ ID NO: 1003407 - DNA, 22 bp, Artificial Sequence
  chemically synthesized
gatttactttatctgtcttttg

SEQ ID NO: 1003408 - DNA, 22 bp, Artificial Sequence
  chemically synthesized
catttgatttactttatctgtc

SEQ ID NO: 1003409 - DNA, 22 bp, Artificial Sequence
  chemically synthesized
tgccaaaagacagataaagtaa

SEQ ID NO: 1003410 - DNA, 22 bp, Artificial Sequence
  chemically synthesized
ccaaaagacagataaagtaaat

SEQ ID NO: 1003411 - DNA, 22 bp, Artificial Sequence
  chemically synthesized
cgcctgcatttgatttacttta

SEQ ID NO: 1003412 - DNA, 22 bp, Artificial Sequence
  chemically synthesized
cataatatagatgttacgcctg

SEQ ID NO: 1003413 - DNA, 22 bp, Artificial Sequence
  chemically synthesized
cacacatctacataatatagat

SEQ ID NO: 1003414 - DNA, 22 bp, Artificial Sequence
  chemically synthesized
gtaataactacacacatctaca

SEQ ID NO: 1003415 - DNA, 22 bp, Artificial Sequence
  chemically synthesized
cactagtaataactacacacat

SEQ ID NO: 1003416 - DNA, 22 bp, Artificial Sequence
  chemically synthesized
tattatgtagatgtgtgtagtt

SEQ ID NO: 1003417 - DNA, 22 bp, Artificial Sequence
  chemically synthesized
atctccactagtaataactaca

SEQ ID NO: 1003418 - DNA, 22 bp, Artificial Sequence
  chemically synthesized
tgtagatgtgtgtagttattac

SEQ ID NO: 1003419 - DNA, 22 bp, Artificial Sequence
  chemically synthesized
ttactagtggagattaatatga

SEQ ID NO: 1003420 - DNA, 22 bp, Artificial Sequence
  chemically synthesized
taagcataataaatcatattaa

SEQ ID NO: 1003421 - DNA, 22 bp, Artificial Sequence
  chemically synthesized
ctagtggagattaatatgattt

SEQ ID NO: 1003422 - DNA, 22 bp, Artificial Sequence
  chemically synthesized
gtggagattaatatgatttatt

SEQ ID NO: 1003423 - DNA, 22 bp, Artificial Sequence
  chemically synthesized
atatgatttattatgcttatag

SEQ ID NO: 1003424 - DNA, 22 bp, Artificial Sequence
  chemically synthesized
taaaggtcaaacaaatgaccta

SEQ ID NO: 1003425 - DNA, 22 bp, Artificial Sequence
  chemically synthesized
attatgcttataggtcatttgt

SEQ ID NO: 1003426 - DNA, 22 bp, Artificial Sequence
  chemically synthesized
ttatgcttataggtcatttgtt

SEQ ID NO: 1003427 - DNA, 22 bp, Artificial Sequence
  chemically synthesized
ctataaaggtcaaacaaatgac

SEQ ID NO: 1003428 - DNA, 22 bp, Artificial Sequence
  chemically synthesized
actataaaggtcaaacaaatga

SEQ ID NO: 1003429 - DNA, 22 bp, Artificial Sequence
  chemically synthesized
tactataaaggtcaaacaaatg

SEQ ID NO: 1003430 - DNA, 22 bp, Artificial Sequence
  chemically synthesized
tgcttataggtcatttgtttga

SEQ ID NO: 1003431 - DNA, 22 bp, Artificial Sequence
  chemically synthesized
ataggtcatttgtttgaccttt

SEQ ID NO: 1003432 - DNA, 22 bp, Artificial Sequence
  chemically synthesized
taggtcatttgtttgaccttta

SEQ ID NO: 1003433 - DNA, 22 bp, Artificial Sequence
  chemically synthesized
gtttgacctttatagtaaaatg

SEQ ID NO: 1003434 - DNA, 22 bp, Artificial Sequence
  chemically synthesized
tttgacctttatagtaaaatgc

SEQ ID NO: 1003435 - DNA, 22 bp, Artificial Sequence
  chemically synthesized
gacctttatagtaaaatgccat

SEQ ID NO: 1003436 - DNA, 22 bp, Artificial Sequence
  chemically synthesized
acctttatagtaaaatgccatt

SEQ ID NO: 1003437 - DNA, 22 bp, Artificial Sequence
  chemically synthesized
tatagtaaaatgccatttcata

SEQ ID NO: 1003438 - DNA, 22 bp, Artificial Sequence
  chemically synthesized
atagtaaaatgccatttcatat

SEQ ID NO: 1003439 - DNA, 22 bp, Artificial Sequence
  chemically synthesized
tagtaaaatgccatttcatatc

SEQ ID NO: 1003440 - DNA, 22 bp, Artificial Sequence
  chemically synthesized
ataataacaatatgtaagaagg

SEQ ID NO: 1003441 - DNA, 22 bp, Artificial Sequence
  chemically synthesized
catatccttcttacatattgtt

SEQ ID NO: 1003442 - DNA, 22 bp, Artificial Sequence
  chemically synthesized
atatccttcttacatattgtta

SEQ ID NO: 1003443 - DNA, 22 bp, Artificial Sequence
  chemically synthesized
atggaggttaataataacaata

SEQ ID NO: 1003444 - DNA, 22 bp, Artificial Sequence
  chemically synthesized
cttacatattgttattattaac

SEQ ID NO: 1003445 - DNA, 22 bp, Artificial Sequence
  chemically synthesized
ttacatattgttattattaacc

SEQ ID NO: 1003446 - DNA, 22 bp, Artificial Sequence
  chemically synthesized
acatattgttattattaacctc

SEQ ID NO: 1003447 - DNA, 22 bp, Artificial Sequence
  chemically synthesized
catattgttattattaacctcc

SEQ ID NO: 1003448 - DNA, 22 bp, Artificial Sequence
  chemically synthesized
caaaaatatatgactaatggag

SEQ ID NO: 1003449 - DNA, 22 bp, Artificial Sequence
  chemically synthesized
ttattattaacctccattagtc

SEQ ID NO: 1003450 - DNA, 22 bp, Artificial Sequence
  chemically synthesized
acaaaaatatatgactaatgga

SEQ ID NO: 1003451 - DNA, 22 bp, Artificial Sequence
  chemically synthesized
ttattaacctccattagtcata

SEQ ID NO: 1003452 - DNA, 22 bp, Artificial Sequence
  chemically synthesized
ttaacctccattagtcatatat

SEQ ID NO: 1003453 - DNA, 22 bp, Artificial Sequence
  chemically synthesized
acctccattagtcatatatttt

SEQ ID NO: 1003454 - DNA, 22 bp, Artificial Sequence
  chemically synthesized
gagaaggtatttacaaaaatat

SEQ ID NO: 1003455 - DNA, 22 bp, Artificial Sequence
  chemically synthesized
agagaaggtatttacaaaaata

SEQ ID NO: 1003456 - DNA, 22 bp, Artificial Sequence
  chemically synthesized
cattagtcatatatttttgtaa

SEQ ID NO: 1003457 - DNA, 22 bp, Artificial Sequence
  chemically synthesized
gtcatatatttttgtaaatacc

SEQ ID NO: 1003458 - DNA, 22 bp, Artificial Sequence
  chemically synthesized
ttgtaaataccttctctaaatc

SEQ ID NO: 1003459 - DNA, 22 bp, Artificial Sequence
  chemically synthesized
aaatatataatggatttagaga

SEQ ID NO: 1003460 - DNA, 22 bp, Artificial Sequence
  chemically synthesized
tgtaaataccttctctaaatcc

SEQ ID NO: 1003461 - DNA, 22 bp, Artificial Sequence
  chemically synthesized
aaaatatataatggatttagag

SEQ ID NO: 1003462 - DNA, 22 bp, Artificial Sequence
  chemically synthesized
gtaaataccttctctaaatcca

SEQ ID NO: 1003463 - DNA, 22 bp, Artificial Sequence
  chemically synthesized
taaaatatataatggatttaga

SEQ ID NO: 1003464 - DNA, 22 bp, Artificial Sequence
  chemically synthesized
taaataccttctctaaatccat

SEQ ID NO: 1003465 - DNA, 22 bp, Artificial Sequence
  chemically synthesized
ctctaaatccattatatatttt

SEQ ID NO: 1003466 - DNA, 22 bp, Artificial Sequence
  chemically synthesized
tctaaatccattatatatttta

SEQ ID NO: 1003467 - DNA, 22 bp, Artificial Sequence
  chemically synthesized
taaatccattatatattttaaa

SEQ ID NO: 1003468 - DNA, 22 bp, Artificial Sequence
  chemically synthesized
aatccattatatattttaaaac

SEQ ID NO: 1003469 - DNA, 22 bp, Artificial Sequence
  chemically synthesized
tatattttaaaacttggtttat

SEQ ID NO: 1003470 - DNA, 22 bp, Artificial Sequence
  chemically synthesized
catagagcaaaataaatcataa

SEQ ID NO: 1003471 - DNA, 22 bp, Artificial Sequence
  chemically synthesized
taaaacttggtttatgatttat

SEQ ID NO: 1003472 - DNA, 22 bp, Artificial Sequence
  chemically synthesized
ccatagagcaaaataaatcata

SEQ ID NO: 1003473 - DNA, 22 bp, Artificial Sequence
  chemically synthesized
aaaacttggtttatgatttatt

SEQ ID NO: 1003474 - DNA, 22 bp, Artificial Sequence
  chemically synthesized
aaacttggtttatgatttattt

SEQ ID NO: 1003475 - DNA, 22 bp, Artificial Sequence
  chemically synthesized
aagcttccatagagcaaaataa

SEQ ID NO: 1003476 - DNA, 22 bp, Artificial Sequence
  chemically synthesized
aaagcttccatagagcaaaata

SEQ ID NO: 1003477 - DNA, 22 bp, Artificial Sequence
  chemically synthesized
ggtttatgatttattttgctct

SEQ ID NO: 1003478 - DNA, 22 bp, Artificial Sequence
  chemically synthesized
gtttatgatttattttgctcta

SEQ ID NO: 1003479 - DNA, 22 bp, Artificial Sequence
  chemically synthesized
atgatttattttgctctatgga

SEQ ID NO: 1003480 - DNA, 22 bp, Artificial Sequence
  chemically synthesized
tgatttattttgctctatggaa

SEQ ID NO: 1003481 - DNA, 22 bp, Artificial Sequence
  chemically synthesized
atagtttaaagcttccatagag

SEQ ID NO: 1003482 - DNA, 22 bp, Artificial Sequence
  chemically synthesized
actgatagtttaaagcttccat

SEQ ID NO: 1003483 - DNA, 22 bp, Artificial Sequence
  chemically synthesized
attttgctctatggaagcttta

SEQ ID NO: 1003484 - DNA, 22 bp, Artificial Sequence
  chemically synthesized
ttttgctctatggaagctttaa

SEQ ID NO: 1003485 - DNA, 22 bp, Artificial Sequence
  chemically synthesized
aattaactgatagtttaaagct

SEQ ID NO: 1003486 - DNA, 22 bp, Artificial Sequence
  chemically synthesized
tgctctatggaagctttaaact

SEQ ID NO: 1003487 - DNA, 22 bp, Artificial Sequence
  chemically synthesized
gctctatggaagctttaaacta

SEQ ID NO: 1003488 - DNA, 22 bp, Artificial Sequence
  chemically synthesized
ctctatggaagctttaaactat

SEQ ID NO: 1003489 - DNA, 22 bp, Artificial Sequence
  chemically synthesized
tatggaagctttaaactatcag

SEQ ID NO: 1003490 - DNA, 22 bp, Artificial Sequence
  chemically synthesized
tggaagctttaaactatcagtt

SEQ ID NO: 1003491 - DNA, 22 bp, Artificial Sequence
  chemically synthesized
gcagactgaattaactgatagt

SEQ ID NO: 1003492 - DNA, 22 bp, Artificial Sequence
  chemically synthesized
taaactatcagttaattcagtc

SEQ ID NO: 1003493 - DNA, 22 bp, Artificial Sequence
  chemically synthesized
aaactatcagttaattcagtct

SEQ ID NO: 1003494 - DNA, 22 bp, Artificial Sequence
  chemically synthesized
aactatcagttaattcagtctg

SEQ ID NO: 1003495 - DNA, 22 bp, Artificial Sequence
  chemically synthesized
aaacataaaattggcagactga

SEQ ID NO: 1003496 - DNA, 22 bp, Artificial Sequence
  chemically synthesized
aaaacataaaattggcagactg

SEQ ID NO: 1003497 - DNA, 22 bp, Artificial Sequence
  chemically synthesized
tcagttaattcagtctgccaat

SEQ ID NO: 1003498 - DNA, 22 bp, Artificial Sequence
  chemically synthesized
gaagacttaaaacataaaattg

SEQ ID NO: 1003499 - DNA, 22 bp, Artificial Sequence
  chemically synthesized
attcagtctgccaattttatgt

SEQ ID NO: 1003500 - DNA, 22 bp, Artificial Sequence
  chemically synthesized
agtctgccaattttatgtttta

SEQ ID NO: 1003501 - DNA, 22 bp, Artificial Sequence
  chemically synthesized
ccaattttatgttttaagtctt

SEQ ID NO: 1003502 - DNA, 22 bp, Artificial Sequence
  chemically synthesized
gtaagtcaggaagcctggaaga

SEQ ID NO: 1003503 - DNA, 22 bp, Artificial Sequence
  chemically synthesized
tatgttttaagtcttccaggct

SEQ ID NO: 1003504 - DNA, 22 bp, Artificial Sequence
  chemically synthesized
ggtaagtcaggaagcctggaag

SEQ ID NO: 1003505 - DNA, 22 bp, Artificial Sequence
  chemically synthesized
atgttttaagtcttccaggctt

SEQ ID NO: 1003506 - DNA, 22 bp, Artificial Sequence
  chemically synthesized
tggtaagtcaggaagcctggaa

SEQ ID NO: 1003507 - DNA, 22 bp, Artificial Sequence
  chemically synthesized
tgttttaagtcttccaggcttc

SEQ ID NO: 1003508 - DNA, 22 bp, Artificial Sequence
  chemically synthesized
ttggtaagtcaggaagcctgga

SEQ ID NO: 1003509 - DNA, 22 bp, Artificial Sequence
  chemically synthesized
taagtcttccaggcttcctgac

SEQ ID NO: 1003510 - DNA, 22 bp, Artificial Sequence
  chemically synthesized
aagtcttccaggcttcctgact

SEQ ID NO: 1003511 - DNA, 22 bp, Artificial Sequence
  chemically synthesized
agtcttccaggcttcctgactt

SEQ ID NO: 1003512 - DNA, 22 bp, Artificial Sequence
  chemically synthesized
ccaggcttcctgacttaccaaa

SEQ ID NO: 1003513 - DNA, 22 bp, Artificial Sequence
  chemically synthesized
caggcttcctgacttaccaaaa

SEQ ID NO: 1003514 - DNA, 22 bp, Artificial Sequence
  chemically synthesized
atgggagacagatttttggtaa

SEQ ID NO: 1003515 - DNA, 22 bp, Artificial Sequence
  chemically synthesized
catgggagacagatttttggta

SEQ ID NO: 1003516 - DNA, 22 bp, Artificial Sequence
  chemically synthesized
cctgacttaccaaaaatctgtc

SEQ ID NO: 1003517 - DNA, 22 bp, Artificial Sequence
  chemically synthesized
ctgacttaccaaaaatctgtct

SEQ ID NO: 1003518 - DNA, 22 bp, Artificial Sequence
  chemically synthesized
taagcttcatgggagacagatt

SEQ ID NO: 1003519 - DNA, 22 bp, Artificial Sequence
  chemically synthesized
ataagcttcatgggagacagat

SEQ ID NO: 1003520 - DNA, 22 bp, Artificial Sequence
  chemically synthesized
acttaccaaaaatctgtctccc

SEQ ID NO: 1003521 - DNA, 22 bp, Artificial Sequence
  chemically synthesized
tataagcttcatgggagacaga

SEQ ID NO: 1003522 - DNA, 22 bp, Artificial Sequence
  chemically synthesized
accaaaaatctgtctcccatga

SEQ ID NO: 1003523 - DNA, 22 bp, Artificial Sequence
  chemically synthesized
ccaaaaatctgtctcccatgaa

SEQ ID NO: 1003524 - DNA, 22 bp, Artificial Sequence
  chemically synthesized
tctcccatgaagcttataaagt

SEQ ID NO: 1003525 - DNA, 22 bp, Artificial Sequence
  chemically synthesized
ccatgaagcttataaagtccta

SEQ ID NO: 1003526 - DNA, 22 bp, Artificial Sequence
  chemically synthesized
atataaacaataaaggaaagtg

SEQ ID NO: 1003527 - DNA, 22 bp, Artificial Sequence
  chemically synthesized
ataaagtcctacactttccttt

SEQ ID NO: 1003528 - DNA, 22 bp, Artificial Sequence
  chemically synthesized
taaagtcctacactttccttta

SEQ ID NO: 1003529 - DNA, 22 bp, Artificial Sequence
  chemically synthesized
cactttcctttattgtttatat

SEQ ID NO: 1003530 - DNA, 22 bp, Artificial Sequence
  chemically synthesized
gaaatataaattcatataaaca

SEQ ID NO: 1003531 - DNA, 22 bp, Artificial Sequence
  chemically synthesized
tcctttattgtttatatgaatt

SEQ ID NO: 1003532 - DNA, 22 bp, Artificial Sequence
  chemically synthesized
actagaaatataaattcatata

SEQ ID NO: 1003533 - DNA, 22 bp, Artificial Sequence
  chemically synthesized
cctttattgtttatatgaattt

SEQ ID NO: 1003534 - DNA, 22 bp, Artificial Sequence
  chemically synthesized
ctttattgtttatatgaattta

SEQ ID NO: 1003535 - DNA, 22 bp, Artificial Sequence
  chemically synthesized
tattgtttatatgaatttatat

SEQ ID NO: 1003536 - DNA, 22 bp, Artificial Sequence
  chemically synthesized
attgtttatatgaatttatatt

SEQ ID NO: 1003537 - DNA, 22 bp, Artificial Sequence
  chemically synthesized
ttgtttatatgaatttatattt

SEQ ID NO: 1003538 - DNA, 22 bp, Artificial Sequence
  chemically synthesized
aggagctaactagaaatataaa

SEQ ID NO: 1003539 - DNA, 22 bp, Artificial Sequence
  chemically synthesized
tttatatgaatttatatttcta

SEQ ID NO: 1003540 - DNA, 22 bp, Artificial Sequence
  chemically synthesized
atatgaatttatatttctagtt

SEQ ID NO: 1003541 - DNA, 22 bp, Artificial Sequence
  chemically synthesized
gattaaggagctaactagaaat

SEQ ID NO: 1003542 - DNA, 22 bp, Artificial Sequence
  chemically synthesized
tatgaatttatatttctagtta

SEQ ID NO: 1003543 - DNA, 22 bp, Artificial Sequence
  chemically synthesized
ctagattaaggagctaactaga

SEQ ID NO: 1003544 - DNA, 22 bp, Artificial Sequence
  chemically synthesized
atatttctagttagctccttaa

SEQ ID NO: 1003545 - DNA, 22 bp, Artificial Sequence
  chemically synthesized
tatttctagttagctccttaat

SEQ ID NO: 1003546 - DNA, 22 bp, Artificial Sequence
  chemically synthesized
ctagttagctccttaatctagt

SEQ ID NO: 1003547 - DNA, 22 bp, Artificial Sequence
  chemically synthesized
tagttagctccttaatctagta

SEQ ID NO: 1003548 - DNA, 22 bp, Artificial Sequence
  chemically synthesized
gttagctccttaatctagtagg

SEQ ID NO: 1003549 - DNA, 22 bp, Artificial Sequence
  chemically synthesized
gctccttaatctagtagggcgt

SEQ ID NO: 1003550 - DNA, 22 bp, Artificial Sequence
  chemically synthesized
tagaccaaaaaaacgccctact

SEQ ID NO: 1003551 - DNA, 22 bp, Artificial Sequence
  chemically synthesized
cttaatctagtagggcgttttt

SEQ ID NO: 1003552 - DNA, 22 bp, Artificial Sequence
  chemically synthesized
actatagaccaaaaaaacgccc

SEQ ID NO: 1003553 - DNA, 22 bp, Artificial Sequence
  chemically synthesized
aactatagaccaaaaaaacgcc

SEQ ID NO: 1003554 - DNA, 22 bp, Artificial Sequence
  chemically synthesized
aatctagtagggcgtttttttg

SEQ ID NO: 1003555 - DNA, 22 bp, Artificial Sequence
  chemically synthesized
atctagtagggcgtttttttgg

SEQ ID NO: 1003556 - DNA, 22 bp, Artificial Sequence
  chemically synthesized
taagtttaactatagaccaaaa

SEQ ID NO: 1003557 - DNA, 22 bp, Artificial Sequence
  chemically synthesized
gtagggcgtttttttggtctat

SEQ ID NO: 1003558 - DNA, 22 bp, Artificial Sequence
  chemically synthesized
atgtacctataagtttaactat

SEQ ID NO: 1003559 - DNA, 22 bp, Artificial Sequence
  chemically synthesized
ttttggtctatagttaaactta

SEQ ID NO: 1003560 - DNA, 22 bp, Artificial Sequence
  chemically synthesized
ttcatgtacctataagtttaac

SEQ ID NO: 1003561 - DNA, 22 bp, Artificial Sequence
  chemically synthesized
tttggtctatagttaaacttat

SEQ ID NO: 1003562 - DNA, 22 bp, Artificial Sequence
  chemically synthesized
ttggtctatagttaaacttata

SEQ ID NO: 1003563 - DNA, 22 bp, Artificial Sequence
  chemically synthesized
tggtctatagttaaacttatag

SEQ ID NO: 1003564 - DNA, 22 bp, Artificial Sequence
  chemically synthesized
ggtctatagttaaacttatagg

SEQ ID NO: 1003565 - DNA, 22 bp, Artificial Sequence
  chemically synthesized
actattcatgtacctataagtt

SEQ ID NO: 1003566 - DNA, 22 bp, Artificial Sequence
  chemically synthesized
gtctatagttaaacttataggt

SEQ ID NO: 1003567 - DNA, 22 bp, Artificial Sequence
  chemically synthesized
tagttaaacttataggtacatg

SEQ ID NO: 1003568 - DNA, 22 bp, Artificial Sequence
  chemically synthesized
gtaattgactattcatgtacct

SEQ ID NO: 1003569 - DNA, 22 bp, Artificial Sequence
  chemically synthesized
aacttataggtacatgaatagt

SEQ ID NO: 1003570 - DNA, 22 bp, Artificial Sequence
  chemically synthesized
ataggtacatgaatagtcaatt

SEQ ID NO: 1003571 - DNA, 22 bp, Artificial Sequence
  chemically synthesized
taggtacatgaatagtcaatta

SEQ ID NO: 1003572 - DNA, 22 bp, Artificial Sequence
  chemically synthesized
ataaatagtgtctcgtaattga

SEQ ID NO: 1003573 - DNA, 22 bp, Artificial Sequence
  chemically synthesized
aataaatagtgtctcgtaattg

SEQ ID NO: 1003574 - DNA, 22 bp, Artificial Sequence
  chemically synthesized
acttaataaatagtgtctcgta

SEQ ID NO: 1003575 - DNA, 22 bp, Artificial Sequence
  chemically synthesized
cacttaataaatagtgtctcgt

SEQ ID NO: 1003576 - DNA, 22 bp, Artificial Sequence
  chemically synthesized
tttcacttaataaatagtgtct

SEQ ID NO: 1003577 - DNA, 22 bp, Artificial Sequence
  chemically synthesized
cgagacactatttattaagtga

SEQ ID NO: 1003578 - DNA, 22 bp, Artificial Sequence
  chemically synthesized
tgtggatagcctatttcactta

SEQ ID NO: 1003579 - DNA, 22 bp, Artificial Sequence
  chemically synthesized
tgtgtggatagcctatttcact

SEQ ID NO: 1003580 - DNA, 22 bp, Artificial Sequence
  chemically synthesized
gttctgtgtggatagcctattt

SEQ ID NO: 1003581 - DNA, 22 bp, Artificial Sequence
  chemically synthesized
tttattaagtgaaataggctat

SEQ ID NO: 1003582 - DNA, 22 bp, Artificial Sequence
  chemically synthesized
agttctgtgtggatagcctatt

SEQ ID NO: 1003583 - DNA, 22 bp, Artificial Sequence
  chemically synthesized
tagttctgtgtggatagcctat

SEQ ID NO: 1003584 - DNA, 22 bp, Artificial Sequence
  chemically synthesized
attaagtgaaataggctatcca

SEQ ID NO: 1003585 - DNA, 22 bp, Artificial Sequence
  chemically synthesized
ttaagtgaaataggctatccac

SEQ ID NO: 1003586 - DNA, 22 bp, Artificial Sequence
  chemically synthesized
agtgaaataggctatccacaca

SEQ ID NO: 1003587 - DNA, 22 bp, Artificial Sequence
  chemically synthesized
gatattttagttctgtgtggat

SEQ ID NO: 1003588 - DNA, 22 bp, Artificial Sequence
  chemically synthesized
tccacacagaactaaaatatcc

SEQ ID NO: 1003589 - DNA, 22 bp, Artificial Sequence
  chemically synthesized
aaatatccaatcttatttggat

SEQ ID NO: 1003590 - DNA, 22 bp, Artificial Sequence
  chemically synthesized
caagtgagagtccaggaaaaca

SEQ ID NO: 1003591 - DNA, 22 bp, Artificial Sequence
  chemically synthesized
acaagtgagagtccaggaaaac

SEQ ID NO: 1003592 - DNA, 22 bp, Artificial Sequence
  chemically synthesized
atttggatgttttcctggactc

SEQ ID NO: 1003593 - DNA, 22 bp, Artificial Sequence
  chemically synthesized
tttggatgttttcctggactct

SEQ ID NO: 1003594 - DNA, 22 bp, Artificial Sequence
  chemically synthesized
gtggtttacaagtgagagtcca

SEQ ID NO: 1003595 - DNA, 22 bp, Artificial Sequence
  chemically synthesized
ggatgttttcctggactctcac

SEQ ID NO: 1003596 - DNA, 22 bp, Artificial Sequence
  chemically synthesized
gatgttttcctggactctcact

SEQ ID NO: 1003597 - DNA, 22 bp, Artificial Sequence
  chemically synthesized
tcctggactctcacttgtaaac

SEQ ID NO: 1003598 - DNA, 22 bp, Artificial Sequence
  chemically synthesized
cctggactctcacttgtaaacc

SEQ ID NO: 1003599 - DNA, 22 bp, Artificial Sequence
  chemically synthesized
ctggactctcacttgtaaacca

SEQ ID NO: 1003600 - DNA, 22 bp, Artificial Sequence
  chemically synthesized
gagaaatgggttagtggtttac

SEQ ID NO: 1003601 - DNA, 22 bp, Artificial Sequence
  chemically synthesized
gactctcacttgtaaaccacta

SEQ ID NO: 1003602 - DNA, 22 bp, Artificial Sequence
  chemically synthesized
tcacttgtaaaccactaaccca

SEQ ID NO: 1003603 - DNA, 22 bp, Artificial Sequence
  chemically synthesized
acttgtaaaccactaacccatt

SEQ ID NO: 1003604 - DNA, 22 bp, Artificial Sequence
  chemically synthesized
gcataaggctagagaaatgggt

SEQ ID NO: 1003605 - DNA, 22 bp, Artificial Sequence
  chemically synthesized
gtaaaccactaacccatttctc

SEQ ID NO: 1003606 - DNA, 22 bp, Artificial Sequence
  chemically synthesized
taaaccactaacccatttctct

SEQ ID NO: 1003607 - DNA, 22 bp, Artificial Sequence
  chemically synthesized
acccatttctctagccttatgc

SEQ ID NO: 1003608 - DNA, 22 bp, Artificial Sequence
  chemically synthesized
ctctagccttatgccagcacac

SEQ ID NO: 1003609 - DNA, 22 bp, Artificial Sequence
  chemically synthesized
tctagccttatgccagcacact

SEQ ID NO: 1003610 - DNA, 22 bp, Artificial Sequence
  chemically synthesized
tgatcaaaaccacagtgtgctg

SEQ ID NO: 1003611 - DNA, 22 bp, Artificial Sequence
  chemically synthesized
tagccttatgccagcacactgt

SEQ ID NO: 1003612 - DNA, 22 bp, Artificial Sequence
  chemically synthesized
gccttatgccagcacactgtgg

SEQ ID NO: 1003613 - DNA, 22 bp, Artificial Sequence
  chemically synthesized
atgccagcacactgtggttttg

SEQ ID NO: 1003614 - DNA, 22 bp, Artificial Sequence
  chemically synthesized
tgccagcacactgtggttttga

SEQ ID NO: 1003615 - DNA, 22 bp, Artificial Sequence
  chemically synthesized
aagtaattgtgatcaaaaccac

SEQ ID NO: 1003616 - DNA, 22 bp, Artificial Sequence
  chemically synthesized
gaagtaattgtgatcaaaacca

SEQ ID NO: 1003617 - DNA, 22 bp, Artificial Sequence
  chemically synthesized
tgaagtaattgtgatcaaaacc

SEQ ID NO: 1003618 - DNA, 22 bp, Artificial Sequence
  chemically synthesized
tactttgaagtaattgtgatca

SEQ ID NO: 1003619 - DNA, 22 bp, Artificial Sequence
  chemically synthesized
ctatactttgaagtaattgtga

SEQ ID NO: 1003620 - DNA, 22 bp, Artificial Sequence
  chemically synthesized
tactatactttgaagtaattgt

SEQ ID NO: 1003621 - DNA, 22 bp, Artificial Sequence
  chemically synthesized
tggttttgatcacaattacttc

SEQ ID NO: 1003622 - DNA, 22 bp, Artificial Sequence
  chemically synthesized
ctactatactttgaagtaattg

SEQ ID NO: 1003623 - DNA, 22 bp, Artificial Sequence
  chemically synthesized
tgatcacaattacttcaaagta

SEQ ID NO: 1003624 - DNA, 22 bp, Artificial Sequence
  chemically synthesized
gatcacaattacttcaaagtat

SEQ ID NO: 1003625 - DNA, 22 bp, Artificial Sequence
  chemically synthesized
cagatttctactatactttgaa

SEQ ID NO: 1003626 - DNA, 22 bp, Artificial Sequence
  chemically synthesized
atcacaattacttcaaagtata

SEQ ID NO: 1003627 - DNA, 22 bp, Artificial Sequence
  chemically synthesized
ccagatttctactatactttga

SEQ ID NO: 1003628 - DNA, 22 bp, Artificial Sequence
  chemically synthesized
cttcaaagtatagtagaaatct

SEQ ID NO: 1003629 - DNA, 22 bp, Artificial Sequence
  chemically synthesized
caaagtatagtagaaatctgga

SEQ ID NO: 1003630 - DNA, 22 bp, Artificial Sequence
  chemically synthesized
aaagtatagtagaaatctggaa

SEQ ID NO: 1003631 - DNA, 22 bp, Artificial Sequence
  chemically synthesized
tggcagcaacatacacttccag

SEQ ID NO: 1003632 - DNA, 22 bp, Artificial Sequence
  chemically synthesized
ataagcatattatggcagcaac

SEQ ID NO: 1003633 - DNA, 22 bp, Artificial Sequence
  chemically synthesized
gaagtgtatgttgctgccataa

SEQ ID NO: 1003634 - DNA, 22 bp, Artificial Sequence
  chemically synthesized
ttaataagcatattatggcagc

SEQ ID NO: 1003635 - DNA, 22 bp, Artificial Sequence
  chemically synthesized
attaataagcatattatggcag

SEQ ID NO: 1003636 - DNA, 22 bp, Artificial Sequence
  chemically synthesized
tattaataagcatattatggca

SEQ ID NO: 1003637 - DNA, 22 bp, Artificial Sequence
  chemically synthesized
gaaacaattttattaataagca

SEQ ID NO: 1003638 - DNA, 22 bp, Artificial Sequence
  chemically synthesized
ctgccataatatgcttattaat

SEQ ID NO: 1003639 - DNA, 22 bp, Artificial Sequence
  chemically synthesized
ccataatatgcttattaataaa

SEQ ID NO: 1003640 - DNA, 22 bp, Artificial Sequence
  chemically synthesized
attaataaaattgtttccaatt

SEQ ID NO: 1003641 - DNA, 22 bp, Artificial Sequence
  chemically synthesized
ttaataaaattgtttccaattt

SEQ ID NO: 1003642 - DNA, 22 bp, Artificial Sequence
  chemically synthesized
ataaaattgtttccaatttata

SEQ ID NO: 1003643 - DNA, 22 bp, Artificial Sequence
  chemically synthesized
tgtgcgtgtatgtgtgtgtata

SEQ ID NO: 1003644 - DNA, 22 bp, Artificial Sequence
  chemically synthesized
tttccaatttatacacacacat

SEQ ID NO: 1003645 - DNA, 22 bp, Artificial Sequence
  chemically synthesized
ccaatttatacacacacataca

SEQ ID NO: 1003646 - DNA, 22 bp, Artificial Sequence
  chemically synthesized
caatttatacacacacatacac

SEQ ID NO: 1003647 - DNA, 22 bp, Artificial Sequence
  chemically synthesized
atacacacacatacacgcacac

SEQ ID NO: 1003648 - DNA, 22 bp, Artificial Sequence
  chemically synthesized
tacacacacatacacgcacaca

SEQ ID NO: 1003649 - DNA, 22 bp, Artificial Sequence
  chemically synthesized
tatagaaggaaattgtgtgcgt

SEQ ID NO: 1003650 - DNA, 22 bp, Artificial Sequence
  chemically synthesized
atatagaaggaaattgtgtgcg

SEQ ID NO: 1003651 - DNA, 22 bp, Artificial Sequence
  chemically synthesized
aagtttatatagaaggaaattg

SEQ ID NO: 1003652 - DNA, 22 bp, Artificial Sequence
  chemically synthesized
aaagtttatatagaaggaaatt

SEQ ID NO: 1003653 - DNA, 22 bp, Artificial Sequence
  chemically synthesized
ccttctatataaactttaaatt

SEQ ID NO: 1003654 - DNA, 22 bp, Artificial Sequence
  chemically synthesized
cttctatataaactttaaatta

SEQ ID NO: 1003655 - DNA, 22 bp, Artificial Sequence
  chemically synthesized
ctatataaactttaaattacat

SEQ ID NO: 1003656 - DNA, 22 bp, Artificial Sequence
  chemically synthesized
tatataaactttaaattacatc

SEQ ID NO: 1003657 - DNA, 22 bp, Artificial Sequence
  chemically synthesized
tataaactttaaattacatcat

SEQ ID NO: 1003658 - DNA, 22 bp, Artificial Sequence
  chemically synthesized
aaaggaaataggcaatgatgta

SEQ ID NO: 1003659 - DNA, 22 bp, Artificial Sequence
  chemically synthesized
caaaggaaataggcaatgatgt

SEQ ID NO: 1003660 - DNA, 22 bp, Artificial Sequence
  chemically synthesized
taaattacatcattgcctattt

SEQ ID NO: 1003661 - DNA, 22 bp, Artificial Sequence
  chemically synthesized
aaattacatcattgcctatttc

SEQ ID NO: 1003662 - DNA, 22 bp, Artificial Sequence
  chemically synthesized
aattacatcattgcctatttcc

SEQ ID NO: 1003663 - DNA, 22 bp, Artificial Sequence
  chemically synthesized
catcattgcctatttcctttga

SEQ ID NO: 1003664 - DNA, 22 bp, Artificial Sequence
  chemically synthesized
ggggcaatataatttcaaagga

SEQ ID NO: 1003665 - DNA, 22 bp, Artificial Sequence
  chemically synthesized
gggggcaatataatttcaaagg

SEQ ID NO: 1003666 - DNA, 22 bp, Artificial Sequence
  chemically synthesized
cctatttcctttgaaattatat

SEQ ID NO: 1003667 - DNA, 22 bp, Artificial Sequence
  chemically synthesized
atgtgtttgggggcaatataat

SEQ ID NO: 1003668 - DNA, 22 bp, Artificial Sequence
  chemically synthesized
tttcctttgaaattatattgcc

SEQ ID NO: 1003669 - DNA, 22 bp, Artificial Sequence
  chemically synthesized
gatgtgtttgggggcaatataa

SEQ ID NO: 1003670 - DNA, 22 bp, Artificial Sequence
  chemically synthesized
tgatgtgtttgggggcaatata

SEQ ID NO: 1003671 - DNA, 22 bp, Artificial Sequence
  chemically synthesized
ttgatgtgtttgggggcaatat

SEQ ID NO: 1003672 - DNA, 22 bp, Artificial Sequence
  chemically synthesized
cctttgaaattatattgccccc

SEQ ID NO: 1003673 - DNA, 22 bp, Artificial Sequence
  chemically synthesized
ctttgaaattatattgccccca

SEQ ID NO: 1003674 - DNA, 22 bp, Artificial Sequence
  chemically synthesized
tgaaattatattgcccccaaac

SEQ ID NO: 1003675 - DNA, 22 bp, Artificial Sequence
  chemically synthesized
gaaattatattgcccccaaaca

SEQ ID NO: 1003676 - DNA, 22 bp, Artificial Sequence
  chemically synthesized
aaattatattgcccccaaacac

SEQ ID NO: 1003677 - DNA, 22 bp, Artificial Sequence
  chemically synthesized
tattgcccccaaacacatcaaa

SEQ ID NO: 1003678 - DNA, 22 bp, Artificial Sequence
  chemically synthesized
taatcagaatgcttttgatgtg

SEQ ID NO: 1003679 - DNA, 22 bp, Artificial Sequence
  chemically synthesized
cccccaaacacatcaaaagcat

SEQ ID NO: 1003680 - DNA, 22 bp, Artificial Sequence
  chemically synthesized
atacagttataatcagaatgct

SEQ ID NO: 1003681 - DNA, 22 bp, Artificial Sequence
  chemically synthesized
aatacagttataatcagaatgc

SEQ ID NO: 1003682 - DNA, 22 bp, Artificial Sequence
  chemically synthesized
aatttaatacagttataatcag

SEQ ID NO: 1003683 - DNA, 22 bp, Artificial Sequence
  chemically synthesized
gaatttaatacagttataatca

SEQ ID NO: 1003684 - DNA, 22 bp, Artificial Sequence
  chemically synthesized
acatttgaatttaatacagtta

SEQ ID NO: 1003685 - DNA, 22 bp, Artificial Sequence
  chemically synthesized
tgattataactgtattaaattc

SEQ ID NO: 1003686 - DNA, 22 bp, Artificial Sequence
  chemically synthesized
attataactgtattaaattcaa

SEQ ID NO: 1003687 - DNA, 22 bp, Artificial Sequence
  chemically synthesized
taactgtattaaattcaaatgt

SEQ ID NO: 1003688 - DNA, 22 bp, Artificial Sequence
  chemically synthesized
caataccagccaagttaacatt

SEQ ID NO: 1003689 - DNA, 22 bp, Artificial Sequence
  chemically synthesized
tattaaattcaaatgttaactt

SEQ ID NO: 1003690 - DNA, 22 bp, Artificial Sequence
  chemically synthesized
gcaataccagccaagttaacat

SEQ ID NO: 1003691 - DNA, 22 bp, Artificial Sequence
  chemically synthesized
aattcaaatgttaacttggctg

SEQ ID NO: 1003692 - DNA, 22 bp, Artificial Sequence
  chemically synthesized
aacttgcaataccagccaagtt

SEQ ID NO: 1003693 - DNA, 22 bp, Artificial Sequence
  chemically synthesized
aaatgttaacttggctggtatt

SEQ ID NO: 1003694 - DNA, 22 bp, Artificial Sequence
  chemically synthesized
tcattaaacttgcaataccagc

SEQ ID NO: 1003695 - DNA, 22 bp, Artificial Sequence
  chemically synthesized
ttgtcattaaacttgcaatacc

SEQ ID NO: 1003696 - DNA, 22 bp, Artificial Sequence
  chemically synthesized
attgtcattaaacttgcaatac

SEQ ID NO: 1003697 - DNA, 22 bp, Artificial Sequence
  chemically synthesized
acttggctggtattgcaagttt

SEQ ID NO: 1003698 - DNA, 22 bp, Artificial Sequence
  chemically synthesized
agatttattgtcattaaacttg

SEQ ID NO: 1003699 - DNA, 22 bp, Artificial Sequence
  chemically synthesized
ggctggtattgcaagtttaatg

SEQ ID NO: 1003700 - DNA, 22 bp, Artificial Sequence
  chemically synthesized
aagatttattgtcattaaactt

SEQ ID NO: 1003701 - DNA, 22 bp, Artificial Sequence
  chemically synthesized
gctggtattgcaagtttaatga

SEQ ID NO: 1003702 - DNA, 22 bp, Artificial Sequence
  chemically synthesized
gtattgcaagtttaatgacaat

SEQ ID NO: 1003703 - DNA, 22 bp, Artificial Sequence
  chemically synthesized
ggatttaagatttattgtcatt

SEQ ID NO: 1003704 - DNA, 22 bp, Artificial Sequence
  chemically synthesized
aggatttaagatttattgtcat

SEQ ID NO: 1003705 - DNA, 22 bp, Artificial Sequence
  chemically synthesized
taggatttaagatttattgtca

SEQ ID NO: 1003706 - DNA, 22 bp, Artificial Sequence
  chemically synthesized
caagtttaatgacaataaatct

SEQ ID NO: 1003707 - DNA, 22 bp, Artificial Sequence
  chemically synthesized
ttttaggatttaagatttattg

SEQ ID NO: 1003708 - DNA, 22 bp, Artificial Sequence
  chemically synthesized
aatgacaataaatcttaaatcc

SEQ ID NO: 1003709 - DNA, 22 bp, Artificial Sequence
  chemically synthesized
atgacaataaatcttaaatcct

SEQ ID NO: 1003710 - DNA, 22 bp, Artificial Sequence
  chemically synthesized
cgtaggattgttttaggattta

SEQ ID NO: 1003711 - DNA, 22 bp, Artificial Sequence
  chemically synthesized
actacgtaggattgttttagga

SEQ ID NO: 1003712 - DNA, 22 bp, Artificial Sequence
  chemically synthesized
aaatcctaaaacaatcctacgt

SEQ ID NO: 1003713 - DNA, 22 bp, Artificial Sequence
  chemically synthesized
aatcctaaaacaatcctacgta

SEQ ID NO: 1003714 - DNA, 22 bp, Artificial Sequence
  chemically synthesized
aaacaatcctacgtagtcaatt

SEQ ID NO: 1003715 - DNA, 22 bp, Artificial Sequence
  chemically synthesized
cgtagtcaatttttgctttttc

SEQ ID NO: 1003716 - DNA, 22 bp, Artificial Sequence
  chemically synthesized
ttgctttttcttatgtatattt

SEQ ID NO: 1003717 - DNA, 22 bp, Artificial Sequence
  chemically synthesized
tgctttttcttatgtatatttt

SEQ ID NO: 1003718 - DNA, 22 bp, Artificial Sequence
  chemically synthesized
gctttttcttatgtatattttt

SEQ ID NO: 1003719 - DNA, 22 bp, Artificial Sequence
  chemically synthesized
ctttttcttatgtatattttta

SEQ ID NO: 1003720 - DNA, 22 bp, Artificial Sequence
  chemically synthesized
taggtgaaaagcataaaaatat

SEQ ID NO: 1003721 - DNA, 22 bp, Artificial Sequence
  chemically synthesized
tttcttatgtatatttttatgc

SEQ ID NO: 1003722 - DNA, 22 bp, Artificial Sequence
  chemically synthesized
ttcttatgtatatttttatgct

SEQ ID NO: 1003723 - DNA, 22 bp, Artificial Sequence
  chemically synthesized
tcttatgtatatttttatgctt

SEQ ID NO: 1003724 - DNA, 22 bp, Artificial Sequence
  chemically synthesized
cttatgtatatttttatgcttt

SEQ ID NO: 1003725 - DNA, 22 bp, Artificial Sequence
  chemically synthesized
ttatgtatatttttatgctttt

SEQ ID NO: 1003726 - DNA, 22 bp, Artificial Sequence
  chemically synthesized
atgtatatttttatgcttttca

SEQ ID NO: 1003727 - DNA, 22 bp, Artificial Sequence
  chemically synthesized
tgtatatttttatgcttttcac

SEQ ID NO: 1003728 - DNA, 22 bp, Artificial Sequence
  chemically synthesized
tagaccctataggtgaaaagca

SEQ ID NO: 1003729 - DNA, 22 bp, Artificial Sequence
  chemically synthesized
ttatgcttttcacctatagggt

SEQ ID NO: 1003730 - DNA, 22 bp, Artificial Sequence
  chemically synthesized
tatgcttttcacctatagggtc

SEQ ID NO: 1003731 - DNA, 22 bp, Artificial Sequence
  chemically synthesized
atgcttttcacctatagggtct

SEQ ID NO: 1003732 - DNA, 22 bp, Artificial Sequence
  chemically synthesized
tgcttttcacctatagggtcta

SEQ ID NO: 1003733 - DNA, 22 bp, Artificial Sequence
  chemically synthesized
ttcacctatagggtctacaatt

SEQ ID NO: 1003734 - DNA, 22 bp, Artificial Sequence
  chemically synthesized
aggaggaataaaaattgtagac

SEQ ID NO: 1003735 - DNA, 22 bp, Artificial Sequence
  chemically synthesized
tcacctatagggtctacaattt

SEQ ID NO: 1003736 - DNA, 22 bp, Artificial Sequence
  chemically synthesized
cacctatagggtctacaatttt

SEQ ID NO: 1003737 - DNA, 22 bp, Artificial Sequence
  chemically synthesized
acctatagggtctacaattttt

SEQ ID NO: 1003738 - DNA, 22 bp, Artificial Sequence
  chemically synthesized
tagggtctacaatttttattcc

SEQ ID NO: 1003739 - DNA, 22 bp, Artificial Sequence
  chemically synthesized
caatttttattcctccttaatt

SEQ ID NO: 1003740 - DNA, 22 bp, Artificial Sequence
  chemically synthesized
atgacaatgtataaattaagga

SEQ ID NO: 1003741 - DNA, 22 bp, Artificial Sequence
  chemically synthesized
ttattcctccttaatttataca

SEQ ID NO: 1003742 - DNA, 22 bp, Artificial Sequence
  chemically synthesized
tattcctccttaatttatacat

SEQ ID NO: 1003743 - DNA, 22 bp, Artificial Sequence
  chemically synthesized
acactgatgacaatgtataaat

SEQ ID NO: 1003744 - DNA, 22 bp, Artificial Sequence
  chemically synthesized
attcctccttaatttatacatt

SEQ ID NO: 1003745 - DNA, 22 bp, Artificial Sequence
  chemically synthesized
ttcctccttaatttatacattg

SEQ ID NO: 1003746 - DNA, 22 bp, Artificial Sequence
  chemically synthesized
attcacactgatgacaatgtat

SEQ ID NO: 1003747 - DNA, 22 bp, Artificial Sequence
  chemically synthesized
ctccttaatttatacattgtca

SEQ ID NO: 1003748 - DNA, 22 bp, Artificial Sequence
  chemically synthesized
cattcacactgatgacaatgta

SEQ ID NO: 1003749 - DNA, 22 bp, Artificial Sequence
  chemically synthesized
cttaatttatacattgtcatca

SEQ ID NO: 1003750 - DNA, 22 bp, Artificial Sequence
  chemically synthesized
aatttatacattgtcatcagtg

SEQ ID NO: 1003751 - DNA, 22 bp, Artificial Sequence
  chemically synthesized
atttatacattgtcatcagtgt

SEQ ID NO: 1003752 - DNA, 22 bp, Artificial Sequence
  chemically synthesized
atacattgtcatcagtgtgaat

SEQ ID NO: 1003753 - DNA, 22 bp, Artificial Sequence
  chemically synthesized
tacattgtcatcagtgtgaatg

SEQ ID NO: 1003754 - DNA, 22 bp, Artificial Sequence
  chemically synthesized
tcatcagtgtgaatgaaatatt

SEQ ID NO: 1003755 - DNA, 22 bp, Artificial Sequence
  chemically synthesized
taaatgcaaatggaaatatttc

SEQ ID NO: 1003756 - DNA, 22 bp, Artificial Sequence
  chemically synthesized
atgactataaatgcaaatggaa

SEQ ID NO: 1003757 - DNA, 22 bp, Artificial Sequence
  chemically synthesized
atattaatgactataaatgcaa

SEQ ID NO: 1003758 - DNA, 22 bp, Artificial Sequence
  chemically synthesized
ttcatattaatgactataaatg

SEQ ID NO: 1003759 - DNA, 22 bp, Artificial Sequence
  chemically synthesized
attcatattaatgactataaat

SEQ ID NO: 1003760 - DNA, 22 bp, Artificial Sequence
  chemically synthesized
tattcatattaatgactataaa

SEQ ID NO: 1003761 - DNA, 22 bp, Artificial Sequence
  chemically synthesized
ttattcatattaatgactataa

SEQ ID NO: 1003762 - DNA, 22 bp, Artificial Sequence
  chemically synthesized
ccatttgcatttatagtcatta

SEQ ID NO: 1003763 - DNA, 22 bp, Artificial Sequence
  chemically synthesized
catttgcatttatagtcattaa

SEQ ID NO: 1003764 - DNA, 22 bp, Artificial Sequence
  chemically synthesized
gcatttatagtcattaatatga

SEQ ID NO: 1003765 - DNA, 22 bp, Artificial Sequence
  chemically synthesized
catttatagtcattaatatgaa

SEQ ID NO: 1003766 - DNA, 22 bp, Artificial Sequence
  chemically synthesized
atagtcattaatatgaataaaa

SEQ ID NO: 1003767 - DNA, 22 bp, Artificial Sequence
  chemically synthesized
tagtcattaatatgaataaaag

SEQ ID NO: 1003768 - DNA, 22 bp, Artificial Sequence
  chemically synthesized
tgaatagatacataatagcttt

SEQ ID NO: 1003769 - DNA, 22 bp, Artificial Sequence
  chemically synthesized
atgaatagatacataatagctt

SEQ ID NO: 1003770 - DNA, 22 bp, Artificial Sequence
  chemically synthesized
tatgaatagatacataatagct

SEQ ID NO: 1003771 - DNA, 22 bp, Artificial Sequence
  chemically synthesized
atatgaataaaagctattatgt

SEQ ID NO: 1003772 - DNA, 22 bp, Artificial Sequence
  chemically synthesized
aaaatactttatgaatagatac

SEQ ID NO: 1003773 - DNA, 22 bp, Artificial Sequence
  chemically synthesized
aaaaatactttatgaatagata

SEQ ID NO: 1003774 - DNA, 22 bp, Artificial Sequence
  chemically synthesized
taaaaatactttatgaatagat

SEQ ID NO: 1003775 - DNA, 22 bp, Artificial Sequence
  chemically synthesized
ttatgtatctattcataaagta

SEQ ID NO: 1003776 - DNA, 22 bp, Artificial Sequence
  chemically synthesized
tgtatctattcataaagtattt

SEQ ID NO: 1003777 - DNA, 22 bp, Artificial Sequence
  chemically synthesized
tgaaataattttaaaaatactt

SEQ ID NO: 1003778 - DNA, 22 bp, Artificial Sequence
  chemically synthesized
ttcataaagtatttttaaaatt

SEQ ID NO: 1003779 - DNA, 22 bp, Artificial Sequence
  chemically synthesized
aaatctgtgaaataattttaaa

SEQ ID NO: 1003780 - DNA, 22 bp, Artificial Sequence
  chemically synthesized
aaaatctgtgaaataattttaa

SEQ ID NO: 1003781 - DNA, 22 bp, Artificial Sequence
  chemically synthesized
ataaagtatttttaaaattatt

SEQ ID NO: 1003782 - DNA, 22 bp, Artificial Sequence
  chemically synthesized
taaaatctgtgaaataatttta

SEQ ID NO: 1003783 - DNA, 22 bp, Artificial Sequence
  chemically synthesized
aattttaaaatctgtgaaataa

SEQ ID NO: 1003784 - DNA, 22 bp, Artificial Sequence
  chemically synthesized
ttaaaattatttcacagatttt

SEQ ID NO: 1003785 - DNA, 22 bp, Artificial Sequence
  chemically synthesized
taaaattatttcacagatttta

SEQ ID NO: 1003786 - DNA, 22 bp, Artificial Sequence
  chemically synthesized
aaaattatttcacagattttaa

SEQ ID NO: 1003787 - DNA, 22 bp, Artificial Sequence
  chemically synthesized
ggagactcaattttaaaatctg

SEQ ID NO: 1003788 - DNA, 22 bp, Artificial Sequence
  chemically synthesized
aaattatttcacagattttaaa

SEQ ID NO: 1003789 - DNA, 22 bp, Artificial Sequence
  chemically synthesized
tttcacagattttaaaattgag

SEQ ID NO: 1003790 - DNA, 22 bp, Artificial Sequence
  chemically synthesized
cacagattttaaaattgagtct

SEQ ID NO: 1003791 - DNA, 22 bp, Artificial Sequence
  chemically synthesized
acagattttaaaattgagtctc

SEQ ID NO: 1003792 - DNA, 22 bp, Artificial Sequence
  chemically synthesized
tgcagagaaaacctaggagact

SEQ ID NO: 1003793 - DNA, 22 bp, Artificial Sequence
  chemically synthesized
ttgtgcagagaaaacctaggag

SEQ ID NO: 1003794 - DNA, 22 bp, Artificial Sequence
  chemically synthesized
taaaattgagtctcctaggttt

SEQ ID NO: 1003795 - DNA, 22 bp, Artificial Sequence
  chemically synthesized
aaaattgagtctcctaggtttt

SEQ ID NO: 1003796 - DNA, 22 bp, Artificial Sequence
  chemically synthesized
aaattgagtctcctaggttttc

SEQ ID NO: 1003797 - DNA, 22 bp, Artificial Sequence
  chemically synthesized
agtctcctaggttttctctgca

SEQ ID NO: 1003798 - DNA, 22 bp, Artificial Sequence
  chemically synthesized
aataggattattgtgcagagaa

SEQ ID NO: 1003799 - DNA, 22 bp, Artificial Sequence
  chemically synthesized
ttaaataggattattgtgcaga

SEQ ID NO: 1003800 - DNA, 22 bp, Artificial Sequence
  chemically synthesized
ctaggttttctctgcacaataa

SEQ ID NO: 1003801 - DNA, 22 bp, Artificial Sequence
  chemically synthesized
ttgttaaataggattattgtgc

SEQ ID NO: 1003802 - DNA, 22 bp, Artificial Sequence
  chemically synthesized
ggttttctctgcacaataatcc

SEQ ID NO: 1003803 - DNA, 22 bp, Artificial Sequence
  chemically synthesized
tctctgcacaataatcctattt

SEQ ID NO: 1003804 - DNA, 22 bp, Artificial Sequence
  chemically synthesized
ctctgcacaataatcctattta

SEQ ID NO: 1003805 - DNA, 22 bp, Artificial Sequence
  chemically synthesized
tctgcacaataatcctatttaa

SEQ ID NO: 1003806 - DNA, 22 bp, Artificial Sequence
  chemically synthesized
tgcacaataatcctatttaaca

SEQ ID NO: 1003807 - DNA, 22 bp, Artificial Sequence
  chemically synthesized
cacaataatcctatttaacaat

SEQ ID NO: 1003808 - DNA, 22 bp, Artificial Sequence
  chemically synthesized
aagaagaaaaattattgttaaa

SEQ ID NO: 1003809 - DNA, 22 bp, Artificial Sequence
  chemically synthesized
aaagaagaaaaattattgttaa

SEQ ID NO: 1003810 - DNA, 22 bp, Artificial Sequence
  chemically synthesized
taaagaagaaaaattattgtta

SEQ ID NO: 1003811 - DNA, 22 bp, Artificial Sequence
  chemically synthesized
ttaaagaagaaaaattattgtt

SEQ ID NO: 1003812 - DNA, 22 bp, Artificial Sequence
  chemically synthesized
tttaacaataatttttcttctt

SEQ ID NO: 1003813 - DNA, 22 bp, Artificial Sequence
  chemically synthesized
aacaataatttttcttctttaa

SEQ ID NO: 1003814 - DNA, 22 bp, Artificial Sequence
  chemically synthesized
acaataatttttcttctttaaa

SEQ ID NO: 1003815 - DNA, 22 bp, Artificial Sequence
  chemically synthesized
aaaaggaaagaagaaatatttt

SEQ ID NO: 1003816 - DNA, 22 bp, Artificial Sequence
  chemically synthesized
ttcttctttaaaaatatttctt

SEQ ID NO: 1003817 - DNA, 22 bp, Artificial Sequence
  chemically synthesized
tcttctttaaaaatatttcttc

SEQ ID NO: 1003818 - DNA, 22 bp, Artificial Sequence
  chemically synthesized
cttctttaaaaatatttcttct

SEQ ID NO: 1003819 - DNA, 22 bp, Artificial Sequence
  chemically synthesized
ttctttaaaaatatttcttctt

SEQ ID NO: 1003820 - DNA, 22 bp, Artificial Sequence
  chemically synthesized
ctttaaaaatatttcttctttc

SEQ ID NO: 1003821 - DNA, 22 bp, Artificial Sequence
  chemically synthesized
tttaaaaatatttcttctttcc

SEQ ID NO: 1003822 - DNA, 22 bp, Artificial Sequence
  chemically synthesized
taaaaatatttcttctttcctt

SEQ ID NO: 1003823 - DNA, 22 bp, Artificial Sequence
  chemically synthesized
aaaaatatttcttctttccttt

SEQ ID NO: 1003824 - DNA, 22 bp, Artificial Sequence
  chemically synthesized
aaaatatttcttctttcctttt

SEQ ID NO: 1003825 - DNA, 22 bp, Artificial Sequence
  chemically synthesized
cttctttccttttgaggttatc

SEQ ID NO: 1003826 - DNA, 22 bp, Artificial Sequence
  chemically synthesized
ttctttccttttgaggttatca

SEQ ID NO: 1003827 - DNA, 22 bp, Artificial Sequence
  chemically synthesized
ctttccttttgaggttatcatt

SEQ ID NO: 1003828 - DNA, 22 bp, Artificial Sequence
  chemically synthesized
tttccttttgaggttatcatta

SEQ ID NO: 1003829 - DNA, 22 bp, Artificial Sequence
  chemically synthesized
aaataataatagtaatgataac

SEQ ID NO: 1003830 - DNA, 22 bp, Artificial Sequence
  chemically synthesized
tccttttgaggttatcattact

SEQ ID NO: 1003831 - DNA, 22 bp, Artificial Sequence
  chemically synthesized
taaaataataatagtaatgata

SEQ ID NO: 1003832 - DNA, 22 bp, Artificial Sequence
  chemically synthesized
ccttttgaggttatcattacta

SEQ ID NO: 1003833 - DNA, 22 bp, Artificial Sequence
  chemically synthesized
cttttgaggttatcattactat

SEQ ID NO: 1003834 - DNA, 22 bp, Artificial Sequence
  chemically synthesized
ttgaggttatcattactattat

SEQ ID NO: 1003835 - DNA, 22 bp, Artificial Sequence
  chemically synthesized
tgaggttatcattactattatt

SEQ ID NO: 1003836 - DNA, 22 bp, Artificial Sequence
  chemically synthesized
cacctctaaaataataatagta

SEQ ID NO: 1003837 - DNA, 22 bp, Artificial Sequence
  chemically synthesized
gaggttatcattactattatta

SEQ ID NO: 1003838 - DNA, 22 bp, Artificial Sequence
  chemically synthesized
aggttatcattactattattat

SEQ ID NO: 1003839 - DNA, 22 bp, Artificial Sequence
  chemically synthesized
tcattactattattattttaga

SEQ ID NO: 1003840 - DNA, 22 bp, Artificial Sequence
  chemically synthesized
ctattattattttagaggtgga

SEQ ID NO: 1003841 - DNA, 22 bp, Artificial Sequence
  chemically synthesized
ttattattttagaggtggaggt

SEQ ID NO: 1003842 - DNA, 22 bp, Artificial Sequence
  chemically synthesized
ttattttagaggtggaggtctt

SEQ ID NO: 1003843 - DNA, 22 bp, Artificial Sequence
  chemically synthesized
ttttagaggtggaggtcttgct

SEQ ID NO: 1003844 - DNA, 22 bp, Artificial Sequence
  chemically synthesized
tagaggtggaggtcttgctact

SEQ ID NO: 1003845 - DNA, 22 bp, Artificial Sequence
  chemically synthesized
agaggtggaggtcttgctactt

SEQ ID NO: 1003846 - DNA, 22 bp, Artificial Sequence
  chemically synthesized
gaggtggaggtcttgctacttt

SEQ ID NO: 1003847 - DNA, 22 bp, Artificial Sequence
  chemically synthesized
atgaaataagtcaaaagtagca

SEQ ID NO: 1003848 - DNA, 22 bp, Artificial Sequence
  chemically synthesized
gctcatgaaataagtcaaaagt

SEQ ID NO: 1003849 - DNA, 22 bp, Artificial Sequence
  chemically synthesized
gtctagctcatgaaataagtca

SEQ ID NO: 1003850 - DNA, 22 bp, Artificial Sequence
  chemically synthesized
ggtctagctcatgaaataagtc

SEQ ID NO: 1003851 - DNA, 22 bp, Artificial Sequence
  chemically synthesized
gctacttttgacttatttcatg

SEQ ID NO: 1003852 - DNA, 22 bp, Artificial Sequence
  chemically synthesized
cttggtctagctcatgaaataa

SEQ ID NO: 1003853 - DNA, 22 bp, Artificial Sequence
  chemically synthesized
ctacttttgacttatttcatga

SEQ ID NO: 1003854 - DNA, 22 bp, Artificial Sequence
  chemically synthesized
gcttggtctagctcatgaaata

SEQ ID NO: 1003855 - DNA, 22 bp, Artificial Sequence
  chemically synthesized
tgcttggtctagctcatgaaat

SEQ ID NO: 1003856 - DNA, 22 bp, Artificial Sequence
  chemically synthesized
cttttgacttatttcatgagct

SEQ ID NO: 1003857 - DNA, 22 bp, Artificial Sequence
  chemically synthesized
ctttgcttggtctagctcatga

SEQ ID NO: 1003858 - DNA, 22 bp, Artificial Sequence
  chemically synthesized
gctttgcttggtctagctcatg

SEQ ID NO: 1003859 - DNA, 22 bp, Artificial Sequence
  chemically synthesized
ttgacttatttcatgagctaga

SEQ ID NO: 1003860 - DNA, 22 bp, Artificial Sequence
  chemically synthesized
tgacttatttcatgagctagac

SEQ ID NO: 1003861 - DNA, 22 bp, Artificial Sequence
  chemically synthesized
gacttatttcatgagctagacc

SEQ ID NO: 1003862 - DNA, 22 bp, Artificial Sequence
  chemically synthesized
acttatttcatgagctagacca

SEQ ID NO: 1003863 - DNA, 22 bp, Artificial Sequence
  chemically synthesized
aaatttgctttgcttggtctag

SEQ ID NO: 1003864 - DNA, 22 bp, Artificial Sequence
  chemically synthesized
caaatttgctttgcttggtcta

SEQ ID NO: 1003865 - DNA, 22 bp, Artificial Sequence
  chemically synthesized
atttcatgagctagaccaagca

SEQ ID NO: 1003866 - DNA, 22 bp, Artificial Sequence
  chemically synthesized
tcaaatttgctttgcttggtct

SEQ ID NO: 1003867 - DNA, 22 bp, Artificial Sequence
  chemically synthesized
tttcatgagctagaccaagcaa

SEQ ID NO: 1003868 - DNA, 22 bp, Artificial Sequence
  chemically synthesized
catgagctagaccaagcaaagc

SEQ ID NO: 1003869 - DNA, 22 bp, Artificial Sequence
  chemically synthesized
atgagctagaccaagcaaagca

SEQ ID NO: 1003870 - DNA, 22 bp, Artificial Sequence
  chemically synthesized
aaagttttcaaatttgctttgc

SEQ ID NO: 1003871 - DNA, 22 bp, Artificial Sequence
  chemically synthesized
caaagttttcaaatttgctttg

SEQ ID NO: 1003872 - DNA, 22 bp, Artificial Sequence
  chemically synthesized
tcaaagttttcaaatttgcttt

SEQ ID NO: 1003873 - DNA, 22 bp, Artificial Sequence
  chemically synthesized
ttcaaagttttcaaatttgctt

SEQ ID NO: 1003874 - DNA, 22 bp, Artificial Sequence
  chemically synthesized
gaccaagcaaagcaaatttgaa

SEQ ID NO: 1003875 - DNA, 22 bp, Artificial Sequence
  chemically synthesized
tttttcaaagttttcaaatttg

SEQ ID NO: 1003876 - DNA, 22 bp, Artificial Sequence
  chemically synthesized
atttttcaaagttttcaaattt

SEQ ID NO: 1003877 - DNA, 22 bp, Artificial Sequence
  chemically synthesized
tatttttcaaagttttcaaatt

SEQ ID NO: 1003878 - DNA, 22 bp, Artificial Sequence
  chemically synthesized
ttatttttcaaagttttcaaat

SEQ ID NO: 1003879 - DNA, 22 bp, Artificial Sequence
  chemically synthesized
tcaaatttttatttttcaaagt

SEQ ID NO: 1003880 - DNA, 22 bp, Artificial Sequence
  chemically synthesized
aaaattatcaaatttttatttt

SEQ ID NO: 1003881 - DNA, 22 bp, Artificial Sequence
  chemically synthesized
gaaaactttgaaaaataaaaat

SEQ ID NO: 1003882 - DNA, 22 bp, Artificial Sequence
  chemically synthesized
aaaactttgaaaaataaaaatt

SEQ ID NO: 1003883 - DNA, 22 bp, Artificial Sequence
  chemically synthesized
tgaaaaataaaaatttgataat

SEQ ID NO: 1003884 - DNA, 22 bp, Artificial Sequence
  chemically synthesized
tcaacgttaaaaattatcaaat

SEQ ID NO: 1003885 - DNA, 22 bp, Artificial Sequence
  chemically synthesized
gaaaaataaaaatttgataatt

SEQ ID NO: 1003886 - DNA, 22 bp, Artificial Sequence
  chemically synthesized
aaaaataaaaatttgataattt

SEQ ID NO: 1003887 - DNA, 22 bp, Artificial Sequence
  chemically synthesized
gataatttttaacgttgacaat

SEQ ID NO: 1003888 - DNA, 22 bp, Artificial Sequence
  chemically synthesized
ataatttttaacgttgacaatg

SEQ ID NO: 1003889 - DNA, 22 bp, Artificial Sequence
  chemically synthesized
gtaaagaagcaccattgtcaac

SEQ ID NO: 1003890 - DNA, 22 bp, Artificial Sequence
  chemically synthesized
ttaacgttgacaatggtgcttc

SEQ ID NO: 1003891 - DNA, 22 bp, Artificial Sequence
  chemically synthesized
taacgttgacaatggtgcttct

SEQ ID NO: 1003892 - DNA, 22 bp, Artificial Sequence
  chemically synthesized
acaccctagtaaagaagcacca

SEQ ID NO: 1003893 - DNA, 22 bp, Artificial Sequence
  chemically synthesized
aacgttgacaatggtgcttctt

SEQ ID NO: 1003894 - DNA, 22 bp, Artificial Sequence
  chemically synthesized
acgttgacaatggtgcttcttt

SEQ ID NO: 1003895 - DNA, 22 bp, Artificial Sequence
  chemically synthesized
ctgacaccctagtaaagaagca

SEQ ID NO: 1003896 - DNA, 22 bp, Artificial Sequence
  chemically synthesized
gctgacaccctagtaaagaagc

SEQ ID NO: 1003897 - DNA, 22 bp, Artificial Sequence
  chemically synthesized
acaatggtgcttctttactagg

SEQ ID NO: 1003898 - DNA, 22 bp, Artificial Sequence
  chemically synthesized
tagtttgctgacaccctagtaa

SEQ ID NO: 1003899 - DNA, 22 bp, Artificial Sequence
  chemically synthesized
gtagtttgctgacaccctagta

SEQ ID NO: 1003900 - DNA, 22 bp, Artificial Sequence
  chemically synthesized
tgtagtttgctgacaccctagt

SEQ ID NO: 1003901 - DNA, 22 bp, Artificial Sequence
  chemically synthesized
ttgtagtttgctgacaccctag

SEQ ID NO: 1003902 - DNA, 22 bp, Artificial Sequence
  chemically synthesized
tttgtagtttgctgacacccta

SEQ ID NO: 1003903 - DNA, 22 bp, Artificial Sequence
  chemically synthesized
ttttgtagtttgctgacaccct

SEQ ID NO: 1003904 - DNA, 22 bp, Artificial Sequence
  chemically synthesized
tttttgtagtttgctgacaccc

SEQ ID NO: 1003905 - DNA, 22 bp, Artificial Sequence
  chemically synthesized
ttttttgtagtttgctgacacc

SEQ ID NO: 1003906 - DNA, 22 bp, Artificial Sequence
  chemically synthesized
tttttttgtagtttgctgacac

SEQ ID NO: 1003907 - DNA, 22 bp, Artificial Sequence
  chemically synthesized
ttttttttgtagtttgctgaca

SEQ ID NO: 1003908 - DNA, 22 bp, Artificial Sequence
  chemically synthesized
ctttactagggtgtcagcaaac

SEQ ID NO: 1003909 - DNA, 22 bp, Artificial Sequence
  chemically synthesized
tttttttttgtagtttgctgac

SEQ ID NO: 1003910 - DNA, 22 bp, Artificial Sequence
  chemically synthesized
tttactagggtgtcagcaaact

SEQ ID NO: 1003911 - DNA, 22 bp, Artificial Sequence
  chemically synthesized
ttttttttttgtagtttgctga

SEQ ID NO: 1003912 - DNA, 22 bp, Artificial Sequence
  chemically synthesized
tttttttttttgtagtttgctg

SEQ ID NO: 1003913 - DNA, 22 bp, Artificial Sequence
  chemically synthesized
tactagggtgtcagcaaactac

SEQ ID NO: 1003914 - DNA, 22 bp, Artificial Sequence
  chemically synthesized
actagggtgtcagcaaactaca

SEQ ID NO: 1003915 - DNA, 22 bp, Artificial Sequence
  chemically synthesized
ctagggtgtcagcaaactacaa

SEQ ID NO: 1003916 - DNA, 22 bp, Artificial Sequence
  chemically synthesized
ttttttttttttttgtagtttg

SEQ ID NO: 1003917 - DNA, 22 bp, Artificial Sequence
  chemically synthesized
gggtgtcagcaaactacaaaaa

SEQ ID NO: 1003918 - DNA, 22 bp, Artificial Sequence
  chemically synthesized
caaaacaaagttgttttttttt

SEQ ID NO: 1003919 - DNA, 22 bp, Artificial Sequence
  chemically synthesized
gcaaaacaaagttgtttttttt

SEQ ID NO: 1003920 - DNA, 22 bp, Artificial Sequence
  chemically synthesized
caaaaaaaaaaaaaacaacttt

SEQ ID NO: 1003921 - DNA, 22 bp, Artificial Sequence
  chemically synthesized
taaatacaaagtttgcaaaaca

SEQ ID NO: 1003922 - DNA, 22 bp, Artificial Sequence
  chemically synthesized
ataaatacaaagtttgcaaaac

SEQ ID NO: 1003923 - DNA, 22 bp, Artificial Sequence
  chemically synthesized
tataaatacaaagtttgcaaaa

SEQ ID NO: 1003924 - DNA, 22 bp, Artificial Sequence
  chemically synthesized
tgttttgcaaactttgtattta

SEQ ID NO: 1003925 - DNA, 22 bp, Artificial Sequence
  chemically synthesized
aataaaattttataaatacaaa

SEQ ID NO: 1003926 - DNA, 22 bp, Artificial Sequence
  chemically synthesized
gttttgcaaactttgtatttat

SEQ ID NO: 1003927 - DNA, 22 bp, Artificial Sequence
  chemically synthesized
caataaaattttataaatacaa

SEQ ID NO: 1003928 - DNA, 22 bp, Artificial Sequence
  chemically synthesized
ttttgcaaactttgtatttata

SEQ ID NO: 1003929 - DNA, 22 bp, Artificial Sequence
  chemically synthesized
tcaataaaattttataaataca

SEQ ID NO: 1003930 - DNA, 22 bp, Artificial Sequence
  chemically synthesized
tgcaaactttgtatttataaaa

SEQ ID NO: 1003931 - DNA, 22 bp, Artificial Sequence
  chemically synthesized
gcaaactttgtatttataaaat

SEQ ID NO: 1003932 - DNA, 22 bp, Artificial Sequence
  chemically synthesized
caaactttgtatttataaaatt

SEQ ID NO: 1003933 - DNA, 22 bp, Artificial Sequence
  chemically synthesized
tgctttcaataaaattttataa

SEQ ID NO: 1003934 - DNA, 22 bp, Artificial Sequence
  chemically synthesized
tgtatttataaaattttattga

SEQ ID NO: 1003935 - DNA, 22 bp, Artificial Sequence
  chemically synthesized
gtatttataaaattttattgaa

SEQ ID NO: 1003936 - DNA, 22 bp, Artificial Sequence
  chemically synthesized
tatttataaaattttattgaaa

SEQ ID NO: 1003937 - DNA, 22 bp, Artificial Sequence
  chemically synthesized
gtaggtgtgcctgtgctttcaa

SEQ ID NO: 1003938 - DNA, 22 bp, Artificial Sequence
  chemically synthesized
ataaaattttattgaaagcaca

SEQ ID NO: 1003939 - DNA, 22 bp, Artificial Sequence
  chemically synthesized
taaaattttattgaaagcacag

SEQ ID NO: 1003940 - DNA, 22 bp, Artificial Sequence
  chemically synthesized
aattagtaggtgtgcctgtgct

SEQ ID NO: 1003941 - DNA, 22 bp, Artificial Sequence
  chemically synthesized
aaattagtaggtgtgcctgtgc

SEQ ID NO: 1003942 - DNA, 22 bp, Artificial Sequence
  chemically synthesized
tattgaaagcacaggcacacct

SEQ ID NO: 1003943 - DNA, 22 bp, Artificial Sequence
  chemically synthesized
attgaaagcacaggcacaccta

SEQ ID NO: 1003944 - DNA, 22 bp, Artificial Sequence
  chemically synthesized
ttgaaagcacaggcacacctac

SEQ ID NO: 1003945 - DNA, 22 bp, Artificial Sequence
  chemically synthesized
aaagcacaggcacacctactaa

SEQ ID NO: 1003946 - DNA, 22 bp, Artificial Sequence
  chemically synthesized
tggacaatacttaaattagtag

SEQ ID NO: 1003947 - DNA, 22 bp, Artificial Sequence
  chemically synthesized
gaagcagctatggacaatactt

SEQ ID NO: 1003948 - DNA, 22 bp, Artificial Sequence
  chemically synthesized
ctaatttaagtattgtccatag

SEQ ID NO: 1003949 - DNA, 22 bp, Artificial Sequence
  chemically synthesized
atttaagtattgtccatagctg

SEQ ID NO: 1003950 - DNA, 22 bp, Artificial Sequence
  chemically synthesized
tggcattggaagcagctatgga

SEQ ID NO: 1003951 - DNA, 22 bp, Artificial Sequence
  chemically synthesized
aagtattgtccatagctgcttc

SEQ ID NO: 1003952 - DNA, 22 bp, Artificial Sequence
  chemically synthesized
agtattgtccatagctgcttcc

SEQ ID NO: 1003953 - DNA, 22 bp, Artificial Sequence
  chemically synthesized
cagttgtggcattggaagcagc

SEQ ID NO: 1003954 - DNA, 22 bp, Artificial Sequence
  chemically synthesized
tgcagttgtggcattggaagca

SEQ ID NO: 1003955 - DNA, 22 bp, Artificial Sequence
  chemically synthesized
tccatagctgcttccaatgcca

SEQ ID NO: 1003956 - DNA, 22 bp, Artificial Sequence
  chemically synthesized
attctgcagttgtggcattgga

SEQ ID NO: 1003957 - DNA, 22 bp, Artificial Sequence
  chemically synthesized
gattctgcagttgtggcattgg

SEQ ID NO: 1003958 - DNA, 22 bp, Artificial Sequence
  chemically synthesized
cttgattctgcagttgtggcat

SEQ ID NO: 1003959 - DNA, 22 bp, Artificial Sequence
  chemically synthesized
acttgattctgcagttgtggca

SEQ ID NO: 1003960 - DNA, 22 bp, Artificial Sequence
  chemically synthesized
cttccaatgccacaactgcaga

SEQ ID NO: 1003961 - DNA, 22 bp, Artificial Sequence
  chemically synthesized
ccaatgccacaactgcagaatc

SEQ ID NO: 1003962 - DNA, 22 bp, Artificial Sequence
  chemically synthesized
tcacatttacttgattctgcag

SEQ ID NO: 1003963 - DNA, 22 bp, Artificial Sequence
  chemically synthesized
caatgccacaactgcagaatca

SEQ ID NO: 1003964 - DNA, 22 bp, Artificial Sequence
  chemically synthesized
tgtcacatttacttgattctgc

SEQ ID NO: 1003965 - DNA, 22 bp, Artificial Sequence
  chemically synthesized
cagaatcaagtaaatgtgacag

SEQ ID NO: 1003966 - DNA, 22 bp, Artificial Sequence
  chemically synthesized
tggcccaaatagtctctgtcac

SEQ ID NO: 1003967 - DNA, 22 bp, Artificial Sequence
  chemically synthesized
gtggcccaaatagtctctgtca

SEQ ID NO: 1003968 - DNA, 22 bp, Artificial Sequence
  chemically synthesized
tgtggcccaaatagtctctgtc

SEQ ID NO: 1003969 - DNA, 22 bp, Artificial Sequence
  chemically synthesized
agttttgtggcccaaatagtct

SEQ ID NO: 1003970 - DNA, 22 bp, Artificial Sequence
  chemically synthesized
aagttttgtggcccaaatagtc

SEQ ID NO: 1003971 - DNA, 22 bp, Artificial Sequence
  chemically synthesized
taagttttgtggcccaaatagt

SEQ ID NO: 1003972 - DNA, 22 bp, Artificial Sequence
  chemically synthesized
tttgggccacaaaacttaaaat

SEQ ID NO: 1003973 - DNA, 22 bp, Artificial Sequence
  chemically synthesized
gggccacaaaacttaaaatatt

SEQ ID NO: 1003974 - DNA, 22 bp, Artificial Sequence
  chemically synthesized
ggccacaaaacttaaaatattt

SEQ ID NO: 1003975 - DNA, 22 bp, Artificial Sequence
  chemically synthesized
taatggggcagatagtaaatat

SEQ ID NO: 1003976 - DNA, 22 bp, Artificial Sequence
  chemically synthesized
tgtaatggggcagatagtaaat

SEQ ID NO: 1003977 - DNA, 22 bp, Artificial Sequence
  chemically synthesized
ctgtaatggggcagatagtaaa

SEQ ID NO: 1003978 - DNA, 22 bp, Artificial Sequence
  chemically synthesized
ttctgtaatggggcagatagta

SEQ ID NO: 1003979 - DNA, 22 bp, Artificial Sequence
  chemically synthesized
cttctgtaatggggcagatagt

SEQ ID NO: 1003980 - DNA, 22 bp, Artificial Sequence
  chemically synthesized
tcttctgtaatggggcagatag

SEQ ID NO: 1003981 - DNA, 22 bp, Artificial Sequence
  chemically synthesized
ttcttctgtaatggggcagata

SEQ ID NO: 1003982 - DNA, 22 bp, Artificial Sequence
  chemically synthesized
aaaatatttactatctgcccca

SEQ ID NO: 1003983 - DNA, 22 bp, Artificial Sequence
  chemically synthesized
tttcttctgtaatggggcagat

SEQ ID NO: 1003984 - DNA, 22 bp, Artificial Sequence
  chemically synthesized
aaatatttactatctgccccat

SEQ ID NO: 1003985 - DNA, 22 bp, Artificial Sequence
  chemically synthesized
cattttttcttctgtaatgggg

SEQ ID NO: 1003986 - DNA, 22 bp, Artificial Sequence
  chemically synthesized
actatctgccccattacagaag

SEQ ID NO: 1003987 - DNA, 22 bp, Artificial Sequence
  chemically synthesized
ctatctgccccattacagaaga

SEQ ID NO: 1003988 - DNA, 22 bp, Artificial Sequence
  chemically synthesized
tctgccccattacagaagaaaa

SEQ ID NO: 1003989 - DNA, 22 bp, Artificial Sequence
  chemically synthesized
ccccattacagaagaaaaaatg

SEQ ID NO: 1003990 - DNA, 22 bp, Artificial Sequence
  chemically synthesized
cagaagaaaaaatgcagatttc

SEQ ID NO: 1003991 - DNA, 22 bp, Artificial Sequence
  chemically synthesized
cgtagtaaaaggaaggagaagg

SEQ ID NO: 1003992 - DNA, 22 bp, Artificial Sequence
  chemically synthesized
ctgcgtagtaaaaggaaggaga

SEQ ID NO: 1003993 - DNA, 22 bp, Artificial Sequence
  chemically synthesized
ctctttatccttctccttcctt

SEQ ID NO: 1003994 - DNA, 22 bp, Artificial Sequence
  chemically synthesized
tctttatccttctccttccttt

SEQ ID NO: 1003995 - DNA, 22 bp, Artificial Sequence
  chemically synthesized
tttatccttctccttcctttta

SEQ ID NO: 1003996 - DNA, 22 bp, Artificial Sequence
  chemically synthesized
tatccttctccttccttttact

SEQ ID NO: 1003997 - DNA, 22 bp, Artificial Sequence
  chemically synthesized
atccttctccttccttttacta

SEQ ID NO: 1003998 - DNA, 22 bp, Artificial Sequence
  chemically synthesized
tccttctccttccttttactac

SEQ ID NO: 1003999 - DNA, 22 bp, Artificial Sequence
  chemically synthesized
gaagtatgcctgctgcgtagta

SEQ ID NO: 1004000 - DNA, 22 bp, Artificial Sequence
  chemically synthesized
ctccttccttttactacgcagc

SEQ ID NO: 1004001 - DNA, 22 bp, Artificial Sequence
  chemically synthesized
tccttccttttactacgcagca

SEQ ID NO: 1004002 - DNA, 22 bp, Artificial Sequence
  chemically synthesized
cttccttttactacgcagcagg

SEQ ID NO: 1004003 - DNA, 22 bp, Artificial Sequence
  chemically synthesized
ccttttactacgcagcaggcat

SEQ ID NO: 1004004 - DNA, 22 bp, Artificial Sequence
  chemically synthesized
cttttactacgcagcaggcata

SEQ ID NO: 1004005 - DNA, 22 bp, Artificial Sequence
  chemically synthesized
ttactacgcagcaggcatactt

SEQ ID NO: 1004006 - DNA, 22 bp, Artificial Sequence
  chemically synthesized
tactacgcagcaggcatacttc

SEQ ID NO: 1004007 - DNA, 22 bp, Artificial Sequence
  chemically synthesized
actacgcagcaggcatacttct

SEQ ID NO: 1004008 - DNA, 22 bp, Artificial Sequence
  chemically synthesized
ctacgcagcaggcatacttcta

SEQ ID NO: 1004009 - DNA, 22 bp, Artificial Sequence
  chemically synthesized
cgcagcaggcatacttctagga

SEQ ID NO: 1004010 - DNA, 22 bp, Artificial Sequence
  chemically synthesized
tataggaaaaaaaaaaaaatcc

SEQ ID NO: 1004011 - DNA, 22 bp, Artificial Sequence
  chemically synthesized
ctaggatttttttttttttcct

SEQ ID NO: 1004012 - DNA, 22 bp, Artificial Sequence
  chemically synthesized
taggatttttttttttttccta

SEQ ID NO: 1004013 - DNA, 22 bp, Artificial Sequence
  chemically synthesized
ggatttttttttttttcctata

SEQ ID NO: 1004014 - DNA, 22 bp, Artificial Sequence
  chemically synthesized
ttttttttttcctatataacca

SEQ ID NO: 1004015 - DNA, 22 bp, Artificial Sequence
  chemically synthesized
tttttttttcctatataaccac

SEQ ID NO: 1004016 - DNA, 22 bp, Artificial Sequence
  chemically synthesized
cggaaataatatgtggttatat

SEQ ID NO: 1004017 - DNA, 22 bp, Artificial Sequence
  chemically synthesized
ttttttttcctatataaccaca

SEQ ID NO: 1004018 - DNA, 22 bp, Artificial Sequence
  chemically synthesized
gcggaaataatatgtggttata

SEQ ID NO: 1004019 - DNA, 22 bp, Artificial Sequence
  chemically synthesized
tttttttcctatataaccacat

SEQ ID NO: 1004020 - DNA, 22 bp, Artificial Sequence
  chemically synthesized
tgcggaaataatatgtggttat

SEQ ID NO: 1004021 - DNA, 22 bp, Artificial Sequence
  chemically synthesized
ttttttcctatataaccacata

SEQ ID NO: 1004022 - DNA, 22 bp, Artificial Sequence
  chemically synthesized
tttttcctatataaccacatat

SEQ ID NO: 1004023 - DNA, 22 bp, Artificial Sequence
  chemically synthesized
ttttcctatataaccacatatt

SEQ ID NO: 1004024 - DNA, 22 bp, Artificial Sequence
  chemically synthesized
tttcctatataaccacatatta

SEQ ID NO: 1004025 - DNA, 22 bp, Artificial Sequence
  chemically synthesized
ttcctatataaccacatattat

SEQ ID NO: 1004026 - DNA, 22 bp, Artificial Sequence
  chemically synthesized
tcctatataaccacatattatt

SEQ ID NO: 1004027 - DNA, 22 bp, Artificial Sequence
  chemically synthesized
cctatataaccacatattattt

SEQ ID NO: 1004028 - DNA, 22 bp, Artificial Sequence
  chemically synthesized
ataactttgcggaaataatatg

SEQ ID NO: 1004029 - DNA, 22 bp, Artificial Sequence
  chemically synthesized
ctatataaccacatattatttc

SEQ ID NO: 1004030 - DNA, 22 bp, Artificial Sequence
  chemically synthesized
ctaataactttgcggaaataat

SEQ ID NO: 1004031 - DNA, 22 bp, Artificial Sequence
  chemically synthesized
tataaccacatattatttccgc

SEQ ID NO: 1004032 - DNA, 22 bp, Artificial Sequence
  chemically synthesized
cctaataactttgcggaaataa

SEQ ID NO: 1004033 - DNA, 22 bp, Artificial Sequence
  chemically synthesized
tttccgcaaagttattaggaag

SEQ ID NO: 1004034 - DNA, 22 bp, Artificial Sequence
  chemically synthesized
gaaagtcccatgtacttcctaa

SEQ ID NO: 1004035 - DNA, 22 bp, Artificial Sequence
  chemically synthesized
ccgcaaagttattaggaagtac

SEQ ID NO: 1004036 - DNA, 22 bp, Artificial Sequence
  chemically synthesized
cgcaaagttattaggaagtaca

SEQ ID NO: 1004037 - DNA, 22 bp, Artificial Sequence
  chemically synthesized
ttaggaagtacatgggactttc

SEQ ID NO: 1004038 - DNA, 22 bp, Artificial Sequence
  chemically synthesized
ggaagtacatgggactttccag

SEQ ID NO: 1004039 - DNA, 22 bp, Artificial Sequence
  chemically synthesized
tccaatgtgaaatggggctgga

SEQ ID NO: 1004040 - DNA, 22 bp, Artificial Sequence
  chemically synthesized
atccaatgtgaaatggggctgg

SEQ ID NO: 1004041 - DNA, 22 bp, Artificial Sequence
  chemically synthesized
tatccaatgtgaaatggggctg

SEQ ID NO: 1004042 - DNA, 22 bp, Artificial Sequence
  chemically synthesized
agttttatccaatgtgaaatgg

SEQ ID NO: 1004043 - DNA, 22 bp, Artificial Sequence
  chemically synthesized
tccagccccatttcacattgga

SEQ ID NO: 1004044 - DNA, 22 bp, Artificial Sequence
  chemically synthesized
ccagccccatttcacattggat

SEQ ID NO: 1004045 - DNA, 22 bp, Artificial Sequence
  chemically synthesized
cagccccatttcacattggata

SEQ ID NO: 1004046 - DNA, 22 bp, Artificial Sequence
  chemically synthesized
atgcctcagttttatccaatgt

SEQ ID NO: 1004047 - DNA, 22 bp, Artificial Sequence
  chemically synthesized
ttcatgcctcagttttatccaa

SEQ ID NO: 1004048 - DNA, 22 bp, Artificial Sequence
  chemically synthesized
attcatgcctcagttttatcca

SEQ ID NO: 1004049 - DNA, 22 bp, Artificial Sequence
  chemically synthesized
gcttattcatgcctcagtttta

SEQ ID NO: 1004050 - DNA, 22 bp, Artificial Sequence
  chemically synthesized
agcttattcatgcctcagtttt

SEQ ID NO: 1004051 - DNA, 22 bp, Artificial Sequence
  chemically synthesized
cacattggataaaactgaggca

SEQ ID NO: 1004052 - DNA, 22 bp, Artificial Sequence
  chemically synthesized
acattggataaaactgaggcat

SEQ ID NO: 1004053 - DNA, 22 bp, Artificial Sequence
  chemically synthesized
gataaaactgaggcatgaataa

SEQ ID NO: 1004054 - DNA, 22 bp, Artificial Sequence
  chemically synthesized
gcaggtgacttagcttattcat

SEQ ID NO: 1004055 - DNA, 22 bp, Artificial Sequence
  chemically synthesized
ggcaggtgacttagcttattca

SEQ ID NO: 1004056 - DNA, 22 bp, Artificial Sequence
  chemically synthesized
tggcaggtgacttagcttattc

SEQ ID NO: 1004057 - DNA, 22 bp, Artificial Sequence
  chemically synthesized
aggcatgaataagctaagtcac

SEQ ID NO: 1004058 - DNA, 22 bp, Artificial Sequence
  chemically synthesized
ccacccacgtgacctttggcag

SEQ ID NO: 1004059 - DNA, 22 bp, Artificial Sequence
  chemically synthesized
gccacccacgtgacctttggca

SEQ ID NO: 1004060 - DNA, 22 bp, Artificial Sequence
  chemically synthesized
agtcacctgccaaaggtcacgt

SEQ ID NO: 1004061 - DNA, 22 bp, Artificial Sequence
  chemically synthesized
aagatatttgccacccacgtga

SEQ ID NO: 1004062 - DNA, 22 bp, Artificial Sequence
  chemically synthesized
ctgaagatatttgccacccacg

SEQ ID NO: 1004063 - DNA, 22 bp, Artificial Sequence
  chemically synthesized
gctgaagatatttgccacccac

SEQ ID NO: 1004064 - DNA, 22 bp, Artificial Sequence
  chemically synthesized
ccaaaggtcacgtgggtggcaa

SEQ ID NO: 1004065 - DNA, 22 bp, Artificial Sequence
  chemically synthesized
tgctgaagatatttgccaccca

SEQ ID NO: 1004066 - DNA, 22 bp, Artificial Sequence
  chemically synthesized
gggtcaaaattttgctgaagat

SEQ ID NO: 1004067 - DNA, 22 bp, Artificial Sequence
  chemically synthesized
ggggtcaaaattttgctgaaga

SEQ ID NO: 1004068 - DNA, 22 bp, Artificial Sequence
  chemically synthesized
tggggtcaaaattttgctgaag

SEQ ID NO: 1004069 - DNA, 22 bp, Artificial Sequence
  chemically synthesized
ttggggtcaaaattttgctgaa

SEQ ID NO: 1004070 - DNA, 22 bp, Artificial Sequence
  chemically synthesized
ggcttttggggtcaaaattttg

SEQ ID NO: 1004071 - DNA, 22 bp, Artificial Sequence
  chemically synthesized
atagttaggcttttggggtcaa

SEQ ID NO: 1004072 - DNA, 22 bp, Artificial Sequence
  chemically synthesized
cagcaaaattttgaccccaaaa

SEQ ID NO: 1004073 - DNA, 22 bp, Artificial Sequence
  chemically synthesized
agcaaaattttgaccccaaaag

SEQ ID NO: 1004074 - DNA, 22 bp, Artificial Sequence
  chemically synthesized
tgaactcatagttaggcttttg

SEQ ID NO: 1004075 - DNA, 22 bp, Artificial Sequence
  chemically synthesized
tgaccccaaaagcctaactatg

SEQ ID NO: 1004076 - DNA, 22 bp, Artificial Sequence
  chemically synthesized
gaccccaaaagcctaactatga

SEQ ID NO: 1004077 - DNA, 22 bp, Artificial Sequence
  chemically synthesized
accccaaaagcctaactatgag

SEQ ID NO: 1004078 - DNA, 22 bp, Artificial Sequence
  chemically synthesized
cacagttatgaactcatagtta

SEQ ID NO: 1004079 - DNA, 22 bp, Artificial Sequence
  chemically synthesized
ctgcacagttatgaactcatag

SEQ ID NO: 1004080 - DNA, 22 bp, Artificial Sequence
  chemically synthesized
tactgcacagttatgaactcat

SEQ ID NO: 1004081 - DNA, 22 bp, Artificial Sequence
  chemically synthesized
actatgagttcataactgtgca

SEQ ID NO: 1004082 - DNA, 22 bp, Artificial Sequence
  chemically synthesized
tgagttcataactgtgcagtag

SEQ ID NO: 1004083 - DNA, 22 bp, Artificial Sequence
  chemically synthesized
ataactgtgcagtagaaccctt

SEQ ID NO: 1004084 - DNA, 22 bp, Artificial Sequence
  chemically synthesized
tgggaccaaagatgaaagggtt

SEQ ID NO: 1004085 - DNA, 22 bp, Artificial Sequence
  chemically synthesized
tgcagtagaaccctttcatctt

SEQ ID NO: 1004086 - DNA, 22 bp, Artificial Sequence
  chemically synthesized
tcatctttggtcccatagcact

SEQ ID NO: 1004087 - DNA, 22 bp, Artificial Sequence
  chemically synthesized
catctttggtcccatagcactt

SEQ ID NO: 1004088 - DNA, 22 bp, Artificial Sequence
  chemically synthesized
atctttggtcccatagcactta

SEQ ID NO: 1004089 - DNA, 22 bp, Artificial Sequence
  chemically synthesized
tggtcccatagcacttatcata

SEQ ID NO: 1004090 - DNA, 22 bp, Artificial Sequence
  chemically synthesized
ggtcccatagcacttatcatac

SEQ ID NO: 1004091 - DNA, 22 bp, Artificial Sequence
  chemically synthesized
gtcccatagcacttatcatact

SEQ ID NO: 1004092 - DNA, 22 bp, Artificial Sequence
  chemically synthesized
atcatactgtattgttttgtta

SEQ ID NO: 1004093 - DNA, 22 bp, Artificial Sequence
  chemically synthesized
tcatactgtattgttttgttac

SEQ ID NO: 1004094 - DNA, 22 bp, Artificial Sequence
  chemically synthesized
aagtataataaaaaaaatgtaa

SEQ ID NO: 1004095 - DNA, 22 bp, Artificial Sequence
  chemically synthesized
aaagtataataaaaaaaatgta

SEQ ID NO: 1004096 - DNA, 22 bp, Artificial Sequence
  chemically synthesized
tattgttttgttacattttttt

SEQ ID NO: 1004097 - DNA, 22 bp, Artificial Sequence
  chemically synthesized
ttttgttacattttttttatta

SEQ ID NO: 1004098 - DNA, 22 bp, Artificial Sequence
  chemically synthesized
gaacttaaagtataataaaaaa

SEQ ID NO: 1004099 - DNA, 22 bp, Artificial Sequence
  chemically synthesized
tgttacattttttttattatac

SEQ ID NO: 1004100 - DNA, 22 bp, Artificial Sequence
  chemically synthesized
gttacattttttttattatact

SEQ ID NO: 1004101 - DNA, 22 bp, Artificial Sequence
  chemically synthesized
ttacattttttttattatactt

SEQ ID NO: 1004102 - DNA, 22 bp, Artificial Sequence
  chemically synthesized
cattttttttattatactttaa

SEQ ID NO: 1004103 - DNA, 22 bp, Artificial Sequence
  chemically synthesized
tttttattatactttaagttct

SEQ ID NO: 1004104 - DNA, 22 bp, Artificial Sequence
  chemically synthesized
ttttattatactttaagttcta

SEQ ID NO: 1004105 - DNA, 22 bp, Artificial Sequence
  chemically synthesized
tttattatactttaagttctag

SEQ ID NO: 1004106 - DNA, 22 bp, Artificial Sequence
  chemically synthesized
tgcacatgtaccctagaactta

SEQ ID NO: 1004107 - DNA, 22 bp, Artificial Sequence
  chemically synthesized
ttattatactttaagttctagg

SEQ ID NO: 1004108 - DNA, 22 bp, Artificial Sequence
  chemically synthesized
tattatactttaagttctaggg

SEQ ID NO: 1004109 - DNA, 22 bp, Artificial Sequence
  chemically synthesized
attatactttaagttctagggt

SEQ ID NO: 1004110 - DNA, 22 bp, Artificial Sequence
  chemically synthesized
ttatactttaagttctagggta

SEQ ID NO: 1004111 - DNA, 22 bp, Artificial Sequence
  chemically synthesized
tactttaagttctagggtacat

SEQ ID NO: 1004112 - DNA, 22 bp, Artificial Sequence
  chemically synthesized
catgttgtgcacatgtacccta

SEQ ID NO: 1004113 - DNA, 22 bp, Artificial Sequence
  chemically synthesized
taagttctagggtacatgtgca

SEQ ID NO: 1004114 - DNA, 22 bp, Artificial Sequence
  chemically synthesized
aagttctagggtacatgtgcac

SEQ ID NO: 1004115 - DNA, 22 bp, Artificial Sequence
  chemically synthesized
agttctagggtacatgtgcaca

SEQ ID NO: 1004116 - DNA, 22 bp, Artificial Sequence
  chemically synthesized
tagggtacatgtgcacaacatg

SEQ ID NO: 1004117 - DNA, 22 bp, Artificial Sequence
  chemically synthesized
gggtacatgtgcacaacatgca

SEQ ID NO: 1004118 - DNA, 22 bp, Artificial Sequence
  chemically synthesized
cacatgtatacatatgtaacaa

SEQ ID NO: 1004119 - DNA, 22 bp, Artificial Sequence
  chemically synthesized
ttacacatgtatacatatgtaa

SEQ ID NO: 1004120 - DNA, 22 bp, Artificial Sequence
  chemically synthesized
cagtctattacacatgtataca

SEQ ID NO: 1004121 - DNA, 22 bp, Artificial Sequence
  chemically synthesized
gttacatatgtatacatgtgta

SEQ ID NO: 1004122 - DNA, 22 bp, Artificial Sequence
  chemically synthesized
ttacatatgtatacatgtgtaa

SEQ ID NO: 1004123 - DNA, 22 bp, Artificial Sequence
  chemically synthesized
catatgtatacatgtgtaatag

SEQ ID NO: 1004124 - DNA, 22 bp, Artificial Sequence
  chemically synthesized
catatagctacagtctattaca

SEQ ID NO: 1004125 - DNA, 22 bp, Artificial Sequence
  chemically synthesized
acatatagctacagtctattac

SEQ ID NO: 1004126 - DNA, 22 bp, Artificial Sequence
  chemically synthesized
gtatgtttacatatagctacag

SEQ ID NO: 1004127 - DNA, 22 bp, Artificial Sequence
  chemically synthesized
agaaagctggtatgtttacata

SEQ ID NO: 1004128 - DNA, 22 bp, Artificial Sequence
  chemically synthesized
tagctatatgtaaacataccag

SEQ ID NO: 1004129 - DNA, 22 bp, Artificial Sequence
  chemically synthesized
tatgtaaacataccagctttct

SEQ ID NO: 1004130 - DNA, 22 bp, Artificial Sequence
  chemically synthesized
tgaggaagtaacatctaagaaa

SEQ ID NO: 1004131 - DNA, 22 bp, Artificial Sequence
  chemically synthesized
atgaggaagtaacatctaagaa

SEQ ID NO: 1004132 - DNA, 22 bp, Artificial Sequence
  chemically synthesized
tatgaggaagtaacatctaaga

SEQ ID NO: 1004133 - DNA, 22 bp, Artificial Sequence
  chemically synthesized
tcttagatgttacttcctcata

SEQ ID NO: 1004134 - DNA, 22 bp, Artificial Sequence
  chemically synthesized
gggggaggtctttatgaggaag

SEQ ID NO: 1004135 - DNA, 22 bp, Artificial Sequence
  chemically synthesized
cttagatgttacttcctcataa

SEQ ID NO: 1004136 - DNA, 22 bp, Artificial Sequence
  chemically synthesized
ttagatgttacttcctcataaa

SEQ ID NO: 1004137 - DNA, 22 bp, Artificial Sequence
  chemically synthesized
agatgttacttcctcataaaga

SEQ ID NO: 1004138 - DNA, 22 bp, Artificial Sequence
  chemically synthesized
gatgttacttcctcataaagac

SEQ ID NO: 1004139 - DNA, 22 bp, Artificial Sequence
  chemically synthesized
gtctagggggaggtctttatga

SEQ ID NO: 1004140 - DNA, 22 bp, Artificial Sequence
  chemically synthesized
cttcctcataaagacctccccc

SEQ ID NO: 1004141 - DNA, 22 bp, Artificial Sequence
  chemically synthesized
cctcataaagacctccccctag

SEQ ID NO: 1004142 - DNA, 22 bp, Artificial Sequence
  chemically synthesized
aaaatcactggtctagggggag

SEQ ID NO: 1004143 - DNA, 22 bp, Artificial Sequence
  chemically synthesized
ctcataaagacctccccctaga

SEQ ID NO: 1004144 - DNA, 22 bp, Artificial Sequence
  chemically synthesized
ataaagacctccccctagacca

SEQ ID NO: 1004145 - DNA, 22 bp, Artificial Sequence
  chemically synthesized
gttgaaaatcactggtctaggg

SEQ ID NO: 1004146 - DNA, 22 bp, Artificial Sequence
  chemically synthesized
cccctagaccagtgattttcaa

SEQ ID NO: 1004147 - DNA, 22 bp, Artificial Sequence
  chemically synthesized
gaccagtgattttcaactaggg

SEQ ID NO: 1004148 - DNA, 22 bp, Artificial Sequence
  chemically synthesized
gggagcaaaatcatccctagtt

SEQ ID NO: 1004149 - DNA, 22 bp, Artificial Sequence
  chemically synthesized
ggggagcaaaatcatccctagt

SEQ ID NO: 1004150 - DNA, 22 bp, Artificial Sequence
  chemically synthesized
tcaactagggatgattttgctc

SEQ ID NO: 1004151 - DNA, 22 bp, Artificial Sequence
  chemically synthesized
caactagggatgattttgctcc

SEQ ID NO: 1004152 - DNA, 22 bp, Artificial Sequence
  chemically synthesized
aactagggatgattttgctccc

SEQ ID NO: 1004153 - DNA, 22 bp, Artificial Sequence
  chemically synthesized
caaatgtcccttggggagcaaa

SEQ ID NO: 1004154 - DNA, 22 bp, Artificial Sequence
  chemically synthesized
ccaaatgtcccttggggagcaa

SEQ ID NO: 1004155 - DNA, 22 bp, Artificial Sequence
  chemically synthesized
gggatgattttgctccccaagg

SEQ ID NO: 1004156 - DNA, 22 bp, Artificial Sequence
  chemically synthesized
tcccagacatttccaaatgtcc

SEQ ID NO: 1004157 - DNA, 22 bp, Artificial Sequence
  chemically synthesized
tgctccccaagggacatttgga

SEQ ID NO: 1004158 - DNA, 22 bp, Artificial Sequence
  chemically synthesized
gtcccagacatttccaaatgtc

SEQ ID NO: 1004159 - DNA, 22 bp, Artificial Sequence
  chemically synthesized
gctccccaagggacatttggaa

SEQ ID NO: 1004160 - DNA, 22 bp, Artificial Sequence
  chemically synthesized
ctccccaagggacatttggaaa

SEQ ID NO: 1004161 - DNA, 22 bp, Artificial Sequence
  chemically synthesized
cccaagggacatttggaaatgt

SEQ ID NO: 1004162 - DNA, 22 bp, Artificial Sequence
  chemically synthesized
atcacaaatttgtcccagacat

SEQ ID NO: 1004163 - DNA, 22 bp, Artificial Sequence
  chemically synthesized
aatcacaaatttgtcccagaca

SEQ ID NO: 1004164 - DNA, 22 bp, Artificial Sequence
  chemically synthesized
taatcacaaatttgtcccagac

SEQ ID NO: 1004165 - DNA, 22 bp, Artificial Sequence
  chemically synthesized
tttaatcacaaatttgtcccag

SEQ ID NO: 1004166 - DNA, 22 bp, Artificial Sequence
  chemically synthesized
ctttaatcacaaatttgtccca

SEQ ID NO: 1004167 - DNA, 22 bp, Artificial Sequence
  chemically synthesized
ttctttaatcacaaatttgtcc

SEQ ID NO: 1004168 - DNA, 22 bp, Artificial Sequence
  chemically synthesized
ggaaatgtctgggacaaatttg

SEQ ID NO: 1004169 - DNA, 22 bp, Artificial Sequence
  chemically synthesized
gaaatgtctgggacaaatttgt

SEQ ID NO: 1004170 - DNA, 22 bp, Artificial Sequence
  chemically synthesized
tcttctttaatcacaaatttgt

SEQ ID NO: 1004171 - DNA, 22 bp, Artificial Sequence
  chemically synthesized
ggacaaatttgtgattaaagaa

SEQ ID NO: 1004172 - DNA, 22 bp, Artificial Sequence
  chemically synthesized
gatgccaatagtactctcttct

SEQ ID NO: 1004173 - DNA, 22 bp, Artificial Sequence
  chemically synthesized
gtgattaaagaagagagtacta

SEQ ID NO: 1004174 - DNA, 22 bp, Artificial Sequence
  chemically synthesized
tgattaaagaagagagtactat

SEQ ID NO: 1004175 - DNA, 22 bp, Artificial Sequence
  chemically synthesized
cccattagatgccaatagtact

SEQ ID NO: 1004176 - DNA, 22 bp, Artificial Sequence
  chemically synthesized
tgcccattagatgccaatagta

SEQ ID NO: 1004177 - DNA, 22 bp, Artificial Sequence
  chemically synthesized
aagaagagagtactattggcat

SEQ ID NO: 1004178 - DNA, 22 bp, Artificial Sequence
  chemically synthesized
acctctgcccattagatgccaa

SEQ ID NO: 1004179 - DNA, 22 bp, Artificial Sequence
  chemically synthesized
ttggcatctaatgggcagaggt

SEQ ID NO: 1004180 - DNA, 22 bp, Artificial Sequence
  chemically synthesized
gcatcacaactgacctctgccc

SEQ ID NO: 1004181 - DNA, 22 bp, Artificial Sequence
  chemically synthesized
ggcatcacaactgacctctgcc

SEQ ID NO: 1004182 - DNA, 22 bp, Artificial Sequence
  chemically synthesized
gcatctaatgggcagaggtcag

SEQ ID NO: 1004183 - DNA, 22 bp, Artificial Sequence
  chemically synthesized
atgggcagaggtcagttgtgat

SEQ ID NO: 1004184 - DNA, 22 bp, Artificial Sequence
  chemically synthesized
taggatgtttggcatcacaact

SEQ ID NO: 1004185 - DNA, 22 bp, Artificial Sequence
  chemically synthesized
tccactataggatgtttggcat

SEQ ID NO: 1004186 - DNA, 22 bp, Artificial Sequence
  chemically synthesized
ccctgtccactataggatgttt

SEQ ID NO: 1004187 - DNA, 22 bp, Artificial Sequence
  chemically synthesized
tgatgccaaacatcctatagtg

SEQ ID NO: 1004188 - DNA, 22 bp, Artificial Sequence
  chemically synthesized
tggtggactgccctgtccacta

SEQ ID NO: 1004189 - DNA, 22 bp, Artificial Sequence
  chemically synthesized
ttgtggtggactgccctgtcca

SEQ ID NO: 1004190 - DNA, 22 bp, Artificial Sequence
  chemically synthesized
gttgtggtggactgccctgtcc

SEQ ID NO: 1004191 - DNA, 22 bp, Artificial Sequence
  chemically synthesized
tgttgtggtggactgccctgtc

SEQ ID NO: 1004192 - DNA, 22 bp, Artificial Sequence
  chemically synthesized
tagtggacagggcagtccacca

SEQ ID NO: 1004193 - DNA, 22 bp, Artificial Sequence
  chemically synthesized
agccaaatacatctttgttgtg

SEQ ID NO: 1004194 - DNA, 22 bp, Artificial Sequence
  chemically synthesized
gagccaaatacatctttgttgt

SEQ ID NO: 1004195 - DNA, 22 bp, Artificial Sequence
  chemically synthesized
tgagccaaatacatctttgttg

SEQ ID NO: 1004196 - DNA, 22 bp, Artificial Sequence
  chemically synthesized
acgttttgagccaaatacatct

SEQ ID NO: 1004197 - DNA, 22 bp, Artificial Sequence
  chemically synthesized
tgacgttttgagccaaatacat

SEQ ID NO: 1004198 - DNA, 22 bp, Artificial Sequence
  chemically synthesized
aatctctgacgttttgagccaa

SEQ ID NO: 1004199 - DNA, 22 bp, Artificial Sequence
  chemically synthesized
tcaatctctgacgttttgagcc

SEQ ID NO: 1004200 - DNA, 22 bp, Artificial Sequence
  chemically synthesized
ctcaatctctgacgttttgagc

SEQ ID NO: 1004201 - DNA, 22 bp, Artificial Sequence
  chemically synthesized
ggctcaaaacgtcagagattga

SEQ ID NO: 1004202 - DNA, 22 bp, Artificial Sequence
  chemically synthesized
cggcaatgtttctcaatctctg

SEQ ID NO: 1004203 - DNA, 22 bp, Artificial Sequence
  chemically synthesized
gctcaaaacgtcagagattgag

SEQ ID NO: 1004204 - DNA, 22 bp, Artificial Sequence
  chemically synthesized
aaaacgtcagagattgagaaac

SEQ ID NO: 1004205 - DNA, 22 bp, Artificial Sequence
  chemically synthesized
atctacggcaatgtttctcaat

SEQ ID NO: 1004206 - DNA, 22 bp, Artificial Sequence
  chemically synthesized
agaagatgacaattgatctacg

SEQ ID NO: 1004207 - DNA, 22 bp, Artificial Sequence
  chemically synthesized
agaaacattgccgtagatcaat

SEQ ID NO: 1004208 - DNA, 22 bp, Artificial Sequence
  chemically synthesized
ccgtagatcaattgtcatcttc

SEQ ID NO: 1004209 - DNA, 22 bp, Artificial Sequence
  chemically synthesized
catgtgtaaacgtcaaagttca

SEQ ID NO: 1004210 - DNA, 22 bp, Artificial Sequence
  chemically synthesized
tcatcttctgaactttgacgtt

SEQ ID NO: 1004211 - DNA, 22 bp, Artificial Sequence
  chemically synthesized
gttgcatgtgtaaacgtcaaag

SEQ ID NO: 1004212 - DNA, 22 bp, Artificial Sequence
  chemically synthesized
ctgaactttgacgtttacacat

SEQ ID NO: 1004213 - DNA, 22 bp, Artificial Sequence
  chemically synthesized
tgaactttgacgtttacacatg

SEQ ID NO: 1004214 - DNA, 22 bp, Artificial Sequence
  chemically synthesized
tacaattagttgcatgtgtaaa

SEQ ID NO: 1004215 - DNA, 22 bp, Artificial Sequence
  chemically synthesized
aactttgacgtttacacatgca

SEQ ID NO: 1004216 - DNA, 22 bp, Artificial Sequence
  chemically synthesized
tgacgtttacacatgcaactaa

SEQ ID NO: 1004217 - DNA, 22 bp, Artificial Sequence
  chemically synthesized
gacgtttacacatgcaactaat

SEQ ID NO: 1004218 - DNA, 22 bp, Artificial Sequence
  chemically synthesized
aataattgtacaattagttgca

SEQ ID NO: 1004219 - DNA, 22 bp, Artificial Sequence
  chemically synthesized
acgtttacacatgcaactaatt

SEQ ID NO: 1004220 - DNA, 22 bp, Artificial Sequence
  chemically synthesized
acacatgcaactaattgtacaa

SEQ ID NO: 1004221 - DNA, 22 bp, Artificial Sequence
  chemically synthesized
cacatgcaactaattgtacaat

SEQ ID NO: 1004222 - DNA, 22 bp, Artificial Sequence
  chemically synthesized
attgtacaattatttaacatct

SEQ ID NO: 1004223 - DNA, 22 bp, Artificial Sequence
  chemically synthesized
tacaattatttaacatctgtac

SEQ ID NO: 1004224 - DNA, 22 bp, Artificial Sequence
  chemically synthesized
tttaacatctgtacacccattc

SEQ ID NO: 1004225 - DNA, 22 bp, Artificial Sequence
  chemically synthesized
gtggtgaaagcagtgaatgggt

SEQ ID NO: 1004226 - DNA, 22 bp, Artificial Sequence
  chemically synthesized
aacatctgtacacccattcact

SEQ ID NO: 1004227 - DNA, 22 bp, Artificial Sequence
  chemically synthesized
acatctgtacacccattcactg

SEQ ID NO: 1004228 - DNA, 22 bp, Artificial Sequence
  chemically synthesized
agtctagtggtgaaagcagtga

SEQ ID NO: 1004229 - DNA, 22 bp, Artificial Sequence
  chemically synthesized
cagtctagtggtgaaagcagtg

SEQ ID NO: 1004230 - DNA, 22 bp, Artificial Sequence
  chemically synthesized
tcagtctagtggtgaaagcagt

SEQ ID NO: 1004231 - DNA, 22 bp, Artificial Sequence
  chemically synthesized
tacacccattcactgctttcac

SEQ ID NO: 1004232 - DNA, 22 bp, Artificial Sequence
  chemically synthesized
ttcagtctagtggtgaaagcag

SEQ ID NO: 1004233 - DNA, 22 bp, Artificial Sequence
  chemically synthesized
atggagtttttcagtctagtgg

SEQ ID NO: 1004234 - DNA, 22 bp, Artificial Sequence
  chemically synthesized
actgctttcaccactagactga

SEQ ID NO: 1004235 - DNA, 22 bp, Artificial Sequence
  chemically synthesized
tgatggagtttttcagtctagt

SEQ ID NO: 1004236 - DNA, 22 bp, Artificial Sequence
  chemically synthesized
ctttcaccactagactgaaaaa

SEQ ID NO: 1004237 - DNA, 22 bp, Artificial Sequence
  chemically synthesized
tcaccactagactgaaaaactc

SEQ ID NO: 1004238 - DNA, 22 bp, Artificial Sequence
  chemically synthesized
caccactagactgaaaaactcc

SEQ ID NO: 1004239 - DNA, 22 bp, Artificial Sequence
  chemically synthesized
accactagactgaaaaactcca

SEQ ID NO: 1004240 - DNA, 22 bp, Artificial Sequence
  chemically synthesized
gactgaaaaactccatcagaga

SEQ ID NO: 1004241 - DNA, 22 bp, Artificial Sequence
  chemically synthesized
cacaaaacatatgtggtctctg

SEQ ID NO: 1004242 - DNA, 22 bp, Artificial Sequence
  chemically synthesized
aaaaactccatcagagaccaca

SEQ ID NO: 1004243 - DNA, 22 bp, Artificial Sequence
  chemically synthesized
catcagagaccacatatgtttt

SEQ ID NO: 1004244 - DNA, 22 bp, Artificial Sequence
  chemically synthesized
cggaaggcacaggcggtatagc

SEQ ID NO: 1004245 - DNA, 22 bp, Artificial Sequence
  chemically synthesized
ttgcggaaggcacaggcggtat

SEQ ID NO: 1004246 - DNA, 22 bp, Artificial Sequence
  chemically synthesized
tgtgcaatgctataccgcctgt

SEQ ID NO: 1004247 - DNA, 22 bp, Artificial Sequence
  chemically synthesized
attgcggaaggcacaggcggta

SEQ ID NO: 1004248 - DNA, 22 bp, Artificial Sequence
  chemically synthesized
gtgcaatgctataccgcctgtg

SEQ ID NO: 1004249 - DNA, 22 bp, Artificial Sequence
  chemically synthesized
tgcaatgctataccgcctgtgc

SEQ ID NO: 1004250 - DNA, 22 bp, Artificial Sequence
  chemically synthesized
tgtcacttattgcggaaggcac

SEQ ID NO: 1004251 - DNA, 22 bp, Artificial Sequence
  chemically synthesized
ctgtgtcacttattgcggaagg

SEQ ID NO: 1004252 - DNA, 22 bp, Artificial Sequence
  chemically synthesized
taccgcctgtgccttccgcaat

SEQ ID NO: 1004253 - DNA, 22 bp, Artificial Sequence
  chemically synthesized
tgccttccgcaataagtgacac

SEQ ID NO: 1004254 - DNA, 22 bp, Artificial Sequence
  chemically synthesized
atgagtgtctgctgtgtcactt

SEQ ID NO: 1004255 - DNA, 22 bp, Artificial Sequence
  chemically synthesized
aatgagtgtctgctgtgtcact

SEQ ID NO: 1004256 - DNA, 22 bp, Artificial Sequence
  chemically synthesized
ccgcaataagtgacacagcaga

SEQ ID NO: 1004257 - DNA, 22 bp, Artificial Sequence
  chemically synthesized
cgcaataagtgacacagcagac

SEQ ID NO: 1004258 - DNA, 22 bp, Artificial Sequence
  chemically synthesized
tacttaatgagtgtctgctgtg

SEQ ID NO: 1004259 - DNA, 22 bp, Artificial Sequence
  chemically synthesized
atacttaatgagtgtctgctgt

SEQ ID NO: 1004260 - DNA, 22 bp, Artificial Sequence
  chemically synthesized
agcttatacttaatgagtgtct

SEQ ID NO: 1004261 - DNA, 22 bp, Artificial Sequence
  chemically synthesized
actaagcttatacttaatgagt

SEQ ID NO: 1004262 - DNA, 22 bp, Artificial Sequence
  chemically synthesized
actcactaagcttatacttaat

SEQ ID NO: 1004263 - DNA, 22 bp, Artificial Sequence
  chemically synthesized
ttcactcactaagcttatactt

SEQ ID NO: 1004264 - DNA, 22 bp, Artificial Sequence
  chemically synthesized
tccactattcactcactaagct

SEQ ID NO: 1004265 - DNA, 22 bp, Artificial Sequence
  chemically synthesized
attaagtataagcttagtgagt

SEQ ID NO: 1004266 - DNA, 22 bp, Artificial Sequence
  chemically synthesized
agttatccactattcactcact

SEQ ID NO: 1004267 - DNA, 22 bp, Artificial Sequence
  chemically synthesized
agtataagcttagtgagtgaat

SEQ ID NO: 1004268 - DNA, 22 bp, Artificial Sequence
  chemically synthesized
aagttatccactattcactcac

SEQ ID NO: 1004269 - DNA, 22 bp, Artificial Sequence
  chemically synthesized
taagttatccactattcactca

SEQ ID NO: 1004270 - DNA, 22 bp, Artificial Sequence
  chemically synthesized
taaaactttaagttatccacta

SEQ ID NO: 1004271 - DNA, 22 bp, Artificial Sequence
  chemically synthesized
agtgagtgaatagtggataact

SEQ ID NO: 1004272 - DNA, 22 bp, Artificial Sequence
  chemically synthesized
gtgagtgaatagtggataactt

SEQ ID NO: 1004273 - DNA, 22 bp, Artificial Sequence
  chemically synthesized
acaagtcccatgtatacactat

SEQ ID NO: 1004274 - DNA, 22 bp, Artificial Sequence
  chemically synthesized
gacaagtcccatgtatacacta

SEQ ID NO: 1004275 - DNA, 22 bp, Artificial Sequence
  chemically synthesized
ttgacaagtcccatgtatacac

SEQ ID NO: 1004276 - DNA, 22 bp, Artificial Sequence
  chemically synthesized
aaagttttatagtgtatacatg

SEQ ID NO: 1004277 - DNA, 22 bp, Artificial Sequence
  chemically synthesized
aagttttatagtgtatacatgg

SEQ ID NO: 1004278 - DNA, 22 bp, Artificial Sequence
  chemically synthesized
tatagtgtatacatgggacttg

SEQ ID NO: 1004279 - DNA, 22 bp, Artificial Sequence
  chemically synthesized
atagtgtatacatgggacttgt

SEQ ID NO: 1004280 - DNA, 22 bp, Artificial Sequence
  chemically synthesized
tagtgtatacatgggacttgtc

SEQ ID NO: 1004281 - DNA, 22 bp, Artificial Sequence
  chemically synthesized
tgaaacacagagactcttgaca

SEQ ID NO: 1004282 - DNA, 22 bp, Artificial Sequence
  chemically synthesized
atgaaacacagagactcttgac

SEQ ID NO: 1004283 - DNA, 22 bp, Artificial Sequence
  chemically synthesized
gtcaagagtctctgtgtttcat

SEQ ID NO: 1004284 - DNA, 22 bp, Artificial Sequence
  chemically synthesized
tcaagagtctctgtgtttcata

SEQ ID NO: 1004285 - DNA, 22 bp, Artificial Sequence
  chemically synthesized
gaatatgacgacaatgtttatg

SEQ ID NO: 1004286 - DNA, 22 bp, Artificial Sequence
  chemically synthesized
gctagaatatgacgacaatgtt

SEQ ID NO: 1004287 - DNA, 22 bp, Artificial Sequence
  chemically synthesized
tgtgtttcataaacattgtcgt

SEQ ID NO: 1004288 - DNA, 22 bp, Artificial Sequence
  chemically synthesized
tgtttcataaacattgtcgtca

SEQ ID NO: 1004289 - DNA, 22 bp, Artificial Sequence
  chemically synthesized
cataaacattgtcgtcatattc

SEQ ID NO: 1004290 - DNA, 22 bp, Artificial Sequence
  chemically synthesized
ataaacattgtcgtcatattct

SEQ ID NO: 1004291 - DNA, 22 bp, Artificial Sequence
  chemically synthesized
aatatggttagctagaatatga

SEQ ID NO: 1004292 - DNA, 22 bp, Artificial Sequence
  chemically synthesized
aaatatggttagctagaatatg

SEQ ID NO: 1004293 - DNA, 22 bp, Artificial Sequence
  chemically synthesized
taaatatggttagctagaatat

SEQ ID NO: 1004294 - DNA, 22 bp, Artificial Sequence
  chemically synthesized
tcgtcatattctagctaaccat

SEQ ID NO: 1004295 - DNA, 22 bp, Artificial Sequence
  chemically synthesized
tagctaaccatatttaaaattt

SEQ ID NO: 1004296 - DNA, 22 bp, Artificial Sequence
  chemically synthesized
gctaaccatatttaaaatttta

SEQ ID NO: 1004297 - DNA, 22 bp, Artificial Sequence
  chemically synthesized
accatatttaaaattttatata

SEQ ID NO: 1004298 - DNA, 22 bp, Artificial Sequence
  chemically synthesized
aaaattttatatatatatatat

SEQ ID NO: 1004299 - DNA, 22 bp, Artificial Sequence
  chemically synthesized
aaattttatatatatatatata

SEQ ID NO: 1004300 - DNA, 22 bp, Artificial Sequence
  chemically synthesized
tatatatatatatatatatata

SEQ ID NO: 1004301 - DNA, 22 bp, Artificial Sequence
  chemically synthesized
atatatatatatatatatatat

SEQ ID NO: 1004302 - DNA, 22 bp, Artificial Sequence
  chemically synthesized
tatatatatatatatatatata

SEQ ID NO: 1004303 - DNA, 22 bp, Artificial Sequence
  chemically synthesized
tggtgaaatatatatatatata

SEQ ID NO: 1004304 - DNA, 22 bp, Artificial Sequence
  chemically synthesized
gtggtgaaatatatatatatat

SEQ ID NO: 1004305 - DNA, 22 bp, Artificial Sequence
  chemically synthesized
caccacaagatttttatggtgg

SEQ ID NO: 1004306 - DNA, 22 bp, Artificial Sequence
  chemically synthesized
tggataaaagcaccaccataaa

SEQ ID NO: 1004307 - DNA, 22 bp, Artificial Sequence
  chemically synthesized
accacaagatttttatggtggt

SEQ ID NO: 1004308 - DNA, 22 bp, Artificial Sequence
  chemically synthesized
taactgtggataaaagcaccac

SEQ ID NO: 1004309 - DNA, 22 bp, Artificial Sequence
  chemically synthesized
ataactgtggataaaagcacca

SEQ ID NO: 1004310 - DNA, 22 bp, Artificial Sequence
  chemically synthesized
ttatggtggtgcttttatccac

SEQ ID NO: 1004311 - DNA, 22 bp, Artificial Sequence
  chemically synthesized
tatggtggtgcttttatccaca

SEQ ID NO: 1004312 - DNA, 22 bp, Artificial Sequence
  chemically synthesized
atggtggtgcttttatccacag

SEQ ID NO: 1004313 - DNA, 22 bp, Artificial Sequence
  chemically synthesized
aagaacttataactgtggataa

SEQ ID NO: 1004314 - DNA, 22 bp, Artificial Sequence
  chemically synthesized
tggtggtgcttttatccacagt

SEQ ID NO: 1004315 - DNA, 22 bp, Artificial Sequence
  chemically synthesized
aaagaacttataactgtggata

SEQ ID NO: 1004316 - DNA, 22 bp, Artificial Sequence
  chemically synthesized
ttaaagaacttataactgtgga

SEQ ID NO: 1004317 - DNA, 22 bp, Artificial Sequence
  chemically synthesized
ttatccacagttataagttctt

SEQ ID NO: 1004318 - DNA, 22 bp, Artificial Sequence
  chemically synthesized
tatccacagttataagttcttt

SEQ ID NO: 1004319 - DNA, 22 bp, Artificial Sequence
  chemically synthesized
atccacagttataagttcttta

SEQ ID NO: 1004320 - DNA, 22 bp, Artificial Sequence
  chemically synthesized
tccacagttataagttctttaa

SEQ ID NO: 1004321 - DNA, 22 bp, Artificial Sequence
  chemically synthesized
atgatagaaaatatctcttaaa

SEQ ID NO: 1004322 - DNA, 22 bp, Artificial Sequence
  chemically synthesized
aatgatagaaaatatctcttaa

SEQ ID NO: 1004323 - DNA, 22 bp, Artificial Sequence
  chemically synthesized
taatgatagaaaatatctctta

SEQ ID NO: 1004324 - DNA, 22 bp, Artificial Sequence
  chemically synthesized
ttaatgatagaaaatatctctt

SEQ ID NO: 1004325 - DNA, 22 bp, Artificial Sequence
  chemically synthesized
tttaatgatagaaaatatctct

SEQ ID NO: 1004326 - DNA, 22 bp, Artificial Sequence
  chemically synthesized
taagttctttaagagatatttt

SEQ ID NO: 1004327 - DNA, 22 bp, Artificial Sequence
  chemically synthesized
ttttttaatgatagaaaatatc

SEQ ID NO: 1004328 - DNA, 22 bp, Artificial Sequence
  chemically synthesized
attttttaatgatagaaaatat

SEQ ID NO: 1004329 - DNA, 22 bp, Artificial Sequence
  chemically synthesized
tttaagagatattttctatcat

SEQ ID NO: 1004330 - DNA, 22 bp, Artificial Sequence
  chemically synthesized
taagagatattttctatcatta

SEQ ID NO: 1004331 - DNA, 22 bp, Artificial Sequence
  chemically synthesized
aagagatattttctatcattaa

SEQ ID NO: 1004332 - DNA, 22 bp, Artificial Sequence
  chemically synthesized
agagatattttctatcattaaa

SEQ ID NO: 1004333 - DNA, 22 bp, Artificial Sequence
  chemically synthesized
tctatcattaaaaaataaattt

SEQ ID NO: 1004334 - DNA, 22 bp, Artificial Sequence
  chemically synthesized
ctatcattaaaaaataaattta

SEQ ID NO: 1004335 - DNA, 22 bp, Artificial Sequence
  chemically synthesized
agtaaataggcataaatttatt

SEQ ID NO: 1004336 - DNA, 22 bp, Artificial Sequence
  chemically synthesized
tatcattaaaaaataaatttat

SEQ ID NO: 1004337 - DNA, 22 bp, Artificial Sequence
  chemically synthesized
cagtaaataggcataaatttat

SEQ ID NO: 1004338 - DNA, 22 bp, Artificial Sequence
  chemically synthesized
tcattaaaaaataaatttatgc

SEQ ID NO: 1004339 - DNA, 22 bp, Artificial Sequence
  chemically synthesized
aaaaataaatttatgcctattt

SEQ ID NO: 1004340 - DNA, 22 bp, Artificial Sequence
  chemically synthesized
acaaatacttcagtaaataggc

SEQ ID NO: 1004341 - DNA, 22 bp, Artificial Sequence
  chemically synthesized
cacaaatacttcagtaaatagg

SEQ ID NO: 1004342 - DNA, 22 bp, Artificial Sequence
  chemically synthesized
tcacaaatacttcagtaaatag

SEQ ID NO: 1004343 - DNA, 22 bp, Artificial Sequence
  chemically synthesized
ttcacaaatacttcagtaaata

SEQ ID NO: 1004344 - DNA, 22 bp, Artificial Sequence
  chemically synthesized
tttcacaaatacttcagtaaat

SEQ ID NO: 1004345 - DNA, 22 bp, Artificial Sequence
  chemically synthesized
ttttcacaaatacttcagtaaa

SEQ ID NO: 1004346 - DNA, 22 bp, Artificial Sequence
  chemically synthesized
atgcctatttactgaagtattt

SEQ ID NO: 1004347 - DNA, 22 bp, Artificial Sequence
  chemically synthesized
ggcttttttcacaaatacttca

SEQ ID NO: 1004348 - DNA, 22 bp, Artificial Sequence
  chemically synthesized
tgcctatttactgaagtatttg

SEQ ID NO: 1004349 - DNA, 22 bp, Artificial Sequence
  chemically synthesized
tttactgaagtatttgtgaaaa

SEQ ID NO: 1004350 - DNA, 22 bp, Artificial Sequence
  chemically synthesized
gtcagttgggcttttttcacaa

SEQ ID NO: 1004351 - DNA, 22 bp, Artificial Sequence
  chemically synthesized
actgaagtatttgtgaaaaaag

SEQ ID NO: 1004352 - DNA, 22 bp, Artificial Sequence
  chemically synthesized
ctgaagtatttgtgaaaaaagc

SEQ ID NO: 1004353 - DNA, 22 bp, Artificial Sequence
  chemically synthesized
ctcgtcagttgggcttttttca

SEQ ID NO: 1004354 - DNA, 22 bp, Artificial Sequence
  chemically synthesized
aagtatttgtgaaaaaagccca

SEQ ID NO: 1004355 - DNA, 22 bp, Artificial Sequence
  chemically synthesized
acctactcgtcagttgggcttt

SEQ ID NO: 1004356 - DNA, 22 bp, Artificial Sequence
  chemically synthesized
taacctactcgtcagttgggct

SEQ ID NO: 1004357 - DNA, 22 bp, Artificial Sequence
  chemically synthesized
gtgaaaaaagcccaactgacga

SEQ ID NO: 1004358 - DNA, 22 bp, Artificial Sequence
  chemically synthesized
tgaaaaaagcccaactgacgag

SEQ ID NO: 1004359 - DNA, 22 bp, Artificial Sequence
  chemically synthesized
gaatgttctaacctactcgtca

SEQ ID NO: 1004360 - DNA, 22 bp, Artificial Sequence
  chemically synthesized
cgaatgttctaacctactcgtc

SEQ ID NO: 1004361 - DNA, 22 bp, Artificial Sequence
  chemically synthesized
aagatttcgaatgttctaacct

SEQ ID NO: 1004362 - DNA, 22 bp, Artificial Sequence
  chemically synthesized
acgagtaggttagaacattcga

SEQ ID NO: 1004363 - DNA, 22 bp, Artificial Sequence
  chemically synthesized
tcaaaacctgaagatttcgaat

SEQ ID NO: 1004364 - DNA, 22 bp, Artificial Sequence
  chemically synthesized
gaacattcgaaatcttcaggtt

SEQ ID NO: 1004365 - DNA, 22 bp, Artificial Sequence
  chemically synthesized
gaaatcttcaggttttgatagt

SEQ ID NO: 1004366 - DNA, 22 bp, Artificial Sequence
  chemically synthesized
acacggatgtaaaacaaaacta

SEQ ID NO: 1004367 - DNA, 22 bp, Artificial Sequence
  chemically synthesized
aacacggatgtaaaacaaaact

SEQ ID NO: 1004368 - DNA, 22 bp, Artificial Sequence
  chemically synthesized
caggttttgatagttttgtttt

SEQ ID NO: 1004369 - DNA, 22 bp, Artificial Sequence
  chemically synthesized
taacacggatgtaaaacaaaac

SEQ ID NO: 1004370 - DNA, 22 bp, Artificial Sequence
  chemically synthesized
aggttttgatagttttgtttta

SEQ ID NO: 1004371 - DNA, 22 bp, Artificial Sequence
  chemically synthesized
tgatagttttgttttacatccg

SEQ ID NO: 1004372 - DNA, 22 bp, Artificial Sequence
  chemically synthesized
gatagttttgttttacatccgt

SEQ ID NO: 1004373 - DNA, 22 bp, Artificial Sequence
  chemically synthesized
atagttttgttttacatccgtg

SEQ ID NO: 1004374 - DNA, 22 bp, Artificial Sequence
  chemically synthesized
aaacatctttaacacggatgta

SEQ ID NO: 1004375 - DNA, 22 bp, Artificial Sequence
  chemically synthesized
tgttttacatccgtgttaaaga

SEQ ID NO: 1004376 - DNA, 22 bp, Artificial Sequence
  chemically synthesized
gttttacatccgtgttaaagat

SEQ ID NO: 1004377 - DNA, 22 bp, Artificial Sequence
  chemically synthesized
ttttacatccgtgttaaagatg

SEQ ID NO: 1004378 - DNA, 22 bp, Artificial Sequence
  chemically synthesized
tacatccgtgttaaagatgttt

SEQ ID NO: 1004379 - DNA, 22 bp, Artificial Sequence
  chemically synthesized
aagagccagttaaaacatcttt

SEQ ID NO: 1004380 - DNA, 22 bp, Artificial Sequence
  chemically synthesized
acatccgtgttaaagatgtttt

SEQ ID NO: 1004381 - DNA, 22 bp, Artificial Sequence
  chemically synthesized
catccgtgttaaagatgtttta

SEQ ID NO: 1004382 - DNA, 22 bp, Artificial Sequence
  chemically synthesized
gagaatgttgaagagccagtta

SEQ ID NO: 1004383 - DNA, 22 bp, Artificial Sequence
  chemically synthesized
agagaatgttgaagagccagtt

SEQ ID NO: 1004384 - DNA, 22 bp, Artificial Sequence
  chemically synthesized
aagatgttttaactggctcttc

SEQ ID NO: 1004385 - DNA, 22 bp, Artificial Sequence
  chemically synthesized
cttagagaatgttgaagagcca

SEQ ID NO: 1004386 - DNA, 22 bp, Artificial Sequence
  chemically synthesized
cctacttagagaatgttgaaga

SEQ ID NO: 1004387 - DNA, 22 bp, Artificial Sequence
  chemically synthesized
taactggctcttcaacattctc

SEQ ID NO: 1004388 - DNA, 22 bp, Artificial Sequence
  chemically synthesized
aactggctcttcaacattctct

SEQ ID NO: 1004389 - DNA, 22 bp, Artificial Sequence
  chemically synthesized
actggctcttcaacattctcta

SEQ ID NO: 1004390 - DNA, 22 bp, Artificial Sequence
  chemically synthesized
gctcttcaacattctctaagta

SEQ ID NO: 1004391 - DNA, 22 bp, Artificial Sequence
  chemically synthesized
gagccagccctacctacttaga

SEQ ID NO: 1004392 - DNA, 22 bp, Artificial Sequence
  chemically synthesized
ttcaacattctctaagtaggta

SEQ ID NO: 1004393 - DNA, 22 bp, Artificial Sequence
  chemically synthesized
caacattctctaagtaggtagg

SEQ ID NO: 1004394 - DNA, 22 bp, Artificial Sequence
  chemically synthesized
cctagagccagccctacctact

SEQ ID NO: 1004395 - DNA, 22 bp, Artificial Sequence
  chemically synthesized
aacattctctaagtaggtaggg

SEQ ID NO: 1004396 - DNA, 22 bp, Artificial Sequence
  chemically synthesized
gcctagagccagccctacctac

SEQ ID NO: 1004397 - DNA, 22 bp, Artificial Sequence
  chemically synthesized
tctaagtaggtagggctggctc

SEQ ID NO: 1004398 - DNA, 22 bp, Artificial Sequence
  chemically synthesized
aggtgcttgcctagagccagcc

SEQ ID NO: 1004399 - DNA, 22 bp, Artificial Sequence
  chemically synthesized
taagtaggtagggctggctcta

SEQ ID NO: 1004400 - DNA, 22 bp, Artificial Sequence
  chemically synthesized
caggtgcttgcctagagccagc

SEQ ID NO: 1004401 - DNA, 22 bp, Artificial Sequence
  chemically synthesized
agtaggtagggctggctctagg

SEQ ID NO: 1004402 - DNA, 22 bp, Artificial Sequence
  chemically synthesized
tacttcaggtgcttgcctagag

SEQ ID NO: 1004403 - DNA, 22 bp, Artificial Sequence
  chemically synthesized
tatacttcaggtgcttgcctag

SEQ ID NO: 1004404 - DNA, 22 bp, Artificial Sequence
  chemically synthesized
actctatacttcaggtgcttgc

SEQ ID NO: 1004405 - DNA, 22 bp, Artificial Sequence
  chemically synthesized
gctctaggcaagcacctgaagt

SEQ ID NO: 1004406 - DNA, 22 bp, Artificial Sequence
  chemically synthesized
aagctaactctatacttcaggt

SEQ ID NO: 1004407 - DNA, 22 bp, Artificial Sequence
  chemically synthesized
taggcaagcacctgaagtatag

SEQ ID NO: 1004408 - DNA, 22 bp, Artificial Sequence
  chemically synthesized
ggcaagcacctgaagtatagag

SEQ ID NO: 1004409 - DNA, 22 bp, Artificial Sequence
  chemically synthesized
aagtatagagttagcttcaggt

SEQ ID NO: 1004410 - DNA, 22 bp, Artificial Sequence
  chemically synthesized
aaggtaagaaaaggaaggcaga

SEQ ID NO: 1004411 - DNA, 22 bp, Artificial Sequence
  chemically synthesized
gcttcaggtctgccttcctttt

SEQ ID NO: 1004412 - DNA, 22 bp, Artificial Sequence
  chemically synthesized
caggtctgccttccttttctta

SEQ ID NO: 1004413 - DNA, 22 bp, Artificial Sequence
  chemically synthesized
aggtctgccttccttttcttac

SEQ ID NO: 1004414 - DNA, 22 bp, Artificial Sequence
  chemically synthesized
ccttccttttcttacctttagg

SEQ ID NO: 1004415 - DNA, 22 bp, Artificial Sequence
  chemically synthesized
ccttttcttacctttaggattt

SEQ ID NO: 1004416 - DNA, 22 bp, Artificial Sequence
  chemically synthesized
cttttcttacctttaggatttc

SEQ ID NO: 1004417 - DNA, 22 bp, Artificial Sequence
  chemically synthesized
ttcttacctttaggatttcctg

SEQ ID NO: 1004418 - DNA, 22 bp, Artificial Sequence
  chemically synthesized
tcttacctttaggatttcctgg

SEQ ID NO: 1004419 - DNA, 22 bp, Artificial Sequence
  chemically synthesized
cttacctttaggatttcctggt

SEQ ID NO: 1004420 - DNA, 22 bp, Artificial Sequence
  chemically synthesized
ttacctttaggatttcctggta

SEQ ID NO: 1004421 - DNA, 22 bp, Artificial Sequence
  chemically synthesized
acctttaggatttcctggtatc

SEQ ID NO: 1004422 - DNA, 22 bp, Artificial Sequence
  chemically synthesized
cctttaggatttcctggtatct

SEQ ID NO: 1004423 - DNA, 22 bp, Artificial Sequence
  chemically synthesized
ggagaaataggataaagatacc

SEQ ID NO: 1004424 - DNA, 22 bp, Artificial Sequence
  chemically synthesized
taggatttcctggtatctttat

SEQ ID NO: 1004425 - DNA, 22 bp, Artificial Sequence
  chemically synthesized
aggatttcctggtatctttatc

SEQ ID NO: 1004426 - DNA, 22 bp, Artificial Sequence
  chemically synthesized
ggatttcctggtatctttatcc

SEQ ID NO: 1004427 - DNA, 22 bp, Artificial Sequence
  chemically synthesized
cctggtatctttatcctatttc

SEQ ID NO: 1004428 - DNA, 22 bp, Artificial Sequence
  chemically synthesized
ctggtatctttatcctatttct

SEQ ID NO: 1004429 - DNA, 22 bp, Artificial Sequence
  chemically synthesized
gtatctttatcctatttctccc

SEQ ID NO: 1004430 - DNA, 22 bp, Artificial Sequence
  chemically synthesized
tatcctatttctcccaatccca

SEQ ID NO: 1004431 - DNA, 22 bp, Artificial Sequence
  chemically synthesized
atcctatttctcccaatcccat

SEQ ID NO: 1004432 - DNA, 22 bp, Artificial Sequence
  chemically synthesized
tcctatttctcccaatcccatc

SEQ ID NO: 1004433 - DNA, 22 bp, Artificial Sequence
  chemically synthesized
tttctcccaatcccatcttctg

SEQ ID NO: 1004434 - DNA, 22 bp, Artificial Sequence
  chemically synthesized
ctcccaatcccatcttctgctc

SEQ ID NO: 1004435 - DNA, 22 bp, Artificial Sequence
  chemically synthesized
tcccaatcccatcttctgctct

SEQ ID NO: 1004436 - DNA, 22 bp, Artificial Sequence
  chemically synthesized
ccaatcccatcttctgctctgt

SEQ ID NO: 1004437 - DNA, 22 bp, Artificial Sequence
  chemically synthesized
ccaacaagagaggtacagagca

SEQ ID NO: 1004438 - DNA, 22 bp, Artificial Sequence
  chemically synthesized
cccaacaagagaggtacagagc

SEQ ID NO: 1004439 - DNA, 22 bp, Artificial Sequence
  chemically synthesized
tttcccaacaagagaggtacag

SEQ ID NO: 1004440 - DNA, 22 bp, Artificial Sequence
  chemically synthesized
atttcccaacaagagaggtaca

SEQ ID NO: 1004441 - DNA, 22 bp, Artificial Sequence
  chemically synthesized
ctgctctgtacctctcttgttg

SEQ ID NO: 1004442 - DNA, 22 bp, Artificial Sequence
  chemically synthesized
agtcttatttcccaacaagaga

SEQ ID NO: 1004443 - DNA, 22 bp, Artificial Sequence
  chemically synthesized
tgctctgtacctctcttgttgg

SEQ ID NO: 1004444 - DNA, 22 bp, Artificial Sequence
  chemically synthesized
tgagtcttatttcccaacaaga

SEQ ID NO: 1004445 - DNA, 22 bp, Artificial Sequence
  chemically synthesized
ctctgtacctctcttgttggga

SEQ ID NO: 1004446 - DNA, 22 bp, Artificial Sequence
  chemically synthesized
tgtacctctcttgttgggaaat

SEQ ID NO: 1004447 - DNA, 22 bp, Artificial Sequence
  chemically synthesized
tacctctcttgttgggaaataa

SEQ ID NO: 1004448 - DNA, 22 bp, Artificial Sequence
  chemically synthesized
tgattctgagtcttatttccca

SEQ ID NO: 1004449 - DNA, 22 bp, Artificial Sequence
  chemically synthesized
tcttgttgggaaataagactca

SEQ ID NO: 1004450 - DNA, 22 bp, Artificial Sequence
  chemically synthesized
ttgttgggaaataagactcaga

SEQ ID NO: 1004451 - DNA, 22 bp, Artificial Sequence
  chemically synthesized
agagtctgtgattctgagtctt

SEQ ID NO: 1004452 - DNA, 22 bp, Artificial Sequence
  chemically synthesized
gttgggaaataagactcagaat

SEQ ID NO: 1004453 - DNA, 22 bp, Artificial Sequence
  chemically synthesized
taagagtctgtgattctgagtc

SEQ ID NO: 1004454 - DNA, 22 bp, Artificial Sequence
  chemically synthesized
ttgggaaataagactcagaatc

SEQ ID NO: 1004455 - DNA, 22 bp, Artificial Sequence
  chemically synthesized
ggaaataagactcagaatcaca

SEQ ID NO: 1004456 - DNA, 22 bp, Artificial Sequence
  chemically synthesized
tgttctaagagtctgtgattct

SEQ ID NO: 1004457 - DNA, 22 bp, Artificial Sequence
  chemically synthesized
ttgtgttctaagagtctgtgat

SEQ ID NO: 1004458 - DNA, 22 bp, Artificial Sequence
  chemically synthesized
aagtcctgttgtgttctaagag

SEQ ID NO: 1004459 - DNA, 22 bp, Artificial Sequence
  chemically synthesized
agaatcacagactcttagaaca

SEQ ID NO: 1004460 - DNA, 22 bp, Artificial Sequence
  chemically synthesized
aaagtcctgttgtgttctaaga

SEQ ID NO: 1004461 - DNA, 22 bp, Artificial Sequence
  chemically synthesized
ttagaacacaacaggactttaa

SEQ ID NO: 1004462 - DNA, 22 bp, Artificial Sequence
  chemically synthesized
ggagaggtggccttaaagtcct

SEQ ID NO: 1004463 - DNA, 22 bp, Artificial Sequence
  chemically synthesized
agaacacaacaggactttaagg

SEQ ID NO: 1004464 - DNA, 22 bp, Artificial Sequence
  chemically synthesized
gaacacaacaggactttaaggc

SEQ ID NO: 1004465 - DNA, 22 bp, Artificial Sequence
  chemically synthesized
ggtgattaggagaggtggcctt

SEQ ID NO: 1004466 - DNA, 22 bp, Artificial Sequence
  chemically synthesized
tcagttgggtgattaggagagg

SEQ ID NO: 1004467 - DNA, 22 bp, Artificial Sequence
  chemically synthesized
atcagttgggtgattaggagag

SEQ ID NO: 1004468 - DNA, 22 bp, Artificial Sequence
  chemically synthesized
taaggccacctctcctaatcac

SEQ ID NO: 1004469 - DNA, 22 bp, Artificial Sequence
  chemically synthesized
tttatcagttgggtgattagga

SEQ ID NO: 1004470 - DNA, 22 bp, Artificial Sequence
  chemically synthesized
aaggccacctctcctaatcacc

SEQ ID NO: 1004471 - DNA, 22 bp, Artificial Sequence
  chemically synthesized
gtttatcagttgggtgattagg

SEQ ID NO: 1004472 - DNA, 22 bp, Artificial Sequence
  chemically synthesized
aggccacctctcctaatcaccc

SEQ ID NO: 1004473 - DNA, 22 bp, Artificial Sequence
  chemically synthesized
tcctaatcacccaactgataaa

SEQ ID NO: 1004474 - DNA, 22 bp, Artificial Sequence
  chemically synthesized
ctaatcacccaactgataaaca

SEQ ID NO: 1004475 - DNA, 22 bp, Artificial Sequence
  chemically synthesized
tacatgggaatttgtttatcag

SEQ ID NO: 1004476 - DNA, 22 bp, Artificial Sequence
  chemically synthesized
atcacccaactgataaacaaat

SEQ ID NO: 1004477 - DNA, 22 bp, Artificial Sequence
  chemically synthesized
ggagttatacatgggaatttgt

SEQ ID NO: 1004478 - DNA, 22 bp, Artificial Sequence
  chemically synthesized
ggacctgggagttatacatggg

SEQ ID NO: 1004479 - DNA, 22 bp, Artificial Sequence
  chemically synthesized
ataaacaaattcccatgtataa

SEQ ID NO: 1004480 - DNA, 22 bp, Artificial Sequence
  chemically synthesized
ccatgtataactcccaggtccc

SEQ ID NO: 1004481 - DNA, 22 bp, Artificial Sequence
  chemically synthesized
ccaggtcccaatttttcattat

SEQ ID NO: 1004482 - DNA, 22 bp, Artificial Sequence
  chemically synthesized
atcataggcaagataatgaaaa

SEQ ID NO: 1004483 - DNA, 22 bp, Artificial Sequence
  chemically synthesized
tgatacctgatcataggcaaga

SEQ ID NO: 1004484 - DNA, 22 bp, Artificial Sequence
  chemically synthesized
atgatacctgatcataggcaag

SEQ ID NO: 1004485 - DNA, 22 bp, Artificial Sequence
  chemically synthesized
ttcattatcttgcctatgatca

SEQ ID NO: 1004486 - DNA, 22 bp, Artificial Sequence
  chemically synthesized
tcattatcttgcctatgatcag

SEQ ID NO: 1004487 - DNA, 22 bp, Artificial Sequence
  chemically synthesized
cattatcttgcctatgatcagg

SEQ ID NO: 1004488 - DNA, 22 bp, Artificial Sequence
  chemically synthesized
gcacttatgatacctgatcata

SEQ ID NO: 1004489 - DNA, 22 bp, Artificial Sequence
  chemically synthesized
attatcttgcctatgatcaggt

SEQ ID NO: 1004490 - DNA, 22 bp, Artificial Sequence
  chemically synthesized
tagcacttatgatacctgatca

SEQ ID NO: 1004491 - DNA, 22 bp, Artificial Sequence
  chemically synthesized
ctagcacttatgatacctgatc

SEQ ID NO: 1004492 - DNA, 22 bp, Artificial Sequence
  chemically synthesized
tctagcacttatgatacctgat

SEQ ID NO: 1004493 - DNA, 22 bp, Artificial Sequence
  chemically synthesized
tcttgcctatgatcaggtatca

SEQ ID NO: 1004494 - DNA, 22 bp, Artificial Sequence
  chemically synthesized
gcctatgatcaggtatcataag

SEQ ID NO: 1004495 - DNA, 22 bp, Artificial Sequence
  chemically synthesized
cctatgatcaggtatcataagt

SEQ ID NO: 1004496 - DNA, 22 bp, Artificial Sequence
  chemically synthesized
tgatcaggtatcataagtgcta

SEQ ID NO: 1004497 - DNA, 22 bp, Artificial Sequence
  chemically synthesized
atagtgtgttttctagcactta

SEQ ID NO: 1004498 - DNA, 22 bp, Artificial Sequence
  chemically synthesized
aattaatagtgtgttttctagc

SEQ ID NO: 1004499 - DNA, 22 bp, Artificial Sequence
  chemically synthesized
gtgcctcaattaatagtgtgtt

SEQ ID NO: 1004500 - DNA, 22 bp, Artificial Sequence
  chemically synthesized
gaaaacacactattaattgagg

SEQ ID NO: 1004501 - DNA, 22 bp, Artificial Sequence
  chemically synthesized
aaaagcaggaactggtgcctca

SEQ ID NO: 1004502 - DNA, 22 bp, Artificial Sequence
  chemically synthesized
caaaagcaggaactggtgcctc

SEQ ID NO: 1004503 - DNA, 22 bp, Artificial Sequence
  chemically synthesized
tcaaaagcaggaactggtgcct

SEQ ID NO: 1004504 - DNA, 22 bp, Artificial Sequence
  chemically synthesized
ttaattgaggcaccagttcctg

SEQ ID NO: 1004505 - DNA, 22 bp, Artificial Sequence
  chemically synthesized
attgaggcaccagttcctgctt

SEQ ID NO: 1004506 - DNA, 22 bp, Artificial Sequence
  chemically synthesized
aggcaccagttcctgcttttga

SEQ ID NO: 1004507 - DNA, 22 bp, Artificial Sequence
  chemically synthesized
aatatcagaactttcaaaagca

SEQ ID NO: 1004508 - DNA, 22 bp, Artificial Sequence
  chemically synthesized
ctgcttttgaaagttctgatat

SEQ ID NO: 1004509 - DNA, 22 bp, Artificial Sequence
  chemically synthesized
cttttgaaagttctgatattta

SEQ ID NO: 1004510 - DNA, 22 bp, Artificial Sequence
  chemically synthesized
aacaaaaagccatctaaatatc

SEQ ID NO: 1004511 - DNA, 22 bp, Artificial Sequence
  chemically synthesized
ttgaaagttctgatatttagat

SEQ ID NO: 1004512 - DNA, 22 bp, Artificial Sequence
  chemically synthesized
tgaaagttctgatatttagatg

SEQ ID NO: 1004513 - DNA, 22 bp, Artificial Sequence
  chemically synthesized
gaaagttctgatatttagatgg

SEQ ID NO: 1004514 - DNA, 22 bp, Artificial Sequence
  chemically synthesized
aaagttctgatatttagatggc

SEQ ID NO: 1004515 - DNA, 22 bp, Artificial Sequence
  chemically synthesized
actcaacaaaaagccatctaaa

SEQ ID NO: 1004516 - DNA, 22 bp, Artificial Sequence
  chemically synthesized
gactcaacaaaaagccatctaa

SEQ ID NO: 1004517 - DNA, 22 bp, Artificial Sequence
  chemically synthesized
tgatatttagatggctttttgt

SEQ ID NO: 1004518 - DNA, 22 bp, Artificial Sequence
  chemically synthesized
atatttagatggctttttgttg

SEQ ID NO: 1004519 - DNA, 22 bp, Artificial Sequence
  chemically synthesized
agatggctttttgttgagtcaa

SEQ ID NO: 1004520 - DNA, 22 bp, Artificial Sequence
  chemically synthesized
gatggctttttgttgagtcaaa

SEQ ID NO: 1004521 - DNA, 22 bp, Artificial Sequence
  chemically synthesized
aagtggggggtgacatttgact

SEQ ID NO: 1004522 - DNA, 22 bp, Artificial Sequence
  chemically synthesized
tttgttgagtcaaatgtcaccc

SEQ ID NO: 1004523 - DNA, 22 bp, Artificial Sequence
  chemically synthesized
ttgttgagtcaaatgtcacccc

SEQ ID NO: 1004524 - DNA, 22 bp, Artificial Sequence
  chemically synthesized
tgttgagtcaaatgtcaccccc

SEQ ID NO: 1004525 - DNA, 22 bp, Artificial Sequence
  chemically synthesized
gttgagtcaaatgtcacccccc

SEQ ID NO: 1004526 - DNA, 22 bp, Artificial Sequence
  chemically synthesized
ttgagtcaaatgtcacccccca

SEQ ID NO: 1004527 - DNA, 22 bp, Artificial Sequence
  chemically synthesized
gatagaagctaaagtggggggt

SEQ ID NO: 1004528 - DNA, 22 bp, Artificial Sequence
  chemically synthesized
agtcaaatgtcaccccccactt

SEQ ID NO: 1004529 - DNA, 22 bp, Artificial Sequence
  chemically synthesized
tcgatagaagctaaagtggggg

SEQ ID NO: 1004530 - DNA, 22 bp, Artificial Sequence
  chemically synthesized
caagaggtacacagtctctcga

SEQ ID NO: 1004531 - DNA, 22 bp, Artificial Sequence
  chemically synthesized
tagcttctatcgagagactgtg

SEQ ID NO: 1004532 - DNA, 22 bp, Artificial Sequence
  chemically synthesized
agcttctatcgagagactgtgt

SEQ ID NO: 1004533 - DNA, 22 bp, Artificial Sequence
  chemically synthesized
gcttctatcgagagactgtgta

SEQ ID NO: 1004534 - DNA, 22 bp, Artificial Sequence
  chemically synthesized
aataattccaagaggtacacag

SEQ ID NO: 1004535 - DNA, 22 bp, Artificial Sequence
  chemically synthesized
ctatcgagagactgtgtacctc

SEQ ID NO: 1004536 - DNA, 22 bp, Artificial Sequence
  chemically synthesized
tatcgagagactgtgtacctct

SEQ ID NO: 1004537 - DNA, 22 bp, Artificial Sequence
  chemically synthesized
tcgagagactgtgtacctcttg

SEQ ID NO: 1004538 - DNA, 22 bp, Artificial Sequence
  chemically synthesized
tgctgaataattccaagaggta

SEQ ID NO: 1004539 - DNA, 22 bp, Artificial Sequence
  chemically synthesized
gtgctgaataattccaagaggt

SEQ ID NO: 1004540 - DNA, 22 bp, Artificial Sequence
  chemically synthesized
aacttgtgctgaataattccaa

SEQ ID NO: 1004541 - DNA, 22 bp, Artificial Sequence
  chemically synthesized
aaacttgtgctgaataattcca

SEQ ID NO: 1004542 - DNA, 22 bp, Artificial Sequence
  chemically synthesized
tgtacctcttggaattattcag

SEQ ID NO: 1004543 - DNA, 22 bp, Artificial Sequence
  chemically synthesized
ttggaattattcagcacaagtt

SEQ ID NO: 1004544 - DNA, 22 bp, Artificial Sequence
  chemically synthesized
ggaattattcagcacaagttta

SEQ ID NO: 1004545 - DNA, 22 bp, Artificial Sequence
  chemically synthesized
gaattattcagcacaagtttaa

SEQ ID NO: 1004546 - DNA, 22 bp, Artificial Sequence
  chemically synthesized
cggacacaaaaatttaaacttg

SEQ ID NO: 1004547 - DNA, 22 bp, Artificial Sequence
  chemically synthesized
ttacggacacaaaaatttaaac

SEQ ID NO: 1004548 - DNA, 22 bp, Artificial Sequence
  chemically synthesized
ttcagcacaagtttaaattttt

SEQ ID NO: 1004549 - DNA, 22 bp, Artificial Sequence
  chemically synthesized
agcacaagtttaaatttttgtg

SEQ ID NO: 1004550 - DNA, 22 bp, Artificial Sequence
  chemically synthesized
aaggactgttacggacacaaaa

SEQ ID NO: 1004551 - DNA, 22 bp, Artificial Sequence
  chemically synthesized
gaaggactgttacggacacaaa

SEQ ID NO: 1004552 - DNA, 22 bp, Artificial Sequence
  chemically synthesized
aaatttttgtgtccgtaacagt

SEQ ID NO: 1004553 - DNA, 22 bp, Artificial Sequence
  chemically synthesized
aatttttgtgtccgtaacagtc

SEQ ID NO: 1004554 - DNA, 22 bp, Artificial Sequence
  chemically synthesized
aaatgtttgaaggactgttacg

SEQ ID NO: 1004555 - DNA, 22 bp, Artificial Sequence
  chemically synthesized
caaatgtttgaaggactgttac

SEQ ID NO: 1004556 - DNA, 22 bp, Artificial Sequence
  chemically synthesized
ttgtgtccgtaacagtccttca

SEQ ID NO: 1004557 - DNA, 22 bp, Artificial Sequence
  chemically synthesized
tcttcaaatgtttgaaggactg

SEQ ID NO: 1004558 - DNA, 22 bp, Artificial Sequence
  chemically synthesized
tgtgtccgtaacagtccttcaa

SEQ ID NO: 1004559 - DNA, 22 bp, Artificial Sequence
  chemically synthesized
gtgtccgtaacagtccttcaaa

SEQ ID NO: 1004560 - DNA, 22 bp, Artificial Sequence
  chemically synthesized
tgtccgtaacagtccttcaaac

SEQ ID NO: 1004561 - DNA, 22 bp, Artificial Sequence
  chemically synthesized
caaacatttgaagacaactatc

SEQ ID NO: 1004562 - DNA, 22 bp, Artificial Sequence
  chemically synthesized
aaacatttgaagacaactatca

SEQ ID NO: 1004563 - DNA, 22 bp, Artificial Sequence
  chemically synthesized
gcagggagaagaagagagatga

SEQ ID NO: 1004564 - DNA, 22 bp, Artificial Sequence
  chemically synthesized
gaagacaactatcatctctctt

SEQ ID NO: 1004565 - DNA, 22 bp, Artificial Sequence
  chemically synthesized
agcagggagaagaagagagatg

SEQ ID NO: 1004566 - DNA, 22 bp, Artificial Sequence
  chemically synthesized
aagacaactatcatctctcttc

SEQ ID NO: 1004567 - DNA, 22 bp, Artificial Sequence
  chemically synthesized
gggaagtttagcagggagaaga

SEQ ID NO: 1004568 - DNA, 22 bp, Artificial Sequence
  chemically synthesized
tcatctctcttcttctccctgc

SEQ ID NO: 1004569 - DNA, 22 bp, Artificial Sequence
  chemically synthesized
tcttcttctccctgctaaactt

SEQ ID NO: 1004570 - DNA, 22 bp, Artificial Sequence
  chemically synthesized
ttcttctccctgctaaacttcc

SEQ ID NO: 1004571 - DNA, 22 bp, Artificial Sequence
  chemically synthesized
cttctccctgctaaacttccct

SEQ ID NO: 1004572 - DNA, 22 bp, Artificial Sequence
  chemically synthesized
ttctccctgctaaacttcccta

SEQ ID NO: 1004573 - DNA, 22 bp, Artificial Sequence
  chemically synthesized
ctccctgctaaacttccctaga

SEQ ID NO: 1004574 - DNA, 22 bp, Artificial Sequence
  chemically synthesized
ggtaatgaaagatctagggaag

SEQ ID NO: 1004575 - DNA, 22 bp, Artificial Sequence
  chemically synthesized
tccctgctaaacttccctagat

SEQ ID NO: 1004576 - DNA, 22 bp, Artificial Sequence
  chemically synthesized
cctgctaaacttccctagatct

SEQ ID NO: 1004577 - DNA, 22 bp, Artificial Sequence
  chemically synthesized
ctaaacttccctagatctttca

SEQ ID NO: 1004578 - DNA, 22 bp, Artificial Sequence
  chemically synthesized
tgtcatctaggtaatgaaagat

SEQ ID NO: 1004579 - DNA, 22 bp, Artificial Sequence
  chemically synthesized
aacttccctagatctttcatta

SEQ ID NO: 1004580 - DNA, 22 bp, Artificial Sequence
  chemically synthesized
ccctagatctttcattacctag

SEQ ID NO: 1004581 - DNA, 22 bp, Artificial Sequence
  chemically synthesized
cctagatctttcattacctaga

SEQ ID NO: 1004582 - DNA, 22 bp, Artificial Sequence
  chemically synthesized
gacgctgtgtcatctaggtaat

SEQ ID NO: 1004583 - DNA, 22 bp, Artificial Sequence
  chemically synthesized
gatctttcattacctagatgac

SEQ ID NO: 1004584 - DNA, 22 bp, Artificial Sequence
  chemically synthesized
agaagcctcgacgctgtgtcat

SEQ ID NO: 1004585 - DNA, 22 bp, Artificial Sequence
  chemically synthesized
tcattacctagatgacacagcg

SEQ ID NO: 1004586 - DNA, 22 bp, Artificial Sequence
  chemically synthesized
cattacctagatgacacagcgt

SEQ ID NO: 1004587 - DNA, 22 bp, Artificial Sequence
  chemically synthesized
attacctagatgacacagcgtc

SEQ ID NO: 1004588 - DNA, 22 bp, Artificial Sequence
  chemically synthesized
cctagatgacacagcgtcgagg

SEQ ID NO: 1004589 - DNA, 22 bp, Artificial Sequence
  chemically synthesized
atacattgagaagcctcgacgc

SEQ ID NO: 1004590 - DNA, 22 bp, Artificial Sequence
  chemically synthesized
gatgacacagcgtcgaggcttc

SEQ ID NO: 1004591 - DNA, 22 bp, Artificial Sequence
  chemically synthesized
ttcatacattgagaagcctcga

SEQ ID NO: 1004592 - DNA, 22 bp, Artificial Sequence
  chemically synthesized
gttgttcatacattgagaagcc

SEQ ID NO: 1004593 - DNA, 22 bp, Artificial Sequence
  chemically synthesized
gttagttgttcatacattgaga

SEQ ID NO: 1004594 - DNA, 22 bp, Artificial Sequence
  chemically synthesized
gaagttagttagttgttcatac

SEQ ID NO: 1004595 - DNA, 22 bp, Artificial Sequence
  chemically synthesized
ctcaatgtatgaacaactaact

SEQ ID NO: 1004596 - DNA, 22 bp, Artificial Sequence
  chemically synthesized
tcaatgtatgaacaactaacta

SEQ ID NO: 1004597 - DNA, 22 bp, Artificial Sequence
  chemically synthesized
aatgtatgaacaactaactaac

SEQ ID NO: 1004598 - DNA, 22 bp, Artificial Sequence
  chemically synthesized
aaccagtcagagaaaagttgga

SEQ ID NO: 1004599 - DNA, 22 bp, Artificial Sequence
  chemically synthesized
aaaccagtcagagaaaagttgg

SEQ ID NO: 1004600 - DNA, 22 bp, Artificial Sequence
  chemically synthesized
taaaccagtcagagaaaagttg

SEQ ID NO: 1004601 - DNA, 22 bp, Artificial Sequence
  chemically synthesized
actaacttccaacttttctctg

SEQ ID NO: 1004602 - DNA, 22 bp, Artificial Sequence
  chemically synthesized
acttccaacttttctctgactg

SEQ ID NO: 1004603 - DNA, 22 bp, Artificial Sequence
  chemically synthesized
caagagattttaaaccagtcag

SEQ ID NO: 1004604 - DNA, 22 bp, Artificial Sequence
  chemically synthesized
ccaacttttctctgactggttt

SEQ ID NO: 1004605 - DNA, 22 bp, Artificial Sequence
  chemically synthesized
acaagagattttaaaccagtca

SEQ ID NO: 1004606 - DNA, 22 bp, Artificial Sequence
  chemically synthesized
caacttttctctgactggttta

SEQ ID NO: 1004607 - DNA, 22 bp, Artificial Sequence
  chemically synthesized
ttctctgactggtttaaaatct

SEQ ID NO: 1004608 - DNA, 22 bp, Artificial Sequence
  chemically synthesized
tctctgactggtttaaaatctc

SEQ ID NO: 1004609 - DNA, 22 bp, Artificial Sequence
  chemically synthesized
ctctgactggtttaaaatctct

SEQ ID NO: 1004610 - DNA, 22 bp, Artificial Sequence
  chemically synthesized
tctgactggtttaaaatctctt

SEQ ID NO: 1004611 - DNA, 22 bp, Artificial Sequence
  chemically synthesized
tgactggtttaaaatctcttgt

SEQ ID NO: 1004612 - DNA, 22 bp, Artificial Sequence
  chemically synthesized
actggtttaaaatctcttgtaa

SEQ ID NO: 1004613 - DNA, 22 bp, Artificial Sequence
  chemically synthesized
gtttaaaatctcttgtaagatt

SEQ ID NO: 1004614 - DNA, 22 bp, Artificial Sequence
  chemically synthesized
aaaatctcttgtaagatttgac

SEQ ID NO: 1004615 - DNA, 22 bp, Artificial Sequence
  chemically synthesized
aaatctcttgtaagatttgact

SEQ ID NO: 1004616 - DNA, 22 bp, Artificial Sequence
  chemically synthesized
atgtaatgaataaacagtcaaa

SEQ ID NO: 1004617 - DNA, 22 bp, Artificial Sequence
  chemically synthesized
catgtaatgaataaacagtcaa

SEQ ID NO: 1004618 - DNA, 22 bp, Artificial Sequence
  chemically synthesized
ttgtaagatttgactgtttatt

SEQ ID NO: 1004619 - DNA, 22 bp, Artificial Sequence
  chemically synthesized
cttcatgtaatgaataaacagt

SEQ ID NO: 1004620 - DNA, 22 bp, Artificial Sequence
  chemically synthesized
gtaagatttgactgtttattca

SEQ ID NO: 1004621 - DNA, 22 bp, Artificial Sequence
  chemically synthesized
taagatttgactgtttattcat

SEQ ID NO: 1004622 - DNA, 22 bp, Artificial Sequence
  chemically synthesized
ttccttcatgtaatgaataaac

SEQ ID NO: 1004623 - DNA, 22 bp, Artificial Sequence
  chemically synthesized
gctgttccttcatgtaatgaat

SEQ ID NO: 1004624 - DNA, 22 bp, Artificial Sequence
  chemically synthesized
tcgctgttccttcatgtaatga

SEQ ID NO: 1004625 - DNA, 22 bp, Artificial Sequence
  chemically synthesized
gactgtttattcattacatgaa

SEQ ID NO: 1004626 - DNA, 22 bp, Artificial Sequence
  chemically synthesized
actgtttattcattacatgaag

SEQ ID NO: 1004627 - DNA, 22 bp, Artificial Sequence
  chemically synthesized
ttctcgctgttccttcatgtaa

SEQ ID NO: 1004628 - DNA, 22 bp, Artificial Sequence
  chemically synthesized
attctcgctgttccttcatgta

SEQ ID NO: 1004629 - DNA, 22 bp, Artificial Sequence
  chemically synthesized
tttattcattacatgaaggaac

SEQ ID NO: 1004630 - DNA, 22 bp, Artificial Sequence
  chemically synthesized
attcattacatgaaggaacagc

SEQ ID NO: 1004631 - DNA, 22 bp, Artificial Sequence
  chemically synthesized
ttcattacatgaaggaacagcg

SEQ ID NO: 1004632 - DNA, 22 bp, Artificial Sequence
  chemically synthesized
tccccttattctcgctgttcct

SEQ ID NO: 1004633 - DNA, 22 bp, Artificial Sequence
  chemically synthesized
attacatgaaggaacagcgaga

SEQ ID NO: 1004634 - DNA, 22 bp, Artificial Sequence
  chemically synthesized
catgaaggaacagcgagaataa

SEQ ID NO: 1004635 - DNA, 22 bp, Artificial Sequence
  chemically synthesized
aggagagaacagagggaaccat

SEQ ID NO: 1004636 - DNA, 22 bp, Artificial Sequence
  chemically synthesized
cctctgttctctcctcaatgca

SEQ ID NO: 1004637 - DNA, 22 bp, Artificial Sequence
  chemically synthesized
tgttctctcctcaatgcatatt

SEQ ID NO: 1004638 - DNA, 22 bp, Artificial Sequence
  chemically synthesized
ttctctcctcaatgcatatttg

SEQ ID NO: 1004639 - DNA, 22 bp, Artificial Sequence
  chemically synthesized
tctcctcaatgcatatttgttg

SEQ ID NO: 1004640 - DNA, 22 bp, Artificial Sequence
  chemically synthesized
gcaaagagtatacaacaaatat

SEQ ID NO: 1004641 - DNA, 22 bp, Artificial Sequence
  chemically synthesized
tcctcaatgcatatttgttgta

SEQ ID NO: 1004642 - DNA, 22 bp, Artificial Sequence
  chemically synthesized
ctggcaaagagtatacaacaaa

SEQ ID NO: 1004643 - DNA, 22 bp, Artificial Sequence
  chemically synthesized
ctcaatgcatatttgttgtata

SEQ ID NO: 1004644 - DNA, 22 bp, Artificial Sequence
  chemically synthesized
aatgcatatttgttgtatactc

SEQ ID NO: 1004645 - DNA, 22 bp, Artificial Sequence
  chemically synthesized
gcatagctcctggcaaagagta

SEQ ID NO: 1004646 - DNA, 22 bp, Artificial Sequence
  chemically synthesized
gttgtatactctttgccaggag

SEQ ID NO: 1004647 - DNA, 22 bp, Artificial Sequence
  chemically synthesized
ttgtatactctttgccaggagc

SEQ ID NO: 1004648 - DNA, 22 bp, Artificial Sequence
  chemically synthesized
tatactctttgccaggagctat

SEQ ID NO: 1004649 - DNA, 22 bp, Artificial Sequence
  chemically synthesized
ccgggacctagcatagctcctg

SEQ ID NO: 1004650 - DNA, 22 bp, Artificial Sequence
  chemically synthesized
tttgccaggagctatgctaggt

SEQ ID NO: 1004651 - DNA, 22 bp, Artificial Sequence
  chemically synthesized
tgccaggagctatgctaggtcc

SEQ ID NO: 1004652 - DNA, 22 bp, Artificial Sequence
  chemically synthesized
gccaggagctatgctaggtccc

SEQ ID NO: 1004653 - DNA, 22 bp, Artificial Sequence
  chemically synthesized
ccaggagctatgctaggtcccg

SEQ ID NO: 1004654 - DNA, 22 bp, Artificial Sequence
  chemically synthesized
cccaaaatcgtgttcccgggac

SEQ ID NO: 1004655 - DNA, 22 bp, Artificial Sequence
  chemically synthesized
gcccaaaatcgtgttcccggga

SEQ ID NO: 1004656 - DNA, 22 bp, Artificial Sequence
  chemically synthesized
tgcccaaaatcgtgttcccggg

SEQ ID NO: 1004657 - DNA, 22 bp, Artificial Sequence
  chemically synthesized
ttttgcccaaaatcgtgttccc

SEQ ID NO: 1004658 - DNA, 22 bp, Artificial Sequence
  chemically synthesized
tgctaggtcccgggaacacgat

SEQ ID NO: 1004659 - DNA, 22 bp, Artificial Sequence
  chemically synthesized
tctattttgcccaaaatcgtgt

SEQ ID NO: 1004660 - DNA, 22 bp, Artificial Sequence
  chemically synthesized
ggtcccgggaacacgattttgg

SEQ ID NO: 1004661 - DNA, 22 bp, Artificial Sequence
  chemically synthesized
tgggcaaaatagacagattcct

SEQ ID NO: 1004662 - DNA, 22 bp, Artificial Sequence
  chemically synthesized
gggcaaaatagacagattcctt

SEQ ID NO: 1004663 - DNA, 22 bp, Artificial Sequence
  chemically synthesized
ggcaaaatagacagattccttt

SEQ ID NO: 1004664 - DNA, 22 bp, Artificial Sequence
  chemically synthesized
taagcagcaagagggaaaggaa

SEQ ID NO: 1004665 - DNA, 22 bp, Artificial Sequence
  chemically synthesized
tattataagcagcaagagggaa

SEQ ID NO: 1004666 - DNA, 22 bp, Artificial Sequence
  chemically synthesized
ctttccctcttgctgcttataa

SEQ ID NO: 1004667 - DNA, 22 bp, Artificial Sequence
  chemically synthesized
agggacaattgtattataagca

SEQ ID NO: 1004668 - DNA, 22 bp, Artificial Sequence
  chemically synthesized
tccctcttgctgcttataatac

SEQ ID NO: 1004669 - DNA, 22 bp, Artificial Sequence
  chemically synthesized
ccctcttgctgcttataataca

SEQ ID NO: 1004670 - DNA, 22 bp, Artificial Sequence
  chemically synthesized
cctcttgctgcttataatacaa

SEQ ID NO: 1004671 - DNA, 22 bp, Artificial Sequence
  chemically synthesized
ttgctgcttataatacaattgt

SEQ ID NO: 1004672 - DNA, 22 bp, Artificial Sequence
  chemically synthesized
gctgcttataatacaattgtcc

SEQ ID NO: 1004673 - DNA, 22 bp, Artificial Sequence
  chemically synthesized
ctgcttataatacaattgtccc

SEQ ID NO: 1004674 - DNA, 22 bp, Artificial Sequence
  chemically synthesized
cttataatacaattgtccctca

SEQ ID NO: 1004675 - DNA, 22 bp, Artificial Sequence
  chemically synthesized
ataatacaattgtccctcagta

SEQ ID NO: 1004676 - DNA, 22 bp, Artificial Sequence
  chemically synthesized
taatacaattgtccctcagtat

SEQ ID NO: 1004677 - DNA, 22 bp, Artificial Sequence
  chemically synthesized
gaaccaatcccccatggatact

SEQ ID NO: 1004678 - DNA, 22 bp, Artificial Sequence
  chemically synthesized
tccctcagtatccatgggggat

SEQ ID NO: 1004679 - DNA, 22 bp, Artificial Sequence
  chemically synthesized
agtatccatgggggattggttc

SEQ ID NO: 1004680 - DNA, 22 bp, Artificial Sequence
  chemically synthesized
tccgtggggatcctggaaccaa

SEQ ID NO: 1004681 - DNA, 22 bp, Artificial Sequence
  chemically synthesized
ctatccgtggggatcctggaac

SEQ ID NO: 1004682 - DNA, 22 bp, Artificial Sequence
  chemically synthesized
gctatccgtggggatcctggaa

SEQ ID NO: 1004683 - DNA, 22 bp, Artificial Sequence
  chemically synthesized
tggatttgctatccgtggggat

SEQ ID NO: 1004684 - DNA, 22 bp, Artificial Sequence
  chemically synthesized
gtggatttgctatccgtgggga

SEQ ID NO: 1004685 - DNA, 22 bp, Artificial Sequence
  chemically synthesized
gttccaggatccccacggatag

SEQ ID NO: 1004686 - DNA, 22 bp, Artificial Sequence
  chemically synthesized
caggatccccacggatagcaaa

SEQ ID NO: 1004687 - DNA, 22 bp, Artificial Sequence
  chemically synthesized
aacatttgtggatttgctatcc

SEQ ID NO: 1004688 - DNA, 22 bp, Artificial Sequence
  chemically synthesized
gaacatttgtggatttgctatc

SEQ ID NO: 1004689 - DNA, 22 bp, Artificial Sequence
  chemically synthesized
tatgtcacttgaacatttgtgg

SEQ ID NO: 1004690 - DNA, 22 bp, Artificial Sequence
  chemically synthesized
atatgtcacttgaacatttgtg

SEQ ID NO: 1004691 - DNA, 22 bp, Artificial Sequence
  chemically synthesized
tatatgtcacttgaacatttgt

SEQ ID NO: 1004692 - DNA, 22 bp, Artificial Sequence
  chemically synthesized
tatggaaatagtatgtcatttt

SEQ ID NO: 1004693 - DNA, 22 bp, Artificial Sequence
  chemically synthesized
aagtgacatataaaatgacata

SEQ ID NO: 1004694 - DNA, 22 bp, Artificial Sequence
  chemically synthesized
tttccatacaacctacacacat

SEQ ID NO: 1004695 - DNA, 22 bp, Artificial Sequence
  chemically synthesized
aagtatataggaggatgtgtgt

SEQ ID NO: 1004696 - DNA, 22 bp, Artificial Sequence
  chemically synthesized
ccatacaacctacacacatcct

SEQ ID NO: 1004697 - DNA, 22 bp, Artificial Sequence
  chemically synthesized
aaagtatataggaggatgtgtg

SEQ ID NO: 1004698 - DNA, 22 bp, Artificial Sequence
  chemically synthesized
catacaacctacacacatcctc

SEQ ID NO: 1004699 - DNA, 22 bp, Artificial Sequence
  chemically synthesized
taaagtatataggaggatgtgt

SEQ ID NO: 1004700 - DNA, 22 bp, Artificial Sequence
  chemically synthesized
gagatgttttaaagtatatagg

SEQ ID NO: 1004701 - DNA, 22 bp, Artificial Sequence
  chemically synthesized
cacacatcctcctatatacttt

SEQ ID NO: 1004702 - DNA, 22 bp, Artificial Sequence
  chemically synthesized
taagtaatctagagatgtttta

SEQ ID NO: 1004703 - DNA, 22 bp, Artificial Sequence
  chemically synthesized
ctatatactttaaaacatctct

SEQ ID NO: 1004704 - DNA, 22 bp, Artificial Sequence
  chemically synthesized
tatactttaaaacatctctaga

SEQ ID NO: 1004705 - DNA, 22 bp, Artificial Sequence
  chemically synthesized
agtattataagtaatctagaga

SEQ ID NO: 1004706 - DNA, 22 bp, Artificial Sequence
  chemically synthesized
taaaacatctctagattactta

SEQ ID NO: 1004707 - DNA, 22 bp, Artificial Sequence
  chemically synthesized
tattaagtattataagtaatct

SEQ ID NO: 1004708 - DNA, 22 bp, Artificial Sequence
  chemically synthesized
aaaacatctctagattacttat

SEQ ID NO: 1004709 - DNA, 22 bp, Artificial Sequence
  chemically synthesized
aaacatctctagattacttata

SEQ ID NO: 1004710 - DNA, 22 bp, Artificial Sequence
  chemically synthesized
cattgtattaagtattataagt

SEQ ID NO: 1004711 - DNA, 22 bp, Artificial Sequence
  chemically synthesized
acattgtattaagtattataag

SEQ ID NO: 1004712 - DNA, 22 bp, Artificial Sequence
  chemically synthesized
tagattacttataatacttaat

SEQ ID NO: 1004713 - DNA, 22 bp, Artificial Sequence
  chemically synthesized
gattacttataatacttaatac

SEQ ID NO: 1004714 - DNA, 22 bp, Artificial Sequence
  chemically synthesized
tatagcatttacattgtattaa

SEQ ID NO: 1004715 - DNA, 22 bp, Artificial Sequence
  chemically synthesized
atatagcatttacattgtatta

SEQ ID NO: 1004716 - DNA, 22 bp, Artificial Sequence
  chemically synthesized
cttataatacttaatacaatgt

SEQ ID NO: 1004717 - DNA, 22 bp, Artificial Sequence
  chemically synthesized
ataatacttaatacaatgtaaa

SEQ ID NO: 1004718 - DNA, 22 bp, Artificial Sequence
  chemically synthesized
taatacttaatacaatgtaaat

SEQ ID NO: 1004719 - DNA, 22 bp, Artificial Sequence
  chemically synthesized
aatacaatgtaaatgctatata

SEQ ID NO: 1004720 - DNA, 22 bp, Artificial Sequence
  chemically synthesized
atacaatgtaaatgctatataa

SEQ ID NO: 1004721 - DNA, 22 bp, Artificial Sequence
  chemically synthesized
aacagtacaatgtaataagtat

SEQ ID NO: 1004722 - DNA, 22 bp, Artificial Sequence
  chemically synthesized
cctaaacagtacaatgtaataa

SEQ ID NO: 1004723 - DNA, 22 bp, Artificial Sequence
  chemically synthesized
tataaatacttattacattgta

SEQ ID NO: 1004724 - DNA, 22 bp, Artificial Sequence
  chemically synthesized
ttccctaaacagtacaatgtaa

SEQ ID NO: 1004725 - DNA, 22 bp, Artificial Sequence
  chemically synthesized
tcattattccctaaacagtaca

SEQ ID NO: 1004726 - DNA, 22 bp, Artificial Sequence
  chemically synthesized
gtcattattccctaaacagtac

SEQ ID NO: 1004727 - DNA, 22 bp, Artificial Sequence
  chemically synthesized
ttgtcattattccctaaacagt

SEQ ID NO: 1004728 - DNA, 22 bp, Artificial Sequence
  chemically synthesized
cttgtcattattccctaaacag

SEQ ID NO: 1004729 - DNA, 22 bp, Artificial Sequence
  chemically synthesized
attacattgtactgtttaggga

SEQ ID NO: 1004730 - DNA, 22 bp, Artificial Sequence
  chemically synthesized
tcttgtcattattccctaaaca

SEQ ID NO: 1004731 - DNA, 22 bp, Artificial Sequence
  chemically synthesized
ttacattgtactgtttagggaa

SEQ ID NO: 1004732 - DNA, 22 bp, Artificial Sequence
  chemically synthesized
ttcttgtcattattccctaaac

SEQ ID NO: 1004733 - DNA, 22 bp, Artificial Sequence
  chemically synthesized
cattgtactgtttagggaataa

SEQ ID NO: 1004734 - DNA, 22 bp, Artificial Sequence
  chemically synthesized
tactgtttagggaataatgaca

SEQ ID NO: 1004735 - DNA, 22 bp, Artificial Sequence
  chemically synthesized
taggtgtttttcttgtcattat

SEQ ID NO: 1004736 - DNA, 22 bp, Artificial Sequence
  chemically synthesized
ataggtgtttttcttgtcatta

SEQ ID NO: 1004737 - DNA, 22 bp, Artificial Sequence
  chemically synthesized
tttagggaataatgacaagaaa

SEQ ID NO: 1004738 - DNA, 22 bp, Artificial Sequence
  chemically synthesized
agggaataatgacaagaaaaac

SEQ ID NO: 1004739 - DNA, 22 bp, Artificial Sequence
  chemically synthesized
gggaataatgacaagaaaaaca

SEQ ID NO: 1004740 - DNA, 22 bp, Artificial Sequence
  chemically synthesized
atgatttataggtgtttttctt

SEQ ID NO: 1004741 - DNA, 22 bp, Artificial Sequence
  chemically synthesized
tactgatgatttataggtgttt

SEQ ID NO: 1004742 - DNA, 22 bp, Artificial Sequence
  chemically synthesized
tgtactgatgatttataggtgt

SEQ ID NO: 1004743 - DNA, 22 bp, Artificial Sequence
  chemically synthesized
cctctgtactgatgatttatag

SEQ ID NO: 1004744 - DNA, 22 bp, Artificial Sequence
  chemically synthesized
taaatcatcagtacagaggtag

SEQ ID NO: 1004745 - DNA, 22 bp, Artificial Sequence
  chemically synthesized
agaaaaacaatgaatgcctacc

SEQ ID NO: 1004746 - DNA, 22 bp, Artificial Sequence
  chemically synthesized
attgtttttctgaatatttttg

SEQ ID NO: 1004747 - DNA, 22 bp, Artificial Sequence
  chemically synthesized
tttttctgaatatttttgatgc

SEQ ID NO: 1004748 - DNA, 22 bp, Artificial Sequence
  chemically synthesized
tgaatgcaaccatgcatcaaaa

SEQ ID NO: 1004749 - DNA, 22 bp, Artificial Sequence
  chemically synthesized
ttctgaatatttttgatgcatg

SEQ ID NO: 1004750 - DNA, 22 bp, Artificial Sequence
  chemically synthesized
tctgaatatttttgatgcatgg

SEQ ID NO: 1004751 - DNA, 22 bp, Artificial Sequence
  chemically synthesized
ctgaatatttttgatgcatggt

SEQ ID NO: 1004752 - DNA, 22 bp, Artificial Sequence
  chemically synthesized
tgaatatttttgatgcatggtt

SEQ ID NO: 1004753 - DNA, 22 bp, Artificial Sequence
  chemically synthesized
aatatttttgatgcatggttgc

SEQ ID NO: 1004754 - DNA, 22 bp, Artificial Sequence
  chemically synthesized
caaatctgtgaatgcaaccatg

SEQ ID NO: 1004755 - DNA, 22 bp, Artificial Sequence
  chemically synthesized
gattacaaatctgtgaatgcaa

SEQ ID NO: 1004756 - DNA, 22 bp, Artificial Sequence
  chemically synthesized
ttgatgcatggttgcattcaca

SEQ ID NO: 1004757 - DNA, 22 bp, Artificial Sequence
  chemically synthesized
ggattacaaatctgtgaatgca

SEQ ID NO: 1004758 - DNA, 22 bp, Artificial Sequence
  chemically synthesized
tgatgcatggttgcattcacag

SEQ ID NO: 1004759 - DNA, 22 bp, Artificial Sequence
  chemically synthesized
gatgcatggttgcattcacaga

SEQ ID NO: 1004760 - DNA, 22 bp, Artificial Sequence
  chemically synthesized
ttggattacaaatctgtgaatg

SEQ ID NO: 1004761 - DNA, 22 bp, Artificial Sequence
  chemically synthesized
atgcatggttgcattcacagat

SEQ ID NO: 1004762 - DNA, 22 bp, Artificial Sequence
  chemically synthesized
atattcttggattacaaatctg

SEQ ID NO: 1004763 - DNA, 22 bp, Artificial Sequence
  chemically synthesized
catattcttggattacaaatct

SEQ ID NO: 1004764 - DNA, 22 bp, Artificial Sequence
  chemically synthesized
ttcatattcttggattacaaat

SEQ ID NO: 1004765 - DNA, 22 bp, Artificial Sequence
  chemically synthesized
cattcacagatttgtaatccaa

SEQ ID NO: 1004766 - DNA, 22 bp, Artificial Sequence
  chemically synthesized
acagatttgtaatccaagaata

SEQ ID NO: 1004767 - DNA, 22 bp, Artificial Sequence
  chemically synthesized
gtacaggggctcttcatattct

SEQ ID NO: 1004768 - DNA, 22 bp, Artificial Sequence
  chemically synthesized
gtaatccaagaatatgaagagc

SEQ ID NO: 1004769 - DNA, 22 bp, Artificial Sequence
  chemically synthesized
cctggtacaggggctcttcata

SEQ ID NO: 1004770 - DNA, 22 bp, Artificial Sequence
  chemically synthesized
taatccaagaatatgaagagcc

SEQ ID NO: 1004771 - DNA, 22 bp, Artificial Sequence
  chemically synthesized
acctggtacaggggctcttcat

SEQ ID NO: 1004772 - DNA, 22 bp, Artificial Sequence
  chemically synthesized
ttacctggtacaggggctcttc

SEQ ID NO: 1004773 - DNA, 22 bp, Artificial Sequence
  chemically synthesized
catcaatgtccctcttacctgg

SEQ ID NO: 1004774 - DNA, 22 bp, Artificial Sequence
  chemically synthesized
ccatcaatgtccctcttacctg

SEQ ID NO: 1004775 - DNA, 22 bp, Artificial Sequence
  chemically synthesized
taatgtttccatcaatgtccct

SEQ ID NO: 1004776 - DNA, 22 bp, Artificial Sequence
  chemically synthesized
taccaggtaagagggacattga

SEQ ID NO: 1004777 - DNA, 22 bp, Artificial Sequence
  chemically synthesized
actgtaatgtttccatcaatgt

SEQ ID NO: 1004778 - DNA, 22 bp, Artificial Sequence
  chemically synthesized
aactgtaatgtttccatcaatg

SEQ ID NO: 1004779 - DNA, 22 bp, Artificial Sequence
  chemically synthesized
taactgtaatgtttccatcaat

SEQ ID NO: 1004780 - DNA, 22 bp, Artificial Sequence
  chemically synthesized
agttttaactgtaatgtttcca

SEQ ID NO: 1004781 - DNA, 22 bp, Artificial Sequence
  chemically synthesized
taacctcagttttaactgtaat

SEQ ID NO: 1004782 - DNA, 22 bp, Artificial Sequence
  chemically synthesized
gtaacctcagttttaactgtaa

SEQ ID NO: 1004783 - DNA, 22 bp, Artificial Sequence
  chemically synthesized
atggaaacattacagttaaaac

SEQ ID NO: 1004784 - DNA, 22 bp, Artificial Sequence
  chemically synthesized
tcgtatttgtaacctcagtttt

SEQ ID NO: 1004785 - DNA, 22 bp, Artificial Sequence
  chemically synthesized
gtcgtatttgtaacctcagttt

SEQ ID NO: 1004786 - DNA, 22 bp, Artificial Sequence
  chemically synthesized
cagttaaaactgaggttacaaa

SEQ ID NO: 1004787 - DNA, 22 bp, Artificial Sequence
  chemically synthesized
aggcaacacttgtcgtatttgt

SEQ ID NO: 1004788 - DNA, 22 bp, Artificial Sequence
  chemically synthesized
aaactgaggttacaaatacgac

SEQ ID NO: 1004789 - DNA, 22 bp, Artificial Sequence
  chemically synthesized
caggcaacacttgtcgtatttg

SEQ ID NO: 1004790 - DNA, 22 bp, Artificial Sequence
  chemically synthesized
aggttacaaatacgacaagtgt

SEQ ID NO: 1004791 - DNA, 22 bp, Artificial Sequence
  chemically synthesized
atagtttcaggcaacacttgtc

SEQ ID NO: 1004792 - DNA, 22 bp, Artificial Sequence
  chemically synthesized
tcatagtttcaggcaacacttg

SEQ ID NO: 1004793 - DNA, 22 bp, Artificial Sequence
  chemically synthesized
caaatacgacaagtgttgcctg

SEQ ID NO: 1004794 - DNA, 22 bp, Artificial Sequence
  chemically synthesized
tatgctctcatagtttcaggca

SEQ ID NO: 1004795 - DNA, 22 bp, Artificial Sequence
  chemically synthesized
ttatatgctctcatagtttcag

SEQ ID NO: 1004796 - DNA, 22 bp, Artificial Sequence
  chemically synthesized
attatatgctctcatagtttca

SEQ ID NO: 1004797 - DNA, 22 bp, Artificial Sequence
  chemically synthesized
cctgaaactatgagagcatata

SEQ ID NO: 1004798 - DNA, 22 bp, Artificial Sequence
  chemically synthesized
aaactatgagagcatataataa

SEQ ID NO: 1004799 - DNA, 22 bp, Artificial Sequence
  chemically synthesized
aatataggcccccttattatat

SEQ ID NO: 1004800 - DNA, 22 bp, Artificial Sequence
  chemically synthesized
aaatataggcccccttattata

SEQ ID NO: 1004801 - DNA, 22 bp, Artificial Sequence
  chemically synthesized
taaatataggcccccttattat

SEQ ID NO: 1004802 - DNA, 22 bp, Artificial Sequence
  chemically synthesized
ttaaatataggcccccttatta

SEQ ID NO: 1004803 - DNA, 22 bp, Artificial Sequence
  chemically synthesized
tgagagcatataataagggggc

SEQ ID NO: 1004804 - DNA, 22 bp, Artificial Sequence
  chemically synthesized
cttttaaatataggccccctta

SEQ ID NO: 1004805 - DNA, 22 bp, Artificial Sequence
  chemically synthesized
tgtgagatgttacttttaaata

SEQ ID NO: 1004806 - DNA, 22 bp, Artificial Sequence
  chemically synthesized
tgaggattatgtgagatgttac

SEQ ID NO: 1004807 - DNA, 22 bp, Artificial Sequence
  chemically synthesized
tatttaaaagtaacatctcaca

SEQ ID NO: 1004808 - DNA, 22 bp, Artificial Sequence
  chemically synthesized
aaaagtaacatctcacataatc

SEQ ID NO: 1004809 - DNA, 22 bp, Artificial Sequence
  chemically synthesized
ggtcattgtgaggattatgtga

SEQ ID NO: 1004810 - DNA, 22 bp, Artificial Sequence
  chemically synthesized
aaagtaacatctcacataatcc

SEQ ID NO: 1004811 - DNA, 22 bp, Artificial Sequence
  chemically synthesized
gggtcattgtgaggattatgtg

SEQ ID NO: 1004812 - DNA, 22 bp, Artificial Sequence
  chemically synthesized
acataatcctcacaatgaccca

SEQ ID NO: 1004813 - DNA, 22 bp, Artificial Sequence
  chemically synthesized
aggtgaaaatgcatgtttgggt

SEQ ID NO: 1004814 - DNA, 22 bp, Artificial Sequence
  chemically synthesized
aaggtgaaaatgcatgtttggg

SEQ ID NO: 1004815 - DNA, 22 bp, Artificial Sequence
  chemically synthesized
acaatgacccaaacatgcattt

SEQ ID NO: 1004816 - DNA, 22 bp, Artificial Sequence
  chemically synthesized
atatttaaggtgaaaatgcatg

SEQ ID NO: 1004817 - DNA, 22 bp, Artificial Sequence
  chemically synthesized
ctgatatttaaggtgaaaatgc

SEQ ID NO: 1004818 - DNA, 22 bp, Artificial Sequence
  chemically synthesized
cctgatatttaaggtgaaaatg

SEQ ID NO: 1004819 - DNA, 22 bp, Artificial Sequence
  chemically synthesized
cttcctgatatttaaggtgaaa

SEQ ID NO: 1004820 - DNA, 22 bp, Artificial Sequence
  chemically synthesized
gcttcctgatatttaaggtgaa

SEQ ID NO: 1004821 - DNA, 22 bp, Artificial Sequence
  chemically synthesized
tgcttcctgatatttaaggtga

SEQ ID NO: 1004822 - DNA, 22 bp, Artificial Sequence
  chemically synthesized
tgcaattttgcttcctgatatt

SEQ ID NO: 1004823 - DNA, 22 bp, Artificial Sequence
  chemically synthesized
tcaccttaaatatcaggaagca

SEQ ID NO: 1004824 - DNA, 22 bp, Artificial Sequence
  chemically synthesized
caccttaaatatcaggaagcaa

SEQ ID NO: 1004825 - DNA, 22 bp, Artificial Sequence
  chemically synthesized
accttaaatatcaggaagcaaa

SEQ ID NO: 1004826 - DNA, 22 bp, Artificial Sequence
  chemically synthesized
agaatacctgtgcaattttgct

SEQ ID NO: 1004827 - DNA, 22 bp, Artificial Sequence
  chemically synthesized
aaatatcaggaagcaaaattgc

SEQ ID NO: 1004828 - DNA, 22 bp, Artificial Sequence
  chemically synthesized
aatatcaggaagcaaaattgca

SEQ ID NO: 1004829 - DNA, 22 bp, Artificial Sequence
  chemically synthesized
cacaggtattcttaacatggat

SEQ ID NO: 1004830 - DNA, 22 bp, Artificial Sequence
  chemically synthesized
aggcccagacccggcatccatg

SEQ ID NO: 1004831 - DNA, 22 bp, Artificial Sequence
  chemically synthesized
gaggcccagacccggcatccat

SEQ ID NO: 1004832 - DNA, 22 bp, Artificial Sequence
  chemically synthesized
ttgaggcccagacccggcatcc

SEQ ID NO: 1004833 - DNA, 22 bp, Artificial Sequence
  chemically synthesized
cttgaggcccagacccggcatc

SEQ ID NO: 1004834 - DNA, 22 bp, Artificial Sequence
  chemically synthesized
ttcttgaggcccagacccggca

SEQ ID NO: 1004835 - DNA, 22 bp, Artificial Sequence
  chemically synthesized
ttaacatggatgccgggtctgg

SEQ ID NO: 1004836 - DNA, 22 bp, Artificial Sequence
  chemically synthesized
aacatggatgccgggtctgggc

SEQ ID NO: 1004837 - DNA, 22 bp, Artificial Sequence
  chemically synthesized
acatggatgccgggtctgggcc

SEQ ID NO: 1004838 - DNA, 22 bp, Artificial Sequence
  chemically synthesized
ggcctcaagaagaatccctggt

SEQ ID NO: 1004839 - DNA, 22 bp, Artificial Sequence
  chemically synthesized
atagagtgaaggaaccagggat

SEQ ID NO: 1004840 - DNA, 22 bp, Artificial Sequence
  chemically synthesized
cctcatagagtgaaggaaccag

SEQ ID NO: 1004841 - DNA, 22 bp, Artificial Sequence
  chemically synthesized
aagaagaatccctggttccttc

SEQ ID NO: 1004842 - DNA, 22 bp, Artificial Sequence
  chemically synthesized
ggtatcatacctccctcataga

SEQ ID NO: 1004843 - DNA, 22 bp, Artificial Sequence
  chemically synthesized
gggtatcatacctccctcatag

SEQ ID NO: 1004844 - DNA, 22 bp, Artificial Sequence
  chemically synthesized
gttccttcactctatgagggag

SEQ ID NO: 1004845 - DNA, 22 bp, Artificial Sequence
  chemically synthesized
cttcactctatgagggaggtat

SEQ ID NO: 1004846 - DNA, 22 bp, Artificial Sequence
  chemically synthesized
agtcttgggtatcatacctccc

SEQ ID NO: 1004847 - DNA, 22 bp, Artificial Sequence
  chemically synthesized
gagtcttgggtatcatacctcc

SEQ ID NO: 1004848 - DNA, 22 bp, Artificial Sequence
  chemically synthesized
cactctatgagggaggtatgat

SEQ ID NO: 1004849 - DNA, 22 bp, Artificial Sequence
  chemically synthesized
tgagtcttgggtatcatacctc

SEQ ID NO: 1004850 - DNA, 22 bp, Artificial Sequence
  chemically synthesized
actctatgagggaggtatgata

SEQ ID NO: 1004851 - DNA, 22 bp, Artificial Sequence
  chemically synthesized
gctttgagtcttgggtatcata

SEQ ID NO: 1004852 - DNA, 22 bp, Artificial Sequence
  chemically synthesized
tatgagggaggtatgataccca

SEQ ID NO: 1004853 - DNA, 22 bp, Artificial Sequence
  chemically synthesized
ggctttgagtcttgggtatcat

SEQ ID NO: 1004854 - DNA, 22 bp, Artificial Sequence
  chemically synthesized
tgagggaggtatgatacccaag

SEQ ID NO: 1004855 - DNA, 22 bp, Artificial Sequence
  chemically synthesized
tgcatacttggctttgagtctt

SEQ ID NO: 1004856 - DNA, 22 bp, Artificial Sequence
  chemically synthesized
agactatgcatacttggctttg

SEQ ID NO: 1004857 - DNA, 22 bp, Artificial Sequence
  chemically synthesized
tgagttaagactatgcatactt

SEQ ID NO: 1004858 - DNA, 22 bp, Artificial Sequence
  chemically synthesized
aaagccaagtatgcatagtctt

SEQ ID NO: 1004859 - DNA, 22 bp, Artificial Sequence
  chemically synthesized
aactcatagttccttctgacac

SEQ ID NO: 1004860 - DNA, 22 bp, Artificial Sequence
  chemically synthesized
actcatagttccttctgacacc

SEQ ID NO: 1004861 - DNA, 22 bp, Artificial Sequence
  chemically synthesized
tggtagaaagcatggtgtcaga

SEQ ID NO: 1004862 - DNA, 22 bp, Artificial Sequence
  chemically synthesized
atagttccttctgacaccatgc

SEQ ID NO: 1004863 - DNA, 22 bp, Artificial Sequence
  chemically synthesized
gcctgtggtagaaagcatggtg

SEQ ID NO: 1004864 - DNA, 22 bp, Artificial Sequence
  chemically synthesized
cttctgacaccatgctttctac

SEQ ID NO: 1004865 - DNA, 22 bp, Artificial Sequence
  chemically synthesized
aatcctagcctgtggtagaaag

SEQ ID NO: 1004866 - DNA, 22 bp, Artificial Sequence
  chemically synthesized
ctgacaccatgctttctaccac

SEQ ID NO: 1004867 - DNA, 22 bp, Artificial Sequence
  chemically synthesized
gaatcctagcctgtggtagaaa

SEQ ID NO: 1004868 - DNA, 22 bp, Artificial Sequence
  chemically synthesized
tgacaccatgctttctaccaca

SEQ ID NO: 1004869 - DNA, 22 bp, Artificial Sequence
  chemically synthesized
tgaatcctagcctgtggtagaa

SEQ ID NO: 1004870 - DNA, 22 bp, Artificial Sequence
  chemically synthesized
acaccatgctttctaccacagg

SEQ ID NO: 1004871 - DNA, 22 bp, Artificial Sequence
  chemically synthesized
actttgaatcctagcctgtggt

SEQ ID NO: 1004872 - DNA, 22 bp, Artificial Sequence
  chemically synthesized
tggctgactttgaatcctagcc

SEQ ID NO: 1004873 - DNA, 22 bp, Artificial Sequence
  chemically synthesized
atggctgactttgaatcctagc

SEQ ID NO: 1004874 - DNA, 22 bp, Artificial Sequence
  chemically synthesized
tatggctgactttgaatcctag

SEQ ID NO: 1004875 - DNA, 22 bp, Artificial Sequence
  chemically synthesized
tctaccacaggctaggattcaa

SEQ ID NO: 1004876 - DNA, 22 bp, Artificial Sequence
  chemically synthesized
ctaccacaggctaggattcaaa

SEQ ID NO: 1004877 - DNA, 22 bp, Artificial Sequence
  chemically synthesized
taccacaggctaggattcaaag

SEQ ID NO: 1004878 - DNA, 22 bp, Artificial Sequence
  chemically synthesized
ccacaggctaggattcaaagtc

SEQ ID NO: 1004879 - DNA, 22 bp, Artificial Sequence
  chemically synthesized
gatctttatggctgactttgaa

SEQ ID NO: 1004880 - DNA, 22 bp, Artificial Sequence
  chemically synthesized
tggatctttatggctgactttg

SEQ ID NO: 1004881 - DNA, 22 bp, Artificial Sequence
  chemically synthesized
ctggatctttatggctgacttt

SEQ ID NO: 1004882 - DNA, 22 bp, Artificial Sequence
  chemically synthesized
atttctggatctttatggctga

SEQ ID NO: 1004883 - DNA, 22 bp, Artificial Sequence
  chemically synthesized
ggattcaaagtcagccataaag

SEQ ID NO: 1004884 - DNA, 22 bp, Artificial Sequence
  chemically synthesized
ctcatttctggatctttatggc

SEQ ID NO: 1004885 - DNA, 22 bp, Artificial Sequence
  chemically synthesized
actcatttctggatctttatgg

SEQ ID NO: 1004886 - DNA, 22 bp, Artificial Sequence
  chemically synthesized
tactcatttctggatctttatg

SEQ ID NO: 1004887 - DNA, 22 bp, Artificial Sequence
  chemically synthesized
aaagtcagccataaagatccag

SEQ ID NO: 1004888 - DNA, 22 bp, Artificial Sequence
  chemically synthesized
gatgtatgttttactcatttct

SEQ ID NO: 1004889 - DNA, 22 bp, Artificial Sequence
  chemically synthesized
actagatgtatgttttactcat

SEQ ID NO: 1004890 - DNA, 22 bp, Artificial Sequence
  chemically synthesized
aactagatgtatgttttactca

SEQ ID NO: 1004891 - DNA, 22 bp, Artificial Sequence
  chemically synthesized
cccttaactagatgtatgtttt

SEQ ID NO: 1004892 - DNA, 22 bp, Artificial Sequence
  chemically synthesized
tccccttaactagatgtatgtt

SEQ ID NO: 1004893 - DNA, 22 bp, Artificial Sequence
  chemically synthesized
ctccccttaactagatgtatgt

SEQ ID NO: 1004894 - DNA, 22 bp, Artificial Sequence
  chemically synthesized
agccttctccccttaactagat

SEQ ID NO: 1004895 - DNA, 22 bp, Artificial Sequence
  chemically synthesized
gagagcaattaagccttctccc

SEQ ID NO: 1004896 - DNA, 22 bp, Artificial Sequence
  chemically synthesized
gttaaggggagaaggcttaatt

SEQ ID NO: 1004897 - DNA, 22 bp, Artificial Sequence
  chemically synthesized
gcaacctagagagcaattaagc

SEQ ID NO: 1004898 - DNA, 22 bp, Artificial Sequence
  chemically synthesized
aggggagaaggcttaattgctc

SEQ ID NO: 1004899 - DNA, 22 bp, Artificial Sequence
  chemically synthesized
atattggcaacctagagagcaa

SEQ ID NO: 1004900 - DNA, 22 bp, Artificial Sequence
  chemically synthesized
catattggcaacctagagagca

SEQ ID NO: 1004901 - DNA, 22 bp, Artificial Sequence
  chemically synthesized
atttcatattggcaacctagag

SEQ ID NO: 1004902 - DNA, 22 bp, Artificial Sequence
  chemically synthesized
catttcatattggcaacctaga

SEQ ID NO: 1004903 - DNA, 22 bp, Artificial Sequence
  chemically synthesized
tcatttcatattggcaacctag

SEQ ID NO: 1004904 - DNA, 22 bp, Artificial Sequence
  chemically synthesized
ttcatttcatattggcaaccta

SEQ ID NO: 1004905 - DNA, 22 bp, Artificial Sequence
  chemically synthesized
tttcatttcatattggcaacct

SEQ ID NO: 1004906 - DNA, 22 bp, Artificial Sequence
  chemically synthesized
aattgctctctaggttgccaat

SEQ ID NO: 1004907 - DNA, 22 bp, Artificial Sequence
  chemically synthesized
attgctctctaggttgccaata

SEQ ID NO: 1004908 - DNA, 22 bp, Artificial Sequence
  chemically synthesized
tttttcatttcatattggcaac

SEQ ID NO: 1004909 - DNA, 22 bp, Artificial Sequence
  chemically synthesized
ctctctaggttgccaatatgaa

SEQ ID NO: 1004910 - DNA, 22 bp, Artificial Sequence
  chemically synthesized
tctaggttgccaatatgaaatg

SEQ ID NO: 1004911 - DNA, 22 bp, Artificial Sequence
  chemically synthesized
gccattctttttcatttcatat

SEQ ID NO: 1004912 - DNA, 22 bp, Artificial Sequence
  chemically synthesized
taggttgccaatatgaaatgaa

SEQ ID NO: 1004913 - DNA, 22 bp, Artificial Sequence
  chemically synthesized
ggttgccaatatgaaatgaaaa

SEQ ID NO: 1004914 - DNA, 22 bp, Artificial Sequence
  chemically synthesized
ccaatatgaaatgaaaaagaat

SEQ ID NO: 1004915 - DNA, 22 bp, Artificial Sequence
  chemically synthesized
agagatgtggttagccattctt

SEQ ID NO: 1004916 - DNA, 22 bp, Artificial Sequence
  chemically synthesized
acaatgctgagagatgtggtta

SEQ ID NO: 1004917 - DNA, 22 bp, Artificial Sequence
  chemically synthesized
gacaatgctgagagatgtggtt

SEQ ID NO: 1004918 - DNA, 22 bp, Artificial Sequence
  chemically synthesized
tgacaatgctgagagatgtggt

SEQ ID NO: 1004919 - DNA, 22 bp, Artificial Sequence
  chemically synthesized
ttttgacaatgctgagagatgt

SEQ ID NO: 1004920 - DNA, 22 bp, Artificial Sequence
  chemically synthesized
gctattttgacaatgctgagag

SEQ ID NO: 1004921 - DNA, 22 bp, Artificial Sequence
  chemically synthesized
attggctattttgacaatgctg

SEQ ID NO: 1004922 - DNA, 22 bp, Artificial Sequence
  chemically synthesized
accacatctctcagcattgtca

SEQ ID NO: 1004923 - DNA, 22 bp, Artificial Sequence
  chemically synthesized
ttcattggctattttgacaatg

SEQ ID NO: 1004924 - DNA, 22 bp, Artificial Sequence
  chemically synthesized
tgttcattggctattttgacaa

SEQ ID NO: 1004925 - DNA, 22 bp, Artificial Sequence
  chemically synthesized
tctgttcattggctattttgac

SEQ ID NO: 1004926 - DNA, 22 bp, Artificial Sequence
  chemically synthesized
tctctgttcattggctattttg

SEQ ID NO: 1004927 - DNA, 22 bp, Artificial Sequence
  chemically synthesized
tcagcattgtcaaaatagccaa

SEQ ID NO: 1004928 - DNA, 22 bp, Artificial Sequence
  chemically synthesized
agcattgtcaaaatagccaatg

SEQ ID NO: 1004929 - DNA, 22 bp, Artificial Sequence
  chemically synthesized
cagtgctctctctgttcattgg

SEQ ID NO: 1004930 - DNA, 22 bp, Artificial Sequence
  chemically synthesized
gcagtgctctctctgttcattg

SEQ ID NO: 1004931 - DNA, 22 bp, Artificial Sequence
  chemically synthesized
tgcagtgctctctctgttcatt

SEQ ID NO: 1004932 - DNA, 22 bp, Artificial Sequence
  chemically synthesized
tcaaaatagccaatgaacagag

SEQ ID NO: 1004933 - DNA, 22 bp, Artificial Sequence
  chemically synthesized
ggggtctttgcagtgctctctc

SEQ ID NO: 1004934 - DNA, 22 bp, Artificial Sequence
  chemically synthesized
agttgggggtctttgcagtgct

SEQ ID NO: 1004935 - DNA, 22 bp, Artificial Sequence
  chemically synthesized
aattgagttgggggtctttgca

SEQ ID NO: 1004936 - DNA, 22 bp, Artificial Sequence
  chemically synthesized
caaagacccccaactcaattca

SEQ ID NO: 1004937 - DNA, 22 bp, Artificial Sequence
  chemically synthesized
cacataggtagaaatgaagtct

SEQ ID NO: 1004938 - DNA, 22 bp, Artificial Sequence
  chemically synthesized
aattcagacttcatttctacct

SEQ ID NO: 1004939 - DNA, 22 bp, Artificial Sequence
  chemically synthesized
cagcaattccacataggtagaa

SEQ ID NO: 1004940 - DNA, 22 bp, Artificial Sequence
  chemically synthesized
agacttcatttctacctatgtg

SEQ ID NO: 1004941 - DNA, 22 bp, Artificial Sequence
  chemically synthesized
gctgcagcaattccacataggt

SEQ ID NO: 1004942 - DNA, 22 bp, Artificial Sequence
  chemically synthesized
tggctgcagcaattccacatag

SEQ ID NO: 1004943 - DNA, 22 bp, Artificial Sequence
  chemically synthesized
ctggctgcagcaattccacata

SEQ ID NO: 1004944 - DNA, 22 bp, Artificial Sequence
  chemically synthesized
catttctacctatgtggaattg

SEQ ID NO: 1004945 - DNA, 22 bp, Artificial Sequence
  chemically synthesized
atttctacctatgtggaattgc

SEQ ID NO: 1004946 - DNA, 22 bp, Artificial Sequence
  chemically synthesized
aatttctggctgcagcaattcc

SEQ ID NO: 1004947 - DNA, 22 bp, Artificial Sequence
  chemically synthesized
aaatttctggctgcagcaattc

SEQ ID NO: 1004948 - DNA, 22 bp, Artificial Sequence
  chemically synthesized
ctacctatgtggaattgctgca

SEQ ID NO: 1004949 - DNA, 22 bp, Artificial Sequence
  chemically synthesized
tacctatgtggaattgctgcag

SEQ ID NO: 1004950 - DNA, 22 bp, Artificial Sequence
  chemically synthesized
cttaaatttctggctgcagcaa

SEQ ID NO: 1004951 - DNA, 22 bp, Artificial Sequence
  chemically synthesized
cctatgtggaattgctgcagcc

SEQ ID NO: 1004952 - DNA, 22 bp, Artificial Sequence
  chemically synthesized
acttaaatttctggctgcagca

SEQ ID NO: 1004953 - DNA, 22 bp, Artificial Sequence
  chemically synthesized
tgtggaattgctgcagccagaa

SEQ ID NO: 1004954 - DNA, 22 bp, Artificial Sequence
  chemically synthesized
agtaacatttacttaaatttct

SEQ ID NO: 1004955 - DNA, 22 bp, Artificial Sequence
  chemically synthesized
aagtaacatttacttaaatttc

SEQ ID NO: 1004956 - DNA, 22 bp, Artificial Sequence
  chemically synthesized
ctgcagccagaaatttaagtaa

SEQ ID NO: 1004957 - DNA, 22 bp, Artificial Sequence
  chemically synthesized
catttaagtaacatttacttaa

SEQ ID NO: 1004958 - DNA, 22 bp, Artificial Sequence
  chemically synthesized
cagccagaaatttaagtaaatg

SEQ ID NO: 1004959 - DNA, 22 bp, Artificial Sequence
  chemically synthesized
acatttaagtaacatttactta

SEQ ID NO: 1004960 - DNA, 22 bp, Artificial Sequence
  chemically synthesized
ttacatttaagtaacatttact

SEQ ID NO: 1004961 - DNA, 22 bp, Artificial Sequence
  chemically synthesized
aagtaaatgttacttaaatgta

SEQ ID NO: 1004962 - DNA, 22 bp, Artificial Sequence
  chemically synthesized
agtaaatgttacttaaatgtaa

SEQ ID NO: 1004963 - DNA, 22 bp, Artificial Sequence
  chemically synthesized
ggtacatggctcttacatttaa

SEQ ID NO: 1004964 - DNA, 22 bp, Artificial Sequence
  chemically synthesized
agagttaggtacatggctctta

SEQ ID NO: 1004965 - DNA, 22 bp, Artificial Sequence
  chemically synthesized
aagagttaggtacatggctctt

SEQ ID NO: 1004966 - DNA, 22 bp, Artificial Sequence
  chemically synthesized
cttaaatgtaagagccatgtac

SEQ ID NO: 1004967 - DNA, 22 bp, Artificial Sequence
  chemically synthesized
aaatgtaagagccatgtaccta

SEQ ID NO: 1004968 - DNA, 22 bp, Artificial Sequence
  chemically synthesized
aatgtaagagccatgtacctaa

SEQ ID NO: 1004969 - DNA, 22 bp, Artificial Sequence
  chemically synthesized
aggatatccacttaagagttag

SEQ ID NO: 1004970 - DNA, 22 bp, Artificial Sequence
  chemically synthesized
gaggatatccacttaagagtta

SEQ ID NO: 1004971 - DNA, 22 bp, Artificial Sequence
  chemically synthesized
catttgaggatatccacttaag

SEQ ID NO: 1004972 - DNA, 22 bp, Artificial Sequence
  chemically synthesized
gcatttgaggatatccacttaa

SEQ ID NO: 1004973 - DNA, 22 bp, Artificial Sequence
  chemically synthesized
actcttaagtggatatcctcaa

SEQ ID NO: 1004974 - DNA, 22 bp, Artificial Sequence
  chemically synthesized
aatggatatttgcatttgagga

SEQ ID NO: 1004975 - DNA, 22 bp, Artificial Sequence
  chemically synthesized
ttaagtggatatcctcaaatgc

SEQ ID NO: 1004976 - DNA, 22 bp, Artificial Sequence
  chemically synthesized
aaatggatatttgcatttgagg

SEQ ID NO: 1004977 - DNA, 22 bp, Artificial Sequence
  chemically synthesized
taaatggatatttgcatttgag

SEQ ID NO: 1004978 - DNA, 22 bp, Artificial Sequence
  chemically synthesized
aagtggatatcctcaaatgcaa

SEQ ID NO: 1004979 - DNA, 22 bp, Artificial Sequence
  chemically synthesized
agtggatatcctcaaatgcaaa

SEQ ID NO: 1004980 - DNA, 22 bp, Artificial Sequence
  chemically synthesized
tatattttaaatggatatttgc

SEQ ID NO: 1004981 - DNA, 22 bp, Artificial Sequence
  chemically synthesized
gtatattttaaatggatatttg

SEQ ID NO: 1004982 - DNA, 22 bp, Artificial Sequence
  chemically synthesized
ttgtatattttaaatggatatt

SEQ ID NO: 1004983 - DNA, 22 bp, Artificial Sequence
  chemically synthesized
aaatgcaaatatccatttaaaa

SEQ ID NO: 1004984 - DNA, 22 bp, Artificial Sequence
  chemically synthesized
tatcacagtaattcttgtatat

SEQ ID NO: 1004985 - DNA, 22 bp, Artificial Sequence
  chemically synthesized
atatcacagtaattcttgtata

SEQ ID NO: 1004986 - DNA, 22 bp, Artificial Sequence
  chemically synthesized
tatatcacagtaattcttgtat

SEQ ID NO: 1004987 - DNA, 22 bp, Artificial Sequence
  chemically synthesized
ctttatatcacagtaattcttg

SEQ ID NO: 1004988 - DNA, 22 bp, Artificial Sequence
  chemically synthesized
ttactttatatcacagtaattc

SEQ ID NO: 1004989 - DNA, 22 bp, Artificial Sequence
  chemically synthesized
aaaatatacaagaattactgtg

SEQ ID NO: 1004990 - DNA, 22 bp, Artificial Sequence
  chemically synthesized
aaatatacaagaattactgtga

SEQ ID NO: 1004991 - DNA, 22 bp, Artificial Sequence
  chemically synthesized
ctgtgatataaagtaacaattg

SEQ ID NO: 1004992 - DNA, 22 bp, Artificial Sequence
  chemically synthesized
tgatataaagtaacaattgcta

SEQ ID NO: 1004993 - DNA, 22 bp, Artificial Sequence
  chemically synthesized
ggcgacaaaagtaaaagataca

SEQ ID NO: 1004994 - DNA, 22 bp, Artificial Sequence
  chemically synthesized
ctatgtatcttttacttttgtc

SEQ ID NO: 1004995 - DNA, 22 bp, Artificial Sequence
  chemically synthesized
aaggccactgggcgacaaaagt

SEQ ID NO: 1004996 - DNA, 22 bp, Artificial Sequence
  chemically synthesized
tgtatcttttacttttgtcgcc

SEQ ID NO: 1004997 - DNA, 22 bp, Artificial Sequence
  chemically synthesized
ttacttttgtcgcccagtggcc

SEQ ID NO: 1004998 - DNA, 22 bp, Artificial Sequence
  chemically synthesized
tacttttgtcgcccagtggcct

SEQ ID NO: 1004999 - DNA, 22 bp, Artificial Sequence
  chemically synthesized
acttttgtcgcccagtggcctt

SEQ ID NO: 1005000 - DNA, 22 bp, Artificial Sequence
  chemically synthesized
cttttgtcgcccagtggccttt

SEQ ID NO: 1005001 - DNA, 22 bp, Artificial Sequence
  chemically synthesized
ttgtcgcccagtggcctttaga

SEQ ID NO: 1005002 - DNA, 22 bp, Artificial Sequence
  chemically synthesized
tgtcgcccagtggcctttagac

SEQ ID NO: 1005003 - DNA, 22 bp, Artificial Sequence
  chemically synthesized
gtcgcccagtggcctttagact

SEQ ID NO: 1005004 - DNA, 22 bp, Artificial Sequence
  chemically synthesized
acatatatccagagtctaaagg

SEQ ID NO: 1005005 - DNA, 22 bp, Artificial Sequence
  chemically synthesized
tcgcccagtggcctttagactc

SEQ ID NO: 1005006 - DNA, 22 bp, Artificial Sequence
  chemically synthesized
tagactctggatatatgttaac

SEQ ID NO: 1005007 - DNA, 22 bp, Artificial Sequence
  chemically synthesized
agactctggatatatgttaact

SEQ ID NO: 1005008 - DNA, 22 bp, Artificial Sequence
  chemically synthesized
gactctggatatatgttaactg

SEQ ID NO: 1005009 - DNA, 22 bp, Artificial Sequence
  chemically synthesized
caaagtagccatgccagttaac

SEQ ID NO: 1005010 - DNA, 22 bp, Artificial Sequence
  chemically synthesized
tggatatatgttaactggcatg

SEQ ID NO: 1005011 - DNA, 22 bp, Artificial Sequence
  chemically synthesized
gatatatgttaactggcatggc

SEQ ID NO: 1005012 - DNA, 22 bp, Artificial Sequence
  chemically synthesized
actggcatggctactttggaat

SEQ ID NO: 1005013 - DNA, 22 bp, Artificial Sequence
  chemically synthesized
catatatgagtaaatattccaa

SEQ ID NO: 1005014 - DNA, 22 bp, Artificial Sequence
  chemically synthesized
gcatggctactttggaatattt

SEQ ID NO: 1005015 - DNA, 22 bp, Artificial Sequence
  chemically synthesized
acatatatgagtaaatattcca

SEQ ID NO: 1005016 - DNA, 22 bp, Artificial Sequence
  chemically synthesized
tggtttacatatatgagtaaat

SEQ ID NO: 1005017 - DNA, 22 bp, Artificial Sequence
  chemically synthesized
ctttggaatatttactcatata

SEQ ID NO: 1005018 - DNA, 22 bp, Artificial Sequence
  chemically synthesized
tggaatatttactcatatatgt

SEQ ID NO: 1005019 - DNA, 22 bp, Artificial Sequence
  chemically synthesized
ggaatatttactcatatatgta

SEQ ID NO: 1005020 - DNA, 22 bp, Artificial Sequence
  chemically synthesized
gaatatttactcatatatgtaa

SEQ ID NO: 1005021 - DNA, 22 bp, Artificial Sequence
  chemically synthesized
aggccattatggtttacatata

SEQ ID NO: 1005022 - DNA, 22 bp, Artificial Sequence
  chemically synthesized
aaggccattatggtttacatat

SEQ ID NO: 1005023 - DNA, 22 bp, Artificial Sequence
  chemically synthesized
actcatatatgtaaaccataat

SEQ ID NO: 1005024 - DNA, 22 bp, Artificial Sequence
  chemically synthesized
ctcatatatgtaaaccataatg

SEQ ID NO: 1005025 - DNA, 22 bp, Artificial Sequence
  chemically synthesized
tagtccttaaggccattatggt

SEQ ID NO: 1005026 - DNA, 22 bp, Artificial Sequence
  chemically synthesized
atatatgtaaaccataatggcc

SEQ ID NO: 1005027 - DNA, 22 bp, Artificial Sequence
  chemically synthesized
tctgtagtccttaaggccatta

SEQ ID NO: 1005028 - DNA, 22 bp, Artificial Sequence
  chemically synthesized
atctgtagtccttaaggccatt

SEQ ID NO: 1005029 - DNA, 22 bp, Artificial Sequence
  chemically synthesized
atatgaaagaagccttatctgt

SEQ ID NO: 1005030 - DNA, 22 bp, Artificial Sequence
  chemically synthesized
attaatatgaaagaagccttat

SEQ ID NO: 1005031 - DNA, 22 bp, Artificial Sequence
  chemically synthesized
aaggactacagataaggcttct

SEQ ID NO: 1005032 - DNA, 22 bp, Artificial Sequence
  chemically synthesized
aggactacagataaggcttctt

SEQ ID NO: 1005033 - DNA, 22 bp, Artificial Sequence
  chemically synthesized
cagataaggcttctttcatatt

SEQ ID NO: 1005034 - DNA, 22 bp, Artificial Sequence
  chemically synthesized
aaagatagttgattaatatgaa

SEQ ID NO: 1005035 - DNA, 22 bp, Artificial Sequence
  chemically synthesized
gaaagatagttgattaatatga

SEQ ID NO: 1005036 - DNA, 22 bp, Artificial Sequence
  chemically synthesized
tgaaagatagttgattaatatg

SEQ ID NO: 1005037 - DNA, 22 bp, Artificial Sequence
  chemically synthesized
ctttcatattaatcaactatct

SEQ ID NO: 1005038 - DNA, 22 bp, Artificial Sequence
  chemically synthesized
tttcatattaatcaactatctt

SEQ ID NO: 1005039 - DNA, 22 bp, Artificial Sequence
  chemically synthesized
tcatattaatcaactatctttc

SEQ ID NO: 1005040 - DNA, 22 bp, Artificial Sequence
  chemically synthesized
catattaatcaactatctttca

SEQ ID NO: 1005041 - DNA, 22 bp, Artificial Sequence
  chemically synthesized
cggtacacattttgaaagatag

SEQ ID NO: 1005042 - DNA, 22 bp, Artificial Sequence
  chemically synthesized
atattaatcaactatctttcaa

SEQ ID NO: 1005043 - DNA, 22 bp, Artificial Sequence
  chemically synthesized
atcaactatctttcaaaatgtg

SEQ ID NO: 1005044 - DNA, 22 bp, Artificial Sequence
  chemically synthesized
cgagaacagcctgcggtacaca

SEQ ID NO: 1005045 - DNA, 22 bp, Artificial Sequence
  chemically synthesized
tctttcaaaatgtgtaccgcag

SEQ ID NO: 1005046 - DNA, 22 bp, Artificial Sequence
  chemically synthesized
cattccgagaacagcctgcggt

SEQ ID NO: 1005047 - DNA, 22 bp, Artificial Sequence
  chemically synthesized
tcaaaatgtgtaccgcaggctg

SEQ ID NO: 1005048 - DNA, 22 bp, Artificial Sequence
  chemically synthesized
caaaatgtgtaccgcaggctgt

SEQ ID NO: 1005049 - DNA, 22 bp, Artificial Sequence
  chemically synthesized
aaaatgtgtaccgcaggctgtt

SEQ ID NO: 1005050 - DNA, 22 bp, Artificial Sequence
  chemically synthesized
gctccattccgagaacagcctg

SEQ ID NO: 1005051 - DNA, 22 bp, Artificial Sequence
  chemically synthesized
aaatctagctccattccgagaa

SEQ ID NO: 1005052 - DNA, 22 bp, Artificial Sequence
  chemically synthesized
atggctgaaatctagctccatt

SEQ ID NO: 1005053 - DNA, 22 bp, Artificial Sequence
  chemically synthesized
ctaatggctgaaatctagctcc

SEQ ID NO: 1005054 - DNA, 22 bp, Artificial Sequence
  chemically synthesized
gctaatggctgaaatctagctc

SEQ ID NO: 1005055 - DNA, 22 bp, Artificial Sequence
  chemically synthesized
ttctcggaatggagctagattt

SEQ ID NO: 1005056 - DNA, 22 bp, Artificial Sequence
  chemically synthesized
tgctaatggctgaaatctagct

SEQ ID NO: 1005057 - DNA, 22 bp, Artificial Sequence
  chemically synthesized
tcggaatggagctagatttcag

SEQ ID NO: 1005058 - DNA, 22 bp, Artificial Sequence
  chemically synthesized
ggaatggagctagatttcagcc

SEQ ID NO: 1005059 - DNA, 22 bp, Artificial Sequence
  chemically synthesized
tagacctttgctaatggctgaa

SEQ ID NO: 1005060 - DNA, 22 bp, Artificial Sequence
  chemically synthesized
gtagacctttgctaatggctga

SEQ ID NO: 1005061 - DNA, 22 bp, Artificial Sequence
  chemically synthesized
tgtagacctttgctaatggctg

SEQ ID NO: 1005062 - DNA, 22 bp, Artificial Sequence
  chemically synthesized
ctttgtagacctttgctaatgg

SEQ ID NO: 1005063 - DNA, 22 bp, Artificial Sequence
  chemically synthesized
actttgtagacctttgctaatg

SEQ ID NO: 1005064 - DNA, 22 bp, Artificial Sequence
  chemically synthesized
tactttgtagacctttgctaat

SEQ ID NO: 1005065 - DNA, 22 bp, Artificial Sequence
  chemically synthesized
gatttcagccattagcaaaggt

SEQ ID NO: 1005066 - DNA, 22 bp, Artificial Sequence
  chemically synthesized
cagccattagcaaaggtctaca

SEQ ID NO: 1005067 - DNA, 22 bp, Artificial Sequence
  chemically synthesized
agccattagcaaaggtctacaa

SEQ ID NO: 1005068 - DNA, 22 bp, Artificial Sequence
  chemically synthesized
gcaaaggtctacaaagtaaaat

SEQ ID NO: 1005069 - DNA, 22 bp, Artificial Sequence
  chemically synthesized
acagtaacagtgattttacttt

SEQ ID NO: 1005070 - DNA, 22 bp, Artificial Sequence
  chemically synthesized
caaagtaaaatcactgttactg

SEQ ID NO: 1005071 - DNA, 22 bp, Artificial Sequence
  chemically synthesized
atcagaaaaataaaagttaaca

SEQ ID NO: 1005072 - DNA, 22 bp, Artificial Sequence
  chemically synthesized
aatcagaaaaataaaagttaac

SEQ ID NO: 1005073 - DNA, 22 bp, Artificial Sequence
  chemically synthesized
ttactgttaacttttatttttc

SEQ ID NO: 1005074 - DNA, 22 bp, Artificial Sequence
  chemically synthesized
ctgttaacttttatttttctga

SEQ ID NO: 1005075 - DNA, 22 bp, Artificial Sequence
  chemically synthesized
ttaacttttatttttctgatta

SEQ ID NO: 1005076 - DNA, 22 bp, Artificial Sequence
  chemically synthesized
acttttatttttctgattaaac

SEQ ID NO: 1005077 - DNA, 22 bp, Artificial Sequence
  chemically synthesized
ttatttttctgattaaacatgg

SEQ ID NO: 1005078 - DNA, 22 bp, Artificial Sequence
  chemically synthesized
tatttttctgattaaacatgga

SEQ ID NO: 1005079 - DNA, 22 bp, Artificial Sequence
  chemically synthesized
atttttctgattaaacatggat

SEQ ID NO: 1005080 - DNA, 22 bp, Artificial Sequence
  chemically synthesized
tttttctgattaaacatggata

SEQ ID NO: 1005081 - DNA, 22 bp, Artificial Sequence
  chemically synthesized
ttctgattaaacatggatatca

SEQ ID NO: 1005082 - DNA, 22 bp, Artificial Sequence
  chemically synthesized
tctgattaaacatggatatcat

SEQ ID NO: 1005083 - DNA, 22 bp, Artificial Sequence
  chemically synthesized
ctgattaaacatggatatcatt

SEQ ID NO: 1005084 - DNA, 22 bp, Artificial Sequence
  chemically synthesized
tgattaaacatggatatcattt

SEQ ID NO: 1005085 - DNA, 22 bp, Artificial Sequence
  chemically synthesized
attaaacatggatatcatttgg

SEQ ID NO: 1005086 - DNA, 22 bp, Artificial Sequence
  chemically synthesized
ggcggggacacatatccaaatg

SEQ ID NO: 1005087 - DNA, 22 bp, Artificial Sequence
  chemically synthesized
aacatggatatcatttggatat

SEQ ID NO: 1005088 - DNA, 22 bp, Artificial Sequence
  chemically synthesized
gggcggggacacatatccaaat

SEQ ID NO: 1005089 - DNA, 22 bp, Artificial Sequence
  chemically synthesized
aagatgagatttgggcggggac

SEQ ID NO: 1005090 - DNA, 22 bp, Artificial Sequence
  chemically synthesized
caagatgagatttgggcgggga

SEQ ID NO: 1005091 - DNA, 22 bp, Artificial Sequence
  chemically synthesized
ggatatgtgtccccgcccaaat

SEQ ID NO: 1005092 - DNA, 22 bp, Artificial Sequence
  chemically synthesized
gatatgtgtccccgcccaaatc

SEQ ID NO: 1005093 - DNA, 22 bp, Artificial Sequence
  chemically synthesized
catttcaagatgagatttgggc

SEQ ID NO: 1005094 - DNA, 22 bp, Artificial Sequence
  chemically synthesized
ggaattacatttcaagatgaga

SEQ ID NO: 1005095 - DNA, 22 bp, Artificial Sequence
  chemically synthesized
caacactgggaattacatttca

SEQ ID NO: 1005096 - DNA, 22 bp, Artificial Sequence
  chemically synthesized
atcttgaaatgtaattcccagt

SEQ ID NO: 1005097 - DNA, 22 bp, Artificial Sequence
  chemically synthesized
gaaatgtaattcccagtgttgg

SEQ ID NO: 1005098 - DNA, 22 bp, Artificial Sequence
  chemically synthesized
aaatgtaattcccagtgttgga

SEQ ID NO: 1005099 - DNA, 22 bp, Artificial Sequence
  chemically synthesized
ccaccaggccccacctccaaca

SEQ ID NO: 1005100 - DNA, 22 bp, Artificial Sequence
  chemically synthesized
ccagtgttggaggtggggcctg

SEQ ID NO: 1005101 - DNA, 22 bp, Artificial Sequence
  chemically synthesized
gaggtggggcctggtgggaggt

SEQ ID NO: 1005102 - DNA, 22 bp, Artificial Sequence
  chemically synthesized
gtgggaggtgactggatcatgt

SEQ ID NO: 1005103 - DNA, 22 bp, Artificial Sequence
  chemically synthesized
atgagaaatccacacacatgat

SEQ ID NO: 1005104 - DNA, 22 bp, Artificial Sequence
  chemically synthesized
aaccattcatgagaaatccaca

SEQ ID NO: 1005105 - DNA, 22 bp, Artificial Sequence
  chemically synthesized
gatcatgtgtgtggatttctca

SEQ ID NO: 1005106 - DNA, 22 bp, Artificial Sequence
  chemically synthesized
ctcatgaatggtttaacaccat

SEQ ID NO: 1005107 - DNA, 22 bp, Artificial Sequence
  chemically synthesized
tcatgaatggtttaacaccatc

SEQ ID NO: 1005108 - DNA, 22 bp, Artificial Sequence
  chemically synthesized
atgaatggtttaacaccatcct

SEQ ID NO: 1005109 - DNA, 22 bp, Artificial Sequence
  chemically synthesized
aacaccatcctcttggtgccat

SEQ ID NO: 1005110 - DNA, 22 bp, Artificial Sequence
  chemically synthesized
atcatcatgaggatggcaccaa

SEQ ID NO: 1005111 - DNA, 22 bp, Artificial Sequence
  chemically synthesized
acaccatcctcttggtgccatc

SEQ ID NO: 1005112 - DNA, 22 bp, Artificial Sequence
  chemically synthesized
actcatcatcatgaggatggca

SEQ ID NO: 1005113 - DNA, 22 bp, Artificial Sequence
  chemically synthesized
ttggtgccatcctcatgatgat

SEQ ID NO: 1005114 - DNA, 22 bp, Artificial Sequence
  chemically synthesized
agagaactcactcatcatcatg

SEQ ID NO: 1005115 - DNA, 22 bp, Artificial Sequence
  chemically synthesized
ggtgccatcctcatgatgatga

SEQ ID NO: 1005116 - DNA, 22 bp, Artificial Sequence
  chemically synthesized
gtgccatcctcatgatgatgag

SEQ ID NO: 1005117 - DNA, 22 bp, Artificial Sequence
  chemically synthesized
atgatgatgagtgagttctctg

SEQ ID NO: 1005118 - DNA, 22 bp, Artificial Sequence
  chemically synthesized
tctgagatctggctgtttacac

SEQ ID NO: 1005119 - DNA, 22 bp, Artificial Sequence
  chemically synthesized
tgagatctggctgtttacacgt

SEQ ID NO: 1005120 - DNA, 22 bp, Artificial Sequence
  chemically synthesized
agatctggctgtttacacgtgt

SEQ ID NO: 1005121 - DNA, 22 bp, Artificial Sequence
  chemically synthesized
gctgtttacacgtgtgtggtac

SEQ ID NO: 1005122 - DNA, 22 bp, Artificial Sequence
  chemically synthesized
tttacacgtgtgtggtacttca

SEQ ID NO: 1005123 - DNA, 22 bp, Artificial Sequence
  chemically synthesized
acacgtgtgtggtacttcattc

SEQ ID NO: 1005124 - DNA, 22 bp, Artificial Sequence
  chemically synthesized
cacgtgtgtggtacttcattct

SEQ ID NO: 1005125 - DNA, 22 bp, Artificial Sequence
  chemically synthesized
gagcaggagcaagagagacaga

SEQ ID NO: 1005126 - DNA, 22 bp, Artificial Sequence
  chemically synthesized
gctagagcaggagcaagagaga

SEQ ID NO: 1005127 - DNA, 22 bp, Artificial Sequence
  chemically synthesized
cattctgtctctcttgctcctg

SEQ ID NO: 1005128 - DNA, 22 bp, Artificial Sequence
  chemically synthesized
acctggctagagcaggagcaag

SEQ ID NO: 1005129 - DNA, 22 bp, Artificial Sequence
  chemically synthesized
attctgtctctcttgctcctgc

SEQ ID NO: 1005130 - DNA, 22 bp, Artificial Sequence
  chemically synthesized
cacctggctagagcaggagcaa

SEQ ID NO: 1005131 - DNA, 22 bp, Artificial Sequence
  chemically synthesized
tgtctctcttgctcctgctcta

SEQ ID NO: 1005132 - DNA, 22 bp, Artificial Sequence
  chemically synthesized
tctctcttgctcctgctctagc

SEQ ID NO: 1005133 - DNA, 22 bp, Artificial Sequence
  chemically synthesized
tcttgctcctgctctagccagg

SEQ ID NO: 1005134 - DNA, 22 bp, Artificial Sequence
  chemically synthesized
ttgctcctgctctagccaggtg

SEQ ID NO: 1005135 - DNA, 22 bp, Artificial Sequence
  chemically synthesized
gctcctgctctagccaggtgaa

SEQ ID NO: 1005136 - DNA, 22 bp, Artificial Sequence
  chemically synthesized
ctcctgctctagccaggtgaag

SEQ ID NO: 1005137 - DNA, 22 bp, Artificial Sequence
  chemically synthesized
ctgctctagccaggtgaagtgc

SEQ ID NO: 1005138 - DNA, 22 bp, Artificial Sequence
  chemically synthesized
ctctagccaggtgaagtgcctg

SEQ ID NO: 1005139 - DNA, 22 bp, Artificial Sequence
  chemically synthesized
tagccaggtgaagtgcctgctc

SEQ ID NO: 1005140 - DNA, 22 bp, Artificial Sequence
  chemically synthesized
gccaggtgaagtgcctgctccc

SEQ ID NO: 1005141 - DNA, 22 bp, Artificial Sequence
  chemically synthesized
cagtcgtggcagaaggcagaac

SEQ ID NO: 1005142 - DNA, 22 bp, Artificial Sequence
  chemically synthesized
ccagtcgtggcagaaggcagaa

SEQ ID NO: 1005143 - DNA, 22 bp, Artificial Sequence
  chemically synthesized
ctcccgttctgccttctgccac

SEQ ID NO: 1005144 - DNA, 22 bp, Artificial Sequence
  chemically synthesized
ccgttctgccttctgccacgac

SEQ ID NO: 1005145 - DNA, 22 bp, Artificial Sequence
  chemically synthesized
gggaagcttccagtcgtggcag

SEQ ID NO: 1005146 - DNA, 22 bp, Artificial Sequence
  chemically synthesized
cgggaagcttccagtcgtggca

SEQ ID NO: 1005147 - DNA, 22 bp, Artificial Sequence
  chemically synthesized
tgccttctgccacgactggaag

SEQ ID NO: 1005148 - DNA, 22 bp, Artificial Sequence
  chemically synthesized
ccttctgccacgactggaagct

SEQ ID NO: 1005149 - DNA, 22 bp, Artificial Sequence
  chemically synthesized
tggaggcttcgggaagcttcca

SEQ ID NO: 1005150 - DNA, 22 bp, Artificial Sequence
  chemically synthesized
ctgccacgactggaagcttccc

SEQ ID NO: 1005151 - DNA, 22 bp, Artificial Sequence
  chemically synthesized
tgtggaggcttcgggaagcttc

SEQ ID NO: 1005152 - DNA, 22 bp, Artificial Sequence
  chemically synthesized
tgccacgactggaagcttcccg

SEQ ID NO: 1005153 - DNA, 22 bp, Artificial Sequence
  chemically synthesized
ctgtggaggcttcgggaagctt

SEQ ID NO: 1005154 - DNA, 22 bp, Artificial Sequence
  chemically synthesized
ccacgactggaagcttcccgaa

SEQ ID NO: 1005155 - DNA, 22 bp, Artificial Sequence
  chemically synthesized
cttctgtggaggcttcgggaag

SEQ ID NO: 1005156 - DNA, 22 bp, Artificial Sequence
  chemically synthesized
gaagcttcccgaagcctccaca

SEQ ID NO: 1005157 - DNA, 22 bp, Artificial Sequence
  chemically synthesized
cccgaagcctccacagaaggag

SEQ ID NO: 1005158 - DNA, 22 bp, Artificial Sequence
  chemically synthesized
ccgaagcctccacagaaggaga

SEQ ID NO: 1005159 - DNA, 22 bp, Artificial Sequence
  chemically synthesized
taccggaagcatagcagcatct

SEQ ID NO: 1005160 - DNA, 22 bp, Artificial Sequence
  chemically synthesized
cacagaaggagatgctgctatg

SEQ ID NO: 1005161 - DNA, 22 bp, Artificial Sequence
  chemically synthesized
caggctgtaccggaagcatagc

SEQ ID NO: 1005162 - DNA, 22 bp, Artificial Sequence
  chemically synthesized
tgcaggctgtaccggaagcata

SEQ ID NO: 1005163 - DNA, 22 bp, Artificial Sequence
  chemically synthesized
acagttctgcaggctgtaccgg

SEQ ID NO: 1005164 - DNA, 22 bp, Artificial Sequence
  chemically synthesized
ctatgcttccggtacagcctgc

SEQ ID NO: 1005165 - DNA, 22 bp, Artificial Sequence
  chemically synthesized
gctcacagttctgcaggctgta

SEQ ID NO: 1005166 - DNA, 22 bp, Artificial Sequence
  chemically synthesized
ggctcacagttctgcaggctgt

SEQ ID NO: 1005167 - DNA, 22 bp, Artificial Sequence
  chemically synthesized
tgcttccggtacagcctgcaga

SEQ ID NO: 1005168 - DNA, 22 bp, Artificial Sequence
  chemically synthesized
cttggctcacagttctgcaggc

SEQ ID NO: 1005169 - DNA, 22 bp, Artificial Sequence
  chemically synthesized
acttggctcacagttctgcagg

SEQ ID NO: 1005170 - DNA, 22 bp, Artificial Sequence
  chemically synthesized
ccggtacagcctgcagaactgt

SEQ ID NO: 1005171 - DNA, 22 bp, Artificial Sequence
  chemically synthesized
cggtacagcctgcagaactgtg

SEQ ID NO: 1005172 - DNA, 22 bp, Artificial Sequence
  chemically synthesized
cagaactgtgagccaagtaagt

SEQ ID NO: 1005173 - DNA, 22 bp, Artificial Sequence
  chemically synthesized
tgagccaagtaagtgtcttttc

SEQ ID NO: 1005174 - DNA, 22 bp, Artificial Sequence
  chemically synthesized
ggtaatggatgagaaaagacac

SEQ ID NO: 1005175 - DNA, 22 bp, Artificial Sequence
  chemically synthesized
agactgggtaatggatgagaaa

SEQ ID NO: 1005176 - DNA, 22 bp, Artificial Sequence
  chemically synthesized
ttctcatccattacccagtctc

SEQ ID NO: 1005177 - DNA, 22 bp, Artificial Sequence
  chemically synthesized
tctcatccattacccagtctca

SEQ ID NO: 1005178 - DNA, 22 bp, Artificial Sequence
  chemically synthesized
taaagaaatacctgagactggg

SEQ ID NO: 1005179 - DNA, 22 bp, Artificial Sequence
  chemically synthesized
ctcatccattacccagtctcag

SEQ ID NO: 1005180 - DNA, 22 bp, Artificial Sequence
  chemically synthesized
tcatccattacccagtctcagg

SEQ ID NO: 1005181 - DNA, 22 bp, Artificial Sequence
  chemically synthesized
ctataaagaaatacctgagact

SEQ ID NO: 1005182 - DNA, 22 bp, Artificial Sequence
  chemically synthesized
atccattacccagtctcaggta

SEQ ID NO: 1005183 - DNA, 22 bp, Artificial Sequence
  chemically synthesized
cattgctataaagaaatacctg

SEQ ID NO: 1005184 - DNA, 22 bp, Artificial Sequence
  chemically synthesized
gcattgctataaagaaatacct

SEQ ID NO: 1005185 - DNA, 22 bp, Artificial Sequence
  chemically synthesized
ttgcattgctataaagaaatac

SEQ ID NO: 1005186 - DNA, 22 bp, Artificial Sequence
  chemically synthesized
cccagtctcaggtatttcttta

SEQ ID NO: 1005187 - DNA, 22 bp, Artificial Sequence
  chemically synthesized
cttgcattgctataaagaaata

SEQ ID NO: 1005188 - DNA, 22 bp, Artificial Sequence
  chemically synthesized
tcttgcattgctataaagaaat

SEQ ID NO: 1005189 - DNA, 22 bp, Artificial Sequence
  chemically synthesized
ttcttgcattgctataaagaaa

SEQ ID NO: 1005190 - DNA, 22 bp, Artificial Sequence
  chemically synthesized
atcttttcttgcattgctataa

SEQ ID NO: 1005191 - DNA, 22 bp, Artificial Sequence
  chemically synthesized
aggtatttctttatagcaatgc

SEQ ID NO: 1005192 - DNA, 22 bp, Artificial Sequence
  chemically synthesized
tattaatcttttcttgcattgc

SEQ ID NO: 1005193 - DNA, 22 bp, Artificial Sequence
  chemically synthesized
ctttatagcaatgcaagaaaag

SEQ ID NO: 1005194 - DNA, 22 bp, Artificial Sequence
  chemically synthesized
tgttatattaatcttttcttgc

SEQ ID NO: 1005195 - DNA, 22 bp, Artificial Sequence
  chemically synthesized
tttatagcaatgcaagaaaaga

SEQ ID NO: 1005196 - DNA, 22 bp, Artificial Sequence
  chemically synthesized
tatagcaatgcaagaaaagatt

SEQ ID NO: 1005197 - DNA, 22 bp, Artificial Sequence
  chemically synthesized
atagcaatgcaagaaaagatta

SEQ ID NO: 1005198 - DNA, 22 bp, Artificial Sequence
  chemically synthesized
tagcaatgcaagaaaagattaa

SEQ ID NO: 1005199 - DNA, 22 bp, Artificial Sequence
  chemically synthesized
tgtgttgtgttatattaatctt

SEQ ID NO: 1005200 - DNA, 22 bp, Artificial Sequence
  chemically synthesized
atgtgtctgtgtgttgtgttat

SEQ ID NO: 1005201 - DNA, 22 bp, Artificial Sequence
  chemically synthesized
ttcatgtgtctgtgtgttgtgt

SEQ ID NO: 1005202 - DNA, 22 bp, Artificial Sequence
  chemically synthesized
attcatgtgtctgtgtgttgtg

SEQ ID NO: 1005203 - DNA, 22 bp, Artificial Sequence
  chemically synthesized
atataacacaacacacagacac

SEQ ID NO: 1005204 - DNA, 22 bp, Artificial Sequence
  chemically synthesized
tgagtttattcatgtgtctgtg

SEQ ID NO: 1005205 - DNA, 22 bp, Artificial Sequence
  chemically synthesized
gtgtattatgagtttattcatg

SEQ ID NO: 1005206 - DNA, 22 bp, Artificial Sequence
  chemically synthesized
attagtgtattatgagtttatt

SEQ ID NO: 1005207 - DNA, 22 bp, Artificial Sequence
  chemically synthesized
aattagtgtattatgagtttat

SEQ ID NO: 1005208 - DNA, 22 bp, Artificial Sequence
  chemically synthesized
taattagtgtattatgagttta

SEQ ID NO: 1005209 - DNA, 22 bp, Artificial Sequence
  chemically synthesized
ttttaattagtgtattatgagt

SEQ ID NO: 1005210 - DNA, 22 bp, Artificial Sequence
  chemically synthesized
aaaatattgttttaattagtgt

SEQ ID NO: 1005211 - DNA, 22 bp, Artificial Sequence
  chemically synthesized
atgttcaaaatattgttttaat

SEQ ID NO: 1005212 - DNA, 22 bp, Artificial Sequence
  chemically synthesized
ataatacactaattaaaacaat

SEQ ID NO: 1005213 - DNA, 22 bp, Artificial Sequence
  chemically synthesized
aatgttcaaaatattgttttaa

SEQ ID NO: 1005214 - DNA, 22 bp, Artificial Sequence
  chemically synthesized
ttaatgttcaaaatattgtttt

SEQ ID NO: 1005215 - DNA, 22 bp, Artificial Sequence
  chemically synthesized
cttaatgttcaaaatattgttt

SEQ ID NO: 1005216 - DNA, 22 bp, Artificial Sequence
  chemically synthesized
tcttaatgttcaaaatattgtt

SEQ ID NO: 1005217 - DNA, 22 bp, Artificial Sequence
  chemically synthesized
attaaaacaatattttgaacat

SEQ ID NO: 1005218 - DNA, 22 bp, Artificial Sequence
  chemically synthesized
aaacaatattttgaacattaag

SEQ ID NO: 1005219 - DNA, 22 bp, Artificial Sequence
  chemically synthesized
catgggcatgttttcttaatgt

SEQ ID NO: 1005220 - DNA, 22 bp, Artificial Sequence
  chemically synthesized
tgaacattaagaaaacatgccc

SEQ ID NO: 1005221 - DNA, 22 bp, Artificial Sequence
  chemically synthesized
ataaaattacatgggcatgttt

SEQ ID NO: 1005222 - DNA, 22 bp, Artificial Sequence
  chemically synthesized
gaacattaagaaaacatgccca

SEQ ID NO: 1005223 - DNA, 22 bp, Artificial Sequence
  chemically synthesized
aacattaagaaaacatgcccat

SEQ ID NO: 1005224 - DNA, 22 bp, Artificial Sequence
  chemically synthesized
agaaaacatgcccatgtaattt

SEQ ID NO: 1005225 - DNA, 22 bp, Artificial Sequence
  chemically synthesized
aaaggatatacgaaagacattc

SEQ ID NO: 1005226 - DNA, 22 bp, Artificial Sequence
  chemically synthesized
tatgaatgtctttcgtatatcc

SEQ ID NO: 1005227 - DNA, 22 bp, Artificial Sequence
  chemically synthesized
atgaatgtctttcgtatatcct

SEQ ID NO: 1005228 - DNA, 22 bp, Artificial Sequence
  chemically synthesized
tgaatgtctttcgtatatcctt

SEQ ID NO: 1005229 - DNA, 22 bp, Artificial Sequence
  chemically synthesized
gaatgaacgtccaatccctgaa

SEQ ID NO: 1005230 - DNA, 22 bp, Artificial Sequence
  chemically synthesized
tcgtatatcctttcagggattg

SEQ ID NO: 1005231 - DNA, 22 bp, Artificial Sequence
  chemically synthesized
cgtatatcctttcagggattgg

SEQ ID NO: 1005232 - DNA, 22 bp, Artificial Sequence
  chemically synthesized
gtatatcctttcagggattgga

SEQ ID NO: 1005233 - DNA, 22 bp, Artificial Sequence
  chemically synthesized
tcagggattggacgttcattct

SEQ ID NO: 1005234 - DNA, 22 bp, Artificial Sequence
  chemically synthesized
cagggattggacgttcattcta

SEQ ID NO: 1005235 - DNA, 22 bp, Artificial Sequence
  chemically synthesized
agggattggacgttcattctaa

SEQ ID NO: 1005236 - DNA, 22 bp, Artificial Sequence
  chemically synthesized
gacgttcattctaacatacctc

SEQ ID NO: 1005237 - DNA, 22 bp, Artificial Sequence
  chemically synthesized
atgcacaatatataagaggtat

SEQ ID NO: 1005238 - DNA, 22 bp, Artificial Sequence
  chemically synthesized
attctaacatacctcttatata

SEQ ID NO: 1005239 - DNA, 22 bp, Artificial Sequence
  chemically synthesized
aattaatgcacaatatataaga

SEQ ID NO: 1005240 - DNA, 22 bp, Artificial Sequence
  chemically synthesized
aaattaatgcacaatatataag

SEQ ID NO: 1005241 - DNA, 22 bp, Artificial Sequence
  chemically synthesized
taaattaatgcacaatatataa

SEQ ID NO: 1005242 - DNA, 22 bp, Artificial Sequence
  chemically synthesized
taacatacctcttatatattgt

SEQ ID NO: 1005243 - DNA, 22 bp, Artificial Sequence
  chemically synthesized
ttaaattaatgcacaatatata

SEQ ID NO: 1005244 - DNA, 22 bp, Artificial Sequence
  chemically synthesized
tttaaattaatgcacaatatat

SEQ ID NO: 1005245 - DNA, 22 bp, Artificial Sequence
  chemically synthesized
acatacctcttatatattgtgc

SEQ ID NO: 1005246 - DNA, 22 bp, Artificial Sequence
  chemically synthesized
ttttttaaattaatgcacaata

SEQ ID NO: 1005247 - DNA, 22 bp, Artificial Sequence
  chemically synthesized
attttttaaattaatgcacaat

SEQ ID NO: 1005248 - DNA, 22 bp, Artificial Sequence
  chemically synthesized
tattttttaaattaatgcacaa

SEQ ID NO: 1005249 - DNA, 22 bp, Artificial Sequence
  chemically synthesized
ttatatattgtgcattaattta

SEQ ID NO: 1005250 - DNA, 22 bp, Artificial Sequence
  chemically synthesized
atatattgtgcattaatttaaa

SEQ ID NO: 1005251 - DNA, 22 bp, Artificial Sequence
  chemically synthesized
tatattgtgcattaatttaaaa

SEQ ID NO: 1005252 - DNA, 22 bp, Artificial Sequence
  chemically synthesized
tgcattaatttaaaaaataaag

SEQ ID NO: 1005253 - DNA, 22 bp, Artificial Sequence
  chemically synthesized
atttaaaaaataaaggctttat

SEQ ID NO: 1005254 - DNA, 22 bp, Artificial Sequence
  chemically synthesized
aaaaaataaaggctttatggct

SEQ ID NO: 1005255 - DNA, 22 bp, Artificial Sequence
  chemically synthesized
aaaaataaaggctttatggctt

SEQ ID NO: 1005256 - DNA, 22 bp, Artificial Sequence
  chemically synthesized
tatggcttcacctctgcctgtg

SEQ ID NO: 1005257 - DNA, 22 bp, Artificial Sequence
  chemically synthesized
atggcttcacctctgcctgtgt

SEQ ID NO: 1005258 - DNA, 22 bp, Artificial Sequence
  chemically synthesized
tggcttcacctctgcctgtgta

SEQ ID NO: 1005259 - DNA, 22 bp, Artificial Sequence
  chemically synthesized
aaagcaccatcaatacacaggc

SEQ ID NO: 1005260 - DNA, 22 bp, Artificial Sequence
  chemically synthesized
cacctctgcctgtgtattgatg

SEQ ID NO: 1005261 - DNA, 22 bp, Artificial Sequence
  chemically synthesized
acctctgcctgtgtattgatgg

SEQ ID NO: 1005262 - DNA, 22 bp, Artificial Sequence
  chemically synthesized
tgcctgtgtattgatggtgctt

SEQ ID NO: 1005263 - DNA, 22 bp, Artificial Sequence
  chemically synthesized
cctgtgtattgatggtgctttt

SEQ ID NO: 1005264 - DNA, 22 bp, Artificial Sequence
  chemically synthesized
tgtattgatggtgcttttagtg

SEQ ID NO: 1005265 - DNA, 22 bp, Artificial Sequence
  chemically synthesized
atggtgcttttagtgtttcacc

SEQ ID NO: 1005266 - DNA, 22 bp, Artificial Sequence
  chemically synthesized
gcagaacagcaaaggtgaaaca

SEQ ID NO: 1005267 - DNA, 22 bp, Artificial Sequence
  chemically synthesized
ttagtgtttcacctttgctgtt

SEQ ID NO: 1005268 - DNA, 22 bp, Artificial Sequence
  chemically synthesized
tagtgtttcacctttgctgttc

SEQ ID NO: 1005269 - DNA, 22 bp, Artificial Sequence
  chemically synthesized
agtgtttcacctttgctgttct

SEQ ID NO: 1005270 - DNA, 22 bp, Artificial Sequence
  chemically synthesized
gtgtttcacctttgctgttctg

SEQ ID NO: 1005271 - DNA, 22 bp, Artificial Sequence
  chemically synthesized
aggatatgttagcagaacagca

SEQ ID NO: 1005272 - DNA, 22 bp, Artificial Sequence
  chemically synthesized
ttgaggatatgttagcagaaca

SEQ ID NO: 1005273 - DNA, 22 bp, Artificial Sequence
  chemically synthesized
attgaggatatgttagcagaac

SEQ ID NO: 1005274 - DNA, 22 bp, Artificial Sequence
  chemically synthesized
cacctttgctgttctgctaaca

SEQ ID NO: 1005275 - DNA, 22 bp, Artificial Sequence
  chemically synthesized
acctttgctgttctgctaacat

SEQ ID NO: 1005276 - DNA, 22 bp, Artificial Sequence
  chemically synthesized
tgctgttctgctaacatatcct

SEQ ID NO: 1005277 - DNA, 22 bp, Artificial Sequence
  chemically synthesized
gctgttctgctaacatatcctc

SEQ ID NO: 1005278 - DNA, 22 bp, Artificial Sequence
  chemically synthesized
ctgttctgctaacatatcctca

SEQ ID NO: 1005279 - DNA, 22 bp, Artificial Sequence
  chemically synthesized
ggatcgatttattgaggatatg

SEQ ID NO: 1005280 - DNA, 22 bp, Artificial Sequence
  chemically synthesized
gggatcgatttattgaggatat

SEQ ID NO: 1005281 - DNA, 22 bp, Artificial Sequence
  chemically synthesized
ttctgctaacatatcctcaata

SEQ ID NO: 1005282 - DNA, 22 bp, Artificial Sequence
  chemically synthesized
tgctaacatatcctcaataaat

SEQ ID NO: 1005283 - DNA, 22 bp, Artificial Sequence
  chemically synthesized
gcacttgggatcgatttattga

SEQ ID NO: 1005284 - DNA, 22 bp, Artificial Sequence
  chemically synthesized
ctaacatatcctcaataaatcg

SEQ ID NO: 1005285 - DNA, 22 bp, Artificial Sequence
  chemically synthesized
tggcacttgggatcgatttatt

SEQ ID NO: 1005286 - DNA, 22 bp, Artificial Sequence
  chemically synthesized
ctggcacttgggatcgatttat

SEQ ID NO: 1005287 - DNA, 22 bp, Artificial Sequence
  chemically synthesized
acatatcctcaataaatcgatc

SEQ ID NO: 1005288 - DNA, 22 bp, Artificial Sequence
  chemically synthesized
tctggcacttgggatcgattta

SEQ ID NO: 1005289 - DNA, 22 bp, Artificial Sequence
  chemically synthesized
ctttctggcacttgggatcgat

SEQ ID NO: 1005290 - DNA, 22 bp, Artificial Sequence
  chemically synthesized
gctttctggcacttgggatcga

SEQ ID NO: 1005291 - DNA, 22 bp, Artificial Sequence
  chemically synthesized
tttgctttctggcacttgggat

SEQ ID NO: 1005292 - DNA, 22 bp, Artificial Sequence
  chemically synthesized
aataaatcgatcccaagtgcca

SEQ ID NO: 1005293 - DNA, 22 bp, Artificial Sequence
  chemically synthesized
aatgtgcaaaaaataaagggtt

SEQ ID NO: 1005294 - DNA, 22 bp, Artificial Sequence
  chemically synthesized
taaatgtgcaaaaaataaaggg

SEQ ID NO: 1005295 - DNA, 22 bp, Artificial Sequence
  chemically synthesized
ggggaaacattctaaatgtgca

SEQ ID NO: 1005296 - DNA, 22 bp, Artificial Sequence
  chemically synthesized
gggggaaacattctaaatgtgc

SEQ ID NO: 1005297 - DNA, 22 bp, Artificial Sequence
  chemically synthesized
tgggggaaacattctaaatgtg

SEQ ID NO: 1005298 - DNA, 22 bp, Artificial Sequence
  chemically synthesized
ttgggggaaacattctaaatgt

SEQ ID NO: 1005299 - DNA, 22 bp, Artificial Sequence
  chemically synthesized
tttgggggaaacattctaaatg

SEQ ID NO: 1005300 - DNA, 22 bp, Artificial Sequence
  chemically synthesized
tattttttgcacatttagaatg

SEQ ID NO: 1005301 - DNA, 22 bp, Artificial Sequence
  chemically synthesized
attttttgcacatttagaatgt

SEQ ID NO: 1005302 - DNA, 22 bp, Artificial Sequence
  chemically synthesized
ttttttgcacatttagaatgtt

SEQ ID NO: 1005303 - DNA, 22 bp, Artificial Sequence
  chemically synthesized
ctttttgggggaaacattctaa

SEQ ID NO: 1005304 - DNA, 22 bp, Artificial Sequence
  chemically synthesized
tttgcacatttagaatgtttcc

SEQ ID NO: 1005305 - DNA, 22 bp, Artificial Sequence
  chemically synthesized
ttgcacatttagaatgtttccc

SEQ ID NO: 1005306 - DNA, 22 bp, Artificial Sequence
  chemically synthesized
cctcctttttgggggaaacatt

SEQ ID NO: 1005307 - DNA, 22 bp, Artificial Sequence
  chemically synthesized
tgcacatttagaatgtttcccc

SEQ ID NO: 1005308 - DNA, 22 bp, Artificial Sequence
  chemically synthesized
gcacatttagaatgtttccccc

SEQ ID NO: 1005309 - DNA, 22 bp, Artificial Sequence
  chemically synthesized
cacatttagaatgtttccccca

SEQ ID NO: 1005310 - DNA, 22 bp, Artificial Sequence
  chemically synthesized
ccgtctccctcctttttggggg

SEQ ID NO: 1005311 - DNA, 22 bp, Artificial Sequence
  chemically synthesized
agaatgtttcccccaaaaagga

SEQ ID NO: 1005312 - DNA, 22 bp, Artificial Sequence
  chemically synthesized
gaatgtttcccccaaaaaggag

SEQ ID NO: 1005313 - DNA, 22 bp, Artificial Sequence
  chemically synthesized
atacctaccgtctccctccttt

SEQ ID NO: 1005314 - DNA, 22 bp, Artificial Sequence
  chemically synthesized
taatacctaccgtctccctcct

SEQ ID NO: 1005315 - DNA, 22 bp, Artificial Sequence
  chemically synthesized
tctaatacctaccgtctccctc

SEQ ID NO: 1005316 - DNA, 22 bp, Artificial Sequence
  chemically synthesized
cccccaaaaaggagggagacgg

SEQ ID NO: 1005317 - DNA, 22 bp, Artificial Sequence
  chemically synthesized
ccccaaaaaggagggagacggt

SEQ ID NO: 1005318 - DNA, 22 bp, Artificial Sequence
  chemically synthesized
aacaccacgcagtaggcactct

SEQ ID NO: 1005319 - DNA, 22 bp, Artificial Sequence
  chemically synthesized
tgattgaacaccacgcagtagg

SEQ ID NO: 1005320 - DNA, 22 bp, Artificial Sequence
  chemically synthesized
ttgtgattgaacaccacgcagt

SEQ ID NO: 1005321 - DNA, 22 bp, Artificial Sequence
  chemically synthesized
gagagtgcctactgcgtggtgt

SEQ ID NO: 1005322 - DNA, 22 bp, Artificial Sequence
  chemically synthesized
ctgcgtggtgttcaatcacaat

SEQ ID NO: 1005323 - DNA, 22 bp, Artificial Sequence
  chemically synthesized
atcgaagggcctattgtgattg

SEQ ID NO: 1005324 - DNA, 22 bp, Artificial Sequence
  chemically synthesized
cgtggtgttcaatcacaatagg

SEQ ID NO: 1005325 - DNA, 22 bp, Artificial Sequence
  chemically synthesized
aatcacaataggcccttcgatt

SEQ ID NO: 1005326 - DNA, 22 bp, Artificial Sequence
  chemically synthesized
ggatgtcaaaatgaataaatat

SEQ ID NO: 1005327 - DNA, 22 bp, Artificial Sequence
  chemically synthesized
cgattaatatttattcattttg

SEQ ID NO: 1005328 - DNA, 22 bp, Artificial Sequence
  chemically synthesized
gattaatatttattcattttga

SEQ ID NO: 1005329 - DNA, 22 bp, Artificial Sequence
  chemically synthesized
gaacaagttgggatgtcaaaat

SEQ ID NO: 1005330 - DNA, 22 bp, Artificial Sequence
  chemically synthesized
atatttattcattttgacatcc

SEQ ID NO: 1005331 - DNA, 22 bp, Artificial Sequence
  chemically synthesized
attcattttgacatcccaactt

SEQ ID NO: 1005332 - DNA, 22 bp, Artificial Sequence
  chemically synthesized
ttcattttgacatcccaacttg

SEQ ID NO: 1005333 - DNA, 22 bp, Artificial Sequence
  chemically synthesized
attttgacatcccaacttgttc

SEQ ID NO: 1005334 - DNA, 22 bp, Artificial Sequence
  chemically synthesized
tgacatcccaacttgttctagt

SEQ ID NO: 1005335 - DNA, 22 bp, Artificial Sequence
  chemically synthesized
gacatcccaacttgttctagtc

SEQ ID NO: 1005336 - DNA, 22 bp, Artificial Sequence
  chemically synthesized
acatcccaacttgttctagtct

SEQ ID NO: 1005337 - DNA, 22 bp, Artificial Sequence
  chemically synthesized
aagaccccatcacagactagaa

SEQ ID NO: 1005338 - DNA, 22 bp, Artificial Sequence
  chemically synthesized
gttctagtctgtgatggggtct

SEQ ID NO: 1005339 - DNA, 22 bp, Artificial Sequence
  chemically synthesized
ttctagtctgtgatggggtctt

SEQ ID NO: 1005340 - DNA, 22 bp, Artificial Sequence
  chemically synthesized
tagtctgtgatggggtctttaa

SEQ ID NO: 1005341 - DNA, 22 bp, Artificial Sequence
  chemically synthesized
gtctgtgatggggtctttaacc

SEQ ID NO: 1005342 - DNA, 22 bp, Artificial Sequence
  chemically synthesized
tgatggggtctttaacctggca

SEQ ID NO: 1005343 - DNA, 22 bp, Artificial Sequence
  chemically synthesized
atcccatccacagatgccaggt

SEQ ID NO: 1005344 - DNA, 22 bp, Artificial Sequence
  chemically synthesized
aatcccatccacagatgccagg

SEQ ID NO: 1005345 - DNA, 22 bp, Artificial Sequence
  chemically synthesized
ccttaatcccatccacagatgc

SEQ ID NO: 1005346 - DNA, 22 bp, Artificial Sequence
  chemically synthesized
taacctggcatctgtggatggg

SEQ ID NO: 1005347 - DNA, 22 bp, Artificial Sequence
  chemically synthesized
aacctggcatctgtggatggga

SEQ ID NO: 1005348 - DNA, 22 bp, Artificial Sequence
  chemically synthesized
acctggcatctgtggatgggat

SEQ ID NO: 1005349 - DNA, 22 bp, Artificial Sequence
  chemically synthesized
ggacctcccttaatcccatcca

SEQ ID NO: 1005350 - DNA, 22 bp, Artificial Sequence
  chemically synthesized
gcatctgtggatgggattaagg

SEQ ID NO: 1005351 - DNA, 22 bp, Artificial Sequence
  chemically synthesized
cgatcctgggacctcccttaat

SEQ ID NO: 1005352 - DNA, 22 bp, Artificial Sequence
  chemically synthesized
ctgcgatcctgggacctccctt

SEQ ID NO: 1005353 - DNA, 22 bp, Artificial Sequence
  chemically synthesized
tggatgggattaagggaggtcc

SEQ ID NO: 1005354 - DNA, 22 bp, Artificial Sequence
  chemically synthesized
agggaggtcccaggatcgcagg

SEQ ID NO: 1005355 - DNA, 22 bp, Artificial Sequence
  chemically synthesized
tgtaatataattcctgcgatcc

SEQ ID NO: 1005356 - DNA, 22 bp, Artificial Sequence
  chemically synthesized
atgtaatataattcctgcgatc

SEQ ID NO: 1005357 - DNA, 22 bp, Artificial Sequence
  chemically synthesized
ccttatgtaatataattcctgc

SEQ ID NO: 1005358 - DNA, 22 bp, Artificial Sequence
  chemically synthesized
accttatgtaatataattcctg

SEQ ID NO: 1005359 - DNA, 22 bp, Artificial Sequence
  chemically synthesized
acaacgcaaaggtatttacctt

SEQ ID NO: 1005360 - DNA, 22 bp, Artificial Sequence
  chemically synthesized
tattacataaggtaaatacctt

SEQ ID NO: 1005361 - DNA, 22 bp, Artificial Sequence
  chemically synthesized
actcacaacgcaaaggtattta

SEQ ID NO: 1005362 - DNA, 22 bp, Artificial Sequence
  chemically synthesized
cataaggtaaatacctttgcgt

SEQ ID NO: 1005363 - DNA, 22 bp, Artificial Sequence
  chemically synthesized
tgaaatggaatgtaacacctga

SEQ ID NO: 1005364 - DNA, 22 bp, Artificial Sequence
  chemically synthesized
tgcgttgtgagtcaggtgttac

SEQ ID NO: 1005365 - DNA, 22 bp, Artificial Sequence
  chemically synthesized
gcgttgtgagtcaggtgttaca

SEQ ID NO: 1005366 - DNA, 22 bp, Artificial Sequence
  chemically synthesized
cgttgtgagtcaggtgttacat

SEQ ID NO: 1005367 - DNA, 22 bp, Artificial Sequence
  chemically synthesized
cactgtgaaatggaatgtaaca

SEQ ID NO: 1005368 - DNA, 22 bp, Artificial Sequence
  chemically synthesized
ccactgtgaaatggaatgtaac

SEQ ID NO: 1005369 - DNA, 22 bp, Artificial Sequence
  chemically synthesized
tgagtcaggtgttacattccat

SEQ ID NO: 1005370 - DNA, 22 bp, Artificial Sequence
  chemically synthesized
aataatcttccactgtgaaatg

SEQ ID NO: 1005371 - DNA, 22 bp, Artificial Sequence
  chemically synthesized
gatctcaataatcttccactgt

SEQ ID NO: 1005372 - DNA, 22 bp, Artificial Sequence
  chemically synthesized
cattccatttcacagtggaaga

SEQ ID NO: 1005373 - DNA, 22 bp, Artificial Sequence
  chemically synthesized
ctggatctcaataatcttccac

SEQ ID NO: 1005374 - DNA, 22 bp, Artificial Sequence
  chemically synthesized
catttcacagtggaagattatt

SEQ ID NO: 1005375 - DNA, 22 bp, Artificial Sequence
  chemically synthesized
cacagtggaagattattgagat

SEQ ID NO: 1005376 - DNA, 22 bp, Artificial Sequence
  chemically synthesized
acagtggaagattattgagatc

SEQ ID NO: 1005377 - DNA, 22 bp, Artificial Sequence
  chemically synthesized
tcaatgatgtgggtatgttgct

SEQ ID NO: 1005378 - DNA, 22 bp, Artificial Sequence
  chemically synthesized
ttgagatccagcaacataccca

SEQ ID NO: 1005379 - DNA, 22 bp, Artificial Sequence
  chemically synthesized
agatccagcaacatacccacat

SEQ ID NO: 1005380 - DNA, 22 bp, Artificial Sequence
  chemically synthesized
ccaattatcaatgatgtgggta

SEQ ID NO: 1005381 - DNA, 22 bp, Artificial Sequence
  chemically synthesized
gtatacaaccccatgtctacca

SEQ ID NO: 1005382 - DNA, 22 bp, Artificial Sequence
  chemically synthesized
ataattggtagacatggggttg

SEQ ID NO: 1005383 - DNA, 22 bp, Artificial Sequence
  chemically synthesized
gtagacatggggttgtatacca

SEQ ID NO: 1005384 - DNA, 22 bp, Artificial Sequence
  chemically synthesized
gagtaacacagagctggtatac

SEQ ID NO: 1005385 - DNA, 22 bp, Artificial Sequence
  chemically synthesized
agagtaacacagagctggtata

SEQ ID NO: 1005386 - DNA, 22 bp, Artificial Sequence
  chemically synthesized
tagagtaacacagagctggtat

SEQ ID NO: 1005387 - DNA, 22 bp, Artificial Sequence
  chemically synthesized
tataccagctctgtgttactct

SEQ ID NO: 1005388 - DNA, 22 bp, Artificial Sequence
  chemically synthesized
aagcaagcatgtgttttagagt

SEQ ID NO: 1005389 - DNA, 22 bp, Artificial Sequence
  chemically synthesized
tgtgttactctaaaacacatgc

SEQ ID NO: 1005390 - DNA, 22 bp, Artificial Sequence
  chemically synthesized
tgttactctaaaacacatgctt

SEQ ID NO: 1005391 - DNA, 22 bp, Artificial Sequence
  chemically synthesized
ctctaaaacacatgcttgcttc

SEQ ID NO: 1005392 - DNA, 22 bp, Artificial Sequence
  chemically synthesized
taaaacacatgcttgcttcaac

SEQ ID NO: 1005393 - DNA, 22 bp, Artificial Sequence
  chemically synthesized
aaacacatgcttgcttcaacat

SEQ ID NO: 1005394 - DNA, 22 bp, Artificial Sequence
  chemically synthesized
taagaaggcagtgtggcatgtt

SEQ ID NO: 1005395 - DNA, 22 bp, Artificial Sequence
  chemically synthesized
tgtaagaaggcagtgtggcatg

SEQ ID NO: 1005396 - DNA, 22 bp, Artificial Sequence
  chemically synthesized
gcttcaacatgccacactgcct

SEQ ID NO: 1005397 - DNA, 22 bp, Artificial Sequence
  chemically synthesized
cttcaacatgccacactgcctt

SEQ ID NO: 1005398 - DNA, 22 bp, Artificial Sequence
  chemically synthesized
acagctctgtaagaaggcagtg

SEQ ID NO: 1005399 - DNA, 22 bp, Artificial Sequence
  chemically synthesized
cacagctctgtaagaaggcagt

SEQ ID NO: 1005400 - DNA, 22 bp, Artificial Sequence
  chemically synthesized
caacatgccacactgccttctt

SEQ ID NO: 1005401 - DNA, 22 bp, Artificial Sequence
  chemically synthesized
aacatgccacactgccttctta

SEQ ID NO: 1005402 - DNA, 22 bp, Artificial Sequence
  chemically synthesized
ttcacagctctgtaagaaggca

SEQ ID NO: 1005403 - DNA, 22 bp, Artificial Sequence
  chemically synthesized
cttcacagctctgtaagaaggc

SEQ ID NO: 1005404 - DNA, 22 bp, Artificial Sequence
  chemically synthesized
aacttcttcacagctctgtaag

SEQ ID NO: 1005405 - DNA, 22 bp, Artificial Sequence
  chemically synthesized
caacttcttcacagctctgtaa

SEQ ID NO: 1005406 - DNA, 22 bp, Artificial Sequence
  chemically synthesized
ccttcttacagagctgtgaaga

SEQ ID NO: 1005407 - DNA, 22 bp, Artificial Sequence
  chemically synthesized
gcgatttcaacttcttcacagc

SEQ ID NO: 1005408 - DNA, 22 bp, Artificial Sequence
  chemically synthesized
cgcgatttcaacttcttcacag

SEQ ID NO: 1005409 - DNA, 22 bp, Artificial Sequence
  chemically synthesized
tcgcgatttcaacttcttcaca

SEQ ID NO: 1005410 - DNA, 22 bp, Artificial Sequence
  chemically synthesized
cttacagagctgtgaagaagtt

SEQ ID NO: 1005411 - DNA, 22 bp, Artificial Sequence
  chemically synthesized
ttacagagctgtgaagaagttg

SEQ ID NO: 1005412 - DNA, 22 bp, Artificial Sequence
  chemically synthesized
acagagctgtgaagaagttgaa

SEQ ID NO: 1005413 - DNA, 22 bp, Artificial Sequence
  chemically synthesized
cagagctgtgaagaagttgaaa

SEQ ID NO: 1005414 - DNA, 22 bp, Artificial Sequence
  chemically synthesized
atagctttcgcgatttcaactt

SEQ ID NO: 1005415 - DNA, 22 bp, Artificial Sequence
  chemically synthesized
aatagctttcgcgatttcaact

SEQ ID NO: 1005416 - DNA, 22 bp, Artificial Sequence
  chemically synthesized
taatagctttcgcgatttcaac

SEQ ID NO: 1005417 - DNA, 22 bp, Artificial Sequence
  chemically synthesized
tgaagaagttgaaatcgcgaaa

SEQ ID NO: 1005418 - DNA, 22 bp, Artificial Sequence
  chemically synthesized
atctttaatagctttcgcgatt

SEQ ID NO: 1005419 - DNA, 22 bp, Artificial Sequence
  chemically synthesized
gatctttaatagctttcgcgat

SEQ ID NO: 1005420 - DNA, 22 bp, Artificial Sequence
  chemically synthesized
ccttgatctttaatagctttcg

SEQ ID NO: 1005421 - DNA, 22 bp, Artificial Sequence
  chemically synthesized
tctgccttgatctttaatagct

SEQ ID NO: 1005422 - DNA, 22 bp, Artificial Sequence
  chemically synthesized
atctgccttgatctttaatagc

SEQ ID NO: 1005423 - DNA, 22 bp, Artificial Sequence
  chemically synthesized
aaatcgcgaaagctattaaaga

SEQ ID NO: 1005424 - DNA, 22 bp, Artificial Sequence
  chemically synthesized
cataatatgaagtttatctgcc

SEQ ID NO: 1005425 - DNA, 22 bp, Artificial Sequence
  chemically synthesized
ttaaagatcaaggcagataaac

SEQ ID NO: 1005426 - DNA, 22 bp, Artificial Sequence
  chemically synthesized
aagatcaaggcagataaacttc

SEQ ID NO: 1005427 - DNA, 22 bp, Artificial Sequence
  chemically synthesized
acaagaaggctgcataatatga

SEQ ID NO: 1005428 - DNA, 22 bp, Artificial Sequence
  chemically synthesized
tactcacaagaaggctgcataa

SEQ ID NO: 1005429 - DNA, 22 bp, Artificial Sequence
  chemically synthesized
aaagttatactcacaagaaggc

SEQ ID NO: 1005430 - DNA, 22 bp, Artificial Sequence
  chemically synthesized
catattatgcagccttcttgtg

SEQ ID NO: 1005431 - DNA, 22 bp, Artificial Sequence
  chemically synthesized
atattatgcagccttcttgtga

SEQ ID NO: 1005432 - DNA, 22 bp, Artificial Sequence
  chemically synthesized
tgcagccttcttgtgagtataa

SEQ ID NO: 1005433 - DNA, 22 bp, Artificial Sequence
  chemically synthesized
gagataattgaaagttatactc

SEQ ID NO: 1005434 - DNA, 22 bp, Artificial Sequence
  chemically synthesized
ttggagataattgaaagttata

SEQ ID NO: 1005435 - DNA, 22 bp, Artificial Sequence
  chemically synthesized
cttgtgagtataactttcaatt

SEQ ID NO: 1005436 - DNA, 22 bp, Artificial Sequence
  chemically synthesized
ttgtgagtataactttcaatta

SEQ ID NO: 1005437 - DNA, 22 bp, Artificial Sequence
  chemically synthesized
aggttattggagataattgaaa

SEQ ID NO: 1005438 - DNA, 22 bp, Artificial Sequence
  chemically synthesized
gtgagtataactttcaattatc

SEQ ID NO: 1005439 - DNA, 22 bp, Artificial Sequence
  chemically synthesized
tgagtataactttcaattatct

SEQ ID NO: 1005440 - DNA, 22 bp, Artificial Sequence
  chemically synthesized
tatgtagttaaggttattggag

SEQ ID NO: 1005441 - DNA, 22 bp, Artificial Sequence
  chemically synthesized
gtatgtagttaaggttattgga

SEQ ID NO: 1005442 - DNA, 22 bp, Artificial Sequence
  chemically synthesized
tgtatgtagttaaggttattgg

SEQ ID NO: 1005443 - DNA, 22 bp, Artificial Sequence
  chemically synthesized
tcaattatctccaataacctta

SEQ ID NO: 1005444 - DNA, 22 bp, Artificial Sequence
  chemically synthesized
caattatctccaataaccttaa

SEQ ID NO: 1005445 - DNA, 22 bp, Artificial Sequence
  chemically synthesized
aattatctccaataaccttaac

SEQ ID NO: 1005446 - DNA, 22 bp, Artificial Sequence
  chemically synthesized
tctccaataaccttaactacat

SEQ ID NO: 1005447 - DNA, 22 bp, Artificial Sequence
  chemically synthesized
caataaccttaactacatacaa

SEQ ID NO: 1005448 - DNA, 22 bp, Artificial Sequence
  chemically synthesized
atgtatgatagttttgtatgta

SEQ ID NO: 1005449 - DNA, 22 bp, Artificial Sequence
  chemically synthesized
aactacatacaaaactatcata

SEQ ID NO: 1005450 - DNA, 22 bp, Artificial Sequence
  chemically synthesized
actacatacaaaactatcatac

SEQ ID NO: 1005451 - DNA, 22 bp, Artificial Sequence
  chemically synthesized
tatccatcattgatgtatgata

SEQ ID NO: 1005452 - DNA, 22 bp, Artificial Sequence
  chemically synthesized
catacaaaactatcatacatca

SEQ ID NO: 1005453 - DNA, 22 bp, Artificial Sequence
  chemically synthesized
tgtatccatcattgatgtatga

SEQ ID NO: 1005454 - DNA, 22 bp, Artificial Sequence
  chemically synthesized
attctgtatccatcattgatgt

SEQ ID NO: 1005455 - DNA, 22 bp, Artificial Sequence
  chemically synthesized
tcatacatcaatgatggataca

SEQ ID NO: 1005456 - DNA, 22 bp, Artificial Sequence
  chemically synthesized
aaatgagattaattctgtatcc

SEQ ID NO: 1005457 - DNA, 22 bp, Artificial Sequence
  chemically synthesized
attcaaatgagattaattctgt

SEQ ID NO: 1005458 - DNA, 22 bp, Artificial Sequence
  chemically synthesized
gattcaaatgagattaattctg

SEQ ID NO: 1005459 - DNA, 22 bp, Artificial Sequence
  chemically synthesized
aagatttgattcaaatgagatt

SEQ ID NO: 1005460 - DNA, 22 bp, Artificial Sequence
  chemically synthesized
aaagatttgattcaaatgagat

SEQ ID NO: 1005461 - DNA, 22 bp, Artificial Sequence
  chemically synthesized
taaagatttgattcaaatgaga

SEQ ID NO: 1005462 - DNA, 22 bp, Artificial Sequence
  chemically synthesized
ttaaagatttgattcaaatgag

SEQ ID NO: 1005463 - DNA, 22 bp, Artificial Sequence
  chemically synthesized
ttttaaagatttgattcaaatg

SEQ ID NO: 1005464 - DNA, 22 bp, Artificial Sequence
  chemically synthesized
aaattcttttaaagatttgatt

SEQ ID NO: 1005465 - DNA, 22 bp, Artificial Sequence
  chemically synthesized
atctcatttgaatcaaatcttt

SEQ ID NO: 1005466 - DNA, 22 bp, Artificial Sequence
  chemically synthesized
atttgaatcaaatctttaaaag

SEQ ID NO: 1005467 - DNA, 22 bp, Artificial Sequence
  chemically synthesized
gaatcaaatctttaaaagaatt

SEQ ID NO: 1005468 - DNA, 22 bp, Artificial Sequence
  chemically synthesized
aatcaaatctttaaaagaattt

SEQ ID NO: 1005469 - DNA, 22 bp, Artificial Sequence
  chemically synthesized
tatcaacagttgaaattctttt

SEQ ID NO: 1005470 - DNA, 22 bp, Artificial Sequence
  chemically synthesized
aaaattatatcaacagttgaaa

SEQ ID NO: 1005471 - DNA, 22 bp, Artificial Sequence
  chemically synthesized
caaaattatatcaacagttgaa

SEQ ID NO: 1005472 - DNA, 22 bp, Artificial Sequence
  chemically synthesized
tcaaaattatatcaacagttga

SEQ ID NO: 1005473 - DNA, 22 bp, Artificial Sequence
  chemically synthesized
taaaagaatttcaactgttgat

SEQ ID NO: 1005474 - DNA, 22 bp, Artificial Sequence
  chemically synthesized
aaaagaatttcaactgttgata

SEQ ID NO: 1005475 - DNA, 22 bp, Artificial Sequence
  chemically synthesized
ttttcaaaattatatcaacagt

SEQ ID NO: 1005476 - DNA, 22 bp, Artificial Sequence
  chemically synthesized
aaagaatttcaactgttgatat

SEQ ID NO: 1005477 - DNA, 22 bp, Artificial Sequence
  chemically synthesized
gttttcaaaattatatcaacag

SEQ ID NO: 1005478 - DNA, 22 bp, Artificial Sequence
  chemically synthesized
caactgttgatataattttgaa

SEQ ID NO: 1005479 - DNA, 22 bp, Artificial Sequence
  chemically synthesized
aactgttgatataattttgaaa

SEQ ID NO: 1005480 - DNA, 22 bp, Artificial Sequence
  chemically synthesized
aaaaaagtttgttttcaaaatt

SEQ ID NO: 1005481 - DNA, 22 bp, Artificial Sequence
  chemically synthesized
ttgatataattttgaaaacaaa

SEQ ID NO: 1005482 - DNA, 22 bp, Artificial Sequence
  chemically synthesized
aactgaaaaaagtttgttttca

SEQ ID NO: 1005483 - DNA, 22 bp, Artificial Sequence
  chemically synthesized
atataattttgaaaacaaactt

SEQ ID NO: 1005484 - DNA, 22 bp, Artificial Sequence
  chemically synthesized
tgcctcaactgaaaaaagtttg

SEQ ID NO: 1005485 - DNA, 22 bp, Artificial Sequence
  chemically synthesized
tgaaaacaaacttttttcagtt

SEQ ID NO: 1005486 - DNA, 22 bp, Artificial Sequence
  chemically synthesized
gaaaacaaacttttttcagttg

SEQ ID NO: 1005487 - DNA, 22 bp, Artificial Sequence
  chemically synthesized
aaaacaaacttttttcagttga

SEQ ID NO: 1005488 - DNA, 22 bp, Artificial Sequence
  chemically synthesized
tatgcaaattatgcctcaactg

SEQ ID NO: 1005489 - DNA, 22 bp, Artificial Sequence
  chemically synthesized
ttatatgcaaattatgcctcaa

SEQ ID NO: 1005490 - DNA, 22 bp, Artificial Sequence
  chemically synthesized
attatatgcaaattatgcctca

SEQ ID NO: 1005491 - DNA, 22 bp, Artificial Sequence
  chemically synthesized
tattatatgcaaattatgcctc

SEQ ID NO: 1005492 - DNA, 22 bp, Artificial Sequence
  chemically synthesized
ttttcagttgaggcataatttg

SEQ ID NO: 1005493 - DNA, 22 bp, Artificial Sequence
  chemically synthesized
tttcagttgaggcataatttgc

SEQ ID NO: 1005494 - DNA, 22 bp, Artificial Sequence
  chemically synthesized
ttcagttgaggcataatttgca

SEQ ID NO: 1005495 - DNA, 22 bp, Artificial Sequence
  chemically synthesized
cactttattatatgcaaattat

SEQ ID NO: 1005496 - DNA, 22 bp, Artificial Sequence
  chemically synthesized
tcagttgaggcataatttgcat

SEQ ID NO: 1005497 - DNA, 22 bp, Artificial Sequence
  chemically synthesized
gcactttattatatgcaaatta

SEQ ID NO: 1005498 - DNA, 22 bp, Artificial Sequence
  chemically synthesized
cagttgaggcataatttgcata

SEQ ID NO: 1005499 - DNA, 22 bp, Artificial Sequence
  chemically synthesized
tgcactttattatatgcaaatt

SEQ ID NO: 1005500 - DNA, 22 bp, Artificial Sequence
  chemically synthesized
agttgaggcataatttgcatat

SEQ ID NO: 1005501 - DNA, 22 bp, Artificial Sequence
  chemically synthesized
ttgcactttattatatgcaaat

SEQ ID NO: 1005502 - DNA, 22 bp, Artificial Sequence
  chemically synthesized
aggcataatttgcatataataa

SEQ ID NO: 1005503 - DNA, 22 bp, Artificial Sequence
  chemically synthesized
gacttttgcactttattatatg

SEQ ID NO: 1005504 - DNA, 22 bp, Artificial Sequence
  chemically synthesized
agacttttgcactttattatat

SEQ ID NO: 1005505 - DNA, 22 bp, Artificial Sequence
  chemically synthesized
gcatataataaagtgcaaaagt

SEQ ID NO: 1005506 - DNA, 22 bp, Artificial Sequence
  chemically synthesized
catataataaagtgcaaaagtc

SEQ ID NO: 1005507 - DNA, 22 bp, Artificial Sequence
  chemically synthesized
tcaaaacacatccatccaaaca

SEQ ID NO: 1005508 - DNA, 22 bp, Artificial Sequence
  chemically synthesized
aattgtcaaaacacatccatcc

SEQ ID NO: 1005509 - DNA, 22 bp, Artificial Sequence
  chemically synthesized
agtgtttggatggatgtgtttt

SEQ ID NO: 1005510 - DNA, 22 bp, Artificial Sequence
  chemically synthesized
ggatggatgtgttttgacaatt

SEQ ID NO: 1005511 - DNA, 22 bp, Artificial Sequence
  chemically synthesized
gatggatgtgttttgacaattg

SEQ ID NO: 1005512 - DNA, 22 bp, Artificial Sequence
  chemically synthesized
aggtggtgaatacatagataca

SEQ ID NO: 1005513 - DNA, 22 bp, Artificial Sequence
  chemically synthesized
tgacaattgaatgtatctatgt

SEQ ID NO: 1005514 - DNA, 22 bp, Artificial Sequence
  chemically synthesized
gacaattgaatgtatctatgta

SEQ ID NO: 1005515 - DNA, 22 bp, Artificial Sequence
  chemically synthesized
acaattgaatgtatctatgtat

SEQ ID NO: 1005516 - DNA, 22 bp, Artificial Sequence
  chemically synthesized
ttcaggtggtgaatacatagat

SEQ ID NO: 1005517 - DNA, 22 bp, Artificial Sequence
  chemically synthesized
gttcaggtggtgaatacataga

SEQ ID NO: 1005518 - DNA, 22 bp, Artificial Sequence
  chemically synthesized
tgttcaggtggtgaatacatag

SEQ ID NO: 1005519 - DNA, 22 bp, Artificial Sequence
  chemically synthesized
ttttgttcaggtggtgaataca

SEQ ID NO: 1005520 - DNA, 22 bp, Artificial Sequence
  chemically synthesized
aatgtatctatgtattcaccac

SEQ ID NO: 1005521 - DNA, 22 bp, Artificial Sequence
  chemically synthesized
tctattttgttcaggtggtgaa

SEQ ID NO: 1005522 - DNA, 22 bp, Artificial Sequence
  chemically synthesized
tgtattcaccacctgaacaaaa

SEQ ID NO: 1005523 - DNA, 22 bp, Artificial Sequence
  chemically synthesized
accacctgaacaaaatagacaa

SEQ ID NO: 1005524 - DNA, 22 bp, Artificial Sequence
  chemically synthesized
ggggtaatggaaatgttgtcta

SEQ ID NO: 1005525 - DNA, 22 bp, Artificial Sequence
  chemically synthesized
cggggtaatggaaatgttgtct

SEQ ID NO: 1005526 - DNA, 22 bp, Artificial Sequence
  chemically synthesized
tcggggtaatggaaatgttgtc

SEQ ID NO: 1005527 - DNA, 22 bp, Artificial Sequence
  chemically synthesized
ttcggggtaatggaaatgttgt

SEQ ID NO: 1005528 - DNA, 22 bp, Artificial Sequence
  chemically synthesized
tttcggggtaatggaaatgttg

SEQ ID NO: 1005529 - DNA, 22 bp, Artificial Sequence
  chemically synthesized
aacaaaatagacaacatttcca

SEQ ID NO: 1005530 - DNA, 22 bp, Artificial Sequence
  chemically synthesized
gtgactttttcggggtaatgga

SEQ ID NO: 1005531 - DNA, 22 bp, Artificial Sequence
  chemically synthesized
ccattaccccgaaaaagtcact

SEQ ID NO: 1005532 - DNA, 22 bp, Artificial Sequence
  chemically synthesized
cattaccccgaaaaagtcacta

SEQ ID NO: 1005533 - DNA, 22 bp, Artificial Sequence
  chemically synthesized
agtggacagaggcattagtgac

SEQ ID NO: 1005534 - DNA, 22 bp, Artificial Sequence
  chemically synthesized
ccccgaaaaagtcactaatgcc

SEQ ID NO: 1005535 - DNA, 22 bp, Artificial Sequence
  chemically synthesized
gaattgagtggacagaggcatt

SEQ ID NO: 1005536 - DNA, 22 bp, Artificial Sequence
  chemically synthesized
ggtgagggttggaattgagtgg

SEQ ID NO: 1005537 - DNA, 22 bp, Artificial Sequence
  chemically synthesized
atgcctctgtccactcaattcc

SEQ ID NO: 1005538 - DNA, 22 bp, Artificial Sequence
  chemically synthesized
tgggtgagggttggaattgagt

SEQ ID NO: 1005539 - DNA, 22 bp, Artificial Sequence
  chemically synthesized
cctctgggtgagggttggaatt

SEQ ID NO: 1005540 - DNA, 22 bp, Artificial Sequence
  chemically synthesized
tgtccactcaattccaaccctc

SEQ ID NO: 1005541 - DNA, 22 bp, Artificial Sequence
  chemically synthesized
tccactcaattccaaccctcac

SEQ ID NO: 1005542 - DNA, 22 bp, Artificial Sequence
  chemically synthesized
aattccaaccctcacccagagg

SEQ ID NO: 1005543 - DNA, 22 bp, Artificial Sequence
  chemically synthesized
agaaagtggttacctctgggtg

SEQ ID NO: 1005544 - DNA, 22 bp, Artificial Sequence
  chemically synthesized
caaccctcacccagaggtaacc

SEQ ID NO: 1005545 - DNA, 22 bp, Artificial Sequence
  chemically synthesized
acccagaggtaaccactttctt

SEQ ID NO: 1005546 - DNA, 22 bp, Artificial Sequence
  chemically synthesized
cggtaatagaattaagaaagtg

SEQ ID NO: 1005547 - DNA, 22 bp, Artificial Sequence
  chemically synthesized
aattacggtaatagaattaaga

SEQ ID NO: 1005548 - DNA, 22 bp, Artificial Sequence
  chemically synthesized
tcttaattctattaccgtaatt

SEQ ID NO: 1005549 - DNA, 22 bp, Artificial Sequence
  chemically synthesized
cttaattctattaccgtaattg

SEQ ID NO: 1005550 - DNA, 22 bp, Artificial Sequence
  chemically synthesized
ttaattctattaccgtaattga

SEQ ID NO: 1005551 - DNA, 22 bp, Artificial Sequence
  chemically synthesized
aattctattaccgtaattgagt

SEQ ID NO: 1005552 - DNA, 22 bp, Artificial Sequence
  chemically synthesized
aagcacagcaaaactcaattac

SEQ ID NO: 1005553 - DNA, 22 bp, Artificial Sequence
  chemically synthesized
attctattaccgtaattgagtt

SEQ ID NO: 1005554 - DNA, 22 bp, Artificial Sequence
  chemically synthesized
tattaccgtaattgagttttgc

SEQ ID NO: 1005555 - DNA, 22 bp, Artificial Sequence
  chemically synthesized
ttaccgtaattgagttttgctg

SEQ ID NO: 1005556 - DNA, 22 bp, Artificial Sequence
  chemically synthesized
ccgtaattgagttttgctgtgc

SEQ ID NO: 1005557 - DNA, 22 bp, Artificial Sequence
  chemically synthesized
catgaagttaaagcacagcaaa

SEQ ID NO: 1005558 - DNA, 22 bp, Artificial Sequence
  chemically synthesized
acatgaagttaaagcacagcaa

SEQ ID NO: 1005559 - DNA, 22 bp, Artificial Sequence
  chemically synthesized
agttttgctgtgctttaacttc

SEQ ID NO: 1005560 - DNA, 22 bp, Artificial Sequence
  chemically synthesized
tgctgtgctttaacttcatgta

SEQ ID NO: 1005561 - DNA, 22 bp, Artificial Sequence
  chemically synthesized
gctgtgctttaacttcatgtaa

SEQ ID NO: 1005562 - DNA, 22 bp, Artificial Sequence
  chemically synthesized
ctgtgctttaacttcatgtaaa

SEQ ID NO: 1005563 - DNA, 22 bp, Artificial Sequence
  chemically synthesized
tgctttaacttcatgtaaatac

SEQ ID NO: 1005564 - DNA, 22 bp, Artificial Sequence
  chemically synthesized
taacttcatgtaaatacccata

SEQ ID NO: 1005565 - DNA, 22 bp, Artificial Sequence
  chemically synthesized
aacttcatgtaaatacccatat

SEQ ID NO: 1005566 - DNA, 22 bp, Artificial Sequence
  chemically synthesized
acttcatgtaaatacccatatt

SEQ ID NO: 1005567 - DNA, 22 bp, Artificial Sequence
  chemically synthesized
catgtaaatacccatatttgtg

SEQ ID NO: 1005568 - DNA, 22 bp, Artificial Sequence
  chemically synthesized
atgtaaatacccatatttgtgt

SEQ ID NO: 1005569 - DNA, 22 bp, Artificial Sequence
  chemically synthesized
agccaaaagtcatagacacaaa

SEQ ID NO: 1005570 - DNA, 22 bp, Artificial Sequence
  chemically synthesized
tgctgagccaaaagtcatagac

SEQ ID NO: 1005571 - DNA, 22 bp, Artificial Sequence
  chemically synthesized
gtgtctatgacttttggctcag

SEQ ID NO: 1005572 - DNA, 22 bp, Artificial Sequence
  chemically synthesized
tgtctatgacttttggctcagc

SEQ ID NO: 1005573 - DNA, 22 bp, Artificial Sequence
  chemically synthesized
tgacttttggctcagcataata

SEQ ID NO: 1005574 - DNA, 22 bp, Artificial Sequence
  chemically synthesized
ttggctcagcataatatttttg

SEQ ID NO: 1005575 - DNA, 22 bp, Artificial Sequence
  chemically synthesized
tggctcagcataatatttttga

SEQ ID NO: 1005576 - DNA, 22 bp, Artificial Sequence
  chemically synthesized
ggctcagcataatatttttgac

SEQ ID NO: 1005577 - DNA, 22 bp, Artificial Sequence
  chemically synthesized
gctcagcataatatttttgaca

SEQ ID NO: 1005578 - DNA, 22 bp, Artificial Sequence
  chemically synthesized
agcataatatttttgacattca

SEQ ID NO: 1005579 - DNA, 22 bp, Artificial Sequence
  chemically synthesized
ttgacattcattcattcatatg

SEQ ID NO: 1005580 - DNA, 22 bp, Artificial Sequence
  chemically synthesized
tgacattcattcattcatatgg

SEQ ID NO: 1005581 - DNA, 22 bp, Artificial Sequence
  chemically synthesized
gacattcattcattcatatggt

SEQ ID NO: 1005582 - DNA, 22 bp, Artificial Sequence
  chemically synthesized
acattcattcattcatatggtt

SEQ ID NO: 1005583 - DNA, 22 bp, Artificial Sequence
  chemically synthesized
attcattcatatggttgctttt

SEQ ID NO: 1005584 - DNA, 22 bp, Artificial Sequence
  chemically synthesized
attcatatggttgcttttacca

SEQ ID NO: 1005585 - DNA, 22 bp, Artificial Sequence
  chemically synthesized
atatggttgcttttaccattgg

SEQ ID NO: 1005586 - DNA, 22 bp, Artificial Sequence
  chemically synthesized
ggcagtgaatagaggaaaaacc

SEQ ID NO: 1005587 - DNA, 22 bp, Artificial Sequence
  chemically synthesized
cttttaccattggtttttcctc

SEQ ID NO: 1005588 - DNA, 22 bp, Artificial Sequence
  chemically synthesized
ctcggcagtgaatagaggaaaa

SEQ ID NO: 1005589 - DNA, 22 bp, Artificial Sequence
  chemically synthesized
ttaccattggtttttcctctat

SEQ ID NO: 1005590 - DNA, 22 bp, Artificial Sequence
  chemically synthesized
actcggcagtgaatagaggaaa

SEQ ID NO: 1005591 - DNA, 22 bp, Artificial Sequence
  chemically synthesized
taccattggtttttcctctatt

SEQ ID NO: 1005592 - DNA, 22 bp, Artificial Sequence
  chemically synthesized
tactcggcagtgaatagaggaa

SEQ ID NO: 1005593 - DNA, 22 bp, Artificial Sequence
  chemically synthesized
accattggtttttcctctattc

SEQ ID NO: 1005594 - DNA, 22 bp, Artificial Sequence
  chemically synthesized
ccattggtttttcctctattca

SEQ ID NO: 1005595 - DNA, 22 bp, Artificial Sequence
  chemically synthesized
gtttttcctctattcactgccg

SEQ ID NO: 1005596 - DNA, 22 bp, Artificial Sequence
  chemically synthesized
ttcctctattcactgccgagta

SEQ ID NO: 1005597 - DNA, 22 bp, Artificial Sequence
  chemically synthesized
tcctctattcactgccgagtaa

SEQ ID NO: 1005598 - DNA, 22 bp, Artificial Sequence
  chemically synthesized
cctctattcactgccgagtaaa

SEQ ID NO: 1005599 - DNA, 22 bp, Artificial Sequence
  chemically synthesized
ctctattcactgccgagtaaaa

SEQ ID NO: 1005600 - DNA, 22 bp, Artificial Sequence
  chemically synthesized
aaccatgaatggaattttactc

SEQ ID NO: 1005601 - DNA, 22 bp, Artificial Sequence
  chemically synthesized
tattcactgccgagtaaaattc

SEQ ID NO: 1005602 - DNA, 22 bp, Artificial Sequence
  chemically synthesized
ttcactgccgagtaaaattcca

SEQ ID NO: 1005603 - DNA, 22 bp, Artificial Sequence
  chemically synthesized
ttaaaccatgaatggaatttta

SEQ ID NO: 1005604 - DNA, 22 bp, Artificial Sequence
  chemically synthesized
tgttaaaccatgaatggaattt

SEQ ID NO: 1005605 - DNA, 22 bp, Artificial Sequence
  chemically synthesized
actgccgagtaaaattccattc

SEQ ID NO: 1005606 - DNA, 22 bp, Artificial Sequence
  chemically synthesized
ccgagtaaaattccattcatgg

SEQ ID NO: 1005607 - DNA, 22 bp, Artificial Sequence
  chemically synthesized
atgcctctgttaaaccatgaat

SEQ ID NO: 1005608 - DNA, 22 bp, Artificial Sequence
  chemically synthesized
cattcatggtttaacagaggca

SEQ ID NO: 1005609 - DNA, 22 bp, Artificial Sequence
  chemically synthesized
acaaaaagttgatgcctctgtt

SEQ ID NO: 1005610 - DNA, 22 bp, Artificial Sequence
  chemically synthesized
cctcacaaaaagttgatgcctc

SEQ ID NO: 1005611 - DNA, 22 bp, Artificial Sequence
  chemically synthesized
atggtttaacagaggcatcaac

SEQ ID NO: 1005612 - DNA, 22 bp, Artificial Sequence
  chemically synthesized
actacctcacaaaaagttgatg

SEQ ID NO: 1005613 - DNA, 22 bp, Artificial Sequence
  chemically synthesized
aacagaggcatcaactttttgt

SEQ ID NO: 1005614 - DNA, 22 bp, Artificial Sequence
  chemically synthesized
cctcactacctcacaaaaagtt

SEQ ID NO: 1005615 - DNA, 22 bp, Artificial Sequence
  chemically synthesized
acagaggcatcaactttttgtg

SEQ ID NO: 1005616 - DNA, 22 bp, Artificial Sequence
  chemically synthesized
ccctcactacctcacaaaaagt

SEQ ID NO: 1005617 - DNA, 22 bp, Artificial Sequence
  chemically synthesized
cttccctcactacctcacaaaa

SEQ ID NO: 1005618 - DNA, 22 bp, Artificial Sequence
  chemically synthesized
ctccttccctcactacctcaca

SEQ ID NO: 1005619 - DNA, 22 bp, Artificial Sequence
  chemically synthesized
cctcctccttccctcactacct

SEQ ID NO: 1005620 - DNA, 22 bp, Artificial Sequence
  chemically synthesized
tttgtgaggtagtgagggaagg

SEQ ID NO: 1005621 - DNA, 22 bp, Artificial Sequence
  chemically synthesized
ttgtgaggtagtgagggaagga

SEQ ID NO: 1005622 - DNA, 22 bp, Artificial Sequence
  chemically synthesized
tgtgaggtagtgagggaaggag

SEQ ID NO: 1005623 - DNA, 22 bp, Artificial Sequence
  chemically synthesized
gtgaggtagtgagggaaggagg

SEQ ID NO: 1005624 - DNA, 22 bp, Artificial Sequence
  chemically synthesized
tgaggtagtgagggaaggagga

SEQ ID NO: 1005625 - DNA, 22 bp, Artificial Sequence
  chemically synthesized
cgtatcacatgaaatgcagtca

SEQ ID NO: 1005626 - DNA, 22 bp, Artificial Sequence
  chemically synthesized
acgtatcacatgaaatgcagtc

SEQ ID NO: 1005627 - DNA, 22 bp, Artificial Sequence
  chemically synthesized
catttacgtatcacatgaaatg

SEQ ID NO: 1005628 - DNA, 22 bp, Artificial Sequence
  chemically synthesized
ccatttacgtatcacatgaaat

SEQ ID NO: 1005629 - DNA, 22 bp, Artificial Sequence
  chemically synthesized
tccatttacgtatcacatgaaa

SEQ ID NO: 1005630 - DNA, 22 bp, Artificial Sequence
  chemically synthesized
tttccatttacgtatcacatga

SEQ ID NO: 1005631 - DNA, 22 bp, Artificial Sequence
  chemically synthesized
ctttccatttacgtatcacatg

SEQ ID NO: 1005632 - DNA, 22 bp, Artificial Sequence
  chemically synthesized
catttcatgtgatacgtaaatg

SEQ ID NO: 1005633 - DNA, 22 bp, Artificial Sequence
  chemically synthesized
ggtgcttctttccatttacgta

SEQ ID NO: 1005634 - DNA, 22 bp, Artificial Sequence
  chemically synthesized
catgtgatacgtaaatggaaag

SEQ ID NO: 1005635 - DNA, 22 bp, Artificial Sequence
  chemically synthesized
atgtgatacgtaaatggaaaga

SEQ ID NO: 1005636 - DNA, 22 bp, Artificial Sequence
  chemically synthesized
tgtagctaggtgcttctttcca

SEQ ID NO: 1005637 - DNA, 22 bp, Artificial Sequence
  chemically synthesized
gtgtagctaggtgcttctttcc

SEQ ID NO: 1005638 - DNA, 22 bp, Artificial Sequence
  chemically synthesized
tgtgtagctaggtgcttctttc

SEQ ID NO: 1005639 - DNA, 22 bp, Artificial Sequence
  chemically synthesized
tttgtgtagctaggtgcttctt

SEQ ID NO: 1005640 - DNA, 22 bp, Artificial Sequence
  chemically synthesized
tctttgtgtagctaggtgcttc

SEQ ID NO: 1005641 - DNA, 22 bp, Artificial Sequence
  chemically synthesized
ctctttgtgtagctaggtgctt

SEQ ID NO: 1005642 - DNA, 22 bp, Artificial Sequence
  chemically synthesized
tctctttgtgtagctaggtgct

SEQ ID NO: 1005643 - DNA, 22 bp, Artificial Sequence
  chemically synthesized
ttctctttgtgtagctaggtgc

SEQ ID NO: 1005644 - DNA, 22 bp, Artificial Sequence
  chemically synthesized
cttttctctttgtgtagctagg

SEQ ID NO: 1005645 - DNA, 22 bp, Artificial Sequence
  chemically synthesized
ccttttctctttgtgtagctag

SEQ ID NO: 1005646 - DNA, 22 bp, Artificial Sequence
  chemically synthesized
ttccttttctctttgtgtagct

SEQ ID NO: 1005647 - DNA, 22 bp, Artificial Sequence
  chemically synthesized
gctacacaaagagaaaaggaag

SEQ ID NO: 1005648 - DNA, 22 bp, Artificial Sequence
  chemically synthesized
gacccagaatgctcttcctttt

SEQ ID NO: 1005649 - DNA, 22 bp, Artificial Sequence
  chemically synthesized
agacccagaatgctcttccttt

SEQ ID NO: 1005650 - DNA, 22 bp, Artificial Sequence
  chemically synthesized
cacaaagagaaaaggaagagca

SEQ ID NO: 1005651 - DNA, 22 bp, Artificial Sequence
  chemically synthesized
ttagacccagaatgctcttcct

SEQ ID NO: 1005652 - DNA, 22 bp, Artificial Sequence
  chemically synthesized
ttcttagacccagaatgctctt

SEQ ID NO: 1005653 - DNA, 22 bp, Artificial Sequence
  chemically synthesized
tgttcttagacccagaatgctc

SEQ ID NO: 1005654 - DNA, 22 bp, Artificial Sequence
  chemically synthesized
tctgttcttagacccagaatgc

SEQ ID NO: 1005655 - DNA, 22 bp, Artificial Sequence
  chemically synthesized
ctctgttcttagacccagaatg

SEQ ID NO: 1005656 - DNA, 22 bp, Artificial Sequence
  chemically synthesized
cacgtgtttctctgttcttaga

SEQ ID NO: 1005657 - DNA, 22 bp, Artificial Sequence
  chemically synthesized
gcacgtgtttctctgttcttag

SEQ ID NO: 1005658 - DNA, 22 bp, Artificial Sequence
  chemically synthesized
tgcacgtgtttctctgttctta

SEQ ID NO: 1005659 - DNA, 22 bp, Artificial Sequence
  chemically synthesized
tgggtctaagaacagagaaaca

SEQ ID NO: 1005660 - DNA, 22 bp, Artificial Sequence
  chemically synthesized
ggtctaagaacagagaaacacg

SEQ ID NO: 1005661 - DNA, 22 bp, Artificial Sequence
  chemically synthesized
agggcctttgcacgtgtttctc

SEQ ID NO: 1005662 - DNA, 22 bp, Artificial Sequence
  chemically synthesized
agaacagagaaacacgtgcaaa

SEQ ID NO: 1005663 - DNA, 22 bp, Artificial Sequence
  chemically synthesized
aaacatctcagggcctttgcac

SEQ ID NO: 1005664 - DNA, 22 bp, Artificial Sequence
  chemically synthesized
taaaacatctcagggcctttgc

SEQ ID NO: 1005665 - DNA, 22 bp, Artificial Sequence
  chemically synthesized
ctaaaacatctcagggcctttg

SEQ ID NO: 1005666 - DNA, 22 bp, Artificial Sequence
  chemically synthesized
tctaaaacatctcagggccttt

SEQ ID NO: 1005667 - DNA, 22 bp, Artificial Sequence
  chemically synthesized
actttctaaaacatctcagggc

SEQ ID NO: 1005668 - DNA, 22 bp, Artificial Sequence
  chemically synthesized
ctcactttctaaaacatctcag

SEQ ID NO: 1005669 - DNA, 22 bp, Artificial Sequence
  chemically synthesized
cctcactttctaaaacatctca

SEQ ID NO: 1005670 - DNA, 22 bp, Artificial Sequence
  chemically synthesized
gtgcttcctcactttctaaaac

SEQ ID NO: 1005671 - DNA, 22 bp, Artificial Sequence
  chemically synthesized
agatgttttagaaagtgaggaa

SEQ ID NO: 1005672 - DNA, 22 bp, Artificial Sequence
  chemically synthesized
tagaaagtgaggaagcactaat

SEQ ID NO: 1005673 - DNA, 22 bp, Artificial Sequence
  chemically synthesized
agaaagtgaggaagcactaata

SEQ ID NO: 1005674 - DNA, 22 bp, Artificial Sequence
  chemically synthesized
gaaagtgaggaagcactaatat

SEQ ID NO: 1005675 - DNA, 22 bp, Artificial Sequence
  chemically synthesized
aatccatataggataatcatat

SEQ ID NO: 1005676 - DNA, 22 bp, Artificial Sequence
  chemically synthesized
tcaatccatataggataatcat

SEQ ID NO: 1005677 - DNA, 22 bp, Artificial Sequence
  chemically synthesized
ctcaatccatataggataatca

SEQ ID NO: 1005678 - DNA, 22 bp, Artificial Sequence
  chemically synthesized
tctcaatccatataggataatc

SEQ ID NO: 1005679 - DNA, 22 bp, Artificial Sequence
  chemically synthesized
atatgattatcctatatggatt

SEQ ID NO: 1005680 - DNA, 22 bp, Artificial Sequence
  chemically synthesized
agtcaacctttctcaatccata

SEQ ID NO: 1005681 - DNA, 22 bp, Artificial Sequence
  chemically synthesized
aagtcaacctttctcaatccat

SEQ ID NO: 1005682 - DNA, 22 bp, Artificial Sequence
  chemically synthesized
ttaagtcaacctttctcaatcc

SEQ ID NO: 1005683 - DNA, 22 bp, Artificial Sequence
  chemically synthesized
cttaagtcaacctttctcaatc

SEQ ID NO: 1005684 - DNA, 22 bp, Artificial Sequence
  chemically synthesized
ttcttaagtcaacctttctcaa

SEQ ID NO: 1005685 - DNA, 22 bp, Artificial Sequence
  chemically synthesized
tcctatatggattgagaaaggt

SEQ ID NO: 1005686 - DNA, 22 bp, Artificial Sequence
  chemically synthesized
cttcttaagtcaacctttctca

SEQ ID NO: 1005687 - DNA, 22 bp, Artificial Sequence
  chemically synthesized
tcttcttaagtcaacctttctc

SEQ ID NO: 1005688 - DNA, 22 bp, Artificial Sequence
  chemically synthesized
tatggattgagaaaggttgact

SEQ ID NO: 1005689 - DNA, 22 bp, Artificial Sequence
  chemically synthesized
ccattttcttcttaagtcaacc

SEQ ID NO: 1005690 - DNA, 22 bp, Artificial Sequence
  chemically synthesized
accattttcttcttaagtcaac

SEQ ID NO: 1005691 - DNA, 22 bp, Artificial Sequence
  chemically synthesized
taccattttcttcttaagtcaa

SEQ ID NO: 1005692 - DNA, 22 bp, Artificial Sequence
  chemically synthesized
tctttaccattttcttcttaag

SEQ ID NO: 1005693 - DNA, 22 bp, Artificial Sequence
  chemically synthesized
agaaaggttgacttaagaagaa

SEQ ID NO: 1005694 - DNA, 22 bp, Artificial Sequence
  chemically synthesized
tatctttaccattttcttctta

SEQ ID NO: 1005695 - DNA, 22 bp, Artificial Sequence
  chemically synthesized
ctatctttaccattttcttctt

SEQ ID NO: 1005696 - DNA, 22 bp, Artificial Sequence
  chemically synthesized
tatttctatctttaccattttc

SEQ ID NO: 1005697 - DNA, 22 bp, Artificial Sequence
  chemically synthesized
acttaagaagaaaatggtaaag

SEQ ID NO: 1005698 - DNA, 22 bp, Artificial Sequence
  chemically synthesized
aagaagaaaatggtaaagatag

SEQ ID NO: 1005699 - DNA, 22 bp, Artificial Sequence
  chemically synthesized
agaagaaaatggtaaagataga

SEQ ID NO: 1005700 - DNA, 22 bp, Artificial Sequence
  chemically synthesized
caacacataatgaatatattat

SEQ ID NO: 1005701 - DNA, 22 bp, Artificial Sequence
  chemically synthesized
gaatacaatgaattacaacaca

SEQ ID NO: 1005702 - DNA, 22 bp, Artificial Sequence
  chemically synthesized
agaatacaatgaattacaacac

SEQ ID NO: 1005703 - DNA, 22 bp, Artificial Sequence
  chemically synthesized
tggcttagaatacaatgaatta

SEQ ID NO: 1005704 - DNA, 22 bp, Artificial Sequence
  chemically synthesized
attatgtgttgtaattcattgt

SEQ ID NO: 1005705 - DNA, 22 bp, Artificial Sequence
  chemically synthesized
ttatggcttagaatacaatgaa

SEQ ID NO: 1005706 - DNA, 22 bp, Artificial Sequence
  chemically synthesized
attatggcttagaatacaatga

SEQ ID NO: 1005707 - DNA, 22 bp, Artificial Sequence
  chemically synthesized
tgtgttgtaattcattgtattc

SEQ ID NO: 1005708 - DNA, 22 bp, Artificial Sequence
  chemically synthesized
tattatggcttagaatacaatg

SEQ ID NO: 1005709 - DNA, 22 bp, Artificial Sequence
  chemically synthesized
tttattatggcttagaatacaa

SEQ ID NO: 1005710 - DNA, 22 bp, Artificial Sequence
  chemically synthesized
taattcattgtattctaagcca

SEQ ID NO: 1005711 - DNA, 22 bp, Artificial Sequence
  chemically synthesized
attgtattctaagccataataa

SEQ ID NO: 1005712 - DNA, 22 bp, Artificial Sequence
  chemically synthesized
tattctaagccataataaagag

SEQ ID NO: 1005713 - DNA, 22 bp, Artificial Sequence
  chemically synthesized
ggatgaacacccaactctttat

SEQ ID NO: 1005714 - DNA, 22 bp, Artificial Sequence
  chemically synthesized
taagccataataaagagttggg

SEQ ID NO: 1005715 - DNA, 22 bp, Artificial Sequence
  chemically synthesized
ttaggatgaacacccaactctt

SEQ ID NO: 1005716 - DNA, 22 bp, Artificial Sequence
  chemically synthesized
attaggatgaacacccaactct

SEQ ID NO: 1005717 - DNA, 22 bp, Artificial Sequence
  chemically synthesized
agccataataaagagttgggtg

SEQ ID NO: 1005718 - DNA, 22 bp, Artificial Sequence
  chemically synthesized
tcttattaggatgaacacccaa

SEQ ID NO: 1005719 - DNA, 22 bp, Artificial Sequence
  chemically synthesized
atcttattaggatgaacaccca

SEQ ID NO: 1005720 - DNA, 22 bp, Artificial Sequence
  chemically synthesized
atggatttatcttattaggatg

SEQ ID NO: 1005721 - DNA, 22 bp, Artificial Sequence
  chemically synthesized
ggtgttcatcctaataagataa

SEQ ID NO: 1005722 - DNA, 22 bp, Artificial Sequence
  chemically synthesized
aggccctcatggatttatctta

SEQ ID NO: 1005723 - DNA, 22 bp, Artificial Sequence
  chemically synthesized
aaggccctcatggatttatctt

SEQ ID NO: 1005724 - DNA, 22 bp, Artificial Sequence
  chemically synthesized
atcctaataagataaatccatg

SEQ ID NO: 1005725 - DNA, 22 bp, Artificial Sequence
  chemically synthesized
tgcttaaggccctcatggattt

SEQ ID NO: 1005726 - DNA, 22 bp, Artificial Sequence
  chemically synthesized
tgtgcttaaggccctcatggat

SEQ ID NO: 1005727 - DNA, 22 bp, Artificial Sequence
  chemically synthesized
ctgtgcttaaggccctcatgga

SEQ ID NO: 1005728 - DNA, 22 bp, Artificial Sequence
  chemically synthesized
ataagataaatccatgagggcc

SEQ ID NO: 1005729 - DNA, 22 bp, Artificial Sequence
  chemically synthesized
gataaaggcatttctgtgctta

SEQ ID NO: 1005730 - DNA, 22 bp, Artificial Sequence
  chemically synthesized
aagcacagaaatgcctttatct

SEQ ID NO: 1005731 - DNA, 22 bp, Artificial Sequence
  chemically synthesized
aaaatgtcagctagataaaggc

SEQ ID NO: 1005732 - DNA, 22 bp, Artificial Sequence
  chemically synthesized
agcacagaaatgcctttatcta

SEQ ID NO: 1005733 - DNA, 22 bp, Artificial Sequence
  chemically synthesized
tcaaaatgtcagctagataaag

SEQ ID NO: 1005734 - DNA, 22 bp, Artificial Sequence
  chemically synthesized
ctcaaaatgtcagctagataaa

SEQ ID NO: 1005735 - DNA, 22 bp, Artificial Sequence
  chemically synthesized
tatctagctgacattttgagaa

SEQ ID NO: 1005736 - DNA, 22 bp, Artificial Sequence
  chemically synthesized
atctagctgacattttgagaag

SEQ ID NO: 1005737 - DNA, 22 bp, Artificial Sequence
  chemically synthesized
tctagctgacattttgagaaga

SEQ ID NO: 1005738 - DNA, 22 bp, Artificial Sequence
  chemically synthesized
gctgacattttgagaagatcca

SEQ ID NO: 1005739 - DNA, 22 bp, Artificial Sequence
  chemically synthesized
caccgcagcaaaatggatcttc

SEQ ID NO: 1005740 - DNA, 22 bp, Artificial Sequence
  chemically synthesized
acattttgagaagatccatttt

SEQ ID NO: 1005741 - DNA, 22 bp, Artificial Sequence
  chemically synthesized
aatcctacaccgcagcaaaatg

SEQ ID NO: 1005742 - DNA, 22 bp, Artificial Sequence
  chemically synthesized
tgagaagatccattttgctgcg

SEQ ID NO: 1005743 - DNA, 22 bp, Artificial Sequence
  chemically synthesized
gagaagatccattttgctgcgg

SEQ ID NO: 1005744 - DNA, 22 bp, Artificial Sequence
  chemically synthesized
ttcaatcctacaccgcagcaaa

SEQ ID NO: 1005745 - DNA, 22 bp, Artificial Sequence
  chemically synthesized
agaagatccattttgctgcggt

SEQ ID NO: 1005746 - DNA, 22 bp, Artificial Sequence
  chemically synthesized
ctattcaatcctacaccgcagc

SEQ ID NO: 1005747 - DNA, 22 bp, Artificial Sequence
  chemically synthesized
cctattcaatcctacaccgcag

SEQ ID NO: 1005748 - DNA, 22 bp, Artificial Sequence
  chemically synthesized
ttcctattcaatcctacaccgc

SEQ ID NO: 1005749 - DNA, 22 bp, Artificial Sequence
  chemically synthesized
tcttcctattcaatcctacacc

SEQ ID NO: 1005750 - DNA, 22 bp, Artificial Sequence
  chemically synthesized
ttctcttcctattcaatcctac

SEQ ID NO: 1005751 - DNA, 22 bp, Artificial Sequence
  chemically synthesized
tgctgcggtgtaggattgaata

SEQ ID NO: 1005752 - DNA, 22 bp, Artificial Sequence
  chemically synthesized
ttattctcttcctattcaatcc

SEQ ID NO: 1005753 - DNA, 22 bp, Artificial Sequence
  chemically synthesized
gctgcggtgtaggattgaatag

SEQ ID NO: 1005754 - DNA, 22 bp, Artificial Sequence
  chemically synthesized
ctgcggtgtaggattgaatagg

SEQ ID NO: 1005755 - DNA, 22 bp, Artificial Sequence
  chemically synthesized
ttgttattctcttcctattcaa

SEQ ID NO: 1005756 - DNA, 22 bp, Artificial Sequence
  chemically synthesized
cggtgtaggattgaataggaag

SEQ ID NO: 1005757 - DNA, 22 bp, Artificial Sequence
  chemically synthesized
ctgttgttattctcttcctatt

SEQ ID NO: 1005758 - DNA, 22 bp, Artificial Sequence
  chemically synthesized
ctactgttgttattctcttcct

SEQ ID NO: 1005759 - DNA, 22 bp, Artificial Sequence
  chemically synthesized
actactgttgttattctcttcc

SEQ ID NO: 1005760 - DNA, 22 bp, Artificial Sequence
  chemically synthesized
ttactactgttgttattctctt

SEQ ID NO: 1005761 - DNA, 22 bp, Artificial Sequence
  chemically synthesized
tcttactactgttgttattctc

SEQ ID NO: 1005762 - DNA, 22 bp, Artificial Sequence
  chemically synthesized
aataggaagagaataacaacag

SEQ ID NO: 1005763 - DNA, 22 bp, Artificial Sequence
  chemically synthesized
ggtcacattctcttactactgt

SEQ ID NO: 1005764 - DNA, 22 bp, Artificial Sequence
  chemically synthesized
ccagattaggtcacattctctt

SEQ ID NO: 1005765 - DNA, 22 bp, Artificial Sequence
  chemically synthesized
gccagattaggtcacattctct

SEQ ID NO: 1005766 - DNA, 22 bp, Artificial Sequence
  chemically synthesized
ttgccagattaggtcacattct

SEQ ID NO: 1005767 - DNA, 22 bp, Artificial Sequence
  chemically synthesized
ccctcttgccagattaggtcac

SEQ ID NO: 1005768 - DNA, 22 bp, Artificial Sequence
  chemically synthesized
tgccctcttgccagattaggtc

SEQ ID NO: 1005769 - DNA, 22 bp, Artificial Sequence
  chemically synthesized
ggccaggtcacctctgccctct

SEQ ID NO: 1005770 - DNA, 22 bp, Artificial Sequence
  chemically synthesized
aggccaggtcacctctgccctc

SEQ ID NO: 1005771 - DNA, 22 bp, Artificial Sequence
  chemically synthesized
atctggcaagagggcagaggtg

SEQ ID NO: 1005772 - DNA, 22 bp, Artificial Sequence
  chemically synthesized
gcaagagggcagaggtgacctg

SEQ ID NO: 1005773 - DNA, 22 bp, Artificial Sequence
  chemically synthesized
ccccatcttaggccaggtcacc

SEQ ID NO: 1005774 - DNA, 22 bp, Artificial Sequence
  chemically synthesized
catctcccccatcttaggccag

SEQ ID NO: 1005775 - DNA, 22 bp, Artificial Sequence
  chemically synthesized
tgcatctcccccatcttaggcc

SEQ ID NO: 1005776 - DNA, 22 bp, Artificial Sequence
  chemically synthesized
ctctgcatctcccccatcttag

SEQ ID NO: 1005777 - DNA, 22 bp, Artificial Sequence
  chemically synthesized
cctctgcatctcccccatctta

SEQ ID NO: 1005778 - DNA, 22 bp, Artificial Sequence
  chemically synthesized
ttcctctgcatctcccccatct

SEQ ID NO: 1005779 - DNA, 22 bp, Artificial Sequence
  chemically synthesized
tcttcctctgcatctcccccat

SEQ ID NO: 1005780 - DNA, 22 bp, Artificial Sequence
  chemically synthesized
ctcttcctctgcatctccccca

SEQ ID NO: 1005781 - DNA, 22 bp, Artificial Sequence
  chemically synthesized
gcctaagatgggggagatgcag

SEQ ID NO: 1005782 - DNA, 22 bp, Artificial Sequence
  chemically synthesized
ccttctcttcctctgcatctcc

SEQ ID NO: 1005783 - DNA, 22 bp, Artificial Sequence
  chemically synthesized
gccttctcttcctctgcatctc

SEQ ID NO: 1005784 - DNA, 22 bp, Artificial Sequence
  chemically synthesized
agatgggggagatgcagaggaa

SEQ ID NO: 1005785 - DNA, 22 bp, Artificial Sequence
  chemically synthesized
aatttgccttctcttcctctgc

SEQ ID NO: 1005786 - DNA, 22 bp, Artificial Sequence
  chemically synthesized
gaatttgccttctcttcctctg

SEQ ID NO: 1005787 - DNA, 22 bp, Artificial Sequence
  chemically synthesized
tgaatttgccttctcttcctct

SEQ ID NO: 1005788 - DNA, 22 bp, Artificial Sequence
  chemically synthesized
ttttgaatttgccttctcttcc

SEQ ID NO: 1005789 - DNA, 22 bp, Artificial Sequence
  chemically synthesized
attttgaatttgccttctcttc

SEQ ID NO: 1005790 - DNA, 22 bp, Artificial Sequence
  chemically synthesized
caaaaatttattttgaatttgc

SEQ ID NO: 1005791 - DNA, 22 bp, Artificial Sequence
  chemically synthesized
tctccaaaaatttattttgaat

SEQ ID NO: 1005792 - DNA, 22 bp, Artificial Sequence
  chemically synthesized
tgtctccaaaaatttattttga

SEQ ID NO: 1005793 - DNA, 22 bp, Artificial Sequence
  chemically synthesized
ctgtctccaaaaatttattttg

SEQ ID NO: 1005794 - DNA, 22 bp, Artificial Sequence
  chemically synthesized
aaaataaatttttggagacaga

SEQ ID NO: 1005795 - DNA, 22 bp, Artificial Sequence
  chemically synthesized
ttggagacagaagttgcattgc

SEQ ID NO: 1005796 - DNA, 22 bp, Artificial Sequence
  chemically synthesized
taagcaagtaatgcaatgcaac

SEQ ID NO: 1005797 - DNA, 22 bp, Artificial Sequence
  chemically synthesized
tggagacagaagttgcattgca

SEQ ID NO: 1005798 - DNA, 22 bp, Artificial Sequence
  chemically synthesized
ggagacagaagttgcattgcat

SEQ ID NO: 1005799 - DNA, 22 bp, Artificial Sequence
  chemically synthesized
gagacagaagttgcattgcatt

SEQ ID NO: 1005800 - DNA, 22 bp, Artificial Sequence
  chemically synthesized
atctataagcaagtaatgcaat

SEQ ID NO: 1005801 - DNA, 22 bp, Artificial Sequence
  chemically synthesized
tatctaatctataagcaagtaa

SEQ ID NO: 1005802 - DNA, 22 bp, Artificial Sequence
  chemically synthesized
atatctaatctataagcaagta

SEQ ID NO: 1005803 - DNA, 22 bp, Artificial Sequence
  chemically synthesized
tatatctaatctataagcaagt

SEQ ID NO: 1005804 - DNA, 22 bp, Artificial Sequence
  chemically synthesized
cattgcattacttgcttataga

SEQ ID NO: 1005805 - DNA, 22 bp, Artificial Sequence
  chemically synthesized
ccattttatatctaatctataa

SEQ ID NO: 1005806 - DNA, 22 bp, Artificial Sequence
  chemically synthesized
cattacttgcttatagattaga

SEQ ID NO: 1005807 - DNA, 22 bp, Artificial Sequence
  chemically synthesized
tctcccattttatatctaatct

SEQ ID NO: 1005808 - DNA, 22 bp, Artificial Sequence
  chemically synthesized
atctcccattttatatctaatc

SEQ ID NO: 1005809 - DNA, 22 bp, Artificial Sequence
  chemically synthesized
cttgcttatagattagatataa

SEQ ID NO: 1005810 - DNA, 22 bp, Artificial Sequence
  chemically synthesized
gcttatagattagatataaaat

SEQ ID NO: 1005811 - DNA, 22 bp, Artificial Sequence
  chemically synthesized
cttatagattagatataaaatg

SEQ ID NO: 1005812 - DNA, 22 bp, Artificial Sequence
  chemically synthesized
catcatttatctcccattttat

SEQ ID NO: 1005813 - DNA, 22 bp, Artificial Sequence
  chemically synthesized
atagattagatataaaatggga

SEQ ID NO: 1005814 - DNA, 22 bp, Artificial Sequence
  chemically synthesized
tagattagatataaaatgggag

SEQ ID NO: 1005815 - DNA, 22 bp, Artificial Sequence
  chemically synthesized
gatataaaatgggagataaatg

SEQ ID NO: 1005816 - DNA, 22 bp, Artificial Sequence
  chemically synthesized
gtaagcagagtccacatgattc

SEQ ID NO: 1005817 - DNA, 22 bp, Artificial Sequence
  chemically synthesized
attggtaagcagagtccacatg

SEQ ID NO: 1005818 - DNA, 22 bp, Artificial Sequence
  chemically synthesized
gattggtaagcagagtccacat

SEQ ID NO: 1005819 - DNA, 22 bp, Artificial Sequence
  chemically synthesized
cttgattggtaagcagagtcca

SEQ ID NO: 1005820 - DNA, 22 bp, Artificial Sequence
  chemically synthesized
tctacttgattggtaagcagag

SEQ ID NO: 1005821 - DNA, 22 bp, Artificial Sequence
  chemically synthesized
atctacttgattggtaagcaga

SEQ ID NO: 1005822 - DNA, 22 bp, Artificial Sequence
  chemically synthesized
ttatctacttgattggtaagca

SEQ ID NO: 1005823 - DNA, 22 bp, Artificial Sequence
  chemically synthesized
cttatctacttgattggtaagc

SEQ ID NO: 1005824 - DNA, 22 bp, Artificial Sequence
  chemically synthesized
ttcttatctacttgattggtaa

SEQ ID NO: 1005825 - DNA, 22 bp, Artificial Sequence
  chemically synthesized
cttcttatctacttgattggta

SEQ ID NO: 1005826 - DNA, 22 bp, Artificial Sequence
  chemically synthesized
tgcttaccaatcaagtagataa

SEQ ID NO: 1005827 - DNA, 22 bp, Artificial Sequence
  chemically synthesized
cttaccaatcaagtagataaga

SEQ ID NO: 1005828 - DNA, 22 bp, Artificial Sequence
  chemically synthesized
accaatcaagtagataagaaga

SEQ ID NO: 1005829 - DNA, 22 bp, Artificial Sequence
  chemically synthesized
acagtagtatcttcttcttatc

SEQ ID NO: 1005830 - DNA, 22 bp, Artificial Sequence
  chemically synthesized
ccaatcaagtagataagaagaa

SEQ ID NO: 1005831 - DNA, 22 bp, Artificial Sequence
  chemically synthesized
cacagtagtatcttcttcttat

SEQ ID NO: 1005832 - DNA, 22 bp, Artificial Sequence
  chemically synthesized
tttcacagtagtatcttcttct

SEQ ID NO: 1005833 - DNA, 22 bp, Artificial Sequence
  chemically synthesized
atctatttcacagtagtatctt

SEQ ID NO: 1005834 - DNA, 22 bp, Artificial Sequence
  chemically synthesized
cccagccctcatctatttcaca

SEQ ID NO: 1005835 - DNA, 22 bp, Artificial Sequence
  chemically synthesized
ccccagccctcatctatttcac

SEQ ID NO: 1005836 - DNA, 22 bp, Artificial Sequence
  chemically synthesized
cccttccccagccctcatctat

SEQ ID NO: 1005837 - DNA, 22 bp, Artificial Sequence
  chemically synthesized
ccccttccccagccctcatcta

SEQ ID NO: 1005838 - DNA, 22 bp, Artificial Sequence
  chemically synthesized
tccccttccccagccctcatct

SEQ ID NO: 1005839 - DNA, 22 bp, Artificial Sequence
  chemically synthesized
ctgtgaaatagatgagggctgg

SEQ ID NO: 1005840 - DNA, 22 bp, Artificial Sequence
  chemically synthesized
tgaaatagatgagggctgggga

SEQ ID NO: 1005841 - DNA, 22 bp, Artificial Sequence
  chemically synthesized
aaatctttccccttccccagcc

SEQ ID NO: 1005842 - DNA, 22 bp, Artificial Sequence
  chemically synthesized
aaaatctttccccttccccagc

SEQ ID NO: 1005843 - DNA, 22 bp, Artificial Sequence
  chemically synthesized
tttaaaatctttccccttcccc

SEQ ID NO: 1005844 - DNA, 22 bp, Artificial Sequence
  chemically synthesized
atttaaaatctttccccttccc

SEQ ID NO: 1005845 - DNA, 22 bp, Artificial Sequence
  chemically synthesized
tatttaaaatctttccccttcc

SEQ ID NO: 1005846 - DNA, 22 bp, Artificial Sequence
  chemically synthesized
acattttatttaaaatctttcc

SEQ ID NO: 1005847 - DNA, 22 bp, Artificial Sequence
  chemically synthesized
gacattttatttaaaatctttc

SEQ ID NO: 1005848 - DNA, 22 bp, Artificial Sequence
  chemically synthesized
tgacattttatttaaaatcttt

SEQ ID NO: 1005849 - DNA, 22 bp, Artificial Sequence
  chemically synthesized
gggaaggggaaagattttaaat

SEQ ID NO: 1005850 - DNA, 22 bp, Artificial Sequence
  chemically synthesized
ccgcacatgcagctttgacatt

SEQ ID NO: 1005851 - DNA, 22 bp, Artificial Sequence
  chemically synthesized
gctgccgcacatgcagctttga

SEQ ID NO: 1005852 - DNA, 22 bp, Artificial Sequence
  chemically synthesized
taaataaaatgtcaaagctgca

SEQ ID NO: 1005853 - DNA, 22 bp, Artificial Sequence
  chemically synthesized
aaataaaatgtcaaagctgcat

SEQ ID NO: 1005854 - DNA, 22 bp, Artificial Sequence
  chemically synthesized
aataaaatgtcaaagctgcatg

SEQ ID NO: 1005855 - DNA, 22 bp, Artificial Sequence
  chemically synthesized
attggctgccgcacatgcagct

SEQ ID NO: 1005856 - DNA, 22 bp, Artificial Sequence
  chemically synthesized
catgtgcggcagccaatgaatt

SEQ ID NO: 1005857 - DNA, 22 bp, Artificial Sequence
  chemically synthesized
agcatatgacacaattcattgg

SEQ ID NO: 1005858 - DNA, 22 bp, Artificial Sequence
  chemically synthesized
acctgagcatatgacacaattc

SEQ ID NO: 1005859 - DNA, 22 bp, Artificial Sequence
  chemically synthesized
ttcacctgagcatatgacacaa

SEQ ID NO: 1005860 - DNA, 22 bp, Artificial Sequence
  chemically synthesized
gttcacctgagcatatgacaca

SEQ ID NO: 1005861 - DNA, 22 bp, Artificial Sequence
  chemically synthesized
cttgttcacctgagcatatgac

SEQ ID NO: 1005862 - DNA, 22 bp, Artificial Sequence
  chemically synthesized
caaacctgcttgttcacctgag

SEQ ID NO: 1005863 - DNA, 22 bp, Artificial Sequence
  chemically synthesized
tgtcatatgctcaggtgaacaa

SEQ ID NO: 1005864 - DNA, 22 bp, Artificial Sequence
  chemically synthesized
attccaaacctgcttgttcacc

SEQ ID NO: 1005865 - DNA, 22 bp, Artificial Sequence
  chemically synthesized
gattccaaacctgcttgttcac

SEQ ID NO: 1005866 - DNA, 22 bp, Artificial Sequence
  chemically synthesized
ttgattccaaacctgcttgttc

SEQ ID NO: 1005867 - DNA, 22 bp, Artificial Sequence
  chemically synthesized
tcttgattccaaacctgcttgt

SEQ ID NO: 1005868 - DNA, 22 bp, Artificial Sequence
  chemically synthesized
ctcttgattccaaacctgcttg

SEQ ID NO: 1005869 - DNA, 22 bp, Artificial Sequence
  chemically synthesized
aggtgaacaagcaggtttggaa

SEQ ID NO: 1005870 - DNA, 22 bp, Artificial Sequence
  chemically synthesized
catcccatatttctcttgattc

SEQ ID NO: 1005871 - DNA, 22 bp, Artificial Sequence
  chemically synthesized
ccatcccatatttctcttgatt

SEQ ID NO: 1005872 - DNA, 22 bp, Artificial Sequence
  chemically synthesized
tccatcccatatttctcttgat

SEQ ID NO: 1005873 - DNA, 22 bp, Artificial Sequence
  chemically synthesized
tctttccatcccatatttctct

SEQ ID NO: 1005874 - DNA, 22 bp, Artificial Sequence
  chemically synthesized
tatctttccatcccatatttct

SEQ ID NO: 1005875 - DNA, 22 bp, Artificial Sequence
  chemically synthesized
ggaatcaagagaaatatgggat

SEQ ID NO: 1005876 - DNA, 22 bp, Artificial Sequence
  chemically synthesized
ctctatctttccatcccatatt

SEQ ID NO: 1005877 - DNA, 22 bp, Artificial Sequence
  chemically synthesized
gaatcaagagaaatatgggatg

SEQ ID NO: 1005878 - DNA, 22 bp, Artificial Sequence
  chemically synthesized
aataactcctctatctttccat

SEQ ID NO: 1005879 - DNA, 22 bp, Artificial Sequence
  chemically synthesized
gttgaataactcctctatcttt

SEQ ID NO: 1005880 - DNA, 22 bp, Artificial Sequence
  chemically synthesized
agttgaataactcctctatctt

SEQ ID NO: 1005881 - DNA, 22 bp, Artificial Sequence
  chemically synthesized
tagttgaataactcctctatct

SEQ ID NO: 1005882 - DNA, 22 bp, Artificial Sequence
  chemically synthesized
ccatctttagttgaataactcc

SEQ ID NO: 1005883 - DNA, 22 bp, Artificial Sequence
  chemically synthesized
actgccatctttagttgaataa

SEQ ID NO: 1005884 - DNA, 22 bp, Artificial Sequence
  chemically synthesized
aactgccatctttagttgaata

SEQ ID NO: 1005885 - DNA, 22 bp, Artificial Sequence
  chemically synthesized
cggacttaactgccatctttag

SEQ ID NO: 1005886 - DNA, 22 bp, Artificial Sequence
  chemically synthesized
tacggacttaactgccatcttt

SEQ ID NO: 1005887 - DNA, 22 bp, Artificial Sequence
  chemically synthesized
ctacggacttaactgccatctt

SEQ ID NO: 1005888 - DNA, 22 bp, Artificial Sequence
  chemically synthesized
ttcaactaaagatggcagttaa

SEQ ID NO: 1005889 - DNA, 22 bp, Artificial Sequence
  chemically synthesized
aactaaagatggcagttaagtc

SEQ ID NO: 1005890 - DNA, 22 bp, Artificial Sequence
  chemically synthesized
aagatggcagttaagtccgtag

SEQ ID NO: 1005891 - DNA, 22 bp, Artificial Sequence
  chemically synthesized
ggtgatagcatccatttctacg

SEQ ID NO: 1005892 - DNA, 22 bp, Artificial Sequence
  chemically synthesized
ctaggtgatagcatccatttct

SEQ ID NO: 1005893 - DNA, 22 bp, Artificial Sequence
  chemically synthesized
ctcctaggtgatagcatccatt

SEQ ID NO: 1005894 - DNA, 22 bp, Artificial Sequence
  chemically synthesized
agtccgtagaaatggatgctat

SEQ ID NO: 1005895 - DNA, 22 bp, Artificial Sequence
  chemically synthesized
tcctcctaggtgatagcatcca

SEQ ID NO: 1005896 - DNA, 22 bp, Artificial Sequence
  chemically synthesized
gctctcctcctaggtgatagca

SEQ ID NO: 1005897 - DNA, 22 bp, Artificial Sequence
  chemically synthesized
cgctctcctcctaggtgatagc

SEQ ID NO: 1005898 - DNA, 22 bp, Artificial Sequence
  chemically synthesized
gtttcgctctcctcctaggtga

SEQ ID NO: 1005899 - DNA, 22 bp, Artificial Sequence
  chemically synthesized
tggtttcgctctcctcctaggt

SEQ ID NO: 1005900 - DNA, 22 bp, Artificial Sequence
  chemically synthesized
ctggtttcgctctcctcctagg

SEQ ID NO: 1005901 - DNA, 22 bp, Artificial Sequence
  chemically synthesized
gggtttctggtttcgctctcct

SEQ ID NO: 1005902 - DNA, 22 bp, Artificial Sequence
  chemically synthesized
tcacctaggaggagagcgaaac

SEQ ID NO: 1005903 - DNA, 22 bp, Artificial Sequence
  chemically synthesized
aatcctagggtttctggtttcg

SEQ ID NO: 1005904 - DNA, 22 bp, Artificial Sequence
  chemically synthesized
caatcctagggtttctggtttc

SEQ ID NO: 1005905 - DNA, 22 bp, Artificial Sequence
  chemically synthesized
ggaggagagcgaaaccagaaac

SEQ ID NO: 1005906 - DNA, 22 bp, Artificial Sequence
  chemically synthesized
taccttcaatcctagggtttct

SEQ ID NO: 1005907 - DNA, 22 bp, Artificial Sequence
  chemically synthesized
agactataccttcaatcctagg

SEQ ID NO: 1005908 - DNA, 22 bp, Artificial Sequence
  chemically synthesized
gagactataccttcaatcctag

SEQ ID NO: 1005909 - DNA, 22 bp, Artificial Sequence
  chemically synthesized
ggattgaaggtatagtctcaaa

SEQ ID NO: 1005910 - DNA, 22 bp, Artificial Sequence
  chemically synthesized
aaggtatagtctcaaactgtga

SEQ ID NO: 1005911 - DNA, 22 bp, Artificial Sequence
  chemically synthesized
ggaggtaggtatgtcacagttt

SEQ ID NO: 1005912 - DNA, 22 bp, Artificial Sequence
  chemically synthesized
ctcggaggtaggtatgtcacag

SEQ ID NO: 1005913 - DNA, 22 bp, Artificial Sequence
  chemically synthesized
caaattcctcggaggtaggtat

SEQ ID NO: 1005914 - DNA, 22 bp, Artificial Sequence
  chemically synthesized
aaactgtgacatacctacctcc

SEQ ID NO: 1005915 - DNA, 22 bp, Artificial Sequence
  chemically synthesized
ttccaaattcctcggaggtagg

SEQ ID NO: 1005916 - DNA, 22 bp, Artificial Sequence
  chemically synthesized
tgacatacctacctccgaggaa

SEQ ID NO: 1005917 - DNA, 22 bp, Artificial Sequence
  chemically synthesized
tgtcccagtgagttgttccaaa

SEQ ID NO: 1005918 - DNA, 22 bp, Artificial Sequence
  chemically synthesized
cctccgaggaatttggaacaac

SEQ ID NO: 1005919 - DNA, 22 bp, Artificial Sequence
  chemically synthesized
gtgtcccagtgagttgttccaa

SEQ ID NO: 1005920 - DNA, 22 bp, Artificial Sequence
  chemically synthesized
tgtgtcccagtgagttgttcca

SEQ ID NO: 1005921 - DNA, 22 bp, Artificial Sequence
  chemically synthesized
ttgtgtcccagtgagttgttcc

SEQ ID NO: 1005922 - DNA, 22 bp, Artificial Sequence
  chemically synthesized
cgaggaatttggaacaactcac

SEQ ID NO: 1005923 - DNA, 22 bp, Artificial Sequence
  chemically synthesized
ttttgtgtcccagtgagttgtt

SEQ ID NO: 1005924 - DNA, 22 bp, Artificial Sequence
  chemically synthesized
cttttgtgtcccagtgagttgt

SEQ ID NO: 1005925 - DNA, 22 bp, Artificial Sequence
  chemically synthesized
tcttttgtgtcccagtgagttg

SEQ ID NO: 1005926 - DNA, 22 bp, Artificial Sequence
  chemically synthesized
acagttttcttttgtgtcccag

SEQ ID NO: 1005927 - DNA, 22 bp, Artificial Sequence
  chemically synthesized
ggaacaactcactgggacacaa

SEQ ID NO: 1005928 - DNA, 22 bp, Artificial Sequence
  chemically synthesized
gaacaactcactgggacacaaa

SEQ ID NO: 1005929 - DNA, 22 bp, Artificial Sequence
  chemically synthesized
actgggacacaaaagaaaactg

SEQ ID NO: 1005930 - DNA, 22 bp, Artificial Sequence
  chemically synthesized
ggacacaaaagaaaactgtgaa

SEQ ID NO: 1005931 - DNA, 22 bp, Artificial Sequence
  chemically synthesized
tgaatgcttctatttgtgtttg

SEQ ID NO: 1005932 - DNA, 22 bp, Artificial Sequence
  chemically synthesized
ctatttgtgtttgcatttatat

SEQ ID NO: 1005933 - DNA, 22 bp, Artificial Sequence
  chemically synthesized
tatttgtgtttgcatttatatt

SEQ ID NO: 1005934 - DNA, 22 bp, Artificial Sequence
  chemically synthesized
tttgtgtttgcatttatattta

SEQ ID NO: 1005935 - DNA, 22 bp, Artificial Sequence
  chemically synthesized
gtgtttgcatttatatttattg

SEQ ID NO: 1005936 - DNA, 22 bp, Artificial Sequence
  chemically synthesized
tgtttgcatttatatttattga

SEQ ID NO: 1005937 - DNA, 22 bp, Artificial Sequence
  chemically synthesized
gcatttatatttattgatttct

SEQ ID NO: 1005938 - DNA, 22 bp, Artificial Sequence
  chemically synthesized
catttatatttattgatttcta

SEQ ID NO: 1005939 - DNA, 22 bp, Artificial Sequence
  chemically synthesized
atatttattgatttctattttc

SEQ ID NO: 1005940 - DNA, 22 bp, Artificial Sequence
  chemically synthesized
tatttattgatttctattttca

SEQ ID NO: 1005941 - DNA, 22 bp, Artificial Sequence
  chemically synthesized
agcatgtaaacgtatgtgaaaa

SEQ ID NO: 1005942 - DNA, 22 bp, Artificial Sequence
  chemically synthesized
attgatttctattttcacatac

SEQ ID NO: 1005943 - DNA, 22 bp, Artificial Sequence
  chemically synthesized
ttgatttctattttcacatacg

SEQ ID NO: 1005944 - DNA, 22 bp, Artificial Sequence
  chemically synthesized
atttctattttcacatacgttt

SEQ ID NO: 1005945 - DNA, 22 bp, Artificial Sequence
  chemically synthesized
ctattttcacatacgtttacat

SEQ ID NO: 1005946 - DNA, 22 bp, Artificial Sequence
  chemically synthesized
tattttcacatacgtttacatg

SEQ ID NO: 1005947 - DNA, 22 bp, Artificial Sequence
  chemically synthesized
ttttcacatacgtttacatgct

SEQ ID NO: 1005948 - DNA, 22 bp, Artificial Sequence
  chemically synthesized
tcacatacgtttacatgcttag

SEQ ID NO: 1005949 - DNA, 22 bp, Artificial Sequence
  chemically synthesized
cacatacgtttacatgcttagt

SEQ ID NO: 1005950 - DNA, 22 bp, Artificial Sequence
  chemically synthesized
acatacgtttacatgcttagtc

SEQ ID NO: 1005951 - DNA, 22 bp, Artificial Sequence
  chemically synthesized
taaatcatatatgaatatgact

SEQ ID NO: 1005952 - DNA, 22 bp, Artificial Sequence
  chemically synthesized
gtaaatcatatatgaatatgac

SEQ ID NO: 1005953 - DNA, 22 bp, Artificial Sequence
  chemically synthesized
acatgcttagtcatattcatat

SEQ ID NO: 1005954 - DNA, 22 bp, Artificial Sequence
  chemically synthesized
tttgtaaatcatatatgaatat

SEQ ID NO: 1005955 - DNA, 22 bp, Artificial Sequence
  chemically synthesized
catgcttagtcatattcatata

SEQ ID NO: 1005956 - DNA, 22 bp, Artificial Sequence
  chemically synthesized
atttgtaaatcatatatgaata

SEQ ID NO: 1005957 - DNA, 22 bp, Artificial Sequence
  chemically synthesized
agtcatattcatatatgattta

SEQ ID NO: 1005958 - DNA, 22 bp, Artificial Sequence
  chemically synthesized
gtcatattcatatatgatttac

SEQ ID NO: 1005959 - DNA, 22 bp, Artificial Sequence
  chemically synthesized
atatatgatttacaaataaatg

SEQ ID NO: 1005960 - DNA, 22 bp, Artificial Sequence
  chemically synthesized
ccacaaaatgtacatttatttg

SEQ ID NO: 1005961 - DNA, 22 bp, Artificial Sequence
  chemically synthesized
cccacaaaatgtacatttattt

SEQ ID NO: 1005962 - DNA, 22 bp, Artificial Sequence
  chemically synthesized
ttcccacaaaatgtacatttat

SEQ ID NO: 1005963 - DNA, 22 bp, Artificial Sequence
  chemically synthesized
cttcccacaaaatgtacattta

SEQ ID NO: 1005964 - DNA, 22 bp, Artificial Sequence
  chemically synthesized
acaaataaatgtacattttgtg

SEQ ID NO: 1005965 - DNA, 22 bp, Artificial Sequence
  chemically synthesized
caaataaatgtacattttgtgg

SEQ ID NO: 1005966 - DNA, 22 bp, Artificial Sequence
  chemically synthesized
taagcacatttcttcccacaaa

SEQ ID NO: 1005967 - DNA, 22 bp, Artificial Sequence
  chemically synthesized
ataagcacatttcttcccacaa

SEQ ID NO: 1005968 - DNA, 22 bp, Artificial Sequence
  chemically synthesized
aaacaaaacttataagcacatt

SEQ ID NO: 1005969 - DNA, 22 bp, Artificial Sequence
  chemically synthesized
tgtgggaagaaatgtgcttata

SEQ ID NO: 1005970 - DNA, 22 bp, Artificial Sequence
  chemically synthesized
gtgggaagaaatgtgcttataa

SEQ ID NO: 1005971 - DNA, 22 bp, Artificial Sequence
  chemically synthesized
tgggaagaaatgtgcttataag

SEQ ID NO: 1005972 - DNA, 22 bp, Artificial Sequence
  chemically synthesized
attgaaacaaaacttataagca

SEQ ID NO: 1005973 - DNA, 22 bp, Artificial Sequence
  chemically synthesized
taattgaaacaaaacttataag

SEQ ID NO: 1005974 - DNA, 22 bp, Artificial Sequence
  chemically synthesized
ctaattgaaacaaaacttataa

SEQ ID NO: 1005975 - DNA, 22 bp, Artificial Sequence
  chemically synthesized
tctaattgaaacaaaacttata

SEQ ID NO: 1005976 - DNA, 22 bp, Artificial Sequence
  chemically synthesized
ctttctaattgaaacaaaactt

SEQ ID NO: 1005977 - DNA, 22 bp, Artificial Sequence
  chemically synthesized
aagactgctttctaattgaaac

SEQ ID NO: 1005978 - DNA, 22 bp, Artificial Sequence
  chemically synthesized
caagactgctttctaattgaaa

SEQ ID NO: 1005979 - DNA, 22 bp, Artificial Sequence
  chemically synthesized
ataagttttgtttcaattagaa

SEQ ID NO: 1005980 - DNA, 22 bp, Artificial Sequence
  chemically synthesized
taagttttgtttcaattagaaa

SEQ ID NO: 1005981 - DNA, 22 bp, Artificial Sequence
  chemically synthesized
aaaatttcaagactgctttcta

SEQ ID NO: 1005982 - DNA, 22 bp, Artificial Sequence
  chemically synthesized
caaaatttcaagactgctttct

SEQ ID NO: 1005983 - DNA, 22 bp, Artificial Sequence
  chemically synthesized
tgtttcaattagaaagcagtct

SEQ ID NO: 1005984 - DNA, 22 bp, Artificial Sequence
  chemically synthesized
ttcaaaatttcaagactgcttt

SEQ ID NO: 1005985 - DNA, 22 bp, Artificial Sequence
  chemically synthesized
gtttcaattagaaagcagtctt

SEQ ID NO: 1005986 - DNA, 22 bp, Artificial Sequence
  chemically synthesized
tttcaattagaaagcagtcttg

SEQ ID NO: 1005987 - DNA, 22 bp, Artificial Sequence
  chemically synthesized
caattagaaagcagtcttgaaa

SEQ ID NO: 1005988 - DNA, 22 bp, Artificial Sequence
  chemically synthesized
aattagaaagcagtcttgaaat

SEQ ID NO: 1005989 - DNA, 22 bp, Artificial Sequence
  chemically synthesized
gaaagcagtcttgaaattttga

SEQ ID NO: 1005990 - DNA, 22 bp, Artificial Sequence
  chemically synthesized
aggcaatgctcttcaaaatttc

SEQ ID NO: 1005991 - DNA, 22 bp, Artificial Sequence
  chemically synthesized
taaggcaatgctcttcaaaatt

SEQ ID NO: 1005992 - DNA, 22 bp, Artificial Sequence
  chemically synthesized
acctctaaggcaatgctcttca

SEQ ID NO: 1005993 - DNA, 22 bp, Artificial Sequence
  chemically synthesized
gacctctaaggcaatgctcttc

SEQ ID NO: 1005994 - DNA, 22 bp, Artificial Sequence
  chemically synthesized
ttgacctctaaggcaatgctct

SEQ ID NO: 1005995 - DNA, 22 bp, Artificial Sequence
  chemically synthesized
gaaattttgaagagcattgcct

SEQ ID NO: 1005996 - DNA, 22 bp, Artificial Sequence
  chemically synthesized
aaattttgaagagcattgcctt

SEQ ID NO: 1005997 - DNA, 22 bp, Artificial Sequence
  chemically synthesized
cgcctcttgacctctaaggcaa

SEQ ID NO: 1005998 - DNA, 22 bp, Artificial Sequence
  chemically synthesized
tgaagagcattgccttagaggt

SEQ ID NO: 1005999 - DNA, 22 bp, Artificial Sequence
  chemically synthesized
ctccgcctcttgacctctaagg

SEQ ID NO: 1006000 - DNA, 22 bp, Artificial Sequence
  chemically synthesized
gaagagcattgccttagaggtc

SEQ ID NO: 1006001 - DNA, 22 bp, Artificial Sequence
  chemically synthesized
aagagcattgccttagaggtca

SEQ ID NO: 1006002 - DNA, 22 bp, Artificial Sequence
  chemically synthesized
ctcctccgcctcttgacctcta

SEQ ID NO: 1006003 - DNA, 22 bp, Artificial Sequence
  chemically synthesized
gctcctcctccgcctcttgacc

SEQ ID NO: 1006004 - DNA, 22 bp, Artificial Sequence
  chemically synthesized
ctagctcctcctccgcctcttg

SEQ ID NO: 1006005 - DNA, 22 bp, Artificial Sequence
  chemically synthesized
ccttagaggtcaagaggcggag

SEQ ID NO: 1006006 - DNA, 22 bp, Artificial Sequence
  chemically synthesized
tgctagctcctcctccgcctct

SEQ ID NO: 1006007 - DNA, 22 bp, Artificial Sequence
  chemically synthesized
ctgctagctcctcctccgcctc

SEQ ID NO: 1006008 - DNA, 22 bp, Artificial Sequence
  chemically synthesized
agaggtcaagaggcggaggagg

SEQ ID NO: 1006009 - DNA, 22 bp, Artificial Sequence
  chemically synthesized
tttctgctagctcctcctccgc

SEQ ID NO: 1006010 - DNA, 22 bp, Artificial Sequence
  chemically synthesized
gaggtcaagaggcggaggagga

SEQ ID NO: 1006011 - DNA, 22 bp, Artificial Sequence
  chemically synthesized
agctgtttctgctagctcctcc

SEQ ID NO: 1006012 - DNA, 22 bp, Artificial Sequence
  chemically synthesized
cagctgtttctgctagctcctc

SEQ ID NO: 1006013 - DNA, 22 bp, Artificial Sequence
  chemically synthesized
tcagctgtttctgctagctcct

SEQ ID NO: 1006014 - DNA, 22 bp, Artificial Sequence
  chemically synthesized
ttcagctgtttctgctagctcc

SEQ ID NO: 1006015 - DNA, 22 bp, Artificial Sequence
  chemically synthesized
ttttcagctgtttctgctagct

SEQ ID NO: 1006016 - DNA, 22 bp, Artificial Sequence
  chemically synthesized
cttttcagctgtttctgctagc

SEQ ID NO: 1006017 - DNA, 22 bp, Artificial Sequence
  chemically synthesized
gcttcttttcagctgtttctgc

SEQ ID NO: 1006018 - DNA, 22 bp, Artificial Sequence
  chemically synthesized
actggcttcttttcagctgttt

SEQ ID NO: 1006019 - DNA, 22 bp, Artificial Sequence
  chemically synthesized
aagctcactggcttcttttcag

SEQ ID NO: 1006020 - DNA, 22 bp, Artificial Sequence
  chemically synthesized
gcagaaacagctgaaaagaagc

SEQ ID NO: 1006021 - DNA, 22 bp, Artificial Sequence
  chemically synthesized
ttgaagctcactggcttctttt

SEQ ID NO: 1006022 - DNA, 22 bp, Artificial Sequence
  chemically synthesized
tgttgaagctcactggcttctt

SEQ ID NO: 1006023 - DNA, 22 bp, Artificial Sequence
  chemically synthesized
ctgttgaagctcactggcttct

SEQ ID NO: 1006024 - DNA, 22 bp, Artificial Sequence
  chemically synthesized
aaaagaagccagtgagcttcaa

SEQ ID NO: 1006025 - DNA, 22 bp, Artificial Sequence
  chemically synthesized
aaacaataacttctgttgaagc

SEQ ID NO: 1006026 - DNA, 22 bp, Artificial Sequence
  chemically synthesized
gaaacaataacttctgttgaag

SEQ ID NO: 1006027 - DNA, 22 bp, Artificial Sequence
  chemically synthesized
ttgaaacaataacttctgttga

SEQ ID NO: 1006028 - DNA, 22 bp, Artificial Sequence
  chemically synthesized
cttgaaacaataacttctgttg

SEQ ID NO: 1006029 - DNA, 22 bp, Artificial Sequence
  chemically synthesized
ttcttgaaacaataacttctgt

SEQ ID NO: 1006030 - DNA, 22 bp, Artificial Sequence
  chemically synthesized
cttcttgaaacaataacttctg

SEQ ID NO: 1006031 - DNA, 22 bp, Artificial Sequence
  chemically synthesized
tcttcttgaaacaataacttct

SEQ ID NO: 1006032 - DNA, 22 bp, Artificial Sequence
  chemically synthesized
cctttcttcttgaaacaataac

SEQ ID NO: 1006033 - DNA, 22 bp, Artificial Sequence
  chemically synthesized
caacagaagttattgtttcaag

SEQ ID NO: 1006034 - DNA, 22 bp, Artificial Sequence
  chemically synthesized
aacagaagttattgtttcaaga

SEQ ID NO: 1006035 - DNA, 22 bp, Artificial Sequence
  chemically synthesized
ttgtttcaagaagaaagggagt

SEQ ID NO: 1006036 - DNA, 22 bp, Artificial Sequence
  chemically synthesized
tttcaagaagaaagggagtatt

SEQ ID NO: 1006037 - DNA, 22 bp, Artificial Sequence
  chemically synthesized
caagaagaaagggagtattctg

SEQ ID NO: 1006038 - DNA, 22 bp, Artificial Sequence
  chemically synthesized
aagaagaaagggagtattctgt

SEQ ID NO: 1006039 - DNA, 22 bp, Artificial Sequence
  chemically synthesized
cacagatagaaagagggaacaa

SEQ ID NO: 1006040 - DNA, 22 bp, Artificial Sequence
  chemically synthesized
ccacaactgcacagatagaaag

SEQ ID NO: 1006041 - DNA, 22 bp, Artificial Sequence
  chemically synthesized
tgttgttccctctttctatctg

SEQ ID NO: 1006042 - DNA, 22 bp, Artificial Sequence
  chemically synthesized
cccacaactgcacagatagaaa

SEQ ID NO: 1006043 - DNA, 22 bp, Artificial Sequence
  chemically synthesized
ttgttccctctttctatctgtg

SEQ ID NO: 1006044 - DNA, 22 bp, Artificial Sequence
  chemically synthesized
ttccctctttctatctgtgcag

SEQ ID NO: 1006045 - DNA, 22 bp, Artificial Sequence
  chemically synthesized
acatttcccacaactgcacaga

SEQ ID NO: 1006046 - DNA, 22 bp, Artificial Sequence
  chemically synthesized
cctctttctatctgtgcagttg

SEQ ID NO: 1006047 - DNA, 22 bp, Artificial Sequence
  chemically synthesized
tttctatctgtgcagttgtggg

SEQ ID NO: 1006048 - DNA, 22 bp, Artificial Sequence
  chemically synthesized
tgagttcacatttcccacaact

SEQ ID NO: 1006049 - DNA, 22 bp, Artificial Sequence
  chemically synthesized
tctatctgtgcagttgtgggaa

SEQ ID NO: 1006050 - DNA, 22 bp, Artificial Sequence
  chemically synthesized
ctatctgtgcagttgtgggaaa

SEQ ID NO: 1006051 - DNA, 22 bp, Artificial Sequence
  chemically synthesized
tatctgtgcagttgtgggaaat

SEQ ID NO: 1006052 - DNA, 22 bp, Artificial Sequence
  chemically synthesized
tctgtgcagttgtgggaaatgt

SEQ ID NO: 1006053 - DNA, 22 bp, Artificial Sequence
  chemically synthesized
tgcagttgtgggaaatgtgaac

SEQ ID NO: 1006054 - DNA, 22 bp, Artificial Sequence
  chemically synthesized
tgggaaatgtgaactcatagtt

SEQ ID NO: 1006055 - DNA, 22 bp, Artificial Sequence
  chemically synthesized
gaacaggaccacacgagacaaa

SEQ ID NO: 1006056 - DNA, 22 bp, Artificial Sequence
  chemically synthesized
ggaacaggaccacacgagacaa

SEQ ID NO: 1006057 - DNA, 22 bp, Artificial Sequence
  chemically synthesized
atagtttgtctcgtgtggtcct

SEQ ID NO: 1006058 - DNA, 22 bp, Artificial Sequence
  chemically synthesized
gtctcgtgtggtcctgttccaa

SEQ ID NO: 1006059 - DNA, 22 bp, Artificial Sequence
  chemically synthesized
tctcgtgtggtcctgttccaaa

SEQ ID NO: 1006060 - DNA, 22 bp, Artificial Sequence
  chemically synthesized
cagcaagtatggcatttggaac

SEQ ID NO: 1006061 - DNA, 22 bp, Artificial Sequence
  chemically synthesized
ccagcaagtatggcatttggaa

SEQ ID NO: 1006062 - DNA, 22 bp, Artificial Sequence
  chemically synthesized
gtgtggtcctgttccaaatgcc

SEQ ID NO: 1006063 - DNA, 22 bp, Artificial Sequence
  chemically synthesized
tttccagcaagtatggcatttg

SEQ ID NO: 1006064 - DNA, 22 bp, Artificial Sequence
  chemically synthesized
tatttccagcaagtatggcatt

SEQ ID NO: 1006065 - DNA, 22 bp, Artificial Sequence
  chemically synthesized
cactctatttccagcaagtatg

SEQ ID NO: 1006066 - DNA, 22 bp, Artificial Sequence
  chemically synthesized
ttccaaatgccatacttgctgg

SEQ ID NO: 1006067 - DNA, 22 bp, Artificial Sequence
  chemically synthesized
tgcactctatttccagcaagta

SEQ ID NO: 1006068 - DNA, 22 bp, Artificial Sequence
  chemically synthesized
caaatgccatacttgctggaaa

SEQ ID NO: 1006069 - DNA, 22 bp, Artificial Sequence
  chemically synthesized
tggatgctctgcactctatttc

SEQ ID NO: 1006070 - DNA, 22 bp, Artificial Sequence
  chemically synthesized
atggatgctctgcactctattt

SEQ ID NO: 1006071 - DNA, 22 bp, Artificial Sequence
  chemically synthesized
tatggatgctctgcactctatt

SEQ ID NO: 1006072 - DNA, 22 bp, Artificial Sequence
  chemically synthesized
ttttatggatgctctgcactct

SEQ ID NO: 1006073 - DNA, 22 bp, Artificial Sequence
  chemically synthesized
gctggaaatagagtgcagagca

SEQ ID NO: 1006074 - DNA, 22 bp, Artificial Sequence
  chemically synthesized
ctggaaatagagtgcagagcat

SEQ ID NO: 1006075 - DNA, 22 bp, Artificial Sequence
  chemically synthesized
gaaatagagtgcagagcatcca

SEQ ID NO: 1006076 - DNA, 22 bp, Artificial Sequence
  chemically synthesized
tagactgttttatggatgctct

SEQ ID NO: 1006077 - DNA, 22 bp, Artificial Sequence
  chemically synthesized
atagactgttttatggatgctc

SEQ ID NO: 1006078 - DNA, 22 bp, Artificial Sequence
  chemically synthesized
gtcttatagactgttttatgga

SEQ ID NO: 1006079 - DNA, 22 bp, Artificial Sequence
  chemically synthesized
agtcttatagactgttttatgg

SEQ ID NO: 1006080 - DNA, 22 bp, Artificial Sequence
  chemically synthesized
tatatgcttagtcttatagact

SEQ ID NO: 1006081 - DNA, 22 bp, Artificial Sequence
  chemically synthesized
atatatgcttagtcttatagac

SEQ ID NO: 1006082 - DNA, 22 bp, Artificial Sequence
  chemically synthesized
gcagccttatatatgcttagtc

SEQ ID NO: 1006083 - DNA, 22 bp, Artificial Sequence
  chemically synthesized
ggcagccttatatatgcttagt

SEQ ID NO: 1006084 - DNA, 22 bp, Artificial Sequence
  chemically synthesized
tggcagccttatatatgcttag

SEQ ID NO: 1006085 - DNA, 22 bp, Artificial Sequence
  chemically synthesized
tttggcagccttatatatgctt

SEQ ID NO: 1006086 - DNA, 22 bp, Artificial Sequence
  chemically synthesized
ctttggcagccttatatatgct

SEQ ID NO: 1006087 - DNA, 22 bp, Artificial Sequence
  chemically synthesized
taagactaagcatatataaggc

SEQ ID NO: 1006088 - DNA, 22 bp, Artificial Sequence
  chemically synthesized
agcatatataaggctgccaaag

SEQ ID NO: 1006089 - DNA, 22 bp, Artificial Sequence
  chemically synthesized
ccaaagaagtcatttgttacta

SEQ ID NO: 1006090 - DNA, 22 bp, Artificial Sequence
  chemically synthesized
agaaaatgaatgggaagataga

SEQ ID NO: 1006091 - DNA, 22 bp, Artificial Sequence
  chemically synthesized
gagaaaatgaatgggaagatag

SEQ ID NO: 1006092 - DNA, 22 bp, Artificial Sequence
  chemically synthesized
gttactatctatcttcccattc

SEQ ID NO: 1006093 - DNA, 22 bp, Artificial Sequence
  chemically synthesized
ttactatctatcttcccattca

SEQ ID NO: 1006094 - DNA, 22 bp, Artificial Sequence
  chemically synthesized
gacttgagaaaatgaatgggaa

SEQ ID NO: 1006095 - DNA, 22 bp, Artificial Sequence
  chemically synthesized
ctatctatcttcccattcattt

SEQ ID NO: 1006096 - DNA, 22 bp, Artificial Sequence
  chemically synthesized
tctatcttcccattcattttct

SEQ ID NO: 1006097 - DNA, 22 bp, Artificial Sequence
  chemically synthesized
tcttcccattcattttctcaag

SEQ ID NO: 1006098 - DNA, 22 bp, Artificial Sequence
  chemically synthesized
cccattcattttctcaagtcta

SEQ ID NO: 1006099 - DNA, 22 bp, Artificial Sequence
  chemically synthesized
ccattcattttctcaagtctag

SEQ ID NO: 1006100 - DNA, 22 bp, Artificial Sequence
  chemically synthesized
attttctcaagtctagttcttc

SEQ ID NO: 1006101 - DNA, 22 bp, Artificial Sequence
  chemically synthesized
accacaggccagcagaagaact

SEQ ID NO: 1006102 - DNA, 22 bp, Artificial Sequence
  chemically synthesized
tctcaagtctagttcttctgct

SEQ ID NO: 1006103 - DNA, 22 bp, Artificial Sequence
  chemically synthesized
ctcaagtctagttcttctgctg

SEQ ID NO: 1006104 - DNA, 22 bp, Artificial Sequence
  chemically synthesized
tcaagtctagttcttctgctgg

SEQ ID NO: 1006105 - DNA, 22 bp, Artificial Sequence
  chemically synthesized
aagtctagttcttctgctggcc

SEQ ID NO: 1006106 - DNA, 22 bp, Artificial Sequence
  chemically synthesized
gttcttctgctggcctgtggtt

SEQ ID NO: 1006107 - DNA, 22 bp, Artificial Sequence
  chemically synthesized
agaataaaccccctaaccacag

SEQ ID NO: 1006108 - DNA, 22 bp, Artificial Sequence
  chemically synthesized
ttctgctggcctgtggttaggg

SEQ ID NO: 1006109 - DNA, 22 bp, Artificial Sequence
  chemically synthesized
ctgctggcctgtggttaggggg

SEQ ID NO: 1006110 - DNA, 22 bp, Artificial Sequence
  chemically synthesized
tgctggcctgtggttagggggt

SEQ ID NO: 1006111 - DNA, 22 bp, Artificial Sequence
  chemically synthesized
ctggcctgtggttagggggttt

SEQ ID NO: 1006112 - DNA, 22 bp, Artificial Sequence
  chemically synthesized
gcctgtggttagggggtttatt

SEQ ID NO: 1006113 - DNA, 22 bp, Artificial Sequence
  chemically synthesized
tggttagggggtttattctgag

SEQ ID NO: 1006114 - DNA, 22 bp, Artificial Sequence
  chemically synthesized
aagacacagggaaatactcaga

SEQ ID NO: 1006115 - DNA, 22 bp, Artificial Sequence
  chemically synthesized
aaagacacagggaaatactcag

SEQ ID NO: 1006116 - DNA, 22 bp, Artificial Sequence
  chemically synthesized
gggggtttattctgagtatttc

SEQ ID NO: 1006117 - DNA, 22 bp, Artificial Sequence
  chemically synthesized
taaagacacagggaaatactca

SEQ ID NO: 1006118 - DNA, 22 bp, Artificial Sequence
  chemically synthesized
attctgagtatttccctgtgtc

SEQ ID NO: 1006119 - DNA, 22 bp, Artificial Sequence
  chemically synthesized
ttctgagtatttccctgtgtct

SEQ ID NO: 1006120 - DNA, 22 bp, Artificial Sequence
  chemically synthesized
tgagtatttccctgtgtcttta

SEQ ID NO: 1006121 - DNA, 22 bp, Artificial Sequence
  chemically synthesized
agtatttccctgtgtctttaaa

SEQ ID NO: 1006122 - DNA, 22 bp, Artificial Sequence
  chemically synthesized
ccctgtgtctttaaaacttcac

SEQ ID NO: 1006123 - DNA, 22 bp, Artificial Sequence
  chemically synthesized
cctgtgtctttaaaacttcaca

SEQ ID NO: 1006124 - DNA, 22 bp, Artificial Sequence
  chemically synthesized
tgtctttaaaacttcacattta

SEQ ID NO: 1006125 - DNA, 22 bp, Artificial Sequence
  chemically synthesized
taaaacttcacatttatatttg

SEQ ID NO: 1006126 - DNA, 22 bp, Artificial Sequence
  chemically synthesized
atggaataccatcaaatataaa

SEQ ID NO: 1006127 - DNA, 22 bp, Artificial Sequence
  chemically synthesized
aaaacttcacatttatatttga

SEQ ID NO: 1006128 - DNA, 22 bp, Artificial Sequence
  chemically synthesized
catggaataccatcaaatataa

SEQ ID NO: 1006129 - DNA, 22 bp, Artificial Sequence
  chemically synthesized
aaacttcacatttatatttgat

SEQ ID NO: 1006130 - DNA, 22 bp, Artificial Sequence
  chemically synthesized
cacatttatatttgatggtatt

SEQ ID NO: 1006131 - DNA, 22 bp, Artificial Sequence
  chemically synthesized
atgatttcatggaataccatca

SEQ ID NO: 1006132 - DNA, 22 bp, Artificial Sequence
  chemically synthesized
acatttatatttgatggtattc

SEQ ID NO: 1006133 - DNA, 22 bp, Artificial Sequence
  chemically synthesized
atatttgatggtattccatgaa

SEQ ID NO: 1006134 - DNA, 22 bp, Artificial Sequence
  chemically synthesized
tatttgatggtattccatgaaa

SEQ ID NO: 1006135 - DNA, 22 bp, Artificial Sequence
  chemically synthesized
acaagtaacctgatgatttcat

SEQ ID NO: 1006136 - DNA, 22 bp, Artificial Sequence
  chemically synthesized
gatggtattccatgaaatcatc

SEQ ID NO: 1006137 - DNA, 22 bp, Artificial Sequence
  chemically synthesized
atggtattccatgaaatcatca

SEQ ID NO: 1006138 - DNA, 22 bp, Artificial Sequence
  chemically synthesized
aaacctgacaagtaacctgatg

SEQ ID NO: 1006139 - DNA, 22 bp, Artificial Sequence
  chemically synthesized
gaaacctgacaagtaacctgat

SEQ ID NO: 1006140 - DNA, 22 bp, Artificial Sequence
  chemically synthesized
catgaaatcatcaggttacttg

SEQ ID NO: 1006141 - DNA, 22 bp, Artificial Sequence
  chemically synthesized
atgtaatatttgaaacctgaca

SEQ ID NO: 1006142 - DNA, 22 bp, Artificial Sequence
  chemically synthesized
cttgtcaggtttcaaatattac

SEQ ID NO: 1006143 - DNA, 22 bp, Artificial Sequence
  chemically synthesized
caaaatagttcatgtaatattt

SEQ ID NO: 1006144 - DNA, 22 bp, Artificial Sequence
  chemically synthesized
ccaaaatagttcatgtaatatt

SEQ ID NO: 1006145 - DNA, 22 bp, Artificial Sequence
  chemically synthesized
gtcaggtttcaaatattacatg

SEQ ID NO: 1006146 - DNA, 22 bp, Artificial Sequence
  chemically synthesized
tccaaaatagttcatgtaatat

SEQ ID NO: 1006147 - DNA, 22 bp, Artificial Sequence
  chemically synthesized
tcaggtttcaaatattacatga

SEQ ID NO: 1006148 - DNA, 22 bp, Artificial Sequence
  chemically synthesized
ttccaaaatagttcatgtaata

SEQ ID NO: 1006149 - DNA, 22 bp, Artificial Sequence
  chemically synthesized
tttccaaaatagttcatgtaat

SEQ ID NO: 1006150 - DNA, 22 bp, Artificial Sequence
  chemically synthesized
ttttccaaaatagttcatgtaa

SEQ ID NO: 1006151 - DNA, 22 bp, Artificial Sequence
  chemically synthesized
caaatattacatgaactatttt

SEQ ID NO: 1006152 - DNA, 22 bp, Artificial Sequence
  chemically synthesized
aaatattacatgaactattttg

SEQ ID NO: 1006153 - DNA, 22 bp, Artificial Sequence
  chemically synthesized
aaatgtacatttttttccaaaa

SEQ ID NO: 1006154 - DNA, 22 bp, Artificial Sequence
  chemically synthesized
catgaactattttggaaaaaaa

SEQ ID NO: 1006155 - DNA, 22 bp, Artificial Sequence
  chemically synthesized
ttttggaaaaaaatgtacattt

SEQ ID NO: 1006156 - DNA, 22 bp, Artificial Sequence
  chemically synthesized
gaaatgagcctgaaatgtacat

SEQ ID NO: 1006157 - DNA, 22 bp, Artificial Sequence
  chemically synthesized
tggaaaaaaatgtacatttcag

SEQ ID NO: 1006158 - DNA, 22 bp, Artificial Sequence
  chemically synthesized
ggaaaaaaatgtacatttcagg

SEQ ID NO: 1006159 - DNA, 22 bp, Artificial Sequence
  chemically synthesized
gaaaaaaatgtacatttcaggc

SEQ ID NO: 1006160 - DNA, 22 bp, Artificial Sequence
  chemically synthesized
ggactggaaatgagcctgaaat

SEQ ID NO: 1006161 - DNA, 22 bp, Artificial Sequence
  chemically synthesized
aggactggaaatgagcctgaaa

SEQ ID NO: 1006162 - DNA, 22 bp, Artificial Sequence
  chemically synthesized
tttaggactggaaatgagcctg

SEQ ID NO: 1006163 - DNA, 22 bp, Artificial Sequence
  chemically synthesized
tattgtttaggactggaaatga

SEQ ID NO: 1006164 - DNA, 22 bp, Artificial Sequence
  chemically synthesized
atattgtttaggactggaaatg

SEQ ID NO: 1006165 - DNA, 22 bp, Artificial Sequence
  chemically synthesized
caggctcatttccagtcctaaa

SEQ ID NO: 1006166 - DNA, 22 bp, Artificial Sequence
  chemically synthesized
taatttatattgtttaggactg

SEQ ID NO: 1006167 - DNA, 22 bp, Artificial Sequence
  chemically synthesized
aggctcatttccagtcctaaac

SEQ ID NO: 1006168 - DNA, 22 bp, Artificial Sequence
  chemically synthesized
gctataatttatattgtttagg

SEQ ID NO: 1006169 - DNA, 22 bp, Artificial Sequence
  chemically synthesized
ggctataatttatattgtttag

SEQ ID NO: 1006170 - DNA, 22 bp, Artificial Sequence
  chemically synthesized
atttccagtcctaaacaatata

SEQ ID NO: 1006171 - DNA, 22 bp, Artificial Sequence
  chemically synthesized
ccagtcctaaacaatataaatt

SEQ ID NO: 1006172 - DNA, 22 bp, Artificial Sequence
  chemically synthesized
cagtcctaaacaatataaatta

SEQ ID NO: 1006173 - DNA, 22 bp, Artificial Sequence
  chemically synthesized
aatgccatacttggctataatt

SEQ ID NO: 1006174 - DNA, 22 bp, Artificial Sequence
  chemically synthesized
aacaatataaattatagccaag

SEQ ID NO: 1006175 - DNA, 22 bp, Artificial Sequence
  chemically synthesized
atggctaaatgccatacttggc

SEQ ID NO: 1006176 - DNA, 22 bp, Artificial Sequence
  chemically synthesized
tagccaagtatggcatttagcc

SEQ ID NO: 1006177 - DNA, 22 bp, Artificial Sequence
  chemically synthesized
aagtgaaagacagcattaatgg

SEQ ID NO: 1006178 - DNA, 22 bp, Artificial Sequence
  chemically synthesized
ctgaagtgaaagacagcattaa

SEQ ID NO: 1006179 - DNA, 22 bp, Artificial Sequence
  chemically synthesized
cattactgaagtgaaagacagc

SEQ ID NO: 1006180 - DNA, 22 bp, Artificial Sequence
  chemically synthesized
acattactgaagtgaaagacag

SEQ ID NO: 1006181 - DNA, 22 bp, Artificial Sequence
  chemically synthesized
agccattaatgctgtctttcac

SEQ ID NO: 1006182 - DNA, 22 bp, Artificial Sequence
  chemically synthesized
tacattactgaagtgaaagaca

SEQ ID NO: 1006183 - DNA, 22 bp, Artificial Sequence
  chemically synthesized
gccattaatgctgtctttcact

SEQ ID NO: 1006184 - DNA, 22 bp, Artificial Sequence
  chemically synthesized
tttacattactgaagtgaaaga

SEQ ID NO: 1006185 - DNA, 22 bp, Artificial Sequence
  chemically synthesized
ctttacattactgaagtgaaag

SEQ ID NO: 1006186 - DNA, 22 bp, Artificial Sequence
  chemically synthesized
tttctttacattactgaagtga

SEQ ID NO: 1006187 - DNA, 22 bp, Artificial Sequence
  chemically synthesized
atgctgtctttcacttcagtaa

SEQ ID NO: 1006188 - DNA, 22 bp, Artificial Sequence
  chemically synthesized
ttatttctttacattactgaag

SEQ ID NO: 1006189 - DNA, 22 bp, Artificial Sequence
  chemically synthesized
tctttcacttcagtaatgtaaa

SEQ ID NO: 1006190 - DNA, 22 bp, Artificial Sequence
  chemically synthesized
tcacttcagtaatgtaaagaaa

SEQ ID NO: 1006191 - DNA, 22 bp, Artificial Sequence
  chemically synthesized
cacttcagtaatgtaaagaaat

SEQ ID NO: 1006192 - DNA, 22 bp, Artificial Sequence
  chemically synthesized
acttcagtaatgtaaagaaata

SEQ ID NO: 1006193 - DNA, 22 bp, Artificial Sequence
  chemically synthesized
tcataagcctattatttcttta

SEQ ID NO: 1006194 - DNA, 22 bp, Artificial Sequence
  chemically synthesized
cagtaatgtaaagaaataatag

SEQ ID NO: 1006195 - DNA, 22 bp, Artificial Sequence
  chemically synthesized
agtaatgtaaagaaataatagg

SEQ ID NO: 1006196 - DNA, 22 bp, Artificial Sequence
  chemically synthesized
tccaagttgtcataagcctatt

SEQ ID NO: 1006197 - DNA, 22 bp, Artificial Sequence
  chemically synthesized
aatgtattatccaagttgtcat

SEQ ID NO: 1006198 - DNA, 22 bp, Artificial Sequence
  chemically synthesized
aaatgtattatccaagttgtca

SEQ ID NO: 1006199 - DNA, 22 bp, Artificial Sequence
  chemically synthesized
atgacaacttggataatacatt

SEQ ID NO: 1006200 - DNA, 22 bp, Artificial Sequence
  chemically synthesized
tgacaacttggataatacattt

SEQ ID NO: 1006201 - DNA, 22 bp, Artificial Sequence
  chemically synthesized
gagcaataatgtagaagcttaa

SEQ ID NO: 1006202 - DNA, 22 bp, Artificial Sequence
  chemically synthesized
ggataatacatttaagcttcta

SEQ ID NO: 1006203 - DNA, 22 bp, Artificial Sequence
  chemically synthesized
gataatacatttaagcttctac

SEQ ID NO: 1006204 - DNA, 22 bp, Artificial Sequence
  chemically synthesized
tatctggagcaataatgtagaa

SEQ ID NO: 1006205 - DNA, 22 bp, Artificial Sequence
  chemically synthesized
atatctggagcaataatgtaga

SEQ ID NO: 1006206 - DNA, 22 bp, Artificial Sequence
  chemically synthesized
tatatctggagcaataatgtag

SEQ ID NO: 1006207 - DNA, 22 bp, Artificial Sequence
  chemically synthesized
ttatatctggagcaataatgta

SEQ ID NO: 1006208 - DNA, 22 bp, Artificial Sequence
  chemically synthesized
tttatatctggagcaataatgt

SEQ ID NO: 1006209 - DNA, 22 bp, Artificial Sequence
  chemically synthesized
ttttatatctggagcaataatg

SEQ ID NO: 1006210 - DNA, 22 bp, Artificial Sequence
  chemically synthesized
tttttatatctggagcaataat

SEQ ID NO: 1006211 - DNA, 22 bp, Artificial Sequence
  chemically synthesized
aagcttctacattattgctcca

SEQ ID NO: 1006212 - DNA, 22 bp, Artificial Sequence
  chemically synthesized
agcttctacattattgctccag

SEQ ID NO: 1006213 - DNA, 22 bp, Artificial Sequence
  chemically synthesized
ctacattattgctccagatata

SEQ ID NO: 1006214 - DNA, 22 bp, Artificial Sequence
  chemically synthesized
tacattattgctccagatataa

SEQ ID NO: 1006215 - DNA, 22 bp, Artificial Sequence
  chemically synthesized
cattattgctccagatataaaa

SEQ ID NO: 1006216 - DNA, 22 bp, Artificial Sequence
  chemically synthesized
tgaagtgaaaaattttttttat

SEQ ID NO: 1006217 - DNA, 22 bp, Artificial Sequence
  chemically synthesized
ttgctccagatataaaaaaaat

SEQ ID NO: 1006218 - DNA, 22 bp, Artificial Sequence
  chemically synthesized
tgtgaagtgaaaaatttttttt

SEQ ID NO: 1006219 - DNA, 22 bp, Artificial Sequence
  chemically synthesized
ctccagatataaaaaaaatttt

SEQ ID NO: 1006220 - DNA, 22 bp, Artificial Sequence
  chemically synthesized
cagatataaaaaaaatttttca

SEQ ID NO: 1006221 - DNA, 22 bp, Artificial Sequence
  chemically synthesized
aaggtagaacctctgtgaagtg

SEQ ID NO: 1006222 - DNA, 22 bp, Artificial Sequence
  chemically synthesized
caaggtagaacctctgtgaagt

SEQ ID NO: 1006223 - DNA, 22 bp, Artificial Sequence
  chemically synthesized
ttcaaggtagaacctctgtgaa

SEQ ID NO: 1006224 - DNA, 22 bp, Artificial Sequence
  chemically synthesized
cttcaaggtagaacctctgtga

SEQ ID NO: 1006225 - DNA, 22 bp, Artificial Sequence
  chemically synthesized
tcttcaaggtagaacctctgtg

SEQ ID NO: 1006226 - DNA, 22 bp, Artificial Sequence
  chemically synthesized
tttcttcaaggtagaacctctg

SEQ ID NO: 1006227 - DNA, 22 bp, Artificial Sequence
  chemically synthesized
ctttcttcaaggtagaacctct

SEQ ID NO: 1006228 - DNA, 22 bp, Artificial Sequence
  chemically synthesized
tctttcttcaaggtagaacctc

SEQ ID NO: 1006229 - DNA, 22 bp, Artificial Sequence
  chemically synthesized
ttcacttcacagaggttctacc

SEQ ID NO: 1006230 - DNA, 22 bp, Artificial Sequence
  chemically synthesized
tcacttcacagaggttctacct

SEQ ID NO: 1006231 - DNA, 22 bp, Artificial Sequence
  chemically synthesized
cacttcacagaggttctacctt

SEQ ID NO: 1006232 - DNA, 22 bp, Artificial Sequence
  chemically synthesized
acttcacagaggttctaccttg

SEQ ID NO: 1006233 - DNA, 22 bp, Artificial Sequence
  chemically synthesized
gttttctttcttcaaggtagaa

SEQ ID NO: 1006234 - DNA, 22 bp, Artificial Sequence
  chemically synthesized
cacagaggttctaccttgaaga

SEQ ID NO: 1006235 - DNA, 22 bp, Artificial Sequence
  chemically synthesized
acagaggttctaccttgaagaa

SEQ ID NO: 1006236 - DNA, 22 bp, Artificial Sequence
  chemically synthesized
gagcctggttttctttcttcaa

SEQ ID NO: 1006237 - DNA, 22 bp, Artificial Sequence
  chemically synthesized
tatctggagcctggttttcttt

SEQ ID NO: 1006238 - DNA, 22 bp, Artificial Sequence
  chemically synthesized
atatctggagcctggttttctt

SEQ ID NO: 1006239 - DNA, 22 bp, Artificial Sequence
  chemically synthesized
taccttgaagaaagaaaaccag

SEQ ID NO: 1006240 - DNA, 22 bp, Artificial Sequence
  chemically synthesized
ccttgaagaaagaaaaccaggc

SEQ ID NO: 1006241 - DNA, 22 bp, Artificial Sequence
  chemically synthesized
aggcttatatctggagcctggt

SEQ ID NO: 1006242 - DNA, 22 bp, Artificial Sequence
  chemically synthesized
gaagaaagaaaaccaggctcca

SEQ ID NO: 1006243 - DNA, 22 bp, Artificial Sequence
  chemically synthesized
caggcttatatctggagcctgg

SEQ ID NO: 1006244 - DNA, 22 bp, Artificial Sequence
  chemically synthesized
aagaaagaaaaccaggctccag

SEQ ID NO: 1006245 - DNA, 22 bp, Artificial Sequence
  chemically synthesized
aggaaagtttcaggcttatatc

SEQ ID NO: 1006246 - DNA, 22 bp, Artificial Sequence
  chemically synthesized
cagatataagcctgaaactttc

SEQ ID NO: 1006247 - DNA, 22 bp, Artificial Sequence
  chemically synthesized
gcaaaagtcagaaactcaggaa

SEQ ID NO: 1006248 - DNA, 22 bp, Artificial Sequence
  chemically synthesized
aaactttcctgagtttctgact

SEQ ID NO: 1006249 - DNA, 22 bp, Artificial Sequence
  chemically synthesized
tcctgagtttctgacttttgcc

SEQ ID NO: 1006250 - DNA, 22 bp, Artificial Sequence
  chemically synthesized
cctgagtttctgacttttgcca

SEQ ID NO: 1006251 - DNA, 22 bp, Artificial Sequence
  chemically synthesized
ctgagtttctgacttttgccag

SEQ ID NO: 1006252 - DNA, 22 bp, Artificial Sequence
  chemically synthesized
gtgtgatgaaatggctggcaaa

SEQ ID NO: 1006253 - DNA, 22 bp, Artificial Sequence
  chemically synthesized
agtttctgacttttgccagcca

SEQ ID NO: 1006254 - DNA, 22 bp, Artificial Sequence
  chemically synthesized
ttagtgtgatgaaatggctggc

SEQ ID NO: 1006255 - DNA, 22 bp, Artificial Sequence
  chemically synthesized
ctgacttttgccagccatttca

SEQ ID NO: 1006256 - DNA, 22 bp, Artificial Sequence
  chemically synthesized
tgacttttgccagccatttcat

SEQ ID NO: 1006257 - DNA, 22 bp, Artificial Sequence
  chemically synthesized
tgttgttagtgtgatgaaatgg

SEQ ID NO: 1006258 - DNA, 22 bp, Artificial Sequence
  chemically synthesized
acttttgccagccatttcatca

SEQ ID NO: 1006259 - DNA, 22 bp, Artificial Sequence
  chemically synthesized
atgttgttagtgtgatgaaatg

SEQ ID NO: 1006260 - DNA, 22 bp, Artificial Sequence
  chemically synthesized
ttgccagccatttcatcacact

SEQ ID NO: 1006261 - DNA, 22 bp, Artificial Sequence
  chemically synthesized
tgccagccatttcatcacacta

SEQ ID NO: 1006262 - DNA, 22 bp, Artificial Sequence
  chemically synthesized
gccagccatttcatcacactaa

SEQ ID NO: 1006263 - DNA, 22 bp, Artificial Sequence
  chemically synthesized
aggtttatgttgttagtgtgat

SEQ ID NO: 1006264 - DNA, 22 bp, Artificial Sequence
  chemically synthesized
ccagccatttcatcacactaac

SEQ ID NO: 1006265 - DNA, 22 bp, Artificial Sequence
  chemically synthesized
aaggtttatgttgttagtgtga

SEQ ID NO: 1006266 - DNA, 22 bp, Artificial Sequence
  chemically synthesized
tttaaggtttatgttgttagtg

SEQ ID NO: 1006267 - DNA, 22 bp, Artificial Sequence
  chemically synthesized
actatttaaggtttatgttgtt

SEQ ID NO: 1006268 - DNA, 22 bp, Artificial Sequence
  chemically synthesized
aactatttaaggtttatgttgt

SEQ ID NO: 1006269 - DNA, 22 bp, Artificial Sequence
  chemically synthesized
taactatttaaggtttatgttg

SEQ ID NO: 1006270 - DNA, 22 bp, Artificial Sequence
  chemically synthesized
catcacactaacaacataaacc

SEQ ID NO: 1006271 - DNA, 22 bp, Artificial Sequence
  chemically synthesized
atcacactaacaacataaacct

SEQ ID NO: 1006272 - DNA, 22 bp, Artificial Sequence
  chemically synthesized
ttttaactatttaaggtttatg

SEQ ID NO: 1006273 - DNA, 22 bp, Artificial Sequence
  chemically synthesized
gttttaactatttaaggtttat

SEQ ID NO: 1006274 - DNA, 22 bp, Artificial Sequence
  chemically synthesized
catttgttttaactatttaagg

SEQ ID NO: 1006275 - DNA, 22 bp, Artificial Sequence
  chemically synthesized
acatttgttttaactatttaag

SEQ ID NO: 1006276 - DNA, 22 bp, Artificial Sequence
  chemically synthesized
acaacataaaccttaaatagtt

SEQ ID NO: 1006277 - DNA, 22 bp, Artificial Sequence
  chemically synthesized
aaatagttaaaacaaatgtaag

SEQ ID NO: 1006278 - DNA, 22 bp, Artificial Sequence
  chemically synthesized
aatagttaaaacaaatgtaagg

SEQ ID NO: 1006279 - DNA, 22 bp, Artificial Sequence
  chemically synthesized
aatatataacataaatgcctta

SEQ ID NO: 1006280 - DNA, 22 bp, Artificial Sequence
  chemically synthesized
gaatatataacataaatgcctt

SEQ ID NO: 1006281 - DNA, 22 bp, Artificial Sequence
  chemically synthesized
aaacaaatgtaaggcatttatg

SEQ ID NO: 1006282 - DNA, 22 bp, Artificial Sequence
  chemically synthesized
catggtatatccatttgaatat

SEQ ID NO: 1006283 - DNA, 22 bp, Artificial Sequence
  chemically synthesized
ccatggtatatccatttgaata

SEQ ID NO: 1006284 - DNA, 22 bp, Artificial Sequence
  chemically synthesized
tccatggtatatccatttgaat

SEQ ID NO: 1006285 - DNA, 22 bp, Artificial Sequence
  chemically synthesized
ttccatggtatatccatttgaa

SEQ ID NO: 1006286 - DNA, 22 bp, Artificial Sequence
  chemically synthesized
tttccatggtatatccatttga

SEQ ID NO: 1006287 - DNA, 22 bp, Artificial Sequence
  chemically synthesized
atgttatatattcaaatggata

SEQ ID NO: 1006288 - DNA, 22 bp, Artificial Sequence
  chemically synthesized
ttttccatggtatatccatttg

SEQ ID NO: 1006289 - DNA, 22 bp, Artificial Sequence
  chemically synthesized
tgttatatattcaaatggatat

SEQ ID NO: 1006290 - DNA, 22 bp, Artificial Sequence
  chemically synthesized
tttttccatggtatatccattt

SEQ ID NO: 1006291 - DNA, 22 bp, Artificial Sequence
  chemically synthesized
tttttttccatggtatatccat

SEQ ID NO: 1006292 - DNA, 22 bp, Artificial Sequence
  chemically synthesized
tatattcaaatggatataccat

SEQ ID NO: 1006293 - DNA, 22 bp, Artificial Sequence
  chemically synthesized
aaatggatataccatggaaaaa

SEQ ID NO: 1006294 - DNA, 22 bp, Artificial Sequence
  chemically synthesized
agtaataggttctttttttcca

SEQ ID NO: 1006295 - DNA, 22 bp, Artificial Sequence
  chemically synthesized
aatattcagtaataggttcttt

SEQ ID NO: 1006296 - DNA, 22 bp, Artificial Sequence
  chemically synthesized
aagcaaactaaatattcagtaa

SEQ ID NO: 1006297 - DNA, 22 bp, Artificial Sequence
  chemically synthesized
cgaagcctgaagcaaactaaat

SEQ ID NO: 1006298 - DNA, 22 bp, Artificial Sequence
  chemically synthesized
ttactgaatatttagtttgctt

SEQ ID NO: 1006299 - DNA, 22 bp, Artificial Sequence
  chemically synthesized
ctgaatatttagtttgcttcag

SEQ ID NO: 1006300 - DNA, 22 bp, Artificial Sequence
  chemically synthesized
aatatttagtttgcttcaggct

SEQ ID NO: 1006301 - DNA, 22 bp, Artificial Sequence
  chemically synthesized
taatgattgcgaagcctgaagc

SEQ ID NO: 1006302 - DNA, 22 bp, Artificial Sequence
  chemically synthesized
agtttgcttcaggcttcgcaat

SEQ ID NO: 1006303 - DNA, 22 bp, Artificial Sequence
  chemically synthesized
gtttgcttcaggcttcgcaatc

SEQ ID NO: 1006304 - DNA, 22 bp, Artificial Sequence
  chemically synthesized
gcttcaggcttcgcaatcatta

SEQ ID NO: 1006305 - DNA, 22 bp, Artificial Sequence
  chemically synthesized
cttcaggcttcgcaatcattat

SEQ ID NO: 1006306 - DNA, 22 bp, Artificial Sequence
  chemically synthesized
aatgtggaatctataatgattg

SEQ ID NO: 1006307 - DNA, 22 bp, Artificial Sequence
  chemically synthesized
caggcttcgcaatcattataga

SEQ ID NO: 1006308 - DNA, 22 bp, Artificial Sequence
  chemically synthesized
aggcttcgcaatcattatagat

SEQ ID NO: 1006309 - DNA, 22 bp, Artificial Sequence
  chemically synthesized
cgcaatcattatagattccaca

SEQ ID NO: 1006310 - DNA, 22 bp, Artificial Sequence
  chemically synthesized
gcaatcattatagattccacat

SEQ ID NO: 1006311 - DNA, 22 bp, Artificial Sequence
  chemically synthesized
tagattccacatttaatatata

SEQ ID NO: 1006312 - DNA, 22 bp, Artificial Sequence
  chemically synthesized
aatcagcacatatatatattaa

SEQ ID NO: 1006313 - DNA, 22 bp, Artificial Sequence
  chemically synthesized
cacatttaatatatatatgtgc

SEQ ID NO: 1006314 - DNA, 22 bp, Artificial Sequence
  chemically synthesized
aatatatatatgtgctgattga

SEQ ID NO: 1006315 - DNA, 22 bp, Artificial Sequence
  chemically synthesized
atatatatatgtgctgattgag

SEQ ID NO: 1006316 - DNA, 22 bp, Artificial Sequence
  chemically synthesized
taagaaataatgaagacaactc

SEQ ID NO: 1006317 - DNA, 22 bp, Artificial Sequence
  chemically synthesized
ataagaaataatgaagacaact

SEQ ID NO: 1006318 - DNA, 22 bp, Artificial Sequence
  chemically synthesized
tataagaaataatgaagacaac

SEQ ID NO: 1006319 - DNA, 22 bp, Artificial Sequence
  chemically synthesized
attgagttgtcttcattatttc

SEQ ID NO: 1006320 - DNA, 22 bp, Artificial Sequence
  chemically synthesized
gagatattttataagaaataat

SEQ ID NO: 1006321 - DNA, 22 bp, Artificial Sequence
  chemically synthesized
agttgtcttcattatttcttat

SEQ ID NO: 1006322 - DNA, 22 bp, Artificial Sequence
  chemically synthesized
tcttcattatttcttataaaat

SEQ ID NO: 1006323 - DNA, 22 bp, Artificial Sequence
  chemically synthesized
aacattggagatattttataag

SEQ ID NO: 1006324 - DNA, 22 bp, Artificial Sequence
  chemically synthesized
cattatttcttataaaatatct

SEQ ID NO: 1006325 - DNA, 22 bp, Artificial Sequence
  chemically synthesized
attatttcttataaaatatctc

SEQ ID NO: 1006326 - DNA, 22 bp, Artificial Sequence
  chemically synthesized
tttcttataaaatatctccaat

SEQ ID NO: 1006327 - DNA, 22 bp, Artificial Sequence
  chemically synthesized
cttataaaatatctccaatgtt

SEQ ID NO: 1006328 - DNA, 22 bp, Artificial Sequence
  chemically synthesized
ttataaaatatctccaatgttc

SEQ ID NO: 1006329 - DNA, 22 bp, Artificial Sequence
  chemically synthesized
ataaaatatctccaatgttcaa

SEQ ID NO: 1006330 - DNA, 22 bp, Artificial Sequence
  chemically synthesized
taaaatatctccaatgttcaat

SEQ ID NO: 1006331 - DNA, 22 bp, Artificial Sequence
  chemically synthesized
aacatgatcaatagattgaaca

SEQ ID NO: 1006332 - DNA, 22 bp, Artificial Sequence
  chemically synthesized
caacatgatcaatagattgaac

SEQ ID NO: 1006333 - DNA, 22 bp, Artificial Sequence
  chemically synthesized
tcaacatgatcaatagattgaa

SEQ ID NO: 1006334 - DNA, 22 bp, Artificial Sequence
  chemically synthesized
tttcaacatgatcaatagattg

SEQ ID NO: 1006335 - DNA, 22 bp, Artificial Sequence
  chemically synthesized
ctttcaacatgatcaatagatt

SEQ ID NO: 1006336 - DNA, 22 bp, Artificial Sequence
  chemically synthesized
tctttcaacatgatcaatagat

SEQ ID NO: 1006337 - DNA, 22 bp, Artificial Sequence
  chemically synthesized
ttctttcaacatgatcaataga

SEQ ID NO: 1006338 - DNA, 22 bp, Artificial Sequence
  chemically synthesized
tttctttcaacatgatcaatag

SEQ ID NO: 1006339 - DNA, 22 bp, Artificial Sequence
  chemically synthesized
caatgttcaatctattgatcat

SEQ ID NO: 1006340 - DNA, 22 bp, Artificial Sequence
  chemically synthesized
aaccctttttctttcaacatga

SEQ ID NO: 1006341 - DNA, 22 bp, Artificial Sequence
  chemically synthesized
aatctattgatcatgttgaaag

SEQ ID NO: 1006342 - DNA, 22 bp, Artificial Sequence
  chemically synthesized
atctaaaccctttttctttcaa

SEQ ID NO: 1006343 - DNA, 22 bp, Artificial Sequence
  chemically synthesized
ttgatcatgttgaaagaaaaag

SEQ ID NO: 1006344 - DNA, 22 bp, Artificial Sequence
  chemically synthesized
atcatgttgaaagaaaaagggt

SEQ ID NO: 1006345 - DNA, 22 bp, Artificial Sequence
  chemically synthesized
aaagaaaaagggtttagatgag

SEQ ID NO: 1006346 - DNA, 22 bp, Artificial Sequence
  chemically synthesized
agatgagctgtacacatacata

SEQ ID NO: 1006347 - DNA, 22 bp, Artificial Sequence
  chemically synthesized
gatgagctgtacacatacatat

SEQ ID NO: 1006348 - DNA, 22 bp, Artificial Sequence
  chemically synthesized
tcatgatcccgagagtatatat

SEQ ID NO: 1006349 - DNA, 22 bp, Artificial Sequence
  chemically synthesized
atcatgatcccgagagtatata

SEQ ID NO: 1006350 - DNA, 22 bp, Artificial Sequence
  chemically synthesized
tatcatgatcccgagagtatat

SEQ ID NO: 1006351 - DNA, 22 bp, Artificial Sequence
  chemically synthesized
tacacatacatatatactctcg

SEQ ID NO: 1006352 - DNA, 22 bp, Artificial Sequence
  chemically synthesized
ttttatcatgatcccgagagta

SEQ ID NO: 1006353 - DNA, 22 bp, Artificial Sequence
  chemically synthesized
gttttatcatgatcccgagagt

SEQ ID NO: 1006354 - DNA, 22 bp, Artificial Sequence
  chemically synthesized
tcttgttttatcatgatcccga

SEQ ID NO: 1006355 - DNA, 22 bp, Artificial Sequence
  chemically synthesized
tcgggatcatgataaaacaaga

SEQ ID NO: 1006356 - DNA, 22 bp, Artificial Sequence
  chemically synthesized
gggatcatgataaaacaagaca

SEQ ID NO: 1006357 - DNA, 22 bp, Artificial Sequence
  chemically synthesized
caggcgtgagccaccgtgccag

SEQ ID NO: 1006358 - DNA, 22 bp, Artificial Sequence
  chemically synthesized
ggattacaggcgtgagccaccg

SEQ ID NO: 1006359 - DNA, 22 bp, Artificial Sequence
  chemically synthesized
gcacggtggctcacgcctgtaa

SEQ ID NO: 1006360 - DNA, 22 bp, Artificial Sequence
  chemically synthesized
ccaaagtgctgggattacaggc

SEQ ID NO: 1006361 - DNA, 22 bp, Artificial Sequence
  chemically synthesized
gcctcccaaagtgctgggatta

SEQ ID NO: 1006362 - DNA, 22 bp, Artificial Sequence
  chemically synthesized
ggcctcccaaagtgctgggatt

SEQ ID NO: 1006363 - DNA, 22 bp, Artificial Sequence
  chemically synthesized
acgcctgtaatcccagcacttt

SEQ ID NO: 1006364 - DNA, 22 bp, Artificial Sequence
  chemically synthesized
cccaccttggcctcccaaagtg

SEQ ID NO: 1006365 - DNA, 22 bp, Artificial Sequence
  chemically synthesized
taatcccagcactttgggaggc

SEQ ID NO: 1006366 - DNA, 22 bp, Artificial Sequence
  chemically synthesized
gtgatctgcccaccttggcctc

SEQ ID NO: 1006367 - DNA, 22 bp, Artificial Sequence
  chemically synthesized
acctcgtgatctgcccaccttg

SEQ ID NO: 1006368 - DNA, 22 bp, Artificial Sequence
  chemically synthesized
ctgacctcgtgatctgcccacc

SEQ ID NO: 1006369 - DNA, 22 bp, Artificial Sequence
  chemically synthesized
tgggaggccaaggtgggcagat

SEQ ID NO: 1006370 - DNA, 22 bp, Artificial Sequence
  chemically synthesized
gggaggccaaggtgggcagatc

SEQ ID NO: 1006371 - DNA, 22 bp, Artificial Sequence
  chemically synthesized
ggaggccaaggtgggcagatca

SEQ ID NO: 1006372 - DNA, 22 bp, Artificial Sequence
  chemically synthesized
gatctcctgacctcgtgatctg

SEQ ID NO: 1006373 - DNA, 22 bp, Artificial Sequence
  chemically synthesized
gccaggatggtctcgatctcct

SEQ ID NO: 1006374 - DNA, 22 bp, Artificial Sequence
  chemically synthesized
accgtgttagccaggatggtct

SEQ ID NO: 1006375 - DNA, 22 bp, Artificial Sequence
  chemically synthesized
caccgtgttagccaggatggtc

SEQ ID NO: 1006376 - DNA, 22 bp, Artificial Sequence
  chemically synthesized
gtagagacggggtttcaccgtg

SEQ ID NO: 1006377 - DNA, 22 bp, Artificial Sequence
  chemically synthesized
agtagagacggggtttcaccgt

SEQ ID NO: 1006378 - DNA, 22 bp, Artificial Sequence
  chemically synthesized
tagtagagacggggtttcaccg

SEQ ID NO: 1006379 - DNA, 22 bp, Artificial Sequence
  chemically synthesized
ttagtagagacggggtttcacc

SEQ ID NO: 1006380 - DNA, 22 bp, Artificial Sequence
  chemically synthesized
gctaacacggtgaaaccccgtc

SEQ ID NO: 1006381 - DNA, 22 bp, Artificial Sequence
  chemically synthesized
tatttttagtagagacggggtt

SEQ ID NO: 1006382 - DNA, 22 bp, Artificial Sequence
  chemically synthesized
gtatttttagtagagacggggt

SEQ ID NO: 1006383 - DNA, 22 bp, Artificial Sequence
  chemically synthesized
tgtatttttagtagagacgggg

SEQ ID NO: 1006384 - DNA, 22 bp, Artificial Sequence
  chemically synthesized
acacggtgaaaccccgtctcta

SEQ ID NO: 1006385 - DNA, 22 bp, Artificial Sequence
  chemically synthesized
ttgtatttttagtagagacggg

SEQ ID NO: 1006386 - DNA, 22 bp, Artificial Sequence
  chemically synthesized
tttgtatttttagtagagacgg

SEQ ID NO: 1006387 - DNA, 22 bp, Artificial Sequence
  chemically synthesized
ttttgtatttttagtagagacg

SEQ ID NO: 1006388 - DNA, 22 bp, Artificial Sequence
  chemically synthesized
atttttttgtatttttagtaga

SEQ ID NO: 1006389 - DNA, 22 bp, Artificial Sequence
  chemically synthesized
ccacgccccgctaatttttttg

SEQ ID NO: 1006390 - DNA, 22 bp, Artificial Sequence
  chemically synthesized
tactaaaaatacaaaaaaatta

SEQ ID NO: 1006391 - DNA, 22 bp, Artificial Sequence
  chemically synthesized
ctaaaaatacaaaaaaattagc

SEQ ID NO: 1006392 - DNA, 22 bp, Artificial Sequence
  chemically synthesized
gctaccacgccccgctaatttt

SEQ ID NO: 1006393 - DNA, 22 bp, Artificial Sequence
  chemically synthesized
aaaatacaaaaaaattagcggg

SEQ ID NO: 1006394 - DNA, 22 bp, Artificial Sequence
  chemically synthesized
caggcgctggctaccacgcccc

SEQ ID NO: 1006395 - DNA, 22 bp, Artificial Sequence
  chemically synthesized
gtactacaggcgctggctacca

SEQ ID NO: 1006396 - DNA, 22 bp, Artificial Sequence
  chemically synthesized
gcggggcgtggtagccagcgcc

SEQ ID NO: 1006397 - DNA, 22 bp, Artificial Sequence
  chemically synthesized
ccgagtagctggtactacaggc

SEQ ID NO: 1006398 - DNA, 22 bp, Artificial Sequence
  chemically synthesized
agcctcccgagtagctggtact

SEQ ID NO: 1006399 - DNA, 22 bp, Artificial Sequence
  chemically synthesized
cctcagcctcccgagtagctgg

SEQ ID NO: 1006400 - DNA, 22 bp, Artificial Sequence
  chemically synthesized
ctgcctcagcctcccgagtagc

SEQ ID NO: 1006401 - DNA, 22 bp, Artificial Sequence
  chemically synthesized
tcctgcctcagcctcccgagta

SEQ ID NO: 1006402 - DNA, 22 bp, Artificial Sequence
  chemically synthesized
tagtaccagctactcgggaggc

SEQ ID NO: 1006403 - DNA, 22 bp, Artificial Sequence
  chemically synthesized
cgccattctcctgcctcagcct

SEQ ID NO: 1006404 - DNA, 22 bp, Artificial Sequence
  chemically synthesized
acgccattctcctgcctcagcc

SEQ ID NO: 1006405 - DNA, 22 bp, Artificial Sequence
  chemically synthesized
ctcgggaggctgaggcaggaga

SEQ ID NO: 1006406 - DNA, 22 bp, Artificial Sequence
  chemically synthesized
gggaggctgaggcaggagaatg

SEQ ID NO: 1006407 - DNA, 22 bp, Artificial Sequence
  chemically synthesized
ccgggtttacgccattctcctg

SEQ ID NO: 1006408 - DNA, 22 bp, Artificial Sequence
  chemically synthesized
cctcccgggtttacgccattct

SEQ ID NO: 1006409 - DNA, 22 bp, Artificial Sequence
  chemically synthesized
tgcctcccgggtttacgccatt

SEQ ID NO: 1006410 - DNA, 22 bp, Artificial Sequence
  chemically synthesized
aggcaggagaatggcgtaaacc

SEQ ID NO: 1006411 - DNA, 22 bp, Artificial Sequence
  chemically synthesized
caagctctgcctcccgggttta

SEQ ID NO: 1006412 - DNA, 22 bp, Artificial Sequence
  chemically synthesized
actgcaagctctgcctcccggg

SEQ ID NO: 1006413 - DNA, 22 bp, Artificial Sequence
  chemically synthesized
gctcactgcaagctctgcctcc

SEQ ID NO: 1006414 - DNA, 22 bp, Artificial Sequence
  chemically synthesized
ggctcactgcaagctctgcctc

SEQ ID NO: 1006415 - DNA, 22 bp, Artificial Sequence
  chemically synthesized
gagtacagtggcgcgatcttgg

SEQ ID NO: 1006416 - DNA, 22 bp, Artificial Sequence
  chemically synthesized
gcagtgagccaagatcgcgcca

SEQ ID NO: 1006417 - DNA, 22 bp, Artificial Sequence
  chemically synthesized
cagtgagccaagatcgcgccac

SEQ ID NO: 1006418 - DNA, 22 bp, Artificial Sequence
  chemically synthesized
tcaccccaggctggagtacagt

SEQ ID NO: 1006419 - DNA, 22 bp, Artificial Sequence
  chemically synthesized
tgtcaccccaggctggagtaca

SEQ ID NO: 1006420 - DNA, 22 bp, Artificial Sequence
  chemically synthesized
gctctgtcaccccaggctggag

SEQ ID NO: 1006421 - DNA, 22 bp, Artificial Sequence
  chemically synthesized
tactccagcctggggtgacaga

SEQ ID NO: 1006422 - DNA, 22 bp, Artificial Sequence
  chemically synthesized
agatggagtctcgctctgtcac

SEQ ID NO: 1006423 - DNA, 22 bp, Artificial Sequence
  chemically synthesized
gagatggagtctcgctctgtca

SEQ ID NO: 1006424 - DNA, 22 bp, Artificial Sequence
  chemically synthesized
tgagatggagtctcgctctgtc

SEQ ID NO: 1006425 - DNA, 22 bp, Artificial Sequence
  chemically synthesized
cagcctggggtgacagagcgag

SEQ ID NO: 1006426 - DNA, 22 bp, Artificial Sequence
  chemically synthesized
ttgagatggagtctcgctctgt

SEQ ID NO: 1006427 - DNA, 22 bp, Artificial Sequence
  chemically synthesized
tttgagatggagtctcgctctg

SEQ ID NO: 1006428 - DNA, 22 bp, Artificial Sequence
  chemically synthesized
ttttgagatggagtctcgctct

SEQ ID NO: 1006429 - DNA, 22 bp, Artificial Sequence
  chemically synthesized
tttttgagatggagtctcgctc

SEQ ID NO: 1006430 - DNA, 22 bp, Artificial Sequence
  chemically synthesized
ttttttgagatggagtctcgct

SEQ ID NO: 1006431 - DNA, 22 bp, Artificial Sequence
  chemically synthesized
tttttttgagatggagtctcgc

SEQ ID NO: 1006432 - DNA, 22 bp, Artificial Sequence
  chemically synthesized
ttttttttgagatggagtctcg

SEQ ID NO: 1006433 - DNA, 22 bp, Artificial Sequence
  chemically synthesized
gggtgacagagcgagactccat

SEQ ID NO: 1006434 - DNA, 22 bp, Artificial Sequence
  chemically synthesized
tttttttttgagatggagtctc

SEQ ID NO: 1006435 - DNA, 22 bp, Artificial Sequence
  chemically synthesized
ttttttttttgagatggagtct

SEQ ID NO: 1006436 - DNA, 22 bp, Artificial Sequence
  chemically synthesized
tttttttttttgagatggagtc

SEQ ID NO: 1006437 - DNA, 22 bp, Artificial Sequence
  chemically synthesized
ttttttttttttgagatggagt

SEQ ID NO: 1006438 - DNA, 22 bp, Artificial Sequence
  chemically synthesized
tttttttttttttgagatggag

SEQ ID NO: 1006439 - DNA, 22 bp, Artificial Sequence
  chemically synthesized
ttttttttttttttgagatgga

SEQ ID NO: 1006440 - DNA, 22 bp, Artificial Sequence
  chemically synthesized
tttttttttttttttgagatgg

SEQ ID NO: 1006441 - DNA, 22 bp, Artificial Sequence
  chemically synthesized
ttttttttttttttttgagatg

SEQ ID NO: 1006442 - DNA, 22 bp, Artificial Sequence
  chemically synthesized
tttttttttttttttttttgag

SEQ ID NO: 1006443 - DNA, 22 bp, Artificial Sequence
  chemically synthesized
gtttttttttttttttttttga

SEQ ID NO: 1006444 - DNA, 22 bp, Artificial Sequence
  chemically synthesized
tgtttttttttttttttttttg

SEQ ID NO: 1006445 - DNA, 22 bp, Artificial Sequence
  chemically synthesized
ttgttttttttttttttttttt

SEQ ID NO: 1006446 - DNA, 22 bp, Artificial Sequence
  chemically synthesized
tttttgtttttttttttttttt

SEQ ID NO: 1006447 - DNA, 22 bp, Artificial Sequence
  chemically synthesized
gtttttgttttttttttttttt

SEQ ID NO: 1006448 - DNA, 22 bp, Artificial Sequence
  chemically synthesized
tgtttttgtttttttttttttt

SEQ ID NO: 1006449 - DNA, 22 bp, Artificial Sequence
  chemically synthesized
catctcaaaaaaaaaaaaaaaa

SEQ ID NO: 1006450 - DNA, 22 bp, Artificial Sequence
  chemically synthesized
ttgtttttgttttttttttttt

SEQ ID NO: 1006451 - DNA, 22 bp, Artificial Sequence
  chemically synthesized
ttttgtttttgttttttttttt

SEQ ID NO: 1006452 - DNA, 22 bp, Artificial Sequence
  chemically synthesized
cttttgtttttgtttttttttt

SEQ ID NO: 1006453 - DNA, 22 bp, Artificial Sequence
  chemically synthesized
tcttttgtttttgttttttttt

SEQ ID NO: 1006454 - DNA, 22 bp, Artificial Sequence
  chemically synthesized
ttcttttgtttttgtttttttt

SEQ ID NO: 1006455 - DNA, 22 bp, Artificial Sequence
  chemically synthesized
aaaaaaaaaaaaaaaaaaacaa

SEQ ID NO: 1006456 - DNA, 22 bp, Artificial Sequence
  chemically synthesized
tttcttttgtttttgttttttt

SEQ ID NO: 1006457 - DNA, 22 bp, Artificial Sequence
  chemically synthesized
ttttttcttttgtttttgtttt

SEQ ID NO: 1006458 - DNA, 22 bp, Artificial Sequence
  chemically synthesized
gttttttcttttgtttttgttt

SEQ ID NO: 1006459 - DNA, 22 bp, Artificial Sequence
  chemically synthesized
tcttgttttttcttttgttttt

SEQ ID NO: 1006460 - DNA, 22 bp, Artificial Sequence
  chemically synthesized
aaagtcacctgtcttgtttttt

SEQ ID NO: 1006461 - DNA, 22 bp, Artificial Sequence
  chemically synthesized
aaattcaaagtcacctgtcttg

SEQ ID NO: 1006462 - DNA, 22 bp, Artificial Sequence
  chemically synthesized
attaaaattcaaagtcacctgt

SEQ ID NO: 1006463 - DNA, 22 bp, Artificial Sequence
  chemically synthesized
ttcattaaaattcaaagtcacc

SEQ ID NO: 1006464 - DNA, 22 bp, Artificial Sequence
  chemically synthesized
gttcattaaaattcaaagtcac

SEQ ID NO: 1006465 - DNA, 22 bp, Artificial Sequence
  chemically synthesized
acttgttcattaaaattcaaag

SEQ ID NO: 1006466 - DNA, 22 bp, Artificial Sequence
  chemically synthesized
taacttgttcattaaaattcaa

SEQ ID NO: 1006467 - DNA, 22 bp, Artificial Sequence
  chemically synthesized
ggggagggttctaacttgttca

SEQ ID NO: 1006468 - DNA, 22 bp, Artificial Sequence
  chemically synthesized
tgaattttaatgaacaagttag

SEQ ID NO: 1006469 - DNA, 22 bp, Artificial Sequence
  chemically synthesized
gaattttaatgaacaagttaga

SEQ ID NO: 1006470 - DNA, 22 bp, Artificial Sequence
  chemically synthesized
aattttaatgaacaagttagaa

SEQ ID NO: 1006471 - DNA, 22 bp, Artificial Sequence
  chemically synthesized
taatgaacaagttagaaccctc

SEQ ID NO: 1006472 - DNA, 22 bp, Artificial Sequence
  chemically synthesized
aatgaacaagttagaaccctcc

SEQ ID NO: 1006473 - DNA, 22 bp, Artificial Sequence
  chemically synthesized
atgaacaagttagaaccctccc

SEQ ID NO: 1006474 - DNA, 22 bp, Artificial Sequence
  chemically synthesized
aaaccagatgttgggggagggt

SEQ ID NO: 1006475 - DNA, 22 bp, Artificial Sequence
  chemically synthesized
aaaaccagatgttgggggaggg

SEQ ID NO: 1006476 - DNA, 22 bp, Artificial Sequence
  chemically synthesized
gaaccctcccccaacatctggt

SEQ ID NO: 1006477 - DNA, 22 bp, Artificial Sequence
  chemically synthesized
ccccaacatctggttttaaatg

SEQ ID NO: 1006478 - DNA, 22 bp, Artificial Sequence
  chemically synthesized
gttttaaatgctattactttcg

SEQ ID NO: 1006479 - DNA, 22 bp, Artificial Sequence
  chemically synthesized
taaatgctattactttcggtat

SEQ ID NO: 1006480 - DNA, 22 bp, Artificial Sequence
  chemically synthesized
aaatgctattactttcggtatg

SEQ ID NO: 1006481 - DNA, 22 bp, Artificial Sequence
  chemically synthesized
agataagcaatacataccgaaa

SEQ ID NO: 1006482 - DNA, 22 bp, Artificial Sequence
  chemically synthesized
aatgctattactttcggtatgt

SEQ ID NO: 1006483 - DNA, 22 bp, Artificial Sequence
  chemically synthesized
ttaagataagcaatacataccg

SEQ ID NO: 1006484 - DNA, 22 bp, Artificial Sequence
  chemically synthesized
attaagataagcaatacatacc

SEQ ID NO: 1006485 - DNA, 22 bp, Artificial Sequence
  chemically synthesized
ttactttcggtatgtattgctt

SEQ ID NO: 1006486 - DNA, 22 bp, Artificial Sequence
  chemically synthesized
ctttcggtatgtattgcttatc

SEQ ID NO: 1006487 - DNA, 22 bp, Artificial Sequence
  chemically synthesized
atcatacttattaagataagca

SEQ ID NO: 1006488 - DNA, 22 bp, Artificial Sequence
  chemically synthesized
tcggtatgtattgcttatctta

SEQ ID NO: 1006489 - DNA, 22 bp, Artificial Sequence
  chemically synthesized
cggtatgtattgcttatcttaa

SEQ ID NO: 1006490 - DNA, 22 bp, Artificial Sequence
  chemically synthesized
ggtatgtattgcttatcttaat

SEQ ID NO: 1006491 - DNA, 22 bp, Artificial Sequence
  chemically synthesized
agctcatcatacttattaagat

SEQ ID NO: 1006492 - DNA, 22 bp, Artificial Sequence
  chemically synthesized
aagctcatcatacttattaaga

SEQ ID NO: 1006493 - DNA, 22 bp, Artificial Sequence
  chemically synthesized
atatttaagctcatcatactta

SEQ ID NO: 1006494 - DNA, 22 bp, Artificial Sequence
  chemically synthesized
cttatcttaataagtatgatga

SEQ ID NO: 1006495 - DNA, 22 bp, Artificial Sequence
  chemically synthesized
atcttaataagtatgatgagct

SEQ ID NO: 1006496 - DNA, 22 bp, Artificial Sequence
  chemically synthesized
tcttaataagtatgatgagctt

SEQ ID NO: 1006497 - DNA, 22 bp, Artificial Sequence
  chemically synthesized
aataagtatgatgagcttaaat

SEQ ID NO: 1006498 - DNA, 22 bp, Artificial Sequence
  chemically synthesized
ataagtatgatgagcttaaata

SEQ ID NO: 1006499 - DNA, 22 bp, Artificial Sequence
  chemically synthesized
aaatattagcttatcttcgggt

SEQ ID NO: 1006500 - DNA, 22 bp, Artificial Sequence
  chemically synthesized
aatattagcttatcttcgggtc

SEQ ID NO: 1006501 - DNA, 22 bp, Artificial Sequence
  chemically synthesized
aaataaaaaagagagggacccg

SEQ ID NO: 1006502 - DNA, 22 bp, Artificial Sequence
  chemically synthesized
gcttatcttcgggtccctctct

SEQ ID NO: 1006503 - DNA, 22 bp, Artificial Sequence
  chemically synthesized
atcttcgggtccctctcttttt

SEQ ID NO: 1006504 - DNA, 22 bp, Artificial Sequence
  chemically synthesized
tcttcgggtccctctctttttt

SEQ ID NO: 1006505 - DNA, 22 bp, Artificial Sequence
  chemically synthesized
cgggtccctctcttttttattt

SEQ ID NO: 1006506 - DNA, 22 bp, Artificial Sequence
  chemically synthesized
gggtccctctcttttttatttt

SEQ ID NO: 1006507 - DNA, 22 bp, Artificial Sequence
  chemically synthesized
cgatgtacccacaaaaattaaa

SEQ ID NO: 1006508 - DNA, 22 bp, Artificial Sequence
  chemically synthesized
tcttttttattttaatttttgt

SEQ ID NO: 1006509 - DNA, 22 bp, Artificial Sequence
  chemically synthesized
ctacgatgtacccacaaaaatt

SEQ ID NO: 1006510 - DNA, 22 bp, Artificial Sequence
  chemically synthesized
ttttttattttaatttttgtgg

SEQ ID NO: 1006511 - DNA, 22 bp, Artificial Sequence
  chemically synthesized
ttttattttaatttttgtgggt

SEQ ID NO: 1006512 - DNA, 22 bp, Artificial Sequence
  chemically synthesized
tttattttaatttttgtgggta

SEQ ID NO: 1006513 - DNA, 22 bp, Artificial Sequence
  chemically synthesized
ttattttaatttttgtgggtac

SEQ ID NO: 1006514 - DNA, 22 bp, Artificial Sequence
  chemically synthesized
tattttaatttttgtgggtaca

SEQ ID NO: 1006515 - DNA, 22 bp, Artificial Sequence
  chemically synthesized
attttaatttttgtgggtacat

SEQ ID NO: 1006516 - DNA, 22 bp, Artificial Sequence
  chemically synthesized
ttttaatttttgtgggtacatc

SEQ ID NO: 1006517 - DNA, 22 bp, Artificial Sequence
  chemically synthesized
taatttttgtgggtacatcgta

SEQ ID NO: 1006518 - DNA, 22 bp, Artificial Sequence
  chemically synthesized
aatttttgtgggtacatcgtag

SEQ ID NO: 1006519 - DNA, 22 bp, Artificial Sequence
  chemically synthesized
atttttgtgggtacatcgtagg

SEQ ID NO: 1006520 - DNA, 22 bp, Artificial Sequence
  chemically synthesized
caaatatatactcctacgatgt

SEQ ID NO: 1006521 - DNA, 22 bp, Artificial Sequence
  chemically synthesized
ttgtgggtacatcgtaggagta

SEQ ID NO: 1006522 - DNA, 22 bp, Artificial Sequence
  chemically synthesized
tgtgggtacatcgtaggagtat

SEQ ID NO: 1006523 - DNA, 22 bp, Artificial Sequence
  chemically synthesized
gtgggtacatcgtaggagtata

SEQ ID NO: 1006524 - DNA, 22 bp, Artificial Sequence
  chemically synthesized
tgggtacatcgtaggagtatat

SEQ ID NO: 1006525 - DNA, 22 bp, Artificial Sequence
  chemically synthesized
atgtaccctacaaatatatact

SEQ ID NO: 1006526 - DNA, 22 bp, Artificial Sequence
  chemically synthesized
tgtcaaaacatctcatgtaccc

SEQ ID NO: 1006527 - DNA, 22 bp, Artificial Sequence
  chemically synthesized
cctgtgtcaaaacatctcatgt

SEQ ID NO: 1006528 - DNA, 22 bp, Artificial Sequence
  chemically synthesized
cctgcctgtgtcaaaacatctc

SEQ ID NO: 1006529 - DNA, 22 bp, Artificial Sequence
  chemically synthesized
gtagggtacatgagatgttttg

SEQ ID NO: 1006530 - DNA, 22 bp, Artificial Sequence
  chemically synthesized
tagggtacatgagatgttttga

SEQ ID NO: 1006531 - DNA, 22 bp, Artificial Sequence
  chemically synthesized
cccattgcctgcctgtgtcaaa

SEQ ID NO: 1006532 - DNA, 22 bp, Artificial Sequence
  chemically synthesized
ttacccattgcctgcctgtgtc

SEQ ID NO: 1006533 - DNA, 22 bp, Artificial Sequence
  chemically synthesized
tgacacaggcaggcaatgggta

SEQ ID NO: 1006534 - DNA, 22 bp, Artificial Sequence
  chemically synthesized
gacacaggcaggcaatgggtaa

SEQ ID NO: 1006535 - DNA, 22 bp, Artificial Sequence
  chemically synthesized
acacaggcaggcaatgggtaat

SEQ ID NO: 1006536 - DNA, 22 bp, Artificial Sequence
  chemically synthesized
catgatgtgattattacccatt

SEQ ID NO: 1006537 - DNA, 22 bp, Artificial Sequence
  chemically synthesized
tccatgatgtgattattaccca

SEQ ID NO: 1006538 - DNA, 22 bp, Artificial Sequence
  chemically synthesized
aagggatggataccccgttctc

SEQ ID NO: 1006539 - DNA, 22 bp, Artificial Sequence
  chemically synthesized
gaagggatggataccccgttct

SEQ ID NO: 1006540 - DNA, 22 bp, Artificial Sequence
  chemically synthesized
taacacaaaggagaaatgcttg

SEQ ID NO: 1006541 - DNA, 22 bp, Artificial Sequence
  chemically synthesized
gtaacacaaaggagaaatgctt

SEQ ID NO: 1006542 - DNA, 22 bp, Artificial Sequence
  chemically synthesized
tttgtaacacaaaggagaaatg

SEQ ID NO: 1006543 - DNA, 22 bp, Artificial Sequence
  chemically synthesized
gattgtttgtaacacaaaggag

SEQ ID NO: 1006544 - DNA, 22 bp, Artificial Sequence
  chemically synthesized
caagcatttctcctttgtgtta

SEQ ID NO: 1006545 - DNA, 22 bp, Artificial Sequence
  chemically synthesized
aagcatttctcctttgtgttac

SEQ ID NO: 1006546 - DNA, 22 bp, Artificial Sequence
  chemically synthesized
ctcctttgtgttacaaacaatc

SEQ ID NO: 1006547 - DNA, 22 bp, Artificial Sequence
  chemically synthesized
tcctttgtgttacaaacaatcc

SEQ ID NO: 1006548 - DNA, 22 bp, Artificial Sequence
  chemically synthesized
aaggagtgtgattggattgttt

SEQ ID NO: 1006549 - DNA, 22 bp, Artificial Sequence
  chemically synthesized
ctttgtgttacaaacaatccaa

SEQ ID NO: 1006550 - DNA, 22 bp, Artificial Sequence
  chemically synthesized
tgtgttacaaacaatccaatca

SEQ ID NO: 1006551 - DNA, 22 bp, Artificial Sequence
  chemically synthesized
gtgttacaaacaatccaatcac

SEQ ID NO: 1006552 - DNA, 22 bp, Artificial Sequence
  chemically synthesized
tgttacaaacaatccaatcaca

SEQ ID NO: 1006553 - DNA, 22 bp, Artificial Sequence
  chemically synthesized
aaaataactaaaggagtgtgat

SEQ ID NO: 1006554 - DNA, 22 bp, Artificial Sequence
  chemically synthesized
caaacaatccaatcacactcct

SEQ ID NO: 1006555 - DNA, 22 bp, Artificial Sequence
  chemically synthesized
aaaaataactaaaggagtgtga

SEQ ID NO: 1006556 - DNA, 22 bp, Artificial Sequence
  chemically synthesized
tacatttaaaaataactaaagg

SEQ ID NO: 1006557 - DNA, 22 bp, Artificial Sequence
  chemically synthesized
gtacatttaaaaataactaaag

SEQ ID NO: 1006558 - DNA, 22 bp, Artificial Sequence
  chemically synthesized
cttgtacatttaaaaataacta

SEQ ID NO: 1006559 - DNA, 22 bp, Artificial Sequence
  chemically synthesized
ctttagttatttttaaatgtac

SEQ ID NO: 1006560 - DNA, 22 bp, Artificial Sequence
  chemically synthesized
ataatgagttacttgtacattt

SEQ ID NO: 1006561 - DNA, 22 bp, Artificial Sequence
  chemically synthesized
tagttatttttaaatgtacaag

SEQ ID NO: 1006562 - DNA, 22 bp, Artificial Sequence
  chemically synthesized
agttatttttaaatgtacaagt

SEQ ID NO: 1006563 - DNA, 22 bp, Artificial Sequence
  chemically synthesized
gttatttttaaatgtacaagta

SEQ ID NO: 1006564 - DNA, 22 bp, Artificial Sequence
  chemically synthesized
tggttaataatgagttacttgt

SEQ ID NO: 1006565 - DNA, 22 bp, Artificial Sequence
  chemically synthesized
tttttaaatgtacaagtaactc

SEQ ID NO: 1006566 - DNA, 22 bp, Artificial Sequence
  chemically synthesized
ttaaatgtacaagtaactcatt

SEQ ID NO: 1006567 - DNA, 22 bp, Artificial Sequence
  chemically synthesized
taaatgtacaagtaactcatta

SEQ ID NO: 1006568 - DNA, 22 bp, Artificial Sequence
  chemically synthesized
aaatgtacaagtaactcattat

SEQ ID NO: 1006569 - DNA, 22 bp, Artificial Sequence
  chemically synthesized
aatgtacaagtaactcattatt

SEQ ID NO: 1006570 - DNA, 22 bp, Artificial Sequence
  chemically synthesized
atcaaacaacgggatgattatg

SEQ ID NO: 1006571 - DNA, 22 bp, Artificial Sequence
  chemically synthesized
attattaaccataatcatcccg

SEQ ID NO: 1006572 - DNA, 22 bp, Artificial Sequence
  chemically synthesized
atctgatcaaacaacgggatga

SEQ ID NO: 1006573 - DNA, 22 bp, Artificial Sequence
  chemically synthesized
gatctgatcaaacaacgggatg

SEQ ID NO: 1006574 - DNA, 22 bp, Artificial Sequence
  chemically synthesized
ttaaccataatcatcccgttgt

SEQ ID NO: 1006575 - DNA, 22 bp, Artificial Sequence
  chemically synthesized
tttgatctgatcaaacaacggg

SEQ ID NO: 1006576 - DNA, 22 bp, Artificial Sequence
  chemically synthesized
accataatcatcccgttgtttg

SEQ ID NO: 1006577 - DNA, 22 bp, Artificial Sequence
  chemically synthesized
tttgatcagatcaaatagtgtg

SEQ ID NO: 1006578 - DNA, 22 bp, Artificial Sequence
  chemically synthesized
cagggaaaataagacacactat

SEQ ID NO: 1006579 - DNA, 22 bp, Artificial Sequence
  chemically synthesized
gatcagatcaaatagtgtgtct

SEQ ID NO: 1006580 - DNA, 22 bp, Artificial Sequence
  chemically synthesized
atcagatcaaatagtgtgtctt

SEQ ID NO: 1006581 - DNA, 22 bp, Artificial Sequence
  chemically synthesized
tacagggaaaataagacacact

SEQ ID NO: 1006582 - DNA, 22 bp, Artificial Sequence
  chemically synthesized
caaataattctacagggaaaat

SEQ ID NO: 1006583 - DNA, 22 bp, Artificial Sequence
  chemically synthesized
ccaaataattctacagggaaaa

SEQ ID NO: 1006584 - DNA, 22 bp, Artificial Sequence
  chemically synthesized
attttccctgtagaattatttg

SEQ ID NO: 1006585 - DNA, 22 bp, Artificial Sequence
  chemically synthesized
ttttccctgtagaattatttgg

SEQ ID NO: 1006586 - DNA, 22 bp, Artificial Sequence
  chemically synthesized
tccctgtagaattatttggaaa

SEQ ID NO: 1006587 - DNA, 22 bp, Artificial Sequence
  chemically synthesized
ccctgtagaattatttggaaat

SEQ ID NO: 1006588 - DNA, 22 bp, Artificial Sequence
  chemically synthesized
cctgtagaattatttggaaatt

SEQ ID NO: 1006589 - DNA, 22 bp, Artificial Sequence
  chemically synthesized
tagaattatttggaaattttct

SEQ ID NO: 1006590 - DNA, 22 bp, Artificial Sequence
  chemically synthesized
atgaaaacataaacagaaaatt

SEQ ID NO: 1006591 - DNA, 22 bp, Artificial Sequence
  chemically synthesized
tttggaaattttctgtttatgt

SEQ ID NO: 1006592 - DNA, 22 bp, Artificial Sequence
  chemically synthesized
ggaaattttctgtttatgtttt

SEQ ID NO: 1006593 - DNA, 22 bp, Artificial Sequence
  chemically synthesized
gaaattttctgtttatgttttc

SEQ ID NO: 1006594 - DNA, 22 bp, Artificial Sequence
  chemically synthesized
tctgtttatgttttcatgagct

SEQ ID NO: 1006595 - DNA, 22 bp, Artificial Sequence
  chemically synthesized
cccaaatcccaaagctcatgaa

SEQ ID NO: 1006596 - DNA, 22 bp, Artificial Sequence
  chemically synthesized
ctgtttatgttttcatgagctt

SEQ ID NO: 1006597 - DNA, 22 bp, Artificial Sequence
  chemically synthesized
ccccaaatcccaaagctcatga

SEQ ID NO: 1006598 - DNA, 22 bp, Artificial Sequence
  chemically synthesized
tgtttatgttttcatgagcttt

SEQ ID NO: 1006599 - DNA, 22 bp, Artificial Sequence
  chemically synthesized
ttccccaaatcccaaagctcat

SEQ ID NO: 1006600 - DNA, 22 bp, Artificial Sequence
  chemically synthesized
tttatgttttcatgagctttgg

SEQ ID NO: 1006601 - DNA, 22 bp, Artificial Sequence
  chemically synthesized
atgttttcatgagctttgggat

SEQ ID NO: 1006602 - DNA, 22 bp, Artificial Sequence
  chemically synthesized
tgttttcatgagctttgggatt

SEQ ID NO: 1006603 - DNA, 22 bp, Artificial Sequence
  chemically synthesized
aaattcttccccaaatcccaaa

SEQ ID NO: 1006604 - DNA, 22 bp, Artificial Sequence
  chemically synthesized
tcatgagctttgggatttgggg

SEQ ID NO: 1006605 - DNA, 22 bp, Artificial Sequence
  chemically synthesized
catgagctttgggatttgggga

SEQ ID NO: 1006606 - DNA, 22 bp, Artificial Sequence
  chemically synthesized
atgagctttgggatttggggaa

SEQ ID NO: 1006607 - DNA, 22 bp, Artificial Sequence
  chemically synthesized
tgggatttggggaagaatttca

SEQ ID NO: 1006608 - DNA, 22 bp, Artificial Sequence
  chemically synthesized
agtcaaaaatgctgaaattctt

SEQ ID NO: 1006609 - DNA, 22 bp, Artificial Sequence
  chemically synthesized
gggatttggggaagaatttcag

SEQ ID NO: 1006610 - DNA, 22 bp, Artificial Sequence
  chemically synthesized
aagtcaaaaatgctgaaattct

SEQ ID NO: 1006611 - DNA, 22 bp, Artificial Sequence
  chemically synthesized
ggatttggggaagaatttcagc

SEQ ID NO: 1006612 - DNA, 22 bp, Artificial Sequence
  chemically synthesized
tatcttaagtcaaaaatgctga

SEQ ID NO: 1006613 - DNA, 22 bp, Artificial Sequence
  chemically synthesized
ggggaagaatttcagcattttt

SEQ ID NO: 1006614 - DNA, 22 bp, Artificial Sequence
  chemically synthesized
gggaagaatttcagcatttttg

SEQ ID NO: 1006615 - DNA, 22 bp, Artificial Sequence
  chemically synthesized
cagcatttttgacttaagatat

SEQ ID NO: 1006616 - DNA, 22 bp, Artificial Sequence
  chemically synthesized
agtgaaccaactatatcttaag

SEQ ID NO: 1006617 - DNA, 22 bp, Artificial Sequence
  chemically synthesized
agcatttttgacttaagatata

SEQ ID NO: 1006618 - DNA, 22 bp, Artificial Sequence
  chemically synthesized
ggctaagtgaaccaactatatc

SEQ ID NO: 1006619 - DNA, 22 bp, Artificial Sequence
  chemically synthesized
ttgacttaagatatagttggtt

SEQ ID NO: 1006620 - DNA, 22 bp, Artificial Sequence
  chemically synthesized
ctgggctaagtgaaccaactat

SEQ ID NO: 1006621 - DNA, 22 bp, Artificial Sequence
  chemically synthesized
tgacttaagatatagttggttc

SEQ ID NO: 1006622 - DNA, 22 bp, Artificial Sequence
  chemically synthesized
gacttaagatatagttggttca

SEQ ID NO: 1006623 - DNA, 22 bp, Artificial Sequence
  chemically synthesized
acttaagatatagttggttcac

SEQ ID NO: 1006624 - DNA, 22 bp, Artificial Sequence
  chemically synthesized
actgctgggctaagtgaaccaa

SEQ ID NO: 1006625 - DNA, 22 bp, Artificial Sequence
  chemically synthesized
aagatatagttggttcacttag

SEQ ID NO: 1006626 - DNA, 22 bp, Artificial Sequence
  chemically synthesized
agatatagttggttcacttagc

SEQ ID NO: 1006627 - DNA, 22 bp, Artificial Sequence
  chemically synthesized
aagttcactgctgggctaagtg

SEQ ID NO: 1006628 - DNA, 22 bp, Artificial Sequence
  chemically synthesized
accccctgaagttcactgctgg

SEQ ID NO: 1006629 - DNA, 22 bp, Artificial Sequence
  chemically synthesized
gttcacttagcccagcagtgaa

SEQ ID NO: 1006630 - DNA, 22 bp, Artificial Sequence
  chemically synthesized
ttgaccccctgaagttcactgc

SEQ ID NO: 1006631 - DNA, 22 bp, Artificial Sequence
  chemically synthesized
acttagcccagcagtgaacttc

SEQ ID NO: 1006632 - DNA, 22 bp, Artificial Sequence
  chemically synthesized
agcccagcagtgaacttcaggg

SEQ ID NO: 1006633 - DNA, 22 bp, Artificial Sequence
  chemically synthesized
gcccagcagtgaacttcagggg

SEQ ID NO: 1006634 - DNA, 22 bp, Artificial Sequence
  chemically synthesized
catgctattgaccccctgaagt

SEQ ID NO: 1006635 - DNA, 22 bp, Artificial Sequence
  chemically synthesized
gcatgctattgaccccctgaag

SEQ ID NO: 1006636 - DNA, 22 bp, Artificial Sequence
  chemically synthesized
aatacatatttgcatgctattg

SEQ ID NO: 1006637 - DNA, 22 bp, Artificial Sequence
  chemically synthesized
aaatacatatttgcatgctatt

SEQ ID NO: 1006638 - DNA, 22 bp, Artificial Sequence
  chemically synthesized
cagggggtcaatagcatgcaaa

SEQ ID NO: 1006639 - DNA, 22 bp, Artificial Sequence
  chemically synthesized
agggggtcaatagcatgcaaat

SEQ ID NO: 1006640 - DNA, 22 bp, Artificial Sequence
  chemically synthesized
atatttaaatacatatttgcat

SEQ ID NO: 1006641 - DNA, 22 bp, Artificial Sequence
  chemically synthesized
aatatttaaatacatatttgca

SEQ ID NO: 1006642 - DNA, 22 bp, Artificial Sequence
  chemically synthesized
acagaaacaaaaatgtttaata

SEQ ID NO: 1006643 - DNA, 22 bp, Artificial Sequence
  chemically synthesized
atgttaacagaaacaaaaatgt

SEQ ID NO: 1006644 - DNA, 22 bp, Artificial Sequence
  chemically synthesized
gatgttaacagaaacaaaaatg

SEQ ID NO: 1006645 - DNA, 22 bp, Artificial Sequence
  chemically synthesized
tgatgttaacagaaacaaaaat

SEQ ID NO: 1006646 - DNA, 22 bp, Artificial Sequence
  chemically synthesized
aaatattaaacatttttgtttc

SEQ ID NO: 1006647 - DNA, 22 bp, Artificial Sequence
  chemically synthesized
ttgatgttaacagaaacaaaaa

SEQ ID NO: 1006648 - DNA, 22 bp, Artificial Sequence
  chemically synthesized
aatattaaacatttttgtttct

SEQ ID NO: 1006649 - DNA, 22 bp, Artificial Sequence
  chemically synthesized
aacatttttgtttctgttaaca

SEQ ID NO: 1006650 - DNA, 22 bp, Artificial Sequence
  chemically synthesized
ttgtttctgttaacatcaaaaa

SEQ ID NO: 1006651 - DNA, 22 bp, Artificial Sequence
  chemically synthesized
tgtttctgttaacatcaaaaat

SEQ ID NO: 1006652 - DNA, 22 bp, Artificial Sequence
  chemically synthesized
aatgtccaataaatttttgatg

SEQ ID NO: 1006653 - DNA, 22 bp, Artificial Sequence
  chemically synthesized
gtttctgttaacatcaaaaatt

SEQ ID NO: 1006654 - DNA, 22 bp, Artificial Sequence
  chemically synthesized
tttctgttaacatcaaaaattt

SEQ ID NO: 1006655 - DNA, 22 bp, Artificial Sequence
  chemically synthesized
ctgttaacatcaaaaatttatt

SEQ ID NO: 1006656 - DNA, 22 bp, Artificial Sequence
  chemically synthesized
tgttaacatcaaaaatttattg

SEQ ID NO: 1006657 - DNA, 22 bp, Artificial Sequence
  chemically synthesized
ttaacatcaaaaatttattgga

SEQ ID NO: 1006658 - DNA, 22 bp, Artificial Sequence
  chemically synthesized
aaagattaaatgtccaataaat

SEQ ID NO: 1006659 - DNA, 22 bp, Artificial Sequence
  chemically synthesized
acatcaaaaatttattggacat

SEQ ID NO: 1006660 - DNA, 22 bp, Artificial Sequence
  chemically synthesized
ttaaaagattaaatgtccaata

SEQ ID NO: 1006661 - DNA, 22 bp, Artificial Sequence
  chemically synthesized
tgttaaaagattaaatgtccaa

SEQ ID NO: 1006662 - DNA, 22 bp, Artificial Sequence
  chemically synthesized
ctgttaaaagattaaatgtcca

SEQ ID NO: 1006663 - DNA, 22 bp, Artificial Sequence
  chemically synthesized
tctgttaaaagattaaatgtcc

SEQ ID NO: 1006664 - DNA, 22 bp, Artificial Sequence
  chemically synthesized
attggacatttaatcttttaac

SEQ ID NO: 1006665 - DNA, 22 bp, Artificial Sequence
  chemically synthesized
ttggacatttaatcttttaaca

SEQ ID NO: 1006666 - DNA, 22 bp, Artificial Sequence
  chemically synthesized
gacatttaatcttttaacagaa

SEQ ID NO: 1006667 - DNA, 22 bp, Artificial Sequence
  chemically synthesized
aatcttttaacagaaaatatct

SEQ ID NO: 1006668 - DNA, 22 bp, Artificial Sequence
  chemically synthesized
atcttttaacagaaaatatctc

SEQ ID NO: 1006669 - DNA, 22 bp, Artificial Sequence
  chemically synthesized
atatgaaaccatgagatatttt

SEQ ID NO: 1006670 - DNA, 22 bp, Artificial Sequence
  chemically synthesized
catatgaaaccatgagatattt

SEQ ID NO: 1006671 - DNA, 22 bp, Artificial Sequence
  chemically synthesized
tcatatgaaaccatgagatatt

SEQ ID NO: 1006672 - DNA, 22 bp, Artificial Sequence
  chemically synthesized
ttcatatgaaaccatgagatat

SEQ ID NO: 1006673 - DNA, 22 bp, Artificial Sequence
  chemically synthesized
ttaacagaaaatatctcatggt

SEQ ID NO: 1006674 - DNA, 22 bp, Artificial Sequence
  chemically synthesized
taacagaaaatatctcatggtt

SEQ ID NO: 1006675 - DNA, 22 bp, Artificial Sequence
  chemically synthesized
aacagaaaatatctcatggttt

SEQ ID NO: 1006676 - DNA, 22 bp, Artificial Sequence
  chemically synthesized
acagaaaatatctcatggtttc

SEQ ID NO: 1006677 - DNA, 22 bp, Artificial Sequence
  chemically synthesized
atggtttcatatgaaaagtgga

SEQ ID NO: 1006678 - DNA, 22 bp, Artificial Sequence
  chemically synthesized
catatgaaaagtggatgttctt

SEQ ID NO: 1006679 - DNA, 22 bp, Artificial Sequence
  chemically synthesized
atatgaaaagtggatgttcttc

SEQ ID NO: 1006680 - DNA, 22 bp, Artificial Sequence
  chemically synthesized
aaataaataaaatgtgaagaac

SEQ ID NO: 1006681 - DNA, 22 bp, Artificial Sequence
  chemically synthesized
gaaataaataaaatgtgaagaa

SEQ ID NO: 1006682 - DNA, 22 bp, Artificial Sequence
  chemically synthesized
tttgaaataaataaaatgtgaa

SEQ ID NO: 1006683 - DNA, 22 bp, Artificial Sequence
  chemically synthesized
ttcacattttatttatttcaaa

SEQ ID NO: 1006684 - DNA, 22 bp, Artificial Sequence
  chemically synthesized
cacattttatttatttcaaata

SEQ ID NO: 1006685 - DNA, 22 bp, Artificial Sequence
  chemically synthesized
acattttatttatttcaaataa

SEQ ID NO: 1006686 - DNA, 22 bp, Artificial Sequence
  chemically synthesized
tatttatttcaaataatttaca

SEQ ID NO: 1006687 - DNA, 22 bp, Artificial Sequence
  chemically synthesized
atttatttcaaataatttacat

SEQ ID NO: 1006688 - DNA, 22 bp, Artificial Sequence
  chemically synthesized
tttatttcaaataatttacatt

SEQ ID NO: 1006689 - DNA, 22 bp, Artificial Sequence
  chemically synthesized
atttcaaataatttacatttat

SEQ ID NO: 1006690 - DNA, 22 bp, Artificial Sequence
  chemically synthesized
caataagtaaaaataaatgtaa

SEQ ID NO: 1006691 - DNA, 22 bp, Artificial Sequence
  chemically synthesized
tttcaaataatttacatttatt

SEQ ID NO: 1006692 - DNA, 22 bp, Artificial Sequence
  chemically synthesized
caaataatttacatttattttt

SEQ ID NO: 1006693 - DNA, 22 bp, Artificial Sequence
  chemically synthesized
aaataatttacatttattttta

SEQ ID NO: 1006694 - DNA, 22 bp, Artificial Sequence
  chemically synthesized
caattccaataagtaaaaataa

SEQ ID NO: 1006695 - DNA, 22 bp, Artificial Sequence
  chemically synthesized
ccaattccaataagtaaaaata

SEQ ID NO: 1006696 - DNA, 22 bp, Artificial Sequence
  chemically synthesized
tccaattccaataagtaaaaat

SEQ ID NO: 1006697 - DNA, 22 bp, Artificial Sequence
  chemically synthesized
tattttccaattccaataagta

SEQ ID NO: 1006698 - DNA, 22 bp, Artificial Sequence
  chemically synthesized
acatttatttttacttattgga

SEQ ID NO: 1006699 - DNA, 22 bp, Artificial Sequence
  chemically synthesized
atattttccaattccaataagt

SEQ ID NO: 1006700 - DNA, 22 bp, Artificial Sequence
  chemically synthesized
catttatttttacttattggaa

SEQ ID NO: 1006701 - DNA, 22 bp, Artificial Sequence
  chemically synthesized
atttttacttattggaattgga

SEQ ID NO: 1006702 - DNA, 22 bp, Artificial Sequence
  chemically synthesized
tttttacttattggaattggaa

SEQ ID NO: 1006703 - DNA, 22 bp, Artificial Sequence
  chemically synthesized
ttacttattggaattggaaaat

SEQ ID NO: 1006704 - DNA, 22 bp, Artificial Sequence
  chemically synthesized
tacttattggaattggaaaata

SEQ ID NO: 1006705 - DNA, 22 bp, Artificial Sequence
  chemically synthesized
acttattggaattggaaaatat

SEQ ID NO: 1006706 - DNA, 22 bp, Artificial Sequence
  chemically synthesized
cttattggaattggaaaatata

SEQ ID NO: 1006707 - DNA, 22 bp, Artificial Sequence
  chemically synthesized
attggaattggaaaatataagt

SEQ ID NO: 1006708 - DNA, 22 bp, Artificial Sequence
  chemically synthesized
ttggaattggaaaatataagtt

SEQ ID NO: 1006709 - DNA, 22 bp, Artificial Sequence
  chemically synthesized
gaattggaaaatataagttgta

SEQ ID NO: 1006710 - DNA, 22 bp, Artificial Sequence
  chemically synthesized
tataatacgtgatatatacaac

SEQ ID NO: 1006711 - DNA, 22 bp, Artificial Sequence
  chemically synthesized
gaaaatataagttgtatatatc

SEQ ID NO: 1006712 - DNA, 22 bp, Artificial Sequence
  chemically synthesized
aatacaatgtgttgtataatac

SEQ ID NO: 1006713 - DNA, 22 bp, Artificial Sequence
  chemically synthesized
caatacaatgtgttgtataata

SEQ ID NO: 1006714 - DNA, 22 bp, Artificial Sequence
  chemically synthesized
tatatatcacgtattatacaac

SEQ ID NO: 1006715 - DNA, 22 bp, Artificial Sequence
  chemically synthesized
tcaatacaatgtgttgtataat

SEQ ID NO: 1006716 - DNA, 22 bp, Artificial Sequence
  chemically synthesized
ttcaatacaatgtgttgtataa

SEQ ID NO: 1006717 - DNA, 22 bp, Artificial Sequence
  chemically synthesized
gtccacatttttcaatacaatg

SEQ ID NO: 1006718 - DNA, 22 bp, Artificial Sequence
  chemically synthesized
gctagtccacatttttcaatac

SEQ ID NO: 1006719 - DNA, 22 bp, Artificial Sequence
  chemically synthesized
tacaacacattgtattgaaaaa

SEQ ID NO: 1006720 - DNA, 22 bp, Artificial Sequence
  chemically synthesized
agctagtccacatttttcaata

SEQ ID NO: 1006721 - DNA, 22 bp, Artificial Sequence
  chemically synthesized
tagctagtccacatttttcaat

SEQ ID NO: 1006722 - DNA, 22 bp, Artificial Sequence
  chemically synthesized
attttagctagtccacattttt

SEQ ID NO: 1006723 - DNA, 22 bp, Artificial Sequence
  chemically synthesized
gctcattttagctagtccacat

SEQ ID NO: 1006724 - DNA, 22 bp, Artificial Sequence
  chemically synthesized
tattgaaaaatgtggactagct

SEQ ID NO: 1006725 - DNA, 22 bp, Artificial Sequence
  chemically synthesized
attagctcattttagctagtcc

SEQ ID NO: 1006726 - DNA, 22 bp, Artificial Sequence
  chemically synthesized
aaaaatgtggactagctaaaat

SEQ ID NO: 1006727 - DNA, 22 bp, Artificial Sequence
  chemically synthesized
gctaaaatgagctaattaacat

SEQ ID NO: 1006728 - DNA, 22 bp, Artificial Sequence
  chemically synthesized
aaatgagctaattaacatatgc

SEQ ID NO: 1006729 - DNA, 22 bp, Artificial Sequence
  chemically synthesized
attaacatatgcattacctcac

SEQ ID NO: 1006730 - DNA, 22 bp, Artificial Sequence
  chemically synthesized
acatatgcattacctcacatac

SEQ ID NO: 1006731 - DNA, 22 bp, Artificial Sequence
  chemically synthesized
accgcaaaaaaatagtatgtga

SEQ ID NO: 1006732 - DNA, 22 bp, Artificial Sequence
  chemically synthesized
tcaccgcaaaaaaatagtatgt

SEQ ID NO: 1006733 - DNA, 22 bp, Artificial Sequence
  chemically synthesized
agtgttctcaccgcaaaaaaat

SEQ ID NO: 1006734 - DNA, 22 bp, Artificial Sequence
  chemically synthesized
cctcacatactatttttttgcg

SEQ ID NO: 1006735 - DNA, 22 bp, Artificial Sequence
  chemically synthesized
aagtgttctcaccgcaaaaaaa

SEQ ID NO: 1006736 - DNA, 22 bp, Artificial Sequence
  chemically synthesized
taagtgttctcaccgcaaaaaa

SEQ ID NO: 1006737 - DNA, 22 bp, Artificial Sequence
  chemically synthesized
acatactatttttttgcggtga

SEQ ID NO: 1006738 - DNA, 22 bp, Artificial Sequence
  chemically synthesized
tttttttgcggtgagaacactt

SEQ ID NO: 1006739 - DNA, 22 bp, Artificial Sequence
  chemically synthesized
agagagtcgattttaagtgttc

SEQ ID NO: 1006740 - DNA, 22 bp, Artificial Sequence
  chemically synthesized
ttttgcggtgagaacacttaaa

SEQ ID NO: 1006741 - DNA, 22 bp, Artificial Sequence
  chemically synthesized
tttgcggtgagaacacttaaaa

SEQ ID NO: 1006742 - DNA, 22 bp, Artificial Sequence
  chemically synthesized
ttgcggtgagaacacttaaaat

SEQ ID NO: 1006743 - DNA, 22 bp, Artificial Sequence
  chemically synthesized
ctaagagagtcgattttaagtg

SEQ ID NO: 1006744 - DNA, 22 bp, Artificial Sequence
  chemically synthesized
tgcggtgagaacacttaaaatc

SEQ ID NO: 1006745 - DNA, 22 bp, Artificial Sequence
  chemically synthesized
gcggtgagaacacttaaaatcg

SEQ ID NO: 1006746 - DNA, 22 bp, Artificial Sequence
  chemically synthesized
cggtgagaacacttaaaatcga

SEQ ID NO: 1006747 - DNA, 22 bp, Artificial Sequence
  chemically synthesized
gaaaattactaagagagtcgat

SEQ ID NO: 1006748 - DNA, 22 bp, Artificial Sequence
  chemically synthesized
cgaaaattactaagagagtcga

SEQ ID NO: 1006749 - DNA, 22 bp, Artificial Sequence
  chemically synthesized
tcgaaaattactaagagagtcg

SEQ ID NO: 1006750 - DNA, 22 bp, Artificial Sequence
  chemically synthesized
aaaatcgactctcttagtaatt

SEQ ID NO: 1006751 - DNA, 22 bp, Artificial Sequence
  chemically synthesized
aaatcgactctcttagtaattt

SEQ ID NO: 1006752 - DNA, 22 bp, Artificial Sequence
  chemically synthesized
ataataatatgttttcgaaaat

SEQ ID NO: 1006753 - DNA, 22 bp, Artificial Sequence
  chemically synthesized
tcttagtaattttcgaaaacat

SEQ ID NO: 1006754 - DNA, 22 bp, Artificial Sequence
  chemically synthesized
ttagtaattttcgaaaacatat

SEQ ID NO: 1006755 - DNA, 22 bp, Artificial Sequence
  chemically synthesized
taattaataataatatgttttc

SEQ ID NO: 1006756 - DNA, 22 bp, Artificial Sequence
  chemically synthesized
agtaattttcgaaaacatatta

SEQ ID NO: 1006757 - DNA, 22 bp, Artificial Sequence
  chemically synthesized
gtaattttcgaaaacatattat

SEQ ID NO: 1006758 - DNA, 22 bp, Artificial Sequence
  chemically synthesized
tcgaaaacatattattattaat

SEQ ID NO: 1006759 - DNA, 22 bp, Artificial Sequence
  chemically synthesized
cgaaaacatattattattaatt

SEQ ID NO: 1006760 - DNA, 22 bp, Artificial Sequence
  chemically synthesized
gaaaacatattattattaatta

SEQ ID NO: 1006761 - DNA, 22 bp, Artificial Sequence
  chemically synthesized
tacgacatagtgactataatta

SEQ ID NO: 1006762 - DNA, 22 bp, Artificial Sequence
  chemically synthesized
gtacgacatagtgactataatt

SEQ ID NO: 1006763 - DNA, 22 bp, Artificial Sequence
  chemically synthesized
tgtacgacatagtgactataat

SEQ ID NO: 1006764 - DNA, 22 bp, Artificial Sequence
  chemically synthesized
ttgtacgacatagtgactataa

SEQ ID NO: 1006765 - DNA, 22 bp, Artificial Sequence
  chemically synthesized
ttattaattatagtcactatgt

SEQ ID NO: 1006766 - DNA, 22 bp, Artificial Sequence
  chemically synthesized
ttaattatagtcactatgtcgt

SEQ ID NO: 1006767 - DNA, 22 bp, Artificial Sequence
  chemically synthesized
atgagatcttttgtacgacata

SEQ ID NO: 1006768 - DNA, 22 bp, Artificial Sequence
  chemically synthesized
attatagtcactatgtcgtaca

SEQ ID NO: 1006769 - DNA, 22 bp, Artificial Sequence
  chemically synthesized
tagtcactatgtcgtacaaaag

SEQ ID NO: 1006770 - DNA, 22 bp, Artificial Sequence
  chemically synthesized
tgtcgtacaaaagatctcatga

SEQ ID NO: 1006771 - DNA, 22 bp, Artificial Sequence
  chemically synthesized
gataggagacataagttcatga

SEQ ID NO: 1006772 - DNA, 22 bp, Artificial Sequence
  chemically synthesized
agttagataggagacataagtt

SEQ ID NO: 1006773 - DNA, 22 bp, Artificial Sequence
  chemically synthesized
cagttagataggagacataagt

SEQ ID NO: 1006774 - DNA, 22 bp, Artificial Sequence
  chemically synthesized
atgaacttatgtctcctatcta

SEQ ID NO: 1006775 - DNA, 22 bp, Artificial Sequence
  chemically synthesized
atgtctcctatctaactgaaat

SEQ ID NO: 1006776 - DNA, 22 bp, Artificial Sequence
  chemically synthesized
tgtctcctatctaactgaaatt

SEQ ID NO: 1006777 - DNA, 22 bp, Artificial Sequence
  chemically synthesized
gtcagaggatacaaaatttcag

SEQ ID NO: 1006778 - DNA, 22 bp, Artificial Sequence
  chemically synthesized
ctatctaactgaaattttgtat

SEQ ID NO: 1006779 - DNA, 22 bp, Artificial Sequence
  chemically synthesized
tgttggtcagaggatacaaaat

SEQ ID NO: 1006780 - DNA, 22 bp, Artificial Sequence
  chemically synthesized
tctaactgaaattttgtatcct

SEQ ID NO: 1006781 - DNA, 22 bp, Artificial Sequence
  chemically synthesized
actgaaattttgtatcctctga

SEQ ID NO: 1006782 - DNA, 22 bp, Artificial Sequence
  chemically synthesized
aaattttgtatcctctgaccaa

SEQ ID NO: 1006783 - DNA, 22 bp, Artificial Sequence
  chemically synthesized
tgtatcctctgaccaacacagc

SEQ ID NO: 1006784 - DNA, 22 bp, Artificial Sequence
  chemically synthesized
gtatcctctgaccaacacagcc

SEQ ID NO: 1006785 - DNA, 22 bp, Artificial Sequence
  chemically synthesized
tatcctctgaccaacacagccc

SEQ ID NO: 1006786 - DNA, 22 bp, Artificial Sequence
  chemically synthesized
aaatcaaaggatacaaaagggc

SEQ ID NO: 1006787 - DNA, 22 bp, Artificial Sequence
  chemically synthesized
tgaccaacacagcccttttgta

SEQ ID NO: 1006788 - DNA, 22 bp, Artificial Sequence
  chemically synthesized
aaaatcaaaggatacaaaaggg

SEQ ID NO: 1006789 - DNA, 22 bp, Artificial Sequence
  chemically synthesized
taaaatcaaaggatacaaaagg

SEQ ID NO: 1006790 - DNA, 22 bp, Artificial Sequence
  chemically synthesized
accaacacagcccttttgtatc

SEQ ID NO: 1006791 - DNA, 22 bp, Artificial Sequence
  chemically synthesized
ttaaaatcaaaggatacaaaag

SEQ ID NO: 1006792 - DNA, 22 bp, Artificial Sequence
  chemically synthesized
tttaaaatcaaaggatacaaaa

SEQ ID NO: 1006793 - DNA, 22 bp, Artificial Sequence
  chemically synthesized
ttttaaaatcaaaggatacaaa

SEQ ID NO: 1006794 - DNA, 22 bp, Artificial Sequence
  chemically synthesized
aacaacgccttttttaaaatca

SEQ ID NO: 1006795 - DNA, 22 bp, Artificial Sequence
  chemically synthesized
ttgtatcctttgattttaaaaa

SEQ ID NO: 1006796 - DNA, 22 bp, Artificial Sequence
  chemically synthesized
tgtatcctttgattttaaaaaa

SEQ ID NO: 1006797 - DNA, 22 bp, Artificial Sequence
  chemically synthesized
gtatcctttgattttaaaaaag

SEQ ID NO: 1006798 - DNA, 22 bp, Artificial Sequence
  chemically synthesized
tatcctttgattttaaaaaagg

SEQ ID NO: 1006799 - DNA, 22 bp, Artificial Sequence
  chemically synthesized
aaattaaacaacgcctttttta

SEQ ID NO: 1006800 - DNA, 22 bp, Artificial Sequence
  chemically synthesized
ttaaaattaaacaacgcctttt

SEQ ID NO: 1006801 - DNA, 22 bp, Artificial Sequence
  chemically synthesized
tgattttaaaaaaggcgttgtt

SEQ ID NO: 1006802 - DNA, 22 bp, Artificial Sequence
  chemically synthesized
gattttaaaaaaggcgttgttt

SEQ ID NO: 1006803 - DNA, 22 bp, Artificial Sequence
  chemically synthesized
attttaaaaaaggcgttgttta

SEQ ID NO: 1006804 - DNA, 22 bp, Artificial Sequence
  chemically synthesized
acactgttaaaattaaacaacg

SEQ ID NO: 1006805 - DNA, 22 bp, Artificial Sequence
  chemically synthesized
gacactgttaaaattaaacaac

SEQ ID NO: 1006806 - DNA, 22 bp, Artificial Sequence
  chemically synthesized
taaaaaaggcgttgtttaattt

SEQ ID NO: 1006807 - DNA, 22 bp, Artificial Sequence
  chemically synthesized
aaaaaaggcgttgtttaatttt

SEQ ID NO: 1006808 - DNA, 22 bp, Artificial Sequence
  chemically synthesized
aaaaaggcgttgtttaatttta

SEQ ID NO: 1006809 - DNA, 22 bp, Artificial Sequence
  chemically synthesized
aaagtcttgacactgttaaaat

SEQ ID NO: 1006810 - DNA, 22 bp, Artificial Sequence
  chemically synthesized
tttaattttaacagtgtcaaga

SEQ ID NO: 1006811 - DNA, 22 bp, Artificial Sequence
  chemically synthesized
gtatcattaaaagtcttgacac

SEQ ID NO: 1006812 - DNA, 22 bp, Artificial Sequence
  chemically synthesized
aattttaacagtgtcaagactt

SEQ ID NO: 1006813 - DNA, 22 bp, Artificial Sequence
  chemically synthesized
attttaacagtgtcaagacttt

SEQ ID NO: 1006814 - DNA, 22 bp, Artificial Sequence
  chemically synthesized
taacagtgtcaagacttttaat

SEQ ID NO: 1006815 - DNA, 22 bp, Artificial Sequence
  chemically synthesized
aacagtgtcaagacttttaatg

SEQ ID NO: 1006816 - DNA, 22 bp, Artificial Sequence
  chemically synthesized
aggacctggtatcattaaaagt

SEQ ID NO: 1006817 - DNA, 22 bp, Artificial Sequence
  chemically synthesized
acagtgtcaagacttttaatga

SEQ ID NO: 1006818 - DNA, 22 bp, Artificial Sequence
  chemically synthesized
caggacctggtatcattaaaag

SEQ ID NO: 1006819 - DNA, 22 bp, Artificial Sequence
  chemically synthesized
tcaggacctggtatcattaaaa

SEQ ID NO: 1006820 - DNA, 22 bp, Artificial Sequence
  chemically synthesized
acattttcaggacctggtatca

SEQ ID NO: 1006821 - DNA, 22 bp, Artificial Sequence
  chemically synthesized
ttaatgataccaggtcctgaaa

SEQ ID NO: 1006822 - DNA, 22 bp, Artificial Sequence
  chemically synthesized
taatgataccaggtcctgaaaa

SEQ ID NO: 1006823 - DNA, 22 bp, Artificial Sequence
  chemically synthesized
aatgataccaggtcctgaaaat

SEQ ID NO: 1006824 - DNA, 22 bp, Artificial Sequence
  chemically synthesized
atgataccaggtcctgaaaatg

SEQ ID NO: 1006825 - DNA, 22 bp, Artificial Sequence
  chemically synthesized
tatgggaaacacagtctgacat

SEQ ID NO: 1006826 - DNA, 22 bp, Artificial Sequence
  chemically synthesized
aaaatgtcagactgtgtttccc

SEQ ID NO: 1006827 - DNA, 22 bp, Artificial Sequence
  chemically synthesized
aagaaactgtatgggaaacaca

SEQ ID NO: 1006828 - DNA, 22 bp, Artificial Sequence
  chemically synthesized
atgctaaagaaactgtatggga

SEQ ID NO: 1006829 - DNA, 22 bp, Artificial Sequence
  chemically synthesized
catgctaaagaaactgtatggg

SEQ ID NO: 1006830 - DNA, 22 bp, Artificial Sequence
  chemically synthesized
tcatgctaaagaaactgtatgg

SEQ ID NO: 1006831 - DNA, 22 bp, Artificial Sequence
  chemically synthesized
tgtttcccatacagtttcttta

SEQ ID NO: 1006832 - DNA, 22 bp, Artificial Sequence
  chemically synthesized
cccatacagtttctttagcatg

SEQ ID NO: 1006833 - DNA, 22 bp, Artificial Sequence
  chemically synthesized
ccatacagtttctttagcatga

SEQ ID NO: 1006834 - DNA, 22 bp, Artificial Sequence
  chemically synthesized
aaatgcatacatcccctttcat

SEQ ID NO: 1006835 - DNA, 22 bp, Artificial Sequence
  chemically synthesized
caaatgcatacatcccctttca

SEQ ID NO: 1006836 - DNA, 22 bp, Artificial Sequence
  chemically synthesized
ctttagcatgaaaggggatgta

SEQ ID NO: 1006837 - DNA, 22 bp, Artificial Sequence
  chemically synthesized
tttagcatgaaaggggatgtat

SEQ ID NO: 1006838 - DNA, 22 bp, Artificial Sequence
  chemically synthesized
tatttcaaatgcatacatcccc

SEQ ID NO: 1006839 - DNA, 22 bp, Artificial Sequence
  chemically synthesized
tagcatgaaaggggatgtatgc

SEQ ID NO: 1006840 - DNA, 22 bp, Artificial Sequence
  chemically synthesized
agcatgaaaggggatgtatgca

SEQ ID NO: 1006841 - DNA, 22 bp, Artificial Sequence
  chemically synthesized
ctatatttcaaatgcatacatc

SEQ ID NO: 1006842 - DNA, 22 bp, Artificial Sequence
  chemically synthesized
gcatgaaaggggatgtatgcat

SEQ ID NO: 1006843 - DNA, 22 bp, Artificial Sequence
  chemically synthesized
atcaactactatatttcaaatg

SEQ ID NO: 1006844 - DNA, 22 bp, Artificial Sequence
  chemically synthesized
aaagatgttcatcaactactat

SEQ ID NO: 1006845 - DNA, 22 bp, Artificial Sequence
  chemically synthesized
gaaatatagtagttgatgaaca

SEQ ID NO: 1006846 - DNA, 22 bp, Artificial Sequence
  chemically synthesized
aaatatagtagttgatgaacat

SEQ ID NO: 1006847 - DNA, 22 bp, Artificial Sequence
  chemically synthesized
aaaaatctaaaagatgttcatc

SEQ ID NO: 1006848 - DNA, 22 bp, Artificial Sequence
  chemically synthesized
ctgaaaaatctaaaagatgttc

SEQ ID NO: 1006849 - DNA, 22 bp, Artificial Sequence
  chemically synthesized
tactgaaaaatctaaaagatgt

SEQ ID NO: 1006850 - DNA, 22 bp, Artificial Sequence
  chemically synthesized
attctactgaaaaatctaaaag

SEQ ID NO: 1006851 - DNA, 22 bp, Artificial Sequence
  chemically synthesized
aattctactgaaaaatctaaaa

SEQ ID NO: 1006852 - DNA, 22 bp, Artificial Sequence
  chemically synthesized
taattctactgaaaaatctaaa

SEQ ID NO: 1006853 - DNA, 22 bp, Artificial Sequence
  chemically synthesized
atgaacatcttttagatttttc

SEQ ID NO: 1006854 - DNA, 22 bp, Artificial Sequence
  chemically synthesized
tcatccagttttaattctactg

SEQ ID NO: 1006855 - DNA, 22 bp, Artificial Sequence
  chemically synthesized
atcatccagttttaattctact

SEQ ID NO: 1006856 - DNA, 22 bp, Artificial Sequence
  chemically synthesized
ttagatttttcagtagaattaa

SEQ ID NO: 1006857 - DNA, 22 bp, Artificial Sequence
  chemically synthesized
tatcatccagttttaattctac

SEQ ID NO: 1006858 - DNA, 22 bp, Artificial Sequence
  chemically synthesized
tagatttttcagtagaattaaa

SEQ ID NO: 1006859 - DNA, 22 bp, Artificial Sequence
  chemically synthesized
ttatcatccagttttaattcta

SEQ ID NO: 1006860 - DNA, 22 bp, Artificial Sequence
  chemically synthesized
agatttttcagtagaattaaaa

SEQ ID NO: 1006861 - DNA, 22 bp, Artificial Sequence
  chemically synthesized
gatttttcagtagaattaaaac

SEQ ID NO: 1006862 - DNA, 22 bp, Artificial Sequence
  chemically synthesized
aatttttatcatccagttttaa

SEQ ID NO: 1006863 - DNA, 22 bp, Artificial Sequence
  chemically synthesized
ttcagtagaattaaaactggat

SEQ ID NO: 1006864 - DNA, 22 bp, Artificial Sequence
  chemically synthesized
tcagtagaattaaaactggatg

SEQ ID NO: 1006865 - DNA, 22 bp, Artificial Sequence
  chemically synthesized
cagtagaattaaaactggatga

SEQ ID NO: 1006866 - DNA, 22 bp, Artificial Sequence
  chemically synthesized
agtagaattaaaactggatgat

SEQ ID NO: 1006867 - DNA, 22 bp, Artificial Sequence
  chemically synthesized
atatgtgctgaatttttatcat

SEQ ID NO: 1006868 - DNA, 22 bp, Artificial Sequence
  chemically synthesized
aaactggatgataaaaattcag

SEQ ID NO: 1006869 - DNA, 22 bp, Artificial Sequence
  chemically synthesized
gatgataaaaattcagcacata

SEQ ID NO: 1006870 - DNA, 22 bp, Artificial Sequence
  chemically synthesized
gaatatagttgatatgtgctga

SEQ ID NO: 1006871 - DNA, 22 bp, Artificial Sequence
  chemically synthesized
ggaatatagttgatatgtgctg

SEQ ID NO: 1006872 - DNA, 22 bp, Artificial Sequence
  chemically synthesized
tggaatatagttgatatgtgct

SEQ ID NO: 1006873 - DNA, 22 bp, Artificial Sequence
  chemically synthesized
ttggaatatagttgatatgtgc

SEQ ID NO: 1006874 - DNA, 22 bp, Artificial Sequence
  chemically synthesized
atttttggaatatagttgatat

SEQ ID NO: 1006875 - DNA, 22 bp, Artificial Sequence
  chemically synthesized
ttgatttttggaatatagttga

SEQ ID NO: 1006876 - DNA, 22 bp, Artificial Sequence
  chemically synthesized
attgatttttggaatatagttg

SEQ ID NO: 1006877 - DNA, 22 bp, Artificial Sequence
  chemically synthesized
tattgatttttggaatatagtt

SEQ ID NO: 1006878 - DNA, 22 bp, Artificial Sequence
  chemically synthesized
ttattgatttttggaatatagt

SEQ ID NO: 1006879 - DNA, 22 bp, Artificial Sequence
  chemically synthesized
agcacatatcaactatattcca

SEQ ID NO: 1006880 - DNA, 22 bp, Artificial Sequence
  chemically synthesized
ggcacttttattgatttttgga

SEQ ID NO: 1006881 - DNA, 22 bp, Artificial Sequence
  chemically synthesized
ctaggcacttttattgattttt

SEQ ID NO: 1006882 - DNA, 22 bp, Artificial Sequence
  chemically synthesized
tcctaggcacttttattgattt

SEQ ID NO: 1006883 - DNA, 22 bp, Artificial Sequence
  chemically synthesized
ctcctaggcacttttattgatt

SEQ ID NO: 1006884 - DNA, 22 bp, Artificial Sequence
  chemically synthesized
tattccaaaaatcaataaaagt

SEQ ID NO: 1006885 - DNA, 22 bp, Artificial Sequence
  chemically synthesized
aatgtttctcctaggcactttt

SEQ ID NO: 1006886 - DNA, 22 bp, Artificial Sequence
  chemically synthesized
caaaaatcaataaaagtgccta

SEQ ID NO: 1006887 - DNA, 22 bp, Artificial Sequence
  chemically synthesized
aaatgtttctcctaggcacttt

SEQ ID NO: 1006888 - DNA, 22 bp, Artificial Sequence
  chemically synthesized
taaatgtttctcctaggcactt

SEQ ID NO: 1006889 - DNA, 22 bp, Artificial Sequence
  chemically synthesized
ttaaatgtttctcctaggcact

SEQ ID NO: 1006890 - DNA, 22 bp, Artificial Sequence
  chemically synthesized
accttttaaatgtttctcctag

SEQ ID NO: 1006891 - DNA, 22 bp, Artificial Sequence
  chemically synthesized
aaccttttaaatgtttctccta

SEQ ID NO: 1006892 - DNA, 22 bp, Artificial Sequence
  chemically synthesized
cttaaccttttaaatgtttctc

SEQ ID NO: 1006893 - DNA, 22 bp, Artificial Sequence
  chemically synthesized
ccttaaccttttaaatgtttct

SEQ ID NO: 1006894 - DNA, 22 bp, Artificial Sequence
  chemically synthesized
atttccttaaccttttaaatgt

SEQ ID NO: 1006895 - DNA, 22 bp, Artificial Sequence
  chemically synthesized
aatttccttaaccttttaaatg

SEQ ID NO: 1006896 - DNA, 22 bp, Artificial Sequence
  chemically synthesized
ttaatttccttaaccttttaaa

SEQ ID NO: 1006897 - DNA, 22 bp, Artificial Sequence
  chemically synthesized
cttaatttccttaaccttttaa

SEQ ID NO: 1006898 - DNA, 22 bp, Artificial Sequence
  chemically synthesized
tcttaatttccttaacctttta

SEQ ID NO: 1006899 - DNA, 22 bp, Artificial Sequence
  chemically synthesized
ggagaaacatttaaaaggttaa

SEQ ID NO: 1006900 - DNA, 22 bp, Artificial Sequence
  chemically synthesized
tccattttcttaatttccttaa

SEQ ID NO: 1006901 - DNA, 22 bp, Artificial Sequence
  chemically synthesized
atccattttcttaatttcctta

SEQ ID NO: 1006902 - DNA, 22 bp, Artificial Sequence
  chemically synthesized
tcttatccattttcttaatttc

SEQ ID NO: 1006903 - DNA, 22 bp, Artificial Sequence
  chemically synthesized
aaaaggttaaggaaattaagaa

SEQ ID NO: 1006904 - DNA, 22 bp, Artificial Sequence
  chemically synthesized
aaaggttaaggaaattaagaaa

SEQ ID NO: 1006905 - DNA, 22 bp, Artificial Sequence
  chemically synthesized
ttatcttatccattttcttaat

SEQ ID NO: 1006906 - DNA, 22 bp, Artificial Sequence
  chemically synthesized
attatcttatccattttcttaa

SEQ ID NO: 1006907 - DNA, 22 bp, Artificial Sequence
  chemically synthesized
tcttattatcttatccattttc

SEQ ID NO: 1006908 - DNA, 22 bp, Artificial Sequence
  chemically synthesized
aggaaattaagaaaatggataa

SEQ ID NO: 1006909 - DNA, 22 bp, Artificial Sequence
  chemically synthesized
aattatcttattatcttatcca

SEQ ID NO: 1006910 - DNA, 22 bp, Artificial Sequence
  chemically synthesized
aaattatcttattatcttatcc

SEQ ID NO: 1006911 - DNA, 22 bp, Artificial Sequence
  chemically synthesized
ttaaattatcttattatcttat

SEQ ID NO: 1006912 - DNA, 22 bp, Artificial Sequence
  chemically synthesized
cttaaattatcttattatctta

SEQ ID NO: 1006913 - DNA, 22 bp, Artificial Sequence
  chemically synthesized
tcttaaattatcttattatctt

SEQ ID NO: 1006914 - DNA, 22 bp, Artificial Sequence
  chemically synthesized
agaaaatggataagataataag

SEQ ID NO: 1006915 - DNA, 22 bp, Artificial Sequence
  chemically synthesized
ttcttaaattatcttattatct

SEQ ID NO: 1006916 - DNA, 22 bp, Artificial Sequence
  chemically synthesized
gataatttttcttaaattatct

SEQ ID NO: 1006917 - DNA, 22 bp, Artificial Sequence
  chemically synthesized
ggataatttttcttaaattatc

SEQ ID NO: 1006918 - DNA, 22 bp, Artificial Sequence
  chemically synthesized
tggataatttttcttaaattat

SEQ ID NO: 1006919 - DNA, 22 bp, Artificial Sequence
  chemically synthesized
agttttggataatttttcttaa

SEQ ID NO: 1006920 - DNA, 22 bp, Artificial Sequence
  chemically synthesized
taagttttggataatttttctt

SEQ ID NO: 1006921 - DNA, 22 bp, Artificial Sequence
  chemically synthesized
ctaagttttggataatttttct

SEQ ID NO: 1006922 - DNA, 22 bp, Artificial Sequence
  chemically synthesized
cttctaagttttggataatttt

SEQ ID NO: 1006923 - DNA, 22 bp, Artificial Sequence
  chemically synthesized
acttctaagttttggataattt

SEQ ID NO: 1006924 - DNA, 22 bp, Artificial Sequence
  chemically synthesized
tacttctaagttttggataatt

SEQ ID NO: 1006925 - DNA, 22 bp, Artificial Sequence
  chemically synthesized
ttttacttctaagttttggata

SEQ ID NO: 1006926 - DNA, 22 bp, Artificial Sequence
  chemically synthesized
gttttacttctaagttttggat

SEQ ID NO: 1006927 - DNA, 22 bp, Artificial Sequence
  chemically synthesized
tgttttacttctaagttttgga

SEQ ID NO: 1006928 - DNA, 22 bp, Artificial Sequence
  chemically synthesized
aagaaaaattatccaaaactta

SEQ ID NO: 1006929 - DNA, 22 bp, Artificial Sequence
  chemically synthesized
ttgttttacttctaagttttgg

SEQ ID NO: 1006930 - DNA, 22 bp, Artificial Sequence
  chemically synthesized
agaaaaattatccaaaacttag

SEQ ID NO: 1006931 - DNA, 22 bp, Artificial Sequence
  chemically synthesized
tccaaaacttagaagtaaaaca

SEQ ID NO: 1006932 - DNA, 22 bp, Artificial Sequence
  chemically synthesized
aaacacacacgatcatcttttg

SEQ ID NO: 1006933 - DNA, 22 bp, Artificial Sequence
  chemically synthesized
gaaacacacacgatcatctttt

SEQ ID NO: 1006934 - DNA, 22 bp, Artificial Sequence
  chemically synthesized
agaagtaaaacaaaagatgatc

SEQ ID NO: 1006935 - DNA, 22 bp, Artificial Sequence
  chemically synthesized
tgaaacacacacgatcatcttt

SEQ ID NO: 1006936 - DNA, 22 bp, Artificial Sequence
  chemically synthesized
gaagtaaaacaaaagatgatcg

SEQ ID NO: 1006937 - DNA, 22 bp, Artificial Sequence
  chemically synthesized
ttttgaaacacacacgatcatc

SEQ ID NO: 1006938 - DNA, 22 bp, Artificial Sequence
  chemically synthesized
ccattattttgaaacacacacg

SEQ ID NO: 1006939 - DNA, 22 bp, Artificial Sequence
  chemically synthesized
gaaaacaacgctaccattattt

SEQ ID NO: 1006940 - DNA, 22 bp, Artificial Sequence
  chemically synthesized
ttagaaaacaacgctaccatta

SEQ ID NO: 1006941 - DNA, 22 bp, Artificial Sequence
  chemically synthesized
gttagaaaacaacgctaccatt

SEQ ID NO: 1006942 - DNA, 22 bp, Artificial Sequence
  chemically synthesized
caaaataatggtagcgttgttt

SEQ ID NO: 1006943 - DNA, 22 bp, Artificial Sequence
  chemically synthesized
aaaataatggtagcgttgtttt

SEQ ID NO: 1006944 - DNA, 22 bp, Artificial Sequence
  chemically synthesized
tgagggtgtgaggagtttgtta

SEQ ID NO: 1006945 - DNA, 22 bp, Artificial Sequence
  chemically synthesized
gtgagggtgtgaggagtttgtt

SEQ ID NO: 1006946 - DNA, 22 bp, Artificial Sequence
  chemically synthesized
ttgtgagggtgtgaggagtttg

SEQ ID NO: 1006947 - DNA, 22 bp, Artificial Sequence
  chemically synthesized
ttttctaacaaactcctcacac

SEQ ID NO: 1006948 - DNA, 22 bp, Artificial Sequence
  chemically synthesized
aagctcttgtgagggtgtgagg

SEQ ID NO: 1006949 - DNA, 22 bp, Artificial Sequence
  chemically synthesized
tctaacaaactcctcacaccct

SEQ ID NO: 1006950 - DNA, 22 bp, Artificial Sequence
  chemically synthesized
ctaacaaactcctcacaccctc

SEQ ID NO: 1006951 - DNA, 22 bp, Artificial Sequence
  chemically synthesized
taacaaactcctcacaccctca

SEQ ID NO: 1006952 - DNA, 22 bp, Artificial Sequence
  chemically synthesized
acaaactcctcacaccctcaca

SEQ ID NO: 1006953 - DNA, 22 bp, Artificial Sequence
  chemically synthesized
aaaatattgaagctcttgtgag

SEQ ID NO: 1006954 - DNA, 22 bp, Artificial Sequence
  chemically synthesized
tgaaaatattgaagctcttgtg

SEQ ID NO: 1006955 - DNA, 22 bp, Artificial Sequence
  chemically synthesized
ctcacaccctcacaagagcttc

SEQ ID NO: 1006956 - DNA, 22 bp, Artificial Sequence
  chemically synthesized
ctctgaaaatattgaagctctt

SEQ ID NO: 1006957 - DNA, 22 bp, Artificial Sequence
  chemically synthesized
actctgaaaatattgaagctct

SEQ ID NO: 1006958 - DNA, 22 bp, Artificial Sequence
  chemically synthesized
acaccctcacaagagcttcaat

SEQ ID NO: 1006959 - DNA, 22 bp, Artificial Sequence
  chemically synthesized
tactctgaaaatattgaagctc

SEQ ID NO: 1006960 - DNA, 22 bp, Artificial Sequence
  chemically synthesized
ctttactctgaaaatattgaag

SEQ ID NO: 1006961 - DNA, 22 bp, Artificial Sequence
  chemically synthesized
acaagagcttcaatattttcag

SEQ ID NO: 1006962 - DNA, 22 bp, Artificial Sequence
  chemically synthesized
caatattttcagagtaaagcaa

SEQ ID NO: 1006963 - DNA, 22 bp, Artificial Sequence
  chemically synthesized
aatattttcagagtaaagcaac

SEQ ID NO: 1006964 - DNA, 22 bp, Artificial Sequence
  chemically synthesized
atagtaaacagtaagagttgct

SEQ ID NO: 1006965 - DNA, 22 bp, Artificial Sequence
  chemically synthesized
tcagagtaaagcaactcttact

SEQ ID NO: 1006966 - DNA, 22 bp, Artificial Sequence
  chemically synthesized
cagagtaaagcaactcttactg

SEQ ID NO: 1006967 - DNA, 22 bp, Artificial Sequence
  chemically synthesized
agagtaaagcaactcttactgt

SEQ ID NO: 1006968 - DNA, 22 bp, Artificial Sequence
  chemically synthesized
ttactgtttactattaatttgg

SEQ ID NO: 1006969 - DNA, 22 bp, Artificial Sequence
  chemically synthesized
actgtttactattaatttgggc

SEQ ID NO: 1006970 - DNA, 22 bp, Artificial Sequence
  chemically synthesized
taacatgtgtgggcccaaatta

SEQ ID NO: 1006971 - DNA, 22 bp, Artificial Sequence
  chemically synthesized
ctgtttactattaatttgggcc

SEQ ID NO: 1006972 - DNA, 22 bp, Artificial Sequence
  chemically synthesized
tttactattaatttgggcccac

SEQ ID NO: 1006973 - DNA, 22 bp, Artificial Sequence
  chemically synthesized
actattaatttgggcccacaca

SEQ ID NO: 1006974 - DNA, 22 bp, Artificial Sequence
  chemically synthesized
ctattaatttgggcccacacat

SEQ ID NO: 1006975 - DNA, 22 bp, Artificial Sequence
  chemically synthesized
atagcgttgtaacatgtgtggg

SEQ ID NO: 1006976 - DNA, 22 bp, Artificial Sequence
  chemically synthesized
catagcgttgtaacatgtgtgg

SEQ ID NO: 1006977 - DNA, 22 bp, Artificial Sequence
  chemically synthesized
ttaatttgggcccacacatgtt

SEQ ID NO: 1006978 - DNA, 22 bp, Artificial Sequence
  chemically synthesized
atttgggcccacacatgttaca

SEQ ID NO: 1006979 - DNA, 22 bp, Artificial Sequence
  chemically synthesized
aacttcatagcgttgtaacatg

SEQ ID NO: 1006980 - DNA, 22 bp, Artificial Sequence
  chemically synthesized
gggcccacacatgttacaacgc

SEQ ID NO: 1006981 - DNA, 22 bp, Artificial Sequence
  chemically synthesized
ggcccacacatgttacaacgct

SEQ ID NO: 1006982 - DNA, 22 bp, Artificial Sequence
  chemically synthesized
cattgaacttcatagcgttgta

SEQ ID NO: 1006983 - DNA, 22 bp, Artificial Sequence
  chemically synthesized
gcattgaacttcatagcgttgt

SEQ ID NO: 1006984 - DNA, 22 bp, Artificial Sequence
  chemically synthesized
aaatttgcattgaacttcatag

SEQ ID NO: 1006985 - DNA, 22 bp, Artificial Sequence
  chemically synthesized
taaaatttgcattgaacttcat

SEQ ID NO: 1006986 - DNA, 22 bp, Artificial Sequence
  chemically synthesized
ctaaaatttgcattgaacttca

SEQ ID NO: 1006987 - DNA, 22 bp, Artificial Sequence
  chemically synthesized
tctaaaatttgcattgaacttc

SEQ ID NO: 1006988 - DNA, 22 bp, Artificial Sequence
  chemically synthesized
caacgctatgaagttcaatgca

SEQ ID NO: 1006989 - DNA, 22 bp, Artificial Sequence
  chemically synthesized
tgaagttcaatgcaaattttag

SEQ ID NO: 1006990 - DNA, 22 bp, Artificial Sequence
  chemically synthesized
catcatatcagttttctaaaat

SEQ ID NO: 1006991 - DNA, 22 bp, Artificial Sequence
  chemically synthesized
acatcatatcagttttctaaaa

SEQ ID NO: 1006992 - DNA, 22 bp, Artificial Sequence
  chemically synthesized
aatgcaaattttagaaaactga

SEQ ID NO: 1006993 - DNA, 22 bp, Artificial Sequence
  chemically synthesized
tagaaaactgatatgatgtaaa

SEQ ID NO: 1006994 - DNA, 22 bp, Artificial Sequence
  chemically synthesized
ggtaaaaagtcatttacatcat

SEQ ID NO: 1006995 - DNA, 22 bp, Artificial Sequence
  chemically synthesized
agaaaactgatatgatgtaaat

SEQ ID NO: 1006996 - DNA, 22 bp, Artificial Sequence
  chemically synthesized
gaaaactgatatgatgtaaatg

SEQ ID NO: 1006997 - DNA, 22 bp, Artificial Sequence
  chemically synthesized
ctgggtaaaaagtcatttacat

SEQ ID NO: 1006998 - DNA, 22 bp, Artificial Sequence
  chemically synthesized
tactgggtaaaaagtcatttac

SEQ ID NO: 1006999 - DNA, 22 bp, Artificial Sequence
  chemically synthesized
atatgatgtaaatgacttttta

SEQ ID NO: 1007000 - DNA, 22 bp, Artificial Sequence
  chemically synthesized
tatcctctactgggtaaaaagt

SEQ ID NO: 1007001 - DNA, 22 bp, Artificial Sequence
  chemically synthesized
gggttatatcctctactgggta

SEQ ID NO: 1007002 - DNA, 22 bp, Artificial Sequence
  chemically synthesized
ggggttatatcctctactgggt

SEQ ID NO: 1007003 - DNA, 22 bp, Artificial Sequence
  chemically synthesized
tggggttatatcctctactggg

SEQ ID NO: 1007004 - DNA, 22 bp, Artificial Sequence
  chemically synthesized
cagcctttggggttatatcctc

SEQ ID NO: 1007005 - DNA, 22 bp, Artificial Sequence
  chemically synthesized
tttacccagtagaggatataac

SEQ ID NO: 1007006 - DNA, 22 bp, Artificial Sequence
  chemically synthesized
ttacccagtagaggatataacc

SEQ ID NO: 1007007 - DNA, 22 bp, Artificial Sequence
  chemically synthesized
tacccagtagaggatataaccc

SEQ ID NO: 1007008 - DNA, 22 bp, Artificial Sequence
  chemically synthesized
acccagtagaggatataacccc

SEQ ID NO: 1007009 - DNA, 22 bp, Artificial Sequence
  chemically synthesized
cccagtagaggatataacccca

SEQ ID NO: 1007010 - DNA, 22 bp, Artificial Sequence
  chemically synthesized
ataccctacagcctttggggtt

SEQ ID NO: 1007011 - DNA, 22 bp, Artificial Sequence
  chemically synthesized
gttgataccctacagcctttgg

SEQ ID NO: 1007012 - DNA, 22 bp, Artificial Sequence
  chemically synthesized
aactcgttgataccctacagcc

SEQ ID NO: 1007013 - DNA, 22 bp, Artificial Sequence
  chemically synthesized
gtgaataagatactaaactcgt

SEQ ID NO: 1007014 - DNA, 22 bp, Artificial Sequence
  chemically synthesized
tagggtatcaacgagtttagta

SEQ ID NO: 1007015 - DNA, 22 bp, Artificial Sequence
  chemically synthesized
gaataagattagtgaataagat

SEQ ID NO: 1007016 - DNA, 22 bp, Artificial Sequence
  chemically synthesized
tggaataagattagtgaataag

SEQ ID NO: 1007017 - DNA, 22 bp, Artificial Sequence
  chemically synthesized
agtatcttattcactaatctta

SEQ ID NO: 1007018 - DNA, 22 bp, Artificial Sequence
  chemically synthesized
gtatcttattcactaatcttat

SEQ ID NO: 1007019 - DNA, 22 bp, Artificial Sequence
  chemically synthesized
aaaaagtattctggaataagat

SEQ ID NO: 1007020 - DNA, 22 bp, Artificial Sequence
  chemically synthesized
aaaaaagtattctggaataaga

SEQ ID NO: 1007021 - DNA, 22 bp, Artificial Sequence
  chemically synthesized
taaaaaagtattctggaataag

SEQ ID NO: 1007022 - DNA, 22 bp, Artificial Sequence
  chemically synthesized
ttaaaaaagtattctggaataa

SEQ ID NO: 1007023 - DNA, 22 bp, Artificial Sequence
  chemically synthesized
attcactaatcttattccagaa

SEQ ID NO: 1007024 - DNA, 22 bp, Artificial Sequence
  chemically synthesized
ttcactaatcttattccagaat

SEQ ID NO: 1007025 - DNA, 22 bp, Artificial Sequence
  chemically synthesized
actaatcttattccagaatact

SEQ ID NO: 1007026 - DNA, 22 bp, Artificial Sequence
  chemically synthesized
atcttattccagaatacttttt

SEQ ID NO: 1007027 - DNA, 22 bp, Artificial Sequence
  chemically synthesized
attccagaatacttttttaaaa

SEQ ID NO: 1007028 - DNA, 22 bp, Artificial Sequence
  chemically synthesized
taatgagtgaatttttaaaaaa

SEQ ID NO: 1007029 - DNA, 22 bp, Artificial Sequence
  chemically synthesized
ttccagaatacttttttaaaaa

SEQ ID NO: 1007030 - DNA, 22 bp, Artificial Sequence
  chemically synthesized
tataatgagtgaatttttaaaa

SEQ ID NO: 1007031 - DNA, 22 bp, Artificial Sequence
  chemically synthesized
ctataatgagtgaatttttaaa

SEQ ID NO: 1007032 - DNA, 22 bp, Artificial Sequence
  chemically synthesized
cagaatacttttttaaaaattc

SEQ ID NO: 1007033 - DNA, 22 bp, Artificial Sequence
  chemically synthesized
ttttaaaaattcactcattata

SEQ ID NO: 1007034 - DNA, 22 bp, Artificial Sequence
  chemically synthesized
tttaaaaattcactcattatag

SEQ ID NO: 1007035 - DNA, 22 bp, Artificial Sequence
  chemically synthesized
ttaaaaattcactcattataga

SEQ ID NO: 1007036 - DNA, 22 bp, Artificial Sequence
  chemically synthesized
taaaaattcactcattatagaa

SEQ ID NO: 1007037 - DNA, 22 bp, Artificial Sequence
  chemically synthesized
aaaaattcactcattatagaag

SEQ ID NO: 1007038 - DNA, 22 bp, Artificial Sequence
  chemically synthesized
aaaattcactcattatagaagc

SEQ ID NO: 1007039 - DNA, 22 bp, Artificial Sequence
  chemically synthesized
actcattatagaagcatttgtt

SEQ ID NO: 1007040 - DNA, 22 bp, Artificial Sequence
  chemically synthesized
attatagaagcatttgtttctt

SEQ ID NO: 1007041 - DNA, 22 bp, Artificial Sequence
  chemically synthesized
aaaagagaatacaagaaacaaa

SEQ ID NO: 1007042 - DNA, 22 bp, Artificial Sequence
  chemically synthesized
tagaagcatttgtttcttgtat

SEQ ID NO: 1007043 - DNA, 22 bp, Artificial Sequence
  chemically synthesized
gttcaaaagagaatacaagaaa

SEQ ID NO: 1007044 - DNA, 22 bp, Artificial Sequence
  chemically synthesized
gtttcttgtattctcttttgaa

SEQ ID NO: 1007045 - DNA, 22 bp, Artificial Sequence
  chemically synthesized
tttcttgtattctcttttgaac

SEQ ID NO: 1007046 - DNA, 22 bp, Artificial Sequence
  chemically synthesized
cttgtattctcttttgaaccag

SEQ ID NO: 1007047 - DNA, 22 bp, Artificial Sequence
  chemically synthesized
ttgtattctcttttgaaccagt

SEQ ID NO: 1007048 - DNA, 22 bp, Artificial Sequence
  chemically synthesized
gtaggaagacaaaactggttca

SEQ ID NO: 1007049 - DNA, 22 bp, Artificial Sequence
  chemically synthesized
gtattctcttttgaaccagttt

SEQ ID NO: 1007050 - DNA, 22 bp, Artificial Sequence
  chemically synthesized
tattctcttttgaaccagtttt

SEQ ID NO: 1007051 - DNA, 22 bp, Artificial Sequence
  chemically synthesized
tcttttgaaccagttttgtctt

SEQ ID NO: 1007052 - DNA, 22 bp, Artificial Sequence
  chemically synthesized
gagagctggtaggaagacaaaa

SEQ ID NO: 1007053 - DNA, 22 bp, Artificial Sequence
  chemically synthesized
ttttgaaccagttttgtcttcc

SEQ ID NO: 1007054 - DNA, 22 bp, Artificial Sequence
  chemically synthesized
ttgaaccagttttgtcttccta

SEQ ID NO: 1007055 - DNA, 22 bp, Artificial Sequence
  chemically synthesized
tgaaccagttttgtcttcctac

SEQ ID NO: 1007056 - DNA, 22 bp, Artificial Sequence
  chemically synthesized
gaaccagttttgtcttcctacc

SEQ ID NO: 1007057 - DNA, 22 bp, Artificial Sequence
  chemically synthesized
aaccagttttgtcttcctacca

SEQ ID NO: 1007058 - DNA, 22 bp, Artificial Sequence
  chemically synthesized
atacagtaattggagagctggt

SEQ ID NO: 1007059 - DNA, 22 bp, Artificial Sequence
  chemically synthesized
aatacagtaattggagagctgg

SEQ ID NO: 1007060 - DNA, 22 bp, Artificial Sequence
  chemically synthesized
tgtcttcctaccagctctccaa

SEQ ID NO: 1007061 - DNA, 22 bp, Artificial Sequence
  chemically synthesized
gtcttcctaccagctctccaat

SEQ ID NO: 1007062 - DNA, 22 bp, Artificial Sequence
  chemically synthesized
tttaatacagtaattggagagc

SEQ ID NO: 1007063 - DNA, 22 bp, Artificial Sequence
  chemically synthesized
tcttcctaccagctctccaatt

SEQ ID NO: 1007064 - DNA, 22 bp, Artificial Sequence
  chemically synthesized
atttaatacagtaattggagag

SEQ ID NO: 1007065 - DNA, 22 bp, Artificial Sequence
  chemically synthesized
tatttaatacagtaattggaga

SEQ ID NO: 1007066 - DNA, 22 bp, Artificial Sequence
  chemically synthesized
cctaccagctctccaattactg

SEQ ID NO: 1007067 - DNA, 22 bp, Artificial Sequence
  chemically synthesized
ctaccagctctccaattactgt

SEQ ID NO: 1007068 - DNA, 22 bp, Artificial Sequence
  chemically synthesized
ccagctctccaattactgtatt

SEQ ID NO: 1007069 - DNA, 22 bp, Artificial Sequence
  chemically synthesized
acggtaggttttatttaataca

SEQ ID NO: 1007070 - DNA, 22 bp, Artificial Sequence
  chemically synthesized
tccaattactgtattaaataaa

SEQ ID NO: 1007071 - DNA, 22 bp, Artificial Sequence
  chemically synthesized
caattactgtattaaataaaac

SEQ ID NO: 1007072 - DNA, 22 bp, Artificial Sequence
  chemically synthesized
ctgtattaaataaaacctaccg

SEQ ID NO: 1007073 - DNA, 22 bp, Artificial Sequence
  chemically synthesized
tattaaataaaacctaccgtga

SEQ ID NO: 1007074 - DNA, 22 bp, Artificial Sequence
  chemically synthesized
aataaaacctaccgtgagttca

SEQ ID NO: 1007075 - DNA, 22 bp, Artificial Sequence
  chemically synthesized
atgtaaatcatagtgaactcac

SEQ ID NO: 1007076 - DNA, 22 bp, Artificial Sequence
  chemically synthesized
catgtaaatcatagtgaactca

SEQ ID NO: 1007077 - DNA, 22 bp, Artificial Sequence
  chemically synthesized
tcatgtaaatcatagtgaactc

SEQ ID NO: 1007078 - DNA, 22 bp, Artificial Sequence
  chemically synthesized
ccgtgagttcactatgatttac

SEQ ID NO: 1007079 - DNA, 22 bp, Artificial Sequence
  chemically synthesized
tgaagaaacataattttcatgt

SEQ ID NO: 1007080 - DNA, 22 bp, Artificial Sequence
  chemically synthesized
atgaagaaacataattttcatg

SEQ ID NO: 1007081 - DNA, 22 bp, Artificial Sequence
  chemically synthesized
actatgatttacatgaaaatta

SEQ ID NO: 1007082 - DNA, 22 bp, Artificial Sequence
  chemically synthesized
tatgaagaaacataattttcat

SEQ ID NO: 1007083 - DNA, 22 bp, Artificial Sequence
  chemically synthesized
tgatttacatgaaaattatgtt

SEQ ID NO: 1007084 - DNA, 22 bp, Artificial Sequence
  chemically synthesized
acatgaaaattatgtttcttca

SEQ ID NO: 1007085 - DNA, 22 bp, Artificial Sequence
  chemically synthesized
catgaaaattatgtttcttcat

SEQ ID NO: 1007086 - DNA, 22 bp, Artificial Sequence
  chemically synthesized
tcagcacagtgaaattttatga

SEQ ID NO: 1007087 - DNA, 22 bp, Artificial Sequence
  chemically synthesized
tgtttcttcataaaatttcact

SEQ ID NO: 1007088 - DNA, 22 bp, Artificial Sequence
  chemically synthesized
ccacctatcagcacagtgaaat

SEQ ID NO: 1007089 - DNA, 22 bp, Artificial Sequence
  chemically synthesized
taccacctatcagcacagtgaa

SEQ ID NO: 1007090 - DNA, 22 bp, Artificial Sequence
  chemically synthesized
cttcataaaatttcactgtgct

SEQ ID NO: 1007091 - DNA, 22 bp, Artificial Sequence
  chemically synthesized
ttcataaaatttcactgtgctg

SEQ ID NO: 1007092 - DNA, 22 bp, Artificial Sequence
  chemically synthesized
cataaaatttcactgtgctgat

SEQ ID NO: 1007093 - DNA, 22 bp, Artificial Sequence
  chemically synthesized
ataaaatttcactgtgctgata

SEQ ID NO: 1007094 - DNA, 22 bp, Artificial Sequence
  chemically synthesized
ataattctaccacctatcagca

SEQ ID NO: 1007095 - DNA, 22 bp, Artificial Sequence
  chemically synthesized
cactgtgctgataggtggtaga

SEQ ID NO: 1007096 - DNA, 22 bp, Artificial Sequence
  chemically synthesized
actgtgctgataggtggtagaa

SEQ ID NO: 1007097 - DNA, 22 bp, Artificial Sequence
  chemically synthesized
tgctgataggtggtagaattat

SEQ ID NO: 1007098 - DNA, 22 bp, Artificial Sequence
  chemically synthesized
ataggtggtagaattatgaatt

SEQ ID NO: 1007099 - DNA, 22 bp, Artificial Sequence
  chemically synthesized
aataatggagaaaagtacaaag

SEQ ID NO: 1007100 - DNA, 22 bp, Artificial Sequence
  chemically synthesized
gaataatggagaaaagtacaaa

SEQ ID NO: 1007101 - DNA, 22 bp, Artificial Sequence
  chemically synthesized
tgaataatggagaaaagtacaa

SEQ ID NO: 1007102 - DNA, 22 bp, Artificial Sequence
  chemically synthesized
tgaattttctttgtacttttct

SEQ ID NO: 1007103 - DNA, 22 bp, Artificial Sequence
  chemically synthesized
tctttgtacttttctccattat

SEQ ID NO: 1007104 - DNA, 22 bp, Artificial Sequence
  chemically synthesized
gggacattttgaataatggaga

SEQ ID NO: 1007105 - DNA, 22 bp, Artificial Sequence
  chemically synthesized
ctttgtacttttctccattatt

SEQ ID NO: 1007106 - DNA, 22 bp, Artificial Sequence
  chemically synthesized
tttgtacttttctccattattc

SEQ ID NO: 1007107 - DNA, 22 bp, Artificial Sequence
  chemically synthesized
tgtacttttctccattattcaa

SEQ ID NO: 1007108 - DNA, 22 bp, Artificial Sequence
  chemically synthesized
gtacttttctccattattcaaa

SEQ ID NO: 1007109 - DNA, 22 bp, Artificial Sequence
  chemically synthesized
tacttttctccattattcaaaa

SEQ ID NO: 1007110 - DNA, 22 bp, Artificial Sequence
  chemically synthesized
ttctccattattcaaaatgtcc

SEQ ID NO: 1007111 - DNA, 22 bp, Artificial Sequence
  chemically synthesized
agagtatactggggacattttg

SEQ ID NO: 1007112 - DNA, 22 bp, Artificial Sequence
  chemically synthesized
tctccattattcaaaatgtccc

SEQ ID NO: 1007113 - DNA, 22 bp, Artificial Sequence
  chemically synthesized
ctccattattcaaaatgtcccc

SEQ ID NO: 1007114 - DNA, 22 bp, Artificial Sequence
  chemically synthesized
tccattattcaaaatgtcccca

SEQ ID NO: 1007115 - DNA, 22 bp, Artificial Sequence
  chemically synthesized
ttcagagtatactggggacatt

SEQ ID NO: 1007116 - DNA, 22 bp, Artificial Sequence
  chemically synthesized
gttcagagtatactggggacat

SEQ ID NO: 1007117 - DNA, 22 bp, Artificial Sequence
  chemically synthesized
cattattcaaaatgtccccagt

SEQ ID NO: 1007118 - DNA, 22 bp, Artificial Sequence
  chemically synthesized
tgttcagagtatactggggaca

SEQ ID NO: 1007119 - DNA, 22 bp, Artificial Sequence
  chemically synthesized
attttgttcagagtatactggg

SEQ ID NO: 1007120 - DNA, 22 bp, Artificial Sequence
  chemically synthesized
ttcaaaatgtccccagtatact

SEQ ID NO: 1007121 - DNA, 22 bp, Artificial Sequence
  chemically synthesized
aattttgttcagagtatactgg

SEQ ID NO: 1007122 - DNA, 22 bp, Artificial Sequence
  chemically synthesized
aaaatgtccccagtatactctg

SEQ ID NO: 1007123 - DNA, 22 bp, Artificial Sequence
  chemically synthesized
aatgtttaattttgttcagagt

SEQ ID NO: 1007124 - DNA, 22 bp, Artificial Sequence
  chemically synthesized
caattaaatgtttaattttgtt

SEQ ID NO: 1007125 - DNA, 22 bp, Artificial Sequence
  chemically synthesized
ccaattaaatgtttaattttgt

SEQ ID NO: 1007126 - DNA, 22 bp, Artificial Sequence
  chemically synthesized
tccaattaaatgtttaattttg

SEQ ID NO: 1007127 - DNA, 22 bp, Artificial Sequence
  chemically synthesized
ttccaattaaatgtttaatttt

SEQ ID NO: 1007128 - DNA, 22 bp, Artificial Sequence
  chemically synthesized
tttccaattaaatgtttaattt

SEQ ID NO: 1007129 - DNA, 22 bp, Artificial Sequence
  chemically synthesized
tgaacaaaattaaacatttaat

SEQ ID NO: 1007130 - DNA, 22 bp, Artificial Sequence
  chemically synthesized
aacaaaattaaacatttaattg

SEQ ID NO: 1007131 - DNA, 22 bp, Artificial Sequence
  chemically synthesized
catatagcatgtattttttcca

SEQ ID NO: 1007132 - DNA, 22 bp, Artificial Sequence
  chemically synthesized
gcatatagcatgtattttttcc

SEQ ID NO: 1007133 - DNA, 22 bp, Artificial Sequence
  chemically synthesized
aacatttaattggaaaaaatac

SEQ ID NO: 1007134 - DNA, 22 bp, Artificial Sequence
  chemically synthesized
aattggaaaaaatacatgctat

SEQ ID NO: 1007135 - DNA, 22 bp, Artificial Sequence
  chemically synthesized
attggaaaaaatacatgctata

SEQ ID NO: 1007136 - DNA, 22 bp, Artificial Sequence
  chemically synthesized
aatagatttgcatatagcatgt

SEQ ID NO: 1007137 - DNA, 22 bp, Artificial Sequence
  chemically synthesized
gaaaaaatacatgctatatgca

SEQ ID NO: 1007138 - DNA, 22 bp, Artificial Sequence
  chemically synthesized
aggcaacacgaagctaaataga

SEQ ID NO: 1007139 - DNA, 22 bp, Artificial Sequence
  chemically synthesized
tatgcaaatctatttagcttcg

SEQ ID NO: 1007140 - DNA, 22 bp, Artificial Sequence
  chemically synthesized
catacctaaggcaacacgaagc

SEQ ID NO: 1007141 - DNA, 22 bp, Artificial Sequence
  chemically synthesized
gcatacctaaggcaacacgaag

SEQ ID NO: 1007142 - DNA, 22 bp, Artificial Sequence
  chemically synthesized
tttagcttcgtgttgccttagg

SEQ ID NO: 1007143 - DNA, 22 bp, Artificial Sequence
  chemically synthesized
agcttcgtgttgccttaggtat

SEQ ID NO: 1007144 - DNA, 22 bp, Artificial Sequence
  chemically synthesized
gcttcgtgttgccttaggtatg

SEQ ID NO: 1007145 - DNA, 22 bp, Artificial Sequence
  chemically synthesized
cgtgttgccttaggtatgcaag

SEQ ID NO: 1007146 - DNA, 22 bp, Artificial Sequence
  chemically synthesized
gtgttgccttaggtatgcaaga

SEQ ID NO: 1007147 - DNA, 22 bp, Artificial Sequence
  chemically synthesized
tatgatatgtaacgtcttgcat

SEQ ID NO: 1007148 - DNA, 22 bp, Artificial Sequence
  chemically synthesized
gtatgatatgtaacgtcttgca

SEQ ID NO: 1007149 - DNA, 22 bp, Artificial Sequence
  chemically synthesized
tgtatgatatgtaacgtcttgc

SEQ ID NO: 1007150 - DNA, 22 bp, Artificial Sequence
  chemically synthesized
ttgtatgatatgtaacgtcttg

SEQ ID NO: 1007151 - DNA, 22 bp, Artificial Sequence
  chemically synthesized
ccttaggtatgcaagacgttac

SEQ ID NO: 1007152 - DNA, 22 bp, Artificial Sequence
  chemically synthesized
tttgtatgatatgtaacgtctt

SEQ ID NO: 1007153 - DNA, 22 bp, Artificial Sequence
  chemically synthesized
ttttgtatgatatgtaacgtct

SEQ ID NO: 1007154 - DNA, 22 bp, Artificial Sequence
  chemically synthesized
tttttgtatgatatgtaacgtc

SEQ ID NO: 1007155 - DNA, 22 bp, Artificial Sequence
  chemically synthesized
aggtatgcaagacgttacatat

SEQ ID NO: 1007156 - DNA, 22 bp, Artificial Sequence
  chemically synthesized
ggtatgcaagacgttacatatc

SEQ ID NO: 1007157 - DNA, 22 bp, Artificial Sequence
  chemically synthesized
gattttttttgtatgatatgta

SEQ ID NO: 1007158 - DNA, 22 bp, Artificial Sequence
  chemically synthesized
agattttttttgtatgatatgt

SEQ ID NO: 1007159 - DNA, 22 bp, Artificial Sequence
  chemically synthesized
gtggcttagattttttttgtat

SEQ ID NO: 1007160 - DNA, 22 bp, Artificial Sequence
  chemically synthesized
ggtggcttagattttttttgta

SEQ ID NO: 1007161 - DNA, 22 bp, Artificial Sequence
  chemically synthesized
tggtggcttagattttttttgt

SEQ ID NO: 1007162 - DNA, 22 bp, Artificial Sequence
  chemically synthesized
catatcatacaaaaaaaatcta

SEQ ID NO: 1007163 - DNA, 22 bp, Artificial Sequence
  chemically synthesized
tctttggtggcttagatttttt

SEQ ID NO: 1007164 - DNA, 22 bp, Artificial Sequence
  chemically synthesized
atctttggtggcttagattttt

SEQ ID NO: 1007165 - DNA, 22 bp, Artificial Sequence
  chemically synthesized
tatctttggtggcttagatttt

SEQ ID NO: 1007166 - DNA, 22 bp, Artificial Sequence
  chemically synthesized
ttttatctttggtggcttagat

SEQ ID NO: 1007167 - DNA, 22 bp, Artificial Sequence
  chemically synthesized
caaaactgttttatctttggtg

SEQ ID NO: 1007168 - DNA, 22 bp, Artificial Sequence
  chemically synthesized
attgcaaaactgttttatcttt

SEQ ID NO: 1007169 - DNA, 22 bp, Artificial Sequence
  chemically synthesized
ttgattgcaaaactgttttatc

SEQ ID NO: 1007170 - DNA, 22 bp, Artificial Sequence
  chemically synthesized
agccaccaaagataaaacagtt

SEQ ID NO: 1007171 - DNA, 22 bp, Artificial Sequence
  chemically synthesized
tgcaatcaatagtgtttttcct

SEQ ID NO: 1007172 - DNA, 22 bp, Artificial Sequence
  chemically synthesized
atggaagagaaaaggaaaaaca

SEQ ID NO: 1007173 - DNA, 22 bp, Artificial Sequence
  chemically synthesized
gcaatcaatagtgtttttcctt

SEQ ID NO: 1007174 - DNA, 22 bp, Artificial Sequence
  chemically synthesized
caatcaatagtgtttttccttt

SEQ ID NO: 1007175 - DNA, 22 bp, Artificial Sequence
  chemically synthesized
ctgatggaagagaaaaggaaaa

SEQ ID NO: 1007176 - DNA, 22 bp, Artificial Sequence
  chemically synthesized
tgctgctgatggaagagaaaag

SEQ ID NO: 1007177 - DNA, 22 bp, Artificial Sequence
  chemically synthesized
ttccttttctcttccatcagca

SEQ ID NO: 1007178 - DNA, 22 bp, Artificial Sequence
  chemically synthesized
tccttttctcttccatcagcag

SEQ ID NO: 1007179 - DNA, 22 bp, Artificial Sequence
  chemically synthesized
tacatcgctgtgctgctgatgg

SEQ ID NO: 1007180 - DNA, 22 bp, Artificial Sequence
  chemically synthesized
ccttttctcttccatcagcagc

SEQ ID NO: 1007181 - DNA, 22 bp, Artificial Sequence
  chemically synthesized
cttttctcttccatcagcagca

SEQ ID NO: 1007182 - DNA, 22 bp, Artificial Sequence
  chemically synthesized
ttgtacatcgctgtgctgctga

SEQ ID NO: 1007183 - DNA, 22 bp, Artificial Sequence
  chemically synthesized
attgtacatcgctgtgctgctg

SEQ ID NO: 1007184 - DNA, 22 bp, Artificial Sequence
  chemically synthesized
ttctcttccatcagcagcacag

SEQ ID NO: 1007185 - DNA, 22 bp, Artificial Sequence
  chemically synthesized
tctcttccatcagcagcacagc

SEQ ID NO: 1007186 - DNA, 22 bp, Artificial Sequence
  chemically synthesized
ctcttccatcagcagcacagcg

SEQ ID NO: 1007187 - DNA, 22 bp, Artificial Sequence
  chemically synthesized
cttattgtacatcgctgtgctg

SEQ ID NO: 1007188 - DNA, 22 bp, Artificial Sequence
  chemically synthesized
tcttccatcagcagcacagcga

SEQ ID NO: 1007189 - DNA, 22 bp, Artificial Sequence
  chemically synthesized
ccttattgtacatcgctgtgct

SEQ ID NO: 1007190 - DNA, 22 bp, Artificial Sequence
  chemically synthesized
ttccatcagcagcacagcgatg

SEQ ID NO: 1007191 - DNA, 22 bp, Artificial Sequence
  chemically synthesized
tttccttattgtacatcgctgt

SEQ ID NO: 1007192 - DNA, 22 bp, Artificial Sequence
  chemically synthesized
ccatcagcagcacagcgatgta

SEQ ID NO: 1007193 - DNA, 22 bp, Artificial Sequence
  chemically synthesized
atttccttattgtacatcgctg

SEQ ID NO: 1007194 - DNA, 22 bp, Artificial Sequence
  chemically synthesized
catcagcagcacagcgatgtac

SEQ ID NO: 1007195 - DNA, 22 bp, Artificial Sequence
  chemically synthesized
tatttccttattgtacatcgct

SEQ ID NO: 1007196 - DNA, 22 bp, Artificial Sequence
  chemically synthesized
ctttatttccttattgtacatc

SEQ ID NO: 1007197 - DNA, 22 bp, Artificial Sequence
  chemically synthesized
actttatttccttattgtacat

SEQ ID NO: 1007198 - DNA, 22 bp, Artificial Sequence
  chemically synthesized
aagtttactttatttccttatt

SEQ ID NO: 1007199 - DNA, 22 bp, Artificial Sequence
  chemically synthesized
taaagtttactttatttcctta

SEQ ID NO: 1007200 - DNA, 22 bp, Artificial Sequence
  chemically synthesized
ctaaagtttactttatttcctt

SEQ ID NO: 1007201 - DNA, 22 bp, Artificial Sequence
  chemically synthesized
atatttctaaagtttactttat

SEQ ID NO: 1007202 - DNA, 22 bp, Artificial Sequence
  chemically synthesized
catatttctaaagtttacttta

SEQ ID NO: 1007203 - DNA, 22 bp, Artificial Sequence
  chemically synthesized
tagaaatatgaaatgtgtatac

SEQ ID NO: 1007204 - DNA, 22 bp, Artificial Sequence
  chemically synthesized
agaaatatgaaatgtgtatacg

SEQ ID NO: 1007205 - DNA, 22 bp, Artificial Sequence
  chemically synthesized
gaaatatgaaatgtgtatacgt

SEQ ID NO: 1007206 - DNA, 22 bp, Artificial Sequence
  chemically synthesized
acaataagcacgtcaatacgta

SEQ ID NO: 1007207 - DNA, 22 bp, Artificial Sequence
  chemically synthesized
atcgcattcacaataagcacgt

SEQ ID NO: 1007208 - DNA, 22 bp, Artificial Sequence
  chemically synthesized
tcatcgcattcacaataagcac

SEQ ID NO: 1007209 - DNA, 22 bp, Artificial Sequence
  chemically synthesized
ctcatcgcattcacaataagca

SEQ ID NO: 1007210 - DNA, 22 bp, Artificial Sequence
  chemically synthesized
tctcatcgcattcacaataagc

SEQ ID NO: 1007211 - DNA, 22 bp, Artificial Sequence
  chemically synthesized
cctttctcatcgcattcacaat

SEQ ID NO: 1007212 - DNA, 22 bp, Artificial Sequence
  chemically synthesized
gcctttctcatcgcattcacaa

SEQ ID NO: 1007213 - DNA, 22 bp, Artificial Sequence
  chemically synthesized
acgtgcttattgtgaatgcgat

SEQ ID NO: 1007214 - DNA, 22 bp, Artificial Sequence
  chemically synthesized
acttgcctttctcatcgcattc

SEQ ID NO: 1007215 - DNA, 22 bp, Artificial Sequence
  chemically synthesized
tcctgacttgcctttctcatcg

SEQ ID NO: 1007216 - DNA, 22 bp, Artificial Sequence
  chemically synthesized
attgtgaatgcgatgagaaagg

SEQ ID NO: 1007217 - DNA, 22 bp, Artificial Sequence
  chemically synthesized
ttgtgaatgcgatgagaaaggc

SEQ ID NO: 1007218 - DNA, 22 bp, Artificial Sequence
  chemically synthesized
actgtcctgacttgcctttctc

SEQ ID NO: 1007219 - DNA, 22 bp, Artificial Sequence
  chemically synthesized
tgaatgcgatgagaaaggcaag

SEQ ID NO: 1007220 - DNA, 22 bp, Artificial Sequence
  chemically synthesized
tcactgtcctgacttgcctttc

SEQ ID NO: 1007221 - DNA, 22 bp, Artificial Sequence
  chemically synthesized
actctcactgtcctgacttgcc

SEQ ID NO: 1007222 - DNA, 22 bp, Artificial Sequence
  chemically synthesized
tagtgtgagaatgcagtgtaat

SEQ ID NO: 1007223 - DNA, 22 bp, Artificial Sequence
  chemically synthesized
atagtgtgagaatgcagtgtaa

SEQ ID NO: 1007224 - DNA, 22 bp, Artificial Sequence
  chemically synthesized
atttatagtgtgagaatgcagt

SEQ ID NO: 1007225 - DNA, 22 bp, Artificial Sequence
  chemically synthesized
catttatagtgtgagaatgcag

SEQ ID NO: 1007226 - DNA, 22 bp, Artificial Sequence
  chemically synthesized
tcatttatagtgtgagaatgca

SEQ ID NO: 1007227 - DNA, 22 bp, Artificial Sequence
  chemically synthesized
tttcatttatagtgtgagaatg

SEQ ID NO: 1007228 - DNA, 22 bp, Artificial Sequence
  chemically synthesized
attacactgcattctcacacta

SEQ ID NO: 1007229 - DNA, 22 bp, Artificial Sequence
  chemically synthesized
ctctttcatttatagtgtgaga

SEQ ID NO: 1007230 - DNA, 22 bp, Artificial Sequence
  chemically synthesized
ctactctttcatttatagtgtg

SEQ ID NO: 1007231 - DNA, 22 bp, Artificial Sequence
  chemically synthesized
cactgcattctcacactataaa

SEQ ID NO: 1007232 - DNA, 22 bp, Artificial Sequence
  chemically synthesized
gctactctttcatttatagtgt

SEQ ID NO: 1007233 - DNA, 22 bp, Artificial Sequence
  chemically synthesized
cattctcacactataaatgaaa

SEQ ID NO: 1007234 - DNA, 22 bp, Artificial Sequence
  chemically synthesized
tcacactataaatgaaagagta

SEQ ID NO: 1007235 - DNA, 22 bp, Artificial Sequence
  chemically synthesized
gccaatacttgctactctttca

SEQ ID NO: 1007236 - DNA, 22 bp, Artificial Sequence
  chemically synthesized
agccaatacttgctactctttc

SEQ ID NO: 1007237 - DNA, 22 bp, Artificial Sequence
  chemically synthesized
acactataaatgaaagagtagc

SEQ ID NO: 1007238 - DNA, 22 bp, Artificial Sequence
  chemically synthesized
tagccaatacttgctactcttt

SEQ ID NO: 1007239 - DNA, 22 bp, Artificial Sequence
  chemically synthesized
aattttagccaatacttgctac

SEQ ID NO: 1007240 - DNA, 22 bp, Artificial Sequence
  chemically synthesized
taaatgaaagagtagcaagtat

SEQ ID NO: 1007241 - DNA, 22 bp, Artificial Sequence
  chemically synthesized
ttgaattttagccaatacttgc

SEQ ID NO: 1007242 - DNA, 22 bp, Artificial Sequence
  chemically synthesized
gccatggaagttattgaatttt

SEQ ID NO: 1007243 - DNA, 22 bp, Artificial Sequence
  chemically synthesized
ggccatggaagttattgaattt

SEQ ID NO: 1007244 - DNA, 22 bp, Artificial Sequence
  chemically synthesized
gctaaaattcaataacttccat

SEQ ID NO: 1007245 - DNA, 22 bp, Artificial Sequence
  chemically synthesized
aaattcaataacttccatggcc

SEQ ID NO: 1007246 - DNA, 22 bp, Artificial Sequence
  chemically synthesized
tagtaggtatcttggccatgga

SEQ ID NO: 1007247 - DNA, 22 bp, Artificial Sequence
  chemically synthesized
aataacttccatggccaagata

SEQ ID NO: 1007248 - DNA, 22 bp, Artificial Sequence
  chemically synthesized
aaattatagtaggtatcttggc

SEQ ID NO: 1007249 - DNA, 22 bp, Artificial Sequence
  chemically synthesized
ccatggccaagatacctactat

SEQ ID NO: 1007250 - DNA, 22 bp, Artificial Sequence
  chemically synthesized
catggccaagatacctactata

SEQ ID NO: 1007251 - DNA, 22 bp, Artificial Sequence
  chemically synthesized
aaagggaatcaatgttcaaatt

SEQ ID NO: 1007252 - DNA, 22 bp, Artificial Sequence
  chemically synthesized
tcaaagggaatcaatgttcaaa

SEQ ID NO: 1007253 - DNA, 22 bp, Artificial Sequence
  chemically synthesized
ctcaaagggaatcaatgttcaa

SEQ ID NO: 1007254 - DNA, 22 bp, Artificial Sequence
  chemically synthesized
ctataatttgaacattgattcc

SEQ ID NO: 1007255 - DNA, 22 bp, Artificial Sequence
  chemically synthesized
taatttgaacattgattccctt

SEQ ID NO: 1007256 - DNA, 22 bp, Artificial Sequence
  chemically synthesized
aggagaaagcttctcaaaggga

SEQ ID NO: 1007257 - DNA, 22 bp, Artificial Sequence
  chemically synthesized
gaacattgattccctttgagaa

SEQ ID NO: 1007258 - DNA, 22 bp, Artificial Sequence
  chemically synthesized
aacattgattccctttgagaag

SEQ ID NO: 1007259 - DNA, 22 bp, Artificial Sequence
  chemically synthesized
attccctttgagaagctttctc

SEQ ID NO: 1007260 - DNA, 22 bp, Artificial Sequence
  chemically synthesized
atggtgcctcaggagaaagctt

SEQ ID NO: 1007261 - DNA, 22 bp, Artificial Sequence
  chemically synthesized
gatggtgcctcaggagaaagct

SEQ ID NO: 1007262 - DNA, 22 bp, Artificial Sequence
  chemically synthesized
cctttgagaagctttctcctga

SEQ ID NO: 1007263 - DNA, 22 bp, Artificial Sequence
  chemically synthesized
tcttgatggtgcctcaggagaa

SEQ ID NO: 1007264 - DNA, 22 bp, Artificial Sequence
  chemically synthesized
tgagaagctttctcctgaggca

SEQ ID NO: 1007265 - DNA, 22 bp, Artificial Sequence
  chemically synthesized
gagaagctttctcctgaggcac

SEQ ID NO: 1007266 - DNA, 22 bp, Artificial Sequence
  chemically synthesized
agaagctttctcctgaggcacc

SEQ ID NO: 1007267 - DNA, 22 bp, Artificial Sequence
  chemically synthesized
atatctgtcttgatggtgcctc

SEQ ID NO: 1007268 - DNA, 22 bp, Artificial Sequence
  chemically synthesized
ttaatatctgtcttgatggtgc

SEQ ID NO: 1007269 - DNA, 22 bp, Artificial Sequence
  chemically synthesized
tctcctgaggcaccatcaagac

SEQ ID NO: 1007270 - DNA, 22 bp, Artificial Sequence
  chemically synthesized
ctcctgaggcaccatcaagaca

SEQ ID NO: 1007271 - DNA, 22 bp, Artificial Sequence
  chemically synthesized
attattaatatctgtcttgatg

SEQ ID NO: 1007272 - DNA, 22 bp, Artificial Sequence
  chemically synthesized
tcctgaggcaccatcaagacag

SEQ ID NO: 1007273 - DNA, 22 bp, Artificial Sequence
  chemically synthesized
ctgaggcaccatcaagacagat

SEQ ID NO: 1007274 - DNA, 22 bp, Artificial Sequence
  chemically synthesized
ctaattattaatatctgtcttg

SEQ ID NO: 1007275 - DNA, 22 bp, Artificial Sequence
  chemically synthesized
aggcaccatcaagacagatatt

SEQ ID NO: 1007276 - DNA, 22 bp, Artificial Sequence
  chemically synthesized
aactactaattattaatatctg

SEQ ID NO: 1007277 - DNA, 22 bp, Artificial Sequence
  chemically synthesized
gctgaactactaattattaata

SEQ ID NO: 1007278 - DNA, 22 bp, Artificial Sequence
  chemically synthesized
tggtccaacccctagctgaact

SEQ ID NO: 1007279 - DNA, 22 bp, Artificial Sequence
  chemically synthesized
gtggtccaacccctagctgaac

SEQ ID NO: 1007280 - DNA, 22 bp, Artificial Sequence
  chemically synthesized
ataattagtagttcagctaggg

SEQ ID NO: 1007281 - DNA, 22 bp, Artificial Sequence
  chemically synthesized
atatttgtggtccaacccctag

SEQ ID NO: 1007282 - DNA, 22 bp, Artificial Sequence
  chemically synthesized
gtagttcagctaggggttggac

SEQ ID NO: 1007283 - DNA, 22 bp, Artificial Sequence
  chemically synthesized
aggttgatatttgtggtccaac

SEQ ID NO: 1007284 - DNA, 22 bp, Artificial Sequence
  chemically synthesized
ttcaggttgatatttgtggtcc

SEQ ID NO: 1007285 - DNA, 22 bp, Artificial Sequence
  chemically synthesized
agctaggggttggaccacaaat

SEQ ID NO: 1007286 - DNA, 22 bp, Artificial Sequence
  chemically synthesized
gttcaggttgatatttgtggtc

SEQ ID NO: 1007287 - DNA, 22 bp, Artificial Sequence
  chemically synthesized
ggggttggaccacaaatatcaa

SEQ ID NO: 1007288 - DNA, 22 bp, Artificial Sequence
  chemically synthesized
tagtttgttcaggttgatattt

SEQ ID NO: 1007289 - DNA, 22 bp, Artificial Sequence
  chemically synthesized
tgtagtttgttcaggttgatat

SEQ ID NO: 1007290 - DNA, 22 bp, Artificial Sequence
  chemically synthesized
gaccacaaatatcaacctgaac

SEQ ID NO: 1007291 - DNA, 22 bp, Artificial Sequence
  chemically synthesized
aagcaaatgtggagggtgttct

SEQ ID NO: 1007292 - DNA, 22 bp, Artificial Sequence
  chemically synthesized
aacaaactacagaacaccctcc

SEQ ID NO: 1007293 - DNA, 22 bp, Artificial Sequence
  chemically synthesized
tcagtgctgaagcaaatgtgga

SEQ ID NO: 1007294 - DNA, 22 bp, Artificial Sequence
  chemically synthesized
cagaacaccctccacatttgct

SEQ ID NO: 1007295 - DNA, 22 bp, Artificial Sequence
  chemically synthesized
aaaactgtcagtgctgaagcaa

SEQ ID NO: 1007296 - DNA, 22 bp, Artificial Sequence
  chemically synthesized
cacatttgcttcagcactgaca

SEQ ID NO: 1007297 - DNA, 22 bp, Artificial Sequence
  chemically synthesized
gcttcagcactgacagttttga

SEQ ID NO: 1007298 - DNA, 22 bp, Artificial Sequence
  chemically synthesized
cttcagcactgacagttttgaa

SEQ ID NO: 1007299 - DNA, 22 bp, Artificial Sequence
  chemically synthesized
gccaccagggagtgttcaaaac

SEQ ID NO: 1007300 - DNA, 22 bp, Artificial Sequence
  chemically synthesized
cagcactgacagttttgaacac

SEQ ID NO: 1007301 - DNA, 22 bp, Artificial Sequence
  chemically synthesized
ggccaccagggagtgttcaaaa

SEQ ID NO: 1007302 - DNA, 22 bp, Artificial Sequence
  chemically synthesized
agcactgacagttttgaacact

SEQ ID NO: 1007303 - DNA, 22 bp, Artificial Sequence
  chemically synthesized
acagttttgaacactccctggt

SEQ ID NO: 1007304 - DNA, 22 bp, Artificial Sequence
  chemically synthesized
tgaacactccctggtggccaaa

SEQ ID NO: 1007305 - DNA, 22 bp, Artificial Sequence
  chemically synthesized
gaacactccctggtggccaaac

SEQ ID NO: 1007306 - DNA, 22 bp, Artificial Sequence
  chemically synthesized
aacactccctggtggccaaact

SEQ ID NO: 1007307 - DNA, 22 bp, Artificial Sequence
  chemically synthesized
aaaggtgaaaacaagtgagttt

SEQ ID NO: 1007308 - DNA, 22 bp, Artificial Sequence
  chemically synthesized
caaaggtgaaaacaagtgagtt

SEQ ID NO: 1007309 - DNA, 22 bp, Artificial Sequence
  chemically synthesized
cctggtggccaaactcacttgt

SEQ ID NO: 1007310 - DNA, 22 bp, Artificial Sequence
  chemically synthesized
atttcaaaggtgaaaacaagtg

SEQ ID NO: 1007311 - DNA, 22 bp, Artificial Sequence
  chemically synthesized
gtggccaaactcacttgttttc

SEQ ID NO: 1007312 - DNA, 22 bp, Artificial Sequence
  chemically synthesized
actcatttcaaaggtgaaaaca

SEQ ID NO: 1007313 - DNA, 22 bp, Artificial Sequence
  chemically synthesized
acttgttttcacctttgaaatg

SEQ ID NO: 1007314 - DNA, 22 bp, Artificial Sequence
  chemically synthesized
agtgaaaactaactcatttcaa

SEQ ID NO: 1007315 - DNA, 22 bp, Artificial Sequence
  chemically synthesized
gttttcacctttgaaatgagtt

SEQ ID NO: 1007316 - DNA, 22 bp, Artificial Sequence
  chemically synthesized
ttttcacctttgaaatgagtta

SEQ ID NO: 1007317 - DNA, 22 bp, Artificial Sequence
  chemically synthesized
tcacctttgaaatgagttagtt

SEQ ID NO: 1007318 - DNA, 22 bp, Artificial Sequence
  chemically synthesized
cacctttgaaatgagttagttt

SEQ ID NO: 1007319 - DNA, 22 bp, Artificial Sequence
  chemically synthesized
acctttgaaatgagttagtttt

SEQ ID NO: 1007320 - DNA, 22 bp, Artificial Sequence
  chemically synthesized
tgaaatgagttagttttcactg

SEQ ID NO: 1007321 - DNA, 22 bp, Artificial Sequence
  chemically synthesized
gaaatgagttagttttcactga

SEQ ID NO: 1007322 - DNA, 22 bp, Artificial Sequence
  chemically synthesized
aaatgagttagttttcactgag

SEQ ID NO: 1007323 - DNA, 22 bp, Artificial Sequence
  chemically synthesized
agtacccaacagcactcagtga

SEQ ID NO: 1007324 - DNA, 22 bp, Artificial Sequence
  chemically synthesized
gtggctcagtacccaacagcac

SEQ ID NO: 1007325 - DNA, 22 bp, Artificial Sequence
  chemically synthesized
gttttcactgagtgctgttggg

SEQ ID NO: 1007326 - DNA, 22 bp, Artificial Sequence
  chemically synthesized
ctagtggctcagtacccaacag

SEQ ID NO: 1007327 - DNA, 22 bp, Artificial Sequence
  chemically synthesized
tcactgagtgctgttgggtact

SEQ ID NO: 1007328 - DNA, 22 bp, Artificial Sequence
  chemically synthesized
tgctagtggctcagtacccaac

SEQ ID NO: 1007329 - DNA, 22 bp, Artificial Sequence
  chemically synthesized
cactgagtgctgttgggtactg

SEQ ID NO: 1007330 - DNA, 22 bp, Artificial Sequence
  chemically synthesized
ctgctagtggctcagtacccaa

SEQ ID NO: 1007331 - DNA, 22 bp, Artificial Sequence
  chemically synthesized
actgagtgctgttgggtactga

SEQ ID NO: 1007332 - DNA, 22 bp, Artificial Sequence
  chemically synthesized
acttctgctagtggctcagtac

SEQ ID NO: 1007333 - DNA, 22 bp, Artificial Sequence
  chemically synthesized
agtgctgttgggtactgagcca

SEQ ID NO: 1007334 - DNA, 22 bp, Artificial Sequence
  chemically synthesized
ttgggtactgagccactagcag

SEQ ID NO: 1007335 - DNA, 22 bp, Artificial Sequence
  chemically synthesized
cacatcctcacttctgctagtg

SEQ ID NO: 1007336 - DNA, 22 bp, Artificial Sequence
  chemically synthesized
ggtactgagccactagcagaag

SEQ ID NO: 1007337 - DNA, 22 bp, Artificial Sequence
  chemically synthesized
agccactagcagaagtgaggat

SEQ ID NO: 1007338 - DNA, 22 bp, Artificial Sequence
  chemically synthesized
gcagaagtgaggatgtgcagtc

SEQ ID NO: 1007339 - DNA, 22 bp, Artificial Sequence
  chemically synthesized
gtggcgtgcaaccgtgagtcat

SEQ ID NO: 1007340 - DNA, 22 bp, Artificial Sequence
  chemically synthesized
agtggcgtgcaaccgtgagtca

SEQ ID NO: 1007341 - DNA, 22 bp, Artificial Sequence
  chemically synthesized
gcagtatttagtggcgtgcaac

SEQ ID NO: 1007342 - DNA, 22 bp, Artificial Sequence
  chemically synthesized
atgactcacggttgcacgccac

SEQ ID NO: 1007343 - DNA, 22 bp, Artificial Sequence
  chemically synthesized
acggttgcacgccactaaatac

SEQ ID NO: 1007344 - DNA, 22 bp, Artificial Sequence
  chemically synthesized
cacgccactaaatactgccaat

SEQ ID NO: 1007345 - DNA, 22 bp, Artificial Sequence
  chemically synthesized
caaggggaaaaatgtgtgtaat

SEQ ID NO: 1007346 - DNA, 22 bp, Artificial Sequence
  chemically synthesized
gcaaggggaaaaatgtgtgtaa

SEQ ID NO: 1007347 - DNA, 22 bp, Artificial Sequence
  chemically synthesized
aatactgccaattacacacatt

SEQ ID NO: 1007348 - DNA, 22 bp, Artificial Sequence
  chemically synthesized
ccaattacacacatttttcccc

SEQ ID NO: 1007349 - DNA, 22 bp, Artificial Sequence
  chemically synthesized
cccaaaatttgcaaggggaaaa

SEQ ID NO: 1007350 - DNA, 22 bp, Artificial Sequence
  chemically synthesized
ccccaaaatttgcaaggggaaa

SEQ ID NO: 1007351 - DNA, 22 bp, Artificial Sequence
  chemically synthesized
cacacatttttccccttgcaaa

SEQ ID NO: 1007352 - DNA, 22 bp, Artificial Sequence
  chemically synthesized
ccccttccccaaaatttgcaag

SEQ ID NO: 1007353 - DNA, 22 bp, Artificial Sequence
  chemically synthesized
ttccccttgcaaattttgggga

SEQ ID NO: 1007354 - DNA, 22 bp, Artificial Sequence
  chemically synthesized
tccccttgcaaattttggggaa

SEQ ID NO: 1007355 - DNA, 22 bp, Artificial Sequence
  chemically synthesized
ccccttgcaaattttggggaag

SEQ ID NO: 1007356 - DNA, 22 bp, Artificial Sequence
  chemically synthesized
acacccctcccccttccccaaa

SEQ ID NO: 1007357 - DNA, 22 bp, Artificial Sequence
  chemically synthesized
cccttgcaaattttggggaagg

SEQ ID NO: 1007358 - DNA, 22 bp, Artificial Sequence
  chemically synthesized
cacacccctcccccttccccaa

SEQ ID NO: 1007359 - DNA, 22 bp, Artificial Sequence
  chemically synthesized
gcaaattttggggaagggggag

SEQ ID NO: 1007360 - DNA, 22 bp, Artificial Sequence
  chemically synthesized
caaattttggggaagggggagg

SEQ ID NO: 1007361 - DNA, 22 bp, Artificial Sequence
  chemically synthesized
ccccttcacacccctccccctt

SEQ ID NO: 1007362 - DNA, 22 bp, Artificial Sequence
  chemically synthesized
tggggaagggggaggggtgtga

SEQ ID NO: 1007363 - DNA, 22 bp, Artificial Sequence
  chemically synthesized
ggggaagggggaggggtgtgaa

SEQ ID NO: 1007364 - DNA, 22 bp, Artificial Sequence
  chemically synthesized
gggaagggggaggggtgtgaag

SEQ ID NO: 1007365 - DNA, 22 bp, Artificial Sequence
  chemically synthesized
acacccctcccccttcacaccc

SEQ ID NO: 1007366 - DNA, 22 bp, Artificial Sequence
  chemically synthesized
cacacccctcccccttcacacc

SEQ ID NO: 1007367 - DNA, 22 bp, Artificial Sequence
  chemically synthesized
cttcacacccctcccccttcac

SEQ ID NO: 1007368 - DNA, 22 bp, Artificial Sequence
  chemically synthesized
ctccttcacacccctccccctt

SEQ ID NO: 1007369 - DNA, 22 bp, Artificial Sequence
  chemically synthesized
acacccctcctccttcacaccc

SEQ ID NO: 1007370 - DNA, 22 bp, Artificial Sequence
  chemically synthesized
ctcacacccctcctccttcaca

SEQ ID NO: 1007371 - DNA, 22 bp, Artificial Sequence
  chemically synthesized
tatgcagctgctcacacccctc

SEQ ID NO: 1007372 - DNA, 22 bp, Artificial Sequence
  chemically synthesized
atatgcagctgctcacacccct

SEQ ID NO: 1007373 - DNA, 22 bp, Artificial Sequence
  chemically synthesized
cttatatgcagctgctcacacc

SEQ ID NO: 1007374 - DNA, 22 bp, Artificial Sequence
  chemically synthesized
catataaggagtgcctatactt

SEQ ID NO: 1007375 - DNA, 22 bp, Artificial Sequence
  chemically synthesized
aaaaaaaaaagaaaagaaagaa

SEQ ID NO: 1007376 - DNA, 22 bp, Artificial Sequence
  chemically synthesized
tctcaaaaaaaaaagaaaagaa

SEQ ID NO: 1007377 - DNA, 22 bp, Artificial Sequence
  chemically synthesized
tactttctttcttttctttttt

SEQ ID NO: 1007378 - DNA, 22 bp, Artificial Sequence
  chemically synthesized
tctttcttttcttttttttttg

SEQ ID NO: 1007379 - DNA, 22 bp, Artificial Sequence
  chemically synthesized
ctttcttttcttttttttttga

SEQ ID NO: 1007380 - DNA, 22 bp, Artificial Sequence
  chemically synthesized
tttcttttcttttttttttgag

SEQ ID NO: 1007381 - DNA, 22 bp, Artificial Sequence
  chemically synthesized
tcttttcttttttttttgagac

SEQ ID NO: 1007382 - DNA, 22 bp, Artificial Sequence
  chemically synthesized
cttttcttttttttttgagaca

SEQ ID NO: 1007383 - DNA, 22 bp, Artificial Sequence
  chemically synthesized
ttttcttttttttttgagacag

SEQ ID NO: 1007384 - DNA, 22 bp, Artificial Sequence
  chemically synthesized
ttcttttttttttgagacagtc

SEQ ID NO: 1007385 - DNA, 22 bp, Artificial Sequence
  chemically synthesized
tcttttttttttgagacagtct

SEQ ID NO: 1007386 - DNA, 22 bp, Artificial Sequence
  chemically synthesized
ggtgacagagtaagactgtctc

SEQ ID NO: 1007387 - DNA, 22 bp, Artificial Sequence
  chemically synthesized
cttttttttttgagacagtctt

SEQ ID NO: 1007388 - DNA, 22 bp, Artificial Sequence
  chemically synthesized
ttttttttttgagacagtctta

SEQ ID NO: 1007389 - DNA, 22 bp, Artificial Sequence
  chemically synthesized
ttttttttgagacagtcttact

SEQ ID NO: 1007390 - DNA, 22 bp, Artificial Sequence
  chemically synthesized
tttttttgagacagtcttactc

SEQ ID NO: 1007391 - DNA, 22 bp, Artificial Sequence
  chemically synthesized
ttttttgagacagtcttactct

SEQ ID NO: 1007392 - DNA, 22 bp, Artificial Sequence
  chemically synthesized
tttttgagacagtcttactctg

SEQ ID NO: 1007393 - DNA, 22 bp, Artificial Sequence
  chemically synthesized
cgacctgggtgacagagtaaga

SEQ ID NO: 1007394 - DNA, 22 bp, Artificial Sequence
  chemically synthesized
ttttgagacagtcttactctgt

SEQ ID NO: 1007395 - DNA, 22 bp, Artificial Sequence
  chemically synthesized
tttgagacagtcttactctgtc

SEQ ID NO: 1007396 - DNA, 22 bp, Artificial Sequence
  chemically synthesized
ttgagacagtcttactctgtca

SEQ ID NO: 1007397 - DNA, 22 bp, Artificial Sequence
  chemically synthesized
tgagacagtcttactctgtcac

SEQ ID NO: 1007398 - DNA, 22 bp, Artificial Sequence
  chemically synthesized
gagacagtcttactctgtcacc

SEQ ID NO: 1007399 - DNA, 22 bp, Artificial Sequence
  chemically synthesized
cactccgacctgggtgacagag

SEQ ID NO: 1007400 - DNA, 22 bp, Artificial Sequence
  chemically synthesized
agacagtcttactctgtcaccc

SEQ ID NO: 1007401 - DNA, 22 bp, Artificial Sequence
  chemically synthesized
actctgtcacccaggtcggagt

SEQ ID NO: 1007402 - DNA, 22 bp, Artificial Sequence
  chemically synthesized
ctctgtcacccaggtcggagtg

SEQ ID NO: 1007403 - DNA, 22 bp, Artificial Sequence
  chemically synthesized
agatagcaccactgcactccga

SEQ ID NO: 1007404 - DNA, 22 bp, Artificial Sequence
  chemically synthesized
tgtcacccaggtcggagtgcag

SEQ ID NO: 1007405 - DNA, 22 bp, Artificial Sequence
  chemically synthesized
tcacccaggtcggagtgcagtg

SEQ ID NO: 1007406 - DNA, 22 bp, Artificial Sequence
  chemically synthesized
cagtgagctgagatagcaccac

SEQ ID NO: 1007407 - DNA, 22 bp, Artificial Sequence
  chemically synthesized
ggagacagaggttgcagtgagc

SEQ ID NO: 1007408 - DNA, 22 bp, Artificial Sequence
  chemically synthesized
aacctgggagacagaggttgca

SEQ ID NO: 1007409 - DNA, 22 bp, Artificial Sequence
  chemically synthesized
tctcagctcactgcaacctctg

SEQ ID NO: 1007410 - DNA, 22 bp, Artificial Sequence
  chemically synthesized
gaacctgggagacagaggttgc

SEQ ID NO: 1007411 - DNA, 22 bp, Artificial Sequence
  chemically synthesized
cttgaacctgggagacagaggt

SEQ ID NO: 1007412 - DNA, 22 bp, Artificial Sequence
  chemically synthesized
agctcactgcaacctctgtctc

SEQ ID NO: 1007413 - DNA, 22 bp, Artificial Sequence
  chemically synthesized
actgcaacctctgtctcccagg

SEQ ID NO: 1007414 - DNA, 22 bp, Artificial Sequence
  chemically synthesized
caacctctgtctcccaggttca

SEQ ID NO: 1007415 - DNA, 22 bp, Artificial Sequence
  chemically synthesized
aggcgggaagattgcttgaacc

SEQ ID NO: 1007416 - DNA, 22 bp, Artificial Sequence
  chemically synthesized
tgtctcccaggttcaagcaatc

SEQ ID NO: 1007417 - DNA, 22 bp, Artificial Sequence
  chemically synthesized
tctcccaggttcaagcaatctt

SEQ ID NO: 1007418 - DNA, 22 bp, Artificial Sequence
  chemically synthesized
ccaggttcaagcaatcttcccg

SEQ ID NO: 1007419 - DNA, 22 bp, Artificial Sequence
  chemically synthesized
aggaggctgaggcgggaagatt

SEQ ID NO: 1007420 - DNA, 22 bp, Artificial Sequence
  chemically synthesized
ctcaggaggctgaggcgggaag

SEQ ID NO: 1007421 - DNA, 22 bp, Artificial Sequence
  chemically synthesized
aagcaatcttcccgcctcagcc

SEQ ID NO: 1007422 - DNA, 22 bp, Artificial Sequence
  chemically synthesized
atagtcccagctactcaggagg

SEQ ID NO: 1007423 - DNA, 22 bp, Artificial Sequence
  chemically synthesized
cccgcctcagcctcctgagtag

SEQ ID NO: 1007424 - DNA, 22 bp, Artificial Sequence
  chemically synthesized
ccgcctcagcctcctgagtagc

SEQ ID NO: 1007425 - DNA, 22 bp, Artificial Sequence
  chemically synthesized
ctgatagtcccagctactcagg

SEQ ID NO: 1007426 - DNA, 22 bp, Artificial Sequence
  chemically synthesized
gctgatagtcccagctactcag

SEQ ID NO: 1007427 - DNA, 22 bp, Artificial Sequence
  chemically synthesized
agcctcctgagtagctgggact

SEQ ID NO: 1007428 - DNA, 22 bp, Artificial Sequence
  chemically synthesized
ctgagtagctgggactatcagc

SEQ ID NO: 1007429 - DNA, 22 bp, Artificial Sequence
  chemically synthesized
cgtggtggcgcttgctgatagt

SEQ ID NO: 1007430 - DNA, 22 bp, Artificial Sequence
  chemically synthesized
gcgtggtggcgcttgctgatag

SEQ ID NO: 1007431 - DNA, 22 bp, Artificial Sequence
  chemically synthesized
agtagctgggactatcagcaag

SEQ ID NO: 1007432 - DNA, 22 bp, Artificial Sequence
  chemically synthesized
ggactatcagcaagcgccacca

SEQ ID NO: 1007433 - DNA, 22 bp, Artificial Sequence
  chemically synthesized
tcagcaagcgccaccacgcaag

SEQ ID NO: 1007434 - DNA, 22 bp, Artificial Sequence
  chemically synthesized
ttgtgtgtgtgtgtgtgtgtgt

SEQ ID NO: 1007435 - DNA, 22 bp, Artificial Sequence
  chemically synthesized
tgtgtgtgtgtgtgtgtgtgtg

SEQ ID NO: 1007436 - DNA, 22 bp, Artificial Sequence
  chemically synthesized
gtgtgtgtgtgtgtgtgtgtgt

SEQ ID NO: 1007437 - DNA, 22 bp, Artificial Sequence
  chemically synthesized
tgtgtgtgtgtgtgtgtgtgtg

SEQ ID NO: 1007438 - DNA, 22 bp, Artificial Sequence
  chemically synthesized
aaaatacacacacacacacaca

SEQ ID NO: 1007439 - DNA, 22 bp, Artificial Sequence
  chemically synthesized
ctaaaaatacacacacacacac

SEQ ID NO: 1007440 - DNA, 22 bp, Artificial Sequence
  chemically synthesized
tactaaaaatacacacacacac

SEQ ID NO: 1007441 - DNA, 22 bp, Artificial Sequence
  chemically synthesized
cacctctactaaaaatacacac

SEQ ID NO: 1007442 - DNA, 22 bp, Artificial Sequence
  chemically synthesized
cagggtgaaactccacctctac

SEQ ID NO: 1007443 - DNA, 22 bp, Artificial Sequence
  chemically synthesized
gcctacagggtgaaactccacc

SEQ ID NO: 1007444 - DNA, 22 bp, Artificial Sequence
  chemically synthesized
ttagtagaggtggagtttcacc

SEQ ID NO: 1007445 - DNA, 22 bp, Artificial Sequence
  chemically synthesized
tagtagaggtggagtttcaccc

SEQ ID NO: 1007446 - DNA, 22 bp, Artificial Sequence
  chemically synthesized
gcctggcctacagggtgaaact

SEQ ID NO: 1007447 - DNA, 22 bp, Artificial Sequence
  chemically synthesized
agtagaggtggagtttcaccct

SEQ ID NO: 1007448 - DNA, 22 bp, Artificial Sequence
  chemically synthesized
gtagaggtggagtttcaccctg

SEQ ID NO: 1007449 - DNA, 22 bp, Artificial Sequence
  chemically synthesized
agtctagcctggcctacagggt

SEQ ID NO: 1007450 - DNA, 22 bp, Artificial Sequence
  chemically synthesized
gagtctagcctggcctacaggg

SEQ ID NO: 1007451 - DNA, 22 bp, Artificial Sequence
  chemically synthesized
caccctgtaggccaggctagac

SEQ ID NO: 1007452 - DNA, 22 bp, Artificial Sequence
  chemically synthesized
accctgtaggccaggctagact

SEQ ID NO: 1007453 - DNA, 22 bp, Artificial Sequence
  chemically synthesized
agcccagaagtttgagtctagc

SEQ ID NO: 1007454 - DNA, 22 bp, Artificial Sequence
  chemically synthesized
gagcccagaagtttgagtctag

SEQ ID NO: 1007455 - DNA, 22 bp, Artificial Sequence
  chemically synthesized
taggccaggctagactcaaact

SEQ ID NO: 1007456 - DNA, 22 bp, Artificial Sequence
  chemically synthesized
cttgagcccagaagtttgagtc

SEQ ID NO: 1007457 - DNA, 22 bp, Artificial Sequence
  chemically synthesized
gactcaaacttctgggctcaag

SEQ ID NO: 1007458 - DNA, 22 bp, Artificial Sequence
  chemically synthesized
gggcgagagtattgcttgagcc

SEQ ID NO: 1007459 - DNA, 22 bp, Artificial Sequence
  chemically synthesized
aaacttctgggctcaagcaata

SEQ ID NO: 1007460 - DNA, 22 bp, Artificial Sequence
  chemically synthesized
ggaagctggggcgagagtattg

SEQ ID NO: 1007461 - DNA, 22 bp, Artificial Sequence
  chemically synthesized
ctgggctcaagcaatactctcg

SEQ ID NO: 1007462 - DNA, 22 bp, Artificial Sequence
  chemically synthesized
gggaagctggggcgagagtatt

SEQ ID NO: 1007463 - DNA, 22 bp, Artificial Sequence
  chemically synthesized
tgggctcaagcaatactctcgc

SEQ ID NO: 1007464 - DNA, 22 bp, Artificial Sequence
  chemically synthesized
tgggaagctggggcgagagtat

SEQ ID NO: 1007465 - DNA, 22 bp, Artificial Sequence
  chemically synthesized
ggctcaagcaatactctcgccc

SEQ ID NO: 1007466 - DNA, 22 bp, Artificial Sequence
  chemically synthesized
aagcaatactctcgccccagct

SEQ ID NO: 1007467 - DNA, 22 bp, Artificial Sequence
  chemically synthesized
taatcccagcactttgggaagc

SEQ ID NO: 1007468 - DNA, 22 bp, Artificial Sequence
  chemically synthesized
tcgccccagcttcccaaagtgc

SEQ ID NO: 1007469 - DNA, 22 bp, Artificial Sequence
  chemically synthesized
gccccagcttcccaaagtgctg

SEQ ID NO: 1007470 - DNA, 22 bp, Artificial Sequence
  chemically synthesized
aagcctgtaatcccagcacttt

SEQ ID NO: 1007471 - DNA, 22 bp, Artificial Sequence
  chemically synthesized
cccaaagtgctgggattacagg

SEQ ID NO: 1007472 - DNA, 22 bp, Artificial Sequence
  chemically synthesized
ccaaagtgctgggattacaggc

SEQ ID NO: 1007473 - DNA, 22 bp, Artificial Sequence
  chemically synthesized
gccaagcatggtggttcaagcc

SEQ ID NO: 1007474 - DNA, 22 bp, Artificial Sequence
  chemically synthesized
ctggccaagcatggtggttcaa

SEQ ID NO: 1007475 - DNA, 22 bp, Artificial Sequence
  chemically synthesized
ggattacaggcttgaaccacca

SEQ ID NO: 1007476 - DNA, 22 bp, Artificial Sequence
  chemically synthesized
caggcttgaaccaccatgcttg

SEQ ID NO: 1007477 - DNA, 22 bp, Artificial Sequence
  chemically synthesized
taggtgctcctggccaagcatg

SEQ ID NO: 1007478 - DNA, 22 bp, Artificial Sequence
  chemically synthesized
gaaccaccatgcttggccagga

SEQ ID NO: 1007479 - DNA, 22 bp, Artificial Sequence
  chemically synthesized
aaccaccatgcttggccaggag

SEQ ID NO: 1007480 - DNA, 22 bp, Artificial Sequence
  chemically synthesized
aggtagaaactataggtgctcc

SEQ ID NO: 1007481 - DNA, 22 bp, Artificial Sequence
  chemically synthesized
gaggtagaaactataggtgctc

SEQ ID NO: 1007482 - DNA, 22 bp, Artificial Sequence
  chemically synthesized
tgaggtagaaactataggtgct

SEQ ID NO: 1007483 - DNA, 22 bp, Artificial Sequence
  chemically synthesized
ttgaggtagaaactataggtgc

SEQ ID NO: 1007484 - DNA, 22 bp, Artificial Sequence
  chemically synthesized
ggccaggagcacctatagtttc

SEQ ID NO: 1007485 - DNA, 22 bp, Artificial Sequence
  chemically synthesized
gccaggagcacctatagtttct

SEQ ID NO: 1007486 - DNA, 22 bp, Artificial Sequence
  chemically synthesized
tgtttttgaggtagaaactata

SEQ ID NO: 1007487 - DNA, 22 bp, Artificial Sequence
  chemically synthesized
tagtttctacctcaaaaacata

SEQ ID NO: 1007488 - DNA, 22 bp, Artificial Sequence
  chemically synthesized
ctacctcaaaaacatagccccc

SEQ ID NO: 1007489 - DNA, 22 bp, Artificial Sequence
  chemically synthesized
tggaaaggtatagggggctatg

SEQ ID NO: 1007490 - DNA, 22 bp, Artificial Sequence
  chemically synthesized
tacctcaaaaacatagccccct

SEQ ID NO: 1007491 - DNA, 22 bp, Artificial Sequence
  chemically synthesized
cctcaaaaacatagccccctat

SEQ ID NO: 1007492 - DNA, 22 bp, Artificial Sequence
  chemically synthesized
aaaaacatagccccctatacct

SEQ ID NO: 1007493 - DNA, 22 bp, Artificial Sequence
  chemically synthesized
tacctttccacagattatattg

SEQ ID NO: 1007494 - DNA, 22 bp, Artificial Sequence
  chemically synthesized
aatatcaaaagtaacaatataa

SEQ ID NO: 1007495 - DNA, 22 bp, Artificial Sequence
  chemically synthesized
tccacagattatattgttactt

SEQ ID NO: 1007496 - DNA, 22 bp, Artificial Sequence
  chemically synthesized
ccacagattatattgttacttt

SEQ ID NO: 1007497 - DNA, 22 bp, Artificial Sequence
  chemically synthesized
cacagattatattgttactttt

SEQ ID NO: 1007498 - DNA, 22 bp, Artificial Sequence
  chemically synthesized
tattgttacttttgatattgaa

SEQ ID NO: 1007499 - DNA, 22 bp, Artificial Sequence
  chemically synthesized
caatgaaaagaagttcaatatc

SEQ ID NO: 1007500 - DNA, 22 bp, Artificial Sequence
  chemically synthesized
acaatgaaaagaagttcaatat

SEQ ID NO: 1007501 - DNA, 22 bp, Artificial Sequence
  chemically synthesized
tacaatgaaaagaagttcaata

SEQ ID NO: 1007502 - DNA, 22 bp, Artificial Sequence
  chemically synthesized
ttacaatgaaaagaagttcaat

SEQ ID NO: 1007503 - DNA, 22 bp, Artificial Sequence
  chemically synthesized
ttacttttgatattgaacttct

SEQ ID NO: 1007504 - DNA, 22 bp, Artificial Sequence
  chemically synthesized
cttttgatattgaacttctttt

SEQ ID NO: 1007505 - DNA, 22 bp, Artificial Sequence
  chemically synthesized
ttgatattgaacttcttttcat

SEQ ID NO: 1007506 - DNA, 22 bp, Artificial Sequence
  chemically synthesized
caggcttttacaatgaaaagaa

SEQ ID NO: 1007507 - DNA, 22 bp, Artificial Sequence
  chemically synthesized
tgatattgaacttcttttcatt

SEQ ID NO: 1007508 - DNA, 22 bp, Artificial Sequence
  chemically synthesized
gatattgaacttcttttcattg

SEQ ID NO: 1007509 - DNA, 22 bp, Artificial Sequence
  chemically synthesized
tccaggcttttacaatgaaaag

SEQ ID NO: 1007510 - DNA, 22 bp, Artificial Sequence
  chemically synthesized
atattgaacttcttttcattgt

SEQ ID NO: 1007511 - DNA, 22 bp, Artificial Sequence
  chemically synthesized
ctccaggcttttacaatgaaaa

SEQ ID NO: 1007512 - DNA, 22 bp, Artificial Sequence
  chemically synthesized
tctccaggcttttacaatgaaa

SEQ ID NO: 1007513 - DNA, 22 bp, Artificial Sequence
  chemically synthesized
aacttcttttcattgtaaaagc

SEQ ID NO: 1007514 - DNA, 22 bp, Artificial Sequence
  chemically synthesized
aattttctccaggcttttacaa

SEQ ID NO: 1007515 - DNA, 22 bp, Artificial Sequence
  chemically synthesized
aaattttctccaggcttttaca

SEQ ID NO: 1007516 - DNA, 22 bp, Artificial Sequence
  chemically synthesized
cttttcattgtaaaagcctgga

SEQ ID NO: 1007517 - DNA, 22 bp, Artificial Sequence
  chemically synthesized
ttttcattgtaaaagcctggag

SEQ ID NO: 1007518 - DNA, 22 bp, Artificial Sequence
  chemically synthesized
ttcattgtaaaagcctggagaa

SEQ ID NO: 1007519 - DNA, 22 bp, Artificial Sequence
  chemically synthesized
tcattgtaaaagcctggagaaa

SEQ ID NO: 1007520 - DNA, 22 bp, Artificial Sequence
  chemically synthesized
cattgtaaaagcctggagaaaa

SEQ ID NO: 1007521 - DNA, 22 bp, Artificial Sequence
  chemically synthesized
attgtaaaagcctggagaaaat

SEQ ID NO: 1007522 - DNA, 22 bp, Artificial Sequence
  chemically synthesized
taaaagcctggagaaaatttaa

SEQ ID NO: 1007523 - DNA, 22 bp, Artificial Sequence
  chemically synthesized
gagaaaatttaaggctgtttat

SEQ ID NO: 1007524 - DNA, 22 bp, Artificial Sequence
  chemically synthesized
gaaaacagatatataaacagcc

SEQ ID NO: 1007525 - DNA, 22 bp, Artificial Sequence
  chemically synthesized
agaaaacagatatataaacagc

SEQ ID NO: 1007526 - DNA, 22 bp, Artificial Sequence
  chemically synthesized
atttagaaaacagatatataaa

SEQ ID NO: 1007527 - DNA, 22 bp, Artificial Sequence
  chemically synthesized
aaggctgtttatatatctgttt

SEQ ID NO: 1007528 - DNA, 22 bp, Artificial Sequence
  chemically synthesized
aggctgtttatatatctgtttt

SEQ ID NO: 1007529 - DNA, 22 bp, Artificial Sequence
  chemically synthesized
gtgtgctgatttagaaaacaga

SEQ ID NO: 1007530 - DNA, 22 bp, Artificial Sequence
  chemically synthesized
tttatatatctgttttctaaat

SEQ ID NO: 1007531 - DNA, 22 bp, Artificial Sequence
  chemically synthesized
atatatctgttttctaaatcag

SEQ ID NO: 1007532 - DNA, 22 bp, Artificial Sequence
  chemically synthesized
acagttggtgtgctgatttaga

SEQ ID NO: 1007533 - DNA, 22 bp, Artificial Sequence
  chemically synthesized
tatatctgttttctaaatcagc

SEQ ID NO: 1007534 - DNA, 22 bp, Artificial Sequence
  chemically synthesized
ttttctaaatcagcacaccaac

SEQ ID NO: 1007535 - DNA, 22 bp, Artificial Sequence
  chemically synthesized
tctaaatcagcacaccaactgt

SEQ ID NO: 1007536 - DNA, 22 bp, Artificial Sequence
  chemically synthesized
ctaaatcagcacaccaactgtg

SEQ ID NO: 1007537 - DNA, 22 bp, Artificial Sequence
  chemically synthesized
taaatcagcacaccaactgtga

SEQ ID NO: 1007538 - DNA, 22 bp, Artificial Sequence
  chemically synthesized
aaaagtgcagagttcacagttg

SEQ ID NO: 1007539 - DNA, 22 bp, Artificial Sequence
  chemically synthesized
aatcagcacaccaactgtgaac

SEQ ID NO: 1007540 - DNA, 22 bp, Artificial Sequence
  chemically synthesized
atcccaattcaaaagtgcagag

SEQ ID NO: 1007541 - DNA, 22 bp, Artificial Sequence
  chemically synthesized
tcatcccaattcaaaagtgcag

SEQ ID NO: 1007542 - DNA, 22 bp, Artificial Sequence
  chemically synthesized
tctcatcccaattcaaaagtgc

SEQ ID NO: 1007543 - DNA, 22 bp, Artificial Sequence
  chemically synthesized
tgaactctgcacttttgaattg

SEQ ID NO: 1007544 - DNA, 22 bp, Artificial Sequence
  chemically synthesized
cattctctcatcccaattcaaa

SEQ ID NO: 1007545 - DNA, 22 bp, Artificial Sequence
  chemically synthesized
ccattctctcatcccaattcaa

SEQ ID NO: 1007546 - DNA, 22 bp, Artificial Sequence
  chemically synthesized
tccattctctcatcccaattca

SEQ ID NO: 1007547 - DNA, 22 bp, Artificial Sequence
  chemically synthesized
tttccattctctcatcccaatt

SEQ ID NO: 1007548 - DNA, 22 bp, Artificial Sequence
  chemically synthesized
ctttccattctctcatcccaat

SEQ ID NO: 1007549 - DNA, 22 bp, Artificial Sequence
  chemically synthesized
tgcacttttgaattgggatgag

SEQ ID NO: 1007550 - DNA, 22 bp, Artificial Sequence
  chemically synthesized
tctttccattctctcatcccaa

SEQ ID NO: 1007551 - DNA, 22 bp, Artificial Sequence
  chemically synthesized
ttctttccattctctcatccca

SEQ ID NO: 1007552 - DNA, 22 bp, Artificial Sequence
  chemically synthesized
cacttttgaattgggatgagag

SEQ ID NO: 1007553 - DNA, 22 bp, Artificial Sequence
  chemically synthesized
tttctttccattctctcatccc

SEQ ID NO: 1007554 - DNA, 22 bp, Artificial Sequence
  chemically synthesized
ttttctttccattctctcatcc

SEQ ID NO: 1007555 - DNA, 22 bp, Artificial Sequence
  chemically synthesized
ttgaattgggatgagagaatgg

SEQ ID NO: 1007556 - DNA, 22 bp, Artificial Sequence
  chemically synthesized
tgaattgggatgagagaatgga

SEQ ID NO: 1007557 - DNA, 22 bp, Artificial Sequence
  chemically synthesized
gaattgggatgagagaatggaa

SEQ ID NO: 1007558 - DNA, 22 bp, Artificial Sequence
  chemically synthesized
aattgggatgagagaatggaaa

SEQ ID NO: 1007559 - DNA, 22 bp, Artificial Sequence
  chemically synthesized
ccaaccttttttctttccattc

SEQ ID NO: 1007560 - DNA, 22 bp, Artificial Sequence
  chemically synthesized
tcccaaccttttttctttccat

SEQ ID NO: 1007561 - DNA, 22 bp, Artificial Sequence
  chemically synthesized
ggatgagagaatggaaagaaaa

SEQ ID NO: 1007562 - DNA, 22 bp, Artificial Sequence
  chemically synthesized
ctctcccaaccttttttctttc

SEQ ID NO: 1007563 - DNA, 22 bp, Artificial Sequence
  chemically synthesized
cgctcctctcccaacctttttt

SEQ ID NO: 1007564 - DNA, 22 bp, Artificial Sequence
  chemically synthesized
ccagctccgctcctctcccaac

SEQ ID NO: 1007565 - DNA, 22 bp, Artificial Sequence
  chemically synthesized
cccagctccgctcctctcccaa

SEQ ID NO: 1007566 - DNA, 22 bp, Artificial Sequence
  chemically synthesized
ttcccagctccgctcctctccc

SEQ ID NO: 1007567 - DNA, 22 bp, Artificial Sequence
  chemically synthesized
cttcccagctccgctcctctcc

SEQ ID NO: 1007568 - DNA, 22 bp, Artificial Sequence
  chemically synthesized
tcttcccagctccgctcctctc

SEQ ID NO: 1007569 - DNA, 22 bp, Artificial Sequence
  chemically synthesized
ggagaggagcggagctgggaag

SEQ ID NO: 1007570 - DNA, 22 bp, Artificial Sequence
  chemically synthesized
gagatcacctttcttcccagct

SEQ ID NO: 1007571 - DNA, 22 bp, Artificial Sequence
  chemically synthesized
ggaagaaaggtgatctctagtc

SEQ ID NO: 1007572 - DNA, 22 bp, Artificial Sequence
  chemically synthesized
gagcagggagcggaggaaaaag

SEQ ID NO: 1007573 - DNA, 22 bp, Artificial Sequence
  chemically synthesized
tagtcctttttcctccgctccc

SEQ ID NO: 1007574 - DNA, 22 bp, Artificial Sequence
  chemically synthesized
gtcctttttcctccgctccctg

SEQ ID NO: 1007575 - DNA, 22 bp, Artificial Sequence
  chemically synthesized
gaaaagtgagctggagcaggga

SEQ ID NO: 1007576 - DNA, 22 bp, Artificial Sequence
  chemically synthesized
tttcctccgctccctgctccag

SEQ ID NO: 1007577 - DNA, 22 bp, Artificial Sequence
  chemically synthesized
ttcctccgctccctgctccagc

SEQ ID NO: 1007578 - DNA, 22 bp, Artificial Sequence
  chemically synthesized
tcctccgctccctgctccagct

SEQ ID NO: 1007579 - DNA, 22 bp, Artificial Sequence
  chemically synthesized
attggaaaagtgagctggagca

SEQ ID NO: 1007580 - DNA, 22 bp, Artificial Sequence
  chemically synthesized
cctccgctccctgctccagctc

SEQ ID NO: 1007581 - DNA, 22 bp, Artificial Sequence
  chemically synthesized
ctccgctccctgctccagctca

SEQ ID NO: 1007582 - DNA, 22 bp, Artificial Sequence
  chemically synthesized
cgctccctgctccagctcactt

SEQ ID NO: 1007583 - DNA, 22 bp, Artificial Sequence
  chemically synthesized
taaaaactgattggaaaagtga

SEQ ID NO: 1007584 - DNA, 22 bp, Artificial Sequence
  chemically synthesized
cctgctccagctcacttttcca

SEQ ID NO: 1007585 - DNA, 22 bp, Artificial Sequence
  chemically synthesized
ttataaaaactgattggaaaag

SEQ ID NO: 1007586 - DNA, 22 bp, Artificial Sequence
  chemically synthesized
attataaaaactgattggaaaa

SEQ ID NO: 1007587 - DNA, 22 bp, Artificial Sequence
  chemically synthesized
ctccagctcacttttccaatca

SEQ ID NO: 1007588 - DNA, 22 bp, Artificial Sequence
  chemically synthesized
cagctcacttttccaatcagtt

SEQ ID NO: 1007589 - DNA, 22 bp, Artificial Sequence
  chemically synthesized
acttttccaatcagtttttata

SEQ ID NO: 1007590 - DNA, 22 bp, Artificial Sequence
  chemically synthesized
ttccaatcagtttttataataa

SEQ ID NO: 1007591 - DNA, 22 bp, Artificial Sequence
  chemically synthesized
tccaatcagtttttataataag

SEQ ID NO: 1007592 - DNA, 22 bp, Artificial Sequence
  chemically synthesized
ccaatcagtttttataataagc

SEQ ID NO: 1007593 - DNA, 22 bp, Artificial Sequence
  chemically synthesized
caatcagtttttataataagca

SEQ ID NO: 1007594 - DNA, 22 bp, Artificial Sequence
  chemically synthesized
taggagaataaataatgcttat

SEQ ID NO: 1007595 - DNA, 22 bp, Artificial Sequence
  chemically synthesized
gtaggagaataaataatgctta

SEQ ID NO: 1007596 - DNA, 22 bp, Artificial Sequence
  chemically synthesized
tgtaggagaataaataatgctt

SEQ ID NO: 1007597 - DNA, 22 bp, Artificial Sequence
  chemically synthesized
ttgtaggagaataaataatgct

SEQ ID NO: 1007598 - DNA, 22 bp, Artificial Sequence
  chemically synthesized
ttataataagcattatttattc

SEQ ID NO: 1007599 - DNA, 22 bp, Artificial Sequence
  chemically synthesized
tataataagcattatttattct

SEQ ID NO: 1007600 - DNA, 22 bp, Artificial Sequence
  chemically synthesized
ataataagcattatttattctc

SEQ ID NO: 1007601 - DNA, 22 bp, Artificial Sequence
  chemically synthesized
agacttttgtaggagaataaat

SEQ ID NO: 1007602 - DNA, 22 bp, Artificial Sequence
  chemically synthesized
taataagcattatttattctcc

SEQ ID NO: 1007603 - DNA, 22 bp, Artificial Sequence
  chemically synthesized
gagacttttgtaggagaataaa

SEQ ID NO: 1007604 - DNA, 22 bp, Artificial Sequence
  chemically synthesized
tgagacttttgtaggagaataa

SEQ ID NO: 1007605 - DNA, 22 bp, Artificial Sequence
  chemically synthesized
gtaaactttgagacttttgtag

SEQ ID NO: 1007606 - DNA, 22 bp, Artificial Sequence
  chemically synthesized
tttattctcctacaaaagtctc

SEQ ID NO: 1007607 - DNA, 22 bp, Artificial Sequence
  chemically synthesized
attctcctacaaaagtctcaaa

SEQ ID NO: 1007608 - DNA, 22 bp, Artificial Sequence
  chemically synthesized
taactagtaaactttgagactt

SEQ ID NO: 1007609 - DNA, 22 bp, Artificial Sequence
  chemically synthesized
ttctcctacaaaagtctcaaag

SEQ ID NO: 1007610 - DNA, 22 bp, Artificial Sequence
  chemically synthesized
ataactagtaaactttgagact

SEQ ID NO: 1007611 - DNA, 22 bp, Artificial Sequence
  chemically synthesized
tataactagtaaactttgagac

SEQ ID NO: 1007612 - DNA, 22 bp, Artificial Sequence
  chemically synthesized
ttataactagtaaactttgaga

SEQ ID NO: 1007613 - DNA, 22 bp, Artificial Sequence
  chemically synthesized
tcctacaaaagtctcaaagttt

SEQ ID NO: 1007614 - DNA, 22 bp, Artificial Sequence
  chemically synthesized
tttataactagtaaactttgag

SEQ ID NO: 1007615 - DNA, 22 bp, Artificial Sequence
  chemically synthesized
ctacaaaagtctcaaagtttac

SEQ ID NO: 1007616 - DNA, 22 bp, Artificial Sequence
  chemically synthesized
caaaagtctcaaagtttactag

SEQ ID NO: 1007617 - DNA, 22 bp, Artificial Sequence
  chemically synthesized
aaagtttactagttataaaaaa

SEQ ID NO: 1007618 - DNA, 22 bp, Artificial Sequence
  chemically synthesized
ataaagcatcatgagtttttta

SEQ ID NO: 1007619 - DNA, 22 bp, Artificial Sequence
  chemically synthesized
aataaagcatcatgagtttttt

SEQ ID NO: 1007620 - DNA, 22 bp, Artificial Sequence
  chemically synthesized
actagttataaaaaactcatga

SEQ ID NO: 1007621 - DNA, 22 bp, Artificial Sequence
  chemically synthesized
tttaataaagcatcatgagttt

SEQ ID NO: 1007622 - DNA, 22 bp, Artificial Sequence
  chemically synthesized
ctagttataaaaaactcatgat

SEQ ID NO: 1007623 - DNA, 22 bp, Artificial Sequence
  chemically synthesized
gttataaaaaactcatgatgct

SEQ ID NO: 1007624 - DNA, 22 bp, Artificial Sequence
  chemically synthesized
ccctatttaataaagcatcatg

SEQ ID NO: 1007625 - DNA, 22 bp, Artificial Sequence
  chemically synthesized
accctatttaataaagcatcat

SEQ ID NO: 1007626 - DNA, 22 bp, Artificial Sequence
  chemically synthesized
taaaaaactcatgatgctttat

SEQ ID NO: 1007627 - DNA, 22 bp, Artificial Sequence
  chemically synthesized
atgatgctttattaaatagggt

SEQ ID NO: 1007628 - DNA, 22 bp, Artificial Sequence
  chemically synthesized
caaagtcaaatttaccctattt

SEQ ID NO: 1007629 - DNA, 22 bp, Artificial Sequence
  chemically synthesized
acaaagtcaaatttaccctatt

SEQ ID NO: 1007630 - DNA, 22 bp, Artificial Sequence
  chemically synthesized
tacaaagtcaaatttaccctat

SEQ ID NO: 1007631 - DNA, 22 bp, Artificial Sequence
  chemically synthesized
ctttacaaagtcaaatttaccc

SEQ ID NO: 1007632 - DNA, 22 bp, Artificial Sequence
  chemically synthesized
gctttacaaagtcaaatttacc

SEQ ID NO: 1007633 - DNA, 22 bp, Artificial Sequence
  chemically synthesized
tgctttacaaagtcaaatttac

SEQ ID NO: 1007634 - DNA, 22 bp, Artificial Sequence
  chemically synthesized
tattaaatagggtaaatttgac

SEQ ID NO: 1007635 - DNA, 22 bp, Artificial Sequence
  chemically synthesized
ttgctttacaaagtcaaattta

SEQ ID NO: 1007636 - DNA, 22 bp, Artificial Sequence
  chemically synthesized
attaaatagggtaaatttgact

SEQ ID NO: 1007637 - DNA, 22 bp, Artificial Sequence
  chemically synthesized
ttaaatagggtaaatttgactt

SEQ ID NO: 1007638 - DNA, 22 bp, Artificial Sequence
  chemically synthesized
tttttgctttacaaagtcaaat

SEQ ID NO: 1007639 - DNA, 22 bp, Artificial Sequence
  chemically synthesized
aatagggtaaatttgactttgt

SEQ ID NO: 1007640 - DNA, 22 bp, Artificial Sequence
  chemically synthesized
ttatttttgctttacaaagtca

SEQ ID NO: 1007641 - DNA, 22 bp, Artificial Sequence
  chemically synthesized
gttatttttgctttacaaagtc

SEQ ID NO: 1007642 - DNA, 22 bp, Artificial Sequence
  chemically synthesized
tgttatttttgctttacaaagt

SEQ ID NO: 1007643 - DNA, 22 bp, Artificial Sequence
  chemically synthesized
cgtattttgttatttttgcttt

SEQ ID NO: 1007644 - DNA, 22 bp, Artificial Sequence
  chemically synthesized
gactttgtaaagcaaaaataac

SEQ ID NO: 1007645 - DNA, 22 bp, Artificial Sequence
  chemically synthesized
actttgtaaagcaaaaataaca

SEQ ID NO: 1007646 - DNA, 22 bp, Artificial Sequence
  chemically synthesized
caaattacgtattttgttattt

SEQ ID NO: 1007647 - DNA, 22 bp, Artificial Sequence
  chemically synthesized
tgtaaagcaaaaataacaaaat

SEQ ID NO: 1007648 - DNA, 22 bp, Artificial Sequence
  chemically synthesized
gtaaagcaaaaataacaaaata

SEQ ID NO: 1007649 - DNA, 22 bp, Artificial Sequence
  chemically synthesized
taaagcaaaaataacaaaatac

SEQ ID NO: 1007650 - DNA, 22 bp, Artificial Sequence
  chemically synthesized
aaaattacaaattacgtatttt

SEQ ID NO: 1007651 - DNA, 22 bp, Artificial Sequence
  chemically synthesized
gaaaattacaaattacgtattt

SEQ ID NO: 1007652 - DNA, 22 bp, Artificial Sequence
  chemically synthesized
tgaaaattacaaattacgtatt

SEQ ID NO: 1007653 - DNA, 22 bp, Artificial Sequence
  chemically synthesized
catgtgtatattttgaaaatta

SEQ ID NO: 1007654 - DNA, 22 bp, Artificial Sequence
  chemically synthesized
aaattacatgtgtatattttga

SEQ ID NO: 1007655 - DNA, 22 bp, Artificial Sequence
  chemically synthesized
caaattacatgtgtatattttg

SEQ ID NO: 1007656 - DNA, 22 bp, Artificial Sequence
  chemically synthesized
gtaattttcaaaatatacacat

SEQ ID NO: 1007657 - DNA, 22 bp, Artificial Sequence
  chemically synthesized
taattttcaaaatatacacatg

SEQ ID NO: 1007658 - DNA, 22 bp, Artificial Sequence
  chemically synthesized
catgtaatttcaaattacatgt

SEQ ID NO: 1007659 - DNA, 22 bp, Artificial Sequence
  chemically synthesized
tcaaaatatacacatgtaattt

SEQ ID NO: 1007660 - DNA, 22 bp, Artificial Sequence
  chemically synthesized
caaaatatacacatgtaatttg

SEQ ID NO: 1007661 - DNA, 22 bp, Artificial Sequence
  chemically synthesized
aaaatatacacatgtaatttga

SEQ ID NO: 1007662 - DNA, 22 bp, Artificial Sequence
  chemically synthesized
gaaattacatgtaatttcatat

SEQ ID NO: 1007663 - DNA, 22 bp, Artificial Sequence
  chemically synthesized
cacacatgcataatatgaaatt

SEQ ID NO: 1007664 - DNA, 22 bp, Artificial Sequence
  chemically synthesized
aaattacatgtaatttcatatt

SEQ ID NO: 1007665 - DNA, 22 bp, Artificial Sequence
  chemically synthesized
cattacacacatgcataatatg

SEQ ID NO: 1007666 - DNA, 22 bp, Artificial Sequence
  chemically synthesized
gcattacacacatgcataatat

SEQ ID NO: 1007667 - DNA, 22 bp, Artificial Sequence
  chemically synthesized
catgtaatttcatattatgcat

SEQ ID NO: 1007668 - DNA, 22 bp, Artificial Sequence
  chemically synthesized
catattatgcatgtgtgtaatg

SEQ ID NO: 1007669 - DNA, 22 bp, Artificial Sequence
  chemically synthesized
catgtgtgcttgcattacacac

SEQ ID NO: 1007670 - DNA, 22 bp, Artificial Sequence
  chemically synthesized
atattatgcatgtgtgtaatgc

SEQ ID NO: 1007671 - DNA, 22 bp, Artificial Sequence
  chemically synthesized
ttacatgtgtgcttgcattaca

SEQ ID NO: 1007672 - DNA, 22 bp, Artificial Sequence
  chemically synthesized
tgcatgtgtgtaatgcaagcac

SEQ ID NO: 1007673 - DNA, 22 bp, Artificial Sequence
  chemically synthesized
catatgtattgttacatgtgtg

SEQ ID NO: 1007674 - DNA, 22 bp, Artificial Sequence
  chemically synthesized
catatataacacgttacatatg

SEQ ID NO: 1007675 - DNA, 22 bp, Artificial Sequence
  chemically synthesized
tatatgtaacacgttacatatg

SEQ ID NO: 1007676 - DNA, 22 bp, Artificial Sequence
  chemically synthesized
acacgtgcatatgtatgcaaca

SEQ ID NO: 1007677 - DNA, 22 bp, Artificial Sequence
  chemically synthesized
cctaacacgtgcatatgtatgc

SEQ ID NO: 1007678 - DNA, 22 bp, Artificial Sequence
  chemically synthesized
catatgtgttgcatacatatgc

SEQ ID NO: 1007679 - DNA, 22 bp, Artificial Sequence
  chemically synthesized
catacatatgcacgtgttaggt

SEQ ID NO: 1007680 - DNA, 22 bp, Artificial Sequence
  chemically synthesized
catgtgacatgtaaaacacgtt

SEQ ID NO: 1007681 - DNA, 22 bp, Artificial Sequence
  chemically synthesized
ttacatgtgacatgtaaaacac

SEQ ID NO: 1007682 - DNA, 22 bp, Artificial Sequence
  chemically synthesized
attgttacatgtgacatgtaaa

SEQ ID NO: 1007683 - DNA, 22 bp, Artificial Sequence
  chemically synthesized
ggtaacgtgttttacatgtcac

SEQ ID NO: 1007684 - DNA, 22 bp, Artificial Sequence
  chemically synthesized
catgtgaaattgattgttacat

SEQ ID NO: 1007685 - DNA, 22 bp, Artificial Sequence
  chemically synthesized
tacatgtcacatgtaacaatca

SEQ ID NO: 1007686 - DNA, 22 bp, Artificial Sequence
  chemically synthesized
acatgtcacatgtaacaatcaa

SEQ ID NO: 1007687 - DNA, 22 bp, Artificial Sequence
  chemically synthesized
catgtcacatgtaacaatcaat

SEQ ID NO: 1007688 - DNA, 22 bp, Artificial Sequence
  chemically synthesized
atgttacatgtgaaattgattg

SEQ ID NO: 1007689 - DNA, 22 bp, Artificial Sequence
  chemically synthesized
acatatgtaactgatgttacat

SEQ ID NO: 1007690 - DNA, 22 bp, Artificial Sequence
  chemically synthesized
cacatatgtaactgatgttaca

SEQ ID NO: 1007691 - DNA, 22 bp, Artificial Sequence
  chemically synthesized
tcacatatgtaactgatgttac

SEQ ID NO: 1007692 - DNA, 22 bp, Artificial Sequence
  chemically synthesized
cacatgtaacatcagttacata

SEQ ID NO: 1007693 - DNA, 22 bp, Artificial Sequence
  chemically synthesized
acatgtaacatcagttacatat

SEQ ID NO: 1007694 - DNA, 22 bp, Artificial Sequence
  chemically synthesized
catatgtgtgttttcacatatg

SEQ ID NO: 1007695 - DNA, 22 bp, Artificial Sequence
  chemically synthesized
catatgtgaaaacacacatatg

SEQ ID NO: 1007696 - DNA, 22 bp, Artificial Sequence
  chemically synthesized
tatatgtgtgtgattacatatg

SEQ ID NO: 1007697 - DNA, 22 bp, Artificial Sequence
  chemically synthesized
aaattatatatgtgtgtgatta

SEQ ID NO: 1007698 - DNA, 22 bp, Artificial Sequence
  chemically synthesized
caaattatatatgtgtgtgatt

SEQ ID NO: 1007699 - DNA, 22 bp, Artificial Sequence
  chemically synthesized
tgaaaaatttcaaattatatat

SEQ ID NO: 1007700 - DNA, 22 bp, Artificial Sequence
  chemically synthesized
aaaatgtggctatgaaaaattt

SEQ ID NO: 1007701 - DNA, 22 bp, Artificial Sequence
  chemically synthesized
aaaaatgtggctatgaaaaatt

SEQ ID NO: 1007702 - DNA, 22 bp, Artificial Sequence
  chemically synthesized
taaaaatgtggctatgaaaaat

SEQ ID NO: 1007703 - DNA, 22 bp, Artificial Sequence
  chemically synthesized
ttaaaaatgtggctatgaaaaa

SEQ ID NO: 1007704 - DNA, 22 bp, Artificial Sequence
  chemically synthesized
cttttaaaaatgtggctatgaa

SEQ ID NO: 1007705 - DNA, 22 bp, Artificial Sequence
  chemically synthesized
gcttttaaaaatgtggctatga

SEQ ID NO: 1007706 - DNA, 22 bp, Artificial Sequence
  chemically synthesized
tgcttttaaaaatgtggctatg

SEQ ID NO: 1007707 - DNA, 22 bp, Artificial Sequence
  chemically synthesized
gaaatttttcatagccacattt

SEQ ID NO: 1007708 - DNA, 22 bp, Artificial Sequence
  chemically synthesized
aaatttttcatagccacatttt

SEQ ID NO: 1007709 - DNA, 22 bp, Artificial Sequence
  chemically synthesized
attttgcttttaaaaatgtggc

SEQ ID NO: 1007710 - DNA, 22 bp, Artificial Sequence
  chemically synthesized
cattttgcttttaaaaatgtgg

SEQ ID NO: 1007711 - DNA, 22 bp, Artificial Sequence
  chemically synthesized
acttcattttgcttttaaaaat

SEQ ID NO: 1007712 - DNA, 22 bp, Artificial Sequence
  chemically synthesized
ttcatagccacatttttaaaag

SEQ ID NO: 1007713 - DNA, 22 bp, Artificial Sequence
  chemically synthesized
tcatagccacatttttaaaagc

SEQ ID NO: 1007714 - DNA, 22 bp, Artificial Sequence
  chemically synthesized
catagccacatttttaaaagca

SEQ ID NO: 1007715 - DNA, 22 bp, Artificial Sequence
  chemically synthesized
atagccacatttttaaaagcaa

SEQ ID NO: 1007716 - DNA, 22 bp, Artificial Sequence
  chemically synthesized
aattgacttcattttgctttta

SEQ ID NO: 1007717 - DNA, 22 bp, Artificial Sequence
  chemically synthesized
ttaaaagcaaaatgaagtcaat

SEQ ID NO: 1007718 - DNA, 22 bp, Artificial Sequence
  chemically synthesized
taaaagcaaaatgaagtcaatt

SEQ ID NO: 1007719 - DNA, 22 bp, Artificial Sequence
  chemically synthesized
aaaagcaaaatgaagtcaattt

SEQ ID NO: 1007720 - DNA, 22 bp, Artificial Sequence
  chemically synthesized
aaagcaaaatgaagtcaattta

SEQ ID NO: 1007721 - DNA, 22 bp, Artificial Sequence
  chemically synthesized
aataaaatatataattaaattg

SEQ ID NO: 1007722 - DNA, 22 bp, Artificial Sequence
  chemically synthesized
attaaataaaatatataattaa

SEQ ID NO: 1007723 - DNA, 22 bp, Artificial Sequence
  chemically synthesized
tagttgattaaataaaatatat

SEQ ID NO: 1007724 - DNA, 22 bp, Artificial Sequence
  chemically synthesized
ttatagttgattaaataaaata

SEQ ID NO: 1007725 - DNA, 22 bp, Artificial Sequence
  chemically synthesized
attatagttgattaaataaaat

SEQ ID NO: 1007726 - DNA, 22 bp, Artificial Sequence
  chemically synthesized
tattatagttgattaaataaaa

SEQ ID NO: 1007727 - DNA, 22 bp, Artificial Sequence
  chemically synthesized
aattatatattttatttaatca

SEQ ID NO: 1007728 - DNA, 22 bp, Artificial Sequence
  chemically synthesized
attatatattttatttaatcaa

SEQ ID NO: 1007729 - DNA, 22 bp, Artificial Sequence
  chemically synthesized
tggttttattatagttgattaa

SEQ ID NO: 1007730 - DNA, 22 bp, Artificial Sequence
  chemically synthesized
tatattttatttaatcaactat

SEQ ID NO: 1007731 - DNA, 22 bp, Artificial Sequence
  chemically synthesized
aaattatggttttattatagtt

SEQ ID NO: 1007732 - DNA, 22 bp, Artificial Sequence
  chemically synthesized
tatttaatcaactataataaaa

SEQ ID NO: 1007733 - DNA, 22 bp, Artificial Sequence
  chemically synthesized
atttaatcaactataataaaac

SEQ ID NO: 1007734 - DNA, 22 bp, Artificial Sequence
  chemically synthesized
tttaatcaactataataaaacc

SEQ ID NO: 1007735 - DNA, 22 bp, Artificial Sequence
  chemically synthesized
catgttaaaattatggttttat

SEQ ID NO: 1007736 - DNA, 22 bp, Artificial Sequence
  chemically synthesized
aatcaactataataaaaccata

SEQ ID NO: 1007737 - DNA, 22 bp, Artificial Sequence
  chemically synthesized
atcaactataataaaaccataa

SEQ ID NO: 1007738 - DNA, 22 bp, Artificial Sequence
  chemically synthesized
ttgcatgttaaaattatggttt

SEQ ID NO: 1007739 - DNA, 22 bp, Artificial Sequence
  chemically synthesized
attgcatgttaaaattatggtt

SEQ ID NO: 1007740 - DNA, 22 bp, Artificial Sequence
  chemically synthesized
atttattgcatgttaaaattat

SEQ ID NO: 1007741 - DNA, 22 bp, Artificial Sequence
  chemically synthesized
taataaaaccataattttaaca

SEQ ID NO: 1007742 - DNA, 22 bp, Artificial Sequence
  chemically synthesized
taacatgcaataaatgagcatt

SEQ ID NO: 1007743 - DNA, 22 bp, Artificial Sequence
  chemically synthesized
aacatgcaataaatgagcattt

SEQ ID NO: 1007744 - DNA, 22 bp, Artificial Sequence
  chemically synthesized
acatgcaataaatgagcattta

SEQ ID NO: 1007745 - DNA, 22 bp, Artificial Sequence
  chemically synthesized
gaaccaaaaaggaagtaaatgc

SEQ ID NO: 1007746 - DNA, 22 bp, Artificial Sequence
  chemically synthesized
agaaccaaaaaggaagtaaatg

SEQ ID NO: 1007747 - DNA, 22 bp, Artificial Sequence
  chemically synthesized
aatacttagaaccaaaaaggaa

SEQ ID NO: 1007748 - DNA, 22 bp, Artificial Sequence
  chemically synthesized
gaatacttagaaccaaaaagga

SEQ ID NO: 1007749 - DNA, 22 bp, Artificial Sequence
  chemically synthesized
acttcctttttggttctaagta

SEQ ID NO: 1007750 - DNA, 22 bp, Artificial Sequence
  chemically synthesized
cttcctttttggttctaagtat

SEQ ID NO: 1007751 - DNA, 22 bp, Artificial Sequence
  chemically synthesized
cctttttggttctaagtattca

SEQ ID NO: 1007752 - DNA, 22 bp, Artificial Sequence
  chemically synthesized
ctttttggttctaagtattcaa

SEQ ID NO: 1007753 - DNA, 22 bp, Artificial Sequence
  chemically synthesized
tttggttctaagtattcaaacc

SEQ ID NO: 1007754 - DNA, 22 bp, Artificial Sequence
  chemically synthesized
ttggttctaagtattcaaaccc

SEQ ID NO: 1007755 - DNA, 22 bp, Artificial Sequence
  chemically synthesized
tggttctaagtattcaaaccct

SEQ ID NO: 1007756 - DNA, 22 bp, Artificial Sequence
  chemically synthesized
ggttctaagtattcaaaccctg

SEQ ID NO: 1007757 - DNA, 22 bp, Artificial Sequence
  chemically synthesized
gttctaagtattcaaaccctgg

SEQ ID NO: 1007758 - DNA, 22 bp, Artificial Sequence
  chemically synthesized
agtataacacacatgccagggt

SEQ ID NO: 1007759 - DNA, 22 bp, Artificial Sequence
  chemically synthesized
taagtattcaaaccctggcatg

SEQ ID NO: 1007760 - DNA, 22 bp, Artificial Sequence
  chemically synthesized
agtattcaaaccctggcatgtg

SEQ ID NO: 1007761 - DNA, 22 bp, Artificial Sequence
  chemically synthesized
aaaccctggcatgtgtgttata

SEQ ID NO: 1007762 - DNA, 22 bp, Artificial Sequence
  chemically synthesized
agatgggcactgagtataacac

SEQ ID NO: 1007763 - DNA, 22 bp, Artificial Sequence
  chemically synthesized
attgagatgggcactgagtata

SEQ ID NO: 1007764 - DNA, 22 bp, Artificial Sequence
  chemically synthesized
gcatgtgtgttatactcagtgc

SEQ ID NO: 1007765 - DNA, 22 bp, Artificial Sequence
  chemically synthesized
gtactaattgagatgggcactg

SEQ ID NO: 1007766 - DNA, 22 bp, Artificial Sequence
  chemically synthesized
tactcagtgcccatctcaatta

SEQ ID NO: 1007767 - DNA, 22 bp, Artificial Sequence
  chemically synthesized
aaatgcggctagtactaattga

SEQ ID NO: 1007768 - DNA, 22 bp, Artificial Sequence
  chemically synthesized
aaaatgcggctagtactaattg

SEQ ID NO: 1007769 - DNA, 22 bp, Artificial Sequence
  chemically synthesized
agtgcccatctcaattagtact

SEQ ID NO: 1007770 - DNA, 22 bp, Artificial Sequence
  chemically synthesized
ttaaaatgcggctagtactaat

SEQ ID NO: 1007771 - DNA, 22 bp, Artificial Sequence
  chemically synthesized
agctcttaaaatgcggctagta

SEQ ID NO: 1007772 - DNA, 22 bp, Artificial Sequence
  chemically synthesized
aattagtactagccgcatttta

SEQ ID NO: 1007773 - DNA, 22 bp, Artificial Sequence
  chemically synthesized
gtactagccgcattttaagagc

SEQ ID NO: 1007774 - DNA, 22 bp, Artificial Sequence
  chemically synthesized
gccacataagatactgagctct

SEQ ID NO: 1007775 - DNA, 22 bp, Artificial Sequence
  chemically synthesized
gccgcattttaagagctcagta

SEQ ID NO: 1007776 - DNA, 22 bp, Artificial Sequence
  chemically synthesized
taagagctcagtatcttatgtg

SEQ ID NO: 1007777 - DNA, 22 bp, Artificial Sequence
  chemically synthesized
aagagctcagtatcttatgtgg

SEQ ID NO: 1007778 - DNA, 22 bp, Artificial Sequence
  chemically synthesized
agtgccccctagccacataaga

SEQ ID NO: 1007779 - DNA, 22 bp, Artificial Sequence
  chemically synthesized
agagctcagtatcttatgtggc

SEQ ID NO: 1007780 - DNA, 22 bp, Artificial Sequence
  chemically synthesized
agtatcttatgtggctaggggg

SEQ ID NO: 1007781 - DNA, 22 bp, Artificial Sequence
  chemically synthesized
caaagtccaattcagtgccccc

SEQ ID NO: 1007782 - DNA, 22 bp, Artificial Sequence
  chemically synthesized
atgtggctagggggcactgaat

SEQ ID NO: 1007783 - DNA, 22 bp, Artificial Sequence
  chemically synthesized
tgtggctagggggcactgaatt

SEQ ID NO: 1007784 - DNA, 22 bp, Artificial Sequence
  chemically synthesized
gagctgcaaagtccaattcagt

SEQ ID NO: 1007785 - DNA, 22 bp, Artificial Sequence
  chemically synthesized
agagctgcaaagtccaattcag

SEQ ID NO: 1007786 - DNA, 22 bp, Artificial Sequence
  chemically synthesized
tagagctgcaaagtccaattca

SEQ ID NO: 1007787 - DNA, 22 bp, Artificial Sequence
  chemically synthesized
tttagagctgcaaagtccaatt

SEQ ID NO: 1007788 - DNA, 22 bp, Artificial Sequence
  chemically synthesized
gggggcactgaattggactttg

SEQ ID NO: 1007789 - DNA, 22 bp, Artificial Sequence
  chemically synthesized
tctttagagctgcaaagtccaa

SEQ ID NO: 1007790 - DNA, 22 bp, Artificial Sequence
  chemically synthesized
aattggactttgcagctctaaa

SEQ ID NO: 1007791 - DNA, 22 bp, Artificial Sequence
  chemically synthesized
gactttgcagctctaaagagag

SEQ ID NO: 1007792 - DNA, 22 bp, Artificial Sequence
  chemically synthesized
tgcagctctaaagagagacctc

SEQ ID NO: 1007793 - DNA, 22 bp, Artificial Sequence
  chemically synthesized
gcagctctaaagagagacctca

SEQ ID NO: 1007794 - DNA, 22 bp, Artificial Sequence
  chemically synthesized
cagctctaaagagagacctcac

SEQ ID NO: 1007795 - DNA, 22 bp, Artificial Sequence
  chemically synthesized
acaataaaaatcacaatgtgag

SEQ ID NO: 1007796 - DNA, 22 bp, Artificial Sequence
  chemically synthesized
taaagagagacctcacattgtg

SEQ ID NO: 1007797 - DNA, 22 bp, Artificial Sequence
  chemically synthesized
aagagagacctcacattgtgat

SEQ ID NO: 1007798 - DNA, 22 bp, Artificial Sequence
  chemically synthesized
cctgacaataaaaatcacaatg

SEQ ID NO: 1007799 - DNA, 22 bp, Artificial Sequence
  chemically synthesized
gcctgacaataaaaatcacaat

SEQ ID NO: 1007800 - DNA, 22 bp, Artificial Sequence
  chemically synthesized
aaatttgcctgacaataaaaat

SEQ ID NO: 1007801 - DNA, 22 bp, Artificial Sequence
  chemically synthesized
gaaatttgcctgacaataaaaa

SEQ ID NO: 1007802 - DNA, 22 bp, Artificial Sequence
  chemically synthesized
tgaaatttgcctgacaataaaa

SEQ ID NO: 1007803 - DNA, 22 bp, Artificial Sequence
  chemically synthesized
acattgtgatttttattgtcag

SEQ ID NO: 1007804 - DNA, 22 bp, Artificial Sequence
  chemically synthesized
tgatttttattgtcaggcaaat

SEQ ID NO: 1007805 - DNA, 22 bp, Artificial Sequence
  chemically synthesized
ttattgtcaggcaaatttcaaa

SEQ ID NO: 1007806 - DNA, 22 bp, Artificial Sequence
  chemically synthesized
tattgtcaggcaaatttcaaaa

SEQ ID NO: 1007807 - DNA, 22 bp, Artificial Sequence
  chemically synthesized
attgtcaggcaaatttcaaaat

SEQ ID NO: 1007808 - DNA, 22 bp, Artificial Sequence
  chemically synthesized
ttgtcaggcaaatttcaaaatt

SEQ ID NO: 1007809 - DNA, 22 bp, Artificial Sequence
  chemically synthesized
tcaggcaaatttcaaaattatt

SEQ ID NO: 1007810 - DNA, 22 bp, Artificial Sequence
  chemically synthesized
atccaagcagagaaataatttt

SEQ ID NO: 1007811 - DNA, 22 bp, Artificial Sequence
  chemically synthesized
caaaattatttctctgcttgga

SEQ ID NO: 1007812 - DNA, 22 bp, Artificial Sequence
  chemically synthesized
aaaattatttctctgcttggat

SEQ ID NO: 1007813 - DNA, 22 bp, Artificial Sequence
  chemically synthesized
tttctctgcttggatgaggcac

SEQ ID NO: 1007814 - DNA, 22 bp, Artificial Sequence
  chemically synthesized
ctctgcttggatgaggcaccac

SEQ ID NO: 1007815 - DNA, 22 bp, Artificial Sequence
  chemically synthesized
tctgcttggatgaggcaccacg

SEQ ID NO: 1007816 - DNA, 22 bp, Artificial Sequence
  chemically synthesized
caaggagtgagacgtggtgcct

SEQ ID NO: 1007817 - DNA, 22 bp, Artificial Sequence
  chemically synthesized
gcaaggagtgagacgtggtgcc

SEQ ID NO: 1007818 - DNA, 22 bp, Artificial Sequence
  chemically synthesized
tgcttggatgaggcaccacgtc

SEQ ID NO: 1007819 - DNA, 22 bp, Artificial Sequence
  chemically synthesized
cttggatgaggcaccacgtctc

SEQ ID NO: 1007820 - DNA, 22 bp, Artificial Sequence
  chemically synthesized
ggatgaggcaccacgtctcact

SEQ ID NO: 1007821 - DNA, 22 bp, Artificial Sequence
  chemically synthesized
gatgaggcaccacgtctcactc

SEQ ID NO: 1007822 - DNA, 22 bp, Artificial Sequence
  chemically synthesized
gtagtgagagtgatgtatttgc

SEQ ID NO: 1007823 - DNA, 22 bp, Artificial Sequence
  chemically synthesized
ggtagtgagagtgatgtatttg

SEQ ID NO: 1007824 - DNA, 22 bp, Artificial Sequence
  chemically synthesized
actccttgcaaatacatcactc

SEQ ID NO: 1007825 - DNA, 22 bp, Artificial Sequence
  chemically synthesized
cttgcaaatacatcactctcac

SEQ ID NO: 1007826 - DNA, 22 bp, Artificial Sequence
  chemically synthesized
gcaaatacatcactctcactac

SEQ ID NO: 1007827 - DNA, 22 bp, Artificial Sequence
  chemically synthesized
atccaggatttggtagtgagag

SEQ ID NO: 1007828 - DNA, 22 bp, Artificial Sequence
  chemically synthesized
caaatacatcactctcactacc

SEQ ID NO: 1007829 - DNA, 22 bp, Artificial Sequence
  chemically synthesized
aactaatccaggatttggtagt

SEQ ID NO: 1007830 - DNA, 22 bp, Artificial Sequence
  chemically synthesized
tcactaccaaatcctggattag

SEQ ID NO: 1007831 - DNA, 22 bp, Artificial Sequence
  chemically synthesized
actaccaaatcctggattagtt

SEQ ID NO: 1007832 - DNA, 22 bp, Artificial Sequence
  chemically synthesized
ccaaatcctggattagttcagt

SEQ ID NO: 1007833 - DNA, 22 bp, Artificial Sequence
  chemically synthesized
ataacaatatgacatcaacact

SEQ ID NO: 1007834 - DNA, 22 bp, Artificial Sequence
  chemically synthesized
gattagttcagtgttgatgtca

SEQ ID NO: 1007835 - DNA, 22 bp, Artificial Sequence
  chemically synthesized
tgagctcataacaatatgacat

SEQ ID NO: 1007836 - DNA, 22 bp, Artificial Sequence
  chemically synthesized
gttcagtgttgatgtcatattg

SEQ ID NO: 1007837 - DNA, 22 bp, Artificial Sequence
  chemically synthesized
agtgttgatgtcatattgttat

SEQ ID NO: 1007838 - DNA, 22 bp, Artificial Sequence
  chemically synthesized
caggtgttgtgagctcataaca

SEQ ID NO: 1007839 - DNA, 22 bp, Artificial Sequence
  chemically synthesized
atgtcatattgttatgagctca

SEQ ID NO: 1007840 - DNA, 22 bp, Artificial Sequence
  chemically synthesized
tgtgaatgctacaggtgttgtg

SEQ ID NO: 1007841 - DNA, 22 bp, Artificial Sequence
  chemically synthesized
gtgtgaatgctacaggtgttgt

SEQ ID NO: 1007842 - DNA, 22 bp, Artificial Sequence
  chemically synthesized
ttatgagctcacaacacctgta

SEQ ID NO: 1007843 - DNA, 22 bp, Artificial Sequence
  chemically synthesized
tttgtgtgaatgctacaggtgt

SEQ ID NO: 1007844 - DNA, 22 bp, Artificial Sequence
  chemically synthesized
tgagctcacaacacctgtagca

SEQ ID NO: 1007845 - DNA, 22 bp, Artificial Sequence
  chemically synthesized
tatcctatttgtgtgaatgcta

SEQ ID NO: 1007846 - DNA, 22 bp, Artificial Sequence
  chemically synthesized
acaacacctgtagcattcacac

SEQ ID NO: 1007847 - DNA, 22 bp, Artificial Sequence
  chemically synthesized
tagcattcacacaaataggata

SEQ ID NO: 1007848 - DNA, 22 bp, Artificial Sequence
  chemically synthesized
acacaaataggatacagtggtt

SEQ ID NO: 1007849 - DNA, 22 bp, Artificial Sequence
  chemically synthesized
cagataaggggtaaaccactgt

SEQ ID NO: 1007850 - DNA, 22 bp, Artificial Sequence
  chemically synthesized
gaatgtatcccctacagataag

SEQ ID NO: 1007851 - DNA, 22 bp, Artificial Sequence
  chemically synthesized
ggaatgtatcccctacagataa

SEQ ID NO: 1007852 - DNA, 22 bp, Artificial Sequence
  chemically synthesized
accccttatctgtaggggatac

SEQ ID NO: 1007853 - DNA, 22 bp, Artificial Sequence
  chemically synthesized
ccccttatctgtaggggataca

SEQ ID NO: 1007854 - DNA, 22 bp, Artificial Sequence
  chemically synthesized
ggagtcttggaatgtatcccct

SEQ ID NO: 1007855 - DNA, 22 bp, Artificial Sequence
  chemically synthesized
atctgtaggggatacattccaa

SEQ ID NO: 1007856 - DNA, 22 bp, Artificial Sequence
  chemically synthesized
tctgtaggggatacattccaag

SEQ ID NO: 1007857 - DNA, 22 bp, Artificial Sequence
  chemically synthesized
taggggatacattccaagactc

SEQ ID NO: 1007858 - DNA, 22 bp, Artificial Sequence
  chemically synthesized
agacatccactgggagtcttgg

SEQ ID NO: 1007859 - DNA, 22 bp, Artificial Sequence
  chemically synthesized
cagacatccactgggagtcttg

SEQ ID NO: 1007860 - DNA, 22 bp, Artificial Sequence
  chemically synthesized
cagtttcagacatccactggga

SEQ ID NO: 1007861 - DNA, 22 bp, Artificial Sequence
  chemically synthesized
tctgcagtttcagacatccact

SEQ ID NO: 1007862 - DNA, 22 bp, Artificial Sequence
  chemically synthesized
caagactcccagtggatgtctg

SEQ ID NO: 1007863 - DNA, 22 bp, Artificial Sequence
  chemically synthesized
agtactatctgcagtttcagac

SEQ ID NO: 1007864 - DNA, 22 bp, Artificial Sequence
  chemically synthesized
ccagtggatgtctgaaactgca

SEQ ID NO: 1007865 - DNA, 22 bp, Artificial Sequence
  chemically synthesized
tatagggctcagtactatctgc

SEQ ID NO: 1007866 - DNA, 22 bp, Artificial Sequence
  chemically synthesized
atatagggctcagtactatctg

SEQ ID NO: 1007867 - DNA, 22 bp, Artificial Sequence
  chemically synthesized
aaactgcagatagtactgagcc

SEQ ID NO: 1007868 - DNA, 22 bp, Artificial Sequence
  chemically synthesized
cagatagtactgagccctatat

SEQ ID NO: 1007869 - DNA, 22 bp, Artificial Sequence
  chemically synthesized
tcacaagtacatatagtttata

SEQ ID NO: 1007870 - DNA, 22 bp, Artificial Sequence
  chemically synthesized
atcacaagtacatatagtttat

SEQ ID NO: 1007871 - DNA, 22 bp, Artificial Sequence
  chemically synthesized
agccctatataaactatatgta

SEQ ID NO: 1007872 - DNA, 22 bp, Artificial Sequence
  chemically synthesized
aaatttatcacaagtacatata

SEQ ID NO: 1007873 - DNA, 22 bp, Artificial Sequence
  chemically synthesized
tataaactatatgtacttgtga

SEQ ID NO: 1007874 - DNA, 22 bp, Artificial Sequence
  chemically synthesized
taaattaaaatttatcacaagt

SEQ ID NO: 1007875 - DNA, 22 bp, Artificial Sequence
  chemically synthesized
ataaattaaaatttatcacaag

SEQ ID NO: 1007876 - DNA, 22 bp, Artificial Sequence
  chemically synthesized
tatgtacttgtgataaatttta

SEQ ID NO: 1007877 - DNA, 22 bp, Artificial Sequence
  chemically synthesized
cgccaaatttataaattaaaat

SEQ ID NO: 1007878 - DNA, 22 bp, Artificial Sequence
  chemically synthesized
actgcgccaaatttataaatta

SEQ ID NO: 1007879 - DNA, 22 bp, Artificial Sequence
  chemically synthesized
gtgataaattttaatttataaa

SEQ ID NO: 1007880 - DNA, 22 bp, Artificial Sequence
  chemically synthesized
aactgcgccaaatttataaatt

SEQ ID NO: 1007881 - DNA, 22 bp, Artificial Sequence
  chemically synthesized
tgataaattttaatttataaat

SEQ ID NO: 1007882 - DNA, 22 bp, Artificial Sequence
  chemically synthesized
ttaactgcgccaaatttataaa

SEQ ID NO: 1007883 - DNA, 22 bp, Artificial Sequence
  chemically synthesized
atctcttaactgcgccaaattt

SEQ ID NO: 1007884 - DNA, 22 bp, Artificial Sequence
  chemically synthesized
aatctcttaactgcgccaaatt

SEQ ID NO: 1007885 - DNA, 22 bp, Artificial Sequence
  chemically synthesized
taatctcttaactgcgccaaat

SEQ ID NO: 1007886 - DNA, 22 bp, Artificial Sequence
  chemically synthesized
ttaatctcttaactgcgccaaa

SEQ ID NO: 1007887 - DNA, 22 bp, Artificial Sequence
  chemically synthesized
taatttataaatttggcgcagt

SEQ ID NO: 1007888 - DNA, 22 bp, Artificial Sequence
  chemically synthesized
aatttataaatttggcgcagtt

SEQ ID NO: 1007889 - DNA, 22 bp, Artificial Sequence
  chemically synthesized
atttataaatttggcgcagtta

SEQ ID NO: 1007890 - DNA, 22 bp, Artificial Sequence
  chemically synthesized
ataaatttggcgcagttaagag

SEQ ID NO: 1007891 - DNA, 22 bp, Artificial Sequence
  chemically synthesized
atgatttttaatctcttaactg

SEQ ID NO: 1007892 - DNA, 22 bp, Artificial Sequence
  chemically synthesized
taaatttggcgcagttaagaga

SEQ ID NO: 1007893 - DNA, 22 bp, Artificial Sequence
  chemically synthesized
ttcatgatttttaatctcttaa

SEQ ID NO: 1007894 - DNA, 22 bp, Artificial Sequence
  chemically synthesized
attcatgatttttaatctctta

SEQ ID NO: 1007895 - DNA, 22 bp, Artificial Sequence
  chemically synthesized
tattcatgatttttaatctctt

SEQ ID NO: 1007896 - DNA, 22 bp, Artificial Sequence
  chemically synthesized
ttattcatgatttttaatctct

SEQ ID NO: 1007897 - DNA, 22 bp, Artificial Sequence
  chemically synthesized
ggcgcagttaagagattaaaaa

SEQ ID NO: 1007898 - DNA, 22 bp, Artificial Sequence
  chemically synthesized
gcgcagttaagagattaaaaat

SEQ ID NO: 1007899 - DNA, 22 bp, Artificial Sequence
  chemically synthesized
tttttattcatgatttttaatc

SEQ ID NO: 1007900 - DNA, 22 bp, Artificial Sequence
  chemically synthesized
tatttttattcatgatttttaa

SEQ ID NO: 1007901 - DNA, 22 bp, Artificial Sequence
  chemically synthesized
ttctatttttattcatgatttt

SEQ ID NO: 1007902 - DNA, 22 bp, Artificial Sequence
  chemically synthesized
agagattaaaaatcatgaataa

SEQ ID NO: 1007903 - DNA, 22 bp, Artificial Sequence
  chemically synthesized
taattgttctatttttattcat

SEQ ID NO: 1007904 - DNA, 22 bp, Artificial Sequence
  chemically synthesized
ttataattgttctatttttatt

SEQ ID NO: 1007905 - DNA, 22 bp, Artificial Sequence
  chemically synthesized
aaaatcatgaataaaaatagaa

SEQ ID NO: 1007906 - DNA, 22 bp, Artificial Sequence
  chemically synthesized
caatgtattgttataattgttc

SEQ ID NO: 1007907 - DNA, 22 bp, Artificial Sequence
  chemically synthesized
attacaatgtattgttataatt

SEQ ID NO: 1007908 - DNA, 22 bp, Artificial Sequence
  chemically synthesized
cattacaatgtattgttataat

SEQ ID NO: 1007909 - DNA, 22 bp, Artificial Sequence
  chemically synthesized
tcattacaatgtattgttataa

SEQ ID NO: 1007910 - DNA, 22 bp, Artificial Sequence
  chemically synthesized
acatgattttcattacaatgta

SEQ ID NO: 1007911 - DNA, 22 bp, Artificial Sequence
  chemically synthesized
taacaatacattgtaatgaaaa

SEQ ID NO: 1007912 - DNA, 22 bp, Artificial Sequence
  chemically synthesized
taatgaaaatcatgtgaatgtg

SEQ ID NO: 1007913 - DNA, 22 bp, Artificial Sequence
  chemically synthesized
agagagagaaagaaagatcaca

SEQ ID NO: 1007914 - DNA, 22 bp, Artificial Sequence
  chemically synthesized
aagagagagaaagaaagatcac

SEQ ID NO: 1007915 - DNA, 22 bp, Artificial Sequence
  chemically synthesized
taagagagagaaagaaagatca

SEQ ID NO: 1007916 - DNA, 22 bp, Artificial Sequence
  chemically synthesized
caatacaataagatattttaag

SEQ ID NO: 1007917 - DNA, 22 bp, Artificial Sequence
  chemically synthesized
tctttctctctcttaaaatatc

SEQ ID NO: 1007918 - DNA, 22 bp, Artificial Sequence
  chemically synthesized
ctttctctctcttaaaatatct

SEQ ID NO: 1007919 - DNA, 22 bp, Artificial Sequence
  chemically synthesized
tttctctctcttaaaatatctt

SEQ ID NO: 1007920 - DNA, 22 bp, Artificial Sequence
  chemically synthesized
tctctctcttaaaatatcttat

SEQ ID NO: 1007921 - DNA, 22 bp, Artificial Sequence
  chemically synthesized
ctctctcttaaaatatcttatt

SEQ ID NO: 1007922 - DNA, 22 bp, Artificial Sequence
  chemically synthesized
tctctcttaaaatatcttattg

SEQ ID NO: 1007923 - DNA, 22 bp, Artificial Sequence
  chemically synthesized
tctcttaaaatatcttattgta

SEQ ID NO: 1007924 - DNA, 22 bp, Artificial Sequence
  chemically synthesized
tcttaaaatatcttattgtatt

SEQ ID NO: 1007925 - DNA, 22 bp, Artificial Sequence
  chemically synthesized
ttaaaatatcttattgtattgt

SEQ ID NO: 1007926 - DNA, 22 bp, Artificial Sequence
  chemically synthesized
aaaataggtgactacaatacaa

SEQ ID NO: 1007927 - DNA, 22 bp, Artificial Sequence
  chemically synthesized
aaaatatcttattgtattgtag

SEQ ID NO: 1007928 - DNA, 22 bp, Artificial Sequence
  chemically synthesized
aaatatcttattgtattgtagt

SEQ ID NO: 1007929 - DNA, 22 bp, Artificial Sequence
  chemically synthesized
tctgaaaataggtgactacaat

SEQ ID NO: 1007930 - DNA, 22 bp, Artificial Sequence
  chemically synthesized
ctgtctgaaaataggtgactac

SEQ ID NO: 1007931 - DNA, 22 bp, Artificial Sequence
  chemically synthesized
attgtattgtagtcacctattt

SEQ ID NO: 1007932 - DNA, 22 bp, Artificial Sequence
  chemically synthesized
ttgtattgtagtcacctatttt

SEQ ID NO: 1007933 - DNA, 22 bp, Artificial Sequence
  chemically synthesized
tattgtagtcacctattttcag

SEQ ID NO: 1007934 - DNA, 22 bp, Artificial Sequence
  chemically synthesized
tagtcacctattttcagacagc

SEQ ID NO: 1007935 - DNA, 22 bp, Artificial Sequence
  chemically synthesized
agtgacccatggtcaactgctg

SEQ ID NO: 1007936 - DNA, 22 bp, Artificial Sequence
  chemically synthesized
cagtgacccatggtcaactgct

SEQ ID NO: 1007937 - DNA, 22 bp, Artificial Sequence
  chemically synthesized
ttttcagacagcagttgaccat

SEQ ID NO: 1007938 - DNA, 22 bp, Artificial Sequence
  chemically synthesized
tcagacagcagttgaccatggg

SEQ ID NO: 1007939 - DNA, 22 bp, Artificial Sequence
  chemically synthesized
cagacagcagttgaccatgggt

SEQ ID NO: 1007940 - DNA, 22 bp, Artificial Sequence
  chemically synthesized
agacagcagttgaccatgggtc

SEQ ID NO: 1007941 - DNA, 22 bp, Artificial Sequence
  chemically synthesized
cccagtttcagtgacccatggt

SEQ ID NO: 1007942 - DNA, 22 bp, Artificial Sequence
  chemically synthesized
ccccagtttcagtgacccatgg

SEQ ID NO: 1007943 - DNA, 22 bp, Artificial Sequence
  chemically synthesized
tccccagtttcagtgacccatg

SEQ ID NO: 1007944 - DNA, 22 bp, Artificial Sequence
  chemically synthesized
ctttccccagtttcagtgaccc

SEQ ID NO: 1007945 - DNA, 22 bp, Artificial Sequence
  chemically synthesized
gctttccccagtttcagtgacc

SEQ ID NO: 1007946 - DNA, 22 bp, Artificial Sequence
  chemically synthesized
tgctttccccagtttcagtgac

SEQ ID NO: 1007947 - DNA, 22 bp, Artificial Sequence
  chemically synthesized
accatgggtcactgaaactggg

SEQ ID NO: 1007948 - DNA, 22 bp, Artificial Sequence
  chemically synthesized
aaactggggaaagcaaaactgt

SEQ ID NO: 1007949 - DNA, 22 bp, Artificial Sequence
  chemically synthesized
gggaaagcaaaactgtggatat

SEQ ID NO: 1007950 - DNA, 22 bp, Artificial Sequence
  chemically synthesized
cacagtggtggaacaaaatatc

SEQ ID NO: 1007951 - DNA, 22 bp, Artificial Sequence
  chemically synthesized
tggatattttgttccaccactg

SEQ ID NO: 1007952 - DNA, 22 bp, Artificial Sequence
  chemically synthesized
tgttccaccactgtggagatgt

SEQ ID NO: 1007953 - DNA, 22 bp, Artificial Sequence
  chemically synthesized
gttccaccactgtggagatgta

SEQ ID NO: 1007954 - DNA, 22 bp, Artificial Sequence
  chemically synthesized
ttccaccactgtggagatgtac

SEQ ID NO: 1007955 - DNA, 22 bp, Artificial Sequence
  chemically synthesized
caccactgtggagatgtacatt

SEQ ID NO: 1007956 - DNA, 22 bp, Artificial Sequence
  chemically synthesized
tggagatgtacattatgactac

SEQ ID NO: 1007957 - DNA, 22 bp, Artificial Sequence
  chemically synthesized
tgactacatcattaccaccatc

SEQ ID NO: 1007958 - DNA, 22 bp, Artificial Sequence
  chemically synthesized
aaggaaaaccacagatggtggt

SEQ ID NO: 1007959 - DNA, 22 bp, Artificial Sequence
  chemically synthesized
aaaggaaaaccacagatggtgg

SEQ ID NO: 1007960 - DNA, 22 bp, Artificial Sequence
  chemically synthesized
catcattaccaccatctgtggt

SEQ ID NO: 1007961 - DNA, 22 bp, Artificial Sequence
  chemically synthesized
acccttaaaggaaaaccacaga

SEQ ID NO: 1007962 - DNA, 22 bp, Artificial Sequence
  chemically synthesized
ccaccatctgtggttttccttt

SEQ ID NO: 1007963 - DNA, 22 bp, Artificial Sequence
  chemically synthesized
catataaatagtctcaccctta

SEQ ID NO: 1007964 - DNA, 22 bp, Artificial Sequence
  chemically synthesized
tggttttcctttaagggtgaga

SEQ ID NO: 1007965 - DNA, 22 bp, Artificial Sequence
  chemically synthesized
gcatataaatagtctcaccctt

SEQ ID NO: 1007966 - DNA, 22 bp, Artificial Sequence
  chemically synthesized
aatttgcatataaatagtctca

SEQ ID NO: 1007967 - DNA, 22 bp, Artificial Sequence
  chemically synthesized
tcctttaagggtgagactattt

SEQ ID NO: 1007968 - DNA, 22 bp, Artificial Sequence
  chemically synthesized
gaatttgcatataaatagtctc

SEQ ID NO: 1007969 - DNA, 22 bp, Artificial Sequence
  chemically synthesized
cctttaagggtgagactattta

SEQ ID NO: 1007970 - DNA, 22 bp, Artificial Sequence
  chemically synthesized
ctttaagggtgagactatttat

SEQ ID NO: 1007971 - DNA, 22 bp, Artificial Sequence
  chemically synthesized
taagggtgagactatttatatg

SEQ ID NO: 1007972 - DNA, 22 bp, Artificial Sequence
  chemically synthesized
aagggtgagactatttatatgc

SEQ ID NO: 1007973 - DNA, 22 bp, Artificial Sequence
  chemically synthesized
agggtgagactatttatatgca

SEQ ID NO: 1007974 - DNA, 22 bp, Artificial Sequence
  chemically synthesized
gggggggggggggtgtttgaat

SEQ ID NO: 1007975 - DNA, 22 bp, Artificial Sequence
  chemically synthesized
tttatatgcaaattcaaacacc

SEQ ID NO: 1007976 - DNA, 22 bp, Artificial Sequence
  chemically synthesized
ttggggggggggggggtgtttg

SEQ ID NO: 1007977 - DNA, 22 bp, Artificial Sequence
  chemically synthesized
atatgcaaattcaaacaccccc

SEQ ID NO: 1007978 - DNA, 22 bp, Artificial Sequence
  chemically synthesized
gttggggggggggggggtgttt

SEQ ID NO: 1007979 - DNA, 22 bp, Artificial Sequence
  chemically synthesized
tatgcaaattcaaacacccccc

SEQ ID NO: 1007980 - DNA, 22 bp, Artificial Sequence
  chemically synthesized
cttgttggggggggggggggtg

SEQ ID NO: 1007981 - DNA, 22 bp, Artificial Sequence
  chemically synthesized
aaacaccccccccccccccaac

SEQ ID NO: 1007982 - DNA, 22 bp, Artificial Sequence
  chemically synthesized
aatatggcctccttgttggggg

SEQ ID NO: 1007983 - DNA, 22 bp, Artificial Sequence
  chemically synthesized
caggaggtaatctaaatatggc

SEQ ID NO: 1007984 - DNA, 22 bp, Artificial Sequence
  chemically synthesized
ccaggaggtaatctaaatatgg

SEQ ID NO: 1007985 - DNA, 22 bp, Artificial Sequence
  chemically synthesized
tccaggaggtaatctaaatatg

SEQ ID NO: 1007986 - DNA, 22 bp, Artificial Sequence
  chemically synthesized
agtaactttccaggaggtaatc

SEQ ID NO: 1007987 - DNA, 22 bp, Artificial Sequence
  chemically synthesized
cagagagttaagtaactttcca

SEQ ID NO: 1007988 - DNA, 22 bp, Artificial Sequence
  chemically synthesized
agattacctcctggaaagttac

SEQ ID NO: 1007989 - DNA, 22 bp, Artificial Sequence
  chemically synthesized
gattacctcctggaaagttact

SEQ ID NO: 1007990 - DNA, 22 bp, Artificial Sequence
  chemically synthesized
aaattccagagagttaagtaac

SEQ ID NO: 1007991 - DNA, 22 bp, Artificial Sequence
  chemically synthesized
cctcctggaaagttacttaact

SEQ ID NO: 1007992 - DNA, 22 bp, Artificial Sequence
  chemically synthesized
ctggaaagttacttaactctct

SEQ ID NO: 1007993 - DNA, 22 bp, Artificial Sequence
  chemically synthesized
aattcaaattccagagagttaa

SEQ ID NO: 1007994 - DNA, 22 bp, Artificial Sequence
  chemically synthesized
aaattcaaattccagagagtta

SEQ ID NO: 1007995 - DNA, 22 bp, Artificial Sequence
  chemically synthesized
gaaagttacttaactctctgga

SEQ ID NO: 1007996 - DNA, 22 bp, Artificial Sequence
  chemically synthesized
tttaaattcaaattccagagag

SEQ ID NO: 1007997 - DNA, 22 bp, Artificial Sequence
  chemically synthesized
atttaaattcaaattccagaga

SEQ ID NO: 1007998 - DNA, 22 bp, Artificial Sequence
  chemically synthesized
tatttaaattcaaattccagag

SEQ ID NO: 1007999 - DNA, 22 bp, Artificial Sequence
  chemically synthesized
tttatttaaattcaaattccag

SEQ ID NO: 1008000 - DNA, 22 bp, Artificial Sequence
  chemically synthesized
cttaactctctggaatttgaat

SEQ ID NO: 1008001 - DNA, 22 bp, Artificial Sequence
  chemically synthesized
ctctttatttaaattcaaattc

SEQ ID NO: 1008002 - DNA, 22 bp, Artificial Sequence
  chemically synthesized
aactctctggaatttgaattta

SEQ ID NO: 1008003 - DNA, 22 bp, Artificial Sequence
  chemically synthesized
actctctggaatttgaatttaa

SEQ ID NO: 1008004 - DNA, 22 bp, Artificial Sequence
  chemically synthesized
tctggaatttgaatttaaataa

SEQ ID NO: 1008005 - DNA, 22 bp, Artificial Sequence
  chemically synthesized
tggaatttgaatttaaataaag

SEQ ID NO: 1008006 - DNA, 22 bp, Artificial Sequence
  chemically synthesized
gaatttgaatttaaataaagag

SEQ ID NO: 1008007 - DNA, 22 bp, Artificial Sequence
  chemically synthesized
gaatttaaataaagagtagact

SEQ ID NO: 1008008 - DNA, 22 bp, Artificial Sequence
  chemically synthesized
aatttaaataaagagtagactt

SEQ ID NO: 1008009 - DNA, 22 bp, Artificial Sequence
  chemically synthesized
aaataaagagtagacttcttat

SEQ ID NO: 1008010 - DNA, 22 bp, Artificial Sequence
  chemically synthesized
aataaagagtagacttcttatt

SEQ ID NO: 1008011 - DNA, 22 bp, Artificial Sequence
  chemically synthesized
aaaacccaaaatgaaataagaa

SEQ ID NO: 1008012 - DNA, 22 bp, Artificial Sequence
  chemically synthesized
tcaaaacccaaaatgaaataag

SEQ ID NO: 1008013 - DNA, 22 bp, Artificial Sequence
  chemically synthesized
atatagttctcaaaacccaaaa

SEQ ID NO: 1008014 - DNA, 22 bp, Artificial Sequence
  chemically synthesized
gatatagttctcaaaacccaaa

SEQ ID NO: 1008015 - DNA, 22 bp, Artificial Sequence
  chemically synthesized
cttatttcattttgggttttga

SEQ ID NO: 1008016 - DNA, 22 bp, Artificial Sequence
  chemically synthesized
ttgatatagttctcaaaaccca

SEQ ID NO: 1008017 - DNA, 22 bp, Artificial Sequence
  chemically synthesized
ttatttcattttgggttttgag

SEQ ID NO: 1008018 - DNA, 22 bp, Artificial Sequence
  chemically synthesized
atttcattttgggttttgagaa

SEQ ID NO: 1008019 - DNA, 22 bp, Artificial Sequence
  chemically synthesized
tttcattttgggttttgagaac

SEQ ID NO: 1008020 - DNA, 22 bp, Artificial Sequence
  chemically synthesized
agctcttgatatagttctcaaa

SEQ ID NO: 1008021 - DNA, 22 bp, Artificial Sequence
  chemically synthesized
cattttgggttttgagaactat

SEQ ID NO: 1008022 - DNA, 22 bp, Artificial Sequence
  chemically synthesized
attttgggttttgagaactata

SEQ ID NO: 1008023 - DNA, 22 bp, Artificial Sequence
  chemically synthesized
tgggttttgagaactatatcaa

SEQ ID NO: 1008024 - DNA, 22 bp, Artificial Sequence
  chemically synthesized
gggttttgagaactatatcaag

SEQ ID NO: 1008025 - DNA, 22 bp, Artificial Sequence
  chemically synthesized
ggttttgagaactatatcaaga

SEQ ID NO: 1008026 - DNA, 22 bp, Artificial Sequence
  chemically synthesized
acaggatattgagctcttgata

SEQ ID NO: 1008027 - DNA, 22 bp, Artificial Sequence
  chemically synthesized
tgagaactatatcaagagctca

SEQ ID NO: 1008028 - DNA, 22 bp, Artificial Sequence
  chemically synthesized
gagaactatatcaagagctcaa

SEQ ID NO: 1008029 - DNA, 22 bp, Artificial Sequence
  chemically synthesized
attcacaggatattgagctctt

SEQ ID NO: 1008030 - DNA, 22 bp, Artificial Sequence
  chemically synthesized
agaactatatcaagagctcaat

SEQ ID NO: 1008031 - DNA, 22 bp, Artificial Sequence
  chemically synthesized
cattcacaggatattgagctct

SEQ ID NO: 1008032 - DNA, 22 bp, Artificial Sequence
  chemically synthesized
tatcaagagctcaatatcctgt

SEQ ID NO: 1008033 - DNA, 22 bp, Artificial Sequence
  chemically synthesized
catgatcagtatttcattcaca

SEQ ID NO: 1008034 - DNA, 22 bp, Artificial Sequence
  chemically synthesized
gcatgatcagtatttcattcac

SEQ ID NO: 1008035 - DNA, 22 bp, Artificial Sequence
  chemically synthesized
aatatcctgtgaatgaaatact

SEQ ID NO: 1008036 - DNA, 22 bp, Artificial Sequence
  chemically synthesized
tgtttgcatgatcagtatttca

SEQ ID NO: 1008037 - DNA, 22 bp, Artificial Sequence
  chemically synthesized
gctgtgtttgcatgatcagtat

SEQ ID NO: 1008038 - DNA, 22 bp, Artificial Sequence
  chemically synthesized
ggctgtgtttgcatgatcagta

SEQ ID NO: 1008039 - DNA, 22 bp, Artificial Sequence
  chemically synthesized
tggctgtgtttgcatgatcagt

SEQ ID NO: 1008040 - DNA, 22 bp, Artificial Sequence
  chemically synthesized
tgaatgaaatactgatcatgca

SEQ ID NO: 1008041 - DNA, 22 bp, Artificial Sequence
  chemically synthesized
gacaatctttggctgtgtttgc

SEQ ID NO: 1008042 - DNA, 22 bp, Artificial Sequence
  chemically synthesized
cctagacaatctttggctgtgt

SEQ ID NO: 1008043 - DNA, 22 bp, Artificial Sequence
  chemically synthesized
ccctagacaatctttggctgtg

SEQ ID NO: 1008044 - DNA, 22 bp, Artificial Sequence
  chemically synthesized
tccctagacaatctttggctgt

SEQ ID NO: 1008045 - DNA, 22 bp, Artificial Sequence
  chemically synthesized
atcatgcaaacacagccaaaga

SEQ ID NO: 1008046 - DNA, 22 bp, Artificial Sequence
  chemically synthesized
agcattttccctagacaatctt

SEQ ID NO: 1008047 - DNA, 22 bp, Artificial Sequence
  chemically synthesized
cagcattttccctagacaatct

SEQ ID NO: 1008048 - DNA, 22 bp, Artificial Sequence
  chemically synthesized
ccttcagcattttccctagaca

SEQ ID NO: 1008049 - DNA, 22 bp, Artificial Sequence
  chemically synthesized
gaaagttcccttcagcattttc

SEQ ID NO: 1008050 - DNA, 22 bp, Artificial Sequence
  chemically synthesized
ggaaagttcccttcagcatttt

SEQ ID NO: 1008051 - DNA, 22 bp, Artificial Sequence
  chemically synthesized
tctagggaaaatgctgaaggga

SEQ ID NO: 1008052 - DNA, 22 bp, Artificial Sequence
  chemically synthesized
gggaaaatgctgaagggaactt

SEQ ID NO: 1008053 - DNA, 22 bp, Artificial Sequence
  chemically synthesized
tagtggatttggaaagttccct

SEQ ID NO: 1008054 - DNA, 22 bp, Artificial Sequence
  chemically synthesized
aagggaactttccaaatccact

SEQ ID NO: 1008055 - DNA, 22 bp, Artificial Sequence
  chemically synthesized
tccaaatccactatagttcttc

SEQ ID NO: 1008056 - DNA, 22 bp, Artificial Sequence
  chemically synthesized
ccaaatccactatagttcttct

SEQ ID NO: 1008057 - DNA, 22 bp, Artificial Sequence
  chemically synthesized
caaatccactatagttcttctt

SEQ ID NO: 1008058 - DNA, 22 bp, Artificial Sequence
  chemically synthesized
tagttcttctttcttaccattc

SEQ ID NO: 1008059 - DNA, 22 bp, Artificial Sequence
  chemically synthesized
ttctttcttaccattccattta

SEQ ID NO: 1008060 - DNA, 22 bp, Artificial Sequence
  chemically synthesized
ctttcttaccattccatttatg

SEQ ID NO: 1008061 - DNA, 22 bp, Artificial Sequence
  chemically synthesized
tttcttaccattccatttatgg

SEQ ID NO: 1008062 - DNA, 22 bp, Artificial Sequence
  chemically synthesized
tcttaccattccatttatgggc

SEQ ID NO: 1008063 - DNA, 22 bp, Artificial Sequence
  chemically synthesized
cttaccattccatttatgggct

SEQ ID NO: 1008064 - DNA, 22 bp, Artificial Sequence
  chemically synthesized
ttaccattccatttatgggctg

SEQ ID NO: 1008065 - DNA, 22 bp, Artificial Sequence
  chemically synthesized
accattccatttatgggctgtc

SEQ ID NO: 1008066 - DNA, 22 bp, Artificial Sequence
  chemically synthesized
ccattccatttatgggctgtcc

SEQ ID NO: 1008067 - DNA, 22 bp, Artificial Sequence
  chemically synthesized
catttatgggctgtccacttac

SEQ ID NO: 1008068 - DNA, 22 bp, Artificial Sequence
  chemically synthesized
atgggctgtccacttactccct

SEQ ID NO: 1008069 - DNA, 22 bp, Artificial Sequence
  chemically synthesized
tgggctgtccacttactccctg

SEQ ID NO: 1008070 - DNA, 22 bp, Artificial Sequence
  chemically synthesized
tccacttactccctggcatctg

SEQ ID NO: 1008071 - DNA, 22 bp, Artificial Sequence
  chemically synthesized
actccctggcatctgtcctgtg

SEQ ID NO: 1008072 - DNA, 22 bp, Artificial Sequence
  chemically synthesized
ctccctggcatctgtcctgtgc

SEQ ID NO: 1008073 - DNA, 22 bp, Artificial Sequence
  chemically synthesized
caatcagaaaggggcacaggac

SEQ ID NO: 1008074 - DNA, 22 bp, Artificial Sequence
  chemically synthesized
acaatcagaaaggggcacagga

SEQ ID NO: 1008075 - DNA, 22 bp, Artificial Sequence
  chemically synthesized
cctggcatctgtcctgtgcccc

SEQ ID NO: 1008076 - DNA, 22 bp, Artificial Sequence
  chemically synthesized
gcatctgtcctgtgcccctttc

SEQ ID NO: 1008077 - DNA, 22 bp, Artificial Sequence
  chemically synthesized
tacttacaatcagaaaggggca

SEQ ID NO: 1008078 - DNA, 22 bp, Artificial Sequence
  chemically synthesized
actgtacttacaatcagaaagg

SEQ ID NO: 1008079 - DNA, 22 bp, Artificial Sequence
  chemically synthesized
tcctgtgcccctttctgattgt

SEQ ID NO: 1008080 - DNA, 22 bp, Artificial Sequence
  chemically synthesized
ttgactgtacttacaatcagaa

SEQ ID NO: 1008081 - DNA, 22 bp, Artificial Sequence
  chemically synthesized
tgcccctttctgattgtaagta

SEQ ID NO: 1008082 - DNA, 22 bp, Artificial Sequence
  chemically synthesized
tatcattgttgactgtacttac

SEQ ID NO: 1008083 - DNA, 22 bp, Artificial Sequence
  chemically synthesized
cctgtatcattgttgactgtac

SEQ ID NO: 1008084 - DNA, 22 bp, Artificial Sequence
  chemically synthesized
tctgattgtaagtacagtcaac

SEQ ID NO: 1008085 - DNA, 22 bp, Artificial Sequence
  chemically synthesized
gcctgtatcattgttgactgta

SEQ ID NO: 1008086 - DNA, 22 bp, Artificial Sequence
  chemically synthesized
ctgattgtaagtacagtcaaca

SEQ ID NO: 1008087 - DNA, 22 bp, Artificial Sequence
  chemically synthesized
tgcctgtatcattgttgactgt

SEQ ID NO: 1008088 - DNA, 22 bp, Artificial Sequence
  chemically synthesized
tgattgtaagtacagtcaacaa

SEQ ID NO: 1008089 - DNA, 22 bp, Artificial Sequence
  chemically synthesized
attgtaagtacagtcaacaatg

SEQ ID NO: 1008090 - DNA, 22 bp, Artificial Sequence
  chemically synthesized
taagtacagtcaacaatgatac

SEQ ID NO: 1008091 - DNA, 22 bp, Artificial Sequence
  chemically synthesized
aagaaacagataagcgaatgac

SEQ ID NO: 1008092 - DNA, 22 bp, Artificial Sequence
  chemically synthesized
aaagaaacagataagcgaatga

SEQ ID NO: 1008093 - DNA, 22 bp, Artificial Sequence
  chemically synthesized
gagtcttaaagaaacagataag

SEQ ID NO: 1008094 - DNA, 22 bp, Artificial Sequence
  chemically synthesized
cactggagtcttaaagaaacag

SEQ ID NO: 1008095 - DNA, 22 bp, Artificial Sequence
  chemically synthesized
gcttatctgtttctttaagact

SEQ ID NO: 1008096 - DNA, 22 bp, Artificial Sequence
  chemically synthesized
tatcattgcactggagtcttaa

SEQ ID NO: 1008097 - DNA, 22 bp, Artificial Sequence
  chemically synthesized
atctgtttctttaagactccag

SEQ ID NO: 1008098 - DNA, 22 bp, Artificial Sequence
  chemically synthesized
tctgtttctttaagactccagt

SEQ ID NO: 1008099 - DNA, 22 bp, Artificial Sequence
  chemically synthesized
attgtatcattgcactggagtc

SEQ ID NO: 1008100 - DNA, 22 bp, Artificial Sequence
  chemically synthesized
tttctttaagactccagtgcaa

SEQ ID NO: 1008101 - DNA, 22 bp, Artificial Sequence
  chemically synthesized
ctttaagactccagtgcaatga

SEQ ID NO: 1008102 - DNA, 22 bp, Artificial Sequence
  chemically synthesized
tttaagactccagtgcaatgat

SEQ ID NO: 1008103 - DNA, 22 bp, Artificial Sequence
  chemically synthesized
gaagtctaattgtatcattgca

SEQ ID NO: 1008104 - DNA, 22 bp, Artificial Sequence
  chemically synthesized
taagactccagtgcaatgatac

SEQ ID NO: 1008105 - DNA, 22 bp, Artificial Sequence
  chemically synthesized
ggaagtctaattgtatcattgc

SEQ ID NO: 1008106 - DNA, 22 bp, Artificial Sequence
  chemically synthesized
aagactccagtgcaatgataca

SEQ ID NO: 1008107 - DNA, 22 bp, Artificial Sequence
  chemically synthesized
agactccagtgcaatgatacaa

SEQ ID NO: 1008108 - DNA, 22 bp, Artificial Sequence
  chemically synthesized
cagtgcaatgatacaattagac

SEQ ID NO: 1008109 - DNA, 22 bp, Artificial Sequence
  chemically synthesized
tgagaatttggaagtctaattg

SEQ ID NO: 1008110 - DNA, 22 bp, Artificial Sequence
  chemically synthesized
atgagaatttggaagtctaatt

SEQ ID NO: 1008111 - DNA, 22 bp, Artificial Sequence
  chemically synthesized
acttatgagaatttggaagtct

SEQ ID NO: 1008112 - DNA, 22 bp, Artificial Sequence
  chemically synthesized
gacttatgagaatttggaagtc

SEQ ID NO: 1008113 - DNA, 22 bp, Artificial Sequence
  chemically synthesized
tgacttatgagaatttggaagt

SEQ ID NO: 1008114 - DNA, 22 bp, Artificial Sequence
  chemically synthesized
ttgacttatgagaatttggaag

SEQ ID NO: 1008115 - DNA, 22 bp, Artificial Sequence
  chemically synthesized
taccttttgacttatgagaatt

SEQ ID NO: 1008116 - DNA, 22 bp, Artificial Sequence
  chemically synthesized
gtaccttttgacttatgagaat

SEQ ID NO: 1008117 - DNA, 22 bp, Artificial Sequence
  chemically synthesized
gacttccaaattctcataagtc

SEQ ID NO: 1008118 - DNA, 22 bp, Artificial Sequence
  chemically synthesized
ccaaattctcataagtcaaaag

SEQ ID NO: 1008119 - DNA, 22 bp, Artificial Sequence
  chemically synthesized
agggatttgtaccttttgactt

SEQ ID NO: 1008120 - DNA, 22 bp, Artificial Sequence
  chemically synthesized
caaattctcataagtcaaaagg

SEQ ID NO: 1008121 - DNA, 22 bp, Artificial Sequence
  chemically synthesized
cagggatttgtaccttttgact

SEQ ID NO: 1008122 - DNA, 22 bp, Artificial Sequence
  chemically synthesized
tcagggatttgtaccttttgac

SEQ ID NO: 1008123 - DNA, 22 bp, Artificial Sequence
  chemically synthesized
tcataagtcaaaaggtacaaat

SEQ ID NO: 1008124 - DNA, 22 bp, Artificial Sequence
  chemically synthesized
ataagtcaaaaggtacaaatcc

SEQ ID NO: 1008125 - DNA, 22 bp, Artificial Sequence
  chemically synthesized
agcagttttcagggatttgtac

SEQ ID NO: 1008126 - DNA, 22 bp, Artificial Sequence
  chemically synthesized
attcagcagttttcagggattt

SEQ ID NO: 1008127 - DNA, 22 bp, Artificial Sequence
  chemically synthesized
aatactcattcagcagttttca

SEQ ID NO: 1008128 - DNA, 22 bp, Artificial Sequence
  chemically synthesized
caatactcattcagcagttttc

SEQ ID NO: 1008129 - DNA, 22 bp, Artificial Sequence
  chemically synthesized
ccaacacttcaatactcattca

SEQ ID NO: 1008130 - DNA, 22 bp, Artificial Sequence
  chemically synthesized
aaaactgctgaatgagtattga

SEQ ID NO: 1008131 - DNA, 22 bp, Artificial Sequence
  chemically synthesized
taactgccaacacttcaatact

SEQ ID NO: 1008132 - DNA, 22 bp, Artificial Sequence
  chemically synthesized
ctgaatgagtattgaagtgttg

SEQ ID NO: 1008133 - DNA, 22 bp, Artificial Sequence
  chemically synthesized
aatgagtattgaagtgttggca

SEQ ID NO: 1008134 - DNA, 22 bp, Artificial Sequence
  chemically synthesized
tcataagctgtaactgccaaca

SEQ ID NO: 1008135 - DNA, 22 bp, Artificial Sequence
  chemically synthesized
tatcataagctgtaactgccaa

SEQ ID NO: 1008136 - DNA, 22 bp, Artificial Sequence
  chemically synthesized
aagtgttggcagttacagctta

SEQ ID NO: 1008137 - DNA, 22 bp, Artificial Sequence
  chemically synthesized
aaaataaaaattctatcataag

SEQ ID NO: 1008138 - DNA, 22 bp, Artificial Sequence
  chemically synthesized
gaaaataaaaattctatcataa

SEQ ID NO: 1008139 - DNA, 22 bp, Artificial Sequence
  chemically synthesized
gcagttacagcttatgatagaa

SEQ ID NO: 1008140 - DNA, 22 bp, Artificial Sequence
  chemically synthesized
tgaaaataaaaattctatcata

SEQ ID NO: 1008141 - DNA, 22 bp, Artificial Sequence
  chemically synthesized
ttgaaaataaaaattctatcat

SEQ ID NO: 1008142 - DNA, 22 bp, Artificial Sequence
  chemically synthesized
ttttgaaaataaaaattctatc

SEQ ID NO: 1008143 - DNA, 22 bp, Artificial Sequence
  chemically synthesized
tcttttgaaaataaaaattcta

SEQ ID NO: 1008144 - DNA, 22 bp, Artificial Sequence
  chemically synthesized
ctcttttgaaaataaaaattct

SEQ ID NO: 1008145 - DNA, 22 bp, Artificial Sequence
  chemically synthesized
cagcttatgatagaatttttat

SEQ ID NO: 1008146 - DNA, 22 bp, Artificial Sequence
  chemically synthesized
aatttctcttttgaaaataaaa

SEQ ID NO: 1008147 - DNA, 22 bp, Artificial Sequence
  chemically synthesized
atgatagaatttttattttcaa

SEQ ID NO: 1008148 - DNA, 22 bp, Artificial Sequence
  chemically synthesized
tgatagaatttttattttcaaa

SEQ ID NO: 1008149 - DNA, 22 bp, Artificial Sequence
  chemically synthesized
aattaaatttctcttttgaaaa

SEQ ID NO: 1008150 - DNA, 22 bp, Artificial Sequence
  chemically synthesized
ttattttcaaaagagaaattta

SEQ ID NO: 1008151 - DNA, 22 bp, Artificial Sequence
  chemically synthesized
tattttcaaaagagaaatttaa

SEQ ID NO: 1008152 - DNA, 22 bp, Artificial Sequence
  chemically synthesized
attttcaaaagagaaatttaat

SEQ ID NO: 1008153 - DNA, 22 bp, Artificial Sequence
  chemically synthesized
ttttcaaaagagaaatttaatt

SEQ ID NO: 1008154 - DNA, 22 bp, Artificial Sequence
  chemically synthesized
tcaaaagagaaatttaattcag

SEQ ID NO: 1008155 - DNA, 22 bp, Artificial Sequence
  chemically synthesized
caaaagagaaatttaattcagg

SEQ ID NO: 1008156 - DNA, 22 bp, Artificial Sequence
  chemically synthesized
aaaagagaaatttaattcaggg

SEQ ID NO: 1008157 - DNA, 22 bp, Artificial Sequence
  chemically synthesized
aattcagggatatcactatacg

SEQ ID NO: 1008158 - DNA, 22 bp, Artificial Sequence
  chemically synthesized
attcagggatatcactatacgt

SEQ ID NO: 1008159 - DNA, 22 bp, Artificial Sequence
  chemically synthesized
agggatatcactatacgtatat

SEQ ID NO: 1008160 - DNA, 22 bp, Artificial Sequence
  chemically synthesized
ccaaaaaggaaataaaaggata

SEQ ID NO: 1008161 - DNA, 22 bp, Artificial Sequence
  chemically synthesized
tacgtatatccttttatttcct

SEQ ID NO: 1008162 - DNA, 22 bp, Artificial Sequence
  chemically synthesized
tagagttcccaaaaaggaaata

SEQ ID NO: 1008163 - DNA, 22 bp, Artificial Sequence
  chemically synthesized
atagagttcccaaaaaggaaat

SEQ ID NO: 1008164 - DNA, 22 bp, Artificial Sequence
  chemically synthesized
ttatagagttcccaaaaaggaa

SEQ ID NO: 1008165 - DNA, 22 bp, Artificial Sequence
  chemically synthesized
cttatagagttcccaaaaagga

SEQ ID NO: 1008166 - DNA, 22 bp, Artificial Sequence
  chemically synthesized
ttatttcctttttgggaactct

SEQ ID NO: 1008167 - DNA, 22 bp, Artificial Sequence
  chemically synthesized
tatttcctttttgggaactcta

SEQ ID NO: 1008168 - DNA, 22 bp, Artificial Sequence
  chemically synthesized
atttcctttttgggaactctat

SEQ ID NO: 1008169 - DNA, 22 bp, Artificial Sequence
  chemically synthesized
tttcctttttgggaactctata

SEQ ID NO: 1008170 - DNA, 22 bp, Artificial Sequence
  chemically synthesized
cctttttgggaactctataaga

SEQ ID NO: 1008171 - DNA, 22 bp, Artificial Sequence
  chemically synthesized
ctttttgggaactctataagaa

SEQ ID NO: 1008172 - DNA, 22 bp, Artificial Sequence
  chemically synthesized
tttgggaactctataagaagcc

SEQ ID NO: 1008173 - DNA, 22 bp, Artificial Sequence
  chemically synthesized
ttgggaactctataagaagcca

SEQ ID NO: 1008174 - DNA, 22 bp, Artificial Sequence
  chemically synthesized
tgggaactctataagaagccat

SEQ ID NO: 1008175 - DNA, 22 bp, Artificial Sequence
  chemically synthesized
gggaactctataagaagccata

SEQ ID NO: 1008176 - DNA, 22 bp, Artificial Sequence
  chemically synthesized
ggaactctataagaagccatac

SEQ ID NO: 1008177 - DNA, 22 bp, Artificial Sequence
  chemically synthesized
tataagaagccatacttgtttc

SEQ ID NO: 1008178 - DNA, 22 bp, Artificial Sequence
  chemically synthesized
taagaagccatacttgtttcat

SEQ ID NO: 1008179 - DNA, 22 bp, Artificial Sequence
  chemically synthesized
caggaaataagagatccagcaa

SEQ ID NO: 1008180 - DNA, 22 bp, Artificial Sequence
  chemically synthesized
ttccaggaaataagagatccag

SEQ ID NO: 1008181 - DNA, 22 bp, Artificial Sequence
  chemically synthesized
gtttcattgctggatctcttat

SEQ ID NO: 1008182 - DNA, 22 bp, Artificial Sequence
  chemically synthesized
tttcattgctggatctcttatt

SEQ ID NO: 1008183 - DNA, 22 bp, Artificial Sequence
  chemically synthesized
cattgctggatctcttatttcc

SEQ ID NO: 1008184 - DNA, 22 bp, Artificial Sequence
  chemically synthesized
attgctggatctcttatttcct

SEQ ID NO: 1008185 - DNA, 22 bp, Artificial Sequence
  chemically synthesized
ctggatctcttatttcctggaa

SEQ ID NO: 1008186 - DNA, 22 bp, Artificial Sequence
  chemically synthesized
tgtgacaagtattattccagga

SEQ ID NO: 1008187 - DNA, 22 bp, Artificial Sequence
  chemically synthesized
gatctcttatttcctggaataa

SEQ ID NO: 1008188 - DNA, 22 bp, Artificial Sequence
  chemically synthesized
ctgtgtgacaagtattattcca

SEQ ID NO: 1008189 - DNA, 22 bp, Artificial Sequence
  chemically synthesized
ttatttcctggaataatacttg

SEQ ID NO: 1008190 - DNA, 22 bp, Artificial Sequence
  chemically synthesized
acctactgtgtgacaagtatta

SEQ ID NO: 1008191 - DNA, 22 bp, Artificial Sequence
  chemically synthesized
atttcctggaataatacttgtc

SEQ ID NO: 1008192 - DNA, 22 bp, Artificial Sequence
  chemically synthesized
tttcctggaataatacttgtca

SEQ ID NO: 1008193 - DNA, 22 bp, Artificial Sequence
  chemically synthesized
ttgacctactgtgtgacaagta

SEQ ID NO: 1008194 - DNA, 22 bp, Artificial Sequence
  chemically synthesized
gttgacctactgtgtgacaagt

SEQ ID NO: 1008195 - DNA, 22 bp, Artificial Sequence
  chemically synthesized
cctggaataatacttgtcacac

SEQ ID NO: 1008196 - DNA, 22 bp, Artificial Sequence
  chemically synthesized
ctggaataatacttgtcacaca

SEQ ID NO: 1008197 - DNA, 22 bp, Artificial Sequence
  chemically synthesized
gaataatacttgtcacacagta

SEQ ID NO: 1008198 - DNA, 22 bp, Artificial Sequence
  chemically synthesized
accaaatatttgttgacctact

SEQ ID NO: 1008199 - DNA, 22 bp, Artificial Sequence
  chemically synthesized
gtcacacagtaggtcaacaaat

SEQ ID NO: 1008200 - DNA, 22 bp, Artificial Sequence
  chemically synthesized
tcacacagtaggtcaacaaata

SEQ ID NO: 1008201 - DNA, 22 bp, Artificial Sequence
  chemically synthesized
aatacataaattaaccaaatat

SEQ ID NO: 1008202 - DNA, 22 bp, Artificial Sequence
  chemically synthesized
tcaatacataaattaaccaaat

SEQ ID NO: 1008203 - DNA, 22 bp, Artificial Sequence
  chemically synthesized
tctcaatacataaattaaccaa

SEQ ID NO: 1008204 - DNA, 22 bp, Artificial Sequence
  chemically synthesized
tgccaagcaattctctcaatac

SEQ ID NO: 1008205 - DNA, 22 bp, Artificial Sequence
  chemically synthesized
ggttaatttatgtattgagaga

SEQ ID NO: 1008206 - DNA, 22 bp, Artificial Sequence
  chemically synthesized
gttaatttatgtattgagagaa

SEQ ID NO: 1008207 - DNA, 22 bp, Artificial Sequence
  chemically synthesized
aattgtgccaagcaattctctc

SEQ ID NO: 1008208 - DNA, 22 bp, Artificial Sequence
  chemically synthesized
atttatgtattgagagaattgc

SEQ ID NO: 1008209 - DNA, 22 bp, Artificial Sequence
  chemically synthesized
atgtattgagagaattgcttgg

SEQ ID NO: 1008210 - DNA, 22 bp, Artificial Sequence
  chemically synthesized
tgtattgagagaattgcttggc

SEQ ID NO: 1008211 - DNA, 22 bp, Artificial Sequence
  chemically synthesized
agagggttgaattgtgccaagc

SEQ ID NO: 1008212 - DNA, 22 bp, Artificial Sequence
  chemically synthesized
gagagggttgaattgtgccaag

SEQ ID NO: 1008213 - DNA, 22 bp, Artificial Sequence
  chemically synthesized
tgagagggttgaattgtgccaa

SEQ ID NO: 1008214 - DNA, 22 bp, Artificial Sequence
  chemically synthesized
agagaattgcttggcacaattc

SEQ ID NO: 1008215 - DNA, 22 bp, Artificial Sequence
  chemically synthesized
cataaactttgagagggttgaa

SEQ ID NO: 1008216 - DNA, 22 bp, Artificial Sequence
  chemically synthesized
cttggcacaattcaaccctctc

SEQ ID NO: 1008217 - DNA, 22 bp, Artificial Sequence
  chemically synthesized
ggcacaattcaaccctctcaaa

SEQ ID NO: 1008218 - DNA, 22 bp, Artificial Sequence
  chemically synthesized
acctgcataaactttgagaggg

SEQ ID NO: 1008219 - DNA, 22 bp, Artificial Sequence
  chemically synthesized
gcacaattcaaccctctcaaag

SEQ ID NO: 1008220 - DNA, 22 bp, Artificial Sequence
  chemically synthesized
aaccctctcaaagtttatgcag

SEQ ID NO: 1008221 - DNA, 22 bp, Artificial Sequence
  chemically synthesized
cacggtgctcacctgcataaac

SEQ ID NO: 1008222 - DNA, 22 bp, Artificial Sequence
  chemically synthesized
tactgcacggtgctcacctgca

SEQ ID NO: 1008223 - DNA, 22 bp, Artificial Sequence
  chemically synthesized
tcaaagtttatgcaggtgagca

SEQ ID NO: 1008224 - DNA, 22 bp, Artificial Sequence
  chemically synthesized
aaagtttatgcaggtgagcacc

SEQ ID NO: 1008225 - DNA, 22 bp, Artificial Sequence
  chemically synthesized
atgcaggtgagcaccgtgcagt

SEQ ID NO: 1008226 - DNA, 22 bp, Artificial Sequence
  chemically synthesized
tgcaggtgagcaccgtgcagta

SEQ ID NO: 1008227 - DNA, 22 bp, Artificial Sequence
  chemically synthesized
ccaaaggagactatactgcacg

SEQ ID NO: 1008228 - DNA, 22 bp, Artificial Sequence
  chemically synthesized
ctgccaaaggagactatactgc

SEQ ID NO: 1008229 - DNA, 22 bp, Artificial Sequence
  chemically synthesized
gctgccaaaggagactatactg

SEQ ID NO: 1008230 - DNA, 22 bp, Artificial Sequence
  chemically synthesized
ttgctgccaaaggagactatac

SEQ ID NO: 1008231 - DNA, 22 bp, Artificial Sequence
  chemically synthesized
agctcttgctgccaaaggagac

SEQ ID NO: 1008232 - DNA, 22 bp, Artificial Sequence
  chemically synthesized
aaaatcagatattaagctcttg

SEQ ID NO: 1008233 - DNA, 22 bp, Artificial Sequence
  chemically synthesized
tcaaaatcagatattaagctct

SEQ ID NO: 1008234 - DNA, 22 bp, Artificial Sequence
  chemically synthesized
ctttggcagcaagagcttaata

SEQ ID NO: 1008235 - DNA, 22 bp, Artificial Sequence
  chemically synthesized
tctcaaaatcagatattaagct

SEQ ID NO: 1008236 - DNA, 22 bp, Artificial Sequence
  chemically synthesized
tggcagcaagagcttaatatct

SEQ ID NO: 1008237 - DNA, 22 bp, Artificial Sequence
  chemically synthesized
ggcagcaagagcttaatatctg

SEQ ID NO: 1008238 - DNA, 22 bp, Artificial Sequence
  chemically synthesized
gcagcaagagcttaatatctga

SEQ ID NO: 1008239 - DNA, 22 bp, Artificial Sequence
  chemically synthesized
agctctctcaaaatcagatatt

SEQ ID NO: 1008240 - DNA, 22 bp, Artificial Sequence
  chemically synthesized
tcagctctctcaaaatcagata

SEQ ID NO: 1008241 - DNA, 22 bp, Artificial Sequence
  chemically synthesized
aatatctgattttgagagagct

SEQ ID NO: 1008242 - DNA, 22 bp, Artificial Sequence
  chemically synthesized
cgtatcattctcagctctctca

SEQ ID NO: 1008243 - DNA, 22 bp, Artificial Sequence
  chemically synthesized
atatctgattttgagagagctg

SEQ ID NO: 1008244 - DNA, 22 bp, Artificial Sequence
  chemically synthesized
gcgtatcattctcagctctctc

SEQ ID NO: 1008245 - DNA, 22 bp, Artificial Sequence
  chemically synthesized
tgcgtatcattctcagctctct

SEQ ID NO: 1008246 - DNA, 22 bp, Artificial Sequence
  chemically synthesized
ttttgcgtatcattctcagctc

SEQ ID NO: 1008247 - DNA, 22 bp, Artificial Sequence
  chemically synthesized
attttgagagagctgagaatga

SEQ ID NO: 1008248 - DNA, 22 bp, Artificial Sequence
  chemically synthesized
atgctgttttgcgtatcattct

SEQ ID NO: 1008249 - DNA, 22 bp, Artificial Sequence
  chemically synthesized
tgagagagctgagaatgatacg

SEQ ID NO: 1008250 - DNA, 22 bp, Artificial Sequence
  chemically synthesized
gagagagctgagaatgatacgc

SEQ ID NO: 1008251 - DNA, 22 bp, Artificial Sequence
  chemically synthesized
agagagctgagaatgatacgca

SEQ ID NO: 1008252 - DNA, 22 bp, Artificial Sequence
  chemically synthesized
agaatgatacgcaaaacagcat

SEQ ID NO: 1008253 - DNA, 22 bp, Artificial Sequence
  chemically synthesized
aaaatatagggaagaaactaat

SEQ ID NO: 1008254 - DNA, 22 bp, Artificial Sequence
  chemically synthesized
taattaaaaatatagggaagaa

SEQ ID NO: 1008255 - DNA, 22 bp, Artificial Sequence
  chemically synthesized
ctgtaattaaaaatatagggaa

SEQ ID NO: 1008256 - DNA, 22 bp, Artificial Sequence
  chemically synthesized
gtttcttccctatatttttaat

SEQ ID NO: 1008257 - DNA, 22 bp, Artificial Sequence
  chemically synthesized
cttccctatatttttaattaca

SEQ ID NO: 1008258 - DNA, 22 bp, Artificial Sequence
  chemically synthesized
ttccctatatttttaattacag

SEQ ID NO: 1008259 - DNA, 22 bp, Artificial Sequence
  chemically synthesized
aaagacagcattactgtaatta

SEQ ID NO: 1008260 - DNA, 22 bp, Artificial Sequence
  chemically synthesized
ccctatatttttaattacagta

SEQ ID NO: 1008261 - DNA, 22 bp, Artificial Sequence
  chemically synthesized
aaaagacagcattactgtaatt

SEQ ID NO: 1008262 - DNA, 22 bp, Artificial Sequence
  chemically synthesized
cctatatttttaattacagtaa

SEQ ID NO: 1008263 - DNA, 22 bp, Artificial Sequence
  chemically synthesized
taaaagacagcattactgtaat

SEQ ID NO: 1008264 - DNA, 22 bp, Artificial Sequence
  chemically synthesized
ttttaaaagacagcattactgt

SEQ ID NO: 1008265 - DNA, 22 bp, Artificial Sequence
  chemically synthesized
tatttttaattacagtaatgct

SEQ ID NO: 1008266 - DNA, 22 bp, Artificial Sequence
  chemically synthesized
attttaaaagacagcattactg

SEQ ID NO: 1008267 - DNA, 22 bp, Artificial Sequence
  chemically synthesized
ttaattacagtaatgctgtctt

SEQ ID NO: 1008268 - DNA, 22 bp, Artificial Sequence
  chemically synthesized
taattacagtaatgctgtcttt

SEQ ID NO: 1008269 - DNA, 22 bp, Artificial Sequence
  chemically synthesized
aattacagtaatgctgtctttt

SEQ ID NO: 1008270 - DNA, 22 bp, Artificial Sequence
  chemically synthesized
attacagtaatgctgtctttta

SEQ ID NO: 1008271 - DNA, 22 bp, Artificial Sequence
  chemically synthesized
aggagtcttattttaaaagaca

SEQ ID NO: 1008272 - DNA, 22 bp, Artificial Sequence
  chemically synthesized
cagtaatgctgtcttttaaaat

SEQ ID NO: 1008273 - DNA, 22 bp, Artificial Sequence
  chemically synthesized
tcttttaaaataagactcctga

SEQ ID NO: 1008274 - DNA, 22 bp, Artificial Sequence
  chemically synthesized
tgatcataaagtactcaggagt

SEQ ID NO: 1008275 - DNA, 22 bp, Artificial Sequence
  chemically synthesized
ttaaaataagactcctgagtac

SEQ ID NO: 1008276 - DNA, 22 bp, Artificial Sequence
  chemically synthesized
taaaataagactcctgagtact

SEQ ID NO: 1008277 - DNA, 22 bp, Artificial Sequence
  chemically synthesized
ttatgatcataaagtactcagg

SEQ ID NO: 1008278 - DNA, 22 bp, Artificial Sequence
  chemically synthesized
aaaataagactcctgagtactt

SEQ ID NO: 1008279 - DNA, 22 bp, Artificial Sequence
  chemically synthesized
attatgatcataaagtactcag

SEQ ID NO: 1008280 - DNA, 22 bp, Artificial Sequence
  chemically synthesized
aaataagactcctgagtacttt

SEQ ID NO: 1008281 - DNA, 22 bp, Artificial Sequence
  chemically synthesized
agatggatttattatgatcata

SEQ ID NO: 1008282 - DNA, 22 bp, Artificial Sequence
  chemically synthesized
ctgagtactttatgatcataat

SEQ ID NO: 1008283 - DNA, 22 bp, Artificial Sequence
  chemically synthesized
agtactttatgatcataataaa

SEQ ID NO: 1008284 - DNA, 22 bp, Artificial Sequence
  chemically synthesized
tatgatcataataaatccatct

SEQ ID NO: 1008285 - DNA, 22 bp, Artificial Sequence
  chemically synthesized
atgatcataataaatccatctt

SEQ ID NO: 1008286 - DNA, 22 bp, Artificial Sequence
  chemically synthesized
tgatcataataaatccatctta

SEQ ID NO: 1008287 - DNA, 22 bp, Artificial Sequence
  chemically synthesized
aatcgcattcactgctttattt

SEQ ID NO: 1008288 - DNA, 22 bp, Artificial Sequence
  chemically synthesized
atcgcattcactgctttatttt

SEQ ID NO: 1008289 - DNA, 22 bp, Artificial Sequence
  chemically synthesized
aaaagaaataaaaaagaaaata

SEQ ID NO: 1008290 - DNA, 22 bp, Artificial Sequence
  chemically synthesized
tctcaaaagaaataaaaaagaa

SEQ ID NO: 1008291 - DNA, 22 bp, Artificial Sequence
  chemically synthesized
actgctttattttcttttttat

SEQ ID NO: 1008292 - DNA, 22 bp, Artificial Sequence
  chemically synthesized
tgtctcaaaagaaataaaaaag

SEQ ID NO: 1008293 - DNA, 22 bp, Artificial Sequence
  chemically synthesized
ctttattttcttttttatttct

SEQ ID NO: 1008294 - DNA, 22 bp, Artificial Sequence
  chemically synthesized
tattttcttttttatttctttt

SEQ ID NO: 1008295 - DNA, 22 bp, Artificial Sequence
  chemically synthesized
attttcttttttatttcttttg

SEQ ID NO: 1008296 - DNA, 22 bp, Artificial Sequence
  chemically synthesized
ttttcttttttatttcttttga

SEQ ID NO: 1008297 - DNA, 22 bp, Artificial Sequence
  chemically synthesized
tcttttttatttcttttgagac

SEQ ID NO: 1008298 - DNA, 22 bp, Artificial Sequence
  chemically synthesized
cttttttatttcttttgagaca

SEQ ID NO: 1008299 - DNA, 22 bp, Artificial Sequence
  chemically synthesized
ttttttatttcttttgagacag

SEQ ID NO: 1008300 - DNA, 22 bp, Artificial Sequence
  chemically synthesized
ttttatttcttttgagacagag

SEQ ID NO: 1008301 - DNA, 22 bp, Artificial Sequence
  chemically synthesized
tttatttcttttgagacagagt

SEQ ID NO: 1008302 - DNA, 22 bp, Artificial Sequence
  chemically synthesized
ttatttcttttgagacagagtc

SEQ ID NO: 1008303 - DNA, 22 bp, Artificial Sequence
  chemically synthesized
gcgacagagtgagactctgtct

SEQ ID NO: 1008304 - DNA, 22 bp, Artificial Sequence
  chemically synthesized
tatttcttttgagacagagtct

SEQ ID NO: 1008305 - DNA, 22 bp, Artificial Sequence
  chemically synthesized
atttcttttgagacagagtctc

SEQ ID NO: 1008306 - DNA, 22 bp, Artificial Sequence
  chemically synthesized
tttcttttgagacagagtctca

SEQ ID NO: 1008307 - DNA, 22 bp, Artificial Sequence
  chemically synthesized
cttttgagacagagtctcactc

SEQ ID NO: 1008308 - DNA, 22 bp, Artificial Sequence
  chemically synthesized
ttttgagacagagtctcactct

SEQ ID NO: 1008309 - DNA, 22 bp, Artificial Sequence
  chemically synthesized
cagcctggcgacagagtgagac

SEQ ID NO: 1008310 - DNA, 22 bp, Artificial Sequence
  chemically synthesized
ttgagacagagtctcactctgt

SEQ ID NO: 1008311 - DNA, 22 bp, Artificial Sequence
  chemically synthesized
tgagacagagtctcactctgtc

SEQ ID NO: 1008312 - DNA, 22 bp, Artificial Sequence
  chemically synthesized
gagacagagtctcactctgtcg

SEQ ID NO: 1008313 - DNA, 22 bp, Artificial Sequence
  chemically synthesized
agacagagtctcactctgtcgc

SEQ ID NO: 1008314 - DNA, 22 bp, Artificial Sequence
  chemically synthesized
cactccagcctggcgacagagt

SEQ ID NO: 1008315 - DNA, 22 bp, Artificial Sequence
  chemically synthesized
actctgtcgccaggctggagtg

SEQ ID NO: 1008316 - DNA, 22 bp, Artificial Sequence
  chemically synthesized
tgtcgccaggctggagtgcagt

SEQ ID NO: 1008317 - DNA, 22 bp, Artificial Sequence
  chemically synthesized
tcgccaggctggagtgcagtgg

SEQ ID NO: 1008318 - DNA, 22 bp, Artificial Sequence
  chemically synthesized
gagtgcagtggcacgatcttgg

SEQ ID NO: 1008319 - DNA, 22 bp, Artificial Sequence
  chemically synthesized
aacccgagaggcggaggtcgca

SEQ ID NO: 1008320 - DNA, 22 bp, Artificial Sequence
  chemically synthesized
gaacccgagaggcggaggtcgc

SEQ ID NO: 1008321 - DNA, 22 bp, Artificial Sequence
  chemically synthesized
ggctcactgcgacctccgcctc

SEQ ID NO: 1008322 - DNA, 22 bp, Artificial Sequence
  chemically synthesized
gctcactgcgacctccgcctct

SEQ ID NO: 1008323 - DNA, 22 bp, Artificial Sequence
  chemically synthesized
actgcgacctccgcctctcggg

SEQ ID NO: 1008324 - DNA, 22 bp, Artificial Sequence
  chemically synthesized
cgacctccgcctctcgggttca

SEQ ID NO: 1008325 - DNA, 22 bp, Artificial Sequence
  chemically synthesized
aggcaggagtatcgcttgaacc

SEQ ID NO: 1008326 - DNA, 22 bp, Artificial Sequence
  chemically synthesized
cgcctctcgggttcaagcgata

SEQ ID NO: 1008327 - DNA, 22 bp, Artificial Sequence
  chemically synthesized
ggaggctgaggcaggagtatcg

SEQ ID NO: 1008328 - DNA, 22 bp, Artificial Sequence
  chemically synthesized
tcgggttcaagcgatactcctg

SEQ ID NO: 1008329 - DNA, 22 bp, Artificial Sequence
  chemically synthesized
gggaggctgaggcaggagtatc

SEQ ID NO: 1008330 - DNA, 22 bp, Artificial Sequence
  chemically synthesized
gggttcaagcgatactcctgcc

SEQ ID NO: 1008331 - DNA, 22 bp, Artificial Sequence
  chemically synthesized
cttgggaggctgaggcaggagt

SEQ ID NO: 1008332 - DNA, 22 bp, Artificial Sequence
  chemically synthesized
aagcgatactcctgcctcagcc

SEQ ID NO: 1008333 - DNA, 22 bp, Artificial Sequence
  chemically synthesized
gagtcccagctacttgggaggc

SEQ ID NO: 1008334 - DNA, 22 bp, Artificial Sequence
  chemically synthesized
ctgcctcagcctcccaagtagc

SEQ ID NO: 1008335 - DNA, 22 bp, Artificial Sequence
  chemically synthesized
cctcagcctcccaagtagctgg

SEQ ID NO: 1008336 - DNA, 22 bp, Artificial Sequence
  chemically synthesized
agcctcccaagtagctgggact

SEQ ID NO: 1008337 - DNA, 22 bp, Artificial Sequence
  chemically synthesized
ccaagtagctgggactctaggc

SEQ ID NO: 1008338 - DNA, 22 bp, Artificial Sequence
  chemically synthesized
gccaggcgtggtggtgcatgcc

SEQ ID NO: 1008339 - DNA, 22 bp, Artificial Sequence
  chemically synthesized
ggactctaggcatgcaccacca

SEQ ID NO: 1008340 - DNA, 22 bp, Artificial Sequence
  chemically synthesized
taggcatgcaccaccacgcctg

SEQ ID NO: 1008341 - DNA, 22 bp, Artificial Sequence
  chemically synthesized
ggcatgcaccaccacgcctggc

SEQ ID NO: 1008342 - DNA, 22 bp, Artificial Sequence
  chemically synthesized
aaaatatgaaaattagccaggc

SEQ ID NO: 1008343 - DNA, 22 bp, Artificial Sequence
  chemically synthesized
ctaaaaatatgaaaattagcca

SEQ ID NO: 1008344 - DNA, 22 bp, Artificial Sequence
  chemically synthesized
tactaaaaatatgaaaattagc

SEQ ID NO: 1008345 - DNA, 22 bp, Artificial Sequence
  chemically synthesized
gctaattttcatatttttagta

SEQ ID NO: 1008346 - DNA, 22 bp, Artificial Sequence
  chemically synthesized
attttcatatttttagtagaga

SEQ ID NO: 1008347 - DNA, 22 bp, Artificial Sequence
  chemically synthesized
tcatatttttagtagagatggg

SEQ ID NO: 1008348 - DNA, 22 bp, Artificial Sequence
  chemically synthesized
catatttttagtagagatgggg

SEQ ID NO: 1008349 - DNA, 22 bp, Artificial Sequence
  chemically synthesized
atatttttagtagagatggggt

SEQ ID NO: 1008350 - DNA, 22 bp, Artificial Sequence
  chemically synthesized
gccaacatggcgaaaccccatc

SEQ ID NO: 1008351 - DNA, 22 bp, Artificial Sequence
  chemically synthesized
ttagtagagatggggtttcgcc

SEQ ID NO: 1008352 - DNA, 22 bp, Artificial Sequence
  chemically synthesized
tagtagagatggggtttcgcca

SEQ ID NO: 1008353 - DNA, 22 bp, Artificial Sequence
  chemically synthesized
agtagagatggggtttcgccat

SEQ ID NO: 1008354 - DNA, 22 bp, Artificial Sequence
  chemically synthesized
gtagagatggggtttcgccatg

SEQ ID NO: 1008355 - DNA, 22 bp, Artificial Sequence
  chemically synthesized
cgccatgttggccaggatggtc

SEQ ID NO: 1008356 - DNA, 22 bp, Artificial Sequence
  chemically synthesized
gccatgttggccaggatggtct

SEQ ID NO: 1008357 - DNA, 22 bp, Artificial Sequence
  chemically synthesized
ggtcaagaaatcgagaccatcc

SEQ ID NO: 1008358 - DNA, 22 bp, Artificial Sequence
  chemically synthesized
gccaggatggtctcgatttctt

SEQ ID NO: 1008359 - DNA, 22 bp, Artificial Sequence
  chemically synthesized
gatttcttgacctagtgatctg

SEQ ID NO: 1008360 - DNA, 22 bp, Artificial Sequence
  chemically synthesized
ggaggccgaggcaggcagatca

SEQ ID NO: 1008361 - DNA, 22 bp, Artificial Sequence
  chemically synthesized
gggaggccgaggcaggcagatc

SEQ ID NO: 1008362 - DNA, 22 bp, Artificial Sequence
  chemically synthesized
cttgacctagtgatctgcctgc

SEQ ID NO: 1008363 - DNA, 22 bp, Artificial Sequence
  chemically synthesized
tgggaggccgaggcaggcagat

SEQ ID NO: 1008364 - DNA, 22 bp, Artificial Sequence
  chemically synthesized
ttgacctagtgatctgcctgcc

SEQ ID NO: 1008365 - DNA, 22 bp, Artificial Sequence
  chemically synthesized
gacctagtgatctgcctgcctc

SEQ ID NO: 1008366 - DNA, 22 bp, Artificial Sequence
  chemically synthesized
acctagtgatctgcctgcctcg

SEQ ID NO: 1008367 - DNA, 22 bp, Artificial Sequence
  chemically synthesized
gtgatctgcctgcctcggcctc

SEQ ID NO: 1008368 - DNA, 22 bp, Artificial Sequence
  chemically synthesized
taatcccagcactttgggaggc

SEQ ID NO: 1008369 - DNA, 22 bp, Artificial Sequence
  chemically synthesized
cctgcctcggcctcccaaagtg

SEQ ID NO: 1008370 - DNA, 22 bp, Artificial Sequence
  chemically synthesized
cctcggcctcccaaagtgctgg

SEQ ID NO: 1008371 - DNA, 22 bp, Artificial Sequence
  chemically synthesized
acgcctgtaatcccagcacttt

SEQ ID NO: 1008372 - DNA, 22 bp, Artificial Sequence
  chemically synthesized
ggcctcccaaagtgctgggatt

SEQ ID NO: 1008373 - DNA, 22 bp, Artificial Sequence
  chemically synthesized
ccaaagtgctgggattacaggc

SEQ ID NO: 1008374 - DNA, 22 bp, Artificial Sequence
  chemically synthesized
ggtgcggtggctcacgcctgta

SEQ ID NO: 1008375 - DNA, 22 bp, Artificial Sequence
  chemically synthesized
ggattacaggcgtgagccaccg

SEQ ID NO: 1008376 - DNA, 22 bp, Artificial Sequence
  chemically synthesized
caggcgtgagccaccgcaccca

SEQ ID NO: 1008377 - DNA, 22 bp, Artificial Sequence
  chemically synthesized
aaaataaagcagtgggctgggt

SEQ ID NO: 1008378 - DNA, 22 bp, Artificial Sequence
  chemically synthesized
gaaaataaagcagtgggctggg

SEQ ID NO: 1008379 - DNA, 22 bp, Artificial Sequence
  chemically synthesized
cttgaaaataaagcagtgggct

SEQ ID NO: 1008380 - DNA, 22 bp, Artificial Sequence
  chemically synthesized
tgcttgaaaataaagcagtggg

SEQ ID NO: 1008381 - DNA, 22 bp, Artificial Sequence
  chemically synthesized
ctgcttgaaaataaagcagtgg

SEQ ID NO: 1008382 - DNA, 22 bp, Artificial Sequence
  chemically synthesized
tctgcttgaaaataaagcagtg

SEQ ID NO: 1008383 - DNA, 22 bp, Artificial Sequence
  chemically synthesized
tgtatgttttctgcttgaaaat

SEQ ID NO: 1008384 - DNA, 22 bp, Artificial Sequence
  chemically synthesized
ctttattttcaagcagaaaaca

SEQ ID NO: 1008385 - DNA, 22 bp, Artificial Sequence
  chemically synthesized
aaggtgttgtgtatgttttctg

SEQ ID NO: 1008386 - DNA, 22 bp, Artificial Sequence
  chemically synthesized
tattttcaagcagaaaacatac

SEQ ID NO: 1008387 - DNA, 22 bp, Artificial Sequence
  chemically synthesized
attttcaagcagaaaacataca

SEQ ID NO: 1008388 - DNA, 22 bp, Artificial Sequence
  chemically synthesized
ttttcaagcagaaaacatacac

SEQ ID NO: 1008389 - DNA, 22 bp, Artificial Sequence
  chemically synthesized
tcaagcagaaaacatacacaac

SEQ ID NO: 1008390 - DNA, 22 bp, Artificial Sequence
  chemically synthesized
caagcagaaaacatacacaaca

SEQ ID NO: 1008391 - DNA, 22 bp, Artificial Sequence
  chemically synthesized
aagcagaaaacatacacaacac

SEQ ID NO: 1008392 - DNA, 22 bp, Artificial Sequence
  chemically synthesized
gcatccatctgaaggtgttgtg

SEQ ID NO: 1008393 - DNA, 22 bp, Artificial Sequence
  chemically synthesized
agcatccatctgaaggtgttgt

SEQ ID NO: 1008394 - DNA, 22 bp, Artificial Sequence
  chemically synthesized
tagcatccatctgaaggtgttg

SEQ ID NO: 1008395 - DNA, 22 bp, Artificial Sequence
  chemically synthesized
ctttagcatccatctgaaggtg

SEQ ID NO: 1008396 - DNA, 22 bp, Artificial Sequence
  chemically synthesized
tactttagcatccatctgaagg

SEQ ID NO: 1008397 - DNA, 22 bp, Artificial Sequence
  chemically synthesized
ctactttagcatccatctgaag

SEQ ID NO: 1008398 - DNA, 22 bp, Artificial Sequence
  chemically synthesized
tttctactttagcatccatctg

SEQ ID NO: 1008399 - DNA, 22 bp, Artificial Sequence
  chemically synthesized
atttctactttagcatccatct

SEQ ID NO: 1008400 - DNA, 22 bp, Artificial Sequence
  chemically synthesized
aacagtttatttctactttagc

SEQ ID NO: 1008401 - DNA, 22 bp, Artificial Sequence
  chemically synthesized
aaacagtttatttctactttag

SEQ ID NO: 1008402 - DNA, 22 bp, Artificial Sequence
  chemically synthesized
taaacagtttatttctacttta

SEQ ID NO: 1008403 - DNA, 22 bp, Artificial Sequence
  chemically synthesized
cagatggatgctaaagtagaaa

SEQ ID NO: 1008404 - DNA, 22 bp, Artificial Sequence
  chemically synthesized
ttaaacagtttatttctacttt

SEQ ID NO: 1008405 - DNA, 22 bp, Artificial Sequence
  chemically synthesized
agatggatgctaaagtagaaat

SEQ ID NO: 1008406 - DNA, 22 bp, Artificial Sequence
  chemically synthesized
aagtagaaataaactgtttaaa

SEQ ID NO: 1008407 - DNA, 22 bp, Artificial Sequence
  chemically synthesized
agacataccacatgacaatcat

SEQ ID NO: 1008408 - DNA, 22 bp, Artificial Sequence
  chemically synthesized
tcagacataccacatgacaatc

SEQ ID NO: 1008409 - DNA, 22 bp, Artificial Sequence
  chemically synthesized
ctcagacataccacatgacaat

SEQ ID NO: 1008410 - DNA, 22 bp, Artificial Sequence
  chemically synthesized
tttaaaaatgattgtcatgtgg

SEQ ID NO: 1008411 - DNA, 22 bp, Artificial Sequence
  chemically synthesized
ttctcagacataccacatgaca

SEQ ID NO: 1008412 - DNA, 22 bp, Artificial Sequence
  chemically synthesized
cttctcagacataccacatgac

SEQ ID NO: 1008413 - DNA, 22 bp, Artificial Sequence
  chemically synthesized
tcttctcagacataccacatga

SEQ ID NO: 1008414 - DNA, 22 bp, Artificial Sequence
  chemically synthesized
aaaaatgattgtcatgtggtat

SEQ ID NO: 1008415 - DNA, 22 bp, Artificial Sequence
  chemically synthesized
aaaatgattgtcatgtggtatg

SEQ ID NO: 1008416 - DNA, 22 bp, Artificial Sequence
  chemically synthesized
ttttcttctcagacataccaca

SEQ ID NO: 1008417 - DNA, 22 bp, Artificial Sequence
  chemically synthesized
attttcttctcagacataccac

SEQ ID NO: 1008418 - DNA, 22 bp, Artificial Sequence
  chemically synthesized
tcatgtggtatgtctgagaaga

SEQ ID NO: 1008419 - DNA, 22 bp, Artificial Sequence
  chemically synthesized
tgatgcttattttcttctcaga

SEQ ID NO: 1008420 - DNA, 22 bp, Artificial Sequence
  chemically synthesized
tgatcctgtgatgcttattttc

SEQ ID NO: 1008421 - DNA, 22 bp, Artificial Sequence
  chemically synthesized
gtgatcctgtgatgcttatttt

SEQ ID NO: 1008422 - DNA, 22 bp, Artificial Sequence
  chemically synthesized
tgtgatcctgtgatgcttattt

SEQ ID NO: 1008423 - DNA, 22 bp, Artificial Sequence
  chemically synthesized
agaagaaaataagcatcacagg

SEQ ID NO: 1008424 - DNA, 22 bp, Artificial Sequence
  chemically synthesized
acagattttgtgatcctgtgat

SEQ ID NO: 1008425 - DNA, 22 bp, Artificial Sequence
  chemically synthesized
aacagattttgtgatcctgtga

SEQ ID NO: 1008426 - DNA, 22 bp, Artificial Sequence
  chemically synthesized
gagacagatatttaacagattt

SEQ ID NO: 1008427 - DNA, 22 bp, Artificial Sequence
  chemically synthesized
aagtcatgattggagacagata

SEQ ID NO: 1008428 - DNA, 22 bp, Artificial Sequence
  chemically synthesized
caagtcatgattggagacagat

SEQ ID NO: 1008429 - DNA, 22 bp, Artificial Sequence
  chemically synthesized
ttaaatatctgtctccaatcat

SEQ ID NO: 1008430 - DNA, 22 bp, Artificial Sequence
  chemically synthesized
aatatctgtctccaatcatgac

SEQ ID NO: 1008431 - DNA, 22 bp, Artificial Sequence
  chemically synthesized
aaagagtgcaacttcaagtcat

SEQ ID NO: 1008432 - DNA, 22 bp, Artificial Sequence
  chemically synthesized
gaaagagtgcaacttcaagtca

SEQ ID NO: 1008433 - DNA, 22 bp, Artificial Sequence
  chemically synthesized
tctccaatcatgacttgaagtt

SEQ ID NO: 1008434 - DNA, 22 bp, Artificial Sequence
  chemically synthesized
caatcatgacttgaagttgcac

SEQ ID NO: 1008435 - DNA, 22 bp, Artificial Sequence
  chemically synthesized
gcatacttgaaagagtgcaact

SEQ ID NO: 1008436 - DNA, 22 bp, Artificial Sequence
  chemically synthesized
agcatacttgaaagagtgcaac

SEQ ID NO: 1008437 - DNA, 22 bp, Artificial Sequence
  chemically synthesized
cagtttagcatacttgaaagag

SEQ ID NO: 1008438 - DNA, 22 bp, Artificial Sequence
  chemically synthesized
gaagttgcactctttcaagtat

SEQ ID NO: 1008439 - DNA, 22 bp, Artificial Sequence
  chemically synthesized
aagttgcactctttcaagtatg

SEQ ID NO: 1008440 - DNA, 22 bp, Artificial Sequence
  chemically synthesized
cactctttcaagtatgctaaac

SEQ ID NO: 1008441 - DNA, 22 bp, Artificial Sequence
  chemically synthesized
aaggaaaactgcagtttagcat

SEQ ID NO: 1008442 - DNA, 22 bp, Artificial Sequence
  chemically synthesized
aaaggaaaactgcagtttagca

SEQ ID NO: 1008443 - DNA, 22 bp, Artificial Sequence
  chemically synthesized
taaaggaaaactgcagtttagc

SEQ ID NO: 1008444 - DNA, 22 bp, Artificial Sequence
  chemically synthesized
tttcaagtatgctaaactgcag

SEQ ID NO: 1008445 - DNA, 22 bp, Artificial Sequence
  chemically synthesized
tcaagtatgctaaactgcagtt

SEQ ID NO: 1008446 - DNA, 22 bp, Artificial Sequence
  chemically synthesized
caagtatgctaaactgcagttt

SEQ ID NO: 1008447 - DNA, 22 bp, Artificial Sequence
  chemically synthesized
aactttaaaggaaaactgcagt

SEQ ID NO: 1008448 - DNA, 22 bp, Artificial Sequence
  chemically synthesized
aagtatgctaaactgcagtttt

SEQ ID NO: 1008449 - DNA, 22 bp, Artificial Sequence
  chemically synthesized
gaactttaaaggaaaactgcag

SEQ ID NO: 1008450 - DNA, 22 bp, Artificial Sequence
  chemically synthesized
cggtttgaactttaaaggaaaa

SEQ ID NO: 1008451 - DNA, 22 bp, Artificial Sequence
  chemically synthesized
aactgcagttttcctttaaagt

SEQ ID NO: 1008452 - DNA, 22 bp, Artificial Sequence
  chemically synthesized
taattacggtttgaactttaaa

SEQ ID NO: 1008453 - DNA, 22 bp, Artificial Sequence
  chemically synthesized
cagttttcctttaaagttcaaa

SEQ ID NO: 1008454 - DNA, 22 bp, Artificial Sequence
  chemically synthesized
cattataattacggtttgaact

SEQ ID NO: 1008455 - DNA, 22 bp, Artificial Sequence
  chemically synthesized
acattataattacggtttgaac

SEQ ID NO: 1008456 - DNA, 22 bp, Artificial Sequence
  chemically synthesized
tacattataattacggtttgaa

SEQ ID NO: 1008457 - DNA, 22 bp, Artificial Sequence
  chemically synthesized
ttacattataattacggtttga

SEQ ID NO: 1008458 - DNA, 22 bp, Artificial Sequence
  chemically synthesized
tcctttaaagttcaaaccgtaa

SEQ ID NO: 1008459 - DNA, 22 bp, Artificial Sequence
  chemically synthesized
cctttaaagttcaaaccgtaat

SEQ ID NO: 1008460 - DNA, 22 bp, Artificial Sequence
  chemically synthesized
ctttaaagttcaaaccgtaatt

SEQ ID NO: 1008461 - DNA, 22 bp, Artificial Sequence
  chemically synthesized
ggtttttacattataattacgg

SEQ ID NO: 1008462 - DNA, 22 bp, Artificial Sequence
  chemically synthesized
taaagttcaaaccgtaattata

SEQ ID NO: 1008463 - DNA, 22 bp, Artificial Sequence
  chemically synthesized
aaagttcaaaccgtaattataa

SEQ ID NO: 1008464 - DNA, 22 bp, Artificial Sequence
  chemically synthesized
aagttcaaaccgtaattataat

SEQ ID NO: 1008465 - DNA, 22 bp, Artificial Sequence
  chemically synthesized
ctgggtttttacattataatta

SEQ ID NO: 1008466 - DNA, 22 bp, Artificial Sequence
  chemically synthesized
cctgggtttttacattataatt

SEQ ID NO: 1008467 - DNA, 22 bp, Artificial Sequence
  chemically synthesized
aaaccgtaattataatgtaaaa

SEQ ID NO: 1008468 - DNA, 22 bp, Artificial Sequence
  chemically synthesized
tatacttcctgggtttttacat

SEQ ID NO: 1008469 - DNA, 22 bp, Artificial Sequence
  chemically synthesized
ctgtatacttcctgggttttta

SEQ ID NO: 1008470 - DNA, 22 bp, Artificial Sequence
  chemically synthesized
gctgtatacttcctgggttttt

SEQ ID NO: 1008471 - DNA, 22 bp, Artificial Sequence
  chemically synthesized
taatgtaaaaacccaggaagta

SEQ ID NO: 1008472 - DNA, 22 bp, Artificial Sequence
  chemically synthesized
cggtttgctgtatacttcctgg

SEQ ID NO: 1008473 - DNA, 22 bp, Artificial Sequence
  chemically synthesized
acggtttgctgtatacttcctg

SEQ ID NO: 1008474 - DNA, 22 bp, Artificial Sequence
  chemically synthesized
ggatacttacggtttgctgtat

SEQ ID NO: 1008475 - DNA, 22 bp, Artificial Sequence
  chemically synthesized
aggatacttacggtttgctgta

SEQ ID NO: 1008476 - DNA, 22 bp, Artificial Sequence
  chemically synthesized
tttaggatacttacggtttgct

SEQ ID NO: 1008477 - DNA, 22 bp, Artificial Sequence
  chemically synthesized
gtttaggatacttacggtttgc

SEQ ID NO: 1008478 - DNA, 22 bp, Artificial Sequence
  chemically synthesized
agtttgtttaggatacttacgg

SEQ ID NO: 1008479 - DNA, 22 bp, Artificial Sequence
  chemically synthesized
aagtttgtttaggatacttacg

SEQ ID NO: 1008480 - DNA, 22 bp, Artificial Sequence
  chemically synthesized
aagatttaagtttgtttaggat

SEQ ID NO: 1008481 - DNA, 22 bp, Artificial Sequence
  chemically synthesized
caagatttaagtttgtttagga

SEQ ID NO: 1008482 - DNA, 22 bp, Artificial Sequence
  chemically synthesized
tcaagatttaagtttgtttagg

SEQ ID NO: 1008483 - DNA, 22 bp, Artificial Sequence
  chemically synthesized
ttcaagatttaagtttgtttag

SEQ ID NO: 1008484 - DNA, 22 bp, Artificial Sequence
  chemically synthesized
cacttttcaagatttaagtttg

SEQ ID NO: 1008485 - DNA, 22 bp, Artificial Sequence
  chemically synthesized
gcacttttcaagatttaagttt

SEQ ID NO: 1008486 - DNA, 22 bp, Artificial Sequence
  chemically synthesized
aacaaacttaaatcttgaaaag

SEQ ID NO: 1008487 - DNA, 22 bp, Artificial Sequence
  chemically synthesized
gggatgagatttgcacttttca

SEQ ID NO: 1008488 - DNA, 22 bp, Artificial Sequence
  chemically synthesized
ggggatgagatttgcacttttc

SEQ ID NO: 1008489 - DNA, 22 bp, Artificial Sequence
  chemically synthesized
tggggatgagatttgcactttt

SEQ ID NO: 1008490 - DNA, 22 bp, Artificial Sequence
  chemically synthesized
ttggggatgagatttgcacttt

SEQ ID NO: 1008491 - DNA, 22 bp, Artificial Sequence
  chemically synthesized
aaatcttgaaaagtgcaaatct

SEQ ID NO: 1008492 - DNA, 22 bp, Artificial Sequence
  chemically synthesized
aatcttgaaaagtgcaaatctc

SEQ ID NO: 1008493 - DNA, 22 bp, Artificial Sequence
  chemically synthesized
gaaaagtgcaaatctcatcccc

SEQ ID NO: 1008494 - DNA, 22 bp, Artificial Sequence
  chemically synthesized
aaaagtgcaaatctcatcccca

SEQ ID NO: 1008495 - DNA, 22 bp, Artificial Sequence
  chemically synthesized
agcaaaggcttttggggatgag

SEQ ID NO: 1008496 - DNA, 22 bp, Artificial Sequence
  chemically synthesized
gagcaaaggcttttggggatga

SEQ ID NO: 1008497 - DNA, 22 bp, Artificial Sequence
  chemically synthesized
cagaatgtgtttgagcaaaggc

SEQ ID NO: 1008498 - DNA, 22 bp, Artificial Sequence
  chemically synthesized
atccccaaaagcctttgctcaa

SEQ ID NO: 1008499 - DNA, 22 bp, Artificial Sequence
  chemically synthesized
taaaccacagttgcagaatgtg

SEQ ID NO: 1008500 - DNA, 22 bp, Artificial Sequence
  chemically synthesized
tgctcaaacacattctgcaact

SEQ ID NO: 1008501 - DNA, 22 bp, Artificial Sequence
  chemically synthesized
gctcaaacacattctgcaactg

SEQ ID NO: 1008502 - DNA, 22 bp, Artificial Sequence
  chemically synthesized
gcctataaaccacagttgcaga

SEQ ID NO: 1008503 - DNA, 22 bp, Artificial Sequence
  chemically synthesized
ctcaaacacattctgcaactgt

SEQ ID NO: 1008504 - DNA, 22 bp, Artificial Sequence
  chemically synthesized
agcctataaaccacagttgcag

SEQ ID NO: 1008505 - DNA, 22 bp, Artificial Sequence
  chemically synthesized
tagcctataaaccacagttgca

SEQ ID NO: 1008506 - DNA, 22 bp, Artificial Sequence
  chemically synthesized
aaacacattctgcaactgtggt

SEQ ID NO: 1008507 - DNA, 22 bp, Artificial Sequence
  chemically synthesized
tgttttagcctataaaccacag

SEQ ID NO: 1008508 - DNA, 22 bp, Artificial Sequence
  chemically synthesized
tgcaactgtggtttataggcta

SEQ ID NO: 1008509 - DNA, 22 bp, Artificial Sequence
  chemically synthesized
caactgtggtttataggctaaa

SEQ ID NO: 1008510 - DNA, 22 bp, Artificial Sequence
  chemically synthesized
tggtttataggctaaaacacag

SEQ ID NO: 1008511 - DNA, 22 bp, Artificial Sequence
  chemically synthesized
ataggctaaaacacagacttgt

SEQ ID NO: 1008512 - DNA, 22 bp, Artificial Sequence
  chemically synthesized
cacggtacacagacaagtctgt

SEQ ID NO: 1008513 - DNA, 22 bp, Artificial Sequence
  chemically synthesized
taggctaaaacacagacttgtc

SEQ ID NO: 1008514 - DNA, 22 bp, Artificial Sequence
  chemically synthesized
aaacacagacttgtctgtgtac

SEQ ID NO: 1008515 - DNA, 22 bp, Artificial Sequence
  chemically synthesized
caaaggacattacacggtacac

SEQ ID NO: 1008516 - DNA, 22 bp, Artificial Sequence
  chemically synthesized
gcaaaggacattacacggtaca

SEQ ID NO: 1008517 - DNA, 22 bp, Artificial Sequence
  chemically synthesized
tgcaaaggacattacacggtac

SEQ ID NO: 1008518 - DNA, 22 bp, Artificial Sequence
  chemically synthesized
gtctgtgtaccgtgtaatgtcc

SEQ ID NO: 1008519 - DNA, 22 bp, Artificial Sequence
  chemically synthesized
tctgtgtaccgtgtaatgtcct

SEQ ID NO: 1008520 - DNA, 22 bp, Artificial Sequence
  chemically synthesized
ggaaaactttgcaaaggacatt

SEQ ID NO: 1008521 - DNA, 22 bp, Artificial Sequence
  chemically synthesized
tgtaccgtgtaatgtcctttgc

SEQ ID NO: 1008522 - DNA, 22 bp, Artificial Sequence
  chemically synthesized
tgcaaagttttcctaacctacc

SEQ ID NO: 1008523 - DNA, 22 bp, Artificial Sequence
  chemically synthesized
gcaaagttttcctaacctacct

SEQ ID NO: 1008524 - DNA, 22 bp, Artificial Sequence
  chemically synthesized
caaagttttcctaacctacctg

SEQ ID NO: 1008525 - DNA, 22 bp, Artificial Sequence
  chemically synthesized
tcctaacctacctgtctggccc

SEQ ID NO: 1008526 - DNA, 22 bp, Artificial Sequence
  chemically synthesized
cctaacctacctgtctggccca

SEQ ID NO: 1008527 - DNA, 22 bp, Artificial Sequence
  chemically synthesized
ctaacctacctgtctggcccat

SEQ ID NO: 1008528 - DNA, 22 bp, Artificial Sequence
  chemically synthesized
acctacctgtctggcccatgct

SEQ ID NO: 1008529 - DNA, 22 bp, Artificial Sequence
  chemically synthesized
cagatggagggtgatagcatgg

SEQ ID NO: 1008530 - DNA, 22 bp, Artificial Sequence
  chemically synthesized
cctgtctggcccatgctatcac

SEQ ID NO: 1008531 - DNA, 22 bp, Artificial Sequence
  chemically synthesized
tctggcccatgctatcaccctc

SEQ ID NO: 1008532 - DNA, 22 bp, Artificial Sequence
  chemically synthesized
gcccatgctatcaccctccatc

SEQ ID NO: 1008533 - DNA, 22 bp, Artificial Sequence
  chemically synthesized
ggatcccaggcctccagatgga

SEQ ID NO: 1008534 - DNA, 22 bp, Artificial Sequence
  chemically synthesized
gggatcccaggcctccagatgg

SEQ ID NO: 1008535 - DNA, 22 bp, Artificial Sequence
  chemically synthesized
tgggatcccaggcctccagatg

SEQ ID NO: 1008536 - DNA, 22 bp, Artificial Sequence
  chemically synthesized
tcaccctccatctggaggcctg

SEQ ID NO: 1008537 - DNA, 22 bp, Artificial Sequence
  chemically synthesized
catctggaggcctgggatccca

SEQ ID NO: 1008538 - DNA, 22 bp, Artificial Sequence
  chemically synthesized
agtggcaaaagctttgggatcc

SEQ ID NO: 1008539 - DNA, 22 bp, Artificial Sequence
  chemically synthesized
gaggcctgggatcccaaagctt

SEQ ID NO: 1008540 - DNA, 22 bp, Artificial Sequence
  chemically synthesized
ggatcccaaagcttttgccact

SEQ ID NO: 1008541 - DNA, 22 bp, Artificial Sequence
  chemically synthesized
gagaatggcaaccaatattaag

SEQ ID NO: 1008542 - DNA, 22 bp, Artificial Sequence
  chemically synthesized
ggagaatggcaaccaatattaa

SEQ ID NO: 1008543 - DNA, 22 bp, Artificial Sequence
  chemically synthesized
ttgccacttaatattggttgcc

SEQ ID NO: 1008544 - DNA, 22 bp, Artificial Sequence
  chemically synthesized
tgccacttaatattggttgcca

SEQ ID NO: 1008545 - DNA, 22 bp, Artificial Sequence
  chemically synthesized
gccacttaatattggttgccat

SEQ ID NO: 1008546 - DNA, 22 bp, Artificial Sequence
  chemically synthesized
ccacttaatattggttgccatt

SEQ ID NO: 1008547 - DNA, 22 bp, Artificial Sequence
  chemically synthesized
gaaaagccagcttggagaatgg

SEQ ID NO: 1008548 - DNA, 22 bp, Artificial Sequence
  chemically synthesized
aatattggttgccattctccaa

SEQ ID NO: 1008549 - DNA, 22 bp, Artificial Sequence
  chemically synthesized
atattggttgccattctccaag

SEQ ID NO: 1008550 - DNA, 22 bp, Artificial Sequence
  chemically synthesized
agtctggaaaagccagcttgga

SEQ ID NO: 1008551 - DNA, 22 bp, Artificial Sequence
  chemically synthesized
gttgccattctccaagctggct

SEQ ID NO: 1008552 - DNA, 22 bp, Artificial Sequence
  chemically synthesized
ccattctccaagctggcttttc

SEQ ID NO: 1008553 - DNA, 22 bp, Artificial Sequence
  chemically synthesized
tccaagctggcttttccagact

SEQ ID NO: 1008554 - DNA, 22 bp, Artificial Sequence
  chemically synthesized
caagctggcttttccagactga

SEQ ID NO: 1008555 - DNA, 22 bp, Artificial Sequence
  chemically synthesized
gcttttccagactgaggtcatc

SEQ ID NO: 1008556 - DNA, 22 bp, Artificial Sequence
  chemically synthesized
tagaaacagaagagatgacctc

SEQ ID NO: 1008557 - DNA, 22 bp, Artificial Sequence
  chemically synthesized
atagaaacagaagagatgacct

SEQ ID NO: 1008558 - DNA, 22 bp, Artificial Sequence
  chemically synthesized
tatagaaacagaagagatgacc

SEQ ID NO: 1008559 - DNA, 22 bp, Artificial Sequence
  chemically synthesized
ttccagactgaggtcatctctt

SEQ ID NO: 1008560 - DNA, 22 bp, Artificial Sequence
  chemically synthesized
tccagactgaggtcatctcttc

SEQ ID NO: 1008561 - DNA, 22 bp, Artificial Sequence
  chemically synthesized
ccagactgaggtcatctcttct

SEQ ID NO: 1008562 - DNA, 22 bp, Artificial Sequence
  chemically synthesized
cagactgaggtcatctcttctg

SEQ ID NO: 1008563 - DNA, 22 bp, Artificial Sequence
  chemically synthesized
aaagttttatagaaacagaaga

SEQ ID NO: 1008564 - DNA, 22 bp, Artificial Sequence
  chemically synthesized
aaaagttttatagaaacagaag

SEQ ID NO: 1008565 - DNA, 22 bp, Artificial Sequence
  chemically synthesized
taaaagttttatagaaacagaa

SEQ ID NO: 1008566 - DNA, 22 bp, Artificial Sequence
  chemically synthesized
aggtcatctcttctgtttctat

SEQ ID NO: 1008567 - DNA, 22 bp, Artificial Sequence
  chemically synthesized
tattttaaaagttttatagaaa

SEQ ID NO: 1008568 - DNA, 22 bp, Artificial Sequence
  chemically synthesized
ttctgtttctataaaactttta

SEQ ID NO: 1008569 - DNA, 22 bp, Artificial Sequence
  chemically synthesized
ctgtttctataaaacttttaaa

SEQ ID NO: 1008570 - DNA, 22 bp, Artificial Sequence
  chemically synthesized
tgtttctataaaacttttaaaa

SEQ ID NO: 1008571 - DNA, 22 bp, Artificial Sequence
  chemically synthesized
cataataactgtattttaaaag

SEQ ID NO: 1008572 - DNA, 22 bp, Artificial Sequence
  chemically synthesized
tttctataaaacttttaaaata

SEQ ID NO: 1008573 - DNA, 22 bp, Artificial Sequence
  chemically synthesized
ccataataactgtattttaaaa

SEQ ID NO: 1008574 - DNA, 22 bp, Artificial Sequence
  chemically synthesized
ctataaaacttttaaaatacag

SEQ ID NO: 1008575 - DNA, 22 bp, Artificial Sequence
  chemically synthesized
tataaaacttttaaaatacagt

SEQ ID NO: 1008576 - DNA, 22 bp, Artificial Sequence
  chemically synthesized
aatttccataataactgtattt

SEQ ID NO: 1008577 - DNA, 22 bp, Artificial Sequence
  chemically synthesized
taaaacttttaaaatacagtta

SEQ ID NO: 1008578 - DNA, 22 bp, Artificial Sequence
  chemically synthesized
aaatttccataataactgtatt

SEQ ID NO: 1008579 - DNA, 22 bp, Artificial Sequence
  chemically synthesized
taaatttccataataactgtat

SEQ ID NO: 1008580 - DNA, 22 bp, Artificial Sequence
  chemically synthesized
ttaaaatacagttattatggaa

SEQ ID NO: 1008581 - DNA, 22 bp, Artificial Sequence
  chemically synthesized
taaaatacagttattatggaaa

SEQ ID NO: 1008582 - DNA, 22 bp, Artificial Sequence
  chemically synthesized
aaaatacagttattatggaaat

SEQ ID NO: 1008583 - DNA, 22 bp, Artificial Sequence
  chemically synthesized
aaatacagttattatggaaatt

SEQ ID NO: 1008584 - DNA, 22 bp, Artificial Sequence
  chemically synthesized
tgatatagcataatagttttaa

SEQ ID NO: 1008585 - DNA, 22 bp, Artificial Sequence
  chemically synthesized
ttatggaaatttaaaactatta

SEQ ID NO: 1008586 - DNA, 22 bp, Artificial Sequence
  chemically synthesized
tggaaatttaaaactattatgc

SEQ ID NO: 1008587 - DNA, 22 bp, Artificial Sequence
  chemically synthesized
aaagttatgatatagcataata

SEQ ID NO: 1008588 - DNA, 22 bp, Artificial Sequence
  chemically synthesized
aaaactattatgctatatcata

SEQ ID NO: 1008589 - DNA, 22 bp, Artificial Sequence
  chemically synthesized
aaactattatgctatatcataa

SEQ ID NO: 1008590 - DNA, 22 bp, Artificial Sequence
  chemically synthesized
ttatgctatatcataactttga

SEQ ID NO: 1008591 - DNA, 22 bp, Artificial Sequence
  chemically synthesized
tgctatatcataactttgaggt

SEQ ID NO: 1008592 - DNA, 22 bp, Artificial Sequence
  chemically synthesized
tatcataactttgaggtttatg

SEQ ID NO: 1008593 - DNA, 22 bp, Artificial Sequence
  chemically synthesized
gtgcagggagagatagatacat

SEQ ID NO: 1008594 - DNA, 22 bp, Artificial Sequence
  chemically synthesized
tgaggtttatgtatctatctct

SEQ ID NO: 1008595 - DNA, 22 bp, Artificial Sequence
  chemically synthesized
gaggtttatgtatctatctctc

SEQ ID NO: 1008596 - DNA, 22 bp, Artificial Sequence
  chemically synthesized
aggtttatgtatctatctctcc

SEQ ID NO: 1008597 - DNA, 22 bp, Artificial Sequence
  chemically synthesized
atgtatctatctctccctgcac

SEQ ID NO: 1008598 - DNA, 22 bp, Artificial Sequence
  chemically synthesized
tgtatctatctctccctgcact

SEQ ID NO: 1008599 - DNA, 22 bp, Artificial Sequence
  chemically synthesized
aagaaagccagtctagtgcagg

SEQ ID NO: 1008600 - DNA, 22 bp, Artificial Sequence
  chemically synthesized
tctctccctgcactagactggc

SEQ ID NO: 1008601 - DNA, 22 bp, Artificial Sequence
  chemically synthesized
cagcactcaagaaagccagtct

SEQ ID NO: 1008602 - DNA, 22 bp, Artificial Sequence
  chemically synthesized
ccagcactcaagaaagccagtc

SEQ ID NO: 1008603 - DNA, 22 bp, Artificial Sequence
  chemically synthesized
tccctgcactagactggctttc

SEQ ID NO: 1008604 - DNA, 22 bp, Artificial Sequence
  chemically synthesized
cctgcactagactggctttctt

SEQ ID NO: 1008605 - DNA, 22 bp, Artificial Sequence
  chemically synthesized
cactagactggctttcttgagt

SEQ ID NO: 1008606 - DNA, 22 bp, Artificial Sequence
  chemically synthesized
gactggctttcttgagtgctgg

SEQ ID NO: 1008607 - DNA, 22 bp, Artificial Sequence
  chemically synthesized
gctttcttgagtgctggaaata

SEQ ID NO: 1008608 - DNA, 22 bp, Artificial Sequence
  chemically synthesized
tcttgagtgctggaaatatgat

SEQ ID NO: 1008609 - DNA, 22 bp, Artificial Sequence
  chemically synthesized
cttgagtgctggaaatatgatt

SEQ ID NO: 1008610 - DNA, 22 bp, Artificial Sequence
  chemically synthesized
ttgagtgctggaaatatgattg

SEQ ID NO: 1008611 - DNA, 22 bp, Artificial Sequence
  chemically synthesized
gagtgctggaaatatgattgat

SEQ ID NO: 1008612 - DNA, 22 bp, Artificial Sequence
  chemically synthesized
agtgctggaaatatgattgatt

SEQ ID NO: 1008613 - DNA, 22 bp, Artificial Sequence
  chemically synthesized
tgtgagggaataaggaatcaat

SEQ ID NO: 1008614 - DNA, 22 bp, Artificial Sequence
  chemically synthesized
atgtgagggaataaggaatcaa

SEQ ID NO: 1008615 - DNA, 22 bp, Artificial Sequence
  chemically synthesized
tatgtgagggaataaggaatca

SEQ ID NO: 1008616 - DNA, 22 bp, Artificial Sequence
  chemically synthesized
gaaatatgattgattccttatt

SEQ ID NO: 1008617 - DNA, 22 bp, Artificial Sequence
  chemically synthesized
cctttatgtgagggaataagga

SEQ ID NO: 1008618 - DNA, 22 bp, Artificial Sequence
  chemically synthesized
attccttattccctcacataaa

SEQ ID NO: 1008619 - DNA, 22 bp, Artificial Sequence
  chemically synthesized
cttattccctcacataaaggca

SEQ ID NO: 1008620 - DNA, 22 bp, Artificial Sequence
  chemically synthesized
attccctcacataaaggcaggc

SEQ ID NO: 1008621 - DNA, 22 bp, Artificial Sequence
  chemically synthesized
ttccctcacataaaggcaggca

SEQ ID NO: 1008622 - DNA, 22 bp, Artificial Sequence
  chemically synthesized
cctcacataaaggcaggcatct

SEQ ID NO: 1008623 - DNA, 22 bp, Artificial Sequence
  chemically synthesized
agtcagggaggcagatgcctgc

SEQ ID NO: 1008624 - DNA, 22 bp, Artificial Sequence
  chemically synthesized
acataaaggcaggcatctgcct

SEQ ID NO: 1008625 - DNA, 22 bp, Artificial Sequence
  chemically synthesized
cctcagtcagggaggcagatgc

SEQ ID NO: 1008626 - DNA, 22 bp, Artificial Sequence
  chemically synthesized
tgcagtgaccctacctcagtca

SEQ ID NO: 1008627 - DNA, 22 bp, Artificial Sequence
  chemically synthesized
gtgcagtgaccctacctcagtc

SEQ ID NO: 1008628 - DNA, 22 bp, Artificial Sequence
  chemically synthesized
cttgtgcagtgaccctacctca

SEQ ID NO: 1008629 - DNA, 22 bp, Artificial Sequence
  chemically synthesized
cctccctgactgaggtagggtc

SEQ ID NO: 1008630 - DNA, 22 bp, Artificial Sequence
  chemically synthesized
cctgactgaggtagggtcactg

SEQ ID NO: 1008631 - DNA, 22 bp, Artificial Sequence
  chemically synthesized
actgaggtagggtcactgcaca

SEQ ID NO: 1008632 - DNA, 22 bp, Artificial Sequence
  chemically synthesized
aggtagggtcactgcacaagta

SEQ ID NO: 1008633 - DNA, 22 bp, Artificial Sequence
  chemically synthesized
aggaaaacaatactacttgtgc

SEQ ID NO: 1008634 - DNA, 22 bp, Artificial Sequence
  chemically synthesized
aacattgaggaaaacaatacta

SEQ ID NO: 1008635 - DNA, 22 bp, Artificial Sequence
  chemically synthesized
caacattgaggaaaacaatact

SEQ ID NO: 1008636 - DNA, 22 bp, Artificial Sequence
  chemically synthesized
cacaagtagtattgttttcctc

SEQ ID NO: 1008637 - DNA, 22 bp, Artificial Sequence
  chemically synthesized
cagaccaaaagtttcaacattg

SEQ ID NO: 1008638 - DNA, 22 bp, Artificial Sequence
  chemically synthesized
ttttcctcaatgttgaaacttt

SEQ ID NO: 1008639 - DNA, 22 bp, Artificial Sequence
  chemically synthesized
tcctcaatgttgaaacttttgg

SEQ ID NO: 1008640 - DNA, 22 bp, Artificial Sequence
  chemically synthesized
cctcaatgttgaaacttttggt

SEQ ID NO: 1008641 - DNA, 22 bp, Artificial Sequence
  chemically synthesized
ctcaatgttgaaacttttggtc

SEQ ID NO: 1008642 - DNA, 22 bp, Artificial Sequence
  chemically synthesized
aggacagtgctgcagaccaaaa

SEQ ID NO: 1008643 - DNA, 22 bp, Artificial Sequence
  chemically synthesized
aatgttgaaacttttggtctgc

SEQ ID NO: 1008644 - DNA, 22 bp, Artificial Sequence
  chemically synthesized
caggacagtgctgcagaccaaa

SEQ ID NO: 1008645 - DNA, 22 bp, Artificial Sequence
  chemically synthesized
agtttcaggacagtgctgcaga

SEQ ID NO: 1008646 - DNA, 22 bp, Artificial Sequence
  chemically synthesized
aagtttcaggacagtgctgcag

SEQ ID NO: 1008647 - DNA, 22 bp, Artificial Sequence
  chemically synthesized
aaacttttggtctgcagcactg

SEQ ID NO: 1008648 - DNA, 22 bp, Artificial Sequence
  chemically synthesized
ttaagtttcaggacagtgctgc

SEQ ID NO: 1008649 - DNA, 22 bp, Artificial Sequence
  chemically synthesized
cttaagtttcaggacagtgctg

SEQ ID NO: 1008650 - DNA, 22 bp, Artificial Sequence
  chemically synthesized
tcttaagtttcaggacagtgct

SEQ ID NO: 1008651 - DNA, 22 bp, Artificial Sequence
  chemically synthesized
ttggtctgcagcactgtcctga

SEQ ID NO: 1008652 - DNA, 22 bp, Artificial Sequence
  chemically synthesized
tggtctgcagcactgtcctgaa

SEQ ID NO: 1008653 - DNA, 22 bp, Artificial Sequence
  chemically synthesized
ggtctgcagcactgtcctgaaa

SEQ ID NO: 1008654 - DNA, 22 bp, Artificial Sequence
  chemically synthesized
gtctgcagcactgtcctgaaac

SEQ ID NO: 1008655 - DNA, 22 bp, Artificial Sequence
  chemically synthesized
aacatagttttcttaagtttca

SEQ ID NO: 1008656 - DNA, 22 bp, Artificial Sequence
  chemically synthesized
cagcactgtcctgaaacttaag

SEQ ID NO: 1008657 - DNA, 22 bp, Artificial Sequence
  chemically synthesized
attcaacatagttttcttaagt

SEQ ID NO: 1008658 - DNA, 22 bp, Artificial Sequence
  chemically synthesized
gctcattcaacatagttttctt

SEQ ID NO: 1008659 - DNA, 22 bp, Artificial Sequence
  chemically synthesized
tcctgaaacttaagaaaactat

SEQ ID NO: 1008660 - DNA, 22 bp, Artificial Sequence
  chemically synthesized
ggctcattcaacatagttttct

SEQ ID NO: 1008661 - DNA, 22 bp, Artificial Sequence
  chemically synthesized
tggctcattcaacatagttttc

SEQ ID NO: 1008662 - DNA, 22 bp, Artificial Sequence
  chemically synthesized
tttggctcattcaacatagttt

SEQ ID NO: 1008663 - DNA, 22 bp, Artificial Sequence
  chemically synthesized
ctttggctcattcaacatagtt

SEQ ID NO: 1008664 - DNA, 22 bp, Artificial Sequence
  chemically synthesized
aaacttaagaaaactatgttga

SEQ ID NO: 1008665 - DNA, 22 bp, Artificial Sequence
  chemically synthesized
aagaaaactatgttgaatgagc

SEQ ID NO: 1008666 - DNA, 22 bp, Artificial Sequence
  chemically synthesized
agaaaactatgttgaatgagcc

SEQ ID NO: 1008667 - DNA, 22 bp, Artificial Sequence
  chemically synthesized
aatatcagccttctttggctca

SEQ ID NO: 1008668 - DNA, 22 bp, Artificial Sequence
  chemically synthesized
cctgaatatcagccttctttgg

SEQ ID NO: 1008669 - DNA, 22 bp, Artificial Sequence
  chemically synthesized
tgttgaatgagccaaagaaggc

SEQ ID NO: 1008670 - DNA, 22 bp, Artificial Sequence
  chemically synthesized
ttccctgaatatcagccttctt

SEQ ID NO: 1008671 - DNA, 22 bp, Artificial Sequence
  chemically synthesized
aatgagccaaagaaggctgata

SEQ ID NO: 1008672 - DNA, 22 bp, Artificial Sequence
  chemically synthesized
ctgttccctgaatatcagcctt

SEQ ID NO: 1008673 - DNA, 22 bp, Artificial Sequence
  chemically synthesized
actgttccctgaatatcagcct

SEQ ID NO: 1008674 - DNA, 22 bp, Artificial Sequence
  chemically synthesized
aaatttactgttccctgaatat

SEQ ID NO: 1008675 - DNA, 22 bp, Artificial Sequence
  chemically synthesized
aaaatttactgttccctgaata

SEQ ID NO: 1008676 - DNA, 22 bp, Artificial Sequence
  chemically synthesized
cttaaaatttactgttccctga

SEQ ID NO: 1008677 - DNA, 22 bp, Artificial Sequence
  chemically synthesized
ccttaaaatttactgttccctg

SEQ ID NO: 1008678 - DNA, 22 bp, Artificial Sequence
  chemically synthesized
tccttaaaatttactgttccct

SEQ ID NO: 1008679 - DNA, 22 bp, Artificial Sequence
  chemically synthesized
ttccttaaaatttactgttccc

SEQ ID NO: 1008680 - DNA, 22 bp, Artificial Sequence
  chemically synthesized
cttttccttaaaatttactgtt

SEQ ID NO: 1008681 - DNA, 22 bp, Artificial Sequence
  chemically synthesized
atattcagggaacagtaaattt

SEQ ID NO: 1008682 - DNA, 22 bp, Artificial Sequence
  chemically synthesized
agggaacagtaaattttaagga

SEQ ID NO: 1008683 - DNA, 22 bp, Artificial Sequence
  chemically synthesized
caggcaaaactgcttttcctta

SEQ ID NO: 1008684 - DNA, 22 bp, Artificial Sequence
  chemically synthesized
cctacaggcaaaactgcttttc

SEQ ID NO: 1008685 - DNA, 22 bp, Artificial Sequence
  chemically synthesized
taaggaaaagcagttttgcctg

SEQ ID NO: 1008686 - DNA, 22 bp, Artificial Sequence
  chemically synthesized
aaggaaaagcagttttgcctgt

SEQ ID NO: 1008687 - DNA, 22 bp, Artificial Sequence
  chemically synthesized
aggaaaagcagttttgcctgta

SEQ ID NO: 1008688 - DNA, 22 bp, Artificial Sequence
  chemically synthesized
tgcctgtagggaaccatgtctt

SEQ ID NO: 1008689 - DNA, 22 bp, Artificial Sequence
  chemically synthesized
gcctgtagggaaccatgtctta

SEQ ID NO: 1008690 - DNA, 22 bp, Artificial Sequence
  chemically synthesized
cctgtagggaaccatgtcttat

SEQ ID NO: 1008691 - DNA, 22 bp, Artificial Sequence
  chemically synthesized
tagggaaccatgtcttatggtg

SEQ ID NO: 1008692 - DNA, 22 bp, Artificial Sequence
  chemically synthesized
aagagaaaagcccaccataaga

SEQ ID NO: 1008693 - DNA, 22 bp, Artificial Sequence
  chemically synthesized
agaataccctcaagagaaaagc

SEQ ID NO: 1008694 - DNA, 22 bp, Artificial Sequence
  chemically synthesized
cagaataccctcaagagaaaag

SEQ ID NO: 1008695 - DNA, 22 bp, Artificial Sequence
  chemically synthesized
tcagaataccctcaagagaaaa

SEQ ID NO: 1008696 - DNA, 22 bp, Artificial Sequence
  chemically synthesized
atggtgggcttttctcttgagg

SEQ ID NO: 1008697 - DNA, 22 bp, Artificial Sequence
  chemically synthesized
tggtgggcttttctcttgaggg

SEQ ID NO: 1008698 - DNA, 22 bp, Artificial Sequence
  chemically synthesized
cctttcagaataccctcaagag

SEQ ID NO: 1008699 - DNA, 22 bp, Artificial Sequence
  chemically synthesized
cctccctttcagaataccctca

SEQ ID NO: 1008700 - DNA, 22 bp, Artificial Sequence
  chemically synthesized
ttctcttgagggtattctgaaa

SEQ ID NO: 1008701 - DNA, 22 bp, Artificial Sequence
  chemically synthesized
tctcttgagggtattctgaaag

SEQ ID NO: 1008702 - DNA, 22 bp, Artificial Sequence
  chemically synthesized
gtaattgcctccctttcagaat

SEQ ID NO: 1008703 - DNA, 22 bp, Artificial Sequence
  chemically synthesized
ctcttgagggtattctgaaagg

SEQ ID NO: 1008704 - DNA, 22 bp, Artificial Sequence
  chemically synthesized
agtaattgcctccctttcagaa

SEQ ID NO: 1008705 - DNA, 22 bp, Artificial Sequence
  chemically synthesized
tcttgagggtattctgaaaggg

SEQ ID NO: 1008706 - DNA, 22 bp, Artificial Sequence
  chemically synthesized
ttgagggtattctgaaagggag

SEQ ID NO: 1008707 - DNA, 22 bp, Artificial Sequence
  chemically synthesized
gagggtattctgaaagggaggc

SEQ ID NO: 1008708 - DNA, 22 bp, Artificial Sequence
  chemically synthesized
agggtattctgaaagggaggca

SEQ ID NO: 1008709 - DNA, 22 bp, Artificial Sequence
  chemically synthesized
tgaaagggaggcaattactaaa

SEQ ID NO: 1008710 - DNA, 22 bp, Artificial Sequence
  chemically synthesized
aaagggaggcaattactaaatc

SEQ ID NO: 1008711 - DNA, 22 bp, Artificial Sequence
  chemically synthesized
aagatcatagccaaggatttag

SEQ ID NO: 1008712 - DNA, 22 bp, Artificial Sequence
  chemically synthesized
gaagatcatagccaaggattta

SEQ ID NO: 1008713 - DNA, 22 bp, Artificial Sequence
  chemically synthesized
tgaagatcatagccaaggattt

SEQ ID NO: 1008714 - DNA, 22 bp, Artificial Sequence
  chemically synthesized
ctaaatccttggctatgatctt

SEQ ID NO: 1008715 - DNA, 22 bp, Artificial Sequence
  chemically synthesized
aatccttggctatgatcttcaa

SEQ ID NO: 1008716 - DNA, 22 bp, Artificial Sequence
  chemically synthesized
cacagggcagaagccctttgaa

SEQ ID NO: 1008717 - DNA, 22 bp, Artificial Sequence
  chemically synthesized
ccacagggcagaagccctttga

SEQ ID NO: 1008718 - DNA, 22 bp, Artificial Sequence
  chemically synthesized
ggctatgatcttcaaagggctt

SEQ ID NO: 1008719 - DNA, 22 bp, Artificial Sequence
  chemically synthesized
gctatgatcttcaaagggcttc

SEQ ID NO: 1008720 - DNA, 22 bp, Artificial Sequence
  chemically synthesized
gtttccacagggcagaagccct

SEQ ID NO: 1008721 - DNA, 22 bp, Artificial Sequence
  chemically synthesized
ggtttccacagggcagaagccc

SEQ ID NO: 1008722 - DNA, 22 bp, Artificial Sequence
  chemically synthesized
tgatcttcaaagggcttctgcc

SEQ ID NO: 1008723 - DNA, 22 bp, Artificial Sequence
  chemically synthesized
ttggtttccacagggcagaagc

SEQ ID NO: 1008724 - DNA, 22 bp, Artificial Sequence
  chemically synthesized
caaagggcttctgccctgtgga

SEQ ID NO: 1008725 - DNA, 22 bp, Artificial Sequence
  chemically synthesized
aaagggcttctgccctgtggaa

SEQ ID NO: 1008726 - DNA, 22 bp, Artificial Sequence
  chemically synthesized
agaaagcctcttggtttccaca

SEQ ID NO: 1008727 - DNA, 22 bp, Artificial Sequence
  chemically synthesized
taagaaagcctcttggtttcca

SEQ ID NO: 1008728 - DNA, 22 bp, Artificial Sequence
  chemically synthesized
ctgccctgtggaaaccaagagg

SEQ ID NO: 1008729 - DNA, 22 bp, Artificial Sequence
  chemically synthesized
tgccctgtggaaaccaagaggc

SEQ ID NO: 1008730 - DNA, 22 bp, Artificial Sequence
  chemically synthesized
ccctgtggaaaccaagaggctt

SEQ ID NO: 1008731 - DNA, 22 bp, Artificial Sequence
  chemically synthesized
atggtctctaagaaagcctctt

SEQ ID NO: 1008732 - DNA, 22 bp, Artificial Sequence
  chemically synthesized
tggaaaccaagaggctttctta

SEQ ID NO: 1008733 - DNA, 22 bp, Artificial Sequence
  chemically synthesized
tgtatggcaagggctgatggtc

SEQ ID NO: 1008734 - DNA, 22 bp, Artificial Sequence
  chemically synthesized
tcttagagaccatcagcccttg

SEQ ID NO: 1008735 - DNA, 22 bp, Artificial Sequence
  chemically synthesized
gattgtgtatggcaagggctga

SEQ ID NO: 1008736 - DNA, 22 bp, Artificial Sequence
  chemically synthesized
cttagagaccatcagcccttgc

SEQ ID NO: 1008737 - DNA, 22 bp, Artificial Sequence
  chemically synthesized
ttagagaccatcagcccttgcc

SEQ ID NO: 1008738 - DNA, 22 bp, Artificial Sequence
  chemically synthesized
agagaccatcagcccttgccat

SEQ ID NO: 1008739 - DNA, 22 bp, Artificial Sequence
  chemically synthesized
gagaccatcagcccttgccata

SEQ ID NO: 1008740 - DNA, 22 bp, Artificial Sequence
  chemically synthesized
gccatacacaatccaatgctca

SEQ ID NO: 1008741 - DNA, 22 bp, Artificial Sequence
  chemically synthesized
ccatacacaatccaatgctcat

SEQ ID NO: 1008742 - DNA, 22 bp, Artificial Sequence
  chemically synthesized
tcaaatggaggacatgagcatt

SEQ ID NO: 1008743 - DNA, 22 bp, Artificial Sequence
  chemically synthesized
gcaagcggctgtcaaatggagg

SEQ ID NO: 1008744 - DNA, 22 bp, Artificial Sequence
  chemically synthesized
agcaagcggctgtcaaatggag

SEQ ID NO: 1008745 - DNA, 22 bp, Artificial Sequence
  chemically synthesized
atgtcctccatttgacagccgc

SEQ ID NO: 1008746 - DNA, 22 bp, Artificial Sequence
  chemically synthesized
catttgacagccgcttgctaaa

SEQ ID NO: 1008747 - DNA, 22 bp, Artificial Sequence
  chemically synthesized
aggtgacggaggaatttagcaa

SEQ ID NO: 1008748 - DNA, 22 bp, Artificial Sequence
  chemically synthesized
gacagccgcttgctaaattcct

SEQ ID NO: 1008749 - DNA, 22 bp, Artificial Sequence
  chemically synthesized
ctgaggtgacggaggaatttag

SEQ ID NO: 1008750 - DNA, 22 bp, Artificial Sequence
  chemically synthesized
acagccgcttgctaaattcctc

SEQ ID NO: 1008751 - DNA, 22 bp, Artificial Sequence
  chemically synthesized
gctaaattcctccgtcacctca

SEQ ID NO: 1008752 - DNA, 22 bp, Artificial Sequence
  chemically synthesized
ctaaattcctccgtcacctcag

SEQ ID NO: 1008753 - DNA, 22 bp, Artificial Sequence
  chemically synthesized
agacataggttactgaggtgac

SEQ ID NO: 1008754 - DNA, 22 bp, Artificial Sequence
  chemically synthesized
taagacataggttactgaggtg

SEQ ID NO: 1008755 - DNA, 22 bp, Artificial Sequence
  chemically synthesized
aattcctccgtcacctcagtaa

SEQ ID NO: 1008756 - DNA, 22 bp, Artificial Sequence
  chemically synthesized
ctccgtcacctcagtaacctat

SEQ ID NO: 1008757 - DNA, 22 bp, Artificial Sequence
  chemically synthesized
tatcactctaagacataggtta

SEQ ID NO: 1008758 - DNA, 22 bp, Artificial Sequence
  chemically synthesized
cgtcacctcagtaacctatgtc

SEQ ID NO: 1008759 - DNA, 22 bp, Artificial Sequence
  chemically synthesized
tatatcactctaagacataggt

SEQ ID NO: 1008760 - DNA, 22 bp, Artificial Sequence
  chemically synthesized
agtaacctatgtcttagagtga

SEQ ID NO: 1008761 - DNA, 22 bp, Artificial Sequence
  chemically synthesized
gcggattctatatcactctaag

SEQ ID NO: 1008762 - DNA, 22 bp, Artificial Sequence
  chemically synthesized
ggcggattctatatcactctaa

SEQ ID NO: 1008763 - DNA, 22 bp, Artificial Sequence
  chemically synthesized
tgtcttagagtgatatagaatc

SEQ ID NO: 1008764 - DNA, 22 bp, Artificial Sequence
  chemically synthesized
atatatagatttggcggattct

SEQ ID NO: 1008765 - DNA, 22 bp, Artificial Sequence
  chemically synthesized
gatatatagatttggcggattc

SEQ ID NO: 1008766 - DNA, 22 bp, Artificial Sequence
  chemically synthesized
agagtgatatagaatccgccaa

SEQ ID NO: 1008767 - DNA, 22 bp, Artificial Sequence
  chemically synthesized
gagtgatatagaatccgccaaa

SEQ ID NO: 1008768 - DNA, 22 bp, Artificial Sequence
  chemically synthesized
tttgatatatagatttggcgga

SEQ ID NO: 1008769 - DNA, 22 bp, Artificial Sequence
  chemically synthesized
tgtttgatatatagatttggcg

SEQ ID NO: 1008770 - DNA, 22 bp, Artificial Sequence
  chemically synthesized
atggtaatctctgtttgatata

SEQ ID NO: 1008771 - DNA, 22 bp, Artificial Sequence
  chemically synthesized
tcatggtaatctctgtttgata

SEQ ID NO: 1008772 - DNA, 22 bp, Artificial Sequence
  chemically synthesized
ctctcatggtaatctctgtttg

SEQ ID NO: 1008773 - DNA, 22 bp, Artificial Sequence
  chemically synthesized
ttactctcatggtaatctctgt

SEQ ID NO: 1008774 - DNA, 22 bp, Artificial Sequence
  chemically synthesized
tatatcaaacagagattaccat

SEQ ID NO: 1008775 - DNA, 22 bp, Artificial Sequence
  chemically synthesized
cattgttactctcatggtaatc

SEQ ID NO: 1008776 - DNA, 22 bp, Artificial Sequence
  chemically synthesized
aattacattgttactctcatgg

SEQ ID NO: 1008777 - DNA, 22 bp, Artificial Sequence
  chemically synthesized
caattacattgttactctcatg

SEQ ID NO: 1008778 - DNA, 22 bp, Artificial Sequence
  chemically synthesized
ccatgagagtaacaatgtaatt

SEQ ID NO: 1008779 - DNA, 22 bp, Artificial Sequence
  chemically synthesized
agaagtgccttcaattacattg

SEQ ID NO: 1008780 - DNA, 22 bp, Artificial Sequence
  chemically synthesized
aagaagtgccttcaattacatt

SEQ ID NO: 1008781 - DNA, 22 bp, Artificial Sequence
  chemically synthesized
ataatttaagaagtgccttcaa

SEQ ID NO: 1008782 - DNA, 22 bp, Artificial Sequence
  chemically synthesized
cataatttaagaagtgccttca

SEQ ID NO: 1008783 - DNA, 22 bp, Artificial Sequence
  chemically synthesized
aaggcacttcttaaattatgaa

SEQ ID NO: 1008784 - DNA, 22 bp, Artificial Sequence
  chemically synthesized
cttaaattatgaagtgctttgt

SEQ ID NO: 1008785 - DNA, 22 bp, Artificial Sequence
  chemically synthesized
ttaaattatgaagtgctttgtt

SEQ ID NO: 1008786 - DNA, 22 bp, Artificial Sequence
  chemically synthesized
aaattatgaagtgctttgttat

SEQ ID NO: 1008787 - DNA, 22 bp, Artificial Sequence
  chemically synthesized
aattatgaagtgctttgttatg

SEQ ID NO: 1008788 - DNA, 22 bp, Artificial Sequence
  chemically synthesized
tgaagtgctttgttatgttatg

SEQ ID NO: 1008789 - DNA, 22 bp, Artificial Sequence
  chemically synthesized
atgataataacagtagtcataa

SEQ ID NO: 1008790 - DNA, 22 bp, Artificial Sequence
  chemically synthesized
ttgatgataataacagtagtca

SEQ ID NO: 1008791 - DNA, 22 bp, Artificial Sequence
  chemically synthesized
tgttatgttatgactactgtta

SEQ ID NO: 1008792 - DNA, 22 bp, Artificial Sequence
  chemically synthesized
gttatgttatgactactgttat

SEQ ID NO: 1008793 - DNA, 22 bp, Artificial Sequence
  chemically synthesized
ttatgttatgactactgttatt

SEQ ID NO: 1008794 - DNA, 22 bp, Artificial Sequence
  chemically synthesized
gggttgttgatgataataacag

SEQ ID NO: 1008795 - DNA, 22 bp, Artificial Sequence
  chemically synthesized
tgttatgactactgttattatc

SEQ ID NO: 1008796 - DNA, 22 bp, Artificial Sequence
  chemically synthesized
tgactactgttattatcatcaa

SEQ ID NO: 1008797 - DNA, 22 bp, Artificial Sequence
  chemically synthesized
ctgttattatcatcaacaaccc

SEQ ID NO: 1008798 - DNA, 22 bp, Artificial Sequence
  chemically synthesized
gagatgatgttagggttgttga

SEQ ID NO: 1008799 - DNA, 22 bp, Artificial Sequence
  chemically synthesized
ttattatcatcaacaaccctaa

SEQ ID NO: 1008800 - DNA, 22 bp, Artificial Sequence
  chemically synthesized
ttagagatgatgttagggttgt

SEQ ID NO: 1008801 - DNA, 22 bp, Artificial Sequence
  chemically synthesized
ttatcatcaacaaccctaacat

SEQ ID NO: 1008802 - DNA, 22 bp, Artificial Sequence
  chemically synthesized
ttattagagatgatgttagggt

SEQ ID NO: 1008803 - DNA, 22 bp, Artificial Sequence
  chemically synthesized
tcatcaacaaccctaacatcat

SEQ ID NO: 1008804 - DNA, 22 bp, Artificial Sequence
  chemically synthesized
aaaggagttgttattagagatg

SEQ ID NO: 1008805 - DNA, 22 bp, Artificial Sequence
  chemically synthesized
acatcatctctaataacaactc

SEQ ID NO: 1008806 - DNA, 22 bp, Artificial Sequence
  chemically synthesized
aaagaaggatgttaaaaggagt

SEQ ID NO: 1008807 - DNA, 22 bp, Artificial Sequence
  chemically synthesized
taataacaactccttttaacat

SEQ ID NO: 1008808 - DNA, 22 bp, Artificial Sequence
  chemically synthesized
ataacaactccttttaacatcc

SEQ ID NO: 1008809 - DNA, 22 bp, Artificial Sequence
  chemically synthesized
acccatagtgtattaaaagaag

SEQ ID NO: 1008810 - DNA, 22 bp, Artificial Sequence
  chemically synthesized
cttttaacatccttcttttaat

SEQ ID NO: 1008811 - DNA, 22 bp, Artificial Sequence
  chemically synthesized
gacccatagtgtattaaaagaa

SEQ ID NO: 1008812 - DNA, 22 bp, Artificial Sequence
  chemically synthesized
ttaacatccttcttttaataca

SEQ ID NO: 1008813 - DNA, 22 bp, Artificial Sequence
  chemically synthesized
taacatccttcttttaatacac

SEQ ID NO: 1008814 - DNA, 22 bp, Artificial Sequence
  chemically synthesized
aacatccttcttttaatacact

SEQ ID NO: 1008815 - DNA, 22 bp, Artificial Sequence
  chemically synthesized
acatccttcttttaatacacta

SEQ ID NO: 1008816 - DNA, 22 bp, Artificial Sequence
  chemically synthesized
taatttgacccatagtgtatta

SEQ ID NO: 1008817 - DNA, 22 bp, Artificial Sequence
  chemically synthesized
cttttaatacactatgggtcaa

SEQ ID NO: 1008818 - DNA, 22 bp, Artificial Sequence
  chemically synthesized
ttttaatacactatgggtcaaa

SEQ ID NO: 1008819 - DNA, 22 bp, Artificial Sequence
  chemically synthesized
atataattataatttgacccat

SEQ ID NO: 1008820 - DNA, 22 bp, Artificial Sequence
  chemically synthesized
ttaatacactatgggtcaaatt

SEQ ID NO: 1008821 - DNA, 22 bp, Artificial Sequence
  chemically synthesized
taatacactatgggtcaaatta

SEQ ID NO: 1008822 - DNA, 22 bp, Artificial Sequence
  chemically synthesized
ttaatataattataatttgacc

SEQ ID NO: 1008823 - DNA, 22 bp, Artificial Sequence
  chemically synthesized
aatacactatgggtcaaattat

SEQ ID NO: 1008824 - DNA, 22 bp, Artificial Sequence
  chemically synthesized
attaatataattataatttgac

SEQ ID NO: 1008825 - DNA, 22 bp, Artificial Sequence
  chemically synthesized
atacactatgggtcaaattata

SEQ ID NO: 1008826 - DNA, 22 bp, Artificial Sequence
  chemically synthesized
tgggtcaaattataattatatt

SEQ ID NO: 1008827 - DNA, 22 bp, Artificial Sequence
  chemically synthesized
agacataacatatttattaata

SEQ ID NO: 1008828 - DNA, 22 bp, Artificial Sequence
  chemically synthesized
taattatattaataaatatgtt

SEQ ID NO: 1008829 - DNA, 22 bp, Artificial Sequence
  chemically synthesized
tattaataaatatgttatgtct

SEQ ID NO: 1008830 - DNA, 22 bp, Artificial Sequence
  chemically synthesized
tcatcagtaaagttgagacata

SEQ ID NO: 1008831 - DNA, 22 bp, Artificial Sequence
  chemically synthesized
ataaatatgttatgtctcaact

SEQ ID NO: 1008832 - DNA, 22 bp, Artificial Sequence
  chemically synthesized
tattgtcatcagtaaagttgag

SEQ ID NO: 1008833 - DNA, 22 bp, Artificial Sequence
  chemically synthesized
atattgtcatcagtaaagttga

SEQ ID NO: 1008834 - DNA, 22 bp, Artificial Sequence
  chemically synthesized
tatattgtcatcagtaaagttg

SEQ ID NO: 1008835 - DNA, 22 bp, Artificial Sequence
  chemically synthesized
ttttatattgtcatcagtaaag

SEQ ID NO: 1008836 - DNA, 22 bp, Artificial Sequence
  chemically synthesized
attttatattgtcatcagtaaa

SEQ ID NO: 1008837 - DNA, 22 bp, Artificial Sequence
  chemically synthesized
tgtctcaactttactgatgaca

SEQ ID NO: 1008838 - DNA, 22 bp, Artificial Sequence
  chemically synthesized
aacttattttatattgtcatca

SEQ ID NO: 1008839 - DNA, 22 bp, Artificial Sequence
  chemically synthesized
aactttactgatgacaatataa

SEQ ID NO: 1008840 - DNA, 22 bp, Artificial Sequence
  chemically synthesized
attaaacttattttatattgtc

SEQ ID NO: 1008841 - DNA, 22 bp, Artificial Sequence
  chemically synthesized
taattaaacttattttatattg

SEQ ID NO: 1008842 - DNA, 22 bp, Artificial Sequence
  chemically synthesized
tactgatgacaatataaaataa

SEQ ID NO: 1008843 - DNA, 22 bp, Artificial Sequence
  chemically synthesized
actgatgacaatataaaataag

SEQ ID NO: 1008844 - DNA, 22 bp, Artificial Sequence
  chemically synthesized
ctgatgacaatataaaataagt

SEQ ID NO: 1008845 - DNA, 22 bp, Artificial Sequence
  chemically synthesized
atgacaatataaaataagttta

SEQ ID NO: 1008846 - DNA, 22 bp, Artificial Sequence
  chemically synthesized
tgagtagagctctaattaaact

SEQ ID NO: 1008847 - DNA, 22 bp, Artificial Sequence
  chemically synthesized
gttatgagtagagctctaatta

SEQ ID NO: 1008848 - DNA, 22 bp, Artificial Sequence
  chemically synthesized
agttatgagtagagctctaatt

SEQ ID NO: 1008849 - DNA, 22 bp, Artificial Sequence
  chemically synthesized
tttagttatgagtagagctcta

SEQ ID NO: 1008850 - DNA, 22 bp, Artificial Sequence
  chemically synthesized
aattagagctctactcataact

SEQ ID NO: 1008851 - DNA, 22 bp, Artificial Sequence
  chemically synthesized
attagagctctactcataacta

SEQ ID NO: 1008852 - DNA, 22 bp, Artificial Sequence
  chemically synthesized
ataaaaatgttatttagttatg

SEQ ID NO: 1008853 - DNA, 22 bp, Artificial Sequence
  chemically synthesized
gagctctactcataactaaata

SEQ ID NO: 1008854 - DNA, 22 bp, Artificial Sequence
  chemically synthesized
ttcataaaaatgttatttagtt

SEQ ID NO: 1008855 - DNA, 22 bp, Artificial Sequence
  chemically synthesized
attcataaaaatgttatttagt

SEQ ID NO: 1008856 - DNA, 22 bp, Artificial Sequence
  chemically synthesized
tattcataaaaatgttatttag

SEQ ID NO: 1008857 - DNA, 22 bp, Artificial Sequence
  chemically synthesized
ttattcataaaaatgttattta

SEQ ID NO: 1008858 - DNA, 22 bp, Artificial Sequence
  chemically synthesized
tactcataactaaataacattt

SEQ ID NO: 1008859 - DNA, 22 bp, Artificial Sequence
  chemically synthesized
ttttattcataaaaatgttatt

SEQ ID NO: 1008860 - DNA, 22 bp, Artificial Sequence
  chemically synthesized
cttttattcataaaaatgttat

SEQ ID NO: 1008861 - DNA, 22 bp, Artificial Sequence
  chemically synthesized
ctcataactaaataacattttt

SEQ ID NO: 1008862 - DNA, 22 bp, Artificial Sequence
  chemically synthesized
ataactaaataacatttttatg

SEQ ID NO: 1008863 - DNA, 22 bp, Artificial Sequence
  chemically synthesized
aataacatttttatgaataaaa

SEQ ID NO: 1008864 - DNA, 22 bp, Artificial Sequence
  chemically synthesized
agtgatgaagatgaaacttctt

SEQ ID NO: 1008865 - DNA, 22 bp, Artificial Sequence
  chemically synthesized
ttatgaataaaagaagtttcat

SEQ ID NO: 1008866 - DNA, 22 bp, Artificial Sequence
  chemically synthesized
tatgaataaaagaagtttcatc

SEQ ID NO: 1008867 - DNA, 22 bp, Artificial Sequence
  chemically synthesized
atgaataaaagaagtttcatct

SEQ ID NO: 1008868 - DNA, 22 bp, Artificial Sequence
  chemically synthesized
tgaataaaagaagtttcatctt

SEQ ID NO: 1008869 - DNA, 22 bp, Artificial Sequence
  chemically synthesized
aatatattaagtgatgaagatg

SEQ ID NO: 1008870 - DNA, 22 bp, Artificial Sequence
  chemically synthesized
aaatatattaagtgatgaagat

SEQ ID NO: 1008871 - DNA, 22 bp, Artificial Sequence
  chemically synthesized
agagaccttaaatatattaagt

SEQ ID NO: 1008872 - DNA, 22 bp, Artificial Sequence
  chemically synthesized
catcttcatcacttaatatatt

SEQ ID NO: 1008873 - DNA, 22 bp, Artificial Sequence
  chemically synthesized
atcttcatcacttaatatattt

SEQ ID NO: 1008874 - DNA, 22 bp, Artificial Sequence
  chemically synthesized
ctaagagaccttaaatatatta

SEQ ID NO: 1008875 - DNA, 22 bp, Artificial Sequence
  chemically synthesized
cctaagagaccttaaatatatt

SEQ ID NO: 1008876 - DNA, 22 bp, Artificial Sequence
  chemically synthesized
catcacttaatatatttaaggt

SEQ ID NO: 1008877 - DNA, 22 bp, Artificial Sequence
  chemically synthesized
atcacttaatatatttaaggtc

SEQ ID NO: 1008878 - DNA, 22 bp, Artificial Sequence
  chemically synthesized
aatatatttaaggtctcttagg

SEQ ID NO: 1008879 - DNA, 22 bp, Artificial Sequence
  chemically synthesized
atatatttaaggtctcttagga

SEQ ID NO: 1008880 - DNA, 22 bp, Artificial Sequence
  chemically synthesized
caggacaaggtcttcctaagag

SEQ ID NO: 1008881 - DNA, 22 bp, Artificial Sequence
  chemically synthesized
actacaggacaaggtcttccta

SEQ ID NO: 1008882 - DNA, 22 bp, Artificial Sequence
  chemically synthesized
aaggtctcttaggaagaccttg

SEQ ID NO: 1008883 - DNA, 22 bp, Artificial Sequence
  chemically synthesized
aggtctcttaggaagaccttgt

SEQ ID NO: 1008884 - DNA, 22 bp, Artificial Sequence
  chemically synthesized
ttaggaagaccttgtcctgtag

SEQ ID NO: 1008885 - DNA, 22 bp, Artificial Sequence
  chemically synthesized
aggaagaccttgtcctgtagtc

SEQ ID NO: 1008886 - DNA, 22 bp, Artificial Sequence
  chemically synthesized
ggaagaccttgtcctgtagtca

SEQ ID NO: 1008887 - DNA, 22 bp, Artificial Sequence
  chemically synthesized
ataaaaagaataataccactga

SEQ ID NO: 1008888 - DNA, 22 bp, Artificial Sequence
  chemically synthesized
gtcctgtagtcagtggtattat

SEQ ID NO: 1008889 - DNA, 22 bp, Artificial Sequence
  chemically synthesized
tcctgtagtcagtggtattatt

SEQ ID NO: 1008890 - DNA, 22 bp, Artificial Sequence
  chemically synthesized
tagtcagtggtattattctttt

SEQ ID NO: 1008891 - DNA, 22 bp, Artificial Sequence
  chemically synthesized
aggaaactaataaaaagaataa

SEQ ID NO: 1008892 - DNA, 22 bp, Artificial Sequence
  chemically synthesized
gaggaaactaataaaaagaata

SEQ ID NO: 1008893 - DNA, 22 bp, Artificial Sequence
  chemically synthesized
ataaatcttgaggaaactaata

SEQ ID NO: 1008894 - DNA, 22 bp, Artificial Sequence
  chemically synthesized
cctaataaatcttgaggaaact

SEQ ID NO: 1008895 - DNA, 22 bp, Artificial Sequence
  chemically synthesized
ttctttttattagtttcctcaa

SEQ ID NO: 1008896 - DNA, 22 bp, Artificial Sequence
  chemically synthesized
tgcctaataaatcttgaggaaa

SEQ ID NO: 1008897 - DNA, 22 bp, Artificial Sequence
  chemically synthesized
tttttattagtttcctcaagat

SEQ ID NO: 1008898 - DNA, 22 bp, Artificial Sequence
  chemically synthesized
ctctgcctaataaatcttgagg

SEQ ID NO: 1008899 - DNA, 22 bp, Artificial Sequence
  chemically synthesized
tttattagtttcctcaagattt

SEQ ID NO: 1008900 - DNA, 22 bp, Artificial Sequence
  chemically synthesized
ttattagtttcctcaagattta

SEQ ID NO: 1008901 - DNA, 22 bp, Artificial Sequence
  chemically synthesized
tattagtttcctcaagatttat

SEQ ID NO: 1008902 - DNA, 22 bp, Artificial Sequence
  chemically synthesized
attagtttcctcaagatttatt

SEQ ID NO: 1008903 - DNA, 22 bp, Artificial Sequence
  chemically synthesized
ttagtttcctcaagatttatta

SEQ ID NO: 1008904 - DNA, 22 bp, Artificial Sequence
  chemically synthesized
gtttcctcaagatttattaggc

SEQ ID NO: 1008905 - DNA, 22 bp, Artificial Sequence
  chemically synthesized
agtcactgctctgcctaataaa

SEQ ID NO: 1008906 - DNA, 22 bp, Artificial Sequence
  chemically synthesized
cctcaagatttattaggcagag

SEQ ID NO: 1008907 - DNA, 22 bp, Artificial Sequence
  chemically synthesized
ctcaagatttattaggcagagc

SEQ ID NO: 1008908 - DNA, 22 bp, Artificial Sequence
  chemically synthesized
aagatttattaggcagagcagt

SEQ ID NO: 1008909 - DNA, 22 bp, Artificial Sequence
  chemically synthesized
agccaaaaacattaagtcactg

SEQ ID NO: 1008910 - DNA, 22 bp, Artificial Sequence
  chemically synthesized
attaggcagagcagtgacttaa

SEQ ID NO: 1008911 - DNA, 22 bp, Artificial Sequence
  chemically synthesized
ttaggcagagcagtgacttaat

SEQ ID NO: 1008912 - DNA, 22 bp, Artificial Sequence
  chemically synthesized
ggcagagcagtgacttaatgtt

SEQ ID NO: 1008913 - DNA, 22 bp, Artificial Sequence
  chemically synthesized
gaaatgttaagccaaaaacatt

SEQ ID NO: 1008914 - DNA, 22 bp, Artificial Sequence
  chemically synthesized
gaagttagaaatgttaagccaa

SEQ ID NO: 1008915 - DNA, 22 bp, Artificial Sequence
  chemically synthesized
aatgtttttggcttaacatttc

SEQ ID NO: 1008916 - DNA, 22 bp, Artificial Sequence
  chemically synthesized
atgtttttggcttaacatttct

SEQ ID NO: 1008917 - DNA, 22 bp, Artificial Sequence
  chemically synthesized
atcagctagaagttagaaatgt

SEQ ID NO: 1008918 - DNA, 22 bp, Artificial Sequence
  chemically synthesized
ttcatcagctagaagttagaaa

SEQ ID NO: 1008919 - DNA, 22 bp, Artificial Sequence
  chemically synthesized
ttggcttaacatttctaacttc

SEQ ID NO: 1008920 - DNA, 22 bp, Artificial Sequence
  chemically synthesized
tggcttaacatttctaacttct

SEQ ID NO: 1008921 - DNA, 22 bp, Artificial Sequence
  chemically synthesized
ggcttaacatttctaacttcta

SEQ ID NO: 1008922 - DNA, 22 bp, Artificial Sequence
  chemically synthesized
ctgttcatcagctagaagttag

SEQ ID NO: 1008923 - DNA, 22 bp, Artificial Sequence
  chemically synthesized
gcttaacatttctaacttctag

SEQ ID NO: 1008924 - DNA, 22 bp, Artificial Sequence
  chemically synthesized
actgttcatcagctagaagtta

SEQ ID NO: 1008925 - DNA, 22 bp, Artificial Sequence
  chemically synthesized
tactgttcatcagctagaagtt

SEQ ID NO: 1008926 - DNA, 22 bp, Artificial Sequence
  chemically synthesized
ttactgttcatcagctagaagt

SEQ ID NO: 1008927 - DNA, 22 bp, Artificial Sequence
  chemically synthesized
tttactgttcatcagctagaag

SEQ ID NO: 1008928 - DNA, 22 bp, Artificial Sequence
  chemically synthesized
aacatttctaacttctagctga

SEQ ID NO: 1008929 - DNA, 22 bp, Artificial Sequence
  chemically synthesized
ttttactgttcatcagctagaa

SEQ ID NO: 1008930 - DNA, 22 bp, Artificial Sequence
  chemically synthesized
acatttctaacttctagctgat

SEQ ID NO: 1008931 - DNA, 22 bp, Artificial Sequence
  chemically synthesized
tttttactgttcatcagctaga

SEQ ID NO: 1008932 - DNA, 22 bp, Artificial Sequence
  chemically synthesized
ctaacttctagctgatgaacag

SEQ ID NO: 1008933 - DNA, 22 bp, Artificial Sequence
  chemically synthesized
taacttctagctgatgaacagt

SEQ ID NO: 1008934 - DNA, 22 bp, Artificial Sequence
  chemically synthesized
acttctagctgatgaacagtaa

SEQ ID NO: 1008935 - DNA, 22 bp, Artificial Sequence
  chemically synthesized
ctagctgatgaacagtaaaaaa

SEQ ID NO: 1008936 - DNA, 22 bp, Artificial Sequence
  chemically synthesized
aaacaccatattttttttactg

SEQ ID NO: 1008937 - DNA, 22 bp, Artificial Sequence
  chemically synthesized
tagctgatgaacagtaaaaaaa

SEQ ID NO: 1008938 - DNA, 22 bp, Artificial Sequence
  chemically synthesized
gctgatgaacagtaaaaaaaat

SEQ ID NO: 1008939 - DNA, 22 bp, Artificial Sequence
  chemically synthesized
ggattcaaacaccatatttttt

SEQ ID NO: 1008940 - DNA, 22 bp, Artificial Sequence
  chemically synthesized
atgaacagtaaaaaaaatatgg

SEQ ID NO: 1008941 - DNA, 22 bp, Artificial Sequence
  chemically synthesized
ataaatgaagaatctgggattc

SEQ ID NO: 1008942 - DNA, 22 bp, Artificial Sequence
  chemically synthesized
gaatcccagattcttcatttat

SEQ ID NO: 1008943 - DNA, 22 bp, Artificial Sequence
  chemically synthesized
aatcccagattcttcatttatt

SEQ ID NO: 1008944 - DNA, 22 bp, Artificial Sequence
  chemically synthesized
tcccaaatcataaagctaataa

SEQ ID NO: 1008945 - DNA, 22 bp, Artificial Sequence
  chemically synthesized
atcccaaatcataaagctaata

SEQ ID NO: 1008946 - DNA, 22 bp, Artificial Sequence
  chemically synthesized
tatcccaaatcataaagctaat

SEQ ID NO: 1008947 - DNA, 22 bp, Artificial Sequence
  chemically synthesized
ttcatttattagctttatgatt

SEQ ID NO: 1008948 - DNA, 22 bp, Artificial Sequence
  chemically synthesized
catttattagctttatgatttg

SEQ ID NO: 1008949 - DNA, 22 bp, Artificial Sequence
  chemically synthesized
aacgctttatcccaaatcataa

SEQ ID NO: 1008950 - DNA, 22 bp, Artificial Sequence
  chemically synthesized
atttattagctttatgatttgg

SEQ ID NO: 1008951 - DNA, 22 bp, Artificial Sequence
  chemically synthesized
aaacgctttatcccaaatcata

SEQ ID NO: 1008952 - DNA, 22 bp, Artificial Sequence
  chemically synthesized
attagctttatgatttgggata

SEQ ID NO: 1008953 - DNA, 22 bp, Artificial Sequence
  chemically synthesized
ttagctttatgatttgggataa

SEQ ID NO: 1008954 - DNA, 22 bp, Artificial Sequence
  chemically synthesized
gctttatgatttgggataaagc

SEQ ID NO: 1008955 - DNA, 22 bp, Artificial Sequence
  chemically synthesized
ggaaagtttaaacgctttatcc

SEQ ID NO: 1008956 - DNA, 22 bp, Artificial Sequence
  chemically synthesized
cggaaagtttaaacgctttatc

SEQ ID NO: 1008957 - DNA, 22 bp, Artificial Sequence
  chemically synthesized
tatgatttgggataaagcgttt

SEQ ID NO: 1008958 - DNA, 22 bp, Artificial Sequence
  chemically synthesized
atgatttgggataaagcgttta

SEQ ID NO: 1008959 - DNA, 22 bp, Artificial Sequence
  chemically synthesized
tgatttgggataaagcgtttaa

SEQ ID NO: 1008960 - DNA, 22 bp, Artificial Sequence
  chemically synthesized
gggataaagcgtttaaactttc

SEQ ID NO: 1008961 - DNA, 22 bp, Artificial Sequence
  chemically synthesized
ggataaagcgtttaaactttcc

SEQ ID NO: 1008962 - DNA, 22 bp, Artificial Sequence
  chemically synthesized
gacaaaaatttcggaaagttta

SEQ ID NO: 1008963 - DNA, 22 bp, Artificial Sequence
  chemically synthesized
agacaaaaatttcggaaagttt

SEQ ID NO: 1008964 - DNA, 22 bp, Artificial Sequence
  chemically synthesized
ttagacaaaaatttcggaaagt

SEQ ID NO: 1008965 - DNA, 22 bp, Artificial Sequence
  chemically synthesized
taactcttagacaaaaatttcg

SEQ ID NO: 1008966 - DNA, 22 bp, Artificial Sequence
  chemically synthesized
ataactcttagacaaaaatttc

SEQ ID NO: 1008967 - DNA, 22 bp, Artificial Sequence
  chemically synthesized
ttataactcttagacaaaaatt

SEQ ID NO: 1008968 - DNA, 22 bp, Artificial Sequence
  chemically synthesized
aaactttccgaaatttttgtct

SEQ ID NO: 1008969 - DNA, 22 bp, Artificial Sequence
  chemically synthesized
aactttccgaaatttttgtcta

SEQ ID NO: 1008970 - DNA, 22 bp, Artificial Sequence
  chemically synthesized
tccgaaatttttgtctaagagt

SEQ ID NO: 1008971 - DNA, 22 bp, Artificial Sequence
  chemically synthesized
ccgaaatttttgtctaagagtt

SEQ ID NO: 1008972 - DNA, 22 bp, Artificial Sequence
  chemically synthesized
cgaaatttttgtctaagagtta

SEQ ID NO: 1008973 - DNA, 22 bp, Artificial Sequence
  chemically synthesized
ttgtctaagagttataagaata

SEQ ID NO: 1008974 - DNA, 22 bp, Artificial Sequence
  chemically synthesized
tgtctaagagttataagaatac

SEQ ID NO: 1008975 - DNA, 22 bp, Artificial Sequence
  chemically synthesized
gtctaagagttataagaatacc

SEQ ID NO: 1008976 - DNA, 22 bp, Artificial Sequence
  chemically synthesized
tctaagagttataagaatacct

SEQ ID NO: 1008977 - DNA, 22 bp, Artificial Sequence
  chemically synthesized
agagttataagaataccttttc

SEQ ID NO: 1008978 - DNA, 22 bp, Artificial Sequence
  chemically synthesized
ccagcaagataggtagaaaagg

SEQ ID NO: 1008979 - DNA, 22 bp, Artificial Sequence
  chemically synthesized
taagaataccttttctacctat

SEQ ID NO: 1008980 - DNA, 22 bp, Artificial Sequence
  chemically synthesized
aaatactcccagcaagataggt

SEQ ID NO: 1008981 - DNA, 22 bp, Artificial Sequence
  chemically synthesized
gaaatactcccagcaagatagg

SEQ ID NO: 1008982 - DNA, 22 bp, Artificial Sequence
  chemically synthesized
tgaaatactcccagcaagatag

SEQ ID NO: 1008983 - DNA, 22 bp, Artificial Sequence
  chemically synthesized
ttctacctatcttgctgggagt

SEQ ID NO: 1008984 - DNA, 22 bp, Artificial Sequence
  chemically synthesized
tctacctatcttgctgggagta

SEQ ID NO: 1008985 - DNA, 22 bp, Artificial Sequence
  chemically synthesized
ctacctatcttgctgggagtat

SEQ ID NO: 1008986 - DNA, 22 bp, Artificial Sequence
  chemically synthesized
tacctatcttgctgggagtatt

SEQ ID NO: 1008987 - DNA, 22 bp, Artificial Sequence
  chemically synthesized
atgtgattttgaaatactccca

SEQ ID NO: 1008988 - DNA, 22 bp, Artificial Sequence
  chemically synthesized
catgtgattttgaaatactccc

SEQ ID NO: 1008989 - DNA, 22 bp, Artificial Sequence
  chemically synthesized
cctatcttgctgggagtatttc

SEQ ID NO: 1008990 - DNA, 22 bp, Artificial Sequence
  chemically synthesized
tcttgctgggagtatttcaaaa

SEQ ID NO: 1008991 - DNA, 22 bp, Artificial Sequence
  chemically synthesized
gctgggagtatttcaaaatcac

SEQ ID NO: 1008992 - DNA, 22 bp, Artificial Sequence
  chemically synthesized
ctgggagtatttcaaaatcaca

SEQ ID NO: 1008993 - DNA, 22 bp, Artificial Sequence
  chemically synthesized
ggagtatttcaaaatcacatga

SEQ ID NO: 1008994 - DNA, 22 bp, Artificial Sequence
  chemically synthesized
ccaagaatatgacttcatgtga

SEQ ID NO: 1008995 - DNA, 22 bp, Artificial Sequence
  chemically synthesized
caaaatcacatgaagtcatatt

SEQ ID NO: 1008996 - DNA, 22 bp, Artificial Sequence
  chemically synthesized
aaaattaccaagaatatgactt

SEQ ID NO: 1008997 - DNA, 22 bp, Artificial Sequence
  chemically synthesized
aaaatcacatgaagtcatattc

SEQ ID NO: 1008998 - DNA, 22 bp, Artificial Sequence
  chemically synthesized
aaaaattaccaagaatatgact

SEQ ID NO: 1008999 - DNA, 22 bp, Artificial Sequence
  chemically synthesized
taaaaattaccaagaatatgac

SEQ ID NO: 1009000 - DNA, 22 bp, Artificial Sequence
  chemically synthesized
ttttaaaaattaccaagaatat

SEQ ID NO: 1009001 - DNA, 22 bp, Artificial Sequence
  chemically synthesized
catgctgttttaaaaattacca

SEQ ID NO: 1009002 - DNA, 22 bp, Artificial Sequence
  chemically synthesized
gcatgctgttttaaaaattacc

SEQ ID NO: 1009003 - DNA, 22 bp, Artificial Sequence
  chemically synthesized
tgcatgctgttttaaaaattac

SEQ ID NO: 1009004 - DNA, 22 bp, Artificial Sequence
  chemically synthesized
ttgcatgctgttttaaaaatta

SEQ ID NO: 1009005 - DNA, 22 bp, Artificial Sequence
  chemically synthesized
cttttgcatgctgttttaaaaa

SEQ ID NO: 1009006 - DNA, 22 bp, Artificial Sequence
  chemically synthesized
gcttttgcatgctgttttaaaa

SEQ ID NO: 1009007 - DNA, 22 bp, Artificial Sequence
  chemically synthesized
ttggtaatttttaaaacagcat

SEQ ID NO: 1009008 - DNA, 22 bp, Artificial Sequence
  chemically synthesized
ggtaatttttaaaacagcatgc

SEQ ID NO: 1009009 - DNA, 22 bp, Artificial Sequence
  chemically synthesized
gtaatttttaaaacagcatgca

SEQ ID NO: 1009010 - DNA, 22 bp, Artificial Sequence
  chemically synthesized
gtgccttgcttttgcatgctgt

SEQ ID NO: 1009011 - DNA, 22 bp, Artificial Sequence
  chemically synthesized
agtgccttgcttttgcatgctg

SEQ ID NO: 1009012 - DNA, 22 bp, Artificial Sequence
  chemically synthesized
gtttagtgccttgcttttgcat

SEQ ID NO: 1009013 - DNA, 22 bp, Artificial Sequence
  chemically synthesized
ttaaaacagcatgcaaaagcaa

SEQ ID NO: 1009014 - DNA, 22 bp, Artificial Sequence
  chemically synthesized
taaaacagcatgcaaaagcaag

SEQ ID NO: 1009015 - DNA, 22 bp, Artificial Sequence
  chemically synthesized
aaaacagcatgcaaaagcaagg

SEQ ID NO: 1009016 - DNA, 22 bp, Artificial Sequence
  chemically synthesized
aaacagcatgcaaaagcaaggc

SEQ ID NO: 1009017 - DNA, 22 bp, Artificial Sequence
  chemically synthesized
taaagttggtttagtgccttgc

SEQ ID NO: 1009018 - DNA, 22 bp, Artificial Sequence
  chemically synthesized
ataaagttggtttagtgccttg

SEQ ID NO: 1009019 - DNA, 22 bp, Artificial Sequence
  chemically synthesized
cagtaatttataaagttggttt

SEQ ID NO: 1009020 - DNA, 22 bp, Artificial Sequence
  chemically synthesized
attgcagtaatttataaagttg

SEQ ID NO: 1009021 - DNA, 22 bp, Artificial Sequence
  chemically synthesized
cattgcagtaatttataaagtt

SEQ ID NO: 1009022 - DNA, 22 bp, Artificial Sequence
  chemically synthesized
tttcattgcagtaatttataaa

SEQ ID NO: 1009023 - DNA, 22 bp, Artificial Sequence
  chemically synthesized
atttcattgcagtaatttataa

SEQ ID NO: 1009024 - DNA, 22 bp, Artificial Sequence
  chemically synthesized
aaccaactttataaattactgc

SEQ ID NO: 1009025 - DNA, 22 bp, Artificial Sequence
  chemically synthesized
tataaattactgcaatgaaata

SEQ ID NO: 1009026 - DNA, 22 bp, Artificial Sequence
  chemically synthesized
ataaattactgcaatgaaataa

SEQ ID NO: 1009027 - DNA, 22 bp, Artificial Sequence
  chemically synthesized
taaattactgcaatgaaataaa

SEQ ID NO: 1009028 - DNA, 22 bp, Artificial Sequence
  chemically synthesized
ctgcaatgaaataaatcttgta

SEQ ID NO: 1009029 - DNA, 22 bp, Artificial Sequence
  chemically synthesized
caatgaaataaatcttgtatta

SEQ ID NO: 1009030 - DNA, 22 bp, Artificial Sequence
  chemically synthesized
caagaatatacacagaaagatg

SEQ ID NO: 1009031 - DNA, 22 bp, Artificial Sequence
  chemically synthesized
acaagaatatacacagaaagat

SEQ ID NO: 1009032 - DNA, 22 bp, Artificial Sequence
  chemically synthesized
tacaagaatatacacagaaaga

SEQ ID NO: 1009033 - DNA, 22 bp, Artificial Sequence
  chemically synthesized
gtattacatctttctgtgtata

SEQ ID NO: 1009034 - DNA, 22 bp, Artificial Sequence
  chemically synthesized
tattacatctttctgtgtatat

SEQ ID NO: 1009035 - DNA, 22 bp, Artificial Sequence
  chemically synthesized
catctttctgtgtatattcttg

SEQ ID NO: 1009036 - DNA, 22 bp, Artificial Sequence
  chemically synthesized
tctgtgtatattcttgtaaagt

SEQ ID NO: 1009037 - DNA, 22 bp, Artificial Sequence
  chemically synthesized
ctgtgtatattcttgtaaagtt

SEQ ID NO: 1009038 - DNA, 22 bp, Artificial Sequence
  chemically synthesized
tgtgtatattcttgtaaagttg

SEQ ID NO: 1009039 - DNA, 22 bp, Artificial Sequence
  chemically synthesized
tgtatattcttgtaaagttgat

SEQ ID NO: 1009040 - DNA, 22 bp, Artificial Sequence
  chemically synthesized
gaaaatagtacaaaatcaactt

SEQ ID NO: 1009041 - DNA, 22 bp, Artificial Sequence
  chemically synthesized
ggaaaatagtacaaaatcaact

SEQ ID NO: 1009042 - DNA, 22 bp, Artificial Sequence
  chemically synthesized
tggaaaatagtacaaaatcaac

SEQ ID NO: 1009043 - DNA, 22 bp, Artificial Sequence
  chemically synthesized
ttggaaaatagtacaaaatcaa

SEQ ID NO: 1009044 - DNA, 22 bp, Artificial Sequence
  chemically synthesized
ttgtaaagttgattttgtacta

SEQ ID NO: 1009045 - DNA, 22 bp, Artificial Sequence
  chemically synthesized
gtaaagttgattttgtactatt

SEQ ID NO: 1009046 - DNA, 22 bp, Artificial Sequence
  chemically synthesized
atacttttggaaaatagtacaa

SEQ ID NO: 1009047 - DNA, 22 bp, Artificial Sequence
  chemically synthesized
taaagttgattttgtactattt

SEQ ID NO: 1009048 - DNA, 22 bp, Artificial Sequence
  chemically synthesized
attttgtactattttccaaaag

SEQ ID NO: 1009049 - DNA, 22 bp, Artificial Sequence
  chemically synthesized
agaaaactaatacttttggaaa

SEQ ID NO: 1009050 - DNA, 22 bp, Artificial Sequence
  chemically synthesized
tgtactattttccaaaagtatt

SEQ ID NO: 1009051 - DNA, 22 bp, Artificial Sequence
  chemically synthesized
gtactattttccaaaagtatta

SEQ ID NO: 1009052 - DNA, 22 bp, Artificial Sequence
  chemically synthesized
tactattttccaaaagtattag

SEQ ID NO: 1009053 - DNA, 22 bp, Artificial Sequence
  chemically synthesized
ttttccaaaagtattagttttc

SEQ ID NO: 1009054 - DNA, 22 bp, Artificial Sequence
  chemically synthesized
agaagccagttcagaaaactaa

SEQ ID NO: 1009055 - DNA, 22 bp, Artificial Sequence
  chemically synthesized
tccaaaagtattagttttctga

SEQ ID NO: 1009056 - DNA, 22 bp, Artificial Sequence
  chemically synthesized
ccaaaagtattagttttctgaa

SEQ ID NO: 1009057 - DNA, 22 bp, Artificial Sequence
  chemically synthesized
caaaagtattagttttctgaac

SEQ ID NO: 1009058 - DNA, 22 bp, Artificial Sequence
  chemically synthesized
gaaaattaagaagccagttcag

SEQ ID NO: 1009059 - DNA, 22 bp, Artificial Sequence
  chemically synthesized
agaaaattaagaagccagttca

SEQ ID NO: 1009060 - DNA, 22 bp, Artificial Sequence
  chemically synthesized
tagaaaattaagaagccagttc

SEQ ID NO: 1009061 - DNA, 22 bp, Artificial Sequence
  chemically synthesized
gttttctgaactggcttcttaa

SEQ ID NO: 1009062 - DNA, 22 bp, Artificial Sequence
  chemically synthesized
tctgaactggcttcttaatttt

SEQ ID NO: 1009063 - DNA, 22 bp, Artificial Sequence
  chemically synthesized
ctgaactggcttcttaattttc

SEQ ID NO: 1009064 - DNA, 22 bp, Artificial Sequence
  chemically synthesized
tgaactggcttcttaattttct

SEQ ID NO: 1009065 - DNA, 22 bp, Artificial Sequence
  chemically synthesized
aactggcttcttaattttctaa

SEQ ID NO: 1009066 - DNA, 22 bp, Artificial Sequence
  chemically synthesized
gcttcttaattttctaaaactt

SEQ ID NO: 1009067 - DNA, 22 bp, Artificial Sequence
  chemically synthesized
cttaattttctaaaacttatac

SEQ ID NO: 1009068 - DNA, 22 bp, Artificial Sequence
  chemically synthesized
ttaattttctaaaacttatact

SEQ ID NO: 1009069 - DNA, 22 bp, Artificial Sequence
  chemically synthesized
aattttctaaaacttatacttc

SEQ ID NO: 1009070 - DNA, 22 bp, Artificial Sequence
  chemically synthesized
attttctaaaacttatacttcc

SEQ ID NO: 1009071 - DNA, 22 bp, Artificial Sequence
  chemically synthesized
tctaaaacttatacttccttac

SEQ ID NO: 1009072 - DNA, 22 bp, Artificial Sequence
  chemically synthesized
ctaaaacttatacttccttaca

SEQ ID NO: 1009073 - DNA, 22 bp, Artificial Sequence
  chemically synthesized
taatatggtgagtgtaaggaag

SEQ ID NO: 1009074 - DNA, 22 bp, Artificial Sequence
  chemically synthesized
taaaacttatacttccttacac

SEQ ID NO: 1009075 - DNA, 22 bp, Artificial Sequence
  chemically synthesized
aaacttatacttccttacactc

SEQ ID NO: 1009076 - DNA, 22 bp, Artificial Sequence
  chemically synthesized
atacttccttacactcaccata

SEQ ID NO: 1009077 - DNA, 22 bp, Artificial Sequence
  chemically synthesized
tacttccttacactcaccatat

SEQ ID NO: 1009078 - DNA, 22 bp, Artificial Sequence
  chemically synthesized
ccttacactcaccatattacaa

SEQ ID NO: 1009079 - DNA, 22 bp, Artificial Sequence
  chemically synthesized
agtgtcacaaggttgtaatatg

SEQ ID NO: 1009080 - DNA, 22 bp, Artificial Sequence
  chemically synthesized
cttacactcaccatattacaac

SEQ ID NO: 1009081 - DNA, 22 bp, Artificial Sequence
  chemically synthesized
acactcaccatattacaacctt

SEQ ID NO: 1009082 - DNA, 22 bp, Artificial Sequence
  chemically synthesized
gttgagtgtcacaaggttgtaa

SEQ ID NO: 1009083 - DNA, 22 bp, Artificial Sequence
  chemically synthesized
cactcaccatattacaaccttg

SEQ ID NO: 1009084 - DNA, 22 bp, Artificial Sequence
  chemically synthesized
tggttgagtgtcacaaggttgt

SEQ ID NO: 1009085 - DNA, 22 bp, Artificial Sequence
  chemically synthesized
ctggttgagtgtcacaaggttg

SEQ ID NO: 1009086 - DNA, 22 bp, Artificial Sequence
  chemically synthesized
accatattacaaccttgtgaca

SEQ ID NO: 1009087 - DNA, 22 bp, Artificial Sequence
  chemically synthesized
ggtgatttctggttgagtgtca

SEQ ID NO: 1009088 - DNA, 22 bp, Artificial Sequence
  chemically synthesized
caaccttgtgacactcaaccag

SEQ ID NO: 1009089 - DNA, 22 bp, Artificial Sequence
  chemically synthesized
gtgacactcaaccagaaatcac

SEQ ID NO: 1009090 - DNA, 22 bp, Artificial Sequence
  chemically synthesized
tgacactcaaccagaaatcacc

SEQ ID NO: 1009091 - DNA, 22 bp, Artificial Sequence
  chemically synthesized
tatgtgtatgtgtgtgttgggt

SEQ ID NO: 1009092 - DNA, 22 bp, Artificial Sequence
  chemically synthesized
aaccagaaatcacccaacacac

SEQ ID NO: 1009093 - DNA, 22 bp, Artificial Sequence
  chemically synthesized
acacagttgtatgtgtatgtgt

SEQ ID NO: 1009094 - DNA, 22 bp, Artificial Sequence
  chemically synthesized
tagcaatgcaagaagggactaa

SEQ ID NO: 1009095 - DNA, 22 bp, Artificial Sequence
  chemically synthesized
atagcaatgcaagaagggacta

SEQ ID NO: 1009096 - DNA, 22 bp, Artificial Sequence
  chemically synthesized
tatagcaatgcaagaagggact

SEQ ID NO: 1009097 - DNA, 22 bp, Artificial Sequence
  chemically synthesized
tttatagcaatgcaagaaggga

SEQ ID NO: 1009098 - DNA, 22 bp, Artificial Sequence
  chemically synthesized
ctttatagcaatgcaagaaggg

SEQ ID NO: 1009099 - DNA, 22 bp, Artificial Sequence
  chemically synthesized
tgttagtcccttcttgcattgc

SEQ ID NO: 1009100 - DNA, 22 bp, Artificial Sequence
  chemically synthesized
aggtatttctttatagcaatgc

SEQ ID NO: 1009101 - DNA, 22 bp, Artificial Sequence
  chemically synthesized
caggtatttctttatagcaatg

SEQ ID NO: 1009102 - DNA, 22 bp, Artificial Sequence
  chemically synthesized
gtcccttcttgcattgctataa

SEQ ID NO: 1009103 - DNA, 22 bp, Artificial Sequence
  chemically synthesized
cttgcattgctataaagaaata

SEQ ID NO: 1009104 - DNA, 22 bp, Artificial Sequence
  chemically synthesized
ttgcattgctataaagaaatac

SEQ ID NO: 1009105 - DNA, 22 bp, Artificial Sequence
  chemically synthesized
gcattgctataaagaaatacct

SEQ ID NO: 1009106 - DNA, 22 bp, Artificial Sequence
  chemically synthesized
cattgctataaagaaatacctg

SEQ ID NO: 1009107 - DNA, 22 bp, Artificial Sequence
  chemically synthesized
aagcacccagtttcaggtattt

SEQ ID NO: 1009108 - DNA, 22 bp, Artificial Sequence
  chemically synthesized
aaagcacccagtttcaggtatt

SEQ ID NO: 1009109 - DNA, 22 bp, Artificial Sequence
  chemically synthesized
taaagcacccagtttcaggtat

SEQ ID NO: 1009110 - DNA, 22 bp, Artificial Sequence
  chemically synthesized
ttaaagcacccagtttcaggta

SEQ ID NO: 1009111 - DNA, 22 bp, Artificial Sequence
  chemically synthesized
ctataaagaaatacctgaaact

SEQ ID NO: 1009112 - DNA, 22 bp, Artificial Sequence
  chemically synthesized
tttaaagcacccagtttcaggt

SEQ ID NO: 1009113 - DNA, 22 bp, Artificial Sequence
  chemically synthesized
tttttaaagcacccagtttcag

SEQ ID NO: 1009114 - DNA, 22 bp, Artificial Sequence
  chemically synthesized
taaagaaatacctgaaactggg

SEQ ID NO: 1009115 - DNA, 22 bp, Artificial Sequence
  chemically synthesized
ctttttaaagcacccagtttca

SEQ ID NO: 1009116 - DNA, 22 bp, Artificial Sequence
  chemically synthesized
tctttttaaagcacccagtttc

SEQ ID NO: 1009117 - DNA, 22 bp, Artificial Sequence
  chemically synthesized
ttctttttaaagcacccagttt

SEQ ID NO: 1009118 - DNA, 22 bp, Artificial Sequence
  chemically synthesized
aaactgggtgctttaaaaagaa

SEQ ID NO: 1009119 - DNA, 22 bp, Artificial Sequence
  chemically synthesized
ggtgctttaaaaagaaaagggg

SEQ ID NO: 1009120 - DNA, 22 bp, Artificial Sequence
  chemically synthesized
taaaaagaaaaggggttttctt

SEQ ID NO: 1009121 - DNA, 22 bp, Artificial Sequence
  chemically synthesized
aaaaagaaaaggggttttcttt

SEQ ID NO: 1009122 - DNA, 22 bp, Artificial Sequence
  chemically synthesized
aaaagaaaaggggttttctttt

SEQ ID NO: 1009123 - DNA, 22 bp, Artificial Sequence
  chemically synthesized
cagaaccgtaagtcaaaagaaa

SEQ ID NO: 1009124 - DNA, 22 bp, Artificial Sequence
  chemically synthesized
tacagcctgcagaaccgtaagt

SEQ ID NO: 1009125 - DNA, 22 bp, Artificial Sequence
  chemically synthesized
ctgtacagcctgcagaaccgta

SEQ ID NO: 1009126 - DNA, 22 bp, Artificial Sequence
  chemically synthesized
cctgtacagcctgcagaaccgt

SEQ ID NO: 1009127 - DNA, 22 bp, Artificial Sequence
  chemically synthesized
tcttttgacttacggttctgca

SEQ ID NO: 1009128 - DNA, 22 bp, Artificial Sequence
  chemically synthesized
cttttgacttacggttctgcag

SEQ ID NO: 1009129 - DNA, 22 bp, Artificial Sequence
  chemically synthesized
ttttgacttacggttctgcagg

SEQ ID NO: 1009130 - DNA, 22 bp, Artificial Sequence
  chemically synthesized
ttgacttacggttctgcaggct

SEQ ID NO: 1009131 - DNA, 22 bp, Artificial Sequence
  chemically synthesized
tgacttacggttctgcaggctg

SEQ ID NO: 1009132 - DNA, 22 bp, Artificial Sequence
  chemically synthesized
gacttacggttctgcaggctgt

SEQ ID NO: 1009133 - DNA, 22 bp, Artificial Sequence
  chemically synthesized
acttacggttctgcaggctgta

SEQ ID NO: 1009134 - DNA, 22 bp, Artificial Sequence
  chemically synthesized
acggttctgcaggctgtacagg

SEQ ID NO: 1009135 - DNA, 22 bp, Artificial Sequence
  chemically synthesized
cggttctgcaggctgtacagga

SEQ ID NO: 1009136 - DNA, 22 bp, Artificial Sequence
  chemically synthesized
tgcaggctgtacaggaagcatg

SEQ ID NO: 1009137 - DNA, 22 bp, Artificial Sequence
  chemically synthesized
caggctgtacaggaagcatgtc

SEQ ID NO: 1009138 - DNA, 22 bp, Artificial Sequence
  chemically synthesized
tacaggaagcatgtcactggca

SEQ ID NO: 1009139 - DNA, 22 bp, Artificial Sequence
  chemically synthesized
accagaagtagatgccagtgac

SEQ ID NO: 1009140 - DNA, 22 bp, Artificial Sequence
  chemically synthesized
tcaccagaagtagatgccagtg

SEQ ID NO: 1009141 - DNA, 22 bp, Artificial Sequence
  chemically synthesized
aggctctcaccagaagtagatg

SEQ ID NO: 1009142 - DNA, 22 bp, Artificial Sequence
  chemically synthesized
ctgaggctctcaccagaagtag

SEQ ID NO: 1009143 - DNA, 22 bp, Artificial Sequence
  chemically synthesized
cctgaggctctcaccagaagta

SEQ ID NO: 1009144 - DNA, 22 bp, Artificial Sequence
  chemically synthesized
gcatctacttctggtgagagcc

SEQ ID NO: 1009145 - DNA, 22 bp, Artificial Sequence
  chemically synthesized
taaacttcctgaggctctcacc

SEQ ID NO: 1009146 - DNA, 22 bp, Artificial Sequence
  chemically synthesized
gttgtaaacttcctgaggctct

SEQ ID NO: 1009147 - DNA, 22 bp, Artificial Sequence
  chemically synthesized
cttctggtgagagcctcaggaa

SEQ ID NO: 1009148 - DNA, 22 bp, Artificial Sequence
  chemically synthesized
ctggtgagagcctcaggaagtt

SEQ ID NO: 1009149 - DNA, 22 bp, Artificial Sequence
  chemically synthesized
tggtgagagcctcaggaagttt

SEQ ID NO: 1009150 - DNA, 22 bp, Artificial Sequence
  chemically synthesized
gtgagagcctcaggaagtttac

SEQ ID NO: 1009151 - DNA, 22 bp, Artificial Sequence
  chemically synthesized
caccatggttggttgtaaactt

SEQ ID NO: 1009152 - DNA, 22 bp, Artificial Sequence
  chemically synthesized
ccaccatggttggttgtaaact

SEQ ID NO: 1009153 - DNA, 22 bp, Artificial Sequence
  chemically synthesized
ccttccaccatggttggttgta

SEQ ID NO: 1009154 - DNA, 22 bp, Artificial Sequence
  chemically synthesized
gccttccaccatggttggttgt

SEQ ID NO: 1009155 - DNA, 22 bp, Artificial Sequence
  chemically synthesized
tgccttccaccatggttggttg

SEQ ID NO: 1009156 - DNA, 22 bp, Artificial Sequence
  chemically synthesized
aggaagtttacaaccaaccatg

SEQ ID NO: 1009157 - DNA, 22 bp, Artificial Sequence
  chemically synthesized
ccctttgccttccaccatggtt

SEQ ID NO: 1009158 - DNA, 22 bp, Artificial Sequence
  chemically synthesized
tcccctttgccttccaccatgg

SEQ ID NO: 1009159 - DNA, 22 bp, Artificial Sequence
  chemically synthesized
ctctcccctttgccttccacca

SEQ ID NO: 1009160 - DNA, 22 bp, Artificial Sequence
  chemically synthesized
acaaccaaccatggtggaaggc

SEQ ID NO: 1009161 - DNA, 22 bp, Artificial Sequence
  chemically synthesized
caaccaaccatggtggaaggca

SEQ ID NO: 1009162 - DNA, 22 bp, Artificial Sequence
  chemically synthesized
ctgctctcccctttgccttcca

SEQ ID NO: 1009163 - DNA, 22 bp, Artificial Sequence
  chemically synthesized
cctgctctcccctttgccttcc

SEQ ID NO: 1009164 - DNA, 22 bp, Artificial Sequence
  chemically synthesized
tttcctgctctcccctttgcct

SEQ ID NO: 1009165 - DNA, 22 bp, Artificial Sequence
  chemically synthesized
aacccccacctgtttcctgctc

SEQ ID NO: 1009166 - DNA, 22 bp, Artificial Sequence
  chemically synthesized
aaagagtatgagacctcaaccc

SEQ ID NO: 1009167 - DNA, 22 bp, Artificial Sequence
  chemically synthesized
aaaagagtatgagacctcaacc

SEQ ID NO: 1009168 - DNA, 22 bp, Artificial Sequence
  chemically synthesized
tttaaaagagtatgagacctca

SEQ ID NO: 1009169 - DNA, 22 bp, Artificial Sequence
  chemically synthesized
tatgtggttgtttaaaagagta

SEQ ID NO: 1009170 - DNA, 22 bp, Artificial Sequence
  chemically synthesized
aggtctcatactcttttaaaca

SEQ ID NO: 1009171 - DNA, 22 bp, Artificial Sequence
  chemically synthesized
atgctatatgtggttgtttaaa

SEQ ID NO: 1009172 - DNA, 22 bp, Artificial Sequence
  chemically synthesized
gttcatgctatatgtggttgtt

SEQ ID NO: 1009173 - DNA, 22 bp, Artificial Sequence
  chemically synthesized
atactcttttaaacaaccacat

SEQ ID NO: 1009174 - DNA, 22 bp, Artificial Sequence
  chemically synthesized
ttttaaacaaccacatatagca

SEQ ID NO: 1009175 - DNA, 22 bp, Artificial Sequence
  chemically synthesized
ttaaacaaccacatatagcatg

SEQ ID NO: 1009176 - DNA, 22 bp, Artificial Sequence
  chemically synthesized
taaacaaccacatatagcatga

SEQ ID NO: 1009177 - DNA, 22 bp, Artificial Sequence
  chemically synthesized
aaacaaccacatatagcatgaa

SEQ ID NO: 1009178 - DNA, 22 bp, Artificial Sequence
  chemically synthesized
gtgacaagttagttcatgctat

SEQ ID NO: 1009179 - DNA, 22 bp, Artificial Sequence
  chemically synthesized
aacaaccacatatagcatgaac

SEQ ID NO: 1009180 - DNA, 22 bp, Artificial Sequence
  chemically synthesized
ggtgacaagttagttcatgcta

SEQ ID NO: 1009181 - DNA, 22 bp, Artificial Sequence
  chemically synthesized
tggtgacaagttagttcatgct

SEQ ID NO: 1009182 - DNA, 22 bp, Artificial Sequence
  chemically synthesized
atgaatgatccctttggtgaca

SEQ ID NO: 1009183 - DNA, 22 bp, Artificial Sequence
  chemically synthesized
catgaatgatccctttggtgac

SEQ ID NO: 1009184 - DNA, 22 bp, Artificial Sequence
  chemically synthesized
acttgtcaccaaagggatcatt

SEQ ID NO: 1009185 - DNA, 22 bp, Artificial Sequence
  chemically synthesized
gtcaccaaagggatcattcatg

SEQ ID NO: 1009186 - DNA, 22 bp, Artificial Sequence
  chemically synthesized
tcaccaaagggatcattcatga

SEQ ID NO: 1009187 - DNA, 22 bp, Artificial Sequence
  chemically synthesized
gatcatgtgggtggatccttca

SEQ ID NO: 1009188 - DNA, 22 bp, Artificial Sequence
  chemically synthesized
atgaaggatccacccacatgat

SEQ ID NO: 1009189 - DNA, 22 bp, Artificial Sequence
  chemically synthesized
gtaggtgtgattggatcatgtg

SEQ ID NO: 1009190 - DNA, 22 bp, Artificial Sequence
  chemically synthesized
gaggcagggcctggtaggtgtg

SEQ ID NO: 1009191 - DNA, 22 bp, Artificial Sequence
  chemically synthesized
caatgttggaggcagggcctgg

SEQ ID NO: 1009192 - DNA, 22 bp, Artificial Sequence
  chemically synthesized
ccaatgttggaggcagggcctg

SEQ ID NO: 1009193 - DNA, 22 bp, Artificial Sequence
  chemically synthesized
ccaggccctgcctccaacattg

SEQ ID NO: 1009194 - DNA, 22 bp, Artificial Sequence
  chemically synthesized
aaatgtgatttccaatgttgga

SEQ ID NO: 1009195 - DNA, 22 bp, Artificial Sequence
  chemically synthesized
tattgaaatgtgatttccaatg

SEQ ID NO: 1009196 - DNA, 22 bp, Artificial Sequence
  chemically synthesized
atattgaaatgtgatttccaat

SEQ ID NO: 1009197 - DNA, 22 bp, Artificial Sequence
  chemically synthesized
cctccaacattggaaatcacat

SEQ ID NO: 1009198 - DNA, 22 bp, Artificial Sequence
  chemically synthesized
caacattggaaatcacatttca

SEQ ID NO: 1009199 - DNA, 22 bp, Artificial Sequence
  chemically synthesized
cgaatcttatattgaaatgtga

SEQ ID NO: 1009200 - DNA, 22 bp, Artificial Sequence
  chemically synthesized
tcacctccgaatcttatattga

SEQ ID NO: 1009201 - DNA, 22 bp, Artificial Sequence
  chemically synthesized
gaaatcacatttcaatataaga

SEQ ID NO: 1009202 - DNA, 22 bp, Artificial Sequence
  chemically synthesized
atcacctccgaatcttatattg

SEQ ID NO: 1009203 - DNA, 22 bp, Artificial Sequence
  chemically synthesized
gatgtttatcacctccgaatct

SEQ ID NO: 1009204 - DNA, 22 bp, Artificial Sequence
  chemically synthesized
ggatgtttatcacctccgaatc

SEQ ID NO: 1009205 - DNA, 22 bp, Artificial Sequence
  chemically synthesized
caatataagattcggaggtgat

SEQ ID NO: 1009206 - DNA, 22 bp, Artificial Sequence
  chemically synthesized
aatataagattcggaggtgata

SEQ ID NO: 1009207 - DNA, 22 bp, Artificial Sequence
  chemically synthesized
ggaggtgataaacatccaagcc

SEQ ID NO: 1009208 - DNA, 22 bp, Artificial Sequence
  chemically synthesized
tctctctctctctctctctctc

SEQ ID NO: 1009209 - DNA, 22 bp, Artificial Sequence
  chemically synthesized
tctctctctctctctctctctc

SEQ ID NO: 1009210 - DNA, 22 bp, Artificial Sequence
  chemically synthesized
tctctctctctctctctctctc

SEQ ID NO: 1009211 - DNA, 22 bp, Artificial Sequence
  chemically synthesized
tctctctctctctctctctcac

SEQ ID NO: 1009212 - DNA, 22 bp, Artificial Sequence
  chemically synthesized
tctctctctctctctctcacat

SEQ ID NO: 1009213 - DNA, 22 bp, Artificial Sequence
  chemically synthesized
tctctctctctctctcacatac

SEQ ID NO: 1009214 - DNA, 22 bp, Artificial Sequence
  chemically synthesized
tctctctctctctcacatacac

SEQ ID NO: 1009215 - DNA, 22 bp, Artificial Sequence
  chemically synthesized
tctctctctctcacatacacac

SEQ ID NO: 1009216 - DNA, 22 bp, Artificial Sequence
  chemically synthesized
tctctctctcacatacacacac

SEQ ID NO: 1009217 - DNA, 22 bp, Artificial Sequence
  chemically synthesized
tctctctcacatacacacacac

SEQ ID NO: 1009218 - DNA, 22 bp, Artificial Sequence
  chemically synthesized
tctctcacatacacacacacac

SEQ ID NO: 1009219 - DNA, 22 bp, Artificial Sequence
  chemically synthesized
tctcacatacacacacacacac

SEQ ID NO: 1009220 - DNA, 22 bp, Artificial Sequence
  chemically synthesized
tcacatacacacacacacacac

SEQ ID NO: 1009221 - DNA, 22 bp, Artificial Sequence
  chemically synthesized
acatacacacacacacacacac

SEQ ID NO: 1009222 - DNA, 22 bp, Artificial Sequence
  chemically synthesized
tgtgtgtgtgggtgtgtgtgtg

SEQ ID NO: 1009223 - DNA, 22 bp, Artificial Sequence
  chemically synthesized
cgactgtgtgtgtgtgggtgtg

SEQ ID NO: 1009224 - DNA, 22 bp, Artificial Sequence
  chemically synthesized
attgcgactgtgtgtgtgtggg

SEQ ID NO: 1009225 - DNA, 22 bp, Artificial Sequence
  chemically synthesized
aattgcgactgtgtgtgtgtgg

SEQ ID NO: 1009226 - DNA, 22 bp, Artificial Sequence
  chemically synthesized
taattgcgactgtgtgtgtgtg

SEQ ID NO: 1009227 - DNA, 22 bp, Artificial Sequence
  chemically synthesized
ttttaattgcgactgtgtgtgt

SEQ ID NO: 1009228 - DNA, 22 bp, Artificial Sequence
  chemically synthesized
gttttaattgcgactgtgtgtg

SEQ ID NO: 1009229 - DNA, 22 bp, Artificial Sequence
  chemically synthesized
tgttttaattgcgactgtgtgt

SEQ ID NO: 1009230 - DNA, 22 bp, Artificial Sequence
  chemically synthesized
ttgttttaattgcgactgtgtg

SEQ ID NO: 1009231 - DNA, 22 bp, Artificial Sequence
  chemically synthesized
tttgttttaattgcgactgtgt

SEQ ID NO: 1009232 - DNA, 22 bp, Artificial Sequence
  chemically synthesized
acagattttttgttttaattgc

SEQ ID NO: 1009233 - DNA, 22 bp, Artificial Sequence
  chemically synthesized
cacagattttttgttttaattg

SEQ ID NO: 1009234 - DNA, 22 bp, Artificial Sequence
  chemically synthesized
atcacaaatagatgtttcacag

SEQ ID NO: 1009235 - DNA, 22 bp, Artificial Sequence
  chemically synthesized
aaacaaaaaatctgtgaaacat

SEQ ID NO: 1009236 - DNA, 22 bp, Artificial Sequence
  chemically synthesized
tgaaacatctatttgtgatgaa

SEQ ID NO: 1009237 - DNA, 22 bp, Artificial Sequence
  chemically synthesized
tttgtgatgaatgctgatattt

SEQ ID NO: 1009238 - DNA, 22 bp, Artificial Sequence
  chemically synthesized
gtgatgaatgctgatattttct

SEQ ID NO: 1009239 - DNA, 22 bp, Artificial Sequence
  chemically synthesized
gtgaaacaaaatagaaaatatc

SEQ ID NO: 1009240 - DNA, 22 bp, Artificial Sequence
  chemically synthesized
tgatgaatgctgatattttcta

SEQ ID NO: 1009241 - DNA, 22 bp, Artificial Sequence
  chemically synthesized
agtgaaacaaaatagaaaatat

SEQ ID NO: 1009242 - DNA, 22 bp, Artificial Sequence
  chemically synthesized
tagtgaaacaaaatagaaaata

SEQ ID NO: 1009243 - DNA, 22 bp, Artificial Sequence
  chemically synthesized
ttagtgaaacaaaatagaaaat

SEQ ID NO: 1009244 - DNA, 22 bp, Artificial Sequence
  chemically synthesized
atttttagtgaaacaaaataga

SEQ ID NO: 1009245 - DNA, 22 bp, Artificial Sequence
  chemically synthesized
gatttttagtgaaacaaaatag

SEQ ID NO: 1009246 - DNA, 22 bp, Artificial Sequence
  chemically synthesized
tgatttttagtgaaacaaaata

SEQ ID NO: 1009247 - DNA, 22 bp, Artificial Sequence
  chemically synthesized
atattttctattttgtttcact

SEQ ID NO: 1009248 - DNA, 22 bp, Artificial Sequence
  chemically synthesized
tctattttgtttcactaaaaat

SEQ ID NO: 1009249 - DNA, 22 bp, Artificial Sequence
  chemically synthesized
ctattttgtttcactaaaaatc

SEQ ID NO: 1009250 - DNA, 22 bp, Artificial Sequence
  chemically synthesized
tattttgtttcactaaaaatca

SEQ ID NO: 1009251 - DNA, 22 bp, Artificial Sequence
  chemically synthesized
ttttgtttcactaaaaatcaaa

SEQ ID NO: 1009252 - DNA, 22 bp, Artificial Sequence
  chemically synthesized
tgtttcactaaaaatcaaaggc

SEQ ID NO: 1009253 - DNA, 22 bp, Artificial Sequence
  chemically synthesized
gtttcactaaaaatcaaaggcc

SEQ ID NO: 1009254 - DNA, 22 bp, Artificial Sequence
  chemically synthesized
tggatcaacaccggcctttgat

SEQ ID NO: 1009255 - DNA, 22 bp, Artificial Sequence
  chemically synthesized
tttcactaaaaatcaaaggccg

SEQ ID NO: 1009256 - DNA, 22 bp, Artificial Sequence
  chemically synthesized
gtggatcaacaccggcctttga

SEQ ID NO: 1009257 - DNA, 22 bp, Artificial Sequence
  chemically synthesized
cactaaaaatcaaaggccggtg

SEQ ID NO: 1009258 - DNA, 22 bp, Artificial Sequence
  chemically synthesized
actaaaaatcaaaggccggtgt

SEQ ID NO: 1009259 - DNA, 22 bp, Artificial Sequence
  chemically synthesized
agtttgtggatcaacaccggcc

SEQ ID NO: 1009260 - DNA, 22 bp, Artificial Sequence
  chemically synthesized
aaaatcaaaggccggtgttgat

SEQ ID NO: 1009261 - DNA, 22 bp, Artificial Sequence
  chemically synthesized
tgaatcataaactcagtttgtg

SEQ ID NO: 1009262 - DNA, 22 bp, Artificial Sequence
  chemically synthesized
atccacaaactgagtttatgat

SEQ ID NO: 1009263 - DNA, 22 bp, Artificial Sequence
  chemically synthesized
tccaaactgtgaatcataaact

SEQ ID NO: 1009264 - DNA, 22 bp, Artificial Sequence
  chemically synthesized
attgtccaaactgtgaatcata

SEQ ID NO: 1009265 - DNA, 22 bp, Artificial Sequence
  chemically synthesized
gtgttcattgtccaaactgtga

SEQ ID NO: 1009266 - DNA, 22 bp, Artificial Sequence
  chemically synthesized
agtttatgattcacagtttgga

SEQ ID NO: 1009267 - DNA, 22 bp, Artificial Sequence
  chemically synthesized
atgattcacagtttggacaatg

SEQ ID NO: 1009268 - DNA, 22 bp, Artificial Sequence
  chemically synthesized
tgattcacagtttggacaatga

SEQ ID NO: 1009269 - DNA, 22 bp, Artificial Sequence
  chemically synthesized
gtatgctagtgttcattgtcca

SEQ ID NO: 1009270 - DNA, 22 bp, Artificial Sequence
  chemically synthesized
acagtttggacaatgaacacta

SEQ ID NO: 1009271 - DNA, 22 bp, Artificial Sequence
  chemically synthesized
aatctagtatgctagtgttcat

SEQ ID NO: 1009272 - DNA, 22 bp, Artificial Sequence
  chemically synthesized
aaatctagtatgctagtgttca

SEQ ID NO: 1009273 - DNA, 22 bp, Artificial Sequence
  chemically synthesized
taaatctagtatgctagtgttc

SEQ ID NO: 1009274 - DNA, 22 bp, Artificial Sequence
  chemically synthesized
ttaaatctagtatgctagtgtt

SEQ ID NO: 1009275 - DNA, 22 bp, Artificial Sequence
  chemically synthesized
tttaaatctagtatgctagtgt

SEQ ID NO: 1009276 - DNA, 22 bp, Artificial Sequence
  chemically synthesized
ggacaatgaacactagcatact

SEQ ID NO: 1009277 - DNA, 22 bp, Artificial Sequence
  chemically synthesized
gacaatgaacactagcatacta

SEQ ID NO: 1009278 - DNA, 22 bp, Artificial Sequence
  chemically synthesized
attttttaaatctagtatgcta

SEQ ID NO: 1009279 - DNA, 22 bp, Artificial Sequence
  chemically synthesized
cattttttaaatctagtatgct

SEQ ID NO: 1009280 - DNA, 22 bp, Artificial Sequence
  chemically synthesized
atttcattttttaaatctagta

SEQ ID NO: 1009281 - DNA, 22 bp, Artificial Sequence
  chemically synthesized
gttaatttcattttttaaatct

SEQ ID NO: 1009282 - DNA, 22 bp, Artificial Sequence
  chemically synthesized
ggttaatttcattttttaaatc

SEQ ID NO: 1009283 - DNA, 22 bp, Artificial Sequence
  chemically synthesized
tggttaatttcattttttaaat

SEQ ID NO: 1009284 - DNA, 22 bp, Artificial Sequence
  chemically synthesized
gcatactagatttaaaaaatga

SEQ ID NO: 1009285 - DNA, 22 bp, Artificial Sequence
  chemically synthesized
ttttggttaatttcatttttta

SEQ ID NO: 1009286 - DNA, 22 bp, Artificial Sequence
  chemically synthesized
gttttggttaatttcatttttt

SEQ ID NO: 1009287 - DNA, 22 bp, Artificial Sequence
  chemically synthesized
tgttttggttaatttcattttt

SEQ ID NO: 1009288 - DNA, 22 bp, Artificial Sequence
  chemically synthesized
gttttgttttggttaatttcat

SEQ ID NO: 1009289 - DNA, 22 bp, Artificial Sequence
  chemically synthesized
gatttaaaaaatgaaattaacc

SEQ ID NO: 1009290 - DNA, 22 bp, Artificial Sequence
  chemically synthesized
ttggttttgttttggttaattt

SEQ ID NO: 1009291 - DNA, 22 bp, Artificial Sequence
  chemically synthesized
ttgttggttttgttttggttaa

SEQ ID NO: 1009292 - DNA, 22 bp, Artificial Sequence
  chemically synthesized
aaaaaatgaaattaaccaaaac

SEQ ID NO: 1009293 - DNA, 22 bp, Artificial Sequence
  chemically synthesized
attgttggttttgttttggtta

SEQ ID NO: 1009294 - DNA, 22 bp, Artificial Sequence
  chemically synthesized
aaaaatgaaattaaccaaaaca

SEQ ID NO: 1009295 - DNA, 22 bp, Artificial Sequence
  chemically synthesized
tattgttggttttgttttggtt

SEQ ID NO: 1009296 - DNA, 22 bp, Artificial Sequence
  chemically synthesized
ttttattgttggttttgttttg

SEQ ID NO: 1009297 - DNA, 22 bp, Artificial Sequence
  chemically synthesized
attttattgttggttttgtttt

SEQ ID NO: 1009298 - DNA, 22 bp, Artificial Sequence
  chemically synthesized
tattttattgttggttttgttt

SEQ ID NO: 1009299 - DNA, 22 bp, Artificial Sequence
  chemically synthesized
ttattttattgttggttttgtt

SEQ ID NO: 1009300 - DNA, 22 bp, Artificial Sequence
  chemically synthesized
tttattttattgttggttttgt

SEQ ID NO: 1009301 - DNA, 22 bp, Artificial Sequence
  chemically synthesized
accaaaacaaaaccaacaataa

SEQ ID NO: 1009302 - DNA, 22 bp, Artificial Sequence
  chemically synthesized
aggacattttttattttattgt

SEQ ID NO: 1009303 - DNA, 22 bp, Artificial Sequence
  chemically synthesized
gatgcatggaaagaaatggcac

SEQ ID NO: 1009304 - DNA, 22 bp, Artificial Sequence
  chemically synthesized
agcattattttgtgccatttct

SEQ ID NO: 1009305 - DNA, 22 bp, Artificial Sequence
  chemically synthesized
ttttgtgccatttctttccatg

SEQ ID NO: 1009306 - DNA, 22 bp, Artificial Sequence
  chemically synthesized
tgtgccatttctttccatgcat

SEQ ID NO: 1009307 - DNA, 22 bp, Artificial Sequence
  chemically synthesized
gtgccatttctttccatgcatc

SEQ ID NO: 1009308 - DNA, 22 bp, Artificial Sequence
  chemically synthesized
gtaagcgtgttggatgcatgga

SEQ ID NO: 1009309 - DNA, 22 bp, Artificial Sequence
  chemically synthesized
tgccatttctttccatgcatcc

SEQ ID NO: 1009310 - DNA, 22 bp, Artificial Sequence
  chemically synthesized
ggtaagcgtgttggatgcatgg

SEQ ID NO: 1009311 - DNA, 22 bp, Artificial Sequence
  chemically synthesized
ttggtaagcgtgttggatgcat

SEQ ID NO: 1009312 - DNA, 22 bp, Artificial Sequence
  chemically synthesized
ctttccatgcatccaacacgct

SEQ ID NO: 1009313 - DNA, 22 bp, Artificial Sequence
  chemically synthesized
tttccatgcatccaacacgctt

SEQ ID NO: 1009314 - DNA, 22 bp, Artificial Sequence
  chemically synthesized
tccatgcatccaacacgcttac

SEQ ID NO: 1009315 - DNA, 22 bp, Artificial Sequence
  chemically synthesized
ccatgcatccaacacgcttacc

SEQ ID NO: 1009316 - DNA, 22 bp, Artificial Sequence
  chemically synthesized
catgcatccaacacgcttacca

SEQ ID NO: 1009317 - DNA, 22 bp, Artificial Sequence
  chemically synthesized
accaagagttcctctcatcttg

SEQ ID NO: 1009318 - DNA, 22 bp, Artificial Sequence
  chemically synthesized
ccaagagttcctctcatcttgt

SEQ ID NO: 1009319 - DNA, 22 bp, Artificial Sequence
  chemically synthesized
tggtatgataatgacaagatga

SEQ ID NO: 1009320 - DNA, 22 bp, Artificial Sequence
  chemically synthesized
gtggtatgataatgacaagatg

SEQ ID NO: 1009321 - DNA, 22 bp, Artificial Sequence
  chemically synthesized
ctctcatcttgtcattatcata

SEQ ID NO: 1009322 - DNA, 22 bp, Artificial Sequence
  chemically synthesized
tcatcttgtcattatcatacca

SEQ ID NO: 1009323 - DNA, 22 bp, Artificial Sequence
  chemically synthesized
atcttgtcattatcataccaca

SEQ ID NO: 1009324 - DNA, 22 bp, Artificial Sequence
  chemically synthesized
gtcattatcataccacaagttt

SEQ ID NO: 1009325 - DNA, 22 bp, Artificial Sequence
  chemically synthesized
tcattatcataccacaagtttt

SEQ ID NO: 1009326 - DNA, 22 bp, Artificial Sequence
  chemically synthesized
tcataccacaagtttttctgac

SEQ ID NO: 1009327 - DNA, 22 bp, Artificial Sequence
  chemically synthesized
aaaagtgatggtgtcagaaaaa

SEQ ID NO: 1009328 - DNA, 22 bp, Artificial Sequence
  chemically synthesized
ttctgacaccatcacttttcaa

SEQ ID NO: 1009329 - DNA, 22 bp, Artificial Sequence
  chemically synthesized
tctgacaccatcacttttcaac

SEQ ID NO: 1009330 - DNA, 22 bp, Artificial Sequence
  chemically synthesized
ctgacaccatcacttttcaact

SEQ ID NO: 1009331 - DNA, 22 bp, Artificial Sequence
  chemically synthesized
tgacaccatcacttttcaactt

SEQ ID NO: 1009332 - DNA, 22 bp, Artificial Sequence
  chemically synthesized
acaccatcacttttcaactttt

SEQ ID NO: 1009333 - DNA, 22 bp, Artificial Sequence
  chemically synthesized
taaatccatgaaaatgagaaaa

SEQ ID NO: 1009334 - DNA, 22 bp, Artificial Sequence
  chemically synthesized
ttcaactttttctcattttcat

SEQ ID NO: 1009335 - DNA, 22 bp, Artificial Sequence
  chemically synthesized
tcaactttttctcattttcatg

SEQ ID NO: 1009336 - DNA, 22 bp, Artificial Sequence
  chemically synthesized
caactttttctcattttcatgg

SEQ ID NO: 1009337 - DNA, 22 bp, Artificial Sequence
  chemically synthesized
aactttttctcattttcatgga

SEQ ID NO: 1009338 - DNA, 22 bp, Artificial Sequence
  chemically synthesized
tttctcattttcatggatttac

SEQ ID NO: 1009339 - DNA, 22 bp, Artificial Sequence
  chemically synthesized
ttctcattttcatggatttaca

SEQ ID NO: 1009340 - DNA, 22 bp, Artificial Sequence
  chemically synthesized
tctcattttcatggatttacaa

SEQ ID NO: 1009341 - DNA, 22 bp, Artificial Sequence
  chemically synthesized
ctcattttcatggatttacaat

SEQ ID NO: 1009342 - DNA, 22 bp, Artificial Sequence
  chemically synthesized
tcattttcatggatttacaatt

SEQ ID NO: 1009343 - DNA, 22 bp, Artificial Sequence
  chemically synthesized
attttcatggatttacaattct

SEQ ID NO: 1009344 - DNA, 22 bp, Artificial Sequence
  chemically synthesized
tcatggatttacaattctctcc

SEQ ID NO: 1009345 - DNA, 22 bp, Artificial Sequence
  chemically synthesized
catggatttacaattctctccc

SEQ ID NO: 1009346 - DNA, 22 bp, Artificial Sequence
  chemically synthesized
atggatttacaattctctccct

SEQ ID NO: 1009347 - DNA, 22 bp, Artificial Sequence
  chemically synthesized
acaattctctcccttattttca

SEQ ID NO: 1009348 - DNA, 22 bp, Artificial Sequence
  chemically synthesized
caattctctcccttattttcat

SEQ ID NO: 1009349 - DNA, 22 bp, Artificial Sequence
  chemically synthesized
atagagagagcgatatgaaaat

SEQ ID NO: 1009350 - DNA, 22 bp, Artificial Sequence
  chemically synthesized
catagagagagcgatatgaaaa

SEQ ID NO: 1009351 - DNA, 22 bp, Artificial Sequence
  chemically synthesized
tctcccttattttcatatcgct

SEQ ID NO: 1009352 - DNA, 22 bp, Artificial Sequence
  chemically synthesized
tcccttattttcatatcgctct

SEQ ID NO: 1009353 - DNA, 22 bp, Artificial Sequence
  chemically synthesized
ccttattttcatatcgctctct

SEQ ID NO: 1009354 - DNA, 22 bp, Artificial Sequence
  chemically synthesized
ggaaagcttcatagagagagcg

SEQ ID NO: 1009355 - DNA, 22 bp, Artificial Sequence
  chemically synthesized
attttcatatcgctctctctat

SEQ ID NO: 1009356 - DNA, 22 bp, Artificial Sequence
  chemically synthesized
ttttcatatcgctctctctatg

SEQ ID NO: 1009357 - DNA, 22 bp, Artificial Sequence
  chemically synthesized
tcatatcgctctctctatgaag

SEQ ID NO: 1009358 - DNA, 22 bp, Artificial Sequence
  chemically synthesized
catatcgctctctctatgaagc

SEQ ID NO: 1009359 - DNA, 22 bp, Artificial Sequence
  chemically synthesized
atatcgctctctctatgaagct

SEQ ID NO: 1009360 - DNA, 22 bp, Artificial Sequence
  chemically synthesized
gccagaagaattgggaaagctt

SEQ ID NO: 1009361 - DNA, 22 bp, Artificial Sequence
  chemically synthesized
tctctatgaagctttcccaatt

SEQ ID NO: 1009362 - DNA, 22 bp, Artificial Sequence
  chemically synthesized
tctatgaagctttcccaattct

SEQ ID NO: 1009363 - DNA, 22 bp, Artificial Sequence
  chemically synthesized
tatgaagctttcccaattcttc

SEQ ID NO: 1009364 - DNA, 22 bp, Artificial Sequence
  chemically synthesized
tgaagctttcccaattcttctg

SEQ ID NO: 1009365 - DNA, 22 bp, Artificial Sequence
  chemically synthesized
tcccaattcttctggctagtta

SEQ ID NO: 1009366 - DNA, 22 bp, Artificial Sequence
  chemically synthesized
cccaattcttctggctagttac

SEQ ID NO: 1009367 - DNA, 22 bp, Artificial Sequence
  chemically synthesized
ccaattcttctggctagttact

SEQ ID NO: 1009368 - DNA, 22 bp, Artificial Sequence
  chemically synthesized
ttctggctagttactctttggg

SEQ ID NO: 1009369 - DNA, 22 bp, Artificial Sequence
  chemically synthesized
ctggctagttactctttgggtt

SEQ ID NO: 1009370 - DNA, 22 bp, Artificial Sequence
  chemically synthesized
tggctagttactctttgggttg

SEQ ID NO: 1009371 - DNA, 22 bp, Artificial Sequence
  chemically synthesized
gctagttactctttgggttgcc

SEQ ID NO: 1009372 - DNA, 22 bp, Artificial Sequence
  chemically synthesized
atgagtcagagcagaggcaacc

SEQ ID NO: 1009373 - DNA, 22 bp, Artificial Sequence
  chemically synthesized
gttactctttgggttgcctctg

SEQ ID NO: 1009374 - DNA, 22 bp, Artificial Sequence
  chemically synthesized
ctctttgggttgcctctgctct

SEQ ID NO: 1009375 - DNA, 22 bp, Artificial Sequence
  chemically synthesized
tttgggttgcctctgctctgac

SEQ ID NO: 1009376 - DNA, 22 bp, Artificial Sequence
  chemically synthesized
tgggttgcctctgctctgactc

SEQ ID NO: 1009377 - DNA, 22 bp, Artificial Sequence
  chemically synthesized
gggttgcctctgctctgactca

SEQ ID NO: 1009378 - DNA, 22 bp, Artificial Sequence
  chemically synthesized
ggttgcctctgctctgactcat

SEQ ID NO: 1009379 - DNA, 22 bp, Artificial Sequence
  chemically synthesized
cctctgctctgactcatcaatg

SEQ ID NO: 1009380 - DNA, 22 bp, Artificial Sequence
  chemically synthesized
tgctctgactcatcaatggtgt

SEQ ID NO: 1009381 - DNA, 22 bp, Artificial Sequence
  chemically synthesized
ctctgactcatcaatggtgtac

SEQ ID NO: 1009382 - DNA, 22 bp, Artificial Sequence
  chemically synthesized
tgactcatcaatggtgtaccga

SEQ ID NO: 1009383 - DNA, 22 bp, Artificial Sequence
  chemically synthesized
actcatcaatggtgtaccgacc

SEQ ID NO: 1009384 - DNA, 22 bp, Artificial Sequence
  chemically synthesized
atagatataatagaggtcggta

SEQ ID NO: 1009385 - DNA, 22 bp, Artificial Sequence
  chemically synthesized
atcaatggtgtaccgacctcta

SEQ ID NO: 1009386 - DNA, 22 bp, Artificial Sequence
  chemically synthesized
agccataaaaatagcatctaat

SEQ ID NO: 1009387 - DNA, 22 bp, Artificial Sequence
  chemically synthesized
aagccataaaaatagcatctaa

SEQ ID NO: 1009388 - DNA, 22 bp, Artificial Sequence
  chemically synthesized
tattatatctattagatgctat

SEQ ID NO: 1009389 - DNA, 22 bp, Artificial Sequence
  chemically synthesized
ttatatctattagatgctattt

SEQ ID NO: 1009390 - DNA, 22 bp, Artificial Sequence
  chemically synthesized
tatctattagatgctattttta

SEQ ID NO: 1009391 - DNA, 22 bp, Artificial Sequence
  chemically synthesized
ttagatgctatttttatggctt

SEQ ID NO: 1009392 - DNA, 22 bp, Artificial Sequence
  chemically synthesized
gcaaatggacatttaagccata

SEQ ID NO: 1009393 - DNA, 22 bp, Artificial Sequence
  chemically synthesized
gatgctatttttatggcttaaa

SEQ ID NO: 1009394 - DNA, 22 bp, Artificial Sequence
  chemically synthesized
tttttatggcttaaatgtccat

SEQ ID NO: 1009395 - DNA, 22 bp, Artificial Sequence
  chemically synthesized
ttatggcttaaatgtccatttg

SEQ ID NO: 1009396 - DNA, 22 bp, Artificial Sequence
  chemically synthesized
tatggcttaaatgtccatttgc

SEQ ID NO: 1009397 - DNA, 22 bp, Artificial Sequence
  chemically synthesized
atggcttaaatgtccatttgct

SEQ ID NO: 1009398 - DNA, 22 bp, Artificial Sequence
  chemically synthesized
agtggtataattagcaaatgga

SEQ ID NO: 1009399 - DNA, 22 bp, Artificial Sequence
  chemically synthesized
tggcttaaatgtccatttgcta

SEQ ID NO: 1009400 - DNA, 22 bp, Artificial Sequence
  chemically synthesized
aagtggtataattagcaaatgg

SEQ ID NO: 1009401 - DNA, 22 bp, Artificial Sequence
  chemically synthesized
aaatgtccatttgctaattata

SEQ ID NO: 1009402 - DNA, 22 bp, Artificial Sequence
  chemically synthesized
aatgtccatttgctaattatac

SEQ ID NO: 1009403 - DNA, 22 bp, Artificial Sequence
  chemically synthesized
aaacatttaagtggtataatta

SEQ ID NO: 1009404 - DNA, 22 bp, Artificial Sequence
  chemically synthesized
aacaattgaaacatttaagtgg

SEQ ID NO: 1009405 - DNA, 22 bp, Artificial Sequence
  chemically synthesized
aaacaattgaaacatttaagtg

SEQ ID NO: 1009406 - DNA, 22 bp, Artificial Sequence
  chemically synthesized
gctaattataccacttaaatgt

SEQ ID NO: 1009407 - DNA, 22 bp, Artificial Sequence
  chemically synthesized
ctaattataccacttaaatgtt

SEQ ID NO: 1009408 - DNA, 22 bp, Artificial Sequence
  chemically synthesized
attataccacttaaatgtttca

SEQ ID NO: 1009409 - DNA, 22 bp, Artificial Sequence
  chemically synthesized
taccacttaaatgtttcaattg

SEQ ID NO: 1009410 - DNA, 22 bp, Artificial Sequence
  chemically synthesized
atggacatttaaacaattgaaa

SEQ ID NO: 1009411 - DNA, 22 bp, Artificial Sequence
  chemically synthesized
aaattgatggacatttaaacaa

SEQ ID NO: 1009412 - DNA, 22 bp, Artificial Sequence
  chemically synthesized
aaatgtttcaattgtttaaatg

SEQ ID NO: 1009413 - DNA, 22 bp, Artificial Sequence
  chemically synthesized
aatgtttcaattgtttaaatgt

SEQ ID NO: 1009414 - DNA, 22 bp, Artificial Sequence
  chemically synthesized
ctgaaattgatggacatttaaa

SEQ ID NO: 1009415 - DNA, 22 bp, Artificial Sequence
  chemically synthesized
gctgaaattgatggacatttaa

SEQ ID NO: 1009416 - DNA, 22 bp, Artificial Sequence
  chemically synthesized
caattgtttaaatgtccatcaa

SEQ ID NO: 1009417 - DNA, 22 bp, Artificial Sequence
  chemically synthesized
aattgtttaaatgtccatcaat

SEQ ID NO: 1009418 - DNA, 22 bp, Artificial Sequence
  chemically synthesized
tttaaatgtccatcaatttcag

SEQ ID NO: 1009419 - DNA, 22 bp, Artificial Sequence
  chemically synthesized
aaatgtccatcaatttcagcaa

SEQ ID NO: 1009420 - DNA, 22 bp, Artificial Sequence
  chemically synthesized
aatgtccatcaatttcagcaaa

SEQ ID NO: 1009421 - DNA, 22 bp, Artificial Sequence
  chemically synthesized
acatataatccaaggtttgctg

SEQ ID NO: 1009422 - DNA, 22 bp, Artificial Sequence
  chemically synthesized
ttcacatataatccaaggtttg

SEQ ID NO: 1009423 - DNA, 22 bp, Artificial Sequence
  chemically synthesized
acctattcacatataatccaag

SEQ ID NO: 1009424 - DNA, 22 bp, Artificial Sequence
  chemically synthesized
cagcaaaccttggattatatgt

SEQ ID NO: 1009425 - DNA, 22 bp, Artificial Sequence
  chemically synthesized
agcaaaccttggattatatgtg

SEQ ID NO: 1009426 - DNA, 22 bp, Artificial Sequence
  chemically synthesized
atacaatcctaacctattcaca

SEQ ID NO: 1009427 - DNA, 22 bp, Artificial Sequence
  chemically synthesized
ggattatatgtgaataggttag

SEQ ID NO: 1009428 - DNA, 22 bp, Artificial Sequence
  chemically synthesized
gattatatgtgaataggttagg

SEQ ID NO: 1009429 - DNA, 22 bp, Artificial Sequence
  chemically synthesized
aaattgatacaatcctaaccta

SEQ ID NO: 1009430 - DNA, 22 bp, Artificial Sequence
  chemically synthesized
tatgtgaataggttaggattgt

SEQ ID NO: 1009431 - DNA, 22 bp, Artificial Sequence
  chemically synthesized
aggatattgaaattgatacaat

SEQ ID NO: 1009432 - DNA, 22 bp, Artificial Sequence
  chemically synthesized
ggtgctcaggatattgaaattg

SEQ ID NO: 1009433 - DNA, 22 bp, Artificial Sequence
  chemically synthesized
ggattgtatcaatttcaatatc

SEQ ID NO: 1009434 - DNA, 22 bp, Artificial Sequence
  chemically synthesized
tgctaggtgctcaggatattga

SEQ ID NO: 1009435 - DNA, 22 bp, Artificial Sequence
  chemically synthesized
tatgctaggtgctcaggatatt

SEQ ID NO: 1009436 - DNA, 22 bp, Artificial Sequence
  chemically synthesized
tatcaatttcaatatcctgagc

SEQ ID NO: 1009437 - DNA, 22 bp, Artificial Sequence
  chemically synthesized
tgtcaggctctatgctaggtgc

SEQ ID NO: 1009438 - DNA, 22 bp, Artificial Sequence
  chemically synthesized
caatatcctgagcacctagcat

SEQ ID NO: 1009439 - DNA, 22 bp, Artificial Sequence
  chemically synthesized
aatatcctgagcacctagcata

SEQ ID NO: 1009440 - DNA, 22 bp, Artificial Sequence
  chemically synthesized
tgtgtcaggctctatgctaggt

SEQ ID NO: 1009441 - DNA, 22 bp, Artificial Sequence
  chemically synthesized
ctctgtgtcaggctctatgcta

SEQ ID NO: 1009442 - DNA, 22 bp, Artificial Sequence
  chemically synthesized
agcacctagcatagagcctgac

SEQ ID NO: 1009443 - DNA, 22 bp, Artificial Sequence
  chemically synthesized
gagctgctctgtgtcaggctct

SEQ ID NO: 1009444 - DNA, 22 bp, Artificial Sequence
  chemically synthesized
ggagctgctctgtgtcaggctc

SEQ ID NO: 1009445 - DNA, 22 bp, Artificial Sequence
  chemically synthesized
tggagctgctctgtgtcaggct

SEQ ID NO: 1009446 - DNA, 22 bp, Artificial Sequence
  chemically synthesized
ttggagctgctctgtgtcaggc

SEQ ID NO: 1009447 - DNA, 22 bp, Artificial Sequence
  chemically synthesized
cttttggagctgctctgtgtca

SEQ ID NO: 1009448 - DNA, 22 bp, Artificial Sequence
  chemically synthesized
acttttggagctgctctgtgtc

SEQ ID NO: 1009449 - DNA, 22 bp, Artificial Sequence
  chemically synthesized
gcatagagcctgacacagagca

SEQ ID NO: 1009450 - DNA, 22 bp, Artificial Sequence
  chemically synthesized
tacttttggagctgctctgtgt

SEQ ID NO: 1009451 - DNA, 22 bp, Artificial Sequence
  chemically synthesized
ttacttttggagctgctctgtg

SEQ ID NO: 1009452 - DNA, 22 bp, Artificial Sequence
  chemically synthesized
agaaaacttttacttttggagc

SEQ ID NO: 1009453 - DNA, 22 bp, Artificial Sequence
  chemically synthesized
acacagagcagctccaaaagta

SEQ ID NO: 1009454 - DNA, 22 bp, Artificial Sequence
  chemically synthesized
ttcagaaaacttttacttttgg

SEQ ID NO: 1009455 - DNA, 22 bp, Artificial Sequence
  chemically synthesized
attcagaaaacttttacttttg

SEQ ID NO: 1009456 - DNA, 22 bp, Artificial Sequence
  chemically synthesized
caaaagtaaaagttttctgaat

SEQ ID NO: 1009457 - DNA, 22 bp, Artificial Sequence
  chemically synthesized
acatcaacacatttattcagaa

SEQ ID NO: 1009458 - DNA, 22 bp, Artificial Sequence
  chemically synthesized
aacatcaacacatttattcaga

SEQ ID NO: 1009459 - DNA, 22 bp, Artificial Sequence
  chemically synthesized
taacatcaacacatttattcag

SEQ ID NO: 1009460 - DNA, 22 bp, Artificial Sequence
  chemically synthesized
acctttaacatcaacacattta

SEQ ID NO: 1009461 - DNA, 22 bp, Artificial Sequence
  chemically synthesized
acctaacctttaacatcaacac

SEQ ID NO: 1009462 - DNA, 22 bp, Artificial Sequence
  chemically synthesized
tctgaataaatgtgttgatgtt

SEQ ID NO: 1009463 - DNA, 22 bp, Artificial Sequence
  chemically synthesized
cacctaacctttaacatcaaca

SEQ ID NO: 1009464 - DNA, 22 bp, Artificial Sequence
  chemically synthesized
ctgaataaatgtgttgatgtta

SEQ ID NO: 1009465 - DNA, 22 bp, Artificial Sequence
  chemically synthesized
tgaataaatgtgttgatgttaa

SEQ ID NO: 1009466 - DNA, 22 bp, Artificial Sequence
  chemically synthesized
aataaatgtgttgatgttaaag

SEQ ID NO: 1009467 - DNA, 22 bp, Artificial Sequence
  chemically synthesized
catttcacctaacctttaacat

SEQ ID NO: 1009468 - DNA, 22 bp, Artificial Sequence
  chemically synthesized
tacatttcacctaacctttaac

SEQ ID NO: 1009469 - DNA, 22 bp, Artificial Sequence
  chemically synthesized
tctacatttcacctaaccttta

SEQ ID NO: 1009470 - DNA, 22 bp, Artificial Sequence
  chemically synthesized
ctctacatttcacctaaccttt

SEQ ID NO: 1009471 - DNA, 22 bp, Artificial Sequence
  chemically synthesized
acacttctctacatttcaccta

SEQ ID NO: 1009472 - DNA, 22 bp, Artificial Sequence
  chemically synthesized
atgttaaaggttaggtgaaatg

SEQ ID NO: 1009473 - DNA, 22 bp, Artificial Sequence
  chemically synthesized
gacacttctctacatttcacct

SEQ ID NO: 1009474 - DNA, 22 bp, Artificial Sequence
  chemically synthesized
tgacacttctctacatttcacc

SEQ ID NO: 1009475 - DNA, 22 bp, Artificial Sequence
  chemically synthesized
aaggttaggtgaaatgtagaga

SEQ ID NO: 1009476 - DNA, 22 bp, Artificial Sequence
  chemically synthesized
tgtactttgacacttctctaca

SEQ ID NO: 1009477 - DNA, 22 bp, Artificial Sequence
  chemically synthesized
gtgtactttgacacttctctac

SEQ ID NO: 1009478 - DNA, 22 bp, Artificial Sequence
  chemically synthesized
ggtgaaatgtagagaagtgtca

SEQ ID NO: 1009479 - DNA, 22 bp, Artificial Sequence
  chemically synthesized
aacatcttgtgtactttgacac

SEQ ID NO: 1009480 - DNA, 22 bp, Artificial Sequence
  chemically synthesized
gaaaacctgaacatcttgtgta

SEQ ID NO: 1009481 - DNA, 22 bp, Artificial Sequence
  chemically synthesized
agaaaacctgaacatcttgtgt

SEQ ID NO: 1009482 - DNA, 22 bp, Artificial Sequence
  chemically synthesized
tcttagaaaacctgaacatctt

SEQ ID NO: 1009483 - DNA, 22 bp, Artificial Sequence
  chemically synthesized
atcttagaaaacctgaacatct

SEQ ID NO: 1009484 - DNA, 22 bp, Artificial Sequence
  chemically synthesized
tatcttagaaaacctgaacatc

SEQ ID NO: 1009485 - DNA, 22 bp, Artificial Sequence
  chemically synthesized
cctttatcttagaaaacctgaa

SEQ ID NO: 1009486 - DNA, 22 bp, Artificial Sequence
  chemically synthesized
aggttttctaagataaaggtaa

SEQ ID NO: 1009487 - DNA, 22 bp, Artificial Sequence
  chemically synthesized
tctaagataaaggtaatctccc

SEQ ID NO: 1009488 - DNA, 22 bp, Artificial Sequence
  chemically synthesized
ctaagataaaggtaatctccct

SEQ ID NO: 1009489 - DNA, 22 bp, Artificial Sequence
  chemically synthesized
taagataaaggtaatctccctg

SEQ ID NO: 1009490 - DNA, 22 bp, Artificial Sequence
  chemically synthesized
agataaaggtaatctccctggt

SEQ ID NO: 1009491 - DNA, 22 bp, Artificial Sequence
  chemically synthesized
tgcaggacagaatcacaccagg

SEQ ID NO: 1009492 - DNA, 22 bp, Artificial Sequence
  chemically synthesized
cctggtgtgattctgtcctgca

SEQ ID NO: 1009493 - DNA, 22 bp, Artificial Sequence
  chemically synthesized
aagagaacagctgtgcaggaca

SEQ ID NO: 1009494 - DNA, 22 bp, Artificial Sequence
  chemically synthesized
gtgtgattctgtcctgcacagc

SEQ ID NO: 1009495 - DNA, 22 bp, Artificial Sequence
  chemically synthesized
ctcaagagaacagctgtgcagg

SEQ ID NO: 1009496 - DNA, 22 bp, Artificial Sequence
  chemically synthesized
tgtcctgcacagctgttctctt

SEQ ID NO: 1009497 - DNA, 22 bp, Artificial Sequence
  chemically synthesized
tcctgcacagctgttctcttga

SEQ ID NO: 1009498 - DNA, 22 bp, Artificial Sequence
  chemically synthesized
cacagctgttctcttgagcagt

SEQ ID NO: 1009499 - DNA, 22 bp, Artificial Sequence
  chemically synthesized
ttctcttgagcagtggtccttt

SEQ ID NO: 1009500 - DNA, 22 bp, Artificial Sequence
  chemically synthesized
tcttgagcagtggtcctttatc

SEQ ID NO: 1009501 - DNA, 22 bp, Artificial Sequence
  chemically synthesized
ttgagcagtggtcctttatcat

SEQ ID NO: 1009502 - DNA, 22 bp, Artificial Sequence
  chemically synthesized
gagcagtggtcctttatcatca

SEQ ID NO: 1009503 - DNA, 22 bp, Artificial Sequence
  chemically synthesized
agcagtggtcctttatcatcat

SEQ ID NO: 1009504 - DNA, 22 bp, Artificial Sequence
  chemically synthesized
ggtgggagagaaggcagatgat

SEQ ID NO: 1009505 - DNA, 22 bp, Artificial Sequence
  chemically synthesized
aggtgggagagaaggcagatga

SEQ ID NO: 1009506 - DNA, 22 bp, Artificial Sequence
  chemically synthesized
tatcatcatctgccttctctcc

SEQ ID NO: 1009507 - DNA, 22 bp, Artificial Sequence
  chemically synthesized
atcatcatctgccttctctccc

SEQ ID NO: 1009508 - DNA, 22 bp, Artificial Sequence
  chemically synthesized
tcatcatctgccttctctccca

SEQ ID NO: 1009509 - DNA, 22 bp, Artificial Sequence
  chemically synthesized
ccttctctcccacctaagtgcg

SEQ ID NO: 1009510 - DNA, 22 bp, Artificial Sequence
  chemically synthesized
ctctcccacctaagtgcgtcct

SEQ ID NO: 1009511 - DNA, 22 bp, Artificial Sequence
  chemically synthesized
tctcccacctaagtgcgtcctg

SEQ ID NO: 1009512 - DNA, 22 bp, Artificial Sequence
  chemically synthesized
tcccacctaagtgcgtcctgcc

SEQ ID NO: 1009513 - DNA, 22 bp, Artificial Sequence
  chemically synthesized
ccacctaagtgcgtcctgccac

SEQ ID NO: 1009514 - DNA, 22 bp, Artificial Sequence
  chemically synthesized
agtgcgtcctgccacctgatgg

SEQ ID NO: 1009515 - DNA, 22 bp, Artificial Sequence
  chemically synthesized
atgtccatcatcgtccatcagg

SEQ ID NO: 1009516 - DNA, 22 bp, Artificial Sequence
  chemically synthesized
ccacctgatggacgatgatgga

SEQ ID NO: 1009517 - DNA, 22 bp, Artificial Sequence
  chemically synthesized
agaggactcatgtccatcatcg

SEQ ID NO: 1009518 - DNA, 22 bp, Artificial Sequence
  chemically synthesized
atggacgatgatggacatgagt

SEQ ID NO: 1009519 - DNA, 22 bp, Artificial Sequence
  chemically synthesized
gggcctcagaggactcatgtcc

SEQ ID NO: 1009520 - DNA, 22 bp, Artificial Sequence
  chemically synthesized
ggggcctcagaggactcatgtc

SEQ ID NO: 1009521 - DNA, 22 bp, Artificial Sequence
  chemically synthesized
tggggcctcagaggactcatgt

SEQ ID NO: 1009522 - DNA, 22 bp, Artificial Sequence
  chemically synthesized
acaaccaaaaagatagttttgg

SEQ ID NO: 1009523 - DNA, 22 bp, Artificial Sequence
  chemically synthesized
gttcacaaccaaaaagatagtt

SEQ ID NO: 1009524 - DNA, 22 bp, Artificial Sequence
  chemically synthesized
tgaggccccaaaactatctttt

SEQ ID NO: 1009525 - DNA, 22 bp, Artificial Sequence
  chemically synthesized
agttcacaaccaaaaagatagt

SEQ ID NO: 1009526 - DNA, 22 bp, Artificial Sequence
  chemically synthesized
tagttcacaaccaaaaagatag

SEQ ID NO: 1009527 - DNA, 22 bp, Artificial Sequence
  chemically synthesized
aggccccaaaactatctttttg

SEQ ID NO: 1009528 - DNA, 22 bp, Artificial Sequence
  chemically synthesized
tcggcctttagttcacaaccaa

SEQ ID NO: 1009529 - DNA, 22 bp, Artificial Sequence
  chemically synthesized
gtcggcctttagttcacaacca

SEQ ID NO: 1009530 - DNA, 22 bp, Artificial Sequence
  chemically synthesized
tgtcggcctttagttcacaacc

SEQ ID NO: 1009531 - DNA, 22 bp, Artificial Sequence
  chemically synthesized
tctttttggttgtgaactaaag

SEQ ID NO: 1009532 - DNA, 22 bp, Artificial Sequence
  chemically synthesized
tttggttgtgaactaaaggccg

SEQ ID NO: 1009533 - DNA, 22 bp, Artificial Sequence
  chemically synthesized
ttggttgtgaactaaaggccga

SEQ ID NO: 1009534 - DNA, 22 bp, Artificial Sequence
  chemically synthesized
tggttgtgaactaaaggccgac

SEQ ID NO: 1009535 - DNA, 22 bp, Artificial Sequence
  chemically synthesized
ggttgtgaactaaaggccgaca

SEQ ID NO: 1009536 - DNA, 22 bp, Artificial Sequence
  chemically synthesized
gttgtgaactaaaggccgacaa

SEQ ID NO: 1009537 - DNA, 22 bp, Artificial Sequence
  chemically synthesized
aagtgatcatctttgtcggcct

SEQ ID NO: 1009538 - DNA, 22 bp, Artificial Sequence
  chemically synthesized
aaagtgatcatctttgtcggcc

SEQ ID NO: 1009539 - DNA, 22 bp, Artificial Sequence
  chemically synthesized
tgaactaaaggccgacaaagat

SEQ ID NO: 1009540 - DNA, 22 bp, Artificial Sequence
  chemically synthesized
tccaccttaaagtgatcatctt

SEQ ID NO: 1009541 - DNA, 22 bp, Artificial Sequence
  chemically synthesized
aaggccgacaaagatgatcact

SEQ ID NO: 1009542 - DNA, 22 bp, Artificial Sequence
  chemically synthesized
ttatccaccttaaagtgatcat

SEQ ID NO: 1009543 - DNA, 22 bp, Artificial Sequence
  chemically synthesized
attattatccaccttaaagtga

SEQ ID NO: 1009544 - DNA, 22 bp, Artificial Sequence
  chemically synthesized
cattattatccaccttaaagtg

SEQ ID NO: 1009545 - DNA, 22 bp, Artificial Sequence
  chemically synthesized
aatttcattattatccacctta

SEQ ID NO: 1009546 - DNA, 22 bp, Artificial Sequence
  chemically synthesized
ctcaatttcattattatccacc

SEQ ID NO: 1009547 - DNA, 22 bp, Artificial Sequence
  chemically synthesized
ttgctcaatttcattattatcc

SEQ ID NO: 1009548 - DNA, 22 bp, Artificial Sequence
  chemically synthesized
taaggtggataataatgaaatt

SEQ ID NO: 1009549 - DNA, 22 bp, Artificial Sequence
  chemically synthesized
aaggtggataataatgaaattg

SEQ ID NO: 1009550 - DNA, 22 bp, Artificial Sequence
  chemically synthesized
aggtggataataatgaaattga

SEQ ID NO: 1009551 - DNA, 22 bp, Artificial Sequence
  chemically synthesized
aagataactgttgctcaatttc

SEQ ID NO: 1009552 - DNA, 22 bp, Artificial Sequence
  chemically synthesized
aaagataactgttgctcaattt

SEQ ID NO: 1009553 - DNA, 22 bp, Artificial Sequence
  chemically synthesized
ttaaagataactgttgctcaat

SEQ ID NO: 1009554 - DNA, 22 bp, Artificial Sequence
  chemically synthesized
accgttcttaaagataactgtt

SEQ ID NO: 1009555 - DNA, 22 bp, Artificial Sequence
  chemically synthesized
aactgaccgttcttaaagataa

SEQ ID NO: 1009556 - DNA, 22 bp, Artificial Sequence
  chemically synthesized
agcaacagttatctttaagaac

SEQ ID NO: 1009557 - DNA, 22 bp, Artificial Sequence
  chemically synthesized
ccccagcccctaaactgaccgt

SEQ ID NO: 1009558 - DNA, 22 bp, Artificial Sequence
  chemically synthesized
gccccagcccctaaactgaccg

SEQ ID NO: 1009559 - DNA, 22 bp, Artificial Sequence
  chemically synthesized
tgccccagcccctaaactgacc

SEQ ID NO: 1009560 - DNA, 22 bp, Artificial Sequence
  chemically synthesized
tctttaagaacggtcagtttag

SEQ ID NO: 1009561 - DNA, 22 bp, Artificial Sequence
  chemically synthesized
taagaacggtcagtttaggggc

SEQ ID NO: 1009562 - DNA, 22 bp, Artificial Sequence
  chemically synthesized
tcctttgccccagcccctaaac

SEQ ID NO: 1009563 - DNA, 22 bp, Artificial Sequence
  chemically synthesized
aagaacggtcagtttaggggct

SEQ ID NO: 1009564 - DNA, 22 bp, Artificial Sequence
  chemically synthesized
atcctttgccccagcccctaaa

SEQ ID NO: 1009565 - DNA, 22 bp, Artificial Sequence
  chemically synthesized
agaacggtcagtttaggggctg

SEQ ID NO: 1009566 - DNA, 22 bp, Artificial Sequence
  chemically synthesized
aggggctggggcaaaggataaa

SEQ ID NO: 1009567 - DNA, 22 bp, Artificial Sequence
  chemically synthesized
aacaatgtgcaatttatccttt

SEQ ID NO: 1009568 - DNA, 22 bp, Artificial Sequence
  chemically synthesized
ggggctggggcaaaggataaat

SEQ ID NO: 1009569 - DNA, 22 bp, Artificial Sequence
  chemically synthesized
caacaatgtgcaatttatcctt

SEQ ID NO: 1009570 - DNA, 22 bp, Artificial Sequence
  chemically synthesized
cttcaacaatgtgcaatttatc

SEQ ID NO: 1009571 - DNA, 22 bp, Artificial Sequence
  chemically synthesized
tgcttcaacaatgtgcaattta

SEQ ID NO: 1009572 - DNA, 22 bp, Artificial Sequence
  chemically synthesized
gggcaaaggataaattgcacat

SEQ ID NO: 1009573 - DNA, 22 bp, Artificial Sequence
  chemically synthesized
cctctgcttcaacaatgtgcaa

SEQ ID NO: 1009574 - DNA, 22 bp, Artificial Sequence
  chemically synthesized
attgcctctgcttcaacaatgt

SEQ ID NO: 1009575 - DNA, 22 bp, Artificial Sequence
  chemically synthesized
taactcattgcctctgcttcaa

SEQ ID NO: 1009576 - DNA, 22 bp, Artificial Sequence
  chemically synthesized
gtaactcattgcctctgcttca

SEQ ID NO: 1009577 - DNA, 22 bp, Artificial Sequence
  chemically synthesized
tgtaactcattgcctctgcttc

SEQ ID NO: 1009578 - DNA, 22 bp, Artificial Sequence
  chemically synthesized
cacattgttgaagcagaggcaa

SEQ ID NO: 1009579 - DNA, 22 bp, Artificial Sequence
  chemically synthesized
cctttgtaactcattgcctctg

SEQ ID NO: 1009580 - DNA, 22 bp, Artificial Sequence
  chemically synthesized
gactgcctttgtaactcattgc

SEQ ID NO: 1009581 - DNA, 22 bp, Artificial Sequence
  chemically synthesized
ttgaagcagaggcaatgagtta

SEQ ID NO: 1009582 - DNA, 22 bp, Artificial Sequence
  chemically synthesized
aagcagaggcaatgagttacaa

SEQ ID NO: 1009583 - DNA, 22 bp, Artificial Sequence
  chemically synthesized
attggactgcctttgtaactca

SEQ ID NO: 1009584 - DNA, 22 bp, Artificial Sequence
  chemically synthesized
aattggactgcctttgtaactc

SEQ ID NO: 1009585 - DNA, 22 bp, Artificial Sequence
  chemically synthesized
taattggactgcctttgtaact

SEQ ID NO: 1009586 - DNA, 22 bp, Artificial Sequence
  chemically synthesized
ctttaattggactgcctttgta

SEQ ID NO: 1009587 - DNA, 22 bp, Artificial Sequence
  chemically synthesized
ccagtgttactttaattggact

SEQ ID NO: 1009588 - DNA, 22 bp, Artificial Sequence
  chemically synthesized
caaaggcagtccaattaaagta

SEQ ID NO: 1009589 - DNA, 22 bp, Artificial Sequence
  chemically synthesized
aaagctgccagtgttactttaa

SEQ ID NO: 1009590 - DNA, 22 bp, Artificial Sequence
  chemically synthesized
caaagctgccagtgttacttta

SEQ ID NO: 1009591 - DNA, 22 bp, Artificial Sequence
  chemically synthesized
tcaaagctgccagtgttacttt

SEQ ID NO: 1009592 - DNA, 22 bp, Artificial Sequence
  chemically synthesized
tacagacattttcaaagctgcc

SEQ ID NO: 1009593 - DNA, 22 bp, Artificial Sequence
  chemically synthesized
aagtaacactggcagctttgaa

SEQ ID NO: 1009594 - DNA, 22 bp, Artificial Sequence
  chemically synthesized
gcagctttgaaaatgtctgtac

SEQ ID NO: 1009595 - DNA, 22 bp, Artificial Sequence
  chemically synthesized
aagggaaaccatgggctgtaca

SEQ ID NO: 1009596 - DNA, 22 bp, Artificial Sequence
  chemically synthesized
tgaaaatgtctgtacagcccat

SEQ ID NO: 1009597 - DNA, 22 bp, Artificial Sequence
  chemically synthesized
gaaaatgtctgtacagcccatg

SEQ ID NO: 1009598 - DNA, 22 bp, Artificial Sequence
  chemically synthesized
aaaatgtctgtacagcccatgg

SEQ ID NO: 1009599 - DNA, 22 bp, Artificial Sequence
  chemically synthesized
aaagccctcaagggaaaccatg

SEQ ID NO: 1009600 - DNA, 22 bp, Artificial Sequence
  chemically synthesized
caaagccctcaagggaaaccat

SEQ ID NO: 1009601 - DNA, 22 bp, Artificial Sequence
  chemically synthesized
tttcaaagccctcaagggaaac

SEQ ID NO: 1009602 - DNA, 22 bp, Artificial Sequence
  chemically synthesized
tacagcccatggtttcccttga

SEQ ID NO: 1009603 - DNA, 22 bp, Artificial Sequence
  chemically synthesized
atggtgttatttcaaagccctc

SEQ ID NO: 1009604 - DNA, 22 bp, Artificial Sequence
  chemically synthesized
cccttgagggctttgaaataac

SEQ ID NO: 1009605 - DNA, 22 bp, Artificial Sequence
  chemically synthesized
ccttgagggctttgaaataaca

SEQ ID NO: 1009606 - DNA, 22 bp, Artificial Sequence
  chemically synthesized
gagggctttgaaataacaccat

SEQ ID NO: 1009607 - DNA, 22 bp, Artificial Sequence
  chemically synthesized
agggctttgaaataacaccatc

SEQ ID NO: 1009608 - DNA, 22 bp, Artificial Sequence
  chemically synthesized
aaccgtaagaccactgatggtg

SEQ ID NO: 1009609 - DNA, 22 bp, Artificial Sequence
  chemically synthesized
caaccgtaagaccactgatggt

SEQ ID NO: 1009610 - DNA, 22 bp, Artificial Sequence
  chemically synthesized
tgaaataacaccatcagtggtc

SEQ ID NO: 1009611 - DNA, 22 bp, Artificial Sequence
  chemically synthesized
gaaataacaccatcagtggtct

SEQ ID NO: 1009612 - DNA, 22 bp, Artificial Sequence
  chemically synthesized
aaataacaccatcagtggtctt

SEQ ID NO: 1009613 - DNA, 22 bp, Artificial Sequence
  chemically synthesized
aaccacacttcaaccgtaagac

SEQ ID NO: 1009614 - DNA, 22 bp, Artificial Sequence
  chemically synthesized
gccctgaaccacacttcaaccg

SEQ ID NO: 1009615 - DNA, 22 bp, Artificial Sequence
  chemically synthesized
acatgcactggccctgaaccac

SEQ ID NO: 1009616 - DNA, 22 bp, Artificial Sequence
  chemically synthesized
acggttgaagtgtggttcaggg

SEQ ID NO: 1009617 - DNA, 22 bp, Artificial Sequence
  chemically synthesized
cggttgaagtgtggttcagggc

SEQ ID NO: 1009618 - DNA, 22 bp, Artificial Sequence
  chemically synthesized
tccactcacatgcactggccct

SEQ ID NO: 1009619 - DNA, 22 bp, Artificial Sequence
  chemically synthesized
aagtgtggttcagggccagtgc

SEQ ID NO: 1009620 - DNA, 22 bp, Artificial Sequence
  chemically synthesized
aatgctgtccactcacatgcac

SEQ ID NO: 1009621 - DNA, 22 bp, Artificial Sequence
  chemically synthesized
ctaaatgctgtccactcacatg

SEQ ID NO: 1009622 - DNA, 22 bp, Artificial Sequence
  chemically synthesized
agggccagtgcatgtgagtgga

SEQ ID NO: 1009623 - DNA, 22 bp, Artificial Sequence
  chemically synthesized
cccagctactaaatgctgtcca

SEQ ID NO: 1009624 - DNA, 22 bp, Artificial Sequence
  chemically synthesized
ctccccagctactaaatgctgt

SEQ ID NO: 1009625 - DNA, 22 bp, Artificial Sequence
  chemically synthesized
cctccccagctactaaatgctg

SEQ ID NO: 1009626 - DNA, 22 bp, Artificial Sequence
  chemically synthesized
tatcttcctccccagctactaa

SEQ ID NO: 1009627 - DNA, 22 bp, Artificial Sequence
  chemically synthesized
tgtatcttcctccccagctact

SEQ ID NO: 1009628 - DNA, 22 bp, Artificial Sequence
  chemically synthesized
actctgtatcttcctccccagc

SEQ ID NO: 1009629 - DNA, 22 bp, Artificial Sequence
  chemically synthesized
tgactctgtatcttcctcccca

SEQ ID NO: 1009630 - DNA, 22 bp, Artificial Sequence
  chemically synthesized
ctgactctgtatcttcctcccc

SEQ ID NO: 1009631 - DNA, 22 bp, Artificial Sequence
  chemically synthesized
agtagctggggaggaagataca

SEQ ID NO: 1009632 - DNA, 22 bp, Artificial Sequence
  chemically synthesized
gtcttctgactctgtatcttcc

SEQ ID NO: 1009633 - DNA, 22 bp, Artificial Sequence
  chemically synthesized
gtagctggggaggaagatacag

SEQ ID NO: 1009634 - DNA, 22 bp, Artificial Sequence
  chemically synthesized
ttcgtcttctgactctgtatct

SEQ ID NO: 1009635 - DNA, 22 bp, Artificial Sequence
  chemically synthesized
ctgttcgtcttctgactctgta

SEQ ID NO: 1009636 - DNA, 22 bp, Artificial Sequence
  chemically synthesized
gggaggaagatacagagtcaga

SEQ ID NO: 1009637 - DNA, 22 bp, Artificial Sequence
  chemically synthesized
ctcctgttcgtcttctgactct

SEQ ID NO: 1009638 - DNA, 22 bp, Artificial Sequence
  chemically synthesized
acatcctcctcctgttcgtctt

SEQ ID NO: 1009639 - DNA, 22 bp, Artificial Sequence
  chemically synthesized
cacatcctcctcctgttcgtct

SEQ ID NO: 1009640 - DNA, 22 bp, Artificial Sequence
  chemically synthesized
tgagtttcacatcctcctcctg

SEQ ID NO: 1009641 - DNA, 22 bp, Artificial Sequence
  chemically synthesized
atgagtttcacatcctcctcct

SEQ ID NO: 1009642 - DNA, 22 bp, Artificial Sequence
  chemically synthesized
cagatatacttatgagtttcac

SEQ ID NO: 1009643 - DNA, 22 bp, Artificial Sequence
  chemically synthesized
ccagatatacttatgagtttca

SEQ ID NO: 1009644 - DNA, 22 bp, Artificial Sequence
  chemically synthesized
tccagatatacttatgagtttc

SEQ ID NO: 1009645 - DNA, 22 bp, Artificial Sequence
  chemically synthesized
caggagcagatcgctttccaga

SEQ ID NO: 1009646 - DNA, 22 bp, Artificial Sequence
  chemically synthesized
ataagtatatctggaaagcgat

SEQ ID NO: 1009647 - DNA, 22 bp, Artificial Sequence
  chemically synthesized
ccacctccaggagcagatcgct

SEQ ID NO: 1009648 - DNA, 22 bp, Artificial Sequence
  chemically synthesized
ctaccacctccaggagcagatc

SEQ ID NO: 1009649 - DNA, 22 bp, Artificial Sequence
  chemically synthesized
gctaccacctccaggagcagat

SEQ ID NO: 1009650 - DNA, 22 bp, Artificial Sequence
  chemically synthesized
gaaagcgatctgctcctggagg

SEQ ID NO: 1009651 - DNA, 22 bp, Artificial Sequence
  chemically synthesized
tggaaccttgctaccacctcca

SEQ ID NO: 1009652 - DNA, 22 bp, Artificial Sequence
  chemically synthesized
tgtggaaccttgctaccacctc

SEQ ID NO: 1009653 - DNA, 22 bp, Artificial Sequence
  chemically synthesized
ctgtggaaccttgctaccacct

SEQ ID NO: 1009654 - DNA, 22 bp, Artificial Sequence
  chemically synthesized
tctgtggaaccttgctaccacc

SEQ ID NO: 1009655 - DNA, 22 bp, Artificial Sequence
  chemically synthesized
ttctgtggaaccttgctaccac

SEQ ID NO: 1009656 - DNA, 22 bp, Artificial Sequence
  chemically synthesized
tttctgtggaaccttgctacca

SEQ ID NO: 1009657 - DNA, 22 bp, Artificial Sequence
  chemically synthesized
ttttctgtggaaccttgctacc

SEQ ID NO: 1009658 - DNA, 22 bp, Artificial Sequence
  chemically synthesized
ctcctggaggtggtagcaaggt

SEQ ID NO: 1009659 - DNA, 22 bp, Artificial Sequence
  chemically synthesized
cttttttctgtggaaccttgct

SEQ ID NO: 1009660 - DNA, 22 bp, Artificial Sequence
  chemically synthesized
ctggaggtggtagcaaggttcc

SEQ ID NO: 1009661 - DNA, 22 bp, Artificial Sequence
  chemically synthesized
acttttttctgtggaaccttgc

SEQ ID NO: 1009662 - DNA, 22 bp, Artificial Sequence
  chemically synthesized
tacttttttctgtggaaccttg

SEQ ID NO: 1009663 - DNA, 22 bp, Artificial Sequence
  chemically synthesized
gaggtggtagcaaggttccaca

SEQ ID NO: 1009664 - DNA, 22 bp, Artificial Sequence
  chemically synthesized
atcagcagcaagttttactttt

SEQ ID NO: 1009665 - DNA, 22 bp, Artificial Sequence
  chemically synthesized
catcagcagcaagttttacttt

SEQ ID NO: 1009666 - DNA, 22 bp, Artificial Sequence
  chemically synthesized
cacagaaaaaagtaaaacttgc

SEQ ID NO: 1009667 - DNA, 22 bp, Artificial Sequence
  chemically synthesized
gctgctgatgaagatgatgatt

SEQ ID NO: 1009668 - DNA, 22 bp, Artificial Sequence
  chemically synthesized
ctgctgatgaagatgatgattt

SEQ ID NO: 1009669 - DNA, 22 bp, Artificial Sequence
  chemically synthesized
ctgatgaagatgatgattttga

SEQ ID NO: 1009670 - DNA, 22 bp, Artificial Sequence
  chemically synthesized
atgaagatgatgattttgatga

SEQ ID NO: 1009671 - DNA, 22 bp, Artificial Sequence
  chemically synthesized
atcatcaaaatcatcatcatca

SEQ ID NO: 1009672 - DNA, 22 bp, Artificial Sequence
  chemically synthesized
ctcatcatcaaaatcatcatca

SEQ ID NO: 1009673 - DNA, 22 bp, Artificial Sequence
  chemically synthesized
cctcatcatcaaaatcatcatc

SEQ ID NO: 1009674 - DNA, 22 bp, Artificial Sequence
  chemically synthesized
tgatgatgatgatgattttgat

SEQ ID NO: 1009675 - DNA, 22 bp, Artificial Sequence
  chemically synthesized
agtttcctcatcatcaaaatca

SEQ ID NO: 1009676 - DNA, 22 bp, Artificial Sequence
  chemically synthesized
gatgatgatgatgattttgatg

SEQ ID NO: 1009677 - DNA, 22 bp, Artificial Sequence
  chemically synthesized
cagtttcctcatcatcaaaatc

SEQ ID NO: 1009678 - DNA, 22 bp, Artificial Sequence
  chemically synthesized
atgatgatgatgattttgatga

SEQ ID NO: 1009679 - DNA, 22 bp, Artificial Sequence
  chemically synthesized
ttcagtttcctcatcatcaaaa

SEQ ID NO: 1009680 - DNA, 22 bp, Artificial Sequence
  chemically synthesized
cttcagtttcctcatcatcaaa

SEQ ID NO: 1009681 - DNA, 22 bp, Artificial Sequence
  chemically synthesized
tcttcagtttcctcatcatcaa

SEQ ID NO: 1009682 - DNA, 22 bp, Artificial Sequence
  chemically synthesized
ttcttcagtttcctcatcatca

SEQ ID NO: 1009683 - DNA, 22 bp, Artificial Sequence
  chemically synthesized
tttcttcagtttcctcatcatc

SEQ ID NO: 1009684 - DNA, 22 bp, Artificial Sequence
  chemically synthesized
gcgctttttcttcagtttcctc

SEQ ID NO: 1009685 - DNA, 22 bp, Artificial Sequence
  chemically synthesized
actggcgctttttcttcagttt

SEQ ID NO: 1009686 - DNA, 22 bp, Artificial Sequence
  chemically synthesized
tgatgatgaggaaactgaagaa

SEQ ID NO: 1009687 - DNA, 22 bp, Artificial Sequence
  chemically synthesized
cactggcgctttttcttcagtt

SEQ ID NO: 1009688 - DNA, 22 bp, Artificial Sequence
  chemically synthesized
gatgatgaggaaactgaagaaa

SEQ ID NO: 1009689 - DNA, 22 bp, Artificial Sequence
  chemically synthesized
atgatgaggaaactgaagaaaa

SEQ ID NO: 1009690 - DNA, 22 bp, Artificial Sequence
  chemically synthesized
ttcactggcgctttttcttcag

SEQ ID NO: 1009691 - DNA, 22 bp, Artificial Sequence
  chemically synthesized
cttcactggcgctttttcttca

SEQ ID NO: 1009692 - DNA, 22 bp, Artificial Sequence
  chemically synthesized
atatagatttcttcactggcgc

SEQ ID NO: 1009693 - DNA, 22 bp, Artificial Sequence
  chemically synthesized
aagaaaaagcgccagtgaagaa

SEQ ID NO: 1009694 - DNA, 22 bp, Artificial Sequence
  chemically synthesized
gagtatctcatatagatttctt

SEQ ID NO: 1009695 - DNA, 22 bp, Artificial Sequence
  chemically synthesized
gctggagtatctcatatagatt

SEQ ID NO: 1009696 - DNA, 22 bp, Artificial Sequence
  chemically synthesized
ggctggagtatctcatatagat

SEQ ID NO: 1009697 - DNA, 22 bp, Artificial Sequence
  chemically synthesized
tggctggagtatctcatataga

SEQ ID NO: 1009698 - DNA, 22 bp, Artificial Sequence
  chemically synthesized
ttggctggagtatctcatatag

SEQ ID NO: 1009699 - DNA, 22 bp, Artificial Sequence
  chemically synthesized
tgcatttttggctggagtatct

SEQ ID NO: 1009700 - DNA, 22 bp, Artificial Sequence
  chemically synthesized
gtgcatttttggctggagtatc

SEQ ID NO: 1009701 - DNA, 22 bp, Artificial Sequence
  chemically synthesized
tgtgcatttttggctggagtat

SEQ ID NO: 1009702 - DNA, 22 bp, Artificial Sequence
  chemically synthesized
ttgtgcatttttggctggagta

SEQ ID NO: 1009703 - DNA, 22 bp, Artificial Sequence
  chemically synthesized
acttttgtgcatttttggctgg

SEQ ID NO: 1009704 - DNA, 22 bp, Artificial Sequence
  chemically synthesized
tatgagatactccagccaaaaa

SEQ ID NO: 1009705 - DNA, 22 bp, Artificial Sequence
  chemically synthesized
gacttttgtgcatttttggctg

SEQ ID NO: 1009706 - DNA, 22 bp, Artificial Sequence
  chemically synthesized
cgatttgacttttgtgcatttt

SEQ ID NO: 1009707 - DNA, 22 bp, Artificial Sequence
  chemically synthesized
cattccgatttgacttttgtgc

SEQ ID NO: 1009708 - DNA, 22 bp, Artificial Sequence
  chemically synthesized
cagccaaaaatgcacaaaagtc

SEQ ID NO: 1009709 - DNA, 22 bp, Artificial Sequence
  chemically synthesized
ccattccgatttgacttttgtg

SEQ ID NO: 1009710 - DNA, 22 bp, Artificial Sequence
  chemically synthesized
tccattccgatttgacttttgt

SEQ ID NO: 1009711 - DNA, 22 bp, Artificial Sequence
  chemically synthesized
ttccattccgatttgacttttg

SEQ ID NO: 1009712 - DNA, 22 bp, Artificial Sequence
  chemically synthesized
agtcttttccattccgatttga

SEQ ID NO: 1009713 - DNA, 22 bp, Artificial Sequence
  chemically synthesized
gagtcttttccattccgatttg

SEQ ID NO: 1009714 - DNA, 22 bp, Artificial Sequence
  chemically synthesized
tgagtcttttccattccgattt

SEQ ID NO: 1009715 - DNA, 22 bp, Artificial Sequence
  chemically synthesized
acggttttgagtcttttccatt

SEQ ID NO: 1009716 - DNA, 22 bp, Artificial Sequence
  chemically synthesized
gtgttgacggttttgagtcttt

SEQ ID NO: 1009717 - DNA, 22 bp, Artificial Sequence
  chemically synthesized
ggtgttgacggttttgagtctt

SEQ ID NO: 1009718 - DNA, 22 bp, Artificial Sequence
  chemically synthesized
atcttggtgttgacggttttga

SEQ ID NO: 1009719 - DNA, 22 bp, Artificial Sequence
  chemically synthesized
gatcttggtgttgacggttttg

SEQ ID NO: 1009720 - DNA, 22 bp, Artificial Sequence
  chemically synthesized
tgatcttggtgttgacggtttt

SEQ ID NO: 1009721 - DNA, 22 bp, Artificial Sequence
  chemically synthesized
ttgatcttggtgttgacggttt

SEQ ID NO: 1009722 - DNA, 22 bp, Artificial Sequence
  chemically synthesized
tccttttgatcttggtgttgac

SEQ ID NO: 1009723 - DNA, 22 bp, Artificial Sequence
  chemically synthesized
gtccttttgatcttggtgttga

SEQ ID NO: 1009724 - DNA, 22 bp, Artificial Sequence
  chemically synthesized
ttgtccttttgatcttggtgtt

SEQ ID NO: 1009725 - DNA, 22 bp, Artificial Sequence
  chemically synthesized
aaaaccgtcaacaccaagatca

SEQ ID NO: 1009726 - DNA, 22 bp, Artificial Sequence
  chemically synthesized
aaggattcttgtccttttgatc

SEQ ID NO: 1009727 - DNA, 22 bp, Artificial Sequence
  chemically synthesized
gaaggattcttgtccttttgat

SEQ ID NO: 1009728 - DNA, 22 bp, Artificial Sequence
  chemically synthesized
tgaaggattcttgtccttttga

SEQ ID NO: 1009729 - DNA, 22 bp, Artificial Sequence
  chemically synthesized
ttttgaaggattcttgtccttt

SEQ ID NO: 1009730 - DNA, 22 bp, Artificial Sequence
  chemically synthesized
gttttgaaggattcttgtcctt

SEQ ID NO: 1009731 - DNA, 22 bp, Artificial Sequence
  chemically synthesized
cttgttttgaaggattcttgtc

SEQ ID NO: 1009732 - DNA, 22 bp, Artificial Sequence
  chemically synthesized
ccttgttttgaaggattcttgt

SEQ ID NO: 1009733 - DNA, 22 bp, Artificial Sequence
  chemically synthesized
tccttgttttgaaggattcttg

SEQ ID NO: 1009734 - DNA, 22 bp, Artificial Sequence
  chemically synthesized
ttccttgttttgaaggattctt

SEQ ID NO: 1009735 - DNA, 22 bp, Artificial Sequence
  chemically synthesized
ggagtttttccttgttttgaag

SEQ ID NO: 1009736 - DNA, 22 bp, Artificial Sequence
  chemically synthesized
aggagtttttccttgttttgaa

SEQ ID NO: 1009737 - DNA, 22 bp, Artificial Sequence
  chemically synthesized
taggagtttttccttgttttga

SEQ ID NO: 1009738 - DNA, 22 bp, Artificial Sequence
  chemically synthesized
ggtgttttaggagtttttcctt

SEQ ID NO: 1009739 - DNA, 22 bp, Artificial Sequence
  chemically synthesized
gggtgttttaggagtttttcct

SEQ ID NO: 1009740 - DNA, 22 bp, Artificial Sequence
  chemically synthesized
tgggtgttttaggagtttttcc

SEQ ID NO: 1009741 - DNA, 22 bp, Artificial Sequence
  chemically synthesized
caaaacaaggaaaaactcctaa

SEQ ID NO: 1009742 - DNA, 22 bp, Artificial Sequence
  chemically synthesized
aaaacaaggaaaaactcctaaa

SEQ ID NO: 1009743 - DNA, 22 bp, Artificial Sequence
  chemically synthesized
ggtcctttgggtgttttaggag

SEQ ID NO: 1009744 - DNA, 22 bp, Artificial Sequence
  chemically synthesized
cagaactaggtcctttgggtgt

SEQ ID NO: 1009745 - DNA, 22 bp, Artificial Sequence
  chemically synthesized
tacagaactaggtcctttgggt

SEQ ID NO: 1009746 - DNA, 22 bp, Artificial Sequence
  chemically synthesized
ctacagaactaggtcctttggg

SEQ ID NO: 1009747 - DNA, 22 bp, Artificial Sequence
  chemically synthesized
ctaaaacacccaaaggacctag

SEQ ID NO: 1009748 - DNA, 22 bp, Artificial Sequence
  chemically synthesized
aaacacccaaaggacctagttc

SEQ ID NO: 1009749 - DNA, 22 bp, Artificial Sequence
  chemically synthesized
atgtcttctacagaactaggtc

SEQ ID NO: 1009750 - DNA, 22 bp, Artificial Sequence
  chemically synthesized
aatgtcttctacagaactaggt

SEQ ID NO: 1009751 - DNA, 22 bp, Artificial Sequence
  chemically synthesized
taatgtcttctacagaactagg

SEQ ID NO: 1009752 - DNA, 22 bp, Artificial Sequence
  chemically synthesized
ctttaatgtcttctacagaact

SEQ ID NO: 1009753 - DNA, 22 bp, Artificial Sequence
  chemically synthesized
gctttaatgtcttctacagaac

SEQ ID NO: 1009754 - DNA, 22 bp, Artificial Sequence
  chemically synthesized
tgctttaatgtcttctacagaa

SEQ ID NO: 1009755 - DNA, 22 bp, Artificial Sequence
  chemically synthesized
ttgctttaatgtcttctacaga

SEQ ID NO: 1009756 - DNA, 22 bp, Artificial Sequence
  chemically synthesized
catttttgctttaatgtcttct

SEQ ID NO: 1009757 - DNA, 22 bp, Artificial Sequence
  chemically synthesized
gcatttttgctttaatgtcttc

SEQ ID NO: 1009758 - DNA, 22 bp, Artificial Sequence
  chemically synthesized
cttgcatttttgctttaatgtc

SEQ ID NO: 1009759 - DNA, 22 bp, Artificial Sequence
  chemically synthesized
gttctgtagaagacattaaagc

SEQ ID NO: 1009760 - DNA, 22 bp, Artificial Sequence
  chemically synthesized
gcttgcatttttgctttaatgt

SEQ ID NO: 1009761 - DNA, 22 bp, Artificial Sequence
  chemically synthesized
tgtagaagacattaaagcaaaa

SEQ ID NO: 1009762 - DNA, 22 bp, Artificial Sequence
  chemically synthesized
tacttgcttgcatttttgcttt

SEQ ID NO: 1009763 - DNA, 22 bp, Artificial Sequence
  chemically synthesized
tagaagacattaaagcaaaaat

SEQ ID NO: 1009764 - DNA, 22 bp, Artificial Sequence
  chemically synthesized
tatacttgcttgcatttttgct

SEQ ID NO: 1009765 - DNA, 22 bp, Artificial Sequence
  chemically synthesized
ctatacttgcttgcatttttgc

SEQ ID NO: 1009766 - DNA, 22 bp, Artificial Sequence
  chemically synthesized
tctatacttgcttgcatttttg

SEQ ID NO: 1009767 - DNA, 22 bp, Artificial Sequence
  chemically synthesized
ttctatacttgcttgcattttt

SEQ ID NO: 1009768 - DNA, 22 bp, Artificial Sequence
  chemically synthesized
tttctatacttgcttgcatttt

SEQ ID NO: 1009769 - DNA, 22 bp, Artificial Sequence
  chemically synthesized
aagcaaaaatgcaagcaagtat

SEQ ID NO: 1009770 - DNA, 22 bp, Artificial Sequence
  chemically synthesized
ggaagagaaccacctttttcta

SEQ ID NO: 1009771 - DNA, 22 bp, Artificial Sequence
  chemically synthesized
aggaagagaaccacctttttct

SEQ ID NO: 1009772 - DNA, 22 bp, Artificial Sequence
  chemically synthesized
taggaagagaaccacctttttc

SEQ ID NO: 1009773 - DNA, 22 bp, Artificial Sequence
  chemically synthesized
cactttaggaagagaaccacct

SEQ ID NO: 1009774 - DNA, 22 bp, Artificial Sequence
  chemically synthesized
ccactttaggaagagaaccacc

SEQ ID NO: 1009775 - DNA, 22 bp, Artificial Sequence
  chemically synthesized
gcttccactttaggaagagaac

SEQ ID NO: 1009776 - DNA, 22 bp, Artificial Sequence
  chemically synthesized
ggcttccactttaggaagagaa

SEQ ID NO: 1009777 - DNA, 22 bp, Artificial Sequence
  chemically synthesized
atgaacttggcttccactttag

SEQ ID NO: 1009778 - DNA, 22 bp, Artificial Sequence
  chemically synthesized
tcttcctaaagtggaagccaag

SEQ ID NO: 1009779 - DNA, 22 bp, Artificial Sequence
  chemically synthesized
ttcctaaagtggaagccaagtt

SEQ ID NO: 1009780 - DNA, 22 bp, Artificial Sequence
  chemically synthesized
acataattcatgaacttggctt

SEQ ID NO: 1009781 - DNA, 22 bp, Artificial Sequence
  chemically synthesized
cacataattcatgaacttggct

SEQ ID NO: 1009782 - DNA, 22 bp, Artificial Sequence
  chemically synthesized
cctaaagtggaagccaagttca

SEQ ID NO: 1009783 - DNA, 22 bp, Artificial Sequence
  chemically synthesized
ctaaagtggaagccaagttcat

SEQ ID NO: 1009784 - DNA, 22 bp, Artificial Sequence
  chemically synthesized
ttcacataattcatgaacttgg

SEQ ID NO: 1009785 - DNA, 22 bp, Artificial Sequence
  chemically synthesized
aagtggaagccaagttcatgaa

SEQ ID NO: 1009786 - DNA, 22 bp, Artificial Sequence
  chemically synthesized
gaagcaattcttcacataattc

SEQ ID NO: 1009787 - DNA, 22 bp, Artificial Sequence
  chemically synthesized
atgaattatgtgaagaattgct

SEQ ID NO: 1009788 - DNA, 22 bp, Artificial Sequence
  chemically synthesized
gtcagtcatctggaagcaattc

SEQ ID NO: 1009789 - DNA, 22 bp, Artificial Sequence
  chemically synthesized
tggtcagtcatctggaagcaat

SEQ ID NO: 1009790 - DNA, 22 bp, Artificial Sequence
  chemically synthesized
tgtgaagaattgcttccagatg

SEQ ID NO: 1009791 - DNA, 22 bp, Artificial Sequence
  chemically synthesized
aatagcctctggtcagtcatct

SEQ ID NO: 1009792 - DNA, 22 bp, Artificial Sequence
  chemically synthesized
gaatagcctctggtcagtcatc

SEQ ID NO: 1009793 - DNA, 22 bp, Artificial Sequence
  chemically synthesized
cttccagatgactgaccagagg

SEQ ID NO: 1009794 - DNA, 22 bp, Artificial Sequence
  chemically synthesized
ccagatgactgaccagaggcta

SEQ ID NO: 1009795 - DNA, 22 bp, Artificial Sequence
  chemically synthesized
cagatgactgaccagaggctat

SEQ ID NO: 1009796 - DNA, 22 bp, Artificial Sequence
  chemically synthesized
ccagagatcttgaatagcctct

SEQ ID NO: 1009797 - DNA, 22 bp, Artificial Sequence
  chemically synthesized
cactgccagagatcttgaatag

SEQ ID NO: 1009798 - DNA, 22 bp, Artificial Sequence
  chemically synthesized
ctccactgccagagatcttgaa

SEQ ID NO: 1009799 - DNA, 22 bp, Artificial Sequence
  chemically synthesized
accagaggctattcaagatctc

SEQ ID NO: 1009800 - DNA, 22 bp, Artificial Sequence
  chemically synthesized
cctccactgccagagatcttga

SEQ ID NO: 1009801 - DNA, 22 bp, Artificial Sequence
  chemically synthesized
gagagacttcctccactgccag

SEQ ID NO: 1009802 - DNA, 22 bp, Artificial Sequence
  chemically synthesized
agagagacttcctccactgcca

SEQ ID NO: 1009803 - DNA, 22 bp, Artificial Sequence
  chemically synthesized
ttcaagatctctggcagtggag

SEQ ID NO: 1009804 - DNA, 22 bp, Artificial Sequence
  chemically synthesized
ttagagagacttcctccactgc

SEQ ID NO: 1009805 - DNA, 22 bp, Artificial Sequence
  chemically synthesized
cttagagagacttcctccactg

SEQ ID NO: 1009806 - DNA, 22 bp, Artificial Sequence
  chemically synthesized
aagatctctggcagtggaggaa

SEQ ID NO: 1009807 - DNA, 22 bp, Artificial Sequence
  chemically synthesized
tcttagagagacttcctccact

SEQ ID NO: 1009808 - DNA, 22 bp, Artificial Sequence
  chemically synthesized
ttttcttagagagacttcctcc

SEQ ID NO: 1009809 - DNA, 22 bp, Artificial Sequence
  chemically synthesized
tggcagtggaggaagtctctct

SEQ ID NO: 1009810 - DNA, 22 bp, Artificial Sequence
  chemically synthesized
aactattttcttagagagactt

SEQ ID NO: 1009811 - DNA, 22 bp, Artificial Sequence
  chemically synthesized
aaactattttcttagagagact

SEQ ID NO: 1009812 - DNA, 22 bp, Artificial Sequence
  chemically synthesized
gcagtggaggaagtctctctaa

SEQ ID NO: 1009813 - DNA, 22 bp, Artificial Sequence
  chemically synthesized
tttaaactattttcttagagag

SEQ ID NO: 1009814 - DNA, 22 bp, Artificial Sequence
  chemically synthesized
acaaattgtttaaactattttc

SEQ ID NO: 1009815 - DNA, 22 bp, Artificial Sequence
  chemically synthesized
aacaaattgtttaaactatttt

SEQ ID NO: 1009816 - DNA, 22 bp, Artificial Sequence
  chemically synthesized
taacaaattgtttaaactattt

SEQ ID NO: 1009817 - DNA, 22 bp, Artificial Sequence
  chemically synthesized
ttaacaaattgtttaaactatt

SEQ ID NO: 1009818 - DNA, 22 bp, Artificial Sequence
  chemically synthesized
tctaagaaaatagtttaaacaa

SEQ ID NO: 1009819 - DNA, 22 bp, Artificial Sequence
  chemically synthesized
taagaaaatagtttaaacaatt

SEQ ID NO: 1009820 - DNA, 22 bp, Artificial Sequence
  chemically synthesized
agaaaatagtttaaacaatttg

SEQ ID NO: 1009821 - DNA, 22 bp, Artificial Sequence
  chemically synthesized
aaacaatttgttaaaaattttc

SEQ ID NO: 1009822 - DNA, 22 bp, Artificial Sequence
  chemically synthesized
aacaatttgttaaaaattttcc

SEQ ID NO: 1009823 - DNA, 22 bp, Artificial Sequence
  chemically synthesized
cagaaacgaaatcagatggaaa

SEQ ID NO: 1009824 - DNA, 22 bp, Artificial Sequence
  chemically synthesized
gttaaaaattttccatctgatt

SEQ ID NO: 1009825 - DNA, 22 bp, Artificial Sequence
  chemically synthesized
ttacagaaacgaaatcagatgg

SEQ ID NO: 1009826 - DNA, 22 bp, Artificial Sequence
  chemically synthesized
ttaaaaattttccatctgattt

SEQ ID NO: 1009827 - DNA, 22 bp, Artificial Sequence
  chemically synthesized
aaaattttccatctgatttcgt

SEQ ID NO: 1009828 - DNA, 22 bp, Artificial Sequence
  chemically synthesized
tccatctgatttcgtttctgta

SEQ ID NO: 1009829 - DNA, 22 bp, Artificial Sequence
  chemically synthesized
ccatctgatttcgtttctgtaa

SEQ ID NO: 1009830 - DNA, 22 bp, Artificial Sequence
  chemically synthesized
catctgatttcgtttctgtaac

SEQ ID NO: 1009831 - DNA, 22 bp, Artificial Sequence
  chemically synthesized
atttcgtttctgtaacagttga

SEQ ID NO: 1009832 - DNA, 22 bp, Artificial Sequence
  chemically synthesized
cgtttctgtaacagttgatatc

SEQ ID NO: 1009833 - DNA, 22 bp, Artificial Sequence
  chemically synthesized
gtttctgtaacagttgatatct

SEQ ID NO: 1009834 - DNA, 22 bp, Artificial Sequence
  chemically synthesized
tcaaaacgacagccagatatca

SEQ ID NO: 1009835 - DNA, 22 bp, Artificial Sequence
  chemically synthesized
ctgtaacagttgatatctggct

SEQ ID NO: 1009836 - DNA, 22 bp, Artificial Sequence
  chemically synthesized
tgtaacagttgatatctggctg

SEQ ID NO: 1009837 - DNA, 22 bp, Artificial Sequence
  chemically synthesized
taacagttgatatctggctgtc

SEQ ID NO: 1009838 - DNA, 22 bp, Artificial Sequence
  chemically synthesized
cattatcaaaacgacagccaga

SEQ ID NO: 1009839 - DNA, 22 bp, Artificial Sequence
  chemically synthesized
tgcattatcaaaacgacagcca

SEQ ID NO: 1009840 - DNA, 22 bp, Artificial Sequence
  chemically synthesized
actctgcattatcaaaacgaca

SEQ ID NO: 1009841 - DNA, 22 bp, Artificial Sequence
  chemically synthesized
tcactctgcattatcaaaacga

SEQ ID NO: 1009842 - DNA, 22 bp, Artificial Sequence
  chemically synthesized
atatctggctgtcgttttgata

SEQ ID NO: 1009843 - DNA, 22 bp, Artificial Sequence
  chemically synthesized
gctgtcgttttgataatgcaga

SEQ ID NO: 1009844 - DNA, 22 bp, Artificial Sequence
  chemically synthesized
tcgttttgataatgcagagtga

SEQ ID NO: 1009845 - DNA, 22 bp, Artificial Sequence
  chemically synthesized
tgataatgcagagtgagaacct

SEQ ID NO: 1009846 - DNA, 22 bp, Artificial Sequence
  chemically synthesized
gataatgcagagtgagaacctt

SEQ ID NO: 1009847 - DNA, 22 bp, Artificial Sequence
  chemically synthesized
ataatgcagagtgagaaccttc

SEQ ID NO: 1009848 - DNA, 22 bp, Artificial Sequence
  chemically synthesized
tcaaacatggtagggaaggttc

SEQ ID NO: 1009849 - DNA, 22 bp, Artificial Sequence
  chemically synthesized
atcaaacatggtagggaaggtt

SEQ ID NO: 1009850 - DNA, 22 bp, Artificial Sequence
  chemically synthesized
gacaacatttatcaaacatggt

SEQ ID NO: 1009851 - DNA, 22 bp, Artificial Sequence
  chemically synthesized
ccctaccatgtttgataaatgt

SEQ ID NO: 1009852 - DNA, 22 bp, Artificial Sequence
  chemically synthesized
cctaccatgtttgataaatgtt

SEQ ID NO: 1009853 - DNA, 22 bp, Artificial Sequence
  chemically synthesized
ccatgtttgataaatgttgtcc

SEQ ID NO: 1009854 - DNA, 22 bp, Artificial Sequence
  chemically synthesized
gcaatggaatctggacaacatt

SEQ ID NO: 1009855 - DNA, 22 bp, Artificial Sequence
  chemically synthesized
ggcaatggaatctggacaacat

SEQ ID NO: 1009856 - DNA, 22 bp, Artificial Sequence
  chemically synthesized
ttggcaatggaatctggacaac

SEQ ID NO: 1009857 - DNA, 22 bp, Artificial Sequence
  chemically synthesized
gataaatgttgtccagattcca

SEQ ID NO: 1009858 - DNA, 22 bp, Artificial Sequence
  chemically synthesized
ataaatgttgtccagattccat

SEQ ID NO: 1009859 - DNA, 22 bp, Artificial Sequence
  chemically synthesized
gacaacacattcttggcaatgg

SEQ ID NO: 1009860 - DNA, 22 bp, Artificial Sequence
  chemically synthesized
ggacaacacattcttggcaatg

SEQ ID NO: 1009861 - DNA, 22 bp, Artificial Sequence
  chemically synthesized
tggacaacacattcttggcaat

SEQ ID NO: 1009862 - DNA, 22 bp, Artificial Sequence
  chemically synthesized
tccagattccattgccaagaat

SEQ ID NO: 1009863 - DNA, 22 bp, Artificial Sequence
  chemically synthesized
cattgccaagaatgtgttgtcc

SEQ ID NO: 1009864 - DNA, 22 bp, Artificial Sequence
  chemically synthesized
aacaggcattttggacaacaca

SEQ ID NO: 1009865 - DNA, 22 bp, Artificial Sequence
  chemically synthesized
ccaagaatgtgttgtccaaaat

SEQ ID NO: 1009866 - DNA, 22 bp, Artificial Sequence
  chemically synthesized
aaaactaaacaggcattttgga

SEQ ID NO: 1009867 - DNA, 22 bp, Artificial Sequence
  chemically synthesized
aaaaactaaacaggcattttgg

SEQ ID NO: 1009868 - DNA, 22 bp, Artificial Sequence
  chemically synthesized
taaaaactaaacaggcattttg

SEQ ID NO: 1009869 - DNA, 22 bp, Artificial Sequence
  chemically synthesized
catctttaaaaactaaacaggc

SEQ ID NO: 1009870 - DNA, 22 bp, Artificial Sequence
  chemically synthesized
tccaaaatgcctgtttagtttt

SEQ ID NO: 1009871 - DNA, 22 bp, Artificial Sequence
  chemically synthesized
tttagtttttaaagatggaact

SEQ ID NO: 1009872 - DNA, 22 bp, Artificial Sequence
  chemically synthesized
agtttttaaagatggaactcca

SEQ ID NO: 1009873 - DNA, 22 bp, Artificial Sequence
  chemically synthesized
gtttttaaagatggaactccac

SEQ ID NO: 1009874 - DNA, 22 bp, Artificial Sequence
  chemically synthesized
aaaccaagcaaagggtggagtt

SEQ ID NO: 1009875 - DNA, 22 bp, Artificial Sequence
  chemically synthesized
aaaaccaagcaaagggtggagt

SEQ ID NO: 1009876 - DNA, 22 bp, Artificial Sequence
  chemically synthesized
ttaaagatggaactccaccctt

SEQ ID NO: 1009877 - DNA, 22 bp, Artificial Sequence
  chemically synthesized
taaagatggaactccacccttt

SEQ ID NO: 1009878 - DNA, 22 bp, Artificial Sequence
  chemically synthesized
aaagatggaactccaccctttg

SEQ ID NO: 1009879 - DNA, 22 bp, Artificial Sequence
  chemically synthesized
aagatggaactccaccctttgc

SEQ ID NO: 1009880 - DNA, 22 bp, Artificial Sequence
  chemically synthesized
catacatccttaaaaccaagca

SEQ ID NO: 1009881 - DNA, 22 bp, Artificial Sequence
  chemically synthesized
caccctttgcttggttttaagg

SEQ ID NO: 1009882 - DNA, 22 bp, Artificial Sequence
  chemically synthesized
gcataacattccatacatcctt

SEQ ID NO: 1009883 - DNA, 22 bp, Artificial Sequence
  chemically synthesized
tgcttggttttaaggatgtatg

SEQ ID NO: 1009884 - DNA, 22 bp, Artificial Sequence
  chemically synthesized
gcttggttttaaggatgtatgg

SEQ ID NO: 1009885 - DNA, 22 bp, Artificial Sequence
  chemically synthesized
cttggttttaaggatgtatgga

SEQ ID NO: 1009886 - DNA, 22 bp, Artificial Sequence
  chemically synthesized
ggttttaaggatgtatggaatg

SEQ ID NO: 1009887 - DNA, 22 bp, Artificial Sequence
  chemically synthesized
gttttaaggatgtatggaatgt

SEQ ID NO: 1009888 - DNA, 22 bp, Artificial Sequence
  chemically synthesized
tgtcctagcataacattccata

SEQ ID NO: 1009889 - DNA, 22 bp, Artificial Sequence
  chemically synthesized
ctatgtcctagcataacattcc

SEQ ID NO: 1009890 - DNA, 22 bp, Artificial Sequence
  chemically synthesized
taaggatgtatggaatgttatg

SEQ ID NO: 1009891 - DNA, 22 bp, Artificial Sequence
  chemically synthesized
aaggatgtatggaatgttatgc

SEQ ID NO: 1009892 - DNA, 22 bp, Artificial Sequence
  chemically synthesized
aggatgtatggaatgttatgct

SEQ ID NO: 1009893 - DNA, 22 bp, Artificial Sequence
  chemically synthesized
ctactatgtcctagcataacat

SEQ ID NO: 1009894 - DNA, 22 bp, Artificial Sequence
  chemically synthesized
ctactactatgtcctagcataa

SEQ ID NO: 1009895 - DNA, 22 bp, Artificial Sequence
  chemically synthesized
accactgctactactatgtcct

SEQ ID NO: 1009896 - DNA, 22 bp, Artificial Sequence
  chemically synthesized
tgctaggacatagtagtagcag

SEQ ID NO: 1009897 - DNA, 22 bp, Artificial Sequence
  chemically synthesized
catgtctgaccactgctactac

SEQ ID NO: 1009898 - DNA, 22 bp, Artificial Sequence
  chemically synthesized
ccatgtctgaccactgctacta

SEQ ID NO: 1009899 - DNA, 22 bp, Artificial Sequence
  chemically synthesized
ggacatagtagtagcagtggtc

SEQ ID NO: 1009900 - DNA, 22 bp, Artificial Sequence
  chemically synthesized
cccaccatttccatgtctgacc

SEQ ID NO: 1009901 - DNA, 22 bp, Artificial Sequence
  chemically synthesized
tctacccaccatttccatgtct

SEQ ID NO: 1009902 - DNA, 22 bp, Artificial Sequence
  chemically synthesized
gtctacccaccatttccatgtc

SEQ ID NO: 1009903 - DNA, 22 bp, Artificial Sequence
  chemically synthesized
tgtctacccaccatttccatgt

SEQ ID NO: 1009904 - DNA, 22 bp, Artificial Sequence
  chemically synthesized
ttgtctacccaccatttccatg

SEQ ID NO: 1009905 - DNA, 22 bp, Artificial Sequence
  chemically synthesized
catgtatacttttgtctaccca

SEQ ID NO: 1009906 - DNA, 22 bp, Artificial Sequence
  chemically synthesized
acatgtatacttttgtctaccc

SEQ ID NO: 1009907 - DNA, 22 bp, Artificial Sequence
  chemically synthesized
tacatgtatacttttgtctacc

SEQ ID NO: 1009908 - DNA, 22 bp, Artificial Sequence
  chemically synthesized
ttttacatgtatacttttgtct

SEQ ID NO: 1009909 - DNA, 22 bp, Artificial Sequence
  chemically synthesized
attttacatgtatacttttgtc

SEQ ID NO: 1009910 - DNA, 22 bp, Artificial Sequence
  chemically synthesized
tattttacatgtatacttttgt

SEQ ID NO: 1009911 - DNA, 22 bp, Artificial Sequence
  chemically synthesized
ttattttacatgtatacttttg

SEQ ID NO: 1009912 - DNA, 22 bp, Artificial Sequence
  chemically synthesized
aaatacttttattttacatgta

SEQ ID NO: 1009913 - DNA, 22 bp, Artificial Sequence
  chemically synthesized
ttaaaatacttttattttacat

SEQ ID NO: 1009914 - DNA, 22 bp, Artificial Sequence
  chemically synthesized
attaaaatacttttattttaca

SEQ ID NO: 1009915 - DNA, 22 bp, Artificial Sequence
  chemically synthesized
tattaaaatacttttattttac

SEQ ID NO: 1009916 - DNA, 22 bp, Artificial Sequence
  chemically synthesized
ctttattaaaatacttttattt

SEQ ID NO: 1009917 - DNA, 22 bp, Artificial Sequence
  chemically synthesized
actttattaaaatacttttatt

SEQ ID NO: 1009918 - DNA, 22 bp, Artificial Sequence
  chemically synthesized
tactttattaaaatacttttat

SEQ ID NO: 1009919 - DNA, 22 bp, Artificial Sequence
  chemically synthesized
ttactttattaaaatactttta

SEQ ID NO: 1009920 - DNA, 22 bp, Artificial Sequence
  chemically synthesized
tttactttattaaaatactttt

SEQ ID NO: 1009921 - DNA, 22 bp, Artificial Sequence
  chemically synthesized
ttttactttattaaaatacttt

SEQ ID NO: 1009922 - DNA, 22 bp, Artificial Sequence
  chemically synthesized
tttttactttattaaaatactt

SEQ ID NO: 1009923 - DNA, 22 bp, Artificial Sequence
  chemically synthesized
tcattttttttactttattaaa

SEQ ID NO: 1009924 - DNA, 22 bp, Artificial Sequence
  chemically synthesized
atcattttttttactttattaa

SEQ ID NO: 1009925 - DNA, 22 bp, Artificial Sequence
  chemically synthesized
tatcattttttttactttatta

SEQ ID NO: 1009926 - DNA, 22 bp, Artificial Sequence
  chemically synthesized
cctttatcattttttttacttt

SEQ ID NO: 1009927 - DNA, 22 bp, Artificial Sequence
  chemically synthesized
taataaagtaaaaaaaatgata

SEQ ID NO: 1009928 - DNA, 22 bp, Artificial Sequence
  chemically synthesized
aataaagtaaaaaaaatgataa

SEQ ID NO: 1009929 - DNA, 22 bp, Artificial Sequence
  chemically synthesized
atgtgattacctttatcatttt

SEQ ID NO: 1009930 - DNA, 22 bp, Artificial Sequence
  chemically synthesized
ataaagtaaaaaaaatgataaa

SEQ ID NO: 1009931 - DNA, 22 bp, Artificial Sequence
  chemically synthesized
taatgtgattacctttatcatt

SEQ ID NO: 1009932 - DNA, 22 bp, Artificial Sequence
  chemically synthesized
ctaatgtgattacctttatcat

SEQ ID NO: 1009933 - DNA, 22 bp, Artificial Sequence
  chemically synthesized
cacccaagagatgaatcttcta

SEQ ID NO: 1009934 - DNA, 22 bp, Artificial Sequence
  chemically synthesized
ttgcacccaagagatgaatctt

SEQ ID NO: 1009935 - DNA, 22 bp, Artificial Sequence
  chemically synthesized
gctgttgcacccaagagatgaa

SEQ ID NO: 1009936 - DNA, 22 bp, Artificial Sequence
  chemically synthesized
ccctagctgttgcacccaagag

SEQ ID NO: 1009937 - DNA, 22 bp, Artificial Sequence
  chemically synthesized
gaagattcatctcttgggtgca

SEQ ID NO: 1009938 - DNA, 22 bp, Artificial Sequence
  chemically synthesized
ggaggctaccctagctgttgca

SEQ ID NO: 1009939 - DNA, 22 bp, Artificial Sequence
  chemically synthesized
gggaggctaccctagctgttgc

SEQ ID NO: 1009940 - DNA, 22 bp, Artificial Sequence
  chemically synthesized
atctcttgggtgcaacagctag

SEQ ID NO: 1009941 - DNA, 22 bp, Artificial Sequence
  chemically synthesized
ttgggtgcaacagctagggtag

SEQ ID NO: 1009942 - DNA, 22 bp, Artificial Sequence
  chemically synthesized
gggtgcaacagctagggtagcc

SEQ ID NO: 1009943 - DNA, 22 bp, Artificial Sequence
  chemically synthesized
ggtgcaacagctagggtagcct

SEQ ID NO: 1009944 - DNA, 22 bp, Artificial Sequence
  chemically synthesized
ccacacagggcttgggaggcta

SEQ ID NO: 1009945 - DNA, 22 bp, Artificial Sequence
  chemically synthesized
ctaccacacagggcttgggagg

SEQ ID NO: 1009946 - DNA, 22 bp, Artificial Sequence
  chemically synthesized
actactaccacacagggcttgg

SEQ ID NO: 1009947 - DNA, 22 bp, Artificial Sequence
  chemically synthesized
gggtagcctcccaagccctgtg

SEQ ID NO: 1009948 - DNA, 22 bp, Artificial Sequence
  chemically synthesized
ccaagccctgtgtggtagtagt

SEQ ID NO: 1009949 - DNA, 22 bp, Artificial Sequence
  chemically synthesized
aaaccatagtagtgatactgac

SEQ ID NO: 1009950 - DNA, 22 bp, Artificial Sequence
  chemically synthesized
tgtggtagtagtcagtatcact

SEQ ID NO: 1009951 - DNA, 22 bp, Artificial Sequence
  chemically synthesized
gagggaaaaacattgaaaccat

SEQ ID NO: 1009952 - DNA, 22 bp, Artificial Sequence
  chemically synthesized
ggagggaaaaacattgaaacca

SEQ ID NO: 1009953 - DNA, 22 bp, Artificial Sequence
  chemically synthesized
tggagggaaaaacattgaaacc

SEQ ID NO: 1009954 - DNA, 22 bp, Artificial Sequence
  chemically synthesized
ctatggtttcaatgtttttccc

SEQ ID NO: 1009955 - DNA, 22 bp, Artificial Sequence
  chemically synthesized
tggtttcaatgtttttccctcc

SEQ ID NO: 1009956 - DNA, 22 bp, Artificial Sequence
  chemically synthesized
aacatcagttttggagggaaaa

SEQ ID NO: 1009957 - DNA, 22 bp, Artificial Sequence
  chemically synthesized
caacatcagttttggagggaaa

SEQ ID NO: 1009958 - DNA, 22 bp, Artificial Sequence
  chemically synthesized
caatgtttttccctccaaaact

SEQ ID NO: 1009959 - DNA, 22 bp, Artificial Sequence
  chemically synthesized
aatttcaacatcagttttggag

SEQ ID NO: 1009960 - DNA, 22 bp, Artificial Sequence
  chemically synthesized
aatgtttttccctccaaaactg

SEQ ID NO: 1009961 - DNA, 22 bp, Artificial Sequence
  chemically synthesized
ttccctccaaaactgatgttga

SEQ ID NO: 1009962 - DNA, 22 bp, Artificial Sequence
  chemically synthesized
tccctccaaaactgatgttgaa

SEQ ID NO: 1009963 - DNA, 22 bp, Artificial Sequence
  chemically synthesized
ccctccaaaactgatgttgaaa

SEQ ID NO: 1009964 - DNA, 22 bp, Artificial Sequence
  chemically synthesized
cctccaaaactgatgttgaaat

SEQ ID NO: 1009965 - DNA, 22 bp, Artificial Sequence
  chemically synthesized
caaaactgatgttgaaatttaa

SEQ ID NO: 1009966 - DNA, 22 bp, Artificial Sequence
  chemically synthesized
tcacaatggcaattaaatttca

SEQ ID NO: 1009967 - DNA, 22 bp, Artificial Sequence
  chemically synthesized
atactgtcacaatggcaattaa

SEQ ID NO: 1009968 - DNA, 22 bp, Artificial Sequence
  chemically synthesized
aatactgtcacaatggcaatta

SEQ ID NO: 1009969 - DNA, 22 bp, Artificial Sequence
  chemically synthesized
atgttgaaatttaattgccatt

SEQ ID NO: 1009970 - DNA, 22 bp, Artificial Sequence
  chemically synthesized
aaatttaattgccattgtgaca

SEQ ID NO: 1009971 - DNA, 22 bp, Artificial Sequence
  chemically synthesized
ccaccccttaatactgtcacaa

SEQ ID NO: 1009972 - DNA, 22 bp, Artificial Sequence
  chemically synthesized
aattgccattgtgacagtatta

SEQ ID NO: 1009973 - DNA, 22 bp, Artificial Sequence
  chemically synthesized
attgccattgtgacagtattaa

SEQ ID NO: 1009974 - DNA, 22 bp, Artificial Sequence
  chemically synthesized
aagctcccaccccttaatactg

SEQ ID NO: 1009975 - DNA, 22 bp, Artificial Sequence
  chemically synthesized
ccattgtgacagtattaagggg

SEQ ID NO: 1009976 - DNA, 22 bp, Artificial Sequence
  chemically synthesized
ctaaagctcccaccccttaata

SEQ ID NO: 1009977 - DNA, 22 bp, Artificial Sequence
  chemically synthesized
tgacagtattaaggggtgggag

SEQ ID NO: 1009978 - DNA, 22 bp, Artificial Sequence
  chemically synthesized
atcacctcctaaagctcccacc

SEQ ID NO: 1009979 - DNA, 22 bp, Artificial Sequence
  chemically synthesized
aatcacctcctaaagctcccac

SEQ ID NO: 1009980 - DNA, 22 bp, Artificial Sequence
  chemically synthesized
aatccttaatcacctcctaaag

SEQ ID NO: 1009981 - DNA, 22 bp, Artificial Sequence
  chemically synthesized
aggggtgggagctttaggaggt

SEQ ID NO: 1009982 - DNA, 22 bp, Artificial Sequence
  chemically synthesized
taggaggtgattaaggattgag

SEQ ID NO: 1009983 - DNA, 22 bp, Artificial Sequence
  chemically synthesized
aggaggtgattaaggattgagg

SEQ ID NO: 1009984 - DNA, 22 bp, Artificial Sequence
  chemically synthesized
ggaggtgattaaggattgaggg

SEQ ID NO: 1009985 - DNA, 22 bp, Artificial Sequence
  chemically synthesized
gtgagggtggagccctcaatcc

SEQ ID NO: 1009986 - DNA, 22 bp, Artificial Sequence
  chemically synthesized
aggattgagggctccaccctca

SEQ ID NO: 1009987 - DNA, 22 bp, Artificial Sequence
  chemically synthesized
agggctccaccctcacgagtgg

SEQ ID NO: 1009988 - DNA, 22 bp, Artificial Sequence
  chemically synthesized
taagggaaccaaacccactcgt

SEQ ID NO: 1009989 - DNA, 22 bp, Artificial Sequence
  chemically synthesized
ataagggaaccaaacccactcg

SEQ ID NO: 1009990 - DNA, 22 bp, Artificial Sequence
  chemically synthesized
tataagggaaccaaacccactc

SEQ ID NO: 1009991 - DNA, 22 bp, Artificial Sequence
  chemically synthesized
ttataagggaaccaaacccact

SEQ ID NO: 1009992 - DNA, 22 bp, Artificial Sequence
  chemically synthesized
caccctcacgagtgggtttggt

SEQ ID NO: 1009993 - DNA, 22 bp, Artificial Sequence
  chemically synthesized
ccacttttataagggaaccaaa

SEQ ID NO: 1009994 - DNA, 22 bp, Artificial Sequence
  chemically synthesized
acgagtgggtttggttccctta

SEQ ID NO: 1009995 - DNA, 22 bp, Artificial Sequence
  chemically synthesized
aactcccacttttataagggaa

SEQ ID NO: 1009996 - DNA, 22 bp, Artificial Sequence
  chemically synthesized
ggttcccttataaaagtgggag

SEQ ID NO: 1009997 - DNA, 22 bp, Artificial Sequence
  chemically synthesized
gttcccttataaaagtgggagt

SEQ ID NO: 1009998 - DNA, 22 bp, Artificial Sequence
  chemically synthesized
ccttataaaagtgggagttcag

SEQ ID NO: 1009999 - DNA, 22 bp, Artificial Sequence
  chemically synthesized
ataaaagtgggagttcagcccc

SEQ ID NO: 1010000 - DNA, 22 bp, Artificial Sequence
  chemically synthesized
taaaagtgggagttcagccccc

SEQ ID NO: 1010001 - DNA, 22 bp, Artificial Sequence
  chemically synthesized
gagggcaagaaagatcaaaagg

SEQ ID NO: 1010002 - DNA, 22 bp, Artificial Sequence
  chemically synthesized
agcccccttttgatctttcttg

SEQ ID NO: 1010003 - DNA, 22 bp, Artificial Sequence
  chemically synthesized
ttgatctttcttgccctctaat

SEQ ID NO: 1010004 - DNA, 22 bp, Artificial Sequence
  chemically synthesized
tgatctttcttgccctctaatc

SEQ ID NO: 1010005 - DNA, 22 bp, Artificial Sequence
  chemically synthesized
gatctttcttgccctctaatcg

SEQ ID NO: 1010006 - DNA, 22 bp, Artificial Sequence
  chemically synthesized
atctttcttgccctctaatcgt

SEQ ID NO: 1010007 - DNA, 22 bp, Artificial Sequence
  chemically synthesized
tcttgccctctaatcgtccatc

SEQ ID NO: 1010008 - DNA, 22 bp, Artificial Sequence
  chemically synthesized
cttgccctctaatcgtccatca

SEQ ID NO: 1010009 - DNA, 22 bp, Artificial Sequence
  chemically synthesized
ttgccctctaatcgtccatcat

SEQ ID NO: 1010010 - DNA, 22 bp, Artificial Sequence
  chemically synthesized
atatgtcatcacatgatggacg

SEQ ID NO: 1010011 - DNA, 22 bp, Artificial Sequence
  chemically synthesized
gatatgtcatcacatgatggac

SEQ ID NO: 1010012 - DNA, 22 bp, Artificial Sequence
  chemically synthesized
gccctctaatcgtccatcatgt

SEQ ID NO: 1010013 - DNA, 22 bp, Artificial Sequence
  chemically synthesized
ccctctaatcgtccatcatgtg

SEQ ID NO: 1010014 - DNA, 22 bp, Artificial Sequence
  chemically synthesized
cttgatatgtcatcacatgatg

SEQ ID NO: 1010015 - DNA, 22 bp, Artificial Sequence
  chemically synthesized
taatcgtccatcatgtgatgac

SEQ ID NO: 1010016 - DNA, 22 bp, Artificial Sequence
  chemically synthesized
atcgtccatcatgtgatgacat

SEQ ID NO: 1010017 - DNA, 22 bp, Artificial Sequence
  chemically synthesized
gcgagggcctacttgatatgtc

SEQ ID NO: 1010018 - DNA, 22 bp, Artificial Sequence
  chemically synthesized
tggcgagggcctacttgatatg

SEQ ID NO: 1010019 - DNA, 22 bp, Artificial Sequence
  chemically synthesized
aggtgtcagcctctggcgaggg

SEQ ID NO: 1010020 - DNA, 22 bp, Artificial Sequence
  chemically synthesized
acattaaggtgtcagcctctgg

SEQ ID NO: 1010021 - DNA, 22 bp, Artificial Sequence
  chemically synthesized
ggaagtctaacattaaggtgtc

SEQ ID NO: 1010022 - DNA, 22 bp, Artificial Sequence
  chemically synthesized
gccagaggctgacaccttaatg

SEQ ID NO: 1010023 - DNA, 22 bp, Artificial Sequence
  chemically synthesized
gagactaggaagtctaacatta

SEQ ID NO: 1010024 - DNA, 22 bp, Artificial Sequence
  chemically synthesized
tggagactaggaagtctaacat

SEQ ID NO: 1010025 - DNA, 22 bp, Artificial Sequence
  chemically synthesized
acaccttaatgttagacttcct

SEQ ID NO: 1010026 - DNA, 22 bp, Artificial Sequence
  chemically synthesized
acagttctggagactaggaagt

SEQ ID NO: 1010027 - DNA, 22 bp, Artificial Sequence
  chemically synthesized
aatgttagacttcctagtctcc

SEQ ID NO: 1010028 - DNA, 22 bp, Artificial Sequence
  chemically synthesized
gctcacagttctggagactagg

SEQ ID NO: 1010029 - DNA, 22 bp, Artificial Sequence
  chemically synthesized
atgttagacttcctagtctcca

SEQ ID NO: 1010030 - DNA, 22 bp, Artificial Sequence
  chemically synthesized
gacttcctagtctccagaactg

SEQ ID NO: 1010031 - DNA, 22 bp, Artificial Sequence
  chemically synthesized
cctagtctccagaactgtgagc

SEQ ID NO: 1010032 - DNA, 22 bp, Artificial Sequence
  chemically synthesized
ctagtctccagaactgtgagcc

SEQ ID NO: 1010033 - DNA, 22 bp, Artificial Sequence
  chemically synthesized
gtctccagaactgtgagccaat

SEQ ID NO: 1010034 - DNA, 22 bp, Artificial Sequence
  chemically synthesized
taatgaacaaaaatgtattggc

SEQ ID NO: 1010035 - DNA, 22 bp, Artificial Sequence
  chemically synthesized
cagaactgtgagccaatacatt

SEQ ID NO: 1010036 - DNA, 22 bp, Artificial Sequence
  chemically synthesized
gtaatgaacaaaaatgtattgg

SEQ ID NO: 1010037 - DNA, 22 bp, Artificial Sequence
  chemically synthesized
tgagccaatacatttttgttca

SEQ ID NO: 1010038 - DNA, 22 bp, Artificial Sequence
  chemically synthesized
ggtaataatttgtaatgaacaa

SEQ ID NO: 1010039 - DNA, 22 bp, Artificial Sequence
  chemically synthesized
agactaggtaataatttgtaat

SEQ ID NO: 1010040 - DNA, 22 bp, Artificial Sequence
  chemically synthesized
ttgttcattacaaattattacc

SEQ ID NO: 1010041 - DNA, 22 bp, Artificial Sequence
  chemically synthesized
tgttcattacaaattattacct

SEQ ID NO: 1010042 - DNA, 22 bp, Artificial Sequence
  chemically synthesized
gttcattacaaattattaccta

SEQ ID NO: 1010043 - DNA, 22 bp, Artificial Sequence
  chemically synthesized
ttcattacaaattattacctag

SEQ ID NO: 1010044 - DNA, 22 bp, Artificial Sequence
  chemically synthesized
attacaaattattacctagtct

SEQ ID NO: 1010045 - DNA, 22 bp, Artificial Sequence
  chemically synthesized
taacaaagtacctaagactagg

SEQ ID NO: 1010046 - DNA, 22 bp, Artificial Sequence
  chemically synthesized
caaattattacctagtcttagg

SEQ ID NO: 1010047 - DNA, 22 bp, Artificial Sequence
  chemically synthesized
ctgtaacaaagtacctaagact

SEQ ID NO: 1010048 - DNA, 22 bp, Artificial Sequence
  chemically synthesized
tgctgctgtaacaaagtaccta

SEQ ID NO: 1010049 - DNA, 22 bp, Artificial Sequence
  chemically synthesized
ttacctagtcttaggtactttg

SEQ ID NO: 1010050 - DNA, 22 bp, Artificial Sequence
  chemically synthesized
gtgctgctgtaacaaagtacct

SEQ ID NO: 1010051 - DNA, 22 bp, Artificial Sequence
  chemically synthesized
tgtgctgctgtaacaaagtacc

SEQ ID NO: 1010052 - DNA, 22 bp, Artificial Sequence
  chemically synthesized
cctagtcttaggtactttgtta

SEQ ID NO: 1010053 - DNA, 22 bp, Artificial Sequence
  chemically synthesized
gtcttaggtactttgttacagc

SEQ ID NO: 1010054 - DNA, 22 bp, Artificial Sequence
  chemically synthesized
atacgttttgtgctgctgtaac

SEQ ID NO: 1010055 - DNA, 22 bp, Artificial Sequence
  chemically synthesized
aatacgttttgtgctgctgtaa

SEQ ID NO: 1010056 - DNA, 22 bp, Artificial Sequence
  chemically synthesized
aggtactttgttacagcagcac

SEQ ID NO: 1010057 - DNA, 22 bp, Artificial Sequence
  chemically synthesized
ttaatacgttttgtgctgctgt

SEQ ID NO: 1010058 - DNA, 22 bp, Artificial Sequence
  chemically synthesized
ggtactttgttacagcagcaca

SEQ ID NO: 1010059 - DNA, 22 bp, Artificial Sequence
  chemically synthesized
tcttaatacgttttgtgctgct

SEQ ID NO: 1010060 - DNA, 22 bp, Artificial Sequence
  chemically synthesized
tgttacagcagcacaaaacgta

SEQ ID NO: 1010061 - DNA, 22 bp, Artificial Sequence
  chemically synthesized
gttacagcagcacaaaacgtat

SEQ ID NO: 1010062 - DNA, 22 bp, Artificial Sequence
  chemically synthesized
ttacagcagcacaaaacgtatt

SEQ ID NO: 1010063 - DNA, 22 bp, Artificial Sequence
  chemically synthesized
cagcagcacaaaacgtattaag

SEQ ID NO: 1010064 - DNA, 22 bp, Artificial Sequence
  chemically synthesized
agaaaagataagtaggtaactc

SEQ ID NO: 1010065 - DNA, 22 bp, Artificial Sequence
  chemically synthesized
agagagttacctacttatcttt

SEQ ID NO: 1010066 - DNA, 22 bp, Artificial Sequence
  chemically synthesized
taatgatgttcagaaaagataa

SEQ ID NO: 1010067 - DNA, 22 bp, Artificial Sequence
  chemically synthesized
cctacttatcttttctgaacat

SEQ ID NO: 1010068 - DNA, 22 bp, Artificial Sequence
  chemically synthesized
cttatcttttctgaacatcatt

SEQ ID NO: 1010069 - DNA, 22 bp, Artificial Sequence
  chemically synthesized
aaatggaattgtaatgatgttc

SEQ ID NO: 1010070 - DNA, 22 bp, Artificial Sequence
  chemically synthesized
gaaatggaattgtaatgatgtt

SEQ ID NO: 1010071 - DNA, 22 bp, Artificial Sequence
  chemically synthesized
tgaaatggaattgtaatgatgt

SEQ ID NO: 1010072 - DNA, 22 bp, Artificial Sequence
  chemically synthesized
atcttttctgaacatcattaca

SEQ ID NO: 1010073 - DNA, 22 bp, Artificial Sequence
  chemically synthesized
tcttttctgaacatcattacaa

SEQ ID NO: 1010074 - DNA, 22 bp, Artificial Sequence
  chemically synthesized
ttctgaacatcattacaattcc

SEQ ID NO: 1010075 - DNA, 22 bp, Artificial Sequence
  chemically synthesized
tctgaacatcattacaattcca

SEQ ID NO: 1010076 - DNA, 22 bp, Artificial Sequence
  chemically synthesized
ctgaacatcattacaattccat

SEQ ID NO: 1010077 - DNA, 22 bp, Artificial Sequence
  chemically synthesized
tgaacatcattacaattccatt

SEQ ID NO: 1010078 - DNA, 22 bp, Artificial Sequence
  chemically synthesized
aacatcattacaattccatttc

SEQ ID NO: 1010079 - DNA, 22 bp, Artificial Sequence
  chemically synthesized
agagcagaaattttgaaatgga

SEQ ID NO: 1010080 - DNA, 22 bp, Artificial Sequence
  chemically synthesized
caattccatttcaaaatttctg

SEQ ID NO: 1010081 - DNA, 22 bp, Artificial Sequence
  chemically synthesized
ggatatcattaagagcagaaat

SEQ ID NO: 1010082 - DNA, 22 bp, Artificial Sequence
  chemically synthesized
gggatatcattaagagcagaaa

SEQ ID NO: 1010083 - DNA, 22 bp, Artificial Sequence
  chemically synthesized
catttcaaaatttctgctctta

SEQ ID NO: 1010084 - DNA, 22 bp, Artificial Sequence
  chemically synthesized
cttgggatatcattaagagcag

SEQ ID NO: 1010085 - DNA, 22 bp, Artificial Sequence
  chemically synthesized
caaaatttctgctcttaatgat

SEQ ID NO: 1010086 - DNA, 22 bp, Artificial Sequence
  chemically synthesized
aaaatttctgctcttaatgata

SEQ ID NO: 1010087 - DNA, 22 bp, Artificial Sequence
  chemically synthesized
gtctccttgggatatcattaag

SEQ ID NO: 1010088 - DNA, 22 bp, Artificial Sequence
  chemically synthesized
tagtctccttgggatatcatta

SEQ ID NO: 1010089 - DNA, 22 bp, Artificial Sequence
  chemically synthesized
ctagtctccttgggatatcatt

SEQ ID NO: 1010090 - DNA, 22 bp, Artificial Sequence
  chemically synthesized
tctagtctccttgggatatcat

SEQ ID NO: 1010091 - DNA, 22 bp, Artificial Sequence
  chemically synthesized
ctgctcttaatgatatcccaag

SEQ ID NO: 1010092 - DNA, 22 bp, Artificial Sequence
  chemically synthesized
tgctcttaatgatatcccaagg

SEQ ID NO: 1010093 - DNA, 22 bp, Artificial Sequence
  chemically synthesized
ctcttaatgatatcccaaggag

SEQ ID NO: 1010094 - DNA, 22 bp, Artificial Sequence
  chemically synthesized
aaatattttctagtctccttgg

SEQ ID NO: 1010095 - DNA, 22 bp, Artificial Sequence
  chemically synthesized
ttaatgatatcccaaggagact

SEQ ID NO: 1010096 - DNA, 22 bp, Artificial Sequence
  chemically synthesized
aatgatatcccaaggagactag

SEQ ID NO: 1010097 - DNA, 22 bp, Artificial Sequence
  chemically synthesized
ttgaaatattttctagtctcct

SEQ ID NO: 1010098 - DNA, 22 bp, Artificial Sequence
  chemically synthesized
atgatatcccaaggagactaga

SEQ ID NO: 1010099 - DNA, 22 bp, Artificial Sequence
  chemically synthesized
aactgttgaaatattttctagt

SEQ ID NO: 1010100 - DNA, 22 bp, Artificial Sequence
  chemically synthesized
aagagtggctgaactgttgaaa

SEQ ID NO: 1010101 - DNA, 22 bp, Artificial Sequence
  chemically synthesized
attgaagagtggctgaactgtt

SEQ ID NO: 1010102 - DNA, 22 bp, Artificial Sequence
  chemically synthesized
gaaaatatttcaacagttcagc

SEQ ID NO: 1010103 - DNA, 22 bp, Artificial Sequence
  chemically synthesized
cattgaagagtggctgaactgt

SEQ ID NO: 1010104 - DNA, 22 bp, Artificial Sequence
  chemically synthesized
caacagttcagccactcttcaa

SEQ ID NO: 1010105 - DNA, 22 bp, Artificial Sequence
  chemically synthesized
aacagttcagccactcttcaat

SEQ ID NO: 1010106 - DNA, 22 bp, Artificial Sequence
  chemically synthesized
agccactcttcaatgaaattat

SEQ ID NO: 1010107 - DNA, 22 bp, Artificial Sequence
  chemically synthesized
ttcaatgaaattatcttgcgtg

SEQ ID NO: 1010108 - DNA, 22 bp, Artificial Sequence
  chemically synthesized
acgagtacatgaccacgcaaga

SEQ ID NO: 1010109 - DNA, 22 bp, Artificial Sequence
  chemically synthesized
caatgaaattatcttgcgtggt

SEQ ID NO: 1010110 - DNA, 22 bp, Artificial Sequence
  chemically synthesized
aacgagtacatgaccacgcaag

SEQ ID NO: 1010111 - DNA, 22 bp, Artificial Sequence
  chemically synthesized
aatgaaattatcttgcgtggtc

SEQ ID NO: 1010112 - DNA, 22 bp, Artificial Sequence
  chemically synthesized
tcttgcgtggtcatgtactcgt

SEQ ID NO: 1010113 - DNA, 22 bp, Artificial Sequence
  chemically synthesized
gcgtggtcatgtactcgttaaa

SEQ ID NO: 1010114 - DNA, 22 bp, Artificial Sequence
  chemically synthesized
cgtggtcatgtactcgttaaat

SEQ ID NO: 1010115 - DNA, 22 bp, Artificial Sequence
  chemically synthesized
aaagaatggtcagggcaattta

SEQ ID NO: 1010116 - DNA, 22 bp, Artificial Sequence
  chemically synthesized
caaagaatggtcagggcaattt

SEQ ID NO: 1010117 - DNA, 22 bp, Artificial Sequence
  chemically synthesized
tccttcaaagaatggtcagggc

SEQ ID NO: 1010118 - DNA, 22 bp, Artificial Sequence
  chemically synthesized
gttaaattgccctgaccattct

SEQ ID NO: 1010119 - DNA, 22 bp, Artificial Sequence
  chemically synthesized
aattgccctgaccattctttga

SEQ ID NO: 1010120 - DNA, 22 bp, Artificial Sequence
  chemically synthesized
ccctgaccattctttgaaggat

SEQ ID NO: 1010121 - DNA, 22 bp, Artificial Sequence
  chemically synthesized
ataaccagtgctatccttcaaa

SEQ ID NO: 1010122 - DNA, 22 bp, Artificial Sequence
  chemically synthesized
accattctttgaaggatagcac

SEQ ID NO: 1010123 - DNA, 22 bp, Artificial Sequence
  chemically synthesized
atctcataaccagtgctatcct

SEQ ID NO: 1010124 - DNA, 22 bp, Artificial Sequence
  chemically synthesized
aatctcataaccagtgctatcc

SEQ ID NO: 1010125 - DNA, 22 bp, Artificial Sequence
  chemically synthesized
tttgaaggatagcactggttat

SEQ ID NO: 1010126 - DNA, 22 bp, Artificial Sequence
  chemically synthesized
aaatttaatctcataaccagtg

SEQ ID NO: 1010127 - DNA, 22 bp, Artificial Sequence
  chemically synthesized
caaatttaatctcataaccagt

SEQ ID NO: 1010128 - DNA, 22 bp, Artificial Sequence
  chemically synthesized
tgaaggatagcactggttatga

SEQ ID NO: 1010129 - DNA, 22 bp, Artificial Sequence
  chemically synthesized
tcaaatttaatctcataaccag

SEQ ID NO: 1010130 - DNA, 22 bp, Artificial Sequence
  chemically synthesized
gaaggatagcactggttatgag

SEQ ID NO: 1010131 - DNA, 22 bp, Artificial Sequence
  chemically synthesized
aaggatagcactggttatgaga

SEQ ID NO: 1010132 - DNA, 22 bp, Artificial Sequence
  chemically synthesized
ataggaactttcaaatttaatc

SEQ ID NO: 1010133 - DNA, 22 bp, Artificial Sequence
  chemically synthesized
gttatgagattaaatttgaaag

SEQ ID NO: 1010134 - DNA, 22 bp, Artificial Sequence
  chemically synthesized
atagttcataggaactttcaaa

SEQ ID NO: 1010135 - DNA, 22 bp, Artificial Sequence
  chemically synthesized
tgagattaaatttgaaagttcc

SEQ ID NO: 1010136 - DNA, 22 bp, Artificial Sequence
  chemically synthesized
aactgatagttcataggaactt

SEQ ID NO: 1010137 - DNA, 22 bp, Artificial Sequence
  chemically synthesized
actcaactgatagttcatagga

SEQ ID NO: 1010138 - DNA, 22 bp, Artificial Sequence
  chemically synthesized
aatttgaaagttcctatgaact

SEQ ID NO: 1010139 - DNA, 22 bp, Artificial Sequence
  chemically synthesized
gaaagttcctatgaactatcag

SEQ ID NO: 1010140 - DNA, 22 bp, Artificial Sequence
  chemically synthesized
aaagttcctatgaactatcagt

SEQ ID NO: 1010141 - DNA, 22 bp, Artificial Sequence
  chemically synthesized
ctatgaactatcagttgagtga

SEQ ID NO: 1010142 - DNA, 22 bp, Artificial Sequence
  chemically synthesized
taataagcaaattcactcaact

SEQ ID NO: 1010143 - DNA, 22 bp, Artificial Sequence
  chemically synthesized
tgaactatcagttgagtgaatt

SEQ ID NO: 1010144 - DNA, 22 bp, Artificial Sequence
  chemically synthesized
tcagttgagtgaatttgcttat

SEQ ID NO: 1010145 - DNA, 22 bp, Artificial Sequence
  chemically synthesized
agatatatgctataataagcaa

SEQ ID NO: 1010146 - DNA, 22 bp, Artificial Sequence
  chemically synthesized
agtgaatttgcttattatagca

SEQ ID NO: 1010147 - DNA, 22 bp, Artificial Sequence
  chemically synthesized
gcttattatagcatatatctta

SEQ ID NO: 1010148 - DNA, 22 bp, Artificial Sequence
  chemically synthesized
tgaacatatgattaagatatat

SEQ ID NO: 1010149 - DNA, 22 bp, Artificial Sequence
  chemically synthesized
cttattatagcatatatcttaa

SEQ ID NO: 1010150 - DNA, 22 bp, Artificial Sequence
  chemically synthesized
atgaacatatgattaagatata

SEQ ID NO: 1010151 - DNA, 22 bp, Artificial Sequence
  chemically synthesized
attatagcatatatcttaatca

SEQ ID NO: 1010152 - DNA, 22 bp, Artificial Sequence
  chemically synthesized
ttatagcatatatcttaatcat

SEQ ID NO: 1010153 - DNA, 22 bp, Artificial Sequence
  chemically synthesized
tagcatatatcttaatcatatg

SEQ ID NO: 1010154 - DNA, 22 bp, Artificial Sequence
  chemically synthesized
atggaggcttatgaacatatga

SEQ ID NO: 1010155 - DNA, 22 bp, Artificial Sequence
  chemically synthesized
aatggaggcttatgaacatatg

SEQ ID NO: 1010156 - DNA, 22 bp, Artificial Sequence
  chemically synthesized
gcttaatggaggcttatgaaca

SEQ ID NO: 1010157 - DNA, 22 bp, Artificial Sequence
  chemically synthesized
aatcatatgttcataagcctcc

SEQ ID NO: 1010158 - DNA, 22 bp, Artificial Sequence
  chemically synthesized
atcatatgttcataagcctcca

SEQ ID NO: 1010159 - DNA, 22 bp, Artificial Sequence
  chemically synthesized
tgcagcctggcttaatggaggc

SEQ ID NO: 1010160 - DNA, 22 bp, Artificial Sequence
  chemically synthesized
ataagcctccattaagccaggc

SEQ ID NO: 1010161 - DNA, 22 bp, Artificial Sequence
  chemically synthesized
aaaaaataaactgtgcagcctg

SEQ ID NO: 1010162 - DNA, 22 bp, Artificial Sequence
  chemically synthesized
ttaaaaaaataaactgtgcagc

SEQ ID NO: 1010163 - DNA, 22 bp, Artificial Sequence
  chemically synthesized
cattaagccaggctgcacagtt

SEQ ID NO: 1010164 - DNA, 22 bp, Artificial Sequence
  chemically synthesized
agccaggctgcacagtttattt

SEQ ID NO: 1010165 - DNA, 22 bp, Artificial Sequence
  chemically synthesized
aaacaatgcaattgttaaaaaa

SEQ ID NO: 1010166 - DNA, 22 bp, Artificial Sequence
  chemically synthesized
aaaacaatgcaattgttaaaaa

SEQ ID NO: 1010167 - DNA, 22 bp, Artificial Sequence
  chemically synthesized
cacagtttatttttttaacaat

SEQ ID NO: 1010168 - DNA, 22 bp, Artificial Sequence
  chemically synthesized
taaaacaatgcaattgttaaaa

SEQ ID NO: 1010169 - DNA, 22 bp, Artificial Sequence
  chemically synthesized
taactttaaaacaatgcaattg

SEQ ID NO: 1010170 - DNA, 22 bp, Artificial Sequence
  chemically synthesized
atttttttaacaattgcattgt

SEQ ID NO: 1010171 - DNA, 22 bp, Artificial Sequence
  chemically synthesized
tttttttaacaattgcattgtt

SEQ ID NO: 1010172 - DNA, 22 bp, Artificial Sequence
  chemically synthesized
ttttaacaattgcattgtttta

SEQ ID NO: 1010173 - DNA, 22 bp, Artificial Sequence
  chemically synthesized
tttaacaattgcattgttttaa

SEQ ID NO: 1010174 - DNA, 22 bp, Artificial Sequence
  chemically synthesized
ttaacaattgcattgttttaaa

SEQ ID NO: 1010175 - DNA, 22 bp, Artificial Sequence
  chemically synthesized
taacaattgcattgttttaaag

SEQ ID NO: 1010176 - DNA, 22 bp, Artificial Sequence
  chemically synthesized
aaacaactgtaactttaaaaca

SEQ ID NO: 1010177 - DNA, 22 bp, Artificial Sequence
  chemically synthesized
aacaattgcattgttttaaagt

SEQ ID NO: 1010178 - DNA, 22 bp, Artificial Sequence
  chemically synthesized
acaattgcattgttttaaagtt

SEQ ID NO: 1010179 - DNA, 22 bp, Artificial Sequence
  chemically synthesized
ctgaaacaactgtaactttaaa

SEQ ID NO: 1010180 - DNA, 22 bp, Artificial Sequence
  chemically synthesized
cattgttttaaagttacagttg

SEQ ID NO: 1010181 - DNA, 22 bp, Artificial Sequence
  chemically synthesized
ttttaaagttacagttgtttca

SEQ ID NO: 1010182 - DNA, 22 bp, Artificial Sequence
  chemically synthesized
gtaatggattgctgaaacaact

SEQ ID NO: 1010183 - DNA, 22 bp, Artificial Sequence
  chemically synthesized
taaagttacagttgtttcagca

SEQ ID NO: 1010184 - DNA, 22 bp, Artificial Sequence
  chemically synthesized
aaagttacagttgtttcagcaa

SEQ ID NO: 1010185 - DNA, 22 bp, Artificial Sequence
  chemically synthesized
aagttacagttgtttcagcaat

SEQ ID NO: 1010186 - DNA, 22 bp, Artificial Sequence
  chemically synthesized
aatactagtaatggattgctga

SEQ ID NO: 1010187 - DNA, 22 bp, Artificial Sequence
  chemically synthesized
aaatactagtaatggattgctg

SEQ ID NO: 1010188 - DNA, 22 bp, Artificial Sequence
  chemically synthesized
taaatactagtaatggattgct

SEQ ID NO: 1010189 - DNA, 22 bp, Artificial Sequence
  chemically synthesized
ttaaatactagtaatggattgc

SEQ ID NO: 1010190 - DNA, 22 bp, Artificial Sequence
  chemically synthesized
cagttgtttcagcaatccatta

SEQ ID NO: 1010191 - DNA, 22 bp, Artificial Sequence
  chemically synthesized
tttcagcaatccattactagta

SEQ ID NO: 1010192 - DNA, 22 bp, Artificial Sequence
  chemically synthesized
cagcaatccattactagtattt

SEQ ID NO: 1010193 - DNA, 22 bp, Artificial Sequence
  chemically synthesized
agcaatccattactagtattta

SEQ ID NO: 1010194 - DNA, 22 bp, Artificial Sequence
  chemically synthesized
caaaaggacaatgtgtgtactt

SEQ ID NO: 1010195 - DNA, 22 bp, Artificial Sequence
  chemically synthesized
ctagtatttaaaagtacacaca

SEQ ID NO: 1010196 - DNA, 22 bp, Artificial Sequence
  chemically synthesized
acaaaaggacaatgtgtgtact

SEQ ID NO: 1010197 - DNA, 22 bp, Artificial Sequence
  chemically synthesized
gtatttaaaagtacacacattg

SEQ ID NO: 1010198 - DNA, 22 bp, Artificial Sequence
  chemically synthesized
aaaagtacacacattgtccttt

SEQ ID NO: 1010199 - DNA, 22 bp, Artificial Sequence
  chemically synthesized
tatgtatttacaaaaggacaat

SEQ ID NO: 1010200 - DNA, 22 bp, Artificial Sequence
  chemically synthesized
aaagtacacacattgtcctttt

SEQ ID NO: 1010201 - DNA, 22 bp, Artificial Sequence
  chemically synthesized
ttgtatgtatttacaaaaggac

SEQ ID NO: 1010202 - DNA, 22 bp, Artificial Sequence
  chemically synthesized
tggctgttgtatgtatttacaa

SEQ ID NO: 1010203 - DNA, 22 bp, Artificial Sequence
  chemically synthesized
atggctgttgtatgtatttaca

SEQ ID NO: 1010204 - DNA, 22 bp, Artificial Sequence
  chemically synthesized
tccttttgtaaatacatacaac

SEQ ID NO: 1010205 - DNA, 22 bp, Artificial Sequence
  chemically synthesized
taatttatggctgttgtatgta

SEQ ID NO: 1010206 - DNA, 22 bp, Artificial Sequence
  chemically synthesized
ataatttatggctgttgtatgt

SEQ ID NO: 1010207 - DNA, 22 bp, Artificial Sequence
  chemically synthesized
tataatttatggctgttgtatg

SEQ ID NO: 1010208 - DNA, 22 bp, Artificial Sequence
  chemically synthesized
ttataatttatggctgttgtat

SEQ ID NO: 1010209 - DNA, 22 bp, Artificial Sequence
  chemically synthesized
tttataatttatggctgttgta

SEQ ID NO: 1010210 - DNA, 22 bp, Artificial Sequence
  chemically synthesized
ttgtaaatacatacaacagcca

SEQ ID NO: 1010211 - DNA, 22 bp, Artificial Sequence
  chemically synthesized
ttttataatttatggctgttgt

SEQ ID NO: 1010212 - DNA, 22 bp, Artificial Sequence
  chemically synthesized
tgtaaatacatacaacagccat

SEQ ID NO: 1010213 - DNA, 22 bp, Artificial Sequence
  chemically synthesized
gtaaatacatacaacagccata

SEQ ID NO: 1010214 - DNA, 22 bp, Artificial Sequence
  chemically synthesized
taaatacatacaacagccataa

SEQ ID NO: 1010215 - DNA, 22 bp, Artificial Sequence
  chemically synthesized
tttttttataatttatggctgt

SEQ ID NO: 1010216 - DNA, 22 bp, Artificial Sequence
  chemically synthesized
tatttttttataatttatggct

SEQ ID NO: 1010217 - DNA, 22 bp, Artificial Sequence
  chemically synthesized
ctatttttttataatttatggc

SEQ ID NO: 1010218 - DNA, 22 bp, Artificial Sequence
  chemically synthesized
aatttctatttttttataattt

SEQ ID NO: 1010219 - DNA, 22 bp, Artificial Sequence
  chemically synthesized
gaatttctatttttttataatt

SEQ ID NO: 1010220 - DNA, 22 bp, Artificial Sequence
  chemically synthesized
tccttgaatttctattttttta

SEQ ID NO: 1010221 - DNA, 22 bp, Artificial Sequence
  chemically synthesized
atccttgaatttctattttttt

SEQ ID NO: 1010222 - DNA, 22 bp, Artificial Sequence
  chemically synthesized
tatccttgaatttctatttttt

SEQ ID NO: 1010223 - DNA, 22 bp, Artificial Sequence
  chemically synthesized
aaacattttatccttgaatttc

SEQ ID NO: 1010224 - DNA, 22 bp, Artificial Sequence
  chemically synthesized
caaacattttatccttgaattt

SEQ ID NO: 1010225 - DNA, 22 bp, Artificial Sequence
  chemically synthesized
taaaaaaatagaaattcaagga

SEQ ID NO: 1010226 - DNA, 22 bp, Artificial Sequence
  chemically synthesized
tcaaacattttatccttgaatt

SEQ ID NO: 1010227 - DNA, 22 bp, Artificial Sequence
  chemically synthesized
ttcaaacattttatccttgaat

SEQ ID NO: 1010228 - DNA, 22 bp, Artificial Sequence
  chemically synthesized
aataacacatttttcaaacatt

SEQ ID NO: 1010229 - DNA, 22 bp, Artificial Sequence
  chemically synthesized
aaataacacatttttcaaacat

SEQ ID NO: 1010230 - DNA, 22 bp, Artificial Sequence
  chemically synthesized
aaggataaaatgtttgaaaaat

SEQ ID NO: 1010231 - DNA, 22 bp, Artificial Sequence
  chemically synthesized
atcttaaataacacatttttca

SEQ ID NO: 1010232 - DNA, 22 bp, Artificial Sequence
  chemically synthesized
ctaatcttaaataacacatttt

SEQ ID NO: 1010233 - DNA, 22 bp, Artificial Sequence
  chemically synthesized
ctgctaatcttaaataacacat

SEQ ID NO: 1010234 - DNA, 22 bp, Artificial Sequence
  chemically synthesized
actgctaatcttaaataacaca

SEQ ID NO: 1010235 - DNA, 22 bp, Artificial Sequence
  chemically synthesized
tactgctaatcttaaataacac

SEQ ID NO: 1010236 - DNA, 22 bp, Artificial Sequence
  chemically synthesized
gaaaaatgtgttatttaagatt

SEQ ID NO: 1010237 - DNA, 22 bp, Artificial Sequence
  chemically synthesized
aaaaatgtgttatttaagatta

SEQ ID NO: 1010238 - DNA, 22 bp, Artificial Sequence
  chemically synthesized
aaaatccaattttactgctaat

SEQ ID NO: 1010239 - DNA, 22 bp, Artificial Sequence
  chemically synthesized
gaaaatccaattttactgctaa

SEQ ID NO: 1010240 - DNA, 22 bp, Artificial Sequence
  chemically synthesized
tttgaaaatccaattttactgc

SEQ ID NO: 1010241 - DNA, 22 bp, Artificial Sequence
  chemically synthesized
atttgaaaatccaattttactg

SEQ ID NO: 1010242 - DNA, 22 bp, Artificial Sequence
  chemically synthesized
tttaagattagcagtaaaattg

SEQ ID NO: 1010243 - DNA, 22 bp, Artificial Sequence
  chemically synthesized
aagattagcagtaaaattggat

SEQ ID NO: 1010244 - DNA, 22 bp, Artificial Sequence
  chemically synthesized
agattagcagtaaaattggatt

SEQ ID NO: 1010245 - DNA, 22 bp, Artificial Sequence
  chemically synthesized
acatggatttatttgaaaatcc

SEQ ID NO: 1010246 - DNA, 22 bp, Artificial Sequence
  chemically synthesized
gcagtaaaattggattttcaaa

SEQ ID NO: 1010247 - DNA, 22 bp, Artificial Sequence
  chemically synthesized
gttaacatggatttatttgaaa

SEQ ID NO: 1010248 - DNA, 22 bp, Artificial Sequence
  chemically synthesized
gattttcaaataaatccatgtt

SEQ ID NO: 1010249 - DNA, 22 bp, Artificial Sequence
  chemically synthesized
taaatcctagttaacatggatt

SEQ ID NO: 1010250 - DNA, 22 bp, Artificial Sequence
  chemically synthesized
tcaaataaatccatgttaacta

SEQ ID NO: 1010251 - DNA, 22 bp, Artificial Sequence
  chemically synthesized
tattgtaaatcctagttaacat

SEQ ID NO: 1010252 - DNA, 22 bp, Artificial Sequence
  chemically synthesized
caaataaatccatgttaactag

SEQ ID NO: 1010253 - DNA, 22 bp, Artificial Sequence
  chemically synthesized
gtattgtaaatcctagttaaca

SEQ ID NO: 1010254 - DNA, 22 bp, Artificial Sequence
  chemically synthesized
aaataaatccatgttaactagg

SEQ ID NO: 1010255 - DNA, 22 bp, Artificial Sequence
  chemically synthesized
atagtacaggcttgtattgtaa

SEQ ID NO: 1010256 - DNA, 22 bp, Artificial Sequence
  chemically synthesized
actaggatttacaatacaagcc

SEQ ID NO: 1010257 - DNA, 22 bp, Artificial Sequence
  chemically synthesized
caactcatagtacaggcttgta

SEQ ID NO: 1010258 - DNA, 22 bp, Artificial Sequence
  chemically synthesized
acaactcatagtacaggcttgt

SEQ ID NO: 1010259 - DNA, 22 bp, Artificial Sequence
  chemically synthesized
ggatttacaatacaagcctgta

SEQ ID NO: 1010260 - DNA, 22 bp, Artificial Sequence
  chemically synthesized
tacaactcatagtacaggcttg

SEQ ID NO: 1010261 - DNA, 22 bp, Artificial Sequence
  chemically synthesized
gctttacaactcatagtacagg

SEQ ID NO: 1010262 - DNA, 22 bp, Artificial Sequence
  chemically synthesized
acaatacaagcctgtactatga

SEQ ID NO: 1010263 - DNA, 22 bp, Artificial Sequence
  chemically synthesized
caatacaagcctgtactatgag

SEQ ID NO: 1010264 - DNA, 22 bp, Artificial Sequence
  chemically synthesized
aaaatcctggctttacaactca

SEQ ID NO: 1010265 - DNA, 22 bp, Artificial Sequence
  chemically synthesized
tcaaaatcctggctttacaact

SEQ ID NO: 1010266 - DNA, 22 bp, Artificial Sequence
  chemically synthesized
tactatgagttgtaaagccagg

SEQ ID NO: 1010267 - DNA, 22 bp, Artificial Sequence
  chemically synthesized
tgagttgtaaagccaggatttt

SEQ ID NO: 1010268 - DNA, 22 bp, Artificial Sequence
  chemically synthesized
taaagccaggattttgagaact

SEQ ID NO: 1010269 - DNA, 22 bp, Artificial Sequence
  chemically synthesized
atgtggcagcatagttctcaaa

SEQ ID NO: 1010270 - DNA, 22 bp, Artificial Sequence
  chemically synthesized
aatgtggcagcatagttctcaa

SEQ ID NO: 1010271 - DNA, 22 bp, Artificial Sequence
  chemically synthesized
tgagaactatgctgccacatta

SEQ ID NO: 1010272 - DNA, 22 bp, Artificial Sequence
  chemically synthesized
gagaactatgctgccacattaa

SEQ ID NO: 1010273 - DNA, 22 bp, Artificial Sequence
  chemically synthesized
agaactatgctgccacattaaa

SEQ ID NO: 1010274 - DNA, 22 bp, Artificial Sequence
  chemically synthesized
tgaaaatgaataaatttaatgt

SEQ ID NO: 1010275 - DNA, 22 bp, Artificial Sequence
  chemically synthesized
tgctgccacattaaatttattc

SEQ ID NO: 1010276 - DNA, 22 bp, Artificial Sequence
  chemically synthesized
caggctgtgaaaatgaataaat

SEQ ID NO: 1010277 - DNA, 22 bp, Artificial Sequence
  chemically synthesized
ccacattaaatttattcatttt

SEQ ID NO: 1010278 - DNA, 22 bp, Artificial Sequence
  chemically synthesized
aaatgtctgcaggctgtgaaaa

SEQ ID NO: 1010279 - DNA, 22 bp, Artificial Sequence
  chemically synthesized
aatttattcattttcacagcct

SEQ ID NO: 1010280 - DNA, 22 bp, Artificial Sequence
  chemically synthesized
attcattttcacagcctgcaga

SEQ ID NO: 1010281 - DNA, 22 bp, Artificial Sequence
  chemically synthesized
ttcattttcacagcctgcagac

SEQ ID NO: 1010282 - DNA, 22 bp, Artificial Sequence
  chemically synthesized
aggcattaaaatgtctgcaggc

SEQ ID NO: 1010283 - DNA, 22 bp, Artificial Sequence
  chemically synthesized
attttcacagcctgcagacatt

SEQ ID NO: 1010284 - DNA, 22 bp, Artificial Sequence
  chemically synthesized
ctcaggcattaaaatgtctgca

SEQ ID NO: 1010285 - DNA, 22 bp, Artificial Sequence
  chemically synthesized
ctactcaggcattaaaatgtct

SEQ ID NO: 1010286 - DNA, 22 bp, Artificial Sequence
  chemically synthesized
tcacagcctgcagacattttaa

SEQ ID NO: 1010287 - DNA, 22 bp, Artificial Sequence
  chemically synthesized
cacagcctgcagacattttaat

SEQ ID NO: 1010288 - DNA, 22 bp, Artificial Sequence
  chemically synthesized
acagcctgcagacattttaatg

SEQ ID NO: 1010289 - DNA, 22 bp, Artificial Sequence
  chemically synthesized
ttgctactcaggcattaaaatg

SEQ ID NO: 1010290 - DNA, 22 bp, Artificial Sequence
  chemically synthesized
attgctactcaggcattaaaat

SEQ ID NO: 1010291 - DNA, 22 bp, Artificial Sequence
  chemically synthesized
ttattgctactcaggcattaaa

SEQ ID NO: 1010292 - DNA, 22 bp, Artificial Sequence
  chemically synthesized
ttcttattgctactcaggcatt

SEQ ID NO: 1010293 - DNA, 22 bp, Artificial Sequence
  chemically synthesized
gttcttattgctactcaggcat

SEQ ID NO: 1010294 - DNA, 22 bp, Artificial Sequence
  chemically synthesized
cagacattttaatgcctgagta

SEQ ID NO: 1010295 - DNA, 22 bp, Artificial Sequence
  chemically synthesized
gtaatttgttcttattgctact

SEQ ID NO: 1010296 - DNA, 22 bp, Artificial Sequence
  chemically synthesized
ggtaatttgttcttattgctac

SEQ ID NO: 1010297 - DNA, 22 bp, Artificial Sequence
  chemically synthesized
tggtaatttgttcttattgcta

SEQ ID NO: 1010298 - DNA, 22 bp, Artificial Sequence
  chemically synthesized
taatgcctgagtagcaataaga

SEQ ID NO: 1010299 - DNA, 22 bp, Artificial Sequence
  chemically synthesized
ttggtaatttgttcttattgct

SEQ ID NO: 1010300 - DNA, 22 bp, Artificial Sequence
  chemically synthesized
aatgcctgagtagcaataagaa

SEQ ID NO: 1010301 - DNA, 22 bp, Artificial Sequence
  chemically synthesized
tttggtaatttgttcttattgc

SEQ ID NO: 1010302 - DNA, 22 bp, Artificial Sequence
  chemically synthesized
atgcctgagtagcaataagaac

SEQ ID NO: 1010303 - DNA, 22 bp, Artificial Sequence
  chemically synthesized
ttttggtaatttgttcttattg

SEQ ID NO: 1010304 - DNA, 22 bp, Artificial Sequence
  chemically synthesized
agtagcaataagaacaaattac

SEQ ID NO: 1010305 - DNA, 22 bp, Artificial Sequence
  chemically synthesized
aaagtttttttggtaatttgtt

SEQ ID NO: 1010306 - DNA, 22 bp, Artificial Sequence
  chemically synthesized
ttaaaagtttttttggtaattt

SEQ ID NO: 1010307 - DNA, 22 bp, Artificial Sequence
  chemically synthesized
taccctattaaaagtttttttg

SEQ ID NO: 1010308 - DNA, 22 bp, Artificial Sequence
  chemically synthesized
ttataccctattaaaagttttt

SEQ ID NO: 1010309 - DNA, 22 bp, Artificial Sequence
  chemically synthesized
attataccctattaaaagtttt

SEQ ID NO: 1010310 - DNA, 22 bp, Artificial Sequence
  chemically synthesized
atttattataccctattaaaag

SEQ ID NO: 1010311 - DNA, 22 bp, Artificial Sequence
  chemically synthesized
aatttattataccctattaaaa

SEQ ID NO: 1010312 - DNA, 22 bp, Artificial Sequence
  chemically synthesized
ccaaaaaaacttttaatagggt

SEQ ID NO: 1010313 - DNA, 22 bp, Artificial Sequence
  chemically synthesized
agtcttaatttattatacccta

SEQ ID NO: 1010314 - DNA, 22 bp, Artificial Sequence
  chemically synthesized
ccattcagtcttaatttattat

SEQ ID NO: 1010315 - DNA, 22 bp, Artificial Sequence
  chemically synthesized
ttaatagggtataataaattaa

SEQ ID NO: 1010316 - DNA, 22 bp, Artificial Sequence
  chemically synthesized
taatagggtataataaattaag

SEQ ID NO: 1010317 - DNA, 22 bp, Artificial Sequence
  chemically synthesized
aatagggtataataaattaaga

SEQ ID NO: 1010318 - DNA, 22 bp, Artificial Sequence
  chemically synthesized
atagggtataataaattaagac

SEQ ID NO: 1010319 - DNA, 22 bp, Artificial Sequence
  chemically synthesized
cattaccattcagtcttaattt

SEQ ID NO: 1010320 - DNA, 22 bp, Artificial Sequence
  chemically synthesized
gcattaccattcagtcttaatt

SEQ ID NO: 1010321 - DNA, 22 bp, Artificial Sequence
  chemically synthesized
tacccacgtttgcattaccatt

SEQ ID NO: 1010322 - DNA, 22 bp, Artificial Sequence
  chemically synthesized
ttgtacccacgtttgcattacc

SEQ ID NO: 1010323 - DNA, 22 bp, Artificial Sequence
  chemically synthesized
agactgaatggtaatgcaaacg

SEQ ID NO: 1010324 - DNA, 22 bp, Artificial Sequence
  chemically synthesized
tcctgttgtacccacgtttgca

SEQ ID NO: 1010325 - DNA, 22 bp, Artificial Sequence
  chemically synthesized
gtcctgttgtacccacgtttgc

SEQ ID NO: 1010326 - DNA, 22 bp, Artificial Sequence
  chemically synthesized
tgtcctgttgtacccacgtttg

SEQ ID NO: 1010327 - DNA, 22 bp, Artificial Sequence
  chemically synthesized
aatggtaatgcaaacgtgggta

SEQ ID NO: 1010328 - DNA, 22 bp, Artificial Sequence
  chemically synthesized
ataattttgtcctgttgtaccc

SEQ ID NO: 1010329 - DNA, 22 bp, Artificial Sequence
  chemically synthesized
tatgagattcataattttgtcc

SEQ ID NO: 1010330 - DNA, 22 bp, Artificial Sequence
  chemically synthesized
ggtcattatatgagattcataa

SEQ ID NO: 1010331 - DNA, 22 bp, Artificial Sequence
  chemically synthesized
ttgggtcattatatgagattca

SEQ ID NO: 1010332 - DNA, 22 bp, Artificial Sequence
  chemically synthesized
agtgttgttgggtcattatatg

SEQ ID NO: 1010333 - DNA, 22 bp, Artificial Sequence
  chemically synthesized
taagtgttgttgggtcattata

SEQ ID NO: 1010334 - DNA, 22 bp, Artificial Sequence
  chemically synthesized
tgaatctcatataatgacccaa

SEQ ID NO: 1010335 - DNA, 22 bp, Artificial Sequence
  chemically synthesized
cacactctaagtgttgttgggt

SEQ ID NO: 1010336 - DNA, 22 bp, Artificial Sequence
  chemically synthesized
ccacactctaagtgttgttggg

SEQ ID NO: 1010337 - DNA, 22 bp, Artificial Sequence
  chemically synthesized
atataatgacccaacaacactt

SEQ ID NO: 1010338 - DNA, 22 bp, Artificial Sequence
  chemically synthesized
tttccacactctaagtgttgtt

SEQ ID NO: 1010339 - DNA, 22 bp, Artificial Sequence
  chemically synthesized
agagtgtggaaacaacgttggt

SEQ ID NO: 1010340 - DNA, 22 bp, Artificial Sequence
  chemically synthesized
gagtgtggaaacaacgttggta

SEQ ID NO: 1010341 - DNA, 22 bp, Artificial Sequence
  chemically synthesized
accgtggtcgtatatcccagaa

SEQ ID NO: 1010342 - DNA, 22 bp, Artificial Sequence
  chemically synthesized
ggattaaccgtggtcgtatatc

SEQ ID NO: 1010343 - DNA, 22 bp, Artificial Sequence
  chemically synthesized
gtattctgggatatacgaccac

SEQ ID NO: 1010344 - DNA, 22 bp, Artificial Sequence
  chemically synthesized
tgggatatacgaccacggttaa

SEQ ID NO: 1010345 - DNA, 22 bp, Artificial Sequence
  chemically synthesized
ggatatacgaccacggttaatc

SEQ ID NO: 1010346 - DNA, 22 bp, Artificial Sequence
  chemically synthesized
acaagggaaaaacaattaggat

SEQ ID NO: 1010347 - DNA, 22 bp, Artificial Sequence
  chemically synthesized
gacaagggaaaaacaattagga

SEQ ID NO: 1010348 - DNA, 22 bp, Artificial Sequence
  chemically synthesized
tttgacaagggaaaaacaatta

SEQ ID NO: 1010349 - DNA, 22 bp, Artificial Sequence
  chemically synthesized
tatttgacaagggaaaaacaat

SEQ ID NO: 1010350 - DNA, 22 bp, Artificial Sequence
  chemically synthesized
ctatttgacaagggaaaaacaa

SEQ ID NO: 1010351 - DNA, 22 bp, Artificial Sequence
  chemically synthesized
atcctaattgtttttcccttgt

SEQ ID NO: 1010352 - DNA, 22 bp, Artificial Sequence
  chemically synthesized
attgtttttcccttgtcaaata

SEQ ID NO: 1010353 - DNA, 22 bp, Artificial Sequence
  chemically synthesized
atgtgcaatttctatttgacaa

SEQ ID NO: 1010354 - DNA, 22 bp, Artificial Sequence
  chemically synthesized
tttttcccttgtcaaatagaaa

SEQ ID NO: 1010355 - DNA, 22 bp, Artificial Sequence
  chemically synthesized
agattgatgtgcaatttctatt

SEQ ID NO: 1010356 - DNA, 22 bp, Artificial Sequence
  chemically synthesized
ttcccttgtcaaatagaaattg

SEQ ID NO: 1010357 - DNA, 22 bp, Artificial Sequence
  chemically synthesized
gagattgatgtgcaatttctat

SEQ ID NO: 1010358 - DNA, 22 bp, Artificial Sequence
  chemically synthesized
tcccttgtcaaatagaaattgc

SEQ ID NO: 1010359 - DNA, 22 bp, Artificial Sequence
  chemically synthesized
tgagattgatgtgcaatttcta

SEQ ID NO: 1010360 - DNA, 22 bp, Artificial Sequence
  chemically synthesized
cccttgtcaaatagaaattgca

SEQ ID NO: 1010361 - DNA, 22 bp, Artificial Sequence
  chemically synthesized
ccttgtcaaatagaaattgcac

SEQ ID NO: 1010362 - DNA, 22 bp, Artificial Sequence
  chemically synthesized
gtcaaatagaaattgcacatca

SEQ ID NO: 1010363 - DNA, 22 bp, Artificial Sequence
  chemically synthesized
tcaaatagaaattgcacatcaa

SEQ ID NO: 1010364 - DNA, 22 bp, Artificial Sequence
  chemically synthesized
taatactttgagattgatgtgc

SEQ ID NO: 1010365 - DNA, 22 bp, Artificial Sequence
  chemically synthesized
gtaatactttgagattgatgtg

SEQ ID NO: 1010366 - DNA, 22 bp, Artificial Sequence
  chemically synthesized
cacatcaatctcaaagtattac

SEQ ID NO: 1010367 - DNA, 22 bp, Artificial Sequence
  chemically synthesized
catgtaatgaacagtttgtaat

SEQ ID NO: 1010368 - DNA, 22 bp, Artificial Sequence
  chemically synthesized
gcatgtaatgaacagtttgtaa

SEQ ID NO: 1010369 - DNA, 22 bp, Artificial Sequence
  chemically synthesized
aaagtattacaaactgttcatt

SEQ ID NO: 1010370 - DNA, 22 bp, Artificial Sequence
  chemically synthesized
caaactgttcattacatgcaaa

SEQ ID NO: 1010371 - DNA, 22 bp, Artificial Sequence
  chemically synthesized
cagaacataaccatttgcatgt

SEQ ID NO: 1010372 - DNA, 22 bp, Artificial Sequence
  chemically synthesized
ttcattacatgcaaatggttat

SEQ ID NO: 1010373 - DNA, 22 bp, Artificial Sequence
  chemically synthesized
attacatgcaaatggttatgtt

SEQ ID NO: 1010374 - DNA, 22 bp, Artificial Sequence
  chemically synthesized
gagagcctgcagaacataacca

SEQ ID NO: 1010375 - DNA, 22 bp, Artificial Sequence
  chemically synthesized
ggagagcctgcagaacataacc

SEQ ID NO: 1010376 - DNA, 22 bp, Artificial Sequence
  chemically synthesized
catgcaaatggttatgttctgc

SEQ ID NO: 1010377 - DNA, 22 bp, Artificial Sequence
  chemically synthesized
agtccccttggagagcctgcag

SEQ ID NO: 1010378 - DNA, 22 bp, Artificial Sequence
  chemically synthesized
tgttctgcaggctctccaaggg

SEQ ID NO: 1010379 - DNA, 22 bp, Artificial Sequence
  chemically synthesized
taaagaaggttgagtccccttg

SEQ ID NO: 1010380 - DNA, 22 bp, Artificial Sequence
  chemically synthesized
tgcaggctctccaaggggactc

SEQ ID NO: 1010381 - DNA, 22 bp, Artificial Sequence
  chemically synthesized
gtaaagaaggttgagtcccctt

SEQ ID NO: 1010382 - DNA, 22 bp, Artificial Sequence
  chemically synthesized
tgtaaagaaggttgagtcccct

SEQ ID NO: 1010383 - DNA, 22 bp, Artificial Sequence
  chemically synthesized
caggctctccaaggggactcaa

SEQ ID NO: 1010384 - DNA, 22 bp, Artificial Sequence
  chemically synthesized
ttgtaaagaaggttgagtcccc

SEQ ID NO: 1010385 - DNA, 22 bp, Artificial Sequence
  chemically synthesized
cttttgtaaagaaggttgagtc

SEQ ID NO: 1010386 - DNA, 22 bp, Artificial Sequence
  chemically synthesized
tccaaggggactcaaccttctt

SEQ ID NO: 1010387 - DNA, 22 bp, Artificial Sequence
  chemically synthesized
gctccttttgtaaagaaggttg

SEQ ID NO: 1010388 - DNA, 22 bp, Artificial Sequence
  chemically synthesized
caaggggactcaaccttcttta

SEQ ID NO: 1010389 - DNA, 22 bp, Artificial Sequence
  chemically synthesized
gcctggctccttttgtaaagaa

SEQ ID NO: 1010390 - DNA, 22 bp, Artificial Sequence
  chemically synthesized
tagcctggctccttttgtaaag

SEQ ID NO: 1010391 - DNA, 22 bp, Artificial Sequence
  chemically synthesized
ctagcctggctccttttgtaaa

SEQ ID NO: 1010392 - DNA, 22 bp, Artificial Sequence
  chemically synthesized
cttctagcctggctccttttgt

SEQ ID NO: 1010393 - DNA, 22 bp, Artificial Sequence
  chemically synthesized
aaccttctttacaaaaggagcc

SEQ ID NO: 1010394 - DNA, 22 bp, Artificial Sequence
  chemically synthesized
tgcttctagcctggctcctttt

SEQ ID NO: 1010395 - DNA, 22 bp, Artificial Sequence
  chemically synthesized
ctttacaaaaggagccaggcta

SEQ ID NO: 1010396 - DNA, 22 bp, Artificial Sequence
  chemically synthesized
tttacaaaaggagccaggctag

SEQ ID NO: 1010397 - DNA, 22 bp, Artificial Sequence
  chemically synthesized
tacaaaaggagccaggctagaa

SEQ ID NO: 1010398 - DNA, 22 bp, Artificial Sequence
  chemically synthesized
gagaaactctgcttctagcctg

SEQ ID NO: 1010399 - DNA, 22 bp, Artificial Sequence
  chemically synthesized
acaaaaggagccaggctagaag

SEQ ID NO: 1010400 - DNA, 22 bp, Artificial Sequence
  chemically synthesized
caaaaggagccaggctagaagc

SEQ ID NO: 1010401 - DNA, 22 bp, Artificial Sequence
  chemically synthesized
tcattagagaaactctgcttct

SEQ ID NO: 1010402 - DNA, 22 bp, Artificial Sequence
  chemically synthesized
ctgtcattagagaaactctgct

SEQ ID NO: 1010403 - DNA, 22 bp, Artificial Sequence
  chemically synthesized
actgtcattagagaaactctgc

SEQ ID NO: 1010404 - DNA, 22 bp, Artificial Sequence
  chemically synthesized
gaagcagagtttctctaatgac

SEQ ID NO: 1010405 - DNA, 22 bp, Artificial Sequence
  chemically synthesized
atggatacttactgtcattaga

SEQ ID NO: 1010406 - DNA, 22 bp, Artificial Sequence
  chemically synthesized
taatggatacttactgtcatta

SEQ ID NO: 1010407 - DNA, 22 bp, Artificial Sequence
  chemically synthesized
ctctaatgacagtaagtatcca

SEQ ID NO: 1010408 - DNA, 22 bp, Artificial Sequence
  chemically synthesized
tctaatgacagtaagtatccat

SEQ ID NO: 1010409 - DNA, 22 bp, Artificial Sequence
  chemically synthesized
taatgacagtaagtatccatta

SEQ ID NO: 1010410 - DNA, 22 bp, Artificial Sequence
  chemically synthesized
atgacagtaagtatccattaga

SEQ ID NO: 1010411 - DNA, 22 bp, Artificial Sequence
  chemically synthesized
tatatgaggaactctaatggat

SEQ ID NO: 1010412 - DNA, 22 bp, Artificial Sequence
  chemically synthesized
atatatgaggaactctaatgga

SEQ ID NO: 1010413 - DNA, 22 bp, Artificial Sequence
  chemically synthesized
cttatatatgaggaactctaat

SEQ ID NO: 1010414 - DNA, 22 bp, Artificial Sequence
  chemically synthesized
gcttatatatgaggaactctaa

SEQ ID NO: 1010415 - DNA, 22 bp, Artificial Sequence
  chemically synthesized
ttgcttatatatgaggaactct

SEQ ID NO: 1010416 - DNA, 22 bp, Artificial Sequence
  chemically synthesized
tcttgcttatatatgaggaact

SEQ ID NO: 1010417 - DNA, 22 bp, Artificial Sequence
  chemically synthesized
gagttcctcatatataagcaag

SEQ ID NO: 1010418 - DNA, 22 bp, Artificial Sequence
  chemically synthesized
ctcatatataagcaagagagac

SEQ ID NO: 1010419 - DNA, 22 bp, Artificial Sequence
  chemically synthesized
ggaatcagaggcagtctctctt

SEQ ID NO: 1010420 - DNA, 22 bp, Artificial Sequence
  chemically synthesized
gggaatcagaggcagtctctct

SEQ ID NO: 1010421 - DNA, 22 bp, Artificial Sequence
  chemically synthesized
atatataagcaagagagactgc

SEQ ID NO: 1010422 - DNA, 22 bp, Artificial Sequence
  chemically synthesized
tgggaatcagaggcagtctctc

SEQ ID NO: 1010423 - DNA, 22 bp, Artificial Sequence
  chemically synthesized
actttgggaatcagaggcagtc

SEQ ID NO: 1010424 - DNA, 22 bp, Artificial Sequence
  chemically synthesized
ggaaaacctgactttgggaatc

SEQ ID NO: 1010425 - DNA, 22 bp, Artificial Sequence
  chemically synthesized
gggaaaacctgactttgggaat

SEQ ID NO: 1010426 - DNA, 22 bp, Artificial Sequence
  chemically synthesized
acttgggaaaacctgactttgg

SEQ ID NO: 1010427 - DNA, 22 bp, Artificial Sequence
  chemically synthesized
cctctgattcccaaagtcaggt

SEQ ID NO: 1010428 - DNA, 22 bp, Artificial Sequence
  chemically synthesized
gtctgacttgggaaaacctgac

SEQ ID NO: 1010429 - DNA, 22 bp, Artificial Sequence
  chemically synthesized
tgattcccaaagtcaggttttc

SEQ ID NO: 1010430 - DNA, 22 bp, Artificial Sequence
  chemically synthesized
attcccaaagtcaggttttccc

SEQ ID NO: 1010431 - DNA, 22 bp, Artificial Sequence
  chemically synthesized
ccaaagtcaggttttcccaagt

SEQ ID NO: 1010432 - DNA, 22 bp, Artificial Sequence
  chemically synthesized
ggatacctagtctgacttggga

SEQ ID NO: 1010433 - DNA, 22 bp, Artificial Sequence
  chemically synthesized
tgggatacctagtctgacttgg

SEQ ID NO: 1010434 - DNA, 22 bp, Artificial Sequence
  chemically synthesized
cacctctgggatacctagtctg

SEQ ID NO: 1010435 - DNA, 22 bp, Artificial Sequence
  chemically synthesized
tcccaagtcagactaggtatcc

SEQ ID NO: 1010436 - DNA, 22 bp, Artificial Sequence
  chemically synthesized
cccaagtcagactaggtatccc

SEQ ID NO: 1010437 - DNA, 22 bp, Artificial Sequence
  chemically synthesized
cattacacctctgggataccta

SEQ ID NO: 1010438 - DNA, 22 bp, Artificial Sequence
  chemically synthesized
ccaagtcagactaggtatccca

SEQ ID NO: 1010439 - DNA, 22 bp, Artificial Sequence
  chemically synthesized
acagtcctccattacacctctg

SEQ ID NO: 1010440 - DNA, 22 bp, Artificial Sequence
  chemically synthesized
attgacagtcctccattacacc

SEQ ID NO: 1010441 - DNA, 22 bp, Artificial Sequence
  chemically synthesized
ggtatcccagaggtgtaatgga

SEQ ID NO: 1010442 - DNA, 22 bp, Artificial Sequence
  chemically synthesized
ccccctaattgacagtcctcca

SEQ ID NO: 1010443 - DNA, 22 bp, Artificial Sequence
  chemically synthesized
ctgccccctaattgacagtcct

SEQ ID NO: 1010444 - DNA, 22 bp, Artificial Sequence
  chemically synthesized
cctgccccctaattgacagtcc

SEQ ID NO: 1010445 - DNA, 22 bp, Artificial Sequence
  chemically synthesized
tcctgccccctaattgacagtc

SEQ ID NO: 1010446 - DNA, 22 bp, Artificial Sequence
  chemically synthesized
ttcctgccccctaattgacagt

SEQ ID NO: 1010447 - DNA, 22 bp, Artificial Sequence
  chemically synthesized
tttttcctgccccctaattgac

SEQ ID NO: 1010448 - DNA, 22 bp, Artificial Sequence
  chemically synthesized
ttatttttcctgccccctaatt

SEQ ID NO: 1010449 - DNA, 22 bp, Artificial Sequence
  chemically synthesized
cagctgttatttttcctgcccc

SEQ ID NO: 1010450 - DNA, 22 bp, Artificial Sequence
  chemically synthesized
ccagctgttatttttcctgccc

SEQ ID NO: 1010451 - DNA, 22 bp, Artificial Sequence
  chemically synthesized
tccagctgttatttttcctgcc

SEQ ID NO: 1010452 - DNA, 22 bp, Artificial Sequence
  chemically synthesized
ttccagctgttatttttcctgc

SEQ ID NO: 1010453 - DNA, 22 bp, Artificial Sequence
  chemically synthesized
tcaattagggggcaggaaaaat

SEQ ID NO: 1010454 - DNA, 22 bp, Artificial Sequence
  chemically synthesized
tttttccagctgttatttttcc

SEQ ID NO: 1010455 - DNA, 22 bp, Artificial Sequence
  chemically synthesized
gggggcaggaaaaataacagct

SEQ ID NO: 1010456 - DNA, 22 bp, Artificial Sequence
  chemically synthesized
ggacaaatggtgggttgttttt

SEQ ID NO: 1010457 - DNA, 22 bp, Artificial Sequence
  chemically synthesized
gcctaggacaaatggtgggttg

SEQ ID NO: 1010458 - DNA, 22 bp, Artificial Sequence
  chemically synthesized
gaaaaacaacccaccatttgtc

SEQ ID NO: 1010459 - DNA, 22 bp, Artificial Sequence
  chemically synthesized
gatctggcctaggacaaatggt

SEQ ID NO: 1010460 - DNA, 22 bp, Artificial Sequence
  chemically synthesized
cagaaagtactggatctggcct

SEQ ID NO: 1010461 - DNA, 22 bp, Artificial Sequence
  chemically synthesized
gtcctaggccagatccagtact

SEQ ID NO: 1010462 - DNA, 22 bp, Artificial Sequence
  chemically synthesized
tcctaggccagatccagtactt

SEQ ID NO: 1010463 - DNA, 22 bp, Artificial Sequence
  chemically synthesized
ggccagatccagtactttctgg

SEQ ID NO: 1010464 - DNA, 22 bp, Artificial Sequence
  chemically synthesized
aagcaaagggcagtaagtaaac

SEQ ID NO: 1010465 - DNA, 22 bp, Artificial Sequence
  chemically synthesized
tctggagtgtttacttactgcc

SEQ ID NO: 1010466 - DNA, 22 bp, Artificial Sequence
  chemically synthesized
ctggagtgtttacttactgccc

SEQ ID NO: 1010467 - DNA, 22 bp, Artificial Sequence
  chemically synthesized
tggagtgtttacttactgccct

SEQ ID NO: 1010468 - DNA, 22 bp, Artificial Sequence
  chemically synthesized
gagtgtttacttactgcccttt

SEQ ID NO: 1010469 - DNA, 22 bp, Artificial Sequence
  chemically synthesized
aggcacaacgtctaaagcaaag

SEQ ID NO: 1010470 - DNA, 22 bp, Artificial Sequence
  chemically synthesized
aaggcacaacgtctaaagcaaa

SEQ ID NO: 1010471 - DNA, 22 bp, Artificial Sequence
  chemically synthesized
acttactgccctttgctttaga

SEQ ID NO: 1010472 - DNA, 22 bp, Artificial Sequence
  chemically synthesized
cttactgccctttgctttagac

SEQ ID NO: 1010473 - DNA, 22 bp, Artificial Sequence
  chemically synthesized
actgccctttgctttagacgtt

SEQ ID NO: 1010474 - DNA, 22 bp, Artificial Sequence
  chemically synthesized
ctgccctttgctttagacgttg

SEQ ID NO: 1010475 - DNA, 22 bp, Artificial Sequence
  chemically synthesized
aacgtcttaaggcacaacgtct

SEQ ID NO: 1010476 - DNA, 22 bp, Artificial Sequence
  chemically synthesized
ccctttgctttagacgttgtgc

SEQ ID NO: 1010477 - DNA, 22 bp, Artificial Sequence
  chemically synthesized
tgctttagacgttgtgccttaa

SEQ ID NO: 1010478 - DNA, 22 bp, Artificial Sequence
  chemically synthesized
gctttagacgttgtgccttaag

SEQ ID NO: 1010479 - DNA, 22 bp, Artificial Sequence
  chemically synthesized
ctttagacgttgtgccttaaga

SEQ ID NO: 1010480 - DNA, 22 bp, Artificial Sequence
  chemically synthesized
atgagttcaacgtcttaaggca

SEQ ID NO: 1010481 - DNA, 22 bp, Artificial Sequence
  chemically synthesized
tagacgttgtgccttaagacgt

SEQ ID NO: 1010482 - DNA, 22 bp, Artificial Sequence
  chemically synthesized
agacgttgtgccttaagacgtt

SEQ ID NO: 1010483 - DNA, 22 bp, Artificial Sequence
  chemically synthesized
gacgttgtgccttaagacgttg

SEQ ID NO: 1010484 - DNA, 22 bp, Artificial Sequence
  chemically synthesized
acagtctcatgagttcaacgtc

SEQ ID NO: 1010485 - DNA, 22 bp, Artificial Sequence
  chemically synthesized
tgccttaagacgttgaactcat

SEQ ID NO: 1010486 - DNA, 22 bp, Artificial Sequence
  chemically synthesized
tgagctcacagtctcatgagtt

SEQ ID NO: 1010487 - DNA, 22 bp, Artificial Sequence
  chemically synthesized
atgagctcacagtctcatgagt

SEQ ID NO: 1010488 - DNA, 22 bp, Artificial Sequence
  chemically synthesized
tatgagctcacagtctcatgag

SEQ ID NO: 1010489 - DNA, 22 bp, Artificial Sequence
  chemically synthesized
aagacgttgaactcatgagact

SEQ ID NO: 1010490 - DNA, 22 bp, Artificial Sequence
  chemically synthesized
agacgttgaactcatgagactg

SEQ ID NO: 1010491 - DNA, 22 bp, Artificial Sequence
  chemically synthesized
tttatgagctcacagtctcatg

SEQ ID NO: 1010492 - DNA, 22 bp, Artificial Sequence
  chemically synthesized
tctttatgagctcacagtctca

SEQ ID NO: 1010493 - DNA, 22 bp, Artificial Sequence
  chemically synthesized
ctctttatgagctcacagtctc

SEQ ID NO: 1010494 - DNA, 22 bp, Artificial Sequence
  chemically synthesized
tctctttatgagctcacagtct

SEQ ID NO: 1010495 - DNA, 22 bp, Artificial Sequence
  chemically synthesized
ttctctttatgagctcacagtc

SEQ ID NO: 1010496 - DNA, 22 bp, Artificial Sequence
  chemically synthesized
aactcatgagactgtgagctca

SEQ ID NO: 1010497 - DNA, 22 bp, Artificial Sequence
  chemically synthesized
cttttctctttatgagctcaca

SEQ ID NO: 1010498 - DNA, 22 bp, Artificial Sequence
  chemically synthesized
atgagactgtgagctcataaag

SEQ ID NO: 1010499 - DNA, 22 bp, Artificial Sequence
  chemically synthesized
agagctccttttctctttatga

SEQ ID NO: 1010500 - DNA, 22 bp, Artificial Sequence
  chemically synthesized
actaagagctccttttctcttt

SEQ ID NO: 1010501 - DNA, 22 bp, Artificial Sequence
  chemically synthesized
tgagctcataaagagaaaagga

SEQ ID NO: 1010502 - DNA, 22 bp, Artificial Sequence
  chemically synthesized
ataaagagaaaaggagctctta

SEQ ID NO: 1010503 - DNA, 22 bp, Artificial Sequence
  chemically synthesized
ggaatacagagctgactaagag

SEQ ID NO: 1010504 - DNA, 22 bp, Artificial Sequence
  chemically synthesized
ctaggaatacagagctgactaa

SEQ ID NO: 1010505 - DNA, 22 bp, Artificial Sequence
  chemically synthesized
ctgctaggaatacagagctgac

SEQ ID NO: 1010506 - DNA, 22 bp, Artificial Sequence
  chemically synthesized
gctgctaggaatacagagctga

SEQ ID NO: 1010507 - DNA, 22 bp, Artificial Sequence
  chemically synthesized
cttgctgctaggaatacagagc

SEQ ID NO: 1010508 - DNA, 22 bp, Artificial Sequence
  chemically synthesized
ttagtcagctctgtattcctag

SEQ ID NO: 1010509 - DNA, 22 bp, Artificial Sequence
  chemically synthesized
agtcagctctgtattcctagca

SEQ ID NO: 1010510 - DNA, 22 bp, Artificial Sequence
  chemically synthesized
gtcagctctgtattcctagcag

SEQ ID NO: 1010511 - DNA, 22 bp, Artificial Sequence
  chemically synthesized
tgtattcctagcagcaagcagt

SEQ ID NO: 1010512 - DNA, 22 bp, Artificial Sequence
  chemically synthesized
tattcctagcagcaagcagtat

SEQ ID NO: 1010513 - DNA, 22 bp, Artificial Sequence
  chemically synthesized
tgtgcaaagcagatactgcttg

SEQ ID NO: 1010514 - DNA, 22 bp, Artificial Sequence
  chemically synthesized
ctgtgtgcaaagcagatactgc

SEQ ID NO: 1010515 - DNA, 22 bp, Artificial Sequence
  chemically synthesized
ctagcagcaagcagtatctgct

SEQ ID NO: 1010516 - DNA, 22 bp, Artificial Sequence
  chemically synthesized
gcagcaagcagtatctgctttg

SEQ ID NO: 1010517 - DNA, 22 bp, Artificial Sequence
  chemically synthesized
tgatcctactgtgtgcaaagca

SEQ ID NO: 1010518 - DNA, 22 bp, Artificial Sequence
  chemically synthesized
ctttgcacacagtaggatcaca

SEQ ID NO: 1010519 - DNA, 22 bp, Artificial Sequence
  chemically synthesized
tgcacacagtaggatcacaata

SEQ ID NO: 1010520 - DNA, 22 bp, Artificial Sequence
  chemically synthesized
gcacacagtaggatcacaatat

SEQ ID NO: 1010521 - DNA, 22 bp, Artificial Sequence
  chemically synthesized
cacacagtaggatcacaatata

SEQ ID NO: 1010522 - DNA, 22 bp, Artificial Sequence
  chemically synthesized
aataccagaacccatgtaacaa

SEQ ID NO: 1010523 - DNA, 22 bp, Artificial Sequence
  chemically synthesized
gagcatatgttaaataccagaa

SEQ ID NO: 1010524 - DNA, 22 bp, Artificial Sequence
  chemically synthesized
gttacatgggttctggtattta

SEQ ID NO: 1010525 - DNA, 22 bp, Artificial Sequence
  chemically synthesized
ttacatgggttctggtatttaa

SEQ ID NO: 1010526 - DNA, 22 bp, Artificial Sequence
  chemically synthesized
catgggttctggtatttaacat

SEQ ID NO: 1010527 - DNA, 22 bp, Artificial Sequence
  chemically synthesized
cccattggagcatatgttaaat

SEQ ID NO: 1010528 - DNA, 22 bp, Artificial Sequence
  chemically synthesized
acccattggagcatatgttaaa

SEQ ID NO: 1010529 - DNA, 22 bp, Artificial Sequence
  chemically synthesized
ttacccattggagcatatgtta

SEQ ID NO: 1010530 - DNA, 22 bp, Artificial Sequence
  chemically synthesized
tcttacccattggagcatatgt

SEQ ID NO: 1010531 - DNA, 22 bp, Artificial Sequence
  chemically synthesized
tggtatttaacatatgctccaa

SEQ ID NO: 1010532 - DNA, 22 bp, Artificial Sequence
  chemically synthesized
ttctcttacccattggagcata

SEQ ID NO: 1010533 - DNA, 22 bp, Artificial Sequence
  chemically synthesized
gtatttaacatatgctccaatg

SEQ ID NO: 1010534 - DNA, 22 bp, Artificial Sequence
  chemically synthesized
aacatatgctccaatgggtaag

SEQ ID NO: 1010535 - DNA, 22 bp, Artificial Sequence
  chemically synthesized
acatatgctccaatgggtaaga

SEQ ID NO: 1010536 - DNA, 22 bp, Artificial Sequence
  chemically synthesized
acaatatgatggccctgttctc

SEQ ID NO: 1010537 - DNA, 22 bp, Artificial Sequence
  chemically synthesized
aacaatatgatggccctgttct

SEQ ID NO: 1010538 - DNA, 22 bp, Artificial Sequence
  chemically synthesized
caatgggtaagagaacagggcc

SEQ ID NO: 1010539 - DNA, 22 bp, Artificial Sequence
  chemically synthesized
taacaatatgatggccctgttc

SEQ ID NO: 1010540 - DNA, 22 bp, Artificial Sequence
  chemically synthesized
atactttaacaatatgatggcc

SEQ ID NO: 1010541 - DNA, 22 bp, Artificial Sequence
  chemically synthesized
cctgatactttaacaatatgat

SEQ ID NO: 1010542 - DNA, 22 bp, Artificial Sequence
  chemically synthesized
acattgcctgatactttaacaa

SEQ ID NO: 1010543 - DNA, 22 bp, Artificial Sequence
  chemically synthesized
cacattgcctgatactttaaca

SEQ ID NO: 1010544 - DNA, 22 bp, Artificial Sequence
  chemically synthesized
tcacattgcctgatactttaac

SEQ ID NO: 1010545 - DNA, 22 bp, Artificial Sequence
  chemically synthesized
aaattttcacattgcctgatac

SEQ ID NO: 1010546 - DNA, 22 bp, Artificial Sequence
  chemically synthesized
aaaattttcacattgcctgata

SEQ ID NO: 1010547 - DNA, 22 bp, Artificial Sequence
  chemically synthesized
ttaaagtatcaggcaatgtgaa

SEQ ID NO: 1010548 - DNA, 22 bp, Artificial Sequence
  chemically synthesized
aagtatcaggcaatgtgaaaat

SEQ ID NO: 1010549 - DNA, 22 bp, Artificial Sequence
  chemically synthesized
tgtacagagcacttaaaatttt

SEQ ID NO: 1010550 - DNA, 22 bp, Artificial Sequence
  chemically synthesized
tgtgtacagagcacttaaaatt

SEQ ID NO: 1010551 - DNA, 22 bp, Artificial Sequence
  chemically synthesized
ctgtgtacagagcacttaaaat

SEQ ID NO: 1010552 - DNA, 22 bp, Artificial Sequence
  chemically synthesized
ttctgtgtacagagcacttaaa

SEQ ID NO: 1010553 - DNA, 22 bp, Artificial Sequence
  chemically synthesized
acctcttctgtgtacagagcac

SEQ ID NO: 1010554 - DNA, 22 bp, Artificial Sequence
  chemically synthesized
cacctcttctgtgtacagagca

SEQ ID NO: 1010555 - DNA, 22 bp, Artificial Sequence
  chemically synthesized
cttcacctcttctgtgtacaga

SEQ ID NO: 1010556 - DNA, 22 bp, Artificial Sequence
  chemically synthesized
ccttcacctcttctgtgtacag

SEQ ID NO: 1010557 - DNA, 22 bp, Artificial Sequence
  chemically synthesized
taagtgctctgtacacagaaga

SEQ ID NO: 1010558 - DNA, 22 bp, Artificial Sequence
  chemically synthesized
aagtgctctgtacacagaagag

SEQ ID NO: 1010559 - DNA, 22 bp, Artificial Sequence
  chemically synthesized
agcttccttcacctcttctgtg

SEQ ID NO: 1010560 - DNA, 22 bp, Artificial Sequence
  chemically synthesized
agtgctctgtacacagaagagg

SEQ ID NO: 1010561 - DNA, 22 bp, Artificial Sequence
  chemically synthesized
cattgagcttccttcacctctt

SEQ ID NO: 1010562 - DNA, 22 bp, Artificial Sequence
  chemically synthesized
acattgagcttccttcacctct

SEQ ID NO: 1010563 - DNA, 22 bp, Artificial Sequence
  chemically synthesized
tgtacacagaagaggtgaagga

SEQ ID NO: 1010564 - DNA, 22 bp, Artificial Sequence
  chemically synthesized
ttacattgagcttccttcacct

SEQ ID NO: 1010565 - DNA, 22 bp, Artificial Sequence
  chemically synthesized
tacacagaagaggtgaaggaag

SEQ ID NO: 1010566 - DNA, 22 bp, Artificial Sequence
  chemically synthesized
tcttacattgagcttccttcac

SEQ ID NO: 1010567 - DNA, 22 bp, Artificial Sequence
  chemically synthesized
tctcttacattgagcttccttc

SEQ ID NO: 1010568 - DNA, 22 bp, Artificial Sequence
  chemically synthesized
atagccaaaacattctctctta

SEQ ID NO: 1010569 - DNA, 22 bp, Artificial Sequence
  chemically synthesized
catagccaaaacattctctctt

SEQ ID NO: 1010570 - DNA, 22 bp, Artificial Sequence
  chemically synthesized
tcatagccaaaacattctctct

SEQ ID NO: 1010571 - DNA, 22 bp, Artificial Sequence
  chemically synthesized
ttcatagccaaaacattctctc

SEQ ID NO: 1010572 - DNA, 22 bp, Artificial Sequence
  chemically synthesized
cttttcatagccaaaacattct

SEQ ID NO: 1010573 - DNA, 22 bp, Artificial Sequence
  chemically synthesized
gcttttcatagccaaaacattc

SEQ ID NO: 1010574 - DNA, 22 bp, Artificial Sequence
  chemically synthesized
aatgtaagagagaatgttttgg

SEQ ID NO: 1010575 - DNA, 22 bp, Artificial Sequence
  chemically synthesized
tccttgcttttcatagccaaaa

SEQ ID NO: 1010576 - DNA, 22 bp, Artificial Sequence
  chemically synthesized
gtccttgcttttcatagccaaa

SEQ ID NO: 1010577 - DNA, 22 bp, Artificial Sequence
  chemically synthesized
tggctatgaaaagcaaggacaa

SEQ ID NO: 1010578 - DNA, 22 bp, Artificial Sequence
  chemically synthesized
ggctatgaaaagcaaggacaaa

SEQ ID NO: 1010579 - DNA, 22 bp, Artificial Sequence
  chemically synthesized
gctatgaaaagcaaggacaaac

SEQ ID NO: 1010580 - DNA, 22 bp, Artificial Sequence
  chemically synthesized
tgaaaagcaaggacaaacttgg

SEQ ID NO: 1010581 - DNA, 22 bp, Artificial Sequence
  chemically synthesized
agacaaatgatccccaagtttg

SEQ ID NO: 1010582 - DNA, 22 bp, Artificial Sequence
  chemically synthesized
cctgagacaaatgatccccaag

SEQ ID NO: 1010583 - DNA, 22 bp, Artificial Sequence
  chemically synthesized
tattacctgagacaaatgatcc

SEQ ID NO: 1010584 - DNA, 22 bp, Artificial Sequence
  chemically synthesized
ttgtattacctgagacaaatga

SEQ ID NO: 1010585 - DNA, 22 bp, Artificial Sequence
  chemically synthesized
attgtattacctgagacaaatg

SEQ ID NO: 1010586 - DNA, 22 bp, Artificial Sequence
  chemically synthesized
tattgtattacctgagacaaat

SEQ ID NO: 1010587 - DNA, 22 bp, Artificial Sequence
  chemically synthesized
ttattgtattacctgagacaaa

SEQ ID NO: 1010588 - DNA, 22 bp, Artificial Sequence
  chemically synthesized
ggggatcatttgtctcaggtaa

SEQ ID NO: 1010589 - DNA, 22 bp, Artificial Sequence
  chemically synthesized
gggatcatttgtctcaggtaat

SEQ ID NO: 1010590 - DNA, 22 bp, Artificial Sequence
  chemically synthesized
aaaatgatacttttattgtatt

SEQ ID NO: 1010591 - DNA, 22 bp, Artificial Sequence
  chemically synthesized
aaaaatgatacttttattgtat

SEQ ID NO: 1010592 - DNA, 22 bp, Artificial Sequence
  chemically synthesized
gtctcaggtaatacaataaaag

SEQ ID NO: 1010593 - DNA, 22 bp, Artificial Sequence
  chemically synthesized
tctcaggtaatacaataaaagt

SEQ ID NO: 1010594 - DNA, 22 bp, Artificial Sequence
  chemically synthesized
aggtaatacaataaaagtatca

SEQ ID NO: 1010595 - DNA, 22 bp, Artificial Sequence
  chemically synthesized
agtagaacgaataaatacataa

SEQ ID NO: 1010596 - DNA, 22 bp, Artificial Sequence
  chemically synthesized
ttaaatttatttatgtatttat

SEQ ID NO: 1010597 - DNA, 22 bp, Artificial Sequence
  chemically synthesized
taaatttatttatgtatttatt

SEQ ID NO: 1010598 - DNA, 22 bp, Artificial Sequence
  chemically synthesized
aaatttatttatgtatttattc

SEQ ID NO: 1010599 - DNA, 22 bp, Artificial Sequence
  chemically synthesized
aatttatttatgtatttattcg

SEQ ID NO: 1010600 - DNA, 22 bp, Artificial Sequence
  chemically synthesized
atttatgtatttattcgttcta

SEQ ID NO: 1010601 - DNA, 22 bp, Artificial Sequence
  chemically synthesized
tttatgtatttattcgttctac

SEQ ID NO: 1010602 - DNA, 22 bp, Artificial Sequence
  chemically synthesized
atgtatttattcgttctactga

SEQ ID NO: 1010603 - DNA, 22 bp, Artificial Sequence
  chemically synthesized
aaaatgtaatattcagtagaac

SEQ ID NO: 1010604 - DNA, 22 bp, Artificial Sequence
  chemically synthesized
tgtatttattcgttctactgaa

SEQ ID NO: 1010605 - DNA, 22 bp, Artificial Sequence
  chemically synthesized
attcgttctactgaatattaca

SEQ ID NO: 1010606 - DNA, 22 bp, Artificial Sequence
  chemically synthesized
atatattgaaaatgtaatattc

SEQ ID NO: 1010607 - DNA, 22 bp, Artificial Sequence
  chemically synthesized
ttcgttctactgaatattacat

SEQ ID NO: 1010608 - DNA, 22 bp, Artificial Sequence
  chemically synthesized
gttctactgaatattacatttt

SEQ ID NO: 1010609 - DNA, 22 bp, Artificial Sequence
  chemically synthesized
attcatatattgaaaatgtaat

SEQ ID NO: 1010610 - DNA, 22 bp, Artificial Sequence
  chemically synthesized
tactgaatattacattttcaat

SEQ ID NO: 1010611 - DNA, 22 bp, Artificial Sequence
  chemically synthesized
ctgaatattacattttcaatat

SEQ ID NO: 1010612 - DNA, 22 bp, Artificial Sequence
  chemically synthesized
aatattacattttcaatatatg

SEQ ID NO: 1010613 - DNA, 22 bp, Artificial Sequence
  chemically synthesized
cattttcaatatatgaatcaat

SEQ ID NO: 1010614 - DNA, 22 bp, Artificial Sequence
  chemically synthesized
ggtacgtagaaaaattgattca

SEQ ID NO: 1010615 - DNA, 22 bp, Artificial Sequence
  chemically synthesized
tcaatatatgaatcaatttttc

SEQ ID NO: 1010616 - DNA, 22 bp, Artificial Sequence
  chemically synthesized
caatatatgaatcaatttttct

SEQ ID NO: 1010617 - DNA, 22 bp, Artificial Sequence
  chemically synthesized
aatatatgaatcaatttttcta

SEQ ID NO: 1010618 - DNA, 22 bp, Artificial Sequence
  chemically synthesized
gatcaccaatatacctcggtac

SEQ ID NO: 1010619 - DNA, 22 bp, Artificial Sequence
  chemically synthesized
tcgatcaccaatatacctcggt

SEQ ID NO: 1010620 - DNA, 22 bp, Artificial Sequence
  chemically synthesized
ctcgatcaccaatatacctcgg

SEQ ID NO: 1010621 - DNA, 22 bp, Artificial Sequence
  chemically synthesized
tctcgatcaccaatatacctcg

SEQ ID NO: 1010622 - DNA, 22 bp, Artificial Sequence
  chemically synthesized
ttctacgtaccgaggtatattg

SEQ ID NO: 1010623 - DNA, 22 bp, Artificial Sequence
  chemically synthesized
tctacgtaccgaggtatattgg

SEQ ID NO: 1010624 - DNA, 22 bp, Artificial Sequence
  chemically synthesized
ctacgtaccgaggtatattggt

SEQ ID NO: 1010625 - DNA, 22 bp, Artificial Sequence
  chemically synthesized
tacgtaccgaggtatattggtg

SEQ ID NO: 1010626 - DNA, 22 bp, Artificial Sequence
  chemically synthesized
gtctttctcgatcaccaatata

SEQ ID NO: 1010627 - DNA, 22 bp, Artificial Sequence
  chemically synthesized
ggtctttctcgatcaccaatat

SEQ ID NO: 1010628 - DNA, 22 bp, Artificial Sequence
  chemically synthesized
cgtaccgaggtatattggtgat

SEQ ID NO: 1010629 - DNA, 22 bp, Artificial Sequence
  chemically synthesized
ggtacttggtctttctcgatca

SEQ ID NO: 1010630 - DNA, 22 bp, Artificial Sequence
  chemically synthesized
gggtacttggtctttctcgatc

SEQ ID NO: 1010631 - DNA, 22 bp, Artificial Sequence
  chemically synthesized
tgggtacttggtctttctcgat

SEQ ID NO: 1010632 - DNA, 22 bp, Artificial Sequence
  chemically synthesized
gtgatcgagaaagaccaagtac

SEQ ID NO: 1010633 - DNA, 22 bp, Artificial Sequence
  chemically synthesized
gaatgaacatattttgggtact

SEQ ID NO: 1010634 - DNA, 22 bp, Artificial Sequence
  chemically synthesized
cattagaatgaacatattttgg

SEQ ID NO: 1010635 - DNA, 22 bp, Artificial Sequence
  chemically synthesized
ccattagaatgaacatattttg

SEQ ID NO: 1010636 - DNA, 22 bp, Artificial Sequence
  chemically synthesized
tccattagaatgaacatatttt

SEQ ID NO: 1010637 - DNA, 22 bp, Artificial Sequence
  chemically synthesized
ttccattagaatgaacatattt

SEQ ID NO: 1010638 - DNA, 22 bp, Artificial Sequence
  chemically synthesized
tcttttccattagaatgaacat

SEQ ID NO: 1010639 - DNA, 22 bp, Artificial Sequence
  chemically synthesized
ttatcttttccattagaatgaa

SEQ ID NO: 1010640 - DNA, 22 bp, Artificial Sequence
  chemically synthesized
attatcttttccattagaatga

SEQ ID NO: 1010641 - DNA, 22 bp, Artificial Sequence
  chemically synthesized
atgtttattatcttttccatta

SEQ ID NO: 1010642 - DNA, 22 bp, Artificial Sequence
  chemically synthesized
catgtttattatcttttccatt

SEQ ID NO: 1010643 - DNA, 22 bp, Artificial Sequence
  chemically synthesized
tcatgtttattatcttttccat

SEQ ID NO: 1010644 - DNA, 22 bp, Artificial Sequence
  chemically synthesized
attctaatggaaaagataataa

SEQ ID NO: 1010645 - DNA, 22 bp, Artificial Sequence
  chemically synthesized
taatggaaaagataataaacat

SEQ ID NO: 1010646 - DNA, 22 bp, Artificial Sequence
  chemically synthesized
atggaaaagataataaacatga

SEQ ID NO: 1010647 - DNA, 22 bp, Artificial Sequence
  chemically synthesized
tagtatgtgttttcatgtttat

SEQ ID NO: 1010648 - DNA, 22 bp, Artificial Sequence
  chemically synthesized
aaactgtagtatgtgttttcat

SEQ ID NO: 1010649 - DNA, 22 bp, Artificial Sequence
  chemically synthesized
ctgaaactgtagtatgtgtttt

SEQ ID NO: 1010650 - DNA, 22 bp, Artificial Sequence
  chemically synthesized
gctgaaactgtagtatgtgttt

SEQ ID NO: 1010651 - DNA, 22 bp, Artificial Sequence
  chemically synthesized
tcacttgctgaaactgtagtat

SEQ ID NO: 1010652 - DNA, 22 bp, Artificial Sequence
  chemically synthesized
tgtcacttgctgaaactgtagt

SEQ ID NO: 1010653 - DNA, 22 bp, Artificial Sequence
  chemically synthesized
ataactctgtcacttgctgaaa

SEQ ID NO: 1010654 - DNA, 22 bp, Artificial Sequence
  chemically synthesized
cataactctgtcacttgctgaa

SEQ ID NO: 1010655 - DNA, 22 bp, Artificial Sequence
  chemically synthesized
ttcataactctgtcacttgctg

SEQ ID NO: 1010656 - DNA, 22 bp, Artificial Sequence
  chemically synthesized
cttcataactctgtcacttgct

SEQ ID NO: 1010657 - DNA, 22 bp, Artificial Sequence
  chemically synthesized
tcttcataactctgtcacttgc

SEQ ID NO: 1010658 - DNA, 22 bp, Artificial Sequence
  chemically synthesized
cagtttcagcaagtgacagagt

SEQ ID NO: 1010659 - DNA, 22 bp, Artificial Sequence
  chemically synthesized
actttcttcataactctgtcac

SEQ ID NO: 1010660 - DNA, 22 bp, Artificial Sequence
  chemically synthesized
aactttcttcataactctgtca

SEQ ID NO: 1010661 - DNA, 22 bp, Artificial Sequence
  chemically synthesized
cttaactttcttcataactctg

SEQ ID NO: 1010662 - DNA, 22 bp, Artificial Sequence
  chemically synthesized
cagcaagtgacagagttatgaa

SEQ ID NO: 1010663 - DNA, 22 bp, Artificial Sequence
  chemically synthesized
agcaagtgacagagttatgaag

SEQ ID NO: 1010664 - DNA, 22 bp, Artificial Sequence
  chemically synthesized
ggagatctgcttaactttcttc

SEQ ID NO: 1010665 - DNA, 22 bp, Artificial Sequence
  chemically synthesized
tgggagatctgcttaactttct

SEQ ID NO: 1010666 - DNA, 22 bp, Artificial Sequence
  chemically synthesized
ctgggagatctgcttaactttc

SEQ ID NO: 1010667 - DNA, 22 bp, Artificial Sequence
  chemically synthesized
tctgggagatctgcttaacttt

SEQ ID NO: 1010668 - DNA, 22 bp, Artificial Sequence
  chemically synthesized
tttctgggagatctgcttaact

SEQ ID NO: 1010669 - DNA, 22 bp, Artificial Sequence
  chemically synthesized
tgaagaaagttaagcagatctc

SEQ ID NO: 1010670 - DNA, 22 bp, Artificial Sequence
  chemically synthesized
aactctttctgggagatctgct

SEQ ID NO: 1010671 - DNA, 22 bp, Artificial Sequence
  chemically synthesized
agcagatctcccagaaagagtt

SEQ ID NO: 1010672 - DNA, 22 bp, Artificial Sequence
  chemically synthesized
ccagaaagagttcaattttgtg

SEQ ID NO: 1010673 - DNA, 22 bp, Artificial Sequence
  chemically synthesized
aattttgtgtgtgtgcatgtgt

SEQ ID NO: 1010674 - DNA, 22 bp, Artificial Sequence
  chemically synthesized
tgtgtgtgtgcatgtgtgcgta

SEQ ID NO: 1010675 - DNA, 22 bp, Artificial Sequence
  chemically synthesized
gtgtgtgtgcatgtgtgcgtac

SEQ ID NO: 1010676 - DNA, 22 bp, Artificial Sequence
  chemically synthesized
tgtgtgtgcatgtgtgcgtacg

SEQ ID NO: 1010677 - DNA, 22 bp, Artificial Sequence
  chemically synthesized
aagaaagcacacacgtacgcac

SEQ ID NO: 1010678 - DNA, 22 bp, Artificial Sequence
  chemically synthesized
aaagaaagcacacacgtacgca

SEQ ID NO: 1010679 - DNA, 22 bp, Artificial Sequence
  chemically synthesized
ccccatcttaaagaaagcacac

SEQ ID NO: 1010680 - DNA, 22 bp, Artificial Sequence
  chemically synthesized
taactcccccatcttaaagaaa

SEQ ID NO: 1010681 - DNA, 22 bp, Artificial Sequence
  chemically synthesized
gtaactcccccatcttaaagaa

SEQ ID NO: 1010682 - DNA, 22 bp, Artificial Sequence
  chemically synthesized
tgtaactcccccatcttaaaga

SEQ ID NO: 1010683 - DNA, 22 bp, Artificial Sequence
  chemically synthesized
ttgtaactcccccatcttaaag

SEQ ID NO: 1010684 - DNA, 22 bp, Artificial Sequence
  chemically synthesized
tctttaagatgggggagttaca

SEQ ID NO: 1010685 - DNA, 22 bp, Artificial Sequence
  chemically synthesized
ctttaagatgggggagttacaa

SEQ ID NO: 1010686 - DNA, 22 bp, Artificial Sequence
  chemically synthesized
tttaagatgggggagttacaaa

SEQ ID NO: 1010687 - DNA, 22 bp, Artificial Sequence
  chemically synthesized
acagatatgccttttgtaactc

SEQ ID NO: 1010688 - DNA, 22 bp, Artificial Sequence
  chemically synthesized
taagatgggggagttacaaaag

SEQ ID NO: 1010689 - DNA, 22 bp, Artificial Sequence
  chemically synthesized
aagatgggggagttacaaaagg

SEQ ID NO: 1010690 - DNA, 22 bp, Artificial Sequence
  chemically synthesized
agatgggggagttacaaaaggc

SEQ ID NO: 1010691 - DNA, 22 bp, Artificial Sequence
  chemically synthesized
tattcacagatatgccttttgt

SEQ ID NO: 1010692 - DNA, 22 bp, Artificial Sequence
  chemically synthesized
atattcacagatatgccttttg

SEQ ID NO: 1010693 - DNA, 22 bp, Artificial Sequence
  chemically synthesized
tatattcacagatatgcctttt

SEQ ID NO: 1010694 - DNA, 22 bp, Artificial Sequence
  chemically synthesized
attttatattcacagatatgcc

SEQ ID NO: 1010695 - DNA, 22 bp, Artificial Sequence
  chemically synthesized
taattttatattcacagatatg

SEQ ID NO: 1010696 - DNA, 22 bp, Artificial Sequence
  chemically synthesized
caaaaggcatatctgtgaatat

SEQ ID NO: 1010697 - DNA, 22 bp, Artificial Sequence
  chemically synthesized
tgctctaattttatattcacag

SEQ ID NO: 1010698 - DNA, 22 bp, Artificial Sequence
  chemically synthesized
gtgctctaattttatattcaca

SEQ ID NO: 1010699 - DNA, 22 bp, Artificial Sequence
  chemically synthesized
tatatatttgtgctctaatttt

SEQ ID NO: 1010700 - DNA, 22 bp, Artificial Sequence
  chemically synthesized
atatatatttgtgctctaattt

SEQ ID NO: 1010701 - DNA, 22 bp, Artificial Sequence
  chemically synthesized
tatatatatttgtgctctaatt

SEQ ID NO: 1010702 - DNA, 22 bp, Artificial Sequence
  chemically synthesized
tgaatataaaattagagcacaa

SEQ ID NO: 1010703 - DNA, 22 bp, Artificial Sequence
  chemically synthesized
cctttatatatatttgtgctct

SEQ ID NO: 1010704 - DNA, 22 bp, Artificial Sequence
  chemically synthesized
ccctttatatatatttgtgctc

SEQ ID NO: 1010705 - DNA, 22 bp, Artificial Sequence
  chemically synthesized
tacacttccctttatatatatt

SEQ ID NO: 1010706 - DNA, 22 bp, Artificial Sequence
  chemically synthesized
gtacacttccctttatatatat

SEQ ID NO: 1010707 - DNA, 22 bp, Artificial Sequence
  chemically synthesized
tgtacacttccctttatatata

SEQ ID NO: 1010708 - DNA, 22 bp, Artificial Sequence
  chemically synthesized
ttgtacacttccctttatatat

SEQ ID NO: 1010709 - DNA, 22 bp, Artificial Sequence
  chemically synthesized
gagcacaaatatatataaaggg

SEQ ID NO: 1010710 - DNA, 22 bp, Artificial Sequence
  chemically synthesized
agaatttttgtacacttccctt

SEQ ID NO: 1010711 - DNA, 22 bp, Artificial Sequence
  chemically synthesized
tcagaatttttgtacacttccc

SEQ ID NO: 1010712 - DNA, 22 bp, Artificial Sequence
  chemically synthesized
cctctcagaatttttgtacact

SEQ ID NO: 1010713 - DNA, 22 bp, Artificial Sequence
  chemically synthesized
ctccctctcagaatttttgtac

SEQ ID NO: 1010714 - DNA, 22 bp, Artificial Sequence
  chemically synthesized
accatgtcccaatctactccct

SEQ ID NO: 1010715 - DNA, 22 bp, Artificial Sequence
  chemically synthesized
tcaccatgtcccaatctactcc

SEQ ID NO: 1010716 - DNA, 22 bp, Artificial Sequence
  chemically synthesized
ctcaccatgtcccaatctactc

SEQ ID NO: 1010717 - DNA, 22 bp, Artificial Sequence
  chemically synthesized
tgagagggagtagattgggaca

SEQ ID NO: 1010718 - DNA, 22 bp, Artificial Sequence
  chemically synthesized
cagtttctcaccatgtcccaat

SEQ ID NO: 1010719 - DNA, 22 bp, Artificial Sequence
  chemically synthesized
agagggagtagattgggacatg

SEQ ID NO: 1010720 - DNA, 22 bp, Artificial Sequence
  chemically synthesized
tctccagtttctcaccatgtcc

SEQ ID NO: 1010721 - DNA, 22 bp, Artificial Sequence
  chemically synthesized
ccctatctccagtttctcacca

SEQ ID NO: 1010722 - DNA, 22 bp, Artificial Sequence
  chemically synthesized
taccctatctccagtttctcac

SEQ ID NO: 1010723 - DNA, 22 bp, Artificial Sequence
  chemically synthesized
ggacatggtgagaaactggaga

SEQ ID NO: 1010724 - DNA, 22 bp, Artificial Sequence
  chemically synthesized
ccagagggctctaccctatctc

SEQ ID NO: 1010725 - DNA, 22 bp, Artificial Sequence
  chemically synthesized
taccagagggctctaccctatc

SEQ ID NO: 1010726 - DNA, 22 bp, Artificial Sequence
  chemically synthesized
tctaccagagggctctacccta

SEQ ID NO: 1010727 - DNA, 22 bp, Artificial Sequence
  chemically synthesized
tctctaccagagggctctaccc

SEQ ID NO: 1010728 - DNA, 22 bp, Artificial Sequence
  chemically synthesized
ctctctaccagagggctctacc

SEQ ID NO: 1010729 - DNA, 22 bp, Artificial Sequence
  chemically synthesized
tctctctaccagagggctctac

SEQ ID NO: 1010730 - DNA, 22 bp, Artificial Sequence
  chemically synthesized
ttctctctaccagagggctcta

SEQ ID NO: 1010731 - DNA, 22 bp, Artificial Sequence
  chemically synthesized
gagatagggtagagccctctgg

SEQ ID NO: 1010732 - DNA, 22 bp, Artificial Sequence
  chemically synthesized
cttttctctctaccagagggct

SEQ ID NO: 1010733 - DNA, 22 bp, Artificial Sequence
  chemically synthesized
gcttttctctctaccagagggc

SEQ ID NO: 1010734 - DNA, 22 bp, Artificial Sequence
  chemically synthesized
aatttgcttttctctctaccag

SEQ ID NO: 1010735 - DNA, 22 bp, Artificial Sequence
  chemically synthesized
aaatttgcttttctctctacca

SEQ ID NO: 1010736 - DNA, 22 bp, Artificial Sequence
  chemically synthesized
taaatttgcttttctctctacc

SEQ ID NO: 1010737 - DNA, 22 bp, Artificial Sequence
  chemically synthesized
cctttaaatttgcttttctctc

SEQ ID NO: 1010738 - DNA, 22 bp, Artificial Sequence
  chemically synthesized
tacctttaaatttgcttttctc

SEQ ID NO: 1010739 - DNA, 22 bp, Artificial Sequence
  chemically synthesized
ctacctttaaatttgcttttct

SEQ ID NO: 1010740 - DNA, 22 bp, Artificial Sequence
  chemically synthesized
tttctacctttaaatttgcttt

SEQ ID NO: 1010741 - DNA, 22 bp, Artificial Sequence
  chemically synthesized
tggtagagagaaaagcaaattt

SEQ ID NO: 1010742 - DNA, 22 bp, Artificial Sequence
  chemically synthesized
gtttctacctttaaatttgctt

SEQ ID NO: 1010743 - DNA, 22 bp, Artificial Sequence
  chemically synthesized
gtagagagaaaagcaaatttaa

SEQ ID NO: 1010744 - DNA, 22 bp, Artificial Sequence
  chemically synthesized
gaatgcttgtttctacctttaa

SEQ ID NO: 1010745 - DNA, 22 bp, Artificial Sequence
  chemically synthesized
cctagaatgcttgtttctacct

SEQ ID NO: 1010746 - DNA, 22 bp, Artificial Sequence
  chemically synthesized
ttccctagaatgcttgtttcta

SEQ ID NO: 1010747 - DNA, 22 bp, Artificial Sequence
  chemically synthesized
ctgttccctagaatgcttgttt

SEQ ID NO: 1010748 - DNA, 22 bp, Artificial Sequence
  chemically synthesized
actgttccctagaatgcttgtt

SEQ ID NO: 1010749 - DNA, 22 bp, Artificial Sequence
  chemically synthesized
ttactgttccctagaatgcttg

SEQ ID NO: 1010750 - DNA, 22 bp, Artificial Sequence
  chemically synthesized
aaaggtagaaacaagcattcta

SEQ ID NO: 1010751 - DNA, 22 bp, Artificial Sequence
  chemically synthesized
cttactgttccctagaatgctt

SEQ ID NO: 1010752 - DNA, 22 bp, Artificial Sequence
  chemically synthesized
aaggtagaaacaagcattctag

SEQ ID NO: 1010753 - DNA, 22 bp, Artificial Sequence
  chemically synthesized
acatcccttcttactgttccct

SEQ ID NO: 1010754 - DNA, 22 bp, Artificial Sequence
  chemically synthesized
cacatcccttcttactgttccc

SEQ ID NO: 1010755 - DNA, 22 bp, Artificial Sequence
  chemically synthesized
tcacatcccttcttactgttcc

SEQ ID NO: 1010756 - DNA, 22 bp, Artificial Sequence
  chemically synthesized
ttcacatcccttcttactgttc

SEQ ID NO: 1010757 - DNA, 22 bp, Artificial Sequence
  chemically synthesized
ttttcacatcccttcttactgt

SEQ ID NO: 1010758 - DNA, 22 bp, Artificial Sequence
  chemically synthesized
cttttcacatcccttcttactg

SEQ ID NO: 1010759 - DNA, 22 bp, Artificial Sequence
  chemically synthesized
tcttttcacatcccttcttact

SEQ ID NO: 1010760 - DNA, 22 bp, Artificial Sequence
  chemically synthesized
tagggaacagtaagaagggatg

SEQ ID NO: 1010761 - DNA, 22 bp, Artificial Sequence
  chemically synthesized
gggaacagtaagaagggatgtg

SEQ ID NO: 1010762 - DNA, 22 bp, Artificial Sequence
  chemically synthesized
gtgttttcttttcacatccctt

SEQ ID NO: 1010763 - DNA, 22 bp, Artificial Sequence
  chemically synthesized
cgtgttttcttttcacatccct

SEQ ID NO: 1010764 - DNA, 22 bp, Artificial Sequence
  chemically synthesized
atcttcgtgttttcttttcaca

SEQ ID NO: 1010765 - DNA, 22 bp, Artificial Sequence
  chemically synthesized
cagccatattgatcttcgtgtt

SEQ ID NO: 1010766 - DNA, 22 bp, Artificial Sequence
  chemically synthesized
caaggacgatgttccagccata

SEQ ID NO: 1010767 - DNA, 22 bp, Artificial Sequence
  chemically synthesized
gcaaggacgatgttccagccat

SEQ ID NO: 1010768 - DNA, 22 bp, Artificial Sequence
  chemically synthesized
tgcaaggacgatgttccagcca

SEQ ID NO: 1010769 - DNA, 22 bp, Artificial Sequence
  chemically synthesized
atgaaataatattttgcaagga

SEQ ID NO: 1010770 - DNA, 22 bp, Artificial Sequence
  chemically synthesized
catgaaataatattttgcaagg

SEQ ID NO: 1010771 - DNA, 22 bp, Artificial Sequence
  chemically synthesized
tcatgaaataatattttgcaag

SEQ ID NO: 1010772 - DNA, 22 bp, Artificial Sequence
  chemically synthesized
gaacatcgtccttgcaaaatat

SEQ ID NO: 1010773 - DNA, 22 bp, Artificial Sequence
  chemically synthesized
atagaagtaattttcatgaaat

SEQ ID NO: 1010774 - DNA, 22 bp, Artificial Sequence
  chemically synthesized
gcaaaatattatttcatgaaaa

SEQ ID NO: 1010775 - DNA, 22 bp, Artificial Sequence
  chemically synthesized
caaaatattatttcatgaaaat

SEQ ID NO: 1010776 - DNA, 22 bp, Artificial Sequence
  chemically synthesized
aagttaatagaagtaattttca

SEQ ID NO: 1010777 - DNA, 22 bp, Artificial Sequence
  chemically synthesized
tttcatgaaaattacttctatt

SEQ ID NO: 1010778 - DNA, 22 bp, Artificial Sequence
  chemically synthesized
catgaaaattacttctattaac

SEQ ID NO: 1010779 - DNA, 22 bp, Artificial Sequence
  chemically synthesized
atgaaaattacttctattaact

SEQ ID NO: 1010780 - DNA, 22 bp, Artificial Sequence
  chemically synthesized
atgaaatgtaagattaaagtta

SEQ ID NO: 1010781 - DNA, 22 bp, Artificial Sequence
  chemically synthesized
aatgaaatgtaagattaaagtt

SEQ ID NO: 1010782 - DNA, 22 bp, Artificial Sequence
  chemically synthesized
cttctattaactttaatcttac

SEQ ID NO: 1010783 - DNA, 22 bp, Artificial Sequence
  chemically synthesized
tcatttaatgaaatgtaagatt

SEQ ID NO: 1010784 - DNA, 22 bp, Artificial Sequence
  chemically synthesized
ctattaactttaatcttacatt

SEQ ID NO: 1010785 - DNA, 22 bp, Artificial Sequence
  chemically synthesized
tattaactttaatcttacattt

SEQ ID NO: 1010786 - DNA, 22 bp, Artificial Sequence
  chemically synthesized
ttaactttaatcttacatttca

SEQ ID NO: 1010787 - DNA, 22 bp, Artificial Sequence
  chemically synthesized
actttaatcttacatttcatta

SEQ ID NO: 1010788 - DNA, 22 bp, Artificial Sequence
  chemically synthesized
taatcttacatttcattaaatg

SEQ ID NO: 1010789 - DNA, 22 bp, Artificial Sequence
  chemically synthesized
aatcttacatttcattaaatga

SEQ ID NO: 1010790 - DNA, 22 bp, Artificial Sequence
  chemically synthesized
atcttacatttcattaaatgac

SEQ ID NO: 1010791 - DNA, 22 bp, Artificial Sequence
  chemically synthesized
acatttcattaaatgacaattt

SEQ ID NO: 1010792 - DNA, 22 bp, Artificial Sequence
  chemically synthesized
catttcattaaatgacaatttc

SEQ ID NO: 1010793 - DNA, 22 bp, Artificial Sequence
  chemically synthesized
gaagcaatgagaagcagaaatt

SEQ ID NO: 1010794 - DNA, 22 bp, Artificial Sequence
  chemically synthesized
cattaaatgacaatttctgctt

SEQ ID NO: 1010795 - DNA, 22 bp, Artificial Sequence
  chemically synthesized
attaaatgacaatttctgcttc

SEQ ID NO: 1010796 - DNA, 22 bp, Artificial Sequence
  chemically synthesized
tggaagcaatgagaagcagaaa

SEQ ID NO: 1010797 - DNA, 22 bp, Artificial Sequence
  chemically synthesized
aatgacaatttctgcttctcat

SEQ ID NO: 1010798 - DNA, 22 bp, Artificial Sequence
  chemically synthesized
cgcaccatcattctggaagcaa

SEQ ID NO: 1010799 - DNA, 22 bp, Artificial Sequence
  chemically synthesized
ctgcttctcattgcttccagaa

SEQ ID NO: 1010800 - DNA, 22 bp, Artificial Sequence
  chemically synthesized
tgcttctcattgcttccagaat

SEQ ID NO: 1010801 - DNA, 22 bp, Artificial Sequence
  chemically synthesized
cttctcattgcttccagaatga

SEQ ID NO: 1010802 - DNA, 22 bp, Artificial Sequence
  chemically synthesized
ctcattgcttccagaatgatgg

SEQ ID NO: 1010803 - DNA, 22 bp, Artificial Sequence
  chemically synthesized
tcattgcttccagaatgatggt

SEQ ID NO: 1010804 - DNA, 22 bp, Artificial Sequence
  chemically synthesized
attgcttccagaatgatggtgc

SEQ ID NO: 1010805 - DNA, 22 bp, Artificial Sequence
  chemically synthesized
cttccagaatgatggtgcgcag

SEQ ID NO: 1010806 - DNA, 22 bp, Artificial Sequence
  chemically synthesized
ccagaatgatggtgcgcagttt

SEQ ID NO: 1010807 - DNA, 22 bp, Artificial Sequence
  chemically synthesized
cagaatgatggtgcgcagtttt

SEQ ID NO: 1010808 - DNA, 22 bp, Artificial Sequence
  chemically synthesized
caaatagaaaaaatcaaaacaa

SEQ ID NO: 1010809 - DNA, 22 bp, Artificial Sequence
  chemically synthesized
caaattccaaatagaaaaaatc

SEQ ID NO: 1010810 - DNA, 22 bp, Artificial Sequence
  chemically synthesized
attgcaaattccaaatagaaaa

SEQ ID NO: 1010811 - DNA, 22 bp, Artificial Sequence
  chemically synthesized
tgttttgattttttctatttgg

SEQ ID NO: 1010812 - DNA, 22 bp, Artificial Sequence
  chemically synthesized
gttttgattttttctatttgga

SEQ ID NO: 1010813 - DNA, 22 bp, Artificial Sequence
  chemically synthesized
ttttgattttttctatttggaa

SEQ ID NO: 1010814 - DNA, 22 bp, Artificial Sequence
  chemically synthesized
tgattttttctatttggaattt

SEQ ID NO: 1010815 - DNA, 22 bp, Artificial Sequence
  chemically synthesized
gattttttctatttggaatttg

SEQ ID NO: 1010816 - DNA, 22 bp, Artificial Sequence
  chemically synthesized
attttttctatttggaatttgc

SEQ ID NO: 1010817 - DNA, 22 bp, Artificial Sequence
  chemically synthesized
tttctatttggaatttgcaatc

SEQ ID NO: 1010818 - DNA, 22 bp, Artificial Sequence
  chemically synthesized
ttctatttggaatttgcaatca

SEQ ID NO: 1010819 - DNA, 22 bp, Artificial Sequence
  chemically synthesized
tctatttggaatttgcaatcag

SEQ ID NO: 1010820 - DNA, 22 bp, Artificial Sequence
  chemically synthesized
ctatttggaatttgcaatcagc

SEQ ID NO: 1010821 - DNA, 22 bp, Artificial Sequence
  chemically synthesized
tatttggaatttgcaatcagca

SEQ ID NO: 1010822 - DNA, 22 bp, Artificial Sequence
  chemically synthesized
tttggaatttgcaatcagcatt

SEQ ID NO: 1010823 - DNA, 22 bp, Artificial Sequence
  chemically synthesized
caaaaaatgagaagaatgctga

SEQ ID NO: 1010824 - DNA, 22 bp, Artificial Sequence
  chemically synthesized
ggaatttgcaatcagcattctt

SEQ ID NO: 1010825 - DNA, 22 bp, Artificial Sequence
  chemically synthesized
gaatttgcaatcagcattcttc

SEQ ID NO: 1010826 - DNA, 22 bp, Artificial Sequence
  chemically synthesized
gcaatcagcattcttctcattt

SEQ ID NO: 1010827 - DNA, 22 bp, Artificial Sequence
  chemically synthesized
caatcagcattcttctcatttt

SEQ ID NO: 1010828 - DNA, 22 bp, Artificial Sequence
  chemically synthesized
tcaagagagtaagagactacaa

SEQ ID NO: 1010829 - DNA, 22 bp, Artificial Sequence
  chemically synthesized
ttctcattttttgtagtctctt

SEQ ID NO: 1010830 - DNA, 22 bp, Artificial Sequence
  chemically synthesized
ctcattttttgtagtctcttac

SEQ ID NO: 1010831 - DNA, 22 bp, Artificial Sequence
  chemically synthesized
tcattttttgtagtctcttact

SEQ ID NO: 1010832 - DNA, 22 bp, Artificial Sequence
  chemically synthesized
attttttgtagtctcttactct

SEQ ID NO: 1010833 - DNA, 22 bp, Artificial Sequence
  chemically synthesized
tttgtagtctcttactctcttg

SEQ ID NO: 1010834 - DNA, 22 bp, Artificial Sequence
  chemically synthesized
ttgtagtctcttactctcttga

SEQ ID NO: 1010835 - DNA, 22 bp, Artificial Sequence
  chemically synthesized
tgtagtctcttactctcttgat

SEQ ID NO: 1010836 - DNA, 22 bp, Artificial Sequence
  chemically synthesized
gagcatgaaattatcaagagag

SEQ ID NO: 1010837 - DNA, 22 bp, Artificial Sequence
  chemically synthesized
gtagtctcttactctcttgata

SEQ ID NO: 1010838 - DNA, 22 bp, Artificial Sequence
  chemically synthesized
agagcatgaaattatcaagaga

SEQ ID NO: 1010839 - DNA, 22 bp, Artificial Sequence
  chemically synthesized
tagtctcttactctcttgataa

SEQ ID NO: 1010840 - DNA, 22 bp, Artificial Sequence
  chemically synthesized
ttagagcatgaaattatcaaga

SEQ ID NO: 1010841 - DNA, 22 bp, Artificial Sequence
  chemically synthesized
ttactctcttgataatttcatg

SEQ ID NO: 1010842 - DNA, 22 bp, Artificial Sequence
  chemically synthesized
ccattcttagagcatgaaatta

SEQ ID NO: 1010843 - DNA, 22 bp, Artificial Sequence
  chemically synthesized
actctcttgataatttcatgct

SEQ ID NO: 1010844 - DNA, 22 bp, Artificial Sequence
  chemically synthesized
ctctcttgataatttcatgctc

SEQ ID NO: 1010845 - DNA, 22 bp, Artificial Sequence
  chemically synthesized
tcttgataatttcatgctctaa

SEQ ID NO: 1010846 - DNA, 22 bp, Artificial Sequence
  chemically synthesized
ttgataatttcatgctctaaga

SEQ ID NO: 1010847 - DNA, 22 bp, Artificial Sequence
  chemically synthesized
agggattcccattcttagagca

SEQ ID NO: 1010848 - DNA, 22 bp, Artificial Sequence
  chemically synthesized
gataatttcatgctctaagaat

SEQ ID NO: 1010849 - DNA, 22 bp, Artificial Sequence
  chemically synthesized
ataatttcatgctctaagaatg

SEQ ID NO: 1010850 - DNA, 22 bp, Artificial Sequence
  chemically synthesized
catgctctaagaatgggaatcc

SEQ ID NO: 1010851 - DNA, 22 bp, Artificial Sequence
  chemically synthesized
atgctctaagaatgggaatccc

SEQ ID NO: 1010852 - DNA, 22 bp, Artificial Sequence
  chemically synthesized
taagaatgggaatcccttaggg

SEQ ID NO: 1010853 - DNA, 22 bp, Artificial Sequence
  chemically synthesized
agaatgggaatcccttagggat

SEQ ID NO: 1010854 - DNA, 22 bp, Artificial Sequence
  chemically synthesized
aaatgcaggataaacatgtcat

SEQ ID NO: 1010855 - DNA, 22 bp, Artificial Sequence
  chemically synthesized
aaaatgcaggataaacatgtca

SEQ ID NO: 1010856 - DNA, 22 bp, Artificial Sequence
  chemically synthesized
cttaaaatgcaggataaacatg

SEQ ID NO: 1010857 - DNA, 22 bp, Artificial Sequence
  chemically synthesized
agggatgacatgtttatcctgc

SEQ ID NO: 1010858 - DNA, 22 bp, Artificial Sequence
  chemically synthesized
gggatgacatgtttatcctgca

SEQ ID NO: 1010859 - DNA, 22 bp, Artificial Sequence
  chemically synthesized
atcctgcattttaagcagttct

SEQ ID NO: 1010860 - DNA, 22 bp, Artificial Sequence
  chemically synthesized
tcctgcattttaagcagttctt

SEQ ID NO: 1010861 - DNA, 22 bp, Artificial Sequence
  chemically synthesized
tagtaaccacggtaaagaactg

SEQ ID NO: 1010862 - DNA, 22 bp, Artificial Sequence
  chemically synthesized
cattttaagcagttctttaccg

SEQ ID NO: 1010863 - DNA, 22 bp, Artificial Sequence
  chemically synthesized
ctgtagtaaccacggtaaagaa

SEQ ID NO: 1010864 - DNA, 22 bp, Artificial Sequence
  chemically synthesized
actgtagtaaccacggtaaaga

SEQ ID NO: 1010865 - DNA, 22 bp, Artificial Sequence
  chemically synthesized
taagcagttctttaccgtggtt

SEQ ID NO: 1010866 - DNA, 22 bp, Artificial Sequence
  chemically synthesized
aagcagttctttaccgtggtta

SEQ ID NO: 1010867 - DNA, 22 bp, Artificial Sequence
  chemically synthesized
agcagttctttaccgtggttac

SEQ ID NO: 1010868 - DNA, 22 bp, Artificial Sequence
  chemically synthesized
tttaccgtggttactacagtaa

SEQ ID NO: 1010869 - DNA, 22 bp, Artificial Sequence
  chemically synthesized
taccgtggttactacagtaagt

SEQ ID NO: 1010870 - DNA, 22 bp, Artificial Sequence
  chemically synthesized
accgtggttactacagtaagtt

SEQ ID NO: 1010871 - DNA, 22 bp, Artificial Sequence
  chemically synthesized
ccgtggttactacagtaagtta

SEQ ID NO: 1010872 - DNA, 22 bp, Artificial Sequence
  chemically synthesized
ctacagtaagttatgttttttt

SEQ ID NO: 1010873 - DNA, 22 bp, Artificial Sequence
  chemically synthesized
cagtaagttatgtttttttgtt

SEQ ID NO: 1010874 - DNA, 22 bp, Artificial Sequence
  chemically synthesized
gaaagaagcaagaacaaaaaaa

SEQ ID NO: 1010875 - DNA, 22 bp, Artificial Sequence
  chemically synthesized
ttggaaagaagcaagaacaaaa

SEQ ID NO: 1010876 - DNA, 22 bp, Artificial Sequence
  chemically synthesized
tgtttttttgttcttgcttctt

SEQ ID NO: 1010877 - DNA, 22 bp, Artificial Sequence
  chemically synthesized
atacattattggaaagaagcaa

SEQ ID NO: 1010878 - DNA, 22 bp, Artificial Sequence
  chemically synthesized
catacattattggaaagaagca

SEQ ID NO: 1010879 - DNA, 22 bp, Artificial Sequence
  chemically synthesized
tcatacattattggaaagaagc

SEQ ID NO: 1010880 - DNA, 22 bp, Artificial Sequence
  chemically synthesized
ttttgttcttgcttctttccaa

SEQ ID NO: 1010881 - DNA, 22 bp, Artificial Sequence
  chemically synthesized
tttgttcttgcttctttccaat

SEQ ID NO: 1010882 - DNA, 22 bp, Artificial Sequence
  chemically synthesized
ttgttcttgcttctttccaata

SEQ ID NO: 1010883 - DNA, 22 bp, Artificial Sequence
  chemically synthesized
tgttcttgcttctttccaataa

SEQ ID NO: 1010884 - DNA, 22 bp, Artificial Sequence
  chemically synthesized
gttcttgcttctttccaataat

SEQ ID NO: 1010885 - DNA, 22 bp, Artificial Sequence
  chemically synthesized
ttcttgcttctttccaataatg

SEQ ID NO: 1010886 - DNA, 22 bp, Artificial Sequence
  chemically synthesized
ttgcttctttccaataatgtat

SEQ ID NO: 1010887 - DNA, 22 bp, Artificial Sequence
  chemically synthesized
gcttctttccaataatgtatga

SEQ ID NO: 1010888 - DNA, 22 bp, Artificial Sequence
  chemically synthesized
cttctttccaataatgtatgaa

SEQ ID NO: 1010889 - DNA, 22 bp, Artificial Sequence
  chemically synthesized
ctttccaataatgtatgaaaat

SEQ ID NO: 1010890 - DNA, 22 bp, Artificial Sequence
  chemically synthesized
agaagatgacagattttcatac

SEQ ID NO: 1010891 - DNA, 22 bp, Artificial Sequence
  chemically synthesized
tttccaataatgtatgaaaatc

SEQ ID NO: 1010892 - DNA, 22 bp, Artificial Sequence
  chemically synthesized
aagaagatgacagattttcata

SEQ ID NO: 1010893 - DNA, 22 bp, Artificial Sequence
  chemically synthesized
tccaataatgtatgaaaatctg

SEQ ID NO: 1010894 - DNA, 22 bp, Artificial Sequence
  chemically synthesized
ccaataatgtatgaaaatctgt

SEQ ID NO: 1010895 - DNA, 22 bp, Artificial Sequence
  chemically synthesized
caataatgtatgaaaatctgtc

SEQ ID NO: 1010896 - DNA, 22 bp, Artificial Sequence
  chemically synthesized
tccagcatggcatgtttaagaa

SEQ ID NO: 1010897 - DNA, 22 bp, Artificial Sequence
  chemically synthesized
cgttgtccagcatggcatgttt

SEQ ID NO: 1010898 - DNA, 22 bp, Artificial Sequence
  chemically synthesized
ccgttgtccagcatggcatgtt

SEQ ID NO: 1010899 - DNA, 22 bp, Artificial Sequence
  chemically synthesized
tcatcttcttaaacatgccatg

SEQ ID NO: 1010900 - DNA, 22 bp, Artificial Sequence
  chemically synthesized
gacttccgttgtccagcatggc

SEQ ID NO: 1010901 - DNA, 22 bp, Artificial Sequence
  chemically synthesized
cttaaacatgccatgctggaca

SEQ ID NO: 1010902 - DNA, 22 bp, Artificial Sequence
  chemically synthesized
ttagacttccgttgtccagcat

SEQ ID NO: 1010903 - DNA, 22 bp, Artificial Sequence
  chemically synthesized
ttaaacatgccatgctggacaa

SEQ ID NO: 1010904 - DNA, 22 bp, Artificial Sequence
  chemically synthesized
aaacatgccatgctggacaacg

SEQ ID NO: 1010905 - DNA, 22 bp, Artificial Sequence
  chemically synthesized
ttattagacttccgttgtccag

SEQ ID NO: 1010906 - DNA, 22 bp, Artificial Sequence
  chemically synthesized
aacatgccatgctggacaacgg

SEQ ID NO: 1010907 - DNA, 22 bp, Artificial Sequence
  chemically synthesized
gttattagacttccgttgtcca

SEQ ID NO: 1010908 - DNA, 22 bp, Artificial Sequence
  chemically synthesized
agtggcttgttattagacttcc

SEQ ID NO: 1010909 - DNA, 22 bp, Artificial Sequence
  chemically synthesized
cagtggcttgttattagacttc

SEQ ID NO: 1010910 - DNA, 22 bp, Artificial Sequence
  chemically synthesized
gacaacggaagtctaataacaa

SEQ ID NO: 1010911 - DNA, 22 bp, Artificial Sequence
  chemically synthesized
gataatttcagtggcttgttat

SEQ ID NO: 1010912 - DNA, 22 bp, Artificial Sequence
  chemically synthesized
aaataattggataatttcagtg

SEQ ID NO: 1010913 - DNA, 22 bp, Artificial Sequence
  chemically synthesized
ataacaagccactgaaattatc

SEQ ID NO: 1010914 - DNA, 22 bp, Artificial Sequence
  chemically synthesized
agaaataagtatattaaaataa

SEQ ID NO: 1010915 - DNA, 22 bp, Artificial Sequence
  chemically synthesized
aaattatccaattattttaata

SEQ ID NO: 1010916 - DNA, 22 bp, Artificial Sequence
  chemically synthesized
cagaaataagtatattaaaata

SEQ ID NO: 1010917 - DNA, 22 bp, Artificial Sequence
  chemically synthesized
tcagaaataagtatattaaaat

SEQ ID NO: 1010918 - DNA, 22 bp, Artificial Sequence
  chemically synthesized
tccaattattttaatatactta

SEQ ID NO: 1010919 - DNA, 22 bp, Artificial Sequence
  chemically synthesized
ttttaatatacttatttctgaa

SEQ ID NO: 1010920 - DNA, 22 bp, Artificial Sequence
  chemically synthesized
taatatacttatttctgaaaga

SEQ ID NO: 1010921 - DNA, 22 bp, Artificial Sequence
  chemically synthesized
aatatacttatttctgaaagat

SEQ ID NO: 1010922 - DNA, 22 bp, Artificial Sequence
  chemically synthesized
cccatcaagtgtatctttcaga

SEQ ID NO: 1010923 - DNA, 22 bp, Artificial Sequence
  chemically synthesized
atatacttatttctgaaagata

SEQ ID NO: 1010924 - DNA, 22 bp, Artificial Sequence
  chemically synthesized
gcccatcaagtgtatctttcag

SEQ ID NO: 1010925 - DNA, 22 bp, Artificial Sequence
  chemically synthesized
aatccttgcccatcaagtgtat

SEQ ID NO: 1010926 - DNA, 22 bp, Artificial Sequence
  chemically synthesized
atttctgaaagatacacttgat

SEQ ID NO: 1010927 - DNA, 22 bp, Artificial Sequence
  chemically synthesized
caatccttgcccatcaagtgta

SEQ ID NO: 1010928 - DNA, 22 bp, Artificial Sequence
  chemically synthesized
tttctgaaagatacacttgatg

SEQ ID NO: 1010929 - DNA, 22 bp, Artificial Sequence
  chemically synthesized
tcaatccttgcccatcaagtgt

SEQ ID NO: 1010930 - DNA, 22 bp, Artificial Sequence
  chemically synthesized
ctgaaagatacacttgatgggc

SEQ ID NO: 1010931 - DNA, 22 bp, Artificial Sequence
  chemically synthesized
tgaaagatacacttgatgggca

SEQ ID NO: 1010932 - DNA, 22 bp, Artificial Sequence
  chemically synthesized
aaagatacacttgatgggcaag

SEQ ID NO: 1010933 - DNA, 22 bp, Artificial Sequence
  chemically synthesized
cgagaggggctttcaatccttg

SEQ ID NO: 1010934 - DNA, 22 bp, Artificial Sequence
  chemically synthesized
gatgggcaaggattgaaagccc

SEQ ID NO: 1010935 - DNA, 22 bp, Artificial Sequence
  chemically synthesized
atgggcaaggattgaaagcccc

SEQ ID NO: 1010936 - DNA, 22 bp, Artificial Sequence
  chemically synthesized
aaagcccctctcggaatttctg

SEQ ID NO: 1010937 - DNA, 22 bp, Artificial Sequence
  chemically synthesized
ggagtgtggtaccaggcagaaa

SEQ ID NO: 1010938 - DNA, 22 bp, Artificial Sequence
  chemically synthesized
ctgggagtgtggtaccaggcag

SEQ ID NO: 1010939 - DNA, 22 bp, Artificial Sequence
  chemically synthesized
actgggagtgtggtaccaggca

SEQ ID NO: 1010940 - DNA, 22 bp, Artificial Sequence
  chemically synthesized
tcggaatttctgcctggtacca

SEQ ID NO: 1010941 - DNA, 22 bp, Artificial Sequence
  chemically synthesized
ggaatttctgcctggtaccaca

SEQ ID NO: 1010942 - DNA, 22 bp, Artificial Sequence
  chemically synthesized
ctgcctggtaccacactcccag

SEQ ID NO: 1010943 - DNA, 22 bp, Artificial Sequence
  chemically synthesized
tgcctggtaccacactcccagt

SEQ ID NO: 1010944 - DNA, 22 bp, Artificial Sequence
  chemically synthesized
cctggtaccacactcccagtaa

SEQ ID NO: 1010945 - DNA, 22 bp, Artificial Sequence
  chemically synthesized
gtaccacactcccagtaaattg

SEQ ID NO: 1010946 - DNA, 22 bp, Artificial Sequence
  chemically synthesized
agaagtagtaaataaccaattt

SEQ ID NO: 1010947 - DNA, 22 bp, Artificial Sequence
  chemically synthesized
cagaagtagtaaataaccaatt

SEQ ID NO: 1010948 - DNA, 22 bp, Artificial Sequence
  chemically synthesized
tcagaagtagtaaataaccaat

SEQ ID NO: 1010949 - DNA, 22 bp, Artificial Sequence
  chemically synthesized
ttcagaagtagtaaataaccaa

SEQ ID NO: 1010950 - DNA, 22 bp, Artificial Sequence
  chemically synthesized
ccagtaaattggttatttacta

SEQ ID NO: 1010951 - DNA, 22 bp, Artificial Sequence
  chemically synthesized
tccatcttttcagaagtagtaa

SEQ ID NO: 1010952 - DNA, 22 bp, Artificial Sequence
  chemically synthesized
gttatttactacttctgaaaag

SEQ ID NO: 1010953 - DNA, 22 bp, Artificial Sequence
  chemically synthesized
gcccctatccatcttttcagaa

SEQ ID NO: 1010954 - DNA, 22 bp, Artificial Sequence
  chemically synthesized
ggcccctatccatcttttcaga

SEQ ID NO: 1010955 - DNA, 22 bp, Artificial Sequence
  chemically synthesized
tggcccctatccatcttttcag

SEQ ID NO: 1010956 - DNA, 22 bp, Artificial Sequence
  chemically synthesized
ttggcccctatccatcttttca

SEQ ID NO: 1010957 - DNA, 22 bp, Artificial Sequence
  chemically synthesized
tttactacttctgaaaagatgg

SEQ ID NO: 1010958 - DNA, 22 bp, Artificial Sequence
  chemically synthesized
tttggcccctatccatcttttc

SEQ ID NO: 1010959 - DNA, 22 bp, Artificial Sequence
  chemically synthesized
actacttctgaaaagatggata

SEQ ID NO: 1010960 - DNA, 22 bp, Artificial Sequence
  chemically synthesized
ctacttctgaaaagatggatag

SEQ ID NO: 1010961 - DNA, 22 bp, Artificial Sequence
  chemically synthesized
caactttttggcccctatccat

SEQ ID NO: 1010962 - DNA, 22 bp, Artificial Sequence
  chemically synthesized
cttctgaaaagatggatagggg

SEQ ID NO: 1010963 - DNA, 22 bp, Artificial Sequence
  chemically synthesized
tgcaactttttggcccctatcc

SEQ ID NO: 1010964 - DNA, 22 bp, Artificial Sequence
  chemically synthesized
ctgaaaagatggataggggcca

SEQ ID NO: 1010965 - DNA, 22 bp, Artificial Sequence
  chemically synthesized
tgaaaagatggataggggccaa

SEQ ID NO: 1010966 - DNA, 22 bp, Artificial Sequence
  chemically synthesized
ctctgcaactttttggccccta

SEQ ID NO: 1010967 - DNA, 22 bp, Artificial Sequence
  chemically synthesized
aaaagatggataggggccaaaa

SEQ ID NO: 1010968 - DNA, 22 bp, Artificial Sequence
  chemically synthesized
gaaactcctctgcaactttttg

SEQ ID NO: 1010969 - DNA, 22 bp, Artificial Sequence
  chemically synthesized
ggaaactcctctgcaacttttt

SEQ ID NO: 1010970 - DNA, 22 bp, Artificial Sequence
  chemically synthesized
cttggaaactcctctgcaactt

SEQ ID NO: 1010971 - DNA, 22 bp, Artificial Sequence
  chemically synthesized
ctgcttggaaactcctctgcaa

SEQ ID NO: 1010972 - DNA, 22 bp, Artificial Sequence
  chemically synthesized
ttgctgcttggaaactcctctg

SEQ ID NO: 1010973 - DNA, 22 bp, Artificial Sequence
  chemically synthesized
attgctgcttggaaactcctct

SEQ ID NO: 1010974 - DNA, 22 bp, Artificial Sequence
  chemically synthesized
tattgctgcttggaaactcctc

SEQ ID NO: 1010975 - DNA, 22 bp, Artificial Sequence
  chemically synthesized
ttattgctgcttggaaactcct

SEQ ID NO: 1010976 - DNA, 22 bp, Artificial Sequence
  chemically synthesized
cccttttattgctgcttggaaa

SEQ ID NO: 1010977 - DNA, 22 bp, Artificial Sequence
  chemically synthesized
ttacccttttattgctgcttgg

SEQ ID NO: 1010978 - DNA, 22 bp, Artificial Sequence
  chemically synthesized
cagaggagtttccaagcagcaa

SEQ ID NO: 1010979 - DNA, 22 bp, Artificial Sequence
  chemically synthesized
cgtaaatattgttaccctttta

SEQ ID NO: 1010980 - DNA, 22 bp, Artificial Sequence
  chemically synthesized
ccaagcagcaataaaagggtaa

SEQ ID NO: 1010981 - DNA, 22 bp, Artificial Sequence
  chemically synthesized
gcgtaaatattgttaccctttt

SEQ ID NO: 1010982 - DNA, 22 bp, Artificial Sequence
  chemically synthesized
caagcagcaataaaagggtaac

SEQ ID NO: 1010983 - DNA, 22 bp, Artificial Sequence
  chemically synthesized
atccttgcgtaaatattgttac

SEQ ID NO: 1010984 - DNA, 22 bp, Artificial Sequence
  chemically synthesized
catccttgcgtaaatattgtta

SEQ ID NO: 1010985 - DNA, 22 bp, Artificial Sequence
  chemically synthesized
ggcacttcatccttgcgtaaat

SEQ ID NO: 1010986 - DNA, 22 bp, Artificial Sequence
  chemically synthesized
aacagttgggcacttcatcctt

SEQ ID NO: 1010987 - DNA, 22 bp, Artificial Sequence
  chemically synthesized
acgcaaggatgaagtgcccaac

SEQ ID NO: 1010988 - DNA, 22 bp, Artificial Sequence
  chemically synthesized
cgcaaggatgaagtgcccaact

SEQ ID NO: 1010989 - DNA, 22 bp, Artificial Sequence
  chemically synthesized
atacagttaaacagttgggcac

SEQ ID NO: 1010990 - DNA, 22 bp, Artificial Sequence
  chemically synthesized
aatacagttaaacagttgggca

SEQ ID NO: 1010991 - DNA, 22 bp, Artificial Sequence
  chemically synthesized
ttaatacagttaaacagttggg

SEQ ID NO: 1010992 - DNA, 22 bp, Artificial Sequence
  chemically synthesized
agtctcttaatacagttaaaca

SEQ ID NO: 1010993 - DNA, 22 bp, Artificial Sequence
  chemically synthesized
tttaactgtattaagagactta

SEQ ID NO: 1010994 - DNA, 22 bp, Artificial Sequence
  chemically synthesized
aactgtattaagagacttaact

SEQ ID NO: 1010995 - DNA, 22 bp, Artificial Sequence
  chemically synthesized
actgtattaagagacttaactc

SEQ ID NO: 1010996 - DNA, 22 bp, Artificial Sequence
  chemically synthesized
gtagtggcatgagagttaagtc

SEQ ID NO: 1010997 - DNA, 22 bp, Artificial Sequence
  chemically synthesized
tattaagagacttaactctcat

SEQ ID NO: 1010998 - DNA, 22 bp, Artificial Sequence
  chemically synthesized
gctggtagtggcatgagagtta

SEQ ID NO: 1010999 - DNA, 22 bp, Artificial Sequence
  chemically synthesized
ttagctggtagtggcatgagag

SEQ ID NO: 1011000 - DNA, 22 bp, Artificial Sequence
  chemically synthesized
agagacttaactctcatgccac

SEQ ID NO: 1011001 - DNA, 22 bp, Artificial Sequence
  chemically synthesized
aaagttattagctggtagtggc

SEQ ID NO: 1011002 - DNA, 22 bp, Artificial Sequence
  chemically synthesized
caaagttattagctggtagtgg

SEQ ID NO: 1011003 - DNA, 22 bp, Artificial Sequence
  chemically synthesized
tcaaagttattagctggtagtg

SEQ ID NO: 1011004 - DNA, 22 bp, Artificial Sequence
  chemically synthesized
aactctcatgccactaccagct

SEQ ID NO: 1011005 - DNA, 22 bp, Artificial Sequence
  chemically synthesized
ttcaaagttattagctggtagt

SEQ ID NO: 1011006 - DNA, 22 bp, Artificial Sequence
  chemically synthesized
actctcatgccactaccagcta

SEQ ID NO: 1011007 - DNA, 22 bp, Artificial Sequence
  chemically synthesized
tcatgccactaccagctaataa

SEQ ID NO: 1011008 - DNA, 22 bp, Artificial Sequence
  chemically synthesized
atgccactaccagctaataact

SEQ ID NO: 1011009 - DNA, 22 bp, Artificial Sequence
  chemically synthesized
aaatgagcttttcaaagttatt

SEQ ID NO: 1011010 - DNA, 22 bp, Artificial Sequence
  chemically synthesized
aaaatgagcttttcaaagttat

SEQ ID NO: 1011011 - DNA, 22 bp, Artificial Sequence
  chemically synthesized
taaaatgagcttttcaaagtta

SEQ ID NO: 1011012 - DNA, 22 bp, Artificial Sequence
  chemically synthesized
ccagctaataactttgaaaagc

SEQ ID NO: 1011013 - DNA, 22 bp, Artificial Sequence
  chemically synthesized
ataactttgaaaagctcatttt

SEQ ID NO: 1011014 - DNA, 22 bp, Artificial Sequence
  chemically synthesized
tgaaaagctcattttaaaatgt

SEQ ID NO: 1011015 - DNA, 22 bp, Artificial Sequence
  chemically synthesized
gaaaagctcattttaaaatgta

SEQ ID NO: 1011016 - DNA, 22 bp, Artificial Sequence
  chemically synthesized
aaaagctcattttaaaatgtat

SEQ ID NO: 1011017 - DNA, 22 bp, Artificial Sequence
  chemically synthesized
attttaaaatgtattcccacac

SEQ ID NO: 1011018 - DNA, 22 bp, Artificial Sequence
  chemically synthesized
cagcaatgtgtaagtgtgggaa

SEQ ID NO: 1011019 - DNA, 22 bp, Artificial Sequence
  chemically synthesized
taaaatgtattcccacacttac

SEQ ID NO: 1011020 - DNA, 22 bp, Artificial Sequence
  chemically synthesized
aaaatgtattcccacacttaca

SEQ ID NO: 1011021 - DNA, 22 bp, Artificial Sequence
  chemically synthesized
aaatgtattcccacacttacac

SEQ ID NO: 1011022 - DNA, 22 bp, Artificial Sequence
  chemically synthesized
aggttacagcaatgtgtaagtg

SEQ ID NO: 1011023 - DNA, 22 bp, Artificial Sequence
  chemically synthesized
aaggttacagcaatgtgtaagt

SEQ ID NO: 1011024 - DNA, 22 bp, Artificial Sequence
  chemically synthesized
taaggttacagcaatgtgtaag

SEQ ID NO: 1011025 - DNA, 22 bp, Artificial Sequence
  chemically synthesized
ctttaaggttacagcaatgtgt

SEQ ID NO: 1011026 - DNA, 22 bp, Artificial Sequence
  chemically synthesized
actttaaggttacagcaatgtg

SEQ ID NO: 1011027 - DNA, 22 bp, Artificial Sequence
  chemically synthesized
ccacacttacacattgctgtaa

SEQ ID NO: 1011028 - DNA, 22 bp, Artificial Sequence
  chemically synthesized
gtcacttactttaaggttacag

SEQ ID NO: 1011029 - DNA, 22 bp, Artificial Sequence
  chemically synthesized
tagtcacttactttaaggttac

SEQ ID NO: 1011030 - DNA, 22 bp, Artificial Sequence
  chemically synthesized
acacattgctgtaaccttaaag

SEQ ID NO: 1011031 - DNA, 22 bp, Artificial Sequence
  chemically synthesized
cacattgctgtaaccttaaagt

SEQ ID NO: 1011032 - DNA, 22 bp, Artificial Sequence
  chemically synthesized
tctctagtcacttactttaagg

SEQ ID NO: 1011033 - DNA, 22 bp, Artificial Sequence
  chemically synthesized
gtctctagtcacttactttaag

SEQ ID NO: 1011034 - DNA, 22 bp, Artificial Sequence
  chemically synthesized
ctgtaaccttaaagtaagtgac

SEQ ID NO: 1011035 - DNA, 22 bp, Artificial Sequence
  chemically synthesized
taaccttaaagtaagtgactag

SEQ ID NO: 1011036 - DNA, 22 bp, Artificial Sequence
  chemically synthesized
agagaatttgtctctagtcact

SEQ ID NO: 1011037 - DNA, 22 bp, Artificial Sequence
  chemically synthesized
ctaagagaatttgtctctagtc

SEQ ID NO: 1011038 - DNA, 22 bp, Artificial Sequence
  chemically synthesized
aaagtaagtgactagagacaaa

SEQ ID NO: 1011039 - DNA, 22 bp, Artificial Sequence
  chemically synthesized
ctgctaagagaatttgtctcta

SEQ ID NO: 1011040 - DNA, 22 bp, Artificial Sequence
  chemically synthesized
aagtaagtgactagagacaaat

SEQ ID NO: 1011041 - DNA, 22 bp, Artificial Sequence
  chemically synthesized
actgctaagagaatttgtctct

SEQ ID NO: 1011042 - DNA, 22 bp, Artificial Sequence
  chemically synthesized
gagacaaattctcttagcagta

SEQ ID NO: 1011043 - DNA, 22 bp, Artificial Sequence
  chemically synthesized
tcttagcagtaaattttccggc

SEQ ID NO: 1011044 - DNA, 22 bp, Artificial Sequence
  chemically synthesized
ttagcagtaaattttccggctg

SEQ ID NO: 1011045 - DNA, 22 bp, Artificial Sequence
  chemically synthesized
gcataagggaatcagccggaaa

SEQ ID NO: 1011046 - DNA, 22 bp, Artificial Sequence
  chemically synthesized
agcagtaaattttccggctgat

SEQ ID NO: 1011047 - DNA, 22 bp, Artificial Sequence
  chemically synthesized
gcagtaaattttccggctgatt

SEQ ID NO: 1011048 - DNA, 22 bp, Artificial Sequence
  chemically synthesized
tccggctgattcccttatgcta

SEQ ID NO: 1011049 - DNA, 22 bp, Artificial Sequence
  chemically synthesized
gaagacatacactagcataagg

SEQ ID NO: 1011050 - DNA, 22 bp, Artificial Sequence
  chemically synthesized
ccggctgattcccttatgctag

SEQ ID NO: 1011051 - DNA, 22 bp, Artificial Sequence
  chemically synthesized
cggctgattcccttatgctagt

SEQ ID NO: 1011052 - DNA, 22 bp, Artificial Sequence
  chemically synthesized
taactagaagacatacactagc

SEQ ID NO: 1011053 - DNA, 22 bp, Artificial Sequence
  chemically synthesized
attcccttatgctagtgtatgt

SEQ ID NO: 1011054 - DNA, 22 bp, Artificial Sequence
  chemically synthesized
tgtaactagaagacatacacta

SEQ ID NO: 1011055 - DNA, 22 bp, Artificial Sequence
  chemically synthesized
ctgtaactagaagacatacact

SEQ ID NO: 1011056 - DNA, 22 bp, Artificial Sequence
  chemically synthesized
ccttatgctagtgtatgtcttc

SEQ ID NO: 1011057 - DNA, 22 bp, Artificial Sequence
  chemically synthesized
gtttctgtaactagaagacata

SEQ ID NO: 1011058 - DNA, 22 bp, Artificial Sequence
  chemically synthesized
atgctagtgtatgtcttctagt

SEQ ID NO: 1011059 - DNA, 22 bp, Artificial Sequence
  chemically synthesized
tgctagtgtatgtcttctagtt

SEQ ID NO: 1011060 - DNA, 22 bp, Artificial Sequence
  chemically synthesized
tcctggtttctgtaactagaag

SEQ ID NO: 1011061 - DNA, 22 bp, Artificial Sequence
  chemically synthesized
gtgtatgtcttctagttacaga

SEQ ID NO: 1011062 - DNA, 22 bp, Artificial Sequence
  chemically synthesized
tggtcacaaagctatcctggtt

SEQ ID NO: 1011063 - DNA, 22 bp, Artificial Sequence
  chemically synthesized
ctagttacagaaaccaggatag

SEQ ID NO: 1011064 - DNA, 22 bp, Artificial Sequence
  chemically synthesized
gtggtcacaaagctatcctggt

SEQ ID NO: 1011065 - DNA, 22 bp, Artificial Sequence
  chemically synthesized
tagttacagaaaccaggatagc

SEQ ID NO: 1011066 - DNA, 22 bp, Artificial Sequence
  chemically synthesized
tgtggtcacaaagctatcctgg

SEQ ID NO: 1011067 - DNA, 22 bp, Artificial Sequence
  chemically synthesized
gttacagaaaccaggatagctt

SEQ ID NO: 1011068 - DNA, 22 bp, Artificial Sequence
  chemically synthesized
ttttgtggtcacaaagctatcc

SEQ ID NO: 1011069 - DNA, 22 bp, Artificial Sequence
  chemically synthesized
gttttgtggtcacaaagctatc

SEQ ID NO: 1011070 - DNA, 22 bp, Artificial Sequence
  chemically synthesized
tgttttgtggtcacaaagctat

SEQ ID NO: 1011071 - DNA, 22 bp, Artificial Sequence
  chemically synthesized
cagaaaccaggatagctttgtg

SEQ ID NO: 1011072 - DNA, 22 bp, Artificial Sequence
  chemically synthesized
ataagattttgttttgtggtca

SEQ ID NO: 1011073 - DNA, 22 bp, Artificial Sequence
  chemically synthesized
cataagattttgttttgtggtc

SEQ ID NO: 1011074 - DNA, 22 bp, Artificial Sequence
  chemically synthesized
tgtgaccacaaaacaaaatctt

SEQ ID NO: 1011075 - DNA, 22 bp, Artificial Sequence
  chemically synthesized
gtgaccacaaaacaaaatctta

SEQ ID NO: 1011076 - DNA, 22 bp, Artificial Sequence
  chemically synthesized
tgaccacaaaacaaaatcttat

SEQ ID NO: 1011077 - DNA, 22 bp, Artificial Sequence
  chemically synthesized
cccagcagtaataaaatttcat

SEQ ID NO: 1011078 - DNA, 22 bp, Artificial Sequence
  chemically synthesized
ccccagcagtaataaaatttca

SEQ ID NO: 1011079 - DNA, 22 bp, Artificial Sequence
  chemically synthesized
tatttccccagcagtaataaaa

SEQ ID NO: 1011080 - DNA, 22 bp, Artificial Sequence
  chemically synthesized
atatttccccagcagtaataaa

SEQ ID NO: 1011081 - DNA, 22 bp, Artificial Sequence
  chemically synthesized
tatatttccccagcagtaataa

SEQ ID NO: 1011082 - DNA, 22 bp, Artificial Sequence
  chemically synthesized
atgaaattttattactgctggg

SEQ ID NO: 1011083 - DNA, 22 bp, Artificial Sequence
  chemically synthesized
tgaaattttattactgctgggg

SEQ ID NO: 1011084 - DNA, 22 bp, Artificial Sequence
  chemically synthesized
tcctttatatttccccagcagt

SEQ ID NO: 1011085 - DNA, 22 bp, Artificial Sequence
  chemically synthesized
gtcctttatatttccccagcag

SEQ ID NO: 1011086 - DNA, 22 bp, Artificial Sequence
  chemically synthesized
cttgtcctttatatttccccag

SEQ ID NO: 1011087 - DNA, 22 bp, Artificial Sequence
  chemically synthesized
tattactgctggggaaatataa

SEQ ID NO: 1011088 - DNA, 22 bp, Artificial Sequence
  chemically synthesized
attactgctggggaaatataaa

SEQ ID NO: 1011089 - DNA, 22 bp, Artificial Sequence
  chemically synthesized
ttactgctggggaaatataaag

SEQ ID NO: 1011090 - DNA, 22 bp, Artificial Sequence
  chemically synthesized
ctgctggggaaatataaaggac

SEQ ID NO: 1011091 - DNA, 22 bp, Artificial Sequence
  chemically synthesized
ataccattgcttgtcctttata

SEQ ID NO: 1011092 - DNA, 22 bp, Artificial Sequence
  chemically synthesized
ctggggaaatataaaggacaag

SEQ ID NO: 1011093 - DNA, 22 bp, Artificial Sequence
  chemically synthesized
gggaaatataaaggacaagcaa

SEQ ID NO: 1011094 - DNA, 22 bp, Artificial Sequence
  chemically synthesized
agaataattcataccattgctt

SEQ ID NO: 1011095 - DNA, 22 bp, Artificial Sequence
  chemically synthesized
acgttaagaataattcatacca

SEQ ID NO: 1011096 - DNA, 22 bp, Artificial Sequence
  chemically synthesized
ggaccctaacgttaagaataat

SEQ ID NO: 1011097 - DNA, 22 bp, Artificial Sequence
  chemically synthesized
actgggaccctaacgttaagaa

SEQ ID NO: 1011098 - DNA, 22 bp, Artificial Sequence
  chemically synthesized
cactgggaccctaacgttaaga

SEQ ID NO: 1011099 - DNA, 22 bp, Artificial Sequence
  chemically synthesized
cccttcactgggaccctaacgt

SEQ ID NO: 1011100 - DNA, 22 bp, Artificial Sequence
  chemically synthesized
ttgcccttcactgggaccctaa

SEQ ID NO: 1011101 - DNA, 22 bp, Artificial Sequence
  chemically synthesized
ttcttaacgttagggtcccagt

SEQ ID NO: 1011102 - DNA, 22 bp, Artificial Sequence
  chemically synthesized
ttaacgttagggtcccagtgaa

SEQ ID NO: 1011103 - DNA, 22 bp, Artificial Sequence
  chemically synthesized
ccatctgttgcccttcactggg

SEQ ID NO: 1011104 - DNA, 22 bp, Artificial Sequence
  chemically synthesized
aacgttagggtcccagtgaagg

SEQ ID NO: 1011105 - DNA, 22 bp, Artificial Sequence
  chemically synthesized
acgttagggtcccagtgaaggg

SEQ ID NO: 1011106 - DNA, 22 bp, Artificial Sequence
  chemically synthesized
taccatctgttgcccttcactg

SEQ ID NO: 1011107 - DNA, 22 bp, Artificial Sequence
  chemically synthesized
ctaccatctgttgcccttcact

SEQ ID NO: 1011108 - DNA, 22 bp, Artificial Sequence
  chemically synthesized
gggtcccagtgaagggcaacag

SEQ ID NO: 1011109 - DNA, 22 bp, Artificial Sequence
  chemically synthesized
gagtaaatatttctaccatctg

SEQ ID NO: 1011110 - DNA, 22 bp, Artificial Sequence
  chemically synthesized
atggaaaaatcactggagtaaa

SEQ ID NO: 1011111 - DNA, 22 bp, Artificial Sequence
  chemically synthesized
gatggaaaaatcactggagtaa

SEQ ID NO: 1011112 - DNA, 22 bp, Artificial Sequence
  chemically synthesized
tgatggaaaaatcactggagta

SEQ ID NO: 1011113 - DNA, 22 bp, Artificial Sequence
  chemically synthesized
atagaaactttgatggaaaaat

SEQ ID NO: 1011114 - DNA, 22 bp, Artificial Sequence
  chemically synthesized
actccagtgatttttccatcaa

SEQ ID NO: 1011115 - DNA, 22 bp, Artificial Sequence
  chemically synthesized
ctccagtgatttttccatcaaa

SEQ ID NO: 1011116 - DNA, 22 bp, Artificial Sequence
  chemically synthesized
cagtgatttttccatcaaagtt

SEQ ID NO: 1011117 - DNA, 22 bp, Artificial Sequence
  chemically synthesized
aaatgctgatagaaactttgat

SEQ ID NO: 1011118 - DNA, 22 bp, Artificial Sequence
  chemically synthesized
agattcaaatgctgatagaaac

SEQ ID NO: 1011119 - DNA, 22 bp, Artificial Sequence
  chemically synthesized
ttccatcaaagtttctatcagc

SEQ ID NO: 1011120 - DNA, 22 bp, Artificial Sequence
  chemically synthesized
tccatcaaagtttctatcagca

SEQ ID NO: 1011121 - DNA, 22 bp, Artificial Sequence
  chemically synthesized
ctgagattcaaatgctgataga

SEQ ID NO: 1011122 - DNA, 22 bp, Artificial Sequence
  chemically synthesized
ccatcaaagtttctatcagcat

SEQ ID NO: 1011123 - DNA, 22 bp, Artificial Sequence
  chemically synthesized
catcaaagtttctatcagcatt

SEQ ID NO: 1011124 - DNA, 22 bp, Artificial Sequence
  chemically synthesized
acagccacactgctgagattca

SEQ ID NO: 1011125 - DNA, 22 bp, Artificial Sequence
  chemically synthesized
ctatcagcatttgaatctcagc

SEQ ID NO: 1011126 - DNA, 22 bp, Artificial Sequence
  chemically synthesized
aacagccacactgctgagattc

SEQ ID NO: 1011127 - DNA, 22 bp, Artificial Sequence
  chemically synthesized
tatcagcatttgaatctcagca

SEQ ID NO: 1011128 - DNA, 22 bp, Artificial Sequence
  chemically synthesized
ttaacagccacactgctgagat

SEQ ID NO: 1011129 - DNA, 22 bp, Artificial Sequence
  chemically synthesized
tcagcatttgaatctcagcagt

SEQ ID NO: 1011130 - DNA, 22 bp, Artificial Sequence
  chemically synthesized
cttaacagccacactgctgaga

SEQ ID NO: 1011131 - DNA, 22 bp, Artificial Sequence
  chemically synthesized
acggcttcttaacagccacact

SEQ ID NO: 1011132 - DNA, 22 bp, Artificial Sequence
  chemically synthesized
gacggcttcttaacagccacac

SEQ ID NO: 1011133 - DNA, 22 bp, Artificial Sequence
  chemically synthesized
gaatctcagcagtgtggctgtt

SEQ ID NO: 1011134 - DNA, 22 bp, Artificial Sequence
  chemically synthesized
aatctcagcagtgtggctgtta

SEQ ID NO: 1011135 - DNA, 22 bp, Artificial Sequence
  chemically synthesized
agtttgacggcttcttaacagc

SEQ ID NO: 1011136 - DNA, 22 bp, Artificial Sequence
  chemically synthesized
agcagtgtggctgttaagaagc

SEQ ID NO: 1011137 - DNA, 22 bp, Artificial Sequence
  chemically synthesized
ctgagtttgacggcttcttaac

SEQ ID NO: 1011138 - DNA, 22 bp, Artificial Sequence
  chemically synthesized
gctgctgagtttgacggcttct

SEQ ID NO: 1011139 - DNA, 22 bp, Artificial Sequence
  chemically synthesized
accagctggctgctgagtttga

SEQ ID NO: 1011140 - DNA, 22 bp, Artificial Sequence
  chemically synthesized
ttaagaagccgtcaaactcagc

SEQ ID NO: 1011141 - DNA, 22 bp, Artificial Sequence
  chemically synthesized
caccagctggctgctgagtttg

SEQ ID NO: 1011142 - DNA, 22 bp, Artificial Sequence
  chemically synthesized
agaagccgtcaaactcagcagc

SEQ ID NO: 1011143 - DNA, 22 bp, Artificial Sequence
  chemically synthesized
tgatttcaccagctggctgctg

SEQ ID NO: 1011144 - DNA, 22 bp, Artificial Sequence
  chemically synthesized
cattgtgatttcaccagctggc

SEQ ID NO: 1011145 - DNA, 22 bp, Artificial Sequence
  chemically synthesized
acattgtgatttcaccagctgg

SEQ ID NO: 1011146 - DNA, 22 bp, Artificial Sequence
  chemically synthesized
tacattgtgatttcaccagctg

SEQ ID NO: 1011147 - DNA, 22 bp, Artificial Sequence
  chemically synthesized
ttacattgtgatttcaccagct

SEQ ID NO: 1011148 - DNA, 22 bp, Artificial Sequence
  chemically synthesized
agcagccagctggtgaaatcac

SEQ ID NO: 1011149 - DNA, 22 bp, Artificial Sequence
  chemically synthesized
tatagtcagtttttacattgtg

SEQ ID NO: 1011150 - DNA, 22 bp, Artificial Sequence
  chemically synthesized
tgtatagtcagtttttacattg

SEQ ID NO: 1011151 - DNA, 22 bp, Artificial Sequence
  chemically synthesized
ctgtatagtcagtttttacatt

SEQ ID NO: 1011152 - DNA, 22 bp, Artificial Sequence
  chemically synthesized
tctgtatagtcagtttttacat

SEQ ID NO: 1011153 - DNA, 22 bp, Artificial Sequence
  chemically synthesized
gtgaaatcacaatgtaaaaact

SEQ ID NO: 1011154 - DNA, 22 bp, Artificial Sequence
  chemically synthesized
actatacagaaaatatacttgt

SEQ ID NO: 1011155 - DNA, 22 bp, Artificial Sequence
  chemically synthesized
tacagaaaatatacttgtgtct

SEQ ID NO: 1011156 - DNA, 22 bp, Artificial Sequence
  chemically synthesized
gaaaaaggcatatgatgtaaaa

SEQ ID NO: 1011157 - DNA, 22 bp, Artificial Sequence
  chemically synthesized
gtgtctgatttttttacatcat

SEQ ID NO: 1011158 - DNA, 22 bp, Artificial Sequence
  chemically synthesized
tgtctgatttttttacatcata

SEQ ID NO: 1011159 - DNA, 22 bp, Artificial Sequence
  chemically synthesized
atttttttacatcatatgcctt

SEQ ID NO: 1011160 - DNA, 22 bp, Artificial Sequence
  chemically synthesized
ttttacatcatatgcctttttc

SEQ ID NO: 1011161 - DNA, 22 bp, Artificial Sequence
  chemically synthesized
aaggataatctagaaaaaggca

SEQ ID NO: 1011162 - DNA, 22 bp, Artificial Sequence
  chemically synthesized
tttacatcatatgcctttttct

SEQ ID NO: 1011163 - DNA, 22 bp, Artificial Sequence
  chemically synthesized
ttacatcatatgcctttttcta

SEQ ID NO: 1011164 - DNA, 22 bp, Artificial Sequence
  chemically synthesized
tacatcatatgcctttttctag

SEQ ID NO: 1011165 - DNA, 22 bp, Artificial Sequence
  chemically synthesized
acatcatatgcctttttctaga

SEQ ID NO: 1011166 - DNA, 22 bp, Artificial Sequence
  chemically synthesized
catcatatgcctttttctagat

SEQ ID NO: 1011167 - DNA, 22 bp, Artificial Sequence
  chemically synthesized
aattaaaggataatctagaaaa

SEQ ID NO: 1011168 - DNA, 22 bp, Artificial Sequence
  chemically synthesized
atacagattgaattaaaggata

SEQ ID NO: 1011169 - DNA, 22 bp, Artificial Sequence
  chemically synthesized
tttctagattatcctttaattc

SEQ ID NO: 1011170 - DNA, 22 bp, Artificial Sequence
  chemically synthesized
ttctagattatcctttaattca

SEQ ID NO: 1011171 - DNA, 22 bp, Artificial Sequence
  chemically synthesized
tctagattatcctttaattcaa

SEQ ID NO: 1011172 - DNA, 22 bp, Artificial Sequence
  chemically synthesized
tattaatacagattgaattaaa

SEQ ID NO: 1011173 - DNA, 22 bp, Artificial Sequence
  chemically synthesized
ctagattatcctttaattcaat

SEQ ID NO: 1011174 - DNA, 22 bp, Artificial Sequence
  chemically synthesized
atattaatacagattgaattaa

SEQ ID NO: 1011175 - DNA, 22 bp, Artificial Sequence
  chemically synthesized
tagattatcctttaattcaatc

SEQ ID NO: 1011176 - DNA, 22 bp, Artificial Sequence
  chemically synthesized
gattatcctttaattcaatctg

SEQ ID NO: 1011177 - DNA, 22 bp, Artificial Sequence
  chemically synthesized
tcctttaattcaatctgtatta

SEQ ID NO: 1011178 - DNA, 22 bp, Artificial Sequence
  chemically synthesized
taattcaatctgtattaatata

SEQ ID NO: 1011179 - DNA, 22 bp, Artificial Sequence
  chemically synthesized
aattcaatctgtattaatataa

SEQ ID NO: 1011180 - DNA, 22 bp, Artificial Sequence
  chemically synthesized
attcaatctgtattaatataaa

SEQ ID NO: 1011181 - DNA, 22 bp, Artificial Sequence
  chemically synthesized
taggaggtaagtgaatttatat

SEQ ID NO: 1011182 - DNA, 22 bp, Artificial Sequence
  chemically synthesized
aatctgtattaatataaattca

SEQ ID NO: 1011183 - DNA, 22 bp, Artificial Sequence
  chemically synthesized
tataggaggtaagtgaatttat

SEQ ID NO: 1011184 - DNA, 22 bp, Artificial Sequence
  chemically synthesized
tattaatataaattcacttacc

SEQ ID NO: 1011185 - DNA, 22 bp, Artificial Sequence
  chemically synthesized
aaagaactctataggaggtaag

SEQ ID NO: 1011186 - DNA, 22 bp, Artificial Sequence
  chemically synthesized
atataaattcacttacctccta

SEQ ID NO: 1011187 - DNA, 22 bp, Artificial Sequence
  chemically synthesized
cctcaaagaactctataggagg

SEQ ID NO: 1011188 - DNA, 22 bp, Artificial Sequence
  chemically synthesized
ctgcctcaaagaactctatagg

SEQ ID NO: 1011189 - DNA, 22 bp, Artificial Sequence
  chemically synthesized
acttacctcctatagagttctt

SEQ ID NO: 1011190 - DNA, 22 bp, Artificial Sequence
  chemically synthesized
acctcctatagagttctttgag

SEQ ID NO: 1011191 - DNA, 22 bp, Artificial Sequence
  chemically synthesized
cctcctatagagttctttgagg

SEQ ID NO: 1011192 - DNA, 22 bp, Artificial Sequence
  chemically synthesized
ctatagagttctttgaggcagt

SEQ ID NO: 1011193 - DNA, 22 bp, Artificial Sequence
  chemically synthesized
acatggcaatctactgcctcaa

SEQ ID NO: 1011194 - DNA, 22 bp, Artificial Sequence
  chemically synthesized
tagagttctttgaggcagtaga

SEQ ID NO: 1011195 - DNA, 22 bp, Artificial Sequence
  chemically synthesized
tttgaggcagtagattgccatg

SEQ ID NO: 1011196 - DNA, 22 bp, Artificial Sequence
  chemically synthesized
ggatacacctaacatggcaatc

SEQ ID NO: 1011197 - DNA, 22 bp, Artificial Sequence
  chemically synthesized
tgaggcagtagattgccatgtt

SEQ ID NO: 1011198 - DNA, 22 bp, Artificial Sequence
  chemically synthesized
gaggcagtagattgccatgtta

SEQ ID NO: 1011199 - DNA, 22 bp, Artificial Sequence
  chemically synthesized
ttaggatacacctaacatggca

SEQ ID NO: 1011200 - DNA, 22 bp, Artificial Sequence
  chemically synthesized
aggcagtagattgccatgttag

SEQ ID NO: 1011201 - DNA, 22 bp, Artificial Sequence
  chemically synthesized
attaggatacacctaacatggc

SEQ ID NO: 1011202 - DNA, 22 bp, Artificial Sequence
  chemically synthesized
tattaggatacacctaacatgg

SEQ ID NO: 1011203 - DNA, 22 bp, Artificial Sequence
  chemically synthesized
ttattaggatacacctaacatg

SEQ ID NO: 1011204 - DNA, 22 bp, Artificial Sequence
  chemically synthesized
gtatttttattaggatacacct

SEQ ID NO: 1011205 - DNA, 22 bp, Artificial Sequence
  chemically synthesized
cgtatttttattaggatacacc

SEQ ID NO: 1011206 - DNA, 22 bp, Artificial Sequence
  chemically synthesized
tcgtatttttattaggatacac

SEQ ID NO: 1011207 - DNA, 22 bp, Artificial Sequence
  chemically synthesized
ccatgttaggtgtatcctaata

SEQ ID NO: 1011208 - DNA, 22 bp, Artificial Sequence
  chemically synthesized
ggtgtatcctaataaaaatacg

SEQ ID NO: 1011209 - DNA, 22 bp, Artificial Sequence
  chemically synthesized
cagagaatgagttttcgtattt

SEQ ID NO: 1011210 - DNA, 22 bp, Artificial Sequence
  chemically synthesized
ctacagagaatgagttttcgta

SEQ ID NO: 1011211 - DNA, 22 bp, Artificial Sequence
  chemically synthesized
ataaaaatacgaaaactcattc

SEQ ID NO: 1011212 - DNA, 22 bp, Artificial Sequence
  chemically synthesized
acagtatctgctacagagaatg

SEQ ID NO: 1011213 - DNA, 22 bp, Artificial Sequence
  chemically synthesized
attctctgtagcagatactgtc

SEQ ID NO: 1011214 - DNA, 22 bp, Artificial Sequence
  chemically synthesized
tctgtagcagatactgtcagtg

SEQ ID NO: 1011215 - DNA, 22 bp, Artificial Sequence
  chemically synthesized
tgtagcagatactgtcagtgac

SEQ ID NO: 1011216 - DNA, 22 bp, Artificial Sequence
  chemically synthesized
tagcagatactgtcagtgacct

SEQ ID NO: 1011217 - DNA, 22 bp, Artificial Sequence
  chemically synthesized
aatagatgtgcataggtcactg

SEQ ID NO: 1011218 - DNA, 22 bp, Artificial Sequence
  chemically synthesized
tcagtgacctatgcacatctat

SEQ ID NO: 1011219 - DNA, 22 bp, Artificial Sequence
  chemically synthesized
tacaaaaatgatgagtgctgaa

SEQ ID NO: 1011220 - DNA, 22 bp, Artificial Sequence
  chemically synthesized
gtacaaaaatgatgagtgctga

SEQ ID NO: 1011221 - DNA, 22 bp, Artificial Sequence
  chemically synthesized
tgcacatctattcagcactcat

SEQ ID NO: 1011222 - DNA, 22 bp, Artificial Sequence
  chemically synthesized
acttgtacaaaaatgatgagtg

SEQ ID NO: 1011223 - DNA, 22 bp, Artificial Sequence
  chemically synthesized
ttcagcactcatcatttttgta

SEQ ID NO: 1011224 - DNA, 22 bp, Artificial Sequence
  chemically synthesized
agcactcatcatttttgtacaa

SEQ ID NO: 1011225 - DNA, 22 bp, Artificial Sequence
  chemically synthesized
aaaggtcattgacttgtacaaa

SEQ ID NO: 1011226 - DNA, 22 bp, Artificial Sequence
  chemically synthesized
atcatttttgtacaagtcaatg

SEQ ID NO: 1011227 - DNA, 22 bp, Artificial Sequence
  chemically synthesized
ccgttgaaaggtcattgacttg

SEQ ID NO: 1011228 - DNA, 22 bp, Artificial Sequence
  chemically synthesized
ttgtacaagtcaatgacctttc

SEQ ID NO: 1011229 - DNA, 22 bp, Artificial Sequence
  chemically synthesized
tgtacaagtcaatgacctttca

SEQ ID NO: 1011230 - DNA, 22 bp, Artificial Sequence
  chemically synthesized
gtacaagtcaatgacctttcaa

SEQ ID NO: 1011231 - DNA, 22 bp, Artificial Sequence
  chemically synthesized
tacaagtcaatgacctttcaac

SEQ ID NO: 1011232 - DNA, 22 bp, Artificial Sequence
  chemically synthesized
acaggtactgccgttgaaaggt

SEQ ID NO: 1011233 - DNA, 22 bp, Artificial Sequence
  chemically synthesized
tctaacaggtactgccgttgaa

SEQ ID NO: 1011234 - DNA, 22 bp, Artificial Sequence
  chemically synthesized
atctaacaggtactgccgttga

SEQ ID NO: 1011235 - DNA, 22 bp, Artificial Sequence
  chemically synthesized
tcaacggcagtacctgttagat

SEQ ID NO: 1011236 - DNA, 22 bp, Artificial Sequence
  chemically synthesized
caacggcagtacctgttagata

SEQ ID NO: 1011237 - DNA, 22 bp, Artificial Sequence
  chemically synthesized
aacggcagtacctgttagataa

SEQ ID NO: 1011238 - DNA, 22 bp, Artificial Sequence
  chemically synthesized
gcagcccagaaagcccttatct

SEQ ID NO: 1011239 - DNA, 22 bp, Artificial Sequence
  chemically synthesized
agcactcgcagcccagaaagcc

SEQ ID NO: 1011240 - DNA, 22 bp, Artificial Sequence
  chemically synthesized
cagcactcgcagcccagaaagc

SEQ ID NO: 1011241 - DNA, 22 bp, Artificial Sequence
  chemically synthesized
tcagcactcgcagcccagaaag

SEQ ID NO: 1011242 - DNA, 22 bp, Artificial Sequence
  chemically synthesized
ttagataagggctttctgggct

SEQ ID NO: 1011243 - DNA, 22 bp, Artificial Sequence
  chemically synthesized
ctttcagcactcgcagcccaga

SEQ ID NO: 1011244 - DNA, 22 bp, Artificial Sequence
  chemically synthesized
gataagggctttctgggctgcg

SEQ ID NO: 1011245 - DNA, 22 bp, Artificial Sequence
  chemically synthesized
gctttcagcactcgcagcccag

SEQ ID NO: 1011246 - DNA, 22 bp, Artificial Sequence
  chemically synthesized
gccttgctttcagcactcgcag

SEQ ID NO: 1011247 - DNA, 22 bp, Artificial Sequence
  chemically synthesized
tcgccttgctttcagcactcgc

SEQ ID NO: 1011248 - DNA, 22 bp, Artificial Sequence
  chemically synthesized
ctcgccttgctttcagcactcg

SEQ ID NO: 1011249 - DNA, 22 bp, Artificial Sequence
  chemically synthesized
ttctcgccttgctttcagcact

SEQ ID NO: 1011250 - DNA, 22 bp, Artificial Sequence
  chemically synthesized
tctgggctgcgagtgctgaaag

SEQ ID NO: 1011251 - DNA, 22 bp, Artificial Sequence
  chemically synthesized
ctgggctgcgagtgctgaaagc

SEQ ID NO: 1011252 - DNA, 22 bp, Artificial Sequence
  chemically synthesized
tgggctgcgagtgctgaaagca

SEQ ID NO: 1011253 - DNA, 22 bp, Artificial Sequence
  chemically synthesized
attcttctcgccttgctttcag

SEQ ID NO: 1011254 - DNA, 22 bp, Artificial Sequence
  chemically synthesized
ggctgcgagtgctgaaagcaag

SEQ ID NO: 1011255 - DNA, 22 bp, Artificial Sequence
  chemically synthesized
tcattcttctcgccttgctttc

SEQ ID NO: 1011256 - DNA, 22 bp, Artificial Sequence
  chemically synthesized
ctcattcttctcgccttgcttt

SEQ ID NO: 1011257 - DNA, 22 bp, Artificial Sequence
  chemically synthesized
tctcattcttctcgccttgctt

SEQ ID NO: 1011258 - DNA, 22 bp, Artificial Sequence
  chemically synthesized
cgagtgctgaaagcaaggcgag

SEQ ID NO: 1011259 - DNA, 22 bp, Artificial Sequence
  chemically synthesized
aaagcaaggcgagaagaatgag

SEQ ID NO: 1011260 - DNA, 22 bp, Artificial Sequence
  chemically synthesized
atggaaatacccaggttttctc

SEQ ID NO: 1011261 - DNA, 22 bp, Artificial Sequence
  chemically synthesized
aatggaaatacccaggttttct

SEQ ID NO: 1011262 - DNA, 22 bp, Artificial Sequence
  chemically synthesized
ttaatggaaatacccaggtttt

SEQ ID NO: 1011263 - DNA, 22 bp, Artificial Sequence
  chemically synthesized
ctcttaatggaaatacccaggt

SEQ ID NO: 1011264 - DNA, 22 bp, Artificial Sequence
  chemically synthesized
ggtatttccattaagaggagga

SEQ ID NO: 1011265 - DNA, 22 bp, Artificial Sequence
  chemically synthesized
ccattaagaggaggacggtctt

SEQ ID NO: 1011266 - DNA, 22 bp, Artificial Sequence
  chemically synthesized
cattaagaggaggacggtcttt

SEQ ID NO: 1011267 - DNA, 22 bp, Artificial Sequence
  chemically synthesized
agaggaggacggtcttttcatg

SEQ ID NO: 1011268 - DNA, 22 bp, Artificial Sequence
  chemically synthesized
agacaagcgagtccatgaaaag

SEQ ID NO: 1011269 - DNA, 22 bp, Artificial Sequence
  chemically synthesized
gagacaagcgagtccatgaaaa

SEQ ID NO: 1011270 - DNA, 22 bp, Artificial Sequence
  chemically synthesized
aaaagtttgagacaagcgagtc

SEQ ID NO: 1011271 - DNA, 22 bp, Artificial Sequence
  chemically synthesized
ctcaaaagtttgagacaagcga

SEQ ID NO: 1011272 - DNA, 22 bp, Artificial Sequence
  chemically synthesized
ttcatggactcgcttgtctcaa

SEQ ID NO: 1011273 - DNA, 22 bp, Artificial Sequence
  chemically synthesized
ctgctcaaaagtttgagacaag

SEQ ID NO: 1011274 - DNA, 22 bp, Artificial Sequence
  chemically synthesized
tcatggactcgcttgtctcaaa

SEQ ID NO: 1011275 - DNA, 22 bp, Artificial Sequence
  chemically synthesized
catggactcgcttgtctcaaac

SEQ ID NO: 1011276 - DNA, 22 bp, Artificial Sequence
  chemically synthesized
atggactcgcttgtctcaaact

SEQ ID NO: 1011277 - DNA, 22 bp, Artificial Sequence
  chemically synthesized
gagtgactcctgctcaaaagtt

SEQ ID NO: 1011278 - DNA, 22 bp, Artificial Sequence
  chemically synthesized
gcttgtctcaaacttttgagca

SEQ ID NO: 1011279 - DNA, 22 bp, Artificial Sequence
  chemically synthesized
gtctcaaacttttgagcaggag

SEQ ID NO: 1011280 - DNA, 22 bp, Artificial Sequence
  chemically synthesized
tctcaaacttttgagcaggagt

SEQ ID NO: 1011281 - DNA, 22 bp, Artificial Sequence
  chemically synthesized
aaacttttgagcaggagtcact

SEQ ID NO: 1011282 - DNA, 22 bp, Artificial Sequence
  chemically synthesized
ttgagcaggagtcactccaact

SEQ ID NO: 1011283 - DNA, 22 bp, Artificial Sequence
  chemically synthesized
tgagcaggagtcactccaactc

SEQ ID NO: 1011284 - DNA, 22 bp, Artificial Sequence
  chemically synthesized
gagcaggagtcactccaactcc

SEQ ID NO: 1011285 - DNA, 22 bp, Artificial Sequence
  chemically synthesized
agagagcacaatggagttggag

SEQ ID NO: 1011286 - DNA, 22 bp, Artificial Sequence
  chemically synthesized
agcaggagtcactccaactcca

SEQ ID NO: 1011287 - DNA, 22 bp, Artificial Sequence
  chemically synthesized
gattcagagagcacaatggagt

SEQ ID NO: 1011288 - DNA, 22 bp, Artificial Sequence
  chemically synthesized
agattcagagagcacaatggag

SEQ ID NO: 1011289 - DNA, 22 bp, Artificial Sequence
  chemically synthesized
aagagtttagattcagagagca

SEQ ID NO: 1011290 - DNA, 22 bp, Artificial Sequence
  chemically synthesized
caactccattgtgctctctgaa

SEQ ID NO: 1011291 - DNA, 22 bp, Artificial Sequence
  chemically synthesized
tgaagagtttagattcagagag

SEQ ID NO: 1011292 - DNA, 22 bp, Artificial Sequence
  chemically synthesized
cattgtgctctctgaatctaaa

SEQ ID NO: 1011293 - DNA, 22 bp, Artificial Sequence
  chemically synthesized
tgctctctgaatctaaactctt

SEQ ID NO: 1011294 - DNA, 22 bp, Artificial Sequence
  chemically synthesized
aaggacccaattctgaagagtt

SEQ ID NO: 1011295 - DNA, 22 bp, Artificial Sequence
  chemically synthesized
aaaggacccaattctgaagagt

SEQ ID NO: 1011296 - DNA, 22 bp, Artificial Sequence
  chemically synthesized
tctgaatctaaactcttcagaa

SEQ ID NO: 1011297 - DNA, 22 bp, Artificial Sequence
  chemically synthesized
taaaggacccaattctgaagag

SEQ ID NO: 1011298 - DNA, 22 bp, Artificial Sequence
  chemically synthesized
ttaaaggacccaattctgaaga

SEQ ID NO: 1011299 - DNA, 22 bp, Artificial Sequence
  chemically synthesized
tgaatctaaactcttcagaatt

SEQ ID NO: 1011300 - DNA, 22 bp, Artificial Sequence
  chemically synthesized
tttaaaggacccaattctgaag

SEQ ID NO: 1011301 - DNA, 22 bp, Artificial Sequence
  chemically synthesized
aatctaaactcttcagaattgg

SEQ ID NO: 1011302 - DNA, 22 bp, Artificial Sequence
  chemically synthesized
aactcttcagaattgggtcctt

SEQ ID NO: 1011303 - DNA, 22 bp, Artificial Sequence
  chemically synthesized
aagcactttttaaaggacccaa

SEQ ID NO: 1011304 - DNA, 22 bp, Artificial Sequence
  chemically synthesized
taaagcactttttaaaggaccc

SEQ ID NO: 1011305 - DNA, 22 bp, Artificial Sequence
  chemically synthesized
ttcagaattgggtcctttaaaa

SEQ ID NO: 1011306 - DNA, 22 bp, Artificial Sequence
  chemically synthesized
cagaattgggtcctttaaaaag

SEQ ID NO: 1011307 - DNA, 22 bp, Artificial Sequence
  chemically synthesized
agaattgggtcctttaaaaagt

SEQ ID NO: 1011308 - DNA, 22 bp, Artificial Sequence
  chemically synthesized
aagaaaattctaaagcactttt

SEQ ID NO: 1011309 - DNA, 22 bp, Artificial Sequence
  chemically synthesized
ggtcctttaaaaagtgctttag

SEQ ID NO: 1011310 - DNA, 22 bp, Artificial Sequence
  chemically synthesized
gtgattgaagaaaattctaaag

SEQ ID NO: 1011311 - DNA, 22 bp, Artificial Sequence
  chemically synthesized
taaaaagtgctttagaattttc

SEQ ID NO: 1011312 - DNA, 22 bp, Artificial Sequence
  chemically synthesized
ttagtgattgaagaaaattcta

SEQ ID NO: 1011313 - DNA, 22 bp, Artificial Sequence
  chemically synthesized
aaaaagtgctttagaattttct

SEQ ID NO: 1011314 - DNA, 22 bp, Artificial Sequence
  chemically synthesized
aaaagtgctttagaattttctt

SEQ ID NO: 1011315 - DNA, 22 bp, Artificial Sequence
  chemically synthesized
ccatggttattagtgattgaag

SEQ ID NO: 1011316 - DNA, 22 bp, Artificial Sequence
  chemically synthesized
accatggttattagtgattgaa

SEQ ID NO: 1011317 - DNA, 22 bp, Artificial Sequence
  chemically synthesized
tagaattttcttcaatcactaa

SEQ ID NO: 1011318 - DNA, 22 bp, Artificial Sequence
  chemically synthesized
agaattttcttcaatcactaat

SEQ ID NO: 1011319 - DNA, 22 bp, Artificial Sequence
  chemically synthesized
gaattttcttcaatcactaata

SEQ ID NO: 1011320 - DNA, 22 bp, Artificial Sequence
  chemically synthesized
ccttaccatggttattagtgat

SEQ ID NO: 1011321 - DNA, 22 bp, Artificial Sequence
  chemically synthesized
accttaccatggttattagtga

SEQ ID NO: 1011322 - DNA, 22 bp, Artificial Sequence
  chemically synthesized
taccttaccatggttattagtg

SEQ ID NO: 1011323 - DNA, 22 bp, Artificial Sequence
  chemically synthesized
tcttcaatcactaataaccatg

SEQ ID NO: 1011324 - DNA, 22 bp, Artificial Sequence
  chemically synthesized
cttcaatcactaataaccatgg

SEQ ID NO: 1011325 - DNA, 22 bp, Artificial Sequence
  chemically synthesized
agctttaccttaccatggttat

SEQ ID NO: 1011326 - DNA, 22 bp, Artificial Sequence
  chemically synthesized
ttcaatcactaataaccatggt

SEQ ID NO: 1011327 - DNA, 22 bp, Artificial Sequence
  chemically synthesized
cagctttaccttaccatggtta

SEQ ID NO: 1011328 - DNA, 22 bp, Artificial Sequence
  chemically synthesized
caatcactaataaccatggtaa

SEQ ID NO: 1011329 - DNA, 22 bp, Artificial Sequence
  chemically synthesized
ttcagctttaccttaccatggt

SEQ ID NO: 1011330 - DNA, 22 bp, Artificial Sequence
  chemically synthesized
aatcactaataaccatggtaag

SEQ ID NO: 1011331 - DNA, 22 bp, Artificial Sequence
  chemically synthesized
ctcttcagctttaccttaccat

SEQ ID NO: 1011332 - DNA, 22 bp, Artificial Sequence
  chemically synthesized
gctgctcttcagctttacctta

SEQ ID NO: 1011333 - DNA, 22 bp, Artificial Sequence
  chemically synthesized
agctgctcttcagctttacctt

SEQ ID NO: 1011334 - DNA, 22 bp, Artificial Sequence
  chemically synthesized
ataaccatggtaaggtaaagct

SEQ ID NO: 1011335 - DNA, 22 bp, Artificial Sequence
  chemically synthesized
tagctgctcttcagctttacct

SEQ ID NO: 1011336 - DNA, 22 bp, Artificial Sequence
  chemically synthesized
cctttagctgctcttcagcttt

SEQ ID NO: 1011337 - DNA, 22 bp, Artificial Sequence
  chemically synthesized
tccctttagctgctcttcagct

SEQ ID NO: 1011338 - DNA, 22 bp, Artificial Sequence
  chemically synthesized
agctctccctttagctgctctt

SEQ ID NO: 1011339 - DNA, 22 bp, Artificial Sequence
  chemically synthesized
cagctctccctttagctgctct

SEQ ID NO: 1011340 - DNA, 22 bp, Artificial Sequence
  chemically synthesized
ttcagctctccctttagctgct

SEQ ID NO: 1011341 - DNA, 22 bp, Artificial Sequence
  chemically synthesized
ctcttcagctctccctttagct

SEQ ID NO: 1011342 - DNA, 22 bp, Artificial Sequence
  chemically synthesized
gctgctcttcagctctcccttt

SEQ ID NO: 1011343 - DNA, 22 bp, Artificial Sequence
  chemically synthesized
agctgctcttcagctctccctt

SEQ ID NO: 1011344 - DNA, 22 bp, Artificial Sequence
  chemically synthesized
aagagcagctaaagggagagct

SEQ ID NO: 1011345 - DNA, 22 bp, Artificial Sequence
  chemically synthesized
aagggagagctgaagagcagct

SEQ ID NO: 1011346 - DNA, 22 bp, Artificial Sequence
  chemically synthesized
aagagcagctaaacttggcttt

SEQ ID NO: 1011347 - DNA, 22 bp, Artificial Sequence
  chemically synthesized
aacttggctttgacatttttgt

SEQ ID NO: 1011348 - DNA, 22 bp, Artificial Sequence
  chemically synthesized
ggctttgacatttttgtactct

SEQ ID NO: 1011349 - DNA, 22 bp, Artificial Sequence
  chemically synthesized
gctttgacatttttgtactctt

SEQ ID NO: 1011350 - DNA, 22 bp, Artificial Sequence
  chemically synthesized
agagaaggcaaaaaaagagtac

SEQ ID NO: 1011351 - DNA, 22 bp, Artificial Sequence
  chemically synthesized
tgacatttttgtactctttttt

SEQ ID NO: 1011352 - DNA, 22 bp, Artificial Sequence
  chemically synthesized
gacatttttgtactcttttttt

SEQ ID NO: 1011353 - DNA, 22 bp, Artificial Sequence
  chemically synthesized
acatttttgtactctttttttg

SEQ ID NO: 1011354 - DNA, 22 bp, Artificial Sequence
  chemically synthesized
gagttgagagaaggcaaaaaaa

SEQ ID NO: 1011355 - DNA, 22 bp, Artificial Sequence
  chemically synthesized
ggagttgagagaaggcaaaaaa

SEQ ID NO: 1011356 - DNA, 22 bp, Artificial Sequence
  chemically synthesized
tggagttgagagaaggcaaaaa

SEQ ID NO: 1011357 - DNA, 22 bp, Artificial Sequence
  chemically synthesized
ttgtactctttttttgccttct

SEQ ID NO: 1011358 - DNA, 22 bp, Artificial Sequence
  chemically synthesized
tgtactctttttttgccttctc

SEQ ID NO: 1011359 - DNA, 22 bp, Artificial Sequence
  chemically synthesized
gtactctttttttgccttctct

SEQ ID NO: 1011360 - DNA, 22 bp, Artificial Sequence
  chemically synthesized
tactctttttttgccttctctc

SEQ ID NO: 1011361 - DNA, 22 bp, Artificial Sequence
  chemically synthesized
gtgctttggagttgagagaagg

SEQ ID NO: 1011362 - DNA, 22 bp, Artificial Sequence
  chemically synthesized
tttttttgccttctctcaactc

SEQ ID NO: 1011363 - DNA, 22 bp, Artificial Sequence
  chemically synthesized
tttttgccttctctcaactcca

SEQ ID NO: 1011364 - DNA, 22 bp, Artificial Sequence
  chemically synthesized
ttttgccttctctcaactccaa

SEQ ID NO: 1011365 - DNA, 22 bp, Artificial Sequence
  chemically synthesized
tttgccttctctcaactccaaa

SEQ ID NO: 1011366 - DNA, 22 bp, Artificial Sequence
  chemically synthesized
ttgccttctctcaactccaaag

SEQ ID NO: 1011367 - DNA, 22 bp, Artificial Sequence
  chemically synthesized
tgccttctctcaactccaaagc

SEQ ID NO: 1011368 - DNA, 22 bp, Artificial Sequence
  chemically synthesized
gccttctctcaactccaaagca

SEQ ID NO: 1011369 - DNA, 22 bp, Artificial Sequence
  chemically synthesized
ccttctctcaactccaaagcac

SEQ ID NO: 1011370 - DNA, 22 bp, Artificial Sequence
  chemically synthesized
ctctcaactccaaagcaccagt

SEQ ID NO: 1011371 - DNA, 22 bp, Artificial Sequence
  chemically synthesized
tctcaactccaaagcaccagtg

SEQ ID NO: 1011372 - DNA, 22 bp, Artificial Sequence
  chemically synthesized
tcaactccaaagcaccagtgtg

SEQ ID NO: 1011373 - DNA, 22 bp, Artificial Sequence
  chemically synthesized
aactccaaagcaccagtgtgct

SEQ ID NO: 1011374 - DNA, 22 bp, Artificial Sequence
  chemically synthesized
caaagcaccagtgtgctctttc

SEQ ID NO: 1011375 - DNA, 22 bp, Artificial Sequence
  chemically synthesized
agatgaggaacaaaagggagaa

SEQ ID NO: 1011376 - DNA, 22 bp, Artificial Sequence
  chemically synthesized
tcagatgaggaacaaaagggag

SEQ ID NO: 1011377 - DNA, 22 bp, Artificial Sequence
  chemically synthesized
tttctttctcccttttgttcct

SEQ ID NO: 1011378 - DNA, 22 bp, Artificial Sequence
  chemically synthesized
tctttctcccttttgttcctca

SEQ ID NO: 1011379 - DNA, 22 bp, Artificial Sequence
  chemically synthesized
tgatctctcagatgaggaacaa

SEQ ID NO: 1011380 - DNA, 22 bp, Artificial Sequence
  chemically synthesized
ctttctcccttttgttcctcat

SEQ ID NO: 1011381 - DNA, 22 bp, Artificial Sequence
  chemically synthesized
tttctcccttttgttcctcatc

SEQ ID NO: 1011382 - DNA, 22 bp, Artificial Sequence
  chemically synthesized
ctgtgatctctcagatgaggaa

SEQ ID NO: 1011383 - DNA, 22 bp, Artificial Sequence
  chemically synthesized
tctcccttttgttcctcatctg

SEQ ID NO: 1011384 - DNA, 22 bp, Artificial Sequence
  chemically synthesized
ctcccttttgttcctcatctga

SEQ ID NO: 1011385 - DNA, 22 bp, Artificial Sequence
  chemically synthesized
tcccttttgttcctcatctgag

SEQ ID NO: 1011386 - DNA, 22 bp, Artificial Sequence
  chemically synthesized
ccttttgttcctcatctgagag

SEQ ID NO: 1011387 - DNA, 22 bp, Artificial Sequence
  chemically synthesized
ttgttcctcatctgagagatca

SEQ ID NO: 1011388 - DNA, 22 bp, Artificial Sequence
  chemically synthesized
tgttcctcatctgagagatcac

SEQ ID NO: 1011389 - DNA, 22 bp, Artificial Sequence
  chemically synthesized
gttcctcatctgagagatcaca

SEQ ID NO: 1011390 - DNA, 22 bp, Artificial Sequence
  chemically synthesized
ttcctcatctgagagatcacag

SEQ ID NO: 1011391 - DNA, 22 bp, Artificial Sequence
  chemically synthesized
ctcatctgagagatcacagcag

SEQ ID NO: 1011392 - DNA, 22 bp, Artificial Sequence
  chemically synthesized
tagcatggtgaccctgctgtga

SEQ ID NO: 1011393 - DNA, 22 bp, Artificial Sequence
  chemically synthesized
atctgagagatcacagcagggt

SEQ ID NO: 1011394 - DNA, 22 bp, Artificial Sequence
  chemically synthesized
agagatcacagcagggtcacca

SEQ ID NO: 1011395 - DNA, 22 bp, Artificial Sequence
  chemically synthesized
catataaagcatgtagttatag

SEQ ID NO: 1011396 - DNA, 22 bp, Artificial Sequence
  chemically synthesized
taactacatgctttatatgtaa

SEQ ID NO: 1011397 - DNA, 22 bp, Artificial Sequence
  chemically synthesized
catgctttatatgtaattttcc

SEQ ID NO: 1011398 - DNA, 22 bp, Artificial Sequence
  chemically synthesized
tatatgtaattttccattctct

SEQ ID NO: 1011399 - DNA, 22 bp, Artificial Sequence
  chemically synthesized
atatgtaattttccattctctc

SEQ ID NO: 1011400 - DNA, 22 bp, Artificial Sequence
  chemically synthesized
tatgtaattttccattctctct

SEQ ID NO: 1011401 - DNA, 22 bp, Artificial Sequence
  chemically synthesized
aaatgtgaaatgtccagagaga

SEQ ID NO: 1011402 - DNA, 22 bp, Artificial Sequence
  chemically synthesized
tcaaatgtgaaatgtccagaga

SEQ ID NO: 1011403 - DNA, 22 bp, Artificial Sequence
  chemically synthesized
ctcaaatgtgaaatgtccagag

SEQ ID NO: 1011404 - DNA, 22 bp, Artificial Sequence
  chemically synthesized
tctcaaatgtgaaatgtccaga

SEQ ID NO: 1011405 - DNA, 22 bp, Artificial Sequence
  chemically synthesized
ttctcaaatgtgaaatgtccag

SEQ ID NO: 1011406 - DNA, 22 bp, Artificial Sequence
  chemically synthesized
tccattctctctggacatttca

SEQ ID NO: 1011407 - DNA, 22 bp, Artificial Sequence
  chemically synthesized
ccattctctctggacatttcac

SEQ ID NO: 1011408 - DNA, 22 bp, Artificial Sequence
  chemically synthesized
cattctctctggacatttcaca

SEQ ID NO: 1011409 - DNA, 22 bp, Artificial Sequence
  chemically synthesized
ccttttctcaaatgtgaaatgt

SEQ ID NO: 1011410 - DNA, 22 bp, Artificial Sequence
  chemically synthesized
tctctggacatttcacatttga

SEQ ID NO: 1011411 - DNA, 22 bp, Artificial Sequence
  chemically synthesized
tctggacatttcacatttgaga

SEQ ID NO: 1011412 - DNA, 22 bp, Artificial Sequence
  chemically synthesized
tggacatttcacatttgagaaa

SEQ ID NO: 1011413 - DNA, 22 bp, Artificial Sequence
  chemically synthesized
gacatttcacatttgagaaaag

SEQ ID NO: 1011414 - DNA, 22 bp, Artificial Sequence
  chemically synthesized
aagaaaaatacactcccttttc

SEQ ID NO: 1011415 - DNA, 22 bp, Artificial Sequence
  chemically synthesized
cacatttgagaaaagggagtgt

SEQ ID NO: 1011416 - DNA, 22 bp, Artificial Sequence
  chemically synthesized
ttgaagaaaaatacactccctt

SEQ ID NO: 1011417 - DNA, 22 bp, Artificial Sequence
  chemically synthesized
acatttgagaaaagggagtgta

SEQ ID NO: 1011418 - DNA, 22 bp, Artificial Sequence
  chemically synthesized
tattgaagaaaaatacactccc

SEQ ID NO: 1011419 - DNA, 22 bp, Artificial Sequence
  chemically synthesized
gagaaaagggagtgtatttttc

SEQ ID NO: 1011420 - DNA, 22 bp, Artificial Sequence
  chemically synthesized
agaaaagggagtgtatttttct

SEQ ID NO: 1011421 - DNA, 22 bp, Artificial Sequence
  chemically synthesized
acgtcatattctattgaagaaa

SEQ ID NO: 1011422 - DNA, 22 bp, Artificial Sequence
  chemically synthesized
aacgtcatattctattgaagaa

SEQ ID NO: 1011423 - DNA, 22 bp, Artificial Sequence
  chemically synthesized
tagtttaacgtcatattctatt

SEQ ID NO: 1011424 - DNA, 22 bp, Artificial Sequence
  chemically synthesized
atagtttaacgtcatattctat

SEQ ID NO: 1011425 - DNA, 22 bp, Artificial Sequence
  chemically synthesized
ttcttcaatagaatatgacgtt

SEQ ID NO: 1011426 - DNA, 22 bp, Artificial Sequence
  chemically synthesized
tcttcaatagaatatgacgtta

SEQ ID NO: 1011427 - DNA, 22 bp, Artificial Sequence
  chemically synthesized
cttcaatagaatatgacgttaa

SEQ ID NO: 1011428 - DNA, 22 bp, Artificial Sequence
  chemically synthesized
ttcaatagaatatgacgttaaa

SEQ ID NO: 1011429 - DNA, 22 bp, Artificial Sequence
  chemically synthesized
aaaaacttatagtttaacgtca

SEQ ID NO: 1011430 - DNA, 22 bp, Artificial Sequence
  chemically synthesized
caatagaatatgacgttaaact

SEQ ID NO: 1011431 - DNA, 22 bp, Artificial Sequence
  chemically synthesized
aatagaatatgacgttaaacta

SEQ ID NO: 1011432 - DNA, 22 bp, Artificial Sequence
  chemically synthesized
aactataagtttttcaacattt

SEQ ID NO: 1011433 - DNA, 22 bp, Artificial Sequence
  chemically synthesized
acatggtcccaccatcaaatgt

SEQ ID NO: 1011434 - DNA, 22 bp, Artificial Sequence
  chemically synthesized
taagtttttcaacatttgatgg

SEQ ID NO: 1011435 - DNA, 22 bp, Artificial Sequence
  chemically synthesized
atgttcacatggtcccaccatc

SEQ ID NO: 1011436 - DNA, 22 bp, Artificial Sequence
  chemically synthesized
aatgttcacatggtcccaccat

SEQ ID NO: 1011437 - DNA, 22 bp, Artificial Sequence
  chemically synthesized
ttcaacatttgatggtgggacc

SEQ ID NO: 1011438 - DNA, 22 bp, Artificial Sequence
  chemically synthesized
taatgttcacatggtcccacca

SEQ ID NO: 1011439 - DNA, 22 bp, Artificial Sequence
  chemically synthesized
tcaacatttgatggtgggacca

SEQ ID NO: 1011440 - DNA, 22 bp, Artificial Sequence
  chemically synthesized
caacatttgatggtgggaccat

SEQ ID NO: 1011441 - DNA, 22 bp, Artificial Sequence
  chemically synthesized
aacatttgatggtgggaccatg

SEQ ID NO: 1011442 - DNA, 22 bp, Artificial Sequence
  chemically synthesized
gatggtgggaccatgtgaacat

SEQ ID NO: 1011443 - DNA, 22 bp, Artificial Sequence
  chemically synthesized
atggtgggaccatgtgaacatt

SEQ ID NO: 1011444 - DNA, 22 bp, Artificial Sequence
  chemically synthesized
catatgtcatattttaatgttc

SEQ ID NO: 1011445 - DNA, 22 bp, Artificial Sequence
  chemically synthesized
aaatatgacatatgtaatccat

SEQ ID NO: 1011446 - DNA, 22 bp, Artificial Sequence
  chemically synthesized
agcatacagaagtaaatatgga

SEQ ID NO: 1011447 - DNA, 22 bp, Artificial Sequence
  chemically synthesized
tcattgagcatacagaagtaaa

SEQ ID NO: 1011448 - DNA, 22 bp, Artificial Sequence
  chemically synthesized
attgtcattgagcatacagaag

SEQ ID NO: 1011449 - DNA, 22 bp, Artificial Sequence
  chemically synthesized
ttcattgtcattgagcatacag

SEQ ID NO: 1011450 - DNA, 22 bp, Artificial Sequence
  chemically synthesized
attcattgtcattgagcataca

SEQ ID NO: 1011451 - DNA, 22 bp, Artificial Sequence
  chemically synthesized
acttctgtatgctcaatgacaa

SEQ ID NO: 1011452 - DNA, 22 bp, Artificial Sequence
  chemically synthesized
cttctgtatgctcaatgacaat

SEQ ID NO: 1011453 - DNA, 22 bp, Artificial Sequence
  chemically synthesized
ctgtatgctcaatgacaatgaa

SEQ ID NO: 1011454 - DNA, 22 bp, Artificial Sequence
  chemically synthesized
tgtatgctcaatgacaatgaat

SEQ ID NO: 1011455 - DNA, 22 bp, Artificial Sequence
  chemically synthesized
tatgctcaatgacaatgaataa

SEQ ID NO: 1011456 - DNA, 22 bp, Artificial Sequence
  chemically synthesized
tgatatgaaagtaaaaatttat

SEQ ID NO: 1011457 - DNA, 22 bp, Artificial Sequence
  chemically synthesized
aatgacaatgaataaattttta

SEQ ID NO: 1011458 - DNA, 22 bp, Artificial Sequence
  chemically synthesized
gtgatatgaaagtaaaaattta

SEQ ID NO: 1011459 - DNA, 22 bp, Artificial Sequence
  chemically synthesized
tgtgatatgaaagtaaaaattt

SEQ ID NO: 1011460 - DNA, 22 bp, Artificial Sequence
  chemically synthesized
ctttgtgatatgaaagtaaaaa

SEQ ID NO: 1011461 - DNA, 22 bp, Artificial Sequence
  chemically synthesized
actttgtgatatgaaagtaaaa

SEQ ID NO: 1011462 - DNA, 22 bp, Artificial Sequence
  chemically synthesized
tttactttgtgatatgaaagta

SEQ ID NO: 1011463 - DNA, 22 bp, Artificial Sequence
  chemically synthesized
ttactttcatatcacaaagtaa

SEQ ID NO: 1011464 - DNA, 22 bp, Artificial Sequence
  chemically synthesized
tactttcatatcacaaagtaaa

SEQ ID NO: 1011465 - DNA, 22 bp, Artificial Sequence
  chemically synthesized
actttcatatcacaaagtaaac

SEQ ID NO: 1011466 - DNA, 22 bp, Artificial Sequence
  chemically synthesized
ctttcatatcacaaagtaaaca

SEQ ID NO: 1011467 - DNA, 22 bp, Artificial Sequence
  chemically synthesized
tcatatcacaaagtaaacagtt

SEQ ID NO: 1011468 - DNA, 22 bp, Artificial Sequence
  chemically synthesized
catatcacaaagtaaacagttt

SEQ ID NO: 1011469 - DNA, 22 bp, Artificial Sequence
  chemically synthesized
atatcacaaagtaaacagtttt

SEQ ID NO: 1011470 - DNA, 22 bp, Artificial Sequence
  chemically synthesized
taaagaaatgtaataaaaaact

SEQ ID NO: 1011471 - DNA, 22 bp, Artificial Sequence
  chemically synthesized
ctgtaaagaaatgtaataaaaa

SEQ ID NO: 1011472 - DNA, 22 bp, Artificial Sequence
  chemically synthesized
tatatgttgctgtaaagaaatg

SEQ ID NO: 1011473 - DNA, 22 bp, Artificial Sequence
  chemically synthesized
atatatgttgctgtaaagaaat

SEQ ID NO: 1011474 - DNA, 22 bp, Artificial Sequence
  chemically synthesized
tttattacatttctttacagca

SEQ ID NO: 1011475 - DNA, 22 bp, Artificial Sequence
  chemically synthesized
ttattacatttctttacagcaa

SEQ ID NO: 1011476 - DNA, 22 bp, Artificial Sequence
  chemically synthesized
tattacatttctttacagcaac

SEQ ID NO: 1011477 - DNA, 22 bp, Artificial Sequence
  chemically synthesized
attacatttctttacagcaaca

SEQ ID NO: 1011478 - DNA, 22 bp, Artificial Sequence
  chemically synthesized
ttacatttctttacagcaacat

SEQ ID NO: 1011479 - DNA, 22 bp, Artificial Sequence
  chemically synthesized
catttctttacagcaacatata

SEQ ID NO: 1011480 - DNA, 22 bp, Artificial Sequence
  chemically synthesized
ctttacagcaacatatataaat

SEQ ID NO: 1011481 - DNA, 22 bp, Artificial Sequence
  chemically synthesized
tttacagcaacatatataaata

SEQ ID NO: 1011482 - DNA, 22 bp, Artificial Sequence
  chemically synthesized
tacagcaacatatataaatata

SEQ ID NO: 1011483 - DNA, 22 bp, Artificial Sequence
  chemically synthesized
acagcaacatatataaatatat

SEQ ID NO: 1011484 - DNA, 22 bp, Artificial Sequence
  chemically synthesized
cagcaacatatataaatatatt

SEQ ID NO: 1011485 - DNA, 22 bp, Artificial Sequence
  chemically synthesized
tatggtaaatgtgcaatatatt

SEQ ID NO: 1011486 - DNA, 22 bp, Artificial Sequence
  chemically synthesized
tgttatatggtaaatgtgcaat

SEQ ID NO: 1011487 - DNA, 22 bp, Artificial Sequence
  chemically synthesized
cataacctatgttatatggtaa

SEQ ID NO: 1011488 - DNA, 22 bp, Artificial Sequence
  chemically synthesized
ctccataacctatgttatatgg

SEQ ID NO: 1011489 - DNA, 22 bp, Artificial Sequence
  chemically synthesized
ctgctccataacctatgttata

SEQ ID NO: 1011490 - DNA, 22 bp, Artificial Sequence
  chemically synthesized
cacatttaccatataacatagg

SEQ ID NO: 1011491 - DNA, 22 bp, Artificial Sequence
  chemically synthesized
actgctccataacctatgttat

SEQ ID NO: 1011492 - DNA, 22 bp, Artificial Sequence
  chemically synthesized
tactgctccataacctatgtta

SEQ ID NO: 1011493 - DNA, 22 bp, Artificial Sequence
  chemically synthesized
accatataacataggttatgga

SEQ ID NO: 1011494 - DNA, 22 bp, Artificial Sequence
  chemically synthesized
ccatataacataggttatggag

SEQ ID NO: 1011495 - DNA, 22 bp, Artificial Sequence
  chemically synthesized
gtgtgttttactgctccataac

SEQ ID NO: 1011496 - DNA, 22 bp, Artificial Sequence
  chemically synthesized
caatgttagtgtgttttactgc

SEQ ID NO: 1011497 - DNA, 22 bp, Artificial Sequence
  chemically synthesized
gcaatgttagtgtgttttactg

SEQ ID NO: 1011498 - DNA, 22 bp, Artificial Sequence
  chemically synthesized
tgcaatgttagtgtgttttact

SEQ ID NO: 1011499 - DNA, 22 bp, Artificial Sequence
  chemically synthesized
ttgcaatgttagtgtgttttac

SEQ ID NO: 1011500 - DNA, 22 bp, Artificial Sequence
  chemically synthesized
tggagcagtaaaacacactaac

SEQ ID NO: 1011501 - DNA, 22 bp, Artificial Sequence
  chemically synthesized
gtatcttttgcaatgttagtgt

SEQ ID NO: 1011502 - DNA, 22 bp, Artificial Sequence
  chemically synthesized
tggtatcttttgcaatgttagt

SEQ ID NO: 1011503 - DNA, 22 bp, Artificial Sequence
  chemically synthesized
ctggtatcttttgcaatgttag

SEQ ID NO: 1011504 - DNA, 22 bp, Artificial Sequence
  chemically synthesized
tctggtatcttttgcaatgtta

SEQ ID NO: 1011505 - DNA, 22 bp, Artificial Sequence
  chemically synthesized
gttttctggtatcttttgcaat

SEQ ID NO: 1011506 - DNA, 22 bp, Artificial Sequence
  chemically synthesized
attggttttctggtatcttttg

SEQ ID NO: 1011507 - DNA, 22 bp, Artificial Sequence
  chemically synthesized
agctaattggttttctggtatc

SEQ ID NO: 1011508 - DNA, 22 bp, Artificial Sequence
  chemically synthesized
acattgcaaaagataccagaaa

SEQ ID NO: 1011509 - DNA, 22 bp, Artificial Sequence
  chemically synthesized
aggttaagctaattggttttct

SEQ ID NO: 1011510 - DNA, 22 bp, Artificial Sequence
  chemically synthesized
caaaagataccagaaaaccaat

SEQ ID NO: 1011511 - DNA, 22 bp, Artificial Sequence
  chemically synthesized
ttaaggttaagctaattggttt

SEQ ID NO: 1011512 - DNA, 22 bp, Artificial Sequence
  chemically synthesized
gttaaggttaagctaattggtt

SEQ ID NO: 1011513 - DNA, 22 bp, Artificial Sequence
  chemically synthesized
gggaaaaaatatagtcttgtta

SEQ ID NO: 1011514 - DNA, 22 bp, Artificial Sequence
  chemically synthesized
agggaaaaaatatagtcttgtt

SEQ ID NO: 1011515 - DNA, 22 bp, Artificial Sequence
  chemically synthesized
tagggaaaaaatatagtcttgt

SEQ ID NO: 1011516 - DNA, 22 bp, Artificial Sequence
  chemically synthesized
gcttaaccttaacaagactata

SEQ ID NO: 1011517 - DNA, 22 bp, Artificial Sequence
  chemically synthesized
ttagggaaaaaatatagtcttg

SEQ ID NO: 1011518 - DNA, 22 bp, Artificial Sequence
  chemically synthesized
tttttagggaaaaaatatagtc

SEQ ID NO: 1011519 - DNA, 22 bp, Artificial Sequence
  chemically synthesized
aaccttaacaagactatatttt

SEQ ID NO: 1011520 - DNA, 22 bp, Artificial Sequence
  chemically synthesized
accttaacaagactatattttt

SEQ ID NO: 1011521 - DNA, 22 bp, Artificial Sequence
  chemically synthesized
ctgtttttagggaaaaaatata

SEQ ID NO: 1011522 - DNA, 22 bp, Artificial Sequence
  chemically synthesized
aacaagactatattttttccct

SEQ ID NO: 1011523 - DNA, 22 bp, Artificial Sequence
  chemically synthesized
acaagactatattttttcccta

SEQ ID NO: 1011524 - DNA, 22 bp, Artificial Sequence
  chemically synthesized
tattttttccctaaaaacagca

SEQ ID NO: 1011525 - DNA, 22 bp, Artificial Sequence
  chemically synthesized
acatgaataaactgctgttttt

SEQ ID NO: 1011526 - DNA, 22 bp, Artificial Sequence
  chemically synthesized
tgacatgaataaactgctgttt

SEQ ID NO: 1011527 - DNA, 22 bp, Artificial Sequence
  chemically synthesized
tttccctaaaaacagcagttta

SEQ ID NO: 1011528 - DNA, 22 bp, Artificial Sequence
  chemically synthesized
ttctgacatgaataaactgctg

SEQ ID NO: 1011529 - DNA, 22 bp, Artificial Sequence
  chemically synthesized
ttccctaaaaacagcagtttat

SEQ ID NO: 1011530 - DNA, 22 bp, Artificial Sequence
  chemically synthesized
tccctaaaaacagcagtttatt

SEQ ID NO: 1011531 - DNA, 22 bp, Artificial Sequence
  chemically synthesized
ccctaaaaacagcagtttattc

SEQ ID NO: 1011532 - DNA, 22 bp, Artificial Sequence
  chemically synthesized
cctaaaaacagcagtttattca

SEQ ID NO: 1011533 - DNA, 22 bp, Artificial Sequence
  chemically synthesized
aaaacagcagtttattcatgtc

SEQ ID NO: 1011534 - DNA, 22 bp, Artificial Sequence
  chemically synthesized
attcatgtcagaataacacact

SEQ ID NO: 1011535 - DNA, 22 bp, Artificial Sequence
  chemically synthesized
ttcatgtcagaataacacactg

SEQ ID NO: 1011536 - DNA, 22 bp, Artificial Sequence
  chemically synthesized
atgtcagaataacacactggtg

SEQ ID NO: 1011537 - DNA, 22 bp, Artificial Sequence
  chemically synthesized
agcagacatggggagcgaaaca

SEQ ID NO: 1011538 - DNA, 22 bp, Artificial Sequence
  chemically synthesized
gtgtttcgctccccatgtctgc

SEQ ID NO: 1011539 - DNA, 22 bp, Artificial Sequence
  chemically synthesized
aatcaacaaatgttaagcagac

SEQ ID NO: 1011540 - DNA, 22 bp, Artificial Sequence
  chemically synthesized
aaatcaacaaatgttaagcaga

SEQ ID NO: 1011541 - DNA, 22 bp, Artificial Sequence
  chemically synthesized
cgctccccatgtctgcttaaca

SEQ ID NO: 1011542 - DNA, 22 bp, Artificial Sequence
  chemically synthesized
taaatcaacaaatgttaagcag

SEQ ID NO: 1011543 - DNA, 22 bp, Artificial Sequence
  chemically synthesized
gctccccatgtctgcttaacat

SEQ ID NO: 1011544 - DNA, 22 bp, Artificial Sequence
  chemically synthesized
cccatgtctgcttaacatttgt

SEQ ID NO: 1011545 - DNA, 22 bp, Artificial Sequence
  chemically synthesized
ggctttaaatcaacaaatgtta

SEQ ID NO: 1011546 - DNA, 22 bp, Artificial Sequence
  chemically synthesized
aggctttaaatcaacaaatgtt

SEQ ID NO: 1011547 - DNA, 22 bp, Artificial Sequence
  chemically synthesized
taggctttaaatcaacaaatgt

SEQ ID NO: 1011548 - DNA, 22 bp, Artificial Sequence
  chemically synthesized
ttaggctttaaatcaacaaatg

SEQ ID NO: 1011549 - DNA, 22 bp, Artificial Sequence
  chemically synthesized
tttaggctttaaatcaacaaat

SEQ ID NO: 1011550 - DNA, 22 bp, Artificial Sequence
  chemically synthesized
cttaacatttgttgatttaaag

SEQ ID NO: 1011551 - DNA, 22 bp, Artificial Sequence
  chemically synthesized
aacatttgttgatttaaagcct

SEQ ID NO: 1011552 - DNA, 22 bp, Artificial Sequence
  chemically synthesized
acatttgttgatttaaagccta

SEQ ID NO: 1011553 - DNA, 22 bp, Artificial Sequence
  chemically synthesized
gatgaaattttttaggctttaa

SEQ ID NO: 1011554 - DNA, 22 bp, Artificial Sequence
  chemically synthesized
agatgaaattttttaggcttta

SEQ ID NO: 1011555 - DNA, 22 bp, Artificial Sequence
  chemically synthesized
tttagatgaaattttttaggct

SEQ ID NO: 1011556 - DNA, 22 bp, Artificial Sequence
  chemically synthesized
gttgatttaaagcctaaaaaat

SEQ ID NO: 1011557 - DNA, 22 bp, Artificial Sequence
  chemically synthesized
ttgatttaaagcctaaaaaatt

SEQ ID NO: 1011558 - DNA, 22 bp, Artificial Sequence
  chemically synthesized
atttaaagcctaaaaaatttca

SEQ ID NO: 1011559 - DNA, 22 bp, Artificial Sequence
  chemically synthesized
aaagcctaaaaaatttcatcta

SEQ ID NO: 1011560 - DNA, 22 bp, Artificial Sequence
  chemically synthesized
aagcctaaaaaatttcatctaa

SEQ ID NO: 1011561 - DNA, 22 bp, Artificial Sequence
  chemically synthesized
acagtagtggtattgtttagat

SEQ ID NO: 1011562 - DNA, 22 bp, Artificial Sequence
  chemically synthesized
aaaaatttcatctaaacaatac

SEQ ID NO: 1011563 - DNA, 22 bp, Artificial Sequence
  chemically synthesized
agacattaacagtagtggtatt

SEQ ID NO: 1011564 - DNA, 22 bp, Artificial Sequence
  chemically synthesized
aagacattaacagtagtggtat

SEQ ID NO: 1011565 - DNA, 22 bp, Artificial Sequence
  chemically synthesized
catctaaacaataccactactg

SEQ ID NO: 1011566 - DNA, 22 bp, Artificial Sequence
  chemically synthesized
atctaaacaataccactactgt

SEQ ID NO: 1011567 - DNA, 22 bp, Artificial Sequence
  chemically synthesized
aacaataccactactgttaatg

SEQ ID NO: 1011568 - DNA, 22 bp, Artificial Sequence
  chemically synthesized
aaatcgaccttaagacattaac

SEQ ID NO: 1011569 - DNA, 22 bp, Artificial Sequence
  chemically synthesized
gaaatcgaccttaagacattaa

SEQ ID NO: 1011570 - DNA, 22 bp, Artificial Sequence
  chemically synthesized
catttgaaatcgaccttaagac

SEQ ID NO: 1011571 - DNA, 22 bp, Artificial Sequence
  chemically synthesized
ctgttaatgtcttaaggtcgat

SEQ ID NO: 1011572 - DNA, 22 bp, Artificial Sequence
  chemically synthesized
ttaatgtcttaaggtcgatttc

SEQ ID NO: 1011573 - DNA, 22 bp, Artificial Sequence
  chemically synthesized
aggtattccatttgaaatcgac

SEQ ID NO: 1011574 - DNA, 22 bp, Artificial Sequence
  chemically synthesized
aaggtattccatttgaaatcga

SEQ ID NO: 1011575 - DNA, 22 bp, Artificial Sequence
  chemically synthesized
atgtcttaaggtcgatttcaaa

SEQ ID NO: 1011576 - DNA, 22 bp, Artificial Sequence
  chemically synthesized
aaatcttaaggtattccatttg

SEQ ID NO: 1011577 - DNA, 22 bp, Artificial Sequence
  chemically synthesized
aaggtcgatttcaaatggaata

SEQ ID NO: 1011578 - DNA, 22 bp, Artificial Sequence
  chemically synthesized
aggtcgatttcaaatggaatac

SEQ ID NO: 1011579 - DNA, 22 bp, Artificial Sequence
  chemically synthesized
agaccctaaaatcttaaggtat

SEQ ID NO: 1011580 - DNA, 22 bp, Artificial Sequence
  chemically synthesized
caaatggaataccttaagattt

SEQ ID NO: 1011581 - DNA, 22 bp, Artificial Sequence
  chemically synthesized
aaatggaataccttaagatttt

SEQ ID NO: 1011582 - DNA, 22 bp, Artificial Sequence
  chemically synthesized
aagattttagggtctcaggctt

SEQ ID NO: 1011583 - DNA, 22 bp, Artificial Sequence
  chemically synthesized
tcgcagacatacaagcctgaga

SEQ ID NO: 1011584 - DNA, 22 bp, Artificial Sequence
  chemically synthesized
agattttagggtctcaggcttg

SEQ ID NO: 1011585 - DNA, 22 bp, Artificial Sequence
  chemically synthesized
tagggtctcaggcttgtatgtc

SEQ ID NO: 1011586 - DNA, 22 bp, Artificial Sequence
  chemically synthesized
agggtctcaggcttgtatgtct

SEQ ID NO: 1011587 - DNA, 22 bp, Artificial Sequence
  chemically synthesized
gggtctcaggcttgtatgtctg

SEQ ID NO: 1011588 - DNA, 22 bp, Artificial Sequence
  chemically synthesized
cagaacgttgtcgcagacatac

SEQ ID NO: 1011589 - DNA, 22 bp, Artificial Sequence
  chemically synthesized
ctgcagaacgttgtcgcagaca

SEQ ID NO: 1011590 - DNA, 22 bp, Artificial Sequence
  chemically synthesized
cctgcagaacgttgtcgcagac

SEQ ID NO: 1011591 - DNA, 22 bp, Artificial Sequence
  chemically synthesized
aggcttgtatgtctgcgacaac

SEQ ID NO: 1011592 - DNA, 22 bp, Artificial Sequence
  chemically synthesized
gtatgtctgcgacaacgttctg

SEQ ID NO: 1011593 - DNA, 22 bp, Artificial Sequence
  chemically synthesized
tatgtctgcgacaacgttctgc

SEQ ID NO: 1011594 - DNA, 22 bp, Artificial Sequence
  chemically synthesized
aaaatgaccagtatttcctgca

SEQ ID NO: 1011595 - DNA, 22 bp, Artificial Sequence
  chemically synthesized
cgacaacgttctgcaggaaata

SEQ ID NO: 1011596 - DNA, 22 bp, Artificial Sequence
  chemically synthesized
tgcaggaaatactggtcatttt

SEQ ID NO: 1011597 - DNA, 22 bp, Artificial Sequence
  chemically synthesized
caggaaatactggtcattttta

SEQ ID NO: 1011598 - DNA, 22 bp, Artificial Sequence
  chemically synthesized
aatgaaccatattaaaaatgac

SEQ ID NO: 1011599 - DNA, 22 bp, Artificial Sequence
  chemically synthesized
ctgaatgaaccatattaaaaat

SEQ ID NO: 1011600 - DNA, 22 bp, Artificial Sequence
  chemically synthesized
gtcatttttaatatggttcatt

SEQ ID NO: 1011601 - DNA, 22 bp, Artificial Sequence
  chemically synthesized
tgaaataatgctgctgaatgaa

SEQ ID NO: 1011602 - DNA, 22 bp, Artificial Sequence
  chemically synthesized
atgaaataatgctgctgaatga

SEQ ID NO: 1011603 - DNA, 22 bp, Artificial Sequence
  chemically synthesized
tatgaaataatgctgctgaatg

SEQ ID NO: 1011604 - DNA, 22 bp, Artificial Sequence
  chemically synthesized
ttaatatggttcattcagcagc

SEQ ID NO: 1011605 - DNA, 22 bp, Artificial Sequence
  chemically synthesized
taatatggttcattcagcagca

SEQ ID NO: 1011606 - DNA, 22 bp, Artificial Sequence
  chemically synthesized
aatatggttcattcagcagcat

SEQ ID NO: 1011607 - DNA, 22 bp, Artificial Sequence
  chemically synthesized
ttttatgaaataatgctgctga

SEQ ID NO: 1011608 - DNA, 22 bp, Artificial Sequence
  chemically synthesized
atatggttcattcagcagcatt

SEQ ID NO: 1011609 - DNA, 22 bp, Artificial Sequence
  chemically synthesized
attcagcagcattatttcataa

SEQ ID NO: 1011610 - DNA, 22 bp, Artificial Sequence
  chemically synthesized
agcagcattatttcataaaaca

SEQ ID NO: 1011611 - DNA, 22 bp, Artificial Sequence
  chemically synthesized
atggaaatggcatctgttttat

SEQ ID NO: 1011612 - DNA, 22 bp, Artificial Sequence
  chemically synthesized
ttaatggaaatggcatctgttt

SEQ ID NO: 1011613 - DNA, 22 bp, Artificial Sequence
  chemically synthesized
attaatggaaatggcatctgtt

SEQ ID NO: 1011614 - DNA, 22 bp, Artificial Sequence
  chemically synthesized
tattaatggaaatggcatctgt

SEQ ID NO: 1011615 - DNA, 22 bp, Artificial Sequence
  chemically synthesized
ttattaatggaaatggcatctg

SEQ ID NO: 1011616 - DNA, 22 bp, Artificial Sequence
  chemically synthesized
tttcataaaacagatgccattt

SEQ ID NO: 1011617 - DNA, 22 bp, Artificial Sequence
  chemically synthesized
cataaaacagatgccatttcca

SEQ ID NO: 1011618 - DNA, 22 bp, Artificial Sequence
  chemically synthesized
ataaaacagatgccatttccat

SEQ ID NO: 1011619 - DNA, 22 bp, Artificial Sequence
  chemically synthesized
aatatttttattaatggaaatg

SEQ ID NO: 1011620 - DNA, 22 bp, Artificial Sequence
  chemically synthesized
aaccagctgaatatttttatta

SEQ ID NO: 1011621 - DNA, 22 bp, Artificial Sequence
  chemically synthesized
aaaccagctgaatatttttatt

SEQ ID NO: 1011622 - DNA, 22 bp, Artificial Sequence
  chemically synthesized
ccattaataaaaatattcagct

SEQ ID NO: 1011623 - DNA, 22 bp, Artificial Sequence
  chemically synthesized
agtatttaaaccagctgaatat

SEQ ID NO: 1011624 - DNA, 22 bp, Artificial Sequence
  chemically synthesized
cattaataaaaatattcagctg

SEQ ID NO: 1011625 - DNA, 22 bp, Artificial Sequence
  chemically synthesized
gattaagtatttaaaccagctg

SEQ ID NO: 1011626 - DNA, 22 bp, Artificial Sequence
  chemically synthesized
ataaaaatattcagctggttta

SEQ ID NO: 1011627 - DNA, 22 bp, Artificial Sequence
  chemically synthesized
ccattagattaagtatttaaac

SEQ ID NO: 1011628 - DNA, 22 bp, Artificial Sequence
  chemically synthesized
agctggtttaaatacttaatct

SEQ ID NO: 1011629 - DNA, 22 bp, Artificial Sequence
  chemically synthesized
gtttaaatacttaatctaatgg

SEQ ID NO: 1011630 - DNA, 22 bp, Artificial Sequence
  chemically synthesized
aaatacttaatctaatggtaat

SEQ ID NO: 1011631 - DNA, 22 bp, Artificial Sequence
  chemically synthesized
aatacttaatctaatggtaatt

SEQ ID NO: 1011632 - DNA, 22 bp, Artificial Sequence
  chemically synthesized
ccagtagaaacaataacaatta

SEQ ID NO: 1011633 - DNA, 22 bp, Artificial Sequence
  chemically synthesized
aatctaatggtaattgttattg

SEQ ID NO: 1011634 - DNA, 22 bp, Artificial Sequence
  chemically synthesized
atctaatggtaattgttattgt

SEQ ID NO: 1011635 - DNA, 22 bp, Artificial Sequence
  chemically synthesized
tagttgccagtagaaacaataa

SEQ ID NO: 1011636 - DNA, 22 bp, Artificial Sequence
  chemically synthesized
gtagttgccagtagaaacaata

SEQ ID NO: 1011637 - DNA, 22 bp, Artificial Sequence
  chemically synthesized
atggtaattgttattgtttcta

SEQ ID NO: 1011638 - DNA, 22 bp, Artificial Sequence
  chemically synthesized
ttattgtttctactggcaacta

SEQ ID NO: 1011639 - DNA, 22 bp, Artificial Sequence
  chemically synthesized
ttgtttctactggcaactacaa

SEQ ID NO: 1011640 - DNA, 22 bp, Artificial Sequence
  chemically synthesized
tttctactggcaactacaaaca

SEQ ID NO: 1011641 - DNA, 22 bp, Artificial Sequence
  chemically synthesized
ctactggcaactacaaacattt

SEQ ID NO: 1011642 - DNA, 22 bp, Artificial Sequence
  chemically synthesized
tactggcaactacaaacatttt

SEQ ID NO: 1011643 - DNA, 22 bp, Artificial Sequence
  chemically synthesized
ctggcaactacaaacattttcc

SEQ ID NO: 1011644 - DNA, 22 bp, Artificial Sequence
  chemically synthesized
tgatagaatgagatggaaaatg

SEQ ID NO: 1011645 - DNA, 22 bp, Artificial Sequence
  chemically synthesized
gcaactacaaacattttccatc

SEQ ID NO: 1011646 - DNA, 22 bp, Artificial Sequence
  chemically synthesized
caaacattttccatctcattct

SEQ ID NO: 1011647 - DNA, 22 bp, Artificial Sequence
  chemically synthesized
aaacatgggctatgatagaatg

SEQ ID NO: 1011648 - DNA, 22 bp, Artificial Sequence
  chemically synthesized
aaaacatgggctatgatagaat

SEQ ID NO: 1011649 - DNA, 22 bp, Artificial Sequence
  chemically synthesized
taaaacatgggctatgatagaa

SEQ ID NO: 1011650 - DNA, 22 bp, Artificial Sequence
  chemically synthesized
tccatctcattctatcatagcc

SEQ ID NO: 1011651 - DNA, 22 bp, Artificial Sequence
  chemically synthesized
ccatctcattctatcatagccc

SEQ ID NO: 1011652 - DNA, 22 bp, Artificial Sequence
  chemically synthesized
catctcattctatcatagccca

SEQ ID NO: 1011653 - DNA, 22 bp, Artificial Sequence
  chemically synthesized
attctatcatagcccatgtttt

SEQ ID NO: 1011654 - DNA, 22 bp, Artificial Sequence
  chemically synthesized
tatcatagcccatgttttaaaa

SEQ ID NO: 1011655 - DNA, 22 bp, Artificial Sequence
  chemically synthesized
ggaaaaaataagttttaaaaca

SEQ ID NO: 1011656 - DNA, 22 bp, Artificial Sequence
  chemically synthesized
tcatagcccatgttttaaaact

SEQ ID NO: 1011657 - DNA, 22 bp, Artificial Sequence
  chemically synthesized
gagactaggaaaaaataagttt

SEQ ID NO: 1011658 - DNA, 22 bp, Artificial Sequence
  chemically synthesized
ggagactaggaaaaaataagtt

SEQ ID NO: 1011659 - DNA, 22 bp, Artificial Sequence
  chemically synthesized
ttggagactaggaaaaaataag

SEQ ID NO: 1011660 - DNA, 22 bp, Artificial Sequence
  chemically synthesized
taaaacttattttttcctagtc

SEQ ID NO: 1011661 - DNA, 22 bp, Artificial Sequence
  chemically synthesized
aaaacttattttttcctagtct

SEQ ID NO: 1011662 - DNA, 22 bp, Artificial Sequence
  chemically synthesized
gcatgttcttggagactaggaa

SEQ ID NO: 1011663 - DNA, 22 bp, Artificial Sequence
  chemically synthesized
aaacttattttttcctagtctc

SEQ ID NO: 1011664 - DNA, 22 bp, Artificial Sequence
  chemically synthesized
aagctagcatgttcttggagac

SEQ ID NO: 1011665 - DNA, 22 bp, Artificial Sequence
  chemically synthesized
attttttcctagtctccaagaa

SEQ ID NO: 1011666 - DNA, 22 bp, Artificial Sequence
  chemically synthesized
aaagctagcatgttcttggaga

SEQ ID NO: 1011667 - DNA, 22 bp, Artificial Sequence
  chemically synthesized
ttttttcctagtctccaagaac

SEQ ID NO: 1011668 - DNA, 22 bp, Artificial Sequence
  chemically synthesized
tttcctagtctccaagaacatg

SEQ ID NO: 1011669 - DNA, 22 bp, Artificial Sequence
  chemically synthesized
ttcctagtctccaagaacatgc

SEQ ID NO: 1011670 - DNA, 22 bp, Artificial Sequence
  chemically synthesized
tcctagtctccaagaacatgct

SEQ ID NO: 1011671 - DNA, 22 bp, Artificial Sequence
  chemically synthesized
acatttaaagctagcatgttct

SEQ ID NO: 1011672 - DNA, 22 bp, Artificial Sequence
  chemically synthesized
cctagtctccaagaacatgcta

SEQ ID NO: 1011673 - DNA, 22 bp, Artificial Sequence
  chemically synthesized
ctagtctccaagaacatgctag

SEQ ID NO: 1011674 - DNA, 22 bp, Artificial Sequence
  chemically synthesized
gtctccaagaacatgctagctt

SEQ ID NO: 1011675 - DNA, 22 bp, Artificial Sequence
  chemically synthesized
caagaacatgctagctttaaat

SEQ ID NO: 1011676 - DNA, 22 bp, Artificial Sequence
  chemically synthesized
taaaatgccctaacatttaaag

SEQ ID NO: 1011677 - DNA, 22 bp, Artificial Sequence
  chemically synthesized
gctttaaatgttagggcatttt

SEQ ID NO: 1011678 - DNA, 22 bp, Artificial Sequence
  chemically synthesized
taaatgttagggcattttataa

SEQ ID NO: 1011679 - DNA, 22 bp, Artificial Sequence
  chemically synthesized
aaatgttagggcattttataat

SEQ ID NO: 1011680 - DNA, 22 bp, Artificial Sequence
  chemically synthesized
aatgttagggcattttataatt

SEQ ID NO: 1011681 - DNA, 22 bp, Artificial Sequence
  chemically synthesized
gggcattttataatttctactt

SEQ ID NO: 1011682 - DNA, 22 bp, Artificial Sequence
  chemically synthesized
agtgaaaataggaaagtagaaa

SEQ ID NO: 1011683 - DNA, 22 bp, Artificial Sequence
  chemically synthesized
cagtgaaaataggaaagtagaa

SEQ ID NO: 1011684 - DNA, 22 bp, Artificial Sequence
  chemically synthesized
tataatttctactttcctattt

SEQ ID NO: 1011685 - DNA, 22 bp, Artificial Sequence
  chemically synthesized
ataatttctactttcctatttt

SEQ ID NO: 1011686 - DNA, 22 bp, Artificial Sequence
  chemically synthesized
taatttctactttcctattttc

SEQ ID NO: 1011687 - DNA, 22 bp, Artificial Sequence
  chemically synthesized
aagtcccttcagtgaaaatagg

SEQ ID NO: 1011688 - DNA, 22 bp, Artificial Sequence
  chemically synthesized
caagtcccttcagtgaaaatag

SEQ ID NO: 1011689 - DNA, 22 bp, Artificial Sequence
  chemically synthesized
tcaagtcccttcagtgaaaata

SEQ ID NO: 1011690 - DNA, 22 bp, Artificial Sequence
  chemically synthesized
ctactttcctattttcactgaa

SEQ ID NO: 1011691 - DNA, 22 bp, Artificial Sequence
  chemically synthesized
tactttcctattttcactgaag

SEQ ID NO: 1011692 - DNA, 22 bp, Artificial Sequence
  chemically synthesized
ctttcctattttcactgaaggg

SEQ ID NO: 1011693 - DNA, 22 bp, Artificial Sequence
  chemically synthesized
tgtgctttcaagtcccttcagt

SEQ ID NO: 1011694 - DNA, 22 bp, Artificial Sequence
  chemically synthesized
gtgtgctttcaagtcccttcag

SEQ ID NO: 1011695 - DNA, 22 bp, Artificial Sequence
  chemically synthesized
tcctattttcactgaagggact

SEQ ID NO: 1011696 - DNA, 22 bp, Artificial Sequence
  chemically synthesized
cctattttcactgaagggactt

SEQ ID NO: 1011697 - DNA, 22 bp, Artificial Sequence
  chemically synthesized
ctattttcactgaagggacttg

SEQ ID NO: 1011698 - DNA, 22 bp, Artificial Sequence
  chemically synthesized
ttttcactgaagggacttgaaa

SEQ ID NO: 1011699 - DNA, 22 bp, Artificial Sequence
  chemically synthesized
tcactgaagggacttgaaagca

SEQ ID NO: 1011700 - DNA, 22 bp, Artificial Sequence
  chemically synthesized
cactgaagggacttgaaagcac

SEQ ID NO: 1011701 - DNA, 22 bp, Artificial Sequence
  chemically synthesized
actgaagggacttgaaagcaca

SEQ ID NO: 1011702 - DNA, 22 bp, Artificial Sequence
  chemically synthesized
acagggtgaatttgtgtgcttt

SEQ ID NO: 1011703 - DNA, 22 bp, Artificial Sequence
  chemically synthesized
aagggacttgaaagcacacaaa

SEQ ID NO: 1011704 - DNA, 22 bp, Artificial Sequence
  chemically synthesized
atatattgacagggtgaatttg

SEQ ID NO: 1011705 - DNA, 22 bp, Artificial Sequence
  chemically synthesized
gaaagcacacaaattcaccctg

SEQ ID NO: 1011706 - DNA, 22 bp, Artificial Sequence
  chemically synthesized
aaagcacacaaattcaccctgt

SEQ ID NO: 1011707 - DNA, 22 bp, Artificial Sequence
  chemically synthesized
gctcatatattgacagggtgaa

SEQ ID NO: 1011708 - DNA, 22 bp, Artificial Sequence
  chemically synthesized
accctgtcaatatatgagctaa

SEQ ID NO: 1011709 - DNA, 22 bp, Artificial Sequence
  chemically synthesized
tcaatatatgagctaacattat

SEQ ID NO: 1011710 - DNA, 22 bp, Artificial Sequence
  chemically synthesized
aacaccatgaaggaaagtgaca

SEQ ID NO: 1011711 - DNA, 22 bp, Artificial Sequence
  chemically synthesized
acattatttgtgtcactttcct

SEQ ID NO: 1011712 - DNA, 22 bp, Artificial Sequence
  chemically synthesized
tttgtgtcactttccttcatgg

SEQ ID NO: 1011713 - DNA, 22 bp, Artificial Sequence
  chemically synthesized
gtgtcactttccttcatggtgt

SEQ ID NO: 1011714 - DNA, 22 bp, Artificial Sequence
  chemically synthesized
tgtcactttccttcatggtgtt

SEQ ID NO: 1011715 - DNA, 22 bp, Artificial Sequence
  chemically synthesized
aaaggaaaagctgaacaccatg

SEQ ID NO: 1011716 - DNA, 22 bp, Artificial Sequence
  chemically synthesized
caaaggaaaagctgaacaccat

SEQ ID NO: 1011717 - DNA, 22 bp, Artificial Sequence
  chemically synthesized
tcaaaggaaaagctgaacacca

SEQ ID NO: 1011718 - DNA, 22 bp, Artificial Sequence
  chemically synthesized
tccttcatggtgttcagctttt

SEQ ID NO: 1011719 - DNA, 22 bp, Artificial Sequence
  chemically synthesized
ccttcatggtgttcagcttttc

SEQ ID NO: 1011720 - DNA, 22 bp, Artificial Sequence
  chemically synthesized
cttcatggtgttcagcttttcc

SEQ ID NO: 1011721 - DNA, 22 bp, Artificial Sequence
  chemically synthesized
catggtgttcagcttttccttt

SEQ ID NO: 1011722 - DNA, 22 bp, Artificial Sequence
  chemically synthesized
atgggagttttcaaaggaaaag

SEQ ID NO: 1011723 - DNA, 22 bp, Artificial Sequence
  chemically synthesized
atggtgttcagcttttcctttg

SEQ ID NO: 1011724 - DNA, 22 bp, Artificial Sequence
  chemically synthesized
agcttttcctttgaaaactccc

SEQ ID NO: 1011725 - DNA, 22 bp, Artificial Sequence
  chemically synthesized
ttcctttgaaaactcccattaa

SEQ ID NO: 1011726 - DNA, 22 bp, Artificial Sequence
  chemically synthesized
tcctttgaaaactcccattaac

SEQ ID NO: 1011727 - DNA, 22 bp, Artificial Sequence
  chemically synthesized
acaagaagaaatgttaatggga

SEQ ID NO: 1011728 - DNA, 22 bp, Artificial Sequence
  chemically synthesized
cctttgaaaactcccattaaca

SEQ ID NO: 1011729 - DNA, 22 bp, Artificial Sequence
  chemically synthesized
ctttgaaaactcccattaacat

SEQ ID NO: 1011730 - DNA, 22 bp, Artificial Sequence
  chemically synthesized
gctaacaagaagaaatgttaat

SEQ ID NO: 1011731 - DNA, 22 bp, Artificial Sequence
  chemically synthesized
tgaaaactcccattaacatttc

SEQ ID NO: 1011732 - DNA, 22 bp, Artificial Sequence
  chemically synthesized
gaaaactcccattaacatttct

SEQ ID NO: 1011733 - DNA, 22 bp, Artificial Sequence
  chemically synthesized
aaaactcccattaacatttctt

SEQ ID NO: 1011734 - DNA, 22 bp, Artificial Sequence
  chemically synthesized
ctagctaacaagaagaaatgtt

SEQ ID NO: 1011735 - DNA, 22 bp, Artificial Sequence
  chemically synthesized
cctagctaacaagaagaaatgt

SEQ ID NO: 1011736 - DNA, 22 bp, Artificial Sequence
  chemically synthesized
atttcctagctaacaagaagaa

SEQ ID NO: 1011737 - DNA, 22 bp, Artificial Sequence
  chemically synthesized
ccattaacatttcttcttgtta

SEQ ID NO: 1011738 - DNA, 22 bp, Artificial Sequence
  chemically synthesized
ctcatttcctagctaacaagaa

SEQ ID NO: 1011739 - DNA, 22 bp, Artificial Sequence
  chemically synthesized
cctactcatttcctagctaaca

SEQ ID NO: 1011740 - DNA, 22 bp, Artificial Sequence
  chemically synthesized
acatttcttcttgttagctagg

SEQ ID NO: 1011741 - DNA, 22 bp, Artificial Sequence
  chemically synthesized
tgcctactcatttcctagctaa

SEQ ID NO: 1011742 - DNA, 22 bp, Artificial Sequence
  chemically synthesized
ctgcctactcatttcctagcta

SEQ ID NO: 1011743 - DNA, 22 bp, Artificial Sequence
  chemically synthesized
cttcttgttagctaggaaatga

SEQ ID NO: 1011744 - DNA, 22 bp, Artificial Sequence
  chemically synthesized
ttcttgttagctaggaaatgag

SEQ ID NO: 1011745 - DNA, 22 bp, Artificial Sequence
  chemically synthesized
acacttctgcctactcatttcc

SEQ ID NO: 1011746 - DNA, 22 bp, Artificial Sequence
  chemically synthesized
cttgttagctaggaaatgagta

SEQ ID NO: 1011747 - DNA, 22 bp, Artificial Sequence
  chemically synthesized
ttgttagctaggaaatgagtag

SEQ ID NO: 1011748 - DNA, 22 bp, Artificial Sequence
  chemically synthesized
gttagctaggaaatgagtaggc

SEQ ID NO: 1011749 - DNA, 22 bp, Artificial Sequence
  chemically synthesized
ttagctaggaaatgagtaggca

SEQ ID NO: 1011750 - DNA, 22 bp, Artificial Sequence
  chemically synthesized
gctaggaaatgagtaggcagaa

SEQ ID NO: 1011751 - DNA, 22 bp, Artificial Sequence
  chemically synthesized
agatagctgacacttctgccta

SEQ ID NO: 1011752 - DNA, 22 bp, Artificial Sequence
  chemically synthesized
cagatagctgacacttctgcct

SEQ ID NO: 1011753 - DNA, 22 bp, Artificial Sequence
  chemically synthesized
ggaaatgagtaggcagaagtgt

SEQ ID NO: 1011754 - DNA, 22 bp, Artificial Sequence
  chemically synthesized
tttcagatagctgacacttctg

SEQ ID NO: 1011755 - DNA, 22 bp, Artificial Sequence
  chemically synthesized
agccaaacgcatctgtttcaga

SEQ ID NO: 1011756 - DNA, 22 bp, Artificial Sequence
  chemically synthesized
caattcagccaaacgcatctgt

SEQ ID NO: 1011757 - DNA, 22 bp, Artificial Sequence
  chemically synthesized
tctgaaacagatgcgtttggct

SEQ ID NO: 1011758 - DNA, 22 bp, Artificial Sequence
  chemically synthesized
aaacagatgcgtttggctgaat

SEQ ID NO: 1011759 - DNA, 22 bp, Artificial Sequence
  chemically synthesized
aggaaaattccaattcagccaa

SEQ ID NO: 1011760 - DNA, 22 bp, Artificial Sequence
  chemically synthesized
ggaattgaggaaaattccaatt

SEQ ID NO: 1011761 - DNA, 22 bp, Artificial Sequence
  chemically synthesized
gattaggaattgaggaaaattc

SEQ ID NO: 1011762 - DNA, 22 bp, Artificial Sequence
  chemically synthesized
ggattaggaattgaggaaaatt

SEQ ID NO: 1011763 - DNA, 22 bp, Artificial Sequence
  chemically synthesized
ggctgaattggaattttcctca

SEQ ID NO: 1011764 - DNA, 22 bp, Artificial Sequence
  chemically synthesized
gctgaattggaattttcctcaa

SEQ ID NO: 1011765 - DNA, 22 bp, Artificial Sequence
  chemically synthesized
ttggattaggaattgaggaaaa

SEQ ID NO: 1011766 - DNA, 22 bp, Artificial Sequence
  chemically synthesized
aattggaattttcctcaattcc

SEQ ID NO: 1011767 - DNA, 22 bp, Artificial Sequence
  chemically synthesized
gaattttcctcaattcctaatc

SEQ ID NO: 1011768 - DNA, 22 bp, Artificial Sequence
  chemically synthesized
tcctcaattcctaatccaagag

SEQ ID NO: 1011769 - DNA, 22 bp, Artificial Sequence
  chemically synthesized
aaagcataagggctcttggatt

SEQ ID NO: 1011770 - DNA, 22 bp, Artificial Sequence
  chemically synthesized
cctcaattcctaatccaagagc

SEQ ID NO: 1011771 - DNA, 22 bp, Artificial Sequence
  chemically synthesized
ctcaattcctaatccaagagcc

SEQ ID NO: 1011772 - DNA, 22 bp, Artificial Sequence
  chemically synthesized
tcaaagcataagggctcttgga

SEQ ID NO: 1011773 - DNA, 22 bp, Artificial Sequence
  chemically synthesized
ctcaaagcataagggctcttgg

SEQ ID NO: 1011774 - DNA, 22 bp, Artificial Sequence
  chemically synthesized
aattcctaatccaagagccctt

SEQ ID NO: 1011775 - DNA, 22 bp, Artificial Sequence
  chemically synthesized
ttctcaaagcataagggctctt

SEQ ID NO: 1011776 - DNA, 22 bp, Artificial Sequence
  chemically synthesized
cttctcaaagcataagggctct

SEQ ID NO: 1011777 - DNA, 22 bp, Artificial Sequence
  chemically synthesized
ctaatccaagagcccttatgct

SEQ ID NO: 1011778 - DNA, 22 bp, Artificial Sequence
  chemically synthesized
atccaagagcccttatgctttg

SEQ ID NO: 1011779 - DNA, 22 bp, Artificial Sequence
  chemically synthesized
tgtagtataatttcttctcaaa

SEQ ID NO: 1011780 - DNA, 22 bp, Artificial Sequence
  chemically synthesized
atgtagtataatttcttctcaa

SEQ ID NO: 1011781 - DNA, 22 bp, Artificial Sequence
  chemically synthesized
tatgtagtataatttcttctca

SEQ ID NO: 1011782 - DNA, 22 bp, Artificial Sequence
  chemically synthesized
ttatgtagtataatttcttctc

SEQ ID NO: 1011783 - DNA, 22 bp, Artificial Sequence
  chemically synthesized
tttttatgtagtataatttctt

SEQ ID NO: 1011784 - DNA, 22 bp, Artificial Sequence
  chemically synthesized
atttttatgtagtataatttct

SEQ ID NO: 1011785 - DNA, 22 bp, Artificial Sequence
  chemically synthesized
atgctttgagaagaaattatac

SEQ ID NO: 1011786 - DNA, 22 bp, Artificial Sequence
  chemically synthesized
tgctttgagaagaaattatact

SEQ ID NO: 1011787 - DNA, 22 bp, Artificial Sequence
  chemically synthesized
tgagaagaaattatactacata

SEQ ID NO: 1011788 - DNA, 22 bp, Artificial Sequence
  chemically synthesized
gagaagaaattatactacataa

SEQ ID NO: 1011789 - DNA, 22 bp, Artificial Sequence
  chemically synthesized
agaagaaattatactacataaa

SEQ ID NO: 1011790 - DNA, 22 bp, Artificial Sequence
  chemically synthesized
ataaaaccttatttttatgtag

SEQ ID NO: 1011791 - DNA, 22 bp, Artificial Sequence
  chemically synthesized
cataaaaccttatttttatgta

SEQ ID NO: 1011792 - DNA, 22 bp, Artificial Sequence
  chemically synthesized
gaaatttcataaaaccttattt

SEQ ID NO: 1011793 - DNA, 22 bp, Artificial Sequence
  chemically synthesized
tactacataaaaataaggtttt

SEQ ID NO: 1011794 - DNA, 22 bp, Artificial Sequence
  chemically synthesized
cataaaaataaggttttatgaa

SEQ ID NO: 1011795 - DNA, 22 bp, Artificial Sequence
  chemically synthesized
cagaaaaaccaacctggaaatt

SEQ ID NO: 1011796 - DNA, 22 bp, Artificial Sequence
  chemically synthesized
tatgaaatttccaggttggttt

SEQ ID NO: 1011797 - DNA, 22 bp, Artificial Sequence
  chemically synthesized
atgaaatttccaggttggtttt

SEQ ID NO: 1011798 - DNA, 22 bp, Artificial Sequence
  chemically synthesized
tgaaatttccaggttggttttt

SEQ ID NO: 1011799 - DNA, 22 bp, Artificial Sequence
  chemically synthesized
aacatccacactgcagaaaaac

SEQ ID NO: 1011800 - DNA, 22 bp, Artificial Sequence
  chemically synthesized
taaacatccacactgcagaaaa

SEQ ID NO: 1011801 - DNA, 22 bp, Artificial Sequence
  chemically synthesized
ccaggttggtttttctgcagtg

SEQ ID NO: 1011802 - DNA, 22 bp, Artificial Sequence
  chemically synthesized
caggttggtttttctgcagtgt

SEQ ID NO: 1011803 - DNA, 22 bp, Artificial Sequence
  chemically synthesized
tcgtctctaaacatccacactg

SEQ ID NO: 1011804 - DNA, 22 bp, Artificial Sequence
  chemically synthesized
gtttttctgcagtgtggatgtt

SEQ ID NO: 1011805 - DNA, 22 bp, Artificial Sequence
  chemically synthesized
aattatcgtctctaaacatcca

SEQ ID NO: 1011806 - DNA, 22 bp, Artificial Sequence
  chemically synthesized
ttctgcagtgtggatgtttaga

SEQ ID NO: 1011807 - DNA, 22 bp, Artificial Sequence
  chemically synthesized
tctgcagtgtggatgtttagag

SEQ ID NO: 1011808 - DNA, 22 bp, Artificial Sequence
  chemically synthesized
ctgaattatcgtctctaaacat

SEQ ID NO: 1011809 - DNA, 22 bp, Artificial Sequence
  chemically synthesized
ctgcagtgtggatgtttagaga

SEQ ID NO: 1011810 - DNA, 22 bp, Artificial Sequence
  chemically synthesized
actgaattatcgtctctaaaca

SEQ ID NO: 1011811 - DNA, 22 bp, Artificial Sequence
  chemically synthesized
tgcagtgtggatgtttagagac

SEQ ID NO: 1011812 - DNA, 22 bp, Artificial Sequence
  chemically synthesized
cagtgtggatgtttagagacga

SEQ ID NO: 1011813 - DNA, 22 bp, Artificial Sequence
  chemically synthesized
tttactgaattatcgtctctaa

SEQ ID NO: 1011814 - DNA, 22 bp, Artificial Sequence
  chemically synthesized
atttactgaattatcgtctcta

SEQ ID NO: 1011815 - DNA, 22 bp, Artificial Sequence
  chemically synthesized
agacttatttactgaattatcg

SEQ ID NO: 1011816 - DNA, 22 bp, Artificial Sequence
  chemically synthesized
agagacgataattcagtaaata

SEQ ID NO: 1011817 - DNA, 22 bp, Artificial Sequence
  chemically synthesized
gagacgataattcagtaaataa

SEQ ID NO: 1011818 - DNA, 22 bp, Artificial Sequence
  chemically synthesized
atatcaatacaaactaagactt

SEQ ID NO: 1011819 - DNA, 22 bp, Artificial Sequence
  chemically synthesized
gttcatatcaatacaaactaag

SEQ ID NO: 1011820 - DNA, 22 bp, Artificial Sequence
  chemically synthesized
agtaaataagtcttagtttgta

SEQ ID NO: 1011821 - DNA, 22 bp, Artificial Sequence
  chemically synthesized
taagtgattagttcatatcaat

SEQ ID NO: 1011822 - DNA, 22 bp, Artificial Sequence
  chemically synthesized
ataagtgattagttcatatcaa

SEQ ID NO: 1011823 - DNA, 22 bp, Artificial Sequence
  chemically synthesized
tataagtgattagttcatatca

SEQ ID NO: 1011824 - DNA, 22 bp, Artificial Sequence
  chemically synthesized
tttataagtgattagttcatat

SEQ ID NO: 1011825 - DNA, 22 bp, Artificial Sequence
  chemically synthesized
agtttgtattgatatgaactaa

SEQ ID NO: 1011826 - DNA, 22 bp, Artificial Sequence
  chemically synthesized
gtttgtattgatatgaactaat

SEQ ID NO: 1011827 - DNA, 22 bp, Artificial Sequence
  chemically synthesized
gtattgatatgaactaatcact

SEQ ID NO: 1011828 - DNA, 22 bp, Artificial Sequence
  chemically synthesized
tattgatatgaactaatcactt

SEQ ID NO: 1011829 - DNA, 22 bp, Artificial Sequence
  chemically synthesized
atcactctttataagtgattag

SEQ ID NO: 1011830 - DNA, 22 bp, Artificial Sequence
  chemically synthesized
atatgaactaatcacttataaa

SEQ ID NO: 1011831 - DNA, 22 bp, Artificial Sequence
  chemically synthesized
taactaatcactctttataagt

SEQ ID NO: 1011832 - DNA, 22 bp, Artificial Sequence
  chemically synthesized
ttataactaatcactctttata

SEQ ID NO: 1011833 - DNA, 22 bp, Artificial Sequence
  chemically synthesized
atcacttataaagagtgattag

SEQ ID NO: 1011834 - DNA, 22 bp, Artificial Sequence
  chemically synthesized
ataaagagtgattagttataat

SEQ ID NO: 1011835 - DNA, 22 bp, Artificial Sequence
  chemically synthesized
taaagagtgattagttataata

SEQ ID NO: 1011836 - DNA, 22 bp, Artificial Sequence
  chemically synthesized
aatgtaagcccctattataact

SEQ ID NO: 1011837 - DNA, 22 bp, Artificial Sequence
  chemically synthesized
attaaatgtaagcccctattat

SEQ ID NO: 1011838 - DNA, 22 bp, Artificial Sequence
  chemically synthesized
ctcattaaatgtaagcccctat

SEQ ID NO: 1011839 - DNA, 22 bp, Artificial Sequence
  chemically synthesized
gttataataggggcttacattt

SEQ ID NO: 1011840 - DNA, 22 bp, Artificial Sequence
  chemically synthesized
taataggggcttacatttaatg

SEQ ID NO: 1011841 - DNA, 22 bp, Artificial Sequence
  chemically synthesized
cacaaaataattactcattaaa

SEQ ID NO: 1011842 - DNA, 22 bp, Artificial Sequence
  chemically synthesized
gcacaaaataattactcattaa

SEQ ID NO: 1011843 - DNA, 22 bp, Artificial Sequence
  chemically synthesized
tgcacaaaataattactcatta

SEQ ID NO: 1011844 - DNA, 22 bp, Artificial Sequence
  chemically synthesized
acatttaatgagtaattatttt

SEQ ID NO: 1011845 - DNA, 22 bp, Artificial Sequence
  chemically synthesized
catttaatgagtaattattttg

SEQ ID NO: 1011846 - DNA, 22 bp, Artificial Sequence
  chemically synthesized
gaatagcattttgcacaaaata

SEQ ID NO: 1011847 - DNA, 22 bp, Artificial Sequence
  chemically synthesized
ggaatagcattttgcacaaaat

SEQ ID NO: 1011848 - DNA, 22 bp, Artificial Sequence
  chemically synthesized
aatgagtaattattttgtgcaa

SEQ ID NO: 1011849 - DNA, 22 bp, Artificial Sequence
  chemically synthesized
atgagtaattattttgtgcaaa

SEQ ID NO: 1011850 - DNA, 22 bp, Artificial Sequence
  chemically synthesized
ttttgtgcaaaatgctattcca

SEQ ID NO: 1011851 - DNA, 22 bp, Artificial Sequence
  chemically synthesized
tgtgcaaaatgctattccaagt

SEQ ID NO: 1011852 - DNA, 22 bp, Artificial Sequence
  chemically synthesized
gtgcaaaatgctattccaagtg

SEQ ID NO: 1011853 - DNA, 22 bp, Artificial Sequence
  chemically synthesized
tgcaaaatgctattccaagtgg

SEQ ID NO: 1011854 - DNA, 22 bp, Artificial Sequence
  chemically synthesized
ttccaagtggctttatacacat

SEQ ID NO: 1011855 - DNA, 22 bp, Artificial Sequence
  chemically synthesized
caagtggctttatacacatctc

SEQ ID NO: 1011856 - DNA, 22 bp, Artificial Sequence
  chemically synthesized
aaatggaaatataaatgagatg

SEQ ID NO: 1011857 - DNA, 22 bp, Artificial Sequence
  chemically synthesized
taaaatggaaatataaatgaga

SEQ ID NO: 1011858 - DNA, 22 bp, Artificial Sequence
  chemically synthesized
tctaaaatggaaatataaatga

SEQ ID NO: 1011859 - DNA, 22 bp, Artificial Sequence
  chemically synthesized
ctctaaaatggaaatataaatg

SEQ ID NO: 1011860 - DNA, 22 bp, Artificial Sequence
  chemically synthesized
tatacacatctcatttatattt

SEQ ID NO: 1011861 - DNA, 22 bp, Artificial Sequence
  chemically synthesized
atacacatctcatttatatttc

SEQ ID NO: 1011862 - DNA, 22 bp, Artificial Sequence
  chemically synthesized
ttctctaaaatggaaatataaa

SEQ ID NO: 1011863 - DNA, 22 bp, Artificial Sequence
  chemically synthesized
tacacatctcatttatatttcc

SEQ ID NO: 1011864 - DNA, 22 bp, Artificial Sequence
  chemically synthesized
tcttctctaaaatggaaatata

SEQ ID NO: 1011865 - DNA, 22 bp, Artificial Sequence
  chemically synthesized
ctcttctctaaaatggaaatat

SEQ ID NO: 1011866 - DNA, 22 bp, Artificial Sequence
  chemically synthesized
atttctcttctctaaaatggaa

SEQ ID NO: 1011867 - DNA, 22 bp, Artificial Sequence
  chemically synthesized
tgatttctcttctctaaaatgg

SEQ ID NO: 1011868 - DNA, 22 bp, Artificial Sequence
  chemically synthesized
atttatatttccattttagaga

SEQ ID NO: 1011869 - DNA, 22 bp, Artificial Sequence
  chemically synthesized
atatttccattttagagaagag

SEQ ID NO: 1011870 - DNA, 22 bp, Artificial Sequence
  chemically synthesized
tatttccattttagagaagaga

SEQ ID NO: 1011871 - DNA, 22 bp, Artificial Sequence
  chemically synthesized
atgtctctgatttctcttctct

SEQ ID NO: 1011872 - DNA, 22 bp, Artificial Sequence
  chemically synthesized
catgtctctgatttctcttctc

SEQ ID NO: 1011873 - DNA, 22 bp, Artificial Sequence
  chemically synthesized
tcatgtctctgatttctcttct

SEQ ID NO: 1011874 - DNA, 22 bp, Artificial Sequence
  chemically synthesized
ttcatgtctctgatttctcttc

SEQ ID NO: 1011875 - DNA, 22 bp, Artificial Sequence
  chemically synthesized
ccattttagagaagagaaatca

SEQ ID NO: 1011876 - DNA, 22 bp, Artificial Sequence
  chemically synthesized
ttttcatgtctctgatttctct

SEQ ID NO: 1011877 - DNA, 22 bp, Artificial Sequence
  chemically synthesized
cattttagagaagagaaatcag

SEQ ID NO: 1011878 - DNA, 22 bp, Artificial Sequence
  chemically synthesized
attcttttcatgtctctgattt

SEQ ID NO: 1011879 - DNA, 22 bp, Artificial Sequence
  chemically synthesized
aattcttttcatgtctctgatt

SEQ ID NO: 1011880 - DNA, 22 bp, Artificial Sequence
  chemically synthesized
tagagaagagaaatcagagaca

SEQ ID NO: 1011881 - DNA, 22 bp, Artificial Sequence
  chemically synthesized
agagaagagaaatcagagacat

SEQ ID NO: 1011882 - DNA, 22 bp, Artificial Sequence
  chemically synthesized
gagaagagaaatcagagacatg

SEQ ID NO: 1011883 - DNA, 22 bp, Artificial Sequence
  chemically synthesized
tgaaaatatcttaattcttttc

SEQ ID NO: 1011884 - DNA, 22 bp, Artificial Sequence
  chemically synthesized
gtgaaaatatcttaattctttt

SEQ ID NO: 1011885 - DNA, 22 bp, Artificial Sequence
  chemically synthesized
tagaatcttgtgaaaatatctt

SEQ ID NO: 1011886 - DNA, 22 bp, Artificial Sequence
  chemically synthesized
atagttgtagaatcttgtgaaa

SEQ ID NO: 1011887 - DNA, 22 bp, Artificial Sequence
  chemically synthesized
aatagttgtagaatcttgtgaa

SEQ ID NO: 1011888 - DNA, 22 bp, Artificial Sequence
  chemically synthesized
gcttaatagttgtagaatcttg

SEQ ID NO: 1011889 - DNA, 22 bp, Artificial Sequence
  chemically synthesized
agatattttcacaagattctac

SEQ ID NO: 1011890 - DNA, 22 bp, Artificial Sequence
  chemically synthesized
agcttaatagttgtagaatctt

SEQ ID NO: 1011891 - DNA, 22 bp, Artificial Sequence
  chemically synthesized
tagcttaatagttgtagaatct

SEQ ID NO: 1011892 - DNA, 22 bp, Artificial Sequence
  chemically synthesized
tcacaagattctacaactatta

SEQ ID NO: 1011893 - DNA, 22 bp, Artificial Sequence
  chemically synthesized
cacaagattctacaactattaa

SEQ ID NO: 1011894 - DNA, 22 bp, Artificial Sequence
  chemically synthesized
acaagattctacaactattaag

SEQ ID NO: 1011895 - DNA, 22 bp, Artificial Sequence
  chemically synthesized
aaatcccaggtcctttagctta

SEQ ID NO: 1011896 - DNA, 22 bp, Artificial Sequence
  chemically synthesized
tacaactattaagctaaaggac

SEQ ID NO: 1011897 - DNA, 22 bp, Artificial Sequence
  chemically synthesized
caactattaagctaaaggacct

SEQ ID NO: 1011898 - DNA, 22 bp, Artificial Sequence
  chemically synthesized
gattcaaatcccaggtccttta

SEQ ID NO: 1011899 - DNA, 22 bp, Artificial Sequence
  chemically synthesized
ttaagctaaaggacctgggatt

SEQ ID NO: 1011900 - DNA, 22 bp, Artificial Sequence
  chemically synthesized
agctaaaggacctgggatttga

SEQ ID NO: 1011901 - DNA, 22 bp, Artificial Sequence
  chemically synthesized
agaaagattggattcaaatccc

SEQ ID NO: 1011902 - DNA, 22 bp, Artificial Sequence
  chemically synthesized
aaggacctgggatttgaatcca

SEQ ID NO: 1011903 - DNA, 22 bp, Artificial Sequence
  chemically synthesized
gactcagaaagattggattcaa

SEQ ID NO: 1011904 - DNA, 22 bp, Artificial Sequence
  chemically synthesized
aatgctggactcagaaagattg

SEQ ID NO: 1011905 - DNA, 22 bp, Artificial Sequence
  chemically synthesized
ggatttgaatccaatctttctg

SEQ ID NO: 1011906 - DNA, 22 bp, Artificial Sequence
  chemically synthesized
gaatccaatctttctgagtcca

SEQ ID NO: 1011907 - DNA, 22 bp, Artificial Sequence
  chemically synthesized
aatccaatctttctgagtccag

SEQ ID NO: 1011908 - DNA, 22 bp, Artificial Sequence
  chemically synthesized
agtggttaaatgctggactcag

SEQ ID NO: 1011909 - DNA, 22 bp, Artificial Sequence
  chemically synthesized
tctgagtccagcatttaaccac

SEQ ID NO: 1011910 - DNA, 22 bp, Artificial Sequence
  chemically synthesized
ctgagtccagcatttaaccact

SEQ ID NO: 1011911 - DNA, 22 bp, Artificial Sequence
  chemically synthesized
gaaagggggttaagtggttaaa

SEQ ID NO: 1011912 - DNA, 22 bp, Artificial Sequence
  chemically synthesized
tgagtccagcatttaaccactt

SEQ ID NO: 1011913 - DNA, 22 bp, Artificial Sequence
  chemically synthesized
agaaagggggttaagtggttaa

SEQ ID NO: 1011914 - DNA, 22 bp, Artificial Sequence
  chemically synthesized
agtccagcatttaaccacttaa

SEQ ID NO: 1011915 - DNA, 22 bp, Artificial Sequence
  chemically synthesized
atagaagtttagaaagggggtt

SEQ ID NO: 1011916 - DNA, 22 bp, Artificial Sequence
  chemically synthesized
taatagaagtttagaaaggggg

SEQ ID NO: 1011917 - DNA, 22 bp, Artificial Sequence
  chemically synthesized
aaccacttaaccccctttctaa

SEQ ID NO: 1011918 - DNA, 22 bp, Artificial Sequence
  chemically synthesized
accacttaaccccctttctaaa

SEQ ID NO: 1011919 - DNA, 22 bp, Artificial Sequence
  chemically synthesized
aaccccctttctaaacttctat

SEQ ID NO: 1011920 - DNA, 22 bp, Artificial Sequence
  chemically synthesized
accccctttctaaacttctatt

SEQ ID NO: 1011921 - DNA, 22 bp, Artificial Sequence
  chemically synthesized
tctaaacttctattagagcctc

SEQ ID NO: 1011922 - DNA, 22 bp, Artificial Sequence
  chemically synthesized
ctaaacttctattagagcctca

SEQ ID NO: 1011923 - DNA, 22 bp, Artificial Sequence
  chemically synthesized
taaacttctattagagcctcat

SEQ ID NO: 1011924 - DNA, 22 bp, Artificial Sequence
  chemically synthesized
aacttctattagagcctcatgt

SEQ ID NO: 1011925 - DNA, 22 bp, Artificial Sequence
  chemically synthesized
ctattagagcctcatgtggatt

SEQ ID NO: 1011926 - DNA, 22 bp, Artificial Sequence
  chemically synthesized
tattagagcctcatgtggattg

SEQ ID NO: 1011927 - DNA, 22 bp, Artificial Sequence
  chemically synthesized
ttagagcctcatgtggattgtc

SEQ ID NO: 1011928 - DNA, 22 bp, Artificial Sequence
  chemically synthesized
gagcctcatgtggattgtcact

SEQ ID NO: 1011929 - DNA, 22 bp, Artificial Sequence
  chemically synthesized
tcatccaccaaaacagtgacaa

SEQ ID NO: 1011930 - DNA, 22 bp, Artificial Sequence
  chemically synthesized
atcatccaccaaaacagtgaca

SEQ ID NO: 1011931 - DNA, 22 bp, Artificial Sequence
  chemically synthesized
tatcatccaccaaaacagtgac

SEQ ID NO: 1011932 - DNA, 22 bp, Artificial Sequence
  chemically synthesized
atgtggattgtcactgttttgg

SEQ ID NO: 1011933 - DNA, 22 bp, Artificial Sequence
  chemically synthesized
tcactgttttggtggatgataa

SEQ ID NO: 1011934 - DNA, 22 bp, Artificial Sequence
  chemically synthesized
agtgcatatacaaagttttatc

SEQ ID NO: 1011935 - DNA, 22 bp, Artificial Sequence
  chemically synthesized
ttttggtggatgataaaacttt

SEQ ID NO: 1011936 - DNA, 22 bp, Artificial Sequence
  chemically synthesized
tggtggatgataaaactttgta

SEQ ID NO: 1011937 - DNA, 22 bp, Artificial Sequence
  chemically synthesized
ggtggatgataaaactttgtat

SEQ ID NO: 1011938 - DNA, 22 bp, Artificial Sequence
  chemically synthesized
gtggatgataaaactttgtata

SEQ ID NO: 1011939 - DNA, 22 bp, Artificial Sequence
  chemically synthesized
aacaagcagtaattgagtgcat

SEQ ID NO: 1011940 - DNA, 22 bp, Artificial Sequence
  chemically synthesized
actaaacaagcagtaattgagt

SEQ ID NO: 1011941 - DNA, 22 bp, Artificial Sequence
  chemically synthesized
tgtatatgcactcaattactgc

SEQ ID NO: 1011942 - DNA, 22 bp, Artificial Sequence
  chemically synthesized
gtatatgcactcaattactgct

SEQ ID NO: 1011943 - DNA, 22 bp, Artificial Sequence
  chemically synthesized
tatatgcactcaattactgctt

SEQ ID NO: 1011944 - DNA, 22 bp, Artificial Sequence
  chemically synthesized
atgcattcactaaacaagcagt

SEQ ID NO: 1011945 - DNA, 22 bp, Artificial Sequence
  chemically synthesized
aatgcattcactaaacaagcag

SEQ ID NO: 1011946 - DNA, 22 bp, Artificial Sequence
  chemically synthesized
ttaatgcattcactaaacaagc

SEQ ID NO: 1011947 - DNA, 22 bp, Artificial Sequence
  chemically synthesized
aattactgcttgtttagtgaat

SEQ ID NO: 1011948 - DNA, 22 bp, Artificial Sequence
  chemically synthesized
ctgcttgtttagtgaatgcatt

SEQ ID NO: 1011949 - DNA, 22 bp, Artificial Sequence
  chemically synthesized
cttgtttagtgaatgcattaag

SEQ ID NO: 1011950 - DNA, 22 bp, Artificial Sequence
  chemically synthesized
gtttagtgaatgcattaagaga

SEQ ID NO: 1011951 - DNA, 22 bp, Artificial Sequence
  chemically synthesized
tttagtgaatgcattaagagat

SEQ ID NO: 1011952 - DNA, 22 bp, Artificial Sequence
  chemically synthesized
aatgatatcagcatctcttaat

SEQ ID NO: 1011953 - DNA, 22 bp, Artificial Sequence
  chemically synthesized
agtgaatgcattaagagatgct

SEQ ID NO: 1011954 - DNA, 22 bp, Artificial Sequence
  chemically synthesized
gtgaatgcattaagagatgctg

SEQ ID NO: 1011955 - DNA, 22 bp, Artificial Sequence
  chemically synthesized
gttgaatgatatcagcatctct

SEQ ID NO: 1011956 - DNA, 22 bp, Artificial Sequence
  chemically synthesized
aattcgttgaatgatatcagca

SEQ ID NO: 1011957 - DNA, 22 bp, Artificial Sequence
  chemically synthesized
ttaaattcgttgaatgatatca

SEQ ID NO: 1011958 - DNA, 22 bp, Artificial Sequence
  chemically synthesized
attaaattcgttgaatgatatc

SEQ ID NO: 1011959 - DNA, 22 bp, Artificial Sequence
  chemically synthesized
agagatgctgatatcattcaac

SEQ ID NO: 1011960 - DNA, 22 bp, Artificial Sequence
  chemically synthesized
gtttattaaattcgttgaatga

SEQ ID NO: 1011961 - DNA, 22 bp, Artificial Sequence
  chemically synthesized
aaattggtttattaaattcgtt

SEQ ID NO: 1011962 - DNA, 22 bp, Artificial Sequence
  chemically synthesized
atatcattcaacgaatttaata

SEQ ID NO: 1011963 - DNA, 22 bp, Artificial Sequence
  chemically synthesized
tatgccactcaaattggtttat

SEQ ID NO: 1011964 - DNA, 22 bp, Artificial Sequence
  chemically synthesized
aacgaatttaataaaccaattt

SEQ ID NO: 1011965 - DNA, 22 bp, Artificial Sequence
  chemically synthesized
atcatgttatatgccactcaaa

SEQ ID NO: 1011966 - DNA, 22 bp, Artificial Sequence
  chemically synthesized
aataaaccaatttgagtggcat

SEQ ID NO: 1011967 - DNA, 22 bp, Artificial Sequence
  chemically synthesized
ataaaccaatttgagtggcata

SEQ ID NO: 1011968 - DNA, 22 bp, Artificial Sequence
  chemically synthesized
agaaaaatattgatcatgttat

SEQ ID NO: 1011969 - DNA, 22 bp, Artificial Sequence
  chemically synthesized
gagtggcatataacatgatcaa

SEQ ID NO: 1011970 - DNA, 22 bp, Artificial Sequence
  chemically synthesized
agtggcatataacatgatcaat

SEQ ID NO: 1011971 - DNA, 22 bp, Artificial Sequence
  chemically synthesized
cctgagaaaaatattgatcatg

SEQ ID NO: 1011972 - DNA, 22 bp, Artificial Sequence
  chemically synthesized
acctgagaaaaatattgatcat

SEQ ID NO: 1011973 - DNA, 22 bp, Artificial Sequence
  chemically synthesized
tacctgagaaaaatattgatca

SEQ ID NO: 1011974 - DNA, 22 bp, Artificial Sequence
  chemically synthesized
ttacctgagaaaaatattgatc

SEQ ID NO: 1011975 - DNA, 22 bp, Artificial Sequence
  chemically synthesized
tttacctgagaaaaatattgat

SEQ ID NO: 1011976 - DNA, 22 bp, Artificial Sequence
  chemically synthesized
ttttacctgagaaaaatattga

SEQ ID NO: 1011977 - DNA, 22 bp, Artificial Sequence
  chemically synthesized
aaaatatcccatttttttacct

SEQ ID NO: 1011978 - DNA, 22 bp, Artificial Sequence
  chemically synthesized
taaaaatatcccatttttttac

SEQ ID NO: 1011979 - DNA, 22 bp, Artificial Sequence
  chemically synthesized
tctaaaaatatcccattttttt

SEQ ID NO: 1011980 - DNA, 22 bp, Artificial Sequence
  chemically synthesized
ttctcaggtaaaaaaatgggat

SEQ ID NO: 1011981 - DNA, 22 bp, Artificial Sequence
  chemically synthesized
tctcaggtaaaaaaatgggata

SEQ ID NO: 1011982 - DNA, 22 bp, Artificial Sequence
  chemically synthesized
ctcaggtaaaaaaatgggatat

SEQ ID NO: 1011983 - DNA, 22 bp, Artificial Sequence
  chemically synthesized
tcaggtaaaaaaatgggatatt

SEQ ID NO: 1011984 - DNA, 22 bp, Artificial Sequence
  chemically synthesized
aggtaaaaaaatgggatatttt

SEQ ID NO: 1011985 - DNA, 22 bp, Artificial Sequence
  chemically synthesized
tggagaacctctctaaaaatat

SEQ ID NO: 1011986 - DNA, 22 bp, Artificial Sequence
  chemically synthesized
ttagagaggttctccatagtgg

SEQ ID NO: 1011987 - DNA, 22 bp, Artificial Sequence
  chemically synthesized
tagagaggttctccatagtggc

SEQ ID NO: 1011988 - DNA, 22 bp, Artificial Sequence
  chemically synthesized
agagaggttctccatagtggca

SEQ ID NO: 1011989 - DNA, 22 bp, Artificial Sequence
  chemically synthesized
gagaggttctccatagtggcat

SEQ ID NO: 1011990 - DNA, 22 bp, Artificial Sequence
  chemically synthesized
cagagcaatataccatgccact

SEQ ID NO: 1011991 - DNA, 22 bp, Artificial Sequence
  chemically synthesized
tccatagtggcatggtatattg

SEQ ID NO: 1011992 - DNA, 22 bp, Artificial Sequence
  chemically synthesized
catagtggcatggtatattgct

SEQ ID NO: 1011993 - DNA, 22 bp, Artificial Sequence
  chemically synthesized
aagatattccagagcaatatac

SEQ ID NO: 1011994 - DNA, 22 bp, Artificial Sequence
  chemically synthesized
gaagatattccagagcaatata

SEQ ID NO: 1011995 - DNA, 22 bp, Artificial Sequence
  chemically synthesized
tgaagatattccagagcaatat

SEQ ID NO: 1011996 - DNA, 22 bp, Artificial Sequence
  chemically synthesized
ttgaagatattccagagcaata

SEQ ID NO: 1011997 - DNA, 22 bp, Artificial Sequence
  chemically synthesized
tttgaagatattccagagcaat

SEQ ID NO: 1011998 - DNA, 22 bp, Artificial Sequence
  chemically synthesized
gtgctttttgaagatattccag

SEQ ID NO: 1011999 - DNA, 22 bp, Artificial Sequence
  chemically synthesized
ctctggaatatcttcaaaaagc

SEQ ID NO: 1012000 - DNA, 22 bp, Artificial Sequence
  chemically synthesized
tggaatatcttcaaaaagcact

SEQ ID NO: 1012001 - DNA, 22 bp, Artificial Sequence
  chemically synthesized
agtacatgaattagtgcttttt

SEQ ID NO: 1012002 - DNA, 22 bp, Artificial Sequence
  chemically synthesized
gaatatcttcaaaaagcactaa

SEQ ID NO: 1012003 - DNA, 22 bp, Artificial Sequence
  chemically synthesized
caaaaagcactaattcatgtac

SEQ ID NO: 1012004 - DNA, 22 bp, Artificial Sequence
  chemically synthesized
aaaaagcactaattcatgtact

SEQ ID NO: 1012005 - DNA, 22 bp, Artificial Sequence
  chemically synthesized
tcgcaagtaaaagacaaaatta

SEQ ID NO: 1012006 - DNA, 22 bp, Artificial Sequence
  chemically synthesized
attcatgtacttaattttgtct

SEQ ID NO: 1012007 - DNA, 22 bp, Artificial Sequence
  chemically synthesized
tgtcgcaagtaaaagacaaaat

SEQ ID NO: 1012008 - DNA, 22 bp, Artificial Sequence
  chemically synthesized
atgtacttaattttgtctttta

SEQ ID NO: 1012009 - DNA, 22 bp, Artificial Sequence
  chemically synthesized
ctctgtcgcaagtaaaagacaa

SEQ ID NO: 1012010 - DNA, 22 bp, Artificial Sequence
  chemically synthesized
cctctgtcgcaagtaaaagaca

SEQ ID NO: 1012011 - DNA, 22 bp, Artificial Sequence
  chemically synthesized
tcctctgtcgcaagtaaaagac

SEQ ID NO: 1012012 - DNA, 22 bp, Artificial Sequence
  chemically synthesized
ttcctctgtcgcaagtaaaaga

SEQ ID NO: 1012013 - DNA, 22 bp, Artificial Sequence
  chemically synthesized
tttcctctgtcgcaagtaaaag

SEQ ID NO: 1012014 - DNA, 22 bp, Artificial Sequence
  chemically synthesized
ttttcctctgtcgcaagtaaaa

SEQ ID NO: 1012015 - DNA, 22 bp, Artificial Sequence
  chemically synthesized
tttttcctctgtcgcaagtaaa

SEQ ID NO: 1012016 - DNA, 22 bp, Artificial Sequence
  chemically synthesized
aattttgtcttttacttgcgac

SEQ ID NO: 1012017 - DNA, 22 bp, Artificial Sequence
  chemically synthesized
attttgtcttttacttgcgaca

SEQ ID NO: 1012018 - DNA, 22 bp, Artificial Sequence
  chemically synthesized
ttttttttcctctgtcgcaagt

SEQ ID NO: 1012019 - DNA, 22 bp, Artificial Sequence
  chemically synthesized
tattttttttcctctgtcgcaa

SEQ ID NO: 1012020 - DNA, 22 bp, Artificial Sequence
  chemically synthesized
tgtcttttacttgcgacagagg

SEQ ID NO: 1012021 - DNA, 22 bp, Artificial Sequence
  chemically synthesized
gtcttttacttgcgacagagga

SEQ ID NO: 1012022 - DNA, 22 bp, Artificial Sequence
  chemically synthesized
tcttttacttgcgacagaggaa

SEQ ID NO: 1012023 - DNA, 22 bp, Artificial Sequence
  chemically synthesized
ttacttgcgacagaggaaaaaa

SEQ ID NO: 1012024 - DNA, 22 bp, Artificial Sequence
  chemically synthesized
tacttgcgacagaggaaaaaaa

SEQ ID NO: 1012025 - DNA, 22 bp, Artificial Sequence
  chemically synthesized
acttgcgacagaggaaaaaaaa

SEQ ID NO: 1012026 - DNA, 22 bp, Artificial Sequence
  chemically synthesized
catgcaactctattttttttcc

SEQ ID NO: 1012027 - DNA, 22 bp, Artificial Sequence
  chemically synthesized
cttgcgacagaggaaaaaaaat

SEQ ID NO: 1012028 - DNA, 22 bp, Artificial Sequence
  chemically synthesized
gcgacagaggaaaaaaaataga

SEQ ID NO: 1012029 - DNA, 22 bp, Artificial Sequence
  chemically synthesized
gttccatgcaactctatttttt

SEQ ID NO: 1012030 - DNA, 22 bp, Artificial Sequence
  chemically synthesized
cgacagaggaaaaaaaatagag

SEQ ID NO: 1012031 - DNA, 22 bp, Artificial Sequence
  chemically synthesized
ccaatagcagtagaaagataat

SEQ ID NO: 1012032 - DNA, 22 bp, Artificial Sequence
  chemically synthesized
catggaaccagattatctttct

SEQ ID NO: 1012033 - DNA, 22 bp, Artificial Sequence
  chemically synthesized
actgccaatagcagtagaaaga

SEQ ID NO: 1012034 - DNA, 22 bp, Artificial Sequence
  chemically synthesized
aaaatatactgactgccaatag

SEQ ID NO: 1012035 - DNA, 22 bp, Artificial Sequence
  chemically synthesized
tctttctactgctattggcagt

SEQ ID NO: 1012036 - DNA, 22 bp, Artificial Sequence
  chemically synthesized
tctactgctattggcagtcagt

SEQ ID NO: 1012037 - DNA, 22 bp, Artificial Sequence
  chemically synthesized
ctactgctattggcagtcagta

SEQ ID NO: 1012038 - DNA, 22 bp, Artificial Sequence
  chemically synthesized
tcattcaaaatatactgactgc

SEQ ID NO: 1012039 - DNA, 22 bp, Artificial Sequence
  chemically synthesized
tactgctattggcagtcagtat

SEQ ID NO: 1012040 - DNA, 22 bp, Artificial Sequence
  chemically synthesized
ctgctattggcagtcagtatat

SEQ ID NO: 1012041 - DNA, 22 bp, Artificial Sequence
  chemically synthesized
ctattggcagtcagtatatttt

SEQ ID NO: 1012042 - DNA, 22 bp, Artificial Sequence
  chemically synthesized
gtgttatcattcaaaatatact

SEQ ID NO: 1012043 - DNA, 22 bp, Artificial Sequence
  chemically synthesized
agtgttatcattcaaaatatac

SEQ ID NO: 1012044 - DNA, 22 bp, Artificial Sequence
  chemically synthesized
ttggcagtcagtatattttgaa

SEQ ID NO: 1012045 - DNA, 22 bp, Artificial Sequence
  chemically synthesized
gcagtcagtatattttgaatga

SEQ ID NO: 1012046 - DNA, 22 bp, Artificial Sequence
  chemically synthesized
agacttagtgttatcattcaaa

SEQ ID NO: 1012047 - DNA, 22 bp, Artificial Sequence
  chemically synthesized
actgagacttagtgttatcatt

SEQ ID NO: 1012048 - DNA, 22 bp, Artificial Sequence
  chemically synthesized
aactgagacttagtgttatcat

SEQ ID NO: 1012049 - DNA, 22 bp, Artificial Sequence
  chemically synthesized
taactgagacttagtgttatca

SEQ ID NO: 1012050 - DNA, 22 bp, Artificial Sequence
  chemically synthesized
gtgctttaactgagacttagtg

SEQ ID NO: 1012051 - DNA, 22 bp, Artificial Sequence
  chemically synthesized
agtgctttaactgagacttagt

SEQ ID NO: 1012052 - DNA, 22 bp, Artificial Sequence
  chemically synthesized
tgaatgataacactaagtctca

SEQ ID NO: 1012053 - DNA, 22 bp, Artificial Sequence
  chemically synthesized
gaatgataacactaagtctcag

SEQ ID NO: 1012054 - DNA, 22 bp, Artificial Sequence
  chemically synthesized
aatgataacactaagtctcagt

SEQ ID NO: 1012055 - DNA, 22 bp, Artificial Sequence
  chemically synthesized
aagaagagaatttagtgcttta

SEQ ID NO: 1012056 - DNA, 22 bp, Artificial Sequence
  chemically synthesized
aaagaagagaatttagtgcttt

SEQ ID NO: 1012057 - DNA, 22 bp, Artificial Sequence
  chemically synthesized
taaagaagagaatttagtgctt

SEQ ID NO: 1012058 - DNA, 22 bp, Artificial Sequence
  chemically synthesized
agtctcagttaaagcactaaat

SEQ ID NO: 1012059 - DNA, 22 bp, Artificial Sequence
  chemically synthesized
actttaaagaagagaatttagt

SEQ ID NO: 1012060 - DNA, 22 bp, Artificial Sequence
  chemically synthesized
cactttaaagaagagaatttag

SEQ ID NO: 1012061 - DNA, 22 bp, Artificial Sequence
  chemically synthesized
tcactttaaagaagagaattta

SEQ ID NO: 1012062 - DNA, 22 bp, Artificial Sequence
  chemically synthesized
agttaaagcactaaattctctt

SEQ ID NO: 1012063 - DNA, 22 bp, Artificial Sequence
  chemically synthesized
ttcactttaaagaagagaattt

SEQ ID NO: 1012064 - DNA, 22 bp, Artificial Sequence
  chemically synthesized
tttcactttaaagaagagaatt

SEQ ID NO: 1012065 - DNA, 22 bp, Artificial Sequence
  chemically synthesized
ttttcactttaaagaagagaat

SEQ ID NO: 1012066 - DNA, 22 bp, Artificial Sequence
  chemically synthesized
aagcactaaattctcttcttta

SEQ ID NO: 1012067 - DNA, 22 bp, Artificial Sequence
  chemically synthesized
catcatatttttttcactttaa

SEQ ID NO: 1012068 - DNA, 22 bp, Artificial Sequence
  chemically synthesized
aattctcttctttaaagtgaaa

SEQ ID NO: 1012069 - DNA, 22 bp, Artificial Sequence
  chemically synthesized
tcttctttaaagtgaaaaaaat

SEQ ID NO: 1012070 - DNA, 22 bp, Artificial Sequence
  chemically synthesized
ttctttaaagtgaaaaaaatat

SEQ ID NO: 1012071 - DNA, 22 bp, Artificial Sequence
  chemically synthesized
atcaaattgcatcatatttttt

SEQ ID NO: 1012072 - DNA, 22 bp, Artificial Sequence
  chemically synthesized
ctttaaagtgaaaaaaatatga

SEQ ID NO: 1012073 - DNA, 22 bp, Artificial Sequence
  chemically synthesized
gatcaaattgcatcatattttt

SEQ ID NO: 1012074 - DNA, 22 bp, Artificial Sequence
  chemically synthesized
tttaaagtgaaaaaaatatgat

SEQ ID NO: 1012075 - DNA, 22 bp, Artificial Sequence
  chemically synthesized
tgatcaaattgcatcatatttt

SEQ ID NO: 1012076 - DNA, 22 bp, Artificial Sequence
  chemically synthesized
taaagtgaaaaaaatatgatgc

SEQ ID NO: 1012077 - DNA, 22 bp, Artificial Sequence
  chemically synthesized
aaagtgaaaaaaatatgatgca

SEQ ID NO: 1012078 - DNA, 22 bp, Artificial Sequence
  chemically synthesized
aagtgaaaaaaatatgatgcaa

SEQ ID NO: 1012079 - DNA, 22 bp, Artificial Sequence
  chemically synthesized
tgtattttgatcaaattgcatc

SEQ ID NO: 1012080 - DNA, 22 bp, Artificial Sequence
  chemically synthesized
tccctatgtattttgatcaaat

SEQ ID NO: 1012081 - DNA, 22 bp, Artificial Sequence
  chemically synthesized
gtccctatgtattttgatcaaa

SEQ ID NO: 1012082 - DNA, 22 bp, Artificial Sequence
  chemically synthesized
taaacttgtccctatgtatttt

SEQ ID NO: 1012083 - DNA, 22 bp, Artificial Sequence
  chemically synthesized
gatcaaaatacatagggacaag

SEQ ID NO: 1012084 - DNA, 22 bp, Artificial Sequence
  chemically synthesized
atcaaaatacatagggacaagt

SEQ ID NO: 1012085 - DNA, 22 bp, Artificial Sequence
  chemically synthesized
gatatgaaataaacaaatagat

SEQ ID NO: 1012086 - DNA, 22 bp, Artificial Sequence
  chemically synthesized
agatatgaaataaacaaataga

SEQ ID NO: 1012087 - DNA, 22 bp, Artificial Sequence
  chemically synthesized
tagatatgaaataaacaaatag

SEQ ID NO: 1012088 - DNA, 22 bp, Artificial Sequence
  chemically synthesized
acaacatatatctatttgttta

SEQ ID NO: 1012089 - DNA, 22 bp, Artificial Sequence
  chemically synthesized
ttagatatgaaataaacaaata

SEQ ID NO: 1012090 - DNA, 22 bp, Artificial Sequence
  chemically synthesized
caacatatatctatttgtttat

SEQ ID NO: 1012091 - DNA, 22 bp, Artificial Sequence
  chemically synthesized
tttgtttatttcatatctaaaa

SEQ ID NO: 1012092 - DNA, 22 bp, Artificial Sequence
  chemically synthesized
agtaaagaaataacttttagat

SEQ ID NO: 1012093 - DNA, 22 bp, Artificial Sequence
  chemically synthesized
gtttatttcatatctaaaagtt

SEQ ID NO: 1012094 - DNA, 22 bp, Artificial Sequence
  chemically synthesized
cagtaaagaaataacttttaga

SEQ ID NO: 1012095 - DNA, 22 bp, Artificial Sequence
  chemically synthesized
tttatttcatatctaaaagtta

SEQ ID NO: 1012096 - DNA, 22 bp, Artificial Sequence
  chemically synthesized
tcagtaaagaaataacttttag

SEQ ID NO: 1012097 - DNA, 22 bp, Artificial Sequence
  chemically synthesized
atttcatatctaaaagttattt

SEQ ID NO: 1012098 - DNA, 22 bp, Artificial Sequence
  chemically synthesized
tttcatatctaaaagttatttc

SEQ ID NO: 1012099 - DNA, 22 bp, Artificial Sequence
  chemically synthesized
catatctaaaagttatttcttt

SEQ ID NO: 1012100 - DNA, 22 bp, Artificial Sequence
  chemically synthesized
atatctaaaagttatttcttta

SEQ ID NO: 1012101 - DNA, 22 bp, Artificial Sequence
  chemically synthesized
atatgtacaattttcagtaaag

SEQ ID NO: 1012102 - DNA, 22 bp, Artificial Sequence
  chemically synthesized
aaagttatttctttactgaaaa

SEQ ID NO: 1012103 - DNA, 22 bp, Artificial Sequence
  chemically synthesized
aagcctcatatgtacaattttc

SEQ ID NO: 1012104 - DNA, 22 bp, Artificial Sequence
  chemically synthesized
tttctttactgaaaattgtaca

SEQ ID NO: 1012105 - DNA, 22 bp, Artificial Sequence
  chemically synthesized
ctttactgaaaattgtacatat

SEQ ID NO: 1012106 - DNA, 22 bp, Artificial Sequence
  chemically synthesized
tttactgaaaattgtacatatg

SEQ ID NO: 1012107 - DNA, 22 bp, Artificial Sequence
  chemically synthesized
gagtctgaagcctcatatgtac

SEQ ID NO: 1012108 - DNA, 22 bp, Artificial Sequence
  chemically synthesized
tactgaaaattgtacatatgag

SEQ ID NO: 1012109 - DNA, 22 bp, Artificial Sequence
  chemically synthesized
actgaaaattgtacatatgagg

SEQ ID NO: 1012110 - DNA, 22 bp, Artificial Sequence
  chemically synthesized
ctgaaaattgtacatatgaggc

SEQ ID NO: 1012111 - DNA, 22 bp, Artificial Sequence
  chemically synthesized
aaaattgtacatatgaggcttc

SEQ ID NO: 1012112 - DNA, 22 bp, Artificial Sequence
  chemically synthesized
tacatatgaggcttcagactcc

SEQ ID NO: 1012113 - DNA, 22 bp, Artificial Sequence
  chemically synthesized
aacaaacacacgcagaagcacg

SEQ ID NO: 1012114 - DNA, 22 bp, Artificial Sequence
  chemically synthesized
cagactccaacgtgcttctgcg

SEQ ID NO: 1012115 - DNA, 22 bp, Artificial Sequence
  chemically synthesized
agactccaacgtgcttctgcgt

SEQ ID NO: 1012116 - DNA, 22 bp, Artificial Sequence
  chemically synthesized
caacgtgcttctgcgtgtgttt

SEQ ID NO: 1012117 - DNA, 22 bp, Artificial Sequence
  chemically synthesized
ctgcgtgtgtttgtttaatata

SEQ ID NO: 1012118 - DNA, 22 bp, Artificial Sequence
  chemically synthesized
tgcgtgtgtttgtttaatatat

SEQ ID NO: 1012119 - DNA, 22 bp, Artificial Sequence
  chemically synthesized
cgtgtgtttgtttaatatatgg

SEQ ID NO: 1012120 - DNA, 22 bp, Artificial Sequence
  chemically synthesized
gtttaatatatgggctgcttgg

SEQ ID NO: 1012121 - DNA, 22 bp, Artificial Sequence
  chemically synthesized
tttaatatatgggctgcttggt

SEQ ID NO: 1012122 - DNA, 22 bp, Artificial Sequence
  chemically synthesized
tgaaaaaaatcaaccaagcagc

SEQ ID NO: 1012123 - DNA, 22 bp, Artificial Sequence
  chemically synthesized
aatatatgggctgcttggttga

SEQ ID NO: 1012124 - DNA, 22 bp, Artificial Sequence
  chemically synthesized
ctgtgaaaaaaatcaaccaagc

SEQ ID NO: 1012125 - DNA, 22 bp, Artificial Sequence
  chemically synthesized
atatatgggctgcttggttgat

SEQ ID NO: 1012126 - DNA, 22 bp, Artificial Sequence
  chemically synthesized
cttggttgatttttttcacagt

SEQ ID NO: 1012127 - DNA, 22 bp, Artificial Sequence
  chemically synthesized
ggttgatttttttcacagtaac

SEQ ID NO: 1012128 - DNA, 22 bp, Artificial Sequence
  chemically synthesized
gttgatttttttcacagtaacc

SEQ ID NO: 1012129 - DNA, 22 bp, Artificial Sequence
  chemically synthesized
gcatgagccagtaatggttact

SEQ ID NO: 1012130 - DNA, 22 bp, Artificial Sequence
  chemically synthesized
atttttttcacagtaaccatta

SEQ ID NO: 1012131 - DNA, 22 bp, Artificial Sequence
  chemically synthesized
ggcatgagccagtaatggttac

SEQ ID NO: 1012132 - DNA, 22 bp, Artificial Sequence
  chemically synthesized
tttggcatgagccagtaatggt

SEQ ID NO: 1012133 - DNA, 22 bp, Artificial Sequence
  chemically synthesized
ttttcacagtaaccattactgg

SEQ ID NO: 1012134 - DNA, 22 bp, Artificial Sequence
  chemically synthesized
tttcacagtaaccattactggc

SEQ ID NO: 1012135 - DNA, 22 bp, Artificial Sequence
  chemically synthesized
ttcacagtaaccattactggct

SEQ ID NO: 1012136 - DNA, 22 bp, Artificial Sequence
  chemically synthesized
tcacagtaaccattactggctc

SEQ ID NO: 1012137 - DNA, 22 bp, Artificial Sequence
  chemically synthesized
cacagtaaccattactggctca

SEQ ID NO: 1012138 - DNA, 22 bp, Artificial Sequence
  chemically synthesized
acagtaaccattactggctcat

SEQ ID NO: 1012139 - DNA, 22 bp, Artificial Sequence
  chemically synthesized
gcaggcaattgtttggcatgag

SEQ ID NO: 1012140 - DNA, 22 bp, Artificial Sequence
  chemically synthesized
ttagcaggcaattgtttggcat

SEQ ID NO: 1012141 - DNA, 22 bp, Artificial Sequence
  chemically synthesized
ctggctcatgccaaacaattgc

SEQ ID NO: 1012142 - DNA, 22 bp, Artificial Sequence
  chemically synthesized
gctcatgccaaacaattgcctg

SEQ ID NO: 1012143 - DNA, 22 bp, Artificial Sequence
  chemically synthesized
atgccaaacaattgcctgctaa

SEQ ID NO: 1012144 - DNA, 22 bp, Artificial Sequence
  chemically synthesized
gaagacaggatgtagacagtgg

SEQ ID NO: 1012145 - DNA, 22 bp, Artificial Sequence
  chemically synthesized
cctgctaacagccactgtctac

SEQ ID NO: 1012146 - DNA, 22 bp, Artificial Sequence
  chemically synthesized
agaagacaggatgtagacagtg

SEQ ID NO: 1012147 - DNA, 22 bp, Artificial Sequence
  chemically synthesized
tagaagacaggatgtagacagt

SEQ ID NO: 1012148 - DNA, 22 bp, Artificial Sequence
  chemically synthesized
ctaacagccactgtctacatcc

SEQ ID NO: 1012149 - DNA, 22 bp, Artificial Sequence
  chemically synthesized
ttttagaagacaggatgtagac

SEQ ID NO: 1012150 - DNA, 22 bp, Artificial Sequence
  chemically synthesized
acagccactgtctacatcctgt

SEQ ID NO: 1012151 - DNA, 22 bp, Artificial Sequence
  chemically synthesized
tgaaattattttagaagacagg

SEQ ID NO: 1012152 - DNA, 22 bp, Artificial Sequence
  chemically synthesized
ctatgaaattattttagaagac

SEQ ID NO: 1012153 - DNA, 22 bp, Artificial Sequence
  chemically synthesized
actatgaaattattttagaaga

SEQ ID NO: 1012154 - DNA, 22 bp, Artificial Sequence
  chemically synthesized
tctacatcctgtcttctaaaat

SEQ ID NO: 1012155 - DNA, 22 bp, Artificial Sequence
  chemically synthesized
catcctgtcttctaaaataatt

SEQ ID NO: 1012156 - DNA, 22 bp, Artificial Sequence
  chemically synthesized
aatatttactatgaaattattt

SEQ ID NO: 1012157 - DNA, 22 bp, Artificial Sequence
  chemically synthesized
caatatttactatgaaattatt

SEQ ID NO: 1012158 - DNA, 22 bp, Artificial Sequence
  chemically synthesized
tcttctaaaataatttcatagt

SEQ ID NO: 1012159 - DNA, 22 bp, Artificial Sequence
  chemically synthesized
ctaaaataatttcatagtaaat

SEQ ID NO: 1012160 - DNA, 22 bp, Artificial Sequence
  chemically synthesized
taaaataatttcatagtaaata

SEQ ID NO: 1012161 - DNA, 22 bp, Artificial Sequence
  chemically synthesized
aaataatttcatagtaaatatt

SEQ ID NO: 1012162 - DNA, 22 bp, Artificial Sequence
  chemically synthesized
catagtaaatattgaaactcat

SEQ ID NO: 1012163 - DNA, 22 bp, Artificial Sequence
  chemically synthesized
atagtaaatattgaaactcatt

SEQ ID NO: 1012164 - DNA, 22 bp, Artificial Sequence
  chemically synthesized
ataatgaataagagaatgagtt

SEQ ID NO: 1012165 - DNA, 22 bp, Artificial Sequence
  chemically synthesized
actaataatgaataagagaatg

SEQ ID NO: 1012166 - DNA, 22 bp, Artificial Sequence
  chemically synthesized
attgactaataatgaataagag

SEQ ID NO: 1012167 - DNA, 22 bp, Artificial Sequence
  chemically synthesized
aaactcattctcttattcatta

SEQ ID NO: 1012168 - DNA, 22 bp, Artificial Sequence
  chemically synthesized
ttgattgactaataatgaataa

SEQ ID NO: 1012169 - DNA, 22 bp, Artificial Sequence
  chemically synthesized
gttgattgactaataatgaata

SEQ ID NO: 1012170 - DNA, 22 bp, Artificial Sequence
  chemically synthesized
tgttgattgactaataatgaat

SEQ ID NO: 1012171 - DNA, 22 bp, Artificial Sequence
  chemically synthesized
attctcttattcattattagtc

SEQ ID NO: 1012172 - DNA, 22 bp, Artificial Sequence
  chemically synthesized
gcctttgttgattgactaataa

SEQ ID NO: 1012173 - DNA, 22 bp, Artificial Sequence
  chemically synthesized
ggcctttgttgattgactaata

SEQ ID NO: 1012174 - DNA, 22 bp, Artificial Sequence
  chemically synthesized
tcttattcattattagtcaatc

SEQ ID NO: 1012175 - DNA, 22 bp, Artificial Sequence
  chemically synthesized
ttattcattattagtcaatcaa

SEQ ID NO: 1012176 - DNA, 22 bp, Artificial Sequence
  chemically synthesized
tcttggcctttgttgattgact

SEQ ID NO: 1012177 - DNA, 22 bp, Artificial Sequence
  chemically synthesized
attcattattagtcaatcaaca

SEQ ID NO: 1012178 - DNA, 22 bp, Artificial Sequence
  chemically synthesized
ttcattattagtcaatcaacaa

SEQ ID NO: 1012179 - DNA, 22 bp, Artificial Sequence
  chemically synthesized
ctatcttggcctttgttgattg

SEQ ID NO: 1012180 - DNA, 22 bp, Artificial Sequence
  chemically synthesized
tgctatcttggcctttgttgat

SEQ ID NO: 1012181 - DNA, 22 bp, Artificial Sequence
  chemically synthesized
attattagtcaatcaacaaagg

SEQ ID NO: 1012182 - DNA, 22 bp, Artificial Sequence
  chemically synthesized
ctgctatcttggcctttgttga

SEQ ID NO: 1012183 - DNA, 22 bp, Artificial Sequence
  chemically synthesized
ttagtcaatcaacaaaggccaa

SEQ ID NO: 1012184 - DNA, 22 bp, Artificial Sequence
  chemically synthesized
gtcaatcaacaaaggccaagat

SEQ ID NO: 1012185 - DNA, 22 bp, Artificial Sequence
  chemically synthesized
gtaatttctgctatcttggcct

SEQ ID NO: 1012186 - DNA, 22 bp, Artificial Sequence
  chemically synthesized
ggtaatttctgctatcttggcc

SEQ ID NO: 1012187 - DNA, 22 bp, Artificial Sequence
  chemically synthesized
tggtaatttctgctatcttggc

SEQ ID NO: 1012188 - DNA, 22 bp, Artificial Sequence
  chemically synthesized
atcgataaggcaaatcaaagct

SEQ ID NO: 1012189 - DNA, 22 bp, Artificial Sequence
  chemically synthesized
catcgataaggcaaatcaaagc

SEQ ID NO: 1012190 - DNA, 22 bp, Artificial Sequence
  chemically synthesized
ccaaagctttgatttgccttat

SEQ ID NO: 1012191 - DNA, 22 bp, Artificial Sequence
  chemically synthesized
tgatttgccttatcgatgaagg

SEQ ID NO: 1012192 - DNA, 22 bp, Artificial Sequence
  chemically synthesized
gatttgccttatcgatgaaggt

SEQ ID NO: 1012193 - DNA, 22 bp, Artificial Sequence
  chemically synthesized
atttgccttatcgatgaaggta

SEQ ID NO: 1012194 - DNA, 22 bp, Artificial Sequence
  chemically synthesized
gccttatcgatgaaggtatctt

SEQ ID NO: 1012195 - DNA, 22 bp, Artificial Sequence
  chemically synthesized
ccttatcgatgaaggtatctta

SEQ ID NO: 1012196 - DNA, 22 bp, Artificial Sequence
  chemically synthesized
atcgatgaaggtatcttacggg

SEQ ID NO: 1012197 - DNA, 22 bp, Artificial Sequence
  chemically synthesized
tcgatgaaggtatcttacgggg

SEQ ID NO: 1012198 - DNA, 22 bp, Artificial Sequence
  chemically synthesized
tcgtaaaatgggtaaaatcaac

SEQ ID NO: 1012199 - DNA, 22 bp, Artificial Sequence
  chemically synthesized
acggggttgattttacccattt

SEQ ID NO: 1012200 - DNA, 22 bp, Artificial Sequence
  chemically synthesized
cggggttgattttacccatttt

SEQ ID NO: 1012201 - DNA, 22 bp, Artificial Sequence
  chemically synthesized
agtaattatcgtaaaatgggta

SEQ ID NO: 1012202 - DNA, 22 bp, Artificial Sequence
  chemically synthesized
tgagtaattatcgtaaaatggg

SEQ ID NO: 1012203 - DNA, 22 bp, Artificial Sequence
  chemically synthesized
cattctgagtaattatcgtaaa

SEQ ID NO: 1012204 - DNA, 22 bp, Artificial Sequence
  chemically synthesized
attttacccattttacgataat

SEQ ID NO: 1012205 - DNA, 22 bp, Artificial Sequence
  chemically synthesized
ccattctgagtaattatcgtaa

SEQ ID NO: 1012206 - DNA, 22 bp, Artificial Sequence
  chemically synthesized
tccattctgagtaattatcgta

SEQ ID NO: 1012207 - DNA, 22 bp, Artificial Sequence
  chemically synthesized
tacccattttacgataattact

SEQ ID NO: 1012208 - DNA, 22 bp, Artificial Sequence
  chemically synthesized
acccattttacgataattactc

SEQ ID NO: 1012209 - DNA, 22 bp, Artificial Sequence
  chemically synthesized
tctttccattctgagtaattat

SEQ ID NO: 1012210 - DNA, 22 bp, Artificial Sequence
  chemically synthesized
cccattttacgataattactca

SEQ ID NO: 1012211 - DNA, 22 bp, Artificial Sequence
  chemically synthesized
ggttatctttccattctgagta

SEQ ID NO: 1012212 - DNA, 22 bp, Artificial Sequence
  chemically synthesized
aggttatctttccattctgagt

SEQ ID NO: 1012213 - DNA, 22 bp, Artificial Sequence
  chemically synthesized
tacgataattactcagaatgga

SEQ ID NO: 1012214 - DNA, 22 bp, Artificial Sequence
  chemically synthesized
acgataattactcagaatggaa

SEQ ID NO: 1012215 - DNA, 22 bp, Artificial Sequence
  chemically synthesized
cgataattactcagaatggaaa

SEQ ID NO: 1012216 - DNA, 22 bp, Artificial Sequence
  chemically synthesized
ctcagaatggaaagataaccta

SEQ ID NO: 1012217 - DNA, 22 bp, Artificial Sequence
  chemically synthesized
agaatggaaagataacctaagg

SEQ ID NO: 1012218 - DNA, 22 bp, Artificial Sequence
  chemically synthesized
aggtacattatgtgcgtgtata

SEQ ID NO: 1012219 - DNA, 22 bp, Artificial Sequence
  chemically synthesized
tgtgcgtgtatatgtattcatg

SEQ ID NO: 1012220 - DNA, 22 bp, Artificial Sequence
  chemically synthesized
atgtgtgtgtgcacgctcatgt

SEQ ID NO: 1012221 - DNA, 22 bp, Artificial Sequence
  chemically synthesized
atgtgtgtgcacatgttcatat

SEQ ID NO: 1012222 - DNA, 22 bp, Artificial Sequence
  chemically synthesized
tgtccaaaatcatgcatatgaa

SEQ ID NO: 1012223 - DNA, 22 bp, Artificial Sequence
  chemically synthesized
atgtccaaaatcatgcatatga

SEQ ID NO: 1012224 - DNA, 22 bp, Artificial Sequence
  chemically synthesized
tatgtccaaaatcatgcatatg

SEQ ID NO: 1012225 - DNA, 22 bp, Artificial Sequence
  chemically synthesized
ttttatgtccaaaatcatgcat

SEQ ID NO: 1012226 - DNA, 22 bp, Artificial Sequence
  chemically synthesized
gttattttatgtccaaaatcat

SEQ ID NO: 1012227 - DNA, 22 bp, Artificial Sequence
  chemically synthesized
ctggttattttatgtccaaaat

SEQ ID NO: 1012228 - DNA, 22 bp, Artificial Sequence
  chemically synthesized
cctggttattttatgtccaaaa

SEQ ID NO: 1012229 - DNA, 22 bp, Artificial Sequence
  chemically synthesized
tcctggttattttatgtccaaa

SEQ ID NO: 1012230 - DNA, 22 bp, Artificial Sequence
  chemically synthesized
atatgcatgattttggacataa

SEQ ID NO: 1012231 - DNA, 22 bp, Artificial Sequence
  chemically synthesized
tttcctggttattttatgtcca

SEQ ID NO: 1012232 - DNA, 22 bp, Artificial Sequence
  chemically synthesized
ctttcctggttattttatgtcc

SEQ ID NO: 1012233 - DNA, 22 bp, Artificial Sequence
  chemically synthesized
aggtatttctttcctggttatt

SEQ ID NO: 1012234 - DNA, 22 bp, Artificial Sequence
  chemically synthesized
tggacataaaataaccaggaaa

SEQ ID NO: 1012235 - DNA, 22 bp, Artificial Sequence
  chemically synthesized
ggacataaaataaccaggaaag

SEQ ID NO: 1012236 - DNA, 22 bp, Artificial Sequence
  chemically synthesized
gacataaaataaccaggaaaga

SEQ ID NO: 1012237 - DNA, 22 bp, Artificial Sequence
  chemically synthesized
tgaatgatatcacaaacccccc

SEQ ID NO: 1012238 - DNA, 22 bp, Artificial Sequence
  chemically synthesized
aactgtttggggggtttgtgat

SEQ ID NO: 1012239 - DNA, 22 bp, Artificial Sequence
  chemically synthesized
actgtttggggggtttgtgata

SEQ ID NO: 1012240 - DNA, 22 bp, Artificial Sequence
  chemically synthesized
tttggggggtttgtgatatcat

SEQ ID NO: 1012241 - DNA, 22 bp, Artificial Sequence
  chemically synthesized
ggggggtttgtgatatcattca

SEQ ID NO: 1012242 - DNA, 22 bp, Artificial Sequence
  chemically synthesized
agaaaagagctgtgaatgatat

SEQ ID NO: 1012243 - DNA, 22 bp, Artificial Sequence
  chemically synthesized
gggggtttgtgatatcattcac

SEQ ID NO: 1012244 - DNA, 22 bp, Artificial Sequence
  chemically synthesized
cagaaaagagctgtgaatgata

SEQ ID NO: 1012245 - DNA, 22 bp, Artificial Sequence
  chemically synthesized
tcagaaaagagctgtgaatgat

SEQ ID NO: 1012246 - DNA, 22 bp, Artificial Sequence
  chemically synthesized
tttcagaaaagagctgtgaatg

SEQ ID NO: 1012247 - DNA, 22 bp, Artificial Sequence
  chemically synthesized
gtgatatcattcacagctcttt

SEQ ID NO: 1012248 - DNA, 22 bp, Artificial Sequence
  chemically synthesized
tgatatcattcacagctctttt

SEQ ID NO: 1012249 - DNA, 22 bp, Artificial Sequence
  chemically synthesized
acagctcttttctgaaagaatt

SEQ ID NO: 1012250 - DNA, 22 bp, Artificial Sequence
  chemically synthesized
gatgtccaaggaaaaattcttt

SEQ ID NO: 1012251 - DNA, 22 bp, Artificial Sequence
  chemically synthesized
tagatgtccaaggaaaaattct

SEQ ID NO: 1012252 - DNA, 22 bp, Artificial Sequence
  chemically synthesized
ttttctgaaagaatttttcctt

SEQ ID NO: 1012253 - DNA, 22 bp, Artificial Sequence
  chemically synthesized
ttctgaaagaatttttccttgg

SEQ ID NO: 1012254 - DNA, 22 bp, Artificial Sequence
  chemically synthesized
tctgaaagaatttttccttgga

SEQ ID NO: 1012255 - DNA, 22 bp, Artificial Sequence
  chemically synthesized
ctgaaagaatttttccttggac

SEQ ID NO: 1012256 - DNA, 22 bp, Artificial Sequence
  chemically synthesized
tgaaagaatttttccttggaca

SEQ ID NO: 1012257 - DNA, 22 bp, Artificial Sequence
  chemically synthesized
aaagaatttttccttggacatc

SEQ ID NO: 1012258 - DNA, 22 bp, Artificial Sequence
  chemically synthesized
ttccttggacatctagaatgat

SEQ ID NO: 1012259 - DNA, 22 bp, Artificial Sequence
  chemically synthesized
tccttggacatctagaatgatt

SEQ ID NO: 1012260 - DNA, 22 bp, Artificial Sequence
  chemically synthesized
ccttggacatctagaatgattt

SEQ ID NO: 1012261 - DNA, 22 bp, Artificial Sequence
  chemically synthesized
cttggacatctagaatgatttt

SEQ ID NO: 1012262 - DNA, 22 bp, Artificial Sequence
  chemically synthesized
tagatgagataagaaaaatcat

SEQ ID NO: 1012263 - DNA, 22 bp, Artificial Sequence
  chemically synthesized
ggacatctagaatgatttttct

SEQ ID NO: 1012264 - DNA, 22 bp, Artificial Sequence
  chemically synthesized
gacatctagaatgatttttctt

SEQ ID NO: 1012265 - DNA, 22 bp, Artificial Sequence
  chemically synthesized
aatctatagatgagataagaaa

SEQ ID NO: 1012266 - DNA, 22 bp, Artificial Sequence
  chemically synthesized
tcaatctatagatgagataaga

SEQ ID NO: 1012267 - DNA, 22 bp, Artificial Sequence
  chemically synthesized
ctcaatctatagatgagataag

SEQ ID NO: 1012268 - DNA, 22 bp, Artificial Sequence
  chemically synthesized
gaatgatttttcttatctcatc

SEQ ID NO: 1012269 - DNA, 22 bp, Artificial Sequence
  chemically synthesized
tctcaatctatagatgagataa

SEQ ID NO: 1012270 - DNA, 22 bp, Artificial Sequence
  chemically synthesized
ttctcaatctatagatgagata

SEQ ID NO: 1012271 - DNA, 22 bp, Artificial Sequence
  chemically synthesized
tttctcaatctatagatgagat

SEQ ID NO: 1012272 - DNA, 22 bp, Artificial Sequence
  chemically synthesized
ttttttctcaatctatagatga

SEQ ID NO: 1012273 - DNA, 22 bp, Artificial Sequence
  chemically synthesized
ttcttatctcatctatagattg

SEQ ID NO: 1012274 - DNA, 22 bp, Artificial Sequence
  chemically synthesized
tcttatctcatctatagattga

SEQ ID NO: 1012275 - DNA, 22 bp, Artificial Sequence
  chemically synthesized
gtctattttttctcaatctata

SEQ ID NO: 1012276 - DNA, 22 bp, Artificial Sequence
  chemically synthesized
cttatctcatctatagattgag

SEQ ID NO: 1012277 - DNA, 22 bp, Artificial Sequence
  chemically synthesized
agtctattttttctcaatctat

SEQ ID NO: 1012278 - DNA, 22 bp, Artificial Sequence
  chemically synthesized
ttatctcatctatagattgaga

SEQ ID NO: 1012279 - DNA, 22 bp, Artificial Sequence
  chemically synthesized
atctcatctatagattgagaaa

SEQ ID NO: 1012280 - DNA, 22 bp, Artificial Sequence
  chemically synthesized
tttagtctattttttctcaatc

SEQ ID NO: 1012281 - DNA, 22 bp, Artificial Sequence
  chemically synthesized
tctcatctatagattgagaaaa

SEQ ID NO: 1012282 - DNA, 22 bp, Artificial Sequence
  chemically synthesized
atttagtctattttttctcaat

SEQ ID NO: 1012283 - DNA, 22 bp, Artificial Sequence
  chemically synthesized
tatttagtctattttttctcaa

SEQ ID NO: 1012284 - DNA, 22 bp, Artificial Sequence
  chemically synthesized
atctatagattgagaaaaaata

SEQ ID NO: 1012285 - DNA, 22 bp, Artificial Sequence
  chemically synthesized
tagattgagaaaaaatagacta

SEQ ID NO: 1012286 - DNA, 22 bp, Artificial Sequence
  chemically synthesized
aaaagaccattttatttagtct

SEQ ID NO: 1012287 - DNA, 22 bp, Artificial Sequence
  chemically synthesized
aaaaagaccattttatttagtc

SEQ ID NO: 1012288 - DNA, 22 bp, Artificial Sequence
  chemically synthesized
taaaaagaccattttatttagt

SEQ ID NO: 1012289 - DNA, 22 bp, Artificial Sequence
  chemically synthesized
agaaaaaatagactaaataaaa

SEQ ID NO: 1012290 - DNA, 22 bp, Artificial Sequence
  chemically synthesized
gataattttaaaaagaccattt

SEQ ID NO: 1012291 - DNA, 22 bp, Artificial Sequence
  chemically synthesized
aataaaatggtctttttaaaat

SEQ ID NO: 1012292 - DNA, 22 bp, Artificial Sequence
  chemically synthesized
gccaactggataattttaaaaa

SEQ ID NO: 1012293 - DNA, 22 bp, Artificial Sequence
  chemically synthesized
tttaaaattatccagttggcca

SEQ ID NO: 1012294 - DNA, 22 bp, Artificial Sequence
  chemically synthesized
ttaaaattatccagttggccag

SEQ ID NO: 1012295 - DNA, 22 bp, Artificial Sequence
  chemically synthesized
taaaattatccagttggccagg

SEQ ID NO: 1012296 - DNA, 22 bp, Artificial Sequence
  chemically synthesized
aaaattatccagttggccaggc

SEQ ID NO: 1012297 - DNA, 22 bp, Artificial Sequence
  chemically synthesized
aaattatccagttggccaggca

SEQ ID NO: 1012298 - DNA, 22 bp, Artificial Sequence
  chemically synthesized
cagacgtgagccaccatgcctg

SEQ ID NO: 1012299 - DNA, 22 bp, Artificial Sequence
  chemically synthesized
tccagttggccaggcatggtgg

SEQ ID NO: 1012300 - DNA, 22 bp, Artificial Sequence
  chemically synthesized
ggattgcagacgtgagccacca

SEQ ID NO: 1012301 - DNA, 22 bp, Artificial Sequence
  chemically synthesized
gccaggcatggtggctcacgtc

SEQ ID NO: 1012302 - DNA, 22 bp, Artificial Sequence
  chemically synthesized
ccaaagtgctgggattgcagac

SEQ ID NO: 1012303 - DNA, 22 bp, Artificial Sequence
  chemically synthesized
agcctcccaaagtgctgggatt

SEQ ID NO: 1012304 - DNA, 22 bp, Artificial Sequence
  chemically synthesized
acgtctgcaatcccagcacttt

SEQ ID NO: 1012305 - DNA, 22 bp, Artificial Sequence
  chemically synthesized
tctcagcctcccaaagtgctgg

SEQ ID NO: 1012306 - DNA, 22 bp, Artificial Sequence
  chemically synthesized
cctgtctcagcctcccaaagtg

SEQ ID NO: 1012307 - DNA, 22 bp, Artificial Sequence
  chemically synthesized
caatcccagcactttgggaggc

SEQ ID NO: 1012308 - DNA, 22 bp, Artificial Sequence
  chemically synthesized
aggtggtctgcctgtctcagcc

SEQ ID NO: 1012309 - DNA, 22 bp, Artificial Sequence
  chemically synthesized
tgggaggctgagacaggcagac

SEQ ID NO: 1012310 - DNA, 22 bp, Artificial Sequence
  chemically synthesized
cgacctcaggtggtctgcctgt

SEQ ID NO: 1012311 - DNA, 22 bp, Artificial Sequence
  chemically synthesized
gggaggctgagacaggcagacc

SEQ ID NO: 1012312 - DNA, 22 bp, Artificial Sequence
  chemically synthesized
ggaggctgagacaggcagacca

SEQ ID NO: 1012313 - DNA, 22 bp, Artificial Sequence
  chemically synthesized
gatctccgacctcaggtggtct

SEQ ID NO: 1012314 - DNA, 22 bp, Artificial Sequence
  chemically synthesized
agacaggcagaccacctgaggt

SEQ ID NO: 1012315 - DNA, 22 bp, Artificial Sequence
  chemically synthesized
gtctagatctccgacctcaggt

SEQ ID NO: 1012316 - DNA, 22 bp, Artificial Sequence
  chemically synthesized
gtcaggctggtctagatctccg

SEQ ID NO: 1012317 - DNA, 22 bp, Artificial Sequence
  chemically synthesized
aggtcggagatctagaccagcc

SEQ ID NO: 1012318 - DNA, 22 bp, Artificial Sequence
  chemically synthesized
accatgttggtcaggctggtct

SEQ ID NO: 1012319 - DNA, 22 bp, Artificial Sequence
  chemically synthesized
caccatgttggtcaggctggtc

SEQ ID NO: 1012320 - DNA, 22 bp, Artificial Sequence
  chemically synthesized
gaccagcctgaccaacatggtg

SEQ ID NO: 1012321 - DNA, 22 bp, Artificial Sequence
  chemically synthesized
gtagagacgagatttcaccatg

SEQ ID NO: 1012322 - DNA, 22 bp, Artificial Sequence
  chemically synthesized
agtagagacgagatttcaccat

SEQ ID NO: 1012323 - DNA, 22 bp, Artificial Sequence
  chemically synthesized
tagtagagacgagatttcacca

SEQ ID NO: 1012324 - DNA, 22 bp, Artificial Sequence
  chemically synthesized
ttagtagagacgagatttcacc

SEQ ID NO: 1012325 - DNA, 22 bp, Artificial Sequence
  chemically synthesized
accaacatggtgaaatctcgtc

SEQ ID NO: 1012326 - DNA, 22 bp, Artificial Sequence
  chemically synthesized
tatttttagtagagacgagatt

SEQ ID NO: 1012327 - DNA, 22 bp, Artificial Sequence
  chemically synthesized
gtatttttagtagagacgagat

SEQ ID NO: 1012328 - DNA, 22 bp, Artificial Sequence
  chemically synthesized
tgtatttttagtagagacgaga

SEQ ID NO: 1012329 - DNA, 22 bp, Artificial Sequence
  chemically synthesized
ttgtatttttagtagagacgag

SEQ ID NO: 1012330 - DNA, 22 bp, Artificial Sequence
  chemically synthesized
atttttgtatttttagtagaga

SEQ ID NO: 1012331 - DNA, 22 bp, Artificial Sequence
  chemically synthesized
gctaatttttgtatttttagta

SEQ ID NO: 1012332 - DNA, 22 bp, Artificial Sequence
  chemically synthesized
gtctctactaaaaatacaaaaa

SEQ ID NO: 1012333 - DNA, 22 bp, Artificial Sequence
  chemically synthesized
tactaaaaatacaaaaattagc

SEQ ID NO: 1012334 - DNA, 22 bp, Artificial Sequence
  chemically synthesized
ctaaaaatacaaaaattagcca

SEQ ID NO: 1012335 - DNA, 22 bp, Artificial Sequence
  chemically synthesized
aaaatacaaaaattagccaggt

SEQ ID NO: 1012336 - DNA, 22 bp, Artificial Sequence
  chemically synthesized
caggtgcccacccccacacctg

SEQ ID NO: 1012337 - DNA, 22 bp, Artificial Sequence
  chemically synthesized
ggattacaggtgcccaccccca

SEQ ID NO: 1012338 - DNA, 22 bp, Artificial Sequence
  chemically synthesized
gccaggtgtgggggtgggcacc

SEQ ID NO: 1012339 - DNA, 22 bp, Artificial Sequence
  chemically synthesized
ccgagtagctgggattacaggt

SEQ ID NO: 1012340 - DNA, 22 bp, Artificial Sequence
  chemically synthesized
gcctcccgagtagctgggatta

SEQ ID NO: 1012341 - DNA, 22 bp, Artificial Sequence
  chemically synthesized
agcctcccgagtagctgggatt

SEQ ID NO: 1012342 - DNA, 22 bp, Artificial Sequence
  chemically synthesized
ccttagcctcccgagtagctgg

SEQ ID NO: 1012343 - DNA, 22 bp, Artificial Sequence
  chemically synthesized
ctgccttagcctcccgagtagc

SEQ ID NO: 1012344 - DNA, 22 bp, Artificial Sequence
  chemically synthesized
tcctgccttagcctcccgagta

SEQ ID NO: 1012345 - DNA, 22 bp, Artificial Sequence
  chemically synthesized
taatcccagctactcgggaggc

SEQ ID NO: 1012346 - DNA, 22 bp, Artificial Sequence
  chemically synthesized
aagcaattctcctgccttagcc

SEQ ID NO: 1012347 - DNA, 22 bp, Artificial Sequence
  chemically synthesized
caagcaattctcctgccttagc

SEQ ID NO: 1012348 - DNA, 22 bp, Artificial Sequence
  chemically synthesized
ctcgggaggctaaggcaggaga

SEQ ID NO: 1012349 - DNA, 22 bp, Artificial Sequence
  chemically synthesized
gggaggctaaggcaggagaatt

SEQ ID NO: 1012350 - DNA, 22 bp, Artificial Sequence
  chemically synthesized
caggcttcaagcaattctcctg

SEQ ID NO: 1012351 - DNA, 22 bp, Artificial Sequence
  chemically synthesized
cctccaggcttcaagcaattct

SEQ ID NO: 1012352 - DNA, 22 bp, Artificial Sequence
  chemically synthesized
tgcctccaggcttcaagcaatt

SEQ ID NO: 1012353 - DNA, 22 bp, Artificial Sequence
  chemically synthesized
aggcaggagaattgcttgaagc

SEQ ID NO: 1012354 - DNA, 22 bp, Artificial Sequence
  chemically synthesized
caacctctgcctccaggcttca

SEQ ID NO: 1012355 - DNA, 22 bp, Artificial Sequence
  chemically synthesized
actgcaacctctgcctccaggc

SEQ ID NO: 1012356 - DNA, 22 bp, Artificial Sequence
  chemically synthesized
agctcactgcaacctctgcctc

SEQ ID NO: 1012357 - DNA, 22 bp, Artificial Sequence
  chemically synthesized
cttgaagcctggaggcagaggt

SEQ ID NO: 1012358 - DNA, 22 bp, Artificial Sequence
  chemically synthesized
gaagcctggaggcagaggttgc

SEQ ID NO: 1012359 - DNA, 22 bp, Artificial Sequence
  chemically synthesized
aagcctggaggcagaggttgca

SEQ ID NO: 1012360 - DNA, 22 bp, Artificial Sequence
  chemically synthesized
gaggcagaggttgcagtgagct

SEQ ID NO: 1012361 - DNA, 22 bp, Artificial Sequence
  chemically synthesized
gagtggcatgatctcagctcac

SEQ ID NO: 1012362 - DNA, 22 bp, Artificial Sequence
  chemically synthesized
cagtgagctgagatcatgccac

SEQ ID NO: 1012363 - DNA, 22 bp, Artificial Sequence
  chemically synthesized
tcacccaggctggagtggcatg

SEQ ID NO: 1012364 - DNA, 22 bp, Artificial Sequence
  chemically synthesized
gtcacccaggctggagtggcat

SEQ ID NO: 1012365 - DNA, 22 bp, Artificial Sequence
  chemically synthesized
tgtcacccaggctggagtggca

SEQ ID NO: 1012366 - DNA, 22 bp, Artificial Sequence
  chemically synthesized
ttgtcacccaggctggagtggc

SEQ ID NO: 1012367 - DNA, 22 bp, Artificial Sequence
  chemically synthesized
cttttgtcacccaggctggagt

SEQ ID NO: 1012368 - DNA, 22 bp, Artificial Sequence
  chemically synthesized
gcttttgtcacccaggctggag

SEQ ID NO: 1012369 - DNA, 22 bp, Artificial Sequence
  chemically synthesized
agatcatgccactccagcctgg

SEQ ID NO: 1012370 - DNA, 22 bp, Artificial Sequence
  chemically synthesized
tgcttttgtcacccaggctgga

SEQ ID NO: 1012371 - DNA, 22 bp, Artificial Sequence
  chemically synthesized
agatggaattttgcttttgtca

SEQ ID NO: 1012372 - DNA, 22 bp, Artificial Sequence
  chemically synthesized
gagatggaattttgcttttgtc

SEQ ID NO: 1012373 - DNA, 22 bp, Artificial Sequence
  chemically synthesized
tgagatggaattttgcttttgt

SEQ ID NO: 1012374 - DNA, 22 bp, Artificial Sequence
  chemically synthesized
cagcctgggtgacaaaagcaaa

SEQ ID NO: 1012375 - DNA, 22 bp, Artificial Sequence
  chemically synthesized
ttgagatggaattttgcttttg

SEQ ID NO: 1012376 - DNA, 22 bp, Artificial Sequence
  chemically synthesized
tttgagatggaattttgctttt

SEQ ID NO: 1012377 - DNA, 22 bp, Artificial Sequence
  chemically synthesized
ttttgagatggaattttgcttt

SEQ ID NO: 1012378 - DNA, 22 bp, Artificial Sequence
  chemically synthesized
tttttgagatggaattttgctt

SEQ ID NO: 1012379 - DNA, 22 bp, Artificial Sequence
  chemically synthesized
ttttttgagatggaattttgct

SEQ ID NO: 1012380 - DNA, 22 bp, Artificial Sequence
  chemically synthesized
tttttttgagatggaattttgc

SEQ ID NO: 1012381 - DNA, 22 bp, Artificial Sequence
  chemically synthesized
ttttttttgagatggaattttg

SEQ ID NO: 1012382 - DNA, 22 bp, Artificial Sequence
  chemically synthesized
ggtgacaaaagcaaaattccat

SEQ ID NO: 1012383 - DNA, 22 bp, Artificial Sequence
  chemically synthesized
tttttttttgagatggaatttt

SEQ ID NO: 1012384 - DNA, 22 bp, Artificial Sequence
  chemically synthesized
ttttttttttgagatggaattt

SEQ ID NO: 1012385 - DNA, 22 bp, Artificial Sequence
  chemically synthesized
gatacttttttttttttgagat

SEQ ID NO: 1012386 - DNA, 22 bp, Artificial Sequence
  chemically synthesized
aattggatactttttttttttt

SEQ ID NO: 1012387 - DNA, 22 bp, Artificial Sequence
  chemically synthesized
ccctcaattggatacttttttt

SEQ ID NO: 1012388 - DNA, 22 bp, Artificial Sequence
  chemically synthesized
catctcaaaaaaaaaaaagtat

SEQ ID NO: 1012389 - DNA, 22 bp, Artificial Sequence
  chemically synthesized
cccctcaattggatactttttt

SEQ ID NO: 1012390 - DNA, 22 bp, Artificial Sequence
  chemically synthesized
tcccctcaattggatacttttt

SEQ ID NO: 1012391 - DNA, 22 bp, Artificial Sequence
  chemically synthesized
ttcccctcaattggatactttt

SEQ ID NO: 1012392 - DNA, 22 bp, Artificial Sequence
  chemically synthesized
aaaaaaaaaaaagtatccaatt

SEQ ID NO: 1012393 - DNA, 22 bp, Artificial Sequence
  chemically synthesized
tcaaaacttttcccctcaattg

SEQ ID NO: 1012394 - DNA, 22 bp, Artificial Sequence
  chemically synthesized
atcaaaacttttcccctcaatt

SEQ ID NO: 1012395 - DNA, 22 bp, Artificial Sequence
  chemically synthesized
tatcaaaacttttcccctcaat

SEQ ID NO: 1012396 - DNA, 22 bp, Artificial Sequence
  chemically synthesized
atgaacattttatcaaaacttt

SEQ ID NO: 1012397 - DNA, 22 bp, Artificial Sequence
  chemically synthesized
aggggaaaagttttgataaaat

SEQ ID NO: 1012398 - DNA, 22 bp, Artificial Sequence
  chemically synthesized
aaactgatgaacattttatcaa

SEQ ID NO: 1012399 - DNA, 22 bp, Artificial Sequence
  chemically synthesized
gttgaaactgatgaacatttta

SEQ ID NO: 1012400 - DNA, 22 bp, Artificial Sequence
  chemically synthesized
agttgaaactgatgaacatttt

SEQ ID NO: 1012401 - DNA, 22 bp, Artificial Sequence
  chemically synthesized
tgataaaatgttcatcagtttc

SEQ ID NO: 1012402 - DNA, 22 bp, Artificial Sequence
  chemically synthesized
gataaaatgttcatcagtttca

SEQ ID NO: 1012403 - DNA, 22 bp, Artificial Sequence
  chemically synthesized
ataaaatgttcatcagtttcaa

SEQ ID NO: 1012404 - DNA, 22 bp, Artificial Sequence
  chemically synthesized
acagtgtggtttagttgaaact

SEQ ID NO: 1012405 - DNA, 22 bp, Artificial Sequence
  chemically synthesized
gacagtgtggtttagttgaaac

SEQ ID NO: 1012406 - DNA, 22 bp, Artificial Sequence
  chemically synthesized
ttgacagtgtggtttagttgaa

SEQ ID NO: 1012407 - DNA, 22 bp, Artificial Sequence
  chemically synthesized
cttgacagtgtggtttagttga

SEQ ID NO: 1012408 - DNA, 22 bp, Artificial Sequence
  chemically synthesized
atttcttgacagtgtggtttag

SEQ ID NO: 1012409 - DNA, 22 bp, Artificial Sequence
  chemically synthesized
atcagtttcaactaaaccacac

SEQ ID NO: 1012410 - DNA, 22 bp, Artificial Sequence
  chemically synthesized
caactaaaccacactgtcaaga

SEQ ID NO: 1012411 - DNA, 22 bp, Artificial Sequence
  chemically synthesized
atggtcctcatttcttgacagt

SEQ ID NO: 1012412 - DNA, 22 bp, Artificial Sequence
  chemically synthesized
aactaaaccacactgtcaagaa

SEQ ID NO: 1012413 - DNA, 22 bp, Artificial Sequence
  chemically synthesized
aaccacactgtcaagaaatgag

SEQ ID NO: 1012414 - DNA, 22 bp, Artificial Sequence
  chemically synthesized
agagaatgtctaatggtcctca

SEQ ID NO: 1012415 - DNA, 22 bp, Artificial Sequence
  chemically synthesized
cagagaatgtctaatggtcctc

SEQ ID NO: 1012416 - DNA, 22 bp, Artificial Sequence
  chemically synthesized
tcagagaatgtctaatggtcct

SEQ ID NO: 1012417 - DNA, 22 bp, Artificial Sequence
  chemically synthesized
tcaagaaatgaggaccattaga

SEQ ID NO: 1012418 - DNA, 22 bp, Artificial Sequence
  chemically synthesized
aaattttcagagaatgtctaat

SEQ ID NO: 1012419 - DNA, 22 bp, Artificial Sequence
  chemically synthesized
aaaattttcagagaatgtctaa

SEQ ID NO: 1012420 - DNA, 22 bp, Artificial Sequence
  chemically synthesized
gacattctctgaaaattttaaa

SEQ ID NO: 1012421 - DNA, 22 bp, Artificial Sequence
  chemically synthesized
tgaatatatcataatttaaaat

SEQ ID NO: 1012422 - DNA, 22 bp, Artificial Sequence
  chemically synthesized
gtgaatatatcataatttaaaa

SEQ ID NO: 1012423 - DNA, 22 bp, Artificial Sequence
  chemically synthesized
tgtgaatatatcataatttaaa

SEQ ID NO: 1012424 - DNA, 22 bp, Artificial Sequence
  chemically synthesized
tctgaaaattttaaattatgat

SEQ ID NO: 1012425 - DNA, 22 bp, Artificial Sequence
  chemically synthesized
tgaaaattttaaattatgatat

SEQ ID NO: 1012426 - DNA, 22 bp, Artificial Sequence
  chemically synthesized
aaaattttaaattatgatatat

SEQ ID NO: 1012427 - DNA, 22 bp, Artificial Sequence
  chemically synthesized
cacaattttgtgaatatatcat

SEQ ID NO: 1012428 - DNA, 22 bp, Artificial Sequence
  chemically synthesized
taaattatgatatattcacaaa

SEQ ID NO: 1012429 - DNA, 22 bp, Artificial Sequence
  chemically synthesized
acattacacaattttgtgaata

SEQ ID NO: 1012430 - DNA, 22 bp, Artificial Sequence
  chemically synthesized
aaattatgatatattcacaaaa

SEQ ID NO: 1012431 - DNA, 22 bp, Artificial Sequence
  chemically synthesized
aattatgatatattcacaaaat

SEQ ID NO: 1012432 - DNA, 22 bp, Artificial Sequence
  chemically synthesized
tgatatattcacaaaattgtgt

SEQ ID NO: 1012433 - DNA, 22 bp, Artificial Sequence
  chemically synthesized
atacattaacattacacaattt

SEQ ID NO: 1012434 - DNA, 22 bp, Artificial Sequence
  chemically synthesized
aatacattaacattacacaatt

SEQ ID NO: 1012435 - DNA, 22 bp, Artificial Sequence
  chemically synthesized
taatacattaacattacacaat

SEQ ID NO: 1012436 - DNA, 22 bp, Artificial Sequence
  chemically synthesized
ttaatacattaacattacacaa

SEQ ID NO: 1012437 - DNA, 22 bp, Artificial Sequence
  chemically synthesized
atcttttaatacattaacatta

SEQ ID NO: 1012438 - DNA, 22 bp, Artificial Sequence
  chemically synthesized
acaaaattgtgtaatgttaatg

SEQ ID NO: 1012439 - DNA, 22 bp, Artificial Sequence
  chemically synthesized
gatcttttaatacattaacatt

SEQ ID NO: 1012440 - DNA, 22 bp, Artificial Sequence
  chemically synthesized
tgtaatgttaatgtattaaaag

SEQ ID NO: 1012441 - DNA, 22 bp, Artificial Sequence
  chemically synthesized
atgtaatttgatcttttaatac

SEQ ID NO: 1012442 - DNA, 22 bp, Artificial Sequence
  chemically synthesized
gatgtaatttgatcttttaata

SEQ ID NO: 1012443 - DNA, 22 bp, Artificial Sequence
  chemically synthesized
tgatgtaatttgatcttttaat

SEQ ID NO: 1012444 - DNA, 22 bp, Artificial Sequence
  chemically synthesized
ttttgatgtaatttgatctttt

SEQ ID NO: 1012445 - DNA, 22 bp, Artificial Sequence
  chemically synthesized
atgtattaaaagatcaaattac

SEQ ID NO: 1012446 - DNA, 22 bp, Artificial Sequence
  chemically synthesized
aaagatcaaattacatcaaaat

SEQ ID NO: 1012447 - DNA, 22 bp, Artificial Sequence
  chemically synthesized
aaaacaagtccaaaacaaacta

SEQ ID NO: 1012448 - DNA, 22 bp, Artificial Sequence
  chemically synthesized
gaaaacaagtccaaaacaaact

SEQ ID NO: 1012449 - DNA, 22 bp, Artificial Sequence
  chemically synthesized
catcaaaatagtttgttttgga

SEQ ID NO: 1012450 - DNA, 22 bp, Artificial Sequence
  chemically synthesized
caacttgaaaacaagtccaaaa

SEQ ID NO: 1012451 - DNA, 22 bp, Artificial Sequence
  chemically synthesized
ctccaacttgaaaacaagtcca

SEQ ID NO: 1012452 - DNA, 22 bp, Artificial Sequence
  chemically synthesized
actccaacttgaaaacaagtcc

SEQ ID NO: 1012453 - DNA, 22 bp, Artificial Sequence
  chemically synthesized
tactccaacttgaaaacaagtc

SEQ ID NO: 1012454 - DNA, 22 bp, Artificial Sequence
  chemically synthesized
ctttactccaacttgaaaacaa

SEQ ID NO: 1012455 - DNA, 22 bp, Artificial Sequence
  chemically synthesized
gttttggacttgttttcaagtt

SEQ ID NO: 1012456 - DNA, 22 bp, Artificial Sequence
  chemically synthesized
ttttggacttgttttcaagttg

SEQ ID NO: 1012457 - DNA, 22 bp, Artificial Sequence
  chemically synthesized
agcctcctttactccaacttga

SEQ ID NO: 1012458 - DNA, 22 bp, Artificial Sequence
  chemically synthesized
tggacttgttttcaagttggag

SEQ ID NO: 1012459 - DNA, 22 bp, Artificial Sequence
  chemically synthesized
ggacttgttttcaagttggagt

SEQ ID NO: 1012460 - DNA, 22 bp, Artificial Sequence
  chemically synthesized
gacttgttttcaagttggagta

SEQ ID NO: 1012461 - DNA, 22 bp, Artificial Sequence
  chemically synthesized
agttcagcctcctttactccaa

SEQ ID NO: 1012462 - DNA, 22 bp, Artificial Sequence
  chemically synthesized
gttttcaagttggagtaaagga

SEQ ID NO: 1012463 - DNA, 22 bp, Artificial Sequence
  chemically synthesized
ttttcaagttggagtaaaggag

SEQ ID NO: 1012464 - DNA, 22 bp, Artificial Sequence
  chemically synthesized
tcaagttggagtaaaggaggct

SEQ ID NO: 1012465 - DNA, 22 bp, Artificial Sequence
  chemically synthesized
caagttggagtaaaggaggctg

SEQ ID NO: 1012466 - DNA, 22 bp, Artificial Sequence
  chemically synthesized
aagttggagtaaaggaggctga

SEQ ID NO: 1012467 - DNA, 22 bp, Artificial Sequence
  chemically synthesized
aggcaggagattaagttcagcc

SEQ ID NO: 1012468 - DNA, 22 bp, Artificial Sequence
  chemically synthesized
caggcaggagattaagttcagc

SEQ ID NO: 1012469 - DNA, 22 bp, Artificial Sequence
  chemically synthesized
gagtaaaggaggctgaacttaa

SEQ ID NO: 1012470 - DNA, 22 bp, Artificial Sequence
  chemically synthesized
aggtgtttcaggcaggagatta

SEQ ID NO: 1012471 - DNA, 22 bp, Artificial Sequence
  chemically synthesized
caggtgtttcaggcaggagatt

SEQ ID NO: 1012472 - DNA, 22 bp, Artificial Sequence
  chemically synthesized
aacttaatctcctgcctgaaac

SEQ ID NO: 1012473 - DNA, 22 bp, Artificial Sequence
  chemically synthesized
agtgtttcaggtgtttcaggca

SEQ ID NO: 1012474 - DNA, 22 bp, Artificial Sequence
  chemically synthesized
aagtgtttcaggtgtttcaggc

SEQ ID NO: 1012475 - DNA, 22 bp, Artificial Sequence
  chemically synthesized
taagtgtttcaggtgtttcagg

SEQ ID NO: 1012476 - DNA, 22 bp, Artificial Sequence
  chemically synthesized
ttaagtgtttcaggtgtttcag

SEQ ID NO: 1012477 - DNA, 22 bp, Artificial Sequence
  chemically synthesized
tttaagtgtttcaggtgtttca

SEQ ID NO: 1012478 - DNA, 22 bp, Artificial Sequence
  chemically synthesized
aatctcctgcctgaaacacctg

SEQ ID NO: 1012479 - DNA, 22 bp, Artificial Sequence
  chemically synthesized
ttttaagtgtttcaggtgtttc

SEQ ID NO: 1012480 - DNA, 22 bp, Artificial Sequence
  chemically synthesized
atctcctgcctgaaacacctga

SEQ ID NO: 1012481 - DNA, 22 bp, Artificial Sequence
  chemically synthesized
tttttaagtgtttcaggtgttt

SEQ ID NO: 1012482 - DNA, 22 bp, Artificial Sequence
  chemically synthesized
ttttttaagtgtttcaggtgtt

SEQ ID NO: 1012483 - DNA, 22 bp, Artificial Sequence
  chemically synthesized
tttttttaagtgtttcaggtgt

SEQ ID NO: 1012484 - DNA, 22 bp, Artificial Sequence
  chemically synthesized
ttttttttaagtgtttcaggtg

SEQ ID NO: 1012485 - DNA, 22 bp, Artificial Sequence
  chemically synthesized
tttttttttaagtgtttcaggt

SEQ ID NO: 1012486 - DNA, 22 bp, Artificial Sequence
  chemically synthesized
ctgcctgaaacacctgaaacac

SEQ ID NO: 1012487 - DNA, 22 bp, Artificial Sequence
  chemically synthesized
ttttttttttaagtgtttcagg

SEQ ID NO: 1012488 - DNA, 22 bp, Artificial Sequence
  chemically synthesized
tttttttttttaagtgtttcag

SEQ ID NO: 1012489 - DNA, 22 bp, Artificial Sequence
  chemically synthesized
ttttttttttttaagtgtttca

SEQ ID NO: 1012490 - DNA, 22 bp, Artificial Sequence
  chemically synthesized
cctgaaacacctgaaacactta

SEQ ID NO: 1012491 - DNA, 22 bp, Artificial Sequence
  chemically synthesized
tttttttttttttaagtgtttc

SEQ ID NO: 1012492 - DNA, 22 bp, Artificial Sequence
  chemically synthesized
ttttttttttttttaagtgttt

SEQ ID NO: 1012493 - DNA, 22 bp, Artificial Sequence
  chemically synthesized
tttttttttttttttaagtgtt

SEQ ID NO: 1012494 - DNA, 22 bp, Artificial Sequence
  chemically synthesized
ttttttttttttttttaagtgt

SEQ ID NO: 1012495 - DNA, 22 bp, Artificial Sequence
  chemically synthesized
aaacacctgaaacacttaaaaa

SEQ ID NO: 1012496 - DNA, 22 bp, Artificial Sequence
  chemically synthesized
tttttttttttttttttaagtg

SEQ ID NO: 1012497 - DNA, 22 bp, Artificial Sequence
  chemically synthesized
ttttttttttttttttttaagt

SEQ ID NO: 1012498 - DNA, 22 bp, Artificial Sequence
  chemically synthesized
tttttttttttttttttttaag

SEQ ID NO: 1012499 - DNA, 22 bp, Artificial Sequence
  chemically synthesized
ttttttttttttttttttttaa

SEQ ID NO: 1012500 - DNA, 22 bp, Artificial Sequence
  chemically synthesized
ttttttttttttttttttttta

SEQ ID NO: 1012501 - DNA, 22 bp, Artificial Sequence
  chemically synthesized
tctttttttttttttttttttt

SEQ ID NO: 1012502 - DNA, 22 bp, Artificial Sequence
  chemically synthesized
aaacacttaaaaaaaaaaaaaa

SEQ ID NO: 1012503 - DNA, 22 bp, Artificial Sequence
  chemically synthesized
gtcttttttttttttttttttt

SEQ ID NO: 1012504 - DNA, 22 bp, Artificial Sequence
  chemically synthesized
tgtctttttttttttttttttt

SEQ ID NO: 1012505 - DNA, 22 bp, Artificial Sequence
  chemically synthesized
aaaaaaaaaaaaaaaaaaaaaa

SEQ ID NO: 1012506 - DNA, 22 bp, Artificial Sequence
  chemically synthesized
aaaaaaaaaaaaaaaaaaaaaa

SEQ ID NO: 1012507 - DNA, 22 bp, Artificial Sequence
  chemically synthesized
tagcatatattttgtctttttt

SEQ ID NO: 1012508 - DNA, 22 bp, Artificial Sequence
  chemically synthesized
aaaaccgttgtagcatatattt

SEQ ID NO: 1012509 - DNA, 22 bp, Artificial Sequence
  chemically synthesized
aatgtgttgaaaaccgttgtag

SEQ ID NO: 1012510 - DNA, 22 bp, Artificial Sequence
  chemically synthesized
atgttcaatgtgttgaaaaccg

SEQ ID NO: 1012511 - DNA, 22 bp, Artificial Sequence
  chemically synthesized
aatgtctgatgttcaatgtgtt

SEQ ID NO: 1012512 - DNA, 22 bp, Artificial Sequence
  chemically synthesized
caacggttttcaacacattgaa

SEQ ID NO: 1012513 - DNA, 22 bp, Artificial Sequence
  chemically synthesized
caatgtctgatgttcaatgtgt

SEQ ID NO: 1012514 - DNA, 22 bp, Artificial Sequence
  chemically synthesized
tccttcaatgtctgatgttcaa

SEQ ID NO: 1012515 - DNA, 22 bp, Artificial Sequence
  chemically synthesized
tcaacacattgaacatcagaca

SEQ ID NO: 1012516 - DNA, 22 bp, Artificial Sequence
  chemically synthesized
caacacattgaacatcagacat

SEQ ID NO: 1012517 - DNA, 22 bp, Artificial Sequence
  chemically synthesized
aacacattgaacatcagacatt

SEQ ID NO: 1012518 - DNA, 22 bp, Artificial Sequence
  chemically synthesized
gcaaggatcactgtccttcaat

SEQ ID NO: 1012519 - DNA, 22 bp, Artificial Sequence
  chemically synthesized
aacatcagacattgaaggacag

SEQ ID NO: 1012520 - DNA, 22 bp, Artificial Sequence
  chemically synthesized
ctggcaaggatcactgtccttc

SEQ ID NO: 1012521 - DNA, 22 bp, Artificial Sequence
  chemically synthesized
acaaaagcctcctggcaaggat

SEQ ID NO: 1012522 - DNA, 22 bp, Artificial Sequence
  chemically synthesized
aacaaaagcctcctggcaagga

SEQ ID NO: 1012523 - DNA, 22 bp, Artificial Sequence
  chemically synthesized
aaggacagtgatccttgccagg

SEQ ID NO: 1012524 - DNA, 22 bp, Artificial Sequence
  chemically synthesized
taacaaaagcctcctggcaagg

SEQ ID NO: 1012525 - DNA, 22 bp, Artificial Sequence
  chemically synthesized
ttaacaaaagcctcctggcaag

SEQ ID NO: 1012526 - DNA, 22 bp, Artificial Sequence
  chemically synthesized
atcttttaacaaaagcctcctg

SEQ ID NO: 1012527 - DNA, 22 bp, Artificial Sequence
  chemically synthesized
catcttttaacaaaagcctcct

SEQ ID NO: 1012528 - DNA, 22 bp, Artificial Sequence
  chemically synthesized
agcttcatcttttaacaaaagc

SEQ ID NO: 1012529 - DNA, 22 bp, Artificial Sequence
  chemically synthesized
tcagcttcatcttttaacaaaa

SEQ ID NO: 1012530 - DNA, 22 bp, Artificial Sequence
  chemically synthesized
gccaggaggcttttgttaaaag

SEQ ID NO: 1012531 - DNA, 22 bp, Artificial Sequence
  chemically synthesized
ccaggaggcttttgttaaaaga

SEQ ID NO: 1012532 - DNA, 22 bp, Artificial Sequence
  chemically synthesized
aaactctcagcttcatctttta

SEQ ID NO: 1012533 - DNA, 22 bp, Artificial Sequence
  chemically synthesized
ctgaaactctcagcttcatctt

SEQ ID NO: 1012534 - DNA, 22 bp, Artificial Sequence
  chemically synthesized
ttgttaaaagatgaagctgaga

SEQ ID NO: 1012535 - DNA, 22 bp, Artificial Sequence
  chemically synthesized
ggctgctgaaactctcagcttc

SEQ ID NO: 1012536 - DNA, 22 bp, Artificial Sequence
  chemically synthesized
tgttaaaagatgaagctgagag

SEQ ID NO: 1012537 - DNA, 22 bp, Artificial Sequence
  chemically synthesized
gggctgctgaaactctcagctt

SEQ ID NO: 1012538 - DNA, 22 bp, Artificial Sequence
  chemically synthesized
gttaaaagatgaagctgagagt

SEQ ID NO: 1012539 - DNA, 22 bp, Artificial Sequence
  chemically synthesized
ttaaaagatgaagctgagagtt

SEQ ID NO: 1012540 - DNA, 22 bp, Artificial Sequence
  chemically synthesized
aaagatgaagctgagagtttca

SEQ ID NO: 1012541 - DNA, 22 bp, Artificial Sequence
  chemically synthesized
gtcagccttgggctgctgaaac

SEQ ID NO: 1012542 - DNA, 22 bp, Artificial Sequence
  chemically synthesized
agagtttcagcagcccaaggct

SEQ ID NO: 1012543 - DNA, 22 bp, Artificial Sequence
  chemically synthesized
tgatcactagtcagccttgggc

SEQ ID NO: 1012544 - DNA, 22 bp, Artificial Sequence
  chemically synthesized
ccctgtgatcactagtcagcct

SEQ ID NO: 1012545 - DNA, 22 bp, Artificial Sequence
  chemically synthesized
gccctgtgatcactagtcagcc

SEQ ID NO: 1012546 - DNA, 22 bp, Artificial Sequence
  chemically synthesized
cagcagcccaaggctgactagt

SEQ ID NO: 1012547 - DNA, 22 bp, Artificial Sequence
  chemically synthesized
tgccctgtgatcactagtcagc

SEQ ID NO: 1012548 - DNA, 22 bp, Artificial Sequence
  chemically synthesized
agcagcccaaggctgactagtg

SEQ ID NO: 1012549 - DNA, 22 bp, Artificial Sequence
  chemically synthesized
gtattttgccctgtgatcacta

SEQ ID NO: 1012550 - DNA, 22 bp, Artificial Sequence
  chemically synthesized
tggtattttgccctgtgatcac

SEQ ID NO: 1012551 - DNA, 22 bp, Artificial Sequence
  chemically synthesized
tctggtattttgccctgtgatc

SEQ ID NO: 1012552 - DNA, 22 bp, Artificial Sequence
  chemically synthesized
actagtgatcacagggcaaaat

SEQ ID NO: 1012553 - DNA, 22 bp, Artificial Sequence
  chemically synthesized
gtgatcacagggcaaaatacca

SEQ ID NO: 1012554 - DNA, 22 bp, Artificial Sequence
  chemically synthesized
tgtatatatcacctctctggta

SEQ ID NO: 1012555 - DNA, 22 bp, Artificial Sequence
  chemically synthesized
tgtgtatatatcacctctctgg

SEQ ID NO: 1012556 - DNA, 22 bp, Artificial Sequence
  chemically synthesized
ctctgtgtatatatcacctctc

SEQ ID NO: 1012557 - DNA, 22 bp, Artificial Sequence
  chemically synthesized
cctctgtgtatatatcacctct

SEQ ID NO: 1012558 - DNA, 22 bp, Artificial Sequence
  chemically synthesized
caaaatttcctctgtgtatata

SEQ ID NO: 1012559 - DNA, 22 bp, Artificial Sequence
  chemically synthesized
caaatctccaaaatttcctctg

SEQ ID NO: 1012560 - DNA, 22 bp, Artificial Sequence
  chemically synthesized
tacaaatctccaaaatttcctc

SEQ ID NO: 1012561 - DNA, 22 bp, Artificial Sequence
  chemically synthesized
ctacaaatctccaaaatttcct

SEQ ID NO: 1012562 - DNA, 22 bp, Artificial Sequence
  chemically synthesized
tctacaaatctccaaaatttcc

SEQ ID NO: 1012563 - DNA, 22 bp, Artificial Sequence
  chemically synthesized
tggagatttgtagaaagcttta

SEQ ID NO: 1012564 - DNA, 22 bp, Artificial Sequence
  chemically synthesized
ggagatttgtagaaagctttat

SEQ ID NO: 1012565 - DNA, 22 bp, Artificial Sequence
  chemically synthesized
gagatttgtagaaagctttatt

SEQ ID NO: 1012566 - DNA, 22 bp, Artificial Sequence
  chemically synthesized
agatgaagaataaaataaagct

SEQ ID NO: 1012567 - DNA, 22 bp, Artificial Sequence
  chemically synthesized
gtagaaagctttattttattct

SEQ ID NO: 1012568 - DNA, 22 bp, Artificial Sequence
  chemically synthesized
tagaaagctttattttattctt

SEQ ID NO: 1012569 - DNA, 22 bp, Artificial Sequence
  chemically synthesized
atcaagactcagatgaagaata

SEQ ID NO: 1012570 - DNA, 22 bp, Artificial Sequence
  chemically synthesized
tattttattcttcatctgagtc

SEQ ID NO: 1012571 - DNA, 22 bp, Artificial Sequence
  chemically synthesized
attttattcttcatctgagtct

SEQ ID NO: 1012572 - DNA, 22 bp, Artificial Sequence
  chemically synthesized
ttttattcttcatctgagtctt

SEQ ID NO: 1012573 - DNA, 22 bp, Artificial Sequence
  chemically synthesized
tattcttcatctgagtcttgat

SEQ ID NO: 1012574 - DNA, 22 bp, Artificial Sequence
  chemically synthesized
attcttcatctgagtcttgatc

SEQ ID NO: 1012575 - DNA, 22 bp, Artificial Sequence
  chemically synthesized
catacatgaactgatcaagact

SEQ ID NO: 1012576 - DNA, 22 bp, Artificial Sequence
  chemically synthesized
ttcttcatctgagtcttgatca

SEQ ID NO: 1012577 - DNA, 22 bp, Artificial Sequence
  chemically synthesized
gcatacatgaactgatcaagac

SEQ ID NO: 1012578 - DNA, 22 bp, Artificial Sequence
  chemically synthesized
ttgcatacatgaactgatcaag

SEQ ID NO: 1012579 - DNA, 22 bp, Artificial Sequence
  chemically synthesized
ttcatctgagtcttgatcagtt

SEQ ID NO: 1012580 - DNA, 22 bp, Artificial Sequence
  chemically synthesized
cttgcatacatgaactgatcaa

SEQ ID NO: 1012581 - DNA, 22 bp, Artificial Sequence
  chemically synthesized
tcttgcatacatgaactgatca

SEQ ID NO: 1012582 - DNA, 22 bp, Artificial Sequence
  chemically synthesized
catctgagtcttgatcagttca

SEQ ID NO: 1012583 - DNA, 22 bp, Artificial Sequence
  chemically synthesized
atctgagtcttgatcagttcat

SEQ ID NO: 1012584 - DNA, 22 bp, Artificial Sequence
  chemically synthesized
agtcttgatcagttcatgtatg

SEQ ID NO: 1012585 - DNA, 22 bp, Artificial Sequence
  chemically synthesized
agtggttttcttgcatacatga

SEQ ID NO: 1012586 - DNA, 22 bp, Artificial Sequence
  chemically synthesized
gagtggttttcttgcatacatg

SEQ ID NO: 1012587 - DNA, 22 bp, Artificial Sequence
  chemically synthesized
tgagtggttttcttgcatacat

SEQ ID NO: 1012588 - DNA, 22 bp, Artificial Sequence
  chemically synthesized
gatcagttcatgtatgcaagaa

SEQ ID NO: 1012589 - DNA, 22 bp, Artificial Sequence
  chemically synthesized
atcagttcatgtatgcaagaaa

SEQ ID NO: 1012590 - DNA, 22 bp, Artificial Sequence
  chemically synthesized
gctttgagtggttttcttgcat

SEQ ID NO: 1012591 - DNA, 22 bp, Artificial Sequence
  chemically synthesized
agctttgagtggttttcttgca

SEQ ID NO: 1012592 - DNA, 22 bp, Artificial Sequence
  chemically synthesized
cttagctttgagtggttttctt

SEQ ID NO: 1012593 - DNA, 22 bp, Artificial Sequence
  chemically synthesized
ccttagctttgagtggttttct

SEQ ID NO: 1012594 - DNA, 22 bp, Artificial Sequence
  chemically synthesized
tccttagctttgagtggttttc

SEQ ID NO: 1012595 - DNA, 22 bp, Artificial Sequence
  chemically synthesized
atgtatgcaagaaaaccactca

SEQ ID NO: 1012596 - DNA, 22 bp, Artificial Sequence
  chemically synthesized
tttccttagctttgagtggttt

SEQ ID NO: 1012597 - DNA, 22 bp, Artificial Sequence
  chemically synthesized
tgaagttctttccttagctttg

SEQ ID NO: 1012598 - DNA, 22 bp, Artificial Sequence
  chemically synthesized
gtgaagttctttccttagcttt

SEQ ID NO: 1012599 - DNA, 22 bp, Artificial Sequence
  chemically synthesized
tgtgaagttctttccttagctt

SEQ ID NO: 1012600 - DNA, 22 bp, Artificial Sequence
  chemically synthesized
ttgtgaagttctttccttagct

SEQ ID NO: 1012601 - DNA, 22 bp, Artificial Sequence
  chemically synthesized
ttttgtgaagttctttccttag

SEQ ID NO: 1012602 - DNA, 22 bp, Artificial Sequence
  chemically synthesized
attcttttgtgaagttctttcc

SEQ ID NO: 1012603 - DNA, 22 bp, Artificial Sequence
  chemically synthesized
aattcttttgtgaagttctttc

SEQ ID NO: 1012604 - DNA, 22 bp, Artificial Sequence
  chemically synthesized
taattcttttgtgaagttcttt

SEQ ID NO: 1012605 - DNA, 22 bp, Artificial Sequence
  chemically synthesized
aaagctaaggaaagaacttcac

SEQ ID NO: 1012606 - DNA, 22 bp, Artificial Sequence
  chemically synthesized
ctttaattcttttgtgaagttc

SEQ ID NO: 1012607 - DNA, 22 bp, Artificial Sequence
  chemically synthesized
cctttaattcttttgtgaagtt

SEQ ID NO: 1012608 - DNA, 22 bp, Artificial Sequence
  chemically synthesized
tttcctttaattcttttgtgaa

SEQ ID NO: 1012609 - DNA, 22 bp, Artificial Sequence
  chemically synthesized
aggaaagaacttcacaaaagaa

SEQ ID NO: 1012610 - DNA, 22 bp, Artificial Sequence
  chemically synthesized
gtgattgtttcctttaattctt

SEQ ID NO: 1012611 - DNA, 22 bp, Artificial Sequence
  chemically synthesized
tggtgattgtttcctttaattc

SEQ ID NO: 1012612 - DNA, 22 bp, Artificial Sequence
  chemically synthesized
cacaaaagaattaaaggaaaca

SEQ ID NO: 1012613 - DNA, 22 bp, Artificial Sequence
  chemically synthesized
acaaaagaattaaaggaaacaa

SEQ ID NO: 1012614 - DNA, 22 bp, Artificial Sequence
  chemically synthesized
gccacgtgtgagctctggtgat

SEQ ID NO: 1012615 - DNA, 22 bp, Artificial Sequence
  chemically synthesized
aaggaaacaatcaccagagctc

SEQ ID NO: 1012616 - DNA, 22 bp, Artificial Sequence
  chemically synthesized
ctagccacgtgtgagctctggt

SEQ ID NO: 1012617 - DNA, 22 bp, Artificial Sequence
  chemically synthesized
gtgggaacaggtggtattacta

SEQ ID NO: 1012618 - DNA, 22 bp, Artificial Sequence
  chemically synthesized
acacgtggctagtaataccacc

SEQ ID NO: 1012619 - DNA, 22 bp, Artificial Sequence
  chemically synthesized
gggctcgtgggaacaggtggta

SEQ ID NO: 1012620 - DNA, 22 bp, Artificial Sequence
  chemically synthesized
actggggctcgtgggaacaggt

SEQ ID NO: 1012621 - DNA, 22 bp, Artificial Sequence
  chemically synthesized
cactggggctcgtgggaacagg

SEQ ID NO: 1012622 - DNA, 22 bp, Artificial Sequence
  chemically synthesized
tcactggggctcgtgggaacag

SEQ ID NO: 1012623 - DNA, 22 bp, Artificial Sequence
  chemically synthesized
ttcactggggctcgtgggaaca

SEQ ID NO: 1012624 - DNA, 22 bp, Artificial Sequence
  chemically synthesized
gtaataccacctgttcccacga

SEQ ID NO: 1012625 - DNA, 22 bp, Artificial Sequence
  chemically synthesized
ttcccacgagccccagtgaaaa

SEQ ID NO: 1012626 - DNA, 22 bp, Artificial Sequence
  chemically synthesized
tgaatgataaaatttttcactg

SEQ ID NO: 1012627 - DNA, 22 bp, Artificial Sequence
  chemically synthesized
ccacgagccccagtgaaaaatt

SEQ ID NO: 1012628 - DNA, 22 bp, Artificial Sequence
  chemically synthesized
atgtcctgtgaatgataaaatt

SEQ ID NO: 1012629 - DNA, 22 bp, Artificial Sequence
  chemically synthesized
tgatgtcctgtgaatgataaaa

SEQ ID NO: 1012630 - DNA, 22 bp, Artificial Sequence
  chemically synthesized
tctgatgtcctgtgaatgataa

SEQ ID NO: 1012631 - DNA, 22 bp, Artificial Sequence
  chemically synthesized
tctctgatgtcctgtgaatgat

SEQ ID NO: 1012632 - DNA, 22 bp, Artificial Sequence
  chemically synthesized
agtactctctctgatgtcctgt

SEQ ID NO: 1012633 - DNA, 22 bp, Artificial Sequence
  chemically synthesized
tgagtactctctctgatgtcct

SEQ ID NO: 1012634 - DNA, 22 bp, Artificial Sequence
  chemically synthesized
ctgagtactctctctgatgtcc

SEQ ID NO: 1012635 - DNA, 22 bp, Artificial Sequence
  chemically synthesized
tatcattcacaggacatcagag

SEQ ID NO: 1012636 - DNA, 22 bp, Artificial Sequence
  chemically synthesized
atcattcacaggacatcagaga

SEQ ID NO: 1012637 - DNA, 22 bp, Artificial Sequence
  chemically synthesized
tcattcacaggacatcagagag

SEQ ID NO: 1012638 - DNA, 22 bp, Artificial Sequence
  chemically synthesized
acaggacatcagagagagtact

SEQ ID NO: 1012639 - DNA, 22 bp, Artificial Sequence
  chemically synthesized
aggcaaaacccttctgagtact

SEQ ID NO: 1012640 - DNA, 22 bp, Artificial Sequence
  chemically synthesized
ctgaggcaaaacccttctgagt

SEQ ID NO: 1012641 - DNA, 22 bp, Artificial Sequence
  chemically synthesized
cccactactgaggcaaaaccct

SEQ ID NO: 1012642 - DNA, 22 bp, Artificial Sequence
  chemically synthesized
ccccactactgaggcaaaaccc

SEQ ID NO: 1012643 - DNA, 22 bp, Artificial Sequence
  chemically synthesized
tccccactactgaggcaaaacc

SEQ ID NO: 1012644 - DNA, 22 bp, Artificial Sequence
  chemically synthesized
ttccccactactgaggcaaaac

SEQ ID NO: 1012645 - DNA, 22 bp, Artificial Sequence
  chemically synthesized
tttccccactactgaggcaaaa

SEQ ID NO: 1012646 - DNA, 22 bp, Artificial Sequence
  chemically synthesized
ctttttccccactactgaggca

SEQ ID NO: 1012647 - DNA, 22 bp, Artificial Sequence
  chemically synthesized
agaagggttttgcctcagtagt

SEQ ID NO: 1012648 - DNA, 22 bp, Artificial Sequence
  chemically synthesized
gggctactttttccccactact

SEQ ID NO: 1012649 - DNA, 22 bp, Artificial Sequence
  chemically synthesized
agggctactttttccccactac

SEQ ID NO: 1012650 - DNA, 22 bp, Artificial Sequence
  chemically synthesized
tgcctcagtagtggggaaaaag

SEQ ID NO: 1012651 - DNA, 22 bp, Artificial Sequence
  chemically synthesized
gcctcagtagtggggaaaaagt

SEQ ID NO: 1012652 - DNA, 22 bp, Artificial Sequence
  chemically synthesized
cctcagtagtggggaaaaagta

SEQ ID NO: 1012653 - DNA, 22 bp, Artificial Sequence
  chemically synthesized
agtagtggggaaaaagtagccc

SEQ ID NO: 1012654 - DNA, 22 bp, Artificial Sequence
  chemically synthesized
tgaccagaacagtgtaagttta

SEQ ID NO: 1012655 - DNA, 22 bp, Artificial Sequence
  chemically synthesized
ttatgaccagaacagtgtaagt

SEQ ID NO: 1012656 - DNA, 22 bp, Artificial Sequence
  chemically synthesized
gttatgaccagaacagtgtaag

SEQ ID NO: 1012657 - DNA, 22 bp, Artificial Sequence
  chemically synthesized
tgttatgaccagaacagtgtaa

SEQ ID NO: 1012658 - DNA, 22 bp, Artificial Sequence
  chemically synthesized
tgctttgttatgaccagaacag

SEQ ID NO: 1012659 - DNA, 22 bp, Artificial Sequence
  chemically synthesized
atgctttgttatgaccagaaca

SEQ ID NO: 1012660 - DNA, 22 bp, Artificial Sequence
  chemically synthesized
tatgctttgttatgaccagaac

SEQ ID NO: 1012661 - DNA, 22 bp, Artificial Sequence
  chemically synthesized
ttatgctttgttatgaccagaa

SEQ ID NO: 1012662 - DNA, 22 bp, Artificial Sequence
  chemically synthesized
aacttacactgttctggtcata

SEQ ID NO: 1012663 - DNA, 22 bp, Artificial Sequence
  chemically synthesized
cttttatgctttgttatgacca

SEQ ID NO: 1012664 - DNA, 22 bp, Artificial Sequence
  chemically synthesized
ccttttatgctttgttatgacc

SEQ ID NO: 1012665 - DNA, 22 bp, Artificial Sequence
  chemically synthesized
acactgttctggtcataacaaa

SEQ ID NO: 1012666 - DNA, 22 bp, Artificial Sequence
  chemically synthesized
cactgttctggtcataacaaag

SEQ ID NO: 1012667 - DNA, 22 bp, Artificial Sequence
  chemically synthesized
ttctggtcataacaaagcataa

SEQ ID NO: 1012668 - DNA, 22 bp, Artificial Sequence
  chemically synthesized
agaatcttccttttatgctttg

SEQ ID NO: 1012669 - DNA, 22 bp, Artificial Sequence
  chemically synthesized
gagaatcttccttttatgcttt

SEQ ID NO: 1012670 - DNA, 22 bp, Artificial Sequence
  chemically synthesized
tgagaatcttccttttatgctt

SEQ ID NO: 1012671 - DNA, 22 bp, Artificial Sequence
  chemically synthesized
tggtcataacaaagcataaaag

SEQ ID NO: 1012672 - DNA, 22 bp, Artificial Sequence
  chemically synthesized
ttgagaatcttccttttatgct

SEQ ID NO: 1012673 - DNA, 22 bp, Artificial Sequence
  chemically synthesized
gtcataacaaagcataaaagga

SEQ ID NO: 1012674 - DNA, 22 bp, Artificial Sequence
  chemically synthesized
atcttttgagaatcttcctttt

SEQ ID NO: 1012675 - DNA, 22 bp, Artificial Sequence
  chemically synthesized
gatcttttgagaatcttccttt

SEQ ID NO: 1012676 - DNA, 22 bp, Artificial Sequence
  chemically synthesized
gaaacaatttgatcttttgaga

SEQ ID NO: 1012677 - DNA, 22 bp, Artificial Sequence
  chemically synthesized
ggaaacaatttgatcttttgag

SEQ ID NO: 1012678 - DNA, 22 bp, Artificial Sequence
  chemically synthesized
acttggaaacaatttgatcttt

SEQ ID NO: 1012679 - DNA, 22 bp, Artificial Sequence
  chemically synthesized
attcacttggaaacaatttgat

SEQ ID NO: 1012680 - DNA, 22 bp, Artificial Sequence
  chemically synthesized
tcaaaagatcaaattgtttcca

SEQ ID NO: 1012681 - DNA, 22 bp, Artificial Sequence
  chemically synthesized
aaaagatcaaattgtttccaag

SEQ ID NO: 1012682 - DNA, 22 bp, Artificial Sequence
  chemically synthesized
gaacacagttaattcacttgga

SEQ ID NO: 1012683 - DNA, 22 bp, Artificial Sequence
  chemically synthesized
tggaacacagttaattcacttg

SEQ ID NO: 1012684 - DNA, 22 bp, Artificial Sequence
  chemically synthesized
gttctggaacacagttaattca

SEQ ID NO: 1012685 - DNA, 22 bp, Artificial Sequence
  chemically synthesized
tttccaagtgaattaactgtgt

SEQ ID NO: 1012686 - DNA, 22 bp, Artificial Sequence
  chemically synthesized
ccaagtgaattaactgtgttcc

SEQ ID NO: 1012687 - DNA, 22 bp, Artificial Sequence
  chemically synthesized
aaacctcgttctggaacacagt

SEQ ID NO: 1012688 - DNA, 22 bp, Artificial Sequence
  chemically synthesized
caagtgaattaactgtgttcca

SEQ ID NO: 1012689 - DNA, 22 bp, Artificial Sequence
  chemically synthesized
tcaaacctcgttctggaacaca

SEQ ID NO: 1012690 - DNA, 22 bp, Artificial Sequence
  chemically synthesized
actgtgttccagaacgaggttt

SEQ ID NO: 1012691 - DNA, 22 bp, Artificial Sequence
  chemically synthesized
aaataaatattctcaaacctcg

SEQ ID NO: 1012692 - DNA, 22 bp, Artificial Sequence
  chemically synthesized
tgttccagaacgaggtttgaga

SEQ ID NO: 1012693 - DNA, 22 bp, Artificial Sequence
  chemically synthesized
cagaacgaggtttgagaatatt

SEQ ID NO: 1012694 - DNA, 22 bp, Artificial Sequence
  chemically synthesized
aaatatattgaaataaatattc

SEQ ID NO: 1012695 - DNA, 22 bp, Artificial Sequence
  chemically synthesized
gagaatatttatttcaatatat

SEQ ID NO: 1012696 - DNA, 22 bp, Artificial Sequence
  chemically synthesized
aaataaattcaaatatattgaa

SEQ ID NO: 1012697 - DNA, 22 bp, Artificial Sequence
  chemically synthesized
agaatatttatttcaatatatt

SEQ ID NO: 1012698 - DNA, 22 bp, Artificial Sequence
  chemically synthesized
caaataaattcaaatatattga

SEQ ID NO: 1012699 - DNA, 22 bp, Artificial Sequence
  chemically synthesized
atacttcaaataaattcaaata

SEQ ID NO: 1012700 - DNA, 22 bp, Artificial Sequence
  chemically synthesized
gatacttcaaataaattcaaat

SEQ ID NO: 1012701 - DNA, 22 bp, Artificial Sequence
  chemically synthesized
atttcaatatatttgaatttat

SEQ ID NO: 1012702 - DNA, 22 bp, Artificial Sequence
  chemically synthesized
tttcaatatatttgaatttatt

SEQ ID NO: 1012703 - DNA, 22 bp, Artificial Sequence
  chemically synthesized
caatatatttgaatttatttga

SEQ ID NO: 1012704 - DNA, 22 bp, Artificial Sequence
  chemically synthesized
aatatatttgaatttatttgaa

SEQ ID NO: 1012705 - DNA, 22 bp, Artificial Sequence
  chemically synthesized
gcgcgtgcttgatacttcaaat

SEQ ID NO: 1012706 - DNA, 22 bp, Artificial Sequence
  chemically synthesized
agcgcgtgcttgatacttcaaa

SEQ ID NO: 1012707 - DNA, 22 bp, Artificial Sequence
  chemically synthesized
acttagcgcgtgcttgatactt

SEQ ID NO: 1012708 - DNA, 22 bp, Artificial Sequence
  chemically synthesized
gaatttatttgaagtatcaagc

SEQ ID NO: 1012709 - DNA, 22 bp, Artificial Sequence
  chemically synthesized
aacttagcgcgtgcttgatact

SEQ ID NO: 1012710 - DNA, 22 bp, Artificial Sequence
  chemically synthesized
aatttatttgaagtatcaagca

SEQ ID NO: 1012711 - DNA, 22 bp, Artificial Sequence
  chemically synthesized
taacttagcgcgtgcttgatac

SEQ ID NO: 1012712 - DNA, 22 bp, Artificial Sequence
  chemically synthesized
atttgaagtatcaagcacgcgc

SEQ ID NO: 1012713 - DNA, 22 bp, Artificial Sequence
  chemically synthesized
tttgaagtatcaagcacgcgct

SEQ ID NO: 1012714 - DNA, 22 bp, Artificial Sequence
  chemically synthesized
tgaattttaacttagcgcgtgc

SEQ ID NO: 1012715 - DNA, 22 bp, Artificial Sequence
  chemically synthesized
gaagtatcaagcacgcgctaag

SEQ ID NO: 1012716 - DNA, 22 bp, Artificial Sequence
  chemically synthesized
aagtatcaagcacgcgctaagt

SEQ ID NO: 1012717 - DNA, 22 bp, Artificial Sequence
  chemically synthesized
tatgccagacattgtgaatttt

SEQ ID NO: 1012718 - DNA, 22 bp, Artificial Sequence
  chemically synthesized
actatatgccagacattgtgaa

SEQ ID NO: 1012719 - DNA, 22 bp, Artificial Sequence
  chemically synthesized
gactatatgccagacattgtga

SEQ ID NO: 1012720 - DNA, 22 bp, Artificial Sequence
  chemically synthesized
tgactatatgccagacattgtg

SEQ ID NO: 1012721 - DNA, 22 bp, Artificial Sequence
  chemically synthesized
ttgactatatgccagacattgt

SEQ ID NO: 1012722 - DNA, 22 bp, Artificial Sequence
  chemically synthesized
agttaaaattcacaatgtctgg

SEQ ID NO: 1012723 - DNA, 22 bp, Artificial Sequence
  chemically synthesized
aaattcacaatgtctggcatat

SEQ ID NO: 1012724 - DNA, 22 bp, Artificial Sequence
  chemically synthesized
gtaatttttgactatatgccag

SEQ ID NO: 1012725 - DNA, 22 bp, Artificial Sequence
  chemically synthesized
acaatgtctggcatatagtcaa

SEQ ID NO: 1012726 - DNA, 22 bp, Artificial Sequence
  chemically synthesized
gatgactggtaatttttgacta

SEQ ID NO: 1012727 - DNA, 22 bp, Artificial Sequence
  chemically synthesized
ggatgactggtaatttttgact

SEQ ID NO: 1012728 - DNA, 22 bp, Artificial Sequence
  chemically synthesized
tggatgactggtaatttttgac

SEQ ID NO: 1012729 - DNA, 22 bp, Artificial Sequence
  chemically synthesized
tttggatgactggtaatttttg

SEQ ID NO: 1012730 - DNA, 22 bp, Artificial Sequence
  chemically synthesized
ctttggatgactggtaattttt

SEQ ID NO: 1012731 - DNA, 22 bp, Artificial Sequence
  chemically synthesized
gcatatagtcaaaaattaccag

SEQ ID NO: 1012732 - DNA, 22 bp, Artificial Sequence
  chemically synthesized
cttctttggatgactggtaatt

SEQ ID NO: 1012733 - DNA, 22 bp, Artificial Sequence
  chemically synthesized
actgcttctttggatgactggt

SEQ ID NO: 1012734 - DNA, 22 bp, Artificial Sequence
  chemically synthesized
aactgcttctttggatgactgg

SEQ ID NO: 1012735 - DNA, 22 bp, Artificial Sequence
  chemically synthesized
tttaactgcttctttggatgac

SEQ ID NO: 1012736 - DNA, 22 bp, Artificial Sequence
  chemically synthesized
ccagtcatccaaagaagcagtt

SEQ ID NO: 1012737 - DNA, 22 bp, Artificial Sequence
  chemically synthesized
agtgtgttgtttaactgcttct

SEQ ID NO: 1012738 - DNA, 22 bp, Artificial Sequence
  chemically synthesized
attaagtgtgttgtttaactgc

SEQ ID NO: 1012739 - DNA, 22 bp, Artificial Sequence
  chemically synthesized
ctcattaagtgtgttgtttaac

SEQ ID NO: 1012740 - DNA, 22 bp, Artificial Sequence
  chemically synthesized
tcctcattaagtgtgttgttta

SEQ ID NO: 1012741 - DNA, 22 bp, Artificial Sequence
  chemically synthesized
ctcctcattaagtgtgttgttt

SEQ ID NO: 1012742 - DNA, 22 bp, Artificial Sequence
  chemically synthesized
tctcctcattaagtgtgttgtt

SEQ ID NO: 1012743 - DNA, 22 bp, Artificial Sequence
  chemically synthesized
ttctcctcattaagtgtgttgt

SEQ ID NO: 1012744 - DNA, 22 bp, Artificial Sequence
  chemically synthesized
tttttctcctcattaagtgtgt

SEQ ID NO: 1012745 - DNA, 22 bp, Artificial Sequence
  chemically synthesized
atttttctcctcattaagtgtg

SEQ ID NO: 1012746 - DNA, 22 bp, Artificial Sequence
  chemically synthesized
atttatttttctcctcattaag

SEQ ID NO: 1012747 - DNA, 22 bp, Artificial Sequence
  chemically synthesized
aacaacacacttaatgaggaga

SEQ ID NO: 1012748 - DNA, 22 bp, Artificial Sequence
  chemically synthesized
aattgatttatttttctcctca

SEQ ID NO: 1012749 - DNA, 22 bp, Artificial Sequence
  chemically synthesized
aaattgatttatttttctcctc

SEQ ID NO: 1012750 - DNA, 22 bp, Artificial Sequence
  chemically synthesized
atttaaattgatttatttttct

SEQ ID NO: 1012751 - DNA, 22 bp, Artificial Sequence
  chemically synthesized
aatgaggagaaaaataaatcaa

SEQ ID NO: 1012752 - DNA, 22 bp, Artificial Sequence
  chemically synthesized
ggttaatttaaattgatttatt

SEQ ID NO: 1012753 - DNA, 22 bp, Artificial Sequence
  chemically synthesized
atgaggagaaaaataaatcaat

SEQ ID NO: 1012754 - DNA, 22 bp, Artificial Sequence
  chemically synthesized
tgggttaatttaaattgattta

SEQ ID NO: 1012755 - DNA, 22 bp, Artificial Sequence
  chemically synthesized
ttctgggttaatttaaattgat

SEQ ID NO: 1012756 - DNA, 22 bp, Artificial Sequence
  chemically synthesized
tgtctattctgggttaatttaa

SEQ ID NO: 1012757 - DNA, 22 bp, Artificial Sequence
  chemically synthesized
tcatctgtgtctattctgggtt

SEQ ID NO: 1012758 - DNA, 22 bp, Artificial Sequence
  chemically synthesized
atcatctgtgtctattctgggt

SEQ ID NO: 1012759 - DNA, 22 bp, Artificial Sequence
  chemically synthesized
tatcatctgtgtctattctggg

SEQ ID NO: 1012760 - DNA, 22 bp, Artificial Sequence
  chemically synthesized
attttatcatctgtgtctattc

SEQ ID NO: 1012761 - DNA, 22 bp, Artificial Sequence
  chemically synthesized
aaattaacccagaatagacaca

SEQ ID NO: 1012762 - DNA, 22 bp, Artificial Sequence
  chemically synthesized
aattaacccagaatagacacag

SEQ ID NO: 1012763 - DNA, 22 bp, Artificial Sequence
  chemically synthesized
ctaattttatcatctgtgtcta

SEQ ID NO: 1012764 - DNA, 22 bp, Artificial Sequence
  chemically synthesized
tactaattttatcatctgtgtc

SEQ ID NO: 1012765 - DNA, 22 bp, Artificial Sequence
  chemically synthesized
acccagaatagacacagatgat

SEQ ID NO: 1012766 - DNA, 22 bp, Artificial Sequence
  chemically synthesized
tctactaattttatcatctgtg

SEQ ID NO: 1012767 - DNA, 22 bp, Artificial Sequence
  chemically synthesized
ctctactaattttatcatctgt

SEQ ID NO: 1012768 - DNA, 22 bp, Artificial Sequence
  chemically synthesized
ttctctactaattttatcatct

SEQ ID NO: 1012769 - DNA, 22 bp, Artificial Sequence
  chemically synthesized
gaatattcttctctactaattt

SEQ ID NO: 1012770 - DNA, 22 bp, Artificial Sequence
  chemically synthesized
ttagaatattcttctctactaa

SEQ ID NO: 1012771 - DNA, 22 bp, Artificial Sequence
  chemically synthesized
gtagagaagaatattctaacag

SEQ ID NO: 1012772 - DNA, 22 bp, Artificial Sequence
  chemically synthesized
tatggaatacagatataataac

SEQ ID NO: 1012773 - DNA, 22 bp, Artificial Sequence
  chemically synthesized
actatatggaatacagatataa

SEQ ID NO: 1012774 - DNA, 22 bp, Artificial Sequence
  chemically synthesized
gactatatggaatacagatata

SEQ ID NO: 1012775 - DNA, 22 bp, Artificial Sequence
  chemically synthesized
taacagttattatatctgtatt

SEQ ID NO: 1012776 - DNA, 22 bp, Artificial Sequence
  chemically synthesized
ttgactatatggaatacagata

SEQ ID NO: 1012777 - DNA, 22 bp, Artificial Sequence
  chemically synthesized
cttgactatatggaatacagat

SEQ ID NO: 1012778 - DNA, 22 bp, Artificial Sequence
  chemically synthesized
acagttattatatctgtattcc

SEQ ID NO: 1012779 - DNA, 22 bp, Artificial Sequence
  chemically synthesized
tcttgactatatggaatacaga

SEQ ID NO: 1012780 - DNA, 22 bp, Artificial Sequence
  chemically synthesized
ctttcttgactatatggaatac

SEQ ID NO: 1012781 - DNA, 22 bp, Artificial Sequence
  chemically synthesized
actttcttgactatatggaata

SEQ ID NO: 1012782 - DNA, 22 bp, Artificial Sequence
  chemically synthesized
tactttcttgactatatggaat

SEQ ID NO: 1012783 - DNA, 22 bp, Artificial Sequence
  chemically synthesized
ttatatctgtattccatatagt

SEQ ID NO: 1012784 - DNA, 22 bp, Artificial Sequence
  chemically synthesized
tatctgtattccatatagtcaa

SEQ ID NO: 1012785 - DNA, 22 bp, Artificial Sequence
  chemically synthesized
agtctttactttcttgactata

SEQ ID NO: 1012786 - DNA, 22 bp, Artificial Sequence
  chemically synthesized
tattccatatagtcaagaaagt

SEQ ID NO: 1012787 - DNA, 22 bp, Artificial Sequence
  chemically synthesized
aacatgttcagtctttactttc

SEQ ID NO: 1012788 - DNA, 22 bp, Artificial Sequence
  chemically synthesized
catatagtcaagaaagtaaaga

SEQ ID NO: 1012789 - DNA, 22 bp, Artificial Sequence
  chemically synthesized
ctcaacatgttcagtctttact

SEQ ID NO: 1012790 - DNA, 22 bp, Artificial Sequence
  chemically synthesized
catgtgtctactcaacatgttc

SEQ ID NO: 1012791 - DNA, 22 bp, Artificial Sequence
  chemically synthesized
ccatgtgtctactcaacatgtt

SEQ ID NO: 1012792 - DNA, 22 bp, Artificial Sequence
  chemically synthesized
ttccatgtgtctactcaacatg

SEQ ID NO: 1012793 - DNA, 22 bp, Artificial Sequence
  chemically synthesized
cttccatgtgtctactcaacat

SEQ ID NO: 1012794 - DNA, 22 bp, Artificial Sequence
  chemically synthesized
tttcttccatgtgtctactcaa

SEQ ID NO: 1012795 - DNA, 22 bp, Artificial Sequence
  chemically synthesized
atttcttccatgtgtctactca

SEQ ID NO: 1012796 - DNA, 22 bp, Artificial Sequence
  chemically synthesized
tatttcttccatgtgtctactc

SEQ ID NO: 1012797 - DNA, 22 bp, Artificial Sequence
  chemically synthesized
ttatttcttccatgtgtctact

SEQ ID NO: 1012798 - DNA, 22 bp, Artificial Sequence
  chemically synthesized
tttatttcttccatgtgtctac

SEQ ID NO: 1012799 - DNA, 22 bp, Artificial Sequence
  chemically synthesized
aacatgttgagtagacacatgg

SEQ ID NO: 1012800 - DNA, 22 bp, Artificial Sequence
  chemically synthesized
ggtctttttatttcttccatgt

SEQ ID NO: 1012801 - DNA, 22 bp, Artificial Sequence
  chemically synthesized
agtagacacatggaagaaataa

SEQ ID NO: 1012802 - DNA, 22 bp, Artificial Sequence
  chemically synthesized
gaagtaaaagttgggtcttttt

SEQ ID NO: 1012803 - DNA, 22 bp, Artificial Sequence
  chemically synthesized
agaagtaaaagttgggtctttt

SEQ ID NO: 1012804 - DNA, 22 bp, Artificial Sequence
  chemically synthesized
ttagaagtaaaagttgggtctt

SEQ ID NO: 1012805 - DNA, 22 bp, Artificial Sequence
  chemically synthesized
atctcttagaagtaaaagttgg

SEQ ID NO: 1012806 - DNA, 22 bp, Artificial Sequence
  chemically synthesized
catctcttagaagtaaaagttg

SEQ ID NO: 1012807 - DNA, 22 bp, Artificial Sequence
  chemically synthesized
tcatctcttagaagtaaaagtt

SEQ ID NO: 1012808 - DNA, 22 bp, Artificial Sequence
  chemically synthesized
acatcagacattttcatctctt

SEQ ID NO: 1012809 - DNA, 22 bp, Artificial Sequence
  chemically synthesized
aacatcagacattttcatctct

SEQ ID NO: 1012810 - DNA, 22 bp, Artificial Sequence
  chemically synthesized
taacatcagacattttcatctc

SEQ ID NO: 1012811 - DNA, 22 bp, Artificial Sequence
  chemically synthesized
ttaacatcagacattttcatct

SEQ ID NO: 1012812 - DNA, 22 bp, Artificial Sequence
  chemically synthesized
ttacttctaagagatgaaaatg

SEQ ID NO: 1012813 - DNA, 22 bp, Artificial Sequence
  chemically synthesized
tacttctaagagatgaaaatgt

SEQ ID NO: 1012814 - DNA, 22 bp, Artificial Sequence
  chemically synthesized
acttctaagagatgaaaatgtc

SEQ ID NO: 1012815 - DNA, 22 bp, Artificial Sequence
  chemically synthesized
cttctaagagatgaaaatgtct

SEQ ID NO: 1012816 - DNA, 22 bp, Artificial Sequence
  chemically synthesized
ctaagagatgaaaatgtctgat

SEQ ID NO: 1012817 - DNA, 22 bp, Artificial Sequence
  chemically synthesized
taagagatgaaaatgtctgatg

SEQ ID NO: 1012818 - DNA, 22 bp, Artificial Sequence
  chemically synthesized
agagatgaaaatgtctgatgtt

SEQ ID NO: 1012819 - DNA, 22 bp, Artificial Sequence
  chemically synthesized
atcccatgtagtatatattttt

SEQ ID NO: 1012820 - DNA, 22 bp, Artificial Sequence
  chemically synthesized
tggctaatcccatgtagtatat

SEQ ID NO: 1012821 - DNA, 22 bp, Artificial Sequence
  chemically synthesized
atgttaaaaatatatactacat

SEQ ID NO: 1012822 - DNA, 22 bp, Artificial Sequence
  chemically synthesized
atctatggctaatcccatgtag

SEQ ID NO: 1012823 - DNA, 22 bp, Artificial Sequence
  chemically synthesized
aaaatatatactacatgggatt

SEQ ID NO: 1012824 - DNA, 22 bp, Artificial Sequence
  chemically synthesized
aaagtctaatctatggctaatc

SEQ ID NO: 1012825 - DNA, 22 bp, Artificial Sequence
  chemically synthesized
caaagtctaatctatggctaat

SEQ ID NO: 1012826 - DNA, 22 bp, Artificial Sequence
  chemically synthesized
tcaaagtctaatctatggctaa

SEQ ID NO: 1012827 - DNA, 22 bp, Artificial Sequence
  chemically synthesized
ttcaaagtctaatctatggcta

SEQ ID NO: 1012828 - DNA, 22 bp, Artificial Sequence
  chemically synthesized
tttcaaagtctaatctatggct

SEQ ID NO: 1012829 - DNA, 22 bp, Artificial Sequence
  chemically synthesized
catgggattagccatagattag

SEQ ID NO: 1012830 - DNA, 22 bp, Artificial Sequence
  chemically synthesized
atctttttcaaagtctaatcta

SEQ ID NO: 1012831 - DNA, 22 bp, Artificial Sequence
  chemically synthesized
actaatctttttcaaagtctaa

SEQ ID NO: 1012832 - DNA, 22 bp, Artificial Sequence
  chemically synthesized
gccatagattagactttgaaaa

SEQ ID NO: 1012833 - DNA, 22 bp, Artificial Sequence
  chemically synthesized
tcaaattgactaatctttttca

SEQ ID NO: 1012834 - DNA, 22 bp, Artificial Sequence
  chemically synthesized
ttgtcaaattgactaatctttt

SEQ ID NO: 1012835 - DNA, 22 bp, Artificial Sequence
  chemically synthesized
tattgtcaaattgactaatctt

SEQ ID NO: 1012836 - DNA, 22 bp, Artificial Sequence
  chemically synthesized
gactttgaaaaagattagtcaa

SEQ ID NO: 1012837 - DNA, 22 bp, Artificial Sequence
  chemically synthesized
tgaaaaagattagtcaatttga

SEQ ID NO: 1012838 - DNA, 22 bp, Artificial Sequence
  chemically synthesized
gaaaaagattagtcaatttgac

SEQ ID NO: 1012839 - DNA, 22 bp, Artificial Sequence
  chemically synthesized
aaaaagattagtcaatttgaca

SEQ ID NO: 1012840 - DNA, 22 bp, Artificial Sequence
  chemically synthesized
tataatctctattgtcaaattg

SEQ ID NO: 1012841 - DNA, 22 bp, Artificial Sequence
  chemically synthesized
atataatctctattgtcaaatt

SEQ ID NO: 1012842 - DNA, 22 bp, Artificial Sequence
  chemically synthesized
tatataatctctattgtcaaat

SEQ ID NO: 1012843 - DNA, 22 bp, Artificial Sequence
  chemically synthesized
ttttatataatctctattgtca

SEQ ID NO: 1012844 - DNA, 22 bp, Artificial Sequence
  chemically synthesized
gttttatataatctctattgtc

SEQ ID NO: 1012845 - DNA, 22 bp, Artificial Sequence
  chemically synthesized
gtcaatttgacaatagagatta

SEQ ID NO: 1012846 - DNA, 22 bp, Artificial Sequence
  chemically synthesized
taatttgttttatataatctct

SEQ ID NO: 1012847 - DNA, 22 bp, Artificial Sequence
  chemically synthesized
tgtaatttgttttatataatct

SEQ ID NO: 1012848 - DNA, 22 bp, Artificial Sequence
  chemically synthesized
tctgtaatttgttttatataat

SEQ ID NO: 1012849 - DNA, 22 bp, Artificial Sequence
  chemically synthesized
ctctgtaatttgttttatataa

SEQ ID NO: 1012850 - DNA, 22 bp, Artificial Sequence
  chemically synthesized
gacaatagagattatataaaac

SEQ ID NO: 1012851 - DNA, 22 bp, Artificial Sequence
  chemically synthesized
tctctgtaatttgttttatata

SEQ ID NO: 1012852 - DNA, 22 bp, Artificial Sequence
  chemically synthesized
acaatagagattatataaaaca

SEQ ID NO: 1012853 - DNA, 22 bp, Artificial Sequence
  chemically synthesized
ttctctgtaatttgttttatat

SEQ ID NO: 1012854 - DNA, 22 bp, Artificial Sequence
  chemically synthesized
ttttctctgtaatttgttttat

SEQ ID NO: 1012855 - DNA, 22 bp, Artificial Sequence
  chemically synthesized
tcttttctctgtaatttgtttt

SEQ ID NO: 1012856 - DNA, 22 bp, Artificial Sequence
  chemically synthesized
gtctctcttttctctgtaattt

SEQ ID NO: 1012857 - DNA, 22 bp, Artificial Sequence
  chemically synthesized
ggtctctcttttctctgtaatt

SEQ ID NO: 1012858 - DNA, 22 bp, Artificial Sequence
  chemically synthesized
tataaaacaaattacagagaaa

SEQ ID NO: 1012859 - DNA, 22 bp, Artificial Sequence
  chemically synthesized
tttggtctctcttttctctgta

SEQ ID NO: 1012860 - DNA, 22 bp, Artificial Sequence
  chemically synthesized
tctgtttggtctctcttttctc

SEQ ID NO: 1012861 - DNA, 22 bp, Artificial Sequence
  chemically synthesized
attgtctgtttggtctctcttt

SEQ ID NO: 1012862 - DNA, 22 bp, Artificial Sequence
  chemically synthesized
tgttcattgtctgtttggtctc

SEQ ID NO: 1012863 - DNA, 22 bp, Artificial Sequence
  chemically synthesized
cagagaaaagagagaccaaaca

SEQ ID NO: 1012864 - DNA, 22 bp, Artificial Sequence
  chemically synthesized
atgttatgttcattgtctgttt

SEQ ID NO: 1012865 - DNA, 22 bp, Artificial Sequence
  chemically synthesized
actgatgttatgttcattgtct

SEQ ID NO: 1012866 - DNA, 22 bp, Artificial Sequence
  chemically synthesized
ctcactgatgttatgttcattg

SEQ ID NO: 1012867 - DNA, 22 bp, Artificial Sequence
  chemically synthesized
aagtgccccactactcactgat

SEQ ID NO: 1012868 - DNA, 22 bp, Artificial Sequence
  chemically synthesized
aaagtgccccactactcactga

SEQ ID NO: 1012869 - DNA, 22 bp, Artificial Sequence
  chemically synthesized
cttaaagtgccccactactcac

SEQ ID NO: 1012870 - DNA, 22 bp, Artificial Sequence
  chemically synthesized
ggctccttaaagtgccccacta

SEQ ID NO: 1012871 - DNA, 22 bp, Artificial Sequence
  chemically synthesized
ttaggctccttaaagtgcccca

SEQ ID NO: 1012872 - DNA, 22 bp, Artificial Sequence
  chemically synthesized
attaggctccttaaagtgcccc

SEQ ID NO: 1012873 - DNA, 22 bp, Artificial Sequence
  chemically synthesized
tacatttattaggctccttaaa

SEQ ID NO: 1012874 - DNA, 22 bp, Artificial Sequence
  chemically synthesized
caattgtacatttattaggctc

SEQ ID NO: 1012875 - DNA, 22 bp, Artificial Sequence
  chemically synthesized
taaggagcctaataaatgtaca

SEQ ID NO: 1012876 - DNA, 22 bp, Artificial Sequence
  chemically synthesized
aaggagcctaataaatgtacaa

SEQ ID NO: 1012877 - DNA, 22 bp, Artificial Sequence
  chemically synthesized
aggagcctaataaatgtacaat

SEQ ID NO: 1012878 - DNA, 22 bp, Artificial Sequence
  chemically synthesized
aaaaaaatggaactccaattgt

SEQ ID NO: 1012879 - DNA, 22 bp, Artificial Sequence
  chemically synthesized
aaaaaaaatggaactccaattg

SEQ ID NO: 1012880 - DNA, 22 bp, Artificial Sequence
  chemically synthesized
taaaaaaaatggaactccaatt

SEQ ID NO: 1012881 - DNA, 22 bp, Artificial Sequence
  chemically synthesized
ttaaaaaaaatggaactccaat

SEQ ID NO: 1012882 - DNA, 22 bp, Artificial Sequence
  chemically synthesized
ataaatgtacaattggagttcc

SEQ ID NO: 1012883 - DNA, 22 bp, Artificial Sequence
  chemically synthesized
tttaaaaaaaatggaactccaa

SEQ ID NO: 1012884 - DNA, 22 bp, Artificial Sequence
  chemically synthesized
ttttaaaaaaaatggaactcca

SEQ ID NO: 1012885 - DNA, 22 bp, Artificial Sequence
  chemically synthesized
aaccatttttttaaaaaaaatg

SEQ ID NO: 1012886 - DNA, 22 bp, Artificial Sequence
  chemically synthesized
caaccatttttttaaaaaaaat

SEQ ID NO: 1012887 - DNA, 22 bp, Artificial Sequence
  chemically synthesized
tcaaccatttttttaaaaaaaa

SEQ ID NO: 1012888 - DNA, 22 bp, Artificial Sequence
  chemically synthesized
gagttccattttttttaaaaaa

SEQ ID NO: 1012889 - DNA, 22 bp, Artificial Sequence
  chemically synthesized
gaaacctttcaaccattttttt

SEQ ID NO: 1012890 - DNA, 22 bp, Artificial Sequence
  chemically synthesized
agaaacctttcaaccatttttt

SEQ ID NO: 1012891 - DNA, 22 bp, Artificial Sequence
  chemically synthesized
cattttttttaaaaaaatggtt

SEQ ID NO: 1012892 - DNA, 22 bp, Artificial Sequence
  chemically synthesized
tttttaaaaaaatggttgaaag

SEQ ID NO: 1012893 - DNA, 22 bp, Artificial Sequence
  chemically synthesized
ttttaaaaaaatggttgaaagg

SEQ ID NO: 1012894 - DNA, 22 bp, Artificial Sequence
  chemically synthesized
tttaaaaaaatggttgaaaggt

SEQ ID NO: 1012895 - DNA, 22 bp, Artificial Sequence
  chemically synthesized
ttaaaaaaatggttgaaaggtt

SEQ ID NO: 1012896 - DNA, 22 bp, Artificial Sequence
  chemically synthesized
atcaaatttagaaacctttcaa

SEQ ID NO: 1012897 - DNA, 22 bp, Artificial Sequence
  chemically synthesized
taaaaaaatggttgaaaggttt

SEQ ID NO: 1012898 - DNA, 22 bp, Artificial Sequence
  chemically synthesized
catcaaatttagaaacctttca

SEQ ID NO: 1012899 - DNA, 22 bp, Artificial Sequence
  chemically synthesized
aaaaaaatggttgaaaggtttc

SEQ ID NO: 1012900 - DNA, 22 bp, Artificial Sequence
  chemically synthesized
aaaaaatggttgaaaggtttct

SEQ ID NO: 1012901 - DNA, 22 bp, Artificial Sequence
  chemically synthesized
acatttcatcaaatttagaaac

SEQ ID NO: 1012902 - DNA, 22 bp, Artificial Sequence
  chemically synthesized
aacatttcatcaaatttagaaa

SEQ ID NO: 1012903 - DNA, 22 bp, Artificial Sequence
  chemically synthesized
aaaggtttctaaatttgatgaa

SEQ ID NO: 1012904 - DNA, 22 bp, Artificial Sequence
  chemically synthesized
tgcatttaacatttcatcaaat

SEQ ID NO: 1012905 - DNA, 22 bp, Artificial Sequence
  chemically synthesized
aatctgtgcatttaacatttca

SEQ ID NO: 1012906 - DNA, 22 bp, Artificial Sequence
  chemically synthesized
gaatctgtgcatttaacatttc

SEQ ID NO: 1012907 - DNA, 22 bp, Artificial Sequence
  chemically synthesized
ctaaatttgatgaaatgttaaa

SEQ ID NO: 1012908 - DNA, 22 bp, Artificial Sequence
  chemically synthesized
taaatttgatgaaatgttaaat

SEQ ID NO: 1012909 - DNA, 22 bp, Artificial Sequence
  chemically synthesized
ttgaatctgtgcatttaacatt

SEQ ID NO: 1012910 - DNA, 22 bp, Artificial Sequence
  chemically synthesized
aatttgatgaaatgttaaatgc

SEQ ID NO: 1012911 - DNA, 22 bp, Artificial Sequence
  chemically synthesized
agctcttgaatctgtgcattta

SEQ ID NO: 1012912 - DNA, 22 bp, Artificial Sequence
  chemically synthesized
gatgaaatgttaaatgcacaga

SEQ ID NO: 1012913 - DNA, 22 bp, Artificial Sequence
  chemically synthesized
atgaaatgttaaatgcacagat

SEQ ID NO: 1012914 - DNA, 22 bp, Artificial Sequence
  chemically synthesized
aagtcagttaagctcttgaatc

SEQ ID NO: 1012915 - DNA, 22 bp, Artificial Sequence
  chemically synthesized
gaagtcagttaagctcttgaat

SEQ ID NO: 1012916 - DNA, 22 bp, Artificial Sequence
  chemically synthesized
ttgaagtcagttaagctcttga

SEQ ID NO: 1012917 - DNA, 22 bp, Artificial Sequence
  chemically synthesized
aatgcacagattcaagagctta

SEQ ID NO: 1012918 - DNA, 22 bp, Artificial Sequence
  chemically synthesized
ttcttgaagtcagttaagctct

SEQ ID NO: 1012919 - DNA, 22 bp, Artificial Sequence
  chemically synthesized
gttcttgaagtcagttaagctc

SEQ ID NO: 1012920 - DNA, 22 bp, Artificial Sequence
  chemically synthesized
ttgttcttgaagtcagttaagc

SEQ ID NO: 1012921 - DNA, 22 bp, Artificial Sequence
  chemically synthesized
cttgttcttgaagtcagttaag

SEQ ID NO: 1012922 - DNA, 22 bp, Artificial Sequence
  chemically synthesized
atgtttcttgttcttgaagtca

SEQ ID NO: 1012923 - DNA, 22 bp, Artificial Sequence
  chemically synthesized
aagagcttaactgacttcaaga

SEQ ID NO: 1012924 - DNA, 22 bp, Artificial Sequence
  chemically synthesized
catgtttcttgttcttgaagtc

SEQ ID NO: 1012925 - DNA, 22 bp, Artificial Sequence
  chemically synthesized
ttcatgtttcttgttcttgaag

SEQ ID NO: 1012926 - DNA, 22 bp, Artificial Sequence
  chemically synthesized
cttcatgtttcttgttcttgaa

SEQ ID NO: 1012927 - DNA, 22 bp, Artificial Sequence
  chemically synthesized
tcttcatgtttcttgttcttga

SEQ ID NO: 1012928 - DNA, 22 bp, Artificial Sequence
  chemically synthesized
aactgacttcaagaacaagaaa

SEQ ID NO: 1012929 - DNA, 22 bp, Artificial Sequence
  chemically synthesized
actgacttcaagaacaagaaac

SEQ ID NO: 1012930 - DNA, 22 bp, Artificial Sequence
  chemically synthesized
acttcaagaacaagaaacatga

SEQ ID NO: 1012931 - DNA, 22 bp, Artificial Sequence
  chemically synthesized
gtgtagttttcttcatgtttct

SEQ ID NO: 1012932 - DNA, 22 bp, Artificial Sequence
  chemically synthesized
ggtgtagttttcttcatgtttc

SEQ ID NO: 1012933 - DNA, 22 bp, Artificial Sequence
  chemically synthesized
caagaacaagaaacatgaagaa

SEQ ID NO: 1012934 - DNA, 22 bp, Artificial Sequence
  chemically synthesized
aagaacaagaaacatgaagaaa

SEQ ID NO: 1012935 - DNA, 22 bp, Artificial Sequence
  chemically synthesized
atgtaacttggtgtagttttct

SEQ ID NO: 1012936 - DNA, 22 bp, Artificial Sequence
  chemically synthesized
gatgtaacttggtgtagttttc

SEQ ID NO: 1012937 - DNA, 22 bp, Artificial Sequence
  chemically synthesized
tgatgtaacttggtgtagtttt

SEQ ID NO: 1012938 - DNA, 22 bp, Artificial Sequence
  chemically synthesized
ttttgatgtaacttggtgtagt

SEQ ID NO: 1012939 - DNA, 22 bp, Artificial Sequence
  chemically synthesized
gttttgatgtaacttggtgtag

SEQ ID NO: 1012940 - DNA, 22 bp, Artificial Sequence
  chemically synthesized
cgatgaagcaatttgttttgat

SEQ ID NO: 1012941 - DNA, 22 bp, Artificial Sequence
  chemically synthesized
caccaagttacatcaaaacaaa

SEQ ID NO: 1012942 - DNA, 22 bp, Artificial Sequence
  chemically synthesized
acgatgaagcaatttgttttga

SEQ ID NO: 1012943 - DNA, 22 bp, Artificial Sequence
  chemically synthesized
tacgatgaagcaatttgttttg

SEQ ID NO: 1012944 - DNA, 22 bp, Artificial Sequence
  chemically synthesized
ttacgatgaagcaatttgtttt

SEQ ID NO: 1012945 - DNA, 22 bp, Artificial Sequence
  chemically synthesized
catcaaaacaaattgcttcatc

SEQ ID NO: 1012946 - DNA, 22 bp, Artificial Sequence
  chemically synthesized
gggagtacttttacgatgaagc

SEQ ID NO: 1012947 - DNA, 22 bp, Artificial Sequence
  chemically synthesized
actagggagtacttttacgatg

SEQ ID NO: 1012948 - DNA, 22 bp, Artificial Sequence
  chemically synthesized
cttcatcgtaaaagtactccct

SEQ ID NO: 1012949 - DNA, 22 bp, Artificial Sequence
  chemically synthesized
catcgtaaaagtactccctagt

SEQ ID NO: 1012950 - DNA, 22 bp, Artificial Sequence
  chemically synthesized
atcgtaaaagtactccctagtt

SEQ ID NO: 1012951 - DNA, 22 bp, Artificial Sequence
  chemically synthesized
tatgtagaaggttaactaggga

SEQ ID NO: 1012952 - DNA, 22 bp, Artificial Sequence
  chemically synthesized
gtatgtagaaggttaactaggg

SEQ ID NO: 1012953 - DNA, 22 bp, Artificial Sequence
  chemically synthesized
cctagttaaccttctacataca

SEQ ID NO: 1012954 - DNA, 22 bp, Artificial Sequence
  chemically synthesized
taaaatggagatttgtatgtag

SEQ ID NO: 1012955 - DNA, 22 bp, Artificial Sequence
  chemically synthesized
gttaaccttctacatacaaatc

SEQ ID NO: 1012956 - DNA, 22 bp, Artificial Sequence
  chemically synthesized
accttctacatacaaatctcca

SEQ ID NO: 1012957 - DNA, 22 bp, Artificial Sequence
  chemically synthesized
gaaagccattgtaaaatggaga

SEQ ID NO: 1012958 - DNA, 22 bp, Artificial Sequence
  chemically synthesized
ctacatacaaatctccatttta

SEQ ID NO: 1012959 - DNA, 22 bp, Artificial Sequence
  chemically synthesized
ggaaagccattgtaaaatggag

SEQ ID NO: 1012960 - DNA, 22 bp, Artificial Sequence
  chemically synthesized
tacatacaaatctccattttac

SEQ ID NO: 1012961 - DNA, 22 bp, Artificial Sequence
  chemically synthesized
ttggaaagccattgtaaaatgg

SEQ ID NO: 1012962 - DNA, 22 bp, Artificial Sequence
  chemically synthesized
catacaaatctccattttacaa

SEQ ID NO: 1012963 - DNA, 22 bp, Artificial Sequence
  chemically synthesized
cttggaaagccattgtaaaatg

SEQ ID NO: 1012964 - DNA, 22 bp, Artificial Sequence
  chemically synthesized
ggtttcttggaaagccattgta

SEQ ID NO: 1012965 - DNA, 22 bp, Artificial Sequence
  chemically synthesized
aggctgggtttcttggaaagcc

SEQ ID NO: 1012966 - DNA, 22 bp, Artificial Sequence
  chemically synthesized
cattttacaatggctttccaag

SEQ ID NO: 1012967 - DNA, 22 bp, Artificial Sequence
  chemically synthesized
caggctgggtttcttggaaagc

SEQ ID NO: 1012968 - DNA, 22 bp, Artificial Sequence
  chemically synthesized
tacaatggctttccaagaaacc

SEQ ID NO: 1012969 - DNA, 22 bp, Artificial Sequence
  chemically synthesized
acaatggctttccaagaaaccc

SEQ ID NO: 1012970 - DNA, 22 bp, Artificial Sequence
  chemically synthesized
caatggctttccaagaaaccca

SEQ ID NO: 1012971 - DNA, 22 bp, Artificial Sequence
  chemically synthesized
catatttcaggctgggtttctt

SEQ ID NO: 1012972 - DNA, 22 bp, Artificial Sequence
  chemically synthesized
ctacatatttcaggctgggttt

SEQ ID NO: 1012973 - DNA, 22 bp, Artificial Sequence
  chemically synthesized
gctacatatttcaggctgggtt

SEQ ID NO: 1012974 - DNA, 22 bp, Artificial Sequence
  chemically synthesized
tgctacatatttcaggctgggt

SEQ ID NO: 1012975 - DNA, 22 bp, Artificial Sequence
  chemically synthesized
tccaagaaacccagcctgaaat

SEQ ID NO: 1012976 - DNA, 22 bp, Artificial Sequence
  chemically synthesized
ccaagaaacccagcctgaaata

SEQ ID NO: 1012977 - DNA, 22 bp, Artificial Sequence
  chemically synthesized
caagaaacccagcctgaaatat

SEQ ID NO: 1012978 - DNA, 22 bp, Artificial Sequence
  chemically synthesized
agtatgaattttgctacatatt

SEQ ID NO: 1012979 - DNA, 22 bp, Artificial Sequence
  chemically synthesized
ttcagtatgaattttgctacat

SEQ ID NO: 1012980 - DNA, 22 bp, Artificial Sequence
  chemically synthesized
aaatatgtagcaaaattcatac

SEQ ID NO: 1012981 - DNA, 22 bp, Artificial Sequence
  chemically synthesized
gaggatagttgttcagtatgaa

SEQ ID NO: 1012982 - DNA, 22 bp, Artificial Sequence
  chemically synthesized
ggaggatagttgttcagtatga

SEQ ID NO: 1012983 - DNA, 22 bp, Artificial Sequence
  chemically synthesized
tggaggatagttgttcagtatg

SEQ ID NO: 1012984 - DNA, 22 bp, Artificial Sequence
  chemically synthesized
tttggaggatagttgttcagta

SEQ ID NO: 1012985 - DNA, 22 bp, Artificial Sequence
  chemically synthesized
ctctttggaggatagttgttca

SEQ ID NO: 1012986 - DNA, 22 bp, Artificial Sequence
  chemically synthesized
tactctttggaggatagttgtt

SEQ ID NO: 1012987 - DNA, 22 bp, Artificial Sequence
  chemically synthesized
cattctactctttggaggatag

SEQ ID NO: 1012988 - DNA, 22 bp, Artificial Sequence
  chemically synthesized
atactgaacaactatcctccaa

SEQ ID NO: 1012989 - DNA, 22 bp, Artificial Sequence
  chemically synthesized
aacaactatcctccaaagagta

SEQ ID NO: 1012990 - DNA, 22 bp, Artificial Sequence
  chemically synthesized
taaaagtacctccattctactc

SEQ ID NO: 1012991 - DNA, 22 bp, Artificial Sequence
  chemically synthesized
gtaaaagtacctccattctact

SEQ ID NO: 1012992 - DNA, 22 bp, Artificial Sequence
  chemically synthesized
tcctccaaagagtagaatggag

SEQ ID NO: 1012993 - DNA, 22 bp, Artificial Sequence
  chemically synthesized
caaagagtagaatggaggtact

SEQ ID NO: 1012994 - DNA, 22 bp, Artificial Sequence
  chemically synthesized
tgaaaaaaatcaagtaacatag

SEQ ID NO: 1012995 - DNA, 22 bp, Artificial Sequence
  chemically synthesized
ttacaaatttctatgttacttg

SEQ ID NO: 1012996 - DNA, 22 bp, Artificial Sequence
  chemically synthesized
tacaaatttctatgttacttga

SEQ ID NO: 1012997 - DNA, 22 bp, Artificial Sequence
  chemically synthesized
ttgtgaaaaaaatcaagtaaca

SEQ ID NO: 1012998 - DNA, 22 bp, Artificial Sequence
  chemically synthesized
acaaatttctatgttacttgat

SEQ ID NO: 1012999 - DNA, 22 bp, Artificial Sequence
  chemically synthesized
attgtgaaaaaaatcaagtaac

SEQ ID NO: 1013000 - DNA, 22 bp, Artificial Sequence
  chemically synthesized
caaatttctatgttacttgatt

SEQ ID NO: 1013001 - DNA, 22 bp, Artificial Sequence
  chemically synthesized
gtacttattgtgaaaaaaatca

SEQ ID NO: 1013002 - DNA, 22 bp, Artificial Sequence
  chemically synthesized
ctatgttacttgatttttttca

SEQ ID NO: 1013003 - DNA, 22 bp, Artificial Sequence
  chemically synthesized
tatgttacttgatttttttcac

SEQ ID NO: 1013004 - DNA, 22 bp, Artificial Sequence
  chemically synthesized
tgttacttgatttttttcacaa

SEQ ID NO: 1013005 - DNA, 22 bp, Artificial Sequence
  chemically synthesized
tcaaattagtacttattgtgaa

SEQ ID NO: 1013006 - DNA, 22 bp, Artificial Sequence
  chemically synthesized
cttgatttttttcacaataagt

SEQ ID NO: 1013007 - DNA, 22 bp, Artificial Sequence
  chemically synthesized
ttatcaaattagtacttattgt

SEQ ID NO: 1013008 - DNA, 22 bp, Artificial Sequence
  chemically synthesized
attatcaaattagtacttattg

SEQ ID NO: 1013009 - DNA, 22 bp, Artificial Sequence
  chemically synthesized
gatttttttcacaataagtact

SEQ ID NO: 1013010 - DNA, 22 bp, Artificial Sequence
  chemically synthesized
tattatcaaattagtacttatt

SEQ ID NO: 1013011 - DNA, 22 bp, Artificial Sequence
  chemically synthesized
atttttttcacaataagtacta

SEQ ID NO: 1013012 - DNA, 22 bp, Artificial Sequence
  chemically synthesized
ttttcacaataagtactaattt

SEQ ID NO: 1013013 - DNA, 22 bp, Artificial Sequence
  chemically synthesized
tattttattatcaaattagtac

SEQ ID NO: 1013014 - DNA, 22 bp, Artificial Sequence
  chemically synthesized
tttcacaataagtactaatttg

SEQ ID NO: 1013015 - DNA, 22 bp, Artificial Sequence
  chemically synthesized
atattttattatcaaattagta

SEQ ID NO: 1013016 - DNA, 22 bp, Artificial Sequence
  chemically synthesized
ttcacaataagtactaatttga

SEQ ID NO: 1013017 - DNA, 22 bp, Artificial Sequence
  chemically synthesized
tcacaataagtactaatttgat

SEQ ID NO: 1013018 - DNA, 22 bp, Artificial Sequence
  chemically synthesized
cacaataagtactaatttgata

SEQ ID NO: 1013019 - DNA, 22 bp, Artificial Sequence
  chemically synthesized
acaataagtactaatttgataa

SEQ ID NO: 1013020 - DNA, 22 bp, Artificial Sequence
  chemically synthesized
aatttatattttattatcaaat

SEQ ID NO: 1013021 - DNA, 22 bp, Artificial Sequence
  chemically synthesized
caatttatattttattatcaaa

SEQ ID NO: 1013022 - DNA, 22 bp, Artificial Sequence
  chemically synthesized
tatatttcaatttatattttat

SEQ ID NO: 1013023 - DNA, 22 bp, Artificial Sequence
  chemically synthesized
atttgataataaaatataaatt

SEQ ID NO: 1013024 - DNA, 22 bp, Artificial Sequence
  chemically synthesized
gataataaaatataaattgaaa

SEQ ID NO: 1013025 - DNA, 22 bp, Artificial Sequence
  chemically synthesized
ataataaaatataaattgaaat

SEQ ID NO: 1013026 - DNA, 22 bp, Artificial Sequence
  chemically synthesized
aatgatatccaacccaaggtag

SEQ ID NO: 1013027 - DNA, 22 bp, Artificial Sequence
  chemically synthesized
caatgatatccaacccaaggta

SEQ ID NO: 1013028 - DNA, 22 bp, Artificial Sequence
  chemically synthesized
aaatatataactaccttgggtt

SEQ ID NO: 1013029 - DNA, 22 bp, Artificial Sequence
  chemically synthesized
tcaatgatatccaacccaaggt

SEQ ID NO: 1013030 - DNA, 22 bp, Artificial Sequence
  chemically synthesized
ccattttcaatgatatccaacc

SEQ ID NO: 1013031 - DNA, 22 bp, Artificial Sequence
  chemically synthesized
gccattttcaatgatatccaac

SEQ ID NO: 1013032 - DNA, 22 bp, Artificial Sequence
  chemically synthesized
ccttgggttggatatcattgaa

SEQ ID NO: 1013033 - DNA, 22 bp, Artificial Sequence
  chemically synthesized
gggttggatatcattgaaaatg

SEQ ID NO: 1013034 - DNA, 22 bp, Artificial Sequence
  chemically synthesized
ggttggatatcattgaaaatgg

SEQ ID NO: 1013035 - DNA, 22 bp, Artificial Sequence
  chemically synthesized
gatatcattgaaaatggcaagt

SEQ ID NO: 1013036 - DNA, 22 bp, Artificial Sequence
  chemically synthesized
gggtagatatagaaaccacttg

SEQ ID NO: 1013037 - DNA, 22 bp, Artificial Sequence
  chemically synthesized
ggggtagatatagaaaccactt

SEQ ID NO: 1013038 - DNA, 22 bp, Artificial Sequence
  chemically synthesized
tggggtagatatagaaaccact

SEQ ID NO: 1013039 - DNA, 22 bp, Artificial Sequence
  chemically synthesized
aaaatggcaagtggtttctata

SEQ ID NO: 1013040 - DNA, 22 bp, Artificial Sequence
  chemically synthesized
tataaaatgttttggggtagat

SEQ ID NO: 1013041 - DNA, 22 bp, Artificial Sequence
  chemically synthesized
gagttatataaaatgttttggg

SEQ ID NO: 1013042 - DNA, 22 bp, Artificial Sequence
  chemically synthesized
ctatatctaccccaaaacattt

SEQ ID NO: 1013043 - DNA, 22 bp, Artificial Sequence
  chemically synthesized
tatatctaccccaaaacatttt

SEQ ID NO: 1013044 - DNA, 22 bp, Artificial Sequence
  chemically synthesized
tatctaccccaaaacattttat

SEQ ID NO: 1013045 - DNA, 22 bp, Artificial Sequence
  chemically synthesized
ccccaaaacattttatataact

SEQ ID NO: 1013046 - DNA, 22 bp, Artificial Sequence
  chemically synthesized
agaggcagaaacatattagagt

SEQ ID NO: 1013047 - DNA, 22 bp, Artificial Sequence
  chemically synthesized
cctgagaggcagaaacatatta

SEQ ID NO: 1013048 - DNA, 22 bp, Artificial Sequence
  chemically synthesized
tatataactctaatatgtttct

SEQ ID NO: 1013049 - DNA, 22 bp, Artificial Sequence
  chemically synthesized
tgcctgagaggcagaaacatat

SEQ ID NO: 1013050 - DNA, 22 bp, Artificial Sequence
  chemically synthesized
atataactctaatatgtttctg

SEQ ID NO: 1013051 - DNA, 22 bp, Artificial Sequence
  chemically synthesized
ctgcctgagaggcagaaacata

SEQ ID NO: 1013052 - DNA, 22 bp, Artificial Sequence
  chemically synthesized
tataactctaatatgtttctgc

SEQ ID NO: 1013053 - DNA, 22 bp, Artificial Sequence
  chemically synthesized
taatatgtttctgcctctcagg

SEQ ID NO: 1013054 - DNA, 22 bp, Artificial Sequence
  chemically synthesized
atatgtttctgcctctcaggca

SEQ ID NO: 1013055 - DNA, 22 bp, Artificial Sequence
  chemically synthesized
ctgcctctcaggcagaaacccc

SEQ ID NO: 1013056 - DNA, 22 bp, Artificial Sequence
  chemically synthesized
atgtagcataatggggtttctg

SEQ ID NO: 1013057 - DNA, 22 bp, Artificial Sequence
  chemically synthesized
tgcctctcaggcagaaacccca

SEQ ID NO: 1013058 - DNA, 22 bp, Artificial Sequence
  chemically synthesized
cctctcaggcagaaaccccatt

SEQ ID NO: 1013059 - DNA, 22 bp, Artificial Sequence
  chemically synthesized
ggctaatgtagcataatggggt

SEQ ID NO: 1013060 - DNA, 22 bp, Artificial Sequence
  chemically synthesized
gggctaatgtagcataatgggg

SEQ ID NO: 1013061 - DNA, 22 bp, Artificial Sequence
  chemically synthesized
tcaggcagaaaccccattatgc

SEQ ID NO: 1013062 - DNA, 22 bp, Artificial Sequence
  chemically synthesized
tgggctaatgtagcataatggg

SEQ ID NO: 1013063 - DNA, 22 bp, Artificial Sequence
  chemically synthesized
aggcagaaaccccattatgcta

SEQ ID NO: 1013064 - DNA, 22 bp, Artificial Sequence
  chemically synthesized
aagtgaattttgggctaatgta

SEQ ID NO: 1013065 - DNA, 22 bp, Artificial Sequence
  chemically synthesized
tgctacattagcccaaaattca

SEQ ID NO: 1013066 - DNA, 22 bp, Artificial Sequence
  chemically synthesized
aaaatagcactgaagtgaattt

SEQ ID NO: 1013067 - DNA, 22 bp, Artificial Sequence
  chemically synthesized
aaaaatagcactgaagtgaatt

SEQ ID NO: 1013068 - DNA, 22 bp, Artificial Sequence
  chemically synthesized
cattagcccaaaattcacttca

SEQ ID NO: 1013069 - DNA, 22 bp, Artificial Sequence
  chemically synthesized
taaaaatagcactgaagtgaat

SEQ ID NO: 1013070 - DNA, 22 bp, Artificial Sequence
  chemically synthesized
gcccaaaattcacttcagtgct

SEQ ID NO: 1013071 - DNA, 22 bp, Artificial Sequence
  chemically synthesized
acttcagtgctatttttaaaat

SEQ ID NO: 1013072 - DNA, 22 bp, Artificial Sequence
  chemically synthesized
atatagaagatacattttaaaa

SEQ ID NO: 1013073 - DNA, 22 bp, Artificial Sequence
  chemically synthesized
aatatagaagatacattttaaa

SEQ ID NO: 1013074 - DNA, 22 bp, Artificial Sequence
  chemically synthesized
taatatagaagatacattttaa

SEQ ID NO: 1013075 - DNA, 22 bp, Artificial Sequence
  chemically synthesized
cagtgctatttttaaaatgtat

SEQ ID NO: 1013076 - DNA, 22 bp, Artificial Sequence
  chemically synthesized
agtgctatttttaaaatgtatc

SEQ ID NO: 1013077 - DNA, 22 bp, Artificial Sequence
  chemically synthesized
ctttaatatagaagatacattt

SEQ ID NO: 1013078 - DNA, 22 bp, Artificial Sequence
  chemically synthesized
tttttaaaatgtatcttctata

SEQ ID NO: 1013079 - DNA, 22 bp, Artificial Sequence
  chemically synthesized
ccaatctgctttaatatagaag

SEQ ID NO: 1013080 - DNA, 22 bp, Artificial Sequence
  chemically synthesized
ttaaaatgtatcttctatatta

SEQ ID NO: 1013081 - DNA, 22 bp, Artificial Sequence
  chemically synthesized
taaaatgtatcttctatattaa

SEQ ID NO: 1013082 - DNA, 22 bp, Artificial Sequence
  chemically synthesized
aaaatgtatcttctatattaaa

SEQ ID NO: 1013083 - DNA, 22 bp, Artificial Sequence
  chemically synthesized
aaatgtatcttctatattaaag

SEQ ID NO: 1013084 - DNA, 22 bp, Artificial Sequence
  chemically synthesized
ctatattaaagcagattgggaa

SEQ ID NO: 1013085 - DNA, 22 bp, Artificial Sequence
  chemically synthesized
tatattaaagcagattgggaat

SEQ ID NO: 1013086 - DNA, 22 bp, Artificial Sequence
  chemically synthesized
tattaaagcagattgggaatcc

SEQ ID NO: 1013087 - DNA, 22 bp, Artificial Sequence
  chemically synthesized
aagcagattgggaatccataca

SEQ ID NO: 1013088 - DNA, 22 bp, Artificial Sequence
  chemically synthesized
tatagagaggaaatgtatggat

SEQ ID NO: 1013089 - DNA, 22 bp, Artificial Sequence
  chemically synthesized
gtatagagaggaaatgtatgga

SEQ ID NO: 1013090 - DNA, 22 bp, Artificial Sequence
  chemically synthesized
gcatttgtatagagaggaaatg

SEQ ID NO: 1013091 - DNA, 22 bp, Artificial Sequence
  chemically synthesized
ggaatccatacatttcctctct

SEQ ID NO: 1013092 - DNA, 22 bp, Artificial Sequence
  chemically synthesized
cctctctatacaaatgccaacg

SEQ ID NO: 1013093 - DNA, 22 bp, Artificial Sequence
  chemically synthesized
catgcacaccagcgttggcatt

SEQ ID NO: 1013094 - DNA, 22 bp, Artificial Sequence
  chemically synthesized
ctctctatacaaatgccaacgc

SEQ ID NO: 1013095 - DNA, 22 bp, Artificial Sequence
  chemically synthesized
gcatgcacaccagcgttggcat

SEQ ID NO: 1013096 - DNA, 22 bp, Artificial Sequence
  chemically synthesized
tctatacaaatgccaacgctgg

SEQ ID NO: 1013097 - DNA, 22 bp, Artificial Sequence
  chemically synthesized
tatacaaatgccaacgctggtg

SEQ ID NO: 1013098 - DNA, 22 bp, Artificial Sequence
  chemically synthesized
tacaaatgccaacgctggtgtg

SEQ ID NO: 1013099 - DNA, 22 bp, Artificial Sequence
  chemically synthesized
tatgtgtatcaatcaaacttgc

SEQ ID NO: 1013100 - DNA, 22 bp, Artificial Sequence
  chemically synthesized
gtgtgcatgcaagtttgattga

SEQ ID NO: 1013101 - DNA, 22 bp, Artificial Sequence
  chemically synthesized
tgtaattatatgtgtatcaatc

SEQ ID NO: 1013102 - DNA, 22 bp, Artificial Sequence
  chemically synthesized
gtgtaattatatgtgtatcaat

SEQ ID NO: 1013103 - DNA, 22 bp, Artificial Sequence
  chemically synthesized
aaaccttgtgtaattatatgtg

SEQ ID NO: 1013104 - DNA, 22 bp, Artificial Sequence
  chemically synthesized
aaaaccttgtgtaattatatgt

SEQ ID NO: 1013105 - DNA, 22 bp, Artificial Sequence
  chemically synthesized
taaaaccttgtgtaattatatg

SEQ ID NO: 1013106 - DNA, 22 bp, Artificial Sequence
  chemically synthesized
ttaaaaccttgtgtaattatat

SEQ ID NO: 1013107 - DNA, 22 bp, Artificial Sequence
  chemically synthesized
gattgatacacatataattaca

SEQ ID NO: 1013108 - DNA, 22 bp, Artificial Sequence
  chemically synthesized
attgatacacatataattacac

SEQ ID NO: 1013109 - DNA, 22 bp, Artificial Sequence
  chemically synthesized
atacacatataattacacaagg

SEQ ID NO: 1013110 - DNA, 22 bp, Artificial Sequence
  chemically synthesized
aacacagaaaatatttttaaaa

SEQ ID NO: 1013111 - DNA, 22 bp, Artificial Sequence
  chemically synthesized
aaacacagaaaatatttttaaa

SEQ ID NO: 1013112 - DNA, 22 bp, Artificial Sequence
  chemically synthesized
tttaaacacagaaaatattttt

SEQ ID NO: 1013113 - DNA, 22 bp, Artificial Sequence
  chemically synthesized
cacaaggttttaaaaatatttt

SEQ ID NO: 1013114 - DNA, 22 bp, Artificial Sequence
  chemically synthesized
taaaaatattttctgtgtttaa

SEQ ID NO: 1013115 - DNA, 22 bp, Artificial Sequence
  chemically synthesized
aaaaatattttctgtgtttaaa

SEQ ID NO: 1013116 - DNA, 22 bp, Artificial Sequence
  chemically synthesized
tatgataagctatttaaacaca

SEQ ID NO: 1013117 - DNA, 22 bp, Artificial Sequence
  chemically synthesized
aaaatattttctgtgtttaaat

SEQ ID NO: 1013118 - DNA, 22 bp, Artificial Sequence
  chemically synthesized
atatgataagctatttaaacac

SEQ ID NO: 1013119 - DNA, 22 bp, Artificial Sequence
  chemically synthesized
tttatatgataagctatttaaa

SEQ ID NO: 1013120 - DNA, 22 bp, Artificial Sequence
  chemically synthesized
tctgtgtttaaatagcttatca

SEQ ID NO: 1013121 - DNA, 22 bp, Artificial Sequence
  chemically synthesized
ctgtgtttaaatagcttatcat

SEQ ID NO: 1013122 - DNA, 22 bp, Artificial Sequence
  chemically synthesized
tgtgtttaaatagcttatcata

SEQ ID NO: 1013123 - DNA, 22 bp, Artificial Sequence
  chemically synthesized
aacacctatttatatgataagc

SEQ ID NO: 1013124 - DNA, 22 bp, Artificial Sequence
  chemically synthesized
aaacacctatttatatgataag

SEQ ID NO: 1013125 - DNA, 22 bp, Artificial Sequence
  chemically synthesized
tgtttaaatagcttatcatata

SEQ ID NO: 1013126 - DNA, 22 bp, Artificial Sequence
  chemically synthesized
aaatagcttatcatataaatag

SEQ ID NO: 1013127 - DNA, 22 bp, Artificial Sequence
  chemically synthesized
aatagcttatcatataaatagg

SEQ ID NO: 1013128 - DNA, 22 bp, Artificial Sequence
  chemically synthesized
agcatttaaacacctatttata

SEQ ID NO: 1013129 - DNA, 22 bp, Artificial Sequence
  chemically synthesized
atcatataaataggtgtttaaa

SEQ ID NO: 1013130 - DNA, 22 bp, Artificial Sequence
  chemically synthesized
aggagttaagcatttaaacacc

SEQ ID NO: 1013131 - DNA, 22 bp, Artificial Sequence
  chemically synthesized
tcatataaataggtgtttaaat

SEQ ID NO: 1013132 - DNA, 22 bp, Artificial Sequence
  chemically synthesized
atattaaggagttaagcattta

SEQ ID NO: 1013133 - DNA, 22 bp, Artificial Sequence
  chemically synthesized
aatattaaggagttaagcattt

SEQ ID NO: 1013134 - DNA, 22 bp, Artificial Sequence
  chemically synthesized
taatattaaggagttaagcatt

SEQ ID NO: 1013135 - DNA, 22 bp, Artificial Sequence
  chemically synthesized
aaatgcttaactccttaatatt

SEQ ID NO: 1013136 - DNA, 22 bp, Artificial Sequence
  chemically synthesized
aatgcttaactccttaatatta

SEQ ID NO: 1013137 - DNA, 22 bp, Artificial Sequence
  chemically synthesized
catagtaaatatgccctttaat

SEQ ID NO: 1013138 - DNA, 22 bp, Artificial Sequence
  chemically synthesized
aactccttaatattaaagggca

SEQ ID NO: 1013139 - DNA, 22 bp, Artificial Sequence
  chemically synthesized
ccatagtaaatatgccctttaa

SEQ ID NO: 1013140 - DNA, 22 bp, Artificial Sequence
  chemically synthesized
actccttaatattaaagggcat

SEQ ID NO: 1013141 - DNA, 22 bp, Artificial Sequence
  chemically synthesized
cttaatattaaagggcatattt

SEQ ID NO: 1013142 - DNA, 22 bp, Artificial Sequence
  chemically synthesized
aatattaaagggcatatttact

SEQ ID NO: 1013143 - DNA, 22 bp, Artificial Sequence
  chemically synthesized
atattaaagggcatatttacta

SEQ ID NO: 1013144 - DNA, 22 bp, Artificial Sequence
  chemically synthesized
aaatatgtttccatagtaaata

SEQ ID NO: 1013145 - DNA, 22 bp, Artificial Sequence
  chemically synthesized
tcaaatatgtttccatagtaaa

SEQ ID NO: 1013146 - DNA, 22 bp, Artificial Sequence
  chemically synthesized
aagggcatatttactatggaaa

SEQ ID NO: 1013147 - DNA, 22 bp, Artificial Sequence
  chemically synthesized
attctcaaatatgtttccatag

SEQ ID NO: 1013148 - DNA, 22 bp, Artificial Sequence
  chemically synthesized
cattctcaaatatgtttccata

SEQ ID NO: 1013149 - DNA, 22 bp, Artificial Sequence
  chemically synthesized
caagtcttcattctcaaatatg

SEQ ID NO: 1013150 - DNA, 22 bp, Artificial Sequence
  chemically synthesized
acaagtcttcattctcaaatat

SEQ ID NO: 1013151 - DNA, 22 bp, Artificial Sequence
  chemically synthesized
actatggaaacatatttgagaa

SEQ ID NO: 1013152 - DNA, 22 bp, Artificial Sequence
  chemically synthesized
tacaagtcttcattctcaaata

SEQ ID NO: 1013153 - DNA, 22 bp, Artificial Sequence
  chemically synthesized
ctatggaaacatatttgagaat

SEQ ID NO: 1013154 - DNA, 22 bp, Artificial Sequence
  chemically synthesized
tggaaacatatttgagaatgaa

SEQ ID NO: 1013155 - DNA, 22 bp, Artificial Sequence
  chemically synthesized
actttacaagtcttcattctca

SEQ ID NO: 1013156 - DNA, 22 bp, Artificial Sequence
  chemically synthesized
gactttacaagtcttcattctc

SEQ ID NO: 1013157 - DNA, 22 bp, Artificial Sequence
  chemically synthesized
gagaatgaagacttgtaaagtc

SEQ ID NO: 1013158 - DNA, 22 bp, Artificial Sequence
  chemically synthesized
agaatgaagacttgtaaagtca

SEQ ID NO: 1013159 - DNA, 22 bp, Artificial Sequence
  chemically synthesized
acaaaagcagtatcacatttga

SEQ ID NO: 1013160 - DNA, 22 bp, Artificial Sequence
  chemically synthesized
gattcacaaaagcagtatcaca

SEQ ID NO: 1013161 - DNA, 22 bp, Artificial Sequence
  chemically synthesized
gtaaagtcaaatgtgatactgc

SEQ ID NO: 1013162 - DNA, 22 bp, Artificial Sequence
  chemically synthesized
taaagtcaaatgtgatactgct

SEQ ID NO: 1013163 - DNA, 22 bp, Artificial Sequence
  chemically synthesized
aaaatgctggattcacaaaagc

SEQ ID NO: 1013164 - DNA, 22 bp, Artificial Sequence
  chemically synthesized
caaaatgctggattcacaaaag

SEQ ID NO: 1013165 - DNA, 22 bp, Artificial Sequence
  chemically synthesized
gatatttcaaaatgctggattc

SEQ ID NO: 1013166 - DNA, 22 bp, Artificial Sequence
  chemically synthesized
agatatttcaaaatgctggatt

SEQ ID NO: 1013167 - DNA, 22 bp, Artificial Sequence
  chemically synthesized
tagatatttcaaaatgctggat

SEQ ID NO: 1013168 - DNA, 22 bp, Artificial Sequence
  chemically synthesized
cttttgtgaatccagcattttg

SEQ ID NO: 1013169 - DNA, 22 bp, Artificial Sequence
  chemically synthesized
ttgtgaatccagcattttgaaa

SEQ ID NO: 1013170 - DNA, 22 bp, Artificial Sequence
  chemically synthesized
tgtgaatccagcattttgaaat

SEQ ID NO: 1013171 - DNA, 22 bp, Artificial Sequence
  chemically synthesized
aatactttagatatttcaaaat

SEQ ID NO: 1013172 - DNA, 22 bp, Artificial Sequence
  chemically synthesized
gtgaatccagcattttgaaata

SEQ ID NO: 1013173 - DNA, 22 bp, Artificial Sequence
  chemically synthesized
tgaatccagcattttgaaatat

SEQ ID NO: 1013174 - DNA, 22 bp, Artificial Sequence
  chemically synthesized
ttaaatactttagatatttcaa

SEQ ID NO: 1013175 - DNA, 22 bp, Artificial Sequence
  chemically synthesized
attaaatactttagatatttca

SEQ ID NO: 1013176 - DNA, 22 bp, Artificial Sequence
  chemically synthesized
tgaaatatctaaagtatttaat

SEQ ID NO: 1013177 - DNA, 22 bp, Artificial Sequence
  chemically synthesized
gaaatatctaaagtatttaata

SEQ ID NO: 1013178 - DNA, 22 bp, Artificial Sequence
  chemically synthesized
aaatatctaaagtatttaataa

SEQ ID NO: 1013179 - DNA, 22 bp, Artificial Sequence
  chemically synthesized
aagtatttaataaactactggg

SEQ ID NO: 1013180 - DNA, 22 bp, Artificial Sequence
  chemically synthesized
aataaactactgggtgtttttt

SEQ ID NO: 1013181 - DNA, 22 bp, Artificial Sequence
  chemically synthesized
ataaactactgggtgttttttg

SEQ ID NO: 1013182 - DNA, 22 bp, Artificial Sequence
  chemically synthesized
agacagatgagggcaaaaaaca

SEQ ID NO: 1013183 - DNA, 22 bp, Artificial Sequence
  chemically synthesized
attaagacagatgagggcaaaa

SEQ ID NO: 1013184 - DNA, 22 bp, Artificial Sequence
  chemically synthesized
ctgggtgttttttgccctcatc

SEQ ID NO: 1013185 - DNA, 22 bp, Artificial Sequence
  chemically synthesized
ggtgttttttgccctcatctgt

SEQ ID NO: 1013186 - DNA, 22 bp, Artificial Sequence
  chemically synthesized
tttgccctcatctgtcttaatc

SEQ ID NO: 1013187 - DNA, 22 bp, Artificial Sequence
  chemically synthesized
ttgccctcatctgtcttaatca

SEQ ID NO: 1013188 - DNA, 22 bp, Artificial Sequence
  chemically synthesized
tgccctcatctgtcttaatcag

SEQ ID NO: 1013189 - DNA, 22 bp, Artificial Sequence
  chemically synthesized
gccctcatctgtcttaatcagt

SEQ ID NO: 1013190 - DNA, 22 bp, Artificial Sequence
  chemically synthesized
atgccagaaaatactgattaag

SEQ ID NO: 1013191 - DNA, 22 bp, Artificial Sequence
  chemically synthesized
ccctcatctgtcttaatcagta

SEQ ID NO: 1013192 - DNA, 22 bp, Artificial Sequence
  chemically synthesized
aatgccagaaaatactgattaa

SEQ ID NO: 1013193 - DNA, 22 bp, Artificial Sequence
  chemically synthesized
taatgccagaaaatactgatta

SEQ ID NO: 1013194 - DNA, 22 bp, Artificial Sequence
  chemically synthesized
ttaatgccagaaaatactgatt

SEQ ID NO: 1013195 - DNA, 22 bp, Artificial Sequence
  chemically synthesized
atctgtcttaatcagtattttc

SEQ ID NO: 1013196 - DNA, 22 bp, Artificial Sequence
  chemically synthesized
tcttaatcagtattttctggca

SEQ ID NO: 1013197 - DNA, 22 bp, Artificial Sequence
  chemically synthesized
tagccaatttttaatgccagaa

SEQ ID NO: 1013198 - DNA, 22 bp, Artificial Sequence
  chemically synthesized
aatcagtattttctggcattaa

SEQ ID NO: 1013199 - DNA, 22 bp, Artificial Sequence
  chemically synthesized
atcagtattttctggcattaaa

SEQ ID NO: 1013200 - DNA, 22 bp, Artificial Sequence
  chemically synthesized
aattgtagccaatttttaatgc

SEQ ID NO: 1013201 - DNA, 22 bp, Artificial Sequence
  chemically synthesized
gaattgtagccaatttttaatg

SEQ ID NO: 1013202 - DNA, 22 bp, Artificial Sequence
  chemically synthesized
tctggcattaaaaattggctac

SEQ ID NO: 1013203 - DNA, 22 bp, Artificial Sequence
  chemically synthesized
ctggcattaaaaattggctaca

SEQ ID NO: 1013204 - DNA, 22 bp, Artificial Sequence
  chemically synthesized
tggcattaaaaattggctacaa

SEQ ID NO: 1013205 - DNA, 22 bp, Artificial Sequence
  chemically synthesized
gcattaaaaattggctacaatt

SEQ ID NO: 1013206 - DNA, 22 bp, Artificial Sequence
  chemically synthesized
aaaattggctacaattcaaatc

SEQ ID NO: 1013207 - DNA, 22 bp, Artificial Sequence
  chemically synthesized
caatagtcaatcaagtggattt

SEQ ID NO: 1013208 - DNA, 22 bp, Artificial Sequence
  chemically synthesized
gctacaattcaaatccacttga

SEQ ID NO: 1013209 - DNA, 22 bp, Artificial Sequence
  chemically synthesized
caattcaaatccacttgattga

SEQ ID NO: 1013210 - DNA, 22 bp, Artificial Sequence
  chemically synthesized
atgttgcaatagtcaatcaagt

SEQ ID NO: 1013211 - DNA, 22 bp, Artificial Sequence
  chemically synthesized
ttcatgttgcaatagtcaatca

SEQ ID NO: 1013212 - DNA, 22 bp, Artificial Sequence
  chemically synthesized
aaatccacttgattgactattg

SEQ ID NO: 1013213 - DNA, 22 bp, Artificial Sequence
  chemically synthesized
aaattgttcatgttgcaatagt

SEQ ID NO: 1013214 - DNA, 22 bp, Artificial Sequence
  chemically synthesized
gctcaaattgttcatgttgcaa

SEQ ID NO: 1013215 - DNA, 22 bp, Artificial Sequence
  chemically synthesized
agctcaaattgttcatgttgca

SEQ ID NO: 1013216 - DNA, 22 bp, Artificial Sequence
  chemically synthesized
tagctcaaattgttcatgttgc

SEQ ID NO: 1013217 - DNA, 22 bp, Artificial Sequence
  chemically synthesized
gattgactattgcaacatgaac

SEQ ID NO: 1013218 - DNA, 22 bp, Artificial Sequence
  chemically synthesized
ttagctcaaattgttcatgttg

SEQ ID NO: 1013219 - DNA, 22 bp, Artificial Sequence
  chemically synthesized
attgactattgcaacatgaaca

SEQ ID NO: 1013220 - DNA, 22 bp, Artificial Sequence
  chemically synthesized
tttagctcaaattgttcatgtt

SEQ ID NO: 1013221 - DNA, 22 bp, Artificial Sequence
  chemically synthesized
ttttagctcaaattgttcatgt

SEQ ID NO: 1013222 - DNA, 22 bp, Artificial Sequence
  chemically synthesized
actattgcaacatgaacaattt

SEQ ID NO: 1013223 - DNA, 22 bp, Artificial Sequence
  chemically synthesized
catcttttttagctcaaattgt

SEQ ID NO: 1013224 - DNA, 22 bp, Artificial Sequence
  chemically synthesized
ttgcaacatgaacaatttgagc

SEQ ID NO: 1013225 - DNA, 22 bp, Artificial Sequence
  chemically synthesized
gcatcttttttagctcaaattg

SEQ ID NO: 1013226 - DNA, 22 bp, Artificial Sequence
  chemically synthesized
tgcatcttttttagctcaaatt

SEQ ID NO: 1013227 - DNA, 22 bp, Artificial Sequence
  chemically synthesized
ttgcatcttttttagctcaaat

SEQ ID NO: 1013228 - DNA, 22 bp, Artificial Sequence
  chemically synthesized
caacatgaacaatttgagctaa

SEQ ID NO: 1013229 - DNA, 22 bp, Artificial Sequence
  chemically synthesized
tttttgcatcttttttagctca

SEQ ID NO: 1013230 - DNA, 22 bp, Artificial Sequence
  chemically synthesized
attatttttgcatcttttttag

SEQ ID NO: 1013231 - DNA, 22 bp, Artificial Sequence
  chemically synthesized
aattatttttgcatctttttta

SEQ ID NO: 1013232 - DNA, 22 bp, Artificial Sequence
  chemically synthesized
gagctaaaaaagatgcaaaaat

SEQ ID NO: 1013233 - DNA, 22 bp, Artificial Sequence
  chemically synthesized
agctaaaaaagatgcaaaaata

SEQ ID NO: 1013234 - DNA, 22 bp, Artificial Sequence
  chemically synthesized
cacgaagacttaattatttttg

SEQ ID NO: 1013235 - DNA, 22 bp, Artificial Sequence
  chemically synthesized
aaaaagatgcaaaaataattaa

SEQ ID NO: 1013236 - DNA, 22 bp, Artificial Sequence
  chemically synthesized
ttacacgaagacttaattattt

SEQ ID NO: 1013237 - DNA, 22 bp, Artificial Sequence
  chemically synthesized
attacacgaagacttaattatt

SEQ ID NO: 1013238 - DNA, 22 bp, Artificial Sequence
  chemically synthesized
tgtttattacacgaagacttaa

SEQ ID NO: 1013239 - DNA, 22 bp, Artificial Sequence
  chemically synthesized
agtcttcgtgtaataaacacag

SEQ ID NO: 1013240 - DNA, 22 bp, Artificial Sequence
  chemically synthesized
ggcataagaaacactgtgttta

SEQ ID NO: 1013241 - DNA, 22 bp, Artificial Sequence
  chemically synthesized
aggcataagaaacactgtgttt

SEQ ID NO: 1013242 - DNA, 22 bp, Artificial Sequence
  chemically synthesized
cgtgtaataaacacagtgtttc

SEQ ID NO: 1013243 - DNA, 22 bp, Artificial Sequence
  chemically synthesized
gtgtaataaacacagtgtttct

SEQ ID NO: 1013244 - DNA, 22 bp, Artificial Sequence
  chemically synthesized
catagtttaggcataagaaaca

SEQ ID NO: 1013245 - DNA, 22 bp, Artificial Sequence
  chemically synthesized
aattacatagtttaggcataag

SEQ ID NO: 1013246 - DNA, 22 bp, Artificial Sequence
  chemically synthesized
ctaaattacatagtttaggcat

SEQ ID NO: 1013247 - DNA, 22 bp, Artificial Sequence
  chemically synthesized
gttgctaaattacatagtttag

SEQ ID NO: 1013248 - DNA, 22 bp, Artificial Sequence
  chemically synthesized
ggttgctaaattacatagttta

SEQ ID NO: 1013249 - DNA, 22 bp, Artificial Sequence
  chemically synthesized
cttatgcctaaactatgtaatt

SEQ ID NO: 1013250 - DNA, 22 bp, Artificial Sequence
  chemically synthesized
ttatgcctaaactatgtaattt

SEQ ID NO: 1013251 - DNA, 22 bp, Artificial Sequence
  chemically synthesized
atgcctaaactatgtaatttag

SEQ ID NO: 1013252 - DNA, 22 bp, Artificial Sequence
  chemically synthesized
tgcctaaactatgtaatttagc

SEQ ID NO: 1013253 - DNA, 22 bp, Artificial Sequence
  chemically synthesized
aactatgtaatttagcaaccaa

SEQ ID NO: 1013254 - DNA, 22 bp, Artificial Sequence
  chemically synthesized
tccaggatataatttggttgct

SEQ ID NO: 1013255 - DNA, 22 bp, Artificial Sequence
  chemically synthesized
tgtaatttagcaaccaaattat

SEQ ID NO: 1013256 - DNA, 22 bp, Artificial Sequence
  chemically synthesized
gattgtccaggatataatttgg

SEQ ID NO: 1013257 - DNA, 22 bp, Artificial Sequence
  chemically synthesized
agcaaccaaattatatcctgga

SEQ ID NO: 1013258 - DNA, 22 bp, Artificial Sequence
  chemically synthesized
gcaaccaaattatatcctggac

SEQ ID NO: 1013259 - DNA, 22 bp, Artificial Sequence
  chemically synthesized
tatcctggacaatctaatctat

SEQ ID NO: 1013260 - DNA, 22 bp, Artificial Sequence
  chemically synthesized
aatatgcaggtaaagatagatt

SEQ ID NO: 1013261 - DNA, 22 bp, Artificial Sequence
  chemically synthesized
gaatatgcaggtaaagatagat

SEQ ID NO: 1013262 - DNA, 22 bp, Artificial Sequence
  chemically synthesized
tgaatatgcaggtaaagataga

SEQ ID NO: 1013263 - DNA, 22 bp, Artificial Sequence
  chemically synthesized
gacaatctaatctatctttacc

SEQ ID NO: 1013264 - DNA, 22 bp, Artificial Sequence
  chemically synthesized
tggtgtcctttgaatatgcagg

SEQ ID NO: 1013265 - DNA, 22 bp, Artificial Sequence
  chemically synthesized
atctatctttacctgcatattc

SEQ ID NO: 1013266 - DNA, 22 bp, Artificial Sequence
  chemically synthesized
gtggtgtcctttgaatatgcag

SEQ ID NO: 1013267 - DNA, 22 bp, Artificial Sequence
  chemically synthesized
tctttacctgcatattcaaagg

SEQ ID NO: 1013268 - DNA, 22 bp, Artificial Sequence
  chemically synthesized
aacttgtggtgtcctttgaata

SEQ ID NO: 1013269 - DNA, 22 bp, Artificial Sequence
  chemically synthesized
caacttgtggtgtcctttgaat

SEQ ID NO: 1013270 - DNA, 22 bp, Artificial Sequence
  chemically synthesized
tacctgcatattcaaaggacac

SEQ ID NO: 1013271 - DNA, 22 bp, Artificial Sequence
  chemically synthesized
acctgcatattcaaaggacacc

SEQ ID NO: 1013272 - DNA, 22 bp, Artificial Sequence
  chemically synthesized
atttcaacttgtggtgtccttt

SEQ ID NO: 1013273 - DNA, 22 bp, Artificial Sequence
  chemically synthesized
cctgcatattcaaaggacacca

SEQ ID NO: 1013274 - DNA, 22 bp, Artificial Sequence
  chemically synthesized
aatttcaacttgtggtgtcctt

SEQ ID NO: 1013275 - DNA, 22 bp, Artificial Sequence
  chemically synthesized
catattcaaaggacaccacaag

SEQ ID NO: 1013276 - DNA, 22 bp, Artificial Sequence
  chemically synthesized
aaaggacaccacaagttgaaat

SEQ ID NO: 1013277 - DNA, 22 bp, Artificial Sequence
  chemically synthesized
aaattaaactacacactggtta

SEQ ID NO: 1013278 - DNA, 22 bp, Artificial Sequence
  chemically synthesized
aactacacactggttatcatcc

SEQ ID NO: 1013279 - DNA, 22 bp, Artificial Sequence
  chemically synthesized
cacactggttatcatccatatg

SEQ ID NO: 1013280 - DNA, 22 bp, Artificial Sequence
  chemically synthesized
atagggaaacagcatatggatg

SEQ ID NO: 1013281 - DNA, 22 bp, Artificial Sequence
  chemically synthesized
tgttaatagggaaacagcatat

SEQ ID NO: 1013282 - DNA, 22 bp, Artificial Sequence
  chemically synthesized
atgttaatagggaaacagcata

SEQ ID NO: 1013283 - DNA, 22 bp, Artificial Sequence
  chemically synthesized
gttatcatccatatgctgtttc

SEQ ID NO: 1013284 - DNA, 22 bp, Artificial Sequence
  chemically synthesized
tcatccatatgctgtttcccta

SEQ ID NO: 1013285 - DNA, 22 bp, Artificial Sequence
  chemically synthesized
tggtttatgttaatagggaaac

SEQ ID NO: 1013286 - DNA, 22 bp, Artificial Sequence
  chemically synthesized
atggtttatgttaatagggaaa

SEQ ID NO: 1013287 - DNA, 22 bp, Artificial Sequence
  chemically synthesized
tatggtttatgttaatagggaa

SEQ ID NO: 1013288 - DNA, 22 bp, Artificial Sequence
  chemically synthesized
acattttatggtttatgttaat

SEQ ID NO: 1013289 - DNA, 22 bp, Artificial Sequence
  chemically synthesized
ttgacattttatggtttatgtt

SEQ ID NO: 1013290 - DNA, 22 bp, Artificial Sequence
  chemically synthesized
attgacattttatggtttatgt

SEQ ID NO: 1013291 - DNA, 22 bp, Artificial Sequence
  chemically synthesized
tttccctattaacataaaccat

SEQ ID NO: 1013292 - DNA, 22 bp, Artificial Sequence
  chemically synthesized
ccctattaacataaaccataaa

SEQ ID NO: 1013293 - DNA, 22 bp, Artificial Sequence
  chemically synthesized
cctattaacataaaccataaaa

SEQ ID NO: 1013294 - DNA, 22 bp, Artificial Sequence
  chemically synthesized
gtacttattgacattttatggt

SEQ ID NO: 1013295 - DNA, 22 bp, Artificial Sequence
  chemically synthesized
ttaacataaaccataaaatgtc

SEQ ID NO: 1013296 - DNA, 22 bp, Artificial Sequence
  chemically synthesized
ttggtacttattgacattttat

SEQ ID NO: 1013297 - DNA, 22 bp, Artificial Sequence
  chemically synthesized
acataaaccataaaatgtcaat

SEQ ID NO: 1013298 - DNA, 22 bp, Artificial Sequence
  chemically synthesized
attgttggtacttattgacatt

SEQ ID NO: 1013299 - DNA, 22 bp, Artificial Sequence
  chemically synthesized
aaatagtccagaggccaaaaca

SEQ ID NO: 1013300 - DNA, 22 bp, Artificial Sequence
  chemically synthesized
tgaaatagtccagaggccaaaa

SEQ ID NO: 1013301 - DNA, 22 bp, Artificial Sequence
  chemically synthesized
actctgcattgttttggcctct

SEQ ID NO: 1013302 - DNA, 22 bp, Artificial Sequence
  chemically synthesized
ctgaaatagtccagaggccaaa

SEQ ID NO: 1013303 - DNA, 22 bp, Artificial Sequence
  chemically synthesized
tgcattgttttggcctctggac

SEQ ID NO: 1013304 - DNA, 22 bp, Artificial Sequence
  chemically synthesized
cattgttttggcctctggacta

SEQ ID NO: 1013305 - DNA, 22 bp, Artificial Sequence
  chemically synthesized
ttttggcctctggactatttca

SEQ ID NO: 1013306 - DNA, 22 bp, Artificial Sequence
  chemically synthesized
acaaaatgccttctgaaatagt

SEQ ID NO: 1013307 - DNA, 22 bp, Artificial Sequence
  chemically synthesized
tggcctctggactatttcagaa

SEQ ID NO: 1013308 - DNA, 22 bp, Artificial Sequence
  chemically synthesized
ggcctctggactatttcagaag

SEQ ID NO: 1013309 - DNA, 22 bp, Artificial Sequence
  chemically synthesized
ttgacaaaatgccttctgaaat

SEQ ID NO: 1013310 - DNA, 22 bp, Artificial Sequence
  chemically synthesized
gcctctggactatttcagaagg

SEQ ID NO: 1013311 - DNA, 22 bp, Artificial Sequence
  chemically synthesized
tattgacaaaatgccttctgaa

SEQ ID NO: 1013312 - DNA, 22 bp, Artificial Sequence
  chemically synthesized
tggactatttcagaaggcattt

SEQ ID NO: 1013313 - DNA, 22 bp, Artificial Sequence
  chemically synthesized
gactatttcagaaggcattttg

SEQ ID NO: 1013314 - DNA, 22 bp, Artificial Sequence
  chemically synthesized
tatattctattgacaaaatgcc

SEQ ID NO: 1013315 - DNA, 22 bp, Artificial Sequence
  chemically synthesized
tatatattctattgacaaaatg

SEQ ID NO: 1013316 - DNA, 22 bp, Artificial Sequence
  chemically synthesized
ctatatattctattgacaaaat

SEQ ID NO: 1013317 - DNA, 22 bp, Artificial Sequence
  chemically synthesized
tttcagaaggcattttgtcaat

SEQ ID NO: 1013318 - DNA, 22 bp, Artificial Sequence
  chemically synthesized
cagaaggcattttgtcaataga

SEQ ID NO: 1013319 - DNA, 22 bp, Artificial Sequence
  chemically synthesized
agaaggcattttgtcaatagaa

SEQ ID NO: 1013320 - DNA, 22 bp, Artificial Sequence
  chemically synthesized
tagcaatatttctatatattct

SEQ ID NO: 1013321 - DNA, 22 bp, Artificial Sequence
  chemically synthesized
tgtcaatagaatatatagaaat

SEQ ID NO: 1013322 - DNA, 22 bp, Artificial Sequence
  chemically synthesized
gtcaatagaatatatagaaata

SEQ ID NO: 1013323 - DNA, 22 bp, Artificial Sequence
  chemically synthesized
tcaatagaatatatagaaatat

SEQ ID NO: 1013324 - DNA, 22 bp, Artificial Sequence
  chemically synthesized
tagtgctgtagcaatatttcta

SEQ ID NO: 1013325 - DNA, 22 bp, Artificial Sequence
  chemically synthesized
gtagtgctgtagcaatatttct

SEQ ID NO: 1013326 - DNA, 22 bp, Artificial Sequence
  chemically synthesized
tgtagtgctgtagcaatatttc

SEQ ID NO: 1013327 - DNA, 22 bp, Artificial Sequence
  chemically synthesized
aagacaattttgtagtgctgta

SEQ ID NO: 1013328 - DNA, 22 bp, Artificial Sequence
  chemically synthesized
ctaaagacaattttgtagtgct

SEQ ID NO: 1013329 - DNA, 22 bp, Artificial Sequence
  chemically synthesized
cctaaagacaattttgtagtgc

SEQ ID NO: 1013330 - DNA, 22 bp, Artificial Sequence
  chemically synthesized
tcctaaagacaattttgtagtg

SEQ ID NO: 1013331 - DNA, 22 bp, Artificial Sequence
  chemically synthesized
ttttcctaaagacaattttgta

SEQ ID NO: 1013332 - DNA, 22 bp, Artificial Sequence
  chemically synthesized
tgttttcctaaagacaattttg

SEQ ID NO: 1013333 - DNA, 22 bp, Artificial Sequence
  chemically synthesized
ctacagcactacaaaattgtct

SEQ ID NO: 1013334 - DNA, 22 bp, Artificial Sequence
  chemically synthesized
cagcactacaaaattgtcttta

SEQ ID NO: 1013335 - DNA, 22 bp, Artificial Sequence
  chemically synthesized
cagttctgttttcctaaagaca

SEQ ID NO: 1013336 - DNA, 22 bp, Artificial Sequence
  chemically synthesized
caaaattgtctttaggaaaaca

SEQ ID NO: 1013337 - DNA, 22 bp, Artificial Sequence
  chemically synthesized
tctttaggaaaacagaactgta

SEQ ID NO: 1013338 - DNA, 22 bp, Artificial Sequence
  chemically synthesized
taggaaaacagaactgtaattt

SEQ ID NO: 1013339 - DNA, 22 bp, Artificial Sequence
  chemically synthesized
aggaaaacagaactgtaatttt

SEQ ID NO: 1013340 - DNA, 22 bp, Artificial Sequence
  chemically synthesized
ggaaaacagaactgtaatttta

SEQ ID NO: 1013341 - DNA, 22 bp, Artificial Sequence
  chemically synthesized
gaaatatccatcatgataaaat

SEQ ID NO: 1013342 - DNA, 22 bp, Artificial Sequence
  chemically synthesized
ctagaaatatccatcatgataa

SEQ ID NO: 1013343 - DNA, 22 bp, Artificial Sequence
  chemically synthesized
taattttatcatgatggatatt

SEQ ID NO: 1013344 - DNA, 22 bp, Artificial Sequence
  chemically synthesized
aaatgaagttgctagaaatatc

SEQ ID NO: 1013345 - DNA, 22 bp, Artificial Sequence
  chemically synthesized
tatcatgatggatatttctagc

SEQ ID NO: 1013346 - DNA, 22 bp, Artificial Sequence
  chemically synthesized
atcatgatggatatttctagca

SEQ ID NO: 1013347 - DNA, 22 bp, Artificial Sequence
  chemically synthesized
tcatgatggatatttctagcaa

SEQ ID NO: 1013348 - DNA, 22 bp, Artificial Sequence
  chemically synthesized
gctaaaatgaagttgctagaaa

SEQ ID NO: 1013349 - DNA, 22 bp, Artificial Sequence
  chemically synthesized
agctaaaatgaagttgctagaa

SEQ ID NO: 1013350 - DNA, 22 bp, Artificial Sequence
  chemically synthesized
tggcatacttagctaaaatgaa

SEQ ID NO: 1013351 - DNA, 22 bp, Artificial Sequence
  chemically synthesized
gtggcatacttagctaaaatga

SEQ ID NO: 1013352 - DNA, 22 bp, Artificial Sequence
  chemically synthesized
ctagcaacttcattttagctaa

SEQ ID NO: 1013353 - DNA, 22 bp, Artificial Sequence
  chemically synthesized
tagcaacttcattttagctaag

SEQ ID NO: 1013354 - DNA, 22 bp, Artificial Sequence
  chemically synthesized
gcaacttcattttagctaagta

SEQ ID NO: 1013355 - DNA, 22 bp, Artificial Sequence
  chemically synthesized
cattttagctaagtatgccaca

SEQ ID NO: 1013356 - DNA, 22 bp, Artificial Sequence
  chemically synthesized
attttagctaagtatgccacaa

SEQ ID NO: 1013357 - DNA, 22 bp, Artificial Sequence
  chemically synthesized
cagaaggagaacttgtggcata

SEQ ID NO: 1013358 - DNA, 22 bp, Artificial Sequence
  chemically synthesized
ccagaaggagaacttgtggcat

SEQ ID NO: 1013359 - DNA, 22 bp, Artificial Sequence
  chemically synthesized
tccagaaggagaacttgtggca

SEQ ID NO: 1013360 - DNA, 22 bp, Artificial Sequence
  chemically synthesized
tagctaagtatgccacaagttc

SEQ ID NO: 1013361 - DNA, 22 bp, Artificial Sequence
  chemically synthesized
agctaagtatgccacaagttct

SEQ ID NO: 1013362 - DNA, 22 bp, Artificial Sequence
  chemically synthesized
gctaagtatgccacaagttctc

SEQ ID NO: 1013363 - DNA, 22 bp, Artificial Sequence
  chemically synthesized
gaacctttccagaaggagaact

SEQ ID NO: 1013364 - DNA, 22 bp, Artificial Sequence
  chemically synthesized
agtatgccacaagttctccttc

SEQ ID NO: 1013365 - DNA, 22 bp, Artificial Sequence
  chemically synthesized
tgttggaacctttccagaagga

SEQ ID NO: 1013366 - DNA, 22 bp, Artificial Sequence
  chemically synthesized
atgttggaacctttccagaagg

SEQ ID NO: 1013367 - DNA, 22 bp, Artificial Sequence
  chemically synthesized
tatgttggaacctttccagaag

SEQ ID NO: 1013368 - DNA, 22 bp, Artificial Sequence
  chemically synthesized
ggctttatgttggaacctttcc

SEQ ID NO: 1013369 - DNA, 22 bp, Artificial Sequence
  chemically synthesized
cggctttatgttggaacctttc

SEQ ID NO: 1013370 - DNA, 22 bp, Artificial Sequence
  chemically synthesized
tccttctggaaaggttccaaca

SEQ ID NO: 1013371 - DNA, 22 bp, Artificial Sequence
  chemically synthesized
cttctggaaaggttccaacata

SEQ ID NO: 1013372 - DNA, 22 bp, Artificial Sequence
  chemically synthesized
ctggaaaggttccaacataaag

SEQ ID NO: 1013373 - DNA, 22 bp, Artificial Sequence
  chemically synthesized
tggaaaggttccaacataaagc

SEQ ID NO: 1013374 - DNA, 22 bp, Artificial Sequence
  chemically synthesized
gaaaggttccaacataaagccg

SEQ ID NO: 1013375 - DNA, 22 bp, Artificial Sequence
  chemically synthesized
gggcagtgtgtatttcggcttt

SEQ ID NO: 1013376 - DNA, 22 bp, Artificial Sequence
  chemically synthesized
ggggcagtgtgtatttcggctt

SEQ ID NO: 1013377 - DNA, 22 bp, Artificial Sequence
  chemically synthesized
tggggcagtgtgtatttcggct

SEQ ID NO: 1013378 - DNA, 22 bp, Artificial Sequence
  chemically synthesized
caacataaagccgaaatacaca

SEQ ID NO: 1013379 - DNA, 22 bp, Artificial Sequence
  chemically synthesized
tggctttggggcagtgtgtatt

SEQ ID NO: 1013380 - DNA, 22 bp, Artificial Sequence
  chemically synthesized
gtggctttggggcagtgtgtat

SEQ ID NO: 1013381 - DNA, 22 bp, Artificial Sequence
  chemically synthesized
tgtggctttggggcagtgtgta

SEQ ID NO: 1013382 - DNA, 22 bp, Artificial Sequence
  chemically synthesized
ccccaaagccacaaaacacctt

SEQ ID NO: 1013383 - DNA, 22 bp, Artificial Sequence
  chemically synthesized
tgacagagggaagcatcgtaac

SEQ ID NO: 1013384 - DNA, 22 bp, Artificial Sequence
  chemically synthesized
aatctgtgacagagggaagcat

SEQ ID NO: 1013385 - DNA, 22 bp, Artificial Sequence
  chemically synthesized
gctgttacgatgcttccctctg

SEQ ID NO: 1013386 - DNA, 22 bp, Artificial Sequence
  chemically synthesized
ctgttacgatgcttccctctgt

SEQ ID NO: 1013387 - DNA, 22 bp, Artificial Sequence
  chemically synthesized
ttacgatgcttccctctgtcac

SEQ ID NO: 1013388 - DNA, 22 bp, Artificial Sequence
  chemically synthesized
cgatgcttccctctgtcacaga

SEQ ID NO: 1013389 - DNA, 22 bp, Artificial Sequence
  chemically synthesized
caaaatataattgaatctgtga

SEQ ID NO: 1013390 - DNA, 22 bp, Artificial Sequence
  chemically synthesized
ccctctgtcacagattcaatta

SEQ ID NO: 1013391 - DNA, 22 bp, Artificial Sequence
  chemically synthesized
cctctgtcacagattcaattat

SEQ ID NO: 1013392 - DNA, 22 bp, Artificial Sequence
  chemically synthesized
ataaactgcaaaatataattga

SEQ ID NO: 1013393 - DNA, 22 bp, Artificial Sequence
  chemically synthesized
tgtcacagattcaattatattt

SEQ ID NO: 1013394 - DNA, 22 bp, Artificial Sequence
  chemically synthesized
tcacagattcaattatattttg

SEQ ID NO: 1013395 - DNA, 22 bp, Artificial Sequence
  chemically synthesized
tctgataaactgcaaaatataa

SEQ ID NO: 1013396 - DNA, 22 bp, Artificial Sequence
  chemically synthesized
atctgataaactgcaaaatata

SEQ ID NO: 1013397 - DNA, 22 bp, Artificial Sequence
  chemically synthesized
gtttatctgataaactgcaaaa

SEQ ID NO: 1013398 - DNA, 22 bp, Artificial Sequence
  chemically synthesized
aattatattttgcagtttatca

SEQ ID NO: 1013399 - DNA, 22 bp, Artificial Sequence
  chemically synthesized
tattttgcagtttatcagataa

SEQ ID NO: 1013400 - DNA, 22 bp, Artificial Sequence
  chemically synthesized
gacggagctggtttatctgata

SEQ ID NO: 1013401 - DNA, 22 bp, Artificial Sequence
  chemically synthesized
cctggacggagctggtttatct

SEQ ID NO: 1013402 - DNA, 22 bp, Artificial Sequence
  chemically synthesized
tgcagtttatcagataaaccag

SEQ ID NO: 1013403 - DNA, 22 bp, Artificial Sequence
  chemically synthesized
gcctggacggagctggtttatc

SEQ ID NO: 1013404 - DNA, 22 bp, Artificial Sequence
  chemically synthesized
gcagtttatcagataaaccagc

SEQ ID NO: 1013405 - DNA, 22 bp, Artificial Sequence
  chemically synthesized
cagtttatcagataaaccagct

SEQ ID NO: 1013406 - DNA, 22 bp, Artificial Sequence
  chemically synthesized
atcagataaaccagctccgtcc

SEQ ID NO: 1013407 - DNA, 22 bp, Artificial Sequence
  chemically synthesized
tcagataaaccagctccgtcca

SEQ ID NO: 1013408 - DNA, 22 bp, Artificial Sequence
  chemically synthesized
tgtcaggatgagagagtttgcc

SEQ ID NO: 1013409 - DNA, 22 bp, Artificial Sequence
  chemically synthesized
gtgtcaggatgagagagtttgc

SEQ ID NO: 1013410 - DNA, 22 bp, Artificial Sequence
  chemically synthesized
tgtgtcaggatgagagagtttg

SEQ ID NO: 1013411 - DNA, 22 bp, Artificial Sequence
  chemically synthesized
ttgtgtcaggatgagagagttt

SEQ ID NO: 1013412 - DNA, 22 bp, Artificial Sequence
  chemically synthesized
tttgtgtcaggatgagagagtt

SEQ ID NO: 1013413 - DNA, 22 bp, Artificial Sequence
  chemically synthesized
cgtccaggcaaactctctcatc

SEQ ID NO: 1013414 - DNA, 22 bp, Artificial Sequence
  chemically synthesized
tggactttttgtgtcaggatga

SEQ ID NO: 1013415 - DNA, 22 bp, Artificial Sequence
  chemically synthesized
tctcatcctgacacaaaaagtc

SEQ ID NO: 1013416 - DNA, 22 bp, Artificial Sequence
  chemically synthesized
tcatcctgacacaaaaagtcca

SEQ ID NO: 1013417 - DNA, 22 bp, Artificial Sequence
  chemically synthesized
gagcacggtgctatggactttt

SEQ ID NO: 1013418 - DNA, 22 bp, Artificial Sequence
  chemically synthesized
atcctgacacaaaaagtccata

SEQ ID NO: 1013419 - DNA, 22 bp, Artificial Sequence
  chemically synthesized
acacaaaaagtccatagcaccg

SEQ ID NO: 1013420 - DNA, 22 bp, Artificial Sequence
  chemically synthesized
tcataatgataatattagagca

SEQ ID NO: 1013421 - DNA, 22 bp, Artificial Sequence
  chemically synthesized
gaaagaaaattatcataatgat

SEQ ID NO: 1013422 - DNA, 22 bp, Artificial Sequence
  chemically synthesized
ctagaaagaaaattatcataat

SEQ ID NO: 1013423 - DNA, 22 bp, Artificial Sequence
  chemically synthesized
taatattatcattatgataatt

SEQ ID NO: 1013424 - DNA, 22 bp, Artificial Sequence
  chemically synthesized
atattatcattatgataatttt

SEQ ID NO: 1013425 - DNA, 22 bp, Artificial Sequence
  chemically synthesized
tattactagaaagaaaattatc

SEQ ID NO: 1013426 - DNA, 22 bp, Artificial Sequence
  chemically synthesized
tcattatgataattttctttct

SEQ ID NO: 1013427 - DNA, 22 bp, Artificial Sequence
  chemically synthesized
tcatcattatattactagaaag

SEQ ID NO: 1013428 - DNA, 22 bp, Artificial Sequence
  chemically synthesized
tgataattttctttctagtaat

SEQ ID NO: 1013429 - DNA, 22 bp, Artificial Sequence
  chemically synthesized
ttgtcatcattatattactaga

SEQ ID NO: 1013430 - DNA, 22 bp, Artificial Sequence
  chemically synthesized
ttgttgtcatcattatattact

SEQ ID NO: 1013431 - DNA, 22 bp, Artificial Sequence
  chemically synthesized
actgttgttgtcatcattatat

SEQ ID NO: 1013432 - DNA, 22 bp, Artificial Sequence
  chemically synthesized
tctttctagtaatataatgatg

SEQ ID NO: 1013433 - DNA, 22 bp, Artificial Sequence
  chemically synthesized
gactgttgttgtcatcattata

SEQ ID NO: 1013434 - DNA, 22 bp, Artificial Sequence
  chemically synthesized
ctttctagtaatataatgatga

SEQ ID NO: 1013435 - DNA, 22 bp, Artificial Sequence
  chemically synthesized
tgactgttgttgtcatcattat

SEQ ID NO: 1013436 - DNA, 22 bp, Artificial Sequence
  chemically synthesized
tttctagtaatataatgatgac

SEQ ID NO: 1013437 - DNA, 22 bp, Artificial Sequence
  chemically synthesized
ttgactgttgttgtcatcatta

SEQ ID NO: 1013438 - DNA, 22 bp, Artificial Sequence
  chemically synthesized
tctagtaatataatgatgacaa

SEQ ID NO: 1013439 - DNA, 22 bp, Artificial Sequence
  chemically synthesized
ctagtaatataatgatgacaac

SEQ ID NO: 1013440 - DNA, 22 bp, Artificial Sequence
  chemically synthesized
cttttgactgttgttgtcatca

SEQ ID NO: 1013441 - DNA, 22 bp, Artificial Sequence
  chemically synthesized
tagtaatataatgatgacaaca

SEQ ID NO: 1013442 - DNA, 22 bp, Artificial Sequence
  chemically synthesized
gtaatataatgatgacaacaac

SEQ ID NO: 1013443 - DNA, 22 bp, Artificial Sequence
  chemically synthesized
aagggtgatggaaattactttt

SEQ ID NO: 1013444 - DNA, 22 bp, Artificial Sequence
  chemically synthesized
tgaagggtgatggaaattactt

SEQ ID NO: 1013445 - DNA, 22 bp, Artificial Sequence
  chemically synthesized
aagatcaggttctgaagggtga

SEQ ID NO: 1013446 - DNA, 22 bp, Artificial Sequence
  chemically synthesized
aaagatcaggttctgaagggtg

SEQ ID NO: 1013447 - DNA, 22 bp, Artificial Sequence
  chemically synthesized
ttaaagatcaggttctgaaggg

SEQ ID NO: 1013448 - DNA, 22 bp, Artificial Sequence
  chemically synthesized
cttaaagatcaggttctgaagg

SEQ ID NO: 1013449 - DNA, 22 bp, Artificial Sequence
  chemically synthesized
acttcttaaagatcaggttctg

SEQ ID NO: 1013450 - DNA, 22 bp, Artificial Sequence
  chemically synthesized
ccatcacccttcagaacctgat

SEQ ID NO: 1013451 - DNA, 22 bp, Artificial Sequence
  chemically synthesized
aacttcttaaagatcaggttct

SEQ ID NO: 1013452 - DNA, 22 bp, Artificial Sequence
  chemically synthesized
catcacccttcagaacctgatc

SEQ ID NO: 1013453 - DNA, 22 bp, Artificial Sequence
  chemically synthesized
taacttcttaaagatcaggttc

SEQ ID NO: 1013454 - DNA, 22 bp, Artificial Sequence
  chemically synthesized
tttaacttcttaaagatcaggt

SEQ ID NO: 1013455 - DNA, 22 bp, Artificial Sequence
  chemically synthesized
gactctttaacttcttaaagat

SEQ ID NO: 1013456 - DNA, 22 bp, Artificial Sequence
  chemically synthesized
cagaacctgatctttaagaagt

SEQ ID NO: 1013457 - DNA, 22 bp, Artificial Sequence
  chemically synthesized
agaacctgatctttaagaagtt

SEQ ID NO: 1013458 - DNA, 22 bp, Artificial Sequence
  chemically synthesized
agcacatctggactctttaact

SEQ ID NO: 1013459 - DNA, 22 bp, Artificial Sequence
  chemically synthesized
cagcacatctggactctttaac

SEQ ID NO: 1013460 - DNA, 22 bp, Artificial Sequence
  chemically synthesized
atctttaagaagttaaagagtc

SEQ ID NO: 1013461 - DNA, 22 bp, Artificial Sequence
  chemically synthesized
tcttcagcacatctggactctt

SEQ ID NO: 1013462 - DNA, 22 bp, Artificial Sequence
  chemically synthesized
atcttcagcacatctggactct

SEQ ID NO: 1013463 - DNA, 22 bp, Artificial Sequence
  chemically synthesized
taagaagttaaagagtccagat

SEQ ID NO: 1013464 - DNA, 22 bp, Artificial Sequence
  chemically synthesized
aagaagttaaagagtccagatg

SEQ ID NO: 1013465 - DNA, 22 bp, Artificial Sequence
  chemically synthesized
agaagttaaagagtccagatgt

SEQ ID NO: 1013466 - DNA, 22 bp, Artificial Sequence
  chemically synthesized
tatttatcttcagcacatctgg

SEQ ID NO: 1013467 - DNA, 22 bp, Artificial Sequence
  chemically synthesized
aagagtccagatgtgctgaaga

SEQ ID NO: 1013468 - DNA, 22 bp, Artificial Sequence
  chemically synthesized
gaaattgtatttatcttcagca

SEQ ID NO: 1013469 - DNA, 22 bp, Artificial Sequence
  chemically synthesized
cgaaattgtatttatcttcagc

SEQ ID NO: 1013470 - DNA, 22 bp, Artificial Sequence
  chemically synthesized
tcgaaattgtatttatcttcag

SEQ ID NO: 1013471 - DNA, 22 bp, Artificial Sequence
  chemically synthesized
ttcgaaattgtatttatcttca

SEQ ID NO: 1013472 - DNA, 22 bp, Artificial Sequence
  chemically synthesized
tttcgaaattgtatttatcttc

SEQ ID NO: 1013473 - DNA, 22 bp, Artificial Sequence
  chemically synthesized
ttttttcgaaattgtatttatc

SEQ ID NO: 1013474 - DNA, 22 bp, Artificial Sequence
  chemically synthesized
gttttttcgaaattgtatttat

SEQ ID NO: 1013475 - DNA, 22 bp, Artificial Sequence
  chemically synthesized
atttgttttttcgaaattgtat

SEQ ID NO: 1013476 - DNA, 22 bp, Artificial Sequence
  chemically synthesized
gatttgttttttcgaaattgta

SEQ ID NO: 1013477 - DNA, 22 bp, Artificial Sequence
  chemically synthesized
tgatttgttttttcgaaattgt

SEQ ID NO: 1013478 - DNA, 22 bp, Artificial Sequence
  chemically synthesized
aagataaatacaatttcgaaaa

SEQ ID NO: 1013479 - DNA, 22 bp, Artificial Sequence
  chemically synthesized
aggtaagtctttgatttgtttt

SEQ ID NO: 1013480 - DNA, 22 bp, Artificial Sequence
  chemically synthesized
aaggtaagtctttgatttgttt

SEQ ID NO: 1013481 - DNA, 22 bp, Artificial Sequence
  chemically synthesized
cgaaaaaacaaatcaaagactt

SEQ ID NO: 1013482 - DNA, 22 bp, Artificial Sequence
  chemically synthesized
gaaaaaacaaatcaaagactta

SEQ ID NO: 1013483 - DNA, 22 bp, Artificial Sequence
  chemically synthesized
aatacaaatggtatcttaaggt

SEQ ID NO: 1013484 - DNA, 22 bp, Artificial Sequence
  chemically synthesized
ggaacatgctaaatacaaatgg

SEQ ID NO: 1013485 - DNA, 22 bp, Artificial Sequence
  chemically synthesized
accttaagataccatttgtatt

SEQ ID NO: 1013486 - DNA, 22 bp, Artificial Sequence
  chemically synthesized
ccttaagataccatttgtattt

SEQ ID NO: 1013487 - DNA, 22 bp, Artificial Sequence
  chemically synthesized
aagataccatttgtatttagca

SEQ ID NO: 1013488 - DNA, 22 bp, Artificial Sequence
  chemically synthesized
agataccatttgtatttagcat

SEQ ID NO: 1013489 - DNA, 22 bp, Artificial Sequence
  chemically synthesized
agaattgggaacatgctaaata

SEQ ID NO: 1013490 - DNA, 22 bp, Artificial Sequence
  chemically synthesized
ctgagaattgggaacatgctaa

SEQ ID NO: 1013491 - DNA, 22 bp, Artificial Sequence
  chemically synthesized
gtatttagcatgttcccaattc

SEQ ID NO: 1013492 - DNA, 22 bp, Artificial Sequence
  chemically synthesized
tatttagcatgttcccaattct

SEQ ID NO: 1013493 - DNA, 22 bp, Artificial Sequence
  chemically synthesized
agcatgttcccaattctcagga

SEQ ID NO: 1013494 - DNA, 22 bp, Artificial Sequence
  chemically synthesized
gcatgttcccaattctcaggaa

SEQ ID NO: 1013495 - DNA, 22 bp, Artificial Sequence
  chemically synthesized
agaaagacacaaattcctgaga

SEQ ID NO: 1013496 - DNA, 22 bp, Artificial Sequence
  chemically synthesized
tcagaaagacacaaattcctga

SEQ ID NO: 1013497 - DNA, 22 bp, Artificial Sequence
  chemically synthesized
ctcagaaagacacaaattcctg

SEQ ID NO: 1013498 - DNA, 22 bp, Artificial Sequence
  chemically synthesized
ccaattctcaggaatttgtgtc

SEQ ID NO: 1013499 - DNA, 22 bp, Artificial Sequence
  chemically synthesized
aacagtttctcagaaagacaca

SEQ ID NO: 1013500 - DNA, 22 bp, Artificial Sequence
  chemically synthesized
tcaggaatttgtgtctttctga

SEQ ID NO: 1013501 - DNA, 22 bp, Artificial Sequence
  chemically synthesized
aggaatttgtgtctttctgaga

SEQ ID NO: 1013502 - DNA, 22 bp, Artificial Sequence
  chemically synthesized
acagaagctgaacagtttctca

SEQ ID NO: 1013503 - DNA, 22 bp, Artificial Sequence
  chemically synthesized
gtgtctttctgagaaactgttc

SEQ ID NO: 1013504 - DNA, 22 bp, Artificial Sequence
  chemically synthesized
tgtctttctgagaaactgttca

SEQ ID NO: 1013505 - DNA, 22 bp, Artificial Sequence
  chemically synthesized
tctgagaaactgttcagcttct

SEQ ID NO: 1013506 - DNA, 22 bp, Artificial Sequence
  chemically synthesized
ctgagaaactgttcagcttctg

SEQ ID NO: 1013507 - DNA, 22 bp, Artificial Sequence
  chemically synthesized
atcagtggctaacagaagctga

SEQ ID NO: 1013508 - DNA, 22 bp, Artificial Sequence
  chemically synthesized
tgagaaactgttcagcttctgt

SEQ ID NO: 1013509 - DNA, 22 bp, Artificial Sequence
  chemically synthesized
aatcagtggctaacagaagctg

SEQ ID NO: 1013510 - DNA, 22 bp, Artificial Sequence
  chemically synthesized
agaaactgttcagcttctgtta

SEQ ID NO: 1013511 - DNA, 22 bp, Artificial Sequence
  chemically synthesized
ttcagcttctgttagccactga

SEQ ID NO: 1013512 - DNA, 22 bp, Artificial Sequence
  chemically synthesized
agcttctgttagccactgatta

SEQ ID NO: 1013513 - DNA, 22 bp, Artificial Sequence
  chemically synthesized
tgatataaagatatttaatcag

SEQ ID NO: 1013514 - DNA, 22 bp, Artificial Sequence
  chemically synthesized
ctgttagccactgattaaatat

SEQ ID NO: 1013515 - DNA, 22 bp, Artificial Sequence
  chemically synthesized
tgttagccactgattaaatatc

SEQ ID NO: 1013516 - DNA, 22 bp, Artificial Sequence
  chemically synthesized
attatgatataaagatatttaa

SEQ ID NO: 1013517 - DNA, 22 bp, Artificial Sequence
  chemically synthesized
ttagccactgattaaatatctt

SEQ ID NO: 1013518 - DNA, 22 bp, Artificial Sequence
  chemically synthesized
cattatgatataaagatattta

SEQ ID NO: 1013519 - DNA, 22 bp, Artificial Sequence
  chemically synthesized
tcattatgatataaagatattt

SEQ ID NO: 1013520 - DNA, 22 bp, Artificial Sequence
  chemically synthesized
gccactgattaaatatctttat

SEQ ID NO: 1013521 - DNA, 22 bp, Artificial Sequence
  chemically synthesized
attaaatatctttatatcataa

SEQ ID NO: 1013522 - DNA, 22 bp, Artificial Sequence
  chemically synthesized
aatatctttatatcataatgaa

SEQ ID NO: 1013523 - DNA, 22 bp, Artificial Sequence
  chemically synthesized
agaaatggcggcgttttcatta

SEQ ID NO: 1013524 - DNA, 22 bp, Artificial Sequence
  chemically synthesized
ttgagaaatggcggcgttttca

SEQ ID NO: 1013525 - DNA, 22 bp, Artificial Sequence
  chemically synthesized
tatatcataatgaaaacgccgc

SEQ ID NO: 1013526 - DNA, 22 bp, Artificial Sequence
  chemically synthesized
atatcataatgaaaacgccgcc

SEQ ID NO: 1013527 - DNA, 22 bp, Artificial Sequence
  chemically synthesized
tatcataatgaaaacgccgcca

SEQ ID NO: 1013528 - DNA, 22 bp, Artificial Sequence
  chemically synthesized
acagatctgttgagaaatggcg

SEQ ID NO: 1013529 - DNA, 22 bp, Artificial Sequence
  chemically synthesized
gacagatctgttgagaaatggc

SEQ ID NO: 1013530 - DNA, 22 bp, Artificial Sequence
  chemically synthesized
caggcgatttgacagatctgtt

SEQ ID NO: 1013531 - DNA, 22 bp, Artificial Sequence
  chemically synthesized
cctgcaggcgatttgacagatc

SEQ ID NO: 1013532 - DNA, 22 bp, Artificial Sequence
  chemically synthesized
acctgcaggcgatttgacagat

SEQ ID NO: 1013533 - DNA, 22 bp, Artificial Sequence
  chemically synthesized
tacctgcaggcgatttgacaga

SEQ ID NO: 1013534 - DNA, 22 bp, Artificial Sequence
  chemically synthesized
ttacctgcaggcgatttgacag

SEQ ID NO: 1013535 - DNA, 22 bp, Artificial Sequence
  chemically synthesized
ctcaacagatctgtcaaatcgc

SEQ ID NO: 1013536 - DNA, 22 bp, Artificial Sequence
  chemically synthesized
tcaacagatctgtcaaatcgcc

SEQ ID NO: 1013537 - DNA, 22 bp, Artificial Sequence
  chemically synthesized
aacagatctgtcaaatcgcctg

SEQ ID NO: 1013538 - DNA, 22 bp, Artificial Sequence
  chemically synthesized
atccatatgcttttacctgcag

SEQ ID NO: 1013539 - DNA, 22 bp, Artificial Sequence
  chemically synthesized
gatccatatgcttttacctgca

SEQ ID NO: 1013540 - DNA, 22 bp, Artificial Sequence
  chemically synthesized
tcaaatcgcctgcaggtaaaag

SEQ ID NO: 1013541 - DNA, 22 bp, Artificial Sequence
  chemically synthesized
ttgatccatatgcttttacctg

SEQ ID NO: 1013542 - DNA, 22 bp, Artificial Sequence
  chemically synthesized
cttgatccatatgcttttacct

SEQ ID NO: 1013543 - DNA, 22 bp, Artificial Sequence
  chemically synthesized
tcttgatccatatgcttttacc

SEQ ID NO: 1013544 - DNA, 22 bp, Artificial Sequence
  chemically synthesized
ttcttgatccatatgcttttac

SEQ ID NO: 1013545 - DNA, 22 bp, Artificial Sequence
  chemically synthesized
tttttcttgatccatatgcttt

SEQ ID NO: 1013546 - DNA, 22 bp, Artificial Sequence
  chemically synthesized
caggtaaaagcatatggatcaa

SEQ ID NO: 1013547 - DNA, 22 bp, Artificial Sequence
  chemically synthesized
cataatccatctatttttcttg

SEQ ID NO: 1013548 - DNA, 22 bp, Artificial Sequence
  chemically synthesized
acataatccatctatttttctt

SEQ ID NO: 1013549 - DNA, 22 bp, Artificial Sequence
  chemically synthesized
tacataatccatctatttttct

SEQ ID NO: 1013550 - DNA, 22 bp, Artificial Sequence
  chemically synthesized
ttttacataatccatctatttt

SEQ ID NO: 1013551 - DNA, 22 bp, Artificial Sequence
  chemically synthesized
taatctgttttacataatccat

SEQ ID NO: 1013552 - DNA, 22 bp, Artificial Sequence
  chemically synthesized
tataatctgttttacataatcc

SEQ ID NO: 1013553 - DNA, 22 bp, Artificial Sequence
  chemically synthesized
tatctctataatctgttttaca

SEQ ID NO: 1013554 - DNA, 22 bp, Artificial Sequence
  chemically synthesized
tgtaaaacagattatagagata

SEQ ID NO: 1013555 - DNA, 22 bp, Artificial Sequence
  chemically synthesized
tagagatatagcgtatattttt

SEQ ID NO: 1013556 - DNA, 22 bp, Artificial Sequence
  chemically synthesized
tcagtataaccaaaaaatatac

SEQ ID NO: 1013557 - DNA, 22 bp, Artificial Sequence
  chemically synthesized
gtcagtataaccaaaaaatata

SEQ ID NO: 1013558 - DNA, 22 bp, Artificial Sequence
  chemically synthesized
tgtcagtataaccaaaaaatat

SEQ ID NO: 1013559 - DNA, 22 bp, Artificial Sequence
  chemically synthesized
tcagagtgatatctttgtcagt

SEQ ID NO: 1013560 - DNA, 22 bp, Artificial Sequence
  chemically synthesized
tttggttatactgacaaagata

SEQ ID NO: 1013561 - DNA, 22 bp, Artificial Sequence
  chemically synthesized
ttggttatactgacaaagatat

SEQ ID NO: 1013562 - DNA, 22 bp, Artificial Sequence
  chemically synthesized
tggttatactgacaaagatatc

SEQ ID NO: 1013563 - DNA, 22 bp, Artificial Sequence
  chemically synthesized
ggttatactgacaaagatatca

SEQ ID NO: 1013564 - DNA, 22 bp, Artificial Sequence
  chemically synthesized
gttatactgacaaagatatcac

SEQ ID NO: 1013565 - DNA, 22 bp, Artificial Sequence
  chemically synthesized
tactgacaaagatatcactctg

SEQ ID NO: 1013566 - DNA, 22 bp, Artificial Sequence
  chemically synthesized
acaaagatatcactctgatagt

SEQ ID NO: 1013567 - DNA, 22 bp, Artificial Sequence
  chemically synthesized
caaatgcaggaaactatcagag

SEQ ID NO: 1013568 - DNA, 22 bp, Artificial Sequence
  chemically synthesized
tgcaaatgcaggaaactatcag

SEQ ID NO: 1013569 - DNA, 22 bp, Artificial Sequence
  chemically synthesized
aactctgcaaatgcaggaaact

SEQ ID NO: 1013570 - DNA, 22 bp, Artificial Sequence
  chemically synthesized
aaactaaactctgcaaatgcag

SEQ ID NO: 1013571 - DNA, 22 bp, Artificial Sequence
  chemically synthesized
gaaactaaactctgcaaatgca

SEQ ID NO: 1013572 - DNA, 22 bp, Artificial Sequence
  chemically synthesized
tgatagtttcctgcatttgcag

SEQ ID NO: 1013573 - DNA, 22 bp, Artificial Sequence
  chemically synthesized
atagtttcctgcatttgcagag

SEQ ID NO: 1013574 - DNA, 22 bp, Artificial Sequence
  chemically synthesized
cttgaaactaaactctgcaaat

SEQ ID NO: 1013575 - DNA, 22 bp, Artificial Sequence
  chemically synthesized
ttacttgaaactaaactctgca

SEQ ID NO: 1013576 - DNA, 22 bp, Artificial Sequence
  chemically synthesized
gttacttgaaactaaactctgc

SEQ ID NO: 1013577 - DNA, 22 bp, Artificial Sequence
  chemically synthesized
cctgcatttgcagagtttagtt

SEQ ID NO: 1013578 - DNA, 22 bp, Artificial Sequence
  chemically synthesized
tttgttacttgaaactaaactc

SEQ ID NO: 1013579 - DNA, 22 bp, Artificial Sequence
  chemically synthesized
ctgcatttgcagagtttagttt

SEQ ID NO: 1013580 - DNA, 22 bp, Artificial Sequence
  chemically synthesized
atttgttacttgaaactaaact

SEQ ID NO: 1013581 - DNA, 22 bp, Artificial Sequence
  chemically synthesized
tatttgttacttgaaactaaac

SEQ ID NO: 1013582 - DNA, 22 bp, Artificial Sequence
  chemically synthesized
ttatttgttacttgaaactaaa

SEQ ID NO: 1013583 - DNA, 22 bp, Artificial Sequence
  chemically synthesized
catttgcagagtttagtttcaa

SEQ ID NO: 1013584 - DNA, 22 bp, Artificial Sequence
  chemically synthesized
atttttatttgttacttgaaac

SEQ ID NO: 1013585 - DNA, 22 bp, Artificial Sequence
  chemically synthesized
gcagagtttagtttcaagtaac

SEQ ID NO: 1013586 - DNA, 22 bp, Artificial Sequence
  chemically synthesized
cagagtttagtttcaagtaaca

SEQ ID NO: 1013587 - DNA, 22 bp, Artificial Sequence
  chemically synthesized
agtttcaagtaacaaataaaaa

SEQ ID NO: 1013588 - DNA, 22 bp, Artificial Sequence
  chemically synthesized
gtttcaagtaacaaataaaaat

SEQ ID NO: 1013589 - DNA, 22 bp, Artificial Sequence
  chemically synthesized
ggtgtgtatattaatttttatt

SEQ ID NO: 1013590 - DNA, 22 bp, Artificial Sequence
  chemically synthesized
caagtaacaaataaaaattaat

SEQ ID NO: 1013591 - DNA, 22 bp, Artificial Sequence
  chemically synthesized
aagtaacaaataaaaattaata

SEQ ID NO: 1013592 - DNA, 22 bp, Artificial Sequence
  chemically synthesized
tgtgtacatgctaggtgtgtat

SEQ ID NO: 1013593 - DNA, 22 bp, Artificial Sequence
  chemically synthesized
aaatgttgtgtgtacatgctag

SEQ ID NO: 1013594 - DNA, 22 bp, Artificial Sequence
  chemically synthesized
aaaatgttgtgtgtacatgcta

SEQ ID NO: 1013595 - DNA, 22 bp, Artificial Sequence
  chemically synthesized
atatacacacctagcatgtaca

SEQ ID NO: 1013596 - DNA, 22 bp, Artificial Sequence
  chemically synthesized
taaaatgttgtgtgtacatgct

SEQ ID NO: 1013597 - DNA, 22 bp, Artificial Sequence
  chemically synthesized
ttaaaatgttgtgtgtacatgc

SEQ ID NO: 1013598 - DNA, 22 bp, Artificial Sequence
  chemically synthesized
tttaaaatgttgtgtgtacatg

SEQ ID NO: 1013599 - DNA, 22 bp, Artificial Sequence
  chemically synthesized
ttttaaaatgttgtgtgtacat

SEQ ID NO: 1013600 - DNA, 22 bp, Artificial Sequence
  chemically synthesized
agtatttttttaaaatgttgtg

SEQ ID NO: 1013601 - DNA, 22 bp, Artificial Sequence
  chemically synthesized
gcatgtacacacaacattttaa

SEQ ID NO: 1013602 - DNA, 22 bp, Artificial Sequence
  chemically synthesized
tattgagtatttttttaaaatg

SEQ ID NO: 1013603 - DNA, 22 bp, Artificial Sequence
  chemically synthesized
atattgagtatttttttaaaat

SEQ ID NO: 1013604 - DNA, 22 bp, Artificial Sequence
  chemically synthesized
tatattgagtatttttttaaaa

SEQ ID NO: 1013605 - DNA, 22 bp, Artificial Sequence
  chemically synthesized
ttatattgagtatttttttaaa

SEQ ID NO: 1013606 - DNA, 22 bp, Artificial Sequence
  chemically synthesized
aaatcagcttttatattgagta

SEQ ID NO: 1013607 - DNA, 22 bp, Artificial Sequence
  chemically synthesized
aaaatcagcttttatattgagt

SEQ ID NO: 1013608 - DNA, 22 bp, Artificial Sequence
  chemically synthesized
taaaaaaatactcaatataaaa

SEQ ID NO: 1013609 - DNA, 22 bp, Artificial Sequence
  chemically synthesized
aaaaaaatactcaatataaaag

SEQ ID NO: 1013610 - DNA, 22 bp, Artificial Sequence
  chemically synthesized
aaaaaatactcaatataaaagc

SEQ ID NO: 1013611 - DNA, 22 bp, Artificial Sequence
  chemically synthesized
catttaaaatcagcttttatat

SEQ ID NO: 1013612 - DNA, 22 bp, Artificial Sequence
  chemically synthesized
ccatttaaaatcagcttttata

SEQ ID NO: 1013613 - DNA, 22 bp, Artificial Sequence
  chemically synthesized
caaccttccatttaaaatcagc

SEQ ID NO: 1013614 - DNA, 22 bp, Artificial Sequence
  chemically synthesized
aatataaaagctgattttaaat

SEQ ID NO: 1013615 - DNA, 22 bp, Artificial Sequence
  chemically synthesized
aagggaaaaattgcaaccttcc

SEQ ID NO: 1013616 - DNA, 22 bp, Artificial Sequence
  chemically synthesized
aaagggaaaaattgcaaccttc

SEQ ID NO: 1013617 - DNA, 22 bp, Artificial Sequence
  chemically synthesized
taaagggaaaaattgcaacctt

SEQ ID NO: 1013618 - DNA, 22 bp, Artificial Sequence
  chemically synthesized
attttaaatggaaggttgcaat

SEQ ID NO: 1013619 - DNA, 22 bp, Artificial Sequence
  chemically synthesized
attttaaagggaaaaattgcaa

SEQ ID NO: 1013620 - DNA, 22 bp, Artificial Sequence
  chemically synthesized
taaatggaaggttgcaattttt

SEQ ID NO: 1013621 - DNA, 22 bp, Artificial Sequence
  chemically synthesized
aaatggaaggttgcaatttttc

SEQ ID NO: 1013622 - DNA, 22 bp, Artificial Sequence
  chemically synthesized
aatggaaggttgcaatttttcc

SEQ ID NO: 1013623 - DNA, 22 bp, Artificial Sequence
  chemically synthesized
caatttttccctttaaaatgaa

SEQ ID NO: 1013624 - DNA, 22 bp, Artificial Sequence
  chemically synthesized
atcaataaatatattcatttta

SEQ ID NO: 1013625 - DNA, 22 bp, Artificial Sequence
  chemically synthesized
aatcaataaatatattcatttt

SEQ ID NO: 1013626 - DNA, 22 bp, Artificial Sequence
  chemically synthesized
taatcaataaatatattcattt

SEQ ID NO: 1013627 - DNA, 22 bp, Artificial Sequence
  chemically synthesized
ttaatcaataaatatattcatt

SEQ ID NO: 1013628 - DNA, 22 bp, Artificial Sequence
  chemically synthesized
ttccctttaaaatgaatatatt

SEQ ID NO: 1013629 - DNA, 22 bp, Artificial Sequence
  chemically synthesized
ttttaatcaataaatatattca

SEQ ID NO: 1013630 - DNA, 22 bp, Artificial Sequence
  chemically synthesized
tccctttaaaatgaatatattt

SEQ ID NO: 1013631 - DNA, 22 bp, Artificial Sequence
  chemically synthesized
cttttaatcaataaatatattc

SEQ ID NO: 1013632 - DNA, 22 bp, Artificial Sequence
  chemically synthesized
ccctttaaaatgaatatattta

SEQ ID NO: 1013633 - DNA, 22 bp, Artificial Sequence
  chemically synthesized
tcttttaatcaataaatatatt

SEQ ID NO: 1013634 - DNA, 22 bp, Artificial Sequence
  chemically synthesized
cctttaaaatgaatatatttat

SEQ ID NO: 1013635 - DNA, 22 bp, Artificial Sequence
  chemically synthesized
tctttcttttaatcaataaata

SEQ ID NO: 1013636 - DNA, 22 bp, Artificial Sequence
  chemically synthesized
taaaatgaatatatttattgat

SEQ ID NO: 1013637 - DNA, 22 bp, Artificial Sequence
  chemically synthesized
atctttcttttaatcaataaat

SEQ ID NO: 1013638 - DNA, 22 bp, Artificial Sequence
  chemically synthesized
aaaatgaatatatttattgatt

SEQ ID NO: 1013639 - DNA, 22 bp, Artificial Sequence
  chemically synthesized
tatctttcttttaatcaataaa

SEQ ID NO: 1013640 - DNA, 22 bp, Artificial Sequence
  chemically synthesized
aaatgaatatatttattgatta

SEQ ID NO: 1013641 - DNA, 22 bp, Artificial Sequence
  chemically synthesized
ctttatctttcttttaatcaat

SEQ ID NO: 1013642 - DNA, 22 bp, Artificial Sequence
  chemically synthesized
attgattaaaagaaagataaag

SEQ ID NO: 1013643 - DNA, 22 bp, Artificial Sequence
  chemically synthesized
ttgattaaaagaaagataaagc

SEQ ID NO: 1013644 - DNA, 22 bp, Artificial Sequence
  chemically synthesized
attaaaagaaagataaagcaac

SEQ ID NO: 1013645 - DNA, 22 bp, Artificial Sequence
  chemically synthesized
aaagaaagataaagcaactatt

SEQ ID NO: 1013646 - DNA, 22 bp, Artificial Sequence
  chemically synthesized
ggaaagaaaatgccaatagtcc

SEQ ID NO: 1013647 - DNA, 22 bp, Artificial Sequence
  chemically synthesized
aggaaagaaaatgccaatagtc

SEQ ID NO: 1013648 - DNA, 22 bp, Artificial Sequence
  chemically synthesized
taggaaagaaaatgccaatagt

SEQ ID NO: 1013649 - DNA, 22 bp, Artificial Sequence
  chemically synthesized
ttaggaaagaaaatgccaatag

SEQ ID NO: 1013650 - DNA, 22 bp, Artificial Sequence
  chemically synthesized
ttttggactattggcattttct

SEQ ID NO: 1013651 - DNA, 22 bp, Artificial Sequence
  chemically synthesized
tggactattggcattttctttc

SEQ ID NO: 1013652 - DNA, 22 bp, Artificial Sequence
  chemically synthesized
ggactattggcattttctttcc

SEQ ID NO: 1013653 - DNA, 22 bp, Artificial Sequence
  chemically synthesized
gactattggcattttctttcct

SEQ ID NO: 1013654 - DNA, 22 bp, Artificial Sequence
  chemically synthesized
aaaaaatatatttttaggaaag

SEQ ID NO: 1013655 - DNA, 22 bp, Artificial Sequence
  chemically synthesized
ttggcattttctttcctaaaaa

SEQ ID NO: 1013656 - DNA, 22 bp, Artificial Sequence
  chemically synthesized
gcattttctttcctaaaaatat

SEQ ID NO: 1013657 - DNA, 22 bp, Artificial Sequence
  chemically synthesized
gaattaaaaaaatatattttta

SEQ ID NO: 1013658 - DNA, 22 bp, Artificial Sequence
  chemically synthesized
tagaattaaaaaaatatatttt

SEQ ID NO: 1013659 - DNA, 22 bp, Artificial Sequence
  chemically synthesized
ctagaattaaaaaaatatattt

SEQ ID NO: 1013660 - DNA, 22 bp, Artificial Sequence
  chemically synthesized
tctttcctaaaaatatattttt

SEQ ID NO: 1013661 - DNA, 22 bp, Artificial Sequence
  chemically synthesized
ctttcctaaaaatatatttttt

SEQ ID NO: 1013662 - DNA, 22 bp, Artificial Sequence
  chemically synthesized
tttcctaaaaatatattttttt

SEQ ID NO: 1013663 - DNA, 22 bp, Artificial Sequence
  chemically synthesized
tcctaaaaatatatttttttaa

SEQ ID NO: 1013664 - DNA, 22 bp, Artificial Sequence
  chemically synthesized
cctaaaaatatatttttttaat

SEQ ID NO: 1013665 - DNA, 22 bp, Artificial Sequence
  chemically synthesized
taaatttctagaattaaaaaaa

SEQ ID NO: 1013666 - DNA, 22 bp, Artificial Sequence
  chemically synthesized
ctaaaaatatatttttttaatt

SEQ ID NO: 1013667 - DNA, 22 bp, Artificial Sequence
  chemically synthesized
gtaaatttctagaattaaaaaa

SEQ ID NO: 1013668 - DNA, 22 bp, Artificial Sequence
  chemically synthesized
aaaatatatttttttaattcta

SEQ ID NO: 1013669 - DNA, 22 bp, Artificial Sequence
  chemically synthesized
agatatttgtaaatttctagaa

SEQ ID NO: 1013670 - DNA, 22 bp, Artificial Sequence
  chemically synthesized
ttttaattctagaaatttacaa

SEQ ID NO: 1013671 - DNA, 22 bp, Artificial Sequence
  chemically synthesized
tttaattctagaaatttacaaa

SEQ ID NO: 1013672 - DNA, 22 bp, Artificial Sequence
  chemically synthesized
ttaattctagaaatttacaaat

SEQ ID NO: 1013673 - DNA, 22 bp, Artificial Sequence
  chemically synthesized
caatgttaagatatttgtaaat

SEQ ID NO: 1013674 - DNA, 22 bp, Artificial Sequence
  chemically synthesized
taattctagaaatttacaaata

SEQ ID NO: 1013675 - DNA, 22 bp, Artificial Sequence
  chemically synthesized
aattctagaaatttacaaatat

SEQ ID NO: 1013676 - DNA, 22 bp, Artificial Sequence
  chemically synthesized
attctagaaatttacaaatatc

SEQ ID NO: 1013677 - DNA, 22 bp, Artificial Sequence
  chemically synthesized
ttacaatgttaagatatttgta

SEQ ID NO: 1013678 - DNA, 22 bp, Artificial Sequence
  chemically synthesized
attacaatgttaagatatttgt

SEQ ID NO: 1013679 - DNA, 22 bp, Artificial Sequence
  chemically synthesized
tagaaatttacaaatatcttaa

SEQ ID NO: 1013680 - DNA, 22 bp, Artificial Sequence
  chemically synthesized
gaaatttacaaatatcttaaca

SEQ ID NO: 1013681 - DNA, 22 bp, Artificial Sequence
  chemically synthesized
caaataatttattacaatgtta

SEQ ID NO: 1013682 - DNA, 22 bp, Artificial Sequence
  chemically synthesized
ccaaataatttattacaatgtt

SEQ ID NO: 1013683 - DNA, 22 bp, Artificial Sequence
  chemically synthesized
acaaatatcttaacattgtaat

SEQ ID NO: 1013684 - DNA, 22 bp, Artificial Sequence
  chemically synthesized
caaatatcttaacattgtaata

SEQ ID NO: 1013685 - DNA, 22 bp, Artificial Sequence
  chemically synthesized
cttccaaataatttattacaat

SEQ ID NO: 1013686 - DNA, 22 bp, Artificial Sequence
  chemically synthesized
aacattgtaataaattatttgg

SEQ ID NO: 1013687 - DNA, 22 bp, Artificial Sequence
  chemically synthesized
acattgtaataaattatttgga

SEQ ID NO: 1013688 - DNA, 22 bp, Artificial Sequence
  chemically synthesized
aaagggaatatattgcttccaa

SEQ ID NO: 1013689 - DNA, 22 bp, Artificial Sequence
  chemically synthesized
taataaattatttggaagcaat

SEQ ID NO: 1013690 - DNA, 22 bp, Artificial Sequence
  chemically synthesized
gaaagggaatatattgcttcca

SEQ ID NO: 1013691 - DNA, 22 bp, Artificial Sequence
  chemically synthesized
tgaaagggaatatattgcttcc

SEQ ID NO: 1013692 - DNA, 22 bp, Artificial Sequence
  chemically synthesized
tttggaagcaatatattccctt

SEQ ID NO: 1013693 - DNA, 22 bp, Artificial Sequence
  chemically synthesized
ggaagcaatatattccctttca

SEQ ID NO: 1013694 - DNA, 22 bp, Artificial Sequence
  chemically synthesized
gaagcaatatattccctttcaa

SEQ ID NO: 1013695 - DNA, 22 bp, Artificial Sequence
  chemically synthesized
tccaaaaatattttgaaaggga

SEQ ID NO: 1013696 - DNA, 22 bp, Artificial Sequence
  chemically synthesized
atccaaaaatattttgaaaggg

SEQ ID NO: 1013697 - DNA, 22 bp, Artificial Sequence
  chemically synthesized
tatccaaaaatattttgaaagg

SEQ ID NO: 1013698 - DNA, 22 bp, Artificial Sequence
  chemically synthesized
ttatccaaaaatattttgaaag

SEQ ID NO: 1013699 - DNA, 22 bp, Artificial Sequence
  chemically synthesized
cctttcaaaatatttttggata

SEQ ID NO: 1013700 - DNA, 22 bp, Artificial Sequence
  chemically synthesized
tgaagtaatttttatccaaaaa

SEQ ID NO: 1013701 - DNA, 22 bp, Artificial Sequence
  chemically synthesized
atgaagtaatttttatccaaaa

SEQ ID NO: 1013702 - DNA, 22 bp, Artificial Sequence
  chemically synthesized
tcaaaatatttttggataaaaa

SEQ ID NO: 1013703 - DNA, 22 bp, Artificial Sequence
  chemically synthesized
caaaatatttttggataaaaat

SEQ ID NO: 1013704 - DNA, 22 bp, Artificial Sequence
  chemically synthesized
aaaatatttttggataaaaatt

SEQ ID NO: 1013705 - DNA, 22 bp, Artificial Sequence
  chemically synthesized
ttggataaaaattacttcataa

SEQ ID NO: 1013706 - DNA, 22 bp, Artificial Sequence
  chemically synthesized
tggataaaaattacttcataaa

SEQ ID NO: 1013707 - DNA, 22 bp, Artificial Sequence
  chemically synthesized
aaagtgatagaatttatgaagt

SEQ ID NO: 1013708 - DNA, 22 bp, Artificial Sequence
  chemically synthesized
ggataaaaattacttcataaat

SEQ ID NO: 1013709 - DNA, 22 bp, Artificial Sequence
  chemically synthesized
gataaaaattacttcataaatt

SEQ ID NO: 1013710 - DNA, 22 bp, Artificial Sequence
  chemically synthesized
cttcataaattctatcactttc

SEQ ID NO: 1013711 - DNA, 22 bp, Artificial Sequence
  chemically synthesized
cataaattctatcactttcaat

SEQ ID NO: 1013712 - DNA, 22 bp, Artificial Sequence
  chemically synthesized
ataaattctatcactttcaata

SEQ ID NO: 1013713 - DNA, 22 bp, Artificial Sequence
  chemically synthesized
gatcaagaataatattgaaagt

SEQ ID NO: 1013714 - DNA, 22 bp, Artificial Sequence
  chemically synthesized
ggatcaagaataatattgaaag

SEQ ID NO: 1013715 - DNA, 22 bp, Artificial Sequence
  chemically synthesized
tggatcaagaataatattgaaa

SEQ ID NO: 1013716 - DNA, 22 bp, Artificial Sequence
  chemically synthesized
tatcactttcaatattattctt

SEQ ID NO: 1013717 - DNA, 22 bp, Artificial Sequence
  chemically synthesized
tcactttcaatattattcttga

SEQ ID NO: 1013718 - DNA, 22 bp, Artificial Sequence
  chemically synthesized
tcaatattattcttgatccaaa

SEQ ID NO: 1013719 - DNA, 22 bp, Artificial Sequence
  chemically synthesized
caatattattcttgatccaaaa

SEQ ID NO: 1013720 - DNA, 22 bp, Artificial Sequence
  chemically synthesized
atgaacaggcagttttggatca

SEQ ID NO: 1013721 - DNA, 22 bp, Artificial Sequence
  chemically synthesized
aatattattcttgatccaaaac

SEQ ID NO: 1013722 - DNA, 22 bp, Artificial Sequence
  chemically synthesized
agttgatgaacaggcagttttg

SEQ ID NO: 1013723 - DNA, 22 bp, Artificial Sequence
  chemically synthesized
cagttgatgaacaggcagtttt

SEQ ID NO: 1013724 - DNA, 22 bp, Artificial Sequence
  chemically synthesized
tcagttgatgaacaggcagttt

SEQ ID NO: 1013725 - DNA, 22 bp, Artificial Sequence
  chemically synthesized
ttcttgatccaaaactgcctgt

SEQ ID NO: 1013726 - DNA, 22 bp, Artificial Sequence
  chemically synthesized
ctttcagttgatgaacaggcag

SEQ ID NO: 1013727 - DNA, 22 bp, Artificial Sequence
  chemically synthesized
ttgatccaaaactgcctgttca

SEQ ID NO: 1013728 - DNA, 22 bp, Artificial Sequence
  chemically synthesized
gatccaaaactgcctgttcatc

SEQ ID NO: 1013729 - DNA, 22 bp, Artificial Sequence
  chemically synthesized
ctcctttcagttgatgaacagg

SEQ ID NO: 1013730 - DNA, 22 bp, Artificial Sequence
  chemically synthesized
atccaaaactgcctgttcatca

SEQ ID NO: 1013731 - DNA, 22 bp, Artificial Sequence
  chemically synthesized
ttactcctttcagttgatgaac

SEQ ID NO: 1013732 - DNA, 22 bp, Artificial Sequence
  chemically synthesized
attactcctttcagttgatgaa

SEQ ID NO: 1013733 - DNA, 22 bp, Artificial Sequence
  chemically synthesized
gaacttattactcctttcagtt

SEQ ID NO: 1013734 - DNA, 22 bp, Artificial Sequence
  chemically synthesized
cctgttcatcaactgaaaggag

SEQ ID NO: 1013735 - DNA, 22 bp, Artificial Sequence
  chemically synthesized
ttcatcaactgaaaggagtaat

SEQ ID NO: 1013736 - DNA, 22 bp, Artificial Sequence
  chemically synthesized
atcaactgaaaggagtaataag

SEQ ID NO: 1013737 - DNA, 22 bp, Artificial Sequence
  chemically synthesized
tgcaatagaacactagaactta

SEQ ID NO: 1013738 - DNA, 22 bp, Artificial Sequence
  chemically synthesized
aaaggagtaataagttctagtg

SEQ ID NO: 1013739 - DNA, 22 bp, Artificial Sequence
  chemically synthesized
ctatgcaatagaacactagaac

SEQ ID NO: 1013740 - DNA, 22 bp, Artificial Sequence
  chemically synthesized
atattactatgcaatagaacac

SEQ ID NO: 1013741 - DNA, 22 bp, Artificial Sequence
  chemically synthesized
ttcatattactatgcaatagaa

SEQ ID NO: 1013742 - DNA, 22 bp, Artificial Sequence
  chemically synthesized
gttcatattactatgcaataga

SEQ ID NO: 1013743 - DNA, 22 bp, Artificial Sequence
  chemically synthesized
tgttcatattactatgcaatag

SEQ ID NO: 1013744 - DNA, 22 bp, Artificial Sequence
  chemically synthesized
tagtgttctattgcatagtaat

SEQ ID NO: 1013745 - DNA, 22 bp, Artificial Sequence
  chemically synthesized
gtgttctattgcatagtaatat

SEQ ID NO: 1013746 - DNA, 22 bp, Artificial Sequence
  chemically synthesized
gtaactttgttcatattactat

SEQ ID NO: 1013747 - DNA, 22 bp, Artificial Sequence
  chemically synthesized
tattgcatagtaatatgaacaa

SEQ ID NO: 1013748 - DNA, 22 bp, Artificial Sequence
  chemically synthesized
ttgcatagtaatatgaacaaag

SEQ ID NO: 1013749 - DNA, 22 bp, Artificial Sequence
  chemically synthesized
catagtaatatgaacaaagtta

SEQ ID NO: 1013750 - DNA, 22 bp, Artificial Sequence
  chemically synthesized
aaatatacagcacaatattggt

SEQ ID NO: 1013751 - DNA, 22 bp, Artificial Sequence
  chemically synthesized
gaaatatacagcacaatattgg

SEQ ID NO: 1013752 - DNA, 22 bp, Artificial Sequence
  chemically synthesized
tgaaatatacagcacaatattg

SEQ ID NO: 1013753 - DNA, 22 bp, Artificial Sequence
  chemically synthesized
ttttgaaatatacagcacaata

SEQ ID NO: 1013754 - DNA, 22 bp, Artificial Sequence
  chemically synthesized
actattttgaaatatacagcac

SEQ ID NO: 1013755 - DNA, 22 bp, Artificial Sequence
  chemically synthesized
cactattttgaaatatacagca

SEQ ID NO: 1013756 - DNA, 22 bp, Artificial Sequence
  chemically synthesized
tcactattttgaaatatacagc

SEQ ID NO: 1013757 - DNA, 22 bp, Artificial Sequence
  chemically synthesized
ccaatattgtgctgtatatttc

SEQ ID NO: 1013758 - DNA, 22 bp, Artificial Sequence
  chemically synthesized
tttcactattttgaaatataca

SEQ ID NO: 1013759 - DNA, 22 bp, Artificial Sequence
  chemically synthesized
tctttcactattttgaaatata

SEQ ID NO: 1013760 - DNA, 22 bp, Artificial Sequence
  chemically synthesized
aaattctctttcactattttga

SEQ ID NO: 1013761 - DNA, 22 bp, Artificial Sequence
  chemically synthesized
tgctgtatatttcaaaatagtg

SEQ ID NO: 1013762 - DNA, 22 bp, Artificial Sequence
  chemically synthesized
aaaattctctttcactattttg

SEQ ID NO: 1013763 - DNA, 22 bp, Artificial Sequence
  chemically synthesized
tatatttcaaaatagtgaaaga

SEQ ID NO: 1013764 - DNA, 22 bp, Artificial Sequence
  chemically synthesized
caaaatagtgaaagagaatttt

SEQ ID NO: 1013765 - DNA, 22 bp, Artificial Sequence
  chemically synthesized
aaaatagtgaaagagaatttta

SEQ ID NO: 1013766 - DNA, 22 bp, Artificial Sequence
  chemically synthesized
tggtgagaaaatttaaaattct

SEQ ID NO: 1013767 - DNA, 22 bp, Artificial Sequence
  chemically synthesized
tgtggtgagaaaatttaaaatt

SEQ ID NO: 1013768 - DNA, 22 bp, Artificial Sequence
  chemically synthesized
tctgtggtgagaaaatttaaaa

SEQ ID NO: 1013769 - DNA, 22 bp, Artificial Sequence
  chemically synthesized
ctctgtggtgagaaaatttaaa

SEQ ID NO: 1013770 - DNA, 22 bp, Artificial Sequence
  chemically synthesized
taatttctctgtggtgagaaaa

SEQ ID NO: 1013771 - DNA, 22 bp, Artificial Sequence
  chemically synthesized
ataatttctctgtggtgagaaa

SEQ ID NO: 1013772 - DNA, 22 bp, Artificial Sequence
  chemically synthesized
taaattttctcaccacagagaa

SEQ ID NO: 1013773 - DNA, 22 bp, Artificial Sequence
  chemically synthesized
aaattttctcaccacagagaaa

SEQ ID NO: 1013774 - DNA, 22 bp, Artificial Sequence
  chemically synthesized
aaacatttataatttctctgtg

SEQ ID NO: 1013775 - DNA, 22 bp, Artificial Sequence
  chemically synthesized
aattttctcaccacagagaaat

SEQ ID NO: 1013776 - DNA, 22 bp, Artificial Sequence
  chemically synthesized
tctcaccacagagaaattataa

SEQ ID NO: 1013777 - DNA, 22 bp, Artificial Sequence
  chemically synthesized
ctcaccacagagaaattataaa

SEQ ID NO: 1013778 - DNA, 22 bp, Artificial Sequence
  chemically synthesized
tcaccacagagaaattataaat

SEQ ID NO: 1013779 - DNA, 22 bp, Artificial Sequence
  chemically synthesized
accacagagaaattataaatgt

SEQ ID NO: 1013780 - DNA, 22 bp, Artificial Sequence
  chemically synthesized
gcagatccatagcctcaaacat

SEQ ID NO: 1013781 - DNA, 22 bp, Artificial Sequence
  chemically synthesized
ggcagatccatagcctcaaaca

SEQ ID NO: 1013782 - DNA, 22 bp, Artificial Sequence
  chemically synthesized
ttggcagatccatagcctcaaa

SEQ ID NO: 1013783 - DNA, 22 bp, Artificial Sequence
  chemically synthesized
cttggcagatccatagcctcaa

SEQ ID NO: 1013784 - DNA, 22 bp, Artificial Sequence
  chemically synthesized
taaatgtttgaggctatggatc

SEQ ID NO: 1013785 - DNA, 22 bp, Artificial Sequence
  chemically synthesized
gaggctatggatctgccaagaa

SEQ ID NO: 1013786 - DNA, 22 bp, Artificial Sequence
  chemically synthesized
aggctatggatctgccaagaaa

SEQ ID NO: 1013787 - DNA, 22 bp, Artificial Sequence
  chemically synthesized
tggatctgccaagaaacctgat

SEQ ID NO: 1013788 - DNA, 22 bp, Artificial Sequence
  chemically synthesized
tgtaatgatcaaatcaggtttc

SEQ ID NO: 1013789 - DNA, 22 bp, Artificial Sequence
  chemically synthesized
attgtgtaatgatcaaatcagg

SEQ ID NO: 1013790 - DNA, 22 bp, Artificial Sequence
  chemically synthesized
cattgtgtaatgatcaaatcag

SEQ ID NO: 1013791 - DNA, 22 bp, Artificial Sequence
  chemically synthesized
ccaagaaacctgatttgatcat

SEQ ID NO: 1013792 - DNA, 22 bp, Artificial Sequence
  chemically synthesized
agtgtaatgtttcattgtgtaa

SEQ ID NO: 1013793 - DNA, 22 bp, Artificial Sequence
  chemically synthesized
cagtgtaatgtttcattgtgta

SEQ ID NO: 1013794 - DNA, 22 bp, Artificial Sequence
  chemically synthesized
atttgatcattacacaatgaaa

SEQ ID NO: 1013795 - DNA, 22 bp, Artificial Sequence
  chemically synthesized
gatcattacacaatgaaacatt

SEQ ID NO: 1013796 - DNA, 22 bp, Artificial Sequence
  chemically synthesized
atcattacacaatgaaacatta

SEQ ID NO: 1013797 - DNA, 22 bp, Artificial Sequence
  chemically synthesized
cacaatgaaacattacactgaa

SEQ ID NO: 1013798 - DNA, 22 bp, Artificial Sequence
  chemically synthesized
tggggtacagtgtgacgtttca

SEQ ID NO: 1013799 - DNA, 22 bp, Artificial Sequence
  chemically synthesized
atggggtacagtgtgacgtttc

SEQ ID NO: 1013800 - DNA, 22 bp, Artificial Sequence
  chemically synthesized
cactgaaacgtcacactgtacc

SEQ ID NO: 1013801 - DNA, 22 bp, Artificial Sequence
  chemically synthesized
tatgtatttatggggtacagtg

SEQ ID NO: 1013802 - DNA, 22 bp, Artificial Sequence
  chemically synthesized
aaacgtcacactgtaccccata

SEQ ID NO: 1013803 - DNA, 22 bp, Artificial Sequence
  chemically synthesized
taataactatatgtatttatgg

SEQ ID NO: 1013804 - DNA, 22 bp, Artificial Sequence
  chemically synthesized
gtaataactatatgtatttatg

SEQ ID NO: 1013805 - DNA, 22 bp, Artificial Sequence
  chemically synthesized
tttgtaataactatatgtattt

SEQ ID NO: 1013806 - DNA, 22 bp, Artificial Sequence
  chemically synthesized
atttgtaataactatatgtatt

SEQ ID NO: 1013807 - DNA, 22 bp, Artificial Sequence
  chemically synthesized
tatttgtaataactatatgtat

SEQ ID NO: 1013808 - DNA, 22 bp, Artificial Sequence
  chemically synthesized
taccccataaatacatatagtt

SEQ ID NO: 1013809 - DNA, 22 bp, Artificial Sequence
  chemically synthesized
aagttttatttgtaataactat

SEQ ID NO: 1013810 - DNA, 22 bp, Artificial Sequence
  chemically synthesized
aaagttttatttgtaataacta

SEQ ID NO: 1013811 - DNA, 22 bp, Artificial Sequence
  chemically synthesized
taaagttttatttgtaataact

SEQ ID NO: 1013812 - DNA, 22 bp, Artificial Sequence
  chemically synthesized
ttaaagttttatttgtaataac

SEQ ID NO: 1013813 - DNA, 22 bp, Artificial Sequence
  chemically synthesized
tatttttaaagttttatttgta

SEQ ID NO: 1013814 - DNA, 22 bp, Artificial Sequence
  chemically synthesized
gttatatttttaaagttttatt

SEQ ID NO: 1013815 - DNA, 22 bp, Artificial Sequence
  chemically synthesized
agttatatttttaaagttttat

SEQ ID NO: 1013816 - DNA, 22 bp, Artificial Sequence
  chemically synthesized
tagttatatttttaaagtttta

SEQ ID NO: 1013817 - DNA, 22 bp, Artificial Sequence
  chemically synthesized
ttacaaataaaactttaaaaat

SEQ ID NO: 1013818 - DNA, 22 bp, Artificial Sequence
  chemically synthesized
caaataaaactttaaaaatata

SEQ ID NO: 1013819 - DNA, 22 bp, Artificial Sequence
  chemically synthesized
gtgtgataatggtattttagtt

SEQ ID NO: 1013820 - DNA, 22 bp, Artificial Sequence
  chemically synthesized
taaaaatataactaaaatacca

SEQ ID NO: 1013821 - DNA, 22 bp, Artificial Sequence
  chemically synthesized
ttggtgtgataatggtatttta

SEQ ID NO: 1013822 - DNA, 22 bp, Artificial Sequence
  chemically synthesized
aaaaatataactaaaataccat

SEQ ID NO: 1013823 - DNA, 22 bp, Artificial Sequence
  chemically synthesized
attggtgtgataatggtatttt

SEQ ID NO: 1013824 - DNA, 22 bp, Artificial Sequence
  chemically synthesized
aaaatataactaaaataccatt

SEQ ID NO: 1013825 - DNA, 22 bp, Artificial Sequence
  chemically synthesized
atttattggtgtgataatggta

SEQ ID NO: 1013826 - DNA, 22 bp, Artificial Sequence
  chemically synthesized
ttgatttattggtgtgataatg

SEQ ID NO: 1013827 - DNA, 22 bp, Artificial Sequence
  chemically synthesized
aaataccattatcacaccaata

SEQ ID NO: 1013828 - DNA, 22 bp, Artificial Sequence
  chemically synthesized
tcacaccaataaatcaataatt

SEQ ID NO: 1013829 - DNA, 22 bp, Artificial Sequence
  chemically synthesized
atgatagtgacgaattattgat

SEQ ID NO: 1013830 - DNA, 22 bp, Artificial Sequence
  chemically synthesized
aatgatagtgacgaattattga

SEQ ID NO: 1013831 - DNA, 22 bp, Artificial Sequence
  chemically synthesized
taatgatagtgacgaattattg

SEQ ID NO: 1013832 - DNA, 22 bp, Artificial Sequence
  chemically synthesized
acagaatctttaatgatagtga

SEQ ID NO: 1013833 - DNA, 22 bp, Artificial Sequence
  chemically synthesized
aatattgacagaatctttaatg

SEQ ID NO: 1013834 - DNA, 22 bp, Artificial Sequence
  chemically synthesized
aaatattgacagaatctttaat

SEQ ID NO: 1013835 - DNA, 22 bp, Artificial Sequence
  chemically synthesized
taaatattgacagaatctttaa

SEQ ID NO: 1013836 - DNA, 22 bp, Artificial Sequence
  chemically synthesized
gtcactatcattaaagattctg

SEQ ID NO: 1013837 - DNA, 22 bp, Artificial Sequence
  chemically synthesized
ttttaaatattgacagaatctt

SEQ ID NO: 1013838 - DNA, 22 bp, Artificial Sequence
  chemically synthesized
attttaaatattgacagaatct

SEQ ID NO: 1013839 - DNA, 22 bp, Artificial Sequence
  chemically synthesized
tcattaaagattctgtcaatat

SEQ ID NO: 1013840 - DNA, 22 bp, Artificial Sequence
  chemically synthesized
tcatcttattttaaatattgac

SEQ ID NO: 1013841 - DNA, 22 bp, Artificial Sequence
  chemically synthesized
aagattctgtcaatatttaaaa

SEQ ID NO: 1013842 - DNA, 22 bp, Artificial Sequence
  chemically synthesized
tatctgtcatcttattttaaat

SEQ ID NO: 1013843 - DNA, 22 bp, Artificial Sequence
  chemically synthesized
tgtcaatatttaaaataagatg

SEQ ID NO: 1013844 - DNA, 22 bp, Artificial Sequence
  chemically synthesized
tcaatatttaaaataagatgac

SEQ ID NO: 1013845 - DNA, 22 bp, Artificial Sequence
  chemically synthesized
caatatgaattatatctgtcat

SEQ ID NO: 1013846 - DNA, 22 bp, Artificial Sequence
  chemically synthesized
aaaataagatgacagatataat

SEQ ID NO: 1013847 - DNA, 22 bp, Artificial Sequence
  chemically synthesized
aaataagatgacagatataatt

SEQ ID NO: 1013848 - DNA, 22 bp, Artificial Sequence
  chemically synthesized
catgtgagcctacaatatgaat

SEQ ID NO: 1013849 - DNA, 22 bp, Artificial Sequence
  chemically synthesized
acatgtgagcctacaatatgaa

SEQ ID NO: 1013850 - DNA, 22 bp, Artificial Sequence
  chemically synthesized
atgcttacatgtgagcctacaa

SEQ ID NO: 1013851 - DNA, 22 bp, Artificial Sequence
  chemically synthesized
aatgcttacatgtgagcctaca

SEQ ID NO: 1013852 - DNA, 22 bp, Artificial Sequence
  chemically synthesized
tttaatgcttacatgtgagcct

SEQ ID NO: 1013853 - DNA, 22 bp, Artificial Sequence
  chemically synthesized
atattgtaggctcacatgtaag

SEQ ID NO: 1013854 - DNA, 22 bp, Artificial Sequence
  chemically synthesized
taggctcacatgtaagcattaa

SEQ ID NO: 1013855 - DNA, 22 bp, Artificial Sequence
  chemically synthesized
gtatatcggttatttaatgctt

SEQ ID NO: 1013856 - DNA, 22 bp, Artificial Sequence
  chemically synthesized
agtatatcggttatttaatgct

SEQ ID NO: 1013857 - DNA, 22 bp, Artificial Sequence
  chemically synthesized
acatgtaagcattaaataaccg

SEQ ID NO: 1013858 - DNA, 22 bp, Artificial Sequence
  chemically synthesized
aataaccgatatactaaactat

SEQ ID NO: 1013859 - DNA, 22 bp, Artificial Sequence
  chemically synthesized
aagaaggcatcgcatagtttag

SEQ ID NO: 1013860 - DNA, 22 bp, Artificial Sequence
  chemically synthesized
aactatgcgatgccttctttaa

SEQ ID NO: 1013861 - DNA, 22 bp, Artificial Sequence
  chemically synthesized
tgcgatgccttctttaatcctt

SEQ ID NO: 1013862 - DNA, 22 bp, Artificial Sequence
  chemically synthesized
caataaaataagaaggattaaa

SEQ ID NO: 1013863 - DNA, 22 bp, Artificial Sequence
  chemically synthesized
gtgactacaataaaataagaag

SEQ ID NO: 1013864 - DNA, 22 bp, Artificial Sequence
  chemically synthesized
agtgactacaataaaataagaa

SEQ ID NO: 1013865 - DNA, 22 bp, Artificial Sequence
  chemically synthesized
tagtgactacaataaaataaga

SEQ ID NO: 1013866 - DNA, 22 bp, Artificial Sequence
  chemically synthesized
ctttaatccttcttattttatt

SEQ ID NO: 1013867 - DNA, 22 bp, Artificial Sequence
  chemically synthesized
tttaatccttcttattttattg

SEQ ID NO: 1013868 - DNA, 22 bp, Artificial Sequence
  chemically synthesized
taatccttcttattttattgta

SEQ ID NO: 1013869 - DNA, 22 bp, Artificial Sequence
  chemically synthesized
aatccttcttattttattgtag

SEQ ID NO: 1013870 - DNA, 22 bp, Artificial Sequence
  chemically synthesized
aaattttagtgactacaataaa

SEQ ID NO: 1013871 - DNA, 22 bp, Artificial Sequence
  chemically synthesized
atccttcttattttattgtagt

SEQ ID NO: 1013872 - DNA, 22 bp, Artificial Sequence
  chemically synthesized
cttattttattgtagtcactaa

SEQ ID NO: 1013873 - DNA, 22 bp, Artificial Sequence
  chemically synthesized
caatctaaaattttagtgacta

SEQ ID NO: 1013874 - DNA, 22 bp, Artificial Sequence
  chemically synthesized
ttattttattgtagtcactaaa

SEQ ID NO: 1013875 - DNA, 22 bp, Artificial Sequence
  chemically synthesized
attttattgtagtcactaaaat

SEQ ID NO: 1013876 - DNA, 22 bp, Artificial Sequence
  chemically synthesized
ttttattgtagtcactaaaatt

SEQ ID NO: 1013877 - DNA, 22 bp, Artificial Sequence
  chemically synthesized
tattgtagtcactaaaatttta

SEQ ID NO: 1013878 - DNA, 22 bp, Artificial Sequence
  chemically synthesized
attgtagtcactaaaattttag

SEQ ID NO: 1013879 - DNA, 22 bp, Artificial Sequence
  chemically synthesized
cagtattccaatctaaaatttt

SEQ ID NO: 1013880 - DNA, 22 bp, Artificial Sequence
  chemically synthesized
ttgtagtcactaaaattttaga

SEQ ID NO: 1013881 - DNA, 22 bp, Artificial Sequence
  chemically synthesized
ctgcagtattccaatctaaaat

SEQ ID NO: 1013882 - DNA, 22 bp, Artificial Sequence
  chemically synthesized
tagtcactaaaattttagattg

SEQ ID NO: 1013883 - DNA, 22 bp, Artificial Sequence
  chemically synthesized
agttcctgcagtattccaatct

SEQ ID NO: 1013884 - DNA, 22 bp, Artificial Sequence
  chemically synthesized
aaattttagattggaatactgc

SEQ ID NO: 1013885 - DNA, 22 bp, Artificial Sequence
  chemically synthesized
tactaagttcctgcagtattcc

SEQ ID NO: 1013886 - DNA, 22 bp, Artificial Sequence
  chemically synthesized
gtactaagttcctgcagtattc

SEQ ID NO: 1013887 - DNA, 22 bp, Artificial Sequence
  chemically synthesized
acttgtactaagttcctgcagt

SEQ ID NO: 1013888 - DNA, 22 bp, Artificial Sequence
  chemically synthesized
tagattggaatactgcaggaac

SEQ ID NO: 1013889 - DNA, 22 bp, Artificial Sequence
  chemically synthesized
gacttgtactaagttcctgcag

SEQ ID NO: 1013890 - DNA, 22 bp, Artificial Sequence
  chemically synthesized
agattggaatactgcaggaact

SEQ ID NO: 1013891 - DNA, 22 bp, Artificial Sequence
  chemically synthesized
gattggaatactgcaggaactt

SEQ ID NO: 1013892 - DNA, 22 bp, Artificial Sequence
  chemically synthesized
gaatactgcaggaacttagtac

SEQ ID NO: 1013893 - DNA, 22 bp, Artificial Sequence
  chemically synthesized
acacatttgacttgtactaagt

SEQ ID NO: 1013894 - DNA, 22 bp, Artificial Sequence
  chemically synthesized
caggaacttagtacaagtcaaa

SEQ ID NO: 1013895 - DNA, 22 bp, Artificial Sequence
  chemically synthesized
catgtgtagtattaacacattt

SEQ ID NO: 1013896 - DNA, 22 bp, Artificial Sequence
  chemically synthesized
ccatgtgtagtattaacacatt

SEQ ID NO: 1013897 - DNA, 22 bp, Artificial Sequence
  chemically synthesized
agtacaagtcaaatgtgttaat

SEQ ID NO: 1013898 - DNA, 22 bp, Artificial Sequence
  chemically synthesized
tccatgtgtagtattaacacat

SEQ ID NO: 1013899 - DNA, 22 bp, Artificial Sequence
  chemically synthesized
gtacaagtcaaatgtgttaata

SEQ ID NO: 1013900 - DNA, 22 bp, Artificial Sequence
  chemically synthesized
tttccatgtgtagtattaacac

SEQ ID NO: 1013901 - DNA, 22 bp, Artificial Sequence
  chemically synthesized
atattctttccatgtgtagtat

SEQ ID NO: 1013902 - DNA, 22 bp, Artificial Sequence
  chemically synthesized
ctaatattctttccatgtgtag

SEQ ID NO: 1013903 - DNA, 22 bp, Artificial Sequence
  chemically synthesized
cctaatattctttccatgtgta

SEQ ID NO: 1013904 - DNA, 22 bp, Artificial Sequence
  chemically synthesized
tttcctaatattctttccatgt

SEQ ID NO: 1013905 - DNA, 22 bp, Artificial Sequence
  chemically synthesized
gtttcctaatattctttccatg

SEQ ID NO: 1013906 - DNA, 22 bp, Artificial Sequence
  chemically synthesized
atactacacatggaaagaatat

SEQ ID NO: 1013907 - DNA, 22 bp, Artificial Sequence
  chemically synthesized
cacatggaaagaatattaggaa

SEQ ID NO: 1013908 - DNA, 22 bp, Artificial Sequence
  chemically synthesized
gaaggtgaccaaatgcttgttt

SEQ ID NO: 1013909 - DNA, 22 bp, Artificial Sequence
  chemically synthesized
tgactggaaggtgaccaaatgc

SEQ ID NO: 1013910 - DNA, 22 bp, Artificial Sequence
  chemically synthesized
atgactggaaggtgaccaaatg

SEQ ID NO: 1013911 - DNA, 22 bp, Artificial Sequence
  chemically synthesized
tatgactggaaggtgaccaaat

SEQ ID NO: 1013912 - DNA, 22 bp, Artificial Sequence
  chemically synthesized
ttatgactggaaggtgaccaaa

SEQ ID NO: 1013913 - DNA, 22 bp, Artificial Sequence
  chemically synthesized
ggaaacaagcatttggtcacct

SEQ ID NO: 1013914 - DNA, 22 bp, Artificial Sequence
  chemically synthesized
ttttatgactggaaggtgacca

SEQ ID NO: 1013915 - DNA, 22 bp, Artificial Sequence
  chemically synthesized
agtctcttttatgactggaagg

SEQ ID NO: 1013916 - DNA, 22 bp, Artificial Sequence
  chemically synthesized
cctcagtctcttttatgactgg

SEQ ID NO: 1013917 - DNA, 22 bp, Artificial Sequence
  chemically synthesized
tgcctcagtctcttttatgact

SEQ ID NO: 1013918 - DNA, 22 bp, Artificial Sequence
  chemically synthesized
ggtcaccttccagtcataaaag

SEQ ID NO: 1013919 - DNA, 22 bp, Artificial Sequence
  chemically synthesized
ctgcctcagtctcttttatgac

SEQ ID NO: 1013920 - DNA, 22 bp, Artificial Sequence
  chemically synthesized
gtcaccttccagtcataaaaga

SEQ ID NO: 1013921 - DNA, 22 bp, Artificial Sequence
  chemically synthesized
tttctgcctcagtctcttttat

SEQ ID NO: 1013922 - DNA, 22 bp, Artificial Sequence
  chemically synthesized
ccagtcataaaagagactgagg

SEQ ID NO: 1013923 - DNA, 22 bp, Artificial Sequence
  chemically synthesized
atattatttctgcctcagtctc

SEQ ID NO: 1013924 - DNA, 22 bp, Artificial Sequence
  chemically synthesized
cagtcataaaagagactgaggc

SEQ ID NO: 1013925 - DNA, 22 bp, Artificial Sequence
  chemically synthesized
gttcatattatttctgcctcag

SEQ ID NO: 1013926 - DNA, 22 bp, Artificial Sequence
  chemically synthesized
aggcagaaataatatgaaccag

SEQ ID NO: 1013927 - DNA, 22 bp, Artificial Sequence
  chemically synthesized
ggtaaacatacagccctggttc

SEQ ID NO: 1013928 - DNA, 22 bp, Artificial Sequence
  chemically synthesized
aggtaaacatacagccctggtt

SEQ ID NO: 1013929 - DNA, 22 bp, Artificial Sequence
  chemically synthesized
tcttaggtaaacatacagccct

SEQ ID NO: 1013930 - DNA, 22 bp, Artificial Sequence
  chemically synthesized
tgtgcaactgtcttaggtaaac

SEQ ID NO: 1013931 - DNA, 22 bp, Artificial Sequence
  chemically synthesized
atgtgcaactgtcttaggtaaa

SEQ ID NO: 1013932 - DNA, 22 bp, Artificial Sequence
  chemically synthesized
ttatgtgcaactgtcttaggta

SEQ ID NO: 1013933 - DNA, 22 bp, Artificial Sequence
  chemically synthesized
attcttatgtgcaactgtctta

SEQ ID NO: 1013934 - DNA, 22 bp, Artificial Sequence
  chemically synthesized
tatgtttacctaagacagttgc

SEQ ID NO: 1013935 - DNA, 22 bp, Artificial Sequence
  chemically synthesized
acctaagacagttgcacataag

SEQ ID NO: 1013936 - DNA, 22 bp, Artificial Sequence
  chemically synthesized
cctaagacagttgcacataaga

SEQ ID NO: 1013937 - DNA, 22 bp, Artificial Sequence
  chemically synthesized
aatgccccagttgattcttatg

SEQ ID NO: 1013938 - DNA, 22 bp, Artificial Sequence
  chemically synthesized
agacagttgcacataagaatca

SEQ ID NO: 1013939 - DNA, 22 bp, Artificial Sequence
  chemically synthesized
aaatgccccagttgattcttat

SEQ ID NO: 1013940 - DNA, 22 bp, Artificial Sequence
  chemically synthesized
taaatgccccagttgattctta

SEQ ID NO: 1013941 - DNA, 22 bp, Artificial Sequence
  chemically synthesized
tgttttaaatgccccagttgat

SEQ ID NO: 1013942 - DNA, 22 bp, Artificial Sequence
  chemically synthesized
cacataagaatcaactggggca

SEQ ID NO: 1013943 - DNA, 22 bp, Artificial Sequence
  chemically synthesized
ctgtgttttaaatgccccagtt

SEQ ID NO: 1013944 - DNA, 22 bp, Artificial Sequence
  chemically synthesized
ttgctgtgttttaaatgcccca

SEQ ID NO: 1013945 - DNA, 22 bp, Artificial Sequence
  chemically synthesized
ttgttgctgtgttttaaatgcc

SEQ ID NO: 1013946 - DNA, 22 bp, Artificial Sequence
  chemically synthesized
ttgttgttgctgtgttttaaat

SEQ ID NO: 1013947 - DNA, 22 bp, Artificial Sequence
  chemically synthesized
gttattgttgttgctgtgtttt

SEQ ID NO: 1013948 - DNA, 22 bp, Artificial Sequence
  chemically synthesized
ggttattgttgttgctgtgttt

SEQ ID NO: 1013949 - DNA, 22 bp, Artificial Sequence
  chemically synthesized
gggcatttaaaacacagcaaca

SEQ ID NO: 1013950 - DNA, 22 bp, Artificial Sequence
  chemically synthesized
tttggttattgttgttgctgtg

SEQ ID NO: 1013951 - DNA, 22 bp, Artificial Sequence
  chemically synthesized
aaaacacagcaacaacaataac

SEQ ID NO: 1013952 - DNA, 22 bp, Artificial Sequence
  chemically synthesized
aaacacagcaacaacaataacc

SEQ ID NO: 1013953 - DNA, 22 bp, Artificial Sequence
  chemically synthesized
gaatggagccccaggatcactg

SEQ ID NO: 1013954 - DNA, 22 bp, Artificial Sequence
  chemically synthesized
gtctggaatggagccccaggat

SEQ ID NO: 1013955 - DNA, 22 bp, Artificial Sequence
  chemically synthesized
agttggtctggaatggagcccc

SEQ ID NO: 1013956 - DNA, 22 bp, Artificial Sequence
  chemically synthesized
attaagttggtctggaatggag

SEQ ID NO: 1013957 - DNA, 22 bp, Artificial Sequence
  chemically synthesized
gggctccattccagaccaactt

SEQ ID NO: 1013958 - DNA, 22 bp, Artificial Sequence
  chemically synthesized
cagaaatactgattaagttggt

SEQ ID NO: 1013959 - DNA, 22 bp, Artificial Sequence
  chemically synthesized
cattccagaccaacttaatcag

SEQ ID NO: 1013960 - DNA, 22 bp, Artificial Sequence
  chemically synthesized
cagaccaacttaatcagtattt

SEQ ID NO: 1013961 - DNA, 22 bp, Artificial Sequence
  chemically synthesized
aatcagtatttctggaggttgg

SEQ ID NO: 1013962 - DNA, 22 bp, Artificial Sequence
  chemically synthesized
atcagtatttctggaggttgga

SEQ ID NO: 1013963 - DNA, 22 bp, Artificial Sequence
  chemically synthesized
aaaaataacagcgtcagtgtcc

SEQ ID NO: 1013964 - DNA, 22 bp, Artificial Sequence
  chemically synthesized
gaaaaataacagcgtcagtgtc

SEQ ID NO: 1013965 - DNA, 22 bp, Artificial Sequence
  chemically synthesized
tgaaaaataacagcgtcagtgt

SEQ ID NO: 1013966 - DNA, 22 bp, Artificial Sequence
  chemically synthesized
ctggaggttggacactgacgct

SEQ ID NO: 1013967 - DNA, 22 bp, Artificial Sequence
  chemically synthesized
tggaggttggacactgacgctg

SEQ ID NO: 1013968 - DNA, 22 bp, Artificial Sequence
  chemically synthesized
gaggttggacactgacgctgtt

SEQ ID NO: 1013969 - DNA, 22 bp, Artificial Sequence
  chemically synthesized
gatgctttgaaaaataacagcg

SEQ ID NO: 1013970 - DNA, 22 bp, Artificial Sequence
  chemically synthesized
gacactgacgctgttatttttc

SEQ ID NO: 1013971 - DNA, 22 bp, Artificial Sequence
  chemically synthesized
aaatcacctggatgctttgaaa

SEQ ID NO: 1013972 - DNA, 22 bp, Artificial Sequence
  chemically synthesized
acgctgttatttttcaaagcat

SEQ ID NO: 1013973 - DNA, 22 bp, Artificial Sequence
  chemically synthesized
ttatttttcaaagcatccaggt

SEQ ID NO: 1013974 - DNA, 22 bp, Artificial Sequence
  chemically synthesized
tacattgaaatcacctggatgc

SEQ ID NO: 1013975 - DNA, 22 bp, Artificial Sequence
  chemically synthesized
tttttcaaagcatccaggtgat

SEQ ID NO: 1013976 - DNA, 22 bp, Artificial Sequence
  chemically synthesized
actgtacattgaaatcacctgg

SEQ ID NO: 1013977 - DNA, 22 bp, Artificial Sequence
  chemically synthesized
gactgtacattgaaatcacctg

SEQ ID NO: 1013978 - DNA, 22 bp, Artificial Sequence
  chemically synthesized
ttcaaagcatccaggtgatttc

SEQ ID NO: 1013979 - DNA, 22 bp, Artificial Sequence
  chemically synthesized
tcaaagcatccaggtgatttca

SEQ ID NO: 1013980 - DNA, 22 bp, Artificial Sequence
  chemically synthesized
caaagcatccaggtgatttcaa

SEQ ID NO: 1013981 - DNA, 22 bp, Artificial Sequence
  chemically synthesized
aaagcatccaggtgatttcaat

SEQ ID NO: 1013982 - DNA, 22 bp, Artificial Sequence
  chemically synthesized
accttgactgtacattgaaatc

SEQ ID NO: 1013983 - DNA, 22 bp, Artificial Sequence
  chemically synthesized
caccttgactgtacattgaaat

SEQ ID NO: 1013984 - DNA, 22 bp, Artificial Sequence
  chemically synthesized
tcaccttgactgtacattgaaa

SEQ ID NO: 1013985 - DNA, 22 bp, Artificial Sequence
  chemically synthesized
ttcaccttgactgtacattgaa

SEQ ID NO: 1013986 - DNA, 22 bp, Artificial Sequence
  chemically synthesized
cggcagtgtttttcaccttgac

SEQ ID NO: 1013987 - DNA, 22 bp, Artificial Sequence
  chemically synthesized
acggcagtgtttttcaccttga

SEQ ID NO: 1013988 - DNA, 22 bp, Artificial Sequence
  chemically synthesized
tacggcagtgtttttcaccttg

SEQ ID NO: 1013989 - DNA, 22 bp, Artificial Sequence
  chemically synthesized
caatgtacagtcaaggtgaaaa

SEQ ID NO: 1013990 - DNA, 22 bp, Artificial Sequence
  chemically synthesized
aatgtacagtcaaggtgaaaaa

SEQ ID NO: 1013991 - DNA, 22 bp, Artificial Sequence
  chemically synthesized
ctttacggcagtgtttttcacc

SEQ ID NO: 1013992 - DNA, 22 bp, Artificial Sequence
  chemically synthesized
actttacggcagtgtttttcac

SEQ ID NO: 1013993 - DNA, 22 bp, Artificial Sequence
  chemically synthesized
aaatcttactttacggcagtgt

SEQ ID NO: 1013994 - DNA, 22 bp, Artificial Sequence
  chemically synthesized
caaatcttactttacggcagtg

SEQ ID NO: 1013995 - DNA, 22 bp, Artificial Sequence
  chemically synthesized
ccgtaaagtaagatttgaaatc

SEQ ID NO: 1013996 - DNA, 22 bp, Artificial Sequence
  chemically synthesized
taagcccagtaagatttcaaat

SEQ ID NO: 1013997 - DNA, 22 bp, Artificial Sequence
  chemically synthesized
gtagactgtaagcccagtaaga

SEQ ID NO: 1013998 - DNA, 22 bp, Artificial Sequence
  chemically synthesized
gaaatcttactgggcttacagt

SEQ ID NO: 1013999 - DNA, 22 bp, Artificial Sequence
  chemically synthesized
aaatcttactgggcttacagtc

SEQ ID NO: 1014000 - DNA, 22 bp, Artificial Sequence
  chemically synthesized
actgggcttacagtctaccaga

SEQ ID NO: 1014001 - DNA, 22 bp, Artificial Sequence
  chemically synthesized
ctgggcttacagtctaccagat

SEQ ID NO: 1014002 - DNA, 22 bp, Artificial Sequence
  chemically synthesized
ggcttacagtctaccagatttc

SEQ ID NO: 1014003 - DNA, 22 bp, Artificial Sequence
  chemically synthesized
ggcaggccccaggaaatctggt

SEQ ID NO: 1014004 - DNA, 22 bp, Artificial Sequence
  chemically synthesized
gggcaggccccaggaaatctgg

SEQ ID NO: 1014005 - DNA, 22 bp, Artificial Sequence
  chemically synthesized
cttgggcaggccccaggaaatc

SEQ ID NO: 1014006 - DNA, 22 bp, Artificial Sequence
  chemically synthesized
acagtctaccagatttcctggg

SEQ ID NO: 1014007 - DNA, 22 bp, Artificial Sequence
  chemically synthesized
gcttgggcaggccccaggaaat

SEQ ID NO: 1014008 - DNA, 22 bp, Artificial Sequence
  chemically synthesized
cagtctaccagatttcctgggg

SEQ ID NO: 1014009 - DNA, 22 bp, Artificial Sequence
  chemically synthesized
ccagatttcctggggcctgccc

SEQ ID NO: 1014010 - DNA, 22 bp, Artificial Sequence
  chemically synthesized
acaaatgcttgcttgggcaggc

SEQ ID NO: 1014011 - DNA, 22 bp, Artificial Sequence
  chemically synthesized
tgctcacaaatgcttgcttggg

SEQ ID NO: 1014012 - DNA, 22 bp, Artificial Sequence
  chemically synthesized
cctggggcctgcccaagcaagc

SEQ ID NO: 1014013 - DNA, 22 bp, Artificial Sequence
  chemically synthesized
gtgctcacaaatgcttgcttgg

SEQ ID NO: 1014014 - DNA, 22 bp, Artificial Sequence
  chemically synthesized
ctggggcctgcccaagcaagca

SEQ ID NO: 1014015 - DNA, 22 bp, Artificial Sequence
  chemically synthesized
tgtgctcacaaatgcttgcttg

SEQ ID NO: 1014016 - DNA, 22 bp, Artificial Sequence
  chemically synthesized
gggcctgcccaagcaagcattt

SEQ ID NO: 1014017 - DNA, 22 bp, Artificial Sequence
  chemically synthesized
gttttgtgctcacaaatgcttg

SEQ ID NO: 1014018 - DNA, 22 bp, Artificial Sequence
  chemically synthesized
ttggttttgtgctcacaaatgc

SEQ ID NO: 1014019 - DNA, 22 bp, Artificial Sequence
  chemically synthesized
cccaagcaagcatttgtgagca

SEQ ID NO: 1014020 - DNA, 22 bp, Artificial Sequence
  chemically synthesized
taggatggctattggttttgtg

SEQ ID NO: 1014021 - DNA, 22 bp, Artificial Sequence
  chemically synthesized
gtgagcacaaaaccaatagcca

SEQ ID NO: 1014022 - DNA, 22 bp, Artificial Sequence
  chemically synthesized
tgagcacaaaaccaatagccat

SEQ ID NO: 1014023 - DNA, 22 bp, Artificial Sequence
  chemically synthesized
aggcagcaccatagccggtaat

SEQ ID NO: 1014024 - DNA, 22 bp, Artificial Sequence
  chemically synthesized
tgaggcagcaccatagccggta

SEQ ID NO: 1014025 - DNA, 22 bp, Artificial Sequence
  chemically synthesized
tactctgaggcagcaccatagc

SEQ ID NO: 1014026 - DNA, 22 bp, Artificial Sequence
  chemically synthesized
cagattaccggctatggtgctg

SEQ ID NO: 1014027 - DNA, 22 bp, Artificial Sequence
  chemically synthesized
ctgtactctgaggcagcaccat

SEQ ID NO: 1014028 - DNA, 22 bp, Artificial Sequence
  chemically synthesized
ccggctatggtgctgcctcaga

SEQ ID NO: 1014029 - DNA, 22 bp, Artificial Sequence
  chemically synthesized
acagattcctgtactctgaggc

SEQ ID NO: 1014030 - DNA, 22 bp, Artificial Sequence
  chemically synthesized
gacagattcctgtactctgagg

SEQ ID NO: 1014031 - DNA, 22 bp, Artificial Sequence
  chemically synthesized
tggtgctgcctcagagtacagg

SEQ ID NO: 1014032 - DNA, 22 bp, Artificial Sequence
  chemically synthesized
agaaaagcttgacagattcctg

SEQ ID NO: 1014033 - DNA, 22 bp, Artificial Sequence
  chemically synthesized
cctcagagtacaggaatctgtc

SEQ ID NO: 1014034 - DNA, 22 bp, Artificial Sequence
  chemically synthesized
agagtacaggaatctgtcaagc

SEQ ID NO: 1014035 - DNA, 22 bp, Artificial Sequence
  chemically synthesized
agaatagagttcagaaaagctt

SEQ ID NO: 1014036 - DNA, 22 bp, Artificial Sequence
  chemically synthesized
aagaatagagttcagaaaagct

SEQ ID NO: 1014037 - DNA, 22 bp, Artificial Sequence
  chemically synthesized
ttaagaatagagttcagaaaag

SEQ ID NO: 1014038 - DNA, 22 bp, Artificial Sequence
  chemically synthesized
cttaagaatagagttcagaaaa

SEQ ID NO: 1014039 - DNA, 22 bp, Artificial Sequence
  chemically synthesized
cttcttaagaatagagttcaga

SEQ ID NO: 1014040 - DNA, 22 bp, Artificial Sequence
  chemically synthesized
tcaagcttttctgaactctatt

SEQ ID NO: 1014041 - DNA, 22 bp, Artificial Sequence
  chemically synthesized
ttctgaactctattcttaagaa

SEQ ID NO: 1014042 - DNA, 22 bp, Artificial Sequence
  chemically synthesized
tctgaactctattcttaagaag

SEQ ID NO: 1014043 - DNA, 22 bp, Artificial Sequence
  chemically synthesized
ctgaactctattcttaagaagc

SEQ ID NO: 1014044 - DNA, 22 bp, Artificial Sequence
  chemically synthesized
tgaactctattcttaagaagca

SEQ ID NO: 1014045 - DNA, 22 bp, Artificial Sequence
  chemically synthesized
aactctattcttaagaagcaat

SEQ ID NO: 1014046 - DNA, 22 bp, Artificial Sequence
  chemically synthesized
aaaagtatgatccattgcttct

SEQ ID NO: 1014047 - DNA, 22 bp, Artificial Sequence
  chemically synthesized
tattcttaagaagcaatggatc

SEQ ID NO: 1014048 - DNA, 22 bp, Artificial Sequence
  chemically synthesized
ttcttaagaagcaatggatcat

SEQ ID NO: 1014049 - DNA, 22 bp, Artificial Sequence
  chemically synthesized
ttaagaagcaatggatcatact

SEQ ID NO: 1014050 - DNA, 22 bp, Artificial Sequence
  chemically synthesized
aagaagcaatggatcatacttt

SEQ ID NO: 1014051 - DNA, 22 bp, Artificial Sequence
  chemically synthesized
agaagcaatggatcatactttt

SEQ ID NO: 1014052 - DNA, 22 bp, Artificial Sequence
  chemically synthesized
aaaagatatcatggtattcaaa

SEQ ID NO: 1014053 - DNA, 22 bp, Artificial Sequence
  chemically synthesized
ttgaataccatgatatcttttc

SEQ ID NO: 1014054 - DNA, 22 bp, Artificial Sequence
  chemically synthesized
tgaataccatgatatcttttca

SEQ ID NO: 1014055 - DNA, 22 bp, Artificial Sequence
  chemically synthesized
gaataccatgatatcttttcag

SEQ ID NO: 1014056 - DNA, 22 bp, Artificial Sequence
  chemically synthesized
aataccatgatatcttttcagt

SEQ ID NO: 1014057 - DNA, 22 bp, Artificial Sequence
  chemically synthesized
aatgaaggtagaggactgaaaa

SEQ ID NO: 1014058 - DNA, 22 bp, Artificial Sequence
  chemically synthesized
ctgaatgaaggtagaggactga

SEQ ID NO: 1014059 - DNA, 22 bp, Artificial Sequence
  chemically synthesized
aattcctgaatgaaggtagagg

SEQ ID NO: 1014060 - DNA, 22 bp, Artificial Sequence
  chemically synthesized
aaattcctgaatgaaggtagag

SEQ ID NO: 1014061 - DNA, 22 bp, Artificial Sequence
  chemically synthesized
taaattcctgaatgaaggtaga

SEQ ID NO: 1014062 - DNA, 22 bp, Artificial Sequence
  chemically synthesized
ctttaaattcctgaatgaaggt

SEQ ID NO: 1014063 - DNA, 22 bp, Artificial Sequence
  chemically synthesized
ttcagtcctctaccttcattca

SEQ ID NO: 1014064 - DNA, 22 bp, Artificial Sequence
  chemically synthesized
tcagtcctctaccttcattcag

SEQ ID NO: 1014065 - DNA, 22 bp, Artificial Sequence
  chemically synthesized
cagtcctctaccttcattcagg

SEQ ID NO: 1014066 - DNA, 22 bp, Artificial Sequence
  chemically synthesized
agtcctctaccttcattcagga

SEQ ID NO: 1014067 - DNA, 22 bp, Artificial Sequence
  chemically synthesized
gtgttactttaaattcctgaat

SEQ ID NO: 1014068 - DNA, 22 bp, Artificial Sequence
  chemically synthesized
tagtgttactttaaattcctga

SEQ ID NO: 1014069 - DNA, 22 bp, Artificial Sequence
  chemically synthesized
ctagtgttactttaaattcctg

SEQ ID NO: 1014070 - DNA, 22 bp, Artificial Sequence
  chemically synthesized
taccttcattcaggaatttaaa

SEQ ID NO: 1014071 - DNA, 22 bp, Artificial Sequence
  chemically synthesized
ccttcattcaggaatttaaagt

SEQ ID NO: 1014072 - DNA, 22 bp, Artificial Sequence
  chemically synthesized
aaacttctagtgttactttaaa

SEQ ID NO: 1014073 - DNA, 22 bp, Artificial Sequence
  chemically synthesized
aaaacttctagtgttactttaa

SEQ ID NO: 1014074 - DNA, 22 bp, Artificial Sequence
  chemically synthesized
cattcaggaatttaaagtaaca

SEQ ID NO: 1014075 - DNA, 22 bp, Artificial Sequence
  chemically synthesized
attcaggaatttaaagtaacac

SEQ ID NO: 1014076 - DNA, 22 bp, Artificial Sequence
  chemically synthesized
aggaatttaaagtaacactaga

SEQ ID NO: 1014077 - DNA, 22 bp, Artificial Sequence
  chemically synthesized
aaagtaacactagaagttttaa

SEQ ID NO: 1014078 - DNA, 22 bp, Artificial Sequence
  chemically synthesized
aagtaacactagaagttttaaa

SEQ ID NO: 1014079 - DNA, 22 bp, Artificial Sequence
  chemically synthesized
gaagttttaaattgctacatct

SEQ ID NO: 1014080 - DNA, 22 bp, Artificial Sequence
  chemically synthesized
cccaggacatcagtaggcagat

SEQ ID NO: 1014081 - DNA, 22 bp, Artificial Sequence
  chemically synthesized
taaattgctacatctgcctact

SEQ ID NO: 1014082 - DNA, 22 bp, Artificial Sequence
  chemically synthesized
aaattgctacatctgcctactg

SEQ ID NO: 1014083 - DNA, 22 bp, Artificial Sequence
  chemically synthesized
tgcccaggacatcagtaggcag

SEQ ID NO: 1014084 - DNA, 22 bp, Artificial Sequence
  chemically synthesized
aattgctacatctgcctactga

SEQ ID NO: 1014085 - DNA, 22 bp, Artificial Sequence
  chemically synthesized
tctgcccaggacatcagtaggc

SEQ ID NO: 1014086 - DNA, 22 bp, Artificial Sequence
  chemically synthesized
ctctgcccaggacatcagtagg

SEQ ID NO: 1014087 - DNA, 22 bp, Artificial Sequence
  chemically synthesized
tctctgcccaggacatcagtag

SEQ ID NO: 1014088 - DNA, 22 bp, Artificial Sequence
  chemically synthesized
ctacatctgcctactgatgtcc

SEQ ID NO: 1014089 - DNA, 22 bp, Artificial Sequence
  chemically synthesized
ctttctctgcccaggacatcag

SEQ ID NO: 1014090 - DNA, 22 bp, Artificial Sequence
  chemically synthesized
catctgcctactgatgtcctgg

SEQ ID NO: 1014091 - DNA, 22 bp, Artificial Sequence
  chemically synthesized
attcctttctctgcccaggaca

SEQ ID NO: 1014092 - DNA, 22 bp, Artificial Sequence
  chemically synthesized
cctactgatgtcctgggcagag

SEQ ID NO: 1014093 - DNA, 22 bp, Artificial Sequence
  chemically synthesized
ctgatgtcctgggcagagaaag

SEQ ID NO: 1014094 - DNA, 22 bp, Artificial Sequence
  chemically synthesized
ataaatgttaattcctttctct

SEQ ID NO: 1014095 - DNA, 22 bp, Artificial Sequence
  chemically synthesized
atgtcctgggcagagaaaggaa

SEQ ID NO: 1014096 - DNA, 22 bp, Artificial Sequence
  chemically synthesized
aataaatgttaattcctttctc

SEQ ID NO: 1014097 - DNA, 22 bp, Artificial Sequence
  chemically synthesized
tttaataaatgttaattccttt

SEQ ID NO: 1014098 - DNA, 22 bp, Artificial Sequence
  chemically synthesized
ggcagagaaaggaattaacatt

SEQ ID NO: 1014099 - DNA, 22 bp, Artificial Sequence
  chemically synthesized
gtaactgtttaataaatgttaa

SEQ ID NO: 1014100 - DNA, 22 bp, Artificial Sequence
  chemically synthesized
ttagtaactgtttaataaatgt

SEQ ID NO: 1014101 - DNA, 22 bp, Artificial Sequence
  chemically synthesized
gctattagtaactgtttaataa

SEQ ID NO: 1014102 - DNA, 22 bp, Artificial Sequence
  chemically synthesized
acatttattaaacagttactaa

SEQ ID NO: 1014103 - DNA, 22 bp, Artificial Sequence
  chemically synthesized
attaaacagttactaatagcca

SEQ ID NO: 1014104 - DNA, 22 bp, Artificial Sequence
  chemically synthesized
ttaaacagttactaatagccag

SEQ ID NO: 1014105 - DNA, 22 bp, Artificial Sequence
  chemically synthesized
aacagttactaatagccaggca

SEQ ID NO: 1014106 - DNA, 22 bp, Artificial Sequence
  chemically synthesized
taaaagcacagagcccggtgcc

SEQ ID NO: 1014107 - DNA, 22 bp, Artificial Sequence
  chemically synthesized
ctaatagccaggcaccgggctc

SEQ ID NO: 1014108 - DNA, 22 bp, Artificial Sequence
  chemically synthesized
atagccaggcaccgggctctgt

SEQ ID NO: 1014109 - DNA, 22 bp, Artificial Sequence
  chemically synthesized
gcactataaaagcacagagccc

SEQ ID NO: 1014110 - DNA, 22 bp, Artificial Sequence
  chemically synthesized
tgtgcttttatagtgccagaca

SEQ ID NO: 1014111 - DNA, 22 bp, Artificial Sequence
  chemically synthesized
tgcttttatagtgccagacaca

SEQ ID NO: 1014112 - DNA, 22 bp, Artificial Sequence
  chemically synthesized
ttatagtgccagacacatcatt

SEQ ID NO: 1014113 - DNA, 22 bp, Artificial Sequence
  chemically synthesized
tatagtgccagacacatcattt

SEQ ID NO: 1014114 - DNA, 22 bp, Artificial Sequence
  chemically synthesized
taggtgtcaatgaaatgatgtg

SEQ ID NO: 1014115 - DNA, 22 bp, Artificial Sequence
  chemically synthesized
atagtgccagacacatcatttc

SEQ ID NO: 1014116 - DNA, 22 bp, Artificial Sequence
  chemically synthesized
tagtgccagacacatcatttca

SEQ ID NO: 1014117 - DNA, 22 bp, Artificial Sequence
  chemically synthesized
ttgtaggtgtcaatgaaatgat

SEQ ID NO: 1014118 - DNA, 22 bp, Artificial Sequence
  chemically synthesized
cagggttattgtaggtgtcaat

SEQ ID NO: 1014119 - DNA, 22 bp, Artificial Sequence
  chemically synthesized
tgctgcagggttattgtaggtg

SEQ ID NO: 1014120 - DNA, 22 bp, Artificial Sequence
  chemically synthesized
ttatgctgcagggttattgtag

SEQ ID NO: 1014121 - DNA, 22 bp, Artificial Sequence
  chemically synthesized
cattgacacctacaataaccct

SEQ ID NO: 1014122 - DNA, 22 bp, Artificial Sequence
  chemically synthesized
attgacacctacaataaccctg

SEQ ID NO: 1014123 - DNA, 22 bp, Artificial Sequence
  chemically synthesized
acacctacaataaccctgcagc

SEQ ID NO: 1014124 - DNA, 22 bp, Artificial Sequence
  chemically synthesized
caataaccctgcagcataacaa

SEQ ID NO: 1014125 - DNA, 22 bp, Artificial Sequence
  chemically synthesized
caatggaaaatgggaataataa

SEQ ID NO: 1014126 - DNA, 22 bp, Artificial Sequence
  chemically synthesized
cagcataacaattattattccc

SEQ ID NO: 1014127 - DNA, 22 bp, Artificial Sequence
  chemically synthesized
tccaatggaaaatgggaataat

SEQ ID NO: 1014128 - DNA, 22 bp, Artificial Sequence
  chemically synthesized
ctccaatggaaaatgggaataa

SEQ ID NO: 1014129 - DNA, 22 bp, Artificial Sequence
  chemically synthesized
tctccaatggaaaatgggaata

SEQ ID NO: 1014130 - DNA, 22 bp, Artificial Sequence
  chemically synthesized
ttttctccaatggaaaatggga

SEQ ID NO: 1014131 - DNA, 22 bp, Artificial Sequence
  chemically synthesized
tgttttctccaatggaaaatgg

SEQ ID NO: 1014132 - DNA, 22 bp, Artificial Sequence
  chemically synthesized
gcctctgttttctccaatggaa

SEQ ID NO: 1014133 - DNA, 22 bp, Artificial Sequence
  chemically synthesized
ttattcccattttccattggag

SEQ ID NO: 1014134 - DNA, 22 bp, Artificial Sequence
  chemically synthesized
ggcctctgttttctccaatgga

SEQ ID NO: 1014135 - DNA, 22 bp, Artificial Sequence
  chemically synthesized
ttcccattttccattggagaaa

SEQ ID NO: 1014136 - DNA, 22 bp, Artificial Sequence
  chemically synthesized
cttggcctctgttttctccaat

SEQ ID NO: 1014137 - DNA, 22 bp, Artificial Sequence
  chemically synthesized
ccattttccattggagaaaaca

SEQ ID NO: 1014138 - DNA, 22 bp, Artificial Sequence
  chemically synthesized
gcaaattacttggcctctgttt

SEQ ID NO: 1014139 - DNA, 22 bp, Artificial Sequence
  chemically synthesized
tccattggagaaaacagaggcc

SEQ ID NO: 1014140 - DNA, 22 bp, Artificial Sequence
  chemically synthesized
ggcaaattacttggcctctgtt

SEQ ID NO: 1014141 - DNA, 22 bp, Artificial Sequence
  chemically synthesized
ccattggagaaaacagaggcca

SEQ ID NO: 1014142 - DNA, 22 bp, Artificial Sequence
  chemically synthesized
tggcaaattacttggcctctgt

SEQ ID NO: 1014143 - DNA, 22 bp, Artificial Sequence
  chemically synthesized
cattggagaaaacagaggccaa

SEQ ID NO: 1014144 - DNA, 22 bp, Artificial Sequence
  chemically synthesized
ttggcaaattacttggcctctg

SEQ ID NO: 1014145 - DNA, 22 bp, Artificial Sequence
  chemically synthesized
gagaaaacagaggccaagtaat

SEQ ID NO: 1014146 - DNA, 22 bp, Artificial Sequence
  chemically synthesized
accttttggcaaattacttggc

SEQ ID NO: 1014147 - DNA, 22 bp, Artificial Sequence
  chemically synthesized
caccttttggcaaattacttgg

SEQ ID NO: 1014148 - DNA, 22 bp, Artificial Sequence
  chemically synthesized
tcaccttttggcaaattacttg

SEQ ID NO: 1014149 - DNA, 22 bp, Artificial Sequence
  chemically synthesized
ataccattttcaccttttggca

SEQ ID NO: 1014150 - DNA, 22 bp, Artificial Sequence
  chemically synthesized
aataccattttcaccttttggc

SEQ ID NO: 1014151 - DNA, 22 bp, Artificial Sequence
  chemically synthesized
tttaataccattttcacctttt

SEQ ID NO: 1014152 - DNA, 22 bp, Artificial Sequence
  chemically synthesized
ctatttaataccattttcacct

SEQ ID NO: 1014153 - DNA, 22 bp, Artificial Sequence
  chemically synthesized
tactatttaataccattttcac

SEQ ID NO: 1014154 - DNA, 22 bp, Artificial Sequence
  chemically synthesized
tctactatttaataccattttc

SEQ ID NO: 1014155 - DNA, 22 bp, Artificial Sequence
  chemically synthesized
gccaaaaggtgaaaatggtatt

SEQ ID NO: 1014156 - DNA, 22 bp, Artificial Sequence
  chemically synthesized
tctctactatttaataccattt

SEQ ID NO: 1014157 - DNA, 22 bp, Artificial Sequence
  chemically synthesized
ccaaaaggtgaaaatggtatta

SEQ ID NO: 1014158 - DNA, 22 bp, Artificial Sequence
  chemically synthesized
gaagcctctctctactatttaa

SEQ ID NO: 1014159 - DNA, 22 bp, Artificial Sequence
  chemically synthesized
ggttagaagcctctctctacta

SEQ ID NO: 1014160 - DNA, 22 bp, Artificial Sequence
  chemically synthesized
gggttagaagcctctctctact

SEQ ID NO: 1014161 - DNA, 22 bp, Artificial Sequence
  chemically synthesized
aatagtagagagaggcttctaa

SEQ ID NO: 1014162 - DNA, 22 bp, Artificial Sequence
  chemically synthesized
aaacaagagatatttgggttag

SEQ ID NO: 1014163 - DNA, 22 bp, Artificial Sequence
  chemically synthesized
ctaacccaaatatctcttgttt

SEQ ID NO: 1014164 - DNA, 22 bp, Artificial Sequence
  chemically synthesized
taacccaaatatctcttgtttc

SEQ ID NO: 1014165 - DNA, 22 bp, Artificial Sequence
  chemically synthesized
acccaaatatctcttgtttcaa

SEQ ID NO: 1014166 - DNA, 22 bp, Artificial Sequence
  chemically synthesized
gtagaaaagtgccattgaaaca

SEQ ID NO: 1014167 - DNA, 22 bp, Artificial Sequence
  chemically synthesized
ttgtttcaatggcacttttcta

SEQ ID NO: 1014168 - DNA, 22 bp, Artificial Sequence
  chemically synthesized
gtttcaatggcacttttctacc

SEQ ID NO: 1014169 - DNA, 22 bp, Artificial Sequence
  chemically synthesized
tttcaatggcacttttctacca

SEQ ID NO: 1014170 - DNA, 22 bp, Artificial Sequence
  chemically synthesized
caatggcacttttctaccagtg

SEQ ID NO: 1014171 - DNA, 22 bp, Artificial Sequence
  chemically synthesized
aatggcacttttctaccagtgc

SEQ ID NO: 1014172 - DNA, 22 bp, Artificial Sequence
  chemically synthesized
acaagagagcatgtgcactggt

SEQ ID NO: 1014173 - DNA, 22 bp, Artificial Sequence
  chemically synthesized
cacaagagagcatgtgcactgg

SEQ ID NO: 1014174 - DNA, 22 bp, Artificial Sequence
  chemically synthesized
ttctaccagtgcacatgctctc

SEQ ID NO: 1014175 - DNA, 22 bp, Artificial Sequence
  chemically synthesized
tctaccagtgcacatgctctct

SEQ ID NO: 1014176 - DNA, 22 bp, Artificial Sequence
  chemically synthesized
ctaccagtgcacatgctctctt

SEQ ID NO: 1014177 - DNA, 22 bp, Artificial Sequence
  chemically synthesized
taccagtgcacatgctctcttg

SEQ ID NO: 1014178 - DNA, 22 bp, Artificial Sequence
  chemically synthesized
ccagtgcacatgctctcttgtg

SEQ ID NO: 1014179 - DNA, 22 bp, Artificial Sequence
  chemically synthesized
gaaaaataatttcacaagagag

SEQ ID NO: 1014180 - DNA, 22 bp, Artificial Sequence
  chemically synthesized
ggaaaaataatttcacaagaga

SEQ ID NO: 1014181 - DNA, 22 bp, Artificial Sequence
  chemically synthesized
atcttggaaaaataatttcaca

SEQ ID NO: 1014182 - DNA, 22 bp, Artificial Sequence
  chemically synthesized
catcttggaaaaataatttcac

SEQ ID NO: 1014183 - DNA, 22 bp, Artificial Sequence
  chemically synthesized
tcttgtgaaattatttttccaa

SEQ ID NO: 1014184 - DNA, 22 bp, Artificial Sequence
  chemically synthesized
ttgtgaaattatttttccaaga

SEQ ID NO: 1014185 - DNA, 22 bp, Artificial Sequence
  chemically synthesized
gtgaaattatttttccaagatg

SEQ ID NO: 1014186 - DNA, 22 bp, Artificial Sequence
  chemically synthesized
tgaaattatttttccaagatga

SEQ ID NO: 1014187 - DNA, 22 bp, Artificial Sequence
  chemically synthesized
ataaagtgaagcttcatcttgg

SEQ ID NO: 1014188 - DNA, 22 bp, Artificial Sequence
  chemically synthesized
actgataaagtgaagcttcatc

SEQ ID NO: 1014189 - DNA, 22 bp, Artificial Sequence
  chemically synthesized
aactgataaagtgaagcttcat

SEQ ID NO: 1014190 - DNA, 22 bp, Artificial Sequence
  chemically synthesized
tttttccaagatgaagcttcac

SEQ ID NO: 1014191 - DNA, 22 bp, Artificial Sequence
  chemically synthesized
tttaactgataaagtgaagctt

SEQ ID NO: 1014192 - DNA, 22 bp, Artificial Sequence
  chemically synthesized
ttccaagatgaagcttcacttt

SEQ ID NO: 1014193 - DNA, 22 bp, Artificial Sequence
  chemically synthesized
tccaagatgaagcttcacttta

SEQ ID NO: 1014194 - DNA, 22 bp, Artificial Sequence
  chemically synthesized
ccaagatgaagcttcactttat

SEQ ID NO: 1014195 - DNA, 22 bp, Artificial Sequence
  chemically synthesized
attgtttaactgataaagtgaa

SEQ ID NO: 1014196 - DNA, 22 bp, Artificial Sequence
  chemically synthesized
caagatgaagcttcactttatc

SEQ ID NO: 1014197 - DNA, 22 bp, Artificial Sequence
  chemically synthesized
aattgtttaactgataaagtga

SEQ ID NO: 1014198 - DNA, 22 bp, Artificial Sequence
  chemically synthesized
taattgtttaactgataaagtg

SEQ ID NO: 1014199 - DNA, 22 bp, Artificial Sequence
  chemically synthesized
ttaattgtttaactgataaagt

SEQ ID NO: 1014200 - DNA, 22 bp, Artificial Sequence
  chemically synthesized
tcacttttaattgtttaactga

SEQ ID NO: 1014201 - DNA, 22 bp, Artificial Sequence
  chemically synthesized
cactttatcagttaaacaatta

SEQ ID NO: 1014202 - DNA, 22 bp, Artificial Sequence
  chemically synthesized
actttatcagttaaacaattaa

SEQ ID NO: 1014203 - DNA, 22 bp, Artificial Sequence
  chemically synthesized
gaactatcacttttaattgttt

SEQ ID NO: 1014204 - DNA, 22 bp, Artificial Sequence
  chemically synthesized
tagaactatcacttttaattgt

SEQ ID NO: 1014205 - DNA, 22 bp, Artificial Sequence
  chemically synthesized
tatcagttaaacaattaaaagt

SEQ ID NO: 1014206 - DNA, 22 bp, Artificial Sequence
  chemically synthesized
atcagttaaacaattaaaagtg

SEQ ID NO: 1014207 - DNA, 22 bp, Artificial Sequence
  chemically synthesized
tcagttaaacaattaaaagtga

SEQ ID NO: 1014208 - DNA, 22 bp, Artificial Sequence
  chemically synthesized
aacaattaaaagtgatagttct

SEQ ID NO: 1014209 - DNA, 22 bp, Artificial Sequence
  chemically synthesized
aaagtgatagttctagaggttt

SEQ ID NO: 1014210 - DNA, 22 bp, Artificial Sequence
  chemically synthesized
ataaaaataaggggaaaaaacc

SEQ ID NO: 1014211 - DNA, 22 bp, Artificial Sequence
  chemically synthesized
tagaggttttttccccttattt

SEQ ID NO: 1014212 - DNA, 22 bp, Artificial Sequence
  chemically synthesized
ggtagttaataaaaataagggg

SEQ ID NO: 1014213 - DNA, 22 bp, Artificial Sequence
  chemically synthesized
gggtagttaataaaaataaggg

SEQ ID NO: 1014214 - DNA, 22 bp, Artificial Sequence
  chemically synthesized
gaggttttttccccttattttt

SEQ ID NO: 1014215 - DNA, 22 bp, Artificial Sequence
  chemically synthesized
tgggtagttaataaaaataagg

SEQ ID NO: 1014216 - DNA, 22 bp, Artificial Sequence
  chemically synthesized
aattttgggtagttaataaaaa

SEQ ID NO: 1014217 - DNA, 22 bp, Artificial Sequence
  chemically synthesized
tttccccttatttttattaact

SEQ ID NO: 1014218 - DNA, 22 bp, Artificial Sequence
  chemically synthesized
ttccccttatttttattaacta

SEQ ID NO: 1014219 - DNA, 22 bp, Artificial Sequence
  chemically synthesized
ttaaattttgggtagttaataa

SEQ ID NO: 1014220 - DNA, 22 bp, Artificial Sequence
  chemically synthesized
tccccttatttttattaactac

SEQ ID NO: 1014221 - DNA, 22 bp, Artificial Sequence
  chemically synthesized
ccccttatttttattaactacc

SEQ ID NO: 1014222 - DNA, 22 bp, Artificial Sequence
  chemically synthesized
cccttatttttattaactaccc

SEQ ID NO: 1014223 - DNA, 22 bp, Artificial Sequence
  chemically synthesized
atttttattaactacccaaaat

SEQ ID NO: 1014224 - DNA, 22 bp, Artificial Sequence
  chemically synthesized
tttttattaactacccaaaatt

SEQ ID NO: 1014225 - DNA, 22 bp, Artificial Sequence
  chemically synthesized
ttattaactacccaaaatttaa

SEQ ID NO: 1014226 - DNA, 22 bp, Artificial Sequence
  chemically synthesized
tattaactacccaaaatttaat

SEQ ID NO: 1014227 - DNA, 22 bp, Artificial Sequence
  chemically synthesized
attaactacccaaaatttaata

SEQ ID NO: 1014228 - DNA, 22 bp, Artificial Sequence
  chemically synthesized
ttaactacccaaaatttaataa

SEQ ID NO: 1014229 - DNA, 22 bp, Artificial Sequence
  chemically synthesized
actacccaaaatttaataatgt

SEQ ID NO: 1014230 - DNA, 22 bp, Artificial Sequence
  chemically synthesized
cccaaaatttaataatgtatct

SEQ ID NO: 1014231 - DNA, 22 bp, Artificial Sequence
  chemically synthesized
aataatgtatctacatgtacat

SEQ ID NO: 1014232 - DNA, 22 bp, Artificial Sequence
  chemically synthesized
ataatgtatctacatgtacatt

SEQ ID NO: 1014233 - DNA, 22 bp, Artificial Sequence
  chemically synthesized
aatacaatgagtgcaatgtaca

SEQ ID NO: 1014234 - DNA, 22 bp, Artificial Sequence
  chemically synthesized
attaaatacaatgagtgcaatg

SEQ ID NO: 1014235 - DNA, 22 bp, Artificial Sequence
  chemically synthesized
ttcattaaatacaatgagtgca

SEQ ID NO: 1014236 - DNA, 22 bp, Artificial Sequence
  chemically synthesized
catgtacattgcactcattgta

SEQ ID NO: 1014237 - DNA, 22 bp, Artificial Sequence
  chemically synthesized
agcatataattattcattaaat

SEQ ID NO: 1014238 - DNA, 22 bp, Artificial Sequence
  chemically synthesized
cactcattgtatttaatgaata

SEQ ID NO: 1014239 - DNA, 22 bp, Artificial Sequence
  chemically synthesized
attgtatttaatgaataattat

SEQ ID NO: 1014240 - DNA, 22 bp, Artificial Sequence
  chemically synthesized
aaggttaagcatataattattc

SEQ ID NO: 1014241 - DNA, 22 bp, Artificial Sequence
  chemically synthesized
aaaggttaagcatataattatt

SEQ ID NO: 1014242 - DNA, 22 bp, Artificial Sequence
  chemically synthesized
taaaggttaagcatataattat

SEQ ID NO: 1014243 - DNA, 22 bp, Artificial Sequence
  chemically synthesized
tatttaatgaataattatatgc

SEQ ID NO: 1014244 - DNA, 22 bp, Artificial Sequence
  chemically synthesized
aatgaataattatatgcttaac

SEQ ID NO: 1014245 - DNA, 22 bp, Artificial Sequence
  chemically synthesized
atgaataattatatgcttaacc

SEQ ID NO: 1014246 - DNA, 22 bp, Artificial Sequence
  chemically synthesized
caagattttaaaggttaagcat

SEQ ID NO: 1014247 - DNA, 22 bp, Artificial Sequence
  chemically synthesized
acaagattttaaaggttaagca

SEQ ID NO: 1014248 - DNA, 22 bp, Artificial Sequence
  chemically synthesized
tacaagattttaaaggttaagc

SEQ ID NO: 1014249 - DNA, 22 bp, Artificial Sequence
  chemically synthesized
ttttacaagattttaaaggtta

SEQ ID NO: 1014250 - DNA, 22 bp, Artificial Sequence
  chemically synthesized
tctgttttacaagattttaaag

SEQ ID NO: 1014251 - DNA, 22 bp, Artificial Sequence
  chemically synthesized
tatgcttaacctttaaaatctt

SEQ ID NO: 1014252 - DNA, 22 bp, Artificial Sequence
  chemically synthesized
aacctttaaaatcttgtaaaac

SEQ ID NO: 1014253 - DNA, 22 bp, Artificial Sequence
  chemically synthesized
acctttaaaatcttgtaaaaca

SEQ ID NO: 1014254 - DNA, 22 bp, Artificial Sequence
  chemically synthesized
ccaaaatgctgtctgttttaca

SEQ ID NO: 1014255 - DNA, 22 bp, Artificial Sequence
  chemically synthesized
taaaatcttgtaaaacagacag

SEQ ID NO: 1014256 - DNA, 22 bp, Artificial Sequence
  chemically synthesized
aaaatcttgtaaaacagacagc

SEQ ID NO: 1014257 - DNA, 22 bp, Artificial Sequence
  chemically synthesized
tgctaccaaaatgctgtctgtt

SEQ ID NO: 1014258 - DNA, 22 bp, Artificial Sequence
  chemically synthesized
aaatcttgtaaaacagacagca

SEQ ID NO: 1014259 - DNA, 22 bp, Artificial Sequence
  chemically synthesized
atgctaccaaaatgctgtctgt

SEQ ID NO: 1014260 - DNA, 22 bp, Artificial Sequence
  chemically synthesized
tatgctaccaaaatgctgtctg

SEQ ID NO: 1014261 - DNA, 22 bp, Artificial Sequence
  chemically synthesized
ttatgctaccaaaatgctgtct

SEQ ID NO: 1014262 - DNA, 22 bp, Artificial Sequence
  chemically synthesized
tttatgctaccaaaatgctgtc

SEQ ID NO: 1014263 - DNA, 22 bp, Artificial Sequence
  chemically synthesized
ttttatgctaccaaaatgctgt

SEQ ID NO: 1014264 - DNA, 22 bp, Artificial Sequence
  chemically synthesized
gtaaaacagacagcattttggt

SEQ ID NO: 1014265 - DNA, 22 bp, Artificial Sequence
  chemically synthesized
taaaacagacagcattttggta

SEQ ID NO: 1014266 - DNA, 22 bp, Artificial Sequence
  chemically synthesized
ccttttttatgctaccaaaatg

SEQ ID NO: 1014267 - DNA, 22 bp, Artificial Sequence
  chemically synthesized
ggttgccttttttatgctacca

SEQ ID NO: 1014268 - DNA, 22 bp, Artificial Sequence
  chemically synthesized
cggttgccttttttatgctacc

SEQ ID NO: 1014269 - DNA, 22 bp, Artificial Sequence
  chemically synthesized
ccttcggttgccttttttatgc

SEQ ID NO: 1014270 - DNA, 22 bp, Artificial Sequence
  chemically synthesized
ggctaccttcggttgccttttt

SEQ ID NO: 1014271 - DNA, 22 bp, Artificial Sequence
  chemically synthesized
cggctaccttcggttgcctttt

SEQ ID NO: 1014272 - DNA, 22 bp, Artificial Sequence
  chemically synthesized
tggtagcataaaaaaggcaacc

SEQ ID NO: 1014273 - DNA, 22 bp, Artificial Sequence
  chemically synthesized
ggtagcataaaaaaggcaaccg

SEQ ID NO: 1014274 - DNA, 22 bp, Artificial Sequence
  chemically synthesized
ttcggctaccttcggttgcctt

SEQ ID NO: 1014275 - DNA, 22 bp, Artificial Sequence
  chemically synthesized
gtagcataaaaaaggcaaccga

SEQ ID NO: 1014276 - DNA, 22 bp, Artificial Sequence
  chemically synthesized
gagaatacctcttcggctacct

SEQ ID NO: 1014277 - DNA, 22 bp, Artificial Sequence
  chemically synthesized
cagttagagaatacctcttcgg

SEQ ID NO: 1014278 - DNA, 22 bp, Artificial Sequence
  chemically synthesized
actacagttagagaatacctct

SEQ ID NO: 1014279 - DNA, 22 bp, Artificial Sequence
  chemically synthesized
actaactacagttagagaatac

SEQ ID NO: 1014280 - DNA, 22 bp, Artificial Sequence
  chemically synthesized
cactaactacagttagagaata

SEQ ID NO: 1014281 - DNA, 22 bp, Artificial Sequence
  chemically synthesized
tcactaactacagttagagaat

SEQ ID NO: 1014282 - DNA, 22 bp, Artificial Sequence
  chemically synthesized
ttcactaactacagttagagaa

SEQ ID NO: 1014283 - DNA, 22 bp, Artificial Sequence
  chemically synthesized
tttttcactaactacagttaga

SEQ ID NO: 1014284 - DNA, 22 bp, Artificial Sequence
  chemically synthesized
atttttcactaactacagttag

SEQ ID NO: 1014285 - DNA, 22 bp, Artificial Sequence
  chemically synthesized
ttatttttcactaactacagtt

SEQ ID NO: 1014286 - DNA, 22 bp, Artificial Sequence
  chemically synthesized
tctaactgtagttagtgaaaaa

SEQ ID NO: 1014287 - DNA, 22 bp, Artificial Sequence
  chemically synthesized
taactgtagttagtgaaaaata

SEQ ID NO: 1014288 - DNA, 22 bp, Artificial Sequence
  chemically synthesized
actgtagttagtgaaaaataag

SEQ ID NO: 1014289 - DNA, 22 bp, Artificial Sequence
  chemically synthesized
tagttagtgaaaaataagaatg

SEQ ID NO: 1014290 - DNA, 22 bp, Artificial Sequence
  chemically synthesized
gtgaaaaataagaatgttgcct

SEQ ID NO: 1014291 - DNA, 22 bp, Artificial Sequence
  chemically synthesized
gaataccataaatcatcaaagg

SEQ ID NO: 1014292 - DNA, 22 bp, Artificial Sequence
  chemically synthesized
tagaataccataaatcatcaaa

SEQ ID NO: 1014293 - DNA, 22 bp, Artificial Sequence
  chemically synthesized
aataactctagaataccataaa

SEQ ID NO: 1014294 - DNA, 22 bp, Artificial Sequence
  chemically synthesized
cctttgatgatttatggtattc

SEQ ID NO: 1014295 - DNA, 22 bp, Artificial Sequence
  chemically synthesized
tgatgatttatggtattctaga

SEQ ID NO: 1014296 - DNA, 22 bp, Artificial Sequence
  chemically synthesized
tatctgaataactctagaatac

SEQ ID NO: 1014297 - DNA, 22 bp, Artificial Sequence
  chemically synthesized
gatgatttatggtattctagag

SEQ ID NO: 1014298 - DNA, 22 bp, Artificial Sequence
  chemically synthesized
atgatttatggtattctagagt

SEQ ID NO: 1014299 - DNA, 22 bp, Artificial Sequence
  chemically synthesized
atggtattctagagttattcag

SEQ ID NO: 1014300 - DNA, 22 bp, Artificial Sequence
  chemically synthesized
tggtattctagagttattcaga

SEQ ID NO: 1014301 - DNA, 22 bp, Artificial Sequence
  chemically synthesized
tggaaggatatattgtatctga

SEQ ID NO: 1014302 - DNA, 22 bp, Artificial Sequence
  chemically synthesized
tagagttattcagatacaatat

SEQ ID NO: 1014303 - DNA, 22 bp, Artificial Sequence
  chemically synthesized
ttgtggaaggatatattgtatc

SEQ ID NO: 1014304 - DNA, 22 bp, Artificial Sequence
  chemically synthesized
gttgtggaaggatatattgtat

SEQ ID NO: 1014305 - DNA, 22 bp, Artificial Sequence
  chemically synthesized
gagttattcagatacaatatat

SEQ ID NO: 1014306 - DNA, 22 bp, Artificial Sequence
  chemically synthesized
tgttgtggaaggatatattgta

SEQ ID NO: 1014307 - DNA, 22 bp, Artificial Sequence
  chemically synthesized
ttcagatacaatatatccttcc

SEQ ID NO: 1014308 - DNA, 22 bp, Artificial Sequence
  chemically synthesized
agatacaatatatccttccaca

SEQ ID NO: 1014309 - DNA, 22 bp, Artificial Sequence
  chemically synthesized
gcaagatcattttgttgtggaa

SEQ ID NO: 1014310 - DNA, 22 bp, Artificial Sequence
  chemically synthesized
ccacaacaaaatgatcttgcca

SEQ ID NO: 1014311 - DNA, 22 bp, Artificial Sequence
  chemically synthesized
cacaacaaaatgatcttgccaa

SEQ ID NO: 1014312 - DNA, 22 bp, Artificial Sequence
  chemically synthesized
gtaaacatgcaaaaacattggc

SEQ ID NO: 1014313 - DNA, 22 bp, Artificial Sequence
  chemically synthesized
ttagtaaacatgcaaaaacatt

SEQ ID NO: 1014314 - DNA, 22 bp, Artificial Sequence
  chemically synthesized
aattattagtaaacatgcaaaa

SEQ ID NO: 1014315 - DNA, 22 bp, Artificial Sequence
  chemically synthesized
gccaatgtttttgcatgtttac

SEQ ID NO: 1014316 - DNA, 22 bp, Artificial Sequence
  chemically synthesized
ccaatgtttttgcatgtttact

SEQ ID NO: 1014317 - DNA, 22 bp, Artificial Sequence
  chemically synthesized
ttgcatgtttactaataattta

SEQ ID NO: 1014318 - DNA, 22 bp, Artificial Sequence
  chemically synthesized
tgcatgtttactaataatttag

SEQ ID NO: 1014319 - DNA, 22 bp, Artificial Sequence
  chemically synthesized
gcatgtttactaataatttagc

SEQ ID NO: 1014320 - DNA, 22 bp, Artificial Sequence
  chemically synthesized
catgtttactaataatttagca

SEQ ID NO: 1014321 - DNA, 22 bp, Artificial Sequence
  chemically synthesized
aaaatatatgaatgctaaatta

SEQ ID NO: 1014322 - DNA, 22 bp, Artificial Sequence
  chemically synthesized
actaataatttagcattcatat

SEQ ID NO: 1014323 - DNA, 22 bp, Artificial Sequence
  chemically synthesized
ctaataatttagcattcatata

SEQ ID NO: 1014324 - DNA, 22 bp, Artificial Sequence
  chemically synthesized
tataccattgaaaatatatgaa

SEQ ID NO: 1014325 - DNA, 22 bp, Artificial Sequence
  chemically synthesized
ataatttagcattcatatattt

SEQ ID NO: 1014326 - DNA, 22 bp, Artificial Sequence
  chemically synthesized
tgtgttatataccattgaaaat

SEQ ID NO: 1014327 - DNA, 22 bp, Artificial Sequence
  chemically synthesized
agcattcatatattttcaatgg

SEQ ID NO: 1014328 - DNA, 22 bp, Artificial Sequence
  chemically synthesized
gcattcatatattttcaatggt

SEQ ID NO: 1014329 - DNA, 22 bp, Artificial Sequence
  chemically synthesized
ttgtgtgttatataccattgaa

SEQ ID NO: 1014330 - DNA, 22 bp, Artificial Sequence
  chemically synthesized
attgtgtgttatataccattga

SEQ ID NO: 1014331 - DNA, 22 bp, Artificial Sequence
  chemically synthesized
atatattttcaatggtatataa

SEQ ID NO: 1014332 - DNA, 22 bp, Artificial Sequence
  chemically synthesized
ataggtcatttattgtgtgtta

SEQ ID NO: 1014333 - DNA, 22 bp, Artificial Sequence
  chemically synthesized
tcaatggtatataacacacaat

SEQ ID NO: 1014334 - DNA, 22 bp, Artificial Sequence
  chemically synthesized
caatggtatataacacacaata

SEQ ID NO: 1014335 - DNA, 22 bp, Artificial Sequence
  chemically synthesized
aatggtatataacacacaataa

SEQ ID NO: 1014336 - DNA, 22 bp, Artificial Sequence
  chemically synthesized
cgatatattcataggtcattta

SEQ ID NO: 1014337 - DNA, 22 bp, Artificial Sequence
  chemically synthesized
acgatatattcataggtcattt

SEQ ID NO: 1014338 - DNA, 22 bp, Artificial Sequence
  chemically synthesized
aagggaataaacttacgatata

SEQ ID NO: 1014339 - DNA, 22 bp, Artificial Sequence
  chemically synthesized
aaagggaataaacttacgatat

SEQ ID NO: 1014340 - DNA, 22 bp, Artificial Sequence
  chemically synthesized
taaagggaataaacttacgata

SEQ ID NO: 1014341 - DNA, 22 bp, Artificial Sequence
  chemically synthesized
ttaaagggaataaacttacgat

SEQ ID NO: 1014342 - DNA, 22 bp, Artificial Sequence
  chemically synthesized
atttttaaagggaataaactta

SEQ ID NO: 1014343 - DNA, 22 bp, Artificial Sequence
  chemically synthesized
tgaatatatcgtaagtttattc

SEQ ID NO: 1014344 - DNA, 22 bp, Artificial Sequence
  chemically synthesized
attccctttaaaaatgaattgc

SEQ ID NO: 1014345 - DNA, 22 bp, Artificial Sequence
  chemically synthesized
ttccctttaaaaatgaattgca

SEQ ID NO: 1014346 - DNA, 22 bp, Artificial Sequence
  chemically synthesized
cctttaaaaatgaattgcacat

SEQ ID NO: 1014347 - DNA, 22 bp, Artificial Sequence
  chemically synthesized
taaaaatgaattgcacattgca

SEQ ID NO: 1014348 - DNA, 22 bp, Artificial Sequence
  chemically synthesized
aaaaatgaattgcacattgcat

SEQ ID NO: 1014349 - DNA, 22 bp, Artificial Sequence
  chemically synthesized
aaaatgaattgcacattgcata

SEQ ID NO: 1014350 - DNA, 22 bp, Artificial Sequence
  chemically synthesized
cacattgcatatgttacatgca

SEQ ID NO: 1014351 - DNA, 22 bp, Artificial Sequence
  chemically synthesized
cagtgatgcaaatgcatgtaac

SEQ ID NO: 1014352 - DNA, 22 bp, Artificial Sequence
  chemically synthesized
actccagtgatgcaaatgcatg

SEQ ID NO: 1014353 - DNA, 22 bp, Artificial Sequence
  chemically synthesized
gactccagtgatgcaaatgcat

SEQ ID NO: 1014354 - DNA, 22 bp, Artificial Sequence
  chemically synthesized
tgactccagtgatgcaaatgca

SEQ ID NO: 1014355 - DNA, 22 bp, Artificial Sequence
  chemically synthesized
catatgttacatgcatttgcat

SEQ ID NO: 1014356 - DNA, 22 bp, Artificial Sequence
  chemically synthesized
tttgactccagtgatgcaaatg

SEQ ID NO: 1014357 - DNA, 22 bp, Artificial Sequence
  chemically synthesized
catgcatttgcatcactggagt

SEQ ID NO: 1014358 - DNA, 22 bp, Artificial Sequence
  chemically synthesized
aaaagcaactctttgactccag

SEQ ID NO: 1014359 - DNA, 22 bp, Artificial Sequence
  chemically synthesized
attcaaaagcaactctttgact

SEQ ID NO: 1014360 - DNA, 22 bp, Artificial Sequence
  chemically synthesized
gcatcactggagtcaaagagtt

SEQ ID NO: 1014361 - DNA, 22 bp, Artificial Sequence
  chemically synthesized
tcattcaaaagcaactctttga

SEQ ID NO: 1014362 - DNA, 22 bp, Artificial Sequence
  chemically synthesized
catcactggagtcaaagagttg

SEQ ID NO: 1014363 - DNA, 22 bp, Artificial Sequence
  chemically synthesized
gattctcattcaaaagcaactc

SEQ ID NO: 1014364 - DNA, 22 bp, Artificial Sequence
  chemically synthesized
agattctcattcaaaagcaact

SEQ ID NO: 1014365 - DNA, 22 bp, Artificial Sequence
  chemically synthesized
tagattctcattcaaaagcaac

SEQ ID NO: 1014366 - DNA, 22 bp, Artificial Sequence
  chemically synthesized
ttagattctcattcaaaagcaa

SEQ ID NO: 1014367 - DNA, 22 bp, Artificial Sequence
  chemically synthesized
gagtcaaagagttgcttttgaa

SEQ ID NO: 1014368 - DNA, 22 bp, Artificial Sequence
  chemically synthesized
catagatttttagattctcatt

SEQ ID NO: 1014369 - DNA, 22 bp, Artificial Sequence
  chemically synthesized
tgttgcatagatttttagattc

SEQ ID NO: 1014370 - DNA, 22 bp, Artificial Sequence
  chemically synthesized
cttttgaatgagaatctaaaaa

SEQ ID NO: 1014371 - DNA, 22 bp, Artificial Sequence
  chemically synthesized
ttgaatgagaatctaaaaatct

SEQ ID NO: 1014372 - DNA, 22 bp, Artificial Sequence
  chemically synthesized
actatgttgcatagatttttag

SEQ ID NO: 1014373 - DNA, 22 bp, Artificial Sequence
  chemically synthesized
tgaatgagaatctaaaaatcta

SEQ ID NO: 1014374 - DNA, 22 bp, Artificial Sequence
  chemically synthesized
gaatgagaatctaaaaatctat

SEQ ID NO: 1014375 - DNA, 22 bp, Artificial Sequence
  chemically synthesized
aatgagaatctaaaaatctatg

SEQ ID NO: 1014376 - DNA, 22 bp, Artificial Sequence
  chemically synthesized
aaaatctatgcaacatagttag

SEQ ID NO: 1014377 - DNA, 22 bp, Artificial Sequence
  chemically synthesized
accagtatggaacaatgctaac

SEQ ID NO: 1014378 - DNA, 22 bp, Artificial Sequence
  chemically synthesized
tgcaacatagttagcattgttc

SEQ ID NO: 1014379 - DNA, 22 bp, Artificial Sequence
  chemically synthesized
gcattgttccatactggtgaga

SEQ ID NO: 1014380 - DNA, 22 bp, Artificial Sequence
  chemically synthesized
tataagaaaatatagtctcacc

SEQ ID NO: 1014381 - DNA, 22 bp, Artificial Sequence
  chemically synthesized
ttccatactggtgagactatat

SEQ ID NO: 1014382 - DNA, 22 bp, Artificial Sequence
  chemically synthesized
catactggtgagactatatttt

SEQ ID NO: 1014383 - DNA, 22 bp, Artificial Sequence
  chemically synthesized
gtgagactatattttcttatat

SEQ ID NO: 1014384 - DNA, 22 bp, Artificial Sequence
  chemically synthesized
aaaaatatagaaaaattatata

SEQ ID NO: 1014385 - DNA, 22 bp, Artificial Sequence
  chemically synthesized
tattttcttatataatttttct

SEQ ID NO: 1014386 - DNA, 22 bp, Artificial Sequence
  chemically synthesized
tcttatataatttttctatatt

SEQ ID NO: 1014387 - DNA, 22 bp, Artificial Sequence
  chemically synthesized
cttatataatttttctatattt

SEQ ID NO: 1014388 - DNA, 22 bp, Artificial Sequence
  chemically synthesized
ttatataatttttctatatttt

SEQ ID NO: 1014389 - DNA, 22 bp, Artificial Sequence
  chemically synthesized
tagacaaattgaaaaatataga

SEQ ID NO: 1014390 - DNA, 22 bp, Artificial Sequence
  chemically synthesized
atataatttttctatatttttc

SEQ ID NO: 1014391 - DNA, 22 bp, Artificial Sequence
  chemically synthesized
tataatttttctatatttttca

SEQ ID NO: 1014392 - DNA, 22 bp, Artificial Sequence
  chemically synthesized
ttctatatttttcaatttgtct

SEQ ID NO: 1014393 - DNA, 22 bp, Artificial Sequence
  chemically synthesized
tctatatttttcaatttgtcta

SEQ ID NO: 1014394 - DNA, 22 bp, Artificial Sequence
  chemically synthesized
ctatatttttcaatttgtctac

SEQ ID NO: 1014395 - DNA, 22 bp, Artificial Sequence
  chemically synthesized
tatatttttcaatttgtctaca

SEQ ID NO: 1014396 - DNA, 22 bp, Artificial Sequence
  chemically synthesized
tatttttcaatttgtctacaat

SEQ ID NO: 1014397 - DNA, 22 bp, Artificial Sequence
  chemically synthesized
aatatgaaaagcacattgtaga

SEQ ID NO: 1014398 - DNA, 22 bp, Artificial Sequence
  chemically synthesized
tcaatatgaaaagcacattgta

SEQ ID NO: 1014399 - DNA, 22 bp, Artificial Sequence
  chemically synthesized
ttcaatttgtctacaatgtgct

SEQ ID NO: 1014400 - DNA, 22 bp, Artificial Sequence
  chemically synthesized
tcaatttgtctacaatgtgctt

SEQ ID NO: 1014401 - DNA, 22 bp, Artificial Sequence
  chemically synthesized
caatttgtctacaatgtgcttt

SEQ ID NO: 1014402 - DNA, 22 bp, Artificial Sequence
  chemically synthesized
aatttgtctacaatgtgctttt

SEQ ID NO: 1014403 - DNA, 22 bp, Artificial Sequence
  chemically synthesized
actctcaatatgaaaagcacat

SEQ ID NO: 1014404 - DNA, 22 bp, Artificial Sequence
  chemically synthesized
tgactctcaatatgaaaagcac

SEQ ID NO: 1014405 - DNA, 22 bp, Artificial Sequence
  chemically synthesized
ctgactctcaatatgaaaagca

SEQ ID NO: 1014406 - DNA, 22 bp, Artificial Sequence
  chemically synthesized
tctgactctcaatatgaaaagc

SEQ ID NO: 1014407 - DNA, 22 bp, Artificial Sequence
  chemically synthesized
gtctacaatgtgcttttcatat

SEQ ID NO: 1014408 - DNA, 22 bp, Artificial Sequence
  chemically synthesized
ttctgactctcaatatgaaaag

SEQ ID NO: 1014409 - DNA, 22 bp, Artificial Sequence
  chemically synthesized
tctacaatgtgcttttcatatt

SEQ ID NO: 1014410 - DNA, 22 bp, Artificial Sequence
  chemically synthesized
atttttctgactctcaatatga

SEQ ID NO: 1014411 - DNA, 22 bp, Artificial Sequence
  chemically synthesized
caatgtgcttttcatattgaga

SEQ ID NO: 1014412 - DNA, 22 bp, Artificial Sequence
  chemically synthesized
catttttctgactctcaatatg

SEQ ID NO: 1014413 - DNA, 22 bp, Artificial Sequence
  chemically synthesized
tttcatttttctgactctcaat

SEQ ID NO: 1014414 - DNA, 22 bp, Artificial Sequence
  chemically synthesized
aattatttcatttttctgactc

SEQ ID NO: 1014415 - DNA, 22 bp, Artificial Sequence
  chemically synthesized
aaattatttcatttttctgact

SEQ ID NO: 1014416 - DNA, 22 bp, Artificial Sequence
  chemically synthesized
ttcatattgagagtcagaaaaa

SEQ ID NO: 1014417 - DNA, 22 bp, Artificial Sequence
  chemically synthesized
taaattatttcatttttctgac

SEQ ID NO: 1014418 - DNA, 22 bp, Artificial Sequence
  chemically synthesized
tcatattgagagtcagaaaaat

SEQ ID NO: 1014419 - DNA, 22 bp, Artificial Sequence
  chemically synthesized
catattgagagtcagaaaaatg

SEQ ID NO: 1014420 - DNA, 22 bp, Artificial Sequence
  chemically synthesized
atattgagagtcagaaaaatga

SEQ ID NO: 1014421 - DNA, 22 bp, Artificial Sequence
  chemically synthesized
agagtcagaaaaatgaaataat

SEQ ID NO: 1014422 - DNA, 22 bp, Artificial Sequence
  chemically synthesized
aaaaaaaattttaaattatttc

SEQ ID NO: 1014423 - DNA, 22 bp, Artificial Sequence
  chemically synthesized
aaaaaaaaattttaaattattt

SEQ ID NO: 1014424 - DNA, 22 bp, Artificial Sequence
  chemically synthesized
ccatttaaaaaaaaattttaaa

SEQ ID NO: 1014425 - DNA, 22 bp, Artificial Sequence
  chemically synthesized
catatgagactgccatttaaaa

SEQ ID NO: 1014426 - DNA, 22 bp, Artificial Sequence
  chemically synthesized
gcatatgagactgccatttaaa

SEQ ID NO: 1014427 - DNA, 22 bp, Artificial Sequence
  chemically synthesized
aaaatttttttttaaatggcag

SEQ ID NO: 1014428 - DNA, 22 bp, Artificial Sequence
  chemically synthesized
aaatttttttttaaatggcagt

SEQ ID NO: 1014429 - DNA, 22 bp, Artificial Sequence
  chemically synthesized
ttttttaaatggcagtctcata

SEQ ID NO: 1014430 - DNA, 22 bp, Artificial Sequence
  chemically synthesized
tttttaaatggcagtctcatat

SEQ ID NO: 1014431 - DNA, 22 bp, Artificial Sequence
  chemically synthesized
gcagtcatttgcatatgagact

SEQ ID NO: 1014432 - DNA, 22 bp, Artificial Sequence
  chemically synthesized
ttttaaatggcagtctcatatg

SEQ ID NO: 1014433 - DNA, 22 bp, Artificial Sequence
  chemically synthesized
tttaaatggcagtctcatatgc

SEQ ID NO: 1014434 - DNA, 22 bp, Artificial Sequence
  chemically synthesized
ttaaatggcagtctcatatgca

SEQ ID NO: 1014435 - DNA, 22 bp, Artificial Sequence
  chemically synthesized
taaatggcagtctcatatgcaa

SEQ ID NO: 1014436 - DNA, 22 bp, Artificial Sequence
  chemically synthesized
aaatggcagtctcatatgcaaa

SEQ ID NO: 1014437 - DNA, 22 bp, Artificial Sequence
  chemically synthesized
aatggcagtctcatatgcaaat

SEQ ID NO: 1014438 - DNA, 22 bp, Artificial Sequence
  chemically synthesized
gagttagcagtcatttgcatat

SEQ ID NO: 1014439 - DNA, 22 bp, Artificial Sequence
  chemically synthesized
atatgcaaatgactgctaactc

SEQ ID NO: 1014440 - DNA, 22 bp, Artificial Sequence
  chemically synthesized
tggtagcaggaggagggttgga

SEQ ID NO: 1014441 - DNA, 22 bp, Artificial Sequence
  chemically synthesized
agactgtggtagcaggaggagg

SEQ ID NO: 1014442 - DNA, 22 bp, Artificial Sequence
  chemically synthesized
ctaactccaaccctcctcctgc

SEQ ID NO: 1014443 - DNA, 22 bp, Artificial Sequence
  chemically synthesized
tcagactgtggtagcaggagga

SEQ ID NO: 1014444 - DNA, 22 bp, Artificial Sequence
  chemically synthesized
ctcagactgtggtagcaggagg

SEQ ID NO: 1014445 - DNA, 22 bp, Artificial Sequence
  chemically synthesized
actccaaccctcctcctgctac

SEQ ID NO: 1014446 - DNA, 22 bp, Artificial Sequence
  chemically synthesized
tttctcagactgtggtagcagg

SEQ ID NO: 1014447 - DNA, 22 bp, Artificial Sequence
  chemically synthesized
caaccctcctcctgctaccaca

SEQ ID NO: 1014448 - DNA, 22 bp, Artificial Sequence
  chemically synthesized
actgtttctcagactgtggtag

SEQ ID NO: 1014449 - DNA, 22 bp, Artificial Sequence
  chemically synthesized
ctgactgtttctcagactgtgg

SEQ ID NO: 1014450 - DNA, 22 bp, Artificial Sequence
  chemically synthesized
ctcctgctaccacagtctgaga

SEQ ID NO: 1014451 - DNA, 22 bp, Artificial Sequence
  chemically synthesized
gctgctgactgtttctcagact

SEQ ID NO: 1014452 - DNA, 22 bp, Artificial Sequence
  chemically synthesized
ctgctaccacagtctgagaaac

SEQ ID NO: 1014453 - DNA, 22 bp, Artificial Sequence
  chemically synthesized
gttagctgctgactgtttctca

SEQ ID NO: 1014454 - DNA, 22 bp, Artificial Sequence
  chemically synthesized
ctaccacagtctgagaaacagt

SEQ ID NO: 1014455 - DNA, 22 bp, Artificial Sequence
  chemically synthesized
tggttagctgctgactgtttct

SEQ ID NO: 1014456 - DNA, 22 bp, Artificial Sequence
  chemically synthesized
ccacagtctgagaaacagtcag

SEQ ID NO: 1014457 - DNA, 22 bp, Artificial Sequence
  chemically synthesized
tgctctggttagctgctgactg

SEQ ID NO: 1014458 - DNA, 22 bp, Artificial Sequence
  chemically synthesized
tgtgctctggttagctgctgac

SEQ ID NO: 1014459 - DNA, 22 bp, Artificial Sequence
  chemically synthesized
tctgtgctctggttagctgctg

SEQ ID NO: 1014460 - DNA, 22 bp, Artificial Sequence
  chemically synthesized
ctctgtgctctggttagctgct

SEQ ID NO: 1014461 - DNA, 22 bp, Artificial Sequence
  chemically synthesized
agaaacagtcagcagctaacca

SEQ ID NO: 1014462 - DNA, 22 bp, Artificial Sequence
  chemically synthesized
gtacttctctgtgctctggtta

SEQ ID NO: 1014463 - DNA, 22 bp, Artificial Sequence
  chemically synthesized
accagagcacagagaagtacca

SEQ ID NO: 1014464 - DNA, 22 bp, Artificial Sequence
  chemically synthesized
caaaggtggagtggtaagtcgt

SEQ ID NO: 1014465 - DNA, 22 bp, Artificial Sequence
  chemically synthesized
ctacaaaggtggagtggtaagt

SEQ ID NO: 1014466 - DNA, 22 bp, Artificial Sequence
  chemically synthesized
gtcacgacttaccactccacct

SEQ ID NO: 1014467 - DNA, 22 bp, Artificial Sequence
  chemically synthesized
atggttgctacaaaggtggagt

SEQ ID NO: 1014468 - DNA, 22 bp, Artificial Sequence
  chemically synthesized
accactccacctttgtagcaac

SEQ ID NO: 1014469 - DNA, 22 bp, Artificial Sequence
  chemically synthesized
ccactccacctttgtagcaacc

SEQ ID NO: 1014470 - DNA, 22 bp, Artificial Sequence
  chemically synthesized
cacctttgtagcaaccatcagt

SEQ ID NO: 1014471 - DNA, 22 bp, Artificial Sequence
  chemically synthesized
tgtagcaaccatcagtctccac

SEQ ID NO: 1014472 - DNA, 22 bp, Artificial Sequence
  chemically synthesized
gtagcaaccatcagtctccact

SEQ ID NO: 1014473 - DNA, 22 bp, Artificial Sequence
  chemically synthesized
tagcaaccatcagtctccactc

SEQ ID NO: 1014474 - DNA, 22 bp, Artificial Sequence
  chemically synthesized
ggtaggaaaaacagcaaaccaa

SEQ ID NO: 1014475 - DNA, 22 bp, Artificial Sequence
  chemically synthesized
cactcttggtttgctgtttttc

SEQ ID NO: 1014476 - DNA, 22 bp, Artificial Sequence
  chemically synthesized
aagtgattgggtaggaaaaaca

SEQ ID NO: 1014477 - DNA, 22 bp, Artificial Sequence
  chemically synthesized
ttggtttgctgtttttcctacc

SEQ ID NO: 1014478 - DNA, 22 bp, Artificial Sequence
  chemically synthesized
ggtttgctgtttttcctaccca

SEQ ID NO: 1014479 - DNA, 22 bp, Artificial Sequence
  chemically synthesized
gtttgctgtttttcctacccaa

SEQ ID NO: 1014480 - DNA, 22 bp, Artificial Sequence
  chemically synthesized
gctgtttttcctacccaatcac

SEQ ID NO: 1014481 - DNA, 22 bp, Artificial Sequence
  chemically synthesized
ctgtttttcctacccaatcact

SEQ ID NO: 1014482 - DNA, 22 bp, Artificial Sequence
  chemically synthesized
tttttcctacccaatcacttga

SEQ ID NO: 1014483 - DNA, 22 bp, Artificial Sequence
  chemically synthesized
gcaaaagtatagttcaagtgat

SEQ ID NO: 1014484 - DNA, 22 bp, Artificial Sequence
  chemically synthesized
ttcctacccaatcacttgaact

SEQ ID NO: 1014485 - DNA, 22 bp, Artificial Sequence
  chemically synthesized
tcctacccaatcacttgaacta

SEQ ID NO: 1014486 - DNA, 22 bp, Artificial Sequence
  chemically synthesized
cctacccaatcacttgaactat

SEQ ID NO: 1014487 - DNA, 22 bp, Artificial Sequence
  chemically synthesized
ctacccaatcacttgaactata

SEQ ID NO: 1014488 - DNA, 22 bp, Artificial Sequence
  chemically synthesized
cccaatcacttgaactatactt

SEQ ID NO: 1014489 - DNA, 22 bp, Artificial Sequence
  chemically synthesized
aaagtgttggcaaaagtatagt

SEQ ID NO: 1014490 - DNA, 22 bp, Artificial Sequence
  chemically synthesized
gtagctaaaagtgttggcaaaa

SEQ ID NO: 1014491 - DNA, 22 bp, Artificial Sequence
  chemically synthesized
gaactatacttttgccaacact

SEQ ID NO: 1014492 - DNA, 22 bp, Artificial Sequence
  chemically synthesized
ctagtagctaaaagtgttggca

SEQ ID NO: 1014493 - DNA, 22 bp, Artificial Sequence
  chemically synthesized
aactatacttttgccaacactt

SEQ ID NO: 1014494 - DNA, 22 bp, Artificial Sequence
  chemically synthesized
tacttttgccaacacttttagc

SEQ ID NO: 1014495 - DNA, 22 bp, Artificial Sequence
  chemically synthesized
ttgccaacacttttagctacta

SEQ ID NO: 1014496 - DNA, 22 bp, Artificial Sequence
  chemically synthesized
tgccaacacttttagctactag

SEQ ID NO: 1014497 - DNA, 22 bp, Artificial Sequence
  chemically synthesized
gccaacacttttagctactagg

SEQ ID NO: 1014498 - DNA, 22 bp, Artificial Sequence
  chemically synthesized
ccaacacttttagctactagga

SEQ ID NO: 1014499 - DNA, 22 bp, Artificial Sequence
  chemically synthesized
ttagctactaggaggtgactgt

SEQ ID NO: 1014500 - DNA, 22 bp, Artificial Sequence
  chemically synthesized
tagctactaggaggtgactgtt

SEQ ID NO: 1014501 - DNA, 22 bp, Artificial Sequence
  chemically synthesized
agctactaggaggtgactgttt

SEQ ID NO: 1014502 - DNA, 22 bp, Artificial Sequence
  chemically synthesized
gctactaggaggtgactgtttc

SEQ ID NO: 1014503 - DNA, 22 bp, Artificial Sequence
  chemically synthesized
tagcagtatgtcagagaaacag

SEQ ID NO: 1014504 - DNA, 22 bp, Artificial Sequence
  chemically synthesized
ctaggaggtgactgtttctctg

SEQ ID NO: 1014505 - DNA, 22 bp, Artificial Sequence
  chemically synthesized
atagcagtatgtcagagaaaca

SEQ ID NO: 1014506 - DNA, 22 bp, Artificial Sequence
  chemically synthesized
ggaggtgactgtttctctgaca

SEQ ID NO: 1014507 - DNA, 22 bp, Artificial Sequence
  chemically synthesized
tttctctgacatactgctataa

SEQ ID NO: 1014508 - DNA, 22 bp, Artificial Sequence
  chemically synthesized
ctctgacatactgctataaatg

SEQ ID NO: 1014509 - DNA, 22 bp, Artificial Sequence
  chemically synthesized
tctgacatactgctataaatgc

SEQ ID NO: 1014510 - DNA, 22 bp, Artificial Sequence
  chemically synthesized
aaatgaagaatgggcatttata

SEQ ID NO: 1014511 - DNA, 22 bp, Artificial Sequence
  chemically synthesized
tgacatactgctataaatgccc

SEQ ID NO: 1014512 - DNA, 22 bp, Artificial Sequence
  chemically synthesized
acatactgctataaatgcccat

SEQ ID NO: 1014513 - DNA, 22 bp, Artificial Sequence
  chemically synthesized
ctataaatgcccattcttcatt

SEQ ID NO: 1014514 - DNA, 22 bp, Artificial Sequence
  chemically synthesized
taaatgcccattcttcatttca

SEQ ID NO: 1014515 - DNA, 22 bp, Artificial Sequence
  chemically synthesized
aggtgtacaggatcctgaaatg

SEQ ID NO: 1014516 - DNA, 22 bp, Artificial Sequence
  chemically synthesized
gaggtgtacaggatcctgaaat

SEQ ID NO: 1014517 - DNA, 22 bp, Artificial Sequence
  chemically synthesized
tgaggtgtacaggatcctgaaa

SEQ ID NO: 1014518 - DNA, 22 bp, Artificial Sequence
  chemically synthesized
ttcatttcaggatcctgtacac

SEQ ID NO: 1014519 - DNA, 22 bp, Artificial Sequence
  chemically synthesized
catttcaggatcctgtacacct

SEQ ID NO: 1014520 - DNA, 22 bp, Artificial Sequence
  chemically synthesized
atttcaggatcctgtacacctc

SEQ ID NO: 1014521 - DNA, 22 bp, Artificial Sequence
  chemically synthesized
aaatcgaaaatctttgaggtgt

SEQ ID NO: 1014522 - DNA, 22 bp, Artificial Sequence
  chemically synthesized
caggatcctgtacacctcaaag

SEQ ID NO: 1014523 - DNA, 22 bp, Artificial Sequence
  chemically synthesized
gaaatcgaaaatctttgaggtg

SEQ ID NO: 1014524 - DNA, 22 bp, Artificial Sequence
  chemically synthesized
aggatcctgtacacctcaaaga

SEQ ID NO: 1014525 - DNA, 22 bp, Artificial Sequence
  chemically synthesized
tacacctcaaagattttcgatt

SEQ ID NO: 1014526 - DNA, 22 bp, Artificial Sequence
  chemically synthesized
tgcaacaggtttgaaatcgaaa

SEQ ID NO: 1014527 - DNA, 22 bp, Artificial Sequence
  chemically synthesized
aaagattttcgatttcaaacct

SEQ ID NO: 1014528 - DNA, 22 bp, Artificial Sequence
  chemically synthesized
agaaacaagtctgtgcaacagg

SEQ ID NO: 1014529 - DNA, 22 bp, Artificial Sequence
  chemically synthesized
tcgatttcaaacctgttgcaca

SEQ ID NO: 1014530 - DNA, 22 bp, Artificial Sequence
  chemically synthesized
cgatttcaaacctgttgcacag

SEQ ID NO: 1014531 - DNA, 22 bp, Artificial Sequence
  chemically synthesized
gatttcaaacctgttgcacaga

SEQ ID NO: 1014532 - DNA, 22 bp, Artificial Sequence
  chemically synthesized
caaacctgttgcacagacttgt

SEQ ID NO: 1014533 - DNA, 22 bp, Artificial Sequence
  chemically synthesized
aaacctgttgcacagacttgtt

SEQ ID NO: 1014534 - DNA, 22 bp, Artificial Sequence
  chemically synthesized
ttgcacagacttgtttctcaat

SEQ ID NO: 1014535 - DNA, 22 bp, Artificial Sequence
  chemically synthesized
cacagacttgtttctcaatcac

SEQ ID NO: 1014536 - DNA, 22 bp, Artificial Sequence
  chemically synthesized
ccaatatgatgagtgattgaga

SEQ ID NO: 1014537 - DNA, 22 bp, Artificial Sequence
  chemically synthesized
gtttctcaatcactcatcatat

SEQ ID NO: 1014538 - DNA, 22 bp, Artificial Sequence
  chemically synthesized
tttctcaatcactcatcatatt

SEQ ID NO: 1014539 - DNA, 22 bp, Artificial Sequence
  chemically synthesized
ctcaatcactcatcatattggt

SEQ ID NO: 1014540 - DNA, 22 bp, Artificial Sequence
  chemically synthesized
tcaatcactcatcatattggta

SEQ ID NO: 1014541 - DNA, 22 bp, Artificial Sequence
  chemically synthesized
aatcactcatcatattggtaat

SEQ ID NO: 1014542 - DNA, 22 bp, Artificial Sequence
  chemically synthesized
atagaggatggcaattaccaat

SEQ ID NO: 1014543 - DNA, 22 bp, Artificial Sequence
  chemically synthesized
gatagaggatggcaattaccaa

SEQ ID NO: 1014544 - DNA, 22 bp, Artificial Sequence
  chemically synthesized
aatttgatagaggatggcaatt

SEQ ID NO: 1014545 - DNA, 22 bp, Artificial Sequence
  chemically synthesized
atcatattggtaattgccatcc

SEQ ID NO: 1014546 - DNA, 22 bp, Artificial Sequence
  chemically synthesized
ttgaatttgatagaggatggca

SEQ ID NO: 1014547 - DNA, 22 bp, Artificial Sequence
  chemically synthesized
gttgaatttgatagaggatggc

SEQ ID NO: 1014548 - DNA, 22 bp, Artificial Sequence
  chemically synthesized
gtaattgccatcctctatcaaa

SEQ ID NO: 1014549 - DNA, 22 bp, Artificial Sequence
  chemically synthesized
ccatcctctatcaaattcaaca

SEQ ID NO: 1014550 - DNA, 22 bp, Artificial Sequence
  chemically synthesized
agggtgagagggggatttgttg

SEQ ID NO: 1014551 - DNA, 22 bp, Artificial Sequence
  chemically synthesized
tatcaaattcaacaaatccccc

SEQ ID NO: 1014552 - DNA, 22 bp, Artificial Sequence
  chemically synthesized
tcaaattcaacaaatccccctc

SEQ ID NO: 1014553 - DNA, 22 bp, Artificial Sequence
  chemically synthesized
aacaaatccccctctcaccctg

SEQ ID NO: 1014554 - DNA, 22 bp, Artificial Sequence
  chemically synthesized
taaaaaggaaaagaattcaggg

SEQ ID NO: 1014555 - DNA, 22 bp, Artificial Sequence
  chemically synthesized
gtaaaaaggaaaagaattcagg

SEQ ID NO: 1014556 - DNA, 22 bp, Artificial Sequence
  chemically synthesized
tcaccctgaattcttttccttt

SEQ ID NO: 1014557 - DNA, 22 bp, Artificial Sequence
  chemically synthesized
accctgaattcttttccttttt

SEQ ID NO: 1014558 - DNA, 22 bp, Artificial Sequence
  chemically synthesized
tagataacttgtaaaaaggaaa

SEQ ID NO: 1014559 - DNA, 22 bp, Artificial Sequence
  chemically synthesized
gtagataacttgtaaaaaggaa

SEQ ID NO: 1014560 - DNA, 22 bp, Artificial Sequence
  chemically synthesized
aattcttttcctttttacaagt

SEQ ID NO: 1014561 - DNA, 22 bp, Artificial Sequence
  chemically synthesized
tagaaacttgtagataacttgt

SEQ ID NO: 1014562 - DNA, 22 bp, Artificial Sequence
  chemically synthesized
ttttcctttttacaagttatct

SEQ ID NO: 1014563 - DNA, 22 bp, Artificial Sequence
  chemically synthesized
gtagaaacttgtagataacttg

SEQ ID NO: 1014564 - DNA, 22 bp, Artificial Sequence
  chemically synthesized
ttcctttttacaagttatctac

SEQ ID NO: 1014565 - DNA, 22 bp, Artificial Sequence
  chemically synthesized
tcctttttacaagttatctaca

SEQ ID NO: 1014566 - DNA, 22 bp, Artificial Sequence
  chemically synthesized
cctttttacaagttatctacaa

SEQ ID NO: 1014567 - DNA, 22 bp, Artificial Sequence
  chemically synthesized
ctttttacaagttatctacaag

SEQ ID NO: 1014568 - DNA, 22 bp, Artificial Sequence
  chemically synthesized
tttacaagttatctacaagttt

SEQ ID NO: 1014569 - DNA, 22 bp, Artificial Sequence
  chemically synthesized
ttacaagttatctacaagtttc

SEQ ID NO: 1014570 - DNA, 22 bp, Artificial Sequence
  chemically synthesized
tacaagttatctacaagtttct

SEQ ID NO: 1014571 - DNA, 22 bp, Artificial Sequence
  chemically synthesized
acaagttatctacaagtttcta

SEQ ID NO: 1014572 - DNA, 22 bp, Artificial Sequence
  chemically synthesized
caagttatctacaagtttctac

SEQ ID NO: 1014573 - DNA, 22 bp, Artificial Sequence
  chemically synthesized
tctacaagtttctacaagttat

SEQ ID NO: 1014574 - DNA, 22 bp, Artificial Sequence
  chemically synthesized
caagtttctacaagttatcttt

SEQ ID NO: 1014575 - DNA, 22 bp, Artificial Sequence
  chemically synthesized
ggagaatgtaaaggaaagataa

SEQ ID NO: 1014576 - DNA, 22 bp, Artificial Sequence
  chemically synthesized
gggagaatgtaaaggaaagata

SEQ ID NO: 1014577 - DNA, 22 bp, Artificial Sequence
  chemically synthesized
ttgggagaatgtaaaggaaaga

SEQ ID NO: 1014578 - DNA, 22 bp, Artificial Sequence
  chemically synthesized
ctacaagttatctttcctttac

SEQ ID NO: 1014579 - DNA, 22 bp, Artificial Sequence
  chemically synthesized
tcttgggagaatgtaaaggaaa

SEQ ID NO: 1014580 - DNA, 22 bp, Artificial Sequence
  chemically synthesized
tacaagttatctttcctttaca

SEQ ID NO: 1014581 - DNA, 22 bp, Artificial Sequence
  chemically synthesized
ctcttgggagaatgtaaaggaa

SEQ ID NO: 1014582 - DNA, 22 bp, Artificial Sequence
  chemically synthesized
caagttatctttcctttacatt

SEQ ID NO: 1014583 - DNA, 22 bp, Artificial Sequence
  chemically synthesized
ttctcttgggagaatgtaaagg

SEQ ID NO: 1014584 - DNA, 22 bp, Artificial Sequence
  chemically synthesized
cttctcttgggagaatgtaaag

SEQ ID NO: 1014585 - DNA, 22 bp, Artificial Sequence
  chemically synthesized
tcttctcttgggagaatgtaaa

SEQ ID NO: 1014586 - DNA, 22 bp, Artificial Sequence
  chemically synthesized
tctttcctttacattctcccaa

SEQ ID NO: 1014587 - DNA, 22 bp, Artificial Sequence
  chemically synthesized
cggttttcttctcttgggagaa

SEQ ID NO: 1014588 - DNA, 22 bp, Artificial Sequence
  chemically synthesized
acggttttcttctcttgggaga

SEQ ID NO: 1014589 - DNA, 22 bp, Artificial Sequence
  chemically synthesized
tcctttacattctcccaagaga

SEQ ID NO: 1014590 - DNA, 22 bp, Artificial Sequence
  chemically synthesized
cctttacattctcccaagagaa

SEQ ID NO: 1014591 - DNA, 22 bp, Artificial Sequence
  chemically synthesized
ctttacattctcccaagagaag

SEQ ID NO: 1014592 - DNA, 22 bp, Artificial Sequence
  chemically synthesized
tacattctcccaagagaagaaa

SEQ ID NO: 1014593 - DNA, 22 bp, Artificial Sequence
  chemically synthesized
acattctcccaagagaagaaaa

SEQ ID NO: 1014594 - DNA, 22 bp, Artificial Sequence
  chemically synthesized
cattctcccaagagaagaaaac

SEQ ID NO: 1014595 - DNA, 22 bp, Artificial Sequence
  chemically synthesized
tcccaagagaagaaaaccgtaa

SEQ ID NO: 1014596 - DNA, 22 bp, Artificial Sequence
  chemically synthesized
ccaagagaagaaaaccgtaagg

SEQ ID NO: 1014597 - DNA, 22 bp, Artificial Sequence
  chemically synthesized
cggataccatgagcaagtgtat

SEQ ID NO: 1014598 - DNA, 22 bp, Artificial Sequence
  chemically synthesized
cagagctacggataccatgagc

SEQ ID NO: 1014599 - DNA, 22 bp, Artificial Sequence
  chemically synthesized
acagagctacggataccatgag

SEQ ID NO: 1014600 - DNA, 22 bp, Artificial Sequence
  chemically synthesized
atacacttgctcatggtatccg

SEQ ID NO: 1014601 - DNA, 22 bp, Artificial Sequence
  chemically synthesized
tcttacagagctacggatacca

SEQ ID NO: 1014602 - DNA, 22 bp, Artificial Sequence
  chemically synthesized
tgtcttacagagctacggatac

SEQ ID NO: 1014603 - DNA, 22 bp, Artificial Sequence
  chemically synthesized
gctcatggtatccgtagctctg

SEQ ID NO: 1014604 - DNA, 22 bp, Artificial Sequence
  chemically synthesized
ctcatggtatccgtagctctgt

SEQ ID NO: 1014605 - DNA, 22 bp, Artificial Sequence
  chemically synthesized
cagctctgtcttacagagctac

SEQ ID NO: 1014606 - DNA, 22 bp, Artificial Sequence
  chemically synthesized
atggtatccgtagctctgtaag

SEQ ID NO: 1014607 - DNA, 22 bp, Artificial Sequence
  chemically synthesized
cctccagctctgtcttacagag

SEQ ID NO: 1014608 - DNA, 22 bp, Artificial Sequence
  chemically synthesized
ctacctccagctctgtcttaca

SEQ ID NO: 1014609 - DNA, 22 bp, Artificial Sequence
  chemically synthesized
cctacctccagctctgtcttac

SEQ ID NO: 1014610 - DNA, 22 bp, Artificial Sequence
  chemically synthesized
ttcctacctccagctctgtctt

SEQ ID NO: 1014611 - DNA, 22 bp, Artificial Sequence
  chemically synthesized
tcttcctacctccagctctgtc

SEQ ID NO: 1014612 - DNA, 22 bp, Artificial Sequence
  chemically synthesized
ctcttcctacctccagctctgt

SEQ ID NO: 1014613 - DNA, 22 bp, Artificial Sequence
  chemically synthesized
cccttctcttcctacctccagc

SEQ ID NO: 1014614 - DNA, 22 bp, Artificial Sequence
  chemically synthesized
tgtaagacagagctggaggtag

SEQ ID NO: 1014615 - DNA, 22 bp, Artificial Sequence
  chemically synthesized
taagacagagctggaggtagga

SEQ ID NO: 1014616 - DNA, 22 bp, Artificial Sequence
  chemically synthesized
ttccccttctcttcctacctcc

SEQ ID NO: 1014617 - DNA, 22 bp, Artificial Sequence
  chemically synthesized
gaggtaggaagagaaggggaac

SEQ ID NO: 1014618 - DNA, 22 bp, Artificial Sequence
  chemically synthesized
gaacaatggtgtaagtggaagg

SEQ ID NO: 1014619 - DNA, 22 bp, Artificial Sequence
  chemically synthesized
tgggcctggaacaatggtgtaa

SEQ ID NO: 1014620 - DNA, 22 bp, Artificial Sequence
  chemically synthesized
gtgggcctggaacaatggtgta

SEQ ID NO: 1014621 - DNA, 22 bp, Artificial Sequence
  chemically synthesized
ttgtgggcctggaacaatggtg

SEQ ID NO: 1014622 - DNA, 22 bp, Artificial Sequence
  chemically synthesized
cctcttgtgggcctggaacaat

SEQ ID NO: 1014623 - DNA, 22 bp, Artificial Sequence
  chemically synthesized
ccacttacaccattgttccagg

SEQ ID NO: 1014624 - DNA, 22 bp, Artificial Sequence
  chemically synthesized
cacttacaccattgttccaggc

SEQ ID NO: 1014625 - DNA, 22 bp, Artificial Sequence
  chemically synthesized
cctccctcttgtgggcctggaa

SEQ ID NO: 1014626 - DNA, 22 bp, Artificial Sequence
  chemically synthesized
acaccattgttccaggcccaca

SEQ ID NO: 1014627 - DNA, 22 bp, Artificial Sequence
  chemically synthesized
caccattgttccaggcccacaa

SEQ ID NO: 1014628 - DNA, 22 bp, Artificial Sequence
  chemically synthesized
ttccaggcccacaagagggagg

SEQ ID NO: 1014629 - DNA, 22 bp, Artificial Sequence
  chemically synthesized
caggcccacaagagggaggcag

SEQ ID NO: 1014630 - DNA, 22 bp, Artificial Sequence
  chemically synthesized
agacagtagcaggggtcgggca

SEQ ID NO: 1014631 - DNA, 22 bp, Artificial Sequence
  chemically synthesized
tctgcccgacccctgctactgt

SEQ ID NO: 1014632 - DNA, 22 bp, Artificial Sequence
  chemically synthesized
acaagtcctaagacagtagcag

SEQ ID NO: 1014633 - DNA, 22 bp, Artificial Sequence
  chemically synthesized
ctgcccgacccctgctactgtc

SEQ ID NO: 1014634 - DNA, 22 bp, Artificial Sequence
  chemically synthesized
tgcccgacccctgctactgtct

SEQ ID NO: 1014635 - DNA, 22 bp, Artificial Sequence
  chemically synthesized
cccgacccctgctactgtctta

SEQ ID NO: 1014636 - DNA, 22 bp, Artificial Sequence
  chemically synthesized
ctactgtcttaggacttgtgaa

SEQ ID NO: 1014637 - DNA, 22 bp, Artificial Sequence
  chemically synthesized
ccgatatgcaaattcacaagtc

SEQ ID NO: 1014638 - DNA, 22 bp, Artificial Sequence
  chemically synthesized
ctgtcttaggacttgtgaattt

SEQ ID NO: 1014639 - DNA, 22 bp, Artificial Sequence
  chemically synthesized
tcttaggacttgtgaatttgca

SEQ ID NO: 1014640 - DNA, 22 bp, Artificial Sequence
  chemically synthesized
aggacttgtgaatttgcatatc

SEQ ID NO: 1014641 - DNA, 22 bp, Artificial Sequence
  chemically synthesized
ggacttgtgaatttgcatatcg

SEQ ID NO: 1014642 - DNA, 22 bp, Artificial Sequence
  chemically synthesized
agaaatatgctaccgatatgca

SEQ ID NO: 1014643 - DNA, 22 bp, Artificial Sequence
  chemically synthesized
cagaaatatgctaccgatatgc

SEQ ID NO: 1014644 - DNA, 22 bp, Artificial Sequence
  chemically synthesized
gtgaatttgcatatcggtagca

SEQ ID NO: 1014645 - DNA, 22 bp, Artificial Sequence
  chemically synthesized
tgaatttgcatatcggtagcat

SEQ ID NO: 1014646 - DNA, 22 bp, Artificial Sequence
  chemically synthesized
gcatatcggtagcatatttctg

SEQ ID NO: 1014647 - DNA, 22 bp, Artificial Sequence
  chemically synthesized
catatcggtagcatatttctga

SEQ ID NO: 1014648 - DNA, 22 bp, Artificial Sequence
  chemically synthesized
ctgaaatgcccttcttcccttt

SEQ ID NO: 1014649 - DNA, 22 bp, Artificial Sequence
  chemically synthesized
tgaaatgcccttcttccctttt

SEQ ID NO: 1014650 - DNA, 22 bp, Artificial Sequence
  chemically synthesized
aaatgcccttcttccctttttc

SEQ ID NO: 1014651 - DNA, 22 bp, Artificial Sequence
  chemically synthesized
tacgaggagacgagagaaaaag

SEQ ID NO: 1014652 - DNA, 22 bp, Artificial Sequence
  chemically synthesized
gattatacgaggagacgagaga

SEQ ID NO: 1014653 - DNA, 22 bp, Artificial Sequence
  chemically synthesized
ggattatacgaggagacgagag

SEQ ID NO: 1014654 - DNA, 22 bp, Artificial Sequence
  chemically synthesized
cttccctttttctctcgtctcc

SEQ ID NO: 1014655 - DNA, 22 bp, Artificial Sequence
  chemically synthesized
ttccctttttctctcgtctcct

SEQ ID NO: 1014656 - DNA, 22 bp, Artificial Sequence
  chemically synthesized
ccctttttctctcgtctcctcg

SEQ ID NO: 1014657 - DNA, 22 bp, Artificial Sequence
  chemically synthesized
cctttttctctcgtctcctcgt

SEQ ID NO: 1014658 - DNA, 22 bp, Artificial Sequence
  chemically synthesized
tttctctcgtctcctcgtataa

SEQ ID NO: 1014659 - DNA, 22 bp, Artificial Sequence
  chemically synthesized
ttctctcgtctcctcgtataat

SEQ ID NO: 1014660 - DNA, 22 bp, Artificial Sequence
  chemically synthesized
tctctcgtctcctcgtataatc

SEQ ID NO: 1014661 - DNA, 22 bp, Artificial Sequence
  chemically synthesized
ctctcgtctcctcgtataatcc

SEQ ID NO: 1014662 - DNA, 22 bp, Artificial Sequence
  chemically synthesized
tctcgtctcctcgtataatcca

SEQ ID NO: 1014663 - DNA, 22 bp, Artificial Sequence
  chemically synthesized
tcgtctcctcgtataatccaaa

SEQ ID NO: 1014664 - DNA, 22 bp, Artificial Sequence
  chemically synthesized
aggatgcaaaagtttggattat

SEQ ID NO: 1014665 - DNA, 22 bp, Artificial Sequence
  chemically synthesized
gaggatgcaaaagtttggatta

SEQ ID NO: 1014666 - DNA, 22 bp, Artificial Sequence
  chemically synthesized
gtctcctcgtataatccaaact

SEQ ID NO: 1014667 - DNA, 22 bp, Artificial Sequence
  chemically synthesized
ctcgtataatccaaacttttgc

SEQ ID NO: 1014668 - DNA, 22 bp, Artificial Sequence
  chemically synthesized
ggtccttgaggatgcaaaagtt

SEQ ID NO: 1014669 - DNA, 22 bp, Artificial Sequence
  chemically synthesized
gtataatccaaacttttgcatc

SEQ ID NO: 1014670 - DNA, 22 bp, Artificial Sequence
  chemically synthesized
ttaggtccttgaggatgcaaaa

SEQ ID NO: 1014671 - DNA, 22 bp, Artificial Sequence
  chemically synthesized
attaggtccttgaggatgcaaa

SEQ ID NO: 1014672 - DNA, 22 bp, Artificial Sequence
  chemically synthesized
tattaggtccttgaggatgcaa

SEQ ID NO: 1014673 - DNA, 22 bp, Artificial Sequence
  chemically synthesized
ttattaggtccttgaggatgca

SEQ ID NO: 1014674 - DNA, 22 bp, Artificial Sequence
  chemically synthesized
ttgcatcctcaaggacctaata

SEQ ID NO: 1014675 - DNA, 22 bp, Artificial Sequence
  chemically synthesized
tgcatcctcaaggacctaataa

SEQ ID NO: 1014676 - DNA, 22 bp, Artificial Sequence
  chemically synthesized
gcatcctcaaggacctaataaa

SEQ ID NO: 1014677 - DNA, 22 bp, Artificial Sequence
  chemically synthesized
catcctcaaggacctaataaaa

SEQ ID NO: 1014678 - DNA, 22 bp, Artificial Sequence
  chemically synthesized
aaggacctaataaaaatgactt

SEQ ID NO: 1014679 - DNA, 22 bp, Artificial Sequence
  chemically synthesized
taaagtgacagcataagtcatt

SEQ ID NO: 1014680 - DNA, 22 bp, Artificial Sequence
  chemically synthesized
ataaagtgacagcataagtcat

SEQ ID NO: 1014681 - DNA, 22 bp, Artificial Sequence
  chemically synthesized
ataaaaatgacttatgctgtca

SEQ ID NO: 1014682 - DNA, 22 bp, Artificial Sequence
  chemically synthesized
tatatttataaagtgacagcat

SEQ ID NO: 1014683 - DNA, 22 bp, Artificial Sequence
  chemically synthesized
atatatttataaagtgacagca

SEQ ID NO: 1014684 - DNA, 22 bp, Artificial Sequence
  chemically synthesized
atatttatatatttataaagtg

SEQ ID NO: 1014685 - DNA, 22 bp, Artificial Sequence
  chemically synthesized
catatttatatatttataaagt

SEQ ID NO: 1014686 - DNA, 22 bp, Artificial Sequence
  chemically synthesized
atgctgtcactttataaatata

SEQ ID NO: 1014687 - DNA, 22 bp, Artificial Sequence
  chemically synthesized
tgctgtcactttataaatatat

SEQ ID NO: 1014688 - DNA, 22 bp, Artificial Sequence
  chemically synthesized
tcactttataaatatataaata

SEQ ID NO: 1014689 - DNA, 22 bp, Artificial Sequence
  chemically synthesized
taataaatacttcatatttata

SEQ ID NO: 1014690 - DNA, 22 bp, Artificial Sequence
  chemically synthesized
tataaatatataaatatgaagt

SEQ ID NO: 1014691 - DNA, 22 bp, Artificial Sequence
  chemically synthesized
ataaatatataaatatgaagta

SEQ ID NO: 1014692 - DNA, 22 bp, Artificial Sequence
  chemically synthesized
taaatatataaatatgaagtat

SEQ ID NO: 1014693 - DNA, 22 bp, Artificial Sequence
  chemically synthesized
catgctgtaataaatacttcat

SEQ ID NO: 1014694 - DNA, 22 bp, Artificial Sequence
  chemically synthesized
gcagttgcatgctgtaataaat

SEQ ID NO: 1014695 - DNA, 22 bp, Artificial Sequence
  chemically synthesized
agcagttgcatgctgtaataaa

SEQ ID NO: 1014696 - DNA, 22 bp, Artificial Sequence
  chemically synthesized
aaaggtttagcagttgcatgct

SEQ ID NO: 1014697 - DNA, 22 bp, Artificial Sequence
  chemically synthesized
caaaggtttagcagttgcatgc

SEQ ID NO: 1014698 - DNA, 22 bp, Artificial Sequence
  chemically synthesized
tcaaaggtttagcagttgcatg

SEQ ID NO: 1014699 - DNA, 22 bp, Artificial Sequence
  chemically synthesized
attacagcatgcaactgctaaa

SEQ ID NO: 1014700 - DNA, 22 bp, Artificial Sequence
  chemically synthesized
ttacagcatgcaactgctaaac

SEQ ID NO: 1014701 - DNA, 22 bp, Artificial Sequence
  chemically synthesized
cagttttcaaaggtttagcagt

SEQ ID NO: 1014702 - DNA, 22 bp, Artificial Sequence
  chemically synthesized
acagttttcaaaggtttagcag

SEQ ID NO: 1014703 - DNA, 22 bp, Artificial Sequence
  chemically synthesized
tacagttttcaaaggtttagca

SEQ ID NO: 1014704 - DNA, 22 bp, Artificial Sequence
  chemically synthesized
cagcatgcaactgctaaacctt

SEQ ID NO: 1014705 - DNA, 22 bp, Artificial Sequence
  chemically synthesized
aatcaactttacagttttcaaa

SEQ ID NO: 1014706 - DNA, 22 bp, Artificial Sequence
  chemically synthesized
ctaaacctttgaaaactgtaaa

SEQ ID NO: 1014707 - DNA, 22 bp, Artificial Sequence
  chemically synthesized
aacctttgaaaactgtaaagtt

SEQ ID NO: 1014708 - DNA, 22 bp, Artificial Sequence
  chemically synthesized
aataataaaattaaatcaactt

SEQ ID NO: 1014709 - DNA, 22 bp, Artificial Sequence
  chemically synthesized
tgaaaactgtaaagttgattta

SEQ ID NO: 1014710 - DNA, 22 bp, Artificial Sequence
  chemically synthesized
caataataaaattaaatcaact

SEQ ID NO: 1014711 - DNA, 22 bp, Artificial Sequence
  chemically synthesized
gaaaactgtaaagttgatttaa

SEQ ID NO: 1014712 - DNA, 22 bp, Artificial Sequence
  chemically synthesized
aaaactgtaaagttgatttaat

SEQ ID NO: 1014713 - DNA, 22 bp, Artificial Sequence
  chemically synthesized
taaagttgatttaattttatta

SEQ ID NO: 1014714 - DNA, 22 bp, Artificial Sequence
  chemically synthesized
aacagtaatttcaataataaaa

SEQ ID NO: 1014715 - DNA, 22 bp, Artificial Sequence
  chemically synthesized
caacagtaatttcaataataaa

SEQ ID NO: 1014716 - DNA, 22 bp, Artificial Sequence
  chemically synthesized
tttcaacagtaatttcaataat

SEQ ID NO: 1014717 - DNA, 22 bp, Artificial Sequence
  chemically synthesized
atttcaacagtaatttcaataa

SEQ ID NO: 1014718 - DNA, 22 bp, Artificial Sequence
  chemically synthesized
atttaattttattattgaaatt

SEQ ID NO: 1014719 - DNA, 22 bp, Artificial Sequence
  chemically synthesized
cttatttcaacagtaatttcaa

SEQ ID NO: 1014720 - DNA, 22 bp, Artificial Sequence
  chemically synthesized
aattttattattgaaattactg

SEQ ID NO: 1014721 - DNA, 22 bp, Artificial Sequence
  chemically synthesized
attttattattgaaattactgt

SEQ ID NO: 1014722 - DNA, 22 bp, Artificial Sequence
  chemically synthesized
tattattgaaattactgttgaa

SEQ ID NO: 1014723 - DNA, 22 bp, Artificial Sequence
  chemically synthesized
attattgaaattactgttgaaa

SEQ ID NO: 1014724 - DNA, 22 bp, Artificial Sequence
  chemically synthesized
aatagttacttatttcaacagt

SEQ ID NO: 1014725 - DNA, 22 bp, Artificial Sequence
  chemically synthesized
ttattgaaattactgttgaaat

SEQ ID NO: 1014726 - DNA, 22 bp, Artificial Sequence
  chemically synthesized
gaatagttacttatttcaacag

SEQ ID NO: 1014727 - DNA, 22 bp, Artificial Sequence
  chemically synthesized
ttgaaattactgttgaaataag

SEQ ID NO: 1014728 - DNA, 22 bp, Artificial Sequence
  chemically synthesized
tttgaatagttacttatttcaa

SEQ ID NO: 1014729 - DNA, 22 bp, Artificial Sequence
  chemically synthesized
gtttgaatagttacttatttca

SEQ ID NO: 1014730 - DNA, 22 bp, Artificial Sequence
  chemically synthesized
tgtttgaatagttacttatttc

SEQ ID NO: 1014731 - DNA, 22 bp, Artificial Sequence
  chemically synthesized
aaattactgttgaaataagtaa

SEQ ID NO: 1014732 - DNA, 22 bp, Artificial Sequence
  chemically synthesized
atattttgtttgaatagttact

SEQ ID NO: 1014733 - DNA, 22 bp, Artificial Sequence
  chemically synthesized
ctgttgaaataagtaactattc

SEQ ID NO: 1014734 - DNA, 22 bp, Artificial Sequence
  chemically synthesized
aatattttgtttgaatagttac

SEQ ID NO: 1014735 - DNA, 22 bp, Artificial Sequence
  chemically synthesized
taatattttgtttgaatagtta

SEQ ID NO: 1014736 - DNA, 22 bp, Artificial Sequence
  chemically synthesized
ttgaaataagtaactattcaaa

SEQ ID NO: 1014737 - DNA, 22 bp, Artificial Sequence
  chemically synthesized
tttaatattttgtttgaatagt

SEQ ID NO: 1014738 - DNA, 22 bp, Artificial Sequence
  chemically synthesized
aaataagtaactattcaaacaa

SEQ ID NO: 1014739 - DNA, 22 bp, Artificial Sequence
  chemically synthesized
ttctttaatattttgtttgaat

SEQ ID NO: 1014740 - DNA, 22 bp, Artificial Sequence
  chemically synthesized
attctttaatattttgtttgaa

SEQ ID NO: 1014741 - DNA, 22 bp, Artificial Sequence
  chemically synthesized
tattctttaatattttgtttga

SEQ ID NO: 1014742 - DNA, 22 bp, Artificial Sequence
  chemically synthesized
ttcaaacaaaatattaaagaat

SEQ ID NO: 1014743 - DNA, 22 bp, Artificial Sequence
  chemically synthesized
aaacaaaatattaaagaataaa

SEQ ID NO: 1014744 - DNA, 22 bp, Artificial Sequence
  chemically synthesized
aagaataaaatcatgggcttta

SEQ ID NO: 1014745 - DNA, 22 bp, Artificial Sequence
  chemically synthesized
agtgtcatcacatgtaaagccc

SEQ ID NO: 1014746 - DNA, 22 bp, Artificial Sequence
  chemically synthesized
acattaagtgtcatcacatgta

SEQ ID NO: 1014747 - DNA, 22 bp, Artificial Sequence
  chemically synthesized
ctcacattaagtgtcatcacat

SEQ ID NO: 1014748 - DNA, 22 bp, Artificial Sequence
  chemically synthesized
ttactcacattaagtgtcatca

SEQ ID NO: 1014749 - DNA, 22 bp, Artificial Sequence
  chemically synthesized
tacatgtgatgacacttaatgt

SEQ ID NO: 1014750 - DNA, 22 bp, Artificial Sequence
  chemically synthesized
acatgtgatgacacttaatgtg

SEQ ID NO: 1014751 - DNA, 22 bp, Artificial Sequence
  chemically synthesized
catgtgatgacacttaatgtga

SEQ ID NO: 1014752 - DNA, 22 bp, Artificial Sequence
  chemically synthesized
aagtattattactcacattaag

SEQ ID NO: 1014753 - DNA, 22 bp, Artificial Sequence
  chemically synthesized
aaatggagtctaaagtattatt

SEQ ID NO: 1014754 - DNA, 22 bp, Artificial Sequence
  chemically synthesized
gaaatggagtctaaagtattat

SEQ ID NO: 1014755 - DNA, 22 bp, Artificial Sequence
  chemically synthesized
aatgtgagtaataatactttag

SEQ ID NO: 1014756 - DNA, 22 bp, Artificial Sequence
  chemically synthesized
atgtgagtaataatactttaga

SEQ ID NO: 1014757 - DNA, 22 bp, Artificial Sequence
  chemically synthesized
tgtgaggcttgaaatggagtct

SEQ ID NO: 1014758 - DNA, 22 bp, Artificial Sequence
  chemically synthesized
atgtgaggcttgaaatggagtc

SEQ ID NO: 1014759 - DNA, 22 bp, Artificial Sequence
  chemically synthesized
tatgtgaggcttgaaatggagt

SEQ ID NO: 1014760 - DNA, 22 bp, Artificial Sequence
  chemically synthesized
aaattttatgtgaggcttgaaa

SEQ ID NO: 1014761 - DNA, 22 bp, Artificial Sequence
  chemically synthesized
aaaattttatgtgaggcttgaa

SEQ ID NO: 1014762 - DNA, 22 bp, Artificial Sequence
  chemically synthesized
taaaattttatgtgaggcttga

SEQ ID NO: 1014763 - DNA, 22 bp, Artificial Sequence
  chemically synthesized
tagactccatttcaagcctcac

SEQ ID NO: 1014764 - DNA, 22 bp, Artificial Sequence
  chemically synthesized
agactccatttcaagcctcaca

SEQ ID NO: 1014765 - DNA, 22 bp, Artificial Sequence
  chemically synthesized
gactccatttcaagcctcacat

SEQ ID NO: 1014766 - DNA, 22 bp, Artificial Sequence
  chemically synthesized
catttcaagcctcacataaaat

SEQ ID NO: 1014767 - DNA, 22 bp, Artificial Sequence
  chemically synthesized
aaaagtgtattttaaaatttta

SEQ ID NO: 1014768 - DNA, 22 bp, Artificial Sequence
  chemically synthesized
caagcctcacataaaattttaa

SEQ ID NO: 1014769 - DNA, 22 bp, Artificial Sequence
  chemically synthesized
aagcctcacataaaattttaaa

SEQ ID NO: 1014770 - DNA, 22 bp, Artificial Sequence
  chemically synthesized
aatactgaaaagtgtattttaa

SEQ ID NO: 1014771 - DNA, 22 bp, Artificial Sequence
  chemically synthesized
acataaaattttaaaatacact

SEQ ID NO: 1014772 - DNA, 22 bp, Artificial Sequence
  chemically synthesized
ttaaatactgaaaagtgtattt

SEQ ID NO: 1014773 - DNA, 22 bp, Artificial Sequence
  chemically synthesized
taaaatacacttttcagtattt

SEQ ID NO: 1014774 - DNA, 22 bp, Artificial Sequence
  chemically synthesized
acagcacctattaaatactgaa

SEQ ID NO: 1014775 - DNA, 22 bp, Artificial Sequence
  chemically synthesized
aaaatacacttttcagtattta

SEQ ID NO: 1014776 - DNA, 22 bp, Artificial Sequence
  chemically synthesized
aaatacacttttcagtatttaa

SEQ ID NO: 1014777 - DNA, 22 bp, Artificial Sequence
  chemically synthesized
ttaacagcacctattaaatact

SEQ ID NO: 1014778 - DNA, 22 bp, Artificial Sequence
  chemically synthesized
tgctattaacagcacctattaa

SEQ ID NO: 1014779 - DNA, 22 bp, Artificial Sequence
  chemically synthesized
ttcagtatttaataggtgctgt

SEQ ID NO: 1014780 - DNA, 22 bp, Artificial Sequence
  chemically synthesized
tcagtatttaataggtgctgtt

SEQ ID NO: 1014781 - DNA, 22 bp, Artificial Sequence
  chemically synthesized
gactgtgctattaacagcacct

SEQ ID NO: 1014782 - DNA, 22 bp, Artificial Sequence
  chemically synthesized
cagtatttaataggtgctgtta

SEQ ID NO: 1014783 - DNA, 22 bp, Artificial Sequence
  chemically synthesized
agactgtgctattaacagcacc

SEQ ID NO: 1014784 - DNA, 22 bp, Artificial Sequence
  chemically synthesized
agtatttaataggtgctgttaa

SEQ ID NO: 1014785 - DNA, 22 bp, Artificial Sequence
  chemically synthesized
aataggtgctgttaatagcaca

SEQ ID NO: 1014786 - DNA, 22 bp, Artificial Sequence
  chemically synthesized
ataggtgctgttaatagcacag

SEQ ID NO: 1014787 - DNA, 22 bp, Artificial Sequence
  chemically synthesized
aagaatagatttagactgtgct

SEQ ID NO: 1014788 - DNA, 22 bp, Artificial Sequence
  chemically synthesized
ttaatagcacagtctaaatcta

SEQ ID NO: 1014789 - DNA, 22 bp, Artificial Sequence
  chemically synthesized
atagcacagtctaaatctattc

SEQ ID NO: 1014790 - DNA, 22 bp, Artificial Sequence
  chemically synthesized
cgtagtaaattcaagaatagat

SEQ ID NO: 1014791 - DNA, 22 bp, Artificial Sequence
  chemically synthesized
acgtagtaaattcaagaataga

SEQ ID NO: 1014792 - DNA, 22 bp, Artificial Sequence
  chemically synthesized
tacgtagtaaattcaagaatag

SEQ ID NO: 1014793 - DNA, 22 bp, Artificial Sequence
  chemically synthesized
aatctattcttgaatttactac

SEQ ID NO: 1014794 - DNA, 22 bp, Artificial Sequence
  chemically synthesized
ttcttgaatttactacgtaaaa

SEQ ID NO: 1014795 - DNA, 22 bp, Artificial Sequence
  chemically synthesized
ttgaatttactacgtaaaatta

SEQ ID NO: 1014796 - DNA, 22 bp, Artificial Sequence
  chemically synthesized
gaatttactacgtaaaattaca

SEQ ID NO: 1014797 - DNA, 22 bp, Artificial Sequence
  chemically synthesized
aatttactacgtaaaattacat

SEQ ID NO: 1014798 - DNA, 22 bp, Artificial Sequence
  chemically synthesized
actacgtaaaattacatttttt

SEQ ID NO: 1014799 - DNA, 22 bp, Artificial Sequence
  chemically synthesized
ctacgtaaaattacatttttta

SEQ ID NO: 1014800 - DNA, 22 bp, Artificial Sequence
  chemically synthesized
aaagtagtcatgataaaaaatg

SEQ ID NO: 1014801 - DNA, 22 bp, Artificial Sequence
  chemically synthesized
aaaagtagtcatgataaaaaat

SEQ ID NO: 1014802 - DNA, 22 bp, Artificial Sequence
  chemically synthesized
cgtaaaattacattttttatca

SEQ ID NO: 1014803 - DNA, 22 bp, Artificial Sequence
  chemically synthesized
cattttttatcatgactacttt

SEQ ID NO: 1014804 - DNA, 22 bp, Artificial Sequence
  chemically synthesized
gtggaaaagagtttaaaagtag

SEQ ID NO: 1014805 - DNA, 22 bp, Artificial Sequence
  chemically synthesized
ggtggaaaagagtttaaaagta

SEQ ID NO: 1014806 - DNA, 22 bp, Artificial Sequence
  chemically synthesized
tttatcatgactacttttaaac

SEQ ID NO: 1014807 - DNA, 22 bp, Artificial Sequence
  chemically synthesized
ttatcatgactacttttaaact

SEQ ID NO: 1014808 - DNA, 22 bp, Artificial Sequence
  chemically synthesized
tatcatgactacttttaaactc

SEQ ID NO: 1014809 - DNA, 22 bp, Artificial Sequence
  chemically synthesized
cttggtggaaaagagtttaaaa

SEQ ID NO: 1014810 - DNA, 22 bp, Artificial Sequence
  chemically synthesized
atcatgactacttttaaactct

SEQ ID NO: 1014811 - DNA, 22 bp, Artificial Sequence
  chemically synthesized
ccttggtggaaaagagtttaaa

SEQ ID NO: 1014812 - DNA, 22 bp, Artificial Sequence
  chemically synthesized
tcatgactacttttaaactctt

SEQ ID NO: 1014813 - DNA, 22 bp, Artificial Sequence
  chemically synthesized
tccttggtggaaaagagtttaa

SEQ ID NO: 1014814 - DNA, 22 bp, Artificial Sequence
  chemically synthesized
gaattttccttggtggaaaaga

SEQ ID NO: 1014815 - DNA, 22 bp, Artificial Sequence
  chemically synthesized
ggaattttccttggtggaaaag

SEQ ID NO: 1014816 - DNA, 22 bp, Artificial Sequence
  chemically synthesized
cttttaaactcttttccaccaa

SEQ ID NO: 1014817 - DNA, 22 bp, Artificial Sequence
  chemically synthesized
atttggaattttccttggtgga

SEQ ID NO: 1014818 - DNA, 22 bp, Artificial Sequence
  chemically synthesized
ttaaactcttttccaccaagga

SEQ ID NO: 1014819 - DNA, 22 bp, Artificial Sequence
  chemically synthesized
catttggaattttccttggtgg

SEQ ID NO: 1014820 - DNA, 22 bp, Artificial Sequence
  chemically synthesized
taaactcttttccaccaaggaa

SEQ ID NO: 1014821 - DNA, 22 bp, Artificial Sequence
  chemically synthesized
tcatttggaattttccttggtg

SEQ ID NO: 1014822 - DNA, 22 bp, Artificial Sequence
  chemically synthesized
aaactcttttccaccaaggaaa

SEQ ID NO: 1014823 - DNA, 22 bp, Artificial Sequence
  chemically synthesized
ttcatttggaattttccttggt

SEQ ID NO: 1014824 - DNA, 22 bp, Artificial Sequence
  chemically synthesized
aactcttttccaccaaggaaaa

SEQ ID NO: 1014825 - DNA, 22 bp, Artificial Sequence
  chemically synthesized
tttcatttggaattttccttgg

SEQ ID NO: 1014826 - DNA, 22 bp, Artificial Sequence
  chemically synthesized
ttttcatttggaattttccttg

SEQ ID NO: 1014827 - DNA, 22 bp, Artificial Sequence
  chemically synthesized
ttttccaccaaggaaaattcca

SEQ ID NO: 1014828 - DNA, 22 bp, Artificial Sequence
  chemically synthesized
ttccaccaaggaaaattccaaa

SEQ ID NO: 1014829 - DNA, 22 bp, Artificial Sequence
  chemically synthesized
tccaccaaggaaaattccaaat

SEQ ID NO: 1014830 - DNA, 22 bp, Artificial Sequence
  chemically synthesized
ccaccaaggaaaattccaaatg

SEQ ID NO: 1014831 - DNA, 22 bp, Artificial Sequence
  chemically synthesized
caccaaggaaaattccaaatga

SEQ ID NO: 1014832 - DNA, 22 bp, Artificial Sequence
  chemically synthesized
caaatgaaaaaaatatatatat

SEQ ID NO: 1014833 - DNA, 22 bp, Artificial Sequence
  chemically synthesized
taaaaccagaaaaaatatatat

SEQ ID NO: 1014834 - DNA, 22 bp, Artificial Sequence
  chemically synthesized
gtaaaaccagaaaaaatatata

SEQ ID NO: 1014835 - DNA, 22 bp, Artificial Sequence
  chemically synthesized
tgtaaaaccagaaaaaatatat

SEQ ID NO: 1014836 - DNA, 22 bp, Artificial Sequence
  chemically synthesized
actttgtaaaaccagaaaaaat

SEQ ID NO: 1014837 - DNA, 22 bp, Artificial Sequence
  chemically synthesized
gtaaatctaactttgtaaaacc

SEQ ID NO: 1014838 - DNA, 22 bp, Artificial Sequence
  chemically synthesized
aattggtaaatctaactttgta

SEQ ID NO: 1014839 - DNA, 22 bp, Artificial Sequence
  chemically synthesized
tttctggttttacaaagttaga

SEQ ID NO: 1014840 - DNA, 22 bp, Artificial Sequence
  chemically synthesized
ttctggttttacaaagttagat

SEQ ID NO: 1014841 - DNA, 22 bp, Artificial Sequence
  chemically synthesized
tctggttttacaaagttagatt

SEQ ID NO: 1014842 - DNA, 22 bp, Artificial Sequence
  chemically synthesized
ctggttttacaaagttagattt

SEQ ID NO: 1014843 - DNA, 22 bp, Artificial Sequence
  chemically synthesized
tggttttacaaagttagattta

SEQ ID NO: 1014844 - DNA, 22 bp, Artificial Sequence
  chemically synthesized
gatattaaattggtaaatctaa

SEQ ID NO: 1014845 - DNA, 22 bp, Artificial Sequence
  chemically synthesized
gttttacaaagttagatttacc

SEQ ID NO: 1014846 - DNA, 22 bp, Artificial Sequence
  chemically synthesized
attagatattaaattggtaaat

SEQ ID NO: 1014847 - DNA, 22 bp, Artificial Sequence
  chemically synthesized
tacaaagttagatttaccaatt

SEQ ID NO: 1014848 - DNA, 22 bp, Artificial Sequence
  chemically synthesized
acaaagttagatttaccaattt

SEQ ID NO: 1014849 - DNA, 22 bp, Artificial Sequence
  chemically synthesized
caaagttagatttaccaattta

SEQ ID NO: 1014850 - DNA, 22 bp, Artificial Sequence
  chemically synthesized
gatttaccaatttaatatctaa

SEQ ID NO: 1014851 - DNA, 22 bp, Artificial Sequence
  chemically synthesized
accaatttaatatctaattagt

SEQ ID NO: 1014852 - DNA, 22 bp, Artificial Sequence
  chemically synthesized
gggagcacagtgactaattaga

SEQ ID NO: 1014853 - DNA, 22 bp, Artificial Sequence
  chemically synthesized
ccaatttaatatctaattagtc

SEQ ID NO: 1014854 - DNA, 22 bp, Artificial Sequence
  chemically synthesized
agggagcacagtgactaattag

SEQ ID NO: 1014855 - DNA, 22 bp, Artificial Sequence
  chemically synthesized
aatatctaattagtcactgtgc

SEQ ID NO: 1014856 - DNA, 22 bp, Artificial Sequence
  chemically synthesized
atatctaattagtcactgtgct

SEQ ID NO: 1014857 - DNA, 22 bp, Artificial Sequence
  chemically synthesized
attagtcactgtgctccctaaa

SEQ ID NO: 1014858 - DNA, 22 bp, Artificial Sequence
  chemically synthesized
atggagcgagacaaatttaggg

SEQ ID NO: 1014859 - DNA, 22 bp, Artificial Sequence
  chemically synthesized
gtcactgtgctccctaaatttg

SEQ ID NO: 1014860 - DNA, 22 bp, Artificial Sequence
  chemically synthesized
tgctccctaaatttgtctcgct

SEQ ID NO: 1014861 - DNA, 22 bp, Artificial Sequence
  chemically synthesized
cctaaatttgtctcgctccatt

SEQ ID NO: 1014862 - DNA, 22 bp, Artificial Sequence
  chemically synthesized
atgggcagcccaattaatggag

SEQ ID NO: 1014863 - DNA, 22 bp, Artificial Sequence
  chemically synthesized
aatttgtctcgctccattaatt

SEQ ID NO: 1014864 - DNA, 22 bp, Artificial Sequence
  chemically synthesized
attcatgggcagcccaattaat

SEQ ID NO: 1014865 - DNA, 22 bp, Artificial Sequence
  chemically synthesized
cattcatgggcagcccaattaa

SEQ ID NO: 1014866 - DNA, 22 bp, Artificial Sequence
  chemically synthesized
gtctcgctccattaattgggct

SEQ ID NO: 1014867 - DNA, 22 bp, Artificial Sequence
  chemically synthesized
tctcgctccattaattgggctg

SEQ ID NO: 1014868 - DNA, 22 bp, Artificial Sequence
  chemically synthesized
cttcattcatgggcagcccaat

SEQ ID NO: 1014869 - DNA, 22 bp, Artificial Sequence
  chemically synthesized
gcttcattcatgggcagcccaa

SEQ ID NO: 1014870 - DNA, 22 bp, Artificial Sequence
  chemically synthesized
gctccattaattgggctgccca

SEQ ID NO: 1014871 - DNA, 22 bp, Artificial Sequence
  chemically synthesized
cattaattgggctgcccatgaa

SEQ ID NO: 1014872 - DNA, 22 bp, Artificial Sequence
  chemically synthesized
ccatttgcttcattcatgggca

SEQ ID NO: 1014873 - DNA, 22 bp, Artificial Sequence
  chemically synthesized
ttaccatttgcttcattcatgg

SEQ ID NO: 1014874 - DNA, 22 bp, Artificial Sequence
  chemically synthesized
attgggctgcccatgaatgaag

SEQ ID NO: 1014875 - DNA, 22 bp, Artificial Sequence
  chemically synthesized
attgttaccatttgcttcattc

SEQ ID NO: 1014876 - DNA, 22 bp, Artificial Sequence
  chemically synthesized
ggctgcccatgaatgaagcaaa

SEQ ID NO: 1014877 - DNA, 22 bp, Artificial Sequence
  chemically synthesized
tcattgttaccatttgcttcat

SEQ ID NO: 1014878 - DNA, 22 bp, Artificial Sequence
  chemically synthesized
ctcattgttaccatttgcttca

SEQ ID NO: 1014879 - DNA, 22 bp, Artificial Sequence
  chemically synthesized
tttctcattgttaccatttgct

SEQ ID NO: 1014880 - DNA, 22 bp, Artificial Sequence
  chemically synthesized
cccatgaatgaagcaaatggta

SEQ ID NO: 1014881 - DNA, 22 bp, Artificial Sequence
  chemically synthesized
gtttctcattgttaccatttgc

SEQ ID NO: 1014882 - DNA, 22 bp, Artificial Sequence
  chemically synthesized
cttgtttctcattgttaccatt

SEQ ID NO: 1014883 - DNA, 22 bp, Artificial Sequence
  chemically synthesized
tacttgtttctcattgttacca

SEQ ID NO: 1014884 - DNA, 22 bp, Artificial Sequence
  chemically synthesized
atgtctctacttgtttctcatt

SEQ ID NO: 1014885 - DNA, 22 bp, Artificial Sequence
  chemically synthesized
gatgtctctacttgtttctcat

SEQ ID NO: 1014886 - DNA, 22 bp, Artificial Sequence
  chemically synthesized
tgatgtctctacttgtttctca

SEQ ID NO: 1014887 - DNA, 22 bp, Artificial Sequence
  chemically synthesized
ttgatgtctctacttgtttctc

SEQ ID NO: 1014888 - DNA, 22 bp, Artificial Sequence
  chemically synthesized
tttttgatgtctctacttgttt

SEQ ID NO: 1014889 - DNA, 22 bp, Artificial Sequence
  chemically synthesized
aatgctatttttgatgtctcta

SEQ ID NO: 1014890 - DNA, 22 bp, Artificial Sequence
  chemically synthesized
cctgaatgctatttttgatgtc

SEQ ID NO: 1014891 - DNA, 22 bp, Artificial Sequence
  chemically synthesized
ccctgaatgctatttttgatgt

SEQ ID NO: 1014892 - DNA, 22 bp, Artificial Sequence
  chemically synthesized
tttccctgaatgctatttttga

SEQ ID NO: 1014893 - DNA, 22 bp, Artificial Sequence
  chemically synthesized
gtttccctgaatgctatttttg

SEQ ID NO: 1014894 - DNA, 22 bp, Artificial Sequence
  chemically synthesized
tatttgtttccctgaatgctat

SEQ ID NO: 1014895 - DNA, 22 bp, Artificial Sequence
  chemically synthesized
cagaaggcaaaaattatatttg

SEQ ID NO: 1014896 - DNA, 22 bp, Artificial Sequence
  chemically synthesized
agggaaacaaatataatttttg

SEQ ID NO: 1014897 - DNA, 22 bp, Artificial Sequence
  chemically synthesized
gaaatattacagaaggcaaaaa

SEQ ID NO: 1014898 - DNA, 22 bp, Artificial Sequence
  chemically synthesized
ctagaaatattacagaaggcaa

SEQ ID NO: 1014899 - DNA, 22 bp, Artificial Sequence
  chemically synthesized
cctagaaatattacagaaggca

SEQ ID NO: 1014900 - DNA, 22 bp, Artificial Sequence
  chemically synthesized
tcctagaaatattacagaaggc

SEQ ID NO: 1014901 - DNA, 22 bp, Artificial Sequence
  chemically synthesized
ttcctagaaatattacagaagg

SEQ ID NO: 1014902 - DNA, 22 bp, Artificial Sequence
  chemically synthesized
tttcctagaaatattacagaag

SEQ ID NO: 1014903 - DNA, 22 bp, Artificial Sequence
  chemically synthesized
ttttcctagaaatattacagaa

SEQ ID NO: 1014904 - DNA, 22 bp, Artificial Sequence
  chemically synthesized
tttttcctagaaatattacaga

SEQ ID NO: 1014905 - DNA, 22 bp, Artificial Sequence
  chemically synthesized
ttgccttctgtaatatttctag

SEQ ID NO: 1014906 - DNA, 22 bp, Artificial Sequence
  chemically synthesized
tgccttctgtaatatttctagg

SEQ ID NO: 1014907 - DNA, 22 bp, Artificial Sequence
  chemically synthesized
gccttctgtaatatttctagga

SEQ ID NO: 1014908 - DNA, 22 bp, Artificial Sequence
  chemically synthesized
ccttctgtaatatttctaggaa

SEQ ID NO: 1014909 - DNA, 22 bp, Artificial Sequence
  chemically synthesized
ctgtaatatttctaggaaaaaa

SEQ ID NO: 1014910 - DNA, 22 bp, Artificial Sequence
  chemically synthesized
tgtaatatttctaggaaaaaaa

SEQ ID NO: 1014911 - DNA, 22 bp, Artificial Sequence
  chemically synthesized
taatatttctaggaaaaaaagt

SEQ ID NO: 1014912 - DNA, 22 bp, Artificial Sequence
  chemically synthesized
ccaagaaaaaaaactttttttc

SEQ ID NO: 1014913 - DNA, 22 bp, Artificial Sequence
  chemically synthesized
ctgccaagaaaaaaaacttttt

SEQ ID NO: 1014914 - DNA, 22 bp, Artificial Sequence
  chemically synthesized
actgccaagaaaaaaaactttt

SEQ ID NO: 1014915 - DNA, 22 bp, Artificial Sequence
  chemically synthesized
ttactgccaagaaaaaaaactt

SEQ ID NO: 1014916 - DNA, 22 bp, Artificial Sequence
  chemically synthesized
cttactgccaagaaaaaaaact

SEQ ID NO: 1014917 - DNA, 22 bp, Artificial Sequence
  chemically synthesized
ctaggaaaaaaagttttttttc

SEQ ID NO: 1014918 - DNA, 22 bp, Artificial Sequence
  chemically synthesized
taggaaaaaaagttttttttct

SEQ ID NO: 1014919 - DNA, 22 bp, Artificial Sequence
  chemically synthesized
ttcttactgccaagaaaaaaaa

SEQ ID NO: 1014920 - DNA, 22 bp, Artificial Sequence
  chemically synthesized
cttcttactgccaagaaaaaaa

SEQ ID NO: 1014921 - DNA, 22 bp, Artificial Sequence
  chemically synthesized
ggaaaaaaagttttttttcttg

SEQ ID NO: 1014922 - DNA, 22 bp, Artificial Sequence
  chemically synthesized
catccatatttcttcttactgc

SEQ ID NO: 1014923 - DNA, 22 bp, Artificial Sequence
  chemically synthesized
tttttcttggcagtaagaagaa

SEQ ID NO: 1014924 - DNA, 22 bp, Artificial Sequence
  chemically synthesized
ttttcttggcagtaagaagaaa

SEQ ID NO: 1014925 - DNA, 22 bp, Artificial Sequence
  chemically synthesized
tttcttggcagtaagaagaaat

SEQ ID NO: 1014926 - DNA, 22 bp, Artificial Sequence
  chemically synthesized
agttccatccatatttcttctt

SEQ ID NO: 1014927 - DNA, 22 bp, Artificial Sequence
  chemically synthesized
ttcttggcagtaagaagaaata

SEQ ID NO: 1014928 - DNA, 22 bp, Artificial Sequence
  chemically synthesized
tcttggcagtaagaagaaatat

SEQ ID NO: 1014929 - DNA, 22 bp, Artificial Sequence
  chemically synthesized
cttggcagtaagaagaaatatg

SEQ ID NO: 1014930 - DNA, 22 bp, Artificial Sequence
  chemically synthesized
ttaagttccatccatatttctt

SEQ ID NO: 1014931 - DNA, 22 bp, Artificial Sequence
  chemically synthesized
ttggcagtaagaagaaatatgg

SEQ ID NO: 1014932 - DNA, 22 bp, Artificial Sequence
  chemically synthesized
gttaagttccatccatatttct

SEQ ID NO: 1014933 - DNA, 22 bp, Artificial Sequence
  chemically synthesized
tgttaagttccatccatatttc

SEQ ID NO: 1014934 - DNA, 22 bp, Artificial Sequence
  chemically synthesized
ggcagtaagaagaaatatggat

SEQ ID NO: 1014935 - DNA, 22 bp, Artificial Sequence
  chemically synthesized
gcagtaagaagaaatatggatg

SEQ ID NO: 1014936 - DNA, 22 bp, Artificial Sequence
  chemically synthesized
ccctttgttaagttccatccat

SEQ ID NO: 1014937 - DNA, 22 bp, Artificial Sequence
  chemically synthesized
gccctttgttaagttccatcca

SEQ ID NO: 1014938 - DNA, 22 bp, Artificial Sequence
  chemically synthesized
tgccctttgttaagttccatcc

SEQ ID NO: 1014939 - DNA, 22 bp, Artificial Sequence
  chemically synthesized
ttgccctttgttaagttccatc

SEQ ID NO: 1014940 - DNA, 22 bp, Artificial Sequence
  chemically synthesized
tttgccctttgttaagttccat

SEQ ID NO: 1014941 - DNA, 22 bp, Artificial Sequence
  chemically synthesized
ttttgccctttgttaagttcca

SEQ ID NO: 1014942 - DNA, 22 bp, Artificial Sequence
  chemically synthesized
acatttttttgccctttgttaa

SEQ ID NO: 1014943 - DNA, 22 bp, Artificial Sequence
  chemically synthesized
tactgacatttttttgcccttt

SEQ ID NO: 1014944 - DNA, 22 bp, Artificial Sequence
  chemically synthesized
atactgacatttttttgccctt

SEQ ID NO: 1014945 - DNA, 22 bp, Artificial Sequence
  chemically synthesized
tgtttatactgacatttttttg

SEQ ID NO: 1014946 - DNA, 22 bp, Artificial Sequence
  chemically synthesized
atgtttatactgacattttttt

SEQ ID NO: 1014947 - DNA, 22 bp, Artificial Sequence
  chemically synthesized
aacaaagggcaaaaaaatgtca

SEQ ID NO: 1014948 - DNA, 22 bp, Artificial Sequence
  chemically synthesized
acaaagggcaaaaaaatgtcag

SEQ ID NO: 1014949 - DNA, 22 bp, Artificial Sequence
  chemically synthesized
tccttatgtttatactgacatt

SEQ ID NO: 1014950 - DNA, 22 bp, Artificial Sequence
  chemically synthesized
ttatccttatgtttatactgac

SEQ ID NO: 1014951 - DNA, 22 bp, Artificial Sequence
  chemically synthesized
attatccttatgtttatactga

SEQ ID NO: 1014952 - DNA, 22 bp, Artificial Sequence
  chemically synthesized
atttattatccttatgtttata

SEQ ID NO: 1014953 - DNA, 22 bp, Artificial Sequence
  chemically synthesized
gatttattatccttatgtttat

SEQ ID NO: 1014954 - DNA, 22 bp, Artificial Sequence
  chemically synthesized
aaatcacttgatttattatcct

SEQ ID NO: 1014955 - DNA, 22 bp, Artificial Sequence
  chemically synthesized
taaaatcacttgatttattatc

SEQ ID NO: 1014956 - DNA, 22 bp, Artificial Sequence
  chemically synthesized
caaaattctaaaatcacttgat

SEQ ID NO: 1014957 - DNA, 22 bp, Artificial Sequence
  chemically synthesized
gcaaaattctaaaatcacttga

SEQ ID NO: 1014958 - DNA, 22 bp, Artificial Sequence
  chemically synthesized
atatttgcaaaattctaaaatc

SEQ ID NO: 1014959 - DNA, 22 bp, Artificial Sequence
  chemically synthesized
aatatttgcaaaattctaaaat

SEQ ID NO: 1014960 - DNA, 22 bp, Artificial Sequence
  chemically synthesized
taatatttgcaaaattctaaaa

SEQ ID NO: 1014961 - DNA, 22 bp, Artificial Sequence
  chemically synthesized
tagaattttgcaaatattaaaa

SEQ ID NO: 1014962 - DNA, 22 bp, Artificial Sequence
  chemically synthesized
agaattttgcaaatattaaaat

SEQ ID NO: 1014963 - DNA, 22 bp, Artificial Sequence
  chemically synthesized
gaattttgcaaatattaaaatt

SEQ ID NO: 1014964 - DNA, 22 bp, Artificial Sequence
  chemically synthesized
cacggtgaatgagaattttaat

SEQ ID NO: 1014965 - DNA, 22 bp, Artificial Sequence
  chemically synthesized
tgcaaatattaaaattctcatt

SEQ ID NO: 1014966 - DNA, 22 bp, Artificial Sequence
  chemically synthesized
gcaaatattaaaattctcattc

SEQ ID NO: 1014967 - DNA, 22 bp, Artificial Sequence
  chemically synthesized
caaatattaaaattctcattca

SEQ ID NO: 1014968 - DNA, 22 bp, Artificial Sequence
  chemically synthesized
aataccggttgcacggtgaatg

SEQ ID NO: 1014969 - DNA, 22 bp, Artificial Sequence
  chemically synthesized
aaataccggttgcacggtgaat

SEQ ID NO: 1014970 - DNA, 22 bp, Artificial Sequence
  chemically synthesized
taaataccggttgcacggtgaa

SEQ ID NO: 1014971 - DNA, 22 bp, Artificial Sequence
  chemically synthesized
aaattctcattcaccgtgcaac

SEQ ID NO: 1014972 - DNA, 22 bp, Artificial Sequence
  chemically synthesized
tcattcaccgtgcaaccggtat

SEQ ID NO: 1014973 - DNA, 22 bp, Artificial Sequence
  chemically synthesized
attcaccgtgcaaccggtattt

SEQ ID NO: 1014974 - DNA, 22 bp, Artificial Sequence
  chemically synthesized
accgtgcaaccggtatttaaaa

SEQ ID NO: 1014975 - DNA, 22 bp, Artificial Sequence
  chemically synthesized
cacataaatgaagcagcagtgt

SEQ ID NO: 1014976 - DNA, 22 bp, Artificial Sequence
  chemically synthesized
tgctgcacataaatgaagcagc

SEQ ID NO: 1014977 - DNA, 22 bp, Artificial Sequence
  chemically synthesized
aaaattacactgctgcttcatt

SEQ ID NO: 1014978 - DNA, 22 bp, Artificial Sequence
  chemically synthesized
aaattacactgctgcttcattt

SEQ ID NO: 1014979 - DNA, 22 bp, Artificial Sequence
  chemically synthesized
cactgctgcttcatttatgtgc

SEQ ID NO: 1014980 - DNA, 22 bp, Artificial Sequence
  chemically synthesized
ctgcttcatttatgtgcagcat

SEQ ID NO: 1014981 - DNA, 22 bp, Artificial Sequence
  chemically synthesized
cttcatttatgtgcagcataac

SEQ ID NO: 1014982 - DNA, 22 bp, Artificial Sequence
  chemically synthesized
catttatgtgcagcataactta

SEQ ID NO: 1014983 - DNA, 22 bp, Artificial Sequence
  chemically synthesized
atttatgtgcagcataacttat

SEQ ID NO: 1014984 - DNA, 22 bp, Artificial Sequence
  chemically synthesized
gaacatcagaaaataagttatg

SEQ ID NO: 1014985 - DNA, 22 bp, Artificial Sequence
  chemically synthesized
agaacatcagaaaataagttat

SEQ ID NO: 1014986 - DNA, 22 bp, Artificial Sequence
  chemically synthesized
atgtgcagcataacttattttc

SEQ ID NO: 1014987 - DNA, 22 bp, Artificial Sequence
  chemically synthesized
tgtgcagcataacttattttct

SEQ ID NO: 1014988 - DNA, 22 bp, Artificial Sequence
  chemically synthesized
atttagaacatcagaaaataag

SEQ ID NO: 1014989 - DNA, 22 bp, Artificial Sequence
  chemically synthesized
gatttagaacatcagaaaataa

SEQ ID NO: 1014990 - DNA, 22 bp, Artificial Sequence
  chemically synthesized
acttgatttagaacatcagaaa

SEQ ID NO: 1014991 - DNA, 22 bp, Artificial Sequence
  chemically synthesized
actaacttgatttagaacatca

SEQ ID NO: 1014992 - DNA, 22 bp, Artificial Sequence
  chemically synthesized
attttctgatgttctaaatcaa

SEQ ID NO: 1014993 - DNA, 22 bp, Artificial Sequence
  chemically synthesized
ttttctgatgttctaaatcaag

SEQ ID NO: 1014994 - DNA, 22 bp, Artificial Sequence
  chemically synthesized
tctgatgttctaaatcaagtta

SEQ ID NO: 1014995 - DNA, 22 bp, Artificial Sequence
  chemically synthesized
ctgatgttctaaatcaagttag

SEQ ID NO: 1014996 - DNA, 22 bp, Artificial Sequence
  chemically synthesized
agaataatctgactaacttgat

SEQ ID NO: 1014997 - DNA, 22 bp, Artificial Sequence
  chemically synthesized
tgatgttctaaatcaagttagt

SEQ ID NO: 1014998 - DNA, 22 bp, Artificial Sequence
  chemically synthesized
gagaataatctgactaacttga

SEQ ID NO: 1014999 - DNA, 22 bp, Artificial Sequence
  chemically synthesized
atgttctaaatcaagttagtca

SEQ ID NO: 1015000 - DNA, 22 bp, Artificial Sequence
  chemically synthesized
tgcttgagaataatctgactaa

SEQ ID NO: 1015001 - DNA, 22 bp, Artificial Sequence
  chemically synthesized
atgcttgagaataatctgacta

SEQ ID NO: 1015002 - DNA, 22 bp, Artificial Sequence
  chemically synthesized
taaatcaagttagtcagattat

SEQ ID NO: 1015003 - DNA, 22 bp, Artificial Sequence
  chemically synthesized
aatcaagttagtcagattattc

SEQ ID NO: 1015004 - DNA, 22 bp, Artificial Sequence
  chemically synthesized
aatgtaatttatgcttgagaat

SEQ ID NO: 1015005 - DNA, 22 bp, Artificial Sequence
  chemically synthesized
gtcagattattctcaagcataa

SEQ ID NO: 1015006 - DNA, 22 bp, Artificial Sequence
  chemically synthesized
cctaaatgtaatttatgcttga

SEQ ID NO: 1015007 - DNA, 22 bp, Artificial Sequence
  chemically synthesized
ctccctaaatgtaatttatgct

SEQ ID NO: 1015008 - DNA, 22 bp, Artificial Sequence
  chemically synthesized
ttctcaagcataaattacattt

SEQ ID NO: 1015009 - DNA, 22 bp, Artificial Sequence
  chemically synthesized
tcaagcataaattacatttagg

SEQ ID NO: 1015010 - DNA, 22 bp, Artificial Sequence
  chemically synthesized
aagcataaattacatttaggga

SEQ ID NO: 1015011 - DNA, 22 bp, Artificial Sequence
  chemically synthesized
catttagggagtaattcggtac

SEQ ID NO: 1015012 - DNA, 22 bp, Artificial Sequence
  chemically synthesized
aagtatgccccagagtaccgaa

SEQ ID NO: 1015013 - DNA, 22 bp, Artificial Sequence
  chemically synthesized
agggagtaattcggtactctgg

SEQ ID NO: 1015014 - DNA, 22 bp, Artificial Sequence
  chemically synthesized
gggagtaattcggtactctggg

SEQ ID NO: 1015015 - DNA, 22 bp, Artificial Sequence
  chemically synthesized
ggtactctggggcatactttaa

SEQ ID NO: 1015016 - DNA, 22 bp, Artificial Sequence
  chemically synthesized
atggcccgaaagtgttaaagta

SEQ ID NO: 1015017 - DNA, 22 bp, Artificial Sequence
  chemically synthesized
aatggcccgaaagtgttaaagt

SEQ ID NO: 1015018 - DNA, 22 bp, Artificial Sequence
  chemically synthesized
tggggcatactttaacactttc

SEQ ID NO: 1015019 - DNA, 22 bp, Artificial Sequence
  chemically synthesized
gggcatactttaacactttcgg

SEQ ID NO: 1015020 - DNA, 22 bp, Artificial Sequence
  chemically synthesized
ccaccttaatggcccgaaagtg

SEQ ID NO: 1015021 - DNA, 22 bp, Artificial Sequence
  chemically synthesized
ctaccaccttaatggcccgaaa

SEQ ID NO: 1015022 - DNA, 22 bp, Artificial Sequence
  chemically synthesized
actaccaccttaatggcccgaa

SEQ ID NO: 1015023 - DNA, 22 bp, Artificial Sequence
  chemically synthesized
taacactttcgggccattaagg

SEQ ID NO: 1015024 - DNA, 22 bp, Artificial Sequence
  chemically synthesized
aacactttcgggccattaaggt

SEQ ID NO: 1015025 - DNA, 22 bp, Artificial Sequence
  chemically synthesized
acactttcgggccattaaggtg

SEQ ID NO: 1015026 - DNA, 22 bp, Artificial Sequence
  chemically synthesized
atggaatttactaccaccttaa

SEQ ID NO: 1015027 - DNA, 22 bp, Artificial Sequence
  chemically synthesized
catggaatttactaccacctta

SEQ ID NO: 1015028 - DNA, 22 bp, Artificial Sequence
  chemically synthesized
tcgggccattaaggtggtagta

SEQ ID NO: 1015029 - DNA, 22 bp, Artificial Sequence
  chemically synthesized
tttcatggaatttactaccacc

SEQ ID NO: 1015030 - DNA, 22 bp, Artificial Sequence
  chemically synthesized
cgggccattaaggtggtagtaa

SEQ ID NO: 1015031 - DNA, 22 bp, Artificial Sequence
  chemically synthesized
gggccattaaggtggtagtaaa

SEQ ID NO: 1015032 - DNA, 22 bp, Artificial Sequence
  chemically synthesized
aatctatttcatggaatttact

SEQ ID NO: 1015033 - DNA, 22 bp, Artificial Sequence
  chemically synthesized
aaatctatttcatggaatttac

SEQ ID NO: 1015034 - DNA, 22 bp, Artificial Sequence
  chemically synthesized
tttaaatctatttcatggaatt

SEQ ID NO: 1015035 - DNA, 22 bp, Artificial Sequence
  chemically synthesized
aggtggtagtaaattccatgaa

SEQ ID NO: 1015036 - DNA, 22 bp, Artificial Sequence
  chemically synthesized
atttaaatctatttcatggaat

SEQ ID NO: 1015037 - DNA, 22 bp, Artificial Sequence
  chemically synthesized
tttatttaaatctatttcatgg

SEQ ID NO: 1015038 - DNA, 22 bp, Artificial Sequence
  chemically synthesized
gggtgttatttatttaaatcta

SEQ ID NO: 1015039 - DNA, 22 bp, Artificial Sequence
  chemically synthesized
ctagggtgttatttatttaaat

SEQ ID NO: 1015040 - DNA, 22 bp, Artificial Sequence
  chemically synthesized
catgaaatagatttaaataaat

SEQ ID NO: 1015041 - DNA, 22 bp, Artificial Sequence
  chemically synthesized
aaataaataacaccctagtaga

SEQ ID NO: 1015042 - DNA, 22 bp, Artificial Sequence
  chemically synthesized
aataaataacaccctagtagac

SEQ ID NO: 1015043 - DNA, 22 bp, Artificial Sequence
  chemically synthesized
gtagacttctgacatatccatt

SEQ ID NO: 1015044 - DNA, 22 bp, Artificial Sequence
  chemically synthesized
ctgacatatccattgttgcttt

SEQ ID NO: 1015045 - DNA, 22 bp, Artificial Sequence
  chemically synthesized
tgacatatccattgttgcttta

SEQ ID NO: 1015046 - DNA, 22 bp, Artificial Sequence
  chemically synthesized
cagaccgaagtataaagcaaca

SEQ ID NO: 1015047 - DNA, 22 bp, Artificial Sequence
  chemically synthesized
ccagaccgaagtataaagcaac

SEQ ID NO: 1015048 - DNA, 22 bp, Artificial Sequence
  chemically synthesized
acatatccattgttgctttata

SEQ ID NO: 1015049 - DNA, 22 bp, Artificial Sequence
  chemically synthesized
agtttccagaccgaagtataaa

SEQ ID NO: 1015050 - DNA, 22 bp, Artificial Sequence
  chemically synthesized
ttgctttatacttcggtctgga

SEQ ID NO: 1015051 - DNA, 22 bp, Artificial Sequence
  chemically synthesized
ctttatacttcggtctggaaac

SEQ ID NO: 1015052 - DNA, 22 bp, Artificial Sequence
  chemically synthesized
tatacttcggtctggaaactca

SEQ ID NO: 1015053 - DNA, 22 bp, Artificial Sequence
  chemically synthesized
atacttcggtctggaaactcag

SEQ ID NO: 1015054 - DNA, 22 bp, Artificial Sequence
  chemically synthesized
tacttcggtctggaaactcagc

SEQ ID NO: 1015055 - DNA, 22 bp, Artificial Sequence
  chemically synthesized
cggtctggaaactcagcattgg

SEQ ID NO: 1015056 - DNA, 22 bp, Artificial Sequence
  chemically synthesized
ggtctggaaactcagcattgga

SEQ ID NO: 1015057 - DNA, 22 bp, Artificial Sequence
  chemically synthesized
gaaactcagcattggactgctg

SEQ ID NO: 1015058 - DNA, 22 bp, Artificial Sequence
  chemically synthesized
agcattggactgctgattattt

SEQ ID NO: 1015059 - DNA, 22 bp, Artificial Sequence
  chemically synthesized
gactgctgattatttcatccca

SEQ ID NO: 1015060 - DNA, 22 bp, Artificial Sequence
  chemically synthesized
ctgattatttcatcccatccca

SEQ ID NO: 1015061 - DNA, 22 bp, Artificial Sequence
  chemically synthesized
attatttcatcccatcccacat

SEQ ID NO: 1015062 - DNA, 22 bp, Artificial Sequence
  chemically synthesized
atcaaagatgaaatatgtggga

SEQ ID NO: 1015063 - DNA, 22 bp, Artificial Sequence
  chemically synthesized
tttcatcccatcccacatattt

SEQ ID NO: 1015064 - DNA, 22 bp, Artificial Sequence
  chemically synthesized
catcccatcccacatatttcat

SEQ ID NO: 1015065 - DNA, 22 bp, Artificial Sequence
  chemically synthesized
acctaatcaaagatgaaatatg

SEQ ID NO: 1015066 - DNA, 22 bp, Artificial Sequence
  chemically synthesized
atcccatcccacatatttcatc

SEQ ID NO: 1015067 - DNA, 22 bp, Artificial Sequence
  chemically synthesized
ctcacctaatcaaagatgaaat

SEQ ID NO: 1015068 - DNA, 22 bp, Artificial Sequence
  chemically synthesized
ctcctcacctaatcaaagatga

SEQ ID NO: 1015069 - DNA, 22 bp, Artificial Sequence
  chemically synthesized
aggtccctcctcctcacctaat

SEQ ID NO: 1015070 - DNA, 22 bp, Artificial Sequence
  chemically synthesized
catctttgattaggtgaggagg

SEQ ID NO: 1015071 - DNA, 22 bp, Artificial Sequence
  chemically synthesized
atctttgattaggtgaggagga

SEQ ID NO: 1015072 - DNA, 22 bp, Artificial Sequence
  chemically synthesized
tgattaggtgaggaggagggac

SEQ ID NO: 1015073 - DNA, 22 bp, Artificial Sequence
  chemically synthesized
gattaggtgaggaggagggacc

SEQ ID NO: 1015074 - DNA, 22 bp, Artificial Sequence
  chemically synthesized
attaggtgaggaggagggacct

SEQ ID NO: 1015075 - DNA, 22 bp, Artificial Sequence
  chemically synthesized
ggtgaggaggagggacctgagc

SEQ ID NO: 1015076 - DNA, 22 bp, Artificial Sequence
  chemically synthesized
gaccatgagacacgagctcagg

SEQ ID NO: 1015077 - DNA, 22 bp, Artificial Sequence
  chemically synthesized
ggaccatgagacacgagctcag

SEQ ID NO: 1015078 - DNA, 22 bp, Artificial Sequence
  chemically synthesized
gcacatacagtttggaccatga

SEQ ID NO: 1015079 - DNA, 22 bp, Artificial Sequence
  chemically synthesized
agctcgtgtctcatggtccaaa

SEQ ID NO: 1015080 - DNA, 22 bp, Artificial Sequence
  chemically synthesized
ttcgcacatacagtttggacca

SEQ ID NO: 1015081 - DNA, 22 bp, Artificial Sequence
  chemically synthesized
attcgcacatacagtttggacc

SEQ ID NO: 1015082 - DNA, 22 bp, Artificial Sequence
  chemically synthesized
gtgtctcatggtccaaactgta

SEQ ID NO: 1015083 - DNA, 22 bp, Artificial Sequence
  chemically synthesized
tttattcgcacatacagtttgg

SEQ ID NO: 1015084 - DNA, 22 bp, Artificial Sequence
  chemically synthesized
atttattcgcacatacagtttg

SEQ ID NO: 1015085 - DNA, 22 bp, Artificial Sequence
  chemically synthesized
acttatttattcgcacatacag

SEQ ID NO: 1015086 - DNA, 22 bp, Artificial Sequence
  chemically synthesized
atggtccaaactgtatgtgcga

SEQ ID NO: 1015087 - DNA, 22 bp, Artificial Sequence
  chemically synthesized
gggcagataactaacttattta

SEQ ID NO: 1015088 - DNA, 22 bp, Artificial Sequence
  chemically synthesized
ggggcagataactaacttattt

SEQ ID NO: 1015089 - DNA, 22 bp, Artificial Sequence
  chemically synthesized
tatgtgcgaataaataagttag

SEQ ID NO: 1015090 - DNA, 22 bp, Artificial Sequence
  chemically synthesized
tgatttggggcagataactaac

SEQ ID NO: 1015091 - DNA, 22 bp, Artificial Sequence
  chemically synthesized
gttatctgccccaaatcatagt

SEQ ID NO: 1015092 - DNA, 22 bp, Artificial Sequence
  chemically synthesized
tctgccccaaatcatagtacct

SEQ ID NO: 1015093 - DNA, 22 bp, Artificial Sequence
  chemically synthesized
gggagaagtagcaaggtactat

SEQ ID NO: 1015094 - DNA, 22 bp, Artificial Sequence
  chemically synthesized
ccccaaatcatagtaccttgct

SEQ ID NO: 1015095 - DNA, 22 bp, Artificial Sequence
  chemically synthesized
agggttggggagaagtagcaag

SEQ ID NO: 1015096 - DNA, 22 bp, Artificial Sequence
  chemically synthesized
ggaagttgagggttggggagaa

SEQ ID NO: 1015097 - DNA, 22 bp, Artificial Sequence
  chemically synthesized
gggaagttgagggttggggaga

SEQ ID NO: 1015098 - DNA, 22 bp, Artificial Sequence
  chemically synthesized
cttgggaagttgagggttgggg

SEQ ID NO: 1015099 - DNA, 22 bp, Artificial Sequence
  chemically synthesized
gctacttctccccaaccctcaa

SEQ ID NO: 1015100 - DNA, 22 bp, Artificial Sequence
  chemically synthesized
ctacttctccccaaccctcaac

SEQ ID NO: 1015101 - DNA, 22 bp, Artificial Sequence
  chemically synthesized
tattacttgggaagttgagggt

SEQ ID NO: 1015102 - DNA, 22 bp, Artificial Sequence
  chemically synthesized
gtattacttgggaagttgaggg

SEQ ID NO: 1015103 - DNA, 22 bp, Artificial Sequence
  chemically synthesized
cttctccccaaccctcaacttc

SEQ ID NO: 1015104 - DNA, 22 bp, Artificial Sequence
  chemically synthesized
ctccccaaccctcaacttccca

SEQ ID NO: 1015105 - DNA, 22 bp, Artificial Sequence
  chemically synthesized
tccccaaccctcaacttcccaa

SEQ ID NO: 1015106 - DNA, 22 bp, Artificial Sequence
  chemically synthesized
cccaaccctcaacttcccaagt

SEQ ID NO: 1015107 - DNA, 22 bp, Artificial Sequence
  chemically synthesized
aatatttgtattacttgggaag

SEQ ID NO: 1015108 - DNA, 22 bp, Artificial Sequence
  chemically synthesized
ctaaatatttgtattacttggg

SEQ ID NO: 1015109 - DNA, 22 bp, Artificial Sequence
  chemically synthesized
actaaatatttgtattacttgg

SEQ ID NO: 1015110 - DNA, 22 bp, Artificial Sequence
  chemically synthesized
tactaaatatttgtattacttg

SEQ ID NO: 1015111 - DNA, 22 bp, Artificial Sequence
  chemically synthesized
ttactaaatatttgtattactt

SEQ ID NO: 1015112 - DNA, 22 bp, Artificial Sequence
  chemically synthesized
aacttcccaagtaatacaaata

SEQ ID NO: 1015113 - DNA, 22 bp, Artificial Sequence
  chemically synthesized
tcttttactaaatatttgtatt

SEQ ID NO: 1015114 - DNA, 22 bp, Artificial Sequence
  chemically synthesized
atcttttactaaatatttgtat

SEQ ID NO: 1015115 - DNA, 22 bp, Artificial Sequence
  chemically synthesized
cccaagtaatacaaatatttag

SEQ ID NO: 1015116 - DNA, 22 bp, Artificial Sequence
  chemically synthesized
ccaagtaatacaaatatttagt

SEQ ID NO: 1015117 - DNA, 22 bp, Artificial Sequence
  chemically synthesized
gtagtatacttatcttttacta

SEQ ID NO: 1015118 - DNA, 22 bp, Artificial Sequence
  chemically synthesized
ataattggtagtatacttatct

SEQ ID NO: 1015119 - DNA, 22 bp, Artificial Sequence
  chemically synthesized
cataattggtagtatacttatc

SEQ ID NO: 1015120 - DNA, 22 bp, Artificial Sequence
  chemically synthesized
agtaaaagataagtatactacc

SEQ ID NO: 1015121 - DNA, 22 bp, Artificial Sequence
  chemically synthesized
gtaaaagataagtatactacca

SEQ ID NO: 1015122 - DNA, 22 bp, Artificial Sequence
  chemically synthesized
ggaggtaagtacttcataattg

SEQ ID NO: 1015123 - DNA, 22 bp, Artificial Sequence
  chemically synthesized
aggaggtaagtacttcataatt

SEQ ID NO: 1015124 - DNA, 22 bp, Artificial Sequence
  chemically synthesized
accttaggaggtaagtacttca

SEQ ID NO: 1015125 - DNA, 22 bp, Artificial Sequence
  chemically synthesized
ccaattatgaagtacttacctc

SEQ ID NO: 1015126 - DNA, 22 bp, Artificial Sequence
  chemically synthesized
ccacaattaaccttaggaggta

SEQ ID NO: 1015127 - DNA, 22 bp, Artificial Sequence
  chemically synthesized
tgaagtacttacctcctaaggt

SEQ ID NO: 1015128 - DNA, 22 bp, Artificial Sequence
  chemically synthesized
agctcccacaattaaccttagg

SEQ ID NO: 1015129 - DNA, 22 bp, Artificial Sequence
  chemically synthesized
ttgagctcccacaattaacctt

SEQ ID NO: 1015130 - DNA, 22 bp, Artificial Sequence
  chemically synthesized
attgagctcccacaattaacct

SEQ ID NO: 1015131 - DNA, 22 bp, Artificial Sequence
  chemically synthesized
acctcctaaggttaattgtggg

SEQ ID NO: 1015132 - DNA, 22 bp, Artificial Sequence
  chemically synthesized
atttattgagctcccacaatta

SEQ ID NO: 1015133 - DNA, 22 bp, Artificial Sequence
  chemically synthesized
cctcctaaggttaattgtggga

SEQ ID NO: 1015134 - DNA, 22 bp, Artificial Sequence
  chemically synthesized
ctaaggttaattgtgggagctc

SEQ ID NO: 1015135 - DNA, 22 bp, Artificial Sequence
  chemically synthesized
aggttaattgtgggagctcaat

SEQ ID NO: 1015136 - DNA, 22 bp, Artificial Sequence
  chemically synthesized
tatatactcatttattgagctc

SEQ ID NO: 1015137 - DNA, 22 bp, Artificial Sequence
  chemically synthesized
atatatactcatttattgagct

SEQ ID NO: 1015138 - DNA, 22 bp, Artificial Sequence
  chemically synthesized
attgtgggagctcaataaatga

SEQ ID NO: 1015139 - DNA, 22 bp, Artificial Sequence
  chemically synthesized
tgggagctcaataaatgagtat

SEQ ID NO: 1015140 - DNA, 22 bp, Artificial Sequence
  chemically synthesized
aataaatgagtatatataaatt

SEQ ID NO: 1015141 - DNA, 22 bp, Artificial Sequence
  chemically synthesized
ataaaataaaagatgtaaaaaa

SEQ ID NO: 1015142 - DNA, 22 bp, Artificial Sequence
  chemically synthesized
aaaacattaataaaataaaaga

SEQ ID NO: 1015143 - DNA, 22 bp, Artificial Sequence
  chemically synthesized
ctttttttacatcttttatttt

SEQ ID NO: 1015144 - DNA, 22 bp, Artificial Sequence
  chemically synthesized
aaaaacattaataaaataaaag

SEQ ID NO: 1015145 - DNA, 22 bp, Artificial Sequence
  chemically synthesized
tttttttacatcttttatttta

SEQ ID NO: 1015146 - DNA, 22 bp, Artificial Sequence
  chemically synthesized
taaaaacattaataaaataaaa

SEQ ID NO: 1015147 - DNA, 22 bp, Artificial Sequence
  chemically synthesized
ttaaaaacattaataaaataaa

SEQ ID NO: 1015148 - DNA, 22 bp, Artificial Sequence
  chemically synthesized
tttttacatcttttattttatt

SEQ ID NO: 1015149 - DNA, 22 bp, Artificial Sequence
  chemically synthesized
tttaaaaacattaataaaataa

SEQ ID NO: 1015150 - DNA, 22 bp, Artificial Sequence
  chemically synthesized
ttttacatcttttattttatta

SEQ ID NO: 1015151 - DNA, 22 bp, Artificial Sequence
  chemically synthesized
tttacatcttttattttattaa

SEQ ID NO: 1015152 - DNA, 22 bp, Artificial Sequence
  chemically synthesized
ttacatcttttattttattaat

SEQ ID NO: 1015153 - DNA, 22 bp, Artificial Sequence
  chemically synthesized
tacatcttttattttattaatg

SEQ ID NO: 1015154 - DNA, 22 bp, Artificial Sequence
  chemically synthesized
acatcttttattttattaatgt

SEQ ID NO: 1015155 - DNA, 22 bp, Artificial Sequence
  chemically synthesized
aattttttaaaaacattaataa

SEQ ID NO: 1015156 - DNA, 22 bp, Artificial Sequence
  chemically synthesized
catcttttattttattaatgtt

SEQ ID NO: 1015157 - DNA, 22 bp, Artificial Sequence
  chemically synthesized
gaattttttaaaaacattaata

SEQ ID NO: 1015158 - DNA, 22 bp, Artificial Sequence
  chemically synthesized
aatttgaattttttaaaaacat

SEQ ID NO: 1015159 - DNA, 22 bp, Artificial Sequence
  chemically synthesized
ttattttattaatgtttttaaa

SEQ ID NO: 1015160 - DNA, 22 bp, Artificial Sequence
  chemically synthesized
tattttattaatgtttttaaaa

SEQ ID NO: 1015161 - DNA, 22 bp, Artificial Sequence
  chemically synthesized
attttattaatgtttttaaaaa

SEQ ID NO: 1015162 - DNA, 22 bp, Artificial Sequence
  chemically synthesized
ttgaatttgaattttttaaaaa

SEQ ID NO: 1015163 - DNA, 22 bp, Artificial Sequence
  chemically synthesized
ttttattaatgtttttaaaaaa

SEQ ID NO: 1015164 - DNA, 22 bp, Artificial Sequence
  chemically synthesized
tattaatgtttttaaaaaattc

SEQ ID NO: 1015165 - DNA, 22 bp, Artificial Sequence
  chemically synthesized
attaatgtttttaaaaaattca

SEQ ID NO: 1015166 - DNA, 22 bp, Artificial Sequence
  chemically synthesized
ttaatgtttttaaaaaattcaa

SEQ ID NO: 1015167 - DNA, 22 bp, Artificial Sequence
  chemically synthesized
atgtttttaaaaaattcaaatt

SEQ ID NO: 1015168 - DNA, 22 bp, Artificial Sequence
  chemically synthesized
caaagactattgaatttgaatt

SEQ ID NO: 1015169 - DNA, 22 bp, Artificial Sequence
  chemically synthesized
tattccaaagactattgaattt

SEQ ID NO: 1015170 - DNA, 22 bp, Artificial Sequence
  chemically synthesized
ttaaaaaattcaaattcaatag

SEQ ID NO: 1015171 - DNA, 22 bp, Artificial Sequence
  chemically synthesized
gtattccaaagactattgaatt

SEQ ID NO: 1015172 - DNA, 22 bp, Artificial Sequence
  chemically synthesized
taaaaaattcaaattcaatagt

SEQ ID NO: 1015173 - DNA, 22 bp, Artificial Sequence
  chemically synthesized
aaaaaattcaaattcaatagtc

SEQ ID NO: 1015174 - DNA, 22 bp, Artificial Sequence
  chemically synthesized
aaaaattcaaattcaatagtct

SEQ ID NO: 1015175 - DNA, 22 bp, Artificial Sequence
  chemically synthesized
aaattcaatagtctttggaata

SEQ ID NO: 1015176 - DNA, 22 bp, Artificial Sequence
  chemically synthesized
aatagtctttggaatacaagtg

SEQ ID NO: 1015177 - DNA, 22 bp, Artificial Sequence
  chemically synthesized
atgtaaccaaaaatcacttgta

SEQ ID NO: 1015178 - DNA, 22 bp, Artificial Sequence
  chemically synthesized
attcatgtaaccaaaaatcact

SEQ ID NO: 1015179 - DNA, 22 bp, Artificial Sequence
  chemically synthesized
tggaatacaagtgatttttggt

SEQ ID NO: 1015180 - DNA, 22 bp, Artificial Sequence
  chemically synthesized
ggaatacaagtgatttttggtt

SEQ ID NO: 1015181 - DNA, 22 bp, Artificial Sequence
  chemically synthesized
gaatacaagtgatttttggtta

SEQ ID NO: 1015182 - DNA, 22 bp, Artificial Sequence
  chemically synthesized
tacaattcattcatgtaaccaa

SEQ ID NO: 1015183 - DNA, 22 bp, Artificial Sequence
  chemically synthesized
tatacaattcattcatgtaacc

SEQ ID NO: 1015184 - DNA, 22 bp, Artificial Sequence
  chemically synthesized
ctatacaattcattcatgtaac

SEQ ID NO: 1015185 - DNA, 22 bp, Artificial Sequence
  chemically synthesized
cttctatacaattcattcatgt

SEQ ID NO: 1015186 - DNA, 22 bp, Artificial Sequence
  chemically synthesized
acttctatacaattcattcatg

SEQ ID NO: 1015187 - DNA, 22 bp, Artificial Sequence
  chemically synthesized
tacttctatacaattcattcat

SEQ ID NO: 1015188 - DNA, 22 bp, Artificial Sequence
  chemically synthesized
ttggttacatgaatgaattgta

SEQ ID NO: 1015189 - DNA, 22 bp, Artificial Sequence
  chemically synthesized
attttacttctatacaattcat

SEQ ID NO: 1015190 - DNA, 22 bp, Artificial Sequence
  chemically synthesized
tggttacatgaatgaattgtat

SEQ ID NO: 1015191 - DNA, 22 bp, Artificial Sequence
  chemically synthesized
ggttacatgaatgaattgtata

SEQ ID NO: 1015192 - DNA, 22 bp, Artificial Sequence
  chemically synthesized
gttacatgaatgaattgtatag

SEQ ID NO: 1015193 - DNA, 22 bp, Artificial Sequence
  chemically synthesized
catgaatgaattgtatagaagt

SEQ ID NO: 1015194 - DNA, 22 bp, Artificial Sequence
  chemically synthesized
aaatatctgattttacttctat

SEQ ID NO: 1015195 - DNA, 22 bp, Artificial Sequence
  chemically synthesized
tatagaagtaaaatcagatatt

SEQ ID NO: 1015196 - DNA, 22 bp, Artificial Sequence
  chemically synthesized
ggtgacacgtgcactaaaatat

SEQ ID NO: 1015197 - DNA, 22 bp, Artificial Sequence
  chemically synthesized
gggtgacacgtgcactaaaata

SEQ ID NO: 1015198 - DNA, 22 bp, Artificial Sequence
  chemically synthesized
cttgggtgacacgtgcactaaa

SEQ ID NO: 1015199 - DNA, 22 bp, Artificial Sequence
  chemically synthesized
tagtgcacgtgtcacccaagta

SEQ ID NO: 1015200 - DNA, 22 bp, Artificial Sequence
  chemically synthesized
agtgcacgtgtcacccaagtag

SEQ ID NO: 1015201 - DNA, 22 bp, Artificial Sequence
  chemically synthesized
gtgcacgtgtcacccaagtagt

SEQ ID NO: 1015202 - DNA, 22 bp, Artificial Sequence
  chemically synthesized
gggtgtaatgtacactacttgg

SEQ ID NO: 1015203 - DNA, 22 bp, Artificial Sequence
  chemically synthesized
ggggtgtaatgtacactacttg

SEQ ID NO: 1015204 - DNA, 22 bp, Artificial Sequence
  chemically synthesized
tggggtgtaatgtacactactt

SEQ ID NO: 1015205 - DNA, 22 bp, Artificial Sequence
  chemically synthesized
cctttggggtgtaatgtacact

SEQ ID NO: 1015206 - DNA, 22 bp, Artificial Sequence
  chemically synthesized
caccccaaaggtaattttttat

SEQ ID NO: 1015207 - DNA, 22 bp, Artificial Sequence
  chemically synthesized
tttatccctcactaccttccca

SEQ ID NO: 1015208 - DNA, 22 bp, Artificial Sequence
  chemically synthesized
ttatccctcactaccttcccac

SEQ ID NO: 1015209 - DNA, 22 bp, Artificial Sequence
  chemically synthesized
agaaggggcagagtgggaaggt

SEQ ID NO: 1015210 - DNA, 22 bp, Artificial Sequence
  chemically synthesized
tatccctcactaccttcccact

SEQ ID NO: 1015211 - DNA, 22 bp, Artificial Sequence
  chemically synthesized
atccctcactaccttcccactc

SEQ ID NO: 1015212 - DNA, 22 bp, Artificial Sequence
  chemically synthesized
tccctcactaccttcccactct

SEQ ID NO: 1015213 - DNA, 22 bp, Artificial Sequence
  chemically synthesized
aagactcagaaggggcagagtg

SEQ ID NO: 1015214 - DNA, 22 bp, Artificial Sequence
  chemically synthesized
gaagactcagaaggggcagagt

SEQ ID NO: 1015215 - DNA, 22 bp, Artificial Sequence
  chemically synthesized
actaccttcccactctgcccct

SEQ ID NO: 1015216 - DNA, 22 bp, Artificial Sequence
  chemically synthesized
tgaagactcagaaggggcagag

SEQ ID NO: 1015217 - DNA, 22 bp, Artificial Sequence
  chemically synthesized
ccttcccactctgccccttctg

SEQ ID NO: 1015218 - DNA, 22 bp, Artificial Sequence
  chemically synthesized
cccactctgccccttctgagtc

SEQ ID NO: 1015219 - DNA, 22 bp, Artificial Sequence
  chemically synthesized
ccactctgccccttctgagtct

SEQ ID NO: 1015220 - DNA, 22 bp, Artificial Sequence
  chemically synthesized
tgccccttctgagtcttcaaag

SEQ ID NO: 1015221 - DNA, 22 bp, Artificial Sequence
  chemically synthesized
ccccttctgagtcttcaaagtc

SEQ ID NO: 1015222 - DNA, 22 bp, Artificial Sequence
  chemically synthesized
ctgagtcttcaaagtccattct

SEQ ID NO: 1015223 - DNA, 22 bp, Artificial Sequence
  chemically synthesized
tgagtcttcaaagtccattcta

SEQ ID NO: 1015224 - DNA, 22 bp, Artificial Sequence
  chemically synthesized
agtcttcaaagtccattctacc

SEQ ID NO: 1015225 - DNA, 22 bp, Artificial Sequence
  chemically synthesized
caaagtccattctaccactctg

SEQ ID NO: 1015226 - DNA, 22 bp, Artificial Sequence
  chemically synthesized
aaagtccattctaccactctgt

SEQ ID NO: 1015227 - DNA, 22 bp, Artificial Sequence
  chemically synthesized
taggtacacaaaggcagacaga

SEQ ID NO: 1015228 - DNA, 22 bp, Artificial Sequence
  chemically synthesized
cgctgtaggtacacaaaggcag

SEQ ID NO: 1015229 - DNA, 22 bp, Artificial Sequence
  chemically synthesized
taccactctgtctgcctttgtg

SEQ ID NO: 1015230 - DNA, 22 bp, Artificial Sequence
  chemically synthesized
ccactctgtctgcctttgtgta

SEQ ID NO: 1015231 - DNA, 22 bp, Artificial Sequence
  chemically synthesized
tgtctgcctttgtgtacctaca

SEQ ID NO: 1015232 - DNA, 22 bp, Artificial Sequence
  chemically synthesized
tctgcctttgtgtacctacagc

SEQ ID NO: 1015233 - DNA, 22 bp, Artificial Sequence
  chemically synthesized
taagtgggagctacgctgtagg

SEQ ID NO: 1015234 - DNA, 22 bp, Artificial Sequence
  chemically synthesized
ataagtgggagctacgctgtag

SEQ ID NO: 1015235 - DNA, 22 bp, Artificial Sequence
  chemically synthesized
cctttgtgtacctacagcgtag

SEQ ID NO: 1015236 - DNA, 22 bp, Artificial Sequence
  chemically synthesized
acttataagtgggagctacgct

SEQ ID NO: 1015237 - DNA, 22 bp, Artificial Sequence
  chemically synthesized
tgtgtacctacagcgtagctcc

SEQ ID NO: 1015238 - DNA, 22 bp, Artificial Sequence
  chemically synthesized
gtgtacctacagcgtagctccc

SEQ ID NO: 1015239 - DNA, 22 bp, Artificial Sequence
  chemically synthesized
tcacttataagtgggagctacg

SEQ ID NO: 1015240 - DNA, 22 bp, Artificial Sequence
  chemically synthesized
tgtacctacagcgtagctccca

SEQ ID NO: 1015241 - DNA, 22 bp, Artificial Sequence
  chemically synthesized
tatgttctcacttataagtggg

SEQ ID NO: 1015242 - DNA, 22 bp, Artificial Sequence
  chemically synthesized
cagcgtagctcccacttataag

SEQ ID NO: 1015243 - DNA, 22 bp, Artificial Sequence
  chemically synthesized
ccacttataagtgagaacatac

SEQ ID NO: 1015244 - DNA, 22 bp, Artificial Sequence
  chemically synthesized
ataagtgagaacatacagtatt

SEQ ID NO: 1015245 - DNA, 22 bp, Artificial Sequence
  chemically synthesized
taagtgagaacatacagtattt

SEQ ID NO: 1015246 - DNA, 22 bp, Artificial Sequence
  chemically synthesized
aggaatggaaaaccaaatactg

SEQ ID NO: 1015247 - DNA, 22 bp, Artificial Sequence
  chemically synthesized
agtgaagtaattcaggaatgga

SEQ ID NO: 1015248 - DNA, 22 bp, Artificial Sequence
  chemically synthesized
taagtgaagtaattcaggaatg

SEQ ID NO: 1015249 - DNA, 22 bp, Artificial Sequence
  chemically synthesized
ttctaagtgaagtaattcagga

SEQ ID NO: 1015250 - DNA, 22 bp, Artificial Sequence
  chemically synthesized
ggttttccattcctgaattact

SEQ ID NO: 1015251 - DNA, 22 bp, Artificial Sequence
  chemically synthesized
gttttccattcctgaattactt

SEQ ID NO: 1015252 - DNA, 22 bp, Artificial Sequence
  chemically synthesized
tccattcctgaattacttcact

SEQ ID NO: 1015253 - DNA, 22 bp, Artificial Sequence
  chemically synthesized
ccattcctgaattacttcactt

SEQ ID NO: 1015254 - DNA, 22 bp, Artificial Sequence
  chemically synthesized
cattcctgaattacttcactta

SEQ ID NO: 1015255 - DNA, 22 bp, Artificial Sequence
  chemically synthesized
gatgccattattctaagtgaag

SEQ ID NO: 1015256 - DNA, 22 bp, Artificial Sequence
  chemically synthesized
ctgaattacttcacttagaata

SEQ ID NO: 1015257 - DNA, 22 bp, Artificial Sequence
  chemically synthesized
aattacttcacttagaataatg

SEQ ID NO: 1015258 - DNA, 22 bp, Artificial Sequence
  chemically synthesized
atggagctggatgccattattc

SEQ ID NO: 1015259 - DNA, 22 bp, Artificial Sequence
  chemically synthesized
gatggagctggatgccattatt

SEQ ID NO: 1015260 - DNA, 22 bp, Artificial Sequence
  chemically synthesized
tgatggagctggatgccattat

SEQ ID NO: 1015261 - DNA, 22 bp, Artificial Sequence
  chemically synthesized
cttcacttagaataatggcatc

SEQ ID NO: 1015262 - DNA, 22 bp, Artificial Sequence
  chemically synthesized
cacttagaataatggcatccag

SEQ ID NO: 1015263 - DNA, 22 bp, Artificial Sequence
  chemically synthesized
acttagaataatggcatccagc

SEQ ID NO: 1015264 - DNA, 22 bp, Artificial Sequence
  chemically synthesized
agaataatggcatccagctcca

SEQ ID NO: 1015265 - DNA, 22 bp, Artificial Sequence
  chemically synthesized
cagcaactttgatggagctgga

SEQ ID NO: 1015266 - DNA, 22 bp, Artificial Sequence
  chemically synthesized
gaataatggcatccagctccat

SEQ ID NO: 1015267 - DNA, 22 bp, Artificial Sequence
  chemically synthesized
gcagcaactttgatggagctgg

SEQ ID NO: 1015268 - DNA, 22 bp, Artificial Sequence
  chemically synthesized
tgcagcaactttgatggagctg

SEQ ID NO: 1015269 - DNA, 22 bp, Artificial Sequence
  chemically synthesized
ttgcagcaactttgatggagct

SEQ ID NO: 1015270 - DNA, 22 bp, Artificial Sequence
  chemically synthesized
catcaaagttgctgcaaaagac

SEQ ID NO: 1015271 - DNA, 22 bp, Artificial Sequence
  chemically synthesized
ctgcaaaagacattatttcatt

SEQ ID NO: 1015272 - DNA, 22 bp, Artificial Sequence
  chemically synthesized
agccgtagaaaataatgaaata

SEQ ID NO: 1015273 - DNA, 22 bp, Artificial Sequence
  chemically synthesized
caaaagacattatttcattatt

SEQ ID NO: 1015274 - DNA, 22 bp, Artificial Sequence
  chemically synthesized
ctcagccgtagaaaataatgaa

SEQ ID NO: 1015275 - DNA, 22 bp, Artificial Sequence
  chemically synthesized
tttcattattttctacggctga

SEQ ID NO: 1015276 - DNA, 22 bp, Artificial Sequence
  chemically synthesized
cattattttctacggctgagta

SEQ ID NO: 1015277 - DNA, 22 bp, Artificial Sequence
  chemically synthesized
attattttctacggctgagtag

SEQ ID NO: 1015278 - DNA, 22 bp, Artificial Sequence
  chemically synthesized
ttttctacggctgagtagtatt

SEQ ID NO: 1015279 - DNA, 22 bp, Artificial Sequence
  chemically synthesized
tctacggctgagtagtattgca

SEQ ID NO: 1015280 - DNA, 22 bp, Artificial Sequence
  chemically synthesized
agccacataccatgcaatacta

SEQ ID NO: 1015281 - DNA, 22 bp, Artificial Sequence
  chemically synthesized
ctacggctgagtagtattgcat

SEQ ID NO: 1015282 - DNA, 22 bp, Artificial Sequence
  chemically synthesized
tacggctgagtagtattgcatg

SEQ ID NO: 1015283 - DNA, 22 bp, Artificial Sequence
  chemically synthesized
ttcagccacataccatgcaata

SEQ ID NO: 1015284 - DNA, 22 bp, Artificial Sequence
  chemically synthesized
cggctgagtagtattgcatggt

SEQ ID NO: 1015285 - DNA, 22 bp, Artificial Sequence
  chemically synthesized
agtagtattgcatggtatgtgg

SEQ ID NO: 1015286 - DNA, 22 bp, Artificial Sequence
  chemically synthesized
catggtatgtggctgaatagta

SEQ ID NO: 1015287 - DNA, 22 bp, Artificial Sequence
  chemically synthesized
atataccgtgaaatactattca

SEQ ID NO: 1015288 - DNA, 22 bp, Artificial Sequence
  chemically synthesized
catataccgtgaaatactattc

SEQ ID NO: 1015289 - DNA, 22 bp, Artificial Sequence
  chemically synthesized
tcatataccgtgaaatactatt

SEQ ID NO: 1015290 - DNA, 22 bp, Artificial Sequence
  chemically synthesized
aatagtatttcacggtatatga

SEQ ID NO: 1015291 - DNA, 22 bp, Artificial Sequence
  chemically synthesized
cacggtatatgaaaatatatgc

SEQ ID NO: 1015292 - DNA, 22 bp, Artificial Sequence
  chemically synthesized
acggtatatgaaaatatatgcc

SEQ ID NO: 1015293 - DNA, 22 bp, Artificial Sequence
  chemically synthesized
agtgccagccgaccaatgagtg

SEQ ID NO: 1015294 - DNA, 22 bp, Artificial Sequence
  chemically synthesized
tctttatccactcattggtcgg

SEQ ID NO: 1015295 - DNA, 22 bp, Artificial Sequence
  chemically synthesized
ctttatccactcattggtcggc

SEQ ID NO: 1015296 - DNA, 22 bp, Artificial Sequence
  chemically synthesized
tttatccactcattggtcggct

SEQ ID NO: 1015297 - DNA, 22 bp, Artificial Sequence
  chemically synthesized
tatccactcattggtcggctgg

SEQ ID NO: 1015298 - DNA, 22 bp, Artificial Sequence
  chemically synthesized
atccactcattggtcggctggc

SEQ ID NO: 1015299 - DNA, 22 bp, Artificial Sequence
  chemically synthesized
tccactcattggtcggctggca

SEQ ID NO: 1015300 - DNA, 22 bp, Artificial Sequence
  chemically synthesized
attggtcggctggcacttagga

SEQ ID NO: 1015301 - DNA, 22 bp, Artificial Sequence
  chemically synthesized
gtcggctggcacttaggatggt

SEQ ID NO: 1015302 - DNA, 22 bp, Artificial Sequence
  chemically synthesized
caaagatatggaaccatcctaa

SEQ ID NO: 1015303 - DNA, 22 bp, Artificial Sequence
  chemically synthesized
acagttgcaaagatatggaacc

SEQ ID NO: 1015304 - DNA, 22 bp, Artificial Sequence
  chemically synthesized
gcacttaggatggttccatatc

SEQ ID NO: 1015305 - DNA, 22 bp, Artificial Sequence
  chemically synthesized
aggatggttccatatctttgca

SEQ ID NO: 1015306 - DNA, 22 bp, Artificial Sequence
  chemically synthesized
ggatggttccatatctttgcaa

SEQ ID NO: 1015307 - DNA, 22 bp, Artificial Sequence
  chemically synthesized
tagcagcacaattcacagttgc

SEQ ID NO: 1015308 - DNA, 22 bp, Artificial Sequence
  chemically synthesized
atagcagcacaattcacagttg

SEQ ID NO: 1015309 - DNA, 22 bp, Artificial Sequence
  chemically synthesized
catatctttgcaactgtgaatt

SEQ ID NO: 1015310 - DNA, 22 bp, Artificial Sequence
  chemically synthesized
tgcaactgtgaattgtgctgct

SEQ ID NO: 1015311 - DNA, 22 bp, Artificial Sequence
  chemically synthesized
gcaactgtgaattgtgctgcta

SEQ ID NO: 1015312 - DNA, 22 bp, Artificial Sequence
  chemically synthesized
caactgtgaattgtgctgctat

SEQ ID NO: 1015313 - DNA, 22 bp, Artificial Sequence
  chemically synthesized
cacgcatatgtttatagcagca

SEQ ID NO: 1015314 - DNA, 22 bp, Artificial Sequence
  chemically synthesized
gcacgcatatgtttatagcagc

SEQ ID NO: 1015315 - DNA, 22 bp, Artificial Sequence
  chemically synthesized
tgaattgtgctgctataaacat

SEQ ID NO: 1015316 - DNA, 22 bp, Artificial Sequence
  chemically synthesized
tgctgctataaacatatgcgtg

SEQ ID NO: 1015317 - DNA, 22 bp, Artificial Sequence
  chemically synthesized
ctataaacatatgcgtgcaagt

SEQ ID NO: 1015318 - DNA, 22 bp, Artificial Sequence
  chemically synthesized
tatcaaaaagacacttgcacgc

SEQ ID NO: 1015319 - DNA, 22 bp, Artificial Sequence
  chemically synthesized
taaacatatgcgtgcaagtgtc

SEQ ID NO: 1015320 - DNA, 22 bp, Artificial Sequence
  chemically synthesized
attatatcaaaaagacacttgc

SEQ ID NO: 1015321 - DNA, 22 bp, Artificial Sequence
  chemically synthesized
gaggaagagaattcattatatc

SEQ ID NO: 1015322 - DNA, 22 bp, Artificial Sequence
  chemically synthesized
tgtacctagaggaagagaattc

SEQ ID NO: 1015323 - DNA, 22 bp, Artificial Sequence
  chemically synthesized
tttgatataatgaattctcttc

SEQ ID NO: 1015324 - DNA, 22 bp, Artificial Sequence
  chemically synthesized
ttgatataatgaattctcttcc

SEQ ID NO: 1015325 - DNA, 22 bp, Artificial Sequence
  chemically synthesized
tgatataatgaattctcttcct

SEQ ID NO: 1015326 - DNA, 22 bp, Artificial Sequence
  chemically synthesized
gatataatgaattctcttcctc

SEQ ID NO: 1015327 - DNA, 22 bp, Artificial Sequence
  chemically synthesized
atataatgaattctcttcctct

SEQ ID NO: 1015328 - DNA, 22 bp, Artificial Sequence
  chemically synthesized
ccgattatgtacctagaggaag

SEQ ID NO: 1015329 - DNA, 22 bp, Artificial Sequence
  chemically synthesized
actaccgattatgtacctagag

SEQ ID NO: 1015330 - DNA, 22 bp, Artificial Sequence
  chemically synthesized
tcttcctctaggtacataatcg

SEQ ID NO: 1015331 - DNA, 22 bp, Artificial Sequence
  chemically synthesized
gaaatctcactaccgattatgt

SEQ ID NO: 1015332 - DNA, 22 bp, Artificial Sequence
  chemically synthesized
ttcctctaggtacataatcggt

SEQ ID NO: 1015333 - DNA, 22 bp, Artificial Sequence
  chemically synthesized
cctctaggtacataatcggtag

SEQ ID NO: 1015334 - DNA, 22 bp, Artificial Sequence
  chemically synthesized
ctctaggtacataatcggtagt

SEQ ID NO: 1015335 - DNA, 22 bp, Artificial Sequence
  chemically synthesized
atctggaaatctcactaccgat

SEQ ID NO: 1015336 - DNA, 22 bp, Artificial Sequence
  chemically synthesized
gatctggaaatctcactaccga

SEQ ID NO: 1015337 - DNA, 22 bp, Artificial Sequence
  chemically synthesized
taggtacataatcggtagtgag

SEQ ID NO: 1015338 - DNA, 22 bp, Artificial Sequence
  chemically synthesized
ggtacataatcggtagtgagat

SEQ ID NO: 1015339 - DNA, 22 bp, Artificial Sequence
  chemically synthesized
acatttgatctggaaatctcac

SEQ ID NO: 1015340 - DNA, 22 bp, Artificial Sequence
  chemically synthesized
aaagtagatctaacatttgatc

SEQ ID NO: 1015341 - DNA, 22 bp, Artificial Sequence
  chemically synthesized
aagaactaaaagtagatctaac

SEQ ID NO: 1015342 - DNA, 22 bp, Artificial Sequence
  chemically synthesized
ccagatcaaatgttagatctac

SEQ ID NO: 1015343 - DNA, 22 bp, Artificial Sequence
  chemically synthesized
aaagaactaaaagtagatctaa

SEQ ID NO: 1015344 - DNA, 22 bp, Artificial Sequence
  chemically synthesized
cagatcaaatgttagatctact

SEQ ID NO: 1015345 - DNA, 22 bp, Artificial Sequence
  chemically synthesized
ttaaagaactaaaagtagatct

SEQ ID NO: 1015346 - DNA, 22 bp, Artificial Sequence
  chemically synthesized
cttaaagaactaaaagtagatc

SEQ ID NO: 1015347 - DNA, 22 bp, Artificial Sequence
  chemically synthesized
gatctacttttagttctttaag

SEQ ID NO: 1015348 - DNA, 22 bp, Artificial Sequence
  chemically synthesized
cttttagttctttaagaaatct

SEQ ID NO: 1015349 - DNA, 22 bp, Artificial Sequence
  chemically synthesized
ttagttctttaagaaatcttca

SEQ ID NO: 1015350 - DNA, 22 bp, Artificial Sequence
  chemically synthesized
tagttctttaagaaatcttcat

SEQ ID NO: 1015351 - DNA, 22 bp, Artificial Sequence
  chemically synthesized
agttctttaagaaatcttcata

SEQ ID NO: 1015352 - DNA, 22 bp, Artificial Sequence
  chemically synthesized
catggaaaacagtatgaagatt

SEQ ID NO: 1015353 - DNA, 22 bp, Artificial Sequence
  chemically synthesized
gttctttaagaaatcttcatac

SEQ ID NO: 1015354 - DNA, 22 bp, Artificial Sequence
  chemically synthesized
tttaagaaatcttcatactgtt

SEQ ID NO: 1015355 - DNA, 22 bp, Artificial Sequence
  chemically synthesized
taagaaatcttcatactgtttt

SEQ ID NO: 1015356 - DNA, 22 bp, Artificial Sequence
  chemically synthesized
aagaaatcttcatactgttttc

SEQ ID NO: 1015357 - DNA, 22 bp, Artificial Sequence
  chemically synthesized
agaaatcttcatactgttttcc

SEQ ID NO: 1015358 - DNA, 22 bp, Artificial Sequence
  chemically synthesized
gtacaacctacatggaaaacag

SEQ ID NO: 1015359 - DNA, 22 bp, Artificial Sequence
  chemically synthesized
taaattagtacaacctacatgg

SEQ ID NO: 1015360 - DNA, 22 bp, Artificial Sequence
  chemically synthesized
catactgttttccatgtaggtt

SEQ ID NO: 1015361 - DNA, 22 bp, Artificial Sequence
  chemically synthesized
atactgttttccatgtaggttg

SEQ ID NO: 1015362 - DNA, 22 bp, Artificial Sequence
  chemically synthesized
gtgattgtaaattagtacaacc

SEQ ID NO: 1015363 - DNA, 22 bp, Artificial Sequence
  chemically synthesized
ttttccatgtaggttgtactaa

SEQ ID NO: 1015364 - DNA, 22 bp, Artificial Sequence
  chemically synthesized
ctggtgattgtaaattagtaca

SEQ ID NO: 1015365 - DNA, 22 bp, Artificial Sequence
  chemically synthesized
tccatgtaggttgtactaattt

SEQ ID NO: 1015366 - DNA, 22 bp, Artificial Sequence
  chemically synthesized
ccatgtaggttgtactaattta

SEQ ID NO: 1015367 - DNA, 22 bp, Artificial Sequence
  chemically synthesized
catgtaggttgtactaatttac

SEQ ID NO: 1015368 - DNA, 22 bp, Artificial Sequence
  chemically synthesized
tacactgctggtgattgtaaat

SEQ ID NO: 1015369 - DNA, 22 bp, Artificial Sequence
  chemically synthesized
gtacactgctggtgattgtaaa

SEQ ID NO: 1015370 - DNA, 22 bp, Artificial Sequence
  chemically synthesized
tactaatttacaatcaccagca

SEQ ID NO: 1015371 - DNA, 22 bp, Artificial Sequence
  chemically synthesized
atttacaatcaccagcagtgta

SEQ ID NO: 1015372 - DNA, 22 bp, Artificial Sequence
  chemically synthesized
acaatcaccagcagtgtacaaa

SEQ ID NO: 1015373 - DNA, 22 bp, Artificial Sequence
  chemically synthesized
caatcaccagcagtgtacaaat

SEQ ID NO: 1015374 - DNA, 22 bp, Artificial Sequence
  chemically synthesized
tgaatgtgatgaaaacggaaca

SEQ ID NO: 1015375 - DNA, 22 bp, Artificial Sequence
  chemically synthesized
ttgtgaatgtgatgaaaacgga

SEQ ID NO: 1015376 - DNA, 22 bp, Artificial Sequence
  chemically synthesized
gttgtgaatgtgatgaaaacgg

SEQ ID NO: 1015377 - DNA, 22 bp, Artificial Sequence
  chemically synthesized
tgttgtgaatgtgatgaaaacg

SEQ ID NO: 1015378 - DNA, 22 bp, Artificial Sequence
  chemically synthesized
aatagattttgttgtgaatgtg

SEQ ID NO: 1015379 - DNA, 22 bp, Artificial Sequence
  chemically synthesized
gaatagattttgttgtgaatgt

SEQ ID NO: 1015380 - DNA, 22 bp, Artificial Sequence
  chemically synthesized
tgaatagattttgttgtgaatg

SEQ ID NO: 1015381 - DNA, 22 bp, Artificial Sequence
  chemically synthesized
cgttttcatcacattcacaaca

SEQ ID NO: 1015382 - DNA, 22 bp, Artificial Sequence
  chemically synthesized
tcatcacattcacaacaaaatc

SEQ ID NO: 1015383 - DNA, 22 bp, Artificial Sequence
  chemically synthesized
catcacattcacaacaaaatct

SEQ ID NO: 1015384 - DNA, 22 bp, Artificial Sequence
  chemically synthesized
atcacattcacaacaaaatcta

SEQ ID NO: 1015385 - DNA, 22 bp, Artificial Sequence
  chemically synthesized
tatcccagaggttttgaataga

SEQ ID NO: 1015386 - DNA, 22 bp, Artificial Sequence
  chemically synthesized
acaacaaaatctattcaaaacc

SEQ ID NO: 1015387 - DNA, 22 bp, Artificial Sequence
  chemically synthesized
ctgtatcccagaggttttgaat

SEQ ID NO: 1015388 - DNA, 22 bp, Artificial Sequence
  chemically synthesized
gctgtatcccagaggttttgaa

SEQ ID NO: 1015389 - DNA, 22 bp, Artificial Sequence
  chemically synthesized
tgctgtatcccagaggttttga

SEQ ID NO: 1015390 - DNA, 22 bp, Artificial Sequence
  chemically synthesized
ttgctgtatcccagaggttttg

SEQ ID NO: 1015391 - DNA, 22 bp, Artificial Sequence
  chemically synthesized
cttttgctgtatcccagaggtt

SEQ ID NO: 1015392 - DNA, 22 bp, Artificial Sequence
  chemically synthesized
gcttttgctgtatcccagaggt

SEQ ID NO: 1015393 - DNA, 22 bp, Artificial Sequence
  chemically synthesized
gccttgcttttgctgtatccca

SEQ ID NO: 1015394 - DNA, 22 bp, Artificial Sequence
  chemically synthesized
ttcaaaacctctgggatacagc

SEQ ID NO: 1015395 - DNA, 22 bp, Artificial Sequence
  chemically synthesized
agccttgcttttgctgtatccc

SEQ ID NO: 1015396 - DNA, 22 bp, Artificial Sequence
  chemically synthesized
ttagccttgcttttgctgtatc

SEQ ID NO: 1015397 - DNA, 22 bp, Artificial Sequence
  chemically synthesized
aaaacctctgggatacagcaaa

SEQ ID NO: 1015398 - DNA, 22 bp, Artificial Sequence
  chemically synthesized
ctcttagccttgcttttgctgt

SEQ ID NO: 1015399 - DNA, 22 bp, Artificial Sequence
  chemically synthesized
cctcttagccttgcttttgctg

SEQ ID NO: 1015400 - DNA, 22 bp, Artificial Sequence
  chemically synthesized
tgggatacagcaaaagcaaggc

SEQ ID NO: 1015401 - DNA, 22 bp, Artificial Sequence
  chemically synthesized
ggatacagcaaaagcaaggcta

SEQ ID NO: 1015402 - DNA, 22 bp, Artificial Sequence
  chemically synthesized
gaaaatttcctcttagccttgc

SEQ ID NO: 1015403 - DNA, 22 bp, Artificial Sequence
  chemically synthesized
gtgctagaaaatttcctcttag

SEQ ID NO: 1015404 - DNA, 22 bp, Artificial Sequence
  chemically synthesized
ggtgctagaaaatttcctctta

SEQ ID NO: 1015405 - DNA, 22 bp, Artificial Sequence
  chemically synthesized
atgtaggcatttggtgctagaa

SEQ ID NO: 1015406 - DNA, 22 bp, Artificial Sequence
  chemically synthesized
gatgtaggcatttggtgctaga

SEQ ID NO: 1015407 - DNA, 22 bp, Artificial Sequence
  chemically synthesized
agaggaaattttctagcaccaa

SEQ ID NO: 1015408 - DNA, 22 bp, Artificial Sequence
  chemically synthesized
tgatgtaggcatttggtgctag

SEQ ID NO: 1015409 - DNA, 22 bp, Artificial Sequence
  chemically synthesized
tttgatgtaggcatttggtgct

SEQ ID NO: 1015410 - DNA, 22 bp, Artificial Sequence
  chemically synthesized
aggctctttgatgtaggcattt

SEQ ID NO: 1015411 - DNA, 22 bp, Artificial Sequence
  chemically synthesized
caggctctttgatgtaggcatt

SEQ ID NO: 1015412 - DNA, 22 bp, Artificial Sequence
  chemically synthesized
tcaggctctttgatgtaggcat

SEQ ID NO: 1015413 - DNA, 22 bp, Artificial Sequence
  chemically synthesized
tctagcaccaaatgcctacatc

SEQ ID NO: 1015414 - DNA, 22 bp, Artificial Sequence
  chemically synthesized
ctagcaccaaatgcctacatca

SEQ ID NO: 1015415 - DNA, 22 bp, Artificial Sequence
  chemically synthesized
tagcaccaaatgcctacatcaa

SEQ ID NO: 1015416 - DNA, 22 bp, Artificial Sequence
  chemically synthesized
gcaccaaatgcctacatcaaag

SEQ ID NO: 1015417 - DNA, 22 bp, Artificial Sequence
  chemically synthesized
tgaactttcaggctctttgatg

SEQ ID NO: 1015418 - DNA, 22 bp, Artificial Sequence
  chemically synthesized
catcaaagagcctgaaagttca

SEQ ID NO: 1015419 - DNA, 22 bp, Artificial Sequence
  chemically synthesized
ggtagtcagactgtgaactttc

SEQ ID NO: 1015420 - DNA, 22 bp, Artificial Sequence
  chemically synthesized
aaagttcacagtctgactacct

SEQ ID NO: 1015421 - DNA, 22 bp, Artificial Sequence
  chemically synthesized
aggtgtgatgttaggtagtcag

SEQ ID NO: 1015422 - DNA, 22 bp, Artificial Sequence
  chemically synthesized
caggtgtgatgttaggtagtca

SEQ ID NO: 1015423 - DNA, 22 bp, Artificial Sequence
  chemically synthesized
cttcaggtgtgatgttaggtag

SEQ ID NO: 1015424 - DNA, 22 bp, Artificial Sequence
  chemically synthesized
acagtctgactacctaacatca

SEQ ID NO: 1015425 - DNA, 22 bp, Artificial Sequence
  chemically synthesized
gttccttcaggtgtgatgttag

SEQ ID NO: 1015426 - DNA, 22 bp, Artificial Sequence
  chemically synthesized
tagttccttcaggtgtgatgtt

SEQ ID NO: 1015427 - DNA, 22 bp, Artificial Sequence
  chemically synthesized
tctagttccttcaggtgtgatg

SEQ ID NO: 1015428 - DNA, 22 bp, Artificial Sequence
  chemically synthesized
actacctaacatcacacctgaa

SEQ ID NO: 1015429 - DNA, 22 bp, Artificial Sequence
  chemically synthesized
attctctagttccttcaggtgt

SEQ ID NO: 1015430 - DNA, 22 bp, Artificial Sequence
  chemically synthesized
cctaacatcacacctgaaggaa

SEQ ID NO: 1015431 - DNA, 22 bp, Artificial Sequence
  chemically synthesized
ttgattctctagttccttcagg

SEQ ID NO: 1015432 - DNA, 22 bp, Artificial Sequence
  chemically synthesized
ttgttgattctctagttccttc

SEQ ID NO: 1015433 - DNA, 22 bp, Artificial Sequence
  chemically synthesized
acatcacacctgaaggaactag

SEQ ID NO: 1015434 - DNA, 22 bp, Artificial Sequence
  chemically synthesized
gttgttgattctctagttcctt

SEQ ID NO: 1015435 - DNA, 22 bp, Artificial Sequence
  chemically synthesized
tgttgttgattctctagttcct

SEQ ID NO: 1015436 - DNA, 22 bp, Artificial Sequence
  chemically synthesized
gctttgttgttgattctctagt

SEQ ID NO: 1015437 - DNA, 22 bp, Artificial Sequence
  chemically synthesized
tgttggctttgttgttgattct

SEQ ID NO: 1015438 - DNA, 22 bp, Artificial Sequence
  chemically synthesized
gtgttggctttgttgttgattc

SEQ ID NO: 1015439 - DNA, 22 bp, Artificial Sequence
  chemically synthesized
aaggaactagagaatcaacaac

SEQ ID NO: 1015440 - DNA, 22 bp, Artificial Sequence
  chemically synthesized
tgtgttggctttgttgttgatt

SEQ ID NO: 1015441 - DNA, 22 bp, Artificial Sequence
  chemically synthesized
gagctttgtgttggctttgttg

SEQ ID NO: 1015442 - DNA, 22 bp, Artificial Sequence
  chemically synthesized
tggagctttgtgttggctttgt

SEQ ID NO: 1015443 - DNA, 22 bp, Artificial Sequence
  chemically synthesized
gagaatcaacaacaaagccaac

SEQ ID NO: 1015444 - DNA, 22 bp, Artificial Sequence
  chemically synthesized
ctggagctttgtgttggctttg

SEQ ID NO: 1015445 - DNA, 22 bp, Artificial Sequence
  chemically synthesized
ttctggagctttgtgttggctt

SEQ ID NO: 1015446 - DNA, 22 bp, Artificial Sequence
  chemically synthesized
cttctggagctttgtgttggct

SEQ ID NO: 1015447 - DNA, 22 bp, Artificial Sequence
  chemically synthesized
tcttctggagctttgtgttggc

SEQ ID NO: 1015448 - DNA, 22 bp, Artificial Sequence
  chemically synthesized
ttcttctggagctttgtgttgg

SEQ ID NO: 1015449 - DNA, 22 bp, Artificial Sequence
  chemically synthesized
ttttcttctggagctttgtgtt

SEQ ID NO: 1015450 - DNA, 22 bp, Artificial Sequence
  chemically synthesized
cttttcttctggagctttgtgt

SEQ ID NO: 1015451 - DNA, 22 bp, Artificial Sequence
  chemically synthesized
tttcttttcttctggagctttg

SEQ ID NO: 1015452 - DNA, 22 bp, Artificial Sequence
  chemically synthesized
ttatttcttttcttctggagct

SEQ ID NO: 1015453 - DNA, 22 bp, Artificial Sequence
  chemically synthesized
gttatttcttttcttctggagc

SEQ ID NO: 1015454 - DNA, 22 bp, Artificial Sequence
  chemically synthesized
tgttatttcttttcttctggag

SEQ ID NO: 1015455 - DNA, 22 bp, Artificial Sequence
  chemically synthesized
atctttgttatttcttttcttc

SEQ ID NO: 1015456 - DNA, 22 bp, Artificial Sequence
  chemically synthesized
tgatctttgttatttcttttct

SEQ ID NO: 1015457 - DNA, 22 bp, Artificial Sequence
  chemically synthesized
ctctgatctttgttatttcttt

SEQ ID NO: 1015458 - DNA, 22 bp, Artificial Sequence
  chemically synthesized
tgctctgatctttgttatttct

SEQ ID NO: 1015459 - DNA, 22 bp, Artificial Sequence
  chemically synthesized
cagaagaaaagaaataacaaag

SEQ ID NO: 1015460 - DNA, 22 bp, Artificial Sequence
  chemically synthesized
gttctgctctgatctttgttat

SEQ ID NO: 1015461 - DNA, 22 bp, Artificial Sequence
  chemically synthesized
agttctgctctgatctttgtta

SEQ ID NO: 1015462 - DNA, 22 bp, Artificial Sequence
  chemically synthesized
atttagttctgctctgatcttt

SEQ ID NO: 1015463 - DNA, 22 bp, Artificial Sequence
  chemically synthesized
catttagttctgctctgatctt

SEQ ID NO: 1015464 - DNA, 22 bp, Artificial Sequence
  chemically synthesized
aatttcatttagttctgctctg

SEQ ID NO: 1015465 - DNA, 22 bp, Artificial Sequence
  chemically synthesized
caatttcatttagttctgctct

SEQ ID NO: 1015466 - DNA, 22 bp, Artificial Sequence
  chemically synthesized
tttcaatttcatttagttctgc

SEQ ID NO: 1015467 - DNA, 22 bp, Artificial Sequence
  chemically synthesized
gtttcaatttcatttagttctg

SEQ ID NO: 1015468 - DNA, 22 bp, Artificial Sequence
  chemically synthesized
tgtttcaatttcatttagttct

SEQ ID NO: 1015469 - DNA, 22 bp, Artificial Sequence
  chemically synthesized
ttgtttcaatttcatttagttc

SEQ ID NO: 1015470 - DNA, 22 bp, Artificial Sequence
  chemically synthesized
tatttttgtttcaatttcattt

SEQ ID NO: 1015471 - DNA, 22 bp, Artificial Sequence
  chemically synthesized
atatttttgtttcaatttcatt

SEQ ID NO: 1015472 - DNA, 22 bp, Artificial Sequence
  chemically synthesized
tatatttttgtttcaatttcat

SEQ ID NO: 1015473 - DNA, 22 bp, Artificial Sequence
  chemically synthesized
ttatatttttgtttcaatttca

SEQ ID NO: 1015474 - DNA, 22 bp, Artificial Sequence
  chemically synthesized
atcttttatatttttgtttcaa

SEQ ID NO: 1015475 - DNA, 22 bp, Artificial Sequence
  chemically synthesized
attgatcttttatatttttgtt

SEQ ID NO: 1015476 - DNA, 22 bp, Artificial Sequence
  chemically synthesized
aatgaaattgaaacaaaaatat

SEQ ID NO: 1015477 - DNA, 22 bp, Artificial Sequence
  chemically synthesized
cattgatcttttatatttttgt

SEQ ID NO: 1015478 - DNA, 22 bp, Artificial Sequence
  chemically synthesized
tttcattgatcttttatatttt

SEQ ID NO: 1015479 - DNA, 22 bp, Artificial Sequence
  chemically synthesized
gtttcattgatcttttatattt

SEQ ID NO: 1015480 - DNA, 22 bp, Artificial Sequence
  chemically synthesized
tgtttcattgatcttttatatt

SEQ ID NO: 1015481 - DNA, 22 bp, Artificial Sequence
  chemically synthesized
aaacaaaaatataaaagatcaa

SEQ ID NO: 1015482 - DNA, 22 bp, Artificial Sequence
  chemically synthesized
aaagaatcaacattttgtttca

SEQ ID NO: 1015483 - DNA, 22 bp, Artificial Sequence
  chemically synthesized
caaagaatcaacattttgtttc

SEQ ID NO: 1015484 - DNA, 22 bp, Artificial Sequence
  chemically synthesized
tcaaagaatcaacattttgttt

SEQ ID NO: 1015485 - DNA, 22 bp, Artificial Sequence
  chemically synthesized
ttcaaagaatcaacattttgtt

SEQ ID NO: 1015486 - DNA, 22 bp, Artificial Sequence
  chemically synthesized
tcttttcaaagaatcaacattt

SEQ ID NO: 1015487 - DNA, 22 bp, Artificial Sequence
  chemically synthesized
atcttttcaaagaatcaacatt

SEQ ID NO: 1015488 - DNA, 22 bp, Artificial Sequence
  chemically synthesized
cttatcttttcaaagaatcaac

SEQ ID NO: 1015489 - DNA, 22 bp, Artificial Sequence
  chemically synthesized
acttatcttttcaaagaatcaa

SEQ ID NO: 1015490 - DNA, 22 bp, Artificial Sequence
  chemically synthesized
tacttatcttttcaaagaatca

SEQ ID NO: 1015491 - DNA, 22 bp, Artificial Sequence
  chemically synthesized
tcaattttacttatcttttcaa

SEQ ID NO: 1015492 - DNA, 22 bp, Artificial Sequence
  chemically synthesized
gtctatcaattttacttatctt

SEQ ID NO: 1015493 - DNA, 22 bp, Artificial Sequence
  chemically synthesized
attctttgaaaagataagtaaa

SEQ ID NO: 1015494 - DNA, 22 bp, Artificial Sequence
  chemically synthesized
ctggtctatcaattttacttat

SEQ ID NO: 1015495 - DNA, 22 bp, Artificial Sequence
  chemically synthesized
tttgaaaagataagtaaaattg

SEQ ID NO: 1015496 - DNA, 22 bp, Artificial Sequence
  chemically synthesized
actactggtctatcaattttac

SEQ ID NO: 1015497 - DNA, 22 bp, Artificial Sequence
  chemically synthesized
tgaaaagataagtaaaattgat

SEQ ID NO: 1015498 - DNA, 22 bp, Artificial Sequence
  chemically synthesized
gaaaagataagtaaaattgata

SEQ ID NO: 1015499 - DNA, 22 bp, Artificial Sequence
  chemically synthesized
aaaagataagtaaaattgatag

SEQ ID NO: 1015500 - DNA, 22 bp, Artificial Sequence
  chemically synthesized
atctaactactggtctatcaat

SEQ ID NO: 1015501 - DNA, 22 bp, Artificial Sequence
  chemically synthesized
gttaatctaactactggtctat

SEQ ID NO: 1015502 - DNA, 22 bp, Artificial Sequence
  chemically synthesized
ggttaatctaactactggtcta

SEQ ID NO: 1015503 - DNA, 22 bp, Artificial Sequence
  chemically synthesized
ttggttaatctaactactggtc

SEQ ID NO: 1015504 - DNA, 22 bp, Artificial Sequence
  chemically synthesized
cttggttaatctaactactggt

SEQ ID NO: 1015505 - DNA, 22 bp, Artificial Sequence
  chemically synthesized
tcttggttaatctaactactgg

SEQ ID NO: 1015506 - DNA, 22 bp, Artificial Sequence
  chemically synthesized
ttcttggttaatctaactactg

SEQ ID NO: 1015507 - DNA, 22 bp, Artificial Sequence
  chemically synthesized
tttcttggttaatctaactact

SEQ ID NO: 1015508 - DNA, 22 bp, Artificial Sequence
  chemically synthesized
ttttcttggttaatctaactac

SEQ ID NO: 1015509 - DNA, 22 bp, Artificial Sequence
  chemically synthesized
tttttcttggttaatctaacta

SEQ ID NO: 1015510 - DNA, 22 bp, Artificial Sequence
  chemically synthesized
tttttttcttggttaatctaac

SEQ ID NO: 1015511 - DNA, 22 bp, Artificial Sequence
  chemically synthesized
atagaccagtagttagattaac

SEQ ID NO: 1015512 - DNA, 22 bp, Artificial Sequence
  chemically synthesized
tctttttttcttggttaatcta

SEQ ID NO: 1015513 - DNA, 22 bp, Artificial Sequence
  chemically synthesized
tctctttttttcttggttaatc

SEQ ID NO: 1015514 - DNA, 22 bp, Artificial Sequence
  chemically synthesized
ctctctttttttcttggttaat

SEQ ID NO: 1015515 - DNA, 22 bp, Artificial Sequence
  chemically synthesized
aatcttctctctttttttcttg

SEQ ID NO: 1015516 - DNA, 22 bp, Artificial Sequence
  chemically synthesized
gaatcttctctctttttttctt

SEQ ID NO: 1015517 - DNA, 22 bp, Artificial Sequence
  chemically synthesized
cttgaatcttctctcttttttt

SEQ ID NO: 1015518 - DNA, 22 bp, Artificial Sequence
  chemically synthesized
gattaaccaagaaaaaaagaga

SEQ ID NO: 1015519 - DNA, 22 bp, Artificial Sequence
  chemically synthesized
acttgaatcttctctctttttt

SEQ ID NO: 1015520 - DNA, 22 bp, Artificial Sequence
  chemically synthesized
accaagaaaaaaagagagaaga

SEQ ID NO: 1015521 - DNA, 22 bp, Artificial Sequence
  chemically synthesized
agcttacttgaatcttctctct

SEQ ID NO: 1015522 - DNA, 22 bp, Artificial Sequence
  chemically synthesized
taactgagcttacttgaatctt

SEQ ID NO: 1015523 - DNA, 22 bp, Artificial Sequence
  chemically synthesized
gtaactgagcttacttgaatct

SEQ ID NO: 1015524 - DNA, 22 bp, Artificial Sequence
  chemically synthesized
atttgtaactgagcttacttga

SEQ ID NO: 1015525 - DNA, 22 bp, Artificial Sequence
  chemically synthesized
catttgtaactgagcttacttg

SEQ ID NO: 1015526 - DNA, 22 bp, Artificial Sequence
  chemically synthesized
tcatttgtaactgagcttactt

SEQ ID NO: 1015527 - DNA, 22 bp, Artificial Sequence
  chemically synthesized
cattttcatttgtaactgagct

SEQ ID NO: 1015528 - DNA, 22 bp, Artificial Sequence
  chemically synthesized
gcattttcatttgtaactgagc

SEQ ID NO: 1015529 - DNA, 22 bp, Artificial Sequence
  chemically synthesized
aagtaagctcagttacaaatga

SEQ ID NO: 1015530 - DNA, 22 bp, Artificial Sequence
  chemically synthesized
agaaatttgcattttcatttgt

SEQ ID NO: 1015531 - DNA, 22 bp, Artificial Sequence
  chemically synthesized
aagaaatttgcattttcatttg

SEQ ID NO: 1015532 - DNA, 22 bp, Artificial Sequence
  chemically synthesized
taagaaatttgcattttcattt

SEQ ID NO: 1015533 - DNA, 22 bp, Artificial Sequence
  chemically synthesized
ttttaagaaatttgcattttca

SEQ ID NO: 1015534 - DNA, 22 bp, Artificial Sequence
  chemically synthesized
agttacaaatgaaaatgcaaat

SEQ ID NO: 1015535 - DNA, 22 bp, Artificial Sequence
  chemically synthesized
caaatgaaaatgcaaatttctt

SEQ ID NO: 1015536 - DNA, 22 bp, Artificial Sequence
  chemically synthesized
ccagatgctgttttaagaaatt

SEQ ID NO: 1015537 - DNA, 22 bp, Artificial Sequence
  chemically synthesized
tggaacactgccagatgctgtt

SEQ ID NO: 1015538 - DNA, 22 bp, Artificial Sequence
  chemically synthesized
gtggaacactgccagatgctgt

SEQ ID NO: 1015539 - DNA, 22 bp, Artificial Sequence
  chemically synthesized
cttaaaacagcatctggcagtg

SEQ ID NO: 1015540 - DNA, 22 bp, Artificial Sequence
  chemically synthesized
atacttgtggaacactgccaga

SEQ ID NO: 1015541 - DNA, 22 bp, Artificial Sequence
  chemically synthesized
ttaaaacagcatctggcagtgt

SEQ ID NO: 1015542 - DNA, 22 bp, Artificial Sequence
  chemically synthesized
aaaacagcatctggcagtgttc

SEQ ID NO: 1015543 - DNA, 22 bp, Artificial Sequence
  chemically synthesized
ctcatacttgtggaacactgcc

SEQ ID NO: 1015544 - DNA, 22 bp, Artificial Sequence
  chemically synthesized
aaacagcatctggcagtgttcc

SEQ ID NO: 1015545 - DNA, 22 bp, Artificial Sequence
  chemically synthesized
ctactcatacttgtggaacact

SEQ ID NO: 1015546 - DNA, 22 bp, Artificial Sequence
  chemically synthesized
ctactactcatacttgtggaac

SEQ ID NO: 1015547 - DNA, 22 bp, Artificial Sequence
  chemically synthesized
gcagtgttccacaagtatgagt

SEQ ID NO: 1015548 - DNA, 22 bp, Artificial Sequence
  chemically synthesized
cacaagtatgagtagtagtagt

SEQ ID NO: 1015549 - DNA, 22 bp, Artificial Sequence
  chemically synthesized
ataatgacaacaactactacta

SEQ ID NO: 1015550 - DNA, 22 bp, Artificial Sequence
  chemically synthesized
agccaaatagaggtacactaat

SEQ ID NO: 1015551 - DNA, 22 bp, Artificial Sequence
  chemically synthesized
aagccaaatagaggtacactaa

SEQ ID NO: 1015552 - DNA, 22 bp, Artificial Sequence
  chemically synthesized
ttgtcattattagtgtacctct

SEQ ID NO: 1015553 - DNA, 22 bp, Artificial Sequence
  chemically synthesized
tcattattagtgtacctctatt

SEQ ID NO: 1015554 - DNA, 22 bp, Artificial Sequence
  chemically synthesized
aagtcttaagccaaatagaggt

SEQ ID NO: 1015555 - DNA, 22 bp, Artificial Sequence
  chemically synthesized
aaagtcttaagccaaatagagg

SEQ ID NO: 1015556 - DNA, 22 bp, Artificial Sequence
  chemically synthesized
ttagtgtacctctatttggctt

SEQ ID NO: 1015557 - DNA, 22 bp, Artificial Sequence
  chemically synthesized
catttaaagtcttaagccaaat

SEQ ID NO: 1015558 - DNA, 22 bp, Artificial Sequence
  chemically synthesized
gcatttaaagtcttaagccaaa

SEQ ID NO: 1015559 - DNA, 22 bp, Artificial Sequence
  chemically synthesized
gtgtacctctatttggcttaag

SEQ ID NO: 1015560 - DNA, 22 bp, Artificial Sequence
  chemically synthesized
tttgcatttaaagtcttaagcc

SEQ ID NO: 1015561 - DNA, 22 bp, Artificial Sequence
  chemically synthesized
atttgcatttaaagtcttaagc

SEQ ID NO: 1015562 - DNA, 22 bp, Artificial Sequence
  chemically synthesized
tatttgcatttaaagtcttaag

SEQ ID NO: 1015563 - DNA, 22 bp, Artificial Sequence
  chemically synthesized
tatttggcttaagactttaaat

SEQ ID NO: 1015564 - DNA, 22 bp, Artificial Sequence
  chemically synthesized
tttggcttaagactttaaatgc

SEQ ID NO: 1015565 - DNA, 22 bp, Artificial Sequence
  chemically synthesized
gtcattttatttgcatttaaag

SEQ ID NO: 1015566 - DNA, 22 bp, Artificial Sequence
  chemically synthesized
ggcttaagactttaaatgcaaa

SEQ ID NO: 1015567 - DNA, 22 bp, Artificial Sequence
  chemically synthesized
gcttaagactttaaatgcaaat

SEQ ID NO: 1015568 - DNA, 22 bp, Artificial Sequence
  chemically synthesized
tgttggtcattttatttgcatt

SEQ ID NO: 1015569 - DNA, 22 bp, Artificial Sequence
  chemically synthesized
tatgttggtcattttatttgca

SEQ ID NO: 1015570 - DNA, 22 bp, Artificial Sequence
  chemically synthesized
aagactttaaatgcaaataaaa

SEQ ID NO: 1015571 - DNA, 22 bp, Artificial Sequence
  chemically synthesized
agactttaaatgcaaataaaat

SEQ ID NO: 1015572 - DNA, 22 bp, Artificial Sequence
  chemically synthesized
agattctatgttggtcatttta

SEQ ID NO: 1015573 - DNA, 22 bp, Artificial Sequence
  chemically synthesized
taaatgcaaataaaatgaccaa

SEQ ID NO: 1015574 - DNA, 22 bp, Artificial Sequence
  chemically synthesized
aaatgcaaataaaatgaccaac

SEQ ID NO: 1015575 - DNA, 22 bp, Artificial Sequence
  chemically synthesized
aatgcaaataaaatgaccaaca

SEQ ID NO: 1015576 - DNA, 22 bp, Artificial Sequence
  chemically synthesized
gcatggctcagattctatgttg

SEQ ID NO: 1015577 - DNA, 22 bp, Artificial Sequence
  chemically synthesized
cccaccagagagacactagcat

SEQ ID NO: 1015578 - DNA, 22 bp, Artificial Sequence
  chemically synthesized
ttccccaccagagagacactag

SEQ ID NO: 1015579 - DNA, 22 bp, Artificial Sequence
  chemically synthesized
agccatgctagtgtctctctgg

SEQ ID NO: 1015580 - DNA, 22 bp, Artificial Sequence
  chemically synthesized
tgggtgggtctattccccacca

SEQ ID NO: 1015581 - DNA, 22 bp, Artificial Sequence
  chemically synthesized
atgggtgggtctattccccacc

SEQ ID NO: 1015582 - DNA, 22 bp, Artificial Sequence
  chemically synthesized
gtgtctctctggtggggaatag

SEQ ID NO: 1015583 - DNA, 22 bp, Artificial Sequence
  chemically synthesized
atttatgggtgggtctattccc

SEQ ID NO: 1015584 - DNA, 22 bp, Artificial Sequence
  chemically synthesized
taatttatgggtgggtctattc

SEQ ID NO: 1015585 - DNA, 22 bp, Artificial Sequence
  chemically synthesized
ctaatttatgggtgggtctatt

SEQ ID NO: 1015586 - DNA, 22 bp, Artificial Sequence
  chemically synthesized
tctggtggggaatagacccacc

SEQ ID NO: 1015587 - DNA, 22 bp, Artificial Sequence
  chemically synthesized
tggtggggaatagacccaccca

SEQ ID NO: 1015588 - DNA, 22 bp, Artificial Sequence
  chemically synthesized
gtggggaatagacccacccata

SEQ ID NO: 1015589 - DNA, 22 bp, Artificial Sequence
  chemically synthesized
aagaaggaatttctaatttatg

SEQ ID NO: 1015590 - DNA, 22 bp, Artificial Sequence
  chemically synthesized
tcaagaaggaatttctaattta

SEQ ID NO: 1015591 - DNA, 22 bp, Artificial Sequence
  chemically synthesized
ctcaagaaggaatttctaattt

SEQ ID NO: 1015592 - DNA, 22 bp, Artificial Sequence
  chemically synthesized
aagaaggtaatttctcaagaag

SEQ ID NO: 1015593 - DNA, 22 bp, Artificial Sequence
  chemically synthesized
gaaattccttcttgagaaatta

SEQ ID NO: 1015594 - DNA, 22 bp, Artificial Sequence
  chemically synthesized
aaattaaagaaggtaatttctc

SEQ ID NO: 1015595 - DNA, 22 bp, Artificial Sequence
  chemically synthesized
cttcttgagaaattaccttctt

SEQ ID NO: 1015596 - DNA, 22 bp, Artificial Sequence
  chemically synthesized
agtcctgaaattaaagaaggta

SEQ ID NO: 1015597 - DNA, 22 bp, Artificial Sequence
  chemically synthesized
aagtcctgaaattaaagaaggt

SEQ ID NO: 1015598 - DNA, 22 bp, Artificial Sequence
  chemically synthesized
cttgagaaattaccttctttaa

SEQ ID NO: 1015599 - DNA, 22 bp, Artificial Sequence
  chemically synthesized
taagtcctgaaattaaagaagg

SEQ ID NO: 1015600 - DNA, 22 bp, Artificial Sequence
  chemically synthesized
ttgagaaattaccttctttaat

SEQ ID NO: 1015601 - DNA, 22 bp, Artificial Sequence
  chemically synthesized
gagaaattaccttctttaattt

SEQ ID NO: 1015602 - DNA, 22 bp, Artificial Sequence
  chemically synthesized
agaaattaccttctttaatttc

SEQ ID NO: 1015603 - DNA, 22 bp, Artificial Sequence
  chemically synthesized
aatactttaagtcctgaaatta

SEQ ID NO: 1015604 - DNA, 22 bp, Artificial Sequence
  chemically synthesized
aaatactttaagtcctgaaatt

SEQ ID NO: 1015605 - DNA, 22 bp, Artificial Sequence
  chemically synthesized
tttaaatactttaagtcctgaa

SEQ ID NO: 1015606 - DNA, 22 bp, Artificial Sequence
  chemically synthesized
ccttctttaatttcaggactta

SEQ ID NO: 1015607 - DNA, 22 bp, Artificial Sequence
  chemically synthesized
cctatttaaatactttaagtcc

SEQ ID NO: 1015608 - DNA, 22 bp, Artificial Sequence
  chemically synthesized
ctttaatttcaggacttaaagt

SEQ ID NO: 1015609 - DNA, 22 bp, Artificial Sequence
  chemically synthesized
tttaatttcaggacttaaagta

SEQ ID NO: 1015610 - DNA, 22 bp, Artificial Sequence
  chemically synthesized
taatttcaggacttaaagtatt

SEQ ID NO: 1015611 - DNA, 22 bp, Artificial Sequence
  chemically synthesized
aatttcaggacttaaagtattt

SEQ ID NO: 1015612 - DNA, 22 bp, Artificial Sequence
  chemically synthesized
atttcaggacttaaagtattta

SEQ ID NO: 1015613 - DNA, 22 bp, Artificial Sequence
  chemically synthesized
atgacactgcctatttaaatac

SEQ ID NO: 1015614 - DNA, 22 bp, Artificial Sequence
  chemically synthesized
caggacttaaagtatttaaata

SEQ ID NO: 1015615 - DNA, 22 bp, Artificial Sequence
  chemically synthesized
aggacttaaagtatttaaatag

SEQ ID NO: 1015616 - DNA, 22 bp, Artificial Sequence
  chemically synthesized
aaagtatttaaataggcagtgt

SEQ ID NO: 1015617 - DNA, 22 bp, Artificial Sequence
  chemically synthesized
aagtatttaaataggcagtgtc

SEQ ID NO: 1015618 - DNA, 22 bp, Artificial Sequence
  chemically synthesized
atcagcaggctaatgacactgc

SEQ ID NO: 1015619 - DNA, 22 bp, Artificial Sequence
  chemically synthesized
catcagcaggctaatgacactg

SEQ ID NO: 1015620 - DNA, 22 bp, Artificial Sequence
  chemically synthesized
aaataggcagtgtcattagcct

SEQ ID NO: 1015621 - DNA, 22 bp, Artificial Sequence
  chemically synthesized
aataggcagtgtcattagcctg

SEQ ID NO: 1015622 - DNA, 22 bp, Artificial Sequence
  chemically synthesized
agatttcatcagcaggctaatg

SEQ ID NO: 1015623 - DNA, 22 bp, Artificial Sequence
  chemically synthesized
aaataatgattcagatttcatc

SEQ ID NO: 1015624 - DNA, 22 bp, Artificial Sequence
  chemically synthesized
gcctgctgatgaaatctgaatc

SEQ ID NO: 1015625 - DNA, 22 bp, Artificial Sequence
  chemically synthesized
tgctgaaataatgattcagatt

SEQ ID NO: 1015626 - DNA, 22 bp, Artificial Sequence
  chemically synthesized
tatgctgaaataatgattcaga

SEQ ID NO: 1015627 - DNA, 22 bp, Artificial Sequence
  chemically synthesized
ctgatgaaatctgaatcattat

SEQ ID NO: 1015628 - DNA, 22 bp, Artificial Sequence
  chemically synthesized
atgaaatctgaatcattatttc

SEQ ID NO: 1015629 - DNA, 22 bp, Artificial Sequence
  chemically synthesized
aatcattatttcagcatagaat

SEQ ID NO: 1015630 - DNA, 22 bp, Artificial Sequence
  chemically synthesized
tttcagcatagaatccatggtt

SEQ ID NO: 1015631 - DNA, 22 bp, Artificial Sequence
  chemically synthesized
cagcatagaatccatggttggc

SEQ ID NO: 1015632 - DNA, 22 bp, Artificial Sequence
  chemically synthesized
agcatagaatccatggttggcc

SEQ ID NO: 1015633 - DNA, 22 bp, Artificial Sequence
  chemically synthesized
agggataggcatggccaaccat

SEQ ID NO: 1015634 - DNA, 22 bp, Artificial Sequence
  chemically synthesized
gccatgcctatccctgagtaca

SEQ ID NO: 1015635 - DNA, 22 bp, Artificial Sequence
  chemically synthesized
aaaagtaaatatatgtaatgta

SEQ ID NO: 1015636 - DNA, 22 bp, Artificial Sequence
  chemically synthesized
aaaaagtaaatatatgtaatgt

SEQ ID NO: 1015637 - DNA, 22 bp, Artificial Sequence
  chemically synthesized
tccctgagtacattacatatat

SEQ ID NO: 1015638 - DNA, 22 bp, Artificial Sequence
  chemically synthesized
agtacattacatatatttactt

SEQ ID NO: 1015639 - DNA, 22 bp, Artificial Sequence
  chemically synthesized
acaacaaaaagcatttaaaaag

SEQ ID NO: 1015640 - DNA, 22 bp, Artificial Sequence
  chemically synthesized
cacaacaaaaagcatttaaaaa

SEQ ID NO: 1015641 - DNA, 22 bp, Artificial Sequence
  chemically synthesized
catatatttactttttaaatgc

SEQ ID NO: 1015642 - DNA, 22 bp, Artificial Sequence
  chemically synthesized
tgtttcacaacaaaaagcattt

SEQ ID NO: 1015643 - DNA, 22 bp, Artificial Sequence
  chemically synthesized
actttttaaatgctttttgttg

SEQ ID NO: 1015644 - DNA, 22 bp, Artificial Sequence
  chemically synthesized
tattatgtttcacaacaaaaag

SEQ ID NO: 1015645 - DNA, 22 bp, Artificial Sequence
  chemically synthesized
ctttttaaatgctttttgttgt

SEQ ID NO: 1015646 - DNA, 22 bp, Artificial Sequence
  chemically synthesized
tttaaatgctttttgttgtgaa

SEQ ID NO: 1015647 - DNA, 22 bp, Artificial Sequence
  chemically synthesized
cctatattatgtttcacaacaa

SEQ ID NO: 1015648 - DNA, 22 bp, Artificial Sequence
  chemically synthesized
ttaaatgctttttgttgtgaaa

SEQ ID NO: 1015649 - DNA, 22 bp, Artificial Sequence
  chemically synthesized
taaatgctttttgttgtgaaac

SEQ ID NO: 1015650 - DNA, 22 bp, Artificial Sequence
  chemically synthesized
aaatgctttttgttgtgaaaca

SEQ ID NO: 1015651 - DNA, 22 bp, Artificial Sequence
  chemically synthesized
aatgctttttgttgtgaaacat

SEQ ID NO: 1015652 - DNA, 22 bp, Artificial Sequence
  chemically synthesized
tttgttgtgaaacataatatag

SEQ ID NO: 1015653 - DNA, 22 bp, Artificial Sequence
  chemically synthesized
ttgttgtgaaacataatatagg

SEQ ID NO: 1015654 - DNA, 22 bp, Artificial Sequence
  chemically synthesized
tatgaatggttccctatattat

SEQ ID NO: 1015655 - DNA, 22 bp, Artificial Sequence
  chemically synthesized
tgttgtgaaacataatataggg

SEQ ID NO: 1015656 - DNA, 22 bp, Artificial Sequence
  chemically synthesized
atatgaatggttccctatatta

SEQ ID NO: 1015657 - DNA, 22 bp, Artificial Sequence
  chemically synthesized
gttgtgaaacataatataggga

SEQ ID NO: 1015658 - DNA, 22 bp, Artificial Sequence
  chemically synthesized
ttgtgaaacataatatagggaa

SEQ ID NO: 1015659 - DNA, 22 bp, Artificial Sequence
  chemically synthesized
tgaaacataatatagggaacca

SEQ ID NO: 1015660 - DNA, 22 bp, Artificial Sequence
  chemically synthesized
ggtgatggtcaccatgggttta

SEQ ID NO: 1015661 - DNA, 22 bp, Artificial Sequence
  chemically synthesized
gtctgggtgatggtcaccatgg

SEQ ID NO: 1015662 - DNA, 22 bp, Artificial Sequence
  chemically synthesized
ggtctgggtgatggtcaccatg

SEQ ID NO: 1015663 - DNA, 22 bp, Artificial Sequence
  chemically synthesized
ttggtctgggtgatggtcacca

SEQ ID NO: 1015664 - DNA, 22 bp, Artificial Sequence
  chemically synthesized
atataaacccatggtgaccatc

SEQ ID NO: 1015665 - DNA, 22 bp, Artificial Sequence
  chemically synthesized
cttggtctgggtgatggtcacc

SEQ ID NO: 1015666 - DNA, 22 bp, Artificial Sequence
  chemically synthesized
tttcttggtctgggtgatggtc

SEQ ID NO: 1015667 - DNA, 22 bp, Artificial Sequence
  chemically synthesized
atttcttggtctgggtgatggt

SEQ ID NO: 1015668 - DNA, 22 bp, Artificial Sequence
  chemically synthesized
tatttcttggtctgggtgatgg

SEQ ID NO: 1015669 - DNA, 22 bp, Artificial Sequence
  chemically synthesized
gaagttttatttcttggtctgg

SEQ ID NO: 1015670 - DNA, 22 bp, Artificial Sequence
  chemically synthesized
ctggaagttttatttcttggtc

SEQ ID NO: 1015671 - DNA, 22 bp, Artificial Sequence
  chemically synthesized
gctgctggaagttttatttctt

SEQ ID NO: 1015672 - DNA, 22 bp, Artificial Sequence
  chemically synthesized
ggctgctggaagttttatttct

SEQ ID NO: 1015673 - DNA, 22 bp, Artificial Sequence
  chemically synthesized
catttggctgctggaagtttta

SEQ ID NO: 1015674 - DNA, 22 bp, Artificial Sequence
  chemically synthesized
tgatatagagtgttccatttgg

SEQ ID NO: 1015675 - DNA, 22 bp, Artificial Sequence
  chemically synthesized
ccagcagccaaatggaacactc

SEQ ID NO: 1015676 - DNA, 22 bp, Artificial Sequence
  chemically synthesized
cagcagccaaatggaacactct

SEQ ID NO: 1015677 - DNA, 22 bp, Artificial Sequence
  chemically synthesized
aaactatgatatagagtgttcc

SEQ ID NO: 1015678 - DNA, 22 bp, Artificial Sequence
  chemically synthesized
gaaactatgatatagagtgttc

SEQ ID NO: 1015679 - DNA, 22 bp, Artificial Sequence
  chemically synthesized
atcttgaaactatgatatagag

SEQ ID NO: 1015680 - DNA, 22 bp, Artificial Sequence
  chemically synthesized
tatatcatagtttcaagattaa

SEQ ID NO: 1015681 - DNA, 22 bp, Artificial Sequence
  chemically synthesized
tatcatagtttcaagattaatc

SEQ ID NO: 1015682 - DNA, 22 bp, Artificial Sequence
  chemically synthesized
ataagcaaagaggtagattaat

SEQ ID NO: 1015683 - DNA, 22 bp, Artificial Sequence
  chemically synthesized
caagattaatctacctctttgc

SEQ ID NO: 1015684 - DNA, 22 bp, Artificial Sequence
  chemically synthesized
aagattaatctacctctttgct

SEQ ID NO: 1015685 - DNA, 22 bp, Artificial Sequence
  chemically synthesized
atcaacaactaataagcaaaga

SEQ ID NO: 1015686 - DNA, 22 bp, Artificial Sequence
  chemically synthesized
atctacctctttgcttattagt

SEQ ID NO: 1015687 - DNA, 22 bp, Artificial Sequence
  chemically synthesized
cctctttgcttattagttgttg

SEQ ID NO: 1015688 - DNA, 22 bp, Artificial Sequence
  chemically synthesized
tttgcttattagttgttgatta

SEQ ID NO: 1015689 - DNA, 22 bp, Artificial Sequence
  chemically synthesized
tgcttattagttgttgattaat

SEQ ID NO: 1015690 - DNA, 22 bp, Artificial Sequence
  chemically synthesized
gcttattagttgttgattaatt

SEQ ID NO: 1015691 - DNA, 22 bp, Artificial Sequence
  chemically synthesized
cttattagttgttgattaattt

SEQ ID NO: 1015692 - DNA, 22 bp, Artificial Sequence
  chemically synthesized
attagttgttgattaatttctc

SEQ ID NO: 1015693 - DNA, 22 bp, Artificial Sequence
  chemically synthesized
ttagttgttgattaatttctca

SEQ ID NO: 1015694 - DNA, 22 bp, Artificial Sequence
  chemically synthesized
agacaatcatacagtgagaaat

SEQ ID NO: 1015695 - DNA, 22 bp, Artificial Sequence
  chemically synthesized
gttgttgattaatttctcactg

SEQ ID NO: 1015696 - DNA, 22 bp, Artificial Sequence
  chemically synthesized
ttgattaatttctcactgtatg

SEQ ID NO: 1015697 - DNA, 22 bp, Artificial Sequence
  chemically synthesized
attaatttctcactgtatgatt

SEQ ID NO: 1015698 - DNA, 22 bp, Artificial Sequence
  chemically synthesized
atttctcactgtatgattgtct

SEQ ID NO: 1015699 - DNA, 22 bp, Artificial Sequence
  chemically synthesized
ctcactgtatgattgtcttagt

SEQ ID NO: 1015700 - DNA, 22 bp, Artificial Sequence
  chemically synthesized
tcactgtatgattgtcttagtc

SEQ ID NO: 1015701 - DNA, 22 bp, Artificial Sequence
  chemically synthesized
actgtatgattgtcttagtctg

SEQ ID NO: 1015702 - DNA, 22 bp, Artificial Sequence
  chemically synthesized
taacagcacaaacagactaaga

SEQ ID NO: 1015703 - DNA, 22 bp, Artificial Sequence
  chemically synthesized
ttataacagcacaaacagacta

SEQ ID NO: 1015704 - DNA, 22 bp, Artificial Sequence
  chemically synthesized
tatgattgtcttagtctgtttg

SEQ ID NO: 1015705 - DNA, 22 bp, Artificial Sequence
  chemically synthesized
gttataacagcacaaacagact

SEQ ID NO: 1015706 - DNA, 22 bp, Artificial Sequence
  chemically synthesized
tgttataacagcacaaacagac

SEQ ID NO: 1015707 - DNA, 22 bp, Artificial Sequence
  chemically synthesized
tcttagtctgtttgtgctgtta

SEQ ID NO: 1015708 - DNA, 22 bp, Artificial Sequence
  chemically synthesized
aggcattttgttataacagcac

SEQ ID NO: 1015709 - DNA, 22 bp, Artificial Sequence
  chemically synthesized
agtctgtttgtgctgttataac

SEQ ID NO: 1015710 - DNA, 22 bp, Artificial Sequence
  chemically synthesized
gtctgtttgtgctgttataaca

SEQ ID NO: 1015711 - DNA, 22 bp, Artificial Sequence
  chemically synthesized
tttgtgctgttataacaaaatg

SEQ ID NO: 1015712 - DNA, 22 bp, Artificial Sequence
  chemically synthesized
cccagtctcaggcattttgtta

SEQ ID NO: 1015713 - DNA, 22 bp, Artificial Sequence
  chemically synthesized
gtgctgttataacaaaatgcct

SEQ ID NO: 1015714 - DNA, 22 bp, Artificial Sequence
  chemically synthesized
tgctgttataacaaaatgcctg

SEQ ID NO: 1015715 - DNA, 22 bp, Artificial Sequence
  chemically synthesized
taaattacccagtctcaggcat

SEQ ID NO: 1015716 - DNA, 22 bp, Artificial Sequence
  chemically synthesized
gtaaattacccagtctcaggca

SEQ ID NO: 1015717 - DNA, 22 bp, Artificial Sequence
  chemically synthesized
ttataacaaaatgcctgagact

SEQ ID NO: 1015718 - DNA, 22 bp, Artificial Sequence
  chemically synthesized
tttgtaaattacccagtctcag

SEQ ID NO: 1015719 - DNA, 22 bp, Artificial Sequence
  chemically synthesized
taacaaaatgcctgagactggg

SEQ ID NO: 1015720 - DNA, 22 bp, Artificial Sequence
  chemically synthesized
gtattatttgtaaattacccag

SEQ ID NO: 1015721 - DNA, 22 bp, Artificial Sequence
  chemically synthesized
agactgggtaatttacaaataa

SEQ ID NO: 1015722 - DNA, 22 bp, Artificial Sequence
  chemically synthesized
ggtaatttacaaataataccaa

SEQ ID NO: 1015723 - DNA, 22 bp, Artificial Sequence
  chemically synthesized
tgagtgaatacattggtattat

SEQ ID NO: 1015724 - DNA, 22 bp, Artificial Sequence
  chemically synthesized
acaaataataccaatgtattca

SEQ ID NO: 1015725 - DNA, 22 bp, Artificial Sequence
  chemically synthesized
cagaactgtgagtgaatacatt

SEQ ID NO: 1015726 - DNA, 22 bp, Artificial Sequence
  chemically synthesized
caaataataccaatgtattcac

SEQ ID NO: 1015727 - DNA, 22 bp, Artificial Sequence
  chemically synthesized
ccagcctccagaactgtgagtg

SEQ ID NO: 1015728 - DNA, 22 bp, Artificial Sequence
  chemically synthesized
cccagcctccagaactgtgagt

SEQ ID NO: 1015729 - DNA, 22 bp, Artificial Sequence
  chemically synthesized
gacttcccagcctccagaactg

SEQ ID NO: 1015730 - DNA, 22 bp, Artificial Sequence
  chemically synthesized
ggacttcccagcctccagaact

SEQ ID NO: 1015731 - DNA, 22 bp, Artificial Sequence
  chemically synthesized
tcttggacttcccagcctccag

SEQ ID NO: 1015732 - DNA, 22 bp, Artificial Sequence
  chemically synthesized
atcttggacttcccagcctcca

SEQ ID NO: 1015733 - DNA, 22 bp, Artificial Sequence
  chemically synthesized
actcacagttctggaggctggg

SEQ ID NO: 1015734 - DNA, 22 bp, Artificial Sequence
  chemically synthesized
tatcttggacttcccagcctcc

SEQ ID NO: 1015735 - DNA, 22 bp, Artificial Sequence
  chemically synthesized
acagttctggaggctgggaagt

SEQ ID NO: 1015736 - DNA, 22 bp, Artificial Sequence
  chemically synthesized
tggaggctgggaagtccaagat

SEQ ID NO: 1015737 - DNA, 22 bp, Artificial Sequence
  chemically synthesized
gaggctgggaagtccaagataa

SEQ ID NO: 1015738 - DNA, 22 bp, Artificial Sequence
  chemically synthesized
ggaagtccaagataaaggctct

SEQ ID NO: 1015739 - DNA, 22 bp, Artificial Sequence
  chemically synthesized
accagacaccaaatgccagagc

SEQ ID NO: 1015740 - DNA, 22 bp, Artificial Sequence
  chemically synthesized
tggcatttggtgtctggtgagg

SEQ ID NO: 1015741 - DNA, 22 bp, Artificial Sequence
  chemically synthesized
gcatttggtgtctggtgagggc

SEQ ID NO: 1015742 - DNA, 22 bp, Artificial Sequence
  chemically synthesized
ggtgtctggtgagggccttcct

SEQ ID NO: 1015743 - DNA, 22 bp, Artificial Sequence
  chemically synthesized
tgaagatacagcaggaaggccc

SEQ ID NO: 1015744 - DNA, 22 bp, Artificial Sequence
  chemically synthesized
gtgtctggtgagggccttcctg

SEQ ID NO: 1015745 - DNA, 22 bp, Artificial Sequence
  chemically synthesized
gtgaagatacagcaggaaggcc

SEQ ID NO: 1015746 - DNA, 22 bp, Artificial Sequence
  chemically synthesized
ccttgtgaagatacagcaggaa

SEQ ID NO: 1015747 - DNA, 22 bp, Artificial Sequence
  chemically synthesized
tgccttgtgaagatacagcagg

SEQ ID NO: 1015748 - DNA, 22 bp, Artificial Sequence
  chemically synthesized
gtgagggccttcctgctgtatc

SEQ ID NO: 1015749 - DNA, 22 bp, Artificial Sequence
  chemically synthesized
ctgccttgtgaagatacagcag

SEQ ID NO: 1015750 - DNA, 22 bp, Artificial Sequence
  chemically synthesized
ccttctgccttgtgaagataca

SEQ ID NO: 1015751 - DNA, 22 bp, Artificial Sequence
  chemically synthesized
taccttctgccttgtgaagata

SEQ ID NO: 1015752 - DNA, 22 bp, Artificial Sequence
  chemically synthesized
ctaccttctgccttgtgaagat

SEQ ID NO: 1015753 - DNA, 22 bp, Artificial Sequence
  chemically synthesized
cctgctgtatcttcacaaggca

SEQ ID NO: 1015754 - DNA, 22 bp, Artificial Sequence
  chemically synthesized
ctgctgtatcttcacaaggcag

SEQ ID NO: 1015755 - DNA, 22 bp, Artificial Sequence
  chemically synthesized
cccttctaccttctgccttgtg

SEQ ID NO: 1015756 - DNA, 22 bp, Artificial Sequence
  chemically synthesized
gcccttctaccttctgccttgt

SEQ ID NO: 1015757 - DNA, 22 bp, Artificial Sequence
  chemically synthesized
ctgtatcttcacaaggcagaag

SEQ ID NO: 1015758 - DNA, 22 bp, Artificial Sequence
  chemically synthesized
ttgcccttctaccttctgcctt

SEQ ID NO: 1015759 - DNA, 22 bp, Artificial Sequence
  chemically synthesized
tcttgcccttctaccttctgcc

SEQ ID NO: 1015760 - DNA, 22 bp, Artificial Sequence
  chemically synthesized
tatcttcacaaggcagaaggta

SEQ ID NO: 1015761 - DNA, 22 bp, Artificial Sequence
  chemically synthesized
ctctcttgcccttctaccttct

SEQ ID NO: 1015762 - DNA, 22 bp, Artificial Sequence
  chemically synthesized
gctctcttgcccttctaccttc

SEQ ID NO: 1015763 - DNA, 22 bp, Artificial Sequence
  chemically synthesized
cacaaggcagaaggtagaaggg

SEQ ID NO: 1015764 - DNA, 22 bp, Artificial Sequence
  chemically synthesized
acaaggcagaaggtagaagggc

SEQ ID NO: 1015765 - DNA, 22 bp, Artificial Sequence
  chemically synthesized
agtcagcttgctctcttgccct

SEQ ID NO: 1015766 - DNA, 22 bp, Artificial Sequence
  chemically synthesized
acgcagcattcagtcagcttgc

SEQ ID NO: 1015767 - DNA, 22 bp, Artificial Sequence
  chemically synthesized
cacgcagcattcagtcagcttg

SEQ ID NO: 1015768 - DNA, 22 bp, Artificial Sequence
  chemically synthesized
taaacaaggcttcacgcagcat

SEQ ID NO: 1015769 - DNA, 22 bp, Artificial Sequence
  chemically synthesized
ataaacaaggcttcacgcagca

SEQ ID NO: 1015770 - DNA, 22 bp, Artificial Sequence
  chemically synthesized
actgaatgctgcgtgaagcctt

SEQ ID NO: 1015771 - DNA, 22 bp, Artificial Sequence
  chemically synthesized
aatgctgcgtgaagccttgttt

SEQ ID NO: 1015772 - DNA, 22 bp, Artificial Sequence
  chemically synthesized
cgtgaagccttgtttataaggg

SEQ ID NO: 1015773 - DNA, 22 bp, Artificial Sequence
  chemically synthesized
ataaaaataagacccttataaa

SEQ ID NO: 1015774 - DNA, 22 bp, Artificial Sequence
  chemically synthesized
ttaataaaaataagacccttat

SEQ ID NO: 1015775 - DNA, 22 bp, Artificial Sequence
  chemically synthesized
gttaataaaaataagaccctta

SEQ ID NO: 1015776 - DNA, 22 bp, Artificial Sequence
  chemically synthesized
tgttaataaaaataagaccctt

SEQ ID NO: 1015777 - DNA, 22 bp, Artificial Sequence
  chemically synthesized
tttgttaataaaaataagaccc

SEQ ID NO: 1015778 - DNA, 22 bp, Artificial Sequence
  chemically synthesized
ctttgttaataaaaataagacc

SEQ ID NO: 1015779 - DNA, 22 bp, Artificial Sequence
  chemically synthesized
gtttataagggtcttattttta

SEQ ID NO: 1015780 - DNA, 22 bp, Artificial Sequence
  chemically synthesized
cttctttgttaataaaaataag

SEQ ID NO: 1015781 - DNA, 22 bp, Artificial Sequence
  chemically synthesized
tttataagggtcttatttttat

SEQ ID NO: 1015782 - DNA, 22 bp, Artificial Sequence
  chemically synthesized
ataagggtcttatttttattaa

SEQ ID NO: 1015783 - DNA, 22 bp, Artificial Sequence
  chemically synthesized
taagggtcttatttttattaac

SEQ ID NO: 1015784 - DNA, 22 bp, Artificial Sequence
  chemically synthesized
ggccatgagggctccttctttg

SEQ ID NO: 1015785 - DNA, 22 bp, Artificial Sequence
  chemically synthesized
atttttattaacaaagaaggag

SEQ ID NO: 1015786 - DNA, 22 bp, Artificial Sequence
  chemically synthesized
tttttattaacaaagaaggagc

SEQ ID NO: 1015787 - DNA, 22 bp, Artificial Sequence
  chemically synthesized
ttattaacaaagaaggagccct

SEQ ID NO: 1015788 - DNA, 22 bp, Artificial Sequence
  chemically synthesized
tattaacaaagaaggagccctc

SEQ ID NO: 1015789 - DNA, 22 bp, Artificial Sequence
  chemically synthesized
attaacaaagaaggagccctca

SEQ ID NO: 1015790 - DNA, 22 bp, Artificial Sequence
  chemically synthesized
ttaacaaagaaggagccctcat

SEQ ID NO: 1015791 - DNA, 22 bp, Artificial Sequence
  chemically synthesized
acaaagaaggagccctcatggc

SEQ ID NO: 1015792 - DNA, 22 bp, Artificial Sequence
  chemically synthesized
agtggtgattaggccatgaggg

SEQ ID NO: 1015793 - DNA, 22 bp, Artificial Sequence
  chemically synthesized
aagtggtgattaggccatgagg

SEQ ID NO: 1015794 - DNA, 22 bp, Artificial Sequence
  chemically synthesized
agaggtagggtgtttaagtggt

SEQ ID NO: 1015795 - DNA, 22 bp, Artificial Sequence
  chemically synthesized
atggcctaatcaccacttaaac

SEQ ID NO: 1015796 - DNA, 22 bp, Artificial Sequence
  chemically synthesized
gtactaagaggtagggtgttta

SEQ ID NO: 1015797 - DNA, 22 bp, Artificial Sequence
  chemically synthesized
atcaccacttaaacaccctacc

SEQ ID NO: 1015798 - DNA, 22 bp, Artificial Sequence
  chemically synthesized
aaacaccctacctcttagtact

SEQ ID NO: 1015799 - DNA, 22 bp, Artificial Sequence
  chemically synthesized
aacaccctacctcttagtacta

SEQ ID NO: 1015800 - DNA, 22 bp, Artificial Sequence
  chemically synthesized
aggtgtcgataatgtgctagta

SEQ ID NO: 1015801 - DNA, 22 bp, Artificial Sequence
  chemically synthesized
cctcttagtactagcacattat

SEQ ID NO: 1015802 - DNA, 22 bp, Artificial Sequence
  chemically synthesized
caaattcaggtgtcgataatgt

SEQ ID NO: 1015803 - DNA, 22 bp, Artificial Sequence
  chemically synthesized
ttagtactagcacattatcgac

SEQ ID NO: 1015804 - DNA, 22 bp, Artificial Sequence
  chemically synthesized
ccaaattcaggtgtcgataatg

SEQ ID NO: 1015805 - DNA, 22 bp, Artificial Sequence
  chemically synthesized
tccaaattcaggtgtcgataat

SEQ ID NO: 1015806 - DNA, 22 bp, Artificial Sequence
  chemically synthesized
agtactagcacattatcgacac

SEQ ID NO: 1015807 - DNA, 22 bp, Artificial Sequence
  chemically synthesized
gtactagcacattatcgacacc

SEQ ID NO: 1015808 - DNA, 22 bp, Artificial Sequence
  chemically synthesized
tttccaaattcaggtgtcgata

SEQ ID NO: 1015809 - DNA, 22 bp, Artificial Sequence
  chemically synthesized
gcacattatcgacacctgaatt

SEQ ID NO: 1015810 - DNA, 22 bp, Artificial Sequence
  chemically synthesized
aatgtgtctctttccaaattca

SEQ ID NO: 1015811 - DNA, 22 bp, Artificial Sequence
  chemically synthesized
gaatgtgtctctttccaaattc

SEQ ID NO: 1015812 - DNA, 22 bp, Artificial Sequence
  chemically synthesized
tcgacacctgaatttggaaaga

SEQ ID NO: 1015813 - DNA, 22 bp, Artificial Sequence
  chemically synthesized
tagtttgaatgtgtctctttcc

SEQ ID NO: 1015814 - DNA, 22 bp, Artificial Sequence
  chemically synthesized
ctatagtttgaatgtgtctctt

SEQ ID NO: 1015815 - DNA, 22 bp, Artificial Sequence
  chemically synthesized
gctatagtttgaatgtgtctct

SEQ ID NO: 1015816 - DNA, 22 bp, Artificial Sequence
  chemically synthesized
aatttggaaagagacacattca

SEQ ID NO: 1015817 - DNA, 22 bp, Artificial Sequence
  chemically synthesized
ggaaagagacacattcaaacta

SEQ ID NO: 1015818 - DNA, 22 bp, Artificial Sequence
  chemically synthesized
gaaagagacacattcaaactat

SEQ ID NO: 1015819 - DNA, 22 bp, Artificial Sequence
  chemically synthesized
atagtaaaatttgctatagttt

SEQ ID NO: 1015820 - DNA, 22 bp, Artificial Sequence
  chemically synthesized
ttaatagtaaaatttgctatag

SEQ ID NO: 1015821 - DNA, 22 bp, Artificial Sequence
  chemically synthesized
attaatagtaaaatttgctata

SEQ ID NO: 1015822 - DNA, 22 bp, Artificial Sequence
  chemically synthesized
agtatttattaatagtaaaatt

SEQ ID NO: 1015823 - DNA, 22 bp, Artificial Sequence
  chemically synthesized
aaactatagcaaattttactat

SEQ ID NO: 1015824 - DNA, 22 bp, Artificial Sequence
  chemically synthesized
cagtatttattaatagtaaaat

SEQ ID NO: 1015825 - DNA, 22 bp, Artificial Sequence
  chemically synthesized
cttcagtatttattaatagtaa

SEQ ID NO: 1015826 - DNA, 22 bp, Artificial Sequence
  chemically synthesized
tagcaaattttactattaataa

SEQ ID NO: 1015827 - DNA, 22 bp, Artificial Sequence
  chemically synthesized
tactattaataaatactgaagt

SEQ ID NO: 1015828 - DNA, 22 bp, Artificial Sequence
  chemically synthesized
actattaataaatactgaagta

SEQ ID NO: 1015829 - DNA, 22 bp, Artificial Sequence
  chemically synthesized
ctattaataaatactgaagtag

SEQ ID NO: 1015830 - DNA, 22 bp, Artificial Sequence
  chemically synthesized
ttaataaatactgaagtagttt

SEQ ID NO: 1015831 - DNA, 22 bp, Artificial Sequence
  chemically synthesized
ataaatactgaagtagttttgg

SEQ ID NO: 1015832 - DNA, 22 bp, Artificial Sequence
  chemically synthesized
aagtagttttggtttggggcta

SEQ ID NO: 1015833 - DNA, 22 bp, Artificial Sequence
  chemically synthesized
tggtttggggctattactatgc

SEQ ID NO: 1015834 - DNA, 22 bp, Artificial Sequence
  chemically synthesized
ggtttggggctattactatgct

SEQ ID NO: 1015835 - DNA, 22 bp, Artificial Sequence
  chemically synthesized
gtttggggctattactatgctg

SEQ ID NO: 1015836 - DNA, 22 bp, Artificial Sequence
  chemically synthesized
ggaatgtcatagcagcatagta

SEQ ID NO: 1015837 - DNA, 22 bp, Artificial Sequence
  chemically synthesized
gggaatgtcatagcagcatagt

SEQ ID NO: 1015838 - DNA, 22 bp, Artificial Sequence
  chemically synthesized
ggggctattactatgctgctat

SEQ ID NO: 1015839 - DNA, 22 bp, Artificial Sequence
  chemically synthesized
gggctattactatgctgctatg

SEQ ID NO: 1015840 - DNA, 22 bp, Artificial Sequence
  chemically synthesized
ttactatgctgctatgacattc

SEQ ID NO: 1015841 - DNA, 22 bp, Artificial Sequence
  chemically synthesized
ctatgctgctatgacattccca

SEQ ID NO: 1015842 - DNA, 22 bp, Artificial Sequence
  chemically synthesized
caggagacatgtttgggaatgt

SEQ ID NO: 1015843 - DNA, 22 bp, Artificial Sequence
  chemically synthesized
tgctgctatgacattcccaaac

SEQ ID NO: 1015844 - DNA, 22 bp, Artificial Sequence
  chemically synthesized
atattccaggagacatgtttgg

SEQ ID NO: 1015845 - DNA, 22 bp, Artificial Sequence
  chemically synthesized
ctatgacattcccaaacatgtc

SEQ ID NO: 1015846 - DNA, 22 bp, Artificial Sequence
  chemically synthesized
tgacattcccaaacatgtctcc

SEQ ID NO: 1015847 - DNA, 22 bp, Artificial Sequence
  chemically synthesized
ccaaacatgtctcctggaatat

SEQ ID NO: 1015848 - DNA, 22 bp, Artificial Sequence
  chemically synthesized
cagaaatgcatatgttcatatt

SEQ ID NO: 1015849 - DNA, 22 bp, Artificial Sequence
  chemically synthesized
tacagaaatgcatatgttcata

SEQ ID NO: 1015850 - DNA, 22 bp, Artificial Sequence
  chemically synthesized
ctggaatatgaacatatgcatt

SEQ ID NO: 1015851 - DNA, 22 bp, Artificial Sequence
  chemically synthesized
gaatatgaacatatgcatttct

SEQ ID NO: 1015852 - DNA, 22 bp, Artificial Sequence
  chemically synthesized
tatatacactctacagaaatgc

SEQ ID NO: 1015853 - DNA, 22 bp, Artificial Sequence
  chemically synthesized
tatatatacactctacagaaat

SEQ ID NO: 1015854 - DNA, 22 bp, Artificial Sequence
  chemically synthesized
ctatatatacactctacagaaa

SEQ ID NO: 1015855 - DNA, 22 bp, Artificial Sequence
  chemically synthesized
acttctatatatacactctaca

SEQ ID NO: 1015856 - DNA, 22 bp, Artificial Sequence
  chemically synthesized
cacttctatatatacactctac

SEQ ID NO: 1015857 - DNA, 22 bp, Artificial Sequence
  chemically synthesized
ctgtagagtgtatatatagaag

SEQ ID NO: 1015858 - DNA, 22 bp, Artificial Sequence
  chemically synthesized
tgtagagtgtatatatagaagt

SEQ ID NO: 1015859 - DNA, 22 bp, Artificial Sequence
  chemically synthesized
tagagtgtatatatagaagtga

SEQ ID NO: 1015860 - DNA, 22 bp, Artificial Sequence
  chemically synthesized
tagcccaccaatttcacttcta

SEQ ID NO: 1015861 - DNA, 22 bp, Artificial Sequence
  chemically synthesized
cataacctatagcccaccaatt

SEQ ID NO: 1015862 - DNA, 22 bp, Artificial Sequence
  chemically synthesized
aaagatctgcataacctatagc

SEQ ID NO: 1015863 - DNA, 22 bp, Artificial Sequence
  chemically synthesized
gtgggctataggttatgcagat

SEQ ID NO: 1015864 - DNA, 22 bp, Artificial Sequence
  chemically synthesized
gtaaattcaaagatctgcataa

SEQ ID NO: 1015865 - DNA, 22 bp, Artificial Sequence
  chemically synthesized
agtaaattcaaagatctgcata

SEQ ID NO: 1015866 - DNA, 22 bp, Artificial Sequence
  chemically synthesized
tttagtaaattcaaagatctgc

SEQ ID NO: 1015867 - DNA, 22 bp, Artificial Sequence
  chemically synthesized
taggttatgcagatctttgaat

SEQ ID NO: 1015868 - DNA, 22 bp, Artificial Sequence
  chemically synthesized
gcactatttagtaaattcaaag

SEQ ID NO: 1015869 - DNA, 22 bp, Artificial Sequence
  chemically synthesized
ggcactatttagtaaattcaaa

SEQ ID NO: 1015870 - DNA, 22 bp, Artificial Sequence
  chemically synthesized
tgcagatctttgaatttactaa

SEQ ID NO: 1015871 - DNA, 22 bp, Artificial Sequence
  chemically synthesized
tgaatttactaaatagtgccaa

SEQ ID NO: 1015872 - DNA, 22 bp, Artificial Sequence
  chemically synthesized
gaatttactaaatagtgccaaa

SEQ ID NO: 1015873 - DNA, 22 bp, Artificial Sequence
  chemically synthesized
gagtgaaatccatttggcacta

SEQ ID NO: 1015874 - DNA, 22 bp, Artificial Sequence
  chemically synthesized
aatttactaaatagtgccaaat

SEQ ID NO: 1015875 - DNA, 22 bp, Artificial Sequence
  chemically synthesized
ggagtgaaatccatttggcact

SEQ ID NO: 1015876 - DNA, 22 bp, Artificial Sequence
  chemically synthesized
ttggagtgaaatccatttggca

SEQ ID NO: 1015877 - DNA, 22 bp, Artificial Sequence
  chemically synthesized
cttggagtgaaatccatttggc

SEQ ID NO: 1015878 - DNA, 22 bp, Artificial Sequence
  chemically synthesized
actaaatagtgccaaatggatt

SEQ ID NO: 1015879 - DNA, 22 bp, Artificial Sequence
  chemically synthesized
ctaaatagtgccaaatggattt

SEQ ID NO: 1015880 - DNA, 22 bp, Artificial Sequence
  chemically synthesized
cttcttggagtgaaatccattt

SEQ ID NO: 1015881 - DNA, 22 bp, Artificial Sequence
  chemically synthesized
aatagtgccaaatggatttcac

SEQ ID NO: 1015882 - DNA, 22 bp, Artificial Sequence
  chemically synthesized
ctgcttcttggagtgaaatcca

SEQ ID NO: 1015883 - DNA, 22 bp, Artificial Sequence
  chemically synthesized
cactactgcttcttggagtgaa

SEQ ID NO: 1015884 - DNA, 22 bp, Artificial Sequence
  chemically synthesized
cactccaagaagcagtagtgta

SEQ ID NO: 1015885 - DNA, 22 bp, Artificial Sequence
  chemically synthesized
actccaagaagcagtagtgtaa

SEQ ID NO: 1015886 - DNA, 22 bp, Artificial Sequence
  chemically synthesized
caagaagcagtagtgtaatttt

SEQ ID NO: 1015887 - DNA, 22 bp, Artificial Sequence
  chemically synthesized
taaatagaagtgtaaaattaca

SEQ ID NO: 1015888 - DNA, 22 bp, Artificial Sequence
  chemically synthesized
tgaattgtaaatagaagtgtaa

SEQ ID NO: 1015889 - DNA, 22 bp, Artificial Sequence
  chemically synthesized
gtctgtgaattgtaaatagaag

SEQ ID NO: 1015890 - DNA, 22 bp, Artificial Sequence
  chemically synthesized
ggtctgtgaattgtaaatagaa

SEQ ID NO: 1015891 - DNA, 22 bp, Artificial Sequence
  chemically synthesized
cttggtctgtgaattgtaaata

SEQ ID NO: 1015892 - DNA, 22 bp, Artificial Sequence
  chemically synthesized
tacacttctatttacaattcac

SEQ ID NO: 1015893 - DNA, 22 bp, Artificial Sequence
  chemically synthesized
acacttctatttacaattcaca

SEQ ID NO: 1015894 - DNA, 22 bp, Artificial Sequence
  chemically synthesized
cacttctatttacaattcacag

SEQ ID NO: 1015895 - DNA, 22 bp, Artificial Sequence
  chemically synthesized
ctatttacaattcacagaccaa

SEQ ID NO: 1015896 - DNA, 22 bp, Artificial Sequence
  chemically synthesized
acacaatgttacttggtctgtg

SEQ ID NO: 1015897 - DNA, 22 bp, Artificial Sequence
  chemically synthesized
tatttacaattcacagaccaag

SEQ ID NO: 1015898 - DNA, 22 bp, Artificial Sequence
  chemically synthesized
cacacaatgttacttggtctgt

SEQ ID NO: 1015899 - DNA, 22 bp, Artificial Sequence
  chemically synthesized
tttacaattcacagaccaagta

SEQ ID NO: 1015900 - DNA, 22 bp, Artificial Sequence
  chemically synthesized
acaattcacagaccaagtaaca

SEQ ID NO: 1015901 - DNA, 22 bp, Artificial Sequence
  chemically synthesized
caattcacagaccaagtaacat

SEQ ID NO: 1015902 - DNA, 22 bp, Artificial Sequence
  chemically synthesized
gaaatttcacacaatgttactt

SEQ ID NO: 1015903 - DNA, 22 bp, Artificial Sequence
  chemically synthesized
acagaccaagtaacattgtgtg

SEQ ID NO: 1015904 - DNA, 22 bp, Artificial Sequence
  chemically synthesized
tgtgaaatttctaattgctgta

SEQ ID NO: 1015905 - DNA, 22 bp, Artificial Sequence
  chemically synthesized
catgtggtggtgagaatataca

SEQ ID NO: 1015906 - DNA, 22 bp, Artificial Sequence
  chemically synthesized
ctaattgctgtatattctcacc

SEQ ID NO: 1015907 - DNA, 22 bp, Artificial Sequence
  chemically synthesized
taattgctgtatattctcacca

SEQ ID NO: 1015908 - DNA, 22 bp, Artificial Sequence
  chemically synthesized
attgctgtatattctcaccacc

SEQ ID NO: 1015909 - DNA, 22 bp, Artificial Sequence
  chemically synthesized
acaattccatgtggtggtgaga

SEQ ID NO: 1015910 - DNA, 22 bp, Artificial Sequence
  chemically synthesized
ctgtatattctcaccaccacat

SEQ ID NO: 1015911 - DNA, 22 bp, Artificial Sequence
  chemically synthesized
tatattctcaccaccacatgga

SEQ ID NO: 1015912 - DNA, 22 bp, Artificial Sequence
  chemically synthesized
taagtctgacaattccatgtgg

SEQ ID NO: 1015913 - DNA, 22 bp, Artificial Sequence
  chemically synthesized
ataagtctgacaattccatgtg

SEQ ID NO: 1015914 - DNA, 22 bp, Artificial Sequence
  chemically synthesized
tcaccaccacatggaattgtca

SEQ ID NO: 1015915 - DNA, 22 bp, Artificial Sequence
  chemically synthesized
aaatttataagtctgacaattc

SEQ ID NO: 1015916 - DNA, 22 bp, Artificial Sequence
  chemically synthesized
accaccacatggaattgtcaga

SEQ ID NO: 1015917 - DNA, 22 bp, Artificial Sequence
  chemically synthesized
ccaaccagaatcattgaaattt

SEQ ID NO: 1015918 - DNA, 22 bp, Artificial Sequence
  chemically synthesized
accaaccagaatcattgaaatt

SEQ ID NO: 1015919 - DNA, 22 bp, Artificial Sequence
  chemically synthesized
tcagacttataaatttcaatga

SEQ ID NO: 1015920 - DNA, 22 bp, Artificial Sequence
  chemically synthesized
cttaccaaccagaatcattgaa

SEQ ID NO: 1015921 - DNA, 22 bp, Artificial Sequence
  chemically synthesized
ataaatttcaatgattctggtt

SEQ ID NO: 1015922 - DNA, 22 bp, Artificial Sequence
  chemically synthesized
taaatttcaatgattctggttg

SEQ ID NO: 1015923 - DNA, 22 bp, Artificial Sequence
  chemically synthesized
caatgattctggttggtaagca

SEQ ID NO: 1015924 - DNA, 22 bp, Artificial Sequence
  chemically synthesized
aatgattctggttggtaagcag

SEQ ID NO: 1015925 - DNA, 22 bp, Artificial Sequence
  chemically synthesized
aaatgaaatatcactgcttacc

SEQ ID NO: 1015926 - DNA, 22 bp, Artificial Sequence
  chemically synthesized
aaactaaaatgaaatatcactg

SEQ ID NO: 1015927 - DNA, 22 bp, Artificial Sequence
  chemically synthesized
tggttggtaagcagtgatattt

SEQ ID NO: 1015928 - DNA, 22 bp, Artificial Sequence
  chemically synthesized
gttggtaagcagtgatatttca

SEQ ID NO: 1015929 - DNA, 22 bp, Artificial Sequence
  chemically synthesized
gtaagcagtgatatttcatttt

SEQ ID NO: 1015930 - DNA, 22 bp, Artificial Sequence
  chemically synthesized
atggtccaggccatgcaaatta

SEQ ID NO: 1015931 - DNA, 22 bp, Artificial Sequence
  chemically synthesized
cattttagttttaatttgcatg

SEQ ID NO: 1015932 - DNA, 22 bp, Artificial Sequence
  chemically synthesized
attttagttttaatttgcatgg

SEQ ID NO: 1015933 - DNA, 22 bp, Artificial Sequence
  chemically synthesized
tagttttaatttgcatggcctg

SEQ ID NO: 1015934 - DNA, 22 bp, Artificial Sequence
  chemically synthesized
agttttaatttgcatggcctgg

SEQ ID NO: 1015935 - DNA, 22 bp, Artificial Sequence
  chemically synthesized
gttttaatttgcatggcctgga

SEQ ID NO: 1015936 - DNA, 22 bp, Artificial Sequence
  chemically synthesized
agtcccattaatggtccaggcc

SEQ ID NO: 1015937 - DNA, 22 bp, Artificial Sequence
  chemically synthesized
taatttgcatggcctggaccat

SEQ ID NO: 1015938 - DNA, 22 bp, Artificial Sequence
  chemically synthesized
taagtcccattaatggtccagg

SEQ ID NO: 1015939 - DNA, 22 bp, Artificial Sequence
  chemically synthesized
aatttgcatggcctggaccatt

SEQ ID NO: 1015940 - DNA, 22 bp, Artificial Sequence
  chemically synthesized
ctaagtcccattaatggtccag

SEQ ID NO: 1015941 - DNA, 22 bp, Artificial Sequence
  chemically synthesized
atttgcatggcctggaccatta

SEQ ID NO: 1015942 - DNA, 22 bp, Artificial Sequence
  chemically synthesized
gcatggcctggaccattaatgg

SEQ ID NO: 1015943 - DNA, 22 bp, Artificial Sequence
  chemically synthesized
catggcctggaccattaatggg

SEQ ID NO: 1015944 - DNA, 22 bp, Artificial Sequence
  chemically synthesized
gaccattaatgggacttagaaa

SEQ ID NO: 1015945 - DNA, 22 bp, Artificial Sequence
  chemically synthesized
atgggacttagaaattctttat

SEQ ID NO: 1015946 - DNA, 22 bp, Artificial Sequence
  chemically synthesized
agaaattctttatatatttatt

SEQ ID NO: 1015947 - DNA, 22 bp, Artificial Sequence
  chemically synthesized
gaaattctttatatatttattg

SEQ ID NO: 1015948 - DNA, 22 bp, Artificial Sequence
  chemically synthesized
tttatatatttattggccgttt

SEQ ID NO: 1015949 - DNA, 22 bp, Artificial Sequence
  chemically synthesized
tatatatttattggccgtttgg

SEQ ID NO: 1015950 - DNA, 22 bp, Artificial Sequence
  chemically synthesized
atatatttattggccgtttgga

SEQ ID NO: 1015951 - DNA, 22 bp, Artificial Sequence
  chemically synthesized
caaaataagaaatccaaacggc

SEQ ID NO: 1015952 - DNA, 22 bp, Artificial Sequence
  chemically synthesized
tatatttattggccgtttggat

SEQ ID NO: 1015953 - DNA, 22 bp, Artificial Sequence
  chemically synthesized
acaaaataagaaatccaaacgg

SEQ ID NO: 1015954 - DNA, 22 bp, Artificial Sequence
  chemically synthesized
tacaaaataagaaatccaaacg

SEQ ID NO: 1015955 - DNA, 22 bp, Artificial Sequence
  chemically synthesized
attggccgtttggatttcttat

SEQ ID NO: 1015956 - DNA, 22 bp, Artificial Sequence
  chemically synthesized
ttggccgtttggatttcttatt

SEQ ID NO: 1015957 - DNA, 22 bp, Artificial Sequence
  chemically synthesized
tcatctttacaaaataagaaat

SEQ ID NO: 1015958 - DNA, 22 bp, Artificial Sequence
  chemically synthesized
gtcatctttacaaaataagaaa

SEQ ID NO: 1015959 - DNA, 22 bp, Artificial Sequence
  chemically synthesized
tgtcatctttacaaaataagaa

SEQ ID NO: 1015960 - DNA, 22 bp, Artificial Sequence
  chemically synthesized
gccgtttggatttcttattttg

SEQ ID NO: 1015961 - DNA, 22 bp, Artificial Sequence
  chemically synthesized
ttgtcatctttacaaaataaga

SEQ ID NO: 1015962 - DNA, 22 bp, Artificial Sequence
  chemically synthesized
agatttttgtcatctttacaaa

SEQ ID NO: 1015963 - DNA, 22 bp, Artificial Sequence
  chemically synthesized
ggatttcttattttgtaaagat

SEQ ID NO: 1015964 - DNA, 22 bp, Artificial Sequence
  chemically synthesized
gatttcttattttgtaaagatg

SEQ ID NO: 1015965 - DNA, 22 bp, Artificial Sequence
  chemically synthesized
cttattttgtaaagatgacaaa

SEQ ID NO: 1015966 - DNA, 22 bp, Artificial Sequence
  chemically synthesized
ttattttgtaaagatgacaaaa

SEQ ID NO: 1015967 - DNA, 22 bp, Artificial Sequence
  chemically synthesized
attttgtaaagatgacaaaaat

SEQ ID NO: 1015968 - DNA, 22 bp, Artificial Sequence
  chemically synthesized
ttttgtaaagatgacaaaaatc

SEQ ID NO: 1015969 - DNA, 22 bp, Artificial Sequence
  chemically synthesized
tgtaaagatgacaaaaatctta

SEQ ID NO: 1015970 - DNA, 22 bp, Artificial Sequence
  chemically synthesized
gtaaagatgacaaaaatcttaa

SEQ ID NO: 1015971 - DNA, 22 bp, Artificial Sequence
  chemically synthesized
taaagatgacaaaaatcttaac

SEQ ID NO: 1015972 - DNA, 22 bp, Artificial Sequence
  chemically synthesized
tgcatcatagtaacgttaagat

SEQ ID NO: 1015973 - DNA, 22 bp, Artificial Sequence
  chemically synthesized
atgcatcatagtaacgttaaga

SEQ ID NO: 1015974 - DNA, 22 bp, Artificial Sequence
  chemically synthesized
tatgcatcatagtaacgttaag

SEQ ID NO: 1015975 - DNA, 22 bp, Artificial Sequence
  chemically synthesized
atgtgttttatgcatcatagta

SEQ ID NO: 1015976 - DNA, 22 bp, Artificial Sequence
  chemically synthesized
aacgttactatgatgcataaaa

SEQ ID NO: 1015977 - DNA, 22 bp, Artificial Sequence
  chemically synthesized
acgttactatgatgcataaaac

SEQ ID NO: 1015978 - DNA, 22 bp, Artificial Sequence
  chemically synthesized
tagtaaataactaatgtgtttt

SEQ ID NO: 1015979 - DNA, 22 bp, Artificial Sequence
  chemically synthesized
ctatgatgcataaaacacatta

SEQ ID NO: 1015980 - DNA, 22 bp, Artificial Sequence
  chemically synthesized
atagtaaataactaatgtgttt

SEQ ID NO: 1015981 - DNA, 22 bp, Artificial Sequence
  chemically synthesized
tatagtaaataactaatgtgtt

SEQ ID NO: 1015982 - DNA, 22 bp, Artificial Sequence
  chemically synthesized
tgatgcataaaacacattagtt

SEQ ID NO: 1015983 - DNA, 22 bp, Artificial Sequence
  chemically synthesized
aggtgatcactttatagtaaat

SEQ ID NO: 1015984 - DNA, 22 bp, Artificial Sequence
  chemically synthesized
aaggtgatcactttatagtaaa

SEQ ID NO: 1015985 - DNA, 22 bp, Artificial Sequence
  chemically synthesized
taaggtgatcactttatagtaa

SEQ ID NO: 1015986 - DNA, 22 bp, Artificial Sequence
  chemically synthesized
ttaaggtgatcactttatagta

SEQ ID NO: 1015987 - DNA, 22 bp, Artificial Sequence
  chemically synthesized
gttatttactataaagtgatca

SEQ ID NO: 1015988 - DNA, 22 bp, Artificial Sequence
  chemically synthesized
tttactataaagtgatcacctt

SEQ ID NO: 1015989 - DNA, 22 bp, Artificial Sequence
  chemically synthesized
gatggcatttttaaggtgatca

SEQ ID NO: 1015990 - DNA, 22 bp, Artificial Sequence
  chemically synthesized
actataaagtgatcaccttaaa

SEQ ID NO: 1015991 - DNA, 22 bp, Artificial Sequence
  chemically synthesized
ctataaagtgatcaccttaaaa

SEQ ID NO: 1015992 - DNA, 22 bp, Artificial Sequence
  chemically synthesized
acctggatggcatttttaaggt

SEQ ID NO: 1015993 - DNA, 22 bp, Artificial Sequence
  chemically synthesized
gacctggatggcatttttaagg

SEQ ID NO: 1015994 - DNA, 22 bp, Artificial Sequence
  chemically synthesized
taaagtgatcaccttaaaaatg

SEQ ID NO: 1015995 - DNA, 22 bp, Artificial Sequence
  chemically synthesized
tatcttgacctggatggcattt

SEQ ID NO: 1015996 - DNA, 22 bp, Artificial Sequence
  chemically synthesized
tgtatcttgacctggatggcat

SEQ ID NO: 1015997 - DNA, 22 bp, Artificial Sequence
  chemically synthesized
aaaaatgccatccaggtcaaga

SEQ ID NO: 1015998 - DNA, 22 bp, Artificial Sequence
  chemically synthesized
aaaatgccatccaggtcaagat

SEQ ID NO: 1015999 - DNA, 22 bp, Artificial Sequence
  chemically synthesized
gcaatattctgtatcttgacct

SEQ ID NO: 1016000 - DNA, 22 bp, Artificial Sequence
  chemically synthesized
ctggcaatattctgtatcttga

SEQ ID NO: 1016001 - DNA, 22 bp, Artificial Sequence
  chemically synthesized
tggcctgctggcaatattctgt

SEQ ID NO: 1016002 - DNA, 22 bp, Artificial Sequence
  chemically synthesized
gtggcctgctggcaatattctg

SEQ ID NO: 1016003 - DNA, 22 bp, Artificial Sequence
  chemically synthesized
ccagcaggccacaagccctttt

SEQ ID NO: 1016004 - DNA, 22 bp, Artificial Sequence
  chemically synthesized
aaaagtgaaccatggcacaaaa

SEQ ID NO: 1016005 - DNA, 22 bp, Artificial Sequence
  chemically synthesized
gaaaagtgaaccatggcacaaa

SEQ ID NO: 1016006 - DNA, 22 bp, Artificial Sequence
  chemically synthesized
ttgaaaagtgaaccatggcaca

SEQ ID NO: 1016007 - DNA, 22 bp, Artificial Sequence
  chemically synthesized
tttgtgccatggttcacttttc

SEQ ID NO: 1016008 - DNA, 22 bp, Artificial Sequence
  chemically synthesized
ttgtgccatggttcacttttca

SEQ ID NO: 1016009 - DNA, 22 bp, Artificial Sequence
  chemically synthesized
tgtgccatggttcacttttcaa

SEQ ID NO: 1016010 - DNA, 22 bp, Artificial Sequence
  chemically synthesized
gtgccatggttcacttttcaag

SEQ ID NO: 1016011 - DNA, 22 bp, Artificial Sequence
  chemically synthesized
tgccatggttcacttttcaaga

SEQ ID NO: 1016012 - DNA, 22 bp, Artificial Sequence
  chemically synthesized
acttttcaagaacttttcccat

SEQ ID NO: 1016013 - DNA, 22 bp, Artificial Sequence
  chemically synthesized
ttcaagaacttttcccattttt

SEQ ID NO: 1016014 - DNA, 22 bp, Artificial Sequence
  chemically synthesized
tcaagaacttttcccatttttc

SEQ ID NO: 1016015 - DNA, 22 bp, Artificial Sequence
  chemically synthesized
caagaacttttcccatttttct

SEQ ID NO: 1016016 - DNA, 22 bp, Artificial Sequence
  chemically synthesized
aagaacttttcccatttttcta

SEQ ID NO: 1016017 - DNA, 22 bp, Artificial Sequence
  chemically synthesized
ttcccatttttctattggatta

SEQ ID NO: 1016018 - DNA, 22 bp, Artificial Sequence
  chemically synthesized
tcccatttttctattggattat

SEQ ID NO: 1016019 - DNA, 22 bp, Artificial Sequence
  chemically synthesized
agaaaagaacagataatccaat

SEQ ID NO: 1016020 - DNA, 22 bp, Artificial Sequence
  chemically synthesized
cccatttttctattggattatc

SEQ ID NO: 1016021 - DNA, 22 bp, Artificial Sequence
  chemically synthesized
cagaaaagaacagataatccaa

SEQ ID NO: 1016022 - DNA, 22 bp, Artificial Sequence
  chemically synthesized
ccatttttctattggattatct

SEQ ID NO: 1016023 - DNA, 22 bp, Artificial Sequence
  chemically synthesized
tcagaaaagaacagataatcca

SEQ ID NO: 1016024 - DNA, 22 bp, Artificial Sequence
  chemically synthesized
ttctattggattatctgttctt

SEQ ID NO: 1016025 - DNA, 22 bp, Artificial Sequence
  chemically synthesized
tctattggattatctgttcttt

SEQ ID NO: 1016026 - DNA, 22 bp, Artificial Sequence
  chemically synthesized
ctattggattatctgttctttt

SEQ ID NO: 1016027 - DNA, 22 bp, Artificial Sequence
  chemically synthesized
caaatctttcagaaaagaacag

SEQ ID NO: 1016028 - DNA, 22 bp, Artificial Sequence
  chemically synthesized
tattggattatctgttcttttc

SEQ ID NO: 1016029 - DNA, 22 bp, Artificial Sequence
  chemically synthesized
ttggattatctgttcttttctg

SEQ ID NO: 1016030 - DNA, 22 bp, Artificial Sequence
  chemically synthesized
ctacaaatctttcagaaaagaa

SEQ ID NO: 1016031 - DNA, 22 bp, Artificial Sequence
  chemically synthesized
gattatctgttcttttctgaaa

SEQ ID NO: 1016032 - DNA, 22 bp, Artificial Sequence
  chemically synthesized
tctgttcttttctgaaagattt

SEQ ID NO: 1016033 - DNA, 22 bp, Artificial Sequence
  chemically synthesized
taaagaattcctacaaatcttt

SEQ ID NO: 1016034 - DNA, 22 bp, Artificial Sequence
  chemically synthesized
ttcttttctgaaagatttgtag

SEQ ID NO: 1016035 - DNA, 22 bp, Artificial Sequence
  chemically synthesized
ttttctgaaagatttgtaggaa

SEQ ID NO: 1016036 - DNA, 22 bp, Artificial Sequence
  chemically synthesized
ttctgaaagatttgtaggaatt

SEQ ID NO: 1016037 - DNA, 22 bp, Artificial Sequence
  chemically synthesized
ataattataaagaattcctaca

SEQ ID NO: 1016038 - DNA, 22 bp, Artificial Sequence
  chemically synthesized
tctgaaagatttgtaggaattc

SEQ ID NO: 1016039 - DNA, 22 bp, Artificial Sequence
  chemically synthesized
ctgaaagatttgtaggaattct

SEQ ID NO: 1016040 - DNA, 22 bp, Artificial Sequence
  chemically synthesized
tgaaagatttgtaggaattctt

SEQ ID NO: 1016041 - DNA, 22 bp, Artificial Sequence
  chemically synthesized
aaagatttgtaggaattcttta

SEQ ID NO: 1016042 - DNA, 22 bp, Artificial Sequence
  chemically synthesized
gtaggaattctttataattatg

SEQ ID NO: 1016043 - DNA, 22 bp, Artificial Sequence
  chemically synthesized
taggaattctttataattatga

SEQ ID NO: 1016044 - DNA, 22 bp, Artificial Sequence
  chemically synthesized
tttataattatgaatacacaca

SEQ ID NO: 1016045 - DNA, 22 bp, Artificial Sequence
  chemically synthesized
tataattatgaatacacacatt

SEQ ID NO: 1016046 - DNA, 22 bp, Artificial Sequence
  chemically synthesized
ataattatgaatacacacattt

SEQ ID NO: 1016047 - DNA, 22 bp, Artificial Sequence
  chemically synthesized
taattatgaatacacacatttc

SEQ ID NO: 1016048 - DNA, 22 bp, Artificial Sequence
  chemically synthesized
tgaatacacacatttcatccat

SEQ ID NO: 1016049 - DNA, 22 bp, Artificial Sequence
  chemically synthesized
gaatacacacataatggatgaa

SEQ ID NO: 1016050 - DNA, 22 bp, Artificial Sequence
  chemically synthesized
ggaatacacacataatggatga

SEQ ID NO: 1016051 - DNA, 22 bp, Artificial Sequence
  chemically synthesized
tttggaatacacacataatgga

SEQ ID NO: 1016052 - DNA, 22 bp, Artificial Sequence
  chemically synthesized
catccattatgtgtgtattcca

SEQ ID NO: 1016053 - DNA, 22 bp, Artificial Sequence
  chemically synthesized
atccattatgtgtgtattccaa

SEQ ID NO: 1016054 - DNA, 22 bp, Artificial Sequence
  chemically synthesized
tgtgtgtattccaaataattta

SEQ ID NO: 1016055 - DNA, 22 bp, Artificial Sequence
  chemically synthesized
caaataatttatcctactctgt

SEQ ID NO: 1016056 - DNA, 22 bp, Artificial Sequence
  chemically synthesized
agagagtaaaaatgaaacccac

SEQ ID NO: 1016057 - DNA, 22 bp, Artificial Sequence
  chemically synthesized
atcctactctgtgggtttcatt

SEQ ID NO: 1016058 - DNA, 22 bp, Artificial Sequence
  chemically synthesized
tcctactctgtgggtttcattt

SEQ ID NO: 1016059 - DNA, 22 bp, Artificial Sequence
  chemically synthesized
ctctgtgggtttcatttttact

SEQ ID NO: 1016060 - DNA, 22 bp, Artificial Sequence
  chemically synthesized
tgtgggtttcatttttactctc

SEQ ID NO: 1016061 - DNA, 22 bp, Artificial Sequence
  chemically synthesized
tgggtttcatttttactctctc

SEQ ID NO: 1016062 - DNA, 22 bp, Artificial Sequence
  chemically synthesized
catttttactctctcagtgctg

SEQ ID NO: 1016063 - DNA, 22 bp, Artificial Sequence
  chemically synthesized
tacatcaaaagacagcactgag

SEQ ID NO: 1016064 - DNA, 22 bp, Artificial Sequence
  chemically synthesized
atttttactctctcagtgctgt

SEQ ID NO: 1016065 - DNA, 22 bp, Artificial Sequence
  chemically synthesized
ttactctctcagtgctgtcttt

SEQ ID NO: 1016066 - DNA, 22 bp, Artificial Sequence
  chemically synthesized
tactctctcagtgctgtctttt

SEQ ID NO: 1016067 - DNA, 22 bp, Artificial Sequence
  chemically synthesized
actctctcagtgctgtcttttg

SEQ ID NO: 1016068 - DNA, 22 bp, Artificial Sequence
  chemically synthesized
ctctctcagtgctgtcttttga

SEQ ID NO: 1016069 - DNA, 22 bp, Artificial Sequence
  chemically synthesized
ataacatctatacatcaaaaga

SEQ ID NO: 1016070 - DNA, 22 bp, Artificial Sequence
  chemically synthesized
tctcagtgctgtcttttgatgt

SEQ ID NO: 1016071 - DNA, 22 bp, Artificial Sequence
  chemically synthesized
tcagtgctgtcttttgatgtat

SEQ ID NO: 1016072 - DNA, 22 bp, Artificial Sequence
  chemically synthesized
agtgctgtcttttgatgtatag

SEQ ID NO: 1016073 - DNA, 22 bp, Artificial Sequence
  chemically synthesized
tatattaataacatctatacat

SEQ ID NO: 1016074 - DNA, 22 bp, Artificial Sequence
  chemically synthesized
gtatattaataacatctataca

SEQ ID NO: 1016075 - DNA, 22 bp, Artificial Sequence
  chemically synthesized
tcttttgatgtatagatgttat

SEQ ID NO: 1016076 - DNA, 22 bp, Artificial Sequence
  chemically synthesized
ccttgtatattaataacatcta

SEQ ID NO: 1016077 - DNA, 22 bp, Artificial Sequence
  chemically synthesized
ttgatgtatagatgttattaat

SEQ ID NO: 1016078 - DNA, 22 bp, Artificial Sequence
  chemically synthesized
tgatgtatagatgttattaata

SEQ ID NO: 1016079 - DNA, 22 bp, Artificial Sequence
  chemically synthesized
gatgtatagatgttattaatat

SEQ ID NO: 1016080 - DNA, 22 bp, Artificial Sequence
  chemically synthesized
atgtatagatgttattaatata

SEQ ID NO: 1016081 - DNA, 22 bp, Artificial Sequence
  chemically synthesized
ttaatatacaaggtagtccact

SEQ ID NO: 1016082 - DNA, 22 bp, Artificial Sequence
  chemically synthesized
atatacaaggtagtccacttta

SEQ ID NO: 1016083 - DNA, 22 bp, Artificial Sequence
  chemically synthesized
atcatgaataaaaataataaag

SEQ ID NO: 1016084 - DNA, 22 bp, Artificial Sequence
  chemically synthesized
tattatttttattcatgattag

SEQ ID NO: 1016085 - DNA, 22 bp, Artificial Sequence
  chemically synthesized
attatttttattcatgattagt

SEQ ID NO: 1016086 - DNA, 22 bp, Artificial Sequence
  chemically synthesized
ttatttttattcatgattagtg

SEQ ID NO: 1016087 - DNA, 22 bp, Artificial Sequence
  chemically synthesized
cacaaatgatgaagcactaatc

SEQ ID NO: 1016088 - DNA, 22 bp, Artificial Sequence
  chemically synthesized
tttttattcatgattagtgctt

SEQ ID NO: 1016089 - DNA, 22 bp, Artificial Sequence
  chemically synthesized
acacaaatgatgaagcactaat

SEQ ID NO: 1016090 - DNA, 22 bp, Artificial Sequence
  chemically synthesized
ttattcatgattagtgcttcat

SEQ ID NO: 1016091 - DNA, 22 bp, Artificial Sequence
  chemically synthesized
cttacacaaatgatgaagcact

SEQ ID NO: 1016092 - DNA, 22 bp, Artificial Sequence
  chemically synthesized
tattcatgattagtgcttcatc

SEQ ID NO: 1016093 - DNA, 22 bp, Artificial Sequence
  chemically synthesized
attcatgattagtgcttcatca

SEQ ID NO: 1016094 - DNA, 22 bp, Artificial Sequence
  chemically synthesized
ttcatgattagtgcttcatcat

SEQ ID NO: 1016095 - DNA, 22 bp, Artificial Sequence
  chemically synthesized
atgattagtgcttcatcatttg

SEQ ID NO: 1016096 - DNA, 22 bp, Artificial Sequence
  chemically synthesized
gtgcttcatcatttgtgtaagc

SEQ ID NO: 1016097 - DNA, 22 bp, Artificial Sequence
  chemically synthesized
catcatttgtgtaagcaatttt

SEQ ID NO: 1016098 - DNA, 22 bp, Artificial Sequence
  chemically synthesized
atcatttgtgtaagcaattttt

SEQ ID NO: 1016099 - DNA, 22 bp, Artificial Sequence
  chemically synthesized
atatagggtaagaaaaaattgc

SEQ ID NO: 1016100 - DNA, 22 bp, Artificial Sequence
  chemically synthesized
attaatatagggtaagaaaaaa

SEQ ID NO: 1016101 - DNA, 22 bp, Artificial Sequence
  chemically synthesized
gtgtaagcaattttttcttacc

SEQ ID NO: 1016102 - DNA, 22 bp, Artificial Sequence
  chemically synthesized
tgtaagcaattttttcttaccc

SEQ ID NO: 1016103 - DNA, 22 bp, Artificial Sequence
  chemically synthesized
tttcttaccctatattaattaa

SEQ ID NO: 1016104 - DNA, 22 bp, Artificial Sequence
  chemically synthesized
ttcttaccctatattaattaac

SEQ ID NO: 1016105 - DNA, 22 bp, Artificial Sequence
  chemically synthesized
tcttaccctatattaattaaca

SEQ ID NO: 1016106 - DNA, 22 bp, Artificial Sequence
  chemically synthesized
cttaccctatattaattaacat

SEQ ID NO: 1016107 - DNA, 22 bp, Artificial Sequence
  chemically synthesized
ttaccctatattaattaacata

SEQ ID NO: 1016108 - DNA, 22 bp, Artificial Sequence
  chemically synthesized
accctatattaattaacatatt

SEQ ID NO: 1016109 - DNA, 22 bp, Artificial Sequence
  chemically synthesized
ccctatattaattaacatattc

SEQ ID NO: 1016110 - DNA, 22 bp, Artificial Sequence
  chemically synthesized
cagtaaaatagaggagaatatg

SEQ ID NO: 1016111 - DNA, 22 bp, Artificial Sequence
  chemically synthesized
acagtaaaatagaggagaatat

SEQ ID NO: 1016112 - DNA, 22 bp, Artificial Sequence
  chemically synthesized
tattaattaacatattctcctc

SEQ ID NO: 1016113 - DNA, 22 bp, Artificial Sequence
  chemically synthesized
tacagtaaaatagaggagaata

SEQ ID NO: 1016114 - DNA, 22 bp, Artificial Sequence
  chemically synthesized
ttacagtaaaatagaggagaat

SEQ ID NO: 1016115 - DNA, 22 bp, Artificial Sequence
  chemically synthesized
attaacatattctcctctattt

SEQ ID NO: 1016116 - DNA, 22 bp, Artificial Sequence
  chemically synthesized
acatattctcctctattttact

SEQ ID NO: 1016117 - DNA, 22 bp, Artificial Sequence
  chemically synthesized
ataaagcttttacagtaaaata

SEQ ID NO: 1016118 - DNA, 22 bp, Artificial Sequence
  chemically synthesized
tcctctattttactgtaaaagc

SEQ ID NO: 1016119 - DNA, 22 bp, Artificial Sequence
  chemically synthesized
ctctattttactgtaaaagctt

SEQ ID NO: 1016120 - DNA, 22 bp, Artificial Sequence
  chemically synthesized
tattttactgtaaaagctttat

SEQ ID NO: 1016121 - DNA, 22 bp, Artificial Sequence
  chemically synthesized
ttttactgtaaaagctttatca

SEQ ID NO: 1016122 - DNA, 22 bp, Artificial Sequence
  chemically synthesized
tactgtaaaagctttatcaatt

SEQ ID NO: 1016123 - DNA, 22 bp, Artificial Sequence
  chemically synthesized
actgtaaaagctttatcaattt

SEQ ID NO: 1016124 - DNA, 22 bp, Artificial Sequence
  chemically synthesized
ctgtaaaagctttatcaatttg

SEQ ID NO: 1016125 - DNA, 22 bp, Artificial Sequence
  chemically synthesized
acatgagaaaaaaacaaattga

SEQ ID NO: 1016126 - DNA, 22 bp, Artificial Sequence
  chemically synthesized
taaaagctttatcaatttgttt

SEQ ID NO: 1016127 - DNA, 22 bp, Artificial Sequence
  chemically synthesized
aaaactgacatgagaaaaaaac

SEQ ID NO: 1016128 - DNA, 22 bp, Artificial Sequence
  chemically synthesized
tatcaatttgtttttttctcat

SEQ ID NO: 1016129 - DNA, 22 bp, Artificial Sequence
  chemically synthesized
atcaatttgtttttttctcatg

SEQ ID NO: 1016130 - DNA, 22 bp, Artificial Sequence
  chemically synthesized
tcaatttgtttttttctcatgt

SEQ ID NO: 1016131 - DNA, 22 bp, Artificial Sequence
  chemically synthesized
gtttttttctcatgtcagtttt

SEQ ID NO: 1016132 - DNA, 22 bp, Artificial Sequence
  chemically synthesized
tttttttctcatgtcagttttt

SEQ ID NO: 1016133 - DNA, 22 bp, Artificial Sequence
  chemically synthesized
ttttctcatgtcagtttttagt

SEQ ID NO: 1016134 - DNA, 22 bp, Artificial Sequence
  chemically synthesized
tttctcatgtcagtttttagtc

SEQ ID NO: 1016135 - DNA, 22 bp, Artificial Sequence
  chemically synthesized
ttctcatgtcagtttttagtca

SEQ ID NO: 1016136 - DNA, 22 bp, Artificial Sequence
  chemically synthesized
tctcatgtcagtttttagtcac

SEQ ID NO: 1016137 - DNA, 22 bp, Artificial Sequence
  chemically synthesized
ctcatgtcagtttttagtcacc

SEQ ID NO: 1016138 - DNA, 22 bp, Artificial Sequence
  chemically synthesized
tcatgtcagtttttagtcacct

SEQ ID NO: 1016139 - DNA, 22 bp, Artificial Sequence
  chemically synthesized
atgtcagtttttagtcacctgg

SEQ ID NO: 1016140 - DNA, 22 bp, Artificial Sequence
  chemically synthesized
tatacaaaaataaaatcccagg

SEQ ID NO: 1016141 - DNA, 22 bp, Artificial Sequence
  chemically synthesized
ttagtcacctgggattttattt

SEQ ID NO: 1016142 - DNA, 22 bp, Artificial Sequence
  chemically synthesized
tagtcacctgggattttatttt

SEQ ID NO: 1016143 - DNA, 22 bp, Artificial Sequence
  chemically synthesized
aaactatatacaaaaataaaat

SEQ ID NO: 1016144 - DNA, 22 bp, Artificial Sequence
  chemically synthesized
agtcacctgggattttattttt

SEQ ID NO: 1016145 - DNA, 22 bp, Artificial Sequence
  chemically synthesized
caaactatatacaaaaataaaa

SEQ ID NO: 1016146 - DNA, 22 bp, Artificial Sequence
  chemically synthesized
gtcacctgggattttatttttg

SEQ ID NO: 1016147 - DNA, 22 bp, Artificial Sequence
  chemically synthesized
tttcaaactatatacaaaaata

SEQ ID NO: 1016148 - DNA, 22 bp, Artificial Sequence
  chemically synthesized
tgtttcaaactatatacaaaaa

SEQ ID NO: 1016149 - DNA, 22 bp, Artificial Sequence
  chemically synthesized
ggattttatttttgtatatagt

SEQ ID NO: 1016150 - DNA, 22 bp, Artificial Sequence
  chemically synthesized
tatttttgtatatagtttgaaa

SEQ ID NO: 1016151 - DNA, 22 bp, Artificial Sequence
  chemically synthesized
atttttgtatatagtttgaaac

SEQ ID NO: 1016152 - DNA, 22 bp, Artificial Sequence
  chemically synthesized
tttttgtatatagtttgaaaca

SEQ ID NO: 1016153 - DNA, 22 bp, Artificial Sequence
  chemically synthesized
ttgtatatagtttgaaacagaa

SEQ ID NO: 1016154 - DNA, 22 bp, Artificial Sequence
  chemically synthesized
tgtatatagtttgaaacagaat

SEQ ID NO: 1016155 - DNA, 22 bp, Artificial Sequence
  chemically synthesized
gtatatagtttgaaacagaata

SEQ ID NO: 1016156 - DNA, 22 bp, Artificial Sequence
  chemically synthesized
tatatagtttgaaacagaatat

SEQ ID NO: 1016157 - DNA, 22 bp, Artificial Sequence
  chemically synthesized
ggaaaaaagtatatattctgtt

SEQ ID NO: 1016158 - DNA, 22 bp, Artificial Sequence
  chemically synthesized
aggaaaaaagtatatattctgt

SEQ ID NO: 1016159 - DNA, 22 bp, Artificial Sequence
  chemically synthesized
cttaggaaaaaagtatatattc

SEQ ID NO: 1016160 - DNA, 22 bp, Artificial Sequence
  chemically synthesized
ctgcttaggaaaaaagtatata

SEQ ID NO: 1016161 - DNA, 22 bp, Artificial Sequence
  chemically synthesized
gaaacagaatatatactttttt

SEQ ID NO: 1016162 - DNA, 22 bp, Artificial Sequence
  chemically synthesized
aaacagaatatatacttttttc

SEQ ID NO: 1016163 - DNA, 22 bp, Artificial Sequence
  chemically synthesized
aaatggagtctcctgcttagga

SEQ ID NO: 1016164 - DNA, 22 bp, Artificial Sequence
  chemically synthesized
aaaaattaaaatggagtctcct

SEQ ID NO: 1016165 - DNA, 22 bp, Artificial Sequence
  chemically synthesized
ttttcctaagcaggagactcca

SEQ ID NO: 1016166 - DNA, 22 bp, Artificial Sequence
  chemically synthesized
tttcctaagcaggagactccat

SEQ ID NO: 1016167 - DNA, 22 bp, Artificial Sequence
  chemically synthesized
ttcctaagcaggagactccatt

SEQ ID NO: 1016168 - DNA, 22 bp, Artificial Sequence
  chemically synthesized
tcctaagcaggagactccattt

SEQ ID NO: 1016169 - DNA, 22 bp, Artificial Sequence
  chemically synthesized
cctaaaaaattaaaatggagtc

SEQ ID NO: 1016170 - DNA, 22 bp, Artificial Sequence
  chemically synthesized
cctaagcaggagactccatttt

SEQ ID NO: 1016171 - DNA, 22 bp, Artificial Sequence
  chemically synthesized
acctaaaaaattaaaatggagt

SEQ ID NO: 1016172 - DNA, 22 bp, Artificial Sequence
  chemically synthesized
ctaagcaggagactccatttta

SEQ ID NO: 1016173 - DNA, 22 bp, Artificial Sequence
  chemically synthesized
tacctaaaaaattaaaatggag

SEQ ID NO: 1016174 - DNA, 22 bp, Artificial Sequence
  chemically synthesized
agcaggagactccattttaatt

SEQ ID NO: 1016175 - DNA, 22 bp, Artificial Sequence
  chemically synthesized
cattttaattttttaggtaaaa

SEQ ID NO: 1016176 - DNA, 22 bp, Artificial Sequence
  chemically synthesized
tacagtgcacatgttttaccta

SEQ ID NO: 1016177 - DNA, 22 bp, Artificial Sequence
  chemically synthesized
gtacagtgcacatgttttacct

SEQ ID NO: 1016178 - DNA, 22 bp, Artificial Sequence
  chemically synthesized
taattttttaggtaaaacatgt

SEQ ID NO: 1016179 - DNA, 22 bp, Artificial Sequence
  chemically synthesized
aattttttaggtaaaacatgtg

SEQ ID NO: 1016180 - DNA, 22 bp, Artificial Sequence
  chemically synthesized
tcttgtacagtgcacatgtttt

SEQ ID NO: 1016181 - DNA, 22 bp, Artificial Sequence
  chemically synthesized
attttttaggtaaaacatgtgc

SEQ ID NO: 1016182 - DNA, 22 bp, Artificial Sequence
  chemically synthesized
tttaggtaaaacatgtgcactg

SEQ ID NO: 1016183 - DNA, 22 bp, Artificial Sequence
  chemically synthesized
ttaggtaaaacatgtgcactgt

SEQ ID NO: 1016184 - DNA, 22 bp, Artificial Sequence
  chemically synthesized
taggtaaaacatgtgcactgta

SEQ ID NO: 1016185 - DNA, 22 bp, Artificial Sequence
  chemically synthesized
aggtaaaacatgtgcactgtac

SEQ ID NO: 1016186 - DNA, 22 bp, Artificial Sequence
  chemically synthesized
atgcattatcttgtacagtgca

SEQ ID NO: 1016187 - DNA, 22 bp, Artificial Sequence
  chemically synthesized
ggtaaaacatgtgcactgtaca

SEQ ID NO: 1016188 - DNA, 22 bp, Artificial Sequence
  chemically synthesized
ttcatgcattatcttgtacagt

SEQ ID NO: 1016189 - DNA, 22 bp, Artificial Sequence
  chemically synthesized
ctgttcatgcattatcttgtac

SEQ ID NO: 1016190 - DNA, 22 bp, Artificial Sequence
  chemically synthesized
tgctgttcatgcattatcttgt

SEQ ID NO: 1016191 - DNA, 22 bp, Artificial Sequence
  chemically synthesized
ctgctgttcatgcattatcttg

SEQ ID NO: 1016192 - DNA, 22 bp, Artificial Sequence
  chemically synthesized
tctgctgttcatgcattatctt

SEQ ID NO: 1016193 - DNA, 22 bp, Artificial Sequence
  chemically synthesized
ttctgctgttcatgcattatct

SEQ ID NO: 1016194 - DNA, 22 bp, Artificial Sequence
  chemically synthesized
tttttctgctgttcatgcatta

SEQ ID NO: 1016195 - DNA, 22 bp, Artificial Sequence
  chemically synthesized
atttttctgctgttcatgcatt

SEQ ID NO: 1016196 - DNA, 22 bp, Artificial Sequence
  chemically synthesized
tatttttctgctgttcatgcat

SEQ ID NO: 1016197 - DNA, 22 bp, Artificial Sequence
  chemically synthesized
ttatttttctgctgttcatgca

SEQ ID NO: 1016198 - DNA, 22 bp, Artificial Sequence
  chemically synthesized
tacaagataatgcatgaacagc

SEQ ID NO: 1016199 - DNA, 22 bp, Artificial Sequence
  chemically synthesized
cacacacttttatttttctgct

SEQ ID NO: 1016200 - DNA, 22 bp, Artificial Sequence
  chemically synthesized
actgcacacacttttatttttc

SEQ ID NO: 1016201 - DNA, 22 bp, Artificial Sequence
  chemically synthesized
cactgcacacacttttattttt

SEQ ID NO: 1016202 - DNA, 22 bp, Artificial Sequence
  chemically synthesized
tcactgcacacacttttatttt

SEQ ID NO: 1016203 - DNA, 22 bp, Artificial Sequence
  chemically synthesized
ttcactgcacacacttttattt

SEQ ID NO: 1016204 - DNA, 22 bp, Artificial Sequence
  chemically synthesized
ggacagatgcttttcactgcac

SEQ ID NO: 1016205 - DNA, 22 bp, Artificial Sequence
  chemically synthesized
ccagagtgagcagatcaaaatt

SEQ ID NO: 1016206 - DNA, 22 bp, Artificial Sequence
  chemically synthesized
tcccaattttgatctgctcact

SEQ ID NO: 1016207 - DNA, 22 bp, Artificial Sequence
  chemically synthesized
tgatctgctcactctggtagtt

SEQ ID NO: 1016208 - DNA, 22 bp, Artificial Sequence
  chemically synthesized
gatctgctcactctggtagttc

SEQ ID NO: 1016209 - DNA, 22 bp, Artificial Sequence
  chemically synthesized
acagtgagagcagaactaccag

SEQ ID NO: 1016210 - DNA, 22 bp, Artificial Sequence
  chemically synthesized
atctgctcactctggtagttct

SEQ ID NO: 1016211 - DNA, 22 bp, Artificial Sequence
  chemically synthesized
ttaacagtgagagcagaactac

SEQ ID NO: 1016212 - DNA, 22 bp, Artificial Sequence
  chemically synthesized
attaacagtgagagcagaacta

SEQ ID NO: 1016213 - DNA, 22 bp, Artificial Sequence
  chemically synthesized
tattaacagtgagagcagaact

SEQ ID NO: 1016214 - DNA, 22 bp, Artificial Sequence
  chemically synthesized
ctcactctggtagttctgctct

SEQ ID NO: 1016215 - DNA, 22 bp, Artificial Sequence
  chemically synthesized
ttattaacagtgagagcagaac

SEQ ID NO: 1016216 - DNA, 22 bp, Artificial Sequence
  chemically synthesized
actctggtagttctgctctcac

SEQ ID NO: 1016217 - DNA, 22 bp, Artificial Sequence
  chemically synthesized
tggtagttctgctctcactgtt

SEQ ID NO: 1016218 - DNA, 22 bp, Artificial Sequence
  chemically synthesized
taaaatttttattaacagtgag

SEQ ID NO: 1016219 - DNA, 22 bp, Artificial Sequence
  chemically synthesized
gtagttctgctctcactgttaa

SEQ ID NO: 1016220 - DNA, 22 bp, Artificial Sequence
  chemically synthesized
aaattataaaatttttattaac

SEQ ID NO: 1016221 - DNA, 22 bp, Artificial Sequence
  chemically synthesized
aaaattataaaatttttattaa

SEQ ID NO: 1016222 - DNA, 22 bp, Artificial Sequence
  chemically synthesized
tgctctcactgttaataaaaat

SEQ ID NO: 1016223 - DNA, 22 bp, Artificial Sequence
  chemically synthesized
ctctcactgttaataaaaattt

SEQ ID NO: 1016224 - DNA, 22 bp, Artificial Sequence
  chemically synthesized
tcactgttaataaaaattttat

SEQ ID NO: 1016225 - DNA, 22 bp, Artificial Sequence
  chemically synthesized
actgttaataaaaattttataa

SEQ ID NO: 1016226 - DNA, 22 bp, Artificial Sequence
  chemically synthesized
taaatatttaaaattataaaat

SEQ ID NO: 1016227 - DNA, 22 bp, Artificial Sequence
  chemically synthesized
tataaatatttaaaattataaa

SEQ ID NO: 1016228 - DNA, 22 bp, Artificial Sequence
  chemically synthesized
ttaataaaaattttataatttt

SEQ ID NO: 1016229 - DNA, 22 bp, Artificial Sequence
  chemically synthesized
ttctataaatatttaaaattat

SEQ ID NO: 1016230 - DNA, 22 bp, Artificial Sequence
  chemically synthesized
ataaaaattttataattttaaa

SEQ ID NO: 1016231 - DNA, 22 bp, Artificial Sequence
  chemically synthesized
gttctataaatatttaaaatta

SEQ ID NO: 1016232 - DNA, 22 bp, Artificial Sequence
  chemically synthesized
ccttgttctataaatatttaaa

SEQ ID NO: 1016233 - DNA, 22 bp, Artificial Sequence
  chemically synthesized
gccttgttctataaatatttaa

SEQ ID NO: 1016234 - DNA, 22 bp, Artificial Sequence
  chemically synthesized
tgccttgttctataaatattta

SEQ ID NO: 1016235 - DNA, 22 bp, Artificial Sequence
  chemically synthesized
tttgccttgttctataaatatt

SEQ ID NO: 1016236 - DNA, 22 bp, Artificial Sequence
  chemically synthesized
ctttgccttgttctataaatat

SEQ ID NO: 1016237 - DNA, 22 bp, Artificial Sequence
  chemically synthesized
tataattttaaatatttataga

SEQ ID NO: 1016238 - DNA, 22 bp, Artificial Sequence
  chemically synthesized
ataattttaaatatttatagaa

SEQ ID NO: 1016239 - DNA, 22 bp, Artificial Sequence
  chemically synthesized
taattttaaatatttatagaac

SEQ ID NO: 1016240 - DNA, 22 bp, Artificial Sequence
  chemically synthesized
tttctttgccttgttctataaa

SEQ ID NO: 1016241 - DNA, 22 bp, Artificial Sequence
  chemically synthesized
atttctttgccttgttctataa

SEQ ID NO: 1016242 - DNA, 22 bp, Artificial Sequence
  chemically synthesized
taaatatttatagaacaaggca

SEQ ID NO: 1016243 - DNA, 22 bp, Artificial Sequence
  chemically synthesized
tgtttatttctttgccttgttc

SEQ ID NO: 1016244 - DNA, 22 bp, Artificial Sequence
  chemically synthesized
aaatatttatagaacaaggcaa

SEQ ID NO: 1016245 - DNA, 22 bp, Artificial Sequence
  chemically synthesized
aatatttatagaacaaggcaaa

SEQ ID NO: 1016246 - DNA, 22 bp, Artificial Sequence
  chemically synthesized
tatcactgtgtttatttctttg

SEQ ID NO: 1016247 - DNA, 22 bp, Artificial Sequence
  chemically synthesized
atagaacaaggcaaagaaataa

SEQ ID NO: 1016248 - DNA, 22 bp, Artificial Sequence
  chemically synthesized
atatcactgtgtttatttcttt

SEQ ID NO: 1016249 - DNA, 22 bp, Artificial Sequence
  chemically synthesized
tagaacaaggcaaagaaataaa

SEQ ID NO: 1016250 - DNA, 22 bp, Artificial Sequence
  chemically synthesized
tatatcactgtgtttatttctt

SEQ ID NO: 1016251 - DNA, 22 bp, Artificial Sequence
  chemically synthesized
tcattttatatcactgtgttta

SEQ ID NO: 1016252 - DNA, 22 bp, Artificial Sequence
  chemically synthesized
aatgaggagactatcattttat

SEQ ID NO: 1016253 - DNA, 22 bp, Artificial Sequence
  chemically synthesized
aaagcagtaaaactgaatgagg

SEQ ID NO: 1016254 - DNA, 22 bp, Artificial Sequence
  chemically synthesized
aatatattgaaagcagtaaaac

SEQ ID NO: 1016255 - DNA, 22 bp, Artificial Sequence
  chemically synthesized
ctcattcagttttactgctttc

SEQ ID NO: 1016256 - DNA, 22 bp, Artificial Sequence
  chemically synthesized
attcagttttactgctttcaat

SEQ ID NO: 1016257 - DNA, 22 bp, Artificial Sequence
  chemically synthesized
agttttactgctttcaatatat

SEQ ID NO: 1016258 - DNA, 22 bp, Artificial Sequence
  chemically synthesized
tactgctttcaatatattcaat

SEQ ID NO: 1016259 - DNA, 22 bp, Artificial Sequence
  chemically synthesized
actgctttcaatatattcaatg

SEQ ID NO: 1016260 - DNA, 22 bp, Artificial Sequence
  chemically synthesized
taaaaatatcagcattgaatat

SEQ ID NO: 1016261 - DNA, 22 bp, Artificial Sequence
  chemically synthesized
ctgctttcaatatattcaatgc

SEQ ID NO: 1016262 - DNA, 22 bp, Artificial Sequence
  chemically synthesized
ctttcaatatattcaatgctga

SEQ ID NO: 1016263 - DNA, 22 bp, Artificial Sequence
  chemically synthesized
tcaatatattcaatgctgatat

SEQ ID NO: 1016264 - DNA, 22 bp, Artificial Sequence
  chemically synthesized
caatatattcaatgctgatatt

SEQ ID NO: 1016265 - DNA, 22 bp, Artificial Sequence
  chemically synthesized
aatatattcaatgctgatattt

SEQ ID NO: 1016266 - DNA, 22 bp, Artificial Sequence
  chemically synthesized
aatgctgatatttttacaactc

SEQ ID NO: 1016267 - DNA, 22 bp, Artificial Sequence
  chemically synthesized
atatttttacaactctggattg

SEQ ID NO: 1016268 - DNA, 22 bp, Artificial Sequence
  chemically synthesized
caaagtataatgtcaatccaga

SEQ ID NO: 1016269 - DNA, 22 bp, Artificial Sequence
  chemically synthesized
ttacaactctggattgacatta

SEQ ID NO: 1016270 - DNA, 22 bp, Artificial Sequence
  chemically synthesized
tacaactctggattgacattat

SEQ ID NO: 1016271 - DNA, 22 bp, Artificial Sequence
  chemically synthesized
acaactctggattgacattata

SEQ ID NO: 1016272 - DNA, 22 bp, Artificial Sequence
  chemically synthesized
caactctggattgacattatac

SEQ ID NO: 1016273 - DNA, 22 bp, Artificial Sequence
  chemically synthesized
tggattgacattatactttgta

SEQ ID NO: 1016274 - DNA, 22 bp, Artificial Sequence
  chemically synthesized
gattgacattatactttgtaac

SEQ ID NO: 1016275 - DNA, 22 bp, Artificial Sequence
  chemically synthesized
acattatactttgtaacactct

SEQ ID NO: 1016276 - DNA, 22 bp, Artificial Sequence
  chemically synthesized
gggatcaataaaatagagtgtt

SEQ ID NO: 1016277 - DNA, 22 bp, Artificial Sequence
  chemically synthesized
tactttgtaacactctatttta

SEQ ID NO: 1016278 - DNA, 22 bp, Artificial Sequence
  chemically synthesized
tgtaacactctattttattgat

SEQ ID NO: 1016279 - DNA, 22 bp, Artificial Sequence
  chemically synthesized
gtaacactctattttattgatc

SEQ ID NO: 1016280 - DNA, 22 bp, Artificial Sequence
  chemically synthesized
gggaggattagggatcaataaa

SEQ ID NO: 1016281 - DNA, 22 bp, Artificial Sequence
  chemically synthesized
taacactctattttattgatcc

SEQ ID NO: 1016282 - DNA, 22 bp, Artificial Sequence
  chemically synthesized
acaacctagggaggattaggga

SEQ ID NO: 1016283 - DNA, 22 bp, Artificial Sequence
  chemically synthesized
tattttattgatccctaatcct

SEQ ID NO: 1016284 - DNA, 22 bp, Artificial Sequence
  chemically synthesized
ttttattgatccctaatcctcc

SEQ ID NO: 1016285 - DNA, 22 bp, Artificial Sequence
  chemically synthesized
tattgatccctaatcctcccta

SEQ ID NO: 1016286 - DNA, 22 bp, Artificial Sequence
  chemically synthesized
attgatccctaatcctccctag

SEQ ID NO: 1016287 - DNA, 22 bp, Artificial Sequence
  chemically synthesized
ttgatccctaatcctccctagg

SEQ ID NO: 1016288 - DNA, 22 bp, Artificial Sequence
  chemically synthesized
atccctaatcctccctaggttg

SEQ ID NO: 1016289 - DNA, 22 bp, Artificial Sequence
  chemically synthesized
agaacaaggctcacaacctagg

SEQ ID NO: 1016290 - DNA, 22 bp, Artificial Sequence
  chemically synthesized
atcctccctaggttgtgagcct

SEQ ID NO: 1016291 - DNA, 22 bp, Artificial Sequence
  chemically synthesized
aagcctgagaacaaggctcaca

SEQ ID NO: 1016292 - DNA, 22 bp, Artificial Sequence
  chemically synthesized
gaagcctgagaacaaggctcac

SEQ ID NO: 1016293 - DNA, 22 bp, Artificial Sequence
  chemically synthesized
cctaggttgtgagccttgttct

SEQ ID NO: 1016294 - DNA, 22 bp, Artificial Sequence
  chemically synthesized
ggttgtgagccttgttctcagg

SEQ ID NO: 1016295 - DNA, 22 bp, Artificial Sequence
  chemically synthesized
caaacgtatttgaagcctgaga

SEQ ID NO: 1016296 - DNA, 22 bp, Artificial Sequence
  chemically synthesized
tgagccttgttctcaggcttca

SEQ ID NO: 1016297 - DNA, 22 bp, Artificial Sequence
  chemically synthesized
gttctcaggcttcaaatacgtt

SEQ ID NO: 1016298 - DNA, 22 bp, Artificial Sequence
  chemically synthesized
ttctcaggcttcaaatacgttt

SEQ ID NO: 1016299 - DNA, 22 bp, Artificial Sequence
  chemically synthesized
tcaggcttcaaatacgtttgga

SEQ ID NO: 1016300 - DNA, 22 bp, Artificial Sequence
  chemically synthesized
aggcttcaaatacgtttggagt

SEQ ID NO: 1016301 - DNA, 22 bp, Artificial Sequence
  chemically synthesized
aaatcaaagtatgactccaaac

SEQ ID NO: 1016302 - DNA, 22 bp, Artificial Sequence
  chemically synthesized
aaaatcaaagtatgactccaaa

SEQ ID NO: 1016303 - DNA, 22 bp, Artificial Sequence
  chemically synthesized
caaatacgtttggagtcatact

SEQ ID NO: 1016304 - DNA, 22 bp, Artificial Sequence
  chemically synthesized
aaatacgtttggagtcatactt

SEQ ID NO: 1016305 - DNA, 22 bp, Artificial Sequence
  chemically synthesized
tgagaaacttaaaatcaaagta

SEQ ID NO: 1016306 - DNA, 22 bp, Artificial Sequence
  chemically synthesized
ggagtcatactttgattttaag

SEQ ID NO: 1016307 - DNA, 22 bp, Artificial Sequence
  chemically synthesized
gagtcatactttgattttaagt

SEQ ID NO: 1016308 - DNA, 22 bp, Artificial Sequence
  chemically synthesized
taaacactgtgagaaacttaaa

SEQ ID NO: 1016309 - DNA, 22 bp, Artificial Sequence
  chemically synthesized
tgattttaagtttctcacagtg

SEQ ID NO: 1016310 - DNA, 22 bp, Artificial Sequence
  chemically synthesized
aagtattataaacactgtgaga

SEQ ID NO: 1016311 - DNA, 22 bp, Artificial Sequence
  chemically synthesized
gattttaagtttctcacagtgt

SEQ ID NO: 1016312 - DNA, 22 bp, Artificial Sequence
  chemically synthesized
attttaagtttctcacagtgtt

SEQ ID NO: 1016313 - DNA, 22 bp, Artificial Sequence
  chemically synthesized
agctcaagtattataaacactg

SEQ ID NO: 1016314 - DNA, 22 bp, Artificial Sequence
  chemically synthesized
taagtttctcacagtgtttata

SEQ ID NO: 1016315 - DNA, 22 bp, Artificial Sequence
  chemically synthesized
aagtttctcacagtgtttataa

SEQ ID NO: 1016316 - DNA, 22 bp, Artificial Sequence
  chemically synthesized
agtttctcacagtgtttataat

SEQ ID NO: 1016317 - DNA, 22 bp, Artificial Sequence
  chemically synthesized
ctaagctcaagtattataaaca

SEQ ID NO: 1016318 - DNA, 22 bp, Artificial Sequence
  chemically synthesized
ctcacagtgtttataatacttg

SEQ ID NO: 1016319 - DNA, 22 bp, Artificial Sequence
  chemically synthesized
tcacagtgtttataatacttga

SEQ ID NO: 1016320 - DNA, 22 bp, Artificial Sequence
  chemically synthesized
acagtgtttataatacttgagc

SEQ ID NO: 1016321 - DNA, 22 bp, Artificial Sequence
  chemically synthesized
ataatacttgagcttaggaact

SEQ ID NO: 1016322 - DNA, 22 bp, Artificial Sequence
  chemically synthesized
taatacttgagcttaggaactc

SEQ ID NO: 1016323 - DNA, 22 bp, Artificial Sequence
  chemically synthesized
gagcttaggaactcattctcat

SEQ ID NO: 1016324 - DNA, 22 bp, Artificial Sequence
  chemically synthesized
agcttaggaactcattctcatg

SEQ ID NO: 1016325 - DNA, 22 bp, Artificial Sequence
  chemically synthesized
aggaactcattctcatgccttt

SEQ ID NO: 1016326 - DNA, 22 bp, Artificial Sequence
  chemically synthesized
ggaactcattctcatgccttta

SEQ ID NO: 1016327 - DNA, 22 bp, Artificial Sequence
  chemically synthesized
aacagcgaagagaggggataaa

SEQ ID NO: 1016328 - DNA, 22 bp, Artificial Sequence
  chemically synthesized
attctcatgcctttatcccctc

SEQ ID NO: 1016329 - DNA, 22 bp, Artificial Sequence
  chemically synthesized
caacagcgaagagaggggataa

SEQ ID NO: 1016330 - DNA, 22 bp, Artificial Sequence
  chemically synthesized
tcatgcctttatcccctctctt

SEQ ID NO: 1016331 - DNA, 22 bp, Artificial Sequence
  chemically synthesized
atgcctttatcccctctcttcg

SEQ ID NO: 1016332 - DNA, 22 bp, Artificial Sequence
  chemically synthesized
tatcccctctcttcgctgttga

SEQ ID NO: 1016333 - DNA, 22 bp, Artificial Sequence
  chemically synthesized
atcccctctcttcgctgttgaa

SEQ ID NO: 1016334 - DNA, 22 bp, Artificial Sequence
  chemically synthesized
tcccctctcttcgctgttgaaa

SEQ ID NO: 1016335 - DNA, 22 bp, Artificial Sequence
  chemically synthesized
tcttcgctgttgaaattctaca

SEQ ID NO: 1016336 - DNA, 22 bp, Artificial Sequence
  chemically synthesized
ttcgctgttgaaattctacaca

SEQ ID NO: 1016337 - DNA, 22 bp, Artificial Sequence
  chemically synthesized
cgctgttgaaattctacacatt

SEQ ID NO: 1016338 - DNA, 22 bp, Artificial Sequence
  chemically synthesized
gctgttgaaattctacacattt

SEQ ID NO: 1016339 - DNA, 22 bp, Artificial Sequence
  chemically synthesized
ttgaaattctacacattttttc

SEQ ID NO: 1016340 - DNA, 22 bp, Artificial Sequence
  chemically synthesized
tgagaaataagggaaaaaatgt

SEQ ID NO: 1016341 - DNA, 22 bp, Artificial Sequence
  chemically synthesized
aaattctacacattttttccct

SEQ ID NO: 1016342 - DNA, 22 bp, Artificial Sequence
  chemically synthesized
tacacattttttcccttatttc

SEQ ID NO: 1016343 - DNA, 22 bp, Artificial Sequence
  chemically synthesized
cacattttttcccttatttctc

SEQ ID NO: 1016344 - DNA, 22 bp, Artificial Sequence
  chemically synthesized
tttcccttatttctcataactt

SEQ ID NO: 1016345 - DNA, 22 bp, Artificial Sequence
  chemically synthesized
ttcccttatttctcataacttc

SEQ ID NO: 1016346 - DNA, 22 bp, Artificial Sequence
  chemically synthesized
tcccttatttctcataacttca

SEQ ID NO: 1016347 - DNA, 22 bp, Artificial Sequence
  chemically synthesized
cccttatttctcataacttcac

SEQ ID NO: 1016348 - DNA, 22 bp, Artificial Sequence
  chemically synthesized
agaatgcaataagtgaagttat

SEQ ID NO: 1016349 - DNA, 22 bp, Artificial Sequence
  chemically synthesized
ccttatttctcataacttcact

SEQ ID NO: 1016350 - DNA, 22 bp, Artificial Sequence
  chemically synthesized
ttcagaatgcaataagtgaagt

SEQ ID NO: 1016351 - DNA, 22 bp, Artificial Sequence
  chemically synthesized
attcagaatgcaataagtgaag

SEQ ID NO: 1016352 - DNA, 22 bp, Artificial Sequence
  chemically synthesized
atttctcataacttcacttatt

SEQ ID NO: 1016353 - DNA, 22 bp, Artificial Sequence
  chemically synthesized
tttctcataacttcacttattg

SEQ ID NO: 1016354 - DNA, 22 bp, Artificial Sequence
  chemically synthesized
tttattcagaatgcaataagtg

SEQ ID NO: 1016355 - DNA, 22 bp, Artificial Sequence
  chemically synthesized
ctcataacttcacttattgcat

SEQ ID NO: 1016356 - DNA, 22 bp, Artificial Sequence
  chemically synthesized
tcataacttcacttattgcatt

SEQ ID NO: 1016357 - DNA, 22 bp, Artificial Sequence
  chemically synthesized
ctgtttattcagaatgcaataa

SEQ ID NO: 1016358 - DNA, 22 bp, Artificial Sequence
  chemically synthesized
gctgtttattcagaatgcaata

SEQ ID NO: 1016359 - DNA, 22 bp, Artificial Sequence
  chemically synthesized
ataacttcacttattgcattct

SEQ ID NO: 1016360 - DNA, 22 bp, Artificial Sequence
  chemically synthesized
tgctgtttattcagaatgcaat

SEQ ID NO: 1016361 - DNA, 22 bp, Artificial Sequence
  chemically synthesized
tctttgctgtttattcagaatg

SEQ ID NO: 1016362 - DNA, 22 bp, Artificial Sequence
  chemically synthesized
atctttgctgtttattcagaat

SEQ ID NO: 1016363 - DNA, 22 bp, Artificial Sequence
  chemically synthesized
cacttattgcattctgaataaa

SEQ ID NO: 1016364 - DNA, 22 bp, Artificial Sequence
  chemically synthesized
acttattgcattctgaataaac

SEQ ID NO: 1016365 - DNA, 22 bp, Artificial Sequence
  chemically synthesized
attgcattctgaataaacagca

SEQ ID NO: 1016366 - DNA, 22 bp, Artificial Sequence
  chemically synthesized
ttgcattctgaataaacagcaa

SEQ ID NO: 1016367 - DNA, 22 bp, Artificial Sequence
  chemically synthesized
cattctgaataaacagcaaaga

SEQ ID NO: 1016368 - DNA, 22 bp, Artificial Sequence
  chemically synthesized
tgaataaacagcaaagataaat

SEQ ID NO: 1016369 - DNA, 22 bp, Artificial Sequence
  chemically synthesized
aataaacagcaaagataaattt

SEQ ID NO: 1016370 - DNA, 22 bp, Artificial Sequence
  chemically synthesized
gtggtacaggtcaaagaaaatt

SEQ ID NO: 1016371 - DNA, 22 bp, Artificial Sequence
  chemically synthesized
atgttggtggtacaggtcaaag

SEQ ID NO: 1016372 - DNA, 22 bp, Artificial Sequence
  chemically synthesized
ggtgttgatgttggtggtacag

SEQ ID NO: 1016373 - DNA, 22 bp, Artificial Sequence
  chemically synthesized
aggtgttgatgttggtggtaca

SEQ ID NO: 1016374 - DNA, 22 bp, Artificial Sequence
  chemically synthesized
taggtgttgatgttggtggtac

SEQ ID NO: 1016375 - DNA, 22 bp, Artificial Sequence
  chemically synthesized
tctttgacctgtaccaccaaca

SEQ ID NO: 1016376 - DNA, 22 bp, Artificial Sequence
  chemically synthesized
ctttgacctgtaccaccaacat

SEQ ID NO: 1016377 - DNA, 22 bp, Artificial Sequence
  chemically synthesized
tttgacctgtaccaccaacatc

SEQ ID NO: 1016378 - DNA, 22 bp, Artificial Sequence
  chemically synthesized
tgacctgtaccaccaacatcaa

SEQ ID NO: 1016379 - DNA, 22 bp, Artificial Sequence
  chemically synthesized
gacctgtaccaccaacatcaac

SEQ ID NO: 1016380 - DNA, 22 bp, Artificial Sequence
  chemically synthesized
acctgtaccaccaacatcaaca

SEQ ID NO: 1016381 - DNA, 22 bp, Artificial Sequence
  chemically synthesized
taccaccaacatcaacacctaa

SEQ ID NO: 1016382 - DNA, 22 bp, Artificial Sequence
  chemically synthesized
taatgggaaagaggtcacttta

SEQ ID NO: 1016383 - DNA, 22 bp, Artificial Sequence
  chemically synthesized
aagtgacctctttcccattata

SEQ ID NO: 1016384 - DNA, 22 bp, Artificial Sequence
  chemically synthesized
agcacagtagaagagtccccta

SEQ ID NO: 1016385 - DNA, 22 bp, Artificial Sequence
  chemically synthesized
tttcccattataggggactctt

SEQ ID NO: 1016386 - DNA, 22 bp, Artificial Sequence
  chemically synthesized
tcccattataggggactcttct

SEQ ID NO: 1016387 - DNA, 22 bp, Artificial Sequence
  chemically synthesized
cccattataggggactcttcta

SEQ ID NO: 1016388 - DNA, 22 bp, Artificial Sequence
  chemically synthesized
cattaagcacagtagaagagtc

SEQ ID NO: 1016389 - DNA, 22 bp, Artificial Sequence
  chemically synthesized
ccattataggggactcttctac

SEQ ID NO: 1016390 - DNA, 22 bp, Artificial Sequence
  chemically synthesized
gtctccattaagcacagtagaa

SEQ ID NO: 1016391 - DNA, 22 bp, Artificial Sequence
  chemically synthesized
taggggactcttctactgtgct

SEQ ID NO: 1016392 - DNA, 22 bp, Artificial Sequence
  chemically synthesized
ttctactgtgcttaatggagac

SEQ ID NO: 1016393 - DNA, 22 bp, Artificial Sequence
  chemically synthesized
ctactgtgcttaatggagacta

SEQ ID NO: 1016394 - DNA, 22 bp, Artificial Sequence
  chemically synthesized
tactgtgcttaatggagactag

SEQ ID NO: 1016395 - DNA, 22 bp, Artificial Sequence
  chemically synthesized
aggggaacacatcctagtctcc

SEQ ID NO: 1016396 - DNA, 22 bp, Artificial Sequence
  chemically synthesized
ctgtgcttaatggagactagga

SEQ ID NO: 1016397 - DNA, 22 bp, Artificial Sequence
  chemically synthesized
gaggggaacacatcctagtctc

SEQ ID NO: 1016398 - DNA, 22 bp, Artificial Sequence
  chemically synthesized
tgaggggaacacatcctagtct

SEQ ID NO: 1016399 - DNA, 22 bp, Artificial Sequence
  chemically synthesized
tgcttaatggagactaggatgt

SEQ ID NO: 1016400 - DNA, 22 bp, Artificial Sequence
  chemically synthesized
ctttgaggggaacacatcctag

SEQ ID NO: 1016401 - DNA, 22 bp, Artificial Sequence
  chemically synthesized
aatggagactaggatgtgttcc

SEQ ID NO: 1016402 - DNA, 22 bp, Artificial Sequence
  chemically synthesized
atggagactaggatgtgttccc

SEQ ID NO: 1016403 - DNA, 22 bp, Artificial Sequence
  chemically synthesized
gaattcctttgaggggaacaca

SEQ ID NO: 1016404 - DNA, 22 bp, Artificial Sequence
  chemically synthesized
ggatgtgttcccctcaaaggaa

SEQ ID NO: 1016405 - DNA, 22 bp, Artificial Sequence
  chemically synthesized
taaaaactagaattcctttgag

SEQ ID NO: 1016406 - DNA, 22 bp, Artificial Sequence
  chemically synthesized
cctataaaaactagaattcctt

SEQ ID NO: 1016407 - DNA, 22 bp, Artificial Sequence
  chemically synthesized
acctataaaaactagaattcct

SEQ ID NO: 1016408 - DNA, 22 bp, Artificial Sequence
  chemically synthesized
ccctcaaaggaattctagtttt

SEQ ID NO: 1016409 - DNA, 22 bp, Artificial Sequence
  chemically synthesized
acaagtttacctataaaaacta

SEQ ID NO: 1016410 - DNA, 22 bp, Artificial Sequence
  chemically synthesized
aacaagtttacctataaaaact

SEQ ID NO: 1016411 - DNA, 22 bp, Artificial Sequence
  chemically synthesized
aaaggaattctagtttttatag

SEQ ID NO: 1016412 - DNA, 22 bp, Artificial Sequence
  chemically synthesized
tagtttttataggtaaacttgt

SEQ ID NO: 1016413 - DNA, 22 bp, Artificial Sequence
  chemically synthesized
gtttttataggtaaacttgtta

SEQ ID NO: 1016414 - DNA, 22 bp, Artificial Sequence
  chemically synthesized
ttataggtaaacttgttaaatg

SEQ ID NO: 1016415 - DNA, 22 bp, Artificial Sequence
  chemically synthesized
tataggtaaacttgttaaatgt

SEQ ID NO: 1016416 - DNA, 22 bp, Artificial Sequence
  chemically synthesized
ataggtaaacttgttaaatgtc

SEQ ID NO: 1016417 - DNA, 22 bp, Artificial Sequence
  chemically synthesized
taggtaaacttgttaaatgtct

SEQ ID NO: 1016418 - DNA, 22 bp, Artificial Sequence
  chemically synthesized
ataaggcagtgtccatacaaga

SEQ ID NO: 1016419 - DNA, 22 bp, Artificial Sequence
  chemically synthesized
cataaggcagtgtccatacaag

SEQ ID NO: 1016420 - DNA, 22 bp, Artificial Sequence
  chemically synthesized
gttaaatgtcttgtatggacac

SEQ ID NO: 1016421 - DNA, 22 bp, Artificial Sequence
  chemically synthesized
ttaaatgtcttgtatggacact

SEQ ID NO: 1016422 - DNA, 22 bp, Artificial Sequence
  chemically synthesized
aatgtcttgtatggacactgcc

SEQ ID NO: 1016423 - DNA, 22 bp, Artificial Sequence
  chemically synthesized
gtatggacactgccttatgaaa

SEQ ID NO: 1016424 - DNA, 22 bp, Artificial Sequence
  chemically synthesized
tatggacactgccttatgaaac

SEQ ID NO: 1016425 - DNA, 22 bp, Artificial Sequence
  chemically synthesized
aaagcaaatgaggtttcataag

SEQ ID NO: 1016426 - DNA, 22 bp, Artificial Sequence
  chemically synthesized
gaaagcaaatgaggtttcataa

SEQ ID NO: 1016427 - DNA, 22 bp, Artificial Sequence
  chemically synthesized
tgaaagcaaatgaggtttcata

SEQ ID NO: 1016428 - DNA, 22 bp, Artificial Sequence
  chemically synthesized
aagctttgaaagcaaatgaggt

SEQ ID NO: 1016429 - DNA, 22 bp, Artificial Sequence
  chemically synthesized
ccttatgaaacctcatttgctt

SEQ ID NO: 1016430 - DNA, 22 bp, Artificial Sequence
  chemically synthesized
gttgaagctttgaaagcaaatg

SEQ ID NO: 1016431 - DNA, 22 bp, Artificial Sequence
  chemically synthesized
atgaaacctcatttgctttcaa

SEQ ID NO: 1016432 - DNA, 22 bp, Artificial Sequence
  chemically synthesized
tgaaacctcatttgctttcaaa

SEQ ID NO: 1016433 - DNA, 22 bp, Artificial Sequence
  chemically synthesized
tagatgttagttgaagctttga

SEQ ID NO: 1016434 - DNA, 22 bp, Artificial Sequence
  chemically synthesized
ctgtagatgttagttgaagctt

SEQ ID NO: 1016435 - DNA, 22 bp, Artificial Sequence
  chemically synthesized
atttgctttcaaagcttcaact

SEQ ID NO: 1016436 - DNA, 22 bp, Artificial Sequence
  chemically synthesized
gctttcaaagcttcaactaaca

SEQ ID NO: 1016437 - DNA, 22 bp, Artificial Sequence
  chemically synthesized
ctttcaaagcttcaactaacat

SEQ ID NO: 1016438 - DNA, 22 bp, Artificial Sequence
  chemically synthesized
tcaaagcttcaactaacatcta

SEQ ID NO: 1016439 - DNA, 22 bp, Artificial Sequence
  chemically synthesized
caaagcttcaactaacatctac

SEQ ID NO: 1016440 - DNA, 22 bp, Artificial Sequence
  chemically synthesized
ccaatacctgctgtagatgtta

SEQ ID NO: 1016441 - DNA, 22 bp, Artificial Sequence
  chemically synthesized
aaagcttcaactaacatctaca

SEQ ID NO: 1016442 - DNA, 22 bp, Artificial Sequence
  chemically synthesized
gccaatacctgctgtagatgtt

SEQ ID NO: 1016443 - DNA, 22 bp, Artificial Sequence
  chemically synthesized
caactaacatctacagcaggta

SEQ ID NO: 1016444 - DNA, 22 bp, Artificial Sequence
  chemically synthesized
aactaacatctacagcaggtat

SEQ ID NO: 1016445 - DNA, 22 bp, Artificial Sequence
  chemically synthesized
taaagtttgccaatacctgctg

SEQ ID NO: 1016446 - DNA, 22 bp, Artificial Sequence
  chemically synthesized
tctataaagtttgccaatacct

SEQ ID NO: 1016447 - DNA, 22 bp, Artificial Sequence
  chemically synthesized
acatctacagcaggtattggca

SEQ ID NO: 1016448 - DNA, 22 bp, Artificial Sequence
  chemically synthesized
atctataaagtttgccaatacc

SEQ ID NO: 1016449 - DNA, 22 bp, Artificial Sequence
  chemically synthesized
tatctataaagtttgccaatac

SEQ ID NO: 1016450 - DNA, 22 bp, Artificial Sequence
  chemically synthesized
cagcaggtattggcaaacttta

SEQ ID NO: 1016451 - DNA, 22 bp, Artificial Sequence
  chemically synthesized
aagatctttatctataaagttt

SEQ ID NO: 1016452 - DNA, 22 bp, Artificial Sequence
  chemically synthesized
tcaagatctttatctataaagt

SEQ ID NO: 1016453 - DNA, 22 bp, Artificial Sequence
  chemically synthesized
ttctcaagatctttatctataa

SEQ ID NO: 1016454 - DNA, 22 bp, Artificial Sequence
  chemically synthesized
gttctcaagatctttatctata

SEQ ID NO: 1016455 - DNA, 22 bp, Artificial Sequence
  chemically synthesized
gcaaactttatagataaagatc

SEQ ID NO: 1016456 - DNA, 22 bp, Artificial Sequence
  chemically synthesized
aaatatttgttctcaagatctt

SEQ ID NO: 1016457 - DNA, 22 bp, Artificial Sequence
  chemically synthesized
tatagataaagatcttgagaac

SEQ ID NO: 1016458 - DNA, 22 bp, Artificial Sequence
  chemically synthesized
atagataaagatcttgagaaca

SEQ ID NO: 1016459 - DNA, 22 bp, Artificial Sequence
  chemically synthesized
tagataaagatcttgagaacaa

SEQ ID NO: 1016460 - DNA, 22 bp, Artificial Sequence
  chemically synthesized
gagaacaaatatttcaggcttt

SEQ ID NO: 1016461 - DNA, 22 bp, Artificial Sequence
  chemically synthesized
agaacaaatatttcaggctttg

SEQ ID NO: 1016462 - DNA, 22 bp, Artificial Sequence
  chemically synthesized
taacaaaaaccatacggcccac

SEQ ID NO: 1016463 - DNA, 22 bp, Artificial Sequence
  chemically synthesized
caggctttgtgggccgtatggt

SEQ ID NO: 1016464 - DNA, 22 bp, Artificial Sequence
  chemically synthesized
aggctttgtgggccgtatggtt

SEQ ID NO: 1016465 - DNA, 22 bp, Artificial Sequence
  chemically synthesized
agtagttgtaacaaaaaccata

SEQ ID NO: 1016466 - DNA, 22 bp, Artificial Sequence
  chemically synthesized
tgtgggccgtatggtttttgtt

SEQ ID NO: 1016467 - DNA, 22 bp, Artificial Sequence
  chemically synthesized
gtgggccgtatggtttttgtta

SEQ ID NO: 1016468 - DNA, 22 bp, Artificial Sequence
  chemically synthesized
tgggccgtatggtttttgttac

SEQ ID NO: 1016469 - DNA, 22 bp, Artificial Sequence
  chemically synthesized
aaggcagagttgagtagttgta

SEQ ID NO: 1016470 - DNA, 22 bp, Artificial Sequence
  chemically synthesized
caaggcagagttgagtagttgt

SEQ ID NO: 1016471 - DNA, 22 bp, Artificial Sequence
  chemically synthesized
aacttcaaggcagagttgagta

SEQ ID NO: 1016472 - DNA, 22 bp, Artificial Sequence
  chemically synthesized
gaacttcaaggcagagttgagt

SEQ ID NO: 1016473 - DNA, 22 bp, Artificial Sequence
  chemically synthesized
ttgttacaactactcaactctg

SEQ ID NO: 1016474 - DNA, 22 bp, Artificial Sequence
  chemically synthesized
tgaacttcaaggcagagttgag

SEQ ID NO: 1016475 - DNA, 22 bp, Artificial Sequence
  chemically synthesized
tgttacaactactcaactctgc

SEQ ID NO: 1016476 - DNA, 22 bp, Artificial Sequence
  chemically synthesized
ttgaacttcaaggcagagttga

SEQ ID NO: 1016477 - DNA, 22 bp, Artificial Sequence
  chemically synthesized
gttacaactactcaactctgcc

SEQ ID NO: 1016478 - DNA, 22 bp, Artificial Sequence
  chemically synthesized
tttgaacttcaaggcagagttg

SEQ ID NO: 1016479 - DNA, 22 bp, Artificial Sequence
  chemically synthesized
ttacaactactcaactctgcct

SEQ ID NO: 1016480 - DNA, 22 bp, Artificial Sequence
  chemically synthesized
ttttgaacttcaaggcagagtt

SEQ ID NO: 1016481 - DNA, 22 bp, Artificial Sequence
  chemically synthesized
tttttgaacttcaaggcagagt

SEQ ID NO: 1016482 - DNA, 22 bp, Artificial Sequence
  chemically synthesized
ttttttgaacttcaaggcagag

SEQ ID NO: 1016483 - DNA, 22 bp, Artificial Sequence
  chemically synthesized
caactactcaactctgccttga

SEQ ID NO: 1016484 - DNA, 22 bp, Artificial Sequence
  chemically synthesized
ctcaactctgccttgaagttca

SEQ ID NO: 1016485 - DNA, 22 bp, Artificial Sequence
  chemically synthesized
aactctgccttgaagttcaaaa

SEQ ID NO: 1016486 - DNA, 22 bp, Artificial Sequence
  chemically synthesized
catgtataccttttttttgaac

SEQ ID NO: 1016487 - DNA, 22 bp, Artificial Sequence
  chemically synthesized
tgccttgaagttcaaaaaaaag

SEQ ID NO: 1016488 - DNA, 22 bp, Artificial Sequence
  chemically synthesized
ccttgaagttcaaaaaaaaggt

SEQ ID NO: 1016489 - DNA, 22 bp, Artificial Sequence
  chemically synthesized
tgctccatgtataccttttttt

SEQ ID NO: 1016490 - DNA, 22 bp, Artificial Sequence
  chemically synthesized
atgctccatgtatacctttttt

SEQ ID NO: 1016491 - DNA, 22 bp, Artificial Sequence
  chemically synthesized
gaagttcaaaaaaaaggtatac

SEQ ID NO: 1016492 - DNA, 22 bp, Artificial Sequence
  chemically synthesized
cttatgctccatgtataccttt

SEQ ID NO: 1016493 - DNA, 22 bp, Artificial Sequence
  chemically synthesized
aagttcaaaaaaaaggtataca

SEQ ID NO: 1016494 - DNA, 22 bp, Artificial Sequence
  chemically synthesized
gcttatgctccatgtatacctt

SEQ ID NO: 1016495 - DNA, 22 bp, Artificial Sequence
  chemically synthesized
aaaaaaaaggtatacatggagc

SEQ ID NO: 1016496 - DNA, 22 bp, Artificial Sequence
  chemically synthesized
aatcccagccatatccatttgc

SEQ ID NO: 1016497 - DNA, 22 bp, Artificial Sequence
  chemically synthesized
taaagtagtattgaatcccagc

SEQ ID NO: 1016498 - DNA, 22 bp, Artificial Sequence
  chemically synthesized
gtaaagtagtattgaatcccag

SEQ ID NO: 1016499 - DNA, 22 bp, Artificial Sequence
  chemically synthesized
tgtaaagtagtattgaatccca

SEQ ID NO: 1016500 - DNA, 22 bp, Artificial Sequence
  chemically synthesized
ttgtaaagtagtattgaatccc

SEQ ID NO: 1016501 - DNA, 22 bp, Artificial Sequence
  chemically synthesized
tttttgtaaagtagtattgaat

SEQ ID NO: 1016502 - DNA, 22 bp, Artificial Sequence
  chemically synthesized
gtttttgtaaagtagtattgaa

SEQ ID NO: 1016503 - DNA, 22 bp, Artificial Sequence
  chemically synthesized
ggattcaatactactttacaaa

SEQ ID NO: 1016504 - DNA, 22 bp, Artificial Sequence
  chemically synthesized
cacccaccacttgtttttgtaa

SEQ ID NO: 1016505 - DNA, 22 bp, Artificial Sequence
  chemically synthesized
aatactactttacaaaaacaag

SEQ ID NO: 1016506 - DNA, 22 bp, Artificial Sequence
  chemically synthesized
ctttacaaaaacaagtggtggg

SEQ ID NO: 1016507 - DNA, 22 bp, Artificial Sequence
  chemically synthesized
tacaaaaacaagtggtgggtgt

SEQ ID NO: 1016508 - DNA, 22 bp, Artificial Sequence
  chemically synthesized
acaaaaacaagtggtgggtgta

SEQ ID NO: 1016509 - DNA, 22 bp, Artificial Sequence
  chemically synthesized
caaaaacaagtggtgggtgtaa

SEQ ID NO: 1016510 - DNA, 22 bp, Artificial Sequence
  chemically synthesized
cccatgggccaattacacccac

SEQ ID NO: 1016511 - DNA, 22 bp, Artificial Sequence
  chemically synthesized
ctgcccatgggccaattacacc

SEQ ID NO: 1016512 - DNA, 22 bp, Artificial Sequence
  chemically synthesized
agagtcaataatctcctgccca

SEQ ID NO: 1016513 - DNA, 22 bp, Artificial Sequence
  chemically synthesized
gattaagagtcaataatctcct

SEQ ID NO: 1016514 - DNA, 22 bp, Artificial Sequence
  chemically synthesized
gcccatgggcaggagattattg

SEQ ID NO: 1016515 - DNA, 22 bp, Artificial Sequence
  chemically synthesized
tgtcataatcagcctagattaa

SEQ ID NO: 1016516 - DNA, 22 bp, Artificial Sequence
  chemically synthesized
ttgactcttaatctaggctgat

SEQ ID NO: 1016517 - DNA, 22 bp, Artificial Sequence
  chemically synthesized
gagctatgtcataatcagccta

SEQ ID NO: 1016518 - DNA, 22 bp, Artificial Sequence
  chemically synthesized
ggagctatgtcataatcagcct

SEQ ID NO: 1016519 - DNA, 22 bp, Artificial Sequence
  chemically synthesized
actcttaatctaggctgattat

SEQ ID NO: 1016520 - DNA, 22 bp, Artificial Sequence
  chemically synthesized
ttaatctaggctgattatgaca

SEQ ID NO: 1016521 - DNA, 22 bp, Artificial Sequence
  chemically synthesized
aaatttggagctatgtcataat

SEQ ID NO: 1016522 - DNA, 22 bp, Artificial Sequence
  chemically synthesized
aatctaggctgattatgacata

SEQ ID NO: 1016523 - DNA, 22 bp, Artificial Sequence
  chemically synthesized
atctaggctgattatgacatag

SEQ ID NO: 1016524 - DNA, 22 bp, Artificial Sequence
  chemically synthesized
ggctgattatgacatagctcca

SEQ ID NO: 1016525 - DNA, 22 bp, Artificial Sequence
  chemically synthesized
attatgacatagctccaaattt

SEQ ID NO: 1016526 - DNA, 22 bp, Artificial Sequence
  chemically synthesized
agataagggctgaaatttggag

SEQ ID NO: 1016527 - DNA, 22 bp, Artificial Sequence
  chemically synthesized
tgacatagctccaaatttcagc

SEQ ID NO: 1016528 - DNA, 22 bp, Artificial Sequence
  chemically synthesized
tatacctcagataagggctgaa

SEQ ID NO: 1016529 - DNA, 22 bp, Artificial Sequence
  chemically synthesized
gctatatacctcagataagggc

SEQ ID NO: 1016530 - DNA, 22 bp, Artificial Sequence
  chemically synthesized
caaatttcagcccttatctgag

SEQ ID NO: 1016531 - DNA, 22 bp, Artificial Sequence
  chemically synthesized
cagcccttatctgaggtatata

SEQ ID NO: 1016532 - DNA, 22 bp, Artificial Sequence
  chemically synthesized
agcccttatctgaggtatatag

SEQ ID NO: 1016533 - DNA, 22 bp, Artificial Sequence
  chemically synthesized
atctgaggtatatagccaactg

SEQ ID NO: 1016534 - DNA, 22 bp, Artificial Sequence
  chemically synthesized
tctgaggtatatagccaactgc

SEQ ID NO: 1016535 - DNA, 22 bp, Artificial Sequence
  chemically synthesized
aggtatatagccaactgctact

SEQ ID NO: 1016536 - DNA, 22 bp, Artificial Sequence
  chemically synthesized
atgaggatagtccaagtagcag

SEQ ID NO: 1016537 - DNA, 22 bp, Artificial Sequence
  chemically synthesized
tgatgaggatagtccaagtagc

SEQ ID NO: 1016538 - DNA, 22 bp, Artificial Sequence
  chemically synthesized
ctacttggactatcctcatcag

SEQ ID NO: 1016539 - DNA, 22 bp, Artificial Sequence
  chemically synthesized
acatcaaatgttctgatgagga

SEQ ID NO: 1016540 - DNA, 22 bp, Artificial Sequence
  chemically synthesized
cttggactatcctcatcagaac

SEQ ID NO: 1016541 - DNA, 22 bp, Artificial Sequence
  chemically synthesized
ggactatcctcatcagaacatt

SEQ ID NO: 1016542 - DNA, 22 bp, Artificial Sequence
  chemically synthesized
aggttcacatcaaatgttctga

SEQ ID NO: 1016543 - DNA, 22 bp, Artificial Sequence
  chemically synthesized
gactatcctcatcagaacattt

SEQ ID NO: 1016544 - DNA, 22 bp, Artificial Sequence
  chemically synthesized
gaggttcacatcaaatgttctg

SEQ ID NO: 1016545 - DNA, 22 bp, Artificial Sequence
  chemically synthesized
tgaggttcacatcaaatgttct

SEQ ID NO: 1016546 - DNA, 22 bp, Artificial Sequence
  chemically synthesized
tcctcatcagaacatttgatgt

SEQ ID NO: 1016547 - DNA, 22 bp, Artificial Sequence
  chemically synthesized
atcagaacatttgatgtgaacc

SEQ ID NO: 1016548 - DNA, 22 bp, Artificial Sequence
  chemically synthesized
acataacatctttgaggttcac

SEQ ID NO: 1016549 - DNA, 22 bp, Artificial Sequence
  chemically synthesized
ttgacataacatctttgaggtt

SEQ ID NO: 1016550 - DNA, 22 bp, Artificial Sequence
  chemically synthesized
gatgtgaacctcaaagatgtta

SEQ ID NO: 1016551 - DNA, 22 bp, Artificial Sequence
  chemically synthesized
atgtgaacctcaaagatgttat

SEQ ID NO: 1016552 - DNA, 22 bp, Artificial Sequence
  chemically synthesized
aaagatgttatgtcaacaattc

SEQ ID NO: 1016553 - DNA, 22 bp, Artificial Sequence
  chemically synthesized
catgggaaaataaggaattgtt

SEQ ID NO: 1016554 - DNA, 22 bp, Artificial Sequence
  chemically synthesized
gcatgggaaaataaggaattgt

SEQ ID NO: 1016555 - DNA, 22 bp, Artificial Sequence
  chemically synthesized
tgtcaacaattccttattttcc

SEQ ID NO: 1016556 - DNA, 22 bp, Artificial Sequence
  chemically synthesized
cttattttcccatgcaagtctt

SEQ ID NO: 1016557 - DNA, 22 bp, Artificial Sequence
  chemically synthesized
attttcccatgcaagtctttga

SEQ ID NO: 1016558 - DNA, 22 bp, Artificial Sequence
  chemically synthesized
ttttcccatgcaagtctttgat

SEQ ID NO: 1016559 - DNA, 22 bp, Artificial Sequence
  chemically synthesized
tcccatgcaagtctttgatatg

SEQ ID NO: 1016560 - DNA, 22 bp, Artificial Sequence
  chemically synthesized
cccatgcaagtctttgatatga

SEQ ID NO: 1016561 - DNA, 22 bp, Artificial Sequence
  chemically synthesized
ccatgcaagtctttgatatgat

SEQ ID NO: 1016562 - DNA, 22 bp, Artificial Sequence
  chemically synthesized
ggtggggacacagatccaaatc

SEQ ID NO: 1016563 - DNA, 22 bp, Artificial Sequence
  chemically synthesized
gggtggggacacagatccaaat

SEQ ID NO: 1016564 - DNA, 22 bp, Artificial Sequence
  chemically synthesized
tgatatgatttggatctgtgtc

SEQ ID NO: 1016565 - DNA, 22 bp, Artificial Sequence
  chemically synthesized
gatatgatttggatctgtgtcc

SEQ ID NO: 1016566 - DNA, 22 bp, Artificial Sequence
  chemically synthesized
atatgatttggatctgtgtccc

SEQ ID NO: 1016567 - DNA, 22 bp, Artificial Sequence
  chemically synthesized
atatgagatttgggtggggaca

SEQ ID NO: 1016568 - DNA, 22 bp, Artificial Sequence
  chemically synthesized
aatatgagatttgggtggggac

SEQ ID NO: 1016569 - DNA, 22 bp, Artificial Sequence
  chemically synthesized
ggatctgtgtccccacccaaat

SEQ ID NO: 1016570 - DNA, 22 bp, Artificial Sequence
  chemically synthesized
gatctgtgtccccacccaaatc

SEQ ID NO: 1016571 - DNA, 22 bp, Artificial Sequence
  chemically synthesized
caatttaatatgagatttgggt

SEQ ID NO: 1016572 - DNA, 22 bp, Artificial Sequence
  chemically synthesized
tgtccccacccaaatctcatat

SEQ ID NO: 1016573 - DNA, 22 bp, Artificial Sequence
  chemically synthesized
gggattacaatttaatatgaga

SEQ ID NO: 1016574 - DNA, 22 bp, Artificial Sequence
  chemically synthesized
caacattggggattacaattta

SEQ ID NO: 1016575 - DNA, 22 bp, Artificial Sequence
  chemically synthesized
atattaaattgtaatccccaat

SEQ ID NO: 1016576 - DNA, 22 bp, Artificial Sequence
  chemically synthesized
aattgtaatccccaatgttgga

SEQ ID NO: 1016577 - DNA, 22 bp, Artificial Sequence
  chemically synthesized
accaggccccacctccaacatt

SEQ ID NO: 1016578 - DNA, 22 bp, Artificial Sequence
  chemically synthesized
tcaccaggccccacctccaaca

SEQ ID NO: 1016579 - DNA, 22 bp, Artificial Sequence
  chemically synthesized
taatccccaatgttggaggtgg

SEQ ID NO: 1016580 - DNA, 22 bp, Artificial Sequence
  chemically synthesized
atgatccagtcacctctcacca

SEQ ID NO: 1016581 - DNA, 22 bp, Artificial Sequence
  chemically synthesized
gaggtggggcctggtgagaggt

SEQ ID NO: 1016582 - DNA, 22 bp, Artificial Sequence
  chemically synthesized
gtgagaggtgactggatcatca

SEQ ID NO: 1016583 - DNA, 22 bp, Artificial Sequence
  chemically synthesized
aaccgtgagaaaccaccctgat

SEQ ID NO: 1016584 - DNA, 22 bp, Artificial Sequence
  chemically synthesized
gatcatcagggtggtttctcac

SEQ ID NO: 1016585 - DNA, 22 bp, Artificial Sequence
  chemically synthesized
ctcacggtttaataccatcctc

SEQ ID NO: 1016586 - DNA, 22 bp, Artificial Sequence
  chemically synthesized
tcacggtttaataccatcctct

SEQ ID NO: 1016587 - DNA, 22 bp, Artificial Sequence
  chemically synthesized
acggtttaataccatcctcttg

SEQ ID NO: 1016588 - DNA, 22 bp, Artificial Sequence
  chemically synthesized
atgaggacagtaccaagaggat

SEQ ID NO: 1016589 - DNA, 22 bp, Artificial Sequence
  chemically synthesized
catgaggacagtaccaagagga

SEQ ID NO: 1016590 - DNA, 22 bp, Artificial Sequence
  chemically synthesized
tcatgaggacagtaccaagagg

SEQ ID NO: 1016591 - DNA, 22 bp, Artificial Sequence
  chemically synthesized
aataccatcctcttggtactgt

SEQ ID NO: 1016592 - DNA, 22 bp, Artificial Sequence
  chemically synthesized
attttcatgaggacagtaccaa

SEQ ID NO: 1016593 - DNA, 22 bp, Artificial Sequence
  chemically synthesized
ataccatcctcttggtactgtc

SEQ ID NO: 1016594 - DNA, 22 bp, Artificial Sequence
  chemically synthesized
actcattttcatgaggacagta

SEQ ID NO: 1016595 - DNA, 22 bp, Artificial Sequence
  chemically synthesized
ttggtactgtcctcatgaaaat

SEQ ID NO: 1016596 - DNA, 22 bp, Artificial Sequence
  chemically synthesized
gagaactcactcattttcatga

SEQ ID NO: 1016597 - DNA, 22 bp, Artificial Sequence
  chemically synthesized
ggagaactcactcattttcatg

SEQ ID NO: 1016598 - DNA, 22 bp, Artificial Sequence
  chemically synthesized
ggtactgtcctcatgaaaatga

SEQ ID NO: 1016599 - DNA, 22 bp, Artificial Sequence
  chemically synthesized
gtactgtcctcatgaaaatgag

SEQ ID NO: 1016600 - DNA, 22 bp, Artificial Sequence
  chemically synthesized
tcctcatgaaaatgagtgagtt

SEQ ID NO: 1016601 - DNA, 22 bp, Artificial Sequence
  chemically synthesized
atgaaaatgagtgagttctcca

SEQ ID NO: 1016602 - DNA, 22 bp, Artificial Sequence
  chemically synthesized
aacaaccagatcttggagaact

SEQ ID NO: 1016603 - DNA, 22 bp, Artificial Sequence
  chemically synthesized
aaacaaccagatcttggagaac

SEQ ID NO: 1016604 - DNA, 22 bp, Artificial Sequence
  chemically synthesized
taaacaaccagatcttggagaa

SEQ ID NO: 1016605 - DNA, 22 bp, Artificial Sequence
  chemically synthesized
ttaaacaaccagatcttggaga

SEQ ID NO: 1016606 - DNA, 22 bp, Artificial Sequence
  chemically synthesized
cttttaaacaaccagatcttgg

SEQ ID NO: 1016607 - DNA, 22 bp, Artificial Sequence
  chemically synthesized
cctacttttaaacaaccagatc

SEQ ID NO: 1016608 - DNA, 22 bp, Artificial Sequence
  chemically synthesized
tccaagatctggttgtttaaaa

SEQ ID NO: 1016609 - DNA, 22 bp, Artificial Sequence
  chemically synthesized
caagatctggttgtttaaaagt

SEQ ID NO: 1016610 - DNA, 22 bp, Artificial Sequence
  chemically synthesized
gttgtttaaaagtaggtagcca

SEQ ID NO: 1016611 - DNA, 22 bp, Artificial Sequence
  chemically synthesized
gtggtgggggtgggtggctacc

SEQ ID NO: 1016612 - DNA, 22 bp, Artificial Sequence
  chemically synthesized
tttaaaagtaggtagccaccca

SEQ ID NO: 1016613 - DNA, 22 bp, Artificial Sequence
  chemically synthesized
aaaagtaggtagccacccaccc

SEQ ID NO: 1016614 - DNA, 22 bp, Artificial Sequence
  chemically synthesized
aaagtaggtagccacccacccc

SEQ ID NO: 1016615 - DNA, 22 bp, Artificial Sequence
  chemically synthesized
acatggcgaaagcagagagaga

SEQ ID NO: 1016616 - DNA, 22 bp, Artificial Sequence
  chemically synthesized
cacatggcgaaagcagagagag

SEQ ID NO: 1016617 - DNA, 22 bp, Artificial Sequence
  chemically synthesized
tctctctctgctttcgccatgt

SEQ ID NO: 1016618 - DNA, 22 bp, Artificial Sequence
  chemically synthesized
tctctctgctttcgccatgtga

SEQ ID NO: 1016619 - DNA, 22 bp, Artificial Sequence
  chemically synthesized
tctctgctttcgccatgtgaaa

SEQ ID NO: 1016620 - DNA, 22 bp, Artificial Sequence
  chemically synthesized
tctgctttcgccatgtgaaatg

SEQ ID NO: 1016621 - DNA, 22 bp, Artificial Sequence
  chemically synthesized
tgctttcgccatgtgaaatgcc

SEQ ID NO: 1016622 - DNA, 22 bp, Artificial Sequence
  chemically synthesized
ctttcgccatgtgaaatgccta

SEQ ID NO: 1016623 - DNA, 22 bp, Artificial Sequence
  chemically synthesized
tcgccatgtgaaatgcctacac

SEQ ID NO: 1016624 - DNA, 22 bp, Artificial Sequence
  chemically synthesized
cgccatgtgaaatgcctacacc

SEQ ID NO: 1016625 - DNA, 22 bp, Artificial Sequence
  chemically synthesized
gccatgtgaaatgcctacacct

SEQ ID NO: 1016626 - DNA, 22 bp, Artificial Sequence
  chemically synthesized
atggtggaaggcagagcaggtg

SEQ ID NO: 1016627 - DNA, 22 bp, Artificial Sequence
  chemically synthesized
ctcatggtggaaggcagagcag

SEQ ID NO: 1016628 - DNA, 22 bp, Artificial Sequence
  chemically synthesized
actcatggtggaaggcagagca

SEQ ID NO: 1016629 - DNA, 22 bp, Artificial Sequence
  chemically synthesized
tactcatggtggaaggcagagc

SEQ ID NO: 1016630 - DNA, 22 bp, Artificial Sequence
  chemically synthesized
ttactcatggtggaaggcagag

SEQ ID NO: 1016631 - DNA, 22 bp, Artificial Sequence
  chemically synthesized
cacctgctctgccttccaccat

SEQ ID NO: 1016632 - DNA, 22 bp, Artificial Sequence
  chemically synthesized
agggagcttttactcatggtgg

SEQ ID NO: 1016633 - DNA, 22 bp, Artificial Sequence
  chemically synthesized
ctctgccttccaccatgagtaa

SEQ ID NO: 1016634 - DNA, 22 bp, Artificial Sequence
  chemically synthesized
tgccttccaccatgagtaaaag

SEQ ID NO: 1016635 - DNA, 22 bp, Artificial Sequence
  chemically synthesized
ccttccaccatgagtaaaagct

SEQ ID NO: 1016636 - DNA, 22 bp, Artificial Sequence
  chemically synthesized
gggaggcctcagggagctttta

SEQ ID NO: 1016637 - DNA, 22 bp, Artificial Sequence
  chemically synthesized
ccaccatgagtaaaagctccct

SEQ ID NO: 1016638 - DNA, 22 bp, Artificial Sequence
  chemically synthesized
tggggaggcctcagggagcttt

SEQ ID NO: 1016639 - DNA, 22 bp, Artificial Sequence
  chemically synthesized
caccatgagtaaaagctccctg

SEQ ID NO: 1016640 - DNA, 22 bp, Artificial Sequence
  chemically synthesized
ctggggaggcctcagggagctt

SEQ ID NO: 1016641 - DNA, 22 bp, Artificial Sequence
  chemically synthesized
tttctggggaggcctcagggag

SEQ ID NO: 1016642 - DNA, 22 bp, Artificial Sequence
  chemically synthesized
cctgaggcctccccagaaacag

SEQ ID NO: 1016643 - DNA, 22 bp, Artificial Sequence
  chemically synthesized
aggcctccccagaaacagatgt

SEQ ID NO: 1016644 - DNA, 22 bp, Artificial Sequence
  chemically synthesized
caggaagcatagcaacatctgt

SEQ ID NO: 1016645 - DNA, 22 bp, Artificial Sequence
  chemically synthesized
tacaggaagcatagcaacatct

SEQ ID NO: 1016646 - DNA, 22 bp, Artificial Sequence
  chemically synthesized
cccagaaacagatgttgctatg

SEQ ID NO: 1016647 - DNA, 22 bp, Artificial Sequence
  chemically synthesized
caggctctacaggaagcatagc

SEQ ID NO: 1016648 - DNA, 22 bp, Artificial Sequence
  chemically synthesized
tgcaggctctacaggaagcata

SEQ ID NO: 1016649 - DNA, 22 bp, Artificial Sequence
  chemically synthesized
acgattctgcaggctctacagg

SEQ ID NO: 1016650 - DNA, 22 bp, Artificial Sequence
  chemically synthesized
ctatgcttcctgtagagcctgc

SEQ ID NO: 1016651 - DNA, 22 bp, Artificial Sequence
  chemically synthesized
gctgacgattctgcaggctcta

SEQ ID NO: 1016652 - DNA, 22 bp, Artificial Sequence
  chemically synthesized
tgcttcctgtagagcctgcaga

SEQ ID NO: 1016653 - DNA, 22 bp, Artificial Sequence
  chemically synthesized
attggctgacgattctgcaggc

SEQ ID NO: 1016654 - DNA, 22 bp, Artificial Sequence
  chemically synthesized
aattggctgacgattctgcagg

SEQ ID NO: 1016655 - DNA, 22 bp, Artificial Sequence
  chemically synthesized
cctgtagagcctgcagaatcgt

SEQ ID NO: 1016656 - DNA, 22 bp, Artificial Sequence
  chemically synthesized
ctgtagagcctgcagaatcgtc

SEQ ID NO: 1016657 - DNA, 22 bp, Artificial Sequence
  chemically synthesized
tagagcctgcagaatcgtcagc

SEQ ID NO: 1016658 - DNA, 22 bp, Artificial Sequence
  chemically synthesized
cagaatcgtcagccaattaaac

SEQ ID NO: 1016659 - DNA, 22 bp, Artificial Sequence
  chemically synthesized
taaagtaaagaggtttaattgg

SEQ ID NO: 1016660 - DNA, 22 bp, Artificial Sequence
  chemically synthesized
ataaagtaaagaggtttaattg

SEQ ID NO: 1016661 - DNA, 22 bp, Artificial Sequence
  chemically synthesized
ggtgtttataaagtaaagaggt

SEQ ID NO: 1016662 - DNA, 22 bp, Artificial Sequence
  chemically synthesized
agactgggtgtttataaagtaa

SEQ ID NO: 1016663 - DNA, 22 bp, Artificial Sequence
  chemically synthesized
aacctctttactttataaacac

SEQ ID NO: 1016664 - DNA, 22 bp, Artificial Sequence
  chemically synthesized
tttactttataaacacccagtc

SEQ ID NO: 1016665 - DNA, 22 bp, Artificial Sequence
  chemically synthesized
tactttataaacacccagtctc

SEQ ID NO: 1016666 - DNA, 22 bp, Artificial Sequence
  chemically synthesized
actttataaacacccagtctca

SEQ ID NO: 1016667 - DNA, 22 bp, Artificial Sequence
  chemically synthesized
taaagaaatacctgagactggg

SEQ ID NO: 1016668 - DNA, 22 bp, Artificial Sequence
  chemically synthesized
ctttataaacacccagtctcag

SEQ ID NO: 1016669 - DNA, 22 bp, Artificial Sequence
  chemically synthesized
ctataaagaaatacctgagact

SEQ ID NO: 1016670 - DNA, 22 bp, Artificial Sequence
  chemically synthesized
tataaacacccagtctcaggta

SEQ ID NO: 1016671 - DNA, 22 bp, Artificial Sequence
  chemically synthesized
ataaacacccagtctcaggtat

SEQ ID NO: 1016672 - DNA, 22 bp, Artificial Sequence
  chemically synthesized
taaacacccagtctcaggtatt

SEQ ID NO: 1016673 - DNA, 22 bp, Artificial Sequence
  chemically synthesized
cattgctataaagaaatacctg

SEQ ID NO: 1016674 - DNA, 22 bp, Artificial Sequence
  chemically synthesized
gcattgctataaagaaatacct

SEQ ID NO: 1016675 - DNA, 22 bp, Artificial Sequence
  chemically synthesized
ttgcattgctataaagaaatac

SEQ ID NO: 1016676 - DNA, 22 bp, Artificial Sequence
  chemically synthesized
ggccattcttgcattgctataa

SEQ ID NO: 1016677 - DNA, 22 bp, Artificial Sequence
  chemically synthesized
aggtatttctttatagcaatgc

SEQ ID NO: 1016678 - DNA, 22 bp, Artificial Sequence
  chemically synthesized
gattaggccattcttgcattgc

SEQ ID NO: 1016679 - DNA, 22 bp, Artificial Sequence
  chemically synthesized
ctttatagcaatgcaagaatgg

SEQ ID NO: 1016680 - DNA, 22 bp, Artificial Sequence
  chemically synthesized
tttatagcaatgcaagaatggc

SEQ ID NO: 1016681 - DNA, 22 bp, Artificial Sequence
  chemically synthesized
aggactggattaggccattctt

SEQ ID NO: 1016682 - DNA, 22 bp, Artificial Sequence
  chemically synthesized
tatagcaatgcaagaatggcct

SEQ ID NO: 1016683 - DNA, 22 bp, Artificial Sequence
  chemically synthesized
atagcaatgcaagaatggccta

SEQ ID NO: 1016684 - DNA, 22 bp, Artificial Sequence
  chemically synthesized
tagcaatgcaagaatggcctaa

SEQ ID NO: 1016685 - DNA, 22 bp, Artificial Sequence
  chemically synthesized
aaactaaggactggattaggcc

SEQ ID NO: 1016686 - DNA, 22 bp, Artificial Sequence
  chemically synthesized
aaattaaaactaaggactggat

SEQ ID NO: 1016687 - DNA, 22 bp, Artificial Sequence
  chemically synthesized
actaaaattaaaactaaggact

SEQ ID NO: 1016688 - DNA, 22 bp, Artificial Sequence
  chemically synthesized
atccagtccttagttttaattt

SEQ ID NO: 1016689 - DNA, 22 bp, Artificial Sequence
  chemically synthesized
gaaatcattgactaaaattaaa

SEQ ID NO: 1016690 - DNA, 22 bp, Artificial Sequence
  chemically synthesized
ggaaatcattgactaaaattaa

SEQ ID NO: 1016691 - DNA, 22 bp, Artificial Sequence
  chemically synthesized
gcttggaaatcattgactaaaa

SEQ ID NO: 1016692 - DNA, 22 bp, Artificial Sequence
  chemically synthesized
tagcttggaaatcattgactaa

SEQ ID NO: 1016693 - DNA, 22 bp, Artificial Sequence
  chemically synthesized
ctagcttggaaatcattgacta

SEQ ID NO: 1016694 - DNA, 22 bp, Artificial Sequence
  chemically synthesized
agttttaattttagtcaatgat

SEQ ID NO: 1016695 - DNA, 22 bp, Artificial Sequence
  chemically synthesized
gttttaattttagtcaatgatt

SEQ ID NO: 1016696 - DNA, 22 bp, Artificial Sequence
  chemically synthesized
taattttagtcaatgatttcca

SEQ ID NO: 1016697 - DNA, 22 bp, Artificial Sequence
  chemically synthesized
aattttagtcaatgatttccaa

SEQ ID NO: 1016698 - DNA, 22 bp, Artificial Sequence
  chemically synthesized
aagatttctagcttggaaatca

SEQ ID NO: 1016699 - DNA, 22 bp, Artificial Sequence
  chemically synthesized
attttagtcaatgatttccaag

SEQ ID NO: 1016700 - DNA, 22 bp, Artificial Sequence
  chemically synthesized
tagtcaatgatttccaagctag

SEQ ID NO: 1016701 - DNA, 22 bp, Artificial Sequence
  chemically synthesized
agtcaatgatttccaagctaga

SEQ ID NO: 1016702 - DNA, 22 bp, Artificial Sequence
  chemically synthesized
gtcaatgatttccaagctagaa

SEQ ID NO: 1016703 - DNA, 22 bp, Artificial Sequence
  chemically synthesized
ccaagctagaaatcttgagacc

SEQ ID NO: 1016704 - DNA, 22 bp, Artificial Sequence
  chemically synthesized
caagctagaaatcttgagacca

SEQ ID NO: 1016705 - DNA, 22 bp, Artificial Sequence
  chemically synthesized
gaaatcttgagaccatcgttta

SEQ ID NO: 1016706 - DNA, 22 bp, Artificial Sequence
  chemically synthesized
gagaccatcgtttacttctcga

SEQ ID NO: 1016707 - DNA, 22 bp, Artificial Sequence
  chemically synthesized
agaccatcgtttacttctcgac

SEQ ID NO: 1016708 - DNA, 22 bp, Artificial Sequence
  chemically synthesized
acttctcgacttctttcttatc

SEQ ID NO: 1016709 - DNA, 22 bp, Artificial Sequence
  chemically synthesized
cttctcgacttctttcttatca

SEQ ID NO: 1016710 - DNA, 22 bp, Artificial Sequence
  chemically synthesized
ctcgacttctttcttatcatgc

SEQ ID NO: 1016711 - DNA, 22 bp, Artificial Sequence
  chemically synthesized
tcgacttctttcttatcatgct

SEQ ID NO: 1016712 - DNA, 22 bp, Artificial Sequence
  chemically synthesized
gacttctttcttatcatgcttg

SEQ ID NO: 1016713 - DNA, 22 bp, Artificial Sequence
  chemically synthesized
ataaaatatagagacaagcatg

SEQ ID NO: 1016714 - DNA, 22 bp, Artificial Sequence
  chemically synthesized
ctttcttatcatgcttgtctct

SEQ ID NO: 1016715 - DNA, 22 bp, Artificial Sequence
  chemically synthesized
tttcttatcatgcttgtctcta

SEQ ID NO: 1016716 - DNA, 22 bp, Artificial Sequence
  chemically synthesized
tcttatcatgcttgtctctata

SEQ ID NO: 1016717 - DNA, 22 bp, Artificial Sequence
  chemically synthesized
gaattgataaaatatagagaca

SEQ ID NO: 1016718 - DNA, 22 bp, Artificial Sequence
  chemically synthesized
cttatcatgcttgtctctatat

SEQ ID NO: 1016719 - DNA, 22 bp, Artificial Sequence
  chemically synthesized
agaattgataaaatatagagac

SEQ ID NO: 1016720 - DNA, 22 bp, Artificial Sequence
  chemically synthesized
ttatcatgcttgtctctatatt

SEQ ID NO: 1016721 - DNA, 22 bp, Artificial Sequence
  chemically synthesized
atcatgcttgtctctatatttt

SEQ ID NO: 1016722 - DNA, 22 bp, Artificial Sequence
  chemically synthesized
tcatgcttgtctctatatttta

SEQ ID NO: 1016723 - DNA, 22 bp, Artificial Sequence
  chemically synthesized
gtttagaattgataaaatatag

SEQ ID NO: 1016724 - DNA, 22 bp, Artificial Sequence
  chemically synthesized
tggtttagaattgataaaatat

SEQ ID NO: 1016725 - DNA, 22 bp, Artificial Sequence
  chemically synthesized
ctggtttagaattgataaaata

SEQ ID NO: 1016726 - DNA, 22 bp, Artificial Sequence
  chemically synthesized
gtctctatattttatcaattct

SEQ ID NO: 1016727 - DNA, 22 bp, Artificial Sequence
  chemically synthesized
tctctatattttatcaattcta

SEQ ID NO: 1016728 - DNA, 22 bp, Artificial Sequence
  chemically synthesized
tatattttatcaattctaaacc

SEQ ID NO: 1016729 - DNA, 22 bp, Artificial Sequence
  chemically synthesized
aagagtcatttctggtttagaa

SEQ ID NO: 1016730 - DNA, 22 bp, Artificial Sequence
  chemically synthesized
tattttatcaattctaaaccag

SEQ ID NO: 1016731 - DNA, 22 bp, Artificial Sequence
  chemically synthesized
aattaaagagtcatttctggtt

SEQ ID NO: 1016732 - DNA, 22 bp, Artificial Sequence
  chemically synthesized
tatcaattctaaaccagaaatg

SEQ ID NO: 1016733 - DNA, 22 bp, Artificial Sequence
  chemically synthesized
atcaattctaaaccagaaatga

SEQ ID NO: 1016734 - DNA, 22 bp, Artificial Sequence
  chemically synthesized
tcaattctaaaccagaaatgac

SEQ ID NO: 1016735 - DNA, 22 bp, Artificial Sequence
  chemically synthesized
taaaccagaaatgactctttaa

SEQ ID NO: 1016736 - DNA, 22 bp, Artificial Sequence
  chemically synthesized
aaccagaaatgactctttaatt

SEQ ID NO: 1016737 - DNA, 22 bp, Artificial Sequence
  chemically synthesized
gagagaagaggctaaattaaag

SEQ ID NO: 1016738 - DNA, 22 bp, Artificial Sequence
  chemically synthesized
tttaatttagcctcttctctct

SEQ ID NO: 1016739 - DNA, 22 bp, Artificial Sequence
  chemically synthesized
taatttagcctcttctctctag

SEQ ID NO: 1016740 - DNA, 22 bp, Artificial Sequence
  chemically synthesized
aatttagcctcttctctctagc

SEQ ID NO: 1016741 - DNA, 22 bp, Artificial Sequence
  chemically synthesized
atttagcctcttctctctagcc

SEQ ID NO: 1016742 - DNA, 22 bp, Artificial Sequence
  chemically synthesized
agcctcttctctctagccccac

SEQ ID NO: 1016743 - DNA, 22 bp, Artificial Sequence
  chemically synthesized
gcctcttctctctagccccact

SEQ ID NO: 1016744 - DNA, 22 bp, Artificial Sequence
  chemically synthesized
aagaaaggccacgacagtgggg

SEQ ID NO: 1016745 - DNA, 22 bp, Artificial Sequence
  chemically synthesized
caagaaaggccacgacagtggg

SEQ ID NO: 1016746 - DNA, 22 bp, Artificial Sequence
  chemically synthesized
ttctctctagccccactgtcgt

SEQ ID NO: 1016747 - DNA, 22 bp, Artificial Sequence
  chemically synthesized
tcaagaaaggccacgacagtgg

SEQ ID NO: 1016748 - DNA, 22 bp, Artificial Sequence
  chemically synthesized
ctctctagccccactgtcgtgg

SEQ ID NO: 1016749 - DNA, 22 bp, Artificial Sequence
  chemically synthesized
tctctagccccactgtcgtggc

SEQ ID NO: 1016750 - DNA, 22 bp, Artificial Sequence
  chemically synthesized
tctagccccactgtcgtggcct

SEQ ID NO: 1016751 - DNA, 22 bp, Artificial Sequence
  chemically synthesized
tagccccactgtcgtggccttt

SEQ ID NO: 1016752 - DNA, 22 bp, Artificial Sequence
  chemically synthesized
ggagttttcaagaaaggccacg

SEQ ID NO: 1016753 - DNA, 22 bp, Artificial Sequence
  chemically synthesized
gccccactgtcgtggcctttct

SEQ ID NO: 1016754 - DNA, 22 bp, Artificial Sequence
  chemically synthesized
ttaggagttttcaagaaaggcc

SEQ ID NO: 1016755 - DNA, 22 bp, Artificial Sequence
  chemically synthesized
tcgtggcctttcttgaaaactc

SEQ ID NO: 1016756 - DNA, 22 bp, Artificial Sequence
  chemically synthesized
aggaaaagttattaggagtttt

SEQ ID NO: 1016757 - DNA, 22 bp, Artificial Sequence
  chemically synthesized
tcttgaaaactcctaataactt

SEQ ID NO: 1016758 - DNA, 22 bp, Artificial Sequence
  chemically synthesized
cttgaaaactcctaataacttt

SEQ ID NO: 1016759 - DNA, 22 bp, Artificial Sequence
  chemically synthesized
ttgaaaactcctaataactttt

SEQ ID NO: 1016760 - DNA, 22 bp, Artificial Sequence
  chemically synthesized
gaatatgctgaggaaaagttat

SEQ ID NO: 1016761 - DNA, 22 bp, Artificial Sequence
  chemically synthesized
gaaaactcctaataacttttcc

SEQ ID NO: 1016762 - DNA, 22 bp, Artificial Sequence
  chemically synthesized
aaaactcctaataacttttcct

SEQ ID NO: 1016763 - DNA, 22 bp, Artificial Sequence
  chemically synthesized
ctaataacttttcctcagcata

SEQ ID NO: 1016764 - DNA, 22 bp, Artificial Sequence
  chemically synthesized
ataacttttcctcagcatattc

SEQ ID NO: 1016765 - DNA, 22 bp, Artificial Sequence
  chemically synthesized
ttcctcagcatattccaactca

SEQ ID NO: 1016766 - DNA, 22 bp, Artificial Sequence
  chemically synthesized
tcctcagcatattccaactcat

SEQ ID NO: 1016767 - DNA, 22 bp, Artificial Sequence
  chemically synthesized
cctcagcatattccaactcatc

SEQ ID NO: 1016768 - DNA, 22 bp, Artificial Sequence
  chemically synthesized
ctcagcatattccaactcatct

SEQ ID NO: 1016769 - DNA, 22 bp, Artificial Sequence
  chemically synthesized
agcatattccaactcatctctc

SEQ ID NO: 1016770 - DNA, 22 bp, Artificial Sequence
  chemically synthesized
agaaaccgaaaatagggagaga

SEQ ID NO: 1016771 - DNA, 22 bp, Artificial Sequence
  chemically synthesized
caactcatctctccctattttc

SEQ ID NO: 1016772 - DNA, 22 bp, Artificial Sequence
  chemically synthesized
gagagcgctgagaaaccgaaaa

SEQ ID NO: 1016773 - DNA, 22 bp, Artificial Sequence
  chemically synthesized
atctctccctattttcggtttc

SEQ ID NO: 1016774 - DNA, 22 bp, Artificial Sequence
  chemically synthesized
ttagagagcgctgagaaaccga

SEQ ID NO: 1016775 - DNA, 22 bp, Artificial Sequence
  chemically synthesized
tccctattttcggtttctcagc

SEQ ID NO: 1016776 - DNA, 22 bp, Artificial Sequence
  chemically synthesized
tctgttagagagcgctgagaaa

SEQ ID NO: 1016777 - DNA, 22 bp, Artificial Sequence
  chemically synthesized
cctattttcggtttctcagcgc

SEQ ID NO: 1016778 - DNA, 22 bp, Artificial Sequence
  chemically synthesized
ttttcggtttctcagcgctctc

SEQ ID NO: 1016779 - DNA, 22 bp, Artificial Sequence
  chemically synthesized
tcggtttctcagcgctctctaa

SEQ ID NO: 1016780 - DNA, 22 bp, Artificial Sequence
  chemically synthesized
cggtttctcagcgctctctaac

SEQ ID NO: 1016781 - DNA, 22 bp, Artificial Sequence
  chemically synthesized
ggtttctcagcgctctctaaca

SEQ ID NO: 1016782 - DNA, 22 bp, Artificial Sequence
  chemically synthesized
ctcagcgctctctaacagacaa

SEQ ID NO: 1016783 - DNA, 22 bp, Artificial Sequence
  chemically synthesized
tcagcgctctctaacagacaac

SEQ ID NO: 1016784 - DNA, 22 bp, Artificial Sequence
  chemically synthesized
agcgctctctaacagacaacct

SEQ ID NO: 1016785 - DNA, 22 bp, Artificial Sequence
  chemically synthesized
tctaacagacaacctcacttcc

SEQ ID NO: 1016786 - DNA, 22 bp, Artificial Sequence
  chemically synthesized
taacagacaacctcacttccta

SEQ ID NO: 1016787 - DNA, 22 bp, Artificial Sequence
  chemically synthesized
acagacaacctcacttcctact

SEQ ID NO: 1016788 - DNA, 22 bp, Artificial Sequence
  chemically synthesized
tatagggaccaaagtaggaagt

SEQ ID NO: 1016789 - DNA, 22 bp, Artificial Sequence
  chemically synthesized
gtatagggaccaaagtaggaag

SEQ ID NO: 1016790 - DNA, 22 bp, Artificial Sequence
  chemically synthesized
acttcctactttggtccctata

SEQ ID NO: 1016791 - DNA, 22 bp, Artificial Sequence
  chemically synthesized
tgtgaatgtttgtatagggacc

SEQ ID NO: 1016792 - DNA, 22 bp, Artificial Sequence
  chemically synthesized
cctactttggtccctatacaaa

SEQ ID NO: 1016793 - DNA, 22 bp, Artificial Sequence
  chemically synthesized
ctactttggtccctatacaaac

SEQ ID NO: 1016794 - DNA, 22 bp, Artificial Sequence
  chemically synthesized
ctttggtccctatacaaacatt

SEQ ID NO: 1016795 - DNA, 22 bp, Artificial Sequence
  chemically synthesized
tggtccctatacaaacattcac

SEQ ID NO: 1016796 - DNA, 22 bp, Artificial Sequence
  chemically synthesized
ggtccctatacaaacattcaca

SEQ ID NO: 1016797 - DNA, 22 bp, Artificial Sequence
  chemically synthesized
gtccctatacaaacattcacat

SEQ ID NO: 1016798 - DNA, 22 bp, Artificial Sequence
  chemically synthesized
tacaaacattcacatagcccac

SEQ ID NO: 1016799 - DNA, 22 bp, Artificial Sequence
  chemically synthesized
agtacagtatacatggtgggct

SEQ ID NO: 1016800 - DNA, 22 bp, Artificial Sequence
  chemically synthesized
cagtacagtatacatggtgggc

SEQ ID NO: 1016801 - DNA, 22 bp, Artificial Sequence
  chemically synthesized
tcagtacagtatacatggtggg

SEQ ID NO: 1016802 - DNA, 22 bp, Artificial Sequence
  chemically synthesized
tgttttcagtacagtatacatg

SEQ ID NO: 1016803 - DNA, 22 bp, Artificial Sequence
  chemically synthesized
acatagcccaccatgtatactg

SEQ ID NO: 1016804 - DNA, 22 bp, Artificial Sequence
  chemically synthesized
tatgttttcagtacagtataca

SEQ ID NO: 1016805 - DNA, 22 bp, Artificial Sequence
  chemically synthesized
ctatgttttcagtacagtatac

SEQ ID NO: 1016806 - DNA, 22 bp, Artificial Sequence
  chemically synthesized
tctatgttttcagtacagtata

SEQ ID NO: 1016807 - DNA, 22 bp, Artificial Sequence
  chemically synthesized
agattttctatgttttcagtac

SEQ ID NO: 1016808 - DNA, 22 bp, Artificial Sequence
  chemically synthesized
cagattttctatgttttcagta

SEQ ID NO: 1016809 - DNA, 22 bp, Artificial Sequence
  chemically synthesized
tcagattttctatgttttcagt

SEQ ID NO: 1016810 - DNA, 22 bp, Artificial Sequence
  chemically synthesized
tgaaaattttcagattttctat

SEQ ID NO: 1016811 - DNA, 22 bp, Artificial Sequence
  chemically synthesized
tactgaaaacatagaaaatctg

SEQ ID NO: 1016812 - DNA, 22 bp, Artificial Sequence
  chemically synthesized
ttatgaaaattttcagattttc

SEQ ID NO: 1016813 - DNA, 22 bp, Artificial Sequence
  chemically synthesized
aaaacatagaaaatctgaaaat

SEQ ID NO: 1016814 - DNA, 22 bp, Artificial Sequence
  chemically synthesized
gttgttatgaaaattttcagat

SEQ ID NO: 1016815 - DNA, 22 bp, Artificial Sequence
  chemically synthesized
ggttgttatgaaaattttcaga

SEQ ID NO: 1016816 - DNA, 22 bp, Artificial Sequence
  chemically synthesized
tggttgttatgaaaattttcag

SEQ ID NO: 1016817 - DNA, 22 bp, Artificial Sequence
  chemically synthesized
aaaattttcataacaaccaaaa

SEQ ID NO: 1016818 - DNA, 22 bp, Artificial Sequence
  chemically synthesized
tcataacaaccaaaattccttt

SEQ ID NO: 1016819 - DNA, 22 bp, Artificial Sequence
  chemically synthesized
cataacaaccaaaattcctttt

SEQ ID NO: 1016820 - DNA, 22 bp, Artificial Sequence
  chemically synthesized
ataacaaccaaaattccttttt

SEQ ID NO: 1016821 - DNA, 22 bp, Artificial Sequence
  chemically synthesized
aaatacagcaaaaggcccacag

SEQ ID NO: 1016822 - DNA, 22 bp, Artificial Sequence
  chemically synthesized
taaaatacagcaaaaggcccac

SEQ ID NO: 1016823 - DNA, 22 bp, Artificial Sequence
  chemically synthesized
cttttttactgtgggccttttg

SEQ ID NO: 1016824 - DNA, 22 bp, Artificial Sequence
  chemically synthesized
ttttactgtgggccttttgctg

SEQ ID NO: 1016825 - DNA, 22 bp, Artificial Sequence
  chemically synthesized
tttactgtgggccttttgctgt

SEQ ID NO: 1016826 - DNA, 22 bp, Artificial Sequence
  chemically synthesized
ttactgtgggccttttgctgta

SEQ ID NO: 1016827 - DNA, 22 bp, Artificial Sequence
  chemically synthesized
tactgtgggccttttgctgtat

SEQ ID NO: 1016828 - DNA, 22 bp, Artificial Sequence
  chemically synthesized
actgtgggccttttgctgtatt

SEQ ID NO: 1016829 - DNA, 22 bp, Artificial Sequence
  chemically synthesized
ctgtgggccttttgctgtattt

SEQ ID NO: 1016830 - DNA, 22 bp, Artificial Sequence
  chemically synthesized
tgggccttttgctgtattttag

SEQ ID NO: 1016831 - DNA, 22 bp, Artificial Sequence
  chemically synthesized
gatagggtgtcattctaaaata

SEQ ID NO: 1016832 - DNA, 22 bp, Artificial Sequence
  chemically synthesized
agatagggtgtcattctaaaat

SEQ ID NO: 1016833 - DNA, 22 bp, Artificial Sequence
  chemically synthesized
tagatagggtgtcattctaaaa

SEQ ID NO: 1016834 - DNA, 22 bp, Artificial Sequence
  chemically synthesized
ttgctgtattttagaatgacac

SEQ ID NO: 1016835 - DNA, 22 bp, Artificial Sequence
  chemically synthesized
tgctgtattttagaatgacacc

SEQ ID NO: 1016836 - DNA, 22 bp, Artificial Sequence
  chemically synthesized
gctgtattttagaatgacaccc

SEQ ID NO: 1016837 - DNA, 22 bp, Artificial Sequence
  chemically synthesized
ctgtattttagaatgacaccct

SEQ ID NO: 1016838 - DNA, 22 bp, Artificial Sequence
  chemically synthesized
tattttagaatgacaccctatc

SEQ ID NO: 1016839 - DNA, 22 bp, Artificial Sequence
  chemically synthesized
tagaatgacaccctatctaaaa

SEQ ID NO: 1016840 - DNA, 22 bp, Artificial Sequence
  chemically synthesized
agaatgacaccctatctaaaat

SEQ ID NO: 1016841 - DNA, 22 bp, Artificial Sequence
  chemically synthesized
tggaatagtgacattttagata

SEQ ID NO: 1016842 - DNA, 22 bp, Artificial Sequence
  chemically synthesized
gaatgacaccctatctaaaatg

SEQ ID NO: 1016843 - DNA, 22 bp, Artificial Sequence
  chemically synthesized
atggaatagtgacattttagat

SEQ ID NO: 1016844 - DNA, 22 bp, Artificial Sequence
  chemically synthesized
tctaaaatgtcactattccata

SEQ ID NO: 1016845 - DNA, 22 bp, Artificial Sequence
  chemically synthesized
aaatgtcactattccataaggc

SEQ ID NO: 1016846 - DNA, 22 bp, Artificial Sequence
  chemically synthesized
caagggagagaagccttatgga

SEQ ID NO: 1016847 - DNA, 22 bp, Artificial Sequence
  chemically synthesized
attccaagggagagaagcctta

SEQ ID NO: 1016848 - DNA, 22 bp, Artificial Sequence
  chemically synthesized
ttccataaggcttctctccctt

SEQ ID NO: 1016849 - DNA, 22 bp, Artificial Sequence
  chemically synthesized
cataaggcttctctcccttgga

SEQ ID NO: 1016850 - DNA, 22 bp, Artificial Sequence
  chemically synthesized
tgaagtaactaattccaaggga

SEQ ID NO: 1016851 - DNA, 22 bp, Artificial Sequence
  chemically synthesized
atgaagtaactaattccaaggg

SEQ ID NO: 1016852 - DNA, 22 bp, Artificial Sequence
  chemically synthesized
tcttatgaagtaactaattcca

SEQ ID NO: 1016853 - DNA, 22 bp, Artificial Sequence
  chemically synthesized
gtcttatgaagtaactaattcc

SEQ ID NO: 1016854 - DNA, 22 bp, Artificial Sequence
  chemically synthesized
ctctcccttggaattagttact

SEQ ID NO: 1016855 - DNA, 22 bp, Artificial Sequence
  chemically synthesized
tctcccttggaattagttactt

SEQ ID NO: 1016856 - DNA, 22 bp, Artificial Sequence
  chemically synthesized
tcccttggaattagttacttca

SEQ ID NO: 1016857 - DNA, 22 bp, Artificial Sequence
  chemically synthesized
ccttggaattagttacttcata

SEQ ID NO: 1016858 - DNA, 22 bp, Artificial Sequence
  chemically synthesized
tggaagcttgtcttatgaagta

SEQ ID NO: 1016859 - DNA, 22 bp, Artificial Sequence
  chemically synthesized
ggaattagttacttcataagac

SEQ ID NO: 1016860 - DNA, 22 bp, Artificial Sequence
  chemically synthesized
gaattagttacttcataagaca

SEQ ID NO: 1016861 - DNA, 22 bp, Artificial Sequence
  chemically synthesized
acaaagctgtggaagcttgtct

SEQ ID NO: 1016862 - DNA, 22 bp, Artificial Sequence
  chemically synthesized
gttacttcataagacaagcttc

SEQ ID NO: 1016863 - DNA, 22 bp, Artificial Sequence
  chemically synthesized
cacaaagctgtggaagcttgtc

SEQ ID NO: 1016864 - DNA, 22 bp, Artificial Sequence
  chemically synthesized
tcacaaagctgtggaagcttgt

SEQ ID NO: 1016865 - DNA, 22 bp, Artificial Sequence
  chemically synthesized
cttcataagacaagcttccaca

SEQ ID NO: 1016866 - DNA, 22 bp, Artificial Sequence
  chemically synthesized
cataagacaagcttccacagct

SEQ ID NO: 1016867 - DNA, 22 bp, Artificial Sequence
  chemically synthesized
ataagacaagcttccacagctt

SEQ ID NO: 1016868 - DNA, 22 bp, Artificial Sequence
  chemically synthesized
atagaggttttcacaaagctgt

SEQ ID NO: 1016869 - DNA, 22 bp, Artificial Sequence
  chemically synthesized
ccacagctttgtgaaaacctct

SEQ ID NO: 1016870 - DNA, 22 bp, Artificial Sequence
  chemically synthesized
cacagctttgtgaaaacctcta

SEQ ID NO: 1016871 - DNA, 22 bp, Artificial Sequence
  chemically synthesized
tgtgaaaacctctattaacata

SEQ ID NO: 1016872 - DNA, 22 bp, Artificial Sequence
  chemically synthesized
gtgaaaacctctattaacatac

SEQ ID NO: 1016873 - DNA, 22 bp, Artificial Sequence
  chemically synthesized
gaacatgaagtagtatgttaat

SEQ ID NO: 1016874 - DNA, 22 bp, Artificial Sequence
  chemically synthesized
tgaaaacctctattaacatact

SEQ ID NO: 1016875 - DNA, 22 bp, Artificial Sequence
  chemically synthesized
tattaacatactacttcatgtt

SEQ ID NO: 1016876 - DNA, 22 bp, Artificial Sequence
  chemically synthesized
ttaacatactacttcatgttct

SEQ ID NO: 1016877 - DNA, 22 bp, Artificial Sequence
  chemically synthesized
taaatacataattagaacatga

SEQ ID NO: 1016878 - DNA, 22 bp, Artificial Sequence
  chemically synthesized
gtaaatacataattagaacatg

SEQ ID NO: 1016879 - DNA, 22 bp, Artificial Sequence
  chemically synthesized
acatactacttcatgttctaat

SEQ ID NO: 1016880 - DNA, 22 bp, Artificial Sequence
  chemically synthesized
cttcatgttctaattatgtatt

SEQ ID NO: 1016881 - DNA, 22 bp, Artificial Sequence
  chemically synthesized
catgttctaattatgtatttac

SEQ ID NO: 1016882 - DNA, 22 bp, Artificial Sequence
  chemically synthesized
atgttctaattatgtatttaca

SEQ ID NO: 1016883 - DNA, 22 bp, Artificial Sequence
  chemically synthesized
gaacaaacagccttgtaaatac

SEQ ID NO: 1016884 - DNA, 22 bp, Artificial Sequence
  chemically synthesized
taattatgtatttacaaggctg

SEQ ID NO: 1016885 - DNA, 22 bp, Artificial Sequence
  chemically synthesized
attatgtatttacaaggctgtt

SEQ ID NO: 1016886 - DNA, 22 bp, Artificial Sequence
  chemically synthesized
tgtatttacaaggctgtttgtt

SEQ ID NO: 1016887 - DNA, 22 bp, Artificial Sequence
  chemically synthesized
acaaggctgtttgttccagtac

SEQ ID NO: 1016888 - DNA, 22 bp, Artificial Sequence
  chemically synthesized
caaggctgtttgttccagtaca

SEQ ID NO: 1016889 - DNA, 22 bp, Artificial Sequence
  chemically synthesized
agaggtacatagtgtactggaa

SEQ ID NO: 1016890 - DNA, 22 bp, Artificial Sequence
  chemically synthesized
taagaggtacatagtgtactgg

SEQ ID NO: 1016891 - DNA, 22 bp, Artificial Sequence
  chemically synthesized
ttctaagaggtacatagtgtac

SEQ ID NO: 1016892 - DNA, 22 bp, Artificial Sequence
  chemically synthesized
attctaagaggtacatagtgta

SEQ ID NO: 1016893 - DNA, 22 bp, Artificial Sequence
  chemically synthesized
tttgttccagtacactatgtac

SEQ ID NO: 1016894 - DNA, 22 bp, Artificial Sequence
  chemically synthesized
cttattctaagaggtacatagt

SEQ ID NO: 1016895 - DNA, 22 bp, Artificial Sequence
  chemically synthesized
ccttattctaagaggtacatag

SEQ ID NO: 1016896 - DNA, 22 bp, Artificial Sequence
  chemically synthesized
gttccagtacactatgtacctc

SEQ ID NO: 1016897 - DNA, 22 bp, Artificial Sequence
  chemically synthesized
ttccagtacactatgtacctct

SEQ ID NO: 1016898 - DNA, 22 bp, Artificial Sequence
  chemically synthesized
cagtacactatgtacctcttag

SEQ ID NO: 1016899 - DNA, 22 bp, Artificial Sequence
  chemically synthesized
tgtacctcttagaataaggaag

SEQ ID NO: 1016900 - DNA, 22 bp, Artificial Sequence
  chemically synthesized
aaaggtgcataaaacatcttcc

SEQ ID NO: 1016901 - DNA, 22 bp, Artificial Sequence
  chemically synthesized
ttagaataaggaagatgtttta

SEQ ID NO: 1016902 - DNA, 22 bp, Artificial Sequence
  chemically synthesized
agaataaggaagatgttttatg

SEQ ID NO: 1016903 - DNA, 22 bp, Artificial Sequence
  chemically synthesized
gaataaggaagatgttttatgc

SEQ ID NO: 1016904 - DNA, 22 bp, Artificial Sequence
  chemically synthesized
gtaccaggaattcaaaggtgca

SEQ ID NO: 1016905 - DNA, 22 bp, Artificial Sequence
  chemically synthesized
agtaccaggaattcaaaggtgc

SEQ ID NO: 1016906 - DNA, 22 bp, Artificial Sequence
  chemically synthesized
tatgcacctttgaattcctggt

SEQ ID NO: 1016907 - DNA, 22 bp, Artificial Sequence
  chemically synthesized
atgcacctttgaattcctggta

SEQ ID NO: 1016908 - DNA, 22 bp, Artificial Sequence
  chemically synthesized
tgcacctttgaattcctggtac

SEQ ID NO: 1016909 - DNA, 22 bp, Artificial Sequence
  chemically synthesized
tgaattcctggtactaagcgct

SEQ ID NO: 1016910 - DNA, 22 bp, Artificial Sequence
  chemically synthesized
gaattcctggtactaagcgctg

SEQ ID NO: 1016911 - DNA, 22 bp, Artificial Sequence
  chemically synthesized
aattcctggtactaagcgctgt

SEQ ID NO: 1016912 - DNA, 22 bp, Artificial Sequence
  chemically synthesized
tcatgtaccaggaacagcgctt

SEQ ID NO: 1016913 - DNA, 22 bp, Artificial Sequence
  chemically synthesized
atcatgtaccaggaacagcgct

SEQ ID NO: 1016914 - DNA, 22 bp, Artificial Sequence
  chemically synthesized
ctggtactaagcgctgttcctg

SEQ ID NO: 1016915 - DNA, 22 bp, Artificial Sequence
  chemically synthesized
gtactaagcgctgttcctggta

SEQ ID NO: 1016916 - DNA, 22 bp, Artificial Sequence
  chemically synthesized
aacatttatcatgtaccaggaa

SEQ ID NO: 1016917 - DNA, 22 bp, Artificial Sequence
  chemically synthesized
agcgctgttcctggtacatgat

SEQ ID NO: 1016918 - DNA, 22 bp, Artificial Sequence
  chemically synthesized
aaatgtattcaacatttatcat

SEQ ID NO: 1016919 - DNA, 22 bp, Artificial Sequence
  chemically synthesized
ttcctggtacatgataaatgtt

SEQ ID NO: 1016920 - DNA, 22 bp, Artificial Sequence
  chemically synthesized
ttaaaatgtattcaacatttat

SEQ ID NO: 1016921 - DNA, 22 bp, Artificial Sequence
  chemically synthesized
ctggtacatgataaatgttgaa

SEQ ID NO: 1016922 - DNA, 22 bp, Artificial Sequence
  chemically synthesized
gtacatgataaatgttgaatac

SEQ ID NO: 1016923 - DNA, 22 bp, Artificial Sequence
  chemically synthesized
agttattaaaatgtattcaaca

SEQ ID NO: 1016924 - DNA, 22 bp, Artificial Sequence
  chemically synthesized
attcagttattaaaatgtattc

SEQ ID NO: 1016925 - DNA, 22 bp, Artificial Sequence
  chemically synthesized
attcattcagttattaaaatgt

SEQ ID NO: 1016926 - DNA, 22 bp, Artificial Sequence
  chemically synthesized
ttcattcattcagttattaaaa

SEQ ID NO: 1016927 - DNA, 22 bp, Artificial Sequence
  chemically synthesized
attcattcattcagttattaaa

SEQ ID NO: 1016928 - DNA, 22 bp, Artificial Sequence
  chemically synthesized
tattcattcattcagttattaa

SEQ ID NO: 1016929 - DNA, 22 bp, Artificial Sequence
  chemically synthesized
ttattcattcattcagttatta

SEQ ID NO: 1016930 - DNA, 22 bp, Artificial Sequence
  chemically synthesized
tttattcattcattcagttatt

SEQ ID NO: 1016931 - DNA, 22 bp, Artificial Sequence
  chemically synthesized
ttttattcattcattcagttat

SEQ ID NO: 1016932 - DNA, 22 bp, Artificial Sequence
  chemically synthesized
aatacattttaataactgaatg

SEQ ID NO: 1016933 - DNA, 22 bp, Artificial Sequence
  chemically synthesized
atggacttttttattcattcat

SEQ ID NO: 1016934 - DNA, 22 bp, Artificial Sequence
  chemically synthesized
taataactgaatgaatgaataa

SEQ ID NO: 1016935 - DNA, 22 bp, Artificial Sequence
  chemically synthesized
aataactgaatgaatgaataaa

SEQ ID NO: 1016936 - DNA, 22 bp, Artificial Sequence
  chemically synthesized
ctcatggacttttttattcatt

SEQ ID NO: 1016937 - DNA, 22 bp, Artificial Sequence
  chemically synthesized
ataactgaatgaatgaataaaa

SEQ ID NO: 1016938 - DNA, 22 bp, Artificial Sequence
  chemically synthesized
aatgaatgaataaaaaagtcca

SEQ ID NO: 1016939 - DNA, 22 bp, Artificial Sequence
  chemically synthesized
tgaaattactcatggacttttt

SEQ ID NO: 1016940 - DNA, 22 bp, Artificial Sequence
  chemically synthesized
gtgaaattactcatggactttt

SEQ ID NO: 1016941 - DNA, 22 bp, Artificial Sequence
  chemically synthesized
aatggaagatataaggggtttg

SEQ ID NO: 1016942 - DNA, 22 bp, Artificial Sequence
  chemically synthesized
aaatggaagatataaggggttt

SEQ ID NO: 1016943 - DNA, 22 bp, Artificial Sequence
  chemically synthesized
ttaaatggaagatataaggggt

SEQ ID NO: 1016944 - DNA, 22 bp, Artificial Sequence
  chemically synthesized
cacaaaccccttatatcttcca

SEQ ID NO: 1016945 - DNA, 22 bp, Artificial Sequence
  chemically synthesized
atggctcttaaatggaagatat

SEQ ID NO: 1016946 - DNA, 22 bp, Artificial Sequence
  chemically synthesized
acaaaccccttatatcttccat

SEQ ID NO: 1016947 - DNA, 22 bp, Artificial Sequence
  chemically synthesized
atatcttccatttaagagccat

SEQ ID NO: 1016948 - DNA, 22 bp, Artificial Sequence
  chemically synthesized
tatcttccatttaagagccatg

SEQ ID NO: 1016949 - DNA, 22 bp, Artificial Sequence
  chemically synthesized
ccatttaagagccatgaatgct

SEQ ID NO: 1016950 - DNA, 22 bp, Artificial Sequence
  chemically synthesized
catttaagagccatgaatgctt

SEQ ID NO: 1016951 - DNA, 22 bp, Artificial Sequence
  chemically synthesized
aagagccatgaatgcttggata

SEQ ID NO: 1016952 - DNA, 22 bp, Artificial Sequence
  chemically synthesized
agagccatgaatgcttggatac

SEQ ID NO: 1016953 - DNA, 22 bp, Artificial Sequence
  chemically synthesized
agaggtaaaatagtgtatccaa

SEQ ID NO: 1016954 - DNA, 22 bp, Artificial Sequence
  chemically synthesized
agactcagaggtaaaatagtgt

SEQ ID NO: 1016955 - DNA, 22 bp, Artificial Sequence
  chemically synthesized
ggatacactattttacctctga

SEQ ID NO: 1016956 - DNA, 22 bp, Artificial Sequence
  chemically synthesized
gatacactattttacctctgag

SEQ ID NO: 1016957 - DNA, 22 bp, Artificial Sequence
  chemically synthesized
tgtgtgagataactgagactca

SEQ ID NO: 1016958 - DNA, 22 bp, Artificial Sequence
  chemically synthesized
atgtgtgagataactgagactc

SEQ ID NO: 1016959 - DNA, 22 bp, Artificial Sequence
  chemically synthesized
ttttacctctgagtctcagtta

SEQ ID NO: 1016960 - DNA, 22 bp, Artificial Sequence
  chemically synthesized
tacctctgagtctcagttatct

SEQ ID NO: 1016961 - DNA, 22 bp, Artificial Sequence
  chemically synthesized
ggtttatgtgtgagataactga

SEQ ID NO: 1016962 - DNA, 22 bp, Artificial Sequence
  chemically synthesized
acctctgagtctcagttatctc

SEQ ID NO: 1016963 - DNA, 22 bp, Artificial Sequence
  chemically synthesized
cctctgagtctcagttatctca

SEQ ID NO: 1016964 - DNA, 22 bp, Artificial Sequence
  chemically synthesized
tgggtttatgtgtgagataact

SEQ ID NO: 1016965 - DNA, 22 bp, Artificial Sequence
  chemically synthesized
ttctgggtttatgtgtgagata

SEQ ID NO: 1016966 - DNA, 22 bp, Artificial Sequence
  chemically synthesized
tgagtctcagttatctcacaca

SEQ ID NO: 1016967 - DNA, 22 bp, Artificial Sequence
  chemically synthesized
agtctcagttatctcacacata

SEQ ID NO: 1016968 - DNA, 22 bp, Artificial Sequence
  chemically synthesized
agttatctcacacataaaccca

SEQ ID NO: 1016969 - DNA, 22 bp, Artificial Sequence
  chemically synthesized
tctcacacataaacccagaata

SEQ ID NO: 1016970 - DNA, 22 bp, Artificial Sequence
  chemically synthesized
acacataaacccagaataatac

SEQ ID NO: 1016971 - DNA, 22 bp, Artificial Sequence
  chemically synthesized
aatgaggtaggcagtattattc

SEQ ID NO: 1016972 - DNA, 22 bp, Artificial Sequence
  chemically synthesized
aaaaagctgaatgaggtaggca

SEQ ID NO: 1016973 - DNA, 22 bp, Artificial Sequence
  chemically synthesized
ctgaaaaagctgaatgaggtag

SEQ ID NO: 1016974 - DNA, 22 bp, Artificial Sequence
  chemically synthesized
atcctcctgaaaaagctgaatg

SEQ ID NO: 1016975 - DNA, 22 bp, Artificial Sequence
  chemically synthesized
catcctcctgaaaaagctgaat

SEQ ID NO: 1016976 - DNA, 22 bp, Artificial Sequence
  chemically synthesized
tcatcctcctgaaaaagctgaa

SEQ ID NO: 1016977 - DNA, 22 bp, Artificial Sequence
  chemically synthesized
cctacctcattcagctttttca

SEQ ID NO: 1016978 - DNA, 22 bp, Artificial Sequence
  chemically synthesized
cctcattcagctttttcaggag

SEQ ID NO: 1016979 - DNA, 22 bp, Artificial Sequence
  chemically synthesized
gagtgtactttcatcctcctga

SEQ ID NO: 1016980 - DNA, 22 bp, Artificial Sequence
  chemically synthesized
attcagctttttcaggaggatg

SEQ ID NO: 1016981 - DNA, 22 bp, Artificial Sequence
  chemically synthesized
ggagtgtactttcatcctcctg

SEQ ID NO: 1016982 - DNA, 22 bp, Artificial Sequence
  chemically synthesized
agctttttcaggaggatgaaag

SEQ ID NO: 1016983 - DNA, 22 bp, Artificial Sequence
  chemically synthesized
taacttggagtgtactttcatc

SEQ ID NO: 1016984 - DNA, 22 bp, Artificial Sequence
  chemically synthesized
ataacttggagtgtactttcat

SEQ ID NO: 1016985 - DNA, 22 bp, Artificial Sequence
  chemically synthesized
tttcaggaggatgaaagtacac

SEQ ID NO: 1016986 - DNA, 22 bp, Artificial Sequence
  chemically synthesized
ttcaggaggatgaaagtacact

SEQ ID NO: 1016987 - DNA, 22 bp, Artificial Sequence
  chemically synthesized
tttataacttggagtgtacttt

SEQ ID NO: 1016988 - DNA, 22 bp, Artificial Sequence
  chemically synthesized
tcaggaggatgaaagtacactc

SEQ ID NO: 1016989 - DNA, 22 bp, Artificial Sequence
  chemically synthesized
caggaggatgaaagtacactcc

SEQ ID NO: 1016990 - DNA, 22 bp, Artificial Sequence
  chemically synthesized
aggaggatgaaagtacactcca

SEQ ID NO: 1016991 - DNA, 22 bp, Artificial Sequence
  chemically synthesized
ctatttataacttggagtgtac

SEQ ID NO: 1016992 - DNA, 22 bp, Artificial Sequence
  chemically synthesized
ttgctatttataacttggagtg

SEQ ID NO: 1016993 - DNA, 22 bp, Artificial Sequence
  chemically synthesized
attgctatttataacttggagt

SEQ ID NO: 1016994 - DNA, 22 bp, Artificial Sequence
  chemically synthesized
tattgctatttataacttggag

SEQ ID NO: 1016995 - DNA, 22 bp, Artificial Sequence
  chemically synthesized
aattttattgctatttataact

SEQ ID NO: 1016996 - DNA, 22 bp, Artificial Sequence
  chemically synthesized
caagttataaatagcaataaaa

SEQ ID NO: 1016997 - DNA, 22 bp, Artificial Sequence
  chemically synthesized
atatcgataatactaaatttta

SEQ ID NO: 1016998 - DNA, 22 bp, Artificial Sequence
  chemically synthesized
taaatagcaataaaatttagta

SEQ ID NO: 1016999 - DNA, 22 bp, Artificial Sequence
  chemically synthesized
tattaatatcgataatactaaa

SEQ ID NO: 1017000 - DNA, 22 bp, Artificial Sequence
  chemically synthesized
actgtattaatatcgataatac

SEQ ID NO: 1017001 - DNA, 22 bp, Artificial Sequence
  chemically synthesized
ctaactgtattaatatcgataa

SEQ ID NO: 1017002 - DNA, 22 bp, Artificial Sequence
  chemically synthesized
tagattactaactgtattaata

SEQ ID NO: 1017003 - DNA, 22 bp, Artificial Sequence
  chemically synthesized
agtattatcgatattaatacag

SEQ ID NO: 1017004 - DNA, 22 bp, Artificial Sequence
  chemically synthesized
atagattactaactgtattaat

SEQ ID NO: 1017005 - DNA, 22 bp, Artificial Sequence
  chemically synthesized
gtattatcgatattaatacagt

SEQ ID NO: 1017006 - DNA, 22 bp, Artificial Sequence
  chemically synthesized
tcgatattaatacagttagtaa

SEQ ID NO: 1017007 - DNA, 22 bp, Artificial Sequence
  chemically synthesized
aaaatttatagattactaactg

SEQ ID NO: 1017008 - DNA, 22 bp, Artificial Sequence
  chemically synthesized
atacagttagtaatctataaat

SEQ ID NO: 1017009 - DNA, 22 bp, Artificial Sequence
  chemically synthesized
tgtcggtattaaaaatttatag

SEQ ID NO: 1017010 - DNA, 22 bp, Artificial Sequence
  chemically synthesized
tgtgtcggtattaaaaatttat

SEQ ID NO: 1017011 - DNA, 22 bp, Artificial Sequence
  chemically synthesized
gtaatctataaatttttaatac

SEQ ID NO: 1017012 - DNA, 22 bp, Artificial Sequence
  chemically synthesized
aattctgtgtcggtattaaaaa

SEQ ID NO: 1017013 - DNA, 22 bp, Artificial Sequence
  chemically synthesized
taaattctgtgtcggtattaaa

SEQ ID NO: 1017014 - DNA, 22 bp, Artificial Sequence
  chemically synthesized
ttctaaattctgtgtcggtatt

SEQ ID NO: 1017015 - DNA, 22 bp, Artificial Sequence
  chemically synthesized
attctaaattctgtgtcggtat

SEQ ID NO: 1017016 - DNA, 22 bp, Artificial Sequence
  chemically synthesized
tattctaaattctgtgtcggta

SEQ ID NO: 1017017 - DNA, 22 bp, Artificial Sequence
  chemically synthesized
taaatttttaataccgacacag

SEQ ID NO: 1017018 - DNA, 22 bp, Artificial Sequence
  chemically synthesized
ttattctaaattctgtgtcggt

SEQ ID NO: 1017019 - DNA, 22 bp, Artificial Sequence
  chemically synthesized
tttattctaaattctgtgtcgg

SEQ ID NO: 1017020 - DNA, 22 bp, Artificial Sequence
  chemically synthesized
ttttattctaaattctgtgtcg

SEQ ID NO: 1017021 - DNA, 22 bp, Artificial Sequence
  chemically synthesized
atttttttattctaaattctgt

SEQ ID NO: 1017022 - DNA, 22 bp, Artificial Sequence
  chemically synthesized
ttaataccgacacagaatttag

SEQ ID NO: 1017023 - DNA, 22 bp, Artificial Sequence
  chemically synthesized
taataccgacacagaatttaga

SEQ ID NO: 1017024 - DNA, 22 bp, Artificial Sequence
  chemically synthesized
aataccgacacagaatttagaa

SEQ ID NO: 1017025 - DNA, 22 bp, Artificial Sequence
  chemically synthesized
ataccgacacagaatttagaat

SEQ ID NO: 1017026 - DNA, 22 bp, Artificial Sequence
  chemically synthesized
atgtagattgatttttttattc

SEQ ID NO: 1017027 - DNA, 22 bp, Artificial Sequence
  chemically synthesized
tgatgtagattgatttttttat

SEQ ID NO: 1017028 - DNA, 22 bp, Artificial Sequence
  chemically synthesized
ctgatgtagattgattttttta

SEQ ID NO: 1017029 - DNA, 22 bp, Artificial Sequence
  chemically synthesized
agaataaaaaaatcaatctaca

SEQ ID NO: 1017030 - DNA, 22 bp, Artificial Sequence
  chemically synthesized
gaataaaaaaatcaatctacat

SEQ ID NO: 1017031 - DNA, 22 bp, Artificial Sequence
  chemically synthesized
gaaaatgatttctgatgtagat

SEQ ID NO: 1017032 - DNA, 22 bp, Artificial Sequence
  chemically synthesized
ggaaaatgatttctgatgtaga

SEQ ID NO: 1017033 - DNA, 22 bp, Artificial Sequence
  chemically synthesized
atatatttggaaaatgatttct

SEQ ID NO: 1017034 - DNA, 22 bp, Artificial Sequence
  chemically synthesized
ctgatatatttggaaaatgatt

SEQ ID NO: 1017035 - DNA, 22 bp, Artificial Sequence
  chemically synthesized
catcagaaatcattttccaaat

SEQ ID NO: 1017036 - DNA, 22 bp, Artificial Sequence
  chemically synthesized
tgtgattgctgatatatttgga

SEQ ID NO: 1017037 - DNA, 22 bp, Artificial Sequence
  chemically synthesized
tccaaatatatcagcaatcaca

SEQ ID NO: 1017038 - DNA, 22 bp, Artificial Sequence
  chemically synthesized
ccaaatatatcagcaatcacat

SEQ ID NO: 1017039 - DNA, 22 bp, Artificial Sequence
  chemically synthesized
caaatatatcagcaatcacata

SEQ ID NO: 1017040 - DNA, 22 bp, Artificial Sequence
  chemically synthesized
atgaaaacaacaattatgtgat

SEQ ID NO: 1017041 - DNA, 22 bp, Artificial Sequence
  chemically synthesized
ttaatgaaaacaacaattatgt

SEQ ID NO: 1017042 - DNA, 22 bp, Artificial Sequence
  chemically synthesized
attaatgaaaacaacaattatg

SEQ ID NO: 1017043 - DNA, 22 bp, Artificial Sequence
  chemically synthesized
tattaatgaaaacaacaattat

SEQ ID NO: 1017044 - DNA, 22 bp, Artificial Sequence
  chemically synthesized
ttattaatgaaaacaacaatta

SEQ ID NO: 1017045 - DNA, 22 bp, Artificial Sequence
  chemically synthesized
tgtcttttattaatgaaaacaa

SEQ ID NO: 1017046 - DNA, 22 bp, Artificial Sequence
  chemically synthesized
gtgtcttttattaatgaaaaca

SEQ ID NO: 1017047 - DNA, 22 bp, Artificial Sequence
  chemically synthesized
tgtgtcttttattaatgaaaac

SEQ ID NO: 1017048 - DNA, 22 bp, Artificial Sequence
  chemically synthesized
ttgttttcattaataaaagaca

SEQ ID NO: 1017049 - DNA, 22 bp, Artificial Sequence
  chemically synthesized
ttttcattaataaaagacacaa

SEQ ID NO: 1017050 - DNA, 22 bp, Artificial Sequence
  chemically synthesized
agaatcatcattttgtgtcttt

SEQ ID NO: 1017051 - DNA, 22 bp, Artificial Sequence
  chemically synthesized
aagaatcatcattttgtgtctt

SEQ ID NO: 1017052 - DNA, 22 bp, Artificial Sequence
  chemically synthesized
taagaatcatcattttgtgtct

SEQ ID NO: 1017053 - DNA, 22 bp, Artificial Sequence
  chemically synthesized
tcattaataaaagacacaaaat

SEQ ID NO: 1017054 - DNA, 22 bp, Artificial Sequence
  chemically synthesized
cattaataaaagacacaaaatg

SEQ ID NO: 1017055 - DNA, 22 bp, Artificial Sequence
  chemically synthesized
attaataaaagacacaaaatga

SEQ ID NO: 1017056 - DNA, 22 bp, Artificial Sequence
  chemically synthesized
tctttaagaatcatcattttgt

SEQ ID NO: 1017057 - DNA, 22 bp, Artificial Sequence
  chemically synthesized
atctttaagaatcatcattttg

SEQ ID NO: 1017058 - DNA, 22 bp, Artificial Sequence
  chemically synthesized
ataaaagacacaaaatgatgat

SEQ ID NO: 1017059 - DNA, 22 bp, Artificial Sequence
  chemically synthesized
tttatctttaagaatcatcatt

SEQ ID NO: 1017060 - DNA, 22 bp, Artificial Sequence
  chemically synthesized
aattatttatctttaagaatca

SEQ ID NO: 1017061 - DNA, 22 bp, Artificial Sequence
  chemically synthesized
ctaaattatttatctttaagaa

SEQ ID NO: 1017062 - DNA, 22 bp, Artificial Sequence
  chemically synthesized
gctaaattatttatctttaaga

SEQ ID NO: 1017063 - DNA, 22 bp, Artificial Sequence
  chemically synthesized
aacttgctaaattatttatctt

SEQ ID NO: 1017064 - DNA, 22 bp, Artificial Sequence
  chemically synthesized
ttaaagataaataatttagcaa

SEQ ID NO: 1017065 - DNA, 22 bp, Artificial Sequence
  chemically synthesized
aaagataaataatttagcaagt

SEQ ID NO: 1017066 - DNA, 22 bp, Artificial Sequence
  chemically synthesized
ggatggtgttgaacttgctaaa

SEQ ID NO: 1017067 - DNA, 22 bp, Artificial Sequence
  chemically synthesized
aagataaataatttagcaagtt

SEQ ID NO: 1017068 - DNA, 22 bp, Artificial Sequence
  chemically synthesized
aggatggtgttgaacttgctaa

SEQ ID NO: 1017069 - DNA, 22 bp, Artificial Sequence
  chemically synthesized
taggatggtgttgaacttgcta

SEQ ID NO: 1017070 - DNA, 22 bp, Artificial Sequence
  chemically synthesized
ttaggatggtgttgaacttgct

SEQ ID NO: 1017071 - DNA, 22 bp, Artificial Sequence
  chemically synthesized
tttaggatggtgttgaacttgc

SEQ ID NO: 1017072 - DNA, 22 bp, Artificial Sequence
  chemically synthesized
tttttaggatggtgttgaactt

SEQ ID NO: 1017073 - DNA, 22 bp, Artificial Sequence
  chemically synthesized
agcaagttcaacaccatcctaa

SEQ ID NO: 1017074 - DNA, 22 bp, Artificial Sequence
  chemically synthesized
gcaagttcaacaccatcctaaa

SEQ ID NO: 1017075 - DNA, 22 bp, Artificial Sequence
  chemically synthesized
tgcaaagtgtattctttttagg

SEQ ID NO: 1017076 - DNA, 22 bp, Artificial Sequence
  chemically synthesized
gtgcaaagtgtattctttttag

SEQ ID NO: 1017077 - DNA, 22 bp, Artificial Sequence
  chemically synthesized
aacaccatcctaaaaagaatac

SEQ ID NO: 1017078 - DNA, 22 bp, Artificial Sequence
  chemically synthesized
agtaaatttgtgcaaagtgtat

SEQ ID NO: 1017079 - DNA, 22 bp, Artificial Sequence
  chemically synthesized
aaaagaatacactttgcacaaa

SEQ ID NO: 1017080 - DNA, 22 bp, Artificial Sequence
  chemically synthesized
ggtctcagtaaatttgtgcaaa

SEQ ID NO: 1017081 - DNA, 22 bp, Artificial Sequence
  chemically synthesized
aattaggtctcagtaaatttgt

SEQ ID NO: 1017082 - DNA, 22 bp, Artificial Sequence
  chemically synthesized
aaattaggtctcagtaaatttg

SEQ ID NO: 1017083 - DNA, 22 bp, Artificial Sequence
  chemically synthesized
atatttaaattaggtctcagta

SEQ ID NO: 1017084 - DNA, 22 bp, Artificial Sequence
  chemically synthesized
tgcacaaatttactgagaccta

SEQ ID NO: 1017085 - DNA, 22 bp, Artificial Sequence
  chemically synthesized
gcacaaatttactgagacctaa

SEQ ID NO: 1017086 - DNA, 22 bp, Artificial Sequence
  chemically synthesized
cacaaatttactgagacctaat

SEQ ID NO: 1017087 - DNA, 22 bp, Artificial Sequence
  chemically synthesized
actgagacctaatttaaatatg

SEQ ID NO: 1017088 - DNA, 22 bp, Artificial Sequence
  chemically synthesized
aatgtgcatcctcatatttaaa

SEQ ID NO: 1017089 - DNA, 22 bp, Artificial Sequence
  chemically synthesized
ctgagacctaatttaaatatga

SEQ ID NO: 1017090 - DNA, 22 bp, Artificial Sequence
  chemically synthesized
agacctaatttaaatatgagga

SEQ ID NO: 1017091 - DNA, 22 bp, Artificial Sequence
  chemically synthesized
atttaaatatgaggatgcacat

SEQ ID NO: 1017092 - DNA, 22 bp, Artificial Sequence
  chemically synthesized
aaatatgaggatgcacatttag

SEQ ID NO: 1017093 - DNA, 22 bp, Artificial Sequence
  chemically synthesized
aatatgaggatgcacatttagg

SEQ ID NO: 1017094 - DNA, 22 bp, Artificial Sequence
  chemically synthesized
aaagagtcacagtccctaaatg

SEQ ID NO: 1017095 - DNA, 22 bp, Artificial Sequence
  chemically synthesized
aaaagagtcacagtccctaaat

SEQ ID NO: 1017096 - DNA, 22 bp, Artificial Sequence
  chemically synthesized
accttaaaagagtcacagtccc

SEQ ID NO: 1017097 - DNA, 22 bp, Artificial Sequence
  chemically synthesized
aaacactcaccttaaaagagtc

SEQ ID NO: 1017098 - DNA, 22 bp, Artificial Sequence
  chemically synthesized
aaaacactcaccttaaaagagt

SEQ ID NO: 1017099 - DNA, 22 bp, Artificial Sequence
  chemically synthesized
agggactgtgactcttttaagg

SEQ ID NO: 1017100 - DNA, 22 bp, Artificial Sequence
  chemically synthesized
gggactgtgactcttttaaggt

SEQ ID NO: 1017101 - DNA, 22 bp, Artificial Sequence
  chemically synthesized
gtttaaaacactcaccttaaaa

SEQ ID NO: 1017102 - DNA, 22 bp, Artificial Sequence
  chemically synthesized
ggtttaaaacactcaccttaaa

SEQ ID NO: 1017103 - DNA, 22 bp, Artificial Sequence
  chemically synthesized
tggtttaaaacactcaccttaa

SEQ ID NO: 1017104 - DNA, 22 bp, Artificial Sequence
  chemically synthesized
ttttggtttaaaacactcacct

SEQ ID NO: 1017105 - DNA, 22 bp, Artificial Sequence
  chemically synthesized
tgactcttttaaggtgagtgtt

SEQ ID NO: 1017106 - DNA, 22 bp, Artificial Sequence
  chemically synthesized
ttttaaggtgagtgttttaaac

SEQ ID NO: 1017107 - DNA, 22 bp, Artificial Sequence
  chemically synthesized
ttaaggtgagtgttttaaacca

SEQ ID NO: 1017108 - DNA, 22 bp, Artificial Sequence
  chemically synthesized
tcaatattgttttggtttaaaa

SEQ ID NO: 1017109 - DNA, 22 bp, Artificial Sequence
  chemically synthesized
taaggtgagtgttttaaaccaa

SEQ ID NO: 1017110 - DNA, 22 bp, Artificial Sequence
  chemically synthesized
atcaatattgttttggtttaaa

SEQ ID NO: 1017111 - DNA, 22 bp, Artificial Sequence
  chemically synthesized
aaggtgagtgttttaaaccaaa

SEQ ID NO: 1017112 - DNA, 22 bp, Artificial Sequence
  chemically synthesized
tatcaatattgttttggtttaa

SEQ ID NO: 1017113 - DNA, 22 bp, Artificial Sequence
  chemically synthesized
aggtgagtgttttaaaccaaaa

SEQ ID NO: 1017114 - DNA, 22 bp, Artificial Sequence
  chemically synthesized
gggtgaattttatcaatattgt

SEQ ID NO: 1017115 - DNA, 22 bp, Artificial Sequence
  chemically synthesized
agggtgaattttatcaatattg

SEQ ID NO: 1017116 - DNA, 22 bp, Artificial Sequence
  chemically synthesized
tagggtgaattttatcaatatt

SEQ ID NO: 1017117 - DNA, 22 bp, Artificial Sequence
  chemically synthesized
taaaccaaaacaatattgataa

SEQ ID NO: 1017118 - DNA, 22 bp, Artificial Sequence
  chemically synthesized
aaaccaaaacaatattgataaa

SEQ ID NO: 1017119 - DNA, 22 bp, Artificial Sequence
  chemically synthesized
tttagggtgaattttatcaata

SEQ ID NO: 1017120 - DNA, 22 bp, Artificial Sequence
  chemically synthesized
aaccaaaacaatattgataaaa

SEQ ID NO: 1017121 - DNA, 22 bp, Artificial Sequence
  chemically synthesized
ctttagggtgaattttatcaat

SEQ ID NO: 1017122 - DNA, 22 bp, Artificial Sequence
  chemically synthesized
acttctttagggtgaattttat

SEQ ID NO: 1017123 - DNA, 22 bp, Artificial Sequence
  chemically synthesized
ttgacttctttagggtgaattt

SEQ ID NO: 1017124 - DNA, 22 bp, Artificial Sequence
  chemically synthesized
ataaaattcaccctaaagaagt

SEQ ID NO: 1017125 - DNA, 22 bp, Artificial Sequence
  chemically synthesized
aataatgctattgacttcttta

SEQ ID NO: 1017126 - DNA, 22 bp, Artificial Sequence
  chemically synthesized
aaataatgctattgacttcttt

SEQ ID NO: 1017127 - DNA, 22 bp, Artificial Sequence
  chemically synthesized
taaataatgctattgacttctt

SEQ ID NO: 1017128 - DNA, 22 bp, Artificial Sequence
  chemically synthesized
ttaaataatgctattgacttct

SEQ ID NO: 1017129 - DNA, 22 bp, Artificial Sequence
  chemically synthesized
tttttaaataatgctattgact

SEQ ID NO: 1017130 - DNA, 22 bp, Artificial Sequence
  chemically synthesized
accctaaagaagtcaatagcat

SEQ ID NO: 1017131 - DNA, 22 bp, Artificial Sequence
  chemically synthesized
aagaagtcaatagcattattta

SEQ ID NO: 1017132 - DNA, 22 bp, Artificial Sequence
  chemically synthesized
tccaatcatctgtttttaaata

SEQ ID NO: 1017133 - DNA, 22 bp, Artificial Sequence
  chemically synthesized
atccaatcatctgtttttaaat

SEQ ID NO: 1017134 - DNA, 22 bp, Artificial Sequence
  chemically synthesized
tatccaatcatctgtttttaaa

SEQ ID NO: 1017135 - DNA, 22 bp, Artificial Sequence
  chemically synthesized
tttatccaatcatctgttttta

SEQ ID NO: 1017136 - DNA, 22 bp, Artificial Sequence
  chemically synthesized
cacatattctttatccaatcat

SEQ ID NO: 1017137 - DNA, 22 bp, Artificial Sequence
  chemically synthesized
tttaaaaacagatgattggata

SEQ ID NO: 1017138 - DNA, 22 bp, Artificial Sequence
  chemically synthesized
aaaaacagatgattggataaag

SEQ ID NO: 1017139 - DNA, 22 bp, Artificial Sequence
  chemically synthesized
aaaacagatgattggataaaga

SEQ ID NO: 1017140 - DNA, 22 bp, Artificial Sequence
  chemically synthesized
gataaagaatatgtggagatat

SEQ ID NO: 1017141 - DNA, 22 bp, Artificial Sequence
  chemically synthesized
acacacatataaataaaagaat

SEQ ID NO: 1017142 - DNA, 22 bp, Artificial Sequence
  chemically synthesized
attcacacacatataaataaaa

SEQ ID NO: 1017143 - DNA, 22 bp, Artificial Sequence
  chemically synthesized
cacatattcttttatttatatg

SEQ ID NO: 1017144 - DNA, 22 bp, Artificial Sequence
  chemically synthesized
ttttatttatatgtgtgtgaat

SEQ ID NO: 1017145 - DNA, 22 bp, Artificial Sequence
  chemically synthesized
ttatttatatgtgtgtgaatga

SEQ ID NO: 1017146 - DNA, 22 bp, Artificial Sequence
  chemically synthesized
tatttatatgtgtgtgaatgaa

SEQ ID NO: 1017147 - DNA, 22 bp, Artificial Sequence
  chemically synthesized
atttatatgtgtgtgaatgaat

SEQ ID NO: 1017148 - DNA, 22 bp, Artificial Sequence
  chemically synthesized
tttatatgtgtgtgaatgaatg

SEQ ID NO: 1017149 - DNA, 22 bp, Artificial Sequence
  chemically synthesized
cacaatggaatacattcattca

SEQ ID NO: 1017150 - DNA, 22 bp, Artificial Sequence
  chemically synthesized
atatgtgtgtgaatgaatgtat

SEQ ID NO: 1017151 - DNA, 22 bp, Artificial Sequence
  chemically synthesized
tatgtgtgtgaatgaatgtatt

SEQ ID NO: 1017152 - DNA, 22 bp, Artificial Sequence
  chemically synthesized
ggatagacacacaatggaatac

SEQ ID NO: 1017153 - DNA, 22 bp, Artificial Sequence
  chemically synthesized
cattgtgtagtattccattgtg

SEQ ID NO: 1017154 - DNA, 22 bp, Artificial Sequence
  chemically synthesized
gaagctaggatagacacacaat

SEQ ID NO: 1017155 - DNA, 22 bp, Artificial Sequence
  chemically synthesized
tgtagtattccattgtgtgtct

SEQ ID NO: 1017156 - DNA, 22 bp, Artificial Sequence
  chemically synthesized
agaagctaggatagacacacaa

SEQ ID NO: 1017157 - DNA, 22 bp, Artificial Sequence
  chemically synthesized
gacttagaagctaggatagaca

SEQ ID NO: 1017158 - DNA, 22 bp, Artificial Sequence
  chemically synthesized
agacttagaagctaggatagac

SEQ ID NO: 1017159 - DNA, 22 bp, Artificial Sequence
  chemically synthesized
cattgtgtgtctatcctagctt

SEQ ID NO: 1017160 - DNA, 22 bp, Artificial Sequence
  chemically synthesized
tgtgtctatcctagcttctaag

SEQ ID NO: 1017161 - DNA, 22 bp, Artificial Sequence
  chemically synthesized
tcctagcttctaagtctaagca

SEQ ID NO: 1017162 - DNA, 22 bp, Artificial Sequence
  chemically synthesized
gcttctaagtctaagcatatat

SEQ ID NO: 1017163 - DNA, 22 bp, Artificial Sequence
  chemically synthesized
ctaagtctaagcatatatatat

SEQ ID NO: 1017164 - DNA, 22 bp, Artificial Sequence
  chemically synthesized
taagtctaagcatatatatata

SEQ ID NO: 1017165 - DNA, 22 bp, Artificial Sequence
  chemically synthesized
agtctaagcatatatatatata

SEQ ID NO: 1017166 - DNA, 22 bp, Artificial Sequence
  chemically synthesized
agcatatatatatatatatata

SEQ ID NO: 1017167 - DNA, 22 bp, Artificial Sequence
  chemically synthesized
tgtgtgtgtacatatatatata

SEQ ID NO: 1017168 - DNA, 22 bp, Artificial Sequence
  chemically synthesized
gtgtgtgtgtacatatatatat

SEQ ID NO: 1017169 - DNA, 22 bp, Artificial Sequence
  chemically synthesized
catacgcaatttgtgtgtgtgt

SEQ ID NO: 1017170 - DNA, 22 bp, Artificial Sequence
  chemically synthesized
ttccatacgcaatttgtgtgtg

SEQ ID NO: 1017171 - DNA, 22 bp, Artificial Sequence
  chemically synthesized
attccatacgcaatttgtgtgt

SEQ ID NO: 1017172 - DNA, 22 bp, Artificial Sequence
  chemically synthesized
tttattccatacgcaatttgtg

SEQ ID NO: 1017173 - DNA, 22 bp, Artificial Sequence
  chemically synthesized
tgtatatgaaattgtttattcc

SEQ ID NO: 1017174 - DNA, 22 bp, Artificial Sequence
  chemically synthesized
attgtgtatatgaaattgttta

SEQ ID NO: 1017175 - DNA, 22 bp, Artificial Sequence
  chemically synthesized
cattgtgtatatgaaattgttt

SEQ ID NO: 1017176 - DNA, 22 bp, Artificial Sequence
  chemically synthesized
tcattgtgtatatgaaattgtt

SEQ ID NO: 1017177 - DNA, 22 bp, Artificial Sequence
  chemically synthesized
cgtatggaataaacaatttcat

SEQ ID NO: 1017178 - DNA, 22 bp, Artificial Sequence
  chemically synthesized
ttcattgtgtatatgaaattgt

SEQ ID NO: 1017179 - DNA, 22 bp, Artificial Sequence
  chemically synthesized
tagtatttttcattgtgtatat

SEQ ID NO: 1017180 - DNA, 22 bp, Artificial Sequence
  chemically synthesized
gtagtatttttcattgtgtata

SEQ ID NO: 1017181 - DNA, 22 bp, Artificial Sequence
  chemically synthesized
tgtagtatttttcattgtgtat

SEQ ID NO: 1017182 - DNA, 22 bp, Artificial Sequence
  chemically synthesized
tggctttgtagtatttttcatt

SEQ ID NO: 1017183 - DNA, 22 bp, Artificial Sequence
  chemically synthesized
catatacacaatgaaaaatact

SEQ ID NO: 1017184 - DNA, 22 bp, Artificial Sequence
  chemically synthesized
ctatggctttgtagtatttttc

SEQ ID NO: 1017185 - DNA, 22 bp, Artificial Sequence
  chemically synthesized
atatacacaatgaaaaatacta

SEQ ID NO: 1017186 - DNA, 22 bp, Artificial Sequence
  chemically synthesized
actatggctttgtagtattttt

SEQ ID NO: 1017187 - DNA, 22 bp, Artificial Sequence
  chemically synthesized
tactatggctttgtagtatttt

SEQ ID NO: 1017188 - DNA, 22 bp, Artificial Sequence
  chemically synthesized
tttactatggctttgtagtatt

SEQ ID NO: 1017189 - DNA, 22 bp, Artificial Sequence
  chemically synthesized
attctttactatggctttgtag

SEQ ID NO: 1017190 - DNA, 22 bp, Artificial Sequence
  chemically synthesized
cattctttactatggctttgta

SEQ ID NO: 1017191 - DNA, 22 bp, Artificial Sequence
  chemically synthesized
caaagccatagtaaagaatgaa

SEQ ID NO: 1017192 - DNA, 22 bp, Artificial Sequence
  chemically synthesized
caaaagacatgatttcattctt

SEQ ID NO: 1017193 - DNA, 22 bp, Artificial Sequence
  chemically synthesized
ctgcaaaagacatgatttcatt

SEQ ID NO: 1017194 - DNA, 22 bp, Artificial Sequence
  chemically synthesized
catccatgttgctgcaaaagac

SEQ ID NO: 1017195 - DNA, 22 bp, Artificial Sequence
  chemically synthesized
agatgaccaccagttccatcca

SEQ ID NO: 1017196 - DNA, 22 bp, Artificial Sequence
  chemically synthesized
ttgcagcaacatggatggaact

SEQ ID NO: 1017197 - DNA, 22 bp, Artificial Sequence
  chemically synthesized
aagatgaccaccagttccatcc

SEQ ID NO: 1017198 - DNA, 22 bp, Artificial Sequence
  chemically synthesized
tgcagcaacatggatggaactg

SEQ ID NO: 1017199 - DNA, 22 bp, Artificial Sequence
  chemically synthesized
gcagcaacatggatggaactgg

SEQ ID NO: 1017200 - DNA, 22 bp, Artificial Sequence
  chemically synthesized
cagcaacatggatggaactggt

SEQ ID NO: 1017201 - DNA, 22 bp, Artificial Sequence
  chemically synthesized
cacttaagatgaccaccagttc

SEQ ID NO: 1017202 - DNA, 22 bp, Artificial Sequence
  chemically synthesized
ttccacttaagatgaccaccag

SEQ ID NO: 1017203 - DNA, 22 bp, Artificial Sequence
  chemically synthesized
agttattccacttaagatgacc

SEQ ID NO: 1017204 - DNA, 22 bp, Artificial Sequence
  chemically synthesized
gagttattccacttaagatgac

SEQ ID NO: 1017205 - DNA, 22 bp, Artificial Sequence
  chemically synthesized
tgagttattccacttaagatga

SEQ ID NO: 1017206 - DNA, 22 bp, Artificial Sequence
  chemically synthesized
ttgagttattccacttaagatg

SEQ ID NO: 1017207 - DNA, 22 bp, Artificial Sequence
  chemically synthesized
tttttgagttattccacttaag

SEQ ID NO: 1017208 - DNA, 22 bp, Artificial Sequence
  chemically synthesized
tgtttttgagttattccactta

SEQ ID NO: 1017209 - DNA, 22 bp, Artificial Sequence
  chemically synthesized
ctgtttttgagttattccactt

SEQ ID NO: 1017210 - DNA, 22 bp, Artificial Sequence
  chemically synthesized
gtggtcatcttaagtggaataa

SEQ ID NO: 1017211 - DNA, 22 bp, Artificial Sequence
  chemically synthesized
tctgtttttgagttattccact

SEQ ID NO: 1017212 - DNA, 22 bp, Artificial Sequence
  chemically synthesized
actttctgtttttgagttattc

SEQ ID NO: 1017213 - DNA, 22 bp, Artificial Sequence
  chemically synthesized
gactttctgtttttgagttatt

SEQ ID NO: 1017214 - DNA, 22 bp, Artificial Sequence
  chemically synthesized
aagtggaataactcaaaaacag

SEQ ID NO: 1017215 - DNA, 22 bp, Artificial Sequence
  chemically synthesized
agtggaataactcaaaaacaga

SEQ ID NO: 1017216 - DNA, 22 bp, Artificial Sequence
  chemically synthesized
aaaaacagaaagtcaaatattg

SEQ ID NO: 1017217 - DNA, 22 bp, Artificial Sequence
  chemically synthesized
taagtgagaacatgcaatattt

SEQ ID NO: 1017218 - DNA, 22 bp, Artificial Sequence
  chemically synthesized
gtaagtgagaacatgcaatatt

SEQ ID NO: 1017219 - DNA, 22 bp, Artificial Sequence
  chemically synthesized
cacttgtaagtgagaacatgca

SEQ ID NO: 1017220 - DNA, 22 bp, Artificial Sequence
  chemically synthesized
ccacttgtaagtgagaacatgc

SEQ ID NO: 1017221 - DNA, 22 bp, Artificial Sequence
  chemically synthesized
gcttccacttgtaagtgagaac

SEQ ID NO: 1017222 - DNA, 22 bp, Artificial Sequence
  chemically synthesized
agcttccacttgtaagtgagaa

SEQ ID NO: 1017223 - DNA, 22 bp, Artificial Sequence
  chemically synthesized
tttagcttccacttgtaagtga

SEQ ID NO: 1017224 - DNA, 22 bp, Artificial Sequence
  chemically synthesized
catgttctcacttacaagtgga

SEQ ID NO: 1017225 - DNA, 22 bp, Artificial Sequence
  chemically synthesized
tcacttacaagtggaagctaaa

SEQ ID NO: 1017226 - DNA, 22 bp, Artificial Sequence
  chemically synthesized
acttacaagtggaagctaaata

SEQ ID NO: 1017227 - DNA, 22 bp, Artificial Sequence
  chemically synthesized
acaagtggaagctaaataatgt

SEQ ID NO: 1017228 - DNA, 22 bp, Artificial Sequence
  chemically synthesized
caagtggaagctaaataatgtg

SEQ ID NO: 1017229 - DNA, 22 bp, Artificial Sequence
  chemically synthesized
tgcgcatgtgtacacattattt

SEQ ID NO: 1017230 - DNA, 22 bp, Artificial Sequence
  chemically synthesized
tgtgcgcatgtgtacacattat

SEQ ID NO: 1017231 - DNA, 22 bp, Artificial Sequence
  chemically synthesized
cacactctgtgcgcatgtgtac

SEQ ID NO: 1017232 - DNA, 22 bp, Artificial Sequence
  chemically synthesized
ttccacactctgtgcgcatgtg

SEQ ID NO: 1017233 - DNA, 22 bp, Artificial Sequence
  chemically synthesized
aataatgtgtacacatgcgcac

SEQ ID NO: 1017234 - DNA, 22 bp, Artificial Sequence
  chemically synthesized
ttattccacactctgtgcgcat

SEQ ID NO: 1017235 - DNA, 22 bp, Artificial Sequence
  chemically synthesized
cagtgtctattattccacactc

SEQ ID NO: 1017236 - DNA, 22 bp, Artificial Sequence
  chemically synthesized
agtctccagtgtctattattcc

SEQ ID NO: 1017237 - DNA, 22 bp, Artificial Sequence
  chemically synthesized
tgagtctccagtgtctattatt

SEQ ID NO: 1017238 - DNA, 22 bp, Artificial Sequence
  chemically synthesized
ctgagtctccagtgtctattat

SEQ ID NO: 1017239 - DNA, 22 bp, Artificial Sequence
  chemically synthesized
gcccttctgagtctccagtgtc

SEQ ID NO: 1017240 - DNA, 22 bp, Artificial Sequence
  chemically synthesized
tcgcccttctgagtctccagtg

SEQ ID NO: 1017241 - DNA, 22 bp, Artificial Sequence
  chemically synthesized
gagactcagaagggcgagaggg

SEQ ID NO: 1017242 - DNA, 22 bp, Artificial Sequence
  chemically synthesized
gcccccatcccaccctctcgcc

SEQ ID NO: 1017243 - DNA, 22 bp, Artificial Sequence
  chemically synthesized
cgcccccatcccaccctctcgc

SEQ ID NO: 1017244 - DNA, 22 bp, Artificial Sequence
  chemically synthesized
tccttcgcccccatcccaccct

SEQ ID NO: 1017245 - DNA, 22 bp, Artificial Sequence
  chemically synthesized
agaagggcgagagggtgggatg

SEQ ID NO: 1017246 - DNA, 22 bp, Artificial Sequence
  chemically synthesized
ctatccttcgcccccatcccac

SEQ ID NO: 1017247 - DNA, 22 bp, Artificial Sequence
  chemically synthesized
cctatccttcgcccccatccca

SEQ ID NO: 1017248 - DNA, 22 bp, Artificial Sequence
  chemically synthesized
agcaatttcctatccttcgccc

SEQ ID NO: 1017249 - DNA, 22 bp, Artificial Sequence
  chemically synthesized
cattaagcaatttcctatcctt

SEQ ID NO: 1017250 - DNA, 22 bp, Artificial Sequence
  chemically synthesized
tccattaagcaatttcctatcc

SEQ ID NO: 1017251 - DNA, 22 bp, Artificial Sequence
  chemically synthesized
ctccattaagcaatttcctatc

SEQ ID NO: 1017252 - DNA, 22 bp, Artificial Sequence
  chemically synthesized
tctccattaagcaatttcctat

SEQ ID NO: 1017253 - DNA, 22 bp, Artificial Sequence
  chemically synthesized
ttctccattaagcaatttccta

SEQ ID NO: 1017254 - DNA, 22 bp, Artificial Sequence
  chemically synthesized
cttaatggagaaaaggtacatc

SEQ ID NO: 1017255 - DNA, 22 bp, Artificial Sequence
  chemically synthesized
aatggagaaaaggtacatcatt

SEQ ID NO: 1017256 - DNA, 22 bp, Artificial Sequence
  chemically synthesized
atggagaaaaggtacatcattt

SEQ ID NO: 1017257 - DNA, 22 bp, Artificial Sequence
  chemically synthesized
tgtacccatcatgcaaatgatg

SEQ ID NO: 1017258 - DNA, 22 bp, Artificial Sequence
  chemically synthesized
gtgtacccatcatgcaaatgat

SEQ ID NO: 1017259 - DNA, 22 bp, Artificial Sequence
  chemically synthesized
tgtgtacccatcatgcaaatga

SEQ ID NO: 1017260 - DNA, 22 bp, Artificial Sequence
  chemically synthesized
ttgtgtacccatcatgcaaatg

SEQ ID NO: 1017261 - DNA, 22 bp, Artificial Sequence
  chemically synthesized
tttgtgtacccatcatgcaaat

SEQ ID NO: 1017262 - DNA, 22 bp, Artificial Sequence
  chemically synthesized
gttttttgtgtacccatcatgc

SEQ ID NO: 1017263 - DNA, 22 bp, Artificial Sequence
  chemically synthesized
gcatgatgggtacacaaaaaac

SEQ ID NO: 1017264 - DNA, 22 bp, Artificial Sequence
  chemically synthesized
catgatgggtacacaaaaaacc

SEQ ID NO: 1017265 - DNA, 22 bp, Artificial Sequence
  chemically synthesized
cagagtggcgaagtctggtttt

SEQ ID NO: 1017266 - DNA, 22 bp, Artificial Sequence
  chemically synthesized
catggatatattgcagagtggc

SEQ ID NO: 1017267 - DNA, 22 bp, Artificial Sequence
  chemically synthesized
ttacatggatatattgcagagt

SEQ ID NO: 1017268 - DNA, 22 bp, Artificial Sequence
  chemically synthesized
gttacatggatatattgcagag

SEQ ID NO: 1017269 - DNA, 22 bp, Artificial Sequence
  chemically synthesized
tgttacatggatatattgcaga

SEQ ID NO: 1017270 - DNA, 22 bp, Artificial Sequence
  chemically synthesized
ttgttacatggatatattgcag

SEQ ID NO: 1017271 - DNA, 22 bp, Artificial Sequence
  chemically synthesized
cgccactctgcaatatatccat

SEQ ID NO: 1017272 - DNA, 22 bp, Artificial Sequence
  chemically synthesized
gccactctgcaatatatccatg

SEQ ID NO: 1017273 - DNA, 22 bp, Artificial Sequence
  chemically synthesized
tgcaatatatccatgtaacaaa

SEQ ID NO: 1017274 - DNA, 22 bp, Artificial Sequence
  chemically synthesized
caatatatccatgtaacaaaaa

SEQ ID NO: 1017275 - DNA, 22 bp, Artificial Sequence
  chemically synthesized
aggtatacaagtacatttttgt

SEQ ID NO: 1017276 - DNA, 22 bp, Artificial Sequence
  chemically synthesized
aaggtatacaagtacatttttg

SEQ ID NO: 1017277 - DNA, 22 bp, Artificial Sequence
  chemically synthesized
tataaatttaaggtatacaagt

SEQ ID NO: 1017278 - DNA, 22 bp, Artificial Sequence
  chemically synthesized
gtataaatttaaggtatacaag

SEQ ID NO: 1017279 - DNA, 22 bp, Artificial Sequence
  chemically synthesized
tttgtataaatttaaggtatac

SEQ ID NO: 1017280 - DNA, 22 bp, Artificial Sequence
  chemically synthesized
gtttgtataaatttaaggtata

SEQ ID NO: 1017281 - DNA, 22 bp, Artificial Sequence
  chemically synthesized
tgtttgtataaatttaaggtat

SEQ ID NO: 1017282 - DNA, 22 bp, Artificial Sequence
  chemically synthesized
ttgtttgtataaatttaaggta

SEQ ID NO: 1017283 - DNA, 22 bp, Artificial Sequence
  chemically synthesized
tttgtttgtataaatttaaggt

SEQ ID NO: 1017284 - DNA, 22 bp, Artificial Sequence
  chemically synthesized
ttttgtttgtataaatttaagg

SEQ ID NO: 1017285 - DNA, 22 bp, Artificial Sequence
  chemically synthesized
tttttttgtttgtataaattta

SEQ ID NO: 1017286 - DNA, 22 bp, Artificial Sequence
  chemically synthesized
ttatttttttgtttgtataaat

SEQ ID NO: 1017287 - DNA, 22 bp, Artificial Sequence
  chemically synthesized
gtataccttaaatttatacaaa

SEQ ID NO: 1017288 - DNA, 22 bp, Artificial Sequence
  chemically synthesized
attatttttttgtttgtataaa

SEQ ID NO: 1017289 - DNA, 22 bp, Artificial Sequence
  chemically synthesized
tataccttaaatttatacaaac

SEQ ID NO: 1017290 - DNA, 22 bp, Artificial Sequence
  chemically synthesized
tattatttttttgtttgtataa

SEQ ID NO: 1017291 - DNA, 22 bp, Artificial Sequence
  chemically synthesized
aaatttatacaaacaaaaaaat

SEQ ID NO: 1017292 - DNA, 22 bp, Artificial Sequence
  chemically synthesized
agtaattttattatttttttgt

SEQ ID NO: 1017293 - DNA, 22 bp, Artificial Sequence
  chemically synthesized
aatttatacaaacaaaaaaata

SEQ ID NO: 1017294 - DNA, 22 bp, Artificial Sequence
  chemically synthesized
aagtaattttattatttttttg

SEQ ID NO: 1017295 - DNA, 22 bp, Artificial Sequence
  chemically synthesized
atacaaacaaaaaaataataaa

SEQ ID NO: 1017296 - DNA, 22 bp, Artificial Sequence
  chemically synthesized
tacaaacaaaaaaataataaaa

SEQ ID NO: 1017297 - DNA, 22 bp, Artificial Sequence
  chemically synthesized
caaataatgcaatcaacattta

SEQ ID NO: 1017298 - DNA, 22 bp, Artificial Sequence
  chemically synthesized
acaaataatgcaatcaacattt

SEQ ID NO: 1017299 - DNA, 22 bp, Artificial Sequence
  chemically synthesized
ttacaaataatgcaatcaacat

SEQ ID NO: 1017300 - DNA, 22 bp, Artificial Sequence
  chemically synthesized
cttaaatgttgattgcattatt

SEQ ID NO: 1017301 - DNA, 22 bp, Artificial Sequence
  chemically synthesized
tgagttcttacaaataatgcaa

SEQ ID NO: 1017302 - DNA, 22 bp, Artificial Sequence
  chemically synthesized
gtgagttcttacaaataatgca

SEQ ID NO: 1017303 - DNA, 22 bp, Artificial Sequence
  chemically synthesized
aaatgttgattgcattatttgt

SEQ ID NO: 1017304 - DNA, 22 bp, Artificial Sequence
  chemically synthesized
aatgttgattgcattatttgta

SEQ ID NO: 1017305 - DNA, 22 bp, Artificial Sequence
  chemically synthesized
tttgtgagttcttacaaataat

SEQ ID NO: 1017306 - DNA, 22 bp, Artificial Sequence
  chemically synthesized
aattgtttgtgagttcttacaa

SEQ ID NO: 1017307 - DNA, 22 bp, Artificial Sequence
  chemically synthesized
attgcattatttgtaagaactc

SEQ ID NO: 1017308 - DNA, 22 bp, Artificial Sequence
  chemically synthesized
cattatttgtaagaactcacaa

SEQ ID NO: 1017309 - DNA, 22 bp, Artificial Sequence
  chemically synthesized
tttgtaagaactcacaaacaat

SEQ ID NO: 1017310 - DNA, 22 bp, Artificial Sequence
  chemically synthesized
gtgataacctgaattgtttgtg

SEQ ID NO: 1017311 - DNA, 22 bp, Artificial Sequence
  chemically synthesized
agtgataacctgaattgtttgt

SEQ ID NO: 1017312 - DNA, 22 bp, Artificial Sequence
  chemically synthesized
gtaagaactcacaaacaattca

SEQ ID NO: 1017313 - DNA, 22 bp, Artificial Sequence
  chemically synthesized
taagaactcacaaacaattcag

SEQ ID NO: 1017314 - DNA, 22 bp, Artificial Sequence
  chemically synthesized
atagtcttagtgataacctgaa

SEQ ID NO: 1017315 - DNA, 22 bp, Artificial Sequence
  chemically synthesized
aatagtcttagtgataacctga

SEQ ID NO: 1017316 - DNA, 22 bp, Artificial Sequence
  chemically synthesized
taatagtcttagtgataacctg

SEQ ID NO: 1017317 - DNA, 22 bp, Artificial Sequence
  chemically synthesized
acaaacaattcaggttatcact

SEQ ID NO: 1017318 - DNA, 22 bp, Artificial Sequence
  chemically synthesized
ttttaatagtcttagtgataac

SEQ ID NO: 1017319 - DNA, 22 bp, Artificial Sequence
  chemically synthesized
attttaatagtcttagtgataa

SEQ ID NO: 1017320 - DNA, 22 bp, Artificial Sequence
  chemically synthesized
agatttattttaatagtcttag

SEQ ID NO: 1017321 - DNA, 22 bp, Artificial Sequence
  chemically synthesized
aagatttattttaatagtctta

SEQ ID NO: 1017322 - DNA, 22 bp, Artificial Sequence
  chemically synthesized
taagatttattttaatagtctt

SEQ ID NO: 1017323 - DNA, 22 bp, Artificial Sequence
  chemically synthesized
aggttatcactaagactattaa

SEQ ID NO: 1017324 - DNA, 22 bp, Artificial Sequence
  chemically synthesized
tcactaagactattaaaataaa

SEQ ID NO: 1017325 - DNA, 22 bp, Artificial Sequence
  chemically synthesized
aagaattttaagatttatttta

SEQ ID NO: 1017326 - DNA, 22 bp, Artificial Sequence
  chemically synthesized
agactattaaaataaatcttaa

SEQ ID NO: 1017327 - DNA, 22 bp, Artificial Sequence
  chemically synthesized
gaaatctaaagaattttaagat

SEQ ID NO: 1017328 - DNA, 22 bp, Artificial Sequence
  chemically synthesized
agaaatctaaagaattttaaga

SEQ ID NO: 1017329 - DNA, 22 bp, Artificial Sequence
  chemically synthesized
tagaaatctaaagaattttaag

SEQ ID NO: 1017330 - DNA, 22 bp, Artificial Sequence
  chemically synthesized
ttaaaataaatcttaaaattct

SEQ ID NO: 1017331 - DNA, 22 bp, Artificial Sequence
  chemically synthesized
aaataaatcttaaaattcttta

SEQ ID NO: 1017332 - DNA, 22 bp, Artificial Sequence
  chemically synthesized
aacaacactttagaaatctaaa

SEQ ID NO: 1017333 - DNA, 22 bp, Artificial Sequence
  chemically synthesized
aaacaacactttagaaatctaa

SEQ ID NO: 1017334 - DNA, 22 bp, Artificial Sequence
  chemically synthesized
aaaattctttagatttctaaag

SEQ ID NO: 1017335 - DNA, 22 bp, Artificial Sequence
  chemically synthesized
aaattctttagatttctaaagt

SEQ ID NO: 1017336 - DNA, 22 bp, Artificial Sequence
  chemically synthesized
tttagatttctaaagtgttgtt

SEQ ID NO: 1017337 - DNA, 22 bp, Artificial Sequence
  chemically synthesized
tagatttctaaagtgttgttta

SEQ ID NO: 1017338 - DNA, 22 bp, Artificial Sequence
  chemically synthesized
agatttctaaagtgttgtttaa

SEQ ID NO: 1017339 - DNA, 22 bp, Artificial Sequence
  chemically synthesized
gatttctaaagtgttgtttaaa

SEQ ID NO: 1017340 - DNA, 22 bp, Artificial Sequence
  chemically synthesized
ctaaagtgttgtttaaactttg

SEQ ID NO: 1017341 - DNA, 22 bp, Artificial Sequence
  chemically synthesized
taaagtgttgtttaaactttgc

SEQ ID NO: 1017342 - DNA, 22 bp, Artificial Sequence
  chemically synthesized
aagtgttgtttaaactttgctg

SEQ ID NO: 1017343 - DNA, 22 bp, Artificial Sequence
  chemically synthesized
agcccaataagagtccagcaaa

SEQ ID NO: 1017344 - DNA, 22 bp, Artificial Sequence
  chemically synthesized
aagcccaataagagtccagcaa

SEQ ID NO: 1017345 - DNA, 22 bp, Artificial Sequence
  chemically synthesized
tttaaactttgctggactctta

SEQ ID NO: 1017346 - DNA, 22 bp, Artificial Sequence
  chemically synthesized
aaactttgctggactcttattg

SEQ ID NO: 1017347 - DNA, 22 bp, Artificial Sequence
  chemically synthesized
gagatttaagcccaataagagt

SEQ ID NO: 1017348 - DNA, 22 bp, Artificial Sequence
  chemically synthesized
aactttgctggactcttattgg

SEQ ID NO: 1017349 - DNA, 22 bp, Artificial Sequence
  chemically synthesized
tctagagatttaagcccaataa

SEQ ID NO: 1017350 - DNA, 22 bp, Artificial Sequence
  chemically synthesized
tgctggactcttattgggctta

SEQ ID NO: 1017351 - DNA, 22 bp, Artificial Sequence
  chemically synthesized
gctggactcttattgggcttaa

SEQ ID NO: 1017352 - DNA, 22 bp, Artificial Sequence
  chemically synthesized
ctggactcttattgggcttaaa

SEQ ID NO: 1017353 - DNA, 22 bp, Artificial Sequence
  chemically synthesized
cctgtctagagatttaagccca

SEQ ID NO: 1017354 - DNA, 22 bp, Artificial Sequence
  chemically synthesized
gactcttattgggcttaaatct

SEQ ID NO: 1017355 - DNA, 22 bp, Artificial Sequence
  chemically synthesized
ttattgggcttaaatctctaga

SEQ ID NO: 1017356 - DNA, 22 bp, Artificial Sequence
  chemically synthesized
attgggcttaaatctctagaca

SEQ ID NO: 1017357 - DNA, 22 bp, Artificial Sequence
  chemically synthesized
cacagatctgcctgtctagaga

SEQ ID NO: 1017358 - DNA, 22 bp, Artificial Sequence
  chemically synthesized
ttgggcttaaatctctagacag

SEQ ID NO: 1017359 - DNA, 22 bp, Artificial Sequence
  chemically synthesized
ctccacagatctgcctgtctag

SEQ ID NO: 1017360 - DNA, 22 bp, Artificial Sequence
  chemically synthesized
ggcttaaatctctagacaggca

SEQ ID NO: 1017361 - DNA, 22 bp, Artificial Sequence
  chemically synthesized
aaatctctagacaggcagatct

SEQ ID NO: 1017362 - DNA, 22 bp, Artificial Sequence
  chemically synthesized
aatctctagacaggcagatctg

SEQ ID NO: 1017363 - DNA, 22 bp, Artificial Sequence
  chemically synthesized
cagcgtcctcctccacagatct

SEQ ID NO: 1017364 - DNA, 22 bp, Artificial Sequence
  chemically synthesized
tagacaggcagatctgtggagg

SEQ ID NO: 1017365 - DNA, 22 bp, Artificial Sequence
  chemically synthesized
ttacagcgtcctcctccacaga

SEQ ID NO: 1017366 - DNA, 22 bp, Artificial Sequence
  chemically synthesized
gacaggcagatctgtggaggag

SEQ ID NO: 1017367 - DNA, 22 bp, Artificial Sequence
  chemically synthesized
tgttacagcgtcctcctccaca

SEQ ID NO: 1017368 - DNA, 22 bp, Artificial Sequence
  chemically synthesized
ctgttacagcgtcctcctccac

SEQ ID NO: 1017369 - DNA, 22 bp, Artificial Sequence
  chemically synthesized
tctgttacagcgtcctcctcca

SEQ ID NO: 1017370 - DNA, 22 bp, Artificial Sequence
  chemically synthesized
ttctgttacagcgtcctcctcc

SEQ ID NO: 1017371 - DNA, 22 bp, Artificial Sequence
  chemically synthesized
atgaggcttttctgttacagcg

SEQ ID NO: 1017372 - DNA, 22 bp, Artificial Sequence
  chemically synthesized
tggaggaggacgctgtaacaga

SEQ ID NO: 1017373 - DNA, 22 bp, Artificial Sequence
  chemically synthesized
ttgatgaggcttttctgttaca

SEQ ID NO: 1017374 - DNA, 22 bp, Artificial Sequence
  chemically synthesized
attgatgaggcttttctgttac

SEQ ID NO: 1017375 - DNA, 22 bp, Artificial Sequence
  chemically synthesized
agcttattgatgaggcttttct

SEQ ID NO: 1017376 - DNA, 22 bp, Artificial Sequence
  chemically synthesized
cagcttattgatgaggcttttc

SEQ ID NO: 1017377 - DNA, 22 bp, Artificial Sequence
  chemically synthesized
taacagaaaagcctcatcaata

SEQ ID NO: 1017378 - DNA, 22 bp, Artificial Sequence
  chemically synthesized
aagcaatttcagcttattgatg

SEQ ID NO: 1017379 - DNA, 22 bp, Artificial Sequence
  chemically synthesized
tctaaagcaatttcagcttatt

SEQ ID NO: 1017380 - DNA, 22 bp, Artificial Sequence
  chemically synthesized
atctaaagcaatttcagcttat

SEQ ID NO: 1017381 - DNA, 22 bp, Artificial Sequence
  chemically synthesized
gtttatctaaagcaatttcagc

SEQ ID NO: 1017382 - DNA, 22 bp, Artificial Sequence
  chemically synthesized
atcaataagctgaaattgcttt

SEQ ID NO: 1017383 - DNA, 22 bp, Artificial Sequence
  chemically synthesized
aaattgctttagataaacgagg

SEQ ID NO: 1017384 - DNA, 22 bp, Artificial Sequence
  chemically synthesized
agatcaaaaagtcctcgtttat

SEQ ID NO: 1017385 - DNA, 22 bp, Artificial Sequence
  chemically synthesized
cagatcaaaaagtcctcgttta

SEQ ID NO: 1017386 - DNA, 22 bp, Artificial Sequence
  chemically synthesized
tcagatcaaaaagtcctcgttt

SEQ ID NO: 1017387 - DNA, 22 bp, Artificial Sequence
  chemically synthesized
ctttagataaacgaggactttt

SEQ ID NO: 1017388 - DNA, 22 bp, Artificial Sequence
  chemically synthesized
tagataaacgaggactttttga

SEQ ID NO: 1017389 - DNA, 22 bp, Artificial Sequence
  chemically synthesized
agataaacgaggactttttgat

SEQ ID NO: 1017390 - DNA, 22 bp, Artificial Sequence
  chemically synthesized
gataaacgaggactttttgatc

SEQ ID NO: 1017391 - DNA, 22 bp, Artificial Sequence
  chemically synthesized
tgtgcactttcagatcaaaaag

SEQ ID NO: 1017392 - DNA, 22 bp, Artificial Sequence
  chemically synthesized
gtgtgcactttcagatcaaaaa

SEQ ID NO: 1017393 - DNA, 22 bp, Artificial Sequence
  chemically synthesized
tgtgtgcactttcagatcaaaa

SEQ ID NO: 1017394 - DNA, 22 bp, Artificial Sequence
  chemically synthesized
ttgtgtgcactttcagatcaaa

SEQ ID NO: 1017395 - DNA, 22 bp, Artificial Sequence
  chemically synthesized
tttgatctgaaagtgcacacaa

SEQ ID NO: 1017396 - DNA, 22 bp, Artificial Sequence
  chemically synthesized
ttgatctgaaagtgcacacaaa

SEQ ID NO: 1017397 - DNA, 22 bp, Artificial Sequence
  chemically synthesized
tgatctgaaagtgcacacaaaa

SEQ ID NO: 1017398 - DNA, 22 bp, Artificial Sequence
  chemically synthesized
aagtatatgtatttttgtgtgc

SEQ ID NO: 1017399 - DNA, 22 bp, Artificial Sequence
  chemically synthesized
gatctgaaagtgcacacaaaaa

SEQ ID NO: 1017400 - DNA, 22 bp, Artificial Sequence
  chemically synthesized
atctgaaagtgcacacaaaaat

SEQ ID NO: 1017401 - DNA, 22 bp, Artificial Sequence
  chemically synthesized
aaagtgcacacaaaaatacata

SEQ ID NO: 1017402 - DNA, 22 bp, Artificial Sequence
  chemically synthesized
tatacatattaaagtatatgta

SEQ ID NO: 1017403 - DNA, 22 bp, Artificial Sequence
  chemically synthesized
atatacatattaaagtatatgt

SEQ ID NO: 1017404 - DNA, 22 bp, Artificial Sequence
  chemically synthesized
atatgtgtgtatacttatatac

SEQ ID NO: 1017405 - DNA, 22 bp, Artificial Sequence
  chemically synthesized
tgatatgtgtgtatacttatat

SEQ ID NO: 1017406 - DNA, 22 bp, Artificial Sequence
  chemically synthesized
ctgatatgtgtgtatacttata

SEQ ID NO: 1017407 - DNA, 22 bp, Artificial Sequence
  chemically synthesized
taatatgtatataagtatacac

SEQ ID NO: 1017408 - DNA, 22 bp, Artificial Sequence
  chemically synthesized
aatatgtatataagtatacaca

SEQ ID NO: 1017409 - DNA, 22 bp, Artificial Sequence
  chemically synthesized
atatgtatataagtatacacac

SEQ ID NO: 1017410 - DNA, 22 bp, Artificial Sequence
  chemically synthesized
aggccaagtttctgatatgtgt

SEQ ID NO: 1017411 - DNA, 22 bp, Artificial Sequence
  chemically synthesized
aaaatcactcaggccaagtttc

SEQ ID NO: 1017412 - DNA, 22 bp, Artificial Sequence
  chemically synthesized
gccccctaaaaatcactcaggc

SEQ ID NO: 1017413 - DNA, 22 bp, Artificial Sequence
  chemically synthesized
agccccctaaaaatcactcagg

SEQ ID NO: 1017414 - DNA, 22 bp, Artificial Sequence
  chemically synthesized
ggcctgagtgatttttaggggg

SEQ ID NO: 1017415 - DNA, 22 bp, Artificial Sequence
  chemically synthesized
aggtccccttagccccctaaaa

SEQ ID NO: 1017416 - DNA, 22 bp, Artificial Sequence
  chemically synthesized
gcctgagtgatttttagggggc

SEQ ID NO: 1017417 - DNA, 22 bp, Artificial Sequence
  chemically synthesized
attaaggtccccttagccccct

SEQ ID NO: 1017418 - DNA, 22 bp, Artificial Sequence
  chemically synthesized
aattaaggtccccttagccccc

SEQ ID NO: 1017419 - DNA, 22 bp, Artificial Sequence
  chemically synthesized
agtgatttttagggggctaagg

SEQ ID NO: 1017420 - DNA, 22 bp, Artificial Sequence
  chemically synthesized
ttagggggctaaggggacctta

SEQ ID NO: 1017421 - DNA, 22 bp, Artificial Sequence
  chemically synthesized
tagggggctaaggggaccttaa

SEQ ID NO: 1017422 - DNA, 22 bp, Artificial Sequence
  chemically synthesized
agggggctaaggggaccttaat

SEQ ID NO: 1017423 - DNA, 22 bp, Artificial Sequence
  chemically synthesized
gggggctaaggggaccttaatt

SEQ ID NO: 1017424 - DNA, 22 bp, Artificial Sequence
  chemically synthesized
agccaaaatagagtgcttaatt

SEQ ID NO: 1017425 - DNA, 22 bp, Artificial Sequence
  chemically synthesized
aggggaccttaattaagcactc

SEQ ID NO: 1017426 - DNA, 22 bp, Artificial Sequence
  chemically synthesized
ccctaagccaaaatagagtgct

SEQ ID NO: 1017427 - DNA, 22 bp, Artificial Sequence
  chemically synthesized
cccctaagccaaaatagagtgc

SEQ ID NO: 1017428 - DNA, 22 bp, Artificial Sequence
  chemically synthesized
tcccctaagccaaaatagagtg

SEQ ID NO: 1017429 - DNA, 22 bp, Artificial Sequence
  chemically synthesized
aattaagcactctattttggct

SEQ ID NO: 1017430 - DNA, 22 bp, Artificial Sequence
  chemically synthesized
attaagcactctattttggctt

SEQ ID NO: 1017431 - DNA, 22 bp, Artificial Sequence
  chemically synthesized
cggtgttttcccctaagccaaa

SEQ ID NO: 1017432 - DNA, 22 bp, Artificial Sequence
  chemically synthesized
acggtgttttcccctaagccaa

SEQ ID NO: 1017433 - DNA, 22 bp, Artificial Sequence
  chemically synthesized
agcactctattttggcttaggg

SEQ ID NO: 1017434 - DNA, 22 bp, Artificial Sequence
  chemically synthesized
tattttggcttaggggaaaaca

SEQ ID NO: 1017435 - DNA, 22 bp, Artificial Sequence
  chemically synthesized
ttttggcttaggggaaaacacc

SEQ ID NO: 1017436 - DNA, 22 bp, Artificial Sequence
  chemically synthesized
aaggatatttacggtgttttcc

SEQ ID NO: 1017437 - DNA, 22 bp, Artificial Sequence
  chemically synthesized
tggcttaggggaaaacaccgta

SEQ ID NO: 1017438 - DNA, 22 bp, Artificial Sequence
  chemically synthesized
ggcttaggggaaaacaccgtaa

SEQ ID NO: 1017439 - DNA, 22 bp, Artificial Sequence
  chemically synthesized
tctcaaggatatttacggtgtt

SEQ ID NO: 1017440 - DNA, 22 bp, Artificial Sequence
  chemically synthesized
gcttaggggaaaacaccgtaaa

SEQ ID NO: 1017441 - DNA, 22 bp, Artificial Sequence
  chemically synthesized
atctcaaggatatttacggtgt

SEQ ID NO: 1017442 - DNA, 22 bp, Artificial Sequence
  chemically synthesized
aggggaaaacaccgtaaatatc

SEQ ID NO: 1017443 - DNA, 22 bp, Artificial Sequence
  chemically synthesized
ggggaaaacaccgtaaatatcc

SEQ ID NO: 1017444 - DNA, 22 bp, Artificial Sequence
  chemically synthesized
tcaatttatctcaaggatattt

SEQ ID NO: 1017445 - DNA, 22 bp, Artificial Sequence
  chemically synthesized
atcaatttatctcaaggatatt

SEQ ID NO: 1017446 - DNA, 22 bp, Artificial Sequence
  chemically synthesized
agtacttatcaatttatctcaa

SEQ ID NO: 1017447 - DNA, 22 bp, Artificial Sequence
  chemically synthesized
gagtacttatcaatttatctca

SEQ ID NO: 1017448 - DNA, 22 bp, Artificial Sequence
  chemically synthesized
tttgagtacttatcaatttatc

SEQ ID NO: 1017449 - DNA, 22 bp, Artificial Sequence
  chemically synthesized
actatttgagtacttatcaatt

SEQ ID NO: 1017450 - DNA, 22 bp, Artificial Sequence
  chemically synthesized
taactatttgagtacttatcaa

SEQ ID NO: 1017451 - DNA, 22 bp, Artificial Sequence
  chemically synthesized
gagataaattgataagtactca

SEQ ID NO: 1017452 - DNA, 22 bp, Artificial Sequence
  chemically synthesized
agataaattgataagtactcaa

SEQ ID NO: 1017453 - DNA, 22 bp, Artificial Sequence
  chemically synthesized
ataagtactcaaatagttagag

SEQ ID NO: 1017454 - DNA, 22 bp, Artificial Sequence
  chemically synthesized
aaatagttagagattcatttct

SEQ ID NO: 1017455 - DNA, 22 bp, Artificial Sequence
  chemically synthesized
gagattcatttctttacctatg

SEQ ID NO: 1017456 - DNA, 22 bp, Artificial Sequence
  chemically synthesized
aataatcagataccaagcatag

SEQ ID NO: 1017457 - DNA, 22 bp, Artificial Sequence
  chemically synthesized
atttctttacctatgcttggta

SEQ ID NO: 1017458 - DNA, 22 bp, Artificial Sequence
  chemically synthesized
ctttacctatgcttggtatctg

SEQ ID NO: 1017459 - DNA, 22 bp, Artificial Sequence
  chemically synthesized
tttacctatgcttggtatctga

SEQ ID NO: 1017460 - DNA, 22 bp, Artificial Sequence
  chemically synthesized
aggagttaaataatcagatacc

SEQ ID NO: 1017461 - DNA, 22 bp, Artificial Sequence
  chemically synthesized
tacctatgcttggtatctgatt

SEQ ID NO: 1017462 - DNA, 22 bp, Artificial Sequence
  chemically synthesized
acctatgcttggtatctgatta

SEQ ID NO: 1017463 - DNA, 22 bp, Artificial Sequence
  chemically synthesized
cctatgcttggtatctgattat

SEQ ID NO: 1017464 - DNA, 22 bp, Artificial Sequence
  chemically synthesized
ctaaggagttaaataatcagat

SEQ ID NO: 1017465 - DNA, 22 bp, Artificial Sequence
  chemically synthesized
ttactaaggagttaaataatca

SEQ ID NO: 1017466 - DNA, 22 bp, Artificial Sequence
  chemically synthesized
tgcttggtatctgattatttaa

SEQ ID NO: 1017467 - DNA, 22 bp, Artificial Sequence
  chemically synthesized
ttattactaaggagttaaataa

SEQ ID NO: 1017468 - DNA, 22 bp, Artificial Sequence
  chemically synthesized
gttattactaaggagttaaata

SEQ ID NO: 1017469 - DNA, 22 bp, Artificial Sequence
  chemically synthesized
tgttattactaaggagttaaat

SEQ ID NO: 1017470 - DNA, 22 bp, Artificial Sequence
  chemically synthesized
ggtatctgattatttaactcct

SEQ ID NO: 1017471 - DNA, 22 bp, Artificial Sequence
  chemically synthesized
gtatctgattatttaactcctt

SEQ ID NO: 1017472 - DNA, 22 bp, Artificial Sequence
  chemically synthesized
tttgttattactaaggagttaa

SEQ ID NO: 1017473 - DNA, 22 bp, Artificial Sequence
  chemically synthesized
ctttgttattactaaggagtta

SEQ ID NO: 1017474 - DNA, 22 bp, Artificial Sequence
  chemically synthesized
tctttgttattactaaggagtt

SEQ ID NO: 1017475 - DNA, 22 bp, Artificial Sequence
  chemically synthesized
ctttctttgttattactaagga

SEQ ID NO: 1017476 - DNA, 22 bp, Artificial Sequence
  chemically synthesized
gctttctttgttattactaagg

SEQ ID NO: 1017477 - DNA, 22 bp, Artificial Sequence
  chemically synthesized
attatttaactccttagtaata

SEQ ID NO: 1017478 - DNA, 22 bp, Artificial Sequence
  chemically synthesized
tgctttctttgttattactaag

SEQ ID NO: 1017479 - DNA, 22 bp, Artificial Sequence
  chemically synthesized
ttgctttctttgttattactaa

SEQ ID NO: 1017480 - DNA, 22 bp, Artificial Sequence
  chemically synthesized
tttaactccttagtaataacaa

SEQ ID NO: 1017481 - DNA, 22 bp, Artificial Sequence
  chemically synthesized
aactccttagtaataacaaaga

SEQ ID NO: 1017482 - DNA, 22 bp, Artificial Sequence
  chemically synthesized
actccttagtaataacaaagaa

SEQ ID NO: 1017483 - DNA, 22 bp, Artificial Sequence
  chemically synthesized
cttagtaataacaaagaaagca

SEQ ID NO: 1017484 - DNA, 22 bp, Artificial Sequence
  chemically synthesized
agtaataacaaagaaagcaaaa

SEQ ID NO: 1017485 - DNA, 22 bp, Artificial Sequence
  chemically synthesized
gtaataacaaagaaagcaaaag

SEQ ID NO: 1017486 - DNA, 22 bp, Artificial Sequence
  chemically synthesized
gacaatagtaatatcagggaca

SEQ ID NO: 1017487 - DNA, 22 bp, Artificial Sequence
  chemically synthesized
tagacaatagtaatatcaggga

SEQ ID NO: 1017488 - DNA, 22 bp, Artificial Sequence
  chemically synthesized
cggagttctagacaatagtaat

SEQ ID NO: 1017489 - DNA, 22 bp, Artificial Sequence
  chemically synthesized
gcggagttctagacaatagtaa

SEQ ID NO: 1017490 - DNA, 22 bp, Artificial Sequence
  chemically synthesized
atattactattgtctagaactc

SEQ ID NO: 1017491 - DNA, 22 bp, Artificial Sequence
  chemically synthesized
ctattgtctagaactccgcaaa

SEQ ID NO: 1017492 - DNA, 22 bp, Artificial Sequence
  chemically synthesized
ttgtctagaactccgcaaattt

SEQ ID NO: 1017493 - DNA, 22 bp, Artificial Sequence
  chemically synthesized
tctagaactccgcaaattttct

SEQ ID NO: 1017494 - DNA, 22 bp, Artificial Sequence
  chemically synthesized
gaactccgcaaattttctttgc

SEQ ID NO: 1017495 - DNA, 22 bp, Artificial Sequence
  chemically synthesized
taaaagagaagggcaaagaaaa

SEQ ID NO: 1017496 - DNA, 22 bp, Artificial Sequence
  chemically synthesized
ataaaagagaagggcaaagaaa

SEQ ID NO: 1017497 - DNA, 22 bp, Artificial Sequence
  chemically synthesized
cgcaaattttctttgcccttct

SEQ ID NO: 1017498 - DNA, 22 bp, Artificial Sequence
  chemically synthesized
tctttgcccttctcttttataa

SEQ ID NO: 1017499 - DNA, 22 bp, Artificial Sequence
  chemically synthesized
tgtcaaagagatttataaaaga

SEQ ID NO: 1017500 - DNA, 22 bp, Artificial Sequence
  chemically synthesized
ctttgcccttctcttttataaa

SEQ ID NO: 1017501 - DNA, 22 bp, Artificial Sequence
  chemically synthesized
tttgcccttctcttttataaat

SEQ ID NO: 1017502 - DNA, 22 bp, Artificial Sequence
  chemically synthesized
tgcccttctcttttataaatct

SEQ ID NO: 1017503 - DNA, 22 bp, Artificial Sequence
  chemically synthesized
gcccttctcttttataaatctc

SEQ ID NO: 1017504 - DNA, 22 bp, Artificial Sequence
  chemically synthesized
tattgtgtcaaagagatttata

SEQ ID NO: 1017505 - DNA, 22 bp, Artificial Sequence
  chemically synthesized
cccttctcttttataaatctct

SEQ ID NO: 1017506 - DNA, 22 bp, Artificial Sequence
  chemically synthesized
ctcttttataaatctctttgac

SEQ ID NO: 1017507 - DNA, 22 bp, Artificial Sequence
  chemically synthesized
tcttttataaatctctttgaca

SEQ ID NO: 1017508 - DNA, 22 bp, Artificial Sequence
  chemically synthesized
gaacattatattgtgtcaaaga

SEQ ID NO: 1017509 - DNA, 22 bp, Artificial Sequence
  chemically synthesized
ttttataaatctctttgacaca

SEQ ID NO: 1017510 - DNA, 22 bp, Artificial Sequence
  chemically synthesized
ttataaatctctttgacacaat

SEQ ID NO: 1017511 - DNA, 22 bp, Artificial Sequence
  chemically synthesized
ctggaacattatattgtgtcaa

SEQ ID NO: 1017512 - DNA, 22 bp, Artificial Sequence
  chemically synthesized
tataaatctctttgacacaata

SEQ ID NO: 1017513 - DNA, 22 bp, Artificial Sequence
  chemically synthesized
ataaatctctttgacacaatat

SEQ ID NO: 1017514 - DNA, 22 bp, Artificial Sequence
  chemically synthesized
taaatctctttgacacaatata

SEQ ID NO: 1017515 - DNA, 22 bp, Artificial Sequence
  chemically synthesized
tctgctggaacattatattgtg

SEQ ID NO: 1017516 - DNA, 22 bp, Artificial Sequence
  chemically synthesized
tttgacacaatataatgttcca

SEQ ID NO: 1017517 - DNA, 22 bp, Artificial Sequence
  chemically synthesized
tcagttgtctgctggaacatta

SEQ ID NO: 1017518 - DNA, 22 bp, Artificial Sequence
  chemically synthesized
tgacacaatataatgttccagc

SEQ ID NO: 1017519 - DNA, 22 bp, Artificial Sequence
  chemically synthesized
gacacaatataatgttccagca

SEQ ID NO: 1017520 - DNA, 22 bp, Artificial Sequence
  chemically synthesized
acacaatataatgttccagcag

SEQ ID NO: 1017521 - DNA, 22 bp, Artificial Sequence
  chemically synthesized
cattgtcagttgtctgctggaa

SEQ ID NO: 1017522 - DNA, 22 bp, Artificial Sequence
  chemically synthesized
acattgtcagttgtctgctgga

SEQ ID NO: 1017523 - DNA, 22 bp, Artificial Sequence
  chemically synthesized
tacattgtcagttgtctgctgg

SEQ ID NO: 1017524 - DNA, 22 bp, Artificial Sequence
  chemically synthesized
cagcagacaactgacaatgtaa

SEQ ID NO: 1017525 - DNA, 22 bp, Artificial Sequence
  chemically synthesized
aaatatcacaacctttacattg

SEQ ID NO: 1017526 - DNA, 22 bp, Artificial Sequence
  chemically synthesized
caaatatcacaacctttacatt

SEQ ID NO: 1017527 - DNA, 22 bp, Artificial Sequence
  chemically synthesized
tcaaatatcacaacctttacat

SEQ ID NO: 1017528 - DNA, 22 bp, Artificial Sequence
  chemically synthesized
acaatgtaaaggttgtgatatt

SEQ ID NO: 1017529 - DNA, 22 bp, Artificial Sequence
  chemically synthesized
catcatgatggaattttcaaat

SEQ ID NO: 1017530 - DNA, 22 bp, Artificial Sequence
  chemically synthesized
ccatcatgatggaattttcaaa

SEQ ID NO: 1017531 - DNA, 22 bp, Artificial Sequence
  chemically synthesized
tccatcatgatggaattttcaa

SEQ ID NO: 1017532 - DNA, 22 bp, Artificial Sequence
  chemically synthesized
ttccatcatgatggaattttca

SEQ ID NO: 1017533 - DNA, 22 bp, Artificial Sequence
  chemically synthesized
tgatatttgaaaattccatcat

SEQ ID NO: 1017534 - DNA, 22 bp, Artificial Sequence
  chemically synthesized
aatatttttccatcatgatgga

SEQ ID NO: 1017535 - DNA, 22 bp, Artificial Sequence
  chemically synthesized
gaaaattccatcatgatggaaa

SEQ ID NO: 1017536 - DNA, 22 bp, Artificial Sequence
  chemically synthesized
aaaattccatcatgatggaaaa

SEQ ID NO: 1017537 - DNA, 22 bp, Artificial Sequence
  chemically synthesized
catcatgatggaaaaatattca

SEQ ID NO: 1017538 - DNA, 22 bp, Artificial Sequence
  chemically synthesized
agaagcagtgcaggaatagtac

SEQ ID NO: 1017539 - DNA, 22 bp, Artificial Sequence
  chemically synthesized
cagaagcagtgcaggaatagta

SEQ ID NO: 1017540 - DNA, 22 bp, Artificial Sequence
  chemically synthesized
tcagaagcagtgcaggaatagt

SEQ ID NO: 1017541 - DNA, 22 bp, Artificial Sequence
  chemically synthesized
ttcagaagcagtgcaggaatag

SEQ ID NO: 1017542 - DNA, 22 bp, Artificial Sequence
  chemically synthesized
tttcagaagcagtgcaggaata

SEQ ID NO: 1017543 - DNA, 22 bp, Artificial Sequence
  chemically synthesized
agggtgtactattcctgcactg

SEQ ID NO: 1017544 - DNA, 22 bp, Artificial Sequence
  chemically synthesized
catattttttcagaagcagtgc

SEQ ID NO: 1017545 - DNA, 22 bp, Artificial Sequence
  chemically synthesized
ttcctgcactgcttctgaaaaa

SEQ ID NO: 1017546 - DNA, 22 bp, Artificial Sequence
  chemically synthesized
ctgcactgcttctgaaaaaata

SEQ ID NO: 1017547 - DNA, 22 bp, Artificial Sequence
  chemically synthesized
gcataatcctacatattttttc

SEQ ID NO: 1017548 - DNA, 22 bp, Artificial Sequence
  chemically synthesized
cactgcttctgaaaaaatatgt

SEQ ID NO: 1017549 - DNA, 22 bp, Artificial Sequence
  chemically synthesized
atattagcataatcctacatat

SEQ ID NO: 1017550 - DNA, 22 bp, Artificial Sequence
  chemically synthesized
cttctgaaaaaatatgtaggat

SEQ ID NO: 1017551 - DNA, 22 bp, Artificial Sequence
  chemically synthesized
ctgaaaaaatatgtaggattat

SEQ ID NO: 1017552 - DNA, 22 bp, Artificial Sequence
  chemically synthesized
tgaaaaaatatgtaggattatg

SEQ ID NO: 1017553 - DNA, 22 bp, Artificial Sequence
  chemically synthesized
ggttaatattagcataatccta

SEQ ID NO: 1017554 - DNA, 22 bp, Artificial Sequence
  chemically synthesized
aggttaatattagcataatcct

SEQ ID NO: 1017555 - DNA, 22 bp, Artificial Sequence
  chemically synthesized
aaaaaatatgtaggattatgct

SEQ ID NO: 1017556 - DNA, 22 bp, Artificial Sequence
  chemically synthesized
taggttaatattagcataatcc

SEQ ID NO: 1017557 - DNA, 22 bp, Artificial Sequence
  chemically synthesized
cataattttaggttaatattag

SEQ ID NO: 1017558 - DNA, 22 bp, Artificial Sequence
  chemically synthesized
aaattgcataattttaggttaa

SEQ ID NO: 1017559 - DNA, 22 bp, Artificial Sequence
  chemically synthesized
tgctaatattaacctaaaatta

SEQ ID NO: 1017560 - DNA, 22 bp, Artificial Sequence
  chemically synthesized
atattaacctaaaattatgcaa

SEQ ID NO: 1017561 - DNA, 22 bp, Artificial Sequence
  chemically synthesized
acctaaaattatgcaatttcaa

SEQ ID NO: 1017562 - DNA, 22 bp, Artificial Sequence
  chemically synthesized
tgccaaatcaagacattgaaat

SEQ ID NO: 1017563 - DNA, 22 bp, Artificial Sequence
  chemically synthesized
aaattatgcaatttcaatgtct

SEQ ID NO: 1017564 - DNA, 22 bp, Artificial Sequence
  chemically synthesized
attgtgccaaatcaagacattg

SEQ ID NO: 1017565 - DNA, 22 bp, Artificial Sequence
  chemically synthesized
tgcaatttcaatgtcttgattt

SEQ ID NO: 1017566 - DNA, 22 bp, Artificial Sequence
  chemically synthesized
cagggtgctaattgtgccaaat

SEQ ID NO: 1017567 - DNA, 22 bp, Artificial Sequence
  chemically synthesized
acagggtgctaattgtgccaaa

SEQ ID NO: 1017568 - DNA, 22 bp, Artificial Sequence
  chemically synthesized
caatgtcttgatttggcacaat

SEQ ID NO: 1017569 - DNA, 22 bp, Artificial Sequence
  chemically synthesized
tacagggtgctaattgtgccaa

SEQ ID NO: 1017570 - DNA, 22 bp, Artificial Sequence
  chemically synthesized
aatgtcttgatttggcacaatt

SEQ ID NO: 1017571 - DNA, 22 bp, Artificial Sequence
  chemically synthesized
ttacagggtgctaattgtgcca

SEQ ID NO: 1017572 - DNA, 22 bp, Artificial Sequence
  chemically synthesized
ggtatttttacagggtgctaat

SEQ ID NO: 1017573 - DNA, 22 bp, Artificial Sequence
  chemically synthesized
gatttggcacaattagcaccct

SEQ ID NO: 1017574 - DNA, 22 bp, Artificial Sequence
  chemically synthesized
gggtatttttacagggtgctaa

SEQ ID NO: 1017575 - DNA, 22 bp, Artificial Sequence
  chemically synthesized
atttggcacaattagcaccctg

SEQ ID NO: 1017576 - DNA, 22 bp, Artificial Sequence
  chemically synthesized
tgggtatttttacagggtgcta

SEQ ID NO: 1017577 - DNA, 22 bp, Artificial Sequence
  chemically synthesized
ctttgggtatttttacagggtg

SEQ ID NO: 1017578 - DNA, 22 bp, Artificial Sequence
  chemically synthesized
ggcacaattagcaccctgtaaa

SEQ ID NO: 1017579 - DNA, 22 bp, Artificial Sequence
  chemically synthesized
gcacaattagcaccctgtaaaa

SEQ ID NO: 1017580 - DNA, 22 bp, Artificial Sequence
  chemically synthesized
ctactttgggtatttttacagg

SEQ ID NO: 1017581 - DNA, 22 bp, Artificial Sequence
  chemically synthesized
tgctactttgggtatttttaca

SEQ ID NO: 1017582 - DNA, 22 bp, Artificial Sequence
  chemically synthesized
ctgctactttgggtatttttac

SEQ ID NO: 1017583 - DNA, 22 bp, Artificial Sequence
  chemically synthesized
tttctgctactttgggtatttt

SEQ ID NO: 1017584 - DNA, 22 bp, Artificial Sequence
  chemically synthesized
gcaccctgtaaaaatacccaaa

SEQ ID NO: 1017585 - DNA, 22 bp, Artificial Sequence
  chemically synthesized
taaaaatacccaaagtagcaga

SEQ ID NO: 1017586 - DNA, 22 bp, Artificial Sequence
  chemically synthesized
atagcaaactatttctgctact

SEQ ID NO: 1017587 - DNA, 22 bp, Artificial Sequence
  chemically synthesized
cagatcactaatagcaaactat

SEQ ID NO: 1017588 - DNA, 22 bp, Artificial Sequence
  chemically synthesized
aaagtagcattacagatcacta

SEQ ID NO: 1017589 - DNA, 22 bp, Artificial Sequence
  chemically synthesized
gtattaaaagtagcattacaga

SEQ ID NO: 1017590 - DNA, 22 bp, Artificial Sequence
  chemically synthesized
gctattagtgatctgtaatgct

SEQ ID NO: 1017591 - DNA, 22 bp, Artificial Sequence
  chemically synthesized
ggtattaaaagtagcattacag

SEQ ID NO: 1017592 - DNA, 22 bp, Artificial Sequence
  chemically synthesized
ctattagtgatctgtaatgcta

SEQ ID NO: 1017593 - DNA, 22 bp, Artificial Sequence
  chemically synthesized
ttagtgatctgtaatgctactt

SEQ ID NO: 1017594 - DNA, 22 bp, Artificial Sequence
  chemically synthesized
gtgatctgtaatgctactttta

SEQ ID NO: 1017595 - DNA, 22 bp, Artificial Sequence
  chemically synthesized
caaaaggtcttggtattaaaag

SEQ ID NO: 1017596 - DNA, 22 bp, Artificial Sequence
  chemically synthesized
tccaaaaggtcttggtattaaa

SEQ ID NO: 1017597 - DNA, 22 bp, Artificial Sequence
  chemically synthesized
ctccaaaaggtcttggtattaa

SEQ ID NO: 1017598 - DNA, 22 bp, Artificial Sequence
  chemically synthesized
taatgctacttttaataccaag

SEQ ID NO: 1017599 - DNA, 22 bp, Artificial Sequence
  chemically synthesized
atttctccaaaaggtcttggta

SEQ ID NO: 1017600 - DNA, 22 bp, Artificial Sequence
  chemically synthesized
cttttaataccaagaccttttg

SEQ ID NO: 1017601 - DNA, 22 bp, Artificial Sequence
  chemically synthesized
tagctgatttctccaaaaggtc

SEQ ID NO: 1017602 - DNA, 22 bp, Artificial Sequence
  chemically synthesized
ttaataccaagaccttttggag

SEQ ID NO: 1017603 - DNA, 22 bp, Artificial Sequence
  chemically synthesized
tgtagctgatttctccaaaagg

SEQ ID NO: 1017604 - DNA, 22 bp, Artificial Sequence
  chemically synthesized
taataccaagaccttttggaga

SEQ ID NO: 1017605 - DNA, 22 bp, Artificial Sequence
  chemically synthesized
ctgtagctgatttctccaaaag

SEQ ID NO: 1017606 - DNA, 22 bp, Artificial Sequence
  chemically synthesized
aataccaagaccttttggagaa

SEQ ID NO: 1017607 - DNA, 22 bp, Artificial Sequence
  chemically synthesized
ataccaagaccttttggagaaa

SEQ ID NO: 1017608 - DNA, 22 bp, Artificial Sequence
  chemically synthesized
agtcagtttctgtagctgattt

SEQ ID NO: 1017609 - DNA, 22 bp, Artificial Sequence
  chemically synthesized
ctgagtcagtttctgtagctga

SEQ ID NO: 1017610 - DNA, 22 bp, Artificial Sequence
  chemically synthesized
ttggagaaatcagctacagaaa

SEQ ID NO: 1017611 - DNA, 22 bp, Artificial Sequence
  chemically synthesized
tggagaaatcagctacagaaac

SEQ ID NO: 1017612 - DNA, 22 bp, Artificial Sequence
  chemically synthesized
ggagaaatcagctacagaaact

SEQ ID NO: 1017613 - DNA, 22 bp, Artificial Sequence
  chemically synthesized
gcctgctgagtcagtttctgta

SEQ ID NO: 1017614 - DNA, 22 bp, Artificial Sequence
  chemically synthesized
gagaaatcagctacagaaactg

SEQ ID NO: 1017615 - DNA, 22 bp, Artificial Sequence
  chemically synthesized
agcctgctgagtcagtttctgt

SEQ ID NO: 1017616 - DNA, 22 bp, Artificial Sequence
  chemically synthesized
acttagcctgctgagtcagttt

SEQ ID NO: 1017617 - DNA, 22 bp, Artificial Sequence
  chemically synthesized
aacttagcctgctgagtcagtt

SEQ ID NO: 1017618 - DNA, 22 bp, Artificial Sequence
  chemically synthesized
tttaacttagcctgctgagtca

SEQ ID NO: 1017619 - DNA, 22 bp, Artificial Sequence
  chemically synthesized
cagaaactgactcagcaggcta

SEQ ID NO: 1017620 - DNA, 22 bp, Artificial Sequence
  chemically synthesized
aattatttaacttagcctgctg

SEQ ID NO: 1017621 - DNA, 22 bp, Artificial Sequence
  chemically synthesized
aaattatttaacttagcctgct

SEQ ID NO: 1017622 - DNA, 22 bp, Artificial Sequence
  chemically synthesized
actcagcaggctaagttaaata

SEQ ID NO: 1017623 - DNA, 22 bp, Artificial Sequence
  chemically synthesized
agaaatttaaattatttaactt

SEQ ID NO: 1017624 - DNA, 22 bp, Artificial Sequence
  chemically synthesized
ttaagaaatttaaattatttaa

SEQ ID NO: 1017625 - DNA, 22 bp, Artificial Sequence
  chemically synthesized
agcaggctaagttaaataattt

SEQ ID NO: 1017626 - DNA, 22 bp, Artificial Sequence
  chemically synthesized
attaagaaatttaaattattta

SEQ ID NO: 1017627 - DNA, 22 bp, Artificial Sequence
  chemically synthesized
aacttattaagaaatttaaatt

SEQ ID NO: 1017628 - DNA, 22 bp, Artificial Sequence
  chemically synthesized
aaacttattaagaaatttaaat

SEQ ID NO: 1017629 - DNA, 22 bp, Artificial Sequence
  chemically synthesized
agttaaataatttaaatttctt

SEQ ID NO: 1017630 - DNA, 22 bp, Artificial Sequence
  chemically synthesized
aataatttaaatttcttaataa

SEQ ID NO: 1017631 - DNA, 22 bp, Artificial Sequence
  chemically synthesized
aaatttcttaataagtttaaac

SEQ ID NO: 1017632 - DNA, 22 bp, Artificial Sequence
  chemically synthesized
aatttcttaataagtttaaact

SEQ ID NO: 1017633 - DNA, 22 bp, Artificial Sequence
  chemically synthesized
agagagtatgtcagtttaaact

SEQ ID NO: 1017634 - DNA, 22 bp, Artificial Sequence
  chemically synthesized
cttaataagtttaaactgacat

SEQ ID NO: 1017635 - DNA, 22 bp, Artificial Sequence
  chemically synthesized
ttaataagtttaaactgacata

SEQ ID NO: 1017636 - DNA, 22 bp, Artificial Sequence
  chemically synthesized
aataagtttaaactgacatact

SEQ ID NO: 1017637 - DNA, 22 bp, Artificial Sequence
  chemically synthesized
ataagtttaaactgacatactc

SEQ ID NO: 1017638 - DNA, 22 bp, Artificial Sequence
  chemically synthesized
aatatatcaaatcctcagagag

SEQ ID NO: 1017639 - DNA, 22 bp, Artificial Sequence
  chemically synthesized
aaactgacatactctctgagga

SEQ ID NO: 1017640 - DNA, 22 bp, Artificial Sequence
  chemically synthesized
gaatatatcaaatcctcagaga

SEQ ID NO: 1017641 - DNA, 22 bp, Artificial Sequence
  chemically synthesized
aactgacatactctctgaggat

SEQ ID NO: 1017642 - DNA, 22 bp, Artificial Sequence
  chemically synthesized
acatactctctgaggatttgat

SEQ ID NO: 1017643 - DNA, 22 bp, Artificial Sequence
  chemically synthesized
tctgaggatttgatatattcaa

SEQ ID NO: 1017644 - DNA, 22 bp, Artificial Sequence
  chemically synthesized
taaaggagacccttgaatatat

SEQ ID NO: 1017645 - DNA, 22 bp, Artificial Sequence
  chemically synthesized
ataaaggagacccttgaatata

SEQ ID NO: 1017646 - DNA, 22 bp, Artificial Sequence
  chemically synthesized
tgaggatttgatatattcaagg

SEQ ID NO: 1017647 - DNA, 22 bp, Artificial Sequence
  chemically synthesized
tataaaggagacccttgaatat

SEQ ID NO: 1017648 - DNA, 22 bp, Artificial Sequence
  chemically synthesized
aggatttgatatattcaagggt

SEQ ID NO: 1017649 - DNA, 22 bp, Artificial Sequence
  chemically synthesized
acattttataaaggagaccctt

SEQ ID NO: 1017650 - DNA, 22 bp, Artificial Sequence
  chemically synthesized
gatatattcaagggtctccttt

SEQ ID NO: 1017651 - DNA, 22 bp, Artificial Sequence
  chemically synthesized
atatattcaagggtctccttta

SEQ ID NO: 1017652 - DNA, 22 bp, Artificial Sequence
  chemically synthesized
aatgctcacattttataaagga

SEQ ID NO: 1017653 - DNA, 22 bp, Artificial Sequence
  chemically synthesized
aagggtctcctttataaaatgt

SEQ ID NO: 1017654 - DNA, 22 bp, Artificial Sequence
  chemically synthesized
aattaaatgctcacattttata

SEQ ID NO: 1017655 - DNA, 22 bp, Artificial Sequence
  chemically synthesized
agactcaattaaatgctcacat

SEQ ID NO: 1017656 - DNA, 22 bp, Artificial Sequence
  chemically synthesized
ctttataaaatgtgagcattta

SEQ ID NO: 1017657 - DNA, 22 bp, Artificial Sequence
  chemically synthesized
tataaaatgtgagcatttaatt

SEQ ID NO: 1017658 - DNA, 22 bp, Artificial Sequence
  chemically synthesized
ataaaatgtgagcatttaattg

SEQ ID NO: 1017659 - DNA, 22 bp, Artificial Sequence
  chemically synthesized
taaaatgtgagcatttaattga

SEQ ID NO: 1017660 - DNA, 22 bp, Artificial Sequence
  chemically synthesized
tatagtagaggatatgtaaatt

SEQ ID NO: 1017661 - DNA, 22 bp, Artificial Sequence
  chemically synthesized
aattgagtcttaatttacatat

SEQ ID NO: 1017662 - DNA, 22 bp, Artificial Sequence
  chemically synthesized
attgagtcttaatttacatatc

SEQ ID NO: 1017663 - DNA, 22 bp, Artificial Sequence
  chemically synthesized
agtcttaatttacatatcctct

SEQ ID NO: 1017664 - DNA, 22 bp, Artificial Sequence
  chemically synthesized
atgtggactatatagtagagga

SEQ ID NO: 1017665 - DNA, 22 bp, Artificial Sequence
  chemically synthesized
catgtggactatatagtagagg

SEQ ID NO: 1017666 - DNA, 22 bp, Artificial Sequence
  chemically synthesized
aatttacatatcctctactata

SEQ ID NO: 1017667 - DNA, 22 bp, Artificial Sequence
  chemically synthesized
atttacatatcctctactatat

SEQ ID NO: 1017668 - DNA, 22 bp, Artificial Sequence
  chemically synthesized
ttcatgtggactatatagtaga

SEQ ID NO: 1017669 - DNA, 22 bp, Artificial Sequence
  chemically synthesized
acatatcctctactatatagtc

SEQ ID NO: 1017670 - DNA, 22 bp, Artificial Sequence
  chemically synthesized
catatcctctactatatagtcc

SEQ ID NO: 1017671 - DNA, 22 bp, Artificial Sequence
  chemically synthesized
acaccatatcctcttcatgtgg

SEQ ID NO: 1017672 - DNA, 22 bp, Artificial Sequence
  chemically synthesized
tactatatagtccacatgaaga

SEQ ID NO: 1017673 - DNA, 22 bp, Artificial Sequence
  chemically synthesized
ctatatagtccacatgaagagg

SEQ ID NO: 1017674 - DNA, 22 bp, Artificial Sequence
  chemically synthesized
tatagtccacatgaagaggata

SEQ ID NO: 1017675 - DNA, 22 bp, Artificial Sequence
  chemically synthesized
ggatgtctaacaccatatcctc

SEQ ID NO: 1017676 - DNA, 22 bp, Artificial Sequence
  chemically synthesized
gaagctaggatgtctaacacca

SEQ ID NO: 1017677 - DNA, 22 bp, Artificial Sequence
  chemically synthesized
ggaagctaggatgtctaacacc

SEQ ID NO: 1017678 - DNA, 22 bp, Artificial Sequence
  chemically synthesized
agacttggaagctaggatgtct

SEQ ID NO: 1017679 - DNA, 22 bp, Artificial Sequence
  chemically synthesized
gacatcctagcttccaagtctt

SEQ ID NO: 1017680 - DNA, 22 bp, Artificial Sequence
  chemically synthesized
gccaacaaatgaaagctaagac

SEQ ID NO: 1017681 - DNA, 22 bp, Artificial Sequence
  chemically synthesized
tagccaacaaatgaaagctaag

SEQ ID NO: 1017682 - DNA, 22 bp, Artificial Sequence
  chemically synthesized
gcttccaagtcttagctttcat

SEQ ID NO: 1017683 - DNA, 22 bp, Artificial Sequence
  chemically synthesized
ccaagtcttagctttcatttgt

SEQ ID NO: 1017684 - DNA, 22 bp, Artificial Sequence
  chemically synthesized
caagtcttagctttcatttgtt

SEQ ID NO: 1017685 - DNA, 22 bp, Artificial Sequence
  chemically synthesized
aaatatcccctctagccaacaa

SEQ ID NO: 1017686 - DNA, 22 bp, Artificial Sequence
  chemically synthesized
caaatatcccctctagccaaca

SEQ ID NO: 1017687 - DNA, 22 bp, Artificial Sequence
  chemically synthesized
agctttcatttgttggctagag

SEQ ID NO: 1017688 - DNA, 22 bp, Artificial Sequence
  chemically synthesized
gctttcatttgttggctagagg

SEQ ID NO: 1017689 - DNA, 22 bp, Artificial Sequence
  chemically synthesized
tttcaaatatcccctctagcca

SEQ ID NO: 1017690 - DNA, 22 bp, Artificial Sequence
  chemically synthesized
tcatttgttggctagaggggat

SEQ ID NO: 1017691 - DNA, 22 bp, Artificial Sequence
  chemically synthesized
catttgttggctagaggggata

SEQ ID NO: 1017692 - DNA, 22 bp, Artificial Sequence
  chemically synthesized
atttgttggctagaggggatat

SEQ ID NO: 1017693 - DNA, 22 bp, Artificial Sequence
  chemically synthesized
gttggctagaggggatatttga

SEQ ID NO: 1017694 - DNA, 22 bp, Artificial Sequence
  chemically synthesized
ttggctagaggggatatttgaa

SEQ ID NO: 1017695 - DNA, 22 bp, Artificial Sequence
  chemically synthesized
gctagaggggatatttgaaata

SEQ ID NO: 1017696 - DNA, 22 bp, Artificial Sequence
  chemically synthesized
gaggggatatttgaaataatga

SEQ ID NO: 1017697 - DNA, 22 bp, Artificial Sequence
  chemically synthesized
aatgaagagaaaggcatcatta

SEQ ID NO: 1017698 - DNA, 22 bp, Artificial Sequence
  chemically synthesized
gaatgaagagaaaggcatcatt

SEQ ID NO: 1017699 - DNA, 22 bp, Artificial Sequence
  chemically synthesized
tgtttgaatgaagagaaaggca

SEQ ID NO: 1017700 - DNA, 22 bp, Artificial Sequence
  chemically synthesized
gtgtttgaatgaagagaaaggc

SEQ ID NO: 1017701 - DNA, 22 bp, Artificial Sequence
  chemically synthesized
gaaataatgatgcctttctctt

SEQ ID NO: 1017702 - DNA, 22 bp, Artificial Sequence
  chemically synthesized
tgtgtttgaatgaagagaaagg

SEQ ID NO: 1017703 - DNA, 22 bp, Artificial Sequence
  chemically synthesized
aaataatgatgcctttctcttc

SEQ ID NO: 1017704 - DNA, 22 bp, Artificial Sequence
  chemically synthesized
tatatgttttgtgtttgaatga

SEQ ID NO: 1017705 - DNA, 22 bp, Artificial Sequence
  chemically synthesized
ttatatatgttttgtgtttgaa

SEQ ID NO: 1017706 - DNA, 22 bp, Artificial Sequence
  chemically synthesized
tctcttcattcaaacacaaaac

SEQ ID NO: 1017707 - DNA, 22 bp, Artificial Sequence
  chemically synthesized
ctcttcattcaaacacaaaaca

SEQ ID NO: 1017708 - DNA, 22 bp, Artificial Sequence
  chemically synthesized
tcttcattcaaacacaaaacat

SEQ ID NO: 1017709 - DNA, 22 bp, Artificial Sequence
  chemically synthesized
cacctattatatatgttttgtg

SEQ ID NO: 1017710 - DNA, 22 bp, Artificial Sequence
  chemically synthesized
ttcattcaaacacaaaacatat

SEQ ID NO: 1017711 - DNA, 22 bp, Artificial Sequence
  chemically synthesized
ctacacctattatatatgtttt

SEQ ID NO: 1017712 - DNA, 22 bp, Artificial Sequence
  chemically synthesized
cattcaaacacaaaacatatat

SEQ ID NO: 1017713 - DNA, 22 bp, Artificial Sequence
  chemically synthesized
attcaaacacaaaacatatata

SEQ ID NO: 1017714 - DNA, 22 bp, Artificial Sequence
  chemically synthesized
aaacacaaaacatatataatag

SEQ ID NO: 1017715 - DNA, 22 bp, Artificial Sequence
  chemically synthesized
ggtaaaagttcctacacctatt

SEQ ID NO: 1017716 - DNA, 22 bp, Artificial Sequence
  chemically synthesized
tgggtaaaagttcctacaccta

SEQ ID NO: 1017717 - DNA, 22 bp, Artificial Sequence
  chemically synthesized
ctgggtaaaagttcctacacct

SEQ ID NO: 1017718 - DNA, 22 bp, Artificial Sequence
  chemically synthesized
tttctgggtaaaagttcctaca

SEQ ID NO: 1017719 - DNA, 22 bp, Artificial Sequence
  chemically synthesized
ctatttctgggtaaaagttcct

SEQ ID NO: 1017720 - DNA, 22 bp, Artificial Sequence
  chemically synthesized
ctcctatttctgggtaaaagtt

SEQ ID NO: 1017721 - DNA, 22 bp, Artificial Sequence
  chemically synthesized
gctcctatttctgggtaaaagt

SEQ ID NO: 1017722 - DNA, 22 bp, Artificial Sequence
  chemically synthesized
tgctcctatttctgggtaaaag

SEQ ID NO: 1017723 - DNA, 22 bp, Artificial Sequence
  chemically synthesized
ttgctcctatttctgggtaaaa

SEQ ID NO: 1017724 - DNA, 22 bp, Artificial Sequence
  chemically synthesized
cttttgctcctatttctgggta

SEQ ID NO: 1017725 - DNA, 22 bp, Artificial Sequence
  chemically synthesized
tggttgcttttgctcctatttc

SEQ ID NO: 1017726 - DNA, 22 bp, Artificial Sequence
  chemically synthesized
gtggttgcttttgctcctattt

SEQ ID NO: 1017727 - DNA, 22 bp, Artificial Sequence
  chemically synthesized
ttacccagaaataggagcaaaa

SEQ ID NO: 1017728 - DNA, 22 bp, Artificial Sequence
  chemically synthesized
tacccagaaataggagcaaaag

SEQ ID NO: 1017729 - DNA, 22 bp, Artificial Sequence
  chemically synthesized
acccagaaataggagcaaaagc

SEQ ID NO: 1017730 - DNA, 22 bp, Artificial Sequence
  chemically synthesized
cccagaaataggagcaaaagca

SEQ ID NO: 1017731 - DNA, 22 bp, Artificial Sequence
  chemically synthesized
gagtgcatagcatatatttgtg

SEQ ID NO: 1017732 - DNA, 22 bp, Artificial Sequence
  chemically synthesized
attagagtgcatagcatatatt

SEQ ID NO: 1017733 - DNA, 22 bp, Artificial Sequence
  chemically synthesized
aattagagtgcatagcatatat

SEQ ID NO: 1017734 - DNA, 22 bp, Artificial Sequence
  chemically synthesized
taattagagtgcatagcatata

SEQ ID NO: 1017735 - DNA, 22 bp, Artificial Sequence
  chemically synthesized
aagttttaattagagtgcatag

SEQ ID NO: 1017736 - DNA, 22 bp, Artificial Sequence
  chemically synthesized
atctgaagttttaattagagtg

SEQ ID NO: 1017737 - DNA, 22 bp, Artificial Sequence
  chemically synthesized
aatctgaagttttaattagagt

SEQ ID NO: 1017738 - DNA, 22 bp, Artificial Sequence
  chemically synthesized
tgcactctaattaaaacttcag

SEQ ID NO: 1017739 - DNA, 22 bp, Artificial Sequence
  chemically synthesized
atcatgtacttaatctgaagtt

SEQ ID NO: 1017740 - DNA, 22 bp, Artificial Sequence
  chemically synthesized
aatcatgtacttaatctgaagt

SEQ ID NO: 1017741 - DNA, 22 bp, Artificial Sequence
  chemically synthesized
taattaaaacttcagattaagt

SEQ ID NO: 1017742 - DNA, 22 bp, Artificial Sequence
  chemically synthesized
attaaaacttcagattaagtac

SEQ ID NO: 1017743 - DNA, 22 bp, Artificial Sequence
  chemically synthesized
aaacttcagattaagtacatga

SEQ ID NO: 1017744 - DNA, 22 bp, Artificial Sequence
  chemically synthesized
tggagtatatttaatcatgtac

SEQ ID NO: 1017745 - DNA, 22 bp, Artificial Sequence
  chemically synthesized
cagattaagtacatgattaaat

SEQ ID NO: 1017746 - DNA, 22 bp, Artificial Sequence
  chemically synthesized
agattaagtacatgattaaata

SEQ ID NO: 1017747 - DNA, 22 bp, Artificial Sequence
  chemically synthesized
agtacatgattaaatatactcc

SEQ ID NO: 1017748 - DNA, 22 bp, Artificial Sequence
  chemically synthesized
ccccaaggtgctgtggagtata

SEQ ID NO: 1017749 - DNA, 22 bp, Artificial Sequence
  chemically synthesized
aatatactccacagcaccttgg

SEQ ID NO: 1017750 - DNA, 22 bp, Artificial Sequence
  chemically synthesized
cacagcaccttggggtaggtac

SEQ ID NO: 1017751 - DNA, 22 bp, Artificial Sequence
  chemically synthesized
caaaatgaataaaatgatagta

SEQ ID NO: 1017752 - DNA, 22 bp, Artificial Sequence
  chemically synthesized
gcaaaatgaataaaatgatagt

SEQ ID NO: 1017753 - DNA, 22 bp, Artificial Sequence
  chemically synthesized
ggggtaggtactatcattttat

SEQ ID NO: 1017754 - DNA, 22 bp, Artificial Sequence
  chemically synthesized
gggtaggtactatcattttatt

SEQ ID NO: 1017755 - DNA, 22 bp, Artificial Sequence
  chemically synthesized
atttgcaaaatgaataaaatga

SEQ ID NO: 1017756 - DNA, 22 bp, Artificial Sequence
  chemically synthesized
tcatttgcaaaatgaataaaat

SEQ ID NO: 1017757 - DNA, 22 bp, Artificial Sequence
  chemically synthesized
ctcatttgcaaaatgaataaaa

SEQ ID NO: 1017758 - DNA, 22 bp, Artificial Sequence
  chemically synthesized
tctcatttgcaaaatgaataaa

SEQ ID NO: 1017759 - DNA, 22 bp, Artificial Sequence
  chemically synthesized
agttttctcatttgcaaaatga

SEQ ID NO: 1017760 - DNA, 22 bp, Artificial Sequence
  chemically synthesized
tcattttattcattttgcaaat

SEQ ID NO: 1017761 - DNA, 22 bp, Artificial Sequence
  chemically synthesized
tattcattttgcaaatgagaaa

SEQ ID NO: 1017762 - DNA, 22 bp, Artificial Sequence
  chemically synthesized
attcattttgcaaatgagaaaa

SEQ ID NO: 1017763 - DNA, 22 bp, Artificial Sequence
  chemically synthesized
ccaaagtctcagttttctcatt

SEQ ID NO: 1017764 - DNA, 22 bp, Artificial Sequence
  chemically synthesized
ttcattttgcaaatgagaaaac

SEQ ID NO: 1017765 - DNA, 22 bp, Artificial Sequence
  chemically synthesized
attttgcaaatgagaaaactga

SEQ ID NO: 1017766 - DNA, 22 bp, Artificial Sequence
  chemically synthesized
gactcccaaagtctcagttttc

SEQ ID NO: 1017767 - DNA, 22 bp, Artificial Sequence
  chemically synthesized
tgcaaatgagaaaactgagact

SEQ ID NO: 1017768 - DNA, 22 bp, Artificial Sequence
  chemically synthesized
gcaaatgagaaaactgagactt

SEQ ID NO: 1017769 - DNA, 22 bp, Artificial Sequence
  chemically synthesized
caaatgagaaaactgagacttt

SEQ ID NO: 1017770 - DNA, 22 bp, Artificial Sequence
  chemically synthesized
gaaacatacaagttagactccc

SEQ ID NO: 1017771 - DNA, 22 bp, Artificial Sequence
  chemically synthesized
attagaaacatacaagttagac

SEQ ID NO: 1017772 - DNA, 22 bp, Artificial Sequence
  chemically synthesized
agactttgggagtctaacttgt

SEQ ID NO: 1017773 - DNA, 22 bp, Artificial Sequence
  chemically synthesized
ctgattagaaacatacaagtta

SEQ ID NO: 1017774 - DNA, 22 bp, Artificial Sequence
  chemically synthesized
tgggagtctaacttgtatgttt

SEQ ID NO: 1017775 - DNA, 22 bp, Artificial Sequence
  chemically synthesized
gggagtctaacttgtatgtttc

SEQ ID NO: 1017776 - DNA, 22 bp, Artificial Sequence
  chemically synthesized
cattcctgattagaaacataca

SEQ ID NO: 1017777 - DNA, 22 bp, Artificial Sequence
  chemically synthesized
ggagtctaacttgtatgtttct

SEQ ID NO: 1017778 - DNA, 22 bp, Artificial Sequence
  chemically synthesized
gcattcctgattagaaacatac

SEQ ID NO: 1017779 - DNA, 22 bp, Artificial Sequence
  chemically synthesized
tcttgcattcctgattagaaac

SEQ ID NO: 1017780 - DNA, 22 bp, Artificial Sequence
  chemically synthesized
ttgtcttgcattcctgattaga

SEQ ID NO: 1017781 - DNA, 22 bp, Artificial Sequence
  chemically synthesized
acttgtatgtttctaatcagga

SEQ ID NO: 1017782 - DNA, 22 bp, Artificial Sequence
  chemically synthesized
gtatgtttctaatcaggaatgc

SEQ ID NO: 1017783 - DNA, 22 bp, Artificial Sequence
  chemically synthesized
tgttattgtcttgcattcctga

SEQ ID NO: 1017784 - DNA, 22 bp, Artificial Sequence
  chemically synthesized
tatgtttctaatcaggaatgca

SEQ ID NO: 1017785 - DNA, 22 bp, Artificial Sequence
  chemically synthesized
agctatgttattgtcttgcatt

SEQ ID NO: 1017786 - DNA, 22 bp, Artificial Sequence
  chemically synthesized
ctaatcaggaatgcaagacaat

SEQ ID NO: 1017787 - DNA, 22 bp, Artificial Sequence
  chemically synthesized
ttcagctatgttattgtcttgc

SEQ ID NO: 1017788 - DNA, 22 bp, Artificial Sequence
  chemically synthesized
taatcaggaatgcaagacaata

SEQ ID NO: 1017789 - DNA, 22 bp, Artificial Sequence
  chemically synthesized
attcagctatgttattgtcttg

SEQ ID NO: 1017790 - DNA, 22 bp, Artificial Sequence
  chemically synthesized
atcaggaatgcaagacaataac

SEQ ID NO: 1017791 - DNA, 22 bp, Artificial Sequence
  chemically synthesized
tccttattcagctatgttattg

SEQ ID NO: 1017792 - DNA, 22 bp, Artificial Sequence
  chemically synthesized
taagctatccttattcagctat

SEQ ID NO: 1017793 - DNA, 22 bp, Artificial Sequence
  chemically synthesized
aataaggatagcttatagtgta

SEQ ID NO: 1017794 - DNA, 22 bp, Artificial Sequence
  chemically synthesized
aaaaaaacaagaaacaaaaaac

SEQ ID NO: 1017795 - DNA, 22 bp, Artificial Sequence
  chemically synthesized
aaaaaaaacaagaaacaaaaaa

SEQ ID NO: 1017796 - DNA, 22 bp, Artificial Sequence
  chemically synthesized
atagtgtatgttttttgtttct

SEQ ID NO: 1017797 - DNA, 22 bp, Artificial Sequence
  chemically synthesized
tagtgtatgttttttgtttctt

SEQ ID NO: 1017798 - DNA, 22 bp, Artificial Sequence
  chemically synthesized
aaatgacacttaaaaaaaacaa

SEQ ID NO: 1017799 - DNA, 22 bp, Artificial Sequence
  chemically synthesized
tttgtttcttgttttttttaag

SEQ ID NO: 1017800 - DNA, 22 bp, Artificial Sequence
  chemically synthesized
attcaaatgacacttaaaaaaa

SEQ ID NO: 1017801 - DNA, 22 bp, Artificial Sequence
  chemically synthesized
ttgtttcttgttttttttaagt

SEQ ID NO: 1017802 - DNA, 22 bp, Artificial Sequence
  chemically synthesized
tgtttcttgttttttttaagtg

SEQ ID NO: 1017803 - DNA, 22 bp, Artificial Sequence
  chemically synthesized
gtttcttgttttttttaagtgt

SEQ ID NO: 1017804 - DNA, 22 bp, Artificial Sequence
  chemically synthesized
ctgattcaaatgacacttaaaa

SEQ ID NO: 1017805 - DNA, 22 bp, Artificial Sequence
  chemically synthesized
tttcttgttttttttaagtgtc

SEQ ID NO: 1017806 - DNA, 22 bp, Artificial Sequence
  chemically synthesized
actgattcaaatgacacttaaa

SEQ ID NO: 1017807 - DNA, 22 bp, Artificial Sequence
  chemically synthesized
cttgttttttttaagtgtcatt

SEQ ID NO: 1017808 - DNA, 22 bp, Artificial Sequence
  chemically synthesized
ttgttttttttaagtgtcattt

SEQ ID NO: 1017809 - DNA, 22 bp, Artificial Sequence
  chemically synthesized
gttttttttaagtgtcatttga

SEQ ID NO: 1017810 - DNA, 22 bp, Artificial Sequence
  chemically synthesized
ttttttttaagtgtcatttgaa

SEQ ID NO: 1017811 - DNA, 22 bp, Artificial Sequence
  chemically synthesized
tttttaagtgtcatttgaatca

SEQ ID NO: 1017812 - DNA, 22 bp, Artificial Sequence
  chemically synthesized
ttttaagtgtcatttgaatcag

SEQ ID NO: 1017813 - DNA, 22 bp, Artificial Sequence
  chemically synthesized
atacagtgtttactgattcaaa

SEQ ID NO: 1017814 - DNA, 22 bp, Artificial Sequence
  chemically synthesized
tttaagtgtcatttgaatcagt

SEQ ID NO: 1017815 - DNA, 22 bp, Artificial Sequence
  chemically synthesized
ttaagtgtcatttgaatcagta

SEQ ID NO: 1017816 - DNA, 22 bp, Artificial Sequence
  chemically synthesized
taagtgtcatttgaatcagtaa

SEQ ID NO: 1017817 - DNA, 22 bp, Artificial Sequence
  chemically synthesized
aagtgtcatttgaatcagtaaa

SEQ ID NO: 1017818 - DNA, 22 bp, Artificial Sequence
  chemically synthesized
agtgtcatttgaatcagtaaac

SEQ ID NO: 1017819 - DNA, 22 bp, Artificial Sequence
  chemically synthesized
acaagctaatacagtgtttact

SEQ ID NO: 1017820 - DNA, 22 bp, Artificial Sequence
  chemically synthesized
cacaagctaatacagtgtttac

SEQ ID NO: 1017821 - DNA, 22 bp, Artificial Sequence
  chemically synthesized
tcacaagctaatacagtgttta

SEQ ID NO: 1017822 - DNA, 22 bp, Artificial Sequence
  chemically synthesized
tttcacaagctaatacagtgtt

SEQ ID NO: 1017823 - DNA, 22 bp, Artificial Sequence
  chemically synthesized
tctttcacaagctaatacagtg

SEQ ID NO: 1017824 - DNA, 22 bp, Artificial Sequence
  chemically synthesized
gaatcagtaaacactgtattag

SEQ ID NO: 1017825 - DNA, 22 bp, Artificial Sequence
  chemically synthesized
ctctttcacaagctaatacagt

SEQ ID NO: 1017826 - DNA, 22 bp, Artificial Sequence
  chemically synthesized
aatcagtaaacactgtattagc

SEQ ID NO: 1017827 - DNA, 22 bp, Artificial Sequence
  chemically synthesized
tctctttcacaagctaatacag

SEQ ID NO: 1017828 - DNA, 22 bp, Artificial Sequence
  chemically synthesized
ttctctttcacaagctaataca

SEQ ID NO: 1017829 - DNA, 22 bp, Artificial Sequence
  chemically synthesized
tttctctttcacaagctaatac

SEQ ID NO: 1017830 - DNA, 22 bp, Artificial Sequence
  chemically synthesized
tattagcttgtgaaagagaaaa

SEQ ID NO: 1017831 - DNA, 22 bp, Artificial Sequence
  chemically synthesized
taggagaagtaggattttttct

SEQ ID NO: 1017832 - DNA, 22 bp, Artificial Sequence
  chemically synthesized
gcttgtgaaagagaaaaaatcc

SEQ ID NO: 1017833 - DNA, 22 bp, Artificial Sequence
  chemically synthesized
gtgaaagagaaaaaatcctact

SEQ ID NO: 1017834 - DNA, 22 bp, Artificial Sequence
  chemically synthesized
tgaaagagaaaaaatcctactt

SEQ ID NO: 1017835 - DNA, 22 bp, Artificial Sequence
  chemically synthesized
caagaggatagtatattatagg

SEQ ID NO: 1017836 - DNA, 22 bp, Artificial Sequence
  chemically synthesized
ccaagaggatagtatattatag

SEQ ID NO: 1017837 - DNA, 22 bp, Artificial Sequence
  chemically synthesized
tttccaagaggatagtatatta

SEQ ID NO: 1017838 - DNA, 22 bp, Artificial Sequence
  chemically synthesized
atttccaagaggatagtatatt

SEQ ID NO: 1017839 - DNA, 22 bp, Artificial Sequence
  chemically synthesized
cttctcctataatatactatcc

SEQ ID NO: 1017840 - DNA, 22 bp, Artificial Sequence
  chemically synthesized
ctcctataatatactatcctct

SEQ ID NO: 1017841 - DNA, 22 bp, Artificial Sequence
  chemically synthesized
tcctataatatactatcctctt

SEQ ID NO: 1017842 - DNA, 22 bp, Artificial Sequence
  chemically synthesized
ctataatatactatcctcttgg

SEQ ID NO: 1017843 - DNA, 22 bp, Artificial Sequence
  chemically synthesized
taatatactatcctcttggaaa

SEQ ID NO: 1017844 - DNA, 22 bp, Artificial Sequence
  chemically synthesized
tccaataacaacatgatttatt

SEQ ID NO: 1017845 - DNA, 22 bp, Artificial Sequence
  chemically synthesized
tcctcttggaaataaatcatgt

SEQ ID NO: 1017846 - DNA, 22 bp, Artificial Sequence
  chemically synthesized
ttggaaataaatcatgttgtta

SEQ ID NO: 1017847 - DNA, 22 bp, Artificial Sequence
  chemically synthesized
ggaaataaatcatgttgttatt

SEQ ID NO: 1017848 - DNA, 22 bp, Artificial Sequence
  chemically synthesized
gaaataaatcatgttgttattg

SEQ ID NO: 1017849 - DNA, 22 bp, Artificial Sequence
  chemically synthesized
ttattggatagttacactcacg

SEQ ID NO: 1017850 - DNA, 22 bp, Artificial Sequence
  chemically synthesized
atgatcagaaacacgtgagtgt

SEQ ID NO: 1017851 - DNA, 22 bp, Artificial Sequence
  chemically synthesized
catgatcagaaacacgtgagtg

SEQ ID NO: 1017852 - DNA, 22 bp, Artificial Sequence
  chemically synthesized
ttggatagttacactcacgtgt

SEQ ID NO: 1017853 - DNA, 22 bp, Artificial Sequence
  chemically synthesized
gatagttacactcacgtgtttc

SEQ ID NO: 1017854 - DNA, 22 bp, Artificial Sequence
  chemically synthesized
cactcacgtgtttctgatcatg

SEQ ID NO: 1017855 - DNA, 22 bp, Artificial Sequence
  chemically synthesized
aaatataaatttcatgatcaga

SEQ ID NO: 1017856 - DNA, 22 bp, Artificial Sequence
  chemically synthesized
gaaatataaatttcatgatcag

SEQ ID NO: 1017857 - DNA, 22 bp, Artificial Sequence
  chemically synthesized
tgaaatataaatttcatgatca

SEQ ID NO: 1017858 - DNA, 22 bp, Artificial Sequence
  chemically synthesized
acgtgtttctgatcatgaaatt

SEQ ID NO: 1017859 - DNA, 22 bp, Artificial Sequence
  chemically synthesized
ctttgaaatataaatttcatga

SEQ ID NO: 1017860 - DNA, 22 bp, Artificial Sequence
  chemically synthesized
ctgatcatgaaatttatatttc

SEQ ID NO: 1017861 - DNA, 22 bp, Artificial Sequence
  chemically synthesized
atccattcctttgaaatataaa

SEQ ID NO: 1017862 - DNA, 22 bp, Artificial Sequence
  chemically synthesized
tgatcatgaaatttatatttca

SEQ ID NO: 1017863 - DNA, 22 bp, Artificial Sequence
  chemically synthesized
atcatgaaatttatatttcaaa

SEQ ID NO: 1017864 - DNA, 22 bp, Artificial Sequence
  chemically synthesized
ttaatccattcctttgaaatat

SEQ ID NO: 1017865 - DNA, 22 bp, Artificial Sequence
  chemically synthesized
attaatccattcctttgaaata

SEQ ID NO: 1017866 - DNA, 22 bp, Artificial Sequence
  chemically synthesized
tttattaatccattcctttgaa

SEQ ID NO: 1017867 - DNA, 22 bp, Artificial Sequence
  chemically synthesized
ggttatttattaatccattcct

SEQ ID NO: 1017868 - DNA, 22 bp, Artificial Sequence
  chemically synthesized
atatttcaaaggaatggattaa

SEQ ID NO: 1017869 - DNA, 22 bp, Artificial Sequence
  chemically synthesized
tatttcaaaggaatggattaat

SEQ ID NO: 1017870 - DNA, 22 bp, Artificial Sequence
  chemically synthesized
caaaggaatggattaataaata

SEQ ID NO: 1017871 - DNA, 22 bp, Artificial Sequence
  chemically synthesized
aaaggaatggattaataaataa

SEQ ID NO: 1017872 - DNA, 22 bp, Artificial Sequence
  chemically synthesized
gaaaggaggttaggttatttat

SEQ ID NO: 1017873 - DNA, 22 bp, Artificial Sequence
  chemically synthesized
agaaaggaggttaggttattta

SEQ ID NO: 1017874 - DNA, 22 bp, Artificial Sequence
  chemically synthesized
cttagaaaggaggttaggttat

SEQ ID NO: 1017875 - DNA, 22 bp, Artificial Sequence
  chemically synthesized
ataaataacctaacctcctttc

SEQ ID NO: 1017876 - DNA, 22 bp, Artificial Sequence
  chemically synthesized
agcaaatgctgcttagaaagga

SEQ ID NO: 1017877 - DNA, 22 bp, Artificial Sequence
  chemically synthesized
gagcaaatgctgcttagaaagg

SEQ ID NO: 1017878 - DNA, 22 bp, Artificial Sequence
  chemically synthesized
tgagcaaatgctgcttagaaag

SEQ ID NO: 1017879 - DNA, 22 bp, Artificial Sequence
  chemically synthesized
ttttgagcaaatgctgcttaga

SEQ ID NO: 1017880 - DNA, 22 bp, Artificial Sequence
  chemically synthesized
acctcctttctaagcagcattt

SEQ ID NO: 1017881 - DNA, 22 bp, Artificial Sequence
  chemically synthesized
ctttctaagcagcatttgctca

SEQ ID NO: 1017882 - DNA, 22 bp, Artificial Sequence
  chemically synthesized
gaaatatgttattttgagcaaa

SEQ ID NO: 1017883 - DNA, 22 bp, Artificial Sequence
  chemically synthesized
tctaagcagcatttgctcaaaa

SEQ ID NO: 1017884 - DNA, 22 bp, Artificial Sequence
  chemically synthesized
ctaagcagcatttgctcaaaat

SEQ ID NO: 1017885 - DNA, 22 bp, Artificial Sequence
  chemically synthesized
taagcagcatttgctcaaaata

SEQ ID NO: 1017886 - DNA, 22 bp, Artificial Sequence
  chemically synthesized
agcagcatttgctcaaaataac

SEQ ID NO: 1017887 - DNA, 22 bp, Artificial Sequence
  chemically synthesized
gctcaaaataacatatttctag

SEQ ID NO: 1017888 - DNA, 22 bp, Artificial Sequence
  chemically synthesized
ctcaaaataacatatttctaga

SEQ ID NO: 1017889 - DNA, 22 bp, Artificial Sequence
  chemically synthesized
aaaataacatatttctagacac

SEQ ID NO: 1017890 - DNA, 22 bp, Artificial Sequence
  chemically synthesized
tcatgatatataatgagaagtg

SEQ ID NO: 1017891 - DNA, 22 bp, Artificial Sequence
  chemically synthesized
gtcatgatatataatgagaagt

SEQ ID NO: 1017892 - DNA, 22 bp, Artificial Sequence
  chemically synthesized
ctagacacttctcattatatat

SEQ ID NO: 1017893 - DNA, 22 bp, Artificial Sequence
  chemically synthesized
tagacacttctcattatatatc

SEQ ID NO: 1017894 - DNA, 22 bp, Artificial Sequence
  chemically synthesized
gacacttctcattatatatcat

SEQ ID NO: 1017895 - DNA, 22 bp, Artificial Sequence
  chemically synthesized
ctcattatatatcatgacaagt

SEQ ID NO: 1017896 - DNA, 22 bp, Artificial Sequence
  chemically synthesized
agagtatgaggtacttgtcatg

SEQ ID NO: 1017897 - DNA, 22 bp, Artificial Sequence
  chemically synthesized
tcattatatatcatgacaagta

SEQ ID NO: 1017898 - DNA, 22 bp, Artificial Sequence
  chemically synthesized
gagagtatgaggtacttgtcat

SEQ ID NO: 1017899 - DNA, 22 bp, Artificial Sequence
  chemically synthesized
attatatatcatgacaagtacc

SEQ ID NO: 1017900 - DNA, 22 bp, Artificial Sequence
  chemically synthesized
atttgagagtatgaggtacttg

SEQ ID NO: 1017901 - DNA, 22 bp, Artificial Sequence
  chemically synthesized
gatttgagagtatgaggtactt

SEQ ID NO: 1017902 - DNA, 22 bp, Artificial Sequence
  chemically synthesized
tatatcatgacaagtacctcat

SEQ ID NO: 1017903 - DNA, 22 bp, Artificial Sequence
  chemically synthesized
tgatttgagagtatgaggtact

SEQ ID NO: 1017904 - DNA, 22 bp, Artificial Sequence
  chemically synthesized
cattttgatttgagagtatgag

SEQ ID NO: 1017905 - DNA, 22 bp, Artificial Sequence
  chemically synthesized
atactctcaaatcaaaatggaa

SEQ ID NO: 1017906 - DNA, 22 bp, Artificial Sequence
  chemically synthesized
aaaaatcaagagaaattccatt

SEQ ID NO: 1017907 - DNA, 22 bp, Artificial Sequence
  chemically synthesized
tgaaaaatcaagagaaattcca

SEQ ID NO: 1017908 - DNA, 22 bp, Artificial Sequence
  chemically synthesized
tcaaatcaaaatggaatttctc

SEQ ID NO: 1017909 - DNA, 22 bp, Artificial Sequence
  chemically synthesized
ctgaaaaatcaagagaaattcc

SEQ ID NO: 1017910 - DNA, 22 bp, Artificial Sequence
  chemically synthesized
aaatcaaaatggaatttctctt

SEQ ID NO: 1017911 - DNA, 22 bp, Artificial Sequence
  chemically synthesized
ctcttgatttttcagaaacatc

SEQ ID NO: 1017912 - DNA, 22 bp, Artificial Sequence
  chemically synthesized
tcttgatttttcagaaacatcc

SEQ ID NO: 1017913 - DNA, 22 bp, Artificial Sequence
  chemically synthesized
ttgatttttcagaaacatcctt

SEQ ID NO: 1017914 - DNA, 22 bp, Artificial Sequence
  chemically synthesized
gatttttcagaaacatccttgg

SEQ ID NO: 1017915 - DNA, 22 bp, Artificial Sequence
  chemically synthesized
atttttcagaaacatccttggt

SEQ ID NO: 1017916 - DNA, 22 bp, Artificial Sequence
  chemically synthesized
ttcagaaacatccttggtggtt

SEQ ID NO: 1017917 - DNA, 22 bp, Artificial Sequence
  chemically synthesized
tcagaaacatccttggtggttc

SEQ ID NO: 1017918 - DNA, 22 bp, Artificial Sequence
  chemically synthesized
cagaaacatccttggtggttct

SEQ ID NO: 1017919 - DNA, 22 bp, Artificial Sequence
  chemically synthesized
agaaacatccttggtggttctt

SEQ ID NO: 1017920 - DNA, 22 bp, Artificial Sequence
  chemically synthesized
ggtggttcttcatcttttggtt

SEQ ID NO: 1017921 - DNA, 22 bp, Artificial Sequence
  chemically synthesized
gtggttcttcatcttttggttt

SEQ ID NO: 1017922 - DNA, 22 bp, Artificial Sequence
  chemically synthesized
ttcatcttttggtttatttttg

SEQ ID NO: 1017923 - DNA, 22 bp, Artificial Sequence
  chemically synthesized
catcttttggtttatttttgtt

SEQ ID NO: 1017924 - DNA, 22 bp, Artificial Sequence
  chemically synthesized
atcttttggtttatttttgttt

SEQ ID NO: 1017925 - DNA, 22 bp, Artificial Sequence
  chemically synthesized
agaaaaggaataatataaacaa

SEQ ID NO: 1017926 - DNA, 22 bp, Artificial Sequence
  chemically synthesized
ttggtttatttttgtttatatt

SEQ ID NO: 1017927 - DNA, 22 bp, Artificial Sequence
  chemically synthesized
aagaaaaggaataatataaaca

SEQ ID NO: 1017928 - DNA, 22 bp, Artificial Sequence
  chemically synthesized
tggtttatttttgtttatatta

SEQ ID NO: 1017929 - DNA, 22 bp, Artificial Sequence
  chemically synthesized
taagaaaaggaataatataaac

SEQ ID NO: 1017930 - DNA, 22 bp, Artificial Sequence
  chemically synthesized
ggtttatttttgtttatattat

SEQ ID NO: 1017931 - DNA, 22 bp, Artificial Sequence
  chemically synthesized
gtttatttttgtttatattatt

SEQ ID NO: 1017932 - DNA, 22 bp, Artificial Sequence
  chemically synthesized
atttttgtttatattattcctt

SEQ ID NO: 1017933 - DNA, 22 bp, Artificial Sequence
  chemically synthesized
tttttgtttatattattccttt

SEQ ID NO: 1017934 - DNA, 22 bp, Artificial Sequence
  chemically synthesized
ttgtttatattattccttttct

SEQ ID NO: 1017935 - DNA, 22 bp, Artificial Sequence
  chemically synthesized
tgtttatattattccttttctt

SEQ ID NO: 1017936 - DNA, 22 bp, Artificial Sequence
  chemically synthesized
gtttatattattccttttctta

SEQ ID NO: 1017937 - DNA, 22 bp, Artificial Sequence
  chemically synthesized
tttatattattccttttcttaa

SEQ ID NO: 1017938 - DNA, 22 bp, Artificial Sequence
  chemically synthesized
atattattccttttcttaaagt

SEQ ID NO: 1017939 - DNA, 22 bp, Artificial Sequence
  chemically synthesized
tattattccttttcttaaagta

SEQ ID NO: 1017940 - DNA, 22 bp, Artificial Sequence
  chemically synthesized
ttccttttcttaaagtatcgtt

SEQ ID NO: 1017941 - DNA, 22 bp, Artificial Sequence
  chemically synthesized
ggacaatataagcaacgatact

SEQ ID NO: 1017942 - DNA, 22 bp, Artificial Sequence
  chemically synthesized
aggacaatataagcaacgatac

SEQ ID NO: 1017943 - DNA, 22 bp, Artificial Sequence
  chemically synthesized
cttttcttaaagtatcgttgct

SEQ ID NO: 1017944 - DNA, 22 bp, Artificial Sequence
  chemically synthesized
ttcttaaagtatcgttgcttat

SEQ ID NO: 1017945 - DNA, 22 bp, Artificial Sequence
  chemically synthesized
tcttaaagtatcgttgcttata

SEQ ID NO: 1017946 - DNA, 22 bp, Artificial Sequence
  chemically synthesized
cttaaagtatcgttgcttatat

SEQ ID NO: 1017947 - DNA, 22 bp, Artificial Sequence
  chemically synthesized
ttaaagtatcgttgcttatatt

SEQ ID NO: 1017948 - DNA, 22 bp, Artificial Sequence
  chemically synthesized
aaagtatcgttgcttatattgt

SEQ ID NO: 1017949 - DNA, 22 bp, Artificial Sequence
  chemically synthesized
aagtatcgttgcttatattgtc

SEQ ID NO: 1017950 - DNA, 22 bp, Artificial Sequence
  chemically synthesized
cttatattgtcctaaatttttc

SEQ ID NO: 1017951 - DNA, 22 bp, Artificial Sequence
  chemically synthesized
atattgtcctaaatttttctat

SEQ ID NO: 1017952 - DNA, 22 bp, Artificial Sequence
  chemically synthesized
atggaggaaggtatagaaaaat

SEQ ID NO: 1017953 - DNA, 22 bp, Artificial Sequence
  chemically synthesized
tattgtcctaaatttttctata

SEQ ID NO: 1017954 - DNA, 22 bp, Artificial Sequence
  chemically synthesized
tcatggaggaaggtatagaaaa

SEQ ID NO: 1017955 - DNA, 22 bp, Artificial Sequence
  chemically synthesized
tcctaaatttttctataccttc

SEQ ID NO: 1017956 - DNA, 22 bp, Artificial Sequence
  chemically synthesized
aatttttctataccttcctcca

SEQ ID NO: 1017957 - DNA, 22 bp, Artificial Sequence
  chemically synthesized
ttctataccttcctccatgaga

SEQ ID NO: 1017958 - DNA, 22 bp, Artificial Sequence
  chemically synthesized
tctataccttcctccatgagaa

SEQ ID NO: 1017959 - DNA, 22 bp, Artificial Sequence
  chemically synthesized
ctataccttcctccatgagaac

SEQ ID NO: 1017960 - DNA, 22 bp, Artificial Sequence
  chemically synthesized
tataccttcctccatgagaacc

SEQ ID NO: 1017961 - DNA, 22 bp, Artificial Sequence
  chemically synthesized
gtagtatcagaaaggttctcat

SEQ ID NO: 1017962 - DNA, 22 bp, Artificial Sequence
  chemically synthesized
taccttcctccatgagaacctt

SEQ ID NO: 1017963 - DNA, 22 bp, Artificial Sequence
  chemically synthesized
attggtagtatcagaaaggttc

SEQ ID NO: 1017964 - DNA, 22 bp, Artificial Sequence
  chemically synthesized
taattggtagtatcagaaaggt

SEQ ID NO: 1017965 - DNA, 22 bp, Artificial Sequence
  chemically synthesized
cctccatgagaacctttctgat

SEQ ID NO: 1017966 - DNA, 22 bp, Artificial Sequence
  chemically synthesized
ctaattggtagtatcagaaagg

SEQ ID NO: 1017967 - DNA, 22 bp, Artificial Sequence
  chemically synthesized
ctccatgagaacctttctgata

SEQ ID NO: 1017968 - DNA, 22 bp, Artificial Sequence
  chemically synthesized
cttctaattggtagtatcagaa

SEQ ID NO: 1017969 - DNA, 22 bp, Artificial Sequence
  chemically synthesized
catgagaacctttctgatacta

SEQ ID NO: 1017970 - DNA, 22 bp, Artificial Sequence
  chemically synthesized
tctgatactaccaattagaagt

SEQ ID NO: 1017971 - DNA, 22 bp, Artificial Sequence
  chemically synthesized
ctgatactaccaattagaagta

SEQ ID NO: 1017972 - DNA, 22 bp, Artificial Sequence
  chemically synthesized
tgatactaccaattagaagtaa

SEQ ID NO: 1017973 - DNA, 22 bp, Artificial Sequence
  chemically synthesized
aagaggggagggattacttcta

SEQ ID NO: 1017974 - DNA, 22 bp, Artificial Sequence
  chemically synthesized
atactaccaattagaagtaatc

SEQ ID NO: 1017975 - DNA, 22 bp, Artificial Sequence
  chemically synthesized
ttaaagaggggagggattactt

SEQ ID NO: 1017976 - DNA, 22 bp, Artificial Sequence
  chemically synthesized
ccaattagaagtaatccctccc

SEQ ID NO: 1017977 - DNA, 22 bp, Artificial Sequence
  chemically synthesized
gaagtaatccctcccctcttta

SEQ ID NO: 1017978 - DNA, 22 bp, Artificial Sequence
  chemically synthesized
ataaaaagagtgttattaaaga

SEQ ID NO: 1017979 - DNA, 22 bp, Artificial Sequence
  chemically synthesized
ccctctttaataacactctttt

SEQ ID NO: 1017980 - DNA, 22 bp, Artificial Sequence
  chemically synthesized
tttaataacactctttttatta

SEQ ID NO: 1017981 - DNA, 22 bp, Artificial Sequence
  chemically synthesized
taataacactctttttattagg

SEQ ID NO: 1017982 - DNA, 22 bp, Artificial Sequence
  chemically synthesized
aataacactctttttattaggg

SEQ ID NO: 1017983 - DNA, 22 bp, Artificial Sequence
  chemically synthesized
ataacactctttttattagggt

SEQ ID NO: 1017984 - DNA, 22 bp, Artificial Sequence
  chemically synthesized
tttttattagggtgattatttt

SEQ ID NO: 1017985 - DNA, 22 bp, Artificial Sequence
  chemically synthesized
tttattagggtgattatttttc

SEQ ID NO: 1017986 - DNA, 22 bp, Artificial Sequence
  chemically synthesized
ttattagggtgattatttttct

SEQ ID NO: 1017987 - DNA, 22 bp, Artificial Sequence
  chemically synthesized
tattagggtgattatttttctt

SEQ ID NO: 1017988 - DNA, 22 bp, Artificial Sequence
  chemically synthesized
caaaaaagaatcaagaaaaata

SEQ ID NO: 1017989 - DNA, 22 bp, Artificial Sequence
  chemically synthesized
attagggtgattatttttcttg

SEQ ID NO: 1017990 - DNA, 22 bp, Artificial Sequence
  chemically synthesized
ttagggtgattatttttcttga

SEQ ID NO: 1017991 - DNA, 22 bp, Artificial Sequence
  chemically synthesized
gggtgattatttttcttgattc

SEQ ID NO: 1017992 - DNA, 22 bp, Artificial Sequence
  chemically synthesized
aggtggttacaaaaaagaatca

SEQ ID NO: 1017993 - DNA, 22 bp, Artificial Sequence
  chemically synthesized
attaaggtggttacaaaaaaga

SEQ ID NO: 1017994 - DNA, 22 bp, Artificial Sequence
  chemically synthesized
tttttcttgattcttttttgta

SEQ ID NO: 1017995 - DNA, 22 bp, Artificial Sequence
  chemically synthesized
cattaaggtggttacaaaaaag

SEQ ID NO: 1017996 - DNA, 22 bp, Artificial Sequence
  chemically synthesized
ttcttgattcttttttgtaacc

SEQ ID NO: 1017997 - DNA, 22 bp, Artificial Sequence
  chemically synthesized
tcttgattcttttttgtaacca

SEQ ID NO: 1017998 - DNA, 22 bp, Artificial Sequence
  chemically synthesized
cttgattcttttttgtaaccac

SEQ ID NO: 1017999 - DNA, 22 bp, Artificial Sequence
  chemically synthesized
ttgattcttttttgtaaccacc

SEQ ID NO: 1018000 - DNA, 22 bp, Artificial Sequence
  chemically synthesized
gattcttttttgtaaccacctt

SEQ ID NO: 1018001 - DNA, 22 bp, Artificial Sequence
  chemically synthesized
attcttttttgtaaccacctta

SEQ ID NO: 1018002 - DNA, 22 bp, Artificial Sequence
  chemically synthesized
ttttttgtaaccaccttaatga

SEQ ID NO: 1018003 - DNA, 22 bp, Artificial Sequence
  chemically synthesized
ttttgtaaccaccttaatgaag

SEQ ID NO: 1018004 - DNA, 22 bp, Artificial Sequence
  chemically synthesized
tttgtaaccaccttaatgaagt

SEQ ID NO: 1018005 - DNA, 22 bp, Artificial Sequence
  chemically synthesized
tatgtcaatcatacttcattaa

SEQ ID NO: 1018006 - DNA, 22 bp, Artificial Sequence
  chemically synthesized
ttgtaaccaccttaatgaagta

SEQ ID NO: 1018007 - DNA, 22 bp, Artificial Sequence
  chemically synthesized
gtatgtcaatcatacttcatta

SEQ ID NO: 1018008 - DNA, 22 bp, Artificial Sequence
  chemically synthesized
tgtaaccaccttaatgaagtat

SEQ ID NO: 1018009 - DNA, 22 bp, Artificial Sequence
  chemically synthesized
tgtatgtcaatcatacttcatt

SEQ ID NO: 1018010 - DNA, 22 bp, Artificial Sequence
  chemically synthesized
gtaaccaccttaatgaagtatg

SEQ ID NO: 1018011 - DNA, 22 bp, Artificial Sequence
  chemically synthesized
ttgtatgtcaatcatacttcat

SEQ ID NO: 1018012 - DNA, 22 bp, Artificial Sequence
  chemically synthesized
taaccaccttaatgaagtatga

SEQ ID NO: 1018013 - DNA, 22 bp, Artificial Sequence
  chemically synthesized
tttgtatgtcaatcatacttca

SEQ ID NO: 1018014 - DNA, 22 bp, Artificial Sequence
  chemically synthesized
aatgaagtatgattgacataca

SEQ ID NO: 1018015 - DNA, 22 bp, Artificial Sequence
  chemically synthesized
atgaagtatgattgacatacaa

SEQ ID NO: 1018016 - DNA, 22 bp, Artificial Sequence
  chemically synthesized
acatacaaaaagctgtacatat

SEQ ID NO: 1018017 - DNA, 22 bp, Artificial Sequence
  chemically synthesized
agatatatatatatatatgtaa

SEQ ID NO: 1018018 - DNA, 22 bp, Artificial Sequence
  chemically synthesized
gagatatatatatatatatgta

SEQ ID NO: 1018019 - DNA, 22 bp, Artificial Sequence
  chemically synthesized
tgagatatatatatatatatgt

SEQ ID NO: 1018020 - DNA, 22 bp, Artificial Sequence
  chemically synthesized
tacatattttacatatatatat

SEQ ID NO: 1018021 - DNA, 22 bp, Artificial Sequence
  chemically synthesized
tttgagatatatatatatatat

SEQ ID NO: 1018022 - DNA, 22 bp, Artificial Sequence
  chemically synthesized
tacatatatatatatatatctc

SEQ ID NO: 1018023 - DNA, 22 bp, Artificial Sequence
  chemically synthesized
acatatatatatatatatctca

SEQ ID NO: 1018024 - DNA, 22 bp, Artificial Sequence
  chemically synthesized
catatatatatatatatctcaa

SEQ ID NO: 1018025 - DNA, 22 bp, Artificial Sequence
  chemically synthesized
aaagagtttcatcatatatata

SEQ ID NO: 1018026 - DNA, 22 bp, Artificial Sequence
  chemically synthesized
catcatatatatatatatatat

SEQ ID NO: 1018027 - DNA, 22 bp, Artificial Sequence
  chemically synthesized
atcatatatatatatatatata

SEQ ID NO: 1018028 - DNA, 22 bp, Artificial Sequence
  chemically synthesized
tatatatatatatatatatata

SEQ ID NO: 1018029 - DNA, 22 bp, Artificial Sequence
  chemically synthesized
atatatatatatatatatatat

SEQ ID NO: 1018030 - DNA, 22 bp, Artificial Sequence
  chemically synthesized
tatatatatatatatatatata

SEQ ID NO: 1018031 - DNA, 22 bp, Artificial Sequence
  chemically synthesized
attttatatatatatatatata

SEQ ID NO: 1018032 - DNA, 22 bp, Artificial Sequence
  chemically synthesized
gattttatatatatatatatat

SEQ ID NO: 1018033 - DNA, 22 bp, Artificial Sequence
  chemically synthesized
tgattttatatatatatatata

SEQ ID NO: 1018034 - DNA, 22 bp, Artificial Sequence
  chemically synthesized
tttgattttatatatatatata

SEQ ID NO: 1018035 - DNA, 22 bp, Artificial Sequence
  chemically synthesized
ccaaactctttgattttatata

SEQ ID NO: 1018036 - DNA, 22 bp, Artificial Sequence
  chemically synthesized
ttcccaaactctttgattttat

SEQ ID NO: 1018037 - DNA, 22 bp, Artificial Sequence
  chemically synthesized
attcccaaactctttgatttta

SEQ ID NO: 1018038 - DNA, 22 bp, Artificial Sequence
  chemically synthesized
tgggtgtatacttattcccaaa

SEQ ID NO: 1018039 - DNA, 22 bp, Artificial Sequence
  chemically synthesized
gtgggtgtatacttattcccaa

SEQ ID NO: 1018040 - DNA, 22 bp, Artificial Sequence
  chemically synthesized
tgtgggtgtatacttattccca

SEQ ID NO: 1018041 - DNA, 22 bp, Artificial Sequence
  chemically synthesized
gggaataagtatacacccacaa

SEQ ID NO: 1018042 - DNA, 22 bp, Artificial Sequence
  chemically synthesized
ggaataagtatacacccacaaa

SEQ ID NO: 1018043 - DNA, 22 bp, Artificial Sequence
  chemically synthesized
atggtggcgatggttttgtggg

SEQ ID NO: 1018044 - DNA, 22 bp, Artificial Sequence
  chemically synthesized
catggtggcgatggttttgtgg

SEQ ID NO: 1018045 - DNA, 22 bp, Artificial Sequence
  chemically synthesized
tagccttcatggtggcgatggt

SEQ ID NO: 1018046 - DNA, 22 bp, Artificial Sequence
  chemically synthesized
atagccttcatggtggcgatgg

SEQ ID NO: 1018047 - DNA, 22 bp, Artificial Sequence
  chemically synthesized
agtgatgacagatatgtttata

SEQ ID NO: 1018048 - DNA, 22 bp, Artificial Sequence
  chemically synthesized
gagtgatgacagatatgtttat

SEQ ID NO: 1018049 - DNA, 22 bp, Artificial Sequence
  chemically synthesized
tgagtgatgacagatatgttta

SEQ ID NO: 1018050 - DNA, 22 bp, Artificial Sequence
  chemically synthesized
taaacatatctgtcatcactca

SEQ ID NO: 1018051 - DNA, 22 bp, Artificial Sequence
  chemically synthesized
tcatcactcaaaatttcctctt

SEQ ID NO: 1018052 - DNA, 22 bp, Artificial Sequence
  chemically synthesized
aaaatttcctcttgtccccttt

SEQ ID NO: 1018053 - DNA, 22 bp, Artificial Sequence
  chemically synthesized
cctcttgtcccctttattattg

SEQ ID NO: 1018054 - DNA, 22 bp, Artificial Sequence
  chemically synthesized
ctcttgtcccctttattattgt

SEQ ID NO: 1018055 - DNA, 22 bp, Artificial Sequence
  chemically synthesized
ccaccagtaacaacaataataa

SEQ ID NO: 1018056 - DNA, 22 bp, Artificial Sequence
  chemically synthesized
accaccagtaacaacaataata

SEQ ID NO: 1018057 - DNA, 22 bp, Artificial Sequence
  chemically synthesized
ttgtcccctttattattgttgt

SEQ ID NO: 1018058 - DNA, 22 bp, Artificial Sequence
  chemically synthesized
ttaccaccagtaacaacaataa

SEQ ID NO: 1018059 - DNA, 22 bp, Artificial Sequence
  chemically synthesized
gtcccctttattattgttgtta

SEQ ID NO: 1018060 - DNA, 22 bp, Artificial Sequence
  chemically synthesized
tcccctttattattgttgttac

SEQ ID NO: 1018061 - DNA, 22 bp, Artificial Sequence
  chemically synthesized
tgttcttaccaccagtaacaac

SEQ ID NO: 1018062 - DNA, 22 bp, Artificial Sequence
  chemically synthesized
tattattgttgttactggtggt

SEQ ID NO: 1018063 - DNA, 22 bp, Artificial Sequence
  chemically synthesized
tgttgtgttcttaccaccagta

SEQ ID NO: 1018064 - DNA, 22 bp, Artificial Sequence
  chemically synthesized
attattgttgttactggtggta

SEQ ID NO: 1018065 - DNA, 22 bp, Artificial Sequence
  chemically synthesized
atgttgtgttcttaccaccagt

SEQ ID NO: 1018066 - DNA, 22 bp, Artificial Sequence
  chemically synthesized
ttattgttgttactggtggtaa

SEQ ID NO: 1018067 - DNA, 22 bp, Artificial Sequence
  chemically synthesized
ttgttgttactggtggtaagaa

SEQ ID NO: 1018068 - DNA, 22 bp, Artificial Sequence
  chemically synthesized
ttgttactggtggtaagaacac

SEQ ID NO: 1018069 - DNA, 22 bp, Artificial Sequence
  chemically synthesized
agaaatcttatgttgtgttctt

SEQ ID NO: 1018070 - DNA, 22 bp, Artificial Sequence
  chemically synthesized
ttactggtggtaagaacacaac

SEQ ID NO: 1018071 - DNA, 22 bp, Artificial Sequence
  chemically synthesized
ctaagaaatcttatgttgtgtt

SEQ ID NO: 1018072 - DNA, 22 bp, Artificial Sequence
  chemically synthesized
ctggtggtaagaacacaacata

SEQ ID NO: 1018073 - DNA, 22 bp, Artificial Sequence
  chemically synthesized
cctaagaaatcttatgttgtgt

SEQ ID NO: 1018074 - DNA, 22 bp, Artificial Sequence
  chemically synthesized
gtggtaagaacacaacataaga

SEQ ID NO: 1018075 - DNA, 22 bp, Artificial Sequence
  chemically synthesized
aaatttcctaagaaatcttatg

SEQ ID NO: 1018076 - DNA, 22 bp, Artificial Sequence
  chemically synthesized
aaaatttcctaagaaatcttat

SEQ ID NO: 1018077 - DNA, 22 bp, Artificial Sequence
  chemically synthesized
ggacacttaaaatttcctaaga

SEQ ID NO: 1018078 - DNA, 22 bp, Artificial Sequence
  chemically synthesized
cggacacttaaaatttcctaag

SEQ ID NO: 1018079 - DNA, 22 bp, Artificial Sequence
  chemically synthesized
tttcggacacttaaaatttcct

SEQ ID NO: 1018080 - DNA, 22 bp, Artificial Sequence
  chemically synthesized
cttaggaaattttaagtgtccg

SEQ ID NO: 1018081 - DNA, 22 bp, Artificial Sequence
  chemically synthesized
ataatgctgtttcggacactta

SEQ ID NO: 1018082 - DNA, 22 bp, Artificial Sequence
  chemically synthesized
ttaggaaattttaagtgtccga

SEQ ID NO: 1018083 - DNA, 22 bp, Artificial Sequence
  chemically synthesized
aggaaattttaagtgtccgaaa

SEQ ID NO: 1018084 - DNA, 22 bp, Artificial Sequence
  chemically synthesized
ggaaattttaagtgtccgaaac

SEQ ID NO: 1018085 - DNA, 22 bp, Artificial Sequence
  chemically synthesized
tagctaataatgctgtttcgga

SEQ ID NO: 1018086 - DNA, 22 bp, Artificial Sequence
  chemically synthesized
taagtgtccgaaacagcattat

SEQ ID NO: 1018087 - DNA, 22 bp, Artificial Sequence
  chemically synthesized
aagtgtccgaaacagcattatt

SEQ ID NO: 1018088 - DNA, 22 bp, Artificial Sequence
  chemically synthesized
agtgtccgaaacagcattatta

SEQ ID NO: 1018089 - DNA, 22 bp, Artificial Sequence
  chemically synthesized
tacagcatagtgcctatagcta

SEQ ID NO: 1018090 - DNA, 22 bp, Artificial Sequence
  chemically synthesized
ttatacagcatagtgcctatag

SEQ ID NO: 1018091 - DNA, 22 bp, Artificial Sequence
  chemically synthesized
ttagctataggcactatgctgt

SEQ ID NO: 1018092 - DNA, 22 bp, Artificial Sequence
  chemically synthesized
gagatctattatacagcatagt

SEQ ID NO: 1018093 - DNA, 22 bp, Artificial Sequence
  chemically synthesized
tggagatctattatacagcata

SEQ ID NO: 1018094 - DNA, 22 bp, Artificial Sequence
  chemically synthesized
gctataggcactatgctgtata

SEQ ID NO: 1018095 - DNA, 22 bp, Artificial Sequence
  chemically synthesized
taggcactatgctgtataatag

SEQ ID NO: 1018096 - DNA, 22 bp, Artificial Sequence
  chemically synthesized
tgctgtataatagatctccaga

SEQ ID NO: 1018097 - DNA, 22 bp, Artificial Sequence
  chemically synthesized
tggaagataaaattctggagat

SEQ ID NO: 1018098 - DNA, 22 bp, Artificial Sequence
  chemically synthesized
tataatagatctccagaatttt

SEQ ID NO: 1018099 - DNA, 22 bp, Artificial Sequence
  chemically synthesized
agttatggaagataaaattctg

SEQ ID NO: 1018100 - DNA, 22 bp, Artificial Sequence
  chemically synthesized
cagttatggaagataaaattct

SEQ ID NO: 1018101 - DNA, 22 bp, Artificial Sequence
  chemically synthesized
caaagtttcagttatggaagat

SEQ ID NO: 1018102 - DNA, 22 bp, Artificial Sequence
  chemically synthesized
cagaattttatcttccataact

SEQ ID NO: 1018103 - DNA, 22 bp, Artificial Sequence
  chemically synthesized
aagactacaaagtttcagttat

SEQ ID NO: 1018104 - DNA, 22 bp, Artificial Sequence
  chemically synthesized
tatcttccataactgaaacttt

SEQ ID NO: 1018105 - DNA, 22 bp, Artificial Sequence
  chemically synthesized
atcttccataactgaaactttg

SEQ ID NO: 1018106 - DNA, 22 bp, Artificial Sequence
  chemically synthesized
tcttccataactgaaactttgt

SEQ ID NO: 1018107 - DNA, 22 bp, Artificial Sequence
  chemically synthesized
ccataactgaaactttgtagtc

SEQ ID NO: 1018108 - DNA, 22 bp, Artificial Sequence
  chemically synthesized
cataactgaaactttgtagtct

SEQ ID NO: 1018109 - DNA, 22 bp, Artificial Sequence
  chemically synthesized
aaactttgtagtctttaacact

SEQ ID NO: 1018110 - DNA, 22 bp, Artificial Sequence
  chemically synthesized
aagcaggacaaaaggagtgtta

SEQ ID NO: 1018111 - DNA, 22 bp, Artificial Sequence
  chemically synthesized
aaagcaggacaaaaggagtgtt

SEQ ID NO: 1018112 - DNA, 22 bp, Artificial Sequence
  chemically synthesized
taaagcaggacaaaaggagtgt

SEQ ID NO: 1018113 - DNA, 22 bp, Artificial Sequence
  chemically synthesized
tgtagtctttaacactcctttt

SEQ ID NO: 1018114 - DNA, 22 bp, Artificial Sequence
  chemically synthesized
gtagtctttaacactccttttg

SEQ ID NO: 1018115 - DNA, 22 bp, Artificial Sequence
  chemically synthesized
tttaaagcaggacaaaaggagt

SEQ ID NO: 1018116 - DNA, 22 bp, Artificial Sequence
  chemically synthesized
tagtctttaacactccttttgt

SEQ ID NO: 1018117 - DNA, 22 bp, Artificial Sequence
  chemically synthesized
taacactccttttgtcctgctt

SEQ ID NO: 1018118 - DNA, 22 bp, Artificial Sequence
  chemically synthesized
aacactccttttgtcctgcttt

SEQ ID NO: 1018119 - DNA, 22 bp, Artificial Sequence
  chemically synthesized
acactccttttgtcctgcttta

SEQ ID NO: 1018120 - DNA, 22 bp, Artificial Sequence
  chemically synthesized
gagtagaataaattctttaaag

SEQ ID NO: 1018121 - DNA, 22 bp, Artificial Sequence
  chemically synthesized
cttttgtcctgctttaaagaat

SEQ ID NO: 1018122 - DNA, 22 bp, Artificial Sequence
  chemically synthesized
ttgtcctgctttaaagaattta

SEQ ID NO: 1018123 - DNA, 22 bp, Artificial Sequence
  chemically synthesized
tgtcctgctttaaagaatttat

SEQ ID NO: 1018124 - DNA, 22 bp, Artificial Sequence
  chemically synthesized
gtcctgctttaaagaatttatt

SEQ ID NO: 1018125 - DNA, 22 bp, Artificial Sequence
  chemically synthesized
tcctgctttaaagaatttattc

SEQ ID NO: 1018126 - DNA, 22 bp, Artificial Sequence
  chemically synthesized
atgtaaattagagtagaataaa

SEQ ID NO: 1018127 - DNA, 22 bp, Artificial Sequence
  chemically synthesized
ctttaaagaatttattctactc

SEQ ID NO: 1018128 - DNA, 22 bp, Artificial Sequence
  chemically synthesized
taaagaatttattctactctaa

SEQ ID NO: 1018129 - DNA, 22 bp, Artificial Sequence
  chemically synthesized
aaagaatttattctactctaat

SEQ ID NO: 1018130 - DNA, 22 bp, Artificial Sequence
  chemically synthesized
aagaatttattctactctaatt

SEQ ID NO: 1018131 - DNA, 22 bp, Artificial Sequence
  chemically synthesized
attctactctaatttacattag

SEQ ID NO: 1018132 - DNA, 22 bp, Artificial Sequence
  chemically synthesized
gacgtaatgacactaatgtaaa

SEQ ID NO: 1018133 - DNA, 22 bp, Artificial Sequence
  chemically synthesized
ttctactctaatttacattagt

SEQ ID NO: 1018134 - DNA, 22 bp, Artificial Sequence
  chemically synthesized
agacgtaatgacactaatgtaa

SEQ ID NO: 1018135 - DNA, 22 bp, Artificial Sequence
  chemically synthesized
tactctaatttacattagtgtc

SEQ ID NO: 1018136 - DNA, 22 bp, Artificial Sequence
  chemically synthesized
ctctaatttacattagtgtcat

SEQ ID NO: 1018137 - DNA, 22 bp, Artificial Sequence
  chemically synthesized
taatttacattagtgtcattac

SEQ ID NO: 1018138 - DNA, 22 bp, Artificial Sequence
  chemically synthesized
gtgtggtttagacgtaatgaca

SEQ ID NO: 1018139 - DNA, 22 bp, Artificial Sequence
  chemically synthesized
atttacattagtgtcattacgt

SEQ ID NO: 1018140 - DNA, 22 bp, Artificial Sequence
  chemically synthesized
agtgtggtttagacgtaatgac

SEQ ID NO: 1018141 - DNA, 22 bp, Artificial Sequence
  chemically synthesized
acattagtgtcattacgtctaa

SEQ ID NO: 1018142 - DNA, 22 bp, Artificial Sequence
  chemically synthesized
cattagtgtcattacgtctaaa

SEQ ID NO: 1018143 - DNA, 22 bp, Artificial Sequence
  chemically synthesized
gtgtcattacgtctaaaccaca

SEQ ID NO: 1018144 - DNA, 22 bp, Artificial Sequence
  chemically synthesized
gggagcatttagtgtggtttag

SEQ ID NO: 1018145 - DNA, 22 bp, Artificial Sequence
  chemically synthesized
agggagcatttagtgtggttta

SEQ ID NO: 1018146 - DNA, 22 bp, Artificial Sequence
  chemically synthesized
cccttagggagcatttagtgtg

SEQ ID NO: 1018147 - DNA, 22 bp, Artificial Sequence
  chemically synthesized
tacccttagggagcatttagtg

SEQ ID NO: 1018148 - DNA, 22 bp, Artificial Sequence
  chemically synthesized
cgtctaaaccacactaaatgct

SEQ ID NO: 1018149 - DNA, 22 bp, Artificial Sequence
  chemically synthesized
ctacccttagggagcatttagt

SEQ ID NO: 1018150 - DNA, 22 bp, Artificial Sequence
  chemically synthesized
aaccacactaaatgctccctaa

SEQ ID NO: 1018151 - DNA, 22 bp, Artificial Sequence
  chemically synthesized
aatatagtttctacccttaggg

SEQ ID NO: 1018152 - DNA, 22 bp, Artificial Sequence
  chemically synthesized
aatgctccctaagggtagaaac

SEQ ID NO: 1018153 - DNA, 22 bp, Artificial Sequence
  chemically synthesized
cctaagggtagaaactatattg

SEQ ID NO: 1018154 - DNA, 22 bp, Artificial Sequence
  chemically synthesized
agggtagaaactatattgaatc

SEQ ID NO: 1018155 - DNA, 22 bp, Artificial Sequence
  chemically synthesized
taggaggtaaaaatggtgattc

SEQ ID NO: 1018156 - DNA, 22 bp, Artificial Sequence
  chemically synthesized
ttataggaggtaaaaatggtga

SEQ ID NO: 1018157 - DNA, 22 bp, Artificial Sequence
  chemically synthesized
tattgaatcaccatttttacct

SEQ ID NO: 1018158 - DNA, 22 bp, Artificial Sequence
  chemically synthesized
gcacctgttataggaggtaaaa

SEQ ID NO: 1018159 - DNA, 22 bp, Artificial Sequence
  chemically synthesized
ggcacctgttataggaggtaaa

SEQ ID NO: 1018160 - DNA, 22 bp, Artificial Sequence
  chemically synthesized
tggcacctgttataggaggtaa

SEQ ID NO: 1018161 - DNA, 22 bp, Artificial Sequence
  chemically synthesized
aatcaccatttttacctcctat

SEQ ID NO: 1018162 - DNA, 22 bp, Artificial Sequence
  chemically synthesized
ttggcacctgttataggaggta

SEQ ID NO: 1018163 - DNA, 22 bp, Artificial Sequence
  chemically synthesized
tttggcacctgttataggaggt

SEQ ID NO: 1018164 - DNA, 22 bp, Artificial Sequence
  chemically synthesized
ttttttggcacctgttatagga

SEQ ID NO: 1018165 - DNA, 22 bp, Artificial Sequence
  chemically synthesized
ttacctcctataacaggtgcca

SEQ ID NO: 1018166 - DNA, 22 bp, Artificial Sequence
  chemically synthesized
tacctcctataacaggtgccaa

SEQ ID NO: 1018167 - DNA, 22 bp, Artificial Sequence
  chemically synthesized
acctcctataacaggtgccaaa

SEQ ID NO: 1018168 - DNA, 22 bp, Artificial Sequence
  chemically synthesized
cctcctataacaggtgccaaaa

SEQ ID NO: 1018169 - DNA, 22 bp, Artificial Sequence
  chemically synthesized
agtgcaacattattttttggca

SEQ ID NO: 1018170 - DNA, 22 bp, Artificial Sequence
  chemically synthesized
ctataacaggtgccaaaaaata

SEQ ID NO: 1018171 - DNA, 22 bp, Artificial Sequence
  chemically synthesized
taacaggtgccaaaaaataatg

SEQ ID NO: 1018172 - DNA, 22 bp, Artificial Sequence
  chemically synthesized
caaaaattaagtgcaacattat

SEQ ID NO: 1018173 - DNA, 22 bp, Artificial Sequence
  chemically synthesized
aatctgcaaaaattaagtgcaa

SEQ ID NO: 1018174 - DNA, 22 bp, Artificial Sequence
  chemically synthesized
gaatctgcaaaaattaagtgca

SEQ ID NO: 1018175 - DNA, 22 bp, Artificial Sequence
  chemically synthesized
tggataaatttgaatctgcaaa

SEQ ID NO: 1018176 - DNA, 22 bp, Artificial Sequence
  chemically synthesized
atggataaatttgaatctgcaa

SEQ ID NO: 1018177 - DNA, 22 bp, Artificial Sequence
  chemically synthesized
cacttaatttttgcagattcaa

SEQ ID NO: 1018178 - DNA, 22 bp, Artificial Sequence
  chemically synthesized
cttatggataaatttgaatctg

SEQ ID NO: 1018179 - DNA, 22 bp, Artificial Sequence
  chemically synthesized
aatttttgcagattcaaattta

SEQ ID NO: 1018180 - DNA, 22 bp, Artificial Sequence
  chemically synthesized
atttttgcagattcaaatttat

SEQ ID NO: 1018181 - DNA, 22 bp, Artificial Sequence
  chemically synthesized
aaattacttatggataaatttg

SEQ ID NO: 1018182 - DNA, 22 bp, Artificial Sequence
  chemically synthesized
ttgcagattcaaatttatccat

SEQ ID NO: 1018183 - DNA, 22 bp, Artificial Sequence
  chemically synthesized
tgcagattcaaatttatccata

SEQ ID NO: 1018184 - DNA, 22 bp, Artificial Sequence
  chemically synthesized
gcagattcaaatttatccataa

SEQ ID NO: 1018185 - DNA, 22 bp, Artificial Sequence
  chemically synthesized
tattaaaattacttatggataa

SEQ ID NO: 1018186 - DNA, 22 bp, Artificial Sequence
  chemically synthesized
cagattcaaatttatccataag

SEQ ID NO: 1018187 - DNA, 22 bp, Artificial Sequence
  chemically synthesized
gtattaaaattacttatggata

SEQ ID NO: 1018188 - DNA, 22 bp, Artificial Sequence
  chemically synthesized
tttgtattaaaattacttatgg

SEQ ID NO: 1018189 - DNA, 22 bp, Artificial Sequence
  chemically synthesized
aaatttatccataagtaatttt

SEQ ID NO: 1018190 - DNA, 22 bp, Artificial Sequence
  chemically synthesized
atccataagtaattttaataca

SEQ ID NO: 1018191 - DNA, 22 bp, Artificial Sequence
  chemically synthesized
tccataagtaattttaatacaa

SEQ ID NO: 1018192 - DNA, 22 bp, Artificial Sequence
  chemically synthesized
aagtggataccaattatttgta

SEQ ID NO: 1018193 - DNA, 22 bp, Artificial Sequence
  chemically synthesized
gaagtggataccaattatttgt

SEQ ID NO: 1018194 - DNA, 22 bp, Artificial Sequence
  chemically synthesized
atttgaagtggataccaattat

SEQ ID NO: 1018195 - DNA, 22 bp, Artificial Sequence
  chemically synthesized
taatacaaataattggtatcca

SEQ ID NO: 1018196 - DNA, 22 bp, Artificial Sequence
  chemically synthesized
aatacaaataattggtatccac

SEQ ID NO: 1018197 - DNA, 22 bp, Artificial Sequence
  chemically synthesized
atacaaataattggtatccact

SEQ ID NO: 1018198 - DNA, 22 bp, Artificial Sequence
  chemically synthesized
agaaggtatactcatttgaagt

SEQ ID NO: 1018199 - DNA, 22 bp, Artificial Sequence
  chemically synthesized
cagaaggtatactcatttgaag

SEQ ID NO: 1018200 - DNA, 22 bp, Artificial Sequence
  chemically synthesized
tcagaaggtatactcatttgaa

SEQ ID NO: 1018201 - DNA, 22 bp, Artificial Sequence
  chemically synthesized
ttcagaaggtatactcatttga

SEQ ID NO: 1018202 - DNA, 22 bp, Artificial Sequence
  chemically synthesized
ttttcagaaggtatactcattt

SEQ ID NO: 1018203 - DNA, 22 bp, Artificial Sequence
  chemically synthesized
gtatccacttcaaatgagtata

SEQ ID NO: 1018204 - DNA, 22 bp, Artificial Sequence
  chemically synthesized
cttttcagaaggtatactcatt

SEQ ID NO: 1018205 - DNA, 22 bp, Artificial Sequence
  chemically synthesized
caaatgagtataccttctgaaa

SEQ ID NO: 1018206 - DNA, 22 bp, Artificial Sequence
  chemically synthesized
aaatgagtataccttctgaaaa

SEQ ID NO: 1018207 - DNA, 22 bp, Artificial Sequence
  chemically synthesized
ctgaaaagaaacatggtttttt

SEQ ID NO: 1018208 - DNA, 22 bp, Artificial Sequence
  chemically synthesized
tgaaaagaaacatggttttttt

SEQ ID NO: 1018209 - DNA, 22 bp, Artificial Sequence
  chemically synthesized
aaaagaaacatggttttttttg

SEQ ID NO: 1018210 - DNA, 22 bp, Artificial Sequence
  chemically synthesized
tttttgttttgttttgttttgt

SEQ ID NO: 1018211 - DNA, 22 bp, Artificial Sequence
  chemically synthesized
aaaaataacaaaacaaaacaaa

SEQ ID NO: 1018212 - DNA, 22 bp, Artificial Sequence
  chemically synthesized
ttttgttttgttttgttttgtt

SEQ ID NO: 1018213 - DNA, 22 bp, Artificial Sequence
  chemically synthesized
tttgttttgttttgttttgttt

SEQ ID NO: 1018214 - DNA, 22 bp, Artificial Sequence
  chemically synthesized
ttgttttgttttgttttgtttt

SEQ ID NO: 1018215 - DNA, 22 bp, Artificial Sequence
  chemically synthesized
tgttttgttttgttttgttttg

SEQ ID NO: 1018216 - DNA, 22 bp, Artificial Sequence
  chemically synthesized
gttttgttttgttttgttttgt

SEQ ID NO: 1018217 - DNA, 22 bp, Artificial Sequence
  chemically synthesized
ttttgttttgttttgttttgtt

SEQ ID NO: 1018218 - DNA, 22 bp, Artificial Sequence
  chemically synthesized
cgtctcaaaaataacaaaacaa

SEQ ID NO: 1018219 - DNA, 22 bp, Artificial Sequence
  chemically synthesized
tgttttgttttgttttgttatt

SEQ ID NO: 1018220 - DNA, 22 bp, Artificial Sequence
  chemically synthesized
gttttgttttgttttgttattt

SEQ ID NO: 1018221 - DNA, 22 bp, Artificial Sequence
  chemically synthesized
ttttgttttgttttgttatttt

SEQ ID NO: 1018222 - DNA, 22 bp, Artificial Sequence
  chemically synthesized
tgttttgttttgttatttttga

SEQ ID NO: 1018223 - DNA, 22 bp, Artificial Sequence
  chemically synthesized
gttttgttttgttatttttgag

SEQ ID NO: 1018224 - DNA, 22 bp, Artificial Sequence
  chemically synthesized
ttttgttttgttatttttgaga

SEQ ID NO: 1018225 - DNA, 22 bp, Artificial Sequence
  chemically synthesized
tgttttgttatttttgagacgg

SEQ ID NO: 1018226 - DNA, 22 bp, Artificial Sequence
  chemically synthesized
gttttgttatttttgagacgga

SEQ ID NO: 1018227 - DNA, 22 bp, Artificial Sequence
  chemically synthesized
acagagcgagactccgtctcaa

SEQ ID NO: 1018228 - DNA, 22 bp, Artificial Sequence
  chemically synthesized
ttttgttatttttgagacggag

SEQ ID NO: 1018229 - DNA, 22 bp, Artificial Sequence
  chemically synthesized
tgttatttttgagacggagtct

SEQ ID NO: 1018230 - DNA, 22 bp, Artificial Sequence
  chemically synthesized
gttgacagagcgagactccgtc

SEQ ID NO: 1018231 - DNA, 22 bp, Artificial Sequence
  chemically synthesized
gttatttttgagacggagtctc

SEQ ID NO: 1018232 - DNA, 22 bp, Artificial Sequence
  chemically synthesized
ttatttttgagacggagtctcg

SEQ ID NO: 1018233 - DNA, 22 bp, Artificial Sequence
  chemically synthesized
tttttgagacggagtctcgctc

SEQ ID NO: 1018234 - DNA, 22 bp, Artificial Sequence
  chemically synthesized
cagcctggttgacagagcgaga

SEQ ID NO: 1018235 - DNA, 22 bp, Artificial Sequence
  chemically synthesized
ttgagacggagtctcgctctgt

SEQ ID NO: 1018236 - DNA, 22 bp, Artificial Sequence
  chemically synthesized
tgagacggagtctcgctctgtc

SEQ ID NO: 1018237 - DNA, 22 bp, Artificial Sequence
  chemically synthesized
gagacggagtctcgctctgtca

SEQ ID NO: 1018238 - DNA, 22 bp, Artificial Sequence
  chemically synthesized
agacggagtctcgctctgtcaa

SEQ ID NO: 1018239 - DNA, 22 bp, Artificial Sequence
  chemically synthesized
cactccagcctggttgacagag

SEQ ID NO: 1018240 - DNA, 22 bp, Artificial Sequence
  chemically synthesized
gctctgtcaaccaggctggagt

SEQ ID NO: 1018241 - DNA, 22 bp, Artificial Sequence
  chemically synthesized
tgtcaaccaggctggagtgcag

SEQ ID NO: 1018242 - DNA, 22 bp, Artificial Sequence
  chemically synthesized
tcaaccaggctggagtgcagcg

SEQ ID NO: 1018243 - DNA, 22 bp, Artificial Sequence
  chemically synthesized
tagtgagccgagatcgcgccgc

SEQ ID NO: 1018244 - DNA, 22 bp, Artificial Sequence
  chemically synthesized
gtagtgagccgagatcgcgccg

SEQ ID NO: 1018245 - DNA, 22 bp, Artificial Sequence
  chemically synthesized
gagtgcagcggcgcgatctcgg

SEQ ID NO: 1018246 - DNA, 22 bp, Artificial Sequence
  chemically synthesized
ggaggcagagcttgtagtgagc

SEQ ID NO: 1018247 - DNA, 22 bp, Artificial Sequence
  chemically synthesized
ggctcactacaagctctgcctc

SEQ ID NO: 1018248 - DNA, 22 bp, Artificial Sequence
  chemically synthesized
actacaagctctgcctcccagg

SEQ ID NO: 1018249 - DNA, 22 bp, Artificial Sequence
  chemically synthesized
caagctctgcctcccaggttca

SEQ ID NO: 1018250 - DNA, 22 bp, Artificial Sequence
  chemically synthesized
aggcgggagaaaggcgtgaacc

SEQ ID NO: 1018251 - DNA, 22 bp, Artificial Sequence
  chemically synthesized
tgcctcccaggttcacgccttt

SEQ ID NO: 1018252 - DNA, 22 bp, Artificial Sequence
  chemically synthesized
cctcccaggttcacgcctttct

SEQ ID NO: 1018253 - DNA, 22 bp, Artificial Sequence
  chemically synthesized
ccaggttcacgcctttctcccg

SEQ ID NO: 1018254 - DNA, 22 bp, Artificial Sequence
  chemically synthesized
gggaagctgaggcgggagaaag

SEQ ID NO: 1018255 - DNA, 22 bp, Artificial Sequence
  chemically synthesized
ctcgggaagctgaggcgggaga

SEQ ID NO: 1018256 - DNA, 22 bp, Artificial Sequence
  chemically synthesized
acgcctttctcccgcctcagct

SEQ ID NO: 1018257 - DNA, 22 bp, Artificial Sequence
  chemically synthesized
tctcccgcctcagcttcccgag

SEQ ID NO: 1018258 - DNA, 22 bp, Artificial Sequence
  chemically synthesized
tagtcccagctactcgggaagc

SEQ ID NO: 1018259 - DNA, 22 bp, Artificial Sequence
  chemically synthesized
ctcccgcctcagcttcccgagt

SEQ ID NO: 1018260 - DNA, 22 bp, Artificial Sequence
  chemically synthesized
tcccgcctcagcttcccgagta

SEQ ID NO: 1018261 - DNA, 22 bp, Artificial Sequence
  chemically synthesized
ccgcctcagcttcccgagtagc

SEQ ID NO: 1018262 - DNA, 22 bp, Artificial Sequence
  chemically synthesized
agcttcccgagtagctgggact

SEQ ID NO: 1018263 - DNA, 22 bp, Artificial Sequence
  chemically synthesized
cccgagtagctgggactacagg

SEQ ID NO: 1018264 - DNA, 22 bp, Artificial Sequence
  chemically synthesized
ccgagtagctgggactacaggc

SEQ ID NO: 1018265 - DNA, 22 bp, Artificial Sequence
  chemically synthesized
gccgggcgtggtggcgggcgcc

SEQ ID NO: 1018266 - DNA, 22 bp, Artificial Sequence
  chemically synthesized
ggactacaggcgcccgccacca

SEQ ID NO: 1018267 - DNA, 22 bp, Artificial Sequence
  chemically synthesized
caggcgcccgccaccacgcccg

SEQ ID NO: 1018268 - DNA, 22 bp, Artificial Sequence
  chemically synthesized
aaaaatacaaaaaattagccgg

SEQ ID NO: 1018269 - DNA, 22 bp, Artificial Sequence
  chemically synthesized
ctaaaaaatacaaaaaattagc

SEQ ID NO: 1018270 - DNA, 22 bp, Artificial Sequence
  chemically synthesized
tactaaaaaatacaaaaaatta

SEQ ID NO: 1018271 - DNA, 22 bp, Artificial Sequence
  chemically synthesized
attttttgtattttttagtaga

SEQ ID NO: 1018272 - DNA, 22 bp, Artificial Sequence
  chemically synthesized
tttgtattttttagtagagacg

SEQ ID NO: 1018273 - DNA, 22 bp, Artificial Sequence
  chemically synthesized
ttgtattttttagtagagacgg

SEQ ID NO: 1018274 - DNA, 22 bp, Artificial Sequence
  chemically synthesized
tgtattttttagtagagacggg

SEQ ID NO: 1018275 - DNA, 22 bp, Artificial Sequence
  chemically synthesized
gtattttttagtagagacgggg

SEQ ID NO: 1018276 - DNA, 22 bp, Artificial Sequence
  chemically synthesized
tattttttagtagagacggggt

SEQ ID NO: 1018277 - DNA, 22 bp, Artificial Sequence
  chemically synthesized
gccaacaaggtgaaaccccgtc

SEQ ID NO: 1018278 - DNA, 22 bp, Artificial Sequence
  chemically synthesized
tttagtagagacggggtttcac

SEQ ID NO: 1018279 - DNA, 22 bp, Artificial Sequence
  chemically synthesized
ttagtagagacggggtttcacc

SEQ ID NO: 1018280 - DNA, 22 bp, Artificial Sequence
  chemically synthesized
tagtagagacggggtttcacct

SEQ ID NO: 1018281 - DNA, 22 bp, Artificial Sequence
  chemically synthesized
agtagagacggggtttcacctt

SEQ ID NO: 1018282 - DNA, 22 bp, Artificial Sequence
  chemically synthesized
gtagagacggggtttcaccttg

SEQ ID NO: 1018283 - DNA, 22 bp, Artificial Sequence
  chemically synthesized
caccttgttggccaggacggtc

SEQ ID NO: 1018284 - DNA, 22 bp, Artificial Sequence
  chemically synthesized
accttgttggccaggacggtct

SEQ ID NO: 1018285 - DNA, 22 bp, Artificial Sequence
  chemically synthesized
gttggccaggacggtctcgatc

SEQ ID NO: 1018286 - DNA, 22 bp, Artificial Sequence
  chemically synthesized
ttggccaggacggtctcgatct

SEQ ID NO: 1018287 - DNA, 22 bp, Artificial Sequence
  chemically synthesized
gccaggacggtctcgatctcct

SEQ ID NO: 1018288 - DNA, 22 bp, Artificial Sequence
  chemically synthesized
gatctcctgacctcgtgatcct

SEQ ID NO: 1018289 - DNA, 22 bp, Artificial Sequence
  chemically synthesized
ggaggccgaggcagaaggatca

SEQ ID NO: 1018290 - DNA, 22 bp, Artificial Sequence
  chemically synthesized
gggaggccgaggcagaaggatc

SEQ ID NO: 1018291 - DNA, 22 bp, Artificial Sequence
  chemically synthesized
tgggaggccgaggcagaaggat

SEQ ID NO: 1018292 - DNA, 22 bp, Artificial Sequence
  chemically synthesized
ctgacctcgtgatccttctgcc

SEQ ID NO: 1018293 - DNA, 22 bp, Artificial Sequence
  chemically synthesized
acctcgtgatccttctgcctcg

SEQ ID NO: 1018294 - DNA, 22 bp, Artificial Sequence
  chemically synthesized
gtgatccttctgcctcggcctc

SEQ ID NO: 1018295 - DNA, 22 bp, Artificial Sequence
  chemically synthesized
taatcccagcactttgggaggc

SEQ ID NO: 1018296 - DNA, 22 bp, Artificial Sequence
  chemically synthesized
ctgcctcggcctcccaaagtgc

SEQ ID NO: 1018297 - DNA, 22 bp, Artificial Sequence
  chemically synthesized
tgcctcggcctcccaaagtgct

SEQ ID NO: 1018298 - DNA, 22 bp, Artificial Sequence
  chemically synthesized
cctcggcctcccaaagtgctgg

SEQ ID NO: 1018299 - DNA, 22 bp, Artificial Sequence
  chemically synthesized
acgcctgtaatcccagcacttt

SEQ ID NO: 1018300 - DNA, 22 bp, Artificial Sequence
  chemically synthesized
ggcctcccaaagtgctgggatt

SEQ ID NO: 1018301 - DNA, 22 bp, Artificial Sequence
  chemically synthesized
ccaaagtgctgggattacaggc

SEQ ID NO: 1018302 - DNA, 22 bp, Artificial Sequence
  chemically synthesized
gccgggcgcggtggctcacgcc

SEQ ID NO: 1018303 - DNA, 22 bp, Artificial Sequence
  chemically synthesized
ggccgggcgcggtggctcacgc

SEQ ID NO: 1018304 - DNA, 22 bp, Artificial Sequence
  chemically synthesized
tggccgggcgcggtggctcacg

SEQ ID NO: 1018305 - DNA, 22 bp, Artificial Sequence
  chemically synthesized
ttggccgggcgcggtggctcac

SEQ ID NO: 1018306 - DNA, 22 bp, Artificial Sequence
  chemically synthesized
ggattacaggcgtgagccaccg

SEQ ID NO: 1018307 - DNA, 22 bp, Artificial Sequence
  chemically synthesized
caggcgtgagccaccgcgcccg

SEQ ID NO: 1018308 - DNA, 22 bp, Artificial Sequence
  chemically synthesized
aagaacatgtttttggccgggc

SEQ ID NO: 1018309 - DNA, 22 bp, Artificial Sequence
  chemically synthesized
taaagaacatgtttttggccgg

SEQ ID NO: 1018310 - DNA, 22 bp, Artificial Sequence
  chemically synthesized
ggagttctaaagaacatgtttt

SEQ ID NO: 1018311 - DNA, 22 bp, Artificial Sequence
  chemically synthesized
gggagttctaaagaacatgttt

SEQ ID NO: 1018312 - DNA, 22 bp, Artificial Sequence
  chemically synthesized
tgggagttctaaagaacatgtt

SEQ ID NO: 1018313 - DNA, 22 bp, Artificial Sequence
  chemically synthesized
aaagatgatactttgggagttc

SEQ ID NO: 1018314 - DNA, 22 bp, Artificial Sequence
  chemically synthesized
atactaaaagatgatactttgg

SEQ ID NO: 1018315 - DNA, 22 bp, Artificial Sequence
  chemically synthesized
catactaaaagatgatactttg

SEQ ID NO: 1018316 - DNA, 22 bp, Artificial Sequence
  chemically synthesized
tttagaactcccaaagtatcat

SEQ ID NO: 1018317 - DNA, 22 bp, Artificial Sequence
  chemically synthesized
tagaactcccaaagtatcatct

SEQ ID NO: 1018318 - DNA, 22 bp, Artificial Sequence
  chemically synthesized
agaactcccaaagtatcatctt

SEQ ID NO: 1018319 - DNA, 22 bp, Artificial Sequence
  chemically synthesized
gaactcccaaagtatcatcttt

SEQ ID NO: 1018320 - DNA, 22 bp, Artificial Sequence
  chemically synthesized
ccaaagtatcatcttttagtat

SEQ ID NO: 1018321 - DNA, 22 bp, Artificial Sequence
  chemically synthesized
aaaaaaaatcttcatactaaaa

SEQ ID NO: 1018322 - DNA, 22 bp, Artificial Sequence
  chemically synthesized
caaaaaaaatcttcatactaaa

SEQ ID NO: 1018323 - DNA, 22 bp, Artificial Sequence
  chemically synthesized
atttcaaaaaaaatcttcatac

SEQ ID NO: 1018324 - DNA, 22 bp, Artificial Sequence
  chemically synthesized
aatttcaaaaaaaatcttcata

SEQ ID NO: 1018325 - DNA, 22 bp, Artificial Sequence
  chemically synthesized
ttaatttcaaaaaaaatcttca

SEQ ID NO: 1018326 - DNA, 22 bp, Artificial Sequence
  chemically synthesized
ttcttaatttcaaaaaaaatct

SEQ ID NO: 1018327 - DNA, 22 bp, Artificial Sequence
  chemically synthesized
gttcttaatttcaaaaaaaatc

SEQ ID NO: 1018328 - DNA, 22 bp, Artificial Sequence
  chemically synthesized
ttagtatgaagattttttttga

SEQ ID NO: 1018329 - DNA, 22 bp, Artificial Sequence
  chemically synthesized
tagtatgaagattttttttgaa

SEQ ID NO: 1018330 - DNA, 22 bp, Artificial Sequence
  chemically synthesized
cttgttcttaatttcaaaaaaa

SEQ ID NO: 1018331 - DNA, 22 bp, Artificial Sequence
  chemically synthesized
agtatgaagattttttttgaaa

SEQ ID NO: 1018332 - DNA, 22 bp, Artificial Sequence
  chemically synthesized
gtatgaagattttttttgaaat

SEQ ID NO: 1018333 - DNA, 22 bp, Artificial Sequence
  chemically synthesized
ctacttgttcttaatttcaaaa

SEQ ID NO: 1018334 - DNA, 22 bp, Artificial Sequence
  chemically synthesized
actacttgttcttaatttcaaa

SEQ ID NO: 1018335 - DNA, 22 bp, Artificial Sequence
  chemically synthesized
tactacttgttcttaatttcaa

SEQ ID NO: 1018336 - DNA, 22 bp, Artificial Sequence
  chemically synthesized
ttttactacttgttcttaattt

SEQ ID NO: 1018337 - DNA, 22 bp, Artificial Sequence
  chemically synthesized
attgttttactacttgttctta

SEQ ID NO: 1018338 - DNA, 22 bp, Artificial Sequence
  chemically synthesized
tttttgaaattaagaacaagta

SEQ ID NO: 1018339 - DNA, 22 bp, Artificial Sequence
  chemically synthesized
ttttgaaattaagaacaagtag

SEQ ID NO: 1018340 - DNA, 22 bp, Artificial Sequence
  chemically synthesized
tttgaaattaagaacaagtagt

SEQ ID NO: 1018341 - DNA, 22 bp, Artificial Sequence
  chemically synthesized
ttgaaattaagaacaagtagta

SEQ ID NO: 1018342 - DNA, 22 bp, Artificial Sequence
  chemically synthesized
tgaaattaagaacaagtagtaa

SEQ ID NO: 1018343 - DNA, 22 bp, Artificial Sequence
  chemically synthesized
gaaattaagaacaagtagtaaa

SEQ ID NO: 1018344 - DNA, 22 bp, Artificial Sequence
  chemically synthesized
aaattaagaacaagtagtaaaa

SEQ ID NO: 1018345 - DNA, 22 bp, Artificial Sequence
  chemically synthesized
tacaacctgattgttttactac

SEQ ID NO: 1018346 - DNA, 22 bp, Artificial Sequence
  chemically synthesized
agaacaagtagtaaaacaatca

SEQ ID NO: 1018347 - DNA, 22 bp, Artificial Sequence
  chemically synthesized
tatgctgtacaacctgattgtt

SEQ ID NO: 1018348 - DNA, 22 bp, Artificial Sequence
  chemically synthesized
gtatgctgtacaacctgattgt

SEQ ID NO: 1018349 - DNA, 22 bp, Artificial Sequence
  chemically synthesized
tgtatgctgtacaacctgattg

SEQ ID NO: 1018350 - DNA, 22 bp, Artificial Sequence
  chemically synthesized
aaattttgtatgctgtacaacc

SEQ ID NO: 1018351 - DNA, 22 bp, Artificial Sequence
  chemically synthesized
caaattttgtatgctgtacaac

SEQ ID NO: 1018352 - DNA, 22 bp, Artificial Sequence
  chemically synthesized
tcttcaaattttgtatgctgta

SEQ ID NO: 1018353 - DNA, 22 bp, Artificial Sequence
  chemically synthesized
gtcttcaaattttgtatgctgt

SEQ ID NO: 1018354 - DNA, 22 bp, Artificial Sequence
  chemically synthesized
cttgtcttcaaattttgtatgc

SEQ ID NO: 1018355 - DNA, 22 bp, Artificial Sequence
  chemically synthesized
gcttgtcttcaaattttgtatg

SEQ ID NO: 1018356 - DNA, 22 bp, Artificial Sequence
  chemically synthesized
acgtttgcttgtcttcaaattt

SEQ ID NO: 1018357 - DNA, 22 bp, Artificial Sequence
  chemically synthesized
tacagcatacaaaatttgaaga

SEQ ID NO: 1018358 - DNA, 22 bp, Artificial Sequence
  chemically synthesized
aaactcacgtttgcttgtcttc

SEQ ID NO: 1018359 - DNA, 22 bp, Artificial Sequence
  chemically synthesized
caaactcacgtttgcttgtctt

SEQ ID NO: 1018360 - DNA, 22 bp, Artificial Sequence
  chemically synthesized
gaagacaagcaaacgtgagttt

SEQ ID NO: 1018361 - DNA, 22 bp, Artificial Sequence
  chemically synthesized
aagacaagcaaacgtgagtttg

SEQ ID NO: 1018362 - DNA, 22 bp, Artificial Sequence
  chemically synthesized
ggcaataaaacagaatttcaaa

SEQ ID NO: 1018363 - DNA, 22 bp, Artificial Sequence
  chemically synthesized
ttaggcaataaaacagaatttc

SEQ ID NO: 1018364 - DNA, 22 bp, Artificial Sequence
  chemically synthesized
caaagcactgttaggcaataaa

SEQ ID NO: 1018365 - DNA, 22 bp, Artificial Sequence
  chemically synthesized
acaaagcactgttaggcaataa

SEQ ID NO: 1018366 - DNA, 22 bp, Artificial Sequence
  chemically synthesized
gaaattctgttttattgcctaa

SEQ ID NO: 1018367 - DNA, 22 bp, Artificial Sequence
  chemically synthesized
aaattctgttttattgcctaac

SEQ ID NO: 1018368 - DNA, 22 bp, Artificial Sequence
  chemically synthesized
aagtttacaaagcactgttagg

SEQ ID NO: 1018369 - DNA, 22 bp, Artificial Sequence
  chemically synthesized
tgttttattgcctaacagtgct

SEQ ID NO: 1018370 - DNA, 22 bp, Artificial Sequence
  chemically synthesized
ctgaagtttacaaagcactgtt

SEQ ID NO: 1018371 - DNA, 22 bp, Artificial Sequence
  chemically synthesized
ttttattgcctaacagtgcttt

SEQ ID NO: 1018372 - DNA, 22 bp, Artificial Sequence
  chemically synthesized
gctgaagtttacaaagcactgt

SEQ ID NO: 1018373 - DNA, 22 bp, Artificial Sequence
  chemically synthesized
tattgcctaacagtgctttgta

SEQ ID NO: 1018374 - DNA, 22 bp, Artificial Sequence
  chemically synthesized
attgcctaacagtgctttgtaa

SEQ ID NO: 1018375 - DNA, 22 bp, Artificial Sequence
  chemically synthesized
ttgcctaacagtgctttgtaaa

SEQ ID NO: 1018376 - DNA, 22 bp, Artificial Sequence
  chemically synthesized
cctaacagtgctttgtaaactt

SEQ ID NO: 1018377 - DNA, 22 bp, Artificial Sequence
  chemically synthesized
aatcacttgctgaagtttacaa

SEQ ID NO: 1018378 - DNA, 22 bp, Artificial Sequence
  chemically synthesized
acagtgctttgtaaacttcagc

SEQ ID NO: 1018379 - DNA, 22 bp, Artificial Sequence
  chemically synthesized
tgtaaacttcagcaagtgattt

SEQ ID NO: 1018380 - DNA, 22 bp, Artificial Sequence
  chemically synthesized
gtaaacttcagcaagtgattta

SEQ ID NO: 1018381 - DNA, 22 bp, Artificial Sequence
  chemically synthesized
aaatcaggaaattaaatcactt

SEQ ID NO: 1018382 - DNA, 22 bp, Artificial Sequence
  chemically synthesized
taaacttcagcaagtgatttaa

SEQ ID NO: 1018383 - DNA, 22 bp, Artificial Sequence
  chemically synthesized
tgaaatcaggaaattaaatcac

SEQ ID NO: 1018384 - DNA, 22 bp, Artificial Sequence
  chemically synthesized
cagcaagtgatttaatttcctg

SEQ ID NO: 1018385 - DNA, 22 bp, Artificial Sequence
  chemically synthesized
agcaagtgatttaatttcctga

SEQ ID NO: 1018386 - DNA, 22 bp, Artificial Sequence
  chemically synthesized
acaaatgagaactctgaaatca

SEQ ID NO: 1018387 - DNA, 22 bp, Artificial Sequence
  chemically synthesized
cacaaatgagaactctgaaatc

SEQ ID NO: 1018388 - DNA, 22 bp, Artificial Sequence
  chemically synthesized
tttcacaaatgagaactctgaa

SEQ ID NO: 1018389 - DNA, 22 bp, Artificial Sequence
  chemically synthesized
aatttcctgatttcagagttct

SEQ ID NO: 1018390 - DNA, 22 bp, Artificial Sequence
  chemically synthesized
atttcctgatttcagagttctc

SEQ ID NO: 1018391 - DNA, 22 bp, Artificial Sequence
  chemically synthesized
cctgatttcagagttctcattt

SEQ ID NO: 1018392 - DNA, 22 bp, Artificial Sequence
  chemically synthesized
tgcctatttcacaaatgagaac

SEQ ID NO: 1018393 - DNA, 22 bp, Artificial Sequence
  chemically synthesized
ctgatttcagagttctcatttg

SEQ ID NO: 1018394 - DNA, 22 bp, Artificial Sequence
  chemically synthesized
atttcagagttctcatttgtga

SEQ ID NO: 1018395 - DNA, 22 bp, Artificial Sequence
  chemically synthesized
cagagttctcatttgtgaaata

SEQ ID NO: 1018396 - DNA, 22 bp, Artificial Sequence
  chemically synthesized
agagttctcatttgtgaaatag

SEQ ID NO: 1018397 - DNA, 22 bp, Artificial Sequence
  chemically synthesized
tgaaatatatattatgcctatt

SEQ ID NO: 1018398 - DNA, 22 bp, Artificial Sequence
  chemically synthesized
tcatttgtgaaataggcataat

SEQ ID NO: 1018399 - DNA, 22 bp, Artificial Sequence
  chemically synthesized
atttgtgaaataggcataatat

SEQ ID NO: 1018400 - DNA, 22 bp, Artificial Sequence
  chemically synthesized
gtgaaataggcataatatatat

SEQ ID NO: 1018401 - DNA, 22 bp, Artificial Sequence
  chemically synthesized
tgaaataggcataatatatatt

SEQ ID NO: 1018402 - DNA, 22 bp, Artificial Sequence
  chemically synthesized
taacaaccctgtgaaatatata

SEQ ID NO: 1018403 - DNA, 22 bp, Artificial Sequence
  chemically synthesized
ataacaaccctgtgaaatatat

SEQ ID NO: 1018404 - DNA, 22 bp, Artificial Sequence
  chemically synthesized
ttataacaaccctgtgaaatat

SEQ ID NO: 1018405 - DNA, 22 bp, Artificial Sequence
  chemically synthesized
attcttataacaaccctgtgaa

SEQ ID NO: 1018406 - DNA, 22 bp, Artificial Sequence
  chemically synthesized
aattcttataacaaccctgtga

SEQ ID NO: 1018407 - DNA, 22 bp, Artificial Sequence
  chemically synthesized
taattcttataacaaccctgtg

SEQ ID NO: 1018408 - DNA, 22 bp, Artificial Sequence
  chemically synthesized
ttaattcttataacaaccctgt

SEQ ID NO: 1018409 - DNA, 22 bp, Artificial Sequence
  chemically synthesized
tttttaattcttataacaaccc

SEQ ID NO: 1018410 - DNA, 22 bp, Artificial Sequence
  chemically synthesized
tattatttttaattcttataac

SEQ ID NO: 1018411 - DNA, 22 bp, Artificial Sequence
  chemically synthesized
cacagggttgttataagaatta

SEQ ID NO: 1018412 - DNA, 22 bp, Artificial Sequence
  chemically synthesized
acagggttgttataagaattaa

SEQ ID NO: 1018413 - DNA, 22 bp, Artificial Sequence
  chemically synthesized
actgtattatttttaattctta

SEQ ID NO: 1018414 - DNA, 22 bp, Artificial Sequence
  chemically synthesized
cactgtattatttttaattctt

SEQ ID NO: 1018415 - DNA, 22 bp, Artificial Sequence
  chemically synthesized
ttataagaattaaaaataatac

SEQ ID NO: 1018416 - DNA, 22 bp, Artificial Sequence
  chemically synthesized
agaaaacttcactgtattattt

SEQ ID NO: 1018417 - DNA, 22 bp, Artificial Sequence
  chemically synthesized
taagaattaaaaataatacagt

SEQ ID NO: 1018418 - DNA, 22 bp, Artificial Sequence
  chemically synthesized
tgggctcagaaaacttcactgt

SEQ ID NO: 1018419 - DNA, 22 bp, Artificial Sequence
  chemically synthesized
ctatgggctcagaaaacttcac

SEQ ID NO: 1018420 - DNA, 22 bp, Artificial Sequence
  chemically synthesized
aaaataatacagtgaagttttc

SEQ ID NO: 1018421 - DNA, 22 bp, Artificial Sequence
  chemically synthesized
actatgggctcagaaaacttca

SEQ ID NO: 1018422 - DNA, 22 bp, Artificial Sequence
  chemically synthesized
agcacttactatgggctcagaa

SEQ ID NO: 1018423 - DNA, 22 bp, Artificial Sequence
  chemically synthesized
ccaccattgagcacttactatg

SEQ ID NO: 1018424 - DNA, 22 bp, Artificial Sequence
  chemically synthesized
ttgccaccattgagcacttact

SEQ ID NO: 1018425 - DNA, 22 bp, Artificial Sequence
  chemically synthesized
tctgagcccatagtaagtgctc

SEQ ID NO: 1018426 - DNA, 22 bp, Artificial Sequence
  chemically synthesized
ctgagcccatagtaagtgctca

SEQ ID NO: 1018427 - DNA, 22 bp, Artificial Sequence
  chemically synthesized
tgagcccatagtaagtgctcaa

SEQ ID NO: 1018428 - DNA, 22 bp, Artificial Sequence
  chemically synthesized
ttattgccaccattgagcactt

SEQ ID NO: 1018429 - DNA, 22 bp, Artificial Sequence
  chemically synthesized
agcccatagtaagtgctcaatg

SEQ ID NO: 1018430 - DNA, 22 bp, Artificial Sequence
  chemically synthesized
ttgttattgccaccattgagca

SEQ ID NO: 1018431 - DNA, 22 bp, Artificial Sequence
  chemically synthesized
tgattattgttattgccaccat

SEQ ID NO: 1018432 - DNA, 22 bp, Artificial Sequence
  chemically synthesized
gatattatgattattgttattg

SEQ ID NO: 1018433 - DNA, 22 bp, Artificial Sequence
  chemically synthesized
ggatattatgattattgttatt

SEQ ID NO: 1018434 - DNA, 22 bp, Artificial Sequence
  chemically synthesized
aatggtggcaataacaataatc

SEQ ID NO: 1018435 - DNA, 22 bp, Artificial Sequence
  chemically synthesized
tatatatatttggatattatga

SEQ ID NO: 1018436 - DNA, 22 bp, Artificial Sequence
  chemically synthesized
tatactgtatatatatttggat

SEQ ID NO: 1018437 - DNA, 22 bp, Artificial Sequence
  chemically synthesized
aataacagaaattatatactgt

SEQ ID NO: 1018438 - DNA, 22 bp, Artificial Sequence
  chemically synthesized
taaataacagaaattatatact

SEQ ID NO: 1018439 - DNA, 22 bp, Artificial Sequence
  chemically synthesized
ctaaataacagaaattatatac

SEQ ID NO: 1018440 - DNA, 22 bp, Artificial Sequence
  chemically synthesized
tctaaataacagaaattatata

SEQ ID NO: 1018441 - DNA, 22 bp, Artificial Sequence
  chemically synthesized
atattttctaaataacagaaat

SEQ ID NO: 1018442 - DNA, 22 bp, Artificial Sequence
  chemically synthesized
aatattttctaaataacagaaa

SEQ ID NO: 1018443 - DNA, 22 bp, Artificial Sequence
  chemically synthesized
ataacttaatattttctaaata

SEQ ID NO: 1018444 - DNA, 22 bp, Artificial Sequence
  chemically synthesized
gataacttaatattttctaaat

SEQ ID NO: 1018445 - DNA, 22 bp, Artificial Sequence
  chemically synthesized
ctgttatttagaaaatattaag

SEQ ID NO: 1018446 - DNA, 22 bp, Artificial Sequence
  chemically synthesized
tgttatttagaaaatattaagt

SEQ ID NO: 1018447 - DNA, 22 bp, Artificial Sequence
  chemically synthesized
ttatttagaaaatattaagtta

SEQ ID NO: 1018448 - DNA, 22 bp, Artificial Sequence
  chemically synthesized
tttagaaaatattaagttatca

SEQ ID NO: 1018449 - DNA, 22 bp, Artificial Sequence
  chemically synthesized
agaaaatattaagttatcaaat

SEQ ID NO: 1018450 - DNA, 22 bp, Artificial Sequence
  chemically synthesized
gaaaatattaagttatcaaata

SEQ ID NO: 1018451 - DNA, 22 bp, Artificial Sequence
  chemically synthesized
atatatgtgtacatgtatttga

SEQ ID NO: 1018452 - DNA, 22 bp, Artificial Sequence
  chemically synthesized
agttatcaaatacatgtacaca

SEQ ID NO: 1018453 - DNA, 22 bp, Artificial Sequence
  chemically synthesized
aaaatattcatatatgtgtaca

SEQ ID NO: 1018454 - DNA, 22 bp, Artificial Sequence
  chemically synthesized
tcaaatacatgtacacatatat

SEQ ID NO: 1018455 - DNA, 22 bp, Artificial Sequence
  chemically synthesized
atagatattgaaaatattcata

SEQ ID NO: 1018456 - DNA, 22 bp, Artificial Sequence
  chemically synthesized
attcatagatattgaaaatatt

SEQ ID NO: 1018457 - DNA, 22 bp, Artificial Sequence
  chemically synthesized
ctcattcatagatattgaaaat

SEQ ID NO: 1018458 - DNA, 22 bp, Artificial Sequence
  chemically synthesized
cctcattcatagatattgaaaa

SEQ ID NO: 1018459 - DNA, 22 bp, Artificial Sequence
  chemically synthesized
tcctcattcatagatattgaaa

SEQ ID NO: 1018460 - DNA, 22 bp, Artificial Sequence
  chemically synthesized
tacatattttcctcattcatag

SEQ ID NO: 1018461 - DNA, 22 bp, Artificial Sequence
  chemically synthesized
tcaatatctatgaatgaggaaa

SEQ ID NO: 1018462 - DNA, 22 bp, Artificial Sequence
  chemically synthesized
caatatctatgaatgaggaaaa

SEQ ID NO: 1018463 - DNA, 22 bp, Artificial Sequence
  chemically synthesized
aatatctatgaatgaggaaaat

SEQ ID NO: 1018464 - DNA, 22 bp, Artificial Sequence
  chemically synthesized
tgaatgaggaaaatatgtataa

SEQ ID NO: 1018465 - DNA, 22 bp, Artificial Sequence
  chemically synthesized
atgtgccaatgaggaaatgtat

SEQ ID NO: 1018466 - DNA, 22 bp, Artificial Sequence
  chemically synthesized
catgtgccaatgaggaaatgta

SEQ ID NO: 1018467 - DNA, 22 bp, Artificial Sequence
  chemically synthesized
tcatgtgccaatgaggaaatgt

SEQ ID NO: 1018468 - DNA, 22 bp, Artificial Sequence
  chemically synthesized
attttatacatttcctcattgg

SEQ ID NO: 1018469 - DNA, 22 bp, Artificial Sequence
  chemically synthesized
tatacatttcctcattggcaca

SEQ ID NO: 1018470 - DNA, 22 bp, Artificial Sequence
  chemically synthesized
atacatttcctcattggcacat

SEQ ID NO: 1018471 - DNA, 22 bp, Artificial Sequence
  chemically synthesized
tacatttcctcattggcacatg

SEQ ID NO: 1018472 - DNA, 22 bp, Artificial Sequence
  chemically synthesized
aagatatacaactttcatgtgc

SEQ ID NO: 1018473 - DNA, 22 bp, Artificial Sequence
  chemically synthesized
cctcattggcacatgaaagttg

SEQ ID NO: 1018474 - DNA, 22 bp, Artificial Sequence
  chemically synthesized
gctgaagatatacaactttcat

SEQ ID NO: 1018475 - DNA, 22 bp, Artificial Sequence
  chemically synthesized
ctcattggcacatgaaagttgt

SEQ ID NO: 1018476 - DNA, 22 bp, Artificial Sequence
  chemically synthesized
agctgaagatatacaactttca

SEQ ID NO: 1018477 - DNA, 22 bp, Artificial Sequence
  chemically synthesized
attggcacatgaaagttgtata

SEQ ID NO: 1018478 - DNA, 22 bp, Artificial Sequence
  chemically synthesized
aatttagctgaagatatacaac

SEQ ID NO: 1018479 - DNA, 22 bp, Artificial Sequence
  chemically synthesized
gcacatgaaagttgtatatctt

SEQ ID NO: 1018480 - DNA, 22 bp, Artificial Sequence
  chemically synthesized
tatatcttcagctaaatttagt

SEQ ID NO: 1018481 - DNA, 22 bp, Artificial Sequence
  chemically synthesized
aagggcaagaagactaaattta

SEQ ID NO: 1018482 - DNA, 22 bp, Artificial Sequence
  chemically synthesized
aaagggcaagaagactaaattt

SEQ ID NO: 1018483 - DNA, 22 bp, Artificial Sequence
  chemically synthesized
agccttaaagggcaagaagact

SEQ ID NO: 1018484 - DNA, 22 bp, Artificial Sequence
  chemically synthesized
cagctaaatttagtcttcttgc

SEQ ID NO: 1018485 - DNA, 22 bp, Artificial Sequence
  chemically synthesized
gagccttaaagggcaagaagac

SEQ ID NO: 1018486 - DNA, 22 bp, Artificial Sequence
  chemically synthesized
agctaaatttagtcttcttgcc

SEQ ID NO: 1018487 - DNA, 22 bp, Artificial Sequence
  chemically synthesized
aatttagtcttcttgcccttta

SEQ ID NO: 1018488 - DNA, 22 bp, Artificial Sequence
  chemically synthesized
agtcttcttgccctttaaggct

SEQ ID NO: 1018489 - DNA, 22 bp, Artificial Sequence
  chemically synthesized
gtcttcttgccctttaaggctc

SEQ ID NO: 1018490 - DNA, 22 bp, Artificial Sequence
  chemically synthesized
cttgccctttaaggctcaaaca

SEQ ID NO: 1018491 - DNA, 22 bp, Artificial Sequence
  chemically synthesized
cacatagtaaaatgtttgagcc

SEQ ID NO: 1018492 - DNA, 22 bp, Artificial Sequence
  chemically synthesized
ttgccctttaaggctcaaacat

SEQ ID NO: 1018493 - DNA, 22 bp, Artificial Sequence
  chemically synthesized
acacatagtaaaatgtttgagc

SEQ ID NO: 1018494 - DNA, 22 bp, Artificial Sequence
  chemically synthesized
gccctttaaggctcaaacattt

SEQ ID NO: 1018495 - DNA, 22 bp, Artificial Sequence
  chemically synthesized
ccctttaaggctcaaacatttt

SEQ ID NO: 1018496 - DNA, 22 bp, Artificial Sequence
  chemically synthesized
taaggctcaaacattttactat

SEQ ID NO: 1018497 - DNA, 22 bp, Artificial Sequence
  chemically synthesized
aaggctcaaacattttactatg

SEQ ID NO: 1018498 - DNA, 22 bp, Artificial Sequence
  chemically synthesized
aggctcaaacattttactatgt

SEQ ID NO: 1018499 - DNA, 22 bp, Artificial Sequence
  chemically synthesized
aaacattttactatgtgtaaat

SEQ ID NO: 1018500 - DNA, 22 bp, Artificial Sequence
  chemically synthesized
caatagcagtaaaatcatttac

SEQ ID NO: 1018501 - DNA, 22 bp, Artificial Sequence
  chemically synthesized
tactatgtgtaaatgattttac

SEQ ID NO: 1018502 - DNA, 22 bp, Artificial Sequence
  chemically synthesized
actatgtgtaaatgattttact

SEQ ID NO: 1018503 - DNA, 22 bp, Artificial Sequence
  chemically synthesized
ctatgtgtaaatgattttactg

SEQ ID NO: 1018504 - DNA, 22 bp, Artificial Sequence
  chemically synthesized
cccaattacaatagcagtaaaa

SEQ ID NO: 1018505 - DNA, 22 bp, Artificial Sequence
  chemically synthesized
tgtgtaaatgattttactgcta

SEQ ID NO: 1018506 - DNA, 22 bp, Artificial Sequence
  chemically synthesized
gcccaattacaatagcagtaaa

SEQ ID NO: 1018507 - DNA, 22 bp, Artificial Sequence
  chemically synthesized
gtttgcccaattacaatagcag

SEQ ID NO: 1018508 - DNA, 22 bp, Artificial Sequence
  chemically synthesized
ggtttgcccaattacaatagca

SEQ ID NO: 1018509 - DNA, 22 bp, Artificial Sequence
  chemically synthesized
tggtttgcccaattacaatagc

SEQ ID NO: 1018510 - DNA, 22 bp, Artificial Sequence
  chemically synthesized
ttttggtttgcccaattacaat

SEQ ID NO: 1018511 - DNA, 22 bp, Artificial Sequence
  chemically synthesized
tactgctattgtaattgggcaa

SEQ ID NO: 1018512 - DNA, 22 bp, Artificial Sequence
  chemically synthesized
actgctattgtaattgggcaaa

SEQ ID NO: 1018513 - DNA, 22 bp, Artificial Sequence
  chemically synthesized
taattgttttggtttgcccaat

SEQ ID NO: 1018514 - DNA, 22 bp, Artificial Sequence
  chemically synthesized
ctgctattgtaattgggcaaac

SEQ ID NO: 1018515 - DNA, 22 bp, Artificial Sequence
  chemically synthesized
ctgtaattgttttggtttgccc

SEQ ID NO: 1018516 - DNA, 22 bp, Artificial Sequence
  chemically synthesized
ctattgtaattgggcaaaccaa

SEQ ID NO: 1018517 - DNA, 22 bp, Artificial Sequence
  chemically synthesized
actgtaattgttttggtttgcc

SEQ ID NO: 1018518 - DNA, 22 bp, Artificial Sequence
  chemically synthesized
ttgtaattgggcaaaccaaaac

SEQ ID NO: 1018519 - DNA, 22 bp, Artificial Sequence
  chemically synthesized
catttactgtaattgttttggt

SEQ ID NO: 1018520 - DNA, 22 bp, Artificial Sequence
  chemically synthesized
taattgggcaaaccaaaacaat

SEQ ID NO: 1018521 - DNA, 22 bp, Artificial Sequence
  chemically synthesized
ggcaaaccaaaacaattacagt

SEQ ID NO: 1018522 - DNA, 22 bp, Artificial Sequence
  chemically synthesized
cagtaaatggaatcatatgtct

SEQ ID NO: 1018523 - DNA, 22 bp, Artificial Sequence
  chemically synthesized
agaacgaaacaaagacatatga

SEQ ID NO: 1018524 - DNA, 22 bp, Artificial Sequence
  chemically synthesized
gttgagaacgaaacaaagacat

SEQ ID NO: 1018525 - DNA, 22 bp, Artificial Sequence
  chemically synthesized
cctcgttgagaacgaaacaaag

SEQ ID NO: 1018526 - DNA, 22 bp, Artificial Sequence
  chemically synthesized
ctccctcgttgagaacgaaaca

SEQ ID NO: 1018527 - DNA, 22 bp, Artificial Sequence
  chemically synthesized
ttcctccctcgttgagaacgaa

SEQ ID NO: 1018528 - DNA, 22 bp, Artificial Sequence
  chemically synthesized
tgtttcgttctcaacgagggag

SEQ ID NO: 1018529 - DNA, 22 bp, Artificial Sequence
  chemically synthesized
agtgtactgttcctccctcgtt

SEQ ID NO: 1018530 - DNA, 22 bp, Artificial Sequence
  chemically synthesized
gtttcgttctcaacgagggagg

SEQ ID NO: 1018531 - DNA, 22 bp, Artificial Sequence
  chemically synthesized
tttcgttctcaacgagggagga

SEQ ID NO: 1018532 - DNA, 22 bp, Artificial Sequence
  chemically synthesized
cgttctcaacgagggaggaaca

SEQ ID NO: 1018533 - DNA, 22 bp, Artificial Sequence
  chemically synthesized
tgttaagtgtactgttcctccc

SEQ ID NO: 1018534 - DNA, 22 bp, Artificial Sequence
  chemically synthesized
gttctcaacgagggaggaacag

SEQ ID NO: 1018535 - DNA, 22 bp, Artificial Sequence
  chemically synthesized
tcaacgagggaggaacagtaca

SEQ ID NO: 1018536 - DNA, 22 bp, Artificial Sequence
  chemically synthesized
tagctgtgttaagtgtactgtt

SEQ ID NO: 1018537 - DNA, 22 bp, Artificial Sequence
  chemically synthesized
aacgagggaggaacagtacact

SEQ ID NO: 1018538 - DNA, 22 bp, Artificial Sequence
  chemically synthesized
gtagctgtgttaagtgtactgt

SEQ ID NO: 1018539 - DNA, 22 bp, Artificial Sequence
  chemically synthesized
tgtagctgtgttaagtgtactg

SEQ ID NO: 1018540 - DNA, 22 bp, Artificial Sequence
  chemically synthesized
ttgtagctgtgttaagtgtact

SEQ ID NO: 1018541 - DNA, 22 bp, Artificial Sequence
  chemically synthesized
tttgtagctgtgttaagtgtac

SEQ ID NO: 1018542 - DNA, 22 bp, Artificial Sequence
  chemically synthesized
ttttgtagctgtgttaagtgta

SEQ ID NO: 1018543 - DNA, 22 bp, Artificial Sequence
  chemically synthesized
aatttttttgtagctgtgttaa

SEQ ID NO: 1018544 - DNA, 22 bp, Artificial Sequence
  chemically synthesized
aacacagctacaaaaaaattta

SEQ ID NO: 1018545 - DNA, 22 bp, Artificial Sequence
  chemically synthesized
acacagctacaaaaaaatttaa

SEQ ID NO: 1018546 - DNA, 22 bp, Artificial Sequence
  chemically synthesized
gcagaaaaaagtaagttaaatt

SEQ ID NO: 1018547 - DNA, 22 bp, Artificial Sequence
  chemically synthesized
agcagaaaaaagtaagttaaat

SEQ ID NO: 1018548 - DNA, 22 bp, Artificial Sequence
  chemically synthesized
tagcagaaaaaagtaagttaaa

SEQ ID NO: 1018549 - DNA, 22 bp, Artificial Sequence
  chemically synthesized
ctttagcagaaaaaagtaagtt

SEQ ID NO: 1018550 - DNA, 22 bp, Artificial Sequence
  chemically synthesized
caaaaaaatttaacttactttt

SEQ ID NO: 1018551 - DNA, 22 bp, Artificial Sequence
  chemically synthesized
cctttagcagaaaaaagtaagt

SEQ ID NO: 1018552 - DNA, 22 bp, Artificial Sequence
  chemically synthesized
tcctttagcagaaaaaagtaag

SEQ ID NO: 1018553 - DNA, 22 bp, Artificial Sequence
  chemically synthesized
attttcctttagcagaaaaaag

SEQ ID NO: 1018554 - DNA, 22 bp, Artificial Sequence
  chemically synthesized
atctcattttcctttagcagaa

SEQ ID NO: 1018555 - DNA, 22 bp, Artificial Sequence
  chemically synthesized
aacttacttttttctgctaaag

SEQ ID NO: 1018556 - DNA, 22 bp, Artificial Sequence
  chemically synthesized
catctcattttcctttagcaga

SEQ ID NO: 1018557 - DNA, 22 bp, Artificial Sequence
  chemically synthesized
acttacttttttctgctaaagg

SEQ ID NO: 1018558 - DNA, 22 bp, Artificial Sequence
  chemically synthesized
tcatctcattttcctttagcag

SEQ ID NO: 1018559 - DNA, 22 bp, Artificial Sequence
  chemically synthesized
ttcatctcattttcctttagca

SEQ ID NO: 1018560 - DNA, 22 bp, Artificial Sequence
  chemically synthesized
tttcatctcattttcctttagc

SEQ ID NO: 1018561 - DNA, 22 bp, Artificial Sequence
  chemically synthesized
acttttttctgctaaaggaaaa

SEQ ID NO: 1018562 - DNA, 22 bp, Artificial Sequence
  chemically synthesized
cttttttctgctaaaggaaaat

SEQ ID NO: 1018563 - DNA, 22 bp, Artificial Sequence
  chemically synthesized
ttttctgctaaaggaaaatgag

SEQ ID NO: 1018564 - DNA, 22 bp, Artificial Sequence
  chemically synthesized
tttctgctaaaggaaaatgaga

SEQ ID NO: 1018565 - DNA, 22 bp, Artificial Sequence
  chemically synthesized
ttctgctaaaggaaaatgagat

SEQ ID NO: 1018566 - DNA, 22 bp, Artificial Sequence
  chemically synthesized
tctgctaaaggaaaatgagatg

SEQ ID NO: 1018567 - DNA, 22 bp, Artificial Sequence
  chemically synthesized
ctgctaaaggaaaatgagatga

SEQ ID NO: 1018568 - DNA, 22 bp, Artificial Sequence
  chemically synthesized
tgctaaaggaaaatgagatgaa

SEQ ID NO: 1018569 - DNA, 22 bp, Artificial Sequence
  chemically synthesized
ctaaaggaaaatgagatgaaaa

SEQ ID NO: 1018570 - DNA, 22 bp, Artificial Sequence
  chemically synthesized
aaataaaatggctttttcatct

SEQ ID NO: 1018571 - DNA, 22 bp, Artificial Sequence
  chemically synthesized
aaaataaaatggctttttcatc

SEQ ID NO: 1018572 - DNA, 22 bp, Artificial Sequence
  chemically synthesized
aaggaaaatgagatgaaaaagc

SEQ ID NO: 1018573 - DNA, 22 bp, Artificial Sequence
  chemically synthesized
taaaataaaatggctttttcat

SEQ ID NO: 1018574 - DNA, 22 bp, Artificial Sequence
  chemically synthesized
gttttaaaataaaatggctttt

SEQ ID NO: 1018575 - DNA, 22 bp, Artificial Sequence
  chemically synthesized
ccattcgttttaaaataaaatg

SEQ ID NO: 1018576 - DNA, 22 bp, Artificial Sequence
  chemically synthesized
gaaatcaaaatctgccattcgt

SEQ ID NO: 1018577 - DNA, 22 bp, Artificial Sequence
  chemically synthesized
tattttaaaacgaatggcagat

SEQ ID NO: 1018578 - DNA, 22 bp, Artificial Sequence
  chemically synthesized
attttaaaacgaatggcagatt

SEQ ID NO: 1018579 - DNA, 22 bp, Artificial Sequence
  chemically synthesized
cctcgaaatcaaaatctgccat

SEQ ID NO: 1018580 - DNA, 22 bp, Artificial Sequence
  chemically synthesized
ttttaaaacgaatggcagattt

SEQ ID NO: 1018581 - DNA, 22 bp, Artificial Sequence
  chemically synthesized
gcctcgaaatcaaaatctgcca

SEQ ID NO: 1018582 - DNA, 22 bp, Artificial Sequence
  chemically synthesized
taaaacgaatggcagattttga

SEQ ID NO: 1018583 - DNA, 22 bp, Artificial Sequence
  chemically synthesized
cttgcctcgaaatcaaaatctg

SEQ ID NO: 1018584 - DNA, 22 bp, Artificial Sequence
  chemically synthesized
aaaacgaatggcagattttgat

SEQ ID NO: 1018585 - DNA, 22 bp, Artificial Sequence
  chemically synthesized
acttgcctcgaaatcaaaatct

SEQ ID NO: 1018586 - DNA, 22 bp, Artificial Sequence
  chemically synthesized
aaacgaatggcagattttgatt

SEQ ID NO: 1018587 - DNA, 22 bp, Artificial Sequence
  chemically synthesized
ccttacttgcctcgaaatcaaa

SEQ ID NO: 1018588 - DNA, 22 bp, Artificial Sequence
  chemically synthesized
tgatttcgaggcaagtaaggca

SEQ ID NO: 1018589 - DNA, 22 bp, Artificial Sequence
  chemically synthesized
gatttcgaggcaagtaaggcaa

SEQ ID NO: 1018590 - DNA, 22 bp, Artificial Sequence
  chemically synthesized
atttcgaggcaagtaaggcaat

SEQ ID NO: 1018591 - DNA, 22 bp, Artificial Sequence
  chemically synthesized
ggaagataacacgaaattgcct

SEQ ID NO: 1018592 - DNA, 22 bp, Artificial Sequence
  chemically synthesized
cgaggcaagtaaggcaatttcg

SEQ ID NO: 1018593 - DNA, 22 bp, Artificial Sequence
  chemically synthesized
gggaagataacacgaaattgcc

SEQ ID NO: 1018594 - DNA, 22 bp, Artificial Sequence
  chemically synthesized
gaggcaagtaaggcaatttcgt

SEQ ID NO: 1018595 - DNA, 22 bp, Artificial Sequence
  chemically synthesized
tgggaagataacacgaaattgc

SEQ ID NO: 1018596 - DNA, 22 bp, Artificial Sequence
  chemically synthesized
ttgggaagataacacgaaattg

SEQ ID NO: 1018597 - DNA, 22 bp, Artificial Sequence
  chemically synthesized
accatacttttgggaagataac

SEQ ID NO: 1018598 - DNA, 22 bp, Artificial Sequence
  chemically synthesized
tcaccatacttttgggaagata

SEQ ID NO: 1018599 - DNA, 22 bp, Artificial Sequence
  chemically synthesized
gtattctcaccatacttttggg

SEQ ID NO: 1018600 - DNA, 22 bp, Artificial Sequence
  chemically synthesized
cgtgttatcttcccaaaagtat

SEQ ID NO: 1018601 - DNA, 22 bp, Artificial Sequence
  chemically synthesized
gtgttatcttcccaaaagtatg

SEQ ID NO: 1018602 - DNA, 22 bp, Artificial Sequence
  chemically synthesized
gaattcgtattctcaccatact

SEQ ID NO: 1018603 - DNA, 22 bp, Artificial Sequence
  chemically synthesized
ggaattcgtattctcaccatac

SEQ ID NO: 1018604 - DNA, 22 bp, Artificial Sequence
  chemically synthesized
tcttcccaaaagtatggtgaga

SEQ ID NO: 1018605 - DNA, 22 bp, Artificial Sequence
  chemically synthesized
cccaaaagtatggtgagaatac

SEQ ID NO: 1018606 - DNA, 22 bp, Artificial Sequence
  chemically synthesized
ccaaaagtatggtgagaatacg

SEQ ID NO: 1018607 - DNA, 22 bp, Artificial Sequence
  chemically synthesized
cgcatatttggaattcgtattc

SEQ ID NO: 1018608 - DNA, 22 bp, Artificial Sequence
  chemically synthesized
atactccgcatatttggaattc

SEQ ID NO: 1018609 - DNA, 22 bp, Artificial Sequence
  chemically synthesized
ttcatactccgcatatttggaa

SEQ ID NO: 1018610 - DNA, 22 bp, Artificial Sequence
  chemically synthesized
attcatactccgcatatttgga

SEQ ID NO: 1018611 - DNA, 22 bp, Artificial Sequence
  chemically synthesized
tattcatactccgcatatttgg

SEQ ID NO: 1018612 - DNA, 22 bp, Artificial Sequence
  chemically synthesized
ttattcatactccgcatatttg

SEQ ID NO: 1018613 - DNA, 22 bp, Artificial Sequence
  chemically synthesized
tttattcatactccgcatattt

SEQ ID NO: 1018614 - DNA, 22 bp, Artificial Sequence
  chemically synthesized
ttttttattcatactccgcata

SEQ ID NO: 1018615 - DNA, 22 bp, Artificial Sequence
  chemically synthesized
tattttttattcatactccgca

SEQ ID NO: 1018616 - DNA, 22 bp, Artificial Sequence
  chemically synthesized
ctattttttattcatactccgc

SEQ ID NO: 1018617 - DNA, 22 bp, Artificial Sequence
  chemically synthesized
tctattttttattcatactccg

SEQ ID NO: 1018618 - DNA, 22 bp, Artificial Sequence
  chemically synthesized
caaatatgcggagtatgaataa

SEQ ID NO: 1018619 - DNA, 22 bp, Artificial Sequence
  chemically synthesized
agaagaaaaatgtcataccttt

SEQ ID NO: 1018620 - DNA, 22 bp, Artificial Sequence
  chemically synthesized
cctaagaagaaaaatgtcatac

SEQ ID NO: 1018621 - DNA, 22 bp, Artificial Sequence
  chemically synthesized
gctgcctaagaagaaaaatgtc

SEQ ID NO: 1018622 - DNA, 22 bp, Artificial Sequence
  chemically synthesized
ggctgcctaagaagaaaaatgt

SEQ ID NO: 1018623 - DNA, 22 bp, Artificial Sequence
  chemically synthesized
tggctgcctaagaagaaaaatg

SEQ ID NO: 1018624 - DNA, 22 bp, Artificial Sequence
  chemically synthesized
ttcttcttaggcagccaaaatg

SEQ ID NO: 1018625 - DNA, 22 bp, Artificial Sequence
  chemically synthesized
tggaagaaatatcattttggct

SEQ ID NO: 1018626 - DNA, 22 bp, Artificial Sequence
  chemically synthesized
tcttcttaggcagccaaaatga

SEQ ID NO: 1018627 - DNA, 22 bp, Artificial Sequence
  chemically synthesized
cttcttaggcagccaaaatgat

SEQ ID NO: 1018628 - DNA, 22 bp, Artificial Sequence
  chemically synthesized
ttcttaggcagccaaaatgata

SEQ ID NO: 1018629 - DNA, 22 bp, Artificial Sequence
  chemically synthesized
cttaggcagccaaaatgatatt

SEQ ID NO: 1018630 - DNA, 22 bp, Artificial Sequence
  chemically synthesized
ttaggcagccaaaatgatattt

SEQ ID NO: 1018631 - DNA, 22 bp, Artificial Sequence
  chemically synthesized
aggcagccaaaatgatatttct

SEQ ID NO: 1018632 - DNA, 22 bp, Artificial Sequence
  chemically synthesized
ggcagccaaaatgatatttctt

SEQ ID NO: 1018633 - DNA, 22 bp, Artificial Sequence
  chemically synthesized
ccgcagcagcctatggaagaaa

SEQ ID NO: 1018634 - DNA, 22 bp, Artificial Sequence
  chemically synthesized
gccgcagcagcctatggaagaa

SEQ ID NO: 1018635 - DNA, 22 bp, Artificial Sequence
  chemically synthesized
atttgccgcagcagcctatgga

SEQ ID NO: 1018636 - DNA, 22 bp, Artificial Sequence
  chemically synthesized
gatttgccgcagcagcctatgg

SEQ ID NO: 1018637 - DNA, 22 bp, Artificial Sequence
  chemically synthesized
tgatttgccgcagcagcctatg

SEQ ID NO: 1018638 - DNA, 22 bp, Artificial Sequence
  chemically synthesized
cttccataggctgctgcggcaa

SEQ ID NO: 1018639 - DNA, 22 bp, Artificial Sequence
  chemically synthesized
ttccataggctgctgcggcaaa

SEQ ID NO: 1018640 - DNA, 22 bp, Artificial Sequence
  chemically synthesized
ccataggctgctgcggcaaatc

SEQ ID NO: 1018641 - DNA, 22 bp, Artificial Sequence
  chemically synthesized
cataggctgctgcggcaaatca

SEQ ID NO: 1018642 - DNA, 22 bp, Artificial Sequence
  chemically synthesized
aagtggtgtattttgatttgcc

SEQ ID NO: 1018643 - DNA, 22 bp, Artificial Sequence
  chemically synthesized
atctcaagtggtgtattttgat

SEQ ID NO: 1018644 - DNA, 22 bp, Artificial Sequence
  chemically synthesized
ctgcggcaaatcaaaatacacc

SEQ ID NO: 1018645 - DNA, 22 bp, Artificial Sequence
  chemically synthesized
cggcaaatcaaaatacaccact

SEQ ID NO: 1018646 - DNA, 22 bp, Artificial Sequence
  chemically synthesized
gtaagctgatctcaagtggtgt

SEQ ID NO: 1018647 - DNA, 22 bp, Artificial Sequence
  chemically synthesized
cgtaagctgatctcaagtggtg

SEQ ID NO: 1018648 - DNA, 22 bp, Artificial Sequence
  chemically synthesized
tcgtaagctgatctcaagtggt

SEQ ID NO: 1018649 - DNA, 22 bp, Artificial Sequence
  chemically synthesized
gagatcagcttacgaaaatgtc

SEQ ID NO: 1018650 - DNA, 22 bp, Artificial Sequence
  chemically synthesized
agatcagcttacgaaaatgtcc

SEQ ID NO: 1018651 - DNA, 22 bp, Artificial Sequence
  chemically synthesized
acgaaaatgtcccttttacatg

SEQ ID NO: 1018652 - DNA, 22 bp, Artificial Sequence
  chemically synthesized
cgaaaatgtcccttttacatgg

SEQ ID NO: 1018653 - DNA, 22 bp, Artificial Sequence
  chemically synthesized
tggccaaagaaaatgagtccca

SEQ ID NO: 1018654 - DNA, 22 bp, Artificial Sequence
  chemically synthesized
atggccaaagaaaatgagtccc

SEQ ID NO: 1018655 - DNA, 22 bp, Artificial Sequence
  chemically synthesized
tatggccaaagaaaatgagtcc

SEQ ID NO: 1018656 - DNA, 22 bp, Artificial Sequence
  chemically synthesized
ttatggccaaagaaaatgagtc

SEQ ID NO: 1018657 - DNA, 22 bp, Artificial Sequence
  chemically synthesized
tttatggccaaagaaaatgagt

SEQ ID NO: 1018658 - DNA, 22 bp, Artificial Sequence
  chemically synthesized
ttacatgggactcattttcttt

SEQ ID NO: 1018659 - DNA, 22 bp, Artificial Sequence
  chemically synthesized
tacatgggactcattttctttg

SEQ ID NO: 1018660 - DNA, 22 bp, Artificial Sequence
  chemically synthesized
attttttatggccaaagaaaat

SEQ ID NO: 1018661 - DNA, 22 bp, Artificial Sequence
  chemically synthesized
acatgggactcattttctttgg

SEQ ID NO: 1018662 - DNA, 22 bp, Artificial Sequence
  chemically synthesized
aattttttatggccaaagaaaa

SEQ ID NO: 1018663 - DNA, 22 bp, Artificial Sequence
  chemically synthesized
catgggactcattttctttggc

SEQ ID NO: 1018664 - DNA, 22 bp, Artificial Sequence
  chemically synthesized
taattttttatggccaaagaaa

SEQ ID NO: 1018665 - DNA, 22 bp, Artificial Sequence
  chemically synthesized
atctttaattttttatggccaa

SEQ ID NO: 1018666 - DNA, 22 bp, Artificial Sequence
  chemically synthesized
aatctttaattttttatggcca

SEQ ID NO: 1018667 - DNA, 22 bp, Artificial Sequence
  chemically synthesized
attttctttggccataaaaaat

SEQ ID NO: 1018668 - DNA, 22 bp, Artificial Sequence
  chemically synthesized
tctttggccataaaaaattaaa

SEQ ID NO: 1018669 - DNA, 22 bp, Artificial Sequence
  chemically synthesized
ctttggccataaaaaattaaag

SEQ ID NO: 1018670 - DNA, 22 bp, Artificial Sequence
  chemically synthesized
tttggccataaaaaattaaaga

SEQ ID NO: 1018671 - DNA, 22 bp, Artificial Sequence
  chemically synthesized
tggccataaaaaattaaagatt

SEQ ID NO: 1018672 - DNA, 22 bp, Artificial Sequence
  chemically synthesized
ggccataaaaaattaaagatta

SEQ ID NO: 1018673 - DNA, 22 bp, Artificial Sequence
  chemically synthesized
gccataaaaaattaaagattaa

SEQ ID NO: 1018674 - DNA, 22 bp, Artificial Sequence
  chemically synthesized
aaagatagacagagatcttaat

SEQ ID NO: 1018675 - DNA, 22 bp, Artificial Sequence
  chemically synthesized
aagattaagatctctgtctatc

SEQ ID NO: 1018676 - DNA, 22 bp, Artificial Sequence
  chemically synthesized
atgccatatatattcaaagata

SEQ ID NO: 1018677 - DNA, 22 bp, Artificial Sequence
  chemically synthesized
agatctctgtctatctttgaat

SEQ ID NO: 1018678 - DNA, 22 bp, Artificial Sequence
  chemically synthesized
tgtctatctttgaatatatatg

SEQ ID NO: 1018679 - DNA, 22 bp, Artificial Sequence
  chemically synthesized
tctatctttgaatatatatggc

SEQ ID NO: 1018680 - DNA, 22 bp, Artificial Sequence
  chemically synthesized
taagtgtggtctcatgccatat

SEQ ID NO: 1018681 - DNA, 22 bp, Artificial Sequence
  chemically synthesized
tctttgaatatatatggcatga

SEQ ID NO: 1018682 - DNA, 22 bp, Artificial Sequence
  chemically synthesized
gtaagtgtggtctcatgccata

SEQ ID NO: 1018683 - DNA, 22 bp, Artificial Sequence
  chemically synthesized
tgaatatatatggcatgagacc

SEQ ID NO: 1018684 - DNA, 22 bp, Artificial Sequence
  chemically synthesized
gaatatatatggcatgagacca

SEQ ID NO: 1018685 - DNA, 22 bp, Artificial Sequence
  chemically synthesized
aatatatatggcatgagaccac

SEQ ID NO: 1018686 - DNA, 22 bp, Artificial Sequence
  chemically synthesized
tgtatttgtaagtgtggtctca

SEQ ID NO: 1018687 - DNA, 22 bp, Artificial Sequence
  chemically synthesized
atgtatttgtaagtgtggtctc

SEQ ID NO: 1018688 - DNA, 22 bp, Artificial Sequence
  chemically synthesized
tttatgtatttgtaagtgtggt

SEQ ID NO: 1018689 - DNA, 22 bp, Artificial Sequence
  chemically synthesized
atttatgtatttgtaagtgtgg

SEQ ID NO: 1018690 - DNA, 22 bp, Artificial Sequence
  chemically synthesized
tatttatgtatttgtaagtgtg

SEQ ID NO: 1018691 - DNA, 22 bp, Artificial Sequence
  chemically synthesized
agttttatttatgtatttgtaa

SEQ ID NO: 1018692 - DNA, 22 bp, Artificial Sequence
  chemically synthesized
cagttttatttatgtatttgta

SEQ ID NO: 1018693 - DNA, 22 bp, Artificial Sequence
  chemically synthesized
tttcagttttatttatgtattt

SEQ ID NO: 1018694 - DNA, 22 bp, Artificial Sequence
  chemically synthesized
acaaatacataaataaaactga

SEQ ID NO: 1018695 - DNA, 22 bp, Artificial Sequence
  chemically synthesized
caaatacataaataaaactgaa

SEQ ID NO: 1018696 - DNA, 22 bp, Artificial Sequence
  chemically synthesized
agtaaaaagtgaattgtttcag

SEQ ID NO: 1018697 - DNA, 22 bp, Artificial Sequence
  chemically synthesized
gaataaagctaagtaaaaagtg

SEQ ID NO: 1018698 - DNA, 22 bp, Artificial Sequence
  chemically synthesized
agaataaagctaagtaaaaagt

SEQ ID NO: 1018699 - DNA, 22 bp, Artificial Sequence
  chemically synthesized
aaacaattcactttttacttag

SEQ ID NO: 1018700 - DNA, 22 bp, Artificial Sequence
  chemically synthesized
ccgtttagaataaagctaagta

SEQ ID NO: 1018701 - DNA, 22 bp, Artificial Sequence
  chemically synthesized
cccgtttagaataaagctaagt

SEQ ID NO: 1018702 - DNA, 22 bp, Artificial Sequence
  chemically synthesized
actttttacttagctttattct

SEQ ID NO: 1018703 - DNA, 22 bp, Artificial Sequence
  chemically synthesized
tttacttagctttattctaaac

SEQ ID NO: 1018704 - DNA, 22 bp, Artificial Sequence
  chemically synthesized
ttacttagctttattctaaacg

SEQ ID NO: 1018705 - DNA, 22 bp, Artificial Sequence
  chemically synthesized
tacttagctttattctaaacgg

SEQ ID NO: 1018706 - DNA, 22 bp, Artificial Sequence
  chemically synthesized
acttagctttattctaaacggg

SEQ ID NO: 1018707 - DNA, 22 bp, Artificial Sequence
  chemically synthesized
cttagctttattctaaacggga

SEQ ID NO: 1018708 - DNA, 22 bp, Artificial Sequence
  chemically synthesized
agctttattctaaacgggaaat

SEQ ID NO: 1018709 - DNA, 22 bp, Artificial Sequence
  chemically synthesized
gctttattctaaacgggaaatt

SEQ ID NO: 1018710 - DNA, 22 bp, Artificial Sequence
  chemically synthesized
tattctaaacgggaaattctat

SEQ ID NO: 1018711 - DNA, 22 bp, Artificial Sequence
  chemically synthesized
attctaaacgggaaattctatt

SEQ ID NO: 1018712 - DNA, 22 bp, Artificial Sequence
  chemically synthesized
ttctaaacgggaaattctattt

SEQ ID NO: 1018713 - DNA, 22 bp, Artificial Sequence
  chemically synthesized
taaacgggaaattctattttct

SEQ ID NO: 1018714 - DNA, 22 bp, Artificial Sequence
  chemically synthesized
aacgggaaattctattttctct

SEQ ID NO: 1018715 - DNA, 22 bp, Artificial Sequence
  chemically synthesized
tattttctctcttactactatt

SEQ ID NO: 1018716 - DNA, 22 bp, Artificial Sequence
  chemically synthesized
ttttctctcttactactattct

SEQ ID NO: 1018717 - DNA, 22 bp, Artificial Sequence
  chemically synthesized
tctctcttactactattctact

SEQ ID NO: 1018718 - DNA, 22 bp, Artificial Sequence
  chemically synthesized
ctctcttactactattctactt

SEQ ID NO: 1018719 - DNA, 22 bp, Artificial Sequence
  chemically synthesized
tctcttactactattctacttt

SEQ ID NO: 1018720 - DNA, 22 bp, Artificial Sequence
  chemically synthesized
tcttactactattctactttct

SEQ ID NO: 1018721 - DNA, 22 bp, Artificial Sequence
  chemically synthesized
ttactactattctactttctct

SEQ ID NO: 1018722 - DNA, 22 bp, Artificial Sequence
  chemically synthesized
actactattctactttctctat

SEQ ID NO: 1018723 - DNA, 22 bp, Artificial Sequence
  chemically synthesized
ctactattctactttctctatt

SEQ ID NO: 1018724 - DNA, 22 bp, Artificial Sequence
  chemically synthesized
ctattctactttctctattttc

SEQ ID NO: 1018725 - DNA, 22 bp, Artificial Sequence
  chemically synthesized
ttctactttctctattttctct

SEQ ID NO: 1018726 - DNA, 22 bp, Artificial Sequence
  chemically synthesized
tactttctctattttctctcac

SEQ ID NO: 1018727 - DNA, 22 bp, Artificial Sequence
  chemically synthesized
ctttctctattttctctcactg

SEQ ID NO: 1018728 - DNA, 22 bp, Artificial Sequence
  chemically synthesized
tctctattttctctcactggca

SEQ ID NO: 1018729 - DNA, 22 bp, Artificial Sequence
  chemically synthesized
ctctattttctctcactggcac

SEQ ID NO: 1018730 - DNA, 22 bp, Artificial Sequence
  chemically synthesized
tggaaggtaatggtgccagtga

SEQ ID NO: 1018731 - DNA, 22 bp, Artificial Sequence
  chemically synthesized
tctattttctctcactggcacc

SEQ ID NO: 1018732 - DNA, 22 bp, Artificial Sequence
  chemically synthesized
gtggaaggtaatggtgccagtg

SEQ ID NO: 1018733 - DNA, 22 bp, Artificial Sequence
  chemically synthesized
tattttctctcactggcaccat

SEQ ID NO: 1018734 - DNA, 22 bp, Artificial Sequence
  chemically synthesized
ttttctctcactggcaccatta

SEQ ID NO: 1018735 - DNA, 22 bp, Artificial Sequence
  chemically synthesized
tctctcactggcaccattacct

SEQ ID NO: 1018736 - DNA, 22 bp, Artificial Sequence
  chemically synthesized
ctctcactggcaccattacctt

SEQ ID NO: 1018737 - DNA, 22 bp, Artificial Sequence
  chemically synthesized
tctcactggcaccattaccttc

SEQ ID NO: 1018738 - DNA, 22 bp, Artificial Sequence
  chemically synthesized
tcactggcaccattaccttcca

SEQ ID NO: 1018739 - DNA, 22 bp, Artificial Sequence
  chemically synthesized
actggcaccattaccttccaca

SEQ ID NO: 1018740 - DNA, 22 bp, Artificial Sequence
  chemically synthesized
gcaccattaccttccacaagac

SEQ ID NO: 1018741 - DNA, 22 bp, Artificial Sequence
  chemically synthesized
acaggaaaaacagtcttgtgga

SEQ ID NO: 1018742 - DNA, 22 bp, Artificial Sequence
  chemically synthesized
cacaggaaaaacagtcttgtgg

SEQ ID NO: 1018743 - DNA, 22 bp, Artificial Sequence
  chemically synthesized
ccttcacaggaaaaacagtctt

SEQ ID NO: 1018744 - DNA, 22 bp, Artificial Sequence
  chemically synthesized
ccttccacaagactgtttttcc

SEQ ID NO: 1018745 - DNA, 22 bp, Artificial Sequence
  chemically synthesized
taactaccttcacaggaaaaac

SEQ ID NO: 1018746 - DNA, 22 bp, Artificial Sequence
  chemically synthesized
ccacaagactgtttttcctgtg

SEQ ID NO: 1018747 - DNA, 22 bp, Artificial Sequence
  chemically synthesized
cacaagactgtttttcctgtga

SEQ ID NO: 1018748 - DNA, 22 bp, Artificial Sequence
  chemically synthesized
attataactaccttcacaggaa

SEQ ID NO: 1018749 - DNA, 22 bp, Artificial Sequence
  chemically synthesized
ttaattataactaccttcacag

SEQ ID NO: 1018750 - DNA, 22 bp, Artificial Sequence
  chemically synthesized
gttaattataactaccttcaca

SEQ ID NO: 1018751 - DNA, 22 bp, Artificial Sequence
  chemically synthesized
ttgttaattataactaccttca

SEQ ID NO: 1018752 - DNA, 22 bp, Artificial Sequence
  chemically synthesized
tttttcctgtgaaggtagttat

SEQ ID NO: 1018753 - DNA, 22 bp, Artificial Sequence
  chemically synthesized
ttcctgtgaaggtagttataat

SEQ ID NO: 1018754 - DNA, 22 bp, Artificial Sequence
  chemically synthesized
tcctgtgaaggtagttataatt

SEQ ID NO: 1018755 - DNA, 22 bp, Artificial Sequence
  chemically synthesized
cctgtgaaggtagttataatta

SEQ ID NO: 1018756 - DNA, 22 bp, Artificial Sequence
  chemically synthesized
ctgtgaaggtagttataattaa

SEQ ID NO: 1018757 - DNA, 22 bp, Artificial Sequence
  chemically synthesized
tgaaggtagttataattaacaa

SEQ ID NO: 1018758 - DNA, 22 bp, Artificial Sequence
  chemically synthesized
tgtgtgtataggctcttgttaa

SEQ ID NO: 1018759 - DNA, 22 bp, Artificial Sequence
  chemically synthesized
atgtgtgtataggctcttgtta

SEQ ID NO: 1018760 - DNA, 22 bp, Artificial Sequence
  chemically synthesized
tatgtgtgtataggctcttgtt

SEQ ID NO: 1018761 - DNA, 22 bp, Artificial Sequence
  chemically synthesized
ttatgtgtgtataggctcttgt

SEQ ID NO: 1018762 - DNA, 22 bp, Artificial Sequence
  chemically synthesized
taattaacaagagcctatacac

SEQ ID NO: 1018763 - DNA, 22 bp, Artificial Sequence
  chemically synthesized
acaagagcctatacacacataa

SEQ ID NO: 1018764 - DNA, 22 bp, Artificial Sequence
  chemically synthesized
atatggtaaatgaaaactttta

SEQ ID NO: 1018765 - DNA, 22 bp, Artificial Sequence
  chemically synthesized
tacacacataaaagttttcatt

SEQ ID NO: 1018766 - DNA, 22 bp, Artificial Sequence
  chemically synthesized
actaatatggtaaatgaaaact

SEQ ID NO: 1018767 - DNA, 22 bp, Artificial Sequence
  chemically synthesized
atatgttcactaatatggtaaa

SEQ ID NO: 1018768 - DNA, 22 bp, Artificial Sequence
  chemically synthesized
gatatgttcactaatatggtaa

SEQ ID NO: 1018769 - DNA, 22 bp, Artificial Sequence
  chemically synthesized
tcatttaccatattagtgaaca

SEQ ID NO: 1018770 - DNA, 22 bp, Artificial Sequence
  chemically synthesized
catttaccatattagtgaacat

SEQ ID NO: 1018771 - DNA, 22 bp, Artificial Sequence
  chemically synthesized
atttaccatattagtgaacata

SEQ ID NO: 1018772 - DNA, 22 bp, Artificial Sequence
  chemically synthesized
accatattagtgaacatatcaa

SEQ ID NO: 1018773 - DNA, 22 bp, Artificial Sequence
  chemically synthesized
ccatattagtgaacatatcaag

SEQ ID NO: 1018774 - DNA, 22 bp, Artificial Sequence
  chemically synthesized
agaaaaatgatagcttgatatg

SEQ ID NO: 1018775 - DNA, 22 bp, Artificial Sequence
  chemically synthesized
gtgaacatatcaagctatcatt

SEQ ID NO: 1018776 - DNA, 22 bp, Artificial Sequence
  chemically synthesized
gtaaacattaagaaaaatgata

SEQ ID NO: 1018777 - DNA, 22 bp, Artificial Sequence
  chemically synthesized
agtaaacattaagaaaaatgat

SEQ ID NO: 1018778 - DNA, 22 bp, Artificial Sequence
  chemically synthesized
tcatttttcttaatgtttacta

SEQ ID NO: 1018779 - DNA, 22 bp, Artificial Sequence
  chemically synthesized
aataaagtaaaacttagtaaac

SEQ ID NO: 1018780 - DNA, 22 bp, Artificial Sequence
  chemically synthesized
caataaagtaaaacttagtaaa

SEQ ID NO: 1018781 - DNA, 22 bp, Artificial Sequence
  chemically synthesized
ttcttaatgtttactaagtttt

SEQ ID NO: 1018782 - DNA, 22 bp, Artificial Sequence
  chemically synthesized
tcttaatgtttactaagtttta

SEQ ID NO: 1018783 - DNA, 22 bp, Artificial Sequence
  chemically synthesized
gtttcaataaagtaaaacttag

SEQ ID NO: 1018784 - DNA, 22 bp, Artificial Sequence
  chemically synthesized
cttaatgtttactaagttttac

SEQ ID NO: 1018785 - DNA, 22 bp, Artificial Sequence
  chemically synthesized
ttaatgtttactaagttttact

SEQ ID NO: 1018786 - DNA, 22 bp, Artificial Sequence
  chemically synthesized
aatgtttactaagttttacttt

SEQ ID NO: 1018787 - DNA, 22 bp, Artificial Sequence
  chemically synthesized
atgtttactaagttttacttta

SEQ ID NO: 1018788 - DNA, 22 bp, Artificial Sequence
  chemically synthesized
agattggtttcaataaagtaaa

SEQ ID NO: 1018789 - DNA, 22 bp, Artificial Sequence
  chemically synthesized
gagattggtttcaataaagtaa

SEQ ID NO: 1018790 - DNA, 22 bp, Artificial Sequence
  chemically synthesized
tgagattggtttcaataaagta

SEQ ID NO: 1018791 - DNA, 22 bp, Artificial Sequence
  chemically synthesized
actaagttttactttattgaaa

SEQ ID NO: 1018792 - DNA, 22 bp, Artificial Sequence
  chemically synthesized
ctaagttttactttattgaaac

SEQ ID NO: 1018793 - DNA, 22 bp, Artificial Sequence
  chemically synthesized
agttttactttattgaaaccaa

SEQ ID NO: 1018794 - DNA, 22 bp, Artificial Sequence
  chemically synthesized
caacctttgagattggtttcaa

SEQ ID NO: 1018795 - DNA, 22 bp, Artificial Sequence
  chemically synthesized
tactttattgaaaccaatctca

SEQ ID NO: 1018796 - DNA, 22 bp, Artificial Sequence
  chemically synthesized
actttattgaaaccaatctcaa

SEQ ID NO: 1018797 - DNA, 22 bp, Artificial Sequence
  chemically synthesized
ctttattgaaaccaatctcaaa

SEQ ID NO: 1018798 - DNA, 22 bp, Artificial Sequence
  chemically synthesized
aatgctgcaacctttgagattg

SEQ ID NO: 1018799 - DNA, 22 bp, Artificial Sequence
  chemically synthesized
aaatgctgcaacctttgagatt

SEQ ID NO: 1018800 - DNA, 22 bp, Artificial Sequence
  chemically synthesized
taaatgctgcaacctttgagat

SEQ ID NO: 1018801 - DNA, 22 bp, Artificial Sequence
  chemically synthesized
tattgaaaccaatctcaaaggt

SEQ ID NO: 1018802 - DNA, 22 bp, Artificial Sequence
  chemically synthesized
ttaaatgctgcaacctttgaga

SEQ ID NO: 1018803 - DNA, 22 bp, Artificial Sequence
  chemically synthesized
attgaaaccaatctcaaaggtt

SEQ ID NO: 1018804 - DNA, 22 bp, Artificial Sequence
  chemically synthesized
tttaaatgctgcaacctttgag

SEQ ID NO: 1018805 - DNA, 22 bp, Artificial Sequence
  chemically synthesized
ttgaaaccaatctcaaaggttg

SEQ ID NO: 1018806 - DNA, 22 bp, Artificial Sequence
  chemically synthesized
ttttaaatgctgcaacctttga

SEQ ID NO: 1018807 - DNA, 22 bp, Artificial Sequence
  chemically synthesized
aaaccaatctcaaaggttgcag

SEQ ID NO: 1018808 - DNA, 22 bp, Artificial Sequence
  chemically synthesized
taaatgtcacttttttaaatgc

SEQ ID NO: 1018809 - DNA, 22 bp, Artificial Sequence
  chemically synthesized
aaaggttgcagcatttaaaaaa

SEQ ID NO: 1018810 - DNA, 22 bp, Artificial Sequence
  chemically synthesized
agaattataaatgtcacttttt

SEQ ID NO: 1018811 - DNA, 22 bp, Artificial Sequence
  chemically synthesized
cagcatttaaaaaagtgacatt

SEQ ID NO: 1018812 - DNA, 22 bp, Artificial Sequence
  chemically synthesized
taattgagaattataaatgtca

SEQ ID NO: 1018813 - DNA, 22 bp, Artificial Sequence
  chemically synthesized
ataattgagaattataaatgtc

SEQ ID NO: 1018814 - DNA, 22 bp, Artificial Sequence
  chemically synthesized
tataattgagaattataaatgt

SEQ ID NO: 1018815 - DNA, 22 bp, Artificial Sequence
  chemically synthesized
aaaaaagtgacatttataattc

SEQ ID NO: 1018816 - DNA, 22 bp, Artificial Sequence
  chemically synthesized
ttttataattgagaattataaa

SEQ ID NO: 1018817 - DNA, 22 bp, Artificial Sequence
  chemically synthesized
aaaaagtgacatttataattct

SEQ ID NO: 1018818 - DNA, 22 bp, Artificial Sequence
  chemically synthesized
gaaaattattttataattgaga

SEQ ID NO: 1018819 - DNA, 22 bp, Artificial Sequence
  chemically synthesized
ggaaaattattttataattgag

SEQ ID NO: 1018820 - DNA, 22 bp, Artificial Sequence
  chemically synthesized
tggaaaattattttataattga

SEQ ID NO: 1018821 - DNA, 22 bp, Artificial Sequence
  chemically synthesized
tttggaaaattattttataatt

SEQ ID NO: 1018822 - DNA, 22 bp, Artificial Sequence
  chemically synthesized
ctttggaaaattattttataat

SEQ ID NO: 1018823 - DNA, 22 bp, Artificial Sequence
  chemically synthesized
tctttggaaaattattttataa

SEQ ID NO: 1018824 - DNA, 22 bp, Artificial Sequence
  chemically synthesized
ataattctcaattataaaataa

SEQ ID NO: 1018825 - DNA, 22 bp, Artificial Sequence
  chemically synthesized
taattctcaattataaaataat

SEQ ID NO: 1018826 - DNA, 22 bp, Artificial Sequence
  chemically synthesized
tttctttggaaaattattttat

SEQ ID NO: 1018827 - DNA, 22 bp, Artificial Sequence
  chemically synthesized
ctttctttggaaaattatttta

SEQ ID NO: 1018828 - DNA, 22 bp, Artificial Sequence
  chemically synthesized
tctttctttggaaaattatttt

SEQ ID NO: 1018829 - DNA, 22 bp, Artificial Sequence
  chemically synthesized
ttctttctttggaaaattattt

SEQ ID NO: 1018830 - DNA, 22 bp, Artificial Sequence
  chemically synthesized
tttctttctttggaaaattatt

SEQ ID NO: 1018831 - DNA, 22 bp, Artificial Sequence
  chemically synthesized
ttttctttctttggaaaattat

SEQ ID NO: 1018832 - DNA, 22 bp, Artificial Sequence
  chemically synthesized
tcaattataaaataattttcca

SEQ ID NO: 1018833 - DNA, 22 bp, Artificial Sequence
  chemically synthesized
aattataaaataattttccaaa

SEQ ID NO: 1018834 - DNA, 22 bp, Artificial Sequence
  chemically synthesized
gaatttttttctttctttggaa

SEQ ID NO: 1018835 - DNA, 22 bp, Artificial Sequence
  chemically synthesized
taaaataattttccaaagaaag

SEQ ID NO: 1018836 - DNA, 22 bp, Artificial Sequence
  chemically synthesized
tccaaagaaagaaaaaaattcc

SEQ ID NO: 1018837 - DNA, 22 bp, Artificial Sequence
  chemically synthesized
ccaaagaaagaaaaaaattcca

SEQ ID NO: 1018838 - DNA, 22 bp, Artificial Sequence
  chemically synthesized
taaaagtaaaattggaattttt

SEQ ID NO: 1018839 - DNA, 22 bp, Artificial Sequence
  chemically synthesized
caaagaaagaaaaaaattccaa

SEQ ID NO: 1018840 - DNA, 22 bp, Artificial Sequence
  chemically synthesized
ataaaagtaaaattggaatttt

SEQ ID NO: 1018841 - DNA, 22 bp, Artificial Sequence
  chemically synthesized
caacttataaaagtaaaattgg

SEQ ID NO: 1018842 - DNA, 22 bp, Artificial Sequence
  chemically synthesized
caattttacttttataagttgg

SEQ ID NO: 1018843 - DNA, 22 bp, Artificial Sequence
  chemically synthesized
tacttttataagttggaattta

SEQ ID NO: 1018844 - DNA, 22 bp, Artificial Sequence
  chemically synthesized
acttttataagttggaatttac

SEQ ID NO: 1018845 - DNA, 22 bp, Artificial Sequence
  chemically synthesized
tgtgtatatatagtaaattcca

SEQ ID NO: 1018846 - DNA, 22 bp, Artificial Sequence
  chemically synthesized
cttttataagttggaatttact

SEQ ID NO: 1018847 - DNA, 22 bp, Artificial Sequence
  chemically synthesized
gtgtgtatatatagtaaattcc

SEQ ID NO: 1018848 - DNA, 22 bp, Artificial Sequence
  chemically synthesized
ttataagttggaatttactata

SEQ ID NO: 1018849 - DNA, 22 bp, Artificial Sequence
  chemically synthesized
tataagttggaatttactatat

SEQ ID NO: 1018850 - DNA, 22 bp, Artificial Sequence
  chemically synthesized
ataagttggaatttactatata

SEQ ID NO: 1018851 - DNA, 22 bp, Artificial Sequence
  chemically synthesized
tatttgtgtgtatatatagtaa

SEQ ID NO: 1018852 - DNA, 22 bp, Artificial Sequence
  chemically synthesized
taagttggaatttactatatat

SEQ ID NO: 1018853 - DNA, 22 bp, Artificial Sequence
  chemically synthesized
gaatttactatatatacacaca

SEQ ID NO: 1018854 - DNA, 22 bp, Artificial Sequence
  chemically synthesized
actatatatacacacaaatata

SEQ ID NO: 1018855 - DNA, 22 bp, Artificial Sequence
  chemically synthesized
ctatatatacacacaaatatag

SEQ ID NO: 1018856 - DNA, 22 bp, Artificial Sequence
  chemically synthesized
tatatacacacaaatatagtat

SEQ ID NO: 1018857 - DNA, 22 bp, Artificial Sequence
  chemically synthesized
caaacacacacaaatcatacta

SEQ ID NO: 1018858 - DNA, 22 bp, Artificial Sequence
  chemically synthesized
tgtgttgcaaacacacacaaat

SEQ ID NO: 1018859 - DNA, 22 bp, Artificial Sequence
  chemically synthesized
gtgtgttgcaaacacacacaaa

SEQ ID NO: 1018860 - DNA, 22 bp, Artificial Sequence
  chemically synthesized
tatttgtgtgttgcaaacacac

SEQ ID NO: 1018861 - DNA, 22 bp, Artificial Sequence
  chemically synthesized
gtgtgtgtttgcaacacacaaa

SEQ ID NO: 1018862 - DNA, 22 bp, Artificial Sequence
  chemically synthesized
aataatactatatttgtgtgtt

SEQ ID NO: 1018863 - DNA, 22 bp, Artificial Sequence
  chemically synthesized
tgtgtgtttgcaacacacaaat

SEQ ID NO: 1018864 - DNA, 22 bp, Artificial Sequence
  chemically synthesized
caataatactatatttgtgtgt

SEQ ID NO: 1018865 - DNA, 22 bp, Artificial Sequence
  chemically synthesized
tcaataatactatatttgtgtg

SEQ ID NO: 1018866 - DNA, 22 bp, Artificial Sequence
  chemically synthesized
ttcaataatactatatttgtgt

SEQ ID NO: 1018867 - DNA, 22 bp, Artificial Sequence
  chemically synthesized
tttcaataatactatatttgtg

SEQ ID NO: 1018868 - DNA, 22 bp, Artificial Sequence
  chemically synthesized
ctttttcaataatactatattt

SEQ ID NO: 1018869 - DNA, 22 bp, Artificial Sequence
  chemically synthesized
gcaacacacaaatatagtatta

SEQ ID NO: 1018870 - DNA, 22 bp, Artificial Sequence
  chemically synthesized
ctcctttttcaataatactata

SEQ ID NO: 1018871 - DNA, 22 bp, Artificial Sequence
  chemically synthesized
caacacacaaatatagtattat

SEQ ID NO: 1018872 - DNA, 22 bp, Artificial Sequence
  chemically synthesized
aattcctcctttttcaataata

SEQ ID NO: 1018873 - DNA, 22 bp, Artificial Sequence
  chemically synthesized
gaacatctaaattcctcctttt

SEQ ID NO: 1018874 - DNA, 22 bp, Artificial Sequence
  chemically synthesized
ggaacatctaaattcctccttt

SEQ ID NO: 1018875 - DNA, 22 bp, Artificial Sequence
  chemically synthesized
ttgaaaaaggaggaatttagat

SEQ ID NO: 1018876 - DNA, 22 bp, Artificial Sequence
  chemically synthesized
atgccacttggaacatctaaat

SEQ ID NO: 1018877 - DNA, 22 bp, Artificial Sequence
  chemically synthesized
aaaaaggaggaatttagatgtt

SEQ ID NO: 1018878 - DNA, 22 bp, Artificial Sequence
  chemically synthesized
ttaatgccacttggaacatcta

SEQ ID NO: 1018879 - DNA, 22 bp, Artificial Sequence
  chemically synthesized
tgttaatgccacttggaacatc

SEQ ID NO: 1018880 - DNA, 22 bp, Artificial Sequence
  chemically synthesized
ctgttaatgccacttggaacat

SEQ ID NO: 1018881 - DNA, 22 bp, Artificial Sequence
  chemically synthesized
tctgttaatgccacttggaaca

SEQ ID NO: 1018882 - DNA, 22 bp, Artificial Sequence
  chemically synthesized
attttctgttaatgccacttgg

SEQ ID NO: 1018883 - DNA, 22 bp, Artificial Sequence
  chemically synthesized
agatgttccaagtggcattaac

SEQ ID NO: 1018884 - DNA, 22 bp, Artificial Sequence
  chemically synthesized
gatgttccaagtggcattaaca

SEQ ID NO: 1018885 - DNA, 22 bp, Artificial Sequence
  chemically synthesized
agaactaattttctgttaatgc

SEQ ID NO: 1018886 - DNA, 22 bp, Artificial Sequence
  chemically synthesized
cagaactaattttctgttaatg

SEQ ID NO: 1018887 - DNA, 22 bp, Artificial Sequence
  chemically synthesized
caagtggcattaacagaaaatt

SEQ ID NO: 1018888 - DNA, 22 bp, Artificial Sequence
  chemically synthesized
gcataatttcagaactaatttt

SEQ ID NO: 1018889 - DNA, 22 bp, Artificial Sequence
  chemically synthesized
atctggcataatttcagaacta

SEQ ID NO: 1018890 - DNA, 22 bp, Artificial Sequence
  chemically synthesized
acagaaaattagttctgaaatt

SEQ ID NO: 1018891 - DNA, 22 bp, Artificial Sequence
  chemically synthesized
aaatgctaatctggcataattt

SEQ ID NO: 1018892 - DNA, 22 bp, Artificial Sequence
  chemically synthesized
gttgaaatgctaatctggcata

SEQ ID NO: 1018893 - DNA, 22 bp, Artificial Sequence
  chemically synthesized
gttctgaaattatgccagatta

SEQ ID NO: 1018894 - DNA, 22 bp, Artificial Sequence
  chemically synthesized
tagttgaaatgctaatctggca

SEQ ID NO: 1018895 - DNA, 22 bp, Artificial Sequence
  chemically synthesized
ctagttgaaatgctaatctggc

SEQ ID NO: 1018896 - DNA, 22 bp, Artificial Sequence
  chemically synthesized
tgaaattatgccagattagcat

SEQ ID NO: 1018897 - DNA, 22 bp, Artificial Sequence
  chemically synthesized
aaattatgccagattagcattt

SEQ ID NO: 1018898 - DNA, 22 bp, Artificial Sequence
  chemically synthesized
gcataatttctagttgaaatgc

SEQ ID NO: 1018899 - DNA, 22 bp, Artificial Sequence
  chemically synthesized
tgccagattagcatttcaacta

SEQ ID NO: 1018900 - DNA, 22 bp, Artificial Sequence
  chemically synthesized
atctggcataatttctagttga

SEQ ID NO: 1018901 - DNA, 22 bp, Artificial Sequence
  chemically synthesized
gcatttcaactagaaattatgc

SEQ ID NO: 1018902 - DNA, 22 bp, Artificial Sequence
  chemically synthesized
aaatgctaatctggcataattt

SEQ ID NO: 1018903 - DNA, 22 bp, Artificial Sequence
  chemically synthesized
gttgaaatgctaatctggcata

SEQ ID NO: 1018904 - DNA, 22 bp, Artificial Sequence
  chemically synthesized
caactagaaattatgccagatt

SEQ ID NO: 1018905 - DNA, 22 bp, Artificial Sequence
  chemically synthesized
aactagaaattatgccagatta

SEQ ID NO: 1018906 - DNA, 22 bp, Artificial Sequence
  chemically synthesized
tagttgaaatgctaatctggca

SEQ ID NO: 1018907 - DNA, 22 bp, Artificial Sequence
  chemically synthesized
ctagttgaaatgctaatctggc

SEQ ID NO: 1018908 - DNA, 22 bp, Artificial Sequence
  chemically synthesized
tttctagttgaaatgctaatct

SEQ ID NO: 1018909 - DNA, 22 bp, Artificial Sequence
  chemically synthesized
gaaattatgccagattagcatt

SEQ ID NO: 1018910 - DNA, 22 bp, Artificial Sequence
  chemically synthesized
ctatttctagttgaaatgctaa

SEQ ID NO: 1018911 - DNA, 22 bp, Artificial Sequence
  chemically synthesized
gctatttctagttgaaatgcta

SEQ ID NO: 1018912 - DNA, 22 bp, Artificial Sequence
  chemically synthesized
cttgctatttctagttgaaatg

SEQ ID NO: 1018913 - DNA, 22 bp, Artificial Sequence
  chemically synthesized
tgccagattagcatttcaacta

SEQ ID NO: 1018914 - DNA, 22 bp, Artificial Sequence
  chemically synthesized
ccttgctatttctagttgaaat

SEQ ID NO: 1018915 - DNA, 22 bp, Artificial Sequence
  chemically synthesized
tccttgctatttctagttgaaa

SEQ ID NO: 1018916 - DNA, 22 bp, Artificial Sequence
  chemically synthesized
ttccttgctatttctagttgaa

SEQ ID NO: 1018917 - DNA, 22 bp, Artificial Sequence
  chemically synthesized
gaagtttttccttgctatttct

SEQ ID NO: 1018918 - DNA, 22 bp, Artificial Sequence
  chemically synthesized
gcatttcaactagaaatagcaa

SEQ ID NO: 1018919 - DNA, 22 bp, Artificial Sequence
  chemically synthesized
caactagaaatagcaaggaaaa

SEQ ID NO: 1018920 - DNA, 22 bp, Artificial Sequence
  chemically synthesized
tagcctagaagtttttccttgc

SEQ ID NO: 1018921 - DNA, 22 bp, Artificial Sequence
  chemically synthesized
aactagaaatagcaaggaaaaa

SEQ ID NO: 1018922 - DNA, 22 bp, Artificial Sequence
  chemically synthesized
atagcctagaagtttttccttg

SEQ ID NO: 1018923 - DNA, 22 bp, Artificial Sequence
  chemically synthesized
ttatagcctagaagtttttcct

SEQ ID NO: 1018924 - DNA, 22 bp, Artificial Sequence
  chemically synthesized
gaaatagcaaggaaaaacttct

SEQ ID NO: 1018925 - DNA, 22 bp, Artificial Sequence
  chemically synthesized
tgacctcttatagcctagaagt

SEQ ID NO: 1018926 - DNA, 22 bp, Artificial Sequence
  chemically synthesized
atgacctcttatagcctagaag

SEQ ID NO: 1018927 - DNA, 22 bp, Artificial Sequence
  chemically synthesized
cttatgacctcttatagcctag

SEQ ID NO: 1018928 - DNA, 22 bp, Artificial Sequence
  chemically synthesized
ctacttatgacctcttatagcc

SEQ ID NO: 1018929 - DNA, 22 bp, Artificial Sequence
  chemically synthesized
actacttatgacctcttatagc

SEQ ID NO: 1018930 - DNA, 22 bp, Artificial Sequence
  chemically synthesized
tactacttatgacctcttatag

SEQ ID NO: 1018931 - DNA, 22 bp, Artificial Sequence
  chemically synthesized
tttactacttatgacctcttat

SEQ ID NO: 1018932 - DNA, 22 bp, Artificial Sequence
  chemically synthesized
ctttactacttatgacctctta

SEQ ID NO: 1018933 - DNA, 22 bp, Artificial Sequence
  chemically synthesized
tctttactacttatgacctctt

SEQ ID NO: 1018934 - DNA, 22 bp, Artificial Sequence
  chemically synthesized
ctaggctataagaggtcataag

SEQ ID NO: 1018935 - DNA, 22 bp, Artificial Sequence
  chemically synthesized
ttttctttactacttatgacct

SEQ ID NO: 1018936 - DNA, 22 bp, Artificial Sequence
  chemically synthesized
taggctataagaggtcataagt

SEQ ID NO: 1018937 - DNA, 22 bp, Artificial Sequence
  chemically synthesized
attttctttactacttatgacc

SEQ ID NO: 1018938 - DNA, 22 bp, Artificial Sequence
  chemically synthesized
ggctataagaggtcataagtag

SEQ ID NO: 1018939 - DNA, 22 bp, Artificial Sequence
  chemically synthesized
ttattttctttactacttatga

SEQ ID NO: 1018940 - DNA, 22 bp, Artificial Sequence
  chemically synthesized
taagaggtcataagtagtaaag

SEQ ID NO: 1018941 - DNA, 22 bp, Artificial Sequence
  chemically synthesized
aaaatagttcttattttcttta

SEQ ID NO: 1018942 - DNA, 22 bp, Artificial Sequence
  chemically synthesized
ctgaaaatagttcttattttct

SEQ ID NO: 1018943 - DNA, 22 bp, Artificial Sequence
  chemically synthesized
ccggcagaataggtcatgtctc

SEQ ID NO: 1018944 - DNA, 22 bp, Artificial Sequence
  chemically synthesized
ttttcaggagacatgacctatt

SEQ ID NO: 1018945 - DNA, 22 bp, Artificial Sequence
  chemically synthesized
tcaggagacatgacctattctg

SEQ ID NO: 1018946 - DNA, 22 bp, Artificial Sequence
  chemically synthesized
caggagacatgacctattctgc

SEQ ID NO: 1018947 - DNA, 22 bp, Artificial Sequence
  chemically synthesized
aggagacatgacctattctgcc

SEQ ID NO: 1018948 - DNA, 22 bp, Artificial Sequence
  chemically synthesized
tgggtgcaactcccggcagaat

SEQ ID NO: 1018949 - DNA, 22 bp, Artificial Sequence
  chemically synthesized
atgggtgcaactcccggcagaa

SEQ ID NO: 1018950 - DNA, 22 bp, Artificial Sequence
  chemically synthesized
ccttatgggtgcaactcccggc

SEQ ID NO: 1018951 - DNA, 22 bp, Artificial Sequence
  chemically synthesized
tgccttatgggtgcaactcccg

SEQ ID NO: 1018952 - DNA, 22 bp, Artificial Sequence
  chemically synthesized
cctctgccttatgggtgcaact

SEQ ID NO: 1018953 - DNA, 22 bp, Artificial Sequence
  chemically synthesized
ttctgccgggagttgcacccat

SEQ ID NO: 1018954 - DNA, 22 bp, Artificial Sequence
  chemically synthesized
tgccgggagttgcacccataag

SEQ ID NO: 1018955 - DNA, 22 bp, Artificial Sequence
  chemically synthesized
ccgggagttgcacccataaggc

SEQ ID NO: 1018956 - DNA, 22 bp, Artificial Sequence
  chemically synthesized
gacccgttccctctgccttatg

SEQ ID NO: 1018957 - DNA, 22 bp, Artificial Sequence
  chemically synthesized
ggacccgttccctctgccttat

SEQ ID NO: 1018958 - DNA, 22 bp, Artificial Sequence
  chemically synthesized
tggacccgttccctctgcctta

SEQ ID NO: 1018959 - DNA, 22 bp, Artificial Sequence
  chemically synthesized
cacccataaggcagagggaacg

SEQ ID NO: 1018960 - DNA, 22 bp, Artificial Sequence
  chemically synthesized
taagaaaatattttggacccgt

SEQ ID NO: 1018961 - DNA, 22 bp, Artificial Sequence
  chemically synthesized
ataagaaaatattttggacccg

SEQ ID NO: 1018962 - DNA, 22 bp, Artificial Sequence
  chemically synthesized
tataagaaaatattttggaccc

SEQ ID NO: 1018963 - DNA, 22 bp, Artificial Sequence
  chemically synthesized
ttataagaaaatattttggacc

SEQ ID NO: 1018964 - DNA, 22 bp, Artificial Sequence
  chemically synthesized
tttttataagaaaatattttgg

SEQ ID NO: 1018965 - DNA, 22 bp, Artificial Sequence
  chemically synthesized
tatttttataagaaaatatttt

SEQ ID NO: 1018966 - DNA, 22 bp, Artificial Sequence
  chemically synthesized
tatctctatttttataagaaaa

SEQ ID NO: 1018967 - DNA, 22 bp, Artificial Sequence
  chemically synthesized
ctgtatctctatttttataaga

SEQ ID NO: 1018968 - DNA, 22 bp, Artificial Sequence
  chemically synthesized
attactgtatctctatttttat

SEQ ID NO: 1018969 - DNA, 22 bp, Artificial Sequence
  chemically synthesized
aaattaattactgtatctctat

SEQ ID NO: 1018970 - DNA, 22 bp, Artificial Sequence
  chemically synthesized
gaaattaattactgtatctcta

SEQ ID NO: 1018971 - DNA, 22 bp, Artificial Sequence
  chemically synthesized
tcttataaaaatagagatacag

SEQ ID NO: 1018972 - DNA, 22 bp, Artificial Sequence
  chemically synthesized
cttataaaaatagagatacagt

SEQ ID NO: 1018973 - DNA, 22 bp, Artificial Sequence
  chemically synthesized
ttataaaaatagagatacagta

SEQ ID NO: 1018974 - DNA, 22 bp, Artificial Sequence
  chemically synthesized
ccttgaaattaattactgtatc

SEQ ID NO: 1018975 - DNA, 22 bp, Artificial Sequence
  chemically synthesized
ataaaaatagagatacagtaat

SEQ ID NO: 1018976 - DNA, 22 bp, Artificial Sequence
  chemically synthesized
taaaaatagagatacagtaatt

SEQ ID NO: 1018977 - DNA, 22 bp, Artificial Sequence
  chemically synthesized
aaatctgccttgaaattaatta

SEQ ID NO: 1018978 - DNA, 22 bp, Artificial Sequence
  chemically synthesized
atttcaaggcagatttcagttt

SEQ ID NO: 1018979 - DNA, 22 bp, Artificial Sequence
  chemically synthesized
tcaaaaatagataaactgaaat

SEQ ID NO: 1018980 - DNA, 22 bp, Artificial Sequence
  chemically synthesized
atcaaaaatagataaactgaaa

SEQ ID NO: 1018981 - DNA, 22 bp, Artificial Sequence
  chemically synthesized
caaggcagatttcagtttatct

SEQ ID NO: 1018982 - DNA, 22 bp, Artificial Sequence
  chemically synthesized
aaggcagatttcagtttatcta

SEQ ID NO: 1018983 - DNA, 22 bp, Artificial Sequence
  chemically synthesized
acaaatttatcaaaaatagata

SEQ ID NO: 1018984 - DNA, 22 bp, Artificial Sequence
  chemically synthesized
aacaaatttatcaaaaatagat

SEQ ID NO: 1018985 - DNA, 22 bp, Artificial Sequence
  chemically synthesized
atttaacaaatttatcaaaaat

SEQ ID NO: 1018986 - DNA, 22 bp, Artificial Sequence
  chemically synthesized
cagtttatctatttttgataaa

SEQ ID NO: 1018987 - DNA, 22 bp, Artificial Sequence
  chemically synthesized
agtttatctatttttgataaat

SEQ ID NO: 1018988 - DNA, 22 bp, Artificial Sequence
  chemically synthesized
attgatttaacaaatttatcaa

SEQ ID NO: 1018989 - DNA, 22 bp, Artificial Sequence
  chemically synthesized
aattgatttaacaaatttatca

SEQ ID NO: 1018990 - DNA, 22 bp, Artificial Sequence
  chemically synthesized
atctatttttgataaatttgtt

SEQ ID NO: 1018991 - DNA, 22 bp, Artificial Sequence
  chemically synthesized
tctatttttgataaatttgtta

SEQ ID NO: 1018992 - DNA, 22 bp, Artificial Sequence
  chemically synthesized
tttttgataaatttgttaaatc

SEQ ID NO: 1018993 - DNA, 22 bp, Artificial Sequence
  chemically synthesized
gcatatttaattgatttaacaa

SEQ ID NO: 1018994 - DNA, 22 bp, Artificial Sequence
  chemically synthesized
ttgataaatttgttaaatcaat

SEQ ID NO: 1018995 - DNA, 22 bp, Artificial Sequence
  chemically synthesized
tgataaatttgttaaatcaatt

SEQ ID NO: 1018996 - DNA, 22 bp, Artificial Sequence
  chemically synthesized
gataaatttgttaaatcaatta

SEQ ID NO: 1018997 - DNA, 22 bp, Artificial Sequence
  chemically synthesized
ataaatttgttaaatcaattaa

SEQ ID NO: 1018998 - DNA, 22 bp, Artificial Sequence
  chemically synthesized
gttaaatcaattaaatatgcca

SEQ ID NO: 1018999 - DNA, 22 bp, Artificial Sequence
  chemically synthesized
ataaggggcccctggcatattt

SEQ ID NO: 1019000 - DNA, 22 bp, Artificial Sequence
  chemically synthesized
ttaaatcaattaaatatgccag

SEQ ID NO: 1019001 - DNA, 22 bp, Artificial Sequence
  chemically synthesized
ctaataaggggcccctggcata

SEQ ID NO: 1019002 - DNA, 22 bp, Artificial Sequence
  chemically synthesized
aatcaattaaatatgccagggg

SEQ ID NO: 1019003 - DNA, 22 bp, Artificial Sequence
  chemically synthesized
aatatgccaggggccccttatt

SEQ ID NO: 1019004 - DNA, 22 bp, Artificial Sequence
  chemically synthesized
cagccatactcctaataagggg

SEQ ID NO: 1019005 - DNA, 22 bp, Artificial Sequence
  chemically synthesized
acagccatactcctaataaggg

SEQ ID NO: 1019006 - DNA, 22 bp, Artificial Sequence
  chemically synthesized
gccttacagccatactcctaat

SEQ ID NO: 1019007 - DNA, 22 bp, Artificial Sequence
  chemically synthesized
aaattagccttacagccatact

SEQ ID NO: 1019008 - DNA, 22 bp, Artificial Sequence
  chemically synthesized
attaggagtatggctgtaaggc

SEQ ID NO: 1019009 - DNA, 22 bp, Artificial Sequence
  chemically synthesized
aaactaaaattagccttacagc

SEQ ID NO: 1019010 - DNA, 22 bp, Artificial Sequence
  chemically synthesized
ttaggagtatggctgtaaggct

SEQ ID NO: 1019011 - DNA, 22 bp, Artificial Sequence
  chemically synthesized
ggagtatggctgtaaggctaat

SEQ ID NO: 1019012 - DNA, 22 bp, Artificial Sequence
  chemically synthesized
taaggctaattttagtttgaat

SEQ ID NO: 1019013 - DNA, 22 bp, Artificial Sequence
  chemically synthesized
tggtgtcagtagattcaaacta

SEQ ID NO: 1019014 - DNA, 22 bp, Artificial Sequence
  chemically synthesized
atggtgtcagtagattcaaact

SEQ ID NO: 1019015 - DNA, 22 bp, Artificial Sequence
  chemically synthesized
atgtttatggtgtcagtagatt

SEQ ID NO: 1019016 - DNA, 22 bp, Artificial Sequence
  chemically synthesized
attttagtttgaatctactgac

SEQ ID NO: 1019017 - DNA, 22 bp, Artificial Sequence
  chemically synthesized
aatgtttatggtgtcagtagat

SEQ ID NO: 1019018 - DNA, 22 bp, Artificial Sequence
  chemically synthesized
ttaatgtttatggtgtcagtag

SEQ ID NO: 1019019 - DNA, 22 bp, Artificial Sequence
  chemically synthesized
tagtttgaatctactgacacca

SEQ ID NO: 1019020 - DNA, 22 bp, Artificial Sequence
  chemically synthesized
agtttgaatctactgacaccat

SEQ ID NO: 1019021 - DNA, 22 bp, Artificial Sequence
  chemically synthesized
gtttgaatctactgacaccata

SEQ ID NO: 1019022 - DNA, 22 bp, Artificial Sequence
  chemically synthesized
gaatctactgacaccataaaca

SEQ ID NO: 1019023 - DNA, 22 bp, Artificial Sequence
  chemically synthesized
aatctactgacaccataaacat

SEQ ID NO: 1019024 - DNA, 22 bp, Artificial Sequence
  chemically synthesized
ctgacaccataaacattaagag

SEQ ID NO: 1019025 - DNA, 22 bp, Artificial Sequence
  chemically synthesized
acaccataaacattaagaggat

SEQ ID NO: 1019026 - DNA, 22 bp, Artificial Sequence
  chemically synthesized
gggagtgggtaggagtgggggt

SEQ ID NO: 1019027 - DNA, 22 bp, Artificial Sequence
  chemically synthesized
agaggatttcacccccactcct

SEQ ID NO: 1019028 - DNA, 22 bp, Artificial Sequence
  chemically synthesized
cacccccactcctacccactcc

SEQ ID NO: 1019029 - DNA, 22 bp, Artificial Sequence
  chemically synthesized
catacaggctagggagtgggta

SEQ ID NO: 1019030 - DNA, 22 bp, Artificial Sequence
  chemically synthesized
acccccactcctacccactccc

SEQ ID NO: 1019031 - DNA, 22 bp, Artificial Sequence
  chemically synthesized
ccacagttacatacaggctagg

SEQ ID NO: 1019032 - DNA, 22 bp, Artificial Sequence
  chemically synthesized
ctacccactccctagcctgtat

SEQ ID NO: 1019033 - DNA, 22 bp, Artificial Sequence
  chemically synthesized
ctcccacagttacatacaggct

SEQ ID NO: 1019034 - DNA, 22 bp, Artificial Sequence
  chemically synthesized
cccactccctagcctgtatgta

SEQ ID NO: 1019035 - DNA, 22 bp, Artificial Sequence
  chemically synthesized
ccctgctcccacagttacatac

SEQ ID NO: 1019036 - DNA, 22 bp, Artificial Sequence
  chemically synthesized
cctagcctgtatgtaactgtgg

SEQ ID NO: 1019037 - DNA, 22 bp, Artificial Sequence
  chemically synthesized
gaactgccctgctcccacagtt

SEQ ID NO: 1019038 - DNA, 22 bp, Artificial Sequence
  chemically synthesized
gcctgtatgtaactgtgggagc

SEQ ID NO: 1019039 - DNA, 22 bp, Artificial Sequence
  chemically synthesized
tatgtaactgtgggagcagggc

SEQ ID NO: 1019040 - DNA, 22 bp, Artificial Sequence
  chemically synthesized
acatggtgtcatcctggaactg

SEQ ID NO: 1019041 - DNA, 22 bp, Artificial Sequence
  chemically synthesized
tgggagcagggcagttccagga

SEQ ID NO: 1019042 - DNA, 22 bp, Artificial Sequence
  chemically synthesized
taacatggtgtcatcctggaac

SEQ ID NO: 1019043 - DNA, 22 bp, Artificial Sequence
  chemically synthesized
ctaacatggtgtcatcctggaa

SEQ ID NO: 1019044 - DNA, 22 bp, Artificial Sequence
  chemically synthesized
tctaacatggtgtcatcctgga

SEQ ID NO: 1019045 - DNA, 22 bp, Artificial Sequence
  chemically synthesized
tctttctaacatggtgtcatcc

SEQ ID NO: 1019046 - DNA, 22 bp, Artificial Sequence
  chemically synthesized
caggatgacaccatgttagaaa

SEQ ID NO: 1019047 - DNA, 22 bp, Artificial Sequence
  chemically synthesized
cagtgaagttgtctttctaaca

SEQ ID NO: 1019048 - DNA, 22 bp, Artificial Sequence
  chemically synthesized
gcagtgaagttgtctttctaac

SEQ ID NO: 1019049 - DNA, 22 bp, Artificial Sequence
  chemically synthesized
agtaaatttgcagtgaagttgt

SEQ ID NO: 1019050 - DNA, 22 bp, Artificial Sequence
  chemically synthesized
agttcagtaaatttgcagtgaa

SEQ ID NO: 1019051 - DNA, 22 bp, Artificial Sequence
  chemically synthesized
cagttcagtaaatttgcagtga

SEQ ID NO: 1019052 - DNA, 22 bp, Artificial Sequence
  chemically synthesized
gaaagacaacttcactgcaaat

SEQ ID NO: 1019053 - DNA, 22 bp, Artificial Sequence
  chemically synthesized
ggtcagatttcagttcagtaaa

SEQ ID NO: 1019054 - DNA, 22 bp, Artificial Sequence
  chemically synthesized
gggtcagatttcagttcagtaa

SEQ ID NO: 1019055 - DNA, 22 bp, Artificial Sequence
  chemically synthesized
cactgcaaatttactgaactga

SEQ ID NO: 1019056 - DNA, 22 bp, Artificial Sequence
  chemically synthesized
actgcaaatttactgaactgaa

SEQ ID NO: 1019057 - DNA, 22 bp, Artificial Sequence
  chemically synthesized
tacttgggtcagatttcagttc

SEQ ID NO: 1019058 - DNA, 22 bp, Artificial Sequence
  chemically synthesized
caaatttactgaactgaaatct

SEQ ID NO: 1019059 - DNA, 22 bp, Artificial Sequence
  chemically synthesized
ctatacttgggtcagatttcag

SEQ ID NO: 1019060 - DNA, 22 bp, Artificial Sequence
  chemically synthesized
actgaactgaaatctgacccaa

SEQ ID NO: 1019061 - DNA, 22 bp, Artificial Sequence
  chemically synthesized
gagctgctatacttgggtcaga

SEQ ID NO: 1019062 - DNA, 22 bp, Artificial Sequence
  chemically synthesized
ctgaactgaaatctgacccaag

SEQ ID NO: 1019063 - DNA, 22 bp, Artificial Sequence
  chemically synthesized
agagctgctatacttgggtcag

SEQ ID NO: 1019064 - DNA, 22 bp, Artificial Sequence
  chemically synthesized
aactgaaatctgacccaagtat

SEQ ID NO: 1019065 - DNA, 22 bp, Artificial Sequence
  chemically synthesized
acttagagctgctatacttggg

SEQ ID NO: 1019066 - DNA, 22 bp, Artificial Sequence
  chemically synthesized
gacttagagctgctatacttgg

SEQ ID NO: 1019067 - DNA, 22 bp, Artificial Sequence
  chemically synthesized
tgacttagagctgctatacttg

SEQ ID NO: 1019068 - DNA, 22 bp, Artificial Sequence
  chemically synthesized
aaatctgacccaagtatagcag

SEQ ID NO: 1019069 - DNA, 22 bp, Artificial Sequence
  chemically synthesized
tttgacttagagctgctatact

SEQ ID NO: 1019070 - DNA, 22 bp, Artificial Sequence
  chemically synthesized
ctttgacttagagctgctatac

SEQ ID NO: 1019071 - DNA, 22 bp, Artificial Sequence
  chemically synthesized
tctttgacttagagctgctata

SEQ ID NO: 1019072 - DNA, 22 bp, Artificial Sequence
  chemically synthesized
acccaagtatagcagctctaag

SEQ ID NO: 1019073 - DNA, 22 bp, Artificial Sequence
  chemically synthesized
taagtcaaagaaaatgtcatca

SEQ ID NO: 1019074 - DNA, 22 bp, Artificial Sequence
  chemically synthesized
agtcaaagaaaatgtcatcaca

SEQ ID NO: 1019075 - DNA, 22 bp, Artificial Sequence
  chemically synthesized
ataaggtagtaagtcagatgtg

SEQ ID NO: 1019076 - DNA, 22 bp, Artificial Sequence
  chemically synthesized
ctcataaggtagtaagtcagat

SEQ ID NO: 1019077 - DNA, 22 bp, Artificial Sequence
  chemically synthesized
actcataaggtagtaagtcaga

SEQ ID NO: 1019078 - DNA, 22 bp, Artificial Sequence
  chemically synthesized
tgatgatatttactcataaggt

SEQ ID NO: 1019079 - DNA, 22 bp, Artificial Sequence
  chemically synthesized
gtgatgatatttactcataagg

SEQ ID NO: 1019080 - DNA, 22 bp, Artificial Sequence
  chemically synthesized
tgtgatgatatttactcataag

SEQ ID NO: 1019081 - DNA, 22 bp, Artificial Sequence
  chemically synthesized
ttgtgatgatatttactcataa

SEQ ID NO: 1019082 - DNA, 22 bp, Artificial Sequence
  chemically synthesized
acttactaccttatgagtaaat

SEQ ID NO: 1019083 - DNA, 22 bp, Artificial Sequence
  chemically synthesized
actaccttatgagtaaatatca

SEQ ID NO: 1019084 - DNA, 22 bp, Artificial Sequence
  chemically synthesized
ctaccttatgagtaaatatcat

SEQ ID NO: 1019085 - DNA, 22 bp, Artificial Sequence
  chemically synthesized
ccttatgagtaaatatcatcac

SEQ ID NO: 1019086 - DNA, 22 bp, Artificial Sequence
  chemically synthesized
atgagtaaatatcatcacaaaa

SEQ ID NO: 1019087 - DNA, 22 bp, Artificial Sequence
  chemically synthesized
tgagtaaatatcatcacaaaag

SEQ ID NO: 1019088 - DNA, 22 bp, Artificial Sequence
  chemically synthesized
ataagatagaatataaaatagc

SEQ ID NO: 1019089 - DNA, 22 bp, Artificial Sequence
  chemically synthesized
aataagatagaatataaaatag

SEQ ID NO: 1019090 - DNA, 22 bp, Artificial Sequence
  chemically synthesized
taataagatagaatataaaata

SEQ ID NO: 1019091 - DNA, 22 bp, Artificial Sequence
  chemically synthesized
tgttttaataagatagaatata

SEQ ID NO: 1019092 - DNA, 22 bp, Artificial Sequence
  chemically synthesized
ttgctattttatattctatctt

SEQ ID NO: 1019093 - DNA, 22 bp, Artificial Sequence
  chemically synthesized
tgctattttatattctatctta

SEQ ID NO: 1019094 - DNA, 22 bp, Artificial Sequence
  chemically synthesized
gctattttatattctatcttat

SEQ ID NO: 1019095 - DNA, 22 bp, Artificial Sequence
  chemically synthesized
ctattttatattctatcttatt

SEQ ID NO: 1019096 - DNA, 22 bp, Artificial Sequence
  chemically synthesized
ttttatattctatcttattaaa

SEQ ID NO: 1019097 - DNA, 22 bp, Artificial Sequence
  chemically synthesized
gtgcacctgtgttttaataaga

SEQ ID NO: 1019098 - DNA, 22 bp, Artificial Sequence
  chemically synthesized
tatattctatcttattaaaaca

SEQ ID NO: 1019099 - DNA, 22 bp, Artificial Sequence
  chemically synthesized
atattctatcttattaaaacac

SEQ ID NO: 1019100 - DNA, 22 bp, Artificial Sequence
  chemically synthesized
cctcgtgcacctgtgttttaat

SEQ ID NO: 1019101 - DNA, 22 bp, Artificial Sequence
  chemically synthesized
tattctatcttattaaaacaca

SEQ ID NO: 1019102 - DNA, 22 bp, Artificial Sequence
  chemically synthesized
ccctcgtgcacctgtgttttaa

SEQ ID NO: 1019103 - DNA, 22 bp, Artificial Sequence
  chemically synthesized
tatcttattaaaacacaggtgc

SEQ ID NO: 1019104 - DNA, 22 bp, Artificial Sequence
  chemically synthesized
tcttattaaaacacaggtgcac

SEQ ID NO: 1019105 - DNA, 22 bp, Artificial Sequence
  chemically synthesized
attaaaacacaggtgcacgagg

SEQ ID NO: 1019106 - DNA, 22 bp, Artificial Sequence
  chemically synthesized
ttaaaacacaggtgcacgaggg

SEQ ID NO: 1019107 - DNA, 22 bp, Artificial Sequence
  chemically synthesized
tgccaagaacatttccctcgtg

SEQ ID NO: 1019108 - DNA, 22 bp, Artificial Sequence
  chemically synthesized
aaacacaggtgcacgagggaaa

SEQ ID NO: 1019109 - DNA, 22 bp, Artificial Sequence
  chemically synthesized
atgccaagaacatttccctcgt

SEQ ID NO: 1019110 - DNA, 22 bp, Artificial Sequence
  chemically synthesized
tatgccaagaacatttccctcg

SEQ ID NO: 1019111 - DNA, 22 bp, Artificial Sequence
  chemically synthesized
atgaatgtagtagttttatgcc

SEQ ID NO: 1019112 - DNA, 22 bp, Artificial Sequence
  chemically synthesized
aatgaatgtagtagttttatgc

SEQ ID NO: 1019113 - DNA, 22 bp, Artificial Sequence
  chemically synthesized
ttggcataaaactactacattc

SEQ ID NO: 1019114 - DNA, 22 bp, Artificial Sequence
  chemically synthesized
ggcataaaactactacattcat

SEQ ID NO: 1019115 - DNA, 22 bp, Artificial Sequence
  chemically synthesized
gcataaaactactacattcatt

SEQ ID NO: 1019116 - DNA, 22 bp, Artificial Sequence
  chemically synthesized
cggtgtgggaaagaaaaaattt

SEQ ID NO: 1019117 - DNA, 22 bp, Artificial Sequence
  chemically synthesized
ctacattcattaaattttttct

SEQ ID NO: 1019118 - DNA, 22 bp, Artificial Sequence
  chemically synthesized
ccggtgtgggaaagaaaaaatt

SEQ ID NO: 1019119 - DNA, 22 bp, Artificial Sequence
  chemically synthesized
cattcattaaattttttctttc

SEQ ID NO: 1019120 - DNA, 22 bp, Artificial Sequence
  chemically synthesized
attaaattttttctttcccaca

SEQ ID NO: 1019121 - DNA, 22 bp, Artificial Sequence
  chemically synthesized
aattttttctttcccacaccgg

SEQ ID NO: 1019122 - DNA, 22 bp, Artificial Sequence
  chemically synthesized
gacatgtgccttccggtgtggg

SEQ ID NO: 1019123 - DNA, 22 bp, Artificial Sequence
  chemically synthesized
agacatgtgccttccggtgtgg

SEQ ID NO: 1019124 - DNA, 22 bp, Artificial Sequence
  chemically synthesized
tttctttcccacaccggaaggc

SEQ ID NO: 1019125 - DNA, 22 bp, Artificial Sequence
  chemically synthesized
ttctttcccacaccggaaggca

SEQ ID NO: 1019126 - DNA, 22 bp, Artificial Sequence
  chemically synthesized
tctttcccacaccggaaggcac

SEQ ID NO: 1019127 - DNA, 22 bp, Artificial Sequence
  chemically synthesized
ctttcccacaccggaaggcaca

SEQ ID NO: 1019128 - DNA, 22 bp, Artificial Sequence
  chemically synthesized
caggtttagacatgtgccttcc

SEQ ID NO: 1019129 - DNA, 22 bp, Artificial Sequence
  chemically synthesized
tttcccacaccggaaggcacat

SEQ ID NO: 1019130 - DNA, 22 bp, Artificial Sequence
  chemically synthesized
tcccacaccggaaggcacatgt

SEQ ID NO: 1019131 - DNA, 22 bp, Artificial Sequence
  chemically synthesized
cccacaccggaaggcacatgtc

SEQ ID NO: 1019132 - DNA, 22 bp, Artificial Sequence
  chemically synthesized
ccacaccggaaggcacatgtct

SEQ ID NO: 1019133 - DNA, 22 bp, Artificial Sequence
  chemically synthesized
aataataaagcaacccctacag

SEQ ID NO: 1019134 - DNA, 22 bp, Artificial Sequence
  chemically synthesized
attaaataataaagcaacccct

SEQ ID NO: 1019135 - DNA, 22 bp, Artificial Sequence
  chemically synthesized
taattaaataataaagcaaccc

SEQ ID NO: 1019136 - DNA, 22 bp, Artificial Sequence
  chemically synthesized
aacctgtaggggttgctttatt

SEQ ID NO: 1019137 - DNA, 22 bp, Artificial Sequence
  chemically synthesized
ctctaattaaataataaagcaa

SEQ ID NO: 1019138 - DNA, 22 bp, Artificial Sequence
  chemically synthesized
taggggttgctttattatttaa

SEQ ID NO: 1019139 - DNA, 22 bp, Artificial Sequence
  chemically synthesized
ctttattatttaattagagcag

SEQ ID NO: 1019140 - DNA, 22 bp, Artificial Sequence
  chemically synthesized
tattatttaattagagcagatt

SEQ ID NO: 1019141 - DNA, 22 bp, Artificial Sequence
  chemically synthesized
attatttaattagagcagattc

SEQ ID NO: 1019142 - DNA, 22 bp, Artificial Sequence
  chemically synthesized
ttatttaattagagcagattct

SEQ ID NO: 1019143 - DNA, 22 bp, Artificial Sequence
  chemically synthesized
aaatgatagaaaagaatctgct

SEQ ID NO: 1019144 - DNA, 22 bp, Artificial Sequence
  chemically synthesized
tttaattagagcagattctttt

SEQ ID NO: 1019145 - DNA, 22 bp, Artificial Sequence
  chemically synthesized
aattagagcagattcttttcta

SEQ ID NO: 1019146 - DNA, 22 bp, Artificial Sequence
  chemically synthesized
attagagcagattcttttctat

SEQ ID NO: 1019147 - DNA, 22 bp, Artificial Sequence
  chemically synthesized
gagcagattcttttctatcatt

SEQ ID NO: 1019148 - DNA, 22 bp, Artificial Sequence
  chemically synthesized
gatgaaacacctaaaatgatag

SEQ ID NO: 1019149 - DNA, 22 bp, Artificial Sequence
  chemically synthesized
agatgaaacacctaaaatgata

SEQ ID NO: 1019150 - DNA, 22 bp, Artificial Sequence
  chemically synthesized
tagatgaaacacctaaaatgat

SEQ ID NO: 1019151 - DNA, 22 bp, Artificial Sequence
  chemically synthesized
ttttctatcattttaggtgttt

SEQ ID NO: 1019152 - DNA, 22 bp, Artificial Sequence
  chemically synthesized
ttctatcattttaggtgtttca

SEQ ID NO: 1019153 - DNA, 22 bp, Artificial Sequence
  chemically synthesized
tctatcattttaggtgtttcat

SEQ ID NO: 1019154 - DNA, 22 bp, Artificial Sequence
  chemically synthesized
atcaaactttagatgaaacacc

SEQ ID NO: 1019155 - DNA, 22 bp, Artificial Sequence
  chemically synthesized
ctatcattttaggtgtttcatc

SEQ ID NO: 1019156 - DNA, 22 bp, Artificial Sequence
  chemically synthesized
tatcattttaggtgtttcatct

SEQ ID NO: 1019157 - DNA, 22 bp, Artificial Sequence
  chemically synthesized
tcattttaggtgtttcatctaa

SEQ ID NO: 1019158 - DNA, 22 bp, Artificial Sequence
  chemically synthesized
atgttaatcaaactttagatga

SEQ ID NO: 1019159 - DNA, 22 bp, Artificial Sequence
  chemically synthesized
taggtgtttcatctaaagtttg

SEQ ID NO: 1019160 - DNA, 22 bp, Artificial Sequence
  chemically synthesized
aggtgtttcatctaaagtttga

SEQ ID NO: 1019161 - DNA, 22 bp, Artificial Sequence
  chemically synthesized
ggtgtttcatctaaagtttgat

SEQ ID NO: 1019162 - DNA, 22 bp, Artificial Sequence
  chemically synthesized
catctaaagtttgattaacatc

SEQ ID NO: 1019163 - DNA, 22 bp, Artificial Sequence
  chemically synthesized
atctaaagtttgattaacatca

SEQ ID NO: 1019164 - DNA, 22 bp, Artificial Sequence
  chemically synthesized
agagcacagcatatactgatgt

SEQ ID NO: 1019165 - DNA, 22 bp, Artificial Sequence
  chemically synthesized
aagtttgattaacatcagtata

SEQ ID NO: 1019166 - DNA, 22 bp, Artificial Sequence
  chemically synthesized
cctgagagcacagcatatactg

SEQ ID NO: 1019167 - DNA, 22 bp, Artificial Sequence
  chemically synthesized
gcctgagagcacagcatatact

SEQ ID NO: 1019168 - DNA, 22 bp, Artificial Sequence
  chemically synthesized
gattaacatcagtatatgctgt

SEQ ID NO: 1019169 - DNA, 22 bp, Artificial Sequence
  chemically synthesized
attaacatcagtatatgctgtg

SEQ ID NO: 1019170 - DNA, 22 bp, Artificial Sequence
  chemically synthesized
cttgcctgagagcacagcatat

SEQ ID NO: 1019171 - DNA, 22 bp, Artificial Sequence
  chemically synthesized
acttgcctgagagcacagcata

SEQ ID NO: 1019172 - DNA, 22 bp, Artificial Sequence
  chemically synthesized
acatcagtatatgctgtgctct

SEQ ID NO: 1019173 - DNA, 22 bp, Artificial Sequence
  chemically synthesized
tatttacttgcctgagagcaca

SEQ ID NO: 1019174 - DNA, 22 bp, Artificial Sequence
  chemically synthesized
cggcagctatatttacttgcct

SEQ ID NO: 1019175 - DNA, 22 bp, Artificial Sequence
  chemically synthesized
tacggcagctatatttacttgc

SEQ ID NO: 1019176 - DNA, 22 bp, Artificial Sequence
  chemically synthesized
ctacggcagctatatttacttg

SEQ ID NO: 1019177 - DNA, 22 bp, Artificial Sequence
  chemically synthesized
tctacggcagctatatttactt

SEQ ID NO: 1019178 - DNA, 22 bp, Artificial Sequence
  chemically synthesized
tgctctcaggcaagtaaatata

SEQ ID NO: 1019179 - DNA, 22 bp, Artificial Sequence
  chemically synthesized
tttctacggcagctatatttac

SEQ ID NO: 1019180 - DNA, 22 bp, Artificial Sequence
  chemically synthesized
tctttctacggcagctatattt

SEQ ID NO: 1019181 - DNA, 22 bp, Artificial Sequence
  chemically synthesized
ctctttctacggcagctatatt

SEQ ID NO: 1019182 - DNA, 22 bp, Artificial Sequence
  chemically synthesized
tcaggcaagtaaatatagctgc

SEQ ID NO: 1019183 - DNA, 22 bp, Artificial Sequence
  chemically synthesized
aggcaagtaaatatagctgccg

SEQ ID NO: 1019184 - DNA, 22 bp, Artificial Sequence
  chemically synthesized
tttctctttctacggcagctat

SEQ ID NO: 1019185 - DNA, 22 bp, Artificial Sequence
  chemically synthesized
atttctctttctacggcagcta

SEQ ID NO: 1019186 - DNA, 22 bp, Artificial Sequence
  chemically synthesized
cttatttctctttctacggcag

SEQ ID NO: 1019187 - DNA, 22 bp, Artificial Sequence
  chemically synthesized
tgcttatttctctttctacggc

SEQ ID NO: 1019188 - DNA, 22 bp, Artificial Sequence
  chemically synthesized
ctgcttatttctctttctacgg

SEQ ID NO: 1019189 - DNA, 22 bp, Artificial Sequence
  chemically synthesized
cttctgcttatttctctttcta

SEQ ID NO: 1019190 - DNA, 22 bp, Artificial Sequence
  chemically synthesized
aaatgttgcttctgcttatttc

SEQ ID NO: 1019191 - DNA, 22 bp, Artificial Sequence
  chemically synthesized
ccgtagaaagagaaataagcag

SEQ ID NO: 1019192 - DNA, 22 bp, Artificial Sequence
  chemically synthesized
aaaatgttgcttctgcttattt

SEQ ID NO: 1019193 - DNA, 22 bp, Artificial Sequence
  chemically synthesized
taaaatgttgcttctgcttatt

SEQ ID NO: 1019194 - DNA, 22 bp, Artificial Sequence
  chemically synthesized
ttaaaatgttgcttctgcttat

SEQ ID NO: 1019195 - DNA, 22 bp, Artificial Sequence
  chemically synthesized
tttaaaatgttgcttctgctta

SEQ ID NO: 1019196 - DNA, 22 bp, Artificial Sequence
  chemically synthesized
ttttttaaaatgttgcttctgc

SEQ ID NO: 1019197 - DNA, 22 bp, Artificial Sequence
  chemically synthesized
attttttaaaatgttgcttctg

SEQ ID NO: 1019198 - DNA, 22 bp, Artificial Sequence
  chemically synthesized
tattttttaaaatgttgcttct

SEQ ID NO: 1019199 - DNA, 22 bp, Artificial Sequence
  chemically synthesized
tttattttttaaaatgttgctt

SEQ ID NO: 1019200 - DNA, 22 bp, Artificial Sequence
  chemically synthesized
ttctttattttttaaaatgttg

SEQ ID NO: 1019201 - DNA, 22 bp, Artificial Sequence
  chemically synthesized
atgttattctttattttttaaa

SEQ ID NO: 1019202 - DNA, 22 bp, Artificial Sequence
  chemically synthesized
catgttcatgttattctttatt

SEQ ID NO: 1019203 - DNA, 22 bp, Artificial Sequence
  chemically synthesized
ccatgttcatgttattctttat

SEQ ID NO: 1019204 - DNA, 22 bp, Artificial Sequence
  chemically synthesized
tccatgttcatgttattcttta

SEQ ID NO: 1019205 - DNA, 22 bp, Artificial Sequence
  chemically synthesized
tttccatgttcatgttattctt

SEQ ID NO: 1019206 - DNA, 22 bp, Artificial Sequence
  chemically synthesized
ctttccatgttcatgttattct

SEQ ID NO: 1019207 - DNA, 22 bp, Artificial Sequence
  chemically synthesized
tctttccatgttcatgttattc

SEQ ID NO: 1019208 - DNA, 22 bp, Artificial Sequence
  chemically synthesized
taaaaaataaagaataacatga

SEQ ID NO: 1019209 - DNA, 22 bp, Artificial Sequence
  chemically synthesized
ttctttccatgttcatgttatt

SEQ ID NO: 1019210 - DNA, 22 bp, Artificial Sequence
  chemically synthesized
aaaaaataaagaataacatgaa

SEQ ID NO: 1019211 - DNA, 22 bp, Artificial Sequence
  chemically synthesized
tttctttccatgttcatgttat

SEQ ID NO: 1019212 - DNA, 22 bp, Artificial Sequence
  chemically synthesized
aaaaataaagaataacatgaac

SEQ ID NO: 1019213 - DNA, 22 bp, Artificial Sequence
  chemically synthesized
tttttctttccatgttcatgtt

SEQ ID NO: 1019214 - DNA, 22 bp, Artificial Sequence
  chemically synthesized
aaggttctttttctttccatgt

SEQ ID NO: 1019215 - DNA, 22 bp, Artificial Sequence
  chemically synthesized
aaaggttctttttctttccatg

SEQ ID NO: 1019216 - DNA, 22 bp, Artificial Sequence
  chemically synthesized
ttaaaggttctttttctttcca

SEQ ID NO: 1019217 - DNA, 22 bp, Artificial Sequence
  chemically synthesized
cttaaaggttctttttctttcc

SEQ ID NO: 1019218 - DNA, 22 bp, Artificial Sequence
  chemically synthesized
tttcttaaaggttctttttctt

SEQ ID NO: 1019219 - DNA, 22 bp, Artificial Sequence
  chemically synthesized
atttcttaaaggttctttttct

SEQ ID NO: 1019220 - DNA, 22 bp, Artificial Sequence
  chemically synthesized
tatttcttaaaggttctttttc

SEQ ID NO: 1019221 - DNA, 22 bp, Artificial Sequence
  chemically synthesized
tggatattttatttcttaaagg

SEQ ID NO: 1019222 - DNA, 22 bp, Artificial Sequence
  chemically synthesized
gtggatattttatttcttaaag

SEQ ID NO: 1019223 - DNA, 22 bp, Artificial Sequence
  chemically synthesized
tgtggatattttatttcttaaa

SEQ ID NO: 1019224 - DNA, 22 bp, Artificial Sequence
  chemically synthesized
gtgagctttgtggatattttat

SEQ ID NO: 1019225 - DNA, 22 bp, Artificial Sequence
  chemically synthesized
tagtgagctttgtggatatttt

SEQ ID NO: 1019226 - DNA, 22 bp, Artificial Sequence
  chemically synthesized
ctagtgagctttgtggatattt

SEQ ID NO: 1019227 - DNA, 22 bp, Artificial Sequence
  chemically synthesized
taagaaataaaatatccacaaa

SEQ ID NO: 1019228 - DNA, 22 bp, Artificial Sequence
  chemically synthesized
aagaaataaaatatccacaaag

SEQ ID NO: 1019229 - DNA, 22 bp, Artificial Sequence
  chemically synthesized
agaaataaaatatccacaaagc

SEQ ID NO: 1019230 - DNA, 22 bp, Artificial Sequence
  chemically synthesized
ggaagcatttctagtgagcttt

SEQ ID NO: 1019231 - DNA, 22 bp, Artificial Sequence
  chemically synthesized
aggaagcatttctagtgagctt

SEQ ID NO: 1019232 - DNA, 22 bp, Artificial Sequence
  chemically synthesized
atacacgtttaggaagcatttc

SEQ ID NO: 1019233 - DNA, 22 bp, Artificial Sequence
  chemically synthesized
catacacgtttaggaagcattt

SEQ ID NO: 1019234 - DNA, 22 bp, Artificial Sequence
  chemically synthesized
actagaaatgcttcctaaacgt

SEQ ID NO: 1019235 - DNA, 22 bp, Artificial Sequence
  chemically synthesized
gaaatgcttcctaaacgtgtat

SEQ ID NO: 1019236 - DNA, 22 bp, Artificial Sequence
  chemically synthesized
cctaaacgtgtatgaagcgtat

SEQ ID NO: 1019237 - DNA, 22 bp, Artificial Sequence
  chemically synthesized
ctaaacgtgtatgaagcgtatg

SEQ ID NO: 1019238 - DNA, 22 bp, Artificial Sequence
  chemically synthesized
aacgtgtatgaagcgtatgtgt

SEQ ID NO: 1019239 - DNA, 22 bp, Artificial Sequence
  chemically synthesized
agtaaatgaatcagtggtgaaa

SEQ ID NO: 1019240 - DNA, 22 bp, Artificial Sequence
  chemically synthesized
gtacattttatttcaccactga

SEQ ID NO: 1019241 - DNA, 22 bp, Artificial Sequence
  chemically synthesized
tacattttatttcaccactgat

SEQ ID NO: 1019242 - DNA, 22 bp, Artificial Sequence
  chemically synthesized
tatttcaccactgattcattta

SEQ ID NO: 1019243 - DNA, 22 bp, Artificial Sequence
  chemically synthesized
atttcaccactgattcatttac

SEQ ID NO: 1019244 - DNA, 22 bp, Artificial Sequence
  chemically synthesized
tcaaaagattgagtaaatgaat

SEQ ID NO: 1019245 - DNA, 22 bp, Artificial Sequence
  chemically synthesized
tttcaccactgattcatttact

SEQ ID NO: 1019246 - DNA, 22 bp, Artificial Sequence
  chemically synthesized
atcaaaagattgagtaaatgaa

SEQ ID NO: 1019247 - DNA, 22 bp, Artificial Sequence
  chemically synthesized
caccactgattcatttactcaa

SEQ ID NO: 1019248 - DNA, 22 bp, Artificial Sequence
  chemically synthesized
accactgattcatttactcaat

SEQ ID NO: 1019249 - DNA, 22 bp, Artificial Sequence
  chemically synthesized
attcatttactcaatcttttga

SEQ ID NO: 1019250 - DNA, 22 bp, Artificial Sequence
  chemically synthesized
aataaatgtttatcaaaagatt

SEQ ID NO: 1019251 - DNA, 22 bp, Artificial Sequence
  chemically synthesized
atttactcaatcttttgataaa

SEQ ID NO: 1019252 - DNA, 22 bp, Artificial Sequence
  chemically synthesized
agcgctcaataaatgtttatca

SEQ ID NO: 1019253 - DNA, 22 bp, Artificial Sequence
  chemically synthesized
actcaatcttttgataaacatt

SEQ ID NO: 1019254 - DNA, 22 bp, Artificial Sequence
  chemically synthesized
ctcaatcttttgataaacattt

SEQ ID NO: 1019255 - DNA, 22 bp, Artificial Sequence
  chemically synthesized
aatcttttgataaacatttatt

SEQ ID NO: 1019256 - DNA, 22 bp, Artificial Sequence
  chemically synthesized
aggactaagcgctcaataaatg

SEQ ID NO: 1019257 - DNA, 22 bp, Artificial Sequence
  chemically synthesized
ttgataaacatttattgagcgc

SEQ ID NO: 1019258 - DNA, 22 bp, Artificial Sequence
  chemically synthesized
tgataaacatttattgagcgct

SEQ ID NO: 1019259 - DNA, 22 bp, Artificial Sequence
  chemically synthesized
gcctcaggactaagcgctcaat

SEQ ID NO: 1019260 - DNA, 22 bp, Artificial Sequence
  chemically synthesized
gataaacatttattgagcgctt

SEQ ID NO: 1019261 - DNA, 22 bp, Artificial Sequence
  chemically synthesized
ataaacatttattgagcgctta

SEQ ID NO: 1019262 - DNA, 22 bp, Artificial Sequence
  chemically synthesized
ctagcctcaggactaagcgctc

SEQ ID NO: 1019263 - DNA, 22 bp, Artificial Sequence
  chemically synthesized
attgagcgcttagtcctgaggc

SEQ ID NO: 1019264 - DNA, 22 bp, Artificial Sequence
  chemically synthesized
aacacactgctagcctcaggac

SEQ ID NO: 1019265 - DNA, 22 bp, Artificial Sequence
  chemically synthesized
ttgagcgcttagtcctgaggct

SEQ ID NO: 1019266 - DNA, 22 bp, Artificial Sequence
  chemically synthesized
agcgcttagtcctgaggctagc

SEQ ID NO: 1019267 - DNA, 22 bp, Artificial Sequence
  chemically synthesized
cgaattcaacacactgctagcc

SEQ ID NO: 1019268 - DNA, 22 bp, Artificial Sequence
  chemically synthesized
ccgaattcaacacactgctagc

SEQ ID NO: 1019269 - DNA, 22 bp, Artificial Sequence
  chemically synthesized
agtcctgaggctagcagtgtgt

SEQ ID NO: 1019270 - DNA, 22 bp, Artificial Sequence
  chemically synthesized
gtcctgaggctagcagtgtgtt

SEQ ID NO: 1019271 - DNA, 22 bp, Artificial Sequence
  chemically synthesized
caccttccgaattcaacacact

SEQ ID NO: 1019272 - DNA, 22 bp, Artificial Sequence
  chemically synthesized
acaccttccgaattcaacacac

SEQ ID NO: 1019273 - DNA, 22 bp, Artificial Sequence
  chemically synthesized
tacaccttccgaattcaacaca

SEQ ID NO: 1019274 - DNA, 22 bp, Artificial Sequence
  chemically synthesized
aggctagcagtgtgttgaattc

SEQ ID NO: 1019275 - DNA, 22 bp, Artificial Sequence
  chemically synthesized
agctttacaccttccgaattca

SEQ ID NO: 1019276 - DNA, 22 bp, Artificial Sequence
  chemically synthesized
cagctttacaccttccgaattc

SEQ ID NO: 1019277 - DNA, 22 bp, Artificial Sequence
  chemically synthesized
tcagctttacaccttccgaatt

SEQ ID NO: 1019278 - DNA, 22 bp, Artificial Sequence
  chemically synthesized
gcagtgtgttgaattcggaagg

SEQ ID NO: 1019279 - DNA, 22 bp, Artificial Sequence
  chemically synthesized
ttcagctttacaccttccgaat

SEQ ID NO: 1019280 - DNA, 22 bp, Artificial Sequence
  chemically synthesized
tttcagctttacaccttccgaa

SEQ ID NO: 1019281 - DNA, 22 bp, Artificial Sequence
  chemically synthesized
aattcggaaggtgtaaagctga

SEQ ID NO: 1019282 - DNA, 22 bp, Artificial Sequence
  chemically synthesized
ggaaggtgtaaagctgaaaaag

SEQ ID NO: 1019283 - DNA, 22 bp, Artificial Sequence
  chemically synthesized
atagagatagtatctttttcag

SEQ ID NO: 1019284 - DNA, 22 bp, Artificial Sequence
  chemically synthesized
cccattgatagagatagtatct

SEQ ID NO: 1019285 - DNA, 22 bp, Artificial Sequence
  chemically synthesized
tcaattgcccattgatagagat

SEQ ID NO: 1019286 - DNA, 22 bp, Artificial Sequence
  chemically synthesized
aaaaagatactatctctatcaa

SEQ ID NO: 1019287 - DNA, 22 bp, Artificial Sequence
  chemically synthesized
aactgtcaattgcccattgata

SEQ ID NO: 1019288 - DNA, 22 bp, Artificial Sequence
  chemically synthesized
tctctatcaatgggcaattgac

SEQ ID NO: 1019289 - DNA, 22 bp, Artificial Sequence
  chemically synthesized
tgcaactaaactgtcaattgcc

SEQ ID NO: 1019290 - DNA, 22 bp, Artificial Sequence
  chemically synthesized
tatcaatgggcaattgacagtt

SEQ ID NO: 1019291 - DNA, 22 bp, Artificial Sequence
  chemically synthesized
tcaatgggcaattgacagttta

SEQ ID NO: 1019292 - DNA, 22 bp, Artificial Sequence
  chemically synthesized
aaatactgtgcaactaaactgt

SEQ ID NO: 1019293 - DNA, 22 bp, Artificial Sequence
  chemically synthesized
aaaatactgtgcaactaaactg

SEQ ID NO: 1019294 - DNA, 22 bp, Artificial Sequence
  chemically synthesized
cttaaaatactgtgcaactaaa

SEQ ID NO: 1019295 - DNA, 22 bp, Artificial Sequence
  chemically synthesized
acagtttagttgcacagtattt

SEQ ID NO: 1019296 - DNA, 22 bp, Artificial Sequence
  chemically synthesized
ataccctccttaaaatactgtg

SEQ ID NO: 1019297 - DNA, 22 bp, Artificial Sequence
  chemically synthesized
agttcataccctccttaaaata

SEQ ID NO: 1019298 - DNA, 22 bp, Artificial Sequence
  chemically synthesized
cagttcataccctccttaaaat

SEQ ID NO: 1019299 - DNA, 22 bp, Artificial Sequence
  chemically synthesized
agttgcacagtattttaaggag

SEQ ID NO: 1019300 - DNA, 22 bp, Artificial Sequence
  chemically synthesized
gttgcacagtattttaaggagg

SEQ ID NO: 1019301 - DNA, 22 bp, Artificial Sequence
  chemically synthesized
cacagtattttaaggagggtat

SEQ ID NO: 1019302 - DNA, 22 bp, Artificial Sequence
  chemically synthesized
caacttcagttcataccctcct

SEQ ID NO: 1019303 - DNA, 22 bp, Artificial Sequence
  chemically synthesized
taaggagggtatgaactgaagt

SEQ ID NO: 1019304 - DNA, 22 bp, Artificial Sequence
  chemically synthesized
aaggagggtatgaactgaagtt

SEQ ID NO: 1019305 - DNA, 22 bp, Artificial Sequence
  chemically synthesized
aggagggtatgaactgaagttg

SEQ ID NO: 1019306 - DNA, 22 bp, Artificial Sequence
  chemically synthesized
aagttgtagcacatgctgtact

SEQ ID NO: 1019307 - DNA, 22 bp, Artificial Sequence
  chemically synthesized
tagcacatgctgtacttgctcc

SEQ ID NO: 1019308 - DNA, 22 bp, Artificial Sequence
  chemically synthesized
tacttgctccatgcacttcccc

SEQ ID NO: 1019309 - DNA, 22 bp, Artificial Sequence
  chemically synthesized
aaatggaaaggcaaggggaagt

SEQ ID NO: 1019310 - DNA, 22 bp, Artificial Sequence
  chemically synthesized
gaaatggaaaggcaaggggaag

SEQ ID NO: 1019311 - DNA, 22 bp, Artificial Sequence
  chemically synthesized
tgaaatggaaaggcaaggggaa

SEQ ID NO: 1019312 - DNA, 22 bp, Artificial Sequence
  chemically synthesized
gctccatgcacttccccttgcc

SEQ ID NO: 1019313 - DNA, 22 bp, Artificial Sequence
  chemically synthesized
ctccatgcacttccccttgcct

SEQ ID NO: 1019314 - DNA, 22 bp, Artificial Sequence
  chemically synthesized
catgcacttccccttgcctttc

SEQ ID NO: 1019315 - DNA, 22 bp, Artificial Sequence
  chemically synthesized
ccccttgcctttccatttcaaa

SEQ ID NO: 1019316 - DNA, 22 bp, Artificial Sequence
  chemically synthesized
cccttgcctttccatttcaaaa

SEQ ID NO: 1019317 - DNA, 22 bp, Artificial Sequence
  chemically synthesized
gcctttccatttcaaaatacac

SEQ ID NO: 1019318 - DNA, 22 bp, Artificial Sequence
  chemically synthesized
gaagtcaaaccagtgtattttg

SEQ ID NO: 1019319 - DNA, 22 bp, Artificial Sequence
  chemically synthesized
cctttccatttcaaaatacact

SEQ ID NO: 1019320 - DNA, 22 bp, Artificial Sequence
  chemically synthesized
ggaagtcaaaccagtgtatttt

SEQ ID NO: 1019321 - DNA, 22 bp, Artificial Sequence
  chemically synthesized
tccatttcaaaatacactggtt

SEQ ID NO: 1019322 - DNA, 22 bp, Artificial Sequence
  chemically synthesized
ccatttcaaaatacactggttt

SEQ ID NO: 1019323 - DNA, 22 bp, Artificial Sequence
  chemically synthesized
catttcaaaatacactggtttg

SEQ ID NO: 1019324 - DNA, 22 bp, Artificial Sequence
  chemically synthesized
gcatttggaagtcaaaccagtg

SEQ ID NO: 1019325 - DNA, 22 bp, Artificial Sequence
  chemically synthesized
caaaatacactggtttgacttc

SEQ ID NO: 1019326 - DNA, 22 bp, Artificial Sequence
  chemically synthesized
aaaatacactggtttgacttcc

SEQ ID NO: 1019327 - DNA, 22 bp, Artificial Sequence
  chemically synthesized
gtttgacttccaaatgccagca

SEQ ID NO: 1019328 - DNA, 22 bp, Artificial Sequence
  chemically synthesized
gacttccaaatgccagcatttg

SEQ ID NO: 1019329 - DNA, 22 bp, Artificial Sequence
  chemically synthesized
acttccaaatgccagcatttgg

SEQ ID NO: 1019330 - DNA, 22 bp, Artificial Sequence
  chemically synthesized
cataggtaatgaaatccaaatg

SEQ ID NO: 1019331 - DNA, 22 bp, Artificial Sequence
  chemically synthesized
ccaaatgccagcatttggattt

SEQ ID NO: 1019332 - DNA, 22 bp, Artificial Sequence
  chemically synthesized
caaatgccagcatttggatttc

SEQ ID NO: 1019333 - DNA, 22 bp, Artificial Sequence
  chemically synthesized
caaccagaaagattccataggt

SEQ ID NO: 1019334 - DNA, 22 bp, Artificial Sequence
  chemically synthesized
ggatttcattacctatggaatc

SEQ ID NO: 1019335 - DNA, 22 bp, Artificial Sequence
  chemically synthesized
tgcaaccagaaagattccatag

SEQ ID NO: 1019336 - DNA, 22 bp, Artificial Sequence
  chemically synthesized
gatttcattacctatggaatct

SEQ ID NO: 1019337 - DNA, 22 bp, Artificial Sequence
  chemically synthesized
cattacctatggaatctttctg

SEQ ID NO: 1019338 - DNA, 22 bp, Artificial Sequence
  chemically synthesized
attacctatggaatctttctgg

SEQ ID NO: 1019339 - DNA, 22 bp, Artificial Sequence
  chemically synthesized
cctatggaatctttctggttgc

SEQ ID NO: 1019340 - DNA, 22 bp, Artificial Sequence
  chemically synthesized
tggaatctttctggttgcagag

SEQ ID NO: 1019341 - DNA, 22 bp, Artificial Sequence
  chemically synthesized
tctggttgcagaggtctgatgc

SEQ ID NO: 1019342 - DNA, 22 bp, Artificial Sequence
  chemically synthesized
ctggttgcagaggtctgatgct

SEQ ID NO: 1019343 - DNA, 22 bp, Artificial Sequence
  chemically synthesized
tggttgcagaggtctgatgctg

SEQ ID NO: 1019344 - DNA, 22 bp, Artificial Sequence
  chemically synthesized
gttgcagaggtctgatgctgat

SEQ ID NO: 1019345 - DNA, 22 bp, Artificial Sequence
  chemically synthesized
cccaccccagtaacatcagcat

SEQ ID NO: 1019346 - DNA, 22 bp, Artificial Sequence
  chemically synthesized
cagaggtctgatgctgatgtta

SEQ ID NO: 1019347 - DNA, 22 bp, Artificial Sequence
  chemically synthesized
atgctgatgttactggggtggg

SEQ ID NO: 1019348 - DNA, 22 bp, Artificial Sequence
  chemically synthesized
aaaaatatgctccccaccccag

SEQ ID NO: 1019349 - DNA, 22 bp, Artificial Sequence
  chemically synthesized
gttgaaaaatatgctccccacc

SEQ ID NO: 1019350 - DNA, 22 bp, Artificial Sequence
  chemically synthesized
atgttactggggtggggagcat

SEQ ID NO: 1019351 - DNA, 22 bp, Artificial Sequence
  chemically synthesized
ctggggtggggagcatattttt

SEQ ID NO: 1019352 - DNA, 22 bp, Artificial Sequence
  chemically synthesized
catgccactggttgaaaaatat

SEQ ID NO: 1019353 - DNA, 22 bp, Artificial Sequence
  chemically synthesized
gggtggggagcatatttttcaa

SEQ ID NO: 1019354 - DNA, 22 bp, Artificial Sequence
  chemically synthesized
ccatgccactggttgaaaaata

SEQ ID NO: 1019355 - DNA, 22 bp, Artificial Sequence
  chemically synthesized
cttccatgccactggttgaaaa

SEQ ID NO: 1019356 - DNA, 22 bp, Artificial Sequence
  chemically synthesized
ggccattccttccatgccactg

SEQ ID NO: 1019357 - DNA, 22 bp, Artificial Sequence
  chemically synthesized
gggccattccttccatgccact

SEQ ID NO: 1019358 - DNA, 22 bp, Artificial Sequence
  chemically synthesized
ttcaaccagtggcatggaagga

SEQ ID NO: 1019359 - DNA, 22 bp, Artificial Sequence
  chemically synthesized
tcaaccagtggcatggaaggaa

SEQ ID NO: 1019360 - DNA, 22 bp, Artificial Sequence
  chemically synthesized
gcccttgggccattccttccat

SEQ ID NO: 1019361 - DNA, 22 bp, Artificial Sequence
  chemically synthesized
caaccagtggcatggaaggaat

SEQ ID NO: 1019362 - DNA, 22 bp, Artificial Sequence
  chemically synthesized
aaccagtggcatggaaggaatg

SEQ ID NO: 1019363 - DNA, 22 bp, Artificial Sequence
  chemically synthesized
cccaactagcccttgggccatt

SEQ ID NO: 1019364 - DNA, 22 bp, Artificial Sequence
  chemically synthesized
gcccaactagcccttgggccat

SEQ ID NO: 1019365 - DNA, 22 bp, Artificial Sequence
  chemically synthesized
gtacatcttgcccaactagccc

SEQ ID NO: 1019366 - DNA, 22 bp, Artificial Sequence
  chemically synthesized
atctagtacatcttgcccaact

SEQ ID NO: 1019367 - DNA, 22 bp, Artificial Sequence
  chemically synthesized
ataatgttgatctagtacatct

SEQ ID NO: 1019368 - DNA, 22 bp, Artificial Sequence
  chemically synthesized
cataatgttgatctagtacatc

SEQ ID NO: 1019369 - DNA, 22 bp, Artificial Sequence
  chemically synthesized
gttgggcaagatgtactagatc

SEQ ID NO: 1019370 - DNA, 22 bp, Artificial Sequence
  chemically synthesized
ggcaagatgtactagatcaaca

SEQ ID NO: 1019371 - DNA, 22 bp, Artificial Sequence
  chemically synthesized
atgaaccttcataatgttgatc

SEQ ID NO: 1019372 - DNA, 22 bp, Artificial Sequence
  chemically synthesized
atattcatgaaccttcataatg

SEQ ID NO: 1019373 - DNA, 22 bp, Artificial Sequence
  chemically synthesized
gatattcatgaaccttcataat

SEQ ID NO: 1019374 - DNA, 22 bp, Artificial Sequence
  chemically synthesized
tgatattcatgaaccttcataa

SEQ ID NO: 1019375 - DNA, 22 bp, Artificial Sequence
  chemically synthesized
gatcaacattatgaaggttcat

SEQ ID NO: 1019376 - DNA, 22 bp, Artificial Sequence
  chemically synthesized
aaaaactttgatattcatgaac

SEQ ID NO: 1019377 - DNA, 22 bp, Artificial Sequence
  chemically synthesized
tgaaggttcatgaatatcaaag

SEQ ID NO: 1019378 - DNA, 22 bp, Artificial Sequence
  chemically synthesized
cataaatgaactcaaaaacttt

SEQ ID NO: 1019379 - DNA, 22 bp, Artificial Sequence
  chemically synthesized
tgcataaatgaactcaaaaact

SEQ ID NO: 1019380 - DNA, 22 bp, Artificial Sequence
  chemically synthesized
atgaatatcaaagtttttgagt

SEQ ID NO: 1019381 - DNA, 22 bp, Artificial Sequence
  chemically synthesized
ctgcataaatgaactcaaaaac

SEQ ID NO: 1019382 - DNA, 22 bp, Artificial Sequence
  chemically synthesized
cttctgcataaatgaactcaaa

SEQ ID NO: 1019383 - DNA, 22 bp, Artificial Sequence
  chemically synthesized
caataaactacttctgcataaa

SEQ ID NO: 1019384 - DNA, 22 bp, Artificial Sequence
  chemically synthesized
gcaataaactacttctgcataa

SEQ ID NO: 1019385 - DNA, 22 bp, Artificial Sequence
  chemically synthesized
tgcaataaactacttctgcata

SEQ ID NO: 1019386 - DNA, 22 bp, Artificial Sequence
  chemically synthesized
ttgagttcatttatgcagaagt

SEQ ID NO: 1019387 - DNA, 22 bp, Artificial Sequence
  chemically synthesized
ttgcaataaactacttctgcat

SEQ ID NO: 1019388 - DNA, 22 bp, Artificial Sequence
  chemically synthesized
tgagttcatttatgcagaagta

SEQ ID NO: 1019389 - DNA, 22 bp, Artificial Sequence
  chemically synthesized
gagttcatttatgcagaagtag

SEQ ID NO: 1019390 - DNA, 22 bp, Artificial Sequence
  chemically synthesized
ttttgcaataaactacttctgc

SEQ ID NO: 1019391 - DNA, 22 bp, Artificial Sequence
  chemically synthesized
agttcatttatgcagaagtagt

SEQ ID NO: 1019392 - DNA, 22 bp, Artificial Sequence
  chemically synthesized
atttatgcagaagtagtttatt

SEQ ID NO: 1019393 - DNA, 22 bp, Artificial Sequence
  chemically synthesized
atgcagaagtagtttattgcaa

SEQ ID NO: 1019394 - DNA, 22 bp, Artificial Sequence
  chemically synthesized
tgtggtactcttttgcaataaa

SEQ ID NO: 1019395 - DNA, 22 bp, Artificial Sequence
  chemically synthesized
tgcagaagtagtttattgcaaa

SEQ ID NO: 1019396 - DNA, 22 bp, Artificial Sequence
  chemically synthesized
gtgtggtactcttttgcaataa

SEQ ID NO: 1019397 - DNA, 22 bp, Artificial Sequence
  chemically synthesized
tgtgtggtactcttttgcaata

SEQ ID NO: 1019398 - DNA, 22 bp, Artificial Sequence
  chemically synthesized
ttttgtgtggtactcttttgca

SEQ ID NO: 1019399 - DNA, 22 bp, Artificial Sequence
  chemically synthesized
attttgtgtggtactcttttgc

SEQ ID NO: 1019400 - DNA, 22 bp, Artificial Sequence
  chemically synthesized
tttattttgtgtggtactcttt

SEQ ID NO: 1019401 - DNA, 22 bp, Artificial Sequence
  chemically synthesized
attgcaaaagagtaccacacaa

SEQ ID NO: 1019402 - DNA, 22 bp, Artificial Sequence
  chemically synthesized
cagctatttattttgtgtggta

SEQ ID NO: 1019403 - DNA, 22 bp, Artificial Sequence
  chemically synthesized
ttgcaaaagagtaccacacaaa

SEQ ID NO: 1019404 - DNA, 22 bp, Artificial Sequence
  chemically synthesized
caaaagagtaccacacaaaata

SEQ ID NO: 1019405 - DNA, 22 bp, Artificial Sequence
  chemically synthesized
tgaaagatctgcagctatttat

SEQ ID NO: 1019406 - DNA, 22 bp, Artificial Sequence
  chemically synthesized
tattgtgaaagatctgcagcta

SEQ ID NO: 1019407 - DNA, 22 bp, Artificial Sequence
  chemically synthesized
ttgtattgtgaaagatctgcag

SEQ ID NO: 1019408 - DNA, 22 bp, Artificial Sequence
  chemically synthesized
attgtattgtgaaagatctgca

SEQ ID NO: 1019409 - DNA, 22 bp, Artificial Sequence
  chemically synthesized
atttattgtattgtgaaagatc

SEQ ID NO: 1019410 - DNA, 22 bp, Artificial Sequence
  chemically synthesized
aatttattgtattgtgaaagat

SEQ ID NO: 1019411 - DNA, 22 bp, Artificial Sequence
  chemically synthesized
taatttattgtattgtgaaaga

SEQ ID NO: 1019412 - DNA, 22 bp, Artificial Sequence
  chemically synthesized
ttaatttattgtattgtgaaag

SEQ ID NO: 1019413 - DNA, 22 bp, Artificial Sequence
  chemically synthesized
tttaatttattgtattgtgaaa

SEQ ID NO: 1019414 - DNA, 22 bp, Artificial Sequence
  chemically synthesized
ttttaatttattgtattgtgaa

SEQ ID NO: 1019415 - DNA, 22 bp, Artificial Sequence
  chemically synthesized
cagatctttcacaatacaataa

SEQ ID NO: 1019416 - DNA, 22 bp, Artificial Sequence
  chemically synthesized
caagaagtttttttaatttatt

SEQ ID NO: 1019417 - DNA, 22 bp, Artificial Sequence
  chemically synthesized
tcacaatacaataaattaaaaa

SEQ ID NO: 1019418 - DNA, 22 bp, Artificial Sequence
  chemically synthesized
cacaatacaataaattaaaaaa

SEQ ID NO: 1019419 - DNA, 22 bp, Artificial Sequence
  chemically synthesized
acaatacaataaattaaaaaaa

SEQ ID NO: 1019420 - DNA, 22 bp, Artificial Sequence
  chemically synthesized
cccctccaagaagtttttttaa

SEQ ID NO: 1019421 - DNA, 22 bp, Artificial Sequence
  chemically synthesized
tccccctccaagaagttttttt

SEQ ID NO: 1019422 - DNA, 22 bp, Artificial Sequence
  chemically synthesized
tatattctccccctccaagaag

SEQ ID NO: 1019423 - DNA, 22 bp, Artificial Sequence
  chemically synthesized
tatatattctccccctccaaga

SEQ ID NO: 1019424 - DNA, 22 bp, Artificial Sequence
  chemically synthesized
aaaaaacttcttggagggggag

SEQ ID NO: 1019425 - DNA, 22 bp, Artificial Sequence
  chemically synthesized
ggaatgctctatatattctccc

SEQ ID NO: 1019426 - DNA, 22 bp, Artificial Sequence
  chemically synthesized
cttggagggggagaatatatag

SEQ ID NO: 1019427 - DNA, 22 bp, Artificial Sequence
  chemically synthesized
ttggagggggagaatatataga

SEQ ID NO: 1019428 - DNA, 22 bp, Artificial Sequence
  chemically synthesized
ggagggggagaatatatagagc

SEQ ID NO: 1019429 - DNA, 22 bp, Artificial Sequence
  chemically synthesized
gagggggagaatatatagagca

SEQ ID NO: 1019430 - DNA, 22 bp, Artificial Sequence
  chemically synthesized
taccaggaagtggattgggaat

SEQ ID NO: 1019431 - DNA, 22 bp, Artificial Sequence
  chemically synthesized
ccaatccacttcctggtacaat

SEQ ID NO: 1019432 - DNA, 22 bp, Artificial Sequence
  chemically synthesized
cctggtacaatttctttttctt

SEQ ID NO: 1019433 - DNA, 22 bp, Artificial Sequence
  chemically synthesized
ctggtacaatttctttttcttt

SEQ ID NO: 1019434 - DNA, 22 bp, Artificial Sequence
  chemically synthesized
gtacaatttctttttcttttat

SEQ ID NO: 1019435 - DNA, 22 bp, Artificial Sequence
  chemically synthesized
ctttttcttttatttatttatt

SEQ ID NO: 1019436 - DNA, 22 bp, Artificial Sequence
  chemically synthesized
tttttcttttatttatttattt

SEQ ID NO: 1019437 - DNA, 22 bp, Artificial Sequence
  chemically synthesized
tttcttttatttatttatttat

SEQ ID NO: 1019438 - DNA, 22 bp, Artificial Sequence
  chemically synthesized
ttcttttatttatttatttatt

SEQ ID NO: 1019439 - DNA, 22 bp, Artificial Sequence
  chemically synthesized
tcttttatttatttatttattt

SEQ ID NO: 1019440 - DNA, 22 bp, Artificial Sequence
  chemically synthesized
cttttatttatttatttattta

SEQ ID NO: 1019441 - DNA, 22 bp, Artificial Sequence
  chemically synthesized
ttttatttatttatttatttat

SEQ ID NO: 1019442 - DNA, 22 bp, Artificial Sequence
  chemically synthesized
ttatttatttatttatttattt

SEQ ID NO: 1019443 - DNA, 22 bp, Artificial Sequence
  chemically synthesized
tatttatttatttatttattta

SEQ ID NO: 1019444 - DNA, 22 bp, Artificial Sequence
  chemically synthesized
atttatttatttatttatttat

SEQ ID NO: 1019445 - DNA, 22 bp, Artificial Sequence
  chemically synthesized
tttatttatttatttatttatt

SEQ ID NO: 1019446 - DNA, 22 bp, Artificial Sequence
  chemically synthesized
atttatttatttatttatttat

SEQ ID NO: 1019447 - DNA, 22 bp, Artificial Sequence
  chemically synthesized
tttatttatttatttatttatt

SEQ ID NO: 1019448 - DNA, 22 bp, Artificial Sequence
  chemically synthesized
atttatttatttatttatttat

SEQ ID NO: 1019449 - DNA, 22 bp, Artificial Sequence
  chemically synthesized
tttatttatttatttatttatt

SEQ ID NO: 1019450 - DNA, 22 bp, Artificial Sequence
  chemically synthesized
atttatttatttatttatttat

SEQ ID NO: 1019451 - DNA, 22 bp, Artificial Sequence
  chemically synthesized
tttatttatttatttatttatt

SEQ ID NO: 1019452 - DNA, 22 bp, Artificial Sequence
  chemically synthesized
aataaataaataaataaataaa

SEQ ID NO: 1019453 - DNA, 22 bp, Artificial Sequence
  chemically synthesized
atttatttatttatttatttat

SEQ ID NO: 1019454 - DNA, 22 bp, Artificial Sequence
  chemically synthesized
tttatttatttatttatttatt

SEQ ID NO: 1019455 - DNA, 22 bp, Artificial Sequence
  chemically synthesized
cgtctcaataaataaataaata

SEQ ID NO: 1019456 - DNA, 22 bp, Artificial Sequence
  chemically synthesized
atttatttatttatttatttat

SEQ ID NO: 1019457 - DNA, 22 bp, Artificial Sequence
  chemically synthesized
tttatttatttatttatttatt

SEQ ID NO: 1019458 - DNA, 22 bp, Artificial Sequence
  chemically synthesized
atttatttatttatttatttat

SEQ ID NO: 1019459 - DNA, 22 bp, Artificial Sequence
  chemically synthesized
tttatttatttatttatttatt

SEQ ID NO: 1019460 - DNA, 22 bp, Artificial Sequence
  chemically synthesized
atttatttatttatttattgag

SEQ ID NO: 1019461 - DNA, 22 bp, Artificial Sequence
  chemically synthesized
tttatttatttatttattgaga

SEQ ID NO: 1019462 - DNA, 22 bp, Artificial Sequence
  chemically synthesized
atttatttatttattgagacgg

SEQ ID NO: 1019463 - DNA, 22 bp, Artificial Sequence
  chemically synthesized
tttatttatttattgagacgga

SEQ ID NO: 1019464 - DNA, 22 bp, Artificial Sequence
  chemically synthesized
atttatttattgagacggagct

SEQ ID NO: 1019465 - DNA, 22 bp, Artificial Sequence
  chemically synthesized
tttatttattgagacggagctt

SEQ ID NO: 1019466 - DNA, 22 bp, Artificial Sequence
  chemically synthesized
gggcaacaagagcgaagctccg

SEQ ID NO: 1019467 - DNA, 22 bp, Artificial Sequence
  chemically synthesized
atttattgagacggagcttcgc

SEQ ID NO: 1019468 - DNA, 22 bp, Artificial Sequence
  chemically synthesized
tttattgagacggagcttcgct

SEQ ID NO: 1019469 - DNA, 22 bp, Artificial Sequence
  chemically synthesized
attgagacggagcttcgctctt

SEQ ID NO: 1019470 - DNA, 22 bp, Artificial Sequence
  chemically synthesized
ttgagacggagcttcgctcttg

SEQ ID NO: 1019471 - DNA, 22 bp, Artificial Sequence
  chemically synthesized
cagctggggcaacaagagcgaa

SEQ ID NO: 1019472 - DNA, 22 bp, Artificial Sequence
  chemically synthesized
agacggagcttcgctcttgttg

SEQ ID NO: 1019473 - DNA, 22 bp, Artificial Sequence
  chemically synthesized
cactccagctggggcaacaaga

SEQ ID NO: 1019474 - DNA, 22 bp, Artificial Sequence
  chemically synthesized
cgctcttgttgccccagctgga

SEQ ID NO: 1019475 - DNA, 22 bp, Artificial Sequence
  chemically synthesized
gctcttgttgccccagctggag

SEQ ID NO: 1019476 - DNA, 22 bp, Artificial Sequence
  chemically synthesized
ttgttgccccagctggagtgca

SEQ ID NO: 1019477 - DNA, 22 bp, Artificial Sequence
  chemically synthesized
gttgccccagctggagtgcaat

SEQ ID NO: 1019478 - DNA, 22 bp, Artificial Sequence
  chemically synthesized
ttgccccagctggagtgcaatg

SEQ ID NO: 1019479 - DNA, 22 bp, Artificial Sequence
  chemically synthesized
ccccagctggagtgcaatggtg

SEQ ID NO: 1019480 - DNA, 22 bp, Artificial Sequence
  chemically synthesized
tggtgagagaagatcacaccat

SEQ ID NO: 1019481 - DNA, 22 bp, Artificial Sequence
  chemically synthesized
gagtgcaatggtgtgatcttct

SEQ ID NO: 1019482 - DNA, 22 bp, Artificial Sequence
  chemically synthesized
gaggcataggttgtggtgagag

SEQ ID NO: 1019483 - DNA, 22 bp, Artificial Sequence
  chemically synthesized
caccctggaggcataggttgtg

SEQ ID NO: 1019484 - DNA, 22 bp, Artificial Sequence
  chemically synthesized
ccaccctggaggcataggttgt

SEQ ID NO: 1019485 - DNA, 22 bp, Artificial Sequence
  chemically synthesized
ttccaccctggaggcataggtt

SEQ ID NO: 1019486 - DNA, 22 bp, Artificial Sequence
  chemically synthesized
ctctcaccacaacctatgcctc

SEQ ID NO: 1019487 - DNA, 22 bp, Artificial Sequence
  chemically synthesized
tctcaccacaacctatgcctcc

SEQ ID NO: 1019488 - DNA, 22 bp, Artificial Sequence
  chemically synthesized
tcaccacaacctatgcctccag

SEQ ID NO: 1019489 - DNA, 22 bp, Artificial Sequence
  chemically synthesized
accacaacctatgcctccaggg

SEQ ID NO: 1019490 - DNA, 22 bp, Artificial Sequence
  chemically synthesized
aggcaagagaatctcttccacc

SEQ ID NO: 1019491 - DNA, 22 bp, Artificial Sequence
  chemically synthesized
tgcctccagggtggaagagatt

SEQ ID NO: 1019492 - DNA, 22 bp, Artificial Sequence
  chemically synthesized
cagggtggaagagattctcttg

SEQ ID NO: 1019493 - DNA, 22 bp, Artificial Sequence
  chemically synthesized
aggaggctaaggcaagagaatc

SEQ ID NO: 1019494 - DNA, 22 bp, Artificial Sequence
  chemically synthesized
ctcaggaggctaaggcaagaga

SEQ ID NO: 1019495 - DNA, 22 bp, Artificial Sequence
  chemically synthesized
taaccccagctactcaggaggc

SEQ ID NO: 1019496 - DNA, 22 bp, Artificial Sequence
  chemically synthesized
tcttgccttagcctcctgagta

SEQ ID NO: 1019497 - DNA, 22 bp, Artificial Sequence
  chemically synthesized
ttgccttagcctcctgagtagc

SEQ ID NO: 1019498 - DNA, 22 bp, Artificial Sequence
  chemically synthesized
gccttagcctcctgagtagctg

SEQ ID NO: 1019499 - DNA, 22 bp, Artificial Sequence
  chemically synthesized
ccttagcctcctgagtagctgg

SEQ ID NO: 1019500 - DNA, 22 bp, Artificial Sequence
  chemically synthesized
agcctcctgagtagctggggtt

SEQ ID NO: 1019501 - DNA, 22 bp, Artificial Sequence
  chemically synthesized
gcctcctgagtagctggggtta

SEQ ID NO: 1019502 - DNA, 22 bp, Artificial Sequence
  chemically synthesized
ctgagtagctggggttacaggc

SEQ ID NO: 1019503 - DNA, 22 bp, Artificial Sequence
  chemically synthesized
agtagctggggttacaggcatg

SEQ ID NO: 1019504 - DNA, 22 bp, Artificial Sequence
  chemically synthesized
gccaggcatggtggcgcatgcc

SEQ ID NO: 1019505 - DNA, 22 bp, Artificial Sequence
  chemically synthesized
gggttacaggcatgcgccacca

SEQ ID NO: 1019506 - DNA, 22 bp, Artificial Sequence
  chemically synthesized
caggcatgcgccaccatgcctg

SEQ ID NO: 1019507 - DNA, 22 bp, Artificial Sequence
  chemically synthesized
aaatacaaaattagccaggcat

SEQ ID NO: 1019508 - DNA, 22 bp, Artificial Sequence
  chemically synthesized
aaaatacaaaattagccaggca

SEQ ID NO: 1019509 - DNA, 22 bp, Artificial Sequence
  chemically synthesized
cttaaaatacaaaattagccag

SEQ ID NO: 1019510 - DNA, 22 bp, Artificial Sequence
  chemically synthesized
tacttaaaatacaaaattagcc

SEQ ID NO: 1019511 - DNA, 22 bp, Artificial Sequence
  chemically synthesized
tctacttaaaatacaaaattag

SEQ ID NO: 1019512 - DNA, 22 bp, Artificial Sequence
  chemically synthesized
gctaattttgtattttaagtag

SEQ ID NO: 1019513 - DNA, 22 bp, Artificial Sequence
  chemically synthesized
attttgtattttaagtagagag

SEQ ID NO: 1019514 - DNA, 22 bp, Artificial Sequence
  chemically synthesized
tgtattttaagtagagagggtt

SEQ ID NO: 1019515 - DNA, 22 bp, Artificial Sequence
  chemically synthesized
gtattttaagtagagagggttt

SEQ ID NO: 1019516 - DNA, 22 bp, Artificial Sequence
  chemically synthesized
agcaacatggagaaaccctctc

SEQ ID NO: 1019517 - DNA, 22 bp, Artificial Sequence
  chemically synthesized
tattttaagtagagagggtttc

SEQ ID NO: 1019518 - DNA, 22 bp, Artificial Sequence
  chemically synthesized
taagtagagagggtttctccat

SEQ ID NO: 1019519 - DNA, 22 bp, Artificial Sequence
  chemically synthesized
aagtagagagggtttctccatg

SEQ ID NO: 1019520 - DNA, 22 bp, Artificial Sequence
  chemically synthesized
agtagagagggtttctccatgt

SEQ ID NO: 1019521 - DNA, 22 bp, Artificial Sequence
  chemically synthesized
gagaccagactgagcaacatgg

SEQ ID NO: 1019522 - DNA, 22 bp, Artificial Sequence
  chemically synthesized
ctccatgttgctcagtctggtc

SEQ ID NO: 1019523 - DNA, 22 bp, Artificial Sequence
  chemically synthesized
tccatgttgctcagtctggtct

SEQ ID NO: 1019524 - DNA, 22 bp, Artificial Sequence
  chemically synthesized
catgttgctcagtctggtctcg

SEQ ID NO: 1019525 - DNA, 22 bp, Artificial Sequence
  chemically synthesized
aggtcgggagttcgagaccaga

SEQ ID NO: 1019526 - DNA, 22 bp, Artificial Sequence
  chemically synthesized
ctcagtctggtctcgaactccc

SEQ ID NO: 1019527 - DNA, 22 bp, Artificial Sequence
  chemically synthesized
agtctggtctcgaactcccgac

SEQ ID NO: 1019528 - DNA, 22 bp, Artificial Sequence
  chemically synthesized
gtctcgaactcccgacctcagg

SEQ ID NO: 1019529 - DNA, 22 bp, Artificial Sequence
  chemically synthesized
gaactcccgacctcaggtgatc

SEQ ID NO: 1019530 - DNA, 22 bp, Artificial Sequence
  chemically synthesized
agagaccaaggtgggcggatca

SEQ ID NO: 1019531 - DNA, 22 bp, Artificial Sequence
  chemically synthesized
ccgacctcaggtgatccgccca

SEQ ID NO: 1019532 - DNA, 22 bp, Artificial Sequence
  chemically synthesized
gagagaccaaggtgggcggatc

SEQ ID NO: 1019533 - DNA, 22 bp, Artificial Sequence
  chemically synthesized
tgagagaccaaggtgggcggat

SEQ ID NO: 1019534 - DNA, 22 bp, Artificial Sequence
  chemically synthesized
aggtgatccgcccaccttggtc

SEQ ID NO: 1019535 - DNA, 22 bp, Artificial Sequence
  chemically synthesized
taatcccagcactttgagagac

SEQ ID NO: 1019536 - DNA, 22 bp, Artificial Sequence
  chemically synthesized
atgcctgtaatcccagcacttt

SEQ ID NO: 1019537 - DNA, 22 bp, Artificial Sequence
  chemically synthesized
ggtctctcaaagtgctgggatt

SEQ ID NO: 1019538 - DNA, 22 bp, Artificial Sequence
  chemically synthesized
gtctctcaaagtgctgggatta

SEQ ID NO: 1019539 - DNA, 22 bp, Artificial Sequence
  chemically synthesized
tcaaagtgctgggattacaggc

SEQ ID NO: 1019540 - DNA, 22 bp, Artificial Sequence
  chemically synthesized
aaagtgctgggattacaggcat

SEQ ID NO: 1019541 - DNA, 22 bp, Artificial Sequence
  chemically synthesized
ggtgtggtgactcatgcctgta

SEQ ID NO: 1019542 - DNA, 22 bp, Artificial Sequence
  chemically synthesized
ggattacaggcatgagtcacca

SEQ ID NO: 1019543 - DNA, 22 bp, Artificial Sequence
  chemically synthesized
taccgggctgggtgtggtgact

SEQ ID NO: 1019544 - DNA, 22 bp, Artificial Sequence
  chemically synthesized
caggcatgagtcaccacaccca

SEQ ID NO: 1019545 - DNA, 22 bp, Artificial Sequence
  chemically synthesized
agaaattgtaccgggctgggtg

SEQ ID NO: 1019546 - DNA, 22 bp, Artificial Sequence
  chemically synthesized
gcacaaaatgaagcctaagaaa

SEQ ID NO: 1019547 - DNA, 22 bp, Artificial Sequence
  chemically synthesized
ggcacaaaatgaagcctaagaa

SEQ ID NO: 1019548 - DNA, 22 bp, Artificial Sequence
  chemically synthesized
tggcacaaaatgaagcctaaga

SEQ ID NO: 1019549 - DNA, 22 bp, Artificial Sequence
  chemically synthesized
cttaggcttcattttgtgccaa

SEQ ID NO: 1019550 - DNA, 22 bp, Artificial Sequence
  chemically synthesized
ttaggcttcattttgtgccaaa

SEQ ID NO: 1019551 - DNA, 22 bp, Artificial Sequence
  chemically synthesized
aggcttcattttgtgccaaaat

SEQ ID NO: 1019552 - DNA, 22 bp, Artificial Sequence
  chemically synthesized
catatatatacaattttggcac

SEQ ID NO: 1019553 - DNA, 22 bp, Artificial Sequence
  chemically synthesized
ggcttcattttgtgccaaaatt

SEQ ID NO: 1019554 - DNA, 22 bp, Artificial Sequence
  chemically synthesized
acatatatatacaattttggca

SEQ ID NO: 1019555 - DNA, 22 bp, Artificial Sequence
  chemically synthesized
cattttgtgccaaaattgtata

SEQ ID NO: 1019556 - DNA, 22 bp, Artificial Sequence
  chemically synthesized
attttgtgccaaaattgtatat

SEQ ID NO: 1019557 - DNA, 22 bp, Artificial Sequence
  chemically synthesized
tgtgccaaaattgtatatatat

SEQ ID NO: 1019558 - DNA, 22 bp, Artificial Sequence
  chemically synthesized
gtgccaaaattgtatatatatg

SEQ ID NO: 1019559 - DNA, 22 bp, Artificial Sequence
  chemically synthesized
tgccaaaattgtatatatatgt

SEQ ID NO: 1019560 - DNA, 22 bp, Artificial Sequence
  chemically synthesized
tatatatatgtaagctatactt

SEQ ID NO: 1019561 - DNA, 22 bp, Artificial Sequence
  chemically synthesized
atggaaaacatggtgaagtata

SEQ ID NO: 1019562 - DNA, 22 bp, Artificial Sequence
  chemically synthesized
tagggttaatggaaaacatggt

SEQ ID NO: 1019563 - DNA, 22 bp, Artificial Sequence
  chemically synthesized
tacttcaccatgttttccatta

SEQ ID NO: 1019564 - DNA, 22 bp, Artificial Sequence
  chemically synthesized
caccatgttttccattaaccct

SEQ ID NO: 1019565 - DNA, 22 bp, Artificial Sequence
  chemically synthesized
accatgttttccattaacccta

SEQ ID NO: 1019566 - DNA, 22 bp, Artificial Sequence
  chemically synthesized
ccgaaatcgcagttgtagggtt

SEQ ID NO: 1019567 - DNA, 22 bp, Artificial Sequence
  chemically synthesized
tccattaaccctacaactgcga

SEQ ID NO: 1019568 - DNA, 22 bp, Artificial Sequence
  chemically synthesized
ccattaaccctacaactgcgat

SEQ ID NO: 1019569 - DNA, 22 bp, Artificial Sequence
  chemically synthesized
cattaaccctacaactgcgatt

SEQ ID NO: 1019570 - DNA, 22 bp, Artificial Sequence
  chemically synthesized
accctacaactgcgatttcggc

SEQ ID NO: 1019571 - DNA, 22 bp, Artificial Sequence
  chemically synthesized
agaagcatgaagctgccgaaat

SEQ ID NO: 1019572 - DNA, 22 bp, Artificial Sequence
  chemically synthesized
gagaagcatgaagctgccgaaa

SEQ ID NO: 1019573 - DNA, 22 bp, Artificial Sequence
  chemically synthesized
ttgagaagcatgaagctgccga

SEQ ID NO: 1019574 - DNA, 22 bp, Artificial Sequence
  chemically synthesized
caactgcgatttcggcagcttc

SEQ ID NO: 1019575 - DNA, 22 bp, Artificial Sequence
  chemically synthesized
cgatttcggcagcttcatgctt

SEQ ID NO: 1019576 - DNA, 22 bp, Artificial Sequence
  chemically synthesized
cggcagcttcatgcttctcaag

SEQ ID NO: 1019577 - DNA, 22 bp, Artificial Sequence
  chemically synthesized
ggcagcttcatgcttctcaaga

SEQ ID NO: 1019578 - DNA, 22 bp, Artificial Sequence
  chemically synthesized
tgacccataccatggctcttga

SEQ ID NO: 1019579 - DNA, 22 bp, Artificial Sequence
  chemically synthesized
ctgtgacccataccatggctct

SEQ ID NO: 1019580 - DNA, 22 bp, Artificial Sequence
  chemically synthesized
catgcttctcaagagccatggt

SEQ ID NO: 1019581 - DNA, 22 bp, Artificial Sequence
  chemically synthesized
actgtgacccataccatggctc

SEQ ID NO: 1019582 - DNA, 22 bp, Artificial Sequence
  chemically synthesized
atgcttctcaagagccatggta

SEQ ID NO: 1019583 - DNA, 22 bp, Artificial Sequence
  chemically synthesized
tactgtgacccataccatggct

SEQ ID NO: 1019584 - DNA, 22 bp, Artificial Sequence
  chemically synthesized
ctcaagagccatggtatgggtc

SEQ ID NO: 1019585 - DNA, 22 bp, Artificial Sequence
  chemically synthesized
tcaagagccatggtatgggtca

SEQ ID NO: 1019586 - DNA, 22 bp, Artificial Sequence
  chemically synthesized
aagagccatggtatgggtcaca

SEQ ID NO: 1019587 - DNA, 22 bp, Artificial Sequence
  chemically synthesized
gtggaccagccagttttactgt

SEQ ID NO: 1019588 - DNA, 22 bp, Artificial Sequence
  chemically synthesized
ggtggaccagccagttttactg

SEQ ID NO: 1019589 - DNA, 22 bp, Artificial Sequence
  chemically synthesized
tttggtggaccagccagtttta

SEQ ID NO: 1019590 - DNA, 22 bp, Artificial Sequence
  chemically synthesized
tctatttggtggaccagccagt

SEQ ID NO: 1019591 - DNA, 22 bp, Artificial Sequence
  chemically synthesized
ctgtctatttggtggaccagcc

SEQ ID NO: 1019592 - DNA, 22 bp, Artificial Sequence
  chemically synthesized
ccgtccctgctgtctatttggt

SEQ ID NO: 1019593 - DNA, 22 bp, Artificial Sequence
  chemically synthesized
gctggtccaccaaatagacagc

SEQ ID NO: 1019594 - DNA, 22 bp, Artificial Sequence
  chemically synthesized
accactgccgtccctgctgtct

SEQ ID NO: 1019595 - DNA, 22 bp, Artificial Sequence
  chemically synthesized
gtccaccaaatagacagcaggg

SEQ ID NO: 1019596 - DNA, 22 bp, Artificial Sequence
  chemically synthesized
ttcaccactgccgtccctgctg

SEQ ID NO: 1019597 - DNA, 22 bp, Artificial Sequence
  chemically synthesized
gtggtcatgggactattcacca

SEQ ID NO: 1019598 - DNA, 22 bp, Artificial Sequence
  chemically synthesized
tcgtggtcatgggactattcac

SEQ ID NO: 1019599 - DNA, 22 bp, Artificial Sequence
  chemically synthesized
gtctctcgtggtcatgggacta

SEQ ID NO: 1019600 - DNA, 22 bp, Artificial Sequence
  chemically synthesized
tggtctctcgtggtcatgggac

SEQ ID NO: 1019601 - DNA, 22 bp, Artificial Sequence
  chemically synthesized
ctggtctctcgtggtcatggga

SEQ ID NO: 1019602 - DNA, 22 bp, Artificial Sequence
  chemically synthesized
tctggtctctcgtggtcatggg

SEQ ID NO: 1019603 - DNA, 22 bp, Artificial Sequence
  chemically synthesized
tttctggtctctcgtggtcatg

SEQ ID NO: 1019604 - DNA, 22 bp, Artificial Sequence
  chemically synthesized
attctttctggtctctcgtggt

SEQ ID NO: 1019605 - DNA, 22 bp, Artificial Sequence
  chemically synthesized
tagacaactaattctttctggt

SEQ ID NO: 1019606 - DNA, 22 bp, Artificial Sequence
  chemically synthesized
acagacaagagtagctatagac

SEQ ID NO: 1019607 - DNA, 22 bp, Artificial Sequence
  chemically synthesized
taatctcacagacaagagtagc

SEQ ID NO: 1019608 - DNA, 22 bp, Artificial Sequence
  chemically synthesized
gttgtctatagctactcttgtc

SEQ ID NO: 1019609 - DNA, 22 bp, Artificial Sequence
  chemically synthesized
tctatagctactcttgtctgtg

SEQ ID NO: 1019610 - DNA, 22 bp, Artificial Sequence
  chemically synthesized
tagctactcttgtctgtgagat

SEQ ID NO: 1019611 - DNA, 22 bp, Artificial Sequence
  chemically synthesized
ctcttgtctgtgagattatagt

SEQ ID NO: 1019612 - DNA, 22 bp, Artificial Sequence
  chemically synthesized
aaggcgaaaatgaactataatc

SEQ ID NO: 1019613 - DNA, 22 bp, Artificial Sequence
  chemically synthesized
caaggcgaaaatgaactataat

SEQ ID NO: 1019614 - DNA, 22 bp, Artificial Sequence
  chemically synthesized
ttgtctgtgagattatagttca

SEQ ID NO: 1019615 - DNA, 22 bp, Artificial Sequence
  chemically synthesized
tcaaggcgaaaatgaactataa

SEQ ID NO: 1019616 - DNA, 22 bp, Artificial Sequence
  chemically synthesized
gtctgtgagattatagttcatt

SEQ ID NO: 1019617 - DNA, 22 bp, Artificial Sequence
  chemically synthesized
tctgtgagattatagttcattt

SEQ ID NO: 1019618 - DNA, 22 bp, Artificial Sequence
  chemically synthesized
ctttcaaggcgaaaatgaacta

SEQ ID NO: 1019619 - DNA, 22 bp, Artificial Sequence
  chemically synthesized
cctttcaaggcgaaaatgaact

SEQ ID NO: 1019620 - DNA, 22 bp, Artificial Sequence
  chemically synthesized
tgagattatagttcattttcgc

SEQ ID NO: 1019621 - DNA, 22 bp, Artificial Sequence
  chemically synthesized
aaaccttcctttcaaggcgaaa

SEQ ID NO: 1019622 - DNA, 22 bp, Artificial Sequence
  chemically synthesized
tagttcattttcgccttgaaag

SEQ ID NO: 1019623 - DNA, 22 bp, Artificial Sequence
  chemically synthesized
attttcgccttgaaaggaaggt

SEQ ID NO: 1019624 - DNA, 22 bp, Artificial Sequence
  chemically synthesized
tcgccttgaaaggaaggtttta

SEQ ID NO: 1019625 - DNA, 22 bp, Artificial Sequence
  chemically synthesized
acccaacataactaaaaccttc

SEQ ID NO: 1019626 - DNA, 22 bp, Artificial Sequence
  chemically synthesized
cgccttgaaaggaaggttttag

SEQ ID NO: 1019627 - DNA, 22 bp, Artificial Sequence
  chemically synthesized
gccttgaaaggaaggttttagt

SEQ ID NO: 1019628 - DNA, 22 bp, Artificial Sequence
  chemically synthesized
ctgacccaacataactaaaacc

SEQ ID NO: 1019629 - DNA, 22 bp, Artificial Sequence
  chemically synthesized
cctgacccaacataactaaaac

SEQ ID NO: 1019630 - DNA, 22 bp, Artificial Sequence
  chemically synthesized
tcctgacccaacataactaaaa

SEQ ID NO: 1019631 - DNA, 22 bp, Artificial Sequence
  chemically synthesized
ttcctgacccaacataactaaa

SEQ ID NO: 1019632 - DNA, 22 bp, Artificial Sequence
  chemically synthesized
gaaaggaaggttttagttatgt

SEQ ID NO: 1019633 - DNA, 22 bp, Artificial Sequence
  chemically synthesized
aaaggaaggttttagttatgtt

SEQ ID NO: 1019634 - DNA, 22 bp, Artificial Sequence
  chemically synthesized
tcttttcctgacccaacataac

SEQ ID NO: 1019635 - DNA, 22 bp, Artificial Sequence
  chemically synthesized
tagttatgttgggtcaggaaaa

SEQ ID NO: 1019636 - DNA, 22 bp, Artificial Sequence
  chemically synthesized
agttatgttgggtcaggaaaag

SEQ ID NO: 1019637 - DNA, 22 bp, Artificial Sequence
  chemically synthesized
gttatgttgggtcaggaaaaga

SEQ ID NO: 1019638 - DNA, 22 bp, Artificial Sequence
  chemically synthesized
tgttgggtcaggaaaagacaga

SEQ ID NO: 1019639 - DNA, 22 bp, Artificial Sequence
  chemically synthesized
ggtcaggaaaagacagatgggt

SEQ ID NO: 1019640 - DNA, 22 bp, Artificial Sequence
  chemically synthesized
ataggcaataaataataaccca

SEQ ID NO: 1019641 - DNA, 22 bp, Artificial Sequence
  chemically synthesized
aaactgataggcaataaataat

SEQ ID NO: 1019642 - DNA, 22 bp, Artificial Sequence
  chemically synthesized
cacgtggttaaaactgataggc

SEQ ID NO: 1019643 - DNA, 22 bp, Artificial Sequence
  chemically synthesized
gcacgtggttaaaactgatagg

SEQ ID NO: 1019644 - DNA, 22 bp, Artificial Sequence
  chemically synthesized
ttatttattgcctatcagtttt

SEQ ID NO: 1019645 - DNA, 22 bp, Artificial Sequence
  chemically synthesized
atttgcacgtggttaaaactga

SEQ ID NO: 1019646 - DNA, 22 bp, Artificial Sequence
  chemically synthesized
tttattgcctatcagttttaac

SEQ ID NO: 1019647 - DNA, 22 bp, Artificial Sequence
  chemically synthesized
attgcctatcagttttaaccac

SEQ ID NO: 1019648 - DNA, 22 bp, Artificial Sequence
  chemically synthesized
ttgcctatcagttttaaccacg

SEQ ID NO: 1019649 - DNA, 22 bp, Artificial Sequence
  chemically synthesized
cctatcagttttaaccacgtgc

SEQ ID NO: 1019650 - DNA, 22 bp, Artificial Sequence
  chemically synthesized
cataacgttcatttgcacgtgg

SEQ ID NO: 1019651 - DNA, 22 bp, Artificial Sequence
  chemically synthesized
gcataacgttcatttgcacgtg

SEQ ID NO: 1019652 - DNA, 22 bp, Artificial Sequence
  chemically synthesized
tcagttttaaccacgtgcaaat

SEQ ID NO: 1019653 - DNA, 22 bp, Artificial Sequence
  chemically synthesized
atcttgcataacgttcatttgc

SEQ ID NO: 1019654 - DNA, 22 bp, Artificial Sequence
  chemically synthesized
tcatcttgcataacgttcattt

SEQ ID NO: 1019655 - DNA, 22 bp, Artificial Sequence
  chemically synthesized
taaccacgtgcaaatgaacgtt

SEQ ID NO: 1019656 - DNA, 22 bp, Artificial Sequence
  chemically synthesized
aaccacgtgcaaatgaacgtta

SEQ ID NO: 1019657 - DNA, 22 bp, Artificial Sequence
  chemically synthesized
accacgtgcaaatgaacgttat

SEQ ID NO: 1019658 - DNA, 22 bp, Artificial Sequence
  chemically synthesized
tgctctcatcttgcataacgtt

SEQ ID NO: 1019659 - DNA, 22 bp, Artificial Sequence
  chemically synthesized
ctatgctctcatcttgcataac

SEQ ID NO: 1019660 - DNA, 22 bp, Artificial Sequence
  chemically synthesized
tcctatgctctcatcttgcata

SEQ ID NO: 1019661 - DNA, 22 bp, Artificial Sequence
  chemically synthesized
ctcctatgctctcatcttgcat

SEQ ID NO: 1019662 - DNA, 22 bp, Artificial Sequence
  chemically synthesized
gcttctcctatgctctcatctt

SEQ ID NO: 1019663 - DNA, 22 bp, Artificial Sequence
  chemically synthesized
tagcttctcctatgctctcatc

SEQ ID NO: 1019664 - DNA, 22 bp, Artificial Sequence
  chemically synthesized
ctagcttctcctatgctctcat

SEQ ID NO: 1019665 - DNA, 22 bp, Artificial Sequence
  chemically synthesized
gacttctagcttctcctatgct

SEQ ID NO: 1019666 - DNA, 22 bp, Artificial Sequence
  chemically synthesized
tgcaagatgagagcataggaga

SEQ ID NO: 1019667 - DNA, 22 bp, Artificial Sequence
  chemically synthesized
attagacttctagcttctccta

SEQ ID NO: 1019668 - DNA, 22 bp, Artificial Sequence
  chemically synthesized
aagaactgattagacttctagc

SEQ ID NO: 1019669 - DNA, 22 bp, Artificial Sequence
  chemically synthesized
caagaactgattagacttctag

SEQ ID NO: 1019670 - DNA, 22 bp, Artificial Sequence
  chemically synthesized
ttcaagaactgattagacttct

SEQ ID NO: 1019671 - DNA, 22 bp, Artificial Sequence
  chemically synthesized
cttcaagaactgattagacttc

SEQ ID NO: 1019672 - DNA, 22 bp, Artificial Sequence
  chemically synthesized
cttcttcaagaactgattagac

SEQ ID NO: 1019673 - DNA, 22 bp, Artificial Sequence
  chemically synthesized
ccttcttcaagaactgattaga

SEQ ID NO: 1019674 - DNA, 22 bp, Artificial Sequence
  chemically synthesized
tccttcttcaagaactgattag

SEQ ID NO: 1019675 - DNA, 22 bp, Artificial Sequence
  chemically synthesized
actttccttcttcaagaactga

SEQ ID NO: 1019676 - DNA, 22 bp, Artificial Sequence
  chemically synthesized
cactttccttcttcaagaactg

SEQ ID NO: 1019677 - DNA, 22 bp, Artificial Sequence
  chemically synthesized
gaagtctaatcagttcttgaag

SEQ ID NO: 1019678 - DNA, 22 bp, Artificial Sequence
  chemically synthesized
atcagttcttgaagaaggaaag

SEQ ID NO: 1019679 - DNA, 22 bp, Artificial Sequence
  chemically synthesized
ttgaagaaggaaagtgaaattg

SEQ ID NO: 1019680 - DNA, 22 bp, Artificial Sequence
  chemically synthesized
gaagaaggaaagtgaaattgtg

SEQ ID NO: 1019681 - DNA, 22 bp, Artificial Sequence
  chemically synthesized
aatgtcaaatgtcacaatttca

SEQ ID NO: 1019682 - DNA, 22 bp, Artificial Sequence
  chemically synthesized
aagaaggaaagtgaaattgtga

SEQ ID NO: 1019683 - DNA, 22 bp, Artificial Sequence
  chemically synthesized
aaatgtcaaatgtcacaatttc

SEQ ID NO: 1019684 - DNA, 22 bp, Artificial Sequence
  chemically synthesized
taaatgtcaaatgtcacaattt

SEQ ID NO: 1019685 - DNA, 22 bp, Artificial Sequence
  chemically synthesized
ttaaatgtcaaatgtcacaatt

SEQ ID NO: 1019686 - DNA, 22 bp, Artificial Sequence
  chemically synthesized
tatttttaaatgtcaaatgtca

SEQ ID NO: 1019687 - DNA, 22 bp, Artificial Sequence
  chemically synthesized
caaaattatatttttaaatgtc

SEQ ID NO: 1019688 - DNA, 22 bp, Artificial Sequence
  chemically synthesized
acaaaattatatttttaaatgt

SEQ ID NO: 1019689 - DNA, 22 bp, Artificial Sequence
  chemically synthesized
tgacatttgacatttaaaaata

SEQ ID NO: 1019690 - DNA, 22 bp, Artificial Sequence
  chemically synthesized
tagcttacaaaattatattttt

SEQ ID NO: 1019691 - DNA, 22 bp, Artificial Sequence
  chemically synthesized
atagcttacaaaattatatttt

SEQ ID NO: 1019692 - DNA, 22 bp, Artificial Sequence
  chemically synthesized
tatagcttacaaaattatattt

SEQ ID NO: 1019693 - DNA, 22 bp, Artificial Sequence
  chemically synthesized
tttatagcttacaaaattatat

SEQ ID NO: 1019694 - DNA, 22 bp, Artificial Sequence
  chemically synthesized
gacatttaaaaatataattttg

SEQ ID NO: 1019695 - DNA, 22 bp, Artificial Sequence
  chemically synthesized
ctttatagcttacaaaattata

SEQ ID NO: 1019696 - DNA, 22 bp, Artificial Sequence
  chemically synthesized
acatttaaaaatataattttgt

SEQ ID NO: 1019697 - DNA, 22 bp, Artificial Sequence
  chemically synthesized
aaaaatataattttgtaagcta

SEQ ID NO: 1019698 - DNA, 22 bp, Artificial Sequence
  chemically synthesized
aaaatataattttgtaagctat

SEQ ID NO: 1019699 - DNA, 22 bp, Artificial Sequence
  chemically synthesized
accacccccttctttatagctt

SEQ ID NO: 1019700 - DNA, 22 bp, Artificial Sequence
  chemically synthesized
tcaccacccccttctttatagc

SEQ ID NO: 1019701 - DNA, 22 bp, Artificial Sequence
  chemically synthesized
ctcaccacccccttctttatag

SEQ ID NO: 1019702 - DNA, 22 bp, Artificial Sequence
  chemically synthesized
acttctcaccacccccttcttt

SEQ ID NO: 1019703 - DNA, 22 bp, Artificial Sequence
  chemically synthesized
tgtaagctataaagaagggggt

SEQ ID NO: 1019704 - DNA, 22 bp, Artificial Sequence
  chemically synthesized
taacttctcaccacccccttct

SEQ ID NO: 1019705 - DNA, 22 bp, Artificial Sequence
  chemically synthesized
gtaagctataaagaagggggtg

SEQ ID NO: 1019706 - DNA, 22 bp, Artificial Sequence
  chemically synthesized
taagctataaagaagggggtgg

SEQ ID NO: 1019707 - DNA, 22 bp, Artificial Sequence
  chemically synthesized
ttctaacttctcaccaccccct

SEQ ID NO: 1019708 - DNA, 22 bp, Artificial Sequence
  chemically synthesized
taaagaagggggtggtgagaag

SEQ ID NO: 1019709 - DNA, 22 bp, Artificial Sequence
  chemically synthesized
caaaccactattctaacttctc

SEQ ID NO: 1019710 - DNA, 22 bp, Artificial Sequence
  chemically synthesized
gcaaaccactattctaacttct

SEQ ID NO: 1019711 - DNA, 22 bp, Artificial Sequence
  chemically synthesized
tacagcaagtttgcaaaccact

SEQ ID NO: 1019712 - DNA, 22 bp, Artificial Sequence
  chemically synthesized
cattgtacagcaagtttgcaaa

SEQ ID NO: 1019713 - DNA, 22 bp, Artificial Sequence
  chemically synthesized
gaatagtggtttgcaaacttgc

SEQ ID NO: 1019714 - DNA, 22 bp, Artificial Sequence
  chemically synthesized
gatgactccattgtacagcaag

SEQ ID NO: 1019715 - DNA, 22 bp, Artificial Sequence
  chemically synthesized
ggatgactccattgtacagcaa

SEQ ID NO: 1019716 - DNA, 22 bp, Artificial Sequence
  chemically synthesized
gcaaacttgctgtacaatggag

SEQ ID NO: 1019717 - DNA, 22 bp, Artificial Sequence
  chemically synthesized
caaacttgctgtacaatggagt

SEQ ID NO: 1019718 - DNA, 22 bp, Artificial Sequence
  chemically synthesized
agatccttggatgactccattg

SEQ ID NO: 1019719 - DNA, 22 bp, Artificial Sequence
  chemically synthesized
aagatccttggatgactccatt

SEQ ID NO: 1019720 - DNA, 22 bp, Artificial Sequence
  chemically synthesized
taagatccttggatgactccat

SEQ ID NO: 1019721 - DNA, 22 bp, Artificial Sequence
  chemically synthesized
ttaagatccttggatgactcca

SEQ ID NO: 1019722 - DNA, 22 bp, Artificial Sequence
  chemically synthesized
tttaagatccttggatgactcc

SEQ ID NO: 1019723 - DNA, 22 bp, Artificial Sequence
  chemically synthesized
ttttaagatccttggatgactc

SEQ ID NO: 1019724 - DNA, 22 bp, Artificial Sequence
  chemically synthesized
gctgtacaatggagtcatccaa

SEQ ID NO: 1019725 - DNA, 22 bp, Artificial Sequence
  chemically synthesized
tttttaagatccttggatgact

SEQ ID NO: 1019726 - DNA, 22 bp, Artificial Sequence
  chemically synthesized
ctgtacaatggagtcatccaag

SEQ ID NO: 1019727 - DNA, 22 bp, Artificial Sequence
  chemically synthesized
ttttttaagatccttggatgac

SEQ ID NO: 1019728 - DNA, 22 bp, Artificial Sequence
  chemically synthesized
tttttttaagatccttggatga

SEQ ID NO: 1019729 - DNA, 22 bp, Artificial Sequence
  chemically synthesized
tacaatggagtcatccaaggat

SEQ ID NO: 1019730 - DNA, 22 bp, Artificial Sequence
  chemically synthesized
gtgtattttttttttaagatcc

SEQ ID NO: 1019731 - DNA, 22 bp, Artificial Sequence
  chemically synthesized
tggtgtattttttttttaagat

SEQ ID NO: 1019732 - DNA, 22 bp, Artificial Sequence
  chemically synthesized
aatcagatctctggtgtatttt

SEQ ID NO: 1019733 - DNA, 22 bp, Artificial Sequence
  chemically synthesized
aaaaaaaaaatacaccagagat

SEQ ID NO: 1019734 - DNA, 22 bp, Artificial Sequence
  chemically synthesized
aaaaaaaaatacaccagagatc

SEQ ID NO: 1019735 - DNA, 22 bp, Artificial Sequence
  chemically synthesized
gccatgtcccaaatcagttgaa

SEQ ID NO: 1019736 - DNA, 22 bp, Artificial Sequence
  chemically synthesized
atgccctggccatgtcccaaat

SEQ ID NO: 1019737 - DNA, 22 bp, Artificial Sequence
  chemically synthesized
tgatgccctggccatgtcccaa

SEQ ID NO: 1019738 - DNA, 22 bp, Artificial Sequence
  chemically synthesized
attcaactgatttgggacatgg

SEQ ID NO: 1019739 - DNA, 22 bp, Artificial Sequence
  chemically synthesized
aactgatttgggacatggccag

SEQ ID NO: 1019740 - DNA, 22 bp, Artificial Sequence
  chemically synthesized
atttgggacatggccagggcat

SEQ ID NO: 1019741 - DNA, 22 bp, Artificial Sequence
  chemically synthesized
ggtgaaaattctgatgccctgg

SEQ ID NO: 1019742 - DNA, 22 bp, Artificial Sequence
  chemically synthesized
gggacatggccagggcatcaga

SEQ ID NO: 1019743 - DNA, 22 bp, Artificial Sequence
  chemically synthesized
ggacatggccagggcatcagaa

SEQ ID NO: 1019744 - DNA, 22 bp, Artificial Sequence
  chemically synthesized
aaatattgggtgaaaattctga

SEQ ID NO: 1019745 - DNA, 22 bp, Artificial Sequence
  chemically synthesized
tgttaaaatattgggtgaaaat

SEQ ID NO: 1019746 - DNA, 22 bp, Artificial Sequence
  chemically synthesized
ttatgttaaaatattgggtgaa

SEQ ID NO: 1019747 - DNA, 22 bp, Artificial Sequence
  chemically synthesized
gttatgttaaaatattgggtga

SEQ ID NO: 1019748 - DNA, 22 bp, Artificial Sequence
  chemically synthesized
aaatttgttatgttaaaatatt

SEQ ID NO: 1019749 - DNA, 22 bp, Artificial Sequence
  chemically synthesized
gaaatttgttatgttaaaatat

SEQ ID NO: 1019750 - DNA, 22 bp, Artificial Sequence
  chemically synthesized
tgaaatttgttatgttaaaata

SEQ ID NO: 1019751 - DNA, 22 bp, Artificial Sequence
  chemically synthesized
ttgaaatttgttatgttaaaat

SEQ ID NO: 1019752 - DNA, 22 bp, Artificial Sequence
  chemically synthesized
tcacccaatattttaacataac

SEQ ID NO: 1019753 - DNA, 22 bp, Artificial Sequence
  chemically synthesized
cacccaatattttaacataaca

SEQ ID NO: 1019754 - DNA, 22 bp, Artificial Sequence
  chemically synthesized
acccaatattttaacataacaa

SEQ ID NO: 1019755 - DNA, 22 bp, Artificial Sequence
  chemically synthesized
catttttgaaatttgttatgtt

SEQ ID NO: 1019756 - DNA, 22 bp, Artificial Sequence
  chemically synthesized
ttgcatttttgaaatttgttat

SEQ ID NO: 1019757 - DNA, 22 bp, Artificial Sequence
  chemically synthesized
taacataacaaatttcaaaaat

SEQ ID NO: 1019758 - DNA, 22 bp, Artificial Sequence
  chemically synthesized
aacataacaaatttcaaaaatg

SEQ ID NO: 1019759 - DNA, 22 bp, Artificial Sequence
  chemically synthesized
aaaatgttattgcatttttgaa

SEQ ID NO: 1019760 - DNA, 22 bp, Artificial Sequence
  chemically synthesized
acataacaaatttcaaaaatgc

SEQ ID NO: 1019761 - DNA, 22 bp, Artificial Sequence
  chemically synthesized
aaaaatgttattgcatttttga

SEQ ID NO: 1019762 - DNA, 22 bp, Artificial Sequence
  chemically synthesized
taaaaatgttattgcatttttg

SEQ ID NO: 1019763 - DNA, 22 bp, Artificial Sequence
  chemically synthesized
ttaaaaatgttattgcattttt

SEQ ID NO: 1019764 - DNA, 22 bp, Artificial Sequence
  chemically synthesized
taatttttaaaaatgttattgc

SEQ ID NO: 1019765 - DNA, 22 bp, Artificial Sequence
  chemically synthesized
gtaatttttaaaaatgttattg

SEQ ID NO: 1019766 - DNA, 22 bp, Artificial Sequence
  chemically synthesized
caaaaatgcaataacattttta

SEQ ID NO: 1019767 - DNA, 22 bp, Artificial Sequence
  chemically synthesized
aaaaatgcaataacatttttaa

SEQ ID NO: 1019768 - DNA, 22 bp, Artificial Sequence
  chemically synthesized
gatatatagatatcacttgtaa

SEQ ID NO: 1019769 - DNA, 22 bp, Artificial Sequence
  chemically synthesized
ttaaaaattacaagtgatatct

SEQ ID NO: 1019770 - DNA, 22 bp, Artificial Sequence
  chemically synthesized
taaaaattacaagtgatatcta

SEQ ID NO: 1019771 - DNA, 22 bp, Artificial Sequence
  chemically synthesized
aaaaattacaagtgatatctat

SEQ ID NO: 1019772 - DNA, 22 bp, Artificial Sequence
  chemically synthesized
aaaattacaagtgatatctata

SEQ ID NO: 1019773 - DNA, 22 bp, Artificial Sequence
  chemically synthesized
atggtggaatctagatatatag

SEQ ID NO: 1019774 - DNA, 22 bp, Artificial Sequence
  chemically synthesized
caagtgatatctatatatctag

SEQ ID NO: 1019775 - DNA, 22 bp, Artificial Sequence
  chemically synthesized
tatatctagattccaccatgaa

SEQ ID NO: 1019776 - DNA, 22 bp, Artificial Sequence
  chemically synthesized
gattccaccatgaacattttac

SEQ ID NO: 1019777 - DNA, 22 bp, Artificial Sequence
  chemically synthesized
caccatgaacattttactatac

SEQ ID NO: 1019778 - DNA, 22 bp, Artificial Sequence
  chemically synthesized
tactatactcgttttgatcaca

SEQ ID NO: 1019779 - DNA, 22 bp, Artificial Sequence
  chemically synthesized
actatactcgttttgatcacat

SEQ ID NO: 1019780 - DNA, 22 bp, Artificial Sequence
  chemically synthesized
ctatactcgttttgatcacata

SEQ ID NO: 1019781 - DNA, 22 bp, Artificial Sequence
  chemically synthesized
tactcgttttgatcacatatct

SEQ ID NO: 1019782 - DNA, 22 bp, Artificial Sequence
  chemically synthesized
gttttgatcacatatcttttcc

SEQ ID NO: 1019783 - DNA, 22 bp, Artificial Sequence
  chemically synthesized
tgatcacatatcttttccttcc

SEQ ID NO: 1019784 - DNA, 22 bp, Artificial Sequence
  chemically synthesized
gatcacatatcttttccttcct

SEQ ID NO: 1019785 - DNA, 22 bp, Artificial Sequence
  chemically synthesized
atcacatatcttttccttcctc

SEQ ID NO: 1019786 - DNA, 22 bp, Artificial Sequence
  chemically synthesized
atggatggatcggaggaaggaa

SEQ ID NO: 1019787 - DNA, 22 bp, Artificial Sequence
  chemically synthesized
attgatggatggatcggaggaa

SEQ ID NO: 1019788 - DNA, 22 bp, Artificial Sequence
  chemically synthesized
ttccttcctccgatccatccat

SEQ ID NO: 1019789 - DNA, 22 bp, Artificial Sequence
  chemically synthesized
tccttcctccgatccatccatc

SEQ ID NO: 1019790 - DNA, 22 bp, Artificial Sequence
  chemically synthesized
ccttcctccgatccatccatca

SEQ ID NO: 1019791 - DNA, 22 bp, Artificial Sequence
  chemically synthesized
cttcctccgatccatccatcaa

SEQ ID NO: 1019792 - DNA, 22 bp, Artificial Sequence
  chemically synthesized
cctccgatccatccatcaatca

SEQ ID NO: 1019793 - DNA, 22 bp, Artificial Sequence
  chemically synthesized
ctccgatccatccatcaatcaa

SEQ ID NO: 1019794 - DNA, 22 bp, Artificial Sequence
  chemically synthesized
cgatccatccatcaatcaatca

SEQ ID NO: 1019795 - DNA, 22 bp, Artificial Sequence
  chemically synthesized
gatatgcatcaaaaatatgatt

SEQ ID NO: 1019796 - DNA, 22 bp, Artificial Sequence
  chemically synthesized
cctggatatgcatcaaaaatat

SEQ ID NO: 1019797 - DNA, 22 bp, Artificial Sequence
  chemically synthesized
acctggatatgcatcaaaaata

SEQ ID NO: 1019798 - DNA, 22 bp, Artificial Sequence
  chemically synthesized
atgtcagcagtttacctggata

SEQ ID NO: 1019799 - DNA, 22 bp, Artificial Sequence
  chemically synthesized
ttgatgcatatccaggtaaact

SEQ ID NO: 1019800 - DNA, 22 bp, Artificial Sequence
  chemically synthesized
tgatgcatatccaggtaaactg

SEQ ID NO: 1019801 - DNA, 22 bp, Artificial Sequence
  chemically synthesized
gatgcatatccaggtaaactgc

SEQ ID NO: 1019802 - DNA, 22 bp, Artificial Sequence
  chemically synthesized
atgcatatccaggtaaactgct

SEQ ID NO: 1019803 - DNA, 22 bp, Artificial Sequence
  chemically synthesized
aggtgaatgatactgatgtcag

SEQ ID NO: 1019804 - DNA, 22 bp, Artificial Sequence
  chemically synthesized
aaggtgaatgatactgatgtca

SEQ ID NO: 1019805 - DNA, 22 bp, Artificial Sequence
  chemically synthesized
aggtatttaaggtgaatgatac

SEQ ID NO: 1019806 - DNA, 22 bp, Artificial Sequence
  chemically synthesized
ctgacatcagtatcattcacct

SEQ ID NO: 1019807 - DNA, 22 bp, Artificial Sequence
  chemically synthesized
acatcagtatcattcaccttaa

SEQ ID NO: 1019808 - DNA, 22 bp, Artificial Sequence
  chemically synthesized
agtgatatccatattgaggtat

SEQ ID NO: 1019809 - DNA, 22 bp, Artificial Sequence
  chemically synthesized
ttcagtgatatccatattgagg

SEQ ID NO: 1019810 - DNA, 22 bp, Artificial Sequence
  chemically synthesized
accttaaatacctcaatatgga

SEQ ID NO: 1019811 - DNA, 22 bp, Artificial Sequence
  chemically synthesized
tattcagtgatatccatattga

SEQ ID NO: 1019812 - DNA, 22 bp, Artificial Sequence
  chemically synthesized
aaatacctcaatatggatatca

SEQ ID NO: 1019813 - DNA, 22 bp, Artificial Sequence
  chemically synthesized
aatacctcaatatggatatcac

SEQ ID NO: 1019814 - DNA, 22 bp, Artificial Sequence
  chemically synthesized
tgaattctattcagtgatatcc

SEQ ID NO: 1019815 - DNA, 22 bp, Artificial Sequence
  chemically synthesized
atgaattctattcagtgatatc

SEQ ID NO: 1019816 - DNA, 22 bp, Artificial Sequence
  chemically synthesized
aatatggatatcactgaataga

SEQ ID NO: 1019817 - DNA, 22 bp, Artificial Sequence
  chemically synthesized
aatagaattcataaggtttctt

SEQ ID NO: 1019818 - DNA, 22 bp, Artificial Sequence
  chemically synthesized
ataaggtttctttattattatg

SEQ ID NO: 1019819 - DNA, 22 bp, Artificial Sequence
  chemically synthesized
ctttattattatgttattattt

SEQ ID NO: 1019820 - DNA, 22 bp, Artificial Sequence
  chemically synthesized
tttattattatgttattattta

SEQ ID NO: 1019821 - DNA, 22 bp, Artificial Sequence
  chemically synthesized
tattattatgttattatttact

SEQ ID NO: 1019822 - DNA, 22 bp, Artificial Sequence
  chemically synthesized
attattatgttattatttactg

SEQ ID NO: 1019823 - DNA, 22 bp, Artificial Sequence
  chemically synthesized
ttattatgttattatttactgt

SEQ ID NO: 1019824 - DNA, 22 bp, Artificial Sequence
  chemically synthesized
ttatgttattatttactgtatt

SEQ ID NO: 1019825 - DNA, 22 bp, Artificial Sequence
  chemically synthesized
tgttattatttactgtatttgg

SEQ ID NO: 1019826 - DNA, 22 bp, Artificial Sequence
  chemically synthesized
ttatttactgtatttggtgtcc

SEQ ID NO: 1019827 - DNA, 22 bp, Artificial Sequence
  chemically synthesized
tttactgtatttggtgtcctct

SEQ ID NO: 1019828 - DNA, 22 bp, Artificial Sequence
  chemically synthesized
gccataaggtaaagaggacacc

SEQ ID NO: 1019829 - DNA, 22 bp, Artificial Sequence
  chemically synthesized
actgtatttggtgtcctcttta

SEQ ID NO: 1019830 - DNA, 22 bp, Artificial Sequence
  chemically synthesized
ctgtatttggtgtcctctttac

SEQ ID NO: 1019831 - DNA, 22 bp, Artificial Sequence
  chemically synthesized
aattggccataaggtaaagagg

SEQ ID NO: 1019832 - DNA, 22 bp, Artificial Sequence
  chemically synthesized
gaattggccataaggtaaagag

SEQ ID NO: 1019833 - DNA, 22 bp, Artificial Sequence
  chemically synthesized
tatttggtgtcctctttacctt

SEQ ID NO: 1019834 - DNA, 22 bp, Artificial Sequence
  chemically synthesized
cttgaattggccataaggtaaa

SEQ ID NO: 1019835 - DNA, 22 bp, Artificial Sequence
  chemically synthesized
ggtgtcctctttaccttatggc

SEQ ID NO: 1019836 - DNA, 22 bp, Artificial Sequence
  chemically synthesized
ttacttgaattggccataaggt

SEQ ID NO: 1019837 - DNA, 22 bp, Artificial Sequence
  chemically synthesized
gtgtcctctttaccttatggcc

SEQ ID NO: 1019838 - DNA, 22 bp, Artificial Sequence
  chemically synthesized
cagagttattacttgaattggc

SEQ ID NO: 1019839 - DNA, 22 bp, Artificial Sequence
  chemically synthesized
tttaccttatggccaattcaag

SEQ ID NO: 1019840 - DNA, 22 bp, Artificial Sequence
  chemically synthesized
gcagagttattacttgaattgg

SEQ ID NO: 1019841 - DNA, 22 bp, Artificial Sequence
  chemically synthesized
taccttatggccaattcaagta

SEQ ID NO: 1019842 - DNA, 22 bp, Artificial Sequence
  chemically synthesized
accttatggccaattcaagtaa

SEQ ID NO: 1019843 - DNA, 22 bp, Artificial Sequence
  chemically synthesized
ccttatggccaattcaagtaat

SEQ ID NO: 1019844 - DNA, 22 bp, Artificial Sequence
  chemically synthesized
ccttgcagagttattacttgaa

SEQ ID NO: 1019845 - DNA, 22 bp, Artificial Sequence
  chemically synthesized
atggccaattcaagtaataact

SEQ ID NO: 1019846 - DNA, 22 bp, Artificial Sequence
  chemically synthesized
tggccaattcaagtaataactc

SEQ ID NO: 1019847 - DNA, 22 bp, Artificial Sequence
  chemically synthesized
agtaataactaccttgcagagt

SEQ ID NO: 1019848 - DNA, 22 bp, Artificial Sequence
  chemically synthesized
taagtaataactaccttgcaga

SEQ ID NO: 1019849 - DNA, 22 bp, Artificial Sequence
  chemically synthesized
ctaagtaataactaccttgcag

SEQ ID NO: 1019850 - DNA, 22 bp, Artificial Sequence
  chemically synthesized
aagtaataactctgcaaggtag

SEQ ID NO: 1019851 - DNA, 22 bp, Artificial Sequence
  chemically synthesized
cttctaagtaataactaccttg

SEQ ID NO: 1019852 - DNA, 22 bp, Artificial Sequence
  chemically synthesized
ccttctaagtaataactacctt

SEQ ID NO: 1019853 - DNA, 22 bp, Artificial Sequence
  chemically synthesized
tccttctaagtaataactacct

SEQ ID NO: 1019854 - DNA, 22 bp, Artificial Sequence
  chemically synthesized
ttccttctaagtaataactacc

SEQ ID NO: 1019855 - DNA, 22 bp, Artificial Sequence
  chemically synthesized
tttccttctaagtaataactac

SEQ ID NO: 1019856 - DNA, 22 bp, Artificial Sequence
  chemically synthesized
ttttccttctaagtaataacta

SEQ ID NO: 1019857 - DNA, 22 bp, Artificial Sequence
  chemically synthesized
tttttccttctaagtaataact

SEQ ID NO: 1019858 - DNA, 22 bp, Artificial Sequence
  chemically synthesized
tgcaaggtagttattacttaga

SEQ ID NO: 1019859 - DNA, 22 bp, Artificial Sequence
  chemically synthesized
caaggtagttattacttagaag

SEQ ID NO: 1019860 - DNA, 22 bp, Artificial Sequence
  chemically synthesized
aatctttttttccttctaagta

SEQ ID NO: 1019861 - DNA, 22 bp, Artificial Sequence
  chemically synthesized
tgaatctttttttccttctaag

SEQ ID NO: 1019862 - DNA, 22 bp, Artificial Sequence
  chemically synthesized
atgtctctgaatctttttttcc

SEQ ID NO: 1019863 - DNA, 22 bp, Artificial Sequence
  chemically synthesized
aatgtctctgaatctttttttc

SEQ ID NO: 1019864 - DNA, 22 bp, Artificial Sequence
  chemically synthesized
ttacttagaaggaaaaaaagat

SEQ ID NO: 1019865 - DNA, 22 bp, Artificial Sequence
  chemically synthesized
cttagaaggaaaaaaagattca

SEQ ID NO: 1019866 - DNA, 22 bp, Artificial Sequence
  chemically synthesized
agaaggaaaaaaagattcagag

SEQ ID NO: 1019867 - DNA, 22 bp, Artificial Sequence
  chemically synthesized
gaaggaaaaaaagattcagaga

SEQ ID NO: 1019868 - DNA, 22 bp, Artificial Sequence
  chemically synthesized
aaagatgacttaatgtctctga

SEQ ID NO: 1019869 - DNA, 22 bp, Artificial Sequence
  chemically synthesized
agagacattaagtcatctttta

SEQ ID NO: 1019870 - DNA, 22 bp, Artificial Sequence
  chemically synthesized
ccatgtgaacattaaaagatga

SEQ ID NO: 1019871 - DNA, 22 bp, Artificial Sequence
  chemically synthesized
cccatgtgaacattaaaagatg

SEQ ID NO: 1019872 - DNA, 22 bp, Artificial Sequence
  chemically synthesized
cttcccatgtgaacattaaaag

SEQ ID NO: 1019873 - DNA, 22 bp, Artificial Sequence
  chemically synthesized
acttcccatgtgaacattaaaa

SEQ ID NO: 1019874 - DNA, 22 bp, Artificial Sequence
  chemically synthesized
tacttcccatgtgaacattaaa

SEQ ID NO: 1019875 - DNA, 22 bp, Artificial Sequence
  chemically synthesized
ttacttcccatgtgaacattaa

SEQ ID NO: 1019876 - DNA, 22 bp, Artificial Sequence
  chemically synthesized
agtcatcttttaatgttcacat

SEQ ID NO: 1019877 - DNA, 22 bp, Artificial Sequence
  chemically synthesized
ccttttacttcccatgtgaaca

SEQ ID NO: 1019878 - DNA, 22 bp, Artificial Sequence
  chemically synthesized
taccttttacttcccatgtgaa

SEQ ID NO: 1019879 - DNA, 22 bp, Artificial Sequence
  chemically synthesized
ttaatgttcacatgggaagtaa

SEQ ID NO: 1019880 - DNA, 22 bp, Artificial Sequence
  chemically synthesized
taatgttcacatgggaagtaaa

SEQ ID NO: 1019881 - DNA, 22 bp, Artificial Sequence
  chemically synthesized
aatgttcacatgggaagtaaaa

SEQ ID NO: 1019882 - DNA, 22 bp, Artificial Sequence
  chemically synthesized
atgttcacatgggaagtaaaag

SEQ ID NO: 1019883 - DNA, 22 bp, Artificial Sequence
  chemically synthesized
aatccaactctaccttttactt

SEQ ID NO: 1019884 - DNA, 22 bp, Artificial Sequence
  chemically synthesized
gaatccaactctaccttttact

SEQ ID NO: 1019885 - DNA, 22 bp, Artificial Sequence
  chemically synthesized
acatgggaagtaaaaggtagag

SEQ ID NO: 1019886 - DNA, 22 bp, Artificial Sequence
  chemically synthesized
gatttgaatccaactctacctt

SEQ ID NO: 1019887 - DNA, 22 bp, Artificial Sequence
  chemically synthesized
tgggataagtgaaagctggatt

SEQ ID NO: 1019888 - DNA, 22 bp, Artificial Sequence
  chemically synthesized
atgggataagtgaaagctggat

SEQ ID NO: 1019889 - DNA, 22 bp, Artificial Sequence
  chemically synthesized
tatgggataagtgaaagctgga

SEQ ID NO: 1019890 - DNA, 22 bp, Artificial Sequence
  chemically synthesized
ttttatgggataagtgaaagct

SEQ ID NO: 1019891 - DNA, 22 bp, Artificial Sequence
  chemically synthesized
gattcaaatccagctttcactt

SEQ ID NO: 1019892 - DNA, 22 bp, Artificial Sequence
  chemically synthesized
aaatccagctttcacttatccc

SEQ ID NO: 1019893 - DNA, 22 bp, Artificial Sequence
  chemically synthesized
tcacttatcccataaaacagtg

SEQ ID NO: 1019894 - DNA, 22 bp, Artificial Sequence
  chemically synthesized
cacttatcccataaaacagtgg

SEQ ID NO: 1019895 - DNA, 22 bp, Artificial Sequence
  chemically synthesized
acttatcccataaaacagtggt

SEQ ID NO: 1019896 - DNA, 22 bp, Artificial Sequence
  chemically synthesized
atcccataaaacagtggtccct

SEQ ID NO: 1019897 - DNA, 22 bp, Artificial Sequence
  chemically synthesized
tcccataaaacagtggtccctg

SEQ ID NO: 1019898 - DNA, 22 bp, Artificial Sequence
  chemically synthesized
gtgccaaaagggtcagggacca

SEQ ID NO: 1019899 - DNA, 22 bp, Artificial Sequence
  chemically synthesized
ctggtgccaaaagggtcaggga

SEQ ID NO: 1019900 - DNA, 22 bp, Artificial Sequence
  chemically synthesized
cacaaaatcagttcctggtgcc

SEQ ID NO: 1019901 - DNA, 22 bp, Artificial Sequence
  chemically synthesized
ccacaaaatcagttcctggtgc

SEQ ID NO: 1019902 - DNA, 22 bp, Artificial Sequence
  chemically synthesized
acccttttggcaccaggaactg

SEQ ID NO: 1019903 - DNA, 22 bp, Artificial Sequence
  chemically synthesized
tcttccacaaaatcagttcctg

SEQ ID NO: 1019904 - DNA, 22 bp, Artificial Sequence
  chemically synthesized
ttggcaccaggaactgattttg

SEQ ID NO: 1019905 - DNA, 22 bp, Artificial Sequence
  chemically synthesized
tggcaccaggaactgattttgt

SEQ ID NO: 1019906 - DNA, 22 bp, Artificial Sequence
  chemically synthesized
ggcaccaggaactgattttgtg

SEQ ID NO: 1019907 - DNA, 22 bp, Artificial Sequence
  chemically synthesized
gcaccaggaactgattttgtgg

SEQ ID NO: 1019908 - DNA, 22 bp, Artificial Sequence
  chemically synthesized
attttgtggaagacaatttttc

SEQ ID NO: 1019909 - DNA, 22 bp, Artificial Sequence
  chemically synthesized
caacccggtccacggaaaaatt

SEQ ID NO: 1019910 - DNA, 22 bp, Artificial Sequence
  chemically synthesized
tgtggaagacaatttttccgtg

SEQ ID NO: 1019911 - DNA, 22 bp, Artificial Sequence
  chemically synthesized
gtggaagacaatttttccgtgg

SEQ ID NO: 1019912 - DNA, 22 bp, Artificial Sequence
  chemically synthesized
tggaagacaatttttccgtgga

SEQ ID NO: 1019913 - DNA, 22 bp, Artificial Sequence
  chemically synthesized
ttccgtggaccgggttggagga

SEQ ID NO: 1019914 - DNA, 22 bp, Artificial Sequence
  chemically synthesized
tccgtggaccgggttggaggat

SEQ ID NO: 1019915 - DNA, 22 bp, Artificial Sequence
  chemically synthesized
ccgtggaccgggttggaggatg

SEQ ID NO: 1019916 - DNA, 22 bp, Artificial Sequence
  chemically synthesized
cgtggaccgggttggaggatgg

SEQ ID NO: 1019917 - DNA, 22 bp, Artificial Sequence
  chemically synthesized
aatcatatggaaaccatcctcc

SEQ ID NO: 1019918 - DNA, 22 bp, Artificial Sequence
  chemically synthesized
gaatcatatggaaaccatcctc

SEQ ID NO: 1019919 - DNA, 22 bp, Artificial Sequence
  chemically synthesized
taatgcacttgaatcatatgga

SEQ ID NO: 1019920 - DNA, 22 bp, Artificial Sequence
  chemically synthesized
gaggatggtttccatatgattc

SEQ ID NO: 1019921 - DNA, 22 bp, Artificial Sequence
  chemically synthesized
ccatatgattcaagtgcattac

SEQ ID NO: 1019922 - DNA, 22 bp, Artificial Sequence
  chemically synthesized
catatgattcaagtgcattaca

SEQ ID NO: 1019923 - DNA, 22 bp, Artificial Sequence
  chemically synthesized
aagtgcattacagttattgcac

SEQ ID NO: 1019924 - DNA, 22 bp, Artificial Sequence
  chemically synthesized
cagttattgcacacattattta

SEQ ID NO: 1019925 - DNA, 22 bp, Artificial Sequence
  chemically synthesized
taatgtgataataatataaata

SEQ ID NO: 1019926 - DNA, 22 bp, Artificial Sequence
  chemically synthesized
ttgcacacattatttatattat

SEQ ID NO: 1019927 - DNA, 22 bp, Artificial Sequence
  chemically synthesized
cacacattatttatattattat

SEQ ID NO: 1019928 - DNA, 22 bp, Artificial Sequence
  chemically synthesized
tatattataatgtgataataat

SEQ ID NO: 1019929 - DNA, 22 bp, Artificial Sequence
  chemically synthesized
attatatattataatgtgataa

SEQ ID NO: 1019930 - DNA, 22 bp, Artificial Sequence
  chemically synthesized
cattatatattataatgtgata

SEQ ID NO: 1019931 - DNA, 22 bp, Artificial Sequence
  chemically synthesized
tttatattattatcacattata

SEQ ID NO: 1019932 - DNA, 22 bp, Artificial Sequence
  chemically synthesized
tttcattatatattataatgtg

SEQ ID NO: 1019933 - DNA, 22 bp, Artificial Sequence
  chemically synthesized
atattattatcacattataata

SEQ ID NO: 1019934 - DNA, 22 bp, Artificial Sequence
  chemically synthesized
tattattatcacattataatat

SEQ ID NO: 1019935 - DNA, 22 bp, Artificial Sequence
  chemically synthesized
ttatcacattataatatataat

SEQ ID NO: 1019936 - DNA, 22 bp, Artificial Sequence
  chemically synthesized
tataattatttcattatatatt

SEQ ID NO: 1019937 - DNA, 22 bp, Artificial Sequence
  chemically synthesized
tcacattataatatataatgaa

SEQ ID NO: 1019938 - DNA, 22 bp, Artificial Sequence
  chemically synthesized
tggtgagttgtataattatttc

SEQ ID NO: 1019939 - DNA, 22 bp, Artificial Sequence
  chemically synthesized
taatatataatgaaataattat

SEQ ID NO: 1019940 - DNA, 22 bp, Artificial Sequence
  chemically synthesized
cattatggtgagttgtataatt

SEQ ID NO: 1019941 - DNA, 22 bp, Artificial Sequence
  chemically synthesized
aatctacattatggtgagttgt

SEQ ID NO: 1019942 - DNA, 22 bp, Artificial Sequence
  chemically synthesized
ccactgaatctacattatggtg

SEQ ID NO: 1019943 - DNA, 22 bp, Artificial Sequence
  chemically synthesized
tacaactcaccataatgtagat

SEQ ID NO: 1019944 - DNA, 22 bp, Artificial Sequence
  chemically synthesized
aaggctcccactgaatctacat

SEQ ID NO: 1019945 - DNA, 22 bp, Artificial Sequence
  chemically synthesized
accataatgtagattcagtggg

SEQ ID NO: 1019946 - DNA, 22 bp, Artificial Sequence
  chemically synthesized
caggaaaggaagctcaaggctc

SEQ ID NO: 1019947 - DNA, 22 bp, Artificial Sequence
  chemically synthesized
gctgcaggaaaggaagctcaag

SEQ ID NO: 1019948 - DNA, 22 bp, Artificial Sequence
  chemically synthesized
agtgggagccttgagcttcctt

SEQ ID NO: 1019949 - DNA, 22 bp, Artificial Sequence
  chemically synthesized
gagcttcctttcctgcagctag

SEQ ID NO: 1019950 - DNA, 22 bp, Artificial Sequence
  chemically synthesized
agcttcctttcctgcagctaga

SEQ ID NO: 1019951 - DNA, 22 bp, Artificial Sequence
  chemically synthesized
cctttcctgcagctagatggtc

SEQ ID NO: 1019952 - DNA, 22 bp, Artificial Sequence
  chemically synthesized
ctttcctgcagctagatggtcc

SEQ ID NO: 1019953 - DNA, 22 bp, Artificial Sequence
  chemically synthesized
tcctgcagctagatggtcccat

SEQ ID NO: 1019954 - DNA, 22 bp, Artificial Sequence
  chemically synthesized
cctgcagctagatggtcccatc

SEQ ID NO: 1019955 - DNA, 22 bp, Artificial Sequence
  chemically synthesized
ctgcagctagatggtcccatct

SEQ ID NO: 1019956 - DNA, 22 bp, Artificial Sequence
  chemically synthesized
ccatcaccccccagatgggacc

SEQ ID NO: 1019957 - DNA, 22 bp, Artificial Sequence
  chemically synthesized
cagctagatggtcccatctggg

SEQ ID NO: 1019958 - DNA, 22 bp, Artificial Sequence
  chemically synthesized
tctcccatcaccccccagatgg

SEQ ID NO: 1019959 - DNA, 22 bp, Artificial Sequence
  chemically synthesized
gatggtcccatctggggggtga

SEQ ID NO: 1019960 - DNA, 22 bp, Artificial Sequence
  chemically synthesized
tcactgtctcccatcacccccc

SEQ ID NO: 1019961 - DNA, 22 bp, Artificial Sequence
  chemically synthesized
catgatctgtcactgtctccca

SEQ ID NO: 1019962 - DNA, 22 bp, Artificial Sequence
  chemically synthesized
gggggtgatgggagacagtgac

SEQ ID NO: 1019963 - DNA, 22 bp, Artificial Sequence
  chemically synthesized
atgctgcatgatctgtcactgt

SEQ ID NO: 1019964 - DNA, 22 bp, Artificial Sequence
  chemically synthesized
tgagaatctaatgctgcatgat

SEQ ID NO: 1019965 - DNA, 22 bp, Artificial Sequence
  chemically synthesized
atgagaatctaatgctgcatga

SEQ ID NO: 1019966 - DNA, 22 bp, Artificial Sequence
  chemically synthesized
cttatgagaatctaatgctgca

SEQ ID NO: 1019967 - DNA, 22 bp, Artificial Sequence
  chemically synthesized
catgctccttatgagaatctaa

SEQ ID NO: 1019968 - DNA, 22 bp, Artificial Sequence
  chemically synthesized
ggttgcatgctccttatgagaa

SEQ ID NO: 1019969 - DNA, 22 bp, Artificial Sequence
  chemically synthesized
gattctcataaggagcatgcaa

SEQ ID NO: 1019970 - DNA, 22 bp, Artificial Sequence
  chemically synthesized
atgcaagggatctaggttgcat

SEQ ID NO: 1019971 - DNA, 22 bp, Artificial Sequence
  chemically synthesized
tcataaggagcatgcaacctag

SEQ ID NO: 1019972 - DNA, 22 bp, Artificial Sequence
  chemically synthesized
ataaggagcatgcaacctagat

SEQ ID NO: 1019973 - DNA, 22 bp, Artificial Sequence
  chemically synthesized
ctcatgcaagggatctaggttg

SEQ ID NO: 1019974 - DNA, 22 bp, Artificial Sequence
  chemically synthesized
tgaactactcatgcaagggatc

SEQ ID NO: 1019975 - DNA, 22 bp, Artificial Sequence
  chemically synthesized
ttgtgaactactcatgcaaggg

SEQ ID NO: 1019976 - DNA, 22 bp, Artificial Sequence
  chemically synthesized
gatcccttgcatgagtagttca

SEQ ID NO: 1019977 - DNA, 22 bp, Artificial Sequence
  chemically synthesized
gcatgagtagttcacaataggg

SEQ ID NO: 1019978 - DNA, 22 bp, Artificial Sequence
  chemically synthesized
catgagtagttcacaatagggt

SEQ ID NO: 1019979 - DNA, 22 bp, Artificial Sequence
  chemically synthesized
ccataggagcacaaaccctatt

SEQ ID NO: 1019980 - DNA, 22 bp, Artificial Sequence
  chemically synthesized
aattcccataggagcacaaacc

SEQ ID NO: 1019981 - DNA, 22 bp, Artificial Sequence
  chemically synthesized
acaatagggtttgtgctcctat

SEQ ID NO: 1019982 - DNA, 22 bp, Artificial Sequence
  chemically synthesized
gtgctcctatgggaatttaatg

SEQ ID NO: 1019983 - DNA, 22 bp, Artificial Sequence
  chemically synthesized
tgctcctatgggaatttaatgt

SEQ ID NO: 1019984 - DNA, 22 bp, Artificial Sequence
  chemically synthesized
tcagatcagcagccacattaaa

SEQ ID NO: 1019985 - DNA, 22 bp, Artificial Sequence
  chemically synthesized
ctatgggaatttaatgtggctg

SEQ ID NO: 1019986 - DNA, 22 bp, Artificial Sequence
  chemically synthesized
ctgtcagatcagcagccacatt

SEQ ID NO: 1019987 - DNA, 22 bp, Artificial Sequence
  chemically synthesized
tgggaatttaatgtggctgctg

SEQ ID NO: 1019988 - DNA, 22 bp, Artificial Sequence
  chemically synthesized
cacctcctgtcagatcagcagc

SEQ ID NO: 1019989 - DNA, 22 bp, Artificial Sequence
  chemically synthesized
agctccacctcctgtcagatca

SEQ ID NO: 1019990 - DNA, 22 bp, Artificial Sequence
  chemically synthesized
aatgtggctgctgatctgacag

SEQ ID NO: 1019991 - DNA, 22 bp, Artificial Sequence
  chemically synthesized
atgtggctgctgatctgacagg

SEQ ID NO: 1019992 - DNA, 22 bp, Artificial Sequence
  chemically synthesized
cctgagctccacctcctgtcag

SEQ ID NO: 1019993 - DNA, 22 bp, Artificial Sequence
  chemically synthesized
tgcctgagctccacctcctgtc

SEQ ID NO: 1019994 - DNA, 22 bp, Artificial Sequence
  chemically synthesized
ctgcctgagctccacctcctgt

SEQ ID NO: 1019995 - DNA, 22 bp, Artificial Sequence
  chemically synthesized
ctgatctgacaggaggtggagc

SEQ ID NO: 1019996 - DNA, 22 bp, Artificial Sequence
  chemically synthesized
catttctgcctgagctccacct

SEQ ID NO: 1019997 - DNA, 22 bp, Artificial Sequence
  chemically synthesized
atctgacaggaggtggagctca

SEQ ID NO: 1019998 - DNA, 22 bp, Artificial Sequence
  chemically synthesized
acaggaggtggagctcaggcag

SEQ ID NO: 1019999 - DNA, 22 bp, Artificial Sequence
  chemically synthesized
atcactccatttctgcctgagc

SEQ ID NO: 1020000 - DNA, 22 bp, Artificial Sequence
  chemically synthesized
ctcatcactccatttctgcctg

SEQ ID NO: 1020001 - DNA, 22 bp, Artificial Sequence
  chemically synthesized
ctcctcatcactccatttctgc

SEQ ID NO: 1020002 - DNA, 22 bp, Artificial Sequence
  chemically synthesized
cagctgctcctcatcactccat

SEQ ID NO: 1020003 - DNA, 22 bp, Artificial Sequence
  chemically synthesized
acagctgctcctcatcactcca

SEQ ID NO: 1020004 - DNA, 22 bp, Artificial Sequence
  chemically synthesized
aggcagaaatggagtgatgagg

SEQ ID NO: 1020005 - DNA, 22 bp, Artificial Sequence
  chemically synthesized
tatttacagctgctcctcatca

SEQ ID NO: 1020006 - DNA, 22 bp, Artificial Sequence
  chemically synthesized
atctgtatttacagctgctcct

SEQ ID NO: 1020007 - DNA, 22 bp, Artificial Sequence
  chemically synthesized
catctgtatttacagctgctcc

SEQ ID NO: 1020008 - DNA, 22 bp, Artificial Sequence
  chemically synthesized
gggaaggaagcttcatctgtat

SEQ ID NO: 1020009 - DNA, 22 bp, Artificial Sequence
  chemically synthesized
taaatacagatgaagcttcctt

SEQ ID NO: 1020010 - DNA, 22 bp, Artificial Sequence
  chemically synthesized
ccttccctagcccgctgctgct

SEQ ID NO: 1020011 - DNA, 22 bp, Artificial Sequence
  chemically synthesized
cttccctagcccgctgctgctc

SEQ ID NO: 1020012 - DNA, 22 bp, Artificial Sequence
  chemically synthesized
gcaaagcagtaggtgagcagca

SEQ ID NO: 1020013 - DNA, 22 bp, Artificial Sequence
  chemically synthesized
ccctagcccgctgctgctcacc

SEQ ID NO: 1020014 - DNA, 22 bp, Artificial Sequence
  chemically synthesized
cctagcccgctgctgctcacct

SEQ ID NO: 1020015 - DNA, 22 bp, Artificial Sequence
  chemically synthesized
gcccgctgctgctcacctactg

SEQ ID NO: 1020016 - DNA, 22 bp, Artificial Sequence
  chemically synthesized
gggacccgattcgcaaagcagt

SEQ ID NO: 1020017 - DNA, 22 bp, Artificial Sequence
  chemically synthesized
ctgctcacctactgctttgcga

SEQ ID NO: 1020018 - DNA, 22 bp, Artificial Sequence
  chemically synthesized
ttagggacccgattcgcaaagc

SEQ ID NO: 1020019 - DNA, 22 bp, Artificial Sequence
  chemically synthesized
ctcacctactgctttgcgaatc

SEQ ID NO: 1020020 - DNA, 22 bp, Artificial Sequence
  chemically synthesized
cctgttagggacccgattcgca

SEQ ID NO: 1020021 - DNA, 22 bp, Artificial Sequence
  chemically synthesized
acctactgctttgcgaatcggg

SEQ ID NO: 1020022 - DNA, 22 bp, Artificial Sequence
  chemically synthesized
ctgctttgcgaatcgggtccct

SEQ ID NO: 1020023 - DNA, 22 bp, Artificial Sequence
  chemically synthesized
ctttgcgaatcgggtccctaac

SEQ ID NO: 1020024 - DNA, 22 bp, Artificial Sequence
  chemically synthesized
tgcgaatcgggtccctaacagg

SEQ ID NO: 1020025 - DNA, 22 bp, Artificial Sequence
  chemically synthesized
gcgaatcgggtccctaacaggc

SEQ ID NO: 1020026 - DNA, 22 bp, Artificial Sequence
  chemically synthesized
cgaatcgggtccctaacaggca

SEQ ID NO: 1020027 - DNA, 22 bp, Artificial Sequence
  chemically synthesized
acaggcaacggattggtacggg

SEQ ID NO: 1020028 - DNA, 22 bp, Artificial Sequence
  chemically synthesized
aaccccagagccacagacccgt

SEQ ID NO: 1020029 - DNA, 22 bp, Artificial Sequence
  chemically synthesized
gtacgggtctgtggctctgggg

SEQ ID NO: 1020030 - DNA, 22 bp, Artificial Sequence
  chemically synthesized
tggcagggtacctcaaccccag

SEQ ID NO: 1020031 - DNA, 22 bp, Artificial Sequence
  chemically synthesized
atggcagggtacctcaacccca

SEQ ID NO: 1020032 - DNA, 22 bp, Artificial Sequence
  chemically synthesized
tatggcagggtacctcaacccc

SEQ ID NO: 1020033 - DNA, 22 bp, Artificial Sequence
  chemically synthesized
tggctctggggttgaggtaccc

SEQ ID NO: 1020034 - DNA, 22 bp, Artificial Sequence
  chemically synthesized
tggggttgaggtaccctgccat

SEQ ID NO: 1020035 - DNA, 22 bp, Artificial Sequence
  chemically synthesized
gggttgaggtaccctgccataa

SEQ ID NO: 1020036 - DNA, 22 bp, Artificial Sequence
  chemically synthesized
aggtaccctgccataaaatact

SEQ ID NO: 1020037 - DNA, 22 bp, Artificial Sequence
  chemically synthesized
gaaaaatgaaaaaaatatagta

SEQ ID NO: 1020038 - DNA, 22 bp, Artificial Sequence
  chemically synthesized
ggaaaaatgaaaaaaatatagt

SEQ ID NO: 1020039 - DNA, 22 bp, Artificial Sequence
  chemically synthesized
ccataaaatactatattttttt

SEQ ID NO: 1020040 - DNA, 22 bp, Artificial Sequence
  chemically synthesized
gagacatttggaaaaatgaaaa

SEQ ID NO: 1020041 - DNA, 22 bp, Artificial Sequence
  chemically synthesized
tatttttttcatttttccaaat

SEQ ID NO: 1020042 - DNA, 22 bp, Artificial Sequence
  chemically synthesized
atagcattagagacatttggaa

SEQ ID NO: 1020043 - DNA, 22 bp, Artificial Sequence
  chemically synthesized
ttttcatttttccaaatgtctc

SEQ ID NO: 1020044 - DNA, 22 bp, Artificial Sequence
  chemically synthesized
tttcatttttccaaatgtctct

SEQ ID NO: 1020045 - DNA, 22 bp, Artificial Sequence
  chemically synthesized
ttcatttttccaaatgtctcta

SEQ ID NO: 1020046 - DNA, 22 bp, Artificial Sequence
  chemically synthesized
ccctcatagcattagagacatt

SEQ ID NO: 1020047 - DNA, 22 bp, Artificial Sequence
  chemically synthesized
tcatttttccaaatgtctctaa

SEQ ID NO: 1020048 - DNA, 22 bp, Artificial Sequence
  chemically synthesized
catttttccaaatgtctctaat

SEQ ID NO: 1020049 - DNA, 22 bp, Artificial Sequence
  chemically synthesized
taccctcatagcattagagaca

SEQ ID NO: 1020050 - DNA, 22 bp, Artificial Sequence
  chemically synthesized
atttttccaaatgtctctaatg

SEQ ID NO: 1020051 - DNA, 22 bp, Artificial Sequence
  chemically synthesized
ctaccctcatagcattagagac

SEQ ID NO: 1020052 - DNA, 22 bp, Artificial Sequence
  chemically synthesized
ttccaaatgtctctaatgctat

SEQ ID NO: 1020053 - DNA, 22 bp, Artificial Sequence
  chemically synthesized
tccaaatgtctctaatgctatg

SEQ ID NO: 1020054 - DNA, 22 bp, Artificial Sequence
  chemically synthesized
cacttctaccctcatagcatta

SEQ ID NO: 1020055 - DNA, 22 bp, Artificial Sequence
  chemically synthesized
ccaaatgtctctaatgctatga

SEQ ID NO: 1020056 - DNA, 22 bp, Artificial Sequence
  chemically synthesized
ccacttctaccctcatagcatt

SEQ ID NO: 1020057 - DNA, 22 bp, Artificial Sequence
  chemically synthesized
caaatgtctctaatgctatgag

SEQ ID NO: 1020058 - DNA, 22 bp, Artificial Sequence
  chemically synthesized
tccacttctaccctcatagcat

SEQ ID NO: 1020059 - DNA, 22 bp, Artificial Sequence
  chemically synthesized
ctttccacttctaccctcatag

SEQ ID NO: 1020060 - DNA, 22 bp, Artificial Sequence
  chemically synthesized
gactcctttccacttctaccct

SEQ ID NO: 1020061 - DNA, 22 bp, Artificial Sequence
  chemically synthesized
taatgctatgagggtagaagtg

SEQ ID NO: 1020062 - DNA, 22 bp, Artificial Sequence
  chemically synthesized
atgctatgagggtagaagtgga

SEQ ID NO: 1020063 - DNA, 22 bp, Artificial Sequence
  chemically synthesized
attcgactcctttccacttcta

SEQ ID NO: 1020064 - DNA, 22 bp, Artificial Sequence
  chemically synthesized
tgagggtagaagtggaaaggag

SEQ ID NO: 1020065 - DNA, 22 bp, Artificial Sequence
  chemically synthesized
aatatctaattcgactcctttc

SEQ ID NO: 1020066 - DNA, 22 bp, Artificial Sequence
  chemically synthesized
aaattaaatatctaattcgact

SEQ ID NO: 1020067 - DNA, 22 bp, Artificial Sequence
  chemically synthesized
caaattaaatatctaattcgac

SEQ ID NO: 1020068 - DNA, 22 bp, Artificial Sequence
  chemically synthesized
taatgggtagacttcaaattaa

SEQ ID NO: 1020069 - DNA, 22 bp, Artificial Sequence
  chemically synthesized
gatatttaatttgaagtctacc

SEQ ID NO: 1020070 - DNA, 22 bp, Artificial Sequence
  chemically synthesized
caaaattgtaatgggtagactt

SEQ ID NO: 1020071 - DNA, 22 bp, Artificial Sequence
  chemically synthesized
ccaaaattgtaatgggtagact

SEQ ID NO: 1020072 - DNA, 22 bp, Artificial Sequence
  chemically synthesized
aatttgaagtctacccattaca

SEQ ID NO: 1020073 - DNA, 22 bp, Artificial Sequence
  chemically synthesized
accttccaaaattgtaatgggt

SEQ ID NO: 1020074 - DNA, 22 bp, Artificial Sequence
  chemically synthesized
atttgaagtctacccattacaa

SEQ ID NO: 1020075 - DNA, 22 bp, Artificial Sequence
  chemically synthesized
taaccttccaaaattgtaatgg

SEQ ID NO: 1020076 - DNA, 22 bp, Artificial Sequence
  chemically synthesized
gaagtctacccattacaatttt

SEQ ID NO: 1020077 - DNA, 22 bp, Artificial Sequence
  chemically synthesized
aagtctacccattacaattttg

SEQ ID NO: 1020078 - DNA, 22 bp, Artificial Sequence
  chemically synthesized
gcctctaaccttccaaaattgt

SEQ ID NO: 1020079 - DNA, 22 bp, Artificial Sequence
  chemically synthesized
ggcctctaaccttccaaaattg

SEQ ID NO: 1020080 - DNA, 22 bp, Artificial Sequence
  chemically synthesized
tggcctctaaccttccaaaatt

SEQ ID NO: 1020081 - DNA, 22 bp, Artificial Sequence
  chemically synthesized
ttggcctctaaccttccaaaat

SEQ ID NO: 1020082 - DNA, 22 bp, Artificial Sequence
  chemically synthesized
cccattacaattttggaaggtt

SEQ ID NO: 1020083 - DNA, 22 bp, Artificial Sequence
  chemically synthesized
caattttggaaggttagaggcc

SEQ ID NO: 1020084 - DNA, 22 bp, Artificial Sequence
  chemically synthesized
tggaaggttagaggccaaaagg

SEQ ID NO: 1020085 - DNA, 22 bp, Artificial Sequence
  chemically synthesized
ggaaggttagaggccaaaaggg

SEQ ID NO: 1020086 - DNA, 22 bp, Artificial Sequence
  chemically synthesized
gaaggttagaggccaaaagggg

SEQ ID NO: 1020087 - DNA, 22 bp, Artificial Sequence
  chemically synthesized
gaggccaaaagggggtgtatct

SEQ ID NO: 1020088 - DNA, 22 bp, Artificial Sequence
  chemically synthesized
aaaaaataaaacaagatacacc

SEQ ID NO: 1020089 - DNA, 22 bp, Artificial Sequence
  chemically synthesized
gaaaaagttgaaaaaataaaac

SEQ ID NO: 1020090 - DNA, 22 bp, Artificial Sequence
  chemically synthesized
tcatgttagaaaaagttgaaaa

SEQ ID NO: 1020091 - DNA, 22 bp, Artificial Sequence
  chemically synthesized
gttttattttttcaactttttc

SEQ ID NO: 1020092 - DNA, 22 bp, Artificial Sequence
  chemically synthesized
ttttattttttcaactttttct

SEQ ID NO: 1020093 - DNA, 22 bp, Artificial Sequence
  chemically synthesized
tattttttcaactttttctaac

SEQ ID NO: 1020094 - DNA, 22 bp, Artificial Sequence
  chemically synthesized
aacagttgtcatgttagaaaaa

SEQ ID NO: 1020095 - DNA, 22 bp, Artificial Sequence
  chemically synthesized
attttttcaactttttctaaca

SEQ ID NO: 1020096 - DNA, 22 bp, Artificial Sequence
  chemically synthesized
caacagttgtcatgttagaaaa

SEQ ID NO: 1020097 - DNA, 22 bp, Artificial Sequence
  chemically synthesized
ttttttcaactttttctaacat

SEQ ID NO: 1020098 - DNA, 22 bp, Artificial Sequence
  chemically synthesized
tcaacagttgtcatgttagaaa

SEQ ID NO: 1020099 - DNA, 22 bp, Artificial Sequence
  chemically synthesized
ttcaacagttgtcatgttagaa

SEQ ID NO: 1020100 - DNA, 22 bp, Artificial Sequence
  chemically synthesized
tttcaactttttctaacatgac

SEQ ID NO: 1020101 - DNA, 22 bp, Artificial Sequence
  chemically synthesized
ttcaactttttctaacatgaca

SEQ ID NO: 1020102 - DNA, 22 bp, Artificial Sequence
  chemically synthesized
tttttcaacagttgtcatgtta

SEQ ID NO: 1020103 - DNA, 22 bp, Artificial Sequence
  chemically synthesized
tcaactttttctaacatgacaa

SEQ ID NO: 1020104 - DNA, 22 bp, Artificial Sequence
  chemically synthesized
atttttcaacagttgtcatgtt

SEQ ID NO: 1020105 - DNA, 22 bp, Artificial Sequence
  chemically synthesized
caactttttctaacatgacaac

SEQ ID NO: 1020106 - DNA, 22 bp, Artificial Sequence
  chemically synthesized
aactttttctaacatgacaact

SEQ ID NO: 1020107 - DNA, 22 bp, Artificial Sequence
  chemically synthesized
tttctaacatgacaactgttga

SEQ ID NO: 1020108 - DNA, 22 bp, Artificial Sequence
  chemically synthesized
ttctaacatgacaactgttgaa

SEQ ID NO: 1020109 - DNA, 22 bp, Artificial Sequence
  chemically synthesized
tctaacatgacaactgttgaaa

SEQ ID NO: 1020110 - DNA, 22 bp, Artificial Sequence
  chemically synthesized
ctaacatgacaactgttgaaaa

SEQ ID NO: 1020111 - DNA, 22 bp, Artificial Sequence
  chemically synthesized
taacatgacaactgttgaaaaa

SEQ ID NO: 1020112 - DNA, 22 bp, Artificial Sequence
  chemically synthesized
tacatgatacttatttttcaac

SEQ ID NO: 1020113 - DNA, 22 bp, Artificial Sequence
  chemically synthesized
acatgacaactgttgaaaaata

SEQ ID NO: 1020114 - DNA, 22 bp, Artificial Sequence
  chemically synthesized
gtacatgatacttatttttcaa

SEQ ID NO: 1020115 - DNA, 22 bp, Artificial Sequence
  chemically synthesized
tgtacatgatacttatttttca

SEQ ID NO: 1020116 - DNA, 22 bp, Artificial Sequence
  chemically synthesized
ttgtacatgatacttatttttc

SEQ ID NO: 1020117 - DNA, 22 bp, Artificial Sequence
  chemically synthesized
ccttttgtacatgatacttatt

SEQ ID NO: 1020118 - DNA, 22 bp, Artificial Sequence
  chemically synthesized
accttttgtacatgatacttat

SEQ ID NO: 1020119 - DNA, 22 bp, Artificial Sequence
  chemically synthesized
tttaccttttgtacatgatact

SEQ ID NO: 1020120 - DNA, 22 bp, Artificial Sequence
  chemically synthesized
atttaccttttgtacatgatac

SEQ ID NO: 1020121 - DNA, 22 bp, Artificial Sequence
  chemically synthesized
ttgaaaaataagtatcatgtac

SEQ ID NO: 1020122 - DNA, 22 bp, Artificial Sequence
  chemically synthesized
tatttaccttttgtacatgata

SEQ ID NO: 1020123 - DNA, 22 bp, Artificial Sequence
  chemically synthesized
ttatttaccttttgtacatgat

SEQ ID NO: 1020124 - DNA, 22 bp, Artificial Sequence
  chemically synthesized
aaaaataagtatcatgtacaaa

SEQ ID NO: 1020125 - DNA, 22 bp, Artificial Sequence
  chemically synthesized
caaatgaaaacaaagtgaaggc

SEQ ID NO: 1020126 - DNA, 22 bp, Artificial Sequence
  chemically synthesized
cactttgttttcatttggagta

SEQ ID NO: 1020127 - DNA, 22 bp, Artificial Sequence
  chemically synthesized
actttgttttcatttggagtat

SEQ ID NO: 1020128 - DNA, 22 bp, Artificial Sequence
  chemically synthesized
taagatgaataaatactccaaa

SEQ ID NO: 1020129 - DNA, 22 bp, Artificial Sequence
  chemically synthesized
tgttttcatttggagtatttat

SEQ ID NO: 1020130 - DNA, 22 bp, Artificial Sequence
  chemically synthesized
gttttcatttggagtatttatt

SEQ ID NO: 1020131 - DNA, 22 bp, Artificial Sequence
  chemically synthesized
ttttcatttggagtatttattc

SEQ ID NO: 1020132 - DNA, 22 bp, Artificial Sequence
  chemically synthesized
aggcattataagatgaataaat

SEQ ID NO: 1020133 - DNA, 22 bp, Artificial Sequence
  chemically synthesized
tcatttggagtatttattcatc

SEQ ID NO: 1020134 - DNA, 22 bp, Artificial Sequence
  chemically synthesized
catttggagtatttattcatct

SEQ ID NO: 1020135 - DNA, 22 bp, Artificial Sequence
  chemically synthesized
atttggagtatttattcatctt

SEQ ID NO: 1020136 - DNA, 22 bp, Artificial Sequence
  chemically synthesized
ggagtatttattcatcttataa

SEQ ID NO: 1020137 - DNA, 22 bp, Artificial Sequence
  chemically synthesized
gagtatttattcatcttataat

SEQ ID NO: 1020138 - DNA, 22 bp, Artificial Sequence
  chemically synthesized
aaaatccatgttaaggcattat

SEQ ID NO: 1020139 - DNA, 22 bp, Artificial Sequence
  chemically synthesized
attcatcttataatgccttaac

SEQ ID NO: 1020140 - DNA, 22 bp, Artificial Sequence
  chemically synthesized
ttcatcttataatgccttaaca

SEQ ID NO: 1020141 - DNA, 22 bp, Artificial Sequence
  chemically synthesized
agttaaaaatccatgttaaggc

SEQ ID NO: 1020142 - DNA, 22 bp, Artificial Sequence
  chemically synthesized
atcttataatgccttaacatgg

SEQ ID NO: 1020143 - DNA, 22 bp, Artificial Sequence
  chemically synthesized
attaagttaaaaatccatgtta

SEQ ID NO: 1020144 - DNA, 22 bp, Artificial Sequence
  chemically synthesized
cattaagttaaaaatccatgtt

SEQ ID NO: 1020145 - DNA, 22 bp, Artificial Sequence
  chemically synthesized
ataatgccttaacatggatttt

SEQ ID NO: 1020146 - DNA, 22 bp, Artificial Sequence
  chemically synthesized
taatgccttaacatggattttt

SEQ ID NO: 1020147 - DNA, 22 bp, Artificial Sequence
  chemically synthesized
agggcgatttcattaagttaaa

SEQ ID NO: 1020148 - DNA, 22 bp, Artificial Sequence
  chemically synthesized
aagggcgatttcattaagttaa

SEQ ID NO: 1020149 - DNA, 22 bp, Artificial Sequence
  chemically synthesized
aacatggatttttaacttaatg

SEQ ID NO: 1020150 - DNA, 22 bp, Artificial Sequence
  chemically synthesized
acatggatttttaacttaatga

SEQ ID NO: 1020151 - DNA, 22 bp, Artificial Sequence
  chemically synthesized
atgacaaatttaagggcgattt

SEQ ID NO: 1020152 - DNA, 22 bp, Artificial Sequence
  chemically synthesized
ttaacttaatgaaatcgccctt

SEQ ID NO: 1020153 - DNA, 22 bp, Artificial Sequence
  chemically synthesized
taacttaatgaaatcgccctta

SEQ ID NO: 1020154 - DNA, 22 bp, Artificial Sequence
  chemically synthesized
aacttaatgaaatcgcccttaa

SEQ ID NO: 1020155 - DNA, 22 bp, Artificial Sequence
  chemically synthesized
ttaatgacaaatttaagggcga

SEQ ID NO: 1020156 - DNA, 22 bp, Artificial Sequence
  chemically synthesized
acttaatgaaatcgcccttaaa

SEQ ID NO: 1020157 - DNA, 22 bp, Artificial Sequence
  chemically synthesized
aatgaaatcgcccttaaatttg

SEQ ID NO: 1020158 - DNA, 22 bp, Artificial Sequence
  chemically synthesized
atgaaatcgcccttaaatttgt

SEQ ID NO: 1020159 - DNA, 22 bp, Artificial Sequence
  chemically synthesized
aaacaatagtctgttaatgaca

SEQ ID NO: 1020160 - DNA, 22 bp, Artificial Sequence
  chemically synthesized
aaactaaaacaatagtctgtta

SEQ ID NO: 1020161 - DNA, 22 bp, Artificial Sequence
  chemically synthesized
aaatttgtcattaacagactat

SEQ ID NO: 1020162 - DNA, 22 bp, Artificial Sequence
  chemically synthesized
aatttgtcattaacagactatt

SEQ ID NO: 1020163 - DNA, 22 bp, Artificial Sequence
  chemically synthesized
gtcattaacagactattgtttt

SEQ ID NO: 1020164 - DNA, 22 bp, Artificial Sequence
  chemically synthesized
tcattaacagactattgtttta

SEQ ID NO: 1020165 - DNA, 22 bp, Artificial Sequence
  chemically synthesized
aaaaacactaaaactaaaacaa

SEQ ID NO: 1020166 - DNA, 22 bp, Artificial Sequence
  chemically synthesized
acagactattgttttagtttta

SEQ ID NO: 1020167 - DNA, 22 bp, Artificial Sequence
  chemically synthesized
atagttaaaaaacactaaaact

SEQ ID NO: 1020168 - DNA, 22 bp, Artificial Sequence
  chemically synthesized
catagttaaaaaacactaaaac

SEQ ID NO: 1020169 - DNA, 22 bp, Artificial Sequence
  chemically synthesized
tcatagttaaaaaacactaaaa

SEQ ID NO: 1020170 - DNA, 22 bp, Artificial Sequence
  chemically synthesized
ttgttttagttttagtgttttt

SEQ ID NO: 1020171 - DNA, 22 bp, Artificial Sequence
  chemically synthesized
ttttagttttagtgttttttaa

SEQ ID NO: 1020172 - DNA, 22 bp, Artificial Sequence
  chemically synthesized
tagttttagtgttttttaacta

SEQ ID NO: 1020173 - DNA, 22 bp, Artificial Sequence
  chemically synthesized
agttttagtgttttttaactat

SEQ ID NO: 1020174 - DNA, 22 bp, Artificial Sequence
  chemically synthesized
gttttagtgttttttaactatg

SEQ ID NO: 1020175 - DNA, 22 bp, Artificial Sequence
  chemically synthesized
tagtgttttttaactatgaaaa

SEQ ID NO: 1020176 - DNA, 22 bp, Artificial Sequence
  chemically synthesized
agtgttttttaactatgaaaat

SEQ ID NO: 1020177 - DNA, 22 bp, Artificial Sequence
  chemically synthesized
gtgttttttaactatgaaaata

SEQ ID NO: 1020178 - DNA, 22 bp, Artificial Sequence
  chemically synthesized
atacaatgacaatattttcata

SEQ ID NO: 1020179 - DNA, 22 bp, Artificial Sequence
  chemically synthesized
aatacaatgacaatattttcat

SEQ ID NO: 1020180 - DNA, 22 bp, Artificial Sequence
  chemically synthesized
taatacaatgacaatattttca

SEQ ID NO: 1020181 - DNA, 22 bp, Artificial Sequence
  chemically synthesized
ttaatacaatgacaatattttc

SEQ ID NO: 1020182 - DNA, 22 bp, Artificial Sequence
  chemically synthesized
tttaatacaatgacaatatttt

SEQ ID NO: 1020183 - DNA, 22 bp, Artificial Sequence
  chemically synthesized
tttaactatgaaaatattgtca

SEQ ID NO: 1020184 - DNA, 22 bp, Artificial Sequence
  chemically synthesized
ttaactatgaaaatattgtcat

SEQ ID NO: 1020185 - DNA, 22 bp, Artificial Sequence
  chemically synthesized
ttttttaatacaatgacaatat

SEQ ID NO: 1020186 - DNA, 22 bp, Artificial Sequence
  chemically synthesized
taactatgaaaatattgtcatt

SEQ ID NO: 1020187 - DNA, 22 bp, Artificial Sequence
  chemically synthesized
attttttaatacaatgacaata

SEQ ID NO: 1020188 - DNA, 22 bp, Artificial Sequence
  chemically synthesized
aactatgaaaatattgtcattg

SEQ ID NO: 1020189 - DNA, 22 bp, Artificial Sequence
  chemically synthesized
actatgaaaatattgtcattgt

SEQ ID NO: 1020190 - DNA, 22 bp, Artificial Sequence
  chemically synthesized
ttattttttaatacaatgacaa

SEQ ID NO: 1020191 - DNA, 22 bp, Artificial Sequence
  chemically synthesized
tgaaaatattgtcattgtatta

SEQ ID NO: 1020192 - DNA, 22 bp, Artificial Sequence
  chemically synthesized
gaaattcttattttttaataca

SEQ ID NO: 1020193 - DNA, 22 bp, Artificial Sequence
  chemically synthesized
ggaaattcttattttttaatac

SEQ ID NO: 1020194 - DNA, 22 bp, Artificial Sequence
  chemically synthesized
taacttggaaattcttattttt

SEQ ID NO: 1020195 - DNA, 22 bp, Artificial Sequence
  chemically synthesized
tcattgtattaaaaaataagaa

SEQ ID NO: 1020196 - DNA, 22 bp, Artificial Sequence
  chemically synthesized
gtaacttggaaattcttatttt

SEQ ID NO: 1020197 - DNA, 22 bp, Artificial Sequence
  chemically synthesized
tgtaacttggaaattcttattt

SEQ ID NO: 1020198 - DNA, 22 bp, Artificial Sequence
  chemically synthesized
tattaaaaaataagaatttcca

SEQ ID NO: 1020199 - DNA, 22 bp, Artificial Sequence
  chemically synthesized
tcattttgtaacttggaaattc

SEQ ID NO: 1020200 - DNA, 22 bp, Artificial Sequence
  chemically synthesized
aaaaataagaatttccaagtta

SEQ ID NO: 1020201 - DNA, 22 bp, Artificial Sequence
  chemically synthesized
actgtcattttgtaacttggaa

SEQ ID NO: 1020202 - DNA, 22 bp, Artificial Sequence
  chemically synthesized
cactgtcattttgtaacttgga

SEQ ID NO: 1020203 - DNA, 22 bp, Artificial Sequence
  chemically synthesized
tcactgtcattttgtaacttgg

SEQ ID NO: 1020204 - DNA, 22 bp, Artificial Sequence
  chemically synthesized
ttcactgtcattttgtaacttg

SEQ ID NO: 1020205 - DNA, 22 bp, Artificial Sequence
  chemically synthesized
tttcactgtcattttgtaactt

SEQ ID NO: 1020206 - DNA, 22 bp, Artificial Sequence
  chemically synthesized
ttttcactgtcattttgtaact

SEQ ID NO: 1020207 - DNA, 22 bp, Artificial Sequence
  chemically synthesized
gtttttttcactgtcattttgt

SEQ ID NO: 1020208 - DNA, 22 bp, Artificial Sequence
  chemically synthesized
ccaagttacaaaatgacagtga

SEQ ID NO: 1020209 - DNA, 22 bp, Artificial Sequence
  chemically synthesized
caagttacaaaatgacagtgaa

SEQ ID NO: 1020210 - DNA, 22 bp, Artificial Sequence
  chemically synthesized
caaaatgacagtgaaaaaaacc

SEQ ID NO: 1020211 - DNA, 22 bp, Artificial Sequence
  chemically synthesized
tgtgagggtggaatggtatggc

SEQ ID NO: 1020212 - DNA, 22 bp, Artificial Sequence
  chemically synthesized
ttatgtgagggtggaatggtat

SEQ ID NO: 1020213 - DNA, 22 bp, Artificial Sequence
  chemically synthesized
atagctgttatgtgagggtgga

SEQ ID NO: 1020214 - DNA, 22 bp, Artificial Sequence
  chemically synthesized
atcctgatagctgttatgtgag

SEQ ID NO: 1020215 - DNA, 22 bp, Artificial Sequence
  chemically synthesized
catcctgatagctgttatgtga

SEQ ID NO: 1020216 - DNA, 22 bp, Artificial Sequence
  chemically synthesized
ttcatcctgatagctgttatgt

SEQ ID NO: 1020217 - DNA, 22 bp, Artificial Sequence
  chemically synthesized
ttcttcatcctgatagctgtta

SEQ ID NO: 1020218 - DNA, 22 bp, Artificial Sequence
  chemically synthesized
caccctcacataacagctatca

SEQ ID NO: 1020219 - DNA, 22 bp, Artificial Sequence
  chemically synthesized
acataacagctatcaggatgaa

SEQ ID NO: 1020220 - DNA, 22 bp, Artificial Sequence
  chemically synthesized
tcaggatgaagaataatttttc

SEQ ID NO: 1020221 - DNA, 22 bp, Artificial Sequence
  chemically synthesized
ataaatgataaagagaaaaatt

SEQ ID NO: 1020222 - DNA, 22 bp, Artificial Sequence
  chemically synthesized
gagaactaataaatgataaaga

SEQ ID NO: 1020223 - DNA, 22 bp, Artificial Sequence
  chemically synthesized
ggttagagaactaataaatgat

SEQ ID NO: 1020224 - DNA, 22 bp, Artificial Sequence
  chemically synthesized
ttctctttatcatttattagtt

SEQ ID NO: 1020225 - DNA, 22 bp, Artificial Sequence
  chemically synthesized
tctctttatcatttattagttc

SEQ ID NO: 1020226 - DNA, 22 bp, Artificial Sequence
  chemically synthesized
ctctttatcatttattagttct

SEQ ID NO: 1020227 - DNA, 22 bp, Artificial Sequence
  chemically synthesized
tctttatcatttattagttctc

SEQ ID NO: 1020228 - DNA, 22 bp, Artificial Sequence
  chemically synthesized
aaaaattaggttagagaactaa

SEQ ID NO: 1020229 - DNA, 22 bp, Artificial Sequence
  chemically synthesized
tttatcatttattagttctcta

SEQ ID NO: 1020230 - DNA, 22 bp, Artificial Sequence
  chemically synthesized
aaaaaattaggttagagaacta

SEQ ID NO: 1020231 - DNA, 22 bp, Artificial Sequence
  chemically synthesized
tatcatttattagttctctaac

SEQ ID NO: 1020232 - DNA, 22 bp, Artificial Sequence
  chemically synthesized
atcatttattagttctctaacc

SEQ ID NO: 1020233 - DNA, 22 bp, Artificial Sequence
  chemically synthesized
cttaaaaaattaggttagagaa

SEQ ID NO: 1020234 - DNA, 22 bp, Artificial Sequence
  chemically synthesized
tcatttattagttctctaacct

SEQ ID NO: 1020235 - DNA, 22 bp, Artificial Sequence
  chemically synthesized
attagttctctaacctaatttt

SEQ ID NO: 1020236 - DNA, 22 bp, Artificial Sequence
  chemically synthesized
ttagttctctaacctaattttt

SEQ ID NO: 1020237 - DNA, 22 bp, Artificial Sequence
  chemically synthesized
aatgaattccttaaaaaattag

SEQ ID NO: 1020238 - DNA, 22 bp, Artificial Sequence
  chemically synthesized
aaatgaattccttaaaaaatta

SEQ ID NO: 1020239 - DNA, 22 bp, Artificial Sequence
  chemically synthesized
gttctctaacctaattttttaa

SEQ ID NO: 1020240 - DNA, 22 bp, Artificial Sequence
  chemically synthesized
taaatgaattccttaaaaaatt

SEQ ID NO: 1020241 - DNA, 22 bp, Artificial Sequence
  chemically synthesized
tctaacctaattttttaaggaa

SEQ ID NO: 1020242 - DNA, 22 bp, Artificial Sequence
  chemically synthesized
taacctaattttttaaggaatt

SEQ ID NO: 1020243 - DNA, 22 bp, Artificial Sequence
  chemically synthesized
acctaattttttaaggaattca

SEQ ID NO: 1020244 - DNA, 22 bp, Artificial Sequence
  chemically synthesized
ccatgattttaaatgaattcct

SEQ ID NO: 1020245 - DNA, 22 bp, Artificial Sequence
  chemically synthesized
accatgattttaaatgaattcc

SEQ ID NO: 1020246 - DNA, 22 bp, Artificial Sequence
  chemically synthesized
taccatgattttaaatgaattc

SEQ ID NO: 1020247 - DNA, 22 bp, Artificial Sequence
  chemically synthesized
attttttaaggaattcatttaa

SEQ ID NO: 1020248 - DNA, 22 bp, Artificial Sequence
  chemically synthesized
ttttaccatgattttaaatgaa

SEQ ID NO: 1020249 - DNA, 22 bp, Artificial Sequence
  chemically synthesized
attttaccatgattttaaatga

SEQ ID NO: 1020250 - DNA, 22 bp, Artificial Sequence
  chemically synthesized
tattttaccatgattttaaatg

SEQ ID NO: 1020251 - DNA, 22 bp, Artificial Sequence
  chemically synthesized
tttaaggaattcatttaaaatc

SEQ ID NO: 1020252 - DNA, 22 bp, Artificial Sequence
  chemically synthesized
ttaaggaattcatttaaaatca

SEQ ID NO: 1020253 - DNA, 22 bp, Artificial Sequence
  chemically synthesized
taaggaattcatttaaaatcat

SEQ ID NO: 1020254 - DNA, 22 bp, Artificial Sequence
  chemically synthesized
aaggaattcatttaaaatcatg

SEQ ID NO: 1020255 - DNA, 22 bp, Artificial Sequence
  chemically synthesized
attttattttaccatgatttta

SEQ ID NO: 1020256 - DNA, 22 bp, Artificial Sequence
  chemically synthesized
aggaattcatttaaaatcatgg

SEQ ID NO: 1020257 - DNA, 22 bp, Artificial Sequence
  chemically synthesized
cattttattttaccatgatttt

SEQ ID NO: 1020258 - DNA, 22 bp, Artificial Sequence
  chemically synthesized
tcattttattttaccatgattt

SEQ ID NO: 1020259 - DNA, 22 bp, Artificial Sequence
  chemically synthesized
tattttcattttattttaccat

SEQ ID NO: 1020260 - DNA, 22 bp, Artificial Sequence
  chemically synthesized
atttaaaatcatggtaaaataa

SEQ ID NO: 1020261 - DNA, 22 bp, Artificial Sequence
  chemically synthesized
gttatattttcattttatttta

SEQ ID NO: 1020262 - DNA, 22 bp, Artificial Sequence
  chemically synthesized
aaaatcatggtaaaataaaatg

SEQ ID NO: 1020263 - DNA, 22 bp, Artificial Sequence
  chemically synthesized
aaatcatggtaaaataaaatga

SEQ ID NO: 1020264 - DNA, 22 bp, Artificial Sequence
  chemically synthesized
ttagttatattttcattttatt

SEQ ID NO: 1020265 - DNA, 22 bp, Artificial Sequence
  chemically synthesized
attagttatattttcattttat

SEQ ID NO: 1020266 - DNA, 22 bp, Artificial Sequence
  chemically synthesized
tcttattagttatattttcatt

SEQ ID NO: 1020267 - DNA, 22 bp, Artificial Sequence
  chemically synthesized
aaatactatcttattagttata

SEQ ID NO: 1020268 - DNA, 22 bp, Artificial Sequence
  chemically synthesized
tcacctcaaatactatcttatt

SEQ ID NO: 1020269 - DNA, 22 bp, Artificial Sequence
  chemically synthesized
ataagatagtatttgaggtgat

SEQ ID NO: 1020270 - DNA, 22 bp, Artificial Sequence
  chemically synthesized
aggaggaaatcctatcacctca

SEQ ID NO: 1020271 - DNA, 22 bp, Artificial Sequence
  chemically synthesized
ctgaggaggaaatcctatcacc

SEQ ID NO: 1020272 - DNA, 22 bp, Artificial Sequence
  chemically synthesized
attgctgaggaggaaatcctat

SEQ ID NO: 1020273 - DNA, 22 bp, Artificial Sequence
  chemically synthesized
cattgctgaggaggaaatccta

SEQ ID NO: 1020274 - DNA, 22 bp, Artificial Sequence
  chemically synthesized
tcattgctgaggaggaaatcct

SEQ ID NO: 1020275 - DNA, 22 bp, Artificial Sequence
  chemically synthesized
gaggtgataggatttcctcctc

SEQ ID NO: 1020276 - DNA, 22 bp, Artificial Sequence
  chemically synthesized
aggtgataggatttcctcctca

SEQ ID NO: 1020277 - DNA, 22 bp, Artificial Sequence
  chemically synthesized
tgtaagattttcattgctgagg

SEQ ID NO: 1020278 - DNA, 22 bp, Artificial Sequence
  chemically synthesized
aatgattatgtaagattttcat

SEQ ID NO: 1020279 - DNA, 22 bp, Artificial Sequence
  chemically synthesized
cctcctcagcaatgaaaatctt

SEQ ID NO: 1020280 - DNA, 22 bp, Artificial Sequence
  chemically synthesized
aaatgattatgtaagattttca

SEQ ID NO: 1020281 - DNA, 22 bp, Artificial Sequence
  chemically synthesized
ctcctcagcaatgaaaatctta

SEQ ID NO: 1020282 - DNA, 22 bp, Artificial Sequence
  chemically synthesized
taaatgattatgtaagattttc

SEQ ID NO: 1020283 - DNA, 22 bp, Artificial Sequence
  chemically synthesized
ctcagcaatgaaaatcttacat

SEQ ID NO: 1020284 - DNA, 22 bp, Artificial Sequence
  chemically synthesized
agcaatgaaaatcttacataat

SEQ ID NO: 1020285 - DNA, 22 bp, Artificial Sequence
  chemically synthesized
accggtctttaaatgattatgt

SEQ ID NO: 1020286 - DNA, 22 bp, Artificial Sequence
  chemically synthesized
caccggtctttaaatgattatg

SEQ ID NO: 1020287 - DNA, 22 bp, Artificial Sequence
  chemically synthesized
agcacttcaccggtctttaaat

SEQ ID NO: 1020288 - DNA, 22 bp, Artificial Sequence
  chemically synthesized
cagcacttcaccggtctttaaa

SEQ ID NO: 1020289 - DNA, 22 bp, Artificial Sequence
  chemically synthesized
tcagcacttcaccggtctttaa

SEQ ID NO: 1020290 - DNA, 22 bp, Artificial Sequence
  chemically synthesized
acataatcatttaaagaccggt

SEQ ID NO: 1020291 - DNA, 22 bp, Artificial Sequence
  chemically synthesized
cataatcatttaaagaccggtg

SEQ ID NO: 1020292 - DNA, 22 bp, Artificial Sequence
  chemically synthesized
attttcagcacttcaccggtct

SEQ ID NO: 1020293 - DNA, 22 bp, Artificial Sequence
  chemically synthesized
tctgattttcagcacttcaccg

SEQ ID NO: 1020294 - DNA, 22 bp, Artificial Sequence
  chemically synthesized
gtctgattttcagcacttcacc

SEQ ID NO: 1020295 - DNA, 22 bp, Artificial Sequence
  chemically synthesized
tgtctgattttcagcacttcac

SEQ ID NO: 1020296 - DNA, 22 bp, Artificial Sequence
  chemically synthesized
aaagaccggtgaagtgctgaaa

SEQ ID NO: 1020297 - DNA, 22 bp, Artificial Sequence
  chemically synthesized
aagaccggtgaagtgctgaaaa

SEQ ID NO: 1020298 - DNA, 22 bp, Artificial Sequence
  chemically synthesized
taattttgtctgattttcagca

SEQ ID NO: 1020299 - DNA, 22 bp, Artificial Sequence
  chemically synthesized
acattgtaattttgtctgattt

SEQ ID NO: 1020300 - DNA, 22 bp, Artificial Sequence
  chemically synthesized
cacattgtaattttgtctgatt

SEQ ID NO: 1020301 - DNA, 22 bp, Artificial Sequence
  chemically synthesized
tcacattgtaattttgtctgat

SEQ ID NO: 1020302 - DNA, 22 bp, Artificial Sequence
  chemically synthesized
atgattttcacattgtaatttt

SEQ ID NO: 1020303 - DNA, 22 bp, Artificial Sequence
  chemically synthesized
gatgattttcacattgtaattt

SEQ ID NO: 1020304 - DNA, 22 bp, Artificial Sequence
  chemically synthesized
aaaatcagacaaaattacaatg

SEQ ID NO: 1020305 - DNA, 22 bp, Artificial Sequence
  chemically synthesized
ttgatgattttcacattgtaat

SEQ ID NO: 1020306 - DNA, 22 bp, Artificial Sequence
  chemically synthesized
ctcttgatgattttcacattgt

SEQ ID NO: 1020307 - DNA, 22 bp, Artificial Sequence
  chemically synthesized
cctcttgatgattttcacattg

SEQ ID NO: 1020308 - DNA, 22 bp, Artificial Sequence
  chemically synthesized
tttcctcttgatgattttcaca

SEQ ID NO: 1020309 - DNA, 22 bp, Artificial Sequence
  chemically synthesized
gtttcctcttgatgattttcac

SEQ ID NO: 1020310 - DNA, 22 bp, Artificial Sequence
  chemically synthesized
caatgtgaaaatcatcaagagg

SEQ ID NO: 1020311 - DNA, 22 bp, Artificial Sequence
  chemically synthesized
aaatagacttgtttcctcttga

SEQ ID NO: 1020312 - DNA, 22 bp, Artificial Sequence
  chemically synthesized
aaaatagacttgtttcctcttg

SEQ ID NO: 1020313 - DNA, 22 bp, Artificial Sequence
  chemically synthesized
taaaatagacttgtttcctctt

SEQ ID NO: 1020314 - DNA, 22 bp, Artificial Sequence
  chemically synthesized
ctttaaaatagacttgtttcct

SEQ ID NO: 1020315 - DNA, 22 bp, Artificial Sequence
  chemically synthesized
gcattcctttaaaatagacttg

SEQ ID NO: 1020316 - DNA, 22 bp, Artificial Sequence
  chemically synthesized
attggcattcctttaaaataga

SEQ ID NO: 1020317 - DNA, 22 bp, Artificial Sequence
  chemically synthesized
tcagtctaattggcattccttt

SEQ ID NO: 1020318 - DNA, 22 bp, Artificial Sequence
  chemically synthesized
ttttaaaggaatgccaattaga

SEQ ID NO: 1020319 - DNA, 22 bp, Artificial Sequence
  chemically synthesized
taaaggaatgccaattagactg

SEQ ID NO: 1020320 - DNA, 22 bp, Artificial Sequence
  chemically synthesized
aaaggaatgccaattagactga

SEQ ID NO: 1020321 - DNA, 22 bp, Artificial Sequence
  chemically synthesized
aacggtaagttgtcagtctaat

SEQ ID NO: 1020322 - DNA, 22 bp, Artificial Sequence
  chemically synthesized
aaggaatgccaattagactgac

SEQ ID NO: 1020323 - DNA, 22 bp, Artificial Sequence
  chemically synthesized
ttgaacggtaagttgtcagtct

SEQ ID NO: 1020324 - DNA, 22 bp, Artificial Sequence
  chemically synthesized
tgttgaacggtaagttgtcagt

SEQ ID NO: 1020325 - DNA, 22 bp, Artificial Sequence
  chemically synthesized
ctgttgaacggtaagttgtcag

SEQ ID NO: 1020326 - DNA, 22 bp, Artificial Sequence
  chemically synthesized
tctgttgaacggtaagttgtca

SEQ ID NO: 1020327 - DNA, 22 bp, Artificial Sequence
  chemically synthesized
catattttctgttgaacggtaa

SEQ ID NO: 1020328 - DNA, 22 bp, Artificial Sequence
  chemically synthesized
ccatattttctgttgaacggta

SEQ ID NO: 1020329 - DNA, 22 bp, Artificial Sequence
  chemically synthesized
gactgacaacttaccgttcaac

SEQ ID NO: 1020330 - DNA, 22 bp, Artificial Sequence
  chemically synthesized
acaacttaccgttcaacagaaa

SEQ ID NO: 1020331 - DNA, 22 bp, Artificial Sequence
  chemically synthesized
aggcttccatattttctgttga

SEQ ID NO: 1020332 - DNA, 22 bp, Artificial Sequence
  chemically synthesized
tcaggcttccatattttctgtt

SEQ ID NO: 1020333 - DNA, 22 bp, Artificial Sequence
  chemically synthesized
ttctcaggcttccatattttct

SEQ ID NO: 1020334 - DNA, 22 bp, Artificial Sequence
  chemically synthesized
accgttcaacagaaaatatgga

SEQ ID NO: 1020335 - DNA, 22 bp, Artificial Sequence
  chemically synthesized
ccgttcaacagaaaatatggaa

SEQ ID NO: 1020336 - DNA, 22 bp, Artificial Sequence
  chemically synthesized
aacagaaaatatggaagcctga

SEQ ID NO: 1020337 - DNA, 22 bp, Artificial Sequence
  chemically synthesized
aagatagcatgattgttctcag

SEQ ID NO: 1020338 - DNA, 22 bp, Artificial Sequence
  chemically synthesized
atcacattgaagatagcatgat

SEQ ID NO: 1020339 - DNA, 22 bp, Artificial Sequence
  chemically synthesized
agaacaatcatgctatcttcaa

SEQ ID NO: 1020340 - DNA, 22 bp, Artificial Sequence
  chemically synthesized
cagttaatcacattgaagatag

SEQ ID NO: 1020341 - DNA, 22 bp, Artificial Sequence
  chemically synthesized
ccaaacagcattccagttaatc

SEQ ID NO: 1020342 - DNA, 22 bp, Artificial Sequence
  chemically synthesized
tcttcaatgtgattaactggaa

SEQ ID NO: 1020343 - DNA, 22 bp, Artificial Sequence
  chemically synthesized
caatgtgattaactggaatgct

SEQ ID NO: 1020344 - DNA, 22 bp, Artificial Sequence
  chemically synthesized
aatgtgattaactggaatgctg

SEQ ID NO: 1020345 - DNA, 22 bp, Artificial Sequence
  chemically synthesized
aggatggcatgtcctaccaaac

SEQ ID NO: 1020346 - DNA, 22 bp, Artificial Sequence
  chemically synthesized
actggaatgctgtttggtagga

SEQ ID NO: 1020347 - DNA, 22 bp, Artificial Sequence
  chemically synthesized
gaatgctgtttggtaggacatg

SEQ ID NO: 1020348 - DNA, 22 bp, Artificial Sequence
  chemically synthesized
aactgaggatggcatgtcctac

SEQ ID NO: 1020349 - DNA, 22 bp, Artificial Sequence
  chemically synthesized
gttaaactgaggatggcatgtc

SEQ ID NO: 1020350 - DNA, 22 bp, Artificial Sequence
  chemically synthesized
tttggtaggacatgccatcctc

SEQ ID NO: 1020351 - DNA, 22 bp, Artificial Sequence
  chemically synthesized
ggtaggacatgccatcctcagt

SEQ ID NO: 1020352 - DNA, 22 bp, Artificial Sequence
  chemically synthesized
gtaggacatgccatcctcagtt

SEQ ID NO: 1020353 - DNA, 22 bp, Artificial Sequence
  chemically synthesized
gcaataatctagttaaactgag

SEQ ID NO: 1020354 - DNA, 22 bp, Artificial Sequence
  chemically synthesized
agcaataatctagttaaactga

SEQ ID NO: 1020355 - DNA, 22 bp, Artificial Sequence
  chemically synthesized
gagtgtaatttagcaataatct

SEQ ID NO: 1020356 - DNA, 22 bp, Artificial Sequence
  chemically synthesized
agagtgtaatttagcaataatc

SEQ ID NO: 1020357 - DNA, 22 bp, Artificial Sequence
  chemically synthesized
agtttaactagattattgctaa

SEQ ID NO: 1020358 - DNA, 22 bp, Artificial Sequence
  chemically synthesized
aactagattattgctaaattac

SEQ ID NO: 1020359 - DNA, 22 bp, Artificial Sequence
  chemically synthesized
actagattattgctaaattaca

SEQ ID NO: 1020360 - DNA, 22 bp, Artificial Sequence
  chemically synthesized
gattattgctaaattacactct

SEQ ID NO: 1020361 - DNA, 22 bp, Artificial Sequence
  chemically synthesized
gtacaaccaatttagagtgtaa

SEQ ID NO: 1020362 - DNA, 22 bp, Artificial Sequence
  chemically synthesized
ttgctaaattacactctaaatt

SEQ ID NO: 1020363 - DNA, 22 bp, Artificial Sequence
  chemically synthesized
agttggtacaaccaatttagag

SEQ ID NO: 1020364 - DNA, 22 bp, Artificial Sequence
  chemically synthesized
aagttggtacaaccaatttaga

SEQ ID NO: 1020365 - DNA, 22 bp, Artificial Sequence
  chemically synthesized
ctaaattacactctaaattggt

SEQ ID NO: 1020366 - DNA, 22 bp, Artificial Sequence
  chemically synthesized
aattacactctaaattggttgt

SEQ ID NO: 1020367 - DNA, 22 bp, Artificial Sequence
  chemically synthesized
cactctaaattggttgtaccaa

SEQ ID NO: 1020368 - DNA, 22 bp, Artificial Sequence
  chemically synthesized
tagaaatttaagttggtacaac

SEQ ID NO: 1020369 - DNA, 22 bp, Artificial Sequence
  chemically synthesized
gtagaaatttaagttggtacaa

SEQ ID NO: 1020370 - DNA, 22 bp, Artificial Sequence
  chemically synthesized
ttgtagaaatttaagttggtac

SEQ ID NO: 1020371 - DNA, 22 bp, Artificial Sequence
  chemically synthesized
taaattggttgtaccaacttaa

SEQ ID NO: 1020372 - DNA, 22 bp, Artificial Sequence
  chemically synthesized
aattggttgtaccaacttaaat

SEQ ID NO: 1020373 - DNA, 22 bp, Artificial Sequence
  chemically synthesized
attcttgtagaaatttaagttg

SEQ ID NO: 1020374 - DNA, 22 bp, Artificial Sequence
  chemically synthesized
tcattcttgtagaaatttaagt

SEQ ID NO: 1020375 - DNA, 22 bp, Artificial Sequence
  chemically synthesized
gttgtaccaacttaaatttcta

SEQ ID NO: 1020376 - DNA, 22 bp, Artificial Sequence
  chemically synthesized
taccaacttaaatttctacaag

SEQ ID NO: 1020377 - DNA, 22 bp, Artificial Sequence
  chemically synthesized
aaatttctacaagaatgagagt

SEQ ID NO: 1020378 - DNA, 22 bp, Artificial Sequence
  chemically synthesized
aatttctacaagaatgagagtt

SEQ ID NO: 1020379 - DNA, 22 bp, Artificial Sequence
  chemically synthesized
tgaaaggtcacaaactctcatt

SEQ ID NO: 1020380 - DNA, 22 bp, Artificial Sequence
  chemically synthesized
ctacaagaatgagagtttgtga

SEQ ID NO: 1020381 - DNA, 22 bp, Artificial Sequence
  chemically synthesized
tacaagaatgagagtttgtgac

SEQ ID NO: 1020382 - DNA, 22 bp, Artificial Sequence
  chemically synthesized
caagaatgagagtttgtgacct

SEQ ID NO: 1020383 - DNA, 22 bp, Artificial Sequence
  chemically synthesized
gtgacctttcacaatcttattt

SEQ ID NO: 1020384 - DNA, 22 bp, Artificial Sequence
  chemically synthesized
tgacctttcacaatcttatttt

SEQ ID NO: 1020385 - DNA, 22 bp, Artificial Sequence
  chemically synthesized
gaacaagtaaaaaataaaataa

SEQ ID NO: 1020386 - DNA, 22 bp, Artificial Sequence
  chemically synthesized
tcacaatcttattttatttttt

SEQ ID NO: 1020387 - DNA, 22 bp, Artificial Sequence
  chemically synthesized
cacaatcttattttatttttta

SEQ ID NO: 1020388 - DNA, 22 bp, Artificial Sequence
  chemically synthesized
acaatcttattttattttttac

SEQ ID NO: 1020389 - DNA, 22 bp, Artificial Sequence
  chemically synthesized
ccatcggactggaacaagtaaa

SEQ ID NO: 1020390 - DNA, 22 bp, Artificial Sequence
  chemically synthesized
attttattttttacttgttcca

SEQ ID NO: 1020391 - DNA, 22 bp, Artificial Sequence
  chemically synthesized
ttttattttttacttgttccag

SEQ ID NO: 1020392 - DNA, 22 bp, Artificial Sequence
  chemically synthesized
tattttttacttgttccagtcc

SEQ ID NO: 1020393 - DNA, 22 bp, Artificial Sequence
  chemically synthesized
attttttacttgttccagtccg

SEQ ID NO: 1020394 - DNA, 22 bp, Artificial Sequence
  chemically synthesized
ttttttacttgttccagtccga

SEQ ID NO: 1020395 - DNA, 22 bp, Artificial Sequence
  chemically synthesized
tttacttgttccagtccgatgg

SEQ ID NO: 1020396 - DNA, 22 bp, Artificial Sequence
  chemically synthesized
ttacttgttccagtccgatggg

SEQ ID NO: 1020397 - DNA, 22 bp, Artificial Sequence
  chemically synthesized
tacttgttccagtccgatggga

SEQ ID NO: 1020398 - DNA, 22 bp, Artificial Sequence
  chemically synthesized
acttgttccagtccgatgggag

SEQ ID NO: 1020399 - DNA, 22 bp, Artificial Sequence
  chemically synthesized
cttgttccagtccgatgggagt

SEQ ID NO: 1020400 - DNA, 22 bp, Artificial Sequence
  chemically synthesized
agtgagataacgtactcccatc

SEQ ID NO: 1020401 - DNA, 22 bp, Artificial Sequence
  chemically synthesized
gttccagtccgatgggagtacg

SEQ ID NO: 1020402 - DNA, 22 bp, Artificial Sequence
  chemically synthesized
ttccagtccgatgggagtacgt

SEQ ID NO: 1020403 - DNA, 22 bp, Artificial Sequence
  chemically synthesized
cagtccgatgggagtacgttat

SEQ ID NO: 1020404 - DNA, 22 bp, Artificial Sequence
  chemically synthesized
ccaaaccatatcgtactaagtg

SEQ ID NO: 1020405 - DNA, 22 bp, Artificial Sequence
  chemically synthesized
tctcacttagtacgatatggtt

SEQ ID NO: 1020406 - DNA, 22 bp, Artificial Sequence
  chemically synthesized
acttagtacgatatggtttggc

SEQ ID NO: 1020407 - DNA, 22 bp, Artificial Sequence
  chemically synthesized
ggtggggacactgccaaaccat

SEQ ID NO: 1020408 - DNA, 22 bp, Artificial Sequence
  chemically synthesized
gggtggggacactgccaaacca

SEQ ID NO: 1020409 - DNA, 22 bp, Artificial Sequence
  chemically synthesized
agtacgatatggtttggcagtg

SEQ ID NO: 1020410 - DNA, 22 bp, Artificial Sequence
  chemically synthesized
gtacgatatggtttggcagtgt

SEQ ID NO: 1020411 - DNA, 22 bp, Artificial Sequence
  chemically synthesized
aagatgagatttgggtggggac

SEQ ID NO: 1020412 - DNA, 22 bp, Artificial Sequence
  chemically synthesized
ggcagtgtccccacccaaatct

SEQ ID NO: 1020413 - DNA, 22 bp, Artificial Sequence
  chemically synthesized
gcagtgtccccacccaaatctc

SEQ ID NO: 1020414 - DNA, 22 bp, Artificial Sequence
  chemically synthesized
ccacaacatgtaggaattcaag

SEQ ID NO: 1020415 - DNA, 22 bp, Artificial Sequence
  chemically synthesized
cccacaacatgtaggaattcaa

SEQ ID NO: 1020416 - DNA, 22 bp, Artificial Sequence
  chemically synthesized
atcttgaattcctacatgttgt

SEQ ID NO: 1020417 - DNA, 22 bp, Artificial Sequence
  chemically synthesized
ccacgaggtccttcccacaaca

SEQ ID NO: 1020418 - DNA, 22 bp, Artificial Sequence
  chemically synthesized
gaattcctacatgttgtgggaa

SEQ ID NO: 1020419 - DNA, 22 bp, Artificial Sequence
  chemically synthesized
aattcctacatgttgtgggaag

SEQ ID NO: 1020420 - DNA, 22 bp, Artificial Sequence
  chemically synthesized
cctcccacgaggtccttcccac

SEQ ID NO: 1020421 - DNA, 22 bp, Artificial Sequence
  chemically synthesized
ctacatgttgtgggaaggacct

SEQ ID NO: 1020422 - DNA, 22 bp, Artificial Sequence
  chemically synthesized
aattacctcccacgaggtcctt

SEQ ID NO: 1020423 - DNA, 22 bp, Artificial Sequence
  chemically synthesized
catgttgtgggaaggacctcgt

SEQ ID NO: 1020424 - DNA, 22 bp, Artificial Sequence
  chemically synthesized
tgggaaggacctcgtgggaggt

SEQ ID NO: 1020425 - DNA, 22 bp, Artificial Sequence
  chemically synthesized
cccccatgattcaattacctcc

SEQ ID NO: 1020426 - DNA, 22 bp, Artificial Sequence
  chemically synthesized
gtgggaggtaattgaatcatgg

SEQ ID NO: 1020427 - DNA, 22 bp, Artificial Sequence
  chemically synthesized
aatcatgggggcaggtccttcc

SEQ ID NO: 1020428 - DNA, 22 bp, Artificial Sequence
  chemically synthesized
tcacgagaacagcatgggaagg

SEQ ID NO: 1020429 - DNA, 22 bp, Artificial Sequence
  chemically synthesized
ctatcacgagaacagcatggga

SEQ ID NO: 1020430 - DNA, 22 bp, Artificial Sequence
  chemically synthesized
actatcacgagaacagcatggg

SEQ ID NO: 1020431 - DNA, 22 bp, Artificial Sequence
  chemically synthesized
atttactatcacgagaacagca

SEQ ID NO: 1020432 - DNA, 22 bp, Artificial Sequence
  chemically synthesized
cccatgctgttctcgtgatagt

SEQ ID NO: 1020433 - DNA, 22 bp, Artificial Sequence
  chemically synthesized
ccatgctgttctcgtgatagta

SEQ ID NO: 1020434 - DNA, 22 bp, Artificial Sequence
  chemically synthesized
atgagactaatttactatcacg

SEQ ID NO: 1020435 - DNA, 22 bp, Artificial Sequence
  chemically synthesized
ttctcgtgatagtaaattagtc

SEQ ID NO: 1020436 - DNA, 22 bp, Artificial Sequence
  chemically synthesized
tcgtgatagtaaattagtctca

SEQ ID NO: 1020437 - DNA, 22 bp, Artificial Sequence
  chemically synthesized
gtgatagtaaattagtctcatg

SEQ ID NO: 1020438 - DNA, 22 bp, Artificial Sequence
  chemically synthesized
taaaaccatcagatctcatgag

SEQ ID NO: 1020439 - DNA, 22 bp, Artificial Sequence
  chemically synthesized
ataaaaccatcagatctcatga

SEQ ID NO: 1020440 - DNA, 22 bp, Artificial Sequence
  chemically synthesized
tataaaaccatcagatctcatg

SEQ ID NO: 1020441 - DNA, 22 bp, Artificial Sequence
  chemically synthesized
gtctcatgagatctgatggttt

SEQ ID NO: 1020442 - DNA, 22 bp, Artificial Sequence
  chemically synthesized
atgagatctgatggttttataa

SEQ ID NO: 1020443 - DNA, 22 bp, Artificial Sequence
  chemically synthesized
atggttttataaaggggacttt

SEQ ID NO: 1020444 - DNA, 22 bp, Artificial Sequence
  chemically synthesized
tataaaggggactttctttgcc

SEQ ID NO: 1020445 - DNA, 22 bp, Artificial Sequence
  chemically synthesized
ataaaggggactttctttgcct

SEQ ID NO: 1020446 - DNA, 22 bp, Artificial Sequence
  chemically synthesized
taaaggggactttctttgcctt

SEQ ID NO: 1020447 - DNA, 22 bp, Artificial Sequence
  chemically synthesized
catgaatggcagaaggcaaaga

SEQ ID NO: 1020448 - DNA, 22 bp, Artificial Sequence
  chemically synthesized
acatgaatggcagaaggcaaag

SEQ ID NO: 1020449 - DNA, 22 bp, Artificial Sequence
  chemically synthesized
tctttgccttctgccattcatg

SEQ ID NO: 1020450 - DNA, 22 bp, Artificial Sequence
  chemically synthesized
ctttgccttctgccattcatgt

SEQ ID NO: 1020451 - DNA, 22 bp, Artificial Sequence
  chemically synthesized
tttgccttctgccattcatgta

SEQ ID NO: 1020452 - DNA, 22 bp, Artificial Sequence
  chemically synthesized
tgccttctgccattcatgtaag

SEQ ID NO: 1020453 - DNA, 22 bp, Artificial Sequence
  chemically synthesized
gccttctgccattcatgtaaga

SEQ ID NO: 1020454 - DNA, 22 bp, Artificial Sequence
  chemically synthesized
ccttctgccattcatgtaagat

SEQ ID NO: 1020455 - DNA, 22 bp, Artificial Sequence
  chemically synthesized
ctgccattcatgtaagatgtga

SEQ ID NO: 1020456 - DNA, 22 bp, Artificial Sequence
  chemically synthesized
tgccattcatgtaagatgtgac

SEQ ID NO: 1020457 - DNA, 22 bp, Artificial Sequence
  chemically synthesized
ccattcatgtaagatgtgactt

SEQ ID NO: 1020458 - DNA, 22 bp, Artificial Sequence
  chemically synthesized
atgtaagatgtgacttgctcct

SEQ ID NO: 1020459 - DNA, 22 bp, Artificial Sequence
  chemically synthesized
gcagaaggcaaggaggagcaag

SEQ ID NO: 1020460 - DNA, 22 bp, Artificial Sequence
  chemically synthesized
ggcagaaggcaaggaggagcaa

SEQ ID NO: 1020461 - DNA, 22 bp, Artificial Sequence
  chemically synthesized
acaatcttggcagaaggcaagg

SEQ ID NO: 1020462 - DNA, 22 bp, Artificial Sequence
  chemically synthesized
gctcctccttgccttctgccaa

SEQ ID NO: 1020463 - DNA, 22 bp, Artificial Sequence
  chemically synthesized
ctcctccttgccttctgccaag

SEQ ID NO: 1020464 - DNA, 22 bp, Artificial Sequence
  chemically synthesized
ctccttgccttctgccaagatt

SEQ ID NO: 1020465 - DNA, 22 bp, Artificial Sequence
  chemically synthesized
gggaggcctcacaatcttggca

SEQ ID NO: 1020466 - DNA, 22 bp, Artificial Sequence
  chemically synthesized
cttgccttctgccaagattgtg

SEQ ID NO: 1020467 - DNA, 22 bp, Artificial Sequence
  chemically synthesized
gccttctgccaagattgtgagg

SEQ ID NO: 1020468 - DNA, 22 bp, Artificial Sequence
  chemically synthesized
ccttctgccaagattgtgaggc

SEQ ID NO: 1020469 - DNA, 22 bp, Artificial Sequence
  chemically synthesized
cacacagctggggaggcctcac

SEQ ID NO: 1020470 - DNA, 22 bp, Artificial Sequence
  chemically synthesized
ctgccaagattgtgaggcctcc

SEQ ID NO: 1020471 - DNA, 22 bp, Artificial Sequence
  chemically synthesized
tgccaagattgtgaggcctccc

SEQ ID NO: 1020472 - DNA, 22 bp, Artificial Sequence
  chemically synthesized
ccaagattgtgaggcctcccca

SEQ ID NO: 1020473 - DNA, 22 bp, Artificial Sequence
  chemically synthesized
cagttccacacagctggggagg

SEQ ID NO: 1020474 - DNA, 22 bp, Artificial Sequence
  chemically synthesized
acagttccacacagctggggag

SEQ ID NO: 1020475 - DNA, 22 bp, Artificial Sequence
  chemically synthesized
tgaggcctccccagctgtgtgg

SEQ ID NO: 1020476 - DNA, 22 bp, Artificial Sequence
  chemically synthesized
atggacttacagttccacacag

SEQ ID NO: 1020477 - DNA, 22 bp, Artificial Sequence
  chemically synthesized
aatggacttacagttccacaca

SEQ ID NO: 1020478 - DNA, 22 bp, Artificial Sequence
  chemically synthesized
cccagctgtgtggaactgtaag

SEQ ID NO: 1020479 - DNA, 22 bp, Artificial Sequence
  chemically synthesized
tgtggaactgtaagtccattaa

SEQ ID NO: 1020480 - DNA, 22 bp, Artificial Sequence
  chemically synthesized
tacaggaaaaaggatttaatgg

SEQ ID NO: 1020481 - DNA, 22 bp, Artificial Sequence
  chemically synthesized
atacaggaaaaaggatttaatg

SEQ ID NO: 1020482 - DNA, 22 bp, Artificial Sequence
  chemically synthesized
taagtccattaaatcctttttc

SEQ ID NO: 1020483 - DNA, 22 bp, Artificial Sequence
  chemically synthesized
ggtcatttatacaggaaaaagg

SEQ ID NO: 1020484 - DNA, 22 bp, Artificial Sequence
  chemically synthesized
aatcctttttcctgtataaatg

SEQ ID NO: 1020485 - DNA, 22 bp, Artificial Sequence
  chemically synthesized
tttcctgtataaatgacccagt

SEQ ID NO: 1020486 - DNA, 22 bp, Artificial Sequence
  chemically synthesized
ttcctgtataaatgacccagtc

SEQ ID NO: 1020487 - DNA, 22 bp, Artificial Sequence
  chemically synthesized
tcctgtataaatgacccagtct

SEQ ID NO: 1020488 - DNA, 22 bp, Artificial Sequence
  chemically synthesized
cctgtataaatgacccagtctc

SEQ ID NO: 1020489 - DNA, 22 bp, Artificial Sequence
  chemically synthesized
ctgtataaatgacccagtctca

SEQ ID NO: 1020490 - DNA, 22 bp, Artificial Sequence
  chemically synthesized
ataaagacatacatgagactgg

SEQ ID NO: 1020491 - DNA, 22 bp, Artificial Sequence
  chemically synthesized
tataaatgacccagtctcatgt

SEQ ID NO: 1020492 - DNA, 22 bp, Artificial Sequence
  chemically synthesized
ctgataaagacatacatgagac

SEQ ID NO: 1020493 - DNA, 22 bp, Artificial Sequence
  chemically synthesized
atgctgctgataaagacataca

SEQ ID NO: 1020494 - DNA, 22 bp, Artificial Sequence
  chemically synthesized
catgctgctgataaagacatac

SEQ ID NO: 1020495 - DNA, 22 bp, Artificial Sequence
  chemically synthesized
tcatgctgctgataaagacata

SEQ ID NO: 1020496 - DNA, 22 bp, Artificial Sequence
  chemically synthesized
gtcggttttcatgctgctgata

SEQ ID NO: 1020497 - DNA, 22 bp, Artificial Sequence
  chemically synthesized
atgtatgtctttatcagcagca

SEQ ID NO: 1020498 - DNA, 22 bp, Artificial Sequence
  chemically synthesized
atattagtcggttttcatgctg

SEQ ID NO: 1020499 - DNA, 22 bp, Artificial Sequence
  chemically synthesized
catattagtcggttttcatgct

SEQ ID NO: 1020500 - DNA, 22 bp, Artificial Sequence
  chemically synthesized
cttcatattagtcggttttcat

SEQ ID NO: 1020501 - DNA, 22 bp, Artificial Sequence
  chemically synthesized
tatcagcagcatgaaaaccgac

SEQ ID NO: 1020502 - DNA, 22 bp, Artificial Sequence
  chemically synthesized
atcagcagcatgaaaaccgact

SEQ ID NO: 1020503 - DNA, 22 bp, Artificial Sequence
  chemically synthesized
tcagcagcatgaaaaccgacta

SEQ ID NO: 1020504 - DNA, 22 bp, Artificial Sequence
  chemically synthesized
gaaaaattacttcatattagtc

SEQ ID NO: 1020505 - DNA, 22 bp, Artificial Sequence
  chemically synthesized
ttggaaaaattacttcatatta

SEQ ID NO: 1020506 - DNA, 22 bp, Artificial Sequence
  chemically synthesized
ttattggaaaaattacttcata

SEQ ID NO: 1020507 - DNA, 22 bp, Artificial Sequence
  chemically synthesized
attattggaaaaattacttcat

SEQ ID NO: 1020508 - DNA, 22 bp, Artificial Sequence
  chemically synthesized
atttattattggaaaaattact

SEQ ID NO: 1020509 - DNA, 22 bp, Artificial Sequence
  chemically synthesized
tcatttattattggaaaaatta

SEQ ID NO: 1020510 - DNA, 22 bp, Artificial Sequence
  chemically synthesized
atatgaagtaatttttccaata

SEQ ID NO: 1020511 - DNA, 22 bp, Artificial Sequence
  chemically synthesized
actctcatttattattggaaaa

SEQ ID NO: 1020512 - DNA, 22 bp, Artificial Sequence
  chemically synthesized
tgaatagatgctaactctcatt

SEQ ID NO: 1020513 - DNA, 22 bp, Artificial Sequence
  chemically synthesized
ttccaataataaatgagagtta

SEQ ID NO: 1020514 - DNA, 22 bp, Artificial Sequence
  chemically synthesized
atgaatagatgctaactctcat

SEQ ID NO: 1020515 - DNA, 22 bp, Artificial Sequence
  chemically synthesized
tccaataataaatgagagttag

SEQ ID NO: 1020516 - DNA, 22 bp, Artificial Sequence
  chemically synthesized
ccaataataaatgagagttagc

SEQ ID NO: 1020517 - DNA, 22 bp, Artificial Sequence
  chemically synthesized
caataataaatgagagttagca

SEQ ID NO: 1020518 - DNA, 22 bp, Artificial Sequence
  chemically synthesized
tatgtcaaatacacttatgaat

SEQ ID NO: 1020519 - DNA, 22 bp, Artificial Sequence
  chemically synthesized
gcatctattcataagtgtattt

SEQ ID NO: 1020520 - DNA, 22 bp, Artificial Sequence
  chemically synthesized
acagaacatctgtatgtcaaat

SEQ ID NO: 1020521 - DNA, 22 bp, Artificial Sequence
  chemically synthesized
ttcataagtgtatttgacatac

SEQ ID NO: 1020522 - DNA, 22 bp, Artificial Sequence
  chemically synthesized
ataagtgtatttgacatacaga

SEQ ID NO: 1020523 - DNA, 22 bp, Artificial Sequence
  chemically synthesized
gacatacagatgttctgtgaac

SEQ ID NO: 1020524 - DNA, 22 bp, Artificial Sequence
  chemically synthesized
acatacagatgttctgtgaact

SEQ ID NO: 1020525 - DNA, 22 bp, Artificial Sequence
  chemically synthesized
aaaaataatagacagttcacag

SEQ ID NO: 1020526 - DNA, 22 bp, Artificial Sequence
  chemically synthesized
aaaaaataatagacagttcaca

SEQ ID NO: 1020527 - DNA, 22 bp, Artificial Sequence
  chemically synthesized
aagtttaaaaaataatagacag

SEQ ID NO: 1020528 - DNA, 22 bp, Artificial Sequence
  chemically synthesized
aaagtttaaaaaataatagaca

SEQ ID NO: 1020529 - DNA, 22 bp, Artificial Sequence
  chemically synthesized
taaagtttaaaaaataatagac

SEQ ID NO: 1020530 - DNA, 22 bp, Artificial Sequence
  chemically synthesized
ttaaagtttaaaaaataataga

SEQ ID NO: 1020531 - DNA, 22 bp, Artificial Sequence
  chemically synthesized
tgtgaactgtctattatttttt

SEQ ID NO: 1020532 - DNA, 22 bp, Artificial Sequence
  chemically synthesized
tgaactgtctattattttttaa

SEQ ID NO: 1020533 - DNA, 22 bp, Artificial Sequence
  chemically synthesized
tctattattttttaaactttaa

SEQ ID NO: 1020534 - DNA, 22 bp, Artificial Sequence
  chemically synthesized
acaggaaaatatttttaaagtt

SEQ ID NO: 1020535 - DNA, 22 bp, Artificial Sequence
  chemically synthesized
ttattttttaaactttaaaaat

SEQ ID NO: 1020536 - DNA, 22 bp, Artificial Sequence
  chemically synthesized
ttttttaaactttaaaaatatt

SEQ ID NO: 1020537 - DNA, 22 bp, Artificial Sequence
  chemically synthesized
tttaaactttaaaaatattttc

SEQ ID NO: 1020538 - DNA, 22 bp, Artificial Sequence
  chemically synthesized
ttaaactttaaaaatattttcc

SEQ ID NO: 1020539 - DNA, 22 bp, Artificial Sequence
  chemically synthesized
taaactttaaaaatattttcct

SEQ ID NO: 1020540 - DNA, 22 bp, Artificial Sequence
  chemically synthesized
aaactttaaaaatattttcctg

SEQ ID NO: 1020541 - DNA, 22 bp, Artificial Sequence
  chemically synthesized
aactttaaaaatattttcctgt

SEQ ID NO: 1020542 - DNA, 22 bp, Artificial Sequence
  chemically synthesized
taaaaatattttcctgttaggt

SEQ ID NO: 1020543 - DNA, 22 bp, Artificial Sequence
  chemically synthesized
aaaaatattttcctgttaggtt

SEQ ID NO: 1020544 - DNA, 22 bp, Artificial Sequence
  chemically synthesized
aaaatattttcctgttaggtta

SEQ ID NO: 1020545 - DNA, 22 bp, Artificial Sequence
  chemically synthesized
tcaatagaacaaaataaaaata

SEQ ID NO: 1020546 - DNA, 22 bp, Artificial Sequence
  chemically synthesized
tcctgttaggttatttttattt

SEQ ID NO: 1020547 - DNA, 22 bp, Artificial Sequence
  chemically synthesized
cctgttaggttatttttatttt

SEQ ID NO: 1020548 - DNA, 22 bp, Artificial Sequence
  chemically synthesized
ctgttaggttatttttattttg

SEQ ID NO: 1020549 - DNA, 22 bp, Artificial Sequence
  chemically synthesized
cctatcaatagaacaaaataaa

SEQ ID NO: 1020550 - DNA, 22 bp, Artificial Sequence
  chemically synthesized
acctatcaatagaacaaaataa

SEQ ID NO: 1020551 - DNA, 22 bp, Artificial Sequence
  chemically synthesized
ttaggttatttttattttgttc

SEQ ID NO: 1020552 - DNA, 22 bp, Artificial Sequence
  chemically synthesized
ggttatttttattttgttctat

SEQ ID NO: 1020553 - DNA, 22 bp, Artificial Sequence
  chemically synthesized
tttttattttgttctattgata

SEQ ID NO: 1020554 - DNA, 22 bp, Artificial Sequence
  chemically synthesized
ttattttgttctattgataggt

SEQ ID NO: 1020555 - DNA, 22 bp, Artificial Sequence
  chemically synthesized
agaaaaatatttacctatcaat

SEQ ID NO: 1020556 - DNA, 22 bp, Artificial Sequence
  chemically synthesized
tattttgttctattgataggta

SEQ ID NO: 1020557 - DNA, 22 bp, Artificial Sequence
  chemically synthesized
aagaaaaatatttacctatcaa

SEQ ID NO: 1020558 - DNA, 22 bp, Artificial Sequence
  chemically synthesized
attttgttctattgataggtaa

SEQ ID NO: 1020559 - DNA, 22 bp, Artificial Sequence
  chemically synthesized
ttttgttctattgataggtaaa

SEQ ID NO: 1020560 - DNA, 22 bp, Artificial Sequence
  chemically synthesized
tgttctattgataggtaaatat

SEQ ID NO: 1020561 - DNA, 22 bp, Artificial Sequence
  chemically synthesized
gttctattgataggtaaatatt

SEQ ID NO: 1020562 - DNA, 22 bp, Artificial Sequence
  chemically synthesized
ttctattgataggtaaatattt

SEQ ID NO: 1020563 - DNA, 22 bp, Artificial Sequence
  chemically synthesized
tattgataggtaaatatttttc

SEQ ID NO: 1020564 - DNA, 22 bp, Artificial Sequence
  chemically synthesized
tgtcataatttaagaaaaatat

SEQ ID NO: 1020565 - DNA, 22 bp, Artificial Sequence
  chemically synthesized
ttgataggtaaatatttttctt

SEQ ID NO: 1020566 - DNA, 22 bp, Artificial Sequence
  chemically synthesized
atgtcataatttaagaaaaata

SEQ ID NO: 1020567 - DNA, 22 bp, Artificial Sequence
  chemically synthesized
ataggtaaatatttttcttaaa

SEQ ID NO: 1020568 - DNA, 22 bp, Artificial Sequence
  chemically synthesized
aaacaataaaggatttatgtca

SEQ ID NO: 1020569 - DNA, 22 bp, Artificial Sequence
  chemically synthesized
ttcttaaattatgacataaatc

SEQ ID NO: 1020570 - DNA, 22 bp, Artificial Sequence
  chemically synthesized
tcttaaattatgacataaatcc

SEQ ID NO: 1020571 - DNA, 22 bp, Artificial Sequence
  chemically synthesized
cttaaattatgacataaatcct

SEQ ID NO: 1020572 - DNA, 22 bp, Artificial Sequence
  chemically synthesized
ttaaattatgacataaatcctt

SEQ ID NO: 1020573 - DNA, 22 bp, Artificial Sequence
  chemically synthesized
aaattatgacataaatccttta

SEQ ID NO: 1020574 - DNA, 22 bp, Artificial Sequence
  chemically synthesized
aattatgacataaatcctttat

SEQ ID NO: 1020575 - DNA, 22 bp, Artificial Sequence
  chemically synthesized
caatactaaaacaataaaggat

SEQ ID NO: 1020576 - DNA, 22 bp, Artificial Sequence
  chemically synthesized
gcaatactaaaacaataaagga

SEQ ID NO: 1020577 - DNA, 22 bp, Artificial Sequence
  chemically synthesized
tgacataaatcctttattgttt

SEQ ID NO: 1020578 - DNA, 22 bp, Artificial Sequence
  chemically synthesized
agatagtatatttgcaatacta

SEQ ID NO: 1020579 - DNA, 22 bp, Artificial Sequence
  chemically synthesized
tattgttttagtattgcaaata

SEQ ID NO: 1020580 - DNA, 22 bp, Artificial Sequence
  chemically synthesized
attgttttagtattgcaaatat

SEQ ID NO: 1020581 - DNA, 22 bp, Artificial Sequence
  chemically synthesized
ttgttttagtattgcaaatata

SEQ ID NO: 1020582 - DNA, 22 bp, Artificial Sequence
  chemically synthesized
ttttagtattgcaaatatacta

SEQ ID NO: 1020583 - DNA, 22 bp, Artificial Sequence
  chemically synthesized
tagtattgcaaatatactatct

SEQ ID NO: 1020584 - DNA, 22 bp, Artificial Sequence
  chemically synthesized
agtattgcaaatatactatctg

SEQ ID NO: 1020585 - DNA, 22 bp, Artificial Sequence
  chemically synthesized
gtattgcaaatatactatctga

SEQ ID NO: 1020586 - DNA, 22 bp, Artificial Sequence
  chemically synthesized
caaatatactatctgagcctat

SEQ ID NO: 1020587 - DNA, 22 bp, Artificial Sequence
  chemically synthesized
ataaacaaagaaaagacatagg

SEQ ID NO: 1020588 - DNA, 22 bp, Artificial Sequence
  chemically synthesized
cataaacaaagaaaagacatag

SEQ ID NO: 1020589 - DNA, 22 bp, Artificial Sequence
  chemically synthesized
tctgagcctatgtcttttcttt

SEQ ID NO: 1020590 - DNA, 22 bp, Artificial Sequence
  chemically synthesized
agcctatgtcttttctttgttt

SEQ ID NO: 1020591 - DNA, 22 bp, Artificial Sequence
  chemically synthesized
tgtcttttctttgtttatgaag

SEQ ID NO: 1020592 - DNA, 22 bp, Artificial Sequence
  chemically synthesized
tacaatgcaaagacttcataaa

SEQ ID NO: 1020593 - DNA, 22 bp, Artificial Sequence
  chemically synthesized
ttctttgtttatgaagtctttg

SEQ ID NO: 1020594 - DNA, 22 bp, Artificial Sequence
  chemically synthesized
tctttgtttatgaagtctttgc

SEQ ID NO: 1020595 - DNA, 22 bp, Artificial Sequence
  chemically synthesized
ctttgtttatgaagtctttgca

SEQ ID NO: 1020596 - DNA, 22 bp, Artificial Sequence
  chemically synthesized
tttgtttatgaagtctttgcat

SEQ ID NO: 1020597 - DNA, 22 bp, Artificial Sequence
  chemically synthesized
aaaacctgtacaatgcaaagac

SEQ ID NO: 1020598 - DNA, 22 bp, Artificial Sequence
  chemically synthesized
tgtttatgaagtctttgcattg

SEQ ID NO: 1020599 - DNA, 22 bp, Artificial Sequence
  chemically synthesized
gtttatgaagtctttgcattgt

SEQ ID NO: 1020600 - DNA, 22 bp, Artificial Sequence
  chemically synthesized
tttatgaagtctttgcattgta

SEQ ID NO: 1020601 - DNA, 22 bp, Artificial Sequence
  chemically synthesized
attaaaaacctgtacaatgcaa

SEQ ID NO: 1020602 - DNA, 22 bp, Artificial Sequence
  chemically synthesized
aattaaaaacctgtacaatgca

SEQ ID NO: 1020603 - DNA, 22 bp, Artificial Sequence
  chemically synthesized
taattaaaaacctgtacaatgc

SEQ ID NO: 1020604 - DNA, 22 bp, Artificial Sequence
  chemically synthesized
atgaagtctttgcattgtacag

SEQ ID NO: 1020605 - DNA, 22 bp, Artificial Sequence
  chemically synthesized
tgaagtctttgcattgtacagg

SEQ ID NO: 1020606 - DNA, 22 bp, Artificial Sequence
  chemically synthesized
atcattttaattaaaaacctgt

SEQ ID NO: 1020607 - DNA, 22 bp, Artificial Sequence
  chemically synthesized
gatcattttaattaaaaacctg

SEQ ID NO: 1020608 - DNA, 22 bp, Artificial Sequence
  chemically synthesized
tgcattgtacaggtttttaatt

SEQ ID NO: 1020609 - DNA, 22 bp, Artificial Sequence
  chemically synthesized
gcattgtacaggtttttaatta

SEQ ID NO: 1020610 - DNA, 22 bp, Artificial Sequence
  chemically synthesized
cattgtacaggtttttaattaa

SEQ ID NO: 1020611 - DNA, 22 bp, Artificial Sequence
  chemically synthesized
tacaggtttttaattaaaatga

SEQ ID NO: 1020612 - DNA, 22 bp, Artificial Sequence
  chemically synthesized
ttaattaaaatgatcaaatata

SEQ ID NO: 1020613 - DNA, 22 bp, Artificial Sequence
  chemically synthesized
taattaaaatgatcaaatatat

SEQ ID NO: 1020614 - DNA, 22 bp, Artificial Sequence
  chemically synthesized
aattaaaatgatcaaatatatg

SEQ ID NO: 1020615 - DNA, 22 bp, Artificial Sequence
  chemically synthesized
taaagaaaaagacatatatttg

SEQ ID NO: 1020616 - DNA, 22 bp, Artificial Sequence
  chemically synthesized
attaaaatgatcaaatatatgt

SEQ ID NO: 1020617 - DNA, 22 bp, Artificial Sequence
  chemically synthesized
aaatgatcaaatatatgtcttt

SEQ ID NO: 1020618 - DNA, 22 bp, Artificial Sequence
  chemically synthesized
agcaacagcacaaagcaaaaat

SEQ ID NO: 1020619 - DNA, 22 bp, Artificial Sequence
  chemically synthesized
aagcaacagcacaaagcaaaaa

SEQ ID NO: 1020620 - DNA, 22 bp, Artificial Sequence
  chemically synthesized
tttctttacaatttttgctttg

SEQ ID NO: 1020621 - DNA, 22 bp, Artificial Sequence
  chemically synthesized
ttctttacaatttttgctttgt

SEQ ID NO: 1020622 - DNA, 22 bp, Artificial Sequence
  chemically synthesized
tctttacaatttttgctttgtg

SEQ ID NO: 1020623 - DNA, 22 bp, Artificial Sequence
  chemically synthesized
ctttacaatttttgctttgtgc

SEQ ID NO: 1020624 - DNA, 22 bp, Artificial Sequence
  chemically synthesized
tttacaatttttgctttgtgct

SEQ ID NO: 1020625 - DNA, 22 bp, Artificial Sequence
  chemically synthesized
tacaatttttgctttgtgctgt

SEQ ID NO: 1020626 - DNA, 22 bp, Artificial Sequence
  chemically synthesized
acaatttttgctttgtgctgtt

SEQ ID NO: 1020627 - DNA, 22 bp, Artificial Sequence
  chemically synthesized
caatttttgctttgtgctgttg

SEQ ID NO: 1020628 - DNA, 22 bp, Artificial Sequence
  chemically synthesized
ttgctttgtgctgttgcttaag

SEQ ID NO: 1020629 - DNA, 22 bp, Artificial Sequence
  chemically synthesized
tgctttgtgctgttgcttaagg

SEQ ID NO: 1020630 - DNA, 22 bp, Artificial Sequence
  chemically synthesized
gctttgtgctgttgcttaaggg

SEQ ID NO: 1020631 - DNA, 22 bp, Artificial Sequence
  chemically synthesized
ctttgtgctgttgcttaaggga

SEQ ID NO: 1020632 - DNA, 22 bp, Artificial Sequence
  chemically synthesized
tgtgctgttgcttaagggacac

SEQ ID NO: 1020633 - DNA, 22 bp, Artificial Sequence
  chemically synthesized
gtgctgttgcttaagggacacc

SEQ ID NO: 1020634 - DNA, 22 bp, Artificial Sequence
  chemically synthesized
tgctgttgcttaagggacacct

SEQ ID NO: 1020635 - DNA, 22 bp, Artificial Sequence
  chemically synthesized
ttgcttaagggacacctctttt

SEQ ID NO: 1020636 - DNA, 22 bp, Artificial Sequence
  chemically synthesized
gggcatgtagggcaaaagaggt

SEQ ID NO: 1020637 - DNA, 22 bp, Artificial Sequence
  chemically synthesized
ggggcatgtagggcaaaagagg

SEQ ID NO: 1020638 - DNA, 22 bp, Artificial Sequence
  chemically synthesized
cttaagggacacctcttttgcc

SEQ ID NO: 1020639 - DNA, 22 bp, Artificial Sequence
  chemically synthesized
tggggcatgtagggcaaaagag

SEQ ID NO: 1020640 - DNA, 22 bp, Artificial Sequence
  chemically synthesized
aagggacacctcttttgcccta

SEQ ID NO: 1020641 - DNA, 22 bp, Artificial Sequence
  chemically synthesized
agggacacctcttttgccctac

SEQ ID NO: 1020642 - DNA, 22 bp, Artificial Sequence
  chemically synthesized
ttttgccctacatgccccaaaa

SEQ ID NO: 1020643 - DNA, 22 bp, Artificial Sequence
  chemically synthesized
ttgccctacatgccccaaaata

SEQ ID NO: 1020644 - DNA, 22 bp, Artificial Sequence
  chemically synthesized
tgccctacatgccccaaaatat

SEQ ID NO: 1020645 - DNA, 22 bp, Artificial Sequence
  chemically synthesized
aaatatataaaaatattttggg

SEQ ID NO: 1020646 - DNA, 22 bp, Artificial Sequence
  chemically synthesized
gccctacatgccccaaaatatt

SEQ ID NO: 1020647 - DNA, 22 bp, Artificial Sequence
  chemically synthesized
ccctacatgccccaaaatattt

SEQ ID NO: 1020648 - DNA, 22 bp, Artificial Sequence
  chemically synthesized
catgccccaaaatatttttata

SEQ ID NO: 1020649 - DNA, 22 bp, Artificial Sequence
  chemically synthesized
aacatgaaaggcaaagcattaa

SEQ ID NO: 1020650 - DNA, 22 bp, Artificial Sequence
  chemically synthesized
ttatatattttaatgctttgcc

SEQ ID NO: 1020651 - DNA, 22 bp, Artificial Sequence
  chemically synthesized
tatatattttaatgctttgcct

SEQ ID NO: 1020652 - DNA, 22 bp, Artificial Sequence
  chemically synthesized
cctaaacatgaaaggcaaagca

SEQ ID NO: 1020653 - DNA, 22 bp, Artificial Sequence
  chemically synthesized
atatattttaatgctttgcctt

SEQ ID NO: 1020654 - DNA, 22 bp, Artificial Sequence
  chemically synthesized
tatattttaatgctttgccttt

SEQ ID NO: 1020655 - DNA, 22 bp, Artificial Sequence
  chemically synthesized
atggattgcctaaacatgaaag

SEQ ID NO: 1020656 - DNA, 22 bp, Artificial Sequence
  chemically synthesized
taatgctttgcctttcatgttt

SEQ ID NO: 1020657 - DNA, 22 bp, Artificial Sequence
  chemically synthesized
aatgctttgcctttcatgttta

SEQ ID NO: 1020658 - DNA, 22 bp, Artificial Sequence
  chemically synthesized
atgctttgcctttcatgtttag

SEQ ID NO: 1020659 - DNA, 22 bp, Artificial Sequence
  chemically synthesized
tgcctttcatgtttaggcaatc

SEQ ID NO: 1020660 - DNA, 22 bp, Artificial Sequence
  chemically synthesized
gcctttcatgtttaggcaatcc

SEQ ID NO: 1020661 - DNA, 22 bp, Artificial Sequence
  chemically synthesized
cctttcatgtttaggcaatcca

SEQ ID NO: 1020662 - DNA, 22 bp, Artificial Sequence
  chemically synthesized
tcatgtttaggcaatccatcaa

SEQ ID NO: 1020663 - DNA, 22 bp, Artificial Sequence
  chemically synthesized
catgtttaggcaatccatcaat

SEQ ID NO: 1020664 - DNA, 22 bp, Artificial Sequence
  chemically synthesized
atgtttaggcaatccatcaatt

SEQ ID NO: 1020665 - DNA, 22 bp, Artificial Sequence
  chemically synthesized
aggcaatccatcaatttaccat

SEQ ID NO: 1020666 - DNA, 22 bp, Artificial Sequence
  chemically synthesized
ggcaatccatcaatttaccatt

SEQ ID NO: 1020667 - DNA, 22 bp, Artificial Sequence
  chemically synthesized
tacataaacataaaaatggtaa

SEQ ID NO: 1020668 - DNA, 22 bp, Artificial Sequence
  chemically synthesized
acactgtacataaacataaaaa

SEQ ID NO: 1020669 - DNA, 22 bp, Artificial Sequence
  chemically synthesized
tctcacactgtacataaacata

SEQ ID NO: 1020670 - DNA, 22 bp, Artificial Sequence
  chemically synthesized
accatttttatgtttatgtaca

SEQ ID NO: 1020671 - DNA, 22 bp, Artificial Sequence
  chemically synthesized
ccatttttatgtttatgtacag

SEQ ID NO: 1020672 - DNA, 22 bp, Artificial Sequence
  chemically synthesized
gatccctatctcacactgtaca

SEQ ID NO: 1020673 - DNA, 22 bp, Artificial Sequence
  chemically synthesized
ttatgtttatgtacagtgtgag

SEQ ID NO: 1020674 - DNA, 22 bp, Artificial Sequence
  chemically synthesized
tatgtttatgtacagtgtgaga

SEQ ID NO: 1020675 - DNA, 22 bp, Artificial Sequence
  chemically synthesized
atgtttatgtacagtgtgagat

SEQ ID NO: 1020676 - DNA, 22 bp, Artificial Sequence
  chemically synthesized
tgtttatgtacagtgtgagata

SEQ ID NO: 1020677 - DNA, 22 bp, Artificial Sequence
  chemically synthesized
atgtacagtgtgagatagggat

SEQ ID NO: 1020678 - DNA, 22 bp, Artificial Sequence
  chemically synthesized
tgtacagtgtgagatagggatc

SEQ ID NO: 1020679 - DNA, 22 bp, Artificial Sequence
  chemically synthesized
aacataagaattagatccctat

SEQ ID NO: 1020680 - DNA, 22 bp, Artificial Sequence
  chemically synthesized
ttaaacataagaattagatccc

SEQ ID NO: 1020681 - DNA, 22 bp, Artificial Sequence
  chemically synthesized
attaaacataagaattagatcc

SEQ ID NO: 1020682 - DNA, 22 bp, Artificial Sequence
  chemically synthesized
tattaaacataagaattagatc

SEQ ID NO: 1020683 - DNA, 22 bp, Artificial Sequence
  chemically synthesized
aaattttattaaacataagaat

SEQ ID NO: 1020684 - DNA, 22 bp, Artificial Sequence
  chemically synthesized
aaaattttattaaacataagaa

SEQ ID NO: 1020685 - DNA, 22 bp, Artificial Sequence
  chemically synthesized
attcttatgtttaataaaattt

SEQ ID NO: 1020686 - DNA, 22 bp, Artificial Sequence
  chemically synthesized
ttatgtttaataaaattttaaa

SEQ ID NO: 1020687 - DNA, 22 bp, Artificial Sequence
  chemically synthesized
atgtttaataaaattttaaatg

SEQ ID NO: 1020688 - DNA, 22 bp, Artificial Sequence
  chemically synthesized
tgtttaataaaattttaaatgg

SEQ ID NO: 1020689 - DNA, 22 bp, Artificial Sequence
  chemically synthesized
aataaaattttaaatggtactt

SEQ ID NO: 1020690 - DNA, 22 bp, Artificial Sequence
  chemically synthesized
ataaaattttaaatggtacttc

SEQ ID NO: 1020691 - DNA, 22 bp, Artificial Sequence
  chemically synthesized
taaatggtacttctgtctgtca

SEQ ID NO: 1020692 - DNA, 22 bp, Artificial Sequence
  chemically synthesized
aaatggtacttctgtctgtcat

SEQ ID NO: 1020693 - DNA, 22 bp, Artificial Sequence
  chemically synthesized
aatggtacttctgtctgtcata

SEQ ID NO: 1020694 - DNA, 22 bp, Artificial Sequence
  chemically synthesized
ctgtctgtcatacatgtcatat

SEQ ID NO: 1020695 - DNA, 22 bp, Artificial Sequence
  chemically synthesized
tgtctgtcatacatgtcatata

SEQ ID NO: 1020696 - DNA, 22 bp, Artificial Sequence
  chemically synthesized
tgtaagagtataatatatgaca

SEQ ID NO: 1020697 - DNA, 22 bp, Artificial Sequence
  chemically synthesized
tctgtcatacatgtcatatatt

SEQ ID NO: 1020698 - DNA, 22 bp, Artificial Sequence
  chemically synthesized
ttgtgtaagagtataatatatg

SEQ ID NO: 1020699 - DNA, 22 bp, Artificial Sequence
  chemically synthesized
attgtgtaagagtataatatat

SEQ ID NO: 1020700 - DNA, 22 bp, Artificial Sequence
  chemically synthesized
tcatacatgtcatatattatac

SEQ ID NO: 1020701 - DNA, 22 bp, Artificial Sequence
  chemically synthesized
ttattgtgtaagagtataatat

SEQ ID NO: 1020702 - DNA, 22 bp, Artificial Sequence
  chemically synthesized
agaggtggtattcttattgtgt

SEQ ID NO: 1020703 - DNA, 22 bp, Artificial Sequence
  chemically synthesized
tactcttacacaataagaatac

SEQ ID NO: 1020704 - DNA, 22 bp, Artificial Sequence
  chemically synthesized
ttacacaataagaataccacct

SEQ ID NO: 1020705 - DNA, 22 bp, Artificial Sequence
  chemically synthesized
gaatgtattgagaggtggtatt

SEQ ID NO: 1020706 - DNA, 22 bp, Artificial Sequence
  chemically synthesized
acacaataagaataccacctct

SEQ ID NO: 1020707 - DNA, 22 bp, Artificial Sequence
  chemically synthesized
cacaataagaataccacctctc

SEQ ID NO: 1020708 - DNA, 22 bp, Artificial Sequence
  chemically synthesized
atgtattcgaatgtattgagag

SEQ ID NO: 1020709 - DNA, 22 bp, Artificial Sequence
  chemically synthesized
tcaatacattcgaatacattag

SEQ ID NO: 1020710 - DNA, 22 bp, Artificial Sequence
  chemically synthesized
aatacattcgaatacattagat

SEQ ID NO: 1020711 - DNA, 22 bp, Artificial Sequence
  chemically synthesized
ccaagaaaaaaaaaatctaatg

SEQ ID NO: 1020712 - DNA, 22 bp, Artificial Sequence
  chemically synthesized
ttaccaagaaaaaaaaaatcta

SEQ ID NO: 1020713 - DNA, 22 bp, Artificial Sequence
  chemically synthesized
gttaccaagaaaaaaaaaatct

SEQ ID NO: 1020714 - DNA, 22 bp, Artificial Sequence
  chemically synthesized
tgttaccaagaaaaaaaaaatc

SEQ ID NO: 1020715 - DNA, 22 bp, Artificial Sequence
  chemically synthesized
gaatacattagatttttttttt

SEQ ID NO: 1020716 - DNA, 22 bp, Artificial Sequence
  chemically synthesized
caggaattttgttaccaagaaa

SEQ ID NO: 1020717 - DNA, 22 bp, Artificial Sequence
  chemically synthesized
gattttttttttcttggtaaca

SEQ ID NO: 1020718 - DNA, 22 bp, Artificial Sequence
  chemically synthesized
tttttttcttggtaacaaaatt

SEQ ID NO: 1020719 - DNA, 22 bp, Artificial Sequence
  chemically synthesized
ttttttcttggtaacaaaattc

SEQ ID NO: 1020720 - DNA, 22 bp, Artificial Sequence
  chemically synthesized
tttttcttggtaacaaaattcc

SEQ ID NO: 1020721 - DNA, 22 bp, Artificial Sequence
  chemically synthesized
ttttcttggtaacaaaattcct

SEQ ID NO: 1020722 - DNA, 22 bp, Artificial Sequence
  chemically synthesized
tttcttggtaacaaaattcctg

SEQ ID NO: 1020723 - DNA, 22 bp, Artificial Sequence
  chemically synthesized
ttcttggtaacaaaattcctgg

SEQ ID NO: 1020724 - DNA, 22 bp, Artificial Sequence
  chemically synthesized
tcttggtaacaaaattcctgga

SEQ ID NO: 1020725 - DNA, 22 bp, Artificial Sequence
  chemically synthesized
cttggtaacaaaattcctggag

SEQ ID NO: 1020726 - DNA, 22 bp, Artificial Sequence
  chemically synthesized
ttggtaacaaaattcctggagc

SEQ ID NO: 1020727 - DNA, 22 bp, Artificial Sequence
  chemically synthesized
ggtaacaaaattcctggagcac

SEQ ID NO: 1020728 - DNA, 22 bp, Artificial Sequence
  chemically synthesized
gagaagaaaatagtgctccagg

SEQ ID NO: 1020729 - DNA, 22 bp, Artificial Sequence
  chemically synthesized
gtaacaaaattcctggagcact

SEQ ID NO: 1020730 - DNA, 22 bp, Artificial Sequence
  chemically synthesized
tacagattggagaagaaaatag

SEQ ID NO: 1020731 - DNA, 22 bp, Artificial Sequence
  chemically synthesized
ctggagcactattttcttctcc

SEQ ID NO: 1020732 - DNA, 22 bp, Artificial Sequence
  chemically synthesized
gagcactattttcttctccaat

SEQ ID NO: 1020733 - DNA, 22 bp, Artificial Sequence
  chemically synthesized
tagagagaaacctgtacagatt

SEQ ID NO: 1020734 - DNA, 22 bp, Artificial Sequence
  chemically synthesized
ttttcttctccaatctgtacag

SEQ ID NO: 1020735 - DNA, 22 bp, Artificial Sequence
  chemically synthesized
tcttctccaatctgtacaggtt

SEQ ID NO: 1020736 - DNA, 22 bp, Artificial Sequence
  chemically synthesized
cttctccaatctgtacaggttt

SEQ ID NO: 1020737 - DNA, 22 bp, Artificial Sequence
  chemically synthesized
ttctccaatctgtacaggtttc

SEQ ID NO: 1020738 - DNA, 22 bp, Artificial Sequence
  chemically synthesized
ctccaatctgtacaggtttctc

SEQ ID NO: 1020739 - DNA, 22 bp, Artificial Sequence
  chemically synthesized
tccaatctgtacaggtttctct

SEQ ID NO: 1020740 - DNA, 22 bp, Artificial Sequence
  chemically synthesized
caatctgtacaggtttctctct

SEQ ID NO: 1020741 - DNA, 22 bp, Artificial Sequence
  chemically synthesized
tataacagttgtagagagaaac

SEQ ID NO: 1020742 - DNA, 22 bp, Artificial Sequence
  chemically synthesized
tacaggtttctctctacaactg

SEQ ID NO: 1020743 - DNA, 22 bp, Artificial Sequence
  chemically synthesized
taacaacagctgtataacagtt

SEQ ID NO: 1020744 - DNA, 22 bp, Artificial Sequence
  chemically synthesized
ctctctacaactgttatacagc

SEQ ID NO: 1020745 - DNA, 22 bp, Artificial Sequence
  chemically synthesized
tctctacaactgttatacagct

SEQ ID NO: 1020746 - DNA, 22 bp, Artificial Sequence
  chemically synthesized
tctacaactgttatacagctgt

SEQ ID NO: 1020747 - DNA, 22 bp, Artificial Sequence
  chemically synthesized
tacaactgttatacagctgttg

SEQ ID NO: 1020748 - DNA, 22 bp, Artificial Sequence
  chemically synthesized
caactgttatacagctgttgtt

SEQ ID NO: 1020749 - DNA, 22 bp, Artificial Sequence
  chemically synthesized
ttatacagctgttgttacagga

SEQ ID NO: 1020750 - DNA, 22 bp, Artificial Sequence
  chemically synthesized
tacagctgttgttacaggatct

SEQ ID NO: 1020751 - DNA, 22 bp, Artificial Sequence
  chemically synthesized
ttgttacaggatctcctccacc

SEQ ID NO: 1020752 - DNA, 22 bp, Artificial Sequence
  chemically synthesized
ttacaggatctcctccaccatc

SEQ ID NO: 1020753 - DNA, 22 bp, Artificial Sequence
  chemically synthesized
caggatctcctccaccatcttt

SEQ ID NO: 1020754 - DNA, 22 bp, Artificial Sequence
  chemically synthesized
ctccaccatctttctggcacca

SEQ ID NO: 1020755 - DNA, 22 bp, Artificial Sequence
  chemically synthesized
caccatctttctggcaccactt

SEQ ID NO: 1020756 - DNA, 22 bp, Artificial Sequence
  chemically synthesized
tctggcaccactttgcatcttc

SEQ ID NO: 1020757 - DNA, 22 bp, Artificial Sequence
  chemically synthesized
ctggcaccactttgcatcttcc

SEQ ID NO: 1020758 - DNA, 22 bp, Artificial Sequence
  chemically synthesized
tggcaccactttgcatcttcct

SEQ ID NO: 1020759 - DNA, 22 bp, Artificial Sequence
  chemically synthesized
gcaccactttgcatcttcctcc

SEQ ID NO: 1020760 - DNA, 22 bp, Artificial Sequence
  chemically synthesized
tgcatcttcctcccacgttggg

SEQ ID NO: 1020761 - DNA, 22 bp, Artificial Sequence
  chemically synthesized
gcatcttcctcccacgttgggt

SEQ ID NO: 1020762 - DNA, 22 bp, Artificial Sequence
  chemically synthesized
catcttcctcccacgttgggtt

SEQ ID NO: 1020763 - DNA, 22 bp, Artificial Sequence
  chemically synthesized
ggatccggaaaacagagaaccc

SEQ ID NO: 1020764 - DNA, 22 bp, Artificial Sequence
  chemically synthesized
cctcccacgttgggttctctgt

SEQ ID NO: 1020765 - DNA, 22 bp, Artificial Sequence
  chemically synthesized
ctcccacgttgggttctctgtt

SEQ ID NO: 1020766 - DNA, 22 bp, Artificial Sequence
  chemically synthesized
ccacgttgggttctctgttttc

SEQ ID NO: 1020767 - DNA, 22 bp, Artificial Sequence
  chemically synthesized
caaagcctaggatccggaaaac

SEQ ID NO: 1020768 - DNA, 22 bp, Artificial Sequence
  chemically synthesized
ggttctctgttttccggatcct

SEQ ID NO: 1020769 - DNA, 22 bp, Artificial Sequence
  chemically synthesized
cctgcaaagcctaggatccgga

SEQ ID NO: 1020770 - DNA, 22 bp, Artificial Sequence
  chemically synthesized
tctgttttccggatcctaggct

SEQ ID NO: 1020771 - DNA, 22 bp, Artificial Sequence
  chemically synthesized
gtattacctgcaaagcctagga

SEQ ID NO: 1020772 - DNA, 22 bp, Artificial Sequence
  chemically synthesized
tgttttccggatcctaggcttt

SEQ ID NO: 1020773 - DNA, 22 bp, Artificial Sequence
  chemically synthesized
ttttccggatcctaggctttgc

SEQ ID NO: 1020774 - DNA, 22 bp, Artificial Sequence
  chemically synthesized
tccggatcctaggctttgcagg

SEQ ID NO: 1020775 - DNA, 22 bp, Artificial Sequence
  chemically synthesized
ccggatcctaggctttgcaggt

SEQ ID NO: 1020776 - DNA, 22 bp, Artificial Sequence
  chemically synthesized
cggatcctaggctttgcaggta

SEQ ID NO: 1020777 - DNA, 22 bp, Artificial Sequence
  chemically synthesized
gagcattagtattacctgcaaa

SEQ ID NO: 1020778 - DNA, 22 bp, Artificial Sequence
  chemically synthesized
ggctttgcaggtaatactaatg

SEQ ID NO: 1020779 - DNA, 22 bp, Artificial Sequence
  chemically synthesized
ggaaaatattggagcattagta

SEQ ID NO: 1020780 - DNA, 22 bp, Artificial Sequence
  chemically synthesized
tgcaggtaatactaatgctcca

SEQ ID NO: 1020781 - DNA, 22 bp, Artificial Sequence
  chemically synthesized
gcaggtaatactaatgctccaa

SEQ ID NO: 1020782 - DNA, 22 bp, Artificial Sequence
  chemically synthesized
caggtaatactaatgctccaat

SEQ ID NO: 1020783 - DNA, 22 bp, Artificial Sequence
  chemically synthesized
atgctccaatattttcctaatt

SEQ ID NO: 1020784 - DNA, 22 bp, Artificial Sequence
  chemically synthesized
agagaggtaagagaattaggaa

SEQ ID NO: 1020785 - DNA, 22 bp, Artificial Sequence
  chemically synthesized
aagagaggtaagagaattagga

SEQ ID NO: 1020786 - DNA, 22 bp, Artificial Sequence
  chemically synthesized
taagagaggtaagagaattagg

SEQ ID NO: 1020787 - DNA, 22 bp, Artificial Sequence
  chemically synthesized
ttaagagaggtaagagaattag

SEQ ID NO: 1020788 - DNA, 22 bp, Artificial Sequence
  chemically synthesized
caatattttcctaattctctta

SEQ ID NO: 1020789 - DNA, 22 bp, Artificial Sequence
  chemically synthesized
atatttttaagagaggtaagag

SEQ ID NO: 1020790 - DNA, 22 bp, Artificial Sequence
  chemically synthesized
tcctaattctcttacctctctt

SEQ ID NO: 1020791 - DNA, 22 bp, Artificial Sequence
  chemically synthesized
cctaattctcttacctctctta

SEQ ID NO: 1020792 - DNA, 22 bp, Artificial Sequence
  chemically synthesized
ctaattctcttacctctcttaa

SEQ ID NO: 1020793 - DNA, 22 bp, Artificial Sequence
  chemically synthesized
attctcttacctctcttaaaaa

SEQ ID NO: 1020794 - DNA, 22 bp, Artificial Sequence
  chemically synthesized
taatcactaatatttttaagag

SEQ ID NO: 1020795 - DNA, 22 bp, Artificial Sequence
  chemically synthesized
tcttacctctcttaaaaatatt

SEQ ID NO: 1020796 - DNA, 22 bp, Artificial Sequence
  chemically synthesized
ttacctctcttaaaaatattag

SEQ ID NO: 1020797 - DNA, 22 bp, Artificial Sequence
  chemically synthesized
acctctcttaaaaatattagtg

SEQ ID NO: 1020798 - DNA, 22 bp, Artificial Sequence
  chemically synthesized
cctctcttaaaaatattagtga

SEQ ID NO: 1020799 - DNA, 22 bp, Artificial Sequence
  chemically synthesized
tcttaaaaatattagtgattat

SEQ ID NO: 1020800 - DNA, 22 bp, Artificial Sequence
  chemically synthesized
ttaaaaatattagtgattataa

SEQ ID NO: 1020801 - DNA, 22 bp, Artificial Sequence
  chemically synthesized
aggggacaggggattataatca

SEQ ID NO: 1020802 - DNA, 22 bp, Artificial Sequence
  chemically synthesized
aaaaatattagtgattataatc

SEQ ID NO: 1020803 - DNA, 22 bp, Artificial Sequence
  chemically synthesized
aaaatattagtgattataatcc

SEQ ID NO: 1020804 - DNA, 22 bp, Artificial Sequence
  chemically synthesized
tgaggggacaggggattataat

SEQ ID NO: 1020805 - DNA, 22 bp, Artificial Sequence
  chemically synthesized
actctgaggggacaggggatta

SEQ ID NO: 1020806 - DNA, 22 bp, Artificial Sequence
  chemically synthesized
gtgattataatcccctgtcccc

SEQ ID NO: 1020807 - DNA, 22 bp, Artificial Sequence
  chemically synthesized
taatcccctgtcccctcagagt

SEQ ID NO: 1020808 - DNA, 22 bp, Artificial Sequence
  chemically synthesized
tcccctcagagttaggcatgac

SEQ ID NO: 1020809 - DNA, 22 bp, Artificial Sequence
  chemically synthesized
agagttaggcatgaccacgtga

SEQ ID NO: 1020810 - DNA, 22 bp, Artificial Sequence
  chemically synthesized
atcatccaaaggaagtcacgtg

SEQ ID NO: 1020811 - DNA, 22 bp, Artificial Sequence
  chemically synthesized
catcatccaaaggaagtcacgt

SEQ ID NO: 1020812 - DNA, 22 bp, Artificial Sequence
  chemically synthesized
ggcatgaccacgtgacttcctt

SEQ ID NO: 1020813 - DNA, 22 bp, Artificial Sequence
  chemically synthesized
acttcatcatccaaaggaagtc

SEQ ID NO: 1020814 - DNA, 22 bp, Artificial Sequence
  chemically synthesized
cacttcatcatccaaaggaagt

SEQ ID NO: 1020815 - DNA, 22 bp, Artificial Sequence
  chemically synthesized
atttcacttcatcatccaaagg

SEQ ID NO: 1020816 - DNA, 22 bp, Artificial Sequence
  chemically synthesized
catttcacttcatcatccaaag

SEQ ID NO: 1020817 - DNA, 22 bp, Artificial Sequence
  chemically synthesized
tcatttcacttcatcatccaaa

SEQ ID NO: 1020818 - DNA, 22 bp, Artificial Sequence
  chemically synthesized
cctttggatgatgaagtgaaat

SEQ ID NO: 1020819 - DNA, 22 bp, Artificial Sequence
  chemically synthesized
ctttggatgatgaagtgaaatg

SEQ ID NO: 1020820 - DNA, 22 bp, Artificial Sequence
  chemically synthesized
tggatgatgaagtgaaatgaaa

SEQ ID NO: 1020821 - DNA, 22 bp, Artificial Sequence
  chemically synthesized
ggatgatgaagtgaaatgaaaa

SEQ ID NO: 1020822 - DNA, 22 bp, Artificial Sequence
  chemically synthesized
gatgatgaagtgaaatgaaaat

SEQ ID NO: 1020823 - DNA, 22 bp, Artificial Sequence
  chemically synthesized
tgtaggagtgatatatgtcatt

SEQ ID NO: 1020824 - DNA, 22 bp, Artificial Sequence
  chemically synthesized
tatgtaggagtgatatatgtca

SEQ ID NO: 1020825 - DNA, 22 bp, Artificial Sequence
  chemically synthesized
catgcctctatgtaggagtgat

SEQ ID NO: 1020826 - DNA, 22 bp, Artificial Sequence
  chemically synthesized
acatgcctctatgtaggagtga

SEQ ID NO: 1020827 - DNA, 22 bp, Artificial Sequence
  chemically synthesized
ttacatgcctctatgtaggagt

SEQ ID NO: 1020828 - DNA, 22 bp, Artificial Sequence
  chemically synthesized
actcttacatgcctctatgtag

SEQ ID NO: 1020829 - DNA, 22 bp, Artificial Sequence
  chemically synthesized
aactgactcttacatgcctcta

SEQ ID NO: 1020830 - DNA, 22 bp, Artificial Sequence
  chemically synthesized
aaactgactcttacatgcctct

SEQ ID NO: 1020831 - DNA, 22 bp, Artificial Sequence
  chemically synthesized
taaactgactcttacatgcctc

SEQ ID NO: 1020832 - DNA, 22 bp, Artificial Sequence
  chemically synthesized
ctacatagaggcatgtaagagt

SEQ ID NO: 1020833 - DNA, 22 bp, Artificial Sequence
  chemically synthesized
catagaggcatgtaagagtcag

SEQ ID NO: 1020834 - DNA, 22 bp, Artificial Sequence
  chemically synthesized
accatgtcagtcaaaaatgcgt

SEQ ID NO: 1020835 - DNA, 22 bp, Artificial Sequence
  chemically synthesized
aaaattttccacgcatttttga

SEQ ID NO: 1020836 - DNA, 22 bp, Artificial Sequence
  chemically synthesized
aaattttccacgcatttttgac

SEQ ID NO: 1020837 - DNA, 22 bp, Artificial Sequence
  chemically synthesized
gcgttcaccatgtcagtcaaaa

SEQ ID NO: 1020838 - DNA, 22 bp, Artificial Sequence
  chemically synthesized
agcgttcaccatgtcagtcaaa

SEQ ID NO: 1020839 - DNA, 22 bp, Artificial Sequence
  chemically synthesized
tagcgttcaccatgtcagtcaa

SEQ ID NO: 1020840 - DNA, 22 bp, Artificial Sequence
  chemically synthesized
tccacgcatttttgactgacat

SEQ ID NO: 1020841 - DNA, 22 bp, Artificial Sequence
  chemically synthesized
ccacgcatttttgactgacatg

SEQ ID NO: 1020842 - DNA, 22 bp, Artificial Sequence
  chemically synthesized
cacgcatttttgactgacatgg

SEQ ID NO: 1020843 - DNA, 22 bp, Artificial Sequence
  chemically synthesized
ttgactgacatggtgaacgcta

SEQ ID NO: 1020844 - DNA, 22 bp, Artificial Sequence
  chemically synthesized
tgactgacatggtgaacgctaa

SEQ ID NO: 1020845 - DNA, 22 bp, Artificial Sequence
  chemically synthesized
gactgacatggtgaacgctaaa

SEQ ID NO: 1020846 - DNA, 22 bp, Artificial Sequence
  chemically synthesized
actgacatggtgaacgctaaag

SEQ ID NO: 1020847 - DNA, 22 bp, Artificial Sequence
  chemically synthesized
acatggtgaacgctaaagcttc

SEQ ID NO: 1020848 - DNA, 22 bp, Artificial Sequence
  chemically synthesized
ccgtaacaataagaagctttag

SEQ ID NO: 1020849 - DNA, 22 bp, Artificial Sequence
  chemically synthesized
taccgtaacaataagaagcttt

SEQ ID NO: 1020850 - DNA, 22 bp, Artificial Sequence
  chemically synthesized
tcattctaccgtaacaataaga

SEQ ID NO: 1020851 - DNA, 22 bp, Artificial Sequence
  chemically synthesized
tatcattctaccgtaacaataa

SEQ ID NO: 1020852 - DNA, 22 bp, Artificial Sequence
  chemically synthesized
aagcttcttattgttacggtag

SEQ ID NO: 1020853 - DNA, 22 bp, Artificial Sequence
  chemically synthesized
gtattctatcattctaccgtaa

SEQ ID NO: 1020854 - DNA, 22 bp, Artificial Sequence
  chemically synthesized
tagtattctatcattctaccgt

SEQ ID NO: 1020855 - DNA, 22 bp, Artificial Sequence
  chemically synthesized
cttattgttacggtagaatgat

SEQ ID NO: 1020856 - DNA, 22 bp, Artificial Sequence
  chemically synthesized
ttattgttacggtagaatgata

SEQ ID NO: 1020857 - DNA, 22 bp, Artificial Sequence
  chemically synthesized
attgttacggtagaatgataga

SEQ ID NO: 1020858 - DNA, 22 bp, Artificial Sequence
  chemically synthesized
agtctctagtattctatcattc

SEQ ID NO: 1020859 - DNA, 22 bp, Artificial Sequence
  chemically synthesized
ttgttacggtagaatgatagaa

SEQ ID NO: 1020860 - DNA, 22 bp, Artificial Sequence
  chemically synthesized
ttacggtagaatgatagaatac

SEQ ID NO: 1020861 - DNA, 22 bp, Artificial Sequence
  chemically synthesized
attcagtctctagtattctatc

SEQ ID NO: 1020862 - DNA, 22 bp, Artificial Sequence
  chemically synthesized
cggtagaatgatagaatactag

SEQ ID NO: 1020863 - DNA, 22 bp, Artificial Sequence
  chemically synthesized
agctgattcagtctctagtatt

SEQ ID NO: 1020864 - DNA, 22 bp, Artificial Sequence
  chemically synthesized
aggaatctaagctgattcagtc

SEQ ID NO: 1020865 - DNA, 22 bp, Artificial Sequence
  chemically synthesized
tagtcactcaggaatctaagct

SEQ ID NO: 1020866 - DNA, 22 bp, Artificial Sequence
  chemically synthesized
gagactgaatcagcttagattc

SEQ ID NO: 1020867 - DNA, 22 bp, Artificial Sequence
  chemically synthesized
atcattgtagtcactcaggaat

SEQ ID NO: 1020868 - DNA, 22 bp, Artificial Sequence
  chemically synthesized
aatcagcttagattcctgagtg

SEQ ID NO: 1020869 - DNA, 22 bp, Artificial Sequence
  chemically synthesized
tgatcattgtagtcactcagga

SEQ ID NO: 1020870 - DNA, 22 bp, Artificial Sequence
  chemically synthesized
agattcctgagtgactacaatg

SEQ ID NO: 1020871 - DNA, 22 bp, Artificial Sequence
  chemically synthesized
gattcctgagtgactacaatga

SEQ ID NO: 1020872 - DNA, 22 bp, Artificial Sequence
  chemically synthesized
ctgagtgactacaatgatcaga

SEQ ID NO: 1020873 - DNA, 22 bp, Artificial Sequence
  chemically synthesized
agtgactacaatgatcagaacc

SEQ ID NO: 1020874 - DNA, 22 bp, Artificial Sequence
  chemically synthesized
caatgatcagaacccttgactg

SEQ ID NO: 1020875 - DNA, 22 bp, Artificial Sequence
  chemically synthesized
caacatatccaacacaagtcag

SEQ ID NO: 1020876 - DNA, 22 bp, Artificial Sequence
  chemically synthesized
gcaacatatccaacacaagtca

SEQ ID NO: 1020877 - DNA, 22 bp, Artificial Sequence
  chemically synthesized
tgcaacatatccaacacaagtc

SEQ ID NO: 1020878 - DNA, 22 bp, Artificial Sequence
  chemically synthesized
tatctttgcaacatatccaaca

SEQ ID NO: 1020879 - DNA, 22 bp, Artificial Sequence
  chemically synthesized
gtatctttgcaacatatccaac

SEQ ID NO: 1020880 - DNA, 22 bp, Artificial Sequence
  chemically synthesized
gactgacttgtgttggatatgt

SEQ ID NO: 1020881 - DNA, 22 bp, Artificial Sequence
  chemically synthesized
tgtatctttgcaacatatccaa

SEQ ID NO: 1020882 - DNA, 22 bp, Artificial Sequence
  chemically synthesized
actgacttgtgttggatatgtt

SEQ ID NO: 1020883 - DNA, 22 bp, Artificial Sequence
  chemically synthesized
attttgtatctttgcaacatat

SEQ ID NO: 1020884 - DNA, 22 bp, Artificial Sequence
  chemically synthesized
acttgtgttggatatgttgcaa

SEQ ID NO: 1020885 - DNA, 22 bp, Artificial Sequence
  chemically synthesized
gtgttggatatgttgcaaagat

SEQ ID NO: 1020886 - DNA, 22 bp, Artificial Sequence
  chemically synthesized
tgttggatatgttgcaaagata

SEQ ID NO: 1020887 - DNA, 22 bp, Artificial Sequence
  chemically synthesized
gatatgttgcaaagatacaaaa

SEQ ID NO: 1020888 - DNA, 22 bp, Artificial Sequence
  chemically synthesized
gaaacacaaaggttgattttgt

SEQ ID NO: 1020889 - DNA, 22 bp, Artificial Sequence
  chemically synthesized
caaagatacaaaatcaaccttt

SEQ ID NO: 1020890 - DNA, 22 bp, Artificial Sequence
  chemically synthesized
gtggctagaaacacaaaggttg

SEQ ID NO: 1020891 - DNA, 22 bp, Artificial Sequence
  chemically synthesized
caaaatattagtggctagaaac

SEQ ID NO: 1020892 - DNA, 22 bp, Artificial Sequence
  chemically synthesized
tgtgtttctagccactaatatt

SEQ ID NO: 1020893 - DNA, 22 bp, Artificial Sequence
  chemically synthesized
gtgtttctagccactaatattt

SEQ ID NO: 1020894 - DNA, 22 bp, Artificial Sequence
  chemically synthesized
tgtttctagccactaatatttt

SEQ ID NO: 1020895 - DNA, 22 bp, Artificial Sequence
  chemically synthesized
ctagccactaatattttggaat

SEQ ID NO: 1020896 - DNA, 22 bp, Artificial Sequence
  chemically synthesized
caataataagcaattccaaaat

SEQ ID NO: 1020897 - DNA, 22 bp, Artificial Sequence
  chemically synthesized
tagccactaatattttggaatt

SEQ ID NO: 1020898 - DNA, 22 bp, Artificial Sequence
  chemically synthesized
gccactaatattttggaattgc

SEQ ID NO: 1020899 - DNA, 22 bp, Artificial Sequence
  chemically synthesized
tgctgcaataataagcaattcc

SEQ ID NO: 1020900 - DNA, 22 bp, Artificial Sequence
  chemically synthesized
ttatgctgcaataataagcaat

SEQ ID NO: 1020901 - DNA, 22 bp, Artificial Sequence
  chemically synthesized
gttatgctgcaataataagcaa

SEQ ID NO: 1020902 - DNA, 22 bp, Artificial Sequence
  chemically synthesized
atattttggaattgcttattat

SEQ ID NO: 1020903 - DNA, 22 bp, Artificial Sequence
  chemically synthesized
gccttgttatgctgcaataata

SEQ ID NO: 1020904 - DNA, 22 bp, Artificial Sequence
  chemically synthesized
tggaattgcttattattgcagc

SEQ ID NO: 1020905 - DNA, 22 bp, Artificial Sequence
  chemically synthesized
ggaattgcttattattgcagca

SEQ ID NO: 1020906 - DNA, 22 bp, Artificial Sequence
  chemically synthesized
gaattgcttattattgcagcat

SEQ ID NO: 1020907 - DNA, 22 bp, Artificial Sequence
  chemically synthesized
cttattattgcagcataacaag

SEQ ID NO: 1020908 - DNA, 22 bp, Artificial Sequence
  chemically synthesized
ggcatgattcgccttgttatgc

SEQ ID NO: 1020909 - DNA, 22 bp, Artificial Sequence
  chemically synthesized
aggcatgattcgccttgttatg

SEQ ID NO: 1020910 - DNA, 22 bp, Artificial Sequence
  chemically synthesized
taggcatgattcgccttgttat

SEQ ID NO: 1020911 - DNA, 22 bp, Artificial Sequence
  chemically synthesized
attattgcagcataacaaggcg

SEQ ID NO: 1020912 - DNA, 22 bp, Artificial Sequence
  chemically synthesized
ttattgcagcataacaaggcga

SEQ ID NO: 1020913 - DNA, 22 bp, Artificial Sequence
  chemically synthesized
ttgcagcataacaaggcgaatc

SEQ ID NO: 1020914 - DNA, 22 bp, Artificial Sequence
  chemically synthesized
cagcataacaaggcgaatcatg

SEQ ID NO: 1020915 - DNA, 22 bp, Artificial Sequence
  chemically synthesized
gagatcagaaggagagtgtttt

SEQ ID NO: 1020916 - DNA, 22 bp, Artificial Sequence
  chemically synthesized
tgattggagatcagaaggagag

SEQ ID NO: 1020917 - DNA, 22 bp, Artificial Sequence
  chemically synthesized
gttgtgattggagatcagaagg

SEQ ID NO: 1020918 - DNA, 22 bp, Artificial Sequence
  chemically synthesized
agttgtgattggagatcagaag

SEQ ID NO: 1020919 - DNA, 22 bp, Artificial Sequence
  chemically synthesized
aaacactctccttctgatctcc

SEQ ID NO: 1020920 - DNA, 22 bp, Artificial Sequence
  chemically synthesized
tccttctgatctccaatcacaa

SEQ ID NO: 1020921 - DNA, 22 bp, Artificial Sequence
  chemically synthesized
cttctgatctccaatcacaact

SEQ ID NO: 1020922 - DNA, 22 bp, Artificial Sequence
  chemically synthesized
ctgatctccaatcacaactaaa

SEQ ID NO: 1020923 - DNA, 22 bp, Artificial Sequence
  chemically synthesized
tgatctccaatcacaactaaac

SEQ ID NO: 1020924 - DNA, 22 bp, Artificial Sequence
  chemically synthesized
atctccaatcacaactaaacat

SEQ ID NO: 1020925 - DNA, 22 bp, Artificial Sequence
  chemically synthesized
caatcacaactaaacattcttt

SEQ ID NO: 1020926 - DNA, 22 bp, Artificial Sequence
  chemically synthesized
aacattctttgtctttcttggt

SEQ ID NO: 1020927 - DNA, 22 bp, Artificial Sequence
  chemically synthesized
ccaagtgaagaaagaaaccaag

SEQ ID NO: 1020928 - DNA, 22 bp, Artificial Sequence
  chemically synthesized
taccaagtgaagaaagaaacca

SEQ ID NO: 1020929 - DNA, 22 bp, Artificial Sequence
  chemically synthesized
tttgtctttcttggtttctttc

SEQ ID NO: 1020930 - DNA, 22 bp, Artificial Sequence
  chemically synthesized
tgtctttcttggtttctttctt

SEQ ID NO: 1020931 - DNA, 22 bp, Artificial Sequence
  chemically synthesized
gtctttcttggtttctttcttc

SEQ ID NO: 1020932 - DNA, 22 bp, Artificial Sequence
  chemically synthesized
tctttcttggtttctttcttca

SEQ ID NO: 1020933 - DNA, 22 bp, Artificial Sequence
  chemically synthesized
tcttggtttctttcttcacttg

SEQ ID NO: 1020934 - DNA, 22 bp, Artificial Sequence
  chemically synthesized
cttggtttctttcttcacttgg

SEQ ID NO: 1020935 - DNA, 22 bp, Artificial Sequence
  chemically synthesized
ttggtttctttcttcacttggt

SEQ ID NO: 1020936 - DNA, 22 bp, Artificial Sequence
  chemically synthesized
aaaaatatactctaccaagtga

SEQ ID NO: 1020937 - DNA, 22 bp, Artificial Sequence
  chemically synthesized
ggtttctttcttcacttggtag

SEQ ID NO: 1020938 - DNA, 22 bp, Artificial Sequence
  chemically synthesized
caaaaatatactctaccaagtg

SEQ ID NO: 1020939 - DNA, 22 bp, Artificial Sequence
  chemically synthesized
gtttctttcttcacttggtaga

SEQ ID NO: 1020940 - DNA, 22 bp, Artificial Sequence
  chemically synthesized
tcaaaaatatactctaccaagt

SEQ ID NO: 1020941 - DNA, 22 bp, Artificial Sequence
  chemically synthesized
ttttcaaaaatatactctacca

SEQ ID NO: 1020942 - DNA, 22 bp, Artificial Sequence
  chemically synthesized
ctttcttcacttggtagagtat

SEQ ID NO: 1020943 - DNA, 22 bp, Artificial Sequence
  chemically synthesized
tttcttcacttggtagagtata

SEQ ID NO: 1020944 - DNA, 22 bp, Artificial Sequence
  chemically synthesized
tcttcacttggtagagtatatt

SEQ ID NO: 1020945 - DNA, 22 bp, Artificial Sequence
  chemically synthesized
cttcacttggtagagtatattt

SEQ ID NO: 1020946 - DNA, 22 bp, Artificial Sequence
  chemically synthesized
ttcacttggtagagtatatttt

SEQ ID NO: 1020947 - DNA, 22 bp, Artificial Sequence
  chemically synthesized
cacttggtagagtatatttttg

SEQ ID NO: 1020948 - DNA, 22 bp, Artificial Sequence
  chemically synthesized
acttggtagagtatatttttga

SEQ ID NO: 1020949 - DNA, 22 bp, Artificial Sequence
  chemically synthesized
cccagaaatctattttcaaaaa

SEQ ID NO: 1020950 - DNA, 22 bp, Artificial Sequence
  chemically synthesized
ggtagagtatatttttgaaaat

SEQ ID NO: 1020951 - DNA, 22 bp, Artificial Sequence
  chemically synthesized
ccccagaaatctattttcaaaa

SEQ ID NO: 1020952 - DNA, 22 bp, Artificial Sequence
  chemically synthesized
gtagagtatatttttgaaaata

SEQ ID NO: 1020953 - DNA, 22 bp, Artificial Sequence
  chemically synthesized
tccccagaaatctattttcaaa

SEQ ID NO: 1020954 - DNA, 22 bp, Artificial Sequence
  chemically synthesized
ttccccagaaatctattttcaa

SEQ ID NO: 1020955 - DNA, 22 bp, Artificial Sequence
  chemically synthesized
tttccccagaaatctattttca

SEQ ID NO: 1020956 - DNA, 22 bp, Artificial Sequence
  chemically synthesized
ttttccccagaaatctattttc

SEQ ID NO: 1020957 - DNA, 22 bp, Artificial Sequence
  chemically synthesized
aaccttttttccccagaaatct

SEQ ID NO: 1020958 - DNA, 22 bp, Artificial Sequence
  chemically synthesized
ttgaaaatagatttctggggaa

SEQ ID NO: 1020959 - DNA, 22 bp, Artificial Sequence
  chemically synthesized
tgaaaatagatttctggggaaa

SEQ ID NO: 1020960 - DNA, 22 bp, Artificial Sequence
  chemically synthesized
ccctaaaccttttttccccaga

SEQ ID NO: 1020961 - DNA, 22 bp, Artificial Sequence
  chemically synthesized
gaaaatagatttctggggaaaa

SEQ ID NO: 1020962 - DNA, 22 bp, Artificial Sequence
  chemically synthesized
aaaatagatttctggggaaaaa

SEQ ID NO: 1020963 - DNA, 22 bp, Artificial Sequence
  chemically synthesized
tgtactcccctaaacctttttt

SEQ ID NO: 1020964 - DNA, 22 bp, Artificial Sequence
  chemically synthesized
atgtactcccctaaaccttttt

SEQ ID NO: 1020965 - DNA, 22 bp, Artificial Sequence
  chemically synthesized
ctggggaaaaaaggtttagggg

SEQ ID NO: 1020966 - DNA, 22 bp, Artificial Sequence
  chemically synthesized
tggggaaaaaaggtttagggga

SEQ ID NO: 1020967 - DNA, 22 bp, Artificial Sequence
  chemically synthesized
gggaaaaaaggtttaggggagt

SEQ ID NO: 1020968 - DNA, 22 bp, Artificial Sequence
  chemically synthesized
agagatagccttatgtactccc

SEQ ID NO: 1020969 - DNA, 22 bp, Artificial Sequence
  chemically synthesized
cagagatagccttatgtactcc

SEQ ID NO: 1020970 - DNA, 22 bp, Artificial Sequence
  chemically synthesized
tcagagatagccttatgtactc

SEQ ID NO: 1020971 - DNA, 22 bp, Artificial Sequence
  chemically synthesized
aggggagtacataaggctatct

SEQ ID NO: 1020972 - DNA, 22 bp, Artificial Sequence
  chemically synthesized
ggggagtacataaggctatctc

SEQ ID NO: 1020973 - DNA, 22 bp, Artificial Sequence
  chemically synthesized
tgcggagaaaataattttcaga

SEQ ID NO: 1020974 - DNA, 22 bp, Artificial Sequence
  chemically synthesized
taaattgtgcggagaaaataat

SEQ ID NO: 1020975 - DNA, 22 bp, Artificial Sequence
  chemically synthesized
tctctgaaaattattttctccg

SEQ ID NO: 1020976 - DNA, 22 bp, Artificial Sequence
  chemically synthesized
tgaaaattattttctccgcaca

SEQ ID NO: 1020977 - DNA, 22 bp, Artificial Sequence
  chemically synthesized
ataaactataaattgtgcggag

SEQ ID NO: 1020978 - DNA, 22 bp, Artificial Sequence
  chemically synthesized
aaaattattttctccgcacaat

SEQ ID NO: 1020979 - DNA, 22 bp, Artificial Sequence
  chemically synthesized
ttttctccgcacaatttatagt

SEQ ID NO: 1020980 - DNA, 22 bp, Artificial Sequence
  chemically synthesized
tacaccctgataaactataaat

SEQ ID NO: 1020981 - DNA, 22 bp, Artificial Sequence
  chemically synthesized
tctccgcacaatttatagttta

SEQ ID NO: 1020982 - DNA, 22 bp, Artificial Sequence
  chemically synthesized
ctccgcacaatttatagtttat

SEQ ID NO: 1020983 - DNA, 22 bp, Artificial Sequence
  chemically synthesized
tccgcacaatttatagtttatc

SEQ ID NO: 1020984 - DNA, 22 bp, Artificial Sequence
  chemically synthesized
cgcacaatttatagtttatcag

SEQ ID NO: 1020985 - DNA, 22 bp, Artificial Sequence
  chemically synthesized
atagtttatcagggtgtacaat

SEQ ID NO: 1020986 - DNA, 22 bp, Artificial Sequence
  chemically synthesized
aacaatatataaattgtacacc

SEQ ID NO: 1020987 - DNA, 22 bp, Artificial Sequence
  chemically synthesized
tagtttatcagggtgtacaatt

SEQ ID NO: 1020988 - DNA, 22 bp, Artificial Sequence
  chemically synthesized
ttcaacaatatataaattgtac

SEQ ID NO: 1020989 - DNA, 22 bp, Artificial Sequence
  chemically synthesized
ttattcaacaatatataaattg

SEQ ID NO: 1020990 - DNA, 22 bp, Artificial Sequence
  chemically synthesized
atcagggtgtacaatttatata

SEQ ID NO: 1020991 - DNA, 22 bp, Artificial Sequence
  chemically synthesized
gttattcaacaatatataaatt

SEQ ID NO: 1020992 - DNA, 22 bp, Artificial Sequence
  chemically synthesized
tcagggtgtacaatttatatat

SEQ ID NO: 1020993 - DNA, 22 bp, Artificial Sequence
  chemically synthesized
gaatgacttgttattcaacaat

SEQ ID NO: 1020994 - DNA, 22 bp, Artificial Sequence
  chemically synthesized
ggaatgacttgttattcaacaa

SEQ ID NO: 1020995 - DNA, 22 bp, Artificial Sequence
  chemically synthesized
tggaatgacttgttattcaaca

SEQ ID NO: 1020996 - DNA, 22 bp, Artificial Sequence
  chemically synthesized
aattttggaatgacttgttatt

SEQ ID NO: 1020997 - DNA, 22 bp, Artificial Sequence
  chemically synthesized
atatattgttgaataacaagtc

SEQ ID NO: 1020998 - DNA, 22 bp, Artificial Sequence
  chemically synthesized
tatattgttgaataacaagtca

SEQ ID NO: 1020999 - DNA, 22 bp, Artificial Sequence
  chemically synthesized
ctaaattttggaatgacttgtt

SEQ ID NO: 1021000 - DNA, 22 bp, Artificial Sequence
  chemically synthesized
agctgctaaattttggaatgac

SEQ ID NO: 1021001 - DNA, 22 bp, Artificial Sequence
  chemically synthesized
ttgaataacaagtcattccaaa

SEQ ID NO: 1021002 - DNA, 22 bp, Artificial Sequence
  chemically synthesized
aagctgctaaattttggaatga

SEQ ID NO: 1021003 - DNA, 22 bp, Artificial Sequence
  chemically synthesized
taagctgctaaattttggaatg

SEQ ID NO: 1021004 - DNA, 22 bp, Artificial Sequence
  chemically synthesized
ttaagctgctaaattttggaat

SEQ ID NO: 1021005 - DNA, 22 bp, Artificial Sequence
  chemically synthesized
aataacaagtcattccaaaatt

SEQ ID NO: 1021006 - DNA, 22 bp, Artificial Sequence
  chemically synthesized
tttttaagctgctaaattttgg

SEQ ID NO: 1021007 - DNA, 22 bp, Artificial Sequence
  chemically synthesized
gtttttaagctgctaaattttg

SEQ ID NO: 1021008 - DNA, 22 bp, Artificial Sequence
  chemically synthesized
tgtttttaagctgctaaatttt

SEQ ID NO: 1021009 - DNA, 22 bp, Artificial Sequence
  chemically synthesized
ttgtttttaagctgctaaattt

SEQ ID NO: 1021010 - DNA, 22 bp, Artificial Sequence
  chemically synthesized
caaaatttagcagcttaaaaac

SEQ ID NO: 1021011 - DNA, 22 bp, Artificial Sequence
  chemically synthesized
ccaaataataaacatttttgtt

SEQ ID NO: 1021012 - DNA, 22 bp, Artificial Sequence
  chemically synthesized
agcagcttaaaaacaaaaatgt

SEQ ID NO: 1021013 - DNA, 22 bp, Artificial Sequence
  chemically synthesized
gcagcttaaaaacaaaaatgtt

SEQ ID NO: 1021014 - DNA, 22 bp, Artificial Sequence
  chemically synthesized
agaaactgccaaataataaaca

SEQ ID NO: 1021015 - DNA, 22 bp, Artificial Sequence
  chemically synthesized
aaaaacaaaaatgtttattatt

SEQ ID NO: 1021016 - DNA, 22 bp, Artificial Sequence
  chemically synthesized
cagaaactgccaaataataaac

SEQ ID NO: 1021017 - DNA, 22 bp, Artificial Sequence
  chemically synthesized
aaaacaaaaatgtttattattt

SEQ ID NO: 1021018 - DNA, 22 bp, Artificial Sequence
  chemically synthesized
accttcagaaactgccaaataa

SEQ ID NO: 1021019 - DNA, 22 bp, Artificial Sequence
  chemically synthesized
gaccttcagaaactgccaaata

SEQ ID NO: 1021020 - DNA, 22 bp, Artificial Sequence
  chemically synthesized
ttgaccttcagaaactgccaaa

SEQ ID NO: 1021021 - DNA, 22 bp, Artificial Sequence
  chemically synthesized
agattcttgaccttcagaaact

SEQ ID NO: 1021022 - DNA, 22 bp, Artificial Sequence
  chemically synthesized
attatttggcagtttctgaagg

SEQ ID NO: 1021023 - DNA, 22 bp, Artificial Sequence
  chemically synthesized
tcagattcttgaccttcagaaa

SEQ ID NO: 1021024 - DNA, 22 bp, Artificial Sequence
  chemically synthesized
ttatttggcagtttctgaaggt

SEQ ID NO: 1021025 - DNA, 22 bp, Artificial Sequence
  chemically synthesized
tttggcagtttctgaaggtcaa

SEQ ID NO: 1021026 - DNA, 22 bp, Artificial Sequence
  chemically synthesized
ggcagtttctgaaggtcaagaa

SEQ ID NO: 1021027 - DNA, 22 bp, Artificial Sequence
  chemically synthesized
gcagtttctgaaggtcaagaat

SEQ ID NO: 1021028 - DNA, 22 bp, Artificial Sequence
  chemically synthesized
agccactctcagattcttgacc

SEQ ID NO: 1021029 - DNA, 22 bp, Artificial Sequence
  chemically synthesized
ctaagccactctcagattcttg

SEQ ID NO: 1021030 - DNA, 22 bp, Artificial Sequence
  chemically synthesized
ctgaaggtcaagaatctgagag

SEQ ID NO: 1021031 - DNA, 22 bp, Artificial Sequence
  chemically synthesized
tgaaggtcaagaatctgagagt

SEQ ID NO: 1021032 - DNA, 22 bp, Artificial Sequence
  chemically synthesized
aaggtcaagaatctgagagtgg

SEQ ID NO: 1021033 - DNA, 22 bp, Artificial Sequence
  chemically synthesized
tgccagtcccaccctgctaagc

SEQ ID NO: 1021034 - DNA, 22 bp, Artificial Sequence
  chemically synthesized
agagtggcttagcagggtggga

SEQ ID NO: 1021035 - DNA, 22 bp, Artificial Sequence
  chemically synthesized
ataaaataagctatgccagtcc

SEQ ID NO: 1021036 - DNA, 22 bp, Artificial Sequence
  chemically synthesized
agcagggtgggactggcatagc

SEQ ID NO: 1021037 - DNA, 22 bp, Artificial Sequence
  chemically synthesized
gcagggtgggactggcatagct

SEQ ID NO: 1021038 - DNA, 22 bp, Artificial Sequence
  chemically synthesized
caacctcataaaataagctatg

SEQ ID NO: 1021039 - DNA, 22 bp, Artificial Sequence
  chemically synthesized
actacaacctcataaaataagc

SEQ ID NO: 1021040 - DNA, 22 bp, Artificial Sequence
  chemically synthesized
aactacaacctcataaaataag

SEQ ID NO: 1021041 - DNA, 22 bp, Artificial Sequence
  chemically synthesized
gcatagcttattttatgaggtt

SEQ ID NO: 1021042 - DNA, 22 bp, Artificial Sequence
  chemically synthesized
attttatgaggttgtagttaag

SEQ ID NO: 1021043 - DNA, 22 bp, Artificial Sequence
  chemically synthesized
ttttatgaggttgtagttaagc

SEQ ID NO: 1021044 - DNA, 22 bp, Artificial Sequence
  chemically synthesized
tatgaggttgtagttaagctgt

SEQ ID NO: 1021045 - DNA, 22 bp, Artificial Sequence
  chemically synthesized
caagcatagacaacagcttaac

SEQ ID NO: 1021046 - DNA, 22 bp, Artificial Sequence
  chemically synthesized
atgaggttgtagttaagctgtt

SEQ ID NO: 1021047 - DNA, 22 bp, Artificial Sequence
  chemically synthesized
tgaggttgtagttaagctgttg

SEQ ID NO: 1021048 - DNA, 22 bp, Artificial Sequence
  chemically synthesized
gagaggctgcaagcatagacaa

SEQ ID NO: 1021049 - DNA, 22 bp, Artificial Sequence
  chemically synthesized
tagttaagctgttgtctatgct

SEQ ID NO: 1021050 - DNA, 22 bp, Artificial Sequence
  chemically synthesized
agctgttgtctatgcttgcagc

SEQ ID NO: 1021051 - DNA, 22 bp, Artificial Sequence
  chemically synthesized
ttgtctatgcttgcagcctctc

SEQ ID NO: 1021052 - DNA, 22 bp, Artificial Sequence
  chemically synthesized
tctatgcttgcagcctctcgag

SEQ ID NO: 1021053 - DNA, 22 bp, Artificial Sequence
  chemically synthesized
acaccagacaaatctcgagagg

SEQ ID NO: 1021054 - DNA, 22 bp, Artificial Sequence
  chemically synthesized
aacaccagacaaatctcgagag

SEQ ID NO: 1021055 - DNA, 22 bp, Artificial Sequence
  chemically synthesized
tgcttgcagcctctcgagattt

SEQ ID NO: 1021056 - DNA, 22 bp, Artificial Sequence
  chemically synthesized
gcagcctctcgagatttgtctg

SEQ ID NO: 1021057 - DNA, 22 bp, Artificial Sequence
  chemically synthesized
cagcctctcgagatttgtctgg

SEQ ID NO: 1021058 - DNA, 22 bp, Artificial Sequence
  chemically synthesized
gaagtgcatcatttaacaccag

SEQ ID NO: 1021059 - DNA, 22 bp, Artificial Sequence
  chemically synthesized
tcgagatttgtctggtgttaaa

SEQ ID NO: 1021060 - DNA, 22 bp, Artificial Sequence
  chemically synthesized
agaagtgcatcatttaacacca

SEQ ID NO: 1021061 - DNA, 22 bp, Artificial Sequence
  chemically synthesized
gagatttgtctggtgttaaatg

SEQ ID NO: 1021062 - DNA, 22 bp, Artificial Sequence
  chemically synthesized
gtctggtgttaaatgatgcact

SEQ ID NO: 1021063 - DNA, 22 bp, Artificial Sequence
  chemically synthesized
tctggtgttaaatgatgcactt

SEQ ID NO: 1021064 - DNA, 22 bp, Artificial Sequence
  chemically synthesized
gtgttaaatgatgcacttctaa

SEQ ID NO: 1021065 - DNA, 22 bp, Artificial Sequence
  chemically synthesized
aatgatgcacttctaagctcat

SEQ ID NO: 1021066 - DNA, 22 bp, Artificial Sequence
  chemically synthesized
caaagagccacaagaatgagct

SEQ ID NO: 1021067 - DNA, 22 bp, Artificial Sequence
  chemically synthesized
ctgcaaagagccacaagaatga

SEQ ID NO: 1021068 - DNA, 22 bp, Artificial Sequence
  chemically synthesized
ctaagctcattcttgtggctct

SEQ ID NO: 1021069 - DNA, 22 bp, Artificial Sequence
  chemically synthesized
taagctcattcttgtggctctt

SEQ ID NO: 1021070 - DNA, 22 bp, Artificial Sequence
  chemically synthesized
aggcctcctgcaaagagccaca

SEQ ID NO: 1021071 - DNA, 22 bp, Artificial Sequence
  chemically synthesized
agctcattcttgtggctctttg

SEQ ID NO: 1021072 - DNA, 22 bp, Artificial Sequence
  chemically synthesized
attcttgtggctctttgcagga

SEQ ID NO: 1021073 - DNA, 22 bp, Artificial Sequence
  chemically synthesized
agaaactaaggcctcctgcaaa

SEQ ID NO: 1021074 - DNA, 22 bp, Artificial Sequence
  chemically synthesized
ttgtggctctttgcaggaggcc

SEQ ID NO: 1021075 - DNA, 22 bp, Artificial Sequence
  chemically synthesized
gtggctctttgcaggaggcctt

SEQ ID NO: 1021076 - DNA, 22 bp, Artificial Sequence
  chemically synthesized
tggctctttgcaggaggcctta

SEQ ID NO: 1021077 - DNA, 22 bp, Artificial Sequence
  chemically synthesized
tttgcaggaggccttagtttct

SEQ ID NO: 1021078 - DNA, 22 bp, Artificial Sequence
  chemically synthesized
tgcaggaggccttagtttctca

SEQ ID NO: 1021079 - DNA, 22 bp, Artificial Sequence
  chemically synthesized
gcaggaggccttagtttctcag

SEQ ID NO: 1021080 - DNA, 22 bp, Artificial Sequence
  chemically synthesized
caggaggccttagtttctcagc

SEQ ID NO: 1021081 - DNA, 22 bp, Artificial Sequence
  chemically synthesized
tggagatgcacgtatgctgaga

SEQ ID NO: 1021082 - DNA, 22 bp, Artificial Sequence
  chemically synthesized
agtttctcagcatacgtgcatc

SEQ ID NO: 1021083 - DNA, 22 bp, Artificial Sequence
  chemically synthesized
gtttctcagcatacgtgcatct

SEQ ID NO: 1021084 - DNA, 22 bp, Artificial Sequence
  chemically synthesized
ctcagcatacgtgcatctccat

SEQ ID NO: 1021085 - DNA, 22 bp, Artificial Sequence
  chemically synthesized
tcagcatacgtgcatctccata

SEQ ID NO: 1021086 - DNA, 22 bp, Artificial Sequence
  chemically synthesized
agcatacgtgcatctccatagg

SEQ ID NO: 1021087 - DNA, 22 bp, Artificial Sequence
  chemically synthesized
tgggaacacatgtcatgagcag

SEQ ID NO: 1021088 - DNA, 22 bp, Artificial Sequence
  chemically synthesized
tgtgggaacacatgtcatgagc

SEQ ID NO: 1021089 - DNA, 22 bp, Artificial Sequence
  chemically synthesized
ctgtgggaacacatgtcatgag

SEQ ID NO: 1021090 - DNA, 22 bp, Artificial Sequence
  chemically synthesized
catagggctgctcatgacatgt

SEQ ID NO: 1021091 - DNA, 22 bp, Artificial Sequence
  chemically synthesized
ttctgtgggaacacatgtcatg

SEQ ID NO: 1021092 - DNA, 22 bp, Artificial Sequence
  chemically synthesized
cttctgtgggaacacatgtcat

SEQ ID NO: 1021093 - DNA, 22 bp, Artificial Sequence
  chemically synthesized
cttcttctgtgggaacacatgt

SEQ ID NO: 1021094 - DNA, 22 bp, Artificial Sequence
  chemically synthesized
ctcatgacatgtgttcccacag

SEQ ID NO: 1021095 - DNA, 22 bp, Artificial Sequence
  chemically synthesized
atgcattgcttcttctgtggga

SEQ ID NO: 1021096 - DNA, 22 bp, Artificial Sequence
  chemically synthesized
atgacatgtgttcccacagaag

SEQ ID NO: 1021097 - DNA, 22 bp, Artificial Sequence
  chemically synthesized
tcatgcattgcttcttctgtgg

SEQ ID NO: 1021098 - DNA, 22 bp, Artificial Sequence
  chemically synthesized
tctcatgcattgcttcttctgt

SEQ ID NO: 1021099 - DNA, 22 bp, Artificial Sequence
  chemically synthesized
tctctcatgcattgcttcttct

SEQ ID NO: 1021100 - DNA, 22 bp, Artificial Sequence
  chemically synthesized
tctctctcatgcattgcttctt

SEQ ID NO: 1021101 - DNA, 22 bp, Artificial Sequence
  chemically synthesized
tctctctctcatgcattgcttc

SEQ ID NO: 1021102 - DNA, 22 bp, Artificial Sequence
  chemically synthesized
tctctctctctcatgcattgct

SEQ ID NO: 1021103 - DNA, 22 bp, Artificial Sequence
  chemically synthesized
ccacagaagaagcaatgcatga

SEQ ID NO: 1021104 - DNA, 22 bp, Artificial Sequence
  chemically synthesized
tctctctctctctcatgcattg

SEQ ID NO: 1021105 - DNA, 22 bp, Artificial Sequence
  chemically synthesized
tctctctctctctctcatgcat

SEQ ID NO: 1021106 - DNA, 22 bp, Artificial Sequence
  chemically synthesized
tctctctctctctctctcatgc

SEQ ID NO: 1021107 - DNA, 22 bp, Artificial Sequence
  chemically synthesized
tctctctctctctctctctcat

SEQ ID NO: 1021108 - DNA, 22 bp, Artificial Sequence
  chemically synthesized
tctctctctctctctctctctc

SEQ ID NO: 1021109 - DNA, 22 bp, Artificial Sequence
  chemically synthesized
tctctctctctctctctctctc

SEQ ID NO: 1021110 - DNA, 22 bp, Artificial Sequence
  chemically synthesized
tctctctctctctctctctctc

SEQ ID NO: 1021111 - DNA, 22 bp, Artificial Sequence
  chemically synthesized
tctctctctctctctctctctc

SEQ ID NO: 1021112 - DNA, 22 bp, Artificial Sequence
  chemically synthesized
ctctctctctctctctctctct

SEQ ID NO: 1021113 - DNA, 22 bp, Artificial Sequence
  chemically synthesized
tctctctctctctctctctctc

SEQ ID NO: 1021114 - DNA, 22 bp, Artificial Sequence
  chemically synthesized
tttctctctctctctctctctc

SEQ ID NO: 1021115 - DNA, 22 bp, Artificial Sequence
  chemically synthesized
tctttctctctctctctctctc

SEQ ID NO: 1021116 - DNA, 22 bp, Artificial Sequence
  chemically synthesized
tgtctctctttctctctctctc

SEQ ID NO: 1021117 - DNA, 22 bp, Artificial Sequence
  chemically synthesized
tgtgtctctctttctctctctc

SEQ ID NO: 1021118 - DNA, 22 bp, Artificial Sequence
  chemically synthesized
tctgtgtctctctttctctctc

SEQ ID NO: 1021119 - DNA, 22 bp, Artificial Sequence
  chemically synthesized
tctctgtgtctctctttctctc

SEQ ID NO: 1021120 - DNA, 22 bp, Artificial Sequence
  chemically synthesized
tctctctctgtgtctctctttc

SEQ ID NO: 1021121 - DNA, 22 bp, Artificial Sequence
  chemically synthesized
catccacgcctatctctctctg

SEQ ID NO: 1021122 - DNA, 22 bp, Artificial Sequence
  chemically synthesized
tccatccacgcctatctctctc

SEQ ID NO: 1021123 - DNA, 22 bp, Artificial Sequence
  chemically synthesized
tgttctccatccacgcctatct

SEQ ID NO: 1021124 - DNA, 22 bp, Artificial Sequence
  chemically synthesized
gtgttctccatccacgcctatc

SEQ ID NO: 1021125 - DNA, 22 bp, Artificial Sequence
  chemically synthesized
tgtcttgtgttctccatccacg

SEQ ID NO: 1021126 - DNA, 22 bp, Artificial Sequence
  chemically synthesized
atgtcttgtgttctccatccac

SEQ ID NO: 1021127 - DNA, 22 bp, Artificial Sequence
  chemically synthesized
tggtttatgtcttgtgttctcc

SEQ ID NO: 1021128 - DNA, 22 bp, Artificial Sequence
  chemically synthesized
tagaaagactgtggtttatgtc

SEQ ID NO: 1021129 - DNA, 22 bp, Artificial Sequence
  chemically synthesized
caagtgtaggttgtagaaagac

SEQ ID NO: 1021130 - DNA, 22 bp, Artificial Sequence
  chemically synthesized
ccaagtgtaggttgtagaaaga

SEQ ID NO: 1021131 - DNA, 22 bp, Artificial Sequence
  chemically synthesized
tctacaacctacacttggaaat

SEQ ID NO: 1021132 - DNA, 22 bp, Artificial Sequence
  chemically synthesized
tgatgatatgtcatttccaagt

SEQ ID NO: 1021133 - DNA, 22 bp, Artificial Sequence
  chemically synthesized
ctacaacctacacttggaaatg

SEQ ID NO: 1021134 - DNA, 22 bp, Artificial Sequence
  chemically synthesized
gtgatgatatgtcatttccaag

SEQ ID NO: 1021135 - DNA, 22 bp, Artificial Sequence
  chemically synthesized
tacaacctacacttggaaatga

SEQ ID NO: 1021136 - DNA, 22 bp, Artificial Sequence
  chemically synthesized
tgtgatgatatgtcatttccaa

SEQ ID NO: 1021137 - DNA, 22 bp, Artificial Sequence
  chemically synthesized
ttgtgatgatatgtcatttcca

SEQ ID NO: 1021138 - DNA, 22 bp, Artificial Sequence
  chemically synthesized
caacctacacttggaaatgaca

SEQ ID NO: 1021139 - DNA, 22 bp, Artificial Sequence
  chemically synthesized
ttttgtgatgatatgtcatttc

SEQ ID NO: 1021140 - DNA, 22 bp, Artificial Sequence
  chemically synthesized
cacttggaaatgacatatcatc

SEQ ID NO: 1021141 - DNA, 22 bp, Artificial Sequence
  chemically synthesized
agtgactcttttgtgatgatat

SEQ ID NO: 1021142 - DNA, 22 bp, Artificial Sequence
  chemically synthesized
ggaaatgacatatcatcacaaa

SEQ ID NO: 1021143 - DNA, 22 bp, Artificial Sequence
  chemically synthesized
gaaatgacatatcatcacaaaa

SEQ ID NO: 1021144 - DNA, 22 bp, Artificial Sequence
  chemically synthesized
gattcagtgactcttttgtgat

SEQ ID NO: 1021145 - DNA, 22 bp, Artificial Sequence
  chemically synthesized
agtgtggactagattcagtgac

SEQ ID NO: 1021146 - DNA, 22 bp, Artificial Sequence
  chemically synthesized
tcattgagtgtggactagattc

SEQ ID NO: 1021147 - DNA, 22 bp, Artificial Sequence
  chemically synthesized
aatgtccctgtcattgagtgtg

SEQ ID NO: 1021148 - DNA, 22 bp, Artificial Sequence
  chemically synthesized
aatctagtccacactcaatgac

SEQ ID NO: 1021149 - DNA, 22 bp, Artificial Sequence
  chemically synthesized
cagctaaatgtccctgtcattg

SEQ ID NO: 1021150 - DNA, 22 bp, Artificial Sequence
  chemically synthesized
gtccacactcaatgacagggac

SEQ ID NO: 1021151 - DNA, 22 bp, Artificial Sequence
  chemically synthesized
aagagttacagctaaatgtccc

SEQ ID NO: 1021152 - DNA, 22 bp, Artificial Sequence
  chemically synthesized
ttcaagagttacagctaaatgt

SEQ ID NO: 1021153 - DNA, 22 bp, Artificial Sequence
  chemically synthesized
aatgacagggacatttagctgt

SEQ ID NO: 1021154 - DNA, 22 bp, Artificial Sequence
  chemically synthesized
tattcaagagttacagctaaat

SEQ ID NO: 1021155 - DNA, 22 bp, Artificial Sequence
  chemically synthesized
ctattcaagagttacagctaaa

SEQ ID NO: 1021156 - DNA, 22 bp, Artificial Sequence
  chemically synthesized
ttctattcaagagttacagcta

SEQ ID NO: 1021157 - DNA, 22 bp, Artificial Sequence
  chemically synthesized
tgatgctcttctattcaagagt

SEQ ID NO: 1021158 - DNA, 22 bp, Artificial Sequence
  chemically synthesized
tgtgatgctcttctattcaaga

SEQ ID NO: 1021159 - DNA, 22 bp, Artificial Sequence
  chemically synthesized
agctgtaactcttgaatagaag

SEQ ID NO: 1021160 - DNA, 22 bp, Artificial Sequence
  chemically synthesized
gctgtaactcttgaatagaaga

SEQ ID NO: 1021161 - DNA, 22 bp, Artificial Sequence
  chemically synthesized
taactcttgaatagaagagcat

SEQ ID NO: 1021162 - DNA, 22 bp, Artificial Sequence
  chemically synthesized
acaaattctgtgatgctcttct

SEQ ID NO: 1021163 - DNA, 22 bp, Artificial Sequence
  chemically synthesized
tgttcacaaattctgtgatgct

SEQ ID NO: 1021164 - DNA, 22 bp, Artificial Sequence
  chemically synthesized
ttgaatagaagagcatcacaga

SEQ ID NO: 1021165 - DNA, 22 bp, Artificial Sequence
  chemically synthesized
gaatagaagagcatcacagaat

SEQ ID NO: 1021166 - DNA, 22 bp, Artificial Sequence
  chemically synthesized
aatagaagagcatcacagaatt

SEQ ID NO: 1021167 - DNA, 22 bp, Artificial Sequence
  chemically synthesized
tatgaaattatgttcacaaatt

SEQ ID NO: 1021168 - DNA, 22 bp, Artificial Sequence
  chemically synthesized
atatcctatatgaaattatgtt

SEQ ID NO: 1021169 - DNA, 22 bp, Artificial Sequence
  chemically synthesized
catatcctatatgaaattatgt

SEQ ID NO: 1021170 - DNA, 22 bp, Artificial Sequence
  chemically synthesized
atttcatatcctatatgaaatt

SEQ ID NO: 1021171 - DNA, 22 bp, Artificial Sequence
  chemically synthesized
gatttcatatcctatatgaaat

SEQ ID NO: 1021172 - DNA, 22 bp, Artificial Sequence
  chemically synthesized
tgatttcatatcctatatgaaa

SEQ ID NO: 1021173 - DNA, 22 bp, Artificial Sequence
  chemically synthesized
gtgaacataatttcatatagga

SEQ ID NO: 1021174 - DNA, 22 bp, Artificial Sequence
  chemically synthesized
tgaacataatttcatataggat

SEQ ID NO: 1021175 - DNA, 22 bp, Artificial Sequence
  chemically synthesized
gctttgatttcatatcctatat

SEQ ID NO: 1021176 - DNA, 22 bp, Artificial Sequence
  chemically synthesized
ggctttgatttcatatcctata

SEQ ID NO: 1021177 - DNA, 22 bp, Artificial Sequence
  chemically synthesized
tggctttgatttcatatcctat

SEQ ID NO: 1021178 - DNA, 22 bp, Artificial Sequence
  chemically synthesized
actttggctttgatttcatatc

SEQ ID NO: 1021179 - DNA, 22 bp, Artificial Sequence
  chemically synthesized
catataggatatgaaatcaaag

SEQ ID NO: 1021180 - DNA, 22 bp, Artificial Sequence
  chemically synthesized
atataggatatgaaatcaaagc

SEQ ID NO: 1021181 - DNA, 22 bp, Artificial Sequence
  chemically synthesized
ggaataattaactttggctttg

SEQ ID NO: 1021182 - DNA, 22 bp, Artificial Sequence
  chemically synthesized
taggaataattaactttggctt

SEQ ID NO: 1021183 - DNA, 22 bp, Artificial Sequence
  chemically synthesized
ctaggaataattaactttggct

SEQ ID NO: 1021184 - DNA, 22 bp, Artificial Sequence
  chemically synthesized
aacttctaggaataattaactt

SEQ ID NO: 1021185 - DNA, 22 bp, Artificial Sequence
  chemically synthesized
aaacttctaggaataattaact

SEQ ID NO: 1021186 - DNA, 22 bp, Artificial Sequence
  chemically synthesized
taaacttctaggaataattaac

SEQ ID NO: 1021187 - DNA, 22 bp, Artificial Sequence
  chemically synthesized
ctttaaacttctaggaataatt

SEQ ID NO: 1021188 - DNA, 22 bp, Artificial Sequence
  chemically synthesized
cctttaaacttctaggaataat

SEQ ID NO: 1021189 - DNA, 22 bp, Artificial Sequence
  chemically synthesized
attattcctagaagtttaaagg

SEQ ID NO: 1021190 - DNA, 22 bp, Artificial Sequence
  chemically synthesized
ttcctagaagtttaaaggaagt

SEQ ID NO: 1021191 - DNA, 22 bp, Artificial Sequence
  chemically synthesized
ctagaagtttaaaggaagtgtt

SEQ ID NO: 1021192 - DNA, 22 bp, Artificial Sequence
  chemically synthesized
gaagtttaaaggaagtgttcct

SEQ ID NO: 1021193 - DNA, 22 bp, Artificial Sequence
  chemically synthesized
aaaggaagtgttcctttctgct

SEQ ID NO: 1021194 - DNA, 22 bp, Artificial Sequence
  chemically synthesized
aaggaagtgttcctttctgcta

SEQ ID NO: 1021195 - DNA, 22 bp, Artificial Sequence
  chemically synthesized
agcaatagccatggaaaatagc

SEQ ID NO: 1021196 - DNA, 22 bp, Artificial Sequence
  chemically synthesized
cagcaatagccatggaaaatag

SEQ ID NO: 1021197 - DNA, 22 bp, Artificial Sequence
  chemically synthesized
tcagcaatagccatggaaaata

SEQ ID NO: 1021198 - DNA, 22 bp, Artificial Sequence
  chemically synthesized
ttcagcaatagccatggaaaat

SEQ ID NO: 1021199 - DNA, 22 bp, Artificial Sequence
  chemically synthesized
ctttctgctattttccatggct

SEQ ID NO: 1021200 - DNA, 22 bp, Artificial Sequence
  chemically synthesized
gacttttcagcaatagccatgg

SEQ ID NO: 1021201 - DNA, 22 bp, Artificial Sequence
  chemically synthesized
tctgctattttccatggctatt

SEQ ID NO: 1021202 - DNA, 22 bp, Artificial Sequence
  chemically synthesized
ggacttttcagcaatagccatg

SEQ ID NO: 1021203 - DNA, 22 bp, Artificial Sequence
  chemically synthesized
ctgctattttccatggctattg

SEQ ID NO: 1021204 - DNA, 22 bp, Artificial Sequence
  chemically synthesized
tggacttttcagcaatagccat

SEQ ID NO: 1021205 - DNA, 22 bp, Artificial Sequence
  chemically synthesized
tgctattttccatggctattgc

SEQ ID NO: 1021206 - DNA, 22 bp, Artificial Sequence
  chemically synthesized
ctattttccatggctattgctg

SEQ ID NO: 1021207 - DNA, 22 bp, Artificial Sequence
  chemically synthesized
ttttccatggctattgctgaaa

SEQ ID NO: 1021208 - DNA, 22 bp, Artificial Sequence
  chemically synthesized
tccatggctattgctgaaaagt

SEQ ID NO: 1021209 - DNA, 22 bp, Artificial Sequence
  chemically synthesized
ccatggctattgctgaaaagtc

SEQ ID NO: 1021210 - DNA, 22 bp, Artificial Sequence
  chemically synthesized
catggctattgctgaaaagtcc

SEQ ID NO: 1021211 - DNA, 22 bp, Artificial Sequence
  chemically synthesized
ttgctgaaaagtccaaagccat

SEQ ID NO: 1021212 - DNA, 22 bp, Artificial Sequence
  chemically synthesized
ctgaaaagtccaaagccattct

SEQ ID NO: 1021213 - DNA, 22 bp, Artificial Sequence
  chemically synthesized
acagatcagaaatcagaatggc

SEQ ID NO: 1021214 - DNA, 22 bp, Artificial Sequence
  chemically synthesized
aaaagtccaaagccattctgat

SEQ ID NO: 1021215 - DNA, 22 bp, Artificial Sequence
  chemically synthesized
tgatttctgatctgtgaacttc

SEQ ID NO: 1021216 - DNA, 22 bp, Artificial Sequence
  chemically synthesized
atttctgatctgtgaacttctc

SEQ ID NO: 1021217 - DNA, 22 bp, Artificial Sequence
  chemically synthesized
ctgatctgtgaacttctctttg

SEQ ID NO: 1021218 - DNA, 22 bp, Artificial Sequence
  chemically synthesized
caaaaacaaggacaaagagaag

SEQ ID NO: 1021219 - DNA, 22 bp, Artificial Sequence
  chemically synthesized
tgatctgtgaacttctctttgt

SEQ ID NO: 1021220 - DNA, 22 bp, Artificial Sequence
  chemically synthesized
acaaaaacaaggacaaagagaa

SEQ ID NO: 1021221 - DNA, 22 bp, Artificial Sequence
  chemically synthesized
tacaaaaacaaggacaaagaga

SEQ ID NO: 1021222 - DNA, 22 bp, Artificial Sequence
  chemically synthesized
atctgtgaacttctctttgtcc

SEQ ID NO: 1021223 - DNA, 22 bp, Artificial Sequence
  chemically synthesized
ttacaaaaacaaggacaaagag

SEQ ID NO: 1021224 - DNA, 22 bp, Artificial Sequence
  chemically synthesized
tgaacttctctttgtccttgtt

SEQ ID NO: 1021225 - DNA, 22 bp, Artificial Sequence
  chemically synthesized
ctctttgtccttgtttttgtaa

SEQ ID NO: 1021226 - DNA, 22 bp, Artificial Sequence
  chemically synthesized
tctttgtccttgtttttgtaaa

SEQ ID NO: 1021227 - DNA, 22 bp, Artificial Sequence
  chemically synthesized
atcatcataaatttttacaaaa

SEQ ID NO: 1021228 - DNA, 22 bp, Artificial Sequence
  chemically synthesized
tttgtccttgtttttgtaaaaa

SEQ ID NO: 1021229 - DNA, 22 bp, Artificial Sequence
  chemically synthesized
tgtccttgtttttgtaaaaatt

SEQ ID NO: 1021230 - DNA, 22 bp, Artificial Sequence
  chemically synthesized
gtccttgtttttgtaaaaattt

SEQ ID NO: 1021231 - DNA, 22 bp, Artificial Sequence
  chemically synthesized
tccttgtttttgtaaaaattta

SEQ ID NO: 1021232 - DNA, 22 bp, Artificial Sequence
  chemically synthesized
gtttttgtaaaaatttatgatg

SEQ ID NO: 1021233 - DNA, 22 bp, Artificial Sequence
  chemically synthesized
tttttgtaaaaatttatgatga

SEQ ID NO: 1021234 - DNA, 22 bp, Artificial Sequence
  chemically synthesized
caccaaggctcatcatcataaa

SEQ ID NO: 1021235 - DNA, 22 bp, Artificial Sequence
  chemically synthesized
ttgtaaaaatttatgatgatga

SEQ ID NO: 1021236 - DNA, 22 bp, Artificial Sequence
  chemically synthesized
tgtaaaaatttatgatgatgag

SEQ ID NO: 1021237 - DNA, 22 bp, Artificial Sequence
  chemically synthesized
gtaaaaatttatgatgatgagc

SEQ ID NO: 1021238 - DNA, 22 bp, Artificial Sequence
  chemically synthesized
taaaaatttatgatgatgagcc

SEQ ID NO: 1021239 - DNA, 22 bp, Artificial Sequence
  chemically synthesized
aaaatctacaccaaggctcatc

SEQ ID NO: 1021240 - DNA, 22 bp, Artificial Sequence
  chemically synthesized
atgatgatgagccttggtgtag

SEQ ID NO: 1021241 - DNA, 22 bp, Artificial Sequence
  chemically synthesized
tgatgatgagccttggtgtaga

SEQ ID NO: 1021242 - DNA, 22 bp, Artificial Sequence
  chemically synthesized
ggtgtagatttttagctcattt

SEQ ID NO: 1021243 - DNA, 22 bp, Artificial Sequence
  chemically synthesized
gtgtagatttttagctcatttg

SEQ ID NO: 1021244 - DNA, 22 bp, Artificial Sequence
  chemically synthesized
aatgcccagcacagcaaatgag

SEQ ID NO: 1021245 - DNA, 22 bp, Artificial Sequence
  chemically synthesized
ctaaatgcccagcacagcaaat

SEQ ID NO: 1021246 - DNA, 22 bp, Artificial Sequence
  chemically synthesized
actaaatgcccagcacagcaaa

SEQ ID NO: 1021247 - DNA, 22 bp, Artificial Sequence
  chemically synthesized
ttagctcatttgctgtgctggg

SEQ ID NO: 1021248 - DNA, 22 bp, Artificial Sequence
  chemically synthesized
tagctcatttgctgtgctgggc

SEQ ID NO: 1021249 - DNA, 22 bp, Artificial Sequence
  chemically synthesized
agctcatttgctgtgctgggca

SEQ ID NO: 1021250 - DNA, 22 bp, Artificial Sequence
  chemically synthesized
gctcatttgctgtgctgggcat

SEQ ID NO: 1021251 - DNA, 22 bp, Artificial Sequence
  chemically synthesized
aagggcttactaaatgcccagc

SEQ ID NO: 1021252 - DNA, 22 bp, Artificial Sequence
  chemically synthesized
aaagggcttactaaatgcccag

SEQ ID NO: 1021253 - DNA, 22 bp, Artificial Sequence
  chemically synthesized
atttgctgtgctgggcatttag

SEQ ID NO: 1021254 - DNA, 22 bp, Artificial Sequence
  chemically synthesized
gctgtgctgggcatttagtaag

SEQ ID NO: 1021255 - DNA, 22 bp, Artificial Sequence
  chemically synthesized
ctgtgctgggcatttagtaagc

SEQ ID NO: 1021256 - DNA, 22 bp, Artificial Sequence
  chemically synthesized
tgctgggcatttagtaagccct

SEQ ID NO: 1021257 - DNA, 22 bp, Artificial Sequence
  chemically synthesized
ggcatttagtaagccctttaaa

SEQ ID NO: 1021258 - DNA, 22 bp, Artificial Sequence
  chemically synthesized
agtaagccctttaaacctggac

SEQ ID NO: 1021259 - DNA, 22 bp, Artificial Sequence
  chemically synthesized
aagaaaatgagtgtccaggttt

SEQ ID NO: 1021260 - DNA, 22 bp, Artificial Sequence
  chemically synthesized
gtaagccctttaaacctggaca

SEQ ID NO: 1021261 - DNA, 22 bp, Artificial Sequence
  chemically synthesized
gaactgaagaaaatgagtgtcc

SEQ ID NO: 1021262 - DNA, 22 bp, Artificial Sequence
  chemically synthesized
agaactgaagaaaatgagtgtc

SEQ ID NO: 1021263 - DNA, 22 bp, Artificial Sequence
  chemically synthesized
ttagaactgaagaaaatgagtg

SEQ ID NO: 1021264 - DNA, 22 bp, Artificial Sequence
  chemically synthesized
cttagaactgaagaaaatgagt

SEQ ID NO: 1021265 - DNA, 22 bp, Artificial Sequence
  chemically synthesized
taaacctggacactcattttct

SEQ ID NO: 1021266 - DNA, 22 bp, Artificial Sequence
  chemically synthesized
tcttagaactgaagaaaatgag

SEQ ID NO: 1021267 - DNA, 22 bp, Artificial Sequence
  chemically synthesized
aaacctggacactcattttctt

SEQ ID NO: 1021268 - DNA, 22 bp, Artificial Sequence
  chemically synthesized
aacctggacactcattttcttc

SEQ ID NO: 1021269 - DNA, 22 bp, Artificial Sequence
  chemically synthesized
gacactcattttcttcagttct

SEQ ID NO: 1021270 - DNA, 22 bp, Artificial Sequence
  chemically synthesized
attttcttcagttctaagaaaa

SEQ ID NO: 1021271 - DNA, 22 bp, Artificial Sequence
  chemically synthesized
tcttcagttctaagaaaactga

SEQ ID NO: 1021272 - DNA, 22 bp, Artificial Sequence
  chemically synthesized
cttcagttctaagaaaactgat

SEQ ID NO: 1021273 - DNA, 22 bp, Artificial Sequence
  chemically synthesized
ttcagttctaagaaaactgatg

SEQ ID NO: 1021274 - DNA, 22 bp, Artificial Sequence
  chemically synthesized
cagttctaagaaaactgatgtt

SEQ ID NO: 1021275 - DNA, 22 bp, Artificial Sequence
  chemically synthesized
agttctaagaaaactgatgttg

SEQ ID NO: 1021276 - DNA, 22 bp, Artificial Sequence
  chemically synthesized
tcaaagaagtgacaacatcagt

SEQ ID NO: 1021277 - DNA, 22 bp, Artificial Sequence
  chemically synthesized
taagaaaactgatgttgtcact

SEQ ID NO: 1021278 - DNA, 22 bp, Artificial Sequence
  chemically synthesized
agaaaactgatgttgtcacttc

SEQ ID NO: 1021279 - DNA, 22 bp, Artificial Sequence
  chemically synthesized
tggagagaaaattatcaaagaa

SEQ ID NO: 1021280 - DNA, 22 bp, Artificial Sequence
  chemically synthesized
atgttgtcacttctttgataat

SEQ ID NO: 1021281 - DNA, 22 bp, Artificial Sequence
  chemically synthesized
tcacttctttgataattttctc

SEQ ID NO: 1021282 - DNA, 22 bp, Artificial Sequence
  chemically synthesized
ctttgataattttctctccaca

SEQ ID NO: 1021283 - DNA, 22 bp, Artificial Sequence
  chemically synthesized
tttgataattttctctccacag

SEQ ID NO: 1021284 - DNA, 22 bp, Artificial Sequence
  chemically synthesized
tgataattttctctccacagtt

SEQ ID NO: 1021285 - DNA, 22 bp, Artificial Sequence
  chemically synthesized
gataattttctctccacagttg

SEQ ID NO: 1021286 - DNA, 22 bp, Artificial Sequence
  chemically synthesized
ataattttctctccacagttgc

SEQ ID NO: 1021287 - DNA, 22 bp, Artificial Sequence
  chemically synthesized
tctctccacagttgcctctctt

SEQ ID NO: 1021288 - DNA, 22 bp, Artificial Sequence
  chemically synthesized
aaaataaaacagaagagaggca

SEQ ID NO: 1021289 - DNA, 22 bp, Artificial Sequence
  chemically synthesized
ctctccacagttgcctctcttc

SEQ ID NO: 1021290 - DNA, 22 bp, Artificial Sequence
  chemically synthesized
tctccacagttgcctctcttct

SEQ ID NO: 1021291 - DNA, 22 bp, Artificial Sequence
  chemically synthesized
tccacagttgcctctcttctgt

SEQ ID NO: 1021292 - DNA, 22 bp, Artificial Sequence
  chemically synthesized
cacagttgcctctcttctgttt

SEQ ID NO: 1021293 - DNA, 22 bp, Artificial Sequence
  chemically synthesized
cctctcttctgttttattttta

SEQ ID NO: 1021294 - DNA, 22 bp, Artificial Sequence
  chemically synthesized
aaataatagatgttaaaaataa

SEQ ID NO: 1021295 - DNA, 22 bp, Artificial Sequence
  chemically synthesized
tcttctgttttatttttaacat

SEQ ID NO: 1021296 - DNA, 22 bp, Artificial Sequence
  chemically synthesized
ttctgttttatttttaacatct

SEQ ID NO: 1021297 - DNA, 22 bp, Artificial Sequence
  chemically synthesized
ctgttttatttttaacatctat

SEQ ID NO: 1021298 - DNA, 22 bp, Artificial Sequence
  chemically synthesized
tgttttatttttaacatctatt

SEQ ID NO: 1021299 - DNA, 22 bp, Artificial Sequence
  chemically synthesized
ttttatttttaacatctattat

SEQ ID NO: 1021300 - DNA, 22 bp, Artificial Sequence
  chemically synthesized
tatttttaacatctattatttg

SEQ ID NO: 1021301 - DNA, 22 bp, Artificial Sequence
  chemically synthesized
atttttaacatctattatttga

SEQ ID NO: 1021302 - DNA, 22 bp, Artificial Sequence
  chemically synthesized
tttttaacatctattatttgaa

SEQ ID NO: 1021303 - DNA, 22 bp, Artificial Sequence
  chemically synthesized
tgtaatccaacattcaaataat

SEQ ID NO: 1021304 - DNA, 22 bp, Artificial Sequence
  chemically synthesized
tatgtaatccaacattcaaata

SEQ ID NO: 1021305 - DNA, 22 bp, Artificial Sequence
  chemically synthesized
ttaacatctattatttgaatgt

SEQ ID NO: 1021306 - DNA, 22 bp, Artificial Sequence
  chemically synthesized
taacatctattatttgaatgtt

SEQ ID NO: 1021307 - DNA, 22 bp, Artificial Sequence
  chemically synthesized
aacatctattatttgaatgttg

SEQ ID NO: 1021308 - DNA, 22 bp, Artificial Sequence
  chemically synthesized
ttctatgtaatccaacattcaa

SEQ ID NO: 1021309 - DNA, 22 bp, Artificial Sequence
  chemically synthesized
acatctattatttgaatgttgg

SEQ ID NO: 1021310 - DNA, 22 bp, Artificial Sequence
  chemically synthesized
gttctatgtaatccaacattca

SEQ ID NO: 1021311 - DNA, 22 bp, Artificial Sequence
  chemically synthesized
ttatttgaatgttggattacat

SEQ ID NO: 1021312 - DNA, 22 bp, Artificial Sequence
  chemically synthesized
gaaaccttgttctatgtaatcc

SEQ ID NO: 1021313 - DNA, 22 bp, Artificial Sequence
  chemically synthesized
agaaaccttgttctatgtaatc

SEQ ID NO: 1021314 - DNA, 22 bp, Artificial Sequence
  chemically synthesized
tttgaatgttggattacataga

SEQ ID NO: 1021315 - DNA, 22 bp, Artificial Sequence
  chemically synthesized
gaatgttggattacatagaaca

SEQ ID NO: 1021316 - DNA, 22 bp, Artificial Sequence
  chemically synthesized
aatgttggattacatagaacaa

SEQ ID NO: 1021317 - DNA, 22 bp, Artificial Sequence
  chemically synthesized
tgtttagaaaccttgttctatg

SEQ ID NO: 1021318 - DNA, 22 bp, Artificial Sequence
  chemically synthesized
atgtttagaaaccttgttctat

SEQ ID NO: 1021319 - DNA, 22 bp, Artificial Sequence
  chemically synthesized
gattacatagaacaaggtttct

SEQ ID NO: 1021320 - DNA, 22 bp, Artificial Sequence
  chemically synthesized
catagaacaaggtttctaaaca

SEQ ID NO: 1021321 - DNA, 22 bp, Artificial Sequence
  chemically synthesized
aaagtgtcaatagtgtttatgt

SEQ ID NO: 1021322 - DNA, 22 bp, Artificial Sequence
  chemically synthesized
caaagtgtcaatagtgtttatg

SEQ ID NO: 1021323 - DNA, 22 bp, Artificial Sequence
  chemically synthesized
atttcaaagtgtcaatagtgtt

SEQ ID NO: 1021324 - DNA, 22 bp, Artificial Sequence
  chemically synthesized
ctaaacataaacactattgaca

SEQ ID NO: 1021325 - DNA, 22 bp, Artificial Sequence
  chemically synthesized
ctcatttcaaagtgtcaatagt

SEQ ID NO: 1021326 - DNA, 22 bp, Artificial Sequence
  chemically synthesized
taaacataaacactattgacac

SEQ ID NO: 1021327 - DNA, 22 bp, Artificial Sequence
  chemically synthesized
aacataaacactattgacactt

SEQ ID NO: 1021328 - DNA, 22 bp, Artificial Sequence
  chemically synthesized
ttgacactttgaaatgagtaat

SEQ ID NO: 1021329 - DNA, 22 bp, Artificial Sequence
  chemically synthesized
acactttgaaatgagtaattct

SEQ ID NO: 1021330 - DNA, 22 bp, Artificial Sequence
  chemically synthesized
tgaaatgagtaattcttggttg

SEQ ID NO: 1021331 - DNA, 22 bp, Artificial Sequence
  chemically synthesized
gaaatgagtaattcttggttgt

SEQ ID NO: 1021332 - DNA, 22 bp, Artificial Sequence
  chemically synthesized
aaatgagtaattcttggttgtg

SEQ ID NO: 1021333 - DNA, 22 bp, Artificial Sequence
  chemically synthesized
ttggttgtggatggctgcatgg

SEQ ID NO: 1021334 - DNA, 22 bp, Artificial Sequence
  chemically synthesized
ggttgtggatggctgcatggtg

SEQ ID NO: 1021335 - DNA, 22 bp, Artificial Sequence
  chemically synthesized
gttgtggatggctgcatggtgc

SEQ ID NO: 1021336 - DNA, 22 bp, Artificial Sequence
  chemically synthesized
tggatggctgcatggtgcattc

SEQ ID NO: 1021337 - DNA, 22 bp, Artificial Sequence
  chemically synthesized
tgaagagtgacgcaagaggaat

SEQ ID NO: 1021338 - DNA, 22 bp, Artificial Sequence
  chemically synthesized
gtgaagagtgacgcaagaggaa

SEQ ID NO: 1021339 - DNA, 22 bp, Artificial Sequence
  chemically synthesized
ttgtgaagagtgacgcaagagg

SEQ ID NO: 1021340 - DNA, 22 bp, Artificial Sequence
  chemically synthesized
catggtgcattcctcttgcgtc

SEQ ID NO: 1021341 - DNA, 22 bp, Artificial Sequence
  chemically synthesized
gcctcttgtgaagagtgacgca

SEQ ID NO: 1021342 - DNA, 22 bp, Artificial Sequence
  chemically synthesized
ctggcctcttgtgaagagtgac

SEQ ID NO: 1021343 - DNA, 22 bp, Artificial Sequence
  chemically synthesized
ctcttgcgtcactcttcacaag

SEQ ID NO: 1021344 - DNA, 22 bp, Artificial Sequence
  chemically synthesized
ttgcgtcactcttcacaagagg

SEQ ID NO: 1021345 - DNA, 22 bp, Artificial Sequence
  chemically synthesized
gcgtcactcttcacaagaggcc

SEQ ID NO: 1021346 - DNA, 22 bp, Artificial Sequence
  chemically synthesized
cgtcactcttcacaagaggcca

SEQ ID NO: 1021347 - DNA, 22 bp, Artificial Sequence
  chemically synthesized
ttcacaagaggccagtagtaca

SEQ ID NO: 1021348 - DNA, 22 bp, Artificial Sequence
  chemically synthesized
cacaagaggccagtagtacatc

SEQ ID NO: 1021349 - DNA, 22 bp, Artificial Sequence
  chemically synthesized
acaagaggccagtagtacatcc

SEQ ID NO: 1021350 - DNA, 22 bp, Artificial Sequence
  chemically synthesized
tcacaaataaggaaaggatgta

SEQ ID NO: 1021351 - DNA, 22 bp, Artificial Sequence
  chemically synthesized
gttgtcacaaataaggaaagga

SEQ ID NO: 1021352 - DNA, 22 bp, Artificial Sequence
  chemically synthesized
cgttgtcacaaataaggaaagg

SEQ ID NO: 1021353 - DNA, 22 bp, Artificial Sequence
  chemically synthesized
tcgttgtcacaaataaggaaag

SEQ ID NO: 1021354 - DNA, 22 bp, Artificial Sequence
  chemically synthesized
ttcgttgtcacaaataaggaaa

SEQ ID NO: 1021355 - DNA, 22 bp, Artificial Sequence
  chemically synthesized
tttcgttgtcacaaataaggaa

SEQ ID NO: 1021356 - DNA, 22 bp, Artificial Sequence
  chemically synthesized
tccttatttgtgacaacgaaaa

SEQ ID NO: 1021357 - DNA, 22 bp, Artificial Sequence
  chemically synthesized
ccttatttgtgacaacgaaaaa

SEQ ID NO: 1021358 - DNA, 22 bp, Artificial Sequence
  chemically synthesized
cttatttgtgacaacgaaaaag

SEQ ID NO: 1021359 - DNA, 22 bp, Artificial Sequence
  chemically synthesized
atttgtgacaacgaaaaaggtc

SEQ ID NO: 1021360 - DNA, 22 bp, Artificial Sequence
  chemically synthesized
acaatgtacggagacctttttc

SEQ ID NO: 1021361 - DNA, 22 bp, Artificial Sequence
  chemically synthesized
tttgtgacaacgaaaaaggtct

SEQ ID NO: 1021362 - DNA, 22 bp, Artificial Sequence
  chemically synthesized
gacaatgtacggagaccttttt

SEQ ID NO: 1021363 - DNA, 22 bp, Artificial Sequence
  chemically synthesized
gtgacaacgaaaaaggtctccg

SEQ ID NO: 1021364 - DNA, 22 bp, Artificial Sequence
  chemically synthesized
tgacaacgaaaaaggtctccgt

SEQ ID NO: 1021365 - DNA, 22 bp, Artificial Sequence
  chemically synthesized
cagaggacgtttgacaatgtac

SEQ ID NO: 1021366 - DNA, 22 bp, Artificial Sequence
  chemically synthesized
tcctgcagaggacgtttgacaa

SEQ ID NO: 1021367 - DNA, 22 bp, Artificial Sequence
  chemically synthesized
gtcctgcagaggacgtttgaca

SEQ ID NO: 1021368 - DNA, 22 bp, Artificial Sequence
  chemically synthesized
tgtcctgcagaggacgtttgac

SEQ ID NO: 1021369 - DNA, 22 bp, Artificial Sequence
  chemically synthesized
cgtacattgtcaaacgtcctct

SEQ ID NO: 1021370 - DNA, 22 bp, Artificial Sequence
  chemically synthesized
tcaaacgtcctctgcaggacaa

SEQ ID NO: 1021371 - DNA, 22 bp, Artificial Sequence
  chemically synthesized
acaaatagaggtgattttgtcc

SEQ ID NO: 1021372 - DNA, 22 bp, Artificial Sequence
  chemically synthesized
cacaaatagaggtgattttgtc

SEQ ID NO: 1021373 - DNA, 22 bp, Artificial Sequence
  chemically synthesized
tgcaggacaaaatcacctctat

SEQ ID NO: 1021374 - DNA, 22 bp, Artificial Sequence
  chemically synthesized
caggacaaaatcacctctattt

SEQ ID NO: 1021375 - DNA, 22 bp, Artificial Sequence
  chemically synthesized
ggtaagtgtttcacaaatagag

SEQ ID NO: 1021376 - DNA, 22 bp, Artificial Sequence
  chemically synthesized
taggtaagtgtttcacaaatag

SEQ ID NO: 1021377 - DNA, 22 bp, Artificial Sequence
  chemically synthesized
gaagatcattctaggtaagtgt

SEQ ID NO: 1021378 - DNA, 22 bp, Artificial Sequence
  chemically synthesized
agaagatcattctaggtaagtg

SEQ ID NO: 1021379 - DNA, 22 bp, Artificial Sequence
  chemically synthesized
tatttgtgaaacacttacctag

SEQ ID NO: 1021380 - DNA, 22 bp, Artificial Sequence
  chemically synthesized
tttgtgaaacacttacctagaa

SEQ ID NO: 1021381 - DNA, 22 bp, Artificial Sequence
  chemically synthesized
gtgaaacacttacctagaatga

SEQ ID NO: 1021382 - DNA, 22 bp, Artificial Sequence
  chemically synthesized
tgaaacacttacctagaatgat

SEQ ID NO: 1021383 - DNA, 22 bp, Artificial Sequence
  chemically synthesized
acctagaatgatcttctaagat

SEQ ID NO: 1021384 - DNA, 22 bp, Artificial Sequence
  chemically synthesized
cctagaatgatcttctaagatt

SEQ ID NO: 1021385 - DNA, 22 bp, Artificial Sequence
  chemically synthesized
gaatgatcttctaagattctta

SEQ ID NO: 1021386 - DNA, 22 bp, Artificial Sequence
  chemically synthesized
ctaagattcttatactctccca

SEQ ID NO: 1021387 - DNA, 22 bp, Artificial Sequence
  chemically synthesized
taagattcttatactctcccat

SEQ ID NO: 1021388 - DNA, 22 bp, Artificial Sequence
  chemically synthesized
agattcttatactctcccattt

SEQ ID NO: 1021389 - DNA, 22 bp, Artificial Sequence
  chemically synthesized
ttatactctcccattttccatg

SEQ ID NO: 1021390 - DNA, 22 bp, Artificial Sequence
  chemically synthesized
atactctcccattttccatgct

SEQ ID NO: 1021391 - DNA, 22 bp, Artificial Sequence
  chemically synthesized
tactctcccattttccatgctt

SEQ ID NO: 1021392 - DNA, 22 bp, Artificial Sequence
  chemically synthesized
tcccattttccatgcttttggc

SEQ ID NO: 1021393 - DNA, 22 bp, Artificial Sequence
  chemically synthesized
ccattttccatgcttttggcta

SEQ ID NO: 1021394 - DNA, 22 bp, Artificial Sequence
  chemically synthesized
ataaagcagtataaatagccaa

SEQ ID NO: 1021395 - DNA, 22 bp, Artificial Sequence
  chemically synthesized
tccatgcttttggctatttata

SEQ ID NO: 1021396 - DNA, 22 bp, Artificial Sequence
  chemically synthesized
ccatgcttttggctatttatac

SEQ ID NO: 1021397 - DNA, 22 bp, Artificial Sequence
  chemically synthesized
catgcttttggctatttatact

SEQ ID NO: 1021398 - DNA, 22 bp, Artificial Sequence
  chemically synthesized
ttggctatttatactgctttat

SEQ ID NO: 1021399 - DNA, 22 bp, Artificial Sequence
  chemically synthesized
aagaaatatctcataaagcagt

SEQ ID NO: 1021400 - DNA, 22 bp, Artificial Sequence
  chemically synthesized
tggctatttatactgctttatg

SEQ ID NO: 1021401 - DNA, 22 bp, Artificial Sequence
  chemically synthesized
gaagaaatatctcataaagcag

SEQ ID NO: 1021402 - DNA, 22 bp, Artificial Sequence
  chemically synthesized
ggctatttatactgctttatga

SEQ ID NO: 1021403 - DNA, 22 bp, Artificial Sequence
  chemically synthesized
gctatttatactgctttatgag

SEQ ID NO: 1021404 - DNA, 22 bp, Artificial Sequence
  chemically synthesized
tttatactgctttatgagatat

SEQ ID NO: 1021405 - DNA, 22 bp, Artificial Sequence
  chemically synthesized
atactgctttatgagatatttc

SEQ ID NO: 1021406 - DNA, 22 bp, Artificial Sequence
  chemically synthesized
tactgctttatgagatatttct

SEQ ID NO: 1021407 - DNA, 22 bp, Artificial Sequence
  chemically synthesized
ctttatgagatatttcttcaaa

SEQ ID NO: 1021408 - DNA, 22 bp, Artificial Sequence
  chemically synthesized
tatgagatatttcttcaaattt

SEQ ID NO: 1021409 - DNA, 22 bp, Artificial Sequence
  chemically synthesized
atgagatatttcttcaaattta

SEQ ID NO: 1021410 - DNA, 22 bp, Artificial Sequence
  chemically synthesized
aaaagtagaagataaatttgaa

SEQ ID NO: 1021411 - DNA, 22 bp, Artificial Sequence
  chemically synthesized
tgagatatttcttcaaatttat

SEQ ID NO: 1021412 - DNA, 22 bp, Artificial Sequence
  chemically synthesized
cttcaaatttatcttctacttt

SEQ ID NO: 1021413 - DNA, 22 bp, Artificial Sequence
  chemically synthesized
ttcaaatttatcttctactttt

SEQ ID NO: 1021414 - DNA, 22 bp, Artificial Sequence
  chemically synthesized
caaatttatcttctacttttga

SEQ ID NO: 1021415 - DNA, 22 bp, Artificial Sequence
  chemically synthesized
aaatttatcttctacttttgaa

SEQ ID NO: 1021416 - DNA, 22 bp, Artificial Sequence
  chemically synthesized
atcttctacttttgaactttta

SEQ ID NO: 1021417 - DNA, 22 bp, Artificial Sequence
  chemically synthesized
tcttctacttttgaacttttat

SEQ ID NO: 1021418 - DNA, 22 bp, Artificial Sequence
  chemically synthesized
ctacttttgaacttttatttct

SEQ ID NO: 1021419 - DNA, 22 bp, Artificial Sequence
  chemically synthesized
aaaatgaagagcagaaataaaa

SEQ ID NO: 1021420 - DNA, 22 bp, Artificial Sequence
  chemically synthesized
tacttttgaacttttatttctg

SEQ ID NO: 1021421 - DNA, 22 bp, Artificial Sequence
  chemically synthesized
cttttgaacttttatttctgct

SEQ ID NO: 1021422 - DNA, 22 bp, Artificial Sequence
  chemically synthesized
ttaaaaatgaagagcagaaata

SEQ ID NO: 1021423 - DNA, 22 bp, Artificial Sequence
  chemically synthesized
ttgaacttttatttctgctctt

SEQ ID NO: 1021424 - DNA, 22 bp, Artificial Sequence
  chemically synthesized
tgaacttttatttctgctcttc

SEQ ID NO: 1021425 - DNA, 22 bp, Artificial Sequence
  chemically synthesized
gaacttttatttctgctcttca

SEQ ID NO: 1021426 - DNA, 22 bp, Artificial Sequence
  chemically synthesized
aacttttatttctgctcttcat

SEQ ID NO: 1021427 - DNA, 22 bp, Artificial Sequence
  chemically synthesized
ttatttctgctcttcattttta

SEQ ID NO: 1021428 - DNA, 22 bp, Artificial Sequence
  chemically synthesized
tatttctgctcttcatttttaa

SEQ ID NO: 1021429 - DNA, 22 bp, Artificial Sequence
  chemically synthesized
atttctgctcttcatttttaat

SEQ ID NO: 1021430 - DNA, 22 bp, Artificial Sequence
  chemically synthesized
tttctgctcttcatttttaata

SEQ ID NO: 1021431 - DNA, 22 bp, Artificial Sequence
  chemically synthesized
aaaaatcaagtctattaaaaat

SEQ ID NO: 1021432 - DNA, 22 bp, Artificial Sequence
  chemically synthesized
aaaaaatcaagtctattaaaaa

SEQ ID NO: 1021433 - DNA, 22 bp, Artificial Sequence
  chemically synthesized
taaaaaatcaagtctattaaaa

SEQ ID NO: 1021434 - DNA, 22 bp, Artificial Sequence
  chemically synthesized
ctgctcttcatttttaatagac

SEQ ID NO: 1021435 - DNA, 22 bp, Artificial Sequence
  chemically synthesized
tgctcttcatttttaatagact

SEQ ID NO: 1021436 - DNA, 22 bp, Artificial Sequence
  chemically synthesized
ctttaaaaaatcaagtctatta

SEQ ID NO: 1021437 - DNA, 22 bp, Artificial Sequence
  chemically synthesized
ctcttcatttttaatagacttg

SEQ ID NO: 1021438 - DNA, 22 bp, Artificial Sequence
  chemically synthesized
ttcatttttaatagacttgatt

SEQ ID NO: 1021439 - DNA, 22 bp, Artificial Sequence
  chemically synthesized
catttttaatagacttgatttt

SEQ ID NO: 1021440 - DNA, 22 bp, Artificial Sequence
  chemically synthesized
atttttaatagacttgattttt

SEQ ID NO: 1021441 - DNA, 22 bp, Artificial Sequence
  chemically synthesized
ttaatagacttgattttttaaa

SEQ ID NO: 1021442 - DNA, 22 bp, Artificial Sequence
  chemically synthesized
taatagacttgattttttaaag

SEQ ID NO: 1021443 - DNA, 22 bp, Artificial Sequence
  chemically synthesized
aatagacttgattttttaaagc

SEQ ID NO: 1021444 - DNA, 22 bp, Artificial Sequence
  chemically synthesized
atagacttgattttttaaagca

SEQ ID NO: 1021445 - DNA, 22 bp, Artificial Sequence
  chemically synthesized
taaatgtaaaattgctttaaaa

SEQ ID NO: 1021446 - DNA, 22 bp, Artificial Sequence
  chemically synthesized
ctataaatgtaaaattgcttta

SEQ ID NO: 1021447 - DNA, 22 bp, Artificial Sequence
  chemically synthesized
gctataaatgtaaaattgcttt

SEQ ID NO: 1021448 - DNA, 22 bp, Artificial Sequence
  chemically synthesized
tgctataaatgtaaaattgctt

SEQ ID NO: 1021449 - DNA, 22 bp, Artificial Sequence
  chemically synthesized
gattttttaaagcaattttaca

SEQ ID NO: 1021450 - DNA, 22 bp, Artificial Sequence
  chemically synthesized
attttttaaagcaattttacat

SEQ ID NO: 1021451 - DNA, 22 bp, Artificial Sequence
  chemically synthesized
gattttgctataaatgtaaaat

SEQ ID NO: 1021452 - DNA, 22 bp, Artificial Sequence
  chemically synthesized
tttaaagcaattttacatttat

SEQ ID NO: 1021453 - DNA, 22 bp, Artificial Sequence
  chemically synthesized
ttaaagcaattttacatttata

SEQ ID NO: 1021454 - DNA, 22 bp, Artificial Sequence
  chemically synthesized
taaagcaattttacatttatag

SEQ ID NO: 1021455 - DNA, 22 bp, Artificial Sequence
  chemically synthesized
ccctcgattttgctataaatgt

SEQ ID NO: 1021456 - DNA, 22 bp, Artificial Sequence
  chemically synthesized
aaagcaattttacatttatagc

SEQ ID NO: 1021457 - DNA, 22 bp, Artificial Sequence
  chemically synthesized
cccctcgattttgctataaatg

SEQ ID NO: 1021458 - DNA, 22 bp, Artificial Sequence
  chemically synthesized
aagcaattttacatttatagca

SEQ ID NO: 1021459 - DNA, 22 bp, Artificial Sequence
  chemically synthesized
tcccctcgattttgctataaat

SEQ ID NO: 1021460 - DNA, 22 bp, Artificial Sequence
  chemically synthesized
tactttcccctcgattttgcta

SEQ ID NO: 1021461 - DNA, 22 bp, Artificial Sequence
  chemically synthesized
tgtactttcccctcgattttgc

SEQ ID NO: 1021462 - DNA, 22 bp, Artificial Sequence
  chemically synthesized
tacatttatagcaaaatcgagg

SEQ ID NO: 1021463 - DNA, 22 bp, Artificial Sequence
  chemically synthesized
acatttatagcaaaatcgaggg

SEQ ID NO: 1021464 - DNA, 22 bp, Artificial Sequence
  chemically synthesized
catttatagcaaaatcgagggg

SEQ ID NO: 1021465 - DNA, 22 bp, Artificial Sequence
  chemically synthesized
atagcaaaatcgaggggaaagt

SEQ ID NO: 1021466 - DNA, 22 bp, Artificial Sequence
  chemically synthesized
tagcaaaatcgaggggaaagta

SEQ ID NO: 1021467 - DNA, 22 bp, Artificial Sequence
  chemically synthesized
cccgtatactctctggccccct

SEQ ID NO: 1021468 - DNA, 22 bp, Artificial Sequence
  chemically synthesized
ccgtatactctctggccccctt

SEQ ID NO: 1021469 - DNA, 22 bp, Artificial Sequence
  chemically synthesized
tgtgtaatgaggaagggggcca

SEQ ID NO: 1021470 - DNA, 22 bp, Artificial Sequence
  chemically synthesized
tctggcccccttcctcattaca

SEQ ID NO: 1021471 - DNA, 22 bp, Artificial Sequence
  chemically synthesized
tggcccccttcctcattacaca

SEQ ID NO: 1021472 - DNA, 22 bp, Artificial Sequence
  chemically synthesized
gcccccttcctcattacacaca

SEQ ID NO: 1021473 - DNA, 22 bp, Artificial Sequence
  chemically synthesized
atagcggggtaggctgtgtgta

SEQ ID NO: 1021474 - DNA, 22 bp, Artificial Sequence
  chemically synthesized
cctcattacacacagcctaccc

SEQ ID NO: 1021475 - DNA, 22 bp, Artificial Sequence
  chemically synthesized
ctcattacacacagcctacccc

SEQ ID NO: 1021476 - DNA, 22 bp, Artificial Sequence
  chemically synthesized
attacacacagcctaccccgct

SEQ ID NO: 1021477 - DNA, 22 bp, Artificial Sequence
  chemically synthesized
gtgtgggatgttgatagcgggg

SEQ ID NO: 1021478 - DNA, 22 bp, Artificial Sequence
  chemically synthesized
cacacagcctaccccgctatca

SEQ ID NO: 1021479 - DNA, 22 bp, Artificial Sequence
  chemically synthesized
tggtgtgggatgttgatagcgg

SEQ ID NO: 1021480 - DNA, 22 bp, Artificial Sequence
  chemically synthesized
ccccgctatcaacatcccacac

SEQ ID NO: 1021481 - DNA, 22 bp, Artificial Sequence
  chemically synthesized
taacaaatgtaccactctggtg

SEQ ID NO: 1021482 - DNA, 22 bp, Artificial Sequence
  chemically synthesized
tcaacatcccacaccagagtgg

SEQ ID NO: 1021483 - DNA, 22 bp, Artificial Sequence
  chemically synthesized
atgatatatcaatgtatgtaag

SEQ ID NO: 1021484 - DNA, 22 bp, Artificial Sequence
  chemically synthesized
gttataactgacttacatacat

SEQ ID NO: 1021485 - DNA, 22 bp, Artificial Sequence
  chemically synthesized
ttataactgacttacatacatt

SEQ ID NO: 1021486 - DNA, 22 bp, Artificial Sequence
  chemically synthesized
taactgacttacatacattgat

SEQ ID NO: 1021487 - DNA, 22 bp, Artificial Sequence
  chemically synthesized
gagtgttaatgatatatcaatg

SEQ ID NO: 1021488 - DNA, 22 bp, Artificial Sequence
  chemically synthesized
cgagtgttaatgatatatcaat

SEQ ID NO: 1021489 - DNA, 22 bp, Artificial Sequence
  chemically synthesized
acttacatacattgatatatca

SEQ ID NO: 1021490 - DNA, 22 bp, Artificial Sequence
  chemically synthesized
acatacattgatatatcattaa

SEQ ID NO: 1021491 - DNA, 22 bp, Artificial Sequence
  chemically synthesized
catacattgatatatcattaac

SEQ ID NO: 1021492 - DNA, 22 bp, Artificial Sequence
  chemically synthesized
tggacttcgagtgttaatgata

SEQ ID NO: 1021493 - DNA, 22 bp, Artificial Sequence
  chemically synthesized
atatatcattaacactcgaagt

SEQ ID NO: 1021494 - DNA, 22 bp, Artificial Sequence
  chemically synthesized
atgtaaactatggacttcgagt

SEQ ID NO: 1021495 - DNA, 22 bp, Artificial Sequence
  chemically synthesized
taatgtaaactatggacttcga

SEQ ID NO: 1021496 - DNA, 22 bp, Artificial Sequence
  chemically synthesized
acactcgaagtccatagtttac

SEQ ID NO: 1021497 - DNA, 22 bp, Artificial Sequence
  chemically synthesized
gaagtccatagtttacattaga

SEQ ID NO: 1021498 - DNA, 22 bp, Artificial Sequence
  chemically synthesized
acattagagtttgcttgtgatg

SEQ ID NO: 1021499 - DNA, 22 bp, Artificial Sequence
  chemically synthesized
cattagagtttgcttgtgatgt

SEQ ID NO: 1021500 - DNA, 22 bp, Artificial Sequence
  chemically synthesized
gagtttgcttgtgatgttgtat

SEQ ID NO: 1021501 - DNA, 22 bp, Artificial Sequence
  chemically synthesized
tccaaacccatagaagatacaa

SEQ ID NO: 1021502 - DNA, 22 bp, Artificial Sequence
  chemically synthesized
gtccaaacccatagaagataca

SEQ ID NO: 1021503 - DNA, 22 bp, Artificial Sequence
  chemically synthesized
gcttgtgatgttgtatcttcta

SEQ ID NO: 1021504 - DNA, 22 bp, Artificial Sequence
  chemically synthesized
cttgtgatgttgtatcttctat

SEQ ID NO: 1021505 - DNA, 22 bp, Artificial Sequence
  chemically synthesized
gtgatgttgtatcttctatggg

SEQ ID NO: 1021506 - DNA, 22 bp, Artificial Sequence
  chemically synthesized
tgatgttgtatcttctatgggt

SEQ ID NO: 1021507 - DNA, 22 bp, Artificial Sequence
  chemically synthesized
tatatttgtccaaacccataga

SEQ ID NO: 1021508 - DNA, 22 bp, Artificial Sequence
  chemically synthesized
attatatatttgtccaaaccca

SEQ ID NO: 1021509 - DNA, 22 bp, Artificial Sequence
  chemically synthesized
cattatatatttgtccaaaccc

SEQ ID NO: 1021510 - DNA, 22 bp, Artificial Sequence
  chemically synthesized
tcattatatatttgtccaaacc

SEQ ID NO: 1021511 - DNA, 22 bp, Artificial Sequence
  chemically synthesized
tatcttctatgggtttggacaa

SEQ ID NO: 1021512 - DNA, 22 bp, Artificial Sequence
  chemically synthesized
ctatgggtttggacaaatatat

SEQ ID NO: 1021513 - DNA, 22 bp, Artificial Sequence
  chemically synthesized
tatgggtttggacaaatatata

SEQ ID NO: 1021514 - DNA, 22 bp, Artificial Sequence
  chemically synthesized
tgggtttggacaaatatataat

SEQ ID NO: 1021515 - DNA, 22 bp, Artificial Sequence
  chemically synthesized
taatggtggatacctttcatta

SEQ ID NO: 1021516 - DNA, 22 bp, Artificial Sequence
  chemically synthesized
ggacaaatatataatgaaaggt

SEQ ID NO: 1021517 - DNA, 22 bp, Artificial Sequence
  chemically synthesized
gacaaatatataatgaaaggta

SEQ ID NO: 1021518 - DNA, 22 bp, Artificial Sequence
  chemically synthesized
tgtgatactataatggtggata

SEQ ID NO: 1021519 - DNA, 22 bp, Artificial Sequence
  chemically synthesized
tgtgtgatactataatggtgga

SEQ ID NO: 1021520 - DNA, 22 bp, Artificial Sequence
  chemically synthesized
ctctgtgtgatactataatggt

SEQ ID NO: 1021521 - DNA, 22 bp, Artificial Sequence
  chemically synthesized
gagcaatgaaactactctgtgt

SEQ ID NO: 1021522 - DNA, 22 bp, Artificial Sequence
  chemically synthesized
agagcaatgaaactactctgtg

SEQ ID NO: 1021523 - DNA, 22 bp, Artificial Sequence
  chemically synthesized
tagagcaatgaaactactctgt

SEQ ID NO: 1021524 - DNA, 22 bp, Artificial Sequence
  chemically synthesized
tagtatcacacagagtagtttc

SEQ ID NO: 1021525 - DNA, 22 bp, Artificial Sequence
  chemically synthesized
cattgctctaaaactgctatgc

SEQ ID NO: 1021526 - DNA, 22 bp, Artificial Sequence
  chemically synthesized
attgctctaaaactgctatgca

SEQ ID NO: 1021527 - DNA, 22 bp, Artificial Sequence
  chemically synthesized
ctctaaaactgctatgcatacc

SEQ ID NO: 1021528 - DNA, 22 bp, Artificial Sequence
  chemically synthesized
gaataacatacatggtatgcat

SEQ ID NO: 1021529 - DNA, 22 bp, Artificial Sequence
  chemically synthesized
taaaactgctatgcataccatg

SEQ ID NO: 1021530 - DNA, 22 bp, Artificial Sequence
  chemically synthesized
aaactgctatgcataccatgta

SEQ ID NO: 1021531 - DNA, 22 bp, Artificial Sequence
  chemically synthesized
ctatgcataccatgtatgttat

SEQ ID NO: 1021532 - DNA, 22 bp, Artificial Sequence
  chemically synthesized
tgcataccatgtatgttattcc

SEQ ID NO: 1021533 - DNA, 22 bp, Artificial Sequence
  chemically synthesized
gtatatccaccactggaataac

SEQ ID NO: 1021534 - DNA, 22 bp, Artificial Sequence
  chemically synthesized
agtatatccaccactggaataa

SEQ ID NO: 1021535 - DNA, 22 bp, Artificial Sequence
  chemically synthesized
tagtatatccaccactggaata

SEQ ID NO: 1021536 - DNA, 22 bp, Artificial Sequence
  chemically synthesized
ttagtatatccaccactggaat

SEQ ID NO: 1021537 - DNA, 22 bp, Artificial Sequence
  chemically synthesized
ttccagtggtggatatactaaa

SEQ ID NO: 1021538 - DNA, 22 bp, Artificial Sequence
  chemically synthesized
cagtggtggatatactaaaagc

SEQ ID NO: 1021539 - DNA, 22 bp, Artificial Sequence
  chemically synthesized
tagtggtgaaggcagagctttt

SEQ ID NO: 1021540 - DNA, 22 bp, Artificial Sequence
  chemically synthesized
atagtggtgaaggcagagcttt

SEQ ID NO: 1021541 - DNA, 22 bp, Artificial Sequence
  chemically synthesized
tatagtggtgaaggcagagctt

SEQ ID NO: 1021542 - DNA, 22 bp, Artificial Sequence
  chemically synthesized
aaagctctgccttcaccactat

SEQ ID NO: 1021543 - DNA, 22 bp, Artificial Sequence
  chemically synthesized
tatgaatatattttatagtggt

SEQ ID NO: 1021544 - DNA, 22 bp, Artificial Sequence
  chemically synthesized
ttatatgaatatattttatagt

SEQ ID NO: 1021545 - DNA, 22 bp, Artificial Sequence
  chemically synthesized
gttatatgaatatattttatag

SEQ ID NO: 1021546 - DNA, 22 bp, Artificial Sequence
  chemically synthesized
tgccttcaccactataaaatat

SEQ ID NO: 1021547 - DNA, 22 bp, Artificial Sequence
  chemically synthesized
tgttatatgaatatattttata

SEQ ID NO: 1021548 - DNA, 22 bp, Artificial Sequence
  chemically synthesized
ccttcaccactataaaatatat

SEQ ID NO: 1021549 - DNA, 22 bp, Artificial Sequence
  chemically synthesized
caccactataaaatatattcat

SEQ ID NO: 1021550 - DNA, 22 bp, Artificial Sequence
  chemically synthesized
accactataaaatatattcata

SEQ ID NO: 1021551 - DNA, 22 bp, Artificial Sequence
  chemically synthesized
ccagtgtaattttgttatatga

SEQ ID NO: 1021552 - DNA, 22 bp, Artificial Sequence
  chemically synthesized
taaaatatattcatataacaaa

SEQ ID NO: 1021553 - DNA, 22 bp, Artificial Sequence
  chemically synthesized
tgggttaccagtgtaattttgt

SEQ ID NO: 1021554 - DNA, 22 bp, Artificial Sequence
  chemically synthesized
atgggttaccagtgtaattttg

SEQ ID NO: 1021555 - DNA, 22 bp, Artificial Sequence
  chemically synthesized
atataacaaaattacactggta

SEQ ID NO: 1021556 - DNA, 22 bp, Artificial Sequence
  chemically synthesized
tataaatttatgggttaccagt

SEQ ID NO: 1021557 - DNA, 22 bp, Artificial Sequence
  chemically synthesized
attgtataaatttatgggttac

SEQ ID NO: 1021558 - DNA, 22 bp, Artificial Sequence
  chemically synthesized
aattgtataaatttatgggtta

SEQ ID NO: 1021559 - DNA, 22 bp, Artificial Sequence
  chemically synthesized
ttaattgtataaatttatgggt

SEQ ID NO: 1021560 - DNA, 22 bp, Artificial Sequence
  chemically synthesized
cactggtaacccataaatttat

SEQ ID NO: 1021561 - DNA, 22 bp, Artificial Sequence
  chemically synthesized
aattcttaattgtataaattta

SEQ ID NO: 1021562 - DNA, 22 bp, Artificial Sequence
  chemically synthesized
aaattcttaattgtataaattt

SEQ ID NO: 1021563 - DNA, 22 bp, Artificial Sequence
  chemically synthesized
taaattcttaattgtataaatt

SEQ ID NO: 1021564 - DNA, 22 bp, Artificial Sequence
  chemically synthesized
ttaaattcttaattgtataaat

SEQ ID NO: 1021565 - DNA, 22 bp, Artificial Sequence
  chemically synthesized
gtaacccataaatttatacaat

SEQ ID NO: 1021566 - DNA, 22 bp, Artificial Sequence
  chemically synthesized
agtttttaaattcttaattgta

SEQ ID NO: 1021567 - DNA, 22 bp, Artificial Sequence
  chemically synthesized
atacaattaagaatttaaaaac

SEQ ID NO: 1021568 - DNA, 22 bp, Artificial Sequence
  chemically synthesized
tacaattaagaatttaaaaact

SEQ ID NO: 1021569 - DNA, 22 bp, Artificial Sequence
  chemically synthesized
atagtatagcaggttaagtttt

SEQ ID NO: 1021570 - DNA, 22 bp, Artificial Sequence
  chemically synthesized
agaatttaaaaacttaacctgc

SEQ ID NO: 1021571 - DNA, 22 bp, Artificial Sequence
  chemically synthesized
aattaatagtatagcaggttaa

SEQ ID NO: 1021572 - DNA, 22 bp, Artificial Sequence
  chemically synthesized
aaattaatagtatagcaggtta

SEQ ID NO: 1021573 - DNA, 22 bp, Artificial Sequence
  chemically synthesized
tttaaattaatagtatagcagg

SEQ ID NO: 1021574 - DNA, 22 bp, Artificial Sequence
  chemically synthesized
aaaaacttaacctgctatacta

SEQ ID NO: 1021575 - DNA, 22 bp, Artificial Sequence
  chemically synthesized
aaaacttaacctgctatactat

SEQ ID NO: 1021576 - DNA, 22 bp, Artificial Sequence
  chemically synthesized
aacctgctatactattaattta

SEQ ID NO: 1021577 - DNA, 22 bp, Artificial Sequence
  chemically synthesized
acctgctatactattaatttaa

SEQ ID NO: 1021578 - DNA, 22 bp, Artificial Sequence
  chemically synthesized
ctatactattaatttaaataac

SEQ ID NO: 1021579 - DNA, 22 bp, Artificial Sequence
  chemically synthesized
cgagaaagataagggttattta

SEQ ID NO: 1021580 - DNA, 22 bp, Artificial Sequence
  chemically synthesized
tactattaatttaaataaccct

SEQ ID NO: 1021581 - DNA, 22 bp, Artificial Sequence
  chemically synthesized
ccgagaaagataagggttattt

SEQ ID NO: 1021582 - DNA, 22 bp, Artificial Sequence
  chemically synthesized
ttaatttaaataacccttatct

SEQ ID NO: 1021583 - DNA, 22 bp, Artificial Sequence
  chemically synthesized
atttaaataacccttatctttc

SEQ ID NO: 1021584 - DNA, 22 bp, Artificial Sequence
  chemically synthesized
aaataacccttatctttctcgg

SEQ ID NO: 1021585 - DNA, 22 bp, Artificial Sequence
  chemically synthesized
aataacccttatctttctcgga

SEQ ID NO: 1021586 - DNA, 22 bp, Artificial Sequence
  chemically synthesized
tagaaggtggtatttccgagaa

SEQ ID NO: 1021587 - DNA, 22 bp, Artificial Sequence
  chemically synthesized
atctttctcggaaataccacct

SEQ ID NO: 1021588 - DNA, 22 bp, Artificial Sequence
  chemically synthesized
tctttctcggaaataccacctt

SEQ ID NO: 1021589 - DNA, 22 bp, Artificial Sequence
  chemically synthesized
tctcggaaataccaccttctat

SEQ ID NO: 1021590 - DNA, 22 bp, Artificial Sequence
  chemically synthesized
ctcggaaataccaccttctata

SEQ ID NO: 1021591 - DNA, 22 bp, Artificial Sequence
  chemically synthesized
tcggaaataccaccttctatag

SEQ ID NO: 1021592 - DNA, 22 bp, Artificial Sequence
  chemically synthesized
ggaaataccaccttctatagtc

SEQ ID NO: 1021593 - DNA, 22 bp, Artificial Sequence
  chemically synthesized
ataagaaagaacaagagactat

SEQ ID NO: 1021594 - DNA, 22 bp, Artificial Sequence
  chemically synthesized
tattcataagaaagaacaagag

SEQ ID NO: 1021595 - DNA, 22 bp, Artificial Sequence
  chemically synthesized
ctatagtctcttgttctttctt

SEQ ID NO: 1021596 - DNA, 22 bp, Artificial Sequence
  chemically synthesized
tatagtctcttgttctttctta

SEQ ID NO: 1021597 - DNA, 22 bp, Artificial Sequence
  chemically synthesized
gtcactgtattcataagaaaga

SEQ ID NO: 1021598 - DNA, 22 bp, Artificial Sequence
  chemically synthesized
tagtctcttgttctttcttatg

SEQ ID NO: 1021599 - DNA, 22 bp, Artificial Sequence
  chemically synthesized
ttgttctttcttatgaatacag

SEQ ID NO: 1021600 - DNA, 22 bp, Artificial Sequence
  chemically synthesized
gttctttcttatgaatacagtg

SEQ ID NO: 1021601 - DNA, 22 bp, Artificial Sequence
  chemically synthesized
ttctttcttatgaatacagtga

SEQ ID NO: 1021602 - DNA, 22 bp, Artificial Sequence
  chemically synthesized
acagtgagactagtcactgtat

SEQ ID NO: 1021603 - DNA, 22 bp, Artificial Sequence
  chemically synthesized
tttcttatgaatacagtgacta

SEQ ID NO: 1021604 - DNA, 22 bp, Artificial Sequence
  chemically synthesized
tcttatgaatacagtgactagt

SEQ ID NO: 1021605 - DNA, 22 bp, Artificial Sequence
  chemically synthesized
tctcacagtgagactagtcact

SEQ ID NO: 1021606 - DNA, 22 bp, Artificial Sequence
  chemically synthesized
cttatgaatacagtgactagtc

SEQ ID NO: 1021607 - DNA, 22 bp, Artificial Sequence
  chemically synthesized
ttatgaatacagtgactagtct

SEQ ID NO: 1021608 - DNA, 22 bp, Artificial Sequence
  chemically synthesized
ttatctcacagtgagactagtc

SEQ ID NO: 1021609 - DNA, 22 bp, Artificial Sequence
  chemically synthesized
atgaatacagtgactagtctca

SEQ ID NO: 1021610 - DNA, 22 bp, Artificial Sequence
  chemically synthesized
tgaatacagtgactagtctcac

SEQ ID NO: 1021611 - DNA, 22 bp, Artificial Sequence
  chemically synthesized
taaaattattatctcacagtga

SEQ ID NO: 1021612 - DNA, 22 bp, Artificial Sequence
  chemically synthesized
gtctcactgtgagataataatt

SEQ ID NO: 1021613 - DNA, 22 bp, Artificial Sequence
  chemically synthesized
aagatagctataaaattattat

SEQ ID NO: 1021614 - DNA, 22 bp, Artificial Sequence
  chemically synthesized
aaagatagctataaaattatta

SEQ ID NO: 1021615 - DNA, 22 bp, Artificial Sequence
  chemically synthesized
taaagatagctataaaattatt

SEQ ID NO: 1021616 - DNA, 22 bp, Artificial Sequence
  chemically synthesized
ttaaagatagctataaaattat

SEQ ID NO: 1021617 - DNA, 22 bp, Artificial Sequence
  chemically synthesized
actgtgagataataattttata

SEQ ID NO: 1021618 - DNA, 22 bp, Artificial Sequence
  chemically synthesized
tttaaagatagctataaaatta

SEQ ID NO: 1021619 - DNA, 22 bp, Artificial Sequence
  chemically synthesized
tgagataataattttatagcta

SEQ ID NO: 1021620 - DNA, 22 bp, Artificial Sequence
  chemically synthesized
agaaaactttttaaagatagct

SEQ ID NO: 1021621 - DNA, 22 bp, Artificial Sequence
  chemically synthesized
aagaaaactttttaaagatagc

SEQ ID NO: 1021622 - DNA, 22 bp, Artificial Sequence
  chemically synthesized
tatagctatctttaaaaagttt

SEQ ID NO: 1021623 - DNA, 22 bp, Artificial Sequence
  chemically synthesized
atagctatctttaaaaagtttt

SEQ ID NO: 1021624 - DNA, 22 bp, Artificial Sequence
  chemically synthesized
tagctatctttaaaaagttttc

SEQ ID NO: 1021625 - DNA, 22 bp, Artificial Sequence
  chemically synthesized
tctttaaaaagttttcttaagg

SEQ ID NO: 1021626 - DNA, 22 bp, Artificial Sequence
  chemically synthesized
taaaaagttttcttaaggtcta

SEQ ID NO: 1021627 - DNA, 22 bp, Artificial Sequence
  chemically synthesized
aaaaagttttcttaaggtctat

SEQ ID NO: 1021628 - DNA, 22 bp, Artificial Sequence
  chemically synthesized
aaaagttttcttaaggtctatg

SEQ ID NO: 1021629 - DNA, 22 bp, Artificial Sequence
  chemically synthesized
cagaaagagagacaaggcatag

SEQ ID NO: 1021630 - DNA, 22 bp, Artificial Sequence
  chemically synthesized
tgcagaaagagagacaaggcat

SEQ ID NO: 1021631 - DNA, 22 bp, Artificial Sequence
  chemically synthesized
tcttaaggtctatgccttgtct

SEQ ID NO: 1021632 - DNA, 22 bp, Artificial Sequence
  chemically synthesized
cttaaggtctatgccttgtctc

SEQ ID NO: 1021633 - DNA, 22 bp, Artificial Sequence
  chemically synthesized
ttaaggtctatgccttgtctct

SEQ ID NO: 1021634 - DNA, 22 bp, Artificial Sequence
  chemically synthesized
aaggtctatgccttgtctctct

SEQ ID NO: 1021635 - DNA, 22 bp, Artificial Sequence
  chemically synthesized
aggtctatgccttgtctctctt

SEQ ID NO: 1021636 - DNA, 22 bp, Artificial Sequence
  chemically synthesized
tgccttgtctctctttctgcag

SEQ ID NO: 1021637 - DNA, 22 bp, Artificial Sequence
  chemically synthesized
gtctctctttctgcagagattt

SEQ ID NO: 1021638 - DNA, 22 bp, Artificial Sequence
  chemically synthesized
tctctctttctgcagagatttc

SEQ ID NO: 1021639 - DNA, 22 bp, Artificial Sequence
  chemically synthesized
tctttctgcagagatttctgtt

SEQ ID NO: 1021640 - DNA, 22 bp, Artificial Sequence
  chemically synthesized
tttctgcagagatttctgtttc

SEQ ID NO: 1021641 - DNA, 22 bp, Artificial Sequence
  chemically synthesized
tctgcagagatttctgtttcat

SEQ ID NO: 1021642 - DNA, 22 bp, Artificial Sequence
  chemically synthesized
ctgcagagatttctgtttcatt

SEQ ID NO: 1021643 - DNA, 22 bp, Artificial Sequence
  chemically synthesized
tgcagagatttctgtttcattt

SEQ ID NO: 1021644 - DNA, 22 bp, Artificial Sequence
  chemically synthesized
cagagatttctgtttcatttat

SEQ ID NO: 1021645 - DNA, 22 bp, Artificial Sequence
  chemically synthesized
ggaaaaaaacaatagccacata

SEQ ID NO: 1021646 - DNA, 22 bp, Artificial Sequence
  chemically synthesized
ctgtttcatttatgtggctatt

SEQ ID NO: 1021647 - DNA, 22 bp, Artificial Sequence
  chemically synthesized
tgtttcatttatgtggctattg

SEQ ID NO: 1021648 - DNA, 22 bp, Artificial Sequence
  chemically synthesized
tttcatttatgtggctattgtt

SEQ ID NO: 1021649 - DNA, 22 bp, Artificial Sequence
  chemically synthesized
catttatgtggctattgttttt

SEQ ID NO: 1021650 - DNA, 22 bp, Artificial Sequence
  chemically synthesized
atttatgtggctattgtttttt

SEQ ID NO: 1021651 - DNA, 22 bp, Artificial Sequence
  chemically synthesized
atgtggctattgtttttttccc

SEQ ID NO: 1021652 - DNA, 22 bp, Artificial Sequence
  chemically synthesized
tgtggctattgtttttttccca

SEQ ID NO: 1021653 - DNA, 22 bp, Artificial Sequence
  chemically synthesized
ttgtttttttcccaatatttct

SEQ ID NO: 1021654 - DNA, 22 bp, Artificial Sequence
  chemically synthesized
tttttttcccaatatttctgct

SEQ ID NO: 1021655 - DNA, 22 bp, Artificial Sequence
  chemically synthesized
ttttcccaatatttctgctttt

SEQ ID NO: 1021656 - DNA, 22 bp, Artificial Sequence
  chemically synthesized
tttcccaatatttctgcttttt

SEQ ID NO: 1021657 - DNA, 22 bp, Artificial Sequence
  chemically synthesized
ttcccaatatttctgctttttg

SEQ ID NO: 1021658 - DNA, 22 bp, Artificial Sequence
  chemically synthesized
tcccaatatttctgctttttgt

SEQ ID NO: 1021659 - DNA, 22 bp, Artificial Sequence
  chemically synthesized
cccaatatttctgctttttgtt

SEQ ID NO: 1021660 - DNA, 22 bp, Artificial Sequence
  chemically synthesized
ccaatatttctgctttttgttt

SEQ ID NO: 1021661 - DNA, 22 bp, Artificial Sequence
  chemically synthesized
ctgctttttgtttttatgttgg

SEQ ID NO: 1021662 - DNA, 22 bp, Artificial Sequence
  chemically synthesized
tgctttttgtttttatgttggt

SEQ ID NO: 1021663 - DNA, 22 bp, Artificial Sequence
  chemically synthesized
ctttttgtttttatgttggttt

SEQ ID NO: 1021664 - DNA, 22 bp, Artificial Sequence
  chemically synthesized
tttgtttttatgttggtttctg

SEQ ID NO: 1021665 - DNA, 22 bp, Artificial Sequence
  chemically synthesized
aaagatggaagacagaaaccaa

SEQ ID NO: 1021666 - DNA, 22 bp, Artificial Sequence
  chemically synthesized
ttgtttttatgttggtttctgt

SEQ ID NO: 1021667 - DNA, 22 bp, Artificial Sequence
  chemically synthesized
tgtttttatgttggtttctgtc

SEQ ID NO: 1021668 - DNA, 22 bp, Artificial Sequence
  chemically synthesized
gtttttatgttggtttctgtct

SEQ ID NO: 1021669 - DNA, 22 bp, Artificial Sequence
  chemically synthesized
tttttatgttggtttctgtctt

SEQ ID NO: 1021670 - DNA, 22 bp, Artificial Sequence
  chemically synthesized
ttatgttggtttctgtcttcca

SEQ ID NO: 1021671 - DNA, 22 bp, Artificial Sequence
  chemically synthesized
tatgttggtttctgtcttccat

SEQ ID NO: 1021672 - DNA, 22 bp, Artificial Sequence
  chemically synthesized
atgttggtttctgtcttccatc

SEQ ID NO: 1021673 - DNA, 22 bp, Artificial Sequence
  chemically synthesized
tgttggtttctgtcttccatct

SEQ ID NO: 1021674 - DNA, 22 bp, Artificial Sequence
  chemically synthesized
aacatgtctcaaagatggaaga

SEQ ID NO: 1021675 - DNA, 22 bp, Artificial Sequence
  chemically synthesized
gaacatgtctcaaagatggaag

SEQ ID NO: 1021676 - DNA, 22 bp, Artificial Sequence
  chemically synthesized
gtttctgtcttccatctttgag

SEQ ID NO: 1021677 - DNA, 22 bp, Artificial Sequence
  chemically synthesized
ctgtcttccatctttgagacat

SEQ ID NO: 1021678 - DNA, 22 bp, Artificial Sequence
  chemically synthesized
tgtcttccatctttgagacatg

SEQ ID NO: 1021679 - DNA, 22 bp, Artificial Sequence
  chemically synthesized
cagatatttgaacatgtctcaa

SEQ ID NO: 1021680 - DNA, 22 bp, Artificial Sequence
  chemically synthesized
ccagatatttgaacatgtctca

SEQ ID NO: 1021681 - DNA, 22 bp, Artificial Sequence
  chemically synthesized
tcttccatctttgagacatgtt

SEQ ID NO: 1021682 - DNA, 22 bp, Artificial Sequence
  chemically synthesized
ccatctttgagacatgttcaaa

SEQ ID NO: 1021683 - DNA, 22 bp, Artificial Sequence
  chemically synthesized
catctttgagacatgttcaaat

SEQ ID NO: 1021684 - DNA, 22 bp, Artificial Sequence
  chemically synthesized
tgagacatgttcaaatatctgg

SEQ ID NO: 1021685 - DNA, 22 bp, Artificial Sequence
  chemically synthesized
gagacatgttcaaatatctgga

SEQ ID NO: 1021686 - DNA, 22 bp, Artificial Sequence
  chemically synthesized
agacatgttcaaatatctggaa

SEQ ID NO: 1021687 - DNA, 22 bp, Artificial Sequence
  chemically synthesized
agagacaatcaaggatttccag

SEQ ID NO: 1021688 - DNA, 22 bp, Artificial Sequence
  chemically synthesized
aagagacaatcaaggatttcca

SEQ ID NO: 1021689 - DNA, 22 bp, Artificial Sequence
  chemically synthesized
taagagacaatcaaggatttcc

SEQ ID NO: 1021690 - DNA, 22 bp, Artificial Sequence
  chemically synthesized
aaatatctggaaatccttgatt

SEQ ID NO: 1021691 - DNA, 22 bp, Artificial Sequence
  chemically synthesized
agttttaagagacaatcaagga

SEQ ID NO: 1021692 - DNA, 22 bp, Artificial Sequence
  chemically synthesized
atgcctcagttttaagagacaa

SEQ ID NO: 1021693 - DNA, 22 bp, Artificial Sequence
  chemically synthesized
gaaatccttgattgtctcttaa

SEQ ID NO: 1021694 - DNA, 22 bp, Artificial Sequence
  chemically synthesized
aatgcctcagttttaagagaca

SEQ ID NO: 1021695 - DNA, 22 bp, Artificial Sequence
  chemically synthesized
gattgtctcttaaaactgaggc

SEQ ID NO: 1021696 - DNA, 22 bp, Artificial Sequence
  chemically synthesized
attgtctcttaaaactgaggca

SEQ ID NO: 1021697 - DNA, 22 bp, Artificial Sequence
  chemically synthesized
caaaagcatttaatgcctcagt

SEQ ID NO: 1021698 - DNA, 22 bp, Artificial Sequence
  chemically synthesized
ccaaaagcatttaatgcctcag

SEQ ID NO: 1021699 - DNA, 22 bp, Artificial Sequence
  chemically synthesized
tctcttaaaactgaggcattaa

SEQ ID NO: 1021700 - DNA, 22 bp, Artificial Sequence
  chemically synthesized
ttaaaactgaggcattaaatgc

SEQ ID NO: 1021701 - DNA, 22 bp, Artificial Sequence
  chemically synthesized
aaaactgaggcattaaatgctt

SEQ ID NO: 1021702 - DNA, 22 bp, Artificial Sequence
  chemically synthesized
aaactgaggcattaaatgcttt

SEQ ID NO: 1021703 - DNA, 22 bp, Artificial Sequence
  chemically synthesized
aggcattaaatgcttttggaaa

SEQ ID NO: 1021704 - DNA, 22 bp, Artificial Sequence
  chemically synthesized
catacgcacaaggaatttccaa

SEQ ID NO: 1021705 - DNA, 22 bp, Artificial Sequence
  chemically synthesized
aatgcttttggaaattccttgt

SEQ ID NO: 1021706 - DNA, 22 bp, Artificial Sequence
  chemically synthesized
ttggaaattccttgtgcgtatg

SEQ ID NO: 1021707 - DNA, 22 bp, Artificial Sequence
  chemically synthesized
tggaaattccttgtgcgtatgt

SEQ ID NO: 1021708 - DNA, 22 bp, Artificial Sequence
  chemically synthesized
ggaaattccttgtgcgtatgta

SEQ ID NO: 1021709 - DNA, 22 bp, Artificial Sequence
  chemically synthesized
gaaattccttgtgcgtatgtag

SEQ ID NO: 1021710 - DNA, 22 bp, Artificial Sequence
  chemically synthesized
cttgtgcgtatgtagggcttat

SEQ ID NO: 1021711 - DNA, 22 bp, Artificial Sequence
  chemically synthesized
aagcccaccaagtataagccct

SEQ ID NO: 1021712 - DNA, 22 bp, Artificial Sequence
  chemically synthesized
gtgcgtatgtagggcttatact

SEQ ID NO: 1021713 - DNA, 22 bp, Artificial Sequence
  chemically synthesized
tgcgtatgtagggcttatactt

SEQ ID NO: 1021714 - DNA, 22 bp, Artificial Sequence
  chemically synthesized
atgaccatatattgaagcccac

SEQ ID NO: 1021715 - DNA, 22 bp, Artificial Sequence
  chemically synthesized
atacttggtgggcttcaatata

SEQ ID NO: 1021716 - DNA, 22 bp, Artificial Sequence
  chemically synthesized
tacttggtgggcttcaatatat

SEQ ID NO: 1021717 - DNA, 22 bp, Artificial Sequence
  chemically synthesized
tgcctaatgaccatatattgaa

SEQ ID NO: 1021718 - DNA, 22 bp, Artificial Sequence
  chemically synthesized
ggtgggcttcaatatatggtca

SEQ ID NO: 1021719 - DNA, 22 bp, Artificial Sequence
  chemically synthesized
gtgggcttcaatatatggtcat

SEQ ID NO: 1021720 - DNA, 22 bp, Artificial Sequence
  chemically synthesized
caatatatggtcattaggcaca

SEQ ID NO: 1021721 - DNA, 22 bp, Artificial Sequence
  chemically synthesized
aatatatggtcattaggcacag

SEQ ID NO: 1021722 - DNA, 22 bp, Artificial Sequence
  chemically synthesized
ggcacagatctggctatttcac

SEQ ID NO: 1021723 - DNA, 22 bp, Artificial Sequence
  chemically synthesized
atgatatgtaatgatccaccag

SEQ ID NO: 1021724 - DNA, 22 bp, Artificial Sequence
  chemically synthesized
gctatttcactggtggatcatt

SEQ ID NO: 1021725 - DNA, 22 bp, Artificial Sequence
  chemically synthesized
caattaatgatatgtaatgatc

SEQ ID NO: 1021726 - DNA, 22 bp, Artificial Sequence
  chemically synthesized
tttcactggtggatcattacat

SEQ ID NO: 1021727 - DNA, 22 bp, Artificial Sequence
  chemically synthesized
cactggtggatcattacatatc

SEQ ID NO: 1021728 - DNA, 22 bp, Artificial Sequence
  chemically synthesized
actggtggatcattacatatca

SEQ ID NO: 1021729 - DNA, 22 bp, Artificial Sequence
  chemically synthesized
gtggatcattacatatcattaa

SEQ ID NO: 1021730 - DNA, 22 bp, Artificial Sequence
  chemically synthesized
agatcatagtaacctacaatta

SEQ ID NO: 1021731 - DNA, 22 bp, Artificial Sequence
  chemically synthesized
catatcattaattgtaggttac

SEQ ID NO: 1021732 - DNA, 22 bp, Artificial Sequence
  chemically synthesized
caagaacacactcagatcatag

SEQ ID NO: 1021733 - DNA, 22 bp, Artificial Sequence
  chemically synthesized
attgtaggttactatgatctga

SEQ ID NO: 1021734 - DNA, 22 bp, Artificial Sequence
  chemically synthesized
gcaagaacacactcagatcata

SEQ ID NO: 1021735 - DNA, 22 bp, Artificial Sequence
  chemically synthesized
tgcaagaacacactcagatcat

SEQ ID NO: 1021736 - DNA, 22 bp, Artificial Sequence
  chemically synthesized
taggttactatgatctgagtgt

SEQ ID NO: 1021737 - DNA, 22 bp, Artificial Sequence
  chemically synthesized
ctatgatctgagtgtgttcttg

SEQ ID NO: 1021738 - DNA, 22 bp, Artificial Sequence
  chemically synthesized
tgatctgagtgtgttcttgcaa

SEQ ID NO: 1021739 - DNA, 22 bp, Artificial Sequence
  chemically synthesized
aacgtataaattttgcaagaac

SEQ ID NO: 1021740 - DNA, 22 bp, Artificial Sequence
  chemically synthesized
caacgtataaattttgcaagaa

SEQ ID NO: 1021741 - DNA, 22 bp, Artificial Sequence
  chemically synthesized
agtgtgttcttgcaaaatttat

SEQ ID NO: 1021742 - DNA, 22 bp, Artificial Sequence
  chemically synthesized
agggtgaggatttcaacgtata

SEQ ID NO: 1021743 - DNA, 22 bp, Artificial Sequence
  chemically synthesized
gagggtgaggatttcaacgtat

SEQ ID NO: 1021744 - DNA, 22 bp, Artificial Sequence
  chemically synthesized
ttgcaaaatttatacgttgaaa

SEQ ID NO: 1021745 - DNA, 22 bp, Artificial Sequence
  chemically synthesized
gcaaaatttatacgttgaaatc

SEQ ID NO: 1021746 - DNA, 22 bp, Artificial Sequence
  chemically synthesized
caaaatttatacgttgaaatcc

SEQ ID NO: 1021747 - DNA, 22 bp, Artificial Sequence
  chemically synthesized
atacgttgaaatcctcaccctc

SEQ ID NO: 1021748 - DNA, 22 bp, Artificial Sequence
  chemically synthesized
tacgttgaaatcctcaccctca

SEQ ID NO: 1021749 - DNA, 22 bp, Artificial Sequence
  chemically synthesized
atgtcatcaccttgagggtgag

SEQ ID NO: 1021750 - DNA, 22 bp, Artificial Sequence
  chemically synthesized
ctaatgtcatcaccttgagggt

SEQ ID NO: 1021751 - DNA, 22 bp, Artificial Sequence
  chemically synthesized
cctaatgtcatcaccttgaggg

SEQ ID NO: 1021752 - DNA, 22 bp, Artificial Sequence
  chemically synthesized
aaatcctcaccctcaaggtgat

SEQ ID NO: 1021753 - DNA, 22 bp, Artificial Sequence
  chemically synthesized
accctcaaggtgatgacattag

SEQ ID NO: 1021754 - DNA, 22 bp, Artificial Sequence
  chemically synthesized
caaaggccccacttcctaatgt

SEQ ID NO: 1021755 - DNA, 22 bp, Artificial Sequence
  chemically synthesized
ccaaaggccccacttcctaatg

SEQ ID NO: 1021756 - DNA, 22 bp, Artificial Sequence
  chemically synthesized
aaggtgatgacattaggaagtg

SEQ ID NO: 1021757 - DNA, 22 bp, Artificial Sequence
  chemically synthesized
ccttccaaaggccccacttcct

SEQ ID NO: 1021758 - DNA, 22 bp, Artificial Sequence
  chemically synthesized
attaccttccaaaggccccact

SEQ ID NO: 1021759 - DNA, 22 bp, Artificial Sequence
  chemically synthesized
tgacctaattaccttccaaagg

SEQ ID NO: 1021760 - DNA, 22 bp, Artificial Sequence
  chemically synthesized
atgacctaattaccttccaaag

SEQ ID NO: 1021761 - DNA, 22 bp, Artificial Sequence
  chemically synthesized
ggaagtggggcctttggaaggt

SEQ ID NO: 1021762 - DNA, 22 bp, Artificial Sequence
  chemically synthesized
gccttatgacctaattaccttc

SEQ ID NO: 1021763 - DNA, 22 bp, Artificial Sequence
  chemically synthesized
ggccttatgacctaattacctt

SEQ ID NO: 1021764 - DNA, 22 bp, Artificial Sequence
  chemically synthesized
tggccttatgacctaattacct

SEQ ID NO: 1021765 - DNA, 22 bp, Artificial Sequence
  chemically synthesized
tggaaggtaattaggtcataag

SEQ ID NO: 1021766 - DNA, 22 bp, Artificial Sequence
  chemically synthesized
gatggctttggccttatgacct

SEQ ID NO: 1021767 - DNA, 22 bp, Artificial Sequence
  chemically synthesized
ggaaggtaattaggtcataagg

SEQ ID NO: 1021768 - DNA, 22 bp, Artificial Sequence
  chemically synthesized
gaaggtaattaggtcataaggc

SEQ ID NO: 1021769 - DNA, 22 bp, Artificial Sequence
  chemically synthesized
tggatggctttggccttatgac

SEQ ID NO: 1021770 - DNA, 22 bp, Artificial Sequence
  chemically synthesized
attctggatggctttggcctta

SEQ ID NO: 1021771 - DNA, 22 bp, Artificial Sequence
  chemically synthesized
tcattctggatggctttggcct

SEQ ID NO: 1021772 - DNA, 22 bp, Artificial Sequence
  chemically synthesized
ttctcattctggatggctttgg

SEQ ID NO: 1021773 - DNA, 22 bp, Artificial Sequence
  chemically synthesized
ggtcataaggccaaagccatcc

SEQ ID NO: 1021774 - DNA, 22 bp, Artificial Sequence
  chemically synthesized
taagggtactattctcattctg

SEQ ID NO: 1021775 - DNA, 22 bp, Artificial Sequence
  chemically synthesized
gtaagggtactattctcattct

SEQ ID NO: 1021776 - DNA, 22 bp, Artificial Sequence
  chemically synthesized
tgtaagggtactattctcattc

SEQ ID NO: 1021777 - DNA, 22 bp, Artificial Sequence
  chemically synthesized
ttgtaagggtactattctcatt

SEQ ID NO: 1021778 - DNA, 22 bp, Artificial Sequence
  chemically synthesized
ttttgtaagggtactattctca

SEQ ID NO: 1021779 - DNA, 22 bp, Artificial Sequence
  chemically synthesized
ggcctcttttgtaagggtacta

SEQ ID NO: 1021780 - DNA, 22 bp, Artificial Sequence
  chemically synthesized
gggcctcttttgtaagggtact

SEQ ID NO: 1021781 - DNA, 22 bp, Artificial Sequence
  chemically synthesized
tcttgggcctcttttgtaaggg

SEQ ID NO: 1021782 - DNA, 22 bp, Artificial Sequence
  chemically synthesized
acaaaagaggcccaagacagtt

SEQ ID NO: 1021783 - DNA, 22 bp, Artificial Sequence
  chemically synthesized
caaaagaggcccaagacagttc

SEQ ID NO: 1021784 - DNA, 22 bp, Artificial Sequence
  chemically synthesized
acaaggcagcaggtccaaggga

SEQ ID NO: 1021785 - DNA, 22 bp, Artificial Sequence
  chemically synthesized
taacctcacaaggcagcaggtc

SEQ ID NO: 1021786 - DNA, 22 bp, Artificial Sequence
  chemically synthesized
actgtaacctcacaaggcagca

SEQ ID NO: 1021787 - DNA, 22 bp, Artificial Sequence
  chemically synthesized
tcactgtaacctcacaaggcag

SEQ ID NO: 1021788 - DNA, 22 bp, Artificial Sequence
  chemically synthesized
ccttggacctgctgccttgtga

SEQ ID NO: 1021789 - DNA, 22 bp, Artificial Sequence
  chemically synthesized
ctcactgtaacctcacaaggca

SEQ ID NO: 1021790 - DNA, 22 bp, Artificial Sequence
  chemically synthesized
ggacctgctgccttgtgaggtt

SEQ ID NO: 1021791 - DNA, 22 bp, Artificial Sequence
  chemically synthesized
tcttctcactgtaacctcacaa

SEQ ID NO: 1021792 - DNA, 22 bp, Artificial Sequence
  chemically synthesized
gacctgctgccttgtgaggtta

SEQ ID NO: 1021793 - DNA, 22 bp, Artificial Sequence
  chemically synthesized
ctgtcttctcactgtaacctca

SEQ ID NO: 1021794 - DNA, 22 bp, Artificial Sequence
  chemically synthesized
cctgtcttctcactgtaacctc

SEQ ID NO: 1021795 - DNA, 22 bp, Artificial Sequence
  chemically synthesized
ctgccttgtgaggttacagtga

SEQ ID NO: 1021796 - DNA, 22 bp, Artificial Sequence
  chemically synthesized
atttcctgtcttctcactgtaa

SEQ ID NO: 1021797 - DNA, 22 bp, Artificial Sequence
  chemically synthesized
ccttgtgaggttacagtgagaa

SEQ ID NO: 1021798 - DNA, 22 bp, Artificial Sequence
  chemically synthesized
gtgaggttacagtgagaagaca

SEQ ID NO: 1021799 - DNA, 22 bp, Artificial Sequence
  chemically synthesized
tgaggttacagtgagaagacag

SEQ ID NO: 1021800 - DNA, 22 bp, Artificial Sequence
  chemically synthesized
gtgaaagctcatttcctgtctt

SEQ ID NO: 1021801 - DNA, 22 bp, Artificial Sequence
  chemically synthesized
cagtgagaagacaggaaatgag

SEQ ID NO: 1021802 - DNA, 22 bp, Artificial Sequence
  chemically synthesized
gtgtctggtgaaagctcatttc

SEQ ID NO: 1021803 - DNA, 22 bp, Artificial Sequence
  chemically synthesized
ggtgtctggtgaaagctcattt

SEQ ID NO: 1021804 - DNA, 22 bp, Artificial Sequence
  chemically synthesized
gcaggtttggtgtctggtgaaa

SEQ ID NO: 1021805 - DNA, 22 bp, Artificial Sequence
  chemically synthesized
tcaccagacaccaaacctgcca

SEQ ID NO: 1021806 - DNA, 22 bp, Artificial Sequence
  chemically synthesized
caccagacaccaaacctgccag

SEQ ID NO: 1021807 - DNA, 22 bp, Artificial Sequence
  chemically synthesized
aagatcaaggcactggcaggtt

SEQ ID NO: 1021808 - DNA, 22 bp, Artificial Sequence
  chemically synthesized
accagacaccaaacctgccagt

SEQ ID NO: 1021809 - DNA, 22 bp, Artificial Sequence
  chemically synthesized
ggaagttcaagatcaaggcact

SEQ ID NO: 1021810 - DNA, 22 bp, Artificial Sequence
  chemically synthesized
gaggctgggaagttcaagatca

SEQ ID NO: 1021811 - DNA, 22 bp, Artificial Sequence
  chemically synthesized
tggaggctgggaagttcaagat

SEQ ID NO: 1021812 - DNA, 22 bp, Artificial Sequence
  chemically synthesized
ccagtgccttgatcttgaactt

SEQ ID NO: 1021813 - DNA, 22 bp, Artificial Sequence
  chemically synthesized
accgttctggaggctgggaagt

SEQ ID NO: 1021814 - DNA, 22 bp, Artificial Sequence
  chemically synthesized
tcaccgttctggaggctgggaa

SEQ ID NO: 1021815 - DNA, 22 bp, Artificial Sequence
  chemically synthesized
ctcaccgttctggaggctggga

SEQ ID NO: 1021816 - DNA, 22 bp, Artificial Sequence
  chemically synthesized
gatcttgaacttcccagcctcc

SEQ ID NO: 1021817 - DNA, 22 bp, Artificial Sequence
  chemically synthesized
atcttgaacttcccagcctcca

SEQ ID NO: 1021818 - DNA, 22 bp, Artificial Sequence
  chemically synthesized
tttctcaccgttctggaggctg

SEQ ID NO: 1021819 - DNA, 22 bp, Artificial Sequence
  chemically synthesized
atttctcaccgttctggaggct

SEQ ID NO: 1021820 - DNA, 22 bp, Artificial Sequence
  chemically synthesized
tatttctcaccgttctggaggc

SEQ ID NO: 1021821 - DNA, 22 bp, Artificial Sequence
  chemically synthesized
gaacttcccagcctccagaacg

SEQ ID NO: 1021822 - DNA, 22 bp, Artificial Sequence
  chemically synthesized
aacttcccagcctccagaacgg

SEQ ID NO: 1021823 - DNA, 22 bp, Artificial Sequence
  chemically synthesized
cccagcctccagaacggtgaga

SEQ ID NO: 1021824 - DNA, 22 bp, Artificial Sequence
  chemically synthesized
ccagcctccagaacggtgagaa

SEQ ID NO: 1021825 - DNA, 22 bp, Artificial Sequence
  chemically synthesized
taaacaacagacctttatttct

SEQ ID NO: 1021826 - DNA, 22 bp, Artificial Sequence
  chemically synthesized
ataaacaacagacctttatttc

SEQ ID NO: 1021827 - DNA, 22 bp, Artificial Sequence
  chemically synthesized
cagaacggtgagaaataaaggt

SEQ ID NO: 1021828 - DNA, 22 bp, Artificial Sequence
  chemically synthesized
gatgccttataaacaacagacc

SEQ ID NO: 1021829 - DNA, 22 bp, Artificial Sequence
  chemically synthesized
ttgtttataaggcatccagtct

SEQ ID NO: 1021830 - DNA, 22 bp, Artificial Sequence
  chemically synthesized
taacaaaataccatagactgga

SEQ ID NO: 1021831 - DNA, 22 bp, Artificial Sequence
  chemically synthesized
tttataaggcatccagtctatg

SEQ ID NO: 1021832 - DNA, 22 bp, Artificial Sequence
  chemically synthesized
ctataacaaaataccatagact

SEQ ID NO: 1021833 - DNA, 22 bp, Artificial Sequence
  chemically synthesized
ataaggcatccagtctatggta

SEQ ID NO: 1021834 - DNA, 22 bp, Artificial Sequence
  chemically synthesized
taaggcatccagtctatggtat

SEQ ID NO: 1021835 - DNA, 22 bp, Artificial Sequence
  chemically synthesized
ttgctataacaaaataccatag

SEQ ID NO: 1021836 - DNA, 22 bp, Artificial Sequence
  chemically synthesized
attgctataacaaaataccata

SEQ ID NO: 1021837 - DNA, 22 bp, Artificial Sequence
  chemically synthesized
tattgctataacaaaataccat

SEQ ID NO: 1021838 - DNA, 22 bp, Artificial Sequence
  chemically synthesized
gtcaagttttattgctataaca

SEQ ID NO: 1021839 - DNA, 22 bp, Artificial Sequence
  chemically synthesized
agtcaagttttattgctataac

SEQ ID NO: 1021840 - DNA, 22 bp, Artificial Sequence
  chemically synthesized
tagtcaagttttattgctataa

SEQ ID NO: 1021841 - DNA, 22 bp, Artificial Sequence
  chemically synthesized
ttagtcaagttttattgctata

SEQ ID NO: 1021842 - DNA, 22 bp, Artificial Sequence
  chemically synthesized
tggtattttgttatagcaataa

SEQ ID NO: 1021843 - DNA, 22 bp, Artificial Sequence
  chemically synthesized
tttttagtcaagttttattgct

SEQ ID NO: 1021844 - DNA, 22 bp, Artificial Sequence
  chemically synthesized
tgttatagcaataaaacttgac

SEQ ID NO: 1021845 - DNA, 22 bp, Artificial Sequence
  chemically synthesized
gttatagcaataaaacttgact

SEQ ID NO: 1021846 - DNA, 22 bp, Artificial Sequence
  chemically synthesized
ttatagcaataaaacttgacta

SEQ ID NO: 1021847 - DNA, 22 bp, Artificial Sequence
  chemically synthesized
tagcaataaaacttgactaaaa

SEQ ID NO: 1021848 - DNA, 22 bp, Artificial Sequence
  chemically synthesized
caatacgaaaactatttttagt

SEQ ID NO: 1021849 - DNA, 22 bp, Artificial Sequence
  chemically synthesized
cctgcaatacgaaaactatttt

SEQ ID NO: 1021850 - DNA, 22 bp, Artificial Sequence
  chemically synthesized
gactaaaaatagttttcgtatt

SEQ ID NO: 1021851 - DNA, 22 bp, Artificial Sequence
  chemically synthesized
actaaaaatagttttcgtattg

SEQ ID NO: 1021852 - DNA, 22 bp, Artificial Sequence
  chemically synthesized
agagcctacctgcaatacgaaa

SEQ ID NO: 1021853 - DNA, 22 bp, Artificial Sequence
  chemically synthesized
ctgagagcctacctgcaatacg

SEQ ID NO: 1021854 - DNA, 22 bp, Artificial Sequence
  chemically synthesized
aaaatagttttcgtattgcagg

SEQ ID NO: 1021855 - DNA, 22 bp, Artificial Sequence
  chemically synthesized
tcctgagagcctacctgcaata

SEQ ID NO: 1021856 - DNA, 22 bp, Artificial Sequence
  chemically synthesized
ttctcctgagagcctacctgca

SEQ ID NO: 1021857 - DNA, 22 bp, Artificial Sequence
  chemically synthesized
attctcctgagagcctacctgc

SEQ ID NO: 1021858 - DNA, 22 bp, Artificial Sequence
  chemically synthesized
tcgtattgcaggtaggctctca

SEQ ID NO: 1021859 - DNA, 22 bp, Artificial Sequence
  chemically synthesized
cgtattgcaggtaggctctcag

SEQ ID NO: 1021860 - DNA, 22 bp, Artificial Sequence
  chemically synthesized
gtattgcaggtaggctctcagg

SEQ ID NO: 1021861 - DNA, 22 bp, Artificial Sequence
  chemically synthesized
taaatttattctcctgagagcc

SEQ ID NO: 1021862 - DNA, 22 bp, Artificial Sequence
  chemically synthesized
caggtaggctctcaggagaata

SEQ ID NO: 1021863 - DNA, 22 bp, Artificial Sequence
  chemically synthesized
ggcagtagattataaatttatt

SEQ ID NO: 1021864 - DNA, 22 bp, Artificial Sequence
  chemically synthesized
tgggcagtagattataaattta

SEQ ID NO: 1021865 - DNA, 22 bp, Artificial Sequence
  chemically synthesized
tcaggagaataaatttataatc

SEQ ID NO: 1021866 - DNA, 22 bp, Artificial Sequence
  chemically synthesized
aggagaataaatttataatcta

SEQ ID NO: 1021867 - DNA, 22 bp, Artificial Sequence
  chemically synthesized
tcctctgggcagtagattataa

SEQ ID NO: 1021868 - DNA, 22 bp, Artificial Sequence
  chemically synthesized
tatcctctgggcagtagattat

SEQ ID NO: 1021869 - DNA, 22 bp, Artificial Sequence
  chemically synthesized
ctatcctctgggcagtagatta

SEQ ID NO: 1021870 - DNA, 22 bp, Artificial Sequence
  chemically synthesized
agtttctatcctctgggcagta

SEQ ID NO: 1021871 - DNA, 22 bp, Artificial Sequence
  chemically synthesized
aagtttctatcctctgggcagt

SEQ ID NO: 1021872 - DNA, 22 bp, Artificial Sequence
  chemically synthesized
ttaagtttctatcctctgggca

SEQ ID NO: 1021873 - DNA, 22 bp, Artificial Sequence
  chemically synthesized
ataatctactgcccagaggata

SEQ ID NO: 1021874 - DNA, 22 bp, Artificial Sequence
  chemically synthesized
taatctactgcccagaggatag

SEQ ID NO: 1021875 - DNA, 22 bp, Artificial Sequence
  chemically synthesized
gctcttaagtttctatcctctg

SEQ ID NO: 1021876 - DNA, 22 bp, Artificial Sequence
  chemically synthesized
ggctcttaagtttctatcctct

SEQ ID NO: 1021877 - DNA, 22 bp, Artificial Sequence
  chemically synthesized
ttggctcttaagtttctatcct

SEQ ID NO: 1021878 - DNA, 22 bp, Artificial Sequence
  chemically synthesized
cttggctcttaagtttctatcc

SEQ ID NO: 1021879 - DNA, 22 bp, Artificial Sequence
  chemically synthesized
ctgcccagaggatagaaactta

SEQ ID NO: 1021880 - DNA, 22 bp, Artificial Sequence
  chemically synthesized
accttcttggctcttaagtttc

SEQ ID NO: 1021881 - DNA, 22 bp, Artificial Sequence
  chemically synthesized
cccagaggatagaaacttaaga

SEQ ID NO: 1021882 - DNA, 22 bp, Artificial Sequence
  chemically synthesized
caccttcttggctcttaagttt

SEQ ID NO: 1021883 - DNA, 22 bp, Artificial Sequence
  chemically synthesized
ttcaccttcttggctcttaagt

SEQ ID NO: 1021884 - DNA, 22 bp, Artificial Sequence
  chemically synthesized
aagagccaagaaggtgaagagg

SEQ ID NO: 1021885 - DNA, 22 bp, Artificial Sequence
  chemically synthesized
agagccaagaaggtgaagaggg

SEQ ID NO: 1021886 - DNA, 22 bp, Artificial Sequence
  chemically synthesized
atggtgagaccagcagtccctc

SEQ ID NO: 1021887 - DNA, 22 bp, Artificial Sequence
  chemically synthesized
aatggtgagaccagcagtccct

SEQ ID NO: 1021888 - DNA, 22 bp, Artificial Sequence
  chemically synthesized
aagtcaacatatttaatggtga

SEQ ID NO: 1021889 - DNA, 22 bp, Artificial Sequence
  chemically synthesized
agttaaagtcaacatatttaat

SEQ ID NO: 1021890 - DNA, 22 bp, Artificial Sequence
  chemically synthesized
ctggtctcaccattaaatatgt

SEQ ID NO: 1021891 - DNA, 22 bp, Artificial Sequence
  chemically synthesized
gtctcaccattaaatatgttga

SEQ ID NO: 1021892 - DNA, 22 bp, Artificial Sequence
  chemically synthesized
accattaaatatgttgacttta

SEQ ID NO: 1021893 - DNA, 22 bp, Artificial Sequence
  chemically synthesized
aaaatacaggattaagttaaag

SEQ ID NO: 1021894 - DNA, 22 bp, Artificial Sequence
  chemically synthesized
aatatgttgactttaacttaat

SEQ ID NO: 1021895 - DNA, 22 bp, Artificial Sequence
  chemically synthesized
actttaacttaatcctgtattt

SEQ ID NO: 1021896 - DNA, 22 bp, Artificial Sequence
  chemically synthesized
taacttaatcctgtattttcag

SEQ ID NO: 1021897 - DNA, 22 bp, Artificial Sequence
  chemically synthesized
aacttaatcctgtattttcagt

SEQ ID NO: 1021898 - DNA, 22 bp, Artificial Sequence
  chemically synthesized
acttaatcctgtattttcagta

SEQ ID NO: 1021899 - DNA, 22 bp, Artificial Sequence
  chemically synthesized
aatcctgtattttcagtatggt

SEQ ID NO: 1021900 - DNA, 22 bp, Artificial Sequence
  chemically synthesized
atcctgtattttcagtatggtg

SEQ ID NO: 1021901 - DNA, 22 bp, Artificial Sequence
  chemically synthesized
atggaagagagagccaccatac

SEQ ID NO: 1021902 - DNA, 22 bp, Artificial Sequence
  chemically synthesized
tattttcagtatggtggctctc

SEQ ID NO: 1021903 - DNA, 22 bp, Artificial Sequence
  chemically synthesized
gttgatggaagagagagccacc

SEQ ID NO: 1021904 - DNA, 22 bp, Artificial Sequence
  chemically synthesized
tcagtatggtggctctctcttc

SEQ ID NO: 1021905 - DNA, 22 bp, Artificial Sequence
  chemically synthesized
cagtatggtggctctctcttcc

SEQ ID NO: 1021906 - DNA, 22 bp, Artificial Sequence
  chemically synthesized
agtatggtggctctctcttcca

SEQ ID NO: 1021907 - DNA, 22 bp, Artificial Sequence
  chemically synthesized
gacaacaggattagttgatgga

SEQ ID NO: 1021908 - DNA, 22 bp, Artificial Sequence
  chemically synthesized
ggacaacaggattagttgatgg

SEQ ID NO: 1021909 - DNA, 22 bp, Artificial Sequence
  chemically synthesized
tctcttccatcaactaatcctg

SEQ ID NO: 1021910 - DNA, 22 bp, Artificial Sequence
  chemically synthesized
gcatttggacaacaggattagt

SEQ ID NO: 1021911 - DNA, 22 bp, Artificial Sequence
  chemically synthesized
ggcatttggacaacaggattag

SEQ ID NO: 1021912 - DNA, 22 bp, Artificial Sequence
  chemically synthesized
tcttccatcaactaatcctgtt

SEQ ID NO: 1021913 - DNA, 22 bp, Artificial Sequence
  chemically synthesized
tggcatttggacaacaggatta

SEQ ID NO: 1021914 - DNA, 22 bp, Artificial Sequence
  chemically synthesized
ttggcatttggacaacaggatt

SEQ ID NO: 1021915 - DNA, 22 bp, Artificial Sequence
  chemically synthesized
ttccatcaactaatcctgttgt

SEQ ID NO: 1021916 - DNA, 22 bp, Artificial Sequence
  chemically synthesized
ccatcaactaatcctgttgtcc

SEQ ID NO: 1021917 - DNA, 22 bp, Artificial Sequence
  chemically synthesized
catcaactaatcctgttgtcca

SEQ ID NO: 1021918 - DNA, 22 bp, Artificial Sequence
  chemically synthesized
aaacaacttttggcatttggac

SEQ ID NO: 1021919 - DNA, 22 bp, Artificial Sequence
  chemically synthesized
atcctgttgtccaaatgccaaa

SEQ ID NO: 1021920 - DNA, 22 bp, Artificial Sequence
  chemically synthesized
gtgaggctgaaacaacttttgg

SEQ ID NO: 1021921 - DNA, 22 bp, Artificial Sequence
  chemically synthesized
ttgtccaaatgccaaaagttgt

SEQ ID NO: 1021922 - DNA, 22 bp, Artificial Sequence
  chemically synthesized
tggtgaggctgaaacaactttt

SEQ ID NO: 1021923 - DNA, 22 bp, Artificial Sequence
  chemically synthesized
ctggtgaggctgaaacaacttt

SEQ ID NO: 1021924 - DNA, 22 bp, Artificial Sequence
  chemically synthesized
tccaaatgccaaaagttgtttc

SEQ ID NO: 1021925 - DNA, 22 bp, Artificial Sequence
  chemically synthesized
tctggtgaggctgaaacaactt

SEQ ID NO: 1021926 - DNA, 22 bp, Artificial Sequence
  chemically synthesized
ctttctggtgaggctgaaacaa

SEQ ID NO: 1021927 - DNA, 22 bp, Artificial Sequence
  chemically synthesized
gctttctggtgaggctgaaaca

SEQ ID NO: 1021928 - DNA, 22 bp, Artificial Sequence
  chemically synthesized
tttcagcctcaccagaaagcaa

SEQ ID NO: 1021929 - DNA, 22 bp, Artificial Sequence
  chemically synthesized
cagcctcaccagaaagcaaacc

SEQ ID NO: 1021930 - DNA, 22 bp, Artificial Sequence
  chemically synthesized
agcctcaccagaaagcaaacca

SEQ ID NO: 1021931 - DNA, 22 bp, Artificial Sequence
  chemically synthesized
accagaaagcaaaccactcact

SEQ ID NO: 1021932 - DNA, 22 bp, Artificial Sequence
  chemically synthesized
atcccagcagacgtgagtgagt

SEQ ID NO: 1021933 - DNA, 22 bp, Artificial Sequence
  chemically synthesized
tcatcccagcagacgtgagtga

SEQ ID NO: 1021934 - DNA, 22 bp, Artificial Sequence
  chemically synthesized
tctcatcccagcagacgtgagt

SEQ ID NO: 1021935 - DNA, 22 bp, Artificial Sequence
  chemically synthesized
ctctctcatcccagcagacgtg

SEQ ID NO: 1021936 - DNA, 22 bp, Artificial Sequence
  chemically synthesized
ctcctctctcatcccagcagac

SEQ ID NO: 1021937 - DNA, 22 bp, Artificial Sequence
  chemically synthesized
actcacgtctgctgggatgaga

SEQ ID NO: 1021938 - DNA, 22 bp, Artificial Sequence
  chemically synthesized
gacactactcctctctcatccc

SEQ ID NO: 1021939 - DNA, 22 bp, Artificial Sequence
  chemically synthesized
acgtctgctgggatgagagagg

SEQ ID NO: 1021940 - DNA, 22 bp, Artificial Sequence
  chemically synthesized
attagacactactcctctctca

SEQ ID NO: 1021941 - DNA, 22 bp, Artificial Sequence
  chemically synthesized
ctgggatgagagaggagtagtg

SEQ ID NO: 1021942 - DNA, 22 bp, Artificial Sequence
  chemically synthesized
ggatgagagaggagtagtgtct

SEQ ID NO: 1021943 - DNA, 22 bp, Artificial Sequence
  chemically synthesized
agggtagttaattagacactac

SEQ ID NO: 1021944 - DNA, 22 bp, Artificial Sequence
  chemically synthesized
atgtccccagctcagggtagtt

SEQ ID NO: 1021945 - DNA, 22 bp, Artificial Sequence
  chemically synthesized
catgtccccagctcagggtagt

SEQ ID NO: 1021946 - DNA, 22 bp, Artificial Sequence
  chemically synthesized
catttcatgtccccagctcagg

SEQ ID NO: 1021947 - DNA, 22 bp, Artificial Sequence
  chemically synthesized
attaactaccctgagctgggga

SEQ ID NO: 1021948 - DNA, 22 bp, Artificial Sequence
  chemically synthesized
actaccctgagctggggacatg

SEQ ID NO: 1021949 - DNA, 22 bp, Artificial Sequence
  chemically synthesized
ccctgagctggggacatgaaat

SEQ ID NO: 1021950 - DNA, 22 bp, Artificial Sequence
  chemically synthesized
aaaggggcaattacatttcatg

SEQ ID NO: 1021951 - DNA, 22 bp, Artificial Sequence
  chemically synthesized
aaaaggggcaattacatttcat

SEQ ID NO: 1021952 - DNA, 22 bp, Artificial Sequence
  chemically synthesized
agctggggacatgaaatgtaat

SEQ ID NO: 1021953 - DNA, 22 bp, Artificial Sequence
  chemically synthesized
gggacatgaaatgtaattgccc

SEQ ID NO: 1021954 - DNA, 22 bp, Artificial Sequence
  chemically synthesized
aatcccttaaaaggggcaatta

SEQ ID NO: 1021955 - DNA, 22 bp, Artificial Sequence
  chemically synthesized
gaatcccttaaaaggggcaatt

SEQ ID NO: 1021956 - DNA, 22 bp, Artificial Sequence
  chemically synthesized
tgaatcccttaaaaggggcaat

SEQ ID NO: 1021957 - DNA, 22 bp, Artificial Sequence
  chemically synthesized
ttttgaatcccttaaaaggggc

SEQ ID NO: 1021958 - DNA, 22 bp, Artificial Sequence
  chemically synthesized
ccccttttaagggattcaaaac

SEQ ID NO: 1021959 - DNA, 22 bp, Artificial Sequence
  chemically synthesized
gaaataaaggggttgttttgaa

SEQ ID NO: 1021960 - DNA, 22 bp, Artificial Sequence
  chemically synthesized
ttaagggattcaaaacaacccc

SEQ ID NO: 1021961 - DNA, 22 bp, Artificial Sequence
  chemically synthesized
taagggattcaaaacaacccct

SEQ ID NO: 1021962 - DNA, 22 bp, Artificial Sequence
  chemically synthesized
aagggattcaaaacaacccctt

SEQ ID NO: 1021963 - DNA, 22 bp, Artificial Sequence
  chemically synthesized
agggattcaaaacaaccccttt

SEQ ID NO: 1021964 - DNA, 22 bp, Artificial Sequence
  chemically synthesized
ccgagaggggctggaaataaag

SEQ ID NO: 1021965 - DNA, 22 bp, Artificial Sequence
  chemically synthesized
aaaacaacccctttatttccag

SEQ ID NO: 1021966 - DNA, 22 bp, Artificial Sequence
  chemically synthesized
tatttccagcccctctcgggaa

SEQ ID NO: 1021967 - DNA, 22 bp, Artificial Sequence
  chemically synthesized
gaaggccatatattcccgagag

SEQ ID NO: 1021968 - DNA, 22 bp, Artificial Sequence
  chemically synthesized
atttccagcccctctcgggaat

SEQ ID NO: 1021969 - DNA, 22 bp, Artificial Sequence
  chemically synthesized
agaaggccatatattcccgaga

SEQ ID NO: 1021970 - DNA, 22 bp, Artificial Sequence
  chemically synthesized
tttccagcccctctcgggaata

SEQ ID NO: 1021971 - DNA, 22 bp, Artificial Sequence
  chemically synthesized
tagaaggccatatattcccgag

SEQ ID NO: 1021972 - DNA, 22 bp, Artificial Sequence
  chemically synthesized
ccagcccctctcgggaatatat

SEQ ID NO: 1021973 - DNA, 22 bp, Artificial Sequence
  chemically synthesized
cagcccctctcgggaatatatg

SEQ ID NO: 1021974 - DNA, 22 bp, Artificial Sequence
  chemically synthesized
ggtgttttagaaggccatatat

SEQ ID NO: 1021975 - DNA, 22 bp, Artificial Sequence
  chemically synthesized
tcgggaatatatggccttctaa

SEQ ID NO: 1021976 - DNA, 22 bp, Artificial Sequence
  chemically synthesized
gggaatatatggccttctaaaa

SEQ ID NO: 1021977 - DNA, 22 bp, Artificial Sequence
  chemically synthesized
aagacgctaggtgttttagaag

SEQ ID NO: 1021978 - DNA, 22 bp, Artificial Sequence
  chemically synthesized
tggattgaagacgctaggtgtt

SEQ ID NO: 1021979 - DNA, 22 bp, Artificial Sequence
  chemically synthesized
gtggattgaagacgctaggtgt

SEQ ID NO: 1021980 - DNA, 22 bp, Artificial Sequence
  chemically synthesized
ctaaaacacctagcgtcttcaa

SEQ ID NO: 1021981 - DNA, 22 bp, Artificial Sequence
  chemically synthesized
taaaacacctagcgtcttcaat

SEQ ID NO: 1021982 - DNA, 22 bp, Artificial Sequence
  chemically synthesized
aaacacctagcgtcttcaatcc

SEQ ID NO: 1021983 - DNA, 22 bp, Artificial Sequence
  chemically synthesized
aggatcccagaaaaacttgtgg

SEQ ID NO: 1021984 - DNA, 22 bp, Artificial Sequence
  chemically synthesized
gcgtcttcaatccacaagtttt

SEQ ID NO: 1021985 - DNA, 22 bp, Artificial Sequence
  chemically synthesized
caggatcccagaaaaacttgtg

SEQ ID NO: 1021986 - DNA, 22 bp, Artificial Sequence
  chemically synthesized
tcaggatcccagaaaaacttgt

SEQ ID NO: 1021987 - DNA, 22 bp, Artificial Sequence
  chemically synthesized
ttcaggatcccagaaaaacttg

SEQ ID NO: 1021988 - DNA, 22 bp, Artificial Sequence
  chemically synthesized
tttttcaggatcccagaaaaac

SEQ ID NO: 1021989 - DNA, 22 bp, Artificial Sequence
  chemically synthesized
gtttttcaggatcccagaaaaa

SEQ ID NO: 1021990 - DNA, 22 bp, Artificial Sequence
  chemically synthesized
caatccacaagtttttctggga

SEQ ID NO: 1021991 - DNA, 22 bp, Artificial Sequence
  chemically synthesized
aatccacaagtttttctgggat

SEQ ID NO: 1021992 - DNA, 22 bp, Artificial Sequence
  chemically synthesized
ttctgggatcctgaaaaacaaa

SEQ ID NO: 1021993 - DNA, 22 bp, Artificial Sequence
  chemically synthesized
tctgggatcctgaaaaacaaat

SEQ ID NO: 1021994 - DNA, 22 bp, Artificial Sequence
  chemically synthesized
ctgggatcctgaaaaacaaatt

SEQ ID NO: 1021995 - DNA, 22 bp, Artificial Sequence
  chemically synthesized
tgggatcctgaaaaacaaattg

SEQ ID NO: 1021996 - DNA, 22 bp, Artificial Sequence
  chemically synthesized
ggacaagtaagccaatttgttt

SEQ ID NO: 1021997 - DNA, 22 bp, Artificial Sequence
  chemically synthesized
ggatcctgaaaaacaaattggc

SEQ ID NO: 1021998 - DNA, 22 bp, Artificial Sequence
  chemically synthesized
aaaaacaaattggcttacttgt

SEQ ID NO: 1021999 - DNA, 22 bp, Artificial Sequence
  chemically synthesized
gcttacttgtcctaattttcat

SEQ ID NO: 1022000 - DNA, 22 bp, Artificial Sequence
  chemically synthesized
acttgtcctaattttcatctca

SEQ ID NO: 1022001 - DNA, 22 bp, Artificial Sequence
  chemically synthesized
cttgtcctaattttcatctcat

SEQ ID NO: 1022002 - DNA, 22 bp, Artificial Sequence
  chemically synthesized
gtcctaattttcatctcattga

SEQ ID NO: 1022003 - DNA, 22 bp, Artificial Sequence
  chemically synthesized
tcctaattttcatctcattgac

SEQ ID NO: 1022004 - DNA, 22 bp, Artificial Sequence
  chemically synthesized
cacagacatatcaagtcaatga

SEQ ID NO: 1022005 - DNA, 22 bp, Artificial Sequence
  chemically synthesized
attttcatctcattgacttgat

SEQ ID NO: 1022006 - DNA, 22 bp, Artificial Sequence
  chemically synthesized
tcatctcattgacttgatatgt

SEQ ID NO: 1022007 - DNA, 22 bp, Artificial Sequence
  chemically synthesized
catctcattgacttgatatgtc

SEQ ID NO: 1022008 - DNA, 22 bp, Artificial Sequence
  chemically synthesized
atctcattgacttgatatgtct

SEQ ID NO: 1022009 - DNA, 22 bp, Artificial Sequence
  chemically synthesized
attgacttgatatgtctgtgca

SEQ ID NO: 1022010 - DNA, 22 bp, Artificial Sequence
  chemically synthesized
acttgatatgtctgtgcagatg

SEQ ID NO: 1022011 - DNA, 22 bp, Artificial Sequence
  chemically synthesized
gatatgtctgtgcagatgtctc

SEQ ID NO: 1022012 - DNA, 22 bp, Artificial Sequence
  chemically synthesized
atatgtctgtgcagatgtctct

SEQ ID NO: 1022013 - DNA, 22 bp, Artificial Sequence
  chemically synthesized
tgcagatgtctcttcttccatt

SEQ ID NO: 1022014 - DNA, 22 bp, Artificial Sequence
  chemically synthesized
ttcttccattttatttgtcatt

SEQ ID NO: 1022015 - DNA, 22 bp, Artificial Sequence
  chemically synthesized
cttccattttatttgtcatttt

SEQ ID NO: 1022016 - DNA, 22 bp, Artificial Sequence
  chemically synthesized
ttccattttatttgtcatttta

SEQ ID NO: 1022017 - DNA, 22 bp, Artificial Sequence
  chemically synthesized
ccattttatttgtcattttatg

SEQ ID NO: 1022018 - DNA, 22 bp, Artificial Sequence
  chemically synthesized
cattttatttgtcattttatga

SEQ ID NO: 1022019 - DNA, 22 bp, Artificial Sequence
  chemically synthesized
tatttgtcattttatgactgta

SEQ ID NO: 1022020 - DNA, 22 bp, Artificial Sequence
  chemically synthesized
atttgtcattttatgactgtat

SEQ ID NO: 1022021 - DNA, 22 bp, Artificial Sequence
  chemically synthesized
tttgtcattttatgactgtatt

SEQ ID NO: 1022022 - DNA, 22 bp, Artificial Sequence
  chemically synthesized
agggaataaaaacaatacagtc

SEQ ID NO: 1022023 - DNA, 22 bp, Artificial Sequence
  chemically synthesized
gtcattttatgactgtattgtt

SEQ ID NO: 1022024 - DNA, 22 bp, Artificial Sequence
  chemically synthesized
tcattttatgactgtattgttt

SEQ ID NO: 1022025 - DNA, 22 bp, Artificial Sequence
  chemically synthesized
cgctaagggaataaaaacaata

SEQ ID NO: 1022026 - DNA, 22 bp, Artificial Sequence
  chemically synthesized
tatgactgtattgtttttattc

SEQ ID NO: 1022027 - DNA, 22 bp, Artificial Sequence
  chemically synthesized
atgactgtattgtttttattcc

SEQ ID NO: 1022028 - DNA, 22 bp, Artificial Sequence
  chemically synthesized
tgactgtattgtttttattccc

SEQ ID NO: 1022029 - DNA, 22 bp, Artificial Sequence
  chemically synthesized
aaagattacgctaagggaataa

SEQ ID NO: 1022030 - DNA, 22 bp, Artificial Sequence
  chemically synthesized
ttcaaagattacgctaagggaa

SEQ ID NO: 1022031 - DNA, 22 bp, Artificial Sequence
  chemically synthesized
tattgtttttattcccttagcg

SEQ ID NO: 1022032 - DNA, 22 bp, Artificial Sequence
  chemically synthesized
tttttattcccttagcgtaatc

SEQ ID NO: 1022033 - DNA, 22 bp, Artificial Sequence
  chemically synthesized
ccaaattgttcaaagattacgc

SEQ ID NO: 1022034 - DNA, 22 bp, Artificial Sequence
  chemically synthesized
ttattcccttagcgtaatcttt

SEQ ID NO: 1022035 - DNA, 22 bp, Artificial Sequence
  chemically synthesized
tattcccttagcgtaatctttg

SEQ ID NO: 1022036 - DNA, 22 bp, Artificial Sequence
  chemically synthesized
tcccaaattgttcaaagattac

SEQ ID NO: 1022037 - DNA, 22 bp, Artificial Sequence
  chemically synthesized
attcccttagcgtaatctttga

SEQ ID NO: 1022038 - DNA, 22 bp, Artificial Sequence
  chemically synthesized
ttcccttagcgtaatctttgaa

SEQ ID NO: 1022039 - DNA, 22 bp, Artificial Sequence
  chemically synthesized
tctcccaaattgttcaaagatt

SEQ ID NO: 1022040 - DNA, 22 bp, Artificial Sequence
  chemically synthesized
tctctcccaaattgttcaaaga

SEQ ID NO: 1022041 - DNA, 22 bp, Artificial Sequence
  chemically synthesized
ccttagcgtaatctttgaacaa

SEQ ID NO: 1022042 - DNA, 22 bp, Artificial Sequence
  chemically synthesized
tctctctcccaaattgttcaaa

SEQ ID NO: 1022043 - DNA, 22 bp, Artificial Sequence
  chemically synthesized
ctctctctcccaaattgttcaa

SEQ ID NO: 1022044 - DNA, 22 bp, Artificial Sequence
  chemically synthesized
agcgtaatctttgaacaatttg

SEQ ID NO: 1022045 - DNA, 22 bp, Artificial Sequence
  chemically synthesized
gcgtaatctttgaacaatttgg

SEQ ID NO: 1022046 - DNA, 22 bp, Artificial Sequence
  chemically synthesized
tcttctctctctcccaaattgt

SEQ ID NO: 1022047 - DNA, 22 bp, Artificial Sequence
  chemically synthesized
atcttctctctctcccaaattg

SEQ ID NO: 1022048 - DNA, 22 bp, Artificial Sequence
  chemically synthesized
tgaacaatttgggagagagaga

SEQ ID NO: 1022049 - DNA, 22 bp, Artificial Sequence
  chemically synthesized
gaacaatttgggagagagagaa

SEQ ID NO: 1022050 - DNA, 22 bp, Artificial Sequence
  chemically synthesized
aacaatttgggagagagagaag

SEQ ID NO: 1022051 - DNA, 22 bp, Artificial Sequence
  chemically synthesized
gggagagagagaagataaatgt

SEQ ID NO: 1022052 - DNA, 22 bp, Artificial Sequence
  chemically synthesized
ggagagagagaagataaatgta

SEQ ID NO: 1022053 - DNA, 22 bp, Artificial Sequence
  chemically synthesized
caatagaaatgacaatcgaaaa

SEQ ID NO: 1022054 - DNA, 22 bp, Artificial Sequence
  chemically synthesized
tcgattgtcatttctattggag

SEQ ID NO: 1022055 - DNA, 22 bp, Artificial Sequence
  chemically synthesized
cgattgtcatttctattggagg

SEQ ID NO: 1022056 - DNA, 22 bp, Artificial Sequence
  chemically synthesized
gattgtcatttctattggaggt

SEQ ID NO: 1022057 - DNA, 22 bp, Artificial Sequence
  chemically synthesized
tcatttctattggaggtccatg

SEQ ID NO: 1022058 - DNA, 22 bp, Artificial Sequence
  chemically synthesized
ctattggaggtccatgttcacg

SEQ ID NO: 1022059 - DNA, 22 bp, Artificial Sequence
  chemically synthesized
tattggaggtccatgttcacgt

SEQ ID NO: 1022060 - DNA, 22 bp, Artificial Sequence
  chemically synthesized
ttggaggtccatgttcacgttt

SEQ ID NO: 1022061 - DNA, 22 bp, Artificial Sequence
  chemically synthesized
gaggtccatgttcacgtttgtg

SEQ ID NO: 1022062 - DNA, 22 bp, Artificial Sequence
  chemically synthesized
aggagagagaacaagacacaaa

SEQ ID NO: 1022063 - DNA, 22 bp, Artificial Sequence
  chemically synthesized
acgtttgtgtcttgttctctct

SEQ ID NO: 1022064 - DNA, 22 bp, Artificial Sequence
  chemically synthesized
gatgaggatacctgaggagaga

SEQ ID NO: 1022065 - DNA, 22 bp, Artificial Sequence
  chemically synthesized
gtgtcttgttctctctcctcag

SEQ ID NO: 1022066 - DNA, 22 bp, Artificial Sequence
  chemically synthesized
tgtcttgttctctctcctcagg

SEQ ID NO: 1022067 - DNA, 22 bp, Artificial Sequence
  chemically synthesized
aatgctagatgaggatacctga

SEQ ID NO: 1022068 - DNA, 22 bp, Artificial Sequence
  chemically synthesized
gttctctctcctcaggtatcct

SEQ ID NO: 1022069 - DNA, 22 bp, Artificial Sequence
  chemically synthesized
ttctctctcctcaggtatcctc

SEQ ID NO: 1022070 - DNA, 22 bp, Artificial Sequence
  chemically synthesized
ctaaatgctagatgaggatacc

SEQ ID NO: 1022071 - DNA, 22 bp, Artificial Sequence
  chemically synthesized
tctctcctcaggtatcctcatc

SEQ ID NO: 1022072 - DNA, 22 bp, Artificial Sequence
  chemically synthesized
tctcctcaggtatcctcatcta

SEQ ID NO: 1022073 - DNA, 22 bp, Artificial Sequence
  chemically synthesized
tcctcaggtatcctcatctagc

SEQ ID NO: 1022074 - DNA, 22 bp, Artificial Sequence
  chemically synthesized
ctcaggtatcctcatctagcat

SEQ ID NO: 1022075 - DNA, 22 bp, Artificial Sequence
  chemically synthesized
aggtatcctcatctagcattta

SEQ ID NO: 1022076 - DNA, 22 bp, Artificial Sequence
  chemically synthesized
atctagcatttagtagttgcat

SEQ ID NO: 1022077 - DNA, 22 bp, Artificial Sequence
  chemically synthesized
gcatttagtagttgcatgtgca

SEQ ID NO: 1022078 - DNA, 22 bp, Artificial Sequence
  chemically synthesized
gagaccacgggacgcgatgcac

SEQ ID NO: 1022079 - DNA, 22 bp, Artificial Sequence
  chemically synthesized
agtagttgcatgtgcatcgcgt

SEQ ID NO: 1022080 - DNA, 22 bp, Artificial Sequence
  chemically synthesized
gtagttgcatgtgcatcgcgtc

SEQ ID NO: 1022081 - DNA, 22 bp, Artificial Sequence
  chemically synthesized
catgtgcatcgcgtcccgtggt

SEQ ID NO: 1022082 - DNA, 22 bp, Artificial Sequence
  chemically synthesized
aaggggtggctggagaccacgg

SEQ ID NO: 1022083 - DNA, 22 bp, Artificial Sequence
  chemically synthesized
aaaggggtggctggagaccacg

SEQ ID NO: 1022084 - DNA, 22 bp, Artificial Sequence
  chemically synthesized
aaccttaaaggggtggctggag

SEQ ID NO: 1022085 - DNA, 22 bp, Artificial Sequence
  chemically synthesized
aaaccttaaaggggtggctgga

SEQ ID NO: 1022086 - DNA, 22 bp, Artificial Sequence
  chemically synthesized
taaaccttaaaggggtggctgg

SEQ ID NO: 1022087 - DNA, 22 bp, Artificial Sequence
  chemically synthesized
cagccacccctttaaggtttaa

SEQ ID NO: 1022088 - DNA, 22 bp, Artificial Sequence
  chemically synthesized
cagtgcaagaactttaaacctt

SEQ ID NO: 1022089 - DNA, 22 bp, Artificial Sequence
  chemically synthesized
taaggtttaaagttcttgcact

SEQ ID NO: 1022090 - DNA, 22 bp, Artificial Sequence
  chemically synthesized
aaggtttaaagttcttgcactg

SEQ ID NO: 1022091 - DNA, 22 bp, Artificial Sequence
  chemically synthesized
aggtttaaagttcttgcactgc

SEQ ID NO: 1022092 - DNA, 22 bp, Artificial Sequence
  chemically synthesized
tccccagtaacattgcagtgca

SEQ ID NO: 1022093 - DNA, 22 bp, Artificial Sequence
  chemically synthesized
aaagttcttgcactgcaatgtt

SEQ ID NO: 1022094 - DNA, 22 bp, Artificial Sequence
  chemically synthesized
aagttcttgcactgcaatgtta

SEQ ID NO: 1022095 - DNA, 22 bp, Artificial Sequence
  chemically synthesized
aaattatccccagtaacattgc

SEQ ID NO: 1022096 - DNA, 22 bp, Artificial Sequence
  chemically synthesized
ttgcactgcaatgttactgggg

SEQ ID NO: 1022097 - DNA, 22 bp, Artificial Sequence
  chemically synthesized
gcactgcaatgttactggggat

SEQ ID NO: 1022098 - DNA, 22 bp, Artificial Sequence
  chemically synthesized
cactgcaatgttactggggata

SEQ ID NO: 1022099 - DNA, 22 bp, Artificial Sequence
  chemically synthesized
atgaatggattgaaattatccc

SEQ ID NO: 1022100 - DNA, 22 bp, Artificial Sequence
  chemically synthesized
caatgttactggggataatttc

SEQ ID NO: 1022101 - DNA, 22 bp, Artificial Sequence
  chemically synthesized
gatgaatggattgaaattatcc

SEQ ID NO: 1022102 - DNA, 22 bp, Artificial Sequence
  chemically synthesized
cttgatgaatggattgaaatta

SEQ ID NO: 1022103 - DNA, 22 bp, Artificial Sequence
  chemically synthesized
gcttgatgaatggattgaaatt

SEQ ID NO: 1022104 - DNA, 22 bp, Artificial Sequence
  chemically synthesized
ttgcttgatgaatggattgaaa

SEQ ID NO: 1022105 - DNA, 22 bp, Artificial Sequence
  chemically synthesized
ctggggataatttcaatccatt

SEQ ID NO: 1022106 - DNA, 22 bp, Artificial Sequence
  chemically synthesized
tcttgcttgatgaatggattga

SEQ ID NO: 1022107 - DNA, 22 bp, Artificial Sequence
  chemically synthesized
gggataatttcaatccattcat

SEQ ID NO: 1022108 - DNA, 22 bp, Artificial Sequence
  chemically synthesized
ttctcttgcttgatgaatggat

SEQ ID NO: 1022109 - DNA, 22 bp, Artificial Sequence
  chemically synthesized
catctgttctcttgcttgatga

SEQ ID NO: 1022110 - DNA, 22 bp, Artificial Sequence
  chemically synthesized
caatccattcatcaagcaagag

SEQ ID NO: 1022111 - DNA, 22 bp, Artificial Sequence
  chemically synthesized
aatccattcatcaagcaagaga

SEQ ID NO: 1022112 - DNA, 22 bp, Artificial Sequence
  chemically synthesized
tgttgcatctgttctcttgctt

SEQ ID NO: 1022113 - DNA, 22 bp, Artificial Sequence
  chemically synthesized
ggaactgtgttgcatctgttct

SEQ ID NO: 1022114 - DNA, 22 bp, Artificial Sequence
  chemically synthesized
atcaagcaagagaacagatgca

SEQ ID NO: 1022115 - DNA, 22 bp, Artificial Sequence
  chemically synthesized
ctgggaactgtgttgcatctgt

SEQ ID NO: 1022116 - DNA, 22 bp, Artificial Sequence
  chemically synthesized
ctgctgggaactgtgttgcatc

SEQ ID NO: 1022117 - DNA, 22 bp, Artificial Sequence
  chemically synthesized
gctgctgggaactgtgttgcat

SEQ ID NO: 1022118 - DNA, 22 bp, Artificial Sequence
  chemically synthesized
ccagcagcaaggctatgtcttt

SEQ ID NO: 1022119 - DNA, 22 bp, Artificial Sequence
  chemically synthesized
tgtaggtgtaagaataaagaca

SEQ ID NO: 1022120 - DNA, 22 bp, Artificial Sequence
  chemically synthesized
tgggcctatgtaggtgtaagaa

SEQ ID NO: 1022121 - DNA, 22 bp, Artificial Sequence
  chemically synthesized
atgggcctatgtaggtgtaaga

SEQ ID NO: 1022122 - DNA, 22 bp, Artificial Sequence
  chemically synthesized
tgtctttattcttacacctaca

SEQ ID NO: 1022123 - DNA, 22 bp, Artificial Sequence
  chemically synthesized
aacttatgggcctatgtaggtg

SEQ ID NO: 1022124 - DNA, 22 bp, Artificial Sequence
  chemically synthesized
tattcttacacctacataggcc

SEQ ID NO: 1022125 - DNA, 22 bp, Artificial Sequence
  chemically synthesized
cctaaacttatgggcctatgta

SEQ ID NO: 1022126 - DNA, 22 bp, Artificial Sequence
  chemically synthesized
attcttacacctacataggccc

SEQ ID NO: 1022127 - DNA, 22 bp, Artificial Sequence
  chemically synthesized
gcctaaacttatgggcctatgt

SEQ ID NO: 1022128 - DNA, 22 bp, Artificial Sequence
  chemically synthesized
ttcttacacctacataggccca

SEQ ID NO: 1022129 - DNA, 22 bp, Artificial Sequence
  chemically synthesized
ttacacctacataggcccataa

SEQ ID NO: 1022130 - DNA, 22 bp, Artificial Sequence
  chemically synthesized
acacctacataggcccataagt

SEQ ID NO: 1022131 - DNA, 22 bp, Artificial Sequence
  chemically synthesized
tggcttgcctaaacttatgggc

SEQ ID NO: 1022132 - DNA, 22 bp, Artificial Sequence
  chemically synthesized
cacctacataggcccataagtt

SEQ ID NO: 1022133 - DNA, 22 bp, Artificial Sequence
  chemically synthesized
acgctatggcttgcctaaactt

SEQ ID NO: 1022134 - DNA, 22 bp, Artificial Sequence
  chemically synthesized
cataggcccataagtttaggca

SEQ ID NO: 1022135 - DNA, 22 bp, Artificial Sequence
  chemically synthesized
tagcctgacgctatggcttgcc

SEQ ID NO: 1022136 - DNA, 22 bp, Artificial Sequence
  chemically synthesized
aggctgtagcctgacgctatgg

SEQ ID NO: 1022137 - DNA, 22 bp, Artificial Sequence
  chemically synthesized
caggctgtagcctgacgctatg

SEQ ID NO: 1022138 - DNA, 22 bp, Artificial Sequence
  chemically synthesized
ttcaggctgtagcctgacgcta

SEQ ID NO: 1022139 - DNA, 22 bp, Artificial Sequence
  chemically synthesized
cttcaggctgtagcctgacgct

SEQ ID NO: 1022140 - DNA, 22 bp, Artificial Sequence
  chemically synthesized
aggcaagccatagcgtcaggct

SEQ ID NO: 1022141 - DNA, 22 bp, Artificial Sequence
  chemically synthesized
ggcaagccatagcgtcaggcta

SEQ ID NO: 1022142 - DNA, 22 bp, Artificial Sequence
  chemically synthesized
gggaaaaagtgcttcttcaggc

SEQ ID NO: 1022143 - DNA, 22 bp, Artificial Sequence
  chemically synthesized
cagcctgaagaagcactttttc

SEQ ID NO: 1022144 - DNA, 22 bp, Artificial Sequence
  chemically synthesized
gtgaaagaaaacctggggaaaa

SEQ ID NO: 1022145 - DNA, 22 bp, Artificial Sequence
  chemically synthesized
aagaagcactttttccccaggt

SEQ ID NO: 1022146 - DNA, 22 bp, Artificial Sequence
  chemically synthesized
cattcgtgaaagaaaacctggg

SEQ ID NO: 1022147 - DNA, 22 bp, Artificial Sequence
  chemically synthesized
gcattcgtgaaagaaaacctgg

SEQ ID NO: 1022148 - DNA, 22 bp, Artificial Sequence
  chemically synthesized
tttccccaggttttctttcacg

SEQ ID NO: 1022149 - DNA, 22 bp, Artificial Sequence
  chemically synthesized
ttccccaggttttctttcacga

SEQ ID NO: 1022150 - DNA, 22 bp, Artificial Sequence
  chemically synthesized
tggtgcttgcattcgtgaaaga

SEQ ID NO: 1022151 - DNA, 22 bp, Artificial Sequence
  chemically synthesized
tccccaggttttctttcacgaa

SEQ ID NO: 1022152 - DNA, 22 bp, Artificial Sequence
  chemically synthesized
ccccaggttttctttcacgaat

SEQ ID NO: 1022153 - DNA, 22 bp, Artificial Sequence
  chemically synthesized
cccaggttttctttcacgaatg

SEQ ID NO: 1022154 - DNA, 22 bp, Artificial Sequence
  chemically synthesized
ggctgtggtgcttgcattcgtg

SEQ ID NO: 1022155 - DNA, 22 bp, Artificial Sequence
  chemically synthesized
tctttcacgaatgcaagcacca

SEQ ID NO: 1022156 - DNA, 22 bp, Artificial Sequence
  chemically synthesized
ctttcacgaatgcaagcaccac

SEQ ID NO: 1022157 - DNA, 22 bp, Artificial Sequence
  chemically synthesized
tttcacgaatgcaagcaccaca

SEQ ID NO: 1022158 - DNA, 22 bp, Artificial Sequence
  chemically synthesized
tcacgaatgcaagcaccacagc

SEQ ID NO: 1022159 - DNA, 22 bp, Artificial Sequence
  chemically synthesized
cacgaatgcaagcaccacagcc

SEQ ID NO: 1022160 - DNA, 22 bp, Artificial Sequence
  chemically synthesized
acgaatgcaagcaccacagccc

SEQ ID NO: 1022161 - DNA, 22 bp, Artificial Sequence
  chemically synthesized
aaaaccagaggctgggctgtgg

SEQ ID NO: 1022162 - DNA, 22 bp, Artificial Sequence
  chemically synthesized
agtattcaaaaccagaggctgg

SEQ ID NO: 1022163 - DNA, 22 bp, Artificial Sequence
  chemically synthesized
gagacaaactcagtattcaaaa

SEQ ID NO: 1022164 - DNA, 22 bp, Artificial Sequence
  chemically synthesized
tggttttgaatactgagtttgt

SEQ ID NO: 1022165 - DNA, 22 bp, Artificial Sequence
  chemically synthesized
gttttgaatactgagtttgtct

SEQ ID NO: 1022166 - DNA, 22 bp, Artificial Sequence
  chemically synthesized
tgaatactgagtttgtctccag

SEQ ID NO: 1022167 - DNA, 22 bp, Artificial Sequence
  chemically synthesized
gaatactgagtttgtctccagt

SEQ ID NO: 1022168 - DNA, 22 bp, Artificial Sequence
  chemically synthesized
aatactgagtttgtctccagtt

SEQ ID NO: 1022169 - DNA, 22 bp, Artificial Sequence
  chemically synthesized
aagcaaggtgtggaactggaga

SEQ ID NO: 1022170 - DNA, 22 bp, Artificial Sequence
  chemically synthesized
caagcaaggtgtggaactggag

SEQ ID NO: 1022171 - DNA, 22 bp, Artificial Sequence
  chemically synthesized
cttcaagcaaggtgtggaactg

SEQ ID NO: 1022172 - DNA, 22 bp, Artificial Sequence
  chemically synthesized
agtttgtctccagttccacacc

SEQ ID NO: 1022173 - DNA, 22 bp, Artificial Sequence
  chemically synthesized
aaattgcttcaagcaaggtgtg

SEQ ID NO: 1022174 - DNA, 22 bp, Artificial Sequence
  chemically synthesized
gtctccagttccacaccttgct

SEQ ID NO: 1022175 - DNA, 22 bp, Artificial Sequence
  chemically synthesized
tctccagttccacaccttgctt

SEQ ID NO: 1022176 - DNA, 22 bp, Artificial Sequence
  chemically synthesized
cagttccacaccttgcttgaag

SEQ ID NO: 1022177 - DNA, 22 bp, Artificial Sequence
  chemically synthesized
ggattaaaattgcttcaagcaa

SEQ ID NO: 1022178 - DNA, 22 bp, Artificial Sequence
  chemically synthesized
cacaccttgcttgaagcaattt

SEQ ID NO: 1022179 - DNA, 22 bp, Artificial Sequence
  chemically synthesized
cgggatagttgggattaaaatt

SEQ ID NO: 1022180 - DNA, 22 bp, Artificial Sequence
  chemically synthesized
gcttgaagcaattttaatccca

SEQ ID NO: 1022181 - DNA, 22 bp, Artificial Sequence
  chemically synthesized
cttgaagcaattttaatcccaa

SEQ ID NO: 1022182 - DNA, 22 bp, Artificial Sequence
  chemically synthesized
gaagcaattttaatcccaacta

SEQ ID NO: 1022183 - DNA, 22 bp, Artificial Sequence
  chemically synthesized
gatgctgcgggatagttgggat

SEQ ID NO: 1022184 - DNA, 22 bp, Artificial Sequence
  chemically synthesized
aagcaattttaatcccaactat

SEQ ID NO: 1022185 - DNA, 22 bp, Artificial Sequence
  chemically synthesized
ggatgctgcgggatagttggga

SEQ ID NO: 1022186 - DNA, 22 bp, Artificial Sequence
  chemically synthesized
taatcccaactatcccgcagca

SEQ ID NO: 1022187 - DNA, 22 bp, Artificial Sequence
  chemically synthesized
aatcccaactatcccgcagcat

SEQ ID NO: 1022188 - DNA, 22 bp, Artificial Sequence
  chemically synthesized
atcccaactatcccgcagcatc

SEQ ID NO: 1022189 - DNA, 22 bp, Artificial Sequence
  chemically synthesized
tcccgcagcatccaaattcctg

SEQ ID NO: 1022190 - DNA, 22 bp, Artificial Sequence
  chemically synthesized
aaccacaaaacaacagtggaag

SEQ ID NO: 1022191 - DNA, 22 bp, Artificial Sequence
  chemically synthesized
acactgaaccacaaaacaacag

SEQ ID NO: 1022192 - DNA, 22 bp, Artificial Sequence
  chemically synthesized
gacactgaaccacaaaacaaca

SEQ ID NO: 1022193 - DNA, 22 bp, Artificial Sequence
  chemically synthesized
ctggcttccactgttgttttgt

SEQ ID NO: 1022194 - DNA, 22 bp, Artificial Sequence
  chemically synthesized
gcttccactgttgttttgtggt

SEQ ID NO: 1022195 - DNA, 22 bp, Artificial Sequence
  chemically synthesized
ccactgttgttttgtggttcag

SEQ ID NO: 1022196 - DNA, 22 bp, Artificial Sequence
  chemically synthesized
acagacttgacactgaaccaca

SEQ ID NO: 1022197 - DNA, 22 bp, Artificial Sequence
  chemically synthesized
cactgttgttttgtggttcagt

SEQ ID NO: 1022198 - DNA, 22 bp, Artificial Sequence
  chemically synthesized
ttgttttgtggttcagtgtcaa

SEQ ID NO: 1022199 - DNA, 22 bp, Artificial Sequence
  chemically synthesized
ttttgtggttcagtgtcaagtc

SEQ ID NO: 1022200 - DNA, 22 bp, Artificial Sequence
  chemically synthesized
tgtggttcagtgtcaagtctgt

SEQ ID NO: 1022201 - DNA, 22 bp, Artificial Sequence
  chemically synthesized
gtggttcagtgtcaagtctgtc

SEQ ID NO: 1022202 - DNA, 22 bp, Artificial Sequence
  chemically synthesized
tggttcagtgtcaagtctgtca

SEQ ID NO: 1022203 - DNA, 22 bp, Artificial Sequence
  chemically synthesized
agtgtcaagtctgtcagggact

SEQ ID NO: 1022204 - DNA, 22 bp, Artificial Sequence
  chemically synthesized
tcagggacttccgccccattct

SEQ ID NO: 1022205 - DNA, 22 bp, Artificial Sequence
  chemically synthesized
cagaaatgtaaagcagagaatg

SEQ ID NO: 1022206 - DNA, 22 bp, Artificial Sequence
  chemically synthesized
acagaaatgtaaagcagagaat

SEQ ID NO: 1022207 - DNA, 22 bp, Artificial Sequence
  chemically synthesized
ccgccccattctctgctttaca

SEQ ID NO: 1022208 - DNA, 22 bp, Artificial Sequence
  chemically synthesized
cgccccattctctgctttacat

SEQ ID NO: 1022209 - DNA, 22 bp, Artificial Sequence
  chemically synthesized
cagaaatatatttacagaaatg

SEQ ID NO: 1022210 - DNA, 22 bp, Artificial Sequence
  chemically synthesized
acagaaatatatttacagaaat

SEQ ID NO: 1022211 - DNA, 22 bp, Artificial Sequence
  chemically synthesized
tctgctttacatttctgtaaat

SEQ ID NO: 1022212 - DNA, 22 bp, Artificial Sequence
  chemically synthesized
tgctttacatttctgtaaatat

SEQ ID NO: 1022213 - DNA, 22 bp, Artificial Sequence
  chemically synthesized
ctttacatttctgtaaatatat

SEQ ID NO: 1022214 - DNA, 22 bp, Artificial Sequence
  chemically synthesized
tacatttctgtaaatatatttc

SEQ ID NO: 1022215 - DNA, 22 bp, Artificial Sequence
  chemically synthesized
acatttctgtaaatatatttct

SEQ ID NO: 1022216 - DNA, 22 bp, Artificial Sequence
  chemically synthesized
catttctgtaaatatatttctg

SEQ ID NO: 1022217 - DNA, 22 bp, Artificial Sequence
  chemically synthesized
ctgtaaatatatttctgtaaat

SEQ ID NO: 1022218 - DNA, 22 bp, Artificial Sequence
  chemically synthesized
tgtaaatatatttctgtaaata

SEQ ID NO: 1022219 - DNA, 22 bp, Artificial Sequence
  chemically synthesized
taaatatatttctgtaaataca

SEQ ID NO: 1022220 - DNA, 22 bp, Artificial Sequence
  chemically synthesized
ctgtaaatacacatcatgattt

SEQ ID NO: 1022221 - DNA, 22 bp, Artificial Sequence
  chemically synthesized
tgtaaatacacatcatgatttg

SEQ ID NO: 1022222 - DNA, 22 bp, Artificial Sequence
  chemically synthesized
taaatacacatcatgatttgat

SEQ ID NO: 1022223 - DNA, 22 bp, Artificial Sequence
  chemically synthesized
atgacaagataatcaaatacat

SEQ ID NO: 1022224 - DNA, 22 bp, Artificial Sequence
  chemically synthesized
gatatgtatttgattatcttgt

SEQ ID NO: 1022225 - DNA, 22 bp, Artificial Sequence
  chemically synthesized
atatgtatttgattatcttgtc

SEQ ID NO: 1022226 - DNA, 22 bp, Artificial Sequence
  chemically synthesized
cagaaatatatgttgatgacaa

SEQ ID NO: 1022227 - DNA, 22 bp, Artificial Sequence
  chemically synthesized
acagaaatatatgttgatgaca

SEQ ID NO: 1022228 - DNA, 22 bp, Artificial Sequence
  chemically synthesized
gattatcttgtcatcaacatat

SEQ ID NO: 1022229 - DNA, 22 bp, Artificial Sequence
  chemically synthesized
attatcttgtcatcaacatata

SEQ ID NO: 1022230 - DNA, 22 bp, Artificial Sequence
  chemically synthesized
tatttacagaaatatatgttga

SEQ ID NO: 1022231 - DNA, 22 bp, Artificial Sequence
  chemically synthesized
tcttgtcatcaacatatatttc

SEQ ID NO: 1022232 - DNA, 22 bp, Artificial Sequence
  chemically synthesized
gtcatcaacatatatttctgta

SEQ ID NO: 1022233 - DNA, 22 bp, Artificial Sequence
  chemically synthesized
cagaactgtatttacagaaata

SEQ ID NO: 1022234 - DNA, 22 bp, Artificial Sequence
  chemically synthesized
tcatcaacatatatttctgtaa

SEQ ID NO: 1022235 - DNA, 22 bp, Artificial Sequence
  chemically synthesized
acagaactgtatttacagaaat

SEQ ID NO: 1022236 - DNA, 22 bp, Artificial Sequence
  chemically synthesized
ctgtaaatacagttctgtaaat

SEQ ID NO: 1022237 - DNA, 22 bp, Artificial Sequence
  chemically synthesized
tgtaaatacagttctgtaaata

SEQ ID NO: 1022238 - DNA, 22 bp, Artificial Sequence
  chemically synthesized
taaatacagttctgtaaatata

SEQ ID NO: 1022239 - DNA, 22 bp, Artificial Sequence
  chemically synthesized
tgtaaatatatccttttttatt

SEQ ID NO: 1022240 - DNA, 22 bp, Artificial Sequence
  chemically synthesized
taaatatatccttttttatttt

SEQ ID NO: 1022241 - DNA, 22 bp, Artificial Sequence
  chemically synthesized
ttttattttctattttttcatt

SEQ ID NO: 1022242 - DNA, 22 bp, Artificial Sequence
  chemically synthesized
ccaaaatacagcaatgaaaaaa

SEQ ID NO: 1022243 - DNA, 22 bp, Artificial Sequence
  chemically synthesized
tttattttctattttttcattg

SEQ ID NO: 1022244 - DNA, 22 bp, Artificial Sequence
  chemically synthesized
ttattttctattttttcattgc

SEQ ID NO: 1022245 - DNA, 22 bp, Artificial Sequence
  chemically synthesized
tattttctattttttcattgct

SEQ ID NO: 1022246 - DNA, 22 bp, Artificial Sequence
  chemically synthesized
ctcccaaaatacagcaatgaaa

SEQ ID NO: 1022247 - DNA, 22 bp, Artificial Sequence
  chemically synthesized
attttctattttttcattgctg

SEQ ID NO: 1022248 - DNA, 22 bp, Artificial Sequence
  chemically synthesized
ttttctattttttcattgctgt

SEQ ID NO: 1022249 - DNA, 22 bp, Artificial Sequence
  chemically synthesized
tctattttttcattgctgtatt

SEQ ID NO: 1022250 - DNA, 22 bp, Artificial Sequence
  chemically synthesized
atctgctcccaaaatacagcaa

SEQ ID NO: 1022251 - DNA, 22 bp, Artificial Sequence
  chemically synthesized
ctattttttcattgctgtattt

SEQ ID NO: 1022252 - DNA, 22 bp, Artificial Sequence
  chemically synthesized
tattttttcattgctgtatttt

SEQ ID NO: 1022253 - DNA, 22 bp, Artificial Sequence
  chemically synthesized
ttttttcattgctgtattttgg

SEQ ID NO: 1022254 - DNA, 22 bp, Artificial Sequence
  chemically synthesized
tcctcatctgctcccaaaatac

SEQ ID NO: 1022255 - DNA, 22 bp, Artificial Sequence
  chemically synthesized
tttcattgctgtattttgggag

SEQ ID NO: 1022256 - DNA, 22 bp, Artificial Sequence
  chemically synthesized
ttcattgctgtattttgggagc

SEQ ID NO: 1022257 - DNA, 22 bp, Artificial Sequence
  chemically synthesized
tcattgctgtattttgggagca

SEQ ID NO: 1022258 - DNA, 22 bp, Artificial Sequence
  chemically synthesized
cattgctgtattttgggagcag

SEQ ID NO: 1022259 - DNA, 22 bp, Artificial Sequence
  chemically synthesized
attgctgtattttgggagcaga

SEQ ID NO: 1022260 - DNA, 22 bp, Artificial Sequence
  chemically synthesized
ctgtattttgggagcagatgag

SEQ ID NO: 1022261 - DNA, 22 bp, Artificial Sequence
  chemically synthesized
atccaagtgttatcctcatctg

SEQ ID NO: 1022262 - DNA, 22 bp, Artificial Sequence
  chemically synthesized
tattttgggagcagatgaggat

SEQ ID NO: 1022263 - DNA, 22 bp, Artificial Sequence
  chemically synthesized
taatccaagtgttatcctcatc

SEQ ID NO: 1022264 - DNA, 22 bp, Artificial Sequence
  chemically synthesized
ctaatccaagtgttatcctcat

SEQ ID NO: 1022265 - DNA, 22 bp, Artificial Sequence
  chemically synthesized
tgggagcagatgaggataacac

SEQ ID NO: 1022266 - DNA, 22 bp, Artificial Sequence
  chemically synthesized
gggagcagatgaggataacact

SEQ ID NO: 1022267 - DNA, 22 bp, Artificial Sequence
  chemically synthesized
ggagcagatgaggataacactt

SEQ ID NO: 1022268 - DNA, 22 bp, Artificial Sequence
  chemically synthesized
gagatttctaatccaagtgtta

SEQ ID NO: 1022269 - DNA, 22 bp, Artificial Sequence
  chemically synthesized
ggattagaaatctctaatcatt

SEQ ID NO: 1022270 - DNA, 22 bp, Artificial Sequence
  chemically synthesized
gattagaaatctctaatcattt

SEQ ID NO: 1022271 - DNA, 22 bp, Artificial Sequence
  chemically synthesized
taaaaaccaatgcaaaatgatt

SEQ ID NO: 1022272 - DNA, 22 bp, Artificial Sequence
  chemically synthesized
gaaatctctaatcattttgcat

SEQ ID NO: 1022273 - DNA, 22 bp, Artificial Sequence
  chemically synthesized
ttataaaaaccaatgcaaaatg

SEQ ID NO: 1022274 - DNA, 22 bp, Artificial Sequence
  chemically synthesized
gtacctattataaaaaccaatg

SEQ ID NO: 1022275 - DNA, 22 bp, Artificial Sequence
  chemically synthesized
taatcattttgcattggttttt

SEQ ID NO: 1022276 - DNA, 22 bp, Artificial Sequence
  chemically synthesized
atcattttgcattggtttttat

SEQ ID NO: 1022277 - DNA, 22 bp, Artificial Sequence
  chemically synthesized
tgctggtacctattataaaaac

SEQ ID NO: 1022278 - DNA, 22 bp, Artificial Sequence
  chemically synthesized
tgcattggtttttataataggt

SEQ ID NO: 1022279 - DNA, 22 bp, Artificial Sequence
  chemically synthesized
gcattggtttttataataggta

SEQ ID NO: 1022280 - DNA, 22 bp, Artificial Sequence
  chemically synthesized
cattggtttttataataggtac

SEQ ID NO: 1022281 - DNA, 22 bp, Artificial Sequence
  chemically synthesized
gtttttataataggtaccagca

SEQ ID NO: 1022282 - DNA, 22 bp, Artificial Sequence
  chemically synthesized
ttataataggtaccagcataac

SEQ ID NO: 1022283 - DNA, 22 bp, Artificial Sequence
  chemically synthesized
tataataggtaccagcataacg

SEQ ID NO: 1022284 - DNA, 22 bp, Artificial Sequence
  chemically synthesized
tggaaaaatatacgttatgctg

SEQ ID NO: 1022285 - DNA, 22 bp, Artificial Sequence
  chemically synthesized
ataataggtaccagcataacgt

SEQ ID NO: 1022286 - DNA, 22 bp, Artificial Sequence
  chemically synthesized
atggaaaaatatacgttatgct

SEQ ID NO: 1022287 - DNA, 22 bp, Artificial Sequence
  chemically synthesized
taataggtaccagcataacgta

SEQ ID NO: 1022288 - DNA, 22 bp, Artificial Sequence
  chemically synthesized
ggtatatgccttatggaaaaat

SEQ ID NO: 1022289 - DNA, 22 bp, Artificial Sequence
  chemically synthesized
ttgggtatatgccttatggaaa

SEQ ID NO: 1022290 - DNA, 22 bp, Artificial Sequence
  chemically synthesized
tattgggtatatgccttatgga

SEQ ID NO: 1022291 - DNA, 22 bp, Artificial Sequence
  chemically synthesized
ttccataaggcatatacccaat

SEQ ID NO: 1022292 - DNA, 22 bp, Artificial Sequence
  chemically synthesized
tccataaggcatatacccaata

SEQ ID NO: 1022293 - DNA, 22 bp, Artificial Sequence
  chemically synthesized
ccataaggcatatacccaatag

SEQ ID NO: 1022294 - DNA, 22 bp, Artificial Sequence
  chemically synthesized
cataaggcatatacccaataga

SEQ ID NO: 1022295 - DNA, 22 bp, Artificial Sequence
  chemically synthesized
taaaatagtggtccctctattg

SEQ ID NO: 1022296 - DNA, 22 bp, Artificial Sequence
  chemically synthesized
aggctataaaatagtggtccct

SEQ ID NO: 1022297 - DNA, 22 bp, Artificial Sequence
  chemically synthesized
aaggctataaaatagtggtccc

SEQ ID NO: 1022298 - DNA, 22 bp, Artificial Sequence
  chemically synthesized
cacttaaggctataaaatagtg

SEQ ID NO: 1022299 - DNA, 22 bp, Artificial Sequence
  chemically synthesized
ccacttaaggctataaaatagt

SEQ ID NO: 1022300 - DNA, 22 bp, Artificial Sequence
  chemically synthesized
ataacagagcttccacttaagg

SEQ ID NO: 1022301 - DNA, 22 bp, Artificial Sequence
  chemically synthesized
ttttatagccttaagtggaagc

SEQ ID NO: 1022302 - DNA, 22 bp, Artificial Sequence
  chemically synthesized
tatagccttaagtggaagctct

SEQ ID NO: 1022303 - DNA, 22 bp, Artificial Sequence
  chemically synthesized
atagccttaagtggaagctctg

SEQ ID NO: 1022304 - DNA, 22 bp, Artificial Sequence
  chemically synthesized
tagccttaagtggaagctctgt

SEQ ID NO: 1022305 - DNA, 22 bp, Artificial Sequence
  chemically synthesized
agacacatatgtctcataacag

SEQ ID NO: 1022306 - DNA, 22 bp, Artificial Sequence
  chemically synthesized
aagtggaagctctgttatgaga

SEQ ID NO: 1022307 - DNA, 22 bp, Artificial Sequence
  chemically synthesized
agtggaagctctgttatgagac

SEQ ID NO: 1022308 - DNA, 22 bp, Artificial Sequence
  chemically synthesized
ggttgagacacatatgtctcat

SEQ ID NO: 1022309 - DNA, 22 bp, Artificial Sequence
  chemically synthesized
tgttatgagacatatgtgtctc

SEQ ID NO: 1022310 - DNA, 22 bp, Artificial Sequence
  chemically synthesized
ttatgagacatatgtgtctcaa

SEQ ID NO: 1022311 - DNA, 22 bp, Artificial Sequence
  chemically synthesized
tgagacatatgtgtctcaaccc

SEQ ID NO: 1022312 - DNA, 22 bp, Artificial Sequence
  chemically synthesized
tatagaaccggctgggttgaga

SEQ ID NO: 1022313 - DNA, 22 bp, Artificial Sequence
  chemically synthesized
taaactgtatagaaccggctgg

SEQ ID NO: 1022314 - DNA, 22 bp, Artificial Sequence
  chemically synthesized
gtaaactgtatagaaccggctg

SEQ ID NO: 1022315 - DNA, 22 bp, Artificial Sequence
  chemically synthesized
gtcttgtaaactgtatagaacc

SEQ ID NO: 1022316 - DNA, 22 bp, Artificial Sequence
  chemically synthesized
aacccagccggttctatacagt

SEQ ID NO: 1022317 - DNA, 22 bp, Artificial Sequence
  chemically synthesized
cctggtcttgtaaactgtatag

SEQ ID NO: 1022318 - DNA, 22 bp, Artificial Sequence
  chemically synthesized
tatacagtttacaagaccaggt

SEQ ID NO: 1022319 - DNA, 22 bp, Artificial Sequence
  chemically synthesized
tacagtttacaagaccaggtag

SEQ ID NO: 1022320 - DNA, 22 bp, Artificial Sequence
  chemically synthesized
gggagcatgatgatctacctgg

SEQ ID NO: 1022321 - DNA, 22 bp, Artificial Sequence
  chemically synthesized
tggggagcatgatgatctacct

SEQ ID NO: 1022322 - DNA, 22 bp, Artificial Sequence
  chemically synthesized
tctggggagcatgatgatctac

SEQ ID NO: 1022323 - DNA, 22 bp, Artificial Sequence
  chemically synthesized
acaagaccaggtagatcatcat

SEQ ID NO: 1022324 - DNA, 22 bp, Artificial Sequence
  chemically synthesized
caagaccaggtagatcatcatg

SEQ ID NO: 1022325 - DNA, 22 bp, Artificial Sequence
  chemically synthesized
ggtctctctggggagcatgatg

SEQ ID NO: 1022326 - DNA, 22 bp, Artificial Sequence
  chemically synthesized
gggtctctctggggagcatgat

SEQ ID NO: 1022327 - DNA, 22 bp, Artificial Sequence
  chemically synthesized
tcttgggtctctctggggagca

SEQ ID NO: 1022328 - DNA, 22 bp, Artificial Sequence
  chemically synthesized
atcttgggtctctctggggagc

SEQ ID NO: 1022329 - DNA, 22 bp, Artificial Sequence
  chemically synthesized
atcatcttatcttgggtctctc

SEQ ID NO: 1022330 - DNA, 22 bp, Artificial Sequence
  chemically synthesized
cccagagagacccaagataaga

SEQ ID NO: 1022331 - DNA, 22 bp, Artificial Sequence
  chemically synthesized
gaaaaataaccctaatcatctt

SEQ ID NO: 1022332 - DNA, 22 bp, Artificial Sequence
  chemically synthesized
tgtgctagaaaaataaccctaa

SEQ ID NO: 1022333 - DNA, 22 bp, Artificial Sequence
  chemically synthesized
atgtgctagaaaaataacccta

SEQ ID NO: 1022334 - DNA, 22 bp, Artificial Sequence
  chemically synthesized
tatgtgctagaaaaataaccct

SEQ ID NO: 1022335 - DNA, 22 bp, Artificial Sequence
  chemically synthesized
ttttatgtgctagaaaaataac

SEQ ID NO: 1022336 - DNA, 22 bp, Artificial Sequence
  chemically synthesized
gggttatttttctagcacataa

SEQ ID NO: 1022337 - DNA, 22 bp, Artificial Sequence
  chemically synthesized
tttttctagcacataaaataga

SEQ ID NO: 1022338 - DNA, 22 bp, Artificial Sequence
  chemically synthesized
ttctagcacataaaatagactt

SEQ ID NO: 1022339 - DNA, 22 bp, Artificial Sequence
  chemically synthesized
tctagcacataaaatagacttc

SEQ ID NO: 1022340 - DNA, 22 bp, Artificial Sequence
  chemically synthesized
ctagcacataaaatagacttcc

SEQ ID NO: 1022341 - DNA, 22 bp, Artificial Sequence
  chemically synthesized
catgtcagaaaaggaagtctat

SEQ ID NO: 1022342 - DNA, 22 bp, Artificial Sequence
  chemically synthesized
tagcacataaaatagacttcct

SEQ ID NO: 1022343 - DNA, 22 bp, Artificial Sequence
  chemically synthesized
gcacataaaatagacttccttt

SEQ ID NO: 1022344 - DNA, 22 bp, Artificial Sequence
  chemically synthesized
aggcctccatgtcagaaaagga

SEQ ID NO: 1022345 - DNA, 22 bp, Artificial Sequence
  chemically synthesized
ggattcaggcctccatgtcaga

SEQ ID NO: 1022346 - DNA, 22 bp, Artificial Sequence
  chemically synthesized
gttaggattcaggcctccatgt

SEQ ID NO: 1022347 - DNA, 22 bp, Artificial Sequence
  chemically synthesized
ggttaggattcaggcctccatg

SEQ ID NO: 1022348 - DNA, 22 bp, Artificial Sequence
  chemically synthesized
ccttttctgacatggaggcctg

SEQ ID NO: 1022349 - DNA, 22 bp, Artificial Sequence
  chemically synthesized
cttttctgacatggaggcctga

SEQ ID NO: 1022350 - DNA, 22 bp, Artificial Sequence
  chemically synthesized
ttctgacatggaggcctgaatc

SEQ ID NO: 1022351 - DNA, 22 bp, Artificial Sequence
  chemically synthesized
tctgacatggaggcctgaatcc

SEQ ID NO: 1022352 - DNA, 22 bp, Artificial Sequence
  chemically synthesized
ctgacatggaggcctgaatcct

SEQ ID NO: 1022353 - DNA, 22 bp, Artificial Sequence
  chemically synthesized
tgacatggaggcctgaatccta

SEQ ID NO: 1022354 - DNA, 22 bp, Artificial Sequence
  chemically synthesized
acatggaggcctgaatcctaac

SEQ ID NO: 1022355 - DNA, 22 bp, Artificial Sequence
  chemically synthesized
ccaaggaaatttggttaggatt

SEQ ID NO: 1022356 - DNA, 22 bp, Artificial Sequence
  chemically synthesized
cagttaccaaggaaatttggtt

SEQ ID NO: 1022357 - DNA, 22 bp, Artificial Sequence
  chemically synthesized
ttgcagttaccaaggaaatttg

SEQ ID NO: 1022358 - DNA, 22 bp, Artificial Sequence
  chemically synthesized
gttgcagttaccaaggaaattt

SEQ ID NO: 1022359 - DNA, 22 bp, Artificial Sequence
  chemically synthesized
aatcctaaccaaatttccttgg

SEQ ID NO: 1022360 - DNA, 22 bp, Artificial Sequence
  chemically synthesized
ttgttgcagttaccaaggaaat

SEQ ID NO: 1022361 - DNA, 22 bp, Artificial Sequence
  chemically synthesized
accaaatttccttggtaactgc

SEQ ID NO: 1022362 - DNA, 22 bp, Artificial Sequence
  chemically synthesized
ccttggtaactgcaacaagaac

SEQ ID NO: 1022363 - DNA, 22 bp, Artificial Sequence
  chemically synthesized
cttggtaactgcaacaagaact

SEQ ID NO: 1022364 - DNA, 22 bp, Artificial Sequence
  chemically synthesized
ggtaactgcaacaagaactgtc

SEQ ID NO: 1022365 - DNA, 22 bp, Artificial Sequence
  chemically synthesized
gaacaatatgtagacagttctt

SEQ ID NO: 1022366 - DNA, 22 bp, Artificial Sequence
  chemically synthesized
gtaactgcaacaagaactgtct

SEQ ID NO: 1022367 - DNA, 22 bp, Artificial Sequence
  chemically synthesized
caacaagaactgtctacatatt

SEQ ID NO: 1022368 - DNA, 22 bp, Artificial Sequence
  chemically synthesized
aaggtggaattggaacaatatg

SEQ ID NO: 1022369 - DNA, 22 bp, Artificial Sequence
  chemically synthesized
tctacatattgttccaattcca

SEQ ID NO: 1022370 - DNA, 22 bp, Artificial Sequence
  chemically synthesized
aaggactgaaggtggaattgga

SEQ ID NO: 1022371 - DNA, 22 bp, Artificial Sequence
  chemically synthesized
catattgttccaattccacctt

SEQ ID NO: 1022372 - DNA, 22 bp, Artificial Sequence
  chemically synthesized
cctgaaggactgaaggtggaat

SEQ ID NO: 1022373 - DNA, 22 bp, Artificial Sequence
  chemically synthesized
ttccctgaaggactgaaggtgg

SEQ ID NO: 1022374 - DNA, 22 bp, Artificial Sequence
  chemically synthesized
ttccaattccaccttcagtcct

SEQ ID NO: 1022375 - DNA, 22 bp, Artificial Sequence
  chemically synthesized
caattccaccttcagtccttca

SEQ ID NO: 1022376 - DNA, 22 bp, Artificial Sequence
  chemically synthesized
caccttcagtccttcagggaac

SEQ ID NO: 1022377 - DNA, 22 bp, Artificial Sequence
  chemically synthesized
cagtccttcagggaacagtgtc

SEQ ID NO: 1022378 - DNA, 22 bp, Artificial Sequence
  chemically synthesized
agtccttcagggaacagtgtct

SEQ ID NO: 1022379 - DNA, 22 bp, Artificial Sequence
  chemically synthesized
cataggccacacaccagacact

SEQ ID NO: 1022380 - DNA, 22 bp, Artificial Sequence
  chemically synthesized
cagggaacagtgtctggtgtgt

SEQ ID NO: 1022381 - DNA, 22 bp, Artificial Sequence
  chemically synthesized
agggaacagtgtctggtgtgtg

SEQ ID NO: 1022382 - DNA, 22 bp, Artificial Sequence
  chemically synthesized
tgtaatgttacataggccacac

SEQ ID NO: 1022383 - DNA, 22 bp, Artificial Sequence
  chemically synthesized
gtgtgtggcctatgtaacatta

SEQ ID NO: 1022384 - DNA, 22 bp, Artificial Sequence
  chemically synthesized
cagagtgctgtgtaatgttaca

SEQ ID NO: 1022385 - DNA, 22 bp, Artificial Sequence
  chemically synthesized
tggaatctccagagtgctgtgt

SEQ ID NO: 1022386 - DNA, 22 bp, Artificial Sequence
  chemically synthesized
tgtaacattacacagcactctg

SEQ ID NO: 1022387 - DNA, 22 bp, Artificial Sequence
  chemically synthesized
cagatctgtggaatctccagag

SEQ ID NO: 1022388 - DNA, 22 bp, Artificial Sequence
  chemically synthesized
cacagcactctggagattccac

SEQ ID NO: 1022389 - DNA, 22 bp, Artificial Sequence
  chemically synthesized
ggcctgcagatctgtggaatct

SEQ ID NO: 1022390 - DNA, 22 bp, Artificial Sequence
  chemically synthesized
ctaggcctgcagatctgtggaa

SEQ ID NO: 1022391 - DNA, 22 bp, Artificial Sequence
  chemically synthesized
ttactaggcctgcagatctgtg

SEQ ID NO: 1022392 - DNA, 22 bp, Artificial Sequence
  chemically synthesized
gttactaggcctgcagatctgt

SEQ ID NO: 1022393 - DNA, 22 bp, Artificial Sequence
  chemically synthesized
tgttactaggcctgcagatctg

SEQ ID NO: 1022394 - DNA, 22 bp, Artificial Sequence
  chemically synthesized
tggagattccacagatctgcag

SEQ ID NO: 1022395 - DNA, 22 bp, Artificial Sequence
  chemically synthesized
ttgttactaggcctgcagatct

SEQ ID NO: 1022396 - DNA, 22 bp, Artificial Sequence
  chemically synthesized
gagattccacagatctgcaggc

SEQ ID NO: 1022397 - DNA, 22 bp, Artificial Sequence
  chemically synthesized
tttttgttactaggcctgcaga

SEQ ID NO: 1022398 - DNA, 22 bp, Artificial Sequence
  chemically synthesized
tatttttgttactaggcctgca

SEQ ID NO: 1022399 - DNA, 22 bp, Artificial Sequence
  chemically synthesized
ctatttttgttactaggcctgc

SEQ ID NO: 1022400 - DNA, 22 bp, Artificial Sequence
  chemically synthesized
cacagatctgcaggcctagtaa

SEQ ID NO: 1022401 - DNA, 22 bp, Artificial Sequence
  chemically synthesized
aacttctatttttgttactagg

SEQ ID NO: 1022402 - DNA, 22 bp, Artificial Sequence
  chemically synthesized
gttgaacttctatttttgttac

SEQ ID NO: 1022403 - DNA, 22 bp, Artificial Sequence
  chemically synthesized
caggcctagtaacaaaaataga

SEQ ID NO: 1022404 - DNA, 22 bp, Artificial Sequence
  chemically synthesized
gttagttgaacttctatttttg

SEQ ID NO: 1022405 - DNA, 22 bp, Artificial Sequence
  chemically synthesized
attggttagttgaacttctatt

SEQ ID NO: 1022406 - DNA, 22 bp, Artificial Sequence
  chemically synthesized
gtaacaaaaatagaagttcaac

SEQ ID NO: 1022407 - DNA, 22 bp, Artificial Sequence
  chemically synthesized
gttgattggttagttgaacttc

SEQ ID NO: 1022408 - DNA, 22 bp, Artificial Sequence
  chemically synthesized
ttggttgattggttagttgaac

SEQ ID NO: 1022409 - DNA, 22 bp, Artificial Sequence
  chemically synthesized
gttggttgattggttagttgaa

SEQ ID NO: 1022410 - DNA, 22 bp, Artificial Sequence
  chemically synthesized
aactaaccaatcaaccaacaag

SEQ ID NO: 1022411 - DNA, 22 bp, Artificial Sequence
  chemically synthesized
accaatcaaccaacaaggatca

SEQ ID NO: 1022412 - DNA, 22 bp, Artificial Sequence
  chemically synthesized
ggtggcccagagtgatccttgt

SEQ ID NO: 1022413 - DNA, 22 bp, Artificial Sequence
  chemically synthesized
aggtggcccagagtgatccttg

SEQ ID NO: 1022414 - DNA, 22 bp, Artificial Sequence
  chemically synthesized
taacaggacttaggtggcccag

SEQ ID NO: 1022415 - DNA, 22 bp, Artificial Sequence
  chemically synthesized
tgtaacaggacttaggtggccc

SEQ ID NO: 1022416 - DNA, 22 bp, Artificial Sequence
  chemically synthesized
ctgtaacaggacttaggtggcc

SEQ ID NO: 1022417 - DNA, 22 bp, Artificial Sequence
  chemically synthesized
tcttctgtaacaggacttaggt

SEQ ID NO: 1022418 - DNA, 22 bp, Artificial Sequence
  chemically synthesized
gtcttctgtaacaggacttagg

SEQ ID NO: 1022419 - DNA, 22 bp, Artificial Sequence
  chemically synthesized
tgtcttctgtaacaggacttag

SEQ ID NO: 1022420 - DNA, 22 bp, Artificial Sequence
  chemically synthesized
ctttgtcttctgtaacaggact

SEQ ID NO: 1022421 - DNA, 22 bp, Artificial Sequence
  chemically synthesized
tgggccacctaagtcctgttac

SEQ ID NO: 1022422 - DNA, 22 bp, Artificial Sequence
  chemically synthesized
ggccacctaagtcctgttacag

SEQ ID NO: 1022423 - DNA, 22 bp, Artificial Sequence
  chemically synthesized
atcattactttgtcttctgtaa

SEQ ID NO: 1022424 - DNA, 22 bp, Artificial Sequence
  chemically synthesized
agtcctgttacagaagacaaag

SEQ ID NO: 1022425 - DNA, 22 bp, Artificial Sequence
  chemically synthesized
ttacagaagacaaagtaatgat

SEQ ID NO: 1022426 - DNA, 22 bp, Artificial Sequence
  chemically synthesized
cagaagacaaagtaatgatcag

SEQ ID NO: 1022427 - DNA, 22 bp, Artificial Sequence
  chemically synthesized
aaggaggggagtgatgagactg

SEQ ID NO: 1022428 - DNA, 22 bp, Artificial Sequence
  chemically synthesized
aaaggaggggagtgatgagact

SEQ ID NO: 1022429 - DNA, 22 bp, Artificial Sequence
  chemically synthesized
aagtttaaaggaggggagtgat

SEQ ID NO: 1022430 - DNA, 22 bp, Artificial Sequence
  chemically synthesized
atcactcccctcctttaaactt

SEQ ID NO: 1022431 - DNA, 22 bp, Artificial Sequence
  chemically synthesized
gtaccaaggacactgaagttta

SEQ ID NO: 1022432 - DNA, 22 bp, Artificial Sequence
  chemically synthesized
ttagtaccaaggacactgaagt

SEQ ID NO: 1022433 - DNA, 22 bp, Artificial Sequence
  chemically synthesized
ccctcctttaaacttcagtgtc

SEQ ID NO: 1022434 - DNA, 22 bp, Artificial Sequence
  chemically synthesized
ctttaaacttcagtgtccttgg

SEQ ID NO: 1022435 - DNA, 22 bp, Artificial Sequence
  chemically synthesized
taaacttcagtgtccttggtac

SEQ ID NO: 1022436 - DNA, 22 bp, Artificial Sequence
  chemically synthesized
aaacttcagtgtccttggtact

SEQ ID NO: 1022437 - DNA, 22 bp, Artificial Sequence
  chemically synthesized
aacttcagtgtccttggtacta

SEQ ID NO: 1022438 - DNA, 22 bp, Artificial Sequence
  chemically synthesized
caacatgagtgttattagtacc

SEQ ID NO: 1022439 - DNA, 22 bp, Artificial Sequence
  chemically synthesized
ccaacatgagtgttattagtac

SEQ ID NO: 1022440 - DNA, 22 bp, Artificial Sequence
  chemically synthesized
cagtgtccttggtactaataac

SEQ ID NO: 1022441 - DNA, 22 bp, Artificial Sequence
  chemically synthesized
agtgtccttggtactaataaca

SEQ ID NO: 1022442 - DNA, 22 bp, Artificial Sequence
  chemically synthesized
tttccaacatgagtgttattag

SEQ ID NO: 1022443 - DNA, 22 bp, Artificial Sequence
  chemically synthesized
atttccaacatgagtgttatta

SEQ ID NO: 1022444 - DNA, 22 bp, Artificial Sequence
  chemically synthesized
tatttccaacatgagtgttatt

SEQ ID NO: 1022445 - DNA, 22 bp, Artificial Sequence
  chemically synthesized
gctttatttccaacatgagtgt

SEQ ID NO: 1022446 - DNA, 22 bp, Artificial Sequence
  chemically synthesized
ggtactaataacactcatgttg

SEQ ID NO: 1022447 - DNA, 22 bp, Artificial Sequence
  chemically synthesized
gtactaataacactcatgttgg

SEQ ID NO: 1022448 - DNA, 22 bp, Artificial Sequence
  chemically synthesized
ttggctttatttccaacatgag

SEQ ID NO: 1022449 - DNA, 22 bp, Artificial Sequence
  chemically synthesized
tattggctttatttccaacatg

SEQ ID NO: 1022450 - DNA, 22 bp, Artificial Sequence
  chemically synthesized
ataacactcatgttggaaataa

SEQ ID NO: 1022451 - DNA, 22 bp, Artificial Sequence
  chemically synthesized
atgttggaaataaagccaatag

SEQ ID NO: 1022452 - DNA, 22 bp, Artificial Sequence
  chemically synthesized
gaaataaagccaatagaatcat

SEQ ID NO: 1022453 - DNA, 22 bp, Artificial Sequence
  chemically synthesized
aggtaataaagcatatgcagaa

SEQ ID NO: 1022454 - DNA, 22 bp, Artificial Sequence
  chemically synthesized
caggtaataaagcatatgcaga

SEQ ID NO: 1022455 - DNA, 22 bp, Artificial Sequence
  chemically synthesized
aaggtggtatttcaggtaataa

SEQ ID NO: 1022456 - DNA, 22 bp, Artificial Sequence
  chemically synthesized
tgcatatgctttattacctgaa

SEQ ID NO: 1022457 - DNA, 22 bp, Artificial Sequence
  chemically synthesized
catatgctttattacctgaaat

SEQ ID NO: 1022458 - DNA, 22 bp, Artificial Sequence
  chemically synthesized
tattacctgaaataccaccttt

SEQ ID NO: 1022459 - DNA, 22 bp, Artificial Sequence
  chemically synthesized
attacctgaaataccaccttta

SEQ ID NO: 1022460 - DNA, 22 bp, Artificial Sequence
  chemically synthesized
ttacctgaaataccacctttaa

SEQ ID NO: 1022461 - DNA, 22 bp, Artificial Sequence
  chemically synthesized
cctgaaataccacctttaacat

SEQ ID NO: 1022462 - DNA, 22 bp, Artificial Sequence
  chemically synthesized
aaataccacctttaacattacc

SEQ ID NO: 1022463 - DNA, 22 bp, Artificial Sequence
  chemically synthesized
aaaagtcatcagagggtaatgt

SEQ ID NO: 1022464 - DNA, 22 bp, Artificial Sequence
  chemically synthesized
ttaaaaagtcatcagagggtaa

SEQ ID NO: 1022465 - DNA, 22 bp, Artificial Sequence
  chemically synthesized
actgttaaaaagtcatcagagg

SEQ ID NO: 1022466 - DNA, 22 bp, Artificial Sequence
  chemically synthesized
taacattaccctctgatgactt

SEQ ID NO: 1022467 - DNA, 22 bp, Artificial Sequence
  chemically synthesized
aacattaccctctgatgacttt

SEQ ID NO: 1022468 - DNA, 22 bp, Artificial Sequence
  chemically synthesized
acattaccctctgatgactttt

SEQ ID NO: 1022469 - DNA, 22 bp, Artificial Sequence
  chemically synthesized
aagttaactgttaaaaagtcat

SEQ ID NO: 1022470 - DNA, 22 bp, Artificial Sequence
  chemically synthesized
ccctctgatgactttttaacag

SEQ ID NO: 1022471 - DNA, 22 bp, Artificial Sequence
  chemically synthesized
gacattgaagttaactgttaaa

SEQ ID NO: 1022472 - DNA, 22 bp, Artificial Sequence
  chemically synthesized
tgatgactttttaacagttaac

SEQ ID NO: 1022473 - DNA, 22 bp, Artificial Sequence
  chemically synthesized
atgactttttaacagttaactt

SEQ ID NO: 1022474 - DNA, 22 bp, Artificial Sequence
  chemically synthesized
tttaacagttaacttcaatgtc

SEQ ID NO: 1022475 - DNA, 22 bp, Artificial Sequence
  chemically synthesized
ttaacagttaacttcaatgtct

SEQ ID NO: 1022476 - DNA, 22 bp, Artificial Sequence
  chemically synthesized
taacagttaacttcaatgtcta

SEQ ID NO: 1022477 - DNA, 22 bp, Artificial Sequence
  chemically synthesized
aacagttaacttcaatgtctag

SEQ ID NO: 1022478 - DNA, 22 bp, Artificial Sequence
  chemically synthesized
acagttaacttcaatgtctagc

SEQ ID NO: 1022479 - DNA, 22 bp, Artificial Sequence
  chemically synthesized
acttcaatgtctagcacgttgc

SEQ ID NO: 1022480 - DNA, 22 bp, Artificial Sequence
  chemically synthesized
caatgtctagcacgttgctata

SEQ ID NO: 1022481 - DNA, 22 bp, Artificial Sequence
  chemically synthesized
aatgtctagcacgttgctatat

SEQ ID NO: 1022482 - DNA, 22 bp, Artificial Sequence
  chemically synthesized
aaaaaaaatagacatatagcaa

SEQ ID NO: 1022483 - DNA, 22 bp, Artificial Sequence
  chemically synthesized
ttgaaaaaaaatagacatatag

SEQ ID NO: 1022484 - DNA, 22 bp, Artificial Sequence
  chemically synthesized
gcacgttgctatatgtctattt

SEQ ID NO: 1022485 - DNA, 22 bp, Artificial Sequence
  chemically synthesized
cattattgaaaaaaaatagaca

SEQ ID NO: 1022486 - DNA, 22 bp, Artificial Sequence
  chemically synthesized
ccattattgaaaaaaaatagac

SEQ ID NO: 1022487 - DNA, 22 bp, Artificial Sequence
  chemically synthesized
ctatatgtctattttttttcaa

SEQ ID NO: 1022488 - DNA, 22 bp, Artificial Sequence
  chemically synthesized
gtgcttccattattgaaaaaaa

SEQ ID NO: 1022489 - DNA, 22 bp, Artificial Sequence
  chemically synthesized
tagtgcttccattattgaaaaa

SEQ ID NO: 1022490 - DNA, 22 bp, Artificial Sequence
  chemically synthesized
tatgtctattttttttcaataa

SEQ ID NO: 1022491 - DNA, 22 bp, Artificial Sequence
  chemically synthesized
ctagtgcttccattattgaaaa

SEQ ID NO: 1022492 - DNA, 22 bp, Artificial Sequence
  chemically synthesized
ccttctagtgcttccattattg

SEQ ID NO: 1022493 - DNA, 22 bp, Artificial Sequence
  chemically synthesized
cccttctagtgcttccattatt

SEQ ID NO: 1022494 - DNA, 22 bp, Artificial Sequence
  chemically synthesized
ttttttttcaataatggaagca

SEQ ID NO: 1022495 - DNA, 22 bp, Artificial Sequence
  chemically synthesized
tttttcaataatggaagcacta

SEQ ID NO: 1022496 - DNA, 22 bp, Artificial Sequence
  chemically synthesized
ttttcaataatggaagcactag

SEQ ID NO: 1022497 - DNA, 22 bp, Artificial Sequence
  chemically synthesized
tttcaataatggaagcactaga

SEQ ID NO: 1022498 - DNA, 22 bp, Artificial Sequence
  chemically synthesized
ttcaataatggaagcactagaa

SEQ ID NO: 1022499 - DNA, 22 bp, Artificial Sequence
  chemically synthesized
tcaataatggaagcactagaag

SEQ ID NO: 1022500 - DNA, 22 bp, Artificial Sequence
  chemically synthesized
caataatggaagcactagaagg

SEQ ID NO: 1022501 - DNA, 22 bp, Artificial Sequence
  chemically synthesized
aataatggaagcactagaaggg

SEQ ID NO: 1022502 - DNA, 22 bp, Artificial Sequence
  chemically synthesized
gtgtacataataatgccatttc

SEQ ID NO: 1022503 - DNA, 22 bp, Artificial Sequence
  chemically synthesized
cgtgtacataataatgccattt

SEQ ID NO: 1022504 - DNA, 22 bp, Artificial Sequence
  chemically synthesized
tcgtgtacataataatgccatt

SEQ ID NO: 1022505 - DNA, 22 bp, Artificial Sequence
  chemically synthesized
gaagggaaatggcattattatg

SEQ ID NO: 1022506 - DNA, 22 bp, Artificial Sequence
  chemically synthesized
tatataaatctttcgtgtacat

SEQ ID NO: 1022507 - DNA, 22 bp, Artificial Sequence
  chemically synthesized
gtatataaatctttcgtgtaca

SEQ ID NO: 1022508 - DNA, 22 bp, Artificial Sequence
  chemically synthesized
tgtatataaatctttcgtgtac

SEQ ID NO: 1022509 - DNA, 22 bp, Artificial Sequence
  chemically synthesized
tttgtatataaatctttcgtgt

SEQ ID NO: 1022510 - DNA, 22 bp, Artificial Sequence
  chemically synthesized
ttatgtacacgaaagatttata

SEQ ID NO: 1022511 - DNA, 22 bp, Artificial Sequence
  chemically synthesized
catactctttgtatataaatct

SEQ ID NO: 1022512 - DNA, 22 bp, Artificial Sequence
  chemically synthesized
tgtacacgaaagatttatatac

SEQ ID NO: 1022513 - DNA, 22 bp, Artificial Sequence
  chemically synthesized
acaaataaaataagttacatac

SEQ ID NO: 1022514 - DNA, 22 bp, Artificial Sequence
  chemically synthesized
atatacaaagagtatgtaactt

SEQ ID NO: 1022515 - DNA, 22 bp, Artificial Sequence
  chemically synthesized
tatacaaagagtatgtaactta

SEQ ID NO: 1022516 - DNA, 22 bp, Artificial Sequence
  chemically synthesized
gaaaagtagcaaaagtattaac

SEQ ID NO: 1022517 - DNA, 22 bp, Artificial Sequence
  chemically synthesized
ggaaaagtagcaaaagtattaa

SEQ ID NO: 1022518 - DNA, 22 bp, Artificial Sequence
  chemically synthesized
attttatttgttaatacttttg

SEQ ID NO: 1022519 - DNA, 22 bp, Artificial Sequence
  chemically synthesized
ttttatttgttaatacttttgc

SEQ ID NO: 1022520 - DNA, 22 bp, Artificial Sequence
  chemically synthesized
tttggaaaagtagcaaaagtat

SEQ ID NO: 1022521 - DNA, 22 bp, Artificial Sequence
  chemically synthesized
atttggaaaagtagcaaaagta

SEQ ID NO: 1022522 - DNA, 22 bp, Artificial Sequence
  chemically synthesized
tatttgttaatacttttgctac

SEQ ID NO: 1022523 - DNA, 22 bp, Artificial Sequence
  chemically synthesized
ttatttggaaaagtagcaaaag

SEQ ID NO: 1022524 - DNA, 22 bp, Artificial Sequence
  chemically synthesized
atttgttaatacttttgctact

SEQ ID NO: 1022525 - DNA, 22 bp, Artificial Sequence
  chemically synthesized
cttatttggaaaagtagcaaaa

SEQ ID NO: 1022526 - DNA, 22 bp, Artificial Sequence
  chemically synthesized
tttgttaatacttttgctactt

SEQ ID NO: 1022527 - DNA, 22 bp, Artificial Sequence
  chemically synthesized
tcttatttggaaaagtagcaaa

SEQ ID NO: 1022528 - DNA, 22 bp, Artificial Sequence
  chemically synthesized
ttcttatttggaaaagtagcaa

SEQ ID NO: 1022529 - DNA, 22 bp, Artificial Sequence
  chemically synthesized
gttaatacttttgctacttttc

SEQ ID NO: 1022530 - DNA, 22 bp, Artificial Sequence
  chemically synthesized
ttaatacttttgctacttttcc

SEQ ID NO: 1022531 - DNA, 22 bp, Artificial Sequence
  chemically synthesized
ccttttcttatttggaaaagta

SEQ ID NO: 1022532 - DNA, 22 bp, Artificial Sequence
  chemically synthesized
accttttcttatttggaaaagt

SEQ ID NO: 1022533 - DNA, 22 bp, Artificial Sequence
  chemically synthesized
atacttttgctacttttccaaa

SEQ ID NO: 1022534 - DNA, 22 bp, Artificial Sequence
  chemically synthesized
taccttttcttatttggaaaag

SEQ ID NO: 1022535 - DNA, 22 bp, Artificial Sequence
  chemically synthesized
ttgctacttttccaaataagaa

SEQ ID NO: 1022536 - DNA, 22 bp, Artificial Sequence
  chemically synthesized
tgctacttttccaaataagaaa

SEQ ID NO: 1022537 - DNA, 22 bp, Artificial Sequence
  chemically synthesized
gctacttttccaaataagaaaa

SEQ ID NO: 1022538 - DNA, 22 bp, Artificial Sequence
  chemically synthesized
ctacttttccaaataagaaaag

SEQ ID NO: 1022539 - DNA, 22 bp, Artificial Sequence
  chemically synthesized
cttttccaaataagaaaaggta

SEQ ID NO: 1022540 - DNA, 22 bp, Artificial Sequence
  chemically synthesized
tagggtgcatgttttacctttt

SEQ ID NO: 1022541 - DNA, 22 bp, Artificial Sequence
  chemically synthesized
ttccaaataagaaaaggtaaaa

SEQ ID NO: 1022542 - DNA, 22 bp, Artificial Sequence
  chemically synthesized
atagggtgcatgttttaccttt

SEQ ID NO: 1022543 - DNA, 22 bp, Artificial Sequence
  chemically synthesized
tccaaataagaaaaggtaaaac

SEQ ID NO: 1022544 - DNA, 22 bp, Artificial Sequence
  chemically synthesized
tatagggtgcatgttttacctt

SEQ ID NO: 1022545 - DNA, 22 bp, Artificial Sequence
  chemically synthesized
ccaaataagaaaaggtaaaaca

SEQ ID NO: 1022546 - DNA, 22 bp, Artificial Sequence
  chemically synthesized
caaataagaaaaggtaaaacat

SEQ ID NO: 1022547 - DNA, 22 bp, Artificial Sequence
  chemically synthesized
catgtgattttatagggtgcat

SEQ ID NO: 1022548 - DNA, 22 bp, Artificial Sequence
  chemically synthesized
accaaaatgttccatgtgattt

SEQ ID NO: 1022549 - DNA, 22 bp, Artificial Sequence
  chemically synthesized
aaccaaaatgttccatgtgatt

SEQ ID NO: 1022550 - DNA, 22 bp, Artificial Sequence
  chemically synthesized
taaccaaaatgttccatgtgat

SEQ ID NO: 1022551 - DNA, 22 bp, Artificial Sequence
  chemically synthesized
ttaaccaaaatgttccatgtga

SEQ ID NO: 1022552 - DNA, 22 bp, Artificial Sequence
  chemically synthesized
taaaatcacatggaacattttg

SEQ ID NO: 1022553 - DNA, 22 bp, Artificial Sequence
  chemically synthesized
gaacacacagaagcatttttaa

SEQ ID NO: 1022554 - DNA, 22 bp, Artificial Sequence
  chemically synthesized
agaacacacagaagcattttta

SEQ ID NO: 1022555 - DNA, 22 bp, Artificial Sequence
  chemically synthesized
tagaacacacagaagcattttt

SEQ ID NO: 1022556 - DNA, 22 bp, Artificial Sequence
  chemically synthesized
tggttaaaaatgcttctgtgtg

SEQ ID NO: 1022557 - DNA, 22 bp, Artificial Sequence
  chemically synthesized
ggttaaaaatgcttctgtgtgt

SEQ ID NO: 1022558 - DNA, 22 bp, Artificial Sequence
  chemically synthesized
taatgttttagaacacacagaa

SEQ ID NO: 1022559 - DNA, 22 bp, Artificial Sequence
  chemically synthesized
gttaaaaatgcttctgtgtgtt

SEQ ID NO: 1022560 - DNA, 22 bp, Artificial Sequence
  chemically synthesized
aaaatgcttctgtgtgttctaa

SEQ ID NO: 1022561 - DNA, 22 bp, Artificial Sequence
  chemically synthesized
ctgtgtgttctaaaacattata

SEQ ID NO: 1022562 - DNA, 22 bp, Artificial Sequence
  chemically synthesized
tgtgtgttctaaaacattataa

SEQ ID NO: 1022563 - DNA, 22 bp, Artificial Sequence
  chemically synthesized
aagaaatgaagtattataatgt

SEQ ID NO: 1022564 - DNA, 22 bp, Artificial Sequence
  chemically synthesized
tgtgttctaaaacattataata

SEQ ID NO: 1022565 - DNA, 22 bp, Artificial Sequence
  chemically synthesized
taaaacattataatacttcatt

SEQ ID NO: 1022566 - DNA, 22 bp, Artificial Sequence
  chemically synthesized
aaacattataatacttcatttc

SEQ ID NO: 1022567 - DNA, 22 bp, Artificial Sequence
  chemically synthesized
taatacttcatttcttgagggt

SEQ ID NO: 1022568 - DNA, 22 bp, Artificial Sequence
  chemically synthesized
atgataagagaatccaaccctc

SEQ ID NO: 1022569 - DNA, 22 bp, Artificial Sequence
  chemically synthesized
ttgatgataagagaatccaacc

SEQ ID NO: 1022570 - DNA, 22 bp, Artificial Sequence
  chemically synthesized
catttcttgagggttggattct

SEQ ID NO: 1022571 - DNA, 22 bp, Artificial Sequence
  chemically synthesized
atttcttgagggttggattctc

SEQ ID NO: 1022572 - DNA, 22 bp, Artificial Sequence
  chemically synthesized
ttattgatgataagagaatcca

SEQ ID NO: 1022573 - DNA, 22 bp, Artificial Sequence
  chemically synthesized
cttgagggttggattctcttat

SEQ ID NO: 1022574 - DNA, 22 bp, Artificial Sequence
  chemically synthesized
ttgagggttggattctcttatc

SEQ ID NO: 1022575 - DNA, 22 bp, Artificial Sequence
  chemically synthesized
gagggttggattctcttatcat

SEQ ID NO: 1022576 - DNA, 22 bp, Artificial Sequence
  chemically synthesized
agggttggattctcttatcatc

SEQ ID NO: 1022577 - DNA, 22 bp, Artificial Sequence
  chemically synthesized
catgatattattattgatgata

SEQ ID NO: 1022578 - DNA, 22 bp, Artificial Sequence
  chemically synthesized
gattctcttatcatcaataata

SEQ ID NO: 1022579 - DNA, 22 bp, Artificial Sequence
  chemically synthesized
actacatgatattattattgat

SEQ ID NO: 1022580 - DNA, 22 bp, Artificial Sequence
  chemically synthesized
taactacatgatattattattg

SEQ ID NO: 1022581 - DNA, 22 bp, Artificial Sequence
  chemically synthesized
tcttatcatcaataataatatc

SEQ ID NO: 1022582 - DNA, 22 bp, Artificial Sequence
  chemically synthesized
ttatcatcaataataatatcat

SEQ ID NO: 1022583 - DNA, 22 bp, Artificial Sequence
  chemically synthesized
atcatcaataataatatcatgt

SEQ ID NO: 1022584 - DNA, 22 bp, Artificial Sequence
  chemically synthesized
tcatcaataataatatcatgta

SEQ ID NO: 1022585 - DNA, 22 bp, Artificial Sequence
  chemically synthesized
tgccaatgcgttctaactacat

SEQ ID NO: 1022586 - DNA, 22 bp, Artificial Sequence
  chemically synthesized
tatatctatgccaatgcgttct

SEQ ID NO: 1022587 - DNA, 22 bp, Artificial Sequence
  chemically synthesized
gaacgcattggcatagatatat

SEQ ID NO: 1022588 - DNA, 22 bp, Artificial Sequence
  chemically synthesized
acggacccataaaatgattata

SEQ ID NO: 1022589 - DNA, 22 bp, Artificial Sequence
  chemically synthesized
cacggacccataaaatgattat

SEQ ID NO: 1022590 - DNA, 22 bp, Artificial Sequence
  chemically synthesized
gcatagatatataatcatttta

SEQ ID NO: 1022591 - DNA, 22 bp, Artificial Sequence
  chemically synthesized
atttcacggacccataaaatga

SEQ ID NO: 1022592 - DNA, 22 bp, Artificial Sequence
  chemically synthesized
tcctcatttcacggacccataa

SEQ ID NO: 1022593 - DNA, 22 bp, Artificial Sequence
  chemically synthesized
tatcctcatttcacggacccat

SEQ ID NO: 1022594 - DNA, 22 bp, Artificial Sequence
  chemically synthesized
ccaattctatcctcatttcacg

SEQ ID NO: 1022595 - DNA, 22 bp, Artificial Sequence
  chemically synthesized
tatgggtccgtgaaatgaggat

SEQ ID NO: 1022596 - DNA, 22 bp, Artificial Sequence
  chemically synthesized
atgggtccgtgaaatgaggata

SEQ ID NO: 1022597 - DNA, 22 bp, Artificial Sequence
  chemically synthesized
tgggtccgtgaaatgaggatag

SEQ ID NO: 1022598 - DNA, 22 bp, Artificial Sequence
  chemically synthesized
tgacctcccaattctatcctca

SEQ ID NO: 1022599 - DNA, 22 bp, Artificial Sequence
  chemically synthesized
caaaaattgtgacctcccaatt

SEQ ID NO: 1022600 - DNA, 22 bp, Artificial Sequence
  chemically synthesized
ctacaaaaattgtgacctccca

SEQ ID NO: 1022601 - DNA, 22 bp, Artificial Sequence
  chemically synthesized
ggaggtcacaatttttgtagca

SEQ ID NO: 1022602 - DNA, 22 bp, Artificial Sequence
  chemically synthesized
acaataacaaaaatattgctac

SEQ ID NO: 1022603 - DNA, 22 bp, Artificial Sequence
  chemically synthesized
ttgtagcaatatttttgttatt

SEQ ID NO: 1022604 - DNA, 22 bp, Artificial Sequence
  chemically synthesized
tgtagcaatatttttgttattg

SEQ ID NO: 1022605 - DNA, 22 bp, Artificial Sequence
  chemically synthesized
gtagcaatatttttgttattgt

SEQ ID NO: 1022606 - DNA, 22 bp, Artificial Sequence
  chemically synthesized
tagcaatatttttgttattgtt

SEQ ID NO: 1022607 - DNA, 22 bp, Artificial Sequence
  chemically synthesized
agtaccacaaaaaaactaacaa

SEQ ID NO: 1022608 - DNA, 22 bp, Artificial Sequence
  chemically synthesized
cagtaccacaaaaaaactaaca

SEQ ID NO: 1022609 - DNA, 22 bp, Artificial Sequence
  chemically synthesized
tcagtaccacaaaaaaactaac

SEQ ID NO: 1022610 - DNA, 22 bp, Artificial Sequence
  chemically synthesized
ttcagtaccacaaaaaaactaa

SEQ ID NO: 1022611 - DNA, 22 bp, Artificial Sequence
  chemically synthesized
ttttcagtaccacaaaaaaact

SEQ ID NO: 1022612 - DNA, 22 bp, Artificial Sequence
  chemically synthesized
ttgttattgttagtttttttgt

SEQ ID NO: 1022613 - DNA, 22 bp, Artificial Sequence
  chemically synthesized
cttttcagtaccacaaaaaaac

SEQ ID NO: 1022614 - DNA, 22 bp, Artificial Sequence
  chemically synthesized
tgttattgttagtttttttgtg

SEQ ID NO: 1022615 - DNA, 22 bp, Artificial Sequence
  chemically synthesized
tcttttcagtaccacaaaaaaa

SEQ ID NO: 1022616 - DNA, 22 bp, Artificial Sequence
  chemically synthesized
gttattgttagtttttttgtgg

SEQ ID NO: 1022617 - DNA, 22 bp, Artificial Sequence
  chemically synthesized
ttattgttagtttttttgtggt

SEQ ID NO: 1022618 - DNA, 22 bp, Artificial Sequence
  chemically synthesized
ctttcttttcagtaccacaaaa

SEQ ID NO: 1022619 - DNA, 22 bp, Artificial Sequence
  chemically synthesized
gctttcttttcagtaccacaaa

SEQ ID NO: 1022620 - DNA, 22 bp, Artificial Sequence
  chemically synthesized
ttgttagtttttttgtggtact

SEQ ID NO: 1022621 - DNA, 22 bp, Artificial Sequence
  chemically synthesized
ttagtttttttgtggtactgaa

SEQ ID NO: 1022622 - DNA, 22 bp, Artificial Sequence
  chemically synthesized
gcttgctttcttttcagtacca

SEQ ID NO: 1022623 - DNA, 22 bp, Artificial Sequence
  chemically synthesized
cgcttgctttcttttcagtacc

SEQ ID NO: 1022624 - DNA, 22 bp, Artificial Sequence
  chemically synthesized
gtttttttgtggtactgaaaag

SEQ ID NO: 1022625 - DNA, 22 bp, Artificial Sequence
  chemically synthesized
ttcgcttgctttcttttcagta

SEQ ID NO: 1022626 - DNA, 22 bp, Artificial Sequence
  chemically synthesized
cttcgcttgctttcttttcagt

SEQ ID NO: 1022627 - DNA, 22 bp, Artificial Sequence
  chemically synthesized
tcttcgcttgctttcttttcag

SEQ ID NO: 1022628 - DNA, 22 bp, Artificial Sequence
  chemically synthesized
ttttgtggtactgaaaagaaag

SEQ ID NO: 1022629 - DNA, 22 bp, Artificial Sequence
  chemically synthesized
tttgtggtactgaaaagaaagc

SEQ ID NO: 1022630 - DNA, 22 bp, Artificial Sequence
  chemically synthesized
ctttcttcgcttgctttctttt

SEQ ID NO: 1022631 - DNA, 22 bp, Artificial Sequence
  chemically synthesized
ttgtggtactgaaaagaaagca

SEQ ID NO: 1022632 - DNA, 22 bp, Artificial Sequence
  chemically synthesized
gctttcttcgcttgctttcttt

SEQ ID NO: 1022633 - DNA, 22 bp, Artificial Sequence
  chemically synthesized
tgtggtactgaaaagaaagcaa

SEQ ID NO: 1022634 - DNA, 22 bp, Artificial Sequence
  chemically synthesized
gtggtactgaaaagaaagcaag

SEQ ID NO: 1022635 - DNA, 22 bp, Artificial Sequence
  chemically synthesized
tggtactgaaaagaaagcaagc

SEQ ID NO: 1022636 - DNA, 22 bp, Artificial Sequence
  chemically synthesized
cttgctttcttcgcttgctttc

SEQ ID NO: 1022637 - DNA, 22 bp, Artificial Sequence
  chemically synthesized
ccttgctttcttcgcttgcttt

SEQ ID NO: 1022638 - DNA, 22 bp, Artificial Sequence
  chemically synthesized
tccttgctttcttcgcttgctt

SEQ ID NO: 1022639 - DNA, 22 bp, Artificial Sequence
  chemically synthesized
ctttccttgctttcttcgcttg

SEQ ID NO: 1022640 - DNA, 22 bp, Artificial Sequence
  chemically synthesized
gctttccttgctttcttcgctt

SEQ ID NO: 1022641 - DNA, 22 bp, Artificial Sequence
  chemically synthesized
tgctttccttgctttcttcgct

SEQ ID NO: 1022642 - DNA, 22 bp, Artificial Sequence
  chemically synthesized
aaaagaaagcaagcgaagaaag

SEQ ID NO: 1022643 - DNA, 22 bp, Artificial Sequence
  chemically synthesized
ctttgctttccttgctttcttc

SEQ ID NO: 1022644 - DNA, 22 bp, Artificial Sequence
  chemically synthesized
cgttcctttgctttccttgctt

SEQ ID NO: 1022645 - DNA, 22 bp, Artificial Sequence
  chemically synthesized
gcgttcctttgctttccttgct

SEQ ID NO: 1022646 - DNA, 22 bp, Artificial Sequence
  chemically synthesized
tgcgttcctttgctttccttgc

SEQ ID NO: 1022647 - DNA, 22 bp, Artificial Sequence
  chemically synthesized
ctttgcgttcctttgctttcct

SEQ ID NO: 1022648 - DNA, 22 bp, Artificial Sequence
  chemically synthesized
cctttgcgttcctttgctttcc

SEQ ID NO: 1022649 - DNA, 22 bp, Artificial Sequence
  chemically synthesized
tcctttgcgttcctttgctttc

SEQ ID NO: 1022650 - DNA, 22 bp, Artificial Sequence
  chemically synthesized
ttcctttgcgttcctttgcttt

SEQ ID NO: 1022651 - DNA, 22 bp, Artificial Sequence
  chemically synthesized
cttttcctttgcgttcctttgc

SEQ ID NO: 1022652 - DNA, 22 bp, Artificial Sequence
  chemically synthesized
ccttttcctttgcgttcctttg

SEQ ID NO: 1022653 - DNA, 22 bp, Artificial Sequence
  chemically synthesized
tccttttcctttgcgttccttt

SEQ ID NO: 1022654 - DNA, 22 bp, Artificial Sequence
  chemically synthesized
ttccttttcctttgcgttcctt

SEQ ID NO: 1022655 - DNA, 22 bp, Artificial Sequence
  chemically synthesized
cttttccttttcctttgcgttc

SEQ ID NO: 1022656 - DNA, 22 bp, Artificial Sequence
  chemically synthesized
ccttttccttttcctttgcgtt

SEQ ID NO: 1022657 - DNA, 22 bp, Artificial Sequence
  chemically synthesized
tccttttccttttcctttgcgt

SEQ ID NO: 1022658 - DNA, 22 bp, Artificial Sequence
  chemically synthesized
ttccttttccttttcctttgcg

SEQ ID NO: 1022659 - DNA, 22 bp, Artificial Sequence
  chemically synthesized
cttttccttttccttttccttt

SEQ ID NO: 1022660 - DNA, 22 bp, Artificial Sequence
  chemically synthesized
ttccttttccttttccttttcc

SEQ ID NO: 1022661 - DNA, 22 bp, Artificial Sequence
  chemically synthesized
tgttccttttccttttcctttt

SEQ ID NO: 1022662 - DNA, 22 bp, Artificial Sequence
  chemically synthesized
ctgttccttttccttttccttt

SEQ ID NO: 1022663 - DNA, 22 bp, Artificial Sequence
  chemically synthesized
cttctgttccttttccttttcc

SEQ ID NO: 1022664 - DNA, 22 bp, Artificial Sequence
  chemically synthesized
ccttctgttccttttccttttc

SEQ ID NO: 1022665 - DNA, 22 bp, Artificial Sequence
  chemically synthesized
tccttctgttccttttcctttt

SEQ ID NO: 1022666 - DNA, 22 bp, Artificial Sequence
  chemically synthesized
ctttccttctgttccttttcct

SEQ ID NO: 1022667 - DNA, 22 bp, Artificial Sequence
  chemically synthesized
cctttccttctgttccttttcc

SEQ ID NO: 1022668 - DNA, 22 bp, Artificial Sequence
  chemically synthesized
tcctttccttctgttccttttc

SEQ ID NO: 1022669 - DNA, 22 bp, Artificial Sequence
  chemically synthesized
ctttcctttccttctgttcctt

SEQ ID NO: 1022670 - DNA, 22 bp, Artificial Sequence
  chemically synthesized
cctttcctttccttctgttcct

SEQ ID NO: 1022671 - DNA, 22 bp, Artificial Sequence
  chemically synthesized
ttcctttcctttccttctgttc

SEQ ID NO: 1022672 - DNA, 22 bp, Artificial Sequence
  chemically synthesized
cttcctttcctttccttctgtt

SEQ ID NO: 1022673 - DNA, 22 bp, Artificial Sequence
  chemically synthesized
cttcttcctttcctttccttct

SEQ ID NO: 1022674 - DNA, 22 bp, Artificial Sequence
  chemically synthesized
ccttcttcctttcctttccttc

SEQ ID NO: 1022675 - DNA, 22 bp, Artificial Sequence
  chemically synthesized
cttccttcttcctttcctttcc

SEQ ID NO: 1022676 - DNA, 22 bp, Artificial Sequence
  chemically synthesized
ccttccttcttcctttcctttc

SEQ ID NO: 1022677 - DNA, 22 bp, Artificial Sequence
  chemically synthesized
cttccttccttcttcctttcct

SEQ ID NO: 1022678 - DNA, 22 bp, Artificial Sequence
  chemically synthesized
ccttccttccttcttcctttcc

SEQ ID NO: 1022679 - DNA, 22 bp, Artificial Sequence
  chemically synthesized
cttccttccttccttcttcctt

SEQ ID NO: 1022680 - DNA, 22 bp, Artificial Sequence
  chemically synthesized
ccttccttccttccttcttcct

SEQ ID NO: 1022681 - DNA, 22 bp, Artificial Sequence
  chemically synthesized
ttccttccttccttccttcttc

SEQ ID NO: 1022682 - DNA, 22 bp, Artificial Sequence
  chemically synthesized
cttccttccttccttccttctt

SEQ ID NO: 1022683 - DNA, 22 bp, Artificial Sequence
  chemically synthesized
tttcttccttccttccttcctt

SEQ ID NO: 1022684 - DNA, 22 bp, Artificial Sequence
  chemically synthesized
gtttcttccttccttccttcct

SEQ ID NO: 1022685 - DNA, 22 bp, Artificial Sequence
  chemically synthesized
tgtttcttccttccttccttcc

SEQ ID NO: 1022686 - DNA, 22 bp, Artificial Sequence
  chemically synthesized
ttgtttcttccttccttccttc

SEQ ID NO: 1022687 - DNA, 22 bp, Artificial Sequence
  chemically synthesized
ttttgtttcttccttccttcct

SEQ ID NO: 1022688 - DNA, 22 bp, Artificial Sequence
  chemically synthesized
cttttgtttcttccttccttcc

SEQ ID NO: 1022689 - DNA, 22 bp, Artificial Sequence
  chemically synthesized
tcttttgtttcttccttccttc

SEQ ID NO: 1022690 - DNA, 22 bp, Artificial Sequence
  chemically synthesized
ctttcttttgtttcttccttcc

SEQ ID NO: 1022691 - DNA, 22 bp, Artificial Sequence
  chemically synthesized
cctttcttttgtttcttccttc

SEQ ID NO: 1022692 - DNA, 22 bp, Artificial Sequence
  chemically synthesized
tcctttcttttgtttcttcctt

SEQ ID NO: 1022693 - DNA, 22 bp, Artificial Sequence
  chemically synthesized
ctttcctttcttttgtttcttc

SEQ ID NO: 1022694 - DNA, 22 bp, Artificial Sequence
  chemically synthesized
cctttcctttcttttgtttctt

SEQ ID NO: 1022695 - DNA, 22 bp, Artificial Sequence
  chemically synthesized
tcctttcctttcttttgtttct

SEQ ID NO: 1022696 - DNA, 22 bp, Artificial Sequence
  chemically synthesized
ctttcctttcctttcttttgtt

SEQ ID NO: 1022697 - DNA, 22 bp, Artificial Sequence
  chemically synthesized
tgctttcctttcctttcttttg

SEQ ID NO: 1022698 - DNA, 22 bp, Artificial Sequence
  chemically synthesized
ctgctttcctttcctttctttt

SEQ ID NO: 1022699 - DNA, 22 bp, Artificial Sequence
  chemically synthesized
cttctgctttcctttcctttct

SEQ ID NO: 1022700 - DNA, 22 bp, Artificial Sequence
  chemically synthesized
acttctgctttcctttcctttc

SEQ ID NO: 1022701 - DNA, 22 bp, Artificial Sequence
  chemically synthesized
tacttctgctttcctttccttt

SEQ ID NO: 1022702 - DNA, 22 bp, Artificial Sequence
  chemically synthesized
tttacttctgctttcctttcct

SEQ ID NO: 1022703 - DNA, 22 bp, Artificial Sequence
  chemically synthesized
ctttacttctgctttcctttcc

SEQ ID NO: 1022704 - DNA, 22 bp, Artificial Sequence
  chemically synthesized
tctttacttctgctttcctttc

SEQ ID NO: 1022705 - DNA, 22 bp, Artificial Sequence
  chemically synthesized
ttctttacttctgctttccttt

SEQ ID NO: 1022706 - DNA, 22 bp, Artificial Sequence
  chemically synthesized
ttttctttacttctgctttcct

SEQ ID NO: 1022707 - DNA, 22 bp, Artificial Sequence
  chemically synthesized
cttttctttacttctgctttcc

SEQ ID NO: 1022708 - DNA, 22 bp, Artificial Sequence
  chemically synthesized
tcttttctttacttctgctttc

SEQ ID NO: 1022709 - DNA, 22 bp, Artificial Sequence
  chemically synthesized
tttcttttctttacttctgctt

SEQ ID NO: 1022710 - DNA, 22 bp, Artificial Sequence
  chemically synthesized
ctttcttttctttacttctgct

SEQ ID NO: 1022711 - DNA, 22 bp, Artificial Sequence
  chemically synthesized
tctttcttttctttacttctgc

SEQ ID NO: 1022712 - DNA, 22 bp, Artificial Sequence
  chemically synthesized
ttctttcttttctttacttctg

SEQ ID NO: 1022713 - DNA, 22 bp, Artificial Sequence
  chemically synthesized
tttctttcttttctttacttct

SEQ ID NO: 1022714 - DNA, 22 bp, Artificial Sequence
  chemically synthesized
ttttctttcttttctttacttc

SEQ ID NO: 1022715 - DNA, 22 bp, Artificial Sequence
  chemically synthesized
tttttctttcttttctttactt

SEQ ID NO: 1022716 - DNA, 22 bp, Artificial Sequence
  chemically synthesized
tttttttctttcttttctttac

SEQ ID NO: 1022717 - DNA, 22 bp, Artificial Sequence
  chemically synthesized
ctttttttctttcttttcttta

SEQ ID NO: 1022718 - DNA, 22 bp, Artificial Sequence
  chemically synthesized
tctttttttctttcttttcttt

SEQ ID NO: 1022719 - DNA, 22 bp, Artificial Sequence
  chemically synthesized
ttctttttttctttcttttctt

SEQ ID NO: 1022720 - DNA, 22 bp, Artificial Sequence
  chemically synthesized
gtttttctttttttctttcttt

SEQ ID NO: 1022721 - DNA, 22 bp, Artificial Sequence
  chemically synthesized
ggtttttctttttttctttctt

SEQ ID NO: 1022722 - DNA, 22 bp, Artificial Sequence
  chemically synthesized
cttggtttttctttttttcttt

SEQ ID NO: 1022723 - DNA, 22 bp, Artificial Sequence
  chemically synthesized
gcttggtttttctttttttctt

SEQ ID NO: 1022724 - DNA, 22 bp, Artificial Sequence
  chemically synthesized
cttgcttggtttttcttttttt

SEQ ID NO: 1022725 - DNA, 22 bp, Artificial Sequence
  chemically synthesized
cctgcttgcttggtttttcttt

SEQ ID NO: 1022726 - DNA, 22 bp, Artificial Sequence
  chemically synthesized
tctgcctgcttgcttggttttt

SEQ ID NO: 1022727 - DNA, 22 bp, Artificial Sequence
  chemically synthesized
cctgtctgcctgcttgcttggt

SEQ ID NO: 1022728 - DNA, 22 bp, Artificial Sequence
  chemically synthesized
tctgcctgtctgcctgcttgct

SEQ ID NO: 1022729 - DNA, 22 bp, Artificial Sequence
  chemically synthesized
cctgtctgcctgtctgcctgct

SEQ ID NO: 1022730 - DNA, 22 bp, Artificial Sequence
  chemically synthesized
cctgcctgtctgcctgtctgcc

SEQ ID NO: 1022731 - DNA, 22 bp, Artificial Sequence
  chemically synthesized
gcctgcctgtctgcctgtctgc

SEQ ID NO: 1022732 - DNA, 22 bp, Artificial Sequence
  chemically synthesized
cttgcctgcctgtctgcctgtc

SEQ ID NO: 1022733 - DNA, 22 bp, Artificial Sequence
  chemically synthesized
gcttgcctgcctgtctgcctgt

SEQ ID NO: 1022734 - DNA, 22 bp, Artificial Sequence
  chemically synthesized
gcttgcttgcctgcctgtctgc

SEQ ID NO: 1022735 - DNA, 22 bp, Artificial Sequence
  chemically synthesized
actagcttgcttgcctgcctgt

SEQ ID NO: 1022736 - DNA, 22 bp, Artificial Sequence
  chemically synthesized
aactagcttgcttgcctgcctg

SEQ ID NO: 1022737 - DNA, 22 bp, Artificial Sequence
  chemically synthesized
cttaactagcttgcttgcctgc

SEQ ID NO: 1022738 - DNA, 22 bp, Artificial Sequence
  chemically synthesized
acttaactagcttgcttgcctg

SEQ ID NO: 1022739 - DNA, 22 bp, Artificial Sequence
  chemically synthesized
aaatcttacttaactagcttgc

SEQ ID NO: 1022740 - DNA, 22 bp, Artificial Sequence
  chemically synthesized
tctaaaatcttacttaactagc

SEQ ID NO: 1022741 - DNA, 22 bp, Artificial Sequence
  chemically synthesized
atctaaaatcttacttaactag

SEQ ID NO: 1022742 - DNA, 22 bp, Artificial Sequence
  chemically synthesized
cttatctaaaatcttacttaac

SEQ ID NO: 1022743 - DNA, 22 bp, Artificial Sequence
  chemically synthesized
ccttatctaaaatcttacttaa

SEQ ID NO: 1022744 - DNA, 22 bp, Artificial Sequence
  chemically synthesized
tttccttatctaaaatcttact

SEQ ID NO: 1022745 - DNA, 22 bp, Artificial Sequence
  chemically synthesized
atttccttatctaaaatcttac

SEQ ID NO: 1022746 - DNA, 22 bp, Artificial Sequence
  chemically synthesized
tttatttccttatctaaaatct

SEQ ID NO: 1022747 - DNA, 22 bp, Artificial Sequence
  chemically synthesized
ctatttatttccttatctaaaa

SEQ ID NO: 1022748 - DNA, 22 bp, Artificial Sequence
  chemically synthesized
gttaagtaagattttagataag

SEQ ID NO: 1022749 - DNA, 22 bp, Artificial Sequence
  chemically synthesized
ttcctatttatttccttatcta

SEQ ID NO: 1022750 - DNA, 22 bp, Artificial Sequence
  chemically synthesized
attcctatttatttccttatct

SEQ ID NO: 1022751 - DNA, 22 bp, Artificial Sequence
  chemically synthesized
agtaagattttagataaggaaa

SEQ ID NO: 1022752 - DNA, 22 bp, Artificial Sequence
  chemically synthesized
tttattcctatttatttcctta

SEQ ID NO: 1022753 - DNA, 22 bp, Artificial Sequence
  chemically synthesized
ctatttattcctatttatttcc

SEQ ID NO: 1022754 - DNA, 22 bp, Artificial Sequence
  chemically synthesized
tagataaggaaataaataggaa

SEQ ID NO: 1022755 - DNA, 22 bp, Artificial Sequence
  chemically synthesized
atctcctatttattcctattta

SEQ ID NO: 1022756 - DNA, 22 bp, Artificial Sequence
  chemically synthesized
agataaggaaataaataggaat

SEQ ID NO: 1022757 - DNA, 22 bp, Artificial Sequence
  chemically synthesized
catctcctatttattcctattt

SEQ ID NO: 1022758 - DNA, 22 bp, Artificial Sequence
  chemically synthesized
gataaggaaataaataggaata

SEQ ID NO: 1022759 - DNA, 22 bp, Artificial Sequence
  chemically synthesized
ggatcatataatttcatctcct

SEQ ID NO: 1022760 - DNA, 22 bp, Artificial Sequence
  chemically synthesized
gccctaggatcatataatttca

SEQ ID NO: 1022761 - DNA, 22 bp, Artificial Sequence
  chemically synthesized
ccctagccctaggatcatataa

SEQ ID NO: 1022762 - DNA, 22 bp, Artificial Sequence
  chemically synthesized
accctagccctaggatcatata

SEQ ID NO: 1022763 - DNA, 22 bp, Artificial Sequence
  chemically synthesized
taccctagccctaggatcatat

SEQ ID NO: 1022764 - DNA, 22 bp, Artificial Sequence
  chemically synthesized
tttaccctagccctaggatcat

SEQ ID NO: 1022765 - DNA, 22 bp, Artificial Sequence
  chemically synthesized
ctttaccctagccctaggatca

SEQ ID NO: 1022766 - DNA, 22 bp, Artificial Sequence
  chemically synthesized
tctttaccctagccctaggatc

SEQ ID NO: 1022767 - DNA, 22 bp, Artificial Sequence
  chemically synthesized
ttctttaccctagccctaggat

SEQ ID NO: 1022768 - DNA, 22 bp, Artificial Sequence
  chemically synthesized
ttttctttaccctagccctagg

SEQ ID NO: 1022769 - DNA, 22 bp, Artificial Sequence
  chemically synthesized
ctcttttctttaccctagccct

SEQ ID NO: 1022770 - DNA, 22 bp, Artificial Sequence
  chemically synthesized
gctcttttctttaccctagccc

SEQ ID NO: 1022771 - DNA, 22 bp, Artificial Sequence
  chemically synthesized
tgctcttttctttaccctagcc

SEQ ID NO: 1022772 - DNA, 22 bp, Artificial Sequence
  chemically synthesized
tatgatcctagggctagggtaa

SEQ ID NO: 1022773 - DNA, 22 bp, Artificial Sequence
  chemically synthesized
ttgctcttttctttaccctagc

SEQ ID NO: 1022774 - DNA, 22 bp, Artificial Sequence
  chemically synthesized
tttgctcttttctttaccctag

SEQ ID NO: 1022775 - DNA, 22 bp, Artificial Sequence
  chemically synthesized
tggcctttttgctcttttcttt

SEQ ID NO: 1022776 - DNA, 22 bp, Artificial Sequence
  chemically synthesized
atggcctttttgctcttttctt

SEQ ID NO: 1022777 - DNA, 22 bp, Artificial Sequence
  chemically synthesized
gggctagggtaaagaaaagagc

SEQ ID NO: 1022778 - DNA, 22 bp, Artificial Sequence
  chemically synthesized
tatggcctttttgctcttttct

SEQ ID NO: 1022779 - DNA, 22 bp, Artificial Sequence
  chemically synthesized
gggtaaagaaaagagcaaaaag

SEQ ID NO: 1022780 - DNA, 22 bp, Artificial Sequence
  chemically synthesized
cagaaagattttatggcctttt

SEQ ID NO: 1022781 - DNA, 22 bp, Artificial Sequence
  chemically synthesized
cgctacagaaagattttatggc

SEQ ID NO: 1022782 - DNA, 22 bp, Artificial Sequence
  chemically synthesized
ttacgctacagaaagattttat

SEQ ID NO: 1022783 - DNA, 22 bp, Artificial Sequence
  chemically synthesized
ttattacgctacagaaagattt

SEQ ID NO: 1022784 - DNA, 22 bp, Artificial Sequence
  chemically synthesized
attattacgctacagaaagatt

SEQ ID NO: 1022785 - DNA, 22 bp, Artificial Sequence
  chemically synthesized
tattattacgctacagaaagat

SEQ ID NO: 1022786 - DNA, 22 bp, Artificial Sequence
  chemically synthesized
ttattattacgctacagaaaga

SEQ ID NO: 1022787 - DNA, 22 bp, Artificial Sequence
  chemically synthesized
tttttattattacgctacagaa

SEQ ID NO: 1022788 - DNA, 22 bp, Artificial Sequence
  chemically synthesized
aagttatttttattattacgct

SEQ ID NO: 1022789 - DNA, 22 bp, Artificial Sequence
  chemically synthesized
gaagttatttttattattacgc

SEQ ID NO: 1022790 - DNA, 22 bp, Artificial Sequence
  chemically synthesized
tgaagttatttttattattacg

SEQ ID NO: 1022791 - DNA, 22 bp, Artificial Sequence
  chemically synthesized
ttgaagttatttttattattac

SEQ ID NO: 1022792 - DNA, 22 bp, Artificial Sequence
  chemically synthesized
tctgtagcgtaataataaaaat

SEQ ID NO: 1022793 - DNA, 22 bp, Artificial Sequence
  chemically synthesized
ctgtagcgtaataataaaaata

SEQ ID NO: 1022794 - DNA, 22 bp, Artificial Sequence
  chemically synthesized
tgtagcgtaataataaaaataa

SEQ ID NO: 1022795 - DNA, 22 bp, Artificial Sequence
  chemically synthesized
tagcgtaataataaaaataact

SEQ ID NO: 1022796 - DNA, 22 bp, Artificial Sequence
  chemically synthesized
tcatcaacccaagcacttttga

SEQ ID NO: 1022797 - DNA, 22 bp, Artificial Sequence
  chemically synthesized
tcaggctatcatcaacccaagc

SEQ ID NO: 1022798 - DNA, 22 bp, Artificial Sequence
  chemically synthesized
gtcaggctatcatcaacccaag

SEQ ID NO: 1022799 - DNA, 22 bp, Artificial Sequence
  chemically synthesized
caaaagtgcttgggttgatgat

SEQ ID NO: 1022800 - DNA, 22 bp, Artificial Sequence
  chemically synthesized
aaaagtgcttgggttgatgata

SEQ ID NO: 1022801 - DNA, 22 bp, Artificial Sequence
  chemically synthesized
atccttgtcaggctatcatcaa

SEQ ID NO: 1022802 - DNA, 22 bp, Artificial Sequence
  chemically synthesized
gggttgatgatagcctgacaag

SEQ ID NO: 1022803 - DNA, 22 bp, Artificial Sequence
  chemically synthesized
ggttgatgatagcctgacaagg

SEQ ID NO: 1022804 - DNA, 22 bp, Artificial Sequence
  chemically synthesized
atgatagcctgacaaggattag

SEQ ID NO: 1022805 - DNA, 22 bp, Artificial Sequence
  chemically synthesized
gtatgtacccaagctaatcctt

SEQ ID NO: 1022806 - DNA, 22 bp, Artificial Sequence
  chemically synthesized
attggtatgtacccaagctaat

SEQ ID NO: 1022807 - DNA, 22 bp, Artificial Sequence
  chemically synthesized
aattggtatgtacccaagctaa

SEQ ID NO: 1022808 - DNA, 22 bp, Artificial Sequence
  chemically synthesized
taattggtatgtacccaagcta

SEQ ID NO: 1022809 - DNA, 22 bp, Artificial Sequence
  chemically synthesized
acaaggattagcttgggtacat

SEQ ID NO: 1022810 - DNA, 22 bp, Artificial Sequence
  chemically synthesized
tctttaattggtatgtacccaa

SEQ ID NO: 1022811 - DNA, 22 bp, Artificial Sequence
  chemically synthesized
gaccagctgtctttaattggta

SEQ ID NO: 1022812 - DNA, 22 bp, Artificial Sequence
  chemically synthesized
gcttgggtacataccaattaaa

SEQ ID NO: 1022813 - DNA, 22 bp, Artificial Sequence
  chemically synthesized
tagaccagctgtctttaattgg

SEQ ID NO: 1022814 - DNA, 22 bp, Artificial Sequence
  chemically synthesized
ctagaccagctgtctttaattg

SEQ ID NO: 1022815 - DNA, 22 bp, Artificial Sequence
  chemically synthesized
gggtacataccaattaaagaca

SEQ ID NO: 1022816 - DNA, 22 bp, Artificial Sequence
  chemically synthesized
ggtacataccaattaaagacag

SEQ ID NO: 1022817 - DNA, 22 bp, Artificial Sequence
  chemically synthesized
aagacagctggtctagaagctg

SEQ ID NO: 1022818 - DNA, 22 bp, Artificial Sequence
  chemically synthesized
tagcatcatgtgaaaccagctt

SEQ ID NO: 1022819 - DNA, 22 bp, Artificial Sequence
  chemically synthesized
ctgtagcatcatgtgaaaccag

SEQ ID NO: 1022820 - DNA, 22 bp, Artificial Sequence
  chemically synthesized
actgtagcatcatgtgaaacca

SEQ ID NO: 1022821 - DNA, 22 bp, Artificial Sequence
  chemically synthesized
gtctagaagctggtttcacatg

SEQ ID NO: 1022822 - DNA, 22 bp, Artificial Sequence
  chemically synthesized
gaagctggtttcacatgatgct

SEQ ID NO: 1022823 - DNA, 22 bp, Artificial Sequence
  chemically synthesized
ccagtttactgtagcatcatgt

SEQ ID NO: 1022824 - DNA, 22 bp, Artificial Sequence
  chemically synthesized
accagtttactgtagcatcatg

SEQ ID NO: 1022825 - DNA, 22 bp, Artificial Sequence
  chemically synthesized
taccagtttactgtagcatcat

SEQ ID NO: 1022826 - DNA, 22 bp, Artificial Sequence
  chemically synthesized
ctttaccagtttactgtagcat

SEQ ID NO: 1022827 - DNA, 22 bp, Artificial Sequence
  chemically synthesized
gctttaccagtttactgtagca

SEQ ID NO: 1022828 - DNA, 22 bp, Artificial Sequence
  chemically synthesized
gtttcacatgatgctacagtaa

SEQ ID NO: 1022829 - DNA, 22 bp, Artificial Sequence
  chemically synthesized
cacatgatgctacagtaaactg

SEQ ID NO: 1022830 - DNA, 22 bp, Artificial Sequence
  chemically synthesized
acatgatgctacagtaaactgg

SEQ ID NO: 1022831 - DNA, 22 bp, Artificial Sequence
  chemically synthesized
atacttgctttaccagtttact

SEQ ID NO: 1022832 - DNA, 22 bp, Artificial Sequence
  chemically synthesized
aatacttgctttaccagtttac

SEQ ID NO: 1022833 - DNA, 22 bp, Artificial Sequence
  chemically synthesized
taatacttgctttaccagttta

SEQ ID NO: 1022834 - DNA, 22 bp, Artificial Sequence
  chemically synthesized
ggttttaatacttgctttacca

SEQ ID NO: 1022835 - DNA, 22 bp, Artificial Sequence
  chemically synthesized
aggttttaatacttgctttacc

SEQ ID NO: 1022836 - DNA, 22 bp, Artificial Sequence
  chemically synthesized
cagtaaactggtaaagcaagta

SEQ ID NO: 1022837 - DNA, 22 bp, Artificial Sequence
  chemically synthesized
cttaggttttaatacttgcttt

SEQ ID NO: 1022838 - DNA, 22 bp, Artificial Sequence
  chemically synthesized
ttccttaggttttaatacttgc

SEQ ID NO: 1022839 - DNA, 22 bp, Artificial Sequence
  chemically synthesized
gttccttaggttttaatacttg

SEQ ID NO: 1022840 - DNA, 22 bp, Artificial Sequence
  chemically synthesized
gtaaagcaagtattaaaaccta

SEQ ID NO: 1022841 - DNA, 22 bp, Artificial Sequence
  chemically synthesized
aaacctaaggaacaaactctcc

SEQ ID NO: 1022842 - DNA, 22 bp, Artificial Sequence
  chemically synthesized
agccagtaaatatcacaggaga

SEQ ID NO: 1022843 - DNA, 22 bp, Artificial Sequence
  chemically synthesized
aggaacaaactctcctgtgata

SEQ ID NO: 1022844 - DNA, 22 bp, Artificial Sequence
  chemically synthesized
agatgttgagccagtaaatatc

SEQ ID NO: 1022845 - DNA, 22 bp, Artificial Sequence
  chemically synthesized
aagatgttgagccagtaaatat

SEQ ID NO: 1022846 - DNA, 22 bp, Artificial Sequence
  chemically synthesized
tcctgtgatatttactggctca

SEQ ID NO: 1022847 - DNA, 22 bp, Artificial Sequence
  chemically synthesized
tccttaagatgttgagccagta

SEQ ID NO: 1022848 - DNA, 22 bp, Artificial Sequence
  chemically synthesized
atccttaagatgttgagccagt

SEQ ID NO: 1022849 - DNA, 22 bp, Artificial Sequence
  chemically synthesized
ctgtgatatttactggctcaac

SEQ ID NO: 1022850 - DNA, 22 bp, Artificial Sequence
  chemically synthesized
tatccttaagatgttgagccag

SEQ ID NO: 1022851 - DNA, 22 bp, Artificial Sequence
  chemically synthesized
ttatccttaagatgttgagcca

SEQ ID NO: 1022852 - DNA, 22 bp, Artificial Sequence
  chemically synthesized
tgatatttactggctcaacatc

SEQ ID NO: 1022853 - DNA, 22 bp, Artificial Sequence
  chemically synthesized
tcttttatccttaagatgttga

SEQ ID NO: 1022854 - DNA, 22 bp, Artificial Sequence
  chemically synthesized
actggctcaacatcttaaggat

SEQ ID NO: 1022855 - DNA, 22 bp, Artificial Sequence
  chemically synthesized
ctggctcaacatcttaaggata

SEQ ID NO: 1022856 - DNA, 22 bp, Artificial Sequence
  chemically synthesized
gctcaacatcttaaggataaaa

SEQ ID NO: 1022857 - DNA, 22 bp, Artificial Sequence
  chemically synthesized
aacatcttaaggataaaagaca

SEQ ID NO: 1022858 - DNA, 22 bp, Artificial Sequence
  chemically synthesized
acatcatataattgtcttttat

SEQ ID NO: 1022859 - DNA, 22 bp, Artificial Sequence
  chemically synthesized
attaacatcatataattgtctt

SEQ ID NO: 1022860 - DNA, 22 bp, Artificial Sequence
  chemically synthesized
aattaacatcatataattgtct

SEQ ID NO: 1022861 - DNA, 22 bp, Artificial Sequence
  chemically synthesized
aaggataaaagacaattatatg

SEQ ID NO: 1022862 - DNA, 22 bp, Artificial Sequence
  chemically synthesized
aggataaaagacaattatatga

SEQ ID NO: 1022863 - DNA, 22 bp, Artificial Sequence
  chemically synthesized
tcttaattaacatcatataatt

SEQ ID NO: 1022864 - DNA, 22 bp, Artificial Sequence
  chemically synthesized
ccagcatagcactgtcttaatt

SEQ ID NO: 1022865 - DNA, 22 bp, Artificial Sequence
  chemically synthesized
accagcatagcactgtcttaat

SEQ ID NO: 1022866 - DNA, 22 bp, Artificial Sequence
  chemically synthesized
tatgatgttaattaagacagtg

SEQ ID NO: 1022867 - DNA, 22 bp, Artificial Sequence
  chemically synthesized
gacatttaccagcatagcactg

SEQ ID NO: 1022868 - DNA, 22 bp, Artificial Sequence
  chemically synthesized
ttagacatttaccagcatagca

SEQ ID NO: 1022869 - DNA, 22 bp, Artificial Sequence
  chemically synthesized
attaagacagtgctatgctggt

SEQ ID NO: 1022870 - DNA, 22 bp, Artificial Sequence
  chemically synthesized
attgttagacatttaccagcat

SEQ ID NO: 1022871 - DNA, 22 bp, Artificial Sequence
  chemically synthesized
agacagtgctatgctggtaaat

SEQ ID NO: 1022872 - DNA, 22 bp, Artificial Sequence
  chemically synthesized
aggggatctgattgttagacat

SEQ ID NO: 1022873 - DNA, 22 bp, Artificial Sequence
  chemically synthesized
tcaggggatctgattgttagac

SEQ ID NO: 1022874 - DNA, 22 bp, Artificial Sequence
  chemically synthesized
tgctggtaaatgtctaacaatc

SEQ ID NO: 1022875 - DNA, 22 bp, Artificial Sequence
  chemically synthesized
ctctcaggggatctgattgtta

SEQ ID NO: 1022876 - DNA, 22 bp, Artificial Sequence
  chemically synthesized
cctctcaggggatctgattgtt

SEQ ID NO: 1022877 - DNA, 22 bp, Artificial Sequence
  chemically synthesized
gtaaatgtctaacaatcagatc

SEQ ID NO: 1022878 - DNA, 22 bp, Artificial Sequence
  chemically synthesized
aaatatgtccttcctctcaggg

SEQ ID NO: 1022879 - DNA, 22 bp, Artificial Sequence
  chemically synthesized
acaatcagatcccctgagagga

SEQ ID NO: 1022880 - DNA, 22 bp, Artificial Sequence
  chemically synthesized
ggaatattcaaatatgtccttc

SEQ ID NO: 1022881 - DNA, 22 bp, Artificial Sequence
  chemically synthesized
agaggaaggacatatttgaata

SEQ ID NO: 1022882 - DNA, 22 bp, Artificial Sequence
  chemically synthesized
aacatactgggaatattcaaat

SEQ ID NO: 1022883 - DNA, 22 bp, Artificial Sequence
  chemically synthesized
aaattaaacatactgggaatat

SEQ ID NO: 1022884 - DNA, 22 bp, Artificial Sequence
  chemically synthesized
aaaattaaacatactgggaata

SEQ ID NO: 1022885 - DNA, 22 bp, Artificial Sequence
  chemically synthesized
gaatattcccagtatgtttaat

SEQ ID NO: 1022886 - DNA, 22 bp, Artificial Sequence
  chemically synthesized
aatattcccagtatgtttaatt

SEQ ID NO: 1022887 - DNA, 22 bp, Artificial Sequence
  chemically synthesized
taatgatagcttaaaattaaac

SEQ ID NO: 1022888 - DNA, 22 bp, Artificial Sequence
  chemically synthesized
ccagtatgtttaattttaagct

SEQ ID NO: 1022889 - DNA, 22 bp, Artificial Sequence
  chemically synthesized
gtgacattataatgatagctta

SEQ ID NO: 1022890 - DNA, 22 bp, Artificial Sequence
  chemically synthesized
ggtgacattataatgatagctt

SEQ ID NO: 1022891 - DNA, 22 bp, Artificial Sequence
  chemically synthesized
aattttaagctatcattataat

SEQ ID NO: 1022892 - DNA, 22 bp, Artificial Sequence
  chemically synthesized
atgtttggtgacattataatga

SEQ ID NO: 1022893 - DNA, 22 bp, Artificial Sequence
  chemically synthesized
attttaagctatcattataatg

SEQ ID NO: 1022894 - DNA, 22 bp, Artificial Sequence
  chemically synthesized
catgtttggtgacattataatg

SEQ ID NO: 1022895 - DNA, 22 bp, Artificial Sequence
  chemically synthesized
taagctatcattataatgtcac

SEQ ID NO: 1022896 - DNA, 22 bp, Artificial Sequence
  chemically synthesized
acttcatgtttggtgacattat

SEQ ID NO: 1022897 - DNA, 22 bp, Artificial Sequence
  chemically synthesized
aagctatcattataatgtcacc

SEQ ID NO: 1022898 - DNA, 22 bp, Artificial Sequence
  chemically synthesized
agctatcattataatgtcacca

SEQ ID NO: 1022899 - DNA, 22 bp, Artificial Sequence
  chemically synthesized
tcattataatgtcaccaaacat

SEQ ID NO: 1022900 - DNA, 22 bp, Artificial Sequence
  chemically synthesized
taatgtcaccaaacatgaagtt

SEQ ID NO: 1022901 - DNA, 22 bp, Artificial Sequence
  chemically synthesized
tataatggtgtagtgctaactt

SEQ ID NO: 1022902 - DNA, 22 bp, Artificial Sequence
  chemically synthesized
tataatggaatgactgtataat

SEQ ID NO: 1022903 - DNA, 22 bp, Artificial Sequence
  chemically synthesized
gcactacaccattatacagtca

SEQ ID NO: 1022904 - DNA, 22 bp, Artificial Sequence
  chemically synthesized
cctgtataatggaatgactgta

SEQ ID NO: 1022905 - DNA, 22 bp, Artificial Sequence
  chemically synthesized
ttacctgtataatggaatgact

SEQ ID NO: 1022906 - DNA, 22 bp, Artificial Sequence
  chemically synthesized
caccattatacagtcattccat

SEQ ID NO: 1022907 - DNA, 22 bp, Artificial Sequence
  chemically synthesized
gttacctgtataatggaatgac

SEQ ID NO: 1022908 - DNA, 22 bp, Artificial Sequence
  chemically synthesized
cgggtttgttacctgtataatg

SEQ ID NO: 1022909 - DNA, 22 bp, Artificial Sequence
  chemically synthesized
tacagtcattccattatacagg

SEQ ID NO: 1022910 - DNA, 22 bp, Artificial Sequence
  chemically synthesized
tctacgggtttgttacctgtat

SEQ ID NO: 1022911 - DNA, 22 bp, Artificial Sequence
  chemically synthesized
ttatctacgggtttgttacctg

SEQ ID NO: 1022912 - DNA, 22 bp, Artificial Sequence
  chemically synthesized
actattatctacgggtttgtta

SEQ ID NO: 1022913 - DNA, 22 bp, Artificial Sequence
  chemically synthesized
cattatacaggtaacaaacccg

SEQ ID NO: 1022914 - DNA, 22 bp, Artificial Sequence
  chemically synthesized
cactattatctacgggtttgtt

SEQ ID NO: 1022915 - DNA, 22 bp, Artificial Sequence
  chemically synthesized
tacaggtaacaaacccgtagat

SEQ ID NO: 1022916 - DNA, 22 bp, Artificial Sequence
  chemically synthesized
tatttcactattatctacgggt

SEQ ID NO: 1022917 - DNA, 22 bp, Artificial Sequence
  chemically synthesized
ttatatttcactattatctacg

SEQ ID NO: 1022918 - DNA, 22 bp, Artificial Sequence
  chemically synthesized
attatatttcactattatctac

SEQ ID NO: 1022919 - DNA, 22 bp, Artificial Sequence
  chemically synthesized
tattatatttcactattatcta

SEQ ID NO: 1022920 - DNA, 22 bp, Artificial Sequence
  chemically synthesized
ttattatatttcactattatct

SEQ ID NO: 1022921 - DNA, 22 bp, Artificial Sequence
  chemically synthesized
ttttattatatttcactattat

SEQ ID NO: 1022922 - DNA, 22 bp, Artificial Sequence
  chemically synthesized
attcttttattatatttcacta

SEQ ID NO: 1022923 - DNA, 22 bp, Artificial Sequence
  chemically synthesized
cctaattcttttattatatttc

SEQ ID NO: 1022924 - DNA, 22 bp, Artificial Sequence
  chemically synthesized
gatgcacaaaagtcatcactac

SEQ ID NO: 1022925 - DNA, 22 bp, Artificial Sequence
  chemically synthesized
ggtagtgatgacttttgtgcat

SEQ ID NO: 1022926 - DNA, 22 bp, Artificial Sequence
  chemically synthesized
acaaatgtactagatgcacaaa

SEQ ID NO: 1022927 - DNA, 22 bp, Artificial Sequence
  chemically synthesized
ttcacaaatgtactagatgcac

SEQ ID NO: 1022928 - DNA, 22 bp, Artificial Sequence
  chemically synthesized
ttgtgcatctagtacatttgtg

SEQ ID NO: 1022929 - DNA, 22 bp, Artificial Sequence
  chemically synthesized
tgtgcatctagtacatttgtga

SEQ ID NO: 1022930 - DNA, 22 bp, Artificial Sequence
  chemically synthesized
gtgcatctagtacatttgtgaa

SEQ ID NO: 1022931 - DNA, 22 bp, Artificial Sequence
  chemically synthesized
tgcatctagtacatttgtgaac

SEQ ID NO: 1022932 - DNA, 22 bp, Artificial Sequence
  chemically synthesized
aatgaaatatattgttcacaaa

SEQ ID NO: 1022933 - DNA, 22 bp, Artificial Sequence
  chemically synthesized
cattaaatgaaatatattgttc

SEQ ID NO: 1022934 - DNA, 22 bp, Artificial Sequence
  chemically synthesized
acattaaatgaaatatattgtt

SEQ ID NO: 1022935 - DNA, 22 bp, Artificial Sequence
  chemically synthesized
gtacatttgtgaacaatatatt

SEQ ID NO: 1022936 - DNA, 22 bp, Artificial Sequence
  chemically synthesized
gtgaacaatatatttcatttaa

SEQ ID NO: 1022937 - DNA, 22 bp, Artificial Sequence
  chemically synthesized
tggtaacttacattaaatgaaa

SEQ ID NO: 1022938 - DNA, 22 bp, Artificial Sequence
  chemically synthesized
tgaacaatatatttcatttaat

SEQ ID NO: 1022939 - DNA, 22 bp, Artificial Sequence
  chemically synthesized
aattatggtaacttacattaaa

SEQ ID NO: 1022940 - DNA, 22 bp, Artificial Sequence
  chemically synthesized
catttaatgtaagttaccataa

SEQ ID NO: 1022941 - DNA, 22 bp, Artificial Sequence
  chemically synthesized
tcaaaaattaaattatggtaac

SEQ ID NO: 1022942 - DNA, 22 bp, Artificial Sequence
  chemically synthesized
atttaatgtaagttaccataat

SEQ ID NO: 1022943 - DNA, 22 bp, Artificial Sequence
  chemically synthesized
aatgtaagttaccataatttaa

SEQ ID NO: 1022944 - DNA, 22 bp, Artificial Sequence
  chemically synthesized
atgtaagttaccataatttaat

SEQ ID NO: 1022945 - DNA, 22 bp, Artificial Sequence
  chemically synthesized
aacacaaccattatcaaaaatt

SEQ ID NO: 1022946 - DNA, 22 bp, Artificial Sequence
  chemically synthesized
ccataatttaatttttgataat

SEQ ID NO: 1022947 - DNA, 22 bp, Artificial Sequence
  chemically synthesized
ttaaacacaaccattatcaaaa

SEQ ID NO: 1022948 - DNA, 22 bp, Artificial Sequence
  chemically synthesized
agatctgttaaacacaaccatt

SEQ ID NO: 1022949 - DNA, 22 bp, Artificial Sequence
  chemically synthesized
gagatctgttaaacacaaccat

SEQ ID NO: 1022950 - DNA, 22 bp, Artificial Sequence
  chemically synthesized
aatttttgataatggttgtgtt

SEQ ID NO: 1022951 - DNA, 22 bp, Artificial Sequence
  chemically synthesized
tgagatctgttaaacacaacca

SEQ ID NO: 1022952 - DNA, 22 bp, Artificial Sequence
  chemically synthesized
atttttgataatggttgtgttt

SEQ ID NO: 1022953 - DNA, 22 bp, Artificial Sequence
  chemically synthesized
ttgataatggttgtgtttaaca

SEQ ID NO: 1022954 - DNA, 22 bp, Artificial Sequence
  chemically synthesized
tgataatggttgtgtttaacag

SEQ ID NO: 1022955 - DNA, 22 bp, Artificial Sequence
  chemically synthesized
gataatggttgtgtttaacaga

SEQ ID NO: 1022956 - DNA, 22 bp, Artificial Sequence
  chemically synthesized
ataatggttgtgtttaacagat

SEQ ID NO: 1022957 - DNA, 22 bp, Artificial Sequence
  chemically synthesized
aagaattttgagatctgttaaa

SEQ ID NO: 1022958 - DNA, 22 bp, Artificial Sequence
  chemically synthesized
caagaattttgagatctgttaa

SEQ ID NO: 1022959 - DNA, 22 bp, Artificial Sequence
  chemically synthesized
tcaagaattttgagatctgtta

SEQ ID NO: 1022960 - DNA, 22 bp, Artificial Sequence
  chemically synthesized
aattttcaagaattttgagatc

SEQ ID NO: 1022961 - DNA, 22 bp, Artificial Sequence
  chemically synthesized
tgtttaacagatctcaaaattc

SEQ ID NO: 1022962 - DNA, 22 bp, Artificial Sequence
  chemically synthesized
ttaaattttcaagaattttgag

SEQ ID NO: 1022963 - DNA, 22 bp, Artificial Sequence
  chemically synthesized
gttaaattttcaagaattttga

SEQ ID NO: 1022964 - DNA, 22 bp, Artificial Sequence
  chemically synthesized
aacagatctcaaaattcttgaa

SEQ ID NO: 1022965 - DNA, 22 bp, Artificial Sequence
  chemically synthesized
acagatctcaaaattcttgaaa

SEQ ID NO: 1022966 - DNA, 22 bp, Artificial Sequence
  chemically synthesized
gaaatacttgttaaattttcaa

SEQ ID NO: 1022967 - DNA, 22 bp, Artificial Sequence
  chemically synthesized
aaaattcttgaaaatttaacaa

SEQ ID NO: 1022968 - DNA, 22 bp, Artificial Sequence
  chemically synthesized
ttgaaaatttaacaagtatttc

SEQ ID NO: 1022969 - DNA, 22 bp, Artificial Sequence
  chemically synthesized
agtcgatgtgctggaaatactt

SEQ ID NO: 1022970 - DNA, 22 bp, Artificial Sequence
  chemically synthesized
gaaaatttaacaagtatttcca

SEQ ID NO: 1022971 - DNA, 22 bp, Artificial Sequence
  chemically synthesized
gagtcgatgtgctggaaatact

SEQ ID NO: 1022972 - DNA, 22 bp, Artificial Sequence
  chemically synthesized
aaaatttaacaagtatttccag

SEQ ID NO: 1022973 - DNA, 22 bp, Artificial Sequence
  chemically synthesized
acttgagtcgatgtgctggaaa

SEQ ID NO: 1022974 - DNA, 22 bp, Artificial Sequence
  chemically synthesized
aacttgagtcgatgtgctggaa

SEQ ID NO: 1022975 - DNA, 22 bp, Artificial Sequence
  chemically synthesized
aacaagtatttccagcacatcg

SEQ ID NO: 1022976 - DNA, 22 bp, Artificial Sequence
  chemically synthesized
acaagtatttccagcacatcga

SEQ ID NO: 1022977 - DNA, 22 bp, Artificial Sequence
  chemically synthesized
atgtttaacttgagtcgatgtg

SEQ ID NO: 1022978 - DNA, 22 bp, Artificial Sequence
  chemically synthesized
ccagcacatcgactcaagttaa

SEQ ID NO: 1022979 - DNA, 22 bp, Artificial Sequence
  chemically synthesized
cagcacatcgactcaagttaaa

SEQ ID NO: 1022980 - DNA, 22 bp, Artificial Sequence
  chemically synthesized
tgataaactaatgtttaacttg

SEQ ID NO: 1022981 - DNA, 22 bp, Artificial Sequence
  chemically synthesized
tgtacattgtgataaactaatg

SEQ ID NO: 1022982 - DNA, 22 bp, Artificial Sequence
  chemically synthesized
gtgtacattgtgataaactaat

SEQ ID NO: 1022983 - DNA, 22 bp, Artificial Sequence
  chemically synthesized
tgtgtacattgtgataaactaa

SEQ ID NO: 1022984 - DNA, 22 bp, Artificial Sequence
  chemically synthesized
ttgtgtacattgtgataaacta

SEQ ID NO: 1022985 - DNA, 22 bp, Artificial Sequence
  chemically synthesized
aagttaaacattagtttatcac

SEQ ID NO: 1022986 - DNA, 22 bp, Artificial Sequence
  chemically synthesized
ttttgtgtacattgtgataaac

SEQ ID NO: 1022987 - DNA, 22 bp, Artificial Sequence
  chemically synthesized
cttttgtgtacattgtgataaa

SEQ ID NO: 1022988 - DNA, 22 bp, Artificial Sequence
  chemically synthesized
ttcttttgtgtacattgtgata

SEQ ID NO: 1022989 - DNA, 22 bp, Artificial Sequence
  chemically synthesized
aacattagtttatcacaatgta

SEQ ID NO: 1022990 - DNA, 22 bp, Artificial Sequence
  chemically synthesized
gtttatcacaatgtacacaaaa

SEQ ID NO: 1022991 - DNA, 22 bp, Artificial Sequence
  chemically synthesized
ataagaacctcttcttttgtgt

SEQ ID NO: 1022992 - DNA, 22 bp, Artificial Sequence
  chemically synthesized
atcacaatgtacacaaaagaag

SEQ ID NO: 1022993 - DNA, 22 bp, Artificial Sequence
  chemically synthesized
tcacaatgtacacaaaagaaga

SEQ ID NO: 1022994 - DNA, 22 bp, Artificial Sequence
  chemically synthesized
atgatgtatgggataggtactg

SEQ ID NO: 1022995 - DNA, 22 bp, Artificial Sequence
  chemically synthesized
ttatcagtacctatcccataca

SEQ ID NO: 1022996 - DNA, 22 bp, Artificial Sequence
  chemically synthesized
atcagtacctatcccatacatc

SEQ ID NO: 1022997 - DNA, 22 bp, Artificial Sequence
  chemically synthesized
tcagtacctatcccatacatca

SEQ ID NO: 1022998 - DNA, 22 bp, Artificial Sequence
  chemically synthesized
agaagaataggaaaaattaatg

SEQ ID NO: 1022999 - DNA, 22 bp, Artificial Sequence
  chemically synthesized
tcccatacatcattaatttttc

SEQ ID NO: 1023000 - DNA, 22 bp, Artificial Sequence
  chemically synthesized
atacctgagaagaataggaaaa

SEQ ID NO: 1023001 - DNA, 22 bp, Artificial Sequence
  chemically synthesized
tataaactaatacctgagaaga

SEQ ID NO: 1023002 - DNA, 22 bp, Artificial Sequence
  chemically synthesized
atttttcctattcttctcaggt

SEQ ID NO: 1023003 - DNA, 22 bp, Artificial Sequence
  chemically synthesized
atataaactaatacctgagaag

SEQ ID NO: 1023004 - DNA, 22 bp, Artificial Sequence
  chemically synthesized
tatataaactaatacctgagaa

SEQ ID NO: 1023005 - DNA, 22 bp, Artificial Sequence
  chemically synthesized
ttcctattcttctcaggtatta

SEQ ID NO: 1023006 - DNA, 22 bp, Artificial Sequence
  chemically synthesized
tcctattcttctcaggtattag

SEQ ID NO: 1023007 - DNA, 22 bp, Artificial Sequence
  chemically synthesized
cctattcttctcaggtattagt

SEQ ID NO: 1023008 - DNA, 22 bp, Artificial Sequence
  chemically synthesized
ctattcttctcaggtattagtt

SEQ ID NO: 1023009 - DNA, 22 bp, Artificial Sequence
  chemically synthesized
ttcttctcaggtattagtttat

SEQ ID NO: 1023010 - DNA, 22 bp, Artificial Sequence
  chemically synthesized
ttctcaggtattagtttatata

SEQ ID NO: 1023011 - DNA, 22 bp, Artificial Sequence
  chemically synthesized
ctcaggtattagtttatataaa

SEQ ID NO: 1023012 - DNA, 22 bp, Artificial Sequence
  chemically synthesized
tcaggtattagtttatataaaa

SEQ ID NO: 1023013 - DNA, 22 bp, Artificial Sequence
  chemically synthesized
aggtattagtttatataaaatt

SEQ ID NO: 1023014 - DNA, 22 bp, Artificial Sequence
  chemically synthesized
aaagagaaaacaaaattttata

SEQ ID NO: 1023015 - DNA, 22 bp, Artificial Sequence
  chemically synthesized
caaagagaaaacaaaattttat

SEQ ID NO: 1023016 - DNA, 22 bp, Artificial Sequence
  chemically synthesized
tcaaagagaaaacaaaatttta

SEQ ID NO: 1023017 - DNA, 22 bp, Artificial Sequence
  chemically synthesized
ttttcaaagagaaaacaaaatt

SEQ ID NO: 1023018 - DNA, 22 bp, Artificial Sequence
  chemically synthesized
attttcaaagagaaaacaaaat

SEQ ID NO: 1023019 - DNA, 22 bp, Artificial Sequence
  chemically synthesized
gtttatataaaattttgttttc

SEQ ID NO: 1023020 - DNA, 22 bp, Artificial Sequence
  chemically synthesized
cttattttcaaagagaaaacaa

SEQ ID NO: 1023021 - DNA, 22 bp, Artificial Sequence
  chemically synthesized
atataaaattttgttttctctt

SEQ ID NO: 1023022 - DNA, 22 bp, Artificial Sequence
  chemically synthesized
tataaaattttgttttctcttt

SEQ ID NO: 1023023 - DNA, 22 bp, Artificial Sequence
  chemically synthesized
tgttttctctttgaaaataagg

SEQ ID NO: 1023024 - DNA, 22 bp, Artificial Sequence
  chemically synthesized
gttttctctttgaaaataagga

SEQ ID NO: 1023025 - DNA, 22 bp, Artificial Sequence
  chemically synthesized
ttttctctttgaaaataaggag

SEQ ID NO: 1023026 - DNA, 22 bp, Artificial Sequence
  chemically synthesized
atacaaatgcaagactccttat

SEQ ID NO: 1023027 - DNA, 22 bp, Artificial Sequence
  chemically synthesized
tctctttgaaaataaggagtct

SEQ ID NO: 1023028 - DNA, 22 bp, Artificial Sequence
  chemically synthesized
catacaaatgcaagactcctta

SEQ ID NO: 1023029 - DNA, 22 bp, Artificial Sequence
  chemically synthesized
ctctttgaaaataaggagtctt

SEQ ID NO: 1023030 - DNA, 22 bp, Artificial Sequence
  chemically synthesized
tcatacaaatgcaagactcctt

SEQ ID NO: 1023031 - DNA, 22 bp, Artificial Sequence
  chemically synthesized
tctttgaaaataaggagtcttg

SEQ ID NO: 1023032 - DNA, 22 bp, Artificial Sequence
  chemically synthesized
tttgaaaataaggagtcttgca

SEQ ID NO: 1023033 - DNA, 22 bp, Artificial Sequence
  chemically synthesized
tgaaaataaggagtcttgcatt

SEQ ID NO: 1023034 - DNA, 22 bp, Artificial Sequence
  chemically synthesized
gaaaataaggagtcttgcattt

SEQ ID NO: 1023035 - DNA, 22 bp, Artificial Sequence
  chemically synthesized
gaattttcatacaaatgcaaga

SEQ ID NO: 1023036 - DNA, 22 bp, Artificial Sequence
  chemically synthesized
aaaataaggagtcttgcatttg

SEQ ID NO: 1023037 - DNA, 22 bp, Artificial Sequence
  chemically synthesized
ttagaattttcatacaaatgca

SEQ ID NO: 1023038 - DNA, 22 bp, Artificial Sequence
  chemically synthesized
gttagaattttcatacaaatgc

SEQ ID NO: 1023039 - DNA, 22 bp, Artificial Sequence
  chemically synthesized
ttgttagaattttcatacaaat

SEQ ID NO: 1023040 - DNA, 22 bp, Artificial Sequence
  chemically synthesized
ctcttgttagaattttcataca

SEQ ID NO: 1023041 - DNA, 22 bp, Artificial Sequence
  chemically synthesized
gttcctcttgttagaattttca

SEQ ID NO: 1023042 - DNA, 22 bp, Artificial Sequence
  chemically synthesized
gcatttgtatgaaaattctaac

SEQ ID NO: 1023043 - DNA, 22 bp, Artificial Sequence
  chemically synthesized
catttgtatgaaaattctaaca

SEQ ID NO: 1023044 - DNA, 22 bp, Artificial Sequence
  chemically synthesized
gtatgaaaattctaacaagagg

SEQ ID NO: 1023045 - DNA, 22 bp, Artificial Sequence
  chemically synthesized
tatgaaaattctaacaagagga

SEQ ID NO: 1023046 - DNA, 22 bp, Artificial Sequence
  chemically synthesized
taacaagaggaacgaacttttt

SEQ ID NO: 1023047 - DNA, 22 bp, Artificial Sequence
  chemically synthesized
acaagaggaacgaacttttttt

SEQ ID NO: 1023048 - DNA, 22 bp, Artificial Sequence
  chemically synthesized
aagtataataaaaaaaaaaaag

SEQ ID NO: 1023049 - DNA, 22 bp, Artificial Sequence
  chemically synthesized
aaagtataataaaaaaaaaaaa

SEQ ID NO: 1023050 - DNA, 22 bp, Artificial Sequence
  chemically synthesized
aaacttaaagtataataaaaaa

SEQ ID NO: 1023051 - DNA, 22 bp, Artificial Sequence
  chemically synthesized
ttttttttttattatactttaa

SEQ ID NO: 1023052 - DNA, 22 bp, Artificial Sequence
  chemically synthesized
tttttttttattatactttaag

SEQ ID NO: 1023053 - DNA, 22 bp, Artificial Sequence
  chemically synthesized
ttttttttattatactttaagt

SEQ ID NO: 1023054 - DNA, 22 bp, Artificial Sequence
  chemically synthesized
tttttttattatactttaagtt

SEQ ID NO: 1023055 - DNA, 22 bp, Artificial Sequence
  chemically synthesized
ttttttattatactttaagttt

SEQ ID NO: 1023056 - DNA, 22 bp, Artificial Sequence
  chemically synthesized
tttttattatactttaagtttt

SEQ ID NO: 1023057 - DNA, 22 bp, Artificial Sequence
  chemically synthesized
ttttattatactttaagtttta

SEQ ID NO: 1023058 - DNA, 22 bp, Artificial Sequence
  chemically synthesized
tttattatactttaagttttag

SEQ ID NO: 1023059 - DNA, 22 bp, Artificial Sequence
  chemically synthesized
ttattatactttaagttttagg

SEQ ID NO: 1023060 - DNA, 22 bp, Artificial Sequence
  chemically synthesized
tattatactttaagttttaggg

SEQ ID NO: 1023061 - DNA, 22 bp, Artificial Sequence
  chemically synthesized
attatactttaagttttagggt

SEQ ID NO: 1023062 - DNA, 22 bp, Artificial Sequence
  chemically synthesized
ttatactttaagttttagggta

SEQ ID NO: 1023063 - DNA, 22 bp, Artificial Sequence
  chemically synthesized
tactttaagttttagggtacat

SEQ ID NO: 1023064 - DNA, 22 bp, Artificial Sequence
  chemically synthesized
cacaatgtgcacatgtacccta

SEQ ID NO: 1023065 - DNA, 22 bp, Artificial Sequence
  chemically synthesized
taagttttagggtacatgtgca

SEQ ID NO: 1023066 - DNA, 22 bp, Artificial Sequence
  chemically synthesized
acctacacaatgtgcacatgta

SEQ ID NO: 1023067 - DNA, 22 bp, Artificial Sequence
  chemically synthesized
aagttttagggtacatgtgcac

SEQ ID NO: 1023068 - DNA, 22 bp, Artificial Sequence
  chemically synthesized
agttttagggtacatgtgcaca

SEQ ID NO: 1023069 - DNA, 22 bp, Artificial Sequence
  chemically synthesized
tagggtacatgtgcacattgtg

SEQ ID NO: 1023070 - DNA, 22 bp, Artificial Sequence
  chemically synthesized
agggtacatgtgcacattgtgt

SEQ ID NO: 1023071 - DNA, 22 bp, Artificial Sequence
  chemically synthesized
gggtacatgtgcacattgtgta

SEQ ID NO: 1023072 - DNA, 22 bp, Artificial Sequence
  chemically synthesized
tgtaggttagttacatatgtat

SEQ ID NO: 1023073 - DNA, 22 bp, Artificial Sequence
  chemically synthesized
gttacatatgtatacatgtgcc

SEQ ID NO: 1023074 - DNA, 22 bp, Artificial Sequence
  chemically synthesized
catatgtatacatgtgccatgc

SEQ ID NO: 1023075 - DNA, 22 bp, Artificial Sequence
  chemically synthesized
gtgggtgcagcgcaccagcatg

SEQ ID NO: 1023076 - DNA, 22 bp, Artificial Sequence
  chemically synthesized
gatgacgagttagtgggtgcag

SEQ ID NO: 1023077 - DNA, 22 bp, Artificial Sequence
  chemically synthesized
atgctagatgacgagttagtgg

SEQ ID NO: 1023078 - DNA, 22 bp, Artificial Sequence
  chemically synthesized
gtgcgctgcacccactaactcg

SEQ ID NO: 1023079 - DNA, 22 bp, Artificial Sequence
  chemically synthesized
cacccactaactcgtcatctag

SEQ ID NO: 1023080 - DNA, 22 bp, Artificial Sequence
  chemically synthesized
ggagatatacctaatgctagat

SEQ ID NO: 1023081 - DNA, 22 bp, Artificial Sequence
  chemically synthesized
actcgtcatctagcattaggta

SEQ ID NO: 1023082 - DNA, 22 bp, Artificial Sequence
  chemically synthesized
gtcatctagcattaggtatatc

SEQ ID NO: 1023083 - DNA, 22 bp, Artificial Sequence
  chemically synthesized
gcattaggtatatctcccaatg

SEQ ID NO: 1023084 - DNA, 22 bp, Artificial Sequence
  chemically synthesized
ggtatatctcccaatgctatcc

SEQ ID NO: 1023085 - DNA, 22 bp, Artificial Sequence
  chemically synthesized
ccaatgctatccctcccccctc

SEQ ID NO: 1023086 - DNA, 22 bp, Artificial Sequence
  chemically synthesized
tggtggggtggggggagggggg

SEQ ID NO: 1023087 - DNA, 22 bp, Artificial Sequence
  chemically synthesized
tccctcccccctccccccaccc

SEQ ID NO: 1023088 - DNA, 22 bp, Artificial Sequence
  chemically synthesized
gggactgtggtggggtgggggg

SEQ ID NO: 1023089 - DNA, 22 bp, Artificial Sequence
  chemically synthesized
tggggactgtggtggggtgggg

SEQ ID NO: 1023090 - DNA, 22 bp, Artificial Sequence
  chemically synthesized
ccccctccccccaccccaccac

SEQ ID NO: 1023091 - DNA, 22 bp, Artificial Sequence
  chemically synthesized
cccccaccccaccacagtcccc

SEQ ID NO: 1023092 - DNA, 22 bp, Artificial Sequence
  chemically synthesized
aacaatgagatcacatggacac

SEQ ID NO: 1023093 - DNA, 22 bp, Artificial Sequence
  chemically synthesized
cccttcctgtgtccatgtgatc

SEQ ID NO: 1023094 - DNA, 22 bp, Artificial Sequence
  chemically synthesized
cctgtgtccatgtgatctcatt

SEQ ID NO: 1023095 - DNA, 22 bp, Artificial Sequence
  chemically synthesized
ctgtgtccatgtgatctcattg

SEQ ID NO: 1023096 - DNA, 22 bp, Artificial Sequence
  chemically synthesized
tgtccatgtgatctcattgttc

SEQ ID NO: 1023097 - DNA, 22 bp, Artificial Sequence
  chemically synthesized
ataggtggggtgggaattgaac

SEQ ID NO: 1023098 - DNA, 22 bp, Artificial Sequence
  chemically synthesized
actcataggtggggtgggaatt

SEQ ID NO: 1023099 - DNA, 22 bp, Artificial Sequence
  chemically synthesized
tcactcataggtggggtgggaa

SEQ ID NO: 1023100 - DNA, 22 bp, Artificial Sequence
  chemically synthesized
attgttcaattcccaccccacc

SEQ ID NO: 1023101 - DNA, 22 bp, Artificial Sequence
  chemically synthesized
ttcaattcccaccccacctatg

SEQ ID NO: 1023102 - DNA, 22 bp, Artificial Sequence
  chemically synthesized
catattctcactcataggtggg

SEQ ID NO: 1023103 - DNA, 22 bp, Artificial Sequence
  chemically synthesized
aattcccaccccacctatgagt

SEQ ID NO: 1023104 - DNA, 22 bp, Artificial Sequence
  chemically synthesized
ccaccccacctatgagtgagaa

SEQ ID NO: 1023105 - DNA, 22 bp, Artificial Sequence
  chemically synthesized
tgagtgagaatatgcagtgttt

SEQ ID NO: 1023106 - DNA, 22 bp, Artificial Sequence
  chemically synthesized
tcgcaagaacaaaaaaccaaac

SEQ ID NO: 1023107 - DNA, 22 bp, Artificial Sequence
  chemically synthesized
agtaaactatcgcaagaacaaa

SEQ ID NO: 1023108 - DNA, 22 bp, Artificial Sequence
  chemically synthesized
tcagtaaactatcgcaagaaca

SEQ ID NO: 1023109 - DNA, 22 bp, Artificial Sequence
  chemically synthesized
ggttttttgttcttgcgatagt

SEQ ID NO: 1023110 - DNA, 22 bp, Artificial Sequence
  chemically synthesized
gttttttgttcttgcgatagtt

SEQ ID NO: 1023111 - DNA, 22 bp, Artificial Sequence
  chemically synthesized
tttgttcttgcgatagtttact

SEQ ID NO: 1023112 - DNA, 22 bp, Artificial Sequence
  chemically synthesized
ttgttcttgcgatagtttactg

SEQ ID NO: 1023113 - DNA, 22 bp, Artificial Sequence
  chemically synthesized
tgttcttgcgatagtttactga

SEQ ID NO: 1023114 - DNA, 22 bp, Artificial Sequence
  chemically synthesized
gttcttgcgatagtttactgag

SEQ ID NO: 1023115 - DNA, 22 bp, Artificial Sequence
  chemically synthesized
gaaaccgtcattctcagtaaac

SEQ ID NO: 1023116 - DNA, 22 bp, Artificial Sequence
  chemically synthesized
ttcttgcgatagtttactgaga

SEQ ID NO: 1023117 - DNA, 22 bp, Artificial Sequence
  chemically synthesized
ttgcgatagtttactgagaatg

SEQ ID NO: 1023118 - DNA, 22 bp, Artificial Sequence
  chemically synthesized
gcgatagtttactgagaatgac

SEQ ID NO: 1023119 - DNA, 22 bp, Artificial Sequence
  chemically synthesized
cgatagtttactgagaatgacg

SEQ ID NO: 1023120 - DNA, 22 bp, Artificial Sequence
  chemically synthesized
actgagaatgacggtttccagt

SEQ ID NO: 1023121 - DNA, 22 bp, Artificial Sequence
  chemically synthesized
ctgagaatgacggtttccagtt

SEQ ID NO: 1023122 - DNA, 22 bp, Artificial Sequence
  chemically synthesized
agaatgacggtttccagtttca

SEQ ID NO: 1023123 - DNA, 22 bp, Artificial Sequence
  chemically synthesized
tagggacatggatgaaactgga

SEQ ID NO: 1023124 - DNA, 22 bp, Artificial Sequence
  chemically synthesized
gtagggacatggatgaaactgg

SEQ ID NO: 1023125 - DNA, 22 bp, Artificial Sequence
  chemically synthesized
tgtagggacatggatgaaactg

SEQ ID NO: 1023126 - DNA, 22 bp, Artificial Sequence
  chemically synthesized
atgtcctttgtagggacatgga

SEQ ID NO: 1023127 - DNA, 22 bp, Artificial Sequence
  chemically synthesized
ccagtttcatccatgtccctac

SEQ ID NO: 1023128 - DNA, 22 bp, Artificial Sequence
  chemically synthesized
cagtttcatccatgtccctaca

SEQ ID NO: 1023129 - DNA, 22 bp, Artificial Sequence
  chemically synthesized
catccatgtccctacaaaggac

SEQ ID NO: 1023130 - DNA, 22 bp, Artificial Sequence
  chemically synthesized
atccatgtccctacaaaggaca

SEQ ID NO: 1023131 - DNA, 22 bp, Artificial Sequence
  chemically synthesized
caaaggacatgaactcatcatt

SEQ ID NO: 1023132 - DNA, 22 bp, Artificial Sequence
  chemically synthesized
tgcagccagaaaaaatgatgag

SEQ ID NO: 1023133 - DNA, 22 bp, Artificial Sequence
  chemically synthesized
atcattttttctggctgcatag

SEQ ID NO: 1023134 - DNA, 22 bp, Artificial Sequence
  chemically synthesized
tttctggctgcatagtattcca

SEQ ID NO: 1023135 - DNA, 22 bp, Artificial Sequence
  chemically synthesized
ttctggctgcatagtattccat

SEQ ID NO: 1023136 - DNA, 22 bp, Artificial Sequence
  chemically synthesized
tctggctgcatagtattccatg

SEQ ID NO: 1023137 - DNA, 22 bp, Artificial Sequence
  chemically synthesized
ctggctgcatagtattccatgg

SEQ ID NO: 1023138 - DNA, 22 bp, Artificial Sequence
  chemically synthesized
tggctgcatagtattccatggt

SEQ ID NO: 1023139 - DNA, 22 bp, Artificial Sequence
  chemically synthesized
gctgcatagtattccatggtgt

SEQ ID NO: 1023140 - DNA, 22 bp, Artificial Sequence
  chemically synthesized
catagtattccatggtgtatat

SEQ ID NO: 1023141 - DNA, 22 bp, Artificial Sequence
  chemically synthesized
agaaaatgtggcacatatacac

SEQ ID NO: 1023142 - DNA, 22 bp, Artificial Sequence
  chemically synthesized
gattaagaaaatgtggcacata

SEQ ID NO: 1023143 - DNA, 22 bp, Artificial Sequence
  chemically synthesized
catggtgtatatgtgccacatt

SEQ ID NO: 1023144 - DNA, 22 bp, Artificial Sequence
  chemically synthesized
tcttaatccagtctatcattgt

SEQ ID NO: 1023145 - DNA, 22 bp, Artificial Sequence
  chemically synthesized
cttaatccagtctatcattgtt

SEQ ID NO: 1023146 - DNA, 22 bp, Artificial Sequence
  chemically synthesized
ttaatccagtctatcattgttg

SEQ ID NO: 1023147 - DNA, 22 bp, Artificial Sequence
  chemically synthesized
aatccagtctatcattgttgga

SEQ ID NO: 1023148 - DNA, 22 bp, Artificial Sequence
  chemically synthesized
atccagtctatcattgttggac

SEQ ID NO: 1023149 - DNA, 22 bp, Artificial Sequence
  chemically synthesized
gaaccaacccaaatgtccaaca

SEQ ID NO: 1023150 - DNA, 22 bp, Artificial Sequence
  chemically synthesized
ggaaccaacccaaatgtccaac

SEQ ID NO: 1023151 - DNA, 22 bp, Artificial Sequence
  chemically synthesized
tcattgttggacatttgggttg

SEQ ID NO: 1023152 - DNA, 22 bp, Artificial Sequence
  chemically synthesized
ttggacatttgggttggttcca

SEQ ID NO: 1023153 - DNA, 22 bp, Artificial Sequence
  chemically synthesized
gacatttgggttggttccaagt

SEQ ID NO: 1023154 - DNA, 22 bp, Artificial Sequence
  chemically synthesized
acaataacaaagacttggaacc

SEQ ID NO: 1023155 - DNA, 22 bp, Artificial Sequence
  chemically synthesized
ttcacaataacaaagacttgga

SEQ ID NO: 1023156 - DNA, 22 bp, Artificial Sequence
  chemically synthesized
gggttggttccaagtctttgtt

SEQ ID NO: 1023157 - DNA, 22 bp, Artificial Sequence
  chemically synthesized
ggttggttccaagtctttgtta

SEQ ID NO: 1023158 - DNA, 22 bp, Artificial Sequence
  chemically synthesized
cagcactattcacaataacaaa

SEQ ID NO: 1023159 - DNA, 22 bp, Artificial Sequence
  chemically synthesized
gttccaagtctttgttattgtg

SEQ ID NO: 1023160 - DNA, 22 bp, Artificial Sequence
  chemically synthesized
ttgcagcactattcacaataac

SEQ ID NO: 1023161 - DNA, 22 bp, Artificial Sequence
  chemically synthesized
attgcagcactattcacaataa

SEQ ID NO: 1023162 - DNA, 22 bp, Artificial Sequence
  chemically synthesized
caagtctttgttattgtgaata

SEQ ID NO: 1023163 - DNA, 22 bp, Artificial Sequence
  chemically synthesized
tgttattgtgaatagtgctgca

SEQ ID NO: 1023164 - DNA, 22 bp, Artificial Sequence
  chemically synthesized
gttattgtgaatagtgctgcaa

SEQ ID NO: 1023165 - DNA, 22 bp, Artificial Sequence
  chemically synthesized
ttattgtgaatagtgctgcaat

SEQ ID NO: 1023166 - DNA, 22 bp, Artificial Sequence
  chemically synthesized
ttgtgaatagtgctgcaataaa

SEQ ID NO: 1023167 - DNA, 22 bp, Artificial Sequence
  chemically synthesized
tgaatagtgctgcaataaacat

SEQ ID NO: 1023168 - DNA, 22 bp, Artificial Sequence
  chemically synthesized
taaagacacatgcacacgtatg

SEQ ID NO: 1023169 - DNA, 22 bp, Artificial Sequence
  chemically synthesized
ctataaagacacatgcacacgt

SEQ ID NO: 1023170 - DNA, 22 bp, Artificial Sequence
  chemically synthesized
caataaacatacgtgtgcatgt

SEQ ID NO: 1023171 - DNA, 22 bp, Artificial Sequence
  chemically synthesized
taaatcatgctgctataaagac

SEQ ID NO: 1023172 - DNA, 22 bp, Artificial Sequence
  chemically synthesized
tatagcagcatgatttatagtc

SEQ ID NO: 1023173 - DNA, 22 bp, Artificial Sequence
  chemically synthesized
atagcagcatgatttatagtcc

SEQ ID NO: 1023174 - DNA, 22 bp, Artificial Sequence
  chemically synthesized
tagcagcatgatttatagtcct

SEQ ID NO: 1023175 - DNA, 22 bp, Artificial Sequence
  chemically synthesized
ggtatatacccaaaggactata

SEQ ID NO: 1023176 - DNA, 22 bp, Artificial Sequence
  chemically synthesized
ctgggtatatacccaaaggact

SEQ ID NO: 1023177 - DNA, 22 bp, Artificial Sequence
  chemically synthesized
atagtcctttgggtatataccc

SEQ ID NO: 1023178 - DNA, 22 bp, Artificial Sequence
  chemically synthesized
tagtcctttgggtatataccca

SEQ ID NO: 1023179 - DNA, 22 bp, Artificial Sequence
  chemically synthesized
acccagccatcccattactggg

SEQ ID NO: 1023180 - DNA, 22 bp, Artificial Sequence
  chemically synthesized
gacccagccatcccattactgg

SEQ ID NO: 1023181 - DNA, 22 bp, Artificial Sequence
  chemically synthesized
tgggtatatacccagtaatggg

SEQ ID NO: 1023182 - DNA, 22 bp, Artificial Sequence
  chemically synthesized
gggtatatacccagtaatggga

SEQ ID NO: 1023183 - DNA, 22 bp, Artificial Sequence
  chemically synthesized
ggtatatacccagtaatgggat

SEQ ID NO: 1023184 - DNA, 22 bp, Artificial Sequence
  chemically synthesized
gaaataccatttgacccagcca

SEQ ID NO: 1023185 - DNA, 22 bp, Artificial Sequence
  chemically synthesized
gaactagaaataccatttgacc

SEQ ID NO: 1023186 - DNA, 22 bp, Artificial Sequence
  chemically synthesized
agggatctagaactagaaatac

SEQ ID NO: 1023187 - DNA, 22 bp, Artificial Sequence
  chemically synthesized
ggtcaaatggtatttctagttc

SEQ ID NO: 1023188 - DNA, 22 bp, Artificial Sequence
  chemically synthesized
ctcagggatctagaactagaaa

SEQ ID NO: 1023189 - DNA, 22 bp, Artificial Sequence
  chemically synthesized
ctagttctagatccctgaggaa

SEQ ID NO: 1023190 - DNA, 22 bp, Artificial Sequence
  chemically synthesized
tagttctagatccctgaggaat

SEQ ID NO: 1023191 - DNA, 22 bp, Artificial Sequence
  chemically synthesized
gttctagatccctgaggaatcg

SEQ ID NO: 1023192 - DNA, 22 bp, Artificial Sequence
  chemically synthesized
tggaagtcagtgtggcgattcc

SEQ ID NO: 1023193 - DNA, 22 bp, Artificial Sequence
  chemically synthesized
tagatccctgaggaatcgccac

SEQ ID NO: 1023194 - DNA, 22 bp, Artificial Sequence
  chemically synthesized
gatccctgaggaatcgccacac

SEQ ID NO: 1023195 - DNA, 22 bp, Artificial Sequence
  chemically synthesized
aaccattgtggaagtcagtgtg

SEQ ID NO: 1023196 - DNA, 22 bp, Artificial Sequence
  chemically synthesized
aggaatcgccacactgacttcc

SEQ ID NO: 1023197 - DNA, 22 bp, Artificial Sequence
  chemically synthesized
gttcaaccattgtggaagtcag

SEQ ID NO: 1023198 - DNA, 22 bp, Artificial Sequence
  chemically synthesized
taaactagttcaaccattgtgg

SEQ ID NO: 1023199 - DNA, 22 bp, Artificial Sequence
  chemically synthesized
acttccacaatggttgaactag

SEQ ID NO: 1023200 - DNA, 22 bp, Artificial Sequence
  chemically synthesized
gtgggactgtaaactagttcaa

SEQ ID NO: 1023201 - DNA, 22 bp, Artificial Sequence
  chemically synthesized
ccacaatggttgaactagttta

SEQ ID NO: 1023202 - DNA, 22 bp, Artificial Sequence
  chemically synthesized
ttggtgggactgtaaactagtt

SEQ ID NO: 1023203 - DNA, 22 bp, Artificial Sequence
  chemically synthesized
cacaatggttgaactagtttac

SEQ ID NO: 1023204 - DNA, 22 bp, Artificial Sequence
  chemically synthesized
cactgttggtgggactgtaaac

SEQ ID NO: 1023205 - DNA, 22 bp, Artificial Sequence
  chemically synthesized
acactgttggtgggactgtaaa

SEQ ID NO: 1023206 - DNA, 22 bp, Artificial Sequence
  chemically synthesized
tacactgttggtgggactgtaa

SEQ ID NO: 1023207 - DNA, 22 bp, Artificial Sequence
  chemically synthesized
ttacactgttggtgggactgta

SEQ ID NO: 1023208 - DNA, 22 bp, Artificial Sequence
  chemically synthesized
aactagtttacagtcccaccaa

SEQ ID NO: 1023209 - DNA, 22 bp, Artificial Sequence
  chemically synthesized
gtttacagtcccaccaacagtg

SEQ ID NO: 1023210 - DNA, 22 bp, Artificial Sequence
  chemically synthesized
acagtcccaccaacagtgtaaa

SEQ ID NO: 1023211 - DNA, 22 bp, Artificial Sequence
  chemically synthesized
cagtcccaccaacagtgtaaaa

SEQ ID NO: 1023212 - DNA, 22 bp, Artificial Sequence
  chemically synthesized
gagaggatgtggagaaatagga

SEQ ID NO: 1023213 - DNA, 22 bp, Artificial Sequence
  chemically synthesized
ctatttctccacatcctctcca

SEQ ID NO: 1023214 - DNA, 22 bp, Artificial Sequence
  chemically synthesized
tttctccacatcctctccagca

SEQ ID NO: 1023215 - DNA, 22 bp, Artificial Sequence
  chemically synthesized
ctccacatcctctccagcacct

SEQ ID NO: 1023216 - DNA, 22 bp, Artificial Sequence
  chemically synthesized
tccacatcctctccagcacctg

SEQ ID NO: 1023217 - DNA, 22 bp, Artificial Sequence
  chemically synthesized
cacatcctctccagcacctgtt

SEQ ID NO: 1023218 - DNA, 22 bp, Artificial Sequence
  chemically synthesized
aaaagtcaggaaacaacaggtg

SEQ ID NO: 1023219 - DNA, 22 bp, Artificial Sequence
  chemically synthesized
tccagcacctgttgtttcctga

SEQ ID NO: 1023220 - DNA, 22 bp, Artificial Sequence
  chemically synthesized
cagcacctgttgtttcctgact

SEQ ID NO: 1023221 - DNA, 22 bp, Artificial Sequence
  chemically synthesized
gaatggcaatcattcaaaagtc

SEQ ID NO: 1023222 - DNA, 22 bp, Artificial Sequence
  chemically synthesized
ttgtttcctgacttttgaatga

SEQ ID NO: 1023223 - DNA, 22 bp, Artificial Sequence
  chemically synthesized
tttcctgacttttgaatgattg

SEQ ID NO: 1023224 - DNA, 22 bp, Artificial Sequence
  chemically synthesized
cctgacttttgaatgattgcca

SEQ ID NO: 1023225 - DNA, 22 bp, Artificial Sequence
  chemically synthesized
ctgacttttgaatgattgccat

SEQ ID NO: 1023226 - DNA, 22 bp, Artificial Sequence
  chemically synthesized
acaccagttagaatggcaatca

SEQ ID NO: 1023227 - DNA, 22 bp, Artificial Sequence
  chemically synthesized
acttttgaatgattgccattct

SEQ ID NO: 1023228 - DNA, 22 bp, Artificial Sequence
  chemically synthesized
ttgaatgattgccattctaact

SEQ ID NO: 1023229 - DNA, 22 bp, Artificial Sequence
  chemically synthesized
tgaatgattgccattctaactg

SEQ ID NO: 1023230 - DNA, 22 bp, Artificial Sequence
  chemically synthesized
gaatgattgccattctaactgg

SEQ ID NO: 1023231 - DNA, 22 bp, Artificial Sequence
  chemically synthesized
aatgattgccattctaactggt

SEQ ID NO: 1023232 - DNA, 22 bp, Artificial Sequence
  chemically synthesized
tgagatatcatctcacaccagt

SEQ ID NO: 1023233 - DNA, 22 bp, Artificial Sequence
  chemically synthesized
ccattctaactggtgtgagatg

SEQ ID NO: 1023234 - DNA, 22 bp, Artificial Sequence
  chemically synthesized
taactggtgtgagatgatatct

SEQ ID NO: 1023235 - DNA, 22 bp, Artificial Sequence
  chemically synthesized
actggtgtgagatgatatctca

SEQ ID NO: 1023236 - DNA, 22 bp, Artificial Sequence
  chemically synthesized
gtgtgagatgatatctcatagt

SEQ ID NO: 1023237 - DNA, 22 bp, Artificial Sequence
  chemically synthesized
gccatcagagtaatgcaaatca

SEQ ID NO: 1023238 - DNA, 22 bp, Artificial Sequence
  chemically synthesized
atagtggttttgatttgcatta

SEQ ID NO: 1023239 - DNA, 22 bp, Artificial Sequence
  chemically synthesized
accatcactggccatcagagta

SEQ ID NO: 1023240 - DNA, 22 bp, Artificial Sequence
  chemically synthesized
tgatttgcattactctgatggc

SEQ ID NO: 1023241 - DNA, 22 bp, Artificial Sequence
  chemically synthesized
gatttgcattactctgatggcc

SEQ ID NO: 1023242 - DNA, 22 bp, Artificial Sequence
  chemically synthesized
atttgcattactctgatggcca

SEQ ID NO: 1023243 - DNA, 22 bp, Artificial Sequence
  chemically synthesized
gcattactctgatggccagtga

SEQ ID NO: 1023244 - DNA, 22 bp, Artificial Sequence
  chemically synthesized
cattactctgatggccagtgat

SEQ ID NO: 1023245 - DNA, 22 bp, Artificial Sequence
  chemically synthesized
ctctgatggccagtgatggtga

SEQ ID NO: 1023246 - DNA, 22 bp, Artificial Sequence
  chemically synthesized
tgatggccagtgatggtgagga

SEQ ID NO: 1023247 - DNA, 22 bp, Artificial Sequence
  chemically synthesized
atggccagtgatggtgaggatt

SEQ ID NO: 1023248 - DNA, 22 bp, Artificial Sequence
  chemically synthesized
tgcagccaaaaaacacatgaaa

SEQ ID NO: 1023249 - DNA, 22 bp, Artificial Sequence
  chemically synthesized
atgcagccaaaaaacacatgaa

SEQ ID NO: 1023250 - DNA, 22 bp, Artificial Sequence
  chemically synthesized
tttcatgtgttttttggctgca

SEQ ID NO: 1023251 - DNA, 22 bp, Artificial Sequence
  chemically synthesized
ttcatgtgttttttggctgcat

SEQ ID NO: 1023252 - DNA, 22 bp, Artificial Sequence
  chemically synthesized
tcatgtgttttttggctgcata

SEQ ID NO: 1023253 - DNA, 22 bp, Artificial Sequence
  chemically synthesized
catgtgttttttggctgcataa

SEQ ID NO: 1023254 - DNA, 22 bp, Artificial Sequence
  chemically synthesized
aaaagaagacatttatgcagcc

SEQ ID NO: 1023255 - DNA, 22 bp, Artificial Sequence
  chemically synthesized
atgtgttttttggctgcataaa

SEQ ID NO: 1023256 - DNA, 22 bp, Artificial Sequence
  chemically synthesized
tcaaaagaagacatttatgcag

SEQ ID NO: 1023257 - DNA, 22 bp, Artificial Sequence
  chemically synthesized
ctcaaaagaagacatttatgca

SEQ ID NO: 1023258 - DNA, 22 bp, Artificial Sequence
  chemically synthesized
tttggctgcataaatgtcttct

SEQ ID NO: 1023259 - DNA, 22 bp, Artificial Sequence
  chemically synthesized
ttggctgcataaatgtcttctt

SEQ ID NO: 1023260 - DNA, 22 bp, Artificial Sequence
  chemically synthesized
tggctgcataaatgtcttcttt

SEQ ID NO: 1023261 - DNA, 22 bp, Artificial Sequence
  chemically synthesized
ggctgcataaatgtcttctttt

SEQ ID NO: 1023262 - DNA, 22 bp, Artificial Sequence
  chemically synthesized
gctgcataaatgtcttcttttg

SEQ ID NO: 1023263 - DNA, 22 bp, Artificial Sequence
  chemically synthesized
cataaatgtcttcttttgagaa

SEQ ID NO: 1023264 - DNA, 22 bp, Artificial Sequence
  chemically synthesized
cttttgagaagtgtctgttcat

SEQ ID NO: 1023265 - DNA, 22 bp, Artificial Sequence
  chemically synthesized
ttttgagaagtgtctgttcatg

SEQ ID NO: 1023266 - DNA, 22 bp, Artificial Sequence
  chemically synthesized
ttgagaagtgtctgttcatgtc

SEQ ID NO: 1023267 - DNA, 22 bp, Artificial Sequence
  chemically synthesized
tgagaagtgtctgttcatgtcc

SEQ ID NO: 1023268 - DNA, 22 bp, Artificial Sequence
  chemically synthesized
gagaagtgtctgttcatgtcct

SEQ ID NO: 1023269 - DNA, 22 bp, Artificial Sequence
  chemically synthesized
agaagtgtctgttcatgtcctt

SEQ ID NO: 1023270 - DNA, 22 bp, Artificial Sequence
  chemically synthesized
ttcatgtccttcgctcactttt

SEQ ID NO: 1023271 - DNA, 22 bp, Artificial Sequence
  chemically synthesized
atgtccttcgctcactttttga

SEQ ID NO: 1023272 - DNA, 22 bp, Artificial Sequence
  chemically synthesized
cgctcactttttgatggggttg

SEQ ID NO: 1023273 - DNA, 22 bp, Artificial Sequence
  chemically synthesized
gctcactttttgatggggttgt

SEQ ID NO: 1023274 - DNA, 22 bp, Artificial Sequence
  chemically synthesized
caagaaaaaaacaaacaacccc

SEQ ID NO: 1023275 - DNA, 22 bp, Artificial Sequence
  chemically synthesized
acaagaaaaaaacaaacaaccc

SEQ ID NO: 1023276 - DNA, 22 bp, Artificial Sequence
  chemically synthesized
actttttgatggggttgtttgt

SEQ ID NO: 1023277 - DNA, 22 bp, Artificial Sequence
  chemically synthesized
tttgatggggttgtttgttttt

SEQ ID NO: 1023278 - DNA, 22 bp, Artificial Sequence
  chemically synthesized
ttgatggggttgtttgtttttt

SEQ ID NO: 1023279 - DNA, 22 bp, Artificial Sequence
  chemically synthesized
tgatggggttgtttgttttttt

SEQ ID NO: 1023280 - DNA, 22 bp, Artificial Sequence
  chemically synthesized
gatggggttgtttgtttttttc

SEQ ID NO: 1023281 - DNA, 22 bp, Artificial Sequence
  chemically synthesized
atggggttgtttgtttttttct

SEQ ID NO: 1023282 - DNA, 22 bp, Artificial Sequence
  chemically synthesized
aaacaaatttacaagaaaaaaa

SEQ ID NO: 1023283 - DNA, 22 bp, Artificial Sequence
  chemically synthesized
tttgtttttttcttgtaaattt

SEQ ID NO: 1023284 - DNA, 22 bp, Artificial Sequence
  chemically synthesized
caatgaactcaaacaaatttac

SEQ ID NO: 1023285 - DNA, 22 bp, Artificial Sequence
  chemically synthesized
gtttttttcttgtaaatttgtt

SEQ ID NO: 1023286 - DNA, 22 bp, Artificial Sequence
  chemically synthesized
tttttttcttgtaaatttgttt

SEQ ID NO: 1023287 - DNA, 22 bp, Artificial Sequence
  chemically synthesized
ttttcttgtaaatttgtttgag

SEQ ID NO: 1023288 - DNA, 22 bp, Artificial Sequence
  chemically synthesized
tttcttgtaaatttgtttgagt

SEQ ID NO: 1023289 - DNA, 22 bp, Artificial Sequence
  chemically synthesized
ttcttgtaaatttgtttgagtt

SEQ ID NO: 1023290 - DNA, 22 bp, Artificial Sequence
  chemically synthesized
tcttgtaaatttgtttgagttc

SEQ ID NO: 1023291 - DNA, 22 bp, Artificial Sequence
  chemically synthesized
cttgtaaatttgtttgagttca

SEQ ID NO: 1023292 - DNA, 22 bp, Artificial Sequence
  chemically synthesized
ttgtaaatttgtttgagttcat

SEQ ID NO: 1023293 - DNA, 22 bp, Artificial Sequence
  chemically synthesized
gtaaatttgtttgagttcattg

SEQ ID NO: 1023294 - DNA, 22 bp, Artificial Sequence
  chemically synthesized
taaatttgtttgagttcattgt

SEQ ID NO: 1023295 - DNA, 22 bp, Artificial Sequence
  chemically synthesized
atatccagaatctacaatgaac

SEQ ID NO: 1023296 - DNA, 22 bp, Artificial Sequence
  chemically synthesized
gtttgagttcattgtagattct

SEQ ID NO: 1023297 - DNA, 22 bp, Artificial Sequence
  chemically synthesized
tttgagttcattgtagattctg

SEQ ID NO: 1023298 - DNA, 22 bp, Artificial Sequence
  chemically synthesized
gagttcattgtagattctggat

SEQ ID NO: 1023299 - DNA, 22 bp, Artificial Sequence
  chemically synthesized
agttcattgtagattctggata

SEQ ID NO: 1023300 - DNA, 22 bp, Artificial Sequence
  chemically synthesized
acaaagggctaatatccagaat

SEQ ID NO: 1023301 - DNA, 22 bp, Artificial Sequence
  chemically synthesized
attgtagattctggatattagc

SEQ ID NO: 1023302 - DNA, 22 bp, Artificial Sequence
  chemically synthesized
atctgacaaagggctaatatcc

SEQ ID NO: 1023303 - DNA, 22 bp, Artificial Sequence
  chemically synthesized
ctcatctgacaaagggctaata

SEQ ID NO: 1023304 - DNA, 22 bp, Artificial Sequence
  chemically synthesized
tagattctggatattagccctt

SEQ ID NO: 1023305 - DNA, 22 bp, Artificial Sequence
  chemically synthesized
tggatattagccctttgtcaga

SEQ ID NO: 1023306 - DNA, 22 bp, Artificial Sequence
  chemically synthesized
gcaacctactcatctgacaaag

SEQ ID NO: 1023307 - DNA, 22 bp, Artificial Sequence
  chemically synthesized
cgcaacctactcatctgacaaa

SEQ ID NO: 1023308 - DNA, 22 bp, Artificial Sequence
  chemically synthesized
gatattagccctttgtcagatg

SEQ ID NO: 1023309 - DNA, 22 bp, Artificial Sequence
  chemically synthesized
tcgcaacctactcatctgacaa

SEQ ID NO: 1023310 - DNA, 22 bp, Artificial Sequence
  chemically synthesized
gccctttgtcagatgagtaggt

SEQ ID NO: 1023311 - DNA, 22 bp, Artificial Sequence
  chemically synthesized
tgtcagatgagtaggttgcgaa

SEQ ID NO: 1023312 - DNA, 22 bp, Artificial Sequence
  chemically synthesized
gtcagatgagtaggttgcgaaa

SEQ ID NO: 1023313 - DNA, 22 bp, Artificial Sequence
  chemically synthesized
tcagatgagtaggttgcgaaaa

SEQ ID NO: 1023314 - DNA, 22 bp, Artificial Sequence
  chemically synthesized
caacatgggagaaaattttcgc

SEQ ID NO: 1023315 - DNA, 22 bp, Artificial Sequence
  chemically synthesized
cgaaaattttctcccatgttgt

SEQ ID NO: 1023316 - DNA, 22 bp, Artificial Sequence
  chemically synthesized
tctcccatgttgtaggttccct

SEQ ID NO: 1023317 - DNA, 22 bp, Artificial Sequence
  chemically synthesized
ctcccatgttgtaggttccctg

SEQ ID NO: 1023318 - DNA, 22 bp, Artificial Sequence
  chemically synthesized
tcccatgttgtaggttccctgt

SEQ ID NO: 1023319 - DNA, 22 bp, Artificial Sequence
  chemically synthesized
ccatcagagtgaacagggaacc

SEQ ID NO: 1023320 - DNA, 22 bp, Artificial Sequence
  chemically synthesized
ccatgttgtaggttccctgttc

SEQ ID NO: 1023321 - DNA, 22 bp, Artificial Sequence
  chemically synthesized
taggttccctgttcactctgat

SEQ ID NO: 1023322 - DNA, 22 bp, Artificial Sequence
  chemically synthesized
cctgttcactctgatggtagtt

SEQ ID NO: 1023323 - DNA, 22 bp, Artificial Sequence
  chemically synthesized
cacagcaaaagaaactaccatc

SEQ ID NO: 1023324 - DNA, 22 bp, Artificial Sequence
  chemically synthesized
tgcacagcaaaagaaactacca

SEQ ID NO: 1023325 - DNA, 22 bp, Artificial Sequence
  chemically synthesized
ctgcacagcaaaagaaactacc

SEQ ID NO: 1023326 - DNA, 22 bp, Artificial Sequence
  chemically synthesized
ttcactctgatggtagtttctt

SEQ ID NO: 1023327 - DNA, 22 bp, Artificial Sequence
  chemically synthesized
actctgatggtagtttcttttg

SEQ ID NO: 1023328 - DNA, 22 bp, Artificial Sequence
  chemically synthesized
tgatggtagtttcttttgctgt

SEQ ID NO: 1023329 - DNA, 22 bp, Artificial Sequence
  chemically synthesized
aagagcttctgcacagcaaaag

SEQ ID NO: 1023330 - DNA, 22 bp, Artificial Sequence
  chemically synthesized
atggtagtttcttttgctgtgc

SEQ ID NO: 1023331 - DNA, 22 bp, Artificial Sequence
  chemically synthesized
aactaaagagcttctgcacagc

SEQ ID NO: 1023332 - DNA, 22 bp, Artificial Sequence
  chemically synthesized
attaaactaaagagcttctgca

SEQ ID NO: 1023333 - DNA, 22 bp, Artificial Sequence
  chemically synthesized
cttttgctgtgcagaagctctt

SEQ ID NO: 1023334 - DNA, 22 bp, Artificial Sequence
  chemically synthesized
ttttgctgtgcagaagctcttt

SEQ ID NO: 1023335 - DNA, 22 bp, Artificial Sequence
  chemically synthesized
ttgctgtgcagaagctctttag

SEQ ID NO: 1023336 - DNA, 22 bp, Artificial Sequence
  chemically synthesized
tgctgtgcagaagctctttagt

SEQ ID NO: 1023337 - DNA, 22 bp, Artificial Sequence
  chemically synthesized
gctgtgcagaagctctttagtt

SEQ ID NO: 1023338 - DNA, 22 bp, Artificial Sequence
  chemically synthesized
ctgtgcagaagctctttagttt

SEQ ID NO: 1023339 - DNA, 22 bp, Artificial Sequence
  chemically synthesized
tgcagaagctctttagtttaat

SEQ ID NO: 1023340 - DNA, 22 bp, Artificial Sequence
  chemically synthesized
acaaatgggatctaattaaact

SEQ ID NO: 1023341 - DNA, 22 bp, Artificial Sequence
  chemically synthesized
tttagtttaattagatcccatt

SEQ ID NO: 1023342 - DNA, 22 bp, Artificial Sequence
  chemically synthesized
tagtttaattagatcccatttg

SEQ ID NO: 1023343 - DNA, 22 bp, Artificial Sequence
  chemically synthesized
agtttaattagatcccatttgt

SEQ ID NO: 1023344 - DNA, 22 bp, Artificial Sequence
  chemically synthesized
gtttaattagatcccatttgtc

SEQ ID NO: 1023345 - DNA, 22 bp, Artificial Sequence
  chemically synthesized
aattagatcccatttgtcaatt

SEQ ID NO: 1023346 - DNA, 22 bp, Artificial Sequence
  chemically synthesized
attagatcccatttgtcaattt

SEQ ID NO: 1023347 - DNA, 22 bp, Artificial Sequence
  chemically synthesized
gatcccatttgtcaattttggc

SEQ ID NO: 1023348 - DNA, 22 bp, Artificial Sequence
  chemically synthesized
gtcaattttggcttttgttgcc

SEQ ID NO: 1023349 - DNA, 22 bp, Artificial Sequence
  chemically synthesized
tcaattttggcttttgttgcca

SEQ ID NO: 1023350 - DNA, 22 bp, Artificial Sequence
  chemically synthesized
tggcttttgttgccattgcttt

SEQ ID NO: 1023351 - DNA, 22 bp, Artificial Sequence
  chemically synthesized
ggcttttgttgccattgctttt

SEQ ID NO: 1023352 - DNA, 22 bp, Artificial Sequence
  chemically synthesized
gcttttgttgccattgcttttg

SEQ ID NO: 1023353 - DNA, 22 bp, Artificial Sequence
  chemically synthesized
atgtccaaaacaccaaaagcaa

SEQ ID NO: 1023354 - DNA, 22 bp, Artificial Sequence
  chemically synthesized
catgtccaaaacaccaaaagca

SEQ ID NO: 1023355 - DNA, 22 bp, Artificial Sequence
  chemically synthesized
ttgttgccattgcttttggtgt

SEQ ID NO: 1023356 - DNA, 22 bp, Artificial Sequence
  chemically synthesized
tgttgccattgcttttggtgtt

SEQ ID NO: 1023357 - DNA, 22 bp, Artificial Sequence
  chemically synthesized
gttgccattgcttttggtgttt

SEQ ID NO: 1023358 - DNA, 22 bp, Artificial Sequence
  chemically synthesized
ttgccattgcttttggtgtttt

SEQ ID NO: 1023359 - DNA, 22 bp, Artificial Sequence
  chemically synthesized
ccattgcttttggtgttttgga

SEQ ID NO: 1023360 - DNA, 22 bp, Artificial Sequence
  chemically synthesized
cttttggtgttttggacatgaa

SEQ ID NO: 1023361 - DNA, 22 bp, Artificial Sequence
  chemically synthesized
ttggtgttttggacatgaagtc

SEQ ID NO: 1023362 - DNA, 22 bp, Artificial Sequence
  chemically synthesized
tggtgttttggacatgaagtcc

SEQ ID NO: 1023363 - DNA, 22 bp, Artificial Sequence
  chemically synthesized
ggtgttttggacatgaagtcct

SEQ ID NO: 1023364 - DNA, 22 bp, Artificial Sequence
  chemically synthesized
gtgttttggacatgaagtcctt

SEQ ID NO: 1023365 - DNA, 22 bp, Artificial Sequence
  chemically synthesized
aggacataggcatgggcaagga

SEQ ID NO: 1023366 - DNA, 22 bp, Artificial Sequence
  chemically synthesized
tggacatgaagtccttgcccat

SEQ ID NO: 1023367 - DNA, 22 bp, Artificial Sequence
  chemically synthesized
ggacatgaagtccttgcccatg

SEQ ID NO: 1023368 - DNA, 22 bp, Artificial Sequence
  chemically synthesized
gacatgaagtccttgcccatgc

SEQ ID NO: 1023369 - DNA, 22 bp, Artificial Sequence
  chemically synthesized
ccattcaggacataggcatggg

SEQ ID NO: 1023370 - DNA, 22 bp, Artificial Sequence
  chemically synthesized
ggcattaccattcaggacatag

SEQ ID NO: 1023371 - DNA, 22 bp, Artificial Sequence
  chemically synthesized
gcccatgcctatgtcctgaatg

SEQ ID NO: 1023372 - DNA, 22 bp, Artificial Sequence
  chemically synthesized
cccatgcctatgtcctgaatgg

SEQ ID NO: 1023373 - DNA, 22 bp, Artificial Sequence
  chemically synthesized
gaagaaaacctaggcattacca

SEQ ID NO: 1023374 - DNA, 22 bp, Artificial Sequence
  chemically synthesized
tgtcctgaatggtaatgcctag

SEQ ID NO: 1023375 - DNA, 22 bp, Artificial Sequence
  chemically synthesized
aatggtaatgcctaggttttct

SEQ ID NO: 1023376 - DNA, 22 bp, Artificial Sequence
  chemically synthesized
aaaccataaaaaccctagaaga

SEQ ID NO: 1023377 - DNA, 22 bp, Artificial Sequence
  chemically synthesized
gacctaaaaccataaaaaccct

SEQ ID NO: 1023378 - DNA, 22 bp, Artificial Sequence
  chemically synthesized
ggttttcttctagggtttttat

SEQ ID NO: 1023379 - DNA, 22 bp, Artificial Sequence
  chemically synthesized
tcttctagggtttttatggttt

SEQ ID NO: 1023380 - DNA, 22 bp, Artificial Sequence
  chemically synthesized
cttctagggtttttatggtttt

SEQ ID NO: 1023381 - DNA, 22 bp, Artificial Sequence
  chemically synthesized
aacattagacctaaaaccataa

SEQ ID NO: 1023382 - DNA, 22 bp, Artificial Sequence
  chemically synthesized
ttctagggtttttatggtttta

SEQ ID NO: 1023383 - DNA, 22 bp, Artificial Sequence
  chemically synthesized
aaacattagacctaaaaccata

SEQ ID NO: 1023384 - DNA, 22 bp, Artificial Sequence
  chemically synthesized
ctagggtttttatggttttagg

SEQ ID NO: 1023385 - DNA, 22 bp, Artificial Sequence
  chemically synthesized
tagggtttttatggttttaggt

SEQ ID NO: 1023386 - DNA, 22 bp, Artificial Sequence
  chemically synthesized
gggtttttatggttttaggtct

SEQ ID NO: 1023387 - DNA, 22 bp, Artificial Sequence
  chemically synthesized
aagatttaaacattagacctaa

SEQ ID NO: 1023388 - DNA, 22 bp, Artificial Sequence
  chemically synthesized
ttatggttttaggtctaatgtt

SEQ ID NO: 1023389 - DNA, 22 bp, Artificial Sequence
  chemically synthesized
tatggttttaggtctaatgttt

SEQ ID NO: 1023390 - DNA, 22 bp, Artificial Sequence
  chemically synthesized
atggttttaggtctaatgttta

SEQ ID NO: 1023391 - DNA, 22 bp, Artificial Sequence
  chemically synthesized
tggttttaggtctaatgtttaa

SEQ ID NO: 1023392 - DNA, 22 bp, Artificial Sequence
  chemically synthesized
aagatggattaaagatttaaac

SEQ ID NO: 1023393 - DNA, 22 bp, Artificial Sequence
  chemically synthesized
taggtctaatgtttaaatcttt

SEQ ID NO: 1023394 - DNA, 22 bp, Artificial Sequence
  chemically synthesized
aggtctaatgtttaaatcttta

SEQ ID NO: 1023395 - DNA, 22 bp, Artificial Sequence
  chemically synthesized
ggtctaatgtttaaatctttaa

SEQ ID NO: 1023396 - DNA, 22 bp, Artificial Sequence
  chemically synthesized
atgtttaaatctttaatccatc

SEQ ID NO: 1023397 - DNA, 22 bp, Artificial Sequence
  chemically synthesized
tacaaaaatcaattcaagatgg

SEQ ID NO: 1023398 - DNA, 22 bp, Artificial Sequence
  chemically synthesized
aaatctttaatccatcttgaat

SEQ ID NO: 1023399 - DNA, 22 bp, Artificial Sequence
  chemically synthesized
atacaaaaatcaattcaagatg

SEQ ID NO: 1023400 - DNA, 22 bp, Artificial Sequence
  chemically synthesized
aatctttaatccatcttgaatt

SEQ ID NO: 1023401 - DNA, 22 bp, Artificial Sequence
  chemically synthesized
caccttatacaaaaatcaattc

SEQ ID NO: 1023402 - DNA, 22 bp, Artificial Sequence
  chemically synthesized
taatccatcttgaattgatttt

SEQ ID NO: 1023403 - DNA, 22 bp, Artificial Sequence
  chemically synthesized
acaccttatacaaaaatcaatt

SEQ ID NO: 1023404 - DNA, 22 bp, Artificial Sequence
  chemically synthesized
aatccatcttgaattgattttt

SEQ ID NO: 1023405 - DNA, 22 bp, Artificial Sequence
  chemically synthesized
atccatcttgaattgatttttg

SEQ ID NO: 1023406 - DNA, 22 bp, Artificial Sequence
  chemically synthesized
cttacaccttatacaaaaatca

SEQ ID NO: 1023407 - DNA, 22 bp, Artificial Sequence
  chemically synthesized
ccttacaccttatacaaaaatc

SEQ ID NO: 1023408 - DNA, 22 bp, Artificial Sequence
  chemically synthesized
gaattgatttttgtataaggtg

SEQ ID NO: 1023409 - DNA, 22 bp, Artificial Sequence
  chemically synthesized
aattgatttttgtataaggtgt

SEQ ID NO: 1023410 - DNA, 22 bp, Artificial Sequence
  chemically synthesized
gatcccttccttacaccttata

SEQ ID NO: 1023411 - DNA, 22 bp, Artificial Sequence
  chemically synthesized
atttttgtataaggtgtaagga

SEQ ID NO: 1023412 - DNA, 22 bp, Artificial Sequence
  chemically synthesized
aaactggatcccttccttacac

SEQ ID NO: 1023413 - DNA, 22 bp, Artificial Sequence
  chemically synthesized
ttgtataaggtgtaaggaaggg

SEQ ID NO: 1023414 - DNA, 22 bp, Artificial Sequence
  chemically synthesized
tgtataaggtgtaaggaaggga

SEQ ID NO: 1023415 - DNA, 22 bp, Artificial Sequence
  chemically synthesized
gtataaggtgtaaggaagggat

SEQ ID NO: 1023416 - DNA, 22 bp, Artificial Sequence
  chemically synthesized
tataaggtgtaaggaagggatc

SEQ ID NO: 1023417 - DNA, 22 bp, Artificial Sequence
  chemically synthesized
gccatatgtagaaagctgaaac

SEQ ID NO: 1023418 - DNA, 22 bp, Artificial Sequence
  chemically synthesized
gctagccatatgtagaaagctg

SEQ ID NO: 1023419 - DNA, 22 bp, Artificial Sequence
  chemically synthesized
ggaagactggctagccatatgt

SEQ ID NO: 1023420 - DNA, 22 bp, Artificial Sequence
  chemically synthesized
cagctttctacatatggctagc

SEQ ID NO: 1023421 - DNA, 22 bp, Artificial Sequence
  chemically synthesized
agctttctacatatggctagcc

SEQ ID NO: 1023422 - DNA, 22 bp, Artificial Sequence
  chemically synthesized
tctacatatggctagccagtct

SEQ ID NO: 1023423 - DNA, 22 bp, Artificial Sequence
  chemically synthesized
ctacatatggctagccagtctt

SEQ ID NO: 1023424 - DNA, 22 bp, Artificial Sequence
  chemically synthesized
tacatatggctagccagtcttc

SEQ ID NO: 1023425 - DNA, 22 bp, Artificial Sequence
  chemically synthesized
catatggctagccagtcttccc

SEQ ID NO: 1023426 - DNA, 22 bp, Artificial Sequence
  chemically synthesized
ataaatggtgctgggaagactg

SEQ ID NO: 1023427 - DNA, 22 bp, Artificial Sequence
  chemically synthesized
aataaatggtgctgggaagact

SEQ ID NO: 1023428 - DNA, 22 bp, Artificial Sequence
  chemically synthesized
tttaataaatggtgctgggaag

SEQ ID NO: 1023429 - DNA, 22 bp, Artificial Sequence
  chemically synthesized
cctatttaataaatggtgctgg

SEQ ID NO: 1023430 - DNA, 22 bp, Artificial Sequence
  chemically synthesized
gccagtcttcccagcaccattt

SEQ ID NO: 1023431 - DNA, 22 bp, Artificial Sequence
  chemically synthesized
cccagcaccatttattaaatag

SEQ ID NO: 1023432 - DNA, 22 bp, Artificial Sequence
  chemically synthesized
ccagcaccatttattaaatagg

SEQ ID NO: 1023433 - DNA, 22 bp, Artificial Sequence
  chemically synthesized
attaaatagggaatcctttccc

SEQ ID NO: 1023434 - DNA, 22 bp, Artificial Sequence
  chemically synthesized
ttaaatagggaatcctttcccc

SEQ ID NO: 1023435 - DNA, 22 bp, Artificial Sequence
  chemically synthesized
aatagggaatcctttccccatt

SEQ ID NO: 1023436 - DNA, 22 bp, Artificial Sequence
  chemically synthesized
aggaaaacaagcaatggggaaa

SEQ ID NO: 1023437 - DNA, 22 bp, Artificial Sequence
  chemically synthesized
acaaacctgaggaaaacaagca

SEQ ID NO: 1023438 - DNA, 22 bp, Artificial Sequence
  chemically synthesized
gacaaacctgaggaaaacaagc

SEQ ID NO: 1023439 - DNA, 22 bp, Artificial Sequence
  chemically synthesized
tgacaaacctgaggaaaacaag

SEQ ID NO: 1023440 - DNA, 22 bp, Artificial Sequence
  chemically synthesized
tccccattgcttgttttcctca

SEQ ID NO: 1023441 - DNA, 22 bp, Artificial Sequence
  chemically synthesized
ccccattgcttgttttcctcag

SEQ ID NO: 1023442 - DNA, 22 bp, Artificial Sequence
  chemically synthesized
cccattgcttgttttcctcagg

SEQ ID NO: 1023443 - DNA, 22 bp, Artificial Sequence
  chemically synthesized
atctttgacaaacctgaggaaa

SEQ ID NO: 1023444 - DNA, 22 bp, Artificial Sequence
  chemically synthesized
tctgatctttgacaaacctgag

SEQ ID NO: 1023445 - DNA, 22 bp, Artificial Sequence
  chemically synthesized
cttgttttcctcaggtttgtca

SEQ ID NO: 1023446 - DNA, 22 bp, Artificial Sequence
  chemically synthesized
gttttcctcaggtttgtcaaag

SEQ ID NO: 1023447 - DNA, 22 bp, Artificial Sequence
  chemically synthesized
caactatctgatctttgacaaa

SEQ ID NO: 1023448 - DNA, 22 bp, Artificial Sequence
  chemically synthesized
ttttcctcaggtttgtcaaaga

SEQ ID NO: 1023449 - DNA, 22 bp, Artificial Sequence
  chemically synthesized
tcctcaggtttgtcaaagatca

SEQ ID NO: 1023450 - DNA, 22 bp, Artificial Sequence
  chemically synthesized
cctcaggtttgtcaaagatcag

SEQ ID NO: 1023451 - DNA, 22 bp, Artificial Sequence
  chemically synthesized
ctcaggtttgtcaaagatcaga

SEQ ID NO: 1023452 - DNA, 22 bp, Artificial Sequence
  chemically synthesized
aggtttgtcaaagatcagatag

SEQ ID NO: 1023453 - DNA, 22 bp, Artificial Sequence
  chemically synthesized
gtcaaagatcagatagttgtag

SEQ ID NO: 1023454 - DNA, 22 bp, Artificial Sequence
  chemically synthesized
tcaaagatcagatagttgtagg

SEQ ID NO: 1023455 - DNA, 22 bp, Artificial Sequence
  chemically synthesized
agaaataacgccacatacctac

SEQ ID NO: 1023456 - DNA, 22 bp, Artificial Sequence
  chemically synthesized
taggtatgtggcgttatttctg

SEQ ID NO: 1023457 - DNA, 22 bp, Artificial Sequence
  chemically synthesized
tttctgagggctctgttctgtt

SEQ ID NO: 1023458 - DNA, 22 bp, Artificial Sequence
  chemically synthesized
ctgagggctctgttctgttcca

SEQ ID NO: 1023459 - DNA, 22 bp, Artificial Sequence
  chemically synthesized
tgagggctctgttctgttccat

SEQ ID NO: 1023460 - DNA, 22 bp, Artificial Sequence
  chemically synthesized
agggctctgttctgttccattg

SEQ ID NO: 1023461 - DNA, 22 bp, Artificial Sequence
  chemically synthesized
tgttctgttccattgatctata

SEQ ID NO: 1023462 - DNA, 22 bp, Artificial Sequence
  chemically synthesized
ttctgttccattgatctatatc

SEQ ID NO: 1023463 - DNA, 22 bp, Artificial Sequence
  chemically synthesized
gtaccaaaacagagatatagat

SEQ ID NO: 1023464 - DNA, 22 bp, Artificial Sequence
  chemically synthesized
tgttccattgatctatatctct

SEQ ID NO: 1023465 - DNA, 22 bp, Artificial Sequence
  chemically synthesized
ttccattgatctatatctctgt

SEQ ID NO: 1023466 - DNA, 22 bp, Artificial Sequence
  chemically synthesized
cattgatctatatctctgtttt

SEQ ID NO: 1023467 - DNA, 22 bp, Artificial Sequence
  chemically synthesized
atctatatctctgttttggtac

SEQ ID NO: 1023468 - DNA, 22 bp, Artificial Sequence
  chemically synthesized
tatctctgttttggtaccagta

SEQ ID NO: 1023469 - DNA, 22 bp, Artificial Sequence
  chemically synthesized
tgttttggtaccagtaccatgc

SEQ ID NO: 1023470 - DNA, 22 bp, Artificial Sequence
  chemically synthesized
ttttggtaccagtaccatgctg

SEQ ID NO: 1023471 - DNA, 22 bp, Artificial Sequence
  chemically synthesized
cagtaaccaaaacagcatggta

SEQ ID NO: 1023472 - DNA, 22 bp, Artificial Sequence
  chemically synthesized
tggtaccagtaccatgctgttt

SEQ ID NO: 1023473 - DNA, 22 bp, Artificial Sequence
  chemically synthesized
ggtaccagtaccatgctgtttt

SEQ ID NO: 1023474 - DNA, 22 bp, Artificial Sequence
  chemically synthesized
gtaccagtaccatgctgttttg

SEQ ID NO: 1023475 - DNA, 22 bp, Artificial Sequence
  chemically synthesized
caaggctacagtaaccaaaaca

SEQ ID NO: 1023476 - DNA, 22 bp, Artificial Sequence
  chemically synthesized
tactacaaggctacagtaacca

SEQ ID NO: 1023477 - DNA, 22 bp, Artificial Sequence
  chemically synthesized
aaactatactacaaggctacag

SEQ ID NO: 1023478 - DNA, 22 bp, Artificial Sequence
  chemically synthesized
caaactatactacaaggctaca

SEQ ID NO: 1023479 - DNA, 22 bp, Artificial Sequence
  chemically synthesized
ttttggttactgtagccttgta

SEQ ID NO: 1023480 - DNA, 22 bp, Artificial Sequence
  chemically synthesized
acttcaaactatactacaaggc

SEQ ID NO: 1023481 - DNA, 22 bp, Artificial Sequence
  chemically synthesized
tggttactgtagccttgtagta

SEQ ID NO: 1023482 - DNA, 22 bp, Artificial Sequence
  chemically synthesized
ggttactgtagccttgtagtat

SEQ ID NO: 1023483 - DNA, 22 bp, Artificial Sequence
  chemically synthesized
gttactgtagccttgtagtata

SEQ ID NO: 1023484 - DNA, 22 bp, Artificial Sequence
  chemically synthesized
gctgacttcaaactatactaca

SEQ ID NO: 1023485 - DNA, 22 bp, Artificial Sequence
  chemically synthesized
ctgtagccttgtagtatagttt

SEQ ID NO: 1023486 - DNA, 22 bp, Artificial Sequence
  chemically synthesized
tagccttgtagtatagtttgaa

SEQ ID NO: 1023487 - DNA, 22 bp, Artificial Sequence
  chemically synthesized
gtagtatagtttgaagtcagct

SEQ ID NO: 1023488 - DNA, 22 bp, Artificial Sequence
  chemically synthesized
tagtatagtttgaagtcagcta

SEQ ID NO: 1023489 - DNA, 22 bp, Artificial Sequence
  chemically synthesized
gaggcatcacactagctgactt

SEQ ID NO: 1023490 - DNA, 22 bp, Artificial Sequence
  chemically synthesized
gaagtcagctagtgtgatgcct

SEQ ID NO: 1023491 - DNA, 22 bp, Artificial Sequence
  chemically synthesized
aagtcagctagtgtgatgcctc

SEQ ID NO: 1023492 - DNA, 22 bp, Artificial Sequence
  chemically synthesized
agccaaaagaacaaagctggag

SEQ ID NO: 1023493 - DNA, 22 bp, Artificial Sequence
  chemically synthesized
gtgtgatgcctccagctttgtt

SEQ ID NO: 1023494 - DNA, 22 bp, Artificial Sequence
  chemically synthesized
cagctttgttcttttggcttag

SEQ ID NO: 1023495 - DNA, 22 bp, Artificial Sequence
  chemically synthesized
tgttcttttggcttaggattga

SEQ ID NO: 1023496 - DNA, 22 bp, Artificial Sequence
  chemically synthesized
gttcttttggcttaggattgac

SEQ ID NO: 1023497 - DNA, 22 bp, Artificial Sequence
  chemically synthesized
ttcttttggcttaggattgact

SEQ ID NO: 1023498 - DNA, 22 bp, Artificial Sequence
  chemically synthesized
ttttggcttaggattgacttgg

SEQ ID NO: 1023499 - DNA, 22 bp, Artificial Sequence
  chemically synthesized
ttggcttaggattgacttggcg

SEQ ID NO: 1023500 - DNA, 22 bp, Artificial Sequence
  chemically synthesized
tggcttaggattgacttggcga

SEQ ID NO: 1023501 - DNA, 22 bp, Artificial Sequence
  chemically synthesized
ggcttaggattgacttggcgat

SEQ ID NO: 1023502 - DNA, 22 bp, Artificial Sequence
  chemically synthesized
gcttaggattgacttggcgatg

SEQ ID NO: 1023503 - DNA, 22 bp, Artificial Sequence
  chemically synthesized
aggattgacttggcgatgcggg

SEQ ID NO: 1023504 - DNA, 22 bp, Artificial Sequence
  chemically synthesized
ggattgacttggcgatgcgggc

SEQ ID NO: 1023505 - DNA, 22 bp, Artificial Sequence
  chemically synthesized
acttggcgatgcgggctctttt

SEQ ID NO: 1023506 - DNA, 22 bp, Artificial Sequence
  chemically synthesized
atatggaaccaaaaaagagccc

SEQ ID NO: 1023507 - DNA, 22 bp, Artificial Sequence
  chemically synthesized
ggcgatgcgggctcttttttgg

SEQ ID NO: 1023508 - DNA, 22 bp, Artificial Sequence
  chemically synthesized
gcgatgcgggctcttttttggt

SEQ ID NO: 1023509 - DNA, 22 bp, Artificial Sequence
  chemically synthesized
aagttcatatggaaccaaaaaa

SEQ ID NO: 1023510 - DNA, 22 bp, Artificial Sequence
  chemically synthesized
aaagttcatatggaaccaaaaa

SEQ ID NO: 1023511 - DNA, 22 bp, Artificial Sequence
  chemically synthesized
taaagttcatatggaaccaaaa

SEQ ID NO: 1023512 - DNA, 22 bp, Artificial Sequence
  chemically synthesized
ctttaaagttcatatggaacca

SEQ ID NO: 1023513 - DNA, 22 bp, Artificial Sequence
  chemically synthesized
ttttttggttccatatgaactt

SEQ ID NO: 1023514 - DNA, 22 bp, Artificial Sequence
  chemically synthesized
ttttggttccatatgaacttta

SEQ ID NO: 1023515 - DNA, 22 bp, Artificial Sequence
  chemically synthesized
tttggttccatatgaactttaa

SEQ ID NO: 1023516 - DNA, 22 bp, Artificial Sequence
  chemically synthesized
gaaaaaactactttaaagttca

SEQ ID NO: 1023517 - DNA, 22 bp, Artificial Sequence
  chemically synthesized
ttggttccatatgaactttaaa

SEQ ID NO: 1023518 - DNA, 22 bp, Artificial Sequence
  chemically synthesized
tggttccatatgaactttaaag

SEQ ID NO: 1023519 - DNA, 22 bp, Artificial Sequence
  chemically synthesized
ggttccatatgaactttaaagt

SEQ ID NO: 1023520 - DNA, 22 bp, Artificial Sequence
  chemically synthesized
gttccatatgaactttaaagta

SEQ ID NO: 1023521 - DNA, 22 bp, Artificial Sequence
  chemically synthesized
catatgaactttaaagtagttt

SEQ ID NO: 1023522 - DNA, 22 bp, Artificial Sequence
  chemically synthesized
acagaattggaaaaaactactt

SEQ ID NO: 1023523 - DNA, 22 bp, Artificial Sequence
  chemically synthesized
cacagaattggaaaaaactact

SEQ ID NO: 1023524 - DNA, 22 bp, Artificial Sequence
  chemically synthesized
ttcacagaattggaaaaaacta

SEQ ID NO: 1023525 - DNA, 22 bp, Artificial Sequence
  chemically synthesized
cttcacagaattggaaaaaact

SEQ ID NO: 1023526 - DNA, 22 bp, Artificial Sequence
  chemically synthesized
tcttcacagaattggaaaaaac

SEQ ID NO: 1023527 - DNA, 22 bp, Artificial Sequence
  chemically synthesized
taaagtagttttttccaattct

SEQ ID NO: 1023528 - DNA, 22 bp, Artificial Sequence
  chemically synthesized
aaagtagttttttccaattctg

SEQ ID NO: 1023529 - DNA, 22 bp, Artificial Sequence
  chemically synthesized
aagtagttttttccaattctgt

SEQ ID NO: 1023530 - DNA, 22 bp, Artificial Sequence
  chemically synthesized
ccaatgcctttcttcacagaat

SEQ ID NO: 1023531 - DNA, 22 bp, Artificial Sequence
  chemically synthesized
tttccaattctgtgaagaaagg

SEQ ID NO: 1023532 - DNA, 22 bp, Artificial Sequence
  chemically synthesized
ttccaattctgtgaagaaaggc

SEQ ID NO: 1023533 - DNA, 22 bp, Artificial Sequence
  chemically synthesized
tccaattctgtgaagaaaggca

SEQ ID NO: 1023534 - DNA, 22 bp, Artificial Sequence
  chemically synthesized
ccaattctgtgaagaaaggcat

SEQ ID NO: 1023535 - DNA, 22 bp, Artificial Sequence
  chemically synthesized
caattctgtgaagaaaggcatt

SEQ ID NO: 1023536 - DNA, 22 bp, Artificial Sequence
  chemically synthesized
tgtgaagaaaggcattggtagc

SEQ ID NO: 1023537 - DNA, 22 bp, Artificial Sequence
  chemically synthesized
tgaagaaaggcattggtagctt

SEQ ID NO: 1023538 - DNA, 22 bp, Artificial Sequence
  chemically synthesized
aatgccatccccatcaagctac

SEQ ID NO: 1023539 - DNA, 22 bp, Artificial Sequence
  chemically synthesized
cagattcaatgccatccccatc

SEQ ID NO: 1023540 - DNA, 22 bp, Artificial Sequence
  chemically synthesized
acagattcaatgccatccccat

SEQ ID NO: 1023541 - DNA, 22 bp, Artificial Sequence
  chemically synthesized
gtagcttgatggggatggcatt

SEQ ID NO: 1023542 - DNA, 22 bp, Artificial Sequence
  chemically synthesized
gatggggatggcattgaatctg

SEQ ID NO: 1023543 - DNA, 22 bp, Artificial Sequence
  chemically synthesized
atggggatggcattgaatctgt

SEQ ID NO: 1023544 - DNA, 22 bp, Artificial Sequence
  chemically synthesized
cccaaggtgatttacagattca

SEQ ID NO: 1023545 - DNA, 22 bp, Artificial Sequence
  chemically synthesized
aatctgtaaatcaccttgggca

SEQ ID NO: 1023546 - DNA, 22 bp, Artificial Sequence
  chemically synthesized
taaatcaccttgggcagtatgg

SEQ ID NO: 1023547 - DNA, 22 bp, Artificial Sequence
  chemically synthesized
gggcagtatggccattttcacg

SEQ ID NO: 1023548 - DNA, 22 bp, Artificial Sequence
  chemically synthesized
ggcagtatggccattttcacga

SEQ ID NO: 1023549 - DNA, 22 bp, Artificial Sequence
  chemically synthesized
atgggtaggaagaatcaatatc

SEQ ID NO: 1023550 - DNA, 22 bp, Artificial Sequence
  chemically synthesized
catgctcatgggtaggaagaat

SEQ ID NO: 1023551 - DNA, 22 bp, Artificial Sequence
  chemically synthesized
tcacgatattgattcttcctac

SEQ ID NO: 1023552 - DNA, 22 bp, Artificial Sequence
  chemically synthesized
cacgatattgattcttcctacc

SEQ ID NO: 1023553 - DNA, 22 bp, Artificial Sequence
  chemically synthesized
acgatattgattcttcctaccc

SEQ ID NO: 1023554 - DNA, 22 bp, Artificial Sequence
  chemically synthesized
attcttcctacccatgagcatg

SEQ ID NO: 1023555 - DNA, 22 bp, Artificial Sequence
  chemically synthesized
ttcctacccatgagcatggaat

SEQ ID NO: 1023556 - DNA, 22 bp, Artificial Sequence
  chemically synthesized
cctacccatgagcatggaatgt

SEQ ID NO: 1023557 - DNA, 22 bp, Artificial Sequence
  chemically synthesized
ctacccatgagcatggaatgtt

SEQ ID NO: 1023558 - DNA, 22 bp, Artificial Sequence
  chemically synthesized
cccatgagcatggaatgttctt

SEQ ID NO: 1023559 - DNA, 22 bp, Artificial Sequence
  chemically synthesized
aaggaaataaaagaggatacaa

SEQ ID NO: 1023560 - DNA, 22 bp, Artificial Sequence
  chemically synthesized
ttccatttgtttgtatcctctt

SEQ ID NO: 1023561 - DNA, 22 bp, Artificial Sequence
  chemically synthesized
ctcaaggaaataaaagaggata

SEQ ID NO: 1023562 - DNA, 22 bp, Artificial Sequence
  chemically synthesized
ccatttgtttgtatcctctttt

SEQ ID NO: 1023563 - DNA, 22 bp, Artificial Sequence
  chemically synthesized
catttgtttgtatcctctttta

SEQ ID NO: 1023564 - DNA, 22 bp, Artificial Sequence
  chemically synthesized
gtttgtatcctcttttatttcc

SEQ ID NO: 1023565 - DNA, 22 bp, Artificial Sequence
  chemically synthesized
tttgtatcctcttttatttcct

SEQ ID NO: 1023566 - DNA, 22 bp, Artificial Sequence
  chemically synthesized
caaaccactgctcaaggaaata

SEQ ID NO: 1023567 - DNA, 22 bp, Artificial Sequence
  chemically synthesized
gtatcctcttttatttccttga

SEQ ID NO: 1023568 - DNA, 22 bp, Artificial Sequence
  chemically synthesized
tatcctcttttatttccttgag

SEQ ID NO: 1023569 - DNA, 22 bp, Artificial Sequence
  chemically synthesized
ttttatttccttgagcagtggt

SEQ ID NO: 1023570 - DNA, 22 bp, Artificial Sequence
  chemically synthesized
ttatttccttgagcagtggttt

SEQ ID NO: 1023571 - DNA, 22 bp, Artificial Sequence
  chemically synthesized
aaggagaactacaaaccactgc

SEQ ID NO: 1023572 - DNA, 22 bp, Artificial Sequence
  chemically synthesized
tatttccttgagcagtggtttg

SEQ ID NO: 1023573 - DNA, 22 bp, Artificial Sequence
  chemically synthesized
caaggagaactacaaaccactg

SEQ ID NO: 1023574 - DNA, 22 bp, Artificial Sequence
  chemically synthesized
atttccttgagcagtggtttgt

SEQ ID NO: 1023575 - DNA, 22 bp, Artificial Sequence
  chemically synthesized
tttccttgagcagtggtttgta

SEQ ID NO: 1023576 - DNA, 22 bp, Artificial Sequence
  chemically synthesized
ttcaaggagaactacaaaccac

SEQ ID NO: 1023577 - DNA, 22 bp, Artificial Sequence
  chemically synthesized
ccttgagcagtggtttgtagtt

SEQ ID NO: 1023578 - DNA, 22 bp, Artificial Sequence
  chemically synthesized
cttgagcagtggtttgtagttc

SEQ ID NO: 1023579 - DNA, 22 bp, Artificial Sequence
  chemically synthesized
gagcagtggtttgtagttctcc

SEQ ID NO: 1023580 - DNA, 22 bp, Artificial Sequence
  chemically synthesized
agcagtggtttgtagttctcct

SEQ ID NO: 1023581 - DNA, 22 bp, Artificial Sequence
  chemically synthesized
gtagttctccttgaagaggtcc

SEQ ID NO: 1023582 - DNA, 22 bp, Artificial Sequence
  chemically synthesized
tagttctccttgaagaggtcct

SEQ ID NO: 1023583 - DNA, 22 bp, Artificial Sequence
  chemically synthesized
caagggatgtgaaggacctctt

SEQ ID NO: 1023584 - DNA, 22 bp, Artificial Sequence
  chemically synthesized
acaagggatgtgaaggacctct

SEQ ID NO: 1023585 - DNA, 22 bp, Artificial Sequence
  chemically synthesized
tccttgaagaggtccttcacat

SEQ ID NO: 1023586 - DNA, 22 bp, Artificial Sequence
  chemically synthesized
cttgaagaggtccttcacatcc

SEQ ID NO: 1023587 - DNA, 22 bp, Artificial Sequence
  chemically synthesized
gaagaggtccttcacatccctt

SEQ ID NO: 1023588 - DNA, 22 bp, Artificial Sequence
  chemically synthesized
aagaggtccttcacatcccttg

SEQ ID NO: 1023589 - DNA, 22 bp, Artificial Sequence
  chemically synthesized
ggaatccaacttacaagggatg

SEQ ID NO: 1023590 - DNA, 22 bp, Artificial Sequence
  chemically synthesized
cacatcccttgtaagttggatt

SEQ ID NO: 1023591 - DNA, 22 bp, Artificial Sequence
  chemically synthesized
acatcccttgtaagttggattc

SEQ ID NO: 1023592 - DNA, 22 bp, Artificial Sequence
  chemically synthesized
aaagagaataaaatacctagga

SEQ ID NO: 1023593 - DNA, 22 bp, Artificial Sequence
  chemically synthesized
gtaagttggattcctaggtatt

SEQ ID NO: 1023594 - DNA, 22 bp, Artificial Sequence
  chemically synthesized
caaagagaataaaatacctagg

SEQ ID NO: 1023595 - DNA, 22 bp, Artificial Sequence
  chemically synthesized
taagttggattcctaggtattt

SEQ ID NO: 1023596 - DNA, 22 bp, Artificial Sequence
  chemically synthesized
cttcaaagagaataaaatacct

SEQ ID NO: 1023597 - DNA, 22 bp, Artificial Sequence
  chemically synthesized
gattcctaggtattttattctc

SEQ ID NO: 1023598 - DNA, 22 bp, Artificial Sequence
  chemically synthesized
acaattgcttcaaagagaataa

SEQ ID NO: 1023599 - DNA, 22 bp, Artificial Sequence
  chemically synthesized
ctaggtattttattctctttga

SEQ ID NO: 1023600 - DNA, 22 bp, Artificial Sequence
  chemically synthesized
ggtattttattctctttgaagc

SEQ ID NO: 1023601 - DNA, 22 bp, Artificial Sequence
  chemically synthesized
ccattcacaattgcttcaaaga

SEQ ID NO: 1023602 - DNA, 22 bp, Artificial Sequence
  chemically synthesized
tattctctttgaagcaattgtg

SEQ ID NO: 1023603 - DNA, 22 bp, Artificial Sequence
  chemically synthesized
attctctttgaagcaattgtga

SEQ ID NO: 1023604 - DNA, 22 bp, Artificial Sequence
  chemically synthesized
ttctctttgaagcaattgtgaa

SEQ ID NO: 1023605 - DNA, 22 bp, Artificial Sequence
  chemically synthesized
tctttgaagcaattgtgaatgg

SEQ ID NO: 1023606 - DNA, 22 bp, Artificial Sequence
  chemically synthesized
tttgaagcaattgtgaatggga

SEQ ID NO: 1023607 - DNA, 22 bp, Artificial Sequence
  chemically synthesized
tgaagcaattgtgaatgggagt

SEQ ID NO: 1023608 - DNA, 22 bp, Artificial Sequence
  chemically synthesized
gaagcaattgtgaatgggagtt

SEQ ID NO: 1023609 - DNA, 22 bp, Artificial Sequence
  chemically synthesized
aagcaattgtgaatgggagttc

SEQ ID NO: 1023610 - DNA, 22 bp, Artificial Sequence
  chemically synthesized
tgaatgggagttcactcatgat

SEQ ID NO: 1023611 - DNA, 22 bp, Artificial Sequence
  chemically synthesized
actcatgatttggctctctgtt

SEQ ID NO: 1023612 - DNA, 22 bp, Artificial Sequence
  chemically synthesized
atgatttggctctctgtttgtc

SEQ ID NO: 1023613 - DNA, 22 bp, Artificial Sequence
  chemically synthesized
tacaccaacaacagacaaacag

SEQ ID NO: 1023614 - DNA, 22 bp, Artificial Sequence
  chemically synthesized
atacaccaacaacagacaaaca

SEQ ID NO: 1023615 - DNA, 22 bp, Artificial Sequence
  chemically synthesized
ttatacaccaacaacagacaaa

SEQ ID NO: 1023616 - DNA, 22 bp, Artificial Sequence
  chemically synthesized
ggctctctgtttgtctgttgtt

SEQ ID NO: 1023617 - DNA, 22 bp, Artificial Sequence
  chemically synthesized
gctctctgtttgtctgttgttg

SEQ ID NO: 1023618 - DNA, 22 bp, Artificial Sequence
  chemically synthesized
tctgtttgtctgttgttggtgt

SEQ ID NO: 1023619 - DNA, 22 bp, Artificial Sequence
  chemically synthesized
tgtttgtctgttgttggtgtat

SEQ ID NO: 1023620 - DNA, 22 bp, Artificial Sequence
  chemically synthesized
tttgtctgttgttggtgtataa

SEQ ID NO: 1023621 - DNA, 22 bp, Artificial Sequence
  chemically synthesized
gtctgttgttggtgtataagaa

SEQ ID NO: 1023622 - DNA, 22 bp, Artificial Sequence
  chemically synthesized
tctgttgttggtgtataagaat

SEQ ID NO: 1023623 - DNA, 22 bp, Artificial Sequence
  chemically synthesized
ttgttggtgtataagaatgctt

SEQ ID NO: 1023624 - DNA, 22 bp, Artificial Sequence
  chemically synthesized
ttggtgtataagaatgcttgtg

SEQ ID NO: 1023625 - DNA, 22 bp, Artificial Sequence
  chemically synthesized
gtgtataagaatgcttgtgatt

SEQ ID NO: 1023626 - DNA, 22 bp, Artificial Sequence
  chemically synthesized
aggatacaaaatcaatgtacag

SEQ ID NO: 1023627 - DNA, 22 bp, Artificial Sequence
  chemically synthesized
gtgatttctgtacattgatttt

SEQ ID NO: 1023628 - DNA, 22 bp, Artificial Sequence
  chemically synthesized
tgatttctgtacattgattttg

SEQ ID NO: 1023629 - DNA, 22 bp, Artificial Sequence
  chemically synthesized
agcaaagtctcaggatacaaaa

SEQ ID NO: 1023630 - DNA, 22 bp, Artificial Sequence
  chemically synthesized
ctgtacattgattttgtatcct

SEQ ID NO: 1023631 - DNA, 22 bp, Artificial Sequence
  chemically synthesized
cagcaaagtctcaggatacaaa

SEQ ID NO: 1023632 - DNA, 22 bp, Artificial Sequence
  chemically synthesized
tgtacattgattttgtatcctg

SEQ ID NO: 1023633 - DNA, 22 bp, Artificial Sequence
  chemically synthesized
tacattgattttgtatcctgag

SEQ ID NO: 1023634 - DNA, 22 bp, Artificial Sequence
  chemically synthesized
attttgtatcctgagactttgc

SEQ ID NO: 1023635 - DNA, 22 bp, Artificial Sequence
  chemically synthesized
ataagcaacttcagcaaagtct

SEQ ID NO: 1023636 - DNA, 22 bp, Artificial Sequence
  chemically synthesized
tgtatcctgagactttgctgaa

SEQ ID NO: 1023637 - DNA, 22 bp, Artificial Sequence
  chemically synthesized
gtatcctgagactttgctgaag

SEQ ID NO: 1023638 - DNA, 22 bp, Artificial Sequence
  chemically synthesized
tatcctgagactttgctgaagt

SEQ ID NO: 1023639 - DNA, 22 bp, Artificial Sequence
  chemically synthesized
agctgataagcaacttcagcaa

SEQ ID NO: 1023640 - DNA, 22 bp, Artificial Sequence
  chemically synthesized
aagctgataagcaacttcagca

SEQ ID NO: 1023641 - DNA, 22 bp, Artificial Sequence
  chemically synthesized
cttaagctgataagcaacttca

SEQ ID NO: 1023642 - DNA, 22 bp, Artificial Sequence
  chemically synthesized
agactttgctgaagttgcttat

SEQ ID NO: 1023643 - DNA, 22 bp, Artificial Sequence
  chemically synthesized
tgctgaagttgcttatcagctt

SEQ ID NO: 1023644 - DNA, 22 bp, Artificial Sequence
  chemically synthesized
gctgaagttgcttatcagctta

SEQ ID NO: 1023645 - DNA, 22 bp, Artificial Sequence
  chemically synthesized
ctgaagttgcttatcagcttaa

SEQ ID NO: 1023646 - DNA, 22 bp, Artificial Sequence
  chemically synthesized
agcccaaaatctccttaagctg

SEQ ID NO: 1023647 - DNA, 22 bp, Artificial Sequence
  chemically synthesized
aagttgcttatcagcttaagga

SEQ ID NO: 1023648 - DNA, 22 bp, Artificial Sequence
  chemically synthesized
cttatcagcttaaggagatttt

SEQ ID NO: 1023649 - DNA, 22 bp, Artificial Sequence
  chemically synthesized
atcagcttaaggagattttggg

SEQ ID NO: 1023650 - DNA, 22 bp, Artificial Sequence
  chemically synthesized
tcagcttaaggagattttgggc

SEQ ID NO: 1023651 - DNA, 22 bp, Artificial Sequence
  chemically synthesized
gaaaaccccatcgtctcagccc

SEQ ID NO: 1023652 - DNA, 22 bp, Artificial Sequence
  chemically synthesized
aaggagattttgggctgagacg

SEQ ID NO: 1023653 - DNA, 22 bp, Artificial Sequence
  chemically synthesized
aggagattttgggctgagacga

SEQ ID NO: 1023654 - DNA, 22 bp, Artificial Sequence
  chemically synthesized
tctagaaaaccccatcgtctca

SEQ ID NO: 1023655 - DNA, 22 bp, Artificial Sequence
  chemically synthesized
atctagaaaaccccatcgtctc

SEQ ID NO: 1023656 - DNA, 22 bp, Artificial Sequence
  chemically synthesized
tttatctagaaaaccccatcgt

SEQ ID NO: 1023657 - DNA, 22 bp, Artificial Sequence
  chemically synthesized
tgggctgagacgatggggtttt

SEQ ID NO: 1023658 - DNA, 22 bp, Artificial Sequence
  chemically synthesized
gggctgagacgatggggttttc

SEQ ID NO: 1023659 - DNA, 22 bp, Artificial Sequence
  chemically synthesized
ggctgagacgatggggttttct

SEQ ID NO: 1023660 - DNA, 22 bp, Artificial Sequence
  chemically synthesized
agacgatggggttttctagata

SEQ ID NO: 1023661 - DNA, 22 bp, Artificial Sequence
  chemically synthesized
cagacgacatgattgtttatct

SEQ ID NO: 1023662 - DNA, 22 bp, Artificial Sequence
  chemically synthesized
gcagacgacatgattgtttatc

SEQ ID NO: 1023663 - DNA, 22 bp, Artificial Sequence
  chemically synthesized
tttgcagacgacatgattgttt

SEQ ID NO: 1023664 - DNA, 22 bp, Artificial Sequence
  chemically synthesized
tctagataaacaatcatgtcgt

SEQ ID NO: 1023665 - DNA, 22 bp, Artificial Sequence
  chemically synthesized
ctagataaacaatcatgtcgtc

SEQ ID NO: 1023666 - DNA, 22 bp, Artificial Sequence
  chemically synthesized
tccctgtttgcagacgacatga

SEQ ID NO: 1023667 - DNA, 22 bp, Artificial Sequence
  chemically synthesized
tagataaacaatcatgtcgtct

SEQ ID NO: 1023668 - DNA, 22 bp, Artificial Sequence
  chemically synthesized
gataaacaatcatgtcgtctgc

SEQ ID NO: 1023669 - DNA, 22 bp, Artificial Sequence
  chemically synthesized
ggaaaagaggaagtcaaattgt

SEQ ID NO: 1023670 - DNA, 22 bp, Artificial Sequence
  chemically synthesized
caaacagggacaatttgacttc

SEQ ID NO: 1023671 - DNA, 22 bp, Artificial Sequence
  chemically synthesized
agttaggaaaagaggaagtcaa

SEQ ID NO: 1023672 - DNA, 22 bp, Artificial Sequence
  chemically synthesized
gacttcctcttttcctaactga

SEQ ID NO: 1023673 - DNA, 22 bp, Artificial Sequence
  chemically synthesized
acttcctcttttcctaactgaa

SEQ ID NO: 1023674 - DNA, 22 bp, Artificial Sequence
  chemically synthesized
cctcttttcctaactgaatacc

SEQ ID NO: 1023675 - DNA, 22 bp, Artificial Sequence
  chemically synthesized
ctcttttcctaactgaatacct

SEQ ID NO: 1023676 - DNA, 22 bp, Artificial Sequence
  chemically synthesized
ttttcctaactgaatacctttt

SEQ ID NO: 1023677 - DNA, 22 bp, Artificial Sequence
  chemically synthesized
ttcctaactgaataccttttat

SEQ ID NO: 1023678 - DNA, 22 bp, Artificial Sequence
  chemically synthesized
tcctaactgaataccttttatt

SEQ ID NO: 1023679 - DNA, 22 bp, Artificial Sequence
  chemically synthesized
cctaactgaataccttttattt

SEQ ID NO: 1023680 - DNA, 22 bp, Artificial Sequence
  chemically synthesized
ctaactgaataccttttatttc

SEQ ID NO: 1023681 - DNA, 22 bp, Artificial Sequence
  chemically synthesized
actgaataccttttatttcctt

SEQ ID NO: 1023682 - DNA, 22 bp, Artificial Sequence
  chemically synthesized
aataccttttatttccttctcc

SEQ ID NO: 1023683 - DNA, 22 bp, Artificial Sequence
  chemically synthesized
gccagggcaatcaggcaggaga

SEQ ID NO: 1023684 - DNA, 22 bp, Artificial Sequence
  chemically synthesized
tggccagggcaatcaggcagga

SEQ ID NO: 1023685 - DNA, 22 bp, Artificial Sequence
  chemically synthesized
ttatttccttctcctgcctgat

SEQ ID NO: 1023686 - DNA, 22 bp, Artificial Sequence
  chemically synthesized
tatttccttctcctgcctgatt

SEQ ID NO: 1023687 - DNA, 22 bp, Artificial Sequence
  chemically synthesized
atttccttctcctgcctgattg

SEQ ID NO: 1023688 - DNA, 22 bp, Artificial Sequence
  chemically synthesized
tttccttctcctgcctgattgc

SEQ ID NO: 1023689 - DNA, 22 bp, Artificial Sequence
  chemically synthesized
ccttctcctgcctgattgccct

SEQ ID NO: 1023690 - DNA, 22 bp, Artificial Sequence
  chemically synthesized
gaagttctggccagggcaatca

SEQ ID NO: 1023691 - DNA, 22 bp, Artificial Sequence
  chemically synthesized
cttctcctgcctgattgccctg

SEQ ID NO: 1023692 - DNA, 22 bp, Artificial Sequence
  chemically synthesized
ctcctgcctgattgccctggcc

SEQ ID NO: 1023693 - DNA, 22 bp, Artificial Sequence
  chemically synthesized
tcctgcctgattgccctggcca

SEQ ID NO: 1023694 - DNA, 22 bp, Artificial Sequence
  chemically synthesized
ctgcctgattgccctggccaga

SEQ ID NO: 1023695 - DNA, 22 bp, Artificial Sequence
  chemically synthesized
cctgattgccctggccagaact

SEQ ID NO: 1023696 - DNA, 22 bp, Artificial Sequence
  chemically synthesized
aacatagtgttggaagttctgg

SEQ ID NO: 1023697 - DNA, 22 bp, Artificial Sequence
  chemically synthesized
attgccctggccagaacttcca

SEQ ID NO: 1023698 - DNA, 22 bp, Artificial Sequence
  chemically synthesized
ttcaacatagtgttggaagttc

SEQ ID NO: 1023699 - DNA, 22 bp, Artificial Sequence
  chemically synthesized
ccctggccagaacttccaacac

SEQ ID NO: 1023700 - DNA, 22 bp, Artificial Sequence
  chemically synthesized
ctattcaacatagtgttggaag

SEQ ID NO: 1023701 - DNA, 22 bp, Artificial Sequence
  chemically synthesized
gccagaacttccaacactatgt

SEQ ID NO: 1023702 - DNA, 22 bp, Artificial Sequence
  chemically synthesized
accgctcctattcaacatagtg

SEQ ID NO: 1023703 - DNA, 22 bp, Artificial Sequence
  chemically synthesized
tcaccgctcctattcaacatag

SEQ ID NO: 1023704 - DNA, 22 bp, Artificial Sequence
  chemically synthesized
tctcaccgctcctattcaacat

SEQ ID NO: 1023705 - DNA, 22 bp, Artificial Sequence
  chemically synthesized
ccaacactatgttgaataggag

SEQ ID NO: 1023706 - DNA, 22 bp, Artificial Sequence
  chemically synthesized
caacactatgttgaataggagc

SEQ ID NO: 1023707 - DNA, 22 bp, Artificial Sequence
  chemically synthesized
tgttgaataggagcggtgagag

SEQ ID NO: 1023708 - DNA, 22 bp, Artificial Sequence
  chemically synthesized
aataggagcggtgagagagggc

SEQ ID NO: 1023709 - DNA, 22 bp, Artificial Sequence
  chemically synthesized
gcacaagacagggatgccctct

SEQ ID NO: 1023710 - DNA, 22 bp, Artificial Sequence
  chemically synthesized
aaaactggcacaagacagggat

SEQ ID NO: 1023711 - DNA, 22 bp, Artificial Sequence
  chemically synthesized
gaaaactggcacaagacaggga

SEQ ID NO: 1023712 - DNA, 22 bp, Artificial Sequence
  chemically synthesized
tgaaaactggcacaagacaggg

SEQ ID NO: 1023713 - DNA, 22 bp, Artificial Sequence
  chemically synthesized
cctttgaaaactggcacaagac

SEQ ID NO: 1023714 - DNA, 22 bp, Artificial Sequence
  chemically synthesized
gaagcattccctttgaaaactg

SEQ ID NO: 1023715 - DNA, 22 bp, Artificial Sequence
  chemically synthesized
tcttgtgccagttttcaaaggg

SEQ ID NO: 1023716 - DNA, 22 bp, Artificial Sequence
  chemically synthesized
gtgccagttttcaaagggaatg

SEQ ID NO: 1023717 - DNA, 22 bp, Artificial Sequence
  chemically synthesized
tgccagttttcaaagggaatgc

SEQ ID NO: 1023718 - DNA, 22 bp, Artificial Sequence
  chemically synthesized
aatgggcaaaaactggaagcat

SEQ ID NO: 1023719 - DNA, 22 bp, Artificial Sequence
  chemically synthesized
tcaaagggaatgcttccagttt

SEQ ID NO: 1023720 - DNA, 22 bp, Artificial Sequence
  chemically synthesized
caaagggaatgcttccagtttt

SEQ ID NO: 1023721 - DNA, 22 bp, Artificial Sequence
  chemically synthesized
aaagggaatgcttccagttttt

SEQ ID NO: 1023722 - DNA, 22 bp, Artificial Sequence
  chemically synthesized
ccagtttttgcccattcagtat

SEQ ID NO: 1023723 - DNA, 22 bp, Artificial Sequence
  chemically synthesized
cagtttttgcccattcagtatg

SEQ ID NO: 1023724 - DNA, 22 bp, Artificial Sequence
  chemically synthesized
ttgcccattcagtatgatattg

SEQ ID NO: 1023725 - DNA, 22 bp, Artificial Sequence
  chemically synthesized
tgcccattcagtatgatattgg

SEQ ID NO: 1023726 - DNA, 22 bp, Artificial Sequence
  chemically synthesized
gcccattcagtatgatattggc

SEQ ID NO: 1023727 - DNA, 22 bp, Artificial Sequence
  chemically synthesized
cccattcagtatgatattggct

SEQ ID NO: 1023728 - DNA, 22 bp, Artificial Sequence
  chemically synthesized
tgacaaacccacagccaatatc

SEQ ID NO: 1023729 - DNA, 22 bp, Artificial Sequence
  chemically synthesized
tctatgacaaacccacagccaa

SEQ ID NO: 1023730 - DNA, 22 bp, Artificial Sequence
  chemically synthesized
agtatgatattggctgtgggtt

SEQ ID NO: 1023731 - DNA, 22 bp, Artificial Sequence
  chemically synthesized
gctgtgggtttgtcatagatag

SEQ ID NO: 1023732 - DNA, 22 bp, Artificial Sequence
  chemically synthesized
aaaataataagagctatctatg

SEQ ID NO: 1023733 - DNA, 22 bp, Artificial Sequence
  chemically synthesized
tgggtttgtcatagatagctct

SEQ ID NO: 1023734 - DNA, 22 bp, Artificial Sequence
  chemically synthesized
gtcatagatagctcttattatt

SEQ ID NO: 1023735 - DNA, 22 bp, Artificial Sequence
  chemically synthesized
tcatagatagctcttattattt

SEQ ID NO: 1023736 - DNA, 22 bp, Artificial Sequence
  chemically synthesized
atgggacatatctcaaaataat

SEQ ID NO: 1023737 - DNA, 22 bp, Artificial Sequence
  chemically synthesized
ggtattgatgggacatatctca

SEQ ID NO: 1023738 - DNA, 22 bp, Artificial Sequence
  chemically synthesized
ttattattttgagatatgtccc

SEQ ID NO: 1023739 - DNA, 22 bp, Artificial Sequence
  chemically synthesized
attattttgagatatgtcccat

SEQ ID NO: 1023740 - DNA, 22 bp, Artificial Sequence
  chemically synthesized
ttattttgagatatgtcccatc

SEQ ID NO: 1023741 - DNA, 22 bp, Artificial Sequence
  chemically synthesized
ttttgagatatgtcccatcaat

SEQ ID NO: 1023742 - DNA, 22 bp, Artificial Sequence
  chemically synthesized
aataaattaggtattgatggga

SEQ ID NO: 1023743 - DNA, 22 bp, Artificial Sequence
  chemically synthesized
tcaataaattaggtattgatgg

SEQ ID NO: 1023744 - DNA, 22 bp, Artificial Sequence
  chemically synthesized
tgagatatgtcccatcaatacc

SEQ ID NO: 1023745 - DNA, 22 bp, Artificial Sequence
  chemically synthesized
gagatatgtcccatcaatacct

SEQ ID NO: 1023746 - DNA, 22 bp, Artificial Sequence
  chemically synthesized
agatatgtcccatcaataccta

SEQ ID NO: 1023747 - DNA, 22 bp, Artificial Sequence
  chemically synthesized
aaaactctcaataaattaggta

SEQ ID NO: 1023748 - DNA, 22 bp, Artificial Sequence
  chemically synthesized
atgctaaaaactctcaataaat

SEQ ID NO: 1023749 - DNA, 22 bp, Artificial Sequence
  chemically synthesized
catgctaaaaactctcaataaa

SEQ ID NO: 1023750 - DNA, 22 bp, Artificial Sequence
  chemically synthesized
aacaacccttcatgctaaaaac

SEQ ID NO: 1023751 - DNA, 22 bp, Artificial Sequence
  chemically synthesized
atttattgagagtttttagcat

SEQ ID NO: 1023752 - DNA, 22 bp, Artificial Sequence
  chemically synthesized
attgagagtttttagcatgaag

SEQ ID NO: 1023753 - DNA, 22 bp, Artificial Sequence
  chemically synthesized
ttgagagtttttagcatgaagg

SEQ ID NO: 1023754 - DNA, 22 bp, Artificial Sequence
  chemically synthesized
agagtttttagcatgaagggtt

SEQ ID NO: 1023755 - DNA, 22 bp, Artificial Sequence
  chemically synthesized
acaaaattcaacaacccttcat

SEQ ID NO: 1023756 - DNA, 22 bp, Artificial Sequence
  chemically synthesized
gacaaaattcaacaacccttca

SEQ ID NO: 1023757 - DNA, 22 bp, Artificial Sequence
  chemically synthesized
tgacaaaattcaacaacccttc

SEQ ID NO: 1023758 - DNA, 22 bp, Artificial Sequence
  chemically synthesized
ttagcatgaagggttgttgaat

SEQ ID NO: 1023759 - DNA, 22 bp, Artificial Sequence
  chemically synthesized
tagcatgaagggttgttgaatt

SEQ ID NO: 1023760 - DNA, 22 bp, Artificial Sequence
  chemically synthesized
agcatgaagggttgttgaattt

SEQ ID NO: 1023761 - DNA, 22 bp, Artificial Sequence
  chemically synthesized
gcatgaagggttgttgaatttt

SEQ ID NO: 1023762 - DNA, 22 bp, Artificial Sequence
  chemically synthesized
ttgaattttgtcaaaggctttt

SEQ ID NO: 1023763 - DNA, 22 bp, Artificial Sequence
  chemically synthesized
aatagatgcagaaaaagccttt

SEQ ID NO: 1023764 - DNA, 22 bp, Artificial Sequence
  chemically synthesized
aattttgtcaaaggctttttct

SEQ ID NO: 1023765 - DNA, 22 bp, Artificial Sequence
  chemically synthesized
tctcaatagatgcagaaaaagc

SEQ ID NO: 1023766 - DNA, 22 bp, Artificial Sequence
  chemically synthesized
tgtcaaaggctttttctgcatc

SEQ ID NO: 1023767 - DNA, 22 bp, Artificial Sequence
  chemically synthesized
gtcaaaggctttttctgcatct

SEQ ID NO: 1023768 - DNA, 22 bp, Artificial Sequence
  chemically synthesized
tcaaaggctttttctgcatcta

SEQ ID NO: 1023769 - DNA, 22 bp, Artificial Sequence
  chemically synthesized
tttctgcatctattgagataat

SEQ ID NO: 1023770 - DNA, 22 bp, Artificial Sequence
  chemically synthesized
ttctgcatctattgagataatc

SEQ ID NO: 1023771 - DNA, 22 bp, Artificial Sequence
  chemically synthesized
tctgcatctattgagataatca

SEQ ID NO: 1023772 - DNA, 22 bp, Artificial Sequence
  chemically synthesized
ctgcatctattgagataatcat

SEQ ID NO: 1023773 - DNA, 22 bp, Artificial Sequence
  chemically synthesized
tgcatctattgagataatcatg

SEQ ID NO: 1023774 - DNA, 22 bp, Artificial Sequence
  chemically synthesized
catctattgagataatcatgtg

SEQ ID NO: 1023775 - DNA, 22 bp, Artificial Sequence
  chemically synthesized
ttgagataatcatgtggttttt

SEQ ID NO: 1023776 - DNA, 22 bp, Artificial Sequence
  chemically synthesized
agataatcatgtggtttttgtc

SEQ ID NO: 1023777 - DNA, 22 bp, Artificial Sequence
  chemically synthesized
ttgtctttggctctgtttatat

SEQ ID NO: 1023778 - DNA, 22 bp, Artificial Sequence
  chemically synthesized
tgtctttggctctgtttatatg

SEQ ID NO: 1023779 - DNA, 22 bp, Artificial Sequence
  chemically synthesized
gtctttggctctgtttatatgc

SEQ ID NO: 1023780 - DNA, 22 bp, Artificial Sequence
  chemically synthesized
tctttggctctgtttatatgct

SEQ ID NO: 1023781 - DNA, 22 bp, Artificial Sequence
  chemically synthesized
tggctctgtttatatgctggat

SEQ ID NO: 1023782 - DNA, 22 bp, Artificial Sequence
  chemically synthesized
ggctctgtttatatgctggatt

SEQ ID NO: 1023783 - DNA, 22 bp, Artificial Sequence
  chemically synthesized
gctctgtttatatgctggatta

SEQ ID NO: 1023784 - DNA, 22 bp, Artificial Sequence
  chemically synthesized
tgtttatatgctggattacatt

SEQ ID NO: 1023785 - DNA, 22 bp, Artificial Sequence
  chemically synthesized
tttatatgctggattacattta

SEQ ID NO: 1023786 - DNA, 22 bp, Artificial Sequence
  chemically synthesized
atatgctggattacatttattg

SEQ ID NO: 1023787 - DNA, 22 bp, Artificial Sequence
  chemically synthesized
tatgctggattacatttattga

SEQ ID NO: 1023788 - DNA, 22 bp, Artificial Sequence
  chemically synthesized
aatatacgcaaatcaataaatg

SEQ ID NO: 1023789 - DNA, 22 bp, Artificial Sequence
  chemically synthesized
gttcaatatacgcaaatcaata

SEQ ID NO: 1023790 - DNA, 22 bp, Artificial Sequence
  chemically synthesized
gattacatttattgatttgcgt

SEQ ID NO: 1023791 - DNA, 22 bp, Artificial Sequence
  chemically synthesized
catttattgatttgcgtatatt

SEQ ID NO: 1023792 - DNA, 22 bp, Artificial Sequence
  chemically synthesized
attgatttgcgtatattgaacc

SEQ ID NO: 1023793 - DNA, 22 bp, Artificial Sequence
  chemically synthesized
ggatgcaaggctggttcaatat

SEQ ID NO: 1023794 - DNA, 22 bp, Artificial Sequence
  chemically synthesized
ttgatttgcgtatattgaacca

SEQ ID NO: 1023795 - DNA, 22 bp, Artificial Sequence
  chemically synthesized
gggatgcaaggctggttcaata

SEQ ID NO: 1023796 - DNA, 22 bp, Artificial Sequence
  chemically synthesized
atttgcgtatattgaaccagcc

SEQ ID NO: 1023797 - DNA, 22 bp, Artificial Sequence
  chemically synthesized
atccttgggatgcaaggctggt

SEQ ID NO: 1023798 - DNA, 22 bp, Artificial Sequence
  chemically synthesized
gcgtatattgaaccagccttgc

SEQ ID NO: 1023799 - DNA, 22 bp, Artificial Sequence
  chemically synthesized
catccttgggatgcaaggctgg

SEQ ID NO: 1023800 - DNA, 22 bp, Artificial Sequence
  chemically synthesized
cgtatattgaaccagccttgca

SEQ ID NO: 1023801 - DNA, 22 bp, Artificial Sequence
  chemically synthesized
aaccagccttgcatcccaagga

SEQ ID NO: 1023802 - DNA, 22 bp, Artificial Sequence
  chemically synthesized
gcatcccaaggatgaagcccac

SEQ ID NO: 1023803 - DNA, 22 bp, Artificial Sequence
  chemically synthesized
catcccaaggatgaagcccact

SEQ ID NO: 1023804 - DNA, 22 bp, Artificial Sequence
  chemically synthesized
tccaccatgatcaagtgggctt

SEQ ID NO: 1023805 - DNA, 22 bp, Artificial Sequence
  chemically synthesized
atccaccatgatcaagtgggct

SEQ ID NO: 1023806 - DNA, 22 bp, Artificial Sequence
  chemically synthesized
gatcatggtggataagcttttt

SEQ ID NO: 1023807 - DNA, 22 bp, Artificial Sequence
  chemically synthesized
atcatggtggataagctttttg

SEQ ID NO: 1023808 - DNA, 22 bp, Artificial Sequence
  chemically synthesized
gcataccgaatccagcagcaca

SEQ ID NO: 1023809 - DNA, 22 bp, Artificial Sequence
  chemically synthesized
tttgatgtgctgctggattcgg

SEQ ID NO: 1023810 - DNA, 22 bp, Artificial Sequence
  chemically synthesized
ttgatgtgctgctggattcggt

SEQ ID NO: 1023811 - DNA, 22 bp, Artificial Sequence
  chemically synthesized
tgatgtgctgctggattcggta

SEQ ID NO: 1023812 - DNA, 22 bp, Artificial Sequence
  chemically synthesized
gatgtgctgctggattcggtat

SEQ ID NO: 1023813 - DNA, 22 bp, Artificial Sequence
  chemically synthesized
atgtgctgctggattcggtatg

SEQ ID NO: 1023814 - DNA, 22 bp, Artificial Sequence
  chemically synthesized
aataaaatactggcataccgaa

SEQ ID NO: 1023815 - DNA, 22 bp, Artificial Sequence
  chemically synthesized
ctggattcggtatgccagtatt

SEQ ID NO: 1023816 - DNA, 22 bp, Artificial Sequence
  chemically synthesized
gattcggtatgccagtatttta

SEQ ID NO: 1023817 - DNA, 22 bp, Artificial Sequence
  chemically synthesized
atgcaaaaatcctcaataaaat

SEQ ID NO: 1023818 - DNA, 22 bp, Artificial Sequence
  chemically synthesized
ggtatgccagtattttattgag

SEQ ID NO: 1023819 - DNA, 22 bp, Artificial Sequence
  chemically synthesized
atgaacattgatgcaaaaatcc

SEQ ID NO: 1023820 - DNA, 22 bp, Artificial Sequence
  chemically synthesized
gatgaacattgatgcaaaaatc

SEQ ID NO: 1023821 - DNA, 22 bp, Artificial Sequence
  chemically synthesized
tattgaggatttttgcatcaat

SEQ ID NO: 1023822 - DNA, 22 bp, Artificial Sequence
  chemically synthesized
attgaggatttttgcatcaatg

SEQ ID NO: 1023823 - DNA, 22 bp, Artificial Sequence
  chemically synthesized
ttgaggatttttgcatcaatgt

SEQ ID NO: 1023824 - DNA, 22 bp, Artificial Sequence
  chemically synthesized
aggatttttgcatcaatgttca

SEQ ID NO: 1023825 - DNA, 22 bp, Artificial Sequence
  chemically synthesized
gaccaatatccttgatgaacat

SEQ ID NO: 1023826 - DNA, 22 bp, Artificial Sequence
  chemically synthesized
agaccaatatccttgatgaaca

SEQ ID NO: 1023827 - DNA, 22 bp, Artificial Sequence
  chemically synthesized
tagaccaatatccttgatgaac

SEQ ID NO: 1023828 - DNA, 22 bp, Artificial Sequence
  chemically synthesized
ttgcatcaatgttcatcaagga

SEQ ID NO: 1023829 - DNA, 22 bp, Artificial Sequence
  chemically synthesized
tgcatcaatgttcatcaaggat

SEQ ID NO: 1023830 - DNA, 22 bp, Artificial Sequence
  chemically synthesized
gcatcaatgttcatcaaggata

SEQ ID NO: 1023831 - DNA, 22 bp, Artificial Sequence
  chemically synthesized
catcaatgttcatcaaggatat

SEQ ID NO: 1023832 - DNA, 22 bp, Artificial Sequence
  chemically synthesized
atcaaggatattggtctaaaat

SEQ ID NO: 1023833 - DNA, 22 bp, Artificial Sequence
  chemically synthesized
gtctaaaattctcttttttggt

SEQ ID NO: 1023834 - DNA, 22 bp, Artificial Sequence
  chemically synthesized
aaattctcttttttggttgtgt

SEQ ID NO: 1023835 - DNA, 22 bp, Artificial Sequence
  chemically synthesized
tcttttttggttgtgtctctgc

SEQ ID NO: 1023836 - DNA, 22 bp, Artificial Sequence
  chemically synthesized
ataccaaagccgggcagagaca

SEQ ID NO: 1023837 - DNA, 22 bp, Artificial Sequence
  chemically synthesized
ttttttggttgtgtctctgccc

SEQ ID NO: 1023838 - DNA, 22 bp, Artificial Sequence
  chemically synthesized
tgataccaaagccgggcagaga

SEQ ID NO: 1023839 - DNA, 22 bp, Artificial Sequence
  chemically synthesized
ttttggttgtgtctctgcccgg

SEQ ID NO: 1023840 - DNA, 22 bp, Artificial Sequence
  chemically synthesized
tttggttgtgtctctgcccggc

SEQ ID NO: 1023841 - DNA, 22 bp, Artificial Sequence
  chemically synthesized
ttggttgtgtctctgcccggct

SEQ ID NO: 1023842 - DNA, 22 bp, Artificial Sequence
  chemically synthesized
tggttgtgtctctgcccggctt

SEQ ID NO: 1023843 - DNA, 22 bp, Artificial Sequence
  chemically synthesized
ggttgtgtctctgcccggcttt

SEQ ID NO: 1023844 - DNA, 22 bp, Artificial Sequence
  chemically synthesized
gttgtgtctctgcccggctttg

SEQ ID NO: 1023845 - DNA, 22 bp, Artificial Sequence
  chemically synthesized
tgtctctgcccggctttggtat

SEQ ID NO: 1023846 - DNA, 22 bp, Artificial Sequence
  chemically synthesized
tgcccggctttggtatcagaat

SEQ ID NO: 1023847 - DNA, 22 bp, Artificial Sequence
  chemically synthesized
tgaggccagcatcattctgata

SEQ ID NO: 1023848 - DNA, 22 bp, Artificial Sequence
  chemically synthesized
cccggctttggtatcagaatga

SEQ ID NO: 1023849 - DNA, 22 bp, Artificial Sequence
  chemically synthesized
atgaggccagcatcattctgat

SEQ ID NO: 1023850 - DNA, 22 bp, Artificial Sequence
  chemically synthesized
tatgaggccagcatcattctga

SEQ ID NO: 1023851 - DNA, 22 bp, Artificial Sequence
  chemically synthesized
attttatgaggccagcatcatt

SEQ ID NO: 1023852 - DNA, 22 bp, Artificial Sequence
  chemically synthesized
tggtatcagaatgatgctggcc

SEQ ID NO: 1023853 - DNA, 22 bp, Artificial Sequence
  chemically synthesized
ggtatcagaatgatgctggcct

SEQ ID NO: 1023854 - DNA, 22 bp, Artificial Sequence
  chemically synthesized
actcattttatgaggccagcat

SEQ ID NO: 1023855 - DNA, 22 bp, Artificial Sequence
  chemically synthesized
gtatcagaatgatgctggcctc

SEQ ID NO: 1023856 - DNA, 22 bp, Artificial Sequence
  chemically synthesized
cctaactcattttatgaggcca

SEQ ID NO: 1023857 - DNA, 22 bp, Artificial Sequence
  chemically synthesized
gcctcataaaatgagttaggga

SEQ ID NO: 1023858 - DNA, 22 bp, Artificial Sequence
  chemically synthesized
ataaaatgagttagggaggatt

SEQ ID NO: 1023859 - DNA, 22 bp, Artificial Sequence
  chemically synthesized
caatcaatagaaaaagagggaa

SEQ ID NO: 1023860 - DNA, 22 bp, Artificial Sequence
  chemically synthesized
ttccaatcaatagaaaaagagg

SEQ ID NO: 1023861 - DNA, 22 bp, Artificial Sequence
  chemically synthesized
gggaggattccctctttttcta

SEQ ID NO: 1023862 - DNA, 22 bp, Artificial Sequence
  chemically synthesized
aaactattccaatcaatagaaa

SEQ ID NO: 1023863 - DNA, 22 bp, Artificial Sequence
  chemically synthesized
tgaaactattccaatcaataga

SEQ ID NO: 1023864 - DNA, 22 bp, Artificial Sequence
  chemically synthesized
ctgaaactattccaatcaatag

SEQ ID NO: 1023865 - DNA, 22 bp, Artificial Sequence
  chemically synthesized
cctctttttctattgattggaa

SEQ ID NO: 1023866 - DNA, 22 bp, Artificial Sequence
  chemically synthesized
cttctgaaactattccaatcaa

SEQ ID NO: 1023867 - DNA, 22 bp, Artificial Sequence
  chemically synthesized
tttttctattgattggaatagt

SEQ ID NO: 1023868 - DNA, 22 bp, Artificial Sequence
  chemically synthesized
tttctattgattggaatagttt

SEQ ID NO: 1023869 - DNA, 22 bp, Artificial Sequence
  chemically synthesized
ttctattgattggaatagtttc

SEQ ID NO: 1023870 - DNA, 22 bp, Artificial Sequence
  chemically synthesized
tctattgattggaatagtttca

SEQ ID NO: 1023871 - DNA, 22 bp, Artificial Sequence
  chemically synthesized
ctattgattggaatagtttcag

SEQ ID NO: 1023872 - DNA, 22 bp, Artificial Sequence
  chemically synthesized
gtaccattccttctgaaactat

SEQ ID NO: 1023873 - DNA, 22 bp, Artificial Sequence
  chemically synthesized
tattgattggaatagtttcaga

SEQ ID NO: 1023874 - DNA, 22 bp, Artificial Sequence
  chemically synthesized
ttgattggaatagtttcagaag

SEQ ID NO: 1023875 - DNA, 22 bp, Artificial Sequence
  chemically synthesized
attggaatagtttcagaaggaa

SEQ ID NO: 1023876 - DNA, 22 bp, Artificial Sequence
  chemically synthesized
gaatagtttcagaaggaatggt

SEQ ID NO: 1023877 - DNA, 22 bp, Artificial Sequence
  chemically synthesized
cagaaggaatggtaccagttcc

SEQ ID NO: 1023878 - DNA, 22 bp, Artificial Sequence
  chemically synthesized
agaaggaatggtaccagttcct

SEQ ID NO: 1023879 - DNA, 22 bp, Artificial Sequence
  chemically synthesized
ccagaggtacaaggaggaactg

SEQ ID NO: 1023880 - DNA, 22 bp, Artificial Sequence
  chemically synthesized
taccagaggtacaaggaggaac

SEQ ID NO: 1023881 - DNA, 22 bp, Artificial Sequence
  chemically synthesized
acagccgaattctaccagaggt

SEQ ID NO: 1023882 - DNA, 22 bp, Artificial Sequence
  chemically synthesized
ctccttgtacctctggtagaat

SEQ ID NO: 1023883 - DNA, 22 bp, Artificial Sequence
  chemically synthesized
cttgtacctctggtagaattcg

SEQ ID NO: 1023884 - DNA, 22 bp, Artificial Sequence
  chemically synthesized
gtacctctggtagaattcggct

SEQ ID NO: 1023885 - DNA, 22 bp, Artificial Sequence
  chemically synthesized
tacctctggtagaattcggctg

SEQ ID NO: 1023886 - DNA, 22 bp, Artificial Sequence
  chemically synthesized
tggtagaattcggctgtgaatc

SEQ ID NO: 1023887 - DNA, 22 bp, Artificial Sequence
  chemically synthesized
gtagaattcggctgtgaatcca

SEQ ID NO: 1023888 - DNA, 22 bp, Artificial Sequence
  chemically synthesized
ggctgtgaatccatctggtcct

SEQ ID NO: 1023889 - DNA, 22 bp, Artificial Sequence
  chemically synthesized
tgaatccatctggtcctggact

SEQ ID NO: 1023890 - DNA, 22 bp, Artificial Sequence
  chemically synthesized
ccaaccaaaaagagtccaggac

SEQ ID NO: 1023891 - DNA, 22 bp, Artificial Sequence
  chemically synthesized
accaaccaaaaagagtccagga

SEQ ID NO: 1023892 - DNA, 22 bp, Artificial Sequence
  chemically synthesized
gtcctggactctttttggttgg

SEQ ID NO: 1023893 - DNA, 22 bp, Artificial Sequence
  chemically synthesized
gactctttttggttggtaagct

SEQ ID NO: 1023894 - DNA, 22 bp, Artificial Sequence
  chemically synthesized
tggcaataatcaatagcttacc

SEQ ID NO: 1023895 - DNA, 22 bp, Artificial Sequence
  chemically synthesized
tttttggttggtaagctattga

SEQ ID NO: 1023896 - DNA, 22 bp, Artificial Sequence
  chemically synthesized
tttggttggtaagctattgatt

SEQ ID NO: 1023897 - DNA, 22 bp, Artificial Sequence
  chemically synthesized
ttggttggtaagctattgatta

SEQ ID NO: 1023898 - DNA, 22 bp, Artificial Sequence
  chemically synthesized
aaattgtggcaataatcaatag

SEQ ID NO: 1023899 - DNA, 22 bp, Artificial Sequence
  chemically synthesized
tggttggtaagctattgattat

SEQ ID NO: 1023900 - DNA, 22 bp, Artificial Sequence
  chemically synthesized
ggttggtaagctattgattatt

SEQ ID NO: 1023901 - DNA, 22 bp, Artificial Sequence
  chemically synthesized
gttggtaagctattgattattg

SEQ ID NO: 1023902 - DNA, 22 bp, Artificial Sequence
  chemically synthesized
gtaagctattgattattgccac

SEQ ID NO: 1023903 - DNA, 22 bp, Artificial Sequence
  chemically synthesized
ttgattattgccacaatttcag

SEQ ID NO: 1023904 - DNA, 22 bp, Artificial Sequence
  chemically synthesized
attattgccacaatttcagctc

SEQ ID NO: 1023905 - DNA, 22 bp, Artificial Sequence
  chemically synthesized
ttgccacaatttcagctcctgt

SEQ ID NO: 1023906 - DNA, 22 bp, Artificial Sequence
  chemically synthesized
aatagaccaataacaggagctg

SEQ ID NO: 1023907 - DNA, 22 bp, Artificial Sequence
  chemically synthesized
tgaatagaccaataacaggagc

SEQ ID NO: 1023908 - DNA, 22 bp, Artificial Sequence
  chemically synthesized
ccacaatttcagctcctgttat

SEQ ID NO: 1023909 - DNA, 22 bp, Artificial Sequence
  chemically synthesized
aatctctgaatagaccaataac

SEQ ID NO: 1023910 - DNA, 22 bp, Artificial Sequence
  chemically synthesized
cagctcctgttattggtctatt

SEQ ID NO: 1023911 - DNA, 22 bp, Artificial Sequence
  chemically synthesized
agctcctgttattggtctattc

SEQ ID NO: 1023912 - DNA, 22 bp, Artificial Sequence
  chemically synthesized
ctgttattggtctattcagaga

SEQ ID NO: 1023913 - DNA, 22 bp, Artificial Sequence
  chemically synthesized
ttattggtctattcagagattc

SEQ ID NO: 1023914 - DNA, 22 bp, Artificial Sequence
  chemically synthesized
ttggtctattcagagattcaac

SEQ ID NO: 1023915 - DNA, 22 bp, Artificial Sequence
  chemically synthesized
aaccaggaagaagttgaatctc

SEQ ID NO: 1023916 - DNA, 22 bp, Artificial Sequence
  chemically synthesized
gtctattcagagattcaacttc

SEQ ID NO: 1023917 - DNA, 22 bp, Artificial Sequence
  chemically synthesized
ttcagagattcaacttcttcct

SEQ ID NO: 1023918 - DNA, 22 bp, Artificial Sequence
  chemically synthesized
ccaagactaaaccaggaagaag

SEQ ID NO: 1023919 - DNA, 22 bp, Artificial Sequence
  chemically synthesized
agagattcaacttcttcctggt

SEQ ID NO: 1023920 - DNA, 22 bp, Artificial Sequence
  chemically synthesized
tcccaagactaaaccaggaaga

SEQ ID NO: 1023921 - DNA, 22 bp, Artificial Sequence
  chemically synthesized
aacttcttcctggtttagtctt

SEQ ID NO: 1023922 - DNA, 22 bp, Artificial Sequence
  chemically synthesized
cttcctggtttagtcttgggag

SEQ ID NO: 1023923 - DNA, 22 bp, Artificial Sequence
  chemically synthesized
gacacatacactctcccaagac

SEQ ID NO: 1023924 - DNA, 22 bp, Artificial Sequence
  chemically synthesized
ttcctggtttagtcttgggaga

SEQ ID NO: 1023925 - DNA, 22 bp, Artificial Sequence
  chemically synthesized
cctggtttagtcttgggagagt

SEQ ID NO: 1023926 - DNA, 22 bp, Artificial Sequence
  chemically synthesized
ctcgacacatacactctcccaa

SEQ ID NO: 1023927 - DNA, 22 bp, Artificial Sequence
  chemically synthesized
ctggtttagtcttgggagagtg

SEQ ID NO: 1023928 - DNA, 22 bp, Artificial Sequence
  chemically synthesized
gtttagtcttgggagagtgtat

SEQ ID NO: 1023929 - DNA, 22 bp, Artificial Sequence
  chemically synthesized
agtcttgggagagtgtatgtgt

SEQ ID NO: 1023930 - DNA, 22 bp, Artificial Sequence
  chemically synthesized
gtcttgggagagtgtatgtgtc

SEQ ID NO: 1023931 - DNA, 22 bp, Artificial Sequence
  chemically synthesized
gggagagtgtatgtgtcgagga

SEQ ID NO: 1023932 - DNA, 22 bp, Artificial Sequence
  chemically synthesized
ggagagtgtatgtgtcgaggaa

SEQ ID NO: 1023933 - DNA, 22 bp, Artificial Sequence
  chemically synthesized
gaagaaatggatacattcctcg

SEQ ID NO: 1023934 - DNA, 22 bp, Artificial Sequence
  chemically synthesized
gaaaatctagaagaaatggata

SEQ ID NO: 1023935 - DNA, 22 bp, Artificial Sequence
  chemically synthesized
cacaaataaactagaaaatcta

SEQ ID NO: 1023936 - DNA, 22 bp, Artificial Sequence
  chemically synthesized
tacacaaataaactagaaaatc

SEQ ID NO: 1023937 - DNA, 22 bp, Artificial Sequence
  chemically synthesized
cttctagattttctagtttatt

SEQ ID NO: 1023938 - DNA, 22 bp, Artificial Sequence
  chemically synthesized
ttctagattttctagtttattt

SEQ ID NO: 1023939 - DNA, 22 bp, Artificial Sequence
  chemically synthesized
ctagattttctagtttatttgt

SEQ ID NO: 1023940 - DNA, 22 bp, Artificial Sequence
  chemically synthesized
tagattttctagtttatttgtg

SEQ ID NO: 1023941 - DNA, 22 bp, Artificial Sequence
  chemically synthesized
caaacacctctacacaaataaa

SEQ ID NO: 1023942 - DNA, 22 bp, Artificial Sequence
  chemically synthesized
gattttctagtttatttgtgta

SEQ ID NO: 1023943 - DNA, 22 bp, Artificial Sequence
  chemically synthesized
tctagtttatttgtgtagaggt

SEQ ID NO: 1023944 - DNA, 22 bp, Artificial Sequence
  chemically synthesized
ctagtttatttgtgtagaggtg

SEQ ID NO: 1023945 - DNA, 22 bp, Artificial Sequence
  chemically synthesized
tagtttatttgtgtagaggtgt

SEQ ID NO: 1023946 - DNA, 22 bp, Artificial Sequence
  chemically synthesized
gtttatttgtgtagaggtgttt

SEQ ID NO: 1023947 - DNA, 22 bp, Artificial Sequence
  chemically synthesized
atttgtgtagaggtgtttgtag

SEQ ID NO: 1023948 - DNA, 22 bp, Artificial Sequence
  chemically synthesized
tttgtgtagaggtgtttgtagt

SEQ ID NO: 1023949 - DNA, 22 bp, Artificial Sequence
  chemically synthesized
ccgtcagagaatactacaaaca

SEQ ID NO: 1023950 - DNA, 22 bp, Artificial Sequence
  chemically synthesized
gtgtagaggtgtttgtagtatt

SEQ ID NO: 1023951 - DNA, 22 bp, Artificial Sequence
  chemically synthesized
tgtagaggtgtttgtagtattc

SEQ ID NO: 1023952 - DNA, 22 bp, Artificial Sequence
  chemically synthesized
gtagtattctctgacggtagtt

SEQ ID NO: 1023953 - DNA, 22 bp, Artificial Sequence
  chemically synthesized
tagtattctctgacggtagttt

SEQ ID NO: 1023954 - DNA, 22 bp, Artificial Sequence
  chemically synthesized
tctgacggtagtttgtatttct

SEQ ID NO: 1023955 - DNA, 22 bp, Artificial Sequence
  chemically synthesized
tgacggtagtttgtatttctgt

SEQ ID NO: 1023956 - DNA, 22 bp, Artificial Sequence
  chemically synthesized
acggtagtttgtatttctgtgg

SEQ ID NO: 1023957 - DNA, 22 bp, Artificial Sequence
  chemically synthesized
gtatttctgtgggatcggtggt

SEQ ID NO: 1023958 - DNA, 22 bp, Artificial Sequence
  chemically synthesized
tatttctgtgggatcggtggtg

SEQ ID NO: 1023959 - DNA, 22 bp, Artificial Sequence
  chemically synthesized
acagaagtgatatcaccaccga

SEQ ID NO: 1023960 - DNA, 22 bp, Artificial Sequence
  chemically synthesized
ctgtgggatcggtggtgatatc

SEQ ID NO: 1023961 - DNA, 22 bp, Artificial Sequence
  chemically synthesized
tgtgggatcggtggtgatatca

SEQ ID NO: 1023962 - DNA, 22 bp, Artificial Sequence
  chemically synthesized
tgggatcggtggtgatatcact

SEQ ID NO: 1023963 - DNA, 22 bp, Artificial Sequence
  chemically synthesized
tagagttaacagaagtgatatc

SEQ ID NO: 1023964 - DNA, 22 bp, Artificial Sequence
  chemically synthesized
gtagagttaacagaagtgatat

SEQ ID NO: 1023965 - DNA, 22 bp, Artificial Sequence
  chemically synthesized
acttgtagagttaacagaagtg

SEQ ID NO: 1023966 - DNA, 22 bp, Artificial Sequence
  chemically synthesized
gacttgtagagttaacagaagt

SEQ ID NO: 1023967 - DNA, 22 bp, Artificial Sequence
  chemically synthesized
aggtttgacttgtagagttaac

SEQ ID NO: 1023968 - DNA, 22 bp, Artificial Sequence
  chemically synthesized
caggtttgacttgtagagttaa

SEQ ID NO: 1023969 - DNA, 22 bp, Artificial Sequence
  chemically synthesized
ctgttaactctacaagtcaaac

SEQ ID NO: 1023970 - DNA, 22 bp, Artificial Sequence
  chemically synthesized
tgttaactctacaagtcaaacc

SEQ ID NO: 1023971 - DNA, 22 bp, Artificial Sequence
  chemically synthesized
ttaactctacaagtcaaacctg

SEQ ID NO: 1023972 - DNA, 22 bp, Artificial Sequence
  chemically synthesized
tgagccatgatttcaggtttga

SEQ ID NO: 1023973 - DNA, 22 bp, Artificial Sequence
  chemically synthesized
actctacaagtcaaacctgaaa

SEQ ID NO: 1023974 - DNA, 22 bp, Artificial Sequence
  chemically synthesized
gttgtgagccatgatttcaggt

SEQ ID NO: 1023975 - DNA, 22 bp, Artificial Sequence
  chemically synthesized
tacaagtcaaacctgaaatcat

SEQ ID NO: 1023976 - DNA, 22 bp, Artificial Sequence
  chemically synthesized
caagtcaaacctgaaatcatgg

SEQ ID NO: 1023977 - DNA, 22 bp, Artificial Sequence
  chemically synthesized
ggtggtgctggttgtgagccat

SEQ ID NO: 1023978 - DNA, 22 bp, Artificial Sequence
  chemically synthesized
acattaggtggtgctggttgtg

SEQ ID NO: 1023979 - DNA, 22 bp, Artificial Sequence
  chemically synthesized
aaatcatggctcacaaccagca

SEQ ID NO: 1023980 - DNA, 22 bp, Artificial Sequence
  chemically synthesized
caatgcctgacattaggtggtg

SEQ ID NO: 1023981 - DNA, 22 bp, Artificial Sequence
  chemically synthesized
acaaccagcaccacctaatgtc

SEQ ID NO: 1023982 - DNA, 22 bp, Artificial Sequence
  chemically synthesized
catatgcaattccaatgcctga

SEQ ID NO: 1023983 - DNA, 22 bp, Artificial Sequence
  chemically synthesized
tacatatgcaattccaatgcct

SEQ ID NO: 1023984 - DNA, 22 bp, Artificial Sequence
  chemically synthesized
ggctctacatatgcaattccaa

SEQ ID NO: 1023985 - DNA, 22 bp, Artificial Sequence
  chemically synthesized
atgtcaggcattggaattgcat

SEQ ID NO: 1023986 - DNA, 22 bp, Artificial Sequence
  chemically synthesized
tgggctctacatatgcaattcc

SEQ ID NO: 1023987 - DNA, 22 bp, Artificial Sequence
  chemically synthesized
gaattgcatatgtagagcccag

SEQ ID NO: 1023988 - DNA, 22 bp, Artificial Sequence
  chemically synthesized
catatgtagagcccagaattgg

SEQ ID NO: 1023989 - DNA, 22 bp, Artificial Sequence
  chemically synthesized
aagtacgtggaaaaccaattct

SEQ ID NO: 1023990 - DNA, 22 bp, Artificial Sequence
  chemically synthesized
tgaagtacgtggaaaaccaatt

SEQ ID NO: 1023991 - DNA, 22 bp, Artificial Sequence
  chemically synthesized
actctgaagtacgtggaaaacc

SEQ ID NO: 1023992 - DNA, 22 bp, Artificial Sequence
  chemically synthesized
gactctgaagtacgtggaaaac

SEQ ID NO: 1023993 - DNA, 22 bp, Artificial Sequence
  chemically synthesized
acatttgactctgaagtacgtg

SEQ ID NO: 1023994 - DNA, 22 bp, Artificial Sequence
  chemically synthesized
cacatttgactctgaagtacgt

SEQ ID NO: 1023995 - DNA, 22 bp, Artificial Sequence
  chemically synthesized
gcttcacatttgactctgaagt

SEQ ID NO: 1023996 - DNA, 22 bp, Artificial Sequence
  chemically synthesized
gttttccacgtacttcagagtc

SEQ ID NO: 1023997 - DNA, 22 bp, Artificial Sequence
  chemically synthesized
agcttcacatttgactctgaag

SEQ ID NO: 1023998 - DNA, 22 bp, Artificial Sequence
  chemically synthesized
tccacgtacttcagagtcaaat

SEQ ID NO: 1023999 - DNA, 22 bp, Artificial Sequence
  chemically synthesized
ccacgtacttcagagtcaaatg

SEQ ID NO: 1024000 - DNA, 22 bp, Artificial Sequence
  chemically synthesized
cacgtacttcagagtcaaatgt

SEQ ID NO: 1024001 - DNA, 22 bp, Artificial Sequence
  chemically synthesized
cagagtcaaatgtgaagctaaa

SEQ ID NO: 1024002 - DNA, 22 bp, Artificial Sequence
  chemically synthesized
agagtcaaatgtgaagctaaat

SEQ ID NO: 1024003 - DNA, 22 bp, Artificial Sequence
  chemically synthesized
tagggtgtgtgggtgtgtgtgc

SEQ ID NO: 1024004 - DNA, 22 bp, Artificial Sequence
  chemically synthesized
aatgcacacacacccacacacc

SEQ ID NO: 1024005 - DNA, 22 bp, Artificial Sequence
  chemically synthesized
gccatatctgtagggtgtgtgg

SEQ ID NO: 1024006 - DNA, 22 bp, Artificial Sequence
  chemically synthesized
gggtgggtcctggccatatctg

SEQ ID NO: 1024007 - DNA, 22 bp, Artificial Sequence
  chemically synthesized
gtctggggtgggtcctggccat

SEQ ID NO: 1024008 - DNA, 22 bp, Artificial Sequence
  chemically synthesized
ggtctggggtgggtcctggcca

SEQ ID NO: 1024009 - DNA, 22 bp, Artificial Sequence
  chemically synthesized
tttggtctggggtgggtcctgg

SEQ ID NO: 1024010 - DNA, 22 bp, Artificial Sequence
  chemically synthesized
cagatatggccaggacccaccc

SEQ ID NO: 1024011 - DNA, 22 bp, Artificial Sequence
  chemically synthesized
gttatttggtctggggtgggtc

SEQ ID NO: 1024012 - DNA, 22 bp, Artificial Sequence
  chemically synthesized
gatatcctggttatttggtctg

SEQ ID NO: 1024013 - DNA, 22 bp, Artificial Sequence
  chemically synthesized
taaaaataaattagatatcctg

SEQ ID NO: 1024014 - DNA, 22 bp, Artificial Sequence
  chemically synthesized
catggctataaaaataaattag

SEQ ID NO: 1024015 - DNA, 22 bp, Artificial Sequence
  chemically synthesized
cctacatggctataaaaataaa

SEQ ID NO: 1024016 - DNA, 22 bp, Artificial Sequence
  chemically synthesized
aattacctacatggctataaaa

SEQ ID NO: 1024017 - DNA, 22 bp, Artificial Sequence
  chemically synthesized
aaattacctacatggctataaa

SEQ ID NO: 1024018 - DNA, 22 bp, Artificial Sequence
  chemically synthesized
atttatttttatagccatgtag

SEQ ID NO: 1024019 - DNA, 22 bp, Artificial Sequence
  chemically synthesized
aatttaaattacctacatggct

SEQ ID NO: 1024020 - DNA, 22 bp, Artificial Sequence
  chemically synthesized
atttttatagccatgtaggtaa

SEQ ID NO: 1024021 - DNA, 22 bp, Artificial Sequence
  chemically synthesized
tttttatagccatgtaggtaat

SEQ ID NO: 1024022 - DNA, 22 bp, Artificial Sequence
  chemically synthesized
ttatagccatgtaggtaattta

SEQ ID NO: 1024023 - DNA, 22 bp, Artificial Sequence
  chemically synthesized
aacaactgaatttaaattacct

SEQ ID NO: 1024024 - DNA, 22 bp, Artificial Sequence
  chemically synthesized
tatagccatgtaggtaatttaa

SEQ ID NO: 1024025 - DNA, 22 bp, Artificial Sequence
  chemically synthesized
atagccatgtaggtaatttaaa

SEQ ID NO: 1024026 - DNA, 22 bp, Artificial Sequence
  chemically synthesized
tagccatgtaggtaatttaaat

SEQ ID NO: 1024027 - DNA, 22 bp, Artificial Sequence
  chemically synthesized
gttcaacaactgaatttaaatt

SEQ ID NO: 1024028 - DNA, 22 bp, Artificial Sequence
  chemically synthesized
ggttcaacaactgaatttaaat

SEQ ID NO: 1024029 - DNA, 22 bp, Artificial Sequence
  chemically synthesized
aaacttggttcaacaactgaat

SEQ ID NO: 1024030 - DNA, 22 bp, Artificial Sequence
  chemically synthesized
caaacttggttcaacaactgaa

SEQ ID NO: 1024031 - DNA, 22 bp, Artificial Sequence
  chemically synthesized
tcaaacttggttcaacaactga

SEQ ID NO: 1024032 - DNA, 22 bp, Artificial Sequence
  chemically synthesized
aaattcagttgttgaaccaagt

SEQ ID NO: 1024033 - DNA, 22 bp, Artificial Sequence
  chemically synthesized
aattcagttgttgaaccaagtt

SEQ ID NO: 1024034 - DNA, 22 bp, Artificial Sequence
  chemically synthesized
acaatcgttttcaaacttggtt

SEQ ID NO: 1024035 - DNA, 22 bp, Artificial Sequence
  chemically synthesized
gacaatcgttttcaaacttggt

SEQ ID NO: 1024036 - DNA, 22 bp, Artificial Sequence
  chemically synthesized
tgacaatcgttttcaaacttgg

SEQ ID NO: 1024037 - DNA, 22 bp, Artificial Sequence
  chemically synthesized
agttgttgaaccaagtttgaaa

SEQ ID NO: 1024038 - DNA, 22 bp, Artificial Sequence
  chemically synthesized
tttgacaatcgttttcaaactt

SEQ ID NO: 1024039 - DNA, 22 bp, Artificial Sequence
  chemically synthesized
ctttgacaatcgttttcaaact

SEQ ID NO: 1024040 - DNA, 22 bp, Artificial Sequence
  chemically synthesized
tctttgacaatcgttttcaaac

SEQ ID NO: 1024041 - DNA, 22 bp, Artificial Sequence
  chemically synthesized
tttctttgacaatcgttttcaa

SEQ ID NO: 1024042 - DNA, 22 bp, Artificial Sequence
  chemically synthesized
ttgaaccaagtttgaaaacgat

SEQ ID NO: 1024043 - DNA, 22 bp, Artificial Sequence
  chemically synthesized
aaccaagtttgaaaacgattgt

SEQ ID NO: 1024044 - DNA, 22 bp, Artificial Sequence
  chemically synthesized
cagtaatacctctttctttgac

SEQ ID NO: 1024045 - DNA, 22 bp, Artificial Sequence
  chemically synthesized
gaaaacgattgtcaaagaaaga

SEQ ID NO: 1024046 - DNA, 22 bp, Artificial Sequence
  chemically synthesized
aaaacgattgtcaaagaaagag

SEQ ID NO: 1024047 - DNA, 22 bp, Artificial Sequence
  chemically synthesized
aaatcagaattacagtaatacc

SEQ ID NO: 1024048 - DNA, 22 bp, Artificial Sequence
  chemically synthesized
tcaaagaaagaggtattactgt

SEQ ID NO: 1024049 - DNA, 22 bp, Artificial Sequence
  chemically synthesized
aaaatcagaattacagtaatac

SEQ ID NO: 1024050 - DNA, 22 bp, Artificial Sequence
  chemically synthesized
taaaatcagaattacagtaata

SEQ ID NO: 1024051 - DNA, 22 bp, Artificial Sequence
  chemically synthesized
atgatgtaaaattttaaaatca

SEQ ID NO: 1024052 - DNA, 22 bp, Artificial Sequence
  chemically synthesized
catgatgtaaaattttaaaatc

SEQ ID NO: 1024053 - DNA, 22 bp, Artificial Sequence
  chemically synthesized
tcatgatgtaaaattttaaaat

SEQ ID NO: 1024054 - DNA, 22 bp, Artificial Sequence
  chemically synthesized
ctgtaattctgattttaaaatt

SEQ ID NO: 1024055 - DNA, 22 bp, Artificial Sequence
  chemically synthesized
taattctgattttaaaatttta

SEQ ID NO: 1024056 - DNA, 22 bp, Artificial Sequence
  chemically synthesized
aagattttcatgatgtaaaatt

SEQ ID NO: 1024057 - DNA, 22 bp, Artificial Sequence
  chemically synthesized
gaagattttcatgatgtaaaat

SEQ ID NO: 1024058 - DNA, 22 bp, Artificial Sequence
  chemically synthesized
tgaagattttcatgatgtaaaa

SEQ ID NO: 1024059 - DNA, 22 bp, Artificial Sequence
  chemically synthesized
tgattttaaaattttacatcat

SEQ ID NO: 1024060 - DNA, 22 bp, Artificial Sequence
  chemically synthesized
attttaaaattttacatcatga

SEQ ID NO: 1024061 - DNA, 22 bp, Artificial Sequence
  chemically synthesized
taaaattttacatcatgaaaat

SEQ ID NO: 1024062 - DNA, 22 bp, Artificial Sequence
  chemically synthesized
aaaattttacatcatgaaaatc

SEQ ID NO: 1024063 - DNA, 22 bp, Artificial Sequence
  chemically synthesized
aaattttacatcatgaaaatct

SEQ ID NO: 1024064 - DNA, 22 bp, Artificial Sequence
  chemically synthesized
tatatgtctttgaagattttca

SEQ ID NO: 1024065 - DNA, 22 bp, Artificial Sequence
  chemically synthesized
atatatgtctttgaagattttc

SEQ ID NO: 1024066 - DNA, 22 bp, Artificial Sequence
  chemically synthesized
cttatatatgtctttgaagatt

SEQ ID NO: 1024067 - DNA, 22 bp, Artificial Sequence
  chemically synthesized
tacatcatgaaaatcttcaaag

SEQ ID NO: 1024068 - DNA, 22 bp, Artificial Sequence
  chemically synthesized
acttatatatgtctttgaagat

SEQ ID NO: 1024069 - DNA, 22 bp, Artificial Sequence
  chemically synthesized
acatcatgaaaatcttcaaaga

SEQ ID NO: 1024070 - DNA, 22 bp, Artificial Sequence
  chemically synthesized
tacttatatatgtctttgaaga

SEQ ID NO: 1024071 - DNA, 22 bp, Artificial Sequence
  chemically synthesized
catcatgaaaatcttcaaagac

SEQ ID NO: 1024072 - DNA, 22 bp, Artificial Sequence
  chemically synthesized
tttacttatatatgtctttgaa

SEQ ID NO: 1024073 - DNA, 22 bp, Artificial Sequence
  chemically synthesized
tctttacttatatatgtctttg

SEQ ID NO: 1024074 - DNA, 22 bp, Artificial Sequence
  chemically synthesized
ttctctttacttatatatgtct

SEQ ID NO: 1024075 - DNA, 22 bp, Artificial Sequence
  chemically synthesized
caaagacatatataagtaaaga

SEQ ID NO: 1024076 - DNA, 22 bp, Artificial Sequence
  chemically synthesized
aaagacatatataagtaaagag

SEQ ID NO: 1024077 - DNA, 22 bp, Artificial Sequence
  chemically synthesized
aaggtggtgacaggtgcatggg

SEQ ID NO: 1024078 - DNA, 22 bp, Artificial Sequence
  chemically synthesized
ctcaaggtggtgacaggtgcat

SEQ ID NO: 1024079 - DNA, 22 bp, Artificial Sequence
  chemically synthesized
tggacccccatgcacctgtcac

SEQ ID NO: 1024080 - DNA, 22 bp, Artificial Sequence
  chemically synthesized
ataattgctcaaggtggtgaca

SEQ ID NO: 1024081 - DNA, 22 bp, Artificial Sequence
  chemically synthesized
gcaaatgttgataattgctcaa

SEQ ID NO: 1024082 - DNA, 22 bp, Artificial Sequence
  chemically synthesized
tcaccaccttgagcaattatca

SEQ ID NO: 1024083 - DNA, 22 bp, Artificial Sequence
  chemically synthesized
aacaagattcgcaaatgttgat

SEQ ID NO: 1024084 - DNA, 22 bp, Artificial Sequence
  chemically synthesized
gagcaattatcaacatttgcga

SEQ ID NO: 1024085 - DNA, 22 bp, Artificial Sequence
  chemically synthesized
agcaattatcaacatttgcgaa

SEQ ID NO: 1024086 - DNA, 22 bp, Artificial Sequence
  chemically synthesized
tcaacatttgcgaatcttgttt

SEQ ID NO: 1024087 - DNA, 22 bp, Artificial Sequence
  chemically synthesized
gcgaatcttgtttaatcttcct

SEQ ID NO: 1024088 - DNA, 22 bp, Artificial Sequence
  chemically synthesized
cgaatcttgtttaatcttcctc

SEQ ID NO: 1024089 - DNA, 22 bp, Artificial Sequence
  chemically synthesized
atataaagagcaatggaggaag

SEQ ID NO: 1024090 - DNA, 22 bp, Artificial Sequence
  chemically synthesized
aatataaagagcaatggaggaa

SEQ ID NO: 1024091 - DNA, 22 bp, Artificial Sequence
  chemically synthesized
taatataaagagcaatggagga

SEQ ID NO: 1024092 - DNA, 22 bp, Artificial Sequence
  chemically synthesized
ttaatataaagagcaatggagg

SEQ ID NO: 1024093 - DNA, 22 bp, Artificial Sequence
  chemically synthesized
gtttaatcttcctccattgctc

SEQ ID NO: 1024094 - DNA, 22 bp, Artificial Sequence
  chemically synthesized
tttaatcttcctccattgctct

SEQ ID NO: 1024095 - DNA, 22 bp, Artificial Sequence
  chemically synthesized
tttttaatataaagagcaatgg

SEQ ID NO: 1024096 - DNA, 22 bp, Artificial Sequence
  chemically synthesized
aatcttcctccattgctcttta

SEQ ID NO: 1024097 - DNA, 22 bp, Artificial Sequence
  chemically synthesized
atcttcctccattgctctttat

SEQ ID NO: 1024098 - DNA, 22 bp, Artificial Sequence
  chemically synthesized
cctccattgctctttatattaa

SEQ ID NO: 1024099 - DNA, 22 bp, Artificial Sequence
  chemically synthesized
ctccattgctctttatattaaa

SEQ ID NO: 1024100 - DNA, 22 bp, Artificial Sequence
  chemically synthesized
caaggaaattatttttaatata

SEQ ID NO: 1024101 - DNA, 22 bp, Artificial Sequence
  chemically synthesized
ccaaggaaattatttttaatat

SEQ ID NO: 1024102 - DNA, 22 bp, Artificial Sequence
  chemically synthesized
cattgctctttatattaaaaat

SEQ ID NO: 1024103 - DNA, 22 bp, Artificial Sequence
  chemically synthesized
ctctttatattaaaaataattt

SEQ ID NO: 1024104 - DNA, 22 bp, Artificial Sequence
  chemically synthesized
acaaacttccaaggaaattatt

SEQ ID NO: 1024105 - DNA, 22 bp, Artificial Sequence
  chemically synthesized
tttatattaaaaataatttcct

SEQ ID NO: 1024106 - DNA, 22 bp, Artificial Sequence
  chemically synthesized
gacaaacttccaaggaaattat

SEQ ID NO: 1024107 - DNA, 22 bp, Artificial Sequence
  chemically synthesized
tgacaaacttccaaggaaatta

SEQ ID NO: 1024108 - DNA, 22 bp, Artificial Sequence
  chemically synthesized
tatattaaaaataatttccttg

SEQ ID NO: 1024109 - DNA, 22 bp, Artificial Sequence
  chemically synthesized
atattaaaaataatttccttgg

SEQ ID NO: 1024110 - DNA, 22 bp, Artificial Sequence
  chemically synthesized
tattaaaaataatttccttgga

SEQ ID NO: 1024111 - DNA, 22 bp, Artificial Sequence
  chemically synthesized
ttttgacaaacttccaaggaaa

SEQ ID NO: 1024112 - DNA, 22 bp, Artificial Sequence
  chemically synthesized
gttttgacaaacttccaaggaa

SEQ ID NO: 1024113 - DNA, 22 bp, Artificial Sequence
  chemically synthesized
tgttttgacaaacttccaagga

SEQ ID NO: 1024114 - DNA, 22 bp, Artificial Sequence
  chemically synthesized
aaaataatttccttggaagttt

SEQ ID NO: 1024115 - DNA, 22 bp, Artificial Sequence
  chemically synthesized
gtgggttttgttttgacaaact

SEQ ID NO: 1024116 - DNA, 22 bp, Artificial Sequence
  chemically synthesized
ccttggaagtttgtcaaaacaa

SEQ ID NO: 1024117 - DNA, 22 bp, Artificial Sequence
  chemically synthesized
cttggaagtttgtcaaaacaaa

SEQ ID NO: 1024118 - DNA, 22 bp, Artificial Sequence
  chemically synthesized
ggaagtttgtcaaaacaaaacc

SEQ ID NO: 1024119 - DNA, 22 bp, Artificial Sequence
  chemically synthesized
gaagtttgtcaaaacaaaaccc

SEQ ID NO: 1024120 - DNA, 22 bp, Artificial Sequence
  chemically synthesized
gtcaaaacaaaacccacgaatc

SEQ ID NO: 1024121 - DNA, 22 bp, Artificial Sequence
  chemically synthesized
tcaaaacaaaacccacgaatca

SEQ ID NO: 1024122 - DNA, 22 bp, Artificial Sequence
  chemically synthesized
aggtgaagtaatgtgattcgtg

SEQ ID NO: 1024123 - DNA, 22 bp, Artificial Sequence
  chemically synthesized
caggtgaagtaatgtgattcgt

SEQ ID NO: 1024124 - DNA, 22 bp, Artificial Sequence
  chemically synthesized
tcaggtgaagtaatgtgattcg

SEQ ID NO: 1024125 - DNA, 22 bp, Artificial Sequence
  chemically synthesized
gatacatgccaaagtattttca

SEQ ID NO: 1024126 - DNA, 22 bp, Artificial Sequence
  chemically synthesized
tagatacatgccaaagtatttt

SEQ ID NO: 1024127 - DNA, 22 bp, Artificial Sequence
  chemically synthesized
cttcacctgaaaatactttggc

SEQ ID NO: 1024128 - DNA, 22 bp, Artificial Sequence
  chemically synthesized
cacctgaaaatactttggcatg

SEQ ID NO: 1024129 - DNA, 22 bp, Artificial Sequence
  chemically synthesized
acctgaaaatactttggcatgt

SEQ ID NO: 1024130 - DNA, 22 bp, Artificial Sequence
  chemically synthesized
aagagaaattctagatacatgc

SEQ ID NO: 1024131 - DNA, 22 bp, Artificial Sequence
  chemically synthesized
aaaatactttggcatgtatcta

SEQ ID NO: 1024132 - DNA, 22 bp, Artificial Sequence
  chemically synthesized
aaagagaaattctagatacatg

SEQ ID NO: 1024133 - DNA, 22 bp, Artificial Sequence
  chemically synthesized
tttaaagagaaattctagatac

SEQ ID NO: 1024134 - DNA, 22 bp, Artificial Sequence
  chemically synthesized
tgctatttaaagagaaattcta

SEQ ID NO: 1024135 - DNA, 22 bp, Artificial Sequence
  chemically synthesized
tggcatgtatctagaatttctc

SEQ ID NO: 1024136 - DNA, 22 bp, Artificial Sequence
  chemically synthesized
ggcatgtatctagaatttctct

SEQ ID NO: 1024137 - DNA, 22 bp, Artificial Sequence
  chemically synthesized
gcatgtatctagaatttctctt

SEQ ID NO: 1024138 - DNA, 22 bp, Artificial Sequence
  chemically synthesized
taatagattgtgctatttaaag

SEQ ID NO: 1024139 - DNA, 22 bp, Artificial Sequence
  chemically synthesized
ctataatagattgtgctattta

SEQ ID NO: 1024140 - DNA, 22 bp, Artificial Sequence
  chemically synthesized
gaatttctctttaaatagcaca

SEQ ID NO: 1024141 - DNA, 22 bp, Artificial Sequence
  chemically synthesized
ctactataatagattgtgctat

SEQ ID NO: 1024142 - DNA, 22 bp, Artificial Sequence
  chemically synthesized
ttgctactataatagattgtgc

SEQ ID NO: 1024143 - DNA, 22 bp, Artificial Sequence
  chemically synthesized
ctctttaaatagcacaatctat

SEQ ID NO: 1024144 - DNA, 22 bp, Artificial Sequence
  chemically synthesized
attgctactataatagattgtg

SEQ ID NO: 1024145 - DNA, 22 bp, Artificial Sequence
  chemically synthesized
tctttaaatagcacaatctatt

SEQ ID NO: 1024146 - DNA, 22 bp, Artificial Sequence
  chemically synthesized
tttaaatagcacaatctattat

SEQ ID NO: 1024147 - DNA, 22 bp, Artificial Sequence
  chemically synthesized
taaatagcacaatctattatag

SEQ ID NO: 1024148 - DNA, 22 bp, Artificial Sequence
  chemically synthesized
aaatagcacaatctattatagt

SEQ ID NO: 1024149 - DNA, 22 bp, Artificial Sequence
  chemically synthesized
gcatttattgctactataatag

SEQ ID NO: 1024150 - DNA, 22 bp, Artificial Sequence
  chemically synthesized
aatagcacaatctattatagta

SEQ ID NO: 1024151 - DNA, 22 bp, Artificial Sequence
  chemically synthesized
ggcatttattgctactataata

SEQ ID NO: 1024152 - DNA, 22 bp, Artificial Sequence
  chemically synthesized
tggcatttattgctactataat

SEQ ID NO: 1024153 - DNA, 22 bp, Artificial Sequence
  chemically synthesized
ttggcatttattgctactataa

SEQ ID NO: 1024154 - DNA, 22 bp, Artificial Sequence
  chemically synthesized
acgatttttggcatttattgct

SEQ ID NO: 1024155 - DNA, 22 bp, Artificial Sequence
  chemically synthesized
aacgatttttggcatttattgc

SEQ ID NO: 1024156 - DNA, 22 bp, Artificial Sequence
  chemically synthesized
ttatagtagcaataaatgccaa

SEQ ID NO: 1024157 - DNA, 22 bp, Artificial Sequence
  chemically synthesized
tagtagcaataaatgccaaaaa

SEQ ID NO: 1024158 - DNA, 22 bp, Artificial Sequence
  chemically synthesized
aaagaaatacttaacgattttt

SEQ ID NO: 1024159 - DNA, 22 bp, Artificial Sequence
  chemically synthesized
aaaagaaatacttaacgatttt

SEQ ID NO: 1024160 - DNA, 22 bp, Artificial Sequence
  chemically synthesized
aatatttaaaagaaatacttaa

SEQ ID NO: 1024161 - DNA, 22 bp, Artificial Sequence
  chemically synthesized
gctcaatatttaaaagaaatac

SEQ ID NO: 1024162 - DNA, 22 bp, Artificial Sequence
  chemically synthesized
agtatttcttttaaatattgag

SEQ ID NO: 1024163 - DNA, 22 bp, Artificial Sequence
  chemically synthesized
ccatcatatctggctcaatatt

SEQ ID NO: 1024164 - DNA, 22 bp, Artificial Sequence
  chemically synthesized
cttttaaatattgagccagata

SEQ ID NO: 1024165 - DNA, 22 bp, Artificial Sequence
  chemically synthesized
ttttaaatattgagccagatat

SEQ ID NO: 1024166 - DNA, 22 bp, Artificial Sequence
  chemically synthesized
ttaaatattgagccagatatga

SEQ ID NO: 1024167 - DNA, 22 bp, Artificial Sequence
  chemically synthesized
cagcaactaccatcatatctgg

SEQ ID NO: 1024168 - DNA, 22 bp, Artificial Sequence
  chemically synthesized
taaatattgagccagatatgat

SEQ ID NO: 1024169 - DNA, 22 bp, Artificial Sequence
  chemically synthesized
aaatattgagccagatatgatg

SEQ ID NO: 1024170 - DNA, 22 bp, Artificial Sequence
  chemically synthesized
aatattgagccagatatgatgg

SEQ ID NO: 1024171 - DNA, 22 bp, Artificial Sequence
  chemically synthesized
acatctgcagcaactaccatca

SEQ ID NO: 1024172 - DNA, 22 bp, Artificial Sequence
  chemically synthesized
cacatctgcagcaactaccatc

SEQ ID NO: 1024173 - DNA, 22 bp, Artificial Sequence
  chemically synthesized
tcacatctgcagcaactaccat

SEQ ID NO: 1024174 - DNA, 22 bp, Artificial Sequence
  chemically synthesized
agccagatatgatggtagttgc

SEQ ID NO: 1024175 - DNA, 22 bp, Artificial Sequence
  chemically synthesized
ttcacatctgcagcaactacca

SEQ ID NO: 1024176 - DNA, 22 bp, Artificial Sequence
  chemically synthesized
aggtttttcacatctgcagcaa

SEQ ID NO: 1024177 - DNA, 22 bp, Artificial Sequence
  chemically synthesized
tcactaaggtttttcacatctg

SEQ ID NO: 1024178 - DNA, 22 bp, Artificial Sequence
  chemically synthesized
ctgcagatgtgaaaaaccttag

SEQ ID NO: 1024179 - DNA, 22 bp, Artificial Sequence
  chemically synthesized
aaaaataattgtcactaaggtt

SEQ ID NO: 1024180 - DNA, 22 bp, Artificial Sequence
  chemically synthesized
cagatgtgaaaaaccttagtga

SEQ ID NO: 1024181 - DNA, 22 bp, Artificial Sequence
  chemically synthesized
tgtaagataaaattaaaaaata

SEQ ID NO: 1024182 - DNA, 22 bp, Artificial Sequence
  chemically synthesized
atgtaagataaaattaaaaaat

SEQ ID NO: 1024183 - DNA, 22 bp, Artificial Sequence
  chemically synthesized
tatgtaagataaaattaaaaaa

SEQ ID NO: 1024184 - DNA, 22 bp, Artificial Sequence
  chemically synthesized
agtgacaattattttttaattt

SEQ ID NO: 1024185 - DNA, 22 bp, Artificial Sequence
  chemically synthesized
gtgacaattattttttaatttt

SEQ ID NO: 1024186 - DNA, 22 bp, Artificial Sequence
  chemically synthesized
gctttatgtaagataaaattaa

SEQ ID NO: 1024187 - DNA, 22 bp, Artificial Sequence
  chemically synthesized
actggctttatgtaagataaaa

SEQ ID NO: 1024188 - DNA, 22 bp, Artificial Sequence
  chemically synthesized
ttttttaattttatcttacata

SEQ ID NO: 1024189 - DNA, 22 bp, Artificial Sequence
  chemically synthesized
aatctaactggctttatgtaag

SEQ ID NO: 1024190 - DNA, 22 bp, Artificial Sequence
  chemically synthesized
tttaattttatcttacataaag

SEQ ID NO: 1024191 - DNA, 22 bp, Artificial Sequence
  chemically synthesized
ttaattttatcttacataaagc

SEQ ID NO: 1024192 - DNA, 22 bp, Artificial Sequence
  chemically synthesized
tgaatctaactggctttatgta

SEQ ID NO: 1024193 - DNA, 22 bp, Artificial Sequence
  chemically synthesized
taattttatcttacataaagcc

SEQ ID NO: 1024194 - DNA, 22 bp, Artificial Sequence
  chemically synthesized
aattttatcttacataaagcca

SEQ ID NO: 1024195 - DNA, 22 bp, Artificial Sequence
  chemically synthesized
attttatcttacataaagccag

SEQ ID NO: 1024196 - DNA, 22 bp, Artificial Sequence
  chemically synthesized
tatcttacataaagccagttag

SEQ ID NO: 1024197 - DNA, 22 bp, Artificial Sequence
  chemically synthesized
atcttacataaagccagttaga

SEQ ID NO: 1024198 - DNA, 22 bp, Artificial Sequence
  chemically synthesized
tcttacataaagccagttagat

SEQ ID NO: 1024199 - DNA, 22 bp, Artificial Sequence
  chemically synthesized
acataaagccagttagattcag

SEQ ID NO: 1024200 - DNA, 22 bp, Artificial Sequence
  chemically synthesized
cataaagccagttagattcaga

SEQ ID NO: 1024201 - DNA, 22 bp, Artificial Sequence
  chemically synthesized
accaaatgtgtctctgaatcta

SEQ ID NO: 1024202 - DNA, 22 bp, Artificial Sequence
  chemically synthesized
gaccaaatgtgtctctgaatct

SEQ ID NO: 1024203 - DNA, 22 bp, Artificial Sequence
  chemically synthesized
gattcagagacacatttggtca

SEQ ID NO: 1024204 - DNA, 22 bp, Artificial Sequence
  chemically synthesized
agagacacatttggtcaaactt

SEQ ID NO: 1024205 - DNA, 22 bp, Artificial Sequence
  chemically synthesized
tatgtcaaggacaaagtttgac

SEQ ID NO: 1024206 - DNA, 22 bp, Artificial Sequence
  chemically synthesized
atatgtcaaggacaaagtttga

SEQ ID NO: 1024207 - DNA, 22 bp, Artificial Sequence
  chemically synthesized
tttatatgtcaaggacaaagtt

SEQ ID NO: 1024208 - DNA, 22 bp, Artificial Sequence
  chemically synthesized
ggtcaaactttgtccttgacat

SEQ ID NO: 1024209 - DNA, 22 bp, Artificial Sequence
  chemically synthesized
gtcaaactttgtccttgacata

SEQ ID NO: 1024210 - DNA, 22 bp, Artificial Sequence
  chemically synthesized
ggaaagaaacactatttatatg

SEQ ID NO: 1024211 - DNA, 22 bp, Artificial Sequence
  chemically synthesized
aggaaagaaacactatttatat

SEQ ID NO: 1024212 - DNA, 22 bp, Artificial Sequence
  chemically synthesized
tgtccttgacatataaatagtg

SEQ ID NO: 1024213 - DNA, 22 bp, Artificial Sequence
  chemically synthesized
gtccttgacatataaatagtgt

SEQ ID NO: 1024214 - DNA, 22 bp, Artificial Sequence
  chemically synthesized
tccttgacatataaatagtgtt

SEQ ID NO: 1024215 - DNA, 22 bp, Artificial Sequence
  chemically synthesized
gacatataaatagtgtttcttt

SEQ ID NO: 1024216 - DNA, 22 bp, Artificial Sequence
  chemically synthesized
acatataaatagtgtttctttc

SEQ ID NO: 1024217 - DNA, 22 bp, Artificial Sequence
  chemically synthesized
accagataatggaaagtttagg

SEQ ID NO: 1024218 - DNA, 22 bp, Artificial Sequence
  chemically synthesized
ctttcctaaactttccattatc

SEQ ID NO: 1024219 - DNA, 22 bp, Artificial Sequence
  chemically synthesized
tttcctaaactttccattatct

SEQ ID NO: 1024220 - DNA, 22 bp, Artificial Sequence
  chemically synthesized
ggagaaattaaccagataatgg

SEQ ID NO: 1024221 - DNA, 22 bp, Artificial Sequence
  chemically synthesized
tcctaaactttccattatctgg

SEQ ID NO: 1024222 - DNA, 22 bp, Artificial Sequence
  chemically synthesized
aggagaaattaaccagataatg

SEQ ID NO: 1024223 - DNA, 22 bp, Artificial Sequence
  chemically synthesized
cctaaactttccattatctggt

SEQ ID NO: 1024224 - DNA, 22 bp, Artificial Sequence
  chemically synthesized
ctaaactttccattatctggtt

SEQ ID NO: 1024225 - DNA, 22 bp, Artificial Sequence
  chemically synthesized
aactttccattatctggttaat

SEQ ID NO: 1024226 - DNA, 22 bp, Artificial Sequence
  chemically synthesized
tccattatctggttaatttctc

SEQ ID NO: 1024227 - DNA, 22 bp, Artificial Sequence
  chemically synthesized
ccattatctggttaatttctcc

SEQ ID NO: 1024228 - DNA, 22 bp, Artificial Sequence
  chemically synthesized
cattatctggttaatttctcct

SEQ ID NO: 1024229 - DNA, 22 bp, Artificial Sequence
  chemically synthesized
tctggttaatttctcctaaact

SEQ ID NO: 1024230 - DNA, 22 bp, Artificial Sequence
  chemically synthesized
tccagataatggaaagtttagg

SEQ ID NO: 1024231 - DNA, 22 bp, Artificial Sequence
  chemically synthesized
gttaatttctcctaaactttcc

SEQ ID NO: 1024232 - DNA, 22 bp, Artificial Sequence
  chemically synthesized
atttctcctaaactttccatta

SEQ ID NO: 1024233 - DNA, 22 bp, Artificial Sequence
  chemically synthesized
ctcctaaactttccattatctg

SEQ ID NO: 1024234 - DNA, 22 bp, Artificial Sequence
  chemically synthesized
tcctaaactttccattatctgg

SEQ ID NO: 1024235 - DNA, 22 bp, Artificial Sequence
  chemically synthesized
ctaaactttccattatctggat

SEQ ID NO: 1024236 - DNA, 22 bp, Artificial Sequence
  chemically synthesized
aactttccattatctggataat

SEQ ID NO: 1024237 - DNA, 22 bp, Artificial Sequence
  chemically synthesized
aaaaatgaggagaaattatcca

SEQ ID NO: 1024238 - DNA, 22 bp, Artificial Sequence
  chemically synthesized
taaaaaatgaggagaaattatc

SEQ ID NO: 1024239 - DNA, 22 bp, Artificial Sequence
  chemically synthesized
tccattatctggataatttctc

SEQ ID NO: 1024240 - DNA, 22 bp, Artificial Sequence
  chemically synthesized
ccattatctggataatttctcc

SEQ ID NO: 1024241 - DNA, 22 bp, Artificial Sequence
  chemically synthesized
cattatctggataatttctcct

SEQ ID NO: 1024242 - DNA, 22 bp, Artificial Sequence
  chemically synthesized
agttctaaaaaatgaggagaaa

SEQ ID NO: 1024243 - DNA, 22 bp, Artificial Sequence
  chemically synthesized
tctggataatttctcctcattt

SEQ ID NO: 1024244 - DNA, 22 bp, Artificial Sequence
  chemically synthesized
aattgagttctaaaaaatgagg

SEQ ID NO: 1024245 - DNA, 22 bp, Artificial Sequence
  chemically synthesized
gaattgagttctaaaaaatgag

SEQ ID NO: 1024246 - DNA, 22 bp, Artificial Sequence
  chemically synthesized
gataatttctcctcatttttta

SEQ ID NO: 1024247 - DNA, 22 bp, Artificial Sequence
  chemically synthesized
ctcctcattttttagaactcaa

SEQ ID NO: 1024248 - DNA, 22 bp, Artificial Sequence
  chemically synthesized
tcctcattttttagaactcaat

SEQ ID NO: 1024249 - DNA, 22 bp, Artificial Sequence
  chemically synthesized
ctcattttttagaactcaattc

SEQ ID NO: 1024250 - DNA, 22 bp, Artificial Sequence
  chemically synthesized
attttttagaactcaattcaag

SEQ ID NO: 1024251 - DNA, 22 bp, Artificial Sequence
  chemically synthesized
tttagaactcaattcaaggatc

SEQ ID NO: 1024252 - DNA, 22 bp, Artificial Sequence
  chemically synthesized
ttagaactcaattcaaggatca

SEQ ID NO: 1024253 - DNA, 22 bp, Artificial Sequence
  chemically synthesized
tagaactcaattcaaggatcat

SEQ ID NO: 1024254 - DNA, 22 bp, Artificial Sequence
  chemically synthesized
agaactcaattcaaggatcatc

SEQ ID NO: 1024255 - DNA, 22 bp, Artificial Sequence
  chemically synthesized
gaactcaattcaaggatcatct

SEQ ID NO: 1024256 - DNA, 22 bp, Artificial Sequence
  chemically synthesized
gaaggatccgggtgagatgatc

SEQ ID NO: 1024257 - DNA, 22 bp, Artificial Sequence
  chemically synthesized
aattcaaggatcatctcacccg

SEQ ID NO: 1024258 - DNA, 22 bp, Artificial Sequence
  chemically synthesized
agtctggaaggatccgggtgag

SEQ ID NO: 1024259 - DNA, 22 bp, Artificial Sequence
  chemically synthesized
aaggatcatctcacccggatcc

SEQ ID NO: 1024260 - DNA, 22 bp, Artificial Sequence
  chemically synthesized
ggggtctcagtctggaaggatc

SEQ ID NO: 1024261 - DNA, 22 bp, Artificial Sequence
  chemically synthesized
gggggtctcagtctggaaggat

SEQ ID NO: 1024262 - DNA, 22 bp, Artificial Sequence
  chemically synthesized
acccggatccttccagactgag

SEQ ID NO: 1024263 - DNA, 22 bp, Artificial Sequence
  chemically synthesized
acacagtttgggggtctcagtc

SEQ ID NO: 1024264 - DNA, 22 bp, Artificial Sequence
  chemically synthesized
tctaacacagtttgggggtctc

SEQ ID NO: 1024265 - DNA, 22 bp, Artificial Sequence
  chemically synthesized
ccagactgagacccccaaactg

SEQ ID NO: 1024266 - DNA, 22 bp, Artificial Sequence
  chemically synthesized
cagactgagacccccaaactgt

SEQ ID NO: 1024267 - DNA, 22 bp, Artificial Sequence
  chemically synthesized
agacccccaaactgtgttagac

SEQ ID NO: 1024268 - DNA, 22 bp, Artificial Sequence
  chemically synthesized
ggcatataccaaagcaggactg

SEQ ID NO: 1024269 - DNA, 22 bp, Artificial Sequence
  chemically synthesized
tgttagacagtcctgctttggt

SEQ ID NO: 1024270 - DNA, 22 bp, Artificial Sequence
  chemically synthesized
ggagctaggcatataccaaagc

SEQ ID NO: 1024271 - DNA, 22 bp, Artificial Sequence
  chemically synthesized
gggagctaggcatataccaaag

SEQ ID NO: 1024272 - DNA, 22 bp, Artificial Sequence
  chemically synthesized
gacagtcctgctttggtatatg

SEQ ID NO: 1024273 - DNA, 22 bp, Artificial Sequence
  chemically synthesized
ccttgggagctaggcatatacc

SEQ ID NO: 1024274 - DNA, 22 bp, Artificial Sequence
  chemically synthesized
atgtctgccttgggagctaggc

SEQ ID NO: 1024275 - DNA, 22 bp, Artificial Sequence
  chemically synthesized
ctttggtatatgcctagctccc

SEQ ID NO: 1024276 - DNA, 22 bp, Artificial Sequence
  chemically synthesized
tggtatatgcctagctcccaag

SEQ ID NO: 1024277 - DNA, 22 bp, Artificial Sequence
  chemically synthesized
ggtatatgcctagctcccaagg

SEQ ID NO: 1024278 - DNA, 22 bp, Artificial Sequence
  chemically synthesized
agttcatgtctgccttgggagc

SEQ ID NO: 1024279 - DNA, 22 bp, Artificial Sequence
  chemically synthesized
gtatatgcctagctcccaaggc

SEQ ID NO: 1024280 - DNA, 22 bp, Artificial Sequence
  chemically synthesized
gctcccaaggcagacatgaact

SEQ ID NO: 1024281 - DNA, 22 bp, Artificial Sequence
  chemically synthesized
ccaaggcagacatgaactgagg

SEQ ID NO: 1024282 - DNA, 22 bp, Artificial Sequence
  chemically synthesized
atgcacagtgacgagtcctcag

SEQ ID NO: 1024283 - DNA, 22 bp, Artificial Sequence
  chemically synthesized
aatgcacagtgacgagtcctca

SEQ ID NO: 1024284 - DNA, 22 bp, Artificial Sequence
  chemically synthesized
taatgcacagtgacgagtcctc

SEQ ID NO: 1024285 - DNA, 22 bp, Artificial Sequence
  chemically synthesized
acagttttaatgcacagtgacg

SEQ ID NO: 1024286 - DNA, 22 bp, Artificial Sequence
  chemically synthesized
aggactcgtcactgtgcattaa

SEQ ID NO: 1024287 - DNA, 22 bp, Artificial Sequence
  chemically synthesized
tgaactcacagttttaatgcac

SEQ ID NO: 1024288 - DNA, 22 bp, Artificial Sequence
  chemically synthesized
gtcactgtgcattaaaactgtg

SEQ ID NO: 1024289 - DNA, 22 bp, Artificial Sequence
  chemically synthesized
tgcattaaaactgtgagttcat

SEQ ID NO: 1024290 - DNA, 22 bp, Artificial Sequence
  chemically synthesized
tatatacagaaaggaattatga

SEQ ID NO: 1024291 - DNA, 22 bp, Artificial Sequence
  chemically synthesized
aaactgtgagttcataattcct

SEQ ID NO: 1024292 - DNA, 22 bp, Artificial Sequence
  chemically synthesized
atatatacagaaaggaattatg

SEQ ID NO: 1024293 - DNA, 22 bp, Artificial Sequence
  chemically synthesized
tatttatatatacagaaaggaa

SEQ ID NO: 1024294 - DNA, 22 bp, Artificial Sequence
  chemically synthesized
tgagttcataattcctttctgt

SEQ ID NO: 1024295 - DNA, 22 bp, Artificial Sequence
  chemically synthesized
tgtatttatatatacagaaagg

SEQ ID NO: 1024296 - DNA, 22 bp, Artificial Sequence
  chemically synthesized
ctgtatttatatatacagaaag

SEQ ID NO: 1024297 - DNA, 22 bp, Artificial Sequence
  chemically synthesized
atttctgtatttatatatacag

SEQ ID NO: 1024298 - DNA, 22 bp, Artificial Sequence
  chemically synthesized
ataattcctttctgtatatata

SEQ ID NO: 1024299 - DNA, 22 bp, Artificial Sequence
  chemically synthesized
ctttctgtatatataaatacag

SEQ ID NO: 1024300 - DNA, 22 bp, Artificial Sequence
  chemically synthesized
tctgtatatataaatacagaaa

SEQ ID NO: 1024301 - DNA, 22 bp, Artificial Sequence
  chemically synthesized
ctgtatatataaatacagaaat

SEQ ID NO: 1024302 - DNA, 22 bp, Artificial Sequence
  chemically synthesized
tgtatatataaatacagaaatc

SEQ ID NO: 1024303 - DNA, 22 bp, Artificial Sequence
  chemically synthesized
tatatataaatacagaaatcag

SEQ ID NO: 1024304 - DNA, 22 bp, Artificial Sequence
  chemically synthesized
aataacatataaaccctgattt

SEQ ID NO: 1024305 - DNA, 22 bp, Artificial Sequence
  chemically synthesized
gaaatataaaactgaataacat

SEQ ID NO: 1024306 - DNA, 22 bp, Artificial Sequence
  chemically synthesized
agggctagaaatataaaactga

SEQ ID NO: 1024307 - DNA, 22 bp, Artificial Sequence
  chemically synthesized
tgagggctagaaatataaaact

SEQ ID NO: 1024308 - DNA, 22 bp, Artificial Sequence
  chemically synthesized
atatgttattcagttttatatt

SEQ ID NO: 1024309 - DNA, 22 bp, Artificial Sequence
  chemically synthesized
tatgttattcagttttatattt

SEQ ID NO: 1024310 - DNA, 22 bp, Artificial Sequence
  chemically synthesized
tgattctgagggctagaaatat

SEQ ID NO: 1024311 - DNA, 22 bp, Artificial Sequence
  chemically synthesized
ttcagttttatatttctagccc

SEQ ID NO: 1024312 - DNA, 22 bp, Artificial Sequence
  chemically synthesized
ctatgattctgagggctagaaa

SEQ ID NO: 1024313 - DNA, 22 bp, Artificial Sequence
  chemically synthesized
agttttatatttctagccctca

SEQ ID NO: 1024314 - DNA, 22 bp, Artificial Sequence
  chemically synthesized
tatatttctagccctcagaatc

SEQ ID NO: 1024315 - DNA, 22 bp, Artificial Sequence
  chemically synthesized
atatttctagccctcagaatca

SEQ ID NO: 1024316 - DNA, 22 bp, Artificial Sequence
  chemically synthesized
tatttctagccctcagaatcat

SEQ ID NO: 1024317 - DNA, 22 bp, Artificial Sequence
  chemically synthesized
gtgtgaccctactatgattctg

SEQ ID NO: 1024318 - DNA, 22 bp, Artificial Sequence
  chemically synthesized
ctagccctcagaatcatagtag

SEQ ID NO: 1024319 - DNA, 22 bp, Artificial Sequence
  chemically synthesized
tagccctcagaatcatagtagg

SEQ ID NO: 1024320 - DNA, 22 bp, Artificial Sequence
  chemically synthesized
gccctcagaatcatagtagggt

SEQ ID NO: 1024321 - DNA, 22 bp, Artificial Sequence
  chemically synthesized
aacaaagattagtgtgacccta

SEQ ID NO: 1024322 - DNA, 22 bp, Artificial Sequence
  chemically synthesized
agaatcatagtagggtcacact

SEQ ID NO: 1024323 - DNA, 22 bp, Artificial Sequence
  chemically synthesized
attcaacaaagattagtgtgac

SEQ ID NO: 1024324 - DNA, 22 bp, Artificial Sequence
  chemically synthesized
ttcattcaacaaagattagtgt

SEQ ID NO: 1024325 - DNA, 22 bp, Artificial Sequence
  chemically synthesized
attattcattcaacaaagatta

SEQ ID NO: 1024326 - DNA, 22 bp, Artificial Sequence
  chemically synthesized
atagactcattattcattcaac

SEQ ID NO: 1024327 - DNA, 22 bp, Artificial Sequence
  chemically synthesized
atctttgttgaatgaataatga

SEQ ID NO: 1024328 - DNA, 22 bp, Artificial Sequence
  chemically synthesized
gtcattcatagactcattattc

SEQ ID NO: 1024329 - DNA, 22 bp, Artificial Sequence
  chemically synthesized
tgttgaatgaataatgagtcta

SEQ ID NO: 1024330 - DNA, 22 bp, Artificial Sequence
  chemically synthesized
gttgaatgaataatgagtctat

SEQ ID NO: 1024331 - DNA, 22 bp, Artificial Sequence
  chemically synthesized
ttgaatgaataatgagtctatg

SEQ ID NO: 1024332 - DNA, 22 bp, Artificial Sequence
  chemically synthesized
tcaaactggtcattcatagact

SEQ ID NO: 1024333 - DNA, 22 bp, Artificial Sequence
  chemically synthesized
aatgaataatgagtctatgaat

SEQ ID NO: 1024334 - DNA, 22 bp, Artificial Sequence
  chemically synthesized
tgtcaaactggtcattcataga

SEQ ID NO: 1024335 - DNA, 22 bp, Artificial Sequence
  chemically synthesized
aactctgtcaaactggtcattc

SEQ ID NO: 1024336 - DNA, 22 bp, Artificial Sequence
  chemically synthesized
aaactctgtcaaactggtcatt

SEQ ID NO: 1024337 - DNA, 22 bp, Artificial Sequence
  chemically synthesized
tgaatgaccagtttgacagagt

SEQ ID NO: 1024338 - DNA, 22 bp, Artificial Sequence
  chemically synthesized
acatccacacttaaactctgtc

SEQ ID NO: 1024339 - DNA, 22 bp, Artificial Sequence
  chemically synthesized
gacatccacacttaaactctgt

SEQ ID NO: 1024340 - DNA, 22 bp, Artificial Sequence
  chemically synthesized
tccttgacatccacacttaaac

SEQ ID NO: 1024341 - DNA, 22 bp, Artificial Sequence
  chemically synthesized
atccttgacatccacacttaaa

SEQ ID NO: 1024342 - DNA, 22 bp, Artificial Sequence
  chemically synthesized
atttatccttgacatccacact

SEQ ID NO: 1024343 - DNA, 22 bp, Artificial Sequence
  chemically synthesized
gacagagtttaagtgtggatgt

SEQ ID NO: 1024344 - DNA, 22 bp, Artificial Sequence
  chemically synthesized
catttatccttgacatccacac

SEQ ID NO: 1024345 - DNA, 22 bp, Artificial Sequence
  chemically synthesized
acagagtttaagtgtggatgtc

SEQ ID NO: 1024346 - DNA, 22 bp, Artificial Sequence
  chemically synthesized
ttcatttatccttgacatccac

SEQ ID NO: 1024347 - DNA, 22 bp, Artificial Sequence
  chemically synthesized
cttcatttatccttgacatcca

SEQ ID NO: 1024348 - DNA, 22 bp, Artificial Sequence
  chemically synthesized
atttcttcatttatccttgaca

SEQ ID NO: 1024349 - DNA, 22 bp, Artificial Sequence
  chemically synthesized
aagtgtggatgtcaaggataaa

SEQ ID NO: 1024350 - DNA, 22 bp, Artificial Sequence
  chemically synthesized
agtgtggatgtcaaggataaat

SEQ ID NO: 1024351 - DNA, 22 bp, Artificial Sequence
  chemically synthesized
gctaatttcttcatttatcctt

SEQ ID NO: 1024352 - DNA, 22 bp, Artificial Sequence
  chemically synthesized
ggctaatttcttcatttatcct

SEQ ID NO: 1024353 - DNA, 22 bp, Artificial Sequence
  chemically synthesized
gcagacttggctaatttcttca

SEQ ID NO: 1024354 - DNA, 22 bp, Artificial Sequence
  chemically synthesized
atattagcagacttggctaatt

SEQ ID NO: 1024355 - DNA, 22 bp, Artificial Sequence
  chemically synthesized
catattagcagacttggctaat

SEQ ID NO: 1024356 - DNA, 22 bp, Artificial Sequence
  chemically synthesized
aatatacatcttcatattagca

SEQ ID NO: 1024357 - DNA, 22 bp, Artificial Sequence
  chemically synthesized
aaatatacatcttcatattagc

SEQ ID NO: 1024358 - DNA, 22 bp, Artificial Sequence
  chemically synthesized
gccaagtctgctaatatgaaga

SEQ ID NO: 1024359 - DNA, 22 bp, Artificial Sequence
  chemically synthesized
atttaaatatacatcttcatat

SEQ ID NO: 1024360 - DNA, 22 bp, Artificial Sequence
  chemically synthesized
tcatttaaatatacatcttcat

SEQ ID NO: 1024361 - DNA, 22 bp, Artificial Sequence
  chemically synthesized
ctcatttaaatatacatcttca

SEQ ID NO: 1024362 - DNA, 22 bp, Artificial Sequence
  chemically synthesized
ctaatatgaagatgtatattta

SEQ ID NO: 1024363 - DNA, 22 bp, Artificial Sequence
  chemically synthesized
atatgaagatgtatatttaaat

SEQ ID NO: 1024364 - DNA, 22 bp, Artificial Sequence
  chemically synthesized
taaaatcttctcatttaaatat

SEQ ID NO: 1024365 - DNA, 22 bp, Artificial Sequence
  chemically synthesized
tgaaagtgtaagattataaaat

SEQ ID NO: 1024366 - DNA, 22 bp, Artificial Sequence
  chemically synthesized
aaatgagaagattttataatct

SEQ ID NO: 1024367 - DNA, 22 bp, Artificial Sequence
  chemically synthesized
aatgagaagattttataatctt

SEQ ID NO: 1024368 - DNA, 22 bp, Artificial Sequence
  chemically synthesized
tataatcttacactttcataat

SEQ ID NO: 1024369 - DNA, 22 bp, Artificial Sequence
  chemically synthesized
ataatcttacactttcataatt

SEQ ID NO: 1024370 - DNA, 22 bp, Artificial Sequence
  chemically synthesized
taatcttacactttcataatta

SEQ ID NO: 1024371 - DNA, 22 bp, Artificial Sequence
  chemically synthesized
aaatcaatgtggtcataattat

SEQ ID NO: 1024372 - DNA, 22 bp, Artificial Sequence
  chemically synthesized
caaatcaatgtggtcataatta

SEQ ID NO: 1024373 - DNA, 22 bp, Artificial Sequence
  chemically synthesized
acactttcataattatgaccac

SEQ ID NO: 1024374 - DNA, 22 bp, Artificial Sequence
  chemically synthesized
cactttcataattatgaccaca

SEQ ID NO: 1024375 - DNA, 22 bp, Artificial Sequence
  chemically synthesized
tcataattatgaccacattgat

SEQ ID NO: 1024376 - DNA, 22 bp, Artificial Sequence
  chemically synthesized
cataattatgaccacattgatt

SEQ ID NO: 1024377 - DNA, 22 bp, Artificial Sequence
  chemically synthesized
ataaaaccttcaaatcaatgtg

SEQ ID NO: 1024378 - DNA, 22 bp, Artificial Sequence
  chemically synthesized
ataattatgaccacattgattt

SEQ ID NO: 1024379 - DNA, 22 bp, Artificial Sequence
  chemically synthesized
cataaaaccttcaaatcaatgt

SEQ ID NO: 1024380 - DNA, 22 bp, Artificial Sequence
  chemically synthesized
ttcataaaaccttcaaatcaat

SEQ ID NO: 1024381 - DNA, 22 bp, Artificial Sequence
  chemically synthesized
tcttcataaaaccttcaaatca

SEQ ID NO: 1024382 - DNA, 22 bp, Artificial Sequence
  chemically synthesized
ctcttcataaaaccttcaaatc

SEQ ID NO: 1024383 - DNA, 22 bp, Artificial Sequence
  chemically synthesized
tctcttcataaaaccttcaaat

SEQ ID NO: 1024384 - DNA, 22 bp, Artificial Sequence
  chemically synthesized
tgaccacattgatttgaaggtt

SEQ ID NO: 1024385 - DNA, 22 bp, Artificial Sequence
  chemically synthesized
tttctcttcataaaaccttcaa

SEQ ID NO: 1024386 - DNA, 22 bp, Artificial Sequence
  chemically synthesized
atttgaaggttttatgaagaga

SEQ ID NO: 1024387 - DNA, 22 bp, Artificial Sequence
  chemically synthesized
gtataacctctttctcttcata

SEQ ID NO: 1024388 - DNA, 22 bp, Artificial Sequence
  chemically synthesized
gaaggttttatgaagagaaaga

SEQ ID NO: 1024389 - DNA, 22 bp, Artificial Sequence
  chemically synthesized
aaggttttatgaagagaaagag

SEQ ID NO: 1024390 - DNA, 22 bp, Artificial Sequence
  chemically synthesized
aaataattagtataacctcttt

SEQ ID NO: 1024391 - DNA, 22 bp, Artificial Sequence
  chemically synthesized
tatgaagagaaagaggttatac

SEQ ID NO: 1024392 - DNA, 22 bp, Artificial Sequence
  chemically synthesized
atgaagagaaagaggttatact

SEQ ID NO: 1024393 - DNA, 22 bp, Artificial Sequence
  chemically synthesized
tgaagagaaagaggttatacta

SEQ ID NO: 1024394 - DNA, 22 bp, Artificial Sequence
  chemically synthesized
tgaaaagaaacagctcaaataa

SEQ ID NO: 1024395 - DNA, 22 bp, Artificial Sequence
  chemically synthesized
atgaaaagaaacagctcaaata

SEQ ID NO: 1024396 - DNA, 22 bp, Artificial Sequence
  chemically synthesized
tactaattatttgagctgtttc

SEQ ID NO: 1024397 - DNA, 22 bp, Artificial Sequence
  chemically synthesized
attatttgagctgtttcttttc

SEQ ID NO: 1024398 - DNA, 22 bp, Artificial Sequence
  chemically synthesized
accacaatcacttatgaaaaga

SEQ ID NO: 1024399 - DNA, 22 bp, Artificial Sequence
  chemically synthesized
tttgagctgtttcttttcataa

SEQ ID NO: 1024400 - DNA, 22 bp, Artificial Sequence
  chemically synthesized
gagctgtttcttttcataagtg

SEQ ID NO: 1024401 - DNA, 22 bp, Artificial Sequence
  chemically synthesized
gctgaccacaatcacttatgaa

SEQ ID NO: 1024402 - DNA, 22 bp, Artificial Sequence
  chemically synthesized
agctgtttcttttcataagtga

SEQ ID NO: 1024403 - DNA, 22 bp, Artificial Sequence
  chemically synthesized
ggctgaccacaatcacttatga

SEQ ID NO: 1024404 - DNA, 22 bp, Artificial Sequence
  chemically synthesized
tggctgaccacaatcacttatg

SEQ ID NO: 1024405 - DNA, 22 bp, Artificial Sequence
  chemically synthesized
tttcttttcataagtgattgtg

SEQ ID NO: 1024406 - DNA, 22 bp, Artificial Sequence
  chemically synthesized
attttggctgaccacaatcact

SEQ ID NO: 1024407 - DNA, 22 bp, Artificial Sequence
  chemically synthesized
aattttggctgaccacaatcac

SEQ ID NO: 1024408 - DNA, 22 bp, Artificial Sequence
  chemically synthesized
cttttcataagtgattgtggtc

SEQ ID NO: 1024409 - DNA, 22 bp, Artificial Sequence
  chemically synthesized
ttttcataagtgattgtggtca

SEQ ID NO: 1024410 - DNA, 22 bp, Artificial Sequence
  chemically synthesized
tttaattttggctgaccacaat

SEQ ID NO: 1024411 - DNA, 22 bp, Artificial Sequence
  chemically synthesized
ttcataagtgattgtggtcagc

SEQ ID NO: 1024412 - DNA, 22 bp, Artificial Sequence
  chemically synthesized
tcataagtgattgtggtcagcc

SEQ ID NO: 1024413 - DNA, 22 bp, Artificial Sequence
  chemically synthesized
cataagtgattgtggtcagcca

SEQ ID NO: 1024414 - DNA, 22 bp, Artificial Sequence
  chemically synthesized
ataagtgattgtggtcagccaa

SEQ ID NO: 1024415 - DNA, 22 bp, Artificial Sequence
  chemically synthesized
gtagcatcattgtttaattttg

SEQ ID NO: 1024416 - DNA, 22 bp, Artificial Sequence
  chemically synthesized
cgtagcatcattgtttaatttt

SEQ ID NO: 1024417 - DNA, 22 bp, Artificial Sequence
  chemically synthesized
ttcgtagcatcattgtttaatt

SEQ ID NO: 1024418 - DNA, 22 bp, Artificial Sequence
  chemically synthesized
tggtcagccaaaattaaacaat

SEQ ID NO: 1024419 - DNA, 22 bp, Artificial Sequence
  chemically synthesized
cttcgtagcatcattgtttaat

SEQ ID NO: 1024420 - DNA, 22 bp, Artificial Sequence
  chemically synthesized
tcttcgtagcatcattgtttaa

SEQ ID NO: 1024421 - DNA, 22 bp, Artificial Sequence
  chemically synthesized
atctttcttcgtagcatcattg

SEQ ID NO: 1024422 - DNA, 22 bp, Artificial Sequence
  chemically synthesized
aatctttcttcgtagcatcatt

SEQ ID NO: 1024423 - DNA, 22 bp, Artificial Sequence
  chemically synthesized
cttaatctttcttcgtagcatc

SEQ ID NO: 1024424 - DNA, 22 bp, Artificial Sequence
  chemically synthesized
ccttaatctttcttcgtagcat

SEQ ID NO: 1024425 - DNA, 22 bp, Artificial Sequence
  chemically synthesized
aacaatgatgctacgaagaaag

SEQ ID NO: 1024426 - DNA, 22 bp, Artificial Sequence
  chemically synthesized
ataatatccttccttaatcttt

SEQ ID NO: 1024427 - DNA, 22 bp, Artificial Sequence
  chemically synthesized
gataatatccttccttaatctt

SEQ ID NO: 1024428 - DNA, 22 bp, Artificial Sequence
  chemically synthesized
tttgataatatccttccttaat

SEQ ID NO: 1024429 - DNA, 22 bp, Artificial Sequence
  chemically synthesized
cgaagaaagattaaggaaggat

SEQ ID NO: 1024430 - DNA, 22 bp, Artificial Sequence
  chemically synthesized
gggctgtttgataatatccttc

SEQ ID NO: 1024431 - DNA, 22 bp, Artificial Sequence
  chemically synthesized
ggggctgtttgataatatcctt

SEQ ID NO: 1024432 - DNA, 22 bp, Artificial Sequence
  chemically synthesized
gcaggtttggggctgtttgata

SEQ ID NO: 1024433 - DNA, 22 bp, Artificial Sequence
  chemically synthesized
aggaaggatattatcaaacagc

SEQ ID NO: 1024434 - DNA, 22 bp, Artificial Sequence
  chemically synthesized
tcaaacagccccaaacctgcca

SEQ ID NO: 1024435 - DNA, 22 bp, Artificial Sequence
  chemically synthesized
cagtgaaaccatgaaggactgg

SEQ ID NO: 1024436 - DNA, 22 bp, Artificial Sequence
  chemically synthesized
acagtgaaaccatgaaggactg

SEQ ID NO: 1024437 - DNA, 22 bp, Artificial Sequence
  chemically synthesized
agcatttacagtgaaaccatga

SEQ ID NO: 1024438 - DNA, 22 bp, Artificial Sequence
  chemically synthesized
ccagtccttcatggtttcactg

SEQ ID NO: 1024439 - DNA, 22 bp, Artificial Sequence
  chemically synthesized
tacctgagcatttacagtgaaa

SEQ ID NO: 1024440 - DNA, 22 bp, Artificial Sequence
  chemically synthesized
gctgtacctgagcatttacagt

SEQ ID NO: 1024441 - DNA, 22 bp, Artificial Sequence
  chemically synthesized
catggtttcactgtaaatgctc

SEQ ID NO: 1024442 - DNA, 22 bp, Artificial Sequence
  chemically synthesized
atggtttcactgtaaatgctca

SEQ ID NO: 1024443 - DNA, 22 bp, Artificial Sequence
  chemically synthesized
cactgtaaatgctcaggtacag

SEQ ID NO: 1024444 - DNA, 22 bp, Artificial Sequence
  chemically synthesized
actgtaaatgctcaggtacagc

SEQ ID NO: 1024445 - DNA, 22 bp, Artificial Sequence
  chemically synthesized
atatataagtattggctgtacc

SEQ ID NO: 1024446 - DNA, 22 bp, Artificial Sequence
  chemically synthesized
taaatgctcaggtacagccaat

SEQ ID NO: 1024447 - DNA, 22 bp, Artificial Sequence
  chemically synthesized
aaattcatatataagtattggc

SEQ ID NO: 1024448 - DNA, 22 bp, Artificial Sequence
  chemically synthesized
ttaaaattcatatataagtatt

SEQ ID NO: 1024449 - DNA, 22 bp, Artificial Sequence
  chemically synthesized
aggtacagccaatacttatata

SEQ ID NO: 1024450 - DNA, 22 bp, Artificial Sequence
  chemically synthesized
attattaaaattcatatataag

SEQ ID NO: 1024451 - DNA, 22 bp, Artificial Sequence
  chemically synthesized
aatattgattattaaaattcat

SEQ ID NO: 1024452 - DNA, 22 bp, Artificial Sequence
  chemically synthesized
attaaatattgattattaaaat

SEQ ID NO: 1024453 - DNA, 22 bp, Artificial Sequence
  chemically synthesized
cattaaatattgattattaaaa

SEQ ID NO: 1024454 - DNA, 22 bp, Artificial Sequence
  chemically synthesized
tcattaaatattgattattaaa

SEQ ID NO: 1024455 - DNA, 22 bp, Artificial Sequence
  chemically synthesized
atatatgaattttaataatcaa

SEQ ID NO: 1024456 - DNA, 22 bp, Artificial Sequence
  chemically synthesized
tatatgaattttaataatcaat

SEQ ID NO: 1024457 - DNA, 22 bp, Artificial Sequence
  chemically synthesized
agaacggcattttcattaaata

SEQ ID NO: 1024458 - DNA, 22 bp, Artificial Sequence
  chemically synthesized
aagaacggcattttcattaaat

SEQ ID NO: 1024459 - DNA, 22 bp, Artificial Sequence
  chemically synthesized
taataatcaatatttaatgaaa

SEQ ID NO: 1024460 - DNA, 22 bp, Artificial Sequence
  chemically synthesized
aataatcaatatttaatgaaaa

SEQ ID NO: 1024461 - DNA, 22 bp, Artificial Sequence
  chemically synthesized
ataatcaatatttaatgaaaat

SEQ ID NO: 1024462 - DNA, 22 bp, Artificial Sequence
  chemically synthesized
aatgaaaatgccgttcttaaat

SEQ ID NO: 1024463 - DNA, 22 bp, Artificial Sequence
  chemically synthesized
atgaaaatgccgttcttaaatt

SEQ ID NO: 1024464 - DNA, 22 bp, Artificial Sequence
  chemically synthesized
ccacaaatatgagataaattta

SEQ ID NO: 1024465 - DNA, 22 bp, Artificial Sequence
  chemically synthesized
taccacaaatatgagataaatt

SEQ ID NO: 1024466 - DNA, 22 bp, Artificial Sequence
  chemically synthesized
ctctaccacaaatatgagataa

SEQ ID NO: 1024467 - DNA, 22 bp, Artificial Sequence
  chemically synthesized
ttaaatttatctcatatttgtg

SEQ ID NO: 1024468 - DNA, 22 bp, Artificial Sequence
  chemically synthesized
aaatttatctcatatttgtggt

SEQ ID NO: 1024469 - DNA, 22 bp, Artificial Sequence
  chemically synthesized
taaatctcctctaccacaaata

SEQ ID NO: 1024470 - DNA, 22 bp, Artificial Sequence
  chemically synthesized
aatttatctcatatttgtggta

SEQ ID NO: 1024471 - DNA, 22 bp, Artificial Sequence
  chemically synthesized
gtaaatctcctctaccacaaat

SEQ ID NO: 1024472 - DNA, 22 bp, Artificial Sequence
  chemically synthesized
tgtaaatctcctctaccacaaa

SEQ ID NO: 1024473 - DNA, 22 bp, Artificial Sequence
  chemically synthesized
ttgtaaatctcctctaccacaa

SEQ ID NO: 1024474 - DNA, 22 bp, Artificial Sequence
  chemically synthesized
tttgtaaatctcctctaccaca

SEQ ID NO: 1024475 - DNA, 22 bp, Artificial Sequence
  chemically synthesized
ttttgtaaatctcctctaccac

SEQ ID NO: 1024476 - DNA, 22 bp, Artificial Sequence
  chemically synthesized
atctcatatttgtggtagagga

SEQ ID NO: 1024477 - DNA, 22 bp, Artificial Sequence
  chemically synthesized
tctcatatttgtggtagaggag

SEQ ID NO: 1024478 - DNA, 22 bp, Artificial Sequence
  chemically synthesized
atatttgtggtagaggagattt

SEQ ID NO: 1024479 - DNA, 22 bp, Artificial Sequence
  chemically synthesized
acaatgccttttttgtaaatct

SEQ ID NO: 1024480 - DNA, 22 bp, Artificial Sequence
  chemically synthesized
gtggtagaggagatttacaaaa

SEQ ID NO: 1024481 - DNA, 22 bp, Artificial Sequence
  chemically synthesized
tggtagaggagatttacaaaaa

SEQ ID NO: 1024482 - DNA, 22 bp, Artificial Sequence
  chemically synthesized
atgttaacaatgccttttttgt

SEQ ID NO: 1024483 - DNA, 22 bp, Artificial Sequence
  chemically synthesized
actaatgttaacaatgcctttt

SEQ ID NO: 1024484 - DNA, 22 bp, Artificial Sequence
  chemically synthesized
aactaatgttaacaatgccttt

SEQ ID NO: 1024485 - DNA, 22 bp, Artificial Sequence
  chemically synthesized
taactaatgttaacaatgcctt

SEQ ID NO: 1024486 - DNA, 22 bp, Artificial Sequence
  chemically synthesized
acaaaaaaggcattgttaacat

SEQ ID NO: 1024487 - DNA, 22 bp, Artificial Sequence
  chemically synthesized
caaaaaaggcattgttaacatt

SEQ ID NO: 1024488 - DNA, 22 bp, Artificial Sequence
  chemically synthesized
tataagtgttttaactaatgtt

SEQ ID NO: 1024489 - DNA, 22 bp, Artificial Sequence
  chemically synthesized
ttaacattagttaaaacactta

SEQ ID NO: 1024490 - DNA, 22 bp, Artificial Sequence
  chemically synthesized
acaacagttgtataagtgtttt

SEQ ID NO: 1024491 - DNA, 22 bp, Artificial Sequence
  chemically synthesized
aacaacagttgtataagtgttt

SEQ ID NO: 1024492 - DNA, 22 bp, Artificial Sequence
  chemically synthesized
acattagttaaaacacttatac

SEQ ID NO: 1024493 - DNA, 22 bp, Artificial Sequence
  chemically synthesized
tttaacaacagttgtataagtg

SEQ ID NO: 1024494 - DNA, 22 bp, Artificial Sequence
  chemically synthesized
atttaacaacagttgtataagt

SEQ ID NO: 1024495 - DNA, 22 bp, Artificial Sequence
  chemically synthesized
tatttaacaacagttgtataag

SEQ ID NO: 1024496 - DNA, 22 bp, Artificial Sequence
  chemically synthesized
gttaaaacacttatacaactgt

SEQ ID NO: 1024497 - DNA, 22 bp, Artificial Sequence
  chemically synthesized
aaacacttatacaactgttgtt

SEQ ID NO: 1024498 - DNA, 22 bp, Artificial Sequence
  chemically synthesized
agaagttttatttaacaacagt

SEQ ID NO: 1024499 - DNA, 22 bp, Artificial Sequence
  chemically synthesized
cagaagttttatttaacaacag

SEQ ID NO: 1024500 - DNA, 22 bp, Artificial Sequence
  chemically synthesized
atacaactgttgttaaataaaa

SEQ ID NO: 1024501 - DNA, 22 bp, Artificial Sequence
  chemically synthesized
tacaactgttgttaaataaaac

SEQ ID NO: 1024502 - DNA, 22 bp, Artificial Sequence
  chemically synthesized
tatgacttcagaagttttattt

SEQ ID NO: 1024503 - DNA, 22 bp, Artificial Sequence
  chemically synthesized
ttgttaaataaaacttctgaag

SEQ ID NO: 1024504 - DNA, 22 bp, Artificial Sequence
  chemically synthesized
ttaaataaaacttctgaagtca

SEQ ID NO: 1024505 - DNA, 22 bp, Artificial Sequence
  chemically synthesized
aataaaacttctgaagtcatat
